United States Patent 11,640,849 (METHODS FOR HISTOLOGICAL DIAGNOSIS AND TREATMENT OF DISEASES) - sequence listing, part 84

SEQ ID NO: 3201834 - protein, 20 aa, Giardia lamblia
ELYKKYGLLAKLREQHKEAE

SEQ ID NO: 3201835 - protein, 28 aa, Giardia lamblia
EMKMFSKLLFILLRRYHTFFGTERFEGT

SEQ ID NO: 3201836 - protein, 18 aa, Giardia lamblia
EMYIVFSLVWAFGGSLDS

SEQ ID NO: 3201837 - protein, 22 aa, Giardia lamblia
ENAKLKAALLELGRRYKALQAT

SEQ ID NO: 3201838 - protein, 17 aa, Giardia lamblia
ENKPPVLAALFSGSADI

SEQ ID NO: 3201839 - protein, 23 aa, Giardia lamblia
ENQPRWVPWMQTIPEFSIDSLGT

SEQ ID NO: 3201840 - protein, 24 aa, Giardia lamblia
ENTEWMRMFKMFLSINEKAERTAQ

SEQ ID NO: 3201841 - protein, 23 aa, Giardia lamblia
ENTEYLLDLYSFAFPWAWDTQTA

SEQ ID NO: 3201842 - protein, 17 aa, Giardia lamblia
ENTSMLTKLRFPDLFTL

SEQ ID NO: 3201843 - protein, 17 aa, Giardia lamblia
EPAPLWVPDGIRTLPLT

SEQ ID NO: 3201844 - protein, 18 aa, Giardia lamblia
EPCRLCQLIYIGVRTRFQ

SEQ ID NO: 3201845 - protein, 27 aa, Giardia lamblia
EPFELIPRLFPLASAIYLRSAICAICH

SEQ ID NO: 3201846 - protein, 25 aa, Giardia lamblia
EPFRTGVPHRLPLPPLLSAPTPSGP

SEQ ID NO: 3201847 - protein, 20 aa, Giardia lamblia
EPKDLWQNFFFMCGIPHGSG

SEQ ID NO: 3201848 - protein, 30 aa, Giardia lamblia
EPLDYLAMMRLWKGLYYLLWKEDKVDMQFT

SEQ ID NO: 3201849 - protein, 24 aa, Giardia lamblia
EPLEQVIKRWLLFGEASPFSDHAK

SEQ ID NO: 3201850 - protein, 19 aa, Giardia lamblia
EPLLPLQQAWLVIPGQRKS

SEQ ID NO: 3201851 - protein, 17 aa, Giardia lamblia
EPLPPEFVLLDLKVYHP

SEQ ID NO: 3201852 - protein, 18 aa, Giardia lamblia
EPLRTLKLKWVPRGLPVP

SEQ ID NO: 3201853 - protein, 18 aa, Giardia lamblia
EPQYFRGLSIPYGSRTTA

SEQ ID NO: 3201854 - protein, 20 aa, Giardia lamblia
EPVFSFKGLLLFVASDMSRI

SEQ ID NO: 3201855 - protein, 19 aa, Giardia lamblia
EPVIAIHYLLPDGSTQPGD

SEQ ID NO: 3201856 - protein, 24 aa, Giardia lamblia
EQAVKFILQMRVTTLKDLETALFL

SEQ ID NO: 3201857 - protein, 19 aa, Giardia lamblia
EQCVRMLLPLEWHIMHSNG

SEQ ID NO: 3201858 - protein, 22 aa, Giardia lamblia
EQELRRLILEKSRLLRSVSSLY

SEQ ID NO: 3201859 - protein, 22 aa, Giardia lamblia
EQILLWQRKLAMQTALLENVQK

SEQ ID NO: 3201860 - protein, 17 aa, Giardia lamblia
EQIWAILYSVCAGLSYC

SEQ ID NO: 3201861 - protein, 25 aa, Giardia lamblia
EQKEQQQFLLIKEKLKDFQGALKIE

SEQ ID NO: 3201862 - protein, 18 aa, Giardia lamblia
EQLLSFQWLNPPPTKKLL

SEQ ID NO: 3201863 - protein, 21 aa, Giardia lamblia
EQNVLAYPLQLAITPWVCTAI

SEQ ID NO: 3201864 - protein, 17 aa, Giardia lamblia
EQRLFELVDAANRIFEL

SEQ ID NO: 3201865 - protein, 25 aa, Giardia lamblia
EQRNLYLIGLLIYELCLLTPYNYYS

SEQ ID NO: 3201866 - protein, 25 aa, Giardia lamblia
EQSIILDRIAILRMLDVMIKKFDMV

SEQ ID NO: 3201867 - protein, 18 aa, Giardia lamblia
ERDRRIQCLIAALQNQEQ

SEQ ID NO: 3201868 - protein, 24 aa, Giardia lamblia
ERFPIRWFDIVVLLRLGTEELYDR

SEQ ID NO: 3201869 - protein, 19 aa, Giardia lamblia
ERIWAIISQILQSLAYLHA

SEQ ID NO: 3201870 - protein, 24 aa, Giardia lamblia
ERKPSLLYRLRLWDEVLLSDNDGL

SEQ ID NO: 3201871 - protein, 19 aa, Giardia lamblia
ERLGLLPRSIVELFNLIEA

SEQ ID NO: 3201872 - protein, 19 aa, Giardia lamblia
ERLPSKFTALILACYHGRL

SEQ ID NO: 3201873 - protein, 21 aa, Giardia lamblia
ERLQMILTFYKKMIPTQQELF

SEQ ID NO: 3201874 - protein, 25 aa, Giardia lamblia
ERNVKALFVFISPPSVELLEQRLRG

SEQ ID NO: 3201875 - protein, 25 aa, Giardia lamblia
ERRERRLLKVLPTVYYRITGQQNGN

SEQ ID NO: 3201876 - protein, 22 aa, Giardia lamblia
ESFALLYVLFLARYSFIDTNRK

SEQ ID NO: 3201877 - protein, 24 aa, Giardia lamblia
ESGYLLTKLIYFAPWPAIEDILVF

SEQ ID NO: 3201878 - protein, 25 aa, Giardia lamblia
ESKMHTAPLKPWKPAHDPYLHTSYA

SEQ ID NO: 3201879 - protein, 17 aa, Giardia lamblia
ESLIKMFAALRPIYSMV

SEQ ID NO: 3201880 - protein, 25 aa, Giardia lamblia
ESNAALLYALFPYPKDSVPTNKSLG

SEQ ID NO: 3201881 - protein, 26 aa, Giardia lamblia
ESQLMRSAILLAVDRIAPFIMIDKTD

SEQ ID NO: 3201882 - protein, 23 aa, Giardia lamblia
ESRDRLIEIIARLTLELAGARNI

SEQ ID NO: 3201883 - protein, 25 aa, Giardia lamblia
ESSFPRGLFLRRLRTLLIGRINLPL

SEQ ID NO: 3201884 - protein, 17 aa, Giardia lamblia
ESTARWMNLLWGVTVNV

SEQ ID NO: 3201885 - protein, 23 aa, Giardia lamblia
ESTIWIFAYQLLNALEYCHSPFK

SEQ ID NO: 3201886 - protein, 19 aa, Giardia lamblia
ESTLLILWKIDRPKDPAAG

SEQ ID NO: 3201887 - protein, 23 aa, Giardia lamblia
ESVSLCLRLPLEVGLEGFLGAQG

SEQ ID NO: 3201888 - protein, 25 aa, Giardia lamblia
ESWSEPFAPKFYRFLTLAYALSDYE

SEQ ID NO: 3201889 - protein, 24 aa, Giardia lamblia
ETFRKEFQLLDFGNTGLLSEARFK

SEQ ID NO: 3201890 - protein, 24 aa, Giardia lamblia
ETGLLYPMFLLHTLTPKTEDAAAL

SEQ ID NO: 3201891 - protein, 23 aa, Giardia lamblia
ETNIPFLLGYYYVGKILNDYVHE

SEQ ID NO: 3201892 - protein, 18 aa, Giardia lamblia
ETSMLFLRYFLPTPPHCS

SEQ ID NO: 3201893 - protein, 18 aa, Giardia lamblia
ETTALVFAILKFMPEMTL

SEQ ID NO: 3201894 - protein, 21 aa, Giardia lamblia
ETYYFFRYKFFSELTSEGAPV

SEQ ID NO: 3201895 - protein, 17 aa, Giardia lamblia
EVDKLLDLPLESDFKYF

SEQ ID NO: 3201896 - protein, 18 aa, Giardia lamblia
EVKEFYTILVRWGSLQFK

SEQ ID NO: 3201897 - protein, 23 aa, Giardia lamblia
EVLAPLEYSIFLPNGRTALSLAA

SEQ ID NO: 3201898 - protein, 21 aa, Giardia lamblia
EVLRQFMLSWELPPVVYETQH

SEQ ID NO: 3201899 - protein, 23 aa, Giardia lamblia
EVMLKFFELLPSYLALDGHCVTV

SEQ ID NO: 3201900 - protein, 17 aa, Giardia lamblia
EVQELWRTTRPELYRLV

SEQ ID NO: 3201901 - protein, 21 aa, Giardia lamblia
EVSFLIYITILTHGGLPDAHP

SEQ ID NO: 3201902 - protein, 21 aa, Giardia lamblia
EVVLFIWTTFGYFLGRFACHQ

SEQ ID NO: 3201903 - protein, 22 aa, Giardia lamblia
EWALAILHRILSLKFPISLKDA

SEQ ID NO: 3201904 - protein, 25 aa, Giardia lamblia
EYALQMAVFLPNTHNLLINGLEMVC

SEQ ID NO: 3201905 - protein, 29 aa, Giardia lamblia
EYIAKSLNILLFWKLLPPILEGSPYNYPT

SEQ ID NO: 3201906 - protein, 18 aa, Giardia lamblia
EYITPLEQIFLQIAIYGD

SEQ ID NO: 3201907 - protein, 18 aa, Giardia lamblia
EYKEHYFDKPFLFKKFRK

SEQ ID NO: 3201908 - protein, 24 aa, Giardia lamblia
EYQRWFQTSLPFWPIVRSPVGSME

SEQ ID NO: 3201909 - protein, 20 aa, Giardia lamblia
EYVHLILQAYLTFRYHHVFD

SEQ ID NO: 3201910 - protein, 19 aa, Giardia lamblia
FAILHKTLLLLNFLKREMS

SEQ ID NO: 3201911 - protein, 17 aa, Giardia lamblia
FAIPLLISREGKMTTTT

SEQ ID NO: 3201912 - protein, 23 aa, Giardia lamblia
FAQMKLIFCYLFCMIKLSGDSTK

SEQ ID NO: 3201913 - protein, 17 aa, Giardia lamblia
FARITIPYAAKLFFQEI

SEQ ID NO: 3201914 - protein, 23 aa, Giardia lamblia
FCDGHRIFLYAALAAFPVVVPPR

SEQ ID NO: 3201915 - protein, 20 aa, Giardia lamblia
FCLHRYKTLPFLLLDEVDKN

SEQ ID NO: 3201916 - protein, 24 aa, Giardia lamblia
FDFDKAIDLLISPNYHPWISNPIN

SEQ ID NO: 3201917 - protein, 17 aa, Giardia lamblia
FDKDAVLLLLNKLYNLL

SEQ ID NO: 3201918 - protein, 25 aa, Giardia lamblia
FDLNDPIRRLYLLYLSQQADITEVE

SEQ ID NO: 3201919 - protein, 17 aa, Giardia lamblia
FDPLLTRIFFTIAKCYK

SEQ ID NO: 3201920 - protein, 19 aa, Giardia lamblia
FDYIYLPLLKAPSYTKNWP

SEQ ID NO: 3201921 - protein, 24 aa, Giardia lamblia
FEFFCRYCVLLFSLSFSTANPFPN

SEQ ID NO: 3201922 - protein, 23 aa, Giardia lamblia
FENRYLPFLQLPDTRLKQIAASL

SEQ ID NO: 3201923 - protein, 17 aa, Giardia lamblia
FEPLLYLVRTERGIEAS

SEQ ID NO: 3201924 - protein, 18 aa, Giardia lamblia
FFELARPSTGLSALDYAA

SEQ ID NO: 3201925 - protein, 20 aa, Giardia lamblia
FFGGLQLILCGDFLQLPPVV

SEQ ID NO: 3201926 - protein, 17 aa, Giardia lamblia
FFPTFNFVNAIISRRSI

SEQ ID NO: 3201927 - protein, 17 aa, Giardia lamblia
FFSLSRFIMRRPNRKSL

SEQ ID NO: 3201928 - protein, 21 aa, Giardia lamblia
FFTLSLFRRSLASMRWRLHQA

SEQ ID NO: 3201929 - protein, 25 aa, Giardia lamblia
FGAFYQYLFLTLPPTCCKTYIGESE

SEQ ID NO: 3201930 - protein, 25 aa, Giardia lamblia
FGFNIYPLIMPICRRLFEITTRLNC

SEQ ID NO: 3201931 - protein, 22 aa, Giardia lamblia
FGSPLLVDLFGYRLIMGSTVEQ

SEQ ID NO: 3201932 - protein, 17 aa, Giardia lamblia
FGTRLFKFLATNGEYVT

SEQ ID NO: 3201933 - protein, 17 aa, Giardia lamblia
FGVLLLELCTFKQPNWK

SEQ ID NO: 3201934 - protein, 25 aa, Giardia lamblia
FGWNALMFAAYFDNHDAVKLFLNDE

SEQ ID NO: 3201935 - protein, 25 aa, Giardia lamblia
FHELLLPFSVFPLSGTIYPSSKCTF

SEQ ID NO: 3201936 - protein, 18 aa, Giardia lamblia
FHHNILITSIPLCTVYLD

SEQ ID NO: 3201937 - protein, 23 aa, Giardia lamblia
FHLLSEWVHLSPLLVLKTDMLLR

SEQ ID NO: 3201938 - protein, 18 aa, Giardia lamblia
FIALLEYLPRFLLVNDTL

SEQ ID NO: 3201939 - protein, 18 aa, Giardia lamblia
FIFPPPPKTAFLITDYGT

SEQ ID NO: 3201940 - protein, 18 aa, Giardia lamblia
FILDMDLLDKLGDALSIF

SEQ ID NO: 3201941 - protein, 18 aa, Giardia lamblia
FILLYKKLYESAVESLLS

SEQ ID NO: 3201942 - protein, 23 aa, Giardia lamblia
FIRKQGYFALLIDVFCRTIIDDL

SEQ ID NO: 3201943 - protein, 20 aa, Giardia lamblia
FIYNLQQQVYFLELQSKLLR

SEQ ID NO: 3201944 - protein, 17 aa, Giardia lamblia
FKHFYQLKTLQTWIAFR

SEQ ID NO: 3201945 - protein, 20 aa, Giardia lamblia
FKPNHLYYKLSKTTFDPFDS

SEQ ID NO: 3201946 - protein, 26 aa, Giardia lamblia
FKRQQAFLPLFGYLPDQYIRYITNLY

SEQ ID NO: 3201947 - protein, 18 aa, Giardia lamblia
FLAQAIQALTYLHSPFNK

SEQ ID NO: 3201948 - protein, 20 aa, Giardia lamblia
FLHKQGIVLPILRAGFVQPE

SEQ ID NO: 3201949 - protein, 17 aa, Giardia lamblia
FLHLLRQSMIPRPGAEH

SEQ ID NO: 3201950 - protein, 23 aa, Giardia lamblia
FLKDILRRLLVLNPTNRLSAIDL

SEQ ID NO: 3201951 - protein, 23 aa, Giardia lamblia
FLKRFRIHYCTLYDQGYTSLGSA

SEQ ID NO: 3201952 - protein, 24 aa, Giardia lamblia
FLKTQNFYLYFRYLEKRSNDKICV

SEQ ID NO: 3201953 - protein, 18 aa, Giardia lamblia
FLLPIPQYPLYSAAIALN

SEQ ID NO: 3201954 - protein, 17 aa, Giardia lamblia
FLMGFLLSAPVPLQRTV

SEQ ID NO: 3201955 - protein, 28 aa, Giardia lamblia
FLNHPSVPYQWLMYWLPAAGSGQPVMGV

SEQ ID NO: 3201956 - protein, 21 aa, Giardia lamblia
FLNSLPPVELLVIGSLRNLTS

SEQ ID NO: 3201957 - protein, 19 aa, Giardia lamblia
FLPGLLRVPVKDRIWVTTT

SEQ ID NO: 3201958 - protein, 26 aa, Giardia lamblia
FLRTSRVLAWVALPSEFLFTKASAIA

SEQ ID NO: 3201959 - protein, 17 aa, Giardia lamblia
FLSVVEPLLRVSPPLAT

SEQ ID NO: 3201960 - protein, 20 aa, Giardia lamblia
FLVDSLFLRCFNTAQLLFHC

SEQ ID NO: 3201961 - protein, 17 aa, Giardia lamblia
FLVYPYCSLAANSPVPY

SEQ ID NO: 3201962 - protein, 19 aa, Giardia lamblia
FMISGFCRYYRQLRLIRQH

SEQ ID NO: 3201963 - protein, 28 aa, Giardia lamblia
FMITSIGDIFLKRGLLSLLLTPAQAKFY

SEQ ID NO: 3201964 - protein, 18 aa, Giardia lamblia
FNFLPPYLFVVINRFLWE

SEQ ID NO: 3201965 - protein, 25 aa, Giardia lamblia
FNNYAIMWCNFITKYVAICKHLDFL

SEQ ID NO: 3201966 - protein, 24 aa, Giardia lamblia
FNSRLINHKLPFIRLFNIGKTYNG

SEQ ID NO: 3201967 - protein, 18 aa, Giardia lamblia
FNSVRPFLPPVIPPKVQA

SEQ ID NO: 3201968 - protein, 18 aa, Giardia lamblia
FPIALSPALLFLLLHCTV

SEQ ID NO: 3201969 - protein, 18 aa, Giardia lamblia
FPLIMMMSATLFASYECT

SEQ ID NO: 3201970 - protein, 17 aa, Giardia lamblia
FPPFKPLRAVLELEYTR

SEQ ID NO: 3201971 - protein, 22 aa, Giardia lamblia
FPSLGYYYWFLGNVADTTILPK

SEQ ID NO: 3201972 - protein, 18 aa, Giardia lamblia
FPTFLLVEDPQLLLIHEC

SEQ ID NO: 3201973 - protein, 25 aa, Giardia lamblia
FQEGFRCGFIWGVRFYDPDPSCAVA

SEQ ID NO: 3201974 - protein, 20 aa, Giardia lamblia
FQEHPILRFYLRVLTFYEGR

SEQ ID NO: 3201975 - protein, 21 aa, Giardia lamblia
FQRFYRLRLPFERASDRSLAE

SEQ ID NO: 3201976 - protein, 21 aa, Giardia lamblia
FQVVLLIIRYVIELVKKLEFS

SEQ ID NO: 3201977 - protein, 17 aa, Giardia lamblia
FQWLNRVLVHVTPLWSV

SEQ ID NO: 3201978 - protein, 20 aa, Giardia lamblia
FRERHRLGFLFLERVRTVLN

SEQ ID NO: 3201979 - protein, 18 aa, Giardia lamblia
FRFELPYGLLFVDDVLLV

SEQ ID NO: 3201980 - protein, 31 aa, Giardia lamblia
FRFQSCSLLFWHAFIFLLRVIRWASSQGPRH

SEQ ID NO: 3201981 - protein, 20 aa, Giardia lamblia
FRNIWVHYYVDKHAAIFVVD

SEQ ID NO: 3201982 - protein, 29 aa, Giardia lamblia
FRSDPLLTVYYYLLLICLRDFCLVGIRVG

SEQ ID NO: 3201983 - protein, 18 aa, Giardia lamblia
FSGIFRPDDIRQAIRTAG

SEQ ID NO: 3201984 - protein, 19 aa, Giardia lamblia
FSIAQYYHRQELLSLLGAG

SEQ ID NO: 3201985 - protein, 20 aa, Giardia lamblia
FSILPCIRLLTILSTRDRVS

SEQ ID NO: 3201986 - protein, 22 aa, Giardia lamblia
FSKRILNALWYLHDLYIIHRDI

SEQ ID NO: 3201987 - protein, 17 aa, Giardia lamblia
FSLLTRKQQCIGSYGKD

SEQ ID NO: 3201988 - protein, 23 aa, Giardia lamblia
FSSTKLGALLKLVPQLLQEDGRA

SEQ ID NO: 3201989 - protein, 18 aa, Giardia lamblia
FSVNFWFVKFKQLVDTGK

SEQ ID NO: 3201990 - protein, 20 aa, Giardia lamblia
FTCPTSIFYEPFRAETLKEP

SEQ ID NO: 3201991 - protein, 24 aa, Giardia lamblia
FTEDALIFRLLGSLLKRLDDIYAG

SEQ ID NO: 3201992 - protein, 18 aa, Giardia lamblia
FTLLMTQIGFPRPISIDT

SEQ ID NO: 3201993 - protein, 18 aa, Giardia lamblia
FTMLLSRLDPDTAALFCP

SEQ ID NO: 3201994 - protein, 17 aa, Giardia lamblia
FTPFLSSILIEFSKVSP

SEQ ID NO: 3201995 - protein, 23 aa, Giardia lamblia
FTTYPPFFQFKQVPALLYHIATI

SEQ ID NO: 3201996 - protein, 27 aa, Giardia lamblia
FTYKNRGLLPRILEFMFQQINARHGFT

SEQ ID NO: 3201997 - protein, 25 aa, Giardia lamblia
FVDSTLIIRLLPPGQLPISVPTVAV

SEQ ID NO: 3201998 - protein, 23 aa, Giardia lamblia
FVDVYTDLLFALLDNPRGRTVQG

SEQ ID NO: 3201999 - protein, 19 aa, Giardia lamblia
FVEYILPSYDRLLREKSEE

SEQ ID NO: 3202000 - protein, 20 aa, Giardia lamblia
FVGRWHERLPSKFTALILAC

SEQ ID NO: 3202001 - protein, 17 aa, Giardia lamblia
FVLAKRKLAYIVTPDFG

SEQ ID NO: 3202002 - protein, 17 aa, Giardia lamblia
FVLIPFQILSSVMCGDI

SEQ ID NO: 3202003 - protein, 23 aa, Giardia lamblia
FVPMNNLAAVYLLAPRLSNIRDQ

SEQ ID NO: 3202004 - protein, 19 aa, Giardia lamblia
FVRTFLYIFSLDERIRDVT

SEQ ID NO: 3202005 - protein, 17 aa, Giardia lamblia
FVRVRLFRPFSIELFSN

SEQ ID NO: 3202006 - protein, 27 aa, Giardia lamblia
FVTSFSDLILLLAIRLKSPSPDSTFNL

SEQ ID NO: 3202007 - protein, 17 aa, Giardia lamblia
FWDDRVLPLFPPYHFSC

SEQ ID NO: 3202008 - protein, 24 aa, Giardia lamblia
FWKITVQLIYILILFSTIEGRRNT

SEQ ID NO: 3202009 - protein, 22 aa, Giardia lamblia
FWNCQVIFFINPYETINYFLFS

SEQ ID NO: 3202010 - protein, 23 aa, Giardia lamblia
FWTITYEHCTILPVWFDCLLSDL

SEQ ID NO: 3202011 - protein, 25 aa, Giardia lamblia
FYAAFLILELWCYYITSRDGHLPGY

SEQ ID NO: 3202012 - protein, 18 aa, Giardia lamblia
FYCLYVFININPISPLYN

SEQ ID NO: 3202013 - protein, 17 aa, Giardia lamblia
FYDLYPYYRPGKSDYPV

SEQ ID NO: 3202014 - protein, 21 aa, Giardia lamblia
FYDPDLVMPPLKNPMATTAKQ

SEQ ID NO: 3202015 - protein, 19 aa, Giardia lamblia
FYFAISFMKSLMQRDERGF

SEQ ID NO: 3202016 - protein, 17 aa, Giardia lamblia
FYGKFLGSQALLKRRAR

SEQ ID NO: 3202017 - protein, 17 aa, Giardia lamblia
FYHEKGILMTTIPVVLI

SEQ ID NO: 3202018 - protein, 17 aa, Giardia lamblia
FYHLRRYNKFPLQVVKF

SEQ ID NO: 3202019 - protein, 18 aa, Giardia lamblia
FYNPLFPTFYFGLHHPMK

SEQ ID NO: 3202020 - protein, 17 aa, Giardia lamblia
FYPFLNPQERMLSHTQS

SEQ ID NO: 3202021 - protein, 18 aa, Giardia lamblia
GAESLAWLKAATARYIEA

SEQ ID NO: 3202022 - protein, 17 aa, Giardia lamblia
GAFMRRGIMPIFLDSSK

SEQ ID NO: 3202023 - protein, 29 aa, Giardia lamblia
GAGKSNFYSAILFALMDPLYDLKTINRAQ

SEQ ID NO: 3202024 - protein, 25 aa, Giardia lamblia
GAISQPWLYTMLYLLIEVRQLSAVG

SEQ ID NO: 3202025 - protein, 19 aa, Giardia lamblia
GAIVLWIPENPFYPNRILY

SEQ ID NO: 3202026 - protein, 20 aa, Giardia lamblia
GALMMVWPMGLPDYDPAKEL

SEQ ID NO: 3202027 - protein, 24 aa, Giardia lamblia
GAMDAICILAPGWPVRRTTEGIAA

SEQ ID NO: 3202028 - protein, 24 aa, Giardia lamblia
GAPAPMLPPCLPFPPTADSRPTGH

SEQ ID NO: 3202029 - protein, 18 aa, Giardia lamblia
GCAASIPTSLRDLPDGPL

SEQ ID NO: 3202030 - protein, 18 aa, Giardia lamblia
GCFFILSRSRWSYLTTYL

SEQ ID NO: 3202031 - protein, 17 aa, Giardia lamblia
GCSLVWMHFGYMRPFNL

SEQ ID NO: 3202032 - protein, 24 aa, Giardia lamblia
GDDRTIMIWNLTPPIRAFKFVGHN

SEQ ID NO: 3202033 - protein, 23 aa, Giardia lamblia
GDGKGFFAPYPLAGYIALKIPGG

SEQ ID NO: 3202034 - protein, 23 aa, Giardia lamblia
GDKKAHTFIYDYAYWSLDGRYEK

SEQ ID NO: 3202035 - protein, 24 aa, Giardia lamblia
GDRSILELLLIFRNKKEANACQRC

SEQ ID NO: 3202036 - protein, 23 aa, Giardia lamblia
GDVLKIFCLLPYQSREKDEDGNT

SEQ ID NO: 3202037 - protein, 25 aa, Giardia lamblia
GEKKIKFFSVFYIRVYGGAGAWIFM

SEQ ID NO: 3202038 - protein, 20 aa, Giardia lamblia
GFILNSFYTGLLPFEFLAHA

SEQ ID NO: 3202039 - protein, 25 aa, Giardia lamblia
GFKVDMLTLFHIVLLLTADDPERAR

SEQ ID NO: 3202040 - protein, 22 aa, Giardia lamblia
GFLDLLNKAVFLNGPLAGAKGG

SEQ ID NO: 3202041 - protein, 25 aa, Giardia lamblia
GFLHYIRILALLQMNQLPLVKREMG

SEQ ID NO: 3202042 - protein, 19 aa, Giardia lamblia
GFMALLKFSERHSTFKRLC

SEQ ID NO: 3202043 - protein, 29 aa, Giardia lamblia
GFWCGEDRPLLWWNLLSRVVQDEGGGGTL

SEQ ID NO: 3202044 - protein, 29 aa, Giardia lamblia
GFWCGEDRPLLWWNLLSRVVQNEGGGGTL

SEQ ID NO: 3202045 - protein, 21 aa, Giardia lamblia
GGCDNTFLWTPLKRQTPNSDF

SEQ ID NO: 3202046 - protein, 18 aa, Giardia lamblia
GGEGPWFLHKCPPLPQMA

SEQ ID NO: 3202047 - protein, 17 aa, Giardia lamblia
GGELFYHLRRYNKFPLQ

SEQ ID NO: 3202048 - protein, 27 aa, Giardia lamblia
GGGLYMQIPVLDFLMHPSPITLLAKYS

SEQ ID NO: 3202049 - protein, 23 aa, Giardia lamblia
GGPALPRRVPWARGLRGRPSDPC

SEQ ID NO: 3202050 - protein, 25 aa, Giardia lamblia
GGPDRYYLLVYIALDCLAKLFRCIG

SEQ ID NO: 3202051 - protein, 31 aa, Giardia lamblia
GGQRSLLALSLIFSLLLYKPCPLYILDEIDA

SEQ ID NO: 3202052 - protein, 28 aa, Giardia lamblia
GGRINTIMILFFLKLGLSKLLDFDVACE

SEQ ID NO: 3202053 - protein, 17 aa, Giardia lamblia
GGWLMDACFSFPQLYAA

SEQ ID NO: 3202054 - protein, 25 aa, Giardia lamblia
GHFAFATWLLLWIARSAILPYTGEE

SEQ ID NO: 3202055 - protein, 19 aa, Giardia lamblia
GHFIYPYLLQPETAKHTMH

SEQ ID NO: 3202056 - protein, 23 aa, Giardia lamblia
GHINAIRLLLPYEQDLRDKKGRS

SEQ ID NO: 3202057 - protein, 18 aa, Giardia lamblia
GHLAVLQAVLQKLNHLTD

SEQ ID NO: 3202058 - protein, 19 aa, Giardia lamblia
GHQLSRDLQFYLLDPDELN

SEQ ID NO: 3202059 - protein, 26 aa, Giardia lamblia
GHSKPIQLLSLLPAPPLPFLDPTDET

SEQ ID NO: 3202060 - protein, 26 aa, Giardia lamblia
GICTRRPLILQLIPTKPGQFVKDEKG

SEQ ID NO: 3202061 - protein, 18 aa, Giardia lamblia
GIFIYECLYGVTPFMSKG

SEQ ID NO: 3202062 - protein, 17 aa, Giardia lamblia
GILSCRFVRGTRTTTGF

SEQ ID NO: 3202063 - protein, 20 aa, Giardia lamblia
GISFDPIAIHFPTRPKRCIT

SEQ ID NO: 3202064 - protein, 19 aa, Giardia lamblia
GISLRLPRLLRARPDKRPW

SEQ ID NO: 3202065 - protein, 21 aa, Giardia lamblia
GITIPTRILPLSGLSPKDLGD

SEQ ID NO: 3202066 - protein, 23 aa, Giardia lamblia
GITLDLLNFWRKNQYLPVYIRQT

SEQ ID NO: 3202067 - protein, 28 aa, Giardia lamblia
GKKTMPLPGFRWPLAVAFLPCLADFHSL

SEQ ID NO: 3202068 - protein, 20 aa, Giardia lamblia
GKMIQWFKERPKDMPNALDI

SEQ ID NO: 3202069 - protein, 23 aa, Giardia lamblia
GKNTLIPLFLPYEADIEIHDKLK

SEQ ID NO: 3202070 - protein, 24 aa, Giardia lamblia
GKRYRQLLFQLKRKKTQLVLATQQ

SEQ ID NO: 3202071 - protein, 17 aa, Giardia lamblia
GKSLVAFIYILRCLSLC

SEQ ID NO: 3202072 - protein, 24 aa, Giardia lamblia
GKTCAFIIPILHRIATEKLKLYTM

SEQ ID NO: 3202073 - protein, 20 aa, Giardia lamblia
GLDEELLLLRLFKVYNRSWS

SEQ ID NO: 3202074 - protein, 25 aa, Giardia lamblia
GLGLERFICWLLGIYTVRDTVLYPR

SEQ ID NO: 3202075 - protein, 17 aa, Giardia lamblia
GLKKLWSLIKHPNLLVV

SEQ ID NO: 3202076 - protein, 27 aa, Giardia lamblia
GLLNPVVLTVLILEFIDLLPPEKQIKI

SEQ ID NO: 3202077 - protein, 18 aa, Giardia lamblia
GLNFAIPLLISREGKMTT

SEQ ID NO: 3202078 - protein, 23 aa, Giardia lamblia
GLPLPQLFLKKWKLYDDGTLCLL

SEQ ID NO: 3202079 - protein, 24 aa, Giardia lamblia
GLQTLLDKLLLVKAPPLSELQTKK

SEQ ID NO: 3202080 - protein, 22 aa, Giardia lamblia
GLRPYGVSFLFGGWDAHLGFQL

SEQ ID NO: 3202081 - protein, 17 aa, Giardia lamblia
GLRSFKHLFLKHVYYAD

SEQ ID NO: 3202082 - protein, 25 aa, Giardia lamblia
GLSKLRFCLFISSPIFFVKPMDTCL

SEQ ID NO: 3202083 - protein, 17 aa, Giardia lamblia
GLVIKPAARQHFDGAGG

SEQ ID NO: 3202084 - protein, 22 aa, Giardia lamblia
GMTLRLPILLVLRSILLPCNFN

SEQ ID NO: 3202085 - protein, 22 aa, Giardia lamblia
GMTSFLTSFNFRYAPPGASLSS

SEQ ID NO: 3202086 - protein, 22 aa, Giardia lamblia
GMYSNDLIGFIYKILVVDHNAR

SEQ ID NO: 3202087 - protein, 24 aa, Giardia lamblia
GNLQPYIMSTAVLQSLFSLLTRKQ

SEQ ID NO: 3202088 - protein, 23 aa, Giardia lamblia
GNLSFFWVGSLVPEELRRGLFGA

SEQ ID NO: 3202089 - protein, 22 aa, Giardia lamblia
GNMSFYYITLQDVLGILSKTSR

SEQ ID NO: 3202090 - protein, 22 aa, Giardia lamblia
GNRILDFSLLSNLAFMTLLDND

SEQ ID NO: 3202091 - protein, 24 aa, Giardia lamblia
GPAETFILPLVSNLPVHVSGDIGF

SEQ ID NO: 3202092 - protein, 17 aa, Giardia lamblia
GQFDMVSKMQLEIKRLA

SEQ ID NO: 3202093 - protein, 17 aa, Giardia lamblia
GQPPRIPRALRSLLWPP

SEQ ID NO: 3202094 - protein, 19 aa, Giardia lamblia
GQTPILPYLIPSEAGICTN

SEQ ID NO: 3202095 - protein, 21 aa, Giardia lamblia
GREIIAWLRILRPGSILGQQQ

SEQ ID NO: 3202096 - protein, 21 aa, Giardia lamblia
GRTPIYAPFDECSIVPAVPID

SEQ ID NO: 3202097 - protein, 20 aa, Giardia lamblia
GRYIYVPLILVLRALVSTTD

SEQ ID NO: 3202098 - protein, 19 aa, Giardia lamblia
GSDIYLIAPCRHLIVTIGS

SEQ ID NO: 3202099 - protein, 23 aa, Giardia lamblia
GSDLLLQSLLVRVLTDIRHNRLE

SEQ ID NO: 3202100 - protein, 21 aa, Giardia lamblia
GSEIYLYMRRAIHGPLRALID

SEQ ID NO: 3202101 - protein, 23 aa, Giardia lamblia
GSGKSYIFSLLKDAVFKLTKGNI

SEQ ID NO: 3202102 - protein, 30 aa, Giardia lamblia
GSGKTLAFLIPLLQRLISLQWQRLDGLGAL

SEQ ID NO: 3202103 - protein, 23 aa, Giardia lamblia
GSIRPLRLLAIKFFDTLAQRVTA

SEQ ID NO: 3202104 - protein, 26 aa, Giardia lamblia
GSKTFWARLCLSWIAFRRAPRNDPAG

SEQ ID NO: 3202105 - protein, 26 aa, Giardia lamblia
GSLVPFLDYLLLLLGLNTTGLSDENS

SEQ ID NO: 3202106 - protein, 22 aa, Giardia lamblia
GSTDFALFLWGVDYPTFDLMID

SEQ ID NO: 3202107 - protein, 17 aa, Giardia lamblia
GSWPLLGPRYRVDILGA

SEQ ID NO: 3202108 - protein, 23 aa, Giardia lamblia
GTHKTIYLDTYRFSTMSLRNALG

SEQ ID NO: 3202109 - protein, 20 aa, Giardia lamblia
GTKLFIHRLSSLELIHTLTL

SEQ ID NO: 3202110 - protein, 25 aa, Giardia lamblia
GTLRDEAERFIPCRGFRVSSAGKLR

SEQ ID NO: 3202111 - protein, 21 aa, Giardia lamblia
GTMDTWLLWNLSKEKSYLTDV

SEQ ID NO: 3202112 - protein, 22 aa, Giardia lamblia
GTPTPYWKIAPGKGLDLKQKLE

SEQ ID NO: 3202113 - protein, 24 aa, Giardia lamblia
GTVEYIFLQPYLSALYIHFKREVK

SEQ ID NO: 3202114 - protein, 17 aa, Giardia lamblia
GVFFRKYTKKEADALSL

SEQ ID NO: 3202115 - protein, 22 aa, Giardia lamblia
GVKFLLISWLQKRNVILADDLG

SEQ ID NO: 3202116 - protein, 23 aa, Giardia lamblia
GVQDFLLGVRYLGIPSDLISNDD

SEQ ID NO: 3202117 - protein, 22 aa, Giardia lamblia
GVRKFLPTTLRPAILADPALCD

SEQ ID NO: 3202118 - protein, 18 aa, Giardia lamblia
GVYFVGIWNIAINSWDVD

SEQ ID NO: 3202119 - protein, 19 aa, Giardia lamblia
GWYLAGTKLFIDIYTPELT

SEQ ID NO: 3202120 - protein, 17 aa, Giardia lamblia
GYDSLVSLLIPKEARMA

SEQ ID NO: 3202121 - protein, 17 aa, Giardia lamblia
GYFFPFSNQSNFSRLFF

SEQ ID NO: 3202122 - protein, 25 aa, Giardia lamblia
GYLVHRFHWPPHRALQFITTKRFSS

SEQ ID NO: 3202123 - protein, 26 aa, Giardia lamblia
GYMVDILLILQLFPNLKCLQLENCIL

SEQ ID NO: 3202124 - protein, 20 aa, Giardia lamblia
HAFFVFRMPAGSSLYSIVTA

SEQ ID NO: 3202125 - protein, 26 aa, Giardia lamblia
HASPLIYSLLHLFGYNLSMDDLRHFR

SEQ ID NO: 3202126 - protein, 17 aa, Giardia lamblia
HAYLAQQLKAAATVQPS

SEQ ID NO: 3202127 - protein, 25 aa, Giardia lamblia
HCDLKPQNFMFYKGRLRLIDFGISK

SEQ ID NO: 3202128 - protein, 23 aa, Giardia lamblia
HDKYGWTALIWAIDNNNIECVRL

SEQ ID NO: 3202129 - protein, 19 aa, Giardia lamblia
HDMIVACLYLRVSGKLSAE

SEQ ID NO: 3202130 - protein, 24 aa, Giardia lamblia
HDQKLADTWILYETNRIWKRIPES

SEQ ID NO: 3202131 - protein, 17 aa, Giardia lamblia
HDSIPFLIVPRPVRYAP

SEQ ID NO: 3202132 - protein, 17 aa, Giardia lamblia
HDTCIFLLAQYLGSTRD

SEQ ID NO: 3202133 - protein, 25 aa, Giardia lamblia
HEILPAKQLLFYKNSPHYLKLAAYN

SEQ ID NO: 3202134 - protein, 17 aa, Giardia lamblia
HEQIAHMLLLKESGLET

SEQ ID NO: 3202135 - protein, 24 aa, Giardia lamblia
HFIFDIFHFCPLERFGIIISDRAT

SEQ ID NO: 3202136 - protein, 22 aa, Giardia lamblia
HFQFVYMHSPLLYFALEAYSHL

SEQ ID NO: 3202137 - protein, 17 aa, Giardia lamblia
HFSMTLHDWFRAAEIGD

SEQ ID NO: 3202138 - protein, 26 aa, Giardia lamblia
HGCPCPWLIISLMRFLRRLAPRLEEA

SEQ ID NO: 3202139 - protein, 22 aa, Giardia lamblia
HGDVYIVFNLLGLQAKLQDSEG

SEQ ID NO: 3202140 - protein, 17 aa, Giardia lamblia
HGFYIDKALYDKAKFAN

SEQ ID NO: 3202141 - protein, 17 aa, Giardia lamblia
HGILPRRSPLGTLEYTS

SEQ ID NO: 3202142 - protein, 26 aa, Giardia lamblia
HGTGFLLLVTLLYSKPRLLFVDVQLL

SEQ ID NO: 3202143 - protein, 18 aa, Giardia lamblia
HHQLAMFMPKYNKYIHLS

SEQ ID NO: 3202144 - protein, 24 aa, Giardia lamblia
HIGFEFLHLWMPKAEFYMPSTTWP

SEQ ID NO: 3202145 - protein, 18 aa, Giardia lamblia
HIISLFFMAFYYVLDNYG

SEQ ID NO: 3202146 - protein, 26 aa, Giardia lamblia
HISEAKIWYIFAQLLYALASIHDPVE

SEQ ID NO: 3202147 - protein, 18 aa, Giardia lamblia
HITPTLYLTLLSTFARVL

SEQ ID NO: 3202148 - protein, 23 aa, Giardia lamblia
HKMHIPAPPEWEPWILPPKVSLA

SEQ ID NO: 3202149 - protein, 21 aa, Giardia lamblia
HKMLRWWSLREHPTINMWAAG

SEQ ID NO: 3202150 - protein, 20 aa, Giardia lamblia
HKMYLTLQGLTKLQASLLSQ

SEQ ID NO: 3202151 - protein, 22 aa, Giardia lamblia
HLALTIHYLLTDTAPKLIMCAE

SEQ ID NO: 3202152 - protein, 26 aa, Giardia lamblia
HLEIKFKWFTILLGRLPRIVEMDGNP

SEQ ID NO: 3202153 - protein, 17 aa, Giardia lamblia
HLMGIWKSPLRTPISRP

SEQ ID NO: 3202154 - protein, 26 aa, Giardia lamblia
HLNPKSTLPIFLPFLDEAESSIYSLV

SEQ ID NO: 3202155 - protein, 17 aa, Giardia lamblia
HLQNIYAFYLVMAGDFL

SEQ ID NO: 3202156 - protein, 25 aa, Giardia lamblia
HLRTCLAHYGLSLYLESLASTNIVL

SEQ ID NO: 3202157 - protein, 21 aa, Giardia lamblia
HLSALFDCCIMALSSVGLCVV

SEQ ID NO: 3202158 - protein, 18 aa, Giardia lamblia
HLTSFKLFLVPSAGYLVL

SEQ ID NO: 3202159 - protein, 17 aa, Giardia lamblia
HMEMQPLKAVFKIVTSP

SEQ ID NO: 3202160 - protein, 17 aa, Giardia lamblia
HMQYFVYQLLRGLKYLH

SEQ ID NO: 3202161 - protein, 18 aa, Giardia lamblia
HNDIDMVNLLFSLEFAIS

SEQ ID NO: 3202162 - protein, 18 aa, Giardia lamblia
HNHFACCFPDFIFCRREL

SEQ ID NO: 3202163 - protein, 21 aa, Giardia lamblia
HNHLLHFYKIKYPQLFYMRKS

SEQ ID NO: 3202164 - protein, 17 aa, Giardia lamblia
HNNYILPQTFLTRYIFY

SEQ ID NO: 3202165 - protein, 19 aa, Giardia lamblia
HNRGEMLLLLQILARRLTS

SEQ ID NO: 3202166 - protein, 22 aa, Giardia lamblia
HPDLSRMFYLELLKKDISVAYG

SEQ ID NO: 3202167 - protein, 23 aa, Giardia lamblia
HPELLSRPLKPHPLFVGLIGAAL

SEQ ID NO: 3202168 - protein, 18 aa, Giardia lamblia
HPIPLQFLNGLVSKSIRQ

SEQ ID NO: 3202169 - protein, 22 aa, Giardia lamblia
HPIRAVRFLPKTSFLLVGSDDG

SEQ ID NO: 3202170 - protein, 20 aa, Giardia lamblia
HPLQVLFKFFAFYSAFDFTN

SEQ ID NO: 3202171 - protein, 23 aa, Giardia lamblia
HQECVQLLLPYEAALQHSSGRTA

SEQ ID NO: 3202172 - protein, 24 aa, Giardia lamblia
HQIKAVRLILRGWVHMVRADVDEA

SEQ ID NO: 3202173 - protein, 21 aa, Giardia lamblia
HRCFLLLPHKAKLIKFSAPDN

SEQ ID NO: 3202174 - protein, 17 aa, Giardia lamblia
HRDLQFLTWNFCTMHKA

SEQ ID NO: 3202175 - protein, 22 aa, Giardia lamblia
HRSAWYFVLSELVRLFILNTTS

SEQ ID NO: 3202176 - protein, 23 aa, Giardia lamblia
HSDRIYPALPYKPSFIPDNPMND

SEQ ID NO: 3202177 - protein, 23 aa, Giardia lamblia
HSGTWFAVLYLPPGIYQYKFIVD

SEQ ID NO: 3202178 - protein, 23 aa, Giardia lamblia
HSIRKLQFQLTQRDRLHLDTEIS

SEQ ID NO: 3202179 - protein, 24 aa, Giardia lamblia
HTFKTAMLLFVPTPMQIKMIFSTA

SEQ ID NO: 3202180 - protein, 17 aa, Giardia lamblia
HTGPVVCILLSQNKRHM

SEQ ID NO: 3202181 - protein, 22 aa, Giardia lamblia
HTSPPHRLLSSRSLYSGAGESA

SEQ ID NO: 3202182 - protein, 19 aa, Giardia lamblia
HTVFLIEITSYRETAKGTR

SEQ ID NO: 3202183 - protein, 30 aa, Giardia lamblia
HVDKSIVYVFLLQDLLFIEAMRETVLALLP

SEQ ID NO: 3202184 - protein, 24 aa, Giardia lamblia
HVDPVKPYRSWYLANLSSLPMAFS

SEQ ID NO: 3202185 - protein, 17 aa, Giardia lamblia
HVFKCLPLFTSQRSWLM

SEQ ID NO: 3202186 - protein, 17 aa, Giardia lamblia
HVLFPLLQDIRSVVAQI

SEQ ID NO: 3202187 - protein, 20 aa, Giardia lamblia
HVLKLRLLRTIYLLDGGPKR

SEQ ID NO: 3202188 - protein, 19 aa, Giardia lamblia
HVTAIIPYFGYARQDRKAA

SEQ ID NO: 3202189 - protein, 20 aa, Giardia lamblia
HYERLFAKPWLFPHLGEDLD

SEQ ID NO: 3202190 - protein, 23 aa, Giardia lamblia
HYIASPKLWRPLSSGLRSLAGPG

SEQ ID NO: 3202191 - protein, 18 aa, Giardia lamblia
HYMLLRDLFDNCLVFVHA

SEQ ID NO: 3202192 - protein, 22 aa, Giardia lamblia
HYRKDMIRLLYPYEHGLLPDAE

SEQ ID NO: 3202193 - protein, 23 aa, Giardia lamblia
IACELSLFFRLSSLIPFCAVTHT

SEQ ID NO: 3202194 - protein, 26 aa, Giardia lamblia
IADLLDLLQFILLPHKQYFADDEHID

SEQ ID NO: 3202195 - protein, 23 aa, Giardia lamblia
IADSALMIFLPKIAVLFLEPEFV

SEQ ID NO: 3202196 - protein, 25 aa, Giardia lamblia
IAEFAVYFSTYFYSMMSYVTDFYVT

SEQ ID NO: 3202197 - protein, 18 aa, Giardia lamblia
IAFTRLYNYALSLEHLQA

SEQ ID NO: 3202198 - protein, 17 aa, Giardia lamblia
IAHMLLLKESGLETKEG

SEQ ID NO: 3202199 - protein, 23 aa, Giardia lamblia
IAKPGFLPKMKKMRSFPYAGTNW

SEQ ID NO: 3202200 - protein, 18 aa, Giardia lamblia
IALERYMQLRHPCLLNIL

SEQ ID NO: 3202201 - protein, 23 aa, Giardia lamblia
IALGILLFQYVSSLYDIMWNDIA

SEQ ID NO: 3202202 - protein, 22 aa, Giardia lamblia
IALLALVFCLHRYKTLPFLLLD

SEQ ID NO: 3202203 - protein, 19 aa, Giardia lamblia
IAQFVTLISFLLRRQFDKT

SEQ ID NO: 3202204 - protein, 18 aa, Giardia lamblia
ICEILAPLEKTIYYKDGR

SEQ ID NO: 3202205 - protein, 18 aa, Giardia lamblia
ICELLLLVKDDSTIEANL

SEQ ID NO: 3202206 - protein, 23 aa, Giardia lamblia
ICLDSLPSIVYLPCRHLSICELC

SEQ ID NO: 3202207 - protein, 19 aa, Giardia lamblia
ICVNGFLSKILHLMETNPS

SEQ ID NO: 3202208 - protein, 18 aa, Giardia lamblia
ICYILPTEFLRASAIACQ

SEQ ID NO: 3202209 - protein, 23 aa, Giardia lamblia
IDEKDFIFGLRYSGLPSELISDK

SEQ ID NO: 3202210 - protein, 27 aa, Giardia lamblia
IDKQLDMLYWIRKALLKTFGIKIKDSD

SEQ ID NO: 3202211 - protein, 23 aa, Giardia lamblia
IDNPPRLLFLHGYSFFTDLYATL

SEQ ID NO: 3202212 - protein, 21 aa, Giardia lamblia
IDRRRSCRRFLTASAILDDKI

SEQ ID NO: 3202213 - protein, 19 aa, Giardia lamblia
IDYVPYSLILVFPFCPCDL

SEQ ID NO: 3202214 - protein, 26 aa, Giardia lamblia
IEAMRETVLALLPRLFKKLQKMMDAY

SEQ ID NO: 3202215 - protein, 25 aa, Giardia lamblia
IEEDRIWRIFAQLLIAMEYCHSVRK

SEQ ID NO: 3202216 - protein, 17 aa, Giardia lamblia
IEKYSDLLWLMPSSVYC

SEQ ID NO: 3202217 - protein, 24 aa, Giardia lamblia
IENFYTLCALLSKFPLLQTVILSN

SEQ ID NO: 3202218 - protein, 26 aa, Giardia lamblia
IEQLFDYFVIFLKQLKLFYKMGANPE

SEQ ID NO: 3202219 - protein, 25 aa, Giardia lamblia
IESAIQFLFKVWDYIEEAFALRNSC

SEQ ID NO: 3202220 - protein, 23 aa, Giardia lamblia
IESQSHFLLINLLSNQLGVRGAK

SEQ ID NO: 3202221 - protein, 21 aa, Giardia lamblia
IETIILHLPVSLTECLSICHD

SEQ ID NO: 3202222 - protein, 30 aa, Giardia lamblia
IETSLFRYYCPFFYWMHSFGLILLNHIKPG

SEQ ID NO: 3202223 - protein, 25 aa, Giardia lamblia
IEVPYHPHWPKFVPLSLTVKTHIYN

SEQ ID NO: 3202224 - protein, 19 aa, Giardia lamblia
IEWRWLYRHGIDKFYRSRT

SEQ ID NO: 3202225 - protein, 18 aa, Giardia lamblia
IFDNNLFVDLPWTTAKSL

SEQ ID NO: 3202226 - protein, 17 aa, Giardia lamblia
IFNQFLIGKPGPVAIDQ

SEQ ID NO: 3202227 - protein, 21 aa, Giardia lamblia
IFQYFLREEILYSPLSLLSFE

SEQ ID NO: 3202228 - protein, 17 aa, Giardia lamblia
IFSLLERNLNSGRKEDL

SEQ ID NO: 3202229 - protein, 23 aa, Giardia lamblia
IFYLAFLLRTAVDPLYIARRLII

SEQ ID NO: 3202230 - protein, 25 aa, Giardia lamblia
IGDCFLWEIPLYKCMLLWNVHSFYK

SEQ ID NO: 3202231 - protein, 24 aa, Giardia lamblia
IGIRYIKFFYLRRWKLSLRASREA

SEQ ID NO: 3202232 - protein, 25 aa, Giardia lamblia
IGQISYHFLLITYNSIRFNIKPGYT

SEQ ID NO: 3202233 - protein, 21 aa, Giardia lamblia
IGRIYYLFDLRDATPLLLLSV

SEQ ID NO: 3202234 - protein, 24 aa, Giardia lamblia
IGTPFLAFYEGKAFHFEPYFARLK

SEQ ID NO: 3202235 - protein, 26 aa, Giardia lamblia
IHDYFYFREHLLLKFTLLGEDLYTHF

SEQ ID NO: 3202236 - protein, 18 aa, Giardia lamblia
IHFLITRFWIAVADTSHY

SEQ ID NO: 3202237 - protein, 20 aa, Giardia lamblia
IHGCRIFIVYALLVNGETPK

SEQ ID NO: 3202238 - protein, 18 aa, Giardia lamblia
IHILFRDYGIEPCRAFID

SEQ ID NO: 3202239 - protein, 18 aa, Giardia lamblia
IHIYLIDGALHPVLGAGE

SEQ ID NO: 3202240 - protein, 23 aa, Giardia lamblia
IHKDFRLYLTTIPFPQFPSSITR

SEQ ID NO: 3202241 - protein, 24 aa, Giardia lamblia
IHRQMNYQLFLRSYQYFYGLDDEE

SEQ ID NO: 3202242 - protein, 18 aa, Giardia lamblia
IHSVIPILLPVENKIQDK

SEQ ID NO: 3202243 - protein, 17 aa, Giardia lamblia
IIAFRPYIGEIFTAFLV

SEQ ID NO: 3202244 - protein, 19 aa, Giardia lamblia
IIDAYRVKYLLALKRTTSS

SEQ ID NO: 3202245 - protein, 18 aa, Giardia lamblia
IIDDLKSPGLLFYFTSES

SEQ ID NO: 3202246 - protein, 19 aa, Giardia lamblia
IIETYYWRKNIILVLELCE

SEQ ID NO: 3202247 - protein, 18 aa, Giardia lamblia
IIFLRTYVPITIIKFCYE

SEQ ID NO: 3202248 - protein, 17 aa, Giardia lamblia
IIIIKNSLYLLNCLAKK

SEQ ID NO: 3202249 - protein, 17 aa, Giardia lamblia
IIKALRLSPALIARTGC

SEQ ID NO: 3202250 - protein, 18 aa, Giardia lamblia
IIKLMKPLFFTVFPRVFT

SEQ ID NO: 3202251 - protein, 17 aa, Giardia lamblia
IIKLYWSIMRVLRTLYI

SEQ ID NO: 3202252 - protein, 20 aa, Giardia lamblia
IILAAIFYYVGDYNTIDLNW

SEQ ID NO: 3202253 - protein, 17 aa, Giardia lamblia
IIQRYLETPLLLGGYKF

SEQ ID NO: 3202254 - protein, 17 aa, Giardia lamblia
IISILRRYKPSLTSVSR

SEQ ID NO: 3202255 - protein, 25 aa, Giardia lamblia
IITKYLYDLKLYAMNQRILSYFPDD

SEQ ID NO: 3202256 - protein, 20 aa, Giardia lamblia
IIYELRTLLLPNLYTEDWTL

SEQ ID NO: 3202257 - protein, 27 aa, Giardia lamblia
IKAANLPYPLRRFSLTYVQNRVVLIGG

SEQ ID NO: 3202258 - protein, 18 aa, Giardia lamblia
IKENFLLAFLDLIENSSV

SEQ ID NO: 3202259 - protein, 17 aa, Giardia lamblia
IKESCIDYILFSDSIPL

SEQ ID NO: 3202260 - protein, 23 aa, Giardia lamblia
IKGPLALLFLALRANAAIITSNL

SEQ ID NO: 3202261 - protein, 18 aa, Giardia lamblia
IKNLVTCDPFLRSYPRYP

SEQ ID NO: 3202262 - protein, 26 aa, Giardia lamblia
IKPLKKMRYVVTPIPLPAATVSDRPS

SEQ ID NO: 3202263 - protein, 18 aa, Giardia lamblia
IKPVARRPLAPEPTLTVM

SEQ ID NO: 3202264 - protein, 19 aa, Giardia lamblia
IKPVLSILLSPIPARRLPA

SEQ ID NO: 3202265 - protein, 18 aa, Giardia lamblia
IKRTIPIWCLVWSTVLSG

SEQ ID NO: 3202266 - protein, 22 aa, Giardia lamblia
IKRWLFAFRRDVLADPQAALTI

SEQ ID NO: 3202267 - protein, 25 aa, Giardia lamblia
IKTKDAEILSLRRKLEDYVELSEVQ

SEQ ID NO: 3202268 - protein, 18 aa, Giardia lamblia
IKYLTLSPLFQYIEPLSS

SEQ ID NO: 3202269 - protein, 25 aa, Giardia lamblia
IKYRHDLLMFLYIGQQRLKLTKIFL

SEQ ID NO: 3202270 - protein, 17 aa, Giardia lamblia
ILCKNISRFPVRFQWLL

SEQ ID NO: 3202271 - protein, 17 aa, Giardia lamblia
ILDVYILGCLKPVGGSS

SEQ ID NO: 3202272 - protein, 17 aa, Giardia lamblia
ILKPFLLRRVKTEVLAQ

SEQ ID NO: 3202273 - protein, 19 aa, Giardia lamblia
ILLYMRKYRVLLPAAEGLL

SEQ ID NO: 3202274 - protein, 19 aa, Giardia lamblia
ILNFITVIPHGPIRFSPTV

SEQ ID NO: 3202275 - protein, 25 aa, Giardia lamblia
ILNGKSNYIKWLLPESLRSVDSQGR

SEQ ID NO: 3202276 - protein, 21 aa, Giardia lamblia
ILNKSLLISIPYFKECLLMCS

SEQ ID NO: 3202277 - protein, 17 aa, Giardia lamblia
ILSYQWPTIYDFLLDFS

SEQ ID NO: 3202278 - protein, 20 aa, Giardia lamblia
ILTTPLIRNPPALPPLSLLV

SEQ ID NO: 3202279 - protein, 18 aa, Giardia lamblia
IMFVVFVPEWRVPPAQYH

SEQ ID NO: 3202280 - protein, 25 aa, Giardia lamblia
IMINQLRLWLTDWADVFINKVPVES

SEQ ID NO: 3202281 - protein, 24 aa, Giardia lamblia
INLYYALHIIGFLPSLQSINGRMI

SEQ ID NO: 3202282 - protein, 22 aa, Giardia lamblia
INNVILVYRIYANLKLVEVLRP

SEQ ID NO: 3202283 - protein, 23 aa, Giardia lamblia
INPALLLAFPVPCSMEQGVFPIL

SEQ ID NO: 3202284 - protein, 20 aa, Giardia lamblia
INPFILGQLIFMLIDGQWKH

SEQ ID NO: 3202285 - protein, 19 aa, Giardia lamblia
INYYVLYLSQCAIELIKES

SEQ ID NO: 3202286 - protein, 18 aa, Giardia lamblia
IPDTPRYVIPFFSLIDAV

SEQ ID NO: 3202287 - protein, 26 aa, Giardia lamblia
IPEERIWKLFGQLLLALEYCHCPTKE

SEQ ID NO: 3202288 - protein, 19 aa, Giardia lamblia
IPFIPLCMEIIGNYVFLSG

SEQ ID NO: 3202289 - protein, 17 aa, Giardia lamblia
IPKFTLESLLHCLSEIL

SEQ ID NO: 3202290 - protein, 20 aa, Giardia lamblia
IPLLPIIKALRLSPALIART

SEQ ID NO: 3202291 - protein, 19 aa, Giardia lamblia
IPRFVFLSHFLTRSGLQCP

SEQ ID NO: 3202292 - protein, 20 aa, Giardia lamblia
IPRPILVTHPIFPLASTLSG

SEQ ID NO: 3202293 - protein, 25 aa, Giardia lamblia
IPSQICIQLLIHPLLLVSEYYQCFR

SEQ ID NO: 3202294 - protein, 20 aa, Giardia lamblia
IPSYYCNLLLFKNAPATFPY

SEQ ID NO: 3202295 - protein, 20 aa, Giardia lamblia
IPVPIAMILSVLRQVAAALA

SEQ ID NO: 3202296 - protein, 25 aa, Giardia lamblia
IPYTITQLLLFFDRLFFFLEVRHLG

SEQ ID NO: 3202297 - protein, 19 aa, Giardia lamblia
IQFVVSFLELYLDNTYDLL

SEQ ID NO: 3202298 - protein, 25 aa, Giardia lamblia
IQGDSILIPITYWNSILTEFENLAT

SEQ ID NO: 3202299 - protein, 25 aa, Giardia lamblia
IQGLRRIYNLGFMVKLSFLEVYCER

SEQ ID NO: 3202300 - protein, 23 aa, Giardia lamblia
IQIQLLPFYVLALNYLGVIWANR

SEQ ID NO: 3202301 - protein, 18 aa, Giardia lamblia
IQIYMRIVRPPWMNGIHG

SEQ ID NO: 3202302 - protein, 26 aa, Giardia lamblia
IQKIEDLILFITFLKETGLWGVKSLV

SEQ ID NO: 3202303 - protein, 17 aa, Giardia lamblia
IQNLEFVRLYLSNTFEK

SEQ ID NO: 3202304 - protein, 17 aa, Giardia lamblia
IQQFKLSSPILSLAVNN

SEQ ID NO: 3202305 - protein, 24 aa, Giardia lamblia
IQRNKLCPLIYLAARFAALFEVSK

SEQ ID NO: 3202306 - protein, 23 aa, Giardia lamblia
IQTIRLLLDLLTDYICKTYPVDN

SEQ ID NO: 3202307 - protein, 22 aa, Giardia lamblia
IRDLMASFLLPEIDRRVLISRL

SEQ ID NO: 3202308 - protein, 25 aa, Giardia lamblia
IRENYLLRLLFNLFCNLLTLDPLSS

SEQ ID NO: 3202309 - protein, 20 aa, Giardia lamblia
IRERARLLEAYLYSMHSITF

SEQ ID NO: 3202310 - protein, 20 aa, Giardia lamblia
IRKFWPITCRGIITGGFNWT

SEQ ID NO: 3202311 - protein, 19 aa, Giardia lamblia
IRLSPLFAFDWWFKTRTED

SEQ ID NO: 3202312 - protein, 18 aa, Giardia lamblia
ISCYPYLPNNVFPGQFSG

SEQ ID NO: 3202313 - protein, 19 aa, Giardia lamblia
ISFFCNKGFVLSNYLTIHL

SEQ ID NO: 3202314 - protein, 17 aa, Giardia lamblia
ISFISLFLQWDPQRRCT

SEQ ID NO: 3202315 - protein, 19 aa, Giardia lamblia
ISFISPIFRSGDSFWEENL

SEQ ID NO: 3202316 - protein, 18 aa, Giardia lamblia
ISFKLYYVPFPKEFDSVE

SEQ ID NO: 3202317 - protein, 17 aa, Giardia lamblia
ISFVEFVRLMVTKSRNT

SEQ ID NO: 3202318 - protein, 23 aa, Giardia lamblia
ISGSRPFISYYIELGMDGRRLHI

SEQ ID NO: 3202319 - protein, 25 aa, Giardia lamblia
ISHRTALALLFQFLAQNYSSTLTTD

SEQ ID NO: 3202320 - protein, 24 aa, Giardia lamblia
ISIIKELLKLEVLLLIASDNKVQM

SEQ ID NO: 3202321 - protein, 19 aa, Giardia lamblia
ISIRAPLDFLFEKSPVHDT

SEQ ID NO: 3202322 - protein, 19 aa, Giardia lamblia
ISLELLIPCFVRLLIAYKS

SEQ ID NO: 3202323 - protein, 25 aa, Giardia lamblia
ISPTNADLLPLLESLAHILEDATKN

SEQ ID NO: 3202324 - protein, 17 aa, Giardia lamblia
ISRFDILFVIRDKIHEE

SEQ ID NO: 3202325 - protein, 24 aa, Giardia lamblia
ISRPRLRGFYRPLNSYYAVNCLLY

SEQ ID NO: 3202326 - protein, 22 aa, Giardia lamblia
ISRVFTMLLLFVKNQINLCFFD

SEQ ID NO: 3202327 - protein, 23 aa, Giardia lamblia
ISRVYFFYFNFHFTISPLDPSQQ

SEQ ID NO: 3202328 - protein, 18 aa, Giardia lamblia
ISSFLYKHRFGPYFISPI

SEQ ID NO: 3202329 - protein, 20 aa, Giardia lamblia
ISSSPFWDYLFDSQFRFQSC

SEQ ID NO: 3202330 - protein, 29 aa, Giardia lamblia
ISTILVEYIVLLLERIWLQRSRITLDTDV

SEQ ID NO: 3202331 - protein, 21 aa, Giardia lamblia
ISVFLILDRTLMHPGLVRLEN

SEQ ID NO: 3202332 - protein, 17 aa, Giardia lamblia
ITDAYPLSFKFLMELYT

SEQ ID NO: 3202333 - protein, 24 aa, Giardia lamblia
ITDLWKLLLALILSSAFEKSPSEQ

SEQ ID NO: 3202334 - protein, 28 aa, Giardia lamblia
ITDWIKASPWYLLILTFVPVNKYKMLEH

SEQ ID NO: 3202335 - protein, 26 aa, Giardia lamblia
ITGINQRLYFQFPALPVVSPKLLELI

SEQ ID NO: 3202336 - protein, 20 aa, Giardia lamblia
ITLVQLLAMARYLSSLKLSN

SEQ ID NO: 3202337 - protein, 17 aa, Giardia lamblia
ITPLKRPDSKYLKMVRG

SEQ ID NO: 3202338 - protein, 25 aa, Giardia lamblia
ITQTDIPIIWLYRGSWNRFTLGEAS

SEQ ID NO: 3202339 - protein, 17 aa, Giardia lamblia
IVAVWSWLPRQHKWQDI

SEQ ID NO: 3202340 - protein, 21 aa, Giardia lamblia
IVIEHFLVTRLLINITKHVLV

SEQ ID NO: 3202341 - protein, 22 aa, Giardia lamblia
IVIPRLYLMALAASIWLEHLNN

SEQ ID NO: 3202342 - protein, 21 aa, Giardia lamblia
IVISLGFSGIFRPDDIRQAIR

SEQ ID NO: 3202343 - protein, 24 aa, Giardia lamblia
IVKPPEAWFWYPITSRLCRTALDK

SEQ ID NO: 3202344 - protein, 17 aa, Giardia lamblia
IVPVPMYLENHVRFGRL

SEQ ID NO: 3202345 - protein, 17 aa, Giardia lamblia
IVQSFNIIRLPPRPVKK

SEQ ID NO: 3202346 - protein, 17 aa, Giardia lamblia
IVVPLLFEKGVMVSSYN

SEQ ID NO: 3202347 - protein, 24 aa, Giardia lamblia
IVVRRLMSIGTRPDYLPLLSALLP

SEQ ID NO: 3202348 - protein, 24 aa, Giardia lamblia
IVYLRRAVRFLAGKLKLGVIVDGE

SEQ ID NO: 3202349 - protein, 22 aa, Giardia lamblia
IWCCGLILYELLTAKPAFTVAK

SEQ ID NO: 3202350 - protein, 23 aa, Giardia lamblia
IWSLGIMLYAMLIGKLPFPSDNY

SEQ ID NO: 3202351 - protein, 18 aa, Giardia lamblia
IWTYRYFVEPWPTLTIFA

SEQ ID NO: 3202352 - protein, 18 aa, Giardia lamblia
IWVFRYYFLPKVEDWGWY

SEQ ID NO: 3202353 - protein, 26 aa, Giardia lamblia
IYENWRDYFLFLYNVKGHDIPANVVE

SEQ ID NO: 3202354 - protein, 17 aa, Giardia lamblia
IYIPLPDYPSRVAVLKA

SEQ ID NO: 3202355 - protein, 19 aa, Giardia lamblia
IYMSHWILGWRPVLESWVA

SEQ ID NO: 3202356 - protein, 19 aa, Giardia lamblia
IYRLPFYYRFNINKQTMRC

SEQ ID NO: 3202357 - protein, 18 aa, Giardia lamblia
IYTAIKKYSPRLPVLIFV

SEQ ID NO: 3202358 - protein, 24 aa, Giardia lamblia
KAEAALYPHLRFPNVTSAPSTPRG

SEQ ID NO: 3202359 - protein, 17 aa, Giardia lamblia
KAIRWNAIDMIEVLLRE

SEQ ID NO: 3202360 - protein, 21 aa, Giardia lamblia
KALCDFHVLFPLLQDIRSVVA

SEQ ID NO: 3202361 - protein, 35 aa, Giardia lamblia
KALKFLEKYMSSLALLFRKIPVQILYINKKVHLVI

SEQ ID NO: 3202362 - protein, 21 aa, Giardia lamblia
KALLPIVCLLWNRARLEPSST

SEQ ID NO: 3202363 - protein, 25 aa, Giardia lamblia
KALQHPWLCDPLPHIVPLSGTQSQL

SEQ ID NO: 3202364 - protein, 25 aa, Giardia lamblia
KAMRLPVYLSLLTPSGPFGTIFADA

SEQ ID NO: 3202365 - protein, 17 aa, Giardia lamblia
KANFYLFPPISQNQLLE

SEQ ID NO: 3202366 - protein, 17 aa, Giardia lamblia
KAPVRIVLSKRGIPITS

SEQ ID NO: 3202367 - protein, 20 aa, Giardia lamblia
KASFTFLPQNRFPGGAGPVN

SEQ ID NO: 3202368 - protein, 18 aa, Giardia lamblia
KASGKMIQWFKERPKDMP

SEQ ID NO: 3202369 - protein, 21 aa, Giardia lamblia
KASLAIIKLLVPLEAGVVDFS

SEQ ID NO: 3202370 - protein, 19 aa, Giardia lamblia
KCMEPTIFKALFPASVGLW

SEQ ID NO: 3202371 - protein, 18 aa, Giardia lamblia
KCTSDVLAIPLKITPFLS

SEQ ID NO: 3202372 - protein, 21 aa, Giardia lamblia
KDIIFTMWMGYDISKSLMALF

SEQ ID NO: 3202373 - protein, 20 aa, Giardia lamblia
KDIKMHFVSWYKQAATAVAS

SEQ ID NO: 3202374 - protein, 18 aa, Giardia lamblia
KDMTRLHAYLAQQLKAAA

SEQ ID NO: 3202375 - protein, 24 aa, Giardia lamblia
KDPIYVYLSCLYLPGTPKYSVAQE

SEQ ID NO: 3202376 - protein, 20 aa, Giardia lamblia
KDPTFKFLMKDLLIATESFS

SEQ ID NO: 3202377 - protein, 23 aa, Giardia lamblia
KEAGLFHLKGHSALLLAARSNYH

SEQ ID NO: 3202378 - protein, 24 aa, Giardia lamblia
KEFDYAPYIPEFLSYPAKGDRQDW

SEQ ID NO: 3202379 - protein, 19 aa, Giardia lamblia
KEFITLGVRLAQLANRRSY

SEQ ID NO: 3202380 - protein, 23 aa, Giardia lamblia
KEGRWLQFLLAIKGLHDAQKDFN

SEQ ID NO: 3202381 - protein, 17 aa, Giardia lamblia
KEPRLMDLYLTLPIIRF

SEQ ID NO: 3202382 - protein, 23 aa, Giardia lamblia
KERTYLLYRNLLWRIHIFVNDCP

SEQ ID NO: 3202383 - protein, 18 aa, Giardia lamblia
KETEIIDYFFPKSELAEE

SEQ ID NO: 3202384 - protein, 19 aa, Giardia lamblia
KFEKDFMRLIESIESSKRA

SEQ ID NO: 3202385 - protein, 17 aa, Giardia lamblia
KFFIGLVMCGAWSCFDE

SEQ ID NO: 3202386 - protein, 18 aa, Giardia lamblia
KFFVTFPYPYMNGRLHLG

SEQ ID NO: 3202387 - protein, 17 aa, Giardia lamblia
KFKVLTIQLSSLANACR

SEQ ID NO: 3202388 - protein, 19 aa, Giardia lamblia
KFLPAFITLFPVLMSSRSS

SEQ ID NO: 3202389 - protein, 22 aa, Giardia lamblia
KFSLQLLIAFAYARKLRIIHAD

SEQ ID NO: 3202390 - protein, 20 aa, Giardia lamblia
KFTALILACYHGRLKAATIL

SEQ ID NO: 3202391 - protein, 18 aa, Giardia lamblia
KFTLDILGQLARGAQHIC

SEQ ID NO: 3202392 - protein, 18 aa, Giardia lamblia
KGLLSFQNQRLPLSTARP

SEQ ID NO: 3202393 - protein, 23 aa, Giardia lamblia
KGYKKLIRLLLQLEAKIHDKHGL

SEQ ID NO: 3202394 - protein, 25 aa, Giardia lamblia
KHQETLDLLFFELLTRTLLMKQASL

SEQ ID NO: 3202395 - protein, 21 aa, Giardia lamblia
KHTWPRFIYLLFRGSLPVYVS

SEQ ID NO: 3202396 - protein, 19 aa, Giardia lamblia
KHWDVARILYPLESHLLPE

SEQ ID NO: 3202397 - protein, 18 aa, Giardia lamblia
KIDFVPYLAPLLAQKCDD

SEQ ID NO: 3202398 - protein, 18 aa, Giardia lamblia
KIDQALLLELNPLEAAQS

SEQ ID NO: 3202399 - protein, 20 aa, Giardia lamblia
KIKEYLVKLFELIGSEKRAM

SEQ ID NO: 3202400 - protein, 24 aa, Giardia lamblia
KIKQQHYLILQLQNKLNPSTGVPS

SEQ ID NO: 3202401 - protein, 17 aa, Giardia lamblia
KILLPYEAGIRVLDDKD

SEQ ID NO: 3202402 - protein, 26 aa, Giardia lamblia
KILSIFKRKIISLAMPYEKIAESSEG

SEQ ID NO: 3202403 - protein, 23 aa, Giardia lamblia
KINAQKIPIVPLTGALSGLDAPA

SEQ ID NO: 3202404 - protein, 24 aa, Giardia lamblia
KIQLELLYLFPWLKSAHITEDLLI

SEQ ID NO: 3202405 - protein, 24 aa, Giardia lamblia
KIVGPRLSILRPPRTFYLETIIDL

SEQ ID NO: 3202406 - protein, 17 aa, Giardia lamblia
KKAYFFTLAVWDLEFTY

SEQ ID NO: 3202407 - protein, 21 aa, Giardia lamblia
KKIMILFYQVVDALCYMHFCN

SEQ ID NO: 3202408 - protein, 26 aa, Giardia lamblia
KKKACYHFLVMMYFIGAIHSGTAKNI

SEQ ID NO: 3202409 - protein, 22 aa, Giardia lamblia
KKKNFIRFSFTPDYMKFGMTSG

SEQ ID NO: 3202410 - protein, 19 aa, Giardia lamblia
KKNYLLCLLRLTFHTWLST

SEQ ID NO: 3202411 - protein, 26 aa, Giardia lamblia
KKVAMLPVRILLIDPVLMSADHVAHE

SEQ ID NO: 3202412 - protein, 24 aa, Giardia lamblia
KKVHAVIHMPWFVNPDAGRPKGKR

SEQ ID NO: 3202413 - protein, 17 aa, Giardia lamblia
KKYMLIYALVKLQILRG

SEQ ID NO: 3202414 - protein, 21 aa, Giardia lamblia
KLAIYKVWLARFRTLCLVYRE

SEQ ID NO: 3202415 - protein, 17 aa, Giardia lamblia
KLDQMLCYLLTIPESLL

SEQ ID NO: 3202416 - protein, 20 aa, Giardia lamblia
KLENFITPLKRPDSKYLKMV

SEQ ID NO: 3202417 - protein, 18 aa, Giardia lamblia
KLFIHYYCEFLATHFIRV

SEQ ID NO: 3202418 - protein, 19 aa, Giardia lamblia
KLFLIDRFLGWSQMALCLL

SEQ ID NO: 3202419 - protein, 21 aa, Giardia lamblia
KLFTNTLLRFLINSVSRKNEL

SEQ ID NO: 3202420 - protein, 19 aa, Giardia lamblia
KLIDLFFADYFVDSYEDSD

SEQ ID NO: 3202421 - protein, 23 aa, Giardia lamblia
KLKMRRPLMFLPADSLRITDQAT

SEQ ID NO: 3202422 - protein, 17 aa, Giardia lamblia
KLLLPQYAKDKKHLAEF

SEQ ID NO: 3202423 - protein, 18 aa, Giardia lamblia
KLLTVLVFYDVIIDFVFV

SEQ ID NO: 3202424 - protein, 17 aa, Giardia lamblia
KLLVLQAPYKQFFGTQD

SEQ ID NO: 3202425 - protein, 17 aa, Giardia lamblia
KLRRLFLNLILSYKGYA

SEQ ID NO: 3202426 - protein, 17 aa, Giardia lamblia
KLRTRVIPLSDLLLRLQ

SEQ ID NO: 3202427 - protein, 17 aa, Giardia lamblia
KLSGLMWPKILRYINKE

SEQ ID NO: 3202428 - protein, 26 aa, Giardia lamblia
KLTDIILMPVLYKDLFWKLMRSRSSG

SEQ ID NO: 3202429 - protein, 27 aa, Giardia lamblia
KLTSVHIYWALFGLLFWCTCAKCEQVF

SEQ ID NO: 3202430 - protein, 23 aa, Giardia lamblia
KMNIPNLADFLILFLKRYADLAR

SEQ ID NO: 3202431 - protein, 21 aa, Giardia lamblia
KMPMFHIKLYTFQFLRGLAYM

SEQ ID NO: 3202432 - protein, 21 aa, Giardia lamblia
KNAQLLLYGFVPDESRGVSIL

SEQ ID NO: 3202433 - protein, 17 aa, Giardia lamblia
KNEFMRVFADRLICPED

SEQ ID NO: 3202434 - protein, 27 aa, Giardia lamblia
KNELLRKFLLDKFLFKIVPMVNVDGVI

SEQ ID NO: 3202435 - protein, 19 aa, Giardia lamblia
KNFFPCILKFLYETDETML

SEQ ID NO: 3202436 - protein, 26 aa, Giardia lamblia
KNIQVDVILLLYLLSFGGAVDEVKSD

SEQ ID NO: 3202437 - protein, 19 aa, Giardia lamblia
KNISRFPVRFQWLLQMAQG

SEQ ID NO: 3202438 - protein, 17 aa, Giardia lamblia
KPNQLCYYLFDALFING

SEQ ID NO: 3202439 - protein, 21 aa, Giardia lamblia
KPSWRIPWMEVPVPGVKRFLE

SEQ ID NO: 3202440 - protein, 18 aa, Giardia lamblia
KPWFLALRKRCPVKDLTR

SEQ ID NO: 3202441 - protein, 18 aa, Giardia lamblia
KPWFSFLLDDDSSDVKVD

SEQ ID NO: 3202442 - protein, 22 aa, Giardia lamblia
KQACFLMLVLRFAPLPKVVEMM

SEQ ID NO: 3202443 - protein, 17 aa, Giardia lamblia
KQAKMLPIDQLEYTFTP

SEQ ID NO: 3202444 - protein, 18 aa, Giardia lamblia
KQLILQAIRFRLLTACPE

SEQ ID NO: 3202445 - protein, 20 aa, Giardia lamblia
KQLIMSLYEKYIPPLIDYVL

SEQ ID NO: 3202446 - protein, 17 aa, Giardia lamblia
KQMEIIALQAQLQQVTT

SEQ ID NO: 3202447 - protein, 25 aa, Giardia lamblia
KQPPPPLYFVPLMNRYNILDYQIKT

SEQ ID NO: 3202448 - protein, 23 aa, Giardia lamblia
KQRWKPHYIFIKITTSSKIMTDS

SEQ ID NO: 3202449 - protein, 29 aa, Giardia lamblia
KRAYAERLAWFLLLRTRFIGLLSARDQYV

SEQ ID NO: 3202450 - protein, 19 aa, Giardia lamblia
KRDLTLPPLFMVIRSFDVN

SEQ ID NO: 3202451 - protein, 19 aa, Giardia lamblia
KRISLLVLHFLLLENTAAA

SEQ ID NO: 3202452 - protein, 17 aa, Giardia lamblia
KRKRKFLLEIFLSRVDP

SEQ ID NO: 3202453 - protein, 22 aa, Giardia lamblia
KRLAFPRFFFLSNDELLQILAQ

SEQ ID NO: 3202454 - protein, 22 aa, Giardia lamblia
KRLTRYLMPYPHTSEFVRRRAA

SEQ ID NO: 3202455 - protein, 23 aa, Giardia lamblia
KRLVPYEMNLVLPDGRTPLMLAA

SEQ ID NO: 3202456 - protein, 19 aa, Giardia lamblia
KRQFLLFDHLNGILYILLG

SEQ ID NO: 3202457 - protein, 21 aa, Giardia lamblia
KRRAKALTACSPRRLSFVSSS

SEQ ID NO: 3202458 - protein, 23 aa, Giardia lamblia
KRVTLIFFKLYYLNKIANIGTSN

SEQ ID NO: 3202459 - protein, 25 aa, Giardia lamblia
KRYDRWYLSIRWLMYSFMCPCLVSR

SEQ ID NO: 3202460 - protein, 21 aa, Giardia lamblia
KSASWMYLSRLAAVREFGFMV

SEQ ID NO: 3202461 - protein, 25 aa, Giardia lamblia
KSAYRIWWLLNFFSHPKVSIYPGGL

SEQ ID NO: 3202462 - protein, 26 aa, Giardia lamblia
KSNKVHFFSFDWNIPSFLTLPKITRQ

SEQ ID NO: 3202463 - protein, 23 aa, Giardia lamblia
KSNVFASYKEVWMQQTRLRKLEA

SEQ ID NO: 3202464 - protein, 17 aa, Giardia lamblia
KSPIIIFFGVAYKMLIT

SEQ ID NO: 3202465 - protein, 21 aa, Giardia lamblia
KSTIQYPYLHTFFSPASGLSS

SEQ ID NO: 3202466 - protein, 26 aa, Giardia lamblia
KTAICFKTIYLLIPPRMVLGQAHQLD

SEQ ID NO: 3202467 - protein, 22 aa, Giardia lamblia
KTALKYIKSFYYNDFRSLQSEE

SEQ ID NO: 3202468 - protein, 17 aa, Giardia lamblia
KTFTPFLSSILIEFSKV

SEQ ID NO: 3202469 - protein, 21 aa, Giardia lamblia
KTIPLLCPFLKRKSISIPAQI

SEQ ID NO: 3202470 - protein, 20 aa, Giardia lamblia
KTKHIVFCDDKRIDISRRET

SEQ ID NO: 3202471 - protein, 23 aa, Giardia lamblia
KTKTGFIFALRFSPSLWTRSMER

SEQ ID NO: 3202472 - protein, 19 aa, Giardia lamblia
KTLFEMILSADYWLKFTTV

SEQ ID NO: 3202473 - protein, 18 aa, Giardia lamblia
KTLNLLITAGRKNKTAIA

SEQ ID NO: 3202474 - protein, 25 aa, Giardia lamblia
KTRDRKLIRQVWALEKFGLRLSGMR

SEQ ID NO: 3202475 - protein, 21 aa, Giardia lamblia
KTRNDHFPLLSDPKLPHTREN

SEQ ID NO: 3202476 - protein, 24 aa, Giardia lamblia
KTYLSIFLLDRFLCSIYGSFRHFL

SEQ ID NO: 3202477 - protein, 23 aa, Giardia lamblia
KVGLRLLLFQYDLYLRNTYTDLP

SEQ ID NO: 3202478 - protein, 25 aa, Giardia lamblia
KVIEPFYYAPILPMVLINGSDGIGT

SEQ ID NO: 3202479 - protein, 23 aa, Giardia lamblia
KWSSGIWAFDFPSPLLIATCTQR

SEQ ID NO: 3202480 - protein, 23 aa, Giardia lamblia
KYFPIDEGYLQRLQYEISAIRRY

SEQ ID NO: 3202481 - protein, 22 aa, Giardia lamblia
KYGLRLNLLPNAPPLMHESLLL

SEQ ID NO: 3202482 - protein, 20 aa, Giardia lamblia
KYGWTALIWAIDNNNIECVR

SEQ ID NO: 3202483 - protein, 27 aa, Giardia lamblia
KYMDNFEFFQWFKWFFDQNYKGSKSGA

SEQ ID NO: 3202484 - protein, 30 aa, Giardia lamblia
KYPVEIALKLYYYDACFILLMLHPDKSFEN

SEQ ID NO: 3202485 - protein, 29 aa, Giardia lamblia
KYQPFPHKPFKIPHYPPFKPGARGGAYTN

SEQ ID NO: 3202486 - protein, 18 aa, Giardia lamblia
LAELQRVCPLLAASPEVC

SEQ ID NO: 3202487 - protein, 18 aa, Giardia lamblia
LAERLYIAGYISYPRTES

SEQ ID NO: 3202488 - protein, 21 aa, Giardia lamblia
LAESIAFPRLANLLPRSRTKD

SEQ ID NO: 3202489 - protein, 17 aa, Giardia lamblia
LAFLPVPCPASIKCYSV

SEQ ID NO: 3202490 - protein, 24 aa, Giardia lamblia
LAGYEWFLLQYQLSIFRLAKTQIT

SEQ ID NO: 3202491 - protein, 17 aa, Giardia lamblia
LAILLYDRLKGSQGGAF

SEQ ID NO: 3202492 - protein, 20 aa, Giardia lamblia
LAILYCKYMWIVRKTDPQRL

SEQ ID NO: 3202493 - protein, 24 aa, Giardia lamblia
LAPPVVHHILLNSGLLRSYSAILS

SEQ ID NO: 3202494 - protein, 17 aa, Giardia lamblia
LARRIIKLIQPLYEYSV

SEQ ID NO: 3202495 - protein, 23 aa, Giardia lamblia
LASLKLLDLLAWNKYCVLSRSKG

SEQ ID NO: 3202496 - protein, 20 aa, Giardia lamblia
LASLLYLHASAIHATLAFVT

SEQ ID NO: 3202497 - protein, 18 aa, Giardia lamblia
LASMAVFLWKSPALMLQP

SEQ ID NO: 3202498 - protein, 23 aa, Giardia lamblia
LATDSFVFSVPFLAITGIACDAI

SEQ ID NO: 3202499 - protein, 17 aa, Giardia lamblia
LATLLLIEGGIYRKDGW

SEQ ID NO: 3202500 - protein, 18 aa, Giardia lamblia
LAWQYPRRVASPRELVAL

SEQ ID NO: 3202501 - protein, 23 aa, Giardia lamblia
LAYRKILTLAIEKLLFFKHLITM

SEQ ID NO: 3202502 - protein, 18 aa, Giardia lamblia
LCDLCAWFGRGRLNWESP

SEQ ID NO: 3202503 - protein, 24 aa, Giardia lamblia
LCDNLGILRLLLTRDFTMEQVLQA

SEQ ID NO: 3202504 - protein, 22 aa, Giardia lamblia
LCEFRLKLLPKSGGRWRPIAVQ

SEQ ID NO: 3202505 - protein, 18 aa, Giardia lamblia
LCGFLGPTHLRALALFAQ

SEQ ID NO: 3202506 - protein, 23 aa, Giardia lamblia
LCINFLEFYRYYGTFPIIGAEDI

SEQ ID NO: 3202507 - protein, 21 aa, Giardia lamblia
LCLALLKGNMPVAKFLTPYEG

SEQ ID NO: 3202508 - protein, 18 aa, Giardia lamblia
LCLHALMLSIPNLSGLPL

SEQ ID NO: 3202509 - protein, 22 aa, Giardia lamblia
LDAFNFPSWCGLALSLSSMLAS

SEQ ID NO: 3202510 - protein, 21 aa, Giardia lamblia
LDAWLKFRPDFKTFLLARDTM

SEQ ID NO: 3202511 - protein, 19 aa, Giardia lamblia
LDCWSVGAIMWYLVKLEYP

SEQ ID NO: 3202512 - protein, 25 aa, Giardia lamblia
LDFMSPLLMPVIKRWVNYYTSTKKN

SEQ ID NO: 3202513 - protein, 18 aa, Giardia lamblia
LDISLLRLMHKLCPLIED

SEQ ID NO: 3202514 - protein, 18 aa, Giardia lamblia
LDKEAELVDIRRAYDKLS

SEQ ID NO: 3202515 - protein, 26 aa, Giardia lamblia
LDMMIHKILSFQLYLLARIGPDDLKQ

SEQ ID NO: 3202516 - protein, 21 aa, Giardia lamblia
LDNDYMRMFRSAKITADCLKD

SEQ ID NO: 3202517 - protein, 26 aa, Giardia lamblia
LDSQSLLLFLLQVSPLRSLIKATGSA

SEQ ID NO: 3202518 - protein, 18 aa, Giardia lamblia
LDTNAFLRRMAFWEIGES

SEQ ID NO: 3202519 - protein, 18 aa, Giardia lamblia
LDTSLSELLIFLGDADKF

SEQ ID NO: 3202520 - protein, 18 aa, Giardia lamblia
LDVPFFPPPGFVSEMYRP

SEQ ID NO: 3202521 - protein, 24 aa, Giardia lamblia
LDVSSCIPILLPYLSDCRRDDSVT

SEQ ID NO: 3202522 - protein, 24 aa, Giardia lamblia
LDVTQILLPYFDLSPDSNGLTPID

SEQ ID NO: 3202523 - protein, 24 aa, Giardia lamblia
LDVVNLLPYFYYKQGETITLAQLP

SEQ ID NO: 3202524 - protein, 21 aa, Giardia lamblia
LECIILLLCYKIKYPENFFML

SEQ ID NO: 3202525 - protein, 17 aa, Giardia lamblia
LEDLLNQKLEHLLEADP

SEQ ID NO: 3202526 - protein, 23 aa, Giardia lamblia
LEHDFMIILRYILCPPSQDATHH

SEQ ID NO: 3202527 - protein, 18 aa, Giardia lamblia
LEHVPLPIFIRYLGANHS

SEQ ID NO: 3202528 - protein, 20 aa, Giardia lamblia
LEIIPPYYEIFLTSLGYPGT

SEQ ID NO: 3202529 - protein, 40 aa, Giardia lamblia
LEIPLSVRPLIPGPLYIPLSIKIGYLERLILPITAKAYIE

SEQ ID NO: 3202530 - protein, 23 aa, Giardia lamblia
LEKQLHWIHILTIRLRSVRRAAQ

SEQ ID NO: 3202531 - protein, 18 aa, Giardia lamblia
LELLLCEVGVFLNKHISH

SEQ ID NO: 3202532 - protein, 24 aa, Giardia lamblia
LELSYYLPGVYAPILRILFTAVPI

SEQ ID NO: 3202533 - protein, 19 aa, Giardia lamblia
LELVLWLPTLCHKMGVPYA

SEQ ID NO: 3202534 - protein, 25 aa, Giardia lamblia
LEMAMLVELYVQDLTLLGLFCQYIT

SEQ ID NO: 3202535 - protein, 22 aa, Giardia lamblia
LENQYQKIFLFKAIFDEIIDKA

SEQ ID NO: 3202536 - protein, 19 aa, Giardia lamblia
LEPIDIGVLLSKRFNMSPH

SEQ ID NO: 3202537 - protein, 25 aa, Giardia lamblia
LEPKLQRMFKLVRPLLPIRFVDAVT

SEQ ID NO: 3202538 - protein, 17 aa, Giardia lamblia
LERFIAKAWLLRNGTRL

SEQ ID NO: 3202539 - protein, 17 aa, Giardia lamblia
LERHLADLRLSRQDTNS

SEQ ID NO: 3202540 - protein, 18 aa, Giardia lamblia
LERIGWLEPTAIQKEMLT

SEQ ID NO: 3202541 - protein, 24 aa, Giardia lamblia
LERLFKYCINFYAAFLILELWCYY

SEQ ID NO: 3202542 - protein, 27 aa, Giardia lamblia
LESLPFSRPFMVLAFPLLWCLNGEYIS

SEQ ID NO: 3202543 - protein, 23 aa, Giardia lamblia
LETITLLLCYKINYPNDIFLIRG

SEQ ID NO: 3202544 - protein, 25 aa, Giardia lamblia
LETITLLYLLKLMYPTQIYLIRGNH

SEQ ID NO: 3202545 - protein, 17 aa, Giardia lamblia
LEVFVYLEHLYLAAGDD

SEQ ID NO: 3202546 - protein, 20 aa, Giardia lamblia
LEWILTVLDIFFPAKIRQIF

SEQ ID NO: 3202547 - protein, 17 aa, Giardia lamblia
LFATNICFIFFSLSHHC

SEQ ID NO: 3202548 - protein, 19 aa, Giardia lamblia
LFFSLICEISWSDSSLIAG

SEQ ID NO: 3202549 - protein, 19 aa, Giardia lamblia
LFGRLSFSSLTLHILCDYV

SEQ ID NO: 3202550 - protein, 17 aa, Giardia lamblia
LFHAFLEMKVRALTFIN

SEQ ID NO: 3202551 - protein, 19 aa, Giardia lamblia
LFIFITTYADRMNVKLVLA

SEQ ID NO: 3202552 - protein, 19 aa, Giardia lamblia
LFILLITAFLKDVAIVYNS

SEQ ID NO: 3202553 - protein, 18 aa, Giardia lamblia
LFKQLLIDLGSLGSTQGF

SEQ ID NO: 3202554 - protein, 20 aa, Giardia lamblia
LFNPPIILVPGVCGSLLVAD

SEQ ID NO: 3202555 - protein, 25 aa, Giardia lamblia
LFPAAYFCALFWRYYENLKGNKDKS

SEQ ID NO: 3202556 - protein, 17 aa, Giardia lamblia
LFPLAIGATAAIPGGFG

SEQ ID NO: 3202557 - protein, 17 aa, Giardia lamblia
LFQLLPRPDVRIGLQSL

SEQ ID NO: 3202558 - protein, 20 aa, Giardia lamblia
LFRTFLLVLQKDVPFTVLSA

SEQ ID NO: 3202559 - protein, 17 aa, Giardia lamblia
LFSVILFKKDQQRCLDY

SEQ ID NO: 3202560 - protein, 23 aa, Giardia lamblia
LGATLYEFFTLTPLTYLSQLESA

SEQ ID NO: 3202561 - protein, 20 aa, Giardia lamblia
LGDPLVLLRLLIQQGSWSQV

SEQ ID NO: 3202562 - protein, 24 aa, Giardia lamblia
LGESPLVILDKLRASLRVLLAFKE

SEQ ID NO: 3202563 - protein, 17 aa, Giardia lamblia
LGGLSLPTAFLTALQQQ

SEQ ID NO: 3202564 - protein, 17 aa, Giardia lamblia
LGILLQLLGGIKKITRS

SEQ ID NO: 3202565 - protein, 21 aa, Giardia lamblia
LGITLYEICSFRLPYPSPTID

SEQ ID NO: 3202566 - protein, 22 aa, Giardia lamblia
LGLLMPGFYHDELRRVWASLDV

SEQ ID NO: 3202567 - protein, 18 aa, Giardia lamblia
LGPFLWDPYCYYHQDLKA

SEQ ID NO: 3202568 - protein, 24 aa, Giardia lamblia
LGPPPLLHLLGIRQLSDMPTSAHR

SEQ ID NO: 3202569 - protein, 24 aa, Giardia lamblia
LGRAPLHYAVLSRAPHVVQLILQY

SEQ ID NO: 3202570 - protein, 17 aa, Giardia lamblia
LGRLRDIYKLSLALEDA

SEQ ID NO: 3202571 - protein, 24 aa, Giardia lamblia
LGRNEFILYLLPFENGREINGATA

SEQ ID NO: 3202572 - protein, 18 aa, Giardia lamblia
LGRPIYVLDLLSQYLDFS

SEQ ID NO: 3202573 - protein, 28 aa, Giardia lamblia
LGRTAMMYLVMFPRHSTLVLLEECIGYL

SEQ ID NO: 3202574 - protein, 18 aa, Giardia lamblia
LGVMLYRMMYFTLPFPDG

SEQ ID NO: 3202575 - protein, 18 aa, Giardia lamblia
LHLGALFTSLGALRKKRL

SEQ ID NO: 3202576 - protein, 19 aa, Giardia lamblia
LHLIPNIQRSLFLLSNRQC

SEQ ID NO: 3202577 - protein, 18 aa, Giardia lamblia
LHMLNWSPYIRYTSDQCL

SEQ ID NO: 3202578 - protein, 18 aa, Giardia lamblia
LHNNYLCIPPLLRYERSI

SEQ ID NO: 3202579 - protein, 19 aa, Giardia lamblia
LHQLAMQLLIYKNEKFYNS

SEQ ID NO: 3202580 - protein, 25 aa, Giardia lamblia
LHTELPLNTFLLSTIDHDLPSTLPF

SEQ ID NO: 3202581 - protein, 24 aa, Giardia lamblia
LHVPITCYPRQIAILILKNLELVR

SEQ ID NO: 3202582 - protein, 17 aa, Giardia lamblia
LICTVLPLFPRGDLARF

SEQ ID NO: 3202583 - protein, 17 aa, Giardia lamblia
LIDKYDWIPQRSAAIPA

SEQ ID NO: 3202584 - protein, 25 aa, Giardia lamblia
LIDYEAFLGLFAFKGDIPPEAERGT

SEQ ID NO: 3202585 - protein, 20 aa, Giardia lamblia
LIHLCPYIYVFGTFAKKRWY

SEQ ID NO: 3202586 - protein, 18 aa, Giardia lamblia
LIHLLRVMLSWDARKRFS

SEQ ID NO: 3202587 - protein, 18 aa, Giardia lamblia
LILFLKRYADLARSKEFF

SEQ ID NO: 3202588 - protein, 20 aa, Giardia lamblia
LIPELLPVGEMYFLNIIRIP

SEQ ID NO: 3202589 - protein, 22 aa, Giardia lamblia
LIPFEKGVFLPDGRTPLMLAVE

SEQ ID NO: 3202590 - protein, 17 aa, Giardia lamblia
LIQYSYMLEIPADQLYI

SEQ ID NO: 3202591 - protein, 17 aa, Giardia lamblia
LIRAIRWSRPEAVQELV

SEQ ID NO: 3202592 - protein, 18 aa, Giardia lamblia
LIREGRLPHMIFYGKPGT

SEQ ID NO: 3202593 - protein, 19 aa, Giardia lamblia
LIRNPPALPPLSLLVSAKT

SEQ ID NO: 3202594 - protein, 18 aa, Giardia lamblia
LIVFNPLTKDALVKIFRS

SEQ ID NO: 3202595 - protein, 19 aa, Giardia lamblia
LIYLTLLPDCSVRAFVCSF

SEQ ID NO: 3202596 - protein, 22 aa, Giardia lamblia
LKALRFEYLTKEQLRKLLVVRD

SEQ ID NO: 3202597 - protein, 20 aa, Giardia lamblia
LKDPLLRFWSVYGGSLNTAH

SEQ ID NO: 3202598 - protein, 17 aa, Giardia lamblia
LKDTGFMALLKFSERHS

SEQ ID NO: 3202599 - protein, 20 aa, Giardia lamblia
LKFFLQHRMLLQDDLEAARI

SEQ ID NO: 3202600 - protein, 24 aa, Giardia lamblia
LKHLQICWHFYLKPAIMKTTFTDL

SEQ ID NO: 3202601 - protein, 22 aa, Giardia lamblia
LKNLCRIFSWIFALDLPKTMLK

SEQ ID NO: 3202602 - protein, 21 aa, Giardia lamblia
LKPASYWWFDGLVQETYVMEH

SEQ ID NO: 3202603 - protein, 21 aa, Giardia lamblia
LKQLGLFTVLCFCVLLQDAEA

SEQ ID NO: 3202604 - protein, 19 aa, Giardia lamblia
LKRSFLLIQSWCLYEARIV

SEQ ID NO: 3202605 - protein, 18 aa, Giardia lamblia
LKSYWLGGLSLPTAFLTA

SEQ ID NO: 3202606 - protein, 19 aa, Giardia lamblia
LKTNPYLLSRRLFGEQSAC

SEQ ID NO: 3202607 - protein, 20 aa, Giardia lamblia
LKYRLAQMLLYDKSIPKPTV

SEQ ID NO: 3202608 - protein, 17 aa, Giardia lamblia
LLAILEQGDYEALDALH

SEQ ID NO: 3202609 - protein, 17 aa, Giardia lamblia
LLCLKLCFPDRVFLLRG

SEQ ID NO: 3202610 - protein, 17 aa, Giardia lamblia
LLDIWILILQLDLNDKM

SEQ ID NO: 3202611 - protein, 26 aa, Giardia lamblia
LLDLLFRITHFYSHPSYFARILEASA

SEQ ID NO: 3202612 - protein, 19 aa, Giardia lamblia
LLDMLLDAIKLRTMSRHKL

SEQ ID NO: 3202613 - protein, 18 aa, Giardia lamblia
LLDRRYLIIQPAALSKYV

SEQ ID NO: 3202614 - protein, 18 aa, Giardia lamblia
LLEEAVVLPMLLPDFFTG

SEQ ID NO: 3202615 - protein, 23 aa, Giardia lamblia
LLETESLWYPAASVLYSRTSLSG

SEQ ID NO: 3202616 - protein, 17 aa, Giardia lamblia
LLFCFMHRDLDPDKLLA

SEQ ID NO: 3202617 - protein, 22 aa, Giardia lamblia
LLFKKLARLIPFKGFAGPNGLL

SEQ ID NO: 3202618 - protein, 17 aa, Giardia lamblia
LLGFWKQTQTILGMDDM

SEQ ID NO: 3202619 - protein, 20 aa, Giardia lamblia
LLGHLEEPFTRLPLEGNLES

SEQ ID NO: 3202620 - protein, 17 aa, Giardia lamblia
LLGIYMKNVWPAAAIMH

SEQ ID NO: 3202621 - protein, 18 aa, Giardia lamblia
LLGMITICGSTLCEDDQY

SEQ ID NO: 3202622 - protein, 20 aa, Giardia lamblia
LLGMPFLRMHRMVIDLAIYQ

SEQ ID NO: 3202623 - protein, 20 aa, Giardia lamblia
LLLSPPLRQTLVQTLILFVK

SEQ ID NO: 3202624 - protein, 19 aa, Giardia lamblia
LLMKRFLSVFVLSTRTARY

SEQ ID NO: 3202625 - protein, 25 aa, Giardia lamblia
LLNQALIQYALKFLTDRGYQAMQTP

SEQ ID NO: 3202626 - protein, 20 aa, Giardia lamblia
LLPIIIPSVPPRRPSLAQQL

SEQ ID NO: 3202627 - protein, 19 aa, Giardia lamblia
LLPLLGTVVPAPVATTPFP

SEQ ID NO: 3202628 - protein, 35 aa, Giardia lamblia
LLPSAKNLYYVLFYYTIFELLRQPFSKLRAILVSQ

SEQ ID NO: 3202629 - protein, 24 aa, Giardia lamblia
LLQRLEIDPFFYAMSALNLYDDGE

SEQ ID NO: 3202630 - protein, 17 aa, Giardia lamblia
LLRVHYYKRKPRIARMS

SEQ ID NO: 3202631 - protein, 19 aa, Giardia lamblia
LLSQIYYRSIDTEDYYLKF

SEQ ID NO: 3202632 - protein, 17 aa, Giardia lamblia
LMAWMRKSDMRFSEQEV

SEQ ID NO: 3202633 - protein, 18 aa, Giardia lamblia
LMDKLMLVDLPKAAEALN

SEQ ID NO: 3202634 - protein, 18 aa, Giardia lamblia
LMDLYLTLPIIRFKPQEA

SEQ ID NO: 3202635 - protein, 26 aa, Giardia lamblia
LMERFDKLLQICMWFQREYGKSSNVI

SEQ ID NO: 3202636 - protein, 22 aa, Giardia lamblia
LMGAALNLPWLVQAILDSVPEA

SEQ ID NO: 3202637 - protein, 18 aa, Giardia lamblia
LMHDLVRNRILLADAKKL

SEQ ID NO: 3202638 - protein, 22 aa, Giardia lamblia
LMISVRLRLTPITKFLAAKESG

SEQ ID NO: 3202639 - protein, 20 aa, Giardia lamblia
LMKPLFFTVFPRVFTRNTSY

SEQ ID NO: 3202640 - protein, 17 aa, Giardia lamblia
LMLSFCFIIRNAVRRAK

SEQ ID NO: 3202641 - protein, 17 aa, Giardia lamblia
LMNDLLHRCSHAWRAAG

SEQ ID NO: 3202642 - protein, 18 aa, Giardia lamblia
LMPSLLPPHATGGVKRPA

SEQ ID NO: 3202643 - protein, 17 aa, Giardia lamblia
LMQSSFYDLYPYYRPGK

SEQ ID NO: 3202644 - protein, 21 aa, Giardia lamblia
LMRGLFLMPDGEEFIYAAGSH

SEQ ID NO: 3202645 - protein, 25 aa, Giardia lamblia
LMSMKILLNILLRRTFESSLGMLNI

SEQ ID NO: 3202646 - protein, 18 aa, Giardia lamblia
LMTILQLKHILLHPSLRY

SEQ ID NO: 3202647 - protein, 18 aa, Giardia lamblia
LMVSLLDPALSPHGSRSL

SEQ ID NO: 3202648 - protein, 25 aa, Giardia lamblia
LNDHDILLLFKRYFSMGTLPNVLSD

SEQ ID NO: 3202649 - protein, 23 aa, Giardia lamblia
LNDHHLLLKLPFSYTIESMIERI

SEQ ID NO: 3202650 - protein, 25 aa, Giardia lamblia
LNKLSYWLLFAFFVLNERLTASSRI

SEQ ID NO: 3202651 - protein, 27 aa, Giardia lamblia
LNKYIDRLAILSYYHQLYKELFAAREK

SEQ ID NO: 3202652 - protein, 25 aa, Giardia lamblia
LNPLLSRRIPLPNKILVFIAPFTAI

SEQ ID NO: 3202653 - protein, 24 aa, Giardia lamblia
LNSYRYLLRNVYSTGLFQLYELPS

SEQ ID NO: 3202654 - protein, 17 aa, Giardia lamblia
LNTIWRPYDQELINSCV

SEQ ID NO: 3202655 - protein, 19 aa, Giardia lamblia
LNTYFYTNRFFIPQPNRLA

SEQ ID NO: 3202656 - protein, 19 aa, Giardia lamblia
LNWSFLAQPTLALAASGLP

SEQ ID NO: 3202657 - protein, 20 aa, Giardia lamblia
LPARAIIFSEFKKFDGLTSR

SEQ ID NO: 3202658 - protein, 32 aa, Giardia lamblia
LPFPQMDIYPRLLLLLTLVSMKIKLSEGFFAF

SEQ ID NO: 3202659 - protein, 21 aa, Giardia lamblia
LPPEFVLLDLKVYHPYIEGLT

SEQ ID NO: 3202660 - protein, 37 aa, Giardia lamblia
LPSHKGILASWYFENFLLQYLHRLLVWITDEMGADPQ

SEQ ID NO: 3202661 - protein, 17 aa, Giardia lamblia
LPSPVLLHPLFLFAENC

SEQ ID NO: 3202662 - protein, 25 aa, Giardia lamblia
LPTVHRFIVFLFSVIFRHSMLSKKS

SEQ ID NO: 3202663 - protein, 19 aa, Giardia lamblia
LPVLAAKNIILAKYLHALA

SEQ ID NO: 3202664 - protein, 40 aa, Giardia lamblia
LQDNLLPPNRFEFTSLALLTLIRWLETDSLPIYTSFLCEY

SEQ ID NO: 3202665 - protein, 20 aa, Giardia lamblia
LQDQLRTFELWLLDAHPSTE

SEQ ID NO: 3202666 - protein, 24 aa, Giardia lamblia
LQEELQFTYLMPEPNREELDKLQM

SEQ ID NO: 3202667 - protein, 17 aa, Giardia lamblia
LQGFPVPSLPPPSVFQQ

SEQ ID NO: 3202668 - protein, 25 aa, Giardia lamblia
LQKQMLPVLLGLLAGFLSACPEGEI

SEQ ID NO: 3202669 - protein, 20 aa, Giardia lamblia
LQSFFSILRIHKAGIQCVFA

SEQ ID NO: 3202670 - protein, 21 aa, Giardia lamblia
LQTERDLLFKKLAACTAASTE

SEQ ID NO: 3202671 - protein, 18 aa, Giardia lamblia
LQTIGPCDVWLLGIGHNG

SEQ ID NO: 3202672 - protein, 25 aa, Giardia lamblia
LREAVPLTLWLYNIYYYYSRLDWST

SEQ ID NO: 3202673 - protein, 17 aa, Giardia lamblia
LREEQLSLALPASDATN

SEQ ID NO: 3202674 - protein, 25 aa, Giardia lamblia
LRELDKALRRVFPTVTLPKYPSSMG

SEQ ID NO: 3202675 - protein, 19 aa, Giardia lamblia
LRELLRYILVLDPEARLSA

SEQ ID NO: 3202676 - protein, 25 aa, Giardia lamblia
LREMPILIRFIFNNYIIDLDCRNYK

SEQ ID NO: 3202677 - protein, 21 aa, Giardia lamblia
LREVLTTIWRPIELAMPAFAN

SEQ ID NO: 3202678 - protein, 18 aa, Giardia lamblia
LRFLLQNVRWWLQEFKID

SEQ ID NO: 3202679 - protein, 19 aa, Giardia lamblia
LRHNYYFLTGFVWTIPFDS

SEQ ID NO: 3202680 - protein, 18 aa, Giardia lamblia
LRHPLLVHYLSVLHDRAG

SEQ ID NO: 3202681 - protein, 17 aa, Giardia lamblia
LRIITVPGWLRGPFESE

SEQ ID NO: 3202682 - protein, 21 aa, Giardia lamblia
LRMTIMFRPGIFRFFLKTYKT

SEQ ID NO: 3202683 - protein, 18 aa, Giardia lamblia
LRNEVHYFKLGWIAVMNR

SEQ ID NO: 3202684 - protein, 18 aa, Giardia lamblia
LRQHPPGSSFRPLTTSLT

SEQ ID NO: 3202685 - protein, 19 aa, Giardia lamblia
LRRMCYLVEGIIAGSALFP

SEQ ID NO: 3202686 - protein, 24 aa, Giardia lamblia
LRRTAIQNIITWSFEMWRRERQAQ

SEQ ID NO: 3202687 - protein, 17 aa, Giardia lamblia
LRRVFAPQLVRGLRTYL

SEQ ID NO: 3202688 - protein, 21 aa, Giardia lamblia
LRSVPVIWRIARQTRFIVLSS

SEQ ID NO: 3202689 - protein, 18 aa, Giardia lamblia
LRTIWASAIVYNTVYYLG

SEQ ID NO: 3202690 - protein, 19 aa, Giardia lamblia
LRYAMQLLFPAFVVAKLEA

SEQ ID NO: 3202691 - protein, 20 aa, Giardia lamblia
LSCLPRYLFSLPLSSIVCQI

SEQ ID NO: 3202692 - protein, 20 aa, Giardia lamblia
LSDHKILLPCPQWDDLHLEQ

SEQ ID NO: 3202693 - protein, 18 aa, Giardia lamblia
LSDPINMAPFPEVLHAVA

SEQ ID NO: 3202694 - protein, 22 aa, Giardia lamblia
LSFTPIPLIPPLSIKALHWPEA

SEQ ID NO: 3202695 - protein, 19 aa, Giardia lamblia
LSIDSFPWPIPSTPSFFWH

SEQ ID NO: 3202696 - protein, 17 aa, Giardia lamblia
LSIHQLLCKKVAQLTKV

SEQ ID NO: 3202697 - protein, 21 aa, Giardia lamblia
LSILLASLLIGAGYNAYVCIG

SEQ ID NO: 3202698 - protein, 18 aa, Giardia lamblia
LSILLSPIPARRLPAMAL

SEQ ID NO: 3202699 - protein, 19 aa, Giardia lamblia
LSISFNPKYDWLYAISTDS

SEQ ID NO: 3202700 - protein, 22 aa, Giardia lamblia
LSNLPFLVYVIHGAPLAGKTTL

SEQ ID NO: 3202701 - protein, 26 aa, Giardia lamblia
LSNPEWVRYIFLPAHIYVSAMGILTF

SEQ ID NO: 3202702 - protein, 17 aa, Giardia lamblia
LSNSQFSLFLLPRFIRA

SEQ ID NO: 3202703 - protein, 21 aa, Giardia lamblia
LSPFQILLRALRSYFPRRIHH

SEQ ID NO: 3202704 - protein, 23 aa, Giardia lamblia
LSPKALLRLEALKKRLFLAQTRE

SEQ ID NO: 3202705 - protein, 20 aa, Giardia lamblia
LSPNQPFYIAGGLFTPDMRE

SEQ ID NO: 3202706 - protein, 19 aa, Giardia lamblia
LSPYFALGGSRYLELTNPL

SEQ ID NO: 3202707 - protein, 25 aa, Giardia lamblia
LSQAAWEAILLFIFDQQYSNFFKEK

SEQ ID NO: 3202708 - protein, 22 aa, Giardia lamblia
LSQVLHLTLDVIFPSGPCSTSS

SEQ ID NO: 3202709 - protein, 24 aa, Giardia lamblia
LSSLAMLLLDPYYRTLRGFCILIE

SEQ ID NO: 3202710 - protein, 18 aa, Giardia lamblia
LSTDPIFESIQRRSAEEY

SEQ ID NO: 3202711 - protein, 28 aa, Giardia lamblia
LSVFRRFLFFLVFSTRRKAMRRNTSWPR

SEQ ID NO: 3202712 - protein, 19 aa, Giardia lamblia
LSYIYISLSLRRWLNIQQS

SEQ ID NO: 3202713 - protein, 17 aa, Giardia lamblia
LTALNLLSVFKPGATFA

SEQ ID NO: 3202714 - protein, 25 aa, Giardia lamblia
LTEDFIKLNRILADFPYNAALNAKL

SEQ ID NO: 3202715 - protein, 18 aa, Giardia lamblia
LTIRLYLAIAKTYEQICI

SEQ ID NO: 3202716 - protein, 17 aa, Giardia lamblia
LTNTARFNWLPKAVYLA

SEQ ID NO: 3202717 - protein, 23 aa, Giardia lamblia
LTPKVMYRFVTWLPAVVKRSLDS

SEQ ID NO: 3202718 - protein, 17 aa, Giardia lamblia
LTQENLYLRTRLEQSKV

SEQ ID NO: 3202719 - protein, 26 aa, Giardia lamblia
LTRDSWRMLLLIHYLEFVKKAYHKFI

SEQ ID NO: 3202720 - protein, 18 aa, Giardia lamblia
LTRSYFAALPSFTAPMYV

SEQ ID NO: 3202721 - protein, 18 aa, Giardia lamblia
LTTLMWCILNGKSNYIKW

SEQ ID NO: 3202722 - protein, 22 aa, Giardia lamblia
LTTRYLRVLRNNKPSVIHLIME

SEQ ID NO: 3202723 - protein, 19 aa, Giardia lamblia
LTYLRAPNELPLKTLFTAP

SEQ ID NO: 3202724 - protein, 17 aa, Giardia lamblia
LTYQPYWRLHKLRRLIV

SEQ ID NO: 3202725 - protein, 19 aa, Giardia lamblia
LTYTILLLSLAYSSMGKVV

SEQ ID NO: 3202726 - protein, 20 aa, Giardia lamblia
LVAFHRLLLRRTPALRKLPA

SEQ ID NO: 3202727 - protein, 18 aa, Giardia lamblia
LVCSSPWPYGLGQRDTRG

SEQ ID NO: 3202728 - protein, 27 aa, Giardia lamblia
LVDESYLYVLRRILLTLLDRTKEAELE

SEQ ID NO: 3202729 - protein, 17 aa, Giardia lamblia
LVDTRLWFQSQLKEELV

SEQ ID NO: 3202730 - protein, 17 aa, Giardia lamblia
LVFHAGLLAFVRKYNTA

SEQ ID NO: 3202731 - protein, 19 aa, Giardia lamblia
LVFNLLMRAMDSLPLVAII

SEQ ID NO: 3202732 - protein, 19 aa, Giardia lamblia
LVGVWSWLPRQCKYADNQG

SEQ ID NO: 3202733 - protein, 18 aa, Giardia lamblia
LVIFTCPTSIFYEPFRAE

SEQ ID NO: 3202734 - protein, 24 aa, Giardia lamblia
LVKAIKYAYMALTFKPNAYTEEKD

SEQ ID NO: 3202735 - protein, 31 aa, Giardia lamblia
LVLKRQYFVLFPNLLLPDLWAPDVTGLMRAA

SEQ ID NO: 3202736 - protein, 17 aa, Giardia lamblia
LVLQAPYKQFFGTQDLH

SEQ ID NO: 3202737 - protein, 24 aa, Giardia lamblia
LVNHRRFFLLQNYSNYAHILWSNS

SEQ ID NO: 3202738 - protein, 17 aa, Giardia lamblia
LVNLLRALSYSYKSAES

SEQ ID NO: 3202739 - protein, 18 aa, Giardia lamblia
LVQKLLRFNSIGYLGMDL

SEQ ID NO: 3202740 - protein, 19 aa, Giardia lamblia
LVQWCLICASFHILQNYNM

SEQ ID NO: 3202741 - protein, 23 aa, Giardia lamblia
LVRDLFAYAKLKKPCLLMIDEVD

SEQ ID NO: 3202742 - protein, 18 aa, Giardia lamblia
LVRLIYSGQMLVGSKPLS

SEQ ID NO: 3202743 - protein, 25 aa, Giardia lamblia
LVSETHIFYILLLENFLSSGAFVDR

SEQ ID NO: 3202744 - protein, 17 aa, Giardia lamblia
LVSILCTLLDYIDVEIY

SEQ ID NO: 3202745 - protein, 24 aa, Giardia lamblia
LVTCDPFLRSYPRYPTPDSVGVTA

SEQ ID NO: 3202746 - protein, 17 aa, Giardia lamblia
LVVREKEIVSYDHKTAF

SEQ ID NO: 3202747 - protein, 23 aa, Giardia lamblia
LVVYKRAYYYSFAYYYVGLCMRT

SEQ ID NO: 3202748 - protein, 20 aa, Giardia lamblia
LVYLPRRFYNQLGGLGPLCI

SEQ ID NO: 3202749 - protein, 18 aa, Giardia lamblia
LVYRLVRYAAIVLLECVE

SEQ ID NO: 3202750 - protein, 19 aa, Giardia lamblia
LWALLNFISPLIFNVPEDF

SEQ ID NO: 3202751 - protein, 18 aa, Giardia lamblia
LYNITMLGHLLLEMALMR

SEQ ID NO: 3202752 - protein, 19 aa, Giardia lamblia
LYSLLSCMLIINPDKRPPV

SEQ ID NO: 3202753 - protein, 24 aa, Giardia lamblia
MAFSRALLAIPRQLAVNSALDATK

SEQ ID NO: 3202754 - protein, 20 aa, Giardia lamblia
MAHFLYDLLFHEVVLAEFLA

SEQ ID NO: 3202755 - protein, 17 aa, Giardia lamblia
MAPPALPPTTRMSQERR

SEQ ID NO: 3202756 - protein, 27 aa, Giardia lamblia
MCTYNMVYFGFYSLFDGLLEDDQGFLV

SEQ ID NO: 3202757 - protein, 24 aa, Giardia lamblia
MDDQIFALHDKIRRMRQARADLEA

SEQ ID NO: 3202758 - protein, 24 aa, Giardia lamblia
MDIFSTYVLALLGGAGLFPEEVVK

SEQ ID NO: 3202759 - protein, 22 aa, Giardia lamblia
MDIRPTDLPWLCGLYLITGICI

SEQ ID NO: 3202760 - protein, 17 aa, Giardia lamblia
MDKQMEIIALQAQLQQV

SEQ ID NO: 3202761 - protein, 19 aa, Giardia lamblia
MDLVIIILRTGGLAMDNYD

SEQ ID NO: 3202762 - protein, 33 aa, Giardia lamblia
MDTVYECYLLAKDLLFMLPWESPEIKAPSEQAM

SEQ ID NO: 3202763 - protein, 17 aa, Giardia lamblia
MEIIALQAQLQQVTTEL

SEQ ID NO: 3202764 - protein, 25 aa, Giardia lamblia
MELKRALLIKIREIYKIKLGLGIVN

SEQ ID NO: 3202765 - protein, 17 aa, Giardia lamblia
MERLDLFAVLSSKDTDL

SEQ ID NO: 3202766 - protein, 31 aa, Giardia lamblia
MFDHHLLIYQWILLLYYNLLDVYLPIPLGYT

SEQ ID NO: 3202767 - protein, 18 aa, Giardia lamblia
MFSKWVRSYKDLPLKIHQ

SEQ ID NO: 3202768 - protein, 21 aa, Giardia lamblia
MFSSFPLFDLAFMAPEVLSGE

SEQ ID NO: 3202769 - protein, 24 aa, Giardia lamblia
MIQTLYLLLNLRLNTNLPFPAQFT

SEQ ID NO: 3202770 - protein, 27 aa, Giardia lamblia
MIRNALTHWRLICYKKRYMRVFEDAHD

SEQ ID NO: 3202771 - protein, 25 aa, Giardia lamblia
MKAVRLRYPVLIKLLAPYEAGMTNN

SEQ ID NO: 3202772 - protein, 28 aa, Giardia lamblia
MKLALPSGILLYLRILPEGYEIVGFTEI

SEQ ID NO: 3202773 - protein, 17 aa, Giardia lamblia
MKLLLNVHPLGHTFPGA

SEQ ID NO: 3202774 - protein, 21 aa, Giardia lamblia
MKRSFKIWRYSSDSSTAILLT

SEQ ID NO: 3202775 - protein, 18 aa, Giardia lamblia
MLALLKKGINRRVTFATA

SEQ ID NO: 3202776 - protein, 18 aa, Giardia lamblia
MLAPFLLALPYLFTYHTN

SEQ ID NO: 3202777 - protein, 17 aa, Giardia lamblia
MLDYIAYLQAYTPKLRA

SEQ ID NO: 3202778 - protein, 18 aa, Giardia lamblia
MLFLRYFLPTPPHCSTAD

SEQ ID NO: 3202779 - protein, 24 aa, Giardia lamblia
MLGHKLWFLIERLPKQPATGADLT

SEQ ID NO: 3202780 - protein, 18 aa, Giardia lamblia
MLLAPYELMIRGRDGMFP

SEQ ID NO: 3202781 - protein, 18 aa, Giardia lamblia
MLLLLQILARRLTSGLGF

SEQ ID NO: 3202782 - protein, 25 aa, Giardia lamblia
MLRDQLLFFSLLFDLTSVLYTVPDK

SEQ ID NO: 3202783 - protein, 23 aa, Giardia lamblia
MMSLPVMPMMPMVSPMCMTSISG

SEQ ID NO: 3202784 - protein, 21 aa, Giardia lamblia
MNFRLFMTTKLPNPSLSPDMF

SEQ ID NO: 3202785 - protein, 18 aa, Giardia lamblia
MPCCTLLRVFTVKTCPLP

SEQ ID NO: 3202786 - protein, 22 aa, Giardia lamblia
MPTPQVLPLQRIQLRTPKPPVY

SEQ ID NO: 3202787 - protein, 19 aa, Giardia lamblia
MPVEFLMKIGWRDKSFFKH

SEQ ID NO: 3202788 - protein, 18 aa, Giardia lamblia
MQAPVRSMRLWRTPMIMK

SEQ ID NO: 3202789 - protein, 27 aa, Giardia lamblia
MQAVQLWLLKFLNIHYPLFTHLFTNTF

SEQ ID NO: 3202790 - protein, 23 aa, Giardia lamblia
MQSQIGHILLKNDPLLITSDEAA

SEQ ID NO: 3202791 - protein, 29 aa, Giardia lamblia
MRHLALLFKIPKLIILYKVLGWPTAALDE

SEQ ID NO: 3202792 - protein, 22 aa, Giardia lamblia
MRRLWTLPQILLYLYSQFHIVT

SEQ ID NO: 3202793 - protein, 21 aa, Giardia lamblia
MSIGLIYWLLAREVLRLKGSI

SEQ ID NO: 3202794 - protein, 23 aa, Giardia lamblia
MSSQELIYLLLNVPSLYIDNRVI

SEQ ID NO: 3202795 - protein, 22 aa, Giardia lamblia
MTAFIRYMRVYNLWFNMLAAIP

SEQ ID NO: 3202796 - protein, 18 aa, Giardia lamblia
MVSKMQLEIKRLARELDE

SEQ ID NO: 3202797 - protein, 17 aa, Giardia lamblia
MYAILYTAQDAAGVLVK

SEQ ID NO: 3202798 - protein, 28 aa, Giardia lamblia
MYARFNQPRDLPPPEWRYGIHSAPNEYP

SEQ ID NO: 3202799 - protein, 20 aa, Giardia lamblia
MYSNIWFYYLGGSSLKLQKL

SEQ ID NO: 3202800 - protein, 22 aa, Giardia lamblia
NADASMRILRQKPLLLASNIDT

SEQ ID NO: 3202801 - protein, 23 aa, Giardia lamblia
NAELSLLLVFPFCELDLKTYLKH

SEQ ID NO: 3202802 - protein, 17 aa, Giardia lamblia
NAKGFILNSFYTGLLPF

SEQ ID NO: 3202803 - protein, 23 aa, Giardia lamblia
NANDLRIQLFNRLSLEGLTHISD

SEQ ID NO: 3202804 - protein, 17 aa, Giardia lamblia
NANFFLLSMLKAYRTEV

SEQ ID NO: 3202805 - protein, 22 aa, Giardia lamblia
NARIIFILLLEHKTTQSLLYLP

SEQ ID NO: 3202806 - protein, 20 aa, Giardia lamblia
NCKKCWIYPRLGCYCFNFNK

SEQ ID NO: 3202807 - protein, 18 aa, Giardia lamblia
NCLGIRLVWDIIQEKTTP

SEQ ID NO: 3202808 - protein, 18 aa, Giardia lamblia
NCRYYLLMSYFSKSDLGY

SEQ ID NO: 3202809 - protein, 17 aa, Giardia lamblia
NDELYCVVPIDSEFYTV

SEQ ID NO: 3202810 - protein, 17 aa, Giardia lamblia
NDLLHRCSHAWRAAGVN

SEQ ID NO: 3202811 - protein, 19 aa, Giardia lamblia
NDLLKYIIDDLKSPGLLFY

SEQ ID NO: 3202812 - protein, 20 aa, Giardia lamblia
NDQMSLLRWNPLYGYESCQL

SEQ ID NO: 3202813 - protein, 24 aa, Giardia lamblia
NDQPLPYIHLYPSQLSQILVEGGD

SEQ ID NO: 3202814 - protein, 20 aa, Giardia lamblia
NDSWPMIPQQKVYAQSAVGT

SEQ ID NO: 3202815 - protein, 20 aa, Giardia lamblia
NECVLFWKPGLQAPYQRWPA

SEQ ID NO: 3202816 - protein, 23 aa, Giardia lamblia
NEKLRHDMQLLQNLEKYLPGGHV

SEQ ID NO: 3202817 - protein, 20 aa, Giardia lamblia
NELFIDEFRLLRHFGWTTLM

SEQ ID NO: 3202818 - protein, 32 aa, Giardia lamblia
NELTTFLLPKEQRIFYLFYNPKSMTAFNDYMY

SEQ ID NO: 3202819 - protein, 22 aa, Giardia lamblia
NFCPKLLLPNLLRLSMTHHNTS

SEQ ID NO: 3202820 - protein, 17 aa, Giardia lamblia
NFFRHVVFWFEMIGYHV

SEQ ID NO: 3202821 - protein, 18 aa, Giardia lamblia
NFLLAFLDLIENSSVWRK

SEQ ID NO: 3202822 - protein, 18 aa, Giardia lamblia
NFMPGVESLLYYEKDLRL

SEQ ID NO: 3202823 - protein, 18 aa, Giardia lamblia
NFPNFRLFQTIFLGHTNL

SEQ ID NO: 3202824 - protein, 22 aa, Giardia lamblia
NFRINMFYDFKYNLYRPPYYNE

SEQ ID NO: 3202825 - protein, 17 aa, Giardia lamblia
NFYLFPPISQNQLLEMD

SEQ ID NO: 3202826 - protein, 17 aa, Giardia lamblia
NFYVFPGIGLGAYVCRA

SEQ ID NO: 3202827 - protein, 17 aa, Giardia lamblia
NGDKLLIYLGLSNQRTL

SEQ ID NO: 3202828 - protein, 23 aa, Giardia lamblia
NGDSALLRCLRLGELKLAELLTD

SEQ ID NO: 3202829 - protein, 17 aa, Giardia lamblia
NGFALKIPFIKYITARN

SEQ ID NO: 3202830 - protein, 22 aa, Giardia lamblia
NGQRIFREDALRFGYKGPARNG

SEQ ID NO: 3202831 - protein, 19 aa, Giardia lamblia
NIDAIVRDLAYLKKTFHRN

SEQ ID NO: 3202832 - protein, 21 aa, Giardia lamblia
NIDSPFPRLRILNNLIITVDD

SEQ ID NO: 3202833 - protein, 25 aa, Giardia lamblia
NIHLKKRFPLLPLDTDRLIFISTSE

SEQ ID NO: 3202834 - protein, 17 aa, Giardia lamblia
NIIRLPPRPVKKATKET

SEQ ID NO: 3202835 - protein, 20 aa, Giardia lamblia
NIPLLIRRIRLSFLQLAECE

SEQ ID NO: 3202836 - protein, 22 aa, Giardia lamblia
NIRNARIYALDLGALIAGAQYR

SEQ ID NO: 3202837 - protein, 24 aa, Giardia lamblia
NIVAVWCLIPHQGGLRDEEGFTAL

SEQ ID NO: 3202838 - protein, 24 aa, Giardia lamblia
NKAFQDIKLLKRNITRYALAKEKQ

SEQ ID NO: 3202839 - protein, 26 aa, Giardia lamblia
NKELRQQFFLLLSKEELLSTLEIAER

SEQ ID NO: 3202840 - protein, 18 aa, Giardia lamblia
NKILERIHLIPGLKLEML

SEQ ID NO: 3202841 - protein, 21 aa, Giardia lamblia
NKSTSYLLKSSYQPPVIADGR

SEQ ID NO: 3202842 - protein, 17 aa, Giardia lamblia
NKTILHILAERGLASEL

SEQ ID NO: 3202843 - protein, 19 aa, Giardia lamblia
NLCFVCDLPILYVGTGQSY

SEQ ID NO: 3202844 - protein, 24 aa, Giardia lamblia
NLCPRLLDWLIRLALKYIESPEEF

SEQ ID NO: 3202845 - protein, 17 aa, Giardia lamblia
NLDLLIGLLGRICAARR

SEQ ID NO: 3202846 - protein, 20 aa, Giardia lamblia
NLDTLYYFISLLSIGLAINE

SEQ ID NO: 3202847 - protein, 19 aa, Giardia lamblia
NLFGAIIFFYHGQLFVAGG

SEQ ID NO: 3202848 - protein, 19 aa, Giardia lamblia
NLFIYNMLILSTEAVHYTK

SEQ ID NO: 3202849 - protein, 24 aa, Giardia lamblia
NLHPDLLFGIFTYGYKIPSAIQSQ

SEQ ID NO: 3202850 - protein, 18 aa, Giardia lamblia
NLKDFRFWWASQEAKEAC

SEQ ID NO: 3202851 - protein, 24 aa, Giardia lamblia
NLKVRFWFYFRVANITPKLPYIFH

SEQ ID NO: 3202852 - protein, 17 aa, Giardia lamblia
NLLRALSYSYKSAESLR

SEQ ID NO: 3202853 - protein, 20 aa, Giardia lamblia
NLPSYKQLILQAIRFRLLTA

SEQ ID NO: 3202854 - protein, 22 aa, Giardia lamblia
NLRYYLTMIMKRQKLYGKLDKE

SEQ ID NO: 3202855 - protein, 19 aa, Giardia lamblia
NLYGVYLLDMLMKRTLDDP

SEQ ID NO: 3202856 - protein, 23 aa, Giardia lamblia
NMAPILPCYLKLLKQQRINALLA

SEQ ID NO: 3202857 - protein, 25 aa, Giardia lamblia
NMDGQFFLYRFFKPSNIFLCENGCI

SEQ ID NO: 3202858 - protein, 17 aa, Giardia lamblia
NMIRHRAGPLYPTESVS

SEQ ID NO: 3202859 - protein, 22 aa, Giardia lamblia
NMKKYQASLLHKLFVTKTCTAI

SEQ ID NO: 3202860 - protein, 17 aa, Giardia lamblia
NMNAVLDTLLPYAGRRT

SEQ ID NO: 3202861 - protein, 24 aa, Giardia lamblia
NNAKMPVFPFPEPAIHATGAVLKY

SEQ ID NO: 3202862 - protein, 22 aa, Giardia lamblia
NNCSFILTRVFSKNLHELINVI

SEQ ID NO: 3202863 - protein, 18 aa, Giardia lamblia
NNGYDNFILLYKKLYESA

SEQ ID NO: 3202864 - protein, 22 aa, Giardia lamblia
NNIVRVWSLLPLQGGLVDQEGC

SEQ ID NO: 3202865 - protein, 20 aa, Giardia lamblia
NNKLFLVHKVTLSNIGRLGI

SEQ ID NO: 3202866 - protein, 27 aa, Giardia lamblia
NNLMPVMSLFFKAPLPRTADRSDIVNA

SEQ ID NO: 3202867 - protein, 25 aa, Giardia lamblia
NNLVATWCYLPIQGGLHDQDGCTAL

SEQ ID NO: 3202868 - protein, 24 aa, Giardia lamblia
NNPLTVWCLIPLQGRVQDWSGKTA

SEQ ID NO: 3202869 - protein, 18 aa, Giardia lamblia
NNTLFCNILLISTLSRCI

SEQ ID NO: 3202870 - protein, 19 aa, Giardia lamblia
NNWLLPVLCLWTSKIPLVN

SEQ ID NO: 3202871 - protein, 24 aa, Giardia lamblia
NNWYHLQFIYELLLRFIFAANQHP

SEQ ID NO: 3202872 - protein, 17 aa, Giardia lamblia
NPALIQNLEFVRLYLSN

SEQ ID NO: 3202873 - protein, 17 aa, Giardia lamblia
NPDIFTLYAKMLHILGL

SEQ ID NO: 3202874 - protein, 22 aa, Giardia lamblia
NPDLIFVKLWVSDPVLAVILSD

SEQ ID NO: 3202875 - protein, 20 aa, Giardia lamblia
NPEVFYGFWGYCFNSYRDTT

SEQ ID NO: 3202876 - protein, 28 aa, Giardia lamblia
NPNPDASYILTLTRYYKLMRPIAEHAND

SEQ ID NO: 3202877 - protein, 25 aa, Giardia lamblia
NQILKLPFLQERIRRLLPEDYWNEE

SEQ ID NO: 3202878 - protein, 20 aa, Giardia lamblia
NQLCYYLFDALFINGTSILS

SEQ ID NO: 3202879 - protein, 21 aa, Giardia lamblia
NQLLTPLLFYYKAFLDHLNAR

SEQ ID NO: 3202880 - protein, 23 aa, Giardia lamblia
NQVRMLFCMVPYSASLDYSISMM

SEQ ID NO: 3202881 - protein, 24 aa, Giardia lamblia
NRHLTPLDYFIYGEALISTLGTMY

SEQ ID NO: 3202882 - protein, 26 aa, Giardia lamblia
NRIHRPFFMTILFKLALSLSQLCNFM

SEQ ID NO: 3202883 - protein, 23 aa, Giardia lamblia
NRLEQELLALRKALGSTGITGVE

SEQ ID NO: 3202884 - protein, 17 aa, Giardia lamblia
NRPQIVSLLIDKEARML

SEQ ID NO: 3202885 - protein, 21 aa, Giardia lamblia
NRRFTFPFAVDLYRYCSAGLQ

SEQ ID NO: 3202886 - protein, 22 aa, Giardia lamblia
NRYLRALLCILLGIPPVYDSYG

SEQ ID NO: 3202887 - protein, 22 aa, Giardia lamblia
NSFYAILPSPVDVWCFGVTILY

SEQ ID NO: 3202888 - protein, 28 aa, Giardia lamblia
NSGAFPAIPYYYLKLLVRRLLRAIHHCH

SEQ ID NO: 3202889 - protein, 18 aa, Giardia lamblia
NSKELFLRLTARISAPVG

SEQ ID NO: 3202890 - protein, 22 aa, Giardia lamblia
NSKTLLFANISPLPNLLYETLS

SEQ ID NO: 3202891 - protein, 23 aa, Giardia lamblia
NSMQIICDYLLKHNIRSSVKSRE

SEQ ID NO: 3202892 - protein, 20 aa, Giardia lamblia
NSMSLYRFLSLTPAVARINL

SEQ ID NO: 3202893 - protein, 22 aa, Giardia lamblia
NSSFVQKLILHNLLPGTANYER

SEQ ID NO: 3202894 - protein, 18 aa, Giardia lamblia
NSVPIIRQLIRYEARRKN

SEQ ID NO: 3202895 - protein, 24 aa, Giardia lamblia
NSVVPLLQLLPKCRCGKTFISKDT

SEQ ID NO: 3202896 - protein, 20 aa, Giardia lamblia
NTDLAKMYLCLEKEAKKYSS

SEQ ID NO: 3202897 - protein, 17 aa, Giardia lamblia
NTELLYRGFPYSNIIRA

SEQ ID NO: 3202898 - protein, 21 aa, Giardia lamblia
NTFLSFIQLPNGAPIECIVVF

SEQ ID NO: 3202899 - protein, 20 aa, Giardia lamblia
NTHYIFIVVHFWDFQPLVSR

SEQ ID NO: 3202900 - protein, 22 aa, Giardia lamblia
NTLYALTRLPNLSFLSPFLSEE

SEQ ID NO: 3202901 - protein, 18 aa, Giardia lamblia
NTPVHILRRLPLDKFNVV

SEQ ID NO: 3202902 - protein, 17 aa, Giardia lamblia
NVIYYLTGVPPYIDILQ

SEQ ID NO: 3202903 - protein, 17 aa, Giardia lamblia
NWFEIWIVPAINAEGIR

SEQ ID NO: 3202904 - protein, 19 aa, Giardia lamblia
NWHNDIVRILLPLQARQAT

SEQ ID NO: 3202905 - protein, 21 aa, Giardia lamblia
NYAIFFFRPVYTYPFGLIQLL

SEQ ID NO: 3202906 - protein, 17 aa, Giardia lamblia
NYLKFCEFWTTRNAALA

SEQ ID NO: 3202907 - protein, 20 aa, Giardia lamblia
NYRVSYLQRLLSQLINEGVA

SEQ ID NO: 3202908 - protein, 17 aa, Giardia lamblia
NYWCPWSQFVKPYTPPS

SEQ ID NO: 3202909 - protein, 22 aa, Giardia lamblia
PAAMALYSLKLPKSLMLCTKPH

SEQ ID NO: 3202910 - protein, 17 aa, Giardia lamblia
PAFGHLSAVRRSLQDIG

SEQ ID NO: 3202911 - protein, 20 aa, Giardia lamblia
PALHLLYIYQVALTLDHPNL

SEQ ID NO: 3202912 - protein, 29 aa, Giardia lamblia
PANTIRALLIYILPQLLYLNWAEVTIDER

SEQ ID NO: 3202913 - protein, 20 aa, Giardia lamblia
PAQFFLQVNSPLGASPPPNE

SEQ ID NO: 3202914 - protein, 25 aa, Giardia lamblia
PARPIGVLFYRYWVDLKSLSFTFQR

SEQ ID NO: 3202915 - protein, 25 aa, Giardia lamblia
PAVSIFIKLKMLNLLLLLSNEAKEH

SEQ ID NO: 3202916 - protein, 19 aa, Giardia lamblia
PCRMNISFISPIFRSGDSF

SEQ ID NO: 3202917 - protein, 17 aa, Giardia lamblia
PDCSSYSLVRSNSFLFL

SEQ ID NO: 3202918 - protein, 22 aa, Giardia lamblia
PDEYDFYPMSFYLPADSAEMRQ

SEQ ID NO: 3202919 - protein, 20 aa, Giardia lamblia
PDIQYLQLTRPPLTDALSNR

SEQ ID NO: 3202920 - protein, 27 aa, Giardia lamblia
PDQTVIYLMYNALIDILHYEPKLSAEA

SEQ ID NO: 3202921 - protein, 18 aa, Giardia lamblia
PDRQLFLKKITSIPGCCT

SEQ ID NO: 3202922 - protein, 21 aa, Giardia lamblia
PDSCNLVLIKILFGSPEFTRF

SEQ ID NO: 3202923 - protein, 23 aa, Giardia lamblia
PDYNLLLFYLFQSCAVIHPNLVR

SEQ ID NO: 3202924 - protein, 24 aa, Giardia lamblia
PECVKLLLPHLFTDTYRGLRPLAL

SEQ ID NO: 3202925 - protein, 20 aa, Giardia lamblia
PEDLLLANLPFLIPQPGSEK

SEQ ID NO: 3202926 - protein, 23 aa, Giardia lamblia
PEESPYRLLFSEMIFPIMLQNNK

SEQ ID NO: 3202927 - protein, 17 aa, Giardia lamblia
PEISLLVREHVECRSIV

SEQ ID NO: 3202928 - protein, 17 aa, Giardia lamblia
PELRMVINWLLMQSFPD

SEQ ID NO: 3202929 - protein, 25 aa, Giardia lamblia
PENYPIKYFLQHHLKWPQLTYVCSV

SEQ ID NO: 3202930 - protein, 21 aa, Giardia lamblia
PEPQIWWLLAQMGSALRFLHS

SEQ ID NO: 3202931 - protein, 26 aa, Giardia lamblia
PEQLVWLIMTQLIEGLAYLHNPHKRN

SEQ ID NO: 3202932 - protein, 20 aa, Giardia lamblia
PEWEPWILPPKVSLAEYNNY

SEQ ID NO: 3202933 - protein, 17 aa, Giardia lamblia
PFHLWPNIPTRPSYFPP

SEQ ID NO: 3202934 - protein, 22 aa, Giardia lamblia
PFILYVGFRRLYTVPLPSQPLT

SEQ ID NO: 3202935 - protein, 22 aa, Giardia lamblia
PFNVHAFIPLKLLPGFDFVTAI

SEQ ID NO: 3202936 - protein, 20 aa, Giardia lamblia
PFTYVPFILTAPRAGGCVSP

SEQ ID NO: 3202937 - protein, 18 aa, Giardia lamblia
PFWISPRQIVVIPLHGED

SEQ ID NO: 3202938 - protein, 19 aa, Giardia lamblia
PFYRYWFNIMYDKDHFKIA

SEQ ID NO: 3202939 - protein, 21 aa, Giardia lamblia
PGIILREYWIVTSPAVEVSLL

SEQ ID NO: 3202940 - protein, 26 aa, Giardia lamblia
PGKSYPFGYLWRFSYKVIPSYLADKS

SEQ ID NO: 3202941 - protein, 20 aa, Giardia lamblia
PGPGLYKLPSTLGGPKFSLS

SEQ ID NO: 3202942 - protein, 23 aa, Giardia lamblia
PGPKSFLSVISFNPAVISNHQRI

SEQ ID NO: 3202943 - protein, 24 aa, Giardia lamblia
PGQGTAFPIPLRSLGRIDGSLIYS

SEQ ID NO: 3202944 - protein, 25 aa, Giardia lamblia
PGQLPPALTPYAPLPPPIHLSPEHE

SEQ ID NO: 3202945 - protein, 20 aa, Giardia lamblia
PHITPLIRLLTPYFATDENV

SEQ ID NO: 3202946 - protein, 19 aa, Giardia lamblia
PHLYLPFVRTILRNAEFHL

SEQ ID NO: 3202947 - protein, 19 aa, Giardia lamblia
PIAFKIVTLLNLDFFICLY

SEQ ID NO: 3202948 - protein, 23 aa, Giardia lamblia
PIDHFVDVFLIKDRFRAALAEGY

SEQ ID NO: 3202949 - protein, 18 aa, Giardia lamblia
PIELLLHRSPIVSLDISP

SEQ ID NO: 3202950 - protein, 19 aa, Giardia lamblia
PIFPLKTLILLARKSEKSF

SEQ ID NO: 3202951 - protein, 17 aa, Giardia lamblia
PIIIFFGVAYKMLITML

SEQ ID NO: 3202952 - protein, 25 aa, Giardia lamblia
PIKKRTFVPSPPPLTKPHLLEKGRN

SEQ ID NO: 3202953 - protein, 23 aa, Giardia lamblia
PIQYPPVFVLLNPQATTIPFNTN

SEQ ID NO: 3202954 - protein, 25 aa, Giardia lamblia
PITKKLLLELGLTRLVAWFEQCYLP

SEQ ID NO: 3202955 - protein, 21 aa, Giardia lamblia
PITLEFVLPPELYVARILTAE

SEQ ID NO: 3202956 - protein, 21 aa, Giardia lamblia
PKAVWLPALFNPQSFLRAVLQ

SEQ ID NO: 3202957 - protein, 25 aa, Giardia lamblia
PKNMKTRMLLYTIVCYLRLGKSLHF

SEQ ID NO: 3202958 - protein, 20 aa, Giardia lamblia
PKYPPIVKLSTLFNSDCIGC

SEQ ID NO: 3202959 - protein, 17 aa, Giardia lamblia
PLAFVFLSPTDFTRTVH

SEQ ID NO: 3202960 - protein, 18 aa, Giardia lamblia
PLFMANRVLDNIFVGGCY

SEQ ID NO: 3202961 - protein, 19 aa, Giardia lamblia
PLLVTPAFILERRSIQLGD

SEQ ID NO: 3202962 - protein, 17 aa, Giardia lamblia
PLPVFPAPDPDSKPYVD

SEQ ID NO: 3202963 - protein, 17 aa, Giardia lamblia
PLRLFLQYIMHLHSTYK

SEQ ID NO: 3202964 - protein, 17 aa, Giardia lamblia
PLRYLMDMGYRPIFQVI

SEQ ID NO: 3202965 - protein, 21 aa, Giardia lamblia
PLTEKLLSRPPFKYILDICKA

SEQ ID NO: 3202966 - protein, 23 aa, Giardia lamblia
PLVDRLCLFMYGIARVLQIKMGG

SEQ ID NO: 3202967 - protein, 17 aa, Giardia lamblia
PMRCFFSQFGKVLQVRV

SEQ ID NO: 3202968 - protein, 21 aa, Giardia lamblia
PNPIFLMYHPVLMSPLAKPHR

SEQ ID NO: 3202969 - protein, 24 aa, Giardia lamblia
PNPIIARYFVIIVTAFISTPTRIS

SEQ ID NO: 3202970 - protein, 22 aa, Giardia lamblia
PNTVAFYFIKYLRRMHLSKKLI

SEQ ID NO: 3202971 - protein, 24 aa, Giardia lamblia
PPAQSLLRKGLLGRAWQALLSETS

SEQ ID NO: 3202972 - protein, 17 aa, Giardia lamblia
PPCRGMIPHLAKIPTKY

SEQ ID NO: 3202973 - protein, 23 aa, Giardia lamblia
PPGKPYFIPLFGILPNKLYEFRH

SEQ ID NO: 3202974 - protein, 26 aa, Giardia lamblia
PPRIPRALRSLLWPPAPPCPRCSQAR

SEQ ID NO: 3202975 - protein, 24 aa, Giardia lamblia
PPTKKLLIHGYRPVFRFLDAHHKP

SEQ ID NO: 3202976 - protein, 20 aa, Giardia lamblia
PPTSLMAPPALPPTTRMSQE

SEQ ID NO: 3202977 - protein, 17 aa, Giardia lamblia
PQLLIMAISLESDTFID

SEQ ID NO: 3202978 - protein, 26 aa, Giardia lamblia
PQNMHTYQWWYPLNLSTMRAQNKLYD

SEQ ID NO: 3202979 - protein, 25 aa, Giardia lamblia
PQPSHKVTWLAWLLSMISGIQINKR

SEQ ID NO: 3202980 - protein, 21 aa, Giardia lamblia
PQSDFLLLPRLIRAAHMNCTE

SEQ ID NO: 3202981 - protein, 21 aa, Giardia lamblia
PQVLHLLKFTYTPSGFMASGA

SEQ ID NO: 3202982 - protein, 22 aa, Giardia lamblia
PQVPNFFAPFPDPIPLPVGMEY

SEQ ID NO: 3202983 - protein, 18 aa, Giardia lamblia
PRDELVTMRYIPLSVTFG

SEQ ID NO: 3202984 - protein, 21 aa, Giardia lamblia
PRGFYTVYALLFKTLADEELR

SEQ ID NO: 3202985 - protein, 22 aa, Giardia lamblia
PRNKLIKCLLFTLIVPDVSGVR

SEQ ID NO: 3202986 - protein, 25 aa, Giardia lamblia
PRRDLTILRYPLFIKVASIFLGHQQ

SEQ ID NO: 3202987 - protein, 17 aa, Giardia lamblia
PRRKAQFYLYIGCTYFL

SEQ ID NO: 3202988 - protein, 28 aa, Giardia lamblia
PSCPAPPYWPYYSMPPNPGVYSGPEPGA

SEQ ID NO: 3202989 - protein, 22 aa, Giardia lamblia
PSGKLCAIKLLWSQKGNNYNEK

SEQ ID NO: 3202990 - protein, 25 aa, Giardia lamblia
PSHLRKFLRIITDFTMWYSYRDFCC

SEQ ID NO: 3202991 - protein, 26 aa, Giardia lamblia
PSKVWQMQLYYFLYAHYYTAACILKA

SEQ ID NO: 3202992 - protein, 19 aa, Giardia lamblia
PSLKFVLFTLGSRGSRIVQ

SEQ ID NO: 3202993 - protein, 20 aa, Giardia lamblia
PSMILPHELLRRPYYKDATS

SEQ ID NO: 3202994 - protein, 22 aa, Giardia lamblia
PSMSTLHYLGGRLVLCMAEYGD

SEQ ID NO: 3202995 - protein, 21 aa, Giardia lamblia
PSPHLIPYMQLEKSYKVMQED

SEQ ID NO: 3202996 - protein, 21 aa, Giardia lamblia
PSRQIKICLLYKNIKTCVFEK

SEQ ID NO: 3202997 - protein, 23 aa, Giardia lamblia
PSTLIHHFYFQPIRPVDFKFRLL

SEQ ID NO: 3202998 - protein, 18 aa, Giardia lamblia
PSVLFPYIRYSGGGYRAS

SEQ ID NO: 3202999 - protein, 24 aa, Giardia lamblia
PSWPQFMRVCPILYWSYVDVWDFL

SEQ ID NO: 3203000 - protein, 23 aa, Giardia lamblia
PSYGSLPYPPLLTAELPASPLPS

SEQ ID NO: 3203001 - protein, 17 aa, Giardia lamblia
PTHFKPMRKKWKASEPP

SEQ ID NO: 3203002 - protein, 21 aa, Giardia lamblia
PTHPLIIWFWDIVLNVMTQDQ

SEQ ID NO: 3203003 - protein, 19 aa, Giardia lamblia
PTLVLTYAGYWDCGERHHF

SEQ ID NO: 3203004 - protein, 22 aa, Giardia lamblia
PTPQGLLWRILKHLTFASNKND

SEQ ID NO: 3203005 - protein, 24 aa, Giardia lamblia
PTYRAYFWLIIGIAYNVYDIYHDQ

SEQ ID NO: 3203006 - protein, 17 aa, Giardia lamblia
PVADWAVDALLSKCINQ

SEQ ID NO: 3203007 - protein, 23 aa, Giardia lamblia
PVDLVYVMGPYPLLRKISELTRD

SEQ ID NO: 3203008 - protein, 18 aa, Giardia lamblia
PVELWRLLSPVISALAYL

SEQ ID NO: 3203009 - protein, 17 aa, Giardia lamblia
PVFIAINHDIRPSFIFK

SEQ ID NO: 3203010 - protein, 17 aa, Giardia lamblia
PVKPLTAFFIYFKEQSV

SEQ ID NO: 3203011 - protein, 19 aa, Giardia lamblia
PVLDFILLDYLKLERLFNS

SEQ ID NO: 3203012 - protein, 17 aa, Giardia lamblia
PVLLPKWKANEILRWIE

SEQ ID NO: 3203013 - protein, 17 aa, Giardia lamblia
PVPLLHWPDSTFTYCPE

SEQ ID NO: 3203014 - protein, 18 aa, Giardia lamblia
PVPPIPIFALAHAGLPYP

SEQ ID NO: 3203015 - protein, 20 aa, Giardia lamblia
PVRILRFMSPFYPDLTQKHV

SEQ ID NO: 3203016 - protein, 19 aa, Giardia lamblia
PVRSMRLWRTPMIMKVESE

SEQ ID NO: 3203017 - protein, 24 aa, Giardia lamblia
PVSATLYPRKPQRLSWHGITNVKQ

SEQ ID NO: 3203018 - protein, 19 aa, Giardia lamblia
PVYQYFPLIMMMSATLFAS

SEQ ID NO: 3203019 - protein, 17 aa, Giardia lamblia
PWFDTYGPPSAYLAFRH

SEQ ID NO: 3203020 - protein, 18 aa, Giardia lamblia
PYEQIFVLPLETIKMDKG

SEQ ID NO: 3203021 - protein, 25 aa, Giardia lamblia
PYHRFPMFVPWRINDTWYFVEKAVR

SEQ ID NO: 3203022 - protein, 18 aa, Giardia lamblia
PYIYLPPELSAEGKIFTL

SEQ ID NO: 3203023 - protein, 23 aa, Giardia lamblia
PYRLSGLFFAHYYTYMLPHVIEP

SEQ ID NO: 3203024 - protein, 22 aa, Giardia lamblia
QAADWWTLGIFIYECLYGVTPF

SEQ ID NO: 3203025 - protein, 19 aa, Giardia lamblia
QAMLPPPLTLLLDTKAELA

SEQ ID NO: 3203026 - protein, 26 aa, Giardia lamblia
QANSKFLITVWDLLQTYLNEDSRKIE

SEQ ID NO: 3203027 - protein, 22 aa, Giardia lamblia
QASVILPFLRLVWGDASPSKIT

SEQ ID NO: 3203028 - protein, 19 aa, Giardia lamblia
QDGFFPLHRLMRIAPKTLD

SEQ ID NO: 3203029 - protein, 24 aa, Giardia lamblia
QDKRLINLLIFINGRRVQYPRLKN

SEQ ID NO: 3203030 - protein, 24 aa, Giardia lamblia
QDPFTDFYLRLLLNAPYSTLNEQQ

SEQ ID NO: 3203031 - protein, 23 aa, Giardia lamblia
QDRILLFDSFFNVLVWTGSSVAA

SEQ ID NO: 3203032 - protein, 18 aa, Giardia lamblia
QDSFGWCPLLYAIGFNRA

SEQ ID NO: 3203033 - protein, 23 aa, Giardia lamblia
QEIQDIIAYKYIFGNASMLKVKD

SEQ ID NO: 3203034 - protein, 23 aa, Giardia lamblia
QFHARGYFLTAFLCLCVSPDKVT

SEQ ID NO: 3203035 - protein, 18 aa, Giardia lamblia
QFIHFFSALYPAGAPHTV

SEQ ID NO: 3203036 - protein, 24 aa, Giardia lamblia
QFQQFQLFQQFQQLQRMKCYQDVP

SEQ ID NO: 3203037 - protein, 17 aa, Giardia lamblia
QFRYLFSDMLLGRPTIF

SEQ ID NO: 3203038 - protein, 19 aa, Giardia lamblia
QFVLKPPPKKPLGSARVTF

SEQ ID NO: 3203039 - protein, 18 aa, Giardia lamblia
QFWPFHKYGYYHLLHSLF

SEQ ID NO: 3203040 - protein, 20 aa, Giardia lamblia
QGFPFWNVFFEQRKKWLVTR

SEQ ID NO: 3203041 - protein, 20 aa, Giardia lamblia
QGLMLTPRMNSIANASECTA

SEQ ID NO: 3203042 - protein, 24 aa, Giardia lamblia
QGPLNLMFALPFQTVPYGSHYPLI

SEQ ID NO: 3203043 - protein, 18 aa, Giardia lamblia
QHFYGRPIFLYKGGCYVI

SEQ ID NO: 3203044 - protein, 24 aa, Giardia lamblia
QIANLFILLAQFGLSPSLSDIYSL

SEQ ID NO: 3203045 - protein, 24 aa, Giardia lamblia
QIHFGWHAFPKPTPLILAAGHGHL

SEQ ID NO: 3203046 - protein, 23 aa, Giardia lamblia
QIKESFLLPLQRPDLLKKIGIKP

SEQ ID NO: 3203047 - protein, 26 aa, Giardia lamblia
QILTELFLCALPRRVFHYLEGPASVV

SEQ ID NO: 3203048 - protein, 20 aa, Giardia lamblia
QITWNFYPFLNPQERMLSHT

SEQ ID NO: 3203049 - protein, 23 aa, Giardia lamblia
QKGLLDLVPLLYTERDLLITVTA

SEQ ID NO: 3203050 - protein, 17 aa, Giardia lamblia
QKKVRIGGLYKPDFAPG

SEQ ID NO: 3203051 - protein, 24 aa, Giardia lamblia
QKMELFFLGLYNNIKLAVSYFCDK

SEQ ID NO: 3203052 - protein, 18 aa, Giardia lamblia
QKPILFPSMKLAPGKGFN

SEQ ID NO: 3203053 - protein, 22 aa, Giardia lamblia
QKRILFPRFYFLADSDVLEILS

SEQ ID NO: 3203054 - protein, 17 aa, Giardia lamblia
QKRVLSPVWFKAVETGA

SEQ ID NO: 3203055 - protein, 30 aa, Giardia lamblia
QKTCTALYYWSPDLASVSWLAQFVFPFVKF

SEQ ID NO: 3203056 - protein, 21 aa, Giardia lamblia
QKTRWFFTKLLAKEKGEHLDH

SEQ ID NO: 3203057 - protein, 27 aa, Giardia lamblia
QLDVPLPFPLFILTPDPYFLSGPGRQL

SEQ ID NO: 3203058 - protein, 24 aa, Giardia lamblia
QLEKNLLIYYDKYNQLRVKNGSLN

SEQ ID NO: 3203059 - protein, 20 aa, Giardia lamblia
QLFNEFIIARLLGGVSLHFE

SEQ ID NO: 3203060 - protein, 20 aa, Giardia lamblia
QLHRYRLFLDQLISIKDREL

SEQ ID NO: 3203061 - protein, 17 aa, Giardia lamblia
QLIFPPFVQFQSNLRTL

SEQ ID NO: 3203062 - protein, 21 aa, Giardia lamblia
QLIYLSTCRLILQGNGSLIMS

SEQ ID NO: 3203063 - protein, 18 aa, Giardia lamblia
QLKMIPILAPLEARKKDV

SEQ ID NO: 3203064 - protein, 19 aa, Giardia lamblia
QLLFPAFVVAKLEAAGGLT

SEQ ID NO: 3203065 - protein, 19 aa, Giardia lamblia
QLLKYLESLFLRSVLELIE

SEQ ID NO: 3203066 - protein, 17 aa, Giardia lamblia
QLLLWRAKPRLAPGFSD

SEQ ID NO: 3203067 - protein, 17 aa, Giardia lamblia
QLPQLLIMAISLESDTF

SEQ ID NO: 3203068 - protein, 25 aa, Giardia lamblia
QLRKQFRLWLLADLHYQVLTLLDSN

SEQ ID NO: 3203069 - protein, 23 aa, Giardia lamblia
QLSDILFRRALRSIGIHGPVELL

SEQ ID NO: 3203070 - protein, 24 aa, Giardia lamblia
QLTLSILPVWSYRDLLFKLSHSGS

SEQ ID NO: 3203071 - protein, 24 aa, Giardia lamblia
QLTVLELELLFFEAQLTEIDGKQE

SEQ ID NO: 3203072 - protein, 24 aa, Giardia lamblia
QNEETFMDILKRKISTTLTNVEYA

SEQ ID NO: 3203073 - protein, 20 aa, Giardia lamblia
QNESPIRRAAPAFSLSSRPV

SEQ ID NO: 3203074 - protein, 23 aa, Giardia lamblia
QNIRSIITQLLFDNSTINPAILN

SEQ ID NO: 3203075 - protein, 23 aa, Giardia lamblia
QNKWVSWWTDRVLNWALQKTAAT

SEQ ID NO: 3203076 - protein, 18 aa, Giardia lamblia
QNTYFRPNYFIGLSFLKD

SEQ ID NO: 3203077 - protein, 17 aa, Giardia lamblia
QPLPSVPALLTLPLMIL

SEQ ID NO: 3203078 - protein, 19 aa, Giardia lamblia
QPWMLMNIYLDLQTMCPEL

SEQ ID NO: 3203079 - protein, 22 aa, Giardia lamblia
QQESHFIEYLPPAKFDNSSFVQ

SEQ ID NO: 3203080 - protein, 18 aa, Giardia lamblia
QQKTISFDPLFDRSPDEA

SEQ ID NO: 3203081 - protein, 26 aa, Giardia lamblia
QQNLKLLLFLSKLLKMERLRNGALIL

SEQ ID NO: 3203082 - protein, 18 aa, Giardia lamblia
QQRILTRHNLLSERPQVG

SEQ ID NO: 3203083 - protein, 17 aa, Giardia lamblia
QRDFIFFRAYRYIFENK

SEQ ID NO: 3203084 - protein, 21 aa, Giardia lamblia
QRDIFLLSLLLKLLVAVVSFC

SEQ ID NO: 3203085 - protein, 23 aa, Giardia lamblia
QRHRFNTLLSQKIPKVLFSHNTK

SEQ ID NO: 3203086 - protein, 23 aa, Giardia lamblia
QRKPGLFSVHKYASALASSLCEG

SEQ ID NO: 3203087 - protein, 24 aa, Giardia lamblia
QRSRLNFALLTFQTLPSLLILDEP

SEQ ID NO: 3203088 - protein, 20 aa, Giardia lamblia
QSAERTLLMEKLRLKEEEYR

SEQ ID NO: 3203089 - protein, 18 aa, Giardia lamblia
QSILRIYIALDGSASSYH

SEQ ID NO: 3203090 - protein, 22 aa, Giardia lamblia
QSLYLRDWAIPRLLIFHEFQDH

SEQ ID NO: 3203091 - protein, 26 aa, Giardia lamblia
QSTGILRLGLFLPFLLKYEKEEQSTR

SEQ ID NO: 3203092 - protein, 17 aa, Giardia lamblia
QTAFFLLSGVLPPDQAI

SEQ ID NO: 3203093 - protein, 18 aa, Giardia lamblia
QTHDAVVLLQRKVTDLSQ

SEQ ID NO: 3203094 - protein, 17 aa, Giardia lamblia
QTLLLNPVRPRSFQIEF

SEQ ID NO: 3203095 - protein, 24 aa, Giardia lamblia
QTQWLEMVRSWWPLTRCILLNRAS

SEQ ID NO: 3203096 - protein, 20 aa, Giardia lamblia
QVCCILYQMATFRDLTHGVD

SEQ ID NO: 3203097 - protein, 23 aa, Giardia lamblia
QVEWHMLPVCPLLLTLTLSCNDL

SEQ ID NO: 3203098 - protein, 24 aa, Giardia lamblia
QVFQDFYFLLELLNTYFTSSIFED

SEQ ID NO: 3203099 - protein, 21 aa, Giardia lamblia
QVGGLFYQLPKVSTPRGSHHF

SEQ ID NO: 3203100 - protein, 29 aa, Giardia lamblia
QVLGIIQPFLLMQLFIPKDQIFSLNLGVA

SEQ ID NO: 3203101 - protein, 19 aa, Giardia lamblia
QVRELLDIYKGFRNSAQDT

SEQ ID NO: 3203102 - protein, 22 aa, Giardia lamblia
QVSLYYKHWLYFSNTGKLAMDP

SEQ ID NO: 3203103 - protein, 20 aa, Giardia lamblia
QWFDWFVRLVFKLVSDHSRS

SEQ ID NO: 3203104 - protein, 18 aa, Giardia lamblia
QWMAPLPLCFVTSSKKKL

SEQ ID NO: 3203105 - protein, 21 aa, Giardia lamblia
QWRIFVLIAKIYFIRSCKSNV

SEQ ID NO: 3203106 - protein, 17 aa, Giardia lamblia
QYALRLMRDRLAEGVGP

SEQ ID NO: 3203107 - protein, 23 aa, Giardia lamblia
QYCPSLPQDSLPLAYSALDNTDV

SEQ ID NO: 3203108 - protein, 22 aa, Giardia lamblia
QYDFIIFDRWLPSTSAFILFKM

SEQ ID NO: 3203109 - protein, 24 aa, Giardia lamblia
QYGRQSFIKYLLEKEARMHRSDGV

SEQ ID NO: 3203110 - protein, 19 aa, Giardia lamblia
QYLHYLIDHYMLRAGILPA

SEQ ID NO: 3203111 - protein, 17 aa, Giardia lamblia
QYMMLYRAIQRRVRKSL

SEQ ID NO: 3203112 - protein, 20 aa, Giardia lamblia
QYMYRAYDRMALFARRLLTR

SEQ ID NO: 3203113 - protein, 23 aa, Giardia lamblia
QYVLPYLIILITRLLPTAMELCE

SEQ ID NO: 3203114 - protein, 29 aa, Giardia lamblia
RAEYLEFPEKFIPCILQRVKPEYINKTYN

SEQ ID NO: 3203115 - protein, 19 aa, Giardia lamblia
RAFLLLCSSLQRVKLLLHG

SEQ ID NO: 3203116 - protein, 17 aa, Giardia lamblia
RAFLLLQTYQYASSKKN

SEQ ID NO: 3203117 - protein, 20 aa, Giardia lamblia
RAFQIPLLGIAGRPFLTLMG

SEQ ID NO: 3203118 - protein, 23 aa, Giardia lamblia
RAGNIGCIPFLITDSLLVRDCEG

SEQ ID NO: 3203119 - protein, 17 aa, Giardia lamblia
RAHGFLYSSLLPNNLRP

SEQ ID NO: 3203120 - protein, 23 aa, Giardia lamblia
RASEILPLLPYPRALERDKFIPP

SEQ ID NO: 3203121 - protein, 21 aa, Giardia lamblia
RAYLRPIFRDLGLTPVVCLLA

SEQ ID NO: 3203122 - protein, 18 aa, Giardia lamblia
RCFLWQVSSTRKSSGWRD

SEQ ID NO: 3203123 - protein, 17 aa, Giardia lamblia
RCWCERGFLPALDRSEC

SEQ ID NO: 3203124 - protein, 23 aa, Giardia lamblia
RDALFFELLGLYEKLLRGNNGEE

SEQ ID NO: 3203125 - protein, 24 aa, Giardia lamblia
RDALMLHRLLLRWKRNARLEASHN

SEQ ID NO: 3203126 - protein, 18 aa, Giardia lamblia
RDAVWFMLSALLDYIRYT

SEQ ID NO: 3203127 - protein, 27 aa, Giardia lamblia
RDDLPLFLLILALWQDNVYAARDLLSI

SEQ ID NO: 3203128 - protein, 20 aa, Giardia lamblia
RDIMLFIDTFSGEHVPRLRR

SEQ ID NO: 3203129 - protein, 17 aa, Giardia lamblia
RDKYELQLLARLTNYKT

SEQ ID NO: 3203130 - protein, 17 aa, Giardia lamblia
RDSIHNRPLYIMMEPSL

SEQ ID NO: 3203131 - protein, 21 aa, Giardia lamblia
RDTIFPLFRAINARYKFVMPG

SEQ ID NO: 3203132 - protein, 24 aa, Giardia lamblia
RDVAIAWEFNLWKSAETARFEAEL

SEQ ID NO: 3203133 - protein, 19 aa, Giardia lamblia
RDWRFFFSTSKIHDLSDGY

SEQ ID NO: 3203134 - protein, 19 aa, Giardia lamblia
RDYFNILSVYLDAVFRPAL

SEQ ID NO: 3203135 - protein, 20 aa, Giardia lamblia
RELLAELLFLRQECKRLSTV

SEQ ID NO: 3203136 - protein, 18 aa, Giardia lamblia
REPPTAKLPPLPGTKSNE

SEQ ID NO: 3203137 - protein, 18 aa, Giardia lamblia
RFCGLIVQLLYKLTIRAE

SEQ ID NO: 3203138 - protein, 22 aa, Giardia lamblia
RFGKFDWVPLLKPQNIRDMVVL

SEQ ID NO: 3203139 - protein, 21 aa, Giardia lamblia
RFIFCRFFNVYGPRQDPSSPY

SEQ ID NO: 3203140 - protein, 26 aa, Giardia lamblia
RFIYVAPLPCFIIIFIGAEVDTLHDS

SEQ ID NO: 3203141 - protein, 18 aa, Giardia lamblia
RFLELIDWKIGVSSLNPR

SEQ ID NO: 3203142 - protein, 20 aa, Giardia lamblia
RFNSRFIALLEYLPRFLLVN

SEQ ID NO: 3203143 - protein, 17 aa, Giardia lamblia
RFRAKVFTTIPPDPPPL

SEQ ID NO: 3203144 - protein, 19 aa, Giardia lamblia
RFRLWMDAILRMRMFTKFD

SEQ ID NO: 3203145 - protein, 19 aa, Giardia lamblia
RFRSVKPFIWYRLNPRRAR

SEQ ID NO: 3203146 - protein, 25 aa, Giardia lamblia
RGAQNYYWMPDLTKLAGLIVHSLVA

SEQ ID NO: 3203147 - protein, 23 aa, Giardia lamblia
RGHPPKDILSQVLHLTLDVIFPS

SEQ ID NO: 3203148 - protein, 22 aa, Giardia lamblia
RGIRLLNSLIFLSSLVDPLEDL

SEQ ID NO: 3203149 - protein, 20 aa, Giardia lamblia
RGKILELFQINDYKLFTTMI

SEQ ID NO: 3203150 - protein, 18 aa, Giardia lamblia
RGRTALMYAAEAGHLVIA

SEQ ID NO: 3203151 - protein, 25 aa, Giardia lamblia
RGTDGFIVLLPPSLKPQMPYVAQRW

SEQ ID NO: 3203152 - protein, 19 aa, Giardia lamblia
RGVYFKQPWMLMNIYLDLQ

SEQ ID NO: 3203153 - protein, 26 aa, Giardia lamblia
RHDLTVLLLSLRNLTLRLFTLVNAAR

SEQ ID NO: 3203154 - protein, 25 aa, Giardia lamblia
RHWHRLIFGVAFFYSSLLERKRFGS

SEQ ID NO: 3203155 - protein, 17 aa, Giardia lamblia
RIFFRDVLKVRIEHVGL

SEQ ID NO: 3203156 - protein, 18 aa, Giardia lamblia
RIGGLYKPDFAPGSGMDA

SEQ ID NO: 3203157 - protein, 23 aa, Giardia lamblia
RIKPAFEELFLSLSLSPNCIGYK

SEQ ID NO: 3203158 - protein, 21 aa, Giardia lamblia
RINKAWLLKTLLYQAKQVNNH

SEQ ID NO: 3203159 - protein, 17 aa, Giardia lamblia
RIPLHQLFFEMLFDPKQ

SEQ ID NO: 3203160 - protein, 21 aa, Giardia lamblia
RIPQESLIKMAFYLREKGDEV

SEQ ID NO: 3203161 - protein, 17 aa, Giardia lamblia
RIPYTPFIRLRRTMHER

SEQ ID NO: 3203162 - protein, 17 aa, Giardia lamblia
RIQCLIAALQNQEQSFK

SEQ ID NO: 3203163 - protein, 17 aa, Giardia lamblia
RIQQLMRLVLRIPSHSA

SEQ ID NO: 3203164 - protein, 24 aa, Giardia lamblia
RIRYPGLPFMTKPVPRSSLGLNHI

SEQ ID NO: 3203165 - protein, 17 aa, Giardia lamblia
RITIPYAAKLFFQEIIG

SEQ ID NO: 3203166 - protein, 24 aa, Giardia lamblia
RITSRFLIPYLKPSDLVALGIDCA

SEQ ID NO: 3203167 - protein, 20 aa, Giardia lamblia
RIVFIQWFNMNQLLGIITAG

SEQ ID NO: 3203168 - protein, 18 aa, Giardia lamblia
RIVQLLFLRASDSQLLIL

SEQ ID NO: 3203169 - protein, 24 aa, Giardia lamblia
RKAKLFMLPFAWNLDRIKAIPKSL

SEQ ID NO: 3203170 - protein, 18 aa, Giardia lamblia
RKAPAYTLAGRTAAHRPE

SEQ ID NO: 3203171 - protein, 24 aa, Giardia lamblia
RKAQFYLYIGCTYFLLDQRQTDHS

SEQ ID NO: 3203172 - protein, 17 aa, Giardia lamblia
RKEDLMIIKYLLSLEEE

SEQ ID NO: 3203173 - protein, 22 aa, Giardia lamblia
RKIFWNGGFVVGWFIAHPVQGP

SEQ ID NO: 3203174 - protein, 20 aa, Giardia lamblia
RKKRIGLFKFYIDYKDSIIP

SEQ ID NO: 3203175 - protein, 18 aa, Giardia lamblia
RKLARLELLVLLLAKIDR

SEQ ID NO: 3203176 - protein, 17 aa, Giardia lamblia
RKLLKWREKVIAHICEI

SEQ ID NO: 3203177 - protein, 18 aa, Giardia lamblia
RKRDAVVLVLDFLRAEGY

SEQ ID NO: 3203178 - protein, 20 aa, Giardia lamblia
RKTAWRFMLALPNDVDYYDS

SEQ ID NO: 3203179 - protein, 28 aa, Giardia lamblia
RKVFLPEPLIWRFAYNITLAILCLHSKG

SEQ ID NO: 3203180 - protein, 18 aa, Giardia lamblia
RKYFGVVAIFRALVDILQ

SEQ ID NO: 3203181 - protein, 29 aa, Giardia lamblia
RKYLQLGLDYIFIKYLLLQKKKYAATRLF

SEQ ID NO: 3203182 - protein, 29 aa, Giardia lamblia
RLDFPFCRDIFLMGLIPLANRLYSTYSTI

SEQ ID NO: 3203183 - protein, 19 aa, Giardia lamblia
RLGFLFLERVRTVLNLPRC

SEQ ID NO: 3203184 - protein, 17 aa, Giardia lamblia
RLGHLFYLEPNVLAMAV

SEQ ID NO: 3203185 - protein, 18 aa, Giardia lamblia
RLIYELYLKRKNSWYSDL

SEQ ID NO: 3203186 - protein, 18 aa, Giardia lamblia
RLLEIQPLPRKFVLMFQL

SEQ ID NO: 3203187 - protein, 17 aa, Giardia lamblia
RLLFADLLALKESFLAT

SEQ ID NO: 3203188 - protein, 18 aa, Giardia lamblia
RLLRAKITDLRRQIVSLR

SEQ ID NO: 3203189 - protein, 24 aa, Giardia lamblia
RLLRHAFMIWHFFTVRLINNDSRI

SEQ ID NO: 3203190 - protein, 18 aa, Giardia lamblia
RLLSILPGLLAQNAQRIA

SEQ ID NO: 3203191 - protein, 25 aa, Giardia lamblia
RLNRSLYTIVLLLNANKSTPEEARQ

SEQ ID NO: 3203192 - protein, 17 aa, Giardia lamblia
RLRLDESLPALDTLRSE

SEQ ID NO: 3203193 - protein, 23 aa, Giardia lamblia
RLSNFLPWHLAYAEIIFSDLLWP

SEQ ID NO: 3203194 - protein, 19 aa, Giardia lamblia
RLSTLQFYGKFLGSQALLK

SEQ ID NO: 3203195 - protein, 17 aa, Giardia lamblia
RLVFRGRIISNLPPGHL

SEQ ID NO: 3203196 - protein, 17 aa, Giardia lamblia
RLVVEYLLYLRAAQAVE

SEQ ID NO: 3203197 - protein, 23 aa, Giardia lamblia
RLWTKLRIFHRPICPWDLPLLDN

SEQ ID NO: 3203198 - protein, 17 aa, Giardia lamblia
RLYPIYVGKYTEFFGHR

SEQ ID NO: 3203199 - protein, 19 aa, Giardia lamblia
RLYTYRFLHLLRQSMIPRP

SEQ ID NO: 3203200 - protein, 25 aa, Giardia lamblia
RMFDFRLRLLSWYENLACGPITSVS

SEQ ID NO: 3203201 - protein, 18 aa, Giardia lamblia
RMGFLPEINYVWTAIDNE

SEQ ID NO: 3203202 - protein, 17 aa, Giardia lamblia
RMIETIILHLPVSLTEC

SEQ ID NO: 3203203 - protein, 25 aa, Giardia lamblia
RMKDLRYLRALLSRSDLPIGCVSNT

SEQ ID NO: 3203204 - protein, 18 aa, Giardia lamblia
RMTILLRDVLIALGNDRK

SEQ ID NO: 3203205 - protein, 19 aa, Giardia lamblia
RMVTWYYSPFPPPYTHLPE

SEQ ID NO: 3203206 - protein, 25 aa, Giardia lamblia
RNEGHFPFLLYIEPLEQVIKRWLLF

SEQ ID NO: 3203207 - protein, 19 aa, Giardia lamblia
RNEQLLYLEILRARKEKAL

SEQ ID NO: 3203208 - protein, 18 aa, Giardia lamblia
RNFYLLTLPLQRKCLDSP

SEQ ID NO: 3203209 - protein, 26 aa, Giardia lamblia
RNHSNFRFYILLCTYISTAGLTVKIN

SEQ ID NO: 3203210 - protein, 20 aa, Giardia lamblia
RNRYLELLSLQIQLLGHLEE

SEQ ID NO: 3203211 - protein, 19 aa, Giardia lamblia
RNYKFFKHFYQLKTLQTWI

SEQ ID NO: 3203212 - protein, 24 aa, Giardia lamblia
RPADWAWRLFIGLFTDQLSGDEWL

SEQ ID NO: 3203213 - protein, 22 aa, Giardia lamblia
RPDYLPLLSALLPSLKTIDGVS

SEQ ID NO: 3203214 - protein, 23 aa, Giardia lamblia
RPERKLRLLIIYAQFLHALCGPR

SEQ ID NO: 3203215 - protein, 20 aa, Giardia lamblia
RPLKILFSYPTRELAKDALE

SEQ ID NO: 3203216 - protein, 28 aa, Giardia lamblia
RPPNLDYMLLLQGKLNNLIPYFEDTRST

SEQ ID NO: 3203217 - protein, 24 aa, Giardia lamblia
RPQDILVSGLRYELRRLFSAFGMV

SEQ ID NO: 3203218 - protein, 18 aa, Giardia lamblia
RPQTILEFLLLKVQSHKL

SEQ ID NO: 3203219 - protein, 18 aa, Giardia lamblia
RPYMTTKLWYNITSPFFD

SEQ ID NO: 3203220 - protein, 24 aa, Giardia lamblia
RQCGKFKMFKIKDSDSWFSAVSEG

SEQ ID NO: 3203221 - protein, 17 aa, Giardia lamblia
RQFSSFYSGRYLEKSFL

SEQ ID NO: 3203222 - protein, 20 aa, Giardia lamblia
RQHLLLYRKLYSDIVPTLVY

SEQ ID NO: 3203223 - protein, 24 aa, Giardia lamblia
RQRASFYWRLLGVDPTLQTAKGVL

SEQ ID NO: 3203224 - protein, 17 aa, Giardia lamblia
RRCIRTHLSTMDGILAL

SEQ ID NO: 3203225 - protein, 17 aa, Giardia lamblia
RRFEGYGYLLRYIDRDL

SEQ ID NO: 3203226 - protein, 18 aa, Giardia lamblia
RRHGLGRVIFPNGDVFIG

SEQ ID NO: 3203227 - protein, 18 aa, Giardia lamblia
RRILCQMVMLSLPSDDTK

SEQ ID NO: 3203228 - protein, 29 aa, Giardia lamblia
RRITFEFPTFHLVGLLWGVRWGFFSGELI

SEQ ID NO: 3203229 - protein, 20 aa, Giardia lamblia
RRLLRLLEPFLPIPVELTPE

SEQ ID NO: 3203230 - protein, 17 aa, Giardia lamblia
RRLLTLQHRSALSQRAW

SEQ ID NO: 3203231 - protein, 20 aa, Giardia lamblia
RRLWILIDTIVFDVTEYLNK

SEQ ID NO: 3203232 - protein, 17 aa, Giardia lamblia
RRNIKLQAALWKHKRTL

SEQ ID NO: 3203233 - protein, 18 aa, Giardia lamblia
RRREQVLALIFWKRLGAR

SEQ ID NO: 3203234 - protein, 20 aa, Giardia lamblia
RRRTFLFSATFPSAVQALQN

SEQ ID NO: 3203235 - protein, 22 aa, Giardia lamblia
RRSLCYPLLLLQLFSSRVNGAA

SEQ ID NO: 3203236 - protein, 26 aa, Giardia lamblia
RSDIWSFGLLLWTMCTLRHPLFNLDE

SEQ ID NO: 3203237 - protein, 20 aa, Giardia lamblia
RSHPHLYPDGFARFLLFCRH

SEQ ID NO: 3203238 - protein, 22 aa, Giardia lamblia
RSKRLFSLFRNVNLSALRSLSE

SEQ ID NO: 3203239 - protein, 24 aa, Giardia lamblia
RSLLTPYPTFCAMTIRTGTRRING

SEQ ID NO: 3203240 - protein, 24 aa, Giardia lamblia
RSLSVHLYRRCKIYRRAACEKNQQ

SEQ ID NO: 3203241 - protein, 28 aa, Giardia lamblia
RSNVIQFIGAMWYILMNPPYDNLSAQLK

SEQ ID NO: 3203242 - protein, 32 aa, Giardia lamblia
RSQDAITLLALKSAIYLECNFVKSISGAGPPS

SEQ ID NO: 3203243 - protein, 19 aa, Giardia lamblia
RSRLPLLVPLRLPPDPSTT

SEQ ID NO: 3203244 - protein, 22 aa, Giardia lamblia
RSRPLPLAQLLSKFIRPAAPVS

SEQ ID NO: 3203245 - protein, 18 aa, Giardia lamblia
RSSHFLLIKATLFIMDSL

SEQ ID NO: 3203246 - protein, 21 aa, Giardia lamblia
RSTLFAGVLYPDSLSFASHMC

SEQ ID NO: 3203247 - protein, 26 aa, Giardia lamblia
RTAMMHAVLNRRFDAVKQLSLRETGY

SEQ ID NO: 3203248 - protein, 17 aa, Giardia lamblia
RTFELWLLDAHPSTEIP

SEQ ID NO: 3203249 - protein, 18 aa, Giardia lamblia
RTFTLLLDRMEGASLKLT

SEQ ID NO: 3203250 - protein, 18 aa, Giardia lamblia
RTLGPINPFILGQLIFML

SEQ ID NO: 3203251 - protein, 18 aa, Giardia lamblia
RTLGVMYTINFINPTERN

SEQ ID NO: 3203252 - protein, 25 aa, Giardia lamblia
RTNIKYSPFLLLGSYKTIVSDYPSA

SEQ ID NO: 3203253 - protein, 22 aa, Giardia lamblia
RTVLEFMVKLIFYPPLKHGQAR

SEQ ID NO: 3203254 - protein, 23 aa, Giardia lamblia
RVCGTQYFRPYSFPVIERATALY

SEQ ID NO: 3203255 - protein, 25 aa, Giardia lamblia
RVERLIEIVMYYIKHFFTIESLRIL

SEQ ID NO: 3203256 - protein, 17 aa, Giardia lamblia
RVHYYKRKPRIARMSTC

SEQ ID NO: 3203257 - protein, 21 aa, Giardia lamblia
RVILRIRPLVRAELMDGGGVS

SEQ ID NO: 3203258 - protein, 27 aa, Giardia lamblia
RVKDPFTYAFILKIAFLFSGGMTKVQQ

SEQ ID NO: 3203259 - protein, 17 aa, Giardia lamblia
RVLSPVWFKAVETGAHV

SEQ ID NO: 3203260 - protein, 19 aa, Giardia lamblia
RVMCGVPMLLLAYGVTSAG

SEQ ID NO: 3203261 - protein, 17 aa, Giardia lamblia
RVRRKYLLWVSYMQIYN

SEQ ID NO: 3203262 - protein, 17 aa, Giardia lamblia
RVTALMYAAYYGYGMCV

SEQ ID NO: 3203263 - protein, 24 aa, Giardia lamblia
RVTAWFCQWLNQLGVIFRFVKRPE

SEQ ID NO: 3203264 - protein, 18 aa, Giardia lamblia
RVTFIRPLNYIDDCACPA

SEQ ID NO: 3203265 - protein, 22 aa, Giardia lamblia
RVTSQIFWLFRHIPSVDNSLIT

SEQ ID NO: 3203266 - protein, 24 aa, Giardia lamblia
RVYKYDWFARLFLAIILSIPTCDP

SEQ ID NO: 3203267 - protein, 17 aa, Giardia lamblia
RWNIFNPTALMLAAAYN

SEQ ID NO: 3203268 - protein, 17 aa, Giardia lamblia
RYAVYRLLSKRLLDFEV

SEQ ID NO: 3203269 - protein, 22 aa, Giardia lamblia
RYELDRMRYAFAIAKFNSIQTA

SEQ ID NO: 3203270 - protein, 17 aa, Giardia lamblia
RYHEVVGLSFLKIDLFK

SEQ ID NO: 3203271 - protein, 25 aa, Giardia lamblia
RYNIPPLSLKLPLQNALPTAANPPT

SEQ ID NO: 3203272 - protein, 18 aa, Giardia lamblia
RYVIPFFSLIDAVHCPPI

SEQ ID NO: 3203273 - protein, 25 aa, Giardia lamblia
RYVLLFVNGTLWTPFPGVFVRPNCY

SEQ ID NO: 3203274 - protein, 20 aa, Giardia lamblia
RYWSYFICGFFRYPYSAVPR

SEQ ID NO: 3203275 - protein, 22 aa, Giardia lamblia
RYYILATMLLTCGYTLTILGNT

SEQ ID NO: 3203276 - protein, 19 aa, Giardia lamblia
SAAAPVPNFLAPPATGHSG

SEQ ID NO: 3203277 - protein, 23 aa, Giardia lamblia
SAAELLMFPIITESLQKLSFKYA

SEQ ID NO: 3203278 - protein, 23 aa, Giardia lamblia
SAAELLPYPTLPLPRILGYCGDR

SEQ ID NO: 3203279 - protein, 18 aa, Giardia lamblia
SAEFLMGFLLSAPVPLQR

SEQ ID NO: 3203280 - protein, 24 aa, Giardia lamblia
SAGPLEADALRHSIRKLQFQLTQR

SEQ ID NO: 3203281 - protein, 23 aa, Giardia lamblia
SAKDMLPLFYLIGALTVEYHKES

SEQ ID NO: 3203282 - protein, 17 aa, Giardia lamblia
SAWLYTPSLLIKPDPDP

SEQ ID NO: 3203283 - protein, 33 aa, Giardia lamblia
SCGPDYLLSVLNWAQRRLLLKAPAFTSPVYRVS

SEQ ID NO: 3203284 - protein, 24 aa, Giardia lamblia
SCNPLLQMFYLNPYIFYRNGRVYS

SEQ ID NO: 3203285 - protein, 23 aa, Giardia lamblia
SCSSCLLPILPYKLKNEKASVLY

SEQ ID NO: 3203286 - protein, 18 aa, Giardia lamblia
SCVWIFRYAATSPVALSV

SEQ ID NO: 3203287 - protein, 21 aa, Giardia lamblia
SDAVFSCYLSFLRLAYFYHDK

SEQ ID NO: 3203288 - protein, 17 aa, Giardia lamblia
SDDSICLKPLRKAGMSV

SEQ ID NO: 3203289 - protein, 21 aa, Giardia lamblia
SDFQLAFQPPVPEKWEPLDTV

SEQ ID NO: 3203290 - protein, 21 aa, Giardia lamblia
SDFSLPCNAVIFLNLHGKVDG

SEQ ID NO: 3203291 - protein, 24 aa, Giardia lamblia
SDLEDLFMLTPRSYGVLASQQPDF

SEQ ID NO: 3203292 - protein, 21 aa, Giardia lamblia
SDLLRFLRALGLPFTLKDVAD

SEQ ID NO: 3203293 - protein, 20 aa, Giardia lamblia
SDLQFLLPHLPSPELNYNSA

SEQ ID NO: 3203294 - protein, 20 aa, Giardia lamblia
SDLYRYFSPAKLSPVRNLQQ

SEQ ID NO: 3203295 - protein, 17 aa, Giardia lamblia
SDNYIFYGFPRSQEVNI

SEQ ID NO: 3203296 - protein, 25 aa, Giardia lamblia
SDPRAFYLEALLSKLLLASSFNAAD

SEQ ID NO: 3203297 - protein, 23 aa, Giardia lamblia
SEDKIWSIFAQLLIALDYCHSPN

SEQ ID NO: 3203298 - protein, 17 aa, Giardia lamblia
SEERFYISIWFIGAMKL

SEQ ID NO: 3203299 - protein, 23 aa, Giardia lamblia
SEGDVLIPVPFQLADQPPGSIES

SEQ ID NO: 3203300 - protein, 19 aa, Giardia lamblia
SEHSVYPNTLIWTPSTSSL

SEQ ID NO: 3203301 - protein, 20 aa, Giardia lamblia
SEIYLWKIVKYLLDTFVRLH

SEQ ID NO: 3203302 - protein, 19 aa, Giardia lamblia
SELWYFPPFFTLQQKIEQA

SEQ ID NO: 3203303 - protein, 18 aa, Giardia lamblia
SENYVLIFSFPSLFGQTL

SEQ ID NO: 3203304 - protein, 23 aa, Giardia lamblia
SEPTLTMPFAISTIPLYTMNPAK

SEQ ID NO: 3203305 - protein, 19 aa, Giardia lamblia
SERILLKNLFVTLPSRSGT

SEQ ID NO: 3203306 - protein, 17 aa, Giardia lamblia
SFDPLFDRSPDEAKTIS

SEQ ID NO: 3203307 - protein, 22 aa, Giardia lamblia
SFDTFWLQFDLSAYSKSSLPLA

SEQ ID NO: 3203308 - protein, 25 aa, Giardia lamblia
SFGNVYFITFPLQSPLRTALFFQTK

SEQ ID NO: 3203309 - protein, 20 aa, Giardia lamblia
SFHSLECLILLFSSAPKPLS

SEQ ID NO: 3203310 - protein, 21 aa, Giardia lamblia
SFHSLIAYLRYYHNHISLEGS

SEQ ID NO: 3203311 - protein, 24 aa, Giardia lamblia
SFIRKLYALLYISTALHIILDARR

SEQ ID NO: 3203312 - protein, 17 aa, Giardia lamblia
SFLLLPKLIRAAHTNNT

SEQ ID NO: 3203313 - protein, 17 aa, Giardia lamblia
SFLLPLKPLFGALSEQM

SEQ ID NO: 3203314 - protein, 25 aa, Giardia lamblia
SFLYWKSRVYGWFYSPPLGANSALY

SEQ ID NO: 3203315 - protein, 18 aa, Giardia lamblia
SFPAILNGYLKMTKDELL

SEQ ID NO: 3203316 - protein, 20 aa, Giardia lamblia
SFRRYIDFSFWFIRDTSCED

SEQ ID NO: 3203317 - protein, 17 aa, Giardia lamblia
SFSLLRKFPYGLSPPVA

SEQ ID NO: 3203318 - protein, 20 aa, Giardia lamblia
SFSYCQALLLDLPIKESRTE

SEQ ID NO: 3203319 - protein, 20 aa, Giardia lamblia
SFVRLLPFYFKYENIHSTQP

SEQ ID NO: 3203320 - protein, 20 aa, Giardia lamblia
SFYYPKYYAINKIRTHRLLN

SEQ ID NO: 3203321 - protein, 23 aa, Giardia lamblia
SGAPYPHILPTTPLQGQIFPQYV

SEQ ID NO: 3203322 - protein, 25 aa, Giardia lamblia
SGIIQSMFMLFLSNAPFDSLMHASF

SEQ ID NO: 3203323 - protein, 21 aa, Giardia lamblia
SGLRCRLLVHFPLFVEYSENR

SEQ ID NO: 3203324 - protein, 17 aa, Giardia lamblia
SGPMPFMPQSYPGMPVV

SEQ ID NO: 3203325 - protein, 22 aa, Giardia lamblia
SHDPLLQWLLTMVWQQYKTHID

SEQ ID NO: 3203326 - protein, 24 aa, Giardia lamblia
SHKETAFYLALYHNNLSTAKILEP

SEQ ID NO: 3203327 - protein, 20 aa, Giardia lamblia
SHKIIYRRYAGLYFTICCDL

SEQ ID NO: 3203328 - protein, 18 aa, Giardia lamblia
SHLEPLLPLLLEMANLFK

SEQ ID NO: 3203329 - protein, 24 aa, Giardia lamblia
SHPFFRYHPFTPASYIPLFQSRNI

SEQ ID NO: 3203330 - protein, 19 aa, Giardia lamblia
SHTKLSGLYWVLCSIFILH

SEQ ID NO: 3203331 - protein, 19 aa, Giardia lamblia
SIFLVILNKMLFFTSFPNE

SEQ ID NO: 3203332 - protein, 21 aa, Giardia lamblia
SIHALRVLFFHYGNESDNMGL

SEQ ID NO: 3203333 - protein, 18 aa, Giardia lamblia
SIKVGLLPKIFTMLLGAC

SEQ ID NO: 3203334 - protein, 22 aa, Giardia lamblia
SILIVCEVLLYPVPINDAERYS

SEQ ID NO: 3203335 - protein, 20 aa, Giardia lamblia
SILRALPLPIPATACYLYER

SEQ ID NO: 3203336 - protein, 21 aa, Giardia lamblia
SINLDLRTCIWMHWAQIQALG

SEQ ID NO: 3203337 - protein, 18 aa, Giardia lamblia
SINYSLDLKCPCGCLSVA

SEQ ID NO: 3203338 - protein, 20 aa, Giardia lamblia
SIPELLFYRFSSTKGCNDKL

SEQ ID NO: 3203339 - protein, 18 aa, Giardia lamblia
SIPSPPRRPWPASIPAER

SEQ ID NO: 3203340 - protein, 25 aa, Giardia lamblia
SIQDYLDFDLIPRPLASMQSFLMKD

SEQ ID NO: 3203341 - protein, 21 aa, Giardia lamblia
SIRQLLFRPIPPAEYARIIGI

SEQ ID NO: 3203342 - protein, 19 aa, Giardia lamblia
SISLYLPFQQFYTDNLGRT

SEQ ID NO: 3203343 - protein, 26 aa, Giardia lamblia
SIVAMRRRAIRFSDIKPLPYSNFQRD

SEQ ID NO: 3203344 - protein, 18 aa, Giardia lamblia
SIVFPNRLYYRPSAFPTV

SEQ ID NO: 3203345 - protein, 24 aa, Giardia lamblia
SKELLWFFRSRLGIAVSPLIILQT

SEQ ID NO: 3203346 - protein, 21 aa, Giardia lamblia
SKKELFFLVAATMQKVKKPQH

SEQ ID NO: 3203347 - protein, 21 aa, Giardia lamblia
SKKSLWIAPLPHQPVSNSTQQ

SEQ ID NO: 3203348 - protein, 30 aa, Giardia lamblia
SKLLDLVGFYNIPLYYGLYSEFKGLHEMRF

SEQ ID NO: 3203349 - protein, 21 aa, Giardia lamblia
SKLLIYSVFLDLLGLATYLFT

SEQ ID NO: 3203350 - protein, 20 aa, Giardia lamblia
SKLPIYYNPLHTGAIEVTTP

SEQ ID NO: 3203351 - protein, 18 aa, Giardia lamblia
SKPELLPMMPSAKSAPSI

SEQ ID NO: 3203352 - protein, 17 aa, Giardia lamblia
SKQIRLFFVKYNDPLYI

SEQ ID NO: 3203353 - protein, 24 aa, Giardia lamblia
SKRSLFTRFYFISDDELLFLLGNS

SEQ ID NO: 3203354 - protein, 31 aa, Giardia lamblia
SKSWKQIYKTLLLIEHLLINASPDTVRDIQS

SEQ ID NO: 3203355 - protein, 24 aa, Giardia lamblia
SKTFLDLAVLLRPSIFNNDYLILN

SEQ ID NO: 3203356 - protein, 17 aa, Giardia lamblia
SLDLHGILPRRSPLGTL

SEQ ID NO: 3203357 - protein, 24 aa, Giardia lamblia
SLDQYFVFSLLIFDKFRHNAEAEC

SEQ ID NO: 3203358 - protein, 22 aa, Giardia lamblia
SLDVVILLTPILWAKSDEGYKT

SEQ ID NO: 3203359 - protein, 25 aa, Giardia lamblia
SLEDRFLLVQLAPPEWPIIVWAIPP

SEQ ID NO: 3203360 - protein, 23 aa, Giardia lamblia
SLEDVLSYLRFGNRLREVAATDL

SEQ ID NO: 3203361 - protein, 26 aa, Giardia lamblia
SLEVIIYLFLLKIKYPKSIYLLRGNH

SEQ ID NO: 3203362 - protein, 18 aa, Giardia lamblia
SLFGKIGCYWVFRAETDA

SEQ ID NO: 3203363 - protein, 18 aa, Giardia lamblia
SLGCILIQLLFDYPAFHS

SEQ ID NO: 3203364 - protein, 21 aa, Giardia lamblia
SLGLLFFEVICGRPLFSCSND

SEQ ID NO: 3203365 - protein, 24 aa, Giardia lamblia
SLHPLQLRILLRSLQLLKVGGTLV

SEQ ID NO: 3203366 - protein, 19 aa, Giardia lamblia
SLHRIVCLLSYPYTKTSQR

SEQ ID NO: 3203367 - protein, 17 aa, Giardia lamblia
SLIKDFKFPIALSPALL

SEQ ID NO: 3203368 - protein, 25 aa, Giardia lamblia
SLIQEILARMRILYTSLFNLYTNSN

SEQ ID NO: 3203369 - protein, 23 aa, Giardia lamblia
SLLHLSFIPTGLWYDKTHIVAYN

SEQ ID NO: 3203370 - protein, 18 aa, Giardia lamblia
SLLLIKFTAIYKASQSIC

SEQ ID NO: 3203371 - protein, 24 aa, Giardia lamblia
SLNDLLPMFQLLDFNASHNVIVDV

SEQ ID NO: 3203372 - protein, 24 aa, Giardia lamblia
SLPIALYSYRRKLFHTILAGTRQA

SEQ ID NO: 3203373 - protein, 20 aa, Giardia lamblia
SLPLRYLFSVNSIFPELGYG

SEQ ID NO: 3203374 - protein, 18 aa, Giardia lamblia
SLPPWLQRAAEALQFDED

SEQ ID NO: 3203375 - protein, 18 aa, Giardia lamblia
SLSLAFLIQEADGILLFG

SEQ ID NO: 3203376 - protein, 24 aa, Giardia lamblia
SLSPLLEYLLMALLRLTPENRIHT

SEQ ID NO: 3203377 - protein, 24 aa, Giardia lamblia
SLSQTFFLLIRKILTHILVTQSAP

SEQ ID NO: 3203378 - protein, 21 aa, Giardia lamblia
SLTIRCPIPMFVVFSWGTILN

SEQ ID NO: 3203379 - protein, 22 aa, Giardia lamblia
SLVAFIYILRCLSLCKKSAIIA

SEQ ID NO: 3203380 - protein, 17 aa, Giardia lamblia
SLYDARVPSRWLNVSWP

SEQ ID NO: 3203381 - protein, 19 aa, Giardia lamblia
SLYSFFSFCLQRKCRRRVL

SEQ ID NO: 3203382 - protein, 24 aa, Giardia lamblia
SMFGDLWVLDLTTLRWNRGPEGPS

SEQ ID NO: 3203383 - protein, 23 aa, Giardia lamblia
SMGLGMFWCGFLLAAVASSQELH

SEQ ID NO: 3203384 - protein, 18 aa, Giardia lamblia
SMIALFKFATEELRDTCL

SEQ ID NO: 3203385 - protein, 21 aa, Giardia lamblia
SMNGYYLYHFFLTHKLLTDRD

SEQ ID NO: 3203386 - protein, 21 aa, Giardia lamblia
SMYCDLFMYLEAIRLCKRCGD

SEQ ID NO: 3203387 - protein, 17 aa, Giardia lamblia
SNKYGLRLNLLPNAPPL

SEQ ID NO: 3203388 - protein, 26 aa, Giardia lamblia
SNNPLVWLFEATAFQLIPLKASLTHC

SEQ ID NO: 3203389 - protein, 25 aa, Giardia lamblia
SPALRLMLLHLLLQRYFSLLKDSLN

SEQ ID NO: 3203390 - protein, 21 aa, Giardia lamblia
SPFETYFLRPCGKKRVLAKKS

SEQ ID NO: 3203391 - protein, 22 aa, Giardia lamblia
SPFLLWACGILKKDISINPKTL

SEQ ID NO: 3203392 - protein, 23 aa, Giardia lamblia
SPGPPQGFLKRLKRAVKYLFSGT

SEQ ID NO: 3203393 - protein, 24 aa, Giardia lamblia
SPIRYRSFFLLTEESRLVLLYEKF

SEQ ID NO: 3203394 - protein, 25 aa, Giardia lamblia
SPLWFEKFHWFFSTDGYLVLSGRDA

SEQ ID NO: 3203395 - protein, 23 aa, Giardia lamblia
SPLYKFPVLFLSTAVVMNIAKSA

SEQ ID NO: 3203396 - protein, 18 aa, Giardia lamblia
SPNPYIRLLHNAFKVVYE

SEQ ID NO: 3203397 - protein, 23 aa, Giardia lamblia
SPPPLLPVTLAQLTAYPPSADVK

SEQ ID NO: 3203398 - protein, 22 aa, Giardia lamblia
SPTSFLLLMLYGCCFNAQSEEP

SEQ ID NO: 3203399 - protein, 24 aa, Giardia lamblia
SQAGIPCFYGLLTSLPLFIKHATK

SEQ ID NO: 3203400 - protein, 21 aa, Giardia lamblia
SQFEPVVIPLTPPLSASSSSS

SEQ ID NO: 3203401 - protein, 19 aa, Giardia lamblia
SQFSLFLLPRFIRAARTNE

SEQ ID NO: 3203402 - protein, 23 aa, Giardia lamblia
SQKYLPFKQLAVSVAFFPSGPGS

SEQ ID NO: 3203403 - protein, 24 aa, Giardia lamblia
SQMLLAPDHPLLAPIQKRLLDQVT

SEQ ID NO: 3203404 - protein, 20 aa, Giardia lamblia
SQQEYYYFSPALPGETRACE

SEQ ID NO: 3203405 - protein, 26 aa, Giardia lamblia
SQQTFSFFIPLRYLSTIFNSGRYFFP

SEQ ID NO: 3203406 - protein, 21 aa, Giardia lamblia
SQTLHFFPPYLPSIISRLSST

SEQ ID NO: 3203407 - protein, 19 aa, Giardia lamblia
SRAYIFTMLSLLASSPASV

SEQ ID NO: 3203408 - protein, 24 aa, Giardia lamblia
SRDNLAQFWLPPHLNLSLGQMKHL

SEQ ID NO: 3203409 - protein, 18 aa, Giardia lamblia
SRELIRADRLVFGKPRNS

SEQ ID NO: 3203410 - protein, 25 aa, Giardia lamblia
SRERGHLLLVFRDTERKSYHSCVKV

SEQ ID NO: 3203411 - protein, 17 aa, Giardia lamblia
SRFDGLFKHLIVAISIA

SEQ ID NO: 3203412 - protein, 27 aa, Giardia lamblia
SRGLACVLFIYVLKYLYPRNVLLLRGN

SEQ ID NO: 3203413 - protein, 21 aa, Giardia lamblia
SRHKFMLYGKDNRIKFLMGCI

SEQ ID NO: 3203414 - protein, 25 aa, Giardia lamblia
SRKAPFLRYILFKYKQRDLAIPDTP

SEQ ID NO: 3203415 - protein, 23 aa, Giardia lamblia
SRKHPDVLLLLDRKKELQAALES

SEQ ID NO: 3203416 - protein, 18 aa, Giardia lamblia
SRLGIAVSPLIILQTFKL

SEQ ID NO: 3203417 - protein, 24 aa, Giardia lamblia
SRLWPSFIFLIRLLDFSPAFDIQK

SEQ ID NO: 3203418 - protein, 18 aa, Giardia lamblia
SRQIFRRVILRDLPPQMV

SEQ ID NO: 3203419 - protein, 19 aa, Giardia lamblia
SRRGFYPLAFVFLSPTDFT

SEQ ID NO: 3203420 - protein, 18 aa, Giardia lamblia
SRRGLFLAPVLSVTRLFN

SEQ ID NO: 3203421 - protein, 18 aa, Giardia lamblia
SRRTLLIDLVFLSSHYKI

SEQ ID NO: 3203422 - protein, 20 aa, Giardia lamblia
SRSCRIDSIYRLPFYYRFNI

SEQ ID NO: 3203423 - protein, 21 aa, Giardia lamblia
SRVLTALLLLLLEALPEATDS

SEQ ID NO: 3203424 - protein, 18 aa, Giardia lamblia
SRVTWHPRQPWLLCSGTD

SEQ ID NO: 3203425 - protein, 19 aa, Giardia lamblia
SRWMDLMCNLALEAVSIVA

SEQ ID NO: 3203426 - protein, 22 aa, Giardia lamblia
SSCILFGGVHRAQMSPWATIEG

SEQ ID NO: 3203427 - protein, 24 aa, Giardia lamblia
SSDLHLDLFLLIAGLLHPNPKARM

SEQ ID NO: 3203428 - protein, 23 aa, Giardia lamblia
SSDPELLTLYLLTTFVSQYGHNH

SEQ ID NO: 3203429 - protein, 17 aa, Giardia lamblia
SSFGGILSCRFVRGTRT

SEQ ID NO: 3203430 - protein, 25 aa, Giardia lamblia
SSFLHNILSIYWLPSFLQAGTMNEI

SEQ ID NO: 3203431 - protein, 23 aa, Giardia lamblia
SSGIPMPYILAQPKDRSPPQQAD

SEQ ID NO: 3203432 - protein, 23 aa, Giardia lamblia
SSIKWYMWQLLHAVRIAHASGTF

SEQ ID NO: 3203433 - protein, 26 aa, Giardia lamblia
SSISCFPYLFPYLSFEKDYQGRTALD

SEQ ID NO: 3203434 - protein, 22 aa, Giardia lamblia
SSKIINWWRYATVTGAFNSACA

SEQ ID NO: 3203435 - protein, 20 aa, Giardia lamblia
SSLGTFPYFWASKAEYEEYG

SEQ ID NO: 3203436 - protein, 24 aa, Giardia lamblia
SSLIYLFDYAVIKKSFFSLINANS

SEQ ID NO: 3203437 - protein, 24 aa, Giardia lamblia
SSLLMLLIQLRRLARDHLLQVKAE

SEQ ID NO: 3203438 - protein, 24 aa, Giardia lamblia
SSPEFLPLILLMDLSRVCTILQND

SEQ ID NO: 3203439 - protein, 22 aa, Giardia lamblia
SSPLETYLRLFADIFLSDEEYV

SEQ ID NO: 3203440 - protein, 23 aa, Giardia lamblia
SSTIQYILKMDPRWLPVSEKEIR

SEQ ID NO: 3203441 - protein, 24 aa, Giardia lamblia
SSTSYWTTLYRFLKDPSLSVESKA

SEQ ID NO: 3203442 - protein, 24 aa, Giardia lamblia
SSTYPHLGILRPTTIIFPPSDEPS

SEQ ID NO: 3203443 - protein, 25 aa, Giardia lamblia
SSVIHPVIGPILSPLRSKILSETQF

SEQ ID NO: 3203444 - protein, 25 aa, Giardia lamblia
SSVLATLMMFYNTAYLLPLSKVIDD

SEQ ID NO: 3203445 - protein, 27 aa, Giardia lamblia
SSVLTRSIFLANPILFMASLLSLSLSS

SEQ ID NO: 3203446 - protein, 25 aa, Giardia lamblia
SSYGFVLLVIFYLQILQTPILPVLQ

SEQ ID NO: 3203447 - protein, 21 aa, Giardia lamblia
SSYYYAAFVRPFGVYLARKSA

SEQ ID NO: 3203448 - protein, 24 aa, Giardia lamblia
STAKLLLIFLEYMVCWTLGIGRKQ

SEQ ID NO: 3203449 - protein, 25 aa, Giardia lamblia
STCDKEIYVWFPIQQRQLARPSIEP

SEQ ID NO: 3203450 - protein, 17 aa, Giardia lamblia
STFPFFPTFNFVNAIIS

SEQ ID NO: 3203451 - protein, 23 aa, Giardia lamblia
STIIIRLIVVLPTAAIRIYLVEP

SEQ ID NO: 3203452 - protein, 17 aa, Giardia lamblia
STNLVFPDLPPPQFSNY

SEQ ID NO: 3203453 - protein, 21 aa, Giardia lamblia
STPGFYKLPSTLGGPAFSMSS

SEQ ID NO: 3203454 - protein, 20 aa, Giardia lamblia
STYTHICYMLPFISPTASEA

SEQ ID NO: 3203455 - protein, 23 aa, Giardia lamblia
SVDPLIMYIYNEGLGRFATRKYH

SEQ ID NO: 3203456 - protein, 23 aa, Giardia lamblia
SVETFLLLIAFKVKFPTRISLLR

SEQ ID NO: 3203457 - protein, 20 aa, Giardia lamblia
SVFLNFLQWIYSPQMEKLDF

SEQ ID NO: 3203458 - protein, 17 aa, Giardia lamblia
SVFVQLLHALNYCHSLH

SEQ ID NO: 3203459 - protein, 19 aa, Giardia lamblia
SVIIQKYWRRALAKSKVNA

SEQ ID NO: 3203460 - protein, 17 aa, Giardia lamblia
SVLHYLHTLPYSSLFFV

SEQ ID NO: 3203461 - protein, 17 aa, Giardia lamblia
SVLRQLAAALAYLHGLS

SEQ ID NO: 3203462 - protein, 17 aa, Giardia lamblia
SVPALLTLPLMILGSTE

SEQ ID NO: 3203463 - protein, 21 aa, Giardia lamblia
SVQALPLAQFALSPPTSLTNS

SEQ ID NO: 3203464 - protein, 17 aa, Giardia lamblia
SVRIHRPMSAGINLKVS

SEQ ID NO: 3203465 - protein, 19 aa, Giardia lamblia
SVSMVLYQRLAYLLCTSRL

SEQ ID NO: 3203466 - protein, 19 aa, Giardia lamblia
SWFVKYLKTYKFIYRRYVK

SEQ ID NO: 3203467 - protein, 23 aa, Giardia lamblia
SWLAQFVFPFVKFWERDTVAAFE

SEQ ID NO: 3203468 - protein, 20 aa, Giardia lamblia
SWLMADRWWTKNISALIFTY

SEQ ID NO: 3203469 - protein, 20 aa, Giardia lamblia
SWPRWTNIFFSATKALLGGR

SEQ ID NO: 3203470 - protein, 19 aa, Giardia lamblia
SWSTIKIDMPPRGAVRDAS

SEQ ID NO: 3203471 - protein, 20 aa, Giardia lamblia
SYEISYWKMAPATAMMIAAM

SEQ ID NO: 3203472 - protein, 17 aa, Giardia lamblia
SYHPTMGLLPKREYDRT

SEQ ID NO: 3203473 - protein, 32 aa, Giardia lamblia
SYKYDLTLPFFPHLLPYKLAFAGFLRRESRTN

SEQ ID NO: 3203474 - protein, 20 aa, Giardia lamblia
SYLFVLKYPACRGFKPILLD

SEQ ID NO: 3203475 - protein, 20 aa, Giardia lamblia
SYLIELIEKLLMLHQIRLAE

SEQ ID NO: 3203476 - protein, 17 aa, Giardia lamblia
SYLYSNVTPYYQYKRQL

SEQ ID NO: 3203477 - protein, 20 aa, Giardia lamblia
SYQWPTIYDFLLDFSSLRIP

SEQ ID NO: 3203478 - protein, 18 aa, Giardia lamblia
SYRVIYFSPELICKKGAD

SEQ ID NO: 3203479 - protein, 19 aa, Giardia lamblia
SYYRKINLLVLILNMVSNV

SEQ ID NO: 3203480 - protein, 24 aa, Giardia lamblia
TADGPWSFIFFPLAHRIECHGLAM

SEQ ID NO: 3203481 - protein, 26 aa, Giardia lamblia
TAGECKNMFAPKLLRLALQHLTGQES

SEQ ID NO: 3203482 - protein, 26 aa, Giardia lamblia
TAIAKQIWWVIKEIHIYLIDGALHPV

SEQ ID NO: 3203483 - protein, 25 aa, Giardia lamblia
TAKSISMLFLPALLKGINHPGLETA

SEQ ID NO: 3203484 - protein, 19 aa, Giardia lamblia
TALEIALLRGYFSVAEVLT

SEQ ID NO: 3203485 - protein, 25 aa, Giardia lamblia
TALGEGLPTDLFRYTPPLIEDLQRE

SEQ ID NO: 3203486 - protein, 17 aa, Giardia lamblia
TALMWAVCNREPGCVRL

SEQ ID NO: 3203487 - protein, 18 aa, Giardia lamblia
TALPALDPLLFQSPPSIL

SEQ ID NO: 3203488 - protein, 24 aa, Giardia lamblia
TANGWITAFDWPFRIPKAIYRRRL

SEQ ID NO: 3203489 - protein, 17 aa, Giardia lamblia
TAPLFLFLNVVAAGFWM

SEQ ID NO: 3203490 - protein, 17 aa, Giardia lamblia
TAQVQRFIGVNSTLTRC

SEQ ID NO: 3203491 - protein, 19 aa, Giardia lamblia
TARSLFIRLLAQLQGYSLL

SEQ ID NO: 3203492 - protein, 22 aa, Giardia lamblia
TAVFRVPLFFAQRHRLGLPTDR

SEQ ID NO: 3203493 - protein, 24 aa, Giardia lamblia
TAYKLKLFLYRFGQKAFLYNPELP

SEQ ID NO: 3203494 - protein, 24 aa, Giardia lamblia
TAYLDILIAAFPRELLPQSIADDV

SEQ ID NO: 3203495 - protein, 25 aa, Giardia lamblia
TCIFILQHQIHVLKLRLLRTIYLLD

SEQ ID NO: 3203496 - protein, 18 aa, Giardia lamblia
TCLTFRPPPMTVLSSVSL

SEQ ID NO: 3203497 - protein, 17 aa, Giardia lamblia
TCRGIITGGFNWTITEE

SEQ ID NO: 3203498 - protein, 24 aa, Giardia lamblia
TDDGVPLWTFDWGSAVYFSEHNIG

SEQ ID NO: 3203499 - protein, 24 aa, Giardia lamblia
TDDRKYLILLISGSIFSSAETACP

SEQ ID NO: 3203500 - protein, 24 aa, Giardia lamblia
TDGSVLYRPINTLSILSLASVDDI

SEQ ID NO: 3203501 - protein, 22 aa, Giardia lamblia
TDKALFISPIPTRSSPLRSSRS

SEQ ID NO: 3203502 - protein, 19 aa, Giardia lamblia
TDKYGWTALMWAVCNREPG

SEQ ID NO: 3203503 - protein, 17 aa, Giardia lamblia
TDLLPFNADLYPLGTRP

SEQ ID NO: 3203504 - protein, 24 aa, Giardia lamblia
TDMKYLAWIQHKTAVFNRSVANAR

SEQ ID NO: 3203505 - protein, 22 aa, Giardia lamblia
TDNELLRLYRLFGDAWDVIGNA

SEQ ID NO: 3203506 - protein, 22 aa, Giardia lamblia
TDRPWFFDLLSSKLGNHFNTTL

SEQ ID NO: 3203507 - protein, 24 aa, Giardia lamblia
TDSFVVRGFVIPTLPRGAVQRMQN

SEQ ID NO: 3203508 - protein, 18 aa, Giardia lamblia
TDTLRLMNLLNTTNIWDT

SEQ ID NO: 3203509 - protein, 27 aa, Giardia lamblia
TELSRELTSPLFRQLPPGLITSARNLR

SEQ ID NO: 3203510 - protein, 23 aa, Giardia lamblia
TEPKLVCRMLIRLGAWYSDLLTP

SEQ ID NO: 3203511 - protein, 25 aa, Giardia lamblia
TETCRYGLPFTFFTPLIVCNNEISN

SEQ ID NO: 3203512 - protein, 18 aa, Giardia lamblia
TEYAIFTVALLLLSNASP

SEQ ID NO: 3203513 - protein, 19 aa, Giardia lamblia
TFLIRRLIRQLSGRINFFE

SEQ ID NO: 3203514 - protein, 18 aa, Giardia lamblia
TFMQLLMNYLIKPPVVIA

SEQ ID NO: 3203515 - protein, 25 aa, Giardia lamblia
TFQFPSLLEIIPLFPASTILYFITE

SEQ ID NO: 3203516 - protein, 24 aa, Giardia lamblia
TFRKPDFFLVAEILHYITTVVAPS

SEQ ID NO: 3203517 - protein, 24 aa, Giardia lamblia
TFSEPFLWAILLDISSALQHIHDK

SEQ ID NO: 3203518 - protein, 18 aa, Giardia lamblia
TFYTILARLICLGNPKYR

SEQ ID NO: 3203519 - protein, 24 aa, Giardia lamblia
TGESALLYLLRTQSFQLQLARSVW

SEQ ID NO: 3203520 - protein, 22 aa, Giardia lamblia
TGGVYIFPCGSRWIGGFLGCEM

SEQ ID NO: 3203521 - protein, 21 aa, Giardia lamblia
TGIILYAMLCGCLPFEGSTTQ

SEQ ID NO: 3203522 - protein, 19 aa, Giardia lamblia
TGISYSSLLFYFSSGLAVA

SEQ ID NO: 3203523 - protein, 18 aa, Giardia lamblia
TGRKLMMLPKPTPVSSVL

SEQ ID NO: 3203524 - protein, 26 aa, Giardia lamblia
TGVPMLSILPLFWSLGLNKIVNYAPD

SEQ ID NO: 3203525 - protein, 23 aa, Giardia lamblia
TGVRWILRLFSLNSGGLLADEPG

SEQ ID NO: 3203526 - protein, 18 aa, Giardia lamblia
TGYIFAAPRRQGFSSSGT

SEQ ID NO: 3203527 - protein, 21 aa, Giardia lamblia
TGYPPALYWLSEDPTVECYNC

SEQ ID NO: 3203528 - protein, 17 aa, Giardia lamblia
THIDLYYNFCFCASIQL

SEQ ID NO: 3203529 - protein, 24 aa, Giardia lamblia
THPPTLLYHTLLQRGVPPLSDNWS

SEQ ID NO: 3203530 - protein, 22 aa, Giardia lamblia
THSLEILLRSSLFGKQAILNTI

SEQ ID NO: 3203531 - protein, 22 aa, Giardia lamblia
TIDAIFLPRLAQYLFPLMALQE

SEQ ID NO: 3203532 - protein, 25 aa, Giardia lamblia
TIDLNWHIIYYYYSLLIYNNRTLSS

SEQ ID NO: 3203533 - protein, 24 aa, Giardia lamblia
TIGMKSWLVPYQFTPLFASDQNER

SEQ ID NO: 3203534 - protein, 17 aa, Giardia lamblia
TILLLKDSTDTSQGKGQ

SEQ ID NO: 3203535 - protein, 17 aa, Giardia lamblia
TILVCLAGCYRVDFVIF

SEQ ID NO: 3203536 - protein, 26 aa, Giardia lamblia
TINEFLDRWILPLLVKLISEYEEDSA

SEQ ID NO: 3203537 - protein, 18 aa, Giardia lamblia
TINLLPYQKCRTDLMGRT

SEQ ID NO: 3203538 - protein, 17 aa, Giardia lamblia
TIRNRYLELLSLQIQLL

SEQ ID NO: 3203539 - protein, 17 aa, Giardia lamblia
TKADDQLRFLLFQNELT

SEQ ID NO: 3203540 - protein, 24 aa, Giardia lamblia
TKEGPVHFLWLDFDGNLISESRNP

SEQ ID NO: 3203541 - protein, 25 aa, Giardia lamblia
TKIATKVYMVLRRDKFRASAAMVKK

SEQ ID NO: 3203542 - protein, 32 aa, Giardia lamblia
TKSRIYITPPLFLSFIRLFKRIFAKSVGKLKV

SEQ ID NO: 3203543 - protein, 18 aa, Giardia lamblia
TKVLLPTAGRRVSGGYAQ

SEQ ID NO: 3203544 - protein, 23 aa, Giardia lamblia
TLDVGSWVRLQYALRLMRDRLAE

SEQ ID NO: 3203545 - protein, 20 aa, Giardia lamblia
TLEALFIFTLVWSIGGLIHD

SEQ ID NO: 3203546 - protein, 20 aa, Giardia lamblia
TLGFYVFRVLKVILAYSRFN

SEQ ID NO: 3203547 - protein, 30 aa, Giardia lamblia
TLGSHFFIFPEISFLFKRPSIRDALRPANS

SEQ ID NO: 3203548 - protein, 18 aa, Giardia lamblia
TLIGLFMVCVLQKSAKDI

SEQ ID NO: 3203549 - protein, 18 aa, Giardia lamblia
TLIQYREKFRFLHTEDRS

SEQ ID NO: 3203550 - protein, 20 aa, Giardia lamblia
TLKFIPVPLLHWPDSTFTYC

SEQ ID NO: 3203551 - protein, 18 aa, Giardia lamblia
TLLHVLLDIAKRSPVKFT

SEQ ID NO: 3203552 - protein, 17 aa, Giardia lamblia
TLLLIEGGIYRKDGWSA

SEQ ID NO: 3203553 - protein, 20 aa, Giardia lamblia
TLLLRPELFYYNQGLTLKHQ

SEQ ID NO: 3203554 - protein, 19 aa, Giardia lamblia
TLLVSFFTPSLPGLTKNSI

SEQ ID NO: 3203555 - protein, 25 aa, Giardia lamblia
TLNAYIPAYSAYRRPWPGNYNEKFS

SEQ ID NO: 3203556 - protein, 26 aa, Giardia lamblia
TLPPHQIELLPYLRCPMCLCKIRSAM

SEQ ID NO: 3203557 - protein, 18 aa, Giardia lamblia
TLPSGLLGFWKQTQTILG

SEQ ID NO: 3203558 - protein, 21 aa, Giardia lamblia
TLQVHLTFWKPVIETILEEVV

SEQ ID NO: 3203559 - protein, 17 aa, Giardia lamblia
TLRTFHLLKDNVDFLTP

SEQ ID NO: 3203560 - protein, 21 aa, Giardia lamblia
TLSWFYWPMRFHCRCIEKMCR

SEQ ID NO: 3203561 - protein, 18 aa, Giardia lamblia
TLTPNPIFLMYHPVLMSP

SEQ ID NO: 3203562 - protein, 17 aa, Giardia lamblia
TLVLPPEVFQGQGILPV

SEQ ID NO: 3203563 - protein, 27 aa, Giardia lamblia
TMAYFIGRTYLFLLKLGLDPARLRFRQ

SEQ ID NO: 3203564 - protein, 19 aa, Giardia lamblia
TMPLAIWLVITYHLDKSKF

SEQ ID NO: 3203565 - protein, 27 aa, Giardia lamblia
TMSGRMYIPFIYALHEINLIDPHAVTR

SEQ ID NO: 3203566 - protein, 17 aa, Giardia lamblia
TMVRRVYIWALQLKHNE

SEQ ID NO: 3203567 - protein, 21 aa, Giardia lamblia
TNFYRGYYQLAQAYFVAGLFE

SEQ ID NO: 3203568 - protein, 22 aa, Giardia lamblia
TNLRPLWFIITKGPVATAVVYS

SEQ ID NO: 3203569 - protein, 21 aa, Giardia lamblia
TNNYKLWRYLFCPVPVLEIKT

SEQ ID NO: 3203570 - protein, 19 aa, Giardia lamblia
TNPAFVFLLSTRAGCLGLN

SEQ ID NO: 3203571 - protein, 18 aa, Giardia lamblia
TNQNGCFTLVLLPGPYKP

SEQ ID NO: 3203572 - protein, 21 aa, Giardia lamblia
TNRLYLILIALGLNPTLAGYE

SEQ ID NO: 3203573 - protein, 22 aa, Giardia lamblia
TNTDYLYIYLPDEYKGWSLTEP

SEQ ID NO: 3203574 - protein, 24 aa, Giardia lamblia
TNYKAFPLLIPLVGAAASLHYRIS

SEQ ID NO: 3203575 - protein, 24 aa, Giardia lamblia
TNYRLHVIAYLKSLRYFDHKVIRE

SEQ ID NO: 3203576 - protein, 22 aa, Giardia lamblia
TPENMYCYCTFWGPIVPANTGF

SEQ ID NO: 3203577 - protein, 19 aa, Giardia lamblia
TPFNLILLAYSDPLKHLSH

SEQ ID NO: 3203578 - protein, 21 aa, Giardia lamblia
TPIGWIPYYEDLKSLFRSELD

SEQ ID NO: 3203579 - protein, 18 aa, Giardia lamblia
TPLHIPVPGLAAEPAPFP

SEQ ID NO: 3203580 - protein, 32 aa, Giardia lamblia
TPSPTSFWQYALGPLLVLYLRAKEWISDEGLS

SEQ ID NO: 3203581 - protein, 27 aa, Giardia lamblia
TPSVAELIFIVLKFFPSMTPSAINEKV

SEQ ID NO: 3203582 - protein, 24 aa, Giardia lamblia
TPWTTDFIFTVFPPSSYAKGFDEL

SEQ ID NO: 3203583 - protein, 24 aa, Giardia lamblia
TQDVPVYWVPWFGVWIYHGCECTR

SEQ ID NO: 3203584 - protein, 21 aa, Giardia lamblia
TQRHEFIPIISSALFEDGDAI

SEQ ID NO: 3203585 - protein, 23 aa, Giardia lamblia
TQSLLYLPLWVWQVYEQNLLEKD

SEQ ID NO: 3203586 - protein, 20 aa, Giardia lamblia
TRPELYRLVLKYGAVREQIR

SEQ ID NO: 3203587 - protein, 20 aa, Giardia lamblia
TRRIYPDMLVFVNPRFWFSR

SEQ ID NO: 3203588 - protein, 30 aa, Giardia lamblia
TRRVFHSISVYNFYVLYNLELLFNYVHVKI

SEQ ID NO: 3203589 - protein, 19 aa, Giardia lamblia
TRSYWLLRFAFASDKDAWA

SEQ ID NO: 3203590 - protein, 25 aa, Giardia lamblia
TRTIKPVLLLLLTYADMFGLTRDVI

SEQ ID NO: 3203591 - protein, 23 aa, Giardia lamblia
TSDGKCFFFLPKQTDLVFMGSID

SEQ ID NO: 3203592 - protein, 17 aa, Giardia lamblia
TSDLLLDIVFKPFDYFP

SEQ ID NO: 3203593 - protein, 21 aa, Giardia lamblia
TSFDFVIPMTIFALLTTNRYK

SEQ ID NO: 3203594 - protein, 18 aa, Giardia lamblia
TSHLLYLLLVCFQDLHTV

SEQ ID NO: 3203595 - protein, 21 aa, Giardia lamblia
TSILMPFTFPVGLFVKLKELS

SEQ ID NO: 3203596 - protein, 33 aa, Giardia lamblia
TSKHGFVPNNYLIGKILPQEPFIKGPSGPINMG

SEQ ID NO: 3203597 - protein, 25 aa, Giardia lamblia
TSLGGLRRRLLALFLQFAETPEFNP

SEQ ID NO: 3203598 - protein, 17 aa, Giardia lamblia
TSLLGVYFVGIWNIAIN

SEQ ID NO: 3203599 - protein, 27 aa, Giardia lamblia
TSMLTKLRFPDLFTLLDIRSISESPAS

SEQ ID NO: 3203600 - protein, 20 aa, Giardia lamblia
TSNRFLYRPLSTLNFKEIGG

SEQ ID NO: 3203601 - protein, 22 aa, Giardia lamblia
TSNSWFITSAINSNLMTSLQLS

SEQ ID NO: 3203602 - protein, 25 aa, Giardia lamblia
TSYRGFLRNKWKTLCKLINGAGATI

SEQ ID NO: 3203603 - protein, 22 aa, Giardia lamblia
TTGYLELFRILWPSMPVEVEML

SEQ ID NO: 3203604 - protein, 24 aa, Giardia lamblia
TTKVFKIILLKYWLGNAVKSLYNP

SEQ ID NO: 3203605 - protein, 18 aa, Giardia lamblia
TTLPFVILNEFLDYMAYL

SEQ ID NO: 3203606 - protein, 25 aa, Giardia lamblia
TTSIAKLLYIFKNNGLRSLVCACDS

SEQ ID NO: 3203607 - protein, 22 aa, Giardia lamblia
TTYPYWREYLITVLPHLEKLDG

SEQ ID NO: 3203608 - protein, 20 aa, Giardia lamblia
TVFLPVFLNLKESKPALAAI

SEQ ID NO: 3203609 - protein, 29 aa, Giardia lamblia
TVGFLMARFLVLFCIPLQEYKYIPLPATV

SEQ ID NO: 3203610 - protein, 22 aa, Giardia lamblia
TVKYYPLMLLAAKTAGDGTRAL

SEQ ID NO: 3203611 - protein, 19 aa, Giardia lamblia
TVNLLHLYKYKPALCKLVL

SEQ ID NO: 3203612 - protein, 18 aa, Giardia lamblia
TVPHLPPPLAIPPGFRGK

SEQ ID NO: 3203613 - protein, 25 aa, Giardia lamblia
TVRIFAKLLHDLQLRWIRHSSERMR

SEQ ID NO: 3203614 - protein, 25 aa, Giardia lamblia
TVRSSYLVRKLLLNGFPVLAVGQTG

SEQ ID NO: 3203615 - protein, 23 aa, Giardia lamblia
TVTNIFHRVLLKRLIKHANYLSC

SEQ ID NO: 3203616 - protein, 18 aa, Giardia lamblia
TVVHLFMRLLEKRGQLQR

SEQ ID NO: 3203617 - protein, 20 aa, Giardia lamblia
TYLIDYIPPAKGGIADTIVY

SEQ ID NO: 3203618 - protein, 24 aa, Giardia lamblia
TYNGLRLYYAYLNMMQWSPPLIDT

SEQ ID NO: 3203619 - protein, 19 aa, Giardia lamblia
TYQLLFTKAALFIMALKLE

SEQ ID NO: 3203620 - protein, 20 aa, Giardia lamblia
VAALALLRYLPTLQGVHFTE

SEQ ID NO: 3203621 - protein, 23 aa, Giardia lamblia
VAARKFLLFLLGPTERLAVDNEI

SEQ ID NO: 3203622 - protein, 17 aa, Giardia lamblia
VACSLVLRRQSILGPIT

SEQ ID NO: 3203623 - protein, 33 aa, Giardia lamblia
VADFVARILRFQPLTTLLAIYKAIIGLYCDLLG

SEQ ID NO: 3203624 - protein, 29 aa, Giardia lamblia
VAEFRSFHHFFLFIYAYHASLCRASITYG

SEQ ID NO: 3203625 - protein, 20 aa, Giardia lamblia
VAEPLPVFIAINHDIRPSFI

SEQ ID NO: 3203626 - protein, 18 aa, Giardia lamblia
VAFLSFPMSALTPQKAEV

SEQ ID NO: 3203627 - protein, 18 aa, Giardia lamblia
VAFLVTPAVITFLRGWKV

SEQ ID NO: 3203628 - protein, 25 aa, Giardia lamblia
VAGLFEEALVYYYRAYRKRPDIQEY

SEQ ID NO: 3203629 - protein, 25 aa, Giardia lamblia
VAIPRGVRFFLSISPAAECYFLCCV

SEQ ID NO: 3203630 - protein, 17 aa, Giardia lamblia
VAPILRLLVYEDGMARF

SEQ ID NO: 3203631 - protein, 25 aa, Giardia lamblia
VASHFVFRLKNFAFIYAMESASLHL

SEQ ID NO: 3203632 - protein, 19 aa, Giardia lamblia
VDDELWIILEFCSAGAISD

SEQ ID NO: 3203633 - protein, 23 aa, Giardia lamblia
VDDQWAMFPPVITEFARVTMQNF

SEQ ID NO: 3203634 - protein, 21 aa, Giardia lamblia
VDIASFLIPYERNLILDGAFT

SEQ ID NO: 3203635 - protein, 21 aa, Giardia lamblia
VDKLPIYLYSPVIYTCIFILQ

SEQ ID NO: 3203636 - protein, 20 aa, Giardia lamblia
VDPCYQLYLPTSQTLSMFLD

SEQ ID NO: 3203637 - protein, 24 aa, Giardia lamblia
VDQKLWGLLLFREVIFFQFCRCLA

SEQ ID NO: 3203638 - protein, 19 aa, Giardia lamblia
VDSIIRFICLLELKLKELD

SEQ ID NO: 3203639 - protein, 27 aa, Giardia lamblia
VDVFAFGILLYRLMYRRLPFPDNDLRY

SEQ ID NO: 3203640 - protein, 23 aa, Giardia lamblia
VDYLDLFLVHWPLAFVRNDVGDL

SEQ ID NO: 3203641 - protein, 19 aa, Giardia lamblia
VEFIWISNWFKRILDMQKS

SEQ ID NO: 3203642 - protein, 23 aa, Giardia lamblia
VEHHLPILLLKFTSTHPNFTANL

SEQ ID NO: 3203643 - protein, 24 aa, Giardia lamblia
VEIVQFYLLILITSQPKPKDLQII

SEQ ID NO: 3203644 - protein, 27 aa, Giardia lamblia
VELLVYLHKHHLLAWSGLSPSFVHLTT

SEQ ID NO: 3203645 - protein, 19 aa, Giardia lamblia
VELPTTLSPILFPHNLETT

SEQ ID NO: 3203646 - protein, 17 aa, Giardia lamblia
VFIDPKKSFMQAQARRF

SEQ ID NO: 3203647 - protein, 29 aa, Giardia lamblia
VFKLTFYLKAGLIWEFQRLFRRIRYCMLN

SEQ ID NO: 3203648 - protein, 17 aa, Giardia lamblia
VFNTVPFRPLYGRDFPD

SEQ ID NO: 3203649 - protein, 26 aa, Giardia lamblia
VFRPFYLCTIIKPLFFFLDPYHRKRI

SEQ ID NO: 3203650 - protein, 20 aa, Giardia lamblia
VFSLLMLILLDIGTERPEIP

SEQ ID NO: 3203651 - protein, 23 aa, Giardia lamblia
VGDRLLLSGYFRDDPPNIALSAD

SEQ ID NO: 3203652 - protein, 24 aa, Giardia lamblia
VGHPGILCWLQFHMNLRSEFTMDP

SEQ ID NO: 3203653 - protein, 25 aa, Giardia lamblia
VGLIPRFIVQLFDALASIQSVWKVR

SEQ ID NO: 3203654 - protein, 18 aa, Giardia lamblia
VGSKLLVLQAPYKQFFGT

SEQ ID NO: 3203655 - protein, 20 aa, Giardia lamblia
VGVLLYLMLGRTLPFQANTL

SEQ ID NO: 3203656 - protein, 20 aa, Giardia lamblia
VHPTLNCMLLTFICPHVMSG

SEQ ID NO: 3203657 - protein, 18 aa, Giardia lamblia
VHRPAFRFSLWSRPSCIT

SEQ ID NO: 3203658 - protein, 18 aa, Giardia lamblia
VHRRLTPRNILFNNVNQL

SEQ ID NO: 3203659 - protein, 17 aa, Giardia lamblia
VIAGRQLLLWRAKPRLA

SEQ ID NO: 3203660 - protein, 25 aa, Giardia lamblia
VIDKKYRGLGLGKLLITHLVLKAHR

SEQ ID NO: 3203661 - protein, 25 aa, Giardia lamblia
VIELDLIIPLFYLLIHSVDVTTAEM

SEQ ID NO: 3203662 - protein, 21 aa, Giardia lamblia
VIFLAKVWKTMARGLLLLGRI

SEQ ID NO: 3203663 - protein, 20 aa, Giardia lamblia
VIGFIFILKALYRPSWGDYD

SEQ ID NO: 3203664 - protein, 17 aa, Giardia lamblia
VIHPVFFGRRRALENEF

SEQ ID NO: 3203665 - protein, 17 aa, Giardia lamblia
VILPMMFPQLFQGKREP

SEQ ID NO: 3203666 - protein, 21 aa, Giardia lamblia
VILWHYRLSALLYAGLRVERP

SEQ ID NO: 3203667 - protein, 24 aa, Giardia lamblia
VINDVFFKFYNICAMTLPGIPEHS

SEQ ID NO: 3203668 - protein, 23 aa, Giardia lamblia
VIQFPTHKAFFSNAIFNLLGDYE

SEQ ID NO: 3203669 - protein, 23 aa, Giardia lamblia
VIRAPHPLLYTSLPSPLMALQRN

SEQ ID NO: 3203670 - protein, 19 aa, Giardia lamblia
VKAWKLIRDLSSALLYLQQ

SEQ ID NO: 3203671 - protein, 20 aa, Giardia lamblia
VKIATFPQYLYPVALERYAE

SEQ ID NO: 3203672 - protein, 20 aa, Giardia lamblia
VKILAPIEMDLTLKGGATAL

SEQ ID NO: 3203673 - protein, 21 aa, Giardia lamblia
VKRYIPYQARMMARFVKAGRV

SEQ ID NO: 3203674 - protein, 21 aa, Giardia lamblia
VKVLYKYLYLREALTAAIMIL

SEQ ID NO: 3203675 - protein, 28 aa, Giardia lamblia
VLAAQRIYDPLWFQPSLAATASFVAANR

SEQ ID NO: 3203676 - protein, 23 aa, Giardia lamblia
VLESLYRYIHNWFVQLRGMHDFR

SEQ ID NO: 3203677 - protein, 18 aa, Giardia lamblia
VLIHVCIIIIKNSLYLLN

SEQ ID NO: 3203678 - protein, 21 aa, Giardia lamblia
VLLDESLLRILSLLPTTPAED

SEQ ID NO: 3203679 - protein, 18 aa, Giardia lamblia
VLLEDRMWTAPGPGYYSN

SEQ ID NO: 3203680 - protein, 17 aa, Giardia lamblia
VLLFLHFLCAQVTRWFL

SEQ ID NO: 3203681 - protein, 18 aa, Giardia lamblia
VLLLPYAVYSRKLKAIIL

SEQ ID NO: 3203682 - protein, 18 aa, Giardia lamblia
VLQSLFSLLTRKQQCIGS

SEQ ID NO: 3203683 - protein, 24 aa, Giardia lamblia
VLSKRGIPITSLTKGSHPLPVVHE

SEQ ID NO: 3203684 - protein, 26 aa, Giardia lamblia
VLSLLRGLLFHKLPISLQSKLKATRI

SEQ ID NO: 3203685 - protein, 18 aa, Giardia lamblia
VLSLPTARWLWKGKRYSS

SEQ ID NO: 3203686 - protein, 19 aa, Giardia lamblia
VMQYPKIISTPLIDPARSS

SEQ ID NO: 3203687 - protein, 24 aa, Giardia lamblia
VNGKLPLEILLGKWPGQLTIASNQ

SEQ ID NO: 3203688 - protein, 18 aa, Giardia lamblia
VNTQDLMLLPKTLNFNEE

SEQ ID NO: 3203689 - protein, 19 aa, Giardia lamblia
VPFVKCIYMFKKELKARRL

SEQ ID NO: 3203690 - protein, 25 aa, Giardia lamblia
VPKTFWIGAFFFPHGLLTAELQHYS

SEQ ID NO: 3203691 - protein, 24 aa, Giardia lamblia
VPKTLRMLVMLAQAAKLFKVRSNS

SEQ ID NO: 3203692 - protein, 18 aa, Giardia lamblia
VPKTWRLLVFVATKHHCE

SEQ ID NO: 3203693 - protein, 27 aa, Giardia lamblia
VQGLPRFLNRFFPFSFTQSLFSSAANA

SEQ ID NO: 3203694 - protein, 23 aa, Giardia lamblia
VQILKTLAMIKARDPRIFDKDVR

SEQ ID NO: 3203695 - protein, 20 aa, Giardia lamblia
VQMPFPTSSLLIINWQRGTT

SEQ ID NO: 3203696 - protein, 22 aa, Giardia lamblia
VQNILEYMFSFALPQVPSDAQE

SEQ ID NO: 3203697 - protein, 23 aa, Giardia lamblia
VQTARLCHWLLSQLGISVQGVSE

SEQ ID NO: 3203698 - protein, 20 aa, Giardia lamblia
VRDGRLACIIFIRDRNHSGQ

SEQ ID NO: 3203699 - protein, 20 aa, Giardia lamblia
VRFYPNGIFIKRGPFRAYEH

SEQ ID NO: 3203700 - protein, 18 aa, Giardia lamblia
VRGPLLLCQLLESTLLVL

SEQ ID NO: 3203701 - protein, 22 aa, Giardia lamblia
VRLCPSYHKAWFRLGNIRESAG

SEQ ID NO: 3203702 - protein, 21 aa, Giardia lamblia
VRLFRPFSIELFSNAIPKSAK

SEQ ID NO: 3203703 - protein, 22 aa, Giardia lamblia
VRLLPLVRQWLLEPLKDLVARL

SEQ ID NO: 3203704 - protein, 23 aa, Giardia lamblia
VRPASARLAKLFQLPANAITQRM

SEQ ID NO: 3203705 - protein, 21 aa, Giardia lamblia
VRSPWRGVLLFGPPGTGKTLL

SEQ ID NO: 3203706 - protein, 27 aa, Giardia lamblia
VRVQHAFVPWLRRYHGRCRPTFLFFVG

SEQ ID NO: 3203707 - protein, 23 aa, Giardia lamblia
VSGRKQLFCIPTNELQEMGTVLD

SEQ ID NO: 3203708 - protein, 26 aa, Giardia lamblia
VSHQSTYPMFPYYNAAPQQQVPISNE

SEQ ID NO: 3203709 - protein, 24 aa, Giardia lamblia
VSLDKYWRVIFFGAYLEMLQGNHG

SEQ ID NO: 3203710 - protein, 21 aa, Giardia lamblia
VSLYQILLRKLGKPALDFLPV

SEQ ID NO: 3203711 - protein, 23 aa, Giardia lamblia
VSMLMGWFWSYHIPYQRIKVIGF

SEQ ID NO: 3203712 - protein, 26 aa, Giardia lamblia
VSPDSAFVWFYLNGVFYELDLHKLAE

SEQ ID NO: 3203713 - protein, 20 aa, Giardia lamblia
VSRGLFVRHKLAFAFDICLS

SEQ ID NO: 3203714 - protein, 25 aa, Giardia lamblia
VSSINPLIIFQWTSPYLRFCSSKYS

SEQ ID NO: 3203715 - protein, 32 aa, Giardia lamblia
VSYNLMHMFNSVPYFLSIAIPVTPLPGTCEGT

SEQ ID NO: 3203716 - protein, 17 aa, Giardia lamblia
VTALLARMRAEGPLFGA

SEQ ID NO: 3203717 - protein, 26 aa, Giardia lamblia
VTCARDSLLRFWKLPDIYALNDQSVP

SEQ ID NO: 3203718 - protein, 25 aa, Giardia lamblia
VTDELFTWLYHKICLLADSLVMVIT

SEQ ID NO: 3203719 - protein, 23 aa, Giardia lamblia
VTEFLFTNWPLFEKYYNAIGIPF

SEQ ID NO: 3203720 - protein, 24 aa, Giardia lamblia
VTHTMSFILRFLFSPIQTGHQSKN

SEQ ID NO: 3203721 - protein, 24 aa, Giardia lamblia
VTIEELITYPWIQKNWALNHDGRS

SEQ ID NO: 3203722 - protein, 20 aa, Giardia lamblia
VTLRPRIILHAFHGFDVTAL

SEQ ID NO: 3203723 - protein, 17 aa, Giardia lamblia
VTNFFLCTSFPPSTKST

SEQ ID NO: 3203724 - protein, 25 aa, Giardia lamblia
VTNRFFVVYFTYWELYNEELKDLLA

SEQ ID NO: 3203725 - protein, 22 aa, Giardia lamblia
VTRKYLQDTWRLALDPPDPEKK

SEQ ID NO: 3203726 - protein, 29 aa, Giardia lamblia
VVHSPLRFLLDMILKLNLTVKPIFPCLDK

SEQ ID NO: 3203727 - protein, 21 aa, Giardia lamblia
VVLAIPPLPHYLLGGVKYATA

SEQ ID NO: 3203728 - protein, 17 aa, Giardia lamblia
VVLLKIAKHILLSRRGL

SEQ ID NO: 3203729 - protein, 19 aa, Giardia lamblia
VVLPMLLPDFFTGVRSPWR

SEQ ID NO: 3203730 - protein, 22 aa, Giardia lamblia
VVRLYEVFFNLLVVPTPYLKQE

SEQ ID NO: 3203731 - protein, 21 aa, Giardia lamblia
VVSPLSILQALLRHYCRNNAT

SEQ ID NO: 3203732 - protein, 24 aa, Giardia lamblia
VVSRRPLFITPVKKTGAATVLQSI

SEQ ID NO: 3203733 - protein, 26 aa, Giardia lamblia
VVVERYLRYFIPWFQRPQTILEFLLL

SEQ ID NO: 3203734 - protein, 19 aa, Giardia lamblia
VWEYLLMMIFRGLLDECPK

SEQ ID NO: 3203735 - protein, 17 aa, Giardia lamblia
VWFMLSALLDYIRYTGD

SEQ ID NO: 3203736 - protein, 30 aa, Giardia lamblia
VWIEKGIPICFWISGFFFTQGFLTGCLQNF

SEQ ID NO: 3203737 - protein, 26 aa, Giardia lamblia
VWKTMARGLLLLGRINSYYSKKAAAS

SEQ ID NO: 3203738 - protein, 19 aa, Giardia lamblia
VWMHFGYMRPFNLDSDSRG

SEQ ID NO: 3203739 - protein, 17 aa, Giardia lamblia
VWYRLFVDVKPAFQALC

SEQ ID NO: 3203740 - protein, 19 aa, Giardia lamblia
VYLFRMRMLFIQTYKKQIY

SEQ ID NO: 3203741 - protein, 19 aa, Giardia lamblia
VYRPNTLPIIDFRSLSPLH

SEQ ID NO: 3203742 - protein, 17 aa, Giardia lamblia
VYVAAAARLEAHELRAV

SEQ ID NO: 3203743 - protein, 17 aa, Giardia lamblia
VYVPFRGITRMYGSLHC

SEQ ID NO: 3203744 - protein, 19 aa, Giardia lamblia
WALGCILYEALAARRCFSA

SEQ ID NO: 3203745 - protein, 26 aa, Giardia lamblia
WEEMTPWFRILFDRVLEPWLLDPSAC

SEQ ID NO: 3203746 - protein, 27 aa, Giardia lamblia
WEESNLFLFFVSLFRFFLHTCKLPNHG

SEQ ID NO: 3203747 - protein, 18 aa, Giardia lamblia
WEPLFVGVFLRLDDTLRL

SEQ ID NO: 3203748 - protein, 25 aa, Giardia lamblia
WGADPLLNLLPLPNSIILADGAFAR

SEQ ID NO: 3203749 - protein, 18 aa, Giardia lamblia
WGHRIPCYKFWFGDNPEP

SEQ ID NO: 3203750 - protein, 19 aa, Giardia lamblia
WIDSLYYLTGALAASLGWE

SEQ ID NO: 3203751 - protein, 17 aa, Giardia lamblia
WIICQRQWLYLEGIFSG

SEQ ID NO: 3203752 - protein, 17 aa, Giardia lamblia
WIRMSFFFHVTDFEICN

SEQ ID NO: 3203753 - protein, 18 aa, Giardia lamblia
WKPGLQAPYQRWPARMIA

SEQ ID NO: 3203754 - protein, 20 aa, Giardia lamblia
WKVVDSWFYCRGLAAMQIDS

SEQ ID NO: 3203755 - protein, 21 aa, Giardia lamblia
WLQNSFLYIRARRNPLFYNIF

SEQ ID NO: 3203756 - protein, 17 aa, Giardia lamblia
WLVLMQLAELLAYLHSP

SEQ ID NO: 3203757 - protein, 17 aa, Giardia lamblia
WPGVFGPGIRRAIRPSL

SEQ ID NO: 3203758 - protein, 20 aa, Giardia lamblia
WPRYDAGYADYLRYMGKGMG

SEQ ID NO: 3203759 - protein, 27 aa, Giardia lamblia
WRATYQCARYLLALYVAYGSAVLEAGL

SEQ ID NO: 3203760 - protein, 17 aa, Giardia lamblia
WREIFNYPWIASRVALV

SEQ ID NO: 3203761 - protein, 26 aa, Giardia lamblia
WSLGCVLYEILTFNPLFSGGNFFAIM

SEQ ID NO: 3203762 - protein, 25 aa, Giardia lamblia
WSLGTTLFFIAAFQSVWISSDYASI

SEQ ID NO: 3203763 - protein, 21 aa, Giardia lamblia
WTALMFAVLYNKLESLPTLAA

SEQ ID NO: 3203764 - protein, 19 aa, Giardia lamblia
WVHCRPIIGKLFYQDFDLH

SEQ ID NO: 3203765 - protein, 19 aa, Giardia lamblia
WVINLKYVEPFKTLYAHLI

SEQ ID NO: 3203766 - protein, 21 aa, Giardia lamblia
WVLLMNCHLLPKWLKTLEKIL

SEQ ID NO: 3203767 - protein, 19 aa, Giardia lamblia
WWIGSPAYILLDYLLNANN

SEQ ID NO: 3203768 - protein, 18 aa, Giardia lamblia
WYPSGYWMTPTPTALHLS

SEQ ID NO: 3203769 - protein, 18 aa, Giardia lamblia
YADLKRLFWISCGQLGLI

SEQ ID NO: 3203770 - protein, 25 aa, Giardia lamblia
YAGKPFILYLYLKAAVSVPPVSLIA

SEQ ID NO: 3203771 - protein, 31 aa, Giardia lamblia
YAKFLLETLPSLFVFLLFVTSTLESITLYID

SEQ ID NO: 3203772 - protein, 26 aa, Giardia lamblia
YANNLYILQYPLRPTWRLYNWSSMSS

SEQ ID NO: 3203773 - protein, 20 aa, Giardia lamblia
YAQNPQLLPSAKNLYYVLFY

SEQ ID NO: 3203774 - protein, 18 aa, Giardia lamblia
YCLKLMYMHILGHNIDFG

SEQ ID NO: 3203775 - protein, 18 aa, Giardia lamblia
YCLLFGAFPRKAGMERAE

SEQ ID NO: 3203776 - protein, 17 aa, Giardia lamblia
YCVVPIDSEFYTVEGVA

SEQ ID NO: 3203777 - protein, 19 aa, Giardia lamblia
YDILHFIFCIYRAQEVLLL

SEQ ID NO: 3203778 - protein, 23 aa, Giardia lamblia
YDKLRPLSYPGAHVFLLCFSVVS

SEQ ID NO: 3203779 - protein, 27 aa, Giardia lamblia
YDNTVRIYFLDTLRFKLVLYGHSMPIT

SEQ ID NO: 3203780 - protein, 18 aa, Giardia lamblia
YDPDLRLIIGHLLVLDPL

SEQ ID NO: 3203781 - protein, 17 aa, Giardia lamblia
YDREAELSGWTPLFLAA

SEQ ID NO: 3203782 - protein, 25 aa, Giardia lamblia
YEDMQLIDMFLLKLPPDLNPRGEVV

SEQ ID NO: 3203783 - protein, 24 aa, Giardia lamblia
YEDSPYIPPAFRYLLNNPFTRHQM

SEQ ID NO: 3203784 - protein, 17 aa, Giardia lamblia
YEEGMPVYFQLFATYSL

SEQ ID NO: 3203785 - protein, 18 aa, Giardia lamblia
YELAIFTASLRVYCDAVM

SEQ ID NO: 3203786 - protein, 18 aa, Giardia lamblia
YELCTFKPLFIAPSHMDK

SEQ ID NO: 3203787 - protein, 20 aa, Giardia lamblia
YELQLLARLTNYKTAVSLLQ

SEQ ID NO: 3203788 - protein, 24 aa, Giardia lamblia
YENSNRLLLPIFPRIWSSSNRGAN

SEQ ID NO: 3203789 - protein, 20 aa, Giardia lamblia
YEPEEFPFLSARKLLYALNA

SEQ ID NO: 3203790 - protein, 23 aa, Giardia lamblia
YEQELKAIGPCDVWLLGIGHNGH

SEQ ID NO: 3203791 - protein, 19 aa, Giardia lamblia
YETINYFLFSNITLGLQVE

SEQ ID NO: 3203792 - protein, 20 aa, Giardia lamblia
YFANPQLFFRCTAQFLTYRG

SEQ ID NO: 3203793 - protein, 21 aa, Giardia lamblia
YFDKPFLFKKFRKLEKKRCLL

SEQ ID NO: 3203794 - protein, 18 aa, Giardia lamblia
YFVLIAMFCKFQLRLTLT

SEQ ID NO: 3203795 - protein, 24 aa, Giardia lamblia
YFVNLSFDLLYSTDAWRAGFNHLK

SEQ ID NO: 3203796 - protein, 25 aa, Giardia lamblia
YGDTYIEWLRLLVIKYLVYGTNISS

SEQ ID NO: 3203797 - protein, 20 aa, Giardia lamblia
YGHRLIIIFELLTSNLFSYY

SEQ ID NO: 3203798 - protein, 20 aa, Giardia lamblia
YGRLLFRLAYRMEEQGLRLE

SEQ ID NO: 3203799 - protein, 22 aa, Giardia lamblia
YGRYLMPFHKILSDGAPFPSGA

SEQ ID NO: 3203800 - protein, 23 aa, Giardia lamblia
YGSFKCAFSYIFQYFLREEILYS

SEQ ID NO: 3203801 - protein, 18 aa, Giardia lamblia
YHDKPFAFLWVDPTALDE

SEQ ID NO: 3203802 - protein, 25 aa, Giardia lamblia
YHKMSVQLVNLWYQLPPSKNPINVV

SEQ ID NO: 3203803 - protein, 17 aa, Giardia lamblia
YHWTPSRLIWKLGKRIN

SEQ ID NO: 3203804 - protein, 27 aa, Giardia lamblia
YIARLMGPLSIYPYWKGAPVTAPRAYA

SEQ ID NO: 3203805 - protein, 18 aa, Giardia lamblia
YICRACHLALFSSGDKFD

SEQ ID NO: 3203806 - protein, 20 aa, Giardia lamblia
YILFKEFLQFDPSDPLWINR

SEQ ID NO: 3203807 - protein, 17 aa, Giardia lamblia
YILNIYAQYGILKEFLA

SEQ ID NO: 3203808 - protein, 18 aa, Giardia lamblia
YILPGLRNNKLTTWSTAC

SEQ ID NO: 3203809 - protein, 20 aa, Giardia lamblia
YILPQTFLTRYIFYARMMRP

SEQ ID NO: 3203810 - protein, 19 aa, Giardia lamblia
YIMIALRLALAEYLLLEGS

SEQ ID NO: 3203811 - protein, 19 aa, Giardia lamblia
YIRMTYYPETLRDIITSHT

SEQ ID NO: 3203812 - protein, 23 aa, Giardia lamblia
YIVQDVLLGCYLFTGKDVTIPFA

SEQ ID NO: 3203813 - protein, 17 aa, Giardia lamblia
YIYLVKWRDLPYSQVTD

SEQ ID NO: 3203814 - protein, 20 aa, Giardia lamblia
YKDLLCLLNEKMKRVDQLNA

SEQ ID NO: 3203815 - protein, 18 aa, Giardia lamblia
YKELLRVHYYKRKPRIAR

SEQ ID NO: 3203816 - protein, 18 aa, Giardia lamblia
YKFFNYFGAPDATAVVII

SEQ ID NO: 3203817 - protein, 17 aa, Giardia lamblia
YKIVPYIEFILRGYDIK

SEQ ID NO: 3203818 - protein, 17 aa, Giardia lamblia
YKLPSTLGGPKFSLSGR

SEQ ID NO: 3203819 - protein, 24 aa, Giardia lamblia
YKQEGSLLPLWKFATNFKEVLGIK

SEQ ID NO: 3203820 - protein, 17 aa, Giardia lamblia
YKRIFSYIYPSLSSPRP

SEQ ID NO: 3203821 - protein, 21 aa, Giardia lamblia
YKRRFLKIVSTLRSARDSLRL

SEQ ID NO: 3203822 - protein, 26 aa, Giardia lamblia
YKTIPNLPLNTWYLGDRRLMSISSSV

SEQ ID NO: 3203823 - protein, 18 aa, Giardia lamblia
YLDVIWRSPSANWSILVD

SEQ ID NO: 3203824 - protein, 17 aa, Giardia lamblia
YLDWKTVIVSMLCRYLN

SEQ ID NO: 3203825 - protein, 19 aa, Giardia lamblia
YLEIVQLLMPFEGHIYTRE

SEQ ID NO: 3203826 - protein, 18 aa, Giardia lamblia
YLEQLKLTATIRALPCSD

SEQ ID NO: 3203827 - protein, 27 aa, Giardia lamblia
YLGYPFQEPYIWYVIGQIVNGLAYMHS

SEQ ID NO: 3203828 - protein, 20 aa, Giardia lamblia
YLIYRFLLESGYVHAAFMFG

SEQ ID NO: 3203829 - protein, 17 aa, Giardia lamblia
YLMLGRTLPFQANTLEA

SEQ ID NO: 3203830 - protein, 20 aa, Giardia lamblia
YLSRSMLINRLAYAAASHNI

SEQ ID NO: 3203831 - protein, 18 aa, Giardia lamblia
YLTIPYDSRFDGLFKHLI

SEQ ID NO: 3203832 - protein, 17 aa, Giardia lamblia
YLVLVRASCHFYRFINC

SEQ ID NO: 3203833 - protein, 20 aa, Giardia lamblia
YMLIYALVKLQILRGYIVIF

SEQ ID NO: 3203834 - protein, 25 aa, Giardia lamblia
YNIKPLSYLFTLPDHLLSLITGTPL

SEQ ID NO: 3203835 - protein, 17 aa, Giardia lamblia
YNLTPYLRYHPAGIAPI

SEQ ID NO: 3203836 - protein, 21 aa, Giardia lamblia
YNTDFYILDKFPLNARPFYTM

SEQ ID NO: 3203837 - protein, 19 aa, Giardia lamblia
YNVKHGRLLAFLNDLTAEL

SEQ ID NO: 3203838 - protein, 19 aa, Giardia lamblia
YQFLPSIWNIFRKDEKLPR

SEQ ID NO: 3203839 - protein, 21 aa, Giardia lamblia
YQHIHERFLPPSYTYVSHNPT

SEQ ID NO: 3203840 - protein, 21 aa, Giardia lamblia
YQHLYLKRIFPADQKLKGLAP

SEQ ID NO: 3203841 - protein, 24 aa, Giardia lamblia
YQLPLLIKHVPALVFNLFNVIPIR

SEQ ID NO: 3203842 - protein, 18 aa, Giardia lamblia
YQMYLVAYRRNSSNIEIL

SEQ ID NO: 3203843 - protein, 20 aa, Giardia lamblia
YQPYWRLHKLRRLIVTTEAL

SEQ ID NO: 3203844 - protein, 19 aa, Giardia lamblia
YQQNLPYQALPSLPQMQSL

SEQ ID NO: 3203845 - protein, 27 aa, Giardia lamblia
YQVVCKALRLFDSRLLLSALQSVNSEE

SEQ ID NO: 3203846 - protein, 22 aa, Giardia lamblia
YQWLHMCWGCRPVLHPGNIDSM

SEQ ID NO: 3203847 - protein, 18 aa, Giardia lamblia
YREPYITSIWKDLANMLS

SEQ ID NO: 3203848 - protein, 19 aa, Giardia lamblia
YRGLRPLALAIFLKCYDMV

SEQ ID NO: 3203849 - protein, 18 aa, Giardia lamblia
YRIIMPYYELQDLQTYAE

SEQ ID NO: 3203850 - protein, 17 aa, Giardia lamblia
YRIVRKSDYLRIFKEQS

SEQ ID NO: 3203851 - protein, 20 aa, Giardia lamblia
YRKLLFGISFYHTLLVERRK

SEQ ID NO: 3203852 - protein, 17 aa, Giardia lamblia
YSDTQGLLLIFDMSNRD

SEQ ID NO: 3203853 - protein, 25 aa, Giardia lamblia
YSKIDIVYLVFRFLCSPAGSITNSR

SEQ ID NO: 3203854 - protein, 17 aa, Giardia lamblia
YSLDFFKMLFTRTLSKL

SEQ ID NO: 3203855 - protein, 19 aa, Giardia lamblia
YSLKNISFLDTLYARIAEM

SEQ ID NO: 3203856 - protein, 23 aa, Giardia lamblia
YSSKLLDMRYTQAQLLRAGRYKD

SEQ ID NO: 3203857 - protein, 27 aa, Giardia lamblia
YSVPEPVPLVHRGPLTFAAELHALESE

SEQ ID NO: 3203858 - protein, 17 aa, Giardia lamblia
YTALFKKHYYEVVARYH

SEQ ID NO: 3203859 - protein, 18 aa, Giardia lamblia
YVFPGIGLGAYVCRAKKI

SEQ ID NO: 3203860 - protein, 22 aa, Giardia lamblia
YVTNLPLLRYSLSAISIIPGIV

SEQ ID NO: 3203861 - protein, 18 aa, Giardia lamblia
YVVYTFTISTEKGVFEVA

SEQ ID NO: 3203862 - protein, 20 aa, Giardia lamblia
YWIYSYMLYRYFIDVFEGLS

SEQ ID NO: 3203863 - protein, 17 aa, Giardia lamblia
YWLGGLSLPTAFLTALQ

SEQ ID NO: 3203864 - protein, 17 aa, Giardia lamblia
YWNSFWLRTHEIPSFIN

SEQ ID NO: 3203865 - protein, 19 aa, Giardia lamblia
YYALLKFPPASQLHIEAFF

SEQ ID NO: 3203866 - protein, 18 aa, Giardia lamblia
YYAYSRLKVKFLQKLAAF

SEQ ID NO: 3203867 - protein, 18 aa, Giardia lamblia
YYHRQELLSLLGAGSLQL

SEQ ID NO: 3203868 - protein, 24 aa, Giardia lamblia
YYTKIYVIYHLLKSRWTFMLNRKR

SEQ ID NO: 3203869 - protein, 17 aa, Giardia lamblia
YYTPLTKFTGPDWYRCF

SEQ ID NO: 3203870 - protein, 20 aa, Giardia lamblia
YYWRKNIILVLELCERDIGA

SEQ ID NO: 3203871 - protein, 5 aa, Giardia lamblia
DTGGS

SEQ ID NO: 3203872 - protein, 4 aa, Giardia lamblia
ADQG

SEQ ID NO: 3203873 - protein, 5 aa, Giardia lamblia
DDPTC

SEQ ID NO: 3203874 - protein, 12 aa, Giardia lamblia
KITSPPPKTVYT

SEQ ID NO: 3203875 - protein, 4 aa, Giardia lamblia
TGIT

SEQ ID NO: 3203876 - protein, 5 aa, Giardia lamblia
DLSGV

SEQ ID NO: 3203877 - protein, 4 aa, Giardia lamblia
PHVQ

SEQ ID NO: 3203878 - protein, 5 aa, Giardia lamblia
QNIPG

SEQ ID NO: 3203879 - protein, 10 aa, Giardia lamblia
VSPSKDAAPH

SEQ ID NO: 3203880 - protein, 10 aa, Giardia lamblia
AANGKTASEY

SEQ ID NO: 3203881 - protein, 8 aa, Giardia lamblia
AARNSSAK

SEQ ID NO: 3203882 - protein, 7 aa, Giardia lamblia
AELAKGK

SEQ ID NO: 3203883 - protein, 5 aa, Giardia lamblia
AKATE

SEQ ID NO: 3203884 - protein, 9 aa, Giardia lamblia
ATAQAAGRA

SEQ ID NO: 3203885 - protein, 5 aa, Giardia lamblia
DDSTC

SEQ ID NO: 3203886 - protein, 22 aa, Giardia lamblia
DFPSKDKKGIYSSGPNTKLGGG

SEQ ID NO: 3203887 - protein, 8 aa, Giardia lamblia
EEDDSTDL

SEQ ID NO: 3203888 - protein, 5 aa, Giardia lamblia
EENGV

SEQ ID NO: 3203889 - protein, 5 aa, Giardia lamblia
EPSTQ

SEQ ID NO: 3203890 - protein, 8 aa, Giardia lamblia
ERRPTARE

SEQ ID NO: 3203891 - protein, 7 aa, Giardia lamblia
FDDRQRA

SEQ ID NO: 3203892 - protein, 9 aa, Giardia lamblia
FKGGNDERC

SEQ ID NO: 3203893 - protein, 4 aa, Giardia lamblia
GETT

SEQ ID NO: 3203894 - protein, 8 aa, Giardia lamblia
GFNNDQAR

SEQ ID NO: 3203895 - protein, 8 aa, Giardia lamblia
GLPPSGSI

SEQ ID NO: 3203896 - protein, 6 aa, Giardia lamblia
GPDWGE

SEQ ID NO: 3203897 - protein, 4 aa, Giardia lamblia
GSKS

SEQ ID NO: 3203898 - protein, 5 aa, Giardia lamblia
HKRQE

SEQ ID NO: 3203899 - protein, 5 aa, Giardia lamblia
HMRPQ

SEQ ID NO: 3203900 - protein, 6 aa, Giardia lamblia
HPDTDT

SEQ ID NO: 3203901 - protein, 6 aa, Giardia lamblia
INSNSL

SEQ ID NO: 3203902 - protein, 9 aa, Giardia lamblia
IPRDTSAGQ

SEQ ID NO: 3203903 - protein, 10 aa, Giardia lamblia
ISPSKDAAPH

SEQ ID NO: 3203904 - protein, 18 aa, Giardia lamblia
KDKRPKDRTIKNKAPYRL

SEQ ID NO: 3203905 - protein, 6 aa, Giardia lamblia
KEIGSK

SEQ ID NO: 3203906 - protein, 10 aa, Giardia lamblia
KEKGLKDSNG

SEQ ID NO: 3203907 - protein, 6 aa, Giardia lamblia
KHNDEA

SEQ ID NO: 3203908 - protein, 7 aa, Giardia lamblia
KKGDTDR

SEQ ID NO: 3203909 - protein, 10 aa, Giardia lamblia
KKHSEGMDDP

SEQ ID NO: 3203910 - protein, 8 aa, Giardia lamblia
KVSDQTPV

SEQ ID NO: 3203911 - protein, 5 aa, Giardia lamblia
LNGAN

SEQ ID NO: 3203912 - protein, 7 aa, Giardia lamblia
LPESESS

SEQ ID NO: 3203913 - protein, 9 aa, Giardia lamblia
NEASPASDV

SEQ ID NO: 3203914 - protein, 4 aa, Giardia lamblia
NGDY

SEQ ID NO: 3203915 - protein, 9 aa, Giardia lamblia
PASVPSGPN

SEQ ID NO: 3203916 - protein, 8 aa, Giardia lamblia
QARTKAEA

SEQ ID NO: 3203917 - protein, 4 aa, Giardia lamblia
QGGC

SEQ ID NO: 3203918 - protein, 7 aa, Giardia lamblia
QKRAPRR

SEQ ID NO: 3203919 - protein, 11 aa, Giardia lamblia
QSLTANRKRRS

SEQ ID NO: 3203920 - protein, 6 aa, Giardia lamblia
RDSGGS

SEQ ID NO: 3203921 - protein, 6 aa, Giardia lamblia
RGSNEL

SEQ ID NO: 3203922 - protein, 9 aa, Giardia lamblia
RSAHSGLPS

SEQ ID NO: 3203923 - protein, 8 aa, Giardia lamblia
RSAPNTGL

SEQ ID NO: 3203924 - protein, 8 aa, Giardia lamblia
RSSSPNNL

SEQ ID NO: 3203925 - protein, 5 aa, Giardia lamblia
RSTST

SEQ ID NO: 3203926 - protein, 4 aa, Giardia lamblia
SAPA

SEQ ID NO: 3203927 - protein, 6 aa, Giardia lamblia
SDGSVH

SEQ ID NO: 3203928 - protein, 6 aa, Giardia lamblia
SETSPF

SEQ ID NO: 3203929 - protein, 14 aa, Giardia lamblia
SKKTSIEEKIDRNE

SEQ ID NO: 3203930 - protein, 12 aa, Giardia lamblia
SPMFTNTSDDFE

SEQ ID NO: 3203931 - protein, 11 aa, Giardia lamblia
SRDRSMASSVP

SEQ ID NO: 3203932 - protein, 13 aa, Giardia lamblia
SSGAAKAGDPAYM

SEQ ID NO: 3203933 - protein, 6 aa, Giardia lamblia
SSYGNC

SEQ ID NO: 3203934 - protein, 13 aa, Giardia lamblia
STPAYSSESFTDR

SEQ ID NO: 3203935 - protein, 9 aa, Giardia lamblia
THLTSATKL

SEQ ID NO: 3203936 - protein, 4 aa, Giardia lamblia
TKDE

SEQ ID NO: 3203937 - protein, 10 aa, Giardia lamblia
TPFTEEPSHG

SEQ ID NO: 3203938 - protein, 10 aa, Giardia lamblia
TPFTNEPEHG

SEQ ID NO: 3203939 - protein, 10 aa, Giardia lamblia
TSTGDATSAR

SEQ ID NO: 3203940 - protein, 6 aa, Giardia lamblia
TTSDTV

SEQ ID NO: 3203941 - protein, 9 aa, Giardia lamblia
TTSSGTARV

SEQ ID NO: 3203942 - protein, 5 aa, Giardia lamblia
TVPSE

SEQ ID NO: 3203943 - protein, 10 aa, Giardia lamblia
TYSDGSKTVC

SEQ ID NO: 3203944 - protein, 8 aa, Giardia lamblia
VKPRAARV

SEQ ID NO: 3203945 - protein, 10 aa, Giardia lamblia
VSPSKDTAPH

SEQ ID NO: 3203946 - protein, 7 aa, Giardia lamblia
WGPDWGE

SEQ ID NO: 3203947 - protein, 8 aa, Giardia lamblia
YGTNWGDQ

SEQ ID NO: 3203948 - protein, 6 aa, Giardia lamblia
YKGDDE

SEQ ID NO: 3203949 - protein, 7 aa, Giardia lamblia
YPYPTET

SEQ ID NO: 3203950 - protein, 6 aa, Giardia lamblia
YQASNV

SEQ ID NO: 3203951 - protein, 15 aa, Giardia lamblia
YSPRPRTTARCDKGR

SEQ ID NO: 3203952 - protein, 14 aa, Giardia lamblia
AAAGPARRTLSEKP

SEQ ID NO: 3203953 - protein, 11 aa, Giardia lamblia
AAATDQQKETL

SEQ ID NO: 3203954 - protein, 5 aa, Giardia lamblia
AACPS

SEQ ID NO: 3203955 - protein, 5 aa, Giardia lamblia
AADPS

SEQ ID NO: 3203956 - protein, 5 aa, Giardia lamblia
AADTN

SEQ ID NO: 3203957 - protein, 7 aa, Giardia lamblia
AAEEPAK

SEQ ID NO: 3203958 - protein, 8 aa, Giardia lamblia
AAGDDGRG

SEQ ID NO: 3203959 - protein, 8 aa, Giardia lamblia
AAGGIEPM

SEQ ID NO: 3203960 - protein, 5 aa, Giardia lamblia
AAGST

SEQ ID NO: 3203961 - protein, 6 aa, Giardia lamblia
AAKEDG

SEQ ID NO: 3203962 - protein, 7 aa, Giardia lamblia
AAKNDPY

SEQ ID NO: 3203963 - protein, 12 aa, Giardia lamblia
AAKNYAPISPEN

SEQ ID NO: 3203964 - protein, 38 aa, Giardia lamblia
AAKPENISSQENADSEQDTAKKEKRSEKHTNEANEAAR

SEQ ID NO: 3203965 - protein, 7 aa, Giardia lamblia
AAKTLSA

SEQ ID NO: 3203966 - protein, 10 aa, Giardia lamblia
AANSARSNYP

SEQ ID NO: 3203967 - protein, 11 aa, Giardia lamblia
AAQASASGSLS

SEQ ID NO: 3203968 - protein, 6 aa, Giardia lamblia
AARTQI

SEQ ID NO: 3203969 - protein, 11 aa, Giardia lamblia
AASPDVRLEPG

SEQ ID NO: 3203970 - protein, 23 aa, Giardia lamblia
AATDDPAARASAAFKEGRYRDAS

SEQ ID NO: 3203971 - protein, 17 aa, Giardia lamblia
AATDSVALSSSEAASPE

SEQ ID NO: 3203972 - protein, 22 aa, Giardia lamblia
AATGQPCSPNDAKIAKSQKKAA

SEQ ID NO: 3203973 - protein, 9 aa, Giardia lamblia
AATTNSNRA

SEQ ID NO: 3203974 - protein, 8 aa, Giardia lamblia
AAVQANGQ

SEQ ID NO: 3203975 - protein, 6 aa, Giardia lamblia
AAYTEE

SEQ ID NO: 3203976 - protein, 6 aa, Giardia lamblia
ACASGV

SEQ ID NO: 3203977 - protein, 6 aa, Giardia lamblia
ACQDSD

SEQ ID NO: 3203978 - protein, 9 aa, Giardia lamblia
ADAESRYSA

SEQ ID NO: 3203979 - protein, 11 aa, Giardia lamblia
ADEQEAQDTRL

SEQ ID NO: 3203980 - protein, 4 aa, Giardia lamblia
ADPD

SEQ ID NO: 3203981 - protein, 5 aa, Giardia lamblia
ADPRE

SEQ ID NO: 3203982 - protein, 11 aa, Giardia lamblia
ADSKDKTRSIV

SEQ ID NO: 3203983 - protein, 4 aa, Giardia lamblia
ADSS

SEQ ID NO: 3203984 - protein, 8 aa, Giardia lamblia
ADSSKQAV

SEQ ID NO: 3203985 - protein, 13 aa, Giardia lamblia
ADTAGEEGTEAAN

SEQ ID NO: 3203986 - protein, 7 aa, Giardia lamblia
ADTCTSC

SEQ ID NO: 3203987 - protein, 7 aa, Giardia lamblia
ADTLKPP

SEQ ID NO: 3203988 - protein, 8 aa, Giardia lamblia
AEDGPRAE

SEQ ID NO: 3203989 - protein, 7 aa, Giardia lamblia
AEDGTPA

SEQ ID NO: 3203990 - protein, 6 aa, Giardia lamblia
AEDHRD

SEQ ID NO: 3203991 - protein, 6 aa, Giardia lamblia
AEEAKQ

SEQ ID NO: 3203992 - protein, 8 aa, Giardia lamblia
AEGQSEDL

SEQ ID NO: 3203993 - protein, 8 aa, Giardia lamblia
AEHKQGTR

SEQ ID NO: 3203994 - protein, 6 aa, Giardia lamblia
AEHPED

SEQ ID NO: 3203995 - protein, 100 aa, Giardia lamblia
AEHPQREDDRRGPQGHQGDDHRRGQGPEHPGPGLLPQGPRALRGEVSAPGAADDVQQRAPHPGRPRRPGGARGGAAAPHIRPEGGQAGGGGISCGGHSPA

SEQ ID NO: 3203996 - protein, 8 aa, Giardia lamblia
AEIPPTVK

SEQ ID NO: 3203997 - protein, 15 aa, Giardia lamblia
AEKTDLYTASDPETA

SEQ ID NO: 3203998 - protein, 6 aa, Giardia lamblia
AENSKW

SEQ ID NO: 3203999 - protein, 6 aa, Giardia lamblia
AEQRQG

SEQ ID NO: 3204000 - protein, 7 aa, Giardia lamblia
AERPTAK

SEQ ID NO: 3204001 - protein, 5 aa, Giardia lamblia
AERYR

SEQ ID NO: 3204002 - protein, 8 aa, Giardia lamblia
AESESAAP

SEQ ID NO: 3204003 - protein, 6 aa, Giardia lamblia
AESQGR

SEQ ID NO: 3204004 - protein, 13 aa, Giardia lamblia
AESTGDDSRGQSI

SEQ ID NO: 3204005 - protein, 8 aa, Giardia lamblia
AETVRSGH

SEQ ID NO: 3204006 - protein, 4 aa, Giardia lamblia
AEYE

SEQ ID NO: 3204007 - protein, 4 aa, Giardia lamblia
AEYT

SEQ ID NO: 3204008 - protein, 6 aa, Giardia lamblia
AFPPWG

SEQ ID NO: 3204009 - protein, 8 aa, Giardia lamblia
AFSDNSKV

SEQ ID NO: 3204010 - protein, 14 aa, Giardia lamblia
AGAERDVTNQPGSE

SEQ ID NO: 3204011 - protein, 7 aa, Giardia lamblia
AGAPNGH

SEQ ID NO: 3204012 - protein, 9 aa, Giardia lamblia
AGCTPAECT

SEQ ID NO: 3204013 - protein, 17 aa, Giardia lamblia
AGDPDQEAADKQGSKTS

SEQ ID NO: 3204014 - protein, 5 aa, Giardia lamblia
AGEEE

SEQ ID NO: 3204015 - protein, 4 aa, Giardia lamblia
AGGT

SEQ ID NO: 3204016 - protein, 11 aa, Giardia lamblia
AGKGEMPPSFN

SEQ ID NO: 3204017 - protein, 12 aa, Giardia lamblia
AGKLSGASQPRK

SEQ ID NO: 3204018 - protein, 8 aa, Giardia lamblia
AGKNPRTK

SEQ ID NO: 3204019 - protein, 9 aa, Giardia lamblia
AGLPKTTAT

SEQ ID NO: 3204020 - protein, 6 aa, Giardia lamblia
AGLTGD

SEQ ID NO: 3204021 - protein, 12 aa, Giardia lamblia
AGLTNNKGERAI

SEQ ID NO: 3204022 - protein, 6 aa, Giardia lamblia
AGNGHR

SEQ ID NO: 3204023 - protein, 13 aa, Giardia lamblia
AGNPTDSAPTASL

SEQ ID NO: 3204024 - protein, 4 aa, Giardia lamblia
AGNR

SEQ ID NO: 3204025 - protein, 60 aa, Giardia lamblia
AGPRNSTGKEDSDAQEDTSKENSSVSNPTDSEPNLDTDASDTTDSTQHAQEQHDTEESAL

SEQ ID NO: 3204026 - protein, 6 aa, Giardia lamblia
AGQADC

SEQ ID NO: 3204027 - protein, 10 aa, Giardia lamblia
AGRKDISGGT

SEQ ID NO: 3204028 - protein, 8 aa, Giardia lamblia
AGRRNLGS

SEQ ID NO: 3204029 - protein, 9 aa, Giardia lamblia
AGSPRTQSS

SEQ ID NO: 3204030 - protein, 6 aa, Giardia lamblia
AGTRSG

SEQ ID NO: 3204031 - protein, 11 aa, Giardia lamblia
AHDKADNYSTP

SEQ ID NO: 3204032 - protein, 14 aa, Giardia lamblia
AHPTGTSRSASARL

SEQ ID NO: 3204033 - protein, 4 aa, Giardia lamblia
AHRP

SEQ ID NO: 3204034 - protein, 12 aa, Giardia lamblia
AHTNKSSSVLPQ

SEQ ID NO: 3204035 - protein, 4 aa, Giardia lamblia
AKAK

SEQ ID NO: 3204036 - protein, 9 aa, Giardia lamblia
AKDPVRTKR

SEQ ID NO: 3204037 - protein, 8 aa, Giardia lamblia
AKGAAHDL

SEQ ID NO: 3204038 - protein, 19 aa, Giardia lamblia
AKGAAPRGTFTDKDDVPES

SEQ ID NO: 3204039 - protein, 6 aa, Giardia lamblia
AKIPRT

SEQ ID NO: 3204040 - protein, 12 aa, Giardia lamblia
AKKTDKKPKAKV

SEQ ID NO: 3204041 - protein, 7 aa, Giardia lamblia
AKQQRKW

SEQ ID NO: 3204042 - protein, 8 aa, Giardia lamblia
AKTGPSFT

SEQ ID NO: 3204043 - protein, 10 aa, Giardia lamblia
AKTLARGTKE

SEQ ID NO: 3204044 - protein, 7 aa, Giardia lamblia
AKTRAPH

SEQ ID NO: 3204045 - protein, 9 aa, Giardia lamblia
ALAKGTGRF

SEQ ID NO: 3204046 - protein, 7 aa, Giardia lamblia
ALDQGSC

SEQ ID NO: 3204047 - protein, 4 aa, Giardia lamblia
ALDS

SEQ ID NO: 3204048 - protein, 9 aa, Giardia lamblia
ALEDQGKEH

SEQ ID NO: 3204049 - protein, 26 aa, Giardia lamblia
ALEEEGPEAGARASSEGVEDQEALEP

SEQ ID NO: 3204050 - protein, 6 aa, Giardia lamblia
ALESKV

SEQ ID NO: 3204051 - protein, 9 aa, Giardia lamblia
ALPKTATKD

SEQ ID NO: 3204052 - protein, 10 aa, Giardia lamblia
ALPPSSQDLS

SEQ ID NO: 3204053 - protein, 6 aa, Giardia lamblia
ALRTKK

SEQ ID NO: 3204054 - protein, 7 aa, Giardia lamblia
ALSPTQE

SEQ ID NO: 3204055 - protein, 5 aa, Giardia lamblia
ALTGS

SEQ ID NO: 3204056 - protein, 5 aa, Giardia lamblia
ALTSG

SEQ ID NO: 3204057 - protein, 11 aa, Giardia lamblia
ANAGEKCTECS

SEQ ID NO: 3204058 - protein, 17 aa, Giardia lamblia
ANAIATESSSSDALPTC

SEQ ID NO: 3204059 - protein, 8 aa, Giardia lamblia
ANEEKIRP

SEQ ID NO: 3204060 - protein, 12 aa, Giardia lamblia
ANEKDKPKQRLS

SEQ ID NO: 3204061 - protein, 12 aa, Giardia lamblia
ANGLGGAGSCKT

SEQ ID NO: 3204062 - protein, 13 aa, Giardia lamblia
ANHRENTKVKVVK

SEQ ID NO: 3204063 - protein, 5 aa, Giardia lamblia
ANNAG

SEQ ID NO: 3204064 - protein, 14 aa, Giardia lamblia
ANPVSSSLNSVQSS

SEQ ID NO: 3204065 - protein, 5 aa, Giardia lamblia
ANQGG

SEQ ID NO: 3204066 - protein, 7 aa, Giardia lamblia
ANRTHDE

SEQ ID NO: 3204067 - protein, 8 aa, Giardia lamblia
ANRTPESL

SEQ ID NO: 3204068 - protein, 14 aa, Giardia lamblia
ANSNVGGKETVQDT

SEQ ID NO: 3204069 - protein, 11 aa, Giardia lamblia
ANSPTQGDIET

SEQ ID NO: 3204070 - protein, 27 aa, Giardia lamblia
APAAQSSQPAQPTQQPPPSTAPATTAP

SEQ ID NO: 3204071 - protein, 15 aa, Giardia lamblia
APAEPSVTAEKKGSA

SEQ ID NO: 3204072 - protein, 8 aa, Giardia lamblia
APAKKQCS

SEQ ID NO: 3204073 - protein, 5 aa, Giardia lamblia
APAKN

SEQ ID NO: 3204074 - protein, 6 aa, Giardia lamblia
APDTYT

SEQ ID NO: 3204075 - protein, 13 aa, Giardia lamblia
APESRASDDAMDP

SEQ ID NO: 3204076 - protein, 20 aa, Giardia lamblia
APGATPPGAPSFTRSQSDDL

SEQ ID NO: 3204077 - protein, 7 aa, Giardia lamblia
APGKAGL

SEQ ID NO: 3204078 - protein, 5 aa, Giardia lamblia
APKTV

SEQ ID NO: 3204079 - protein, 6 aa, Giardia lamblia
APNNTL

SEQ ID NO: 3204080 - protein, 36 aa, Giardia lamblia
APPLAPEKDTSEEGAGNPTESSEMDDEGSVDEDGVT

SEQ ID NO: 3204081 - protein, 5 aa, Giardia lamblia
APPLL

SEQ ID NO: 3204082 - protein, 8 aa, Giardia lamblia
APRPSMSV

SEQ ID NO: 3204083 - protein, 6 aa, Giardia lamblia
APSHSQ

SEQ ID NO: 3204084 - protein, 7 aa, Giardia lamblia
APTLAEQ

SEQ ID NO: 3204085 - protein, 5 aa, Giardia lamblia
APTLP

SEQ ID NO: 3204086 - protein, 8 aa, Giardia lamblia
APTRDTEE

SEQ ID NO: 3204087 - protein, 12 aa, Giardia lamblia
APVNGNNDERVS

SEQ ID NO: 3204088 - protein, 6 aa, Giardia lamblia
APYNNS

SEQ ID NO: 3204089 - protein, 25 aa, Giardia lamblia
AQDPSANSERSEQQEQSEKVYEDTE

SEQ ID NO: 3204090 - protein, 13 aa, Giardia lamblia
AQFSEQKRATSRR

SEQ ID NO: 3204091 - protein, 9 aa, Giardia lamblia
AQGDDIASE

SEQ ID NO: 3204092 - protein, 11 aa, Giardia lamblia
AQGEQGATYTT

SEQ ID NO: 3204093 - protein, 4 aa, Giardia lamblia
AQGL

SEQ ID NO: 3204094 - protein, 10 aa, Giardia lamblia
AQGRENEQFQ

SEQ ID NO: 3204095 - protein, 8 aa, Giardia lamblia
AQNNSGET

SEQ ID NO: 3204096 - protein, 6 aa, Giardia lamblia
AQRPPA

SEQ ID NO: 3204097 - protein, 8 aa, Giardia lamblia
ARDQRPAF

SEQ ID NO: 3204098 - protein, 21 aa, Giardia lamblia
ARGNGLPNPQARTARSAEDVA

SEQ ID NO: 3204099 - protein, 4 aa, Giardia lamblia
ARIG

SEQ ID NO: 3204100 - protein, 8 aa, Giardia lamblia
ARKDPADT

SEQ ID NO: 3204101 - protein, 11 aa, Giardia lamblia
ARNNAQGDAEA

SEQ ID NO: 3204102 - protein, 10 aa, Giardia lamblia
ARQTNDAGKT

SEQ ID NO: 3204103 - protein, 7 aa, Giardia lamblia
ARRGNTK

SEQ ID NO: 3204104 - protein, 5 aa, Giardia lamblia
ARSGS

SEQ ID NO: 3204105 - protein, 16 aa, Giardia lamblia
ARTPLQRPAPRPRSTN

SEQ ID NO: 3204106 - protein, 4 aa, Giardia lamblia
ARVT

SEQ ID NO: 3204107 - protein, 6 aa, Giardia lamblia
ASASPQ

SEQ ID NO: 3204108 - protein, 8 aa, Giardia lamblia
ASASRLSN

SEQ ID NO: 3204109 - protein, 8 aa, Giardia lamblia
ASCPSPAV

SEQ ID NO: 3204110 - protein, 10 aa, Giardia lamblia
ASDTAKHSDA

SEQ ID NO: 3204111 - protein, 9 aa, Giardia lamblia
ASDVQGSGS

SEQ ID NO: 3204112 - protein, 6 aa, Giardia lamblia
ASEAHT

SEQ ID NO: 3204113 - protein, 11 aa, Giardia lamblia
ASERKSARRSL

SEQ ID NO: 3204114 - protein, 29 aa, Giardia lamblia
ASEVPTGKASPDDVRPEAPVTVTSEEPSN

SEQ ID NO: 3204115 - protein, 12 aa, Giardia lamblia
ASGRSDRRKPQA

SEQ ID NO: 3204116 - protein, 13 aa, Giardia lamblia
ASIPSNALTGDAA

SEQ ID NO: 3204117 - protein, 7 aa, Giardia lamblia
ASKSPRR

SEQ ID NO: 3204118 - protein, 4 aa, Giardia lamblia
ASLR

SEQ ID NO: 3204119 - protein, 8 aa, Giardia lamblia
ASNPSYAV

SEQ ID NO: 3204120 - protein, 5 aa, Giardia lamblia
ASQKS

SEQ ID NO: 3204121 - protein, 7 aa, Giardia lamblia
ASRNDVK

SEQ ID NO: 3204122 - protein, 15 aa, Giardia lamblia
ASRPSHDSSYAEEKA

SEQ ID NO: 3204123 - protein, 7 aa, Giardia lamblia
ASRTATQ

SEQ ID NO: 3204124 - protein, 8 aa, Giardia lamblia
ASSATIGD

SEQ ID NO: 3204125 - protein, 30 aa, Giardia lamblia
ASSDASLGVSASTASAATSRRHSDATPYRR

SEQ ID NO: 3204126 - protein, 8 aa, Giardia lamblia
ASSESIHS

SEQ ID NO: 3204127 - protein, 5 aa, Giardia lamblia
ASSGA

SEQ ID NO: 3204128 - protein, 7 aa, Giardia lamblia
ASSPECP

SEQ ID NO: 3204129 - protein, 18 aa, Giardia lamblia
ASSSTDRSAPAAHAPTGP

SEQ ID NO: 3204130 - protein, 18 aa, Giardia lamblia
ASSSTDRSAPAAHAPTGS

SEQ ID NO: 3204131 - protein, 16 aa, Giardia lamblia
ASSTSAPTSANTGTTG

SEQ ID NO: 3204132 - protein, 5 aa, Giardia lamblia
ASSVG

SEQ ID NO: 3204133 - protein, 22 aa, Giardia lamblia
ASTASADGGVEDVQKGGSGTQY

SEQ ID NO: 3204134 - protein, 4 aa, Giardia lamblia
ASTE

SEQ ID NO: 3204135 - protein, 7 aa, Giardia lamblia
ASTGTSA

SEQ ID NO: 3204136 - protein, 19 aa, Giardia lamblia
ASVPSDQKAPISKTATAID

SEQ ID NO: 3204137 - protein, 7 aa, Giardia lamblia
ASYDDSG

SEQ ID NO: 3204138 - protein, 14 aa, Giardia lamblia
ASYDSYDTGESYQD

SEQ ID NO: 3204139 - protein, 6 aa, Giardia lamblia
ASYGGT

SEQ ID NO: 3204140 - protein, 10 aa, Giardia lamblia
ASYQGQEGES

SEQ ID NO: 3204141 - protein, 7 aa, Giardia lamblia
ATAPQEE

SEQ ID NO: 3204142 - protein, 6 aa, Giardia lamblia
ATDADI

SEQ ID NO: 3204143 - protein, 8 aa, Giardia lamblia
ATDGANWK

SEQ ID NO: 3204144 - protein, 4 aa, Giardia lamblia
ATDQ

SEQ ID NO: 3204145 - protein, 6 aa, Giardia lamblia
ATGEHC

SEQ ID NO: 3204146 - protein, 7 aa, Giardia lamblia
ATGSVGS

SEQ ID NO: 3204147 - protein, 7 aa, Giardia lamblia
ATKKAND

SEQ ID NO: 3204148 - protein, 7 aa, Giardia lamblia
ATKSKGH

SEQ ID NO: 3204149 - protein, 5 aa, Giardia lamblia
ATPAE

SEQ ID NO: 3204150 - protein, 6 aa, Giardia lamblia
ATPAEL

SEQ ID NO: 3204151 - protein, 5 aa, Giardia lamblia
ATPTV

SEQ ID NO: 3204152 - protein, 5 aa, Giardia lamblia
ATRDS

SEQ ID NO: 3204153 - protein, 18 aa, Giardia lamblia
ATRTAIAKTDEQYRRAPS

SEQ ID NO: 3204154 - protein, 11 aa, Giardia lamblia
ATSGSKSGSAI

SEQ ID NO: 3204155 - protein, 4 aa, Giardia lamblia
ATSQ

SEQ ID NO: 3204156 - protein, 10 aa, Giardia lamblia
ATSSALDAAT

SEQ ID NO: 3204157 - protein, 6 aa, Giardia lamblia
ATSYKD

SEQ ID NO: 3204158 - protein, 4 aa, Giardia lamblia
ATTA

SEQ ID NO: 3204159 - protein, 17 aa, Giardia lamblia
AVEAERGRDRGDALGDQ

SEQ ID NO: 3204160 - protein, 6 aa, Giardia lamblia
AVKYSP

SEQ ID NO: 3204161 - protein, 19 aa, Giardia lamblia
AVPSKASTIYKKEPLSTSV

SEQ ID NO: 3204162 - protein, 7 aa, Giardia lamblia
AVSQRQS

SEQ ID NO: 3204163 - protein, 5 aa, Giardia lamblia
AVSYS

SEQ ID NO: 3204164 - protein, 13 aa, Giardia lamblia
AVTPSAHQDFFLS

SEQ ID NO: 3204165 - protein, 15 aa, Giardia lamblia
AVTPTELPSSPTSEL

SEQ ID NO: 3204166 - protein, 5 aa, Giardia lamblia
AWEGH

SEQ ID NO: 3204167 - protein, 4 aa, Giardia lamblia
AYDN

SEQ ID NO: 3204168 - protein, 4 aa, Giardia lamblia
AYGD

SEQ ID NO: 3204169 - protein, 5 aa, Giardia lamblia
AYPSV

SEQ ID NO: 3204170 - protein, 11 aa, Giardia lamblia
AYQPTGGSTVE

SEQ ID NO: 3204171 - protein, 17 aa, Giardia lamblia
AYRATGDSAIPEPSPFN

SEQ ID NO: 3204172 - protein, 7 aa, Giardia lamblia
AYSPETF

SEQ ID NO: 3204173 - protein, 12 aa, Giardia lamblia
CAARGKAQAGDF

SEQ ID NO: 3204174 - protein, 6 aa, Giardia lamblia
CAEENT

SEQ ID NO: 3204175 - protein, 5 aa, Giardia lamblia
CDAPR

SEQ ID NO: 3204176 - protein, 7 aa, Giardia lamblia
CDDGSAV

SEQ ID NO: 3204177 - protein, 10 aa, Giardia lamblia
CDEGETQVGE

SEQ ID NO: 3204178 - protein, 7 aa, Giardia lamblia
CDGGDTL

SEQ ID NO: 3204179 - protein, 6 aa, Giardia lamblia
CDQGEN

SEQ ID NO: 3204180 - protein, 14 aa, Giardia lamblia
CDTPDAPSLDEDMP

SEQ ID NO: 3204181 - protein, 6 aa, Giardia lamblia
CEEDET

SEQ ID NO: 3204182 - protein, 5 aa, Giardia lamblia
CEESA

SEQ ID NO: 3204183 - protein, 8 aa, Giardia lamblia
CEPGESPY

SEQ ID NO: 3204184 - protein, 6 aa, Giardia lamblia
CGPTAT

SEQ ID NO: 3204185 - protein, 9 aa, Giardia lamblia
CGSEGIEGY

SEQ ID NO: 3204186 - protein, 5 aa, Giardia lamblia
CGSPD

SEQ ID NO: 3204187 - protein, 7 aa, Giardia lamblia
CGTGPAC

SEQ ID NO: 3204188 - protein, 5 aa, Giardia lamblia
CNPEY

SEQ ID NO: 3204189 - protein, 17 aa, Giardia lamblia
CNPTNSGPTCEECSSEA

SEQ ID NO: 3204190 - protein, 5 aa, Giardia lamblia
CNTDR

SEQ ID NO: 3204191 - protein, 8 aa, Giardia lamblia
CPADNPPA

SEQ ID NO: 3204192 - protein, 8 aa, Giardia lamblia
CPATEEEA

SEQ ID NO: 3204193 - protein, 4 aa, Giardia lamblia
CPDA

SEQ ID NO: 3204194 - protein, 5 aa, Giardia lamblia
CPEGE

SEQ ID NO: 3204195 - protein, 20 aa, Giardia lamblia
CPEGYSGTRCENRECPEGET

SEQ ID NO: 3204196 - protein, 10 aa, Giardia lamblia
CPPDTTEYEN

SEQ ID NO: 3204197 - protein, 20 aa, Giardia lamblia
CPTEYSGEQCEDCSPGATRV

SEQ ID NO: 3204198 - protein, 5 aa, Giardia lamblia
CQQPA

SEQ ID NO: 3204199 - protein, 6 aa, Giardia lamblia
CSGRGE

SEQ ID NO: 3204200 - protein, 6 aa, Giardia lamblia
CSSSDV

SEQ ID NO: 3204201 - protein, 8 aa, Giardia lamblia
CSSTTSSV

SEQ ID NO: 3204202 - protein, 6 aa, Giardia lamblia
CSTDQD

SEQ ID NO: 3204203 - protein, 13 aa, Giardia lamblia
CTAYRESSDPADV

SEQ ID NO: 3204204 - protein, 8 aa, Giardia lamblia
CTDEGNNG

SEQ ID NO: 3204205 - protein, 9 aa, Giardia lamblia
CTDESRSKI

SEQ ID NO: 3204206 - protein, 11 aa, Giardia lamblia
CTDKSAKINGT

SEQ ID NO: 3204207 - protein, 6 aa, Giardia lamblia
CTSDRA

SEQ ID NO: 3204208 - protein, 5 aa, Giardia lamblia
CTSGR

SEQ ID NO: 3204209 - protein, 18 aa, Giardia lamblia
CTSPGDSDAPKSTSIKPA

SEQ ID NO: 3204210 - protein, 6 aa, Giardia lamblia
DAAAGS

SEQ ID NO: 3204211 - protein, 32 aa, Giardia lamblia
DAAEETKGHALESDETSLGDDLDTDVAEGEPF

SEQ ID NO: 3204212 - protein, 34 aa, Giardia lamblia
DAAQSHNKRPNSIVETGPRPTIPQSKSPRDPPNT

SEQ ID NO: 3204213 - protein, 6 aa, Giardia lamblia
DAARTI

SEQ ID NO: 3204214 - protein, 10 aa, Giardia lamblia
DADKDLSSPC

SEQ ID NO: 3204215 - protein, 5 aa, Giardia lamblia
DADSF

SEQ ID NO: 3204216 - protein, 9 aa, Giardia lamblia
DAEKDSRLP

SEQ ID NO: 3204217 - protein, 5 aa, Giardia lamblia
DAKAA

SEQ ID NO: 3204218 - protein, 4 aa, Giardia lamblia
DALG

SEQ ID NO: 3204219 - protein, 11 aa, Giardia lamblia
DANGNPVECSG

SEQ ID NO: 3204220 - protein, 4 aa, Giardia lamblia
DAPT

SEQ ID NO: 3204221 - protein, 8 aa, Giardia lamblia
DASGISKA

SEQ ID NO: 3204222 - protein, 28 aa, Giardia lamblia
DASGVYSAQNKVADKTDSSNREKTLKKG

SEQ ID NO: 3204223 - protein, 6 aa, Giardia lamblia
DASMNP

SEQ ID NO: 3204224 - protein, 6 aa, Giardia lamblia
DCANGT

SEQ ID NO: 3204225 - protein, 6 aa, Giardia lamblia
DCPSGE

SEQ ID NO: 3204226 - protein, 7 aa, Giardia lamblia
DDAPSEV

SEQ ID NO: 3204227 - protein, 6 aa, Giardia lamblia
DDDGYV

SEQ ID NO: 3204228 - protein, 12 aa, Giardia lamblia
DDGRVRAEREVD

SEQ ID NO: 3204229 - protein, 8 aa, Giardia lamblia
DDGTTAKC

SEQ ID NO: 3204230 - protein, 5 aa, Giardia lamblia
DDGYD

SEQ ID NO: 3204231 - protein, 6 aa, Giardia lamblia
DDNDNV

SEQ ID NO: 3204232 - protein, 6 aa, Giardia lamblia
DDPEVQ

SEQ ID NO: 3204233 - protein, 7 aa, Giardia lamblia
DDRDGRV

SEQ ID NO: 3204234 - protein, 5 aa, Giardia lamblia
DDSGA

SEQ ID NO: 3204235 - protein, 9 aa, Giardia lamblia
DDTSEGDQC

SEQ ID NO: 3204236 - protein, 6 aa, Giardia lamblia
DEAQSD

SEQ ID NO: 3204237 - protein, 7 aa, Giardia lamblia
DEATGTA

SEQ ID NO: 3204238 - protein, 8 aa, Giardia lamblia
DEEQSESD

SEQ ID NO: 3204239 - protein, 4 aa, Giardia lamblia
DEGG

SEQ ID NO: 3204240 - protein, 4 aa, Giardia lamblia
DEIE

SEQ ID NO: 3204241 - protein, 5 aa, Giardia lamblia
DELPK

SEQ ID NO: 3204242 - protein, 8 aa, Giardia lamblia
DENDQPHC

SEQ ID NO: 3204243 - protein, 20 aa, Giardia lamblia
DENVTEGSTIIPDSTNSGEL

SEQ ID NO: 3204244 - protein, 8 aa, Giardia lamblia
DEPDNLEN

SEQ ID NO: 3204245 - protein, 17 aa, Giardia lamblia
DEPSTTASLANEDIEGV

SEQ ID NO: 3204246 - protein, 4 aa, Giardia lamblia
DERA

SEQ ID NO: 3204247 - protein, 11 aa, Giardia lamblia
DESRRKAFGGY

SEQ ID NO: 3204248 - protein, 6 aa, Giardia lamblia
DEYGSS

SEQ ID NO: 3204249 - protein, 12 aa, Giardia lamblia
DFERGDGRGGYS

SEQ ID NO: 3204250 - protein, 7 aa, Giardia lamblia
DFGGPSR

SEQ ID NO: 3204251 - protein, 15 aa, Giardia lamblia
DFSNQEATKAPCNGR

SEQ ID NO: 3204252 - protein, 18 aa, Giardia lamblia
DGATGEKKASTASGPKVY

SEQ ID NO: 3204253 - protein, 7 aa, Giardia lamblia
DGDGAAV

SEQ ID NO: 3204254 - protein, 5 aa, Giardia lamblia
DGDTC

SEQ ID NO: 3204255 - protein, 4 aa, Giardia lamblia
DGEM

SEQ ID NO: 3204256 - protein, 6 aa, Giardia lamblia
DGERLV

SEQ ID NO: 3204257 - protein, 4 aa, Giardia lamblia
DGGC

SEQ ID NO: 3204258 - protein, 8 aa, Giardia lamblia
DGRHGSAI

SEQ ID NO: 3204259 - protein, 11 aa, Giardia lamblia
DGRRDLGRGVD

SEQ ID NO: 3204260 - protein, 6 aa, Giardia lamblia
DGSAPQ

SEQ ID NO: 3204261 - protein, 4 aa, Giardia lamblia
DGSE

SEQ ID NO: 3204262 - protein, 5 aa, Giardia lamblia
DGSPI

SEQ ID NO: 3204263 - protein, 8 aa, Giardia lamblia
DGTGLPPL

SEQ ID NO: 3204264 - protein, 10 aa, Giardia lamblia
DGVDTTKTSY

SEQ ID NO: 3204265 - protein, 5 aa, Giardia lamblia
DGVSD

SEQ ID NO: 3204266 - protein, 6 aa, Giardia lamblia
DGYDGD

SEQ ID NO: 3204267 - protein, 10 aa, Giardia lamblia
DGYKYNEQRN

SEQ ID NO: 3204268 - protein, 5 aa, Giardia lamblia
DGYTR

SEQ ID NO: 3204269 - protein, 13 aa, Giardia lamblia
DGYYNTTKDGDIK

SEQ ID NO: 3204270 - protein, 12 aa, Giardia lamblia
DIDSNLSSQNPL

SEQ ID NO: 3204271 - protein, 10 aa, Giardia lamblia
DIEEKAREID

SEQ ID NO: 3204272 - protein, 13 aa, Giardia lamblia
DIPSSNDITDQRY

SEQ ID NO: 3204273 - protein, 7 aa, Giardia lamblia
DISDYNP

SEQ ID NO: 3204274 - protein, 6 aa, Giardia lamblia
DISPET

SEQ ID NO: 3204275 - protein, 9 aa, Giardia lamblia
DITRTRQSL

SEQ ID NO: 3204276 - protein, 6 aa, Giardia lamblia
DITSCQ

SEQ ID NO: 3204277 - protein, 10 aa, Giardia lamblia
DKAHDNTVEP

SEQ ID NO: 3204278 - protein, 17 aa, Giardia lamblia
DKDSSAVDASEKPGRRC

SEQ ID NO: 3204279 - protein, 10 aa, Giardia lamblia
DKGGDGYAGV

SEQ ID NO: 3204280 - protein, 7 aa, Giardia lamblia
DKHSAAH

SEQ ID NO: 3204281 - protein, 7 aa, Giardia lamblia
DKHSATH

SEQ ID NO: 3204282 - protein, 7 aa, Giardia lamblia
DKKESSL

SEQ ID NO: 3204283 - protein, 7 aa, Giardia lamblia
DKKNKEE

SEQ ID NO: 3204284 - protein, 8 aa, Giardia lamblia
DKSGHRSI

SEQ ID NO: 3204285 - protein, 6 aa, Giardia lamblia
DKTGGV

SEQ ID NO: 3204286 - protein, 5 aa, Giardia lamblia
DLDPD

SEQ ID NO: 3204287 - protein, 4 aa, Giardia lamblia
DLPA

SEQ ID NO: 3204288 - protein, 7 aa, Giardia lamblia
DLPNEAS

SEQ ID NO: 3204289 - protein, 4 aa, Giardia lamblia
DLSG

SEQ ID NO: 3204290 - protein, 8 aa, Giardia lamblia
DMATDRGI

SEQ ID NO: 3204291 - protein, 8 aa, Giardia lamblia
DMGGQKDN

SEQ ID NO: 3204292 - protein, 6 aa, Giardia lamblia
DNAPEG

SEQ ID NO: 3204293 - protein, 5 aa, Giardia lamblia
DNGDG

SEQ ID NO: 3204294 - protein, 7 aa, Giardia lamblia
DNITQPG

SEQ ID NO: 3204295 - protein, 7 aa, Giardia lamblia
DNKYTPD

SEQ ID NO: 3204296 - protein, 9 aa, Giardia lamblia
DNNGCNGGL

SEQ ID NO: 3204297 - protein, 12 aa, Giardia lamblia
DNPAGPQVSERS

SEQ ID NO: 3204298 - protein, 17 aa, Giardia lamblia
DNTDASKEEIEEEKSKF

SEQ ID NO: 3204299 - protein, 4 aa, Giardia lamblia
DNVT

SEQ ID NO: 3204300 - protein, 6 aa, Giardia lamblia
DPDASE

SEQ ID NO: 3204301 - protein, 6 aa, Giardia lamblia
DPDKGE

SEQ ID NO: 3204302 - protein, 15 aa, Giardia lamblia
DPDRVGDTTVEPPSL

SEQ ID NO: 3204303 - protein, 9 aa, Giardia lamblia
DPEALTDEE

SEQ ID NO: 3204304 - protein, 11 aa, Giardia lamblia
DPEGRGDVPDP

SEQ ID NO: 3204305 - protein, 17 aa, Giardia lamblia
DPEHPSKECSGHGECKD

SEQ ID NO: 3204306 - protein, 8 aa, Giardia lamblia
DPFTTETL

SEQ ID NO: 3204307 - protein, 13 aa, Giardia lamblia
DPLKGSSKVYGGY

SEQ ID NO: 3204308 - protein, 6 aa, Giardia lamblia
DPNNMT

SEQ ID NO: 3204309 - protein, 8 aa, Giardia lamblia
DPSSESRL

SEQ ID NO: 3204310 - protein, 9 aa, Giardia lamblia
DPTDSLSDR

SEQ ID NO: 3204311 - protein, 4 aa, Giardia lamblia
DPTH

SEQ ID NO: 3204312 - protein, 5 aa, Giardia lamblia
DPVLG

SEQ ID NO: 3204313 - protein, 30 aa, Giardia lamblia
DQMDPEGGTIFPSEDEYNELPDGPDNADLT

SEQ ID NO: 3204314 - protein, 15 aa, Giardia lamblia
DQSRAGAAGCSSSTL

SEQ ID NO: 3204315 - protein, 8 aa, Giardia lamblia
DQSRPGPV

SEQ ID NO: 3204316 - protein, 10 aa, Giardia lamblia
DQTRQQTVHG

SEQ ID NO: 3204317 - protein, 13 aa, Giardia lamblia
DQYSAPSADMSSA

SEQ ID NO: 3204318 - protein, 6 aa, Giardia lamblia
DREDAD

SEQ ID NO: 3204319 - protein, 8 aa, Giardia lamblia
DRKASKRI

SEQ ID NO: 3204320 - protein, 6 aa, Giardia lamblia
DRPMDD

SEQ ID NO: 3204321 - protein, 7 aa, Giardia lamblia
DRRMYSP

SEQ ID NO: 3204322 - protein, 8 aa, Giardia lamblia
DRRRDVSS

SEQ ID NO: 3204323 - protein, 6 aa, Giardia lamblia
DRTQTS

SEQ ID NO: 3204324 - protein, 9 aa, Giardia lamblia
DRVPAGGVQ

SEQ ID NO: 3204325 - protein, 12 aa, Giardia lamblia
DSGEAGCQGGEF

SEQ ID NO: 3204326 - protein, 5 aa, Giardia lamblia
DSGGS

SEQ ID NO: 3204327 - protein, 7 aa, Giardia lamblia
DSGSLNT

SEQ ID NO: 3204328 - protein, 7 aa, Giardia lamblia
DSISTSS

SEQ ID NO: 3204329 - protein, 9 aa, Giardia lamblia
DSKATDAKL

SEQ ID NO: 3204330 - protein, 19 aa, Giardia lamblia
DSLPSSAGTPTTSPGASGR

SEQ ID NO: 3204331 - protein, 4 aa, Giardia lamblia
DSNN

SEQ ID NO: 3204332 - protein, 4 aa, Giardia lamblia
DSPE

SEQ ID NO: 3204333 - protein, 12 aa, Giardia lamblia
DSPFPKDHDEAR

SEQ ID NO: 3204334 - protein, 9 aa, Giardia lamblia
DSPLSQTAE

SEQ ID NO: 3204335 - protein, 13 aa, Giardia lamblia
DSQRSATKDAGRI

SEQ ID NO: 3204336 - protein, 7 aa, Giardia lamblia
DSSAGPK

SEQ ID NO: 3204337 - protein, 9 aa, Giardia lamblia
DSSGNVEGI

SEQ ID NO: 3204338 - protein, 8 aa, Giardia lamblia
DSSPNRTV

SEQ ID NO: 3204339 - protein, 8 aa, Giardia lamblia
DSSSTFSG

SEQ ID NO: 3204340 - protein, 6 aa, Giardia lamblia
DSTDNP

SEQ ID NO: 3204341 - protein, 14 aa, Giardia lamblia
DSTHQSRTCAVSSS

SEQ ID NO: 3204342 - protein, 8 aa, Giardia lamblia
DSTNTKKW

SEQ ID NO: 3204343 - protein, 4 aa, Giardia lamblia
DTAT

SEQ ID NO: 3204344 - protein, 5 aa, Giardia lamblia
DTCGR

SEQ ID NO: 3204345 - protein, 18 aa, Giardia lamblia
DTDNGNTSSKQTTSPGAL

SEQ ID NO: 3204346 - protein, 8 aa, Giardia lamblia
DTHLPPSR

SEQ ID NO: 3204347 - protein, 10 aa, Giardia lamblia
DTKTEAQINE

SEQ ID NO: 3204348 - protein, 12 aa, Giardia lamblia
DTQEAPASSGLY

SEQ ID NO: 3204349 - protein, 7 aa, Giardia lamblia
DTSARAD

SEQ ID NO: 3204350 - protein, 7 aa, Giardia lamblia
DTSLDGN

SEQ ID NO: 3204351 - protein, 6 aa, Giardia lamblia
DTSRKR

SEQ ID NO: 3204352 - protein, 7 aa, Giardia lamblia
DTTAASD

SEQ ID NO: 3204353 - protein, 4 aa, Giardia lamblia
DTYQ

SEQ ID NO: 3204354 - protein, 8 aa, Giardia lamblia
DVAQTTSV

SEQ ID NO: 3204355 - protein, 21 aa, Giardia lamblia
DVDADGKKDPQSFQDAEKAVK

SEQ ID NO: 3204356 - protein, 7 aa, Giardia lamblia
DVEKEDE

SEQ ID NO: 3204357 - protein, 10 aa, Giardia lamblia
DVGGDDLRRS

SEQ ID NO: 3204358 - protein, 25 aa, Giardia lamblia
DVPEQTPSHRRSGSSASSVSPGPSH

SEQ ID NO: 3204359 - protein, 6 aa, Giardia lamblia
DVSNYN

SEQ ID NO: 3204360 - protein, 16 aa, Giardia lamblia
DYDQTQSRPCPSTCDD

SEQ ID NO: 3204361 - protein, 12 aa, Giardia lamblia
DYKPSADGLRCE

SEQ ID NO: 3204362 - protein, 4 aa, Giardia lamblia
DYPQ

SEQ ID NO: 3204363 - protein, 5 aa, Giardia lamblia
DYPYP

SEQ ID NO: 3204364 - protein, 24 aa, Giardia lamblia
DYQDEEEKLETEKLEAEKEQKNKS

SEQ ID NO: 3204365 - protein, 6 aa, Giardia lamblia
DYRRPQ

SEQ ID NO: 3204366 - protein, 5 aa, Giardia lamblia
DYSQY

SEQ ID NO: 3204367 - protein, 4 aa, Giardia lamblia
EADP

SEQ ID NO: 3204368 - protein, 13 aa, Giardia lamblia
EADSHQASIGPIG

SEQ ID NO: 3204369 - protein, 11 aa, Giardia lamblia
EAGKQDSHGNT

SEQ ID NO: 3204370 - protein, 8 aa, Giardia lamblia
EAGLADAR

SEQ ID NO: 3204371 - protein, 9 aa, Giardia lamblia
EAGRRNNQG

SEQ ID NO: 3204372 - protein, 7 aa, Giardia lamblia
EAKDGQQ

SEQ ID NO: 3204373 - protein, 12 aa, Giardia lamblia
EALEPEACPHRG

SEQ ID NO: 3204374 - protein, 11 aa, Giardia lamblia
EANGAKPSDVK

SEQ ID NO: 3204375 - protein, 8 aa, Giardia lamblia
EANSKSQL

SEQ ID NO: 3204376 - protein, 16 aa, Giardia lamblia
EASATVPDPQAASDTA

SEQ ID NO: 3204377 - protein, 4 aa, Giardia lamblia
EASD

SEQ ID NO: 3204378 - protein, 6 aa, Giardia lamblia
EASQQR

SEQ ID NO: 3204379 - protein, 23 aa, Giardia lamblia
EATLTASEANTPTLSGVSQRRGS

SEQ ID NO: 3204380 - protein, 5 aa, Giardia lamblia
EATNS

SEQ ID NO: 3204381 - protein, 10 aa, Giardia lamblia
ECNDGANYAP

SEQ ID NO: 3204382 - protein, 4 aa, Giardia lamblia
ECPY

SEQ ID NO: 3204383 - protein, 5 aa, Giardia lamblia
ECQPS

SEQ ID NO: 3204384 - protein, 10 aa, Giardia lamblia
ECREQPNGRY

SEQ ID NO: 3204385 - protein, 5 aa, Giardia lamblia
ECSAT

SEQ ID NO: 3204386 - protein, 8 aa, Giardia lamblia
EDAGYSPG

SEQ ID NO: 3204387 - protein, 10 aa, Giardia lamblia
EDCAEKSRKV

SEQ ID NO: 3204388 - protein, 5 aa, Giardia lamblia
EDCRK

SEQ ID NO: 3204389 - protein, 11 aa, Giardia lamblia
EDDGSYKCSCR

SEQ ID NO: 3204390 - protein, 18 aa, Giardia lamblia
EDGFSGKQCENYDNCPTD

SEQ ID NO: 3204391 - protein, 9 aa, Giardia lamblia
EDGTSSSIP

SEQ ID NO: 3204392 - protein, 6 aa, Giardia lamblia
EDIGSS

SEQ ID NO: 3204393 - protein, 8 aa, Giardia lamblia
EDMPETCS

SEQ ID NO: 3204394 - protein, 5 aa, Giardia lamblia
EDMPS

SEQ ID NO: 3204395 - protein, 6 aa, Giardia lamblia
EDPKKA

SEQ ID NO: 3204396 - protein, 10 aa, Giardia lamblia
EDPNYSEKSL

SEQ ID NO: 3204397 - protein, 5 aa, Giardia lamblia
EDQKE

SEQ ID NO: 3204398 - protein, 9 aa, Giardia lamblia
EEAAPPYYK

SEQ ID NO: 3204399 - protein, 4 aa, Giardia lamblia
EEEQ

SEQ ID NO: 3204400 - protein, 18 aa, Giardia lamblia
EEFAEEDKINRERAEARN

SEQ ID NO: 3204401 - protein, 6 aa, Giardia lamblia
EEGGRF

SEQ ID NO: 3204402 - protein, 6 aa, Giardia lamblia
EEGPHC

SEQ ID NO: 3204403 - protein, 8 aa, Giardia lamblia
EEPDQRIS

SEQ ID NO: 3204404 - protein, 4 aa, Giardia lamblia
EESR

SEQ ID NO: 3204405 - protein, 6 aa, Giardia lamblia
EESREL

SEQ ID NO: 3204406 - protein, 7 aa, Giardia lamblia
EESSTVT

SEQ ID NO: 3204407 - protein, 4 aa, Giardia lamblia
EETL

SEQ ID NO: 3204408 - protein, 11 aa, Giardia lamblia
EETPSIVPQEQ

SEQ ID NO: 3204409 - protein, 6 aa, Giardia lamblia
EEVESG

SEQ ID NO: 3204410 - protein, 8 aa, Giardia lamblia
EEYSGPRE

SEQ ID NO: 3204411 - protein, 5 aa, Giardia lamblia
EGAVK

SEQ ID NO: 3204412 - protein, 5 aa, Giardia lamblia
EGDIA

SEQ ID NO: 3204413 - protein, 4 aa, Giardia lamblia
EGDQ

SEQ ID NO: 3204414 - protein, 4 aa, Giardia lamblia
EGEI

SEQ ID NO: 3204415 - protein, 5 aa, Giardia lamblia
EGERR

SEQ ID NO: 3204416 - protein, 9 aa, Giardia lamblia
EGGIQDNSK

SEQ ID NO: 3204417 - protein, 9 aa, Giardia lamblia
EGGMQKGRG

SEQ ID NO: 3204418 - protein, 11 aa, Giardia lamblia
EGGMQNNDGWP

SEQ ID NO: 3204419 - protein, 14 aa, Giardia lamblia
EGGTPVRPTNATTL

SEQ ID NO: 3204420 - protein, 11 aa, Giardia lamblia
EGNRVKSQLEQ

SEQ ID NO: 3204421 - protein, 9 aa, Giardia lamblia
EGPATPRDV

SEQ ID NO: 3204422 - protein, 22 aa, Giardia lamblia
EGRAGVEETTDMSSVTHGVAKT

SEQ ID NO: 3204423 - protein, 4 aa, Giardia lamblia
EGRI

SEQ ID NO: 3204424 - protein, 8 aa, Giardia lamblia
EGSIEPSV

SEQ ID NO: 3204425 - protein, 5 aa, Giardia lamblia
EGTGG

SEQ ID NO: 3204426 - protein, 14 aa, Giardia lamblia
EGTGQQVDETMSGK

SEQ ID NO: 3204427 - protein, 6 aa, Giardia lamblia
EGVRGY

SEQ ID NO: 3204428 - protein, 4 aa, Giardia lamblia
EGYE

SEQ ID NO: 3204429 - protein, 6 aa, Giardia lamblia
EGYPDK

SEQ ID NO: 3204430 - protein, 12 aa, Giardia lamblia
EGYTSVSPTCAP

SEQ ID NO: 3204431 - protein, 10 aa, Giardia lamblia
EGYVSKGGEC

SEQ ID NO: 3204432 - protein, 4 aa, Giardia lamblia
EKAS

SEQ ID NO: 3204433 - protein, 9 aa, Giardia lamblia
EKDTDPLAD

SEQ ID NO: 3204434 - protein, 7 aa, Giardia lamblia
EKEPCGV

SEQ ID NO: 3204435 - protein, 4 aa, Giardia lamblia
EKIT

SEQ ID NO: 3204436 - protein, 15 aa, Giardia lamblia
EKKPAGRVEGGMADS

SEQ ID NO: 3204437 - protein, 4 aa, Giardia lamblia
EKMV

SEQ ID NO: 3204438 - protein, 9 aa, Giardia lamblia
EKPPGYPID

SEQ ID NO: 3204439 - protein, 4 aa, Giardia lamblia
EKSI

SEQ ID NO: 3204440 - protein, 4 aa, Giardia lamblia
EKSY

SEQ ID NO: 3204441 - protein, 6 aa, Giardia lamblia
EKVRTG

SEQ ID NO: 3204442 - protein, 11 aa, Giardia lamblia
EKYSPTHSGCQ

SEQ ID NO: 3204443 - protein, 12 aa, Giardia lamblia
ELSDPDRCDEPA

SEQ ID NO: 3204444 - protein, 7 aa, Giardia lamblia
ELTPKRY

SEQ ID NO: 3204445 - protein, 22 aa, Giardia lamblia
EMGETDETDEMEESDESEEPEK

SEQ ID NO: 3204446 - protein, 16 aa, Giardia lamblia
EMGETKESEESEEPEK

SEQ ID NO: 3204447 - protein, 8 aa, Giardia lamblia
ENEEADHR

SEQ ID NO: 3204448 - protein, 8 aa, Giardia lamblia
ENGENTDA

SEQ ID NO: 3204449 - protein, 9 aa, Giardia lamblia
ENHEGDTVE

SEQ ID NO: 3204450 - protein, 5 aa, Giardia lamblia
ENLER

SEQ ID NO: 3204451 - protein, 10 aa, Giardia lamblia
ENPYSSSHPN

SEQ ID NO: 3204452 - protein, 5 aa, Giardia lamblia
ENSYT

SEQ ID NO: 3204453 - protein, 19 aa, Giardia lamblia
ENTTAGDNLDAYGRRTDGK

SEQ ID NO: 3204454 - protein, 5 aa, Giardia lamblia
EPAPN

SEQ ID NO: 3204455 - protein, 11 aa, Giardia lamblia
EPHGSDDQHDN

SEQ ID NO: 3204456 - protein, 5 aa, Giardia lamblia
EPNRV

SEQ ID NO: 3204457 - protein, 9 aa, Giardia lamblia
EPSADGYNH

SEQ ID NO: 3204458 - protein, 15 aa, Giardia lamblia
EPSKDASDGEDRKTY

SEQ ID NO: 3204459 - protein, 7 aa, Giardia lamblia
EPSPASD

SEQ ID NO: 3204460 - protein, 9 aa, Giardia lamblia
EPSPDKRLS

SEQ ID NO: 3204461 - protein, 6 aa, Giardia lamblia
EPTACG

SEQ ID NO: 3204462 - protein, 8 aa, Giardia lamblia
EPTSSSIA

SEQ ID NO: 3204463 - protein, 14 aa, Giardia lamblia
EPVAPTVEESEEVQ

SEQ ID NO: 3204464 - protein, 10 aa, Giardia lamblia
EQAKTSPLRK

SEQ ID NO: 3204465 - protein, 6 aa, Giardia lamblia
EQERIA

SEQ ID NO: 3204466 - protein, 8 aa, Giardia lamblia
EQGCQPED

SEQ ID NO: 3204467 - protein, 7 aa, Giardia lamblia
EQISSQR

SEQ ID NO: 3204468 - protein, 6 aa, Giardia lamblia
EQKAGI

SEQ ID NO: 3204469 - protein, 13 aa, Giardia lamblia
EQLHATQRTLEEA

SEQ ID NO: 3204470 - protein, 19 aa, Giardia lamblia
EQMKRNNANVSQNNIIEGQ

SEQ ID NO: 3204471 - protein, 21 aa, Giardia lamblia
EQRAAPAPEAPSPAEQEEDSI

SEQ ID NO: 3204472 - protein, 6 aa, Giardia lamblia
EQRHDL

SEQ ID NO: 3204473 - protein, 4 aa, Giardia lamblia
EREG

SEQ ID NO: 3204474 - protein, 6 aa, Giardia lamblia
ERGEAG

SEQ ID NO: 3204475 - protein, 4 aa, Giardia lamblia
ERKM

SEQ ID NO: 3204476 - protein, 6 aa, Giardia lamblia
ERNPDA

SEQ ID NO: 3204477 - protein, 7 aa, Giardia lamblia
ERPTARG

SEQ ID NO: 3204478 - protein, 23 aa, Giardia lamblia
ERRGFSAASSGAHCTRGPRSPGV

SEQ ID NO: 3204479 - protein, 7 aa, Giardia lamblia
ERRPTAR

SEQ ID NO: 3204480 - protein, 12 aa, Giardia lamblia
ERRSPGMSKPSL

SEQ ID NO: 3204481 - protein, 8 aa, Giardia lamblia
ERSSEYDD

SEQ ID NO: 3204482 - protein, 25 aa, Giardia lamblia
ERSTKLPASTPALAASNKHSHTPLQ

SEQ ID NO: 3204483 - protein, 6 aa, Giardia lamblia
ERSTRT

SEQ ID NO: 3204484 - protein, 10 aa, Giardia lamblia
ERTGRTDAGV

SEQ ID NO: 3204485 - protein, 18 aa, Giardia lamblia
ERVPRKGLRQSSFRRRNG

SEQ ID NO: 3204486 - protein, 10 aa, Giardia lamblia
ERYRDPNTYP

SEQ ID NO: 3204487 - protein, 6 aa, Giardia lamblia
ESAFTT

SEQ ID NO: 3204488 - protein, 9 aa, Giardia lamblia
ESCAQSRDG

SEQ ID NO: 3204489 - protein, 10 aa, Giardia lamblia
ESDAPLGDRQ

SEQ ID NO: 3204490 - protein, 5 aa, Giardia lamblia
ESDES

SEQ ID NO: 3204491 - protein, 5 aa, Giardia lamblia
ESEAL

SEQ ID NO: 3204492 - protein, 15 aa, Giardia lamblia
ESEERYRRTSQGADD

SEQ ID NO: 3204493 - protein, 5 aa, Giardia lamblia
ESEQK

SEQ ID NO: 3204494 - protein, 12 aa, Giardia lamblia
ESGLKSDKGRTA

SEQ ID NO: 3204495 - protein, 7 aa, Giardia lamblia
ESGSNSC

SEQ ID NO: 3204496 - protein, 8 aa, Giardia lamblia
ESHDTEAS

SEQ ID NO: 3204497 - protein, 23 aa, Giardia lamblia
ESKKNGGARAKGGSAPAKTLSNE

SEQ ID NO: 3204498 - protein, 6 aa, Giardia lamblia
ESKTRL

SEQ ID NO: 3204499 - protein, 6 aa, Giardia lamblia
ESQHQK

SEQ ID NO: 3204500 - protein, 6 aa, Giardia lamblia
ESQQRL

SEQ ID NO: 3204501 - protein, 12 aa, Giardia lamblia
ESRKKDAAVDSR

SEQ ID NO: 3204502 - protein, 5 aa, Giardia lamblia
ESRRR

SEQ ID NO: 3204503 - protein, 4 aa, Giardia lamblia
ESSD

SEQ ID NO: 3204504 - protein, 8 aa, Giardia lamblia
ESSESPKR

SEQ ID NO: 3204505 - protein, 8 aa, Giardia lamblia
ESVSPSAY

SEQ ID NO: 3204506 - protein, 6 aa, Giardia lamblia
ETAQLT

SEQ ID NO: 3204507 - protein, 14 aa, Giardia lamblia
ETAWQGADKTQNPC

SEQ ID NO: 3204508 - protein, 9 aa, Giardia lamblia
ETCSADPEL

SEQ ID NO: 3204509 - protein, 5 aa, Giardia lamblia
ETDRK

SEQ ID NO: 3204510 - protein, 5 aa, Giardia lamblia
ETEEY

SEQ ID NO: 3204511 - protein, 10 aa, Giardia lamblia
ETEHETDETF

SEQ ID NO: 3204512 - protein, 6 aa, Giardia lamblia
ETGGEN

SEQ ID NO: 3204513 - protein, 4 aa, Giardia lamblia
ETGS

SEQ ID NO: 3204514 - protein, 7 aa, Giardia lamblia
ETNCNED

SEQ ID NO: 3204515 - protein, 8 aa, Giardia lamblia
ETREENRR

SEQ ID NO: 3204516 - protein, 7 aa, Giardia lamblia
ETRQDTM

SEQ ID NO: 3204517 - protein, 6 aa, Giardia lamblia
ETRTDL

SEQ ID NO: 3204518 - protein, 5 aa, Giardia lamblia
ETRTS

SEQ ID NO: 3204519 - protein, 9 aa, Giardia lamblia
ETSKHNKDT

SEQ ID NO: 3204520 - protein, 7 aa, Giardia lamblia
EVDPTTG

SEQ ID NO: 3204521 - protein, 7 aa, Giardia lamblia
EVPPGHG

SEQ ID NO: 3204522 - protein, 9 aa, Giardia lamblia
EYEDGKRRV

SEQ ID NO: 3204523 - protein, 9 aa, Giardia lamblia
EYNDGQRRV

SEQ ID NO: 3204524 - protein, 8 aa, Giardia lamblia
FADSEQDL

SEQ ID NO: 3204525 - protein, 5 aa, Giardia lamblia
FDPRD

SEQ ID NO: 3204526 - protein, 9 aa, Giardia lamblia
FDQRSRKPY

SEQ ID NO: 3204527 - protein, 5 aa, Giardia lamblia
FDSEL

SEQ ID NO: 3204528 - protein, 7 aa, Giardia lamblia
FDTSRDK

SEQ ID NO: 3204529 - protein, 5 aa, Giardia lamblia
FEDTT

SEQ ID NO: 3204530 - protein, 12 aa, Giardia lamblia
FGEHGSDTIPPR

SEQ ID NO: 3204531 - protein, 21 aa, Giardia lamblia
FGRSASAGSSGPEYDYAEKDE

SEQ ID NO: 3204532 - protein, 7 aa, Giardia lamblia
FNGSRDR

SEQ ID NO: 3204533 - protein, 6 aa, Giardia lamblia
FNQPGL

SEQ ID NO: 3204534 - protein, 9 aa, Giardia lamblia
FPDEDSTRA

SEQ ID NO: 3204535 - protein, 11 aa, Giardia lamblia
FPGKPDYPIAP

SEQ ID NO: 3204536 - protein, 8 aa, Giardia lamblia
FPSTNSAN

SEQ ID NO: 3204537 - protein, 10 aa, Giardia lamblia
FPTPQSLTSS

SEQ ID NO: 3204538 - protein, 6 aa, Giardia lamblia
FRDHRT

SEQ ID NO: 3204539 - protein, 11 aa, Giardia lamblia
FRPTLSGAKTQ

SEQ ID NO: 3204540 - protein, 11 aa, Giardia lamblia
FSNPNSIGSNR

SEQ ID NO: 3204541 - protein, 7 aa, Giardia lamblia
FSPFGSS

SEQ ID NO: 3204542 - protein, 23 aa, Giardia lamblia
FSRQSSDVHTTRPYPTSAGSEHV

SEQ ID NO: 3204543 - protein, 17 aa, Giardia lamblia
FSSVTKRAKAALQMDPD

SEQ ID NO: 3204544 - protein, 15 aa, Giardia lamblia
FSTLSTGDGKPPVVP

SEQ ID NO: 3204545 - protein, 16 aa, Giardia lamblia
FSTPESCSGRNSATDF

SEQ ID NO: 3204546 - protein, 4 aa, Giardia lamblia
FTPT

SEQ ID NO: 3204547 - protein, 5 aa, Giardia lamblia
FVDPT

SEQ ID NO: 3204548 - protein, 15 aa, Giardia lamblia
FYSGNPMSSVDSYKA

SEQ ID NO: 3204549 - protein, 5 aa, Giardia lamblia
GADIS

SEQ ID NO: 3204550 - protein, 5 aa, Giardia lamblia
GAFGD

SEQ ID NO: 3204551 - protein, 43 aa, Giardia lamblia
GAGGQSKSHFSRTASDVKARSNSSKQQKITVSRPNTSQGSLKT

SEQ ID NO: 3204552 - protein, 9 aa, Giardia lamblia
GAGKSTQAD

SEQ ID NO: 3204553 - protein, 7 aa, Giardia lamblia
GAKGSTV

SEQ ID NO: 3204554 - protein, 5 aa, Giardia lamblia
GANWK

SEQ ID NO: 3204555 - protein, 18 aa, Giardia lamblia
GAPAQASSQPQGKAPGFS

SEQ ID NO: 3204556 - protein, 5 aa, Giardia lamblia
GAPLT

SEQ ID NO: 3204557 - protein, 6 aa, Giardia lamblia
GAPSGV

SEQ ID NO: 3204558 - protein, 6 aa, Giardia lamblia
GAQSCM

SEQ ID NO: 3204559 - protein, 14 aa, Giardia lamblia
GAQSCVAPSSMSAG

SEQ ID NO: 3204560 - protein, 15 aa, Giardia lamblia
GARDLESLKAFVTSK

SEQ ID NO: 3204561 - protein, 10 aa, Giardia lamblia
GARSPYTAFP

SEQ ID NO: 3204562 - protein, 5 aa, Giardia lamblia
GARTT

SEQ ID NO: 3204563 - protein, 7 aa, Giardia lamblia
GASGNLN

SEQ ID NO: 3204564 - protein, 10 aa, Giardia lamblia
GASVPSKYRN

SEQ ID NO: 3204565 - protein, 8 aa, Giardia lamblia
GATIGGSE

SEQ ID NO: 3204566 - protein, 12 aa, Giardia lamblia
GCDEDASLPAPR

SEQ ID NO: 3204567 - protein, 12 aa, Giardia lamblia
GDAPLKPFGGTE

SEQ ID NO: 3204568 - protein, 4 aa, Giardia lamblia
GDDN

SEQ ID NO: 3204569 - protein, 6 aa, Giardia lamblia
GDEADF

SEQ ID NO: 3204570 - protein, 4 aa, Giardia lamblia
GDLQ

SEQ ID NO: 3204571 - protein, 6 aa, Giardia lamblia
GDRDPA

SEQ ID NO: 3204572 - protein, 5 aa, Giardia lamblia
GDREA

SEQ ID NO: 3204573 - protein, 5 aa, Giardia lamblia
GDSQQ

SEQ ID NO: 3204574 - protein, 7 aa, Giardia lamblia
GDTAAQK

SEQ ID NO: 3204575 - protein, 6 aa, Giardia lamblia
GDVSDV

SEQ ID NO: 3204576 - protein, 5 aa, Giardia lamblia
GEDPV

SEQ ID NO: 3204577 - protein, 4 aa, Giardia lamblia
GEEP

SEQ ID NO: 3204578 - protein, 18 aa, Giardia lamblia
GEGEINSAPGGTKSNPDI

SEQ ID NO: 3204579 - protein, 7 aa, Giardia lamblia
GEGGEAD

SEQ ID NO: 3204580 - protein, 5 aa, Giardia lamblia
GENTR

SEQ ID NO: 3204581 - protein, 4 aa, Giardia lamblia
GERS

SEQ ID NO: 3204582 - protein, 5 aa, Giardia lamblia
GESEF

SEQ ID NO: 3204583 - protein, 8 aa, Giardia lamblia
GEVETNKH

SEQ ID NO: 3204584 - protein, 13 aa, Giardia lamblia
GFDDTEDKSYQAK

SEQ ID NO: 3204585 - protein, 23 aa, Giardia lamblia
GFGPAQSTQLTQQPQQSQPAPSF

SEQ ID NO: 3204586 - protein, 6 aa, Giardia lamblia
GFPGDQ

SEQ ID NO: 3204587 - protein, 7 aa, Giardia lamblia
GFSTNEE

SEQ ID NO: 3204588 - protein, 11 aa, Giardia lamblia
GFTDDDNPTGH

SEQ ID NO: 3204589 - protein, 6 aa, Giardia lamblia
GGDFQP

SEQ ID NO: 3204590 - protein, 6 aa, Giardia lamblia
GGDGNQ

SEQ ID NO: 3204591 - protein, 6 aa, Giardia lamblia
GGGHAV

SEQ ID NO: 3204592 - protein, 8 aa, Giardia lamblia
GGGSGLGE

SEQ ID NO: 3204593 - protein, 8 aa, Giardia lamblia
GGIQTSKG

SEQ ID NO: 3204594 - protein, 6 aa, Giardia lamblia
GGKEPA

SEQ ID NO: 3204595 - protein, 7 aa, Giardia lamblia
GGKEPAE

SEQ ID NO: 3204596 - protein, 9 aa, Giardia lamblia
GGLQDSSGW

SEQ ID NO: 3204597 - protein, 8 aa, Giardia lamblia
GGMTTPKT

SEQ ID NO: 3204598 - protein, 11 aa, Giardia lamblia
GGQQPKGQSTV

SEQ ID NO: 3204599 - protein, 7 aa, Giardia lamblia
GGREPED

SEQ ID NO: 3204600 - protein, 15 aa, Giardia lamblia
GGSKLDAVNKKNDKV

SEQ ID NO: 3204601 - protein, 4 aa, Giardia lamblia
GGTH

SEQ ID NO: 3204602 - protein, 5 aa, Giardia lamblia
GGVNA

SEQ ID NO: 3204603 - protein, 11 aa, Giardia lamblia
GHGSCREGTCN

SEQ ID NO: 3204604 - protein, 9 aa, Giardia lamblia
GHQDANGRS

SEQ ID NO: 3204605 - protein, 12 aa, Giardia lamblia
GHSSQADRNRTR

SEQ ID NO: 3204606 - protein, 11 aa, Giardia lamblia
GHSTIGQAAEQ

SEQ ID NO: 3204607 - protein, 4 aa, Giardia lamblia
GIAE

SEQ ID NO: 3204608 - protein, 5 aa, Giardia lamblia
GIPER

SEQ ID NO: 3204609 - protein, 7 aa, Giardia lamblia
GIQASSS

SEQ ID NO: 3204610 - protein, 9 aa, Giardia lamblia
GIQDKAGHT

SEQ ID NO: 3204611 - protein, 9 aa, Giardia lamblia
GISTKTYQT

SEQ ID NO: 3204612 - protein, 19 aa, Giardia lamblia
GITEPTKEQIEKAPSKDAT

SEQ ID NO: 3204613 - protein, 6 aa, Giardia lamblia
GKEPAE

SEQ ID NO: 3204614 - protein, 14 aa, Giardia lamblia
GKEPAEVFVTGGGR

SEQ ID NO: 3204615 - protein, 5 aa, Giardia lamblia
GKMSE

SEQ ID NO: 3204616 - protein, 14 aa, Giardia lamblia
GKNAYDKKGRPKEW

SEQ ID NO: 3204617 - protein, 9 aa, Giardia lamblia
GKPSEPVTV

SEQ ID NO: 3204618 - protein, 45 aa, Giardia lamblia; identical to SEQ ID NO: 3112029

SEQ ID NO: 3204619 - protein, 8 aa, Giardia lamblia
GKTQNQKI

SEQ ID NO: 3204620 - protein, 19 aa, Giardia lamblia
GKVRKTNSNNEDLSSDGDW

SEQ ID NO: 3204621 - protein, 7 aa, Giardia lamblia
GKYDVGS

SEQ ID NO: 3204622 - protein, 11 aa, Giardia lamblia
GLKRAKPTHYR

SEQ ID NO: 3204623 - protein, 6 aa, Giardia lamblia
GLPPTT

SEQ ID NO: 3204624 - protein, 8 aa, Giardia lamblia
GLQQTRDP

SEQ ID NO: 3204625 - protein, 19 aa, Giardia lamblia
GLSDDASYSERSSTVADSP

SEQ ID NO: 3204626 - protein, 10 aa, Giardia lamblia
GLSGYGPTLQ

SEQ ID NO: 3204627 - protein, 8 aa, Giardia lamblia
GLSNNDGL

SEQ ID NO: 3204628 - protein, 8 aa, Giardia lamblia
GLSSEHGW

SEQ ID NO: 3204629 - protein, 6 aa, Giardia lamblia
GLSSQV

SEQ ID NO: 3204630 - protein, 5 aa, Giardia lamblia
GLTGD

SEQ ID NO: 3204631 - protein, 10 aa, Giardia lamblia
GMQDNDGETA

SEQ ID NO: 3204632 - protein, 8 aa, Giardia lamblia
GMRSSNEH

SEQ ID NO: 3204633 - protein, 4 aa, Giardia lamblia
GMTS

SEQ ID NO: 3204634 - protein, 63 aa, Giardia lamblia
GNDGGDARLRSARAREAGRRCPAAGGDGREPRAAAAAPPPARAPDGHRLEEDRPRPVRGPEQD

SEQ ID NO: 3204635 - protein, 8 aa, Giardia lamblia
GNGTCDSC

SEQ ID NO: 3204636 - protein, 9 aa, Giardia lamblia
GNHKSKLRE

SEQ ID NO: 3204637 - protein, 5 aa, Giardia lamblia
GNKNP

SEQ ID NO: 3204638 - protein, 6 aa, Giardia lamblia
GNNVPD

SEQ ID NO: 3204639 - protein, 7 aa, Giardia lamblia
GNPGTGK

SEQ ID NO: 3204640 - protein, 6 aa, Giardia lamblia
GNPTIK

SEQ ID NO: 3204641 - protein, 7 aa, Giardia lamblia
GNSEDTY

SEQ ID NO: 3204642 - protein, 9 aa, Giardia lamblia
GNTHLGGED

SEQ ID NO: 3204643 - protein, 4 aa, Giardia lamblia
GNVK

SEQ ID NO: 3204644 - protein, 7 aa, Giardia lamblia
GNVPDTS

SEQ ID NO: 3204645 - protein, 6 aa, Giardia lamblia
GNVPTP

SEQ ID NO: 3204646 - protein, 4 aa, Giardia lamblia
GNYD

SEQ ID NO: 3204647 - protein, 7 aa, Giardia lamblia
GPAGPID

SEQ ID NO: 3204648 - protein, 17 aa, Giardia lamblia
GPDLGDGRRVGDHEAGA

SEQ ID NO: 3204649 - protein, 7 aa, Giardia lamblia
GPESPWA

SEQ ID NO: 3204650 - protein, 8 aa, Giardia lamblia
GPESPWDD

SEQ ID NO: 3204651 - protein, 7 aa, Giardia lamblia
GPGKEPI

SEQ ID NO: 3204652 - protein, 5 aa, Giardia lamblia
GPGRR

SEQ ID NO: 3204653 - protein, 12 aa, Giardia lamblia
GPHSSESPEMTQ

SEQ ID NO: 3204654 - protein, 7 aa, Giardia lamblia
GPIAQTH

SEQ ID NO: 3204655 - protein, 9 aa, Giardia lamblia
GPLSADAEN

SEQ ID NO: 3204656 - protein, 4 aa, Giardia lamblia
GPMK

SEQ ID NO: 3204657 - protein, 4 aa, Giardia lamblia
GPTQ

SEQ ID NO: 3204658 - protein, 7 aa, Giardia lamblia
GPTRGRD

SEQ ID NO: 3204659 - protein, 11 aa, Giardia lamblia
GPTTDDQEPWD

SEQ ID NO: 3204660 - protein, 7 aa, Giardia lamblia
GPTYPGA

SEQ ID NO: 3204661 - protein, 4 aa, Giardia lamblia
GPVQ

SEQ ID NO: 3204662 - protein, 6 aa, Giardia lamblia
GQAGAD

SEQ ID NO: 3204663 - protein, 7 aa, Giardia lamblia
GQGSYHD

SEQ ID NO: 3204664 - protein, 18 aa, Giardia lamblia
GQINQQNKRADETRRDPL

SEQ ID NO: 3204665 - protein, 18 aa, Giardia lamblia
GQKSYTSPGTPSSSALQT

SEQ ID NO: 3204666 - protein, 6 aa, Giardia lamblia
GQLRTR

SEQ ID NO: 3204667 - protein, 6 aa, Giardia lamblia
GQPATT

SEQ ID NO: 3204668 - protein, 6 aa, Giardia lamblia
GQPSTH

SEQ ID NO: 3204669 - protein, 7 aa, Giardia lamblia
GQSSGYD

SEQ ID NO: 3204670 - protein, 6 aa, Giardia lamblia
GQTAFP

SEQ ID NO: 3204671 - protein, 16 aa, Giardia lamblia
GQYPSQGTGSFDLLTQ

SEQ ID NO: 3204672 - protein, 6 aa, Giardia lamblia
GRAERM

SEQ ID NO: 3204673 - protein, 41 aa, Giardia lamblia
GREPSPLREGDDQMDPEGGTIFPSEDEYNELPDGPDNADLT

SEQ ID NO: 3204674 - protein, 8 aa, Giardia lamblia
GREPSPLW

SEQ ID NO: 3204675 - protein, 4 aa, Giardia lamblia
GRGY

SEQ ID NO: 3204676 - protein, 16 aa, Giardia lamblia
GRKGSVIKQCTKCSSP

SEQ ID NO: 3204677 - protein, 7 aa, Giardia lamblia
GRRDQSK

SEQ ID NO: 3204678 - protein, 11 aa, Giardia lamblia
GRSARGTARAR

SEQ ID NO: 3204679 - protein, 4 aa, Giardia lamblia
GRSD

SEQ ID NO: 3204680 - protein, 31 aa, Giardia lamblia
GSAECSNSYCASSSGFSYGGHRGEGWTPQDT

SEQ ID NO: 3204681 - protein, 6 aa, Giardia lamblia
GSATLG

SEQ ID NO: 3204682 - protein, 8 aa, Giardia lamblia
GSCDSKQG

SEQ ID NO: 3204683 - protein, 6 aa, Giardia lamblia
GSCKTE

SEQ ID NO: 3204684 - protein, 17 aa, Giardia lamblia
GSCTKKAQGNRCGTTGY

SEQ ID NO: 3204685 - protein, 7 aa, Giardia lamblia
GSDWGEN

SEQ ID NO: 3204686 - protein, 9 aa, Giardia lamblia
GSGSFGEEF

SEQ ID NO: 3204687 - protein, 6 aa, Giardia lamblia
GSGTYT

SEQ ID NO: 3204688 - protein, 4 aa, Giardia lamblia
GSHG

SEQ ID NO: 3204689 - protein, 4 aa, Giardia lamblia
GSLS

SEQ ID NO: 3204690 - protein, 5 aa, Giardia lamblia
GSLSK

SEQ ID NO: 3204691 - protein, 20 aa, Giardia lamblia
GSNKLSSFEQSSLQSRSKEQ

SEQ ID NO: 3204692 - protein, 19 aa, Giardia lamblia
GSSEPRPFAPPKKLTEEEL

SEQ ID NO: 3204693 - protein, 7 aa, Giardia lamblia
GSSFSQN

SEQ ID NO: 3204694 - protein, 5 aa, Giardia lamblia
GSSQD

SEQ ID NO: 3204695 - protein, 5 aa, Giardia lamblia
GSSSF

SEQ ID NO: 3204696 - protein, 6 aa, Giardia lamblia
GSTHVS

SEQ ID NO: 3204697 - protein, 9 aa, Giardia lamblia
GSTRRTDNY

SEQ ID NO: 3204698 - protein, 6 aa, Giardia lamblia
GSYSGN

SEQ ID NO: 3204699 - protein, 8 aa, Giardia lamblia
GTAAPKLA

SEQ ID NO: 3204700 - protein, 7 aa, Giardia lamblia
GTANKHS

SEQ ID NO: 3204701 - protein, 17 aa, Giardia lamblia
GTAVRPSGDQQAKSGQW

SEQ ID NO: 3204702 - protein, 5 aa, Giardia lamblia
GTCTD

SEQ ID NO: 3204703 - protein, 6 aa, Giardia lamblia
GTDDDG

SEQ ID NO: 3204704 - protein, 5 aa, Giardia lamblia
GTDEY

SEQ ID NO: 3204705 - protein, 11 aa, Giardia lamblia
GTDTPASERYP

SEQ ID NO: 3204706 - protein, 7 aa, Giardia lamblia
GTENSNV

SEQ ID NO: 3204707 - protein, 6 aa, Giardia lamblia
GTEPTL

SEQ ID NO: 3204708 - protein, 20 aa, Giardia lamblia
GTESTKYENVSGSLSSNQPY

SEQ ID NO: 3204709 - protein, 10 aa, Giardia lamblia
GTGADSDADY

SEQ ID NO: 3204710 - protein, 5 aa, Giardia lamblia
GTIEG

SEQ ID NO: 3204711 - protein, 4 aa, Giardia lamblia
GTIP

SEQ ID NO: 3204712 - protein, 7 aa, Giardia lamblia
GTLDENN

SEQ ID NO: 3204713 - protein, 14 aa, Giardia lamblia
GTSNVQPSDVPGQQ

SEQ ID NO: 3204714 - protein, 11 aa, Giardia lamblia
GTSSVERENER

SEQ ID NO: 3204715 - protein, 8 aa, Giardia lamblia
GTTDDEER

SEQ ID NO: 3204716 - protein, 8 aa, Giardia lamblia
GTTDDGTD

SEQ ID NO: 3204717 - protein, 4 aa, Giardia lamblia
GTTT

SEQ ID NO: 3204718 - protein, 6 aa, Giardia lamblia
GTVRRS

SEQ ID NO: 3204719 - protein, 7 aa, Giardia lamblia
GTYTTSN

SEQ ID NO: 3204720 - protein, 7 aa, Giardia lamblia
GVGELGD

SEQ ID NO: 3204721 - protein, 7 aa, Giardia lamblia
GVGESRD

SEQ ID NO: 3204722 - protein, 5 aa, Giardia lamblia
GVGQV

SEQ ID NO: 3204723 - protein, 10 aa, Giardia lamblia
GVPPNSNLPP

SEQ ID NO: 3204724 - protein, 6 aa, Giardia lamblia
GVRAPS

SEQ ID NO: 3204725 - protein, 17 aa, Giardia lamblia
GVSAESSEYTDVEQALC

SEQ ID NO: 3204726 - protein, 13 aa, Giardia lamblia
GVSPGDDPGPKHS

SEQ ID NO: 3204727 - protein, 11 aa, Giardia lamblia
GVSPSAPGEQV

SEQ ID NO: 3204728 - protein, 6 aa, Giardia lamblia
GVSPSN

SEQ ID NO: 3204729 - protein, 7 aa, Giardia lamblia
GVSSENV

SEQ ID NO: 3204730 - protein, 5 aa, Giardia lamblia
GYETV

SEQ ID NO: 3204731 - protein, 8 aa, Giardia lamblia
GYGQVSKS

SEQ ID NO: 3204732 - protein, 38 aa, Giardia lamblia
GYPADDLPAPSDKKDPVPDPEPQPDPDPEPEPEPEPIG

SEQ ID NO: 3204733 - protein, 48 aa, Giardia lamblia
GYQLNGDGSACTDVSGEAKCKAGQQKCKTCKSDNSGCATCDDGYGLKS

SEQ ID NO: 3204734 - protein, 6 aa, Giardia lamblia
GYQPNK

SEQ ID NO: 3204735 - protein, 8 aa, Giardia lamblia
GYSLGNQG

SEQ ID NO: 3204736 - protein, 8 aa, Giardia lamblia
HAEDKEKR

SEQ ID NO: 3204737 - protein, 10 aa, Giardia lamblia
HAETDPSLND

SEQ ID NO: 3204738 - protein, 10 aa, Giardia lamblia
HANREDHDQA

SEQ ID NO: 3204739 - protein, 32 aa, Giardia lamblia
HAPTDGSSMPRNAKPPAPGALPRKSKASTDGG

SEQ ID NO: 3204740 - protein, 10 aa, Giardia lamblia
HAQSDYVPKG

SEQ ID NO: 3204741 - protein, 6 aa, Giardia lamblia
HASVDD

SEQ ID NO: 3204742 - protein, 18 aa, Giardia lamblia
HATDMNDRARADREQSID

SEQ ID NO: 3204743 - protein, 7 aa, Giardia lamblia
HDKRGKT

SEQ ID NO: 3204744 - protein, 4 aa, Giardia lamblia
HDPT

SEQ ID NO: 3204745 - protein, 5 aa, Giardia lamblia
HDRPP

SEQ ID NO: 3204746 - protein, 6 aa, Giardia lamblia
HEKEEV

SEQ ID NO: 3204747 - protein, 8 aa, Giardia lamblia
HGDAESTK

SEQ ID NO: 3204748 - protein, 4 aa, Giardia lamblia
HGDS

SEQ ID NO: 3204749 - protein, 5 aa, Giardia lamblia
HGKCN

SEQ ID NO: 3204750 - protein, 7 aa, Giardia lamblia
HGKKTTI

SEQ ID NO: 3204751 - protein, 9 aa, Giardia lamblia
HGKQPTDKW

SEQ ID NO: 3204752 - protein, 22 aa, Giardia lamblia
HGQPTRPSAECPRAEPSGPIPD

SEQ ID NO: 3204753 - protein, 4 aa, Giardia lamblia
HGTC

SEQ ID NO: 3204754 - protein, 5 aa, Giardia lamblia
HGTCD

SEQ ID NO: 3204755 - protein, 6 aa, Giardia lamblia
HGTGGS

SEQ ID NO: 3204756 - protein, 10 aa, Giardia lamblia
HGTPPPSTRE

SEQ ID NO: 3204757 - protein, 4 aa, Giardia lamblia
HKDA

SEQ ID NO: 3204758 - protein, 13 aa, Giardia lamblia
HKLDRGTSTTKQL

SEQ ID NO: 3204759 - protein, 4 aa, Giardia lamblia
HKRN

SEQ ID NO: 3204760 - protein, 7 aa, Giardia lamblia
HNEDSQL

SEQ ID NO: 3204761 - protein, 36 aa, Giardia lamblia; identical to SEQ ID NO: 3114509

SEQ ID NO: 3204762 - protein, 10 aa, Giardia lamblia
HPKFTREGNN

SEQ ID NO: 3204763 - protein, 17 aa, Giardia lamblia
HPPAGGRPRSGGPEGAC

SEQ ID NO: 3204764 - protein, 23 aa, Giardia lamblia
HPPKQKTPERSMSSNDLATSIGR

SEQ ID NO: 3204765 - protein, 12 aa, Giardia lamblia
HPPVGAPSQQVS

SEQ ID NO: 3204766 - protein, 5 aa, Giardia lamblia
HPQAA

SEQ ID NO: 3204767 - protein, 11 aa, Giardia lamblia
HPRSYNPDTNI

SEQ ID NO: 3204768 - protein, 8 aa, Giardia lamblia
HPSQTSDH

SEQ ID NO: 3204769 - protein, 8 aa, Giardia lamblia
HPVSEGSV

SEQ ID NO: 3204770 - protein, 4 aa, Giardia lamblia
HQAP

SEQ ID NO: 3204771 - protein, 4 aa, Giardia lamblia
HQPV

SEQ ID NO: 3204772 - protein, 19 aa, Giardia lamblia
HQQRKPTRPPTTATTATAM

SEQ ID NO: 3204773 - protein, 10 aa, Giardia lamblia
HQRRGGHVTD

SEQ ID NO: 3204774 - protein, 6 aa, Giardia lamblia
HRVEQK

SEQ ID NO: 3204775 - protein, 16 aa, Giardia lamblia
HSISESKSVDIRKPSL

SEQ ID NO: 3204776 - protein, 4 aa, Giardia lamblia
HSQY

SEQ ID NO: 3204777 - protein, 11 aa, Giardia lamblia
HSSISSKQKMS

SEQ ID NO: 3204778 - protein, 8 aa, Giardia lamblia
HSSSNEEI

SEQ ID NO: 3204779 - protein, 10 aa, Giardia lamblia
HSTKSASSCS

SEQ ID NO: 3204780 - protein, 15 aa, Giardia lamblia
HSTSPISTKRSSKVL

SEQ ID NO: 3204781 - protein, 9 aa, Giardia lamblia
HTHRPARDT

SEQ ID NO: 3204782 - protein, 11 aa, Giardia lamblia
HTKASTSSRKR

SEQ ID NO: 3204783 - protein, 10 aa, Giardia lamblia
HTKENNDNFS

SEQ ID NO: 3204784 - protein, 10 aa, Giardia lamblia
HTSEKYDVGT

SEQ ID NO: 3204785 - protein, 7 aa, Giardia lamblia
HVPRDSH

SEQ ID NO: 3204786 - protein, 12 aa, Giardia lamblia
HVPSSVTDGIDE

SEQ ID NO: 3204787 - protein, 12 aa, Giardia lamblia
IAESGTSRFRQT

SEQ ID NO: 3204788 - protein, 9 aa, Giardia lamblia
IASGRTRKC

SEQ ID NO: 3204789 - protein, 5 aa, Giardia lamblia
IATEY

SEQ ID NO: 3204790 - protein, 4 aa, Giardia lamblia
ICEP

SEQ ID NO: 3204791 - protein, 8 aa, Giardia lamblia
IDTEGTEI

SEQ ID NO: 3204792 - protein, 12 aa, Giardia lamblia
IEAGKRQLSTAS

SEQ ID NO: 3204793 - protein, 8 aa, Giardia lamblia
IEGDSNVE

SEQ ID NO: 3204794 - protein, 11 aa, Giardia lamblia
IEPGKQTKRGL

SEQ ID NO: 3204795 - protein, 10 aa, Giardia lamblia
IEPTRKAENV

SEQ ID NO: 3204796 - protein, 5 aa, Giardia lamblia
IETGS

SEQ ID NO: 3204797 - protein, 5 aa, Giardia lamblia
IGDEA

SEQ ID NO: 3204798 - protein, 6 aa, Giardia lamblia
IGETSP

SEQ ID NO: 3204799 - protein, 7 aa, Giardia lamblia
IHRSSSD

SEQ ID NO: 3204800 - protein, 5 aa, Giardia lamblia
IIESS

SEQ ID NO: 3204801 - protein, 7 aa, Giardia lamblia
IIPPDDT

SEQ ID NO: 3204802 - protein, 10 aa, Giardia lamblia
IKAEGAVPLR

SEQ ID NO: 3204803 - protein, 9 aa, Giardia lamblia
IKKHSHGKK

SEQ ID NO: 3204804 - protein, 5 aa, Giardia lamblia
IKMEG

SEQ ID NO: 3204805 - protein, 10 aa, Giardia lamblia
IKPSARSEEV

SEQ ID NO: 3204806 - protein, 9 aa, Giardia lamblia
IKPSTAPRL

SEQ ID NO: 3204807 - protein, 5 aa, Giardia lamblia
ILSNP

SEQ ID NO: 3204808 - protein, 6 aa, Giardia lamblia
INQSSV

SEQ ID NO: 3204809 - protein, 8 aa, Giardia lamblia
INSYQRAQ

SEQ ID NO: 3204810 - protein, 7 aa, Giardia lamblia
IPANSNL

SEQ ID NO: 3204811 - protein, 5 aa, Giardia lamblia
IPDQT

SEQ ID NO: 3204812 - protein, 5 aa, Giardia lamblia
IPKDF

SEQ ID NO: 3204813 - protein, 8 aa, Giardia lamblia
IPLPTTTP

SEQ ID NO: 3204814 - protein, 10 aa, Giardia lamblia
IPPAPRGTPQ

SEQ ID NO: 3204815 - protein, 7 aa, Giardia lamblia
IPPDTDN

SEQ ID NO: 3204816 - protein, 9 aa, Giardia lamblia
IPPSDRAAG

SEQ ID NO: 3204817 - protein, 19 aa, Giardia lamblia
IPPTSTEDECQHPPNDDDD

SEQ ID NO: 3204818 - protein, 14 aa, Giardia lamblia
IPRRPKQASPVRPE

SEQ ID NO: 3204819 - protein, 5 aa, Giardia lamblia
IPTEN

SEQ ID NO: 3204820 - protein, 8 aa, Giardia lamblia
IRDNMDET

SEQ ID NO: 3204821 - protein, 16 aa, Giardia lamblia
IRRADSDQKPTVQDAV

SEQ ID NO: 3204822 - protein, 10 aa, Giardia lamblia
IRSGDEKATI

SEQ ID NO: 3204823 - protein, 6 aa, Giardia lamblia
IRSSKE

SEQ ID NO: 3204824 - protein, 6 aa, Giardia lamblia
ISGPNE

SEQ ID NO: 3204825 - protein, 6 aa, Giardia lamblia
ISPKGL

SEQ ID NO: 3204826 - protein, 12 aa, Giardia lamblia
ISSPPPKAVYTD

SEQ ID NO: 3204827 - protein, 11 aa, Giardia lamblia
ISSTSRARREL

SEQ ID NO: 3204828 - protein, 9 aa, Giardia lamblia
ITKTSSPEH

SEQ ID NO: 3204829 - protein, 15 aa, Giardia lamblia
KAAGRDVTEVPPDPT

SEQ ID NO: 3204830 - protein, 8 aa, Giardia lamblia
KADQPVFS

SEQ ID NO: 3204831 - protein, 6 aa, Giardia lamblia
KAESSA

SEQ ID NO: 3204832 - protein, 5 aa, Giardia lamblia
KAGPI

SEQ ID NO: 3204833 - protein, 6 aa, Giardia lamblia
KAGVSA

SEQ ID NO: 3204834 - protein, 13 aa, Giardia lamblia
KAKDKEAGATNFS

SEQ ID NO: 3204835 - protein, 9 aa, Giardia lamblia
KAKYTPAST

SEQ ID NO: 3204836 - protein, 13 aa, Giardia lamblia
KALAEAAGTTGTA

SEQ ID NO: 3204837 - protein, 6 aa, Giardia lamblia
KAMNSE

SEQ ID NO: 3204838 - protein, 7 aa, Giardia lamblia
KAREKDE

SEQ ID NO: 3204839 - protein, 6 aa, Giardia lamblia
KARGNA

SEQ ID NO: 3204840 - protein, 6 aa, Giardia lamblia
KASATA

SEQ ID NO: 3204841 - protein, 13 aa, Giardia lamblia
KATKNYAARANQT

SEQ ID NO: 3204842 - protein, 9 aa, Giardia lamblia
KATSTKRSQ

SEQ ID NO: 3204843 - protein, 6 aa, Giardia lamblia
KCNSSS

SEQ ID NO: 3204844 - protein, 8 aa, Giardia lamblia
KDDEANAQ

SEQ ID NO: 3204845 - protein, 8 aa, Giardia lamblia
KDDGRAEL

SEQ ID NO: 3204846 - protein, 5 aa, Giardia lamblia
KDGRP

SEQ ID NO: 3204847 - protein, 4 aa, Giardia lamblia
KDGT

SEQ ID NO: 3204848 - protein, 11 aa, Giardia lamblia
KDHGCNGGEPV

SEQ ID NO: 3204849 - protein, 5 aa, Giardia lamblia
KDKET

SEQ ID NO: 3204850 - protein, 7 aa, Giardia lamblia
KDLTENI

SEQ ID NO: 3204851 - protein, 12 aa, Giardia lamblia
KDPAGSDSQKVR

SEQ ID NO: 3204852 - protein, 8 aa, Giardia lamblia
KDPPDRAA

SEQ ID NO: 3204853 - protein, 12 aa, Giardia lamblia
KDPPKLPANKTF

SEQ ID NO: 3204854 - protein, 8 aa, Giardia lamblia
KDPSKRMT

SEQ ID NO: 3204855 - protein, 5 aa, Giardia lamblia
KDPSV

SEQ ID NO: 3204856 - protein, 4 aa, Giardia lamblia
KDQM

SEQ ID NO: 3204857 - protein, 4 aa, Giardia lamblia
KDVR

SEQ ID NO: 3204858 - protein, 7 aa, Giardia lamblia
KDVSNPD

SEQ ID NO: 3204859 - protein, 7 aa, Giardia lamblia
KEAVKEA

SEQ ID NO: 3204860 - protein, 22 aa, Giardia lamblia
KEDSNPSENCRVSGGAAPNITY

SEQ ID NO: 3204861 - protein, 4 aa, Giardia lamblia
KEED

SEQ ID NO: 3204862 - protein, 19 aa, Giardia lamblia
KEERKEARRKEWAEKSKEI

SEQ ID NO: 3204863 - protein, 6 aa, Giardia lamblia
KEGGHT

SEQ ID NO: 3204864 - protein, 4 aa, Giardia lamblia
KEIP

SEQ ID NO: 3204865 - protein, 4 aa, Giardia lamblia
KENK

SEQ ID NO: 3204866 - protein, 5 aa, Giardia lamblia
KEPPL

SEQ ID NO: 3204867 - protein, 8 aa, Giardia lamblia
KEQADQAN

SEQ ID NO: 3204868 - protein, 7 aa, Giardia lamblia
KEQKEAR

SEQ ID NO: 3204869 - protein, 6 aa, Giardia lamblia
KESGHT

SEQ ID NO: 3204870 - protein, 5 aa, Giardia lamblia
KESNR

SEQ ID NO: 3204871 - protein, 6 aa, Giardia lamblia
KEVGAR

SEQ ID NO: 3204872 - protein, 4 aa, Giardia lamblia
KFGD

SEQ ID NO: 3204873 - protein, 4 aa, Giardia lamblia
KGAY

SEQ ID NO: 3204874 - protein, 5 aa, Giardia lamblia
KGCEG

SEQ ID NO: 3204875 - protein, 6 aa, Giardia lamblia
KGDLTK

SEQ ID NO: 3204876 - protein, 11 aa, Giardia lamblia
KGDQSRDASIE

SEQ ID NO: 3204877 - protein, 10 aa, Giardia lamblia
KGGSEIEEKE

SEQ ID NO: 3204878 - protein, 4 aa, Giardia lamblia
KGIT

SEQ ID NO: 3204879 - protein, 10 aa, Giardia lamblia
KGSHGYSYEG

SEQ ID NO: 3204880 - protein, 5 aa, Giardia lamblia
KGSVG

SEQ ID NO: 3204881 - protein, 6 aa, Giardia lamblia
KGTEAA

SEQ ID NO: 3204882 - protein, 7 aa, Giardia lamblia
KHAETDL

SEQ ID NO: 3204883 - protein, 15 aa, Giardia lamblia
KHNERPSSALKNPTR

SEQ ID NO: 3204884 - protein, 9 aa, Giardia lamblia
KHPPSKMDE

SEQ ID NO: 3204885 - protein, 7 aa, Giardia lamblia
KHQNEAG

SEQ ID NO: 3204886 - protein, 6 aa, Giardia lamblia
KHSGPM

SEQ ID NO: 3204887 - protein, 13 aa, Giardia lamblia
KIAGGARKTSRYG

SEQ ID NO: 3204888 - protein, 5 aa, Giardia lamblia
KIGPS

SEQ ID NO: 3204889 - protein, 4 aa, Giardia lamblia
KITT

SEQ ID NO: 3204890 - protein, 5 aa, Giardia lamblia
KKASD

SEQ ID NO: 3204891 - protein, 7 aa, Giardia lamblia
KKECKHH

SEQ ID NO: 3204892 - protein, 13 aa, Giardia lamblia
KKNPAKYTARAAN

SEQ ID NO: 3204893 - protein, 9 aa, Giardia lamblia
KKNQAPQMS

SEQ ID NO: 3204894 - protein, 10 aa, Giardia lamblia
KKPRASGKSL

SEQ ID NO: 3204895 - protein, 7 aa, Giardia lamblia
KKPRGIE

SEQ ID NO: 3204896 - protein, 8 aa, Giardia lamblia
KKPVKYSP

SEQ ID NO: 3204897 - protein, 5 aa, Giardia lamblia
KKPVR

SEQ ID NO: 3204898 - protein, 11 aa, Giardia lamblia
KKTQETSGKAK

SEQ ID NO: 3204899 - protein, 4 aa, Giardia lamblia
KKYN

SEQ ID NO: 3204900 - protein, 6 aa, Giardia lamblia
KKYPGW

SEQ ID NO: 3204901 - protein, 34 aa, Giardia lamblia
KLASSRPDFSQSSITTTEKSSPAALQSATPGRTY

SEQ ID NO: 3204902 - protein, 6 aa, Giardia lamblia
KLDKKK

SEQ ID NO: 3204903 - protein, 7 aa, Giardia lamblia
KLKQAGT

SEQ ID NO: 3204904 - protein, 13 aa, Giardia lamblia
KLKSKKTKNDKKE

SEQ ID NO: 3204905 - protein, 6 aa, Giardia lamblia
KLSTNE

SEQ ID NO: 3204906 - protein, 4 aa, Giardia lamblia
KMPA

SEQ ID NO: 3204907 - protein, 12 aa, Giardia lamblia
KMSPESKPETEI

SEQ ID NO: 3204908 - protein, 8 aa, Giardia lamblia
KNEDLPQE

SEQ ID NO: 3204909 - protein, 6 aa, Giardia lamblia
KNEEGA

SEQ ID NO: 3204910 - protein, 20 aa, Giardia lamblia
KNIPELSSDKDQEDKEAPID

SEQ ID NO: 3204911 - protein, 7 aa, Giardia lamblia
KPDPALS

SEQ ID NO: 3204912 - protein, 12 aa, Giardia lamblia
KPEYAKAGAELD

SEQ ID NO: 3204913 - protein, 8 aa, Giardia lamblia
KPGISKDE

SEQ ID NO: 3204914 - protein, 6 aa, Giardia lamblia
KPGPEY

SEQ ID NO: 3204915 - protein, 8 aa, Giardia lamblia
KPKVDTTR

SEQ ID NO: 3204916 - protein, 5 aa, Giardia lamblia
KPPEQ

SEQ ID NO: 3204917 - protein, 17 aa, Giardia lamblia
KPPSLSRGTHDAAEQPV

SEQ ID NO: 3204918 - protein, 34 aa, Giardia lamblia
KPQVSGAGGIGQTTSSVAPTTTAPTTASAPAPFS

SEQ ID NO: 3204919 - protein, 11 aa, Giardia lamblia
KPSAPVQRKTS

SEQ ID NO: 3204920 - protein, 7 aa, Giardia lamblia
KPSMTTP

SEQ ID NO: 3204921 - protein, 5 aa, Giardia lamblia
KPTDS

SEQ ID NO: 3204922 - protein, 12 aa, Giardia lamblia
KQAKDSEKEYDN

SEQ ID NO: 3204923 - protein, 24 aa, Giardia lamblia
KQFEGGASLERSAQGGAMGEGLAS

SEQ ID NO: 3204924 - protein, 9 aa, Giardia lamblia
KQKNAKGQT

SEQ ID NO: 3204925 - protein, 8 aa, Giardia lamblia
KQQASYAW

SEQ ID NO: 3204926 - protein, 16 aa, Giardia lamblia
KQTLSDGARFLLGALM

SEQ ID NO: 3204927 - protein, 11 aa, Giardia lamblia
KQTSAAPPASV

SEQ ID NO: 3204928 - protein, 11 aa, Giardia lamblia
KQTSPDQPSVP

SEQ ID NO: 3204929 - protein, 7 aa, Giardia lamblia
KQTTTEN

SEQ ID NO: 3204930 - protein, 6 aa, Giardia lamblia
KQYAES

SEQ ID NO: 3204931 - protein, 7 aa, Giardia lamblia
KRAGGQP

SEQ ID NO: 3204932 - protein, 6 aa, Giardia lamblia
KRGPDG

SEQ ID NO: 3204933 - protein, 8 aa, Giardia lamblia
KRNGVEGG

SEQ ID NO: 3204934 - protein, 6 aa, Giardia lamblia
KRQRDE

SEQ ID NO: 3204935 - protein, 8 aa, Giardia lamblia
KRRIENGR

SEQ ID NO: 3204936 - protein, 19 aa, Giardia lamblia
KRSDSSKEHLSSLFAVLDV

SEQ ID NO: 3204937 - protein, 30 aa, Giardia lamblia
KRTKRSHSSSRSHSSQPESDKNASERSDNI

SEQ ID NO: 3204938 - protein, 15 aa, Giardia lamblia
KSAQDEGRTKGENAH

SEQ ID NO: 3204939 - protein, 24 aa, Giardia lamblia
KSATESFSGANTPGEIEKWLHNHA

SEQ ID NO: 3204940 - protein, 7 aa, Giardia lamblia
KSAVGNP

SEQ ID NO: 3204941 - protein, 21 aa, Giardia lamblia
KSDKETLDRRREAQDKTSKAF

SEQ ID NO: 3204942 - protein, 5 aa, Giardia lamblia
KSDQD

SEQ ID NO: 3204943 - protein, 7 aa, Giardia lamblia
KSEAGAV

SEQ ID NO: 3204944 - protein, 12 aa, Giardia lamblia
KSFGGGGRGHSA

SEQ ID NO: 3204945 - protein, 5 aa, Giardia lamblia
KSFPD

SEQ ID NO: 3204946 - protein, 7 aa, Giardia lamblia
KSGAGAV

SEQ ID NO: 3204947 - protein, 7 aa, Giardia lamblia
KSGGQEV

SEQ ID NO: 3204948 - protein, 4 aa, Giardia lamblia
KSGI

SEQ ID NO: 3204949 - protein, 4 aa, Giardia lamblia
KSGL

SEQ ID NO: 3204950 - protein, 10 aa, Giardia lamblia
KSGQTDRGLS

SEQ ID NO: 3204951 - protein, 6 aa, Giardia lamblia
KSPEIT

SEQ ID NO: 3204952 - protein, 6 aa, Giardia lamblia
KSPVHK

SEQ ID NO: 3204953 - protein, 11 aa, Giardia lamblia
KSRHWRKSDYD

SEQ ID NO: 3204954 - protein, 7 aa, Giardia lamblia
KSSVEDI

SEQ ID NO: 3204955 - protein, 12 aa, Giardia lamblia
KTAKDSGKPADT

SEQ ID NO: 3204956 - protein, 7 aa, Giardia lamblia
KTASSGY

SEQ ID NO: 3204957 - protein, 8 aa, Giardia lamblia
KTATAAEL

SEQ ID NO: 3204958 - protein, 4 aa, Giardia lamblia
KTCA

SEQ ID NO: 3204959 - protein, 8 aa, Giardia lamblia
KTDGGIGP

SEQ ID NO: 3204960 - protein, 5 aa, Giardia lamblia
KTESP

SEQ ID NO: 3204961 - protein, 4 aa, Giardia lamblia
KTGH

SEQ ID NO: 3204962 - protein, 8 aa, Giardia lamblia
KTGTTTDE

SEQ ID NO: 3204963 - protein, 9 aa, Giardia lamblia
KTGTTTDEC

SEQ ID NO: 3204964 - protein, 4 aa, Giardia lamblia
KTKH

SEQ ID NO: 3204965 - protein, 7 aa, Giardia lamblia
KTNTRID

SEQ ID NO: 3204966 - protein, 5 aa, Giardia lamblia
KTPRK

SEQ ID NO: 3204967 - protein, 15 aa, Giardia lamblia
KTQTGRSPDETSQEN

SEQ ID NO: 3204968 - protein, 5 aa, Giardia lamblia
KTRKN

SEQ ID NO: 3204969 - protein, 5 aa, Giardia lamblia
KTRQL

SEQ ID NO: 3204970 - protein, 41 aa, Giardia lamblia
KTRQLRSSSRKQKKQVPAETKPVAQGQDSTEDKEISKPDKQ

SEQ ID NO: 3204971 - protein, 7 aa, Giardia lamblia
KTRTENV

SEQ ID NO: 3204972 - protein, 5 aa, Giardia lamblia
KTVMR

SEQ ID NO: 3204973 - protein, 5 aa, Giardia lamblia
KVCSG

SEQ ID NO: 3204974 - protein, 6 aa, Giardia lamblia
KVEHKA

SEQ ID NO: 3204975 - protein, 9 aa, Giardia lamblia
KVSKSGPCE

SEQ ID NO: 3204976 - protein, 8 aa, Giardia lamblia
KVSPKGNS

SEQ ID NO: 3204977 - protein, 8 aa, Giardia lamblia
KVTEQEWE

SEQ ID NO: 3204978 - protein, 7 aa, Giardia lamblia
KYFSRDP

SEQ ID NO: 3204979 - protein, 13 aa, Giardia lamblia
KYGASKLQSERPI

SEQ ID NO: 3204980 - protein, 7 aa, Giardia lamblia
KYNASGY

SEQ ID NO: 3204981 - protein, 11 aa, Giardia lamblia
KYSRGQDIEDD

SEQ ID NO: 3204982 - protein, 8 aa, Giardia lamblia
KYSTGSVV

SEQ ID NO: 3204983 - protein, 10 aa, Giardia lamblia
KYSYQREQKS

SEQ ID NO: 3204984 - protein, 5 aa, Giardia lamblia
LADYK

SEQ ID NO: 3204985 - protein, 10 aa, Giardia lamblia
LAEAKESTKA

SEQ ID NO: 3204986 - protein, 8 aa, Giardia lamblia
LAEETGAL

SEQ ID NO: 3204987 - protein, 5 aa, Giardia lamblia
LAGAI

SEQ ID NO: 3204988 - protein, 6 aa, Giardia lamblia
LAGPIP

SEQ ID NO: 3204989 - protein, 4 aa, Giardia lamblia
LAQL

SEQ ID NO: 3204990 - protein, 9 aa, Giardia lamblia
LAQQPNREY

SEQ ID NO: 3204991 - protein, 9 aa, Giardia lamblia
LAQSSYNPD

SEQ ID NO: 3204992 - protein, 9 aa, Giardia lamblia
LASESAPAA

SEQ ID NO: 3204993 - protein, 10 aa, Giardia lamblia
LAYSSSEYNR

SEQ ID NO: 3204994 - protein, 18 aa, Giardia lamblia
LDAAPQDGSTLARQRPSA

SEQ ID NO: 3204995 - protein, 4 aa, Giardia lamblia
LDEA

SEQ ID NO: 3204996 - protein, 6 aa, Giardia lamblia
LDQSGV

SEQ ID NO: 3204997 - protein, 7 aa, Giardia lamblia
LDTNPAL

SEQ ID NO: 3204998 - protein, 5 aa, Giardia lamblia
LDVPD

SEQ ID NO: 3204999 - protein, 14 aa, Giardia lamblia
LEEARQRTVAHEGQ

SEQ ID NO: 3205000 - protein, 4 aa, Giardia lamblia
LEER

SEQ ID NO: 3205001 - protein, 5 aa, Giardia lamblia
LEERK

SEQ ID NO: 3205002 - protein, 18 aa, Giardia lamblia
LEGTSSQESSNSTAFKDE

SEQ ID NO: 3205003 - protein, 10 aa, Giardia lamblia
LEKTRTPQPA

SEQ ID NO: 3205004 - protein, 4 aa, Giardia lamblia
LENV

SEQ ID NO: 3205005 - protein, 5 aa, Giardia lamblia
LEPPS

SEQ ID NO: 3205006 - protein, 4 aa, Giardia lamblia
LEQE

SEQ ID NO: 3205007 - protein, 11 aa, Giardia lamblia
LEQTKAENQDM

SEQ ID NO: 3205008 - protein, 10 aa, Giardia lamblia
LEVNEDRARD

SEQ ID NO: 3205009 - protein, 20 aa, Giardia lamblia
LGDPLHTGKPSMQPSRTPSI

SEQ ID NO: 3205010 - protein, 8 aa, Giardia lamblia
LGEDPADQ

SEQ ID NO: 3205011 - protein, 8 aa, Giardia lamblia
LGEGDTPM

SEQ ID NO: 3205012 - protein, 6 aa, Giardia lamblia
LGNETV

SEQ ID NO: 3205013 - protein, 10 aa, Giardia lamblia
LGPADSPPPL

SEQ ID NO: 3205014 - protein, 6 aa, Giardia lamblia
LGPGDQ

SEQ ID NO: 3205015 - protein, 7 aa, Giardia lamblia
LGPNETM

SEQ ID NO: 3205016 - protein, 7 aa, Giardia lamblia
LGPNWGE

SEQ ID NO: 3205017 - protein, 13 aa, Giardia lamblia
LGPSGRAASQGLD

SEQ ID NO: 3205018 - protein, 6 aa, Giardia lamblia
LGRRTG

SEQ ID NO: 3205019 - protein, 45 aa, Giardia lamblia; identical to SEQ ID NO: 3121391

SEQ ID NO: 3205020 - protein, 8 aa, Giardia lamblia
LGVSPDQL

SEQ ID NO: 3205021 - protein, 10 aa, Giardia lamblia
LHSSTKDSSL

SEQ ID NO: 3205022 - protein, 7 aa, Giardia lamblia
LKDGPYQ

SEQ ID NO: 3205023 - protein, 10 aa, Giardia lamblia
LKEDADRLRQ

SEQ ID NO: 3205024 - protein, 18 aa, Giardia lamblia
LKGSSREDLRELLSRLVS

SEQ ID NO: 3205025 - protein, 9 aa, Giardia lamblia
LKGYNGGTA

SEQ ID NO: 3205026 - protein, 9 aa, Giardia lamblia
LKNASQEAY

SEQ ID NO: 3205027 - protein, 10 aa, Giardia lamblia
LKPRASTTSR

SEQ ID NO: 3205028 - protein, 9 aa, Giardia lamblia
LKSPNDPGV

SEQ ID NO: 3205029 - protein, 6 aa, Giardia lamblia
LKTTDI

SEQ ID NO: 3205030 - protein, 4 aa, Giardia lamblia
LNGP

SEQ ID NO: 3205031 - protein, 11 aa, Giardia lamblia
LNKSSRPDGNI

SEQ ID NO: 3205032 - protein, 5 aa, Giardia lamblia
LPANK

SEQ ID NO: 3205033 - protein, 6 aa, Giardia lamblia
LPDETD

SEQ ID NO: 3205034 - protein, 4 aa, Giardia lamblia
LPND

SEQ ID NO: 3205035 - protein, 6 aa, Giardia lamblia
LPSPHA

SEQ ID NO: 3205036 - protein, 28 aa, Giardia lamblia
LPSPSANETVADTANKTTINATSTKKEE

SEQ ID NO: 3205037 - protein, 14 aa, Giardia lamblia
LQAENAKLKETNEK

SEQ ID NO: 3205038 - protein, 5 aa, Giardia lamblia
LQDGP

SEQ ID NO: 3205039 - protein, 4 aa, Giardia lamblia
LQES

SEQ ID NO: 3205040 - protein, 18 aa, Giardia lamblia
LQKAKTARETLKDDLKRE

SEQ ID NO: 3205041 - protein, 7 aa, Giardia lamblia
LQKEGPY

SEQ ID NO: 3205042 - protein, 13 aa, Giardia lamblia
LQPRQEEDQSSRL

SEQ ID NO: 3205043 - protein, 11 aa, Giardia lamblia
LQPTDIQTNAD

SEQ ID NO: 3205044 - protein, 6 aa, Giardia lamblia
LQSISG

SEQ ID NO: 3205045 - protein, 5 aa, Giardia lamblia
LQSKN

SEQ ID NO: 3205046 - protein, 11 aa, Giardia lamblia
LQSTKDPSVNL

SEQ ID NO: 3205047 - protein, 13 aa, Giardia lamblia
LQTANGQSQQTIE

SEQ ID NO: 3205048 - protein, 7 aa, Giardia lamblia
LQTRRAE

SEQ ID NO: 3205049 - protein, 8 aa, Giardia lamblia
LRAPAGAV

SEQ ID NO: 3205050 - protein, 4 aa, Giardia lamblia
LRAR

SEQ ID NO: 3205051 - protein, 5 aa, Giardia lamblia
LRGEK

SEQ ID NO: 3205052 - protein, 8 aa, Giardia lamblia
LRPGPDLK

SEQ ID NO: 3205053 - protein, 10 aa, Giardia lamblia
LRREAGARIK

SEQ ID NO: 3205054 - protein, 8 aa, Giardia lamblia
LSADNATL

SEQ ID NO: 3205055 - protein, 9 aa, Giardia lamblia
LSASSRQRF

SEQ ID NO: 3205056 - protein, 17 aa, Giardia lamblia
LSDSSRSPATTSPTKPL

SEQ ID NO: 3205057 - protein, 12 aa, Giardia lamblia
LSEDNKDNRGSV

SEQ ID NO: 3205058 - protein, 5 aa, Giardia lamblia
LSEKD

SEQ ID NO: 3205059 - protein, 4 aa, Giardia lamblia
LSGE

SEQ ID NO: 3205060 - protein, 12 aa, Giardia lamblia
LSGEGTKGCSDG

SEQ ID NO: 3205061 - protein, 6 aa, Giardia lamblia
LSLGTA

SEQ ID NO: 3205062 - protein, 21 aa, Giardia lamblia
LSPAAQKHAQGPEGPSPGVQR

SEQ ID NO: 3205063 - protein, 7 aa, Giardia lamblia
LSPKPAL

SEQ ID NO: 3205064 - protein, 7 aa, Giardia lamblia
LSPKTGN

SEQ ID NO: 3205065 - protein, 11 aa, Giardia lamblia
LSQTPVEEPHP

SEQ ID NO: 3205066 - protein, 13 aa, Giardia lamblia
LSRTGTTPSSIGS

SEQ ID NO: 3205067 - protein, 10 aa, Giardia lamblia
LSSEATRPTE

SEQ ID NO: 3205068 - protein, 9 aa, Giardia lamblia
LSSGKDAFE

SEQ ID NO: 3205069 - protein, 25 aa, Giardia lamblia
LSSPSASYSGAAQGPLTTTDDKRIA

SEQ ID NO: 3205070 - protein, 9 aa, Giardia lamblia
LSSPSTDST

SEQ ID NO: 3205071 - protein, 6 aa, Giardia lamblia
LSSSGV

SEQ ID NO: 3205072 - protein, 18 aa, Giardia lamblia
LSSSKGFKPDSSPQCVED

SEQ ID NO: 3205073 - protein, 4 aa, Giardia lamblia
LSYT

SEQ ID NO: 3205074 - protein, 5 aa, Giardia lamblia
LTAGT

SEQ ID NO: 3205075 - protein, 5 aa, Giardia lamblia
LTAST

SEQ ID NO: 3205076 - protein, 9 aa, Giardia lamblia
LTCNPTGRD

SEQ ID NO: 3205077 - protein, 4 aa, Giardia lamblia
LTGE

SEQ ID NO: 3205078 - protein, 8 aa, Giardia lamblia
LTPQLTTK

SEQ ID NO: 3205079 - protein, 12 aa, Giardia lamblia
LTPSGGRSTSYC

SEQ ID NO: 3205080 - protein, 7 aa, Giardia lamblia
LTRQYKQ

SEQ ID NO: 3205081 - protein, 14 aa, Giardia lamblia
LTSRGASLTKEEEE

SEQ ID NO: 3205082 - protein, 11 aa, Giardia lamblia
LTSTYGSTQSY

SEQ ID NO: 3205083 - protein, 12 aa, Giardia lamblia
LYPPAGSPDRLD

SEQ ID NO: 3205084 - protein, 19 aa, Giardia lamblia
LYSRDRGTDDRTGPMVVPL

SEQ ID NO: 3205085 - protein, 5 aa, Giardia lamblia
MGPPE

SEQ ID NO: 3205086 - protein, 4 aa, Giardia lamblia
MGPT

SEQ ID NO: 3205087 - protein, 6 aa, Giardia lamblia
MHDGKG

SEQ ID NO: 3205088 - protein, 5 aa, Giardia lamblia
MKPTG

SEQ ID NO: 3205089 - protein, 11 aa, Giardia lamblia
MKTKKANCERH

SEQ ID NO: 3205090 - protein, 12 aa, Giardia lamblia
MLSSGTKSNVPP

SEQ ID NO: 3205091 - protein, 8 aa, Giardia lamblia
MNTADPQS

SEQ ID NO: 3205092 - protein, 8 aa, Giardia lamblia
MNTTDPQS

SEQ ID NO: 3205093 - protein, 4 aa, Giardia lamblia
MPQG

SEQ ID NO: 3205094 - protein, 17 aa, Giardia lamblia
MQHSKNAGEADYHRKQR

SEQ ID NO: 3205095 - protein, 10 aa, Giardia lamblia
MRRAPRDRVQ

SEQ ID NO: 3205096 - protein, 6 aa, Giardia lamblia
MSDEQR

SEQ ID NO: 3205097 - protein, 14 aa, Giardia lamblia
MTKDETGEYVPTPG

SEQ ID NO: 3205098 - protein, 9 aa, Giardia lamblia
NAAPTGDDG

SEQ ID NO: 3205099 - protein, 6 aa, Giardia lamblia
NADFDG

SEQ ID NO: 3205100 - protein, 7 aa, Giardia lamblia
NAEAGKT

SEQ ID NO: 3205101 - protein, 32 aa, Giardia lamblia
NAEERAVRQDNNDAPSYKVGHSSGFSSTIGNS

SEQ ID NO: 3205102 - protein, 16 aa, Giardia lamblia
NAEKEPELKQVPQEQE

SEQ ID NO: 3205103 - protein, 15 aa, Giardia lamblia
NAFAEEPSEATFEEY

SEQ ID NO: 3205104 - protein, 9 aa, Giardia lamblia
NAGFNSDRA

SEQ ID NO: 3205105 - protein, 7 aa, Giardia lamblia
NAHPDGR

SEQ ID NO: 3205106 - protein, 33 aa, Giardia lamblia; identical to SEQ ID NO: 3123946

SEQ ID NO: 3205107 - protein, 4 aa, Giardia lamblia
NASG

SEQ ID NO: 3205108 - protein, 7 aa, Giardia lamblia
NASPKKQ

SEQ ID NO: 3205109 - protein, 7 aa, Giardia lamblia
NAVKEED

SEQ ID NO: 3205110 - protein, 4 aa, Giardia lamblia
NCTP

SEQ ID NO: 3205111 - protein, 14 aa, Giardia lamblia
NDDASNKDPGQSIA

SEQ ID NO: 3205112 - protein, 5 aa, Giardia lamblia
NDGPV

SEQ ID NO: 3205113 - protein, 7 aa, Giardia lamblia
NDKKKEV

SEQ ID NO: 3205114 - protein, 10 aa, Giardia lamblia
NDKTNTDAGI

SEQ ID NO: 3205115 - protein, 4 aa, Giardia lamblia
NDPA

SEQ ID NO: 3205116 - protein, 12 aa, Giardia lamblia
NDPSPSCERGTC

SEQ ID NO: 3205117 - protein, 10 aa, Giardia lamblia
NDRGRLSEDE

SEQ ID NO: 3205118 - protein, 14 aa, Giardia lamblia
NDSTDEQEAQDTRL

SEQ ID NO: 3205119 - protein, 4 aa, Giardia lamblia
NDVE

SEQ ID NO: 3205120 - protein, 7 aa, Giardia lamblia
NECQIEN

SEQ ID NO: 3205121 - protein, 20 aa, Giardia lamblia
NEGRGDEDTAASDSSSSSYN

SEQ ID NO: 3205122 - protein, 5 aa, Giardia lamblia
NEGYS

SEQ ID NO: 3205123 - protein, 8 aa, Giardia lamblia
NEKAQNHL

SEQ ID NO: 3205124 - protein, 9 aa, Giardia lamblia
NENEKLRAE

SEQ ID NO: 3205125 - protein, 8 aa, Giardia lamblia
NEPTSESD

SEQ ID NO: 3205126 - protein, 9 aa, Giardia lamblia
NEQVSGQLK

SEQ ID NO: 3205127 - protein, 5 aa, Giardia lamblia
NESKS

SEQ ID NO: 3205128 - protein, 8 aa, Giardia lamblia
NESNETLR

SEQ ID NO: 3205129 - protein, 9 aa, Giardia lamblia
NESNGGKDL

SEQ ID NO: 3205130 - protein, 9 aa, Giardia lamblia
NESSPASDV

SEQ ID NO: 3205131 - protein, 7 aa, Giardia lamblia
NETDGYY

SEQ ID NO: 3205132 - protein, 4 aa, Giardia lamblia
NETM

SEQ ID NO: 3205133 - protein, 5 aa, Giardia lamblia
NGAGY

SEQ ID NO: 3205134 - protein, 6 aa, Giardia lamblia
NGANNR

SEQ ID NO: 3205135 - protein, 6 aa, Giardia lamblia
NGANTR

SEQ ID NO: 3205136 - protein, 8 aa, Giardia lamblia
NGAREAKA

SEQ ID NO: 3205137 - protein, 9 aa, Giardia lamblia
NGCRGGNPL

SEQ ID NO: 3205138 - protein, 9 aa, Giardia lamblia
NGCRGGNSL

SEQ ID NO: 3205139 - protein, 8 aa, Giardia lamblia
NGDGETGL

SEQ ID NO: 3205140 - protein, 5 aa, Giardia lamblia
NGGRV

SEQ ID NO: 3205141 - protein, 4 aa, Giardia lamblia
NGHA

SEQ ID NO: 3205142 - protein, 4 aa, Giardia lamblia
NGHS

SEQ ID NO: 3205143 - protein, 7 aa, Giardia lamblia
NGLATPA

SEQ ID NO: 3205144 - protein, 10 aa, Giardia lamblia
NGNGVCQDGE

SEQ ID NO: 3205145 - protein, 7 aa, Giardia lamblia
NGPPVTT

SEQ ID NO: 3205146 - protein, 7 aa, Giardia lamblia
NGQCKGG

SEQ ID NO: 3205147 - protein, 5 aa, Giardia lamblia
NGQYH

SEQ ID NO: 3205148 - protein, 11 aa, Giardia lamblia
NGSTTSYIPNG

SEQ ID NO: 3205149 - protein, 8 aa, Giardia lamblia
NHESENLN

SEQ ID NO: 3205150 - protein, 10 aa, Giardia lamblia
NHSSTEDTTA

SEQ ID NO: 3205151 - protein, 5 aa, Giardia lamblia
NHTKS

SEQ ID NO: 3205152 - protein, 25 aa, Giardia lamblia
NISGPSAHRDGPQALQASGLEPKSS

SEQ ID NO: 3205153 - protein, 12 aa, Giardia lamblia
NITEEPPRFPNR

SEQ ID NO: 3205154 - protein, 17 aa, Giardia lamblia
NKAKEDQPSIASGTQPV

SEQ ID NO: 3205155 - protein, 8 aa, Giardia lamblia
NKDINADE

SEQ ID NO: 3205156 - protein, 7 aa, Giardia lamblia
NKGDPEV

SEQ ID NO: 3205157 - protein, 7 aa, Giardia lamblia
NKGTCDM

SEQ ID NO: 3205158 - protein, 10 aa, Giardia lamblia
NKIGKNEIQS

SEQ ID NO: 3205159 - protein, 13 aa, Giardia lamblia
NKITSPPPKTVYT

SEQ ID NO: 3205160 - protein, 8 aa, Giardia lamblia
NKKKALEE

SEQ ID NO: 3205161 - protein, 8 aa, Giardia lamblia
NKKPRDRT

SEQ ID NO: 3205162 - protein, 5 aa, Giardia lamblia
NKKSF

SEQ ID NO: 3205163 - protein, 11 aa, Giardia lamblia
NKLPSDTSFPE

SEQ ID NO: 3205164 - protein, 7 aa, Giardia lamblia
NKPNEDK

SEQ ID NO: 3205165 - protein, 7 aa, Giardia lamblia
NLGTGSI

SEQ ID NO: 3205166 - protein, 8 aa, Giardia lamblia
NLKQEVDA

SEQ ID NO: 3205167 - protein, 6 aa, Giardia lamblia
NLPAEE

SEQ ID NO: 3205168 - protein, 6 aa, Giardia lamblia
NLPEGT

SEQ ID NO: 3205169 - protein, 5 aa, Giardia lamblia
NLTAD

SEQ ID NO: 3205170 - protein, 11 aa, Giardia lamblia
NMPNSRSQTPL

SEQ ID NO: 3205171 - protein, 9 aa, Giardia lamblia
NMRDREGRT

SEQ ID NO: 3205172 - protein, 5 aa, Giardia lamblia
NNAET

SEQ ID NO: 3205173 - protein, 6 aa, Giardia lamblia
NNGQCK

SEQ ID NO: 3205174 - protein, 6 aa, Giardia lamblia
NNIRSE

SEQ ID NO: 3205175 - protein, 16 aa, Giardia lamblia
NNKGMGPQPIPAPDPR

SEQ ID NO: 3205176 - protein, 5 aa, Giardia lamblia
NNLKD

SEQ ID NO: 3205177 - protein, 4 aa, Giardia lamblia
NNQS

SEQ ID NO: 3205178 - protein, 4 aa, Giardia lamblia
NNRS

SEQ ID NO: 3205179 - protein, 8 aa, Giardia lamblia
NNTETSIK

SEQ ID NO: 3205180 - protein, 13 aa, Giardia lamblia
NPAGVSTGAGNHA

SEQ ID NO: 3205181 - protein, 11 aa, Giardia lamblia
NPARSAKNFSK

SEQ ID NO: 3205182 - protein, 12 aa, Giardia lamblia
NPASEYMPEQKQ

SEQ ID NO: 3205183 - protein, 8 aa, Giardia lamblia
NPDSRKAN

SEQ ID NO: 3205184 - protein, 6 aa, Giardia lamblia
NPEQEL

SEQ ID NO: 3205185 - protein, 7 aa, Giardia lamblia
NPFPAET

SEQ ID NO: 3205186 - protein, 20 aa, Giardia lamblia
NQDRPEAKYSLPGCDSSESL

SEQ ID NO: 3205187 - protein, 7 aa, Giardia lamblia
NQEADTL

SEQ ID NO: 3205188 - protein, 13 aa, Giardia lamblia
NQSISQQPAIASG

SEQ ID NO: 3205189 - protein, 8 aa, Giardia lamblia
NRAGSEHA

SEQ ID NO: 3205190 - protein, 5 aa, Giardia lamblia
NRFPG

SEQ ID NO: 3205191 - protein, 9 aa, Giardia lamblia
NRGRNTNGS

SEQ ID NO: 3205192 - protein, 7 aa, Giardia lamblia
NRKLTDK

SEQ ID NO: 3205193 - protein, 7 aa, Giardia lamblia
NRPLTNA

SEQ ID NO: 3205194 - protein, 6 aa, Giardia lamblia
NRPNET

SEQ ID NO: 3205195 - protein, 5 aa, Giardia lamblia
NRTTV

SEQ ID NO: 3205196 - protein, 4 aa, Giardia lamblia
NSEE

SEQ ID NO: 3205197 - protein, 7 aa, Giardia lamblia
NSETNSY

SEQ ID NO: 3205198 - protein, 9 aa, Giardia lamblia
NSGSNPSTM

SEQ ID NO: 3205199 - protein, 8 aa, Giardia lamblia
NSKSARLE

SEQ ID NO: 3205200 - protein, 6 aa, Giardia lamblia
NSNLEP

SEQ ID NO: 3205201 - protein, 8 aa, Giardia lamblia
NSNSSYTF

SEQ ID NO: 3205202 - protein, 6 aa, Giardia lamblia
NSPEVQ

SEQ ID NO: 3205203 - protein, 8 aa, Giardia lamblia
NSQSKYTY

SEQ ID NO: 3205204 - protein, 9 aa, Giardia lamblia
NSSASHRIA

SEQ ID NO: 3205205 - protein, 11 aa, Giardia lamblia
NSSTPPPSYQS

SEQ ID NO: 3205206 - protein, 4 aa, Giardia lamblia
NSTE

SEQ ID NO: 3205207 - protein, 6 aa, Giardia lamblia
NSVDSL

SEQ ID NO: 3205208 - protein, 9 aa, Giardia lamblia
NTKAQVESL

SEQ ID NO: 3205209 - protein, 9 aa, Giardia lamblia
NTLRNSGAS

SEQ ID NO: 3205210 - protein, 6 aa, Giardia lamblia
NTNKYK

SEQ ID NO: 3205211 - protein, 9 aa, Giardia lamblia
NTNTYSGTT

SEQ ID NO: 3205212 - protein, 19 aa, Giardia lamblia
NTPQARCKTPRSAARRSVS

SEQ ID NO: 3205213 - protein, 9 aa, Giardia lamblia
NTSINGEHE

SEQ ID NO: 3205214 - protein, 5 aa, Giardia lamblia
NTSSP

SEQ ID NO: 3205215 - protein, 6 aa, Giardia lamblia
NTVAEQ

SEQ ID NO: 3205216 - protein, 4 aa, Giardia lamblia
NVSC

SEQ ID NO: 3205217 - protein, 15 aa, Giardia lamblia
NYENPNCEDSDDTLS

SEQ ID NO: 3205218 - protein, 8 aa, Giardia lamblia
NYERTKQS

SEQ ID NO: 3205219 - protein, 10 aa, Giardia lamblia
NYIQSSSGEW

SEQ ID NO: 3205220 - protein, 4 aa, Giardia lamblia
NYSS

SEQ ID NO: 3205221 - protein, 6 aa, Giardia lamblia
NYTPDR

SEQ ID NO: 3205222 - protein, 9 aa, Giardia lamblia
NYTPSGGRC

SEQ ID NO: 3205223 - protein, 4 aa, Giardia lamblia
PAAC

SEQ ID NO: 3205224 - protein, 11 aa, Giardia lamblia
PADTGTSTGRC

SEQ ID NO: 3205225 - protein, 11 aa, Giardia lamblia
PANSKDGSFKR

SEQ ID NO: 3205226 - protein, 5 aa, Giardia lamblia
PAPQM

SEQ ID NO: 3205227 - protein, 8 aa, Giardia lamblia
PAPVDSND

SEQ ID NO: 3205228 - protein, 12 aa, Giardia lamblia
PAQDVKKQTQPY

SEQ ID NO: 3205229 - protein, 13 aa, Giardia lamblia
PAQQQLPHPQSAD

SEQ ID NO: 3205230 - protein, 7 aa, Giardia lamblia
PASARRR

SEQ ID NO: 3205231 - protein, 11 aa, Giardia lamblia
PASTQRTEDED

SEQ ID NO: 3205232 - protein, 6 aa, Giardia lamblia
PATTKK

SEQ ID NO: 3205233 - protein, 4 aa, Giardia lamblia
PCTT

SEQ ID NO: 3205234 - protein, 9 aa, Giardia lamblia
PDANLDTDE

SEQ ID NO: 3205235 - protein, 7 aa, Giardia lamblia
PDGTIGE

SEQ ID NO: 3205236 - protein, 6 aa, Giardia lamblia
PDGYEG

SEQ ID NO: 3205237 - protein, 8 aa, Giardia lamblia
PDMPVSSD

SEQ ID NO: 3205238 - protein, 15 aa, Giardia lamblia
PDPEKKKEYFSKTFT

SEQ ID NO: 3205239 - protein, 7 aa, Giardia lamblia
PDPETQL

SEQ ID NO: 3205240 - protein, 6 aa, Giardia lamblia
PDSTDV

SEQ ID NO: 3205241 - protein, 19 aa, Giardia lamblia
PEAPNGGLTNAPSPESTTL

SEQ ID NO: 3205242 - protein, 14 aa, Giardia lamblia
PEDTSTEYGTQKAI

SEQ ID NO: 3205243 - protein, 10 aa, Giardia lamblia
PEKKKVQKTI

SEQ ID NO: 3205244 - protein, 8 aa, Giardia lamblia
PENEDPVP

SEQ ID NO: 3205245 - protein, 35 aa, Giardia lamblia
PENKDEAFSSTSKEKRVSLPSSYTHSGTSSHEGDS

SEQ ID NO: 3205246 - protein, 10 aa, Giardia lamblia
PENRPDGPPT

SEQ ID NO: 3205247 - protein, 14 aa, Giardia lamblia
PEPSDQSAPEAESM

SEQ ID NO: 3205248 - protein, 4 aa, Giardia lamblia
PERD

SEQ ID NO: 3205249 - protein, 5 aa, Giardia lamblia
PETDT

SEQ ID NO: 3205250 - protein, 10 aa, Giardia lamblia
PFAEEPSRGM

SEQ ID NO: 3205251 - protein, 8 aa, Giardia lamblia
PFDGSSSM

SEQ ID NO: 3205252 - protein, 9 aa, Giardia lamblia
PFTEEPSHG

SEQ ID NO: 3205253 - protein, 5 aa, Giardia lamblia
PGEGT

SEQ ID NO: 3205254 - protein, 9 aa, Giardia lamblia
PGELQPKKT

SEQ ID NO: 3205255 - protein, 6 aa, Giardia lamblia
PGGTQR

SEQ ID NO: 3205256 - protein, 9 aa, Giardia lamblia
PGLAGLSAD

SEQ ID NO: 3205257 - protein, 4 aa, Giardia lamblia
PGSA

SEQ ID NO: 3205258 - protein, 12 aa, Giardia lamblia
PGSGPAPSKGET

SEQ ID NO: 3205259 - protein, 8 aa, Giardia lamblia
PGSLSGTE

SEQ ID NO: 3205260 - protein, 8 aa, Giardia lamblia
PGSQSGVI

SEQ ID NO: 3205261 - protein, 10 aa, Giardia lamblia
PGSSPRPLDI

SEQ ID NO: 3205262 - protein, 5 aa, Giardia lamblia
PGTIK

SEQ ID NO: 3205263 - protein, 13 aa, Giardia lamblia
PGVPRHGVPDTLP

SEQ ID NO: 3205264 - protein, 5 aa, Giardia lamblia
PGWGE

SEQ ID NO: 3205265 - protein, 7 aa, Giardia lamblia
PHPGTSD

SEQ ID NO: 3205266 - protein, 15 aa, Giardia lamblia
PIASNAGSVSTARGS

SEQ ID NO: 3205267 - protein, 16 aa, Giardia lamblia
PIDTTPKPEPQNGTIT

SEQ ID NO: 3205268 - protein, 16 aa, Giardia lamblia
PIDTTPKPEPRNGTIT

SEQ ID NO: 3205269 - protein, 10 aa, Giardia lamblia
PIPPAVESPT

SEQ ID NO: 3205270 - protein, 5 aa, Giardia lamblia
PISTY

SEQ ID NO: 3205271 - protein, 6 aa, Giardia lamblia
PKDETS

SEQ ID NO: 3205272 - protein, 20 aa, Giardia lamblia
PKEDSVAYAATSEPYDKSGG

SEQ ID NO: 3205273 - protein, 10 aa, Giardia lamblia
PKTDHEAPKD

SEQ ID NO: 3205274 - protein, 6 aa, Giardia lamblia
PLATNR

SEQ ID NO: 3205275 - protein, 5 aa, Giardia lamblia
PLGDE

SEQ ID NO: 3205276 - protein, 16 aa, Giardia lamblia
PLGKDGRVVRPDGDKE

SEQ ID NO: 3205277 - protein, 8 aa, Giardia lamblia
PLPNSSST

SEQ ID NO: 3205278 - protein, 6 aa, Giardia lamblia
PLPRDA

SEQ ID NO: 3205279 - protein, 9 aa, Giardia lamblia
PLPSLPPQR

SEQ ID NO: 3205280 - protein, 11 aa, Giardia lamblia
PNGDDDSRLPG

SEQ ID NO: 3205281 - protein, 7 aa, Giardia lamblia
PNGDPKL

SEQ ID NO: 3205282 - protein, 5 aa, Giardia lamblia
PNGFD

SEQ ID NO: 3205283 - protein, 6 aa, Giardia lamblia
PNPYSS

SEQ ID NO: 3205284 - protein, 10 aa, Giardia lamblia
PNRYNNPGYR

SEQ ID NO: 3205285 - protein, 14 aa, Giardia lamblia
PNSPNERLSPRRSN

SEQ ID NO: 3205286 - protein, 7 aa, Giardia lamblia
PNSQGAI

SEQ ID NO: 3205287 - protein, 8 aa, Giardia lamblia
PPLPSSGS

SEQ ID NO: 3205288 - protein, 14 aa, Giardia lamblia
PPMKPANSTDPNDD

SEQ ID NO: 3205289 - protein, 14 aa, Giardia lamblia
PPNLREKANSAAQR

SEQ ID NO: 3205290 - protein, 7 aa, Giardia lamblia
PPNRQRP

SEQ ID NO: 3205291 - protein, 15 aa, Giardia lamblia
PPQYEGNDVSHNRRK

SEQ ID NO: 3205292 - protein, 8 aa, Giardia lamblia
PPSDHISR

SEQ ID NO: 3205293 - protein, 6 aa, Giardia lamblia
PPSDWP

SEQ ID NO: 3205294 - protein, 9 aa, Giardia lamblia
PPTAEELDE

SEQ ID NO: 3205295 - protein, 10 aa, Giardia lamblia
PPTNCPTTLE

SEQ ID NO: 3205296 - protein, 4 aa, Giardia lamblia
PPWK

SEQ ID NO: 3205297 - protein, 4 aa, Giardia lamblia
PPWT

SEQ ID NO: 3205298 - protein, 8 aa, Giardia lamblia
PQAISSGL

SEQ ID NO: 3205299 - protein, 4 aa, Giardia lamblia
PQAV

SEQ ID NO: 3205300 - protein, 4 aa, Giardia lamblia
PQEC

SEQ ID NO: 3205301 - protein, 4 aa, Giardia lamblia
PQEL

SEQ ID NO: 3205302 - protein, 12 aa, Giardia lamblia
PQRKPSDTTPCK

SEQ ID NO: 3205303 - protein, 12 aa, Giardia lamblia
PRASRKNRIQKR

SEQ ID NO: 3205304 - protein, 4 aa, Giardia lamblia
PRAV

SEQ ID NO: 3205305 - protein, 9 aa, Giardia lamblia
PRERASATK

SEQ ID NO: 3205306 - protein, 15 aa, Giardia lamblia
PRGGGLARGTNCSAG

SEQ ID NO: 3205307 - protein, 5 aa, Giardia lamblia
PRNAT

SEQ ID NO: 3205308 - protein, 10 aa, Giardia lamblia
PRNTATTDTV

SEQ ID NO: 3205309 - protein, 16 aa, Giardia lamblia
PRPPNAPETGSDGTAL

SEQ ID NO: 3205310 - protein, 20 aa, Giardia lamblia
PRPTATNKKQRKDDMQDTRD

SEQ ID NO: 3205311 - protein, 16 aa, Giardia lamblia
PRTTLGGASSRGGTDV

SEQ ID NO: 3205312 - protein, 21 aa, Giardia lamblia
PRTTLGGASSRGGTDVAEQKA

SEQ ID NO: 3205313 - protein, 15 aa, Giardia lamblia
PSAISPVRQATPDRA

SEQ ID NO: 3205314 - protein, 18 aa, Giardia lamblia
PSDHRGGHSDRDAHGVVQ

SEQ ID NO: 3205315 - protein, 7 aa, Giardia lamblia
PSDQTRP

SEQ ID NO: 3205316 - protein, 5 aa, Giardia lamblia
PSDVS

SEQ ID NO: 3205317 - protein, 4 aa, Giardia lamblia
PSEC

SEQ ID NO: 3205318 - protein, 9 aa, Giardia lamblia
PSGCSDRRT

SEQ ID NO: 3205319 - protein, 4 aa, Giardia lamblia
PSGN

SEQ ID NO: 3205320 - protein, 4 aa, Giardia lamblia
PSLQ

SEQ ID NO: 3205321 - protein, 8 aa, Giardia lamblia
PSNLGSSK

SEQ ID NO: 3205322 - protein, 7 aa, Giardia lamblia
PSNYNNP

SEQ ID NO: 3205323 - protein, 7 aa, Giardia lamblia
PSPADEN

SEQ ID NO: 3205324 - protein, 10 aa, Giardia lamblia
PSPTVERGGI

SEQ ID NO: 3205325 - protein, 22 aa, Giardia lamblia
PSQTVHGKDTLNDYTKNPRGAG

SEQ ID NO: 3205326 - protein, 8 aa, Giardia lamblia
PSSMSAGK

SEQ ID NO: 3205327 - protein, 5 aa, Giardia lamblia
PSTEE

SEQ ID NO: 3205328 - protein, 17 aa, Giardia lamblia
PSVAEGDASYRYDKNPR

SEQ ID NO: 3205329 - protein, 4 aa, Giardia lamblia
PTAS

SEQ ID NO: 3205330 - protein, 9 aa, Giardia lamblia
PTCASSGAE

SEQ ID NO: 3205331 - protein, 9 aa, Giardia lamblia
PTDHSQPFA

SEQ ID NO: 3205332 - protein, 6 aa, Giardia lamblia
PTDPTE

SEQ ID NO: 3205333 - protein, 7 aa, Giardia lamblia
PTEDGDP

SEQ ID NO: 3205334 - protein, 13 aa, Giardia lamblia
PTGSENSAASNGH

SEQ ID NO: 3205335 - protein, 4 aa, Giardia lamblia
PTHE

SEQ ID NO: 3205336 - protein, 8 aa, Giardia lamblia
PTNKERDK

SEQ ID NO: 3205337 - protein, 13 aa, Giardia lamblia
PTSQQQTFTQPSI

SEQ ID NO: 3205338 - protein, 15 aa, Giardia lamblia
PTTISGSSYDLTVAL

SEQ ID NO: 3205339 - protein, 5 aa, Giardia lamblia
PVAGA

SEQ ID NO: 3205340 - protein, 6 aa, Giardia lamblia
PVAGAQ

SEQ ID NO: 3205341 - protein, 15 aa, Giardia lamblia
PVPTSVPNGLLQANT

SEQ ID NO: 3205342 - protein, 6 aa, Giardia lamblia
PWEEGR

SEQ ID NO: 3205343 - protein, 23 aa, Giardia lamblia
PYKSGSTTLRGTCPTKCADGSSK

SEQ ID NO: 3205344 - protein, 8 aa, Giardia lamblia
QAAPPQQA

SEQ ID NO: 3205345 - protein, 25 aa, Giardia lamblia
QADSATEISVTQDGRRPLSAASEGV

SEQ ID NO: 3205346 - protein, 27 aa, Giardia lamblia
QAEEKMKKGKEDKGSAGSSVPNTATRS

SEQ ID NO: 3205347 - protein, 8 aa, Giardia lamblia
QAGSTAHT

SEQ ID NO: 3205348 - protein, 6 aa, Giardia lamblia
QANDGS

SEQ ID NO: 3205349 - protein, 12 aa, Giardia lamblia
QANSQYNSGTYN

SEQ ID NO: 3205350 - protein, 10 aa, Giardia lamblia
QARKQNSRGL

SEQ ID NO: 3205351 - protein, 9 aa, Giardia lamblia
QARTPYNEY

SEQ ID NO: 3205352 - protein, 6 aa, Giardia lamblia
QASTGA

SEQ ID NO: 3205353 - protein, 5 aa, Giardia lamblia
QATDP

SEQ ID NO: 3205354 - protein, 8 aa, Giardia lamblia
QATETGHK

SEQ ID NO: 3205355 - protein, 4 aa, Giardia lamblia
QAVD

SEQ ID NO: 3205356 - protein, 12 aa, Giardia lamblia
QCESCDQDGVDV

SEQ ID NO: 3205357 - protein, 8 aa, Giardia lamblia
QDAEKTEA

SEQ ID NO: 3205358 - protein, 12 aa, Giardia lamblia
QDAKKKKRRVAK

SEQ ID NO: 3205359 - protein, 4 aa, Giardia lamblia
QDGG

SEQ ID NO: 3205360 - protein, 8 aa, Giardia lamblia
QDNKGQTA

SEQ ID NO: 3205361 - protein, 4 aa, Giardia lamblia
QDNL

SEQ ID NO: 3205362 - protein, 6 aa, Giardia lamblia
QDNRGM

SEQ ID NO: 3205363 - protein, 8 aa, Giardia lamblia
QDPSSSNR

SEQ ID NO: 3205364 - protein, 7 aa, Giardia lamblia
QDSNKGA

SEQ ID NO: 3205365 - protein, 7 aa, Giardia lamblia
QDTSIDS

SEQ ID NO: 3205366 - protein, 10 aa, Giardia lamblia
QDVKAYAEKA

SEQ ID NO: 3205367 - protein, 6 aa, Giardia lamblia
QDVQGK

SEQ ID NO: 3205368 - protein, 15 aa, Giardia lamblia
QEASDPSHPPADQDE

SEQ ID NO: 3205369 - protein, 7 aa, Giardia lamblia
QEATRYS

SEQ ID NO: 3205370 - protein, 6 aa, Giardia lamblia
QEEDGS

SEQ ID NO: 3205371 - protein, 9 aa, Giardia lamblia
QEPANPTAY

SEQ ID NO: 3205372 - protein, 13 aa, Giardia lamblia
QEPANVPKKKQSY

SEQ ID NO: 3205373 - protein, 9 aa, Giardia lamblia
QEPSKQNRY

SEQ ID NO: 3205374 - protein, 6 aa, Giardia lamblia
QESSDP

SEQ ID NO: 3205375 - protein, 5 aa, Giardia lamblia
QETDP

SEQ ID NO: 3205376 - protein, 22 aa, Giardia lamblia
QEYRQAQKSFSTENGVEIEPKE

SEQ ID NO: 3205377 - protein, 10 aa, Giardia lamblia
QGLKTGDPGL

SEQ ID NO: 3205378 - protein, 4 aa, Giardia lamblia
QGNC

SEQ ID NO: 3205379 - protein, 9 aa, Giardia lamblia
QGPDGTSQV

SEQ ID NO: 3205380 - protein, 8 aa, Giardia lamblia
QGQEDSDQ

SEQ ID NO: 3205381 - protein, 13 aa, Giardia lamblia
QHEATRQVEAGED

SEQ ID NO: 3205382 - protein, 13 aa, Giardia lamblia
QHKKPTRPPTTAM

SEQ ID NO: 3205383 - protein, 5 aa, Giardia lamblia
QHRGH

SEQ ID NO: 3205384 - protein, 15 aa, Giardia lamblia
QIEADDQPIFEYTLI

SEQ ID NO: 3205385 - protein, 16 aa, Giardia lamblia
QKAEDALKALKKHVEI

SEQ ID NO: 3205386 - protein, 8 aa, Giardia lamblia
QKIQDSQG

SEQ ID NO: 3205387 - protein, 10 aa, Giardia lamblia
QKKYEDPKGI

SEQ ID NO: 3205388 - protein, 8 aa, Giardia lamblia
QKPSAPIR

SEQ ID NO: 3205389 - protein, 10 aa, Giardia lamblia
QKQSATEESL

SEQ ID NO: 3205390 - protein, 10 aa, Giardia lamblia
QKREEEDPLG

SEQ ID NO: 3205391 - protein, 7 aa, Giardia lamblia
QMDAPNV

SEQ ID NO: 3205392 - protein, 8 aa, Giardia lamblia
QNKANNDA

SEQ ID NO: 3205393 - protein, 19 aa, Giardia lamblia
QNLEGRRVPSTQTGKTLPS

SEQ ID NO: 3205394 - protein, 6 aa, Giardia lamblia
QNQPYS

SEQ ID NO: 3205395 - protein, 6 aa, Giardia lamblia
QNSAGE

SEQ ID NO: 3205396 - protein, 13 aa, Giardia lamblia
QPGSTKSASDETL

SEQ ID NO: 3205397 - protein, 5 aa, Giardia lamblia
QPGTK

SEQ ID NO: 3205398 - protein, 13 aa, Giardia lamblia
QPMPSHSSKITTV

SEQ ID NO: 3205399 - protein, 6 aa, Giardia lamblia
QPNCGP

SEQ ID NO: 3205400 - protein, 7 aa, Giardia lamblia
QPSTPTY

SEQ ID NO: 3205401 - protein, 8 aa, Giardia lamblia
QPTDGSAP

SEQ ID NO: 3205402 - protein, 6 aa, Giardia lamblia
QPYDCE

SEQ ID NO: 3205403 - protein, 7 aa, Giardia lamblia
QQGHGDS

SEQ ID NO: 3205404 - protein, 5 aa, Giardia lamblia
QREST

SEQ ID NO: 3205405 - protein, 7 aa, Giardia lamblia
QRGDPED

SEQ ID NO: 3205406 - protein, 9 aa, Giardia lamblia
QRISKSSPR

SEQ ID NO: 3205407 - protein, 12 aa, Giardia lamblia
QRKEEGRGREKL

SEQ ID NO: 3205408 - protein, 5 aa, Giardia lamblia
QRKSI

SEQ ID NO: 3205409 - protein, 4 aa, Giardia lamblia
QRNG

SEQ ID NO: 3205410 - protein, 6 aa, Giardia lamblia
QRQPIP

SEQ ID NO: 3205411 - protein, 10 aa, Giardia lamblia
QRRKSCPGED

SEQ ID NO: 3205412 - protein, 4 aa, Giardia lamblia
QRSF

SEQ ID NO: 3205413 - protein, 6 aa, Giardia lamblia
QSATDL

SEQ ID NO: 3205414 - protein, 5 aa, Giardia lamblia
QSDAF

SEQ ID NO: 3205415 - protein, 8 aa, Giardia lamblia
QSDKGATA

SEQ ID NO: 3205416 - protein, 5 aa, Giardia lamblia
QSEGR

SEQ ID NO: 3205417 - protein, 9 aa, Giardia lamblia
QSEKDSGLT

SEQ ID NO: 3205418 - protein, 6 aa, Giardia lamblia
QSKHNL

SEQ ID NO: 3205419 - protein, 8 aa, Giardia lamblia
QSKRHTPS

SEQ ID NO: 3205420 - protein, 4 aa, Giardia lamblia
QSNI

SEQ ID NO: 3205421 - protein, 5 aa, Giardia lamblia
QSSQF

SEQ ID NO: 3205422 - protein, 6 aa, Giardia lamblia
QSSTGS

SEQ ID NO: 3205423 - protein, 4 aa, Giardia lamblia
QSTF

SEQ ID NO: 3205424 - protein, 10 aa, Giardia lamblia
QSTGEPSTQL

SEQ ID NO: 3205425 - protein, 5 aa, Giardia lamblia
QSVPN

SEQ ID NO: 3205426 - protein, 10 aa, Giardia lamblia
QTAKAASKYV

SEQ ID NO: 3205427 - protein, 4 aa, Giardia lamblia
QTEL

SEQ ID NO: 3205428 - protein, 8 aa, Giardia lamblia
QTHEAASE

SEQ ID NO: 3205429 - protein, 6 aa, Giardia lamblia
QTITKE

SEQ ID NO: 3205430 - protein, 10 aa, Giardia lamblia
QTKSDTVTDS

SEQ ID NO: 3205431 - protein, 5 aa, Giardia lamblia
QTNKS

SEQ ID NO: 3205432 - protein, 4 aa, Giardia lamblia
QTPL

SEQ ID NO: 3205433 - protein, 9 aa, Giardia lamblia
QTSSPAAGF

SEQ ID NO: 3205434 - protein, 8 aa, Giardia lamblia
QVDETKQV

SEQ ID NO: 3205435 - protein, 6 aa, Giardia lamblia
QVSNQR

SEQ ID NO: 3205436 - protein, 18 aa, Giardia lamblia
QYSEQPSWAYSGNTDMKD

SEQ ID NO: 3205437 - protein, 10 aa, Giardia lamblia
QYTDPVTKQT

SEQ ID NO: 3205438 - protein, 4 aa, Giardia lamblia
RAAN

SEQ ID NO: 3205439 - protein, 18 aa, Giardia lamblia
RAAVPRGTVSATQAPDSF

SEQ ID NO: 3205440 - protein, 5 aa, Giardia lamblia
RACSG

SEQ ID NO: 3205441 - protein, 6 aa, Giardia lamblia
RANNET

SEQ ID NO: 3205442 - protein, 7 aa, Giardia lamblia
RANSGKV

SEQ ID NO: 3205443 - protein, 10 aa, Giardia lamblia
RAPSDETADL

SEQ ID NO: 3205444 - protein, 9 aa, Giardia lamblia
RAPYGNNTQ

SEQ ID NO: 3205445 - protein, 10 aa, Giardia lamblia
RARSGSLPPI

SEQ ID NO: 3205446 - protein, 7 aa, Giardia lamblia
RASNETV

SEQ ID NO: 3205447 - protein, 4 aa, Giardia lamblia
RCRQ

SEQ ID NO: 3205448 - protein, 8 aa, Giardia lamblia
RDAQSNTA

SEQ ID NO: 3205449 - protein, 7 aa, Giardia lamblia
RDELNEQ

SEQ ID NO: 3205450 - protein, 6 aa, Giardia lamblia
RDGDKA

SEQ ID NO: 3205451 - protein, 24 aa, Giardia lamblia
RDGLTPPAKPSDSATDDRGADGDL

SEQ ID NO: 3205452 - protein, 4 aa, Giardia lamblia
RDIG

SEQ ID NO: 3205453 - protein, 11 aa, Giardia lamblia
RDIPTKTGKTA

SEQ ID NO: 3205454 - protein, 4 aa, Giardia lamblia
RDSH

SEQ ID NO: 3205455 - protein, 5 aa, Giardia lamblia
RDSHG

SEQ ID NO: 3205456 - protein, 6 aa, Giardia lamblia
RDSIES

SEQ ID NO: 3205457 - protein, 12 aa, Giardia lamblia
READDKKDNQEY

SEQ ID NO: 3205458 - protein, 9 aa, Giardia lamblia
REDDSTSAR

SEQ ID NO: 3205459 - protein, 7 aa, Giardia lamblia
REDKKRE

SEQ ID NO: 3205460 - protein, 10 aa, Giardia lamblia
REDKRELERQ

SEQ ID NO: 3205461 - protein, 4 aa, Giardia lamblia
REEL

SEQ ID NO: 3205462 - protein, 7 aa, Giardia lamblia
REETDQY

SEQ ID NO: 3205463 - protein, 7 aa, Giardia lamblia
REGETWS

SEQ ID NO: 3205464 - protein, 4 aa, Giardia lamblia
REGL

SEQ ID NO: 3205465 - protein, 4 aa, Giardia lamblia
RELT

SEQ ID NO: 3205466 - protein, 11 aa, Giardia lamblia
RENPGARGVQT

SEQ ID NO: 3205467 - protein, 5 aa, Giardia lamblia
REPIN

SEQ ID NO: 3205468 - protein, 9 aa, Giardia lamblia
RESEARNST

SEQ ID NO: 3205469 - protein, 10 aa, Giardia lamblia
RETSKLCGTG

SEQ ID NO: 3205470 - protein, 31 aa, Giardia lamblia
RGENAKLQDELAEAKRQASAALHEKSQNENL

SEQ ID NO: 3205471 - protein, 7 aa, Giardia lamblia
RGERDTP

SEQ ID NO: 3205472 - protein, 7 aa, Giardia lamblia
RGETTNG

SEQ ID NO: 3205473 - protein, 5 aa, Giardia lamblia
RGHSD

SEQ ID NO: 3205474 - protein, 10 aa, Giardia lamblia
RGNRAQKYSS

SEQ ID NO: 3205475 - protein, 7 aa, Giardia lamblia
RGNYAGR

SEQ ID NO: 3205476 - protein, 4 aa, Giardia lamblia
RGPR

SEQ ID NO: 3205477 - protein, 4 aa, Giardia lamblia
RGQH

SEQ ID NO: 3205478 - protein, 9 aa, Giardia lamblia
RGTNTTGVF

SEQ ID NO: 3205479 - protein, 5 aa, Giardia lamblia
RITAN

SEQ ID NO: 3205480 - protein, 8 aa, Giardia lamblia
RKDGKPLY

SEQ ID NO: 3205481 - protein, 9 aa, Giardia lamblia
RKDPPDRAT

SEQ ID NO: 3205482 - protein, 5 aa, Giardia lamblia
RKGDY

SEQ ID NO: 3205483 - protein, 29 aa, Giardia lamblia
RKRKSMKKKKRRKKRKRRKRAKKRRRPRN

SEQ ID NO: 3205484 - protein, 9 aa, Giardia lamblia
RKRNGDPRC

SEQ ID NO: 3205485 - protein, 4 aa, Giardia lamblia
RKST

SEQ ID NO: 3205486 - protein, 26 aa, Giardia lamblia
RKSVPHKTQAVDGQSSLSQNSSYDDY

SEQ ID NO: 3205487 - protein, 5 aa, Giardia lamblia
RKTLA

SEQ ID NO: 3205488 - protein, 8 aa, Giardia lamblia
RKTSDTKG

SEQ ID NO: 3205489 - protein, 6 aa, Giardia lamblia
RKTSYD

SEQ ID NO: 3205490 - protein, 5 aa, Giardia lamblia
RKTTN

SEQ ID NO: 3205491 - protein, 6 aa, Giardia lamblia
RKYGGD

SEQ ID NO: 3205492 - protein, 4 aa, Giardia lamblia
RLPD

SEQ ID NO: 3205493 - protein, 43 aa, Giardia lamblia; identical to SEQ ID NO: 3133542

SEQ ID NO: 3205494 - protein, 4 aa, Giardia lamblia
RMSE

SEQ ID NO: 3205495 - protein, 11 aa, Giardia lamblia
RNAPGIQQYGQ

SEQ ID NO: 3205496 - protein, 35 aa, Giardia lamblia
RNASGRKTSCNARSASNCGKAKSNMHNSAHNAQRK

SEQ ID NO: 3205497 - protein, 5 aa, Giardia lamblia
RNDVE

SEQ ID NO: 3205498 - protein, 10 aa, Giardia lamblia
RNNVQGDAEA

SEQ ID NO: 3205499 - protein, 5 aa, Giardia lamblia
RNSKN

SEQ ID NO: 3205500 - protein, 6 aa, Giardia lamblia
RNTDLE

SEQ ID NO: 3205501 - protein, 8 aa, Giardia lamblia
RPAPTPLD

SEQ ID NO: 3205502 - protein, 5 aa, Giardia lamblia
RPFDG

SEQ ID NO: 3205503 - protein, 6 aa, Giardia lamblia
RPLPQF

SEQ ID NO: 3205504 - protein, 12 aa, Giardia lamblia
RPPAPDGPGSPW

SEQ ID NO: 3205505 - protein, 7 aa, Giardia lamblia
RPPSPAK

SEQ ID NO: 3205506 - protein, 8 aa, Giardia lamblia
RPPTSQPT

SEQ ID NO: 3205507 - protein, 4 aa, Giardia lamblia
RPPW

SEQ ID NO: 3205508 - protein, 17 aa, Giardia lamblia
RPRSEPKRLSPPNRPVA

SEQ ID NO: 3205509 - protein, 12 aa, Giardia lamblia
RPSASAPEDASD

SEQ ID NO: 3205510 - protein, 11 aa, Giardia lamblia
RPSDRKRDTYS

SEQ ID NO: 3205511 - protein, 9 aa, Giardia lamblia
RPSEDYNGT

SEQ ID NO: 3205512 - protein, 6 aa, Giardia lamblia
RPSLGP

SEQ ID NO: 3205513 - protein, 7 aa, Giardia lamblia
RPSSSTV

SEQ ID NO: 3205514 - protein, 8 aa, Giardia lamblia
RPSSSTVA

SEQ ID NO: 3205515 - protein, 7 aa, Giardia lamblia
RPSTATT

SEQ ID NO: 3205516 - protein, 5 aa, Giardia lamblia
RPSTN

SEQ ID NO: 3205517 - protein, 24 aa, Giardia lamblia
RPTKTSARTISSYTPSTRRAASGA

SEQ ID NO: 3205518 - protein, 16 aa, Giardia lamblia
RPTTEESEHLSNNSVT

SEQ ID NO: 3205519 - protein, 5 aa, Giardia lamblia
RPVQY

SEQ ID NO: 3205520 - protein, 4 aa, Giardia lamblia
RQAV

SEQ ID NO: 3205521 - protein, 6 aa, Giardia lamblia
RQGEIE

SEQ ID NO: 3205522 - protein, 7 aa, Giardia lamblia
RQGSQGY

SEQ ID NO: 3205523 - protein, 4 aa, Giardia lamblia
RQPE

SEQ ID NO: 3205524 - protein, 8 aa, Giardia lamblia
RQPQTKRN

SEQ ID NO: 3205525 - protein, 9 aa, Giardia lamblia
RQQAREAGE

SEQ ID NO: 3205526 - protein, 18 aa, Giardia lamblia
RQRDTNLTDSSSNSLQRL

SEQ ID NO: 3205527 - protein, 4 aa, Giardia lamblia
RQSC

SEQ ID NO: 3205528 - protein, 4 aa, Giardia lamblia
RQSL

SEQ ID NO: 3205529 - protein, 14 aa, Giardia lamblia
RQSLAQESEHGAFT

SEQ ID NO: 3205530 - protein, 17 aa, Giardia lamblia
RQSLEQPLERSSVPPLQ

SEQ ID NO: 3205531 - protein, 8 aa, Giardia lamblia
RQSPLTQR

SEQ ID NO: 3205532 - protein, 8 aa, Giardia lamblia
RQTTKTSN

SEQ ID NO: 3205533 - protein, 21 aa, Giardia lamblia
RQVGDDSASGDDATYMISQPP

SEQ ID NO: 3205534 - protein, 16 aa, Giardia lamblia
RREEYTPSADEEDDDV

SEQ ID NO: 3205535 - protein, 19 aa, Giardia lamblia
RRLNNERKKSTCDGSHPWP

SEQ ID NO: 3205536 - protein, 8 aa, Giardia lamblia
RRPPAIPR

SEQ ID NO: 3205537 - protein, 8 aa, Giardia lamblia
RRRGAPVK

SEQ ID NO: 3205538 - protein, 15 aa, Giardia lamblia
RRRSSESVGSKCAAS

SEQ ID NO: 3205539 - protein, 36 aa, Giardia lamblia
RRTKRRPARTRSSRRRARSAGSSQSTALKAGASRSK

SEQ ID NO: 3205540 - protein, 24 aa, Giardia lamblia
RSAAPTAMSPKTSEEHASGPSGFS

SEQ ID NO: 3205541 - protein, 8 aa, Giardia lamblia
RSADRLRT

SEQ ID NO: 3205542 - protein, 10 aa, Giardia lamblia
RSDPTLAQNP

SEQ ID NO: 3205543 - protein, 5 aa, Giardia lamblia
RSDSK

SEQ ID NO: 3205544 - protein, 5 aa, Giardia lamblia
RSEDL

SEQ ID NO: 3205545 - protein, 7 aa, Giardia lamblia
RSESPIT

SEQ ID NO: 3205546 - protein, 7 aa, Giardia lamblia
RSGASGI

SEQ ID NO: 3205547 - protein, 12 aa, Giardia lamblia
RSGRTDRGVSAA

SEQ ID NO: 3205548 - protein, 31 aa, Giardia lamblia
RSIRTSSRGRDYGDRFRRSSNSEYEYSGDYD

SEQ ID NO: 3205549 - protein, 4 aa, Giardia lamblia
RSKE

SEQ ID NO: 3205550 - protein, 24 aa, Giardia lamblia
RSKNDGGKIHPDDAGQDSNEFMND

SEQ ID NO: 3205551 - protein, 12 aa, Giardia lamblia
RSKTALSANTET

SEQ ID NO: 3205552 - protein, 9 aa, Giardia lamblia
RSNTSASKL

SEQ ID NO: 3205553 - protein, 19 aa, Giardia lamblia
RSPDSQVEPSERRAEVNQS

SEQ ID NO: 3205554 - protein, 40 aa, Giardia lamblia
RSPPPPQDEPACEGDGRYDEKGDNDCHGDRRGAGAGLPGL

SEQ ID NO: 3205555 - protein, 9 aa, Giardia lamblia
RSPRAPREW

SEQ ID NO: 3205556 - protein, 5 aa, Giardia lamblia
RSSAG

SEQ ID NO: 3205557 - protein, 6 aa, Giardia lamblia
RSSPEL

SEQ ID NO: 3205558 - protein, 68 aa, Giardia lamblia
RSSSKTASTSRSRTAPKKTVQSRSSVTGNASRSAVARPTARAITKPTQSKRAPVRALPRSTNKPIVRR

SEQ ID NO: 3205559 - protein, 6 aa, Giardia lamblia
RSTPIA

SEQ ID NO: 3205560 - protein, 13 aa, Giardia lamblia
RSTTASIADEGGH

SEQ ID NO: 3205561 - protein, 14 aa, Giardia lamblia
RSTTPPVGAPESYD

SEQ ID NO: 3205562 - protein, 64 aa, Giardia lamblia
RSVSANTRAAAYSGASPSKSMSPYRSTTSRSRQLRTPVTPGTGSGRGASRTPRTPTEPRSLTQQ

SEQ ID NO: 3205563 - protein, 4 aa, Giardia lamblia
RTAK

SEQ ID NO: 3205564 - protein, 5 aa, Giardia lamblia
RTCDG

SEQ ID NO: 3205565 - protein, 5 aa, Giardia lamblia
RTCEK

SEQ ID NO: 3205566 - protein, 15 aa, Giardia lamblia
RTCQSVSSGGPPRAC

SEQ ID NO: 3205567 - protein, 8 aa, Giardia lamblia
RTDADKSD

SEQ ID NO: 3205568 - protein, 8 aa, Giardia lamblia
RTGGRPGM

SEQ ID NO: 3205569 - protein, 4 aa, Giardia lamblia
RTGH

SEQ ID NO: 3205570 - protein, 10 aa, Giardia lamblia
RTGHNVPTAT

SEQ ID NO: 3205571 - protein, 6 aa, Giardia lamblia
RTGSTY

SEQ ID NO: 3205572 - protein, 14 aa, Giardia lamblia
RTKEALASAGQPVY

SEQ ID NO: 3205573 - protein, 23 aa, Giardia lamblia
RTKSESQLTQKSPLLTKGKKASR

SEQ ID NO: 3205574 - protein, 7 aa, Giardia lamblia
RTNATSM

SEQ ID NO: 3205575 - protein, 28 aa, Giardia lamblia
RTPDNAKAPRPGSRPRAMSQKSNDLRSS

SEQ ID NO: 3205576 - protein, 12 aa, Giardia lamblia
RTPYDPQNTSHC

SEQ ID NO: 3205577 - protein, 9 aa, Giardia lamblia
RTQTDGGYT

SEQ ID NO: 3205578 - protein, 5 aa, Giardia lamblia
RTRKL

SEQ ID NO: 3205579 - protein, 4 aa, Giardia lamblia
RTRY

SEQ ID NO: 3205580 - protein, 9 aa, Giardia lamblia
RVDNKGKTS

SEQ ID NO: 3205581 - protein, 5 aa, Giardia lamblia
RVEGG

SEQ ID NO: 3205582 - protein, 6 aa, Giardia lamblia
RVGPST

SEQ ID NO: 3205583 - protein, 6 aa, Giardia lamblia
RVTPKQ

SEQ ID NO: 3205584 - protein, 4 aa, Giardia lamblia
RVTS

SEQ ID NO: 3205585 - protein, 10 aa, Giardia lamblia
SADGESTLSG

SEQ ID NO: 3205586 - protein, 6 aa, Giardia lamblia
SADPGE

SEQ ID NO: 3205587 - protein, 5 aa, Giardia lamblia
SAEHE

SEQ ID NO: 3205588 - protein, 15 aa, Giardia lamblia
SAGAARRGAGLCGPG

SEQ ID NO: 3205589 - protein, 7 aa, Giardia lamblia
SAGHHAP

SEQ ID NO: 3205590 - protein, 12 aa, Giardia lamblia
SAGTATSREAES

SEQ ID NO: 3205591 - protein, 7 aa, Giardia lamblia
SAKRDTE

SEQ ID NO: 3205592 - protein, 7 aa, Giardia lamblia
SALDEPG

SEQ ID NO: 3205593 - protein, 9 aa, Giardia lamblia
SAMADNQKL

SEQ ID NO: 3205594 - protein, 22 aa, Giardia lamblia
SANCTDIEKPPTVRFPSNTSDL

SEQ ID NO: 3205595 - protein, 8 aa, Giardia lamblia
SANERDGF

SEQ ID NO: 3205596 - protein, 14 aa, Giardia lamblia
SANPQVQMLLQATE

SEQ ID NO: 3205597 - protein, 17 aa, Giardia lamblia
SAPARAGMPRPRPPTRG

SEQ ID NO: 3205598 - protein, 6 aa, Giardia lamblia
SAPTSS

SEQ ID NO: 3205599 - protein, 6 aa, Giardia lamblia
SAQARA

SEQ ID NO: 3205600 - protein, 16 aa, Giardia lamblia
SAQPRGLGHATGRQRY

SEQ ID NO: 3205601 - protein, 9 aa, Giardia lamblia
SARHSTSSR

SEQ ID NO: 3205602 - protein, 13 aa, Giardia lamblia
SASRSQQKVDALN

SEQ ID NO: 3205603 - protein, 11 aa, Giardia lamblia
SATLPQPPAGI

SEQ ID NO: 3205604 - protein, 7 aa, Giardia lamblia
SAVTPTE

SEQ ID NO: 3205605 - protein, 5 aa, Giardia lamblia
SCPAG

SEQ ID NO: 3205606 - protein, 7 aa, Giardia lamblia
SCQQRKD

SEQ ID NO: 3205607 - protein, 9 aa, Giardia lamblia
SDADSSDII

SEQ ID NO: 3205608 - protein, 7 aa, Giardia lamblia
SDASSYY

SEQ ID NO: 3205609 - protein, 9 aa, Giardia lamblia
SDATSVPQL

SEQ ID NO: 3205610 - protein, 7 aa, Giardia lamblia
SDDAPEG

SEQ ID NO: 3205611 - protein, 8 aa, Giardia lamblia
SDDQERTV

SEQ ID NO: 3205612 - protein, 7 aa, Giardia lamblia
SDEDPPV

SEQ ID NO: 3205613 - protein, 9 aa, Giardia lamblia
SDEEQTQKN

SEQ ID NO: 3205614 - protein, 41 aa, Giardia lamblia
SDETKRKEYDSGQYRREELESREQAHQRRKMGKANQGQQQE

SEQ ID NO: 3205615 - protein, 15 aa, Giardia lamblia
SDGTRGSLPGQPRGV

SEQ ID NO: 3205616 - protein, 16 aa, Giardia lamblia
SDHQNKAKYEFKAETT

SEQ ID NO: 3205617 - protein, 4 aa, Giardia lamblia
SDLS

SEQ ID NO: 3205618 - protein, 4 aa, Giardia lamblia
SDNF

SEQ ID NO: 3205619 - protein, 18 aa, Giardia lamblia
SDPHLTDPSISSPLDTSS

SEQ ID NO: 3205620 - protein, 9 aa, Giardia lamblia
SDPQVESRT

SEQ ID NO: 3205621 - protein, 5 aa, Giardia lamblia
SDPSH

SEQ ID NO: 3205622 - protein, 8 aa, Giardia lamblia
SDQLASDL

SEQ ID NO: 3205623 - protein, 8 aa, Giardia lamblia
SDRNTVRQ

SEQ ID NO: 3205624 - protein, 8 aa, Giardia lamblia
SDRTKERM

SEQ ID NO: 3205625 - protein, 8 aa, Giardia lamblia
SDSEAVTS

SEQ ID NO: 3205626 - protein, 8 aa, Giardia lamblia
SDSMSSSA

SEQ ID NO: 3205627 - protein, 6 aa, Giardia lamblia
SDTAAA

SEQ ID NO: 3205628 - protein, 5 aa, Giardia lamblia
SDTGS

SEQ ID NO: 3205629 - protein, 11 aa, Giardia lamblia
SDVDADARPTN

SEQ ID NO: 3205630 - protein, 5 aa, Giardia lamblia
SDWKE

SEQ ID NO: 3205631 - protein, 5 aa, Giardia lamblia
SEAGV

SEQ ID NO: 3205632 - protein, 17 aa, Giardia lamblia
SECSAQAQKALAESTRL

SEQ ID NO: 3205633 - protein, 27 aa, Giardia lamblia
SECTTSAGVPLNQEGADPMSLSSGPLK

SEQ ID NO: 3205634 - protein, 9 aa, Giardia lamblia
SEDDAGSDV

SEQ ID NO: 3205635 - protein, 8 aa, Giardia lamblia
SEDTCDSV

SEQ ID NO: 3205636 - protein, 8 aa, Giardia lamblia
SEENQKRV

SEQ ID NO: 3205637 - protein, 5 aa, Giardia lamblia
SEGES

SEQ ID NO: 3205638 - protein, 4 aa, Giardia lamblia
SELD

SEQ ID NO: 3205639 - protein, 18 aa, Giardia lamblia
SEPSGAASTVSVPAPENK

SEQ ID NO: 3205640 - protein, 22 aa, Giardia lamblia
SEQRAAPAPEAPSPAEQEEDSI

SEQ ID NO: 3205641 - protein, 10 aa, Giardia lamblia
SERREQDHEG

SEQ ID NO: 3205642 - protein, 7 aa, Giardia lamblia
SERSDGK

SEQ ID NO: 3205643 - protein, 7 aa, Giardia lamblia
SETPANS

SEQ ID NO: 3205644 - protein, 6 aa, Giardia lamblia
SETPSL

SEQ ID NO: 3205645 - protein, 5 aa, Giardia lamblia
SETQE

SEQ ID NO: 3205646 - protein, 11 aa, Giardia lamblia
SEVTSSSNSTV

SEQ ID NO: 3205647 - protein, 8 aa, Giardia lamblia
SEYEHGNA

SEQ ID NO: 3205648 - protein, 5 aa, Giardia lamblia
SFPPN

SEQ ID NO: 3205649 - protein, 12 aa, Giardia lamblia
SFTKTAKERSLS

SEQ ID NO: 3205650 - protein, 5 aa, Giardia lamblia
SGAKD

SEQ ID NO: 3205651 - protein, 8 aa, Giardia lamblia
SGAKKAEM

SEQ ID NO: 3205652 - protein, 7 aa, Giardia lamblia
SGANTKG

SEQ ID NO: 3205653 - protein, 6 aa, Giardia lamblia
SGAYPP

SEQ ID NO: 3205654 - protein, 9 aa, Giardia lamblia
SGDTRPSPA

SEQ ID NO: 3205655 - protein, 10 aa, Giardia lamblia
SGDVCSGGGS

SEQ ID NO: 3205656 - protein, 6 aa, Giardia lamblia
SGEEGN

SEQ ID NO: 3205657 - protein, 6 aa, Giardia lamblia
SGEPIR

SEQ ID NO: 3205658 - protein, 21 aa, Giardia lamblia
SGESGHSDSSQEEPTSGPLSR

SEQ ID NO: 3205659 - protein, 15 aa, Giardia lamblia
SGGDSDKKDEPPLGL

SEQ ID NO: 3205660 - protein, 4 aa, Giardia lamblia
SGHR

SEQ ID NO: 3205661 - protein, 8 aa, Giardia lamblia
SGIGPTDL

SEQ ID NO: 3205662 - protein, 5 aa, Giardia lamblia
SGING

SEQ ID NO: 3205663 - protein, 4 aa, Giardia lamblia
SGKE

SEQ ID NO: 3205664 - protein, 8 aa, Giardia lamblia
SGLADVDR

SEQ ID NO: 3205665 - protein, 9 aa, Giardia lamblia
SGLDATGVS

SEQ ID NO: 3205666 - protein, 10 aa, Giardia lamblia
SGNGPSSDPE

SEQ ID NO: 3205667 - protein, 17 aa, Giardia lamblia
SGRDESHAKPQATSLAE

SEQ ID NO: 3205668 - protein, 6 aa, Giardia lamblia
SGRGDC

SEQ ID NO: 3205669 - protein, 14 aa, Giardia lamblia
SGRPRCGGSSCRTG

SEQ ID NO: 3205670 - protein, 13 aa, Giardia lamblia
SGTETSASDALPA

SEQ ID NO: 3205671 - protein, 8 aa, Giardia lamblia
SGYNGPTC

SEQ ID NO: 3205672 - protein, 8 aa, Giardia lamblia
SHGVDAAA

SEQ ID NO: 3205673 - protein, 9 aa, Giardia lamblia
SHISRTNSY

SEQ ID NO: 3205674 - protein, 5 aa, Giardia lamblia
SHTPV

SEQ ID NO: 3205675 - protein, 4 aa, Giardia lamblia
SIDQ

SEQ ID NO: 3205676 - protein, 4 aa, Giardia lamblia
SIGS

SEQ ID NO: 3205677 - protein, 6 aa, Giardia lamblia
SIKPDD

SEQ ID NO: 3205678 - protein, 7 aa, Giardia lamblia
SIPSTPT

SEQ ID NO: 3205679 - protein, 6 aa, Giardia lamblia
SIPTPF

SEQ ID NO: 3205680 - protein, 12 aa, Giardia lamblia
SISGNNPYGTPR

SEQ ID NO: 3205681 - protein, 6 aa, Giardia lamblia
SISGTR

SEQ ID NO: 3205682 - protein, 5 aa, Giardia lamblia
SITPD

SEQ ID NO: 3205683 - protein, 13 aa, Giardia lamblia
SITSDTAQQDKAI

SEQ ID NO: 3205684 - protein, 10 aa, Giardia lamblia
SIYNSTGYDK

SEQ ID NO: 3205685 - protein, 5 aa, Giardia lamblia
SIYSA

SEQ ID NO: 3205686 - protein, 6 aa, Giardia lamblia
SKAASS

SEQ ID NO: 3205687 - protein, 8 aa, Giardia lamblia
SKASTSAS

SEQ ID NO: 3205688 - protein, 4 aa, Giardia lamblia
SKAY

SEQ ID NO: 3205689 - protein, 72 aa, Giardia lamblia
SKENTRTSRDMSNTAKAGETDAPPSVSKNVRSTDVHSTSVGEFTPSGTQELSETSTRIEEGSYPFNASQDQV

SEQ ID NO: 3205690 - protein, 7 aa, Giardia lamblia
SKKPLSR

SEQ ID NO: 3205691 - protein, 8 aa, Giardia lamblia
SKNNLNDG

SEQ ID NO: 3205692 - protein, 12 aa, Giardia lamblia
SKPVKSLPLKNG

SEQ ID NO: 3205693 - protein, 6 aa, Giardia lamblia
SKQAQS

SEQ ID NO: 3205694 - protein, 5 aa, Giardia lamblia
SKQLQ

SEQ ID NO: 3205695 - protein, 7 aa, Giardia lamblia
SKSCCDS

SEQ ID NO: 3205696 - protein, 9 aa, Giardia lamblia
SKTLSSSQQ

SEQ ID NO: 3205697 - protein, 6 aa, Giardia lamblia
SKTSLA

SEQ ID NO: 3205698 - protein, 9 aa, Giardia lamblia
SKVSGQTPV

SEQ ID NO: 3205699 - protein, 9 aa, Giardia lamblia
SLAKSPDTT

SEQ ID NO: 3205700 - protein, 6 aa, Giardia lamblia
SLEEAS

SEQ ID NO: 3205701 - protein, 11 aa, Giardia lamblia
SLEPTSTGTAR

SEQ ID NO: 3205702 - protein, 34 aa, Giardia lamblia
SLGNSTLESGSTGESPDATRNGSITTKEKGTRTH

SEQ ID NO: 3205703 - protein, 17 aa, Giardia lamblia
SLKSQTPDALGSPDPAD

SEQ ID NO: 3205704 - protein, 15 aa, Giardia lamblia
SLNEEGQYKSSQFDT

SEQ ID NO: 3205705 - protein, 6 aa, Giardia lamblia
SLPTAN

SEQ ID NO: 3205706 - protein, 11 aa, Giardia lamblia
SLQSQPSAQLQ

SEQ ID NO: 3205707 - protein, 35 aa, Giardia lamblia
SLRAGHDRRAAPSQGCHGTGGRARCSTIEQDGFTG

SEQ ID NO: 3205708 - protein, 4 aa, Giardia lamblia
SLRT

SEQ ID NO: 3205709 - protein, 5 aa, Giardia lamblia
SLSKT

SEQ ID NO: 3205710 - protein, 8 aa, Giardia lamblia
SLSTSAGM

SEQ ID NO: 3205711 - protein, 10 aa, Giardia lamblia
SLTEKGGTGA

SEQ ID NO: 3205712 - protein, 22 aa, Giardia lamblia
SLTESGLARPQISVPDDSSDTF

SEQ ID NO: 3205713 - protein, 6 aa, Giardia lamblia
SMDTGY

SEQ ID NO: 3205714 - protein, 15 aa, Giardia lamblia
SMKNESSYSAFSDPV

SEQ ID NO: 3205715 - protein, 7 aa, Giardia lamblia
SMPSDSY

SEQ ID NO: 3205716 - protein, 7 aa, Giardia lamblia
SMTTNSS

SEQ ID NO: 3205717 - protein, 18 aa, Giardia lamblia
SNAAAKYYPESPEGKELQ

SEQ ID NO: 3205718 - protein, 4 aa, Giardia lamblia
SNAQ

SEQ ID NO: 3205719 - protein, 13 aa, Giardia lamblia
SNATPLSHKPNRT

SEQ ID NO: 3205720 - protein, 5 aa, Giardia lamblia
SNECD

SEQ ID NO: 3205721 - protein, 7 aa, Giardia lamblia
SNEKLTT

SEQ ID NO: 3205722 - protein, 5 aa, Giardia lamblia
SNELD

SEQ ID NO: 3205723 - protein, 7 aa, Giardia lamblia
SNGPYSS

SEQ ID NO: 3205724 - protein, 4 aa, Giardia lamblia
SNHE

SEQ ID NO: 3205725 - protein, 6 aa, Giardia lamblia
SNLDAA

SEQ ID NO: 3205726 - protein, 5 aa, Giardia lamblia
SNMRP

SEQ ID NO: 3205727 - protein, 15 aa, Giardia lamblia
SNNDKTKCANSNITK

SEQ ID NO: 3205728 - protein, 19 aa, Giardia lamblia
SNNQESCKNGGTCVKSNGE

SEQ ID NO: 3205729 - protein, 9 aa, Giardia lamblia
SNPPPSSNI

SEQ ID NO: 3205730 - protein, 4 aa, Giardia lamblia
SNVT

SEQ ID NO: 3205731 - protein, 11 aa, Giardia lamblia
SPAGARTHDSS

SEQ ID NO: 3205732 - protein, 12 aa, Giardia lamblia
SPHNSTRLNQSD

SEQ ID NO: 3205733 - protein, 8 aa, Giardia lamblia
SPHTPSTT

SEQ ID NO: 3205734 - protein, 6 aa, Giardia lamblia
SPKPCG

SEQ ID NO: 3205735 - protein, 6 aa, Giardia lamblia
SPLPKA

SEQ ID NO: 3205736 - protein, 8 aa, Giardia lamblia
SPLPRKPR

SEQ ID NO: 3205737 - protein, 12 aa, Giardia lamblia
SPRHGGTGTDDR

SEQ ID NO: 3205738 - protein, 15 aa, Giardia lamblia
SPRPCALPSDVISIT

SEQ ID NO: 3205739 - protein, 5 aa, Giardia lamblia
SPRRA

SEQ ID NO: 3205740 - protein, 4 aa, Giardia lamblia
SPST

SEQ ID NO: 3205741 - protein, 4 aa, Giardia lamblia
SPSY

SEQ ID NO: 3205742 - protein, 10 aa, Giardia lamblia
SPVSPPPTSH

SEQ ID NO: 3205743 - protein, 7 aa, Giardia lamblia
SPYGNPR

SEQ ID NO: 3205744 - protein, 4 aa, Giardia lamblia
SPYP

SEQ ID NO: 3205745 - protein, 11 aa, Giardia lamblia
SPYTEAANTRG

SEQ ID NO: 3205746 - protein, 9 aa, Giardia lamblia
SQAPPQPVY

SEQ ID NO: 3205747 - protein, 12 aa, Giardia lamblia
SQKQSEKQTQAM

SEQ ID NO: 3205748 - protein, 5 aa, Giardia lamblia
SQNCT

SEQ ID NO: 3205749 - protein, 10 aa, Giardia lamblia
SQNRERTSFY

SEQ ID NO: 3205750 - protein, 6 aa, Giardia lamblia
SQPEDR

SEQ ID NO: 3205751 - protein, 10 aa, Giardia lamblia
SQPSGDTSLA

SEQ ID NO: 3205752 - protein, 9 aa, Giardia lamblia
SQSHPEEYE

SEQ ID NO: 3205753 - protein, 7 aa, Giardia lamblia
SQSPVSV

SEQ ID NO: 3205754 - protein, 11 aa, Giardia lamblia
SREGQTHPHNT

SEQ ID NO: 3205755 - protein, 9 aa, Giardia lamblia
SRGDEDALN

SEQ ID NO: 3205756 - protein, 9 aa, Giardia lamblia
SRGRGRGGA

SEQ ID NO: 3205757 - protein, 11 aa, Giardia lamblia
SRKGEYRTDQR

SEQ ID NO: 3205758 - protein, 29 aa, Giardia lamblia
SRPSTSSNTPSRATISAHQKGSRKSVVDQ

SEQ ID NO: 3205759 - protein, 7 aa, Giardia lamblia
SRPTTTY

SEQ ID NO: 3205760 - protein, 7 aa, Giardia lamblia
SRQRNEL

SEQ ID NO: 3205761 - protein, 16 aa, Giardia lamblia
SRQSSPKELSNDHATA

SEQ ID NO: 3205762 - protein, 20 aa, Giardia lamblia
SRRASGGRRRRGRSSSPPCG

SEQ ID NO: 3205763 - protein, 5 aa, Giardia lamblia
SRRKL

SEQ ID NO: 3205764 - protein, 7 aa, Giardia lamblia
SRSEPSV

SEQ ID NO: 3205765 - protein, 7 aa, Giardia lamblia
SRSTVDE

SEQ ID NO: 3205766 - protein, 5 aa, Giardia lamblia
SRTDH

SEQ ID NO: 3205767 - protein, 15 aa, Giardia lamblia
SRTQDFGGQGSRHPR

SEQ ID NO: 3205768 - protein, 29 aa, Giardia lamblia
SRTQGFGGQGSRHPRESRSLEAAEEPAKN

SEQ ID NO: 3205769 - protein, 9 aa, Giardia lamblia
SSADDSSQF

SEQ ID NO: 3205770 - protein, 8 aa, Giardia lamblia
SSAEPSDV

SEQ ID NO: 3205771 - protein, 9 aa, Giardia lamblia
SSAQPVSRH

SEQ ID NO: 3205772 - protein, 9 aa, Giardia lamblia
SSASPRRPL

SEQ ID NO: 3205773 - protein, 10 aa, Giardia lamblia
SSCESEDSSS

SEQ ID NO: 3205774 - protein, 7 aa, Giardia lamblia
SSDDLEK

SEQ ID NO: 3205775 - protein, 30 aa, Giardia lamblia
SSDEKRKIYDKGGEKALTEHESNNNPNQQQ

SEQ ID NO: 3205776 - protein, 6 aa, Giardia lamblia
SSDEPM

SEQ ID NO: 3205777 - protein, 18 aa, Giardia lamblia
SSEASADRAGATTPNYDP

SEQ ID NO: 3205778 - protein, 18 aa, Giardia lamblia
SSEKPAHRDARGASSGGM

SEQ ID NO: 3205779 - protein, 6 aa, Giardia lamblia
SSFDSY

SEQ ID NO: 3205780 - protein, 6 aa, Giardia lamblia
SSFGPP

SEQ ID NO: 3205781 - protein, 9 aa, Giardia lamblia
SSGLTDDQR

SEQ ID NO: 3205782 - protein, 8 aa, Giardia lamblia
SSGTAKLA

SEQ ID NO: 3205783 - protein, 6 aa, Giardia lamblia
SSPQVS

SEQ ID NO: 3205784 - protein, 13 aa, Giardia lamblia
SSQAAAKKLKQAH

SEQ ID NO: 3205785 - protein, 14 aa, Giardia lamblia
SSQEISDLSPSFDG

SEQ ID NO: 3205786 - protein, 9 aa, Giardia lamblia
SSRSSMHTR

SEQ ID NO: 3205787 - protein, 8 aa, Giardia lamblia
SSSGPYLA

SEQ ID NO: 3205788 - protein, 7 aa, Giardia lamblia
SSSNPNI

SEQ ID NO: 3205789 - protein, 11 aa, Giardia lamblia
SSSSAPKSHGV

SEQ ID NO: 3205790 - protein, 25 aa, Giardia lamblia
SSSSEPEKDDISRDESGTVASVQPV

SEQ ID NO: 3205791 - protein, 11 aa, Giardia lamblia
SSSTAASGITT

SEQ ID NO: 3205792 - protein, 5 aa, Giardia lamblia
SSTAP

SEQ ID NO: 3205793 - protein, 4 aa, Giardia lamblia
SSTC

SEQ ID NO: 3205794 - protein, 23 aa, Giardia lamblia
SSTQEQKPTSGGCSGSSDPSQRC

SEQ ID NO: 3205795 - protein, 10 aa, Giardia lamblia
SSTTSPQTST

SEQ ID NO: 3205796 - protein, 16 aa, Giardia lamblia
SSVAGRDSFAAENATD

SEQ ID NO: 3205797 - protein, 11 aa, Giardia lamblia
SSYDLSAPSIE

SEQ ID NO: 3205798 - protein, 13 aa, Giardia lamblia
SSYRPSSSVTKAG

SEQ ID NO: 3205799 - protein, 6 aa, Giardia lamblia
SSYRSR

SEQ ID NO: 3205800 - protein, 6 aa, Giardia lamblia
SSYTFD

SEQ ID NO: 3205801 - protein, 9 aa, Giardia lamblia
STASGSVDA

SEQ ID NO: 3205802 - protein, 16 aa, Giardia lamblia
STDAHPDEVASTGKTH

SEQ ID NO: 3205803 - protein, 6 aa, Giardia lamblia
STDGAN

SEQ ID NO: 3205804 - protein, 10 aa, Giardia lamblia
STEGGKTALP

SEQ ID NO: 3205805 - protein, 10 aa, Giardia lamblia
STESARPPRA

SEQ ID NO: 3205806 - protein, 6 aa, Giardia lamblia
STFPSR

SEQ ID NO: 3205807 - protein, 8 aa, Giardia lamblia
STGPDGKS

SEQ ID NO: 3205808 - protein, 5 aa, Giardia lamblia
STGQY

SEQ ID NO: 3205809 - protein, 12 aa, Giardia lamblia
STGSHSKAFESG

SEQ ID NO: 3205810 - protein, 11 aa, Giardia lamblia
STHDEDHRKDV

SEQ ID NO: 3205811 - protein, 8 aa, Giardia lamblia
STLSQPRY

SEQ ID NO: 3205812 - protein, 6 aa, Giardia lamblia
STPEMD

SEQ ID NO: 3205813 - protein, 5 aa, Giardia lamblia
STPTY

SEQ ID NO: 3205814 - protein, 11 aa, Giardia lamblia
STQPNDSSDPM

SEQ ID NO: 3205815 - protein, 10 aa, Giardia lamblia
STRIDDNEET

SEQ ID NO: 3205816 - protein, 5 aa, Giardia lamblia
STRIP

SEQ ID NO: 3205817 - protein, 15 aa, Giardia lamblia
STRSAPSQRSGSGSL

SEQ ID NO: 3205818 - protein, 6 aa, Giardia lamblia
STSGPL

SEQ ID NO: 3205819 - protein, 21 aa, Giardia lamblia
STSPPSATESRCGADAPSYKG

SEQ ID NO: 3205820 - protein, 8 aa, Giardia lamblia
STSPSFSK

SEQ ID NO: 3205821 - protein, 16 aa, Giardia lamblia
STSTYHGRIPESLKIP

SEQ ID NO: 3205822 - protein, 13 aa, Giardia lamblia
STTCTYNQDPTGA

SEQ ID NO: 3205823 - protein, 7 aa, Giardia lamblia
STTPDPD

SEQ ID NO: 3205824 - protein, 5 aa, Giardia lamblia
STVKP

SEQ ID NO: 3205825 - protein, 10 aa, Giardia lamblia
STYLTGDSDS

SEQ ID NO: 3205826 - protein, 5 aa, Giardia lamblia
SVANS

SEQ ID NO: 3205827 - protein, 7 aa, Giardia lamblia
SVDEAGQ

SEQ ID NO: 3205828 - protein, 4 aa, Giardia lamblia
SVGD

SEQ ID NO: 3205829 - protein, 5 aa, Giardia lamblia
SVRTE

SEQ ID NO: 3205830 - protein, 8 aa, Giardia lamblia
SVSDARSI

SEQ ID NO: 3205831 - protein, 15 aa, Giardia lamblia
SVVQSQSGEATGKPM

SEQ ID NO: 3205832 - protein, 16 aa, Giardia lamblia
SVVQSQSGEATGKPMY

SEQ ID NO: 3205833 - protein, 18 aa, Giardia lamblia
SYCQPQPSTPTLSATTKI

SEQ ID NO: 3205834 - protein, 13 aa, Giardia lamblia
SYDSEDAAERSSD

SEQ ID NO: 3205835 - protein, 6 aa, Giardia lamblia
SYGRND

SEQ ID NO: 3205836 - protein, 38 aa, Giardia lamblia
SYPADNLPAPSDKKDPVPDPEPQPNPDPEPEPEPEPIG

SEQ ID NO: 3205837 - protein, 5 aa, Giardia lamblia
SYPGA

SEQ ID NO: 3205838 - protein, 5 aa, Giardia lamblia
SYPYD

SEQ ID NO: 3205839 - protein, 27 aa, Giardia lamblia
SYSVQGQGLGEPHPSSQQRSLQPSGRK

SEQ ID NO: 3205840 - protein, 10 aa, Giardia lamblia
SYTGPTNESM

SEQ ID NO: 3205841 - protein, 6 aa, Giardia lamblia
SYTRPT

SEQ ID NO: 3205842 - protein, 5 aa, Giardia lamblia
SYVPD

SEQ ID NO: 3205843 - protein, 9 aa, Giardia lamblia
TAAGEFSNG

SEQ ID NO: 3205844 - protein, 13 aa, Giardia lamblia
TADKIKELTEGGL

SEQ ID NO: 3205845 - protein, 6 aa, Giardia lamblia
TAEKAR

SEQ ID NO: 3205846 - protein, 5 aa, Giardia lamblia
TAGDD

SEQ ID NO: 3205847 - protein, 5 aa, Giardia lamblia
TAGVD

SEQ ID NO: 3205848 - protein, 7 aa, Giardia lamblia
TAHDQQH

SEQ ID NO: 3205849 - protein, 13 aa, Giardia lamblia
TAPKNNGTLNGPL

SEQ ID NO: 3205850 - protein, 6 aa, Giardia lamblia
TAQELQ

SEQ ID NO: 3205851 - protein, 8 aa, Giardia lamblia
TARDNTTI

SEQ ID NO: 3205852 - protein, 7 aa, Giardia lamblia
TASGKTR

SEQ ID NO: 3205853 - protein, 11 aa, Giardia lamblia
TATRDPSDTMK

SEQ ID NO: 3205854 - protein, 4 aa, Giardia lamblia
TCIP

SEQ ID NO: 3205855 - protein, 6 aa, Giardia lamblia
TCTNTD

SEQ ID NO: 3205856 - protein, 9 aa, Giardia lamblia
TCTPGNMNT

SEQ ID NO: 3205857 - protein, 5 aa, Giardia lamblia
TDDVQ

SEQ ID NO: 3205858 - protein, 6 aa, Giardia lamblia
TDEGET

SEQ ID NO: 3205859 - protein, 9 aa, Giardia lamblia
TDESDGGVS

SEQ ID NO: 3205860 - protein, 6 aa, Giardia lamblia
TDGLED

SEQ ID NO: 3205861 - protein, 4 aa, Giardia lamblia
TDKE

SEQ ID NO: 3205862 - protein, 18 aa, Giardia lamblia
TDLSPDGSPVPLKAPKPV

SEQ ID NO: 3205863 - protein, 15 aa, Giardia lamblia
TDPSKYDCAQPDYAS

SEQ ID NO: 3205864 - protein, 8 aa, Giardia lamblia
TDSASIPS

SEQ ID NO: 3205865 - protein, 10 aa, Giardia lamblia
TDSKVGSTPA

SEQ ID NO: 3205866 - protein, 7 aa, Giardia lamblia
TDSTEDS

SEQ ID NO: 3205867 - protein, 8 aa, Giardia lamblia
TDSTENDR

SEQ ID NO: 3205868 - protein, 6 aa, Giardia lamblia
TDSTGP

SEQ ID NO: 3205869 - protein, 16 aa, Giardia lamblia
TDTTPPQQDASAEGLR

SEQ ID NO: 3205870 - protein, 9 aa, Giardia lamblia
TEAKARTRS

SEQ ID NO: 3205871 - protein, 9 aa, Giardia lamblia
TECTGSSKC

SEQ ID NO: 3205872 - protein, 4 aa, Giardia lamblia
TEDE

SEQ ID NO: 3205873 - protein, 6 aa, Giardia lamblia
TEEYAE

SEQ ID NO: 3205874 - protein, 7 aa, Giardia lamblia
TEGDTEK

SEQ ID NO: 3205875 - protein, 15 aa, Giardia lamblia
TEGQTEPDPGNGISA

SEQ ID NO: 3205876 - protein, 6 aa, Giardia lamblia
TEGWGT

SEQ ID NO: 3205877 - protein, 7 aa, Giardia lamblia
TEHTRKN

SEQ ID NO: 3205878 - protein, 5 aa, Giardia lamblia
TEKDS

SEQ ID NO: 3205879 - protein, 4 aa, Giardia lamblia
TEKP

SEQ ID NO: 3205880 - protein, 23 aa, Giardia lamblia
TEQERKAKEAALQKEKNAKKNEV

SEQ ID NO: 3205881 - protein, 9 aa, Giardia lamblia
TERATKRLD

SEQ ID NO: 3205882 - protein, 6 aa, Giardia lamblia
TERDNK

SEQ ID NO: 3205883 - protein, 6 aa, Giardia lamblia
TERNRT

SEQ ID NO: 3205884 - protein, 11 aa, Giardia lamblia
TERQSIKPSNM

SEQ ID NO: 3205885 - protein, 19 aa, Giardia lamblia
TESDELYKSTDKLYINVVL

SEQ ID NO: 3205886 - protein, 8 aa, Giardia lamblia
TETDPSLA

SEQ ID NO: 3205887 - protein, 4 aa, Giardia lamblia
TFEP

SEQ ID NO: 3205888 - protein, 7 aa, Giardia lamblia
TGDPQDD

SEQ ID NO: 3205889 - protein, 4 aa, Giardia lamblia
TGDV

SEQ ID NO: 3205890 - protein, 5 aa, Giardia lamblia
TGGAM

SEQ ID NO: 3205891 - protein, 6 aa, Giardia lamblia
TGGLGT

SEQ ID NO: 3205892 - protein, 6 aa, Giardia lamblia
TGGPLQ

SEQ ID NO: 3205893 - protein, 9 aa, Giardia lamblia
TGKCETVGS

SEQ ID NO: 3205894 - protein, 6 aa, Giardia lamblia
TGKLTE

SEQ ID NO: 3205895 - protein, 6 aa, Giardia lamblia
TGKSRV

SEQ ID NO: 3205896 - protein, 6 aa, Giardia lamblia
TGPECS

SEQ ID NO: 3205897 - protein, 4 aa, Giardia lamblia
TGPI

SEQ ID NO: 3205898 - protein, 5 aa, Giardia lamblia
TGSGL

SEQ ID NO: 3205899 - protein, 10 aa, Giardia lamblia
TGYLKENETI

SEQ ID NO: 3205900 - protein, 21 aa, Giardia lamblia
THGEPEPEERGAGPANGRAEV

SEQ ID NO: 3205901 - protein, 7 aa, Giardia lamblia
THKSRTD

SEQ ID NO: 3205902 - protein, 6 aa, Giardia lamblia
THNPAR

SEQ ID NO: 3205903 - protein, 4 aa, Giardia lamblia
TKAP

SEQ ID NO: 3205904 - protein, 4 aa, Giardia lamblia
TKAT

SEQ ID NO: 3205905 - protein, 12 aa, Giardia lamblia
TKEDREGMHESE

SEQ ID NO: 3205906 - protein, 11 aa, Giardia lamblia
TKEDRGAMHES

SEQ ID NO: 3205907 - protein, 8 aa, Giardia lamblia
TKKGGAVG

SEQ ID NO: 3205908 - protein, 11 aa, Giardia lamblia
TKKHSEGMDDP

SEQ ID NO: 3205909 - protein, 11 aa, Giardia lamblia
TKKHSEGMNDP

SEQ ID NO: 3205910 - protein, 11 aa, Giardia lamblia
TKKLGKPSSRS

SEQ ID NO: 3205911 - protein, 18 aa, Giardia lamblia
TKKQRSRSKAQSKSQSTN

SEQ ID NO: 3205912 - protein, 32 aa, Giardia lamblia
TKLPDKPKDDVSNEEEKEKERPDTDIPDRTED

SEQ ID NO: 3205913 - protein, 6 aa, Giardia lamblia
TKQDDS

SEQ ID NO: 3205914 - protein, 7 aa, Giardia lamblia
TKTGNQL

SEQ ID NO: 3205915 - protein, 5 aa, Giardia lamblia
TKTTP

SEQ ID NO: 3205916 - protein, 9 aa, Giardia lamblia
TKVSDGGKT

SEQ ID NO: 3205917 - protein, 5 aa, Giardia lamblia
TLPNE

SEQ ID NO: 3205918 - protein, 6 aa, Giardia lamblia
TLPPTN

SEQ ID NO: 3205919 - protein, 8 aa, Giardia lamblia
TLREKENE

SEQ ID NO: 3205920 - protein, 6 aa, Giardia lamblia
TLSGAA

SEQ ID NO: 3205921 - protein, 16 aa, Giardia lamblia
TNDGRDANPVFSSTDP

SEQ ID NO: 3205922 - protein, 7 aa, Giardia lamblia
TNEPPSL

SEQ ID NO: 3205923 - protein, 7 aa, Giardia lamblia
TNERNTR

SEQ ID NO: 3205924 - protein, 4 aa, Giardia lamblia
TNGM

SEQ ID NO: 3205925 - protein, 14 aa, Giardia lamblia
TNGPSACSVSTTLT

SEQ ID NO: 3205926 - protein, 6 aa, Giardia lamblia
TNLPKE

SEQ ID NO: 3205927 - protein, 7 aa, Giardia lamblia
TNNIEET

SEQ ID NO: 3205928 - protein, 9 aa, Giardia lamblia
TNPDIPDYE

SEQ ID NO: 3205929 - protein, 10 aa, Giardia lamblia
TNSATNEVCS

SEQ ID NO: 3205930 - protein, 7 aa, Giardia lamblia
TNSDNGV

SEQ ID NO: 3205931 - protein, 15 aa, Giardia lamblia
TNSEARNWKRSREDE

SEQ ID NO: 3205932 - protein, 10 aa, Giardia lamblia
TNSQTNPPQL

SEQ ID NO: 3205933 - protein, 11 aa, Giardia lamblia
TNTGDKAKDMA

SEQ ID NO: 3205934 - protein, 11 aa, Giardia lamblia
TNTGKASTDRA

SEQ ID NO: 3205935 - protein, 10 aa, Giardia lamblia
TNTSSLNHPG

SEQ ID NO: 3205936 - protein, 9 aa, Giardia lamblia
TPAASKALP

SEQ ID NO: 3205937 - protein, 8 aa, Giardia lamblia
TPDAKDSE

SEQ ID NO: 3205938 - protein, 4 aa, Giardia lamblia
TPDR

SEQ ID NO: 3205939 - protein, 5 aa, Giardia lamblia
TPEAA

SEQ ID NO: 3205940 - protein, 5 aa, Giardia lamblia
TPEDN

SEQ ID NO: 3205941 - protein, 4 aa, Giardia lamblia
TPEK

SEQ ID NO: 3205942 - protein, 6 aa, Giardia lamblia
TPEKNT

SEQ ID NO: 3205943 - protein, 9 aa, Giardia lamblia
TPFTNEPEH

SEQ ID NO: 3205944 - protein, 6 aa, Giardia lamblia
TPGDVS

SEQ ID NO: 3205945 - protein, 8 aa, Giardia lamblia
TPHPTLKG

SEQ ID NO: 3205946 - protein, 5 aa, Giardia lamblia
TPIPC

SEQ ID NO: 3205947 - protein, 6 aa, Giardia lamblia
TPITKD

SEQ ID NO: 3205948 - protein, 11 aa, Giardia lamblia
TPQLANSEIAN

SEQ ID NO: 3205949 - protein, 6 aa, Giardia lamblia
TPRGVQ

SEQ ID NO: 3205950 - protein, 17 aa, Giardia lamblia
TQAGAGGTTMATSAPAP

SEQ ID NO: 3205951 - protein, 5 aa, Giardia lamblia
TQEQQ

SEQ ID NO: 3205952 - protein, 10 aa, Giardia lamblia
TQRDRPSSEQ

SEQ ID NO: 3205953 - protein, 14 aa, Giardia lamblia
TQSGIQAATKRRIE

SEQ ID NO: 3205954 - protein, 17 aa, Giardia lamblia
TRAGNEGRYANHRTRDN

SEQ ID NO: 3205955 - protein, 6 aa, Giardia lamblia
TRAPID

SEQ ID NO: 3205956 - protein, 20 aa, Giardia lamblia
TRAQIEDEVERRRVSSTAQK

SEQ ID NO: 3205957 - protein, 6 aa, Giardia lamblia
TRASSL

SEQ ID NO: 3205958 - protein, 12 aa, Giardia lamblia
TRENSELLKKLD

SEQ ID NO: 3205959 - protein, 5 aa, Giardia lamblia
TRETF

SEQ ID NO: 3205960 - protein, 15 aa, Giardia lamblia
TRGEEQTASVIDGPK

SEQ ID NO: 3205961 - protein, 10 aa, Giardia lamblia
TRIQDDEGRT

SEQ ID NO: 3205962 - protein, 6 aa, Giardia lamblia
TRLTDS

SEQ ID NO: 3205963 - protein, 7 aa, Giardia lamblia
TSAEESF

SEQ ID NO: 3205964 - protein, 4 aa, Giardia lamblia
TSAM

SEQ ID NO: 3205965 - protein, 11 aa, Giardia lamblia
TSASGEPLGPI

SEQ ID NO: 3205966 - protein, 6 aa, Giardia lamblia
TSASYP

SEQ ID NO: 3205967 - protein, 9 aa, Giardia lamblia
TSATGRKSN

SEQ ID NO: 3205968 - protein, 8 aa, Giardia lamblia
TSDGTHIG

SEQ ID NO: 3205969 - protein, 5 aa, Giardia lamblia
TSDPS

SEQ ID NO: 3205970 - protein, 14 aa, Giardia lamblia
TSESRPPGAKLGIG

SEQ ID NO: 3205971 - protein, 4 aa, Giardia lamblia
TSHT

SEQ ID NO: 3205972 - protein, 5 aa, Giardia lamblia
TSHTT

SEQ ID NO: 3205973 - protein, 11 aa, Giardia lamblia
TSKKATKQRQT

SEQ ID NO: 3205974 - protein, 15 aa, Giardia lamblia
TSKTTITVTDEPPKL

SEQ ID NO: 3205975 - protein, 4 aa, Giardia lamblia
TSLG

SEQ ID NO: 3205976 - protein, 4 aa, Giardia lamblia
TSNI

SEQ ID NO: 3205977 - protein, 9 aa, Giardia lamblia
TSPAASHPD

SEQ ID NO: 3205978 - protein, 4 aa, Giardia lamblia
TSPV

SEQ ID NO: 3205979 - protein, 8 aa, Giardia lamblia
TSQKPVPE

SEQ ID NO: 3205980 - protein, 6 aa, Giardia lamblia
TSRPAI

SEQ ID NO: 3205981 - protein, 11 aa, Giardia lamblia
TSSNGTTDTTF

SEQ ID NO: 3205982 - protein, 4 aa, Giardia lamblia
TSSS

SEQ ID NO: 3205983 - protein, 6 aa, Giardia lamblia
TSSSDV

SEQ ID NO: 3205984 - protein, 11 aa, Giardia lamblia
TSSVPIPGTPC

SEQ ID NO: 3205985 - protein, 8 aa, Giardia lamblia
TSTNETVS

SEQ ID NO: 3205986 - protein, 11 aa, Giardia lamblia
TSYQGQEGESV

SEQ ID NO: 3205987 - protein, 5 aa, Giardia lamblia
TTAAP

SEQ ID NO: 3205988 - protein, 5 aa, Giardia lamblia
TTDTK

SEQ ID NO: 3205989 - protein, 9 aa, Giardia lamblia
TTEVEDSDF

SEQ ID NO: 3205990 - protein, 8 aa, Giardia lamblia
TTGATFSK

SEQ ID NO: 3205991 - protein, 4 aa, Giardia lamblia
TTGQ

SEQ ID NO: 3205992 - protein, 7 aa, Giardia lamblia
TTLPSRE

SEQ ID NO: 3205993 - protein, 8 aa, Giardia lamblia
TTNRIDGT

SEQ ID NO: 3205994 - protein, 11 aa, Giardia lamblia
TTNYKDRSNNC

SEQ ID NO: 3205995 - protein, 12 aa, Giardia lamblia
TTQTTADKEGNI

SEQ ID NO: 3205996 - protein, 4 aa, Giardia lamblia
TTSG

SEQ ID NO: 3205997 - protein, 4 aa, Giardia lamblia
TTSM

SEQ ID NO: 3205998 - protein, 8 aa, Giardia lamblia
TTTGHSSN

SEQ ID NO: 3205999 - protein, 4 aa, Giardia lamblia
TTVS

SEQ ID NO: 3206000 - protein, 16 aa, Giardia lamblia
TVKKESEQKLHSNEGA

SEQ ID NO: 3206001 - protein, 9 aa, Giardia lamblia
TVSEGKTPL

SEQ ID NO: 3206002 - protein, 9 aa, Giardia lamblia
TVYDPQNPI

SEQ ID NO: 3206003 - protein, 8 aa, Giardia lamblia
TYGPNDDR

SEQ ID NO: 3206004 - protein, 12 aa, Giardia lamblia
TYPDGTQDECGG

SEQ ID NO: 3206005 - protein, 6 aa, Giardia lamblia
TYREPS

SEQ ID NO: 3206006 - protein, 12 aa, Giardia lamblia
TYRGRKDRYGTT

SEQ ID NO: 3206007 - protein, 18 aa, Giardia lamblia
VAEAKQAKKGCCGPSGSK

SEQ ID NO: 3206008 - protein, 16 aa, Giardia lamblia
VAKHPDRCKESERAAC

SEQ ID NO: 3206009 - protein, 5 aa, Giardia lamblia
VAPAD

SEQ ID NO: 3206010 - protein, 17 aa, Giardia lamblia
VASNPQLTTETDGPDQK

SEQ ID NO: 3206011 - protein, 7 aa, Giardia lamblia
VATPTGE

SEQ ID NO: 3206012 - protein, 4 aa, Giardia lamblia
VCGG

SEQ ID NO: 3206013 - protein, 4 aa, Giardia lamblia
VCNG

SEQ ID NO: 3206014 - protein, 15 aa, Giardia lamblia
VCPPTSNQKETGTTR

SEQ ID NO: 3206015 - protein, 10 aa, Giardia lamblia
VDDREADEQR

SEQ ID NO: 3206016 - protein, 16 aa, Giardia lamblia
VDDSAPKEQRSDQTGI

SEQ ID NO: 3206017 - protein, 15 aa, Giardia lamblia
VDEDYDETKDPVPVP

SEQ ID NO: 3206018 - protein, 8 aa, Giardia lamblia
VDKEGKSA

SEQ ID NO: 3206019 - protein, 8 aa, Giardia lamblia
VDNGTHSG

SEQ ID NO: 3206020 - protein, 13 aa, Giardia lamblia
VDNSHSGLSGKPF

SEQ ID NO: 3206021 - protein, 8 aa, Giardia lamblia
VDPEGAAS

SEQ ID NO: 3206022 - protein, 8 aa, Giardia lamblia
VDSQGRTE

SEQ ID NO: 3206023 - protein, 8 aa, Giardia lamblia
VDTQEDNH

SEQ ID NO: 3206024 - protein, 21 aa, Giardia lamblia
VEASSTKIQKEKTSQDRRFSE

SEQ ID NO: 3206025 - protein, 5 aa, Giardia lamblia
VEDEV

SEQ ID NO: 3206026 - protein, 5 aa, Giardia lamblia
VEEQL

SEQ ID NO: 3206027 - protein, 6 aa, Giardia lamblia
VEGSDA

SEQ ID NO: 3206028 - protein, 12 aa, Giardia lamblia
VEKSSGKEESIT

SEQ ID NO: 3206029 - protein, 4 aa, Giardia lamblia
VEPQ

SEQ ID NO: 3206030 - protein, 9 aa, Giardia lamblia
VESEHGSYE

SEQ ID NO: 3206031 - protein, 9 aa, Giardia lamblia
VESSCPELD

SEQ ID NO: 3206032 - protein, 21 aa, Giardia lamblia
VGDKSAEANSQPGISVQKSGR

SEQ ID NO: 3206033 - protein, 6 aa, Giardia lamblia
VGEDPG

SEQ ID NO: 3206034 - protein, 24 aa, Giardia lamblia
VGGTQSARSRGRPMSGSPGGSGLP

SEQ ID NO: 3206035 - protein, 18 aa, Giardia lamblia
VGLNSQDEDSAKPTSASG

SEQ ID NO: 3206036 - protein, 5 aa, Giardia lamblia
VGPEK

SEQ ID NO: 3206037 - protein, 10 aa, Giardia lamblia
VGQRDAQGHV

SEQ ID NO: 3206038 - protein, 15 aa, Giardia lamblia
VGRTPKSKQLGVPPN

SEQ ID NO: 3206039 - protein, 10 aa, Giardia lamblia
VHQKTPTTRK

SEQ ID NO: 3206040 - protein, 13 aa, Giardia lamblia
VITPSPTDTPACS

SEQ ID NO: 3206041 - protein, 38 aa, Giardia lamblia
VKADTKDETNETRSTSGEEVKEEEPQSTKVQRKKRPIP

SEQ ID NO: 3206042 - protein, 9 aa, Giardia lamblia
VKGESGSVS

SEQ ID NO: 3206043 - protein, 5 aa, Giardia lamblia
VKGKI

SEQ ID NO: 3206044 - protein, 10 aa, Giardia lamblia
VKKDPQDRPL

SEQ ID NO: 3206045 - protein, 10 aa, Giardia lamblia
VKPGTDLECS

SEQ ID NO: 3206046 - protein, 4 aa, Giardia lamblia
VKPK

SEQ ID NO: 3206047 - protein, 17 aa, Giardia lamblia
VKTKSTKIDALEDQGKE

SEQ ID NO: 3206048 - protein, 8 aa, Giardia lamblia
VKTRSTKI

SEQ ID NO: 3206049 - protein, 9 aa, Giardia lamblia
VLPNDDEAA

SEQ ID NO: 3206050 - protein, 14 aa, Giardia lamblia
VNEPLSTFNELDID

SEQ ID NO: 3206051 - protein, 5 aa, Giardia lamblia
VNGYP

SEQ ID NO: 3206052 - protein, 13 aa, Giardia lamblia
VNHASPADTSVQS

SEQ ID NO: 3206053 - protein, 46 aa, Giardia lamblia
VNPPQRSSQNQSVSSSYLGDSSSPIRGNKGVNQSTPSIEHRSPPYR

SEQ ID NO: 3206054 - protein, 7 aa, Giardia lamblia
VNSTAYG

SEQ ID NO: 3206055 - protein, 37 aa, Giardia lamblia
VPRDVAPSYSGAVTTTEPGYRRSPVSLSGEYRPTRSY

SEQ ID NO: 3206056 - protein, 5 aa, Giardia lamblia
VPYQS

SEQ ID NO: 3206057 - protein, 5 aa, Giardia lamblia
VQDEA

SEQ ID NO: 3206058 - protein, 7 aa, Giardia lamblia
VQDRSRE

SEQ ID NO: 3206059 - protein, 9 aa, Giardia lamblia
VQQPGGSYQ

SEQ ID NO: 3206060 - protein, 15 aa, Giardia lamblia
VQTAGAIPPSDRAAG

SEQ ID NO: 3206061 - protein, 10 aa, Giardia lamblia
VRARPNGAAS

SEQ ID NO: 3206062 - protein, 8 aa, Giardia lamblia
VRESRELR

SEQ ID NO: 3206063 - protein, 26 aa, Giardia lamblia
VRSPSTPGRLGTPTSIRRTASRKSNH

SEQ ID NO: 3206064 - protein, 6 aa, Giardia lamblia
VRSRPK

SEQ ID NO: 3206065 - protein, 9 aa, Giardia lamblia
VSAPPGAAH

SEQ ID NO: 3206066 - protein, 8 aa, Giardia lamblia
VSDPGNDV

SEQ ID NO: 3206067 - protein, 19 aa, Giardia lamblia
VSEDPKRRNAVGRSGTGPS

SEQ ID NO: 3206068 - protein, 10 aa, Giardia lamblia
VSEDTRSVKL

SEQ ID NO: 3206069 - protein, 4 aa, Giardia lamblia
VSEK

SEQ ID NO: 3206070 - protein, 27 aa, Giardia lamblia
VSKDPTTSLRPHSRQSVDVSDKAVQTL

SEQ ID NO: 3206071 - protein, 7 aa, Giardia lamblia
VSNAAET

SEQ ID NO: 3206072 - protein, 6 aa, Giardia lamblia
VSPDGS

SEQ ID NO: 3206073 - protein, 7 aa, Giardia lamblia
VSPPKPV

SEQ ID NO: 3206074 - protein, 7 aa, Giardia lamblia
VSPSPLT

SEQ ID NO: 3206075 - protein, 21 aa, Giardia lamblia
VSQETADSDDSYNRSASDLEA

SEQ ID NO: 3206076 - protein, 4 aa, Giardia lamblia
VSQL

SEQ ID NO: 3206077 - protein, 15 aa, Giardia lamblia
VSQPHGSSSVNCSAH

SEQ ID NO: 3206078 - protein, 4 aa, Giardia lamblia
VSSS

SEQ ID NO: 3206079 - protein, 10 aa, Giardia lamblia
VSVPPTDPTF

SEQ ID NO: 3206080 - protein, 21 aa, Giardia lamblia
VTAGGRPRRNSSDEAHSPGRG

SEQ ID NO: 3206081 - protein, 11 aa, Giardia lamblia
VTASKASTSAS

SEQ ID NO: 3206082 - protein, 12 aa, Giardia lamblia
VTASKSSDQTSV

SEQ ID NO: 3206083 - protein, 12 aa, Giardia lamblia
VTASKSSTSASK

SEQ ID NO: 3206084 - protein, 9 aa, Giardia lamblia
VTDEPDGSI

SEQ ID NO: 3206085 - protein, 15 aa, Giardia lamblia
VTDNTFDGYLTIEIA

SEQ ID NO: 3206086 - protein, 6 aa, Giardia lamblia
VTGAEG

SEQ ID NO: 3206087 - protein, 12 aa, Giardia lamblia
VTGCSGKADLPT

SEQ ID NO: 3206088 - protein, 5 aa, Giardia lamblia
VTNQG

SEQ ID NO: 3206089 - protein, 9 aa, Giardia lamblia
VTPDKENQF

SEQ ID NO: 3206090 - protein, 17 aa, Giardia lamblia
VTQNATSTSRPLTVSTL

SEQ ID NO: 3206091 - protein, 6 aa, Giardia lamblia
VTRQYP

SEQ ID NO: 3206092 - protein, 9 aa, Giardia lamblia
VTSSEMKSS

SEQ ID NO: 3206093 - protein, 23 aa, Giardia lamblia
VYSDEDGKIHEGAEGGASGSSRD

SEQ ID NO: 3206094 - protein, 12 aa, Giardia lamblia
WDNDPDNPVGPT

SEQ ID NO: 3206095 - protein, 4 aa, Giardia lamblia
WPPP

SEQ ID NO: 3206096 - protein, 9 aa, Giardia lamblia
YAASHGECH

SEQ ID NO: 3206097 - protein, 13 aa, Giardia lamblia
YARSNTASQSYDA

SEQ ID NO: 3206098 - protein, 5 aa, Giardia lamblia
YASAM

SEQ ID NO: 3206099 - protein, 7 aa, Giardia lamblia
YDEQSGY

SEQ ID NO: 3206100 - protein, 4 aa, Giardia lamblia
YDWS

SEQ ID NO: 3206101 - protein, 6 aa, Giardia lamblia
YEAQRE

SEQ ID NO: 3206102 - protein, 9 aa, Giardia lamblia
YEEGTNHGN

SEQ ID NO: 3206103 - protein, 9 aa, Giardia lamblia
YEKPKSPAE

SEQ ID NO: 3206104 - protein, 8 aa, Giardia lamblia
YERPRSGV

SEQ ID NO: 3206105 - protein, 13 aa, Giardia lamblia
YGEQGIPPTIPPR

SEQ ID NO: 3206106 - protein, 9 aa, Giardia lamblia
YGGDEGDDE

SEQ ID NO: 3206107 - protein, 6 aa, Giardia lamblia
YGSGHR

SEQ ID NO: 3206108 - protein, 8 aa, Giardia lamblia
YGTDDTYG

SEQ ID NO: 3206109 - protein, 5 aa, Giardia lamblia
YGTDV

SEQ ID NO: 3206110 - protein, 9 aa, Giardia lamblia
YGTSDEGQD

SEQ ID NO: 3206111 - protein, 5 aa, Giardia lamblia
YHKQS

SEQ ID NO: 3206112 - protein, 19 aa, Giardia lamblia
YHPDYTPADATEEEKAVRQ

SEQ ID NO: 3206113 - protein, 4 aa, Giardia lamblia
YKAG

SEQ ID NO: 3206114 - protein, 6 aa, Giardia lamblia
YKEQKK

SEQ ID NO: 3206115 - protein, 7 aa, Giardia lamblia
YKKDNRT

SEQ ID NO: 3206116 - protein, 8 aa, Giardia lamblia
YKSKKSMA

SEQ ID NO: 3206117 - protein, 21 aa, Giardia lamblia
YKSTPPSNMAKPVRTGNPRPL

SEQ ID NO: 3206118 - protein, 8 aa, Giardia lamblia
YKTETDPI

SEQ ID NO: 3206119 - protein, 10 aa, Giardia lamblia
YNAPKTGDLG

SEQ ID NO: 3206120 - protein, 7 aa, Giardia lamblia
YNDSQDT

SEQ ID NO: 3206121 - protein, 12 aa, Giardia lamblia
YNEQQEERGRYV

SEQ ID NO: 3206122 - protein, 19 aa, Giardia lamblia
YNPRYSNGGLSKHGYEEVK

SEQ ID NO: 3206123 - protein, 7 aa, Giardia lamblia
YPEKTEQ

SEQ ID NO: 3206124 - protein, 5 aa, Giardia lamblia
YPFDP

SEQ ID NO: 3206125 - protein, 13 aa, Giardia lamblia
YQDQDSDAGAGYA

SEQ ID NO: 3206126 - protein, 5 aa, Giardia lamblia
YQDYS

SEQ ID NO: 3206127 - protein, 22 aa, Giardia lamblia
YQSGSTGARGTCPTKCADGSDL

SEQ ID NO: 3206128 - protein, 4 aa, Giardia lamblia
YSDR

SEQ ID NO: 3206129 - protein, 6 aa, Giardia lamblia
YSEDDI

SEQ ID NO: 3206130 - protein, 4 aa, Giardia lamblia
YSEQ

SEQ ID NO: 3206131 - protein, 5 aa, Giardia lamblia
YSPIG

SEQ ID NO: 3206132 - protein, 6 aa, Giardia lamblia
YSSKET

SEQ ID NO: 3206133 - protein, 11 aa, Giardia lamblia
YTEDSTTGNLR

SEQ ID NO: 3206134 - protein, 23 aa, Giardia lamblia
YTSGETGKSGECPTTCQDGTPVE

SEQ ID NO: 3206135 - protein, 8 aa, Giardia lamblia
YTSTGTGA

SEQ ID NO: 3206136 - protein, 5 aa, Giardia lamblia
YTSTR

SEQ ID NO: 3206137 - protein, 10 aa, Giardia lamblia
YVQGTDSSHS

SEQ ID NO: 3206138 - protein, 19 aa, Giardia lamblia
LGDDPTCPYHFGLSEISNV

SEQ ID NO: 3206139 - protein, 23 aa, Giardia lamblia
APHIPWIGAAALPVNLTGALSVT

SEQ ID NO: 3206140 - protein, 25 aa, Giardia lamblia
ATLHCPARGAAYLLSLACQKKGDTD

SEQ ID NO: 3206141 - protein, 20 aa, Giardia lamblia
DLFKIHILKTGLYVLPAALV

SEQ ID NO: 3206142 - protein, 19 aa, Giardia lamblia
DYWIIRNSWGPDWGEDGYF

SEQ ID NO: 3206143 - protein, 20 aa, Giardia lamblia
ELKCQSCILTEHFADDKHSA

SEQ ID NO: 3206144 - protein, 19 aa, Giardia lamblia
EPSHGMGVRFTQRGLEKFC

SEQ ID NO: 3206145 - protein, 18 aa, Giardia lamblia
FIAQRAGNLVFMSTAAEL

SEQ ID NO: 3206146 - protein, 19 aa, Giardia lamblia
GEENGVPYWDCANTYGTNW

SEQ ID NO: 3206147 - protein, 19 aa, Giardia lamblia
GSSVFCTQINPLAMTTSFR

SEQ ID NO: 3206148 - protein, 21 aa, Giardia lamblia
HMRPQPTLLLYAALRTASTAL

SEQ ID NO: 3206149 - protein, 19 aa, Giardia lamblia
HTFTRSAPNTGLYADTLPA

SEQ ID NO: 3206150 - protein, 18 aa, Giardia lamblia
IATIPDWSVRALYPNKIT

SEQ ID NO: 3206151 - protein, 17 aa, Giardia lamblia
IGDVPLLITEPSTQSVW

SEQ ID NO: 3206152 - protein, 25 aa, Giardia lamblia
IPGLAEALVKAGLLSTVNDLGLGVT

SEQ ID NO: 3206153 - protein, 19 aa, Giardia lamblia
KLPEHHCILVSKCDYQASN

SEQ ID NO: 3206154 - protein, 23 aa, Giardia lamblia
KYDKFKADGLTVPYSTIRAQNIP

SEQ ID NO: 3206155 - protein, 18 aa, Giardia lamblia
LASLPFSLSHKLPESESS

SEQ ID NO: 3206156 - protein, 17 aa, Giardia lamblia
LPFSLSHKLPESESSLY

SEQ ID NO: 3206157 - protein, 23 aa, Giardia lamblia
LSRYEMSSVCGLVISNTAIDTNI

SEQ ID NO: 3206158 - protein, 24 aa, Giardia lamblia
NKAPYRLSGVDAMMRDIYQNGPIA

SEQ ID NO: 3206159 - protein, 24 aa, Giardia lamblia
PESESSLYVGPRCPVLVSSASQLY

SEQ ID NO: 3206160 - protein, 18 aa, Giardia lamblia
PYWDCANTYGTNWGDQGY

SEQ ID NO: 3206161 - protein, 20 aa, Giardia lamblia
QAYCGERLLDVIAAGLPPSG

SEQ ID NO: 3206162 - protein, 18 aa, Giardia lamblia
RDREMIVKGSLIVVKEGS

SEQ ID NO: 3206163 - protein, 17 aa, Giardia lamblia
RGLEKFCQKGYSIIPDV

SEQ ID NO: 3206164 - protein, 19 aa, Giardia lamblia
RLPSSYGNCSAAYLRLRSE

SEQ ID NO: 3206165 - protein, 24 aa, Giardia lamblia
SLNPRWKAGIPKRFEGLTKDEISS

SEQ ID NO: 3206166 - protein, 18 aa, Giardia lamblia
TPDRFLRDREMIVKGSLI

SEQ ID NO: 3206167 - protein, 17 aa, Giardia lamblia
VNLTGALVVTASKVSDQ

SEQ ID NO: 3206168 - protein, 17 aa, Giardia lamblia
VRFTRRGLEKFCQKGYS

SEQ ID NO: 3206169 - protein, 23 aa, Giardia lamblia
VSAEGNVLFSARPRLRKHTYGFN

SEQ ID NO: 3206170 - protein, 24 aa, Giardia lamblia
WVRNMKARLASVYQGCIASNQATV

SEQ ID NO: 3206171 - protein, 23 aa, Giardia lamblia
YDKFKADGLTVPYSTIRAQNIPG

SEQ ID NO: 3206172 - protein, 20 aa, Giardia lamblia
AAALPVNLTGALVVTASKAS

SEQ ID NO: 3206173 - protein, 19 aa, Giardia lamblia
AACKEQYASICITLGEIVD

SEQ ID NO: 3206174 - protein, 23 aa, Giardia lamblia
AAFRVIRLLVTFILTVENQVQSS

SEQ ID NO: 3206175 - protein, 22 aa, Giardia lamblia
AAIYAQCYDPLLAEGYLSSFLP

SEQ ID NO: 3206176 - protein, 18 aa, Giardia lamblia
AALNCCFPYVWKHRPSSS

SEQ ID NO: 3206177 - protein, 17 aa, Giardia lamblia
AALNKLRHIPGRVQDRS

SEQ ID NO: 3206178 - protein, 19 aa, Giardia lamblia
AALPVNLTGALVVTASKVS

SEQ ID NO: 3206179 - protein, 24 aa, Giardia lamblia
AAPHIPWIGAAALLTNLTGTLVVT

SEQ ID NO: 3206180 - protein, 29 aa, Giardia lamblia
AAPHIPWIGAAALPVNLTGALVVTASKVS

SEQ ID NO: 3206181 - protein, 22 aa, Giardia lamblia
AAWLRISSTWPAWMASNHSSTE

SEQ ID NO: 3206182 - protein, 24 aa, Giardia lamblia
AAYIKECIANGVIVDGMITAALLH

SEQ ID NO: 3206183 - protein, 25 aa, Giardia lamblia
ACAIALGLLNCGGMNSSFSILTPAG

SEQ ID NO: 3206184 - protein, 19 aa, Giardia lamblia
ACIDTSGLVCSGRGICAGV

SEQ ID NO: 3206185 - protein, 19 aa, Giardia lamblia
ACLAEACGTGPACVNGDCA

SEQ ID NO: 3206186 - protein, 20 aa, Giardia lamblia
ACPHRGSRVVLHLRENSEEF

SEQ ID NO: 3206187 - protein, 19 aa, Giardia lamblia
ACVHKSCLTEFVPGETLVC

SEQ ID NO: 3206188 - protein, 17 aa, Giardia lamblia
ADARPTNKLVFGNIRPT

SEQ ID NO: 3206189 - protein, 26 aa, Giardia lamblia
ADCLMCISNTVPLCIMCDRLRRPSLG

SEQ ID NO: 3206190 - protein, 26 aa, Giardia lamblia
ADFCRARNITGIPALRMYAKKQWFAY

SEQ ID NO: 3206191 - protein, 18 aa, Giardia lamblia
ADGILRFADLLQIPMEAA

SEQ ID NO: 3206192 - protein, 19 aa, Giardia lamblia
ADHRHSLTVLNLEGNGLAT

SEQ ID NO: 3206193 - protein, 28 aa, Giardia lamblia
ADMQRCSYLYDIVCVFKYCFSSSEKPAH

SEQ ID NO: 3206194 - protein, 17 aa, Giardia lamblia
ADNPPADCLMCISNTVP

SEQ ID NO: 3206195 - protein, 21 aa, Giardia lamblia
AEACTKLVGFHDFRNICKPSL

SEQ ID NO: 3206196 - protein, 20 aa, Giardia lamblia
AEIKMLALVFAALALAETII

SEQ ID NO: 3206197 - protein, 25 aa, Giardia lamblia
AEIYPWKIPVGALARAYMYGRSTLA

SEQ ID NO: 3206198 - protein, 17 aa, Giardia lamblia
AEPMILQPVVPRSLGRS

SEQ ID NO: 3206199 - protein, 27 aa, Giardia lamblia
AESHMWHPFSPCIAMCLARDICITVTP

SEQ ID NO: 3206200 - protein, 24 aa, Giardia lamblia
AESSESPKRCYIGFTNNPLRRIRQ

SEQ ID NO: 3206201 - protein, 21 aa, Giardia lamblia
AFLKARMPYTDALSILSVTYN

SEQ ID NO: 3206202 - protein, 18 aa, Giardia lamblia
AFSEFRADVAAGKLVTRL

SEQ ID NO: 3206203 - protein, 17 aa, Giardia lamblia
AGARIKTAVDNFELCDE

SEQ ID NO: 3206204 - protein, 23 aa, Giardia lamblia
AGDGRRVVLADFGFCEGISSGAA

SEQ ID NO: 3206205 - protein, 17 aa, Giardia lamblia
AGGFPYALVLITLTFDF

SEQ ID NO: 3206206 - protein, 25 aa, Giardia lamblia
AGHLECIKLLLKNEVGMQDNDGETA

SEQ ID NO: 3206207 - protein, 25 aa, Giardia lamblia
AGPIPTDLCALTSMQYLQINNAGLT

SEQ ID NO: 3206208 - protein, 24 aa, Giardia lamblia
AHKILCPLCKLELETHAHKRQELK

SEQ ID NO: 3206209 - protein, 24 aa, Giardia lamblia
AHRILCPLCKLELETHAHKRQELK

SEQ ID NO: 3206210 - protein, 22 aa, Giardia lamblia
AHSLGGLVGRTYCQLTPDWMTH

SEQ ID NO: 3206211 - protein, 23 aa, Giardia lamblia
AIMQACLQRETFLCMAPPASARR

SEQ ID NO: 3206212 - protein, 18 aa, Giardia lamblia
AKEEDLRKLFVKWVQDNL

SEQ ID NO: 3206213 - protein, 18 aa, Giardia lamblia
AKLPTPVTFTEGFSDAAI

SEQ ID NO: 3206214 - protein, 20 aa, Giardia lamblia
AKQFRLKINKMVTNSEARNW

SEQ ID NO: 3206215 - protein, 17 aa, Giardia lamblia
AKTSPLRKRAVARQSLA

SEQ ID NO: 3206216 - protein, 17 aa, Giardia lamblia
AKVKAVDIEFERRCHVT

SEQ ID NO: 3206217 - protein, 25 aa, Giardia lamblia
AKYIRRGRKGICIIAADTHPIYVFA

SEQ ID NO: 3206218 - protein, 17 aa, Giardia lamblia
AKYSLPGCDSSESLVDA

SEQ ID NO: 3206219 - protein, 17 aa, Giardia lamblia
ALESRLAQFSDRMNTAD

SEQ ID NO: 3206220 - protein, 27 aa, Giardia lamblia
ALFEKCCVLEGENTRLKDVIHRYEATA

SEQ ID NO: 3206221 - protein, 17 aa, Giardia lamblia
ALGCALGTPFTNEPEHG

SEQ ID NO: 3206222 - protein, 23 aa, Giardia lamblia
ALGGLRISLSNVRVRAVQLATMK

SEQ ID NO: 3206223 - protein, 23 aa, Giardia lamblia
ALLLESLKTLAFNDAAAGSSFII

SEQ ID NO: 3206224 - protein, 25 aa, Giardia lamblia
ALMLLCKAPHPLLAFGQEAKIPRTA

SEQ ID NO: 3206225 - protein, 25 aa, Giardia lamblia
ALNRTLRIPYIYTCGKKAKQLVLAF

SEQ ID NO: 3206226 - protein, 25 aa, Giardia lamblia
ALPAFPEIPITVGILQITLSNIRPR

SEQ ID NO: 3206227 - protein, 20 aa, Giardia lamblia
ALRREAGARIKTAVDNFELC

SEQ ID NO: 3206228 - protein, 19 aa, Giardia lamblia
ALRTKKEVLQKFSHQAPKA

SEQ ID NO: 3206229 - protein, 24 aa, Giardia lamblia
ALSVSLPQFHFYLLKPQHKLDRGT

SEQ ID NO: 3206230 - protein, 26 aa, Giardia lamblia
ALVFAAAVCSLRCTRILIEYEAEKFG

SEQ ID NO: 3206231 - protein, 19 aa, Giardia lamblia
AMGGLSFDSAYFKLLAYTK

SEQ ID NO: 3206232 - protein, 24 aa, Giardia lamblia
AMMHRLRNTSALYLSRYEMSSVCG

SEQ ID NO: 3206233 - protein, 22 aa, Giardia lamblia
AMSSEIADLLLKCDTSKKATKQ

SEQ ID NO: 3206234 - protein, 18 aa, Giardia lamblia
ANMSEYYRFIFLEEPLSL

SEQ ID NO: 3206235 - protein, 18 aa, Giardia lamblia
ANTRFLIIVHEATFADSE

SEQ ID NO: 3206236 - protein, 22 aa, Giardia lamblia
ANWPTASSFADWVSSAEHESLK

SEQ ID NO: 3206237 - protein, 22 aa, Giardia lamblia
APAGCGLALPVRSATMDVIVSV

SEQ ID NO: 3206238 - protein, 19 aa, Giardia lamblia
APAPFSFGAPAAQSSQPAQ

SEQ ID NO: 3206239 - protein, 23 aa, Giardia lamblia
APHIPWIGAAALPVNLTGALVVT

SEQ ID NO: 3206240 - protein, 24 aa, Giardia lamblia
APHIPWIGAAALPVNLTGALVVTA

SEQ ID NO: 3206241 - protein, 19 aa, Giardia lamblia
APHIPWIGAATLPVNLTGA

SEQ ID NO: 3206242 - protein, 25 aa, Giardia lamblia
APLSYECMTEVLPLNSSLILMSSVA

SEQ ID NO: 3206243 - protein, 17 aa, Giardia lamblia
AQALSCINILLRKLGIK

SEQ ID NO: 3206244 - protein, 17 aa, Giardia lamblia
AQFLRDYDSAMADNQKL

SEQ ID NO: 3206245 - protein, 17 aa, Giardia lamblia
AQITSFIHRSTFVVSKD

SEQ ID NO: 3206246 - protein, 25 aa, Giardia lamblia
AQSRDGWTALMWAAKNGHASCVRLL

SEQ ID NO: 3206247 - protein, 18 aa, Giardia lamblia
ARIARRLRDEGVPLNVLH

SEQ ID NO: 3206248 - protein, 17 aa, Giardia lamblia
ARLLKVFIYTRHGARSP

SEQ ID NO: 3206249 - protein, 18 aa, Giardia lamblia
ARLRAVLERILTIEDTNK

SEQ ID NO: 3206250 - protein, 24 aa, Giardia lamblia
ARNAIIEEIHRVFSTYHIEVDERH

SEQ ID NO: 3206251 - protein, 20 aa, Giardia lamblia
ARPLNHLIWHVNFQDPSSSN

SEQ ID NO: 3206252 - protein, 21 aa, Giardia lamblia
ARRCICLSITTGTYCQKCSDE

SEQ ID NO: 3206253 - protein, 21 aa, Giardia lamblia
ARSSAGLGYFCVDVTIPYDEA

SEQ ID NO: 3206254 - protein, 19 aa, Giardia lamblia
ARYVPFSIMAYIKKHHLYE

SEQ ID NO: 3206255 - protein, 29 aa, Giardia lamblia
ASGLIGMFGVGFFSSYLVAEKVDFYSRRA

SEQ ID NO: 3206256 - protein, 17 aa, Giardia lamblia
ASLLGLIGSNFVRHDDA

SEQ ID NO: 3206257 - protein, 17 aa, Giardia lamblia
ASRFCPAQHRSMRRAPR

SEQ ID NO: 3206258 - protein, 18 aa, Giardia lamblia
ASRLSGITKLEFPAYSPE

SEQ ID NO: 3206259 - protein, 26 aa, Giardia lamblia
ATGAFGDRRCMQWLDPVGVPYSQQYT

SEQ ID NO: 3206260 - protein, 33 aa, Giardia lamblia
ATGMGRHYALPVLREGWKPGISKDEAVALLLES

SEQ ID NO: 3206261 - protein, 19 aa, Giardia lamblia
ATISRIWEALYLSEGERRY

SEQ ID NO: 3206262 - protein, 24 aa, Giardia lamblia
ATMGVPRLREIIMTRNTSSPIITM

SEQ ID NO: 3206263 - protein, 20 aa, Giardia lamblia
ATTAPFAFGKPSEPVTVNKA

SEQ ID NO: 3206264 - protein, 24 aa, Giardia lamblia
AVAKMLLKRESFFTAEKFVLRGWH

SEQ ID NO: 3206265 - protein, 23 aa, Giardia lamblia
AVANASGFLSEFAEVIKEQVDPL

SEQ ID NO: 3206266 - protein, 17 aa, Giardia lamblia
AVETYKVLLEKNEEGAY

SEQ ID NO: 3206267 - protein, 20 aa, Giardia lamblia
AVEVRVCRALDVEVAAADVV

SEQ ID NO: 3206268 - protein, 23 aa, Giardia lamblia
AVGKKGLVLLAFGSGNGPSSDPE

SEQ ID NO: 3206269 - protein, 27 aa, Giardia lamblia
AVPDLLKSGGIPLIIKLTQDSNKGAFF

SEQ ID NO: 3206270 - protein, 19 aa, Giardia lamblia
AVPELKRTFFLALTEDPNY

SEQ ID NO: 3206271 - protein, 24 aa, Giardia lamblia
AYDKFKADGLTVPYSTIRGQNIPG

SEQ ID NO: 3206272 - protein, 18 aa, Giardia lamblia
AYTKLSILLGQDLDQSGV

SEQ ID NO: 3206273 - protein, 28 aa, Giardia lamblia
CAEDAIPIWSGLCLAGACASYDDSGNLL

SEQ ID NO: 3206274 - protein, 18 aa, Giardia lamblia
CANLVRPGAHKILCPLCK

SEQ ID NO: 3206275 - protein, 19 aa, Giardia lamblia
CANLVRPGAHRILCPLCKL

SEQ ID NO: 3206276 - protein, 23 aa, Giardia lamblia
CAQPDYASSVTFELYQHENDRYV

SEQ ID NO: 3206277 - protein, 18 aa, Giardia lamblia
CASERYRPLLSAKVLKRN

SEQ ID NO: 3206278 - protein, 21 aa, Giardia lamblia
CCTVRCPLCTLFGSSTQEQKP

SEQ ID NO: 3206279 - protein, 17 aa, Giardia lamblia
CDDQWWGSFCERPAEPC

SEQ ID NO: 3206280 - protein, 24 aa, Giardia lamblia
CDGYVYIACGGYIYSLLYVYTDLS

SEQ ID NO: 3206281 - protein, 38 aa, Giardia lamblia
CDYKESRMFGCSRLRIYDAYYLASYERLMVLVDYSHFA

SEQ ID NO: 3206282 - protein, 18 aa, Giardia lamblia
CELFRKILEHPLLHHAKE

SEQ ID NO: 3206283 - protein, 17 aa, Giardia lamblia
CEMCAEDAIPIWSGLCL

SEQ ID NO: 3206284 - protein, 20 aa, Giardia lamblia
CFGKCPICKREFQWKEMLRK

SEQ ID NO: 3206285 - protein, 18 aa, Giardia lamblia
CGIHLYKQACFQRDVHPS

SEQ ID NO: 3206286 - protein, 20 aa, Giardia lamblia
CGKKAKQLVLAFFEELQANN

SEQ ID NO: 3206287 - protein, 26 aa, Giardia lamblia
CGSAFLYHQIRCIASLLLHIGAELEP

SEQ ID NO: 3206288 - protein, 26 aa, Giardia lamblia
CGTTDCDYCTALPPTNCPTTLERDGC

SEQ ID NO: 3206289 - protein, 26 aa, Giardia lamblia
CHPGRHYDVLESKLLFSLDNEEWLVC

SEQ ID NO: 3206290 - protein, 25 aa, Giardia lamblia
CIGAELRGAETFVLAHFSCLLVQGQ

SEQ ID NO: 3206291 - protein, 18 aa, Giardia lamblia
CIGNPWLYRFLSLLSLKL

SEQ ID NO: 3206292 - protein, 19 aa, Giardia lamblia
CKCYEGFSLTSIYGCQPTV

SEQ ID NO: 3206293 - protein, 19 aa, Giardia lamblia
CKLMDGASVLVELSKGAQS

SEQ ID NO: 3206294 - protein, 17 aa, Giardia lamblia
CLVGFLASVSTDAHPDE

SEQ ID NO: 3206295 - protein, 23 aa, Giardia lamblia
CPEGETAVLAWGCVPDACVTEYA

SEQ ID NO: 3206296 - protein, 17 aa, Giardia lamblia
CPIHCYHNPLGHFEPLF

SEQ ID NO: 3206297 - protein, 17 aa, Giardia lamblia
CPLEDAIALANEKDKPK

SEQ ID NO: 3206298 - protein, 25 aa, Giardia lamblia
CPLSCLRRCVQFGKRYRLQIFRQRY

SEQ ID NO: 3206299 - protein, 21 aa, Giardia lamblia
CQKCSDEALQIGERCVSLSCI

SEQ ID NO: 3206300 - protein, 21 aa, Giardia lamblia
CQPRRWEMHGYNQWTGSHFDF

SEQ ID NO: 3206301 - protein, 26 aa, Giardia lamblia
CSARFCITCAGKLFTRRNTLIPCFGK

SEQ ID NO: 3206302 - protein, 18 aa, Giardia lamblia
CSPLHAYCNIEPCSSILS

SEQ ID NO: 3206303 - protein, 24 aa, Giardia lamblia
CSQFRADLLGSFTEHNFIDLFATD

SEQ ID NO: 3206304 - protein, 20 aa, Giardia lamblia
CTDSRICLLDDFISKIREVS

SEQ ID NO: 3206305 - protein, 18 aa, Giardia lamblia
CTHFKCLNRDLSFKPICS

SEQ ID NO: 3206306 - protein, 20 aa, Giardia lamblia
CTSCARGFFAGFLKASGHCV

SEQ ID NO: 3206307 - protein, 17 aa, Giardia lamblia
CVAGLEAKFKKAMNSEQ

SEQ ID NO: 3206308 - protein, 21 aa, Giardia lamblia
CVGAGDCLRAEMNRAGSEHAA

SEQ ID NO: 3206309 - protein, 18 aa, Giardia lamblia
CVLLLEIVYTLIKSEDMP

SEQ ID NO: 3206310 - protein, 23 aa, Giardia lamblia
CVPSDHIPGSISIFLRDNSLQIG

SEQ ID NO: 3206311 - protein, 20 aa, Giardia lamblia
DAFLCPPAYVNLGTCSSTTS

SEQ ID NO: 3206312 - protein, 20 aa, Giardia lamblia
DAHVFMLLLLLFSTERYFNL

SEQ ID NO: 3206313 - protein, 19 aa, Giardia lamblia
DAIYGILFGLGLIHLGDPL

SEQ ID NO: 3206314 - protein, 18 aa, Giardia lamblia
DALGMTALMHLLRDNFGR

SEQ ID NO: 3206315 - protein, 20 aa, Giardia lamblia
DAPWHVNRGVGLRPHVLCLY

SEQ ID NO: 3206316 - protein, 30 aa, Giardia lamblia
DATFYKIHHWYKRSFFMGAIEDKKNKEEIM

SEQ ID NO: 3206317 - protein, 18 aa, Giardia lamblia
DCVPALASLQARKQNSRG

SEQ ID NO: 3206318 - protein, 22 aa, Giardia lamblia
DDDLFLMPAITSFRETEHETDE

SEQ ID NO: 3206319 - protein, 19 aa, Giardia lamblia
DDIRKLATCRVVTEQGLDN

SEQ ID NO: 3206320 - protein, 20 aa, Giardia lamblia
DEDADFRALWTGFLQTFVTY

SEQ ID NO: 3206321 - protein, 23 aa, Giardia lamblia
DEHGYCKLADFGVASSVLPNDDE

SEQ ID NO: 3206322 - protein, 22 aa, Giardia lamblia
DFFVIPDNCRFFIKETKQDDSF

SEQ ID NO: 3206323 - protein, 18 aa, Giardia lamblia
DFGLCKDALWSESTLIGI

SEQ ID NO: 3206324 - protein, 24 aa, Giardia lamblia
DFGLCKDALWSGNILIGIMAYVAP

SEQ ID NO: 3206325 - protein, 19 aa, Giardia lamblia
DGRLKFIVINTGLYNSLQK

SEQ ID NO: 3206326 - protein, 18 aa, Giardia lamblia
DHGVCKRGPDGFSCACDE

SEQ ID NO: 3206327 - protein, 20 aa, Giardia lamblia
DHIFCLECIRSIPPDTDNAL

SEQ ID NO: 3206328 - protein, 18 aa, Giardia lamblia
DHLEACLALEDFYYKHGF

SEQ ID NO: 3206329 - protein, 19 aa, Giardia lamblia
DIDSLCLFDDYVAGVSEFY

SEQ ID NO: 3206330 - protein, 22 aa, Giardia lamblia
DILKLLKIVSIGCEIVVSTRSK

SEQ ID NO: 3206331 - protein, 17 aa, Giardia lamblia
DILPSQYRHLFAARLER

SEQ ID NO: 3206332 - protein, 24 aa, Giardia lamblia
DKAVRSRPKLELERLDKPSMTTPE

SEQ ID NO: 3206333 - protein, 26 aa, Giardia lamblia
DKEAPIDRPVCLYASDIMWLPIEQHS

SEQ ID NO: 3206334 - protein, 23 aa, Giardia lamblia
DKGRSIYWPDLCRPHAARNSSAK

SEQ ID NO: 3206335 - protein, 24 aa, Giardia lamblia
DKGRSIYWPDLCRPHAARNSSAKL

SEQ ID NO: 3206336 - protein, 18 aa, Giardia lamblia
DKVERVWISKDVLPVPQL

SEQ ID NO: 3206337 - protein, 26 aa, Giardia lamblia
DLAALPYRNLWLFFTKSLDYAKNPYI

SEQ ID NO: 3206338 - protein, 19 aa, Giardia lamblia
DLFDLPYMMEIHVQCNTDL

SEQ ID NO: 3206339 - protein, 17 aa, Giardia lamblia
DLLLPFISTTDIEEKAR

SEQ ID NO: 3206340 - protein, 18 aa, Giardia lamblia
DNIMPLILDEVAKVSCYA

SEQ ID NO: 3206341 - protein, 24 aa, Giardia lamblia
DNSHCLASGLGIRELAVNSCSFLA

SEQ ID NO: 3206342 - protein, 24 aa, Giardia lamblia
DNWIVTCALFLKPCEQPMPSHSSK

SEQ ID NO: 3206343 - protein, 23 aa, Giardia lamblia
DNYSTPHVVKWSSDASSYYTVED

SEQ ID NO: 3206344 - protein, 18 aa, Giardia lamblia
DPDVSCCSFVLSEKDKET

SEQ ID NO: 3206345 - protein, 22 aa, Giardia lamblia
DPELSKIILVSQFRAGADISDI

SEQ ID NO: 3206346 - protein, 26 aa, Giardia lamblia
DPGEGTLQLLEWAARGISVSDLVVSL

SEQ ID NO: 3206347 - protein, 20 aa, Giardia lamblia
DPQSSLLLLPRLMRAAHTNG

SEQ ID NO: 3206348 - protein, 18 aa, Giardia lamblia
DPTHSWLQLNSNFRNAIH

SEQ ID NO: 3206349 - protein, 26 aa, Giardia lamblia
DPYYCGRFELVYSMVERTCRSILNHI

SEQ ID NO: 3206350 - protein, 25 aa, Giardia lamblia
DQGNCGSCWAFSSVQTFADHRCRSG

SEQ ID NO: 3206351 - protein, 20 aa, Giardia lamblia
DRDPAEVFVDGWRPDLSGVA

SEQ ID NO: 3206352 - protein, 22 aa, Giardia lamblia
DRFSEMYTELPAPVDSNDNMAI

SEQ ID NO: 3206353 - protein, 19 aa, Giardia lamblia
DRKSILGLYAAIYSDADSS

SEQ ID NO: 3206354 - protein, 21 aa, Giardia lamblia
DRPPIALALSRPWEEGRTRVL

SEQ ID NO: 3206355 - protein, 25 aa, Giardia lamblia
DRTGGRPGMDYNYLVEQSDYFDHPF

SEQ ID NO: 3206356 - protein, 17 aa, Giardia lamblia
DSKRIAMLTGDAKRPGS

SEQ ID NO: 3206357 - protein, 23 aa, Giardia lamblia
DSMKRLIVLCVKQYHEVGRTPKS

SEQ ID NO: 3206358 - protein, 25 aa, Giardia lamblia
DSPHWKWRMLDYYTSFDPIMNRSKM

SEQ ID NO: 3206359 - protein, 17 aa, Giardia lamblia
DTGSWKQFFEGIDVDSS

SEQ ID NO: 3206360 - protein, 19 aa, Giardia lamblia
DTIPPRAQVIMRFEIFEAF

SEQ ID NO: 3206361 - protein, 26 aa, Giardia lamblia
DTMLMCFQYGKSKSCCDSRLSKAWEG

SEQ ID NO: 3206362 - protein, 17 aa, Giardia lamblia
DTPACSPLHAYCNIEPC

SEQ ID NO: 3206363 - protein, 25 aa, Giardia lamblia
DTVFLRKFYCGDVYRAVSIGNARPC

SEQ ID NO: 3206364 - protein, 24 aa, Giardia lamblia
DVKAVKRYIPYQARMVAKLVKAGR

SEQ ID NO: 3206365 - protein, 22 aa, Giardia lamblia
EAKIPRTAKWVCKFTQIGKYAQ

SEQ ID NO: 3206366 - protein, 17 aa, Giardia lamblia
EALKRIFGGNTLTRLLS

SEQ ID NO: 3206367 - protein, 21 aa, Giardia lamblia
EAMLILQLHVSRYLDGTVLSK

SEQ ID NO: 3206368 - protein, 31 aa, Giardia lamblia
EASLARCAHCKEILFVPIIIYPCTHVVCSTC

SEQ ID NO: 3206369 - protein, 19 aa, Giardia lamblia
EASRLKLEIQQAFRENQMD

SEQ ID NO: 3206370 - protein, 17 aa, Giardia lamblia
ECGRQGLVINGTCFPSH

SEQ ID NO: 3206371 - protein, 25 aa, Giardia lamblia
ECMLYTLQLGKLVPAVPCLPPHNSR

SEQ ID NO: 3206372 - protein, 23 aa, Giardia lamblia
ECVKCVSGYRLAEGVCERCAVDN

SEQ ID NO: 3206373 - protein, 28 aa, Giardia lamblia
EDKLLARYHLKLLRAYMRQATPTVHGVE

SEQ ID NO: 3206374 - protein, 19 aa, Giardia lamblia
EEHFEPIFFIFFREEGRAE

SEQ ID NO: 3206375 - protein, 27 aa, Giardia lamblia
EEPLVPMFICPSIAPSNYNNPGYYVFH

SEQ ID NO: 3206376 - protein, 21 aa, Giardia lamblia
EEPSHGMGVRFTQRGLEKFCQ

SEQ ID NO: 3206377 - protein, 21 aa, Giardia lamblia
EEPSRGMGVRFTRRGLEKFCQ

SEQ ID NO: 3206378 - protein, 20 aa, Giardia lamblia
EEYPQCITPVYDQGYCGACW

SEQ ID NO: 3206379 - protein, 20 aa, Giardia lamblia
EFKNMLPLVCDGSMVFLYIF

SEQ ID NO: 3206380 - protein, 17 aa, Giardia lamblia
EGACKGLGVSPGDDPGP

SEQ ID NO: 3206381 - protein, 34 aa, Giardia lamblia
EGGRFEEACVWLILVQCLLALDYLDTELSDVDAD

SEQ ID NO: 3206382 - protein, 22 aa, Giardia lamblia
EGLTTIPLRIVDQITCADLSES

SEQ ID NO: 3206383 - protein, 19 aa, Giardia lamblia
EGNNLKYKLVINLYEAFFG

SEQ ID NO: 3206384 - protein, 21 aa, Giardia lamblia
EGRGREKLDLSAKVMTEQERK

SEQ ID NO: 3206385 - protein, 18 aa, Giardia lamblia
EGSFLICASERYRPLLSA

SEQ ID NO: 3206386 - protein, 23 aa, Giardia lamblia
EKKEGLFRMNIMGKRGNYAGRSV

SEQ ID NO: 3206387 - protein, 33 aa, Giardia lamblia
EKLADFCSLHGFNNVILFAGSVEWEYEDYYSKG

SEQ ID NO: 3206388 - protein, 21 aa, Giardia lamblia
EKLHPLIILAGSTELSFLDHS

SEQ ID NO: 3206389 - protein, 19 aa, Giardia lamblia
EKRCKFRYLDKTRLYLPDI

SEQ ID NO: 3206390 - protein, 23 aa, Giardia lamblia
EKRLRAFMELFGMIRAFYMLDYK

SEQ ID NO: 3206391 - protein, 20 aa, Giardia lamblia
EKVNLFLIKTVQAYALQQYD

SEQ ID NO: 3206392 - protein, 24 aa, Giardia lamblia
ELHDAKYRLVYCRSDLEERKKYLR

SEQ ID NO: 3206393 - protein, 33 aa, Giardia lamblia
ELLHEFNFNVVVLKKLFAVAIPKHLARVLTKEV

SEQ ID NO: 3206394 - protein, 32 aa, Giardia lamblia
ELLHSSTRFWSLRVDDCLFENISLRAASPDVR

SEQ ID NO: 3206395 - protein, 19 aa, Giardia lamblia
ELRDTELICRTMTTLDIDS

SEQ ID NO: 3206396 - protein, 17 aa, Giardia lamblia
ELRVFPHDPCTFAGITC

SEQ ID NO: 3206397 - protein, 29 aa, Giardia lamblia
ELSPERFLRFLSVELWDTASLPQVDTLVL

SEQ ID NO: 3206398 - protein, 30 aa, Giardia lamblia
ELYGHNRCGWFLSNFGRLATYVLQRHGFTC

SEQ ID NO: 3206399 - protein, 22 aa, Giardia lamblia
EMAPPLTWIHFRGEGGEADFRA

SEQ ID NO: 3206400 - protein, 22 aa, Giardia lamblia
EMLKLGGDLIAIYWDSAAATDQ

SEQ ID NO: 3206401 - protein, 22 aa, Giardia lamblia
EMMKWADSMLEPTLTKCDSVED

SEQ ID NO: 3206402 - protein, 20 aa, Giardia lamblia
EMMREMAQHASVPCINALDD

SEQ ID NO: 3206403 - protein, 23 aa, Giardia lamblia
ENDRRIMLGIILFNTHLHYIIVK

SEQ ID NO: 3206404 - protein, 26 aa, Giardia lamblia
ENTGIRLRLCIKMRAFLNTLPLDTSV

SEQ ID NO: 3206405 - protein, 21 aa, Giardia lamblia
EPEVRRFLLRSSYDSEDAAER

SEQ ID NO: 3206406 - protein, 21 aa, Giardia lamblia
EPIDAAIWCDGYVYIACGGYI

SEQ ID NO: 3206407 - protein, 17 aa, Giardia lamblia
EPPSLSQLHGWPDKVLY

SEQ ID NO: 3206408 - protein, 24 aa, Giardia lamblia
EQLRSSPELAEFVSKHALDDINVR

SEQ ID NO: 3206409 - protein, 18 aa, Giardia lamblia
ERDLYDLTIEYGYTTPVL

SEQ ID NO: 3206410 - protein, 20 aa, Giardia lamblia
ERLKRAVALRGPMQAMFTVY

SEQ ID NO: 3206411 - protein, 22 aa, Giardia lamblia
ERMKIKLHKMIYKVMQEIHQQE

SEQ ID NO: 3206412 - protein, 20 aa, Giardia lamblia
ERNTRMALATEIYSKVDRDL

SEQ ID NO: 3206413 - protein, 22 aa, Giardia lamblia
ESARPPRAWTRNWGRSARGTAR

SEQ ID NO: 3206414 - protein, 22 aa, Giardia lamblia
ESEPLLKYLVLNKYFPFVNGIL

SEQ ID NO: 3206415 - protein, 22 aa, Giardia lamblia
ESEPLLKYLVLNKYLPFVNSIL

SEQ ID NO: 3206416 - protein, 20 aa, Giardia lamblia
ESRIGLAAFFALLPDPAVLS

SEQ ID NO: 3206417 - protein, 25 aa, Giardia lamblia
ETCGLRWKHCPGHAGYVELPVYCYN

SEQ ID NO: 3206418 - protein, 19 aa, Giardia lamblia
ETDRKPVLLFFTSKMCKTC

SEQ ID NO: 3206419 - protein, 25 aa, Giardia lamblia
ETNSYSCLCLHGYAGDYCEMCAEDA

SEQ ID NO: 3206420 - protein, 21 aa, Giardia lamblia
ETQYYYINWQRIRDCTNHDPY

SEQ ID NO: 3206421 - protein, 23 aa, Giardia lamblia
EVADLRTQISLLDRRLRESEARN

SEQ ID NO: 3206422 - protein, 18 aa, Giardia lamblia
EVDLNFSLLEPFTAYENP

SEQ ID NO: 3206423 - protein, 24 aa, Giardia lamblia
EVKASRYLVRDVPDAITMRDPLSF

SEQ ID NO: 3206424 - protein, 24 aa, Giardia lamblia
EVKASRYLVRDVPDAITVRDPLSF

SEQ ID NO: 3206425 - protein, 31 aa, Giardia lamblia
EVTKMFFPHAFLRPNIPRYYGVNITEDDLYP

SEQ ID NO: 3206426 - protein, 26 aa, Giardia lamblia
EVVDQGGCGSCWAFSSVASVGDRRCF

SEQ ID NO: 3206427 - protein, 28 aa, Giardia lamblia
EVVDQGGCGSCWAFSSVATFGDRRCVAG

SEQ ID NO: 3206428 - protein, 22 aa, Giardia lamblia
EYFKVPQIFFSQLLCVAMESLA

SEQ ID NO: 3206429 - protein, 25 aa, Giardia lamblia
EYIDSLKHALSIRVHDFGFDSEAGV

SEQ ID NO: 3206430 - protein, 19 aa, Giardia lamblia
EYINLPLAYQGIKTKIYST

SEQ ID NO: 3206431 - protein, 17 aa, Giardia lamblia
EYPQCITEVIDIGLCSS

SEQ ID NO: 3206432 - protein, 20 aa, Giardia lamblia
EYPQCVKPALDQGSCGGCWA

SEQ ID NO: 3206433 - protein, 20 aa, Giardia lamblia
FAAPLQVPCKLMDGASVLME

SEQ ID NO: 3206434 - protein, 17 aa, Giardia lamblia
FADLVVCLHNYRSLLNL

SEQ ID NO: 3206435 - protein, 27 aa, Giardia lamblia
FAVDRSWLWQTCVEFGYYQTSSPAAGF

SEQ ID NO: 3206436 - protein, 17 aa, Giardia lamblia
FCHGGLGISRCSAKVYP

SEQ ID NO: 3206437 - protein, 29 aa, Giardia lamblia
FDCLYRFSQRYRPWLGLRALPTAQNIAHL

SEQ ID NO: 3206438 - protein, 19 aa, Giardia lamblia
FDGDCPMRPFADASSYTFD

SEQ ID NO: 3206439 - protein, 17 aa, Giardia lamblia
FDPISLVAHHTLVGSFL

SEQ ID NO: 3206440 - protein, 17 aa, Giardia lamblia
FDQPRQFTRIIGAEHCI

SEQ ID NO: 3206441 - protein, 19 aa, Giardia lamblia
FEIEGIALGGLRISLSNVR

SEQ ID NO: 3206442 - protein, 18 aa, Giardia lamblia
FELLGADILLSYDAKTRA

SEQ ID NO: 3206443 - protein, 18 aa, Giardia lamblia
FERGDGRGGYSIYGSEFD

SEQ ID NO: 3206444 - protein, 18 aa, Giardia lamblia
FESACTSLAAGALTSGFD

SEQ ID NO: 3206445 - protein, 27 aa, Giardia lamblia
FESPALRSASSFSALPDRNSSKASNTT

SEQ ID NO: 3206446 - protein, 26 aa, Giardia lamblia
FFAKAESSAAFLLKDAFKTSFRPTLS

SEQ ID NO: 3206447 - protein, 21 aa, Giardia lamblia
FGAQMLREANTRFLIIVHEAT

SEQ ID NO: 3206448 - protein, 24 aa, Giardia lamblia
FGTPDLQNLPALYVLVYEEMNAER

SEQ ID NO: 3206449 - protein, 23 aa, Giardia lamblia
FIEDVHALYIFFHHSISPSTVSL

SEQ ID NO: 3206450 - protein, 29 aa, Giardia lamblia
FIKDFSFQLSRFIHRCLIFDPVIRPSAKD

SEQ ID NO: 3206451 - protein, 18 aa, Giardia lamblia
FIKECSSFKDLDASGISK

SEQ ID NO: 3206452 - protein, 23 aa, Giardia lamblia
FIPEKLSLLPLFVYAMLRTHMMR

SEQ ID NO: 3206453 - protein, 26 aa, Giardia lamblia
FISANSLHYAKFVAPFIRNNIPIVAD

SEQ ID NO: 3206454 - protein, 31 aa, Giardia lamblia
FISPDHFVRCLFKARWSSTVVNPYYFHRIMT

SEQ ID NO: 3206455 - protein, 27 aa, Giardia lamblia
FITISWLRTACRARSLSALPLSASSRQ

SEQ ID NO: 3206456 - protein, 18 aa, Giardia lamblia
FKCIPITCIVDGKMCPNG

SEQ ID NO: 3206457 - protein, 19 aa, Giardia lamblia
FKGIKFAYCGDSMNNVTYD

SEQ ID NO: 3206458 - protein, 25 aa, Giardia lamblia
FKRIEGRTCFQWVIVGGSYPGAVTG

SEQ ID NO: 3206459 - protein, 21 aa, Giardia lamblia
FLPGLTFPLLHASHMSSLLGF

SEQ ID NO: 3206460 - protein, 17 aa, Giardia lamblia
FLPSTLFIKTLLVPPNR

SEQ ID NO: 3206461 - protein, 24 aa, Giardia lamblia
FLRDLCAYPVVLSVGVADTCSYLS

SEQ ID NO: 3206462 - protein, 22 aa, Giardia lamblia
FLRKEMLVVLLATATLASYADR

SEQ ID NO: 3206463 - protein, 17 aa, Giardia lamblia
FLYYRGGVYKHVYGIQI

SEQ ID NO: 3206464 - protein, 25 aa, Giardia lamblia
FMGTLPAPISPIWRAGPIKHVSGIS

SEQ ID NO: 3206465 - protein, 24 aa, Giardia lamblia
FMIRPRANLDYMVHGLNVRPSLSQ

SEQ ID NO: 3206466 - protein, 19 aa, Giardia lamblia
FMTIKEKFTAAGEFSNGFK

SEQ ID NO: 3206467 - protein, 25 aa, Giardia lamblia
FNDVKRLAATLLDLKVGPLPSLPPQ

SEQ ID NO: 3206468 - protein, 20 aa, Giardia lamblia
FPHDPCTFAGITCSKKKDIE

SEQ ID NO: 3206469 - protein, 21 aa, Giardia lamblia
FQRIAEAWSVLSDETKRKEYD

SEQ ID NO: 3206470 - protein, 17 aa, Giardia lamblia
FRALWTGFLQTFVTYDF

SEQ ID NO: 3206471 - protein, 20 aa, Giardia lamblia
FRLSKYPSLLNGTAAPKLAP

SEQ ID NO: 3206472 - protein, 20 aa, Giardia lamblia
FRRKECKCPTEYSGEQCEDC

SEQ ID NO: 3206473 - protein, 18 aa, Giardia lamblia
FSDAAIRYLMEHVRSALR

SEQ ID NO: 3206474 - protein, 19 aa, Giardia lamblia
FSDLILRIAPKSIVMAYSN

SEQ ID NO: 3206475 - protein, 17 aa, Giardia lamblia
FSFKHLLSHPLIVGNGS

SEQ ID NO: 3206476 - protein, 20 aa, Giardia lamblia
FSFTCECLGAVLSQNLTFTQ

SEQ ID NO: 3206477 - protein, 21 aa, Giardia lamblia
FSGRIAYEMDSPYLGVESLCN

SEQ ID NO: 3206478 - protein, 18 aa, Giardia lamblia
FSKSTLYCPRRGLKDGPY

SEQ ID NO: 3206479 - protein, 22 aa, Giardia lamblia
FSLFDLALEIDMLLDIQSVAER

SEQ ID NO: 3206480 - protein, 17 aa, Giardia lamblia
FSTRQLYRFILLNNSAS

SEQ ID NO: 3206481 - protein, 24 aa, Giardia lamblia
FTNEPEHGMGVRFTRRGLEKFCQK

SEQ ID NO: 3206482 - protein, 22 aa, Giardia lamblia
FTSKMCKTCAANMISIQRLATS

SEQ ID NO: 3206483 - protein, 18 aa, Giardia lamblia
FTYVRKVIVPDFYKVLGV

SEQ ID NO: 3206484 - protein, 19 aa, Giardia lamblia
FVDVAMAFAKKGIDALMGK

SEQ ID NO: 3206485 - protein, 17 aa, Giardia lamblia
FVRRIRPKYAALASEAH

SEQ ID NO: 3206486 - protein, 31 aa, Giardia lamblia
FVVDHLWMVRAYCDVSSWGCQDFEGVSAESS

SEQ ID NO: 3206487 - protein, 31 aa, Giardia lamblia
FYCYKDESVCIPVRWTMRSISAFGSHFDLYS

SEQ ID NO: 3206488 - protein, 19 aa, Giardia lamblia
FYIDLAVRSTINFVSIDAF

SEQ ID NO: 3206489 - protein, 20 aa, Giardia lamblia
FYNLPRAELLRHIQQMLAVL

SEQ ID NO: 3206490 - protein, 32 aa, Giardia lamblia
FYTYSAILKYDFRVFWSWRTKLDRDFYSALHP

SEQ ID NO: 3206491 - protein, 22 aa, Giardia lamblia
GAFVLGCFMGGCVLPEITKYGT

SEQ ID NO: 3206492 - protein, 23 aa, Giardia lamblia
GAIEAVPGVKLLTTVPIPVATAI

SEQ ID NO: 3206493 - protein, 17 aa, Giardia lamblia
GAMRRAGVISAYTMTPE

SEQ ID NO: 3206494 - protein, 31 aa, Giardia lamblia
GARKTSRYGPWRMVLFVGGFSTKVSALKFEY

SEQ ID NO: 3206495 - protein, 21 aa, Giardia lamblia
GCDGGDFQPTWSFLTFTGATT

SEQ ID NO: 3206496 - protein, 27 aa, Giardia lamblia
GCFGFSTRESIAWDFIATTGIPLESCV

SEQ ID NO: 3206497 - protein, 23 aa, Giardia lamblia
GCQGGEFESSWAFLETEGAVKSD

SEQ ID NO: 3206498 - protein, 17 aa, Giardia lamblia
GCTCNKAYVSHNGYCVP

SEQ ID NO: 3206499 - protein, 18 aa, Giardia lamblia
GDDPTCPYHFGLFEILNV

SEQ ID NO: 3206500 - protein, 20 aa, Giardia lamblia
GDECCVLKPQTHEAASEYAN

SEQ ID NO: 3206501 - protein, 19 aa, Giardia lamblia
GDEHCYFWVDGIDTTLPSR

SEQ ID NO: 3206502 - protein, 32 aa, Giardia lamblia
GDGRRVVLADFGFCKGISSGAAKAGDPAYMAP

SEQ ID NO: 3206503 - protein, 25 aa, Giardia lamblia
GEDFDRRLLDHFIAIFKKKNNIDLS

SEQ ID NO: 3206504 - protein, 21 aa, Giardia lamblia
GEDGYFRMIRGINDCSIEEQA

SEQ ID NO: 3206505 - protein, 17 aa, Giardia lamblia
GEGMPIMGDRLGRRGDL

SEQ ID NO: 3206506 - protein, 23 aa, Giardia lamblia
GENMAGCFSCLSPADTGTSTGRC

SEQ ID NO: 3206507 - protein, 27 aa, Giardia lamblia
GESVALRFAAPLQVPCKLMDGASVLVE

SEQ ID NO: 3206508 - protein, 22 aa, Giardia lamblia
GESVTLRFAAPLQVPCKLMDGA

SEQ ID NO: 3206509 - protein, 25 aa, Giardia lamblia
GEVFGDRFLMCLQEYADYFIFNDVT

SEQ ID NO: 3206510 - protein, 24 aa, Giardia lamblia
GFCMHCAPGWFLHGYNNVTGAEGG

SEQ ID NO: 3206511 - protein, 25 aa, Giardia lamblia
GFFRLSLELLELLNWSCCKTQRDRP

SEQ ID NO: 3206512 - protein, 18 aa, Giardia lamblia
GFGLCYGLPPLGDESACL

SEQ ID NO: 3206513 - protein, 24 aa, Giardia lamblia
GFGVCFFYPIGIISCICYPSTVLD

SEQ ID NO: 3206514 - protein, 24 aa, Giardia lamblia
GGEADFRALIFVPGFPSLNYYEKY

SEQ ID NO: 3206515 - protein, 18 aa, Giardia lamblia
GGESEFKNMLPLVCDGSM

SEQ ID NO: 3206516 - protein, 17 aa, Giardia lamblia
GGFSMIATIPDWSVRAL

SEQ ID NO: 3206517 - protein, 18 aa, Giardia lamblia
GGFSMIATIPDWSVRALY

SEQ ID NO: 3206518 - protein, 18 aa, Giardia lamblia
GGSGLPCGAHHDRPPIAL

SEQ ID NO: 3206519 - protein, 20 aa, Giardia lamblia
GGVHAIRTANRWNHSEVASF

SEQ ID NO: 3206520 - protein, 22 aa, Giardia lamblia
GGVIPCGWTPEKNDFIIPDPEK

SEQ ID NO: 3206521 - protein, 22 aa, Giardia lamblia
GHADCLKLLLEKESGLKSDKGR

SEQ ID NO: 3206522 - protein, 18 aa, Giardia lamblia
GHGRCIWNNDGAACACND

SEQ ID NO: 3206523 - protein, 17 aa, Giardia lamblia
GHRCIQIIDQGSCGCCY

SEQ ID NO: 3206524 - protein, 24 aa, Giardia lamblia
GHRSRCVLEYGFSDIPQSFVRVLF

SEQ ID NO: 3206525 - protein, 17 aa, Giardia lamblia
GHTDYINGISWGRDSHG

SEQ ID NO: 3206526 - protein, 18 aa, Giardia lamblia
GHVFPSCLLERSEQFGIF

SEQ ID NO: 3206527 - protein, 18 aa, Giardia lamblia
GIQKAGPIALGLAYAHTN

SEQ ID NO: 3206528 - protein, 20 aa, Giardia lamblia
GITESLLFYSGGVYNDPACP

SEQ ID NO: 3206529 - protein, 20 aa, Giardia lamblia
GKAPGFSFGSGFGPAQSTQL

SEQ ID NO: 3206530 - protein, 20 aa, Giardia lamblia
GKEPAEVFVDGWRPDLSGVA

SEQ ID NO: 3206531 - protein, 20 aa, Giardia lamblia
GKPPVVPSFGTYVSSSKGLY

SEQ ID NO: 3206532 - protein, 18 aa, Giardia lamblia
GKSALYYALEKEDLDIAH

SEQ ID NO: 3206533 - protein, 19 aa, Giardia lamblia
GLALLKILAHHEATKVSDG

SEQ ID NO: 3206534 - protein, 18 aa, Giardia lamblia
GLALSPAGARTHDSSVQM

SEQ ID NO: 3206535 - protein, 18 aa, Giardia lamblia
GLFACYCLVAESSESPKR

SEQ ID NO: 3206536 - protein, 25 aa, Giardia lamblia
GLKDTCGRSALMFAGIGGHTSIATL

SEQ ID NO: 3206537 - protein, 17 aa, Giardia lamblia
GLTALMISCRVGFGDGV

SEQ ID NO: 3206538 - protein, 26 aa, Giardia lamblia
GLTSVACEACAEFIKLAITDSTENDR

SEQ ID NO: 3206539 - protein, 25 aa, Giardia lamblia
GLVHCDLRPASILINADGERFIIAD

SEQ ID NO: 3206540 - protein, 22 aa, Giardia lamblia
GNITLGLFGKVAPKTVTNFVEI

SEQ ID NO: 3206541 - protein, 18 aa, Giardia lamblia
GPDGFSCACDEGYTSVSP

SEQ ID NO: 3206542 - protein, 26 aa, Giardia lamblia
GPESPWANSWSYRWNPQLIAARGYGV

SEQ ID NO: 3206543 - protein, 21 aa, Giardia lamblia
GPGRRGFITLVLPRAASSITV

SEQ ID NO: 3206544 - protein, 19 aa, Giardia lamblia
GPMKRRPLIIDPKSVYFTD

SEQ ID NO: 3206545 - protein, 17 aa, Giardia lamblia
GQCKGGVCFCKYDNPSP

SEQ ID NO: 3206546 - protein, 24 aa, Giardia lamblia
GQKVCGVCLEYLDNSHCLASGLGI

SEQ ID NO: 3206547 - protein, 24 aa, Giardia lamblia
GQLTMEIAEGILLIDKAHDYPYPD

SEQ ID NO: 3206548 - protein, 21 aa, Giardia lamblia
GRDALELLSSFYHLMRDKCYD

SEQ ID NO: 3206549 - protein, 19 aa, Giardia lamblia
GRGFTALVLAAGHDHLDCV

SEQ ID NO: 3206550 - protein, 17 aa, Giardia lamblia
GRGGYSIYGSEFDDENF

SEQ ID NO: 3206551 - protein, 20 aa, Giardia lamblia
GRIAQTLKRALAVERENLRL

SEQ ID NO: 3206552 - protein, 17 aa, Giardia lamblia
GRQGLVINGTCFPSHCV

SEQ ID NO: 3206553 - protein, 22 aa, Giardia lamblia
GSCIPMACIFNGEVCPNMGPCQ

SEQ ID NO: 3206554 - protein, 24 aa, Giardia lamblia
GSIHDFIPLLKFLLLNKYLPFANP

SEQ ID NO: 3206555 - protein, 24 aa, Giardia lamblia
GSILHILLEFCKYGSSQDMLKKLK

SEQ ID NO: 3206556 - protein, 17 aa, Giardia lamblia
GSLKLTLSNVRPRAVRV

SEQ ID NO: 3206557 - protein, 17 aa, Giardia lamblia
GSNPFLCPPDYSAYEYS

SEQ ID NO: 3206558 - protein, 19 aa, Giardia lamblia
GSSEPRPFAPPKKLTEEEL

SEQ ID NO: 3206559 - protein, 18 aa, Giardia lamblia
GTFTRSADRLRTKIDNVA

SEQ ID NO: 3206560 - protein, 25 aa, Giardia lamblia
GTTFDLKAVILFRSFQGRAEITLGT

SEQ ID NO: 3206561 - protein, 17 aa, Giardia lamblia
GVAIGFTVGAIVLSALA

SEQ ID NO: 3206562 - protein, 18 aa, Giardia lamblia
GVCLIELAQGVPPNSNLP

SEQ ID NO: 3206563 - protein, 19 aa, Giardia lamblia
GVGACVRNGAGYSCDCRGL

SEQ ID NO: 3206564 - protein, 25 aa, Giardia lamblia
GWRRRSPRAPREWAPALSQPVRSLL

SEQ ID NO: 3206565 - protein, 18 aa, Giardia lamblia
GYEAFVFGYAVSAGLMCL

SEQ ID NO: 3206566 - protein, 22 aa, Giardia lamblia
GYFRIVRGVNECRIEDEIYAVY

SEQ ID NO: 3206567 - protein, 21 aa, Giardia lamblia
GYGKCMNGICLCDDGFVLQGT

SEQ ID NO: 3206568 - protein, 24 aa, Giardia lamblia
GYGRCVKKGNAHVCECRRDGTLIG

SEQ ID NO: 3206569 - protein, 24 aa, Giardia lamblia
HAHLLEFNASPSLAINCPLDKEVK

SEQ ID NO: 3206570 - protein, 23 aa, Giardia lamblia
HAKTLYIQMSFLYTDEAGLRHIR

SEQ ID NO: 3206571 - protein, 19 aa, Giardia lamblia
HAWQSLRSSYDLSAPSIEY

SEQ ID NO: 3206572 - protein, 20 aa, Giardia lamblia
HCALELRILLASHATVALGV

SEQ ID NO: 3206573 - protein, 21 aa, Giardia lamblia
HCTSCACEVFSLLNQQALLTV

SEQ ID NO: 3206574 - protein, 24 aa, Giardia lamblia
HDCKADIWSFGVCLIELAQGVPPN

SEQ ID NO: 3206575 - protein, 20 aa, Giardia lamblia
HFCQCRRGWAGAACDAPRAG

SEQ ID NO: 3206576 - protein, 17 aa, Giardia lamblia
HFGRMLIPNDFIFYSNM

SEQ ID NO: 3206577 - protein, 19 aa, Giardia lamblia
HFITDFAFCSSILCAVGDE

SEQ ID NO: 3206578 - protein, 19 aa, Giardia lamblia
HGDELPKALSVSLPQFHFY

SEQ ID NO: 3206579 - protein, 22 aa, Giardia lamblia
HGTCKRKGCVCDEGYEGSLCQY

SEQ ID NO: 3206580 - protein, 19 aa, Giardia lamblia
HKIKCPHCHGTGADSDADY

SEQ ID NO: 3206581 - protein, 19 aa, Giardia lamblia
HLDCVKLLLEKERDIGGVH

SEQ ID NO: 3206582 - protein, 28 aa, Giardia lamblia
HLSQVLKYFVCLLNDGRFNPLIMLPNDY

SEQ ID NO: 3206583 - protein, 32 aa, Giardia lamblia
HQLPRMGLCKICGGNGLDCCEIVRLAVANSKR

SEQ ID NO: 3206584 - protein, 18 aa, Giardia lamblia
HQVVKNGFRRDFFNHYTV

SEQ ID NO: 3206585 - protein, 34 aa, Giardia lamblia
HRDEFKLIYCQSNASGIPLFMLPAISPNRYNNPG

SEQ ID NO: 3206586 - protein, 26 aa, Giardia lamblia
HRGGDIRTALQFTFRTIARTVAEGLT

SEQ ID NO: 3206587 - protein, 18 aa, Giardia lamblia
HRVACRQGAALALGYINA

SEQ ID NO: 3206588 - protein, 20 aa, Giardia lamblia
HSAALIACEKDIELLEETMK

SEQ ID NO: 3206589 - protein, 28 aa, Giardia lamblia
HSDAFRQWWWQTCTEVAYYQPAPLINSL

SEQ ID NO: 3206590 - protein, 20 aa, Giardia lamblia
HTALMWAALVGRTEVVRLLL

SEQ ID NO: 3206591 - protein, 18 aa, Giardia lamblia
HTVFFCGHVFHTSCLAFY

SEQ ID NO: 3206592 - protein, 17 aa, Giardia lamblia
HTYRQCVHSSGLCDTPD

SEQ ID NO: 3206593 - protein, 24 aa, Giardia lamblia
HWDEEAWPGLYRHLFVAPLPMTGL

SEQ ID NO: 3206594 - protein, 19 aa, Giardia lamblia
HYHNLKDWFLFAYLHADDY

SEQ ID NO: 3206595 - protein, 19 aa, Giardia lamblia
HYLPDWGCVPTPCIGDTPI

SEQ ID NO: 3206596 - protein, 18 aa, Giardia lamblia
IALGCALGTPFTNEPEHG

SEQ ID NO: 3206597 - protein, 17 aa, Giardia lamblia
IALSLSLYSIHYLSHAF

SEQ ID NO: 3206598 - protein, 17 aa, Giardia lamblia
IASQVLKQTPLLRPSTA

SEQ ID NO: 3206599 - protein, 17 aa, Giardia lamblia
IAVAVTETFSWYSGGVF

SEQ ID NO: 3206600 - protein, 17 aa, Giardia lamblia
ICAVLTRYLPTYDAFGN

SEQ ID NO: 3206601 - protein, 18 aa, Giardia lamblia
ICGDALQLWQGISILSAA

SEQ ID NO: 3206602 - protein, 19 aa, Giardia lamblia
IDARRRAVETYKVLLEKNE

SEQ ID NO: 3206603 - protein, 21 aa, Giardia lamblia
IDELGGIGMFRTDRYNFVKDP

SEQ ID NO: 3206604 - protein, 17 aa, Giardia lamblia
IEEGGRFEEACVWLILV

SEQ ID NO: 3206605 - protein, 25 aa, Giardia lamblia
IEGGNLRALFYLSNPFINFDNIYTN

SEQ ID NO: 3206606 - protein, 22 aa, Giardia lamblia
IEMRYTLTFSDTGSWKQFFEGI

SEQ ID NO: 3206607 - protein, 26 aa, Giardia lamblia
IESFAVYLCNLYRAKNSYIHKMCENI

SEQ ID NO: 3206608 - protein, 22 aa, Giardia lamblia
IFDVKRLIGRKFDDPEVQKDMK

SEQ ID NO: 3206609 - protein, 17 aa, Giardia lamblia
IFHICKLLVAPRNLGTG

SEQ ID NO: 3206610 - protein, 25 aa, Giardia lamblia
IFQKRKPGLVFSGFTAGVMEDALNF

SEQ ID NO: 3206611 - protein, 17 aa, Giardia lamblia
IGDEVDRLYLVDRQVHG

SEQ ID NO: 3206612 - protein, 26 aa, Giardia lamblia
IGEDFDCPFHFGLFEFANQVYISKLD

SEQ ID NO: 3206613 - protein, 25 aa, Giardia lamblia
IGGIFLCSMGTFLDFGSLCEYIMVA

SEQ ID NO: 3206614 - protein, 29 aa, Giardia lamblia
IGLCSSSWAYSAVDAFSHRRCLTGLDQEA

SEQ ID NO: 3206615 - protein, 20 aa, Giardia lamblia
IGNARPCILYRIDLETIDDE

SEQ ID NO: 3206616 - protein, 18 aa, Giardia lamblia
IGVIPALFAKVVVSDLQS

SEQ ID NO: 3206617 - protein, 20 aa, Giardia lamblia
IGVSLKPQWVREKLSSITAQ

SEQ ID NO: 3206618 - protein, 17 aa, Giardia lamblia
IHARSSAGLGYFCVDVT

SEQ ID NO: 3206619 - protein, 24 aa, Giardia lamblia
IHERGRPTVIFALDTERDNKLLKT

SEQ ID NO: 3206620 - protein, 22 aa, Giardia lamblia
IHLGDPLFLKAFNFNEFYISKF

SEQ ID NO: 3206621 - protein, 17 aa, Giardia lamblia
IHNRFSVGIECLIHKEA

SEQ ID NO: 3206622 - protein, 23 aa, Giardia lamblia
IIKMETLSLGMHWSHTSYADDCF

SEQ ID NO: 3206623 - protein, 17 aa, Giardia lamblia
IITVPDWSVRALYPNKI

SEQ ID NO: 3206624 - protein, 17 aa, Giardia lamblia
IKAGYYASYEFIACTGP

SEQ ID NO: 3206625 - protein, 17 aa, Giardia lamblia
IKCSVVGACHELGAPWI

SEQ ID NO: 3206626 - protein, 17 aa, Giardia lamblia
IKIPTDIWGPFRETEAR

SEQ ID NO: 3206627 - protein, 35 aa, Giardia lamblia
IKKNKPLWFNKIRCLSNSLLGYAKRNGVEGGLTVH

SEQ ID NO: 3206628 - protein, 25 aa, Giardia lamblia
IKLVKEGKMSEEHIALFTPPQLFFF

SEQ ID NO: 3206629 - protein, 25 aa, Giardia lamblia
IKPDDEVLVPLTLSSYVKGNVPDTS

SEQ ID NO: 3206630 - protein, 29 aa, Giardia lamblia
ILCAVGDEYKRRCLFEDAARCYAQNSNLE

SEQ ID NO: 3206631 - protein, 17 aa, Giardia lamblia
ILNRAAVAKMLLKRESF

SEQ ID NO: 3206632 - protein, 23 aa, Giardia lamblia
ILRRYASTVLACLYGHYHSAYPL

SEQ ID NO: 3206633 - protein, 24 aa, Giardia lamblia
ILSELCGAGSLWSLNAEFCLTLGR

SEQ ID NO: 3206634 - protein, 25 aa, Giardia lamblia
ILSRVLALHRLHIGLGRLLNGAVHY

SEQ ID NO: 3206635 - protein, 18 aa, Giardia lamblia
IMGDRLGRRGDLLIEVQV

SEQ ID NO: 3206636 - protein, 26 aa, Giardia lamblia
IMSAALKKPRGIESLSALWHQLSAES

SEQ ID NO: 3206637 - protein, 24 aa, Giardia lamblia
IMTRSESVFPMFTSVSLQDHSALE

SEQ ID NO: 3206638 - protein, 22 aa, Giardia lamblia
INADEAVAWGAAVQASILSGAK

SEQ ID NO: 3206639 - protein, 25 aa, Giardia lamblia
INMRLPETIRVLGWAPVDENFSARH

SEQ ID NO: 3206640 - protein, 18 aa, Giardia lamblia
INTFRLSKYPSLLNGTAA

SEQ ID NO: 3206641 - protein, 19 aa, Giardia lamblia
IPECICALSKLHSLHLDNN

SEQ ID NO: 3206642 - protein, 27 aa, Giardia lamblia
IPGLAEALVKAGLLSSVSDLGLGVTLT

SEQ ID NO: 3206643 - protein, 21 aa, Giardia lamblia
IPHIDRFSLALSLVNLSHYQN

SEQ ID NO: 3206644 - protein, 17 aa, Giardia lamblia
IPITCIVDGKMCPNGLC

SEQ ID NO: 3206645 - protein, 29 aa, Giardia lamblia
IPLQGGMKMKGCALVGDWKIYEGTALIRA

SEQ ID NO: 3206646 - protein, 29 aa, Giardia lamblia
IPLQGGMKMKGCALVGDWKIYEGTALMRA

SEQ ID NO: 3206647 - protein, 21 aa, Giardia lamblia
IPRKARCAARGKAQAGDFDSL

SEQ ID NO: 3206648 - protein, 22 aa, Giardia lamblia
IPRSLRCSLVFSWRVPSVPSMI

SEQ ID NO: 3206649 - protein, 19 aa, Giardia lamblia
IPVATAITYLSSRMGTINR

SEQ ID NO: 3206650 - protein, 23 aa, Giardia lamblia
IQARPYKAFAYEQLYTRHWDEDI

SEQ ID NO: 3206651 - protein, 18 aa, Giardia lamblia
IQDNSKWTALMIAAERGE

SEQ ID NO: 3206652 - protein, 19 aa, Giardia lamblia
IQVYHGISLFQALRLRGIK

SEQ ID NO: 3206653 - protein, 19 aa, Giardia lamblia
IRAAFPLPSPHAADHFAPV

SEQ ID NO: 3206654 - protein, 24 aa, Giardia lamblia
IREQCAIAAKLFREIQEIKAEMGE

SEQ ID NO: 3206655 - protein, 19 aa, Giardia lamblia
IRNRFNIMDVHLLLCAAEF

SEQ ID NO: 3206656 - protein, 22 aa, Giardia lamblia
IRSERLAGHVLMLADREADPIP

SEQ ID NO: 3206657 - protein, 20 aa, Giardia lamblia
IRTANRWNHSEVASFLESEG

SEQ ID NO: 3206658 - protein, 20 aa, Giardia lamblia
ISALCPKELAYLIDRALDMK

SEQ ID NO: 3206659 - protein, 19 aa, Giardia lamblia
ISCGSSFGPPVSCFSDQSR

SEQ ID NO: 3206660 - protein, 18 aa, Giardia lamblia
ISELTRASSLSVTDFREL

SEQ ID NO: 3206661 - protein, 29 aa, Giardia lamblia
ISEVYLFIGSAEWEWDAYFSNLQIPHSQA

SEQ ID NO: 3206662 - protein, 27 aa, Giardia lamblia
ISGDTRPSPAFVFGAQMLREANTRFLI

SEQ ID NO: 3206663 - protein, 20 aa, Giardia lamblia
ISKASALFRIMTSMCPENKD

SEQ ID NO: 3206664 - protein, 21 aa, Giardia lamblia
ISLLNAERVCPELVGVGDLQY

SEQ ID NO: 3206665 - protein, 25 aa, Giardia lamblia
ISQNCTESWYARLLTENIFTEEVVI

SEQ ID NO: 3206666 - protein, 17 aa, Giardia lamblia
ISSLCACSTSMGTFILA

SEQ ID NO: 3206667 - protein, 20 aa, Giardia lamblia
ITALTFVCPHHPIWKLPSVL

SEQ ID NO: 3206668 - protein, 19 aa, Giardia lamblia
ITCPHRFSMDSSPNRTVQR

SEQ ID NO: 3206669 - protein, 17 aa, Giardia lamblia
ITIGDIDSLCLFDDYVA

SEQ ID NO: 3206670 - protein, 18 aa, Giardia lamblia
ITKYGTDVARDFMGTLPA

SEQ ID NO: 3206671 - protein, 18 aa, Giardia lamblia
ITLGCALGTPFTNEPEHG

SEQ ID NO: 3206672 - protein, 21 aa, Giardia lamblia
ITYLCAFCKQHGISEVYLFIG

SEQ ID NO: 3206673 - protein, 18 aa, Giardia lamblia
IVAIPDWSVRALYPNKIT

SEQ ID NO: 3206674 - protein, 19 aa, Giardia lamblia
IVAPNGWTALMFAAQAGQA

SEQ ID NO: 3206675 - protein, 19 aa, Giardia lamblia
IVDCYWGFGSFGCDGGDTL

SEQ ID NO: 3206676 - protein, 17 aa, Giardia lamblia
IVLWDGRHAVCDVPENR

SEQ ID NO: 3206677 - protein, 18 aa, Giardia lamblia
IVPWGWKKSDPHLTDPSI

SEQ ID NO: 3206678 - protein, 20 aa, Giardia lamblia
IVYPVARWTGKAVISSMLHK

SEQ ID NO: 3206679 - protein, 18 aa, Giardia lamblia
IYASCIVNGIVCPHGTYD

SEQ ID NO: 3206680 - protein, 17 aa, Giardia lamblia
IYGAALIAARYGSGHRV

SEQ ID NO: 3206681 - protein, 25 aa, Giardia lamblia
IYGCRLRVILGLKKEYVDLTHQRQA

SEQ ID NO: 3206682 - protein, 18 aa, Giardia lamblia
IYGRPLRDLINLNYNVSR

SEQ ID NO: 3206683 - protein, 19 aa, Giardia lamblia
IYHSWEYTNVFQLTDAKGH

SEQ ID NO: 3206684 - protein, 18 aa, Giardia lamblia
IYPPCLRAPCTSPGDSDA

SEQ ID NO: 3206685 - protein, 17 aa, Giardia lamblia
KAAIKAEGAVPLRPGAL

SEQ ID NO: 3206686 - protein, 19 aa, Giardia lamblia
KAASSYLFKLAKKVSEKMS

SEQ ID NO: 3206687 - protein, 32 aa, Giardia lamblia
KAKLKMGRLCLTGCSLQCSKKYSLALLDSATR

SEQ ID NO: 3206688 - protein, 19 aa, Giardia lamblia
KANMIKILLPYEGRCQDSF

SEQ ID NO: 3206689 - protein, 24 aa, Giardia lamblia
KAPHVPWLGAAGFPVYFDGIFYIT

SEQ ID NO: 3206690 - protein, 31 aa, Giardia lamblia
KAVDIEFERRCHVTFSPAFWNGTEVFANGYK

SEQ ID NO: 3206691 - protein, 21 aa, Giardia lamblia
KCANCHICSVNLYRPRSEPKR

SEQ ID NO: 3206692 - protein, 24 aa, Giardia lamblia
KCECDPGYELYNSVYYCMPEICIT

SEQ ID NO: 3206693 - protein, 19 aa, Giardia lamblia
KCISHACIDTSGLVCSGRG

SEQ ID NO: 3206694 - protein, 19 aa, Giardia lamblia
KDAGRIAGLDVVRIINEPT

SEQ ID NO: 3206695 - protein, 17 aa, Giardia lamblia
KDINADEAVAWGAAVQA

SEQ ID NO: 3206696 - protein, 17 aa, Giardia lamblia
KDSEFYIDLAVRSTINF

SEQ ID NO: 3206697 - protein, 17 aa, Giardia lamblia
KDSIFYFYGAASRALHM

SEQ ID NO: 3206698 - protein, 22 aa, Giardia lamblia
KEARLKVLTPFQVDDAVMAVTS

SEQ ID NO: 3206699 - protein, 20 aa, Giardia lamblia
KEEYVDFYLGTLYKPDPALS

SEQ ID NO: 3206700 - protein, 24 aa, Giardia lamblia
KEKGLKDSNGWTALMWAVKNDHTD

SEQ ID NO: 3206701 - protein, 24 aa, Giardia lamblia
KEKGLKDSNGWTALMYTARTGHAD

SEQ ID NO: 3206702 - protein, 23 aa, Giardia lamblia
KELLCFVHLLLALWVLDLQKLLG

SEQ ID NO: 3206703 - protein, 18 aa, Giardia lamblia
KEPAEVFIDGWRPDLSGV

SEQ ID NO: 3206704 - protein, 18 aa, Giardia lamblia
KEPAEVFVDGWRPDLSGV

SEQ ID NO: 3206705 - protein, 24 aa, Giardia lamblia
KFGHLEIVRLLRDVEACLQSDKGA

SEQ ID NO: 3206706 - protein, 18 aa, Giardia lamblia
KFGILALQSVGKLNKKKA

SEQ ID NO: 3206707 - protein, 20 aa, Giardia lamblia
KFLSDYRITILIGQSTSTYH

SEQ ID NO: 3206708 - protein, 26 aa, Giardia lamblia
KFVLRGWHFSDCTALMLGAAHGSIDV

SEQ ID NO: 3206709 - protein, 26 aa, Giardia lamblia
KHSHGKKMRTVVCQTPAPWVFLLDIL

SEQ ID NO: 3206710 - protein, 24 aa, Giardia lamblia
KIQGELCSLPRPLSNIDRVSMPEL

SEQ ID NO: 3206711 - protein, 25 aa, Giardia lamblia
KITTQWHLDMCKKIFDGLDLGNPTI

SEQ ID NO: 3206712 - protein, 18 aa, Giardia lamblia
KKDYILHYGKPLLYVNEV

SEQ ID NO: 3206713 - protein, 21 aa, Giardia lamblia
KKIFEFIRSGFLSMAKARSLA

SEQ ID NO: 3206714 - protein, 25 aa, Giardia lamblia
KKNKEEIMHLLLFPTTRTMVNSPEV

SEQ ID NO: 3206715 - protein, 23 aa, Giardia lamblia
KKPLSRVSSIFTRSLDTDLSPDG

SEQ ID NO: 3206716 - protein, 17 aa, Giardia lamblia
KLADFGVSAFLCDDSVE

SEQ ID NO: 3206717 - protein, 27 aa, Giardia lamblia
KLDELVILLRRLRVTTVSEKLLEYLKN

SEQ ID NO: 3206718 - protein, 18 aa, Giardia lamblia
KLMDGASVLMELSKGAQS

SEQ ID NO: 3206719 - protein, 19 aa, Giardia lamblia
KLSLLNCDFVFPVEVSDYF

SEQ ID NO: 3206720 - protein, 18 aa, Giardia lamblia
KLTLSNIRPRAVRVSTMK

SEQ ID NO: 3206721 - protein, 18 aa, Giardia lamblia
KNDLCVILFDGDRVTPKQ

SEQ ID NO: 3206722 - protein, 26 aa, Giardia lamblia
KNIIGDAGCELSFPQYRKKFLPSTLF

SEQ ID NO: 3206723 - protein, 31 aa, Giardia lamblia
KNLFVKFYAPWCGHCKKLAPTWEEMSNEYTT

SEQ ID NO: 3206724 - protein, 20 aa, Giardia lamblia
KNYWGPGWGEDGYFRIVRGQ

SEQ ID NO: 3206725 - protein, 30 aa, Giardia lamblia
KPALDQGSCGGCWAFSAIGVFGDRRCAMGI

SEQ ID NO: 3206726 - protein, 31 aa, Giardia lamblia
KPMMVKFFAPWCGHCKALAPKYVDLSDDAPE

SEQ ID NO: 3206727 - protein, 31 aa, Giardia lamblia
KPMMVKFFAPWCGHCKALAPTYVELGDNAPE

SEQ ID NO: 3206728 - protein, 24 aa, Giardia lamblia
KPPAACPHCASPFTQAVKRSAFNI

SEQ ID NO: 3206729 - protein, 19 aa, Giardia lamblia
KPVLLFFTSKMCKTCAANM

SEQ ID NO: 3206730 - protein, 20 aa, Giardia lamblia
KQAKKGCCGPSGSKVQFPYK

SEQ ID NO: 3206731 - protein, 19 aa, Giardia lamblia
KQHGISEVYLFIGSAEWEW

SEQ ID NO: 3206732 - protein, 24 aa, Giardia lamblia
KQKLRVFKIRGIEIPITALTFVCP

SEQ ID NO: 3206733 - protein, 21 aa, Giardia lamblia
KRGKTALMYAAQQGFGECVRA

SEQ ID NO: 3206734 - protein, 19 aa, Giardia lamblia
KRLSAAELLKHPTILEYKR

SEQ ID NO: 3206735 - protein, 19 aa, Giardia lamblia
KRNTLDIVYCADSYTLKSP

SEQ ID NO: 3206736 - protein, 24 aa, Giardia lamblia
KRQLLKTLVTWLISIELHDPTDSL

SEQ ID NO: 3206737 - protein, 20 aa, Giardia lamblia
KTALLLAICAGHLDVVKVLA

SEQ ID NO: 3206738 - protein, 25 aa, Giardia lamblia
KTIKLWMSGGFSFGAPAQASSQPQG

SEQ ID NO: 3206739 - protein, 19 aa, Giardia lamblia
KTITAMKLAMQIMDNELEQ

SEQ ID NO: 3206740 - protein, 25 aa, Giardia lamblia
KTLCLRHVCRLSPSLQGALQIWINA

SEQ ID NO: 3206741 - protein, 17 aa, Giardia lamblia
KTPLMTSCGVSKDPTTS

SEQ ID NO: 3206742 - protein, 21 aa, Giardia lamblia
KTRLKYSLSQIELLAVVLNTI

SEQ ID NO: 3206743 - protein, 19 aa, Giardia lamblia
KTVRDWYANVCNVLREIHP

SEQ ID NO: 3206744 - protein, 24 aa, Giardia lamblia
KTVWARMVNSWLAFCRSARNNAQG

SEQ ID NO: 3206745 - protein, 19 aa, Giardia lamblia
KTYLYKSVKSVAINRGICS

SEQ ID NO: 3206746 - protein, 18 aa, Giardia lamblia
KVLKRNTLDIVYCADSYT

SEQ ID NO: 3206747 - protein, 17 aa, Giardia lamblia
KVLSSYRPSSSVTKAGI

SEQ ID NO: 3206748 - protein, 24 aa, Giardia lamblia
KVQFPYKYKGLFILTPGPLSADAE

SEQ ID NO: 3206749 - protein, 18 aa, Giardia lamblia
KYECGSLEAALNGANARI

SEQ ID NO: 3206750 - protein, 25 aa, Giardia lamblia
KYGDFFPRRFVQEAFYIRSTNYERT

SEQ ID NO: 3206751 - protein, 19 aa, Giardia lamblia
KYKMLLWNLSLFFSVVLER

SEQ ID NO: 3206752 - protein, 20 aa, Giardia lamblia
KYLPFVNSILIDPGVCLMNG

SEQ ID NO: 3206753 - protein, 18 aa, Giardia lamblia
KYLRPAIGRLLKLLTTEM

SEQ ID NO: 3206754 - protein, 23 aa, Giardia lamblia
LACPHCRAPFILSCTALQRDEFT

SEQ ID NO: 3206755 - protein, 21 aa, Giardia lamblia
LAELDFGRKEACIVNMIKNGD

SEQ ID NO: 3206756 - protein, 24 aa, Giardia lamblia
LAGTRSGKLFAWTVTTETLCFGVQ

SEQ ID NO: 3206757 - protein, 20 aa, Giardia lamblia
LAHKCRHAMAKIAQEHDDLL

SEQ ID NO: 3206758 - protein, 21 aa, Giardia lamblia
LALFALCLADSVLTPHVSYSV

SEQ ID NO: 3206759 - protein, 27 aa, Giardia lamblia
LARREGNLINRWGWSALTYAVHNNNVD

SEQ ID NO: 3206760 - protein, 24 aa, Giardia lamblia
LARSSCALALFAVFCSKASGRSDR

SEQ ID NO: 3206761 - protein, 18 aa, Giardia lamblia
LASCKQTLSELLKSSQAA

SEQ ID NO: 3206762 - protein, 24 aa, Giardia lamblia
LASLKFGETTGMVYDTCEDYWNRT

SEQ ID NO: 3206763 - protein, 18 aa, Giardia lamblia
LASSCPLCDAYGVEEIST

SEQ ID NO: 3206764 - protein, 20 aa, Giardia lamblia
LATSIGRRKPLISVESPDLE

SEQ ID NO: 3206765 - protein, 19 aa, Giardia lamblia
LAVNSCSFLAHNHTVFFCG

SEQ ID NO: 3206766 - protein, 22 aa, Giardia lamblia
LCCAMASGGLSITVLADIHLDE

SEQ ID NO: 3206767 - protein, 20 aa, Giardia lamblia
LCGRSPSIFGCTDSKATDAK

SEQ ID NO: 3206768 - protein, 23 aa, Giardia lamblia
LCHGCGSPDGVVHFLLDNCATFH

SEQ ID NO: 3206769 - protein, 18 aa, Giardia lamblia
LCRCDPLDAITLGPFTCV

SEQ ID NO: 3206770 - protein, 19 aa, Giardia lamblia
LCSCIKRDLIAAAQLDMLH

SEQ ID NO: 3206771 - protein, 21 aa, Giardia lamblia
LCVPPGCIIHGELCPDGHCTN

SEQ ID NO: 3206772 - protein, 19 aa, Giardia lamblia
LDISLAHAISVASNPSYAV

SEQ ID NO: 3206773 - protein, 17 aa, Giardia lamblia
LEDAIALANEKDKPKQR

SEQ ID NO: 3206774 - protein, 22 aa, Giardia lamblia
LEDCRKSKCRVAVIQHIPLMMS

SEQ ID NO: 3206775 - protein, 18 aa, Giardia lamblia
LEGDVLFSSALKLKKFTY

SEQ ID NO: 3206776 - protein, 17 aa, Giardia lamblia
LEGDVLFSSAVKLKKFT

SEQ ID NO: 3206777 - protein, 18 aa, Giardia lamblia
LEGNVLFSSAVKLRKFTY

SEQ ID NO: 3206778 - protein, 17 aa, Giardia lamblia
LEMDPIYNGYIIGGCEP

SEQ ID NO: 3206779 - protein, 18 aa, Giardia lamblia
LEPICAVLTRYLPTYDAF

SEQ ID NO: 3206780 - protein, 23 aa, Giardia lamblia
LEPLATLFLDMIKLISEPSGAAS

SEQ ID NO: 3206781 - protein, 18 aa, Giardia lamblia
LFDCVLLLEIVYTLIKSE

SEQ ID NO: 3206782 - protein, 19 aa, Giardia lamblia
LFENISLRAASPDVRLEPG

SEQ ID NO: 3206783 - protein, 22 aa, Giardia lamblia
LFFFNFELIRGEVRSVYSDEDG

SEQ ID NO: 3206784 - protein, 18 aa, Giardia lamblia
LFFPVRELGGFLLDEQVD

SEQ ID NO: 3206785 - protein, 19 aa, Giardia lamblia
LFIALLCRCNDPVVSEVPP

SEQ ID NO: 3206786 - protein, 26 aa, Giardia lamblia
LFQPFKEYWKSVARARVKALEYNLQE

SEQ ID NO: 3206787 - protein, 17 aa, Giardia lamblia
LGITGRVTQLFLDFLSL

SEQ ID NO: 3206788 - protein, 24 aa, Giardia lamblia
LGKPSSRSLMDWSTIPLRHIAIQV

SEQ ID NO: 3206789 - protein, 30 aa, Giardia lamblia
LGLKLFTARCNRLQYSFSHLDLAVVDYVDL

SEQ ID NO: 3206790 - protein, 23 aa, Giardia lamblia
LGSVKCVSLLLGEAGKQDSHGNT

SEQ ID NO: 3206791 - protein, 24 aa, Giardia lamblia
LGTLYKPDPALSFDSSIASLAKEM

SEQ ID NO: 3206792 - protein, 22 aa, Giardia lamblia
LHASHMSSLLGFLLLSQEVQTA

SEQ ID NO: 3206793 - protein, 20 aa, Giardia lamblia
LIFRRIRKDLFLSLREHFNY

SEQ ID NO: 3206794 - protein, 17 aa, Giardia lamblia
LIMKCTGAIRTFEVDQQ

SEQ ID NO: 3206795 - protein, 19 aa, Giardia lamblia
LIYSGRLSVLSSRVTSNVK

SEQ ID NO: 3206796 - protein, 19 aa, Giardia lamblia
LKDPNRFLTCGAEGNLRLY

SEQ ID NO: 3206797 - protein, 25 aa, Giardia lamblia
LKDSDLCLLGGLSYLRVLDMTDTSL

SEQ ID NO: 3206798 - protein, 24 aa, Giardia lamblia
LKELLPCVAAPTCELFLQAFEQPD

SEQ ID NO: 3206799 - protein, 19 aa, Giardia lamblia
LKEVCAAFVEALNRASNET

SEQ ID NO: 3206800 - protein, 28 aa, Giardia lamblia
LKEVRGITRCFIRYELPADRYVMDIEGG

SEQ ID NO: 3206801 - protein, 21 aa, Giardia lamblia
LKKIGERIARAMVRKLTDLYK

SEQ ID NO: 3206802 - protein, 18 aa, Giardia lamblia
LKLALKQRESTIMELRAQ

SEQ ID NO: 3206803 - protein, 20 aa, Giardia lamblia
LKLTLSNVRPRAVRVSTMKV

SEQ ID NO: 3206804 - protein, 19 aa, Giardia lamblia
LKNDLMKTITAMKLAMQIM

SEQ ID NO: 3206805 - protein, 19 aa, Giardia lamblia
LKQAGTIALELDRRECIEL

SEQ ID NO: 3206806 - protein, 18 aa, Giardia lamblia
LKRTFFLALTEDPNYSEK

SEQ ID NO: 3206807 - protein, 20 aa, Giardia lamblia
LKYKLVINLYEAFFGFSKRI

SEQ ID NO: 3206808 - protein, 18 aa, Giardia lamblia
LLDQCVDLAFTGSLGDPL

SEQ ID NO: 3206809 - protein, 28 aa, Giardia lamblia
LLDRRLRESEARNSTLLSAVSGYEDVLQ

SEQ ID NO: 3206810 - protein, 18 aa, Giardia lamblia
LLEYSYKQKHKMSVANSP

SEQ ID NO: 3206811 - protein, 17 aa, Giardia lamblia
LLGSILLAGWYDIPEVG

SEQ ID NO: 3206812 - protein, 19 aa, Giardia lamblia
LLKHPTILEYKRFYDEQIV

SEQ ID NO: 3206813 - protein, 29 aa, Giardia lamblia
LLLLLVTFCTLTIKKFDEIKALTGDVITF

SEQ ID NO: 3206814 - protein, 19 aa, Giardia lamblia
LLLLWKMGVSSAWAVSGVS

SEQ ID NO: 3206815 - protein, 17 aa, Giardia lamblia
LLMPVSFLKRDRAAVPR

SEQ ID NO: 3206816 - protein, 17 aa, Giardia lamblia
LLPYEGRCQDSFGMTAM

SEQ ID NO: 3206817 - protein, 17 aa, Giardia lamblia
LLQIVDIRFVSQADAES

SEQ ID NO: 3206818 - protein, 24 aa, Giardia lamblia
LLRRYPGRYAIVLGATGGLGTSFC

SEQ ID NO: 3206819 - protein, 20 aa, Giardia lamblia
LLSHIPRDYLNVVKKKTKHV

SEQ ID NO: 3206820 - protein, 21 aa, Giardia lamblia
LLTIEPLNLWNLVYYDNGDTI

SEQ ID NO: 3206821 - protein, 19 aa, Giardia lamblia
LLTSLWAAYTLSKAIAPLA

SEQ ID NO: 3206822 - protein, 17 aa, Giardia lamblia
LMHLLRDNFGRYALTLS

SEQ ID NO: 3206823 - protein, 20 aa, Giardia lamblia
LMSNLLRHLYNIDVTGAAVL

SEQ ID NO: 3206824 - protein, 17 aa, Giardia lamblia
LNEKYVIEITNLKRTLR

SEQ ID NO: 3206825 - protein, 18 aa, Giardia lamblia
LNHCSTCVKKTTCAAFLD

SEQ ID NO: 3206826 - protein, 24 aa, Giardia lamblia
LNLSNIYITLDFSRYGNNVPDIGA

SEQ ID NO: 3206827 - protein, 18 aa, Giardia lamblia
LNSKACELVEKYVTLYKK

SEQ ID NO: 3206828 - protein, 21 aa, Giardia lamblia
LPAGLSVVFAELSWTEAEQNM

SEQ ID NO: 3206829 - protein, 24 aa, Giardia lamblia
LPAPQMRPACAVCAAGPACITRGP

SEQ ID NO: 3206830 - protein, 19 aa, Giardia lamblia
LPCPMVACYSASKAYTHAF

SEQ ID NO: 3206831 - protein, 21 aa, Giardia lamblia
LPPRAGSTISAPRGASQPLPA

SEQ ID NO: 3206832 - protein, 22 aa, Giardia lamblia
LPVNLRTLPLFIRLKQIATIYN

SEQ ID NO: 3206833 - protein, 25 aa, Giardia lamblia
LQEELRPAAITVLVAAPAWIASNMT

SEQ ID NO: 3206834 - protein, 25 aa, Giardia lamblia
LQQQFLWRIMTHLLKDPDRVGDTTV

SEQ ID NO: 3206835 - protein, 19 aa, Giardia lamblia
LQQYLGPRCYYKLRKPSAP

SEQ ID NO: 3206836 - protein, 41 aa, Giardia lamblia
LQSKSLLRVLSWLWATNKAYCAVFLASLPIQQVHLLLLAAP

SEQ ID NO: 3206837 - protein, 18 aa, Giardia lamblia
LQSQLPVFIMGRGDGTVL

SEQ ID NO: 3206838 - protein, 17 aa, Giardia lamblia
LRAPCTSPGDSDAPKST

SEQ ID NO: 3206839 - protein, 17 aa, Giardia lamblia
LRASLRIPPSCYLTPLR

SEQ ID NO: 3206840 - protein, 20 aa, Giardia lamblia
LRFWLRRASAGAARRGAGLC

SEQ ID NO: 3206841 - protein, 23 aa, Giardia lamblia
LRHIRCVTKPLPIASNAGSVSTA

SEQ ID NO: 3206842 - protein, 17 aa, Giardia lamblia
LRIPPSCYLTPLRKLLA

SEQ ID NO: 3206843 - protein, 28 aa, Giardia lamblia
LRKIYLRDVLRSFVLRECPISDGSVRYE

SEQ ID NO: 3206844 - protein, 20 aa, Giardia lamblia
LRLEAKWKRDELNEQLRQER

SEQ ID NO: 3206845 - protein, 19 aa, Giardia lamblia
LRLRGIKTKLVYFPTQSHW

SEQ ID NO: 3206846 - protein, 24 aa, Giardia lamblia
LRLYDRRRMHVANEIYTGNEAILR

SEQ ID NO: 3206847 - protein, 19 aa, Giardia lamblia
LRMCFLHKLVDCFPERLEC

SEQ ID NO: 3206848 - protein, 19 aa, Giardia lamblia
LRNAMKVVSDRLAHIKCIV

SEQ ID NO: 3206849 - protein, 20 aa, Giardia lamblia
LRSSTRCRFAVSSGQLRTRD

SEQ ID NO: 3206850 - protein, 19 aa, Giardia lamblia
LRSVLEIYEIVYLLQEGNF

SEQ ID NO: 3206851 - protein, 20 aa, Giardia lamblia
LRVLLVAFLPVASMRPALST

SEQ ID NO: 3206852 - protein, 22 aa, Giardia lamblia
LSDMLYCTPIMVLRELNAAVAK

SEQ ID NO: 3206853 - protein, 22 aa, Giardia lamblia
LSEKPVPVLLNYASAKRDTEAF

SEQ ID NO: 3206854 - protein, 17 aa, Giardia lamblia
LSGITKLEFPAYSPETF

SEQ ID NO: 3206855 - protein, 19 aa, Giardia lamblia
LSITVCCPCKVESDESIAV

SEQ ID NO: 3206856 - protein, 25 aa, Giardia lamblia
LSKNEWNVFPLRALVERELSDPDRC

SEQ ID NO: 3206857 - protein, 26 aa, Giardia lamblia
LSLAILLCLWLCKIFIIPLFTLSDRK

SEQ ID NO: 3206858 - protein, 18 aa, Giardia lamblia
LSNVKPRAARVSTMKVHL

SEQ ID NO: 3206859 - protein, 17 aa, Giardia lamblia
LSRRELQEIRALQPPWT

SEQ ID NO: 3206860 - protein, 27 aa, Giardia lamblia
LSRSRACSGPCRFHFLNFALLICPQLL

SEQ ID NO: 3206861 - protein, 25 aa, Giardia lamblia
LSSEHGWSETMYLVLRGHDDRALFE

SEQ ID NO: 3206862 - protein, 23 aa, Giardia lamblia
LSWSCRTDMPMRLAISTISDACP

SEQ ID NO: 3206863 - protein, 19 aa, Giardia lamblia
LTELGCYPSGCSDRRTQYV

SEQ ID NO: 3206864 - protein, 22 aa, Giardia lamblia
LTEPLYRMVLVGDEEKMVKGKQ

SEQ ID NO: 3206865 - protein, 20 aa, Giardia lamblia
LTEYACMYWFGDSKHAETDL

SEQ ID NO: 3206866 - protein, 20 aa, Giardia lamblia
LTHFYFRPSRLWNLADLNLK

SEQ ID NO: 3206867 - protein, 39 aa, Giardia lamblia
LTIASSGALDWSVFHRICYSPRVSVPIVVLEEQSRTFQE

SEQ ID NO: 3206868 - protein, 21 aa, Giardia lamblia
LTRLLSAFSRQSSPKELSNDH

SEQ ID NO: 3206869 - protein, 18 aa, Giardia lamblia
LTSCPLEDAIALANEKDK

SEQ ID NO: 3206870 - protein, 24 aa, Giardia lamblia
LTTLRRLDFLGGKEPAEVFVTGGG

SEQ ID NO: 3206871 - protein, 23 aa, Giardia lamblia
LTTLRRLDFLKGKEPAEVFVDGW

SEQ ID NO: 3206872 - protein, 24 aa, Giardia lamblia
LTTLRRPDFLGGKEPAEVFIDGWR

SEQ ID NO: 3206873 - protein, 17 aa, Giardia lamblia
LVCDGSMVFLYIFDLTS

SEQ ID NO: 3206874 - protein, 19 aa, Giardia lamblia
LVCDMHQIFSILRGTSHTS

SEQ ID NO: 3206875 - protein, 25 aa, Giardia lamblia
LVDALRCIVCHDVARKPVVLGCDHI

SEQ ID NO: 3206876 - protein, 24 aa, Giardia lamblia
LVFVGAIGPFACSPVLPRASRKNR

SEQ ID NO: 3206877 - protein, 18 aa, Giardia lamblia
LVLPRAASSITVEIPAEK

SEQ ID NO: 3206878 - protein, 24 aa, Giardia lamblia
LVTLRRPDFLGGKEPAEVFVDGWR

SEQ ID NO: 3206879 - protein, 20 aa, Giardia lamblia
LVVPLHRWRGAPACCLQPPS

SEQ ID NO: 3206880 - protein, 30 aa, Giardia lamblia
LYAIRAIILDSEMPLLFSIEHVVTKRKLDK

SEQ ID NO: 3206881 - protein, 19 aa, Giardia lamblia
LYCDTCKVSITGEKVYQEH

SEQ ID NO: 3206882 - protein, 17 aa, Giardia lamblia
LYFSLTNLWKHAHNEDS

SEQ ID NO: 3206883 - protein, 18 aa, Giardia lamblia
LYINRVFVTNETGSILPQ

SEQ ID NO: 3206884 - protein, 17 aa, Giardia lamblia
LYMYTVLILEKSGQTDR

SEQ ID NO: 3206885 - protein, 19 aa, Giardia lamblia
LYNSVYYCMPEICITGTWL

SEQ ID NO: 3206886 - protein, 22 aa, Giardia lamblia
LYSSSCKRLFSLSPSGFIEVTR

SEQ ID NO: 3206887 - protein, 17 aa, Giardia lamblia
LYTSWSINDSLRATQLE

SEQ ID NO: 3206888 - protein, 26 aa, Giardia lamblia
MACDGGWLPSVWRFLTKTGTTTDECV

SEQ ID NO: 3206889 - protein, 25 aa, Giardia lamblia
MACNGGWLPNVWKFLTKTGTTTDEC

SEQ ID NO: 3206890 - protein, 19 aa, Giardia lamblia
MAFAKKGIDALMGKQTSLL

SEQ ID NO: 3206891 - protein, 19 aa, Giardia lamblia
MAPLRAKKALEAHFQRQPQ

SEQ ID NO: 3206892 - protein, 17 aa, Giardia lamblia
MAQHASVPCINALDDFG

SEQ ID NO: 3206893 - protein, 21 aa, Giardia lamblia
MCGEVTPLYPLVAYTGETVHT

SEQ ID NO: 3206894 - protein, 23 aa, Giardia lamblia
MCIALCCYCIDAQANQAIEFLLD

SEQ ID NO: 3206895 - protein, 17 aa, Giardia lamblia
MDVHLLLCAAEFVHQLQ

SEQ ID NO: 3206896 - protein, 28 aa, Giardia lamblia
MFMKRARIGPYIAELMGLLTAEDGPRAE

SEQ ID NO: 3206897 - protein, 18 aa, Giardia lamblia
MGVSSAWAVSGVSPSAPG

SEQ ID NO: 3206898 - protein, 19 aa, Giardia lamblia
MLIEYKKLMGAPVNGNNDE

SEQ ID NO: 3206899 - protein, 17 aa, Giardia lamblia
MLWKGYQLLRTCTPAAS

SEQ ID NO: 3206900 - protein, 17 aa, Giardia lamblia
MNSEQRLLSWIETDLKP

SEQ ID NO: 3206901 - protein, 19 aa, Giardia lamblia
MPSVDGFSSYTLLNAAEPI

SEQ ID NO: 3206902 - protein, 17 aa, Giardia lamblia
MQISMRLKAVITGITGT

SEQ ID NO: 3206903 - protein, 18 aa, Giardia lamblia
MQISMRLKAVITGITGTV

SEQ ID NO: 3206904 - protein, 17 aa, Giardia lamblia
MSGHVFPSCLLERSEQF

SEQ ID NO: 3206905 - protein, 20 aa, Giardia lamblia
MSQHRLLLFLRFLDSFVSDF

SEQ ID NO: 3206906 - protein, 19 aa, Giardia lamblia
MSSLCYDKKISFICAARAI

SEQ ID NO: 3206907 - protein, 20 aa, Giardia lamblia
MSVVFYAPWCGHCKNLKPEY

SEQ ID NO: 3206908 - protein, 28 aa, Giardia lamblia
MTAAQLLKLPFCKKYLAKEEDLRKLFVK

SEQ ID NO: 3206909 - protein, 19 aa, Giardia lamblia
MTKMLSCLTKLLIILRSPR

SEQ ID NO: 3206910 - protein, 21 aa, Giardia lamblia
MTLSGCVRGLNRLEMRHQTEE

SEQ ID NO: 3206911 - protein, 20 aa, Giardia lamblia
MVAASLNLLSAVEILLEYEL

SEQ ID NO: 3206912 - protein, 18 aa, Giardia lamblia
MVDKDNWNALMYSAMCND

SEQ ID NO: 3206913 - protein, 23 aa, Giardia lamblia
MYRCPLCSAPYSLQRCQPNARLD

SEQ ID NO: 3206914 - protein, 25 aa, Giardia lamblia
NAPAFLRPALTDMLPALADFSFVEE

SEQ ID NO: 3206915 - protein, 24 aa, Giardia lamblia
NCGTLPPTNCAQCFTDPDCGEYCL

SEQ ID NO: 3206916 - protein, 18 aa, Giardia lamblia
NCLPEDAVQDILWSDPSQ

SEQ ID NO: 3206917 - protein, 24 aa, Giardia lamblia
NDNMAICLRKLIVLASQLVCSDSP

SEQ ID NO: 3206918 - protein, 17 aa, Giardia lamblia
NEFSGRIAYEMDSPYLG

SEQ ID NO: 3206919 - protein, 18 aa, Giardia lamblia
NELGARVTPSYVAFTADG

SEQ ID NO: 3206920 - protein, 20 aa, Giardia lamblia
NEPEHGMGMRFTRRGLEKFC

SEQ ID NO: 3206921 - protein, 17 aa, Giardia lamblia
NFGRYALTLSSLEAGLL

SEQ ID NO: 3206922 - protein, 19 aa, Giardia lamblia
NFHGSGSFGEEFQKSIRQH

SEQ ID NO: 3206923 - protein, 26 aa, Giardia lamblia
NGDGLIRLKYPWAFDNEAVTKEANEE

SEQ ID NO: 3206924 - protein, 19 aa, Giardia lamblia
NGDPRCIPKELIAQYPILS

SEQ ID NO: 3206925 - protein, 19 aa, Giardia lamblia
NGFRRDFFNHYTVFSSSDY

SEQ ID NO: 3206926 - protein, 21 aa, Giardia lamblia
NHALSGFLFDAVTYLQENGLL

SEQ ID NO: 3206927 - protein, 23 aa, Giardia lamblia
NIKNFWRIVAELTQEQQRRLLRF

SEQ ID NO: 3206928 - protein, 25 aa, Giardia lamblia
NIYREIKASISLSCNPYMVKTYNIY

SEQ ID NO: 3206929 - protein, 26 aa, Giardia lamblia
NKGAYAVLDVRCMRTTITSEVDVIGL

SEQ ID NO: 3206930 - protein, 27 aa, Giardia lamblia
NKIIYCSNGEFGRALLEYSYKQKHKMS

SEQ ID NO: 3206931 - protein, 22 aa, Giardia lamblia
NKNLFGFSYDWRQPLYAECIKG

SEQ ID NO: 3206932 - protein, 22 aa, Giardia lamblia
NKSWFKKMIGKGGSEIEEKEKK

SEQ ID NO: 3206933 - protein, 23 aa, Giardia lamblia
NKYFPFVNGILIDPGVCLMNGNF

SEQ ID NO: 3206934 - protein, 18 aa, Giardia lamblia
NLDTTVSLWDIYKQEVDI

SEQ ID NO: 3206935 - protein, 19 aa, Giardia lamblia
NLEGDVLFSSALKLKKFTY

SEQ ID NO: 3206936 - protein, 20 aa, Giardia lamblia
NLITRTWLGMSLPQNVTYAD

SEQ ID NO: 3206937 - protein, 18 aa, Giardia lamblia
NLLSAVEILLEYELLAQD

SEQ ID NO: 3206938 - protein, 20 aa, Giardia lamblia
NLNDGMGFYSIIKALTQRRK

SEQ ID NO: 3206939 - protein, 17 aa, Giardia lamblia
NNFRCISDLYFQKYTEE

SEQ ID NO: 3206940 - protein, 18 aa, Giardia lamblia
NNISQIFEIYGIEAARNA

SEQ ID NO: 3206941 - protein, 17 aa, Giardia lamblia
NNQGWTALMNAAKFGHL

SEQ ID NO: 3206942 - protein, 24 aa, Giardia lamblia
NPCPVCAFPDAFWIQMQIRSSDEP

SEQ ID NO: 3206943 - protein, 22 aa, Giardia lamblia
NQPEAFLIAYGMHKFNADTYQA

SEQ ID NO: 3206944 - protein, 21 aa, Giardia lamblia
NRFSVGIECLIHKEAKLQDAL

SEQ ID NO: 3206945 - protein, 19 aa, Giardia lamblia
NSWGPDWGEDGYFRIIRMT

SEQ ID NO: 3206946 - protein, 19 aa, Giardia lamblia
NSWGPDWGEDGYFRMIRGI

SEQ ID NO: 3206947 - protein, 18 aa, Giardia lamblia
NSYIPVKKSKIFSTVQDQ

SEQ ID NO: 3206948 - protein, 19 aa, Giardia lamblia
NTKGTWRWEAYSMWPHLGR

SEQ ID NO: 3206949 - protein, 24 aa, Giardia lamblia
NTPFFDELWIVAGYPSVAEGDASY

SEQ ID NO: 3206950 - protein, 24 aa, Giardia lamblia
NTYKPSLFCSTVYLSSLYASLVPT

SEQ ID NO: 3206951 - protein, 23 aa, Giardia lamblia
NVPTDWSPLMLACVGCDTQRLSE

SEQ ID NO: 3206952 - protein, 23 aa, Giardia lamblia
NWDCNWPPYASHIELEIWEHGSE

SEQ ID NO: 3206953 - protein, 24 aa, Giardia lamblia
NWLTPDVSYCSWTGITCDSNNNVI

SEQ ID NO: 3206954 - protein, 24 aa, Giardia lamblia
NYCVARKLVIHMLIEAMILEIDAR

SEQ ID NO: 3206955 - protein, 21 aa, Giardia lamblia
PAACAMKLSDLQPRQEEDQSS

SEQ ID NO: 3206956 - protein, 25 aa, Giardia lamblia
PAMAPVLRPLLLLPEDTQEAPASSG

SEQ ID NO: 3206957 - protein, 17 aa, Giardia lamblia
PDKRLSAAELLKHPTIL

SEQ ID NO: 3206958 - protein, 17 aa, Giardia lamblia
PDPISRLVCNGHGFCDG

SEQ ID NO: 3206959 - protein, 18 aa, Giardia lamblia
PDQLPLSVTIQFVNSDPS

SEQ ID NO: 3206960 - protein, 17 aa, Giardia lamblia
PEACYTEEGVCFGYGTC

SEQ ID NO: 3206961 - protein, 25 aa, Giardia lamblia
PEDQKECSCCYAFATLGALSTRRCI

SEQ ID NO: 3206962 - protein, 21 aa, Giardia lamblia
PELFQLAPYSLRVYILAEHSA

SEQ ID NO: 3206963 - protein, 17 aa, Giardia lamblia
PELLQIVDIRFVSQADA

SEQ ID NO: 3206964 - protein, 17 aa, Giardia lamblia
PETNCTVVNETRTDLDK

SEQ ID NO: 3206965 - protein, 27 aa, Giardia lamblia
PEVMRELVSFFRWLLLDEEGSIEPSVN

SEQ ID NO: 3206966 - protein, 18 aa, Giardia lamblia
PFYFSTRQLYRFILLNNS

SEQ ID NO: 3206967 - protein, 20 aa, Giardia lamblia
PGEKSITIDDVFAREELFED

SEQ ID NO: 3206968 - protein, 24 aa, Giardia lamblia
PGLAEALVKAGLLSTVNDLGLGVT

SEQ ID NO: 3206969 - protein, 18 aa, Giardia lamblia
PGLAEALVKAGMLTDVSD

SEQ ID NO: 3206970 - protein, 17 aa, Giardia lamblia
PGNSLAESSYKRITSSV

SEQ ID NO: 3206971 - protein, 24 aa, Giardia lamblia
PGTKDLLCSIGLQPILLFCDAHAA

SEQ ID NO: 3206972 - protein, 25 aa, Giardia lamblia
PKRKRIMLTISLFIALLCRCNDPVV

SEQ ID NO: 3206973 - protein, 23 aa, Giardia lamblia
PKTSLLCEFLSISLLPAQVSNQR

SEQ ID NO: 3206974 - protein, 25 aa, Giardia lamblia
PLAKNIFQGMAFAWLFLGWALSVTF

SEQ ID NO: 3206975 - protein, 25 aa, Giardia lamblia
PLASLKFGETTGMVYDTCEDYWNRT

SEQ ID NO: 3206976 - protein, 21 aa, Giardia lamblia
PLTEARRVVTMIFRSINTEDL

SEQ ID NO: 3206977 - protein, 17 aa, Giardia lamblia
PLTHTVCGGVSSENVRA

SEQ ID NO: 3206978 - protein, 18 aa, Giardia lamblia
PMNTHLLAILTICNTIEQ

SEQ ID NO: 3206979 - protein, 18 aa, Giardia lamblia
PMRPFADASSYTFDSHGR

SEQ ID NO: 3206980 - protein, 24 aa, Giardia lamblia
PNRQRPSLMLNQAFIDHPMNTHLL

SEQ ID NO: 3206981 - protein, 18 aa, Giardia lamblia
PNTPCLSSVRIVVREEDL

SEQ ID NO: 3206982 - protein, 18 aa, Giardia lamblia
PPLIDFAAEFNIQPPRCQ

SEQ ID NO: 3206983 - protein, 25 aa, Giardia lamblia
PPPSTREIHGFLATRNYSSRLEMDP

SEQ ID NO: 3206984 - protein, 20 aa, Giardia lamblia
PPSFNRDSLIFIVKPLALSR

SEQ ID NO: 3206985 - protein, 20 aa, Giardia lamblia
PQELDWRVRGIMNMAKDQVA

SEQ ID NO: 3206986 - protein, 18 aa, Giardia lamblia
PQESLFWHTQVFDWLDTY

SEQ ID NO: 3206987 - protein, 20 aa, Giardia lamblia
PRALIKPLVYIGRILHLTNY

SEQ ID NO: 3206988 - protein, 21 aa, Giardia lamblia
PRCICPTDYIGRNSVCYPSSC

SEQ ID NO: 3206989 - protein, 20 aa, Giardia lamblia
PRGAGILYSSEFYRKFATEN

SEQ ID NO: 3206990 - protein, 22 aa, Giardia lamblia
PRYADICSRFESLLVGAKADQP

SEQ ID NO: 3206991 - protein, 22 aa, Giardia lamblia
PSADPREYIEIIPRGTDLAQIL

SEQ ID NO: 3206992 - protein, 19 aa, Giardia lamblia
PSAFPPWGKPTVYDPQNPI

SEQ ID NO: 3206993 - protein, 25 aa, Giardia lamblia
PSHSQQLHCLYEFYDALQGDSWWVR

SEQ ID NO: 3206994 - protein, 20 aa, Giardia lamblia
PSIRHILLMWQRGVMHVVRN

SEQ ID NO: 3206995 - protein, 29 aa, Giardia lamblia
PSLSQLHGWPDKVLYFLRDLCAYPVVLSV

SEQ ID NO: 3206996 - protein, 24 aa, Giardia lamblia
PSLTRFFLSTALERFAPIRLSTLQ

SEQ ID NO: 3206997 - protein, 18 aa, Giardia lamblia
PSMDTGYSIDRFVKDNAV

SEQ ID NO: 3206998 - protein, 25 aa, Giardia lamblia
PSMTTPEYWKRFMSDVLVSTASDLV

SEQ ID NO: 3206999 - protein, 19 aa, Giardia lamblia
PSNTSDLWNDANVLTTYNA

SEQ ID NO: 3207000 - protein, 28 aa, Giardia lamblia
PTALRLCRALLWPPGWPDLQLALHSPRH

SEQ ID NO: 3207001 - protein, 22 aa, Giardia lamblia
PTDYQYVLGYCVPNVCVTTYSD

SEQ ID NO: 3207002 - protein, 20 aa, Giardia lamblia
PTEDLHVLNEKYVIEITNLK

SEQ ID NO: 3207003 - protein, 24 aa, Giardia lamblia
PTLICPSSLLPRGVVNTAQARLIN

SEQ ID NO: 3207004 - protein, 26 aa, Giardia lamblia
PTLKGGSCIQGILTREGRLQHEQLGK

SEQ ID NO: 3207005 - protein, 17 aa, Giardia lamblia
PTNKLVFGNIRPTSIYV

SEQ ID NO: 3207006 - protein, 23 aa, Giardia lamblia
PTTRKLEAWEMDFVDEKKPAGRV

SEQ ID NO: 3207007 - protein, 23 aa, Giardia lamblia
PVHRLLLRRPIRVQFSGEAAVDF

SEQ ID NO: 3207008 - protein, 28 aa, Giardia lamblia
PVKDQAACGSCWSFGAAGTIEGRLNALK

SEQ ID NO: 3207009 - protein, 17 aa, Giardia lamblia
PVNYGRHAGRVMKIPSY

SEQ ID NO: 3207010 - protein, 18 aa, Giardia lamblia
PVSIAVAVTETFSWYSGG

SEQ ID NO: 3207011 - protein, 20 aa, Giardia lamblia
PWAARCIRMRAMLPPCGLRG

SEQ ID NO: 3207012 - protein, 22 aa, Giardia lamblia
PWCGHCKNLKPEYAKAGAELDG

SEQ ID NO: 3207013 - protein, 17 aa, Giardia lamblia
PWHMCSMTDDMGGQKDN

SEQ ID NO: 3207014 - protein, 21 aa, Giardia lamblia
PYTQYRMIFKSELPANKRYYM

SEQ ID NO: 3207015 - protein, 25 aa, Giardia lamblia
PYVACLKAGFLVAAERTKEALASAG

SEQ ID NO: 3207016 - protein, 21 aa, Giardia lamblia
PYWDGRTVLFSKTYQDYSTAL

SEQ ID NO: 3207017 - protein, 17 aa, Giardia lamblia
QAIEFLLDFEPRIQTSH

SEQ ID NO: 3207018 - protein, 17 aa, Giardia lamblia
QCLAILFDPDNYFLRAS

SEQ ID NO: 3207019 - protein, 17 aa, Giardia lamblia
QCNLSFYLFSYLINAGD

SEQ ID NO: 3207020 - protein, 25 aa, Giardia lamblia
QDANGRSALMFAIHNRFSVGIECLI

SEQ ID NO: 3207021 - protein, 24 aa, Giardia lamblia
QDDEGRTALVYALFGQHKDVVKLL

SEQ ID NO: 3207022 - protein, 17 aa, Giardia lamblia
QFAELRALVAEKYKDSI

SEQ ID NO: 3207023 - protein, 24 aa, Giardia lamblia
QGFGECVRALLPFEKGMVDKDNWN

SEQ ID NO: 3207024 - protein, 25 aa, Giardia lamblia
QGSGSVTCWVACAEKAIAQIAEALQ

SEQ ID NO: 3207025 - protein, 21 aa, Giardia lamblia
QIESMTVYKNNFVWVSEQMPG

SEQ ID NO: 3207026 - protein, 18 aa, Giardia lamblia
QKAQCRFESRVTQSLTAN

SEQ ID NO: 3207027 - protein, 18 aa, Giardia lamblia
QKDMKLLPYKVINKDGRP

SEQ ID NO: 3207028 - protein, 20 aa, Giardia lamblia
QKKYPLLMADSSIREAVAEI

SEQ ID NO: 3207029 - protein, 25 aa, Giardia lamblia
QKLPISVAIKPLWVRTELATIEESF

SEQ ID NO: 3207030 - protein, 17 aa, Giardia lamblia
QKYSSWQLNAFDSGAYP

SEQ ID NO: 3207031 - protein, 24 aa, Giardia lamblia
QMGHYDIALTIARYEHSMVTDEGE

SEQ ID NO: 3207032 - protein, 23 aa, Giardia lamblia
QMKALDVSGTWVKYRIKDFNKDF

SEQ ID NO: 3207033 - protein, 18 aa, Giardia lamblia
QMRPETNCTVVNETRTDL

SEQ ID NO: 3207034 - protein, 31 aa, Giardia lamblia
QNIDLALNLFAKRWVGSHSDITSCQSKAIQC

SEQ ID NO: 3207035 - protein, 18 aa, Giardia lamblia
QPGLPDWIDESTINSYQR

SEQ ID NO: 3207036 - protein, 22 aa, Giardia lamblia
QPPRCQNCQAFINCYNTFTPDR

SEQ ID NO: 3207037 - protein, 18 aa, Giardia lamblia
QQAQALFEKCCVLEGENT

SEQ ID NO: 3207038 - protein, 25 aa, Giardia lamblia
QQAREAGELVGSLTLSRFEGGTPVR

SEQ ID NO: 3207039 - protein, 18 aa, Giardia lamblia
QQASYAWKSAQDEGRTKG

SEQ ID NO: 3207040 - protein, 25 aa, Giardia lamblia
QRDELTLKIPHDWICGAESNVSCTT

SEQ ID NO: 3207041 - protein, 21 aa, Giardia lamblia
QRKALAHTLLVDFSREPVAPT

SEQ ID NO: 3207042 - protein, 20 aa, Giardia lamblia
QRLAGLKPGVLSSIDELRKI

SEQ ID NO: 3207043 - protein, 17 aa, Giardia lamblia
QRLLSWIETDLKPRAST

SEQ ID NO: 3207044 - protein, 22 aa, Giardia lamblia
QRRKSCPGEDCHIDKFSISNKV

SEQ ID NO: 3207045 - protein, 18 aa, Giardia lamblia
QSHPEEYEELASMVDQLS

SEQ ID NO: 3207046 - protein, 17 aa, Giardia lamblia
QTFWGMVDLGLYETGGA

SEQ ID NO: 3207047 - protein, 23 aa, Giardia lamblia
QTRDPACAWCLVDDEASQQRYVY

SEQ ID NO: 3207048 - protein, 21 aa, Giardia lamblia
QTSLCALKAINLDRTTVRLET

SEQ ID NO: 3207049 - protein, 24 aa, Giardia lamblia
QTYYIIMPFYRFYDLGTQICKKIE

SEQ ID NO: 3207050 - protein, 17 aa, Giardia lamblia
QVLRHLLGARDMMVRNV

SEQ ID NO: 3207051 - protein, 29 aa, Giardia lamblia
QVYRRDFSLLIAEEFIFIGVRETEKPFEI

SEQ ID NO: 3207052 - protein, 17 aa, Giardia lamblia
QYASICITLGEIVDNGF

SEQ ID NO: 3207053 - protein, 31 aa, Giardia lamblia
QYQHNCWKCGGEGRIIQKSCHVCHAATIKSA

SEQ ID NO: 3207054 - protein, 17 aa, Giardia lamblia
QYVHSWYFAPANLRDSH

SEQ ID NO: 3207055 - protein, 20 aa, Giardia lamblia
RACCLDAKTRIVAILYSVWP

SEQ ID NO: 3207056 - protein, 22 aa, Giardia lamblia
RACDWLLRFGFSSTFVSDLRSG

SEQ ID NO: 3207057 - protein, 21 aa, Giardia lamblia
RADLLKWPLRVRLVNSETSLL

SEQ ID NO: 3207058 - protein, 23 aa, Giardia lamblia
RAEARNAFEMIVSITTTQTTADK

SEQ ID NO: 3207059 - protein, 18 aa, Giardia lamblia
RAELLRHIQQMLAVLTDE

SEQ ID NO: 3207060 - protein, 20 aa, Giardia lamblia
RAELSKVKNAMAIHNQTRAQ

SEQ ID NO: 3207061 - protein, 27 aa, Giardia lamblia
RAKVSAILTRACWKRILNSCIAGKIAV

SEQ ID NO: 3207062 - protein, 24 aa, Giardia lamblia
RALHMQAKMELFFNTSIQKTVNLD

SEQ ID NO: 3207063 - protein, 20 aa, Giardia lamblia
RANQTLTFRTYVFLIDVSPQ

SEQ ID NO: 3207064 - protein, 22 aa, Giardia lamblia
RAQCKLPLNLPLFSAEAISQNC

SEQ ID NO: 3207065 - protein, 25 aa, Giardia lamblia
RAQVIMRFEIFEAFPSTEEEIIYEQ

SEQ ID NO: 3207066 - protein, 19 aa, Giardia lamblia
RASAAFKEGRYRDASDLYT

SEQ ID NO: 3207067 - protein, 17 aa, Giardia lamblia
RASSLSVTDFRELEEKH

SEQ ID NO: 3207068 - protein, 18 aa, Giardia lamblia
RATLNLYINRVFVTNETG

SEQ ID NO: 3207069 - protein, 19 aa, Giardia lamblia
RAVILQCRISLGITMDTCT

SEQ ID NO: 3207070 - protein, 17 aa, Giardia lamblia
RCLCDPGFRGGYCERAA

SEQ ID NO: 3207071 - protein, 21 aa, Giardia lamblia
RCMIMPFPNIHYVCSCYPYDG

SEQ ID NO: 3207072 - protein, 17 aa, Giardia lamblia
RCSNIDLVYTWVNGSAG

SEQ ID NO: 3207073 - protein, 22 aa, Giardia lamblia
RDKCPLILYVHGGPESPWDDSW

SEQ ID NO: 3207074 - protein, 17 aa, Giardia lamblia
RDLIAAAQLDMLHELDK

SEQ ID NO: 3207075 - protein, 17 aa, Giardia lamblia
RDNFGRYALTLSSLEAG

SEQ ID NO: 3207076 - protein, 38 aa, Giardia lamblia
RDPLSFTIHRHGFVFPLPRRRFSVTLMQAGKEVCALDG

SEQ ID NO: 3207077 - protein, 22 aa, Giardia lamblia
REAKALRSFVLYNMKKPFRDHR

SEQ ID NO: 3207078 - protein, 19 aa, Giardia lamblia
REGMSWTCVCRAEYVPYNG

SEQ ID NO: 3207079 - protein, 25 aa, Giardia lamblia
REIDRLQGNITRRHIKLVKEGKMSE

SEQ ID NO: 3207080 - protein, 22 aa, Giardia lamblia
REKFTRLVGVVLLHVLALAVAK

SEQ ID NO: 3207081 - protein, 22 aa, Giardia lamblia
RELTGSVLLELECRGIKNYHDV

SEQ ID NO: 3207082 - protein, 21 aa, Giardia lamblia
REMNLHKGHFGRMLIPNDFIF

SEQ ID NO: 3207083 - protein, 17 aa, Giardia lamblia
REMYKAKLEFEAKDGQQ

SEQ ID NO: 3207084 - protein, 17 aa, Giardia lamblia
REYNLPEGTKIVAVGGS

SEQ ID NO: 3207085 - protein, 20 aa, Giardia lamblia
RFIYFPTQSHWVWQPQESVV

SEQ ID NO: 3207086 - protein, 17 aa, Giardia lamblia
RGLEKFCQKGYSIIPDI

SEQ ID NO: 3207087 - protein, 20 aa, Giardia lamblia
RIAEAFGTVYVMDKQSKHNL

SEQ ID NO: 3207088 - protein, 25 aa, Giardia lamblia
RILMRKFPHLLLLADDVFTNFNGTY

SEQ ID NO: 3207089 - protein, 19 aa, Giardia lamblia
RINLSREFIQESKLLKKIG

SEQ ID NO: 3207090 - protein, 19 aa, Giardia lamblia
RIVTPSRAYLCSRNMASQK

SEQ ID NO: 3207091 - protein, 21 aa, Giardia lamblia
RKDLFLSLREHFNYRMAPNPY

SEQ ID NO: 3207092 - protein, 22 aa, Giardia lamblia
RKLADYKGKYLIIFFYPADFTF

SEQ ID NO: 3207093 - protein, 18 aa, Giardia lamblia
RKLYELQCDVLDIVKKME

SEQ ID NO: 3207094 - protein, 19 aa, Giardia lamblia
RKRSFPFMFHLGQNEVISG

SEQ ID NO: 3207095 - protein, 17 aa, Giardia lamblia
RKVRALNYFLLEAPEYK

SEQ ID NO: 3207096 - protein, 23 aa, Giardia lamblia
RLAHIKCIVPLRESFGSYIADRN

SEQ ID NO: 3207097 - protein, 21 aa, Giardia lamblia
RLGRRGDLLIEVQVLLPPLDN

SEQ ID NO: 3207098 - protein, 19 aa, Giardia lamblia
RLITRCPYAQKGCTFSDTL

SEQ ID NO: 3207099 - protein, 24 aa, Giardia lamblia
RLSAEYMVPGGIYFIEDVHALYIF

SEQ ID NO: 3207100 - protein, 27 aa, Giardia lamblia
RLSRLAGFNETVGWGVLRDNLIARTTM

SEQ ID NO: 3207101 - protein, 18 aa, Giardia lamblia
RNGAGYSCDCRGLATGDL

SEQ ID NO: 3207102 - protein, 17 aa, Giardia lamblia
RNGCYVLDPHGSYRSIF

SEQ ID NO: 3207103 - protein, 24 aa, Giardia lamblia
RNSWSNAWGIDGYMYLSMKNNICG

SEQ ID NO: 3207104 - protein, 37 aa, Giardia lamblia
RPDGPPTIFFRLTQCALRNGLDPWDWQRGVLHTYDRT

SEQ ID NO: 3207105 - protein, 19 aa, Giardia lamblia
RPHVLCLYVGGTIGMTKDE

SEQ ID NO: 3207106 - protein, 24 aa, Giardia lamblia
RPKEWPMKPNIRRTVKQMDDLERR

SEQ ID NO: 3207107 - protein, 19 aa, Giardia lamblia
RPMRCCKKVDTQEDNHIAP

SEQ ID NO: 3207108 - protein, 23 aa, Giardia lamblia
RQCDLDIFPGICVVKQVTPDKEN

SEQ ID NO: 3207109 - protein, 17 aa, Giardia lamblia
RQLGAAFSCTIFADSQL

SEQ ID NO: 3207110 - protein, 23 aa, Giardia lamblia
RQPEFKGLLLTAEIYPWKIPVGA

SEQ ID NO: 3207111 - protein, 24 aa, Giardia lamblia
RQPIPTACAVYFCSPTQKNFGLFH

SEQ ID NO: 3207112 - protein, 31 aa, Giardia lamblia
RQVKNFINELAMTMSRFLNGKAICLNCKQLF

SEQ ID NO: 3207113 - protein, 17 aa, Giardia lamblia
RRFVPTILILGRAHGDS

SEQ ID NO: 3207114 - protein, 18 aa, Giardia lamblia
RRGLEKFCQKGYSIIPDV

SEQ ID NO: 3207115 - protein, 29 aa, Giardia lamblia
RRGTRWLTRRMRLVRCIVLLLLLIAAVDK

SEQ ID NO: 3207116 - protein, 25 aa, Giardia lamblia
RRKVDFRLYVGLFFNAQERSYSAFL

SEQ ID NO: 3207117 - protein, 20 aa, Giardia lamblia
RRNIIRFLKAMEQYIKAFHL

SEQ ID NO: 3207118 - protein, 19 aa, Giardia lamblia
RRPLSAASEGVFGALSLHP

SEQ ID NO: 3207119 - protein, 20 aa, Giardia lamblia
RRTIYEIYNALVIRTIPTSL

SEQ ID NO: 3207120 - protein, 20 aa, Giardia lamblia
RRVLKKNIFENYALSQARTP

SEQ ID NO: 3207121 - protein, 19 aa, Giardia lamblia
RSADRLRTKIDNVADLHKK

SEQ ID NO: 3207122 - protein, 20 aa, Giardia lamblia
RSGSCLSALMPQLQILTHGD

SEQ ID NO: 3207123 - protein, 18 aa, Giardia lamblia
RSLAKIEGVAVILGTLNL

SEQ ID NO: 3207124 - protein, 23 aa, Giardia lamblia
RSPGVGVCPLRGAALRSALDEPG

SEQ ID NO: 3207125 - protein, 20 aa, Giardia lamblia
RSPKPCGLKDYEGLLTFMKS

SEQ ID NO: 3207126 - protein, 24 aa, Giardia lamblia
RTFPTRKMRFAIISGGSFVDPTKQ

SEQ ID NO: 3207127 - protein, 21 aa, Giardia lamblia
RVGEGCHLRRGFLSITVCCPC

SEQ ID NO: 3207128 - protein, 17 aa, Giardia lamblia
RVNCSRLDTLYYKFNKF

SEQ ID NO: 3207129 - protein, 19 aa, Giardia lamblia
RVPTFAVYSNGIWTHYLGG

SEQ ID NO: 3207130 - protein, 21 aa, Giardia lamblia
RVTAFMICLIQLSSCNPEYET

SEQ ID NO: 3207131 - protein, 19 aa, Giardia lamblia
RYSQASLWWSSQLYGLLAM

SEQ ID NO: 3207132 - protein, 31 aa, Giardia lamblia
SACQQPARYRCPSCQLMTCSLACFTTHKEVT

SEQ ID NO: 3207133 - protein, 31 aa, Giardia lamblia
SAELGVNINRLFKLVVCLVFGLNPGIEQIEA

SEQ ID NO: 3207134 - protein, 26 aa, Giardia lamblia
SAGDLLSIGCNFYLPEFKQESVLSKY

SEQ ID NO: 3207135 - protein, 24 aa, Giardia lamblia
SAGEYAIMIAYRLKKYKVLSVLSQ

SEQ ID NO: 3207136 - protein, 25 aa, Giardia lamblia
SAKAKDFLKEWVFPDIDKLIEVAQK

SEQ ID NO: 3207137 - protein, 20 aa, Giardia lamblia
SALCFIIINSPLLRQKKMTT

SEQ ID NO: 3207138 - protein, 25 aa, Giardia lamblia
SALKLRKFVYGFGLDQVYAHIEFLD

SEQ ID NO: 3207139 - protein, 20 aa, Giardia lamblia
SANLGVAVSYDMVVIGHGAG

SEQ ID NO: 3207140 - protein, 21 aa, Giardia lamblia
SASPRRPLIRSSSSAPKSHGV

SEQ ID NO: 3207141 - protein, 21 aa, Giardia lamblia
SASSCSYGLEVTGSVVNTLAS

SEQ ID NO: 3207142 - protein, 19 aa, Giardia lamblia
SCDCRGLATGDLCDTCTDK

SEQ ID NO: 3207143 - protein, 23 aa, Giardia lamblia
SCGGHSPAPLRFWLRRASAGAAR

SEQ ID NO: 3207144 - protein, 21 aa, Giardia lamblia
SCIMYDILQALSYMEQNRQVH

SEQ ID NO: 3207145 - protein, 18 aa, Giardia lamblia
SDGVVGMCRSCVGKDVFW

SEQ ID NO: 3207146 - protein, 18 aa, Giardia lamblia
SDLVPISSMSQGIVVMCE

SEQ ID NO: 3207147 - protein, 24 aa, Giardia lamblia
SDSILKVGLLSKHNKIGKNEIQSA

SEQ ID NO: 3207148 - protein, 20 aa, Giardia lamblia
SDTSFPEYVEKVAGPRNSTG

SEQ ID NO: 3207149 - protein, 18 aa, Giardia lamblia
SDYDDFDLILAMDKSNFQ

SEQ ID NO: 3207150 - protein, 27 aa, Giardia lamblia
SEDLTFMPFCIGINLPDAFSDNSKVEQ

SEQ ID NO: 3207151 - protein, 22 aa, Giardia lamblia
SEGERRYAWNVLKGDTAAQKIY

SEQ ID NO: 3207152 - protein, 23 aa, Giardia lamblia
SELIKRGASLICTHRKTSDTKGL

SEQ ID NO: 3207153 - protein, 28 aa, Giardia lamblia
SESSDVWNGFRFMSMANFLVWQKDIIKV

SEQ ID NO: 3207154 - protein, 21 aa, Giardia lamblia
SFCTSHFKIALAAMSHSVTSS

SEQ ID NO: 3207155 - protein, 20 aa, Giardia lamblia
SFKDKHRVSVLKGDSLHHKT

SEQ ID NO: 3207156 - protein, 18 aa, Giardia lamblia
SFLAHNHTVFFCGHVFHT

SEQ ID NO: 3207157 - protein, 24 aa, Giardia lamblia
SFNVDFTVRWNRFINLNQPEAFLI

SEQ ID NO: 3207158 - protein, 21 aa, Giardia lamblia
SFNVPNVAAFVLDRIQRGDPE

SEQ ID NO: 3207159 - protein, 19 aa, Giardia lamblia
SFRYELFCIARERKTTNCI

SEQ ID NO: 3207160 - protein, 19 aa, Giardia lamblia
SFVRVLFCHGGLGISRCSA

SEQ ID NO: 3207161 - protein, 17 aa, Giardia lamblia
SGGFACLGHAARWISCM

SEQ ID NO: 3207162 - protein, 20 aa, Giardia lamblia
SGKTRLALQLAQALNGEIIC

SEQ ID NO: 3207163 - protein, 26 aa, Giardia lamblia
SGQTAFPRGLLRACAKQKNAKGQTAL

SEQ ID NO: 3207164 - protein, 18 aa, Giardia lamblia
SGVTALMLAALVDNLRAA

SEQ ID NO: 3207165 - protein, 20 aa, Giardia lamblia
SGVYQHRWGLWLGGHAVEII

SEQ ID NO: 3207166 - protein, 17 aa, Giardia lamblia
SHEYPLILYVHGGPESP

SEQ ID NO: 3207167 - protein, 23 aa, Giardia lamblia
SHFAHPHLYFFATTDIKPMEELF

SEQ ID NO: 3207168 - protein, 17 aa, Giardia lamblia
SHIMSFLDVVLGCMQQS

SEQ ID NO: 3207169 - protein, 24 aa, Giardia lamblia
SHWVWQPQESVVWHTEVVAWLDKY

SEQ ID NO: 3207170 - protein, 21 aa, Giardia lamblia
SIAYPSVNPAALFAPTDHSQP

SEQ ID NO: 3207171 - protein, 24 aa, Giardia lamblia
SIGLRFVTARGFPGDQRRLLLIQH

SEQ ID NO: 3207172 - protein, 25 aa, Giardia lamblia
SILQTPCRILKRQVEHVIIPENSDL

SEQ ID NO: 3207173 - protein, 18 aa, Giardia lamblia
SITGRYCTLTTFATTLSR

SEQ ID NO: 3207174 - protein, 26 aa, Giardia lamblia
SKAIEESRYLPALECIFRSFNDSPLS

SEQ ID NO: 3207175 - protein, 20 aa, Giardia lamblia
SKHLDFLTPFLADRSAAPTA

SEQ ID NO: 3207176 - protein, 19 aa, Giardia lamblia
SKKYSLALLDSATRTAIAK

SEQ ID NO: 3207177 - protein, 18 aa, Giardia lamblia
SKLLFSLDNEEWLVCKKK

SEQ ID NO: 3207178 - protein, 31 aa, Giardia lamblia
SKRQSCVPPIFKFSSPILRKWQTERQSIKPS

SEQ ID NO: 3207179 - protein, 25 aa, Giardia lamblia
SKTMIVCLLVLLAVIGGKQLAALPA

SEQ ID NO: 3207180 - protein, 25 aa, Giardia lamblia
SKTVWARMVNSWLAFCRSARNNVQG

SEQ ID NO: 3207181 - protein, 29 aa, Giardia lamblia
SLCRSSRCLPRLSHLLAFRVSCRLISSEH

SEQ ID NO: 3207182 - protein, 25 aa, Giardia lamblia
SLELADCGLGLFSCLQLCKILTSSS

SEQ ID NO: 3207183 - protein, 23 aa, Giardia lamblia
SLSAECKVLAGVVAELIATRKTS

SEQ ID NO: 3207184 - protein, 20 aa, Giardia lamblia
SLTMPVIQVVFILRDIDGTF

SEQ ID NO: 3207185 - protein, 19 aa, Giardia lamblia
SMANFLVWQKDIIKVFRSF

SEQ ID NO: 3207186 - protein, 25 aa, Giardia lamblia
SMKTEGWGTYTPMRALYLALQNDPD

SEQ ID NO: 3207187 - protein, 19 aa, Giardia lamblia
SNALARYMISVGYIPEANR

SEQ ID NO: 3207188 - protein, 25 aa, Giardia lamblia
SNELKIETWPGSALPIDTTPKPEPQ

SEQ ID NO: 3207189 - protein, 25 aa, Giardia lamblia
SNELKIETWPGSALPIDTTPKPEPR

SEQ ID NO: 3207190 - protein, 18 aa, Giardia lamblia
SNISFMIGDAILGKHANR

SEQ ID NO: 3207191 - protein, 25 aa, Giardia lamblia
SNITKSAVVSLDFSAAGRRNLGSKC

SEQ ID NO: 3207192 - protein, 21 aa, Giardia lamblia
SNMRPEDWLLIARDIADAYDN

SEQ ID NO: 3207193 - protein, 17 aa, Giardia lamblia
SNYALPVGMVIEPLGPA

SEQ ID NO: 3207194 - protein, 18 aa, Giardia lamblia
SPITDFRALGILVLDMLL

SEQ ID NO: 3207195 - protein, 25 aa, Giardia lamblia
SPLRSPWKFAEEKKFYSGNPMSSVD

SEQ ID NO: 3207196 - protein, 19 aa, Giardia lamblia
SPSLWFLAIERSDRNTVRQ

SEQ ID NO: 3207197 - protein, 21 aa, Giardia lamblia
SQFFICTVVTPWLNGKHVVFG

SEQ ID NO: 3207198 - protein, 26 aa, Giardia lamblia
SQITFEVVNQLALVYFKLDRFPTPQS

SEQ ID NO: 3207199 - protein, 21 aa, Giardia lamblia
SQKSINCLAYMVLSGAKGSTV

SEQ ID NO: 3207200 - protein, 17 aa, Giardia lamblia
SQLDVYLAIYKHLDALQ

SEQ ID NO: 3207201 - protein, 23 aa, Giardia lamblia
SQRCANCTCWKSRVGDKSAEANS

SEQ ID NO: 3207202 - protein, 19 aa, Giardia lamblia
SQYRHLFAARLERSSEYDD

SEQ ID NO: 3207203 - protein, 26 aa, Giardia lamblia
SREKVCAMGASFGATFMNYMNSHVNN

SEQ ID NO: 3207204 - protein, 26 aa, Giardia lamblia
SRKKCAACPSTAISILRSATRMHAAD

SEQ ID NO: 3207205 - protein, 23 aa, Giardia lamblia
SRPGPVRLTWLPVSRTVMSRDDP

SEQ ID NO: 3207206 - protein, 25 aa, Giardia lamblia
SRSLLKVYLSSSVLMSNLLRHLYNI

SEQ ID NO: 3207207 - protein, 21 aa, Giardia lamblia
SRVTPRPGNSLAESSYKRITS

SEQ ID NO: 3207208 - protein, 19 aa, Giardia lamblia
SSDIVFTAFFLFNVLVQSV

SEQ ID NO: 3207209 - protein, 23 aa, Giardia lamblia
SSEWKVPIEYVYHKTIIPPSDHI

SEQ ID NO: 3207210 - protein, 17 aa, Giardia lamblia
SSLLMPVSFLKRDRAAV

SEQ ID NO: 3207211 - protein, 18 aa, Giardia lamblia
SSMAQLFYVPKVYNQEAD

SEQ ID NO: 3207212 - protein, 18 aa, Giardia lamblia
SSNDLATSIGRRKPLISV

SEQ ID NO: 3207213 - protein, 25 aa, Giardia lamblia
SSVGQAFSYLRAEIHNRKLYVMFEQ

SEQ ID NO: 3207214 - protein, 17 aa, Giardia lamblia
STAPRLDDMQDLDPDSH

SEQ ID NO: 3207215 - protein, 25 aa, Giardia lamblia
STAYKYAEVDSFWRQVAYTLDHFDG

SEQ ID NO: 3207216 - protein, 25 aa, Giardia lamblia
STGMPLPIFWKVYRAVEGSDAAFRV

SEQ ID NO: 3207217 - protein, 26 aa, Giardia lamblia
STKVSALKFEYIWTYPTRSRYVNCIS

SEQ ID NO: 3207218 - protein, 17 aa, Giardia lamblia
STLLCYPTTCLFDRNGY

SEQ ID NO: 3207219 - protein, 25 aa, Giardia lamblia
STTNRIDGTPAWILLIKNRQGEIEK

SEQ ID NO: 3207220 - protein, 19 aa, Giardia lamblia
SVAEAKQAKKGCCGPSGSK

SEQ ID NO: 3207221 - protein, 24 aa, Giardia lamblia
SVEKRAHTSYVRRPNEFEEYYGKS

SEQ ID NO: 3207222 - protein, 18 aa, Giardia lamblia
SVPDAIEFENSRLQTRRA

SEQ ID NO: 3207223 - protein, 25 aa, Giardia lamblia
SVQLLKGCGSAECSNSYCASSSGFS

SEQ ID NO: 3207224 - protein, 25 aa, Giardia lamblia
SVWVPGGAVTIRWTSNLTAGTEMTI

SEQ ID NO: 3207225 - protein, 25 aa, Giardia lamblia
SVWVPGGAVTIRWTSNLTASTEMTI

SEQ ID NO: 3207226 - protein, 18 aa, Giardia lamblia
SWGCVCMYGSIAVGSNCV

SEQ ID NO: 3207227 - protein, 18 aa, Giardia lamblia
SWGPDWGEDGYFRIVRGG

SEQ ID NO: 3207228 - protein, 25 aa, Giardia lamblia
SYQDLKAYASWLLDYYGGSMEEIDL

SEQ ID NO: 3207229 - protein, 19 aa, Giardia lamblia
SYSAFLFRDGIARLCSREY

SEQ ID NO: 3207230 - protein, 29 aa, Giardia lamblia
SYSGNLAAWARIQFPFIIDAAISSSGPYL

SEQ ID NO: 3207231 - protein, 19 aa, Giardia lamblia
SYVPDCRSAGEFTLLHSNP

SEQ ID NO: 3207232 - protein, 24 aa, Giardia lamblia
SYYDFKFSPVPGIHDAILTMRVGE

SEQ ID NO: 3207233 - protein, 18 aa, Giardia lamblia
TAEMSVPDAIEFENSRLQ

SEQ ID NO: 3207234 - protein, 33 aa, Giardia lamblia
TAQELQTRLSVLSSDHLKLEFEYKTVQKQRELL

SEQ ID NO: 3207235 - protein, 21 aa, Giardia lamblia
TCPDATGVQFVFKCGDVDCEN

SEQ ID NO: 3207236 - protein, 22 aa, Giardia lamblia
TDFKGEHFFGFLKAKEWKLTAV

SEQ ID NO: 3207237 - protein, 24 aa, Giardia lamblia
TDGKRYLLIIPISVSSGVDLFKNV

SEQ ID NO: 3207238 - protein, 25 aa, Giardia lamblia
TDIVTTFLIGLDWFHREKSLETFIV

SEQ ID NO: 3207239 - protein, 24 aa, Giardia lamblia
TDLDKAIREARWQIAHTQEIVKNT

SEQ ID NO: 3207240 - protein, 25 aa, Giardia lamblia
TDLRRTARVDACKRLFNRSKNDGGK

SEQ ID NO: 3207241 - protein, 25 aa, Giardia lamblia
TDWPISYPNVGKWRRKSTWNKLYTA

SEQ ID NO: 3207242 - protein, 20 aa, Giardia lamblia
TEEQLSCLYRLYDETGGENW

SEQ ID NO: 3207243 - protein, 25 aa, Giardia lamblia
TEEVVIKLMLLIGFFDDPDKGEFVG

SEQ ID NO: 3207244 - protein, 20 aa, Giardia lamblia
TEEYCSFSDAMLVDTSKDLR

SEQ ID NO: 3207245 - protein, 22 aa, Giardia lamblia
TEMPQFMGIEIQQFQAAECAVF

SEQ ID NO: 3207246 - protein, 17 aa, Giardia lamblia
TEQEWESGAVLCVVLEK

SEQ ID NO: 3207247 - protein, 18 aa, Giardia lamblia
TFTEGFSDAAIRYLMEHV

SEQ ID NO: 3207248 - protein, 19 aa, Giardia lamblia
TFVTYDFIHLWQAMKKSPV

SEQ ID NO: 3207249 - protein, 17 aa, Giardia lamblia
TGARGTCPTKCADGSDL

SEQ ID NO: 3207250 - protein, 24 aa, Giardia lamblia
TGDIPECICDLTHMMFWYMSINAL

SEQ ID NO: 3207251 - protein, 20 aa, Giardia lamblia
TGSILPQWMQFVKGIVDSDS

SEQ ID NO: 3207252 - protein, 24 aa, Giardia lamblia
TGTVDCIFTLKGFGADISLRLGDD

SEQ ID NO: 3207253 - protein, 26 aa, Giardia lamblia
THLDHAYRSSIDFSNPNSIGSNRVEL

SEQ ID NO: 3207254 - protein, 18 aa, Giardia lamblia
THLPPSRLYPSLHSPHTP

SEQ ID NO: 3207255 - protein, 21 aa, Giardia lamblia
THPVPSLLGFLPLSQEVHIAA

SEQ ID NO: 3207256 - protein, 29 aa, Giardia lamblia
TIALELDRRECIELLIPYEDIRDAQSNTA

SEQ ID NO: 3207257 - protein, 24 aa, Giardia lamblia
TKAPSLCLLLSRFYHAESRIGLAA

SEQ ID NO: 3207258 - protein, 21 aa, Giardia lamblia
TKQFREVVDMCMVKNPRERAS

SEQ ID NO: 3207259 - protein, 18 aa, Giardia lamblia
TKVLPIILYATLRNQVQL

SEQ ID NO: 3207260 - protein, 19 aa, Giardia lamblia
TLAALKWLVENNGGRVAFE

SEQ ID NO: 3207261 - protein, 17 aa, Giardia lamblia
TLIPCFGKCPICKREFQ

SEQ ID NO: 3207262 - protein, 17 aa, Giardia lamblia
TLIPLQGGMKMKGCALV

SEQ ID NO: 3207263 - protein, 24 aa, Giardia lamblia
TLLTAPHPLLFVSIANSLYFPYTD

SEQ ID NO: 3207264 - protein, 22 aa, Giardia lamblia
TNACGHSALAIARQLRLEPICA

SEQ ID NO: 3207265 - protein, 20 aa, Giardia lamblia
TNEKLIRRIRMFSDQKRESE

SEQ ID NO: 3207266 - protein, 23 aa, Giardia lamblia
TNEPEHGMGVRFTRRGLEKFCQK

SEQ ID NO: 3207267 - protein, 18 aa, Giardia lamblia
TPSLVAYDGEVFFVGEYA

SEQ ID NO: 3207268 - protein, 23 aa, Giardia lamblia
TPVWMCLLAAIFPTASHVLAIHV

SEQ ID NO: 3207269 - protein, 25 aa, Giardia lamblia
TRAALPTNFTYRGHRCIQIIDQGSC

SEQ ID NO: 3207270 - protein, 29 aa, Giardia lamblia
TRAALPTNFTYRGHRCIQIINQGSCGCCY

SEQ ID NO: 3207271 - protein, 31 aa, Giardia lamblia
TREEISDYLAFRSHCSGLVYYNGDTVYIGQT

SEQ ID NO: 3207272 - protein, 17 aa, Giardia lamblia
TRIIGAEHCIVYPINDP

SEQ ID NO: 3207273 - protein, 31 aa, Giardia lamblia
TRIVDGLEGCWRLLDHWVINTVEQLFKNTTL

SEQ ID NO: 3207274 - protein, 21 aa, Giardia lamblia
TRLTDSTGWCPLEQAVRRSRI

SEQ ID NO: 3207275 - protein, 17 aa, Giardia lamblia
TRPQLFYIPNRPTTEES

SEQ ID NO: 3207276 - protein, 26 aa, Giardia lamblia
TSEEPSNVCGLIIYRATFLSPTTISG

SEQ ID NO: 3207277 - protein, 19 aa, Giardia lamblia
TTMGIPLMKGFTEVDVEES

SEQ ID NO: 3207278 - protein, 24 aa, Giardia lamblia
TTTPSVLVIPGFKGDMATDRGIAA

SEQ ID NO: 3207279 - protein, 18 aa, Giardia lamblia
TTVFDRKSILGLYAAIYS

SEQ ID NO: 3207280 - protein, 25 aa, Giardia lamblia
TVAACTRAGLTYSPRPRTTARCDKG

SEQ ID NO: 3207281 - protein, 17 aa, Giardia lamblia
TVRFPSNTSDLWNDANV

SEQ ID NO: 3207282 - protein, 29 aa, Giardia lamblia
TVSSIFPPIFFKLLLGHSYTVITREDLHD

SEQ ID NO: 3207283 - protein, 25 aa, Giardia lamblia
TVVTPWLNGKHVVFGHVVDGMTVVK

SEQ ID NO: 3207284 - protein, 24 aa, Giardia lamblia
TVYPPSISVALPYAIIPIAQLQSL

SEQ ID NO: 3207285 - protein, 18 aa, Giardia lamblia
TWLGMSLPQNVTYADVVT

SEQ ID NO: 3207286 - protein, 19 aa, Giardia lamblia
TYCQKCSEDALAMEDGSCV

SEQ ID NO: 3207287 - protein, 24 aa, Giardia lamblia
VAACIRAGLTYSPRPRTTARCDKG

SEQ ID NO: 3207288 - protein, 25 aa, Giardia lamblia
VAAFYKRSVEYGVWITSNVDDSAPK

SEQ ID NO: 3207289 - protein, 23 aa, Giardia lamblia
VACGSCWTFGAIGTIEGRINKLR

SEQ ID NO: 3207290 - protein, 20 aa, Giardia lamblia
VASRMAVSGAGWHQANSQYN

SEQ ID NO: 3207291 - protein, 18 aa, Giardia lamblia
VATLGRFVQRERVGPSTQ

SEQ ID NO: 3207292 - protein, 19 aa, Giardia lamblia
VAVTETFSWYSGGVFNDPA

SEQ ID NO: 3207293 - protein, 17 aa, Giardia lamblia
VAYPDYFDRLGDVMDVD

SEQ ID NO: 3207294 - protein, 20 aa, Giardia lamblia
VCLHNYRSLLNLQLDPLLKF

SEQ ID NO: 3207295 - protein, 19 aa, Giardia lamblia
VCLYLRVVVRAHGRRLDHS

SEQ ID NO: 3207296 - protein, 21 aa, Giardia lamblia
VCPHHPIWKLPSVLDEPSTTA

SEQ ID NO: 3207297 - protein, 19 aa, Giardia lamblia
VCTCSYLYAGFHCNVCSAD

SEQ ID NO: 3207298 - protein, 23 aa, Giardia lamblia
VDADEWFLVPSIDLMTLVDANTN

SEQ ID NO: 3207299 - protein, 22 aa, Giardia lamblia
VDDCVGCDIVLVASSQSTFLRS

SEQ ID NO: 3207300 - protein, 24 aa, Giardia lamblia
VDETFKYLGLCAHLHVGLTSCMTV

SEQ ID NO: 3207301 - protein, 19 aa, Giardia lamblia
VDLNFGGSICQLQSVSEDT

SEQ ID NO: 3207302 - protein, 24 aa, Giardia lamblia
VDLYYDKYLRNFVVALADRSVSAN

SEQ ID NO: 3207303 - protein, 19 aa, Giardia lamblia
VDTLLHWNVLHPPTAEELD

SEQ ID NO: 3207304 - protein, 41 aa, Giardia lamblia
VELPVYCYNHFFFRYTLQLYKLVCHSCHRFLITELQALTIE

SEQ ID NO: 3207305 - protein, 19 aa, Giardia lamblia
VERYMPYIRRVFIVTNGER

SEQ ID NO: 3207306 - protein, 23 aa, Giardia lamblia
VESRTAEIWYFYKQAATTNSNRA

SEQ ID NO: 3207307 - protein, 18 aa, Giardia lamblia
VFDPEKWMNFVVNQTRDD

SEQ ID NO: 3207308 - protein, 23 aa, Giardia lamblia
VHCDLRPASILISADGERFIIAD

SEQ ID NO: 3207309 - protein, 19 aa, Giardia lamblia
VHGKLMYAGSKGYLYREEI

SEQ ID NO: 3207310 - protein, 26 aa, Giardia lamblia
VHLTCLPGAATCRLISILIRHDMCGH

SEQ ID NO: 3207311 - protein, 19 aa, Giardia lamblia
VIGSAFLYHQVRYMASMLI

SEQ ID NO: 3207312 - protein, 19 aa, Giardia lamblia
VINKDGRPFVQLSGTNLPK

SEQ ID NO: 3207313 - protein, 17 aa, Giardia lamblia
VIQVVFILRDIDGTFAS

SEQ ID NO: 3207314 - protein, 18 aa, Giardia lamblia
VIRARLPNLQAFDLGSNP

SEQ ID NO: 3207315 - protein, 24 aa, Giardia lamblia
VIRRLKRAKIDCGTFTRSADRLRT

SEQ ID NO: 3207316 - protein, 19 aa, Giardia lamblia
VKALIPLQGGMKMKGCALV

SEQ ID NO: 3207317 - protein, 20 aa, Giardia lamblia
VKGDIQLLCAQEYVDTHTFY

SEQ ID NO: 3207318 - protein, 25 aa, Giardia lamblia
VKGKIARAVAYFFVAYPDYFDRLGD

SEQ ID NO: 3207319 - protein, 20 aa, Giardia lamblia
VKLLMRCEGGMRSSNEHTAL

SEQ ID NO: 3207320 - protein, 19 aa, Giardia lamblia
VKTHWPPPELRVFPHDPCT

SEQ ID NO: 3207321 - protein, 34 aa, Giardia lamblia
VLAYGLCKVMARTSLRLSSLCLNCNKIGDEAGAF

SEQ ID NO: 3207322 - protein, 22 aa, Giardia lamblia
VLGLCTLVGLVLFRRPQRKPSD

SEQ ID NO: 3207323 - protein, 26 aa, Giardia lamblia
VLLRATELMFDFPFVSLTEVMDLILS

SEQ ID NO: 3207324 - protein, 17 aa, Giardia lamblia
VMESLEIVLKRNAKDPV

SEQ ID NO: 3207325 - protein, 24 aa, Giardia lamblia
VMMHRLRNTSALYLSRYEMSSVCG

SEQ ID NO: 3207326 - protein, 21 aa, Giardia lamblia
VNCSAHGSSVIFGKQSATDLL

SEQ ID NO: 3207327 - protein, 23 aa, Giardia lamblia
VNETRPVPILSMDWCAHSLNIIM

SEQ ID NO: 3207328 - protein, 20 aa, Giardia lamblia
VNLAHCIHAYPVVQKPENGT

SEQ ID NO: 3207329 - protein, 17 aa, Giardia lamblia
VNLTGALSVTASKASTS

SEQ ID NO: 3207330 - protein, 17 aa, Giardia lamblia
VNLTGALSVTASKSSDQ

SEQ ID NO: 3207331 - protein, 17 aa, Giardia lamblia
VNLTGALVVTASKASTS

SEQ ID NO: 3207332 - protein, 18 aa, Giardia lamblia
VNNYNCFLKIFGETPHIM

SEQ ID NO: 3207333 - protein, 24 aa, Giardia lamblia
VPHNRLRESIPYIKNGIEVLNLED

SEQ ID NO: 3207334 - protein, 18 aa, Giardia lamblia
VPPGHGMGVRYTERGLEK

SEQ ID NO: 3207335 - protein, 27 aa, Giardia lamblia
VPPNRYYRCLQPFFKNDTFIVSLVHTI

SEQ ID NO: 3207336 - protein, 23 aa, Giardia lamblia
VQFPRQLDWRVRGVITPVKDQAA

SEQ ID NO: 3207337 - protein, 18 aa, Giardia lamblia
VQILLEREAGRRNNQGWT

SEQ ID NO: 3207338 - protein, 17 aa, Giardia lamblia
VRASRRKLAAGVSVPPT

SEQ ID NO: 3207339 - protein, 39 aa, Giardia lamblia
VRDPLSFTIHRHGFVFPLPRRRFSVTLMQAGKEVCALDG

SEQ ID NO: 3207340 - protein, 18 aa, Giardia lamblia
VRFTRRGLEKFCQKGYSI

SEQ ID NO: 3207341 - protein, 18 aa, Giardia lamblia
VRGNLVWRGPGSLSGTEL

SEQ ID NO: 3207342 - protein, 22 aa, Giardia lamblia
VRKVIVPDFYKVLGVSRSTPIA

SEQ ID NO: 3207343 - protein, 18 aa, Giardia lamblia
VRLKRRVNELVAYSKKIR

SEQ ID NO: 3207344 - protein, 24 aa, Giardia lamblia
VRSAIFKTSFAYVYALLMASPSAE

SEQ ID NO: 3207345 - protein, 17 aa, Giardia lamblia
VSIDAFLCPPAYVNLGT

SEQ ID NO: 3207346 - protein, 25 aa, Giardia lamblia
VSNRYPCPVYRTSLRRGVLTTTGHS

SEQ ID NO: 3207347 - protein, 24 aa, Giardia lamblia
VSSICCLCGHSTHLDHAYRSSIDF

SEQ ID NO: 3207348 - protein, 19 aa, Giardia lamblia
VTIIGRLMQDYGYQPNKNL

SEQ ID NO: 3207349 - protein, 24 aa, Giardia lamblia
VTLSCLKPGPEYSIVELQELLAIP

SEQ ID NO: 3207350 - protein, 21 aa, Giardia lamblia
VVAENLFVRRIRPKYAALASE

SEQ ID NO: 3207351 - protein, 18 aa, Giardia lamblia
VVCAKPLVSRAELRRIQA

SEQ ID NO: 3207352 - protein, 37 aa, Giardia lamblia
VVLPLRCATCWNKARDQRPAFSYDGIFLYYASMDEEQ

SEQ ID NO: 3207353 - protein, 22 aa, Giardia lamblia
VWKEEVRLWFSLSWSTHTFCSW

SEQ ID NO: 3207354 - protein, 27 aa, Giardia lamblia
VYEMCLLHSLFRGTCEDVLEQIQKLRR

SEQ ID NO: 3207355 - protein, 18 aa, Giardia lamblia
VYSARPLNHLIWHVNFQD

SEQ ID NO: 3207356 - protein, 20 aa, Giardia lamblia
WARKLERHGLSILHIDTSDW

SEQ ID NO: 3207357 - protein, 25 aa, Giardia lamblia
WDKFGRISYEGIIFRGVTMPGDVGV

SEQ ID NO: 3207358 - protein, 18 aa, Giardia lamblia
WGCVPDACVTEYADGVRR

SEQ ID NO: 3207359 - protein, 17 aa, Giardia lamblia
WGSDWGENGYFRILRGT

SEQ ID NO: 3207360 - protein, 27 aa, Giardia lamblia
WIVRNSWSPLWGMDGYFYLSMKDNICG

SEQ ID NO: 3207361 - protein, 19 aa, Giardia lamblia
WKSNNWLTPDVSYCSWTGI

SEQ ID NO: 3207362 - protein, 20 aa, Giardia lamblia
WKTNNWLSGDSICTWTGVTC

SEQ ID NO: 3207363 - protein, 20 aa, Giardia lamblia
WMTHIRRFITIATPFDGSSS

SEQ ID NO: 3207364 - protein, 17 aa, Giardia lamblia
WPPPELRVFPHDPCTFA

SEQ ID NO: 3207365 - protein, 20 aa, Giardia lamblia
WRIDAQCLAILFDPDNYFLR

SEQ ID NO: 3207366 - protein, 18 aa, Giardia lamblia
WRTKLDRDFYSALHPDQL

SEQ ID NO: 3207367 - protein, 23 aa, Giardia lamblia
WSELSYREGETWSTGHHLHNGST

SEQ ID NO: 3207368 - protein, 23 aa, Giardia lamblia
WWSSQLYGLLAMHKLYIRQVAAV

SEQ ID NO: 3207369 - protein, 17 aa, Giardia lamblia
WYFAPANLRDSHEYPLI

SEQ ID NO: 3207370 - protein, 26 aa, Giardia lamblia
WYKQLDFDSGGLFAYVPLKNNQSLSV

SEQ ID NO: 3207371 - protein, 29 aa, Giardia lamblia
WYNGQEWLIHYHIKFPKLKSMTLRDKLRR

SEQ ID NO: 3207372 - protein, 17 aa, Giardia lamblia
WYPSGCWMTPTPTALRL

SEQ ID NO: 3207373 - protein, 28 aa, Giardia lamblia
YAALRGHNECIRFLVAHESGLVDNNLWT

SEQ ID NO: 3207374 - protein, 21 aa, Giardia lamblia
YAGSKGYLYREEIDALVMEIS

SEQ ID NO: 3207375 - protein, 18 aa, Giardia lamblia
YALPVGMVIEPLGPADSP

SEQ ID NO: 3207376 - protein, 20 aa, Giardia lamblia
YAQKGCTFSDTLFKLYNDHI

SEQ ID NO: 3207377 - protein, 20 aa, Giardia lamblia
YAREVFNVSATVKADTKDET

SEQ ID NO: 3207378 - protein, 17 aa, Giardia lamblia
YASTACYPRQCVSEYND

SEQ ID NO: 3207379 - protein, 17 aa, Giardia lamblia
YCKTCAYRYTLSGQISR

SEQ ID NO: 3207380 - protein, 28 aa, Giardia lamblia
YCPYPCIYRKLGGLFLFVIGAEAENEML

SEQ ID NO: 3207381 - protein, 23 aa, Giardia lamblia
YDIPEVGLFFAGKLYRGNRAQKY

SEQ ID NO: 3207382 - protein, 19 aa, Giardia lamblia
YDKKISFICAARAITIESY

SEQ ID NO: 3207383 - protein, 24 aa, Giardia lamblia
YDLMRGCALLGMECHVCCPDHKDF

SEQ ID NO: 3207384 - protein, 26 aa, Giardia lamblia
YDQGYCGACWAFSATGAFGDRRCMQW

SEQ ID NO: 3207385 - protein, 18 aa, Giardia lamblia
YEGTALMRAAVYGHAGIV

SEQ ID NO: 3207386 - protein, 25 aa, Giardia lamblia
YENSCIPSSCLFNGTICGGHGTCDD

SEQ ID NO: 3207387 - protein, 20 aa, Giardia lamblia
YENTCIYASCIVNGIVCPHG

SEQ ID NO: 3207388 - protein, 20 aa, Giardia lamblia
YESEALRRLNFTDLMLEVFS

SEQ ID NO: 3207389 - protein, 22 aa, Giardia lamblia
YFDHPFFWLRALFPAGKNPRTK

SEQ ID NO: 3207390 - protein, 22 aa, Giardia lamblia
YFKKLPRLMMHLGEENVTELME

SEQ ID NO: 3207391 - protein, 21 aa, Giardia lamblia
YFLEMCYKAYFAPGATPPGAP

SEQ ID NO: 3207392 - protein, 25 aa, Giardia lamblia
YGDATCPFDPFDIESFAVYLCNLYR

SEQ ID NO: 3207393 - protein, 19 aa, Giardia lamblia
YGDGAHFCQCRRGWAGAAC

SEQ ID NO: 3207394 - protein, 17 aa, Giardia lamblia
YGLSWSCRTDMPMRLAI

SEQ ID NO: 3207395 - protein, 23 aa, Giardia lamblia
YGNIECIELLAADEGGMLNNIQW

SEQ ID NO: 3207396 - protein, 20 aa, Giardia lamblia
YGTDVARDFMGTLPAPISPI

SEQ ID NO: 3207397 - protein, 17 aa, Giardia lamblia
YHGLVMIAFVLSSQRSF

SEQ ID NO: 3207398 - protein, 24 aa, Giardia lamblia
YHLMRDKCYDFARKAVEASSTKIQ

SEQ ID NO: 3207399 - protein, 18 aa, Giardia lamblia
YHMSVIFRNITKYKTETD

SEQ ID NO: 3207400 - protein, 20 aa, Giardia lamblia
YHQVRYMASMLIHIMAGLEN

SEQ ID NO: 3207401 - protein, 17 aa, Giardia lamblia
YHSVIVLANRLSVFNSI

SEQ ID NO: 3207402 - protein, 18 aa, Giardia lamblia
YIDIGVSLKPQWVREKLS

SEQ ID NO: 3207403 - protein, 17 aa, Giardia lamblia
YIEIIPRGTDLAQILST

SEQ ID NO: 3207404 - protein, 23 aa, Giardia lamblia
YILNPGGHMFATFASYDLTIATS

SEQ ID NO: 3207405 - protein, 19 aa, Giardia lamblia
YKLEGRIAQTLKRALAVER

SEQ ID NO: 3207406 - protein, 21 aa, Giardia lamblia
YKRARLEMYGFIYNNPLTNAV

SEQ ID NO: 3207407 - protein, 25 aa, Giardia lamblia
YKRIRIDDFLYSFEVEGMPQGEIYS

SEQ ID NO: 3207408 - protein, 24 aa, Giardia lamblia
YLEMIRATALYNFGSSEPRPFAPP

SEQ ID NO: 3207409 - protein, 18 aa, Giardia lamblia
YLPGDLIYVIRERKHPKF

SEQ ID NO: 3207410 - protein, 22 aa, Giardia lamblia
YLTFKCGWYPPLPSSGSFYCSI

SEQ ID NO: 3207411 - protein, 24 aa, Giardia lamblia
YMIRCSRQSPFLCINAERKTLAGD

SEQ ID NO: 3207412 - protein, 17 aa, Giardia lamblia
YNYHSVIVLANRLSVFN

SEQ ID NO: 3207413 - protein, 17 aa, Giardia lamblia
YNYYPDFNGSRDRVRLY

SEQ ID NO: 3207414 - protein, 20 aa, Giardia lamblia
YPICDRCNGRGYTIERHDLG

SEQ ID NO: 3207415 - protein, 17 aa, Giardia lamblia
YPIGLAVGSRRASGGRR

SEQ ID NO: 3207416 - protein, 19 aa, Giardia lamblia
YPTTCLFDRNGYMVPCPHG

SEQ ID NO: 3207417 - protein, 25 aa, Giardia lamblia
YQCADLRTGSTYACKKICYSRFDQL

SEQ ID NO: 3207418 - protein, 19 aa, Giardia lamblia
YQKDIYMISCTFIDECLAS

SEQ ID NO: 3207419 - protein, 24 aa, Giardia lamblia
YQNQKLYIDRFIPDMFYDGRYLSD

SEQ ID NO: 3207420 - protein, 34 aa, Giardia lamblia
YQYSISFRKIFESVLRTRISALLKIDYQDQDSDA

SEQ ID NO: 3207421 - protein, 18 aa, Giardia lamblia
YRAVSIGNARPCILYRID

SEQ ID NO: 3207422 - protein, 28 aa, Giardia lamblia
YRFCSQLSCPFIRRYTRILEEKSTVILE

SEQ ID NO: 3207423 - protein, 21 aa, Giardia lamblia
YRLQIFRQRYGYWGLRTLDYI

SEQ ID NO: 3207424 - protein, 18 aa, Giardia lamblia
YRQFGIDLPTSMMELEAE

SEQ ID NO: 3207425 - protein, 20 aa, Giardia lamblia
YRRKNLLVERSIYQRQSPLT

SEQ ID NO: 3207426 - protein, 20 aa, Giardia lamblia
YRSLLNLQLDPLLKFIPEKL

SEQ ID NO: 3207427 - protein, 18 aa, Giardia lamblia
YSCDPCPDGFVSYEGECL

SEQ ID NO: 3207428 - protein, 18 aa, Giardia lamblia
YSPGLCDLVNAMLEKDPS

SEQ ID NO: 3207429 - protein, 22 aa, Giardia lamblia
YSSEFYRKFATENRVLAMFRGH

SEQ ID NO: 3207430 - protein, 24 aa, Giardia lamblia
YSYPLEDIMDAWSNIYTHADKAYL

SEQ ID NO: 3207431 - protein, 18 aa, Giardia lamblia
YTECKDVLLLANHVVSSD

SEQ ID NO: 3207432 - protein, 20 aa, Giardia lamblia
YTIEEFFMYNSVGDWEDLEA

SEQ ID NO: 3207433 - protein, 22 aa, Giardia lamblia
YVHEKCVPRECVYEGVECNSRG

SEQ ID NO: 3207434 - protein, 17 aa, Giardia lamblia
YVSSSKGLYVWSHTTDS

SEQ ID NO: 3207435 - protein, 20 aa, Giardia lamblia
YYCMPEICITGTWLCNGRGI

SEQ ID NO: 3207436 - protein, 25 aa, Giardia lamblia
YYDPAMGPRLFYDVCETCGLRWKHC

SEQ ID NO: 3207437 - protein, 17 aa, Giardia lamblia
YYRFIFLEEPLSLCNGQ

SEQ ID NO: 3207438 - protein, 20 aa, Giardia lamblia
YYRLAKEYHPDYTPADATEE

SEQ ID NO: 3207439 - protein, 25 aa, Giardia lamblia
FVFPLPRRRFSVTLMQAGKEVCALD

SEQ ID NO: 3207440 - protein, 18 aa, Giardia lamblia
VWVPGGAVTIRWTSNLTA

SEQ ID NO: 3207441 - protein, 17 aa, Giardia lamblia
YEMSSVCGLVISNTAID

SEQ ID NO: 3207442 - protein, 21 aa, Giardia lamblia
AACTRAGLTYSPRPRTTARCD

SEQ ID NO: 3207443 - protein, 19 aa, Giardia lamblia
AAQLLKLPFCKKYLAKEED

SEQ ID NO: 3207444 - protein, 17 aa, Giardia lamblia
ADFCSLHGFNNVILFAG

SEQ ID NO: 3207445 - protein, 18 aa, Giardia lamblia
ADIWSFGVCLIELAQGVP

SEQ ID NO: 3207446 - protein, 23 aa, Giardia lamblia
AFRQWWWQTCTEVAYYQPAPLIN

SEQ ID NO: 3207447 - protein, 23 aa, Giardia lamblia
AIEESRYLPALECIFRSFNDSPL

SEQ ID NO: 3207448 - protein, 26 aa, Giardia lamblia
AILKYDFRVFWSWRTKLDRDFYSALH

SEQ ID NO: 3207449 - protein, 18 aa, Giardia lamblia
APHPLLFVSIANSLYFPY

SEQ ID NO: 3207450 - protein, 20 aa, Giardia lamblia
ARFCITCAGKLFTRRNTLIP

SEQ ID NO: 3207451 - protein, 25 aa, Giardia lamblia
ASLARCAHCKEILFVPIIIYPCTHV

SEQ ID NO: 3207452 - protein, 19 aa, Giardia lamblia
AVRSRPKLELERLDKPSMT

SEQ ID NO: 3207453 - protein, 17 aa, Giardia lamblia
AYASWLLDYYGGSMEEI

SEQ ID NO: 3207454 - protein, 17 aa, Giardia lamblia
CANLVRPGAHKILCPLC

SEQ ID NO: 3207455 - protein, 17 aa, Giardia lamblia
CANLVRPGAHRILCPLC

SEQ ID NO: 3207456 - protein, 19 aa, Giardia lamblia
CIPSSCLFNGTICGGHGTC

SEQ ID NO: 3207457 - protein, 17 aa, Giardia lamblia
CRILKRQVEHVIIPENS

SEQ ID NO: 3207458 - protein, 17 aa, Giardia lamblia
CRTDMPMRLAISTISDA

SEQ ID NO: 3207459 - protein, 20 aa, Giardia lamblia
CSSSWAYSAVDAFSHRRCLT

SEQ ID NO: 3207460 - protein, 22 aa, Giardia lamblia
CVPPIFKFSSPILRKWQTERQS

SEQ ID NO: 3207461 - protein, 25 aa, Giardia lamblia
CYKDESVCIPVRWTMRSISAFGSHF

SEQ ID NO: 3207462 - protein, 20 aa, Giardia lamblia
DALRCIVCHDVARKPVVLGC

SEQ ID NO: 3207463 - protein, 21 aa, Giardia lamblia
DEGRTALVYALFGQHKDVVKL

SEQ ID NO: 3207464 - protein, 17 aa, Giardia lamblia
DEYKRRCLFEDAARCYA

SEQ ID NO: 3207465 - protein, 21 aa, Giardia lamblia
DGGWLPSVWRFLTKTGTTTDE

SEQ ID NO: 3207466 - protein, 19 aa, Giardia lamblia
DGWTALMWAAKNGHASCVR

SEQ ID NO: 3207467 - protein, 18 aa, Giardia lamblia
DRFLMCLQEYADYFIFND

SEQ ID NO: 3207468 - protein, 18 aa, Giardia lamblia
DRRCMQWLDPVGVPYSQQ

SEQ ID NO: 3207469 - protein, 18 aa, Giardia lamblia
DSDLCLLGGLSYLRVLDM

SEQ ID NO: 3207470 - protein, 23 aa, Giardia lamblia
DTLPDRWSIYLPMFVEDILQNNW

SEQ ID NO: 3207471 - protein, 19 aa, Giardia lamblia
ECSCCYAFATLGALSTRRC

SEQ ID NO: 3207472 - protein, 20 aa, Giardia lamblia
ELQTRLSVLSSDHLKLEFEY

SEQ ID NO: 3207473 - protein, 18 aa, Giardia lamblia
ERRCHVTFSPAFWNGTEV

SEQ ID NO: 3207474 - protein, 20 aa, Giardia lamblia
EVVIKLMLLIGFFDDPDKGE

SEQ ID NO: 3207475 - protein, 25 aa, Giardia lamblia
EVYLFIGSAEWEWDAYFSNLQIPHS

SEQ ID NO: 3207476 - protein, 20 aa, Giardia lamblia
FDLKAVILFRSFQGRAEITL

SEQ ID NO: 3207477 - protein, 17 aa, Giardia lamblia
FDSGGLFAYVPLKNNQS

SEQ ID NO: 3207478 - protein, 21 aa, Giardia lamblia
FEVVNQLALVYFKLDRFPTPQ

SEQ ID NO: 3207479 - protein, 23 aa, Giardia lamblia
FGFSTRESIAWDFIATTGIPLES

SEQ ID NO: 3207480 - protein, 17 aa, Giardia lamblia
FKLVVCLVFGLNPGIEQ

SEQ ID NO: 3207481 - protein, 20 aa, Giardia lamblia
FLRKEMLVVLLATATLASYA

SEQ ID NO: 3207482 - protein, 24 aa, Giardia lamblia
FMKRARIGPYIAELMGLLTAEDGP

SEQ ID NO: 3207483 - protein, 20 aa, Giardia lamblia
FSFQLSRFIHRCLIFDPVIR

SEQ ID NO: 3207484 - protein, 26 aa, Giardia lamblia
FVKRAAELFIRWSLRRLLHSFKMHLN

SEQ ID NO: 3207485 - protein, 18 aa, Giardia lamblia
GAVTIRWTSNLTAGTEMT

SEQ ID NO: 3207486 - protein, 18 aa, Giardia lamblia
GAVTIRWTSNLTASTEMT

SEQ ID NO: 3207487 - protein, 17 aa, Giardia lamblia
GCGSAECSNSYCASSSG

SEQ ID NO: 3207488 - protein, 18 aa, Giardia lamblia
GCRLRVILGLKKEYVDLT

SEQ ID NO: 3207489 - protein, 24 aa, Giardia lamblia
GDGLIRLKYPWAFDNEAVTKEANE

SEQ ID NO: 3207490 - protein, 23 aa, Giardia lamblia
GDTRPSPAFVFGAQMLREANTRF

SEQ ID NO: 3207491 - protein, 19 aa, Giardia lamblia
GFGECVRALLPFEKGMVDK

SEQ ID NO: 3207492 - protein, 18 aa, Giardia lamblia
GIFLCSMGTFLDFGSLCE

SEQ ID NO: 3207493 - protein, 26 aa, Giardia lamblia
GLCKICGGNGLDCCEIVRLAVANSKR

SEQ ID NO: 3207494 - protein, 24 aa, Giardia lamblia
GLEGCWRLLDHWVINTVEQLFKNT

SEQ ID NO: 3207495 - protein, 18 aa, Giardia lamblia
GMKMKGCALVGDWKIYEG

SEQ ID NO: 3207496 - protein, 22 aa, Giardia lamblia
GMPLPIFWKVYRAVEGSDAAFR

SEQ ID NO: 3207497 - protein, 24 aa, Giardia lamblia
GNLAAWARIQFPFIIDAAISSSGP

SEQ ID NO: 3207498 - protein, 19 aa, Giardia lamblia
GRSALMFAIHNRFSVGIEC

SEQ ID NO: 3207499 - protein, 18 aa, Giardia lamblia
GSCIQGILTREGRLQHEQ

SEQ ID NO: 3207500 - protein, 17 aa, Giardia lamblia
GTLPAPISPIWRAGPIK

SEQ ID NO: 3207501 - protein, 17 aa, Giardia lamblia
GTLPPTNCAQCFTDPDC

SEQ ID NO: 3207502 - protein, 21 aa, Giardia lamblia
HLECIKLLLKNEVGMQDNDGE

SEQ ID NO: 3207503 - protein, 20 aa, Giardia lamblia
HSHGKKMRTVVCQTPAPWVF

SEQ ID NO: 3207504 - protein, 19 aa, Giardia lamblia
IDGTPAWILLIKNRQGEIE

SEQ ID NO: 3207505 - protein, 18 aa, Giardia lamblia
IFQGMAFAWLFLGWALSV

SEQ ID NO: 3207506 - protein, 18 aa, Giardia lamblia
IHYHIKFPKLKSMTLRDK

SEQ ID NO: 3207507 - protein, 17 aa, Giardia lamblia
IIGDAGCELSFPQYRKK

SEQ ID NO: 3207508 - protein, 19 aa, Giardia lamblia
IILDSEMPLLFSIEHVVTK

SEQ ID NO: 3207509 - protein, 19 aa, Giardia lamblia
IKNFWRIVAELTQEQQRRL

SEQ ID NO: 3207510 - protein, 18 aa, Giardia lamblia
IMLTISLFIALLCRCNDP

SEQ ID NO: 3207511 - protein, 17 aa, Giardia lamblia
ITFEVVNQLALVYFKLD

SEQ ID NO: 3207512 - protein, 22 aa, Giardia lamblia
IVTTFLIGLDWFHREKSLETFI

SEQ ID NO: 3207513 - protein, 19 aa, Giardia lamblia
IWSGLCLAGACASYDDSGN

SEQ ID NO: 3207514 - protein, 22 aa, Giardia lamblia
IYREIKASISLSCNPYMVKTYN

SEQ ID NO: 3207515 - protein, 17 aa, Giardia lamblia
KDFLKEWVFPDIDKLIE

SEQ ID NO: 3207516 - protein, 24 aa, Giardia lamblia
KDQAACGSCWSFGAAGTIEGRLNA

SEQ ID NO: 3207517 - protein, 24 aa, Giardia lamblia
KESRMFGCSRLRIYDAYYLASYER

SEQ ID NO: 3207518 - protein, 21 aa, Giardia lamblia
KIYLRDVLRSFVLRECPISDG

SEQ ID NO: 3207519 - protein, 19 aa, Giardia lamblia
KMFFPHAFLRPNIPRYYGV

SEQ ID NO: 3207520 - protein, 19 aa, Giardia lamblia
KMRTVVCQTPAPWVFLLDI

SEQ ID NO: 3207521 - protein, 17 aa, Giardia lamblia
KSLLRVLSWLWATNKAY

SEQ ID NO: 3207522 - protein, 22 aa, Giardia lamblia
KTIKLWMSGGFSFGAPAQASSQ

SEQ ID NO: 3207523 - protein, 23 aa, Giardia lamblia
KVSALKFEYIWTYPTRSRYVNCI

SEQ ID NO: 3207524 - protein, 23 aa, Giardia lamblia
LAALPYRNLWLFFTKSLDYAKNP

SEQ ID NO: 3207525 - protein, 23 aa, Giardia lamblia
LARSSCALALFAVFCSKASGRSD

SEQ ID NO: 3207526 - protein, 18 aa, Giardia lamblia
LARYHLKLLRAYMRQATP

SEQ ID NO: 3207527 - protein, 19 aa, Giardia lamblia
LCLRHVCRLSPSLQGALQI

SEQ ID NO: 3207528 - protein, 22 aa, Giardia lamblia
LDHAYRSSIDFSNPNSIGSNRV

SEQ ID NO: 3207529 - protein, 17 aa, Giardia lamblia
LEMCYKAYFAPGATPPG

SEQ ID NO: 3207530 - protein, 17 aa, Giardia lamblia
LFFFNFELIRGEVRSVY

SEQ ID NO: 3207531 - protein, 21 aa, Giardia lamblia
LFTARCNRLQYSFSHLDLAVV

SEQ ID NO: 3207532 - protein, 23 aa, Giardia lamblia
LKDTCGRSALMFAGIGGHTSIAT

SEQ ID NO: 3207533 - protein, 21 aa, Giardia lamblia
LKMGRLCLTGCSLQCSKKYSL

SEQ ID NO: 3207534 - protein, 19 aa, Giardia lamblia
LNRTLRIPYIYTCGKKAKQ

SEQ ID NO: 3207535 - protein, 19 aa, Giardia lamblia
LPISVAIKPLWVRTELATI

SEQ ID NO: 3207536 - protein, 22 aa, Giardia lamblia
LRATELMFDFPFVSLTEVMDLI

SEQ ID NO: 3207537 - protein, 19 aa, Giardia lamblia
LRTACRARSLSALPLSASS

SEQ ID NO: 3207538 - protein, 17 aa, Giardia lamblia
LRVILGLKKEYVDLTHQ

SEQ ID NO: 3207539 - protein, 17 aa, Giardia lamblia
LSYECMTEVLPLNSSLI

SEQ ID NO: 3207540 - protein, 22 aa, Giardia lamblia
LTCLPGAATCRLISILIRHDMC

SEQ ID NO: 3207541 - protein, 20 aa, Giardia lamblia
LTFMPFCIGINLPDAFSDNS

SEQ ID NO: 3207542 - protein, 18 aa, Giardia lamblia
LTTIPLRIVDQITCADLS

SEQ ID NO: 3207543 - protein, 19 aa, Giardia lamblia
MAPVLRPLLLLPEDTQEAP

SEQ ID NO: 3207544 - protein, 17 aa, Giardia lamblia
MKMKGCALVGDWKIYEG

SEQ ID NO: 3207545 - protein, 17 aa, Giardia lamblia
MRPACAVCAAGPACITR

SEQ ID NO: 3207546 - protein, 18 aa, Giardia lamblia
MVLFVGGFSTKVSALKFE

SEQ ID NO: 3207547 - protein, 19 aa, Giardia lamblia
NHFFFRYTLQLYKLVCHSC

SEQ ID NO: 3207548 - protein, 19 aa, Giardia lamblia
NLFAKRWVGSHSDITSCQS

SEQ ID NO: 3207549 - protein, 19 aa, Giardia lamblia
NSLHYAKFVAPFIRNNIPI

SEQ ID NO: 3207550 - protein, 17 aa, Giardia lamblia
NSYSCLCLHGYAGDYCE

SEQ ID NO: 3207551 - protein, 24 aa, Giardia lamblia
NTGIRLRLCIKMRAFLNTLPLDTS

SEQ ID NO: 3207552 - protein, 20 aa, Giardia lamblia
NVDFTVRWNRFINLNQPEAF

SEQ ID NO: 3207553 - protein, 19 aa, Giardia lamblia
PCIYRKLGGLFLFVIGAEA

SEQ ID NO: 3207554 - protein, 17 aa, Giardia lamblia
PDYASSVTFELYQHEND

SEQ ID NO: 3207555 - protein, 18 aa, Giardia lamblia
PEHGMGVRFTRRGLEKFC

SEQ ID NO: 3207556 - protein, 25 aa, Giardia lamblia
PERFLRFLSVELWDTASLPQVDTLV

SEQ ID NO: 3207557 - protein, 20 aa, Giardia lamblia
PIPTDLCALTSMQYLQINNA

SEQ ID NO: 3207558 - protein, 18 aa, Giardia lamblia
PLATLFLDMIKLISEPSG

SEQ ID NO: 3207559 - protein, 18 aa, Giardia lamblia
PLRCATCWNKARDQRPAF

SEQ ID NO: 3207560 - protein, 22 aa, Giardia lamblia
PLVPMFICPSIAPSNYNNPGYY

SEQ ID NO: 3207561 - protein, 24 aa, Giardia lamblia
PNRYYRCLQPFFKNDTFIVSLVHT

SEQ ID NO: 3207562 - protein, 19 aa, Giardia lamblia
PPTIPPRSTLVFEVELVQI

SEQ ID NO: 3207563 - protein, 18 aa, Giardia lamblia
PSDHIPGSISIFLRDNSL

SEQ ID NO: 3207564 - protein, 19 aa, Giardia lamblia
QLLKGCGSAECSNSYCASS

SEQ ID NO: 3207565 - protein, 17 aa, Giardia lamblia
QNCTESWYARLLTENIF

SEQ ID NO: 3207566 - protein, 18 aa, Giardia lamblia
QQFLWRIMTHLLKDPDRV

SEQ ID NO: 3207567 - protein, 20 aa, Giardia lamblia
QRCSYLYDIVCVFKYCFSSS

SEQ ID NO: 3207568 - protein, 20 aa, Giardia lamblia
QTAFPRGLLRACAKQKNAKG

SEQ ID NO: 3207569 - protein, 18 aa, Giardia lamblia
RCLPRLSHLLAFRVSCRL

SEQ ID NO: 3207570 - protein, 23 aa, Giardia lamblia
RDELTLKIPHDWICGAESNVSCT

SEQ ID NO: 3207571 - protein, 17 aa, Giardia lamblia
RDKCYDFARKAVEASST

SEQ ID NO: 3207572 - protein, 20 aa, Giardia lamblia
RELVSFFRWLLLDEEGSIEP

SEQ ID NO: 3207573 - protein, 21 aa, Giardia lamblia
RFEEACVWLILVQCLLALDYL

SEQ ID NO: 3207574 - protein, 24 aa, Giardia lamblia
RGGDIRTALQFTFRTIARTVAEGL

SEQ ID NO: 3207575 - protein, 23 aa, Giardia lamblia
RGHNECIRFLVAHESGLVDNNLW

SEQ ID NO: 3207576 - protein, 17 aa, Giardia lamblia
RIDDFLYSFEVEGMPQG

SEQ ID NO: 3207577 - protein, 20 aa, Giardia lamblia
RIEGRTCFQWVIVGGSYPGA

SEQ ID NO: 3207578 - protein, 19 aa, Giardia lamblia
RKPGLVFSGFTAGVMEDAL

SEQ ID NO: 3207579 - protein, 17 aa, Giardia lamblia
RNAFEMIVSITTTQTTA

SEQ ID NO: 3207580 - protein, 18 aa, Giardia lamblia
RPPWPSVCISLRHANTTM

SEQ ID NO: 3207581 - protein, 20 aa, Giardia lamblia
RQRPSLMLNQAFIDHPMNTH

SEQ ID NO: 3207582 - protein, 24 aa, Giardia lamblia
RRDFSLLIAEEFIFIGVRETEKPF

SEQ ID NO: 3207583 - protein, 17 aa, Giardia lamblia
RRECIELLIPYEDIRDA

SEQ ID NO: 3207584 - protein, 17 aa, Giardia lamblia
RRIMLGIILFNTHLHYI

SEQ ID NO: 3207585 - protein, 18 aa, Giardia lamblia
RRLLDHFIAIFKKKNNID

SEQ ID NO: 3207586 - protein, 20 aa, Giardia lamblia
RSESVFPMFTSVSLQDHSAL

SEQ ID NO: 3207587 - protein, 20 aa, Giardia lamblia
RTGGRPGMDYNYLVEQSDYF

SEQ ID NO: 3207588 - protein, 18 aa, Giardia lamblia
RVDDCLFENISLRAASPD

SEQ ID NO: 3207589 - protein, 19 aa, Giardia lamblia
RYGPWRMVLFVGGFSTKVS

SEQ ID NO: 3207590 - protein, 18 aa, Giardia lamblia
SAEYMVPGGIYFIEDVHA

SEQ ID NO: 3207591 - protein, 21 aa, Giardia lamblia
SCGGCWAFSAIGVFGDRRCAM

SEQ ID NO: 3207592 - protein, 24 aa, Giardia lamblia
SEEPSNVCGLIIYRATFLSPTTIS

SEQ ID NO: 3207593 - protein, 19 aa, Giardia lamblia
SESPKRCYIGFTNNPLRRI

SEQ ID NO: 3207594 - protein, 17 aa, Giardia lamblia
SGKLFAWTVTTETLCFG

SEQ ID NO: 3207595 - protein, 21 aa, Giardia lamblia
SHSQQLHCLYEFYDALQGDSW

SEQ ID NO: 3207596 - protein, 22 aa, Giardia lamblia
SNRYPCPVYRTSLRRGVLTTTG

SEQ ID NO: 3207597 - protein, 20 aa, Giardia lamblia
SQLSCPFIRRYTRILEEKST

SEQ ID NO: 3207598 - protein, 23 aa, Giardia lamblia
SRLAGFNETVGWGVLRDNLIART

SEQ ID NO: 3207599 - protein, 25 aa, Giardia lamblia
SRSRACSGPCRFHFLNFALLICPQL

SEQ ID NO: 3207600 - protein, 23 aa, Giardia lamblia
SSIFPPIFFKLLLGHSYTVITRE

SEQ ID NO: 3207601 - protein, 19 aa, Giardia lamblia
STRFWSLRVDDCLFENISL

SEQ ID NO: 3207602 - protein, 22 aa, Giardia lamblia
TCGLRWKHCPGHAGYVELPVYC

SEQ ID NO: 3207603 - protein, 18 aa, Giardia lamblia
TMIVCLLVLLAVIGGKQL

SEQ ID NO: 3207604 - protein, 19 aa, Giardia lamblia
TSVACEACAEFIKLAITDS

SEQ ID NO: 3207605 - protein, 24 aa, Giardia lamblia
VDRSWLWQTCVEFGYYQTSSPAAG

SEQ ID NO: 3207606 - protein, 17 aa, Giardia lamblia
VEKRAHTSYVRRPNEFE

SEQ ID NO: 3207607 - protein, 18 aa, Giardia lamblia
VILLRRLRVTTVSEKLLE

SEQ ID NO: 3207608 - protein, 21 aa, Giardia lamblia
VNINRLFKLVVCLVFGLNPGI

SEQ ID NO: 3207609 - protein, 25 aa, Giardia lamblia
VPDLLKSGGIPLIIKLTQDSNKGAF

SEQ ID NO: 3207610 - protein, 18 aa, Giardia lamblia
VTFCTLTIKKFDEIKALT

SEQ ID NO: 3207611 - protein, 19 aa, Giardia lamblia
VWNGFRFMSMANFLVWQKD

SEQ ID NO: 3207612 - protein, 19 aa, Giardia lamblia
VYCYNHFFFRYTLQLYKLV

SEQ ID NO: 3207613 - protein, 18 aa, Giardia lamblia
WHPFSPCIAMCLARDICI

SEQ ID NO: 3207614 - protein, 19 aa, Giardia lamblia
WKCGGEGRIIQKSCHVCHA

SEQ ID NO: 3207615 - protein, 18 aa, Giardia lamblia
WLPNVWKFLTKTGTTTDE

SEQ ID NO: 3207616 - protein, 19 aa, Giardia lamblia
WSPLWGMDGYFYLSMKDNI

SEQ ID NO: 3207617 - protein, 20 aa, Giardia lamblia
YCGACWAFSATGAFGDRRCM

SEQ ID NO: 3207618 - protein, 23 aa, Giardia lamblia
YGHNRCGWFLSNFGRLATYVLQR

SEQ ID NO: 3207619 - protein, 23 aa, Giardia lamblia
YIDSLKHALSIRVHDFGFDSEAG

SEQ ID NO: 3207620 - protein, 19 aa, Giardia lamblia
YKRRCLFEDAARCYAQNSN

SEQ ID NO: 3207621 - protein, 20 aa, Giardia lamblia
YQHNCWKCGGEGRIIQKSCH

SEQ ID NO: 3207622 - protein, 23 aa, Giardia lamblia
YRFSQRYRPWLGLRALPTAQNIA

SEQ ID NO: 3207623 - protein, 23 aa, Giardia lamblia
YVACLKAGFLVAAERTKEALASA

SEQ ID NO: 3207624 - protein, 24 aa, Giardia lamblia
RESVNSYLYAWHVAYDKFKADGLT

SEQ ID NO: 3207625 - protein, 21 aa, Giardia lamblia
AAPHIPWIGAAALPVNLTGAL

SEQ ID NO: 3207626 - protein, 18 aa, Giardia lamblia
AMIVGQHLLRGATAQAAG

SEQ ID NO: 3207627 - protein, 26 aa, Giardia lamblia
ATIPDWSVRALYPNKITSPPPKTVYT

SEQ ID NO: 3207628 - protein, 24 aa, Giardia lamblia
DLMKNTVLQLLFNTIFNSIKQSML

SEQ ID NO: 3207629 - protein, 22 aa, Giardia lamblia
GPNYFVRMRSNSPMFTNTSDDF

SEQ ID NO: 3207630 - protein, 41 aa, Giardia lamblia
IYVGHADLFKIHILKTGLYVLPAALVLPPRTTLGGASSRGG

SEQ ID NO: 3207631 - protein, 21 aa, Giardia lamblia
KSLNPRWKAGIPKRFEGLTKD

SEQ ID NO: 3207632 - protein, 29 aa, Giardia lamblia
LSFTIHRHGFVFPLPRRRFSVTLMQAGKE

SEQ ID NO: 3207633 - protein, 32 aa, Giardia lamblia
MDDPVPLLKRLLLDKYLPLVNPILAETGVALM

SEQ ID NO: 3207634 - protein, 18 aa, Giardia lamblia
NHMRPQPTLLLYAALRTA

SEQ ID NO: 3207635 - protein, 26 aa, Giardia lamblia
NPLAMTTSFRTVALSPILELDTQRSL

SEQ ID NO: 3207636 - protein, 19 aa, Giardia lamblia
QPTLLLYAALRTASTALCT

SEQ ID NO: 3207637 - protein, 24 aa, Giardia lamblia
RESVNSYLYAWHVAYDKFKADSLT

SEQ ID NO: 3207638 - protein, 18 aa, Giardia lamblia
RYTGLPGCPIASRDRSMA

SEQ ID NO: 3207639 - protein, 21 aa, Giardia lamblia
SNSLASLPFSLSHKLPESESS

SEQ ID NO: 3207640 - protein, 27 aa, Giardia lamblia
TEENFLASELWVRNMKARLASVYQGCI

SEQ ID NO: 3207641 - protein, 25 aa, Giardia lamblia
YCGERLLDVIAAGLPPSGSIEVRLP

SEQ ID NO: 3207642 - protein, 23 aa, Giardia lamblia
AAELLKHPTILEYKRFYDEQIVS

SEQ ID NO: 3207643 - protein, 22 aa, Giardia lamblia
AAKFGHLEIVRLLRDVEACLQS

SEQ ID NO: 3207644 - protein, 20 aa, Giardia lamblia
AAPHIPWIGAAALPVNLTGA

SEQ ID NO: 3207645 - protein, 20 aa, Giardia lamblia
AAPHIPWIGAATLPVNLTGA

SEQ ID NO: 3207646 - protein, 18 aa, Giardia lamblia
AAPLQVPCKLMDGASVLM

SEQ ID NO: 3207647 - protein, 18 aa, Giardia lamblia
AAPLQVPCKLMDGASVLV

SEQ ID NO: 3207648 - protein, 25 aa, Giardia lamblia
AAQRPPAAYYFLRAASYEAQREIAR

SEQ ID NO: 3207649 - protein, 19 aa, Giardia lamblia
AASSYLFKLAKKVSEKMSI

SEQ ID NO: 3207650 - protein, 28 aa, Giardia lamblia
AATCRLISILIRHDMCGHDIVFGCDYVC

SEQ ID NO: 3207651 - protein, 21 aa, Giardia lamblia
AATLNVLYPNMYYIHLDEATG

SEQ ID NO: 3207652 - protein, 18 aa, Giardia lamblia
AAVLYLQEKLQKMPAHNA

SEQ ID NO: 3207653 - protein, 23 aa, Giardia lamblia
ACACNDGFVFYENTCIYASCIVN

SEQ ID NO: 3207654 - protein, 23 aa, Giardia lamblia
ACDGGWLPSVWRFLTKTGTTTDE

SEQ ID NO: 3207655 - protein, 25 aa, Giardia lamblia
ADEISFTPILSYPVGISSPPPKAVY

SEQ ID NO: 3207656 - protein, 23 aa, Giardia lamblia
ADGILRFADLLQIPMEAALQLGT

SEQ ID NO: 3207657 - protein, 26 aa, Giardia lamblia
ADYHNNLIFRRIRKDLFLSLREHFNY

SEQ ID NO: 3207658 - protein, 27 aa, Giardia lamblia
AESSAAFLLKDAFKTSFRPTLSGAKTQ

SEQ ID NO: 3207659 - protein, 17 aa, Giardia lamblia
AFALGSDECPYYTTKVG

SEQ ID NO: 3207660 - protein, 17 aa, Giardia lamblia
AFNFLHNTGTVLASCVG

SEQ ID NO: 3207661 - protein, 23 aa, Giardia lamblia
AGKLVTRLIEYPMSLRMICDDIY

SEQ ID NO: 3207662 - protein, 19 aa, Giardia lamblia
AGYEIAIPYKEVATPAELQ

SEQ ID NO: 3207663 - protein, 25 aa, Giardia lamblia
AHEKLDLYDTKLNIWASDLATDADI

SEQ ID NO: 3207664 - protein, 23 aa, Giardia lamblia
AHEYAALGHPLLLIGRKHENLER

SEQ ID NO: 3207665 - protein, 21 aa, Giardia lamblia
AHVFSMLYYDVLTLECRSTGQ

SEQ ID NO: 3207666 - protein, 18 aa, Giardia lamblia
AIGPFACSPVLPRASRKN

SEQ ID NO: 3207667 - protein, 23 aa, Giardia lamblia
AKALRSFVLYNMKKPFRDHRTPK

SEQ ID NO: 3207668 - protein, 24 aa, Giardia lamblia
AKFEELNIDLFKKSIKPVEQVLRD

SEQ ID NO: 3207669 - protein, 20 aa, Giardia lamblia
AKGYLPLLLAAESTLLDILI

SEQ ID NO: 3207670 - protein, 21 aa, Giardia lamblia
AKGYRVILISHIPFGVNVYDE

SEQ ID NO: 3207671 - protein, 27 aa, Giardia lamblia
AKIELITEALRQYLKYPRPTATNKKQR

SEQ ID NO: 3207672 - protein, 30 aa, Giardia lamblia
AKNIFQGMAFAWLFLGWALSVTFDVHENIK

SEQ ID NO: 3207673 - protein, 23 aa, Giardia lamblia
AKVSAILTRACWKRILNSCIAGK

SEQ ID NO: 3207674 - protein, 27 aa, Giardia lamblia
ALERTRAQCKLPLNLPLFSAEAISQNC

SEQ ID NO: 3207675 - protein, 27 aa, Giardia lamblia
ALFFPLLTLPLQQPIVPILSKYMICTF

SEQ ID NO: 3207676 - protein, 18 aa, Giardia lamblia
ALIIQFIWAQTSCGVGFS

SEQ ID NO: 3207677 - protein, 17 aa, Giardia lamblia
ALLTSLWAAYTLSKAIA

SEQ ID NO: 3207678 - protein, 19 aa, Giardia lamblia
AMVVQGLHPIFLIDKQNKA

SEQ ID NO: 3207679 - protein, 20 aa, Giardia lamblia
ANVRALYSYFASFSRGDEDA

SEQ ID NO: 3207680 - protein, 19 aa, Giardia lamblia
APHIPWIGAAALPVNLTGA

SEQ ID NO: 3207681 - protein, 25 aa, Giardia lamblia
APIDRPVCLYASDIMWLPIEQHSNH

SEQ ID NO: 3207682 - protein, 21 aa, Giardia lamblia
APLSLLIRALNSSNAVLVNVP

SEQ ID NO: 3207683 - protein, 18 aa, Giardia lamblia
APPLLKEDAGYSPGLCDL

SEQ ID NO: 3207684 - protein, 26 aa, Giardia lamblia
AQALSCINILLRKLGIKNILSDTSQI

SEQ ID NO: 3207685 - protein, 22 aa, Giardia lamblia
AQLQSLRRSFLQHPPDFPHPVS

SEQ ID NO: 3207686 - protein, 23 aa, Giardia lamblia
ARAVAYFFVAYPDYFDRLGDVMD

SEQ ID NO: 3207687 - protein, 17 aa, Giardia lamblia
ARHVLAVAGVALDHHVR

SEQ ID NO: 3207688 - protein, 19 aa, Giardia lamblia
ARLKVLTPFQVDDAVMAVT

SEQ ID NO: 3207689 - protein, 27 aa, Giardia lamblia
ASFLAGVGAVFLVQAVHAKCCTVRCPL

SEQ ID NO: 3207690 - protein, 25 aa, Giardia lamblia
ASGLIGMFGVGFFSSYLVAEKVDFY

SEQ ID NO: 3207691 - protein, 43 aa, Giardia lamblia
ASHPDAIYGILFGLGLIHLGDPLFLKAFNFNEFYISKFGMGMT

SEQ ID NO: 3207692 - protein, 24 aa, Giardia lamblia
ASKALPETFLLPADYPKLKAYVAG

SEQ ID NO: 3207693 - protein, 24 aa, Giardia lamblia
ASKHLDFLTPFLADRSAAPTAMSP

SEQ ID NO: 3207694 - protein, 23 aa, Giardia lamblia
ASMNPPRCICPTDYIGRNSVCYP

SEQ ID NO: 3207695 - protein, 26 aa, Giardia lamblia
ASNTTLGSVSLFLAQKTESPVCIQQH

SEQ ID NO: 3207696 - protein, 17 aa, Giardia lamblia
ASSGYFQRVLVKNLEGL

SEQ ID NO: 3207697 - protein, 23 aa, Giardia lamblia
ASVVYPLSKIQFLPSKDVSNPDL

SEQ ID NO: 3207698 - protein, 21 aa, Giardia lamblia
ASYADRYILNPGGHMFATFAS

SEQ ID NO: 3207699 - protein, 17 aa, Giardia lamblia
ATAPFTCTCEDGYIAMG

SEQ ID NO: 3207700 - protein, 24 aa, Giardia lamblia
ATHLSKLHMLLQSQFIYSGAELRQ

SEQ ID NO: 3207701 - protein, 28 aa, Giardia lamblia
ATVSSIFPPIFFKLLLGHSYTVITREDL

SEQ ID NO: 3207702 - protein, 27 aa, Giardia lamblia
AVGEYFKVPQIFFSQLLCVAMESLANL

SEQ ID NO: 3207703 - protein, 18 aa, Giardia lamblia
AVKRYIPYQARMVAKLVK

SEQ ID NO: 3207704 - protein, 32 aa, Giardia lamblia
AYGHAFYHKTIAPFFKLLPVAYVASVTSHTTL

SEQ ID NO: 3207705 - protein, 20 aa, Giardia lamblia
CALELRILLASHATVALGVP

SEQ ID NO: 3207706 - protein, 20 aa, Giardia lamblia
CANLVRPGAHKILCPLCKLE

SEQ ID NO: 3207707 - protein, 20 aa, Giardia lamblia
CANLVRPGAHRILCPLCKLE

SEQ ID NO: 3207708 - protein, 22 aa, Giardia lamblia
CARQVLRHLLGARDMMVRNVAL

SEQ ID NO: 3207709 - protein, 19 aa, Giardia lamblia
CASERYRPLLSAKVLKRNT

SEQ ID NO: 3207710 - protein, 22 aa, Giardia lamblia
CAYGDGAHFCQCRRGWAGAACD

SEQ ID NO: 3207711 - protein, 25 aa, Giardia lamblia
CDDDMHYLPDWGCVPTPCIGDTPIP

SEQ ID NO: 3207712 - protein, 24 aa, Giardia lamblia
CEDPLPILAFMNKLGDLFKSALAT

SEQ ID NO: 3207713 - protein, 36 aa, Giardia lamblia
CGGHGICIPATKATKAFCLCLPKMKNIGNACIPKTC

SEQ ID NO: 3207714 - protein, 17 aa, Giardia lamblia
CIFTLKGFGADISLRLG

SEQ ID NO: 3207715 - protein, 22 aa, Giardia lamblia
CIPKELIAQYPILSSMKPCTTD

SEQ ID NO: 3207716 - protein, 18 aa, Giardia lamblia
CITDYSPIGEPVLCSGHG

SEQ ID NO: 3207717 - protein, 18 aa, Giardia lamblia
CITPVYDQGYCGACWAFS

SEQ ID NO: 3207718 - protein, 49 aa, Giardia lamblia
CLHNYRSLLNLQLDPLLKFIPEKLSLLPLFVYAMLRTHMMRPVNSKSAR

SEQ ID NO: 3207719 - protein, 17 aa, Giardia lamblia
CLVGFLASVSTDAHPDE

SEQ ID NO: 3207720 - protein, 21 aa, Giardia lamblia
CNLSFYLFSYLINAGDPDQEA

SEQ ID NO: 3207721 - protein, 20 aa, Giardia lamblia
CPVCAFPDAFWIQMQIRSSD

SEQ ID NO: 3207722 - protein, 28 aa, Giardia lamblia
CSGPCRFHFLNFALLICPQLLGSSMAQL

SEQ ID NO: 3207723 - protein, 17 aa, Giardia lamblia
CSKKYSLALLDSATRTA

SEQ ID NO: 3207724 - protein, 18 aa, Giardia lamblia
CSNIDLVYTWVNGSAGHH

SEQ ID NO: 3207725 - protein, 17 aa, Giardia lamblia
CTVLLASGVLATSHGVD

SEQ ID NO: 3207726 - protein, 17 aa, Giardia lamblia
CVAGLEAKFKKAMNSEQ

SEQ ID NO: 3207727 - protein, 23 aa, Giardia lamblia
CVDLAFTGSLGDPLHTGKPSMQP

SEQ ID NO: 3207728 - protein, 20 aa, Giardia lamblia
CVLAYGLCKVMARTSLRLSS

SEQ ID NO: 3207729 - protein, 24 aa, Giardia lamblia
CYAKINYTFLPLGPQILYCDTCKV

SEQ ID NO: 3207730 - protein, 22 aa, Giardia lamblia
DAAPHIPWIGAAALLTNLTGTL

SEQ ID NO: 3207731 - protein, 24 aa, Giardia lamblia
DAATRKILAQFLRDYDSAMADNQK

SEQ ID NO: 3207732 - protein, 40 aa, Giardia lamblia
DACTDTGLYQDFGFCMHCAPGWFLHGYNNVTGAEGGCFRC

SEQ ID NO: 3207733 - protein, 20 aa, Giardia lamblia
DACVTEYADGVRRVCAGFGH

SEQ ID NO: 3207734 - protein, 20 aa, Giardia lamblia
DAFNLSYFKKLPRLMMHLGE

SEQ ID NO: 3207735 - protein, 21 aa, Giardia lamblia
DAHFITDFAFCSSILCAVGDE

SEQ ID NO: 3207736 - protein, 28 aa, Giardia lamblia
DALELLSSFYHLMRDKCYDFARKAVEAS

SEQ ID NO: 3207737 - protein, 31 aa, Giardia lamblia
DATSARFSLASYFTLAFDKASYQGQEGESVA

SEQ ID NO: 3207738 - protein, 30 aa, Giardia lamblia
DATSARFSLASYFTLAFDKTSYQGQEGESV

SEQ ID NO: 3207739 - protein, 29 aa, Giardia lamblia
DCLYRFSQRYRPWLGLRALPTAQNIAHLY

SEQ ID NO: 3207740 - protein, 17 aa, Giardia lamblia
DCRSAGEFTLLHSNPPP

SEQ ID NO: 3207741 - protein, 27 aa, Giardia lamblia
DDEYDLWYTIWDNLITRTWLGMSLPQN

SEQ ID NO: 3207742 - protein, 26 aa, Giardia lamblia
DDGFVLQGTFKCIPITCIVDGKMCPN

SEQ ID NO: 3207743 - protein, 20 aa, Giardia lamblia
DDISLNNLAYRLRSDSKRIA

SEQ ID NO: 3207744 - protein, 17 aa, Giardia lamblia
DDNLLPYVAAILRYESE

SEQ ID NO: 3207745 - protein, 23 aa, Giardia lamblia
DDQWWGSFCERPAEPCMPTEVFV

SEQ ID NO: 3207746 - protein, 22 aa, Giardia lamblia
DDRQRAEIYAAFRAANGKTASE

SEQ ID NO: 3207747 - protein, 26 aa, Giardia lamblia
DDVFFSNFWQDPWHMCSMTDDMGGQK

SEQ ID NO: 3207748 - protein, 23 aa, Giardia lamblia
DDYACDCYPIYRGGLCQSCDDAN

SEQ ID NO: 3207749 - protein, 25 aa, Giardia lamblia
DEEVDQFYELLFLQAVVEGELICSG

SEQ ID NO: 3207750 - protein, 22 aa, Giardia lamblia
DEIGLPEYFAKKLTFPEPINEY

SEQ ID NO: 3207751 - protein, 24 aa, Giardia lamblia
DEISSLLMPVSFLKNAKGAAPRGT

SEQ ID NO: 3207752 - protein, 23 aa, Giardia lamblia
DFSKSTLYCPRRGLKDGPYQYDW

SEQ ID NO: 3207753 - protein, 29 aa, Giardia lamblia
DGDVSVCTTCLLRFNYISPGKNCCISTCP

SEQ ID NO: 3207754 - protein, 21 aa, Giardia lamblia
DGEVFFVGEYAEIFQKRKPGL

SEQ ID NO: 3207755 - protein, 21 aa, Giardia lamblia
DGHEPLHSLLFNPLPASLNEE

SEQ ID NO: 3207756 - protein, 26 aa, Giardia lamblia
DGITPLMLLGILNKPIFYPFCQATLG

SEQ ID NO: 3207757 - protein, 24 aa, Giardia lamblia
DGKRYLLIIPISVSSGVDLFKNVY

SEQ ID NO: 3207758 - protein, 21 aa, Giardia lamblia
DGMITAALLHDFCVTSNKEVI

SEQ ID NO: 3207759 - protein, 23 aa, Giardia lamblia
DGPPTIFFRLTQCALRNGLDPWD

SEQ ID NO: 3207760 - protein, 18 aa, Giardia lamblia
DGRYQCICSQLDSYTIDR

SEQ ID NO: 3207761 - protein, 23 aa, Giardia lamblia
DGTPAWILLIKNRQGEIEKLADF

SEQ ID NO: 3207762 - protein, 20 aa, Giardia lamblia
DGWTALMWAAKNGHASCVRL

SEQ ID NO: 3207763 - protein, 24 aa, Giardia lamblia
DHQDFYCLPLNFVDGKLYCQPRRW

SEQ ID NO: 3207764 - protein, 25 aa, Giardia lamblia
DIEGGNLRALFYLSNPFINFDNIYT

SEQ ID NO: 3207765 - protein, 22 aa, Giardia lamblia
DIENKVCTCSYLYAGFHCNVCS

SEQ ID NO: 3207766 - protein, 24 aa, Giardia lamblia
DIGAILLGRFLSDPTLIANDKKKE

SEQ ID NO: 3207767 - protein, 20 aa, Giardia lamblia
DIRVKFLVNITTDSASIPSI

SEQ ID NO: 3207768 - protein, 24 aa, Giardia lamblia
DISLELNIIPEQPISKLKNDLMKT

SEQ ID NO: 3207769 - protein, 20 aa, Giardia lamblia
DITAFYLVPGKPRMLRLTDR

SEQ ID NO: 3207770 - protein, 24 aa, Giardia lamblia
DIVTTFLIGLDWFHREKSLETFIV

SEQ ID NO: 3207771 - protein, 21 aa, Giardia lamblia
DKGRSIYWPDLCRPHAARNSS

SEQ ID NO: 3207772 - protein, 26 aa, Giardia lamblia
DKRRCVCNPLYGGTYCQKCSEDALAM

SEQ ID NO: 3207773 - protein, 21 aa, Giardia lamblia
DLKAYASWLLDYYGGSMEEID

SEQ ID NO: 3207774 - protein, 26 aa, Giardia lamblia
DLLKGVVCLYQSLSGHRSRCVLEYGF

SEQ ID NO: 3207775 - protein, 18 aa, Giardia lamblia
DLRNLFCQLGAMLGISLV

SEQ ID NO: 3207776 - protein, 19 aa, Giardia lamblia
DLTFMPFCIGINLPDAFSD

SEQ ID NO: 3207777 - protein, 24 aa, Giardia lamblia
DNLDALINGLFAKVKDLLDLLSSV

SEQ ID NO: 3207778 - protein, 20 aa, Giardia lamblia
DNLVLQHFYYRTSTADLFQD

SEQ ID NO: 3207779 - protein, 19 aa, Giardia lamblia
DPGYVLIGTAECTPAVCLV

SEQ ID NO: 3207780 - protein, 18 aa, Giardia lamblia
DPMDWPIQKVYPNKITSP

SEQ ID NO: 3207781 - protein, 24 aa, Giardia lamblia
DPTFHPPVLLLLDSSDPQVESRTA

SEQ ID NO: 3207782 - protein, 26 aa, Giardia lamblia
DQVFTYVRKVIVPDFYKVLGVSRSTP

SEQ ID NO: 3207783 - protein, 29 aa, Giardia lamblia
DREADPIPLFYHPYTYTGLMSDLGIFSGG

SEQ ID NO: 3207784 - protein, 22 aa, Giardia lamblia
DRKPVLLFFTSKMCKTCAANMI

SEQ ID NO: 3207785 - protein, 17 aa, Giardia lamblia
DRMSQLLAIFLVIDMLG

SEQ ID NO: 3207786 - protein, 23 aa, Giardia lamblia
DSMNNVTYDLMRGCALLGMECHV

SEQ ID NO: 3207787 - protein, 19 aa, Giardia lamblia
DTEAFLLKQSPDIVRRLVI

SEQ ID NO: 3207788 - protein, 17 aa, Giardia lamblia
DTEKLHPLIILAGSTEL

SEQ ID NO: 3207789 - protein, 20 aa, Giardia lamblia
DTFVQLVIAIQYIHRHLDGP

SEQ ID NO: 3207790 - protein, 18 aa, Giardia lamblia
DTLSFLRYLETTDTKDLC

SEQ ID NO: 3207791 - protein, 23 aa, Giardia lamblia
DVDTLLHWNVLHPPTAEELDEHD

SEQ ID NO: 3207792 - protein, 26 aa, Giardia lamblia
DVQGKLDELVILLRRLRVTTVSEKLL

SEQ ID NO: 3207793 - protein, 21 aa, Giardia lamblia
DWMTHIRRFITIATPFDGSSS

SEQ ID NO: 3207794 - protein, 20 aa, Giardia lamblia
DWPIQKVYPNKITSPPPKTV

SEQ ID NO: 3207795 - protein, 21 aa, Giardia lamblia
DWSVFHRICYSPRVSVPIVVL

SEQ ID NO: 3207796 - protein, 26 aa, Giardia lamblia
EAGGFPYALVLITLTFDFLDLASRDM

SEQ ID NO: 3207797 - protein, 24 aa, Giardia lamblia
EAGSMWFIYYALHEYDKALQYCPV

SEQ ID NO: 3207798 - protein, 34 aa, Giardia lamblia
EAVFRQLVLLRATELMFDFPFVSLTEVMDLILSA

SEQ ID NO: 3207799 - protein, 29 aa, Giardia lamblia
ECICDLTHMMFWYMSINALTGPIPTCVNE

SEQ ID NO: 3207800 - protein, 18 aa, Giardia lamblia
EDDYLLTELGCYPSGCSD

SEQ ID NO: 3207801 - protein, 27 aa, Giardia lamblia
EDFMFVPQPAIVYPVARWTGKAVISSM

SEQ ID NO: 3207802 - protein, 18 aa, Giardia lamblia
EDILPSQYRHLFAARLER

SEQ ID NO: 3207803 - protein, 29 aa, Giardia lamblia
EDKLLARYHLKLLRAYMRQATPTVHGVER

SEQ ID NO: 3207804 - protein, 25 aa, Giardia lamblia
EEHFEPIFFIFFREEGRAERMPYSF

SEQ ID NO: 3207805 - protein, 20 aa, Giardia lamblia
EEHIALFTPPQLFFFEGSDC

SEQ ID NO: 3207806 - protein, 22 aa, Giardia lamblia
EEKIRPYTIEEFFMYNSVGDWE

SEQ ID NO: 3207807 - protein, 23 aa, Giardia lamblia
EELFEDAVSLLNQRILRKTQTGR

SEQ ID NO: 3207808 - protein, 25 aa, Giardia lamblia
EERKKYLRPAIGRLLKLLTTEMSDE

SEQ ID NO: 3207809 - protein, 25 aa, Giardia lamblia
EEYVDFYLGTLYKPDPALSFDSSIA

SEQ ID NO: 3207810 - protein, 25 aa, Giardia lamblia
EFAVDRSWLWQTCVEFGYYQTSSPA

SEQ ID NO: 3207811 - protein, 26 aa, Giardia lamblia
EFSFKHLLSHPLIVGNGSLWFRNDAL

SEQ ID NO: 3207812 - protein, 23 aa, Giardia lamblia
EFSKSCPAGHQLVLGYCVPNVCV

SEQ ID NO: 3207813 - protein, 20 aa, Giardia lamblia
EGAIYGAALIAARYGSGHRV

SEQ ID NO: 3207814 - protein, 26 aa, Giardia lamblia
EGETALMLLCKAPHPLLAFGQEAKIP

SEQ ID NO: 3207815 - protein, 32 aa, Giardia lamblia
EGGRFEEACVWLILVQCLLALDYLDTELSDVD

SEQ ID NO: 3207816 - protein, 19 aa, Giardia lamblia
EHDDLLESIRYFKTSAEES

SEQ ID NO: 3207817 - protein, 24 aa, Giardia lamblia
EHNLIKKFIAELVNLNPPMKPANS

SEQ ID NO: 3207818 - protein, 17 aa, Giardia lamblia
EHRSPPYRTMALSRPST

SEQ ID NO: 3207819 - protein, 24 aa, Giardia lamblia
EISSLLMPVSFLKRDRAAVPRGTV

SEQ ID NO: 3207820 - protein, 20 aa, Giardia lamblia
ELATLRKPDFLGGREPEDVF

SEQ ID NO: 3207821 - protein, 18 aa, Giardia lamblia
ELHDAKYRLVYCRSDLEE

SEQ ID NO: 3207822 - protein, 26 aa, Giardia lamblia
ELLHEFNFNVVVLKKLFAVAIPKHLA

SEQ ID NO: 3207823 - protein, 32 aa, Giardia lamblia
ELPKALSVSLPQFHFYLLKPQHKLDRGTSTTK

SEQ ID NO: 3207824 - protein, 20 aa, Giardia lamblia
ELSKIILVSQFRAGADISDI

SEQ ID NO: 3207825 - protein, 23 aa, Giardia lamblia
ENGMTLYHYAYEQVLRPSEDYNG

SEQ ID NO: 3207826 - protein, 46 aa, Giardia lamblia
ENIVGYYCSFVHQQYLWLVTPILEVNIQDLLLKLAPNGFDEGVISC

SEQ ID NO: 3207827 - protein, 23 aa, Giardia lamblia
ENQKRVQFPRQLDWRVRGVITPV

SEQ ID NO: 3207828 - protein, 30 aa, Giardia lamblia
ENSEEFLDTALLKHVILKYSGFVGFPVNLE

SEQ ID NO: 3207829 - protein, 18 aa, Giardia lamblia
ENVSQWFTSIPATNWIIP

SEQ ID NO: 3207830 - protein, 19 aa, Giardia lamblia
ENVSQWFTSIPATNWIIPS

SEQ ID NO: 3207831 - protein, 18 aa, Giardia lamblia
EPICAVLTRYLPTYDAFG

SEQ ID NO: 3207832 - protein, 22 aa, Giardia lamblia
EPPLGLGPAFQDAIFKTIRTQH

SEQ ID NO: 3207833 - protein, 27 aa, Giardia lamblia
EPSNVCGLIIYRATFLSPTTISGSSYD

SEQ ID NO: 3207834 - protein, 17 aa, Giardia lamblia
EQCKVLYAHYGNLAKDI

SEQ ID NO: 3207835 - protein, 17 aa, Giardia lamblia
EQIQKLRRPVKLPNYSA

SEQ ID NO: 3207836 - protein, 19 aa, Giardia lamblia
EQKLLVYQKLLDHVTRQRD

SEQ ID NO: 3207837 - protein, 19 aa, Giardia lamblia
EQTAIKHHLFGLYAPFQEE

SEQ ID NO: 3207838 - protein, 26 aa, Giardia lamblia
ERFIIADFGLCKDALWSESTLIGIMA

SEQ ID NO: 3207839 - protein, 23 aa, Giardia lamblia
ERVVAAPDRLVGRHLAVVLDPVL

SEQ ID NO: 3207840 - protein, 20 aa, Giardia lamblia
ESCVCDPGYVLIGTAECTPA

SEQ ID NO: 3207841 - protein, 29 aa, Giardia lamblia
ESEPLLKYLVLNKYFPFVNGILIDPGVCL

SEQ ID NO: 3207842 - protein, 29 aa, Giardia lamblia
ESEPLLKYLVLNKYLPFVNSILIDPGVCL

SEQ ID NO: 3207843 - protein, 17 aa, Giardia lamblia
ESIAWDFIATTGIPLES

SEQ ID NO: 3207844 - protein, 24 aa, Giardia lamblia
ESIRTNPILYMQKVRRVLKKNIFE

SEQ ID NO: 3207845 - protein, 27 aa, Giardia lamblia
ESRIGLAAFFALLPDPAVLSLTESDLY

SEQ ID NO: 3207846 - protein, 19 aa, Giardia lamblia
ESVALRFAAPLQVPCKLMD

SEQ ID NO: 3207847 - protein, 20 aa, Giardia lamblia
ESVTLRFAAPLQVPCKLMDG

SEQ ID NO: 3207848 - protein, 25 aa, Giardia lamblia
ETLIKDTVLQLLFNTIFNSIKQSML

SEQ ID NO: 3207849 - protein, 36 aa, Giardia lamblia
ETLVCNGLGRCMIMPFPNIHYVCSCYPYDGTFYNNT

SEQ ID NO: 3207850 - protein, 34 aa, Giardia lamblia
ETPSLTRFFLSTALERFAPIRLSTLQDLISSLEI

SEQ ID NO: 3207851 - protein, 24 aa, Giardia lamblia
ETRRDPLLTSSGLMRSTRLDRSIR

SEQ ID NO: 3207852 - protein, 17 aa, Giardia lamblia
EVAYYQPAPLINSLRSE

SEQ ID NO: 3207853 - protein, 17 aa, Giardia lamblia
EVFVDGSCFPRSCVVEN

SEQ ID NO: 3207854 - protein, 24 aa, Giardia lamblia
EVIDPYLEMIRATALYNFGSSEPR

SEQ ID NO: 3207855 - protein, 26 aa, Giardia lamblia
EVMRELVSFFRWLLLDEEGSIEPSVN

SEQ ID NO: 3207856 - protein, 26 aa, Giardia lamblia
EVREMVDLYYDKYLRNFVVALADRSV

SEQ ID NO: 3207857 - protein, 17 aa, Giardia lamblia
FAWAVSCPEDEVLIDDQ

SEQ ID NO: 3207858 - protein, 26 aa, Giardia lamblia
FCTECAGGFYLLISEDRTQTSCVVSC

SEQ ID NO: 3207859 - protein, 32 aa, Giardia lamblia
FCVLTKMSTGMPLPIFWKVYRAVEGSDAAFRV

SEQ ID NO: 3207860 - protein, 27 aa, Giardia lamblia
FDRESFNSYLYIWHTKYDKFKADGLTV

SEQ ID NO: 3207861 - protein, 25 aa, Giardia lamblia
FDRRLLDHFIAIFKKKNNIDLSITN

SEQ ID NO: 3207862 - protein, 18 aa, Giardia lamblia
FEENLQYERPRSGVTALM

SEQ ID NO: 3207863 - protein, 18 aa, Giardia lamblia
FFTAEKFVLRGWHFSDCT

SEQ ID NO: 3207864 - protein, 18 aa, Giardia lamblia
FFVIPDNCRFFIKETKQD

SEQ ID NO: 3207865 - protein, 25 aa, Giardia lamblia
FGKRYRLQIFRQRYGYWGLRTLDYI

SEQ ID NO: 3207866 - protein, 22 aa, Giardia lamblia
FGRISYEGIIFRGVTMPGDVGV

SEQ ID NO: 3207867 - protein, 22 aa, Giardia lamblia
FHVIGSAFLYHQVRYMASMLIH

SEQ ID NO: 3207868 - protein, 26 aa, Giardia lamblia
FIEDVHALYIFFHHSISPSTVSLFCK

SEQ ID NO: 3207869 - protein, 19 aa, Giardia lamblia
FIVTNGERISWLKSSEWKV

SEQ ID NO: 3207870 - protein, 25 aa, Giardia lamblia
FIVTRGLDVLPPVFTLVHKSHFYTY

SEQ ID NO: 3207871 - protein, 19 aa, Giardia lamblia
FIWFCKSFAAAADLVISMD

SEQ ID NO: 3207872 - protein, 23 aa, Giardia lamblia
FKGEHFFGFLKAKEWKLTAVREG

SEQ ID NO: 3207873 - protein, 19 aa, Giardia lamblia
FKGLLLTAEIYPWKIPVGA

SEQ ID NO: 3207874 - protein, 31 aa, Giardia lamblia
FLDSKRQSCVPPIFKFSSPILRKWQTERQSI

SEQ ID NO: 3207875 - protein, 23 aa, Giardia lamblia
FLRKEMLVVLLATATLASYADRY

SEQ ID NO: 3207876 - protein, 17 aa, Giardia lamblia
FLVWQKDIIKVFRSFDP

SEQ ID NO: 3207877 - protein, 30 aa, Giardia lamblia
FMGTLPAPISPIWRAGPIKHVSGISSLELA

SEQ ID NO: 3207878 - protein, 18 aa, Giardia lamblia
FPGWYKQLDFDSGGLFAY

SEQ ID NO: 3207879 - protein, 34 aa, Giardia lamblia
FPQYRKKFLPSTLFIKTLLVPPNRQRPSLMLNQA

SEQ ID NO: 3207880 - protein, 26 aa, Giardia lamblia
FRQKYGDFFPRRFVQEAFYIRSTNYE

SEQ ID NO: 3207881 - protein, 25 aa, Giardia lamblia
FSDAGIGFYAWGLDFTTISTPKLSL

SEQ ID NO: 3207882 - protein, 17 aa, Giardia lamblia
FSMIVAIPDWSVRALYP

SEQ ID NO: 3207883 - protein, 17 aa, Giardia lamblia
FSSLPEMLSQFLETAFG

SEQ ID NO: 3207884 - protein, 17 aa, Giardia lamblia
FTCTCEDGYIAMGHNCV

SEQ ID NO: 3207885 - protein, 25 aa, Giardia lamblia
FTEHNFIDLFATDLGLRACAIALGL

SEQ ID NO: 3207886 - protein, 24 aa, Giardia lamblia
FTGEPPYVACLKAGFLVAAERTKE

SEQ ID NO: 3207887 - protein, 27 aa, Giardia lamblia
FTLFVGLFLVLSPLLSDGLWGNDGGDA

SEQ ID NO: 3207888 - protein, 27 aa, Giardia lamblia
FVRTACLVLLAYLRTKHDRLEITVRTS

SEQ ID NO: 3207889 - protein, 17 aa, Giardia lamblia
FYLPEFKQESVLSKYST

SEQ ID NO: 3207890 - protein, 19 aa, Giardia lamblia
FYVHEDFLYYVGGIYHKVY

SEQ ID NO: 3207891 - protein, 21 aa, Giardia lamblia
GAAVLPTLLRTLMPGEKSITI

SEQ ID NO: 3207892 - protein, 18 aa, Giardia lamblia
GALLSSASPRRPLIRSSS

SEQ ID NO: 3207893 - protein, 24 aa, Giardia lamblia
GALNVSLQFMRWQRTMMTCAYVAH

SEQ ID NO: 3207894 - protein, 28 aa, Giardia lamblia
GALPADIGCFPLLRSLYLNNNDLAGPIP

SEQ ID NO: 3207895 - protein, 19 aa, Giardia lamblia
GAVAYELATLRKPDFLGGR

SEQ ID NO: 3207896 - protein, 19 aa, Giardia lamblia
GCLTYLKTLYLSNNSLAGA

SEQ ID NO: 3207897 - protein, 23 aa, Giardia lamblia
GCWRLLDHWVINTVEQLFKNTTL

SEQ ID NO: 3207898 - protein, 17 aa, Giardia lamblia
GDCFLLSCDVILDQVYC

SEQ ID NO: 3207899 - protein, 24 aa, Giardia lamblia
GDLLIEVQVLLPPLDNLKGSSRED

SEQ ID NO: 3207900 - protein, 26 aa, Giardia lamblia
GELGDGELLVVRLLGRDDGRVRAERE

SEQ ID NO: 3207901 - protein, 19 aa, Giardia lamblia
GEYHCRCPDMLLPSTESAR

SEQ ID NO: 3207902 - protein, 19 aa, Giardia lamblia
GFGTCIYQYKKASYCVCDD

SEQ ID NO: 3207903 - protein, 25 aa, Giardia lamblia
GFIKSVLERIFVLDPAERPTAKELG

SEQ ID NO: 3207904 - protein, 17 aa, Giardia lamblia
GFPVYFDGIFYITAQKD

SEQ ID NO: 3207905 - protein, 17 aa, Giardia lamblia
GFSIYLRYFTDVATDGL

SEQ ID NO: 3207906 - protein, 17 aa, Giardia lamblia
GFYSIIKALTQRRKSCP

SEQ ID NO: 3207907 - protein, 24 aa, Giardia lamblia
GGDFQPTWSFLTFTGATTAECVKY

SEQ ID NO: 3207908 - protein, 28 aa, Giardia lamblia
GGEADFRALIFVPGFPSLNYYEKYHDER

SEQ ID NO: 3207909 - protein, 20 aa, Giardia lamblia
GHDHLDCVKLLLEKERDIGG

SEQ ID NO: 3207910 - protein, 19 aa, Giardia lamblia
GHSFPLVPSRYLTFKCGWY

SEQ ID NO: 3207911 - protein, 34 aa, Giardia lamblia
GIALFQSLQLRGVPSRFIYFPTQSHWVWQPQESV

SEQ ID NO: 3207912 - protein, 32 aa, Giardia lamblia
GICMSYNWSYLCRCDPLDAITLGPFTCVSNNC

SEQ ID NO: 3207913 - protein, 20 aa, Giardia lamblia
GIFFLALFALCLADSVLTPH

SEQ ID NO: 3207914 - protein, 29 aa, Giardia lamblia
GIKAYPSLFMFYQNTWYPYVGAFTGTYLE

SEQ ID NO: 3207915 - protein, 20 aa, Giardia lamblia
GILDNLYSVLLKDLGTANKH

SEQ ID NO: 3207916 - protein, 25 aa, Giardia lamblia
GKCIRYDVSPYPDDFIYMCECDVGY

SEQ ID NO: 3207917 - protein, 23 aa, Giardia lamblia
GKPLYEPILLYRNDAAGGIEPMD

SEQ ID NO: 3207918 - protein, 20 aa, Giardia lamblia
GKPMMVKFFAPWCGHCKALA

SEQ ID NO: 3207919 - protein, 24 aa, Giardia lamblia
GLGADLLVVLLEGGEVLAGLGELA

SEQ ID NO: 3207920 - protein, 27 aa, Giardia lamblia
GLKEHQLFDCVLLLEIVYTLIKSEDMP

SEQ ID NO: 3207921 - protein, 29 aa, Giardia lamblia
GLLHDEAVFYLIYMGLGLPLQLPHTHGEP

SEQ ID NO: 3207922 - protein, 30 aa, Giardia lamblia
GLSFDSAYFKLLAYTKFIRSLVAPGSAVGV

SEQ ID NO: 3207923 - protein, 25 aa, Giardia lamblia
GMGDQGLDFRYLPGDLIYVIRERKH

SEQ ID NO: 3207924 - protein, 27 aa, Giardia lamblia
GMLNNIQWSAIAYLIQNNYFEGLQYLL

SEQ ID NO: 3207925 - protein, 17 aa, Giardia lamblia
GMYLNGTVFDTSRKRSF

SEQ ID NO: 3207926 - protein, 23 aa, Giardia lamblia
GNGVCMYGLDDEPYCQCLESYAG

SEQ ID NO: 3207927 - protein, 32 aa, Giardia lamblia
GNNLKYKLVINLYEAFFGFSKRIIHLDDRAIE

SEQ ID NO: 3207928 - protein, 20 aa, Giardia lamblia
GPLYGLSWSCRTDMPMRLAI

SEQ ID NO: 3207929 - protein, 33 aa, Giardia lamblia
GQAFSYLRAEIHNRKLYVMFEQLLACDPKTDHE

SEQ ID NO: 3207930 - protein, 33 aa, Giardia lamblia
GQPRGVARRALLPRTQPIFWPESRTLGLGRRTG

SEQ ID NO: 3207931 - protein, 21 aa, Giardia lamblia
GRGRCLLKDPGLAGLSADDYA

SEQ ID NO: 3207932 - protein, 22 aa, Giardia lamblia
GRIAQTLKRALAVERENLRLEA

SEQ ID NO: 3207933 - protein, 17 aa, Giardia lamblia
GRTALVYALFGQHKDVV

SEQ ID NO: 3207934 - protein, 24 aa, Giardia lamblia
GSDAAFRVIRLLVTFILTVENQVQ

SEQ ID NO: 3207935 - protein, 25 aa, Giardia lamblia
GSSNLLVYQYSISFRKIFESVLRTR

SEQ ID NO: 3207936 - protein, 20 aa, Giardia lamblia
GTIVDLCRVALQTKAPSLCL

SEQ ID NO: 3207937 - protein, 18 aa, Giardia lamblia
GVCQPWSCIDERNPDALS

SEQ ID NO: 3207938 - protein, 24 aa, Giardia lamblia
GVDADEWFLVPSIDLMTLVDANTN

SEQ ID NO: 3207939 - protein, 23 aa, Giardia lamblia
GVDGLMLIGTLKKNLKQEVDAHQ

SEQ ID NO: 3207940 - protein, 19 aa, Giardia lamblia
GVGVCPLRGAALRSALDEP

SEQ ID NO: 3207941 - protein, 22 aa, Giardia lamblia
GVVRAFCQCSPGYALYNNTLCV

SEQ ID NO: 3207942 - protein, 25 aa, Giardia lamblia
GWPDKVLYFLRDLCAYPVVLSVGVA

SEQ ID NO: 3207943 - protein, 18 aa, Giardia lamblia
GYALIPDIISAMPSLQVP

SEQ ID NO: 3207944 - protein, 21 aa, Giardia lamblia
GYSIFSLLEHSANPQVQMLLQ

SEQ ID NO: 3207945 - protein, 33 aa, Giardia lamblia
GYVIDRFLTGIRPSSFFFHCQAGREGLIDTAIK

SEQ ID NO: 3207946 - protein, 26 aa, Giardia lamblia
GYVYIACGGYIYSLLYVYTDLSLSED

SEQ ID NO: 3207947 - protein, 19 aa, Giardia lamblia
GYWGLRTLDYIPKGAPVCE

SEQ ID NO: 3207948 - protein, 25 aa, Giardia lamblia
HADSIRAAFPLPSPHAADHFAPVLT

SEQ ID NO: 3207949 - protein, 21 aa, Giardia lamblia
HAGRYIFISSPQGLLPMPNRC

SEQ ID NO: 3207950 - protein, 36 aa, Giardia lamblia
HAGYVELPVYCYNHFFFRYTLQLYKLVCHSCHRFLI

SEQ ID NO: 3207951 - protein, 17 aa, Giardia lamblia
HAKENGQLFFLPDVSLD

SEQ ID NO: 3207952 - protein, 23 aa, Giardia lamblia
HAPFNSLALMRIQTLYEGICKAD

SEQ ID NO: 3207953 - protein, 31 aa, Giardia lamblia
HDKPCQTYYIIMPFYRFYDLGTQICKKIEEG

SEQ ID NO: 3207954 - protein, 20 aa, Giardia lamblia
HDSYPWKKLAPAKNRIRMLE

SEQ ID NO: 3207955 - protein, 19 aa, Giardia lamblia
HEFAPFLVAPFDKIILLGD

SEQ ID NO: 3207956 - protein, 21 aa, Giardia lamblia
HELGAPWIGVPISVLCGCSGT

SEQ ID NO: 3207957 - protein, 18 aa, Giardia lamblia
HFCQCRRGWAGAACDAPR

SEQ ID NO: 3207958 - protein, 23 aa, Giardia lamblia
HGISEVYLFIGSAEWEWDAYFSN

SEQ ID NO: 3207959 - protein, 25 aa, Giardia lamblia
HGTCDYLTGMCSCNYQYSGKHCDLC

SEQ ID NO: 3207960 - protein, 18 aa, Giardia lamblia
HHAARHVLAVAGVALDHH

SEQ ID NO: 3207961 - protein, 19 aa, Giardia lamblia
HHDRPPIALALSRPWEEGR

SEQ ID NO: 3207962 - protein, 29 aa, Giardia lamblia
HHIALSLSLYSIHYLSHAFPLHRNHQHKK

SEQ ID NO: 3207963 - protein, 18 aa, Giardia lamblia
HIALSLSLYSIHYLSHAF

SEQ ID NO: 3207964 - protein, 17 aa, Giardia lamblia
HPLIILAGSTELSFLDH

SEQ ID NO: 3207965 - protein, 21 aa, Giardia lamblia
HPNIKNFWRIVAELTQEQQRR

SEQ ID NO: 3207966 - protein, 35 aa, Giardia lamblia
HPPSIPIMVGGTHYFFLFFLSQPGTKDLLCSIGLQ

SEQ ID NO: 3207967 - protein, 20 aa, Giardia lamblia
HPSAIVIAAIRRNPVHVDLT

SEQ ID NO: 3207968 - protein, 17 aa, Giardia lamblia
HSSNYILDVLLPSNEHV

SEQ ID NO: 3207969 - protein, 17 aa, Giardia lamblia
HSWLQLNSNFRNAIHQV

SEQ ID NO: 3207970 - protein, 17 aa, Giardia lamblia
HVLAVAGVALDHHVRRL

SEQ ID NO: 3207971 - protein, 19 aa, Giardia lamblia
HYFIADTMLMCFQYGKSKS

SEQ ID NO: 3207972 - protein, 18 aa, Giardia lamblia
ICRYKDRQAVPRVVKEPQ

SEQ ID NO: 3207973 - protein, 20 aa, Giardia lamblia
IDGALVHSFFFRPHNNFDTS

SEQ ID NO: 3207974 - protein, 21 aa, Giardia lamblia
IEANELIYVSLAPGSGPAPSK

SEQ ID NO: 3207975 - protein, 27 aa, Giardia lamblia
IEFERRCHVTFSPAFWNGTEVFANGYK

SEQ ID NO: 3207976 - protein, 23 aa, Giardia lamblia
IEGRTCFQWVIVGGSYPGAVTGW

SEQ ID NO: 3207977 - protein, 25 aa, Giardia lamblia
IEIWSLGCIVYEMCLLHSLFRGTCE

SEQ ID NO: 3207978 - protein, 19 aa, Giardia lamblia
IESSEDLTFMPFCIGINLP

SEQ ID NO: 3207979 - protein, 17 aa, Giardia lamblia
IFILQLITASTASGSVD

SEQ ID NO: 3207980 - protein, 17 aa, Giardia lamblia
IFLTDVNEDLLLSTYLN

SEQ ID NO: 3207981 - protein, 17 aa, Giardia lamblia
IFNLHIIGRVYVIGSNA

SEQ ID NO: 3207982 - protein, 26 aa, Giardia lamblia
IFSRHRGRGLLRRYPGRYAIVLGATG

SEQ ID NO: 3207983 - protein, 29 aa, Giardia lamblia
IFTEEVVIKLMLLIGFFDDPDKGEFVGID

SEQ ID NO: 3207984 - protein, 32 aa, Giardia lamblia
IFTSADVSLFLLLGLPIPTLKPMDFSSLPEML

SEQ ID NO: 3207985 - protein, 17 aa, Giardia lamblia
IGCNFYLPEFKQESVLS

SEQ ID NO: 3207986 - protein, 26 aa, Giardia lamblia
IGGIFLCSMGTFLDFGSLCEYIMVAT

SEQ ID NO: 3207987 - protein, 17 aa, Giardia lamblia
IGITESLLFYSGGVYND

SEQ ID NO: 3207988 - protein, 22 aa, Giardia lamblia
IGSTSMILGLMSTPRGVQDLGK

SEQ ID NO: 3207989 - protein, 17 aa, Giardia lamblia
IHEYHGIALFQSLQLRG

SEQ ID NO: 3207990 - protein, 24 aa, Giardia lamblia
IIHQVLCSSPLPRKPRLALPAAGV

SEQ ID NO: 3207991 - protein, 27 aa, Giardia lamblia
IITVPDWSVRALYPNKITSPPPKTVYT

SEQ ID NO: 3207992 - protein, 18 aa, Giardia lamblia
IKHHLFGLYAPFQEEDGS

SEQ ID NO: 3207993 - protein, 25 aa, Giardia lamblia
ILADQDLDLFYYYSNTLLSHIPRDY

SEQ ID NO: 3207994 - protein, 17 aa, Giardia lamblia
ILLYEKVGSKSYLRHTF

SEQ ID NO: 3207995 - protein, 21 aa, Giardia lamblia
ILRDSLAEELGLTASMRVLPE

SEQ ID NO: 3207996 - protein, 18 aa, Giardia lamblia
ILYTKDVIRRLKRAKIDC

SEQ ID NO: 3207997 - protein, 19 aa, Giardia lamblia
IMYDILQALSYMEQNRQVH

SEQ ID NO: 3207998 - protein, 22 aa, Giardia lamblia
INRLFKLVVCLVFGLNPGIEQI

SEQ ID NO: 3207999 - protein, 20 aa, Giardia lamblia
IPALRMYAKKQWFAYKPSMD

SEQ ID NO: 3208000 - protein, 21 aa, Giardia lamblia
IPPGLTLPEISAIRGAIEAVP

SEQ ID NO: 3208001 - protein, 24 aa, Giardia lamblia
IPSDQTRPQLFYIPNRPTTEESEH

SEQ ID NO: 3208002 - protein, 29 aa, Giardia lamblia
IPSVALSPLRSPWKFAEEKKFYSGNPMSS

SEQ ID NO: 3208003 - protein, 17 aa, Giardia lamblia
IQKLRRPVKLPNYSAQL

SEQ ID NO: 3208004 - protein, 28 aa, Giardia lamblia
IQVYHGISLFQALRLRGIKTKLVYFPTQ

SEQ ID NO: 3208005 - protein, 25 aa, Giardia lamblia
ISALPAFPEIPITVGILQITLSNIR

SEQ ID NO: 3208006 - protein, 17 aa, Giardia lamblia
ISELTRASSLSVTDFRE

SEQ ID NO: 3208007 - protein, 18 aa, Giardia lamblia
ISFLPISVSNLKVSPKGN

SEQ ID NO: 3208008 - protein, 29 aa, Giardia lamblia
ISKTCITTSPFLKSDFRIICSGHGVCEID

SEQ ID NO: 3208009 - protein, 18 aa, Giardia lamblia
ISRIWEALYLSEGERRYA

SEQ ID NO: 3208010 - protein, 19 aa, Giardia lamblia
ITCFIVHDGIFDLTSFGLD

SEQ ID NO: 3208011 - protein, 26 aa, Giardia lamblia
ITQRRNIIRFLKAMEQYIKAFHLSYI

SEQ ID NO: 3208012 - protein, 26 aa, Giardia lamblia
ITVPDWSVRALYPNKITSPPPKTVYT

SEQ ID NO: 3208013 - protein, 27 aa, Giardia lamblia
IVNTKGTWRWEAYSMWPHLGRTNATSM

SEQ ID NO: 3208014 - protein, 20 aa, Giardia lamblia
IWEALYLSEGERRYAWNVLK

SEQ ID NO: 3208015 - protein, 18 aa, Giardia lamblia
IYKCKATFRAPYGNNTQH

SEQ ID NO: 3208016 - protein, 25 aa, Giardia lamblia
KAIMEALIKRVIIIGILTGIVGTSN

SEQ ID NO: 3208017 - protein, 17 aa, Giardia lamblia
KAIYLPETSKHNKDTLF

SEQ ID NO: 3208018 - protein, 17 aa, Giardia lamblia
KALIPLQGGMKMKGCAL

SEQ ID NO: 3208019 - protein, 24 aa, Giardia lamblia
KAPSLCLLLSRFYHAESRIGLAAF

SEQ ID NO: 3208020 - protein, 29 aa, Giardia lamblia
KAQNHLSYAKTLFQLLRSISDVNLEDITQ

SEQ ID NO: 3208021 - protein, 24 aa, Giardia lamblia
KCIPNSCISATFDYGYPELCSNKG

SEQ ID NO: 3208022 - protein, 25 aa, Giardia lamblia
KDAEIKMLALVFAALALAETIIGID

SEQ ID NO: 3208023 - protein, 19 aa, Giardia lamblia
KDFLKEWVFPDIDKLIEVA

SEQ ID NO: 3208024 - protein, 25 aa, Giardia lamblia
KDQFAQILLTFDQWDKLTLGELRSC

SEQ ID NO: 3208025 - protein, 20 aa, Giardia lamblia
KDTVLQFLLDTIFKSIKQSM

SEQ ID NO: 3208026 - protein, 19 aa, Giardia lamblia
KDYILHYGKPLLYVNEVVP

SEQ ID NO: 3208027 - protein, 23 aa, Giardia lamblia
KEEVRLWFSLSWSTHTFCSWITV

SEQ ID NO: 3208028 - protein, 34 aa, Giardia lamblia
KEKRLRAFMELFGMIRAFYMLDYKRIRIDDFLYS

SEQ ID NO: 3208029 - protein, 17 aa, Giardia lamblia
KEMAPPLTWIHFRGEGG

SEQ ID NO: 3208030 - protein, 18 aa, Giardia lamblia
KFIVINTGLYNSLQKREE

SEQ ID NO: 3208031 - protein, 18 aa, Giardia lamblia
KFTKRKLADYKGKYLIIF

SEQ ID NO: 3208032 - protein, 24 aa, Giardia lamblia
KFVASHRYAFLPLLGQDNAAALIH

SEQ ID NO: 3208033 - protein, 23 aa, Giardia lamblia
KFVLRGWHFSDCTALMLGAAHGS

SEQ ID NO: 3208034 - protein, 18 aa, Giardia lamblia
KGCTFSDTLFKLYNDHII

SEQ ID NO: 3208035 - protein, 19 aa, Giardia lamblia
KGICIIAADTHPIYVFAHL

SEQ ID NO: 3208036 - protein, 20 aa, Giardia lamblia
KGRSIYWPDLCRPHAARNSS

SEQ ID NO: 3208037 - protein, 29 aa, Giardia lamblia
KHAISKLFTFCSYPFLLNPQTKLNILLYE

SEQ ID NO: 3208038 - protein, 24 aa, Giardia lamblia
KHKNLFVKFYAPWCGHCKKLAPTW

SEQ ID NO: 3208039 - protein, 28 aa, Giardia lamblia
KHSDAFRQWWWQTCTEVAYYQPAPLINS

SEQ ID NO: 3208040 - protein, 23 aa, Giardia lamblia
KIYGCRLRVILGLKKEYVDLTHQ

SEQ ID NO: 3208041 - protein, 27 aa, Giardia lamblia
KKMSQHRLLLFLRFLDSFVSDFVSQAN

SEQ ID NO: 3208042 - protein, 27 aa, Giardia lamblia
KKNKEEIMHLLLFPTTRTMVNSPEVQE

SEQ ID NO: 3208043 - protein, 23 aa, Giardia lamblia
KLISKRPLPQFNTTGIVEAVVES

SEQ ID NO: 3208044 - protein, 17 aa, Giardia lamblia
KLTENALAVFIIDTLRG

SEQ ID NO: 3208045 - protein, 21 aa, Giardia lamblia
KLVKYLKAIYLPETSKHNKDT

SEQ ID NO: 3208046 - protein, 20 aa, Giardia lamblia
KLYIDRFIPDMFYDGRYLSD

SEQ ID NO: 3208047 - protein, 17 aa, Giardia lamblia
KPLVYIGRILHLTNYPQ

SEQ ID NO: 3208048 - protein, 23 aa, Giardia lamblia
KRCKFRYLDKTRLYLPDISCGSS

SEQ ID NO: 3208049 - protein, 17 aa, Giardia lamblia
KRLLILSELCGAGSLWS

SEQ ID NO: 3208050 - protein, 29 aa, Giardia lamblia
KSFPDQYVHSWYFAPANLRDSHEYPLILY

SEQ ID NO: 3208051 - protein, 25 aa, Giardia lamblia
KSGVYQHRWGLWLGGHAVEIIGYGV

SEQ ID NO: 3208052 - protein, 32 aa, Giardia lamblia
KSKLREKFTRLVGVVLLHVLALAVAKGLGADL

SEQ ID NO: 3208053 - protein, 30 aa, Giardia lamblia
KTEGWGTYTPMRALYLALQNDPDVWSVFHS

SEQ ID NO: 3208054 - protein, 21 aa, Giardia lamblia
KTIKLWMSGGFSFGAPAQASS

SEQ ID NO: 3208055 - protein, 21 aa, Giardia lamblia
KTQVYAIVEAVFRQLVLLRAT

SEQ ID NO: 3208056 - protein, 24 aa, Giardia lamblia
KTRIVAILYSVWPEAAEFLIKCAL

SEQ ID NO: 3208057 - protein, 19 aa, Giardia lamblia
KVDFRLYVGLFFNAQERSY

SEQ ID NO: 3208058 - protein, 28 aa, Giardia lamblia
KVGTLEAYLFQPFKEYWKSVARARVKAL

SEQ ID NO: 3208059 - protein, 21 aa, Giardia lamblia
KVHHLNSRIITLTATVASLQT

SEQ ID NO: 3208060 - protein, 25 aa, Giardia lamblia
KVSALKFEYIWTYPTRSRYVNCISA

SEQ ID NO: 3208061 - protein, 20 aa, Giardia lamblia
KYLRNFVVALADRSVSANTR

SEQ ID NO: 3208062 - protein, 22 aa, Giardia lamblia
KYPGWSALVFAAAVCSLRCTRI

SEQ ID NO: 3208063 - protein, 17 aa, Giardia lamblia
LAATLLDLKVGPLPSLP

SEQ ID NO: 3208064 - protein, 30 aa, Giardia lamblia
LADCGLGLFSCLQLCKILTSSSIRIKSLDI

SEQ ID NO: 3208065 - protein, 25 aa, Giardia lamblia
LADIATFLAYLKREYNLPEGTKIVA

SEQ ID NO: 3208066 - protein, 29 aa, Giardia lamblia
LADYKGKYLIIFFYPADFTFVCPSEIIHF

SEQ ID NO: 3208067 - protein, 26 aa, Giardia lamblia
LAESTRLREELREKDLLISELRSQSP

SEQ ID NO: 3208068 - protein, 28 aa, Giardia lamblia
LAFHLNRVLPSQIRVLGLSTAIPKDFSA

SEQ ID NO: 3208069 - protein, 23 aa, Giardia lamblia
LAGLGELALLHALTDVPVHEGAL

SEQ ID NO: 3208070 - protein, 24 aa, Giardia lamblia
LAHIKCIVPLRESFGSYIADRNYS

SEQ ID NO: 3208071 - protein, 25 aa, Giardia lamblia
LAIESFLHRIPGLSEFYVYLNDDCL

SEQ ID NO: 3208072 - protein, 24 aa, Giardia lamblia
LARSVLERMLVLDLAERPTARGLA

SEQ ID NO: 3208073 - protein, 17 aa, Giardia lamblia
LAYRLRSDSKRIAMLTG

SEQ ID NO: 3208074 - protein, 22 aa, Giardia lamblia
LCALTSMQYLQINNAGLTGDIP

SEQ ID NO: 3208075 - protein, 18 aa, Giardia lamblia
LCKVMARTSLRLSSLCLN

SEQ ID NO: 3208076 - protein, 17 aa, Giardia lamblia
LCSTYSVATPTGECVPL

SEQ ID NO: 3208077 - protein, 30 aa, Giardia lamblia
LDLAALPYRNLWLFFTKSLDYAKNPYILDI

SEQ ID NO: 3208078 - protein, 26 aa, Giardia lamblia
LDLAERPTARGLARLLRRLDISADEQ

SEQ ID NO: 3208079 - protein, 21 aa, Giardia lamblia
LDRLLYALLRTFLTGPNIAAA

SEQ ID NO: 3208080 - protein, 25 aa, Giardia lamblia
LDSIKTFERVIFSCFLEIDGQPYDC

SEQ ID NO: 3208081 - protein, 17 aa, Giardia lamblia
LDVLLPSNEHVNKWIRL

SEQ ID NO: 3208082 - protein, 18 aa, Giardia lamblia
LEKLRYISLTDAKVLGEG

SEQ ID NO: 3208083 - protein, 26 aa, Giardia lamblia
LENSKTMIVCLLVLLAVIGGKQLAAL

SEQ ID NO: 3208084 - protein, 24 aa, Giardia lamblia
LETDELFFPVRELGGFLLDEQVDN

SEQ ID NO: 3208085 - protein, 27 aa, Giardia lamblia
LETLRACDWLLRFGFSSTFVSDLRSGA

SEQ ID NO: 3208086 - protein, 18 aa, Giardia lamblia
LFALYLTTDTTPPQQDAS

SEQ ID NO: 3208087 - protein, 29 aa, Giardia lamblia
LFCSDAHVFMLLLLLFSTERYFNLSSHLL

SEQ ID NO: 3208088 - protein, 19 aa, Giardia lamblia
LFFFNFELIRGEVRSVYSD

SEQ ID NO: 3208089 - protein, 17 aa, Giardia lamblia
LFIENRVDHFNPFNQDV

SEQ ID NO: 3208090 - protein, 24 aa, Giardia lamblia
LGRRDACSRLLRKTAKGLGIYFNQ

SEQ ID NO: 3208091 - protein, 19 aa, Giardia lamblia
LGSDCIHPFCMVDYSVCSY

SEQ ID NO: 3208092 - protein, 27 aa, Giardia lamblia
LGTKYRYKYIHALRFAPKEFDPSFFRL

SEQ ID NO: 3208093 - protein, 19 aa, Giardia lamblia
LGVIIYELTTLRRPDFLGG

SEQ ID NO: 3208094 - protein, 20 aa, Giardia lamblia
LGVIIYELVTLRRPDFLGGK

SEQ ID NO: 3208095 - protein, 18 aa, Giardia lamblia
LGVILYELTTLRRLDFLG

SEQ ID NO: 3208096 - protein, 29 aa, Giardia lamblia
LGVPPNRYYRCLQPFFKNDTFIVSLVHTI

SEQ ID NO: 3208097 - protein, 17 aa, Giardia lamblia
LIHGLRYRSIGVETLDS

SEQ ID NO: 3208098 - protein, 17 aa, Giardia lamblia
LILNERDFYAILGVSKT

SEQ ID NO: 3208099 - protein, 18 aa, Giardia lamblia
LKAPKPVRVQHYPGELWF

SEQ ID NO: 3208100 - protein, 24 aa, Giardia lamblia
LKPPKILLRHTLPNDFVILNRQPT

SEQ ID NO: 3208101 - protein, 17 aa, Giardia lamblia
LKTLSKFAREIILNPKD

SEQ ID NO: 3208102 - protein, 18 aa, Giardia lamblia
LLCARPMRCCKKVDTQED

SEQ ID NO: 3208103 - protein, 19 aa, Giardia lamblia
LLCSIGLQPILLFCDAHAA

SEQ ID NO: 3208104 - protein, 22 aa, Giardia lamblia
LLEMNKTFVGILYDGHLISGRS

SEQ ID NO: 3208105 - protein, 27 aa, Giardia lamblia
LLFAESHMWHPFSPCIAMCLARDICIT

SEQ ID NO: 3208106 - protein, 21 aa, Giardia lamblia
LLLFTTVLLARISRLASERKS

SEQ ID NO: 3208107 - protein, 23 aa, Giardia lamblia
LLLLLVTFCTLTIKKFDEIKALT

SEQ ID NO: 3208108 - protein, 20 aa, Giardia lamblia
LLLMPLFVASVLVEACQTGK

SEQ ID NO: 3208109 - protein, 18 aa, Giardia lamblia
LLLYGTLGREPSPLREGD

SEQ ID NO: 3208110 - protein, 19 aa, Giardia lamblia
LLLYGTLGREPSPLWEGDD

SEQ ID NO: 3208111 - protein, 17 aa, Giardia lamblia
LLLYVTLSCLKPGPEYS

SEQ ID NO: 3208112 - protein, 26 aa, Giardia lamblia
LLNGTAAPKLAPYWAPEQLMNYSHSS

SEQ ID NO: 3208113 - protein, 17 aa, Giardia lamblia
LLTISALCPKELAYLID

SEQ ID NO: 3208114 - protein, 28 aa, Giardia lamblia
LMGKQTSLLALLLTLIAPSTLSQPRYNN

SEQ ID NO: 3208115 - protein, 18 aa, Giardia lamblia
LMLAALVDNLRAARLFFG

SEQ ID NO: 3208116 - protein, 18 aa, Giardia lamblia
LNCYFYCPIHCYHNPLGH

SEQ ID NO: 3208117 - protein, 32 aa, Giardia lamblia
LNEVETLHYWIKKNKPLWFNKIRCLSNSLLGY

SEQ ID NO: 3208118 - protein, 17 aa, Giardia lamblia
LNHLIWHVNFQDPSSSN

SEQ ID NO: 3208119 - protein, 21 aa, Giardia lamblia
LPRALIKPLVYIGRILHLTNY

SEQ ID NO: 3208120 - protein, 27 aa, Giardia lamblia
LPVLCEQNGIPYFFIKSKKALAEAAGT

SEQ ID NO: 3208121 - protein, 19 aa, Giardia lamblia
LQILAFDAIIDLGCGTYQV

SEQ ID NO: 3208122 - protein, 19 aa, Giardia lamblia
LQLPPLIQDLTIASSGALD

SEQ ID NO: 3208123 - protein, 20 aa, Giardia lamblia
LQTELPLAYERLLERIDALE

SEQ ID NO: 3208124 - protein, 17 aa, Giardia lamblia
LQTSIGLRFVTARGFPG

SEQ ID NO: 3208125 - protein, 17 aa, Giardia lamblia
LRHSGLYCEKPIDDLCP

SEQ ID NO: 3208126 - protein, 30 aa, Giardia lamblia
LRISSFNKHLLALIYALRSNILLVSINNKY

SEQ ID NO: 3208127 - protein, 18 aa, Giardia lamblia
LRIYSILRDSLSLDTTIE

SEQ ID NO: 3208128 - protein, 17 aa, Giardia lamblia
LRQPEFKGLLLTAEIYP

SEQ ID NO: 3208129 - protein, 20 aa, Giardia lamblia
LRRIQALNPPWKAGMPKRFE

SEQ ID NO: 3208130 - protein, 27 aa, Giardia lamblia
LRVFKIRGIEIPITALTFVCPHHPIWK

SEQ ID NO: 3208131 - protein, 23 aa, Giardia lamblia
LRVLLVAFLPVASMRPALSTMAH

SEQ ID NO: 3208132 - protein, 19 aa, Giardia lamblia
LSAIPSAFPPWGKPTVYDP

SEQ ID NO: 3208133 - protein, 17 aa, Giardia lamblia
LSCNPYMVKTYNIYSHP

SEQ ID NO: 3208134 - protein, 23 aa, Giardia lamblia
LSDLTNLTYLSSLYLSGNNLKDS

SEQ ID NO: 3208135 - protein, 17 aa, Giardia lamblia
LSGKPFPELLQFNQGDI

SEQ ID NO: 3208136 - protein, 17 aa, Giardia lamblia
LSKTQVYAIVEAVFRQL

SEQ ID NO: 3208137 - protein, 33 aa, Giardia lamblia
LSLAILLCLWLCKIFIIPLFTLSDRKASKRIRS

SEQ ID NO: 3208138 - protein, 22 aa, Giardia lamblia
LSLYSIHYLSHAFPLHRNHQQR

SEQ ID NO: 3208139 - protein, 18 aa, Giardia lamblia
LSPPHHIALSLSLYSIHY

SEQ ID NO: 3208140 - protein, 23 aa, Giardia lamblia
LSPSLWFLAIERSDRNTVRQNVN

SEQ ID NO: 3208141 - protein, 28 aa, Giardia lamblia
LSRQFPRLNIFALCEDGFLLINGSCVSK

SEQ ID NO: 3208142 - protein, 18 aa, Giardia lamblia
LSSASPRRPLIRSSSSAP

SEQ ID NO: 3208143 - protein, 17 aa, Giardia lamblia
LSSSTSLYALKISASSE

SEQ ID NO: 3208144 - protein, 17 aa, Giardia lamblia
LSSYPNPWHIPLHTLRA

SEQ ID NO: 3208145 - protein, 25 aa, Giardia lamblia
LTAEIYPWKIPVGALARAYMYGRST

SEQ ID NO: 3208146 - protein, 34 aa, Giardia lamblia
LTAYADFVGLRRIWNVLVPHALIPPLESCLASET

SEQ ID NO: 3208147 - protein, 25 aa, Giardia lamblia
LTFTQKKYPLLMADSSIREAVAEIA

SEQ ID NO: 3208148 - protein, 24 aa, Giardia lamblia
LTSCMTVALYSLVPRSIICWLIRH

SEQ ID NO: 3208149 - protein, 23 aa, Giardia lamblia
LTVHPDIEVPKYTRKDFYGADVP

SEQ ID NO: 3208150 - protein, 21 aa, Giardia lamblia
LVCDMHQIFSILRGTSHTSLA

SEQ ID NO: 3208151 - protein, 17 aa, Giardia lamblia
LVFVGAIGPFACSPVLP

SEQ ID NO: 3208152 - protein, 23 aa, Giardia lamblia
LVKDTVLQFLLDTIFKSIKQSML

SEQ ID NO: 3208153 - protein, 28 aa, Giardia lamblia
LVPSRYLTFKCGWYPPLPSSGSFYCSIR

SEQ ID NO: 3208154 - protein, 17 aa, Giardia lamblia
LVVLAKKSPEITDHVIF

SEQ ID NO: 3208155 - protein, 17 aa, Giardia lamblia
LWKGYQLLRTCTPAASK

SEQ ID NO: 3208156 - protein, 18 aa, Giardia lamblia
LWNLVYYDNGDTILIHGL

SEQ ID NO: 3208157 - protein, 17 aa, Giardia lamblia
LYASLVPTAYLSKVLRT

SEQ ID NO: 3208158 - protein, 24 aa, Giardia lamblia
LYDLTIEYGYTTPVLLFLDVNEQE

SEQ ID NO: 3208159 - protein, 19 aa, Giardia lamblia
LYGHNRCGWFLSNFGRLAT

SEQ ID NO: 3208160 - protein, 20 aa, Giardia lamblia
LYLQEKLQKMPAHNAALARA

SEQ ID NO: 3208161 - protein, 21 aa, Giardia lamblia
MACNGGWLPNVWKFLTKTGTT

SEQ ID NO: 3208162 - protein, 32 aa, Giardia lamblia
MAEISTISLIRYILNPVPLPNSSSTLSIFANE

SEQ ID NO: 3208163 - protein, 21 aa, Giardia lamblia
MAICLRKLIVLASQLVCSDSP

SEQ ID NO: 3208164 - protein, 18 aa, Giardia lamblia
MANFLVWQKDIIKVFRSF

SEQ ID NO: 3208165 - protein, 19 aa, Giardia lamblia
MAPETLLRGIITPASNIWS

SEQ ID NO: 3208166 - protein, 31 aa, Giardia lamblia
MDDPVPLLKRLLLDKYLPLVNPILAETGVAL

SEQ ID NO: 3208167 - protein, 17 aa, Giardia lamblia
MDKKESSLTLLIKEMET

SEQ ID NO: 3208168 - protein, 23 aa, Giardia lamblia
MELLVVPLHRWRGAPACCLQPPS

SEQ ID NO: 3208169 - protein, 24 aa, Giardia lamblia
MFTVYEDFTYYLEGIYSYTYGNRV

SEQ ID NO: 3208170 - protein, 27 aa, Giardia lamblia
MITLDYFLEMCYKAYFAPGATPPGAPS

SEQ ID NO: 3208171 - protein, 28 aa, Giardia lamblia
MIVAIPDWSVRALYPNKITSPPPKTVYT

SEQ ID NO: 3208172 - protein, 27 aa, Giardia lamblia
MLLAKVFITISWLRTACRARSLSALPL

SEQ ID NO: 3208173 - protein, 25 aa, Giardia lamblia
MLSCLTKLLIILRSPREIWVARGAN

SEQ ID NO: 3208174 - protein, 28 aa, Giardia lamblia
MMLTVYPPSISVALPYAIIPIAQLQSLR

SEQ ID NO: 3208175 - protein, 32 aa, Giardia lamblia
MNDPVPLLKRLLLDKYLPLVNPILAETGVALM

SEQ ID NO: 3208176 - protein, 23 aa, Giardia lamblia
MQRCSYLYDIVCVFKYCFSSSEK

SEQ ID NO: 3208177 - protein, 23 aa, Giardia lamblia
MSVYRDFLYYRGGVYKHVYGIQI

SEQ ID NO: 3208178 - protein, 19 aa, Giardia lamblia
MTILLYEKVGSKSYLRHTF

SEQ ID NO: 3208179 - protein, 34 aa, Giardia lamblia
MTPTPTALRLCRALLWPPGWPDLQLALHSPRHGG

SEQ ID NO: 3208180 - protein, 20 aa, Giardia lamblia
MVFAGYCAIPTCIQHPEQGV

SEQ ID NO: 3208181 - protein, 18 aa, Giardia lamblia
MYYKSGVYQHRWGLWLGG

SEQ ID NO: 3208182 - protein, 19 aa, Giardia lamblia
NALAVFIIDTLRGLAYLHD

SEQ ID NO: 3208183 - protein, 24 aa, Giardia lamblia
NASGIPLFMLPAISPNRYNNPGYR

SEQ ID NO: 3208184 - protein, 33 aa, Giardia lamblia
NDGRFNPLIMLPNDYLLYHLRGDVQPVALNTET

SEQ ID NO: 3208185 - protein, 20 aa, Giardia lamblia
NDLMKTITAMKLAMQIMDNE

SEQ ID NO: 3208186 - protein, 27 aa, Giardia lamblia
NDRRIMLGIILFNTHLHYIIVKDAARY

SEQ ID NO: 3208187 - protein, 17 aa, Giardia lamblia
NDSLRATQLEFLRSALG

SEQ ID NO: 3208188 - protein, 19 aa, Giardia lamblia
NEDLLLSTYLNEFRANSGK

SEQ ID NO: 3208189 - protein, 31 aa, Giardia lamblia
NEPKRKRIMLTISLFIALLCRCNDPVVSEVP

SEQ ID NO: 3208190 - protein, 24 aa, Giardia lamblia
NGDGLIRLKYPWAFDNEAVTKEAN

SEQ ID NO: 3208191 - protein, 21 aa, Giardia lamblia
NGICLCDDGFVLQGTFKCIPI

SEQ ID NO: 3208192 - protein, 21 aa, Giardia lamblia
NIVRELIVPWGWKKSDPHLTD

SEQ ID NO: 3208193 - protein, 18 aa, Giardia lamblia
NIYGILILDSYTLPIIGS

SEQ ID NO: 3208194 - protein, 26 aa, Giardia lamblia
NIYSHPGSILHILLEFCKYGSSQDML

SEQ ID NO: 3208195 - protein, 21 aa, Giardia lamblia
NKNLFGFSYDWRQPLYAECIK

SEQ ID NO: 3208196 - protein, 22 aa, Giardia lamblia
NKQVLGRFFSLDALANLVTSLC

SEQ ID NO: 3208197 - protein, 28 aa, Giardia lamblia
NLAAWARIQFPFIIDAAISSSGPYLAQT

SEQ ID NO: 3208198 - protein, 26 aa, Giardia lamblia
NLHKGHFGRMLIPNDFIFYSNMENLD

SEQ ID NO: 3208199 - protein, 33 aa, Giardia lamblia
NLLGSILLAGWYDIPEVGLFFAGKLYRGNRAQK

SEQ ID NO: 3208200 - protein, 19 aa, Giardia lamblia
NLLPYVAAILRYESEALRR

SEQ ID NO: 3208201 - protein, 20 aa, Giardia lamblia
NMVHMPFQYTLMSSIINFST

SEQ ID NO: 3208202 - protein, 27 aa, Giardia lamblia
NNLFGVLPTCIINFPLKVLSVPHNRLR

SEQ ID NO: 3208203 - protein, 24 aa, Giardia lamblia
NNNVDLIRLLLPFSTQEQIVQAQR

SEQ ID NO: 3208204 - protein, 36 aa, Giardia lamblia
NNVGSIHDFIPLLKFLLLNKYLPFANPILTETGIWR

SEQ ID NO: 3208205 - protein, 21 aa, Giardia lamblia
NNYNCFLKIFGETPHIMLTLS

SEQ ID NO: 3208206 - protein, 25 aa, Giardia lamblia
NPRTKVLPIILYATLRNQVQLAAQT

SEQ ID NO: 3208207 - protein, 25 aa, Giardia lamblia
NRDSLIFIVKPLALSRGRQIQLFRD

SEQ ID NO: 3208208 - protein, 26 aa, Giardia lamblia
NSEQRLLSWIETDLKPRASTTSRSLL

SEQ ID NO: 3208209 - protein, 23 aa, Giardia lamblia
NSFWDAMNVIVNGAPPLLKEDAG

SEQ ID NO: 3208210 - protein, 27 aa, Giardia lamblia
NSNLEPLATLFLDMIKLISEPSGAAST

SEQ ID NO: 3208211 - protein, 27 aa, Giardia lamblia
NTADPQSSLLLLPRLMRAAHTNGMETV

SEQ ID NO: 3208212 - protein, 24 aa, Giardia lamblia
NVPPELFQLAPYSLRVYILAEHSA

SEQ ID NO: 3208213 - protein, 18 aa, Giardia lamblia
NYCYCDDGYRLSNAGCTP

SEQ ID NO: 3208214 - protein, 21 aa, Giardia lamblia
NYDNCPTDYQYVLGYCVPNVC

SEQ ID NO: 3208215 - protein, 17 aa, Giardia lamblia
PASILALRQCGSSLYVV

SEQ ID NO: 3208216 - protein, 17 aa, Giardia lamblia
PDDEVLVPLTLSSYVKG

SEQ ID NO: 3208217 - protein, 26 aa, Giardia lamblia
PDLLKSGGIPLIIKLTQDSNKGAFFD

SEQ ID NO: 3208218 - protein, 28 aa, Giardia lamblia
PECMCDLIHLMFWYMSDNALTGSIPTCI

SEQ ID NO: 3208219 - protein, 24 aa, Giardia lamblia
PEVQKDMKLLPYKVINKDGRPFVQ

SEQ ID NO: 3208220 - protein, 19 aa, Giardia lamblia
PFLVAPFDKIILLGDILQL

SEQ ID NO: 3208221 - protein, 19 aa, Giardia lamblia
PFPELLQFNQGDISDYNPM

SEQ ID NO: 3208222 - protein, 27 aa, Giardia lamblia
PHNGLILIRNRFNIMDVHLLLCAAEFV

SEQ ID NO: 3208223 - protein, 22 aa, Giardia lamblia
PIALALSRPWEEGRTRVLLLPA

SEQ ID NO: 3208224 - protein, 23 aa, Giardia lamblia
PKTSLLCEFLSISLLPAQVSNQR

SEQ ID NO: 3208225 - protein, 18 aa, Giardia lamblia
PLAYERLLERIDALEKEV

SEQ ID NO: 3208226 - protein, 19 aa, Giardia lamblia
PNDFVILNRQPTLHKHSMI

SEQ ID NO: 3208227 - protein, 42 aa, Giardia lamblia
PNEHPIFRFFCQYPQQIRPLLRDYLIIHYFEKIASFLKKNNI

SEQ ID NO: 3208228 - protein, 24 aa, Giardia lamblia
PNETIDVTLTIPPGLTLPEISAIR

SEQ ID NO: 3208229 - protein, 26 aa, Giardia lamblia
PPCGLRGRAWVRRYIPQQGLKTGDPG

SEQ ID NO: 3208230 - protein, 19 aa, Giardia lamblia
PPRAQVIMRFEIFEAFPST

SEQ ID NO: 3208231 - protein, 27 aa, Giardia lamblia
PPSCYLTPLRKLLAHHFLMQYPVFTIL

SEQ ID NO: 3208232 - protein, 28 aa, Giardia lamblia
PPSSNILTRASLLSPLIPHTMRELSMRI

SEQ ID NO: 3208233 - protein, 35 aa, Giardia lamblia
PPTSHPFYFSTRQLYRFILLNNSASPWILNLVEQI

SEQ ID NO: 3208234 - protein, 23 aa, Giardia lamblia
PQELYDFLQENLDWTRSTAYKYA

SEQ ID NO: 3208235 - protein, 26 aa, Giardia lamblia
PQLGKKFVHYLWGRPDPETQLYTSYT

SEQ ID NO: 3208236 - protein, 19 aa, Giardia lamblia
PQLLASRFCPAQHRSMRRA

SEQ ID NO: 3208237 - protein, 18 aa, Giardia lamblia
PRIPPRSEKSRKPSASER

SEQ ID NO: 3208238 - protein, 26 aa, Giardia lamblia
PRKHIQLIGLPFLSKNEWNVFPLRAL

SEQ ID NO: 3208239 - protein, 19 aa, Giardia lamblia
PRKLKMIAGLLLVASAFGA

SEQ ID NO: 3208240 - protein, 27 aa, Giardia lamblia
PRPRPPTRGRFWARRPPAPDGPGSPWA

SEQ ID NO: 3208241 - protein, 26 aa, Giardia lamblia
PSGSKVQFPYKYKGLFILTPGPLSAD

SEQ ID NO: 3208242 - protein, 17 aa, Giardia lamblia
PSREYSIRYSQASLWWS

SEQ ID NO: 3208243 - protein, 18 aa, Giardia lamblia
PSSFLLNTFPNTPCLSSV

SEQ ID NO: 3208244 - protein, 37 aa, Giardia lamblia
PTAYTDYIRMLYLAGQKLPISVAIKPLWVRTELATIE

SEQ ID NO: 3208245 - protein, 20 aa, Giardia lamblia
PTNFYVIRTGPGSFLMLSNN

SEQ ID NO: 3208246 - protein, 23 aa, Giardia lamblia
PVHVDLTNIYLGPLGAQCFAAAI

SEQ ID NO: 3208247 - protein, 17 aa, Giardia lamblia
PVMAVPMIPAVQSQAPP

SEQ ID NO: 3208248 - protein, 23 aa, Giardia lamblia
PVPSLLGFLPLSQEVHIAAAIPP

SEQ ID NO: 3208249 - protein, 26 aa, Giardia lamblia
PVTYIVSLDPYFVYYRLAFSCQLNEG

SEQ ID NO: 3208250 - protein, 23 aa, Giardia lamblia
PWANSWSYRWNPQLIAARGYGVL

SEQ ID NO: 3208251 - protein, 23 aa, Giardia lamblia
QCIPALCTVLLSSGDYVECGGHG

SEQ ID NO: 3208252 - protein, 27 aa, Giardia lamblia
QDALGMTALMHLLRDNFGRYALTLSSL

SEQ ID NO: 3208253 - protein, 32 aa, Giardia lamblia
QDYRTIGTLLCYPSSCVRFNVLCNNRGTCIDK

SEQ ID NO: 3208254 - protein, 29 aa, Giardia lamblia
QGNTYINTFRLSKYPSLLNGTAAPKLAPY

SEQ ID NO: 3208255 - protein, 28 aa, Giardia lamblia
QHENDRYVRLLYNSKPFVPPFCASITIG

SEQ ID NO: 3208256 - protein, 34 aa, Giardia lamblia
QHHIFNHYHNLKDWFLFAYLHADDYPQELYDFLQ

SEQ ID NO: 3208257 - protein, 25 aa, Giardia lamblia
QHSTVHWVLIYLGHMGRELSPSLLY

SEQ ID NO: 3208258 - protein, 24 aa, Giardia lamblia
QIKANMIKILLPYEGRCQDSFGMT

SEQ ID NO: 3208259 - protein, 17 aa, Giardia lamblia
QKDIYMISCTFIDECLA

SEQ ID NO: 3208260 - protein, 22 aa, Giardia lamblia
QKGYAIIPDIIAAMSPFQIPEI

SEQ ID NO: 3208261 - protein, 20 aa, Giardia lamblia
QLDVYLAIYKHLDALQLSLL

SEQ ID NO: 3208262 - protein, 28 aa, Giardia lamblia
QLHYCPYPCIYRKLGGLFLFVIGAEAEN

SEQ ID NO: 3208263 - protein, 22 aa, Giardia lamblia
QLKEAEILLQRQTISSVAGRDS

SEQ ID NO: 3208264 - protein, 24 aa, Giardia lamblia
QLSRFIHRCLIFDPVIRPSAKDLL

SEQ ID NO: 3208265 - protein, 17 aa, Giardia lamblia
QLWQNIDLALNLFAKRW

SEQ ID NO: 3208266 - protein, 21 aa, Giardia lamblia
QLYKRIANHAPFNSLALMRIQ

SEQ ID NO: 3208267 - protein, 19 aa, Giardia lamblia
QRDVHPSAIVIAAIRRNPV

SEQ ID NO: 3208268 - protein, 21 aa, Giardia lamblia
QRKSLFALSAALTSRGASLTK

SEQ ID NO: 3208269 - protein, 45 aa, Giardia lamblia
QSKNDQIFYFLYNTLLTAPHPLLFVSIANSLYFPYTDRIASRLSG

SEQ ID NO: 3208270 - protein, 17 aa, Giardia lamblia
QVDLERFELIQNGIEHL

SEQ ID NO: 3208271 - protein, 21 aa, Giardia lamblia
QYKRKCGHYFAIQNSNLLVNV

SEQ ID NO: 3208272 - protein, 25 aa, Giardia lamblia
RAAALNCCFPYVWKHRPSSSTVAAC

SEQ ID NO: 3208273 - protein, 24 aa, Giardia lamblia
RAAALNCCFPYVWRHRPSSSTVAA

SEQ ID NO: 3208274 - protein, 26 aa, Giardia lamblia
RAANKTLLAFFAKPSLRTRVSLETAM

SEQ ID NO: 3208275 - protein, 19 aa, Giardia lamblia
RAARLFFGKEWGLKDTCGR

SEQ ID NO: 3208276 - protein, 23 aa, Giardia lamblia
RACDVIIPTITLSSSSKLLLTVH

SEQ ID NO: 3208277 - protein, 18 aa, Giardia lamblia
RACWKRILNSCIAGKIAV

SEQ ID NO: 3208278 - protein, 34 aa, Giardia lamblia; identical to SEQ ID NO: 3195286

SEQ ID NO: 3208279 - protein, 26 aa, Giardia lamblia
RALHMQAKMELFFNTSIQKTVNLDEG

SEQ ID NO: 3208280 - protein, 17 aa, Giardia lamblia
RALWTGFLQTFVTYDFI

SEQ ID NO: 3208281 - protein, 17 aa, Giardia lamblia
RAMLPPCGLRGRAWVRR

SEQ ID NO: 3208282 - protein, 24 aa, Giardia lamblia
RARLEMYGFIYNNPLTNAVTCVYT

SEQ ID NO: 3208283 - protein, 29 aa, Giardia lamblia
RCAHCKEILFVPIIIYPCTHVVCSTCIEK

SEQ ID NO: 3208284 - protein, 27 aa, Giardia lamblia
RCYSLDNWIVTCALFLKPCEQPMPSHS

SEQ ID NO: 3208285 - protein, 26 aa, Giardia lamblia
RDEFKLIYCQSNASGIPLFMLPAISP

SEQ ID NO: 3208286 - protein, 20 aa, Giardia lamblia
RDFSLLIAEEFIFIGVRETE

SEQ ID NO: 3208287 - protein, 18 aa, Giardia lamblia
RDGRLKFIVINTGLYNSL

SEQ ID NO: 3208288 - protein, 21 aa, Giardia lamblia
RDLYLIASAQAIYISTRHLTE

SEQ ID NO: 3208289 - protein, 17 aa, Giardia lamblia
RDNKLLKTLSKFAREII

SEQ ID NO: 3208290 - protein, 25 aa, Giardia lamblia
RDPNTYPLTNLVPVTLIQSAEHKQG

SEQ ID NO: 3208291 - protein, 23 aa, Giardia lamblia
REGNLINRWGWSALTYAVHNNNV

SEQ ID NO: 3208292 - protein, 17 aa, Giardia lamblia
REKCICSLRHSGLYCEK

SEQ ID NO: 3208293 - protein, 26 aa, Giardia lamblia
REQRNSYLPIFPITAETRLVSAVMNC

SEQ ID NO: 3208294 - protein, 40 aa, Giardia lamblia
REYSIRYSQASLWWSSQLYGLLAMHKLYIRQVAAVLPSPT

SEQ ID NO: 3208295 - protein, 20 aa, Giardia lamblia
RFEGGTPVRPTNATTLAAET

SEQ ID NO: 3208296 - protein, 17 aa, Giardia lamblia
RFRNMDELYYSLRGVER

SEQ ID NO: 3208297 - protein, 25 aa, Giardia lamblia
RGRLLLGCSLCRARPPWPSVCISLR

SEQ ID NO: 3208298 - protein, 33 aa, Giardia lamblia
RGTRWLTRRMRLVRCIVLLLLLIAAVDKSLALK

SEQ ID NO: 3208299 - protein, 17 aa, Giardia lamblia
RGVERYMPYIRRVFIVT

SEQ ID NO: 3208300 - protein, 19 aa, Giardia lamblia
RILFVHGGLPRNATLDTLI

SEQ ID NO: 3208301 - protein, 18 aa, Giardia lamblia
RIPKIRQLLQDYFNGKAL

SEQ ID NO: 3208302 - protein, 25 aa, Giardia lamblia
RISKSSPRYILIPSAYSSCVVNERN

SEQ ID NO: 3208303 - protein, 20 aa, Giardia lamblia
RKLYELQCDVLDIVKKMEDY

SEQ ID NO: 3208304 - protein, 21 aa, Giardia lamblia
RKMRNTLVGSPLYMAPEVISM

SEQ ID NO: 3208305 - protein, 20 aa, Giardia lamblia
RKVRALNYFLLEAPEYKEIY

SEQ ID NO: 3208306 - protein, 24 aa, Giardia lamblia
RLDLISMNFLVLLETVFKAPSAIS

SEQ ID NO: 3208307 - protein, 19 aa, Giardia lamblia
RLELIIEDLRKEISRLQVA

SEQ ID NO: 3208308 - protein, 25 aa, Giardia lamblia
RLKRRVNELVAYSKKIRAILQSVHG

SEQ ID NO: 3208309 - protein, 18 aa, Giardia lamblia
RLLKVFIYTRHGARSPYT

SEQ ID NO: 3208310 - protein, 26 aa, Giardia lamblia
RLNDTLLVSILLPHEMTLQTLSGETA

SEQ ID NO: 3208311 - protein, 18 aa, Giardia lamblia
RMSFSIPVVPLSNALHPV

SEQ ID NO: 3208312 - protein, 19 aa, Giardia lamblia
RNDLICVDGYQPIDGKCVP

SEQ ID NO: 3208313 - protein, 18 aa, Giardia lamblia
RPGAHKILCPLCKLELET

SEQ ID NO: 3208314 - protein, 20 aa, Giardia lamblia
RPGAHRILCPLCKLELETHA

SEQ ID NO: 3208315 - protein, 18 aa, Giardia lamblia
RPLLLLPEDTQEAPASSG

SEQ ID NO: 3208316 - protein, 18 aa, Giardia lamblia
RPLRDLINLNYNVSRLWR

SEQ ID NO: 3208317 - protein, 19 aa, Giardia lamblia
RPVTFISANSLHYAKFVAP

SEQ ID NO: 3208318 - protein, 17 aa, Giardia lamblia
RQAAIRSFLMMLNENHT

SEQ ID NO: 3208319 - protein, 20 aa, Giardia lamblia
RQRAEIYAAFRAANGKTASE

SEQ ID NO: 3208320 - protein, 20 aa, Giardia lamblia
RQYDLLSTLIPLEGGLTDCY

SEQ ID NO: 3208321 - protein, 17 aa, Giardia lamblia
RQYPELLQIVDIRFVSQ

SEQ ID NO: 3208322 - protein, 25 aa, Giardia lamblia
RRRPRNLRRRLGSLRRTKRRPARTR

SEQ ID NO: 3208323 - protein, 31 aa, Giardia lamblia
RSCVGKDVFWFLNTCLTITGTIGKTVCRAMN

SEQ ID NO: 3208324 - protein, 22 aa, Giardia lamblia
RSGKLFAWTVTTETLCFGVQAH

SEQ ID NO: 3208325 - protein, 25 aa, Giardia lamblia
RSVLEIYEIVYLLQEGNFSSVTKRA

SEQ ID NO: 3208326 - protein, 20 aa, Giardia lamblia
RTAEFLCEYLTLTGLLGNLE

SEQ ID NO: 3208327 - protein, 21 aa, Giardia lamblia
RTFPTRKMRFAIISGGSFVDP

SEQ ID NO: 3208328 - protein, 24 aa, Giardia lamblia
RVDIAYFYNLPRAELLRHIQQMLA

SEQ ID NO: 3208329 - protein, 28 aa, Giardia lamblia
RVEQKRQLLKTLVTWLISIELHDPTDSL

SEQ ID NO: 3208330 - protein, 20 aa, Giardia lamblia
RVLSWLWATNKAYCAVFLAS

SEQ ID NO: 3208331 - protein, 25 aa, Giardia lamblia
RVSFKMLSVITYLLAGLGVALSKPL

SEQ ID NO: 3208332 - protein, 41 aa, Giardia lamblia
RYKCECDPGYELYNSVYYCMPEICITGTWLCNGRGICIVDS

SEQ ID NO: 3208333 - protein, 18 aa, Giardia lamblia
SAAAWSIPSTPTIYKCKA

SEQ ID NO: 3208334 - protein, 25 aa, Giardia lamblia
SALCFIIINSPLLRQKKMTTVSTSF

SEQ ID NO: 3208335 - protein, 26 aa, Giardia lamblia
SANLPLIEVNILGITPLMEAATVGDI

SEQ ID NO: 3208336 - protein, 21 aa, Giardia lamblia
SAVLQLTWAACEANGLGGAGS

SEQ ID NO: 3208337 - protein, 18 aa, Giardia lamblia
SCYPYDGTFYNNTCIYNG

SEQ ID NO: 3208338 - protein, 26 aa, Giardia lamblia
SDEGQDYWIVKNYWGPGWGEDGYFRI

SEQ ID NO: 3208339 - protein, 20 aa, Giardia lamblia
SDLCLLGGLSYLRVLDMTDT

SEQ ID NO: 3208340 - protein, 18 aa, Giardia lamblia
SDLTWYLAPETRTSRFFT

SEQ ID NO: 3208341 - protein, 29 aa, Giardia lamblia
SDSFIITTAFFMASLMHAQLGHSLQSTKD

SEQ ID NO: 3208342 - protein, 19 aa, Giardia lamblia
SDTLFKLYNDHIITCPHRF

SEQ ID NO: 3208343 - protein, 23 aa, Giardia lamblia
SEDDLRAMFPRHGQPTRPSAECP

SEQ ID NO: 3208344 - protein, 19 aa, Giardia lamblia
SEGAFFKDGNCYPLYCRTG

SEQ ID NO: 3208345 - protein, 20 aa, Giardia lamblia
SFAKALFMVLDTQLEGTSSQ

SEQ ID NO: 3208346 - protein, 21 aa, Giardia lamblia
SFIDELLFQVRSVSPPKPVCK

SEQ ID NO: 3208347 - protein, 18 aa, Giardia lamblia
SGAYPPLAIMGVSVFVNT

SEQ ID NO: 3208348 - protein, 23 aa, Giardia lamblia
SHEYPLILYVHGGPESPWANSWS

SEQ ID NO: 3208349 - protein, 33 aa, Giardia lamblia
SHFYTYSAILKYDFRVFWSWRTKLDRDFYSALH

SEQ ID NO: 3208350 - protein, 23 aa, Giardia lamblia
SIEKIFHICKLLVAPRNLGTGSI

SEQ ID NO: 3208351 - protein, 27 aa, Giardia lamblia
SIIMLRNQLQTFLLQLKPPAACPHCAS

SEQ ID NO: 3208352 - protein, 22 aa, Giardia lamblia
SIPLMRLNPYQRKSINNEIFPY

SEQ ID NO: 3208353 - protein, 26 aa, Giardia lamblia
SKDATFYKIHHWYKRSFFMGAIEDKK

SEQ ID NO: 3208354 - protein, 18 aa, Giardia lamblia
SKSLLRVLSWLWATNKAY

SEQ ID NO: 3208355 - protein, 19 aa, Giardia lamblia
SLNSFQFPADIFSLPLSFV

SEQ ID NO: 3208356 - protein, 24 aa, Giardia lamblia
SLTMPVIQVVFILRDIDGTFASYF

SEQ ID NO: 3208357 - protein, 30 aa, Giardia lamblia
SLVVCGSAFLYHQIRCIASLLLHIGAELEP

SEQ ID NO: 3208358 - protein, 19 aa, Giardia lamblia
SPAPLRFWLRRASAGAARR

SEQ ID NO: 3208359 - protein, 18 aa, Giardia lamblia
SPKPALHQPLYALQGQED

SEQ ID NO: 3208360 - protein, 30 aa, Giardia lamblia
SQLDSYTIDRFTCLAYACLASDLTKGVCYR

SEQ ID NO: 3208361 - protein, 18 aa, Giardia lamblia
SQNLTFTQKKYPLLMADS

SEQ ID NO: 3208362 - protein, 25 aa, Giardia lamblia
SQRYYYNDTYYKAGGPVFLMIGGEG

SEQ ID NO: 3208363 - protein, 21 aa, Giardia lamblia
SRGLIKAYLHTVHSLFDIVFS

SEQ ID NO: 3208364 - protein, 35 aa, Giardia lamblia
SRLPLVMRPVLGLQQQFLWRIMTHLLKDPDRVGDT

SEQ ID NO: 3208365 - protein, 26 aa, Giardia lamblia
SRMFGCSRLRIYDAYYLASYERLMVL

SEQ ID NO: 3208366 - protein, 18 aa, Giardia lamblia
SSDTFDFGKLGVQGLLVP

SEQ ID NO: 3208367 - protein, 26 aa, Giardia lamblia
SSDVWNGFRFMSMANFLVWQKDIIKV

SEQ ID NO: 3208368 - protein, 18 aa, Giardia lamblia
SSGFFRLSLELLELLNWS

SEQ ID NO: 3208369 - protein, 32 aa, Giardia lamblia
STALDVLVTLLIHPPFSLQPLYVVLLDAEGNR

SEQ ID NO: 3208370 - protein, 32 aa, Giardia lamblia
STCTHFKCLNRDLSFKPICSGVGFCLGPEGCA

SEQ ID NO: 3208371 - protein, 19 aa, Giardia lamblia
STDIAFKHLPVDLIVPHLS

SEQ ID NO: 3208372 - protein, 26 aa, Giardia lamblia
STGKTHYFKKSLSKPLLRTSFDIKES

SEQ ID NO: 3208373 - protein, 20 aa, Giardia lamblia
STHDFLPGLTFPLLHASHMS

SEQ ID NO: 3208374 - protein, 24 aa, Giardia lamblia
STKYIFQKVLLNKTFMESGMAVFL

SEQ ID NO: 3208375 - protein, 17 aa, Giardia lamblia
STYACKKICYSRFDQLK

SEQ ID NO: 3208376 - protein, 28 aa, Giardia lamblia
SVAIPVASLLLLWKMGVSSAWAVSGVSP

SEQ ID NO: 3208377 - protein, 27 aa, Giardia lamblia
SVGPGRRGFITLVLPRAASSITVEIPA

SEQ ID NO: 3208378 - protein, 25 aa, Giardia lamblia
SVTATPFIRQLPLDTLRTMEKDAHF

SEQ ID NO: 3208379 - protein, 18 aa, Giardia lamblia
SVTSIPLMRLNPYQRKSI

SEQ ID NO: 3208380 - protein, 26 aa, Giardia lamblia
SYEWLSPVHRLLLRRPIRVQFSGEAA

SEQ ID NO: 3208381 - protein, 24 aa, Giardia lamblia
SYNAPAFLRPALTDMLPALADFSF

SEQ ID NO: 3208382 - protein, 23 aa, Giardia lamblia
TAKWVCKFTQIGKYAQGLALLKI

SEQ ID NO: 3208383 - protein, 28 aa, Giardia lamblia
TALMHALIHHNFALVPILLQRELGHVDS

SEQ ID NO: 3208384 - protein, 20 aa, Giardia lamblia
TAPHIPWIGAAALPVNLTGA

SEQ ID NO: 3208385 - protein, 19 aa, Giardia lamblia
TASFFATGMGRHYALPVLR

SEQ ID NO: 3208386 - protein, 27 aa, Giardia lamblia
TATAMPAMAPVLRPLLLLPEDTQEAPA

SEQ ID NO: 3208387 - protein, 19 aa, Giardia lamblia
TCGLRWKHCPGHAGYVELP

SEQ ID NO: 3208388 - protein, 23 aa, Giardia lamblia
TDELFFVIREMGGPVWEQFEMYE

SEQ ID NO: 3208389 - protein, 25 aa, Giardia lamblia
TDLAYSAAWLRISSTWPAWMASNHS

SEQ ID NO: 3208390 - protein, 29 aa, Giardia lamblia
TDSLAEPMILQPVVPRSLGRSTGPRKRES

SEQ ID NO: 3208391 - protein, 19 aa, Giardia lamblia
TDYQYVLGYCVPNVCVTTY

SEQ ID NO: 3208392 - protein, 30 aa, Giardia lamblia
TDYRDIHEPIPSKLVLSLLEQLAGALAHLH

SEQ ID NO: 3208393 - protein, 24 aa, Giardia lamblia
TECTPLQCIVLGQVCPHGTCTNTD

SEQ ID NO: 3208394 - protein, 22 aa, Giardia lamblia
TEFEQWLYYLSGTTGATFSKTI

SEQ ID NO: 3208395 - protein, 18 aa, Giardia lamblia
TEMLLNDGYFFSINTPMD

SEQ ID NO: 3208396 - protein, 19 aa, Giardia lamblia
TFATTLSRQFPRLNIFALC

SEQ ID NO: 3208397 - protein, 23 aa, Giardia lamblia
TFEALKRIFGGNTLTRLLSAFSR

SEQ ID NO: 3208398 - protein, 30 aa, Giardia lamblia
TFEVVNQLALVYFKLDRFPTPQSLTSSMRA

SEQ ID NO: 3208399 - protein, 20 aa, Giardia lamblia
TFHDAYLNYTLFQEIILLQY

SEQ ID NO: 3208400 - protein, 18 aa, Giardia lamblia
TFVTYDFIHLWQAMKKSP

SEQ ID NO: 3208401 - protein, 27 aa, Giardia lamblia
TGIRLRLCIKMRAFLNTLPLDTSVHIL

SEQ ID NO: 3208402 - protein, 17 aa, Giardia lamblia
TGSTYACKKICYSRFDQ

SEQ ID NO: 3208403 - protein, 21 aa, Giardia lamblia
TLLLLLCLVSLELIGCVRPSN

SEQ ID NO: 3208404 - protein, 22 aa, Giardia lamblia
TLLRGIITPASNIWSLGAVAYE

SEQ ID NO: 3208405 - protein, 24 aa, Giardia lamblia
TLTFRTYVFLIDVSPQAISSGLTS

SEQ ID NO: 3208406 - protein, 27 aa, Giardia lamblia
TNGSQFFICTVVTPWLNGKHVVFGHVV

SEQ ID NO: 3208407 - protein, 22 aa, Giardia lamblia
TPACVCDPFYAGTFCEECAPDA

SEQ ID NO: 3208408 - protein, 19 aa, Giardia lamblia
TPLIERNSYIPVKKSKIFS

SEQ ID NO: 3208409 - protein, 24 aa, Giardia lamblia
TRETFSHRHLLQTGALQSYLNELM

SEQ ID NO: 3208410 - protein, 24 aa, Giardia lamblia
TRGRDGLLPLFNFSQHPGVPRHGV

SEQ ID NO: 3208411 - protein, 25 aa, Giardia lamblia
TSCARGFFAGFLKASGHCVSCDKGG

SEQ ID NO: 3208412 - protein, 23 aa, Giardia lamblia
TSIGRRKPLISVESPDLELQCED

SEQ ID NO: 3208413 - protein, 17 aa, Giardia lamblia
TSLMLEVLRQADPDVSC

SEQ ID NO: 3208414 - protein, 23 aa, Giardia lamblia
TSMAAHPYFTFNSVGFPVLREDC

SEQ ID NO: 3208415 - protein, 25 aa, Giardia lamblia
TSRKRSFPFMFHLGQNEVISGWDLT

SEQ ID NO: 3208416 - protein, 38 aa, Giardia lamblia
TSRSLLKVYLSSSVLMSNLLRHLYNIDVTGAAVLPTLL

SEQ ID NO: 3208417 - protein, 25 aa, Giardia lamblia
TSRYGPWRMVLFVGGFSTKVSALKF

SEQ ID NO: 3208418 - protein, 23 aa, Giardia lamblia
TSSALLQYFNQYPAKMISFRVSN

SEQ ID NO: 3208419 - protein, 23 aa, Giardia lamblia
TTVPGIMQYPLRAATKLVLSDLL

SEQ ID NO: 3208420 - protein, 18 aa, Giardia lamblia
TTVSLWDIYKQEVDIRFV

SEQ ID NO: 3208421 - protein, 36 aa, Giardia lamblia
TVECGGFGVCFFYPIGIISCICYPSTVLDNYKCVPF

SEQ ID NO: 3208422 - protein, 25 aa, Giardia lamblia
TVEKIISTYRQFGIDLPTSMMELEA

SEQ ID NO: 3208423 - protein, 17 aa, Giardia lamblia
TVFFCGHVFHTSCLAFY

SEQ ID NO: 3208424 - protein, 18 aa, Giardia lamblia
TVLVPFISTLHKILNDFF

SEQ ID NO: 3208425 - protein, 21 aa, Giardia lamblia
TVNVDLLCIPATCMSAENPNV

SEQ ID NO: 3208426 - protein, 29 aa, Giardia lamblia
TVPVGLMTLPYLMELYLNCNPDLTCPDAT

SEQ ID NO: 3208427 - protein, 19 aa, Giardia lamblia
TVQRHIFLTLIAHNDTLLQ

SEQ ID NO: 3208428 - protein, 17 aa, Giardia lamblia
TVRCPLCTLFGSSTQEQ

SEQ ID NO: 3208429 - protein, 18 aa, Giardia lamblia
TVREMNLHKGHFGRMLIP

SEQ ID NO: 3208430 - protein, 23 aa, Giardia lamblia
TVRLRVMLQSKSLLRVLSWLWAT

SEQ ID NO: 3208431 - protein, 37 aa, Giardia lamblia
TYGDYWIVRNSWSPLWGMDGYFYLSMKDNICGILTDA

SEQ ID NO: 3208432 - protein, 24 aa, Giardia lamblia
TYKPSLFCSTVYLSSLYASLVPTA

SEQ ID NO: 3208433 - protein, 26 aa, Giardia lamblia
TYNGTLGSLLYLRHNKIFLATMSSYT

SEQ ID NO: 3208434 - protein, 22 aa, Giardia lamblia
TYNYHSVIVLANRLSVFNSISR

SEQ ID NO: 3208435 - protein, 24 aa, Giardia lamblia
TYQTITRVTAFMICLIQLSSCNPE

SEQ ID NO: 3208436 - protein, 19 aa, Giardia lamblia
TYVLSWGCMPDECVTEYED

SEQ ID NO: 3208437 - protein, 25 aa, Giardia lamblia
VADLRTQISLLDRRLRESEARNSTL

SEQ ID NO: 3208438 - protein, 26 aa, Giardia lamblia
VADRKYKMLLWNLSLFFSVVLERRRF

SEQ ID NO: 3208439 - protein, 27 aa, Giardia lamblia
VADSPHWKWRMLDYYTSFDPIMNRSKM

SEQ ID NO: 3208440 - protein, 27 aa, Giardia lamblia
VAEKYKDSIFYFYGAASRALHMQAKME

SEQ ID NO: 3208441 - protein, 26 aa, Giardia lamblia
VAKNQHLFDLLFGEPIYHSSEASADR

SEQ ID NO: 3208442 - protein, 21 aa, Giardia lamblia
VALRLYMYTVLILEKSGQTDR

SEQ ID NO: 3208443 - protein, 27 aa, Giardia lamblia
VANMSEYYRFIFLEEPLSLCNGQVLHA

SEQ ID NO: 3208444 - protein, 19 aa, Giardia lamblia
VARDFMGTLPAPISPIWRA

SEQ ID NO: 3208445 - protein, 26 aa, Giardia lamblia
VCDGSMVFLYIFDLTSKTSLASIKEW

SEQ ID NO: 3208446 - protein, 22 aa, Giardia lamblia
VCECSIAYVGSLCTECADTAIL

SEQ ID NO: 3208447 - protein, 17 aa, Giardia lamblia
VCHCYTYASAHSTLLCY

SEQ ID NO: 3208448 - protein, 25 aa, Giardia lamblia
VDGQCVPYKYLSKNLFGEYVICNGR

SEQ ID NO: 3208449 - protein, 27 aa, Giardia lamblia
VDLSTVLHFYILLSYGKLSRTGTTPSS

SEQ ID NO: 3208450 - protein, 25 aa, Giardia lamblia
VECGGFGLCYGLPPLGDESACLCDF

SEQ ID NO: 3208451 - protein, 18 aa, Giardia lamblia
VEHAAWDLVLLLLEHEGG

SEQ ID NO: 3208452 - protein, 24 aa, Giardia lamblia
VENSTFSDLILRIAPKSIVMAYSN

SEQ ID NO: 3208453 - protein, 31 aa, Giardia lamblia
VEQSDYFDHPFFWLRALFPAGKNPRTKVLPI

SEQ ID NO: 3208454 - protein, 19 aa, Giardia lamblia
VFAHLPVLCEQNGIPYFFI

SEQ ID NO: 3208455 - protein, 25 aa, Giardia lamblia
VFGDRFLMCLQEYADYFIFNDVTSC

SEQ ID NO: 3208456 - protein, 24 aa, Giardia lamblia
VFHTSCLAFYLSPLSSRINKLVRE

SEQ ID NO: 3208457 - protein, 21 aa, Giardia lamblia
VFIIDTLRGLAYLHDNCKIIH

SEQ ID NO: 3208458 - protein, 20 aa, Giardia lamblia
VGEGCHLRRGFLSITVCCPC

SEQ ID NO: 3208459 - protein, 20 aa, Giardia lamblia
VGGSTRIPKIRQLLQDYFNG

SEQ ID NO: 3208460 - protein, 20 aa, Giardia lamblia
VGLWALQCPQGMTSHADRCV

SEQ ID NO: 3208461 - protein, 29 aa, Giardia lamblia
VHDYSQYFYSLYCELPIAKPNIVDYPYKN

SEQ ID NO: 3208462 - protein, 17 aa, Giardia lamblia
VHFLYSSSCKRLFSLSP

SEQ ID NO: 3208463 - protein, 20 aa, Giardia lamblia
VKEDTLFERPAPTPLDDLCD

SEQ ID NO: 3208464 - protein, 17 aa, Giardia lamblia
VKFIPKTVRLRVMLQSK

SEQ ID NO: 3208465 - protein, 24 aa, Giardia lamblia
VKKRRFVPTILILGRAHGDSVAVY

SEQ ID NO: 3208466 - protein, 19 aa, Giardia lamblia
VKRIMALQMIKKALLQTNK

SEQ ID NO: 3208467 - protein, 26 aa, Giardia lamblia
VKRSAFNIYLIPPKTRQLRSSSRKQK

SEQ ID NO: 3208468 - protein, 26 aa, Giardia lamblia
VLACLYGHYHSAYPLVLSAGEEPLVP

SEQ ID NO: 3208469 - protein, 23 aa, Giardia lamblia
VLGLCTLVGLVLFRRPQRKPSDT

SEQ ID NO: 3208470 - protein, 17 aa, Giardia lamblia
VLSQNLTFTQKKYPLLM

SEQ ID NO: 3208471 - protein, 30 aa, Giardia lamblia
VMAHLSQVLKYFVCLLNDGRFNPLIMLPND

SEQ ID NO: 3208472 - protein, 17 aa, Giardia lamblia
VNAFNFLHNTGTVLASC

SEQ ID NO: 3208473 - protein, 21 aa, Giardia lamblia
VNGYPTIKLLQSSGAVFKYEK

SEQ ID NO: 3208474 - protein, 20 aa, Giardia lamblia
VNPYYFHRIMTSVLGTLPER

SEQ ID NO: 3208475 - protein, 17 aa, Giardia lamblia
VPCSCDENFEYIKSGCH

SEQ ID NO: 3208476 - protein, 22 aa, Giardia lamblia
VPDPYYCGRFELVYSMVERTCR

SEQ ID NO: 3208477 - protein, 25 aa, Giardia lamblia
VPGVKLLTTVPIPVATAITYLSSRM

SEQ ID NO: 3208478 - protein, 19 aa, Giardia lamblia
VQEKFRLHQVSHEELPHFY

SEQ ID NO: 3208479 - protein, 25 aa, Giardia lamblia
VQKQRELLAVNLRELQSRALHLMTK

SEQ ID NO: 3208480 - protein, 21 aa, Giardia lamblia
VRGITRCFIRYELPADRYVMD

SEQ ID NO: 3208481 - protein, 17 aa, Giardia lamblia
VSEKLLEYLKNGGIAEL

SEQ ID NO: 3208482 - protein, 26 aa, Giardia lamblia
VSSDNLLLDQFLISAGTEPTLISDEL

SEQ ID NO: 3208483 - protein, 26 aa, Giardia lamblia
VTKMFFPHAFLRPNIPRYYGVNITED

SEQ ID NO: 3208484 - protein, 28 aa, Giardia lamblia
VVCQTPAPWVFLLDILEQPLYNLLRQVT

SEQ ID NO: 3208485 - protein, 17 aa, Giardia lamblia
VVFDYRGIPSECGGLGY

SEQ ID NO: 3208486 - protein, 27 aa, Giardia lamblia
VVNERNILYLFVGGEFKPLNRLEKVKD

SEQ ID NO: 3208487 - protein, 22 aa, Giardia lamblia
VVQELIAIRLVPAKLQTLVAAV

SEQ ID NO: 3208488 - protein, 28 aa, Giardia lamblia
WDEEAWPGLYRHLFVAPLPMTGLVTEDT

SEQ ID NO: 3208489 - protein, 18 aa, Giardia lamblia
WSFGVCLIELAQGVPPNS

SEQ ID NO: 3208490 - protein, 19 aa, Giardia lamblia
WSIPSTPTIYKCKATFRAP

SEQ ID NO: 3208491 - protein, 18 aa, Giardia lamblia
YAAYYGHVEAVKLLVWGE

SEQ ID NO: 3208492 - protein, 19 aa, Giardia lamblia
YADLLRMLSIASQYIDIGV

SEQ ID NO: 3208493 - protein, 19 aa, Giardia lamblia
YAIMIAYRLKKYKVLSVLS

SEQ ID NO: 3208494 - protein, 29 aa, Giardia lamblia
YAKFVAPFIRNNIPIVADSTLRQVLSGLY

SEQ ID NO: 3208495 - protein, 19 aa, Giardia lamblia
YAQCYDPLLAEGYLSSFLP

SEQ ID NO: 3208496 - protein, 25 aa, Giardia lamblia
YASAHSTLLCYPTTCLFDRNGYMVP

SEQ ID NO: 3208497 - protein, 28 aa, Giardia lamblia
YCSRILMRKFPHLLLLADDVFTNFNGTY

SEQ ID NO: 3208498 - protein, 22 aa, Giardia lamblia
YDCPSGETYVLSWGCMPDECVT

SEQ ID NO: 3208499 - protein, 30 aa, Giardia lamblia
YDIELLPVNLRTLPLFIRLKQIATIYNKKI

SEQ ID NO: 3208500 - protein, 20 aa, Giardia lamblia
YDIKYMIFLAEPSVEYVTKN

SEQ ID NO: 3208501 - protein, 24 aa, Giardia lamblia
YDRYIRIWNMLSGEIALGVSEDPK

SEQ ID NO: 3208502 - protein, 17 aa, Giardia lamblia
YEAFVFGYAVSAGLMCL

SEQ ID NO: 3208503 - protein, 17 aa, Giardia lamblia
YELTMKLLTLSELLHEF

SEQ ID NO: 3208504 - protein, 24 aa, Giardia lamblia
YERLNTVILPLFDKYPEITEIAQF

SEQ ID NO: 3208505 - protein, 21 aa, Giardia lamblia
YESEALRRLNFTDLMLEVFSE

SEQ ID NO: 3208506 - protein, 32 aa, Giardia lamblia
YGGYYFPSYNTPFFDELWIVAGYPSVAEGDAS

SEQ ID NO: 3208507 - protein, 21 aa, Giardia lamblia
YGLDCDLIMKALATGGPLQTA

SEQ ID NO: 3208508 - protein, 18 aa, Giardia lamblia
YHDERATLNLYINRVFVT

SEQ ID NO: 3208509 - protein, 27 aa, Giardia lamblia
YICISTIGGKILYFLSSLPSCGMGSLH

SEQ ID NO: 3208510 - protein, 25 aa, Giardia lamblia
YIGQTAWFFYGGMTRVFKGYTLNLN

SEQ ID NO: 3208511 - protein, 17 aa, Giardia lamblia
YILAVMTSSLYSPVSPP

SEQ ID NO: 3208512 - protein, 25 aa, Giardia lamblia
YISPNIPGLSFRKDLRKYKRAYEAI

SEQ ID NO: 3208513 - protein, 25 aa, Giardia lamblia
YITNAMLINRRKVDFRLYVGLFFNA

SEQ ID NO: 3208514 - protein, 29 aa, Giardia lamblia
YKDESVCIPVRWTMRSISAFGSHFDLYSL

SEQ ID NO: 3208515 - protein, 28 aa, Giardia lamblia
YLDRESFNSYLYIWHTKYDKFKADGLTV

SEQ ID NO: 3208516 - protein, 21 aa, Giardia lamblia
YLNGTVFDTSRKRSFPFMFHL

SEQ ID NO: 3208517 - protein, 26 aa, Giardia lamblia
YLSNGLPYCTYYYNSCIYLKKVHKGL

SEQ ID NO: 3208518 - protein, 20 aa, Giardia lamblia
YNIDVTGAAVLPTLLRTLMP

SEQ ID NO: 3208519 - protein, 23 aa, Giardia lamblia
YPEMCGEVTPLYPLVAYTGETVH

SEQ ID NO: 3208520 - protein, 18 aa, Giardia lamblia
YREEIDALVMEISGAFMD

SEQ ID NO: 3208521 - protein, 24 aa, Giardia lamblia
YREPSDYHLFLLSSALHSMPSDSY

SEQ ID NO: 3208522 - protein, 18 aa, Giardia lamblia
YSLLYVYTDLSLSEDNKD

SEQ ID NO: 3208523 - protein, 26 aa, Giardia lamblia
YSSDIVFTAFFLFNVLVQSVQKQNWN

SEQ ID NO: 3208524 - protein, 31 aa, Giardia lamblia
YTAFQEIPIHMILSPYLYLGSTSPSFSKALN

SEQ ID NO: 3208525 - protein, 26 aa, Giardia lamblia
YTASALSFLLPNLSKPVILTGSQIPL

SEQ ID NO: 3208526 - protein, 24 aa, Giardia lamblia
YTDRIRSILRRYASTVLACLYGHY

SEQ ID NO: 3208527 - protein, 34 aa, Giardia lamblia
YTSTRLPKFYLSGPSYRFLTKNIRFLQSKALARA

SEQ ID NO: 3208528 - protein, 22 aa, Giardia lamblia
TIHRHGFVFPLPRRRFSVTLMQ

SEQ ID NO: 3208529 - protein, 25 aa, Giardia lamblia
VGHADLFKIHILKTGLYVLPAALVL

SEQ ID NO: 3208530 - protein, 23 aa, Giardia lamblia
ADPIPLFYHPYTYTGLMSDLGIF

SEQ ID NO: 3208531 - protein, 24 aa, Giardia lamblia
ADVSLFLLLGLPIPTLKPMDFSSL

SEQ ID NO: 3208532 - protein, 27 aa, Giardia lamblia
ADYKGKYLIIFFYPADFTFVCPSEIIH

SEQ ID NO: 3208533 - protein, 18 aa, Giardia lamblia
AELFIRWSLRRLLHSFKM

SEQ ID NO: 3208534 - protein, 26 aa, Giardia lamblia
AFYHKTIAPFFKLLPVAYVASVTSHT

SEQ ID NO: 3208535 - protein, 22 aa, Giardia lamblia
AISKLFTFCSYPFLLNPQTKLN

SEQ ID NO: 3208536 - protein, 21 aa, Giardia lamblia
ALFFPLLTLPLQQPIVPILSK

SEQ ID NO: 3208537 - protein, 23 aa, Giardia lamblia
ALSCINILLRKLGIKNILSDTSQ

SEQ ID NO: 3208538 - protein, 24 aa, Giardia lamblia
CGGFGVCFFYPIGIISCICYPSTV

SEQ ID NO: 3208539 - protein, 17 aa, Giardia lamblia
CIPVRWTMRSISAFGSH

SEQ ID NO: 3208540 - protein, 21 aa, Giardia lamblia
CNGLGRCMIMPFPNIHYVCSC

SEQ ID NO: 3208541 - protein, 24 aa, Giardia lamblia
CQTPAPWVFLLDILEQPLYNLLRQ

SEQ ID NO: 3208542 - protein, 20 aa, Giardia lamblia
CRFHFLNFALLICPQLLGSS

SEQ ID NO: 3208543 - protein, 23 aa, Giardia lamblia
DAHVFMLLLLLFSTERYFNLSSH

SEQ ID NO: 3208544 - protein, 20 aa, Giardia lamblia
DGELLVVRLLGRDDGRVRAE

SEQ ID NO: 3208545 - protein, 22 aa, Giardia lamblia
DLTHMMFWYMSINALTGPIPTC

SEQ ID NO: 3208546 - protein, 18 aa, Giardia lamblia
DPVPLLKRLLLDKYLPLV

SEQ ID NO: 3208547 - protein, 23 aa, Giardia lamblia
DPVPLLKRLLLDKYLPLVNPILA

SEQ ID NO: 3208548 - protein, 24 aa, Giardia lamblia
DPVPLLKRLLLDKYLPLVNPILAE

SEQ ID NO: 3208549 - protein, 23 aa, Giardia lamblia
DRDALTHFYFRPSRLWNLADLNL

SEQ ID NO: 3208550 - protein, 24 aa, Giardia lamblia
DSKRQSCVPPIFKFSSPILRKWQT

SEQ ID NO: 3208551 - protein, 18 aa, Giardia lamblia
DSLIFIVKPLALSRGRQI

SEQ ID NO: 3208552 - protein, 22 aa, Giardia lamblia
DVWNGFRFMSMANFLVWQKDII

SEQ ID NO: 3208553 - protein, 22 aa, Giardia lamblia
EAWPGLYRHLFVAPLPMTGLVT

SEQ ID NO: 3208554 - protein, 25 aa, Giardia lamblia
ECMCDLIHLMFWYMSDNALTGSIPT

SEQ ID NO: 3208555 - protein, 20 aa, Giardia lamblia
EEIMHLLLFPTTRTMVNSPE

SEQ ID NO: 3208556 - protein, 19 aa, Giardia lamblia
EGQDYWIVKNYWGPGWGED

SEQ ID NO: 3208557 - protein, 29 aa, Giardia lamblia
EQSDYFDHPFFWLRALFPAGKNPRTKVLP

SEQ ID NO: 3208558 - protein, 22 aa, Giardia lamblia
ERNILYLFVGGEFKPLNRLEKV

SEQ ID NO: 3208559 - protein, 17 aa, Giardia lamblia
FIRWSLRRLLHSFKMHL

SEQ ID NO: 3208560 - protein, 20 aa, Giardia lamblia
FLPSTLFIKTLLVPPNRQRP

SEQ ID NO: 3208561 - protein, 24 aa, Giardia lamblia
FMELFGMIRAFYMLDYKRIRIDDF

SEQ ID NO: 3208562 - protein, 19 aa, Giardia lamblia
FNIYLIPPKTRQLRSSSRK

SEQ ID NO: 3208563 - protein, 18 aa, Giardia lamblia
FPPIFFKLLLGHSYTVIT

SEQ ID NO: 3208564 - protein, 18 aa, Giardia lamblia
FSCLQLCKILTSSSIRIK

SEQ ID NO: 3208565 - protein, 21 aa, Giardia lamblia
FSLASYFTLAFDKASYQGQEG

SEQ ID NO: 3208566 - protein, 21 aa, Giardia lamblia
FSLASYFTLAFDKTSYQGQEG

SEQ ID NO: 3208567 - protein, 18 aa, Giardia lamblia
FSNFWQDPWHMCSMTDDM

SEQ ID NO: 3208568 - protein, 18 aa, Giardia lamblia
FTLFVGLFLVLSPLLSDG

SEQ ID NO: 3208569 - protein, 24 aa, Giardia lamblia
GGTHYFFLFFLSQPGTKDLLCSIG

SEQ ID NO: 3208570 - protein, 23 aa, Giardia lamblia
GHGICIPATKATKAFCLCLPKMK

SEQ ID NO: 3208571 - protein, 24 aa, Giardia lamblia
HNLKDWFLFAYLHADDYPQELYDF

SEQ ID NO: 3208572 - protein, 17 aa, Giardia lamblia
HYCPYPCIYRKLGGLFL

SEQ ID NO: 3208573 - protein, 27 aa, Giardia lamblia
IHDFIPLLKFLLLNKYLPFANPILTET

SEQ ID NO: 3208574 - protein, 18 aa, Giardia lamblia
ILTRASLLSPLIPHTMRE

SEQ ID NO: 3208575 - protein, 22 aa, Giardia lamblia
IPIHMILSPYLYLGSTSPSFSK

SEQ ID NO: 3208576 - protein, 18 aa, Giardia lamblia
IRPLLRDYLIIHYFEKIA

SEQ ID NO: 3208577 - protein, 25 aa, Giardia lamblia
ISTISLIRYILNPVPLPNSSSTLSI

SEQ ID NO: 3208578 - protein, 23 aa, Giardia lamblia
KATKAFCLCLPKMKNIGNACIPK

SEQ ID NO: 3208579 - protein, 23 aa, Giardia lamblia
KEHQLFDCVLLLEIVYTLIKSED

SEQ ID NO: 3208580 - protein, 19 aa, Giardia lamblia
KEILFVPIIIYPCTHVVCS

SEQ ID NO: 3208581 - protein, 19 aa, Giardia lamblia
KFTRLVGVVLLHVLALAVA

SEQ ID NO: 3208582 - protein, 17 aa, Giardia lamblia
KLSLLPLFVYAMLRTHM

SEQ ID NO: 3208583 - protein, 25 aa, Giardia lamblia
KMSQHRLLLFLRFLDSFVSDFVSQA

SEQ ID NO: 3208584 - protein, 17 aa, Giardia lamblia
KMSTGMPLPIFWKVYRA

SEQ ID NO: 3208585 - protein, 18 aa, Giardia lamblia
KNKEEIMHLLLFPTTRTM

SEQ ID NO: 3208586 - protein, 26 aa, Giardia lamblia
KPCQTYYIIMPFYRFYDLGTQICKKI

SEQ ID NO: 3208587 - protein, 17 aa, Giardia lamblia
KYLVLNKYFPFVNGILI

SEQ ID NO: 3208588 - protein, 17 aa, Giardia lamblia
LAGVGAVFLVQAVHAKC

SEQ ID NO: 3208589 - protein, 17 aa, Giardia lamblia
LDVIAAGLPPSGSIEVR

SEQ ID NO: 3208590 - protein, 17 aa, Giardia lamblia
LFFFNFELIRGEVRSVY

SEQ ID NO: 3208591 - protein, 18 aa, Giardia lamblia
LGKKFVHYLWGRPDPETQ

SEQ ID NO: 3208592 - protein, 18 aa, Giardia lamblia
LHDEAVFYLIYMGLGLPL

SEQ ID NO: 3208593 - protein, 18 aa, Giardia lamblia
LKRLLLDKYLPLVNPILA

SEQ ID NO: 3208594 - protein, 19 aa, Giardia lamblia
LLKRLLLDKYLPLVNPILA

SEQ ID NO: 3208595 - protein, 18 aa, Giardia lamblia
LLLFTTVLLARISRLASE

SEQ ID NO: 3208596 - protein, 17 aa, Giardia lamblia
LLLLLVTFCTLTIKKFD

SEQ ID NO: 3208597 - protein, 17 aa, Giardia lamblia
LLLYGTLGREPSPLREG

SEQ ID NO: 3208598 - protein, 17 aa, Giardia lamblia
LLLYGTLGREPSPLWEG

SEQ ID NO: 3208599 - protein, 17 aa, Giardia lamblia
LLSSFYHLMRDKCYDFA

SEQ ID NO: 3208600 - protein, 17 aa, Giardia lamblia
LPLIEVNILGITPLMEA

SEQ ID NO: 3208601 - protein, 25 aa, Giardia lamblia
LPVYCYNHFFFRYTLQLYKLVCHSC

SEQ ID NO: 3208602 - protein, 18 aa, Giardia lamblia
LQILAFDAIIDLGCGTYQ

SEQ ID NO: 3208603 - protein, 32 aa, Giardia lamblia
LSLAILLCLWLCKIFIIPLFTLSDRKASKRIR

SEQ ID NO: 3208604 - protein, 19 aa, Giardia lamblia
LSPSLWFLAIERSDRNTVR

SEQ ID NO: 3208605 - protein, 25 aa, Giardia lamblia
LSVSLPQFHFYLLKPQHKLDRGTST

SEQ ID NO: 3208606 - protein, 17 aa, Giardia lamblia
MIKILLPYEGRCQDSFG

SEQ ID NO: 3208607 - protein, 17 aa, Giardia lamblia
MIVCLLVLLAVIGGKQL

SEQ ID NO: 3208608 - protein, 17 aa, Giardia lamblia
MLPNDYLLYHLRGDVQP

SEQ ID NO: 3208609 - protein, 25 aa, Giardia lamblia
NIFQGMAFAWLFLGWALSVTFDVHE

SEQ ID NO: 3208610 - protein, 19 aa, Giardia lamblia
NLIFRRIRKDLFLSLREHF

SEQ ID NO: 3208611 - protein, 17 aa, Giardia lamblia
NPLIMLPNDYLLYHLRG

SEQ ID NO: 3208612 - protein, 21 aa, Giardia lamblia
NQHLFDLLFGEPIYHSSEASA

SEQ ID NO: 3208613 - protein, 23 aa, Giardia lamblia
NTKGTWRWEAYSMWPHLGRTNAT

SEQ ID NO: 3208614 - protein, 21 aa, Giardia lamblia
NVCGLIIYRATFLSPTTISGS

SEQ ID NO: 3208615 - protein, 34 aa, Giardia lamblia
NYRSLLNLQLDPLLKFIPEKLSLLPLFVYAMLRT

SEQ ID NO: 3208616 - protein, 17 aa, Giardia lamblia
PCIYRKLGGLFLFVIGA

SEQ ID NO: 3208617 - protein, 19 aa, Giardia lamblia
PIFRFFCQYPQQIRPLLRD

SEQ ID NO: 3208618 - protein, 17 aa, Giardia lamblia
PISPIWRAGPIKHVSGI

SEQ ID NO: 3208619 - protein, 20 aa, Giardia lamblia
PSYNTPFFDELWIVAGYPSV

SEQ ID NO: 3208620 - protein, 22 aa, Giardia lamblia
QGKLDELVILLRRLRVTTVSEK

SEQ ID NO: 3208621 - protein, 22 aa, Giardia lamblia
QTSLLALLLTLIAPSTLSQPRY

SEQ ID NO: 3208622 - protein, 19 aa, Giardia lamblia
QVLKYFVCLLNDGRFNPLI

SEQ ID NO: 3208623 - protein, 21 aa, Giardia lamblia
RACDWLLRFGFSSTFVSDLRS

SEQ ID NO: 3208624 - protein, 17 aa, Giardia lamblia
RALIFVPGFPSLNYYEK

SEQ ID NO: 3208625 - protein, 19 aa, Giardia lamblia
RAQCKLPLNLPLFSAEAIS

SEQ ID NO: 3208626 - protein, 17 aa, Giardia lamblia
RESFNSYLYIWHTKYDK

SEQ ID NO: 3208627 - protein, 19 aa, Giardia lamblia
RNLWLFFTKSLDYAKNPYI

SEQ ID NO: 3208628 - protein, 20 aa, Giardia lamblia
RQLYRFILLNNSASPWILNL

SEQ ID NO: 3208629 - protein, 17 aa, Giardia lamblia
SAFNIYLIPPKTRQLRS

SEQ ID NO: 3208630 - protein, 20 aa, Giardia lamblia
SALCFIIINSPLLRQKKMTT

SEQ ID NO: 3208631 - protein, 23 aa, Giardia lamblia
SFDSAYFKLLAYTKFIRSLVAPG

SEQ ID NO: 3208632 - protein, 25 aa, Giardia lamblia
SKNDQIFYFLYNTLLTAPHPLLFVS

SEQ ID NO: 3208633 - protein, 22 aa, Giardia lamblia
SSAAFLLKDAFKTSFRPTLSGA

SEQ ID NO: 3208634 - protein, 19 aa, Giardia lamblia
TALRLCRALLWPPGWPDLQ

SEQ ID NO: 3208635 - protein, 28 aa, Giardia lamblia
TYSAILKYDFRVFWSWRTKLDRDFYSAL

SEQ ID NO: 3208636 - protein, 17 aa, Giardia lamblia
VGAVFLVQAVHAKCCTV

SEQ ID NO: 3208637 - protein, 22 aa, Giardia lamblia
VNQLALVYFKLDRFPTPQSLTS

SEQ ID NO: 3208638 - protein, 17 aa, Giardia lamblia
VVCLYQSLSGHRSRCVL

SEQ ID NO: 3208639 - protein, 17 aa, Giardia lamblia
WLSPVHRLLLRRPIRVQ

SEQ ID NO: 3208640 - protein, 19 aa, Giardia lamblia
YNWSYLCRCDPLDAITLGP

SEQ ID NO: 3208641 - protein, 19 aa, Giardia lamblia
YRKKFLPSTLFIKTLLVPP

SEQ ID NO: 3208642 - protein, 22 aa, Giardia lamblia
YSQYFYSLYCELPIAKPNIVDY

SEQ ID NO: 3208643 - protein, 29 aa, Giardia lamblia
YYCSFVHQQYLWLVTPILEVNIQDLLLKL

SEQ ID NO: 3208644 - protein, 6 aa, Plasmodium falciparum
PGSPKY

SEQ ID NO: 3208645 - protein, 5 aa, Plasmodium falciparum
ADKVE

SEQ ID NO: 3208646 - protein, 12 aa, Plasmodium falciparum
DITSSSESEYEE

SEQ ID NO: 3208647 - protein, 12 aa, Plasmodium falciparum
GDSGTDSGYTDH

SEQ ID NO: 3208648 - protein, 6 aa, Plasmodium falciparum
SGKYRG

SEQ ID NO: 3208649 - protein, 4 aa, Plasmodium falciparum
EKEL

SEQ ID NO: 3208650 - protein, 4 aa, Plasmodium falciparum
TGEE

SEQ ID NO: 3208651 - protein, 5 aa, Plasmodium falciparum
EKELT

SEQ ID NO: 3208652 - protein, 22 aa, Plasmodium falciparum
EWENETHSGNTHPSDSNKTLNT

SEQ ID NO: 3208653 - protein, 13 aa, Plasmodium falciparum
KSDYDIPTKLSPN

SEQ ID NO: 3208654 - protein, 5 aa, Plasmodium falciparum
HMNSY

SEQ ID NO: 3208655 - protein, 6 aa, Plasmodium falciparum
LADKTE

SEQ ID NO: 3208656 - protein, 12 aa, Plasmodium falciparum
TDVTSSESEYEE

SEQ ID NO: 3208657 - protein, 6 aa, Plasmodium falciparum
DNDPEM

SEQ ID NO: 3208658 - protein, 6 aa, Plasmodium falciparum
KTKSTI

SEQ ID NO: 3208659 - protein, 7 aa, Plasmodium falciparum
VKMSSQN

SEQ ID NO: 3208660 - protein, 5 aa, Plasmodium falciparum
ADPEY

SEQ ID NO: 3208661 - protein, 5 aa, Plasmodium falciparum
PKPIN

SEQ ID NO: 3208662 - protein, 12 aa, Plasmodium falciparum
TDITSSESEYEE

SEQ ID NO: 3208663 - protein, 10 aa, Plasmodium falciparum
VDSNPDNSSM

SEQ ID NO: 3208664 - protein, 7 aa, Plasmodium falciparum
APRAPKY

SEQ ID NO: 3208665 - protein, 8 aa, Plasmodium falciparum
GDSSGDEK

SEQ ID NO: 3208666 - protein, 7 aa, Plasmodium falciparum
KTKSSVG

SEQ ID NO: 3208667 - protein, 4 aa, Plasmodium falciparum
LSGN

SEQ ID NO: 3208668 - protein, 15 aa, Plasmodium falciparum
MKTTRQKCKDKCDKE

SEQ ID NO: 3208669 - protein, 8 aa, Plasmodium falciparum
NTQNTEPN

SEQ ID NO: 3208670 - protein, 5 aa, Plasmodium falciparum
PEEKP

SEQ ID NO: 3208671 - protein, 7 aa, Plasmodium falciparum
RQTSQRF

SEQ ID NO: 3208672 - protein, 9 aa, Plasmodium falciparum
SNPNQVDDT

SEQ ID NO: 3208673 - protein, 6 aa, Plasmodium falciparum
VADKVE

SEQ ID NO: 3208674 - protein, 4 aa, Plasmodium falciparum
CDKE

SEQ ID NO: 3208675 - protein, 6 aa, Plasmodium falciparum
DRTSQR

SEQ ID NO: 3208676 - protein, 6 aa, Plasmodium falciparum
DRYKGK

SEQ ID NO: 3208677 - protein, 8 aa, Plasmodium falciparum
FENNDDVG

SEQ ID NO: 3208678 - protein, 13 aa, Plasmodium falciparum
KMKKKAQYTKLLN

SEQ ID NO: 3208679 - protein, 7 aa, Plasmodium falciparum
LDANTPK

SEQ ID NO: 3208680 - protein, 6 aa, Plasmodium falciparum
TNSDPI

SEQ ID NO: 3208681 - protein, 14 aa, Plasmodium falciparum
EKLQEQQSDLEQER

SEQ ID NO: 3208682 - protein, 4 aa, Plasmodium falciparum
NENK

SEQ ID NO: 3208683 - protein, 4 aa, Plasmodium falciparum
NNNN

SEQ ID NO: 3208684 - protein, 7 aa, Plasmodium falciparum
NPKTTNE

SEQ ID NO: 3208685 - protein, 9 aa, Plasmodium falciparum
TKNHNPHYH

SEQ ID NO: 3208686 - protein, 5 aa, Plasmodium falciparum
TLSGN

SEQ ID NO: 3208687 - protein, 9 aa, Plasmodium falciparum
TTNTFTDEE

SEQ ID NO: 3208688 - protein, 4 aa, Plasmodium falciparum
ADKV

SEQ ID NO: 3208689 - protein, 5 aa, Plasmodium falciparum
EINDD

SEQ ID NO: 3208690 - protein, 4 aa, Plasmodium falciparum
EKEK

SEQ ID NO: 3208691 - protein, 21 aa, Plasmodium falciparum
IRNKNKNDKGVENISSNTQME

SEQ ID NO: 3208692 - protein, 7 aa, Plasmodium falciparum
KNDNERL

SEQ ID NO: 3208693 - protein, 6 aa, Plasmodium falciparum
KQTQQR

SEQ ID NO: 3208694 - protein, 12 aa, Plasmodium falciparum
MNKKLQYTKLLN

SEQ ID NO: 3208695 - protein, 7 aa, Plasmodium falciparum
NHKSTTH

SEQ ID NO: 3208696 - protein, 18 aa, Plasmodium falciparum
NTSNGSLEQQFPISDVWN

SEQ ID NO: 3208697 - protein, 11 aa, Plasmodium falciparum
RDVKEKNESIN

SEQ ID NO: 3208698 - protein, 5 aa, Plasmodium falciparum
RQTQQ

SEQ ID NO: 3208699 - protein, 8 aa, Plasmodium falciparum
RQTSQRFE

SEQ ID NO: 3208700 - protein, 5 aa, Plasmodium falciparum
YNEPY

SEQ ID NO: 3208701 - protein, 6 aa, Plasmodium falciparum
ADPEYR

SEQ ID NO: 3208702 - protein, 6 aa, Plasmodium falciparum
DSRNNY

SEQ ID NO: 3208703 - protein, 9 aa, Plasmodium falciparum
FEKKDKSGV

SEQ ID NO: 3208704 - protein, 5 aa, Plasmodium falciparum
GASID

SEQ ID NO: 3208705 - protein, 6 aa, Plasmodium falciparum
HTETNR

SEQ ID NO: 3208706 - protein, 7 aa, Plasmodium falciparum
ISETNQN

SEQ ID NO: 3208707 - protein, 15 aa, Plasmodium falciparum
NNEEINKQRNMTNER

SEQ ID NO: 3208708 - protein, 4 aa, Plasmodium falciparum
NNIN

SEQ ID NO: 3208709 - protein, 9 aa, Plasmodium falciparum
NNLDTNNSE

SEQ ID NO: 3208710 - protein, 8 aa, Plasmodium falciparum
NNNNNNNN

SEQ ID NO: 3208711 - protein, 5 aa, Plasmodium falciparum
NQQQI

SEQ ID NO: 3208712 - protein, 27 aa, Plasmodium falciparum
NTDPNDEVERRNADNKEDLTSADPEGQ

SEQ ID NO: 3208713 - protein, 4 aa, Plasmodium falciparum
PFNE

SEQ ID NO: 3208714 - protein, 36 aa, Plasmodium falciparum
PSGNNTTASGKNTPSDTQNDIQNDGIPSSKITDNEW

SEQ ID NO: 3208715 - protein, 10 aa, Plasmodium falciparum
PTNYDSDPEM

SEQ ID NO: 3208716 - protein, 9 aa, Plasmodium falciparum
QKCKEQCDK

SEQ ID NO: 3208717 - protein, 5 aa, Plasmodium falciparum
SGEEY

SEQ ID NO: 3208718 - protein, 9 aa, Plasmodium falciparum
YQQTHDPYK

SEQ ID NO: 3208719 - protein, 8 aa, Plasmodium falciparum
YSNNEECK

SEQ ID NO: 3208720 - protein, 8 aa, Plasmodium falciparum
AKTKGRDK

SEQ ID NO: 3208721 - protein, 12 aa, Plasmodium falciparum
DDDKTSMDNNNN

SEQ ID NO: 3208722 - protein, 4 aa, Plasmodium falciparum
EKQM

SEQ ID NO: 3208723 - protein, 12 aa, Plasmodium falciparum
ENFDRQTSQRFE

SEQ ID NO: 3208724 - protein, 15 aa, Plasmodium falciparum
ENVEETKKDIPQNKN

SEQ ID NO: 3208725 - protein, 6 aa, Plasmodium falciparum
GDYDIP

SEQ ID NO: 3208726 - protein, 9 aa, Plasmodium falciparum
HDTSTVDTN

SEQ ID NO: 3208727 - protein, 11 aa, Plasmodium falciparum
HLTDEENKVEK

SEQ ID NO: 3208728 - protein, 4 aa, Plasmodium falciparum
HMNN

SEQ ID NO: 3208729 - protein, 6 aa, Plasmodium falciparum
KPKSPV

SEQ ID NO: 3208730 - protein, 4 aa, Plasmodium falciparum
NEPY

SEQ ID NO: 3208731 - protein, 7 aa, Plasmodium falciparum
NNNNNNI

SEQ ID NO: 3208732 - protein, 4 aa, Plasmodium falciparum
NNNQ

SEQ ID NO: 3208733 - protein, 4 aa, Plasmodium falciparum
NNNT

SEQ ID NO: 3208734 - protein, 6 aa, Plasmodium falciparum
NPKPIN

SEQ ID NO: 3208735 - protein, 4 aa, Plasmodium falciparum
NQPN

SEQ ID NO: 3208736 - protein, 7 aa, Plasmodium falciparum
PNITSGR

SEQ ID NO: 3208737 - protein, 10 aa, Plasmodium falciparum
PSNYDNDPEM

SEQ ID NO: 3208738 - protein, 4 aa, Plasmodium falciparum
SDPQ

SEQ ID NO: 3208739 - protein, 6 aa, Plasmodium falciparum
TKASVG

SEQ ID NO: 3208740 - protein, 9 aa, Plasmodium falciparum
TKINTRRAS

SEQ ID NO: 3208741 - protein, 4 aa, Plasmodium falciparum
VSEI

SEQ ID NO: 3208742 - protein, 9 aa, Plasmodium falciparum
YQQTHDPYE

SEQ ID NO: 3208743 - protein, 9 aa, Plasmodium falciparum
ATYDDDPQM

SEQ ID NO: 3208744 - protein, 6 aa, Plasmodium falciparum
DEDTNE

SEQ ID NO: 3208745 - protein, 4 aa, Plasmodium falciparum
DKLN

SEQ ID NO: 3208746 - protein, 8 aa, Plasmodium falciparum
DNNTHPTM

SEQ ID NO: 3208747 - protein, 4 aa, Plasmodium falciparum
EICD

SEQ ID NO: 3208748 - protein, 18 aa, Plasmodium falciparum
EKNGTKYTGGNDAEPMST

SEQ ID NO: 3208749 - protein, 5 aa, Plasmodium falciparum
ESDNI

SEQ ID NO: 3208750 - protein, 6 aa, Plasmodium falciparum
GDTDEE

SEQ ID NO: 3208751 - protein, 14 aa, Plasmodium falciparum
GMSPNVDEKSSTCE

SEQ ID NO: 3208752 - protein, 13 aa, Plasmodium falciparum
HDASTVDSNNMDV

SEQ ID NO: 3208753 - protein, 5 aa, Plasmodium falciparum
IDTND

SEQ ID NO: 3208754 - protein, 9 aa, Plasmodium falciparum
KDDSGEDRQ

SEQ ID NO: 3208755 - protein, 4 aa, Plasmodium falciparum
KELT

SEQ ID NO: 3208756 - protein, 4 aa, Plasmodium falciparum
KKKK

SEQ ID NO: 3208757 - protein, 8 aa, Plasmodium falciparum
KLDTNNSE

SEQ ID NO: 3208758 - protein, 9 aa, Plasmodium falciparum
KNDDEMNNH

SEQ ID NO: 3208759 - protein, 15 aa, Plasmodium falciparum
KNTEEGRKKERQKPM

SEQ ID NO: 3208760 - protein, 6 aa, Plasmodium falciparum
KYINDE

SEQ ID NO: 3208761 - protein, 8 aa, Plasmodium falciparum
LNSGNQPI

SEQ ID NO: 3208762 - protein, 15 aa, Plasmodium falciparum
LQEKRQKRKEQRDKN

SEQ ID NO: 3208763 - protein, 12 aa, Plasmodium falciparum
NDNDDDNDQPSV

SEQ ID NO: 3208764 - protein, 9 aa, Plasmodium falciparum
NDNNNTNNI

SEQ ID NO: 3208765 - protein, 5 aa, Plasmodium falciparum
NHIKN

SEQ ID NO: 3208766 - protein, 12 aa, Plasmodium falciparum
NHNSTTPHHPPN

SEQ ID NO: 3208767 - protein, 15 aa, Plasmodium falciparum
NKKKKKNNNNNNNNN

SEQ ID NO: 3208768 - protein, 4 aa, Plasmodium falciparum
NKNI

SEQ ID NO: 3208769 - protein, 5 aa, Plasmodium falciparum
NNDNM

SEQ ID NO: 3208770 - protein, 8 aa, Plasmodium falciparum
NNLSNNNK

SEQ ID NO: 3208771 - protein, 6 aa, Plasmodium falciparum
NNNNNN

SEQ ID NO: 3208772 - protein, 8 aa, Plasmodium falciparum
NSLDDDER

SEQ ID NO: 3208773 - protein, 21 aa, Plasmodium falciparum
NVQTTSQPKDVDDNGPNDPFY

SEQ ID NO: 3208774 - protein, 8 aa, Plasmodium falciparum
RTPKATTR

SEQ ID NO: 3208775 - protein, 6 aa, Plasmodium falciparum
SDIINN

SEQ ID NO: 3208776 - protein, 12 aa, Plasmodium falciparum
SDYDIPTKLSPN

SEQ ID NO: 3208777 - protein, 6 aa, Plasmodium falciparum
SLNSNN

SEQ ID NO: 3208778 - protein, 10 aa, Plasmodium falciparum
STNTNNDIPK

SEQ ID NO: 3208779 - protein, 14 aa, Plasmodium falciparum
TDPNDETSADPEGQ

SEQ ID NO: 3208780 - protein, 10 aa, Plasmodium falciparum
TNSMDDPKYV

SEQ ID NO: 3208781 - protein, 5 aa, Plasmodium falciparum
TPTMD

SEQ ID NO: 3208782 - protein, 7 aa, Plasmodium falciparum
TQNHNPH

SEQ ID NO: 3208783 - protein, 5 aa, Plasmodium falciparum
TTQRF

SEQ ID NO: 3208784 - protein, 6 aa, Plasmodium falciparum
VADKTE

SEQ ID NO: 3208785 - protein, 7 aa, Plasmodium falciparum
YKKNKYH

SEQ ID NO: 3208786 - protein, 7 aa, Plasmodium falciparum
YKNENNH

SEQ ID NO: 3208787 - protein, 4 aa, Plasmodium falciparum
YNNN

SEQ ID NO: 3208788 - protein, 10 aa, Plasmodium falciparum
YSNNEECKEQ

SEQ ID NO: 3208789 - protein, 4 aa, Plasmodium falciparum
ADKM

SEQ ID NO: 3208790 - protein, 10 aa, Plasmodium falciparum
AKAAADAGLK

SEQ ID NO: 3208791 - protein, 6 aa, Plasmodium falciparum
DDDPEM

SEQ ID NO: 3208792 - protein, 4 aa, Plasmodium falciparum
DKIQ

SEQ ID NO: 3208793 - protein, 5 aa, Plasmodium falciparum
DRTTQ

SEQ ID NO: 3208794 - protein, 9 aa, Plasmodium falciparum
DSDSGHYYE

SEQ ID NO: 3208795 - protein, 7 aa, Plasmodium falciparum
DTYCNED

SEQ ID NO: 3208796 - protein, 7 aa, Plasmodium falciparum
EEGSYNE

SEQ ID NO: 3208797 - protein, 8 aa, Plasmodium falciparum
EERPSNED

SEQ ID NO: 3208798 - protein, 11 aa, Plasmodium falciparum
ENFDRQTSQRF

SEQ ID NO: 3208799 - protein, 5 aa, Plasmodium falciparum
ENINK

SEQ ID NO: 3208800 - protein, 7 aa, Plasmodium falciparum
EVEEEGS

SEQ ID NO: 3208801 - protein, 7 aa, Plasmodium falciparum
GEETDDY

SEQ ID NO: 3208802 - protein, 4 aa, Plasmodium falciparum
GEEY

SEQ ID NO: 3208803 - protein, 10 aa, Plasmodium falciparum
GLRGNNGKVE

SEQ ID NO: 3208804 - protein, 31 aa, Plasmodium falciparum
GNNPINISDSTNSMDSLTSNNHSPYNDKNDL

SEQ ID NO: 3208805 - protein, 4 aa, Plasmodium falciparum
INNN

SEQ ID NO: 3208806 - protein, 10 aa, Plasmodium falciparum
ITQEKKDKIK

SEQ ID NO: 3208807 - protein, 13 aa, Plasmodium falciparum
KAGNATSSLSTGI

SEQ ID NO: 3208808 - protein, 4 aa, Plasmodium falciparum
KDNT

SEQ ID NO: 3208809 - protein, 4 aa, Plasmodium falciparum
KENN

SEQ ID NO: 3208810 - protein, 4 aa, Plasmodium falciparum
KEPY

SEQ ID NO: 3208811 - protein, 18 aa, Plasmodium falciparum
KGQKYGSKNVRSFSSQGI

SEQ ID NO: 3208812 - protein, 6 aa, Plasmodium falciparum
KKEEWD

SEQ ID NO: 3208813 - protein, 8 aa, Plasmodium falciparum
KKKNLDPQ

SEQ ID NO: 3208814 - protein, 14 aa, Plasmodium falciparum
KKMNKKQQYTKLLN

SEQ ID NO: 3208815 - protein, 9 aa, Plasmodium falciparum
KKPHTTARH

SEQ ID NO: 3208816 - protein, 6 aa, Plasmodium falciparum
KKPITQ

SEQ ID NO: 3208817 - protein, 8 aa, Plasmodium falciparum
KLTNSDPI

SEQ ID NO: 3208818 - protein, 4 aa, Plasmodium falciparum
KNEE

SEQ ID NO: 3208819 - protein, 11 aa, Plasmodium falciparum
KNTNKKPFGNT

SEQ ID NO: 3208820 - protein, 9 aa, Plasmodium falciparum
KNTYSDDAI

SEQ ID NO: 3208821 - protein, 4 aa, Plasmodium falciparum
KNYN

SEQ ID NO: 3208822 - protein, 7 aa, Plasmodium falciparum
KQTQQRF

SEQ ID NO: 3208823 - protein, 7 aa, Plasmodium falciparum
KTKASVG

SEQ ID NO: 3208824 - protein, 6 aa, Plasmodium falciparum
LSDKVE

SEQ ID NO: 3208825 - protein, 13 aa, Plasmodium falciparum
MKTTRQKCREQCD

SEQ ID NO: 3208826 - protein, 11 aa, Plasmodium falciparum
NDDNTKERTSI

SEQ ID NO: 3208827 - protein, 4 aa, Plasmodium falciparum
NEEM

SEQ ID NO: 3208828 - protein, 4 aa, Plasmodium falciparum
NETD

SEQ ID NO: 3208829 - protein, 4 aa, Plasmodium falciparum
NIEE

SEQ ID NO: 3208830 - protein, 4 aa, Plasmodium falciparum
NIYK

SEQ ID NO: 3208831 - protein, 4 aa, Plasmodium falciparum
NKEE

SEQ ID NO: 3208832 - protein, 4 aa, Plasmodium falciparum
NKNN

SEQ ID NO: 3208833 - protein, 5 aa, Plasmodium falciparum
NNNNN

SEQ ID NO: 3208834 - protein, 7 aa, Plasmodium falciparum
NNNNNNN

SEQ ID NO: 3208835 - protein, 9 aa, Plasmodium falciparum
NNNNNNQGN

SEQ ID NO: 3208836 - protein, 4 aa, Plasmodium falciparum
NNQN

SEQ ID NO: 3208837 - protein, 9 aa, Plasmodium falciparum
NREKTLGKH

SEQ ID NO: 3208838 - protein, 8 aa, Plasmodium falciparum
NRQTSDRF

SEQ ID NO: 3208839 - protein, 5 aa, Plasmodium falciparum
NVTDC

SEQ ID NO: 3208840 - protein, 10 aa, Plasmodium falciparum
PANYDNDPQM

SEQ ID NO: 3208841 - protein, 30 aa, Plasmodium falciparum
PNTEPNNNYRSGNSPTNTNNTTTSHDNMGE

SEQ ID NO: 3208842 - protein, 10 aa, Plasmodium falciparum
PSKSNGNTLG

SEQ ID NO: 3208843 - protein, 8 aa, Plasmodium falciparum
QKIPTTRS

SEQ ID NO: 3208844 - protein, 4 aa, Plasmodium falciparum
RDNK

SEQ ID NO: 3208845 - protein, 4 aa, Plasmodium falciparum
RYKG

SEQ ID NO: 3208846 - protein, 22 aa, Plasmodium falciparum
SEQPKDVPNDYSSGDIPFNTQP

SEQ ID NO: 3208847 - protein, 6 aa, Plasmodium falciparum
SETENV

SEQ ID NO: 3208848 - protein, 5 aa, Plasmodium falciparum
SGSPK

SEQ ID NO: 3208849 - protein, 4 aa, Plasmodium falciparum
SNEE

SEQ ID NO: 3208850 - protein, 9 aa, Plasmodium falciparum
SSEGYNSKD

SEQ ID NO: 3208851 - protein, 14 aa, Plasmodium falciparum
SSGNTSTNKLTDNE

SEQ ID NO: 3208852 - protein, 8 aa, Plasmodium falciparum
SSTDREDT

SEQ ID NO: 3208853 - protein, 6 aa, Plasmodium falciparum
TAYGGY

SEQ ID NO: 3208854 - protein, 9 aa, Plasmodium falciparum
TQEKKDKIK

SEQ ID NO: 3208855 - protein, 5 aa, Plasmodium falciparum
TYKGK

SEQ ID NO: 3208856 - protein, 5 aa, Plasmodium falciparum
VADKV

SEQ ID NO: 3208857 - protein, 4 aa, Plasmodium falciparum
VTPE

SEQ ID NO: 3208858 - protein, 5 aa, Plasmodium falciparum
YEGES

SEQ ID NO: 3208859 - protein, 10 aa, Plasmodium falciparum
YKKNTSNNNV

SEQ ID NO: 3208860 - protein, 9 aa, Plasmodium falciparum
ADDKNGGNN

SEQ ID NO: 3208861 - protein, 4 aa, Plasmodium falciparum
AKND

SEQ ID NO: 3208862 - protein, 9 aa, Plasmodium falciparum
ASPQPAPCS

SEQ ID NO: 3208863 - protein, 4 aa, Plasmodium falciparum
ATST

SEQ ID NO: 3208864 - protein, 4 aa, Plasmodium falciparum
CEEY

SEQ ID NO: 3208865 - protein, 5 aa, Plasmodium falciparum
CMPPR

SEQ ID NO: 3208866 - protein, 6 aa, Plasmodium falciparum
DDPKYV

SEQ ID NO: 3208867 - protein, 7 aa, Plasmodium falciparum
DENPSVD

SEQ ID NO: 3208868 - protein, 7 aa, Plasmodium falciparum
DETNNNN

SEQ ID NO: 3208869 - protein, 4 aa, Plasmodium falciparum
DGMD

SEQ ID NO: 3208870 - protein, 7 aa, Plasmodium falciparum
DHNGYQD

SEQ ID NO: 3208871 - protein, 7 aa, Plasmodium falciparum
DIEKGNV

SEQ ID NO: 3208872 - protein, 11 aa, Plasmodium falciparum
DITSSESEYEE

SEQ ID NO: 3208873 - protein, 16 aa, Plasmodium falciparum
DKGGKGSKKKNPDDQI

SEQ ID NO: 3208874 - protein, 4 aa, Plasmodium falciparum
DKKK

SEQ ID NO: 3208875 - protein, 21 aa, Plasmodium falciparum
DKNNPVDSNNSTYNHRNPADI

SEQ ID NO: 3208876 - protein, 7 aa, Plasmodium falciparum
DKSLAEK

SEQ ID NO: 3208877 - protein, 8 aa, Plasmodium falciparum
DLNSGEEI

SEQ ID NO: 3208878 - protein, 7 aa, Plasmodium falciparum
DNDAEMK

SEQ ID NO: 3208879 - protein, 8 aa, Plasmodium falciparum
DNDISTVD

SEQ ID NO: 3208880 - protein, 6 aa, Plasmodium falciparum
DNDPQM

SEQ ID NO: 3208881 - protein, 4 aa, Plasmodium falciparum
DNER

SEQ ID NO: 3208882 - protein, 11 aa, Plasmodium falciparum
DNLTNSQTNYM

SEQ ID NO: 3208883 - protein, 4 aa, Plasmodium falciparum
DNNI

SEQ ID NO: 3208884 - protein, 5 aa, Plasmodium falciparum
DQYRT

SEQ ID NO: 3208885 - protein, 4 aa, Plasmodium falciparum
DTKY

SEQ ID NO: 3208886 - protein, 4 aa, Plasmodium falciparum
DTNN

SEQ ID NO: 3208887 - protein, 5 aa, Plasmodium falciparum
DYENM

SEQ ID NO: 3208888 - protein, 11 aa, Plasmodium falciparum
DYKMKDENDFK

SEQ ID NO: 3208889 - protein, 5 aa, Plasmodium falciparum
EDNER

SEQ ID NO: 3208890 - protein, 6 aa, Plasmodium falciparum
EEDIES

SEQ ID NO: 3208891 - protein, 14 aa, Plasmodium falciparum
EEGSVSGEVDETEY

SEQ ID NO: 3208892 - protein, 4 aa, Plasmodium falciparum
EENN

SEQ ID NO: 3208893 - protein, 15 aa, Plasmodium falciparum
EGAETAKAAGEAARI

SEQ ID NO: 3208894 - protein, 6 aa, Plasmodium falciparum
EKCTQE

SEQ ID NO: 3208895 - protein, 8 aa, Plasmodium falciparum
EKEEVPKI

SEQ ID NO: 3208896 - protein, 4 aa, Plasmodium falciparum
EKKK

SEQ ID NO: 3208897 - protein, 4 aa, Plasmodium falciparum
EKKY

SEQ ID NO: 3208898 - protein, 14 aa, Plasmodium falciparum
EKLQGQQSDLEQER

SEQ ID NO: 3208899 - protein, 18 aa, Plasmodium falciparum
EKNGTKYTGGKDAEPMST

SEQ ID NO: 3208900 - protein, 4 aa, Plasmodium falciparum
EKNI

SEQ ID NO: 3208901 - protein, 5 aa, Plasmodium falciparum
EKTKN

SEQ ID NO: 3208902 - protein, 13 aa, Plasmodium falciparum
ENKNVEDNKDEEV

SEQ ID NO: 3208903 - protein, 4 aa, Plasmodium falciparum
ENNN

SEQ ID NO: 3208904 - protein, 4 aa, Plasmodium falciparum
ERKN

SEQ ID NO: 3208905 - protein, 6 aa, Plasmodium falciparum
ESKSPM

SEQ ID NO: 3208906 - protein, 9 aa, Plasmodium falciparum
ETEKGDISV

SEQ ID NO: 3208907 - protein, 33 aa, Plasmodium falciparum
FDERNQQVNDRRNFDERNQQVNDRRNFDDRDQN

SEQ ID NO: 3208908 - protein, 4 aa, Plasmodium falciparum
FNCQ

SEQ ID NO: 3208909 - protein, 10 aa, Plasmodium falciparum
GDNKMNGGNI

SEQ ID NO: 3208910 - protein, 8 aa, Plasmodium falciparum
GKTKGRDK

SEQ ID NO: 3208911 - protein, 7 aa, Plasmodium falciparum
GPKAPTS

SEQ ID NO: 3208912 - protein, 13 aa, Plasmodium falciparum
GQNEDKKNKENYN

SEQ ID NO: 3208913 - protein, 4 aa, Plasmodium falciparum
HNDP

SEQ ID NO: 3208914 - protein, 5 aa, Plasmodium falciparum
HNGEE

SEQ ID NO: 3208915 - protein, 4 aa, Plasmodium falciparum
HNNN

SEQ ID NO: 3208916 - protein, 10 aa, Plasmodium falciparum
HRRRGYDDDT

SEQ ID NO: 3208917 - protein, 20 aa, Plasmodium falciparum
HTKKNTSTNSVAKNTNSDPI

SEQ ID NO: 3208918 - protein, 4 aa, Plasmodium falciparum
IDCG

SEQ ID NO: 3208919 - protein, 4 aa, Plasmodium falciparum
IEKE

SEQ ID NO: 3208920 - protein, 4 aa, Plasmodium falciparum
INEQ

SEQ ID NO: 3208921 - protein, 5 aa, Plasmodium falciparum
INEQE

SEQ ID NO: 3208922 - protein, 6 aa, Plasmodium falciparum
IQDTIQ

SEQ ID NO: 3208923 - protein, 4 aa, Plasmodium falciparum
IQTN

SEQ ID NO: 3208924 - protein, 5 aa, Plasmodium falciparum
ITTDD

SEQ ID NO: 3208925 - protein, 5 aa, Plasmodium falciparum
IYESD

SEQ ID NO: 3208926 - protein, 9 aa, Plasmodium falciparum
KCPNEENKN

SEQ ID NO: 3208927 - protein, 7 aa, Plasmodium falciparum
KDADMKS

SEQ ID NO: 3208928 - protein, 4 aa, Plasmodium falciparum
KDNI

SEQ ID NO: 3208929 - protein, 5 aa, Plasmodium falciparum
KEDNI

SEQ ID NO: 3208930 - protein, 4 aa, Plasmodium falciparum
KEEK

SEQ ID NO: 3208931 - protein, 4 aa, Plasmodium falciparum
KEND

SEQ ID NO: 3208932 - protein, 4 aa, Plasmodium falciparum
KEYK

SEQ ID NO: 3208933 - protein, 12 aa, Plasmodium falciparum
KFGDNREKTLGK

SEQ ID NO: 3208934 - protein, 4 aa, Plasmodium falciparum
KIDT

SEQ ID NO: 3208935 - protein, 11 aa, Plasmodium falciparum
KKAERKKRKKE

SEQ ID NO: 3208936 - protein, 7 aa, Plasmodium falciparum
KKEYSNK

SEQ ID NO: 3208937 - protein, 7 aa, Plasmodium falciparum
KKKEIEE

SEQ ID NO: 3208938 - protein, 6 aa, Plasmodium falciparum
KKKKEK

SEQ ID NO: 3208939 - protein, 6 aa, Plasmodium falciparum
KKKKKK

SEQ ID NO: 3208940 - protein, 7 aa, Plasmodium falciparum
KKKLEKL

SEQ ID NO: 3208941 - protein, 5 aa, Plasmodium falciparum
KKKNK

SEQ ID NO: 3208942 - protein, 7 aa, Plasmodium falciparum
KKKVQNL

SEQ ID NO: 3208943 - protein, 4 aa, Plasmodium falciparum
KKKY

SEQ ID NO: 3208944 - protein, 4 aa, Plasmodium falciparum
KKLN

SEQ ID NO: 3208945 - protein, 4 aa, Plasmodium falciparum
KKNE

SEQ ID NO: 3208946 - protein, 5 aa, Plasmodium falciparum
KKNIN

SEQ ID NO: 3208947 - protein, 8 aa, Plasmodium falciparum
KKPSITPR

SEQ ID NO: 3208948 - protein, 4 aa, Plasmodium falciparum
KKQM

SEQ ID NO: 3208949 - protein, 4 aa, Plasmodium falciparum
KKRK

SEQ ID NO: 3208950 - protein, 6 aa, Plasmodium falciparum
KKRLEK

SEQ ID NO: 3208951 - protein, 5 aa, Plasmodium falciparum
KKTEW

SEQ ID NO: 3208952 - protein, 6 aa, Plasmodium falciparum
KKTEWG

SEQ ID NO: 3208953 - protein, 4 aa, Plasmodium falciparum
KKYN

SEQ ID NO: 3208954 - protein, 8 aa, Plasmodium falciparum
KLDTSSKN

SEQ ID NO: 3208955 - protein, 9 aa, Plasmodium falciparum
KMGRTSTTK

SEQ ID NO: 3208956 - protein, 13 aa, Plasmodium falciparum
KMKKKAEYTKLLN

SEQ ID NO: 3208957 - protein, 7 aa, Plasmodium falciparum
KMNETDE

SEQ ID NO: 3208958 - protein, 6 aa, Plasmodium falciparum
KNDCNT

SEQ ID NO: 3208959 - protein, 4 aa, Plasmodium falciparum
KNDN

SEQ ID NO: 3208960 - protein, 4 aa, Plasmodium falciparum
KNEN

SEQ ID NO: 3208961 - protein, 15 aa, Plasmodium falciparum
KNEPHTTPNHTQTTR

SEQ ID NO: 3208962 - protein, 4 aa, Plasmodium falciparum
KNGN

SEQ ID NO: 3208963 - protein, 4 aa, Plasmodium falciparum
KNIQ

SEQ ID NO: 3208964 - protein, 4 aa, Plasmodium falciparum
KNKD

SEQ ID NO: 3208965 - protein, 7 aa, Plasmodium falciparum
KNKKEEL

SEQ ID NO: 3208966 - protein, 5 aa, Plasmodium falciparum
KNKNI

SEQ ID NO: 3208967 - protein, 15 aa, Plasmodium falciparum
KNKPSITSHHTQTNR

SEQ ID NO: 3208968 - protein, 4 aa, Plasmodium falciparum
KNKQ

SEQ ID NO: 3208969 - protein, 7 aa, Plasmodium falciparum
KNKRDEE

SEQ ID NO: 3208970 - protein, 5 aa, Plasmodium falciparum
KNKTL

SEQ ID NO: 3208971 - protein, 4 aa, Plasmodium falciparum
KNNI

SEQ ID NO: 3208972 - protein, 4 aa, Plasmodium falciparum
KNSK

SEQ ID NO: 3208973 - protein, 8 aa, Plasmodium falciparum
KPISDDPI

SEQ ID NO: 3208974 - protein, 5 aa, Plasmodium falciparum
KREEW

SEQ ID NO: 3208975 - protein, 12 aa, Plasmodium falciparum
KSKNSGVNIPSE

SEQ ID NO: 3208976 - protein, 6 aa, Plasmodium falciparum
KSPKYK

SEQ ID NO: 3208977 - protein, 7 aa, Plasmodium falciparum
KSPNRYV

SEQ ID NO: 3208978 - protein, 9 aa, Plasmodium falciparum
KTENENQQL

SEQ ID NO: 3208979 - protein, 7 aa, Plasmodium falciparum
KTKRATI

SEQ ID NO: 3208980 - protein, 6 aa, Plasmodium falciparum
KTKSSV

SEQ ID NO: 3208981 - protein, 4 aa, Plasmodium falciparum
KTSF

SEQ ID NO: 3208982 - protein, 15 aa, Plasmodium falciparum
KWENDNDGGNVPSDN

SEQ ID NO: 3208983 - protein, 8 aa, Plasmodium falciparum
KYAKNNSR

SEQ ID NO: 3208984 - protein, 9 aa, Plasmodium falciparum
KYKEQRDKD

SEQ ID NO: 3208985 - protein, 8 aa, Plasmodium falciparum
KYQYGKEK

SEQ ID NO: 3208986 - protein, 4 aa, Plasmodium falciparum
KYSE

SEQ ID NO: 3208987 - protein, 9 aa, Plasmodium falciparum
KYSNYSNEA

SEQ ID NO: 3208988 - protein, 4 aa, Plasmodium falciparum
LANK

SEQ ID NO: 3208989 - protein, 10 aa, Plasmodium falciparum
LDNGNKNNVD

SEQ ID NO: 3208990 - protein, 8 aa, Plasmodium falciparum
LKEQHNKV

SEQ ID NO: 3208991 - protein, 5 aa, Plasmodium falciparum
LSGNH

SEQ ID NO: 3208992 - protein, 11 aa, Plasmodium falciparum
MDTTPNKSTMD

SEQ ID NO: 3208993 - protein, 15 aa, Plasmodium falciparum
MKGKRQKRKEERDKN

SEQ ID NO: 3208994 - protein, 14 aa, Plasmodium falciparum
MKTTRQKCKEQCDK

SEQ ID NO: 3208995 - protein, 14 aa, Plasmodium falciparum
MNKNRQKCKEQCDR

SEQ ID NO: 3208996 - protein, 8 aa, Plasmodium falciparum
MPKRKEKE

SEQ ID NO: 3208997 - protein, 4 aa, Plasmodium falciparum
MPPR

SEQ ID NO: 3208998 - protein, 4 aa, Plasmodium falciparum
MQSK

SEQ ID NO: 3208999 - protein, 13 aa, Plasmodium falciparum
MSTNSGNNDLYNG

SEQ ID NO: 3209000 - protein, 10 aa, Plasmodium falciparum
MTPSSHKVPK

SEQ ID NO: 3209001 - protein, 5 aa, Plasmodium falciparum
NDDNI

SEQ ID NO: 3209002 - protein, 4 aa, Plasmodium falciparum
NDEW

SEQ ID NO: 3209003 - protein, 6 aa, Plasmodium falciparum
NDITPH

SEQ ID NO: 3209004 - protein, 6 aa, Plasmodium falciparum
NDNERL

SEQ ID NO: 3209005 - protein, 7 aa, Plasmodium falciparum
NDRTAQR

SEQ ID NO: 3209006 - protein, 4 aa, Plasmodium falciparum
NEDD

SEQ ID NO: 3209007 - protein, 4 aa, Plasmodium falciparum
NEED

SEQ ID NO: 3209008 - protein, 9 aa, Plasmodium falciparum
NEKEEVPKI

SEQ ID NO: 3209009 - protein, 4 aa, Plasmodium falciparum
NEKI

SEQ ID NO: 3209010 - protein, 4 aa, Plasmodium falciparum
NENI

SEQ ID NO: 3209011 - protein, 4 aa, Plasmodium falciparum
NENR

SEQ ID NO: 3209012 - protein, 4 aa, Plasmodium falciparum
NENY

SEQ ID NO: 3209013 - protein, 8 aa, Plasmodium falciparum
NEPNTEPN

SEQ ID NO: 3209014 - protein, 5 aa, Plasmodium falciparum
NEQKI

SEQ ID NO: 3209015 - protein, 7 aa, Plasmodium falciparum
NGVENGT

SEQ ID NO: 3209016 - protein, 12 aa, Plasmodium falciparum
NGVGTKKKCNNI

SEQ ID NO: 3209017 - protein, 7 aa, Plasmodium falciparum
NHNSTTH

SEQ ID NO: 3209018 - protein, 5 aa, Plasmodium falciparum
NICSD

SEQ ID NO: 3209019 - protein, 4 aa, Plasmodium falciparum
NINN

SEQ ID NO: 3209020 - protein, 5 aa, Plasmodium falciparum
NINNN

SEQ ID NO: 3209021 - protein, 5 aa, Plasmodium falciparum
NIQQD

SEQ ID NO: 3209022 - protein, 5 aa, Plasmodium falciparum
NITND

SEQ ID NO: 3209023 - protein, 5 aa, Plasmodium falciparum
NIYNN

SEQ ID NO: 3209024 - protein, 15 aa, Plasmodium falciparum
NKIEGDNKNKIEDDI

SEQ ID NO: 3209025 - protein, 4 aa, Plasmodium falciparum
NKNE

SEQ ID NO: 3209026 - protein, 4 aa, Plasmodium falciparum
NKNK

SEQ ID NO: 3209027 - protein, 4 aa, Plasmodium falciparum
NKNT

SEQ ID NO: 3209028 - protein, 7 aa, Plasmodium falciparum
NKNTGNL

SEQ ID NO: 3209029 - protein, 4 aa, Plasmodium falciparum
NKRN

SEQ ID NO: 3209030 - protein, 8 aa, Plasmodium falciparum
NLKTDEIN

SEQ ID NO: 3209031 - protein, 4 aa, Plasmodium falciparum
NLNN

SEQ ID NO: 3209032 - protein, 4 aa, Plasmodium falciparum
NLSN

SEQ ID NO: 3209033 - protein, 6 aa, Plasmodium falciparum
NNDNVD

SEQ ID NO: 3209034 - protein, 4 aa, Plasmodium falciparum
NNEE

SEQ ID NO: 3209035 - protein, 4 aa, Plasmodium falciparum
NNHN

SEQ ID NO: 3209036 - protein, 4 aa, Plasmodium falciparum
NNIS

SEQ ID NO: 3209037 - protein, 8 aa, Plasmodium falciparum
NNLYSGQN

SEQ ID NO: 3209038 - protein, 4 aa, Plasmodium falciparum
NNNH

SEQ ID NO: 3209039 - protein, 4 aa, Plasmodium falciparum
NNNI

SEQ ID NO: 3209040 - protein, 4 aa, Plasmodium falciparum
NNNK

SEQ ID NO: 3209041 - protein, 9 aa, Plasmodium falciparum
NNNNNNNNI

SEQ ID NO: 3209042 - protein, 9 aa, Plasmodium falciparum
NNNNNNNNN

SEQ ID NO: 3209043 - protein, 6 aa, Plasmodium falciparum
NNTNNN

SEQ ID NO: 3209044 - protein, 8 aa, Plasmodium falciparum
NQHPIEKP

SEQ ID NO: 3209045 - protein, 4 aa, Plasmodium falciparum
NSSN

SEQ ID NO: 3209046 - protein, 7 aa, Plasmodium falciparum
NSTGNNI

SEQ ID NO: 3209047 - protein, 4 aa, Plasmodium falciparum
NSYN

SEQ ID NO: 3209048 - protein, 7 aa, Plasmodium falciparum
NTKRTTI

SEQ ID NO: 3209049 - protein, 18 aa, Plasmodium falciparum
NTSNGSLEPEFPISDVWN

SEQ ID NO: 3209050 - protein, 5 aa, Plasmodium falciparum
NYNTV

SEQ ID NO: 3209051 - protein, 10 aa, Plasmodium falciparum
PANYDSDPEM

SEQ ID NO: 3209052 - protein, 5 aa, Plasmodium falciparum
PDEKP

SEQ ID NO: 3209053 - protein, 5 aa, Plasmodium falciparum
PKNIT

SEQ ID NO: 3209054 - protein, 18 aa, Plasmodium falciparum
PSDIPSGKQSDIPSDNNI

SEQ ID NO: 3209055 - protein, 18 aa, Plasmodium falciparum
PSKSNGNTPSKGDGNTLG

SEQ ID NO: 3209056 - protein, 9 aa, Plasmodium falciparum
PSSANQNVE

SEQ ID NO: 3209057 - protein, 6 aa, Plasmodium falciparum
PSSSHD

SEQ ID NO: 3209058 - protein, 4 aa, Plasmodium falciparum
PSTG

SEQ ID NO: 3209059 - protein, 4 aa, Plasmodium falciparum
PTTT

SEQ ID NO: 3209060 - protein, 5 aa, Plasmodium falciparum
QDTIQ

SEQ ID NO: 3209061 - protein, 5 aa, Plasmodium falciparum
QEGMQ

SEQ ID NO: 3209062 - protein, 4 aa, Plasmodium falciparum
QEKP

SEQ ID NO: 3209063 - protein, 9 aa, Plasmodium falciparum
QKCKDQCDK

SEQ ID NO: 3209064 - protein, 9 aa, Plasmodium falciparum
QKCKEQCEK

SEQ ID NO: 3209065 - protein, 6 aa, Plasmodium falciparum
QKEEIE

SEQ ID NO: 3209066 - protein, 10 aa, Plasmodium falciparum
QNGNKKCGKK

SEQ ID NO: 3209067 - protein, 4 aa, Plasmodium falciparum
QNKK

SEQ ID NO: 3209068 - protein, 19 aa, Plasmodium falciparum
QRNHNNSTYHTSNTKTIKS

SEQ ID NO: 3209069 - protein, 7 aa, Plasmodium falciparum
QTSQRLR

SEQ ID NO: 3209070 - protein, 21 aa, Plasmodium falciparum
QWNKDNDGGDIPNDNKKLNTD

SEQ ID NO: 3209071 - protein, 6 aa, Plasmodium falciparum
RKSIKE

SEQ ID NO: 3209072 - protein, 4 aa, Plasmodium falciparum
RNIN

SEQ ID NO: 3209073 - protein, 4 aa, Plasmodium falciparum
RTTI

SEQ ID NO: 3209074 - protein, 6 aa, Plasmodium falciparum
SAPRDA

SEQ ID NO: 3209075 - protein, 8 aa, Plasmodium falciparum
SDYDIPTL

SEQ ID NO: 3209076 - protein, 23 aa, Plasmodium falciparum
SEQPNDVPNDYSSGDIPLNTQPN

SEQ ID NO: 3209077 - protein, 6 aa, Plasmodium falciparum
SGTYKG

SEQ ID NO: 3209078 - protein, 5 aa, Plasmodium falciparum
SGYGD

SEQ ID NO: 3209079 - protein, 4 aa, Plasmodium falciparum
SKSD

SEQ ID NO: 3209080 - protein, 6 aa, Plasmodium falciparum
SNNREV

SEQ ID NO: 3209081 - protein, 11 aa, Plasmodium falciparum
SPANNDNDPEM

SEQ ID NO: 3209082 - protein, 14 aa, Plasmodium falciparum
SPNNNYDEYSEKEN

SEQ ID NO: 3209083 - protein, 5 aa, Plasmodium falciparum
SQRLR

SEQ ID NO: 3209084 - protein, 4 aa, Plasmodium falciparum
SQVN

SEQ ID NO: 3209085 - protein, 6 aa, Plasmodium falciparum
SQVNNQ

SEQ ID NO: 3209086 - protein, 8 aa, Plasmodium falciparum
TAKAAEVN

SEQ ID NO: 3209087 - protein, 8 aa, Plasmodium falciparum
TEQNNGLR

SEQ ID NO: 3209088 - protein, 4 aa, Plasmodium falciparum
TKHP

SEQ ID NO: 3209089 - protein, 4 aa, Plasmodium falciparum
TNDI

SEQ ID NO: 3209090 - protein, 4 aa, Plasmodium falciparum
TNNS

SEQ ID NO: 3209091 - protein, 5 aa, Plasmodium falciparum
TQDTD

SEQ ID NO: 3209092 - protein, 4 aa, Plasmodium falciparum
TSER

SEQ ID NO: 3209093 - protein, 4 aa, Plasmodium falciparum
TSHC

SEQ ID NO: 3209094 - protein, 6 aa, Plasmodium falciparum
TSQRFE

SEQ ID NO: 3209095 - protein, 13 aa, Plasmodium falciparum
TTDITSSESEYEE

SEQ ID NO: 3209096 - protein, 7 aa, Plasmodium falciparum
TVNARGK

SEQ ID NO: 3209097 - protein, 8 aa, Plasmodium falciparum
VADAKTGV

SEQ ID NO: 3209098 - protein, 4 aa, Plasmodium falciparum
VEET

SEQ ID NO: 3209099 - protein, 6 aa, Plasmodium falciparum
WKNEEH

SEQ ID NO: 3209100 - protein, 6 aa, Plasmodium falciparum
YEGDSI

SEQ ID NO: 3209101 - protein, 4 aa, Plasmodium falciparum
YNEP

SEQ ID NO: 3209102 - protein, 4 aa, Plasmodium falciparum
YNKE

SEQ ID NO: 3209103 - protein, 4 aa, Plasmodium falciparum
YNPS

SEQ ID NO: 3209104 - protein, 9 aa, Plasmodium falciparum
YQKTHDPYK

SEQ ID NO: 3209105 - protein, 14 aa, Plasmodium falciparum
AAEISASANAAGAA

SEQ ID NO: 3209106 - protein, 13 aa, Plasmodium falciparum
AAIAEGAKAGIAE

SEQ ID NO: 3209107 - protein, 12 aa, Plasmodium falciparum
AAIEATKKGAIE

SEQ ID NO: 3209108 - protein, 6 aa, Plasmodium falciparum
AATEFA

SEQ ID NO: 3209109 - protein, 7 aa, Plasmodium falciparum
AATKAGM

SEQ ID NO: 3209110 - protein, 6 aa, Plasmodium falciparum
AATTSY

SEQ ID NO: 3209111 - protein, 22 aa, Plasmodium falciparum
ADNEKKKQKEKEEDDEQTHYSK

SEQ ID NO: 3209112 - protein, 5 aa, Plasmodium falciparum
AEDRN

SEQ ID NO: 3209113 - protein, 16 aa, Plasmodium falciparum
AEEPAKAAAEAARESA

SEQ ID NO: 3209114 - protein, 9 aa, Plasmodium falciparum
AEIGQEPPN

SEQ ID NO: 3209115 - protein, 10 aa, Plasmodium falciparum
AEKTGEVTST

SEQ ID NO: 3209116 - protein, 13 aa, Plasmodium falciparum
AENTKTQGVGAGG

SEQ ID NO: 3209117 - protein, 14 aa, Plasmodium falciparum
AGEAAAKTTTETTK

SEQ ID NO: 3209118 - protein, 6 aa, Plasmodium falciparum
AGESDK

SEQ ID NO: 3209119 - protein, 26 aa, Plasmodium falciparum
AGGDGNTQAGETTQGNGASTETPEAS

SEQ ID NO: 3209120 - protein, 12 aa, Plasmodium falciparum
AGGESEDKTPQQ

SEQ ID NO: 3209121 - protein, 8 aa, Plasmodium falciparum
AGTKASVE

SEQ ID NO: 3209122 - protein, 5 aa, Plasmodium falciparum
AINNN

SEQ ID NO: 3209123 - protein, 12 aa, Plasmodium falciparum
AKKAAGEATEKA

SEQ ID NO: 3209124 - protein, 8 aa, Plasmodium falciparum
AKKKKSEA

SEQ ID NO: 3209125 - protein, 4 aa, Plasmodium falciparum
AKNK

SEQ ID NO: 3209126 - protein, 9 aa, Plasmodium falciparum
AKNNGKTTT

SEQ ID NO: 3209127 - protein, 9 aa, Plasmodium falciparum
AKNTNSDPI

SEQ ID NO: 3209128 - protein, 9 aa, Plasmodium falciparum
AKPARDDPL

SEQ ID NO: 3209129 - protein, 6 aa, Plasmodium falciparum
AKRLQT

SEQ ID NO: 3209130 - protein, 4 aa, Plasmodium falciparum
AKRQ

SEQ ID NO: 3209131 - protein, 5 aa, Plasmodium falciparum
ALAEA

SEQ ID NO: 3209132 - protein, 9 aa, Plasmodium falciparum
ALKGDKSLN

SEQ ID NO: 3209133 - protein, 58 aa, Plasmodium falciparum
ALPPPAPSGPPAEDQIEHDNRGRSERGDQGPLPARPPPPPQAAQPPQPKPKRTGEGLG

SEQ ID NO: 3209134 - protein, 4 aa, Plasmodium falciparum
ANAK

SEQ ID NO: 3209135 - protein, 15 aa, Plasmodium falciparum
ANPQKPIDPKANLDS

SEQ ID NO: 3209136 - protein, 9 aa, Plasmodium falciparum
ANYDNDPQM

SEQ ID NO: 3209137 - protein, 9 aa, Plasmodium falciparum
ANYDSDPEM

SEQ ID NO: 3209138 - protein, 4 aa, Plasmodium falciparum
APSS

SEQ ID NO: 3209139 - protein, 13 aa, Plasmodium falciparum
AQKAGIDAATQAG

SEQ ID NO: 3209140 - protein, 5 aa, Plasmodium falciparum
AQSAT

SEQ ID NO: 3209141 - protein, 7 aa, Plasmodium falciparum
AQTEYDK

SEQ ID NO: 3209142 - protein, 5 aa, Plasmodium falciparum
ARETG

SEQ ID NO: 3209143 - protein, 6 aa, Plasmodium falciparum
ASDPEY

SEQ ID NO: 3209144 - protein, 10 aa, Plasmodium falciparum
ASNGGPGYYN

SEQ ID NO: 3209145 - protein, 16 aa, Plasmodium falciparum
ASQRTQGETSSQSGEN

SEQ ID NO: 3209146 - protein, 19 aa, Plasmodium falciparum
ASTNITKQNSSAPERGYRR

SEQ ID NO: 3209147 - protein, 6 aa, Plasmodium falciparum
ASTSGM

SEQ ID NO: 3209148 - protein, 12 aa, Plasmodium falciparum
ATSAKTAKEAVG

SEQ ID NO: 3209149 - protein, 6 aa, Plasmodium falciparum
ATSSVA

SEQ ID NO: 3209150 - protein, 15 aa, Plasmodium falciparum
CDTESSIYDNDEEIN

SEQ ID NO: 3209151 - protein, 15 aa, Plasmodium falciparum
CDTESSIYDSDEEIN

SEQ ID NO: 3209152 - protein, 6 aa, Plasmodium falciparum
CEEDEA

SEQ ID NO: 3209153 - protein, 11 aa, Plasmodium falciparum
CEEKKEERKIY

SEQ ID NO: 3209154 - protein, 49 aa, Plasmodium falciparum
CETAQTTAEETAAAGGERQTPPAPAPAAPPSPPRPLPKPKPPKPDLPPA

SEQ ID NO: 3209155 - protein, 9 aa, Plasmodium falciparum
CGRDTDPPV

SEQ ID NO: 3209156 - protein, 22 aa, Plasmodium falciparum
CKDAEQSNITNCQDAEQSNITN

SEQ ID NO: 3209157 - protein, 4 aa, Plasmodium falciparum
CKDQ

SEQ ID NO: 3209158 - protein, 7 aa, Plasmodium falciparum
CKEQCDK

SEQ ID NO: 3209159 - protein, 4 aa, Plasmodium falciparum
CKPC

SEQ ID NO: 3209160 - protein, 14 aa, Plasmodium falciparum
CKPSEDNNDQDNKI

SEQ ID NO: 3209161 - protein, 16 aa, Plasmodium falciparum
CNGAASSENGKPQKKD

SEQ ID NO: 3209162 - protein, 12 aa, Plasmodium falciparum
CNNDTEGEKCKK

SEQ ID NO: 3209163 - protein, 4 aa, Plasmodium falciparum
CPPN

SEQ ID NO: 3209164 - protein, 30 aa, Plasmodium falciparum
CSDSDGKGSFSQANDKCRCKDKKGKNTDQV

SEQ ID NO: 3209165 - protein, 5 aa, Plasmodium falciparum
DADNV

SEQ ID NO: 3209166 - protein, 4 aa, Plasmodium falciparum
DAEK

SEQ ID NO: 3209167 - protein, 7 aa, Plasmodium falciparum
DAKDLQD

SEQ ID NO: 3209168 - protein, 7 aa, Plasmodium falciparum
DASVDKE

SEQ ID NO: 3209169 - protein, 7 aa, Plasmodium falciparum
DATYPGS

SEQ ID NO: 3209170 - protein, 4 aa, Plasmodium falciparum
DDDY

SEQ ID NO: 3209171 - protein, 4 aa, Plasmodium falciparum
DDEE

SEQ ID NO: 3209172 - protein, 8 aa, Plasmodium falciparum
DDEKNVTH

SEQ ID NO: 3209173 - protein, 4 aa, Plasmodium falciparum
DDEW

SEQ ID NO: 3209174 - protein, 4 aa, Plasmodium falciparum
DDEY

SEQ ID NO: 3209175 - protein, 10 aa, Plasmodium falciparum
DDGKPKKEFT

SEQ ID NO: 3209176 - protein, 4 aa, Plasmodium falciparum
DDGV

SEQ ID NO: 3209177 - protein, 8 aa, Plasmodium falciparum
DDHNGYQD

SEQ ID NO: 3209178 - protein, 12 aa, Plasmodium falciparum
DDIKEKNKSINE

SEQ ID NO: 3209179 - protein, 17 aa, Plasmodium falciparum
DDIKKDDIKKDDIKKDD

SEQ ID NO: 3209180 - protein, 18 aa, Plasmodium falciparum
DDIKKDDIKKKDDIKKDD

SEQ ID NO: 3209181 - protein, 16 aa, Plasmodium falciparum
DDKTKNMDDNQEHKEN

SEQ ID NO: 3209182 - protein, 12 aa, Plasmodium falciparum
DDNIKENDEMKD

SEQ ID NO: 3209183 - protein, 13 aa, Plasmodium falciparum
DDNIKENDEMKDH

SEQ ID NO: 3209184 - protein, 12 aa, Plasmodium falciparum
DDNIKENNEMKD

SEQ ID NO: 3209185 - protein, 8 aa, Plasmodium falciparum
DDNKNNID

SEQ ID NO: 3209186 - protein, 28 aa, Plasmodium falciparum
DDNTINKNDSNKKNESNNKKKEKKSENA

SEQ ID NO: 3209187 - protein, 6 aa, Plasmodium falciparum
DDSIRD

SEQ ID NO: 3209188 - protein, 4 aa, Plasmodium falciparum
DEEE

SEQ ID NO: 3209189 - protein, 6 aa, Plasmodium falciparum
DEGSFT

SEQ ID NO: 3209190 - protein, 10 aa, Plasmodium falciparum
DEGYNIDDNS

SEQ ID NO: 3209191 - protein, 94 aa, Plasmodium falciparum
DEKGEGGFTSKNKENGNNNRNNENELKEEGSLPTKMNEKNSNSSDKQPNDISHDESKSNSNNSQNIQKEPEEKENSNPNLDSSENSSESATRSV

SEQ ID NO: 3209192 - protein, 4 aa, Plasmodium falciparum
DEKN

SEQ ID NO: 3209193 - protein, 4 aa, Plasmodium falciparum
DELE

SEQ ID NO: 3209194 - protein, 8 aa, Plasmodium falciparum
DELPEYEK

SEQ ID NO: 3209195 - protein, 4 aa, Plasmodium falciparum
DEND

SEQ ID NO: 3209196 - protein, 4 aa, Plasmodium falciparum
DENI

SEQ ID NO: 3209197 - protein, 12 aa, Plasmodium falciparum
DENKGKKEFSNM

SEQ ID NO: 3209198 - protein, 7 aa, Plasmodium falciparum
DENPSVN

SEQ ID NO: 3209199 - protein, 7 aa, Plasmodium falciparum
DERDQIK

SEQ ID NO: 3209200 - protein, 4 aa, Plasmodium falciparum
DESG

SEQ ID NO: 3209201 - protein, 7 aa, Plasmodium falciparum
DESKSTD

SEQ ID NO: 3209202 - protein, 18 aa, Plasmodium falciparum
DESTEDKENKVSAEEAKE

SEQ ID NO: 3209203 - protein, 4 aa, Plasmodium falciparum
DETK

SEQ ID NO: 3209204 - protein, 11 aa, Plasmodium falciparum
DETKGKKEFSN

SEQ ID NO: 3209205 - protein, 10 aa, Plasmodium falciparum
DFNEGTEKTF

SEQ ID NO: 3209206 - protein, 10 aa, Plasmodium falciparum
DGENKKNGEH

SEQ ID NO: 3209207 - protein, 24 aa, Plasmodium falciparum
DGENNKAAGGGPKQPNSGKTPQEW

SEQ ID NO: 3209208 - protein, 19 aa, Plasmodium falciparum
DGESKETTGQPDNSHDSHM

SEQ ID NO: 3209209 - protein, 15 aa, Plasmodium falciparum
DGKQARKTNTSSPLG

SEQ ID NO: 3209210 - protein, 10 aa, Plasmodium falciparum
DGNKTLDGNK

SEQ ID NO: 3209211 - protein, 8 aa, Plasmodium falciparum
DGVPGQAQ

SEQ ID NO: 3209212 - protein, 8 aa, Plasmodium falciparum
DHNGYQGI

SEQ ID NO: 3209213 - protein, 8 aa, Plasmodium falciparum
DHNGYQNV

SEQ ID NO: 3209214 - protein, 8 aa, Plasmodium falciparum
DHPSQETP

SEQ ID NO: 3209215 - protein, 5 aa, Plasmodium falciparum
DHSSS

SEQ ID NO: 3209216 - protein, 8 aa, Plasmodium falciparum
DHTKQNIE

SEQ ID NO: 3209217 - protein, 21 aa, Plasmodium falciparum
DIEDNQDVKDENSIQENEEKY

SEQ ID NO: 3209218 - protein, 4 aa, Plasmodium falciparum
DINN

SEQ ID NO: 3209219 - protein, 18 aa, Plasmodium falciparum
DINTSNTNSSNNNSVEHN

SEQ ID NO: 3209220 - protein, 4 aa, Plasmodium falciparum
DISD

SEQ ID NO: 3209221 - protein, 5 aa, Plasmodium falciparum
DISNL

SEQ ID NO: 3209222 - protein, 6 aa, Plasmodium falciparum
DISTDD

SEQ ID NO: 3209223 - protein, 45 aa, Plasmodium falciparum
DKANKCKEDQKPNGENQAQTCEKSAPVEDEDDEPLEEENPVTQPN

SEQ ID NO: 3209224 - protein, 17 aa, Plasmodium falciparum
DKDTGKPQKNGDNDYTY

SEQ ID NO: 3209225 - protein, 4 aa, Plasmodium falciparum
DKEG

SEQ ID NO: 3209226 - protein, 4 aa, Plasmodium falciparum
DKEL

SEQ ID NO: 3209227 - protein, 14 aa, Plasmodium falciparum
DKETYEPGDAKTTD

SEQ ID NO: 3209228 - protein, 4 aa, Plasmodium falciparum
DKEY

SEQ ID NO: 3209229 - protein, 8 aa, Plasmodium falciparum
DKKIEEEV

SEQ ID NO: 3209230 - protein, 10 aa, Plasmodium falciparum
DKKKKPEHRT

SEQ ID NO: 3209231 - protein, 10 aa, Plasmodium falciparum
DKNITQTKNQ

SEQ ID NO: 3209232 - protein, 10 aa, Plasmodium falciparum
DKNKENDENY

SEQ ID NO: 3209233 - protein, 5 aa, Plasmodium falciparum
DKNNS

SEQ ID NO: 3209234 - protein, 11 aa, Plasmodium falciparum
DKREKSLAQKV

SEQ ID NO: 3209235 - protein, 9 aa, Plasmodium falciparum
DKSLAEKVE

SEQ ID NO: 3209236 - protein, 4 aa, Plasmodium falciparum
DKYE

SEQ ID NO: 3209237 - protein, 6 aa, Plasmodium falciparum
DLKDYT

SEQ ID NO: 3209238 - protein, 7 aa, Plasmodium falciparum
DNDADMK

SEQ ID NO: 3209239 - protein, 8 aa, Plasmodium falciparum
DNDADMKS

SEQ ID NO: 3209240 - protein, 9 aa, Plasmodium falciparum
DNDEDMKSV

SEQ ID NO: 3209241 - protein, 5 aa, Plasmodium falciparum
DNDPQ

SEQ ID NO: 3209242 - protein, 4 aa, Plasmodium falciparum
DNEK

SEQ ID NO: 3209243 - protein, 11 aa, Plasmodium falciparum
DNIKGKNDNME

SEQ ID NO: 3209244 - protein, 5 aa, Plasmodium falciparum
DNIKN

SEQ ID NO: 3209245 - protein, 49 aa, Plasmodium falciparum
DNINGKKKEQEDQNKDNNNENNNNDNENNNNDNENNNNDNNNDNNDNNV

SEQ ID NO: 3209246 - protein, 9 aa, Plasmodium falciparum
DNKDEKDKN

SEQ ID NO: 3209247 - protein, 4 aa, Plasmodium falciparum
DNLK

SEQ ID NO: 3209248 - protein, 5 aa, Plasmodium falciparum
DNNIK

SEQ ID NO: 3209249 - protein, 7 aa, Plasmodium falciparum
DNNMNNE

SEQ ID NO: 3209250 - protein, 5 aa, Plasmodium falciparum
DNNNN

SEQ ID NO: 3209251 - protein, 9 aa, Plasmodium falciparum
DNNNNDHTD

SEQ ID NO: 3209252 - protein, 32 aa, Plasmodium falciparum
DNNSKDSCPPSVDTKTNPCAKPPGSKPTKSVK

SEQ ID NO: 3209253 - protein, 12 aa, Plasmodium falciparum
DNNTHPTTSHHN

SEQ ID NO: 3209254 - protein, 8 aa, Plasmodium falciparum
DNNTYDSN

SEQ ID NO: 3209255 - protein, 4 aa, Plasmodium falciparum
DNNY

SEQ ID NO: 3209256 - protein, 7 aa, Plasmodium falciparum
DNQTINN

SEQ ID NO: 3209257 - protein, 5 aa, Plasmodium falciparum
DNSYN

SEQ ID NO: 3209258 - protein, 7 aa, Plasmodium falciparum
DNTNDNV

SEQ ID NO: 3209259 - protein, 11 aa, Plasmodium falciparum
DNTPGSNRSNA

SEQ ID NO: 3209260 - protein, 8 aa, Plasmodium falciparum
DNVKDDAS

SEQ ID NO: 3209261 - protein, 6 aa, Plasmodium falciparum
DPKNDG

SEQ ID NO: 3209262 - protein, 6 aa, Plasmodium falciparum
DPSQFS

SEQ ID NO: 3209263 - protein, 8 aa, Plasmodium falciparum
DQDERKKN

SEQ ID NO: 3209264 - protein, 31 aa, Plasmodium falciparum
DQDGQGETTEKKVPATTEEGSPKETTTPEKS

SEQ ID NO: 3209265 - protein, 7 aa, Plasmodium falciparum
DQNRKSC

SEQ ID NO: 3209266 - protein, 5 aa, Plasmodium falciparum
DQPEF

SEQ ID NO: 3209267 - protein, 7 aa, Plasmodium falciparum
DSGYESV

SEQ ID NO: 3209268 - protein, 4 aa, Plasmodium falciparum
DSLE

SEQ ID NO: 3209269 - protein, 4 aa, Plasmodium falciparum
DSPL

SEQ ID NO: 3209270 - protein, 9 aa, Plasmodium falciparum
DTNNKKEEL

SEQ ID NO: 3209271 - protein, 9 aa, Plasmodium falciparum
DTPTNPTNV

SEQ ID NO: 3209272 - protein, 7 aa, Plasmodium falciparum
DTSGDDD

SEQ ID NO: 3209273 - protein, 7 aa, Plasmodium falciparum
DTSGTTM

SEQ ID NO: 3209274 - protein, 8 aa, Plasmodium falciparum
DVLNNDKT

SEQ ID NO: 3209275 - protein, 8 aa, Plasmodium falciparum
DVTNGKKE

SEQ ID NO: 3209276 - protein, 10 aa, Plasmodium falciparum
DWEDEKNRYD

SEQ ID NO: 3209277 - protein, 4 aa, Plasmodium falciparum
DYGN

SEQ ID NO: 3209278 - protein, 10 aa, Plasmodium falciparum
DYKKKKWKNE

SEQ ID NO: 3209279 - protein, 8 aa, Plasmodium falciparum
DYKNKKSS

SEQ ID NO: 3209280 - protein, 18 aa, Plasmodium falciparum
EAAEQAGAAAAADAGKNA

SEQ ID NO: 3209281 - protein, 7 aa, Plasmodium falciparum
EACRDDS

SEQ ID NO: 3209282 - protein, 4 aa, Plasmodium falciparum
EAEN

SEQ ID NO: 3209283 - protein, 7 aa, Plasmodium falciparum
EAIAEGA

SEQ ID NO: 3209284 - protein, 10 aa, Plasmodium falciparum
EATSRGKGVK

SEQ ID NO: 3209285 - protein, 6 aa, Plasmodium falciparum
EAYDEE

SEQ ID NO: 3209286 - protein, 6 aa, Plasmodium falciparum
ECPSNE

SEQ ID NO: 3209287 - protein, 6 aa, Plasmodium falciparum
EDCKPC

SEQ ID NO: 3209288 - protein, 6 aa, Plasmodium falciparum
EDDFDS

SEQ ID NO: 3209289 - protein, 4 aa, Plasmodium falciparum
EDED

SEQ ID NO: 3209290 - protein, 6 aa, Plasmodium falciparum
EDEKYG

SEQ ID NO: 3209291 - protein, 4 aa, Plasmodium falciparum
EDIN

SEQ ID NO: 3209292 - protein, 4 aa, Plasmodium falciparum
EDKM

SEQ ID NO: 3209293 - protein, 8 aa, Plasmodium falciparum
EDNNNNDY

SEQ ID NO: 3209294 - protein, 15 aa, Plasmodium falciparum
EDSTQDKQNSLDSEE

SEQ ID NO: 3209295 - protein, 13 aa, Plasmodium falciparum
EDTEMNSLEETQD

SEQ ID NO: 3209296 - protein, 5 aa, Plasmodium falciparum
EDTFN

SEQ ID NO: 3209297 - protein, 8 aa, Plasmodium falciparum
EDTKNVED

SEQ ID NO: 3209298 - protein, 4 aa, Plasmodium falciparum
EDTY

SEQ ID NO: 3209299 - protein, 5 aa, Plasmodium falciparum
EDVKY

SEQ ID NO: 3209300 - protein, 19 aa, Plasmodium falciparum
EEATEAAKAAEAAKNAKLT

SEQ ID NO: 3209301 - protein, 8 aa, Plasmodium falciparum
EEDDEEYK

SEQ ID NO: 3209302 - protein, 4 aa, Plasmodium falciparum
EEDK

SEQ ID NO: 3209303 - protein, 4 aa, Plasmodium falciparum
EEDT

SEQ ID NO: 3209304 - protein, 21 aa, Plasmodium falciparum
EEENEENEGTPGADNKNKNTI

SEQ ID NO: 3209305 - protein, 8 aa, Plasmodium falciparum
EEENKQTK

SEQ ID NO: 3209306 - protein, 4 aa, Plasmodium falciparum
EEES

SEQ ID NO: 3209307 - protein, 4 aa, Plasmodium falciparum
EEGN

SEQ ID NO: 3209308 - protein, 6 aa, Plasmodium falciparum
EEGSAT

SEQ ID NO: 3209309 - protein, 4 aa, Plasmodium falciparum
EEIN

SEQ ID NO: 3209310 - protein, 10 aa, Plasmodium falciparum
EEISEKRKQV

SEQ ID NO: 3209311 - protein, 4 aa, Plasmodium falciparum
EEKE

SEQ ID NO: 3209312 - protein, 4 aa, Plasmodium falciparum
EEKN

SEQ ID NO: 3209313 - protein, 11 aa, Plasmodium falciparum
EEKSVSEEIPV

SEQ ID NO: 3209314 - protein, 4 aa, Plasmodium falciparum
EENI

SEQ ID NO: 3209315 - protein, 11 aa, Plasmodium falciparum
EENNNRKDQEG

SEQ ID NO: 3209316 - protein, 4 aa, Plasmodium falciparum
EENV

SEQ ID NO: 3209317 - protein, 4 aa, Plasmodium falciparum
EENY

SEQ ID NO: 3209318 - protein, 9 aa, Plasmodium falciparum
EEQNPKNMR

SEQ ID NO: 3209319 - protein, 32 aa, Plasmodium falciparum
EEREKKKLERKRKREKKRKKKKKEKKKTEATL

SEQ ID NO: 3209320 - protein, 5 aa, Plasmodium falciparum
EERNN

SEQ ID NO: 3209321 - protein, 4 aa, Plasmodium falciparum
EESE

SEQ ID NO: 3209322 - protein, 4 aa, Plasmodium falciparum
EEVQ

SEQ ID NO: 3209323 - protein, 4 aa, Plasmodium falciparum
EEYE

SEQ ID NO: 3209324 - protein, 5 aa, Plasmodium falciparum
EEYNN

SEQ ID NO: 3209325 - protein, 13 aa, Plasmodium falciparum
EEYNSPTSNNSSI

SEQ ID NO: 3209326 - protein, 5 aa, Plasmodium falciparum
EFDDP

SEQ ID NO: 3209327 - protein, 13 aa, Plasmodium falciparum
EFQKQKDKYKGEL

SEQ ID NO: 3209328 - protein, 10 aa, Plasmodium falciparum
EFSNENYNKV

SEQ ID NO: 3209329 - protein, 5 aa, Plasmodium falciparum
EGAAR

SEQ ID NO: 3209330 - protein, 5 aa, Plasmodium falciparum
EGFED

SEQ ID NO: 3209331 - protein, 14 aa, Plasmodium falciparum
EGIKENDTENKDKV

SEQ ID NO: 3209332 - protein, 4 aa, Plasmodium falciparum
EGNL

SEQ ID NO: 3209333 - protein, 5 aa, Plasmodium falciparum
EGSAT

SEQ ID NO: 3209334 - protein, 10 aa, Plasmodium falciparum
EGSNSEDEVK

SEQ ID NO: 3209335 - protein, 6 aa, Plasmodium falciparum
EGSVTE

SEQ ID NO: 3209336 - protein, 8 aa, Plasmodium falciparum
EGYGNAED

SEQ ID NO: 3209337 - protein, 4 aa, Plasmodium falciparum
EIKE

SEQ ID NO: 3209338 - protein, 14 aa, Plasmodium falciparum
EINSNSNYKEGEKL

SEQ ID NO: 3209339 - protein, 5 aa, Plasmodium falciparum
EKANV

SEQ ID NO: 3209340 - protein, 25 aa, Plasmodium falciparum
EKCSQCKSKGKGGNECYRETKECND

SEQ ID NO: 3209341 - protein, 4 aa, Plasmodium falciparum
EKDE

SEQ ID NO: 3209342 - protein, 21 aa, Plasmodium falciparum
EKDEKEEGVDDRNYDNDVRTG

SEQ ID NO: 3209343 - protein, 7 aa, Plasmodium falciparum
EKDINEE

SEQ ID NO: 3209344 - protein, 12 aa, Plasmodium falciparum
EKDRDDLKRDHP

SEQ ID NO: 3209345 - protein, 4 aa, Plasmodium falciparum
EKED

SEQ ID NO: 3209346 - protein, 4 aa, Plasmodium falciparum
EKEE

SEQ ID NO: 3209347 - protein, 8 aa, Plasmodium falciparum
EKEEERKN

SEQ ID NO: 3209348 - protein, 5 aa, Plasmodium falciparum
EKELN

SEQ ID NO: 3209349 - protein, 4 aa, Plasmodium falciparum
EKEN

SEQ ID NO: 3209350 - protein, 12 aa, Plasmodium falciparum
EKENFSGDFGPR

SEQ ID NO: 3209351 - protein, 4 aa, Plasmodium falciparum
EKEY

SEQ ID NO: 3209352 - protein, 5 aa, Plasmodium falciparum
EKEYP

SEQ ID NO: 3209353 - protein, 4 aa, Plasmodium falciparum
EKGY

SEQ ID NO: 3209354 - protein, 18 aa, Plasmodium falciparum
EKIDSSNLKNGTKDSEGA

SEQ ID NO: 3209355 - protein, 4 aa, Plasmodium falciparum
EKIG

SEQ ID NO: 3209356 - protein, 4 aa, Plasmodium falciparum
EKIN

SEQ ID NO: 3209357 - protein, 4 aa, Plasmodium falciparum
EKKE

SEQ ID NO: 3209358 - protein, 7 aa, Plasmodium falciparum
EKKENKK

SEQ ID NO: 3209359 - protein, 4 aa, Plasmodium falciparum
EKKI

SEQ ID NO: 3209360 - protein, 4 aa, Plasmodium falciparum
EKKN

SEQ ID NO: 3209361 - protein, 8 aa, Plasmodium falciparum
EKKSPEEL

SEQ ID NO: 3209362 - protein, 4 aa, Plasmodium falciparum
EKLN

SEQ ID NO: 3209363 - protein, 14 aa, Plasmodium falciparum
EKLQEQQSDLEQDR

SEQ ID NO: 3209364 - protein, 4 aa, Plasmodium falciparum
EKND

SEQ ID NO: 3209365 - protein, 4 aa, Plasmodium falciparum
EKNE

SEQ ID NO: 3209366 - protein, 12 aa, Plasmodium falciparum
EKNNKGSKVKES

SEQ ID NO: 3209367 - protein, 5 aa, Plasmodium falciparum
EKNVT

SEQ ID NO: 3209368 - protein, 4 aa, Plasmodium falciparum
EKQT

SEQ ID NO: 3209369 - protein, 7 aa, Plasmodium falciparum
EKREEQN

SEQ ID NO: 3209370 - protein, 15 aa, Plasmodium falciparum
EKSCQAVKDNDGGTI

SEQ ID NO: 3209371 - protein, 4 aa, Plasmodium falciparum
EKSF

SEQ ID NO: 3209372 - protein, 11 aa, Plasmodium falciparum
EKSGDTKIEDI

SEQ ID NO: 3209373 - protein, 9 aa, Plasmodium falciparum
EKSNELDNA

SEQ ID NO: 3209374 - protein, 14 aa, Plasmodium falciparum
EKSSINDENDTKSR

SEQ ID NO: 3209375 - protein, 8 aa, Plasmodium falciparum
EKSTTKED

SEQ ID NO: 3209376 - protein, 15 aa, Plasmodium falciparum
EKTGGTTYNEDNDPY

SEQ ID NO: 3209377 - protein, 4 aa, Plasmodium falciparum
EKTT

SEQ ID NO: 3209378 - protein, 7 aa, Plasmodium falciparum
EKVPDKK

SEQ ID NO: 3209379 - protein, 16 aa, Plasmodium falciparum
EKVPTDSHNEKKKKEV

SEQ ID NO: 3209380 - protein, 11 aa, Plasmodium falciparum
EKYKNPKSQEN

SEQ ID NO: 3209381 - protein, 4 aa, Plasmodium falciparum
EKYT

SEQ ID NO: 3209382 - protein, 6 aa, Plasmodium falciparum
ELKKNM

SEQ ID NO: 3209383 - protein, 6 aa, Plasmodium falciparum
ELQEEH

SEQ ID NO: 3209384 - protein, 5 aa, Plasmodium falciparum
ENDIS

SEQ ID NO: 3209385 - protein, 5 aa, Plasmodium falciparum
ENDKY

SEQ ID NO: 3209386 - protein, 10 aa, Plasmodium falciparum
ENEDIENKGE

SEQ ID NO: 3209387 - protein, 4 aa, Plasmodium falciparum
ENEK

SEQ ID NO: 3209388 - protein, 6 aa, Plasmodium falciparum
ENEKNN

SEQ ID NO: 3209389 - protein, 22 aa, Plasmodium falciparum
ENGSCGSAKQKDCPNNTITSQN

SEQ ID NO: 3209390 - protein, 5 aa, Plasmodium falciparum
ENIGD

SEQ ID NO: 3209391 - protein, 4 aa, Plasmodium falciparum
ENIN

SEQ ID NO: 3209392 - protein, 5 aa, Plasmodium falciparum
ENINN

SEQ ID NO: 3209393 - protein, 4 aa, Plasmodium falciparum
ENKE

SEQ ID NO: 3209394 - protein, 4 aa, Plasmodium falciparum
ENKN

SEQ ID NO: 3209395 - protein, 7 aa, Plasmodium falciparum
ENKTDEI

SEQ ID NO: 3209396 - protein, 4 aa, Plasmodium falciparum
ENNI

SEQ ID NO: 3209397 - protein, 11 aa, Plasmodium falciparum
ENNKNKENNNM

SEQ ID NO: 3209398 - protein, 4 aa, Plasmodium falciparum
ENRN

SEQ ID NO: 3209399 - protein, 12 aa, Plasmodium falciparum
ENSKNSEESNNS

SEQ ID NO: 3209400 - protein, 4 aa, Plasmodium falciparum
ENSR

SEQ ID NO: 3209401 - protein, 4 aa, Plasmodium falciparum
ENTK

SEQ ID NO: 3209402 - protein, 4 aa, Plasmodium falciparum
ENVN

SEQ ID NO: 3209403 - protein, 10 aa, Plasmodium falciparum
ENYNNENNGV

SEQ ID NO: 3209404 - protein, 4 aa, Plasmodium falciparum
ENYS

SEQ ID NO: 3209405 - protein, 4 aa, Plasmodium falciparum
EPFN

SEQ ID NO: 3209406 - protein, 8 aa, Plasmodium falciparum
EQKYEEGC

SEQ ID NO: 3209407 - protein, 6 aa, Plasmodium falciparum
EQNDND

SEQ ID NO: 3209408 - protein, 8 aa, Plasmodium falciparum
EQNKHKSI

SEQ ID NO: 3209409 - protein, 4 aa, Plasmodium falciparum
ESLN

SEQ ID NO: 3209410 - protein, 8 aa, Plasmodium falciparum
ESNKEQSD

SEQ ID NO: 3209411 - protein, 20 aa, Plasmodium falciparum
ESQSKTVTSVNGDGNGSQEV

SEQ ID NO: 3209412 - protein, 6 aa, Plasmodium falciparum
ESTGNM

SEQ ID NO: 3209413 - protein, 6 aa, Plasmodium falciparum
ESVAPT

SEQ ID NO: 3209414 - protein, 4 aa, Plasmodium falciparum
ESYM

SEQ ID NO: 3209415 - protein, 4 aa, Plasmodium falciparum
ESYN

SEQ ID NO: 3209416 - protein, 5 aa, Plasmodium falciparum
ETEKE

SEQ ID NO: 3209417 - protein, 11 aa, Plasmodium falciparum
ETFDRQTSQRF

SEQ ID NO: 3209418 - protein, 8 aa, Plasmodium falciparum
ETNGDTIN

SEQ ID NO: 3209419 - protein, 4 aa, Plasmodium falciparum
ETNI

SEQ ID NO: 3209420 - protein, 4 aa, Plasmodium falciparum
ETNY

SEQ ID NO: 3209421 - protein, 18 aa, Plasmodium falciparum
ETSGDGLTCGASDNEKET

SEQ ID NO: 3209422 - protein, 15 aa, Plasmodium falciparum
ETTCKDHPKVEEKSD

SEQ ID NO: 3209423 - protein, 86 aa, Plasmodium falciparum
ETTEETVDEGKCEEDTVTPSLGPKDDSEKDEKKEENSEDTTAAEGEENGAPGSSGTPPPPPAAPPSTPAKTKESKKPKSTKKPRIK

SEQ ID NO: 3209424 - protein, 5 aa, Plasmodium falciparum
ETVAE

SEQ ID NO: 3209425 - protein, 13 aa, Plasmodium falciparum
EVGDEKDKQKMKE

SEQ ID NO: 3209426 - protein, 23 aa, Plasmodium falciparum
EWENDTSTSGNTHPSDSNKTLNT

SEQ ID NO: 3209427 - protein, 18 aa, Plasmodium falciparum
EWENETHSGDINSGIPSG

SEQ ID NO: 3209428 - protein, 22 aa, Plasmodium falciparum
EWENETHSGNIHTSDSNKTLNT

SEQ ID NO: 3209429 - protein, 22 aa, Plasmodium falciparum
EWENETHSGNTHTSDSNKTLNT

SEQ ID NO: 3209430 - protein, 27 aa, Plasmodium falciparum
EWNKDTNSGKLSDNIHSDNKPGDIPSD

SEQ ID NO: 3209431 - protein, 16 aa, Plasmodium falciparum
EWNNSGVKNKENDNNG

SEQ ID NO: 3209432 - protein, 4 aa, Plasmodium falciparum
EYDK

SEQ ID NO: 3209433 - protein, 24 aa, Plasmodium falciparum
EYGIPTTKSPNKYVPYGSQRYKGK

SEQ ID NO: 3209434 - protein, 4 aa, Plasmodium falciparum
EYQT

SEQ ID NO: 3209435 - protein, 11 aa, Plasmodium falciparum
FDKPEKTFNPS

SEQ ID NO: 3209436 - protein, 10 aa, Plasmodium falciparum
FDRQTSQRFE

SEQ ID NO: 3209437 - protein, 26 aa, Plasmodium falciparum
FEKQKGKYTKEIEKANGTSNGTTIRT

SEQ ID NO: 3209438 - protein, 13 aa, Plasmodium falciparum
FNNDTNKKRETHI

SEQ ID NO: 3209439 - protein, 7 aa, Plasmodium falciparum
FNNNNQK

SEQ ID NO: 3209440 - protein, 6 aa, Plasmodium falciparum
FPGGFG

SEQ ID NO: 3209441 - protein, 13 aa, Plasmodium falciparum
FQNEQENINESGH

SEQ ID NO: 3209442 - protein, 10 aa, Plasmodium falciparum
FSDESRSQCT

SEQ ID NO: 3209443 - protein, 7 aa, Plasmodium falciparum
FSSRNKK

SEQ ID NO: 3209444 - protein, 6 aa, Plasmodium falciparum
FSTESK

SEQ ID NO: 3209445 - protein, 13 aa, Plasmodium falciparum
GAQPTASPGHSNG

SEQ ID NO: 3209446 - protein, 14 aa, Plasmodium falciparum
GASGTGAKSNDDTK

SEQ ID NO: 3209447 - protein, 5 aa, Plasmodium falciparum
GDDTY

SEQ ID NO: 3209448 - protein, 8 aa, Plasmodium falciparum
GDEEGDIA

SEQ ID NO: 3209449 - protein, 11 aa, Plasmodium falciparum
GDKDKKNGYSD

SEQ ID NO: 3209450 - protein, 13 aa, Plasmodium falciparum
GDKEMKAKEEKIK

SEQ ID NO: 3209451 - protein, 15 aa, Plasmodium falciparum
GDKPDDDKPNTDPPT

SEQ ID NO: 3209452 - protein, 9 aa, Plasmodium falciparum
GDNKMNGEN

SEQ ID NO: 3209453 - protein, 7 aa, Plasmodium falciparum
GDPPTNM

SEQ ID NO: 3209454 - protein, 7 aa, Plasmodium falciparum
GDSDEDK

SEQ ID NO: 3209455 - protein, 12 aa, Plasmodium falciparum
GDYDIPTKLSPN

SEQ ID NO: 3209456 - protein, 14 aa, Plasmodium falciparum
GDYGTPTPKSKNRY

SEQ ID NO: 3209457 - protein, 6 aa, Plasmodium falciparum
GEANET

SEQ ID NO: 3209458 - protein, 10 aa, Plasmodium falciparum
GEDGIDDKDA

SEQ ID NO: 3209459 - protein, 6 aa, Plasmodium falciparum
GEISEV

SEQ ID NO: 3209460 - protein, 4 aa, Plasmodium falciparum
GEKE

SEQ ID NO: 3209461 - protein, 8 aa, Plasmodium falciparum
GENHDDIE

SEQ ID NO: 3209462 - protein, 5 aa, Plasmodium falciparum
GGFDD

SEQ ID NO: 3209463 - protein, 12 aa, Plasmodium falciparum
GGGALGPGGPVG

SEQ ID NO: 3209464 - protein, 16 aa, Plasmodium falciparum
GGNTSDSGNTNGSNNN

SEQ ID NO: 3209465 - protein, 11 aa, Plasmodium falciparum
GHENNNVRRDS

SEQ ID NO: 3209466 - protein, 20 aa, Plasmodium falciparum
GIDPTSDNRGLTSGKHDSYS

SEQ ID NO: 3209467 - protein, 7 aa, Plasmodium falciparum
GIPPGTH

SEQ ID NO: 3209468 - protein, 5 aa, Plasmodium falciparum
GIPTL

SEQ ID NO: 3209469 - protein, 4 aa, Plasmodium falciparum
GITP

SEQ ID NO: 3209470 - protein, 4 aa, Plasmodium falciparum
GKDL

SEQ ID NO: 3209471 - protein, 7 aa, Plasmodium falciparum
GKDTCEI

SEQ ID NO: 3209472 - protein, 22 aa, Plasmodium falciparum
GKDVEKVKDGKDEDDEDYEDDY

SEQ ID NO: 3209473 - protein, 4 aa, Plasmodium falciparum
GKEE

SEQ ID NO: 3209474 - protein, 4 aa, Plasmodium falciparum
GKES

SEQ ID NO: 3209475 - protein, 20 aa, Plasmodium falciparum
GKGQGDGKDCTQKDKECSPC

SEQ ID NO: 3209476 - protein, 6 aa, Plasmodium falciparum
GKKIEE

SEQ ID NO: 3209477 - protein, 6 aa, Plasmodium falciparum
GKNNSR

SEQ ID NO: 3209478 - protein, 4 aa, Plasmodium falciparum
GKNT

SEQ ID NO: 3209479 - protein, 16 aa, Plasmodium falciparum
GKPPNNDNPQNPNNGT

SEQ ID NO: 3209480 - protein, 9 aa, Plasmodium falciparum
GKSGAGKST

SEQ ID NO: 3209481 - protein, 11 aa, Plasmodium falciparum
GLEENNNNNNI

SEQ ID NO: 3209482 - protein, 9 aa, Plasmodium falciparum
GLQSPQSRL

SEQ ID NO: 3209483 - protein, 15 aa, Plasmodium falciparum
GNDSESQVSGVDGHG

SEQ ID NO: 3209484 - protein, 4 aa, Plasmodium falciparum
GNHN

SEQ ID NO: 3209485 - protein, 4 aa, Plasmodium falciparum
GNIS

SEQ ID NO: 3209486 - protein, 8 aa, Plasmodium falciparum
GNKGECGA

SEQ ID NO: 3209487 - protein, 4 aa, Plasmodium falciparum
GNKY

SEQ ID NO: 3209488 - protein, 4 aa, Plasmodium falciparum
GNNN

SEQ ID NO: 3209489 - protein, 6 aa, Plasmodium falciparum
GNQNPN

SEQ ID NO: 3209490 - protein, 5 aa, Plasmodium falciparum
GNYSD

SEQ ID NO: 3209491 - protein, 5 aa, Plasmodium falciparum
GNYSQ

SEQ ID NO: 3209492 - protein, 4 aa, Plasmodium falciparum
GQQW

SEQ ID NO: 3209493 - protein, 12 aa, Plasmodium falciparum
GRAENSKEDEKE

SEQ ID NO: 3209494 - protein, 6 aa, Plasmodium falciparum
GRKHPV

SEQ ID NO: 3209495 - protein, 27 aa, Plasmodium falciparum
GRKKDSKLKNKSEGTNEQQNNKNNGNI

SEQ ID NO: 3209496 - protein, 8 aa, Plasmodium falciparum
GRQTSQRF

SEQ ID NO: 3209497 - protein, 4 aa, Plasmodium falciparum
GRTN

SEQ ID NO: 3209498 - protein, 4 aa, Plasmodium falciparum
GSGT

SEQ ID NO: 3209499 - protein, 9 aa, Plasmodium falciparum
GSKDGKDAI

SEQ ID NO: 3209500 - protein, 4 aa, Plasmodium falciparum
GSLS

SEQ ID NO: 3209501 - protein, 9 aa, Plasmodium falciparum
GSNSDESID

SEQ ID NO: 3209502 - protein, 4 aa, Plasmodium falciparum
GSSR

SEQ ID NO: 3209503 - protein, 6 aa, Plasmodium falciparum
GTGDMT

SEQ ID NO: 3209504 - protein, 9 aa, Plasmodium falciparum
GTKTKDGLN

SEQ ID NO: 3209505 - protein, 4 aa, Plasmodium falciparum
GTLE

SEQ ID NO: 3209506 - protein, 16 aa, Plasmodium falciparum
GTLKSEEYIDDENNDI

SEQ ID NO: 3209507 - protein, 6 aa, Plasmodium falciparum
GTTCTP

SEQ ID NO: 3209508 - protein, 11 aa, Plasmodium falciparum
GVPGEPGMAPG

SEQ ID NO: 3209509 - protein, 7 aa, Plasmodium falciparum
GVSGTGV

SEQ ID NO: 3209510 - protein, 4 aa, Plasmodium falciparum
GVTT

SEQ ID NO: 3209511 - protein, 4 aa, Plasmodium falciparum
GYDC

SEQ ID NO: 3209512 - protein, 6 aa, Plasmodium falciparum
HDNGDC

SEQ ID NO: 3209513 - protein, 13 aa, Plasmodium falciparum
HDTSTVDSNAMDV

SEQ ID NO: 3209514 - protein, 4 aa, Plasmodium falciparum
HEHK

SEQ ID NO: 3209515 - protein, 14 aa, Plasmodium falciparum
HGKDNQGNSDQDNK

SEQ ID NO: 3209516 - protein, 5 aa, Plasmodium falciparum
HIQNT

SEQ ID NO: 3209517 - protein, 6 aa, Plasmodium falciparum
HKDEVS

SEQ ID NO: 3209518 - protein, 11 aa, Plasmodium falciparum
HKGKKSKDAIT

SEQ ID NO: 3209519 - protein, 6 aa, Plasmodium falciparum
HLSNNN

SEQ ID NO: 3209520 - protein, 8 aa, Plasmodium falciparum
HRKRTHPE

SEQ ID NO: 3209521 - protein, 7 aa, Plasmodium falciparum
HRPQPPL

SEQ ID NO: 3209522 - protein, 4 aa, Plasmodium falciparum
HSIS

SEQ ID NO: 3209523 - protein, 15 aa, Plasmodium falciparum
HSNAHNDSQQPCYGK

SEQ ID NO: 3209524 - protein, 11 aa, Plasmodium falciparum
HTKKNTSTNSV

SEQ ID NO: 3209525 - protein, 19 aa, Plasmodium falciparum
HTKRTSTQNVAKPARDDPI

SEQ ID NO: 3209526 - protein, 8 aa, Plasmodium falciparum
HTNNDSAA

SEQ ID NO: 3209527 - protein, 6 aa, Plasmodium falciparum
HTPRYT

SEQ ID NO: 3209528 - protein, 6 aa, Plasmodium falciparum
IADKTE

SEQ ID NO: 3209529 - protein, 7 aa, Plasmodium falciparum
IATSTAK

SEQ ID NO: 3209530 - protein, 34 aa, Plasmodium falciparum
IDDCNKNQAQNSVETQPSDENTAQCQDTHPDDEE

SEQ ID NO: 3209531 - protein, 6 aa, Plasmodium falciparum
IDDDSS

SEQ ID NO: 3209532 - protein, 22 aa, Plasmodium falciparum
IDDEESSNKGKNENKKKKKKDK

SEQ ID NO: 3209533 - protein, 4 aa, Plasmodium falciparum
IDNT

SEQ ID NO: 3209534 - protein, 4 aa, Plasmodium falciparum
IDSS

SEQ ID NO: 3209535 - protein, 5 aa, Plasmodium falciparum
IDTDD

SEQ ID NO: 3209536 - protein, 17 aa, Plasmodium falciparum
IEEEEEKEKKEDEKGVK

SEQ ID NO: 3209537 - protein, 10 aa, Plasmodium falciparum
IEKKEKKEKK

SEQ ID NO: 3209538 - protein, 9 aa, Plasmodium falciparum
IENTNVKNE

SEQ ID NO: 3209539 - protein, 7 aa, Plasmodium falciparum
IEPTKSY

SEQ ID NO: 3209540 - protein, 5 aa, Plasmodium falciparum
IESYK

SEQ ID NO: 3209541 - protein, 7 aa, Plasmodium falciparum
IETETNP

SEQ ID NO: 3209542 - protein, 4 aa, Plasmodium falciparum
IETQ

SEQ ID NO: 3209543 - protein, 11 aa, Plasmodium falciparum
IGCSNSEGACA

SEQ ID NO: 3209544 - protein, 10 aa, Plasmodium falciparum
IGNNNGGTDI

SEQ ID NO: 3209545 - protein, 5 aa, Plasmodium falciparum
IGTND

SEQ ID NO: 3209546 - protein, 4 aa, Plasmodium falciparum
IKDE

SEQ ID NO: 3209547 - protein, 4 aa, Plasmodium falciparum
IKED

SEQ ID NO: 3209548 - protein, 6 aa, Plasmodium falciparum
IKEDKD

SEQ ID NO: 3209549 - protein, 10 aa, Plasmodium falciparum
IKEQASKDAK

SEQ ID NO: 3209550 - protein, 5 aa, Plasmodium falciparum
IKGGA

SEQ ID NO: 3209551 - protein, 12 aa, Plasmodium falciparum
IKGNNRNVTGGA

SEQ ID NO: 3209552 - protein, 4 aa, Plasmodium falciparum
IKKN

SEQ ID NO: 3209553 - protein, 6 aa, Plasmodium falciparum
IKLNDE

SEQ ID NO: 3209554 - protein, 4 aa, Plasmodium falciparum
IKND

SEQ ID NO: 3209555 - protein, 5 aa, Plasmodium falciparum
IKNNK

SEQ ID NO: 3209556 - protein, 5 aa, Plasmodium falciparum
IKTNK

SEQ ID NO: 3209557 - protein, 7 aa, Plasmodium falciparum
IKTNTKE

SEQ ID NO: 3209558 - protein, 6 aa, Plasmodium falciparum
INDDMK

SEQ ID NO: 3209559 - protein, 12 aa, Plasmodium falciparum
INDGGNNERNNF

SEQ ID NO: 3209560 - protein, 4 aa, Plasmodium falciparum
INDK

SEQ ID NO: 3209561 - protein, 4 aa, Plasmodium falciparum
INGS

SEQ ID NO: 3209562 - protein, 9 aa, Plasmodium falciparum
INKNTNDDM

SEQ ID NO: 3209563 - protein, 300 aa, Plasmodium falciparum
INKTGDEDKEINKTGDEDKEINKTGDEDKEINKTDDENKKINKTDDKDKKINKTDFEEKDISKTDSEEKDINKTDSEEKDINKIDSEEKDINKTDSEEKDINKTDSEDKEINKTGDEDKEINKTDDEEKDINKTDSEEKDINKTDSEDKEINKTEDEEKEINKTDSEDKDINKTGDEEKDINKTDSEEKDINKTEDEEKEINKNDNKDNHNKEKVDEDKDINKTDDKDNHNKDKVDEDKQINSTDDKDKKNNSTCQEQKEKETVVKKGKQDEPSVHKEKELKDQENKEHVNEKDNKKKDI

SEQ ID NO: 3209564 - protein, 4 aa, Plasmodium falciparum
INNK

SEQ ID NO: 3209565 - protein, 4 aa, Plasmodium falciparum
INNS

SEQ ID NO: 3209566 - protein, 14 aa, Plasmodium falciparum
INPKSVKTAVDTTK

SEQ ID NO: 3209567 - protein, 14 aa, Plasmodium falciparum
INPNHQNQNQVGDT

SEQ ID NO: 3209568 - protein, 15 aa, Plasmodium falciparum
INPNYESLNDDQIDD

SEQ ID NO: 3209569 - protein, 4 aa, Plasmodium falciparum
INRK

SEQ ID NO: 3209570 - protein, 10 aa, Plasmodium falciparum
INSNDINEEQ

SEQ ID NO: 3209571 - protein, 4 aa, Plasmodium falciparum
INSS

SEQ ID NO: 3209572 - protein, 4 aa, Plasmodium falciparum
INTT

SEQ ID NO: 3209573 - protein, 24 aa, Plasmodium falciparum
IPNEEKDYKSKKGRVKKENDTIPK

SEQ ID NO: 3209574 - protein, 10 aa, Plasmodium falciparum
IQDNEKENFS

SEQ ID NO: 3209575 - protein, 4 aa, Plasmodium falciparum
IQNK

SEQ ID NO: 3209576 - protein, 8 aa, Plasmodium falciparum
IQNSSNKY

SEQ ID NO: 3209577 - protein, 6 aa, Plasmodium falciparum
IQSDSI

SEQ ID NO: 3209578 - protein, 8 aa, Plasmodium falciparum
IREQENDT

SEQ ID NO: 3209579 - protein, 8 aa, Plasmodium falciparum
IRSEGTLK

SEQ ID NO: 3209580 - protein, 4 aa, Plasmodium falciparum
ISDK

SEQ ID NO: 3209581 - protein, 10 aa, Plasmodium falciparum
ISGNGENSTI

SEQ ID NO: 3209582 - protein, 5 aa, Plasmodium falciparum
ISGNH

SEQ ID NO: 3209583 - protein, 4 aa, Plasmodium falciparum
ISPS

SEQ ID NO: 3209584 - protein, 6 aa, Plasmodium falciparum
ISSDNN

SEQ ID NO: 3209585 - protein, 12 aa, Plasmodium falciparum
ISSKADTSTGVG

SEQ ID NO: 3209586 - protein, 4 aa, Plasmodium falciparum
ISTN

SEQ ID NO: 3209587 - protein, 8 aa, Plasmodium falciparum
ITDPNDQA

SEQ ID NO: 3209588 - protein, 20 aa, Plasmodium falciparum
ITEGTANISAAGVKAGEATG

SEQ ID NO: 3209589 - protein, 7 aa, Plasmodium falciparum
ITKTEPL

SEQ ID NO: 3209590 - protein, 6 aa, Plasmodium falciparum
ITTATE

SEQ ID NO: 3209591 - protein, 4 aa, Plasmodium falciparum
ITTN

SEQ ID NO: 3209592 - protein, 5 aa, Plasmodium falciparum
IYEDK

SEQ ID NO: 3209593 - protein, 4 aa, Plasmodium falciparum
IYNN

SEQ ID NO: 3209594 - protein, 7 aa, Plasmodium falciparum
KADTGNA

SEQ ID NO: 3209595 - protein, 10 aa, Plasmodium falciparum
KANNGEKTGV

SEQ ID NO: 3209596 - protein, 7 aa, Plasmodium falciparum
KANNLKE

SEQ ID NO: 3209597 - protein, 8 aa, Plasmodium falciparum
KAQNPTNA

SEQ ID NO: 3209598 - protein, 5 aa, Plasmodium falciparum
KATTV

SEQ ID NO: 3209599 - protein, 4 aa, Plasmodium falciparum
KCEE

SEQ ID NO: 3209600 - protein, 8 aa, Plasmodium falciparum
KCKEQCDK

SEQ ID NO: 3209601 - protein, 27 aa, Plasmodium falciparum
KDDDDQSGDKLQSTSAPSDTPTLNNPK

SEQ ID NO: 3209602 - protein, 16 aa, Plasmodium falciparum
KDDESGPKGNDTIQPA

SEQ ID NO: 3209603 - protein, 10 aa, Plasmodium falciparum
KDDLDNKDNV

SEQ ID NO: 3209604 - protein, 17 aa, Plasmodium falciparum
KDDTSDNVSLNSTDPEL

SEQ ID NO: 3209605 - protein, 14 aa, Plasmodium falciparum
KDDTSNGSSFKKQS

SEQ ID NO: 3209606 - protein, 6 aa, Plasmodium falciparum
KDECSN

SEQ ID NO: 3209607 - protein, 4 aa, Plasmodium falciparum
KDET

SEQ ID NO: 3209608 - protein, 7 aa, Plasmodium falciparum
KDNDYET

SEQ ID NO: 3209609 - protein, 10 aa, Plasmodium falciparum
KDNETDDNAC

SEQ ID NO: 3209610 - protein, 4 aa, Plasmodium falciparum
KDNN

SEQ ID NO: 3209611 - protein, 8 aa, Plasmodium falciparum
KDPPHGYA

SEQ ID NO: 3209612 - protein, 11 aa, Plasmodium falciparum
KDRKSDDGDTV

SEQ ID NO: 3209613 - protein, 19 aa, Plasmodium falciparum
KDVAEATKAQVTSETTATL

SEQ ID NO: 3209614 - protein, 86 aa, Plasmodium falciparum
KECQQKQNECPKKPPKKTPGGPDRALKPEEVDASSEDHYDEEGGEDEEEEEDKEEEGEDGEDVQDDVAEEDTAKEEGSSTTETQLP

SEQ ID NO: 3209615 - protein, 4 aa, Plasmodium falciparum
KEDE

SEQ ID NO: 3209616 - protein, 19 aa, Plasmodium falciparum
KEDGEKSTDDKTTLKRNDD

SEQ ID NO: 3209617 - protein, 9 aa, Plasmodium falciparum
KEEEKLEKE

SEQ ID NO: 3209618 - protein, 5 aa, Plasmodium falciparum
KEEEP

SEQ ID NO: 3209619 - protein, 9 aa, Plasmodium falciparum
KEEWDNNKG

SEQ ID NO: 3209620 - protein, 4 aa, Plasmodium falciparum
KEEY

SEQ ID NO: 3209621 - protein, 9 aa, Plasmodium falciparum
KEEYSEENE

SEQ ID NO: 3209622 - protein, 5 aa, Plasmodium falciparum
KEGIQ

SEQ ID NO: 3209623 - protein, 13 aa, Plasmodium falciparum
KEIEEKEKQAAQN

SEQ ID NO: 3209624 - protein, 9 aa, Plasmodium falciparum
KEISTPKNY

SEQ ID NO: 3209625 - protein, 8 aa, Plasmodium falciparum
KEKEEGKI

SEQ ID NO: 3209626 - protein, 5 aa, Plasmodium falciparum
KEKKK

SEQ ID NO: 3209627 - protein, 5 aa, Plasmodium falciparum
KEKLK

SEQ ID NO: 3209628 - protein, 15 aa, Plasmodium falciparum
KEKNIKKCEKDNIKN

SEQ ID NO: 3209629 - protein, 4 aa, Plasmodium falciparum
KEKS

SEQ ID NO: 3209630 - protein, 20 aa, Plasmodium falciparum
KELAEKAGAAEGASQGAAAG

SEQ ID NO: 3209631 - protein, 4 aa, Plasmodium falciparum
KELE

SEQ ID NO: 3209632 - protein, 14 aa, Plasmodium falciparum
KENGENTCSEESKN

SEQ ID NO: 3209633 - protein, 7 aa, Plasmodium falciparum
KENGGTN

SEQ ID NO: 3209634 - protein, 5 aa, Plasmodium falciparum
KENNS

SEQ ID NO: 3209635 - protein, 4 aa, Plasmodium falciparum
KENR

SEQ ID NO: 3209636 - protein, 4 aa, Plasmodium falciparum
KENT

SEQ ID NO: 3209637 - protein, 4 aa, Plasmodium falciparum
KENV

SEQ ID NO: 3209638 - protein, 5 aa, Plasmodium falciparum
KEQEG

SEQ ID NO: 3209639 - protein, 7 aa, Plasmodium falciparum
KEQFDKQ

SEQ ID NO: 3209640 - protein, 42 aa, Plasmodium falciparum
KEQFDKQKKKYTDEINEASRSSRRQKRGARSTGSSSNYDGYE

SEQ ID NO: 3209641 - protein, 15 aa, Plasmodium falciparum
KEQFDKQKQKYDEEI

SEQ ID NO: 3209642 - protein, 4 aa, Plasmodium falciparum
KEQN

SEQ ID NO: 3209643 - protein, 18 aa, Plasmodium falciparum
KEQTQHVQEQTYERKPSV

SEQ ID NO: 3209644 - protein, 4 aa, Plasmodium falciparum
KETE

SEQ ID NO: 3209645 - protein, 5 aa, Plasmodium falciparum
KETEW

SEQ ID NO: 3209646 - protein, 19 aa, Plasmodium falciparum
KETNEKKKKFMESNNKSLT

SEQ ID NO: 3209647 - protein, 6 aa, Plasmodium falciparum
KEVENA

SEQ ID NO: 3209648 - protein, 14 aa, Plasmodium falciparum
KEYDSYSDTGSTTM

SEQ ID NO: 3209649 - protein, 7 aa, Plasmodium falciparum
KFEPPKM

SEQ ID NO: 3209650 - protein, 13 aa, Plasmodium falciparum
KFGDNREKTLGKH

SEQ ID NO: 3209651 - protein, 7 aa, Plasmodium falciparum
KGDYEMP

SEQ ID NO: 3209652 - protein, 10 aa, Plasmodium falciparum
KGEEKDKDKH

SEQ ID NO: 3209653 - protein, 8 aa, Plasmodium falciparum
KGISNNNC

SEQ ID NO: 3209654 - protein, 26 aa, Plasmodium falciparum
KGKNEKKVATKGKKGRKKNKKTLGQT

SEQ ID NO: 3209655 - protein, 5 aa, Plasmodium falciparum
KGNNN

SEQ ID NO: 3209656 - protein, 10 aa, Plasmodium falciparum
KGQKYGSKNI

SEQ ID NO: 3209657 - protein, 28 aa, Plasmodium falciparum
KGSSEGETSSNKESNESNEPTKKPSKYT

SEQ ID NO: 3209658 - protein, 6 aa, Plasmodium falciparum
KIGTTE

SEQ ID NO: 3209659 - protein, 14 aa, Plasmodium falciparum
KIHGNSKGSNGGAC

SEQ ID NO: 3209660 - protein, 4 aa, Plasmodium falciparum
KIKT

SEQ ID NO: 3209661 - protein, 4 aa, Plasmodium falciparum
KIND

SEQ ID NO: 3209662 - protein, 23 aa, Plasmodium falciparum
KINNNNNNNNNNTQLNNNSFNNN

SEQ ID NO: 3209663 - protein, 25 aa, Plasmodium falciparum
KINPCTKKETEKEKEKSYKCTQGCN

SEQ ID NO: 3209664 - protein, 5 aa, Plasmodium falciparum
KINTE

SEQ ID NO: 3209665 - protein, 4 aa, Plasmodium falciparum
KIPP

SEQ ID NO: 3209666 - protein, 4 aa, Plasmodium falciparum
KISD

SEQ ID NO: 3209667 - protein, 6 aa, Plasmodium falciparum
KISGER

SEQ ID NO: 3209668 - protein, 7 aa, Plasmodium falciparum
KITTSRT

SEQ ID NO: 3209669 - protein, 6 aa, Plasmodium falciparum
KKAQEV

SEQ ID NO: 3209670 - protein, 6 aa, Plasmodium falciparum
KKDEWD

SEQ ID NO: 3209671 - protein, 12 aa, Plasmodium falciparum
KKDGGNSDSSLY

SEQ ID NO: 3209672 - protein, 11 aa, Plasmodium falciparum
KKDKNGGVAQA

SEQ ID NO: 3209673 - protein, 19 aa, Plasmodium falciparum
KKEANEENTFPEQEEPNRQ

SEQ ID NO: 3209674 - protein, 5 aa, Plasmodium falciparum
KKEEN

SEQ ID NO: 3209675 - protein, 4 aa, Plasmodium falciparum
KKEH

SEQ ID NO: 3209676 - protein, 4 aa, Plasmodium falciparum
KKEK

SEQ ID NO: 3209677 - protein, 5 aa, Plasmodium falciparum
KKEKY

SEQ ID NO: 3209678 - protein, 4 aa, Plasmodium falciparum
KKEN

SEQ ID NO: 3209679 - protein, 5 aa, Plasmodium falciparum
KKENK

SEQ ID NO: 3209680 - protein, 8 aa, Plasmodium falciparum
KKERGSKV

SEQ ID NO: 3209681 - protein, 4 aa, Plasmodium falciparum
KKET

SEQ ID NO: 3209682 - protein, 16 aa, Plasmodium falciparum
KKETKSRSRNSEQEMS

SEQ ID NO: 3209683 - protein, 6 aa, Plasmodium falciparum
KKEYEN

SEQ ID NO: 3209684 - protein, 11 aa, Plasmodium falciparum
KKGDNNGKLDD

SEQ ID NO: 3209685 - protein, 6 aa, Plasmodium falciparum
KKGEWK

SEQ ID NO: 3209686 - protein, 4 aa, Plasmodium falciparum
KKGI

SEQ ID NO: 3209687 - protein, 9 aa, Plasmodium falciparum
KKGIDGNWE

SEQ ID NO: 3209688 - protein, 6 aa, Plasmodium falciparum
KKGIDQ

SEQ ID NO: 3209689 - protein, 8 aa, Plasmodium falciparum
KKGKCTSG

SEQ ID NO: 3209690 - protein, 13 aa, Plasmodium falciparum
KKITNGKESSRSI

SEQ ID NO: 3209691 - protein, 7 aa, Plasmodium falciparum
KKKDKKI

SEQ ID NO: 3209692 - protein, 6 aa, Plasmodium falciparum
KKKKEW

SEQ ID NO: 3209693 - protein, 5 aa, Plasmodium falciparum
KKKKK

SEQ ID NO: 3209694 - protein, 8 aa, Plasmodium falciparum
KKKKKIKK

SEQ ID NO: 3209695 - protein, 7 aa, Plasmodium falciparum
KKKKKKK

SEQ ID NO: 3209696 - protein, 16 aa, Plasmodium falciparum
KKKKKKTETERDQLES

SEQ ID NO: 3209697 - protein, 6 aa, Plasmodium falciparum
KKKKKN

SEQ ID NO: 3209698 - protein, 13 aa, Plasmodium falciparum
KKKKKNNNNNNNN

SEQ ID NO: 3209699 - protein, 6 aa, Plasmodium falciparum
KKKKNY

SEQ ID NO: 3209700 - protein, 7 aa, Plasmodium falciparum
KKKKSYK

SEQ ID NO: 3209701 - protein, 4 aa, Plasmodium falciparum
KKKM

SEQ ID NO: 3209702 - protein, 9 aa, Plasmodium falciparum
KKKNEEKTP

SEQ ID NO: 3209703 - protein, 6 aa, Plasmodium falciparum
KKKNFN

SEQ ID NO: 3209704 - protein, 10 aa, Plasmodium falciparum
KKKQNNNQHY

SEQ ID NO: 3209705 - protein, 5 aa, Plasmodium falciparum
KKKRN

SEQ ID NO: 3209706 - protein, 4 aa, Plasmodium falciparum
KKKT

SEQ ID NO: 3209707 - protein, 5 aa, Plasmodium falciparum
KKKYL

SEQ ID NO: 3209708 - protein, 14 aa, Plasmodium falciparum
KKMNKKAQYTELLN

SEQ ID NO: 3209709 - protein, 14 aa, Plasmodium falciparum
KKMNKKAQYTKLLN

SEQ ID NO: 3209710 - protein, 92 aa, Plasmodium falciparum
KKNDTNNVNKQNEEDKNNLEDKNDLEDKNDLEDKNDMEDKNNMEDKNDMEDKNNMEDKNDMEDKNDMENKNNLDGKNKLDDKKKDQKQKNMY

SEQ ID NO: 3209711 - protein, 8 aa, Plasmodium falciparum
KKNDYDKK

SEQ ID NO: 3209712 - protein, 4 aa, Plasmodium falciparum
KKNF

SEQ ID NO: 3209713 - protein, 7 aa, Plasmodium falciparum
KKNGETW

SEQ ID NO: 3209714 - protein, 4 aa, Plasmodium falciparum
KKNI

SEQ ID NO: 3209715 - protein, 10 aa, Plasmodium falciparum
KKNITDADDE

SEQ ID NO: 3209716 - protein, 4 aa, Plasmodium falciparum
KKNN

SEQ ID NO: 3209717 - protein, 4 aa, Plasmodium falciparum
KKNS

SEQ ID NO: 3209718 - protein, 7 aa, Plasmodium falciparum
KKNSNEK

SEQ ID NO: 3209719 - protein, 4 aa, Plasmodium falciparum
KKPL

SEQ ID NO: 3209720 - protein, 4 aa, Plasmodium falciparum
KKQK

SEQ ID NO: 3209721 - protein, 14 aa, Plasmodium falciparum
KKQNGKKTEREKLE

SEQ ID NO: 3209722 - protein, 26 aa, Plasmodium falciparum
KKREDIEKQKANEKVVDTSNVGEELQ

SEQ ID NO: 3209723 - protein, 4 aa, Plasmodium falciparum
KKRI

SEQ ID NO: 3209724 - protein, 4 aa, Plasmodium falciparum
KKRR

SEQ ID NO: 3209725 - protein, 4 aa, Plasmodium falciparum
KKRY

SEQ ID NO: 3209726 - protein, 11 aa, Plasmodium falciparum
KKSEEYSNETK

SEQ ID NO: 3209727 - protein, 9 aa, Plasmodium falciparum
KKSQYEDGF

SEQ ID NO: 3209728 - protein, 35 aa, Plasmodium falciparum
KKTEYEKQESAYSKQKSNYVNGSNGDGGNNNDKEF

SEQ ID NO: 3209729 - protein, 5 aa, Plasmodium falciparum
KKTYN

SEQ ID NO: 3209730 - protein, 4 aa, Plasmodium falciparum
KKVD

SEQ ID NO: 3209731 - protein, 4 aa, Plasmodium falciparum
KKYK

SEQ ID NO: 3209732 - protein, 5 aa, Plasmodium falciparum
KKYQK

SEQ ID NO: 3209733 - protein, 8 aa, Plasmodium falciparum
KLDENTPK

SEQ ID NO: 3209734 - protein, 4 aa, Plasmodium falciparum
KLDS

SEQ ID NO: 3209735 - protein, 4 aa, Plasmodium falciparum
KLKD

SEQ ID NO: 3209736 - protein, 4 aa, Plasmodium falciparum
KLPY

SEQ ID NO: 3209737 - protein, 7 aa, Plasmodium falciparum
KMDEKNK

SEQ ID NO: 3209738 - protein, 5 aa, Plasmodium falciparum
KMEGE

SEQ ID NO: 3209739 - protein, 13 aa, Plasmodium falciparum
KMNKKLQYTKLLN

SEQ ID NO: 3209740 - protein, 19 aa, Plasmodium falciparum
KNAKEQCREKYKSGTDRYC

SEQ ID NO: 3209741 - protein, 12 aa, Plasmodium falciparum
KNDAKTYKGELE

SEQ ID NO: 3209742 - protein, 5 aa, Plasmodium falciparum
KNDIG

SEQ ID NO: 3209743 - protein, 4 aa, Plasmodium falciparum
KNDK

SEQ ID NO: 3209744 - protein, 5 aa, Plasmodium falciparum
KNDNK

SEQ ID NO: 3209745 - protein, 11 aa, Plasmodium falciparum
KNDNKKSFGNT

SEQ ID NO: 3209746 - protein, 4 aa, Plasmodium falciparum
KNDY

SEQ ID NO: 3209747 - protein, 7 aa, Plasmodium falciparum
KNEAENY

SEQ ID NO: 3209748 - protein, 4 aa, Plasmodium falciparum
KNED

SEQ ID NO: 3209749 - protein, 4 aa, Plasmodium falciparum
KNEL

SEQ ID NO: 3209750 - protein, 10 aa, Plasmodium falciparum
KNENGNTNNY

SEQ ID NO: 3209751 - protein, 4 aa, Plasmodium falciparum
KNEQ

SEQ ID NO: 3209752 - protein, 7 aa, Plasmodium falciparum
KNERDKQ

SEQ ID NO: 3209753 - protein, 5 aa, Plasmodium falciparum
KNEWD

SEQ ID NO: 3209754 - protein, 13 aa, Plasmodium falciparum
KNGEENGKKQKTY

SEQ ID NO: 3209755 - protein, 8 aa, Plasmodium falciparum
KNGIDNTS

SEQ ID NO: 3209756 - protein, 9 aa, Plasmodium falciparum
KNGKNKRKI

SEQ ID NO: 3209757 - protein, 14 aa, Plasmodium falciparum
KNGTKTRCKNNKCN

SEQ ID NO: 3209758 - protein, 23 aa, Plasmodium falciparum
KNHTNDSRPNGEPCTGKDKVKNG

SEQ ID NO: 3209759 - protein, 4 aa, Plasmodium falciparum
KNIS

SEQ ID NO: 3209760 - protein, 6 aa, Plasmodium falciparum
KNITGE

SEQ ID NO: 3209761 - protein, 5 aa, Plasmodium falciparum
KNITI

SEQ ID NO: 3209762 - protein, 4 aa, Plasmodium falciparum
KNKF

SEQ ID NO: 3209763 - protein, 4 aa, Plasmodium falciparum
KNKI

SEQ ID NO: 3209764 - protein, 5 aa, Plasmodium falciparum
KNKIN

SEQ ID NO: 3209765 - protein, 22 aa, Plasmodium falciparum
KNKKKTKKEKNIEKEEKKYKNK

SEQ ID NO: 3209766 - protein, 7 aa, Plasmodium falciparum
KNKNDIN

SEQ ID NO: 3209767 - protein, 6 aa, Plasmodium falciparum
KNKNNQ

SEQ ID NO: 3209768 - protein, 16 aa, Plasmodium falciparum
KNKPHTTPHHTPTTTS

SEQ ID NO: 3209769 - protein, 4 aa, Plasmodium falciparum
KNKY

SEQ ID NO: 3209770 - protein, 17 aa, Plasmodium falciparum
KNNDDEGINKESYTTKS

SEQ ID NO: 3209771 - protein, 4 aa, Plasmodium falciparum
KNNE

SEQ ID NO: 3209772 - protein, 13 aa, Plasmodium falciparum
KNNFEVKEDDNSI

SEQ ID NO: 3209773 - protein, 5 aa, Plasmodium falciparum
KNNIS

SEQ ID NO: 3209774 - protein, 4 aa, Plasmodium falciparum
KNNN

SEQ ID NO: 3209775 - protein, 9 aa, Plasmodium falciparum
KNNNGEWEH

SEQ ID NO: 3209776 - protein, 5 aa, Plasmodium falciparum
KNNNN

SEQ ID NO: 3209777 - protein, 19 aa, Plasmodium falciparum
KNNPVDSNSSTYNHHNPAD

SEQ ID NO: 3209778 - protein, 10 aa, Plasmodium falciparum
KNNYDDDPEM

SEQ ID NO: 3209779 - protein, 4 aa, Plasmodium falciparum
KNRL

SEQ ID NO: 3209780 - protein, 6 aa, Plasmodium falciparum
KNRPLK

SEQ ID NO: 3209781 - protein, 4 aa, Plasmodium falciparum
KNSE

SEQ ID NO: 3209782 - protein, 33 aa, Plasmodium falciparum
KNTAIKAGQAAAKMTTETTKALTAEKTGEVTST

SEQ ID NO: 3209783 - protein, 14 aa, Plasmodium falciparum
KNTEEGRKKERQKP

SEQ ID NO: 3209784 - protein, 4 aa, Plasmodium falciparum
KNTK

SEQ ID NO: 3209785 - protein, 4 aa, Plasmodium falciparum
KNTN

SEQ ID NO: 3209786 - protein, 11 aa, Plasmodium falciparum
KNTNKKSNGNA

SEQ ID NO: 3209787 - protein, 9 aa, Plasmodium falciparum
KNTNNKSCA

SEQ ID NO: 3209788 - protein, 8 aa, Plasmodium falciparum
KNVSEEIP

SEQ ID NO: 3209789 - protein, 4 aa, Plasmodium falciparum
KNYE

SEQ ID NO: 3209790 - protein, 4 aa, Plasmodium falciparum
KNYS

SEQ ID NO: 3209791 - protein, 6 aa, Plasmodium falciparum
KNYSEE

SEQ ID NO: 3209792 - protein, 6 aa, Plasmodium falciparum
KNYVNN

SEQ ID NO: 3209793 - protein, 8 aa, Plasmodium falciparum
KPARDDPL

SEQ ID NO: 3209794 - protein, 4 aa, Plasmodium falciparum
KPCD

SEQ ID NO: 3209795 - protein, 11 aa, Plasmodium falciparum
KPDMKKSEQRP

SEQ ID NO: 3209796 - protein, 5 aa, Plasmodium falciparum
KPFNE

SEQ ID NO: 3209797 - protein, 10 aa, Plasmodium falciparum
KPKKDAPHTP

SEQ ID NO: 3209798 - protein, 6 aa, Plasmodium falciparum
KPPNKP

SEQ ID NO: 3209799 - protein, 4 aa, Plasmodium falciparum
KPVS

SEQ ID NO: 3209800 - protein, 4 aa, Plasmodium falciparum
KQDD

SEQ ID NO: 3209801 - protein, 5 aa, Plasmodium falciparum
KQEWT

SEQ ID NO: 3209802 - protein, 4 aa, Plasmodium falciparum
KQME

SEQ ID NO: 3209803 - protein, 8 aa, Plasmodium falciparum
KQPNIKRE

SEQ ID NO: 3209804 - protein, 6 aa, Plasmodium falciparum
KQTEER

SEQ ID NO: 3209805 - protein, 4 aa, Plasmodium falciparum
KRDI

SEQ ID NO: 3209806 - protein, 4 aa, Plasmodium falciparum
KRKI

SEQ ID NO: 3209807 - protein, 4 aa, Plasmodium falciparum
KRNN

SEQ ID NO: 3209808 - protein, 12 aa, Plasmodium falciparum
KSCTEKGEGSPC

SEQ ID NO: 3209809 - protein, 18 aa, Plasmodium falciparum
KSCTGESNNKHCSREGYD

SEQ ID NO: 3209810 - protein, 15 aa, Plasmodium falciparum
KSDYGTPTPKSKNRY

SEQ ID NO: 3209811 - protein, 10 aa, Plasmodium falciparum
KSGEGKEEIE

SEQ ID NO: 3209812 - protein, 7 aa, Plasmodium falciparum
KSGGNSL

SEQ ID NO: 3209813 - protein, 8 aa, Plasmodium falciparum
KSGNVKNA

SEQ ID NO: 3209814 - protein, 4 aa, Plasmodium falciparum
KSIS

SEQ ID NO: 3209815 - protein, 5 aa, Plasmodium falciparum
KSKEE

SEQ ID NO: 3209816 - protein, 20 aa, Plasmodium falciparum
KSKKCNGTSRSGNSEESTKY

SEQ ID NO: 3209817 - protein, 15 aa, Plasmodium falciparum
KSKKGSKKKNPDAEI

SEQ ID NO: 3209818 - protein, 4 aa, Plasmodium falciparum
KSLE

SEQ ID NO: 3209819 - protein, 4 aa, Plasmodium falciparum
KSLK

SEQ ID NO: 3209820 - protein, 5 aa, Plasmodium falciparum
KSNDS

SEQ ID NO: 3209821 - protein, 4 aa, Plasmodium falciparum
KSNN

SEQ ID NO: 3209822 - protein, 6 aa, Plasmodium falciparum
KSPNGK

SEQ ID NO: 3209823 - protein, 8 aa, Plasmodium falciparum
KSPQNTSP

SEQ ID NO: 3209824 - protein, 6 aa, Plasmodium falciparum
KSSITK

SEQ ID NO: 3209825 - protein, 4 aa, Plasmodium falciparum
KSTK

SEQ ID NO: 3209826 - protein, 6 aa, Plasmodium falciparum
KSTNNH

SEQ ID NO: 3209827 - protein, 4 aa, Plasmodium falciparum
KSTP

SEQ ID NO: 3209828 - protein, 20 aa, Plasmodium falciparum
KSVNTRDKRDATDDTTPTVY

SEQ ID NO: 3209829 - protein, 4 aa, Plasmodium falciparum
KTED

SEQ ID NO: 3209830 - protein, 4 aa, Plasmodium falciparum
KTFK

SEQ ID NO: 3209831 - protein, 12 aa, Plasmodium falciparum
KTGGAGTGDHPP

SEQ ID NO: 3209832 - protein, 17 aa, Plasmodium falciparum
KTHENKAECEKNEDKNC

SEQ ID NO: 3209833 - protein, 7 aa, Plasmodium falciparum
KTKGRDK

SEQ ID NO: 3209834 - protein, 5 aa, Plasmodium falciparum
KTKRA

SEQ ID NO: 3209835 - protein, 7 aa, Plasmodium falciparum
KTKRTTI

SEQ ID NO: 3209836 - protein, 6 aa, Plasmodium falciparum
KTKSPV

SEQ ID NO: 3209837 - protein, 8 aa, Plasmodium falciparum
KTLDDTKN

SEQ ID NO: 3209838 - protein, 10 aa, Plasmodium falciparum
KTNNGKESDK

SEQ ID NO: 3209839 - protein, 6 aa, Plasmodium falciparum
KTPNEY

SEQ ID NO: 3209840 - protein, 13 aa, Plasmodium falciparum
KTPSLTESHNSAR

SEQ ID NO: 3209841 - protein, 17 aa, Plasmodium falciparum
KTSENPQKKLEGGEIPE

SEQ ID NO: 3209842 - protein, 23 aa, Plasmodium falciparum
KVASSSSGGRAKRAARGGSNVNG

SEQ ID NO: 3209843 - protein, 6 aa, Plasmodium falciparum
KVTDTD

SEQ ID NO: 3209844 - protein, 4 aa, Plasmodium falciparum
KYEI

SEQ ID NO: 3209845 - protein, 6 aa, Plasmodium falciparum
KYENLR

SEQ ID NO: 3209846 - protein, 11 aa, Plasmodium falciparum
KYKSGNEPRYC

SEQ ID NO: 3209847 - protein, 12 aa, Plasmodium falciparum
KYMNQEDGEIRK

SEQ ID NO: 3209848 - protein, 5 aa, Plasmodium falciparum
KYNMS

SEQ ID NO: 3209849 - protein, 9 aa, Plasmodium falciparum
KYQDENNGI

SEQ ID NO: 3209850 - protein, 9 aa, Plasmodium falciparum
KYQQSNDTY

SEQ ID NO: 3209851 - protein, 9 aa, Plasmodium falciparum
LAKTKGRDK

SEQ ID NO: 3209852 - protein, 11 aa, Plasmodium falciparum
LAPGAVPSRPS

SEQ ID NO: 3209853 - protein, 10 aa, Plasmodium falciparum
LDDEPEEVNG

SEQ ID NO: 3209854 - protein, 4 aa, Plasmodium falciparum
LDEL

SEQ ID NO: 3209855 - protein, 4 aa, Plasmodium falciparum
LDES

SEQ ID NO: 3209856 - protein, 9 aa, Plasmodium falciparum
LDNGNKNNV

SEQ ID NO: 3209857 - protein, 14 aa, Plasmodium falciparum
LDQNTKENPEGNNL

SEQ ID NO: 3209858 - protein, 5 aa, Plasmodium falciparum
LEEGA

SEQ ID NO: 3209859 - protein, 6 aa, Plasmodium falciparum
LGGKDL

SEQ ID NO: 3209860 - protein, 4 aa, Plasmodium falciparum
LGGQ

SEQ ID NO: 3209861 - protein, 29 aa, Plasmodium falciparum
LGTRGGESKLKGDATRGTYNLGGQGNTLN

SEQ ID NO: 3209862 - protein, 4 aa, Plasmodium falciparum
LKED

SEQ ID NO: 3209863 - protein, 29 aa, Plasmodium falciparum
LKGSSGGETSSNKESNENNEPTKKPSKYT

SEQ ID NO: 3209864 - protein, 8 aa, Plasmodium falciparum
LKHNTNKI

SEQ ID NO: 3209865 - protein, 12 aa, Plasmodium falciparum
LKKEDSDKSIDN

SEQ ID NO: 3209866 - protein, 7 aa, Plasmodium falciparum
LKMKGEK

SEQ ID NO: 3209867 - protein, 15 aa, Plasmodium falciparum
LKSFEGKNNNNDNYA

SEQ ID NO: 3209868 - protein, 9 aa, Plasmodium falciparum
LNDDDDDII

SEQ ID NO: 3209869 - protein, 4 aa, Plasmodium falciparum
LNDS

SEQ ID NO: 3209870 - protein, 4 aa, Plasmodium falciparum
LNER

SEQ ID NO: 3209871 - protein, 6 aa, Plasmodium falciparum
LNPTYG

SEQ ID NO: 3209872 - protein, 5 aa, Plasmodium falciparum
LNSDQ

SEQ ID NO: 3209873 - protein, 9 aa, Plasmodium falciparum
LNSGTIPDD

SEQ ID NO: 3209874 - protein, 5 aa, Plasmodium falciparum
LPNEI

SEQ ID NO: 3209875 - protein, 4 aa, Plasmodium falciparum
LPSY

SEQ ID NO: 3209876 - protein, 15 aa, Plasmodium falciparum
LQDKRQKRKEQRDKN

SEQ ID NO: 3209877 - protein, 4 aa, Plasmodium falciparum
LQEK

SEQ ID NO: 3209878 - protein, 4 aa, Plasmodium falciparum
LQEN

SEQ ID NO: 3209879 - protein, 4 aa, Plasmodium falciparum
LQRN

SEQ ID NO: 3209880 - protein, 4 aa, Plasmodium falciparum
LRYG

SEQ ID NO: 3209881 - protein, 4 aa, Plasmodium falciparum
LSDN

SEQ ID NO: 3209882 - protein, 9 aa, Plasmodium falciparum
LSDNPKCTG

SEQ ID NO: 3209883 - protein, 20 aa, Plasmodium falciparum
LSETESVEHSGLSNTSEDVE

SEQ ID NO: 3209884 - protein, 6 aa, Plasmodium falciparum
LSGKVE

SEQ ID NO: 3209885 - protein, 4 aa, Plasmodium falciparum
LSNK

SEQ ID NO: 3209886 - protein, 6 aa, Plasmodium falciparum
LSNNNY

SEQ ID NO: 3209887 - protein, 5 aa, Plasmodium falciparum
LSPKD

SEQ ID NO: 3209888 - protein, 5 aa, Plasmodium falciparum
LSRSN

SEQ ID NO: 3209889 - protein, 4 aa, Plasmodium falciparum
LSSN

SEQ ID NO: 3209890 - protein, 11 aa, Plasmodium falciparum
LSSSNESSMNS

SEQ ID NO: 3209891 - protein, 7 aa, Plasmodium falciparum
LSSTDVK

SEQ ID NO: 3209892 - protein, 27 aa, Plasmodium falciparum
LTDSSKIKNDFPTNIENNKTKNNITNG

SEQ ID NO: 3209893 - protein, 7 aa, Plasmodium falciparum
LTKKGEK

SEQ ID NO: 3209894 - protein, 19 aa, Plasmodium falciparum
LTNESNGLKSDAHNNNTQV

SEQ ID NO: 3209895 - protein, 5 aa, Plasmodium falciparum
MDIEQ

SEQ ID NO: 3209896 - protein, 10 aa, Plasmodium falciparum
MDTNPDKSTM

SEQ ID NO: 3209897 - protein, 10 aa, Plasmodium falciparum
MDTSPDKSTM

SEQ ID NO: 3209898 - protein, 5 aa, Plasmodium falciparum
MEKNL

SEQ ID NO: 3209899 - protein, 4 aa, Plasmodium falciparum
MENE

SEQ ID NO: 3209900 - protein, 9 aa, Plasmodium falciparum
MGKTSTTKH

SEQ ID NO: 3209901 - protein, 14 aa, Plasmodium falciparum
MKDKRRKCKEQCDK

SEQ ID NO: 3209902 - protein, 15 aa, Plasmodium falciparum
MKGKRQKRKEQRDKN

SEQ ID NO: 3209903 - protein, 12 aa, Plasmodium falciparum
MKKKLQYLKLLK

SEQ ID NO: 3209904 - protein, 28 aa, Plasmodium falciparum
MKNTEPIKSYRSLCCELYTSIYDDDPEM

SEQ ID NO: 3209905 - protein, 28 aa, Plasmodium falciparum
MKNTEPIKSYRSLCCELYTSMYDDDPEM

SEQ ID NO: 3209906 - protein, 14 aa, Plasmodium falciparum
MKTTRQECKEQCDK

SEQ ID NO: 3209907 - protein, 14 aa, Plasmodium falciparum
MKTTRQKCKDRCDK

SEQ ID NO: 3209908 - protein, 12 aa, Plasmodium falciparum
MNKNRQKCREQC

SEQ ID NO: 3209909 - protein, 4 aa, Plasmodium falciparum
MNNN

SEQ ID NO: 3209910 - protein, 14 aa, Plasmodium falciparum
MSGQENNYLNSQTN

SEQ ID NO: 3209911 - protein, 8 aa, Plasmodium falciparum
NAGNSEKD

SEQ ID NO: 3209912 - protein, 5 aa, Plasmodium falciparum
NCRNI

SEQ ID NO: 3209913 - protein, 10 aa, Plasmodium falciparum
NCSNEATIAD

SEQ ID NO: 3209914 - protein, 20 aa, Plasmodium falciparum
NCSSGSKSRTSGGTNRCTEV

SEQ ID NO: 3209915 - protein, 8 aa, Plasmodium falciparum
NDDGGINK

SEQ ID NO: 3209916 - protein, 6 aa, Plasmodium falciparum
NDDNIN

SEQ ID NO: 3209917 - protein, 5 aa, Plasmodium falciparum
NDEDI

SEQ ID NO: 3209918 - protein, 5 aa, Plasmodium falciparum
NDEND

SEQ ID NO: 3209919 - protein, 13 aa, Plasmodium falciparum
NDGKEKVNKQKTY

SEQ ID NO: 3209920 - protein, 8 aa, Plasmodium falciparum
NDIEEDGF

SEQ ID NO: 3209921 - protein, 4 aa, Plasmodium falciparum
NDKD

SEQ ID NO: 3209922 - protein, 9 aa, Plasmodium falciparum
NDKLDNENN

SEQ ID NO: 3209923 - protein, 12 aa, Plasmodium falciparum
NDLEGNGTIPEE

SEQ ID NO: 3209924 - protein, 7 aa, Plasmodium falciparum
NDNKIND

SEQ ID NO: 3209925 - protein, 7 aa, Plasmodium falciparum
NDNNYTN

SEQ ID NO: 3209926 - protein, 4 aa, Plasmodium falciparum
NDQD

SEQ ID NO: 3209927 - protein, 17 aa, Plasmodium falciparum
NDRNNKVSSIKSSEKYQ

SEQ ID NO: 3209928 - protein, 13 aa, Plasmodium falciparum
NDSEHSGTFSQPN

SEQ ID NO: 3209929 - protein, 9 aa, Plasmodium falciparum
NDSSKRTVQ

SEQ ID NO: 3209930 - protein, 5 aa, Plasmodium falciparum
NDTLN

SEQ ID NO: 3209931 - protein, 9 aa, Plasmodium falciparum
NDVRTNDIR

SEQ ID NO: 3209932 - protein, 8 aa, Plasmodium falciparum
NDVTTKRK

SEQ ID NO: 3209933 - protein, 4 aa, Plasmodium falciparum
NDYD

SEQ ID NO: 3209934 - protein, 16 aa, Plasmodium falciparum
NEEDNNNNNNKEHPNQ

SEQ ID NO: 3209935 - protein, 4 aa, Plasmodium falciparum
NEEE

SEQ ID NO: 3209936 - protein, 4 aa, Plasmodium falciparum
NEEL

SEQ ID NO: 3209937 - protein, 11 aa, Plasmodium falciparum
NEFEKQKKKYY

SEQ ID NO: 3209938 - protein, 6 aa, Plasmodium falciparum
NEGYET

SEQ ID NO: 3209939 - protein, 4 aa, Plasmodium falciparum
NEIE

SEQ ID NO: 3209940 - protein, 4 aa, Plasmodium falciparum
NEKL

SEQ ID NO: 3209941 - protein, 4 aa, Plasmodium falciparum
NEKN

SEQ ID NO: 3209942 - protein, 7 aa, Plasmodium falciparum
NEKPTNC

SEQ ID NO: 3209943 - protein, 4 aa, Plasmodium falciparum
NEKQ

SEQ ID NO: 3209944 - protein, 7 aa, Plasmodium falciparum
NEKQKNV

SEQ ID NO: 3209945 - protein, 4 aa, Plasmodium falciparum
NEKS

SEQ ID NO: 3209946 - protein, 8 aa, Plasmodium falciparum
NEKTPRND

SEQ ID NO: 3209947 - protein, 4 aa, Plasmodium falciparum
NEKY

SEQ ID NO: 3209948 - protein, 4 aa, Plasmodium falciparum
NELN

SEQ ID NO: 3209949 - protein, 66 aa, Plasmodium falciparum
NENGNENGNENGNGDENGNENGNENGNENGNENGNENGNENGNGNGVENGNENGVENGNENGNAIR

SEQ ID NO: 3209950 - protein, 5 aa, Plasmodium falciparum
NENKD

SEQ ID NO: 3209951 - protein, 4 aa, Plasmodium falciparum
NENL

SEQ ID NO: 3209952 - protein, 4 aa, Plasmodium falciparum
NENN

SEQ ID NO: 3209953 - protein, 5 aa, Plasmodium falciparum
NENNI

SEQ ID NO: 3209954 - protein, 8 aa, Plasmodium falciparum
NENQVAQP

SEQ ID NO: 3209955 - protein, 4 aa, Plasmodium falciparum
NENV

SEQ ID NO: 3209956 - protein, 5 aa, Plasmodium falciparum
NEQTL

SEQ ID NO: 3209957 - protein, 4 aa, Plasmodium falciparum
NESK

SEQ ID NO: 3209958 - protein, 15 aa, Plasmodium falciparum
NETHSGDINSGIPSG

SEQ ID NO: 3209959 - protein, 4 aa, Plasmodium falciparum
NETQ

SEQ ID NO: 3209960 - protein, 14 aa, Plasmodium falciparum
NETYNSDEYDDNYV

SEQ ID NO: 3209961 - protein, 5 aa, Plasmodium falciparum
NFKNE

SEQ ID NO: 3209962 - protein, 31 aa, Plasmodium falciparum
NGASESGGSGSGTESQASDVSQGNGASTSPQ

SEQ ID NO: 3209963 - protein, 10 aa, Plasmodium falciparum
NGDDINGEHI

SEQ ID NO: 3209964 - protein, 16 aa, Plasmodium falciparum
NGDKPGEDKANVDPPT

SEQ ID NO: 3209965 - protein, 14 aa, Plasmodium falciparum
NGGKKGPPPATHPY

SEQ ID NO: 3209966 - protein, 20 aa, Plasmodium falciparum
NGKKWAEAKEYYQDDGTGNY

SEQ ID NO: 3209967 - protein, 4 aa, Plasmodium falciparum
NGNN

SEQ ID NO: 3209968 - protein, 7 aa, Plasmodium falciparum
NGNYNEY

SEQ ID NO: 3209969 - protein, 37 aa, Plasmodium falciparum
NGSGSGGVTARDDPCGNGSGKGEDVSRFSDKEGAQCA

SEQ ID NO: 3209970 - protein, 14 aa, Plasmodium falciparum
NGSGWEEKKKNDQC

SEQ ID NO: 3209971 - protein, 4 aa, Plasmodium falciparum
NGSS

SEQ ID NO: 3209972 - protein, 6 aa, Plasmodium falciparum
NGYGEN

SEQ ID NO: 3209973 - protein, 5 aa, Plasmodium falciparum
NHERL

SEQ ID NO: 3209974 - protein, 13 aa, Plasmodium falciparum
NHKSTNLHTQNNR

SEQ ID NO: 3209975 - protein, 6 aa, Plasmodium falciparum
NHSSAA

SEQ ID NO: 3209976 - protein, 15 aa, Plasmodium falciparum
NIDEKKKKKRKKKKI

SEQ ID NO: 3209977 - protein, 12 aa, Plasmodium falciparum
NIINNNSKNISS

SEQ ID NO: 3209978 - protein, 7 aa, Plasmodium falciparum
NIKKNSD

SEQ ID NO: 3209979 - protein, 5 aa, Plasmodium falciparum
NINEN

SEQ ID NO: 3209980 - protein, 12 aa, Plasmodium falciparum
NINHNNDNINYN

SEQ ID NO: 3209981 - protein, 12 aa, Plasmodium falciparum
NINNNDNINNND

SEQ ID NO: 3209982 - protein, 4 aa, Plasmodium falciparum
NINS

SEQ ID NO: 3209983 - protein, 5 aa, Plasmodium falciparum
NINST

SEQ ID NO: 3209984 - protein, 4 aa, Plasmodium falciparum
NINY

SEQ ID NO: 3209985 - protein, 5 aa, Plasmodium falciparum
NINYN

SEQ ID NO: 3209986 - protein, 6 aa, Plasmodium falciparum
NINYNN

SEQ ID NO: 3209987 - protein, 16 aa, Plasmodium falciparum
NIPNPNDGRNEDKTTI

SEQ ID NO: 3209988 - protein, 24 aa, Plasmodium falciparum
NIPRTNNNKNNNQKNVTNDTTPLG

SEQ ID NO: 3209989 - protein, 4 aa, Plasmodium falciparum
NISN

SEQ ID NO: 3209990 - protein, 7 aa, Plasmodium falciparum
NISQEKV

SEQ ID NO: 3209991 - protein, 5 aa, Plasmodium falciparum
NITGD

SEQ ID NO: 3209992 - protein, 6 aa, Plasmodium falciparum
NIYNNG

SEQ ID NO: 3209993 - protein, 4 aa, Plasmodium falciparum
NKDL

SEQ ID NO: 3209994 - protein, 4 aa, Plasmodium falciparum
NKDN

SEQ ID NO: 3209995 - protein, 7 aa, Plasmodium falciparum
NKEEEAS

SEQ ID NO: 3209996 - protein, 5 aa, Plasmodium falciparum
NKEEV

SEQ ID NO: 3209997 - protein, 4 aa, Plasmodium falciparum
NKEG

SEQ ID NO: 3209998 - protein, 4 aa, Plasmodium falciparum
NKEL

SEQ ID NO: 3209999 - protein, 5 aa, Plasmodium falciparum
NKEVN

SEQ ID NO: 3210000 - protein, 5 aa, Plasmodium falciparum
NKFSS

SEQ ID NO: 3210001 - protein, 6 aa, Plasmodium falciparum
NKIESE

SEQ ID NO: 3210002 - protein, 4 aa, Plasmodium falciparum
NKIK

SEQ ID NO: 3210003 - protein, 6 aa, Plasmodium falciparum
NKISNN

SEQ ID NO: 3210004 - protein, 6 aa, Plasmodium falciparum
NKITQE

SEQ ID NO: 3210005 - protein, 4 aa, Plasmodium falciparum
NKKE

SEQ ID NO: 3210006 - protein, 4 aa, Plasmodium falciparum
NKKI

SEQ ID NO: 3210007 - protein, 5 aa, Plasmodium falciparum
NKKNI

SEQ ID NO: 3210008 - protein, 18 aa, Plasmodium falciparum
NKMEYSNNHNNNNKNNND

SEQ ID NO: 3210009 - protein, 5 aa, Plasmodium falciparum
NKNEN

SEQ ID NO: 3210010 - protein, 6 aa, Plasmodium falciparum
NKNIQE

SEQ ID NO: 3210011 - protein, 15 aa, Plasmodium falciparum
NKNKPSITSHHTPRY

SEQ ID NO: 3210012 - protein, 5 aa, Plasmodium falciparum
NKNNN

SEQ ID NO: 3210013 - protein, 37 aa, Plasmodium falciparum
NKNQKGKQLKSESLKKNELENKNTKNMDGNKNEFEKG

SEQ ID NO: 3210014 - protein, 5 aa, Plasmodium falciparum
NKNRN

SEQ ID NO: 3210015 - protein, 5 aa, Plasmodium falciparum
NKNYY

SEQ ID NO: 3210016 - protein, 5 aa, Plasmodium falciparum
NKPNI

SEQ ID NO: 3210017 - protein, 7 aa, Plasmodium falciparum
NKPYITP

SEQ ID NO: 3210018 - protein, 18 aa, Plasmodium falciparum
NKQEPAPKPSVEKTTPTE

SEQ ID NO: 3210019 - protein, 4 aa, Plasmodium falciparum
NKQI

SEQ ID NO: 3210020 - protein, 7 aa, Plasmodium falciparum
NKQNTHN

SEQ ID NO: 3210021 - protein, 20 aa, Plasmodium falciparum
NKQNTPSVQDTHNNDSKSIM

SEQ ID NO: 3210022 - protein, 10 aa, Plasmodium falciparum
NKQYNSPNEM

SEQ ID NO: 3210023 - protein, 12 aa, Plasmodium falciparum
NKSEKCKNECNT

SEQ ID NO: 3210024 - protein, 4 aa, Plasmodium falciparum
NKSF

SEQ ID NO: 3210025 - protein, 6 aa, Plasmodium falciparum
NKSKKI

SEQ ID NO: 3210026 - protein, 6 aa, Plasmodium falciparum
NKTKED

SEQ ID NO: 3210027 - protein, 6 aa, Plasmodium falciparum
NKVNDN

SEQ ID NO: 3210028 - protein, 4 aa, Plasmodium falciparum
NKYA

SEQ ID NO: 3210029 - protein, 4 aa, Plasmodium falciparum
NKYN

SEQ ID NO: 3210030 - protein, 10 aa, Plasmodium falciparum
NLKEGEDPGK

SEQ ID NO: 3210031 - protein, 5 aa, Plasmodium falciparum
NLQDR

SEQ ID NO: 3210032 - protein, 14 aa, Plasmodium falciparum
NLSTSSKGLSNGSF

SEQ ID NO: 3210033 - protein, 5 aa, Plasmodium falciparum
NLTSN

SEQ ID NO: 3210034 - protein, 4 aa, Plasmodium falciparum
NMNN

SEQ ID NO: 3210035 - protein, 8 aa, Plasmodium falciparum
NNDDGNKN

SEQ ID NO: 3210036 - protein, 8 aa, Plasmodium falciparum
NNDDNKNV

SEQ ID NO: 3210037 - protein, 4 aa, Plasmodium falciparum
NNDK

SEQ ID NO: 3210038 - protein, 10 aa, Plasmodium falciparum
NNDMSKNLTE

SEQ ID NO: 3210039 - protein, 4 aa, Plasmodium falciparum
NNEA

SEQ ID NO: 3210040 - protein, 6 aa, Plasmodium falciparum
NNEENK

SEQ ID NO: 3210041 - protein, 8 aa, Plasmodium falciparum
NNEENNVD

SEQ ID NO: 3210042 - protein, 4 aa, Plasmodium falciparum
NNEG

SEQ ID NO: 3210043 - protein, 4 aa, Plasmodium falciparum
NNEH

SEQ ID NO: 3210044 - protein, 7 aa, Plasmodium falciparum
NNGGCSD

SEQ ID NO: 3210045 - protein, 5 aa, Plasmodium falciparum
NNGLR

SEQ ID NO: 3210046 - protein, 15 aa, Plasmodium falciparum
NNGNKEKYAFKNPPN

SEQ ID NO: 3210047 - protein, 5 aa, Plasmodium falciparum
NNIND

SEQ ID NO: 3210048 - protein, 5 aa, Plasmodium falciparum
NNINN

SEQ ID NO: 3210049 - protein, 6 aa, Plasmodium falciparum
NNINSN

SEQ ID NO: 3210050 - protein, 21 aa, Plasmodium falciparum
NNITKSDYKVNNNDKGDPIAA

SEQ ID NO: 3210051 - protein, 5 aa, Plasmodium falciparum
NNIYD

SEQ ID NO: 3210052 - protein, 4 aa, Plasmodium falciparum
NNKN

SEQ ID NO: 3210053 - protein, 23 aa, Plasmodium falciparum
NNKNSKDDDSNNINNKDEKDKND

SEQ ID NO: 3210054 - protein, 4 aa, Plasmodium falciparum
NNKY

SEQ ID NO: 3210055 - protein, 4 aa, Plasmodium falciparum
NNLN

SEQ ID NO: 3210056 - protein, 4 aa, Plasmodium falciparum
NNMN

SEQ ID NO: 3210057 - protein, 4 aa, Plasmodium falciparum
NNND

SEQ ID NO: 3210058 - protein, 9 aa, Plasmodium falciparum
NNNDIKDLG

SEQ ID NO: 3210059 - protein, 4 aa, Plasmodium falciparum
NNNE

SEQ ID NO: 3210060 - protein, 5 aa, Plasmodium falciparum
NNNEI

SEQ ID NO: 3210061 - protein, 5 aa, Plasmodium falciparum
NNNEQ

SEQ ID NO: 3210062 - protein, 5 aa, Plasmodium falciparum
NNNGS

SEQ ID NO: 3210063 - protein, 5 aa, Plasmodium falciparum
NNNKN

SEQ ID NO: 3210064 - protein, 6 aa, Plasmodium falciparum
NNNNIN

SEQ ID NO: 3210065 - protein, 5 aa, Plasmodium falciparum
NNNNM

SEQ ID NO: 3210066 - protein, 7 aa, Plasmodium falciparum
NNNNNNH

SEQ ID NO: 3210067 - protein, 8 aa, Plasmodium falciparum
NNNNNNNI

SEQ ID NO: 3210068 - protein, 10 aa, Plasmodium falciparum
NNNNNNNNNN

SEQ ID NO: 3210069 - protein, 11 aa, Plasmodium falciparum
NNNNNNNNNNI

SEQ ID NO: 3210070 - protein, 11 aa, Plasmodium falciparum
NNNNNNNNNNN

SEQ ID NO: 3210071 - protein, 13 aa, Plasmodium falciparum
NNNNNNNNNNNNN

SEQ ID NO: 3210072 - protein, 8 aa, Plasmodium falciparum
NNNNNNYN

SEQ ID NO: 3210073 - protein, 51 aa, Plasmodium falciparum
NNNRNKSKSSNKSKSSNKSKNSSSNKSKNSSSNKSKSSSSNKSKSSSSNNN

SEQ ID NO: 3210074 - protein, 4 aa, Plasmodium falciparum
NNNY

SEQ ID NO: 3210075 - protein, 4 aa, Plasmodium falciparum
NNQG

SEQ ID NO: 3210076 - protein, 10 aa, Plasmodium falciparum
NNQNMNNDEY

SEQ ID NO: 3210077 - protein, 4 aa, Plasmodium falciparum
NNQQ

SEQ ID NO: 3210078 - protein, 4 aa, Plasmodium falciparum
NNRR

SEQ ID NO: 3210079 - protein, 22 aa, Plasmodium falciparum
NNSGIYPSSSNRDSLSGTKVPY

SEQ ID NO: 3210080 - protein, 19 aa, Plasmodium falciparum
NNSKNTVYNNNSYDHSSNK

SEQ ID NO: 3210081 - protein, 4 aa, Plasmodium falciparum
NNST

SEQ ID NO: 3210082 - protein, 6 aa, Plasmodium falciparum
NNSTTR

SEQ ID NO: 3210083 - protein, 4 aa, Plasmodium falciparum
NNSY

SEQ ID NO: 3210084 - protein, 11 aa, Plasmodium falciparum
NNTHPTPSRHT

SEQ ID NO: 3210085 - protein, 8 aa, Plasmodium falciparum
NNTKRTTI

SEQ ID NO: 3210086 - protein, 5 aa, Plasmodium falciparum
NNTNK

SEQ ID NO: 3210087 - protein, 12 aa, Plasmodium falciparum
NNTNKKSNGNTL

SEQ ID NO: 3210088 - protein, 5 aa, Plasmodium falciparum
NNTQK

SEQ ID NO: 3210089 - protein, 5 aa, Plasmodium falciparum
NNTTN

SEQ ID NO: 3210090 - protein, 4 aa, Plasmodium falciparum
NNTY

SEQ ID NO: 3210091 - protein, 5 aa, Plasmodium falciparum
NNVKN

SEQ ID NO: 3210092 - protein, 5 aa, Plasmodium falciparum
NNYEI

SEQ ID NO: 3210093 - protein, 5 aa, Plasmodium falciparum
NNYNK

SEQ ID NO: 3210094 - protein, 11 aa, Plasmodium falciparum
NNYTNKENKNV

SEQ ID NO: 3210095 - protein, 4 aa, Plasmodium falciparum
NPEQ

SEQ ID NO: 3210096 - protein, 8 aa, Plasmodium falciparum
NPKPKNEF

SEQ ID NO: 3210097 - protein, 5 aa, Plasmodium falciparum
NPNLT

SEQ ID NO: 3210098 - protein, 7 aa, Plasmodium falciparum
NPSDGKN

SEQ ID NO: 3210099 - protein, 8 aa, Plasmodium falciparum
NQCKEQCD

SEQ ID NO: 3210100 - protein, 4 aa, Plasmodium falciparum
NQEK

SEQ ID NO: 3210101 - protein, 4 aa, Plasmodium falciparum
NQNK

SEQ ID NO: 3210102 - protein, 18 aa, Plasmodium falciparum
NQPNDYKSEDIPLNTQPN

SEQ ID NO: 3210103 - protein, 4 aa, Plasmodium falciparum
NQSQ

SEQ ID NO: 3210104 - protein, 7 aa, Plasmodium falciparum
NRNYSNE

SEQ ID NO: 3210105 - protein, 4 aa, Plasmodium falciparum
NRYI

SEQ ID NO: 3210106 - protein, 4 aa, Plasmodium falciparum
NSDI

SEQ ID NO: 3210107 - protein, 5 aa, Plasmodium falciparum
NSDSN

SEQ ID NO: 3210108 - protein, 5 aa, Plasmodium falciparum
NSDSY

SEQ ID NO: 3210109 - protein, 23 aa, Plasmodium falciparum
NSGSSSPPHGTPGQPNSVTTPQQ

SEQ ID NO: 3210110 - protein, 5 aa, Plasmodium falciparum
NSKKR

SEQ ID NO: 3210111 - protein, 8 aa, Plasmodium falciparum
NSMDDPKY

SEQ ID NO: 3210112 - protein, 4 aa, Plasmodium falciparum
NSNI

SEQ ID NO: 3210113 - protein, 4 aa, Plasmodium falciparum
NSPG

SEQ ID NO: 3210114 - protein, 5 aa, Plasmodium falciparum
NSPNN

SEQ ID NO: 3210115 - protein, 4 aa, Plasmodium falciparum
NSRG

SEQ ID NO: 3210116 - protein, 32 aa, Plasmodium falciparum
NSSNGNDKDESKLKGKAEEGDYSRGGTPSDFN

SEQ ID NO: 3210117 - protein, 4 aa, Plasmodium falciparum
NSST

SEQ ID NO: 3210118 - protein, 4 aa, Plasmodium falciparum
NSSV

SEQ ID NO: 3210119 - protein, 5 aa, Plasmodium falciparum
NSSYN

SEQ ID NO: 3210120 - protein, 11 aa, Plasmodium falciparum
NSTAAAESTYA

SEQ ID NO: 3210121 - protein, 5 aa, Plasmodium falciparum
NSTYN

SEQ ID NO: 3210122 - protein, 27 aa, Plasmodium falciparum
NTDPNDDVERRNADNKEDLTSADPEGQ

SEQ ID NO: 3210123 - protein, 17 aa, Plasmodium falciparum
NTDPNDELETSADPEGQ

SEQ ID NO: 3210124 - protein, 21 aa, Plasmodium falciparum
NTDSNGKDKKIQQVKATDNTD

SEQ ID NO: 3210125 - protein, 9 aa, Plasmodium falciparum
NTGKSVNNI

SEQ ID NO: 3210126 - protein, 4 aa, Plasmodium falciparum
NTHK

SEQ ID NO: 3210127 - protein, 4 aa, Plasmodium falciparum
NTKK

SEQ ID NO: 3210128 - protein, 13 aa, Plasmodium falciparum
NTLDNSAKKEHNK

SEQ ID NO: 3210129 - protein, 7 aa, Plasmodium falciparum
NTLHEQN

SEQ ID NO: 3210130 - protein, 4 aa, Plasmodium falciparum
NTLT

SEQ ID NO: 3210131 - protein, 6 aa, Plasmodium falciparum
NTNDLK

SEQ ID NO: 3210132 - protein, 4 aa, Plasmodium falciparum
NTNE

SEQ ID NO: 3210133 - protein, 6 aa, Plasmodium falciparum
NTNNKN

SEQ ID NO: 3210134 - protein, 5 aa, Plasmodium falciparum
NTNNY

SEQ ID NO: 3210135 - protein, 7 aa, Plasmodium falciparum
NTQRTTI

SEQ ID NO: 3210136 - protein, 13 aa, Plasmodium falciparum
NTSNTNQENKSDK

SEQ ID NO: 3210137 - protein, 5 aa, Plasmodium falciparum
NTSNY

SEQ ID NO: 3210138 - protein, 4 aa, Plasmodium falciparum
NTTE

SEQ ID NO: 3210139 - protein, 7 aa, Plasmodium falciparum
NTTNKNM

SEQ ID NO: 3210140 - protein, 7 aa, Plasmodium falciparum
NTYDSTN

SEQ ID NO: 3210141 - protein, 4 aa, Plasmodium falciparum
NTYN

SEQ ID NO: 3210142 - protein, 4 aa, Plasmodium falciparum
NTYR

SEQ ID NO: 3210143 - protein, 4 aa, Plasmodium falciparum
NTYT

SEQ ID NO: 3210144 - protein, 7 aa, Plasmodium falciparum
NVDTPTM

SEQ ID NO: 3210145 - protein, 34 aa, Plasmodium falciparum
NVPSGKPDTPCQKSPAPVGDDDDPLEEENPVTQP

SEQ ID NO: 3210146 - protein, 4 aa, Plasmodium falciparum
NYDD

SEQ ID NO: 3210147 - protein, 6 aa, Plasmodium falciparum
NYEQNT

SEQ ID NO: 3210148 - protein, 4 aa, Plasmodium falciparum
NYKK

SEQ ID NO: 3210149 - protein, 4 aa, Plasmodium falciparum
NYNT

SEQ ID NO: 3210150 - protein, 4 aa, Plasmodium falciparum
NYSS

SEQ ID NO: 3210151 - protein, 5 aa, Plasmodium falciparum
NYTNE

SEQ ID NO: 3210152 - protein, 8 aa, Plasmodium falciparum
PADNCKPC

SEQ ID NO: 3210153 - protein, 10 aa, Plasmodium falciparum
PANYDSDPQM

SEQ ID NO: 3210154 - protein, 9 aa, Plasmodium falciparum
PCDDNKNEM

SEQ ID NO: 3210155 - protein, 5 aa, Plasmodium falciparum
PDDDN

SEQ ID NO: 3210156 - protein, 4 aa, Plasmodium falciparum
PDNK

SEQ ID NO: 3210157 - protein, 5 aa, Plasmodium falciparum
PDRSN

SEQ ID NO: 3210158 - protein, 7 aa, Plasmodium falciparum
PDSPKYK

SEQ ID NO: 3210159 - protein, 37 aa, Plasmodium falciparum
PDSVSSKYGLKDSRKPQGKDDAHKGDEDPNRLNRDKK

SEQ ID NO: 3210160 - protein, 4 aa, Plasmodium falciparum
PENT

SEQ ID NO: 3210161 - protein, 6 aa, Plasmodium falciparum
PESDSN

SEQ ID NO: 3210162 - protein, 5 aa, Plasmodium falciparum
PFKNE

SEQ ID NO: 3210163 - protein, 8 aa, Plasmodium falciparum
PGQFKSGH

SEQ ID NO: 3210164 - protein, 6 aa, Plasmodium falciparum
PGTPKY

SEQ ID NO: 3210165 - protein, 7 aa, Plasmodium falciparum
PIIEGDP

SEQ ID NO: 3210166 - protein, 16 aa, Plasmodium falciparum
PKEGNRETASGENKDQ

SEQ ID NO: 3210167 - protein, 10 aa, Plasmodium falciparum
PKKNNGEVTE

SEQ ID NO: 3210168 - protein, 6 aa, Plasmodium falciparum
PKPINE

SEQ ID NO: 3210169 - protein, 6 aa, Plasmodium falciparum
PKPINQ

SEQ ID NO: 3210170 - protein, 41 aa, Plasmodium falciparum
PKRDGSKEDEQKKEKINNHHNNDNNNNNNNNNNNNNNNISI

SEQ ID NO: 3210171 - protein, 8 aa, Plasmodium falciparum
PMSGKNDV

SEQ ID NO: 3210172 - protein, 6 aa, Plasmodium falciparum
PNITTE

SEQ ID NO: 3210173 - protein, 5 aa, Plasmodium falciparum
PPLGL

SEQ ID NO: 3210174 - protein, 39 aa, Plasmodium falciparum
PQAEKDASKLTTTYDQTKEVKPQAEKDALAKTENQNGEL

SEQ ID NO: 3210175 - protein, 4 aa, Plasmodium falciparum
PQKN

SEQ ID NO: 3210176 - protein, 7 aa, Plasmodium falciparum
PSCAPTS

SEQ ID NO: 3210177 - protein, 46 aa, Plasmodium falciparum
PSGDKAATSGEGDSGPSRKRRDTTGGESTTSSSATTGGKDGATGGS

SEQ ID NO: 3210178 - protein, 25 aa, Plasmodium falciparum
PSGNNTPTSDIPSDNTPTPQPITDD

SEQ ID NO: 3210179 - protein, 51 aa, Plasmodium falciparum
PSGNNTTASGNNTTASGNNTTASGNNTTASDTQNDIQNDGIPSSKITDNEW

SEQ ID NO: 3210180 - protein, 26 aa, Plasmodium falciparum
PSKRDTFNTQSDIPSDTSTNKFTDNE

SEQ ID NO: 3210181 - protein, 10 aa, Plasmodium falciparum
PSKRDTQNDI

SEQ ID NO: 3210182 - protein, 20 aa, Plasmodium falciparum
PSKRDTQNDIPSDNTPSYKL

SEQ ID NO: 3210183 - protein, 18 aa, Plasmodium falciparum
PSKSDGNTPGKGDGNTLG

SEQ ID NO: 3210184 - protein, 4 aa, Plasmodium falciparum
PSNN

SEQ ID NO: 3210185 - protein, 9 aa, Plasmodium falciparum
PSNYDNDPE

SEQ ID NO: 3210186 - protein, 4 aa, Plasmodium falciparum
PSPE

SEQ ID NO: 3210187 - protein, 4 aa, Plasmodium falciparum
PSSG

SEQ ID NO: 3210188 - protein, 4 aa, Plasmodium falciparum
PSTL

SEQ ID NO: 3210189 - protein, 4 aa, Plasmodium falciparum
PSYN

SEQ ID NO: 3210190 - protein, 32 aa, Plasmodium falciparum
PTSGDKTDTSENGAPRRARSAHGGKSDSEKGS

SEQ ID NO: 3210191 - protein, 25 aa, Plasmodium falciparum
PTSGGEKATGGSGESTGSDATTGGS

SEQ ID NO: 3210192 - protein, 16 aa, Plasmodium falciparum
PTTGDKDGATGKSDGS

SEQ ID NO: 3210193 - protein, 4 aa, Plasmodium falciparum
PVPP

SEQ ID NO: 3210194 - protein, 8 aa, Plasmodium falciparum
QAGAAAGI

SEQ ID NO: 3210195 - protein, 4 aa, Plasmodium falciparum
QDFG

SEQ ID NO: 3210196 - protein, 8 aa, Plasmodium falciparum
QDNSEHVK

SEQ ID NO: 3210197 - protein, 20 aa, Plasmodium falciparum
QEECKQQKKQQRQKQPADKV

SEQ ID NO: 3210198 - protein, 25 aa, Plasmodium falciparum
QEKKYKDEYGKLTKDKSSDDKKLEG

SEQ ID NO: 3210199 - protein, 6 aa, Plasmodium falciparum
QEKPVQ

SEQ ID NO: 3210200 - protein, 4 aa, Plasmodium falciparum
QENV

SEQ ID NO: 3210201 - protein, 15 aa, Plasmodium falciparum
QGHNDGDGKGGNNPL

SEQ ID NO: 3210202 - protein, 9 aa, Plasmodium falciparum
QGSDNEEII

SEQ ID NO: 3210203 - protein, 10 aa, Plasmodium falciparum
QHKRTNPDSK

SEQ ID NO: 3210204 - protein, 5 aa, Plasmodium falciparum
QHTRT

SEQ ID NO: 3210205 - protein, 4 aa, Plasmodium falciparum
QINK

SEQ ID NO: 3210206 - protein, 4 aa, Plasmodium falciparum
QKDN

SEQ ID NO: 3210207 - protein, 7 aa, Plasmodium falciparum
QKIQEEK

SEQ ID NO: 3210208 - protein, 12 aa, Plasmodium falciparum
QKNEELEKSKES

SEQ ID NO: 3210209 - protein, 10 aa, Plasmodium falciparum
QKYGPKAPTS

SEQ ID NO: 3210210 - protein, 6 aa, Plasmodium falciparum
QKYGYP

SEQ ID NO: 3210211 - protein, 11 aa, Plasmodium falciparum
QLDGDDNKNVC

SEQ ID NO: 3210212 - protein, 7 aa, Plasmodium falciparum
QLTNEGS

SEQ ID NO: 3210213 - protein, 12 aa, Plasmodium falciparum
QNEAKQRSNGDL

SEQ ID NO: 3210214 - protein, 45 aa, Plasmodium falciparum
QNECEKKAKPEGRSDSHDDPQPPDDADNEDDLDDEDDEDEEEEVQ

SEQ ID NO: 3210215 - protein, 16 aa, Plasmodium falciparum
QNGTKTRCRNNEKCNK

SEQ ID NO: 3210216 - protein, 9 aa, Plasmodium falciparum
QNGTTTDKC

SEQ ID NO: 3210217 - protein, 9 aa, Plasmodium falciparum
QNIGDETNC

SEQ ID NO: 3210218 - protein, 4 aa, Plasmodium falciparum
QNKI

SEQ ID NO: 3210219 - protein, 6 aa, Plasmodium falciparum
QNMEAE

SEQ ID NO: 3210220 - protein, 5 aa, Plasmodium falciparum
QNNYP

SEQ ID NO: 3210221 - protein, 9 aa, Plasmodium falciparum
QNYDNDPEM

SEQ ID NO: 3210222 - protein, 5 aa, Plasmodium falciparum
QNYNN

SEQ ID NO: 3210223 - protein, 8 aa, Plasmodium falciparum
QQAEYDNK

SEQ ID NO: 3210224 - protein, 4 aa, Plasmodium falciparum
QQTL

SEQ ID NO: 3210225 - protein, 7 aa, Plasmodium falciparum
QQYRGKK

SEQ ID NO: 3210226 - protein, 4 aa, Plasmodium falciparum
QRNS

SEQ ID NO: 3210227 - protein, 4 aa, Plasmodium falciparum
QSDD

SEQ ID NO: 3210228 - protein, 10 aa, Plasmodium falciparum
QSNYENDQEM

SEQ ID NO: 3210229 - protein, 5 aa, Plasmodium falciparum
QSPKY

SEQ ID NO: 3210230 - protein, 7 aa, Plasmodium falciparum
QSQEYEK

SEQ ID NO: 3210231 - protein, 7 aa, Plasmodium falciparum
QSQEYKK

SEQ ID NO: 3210232 - protein, 11 aa, Plasmodium falciparum
QSSNTHGASSV

SEQ ID NO: 3210233 - protein, 8 aa, Plasmodium falciparum
QTDISTND

SEQ ID NO: 3210234 - protein, 61 aa, Plasmodium falciparum
QTSVEEKKKEEEEKCDEKEEEEEKEEEKDKGDEEVKEEEKDKGDEEEEAEEEEEEEEETDS

SEQ ID NO: 3210235 - protein, 6 aa, Plasmodium falciparum
QTYSDP

SEQ ID NO: 3210236 - protein, 9 aa, Plasmodium falciparum
QYPSSGSTM

SEQ ID NO: 3210237 - protein, 5 aa, Plasmodium falciparum
RDQTF

SEQ ID NO: 3210238 - protein, 21 aa, Plasmodium falciparum
REAPPPPTTPSTPNPCAETGG

SEQ ID NO: 3210239 - protein, 4 aa, Plasmodium falciparum
REEW

SEQ ID NO: 3210240 - protein, 4 aa, Plasmodium falciparum
REKK

SEQ ID NO: 3210241 - protein, 15 aa, Plasmodium falciparum
REYTSTNEKKYHKNN

SEQ ID NO: 3210242 - protein, 11 aa, Plasmodium falciparum
RFSNEGEAECN

SEQ ID NO: 3210243 - protein, 4 aa, Plasmodium falciparum
RGQN

SEQ ID NO: 3210244 - protein, 6 aa, Plasmodium falciparum
RHDDIE

SEQ ID NO: 3210245 - protein, 9 aa, Plasmodium falciparum
RKENSINSS

SEQ ID NO: 3210246 - protein, 13 aa, Plasmodium falciparum
RKLEESQNEEKNK

SEQ ID NO: 3210247 - protein, 7 aa, Plasmodium falciparum
RKQARNA

SEQ ID NO: 3210248 - protein, 8 aa, Plasmodium falciparum
RKVKEITD

SEQ ID NO: 3210249 - protein, 12 aa, Plasmodium falciparum
RLNGQNDNGAKC

SEQ ID NO: 3210250 - protein, 6 aa, Plasmodium falciparum
RLNKNN

SEQ ID NO: 3210251 - protein, 9 aa, Plasmodium falciparum
RMDKSLAEK

SEQ ID NO: 3210252 - protein, 14 aa, Plasmodium falciparum
RMKEKRKQCKERCD

SEQ ID NO: 3210253 - protein, 16 aa, Plasmodium falciparum
RMKTTRQKCKDKCDKE

SEQ ID NO: 3210254 - protein, 15 aa, Plasmodium falciparum
RMQEKRKKRKEQCDK

SEQ ID NO: 3210255 - protein, 5 aa, Plasmodium falciparum
RNDDE

SEQ ID NO: 3210256 - protein, 9 aa, Plasmodium falciparum
RNENDEDNY

SEQ ID NO: 3210257 - protein, 5 aa, Plasmodium falciparum
RNETE

SEQ ID NO: 3210258 - protein, 8 aa, Plasmodium falciparum
RNHKSTTH

SEQ ID NO: 3210259 - protein, 79 aa, Plasmodium falciparum
RNLPPADRNTNLSDSEEEDDEDDDEVQEEEETPPSEAEEGEGHVETEEETKPVKEKTEGAGATEVTKQGSAPTATTPTV

SEQ ID NO: 3210260 - protein, 4 aa, Plasmodium falciparum
RNNE

SEQ ID NO: 3210261 - protein, 4 aa, Plasmodium falciparum
RNSI

SEQ ID NO: 3210262 - protein, 12 aa, Plasmodium falciparum
RNSSNSHYSPKN

SEQ ID NO: 3210263 - protein, 7 aa, Plasmodium falciparum
RPNYGNP

SEQ ID NO: 3210264 - protein, 7 aa, Plasmodium falciparum
RQTSERF

SEQ ID NO: 3210265 - protein, 11 aa, Plasmodium falciparum
RRDSRTDKLEE

SEQ ID NO: 3210266 - protein, 27 aa, Plasmodium falciparum
RRQKDTDKNKTEANKKKVDNETNTVKN

SEQ ID NO: 3210267 - protein, 5 aa, Plasmodium falciparum
RRRRR

SEQ ID NO: 3210268 - protein, 13 aa, Plasmodium falciparum
RSGETGKEHCSGD

SEQ ID NO: 3210269 - protein, 9 aa, Plasmodium falciparum
RSKANGDVK

SEQ ID NO: 3210270 - protein, 16 aa, Plasmodium falciparum
RSQTEEPKKKEENVES

SEQ ID NO: 3210271 - protein, 9 aa, Plasmodium falciparum
RTPKTNTRT

SEQ ID NO: 3210272 - protein, 7 aa, Plasmodium falciparum
RTRECQE

SEQ ID NO: 3210273 - protein, 8 aa, Plasmodium falciparum
RYTNRENK

SEQ ID NO: 3210274 - protein, 6 aa, Plasmodium falciparum
SANTMN

SEQ ID NO: 3210275 - protein, 4 aa, Plasmodium falciparum
SCEK

SEQ ID NO: 3210276 - protein, 14 aa, Plasmodium falciparum
SCSKNNKDNGDGTI

SEQ ID NO: 3210277 - protein, 4 aa, Plasmodium falciparum
SDEE

SEQ ID NO: 3210278 - protein, 7 aa, Plasmodium falciparum
SDEESTF

SEQ ID NO: 3210279 - protein, 6 aa, Plasmodium falciparum
SDHTPL

SEQ ID NO: 3210280 - protein, 5 aa, Plasmodium falciparum
SDKKE

SEQ ID NO: 3210281 - protein, 6 aa, Plasmodium falciparum
SDKLNN

SEQ ID NO: 3210282 - protein, 7 aa, Plasmodium falciparum
SDKLNNV

SEQ ID NO: 3210283 - protein, 4 aa, Plasmodium falciparum
SDNL

SEQ ID NO: 3210284 - protein, 11 aa, Plasmodium falciparum
SDNNNNNNNSN

SEQ ID NO: 3210285 - protein, 9 aa, Plasmodium falciparum
SDNTESGFE

SEQ ID NO: 3210286 - protein, 11 aa, Plasmodium falciparum
SDQARQISKDS

SEQ ID NO: 3210287 - protein, 25 aa, Plasmodium falciparum
SDRKGSCSQAKDNCRCDGSNTDQVP

SEQ ID NO: 3210288 - protein, 7 aa, Plasmodium falciparum
SDRYKGK

SEQ ID NO: 3210289 - protein, 9 aa, Plasmodium falciparum
SDYNIPTKL

SEQ ID NO: 3210290 - protein, 6 aa, Plasmodium falciparum
SEGESI

SEQ ID NO: 3210291 - protein, 4 aa, Plasmodium falciparum
SEGQ

SEQ ID NO: 3210292 - protein, 18 aa, Plasmodium falciparum
SEHNSNNPETKEENGEEP

SEQ ID NO: 3210293 - protein, 8 aa, Plasmodium falciparum
SEKKRRKT

SEQ ID NO: 3210294 - protein, 10 aa, Plasmodium falciparum
SEKNESEDEI

SEQ ID NO: 3210295 - protein, 44 aa, Plasmodium falciparum
SENYMTTKDKTSEDKINDDKSSDDKINDDKISDDKISDDKISDD

SEQ ID NO: 3210296 - protein, 15 aa, Plasmodium falciparum
SEQENKKNEFTKEQK

SEQ ID NO: 3210297 - protein, 4 aa, Plasmodium falciparum
SETK

SEQ ID NO: 3210298 - protein, 6 aa, Plasmodium falciparum
SETNDA

SEQ ID NO: 3210299 - protein, 8 aa, Plasmodium falciparum
SFDKNNYS

SEQ ID NO: 3210300 - protein, 10 aa, Plasmodium falciparum
SGAGDLGGTV

SEQ ID NO: 3210301 - protein, 4 aa, Plasmodium falciparum
SGEE

SEQ ID NO: 3210302 - protein, 10 aa, Plasmodium falciparum
SGEKQKEIET

SEQ ID NO: 3210303 - protein, 4 aa, Plasmodium falciparum
SGGH

SEQ ID NO: 3210304 - protein, 4 aa, Plasmodium falciparum
SGGM

SEQ ID NO: 3210305 - protein, 21 aa, Plasmodium falciparum
SGIQSVNDKYKKKLEEYLDTF

SEQ ID NO: 3210306 - protein, 12 aa, Plasmodium falciparum
SGNKSTCTNDCP

SEQ ID NO: 3210307 - protein, 39 aa, Plasmodium falciparum
SGNTSDTTGSESEATGARQRRDTDSSGDTTGGKDGATGG

SEQ ID NO: 3210308 - protein, 7 aa, Plasmodium falciparum
SGNVKNA

SEQ ID NO: 3210309 - protein, 9 aa, Plasmodium falciparum
SGNVKNASN

SEQ ID NO: 3210310 - protein, 4 aa, Plasmodium falciparum
SGQK

SEQ ID NO: 3210311 - protein, 6 aa, Plasmodium falciparum
SGYGNV

SEQ ID NO: 3210312 - protein, 4 aa, Plasmodium falciparum
SHEN

SEQ ID NO: 3210313 - protein, 4 aa, Plasmodium falciparum
SKDY

SEQ ID NO: 3210314 - protein, 6 aa, Plasmodium falciparum
SKEAKV

SEQ ID NO: 3210315 - protein, 8 aa, Plasmodium falciparum
SKEKNEQV

SEQ ID NO: 3210316 - protein, 30 aa, Plasmodium falciparum
SKENGKGEQGEKEDKRIVSEEKKEIEENKE

SEQ ID NO: 3210317 - protein, 7 aa, Plasmodium falciparum
SKERLDE

SEQ ID NO: 3210318 - protein, 5 aa, Plasmodium falciparum
SKNFT

SEQ ID NO: 3210319 - protein, 5 aa, Plasmodium falciparum
SKNKY

SEQ ID NO: 3210320 - protein, 10 aa, Plasmodium falciparum
SKNNEKKKIN

SEQ ID NO: 3210321 - protein, 5 aa, Plasmodium falciparum
SKNNI

SEQ ID NO: 3210322 - protein, 12 aa, Plasmodium falciparum
SKPRDKTTGGID

SEQ ID NO: 3210323 - protein, 8 aa, Plasmodium falciparum
SKTRNDHH

SEQ ID NO: 3210324 - protein, 4 aa, Plasmodium falciparum
SLND

SEQ ID NO: 3210325 - protein, 5 aa, Plasmodium falciparum
SLNGN

SEQ ID NO: 3210326 - protein, 7 aa, Plasmodium falciparum
SLNSGNQ

SEQ ID NO: 3210327 - protein, 5 aa, Plasmodium falciparum
SMDEM

SEQ ID NO: 3210328 - protein, 4 aa, Plasmodium falciparum
SNDE

SEQ ID NO: 3210329 - protein, 10 aa, Plasmodium falciparum
SNGKDGTSKE

SEQ ID NO: 3210330 - protein, 4 aa, Plasmodium falciparum
SNIT

SEQ ID NO: 3210331 - protein, 4 aa, Plasmodium falciparum
SNKK

SEQ ID NO: 3210332 - protein, 10 aa, Plasmodium falciparum
SNNDDNISDE

SEQ ID NO: 3210333 - protein, 14 aa, Plasmodium falciparum
SNNGVKARYEGDKE

SEQ ID NO: 3210334 - protein, 4 aa, Plasmodium falciparum
SNNN

SEQ ID NO: 3210335 - protein, 5 aa, Plasmodium falciparum
SNNNN

SEQ ID NO: 3210336 - protein, 5 aa, Plasmodium falciparum
SNNNY

SEQ ID NO: 3210337 - protein, 18 aa, Plasmodium falciparum
SNNREVDEQQYPIADIWN

SEQ ID NO: 3210338 - protein, 4 aa, Plasmodium falciparum
SNNS

SEQ ID NO: 3210339 - protein, 4 aa, Plasmodium falciparum
SNQE

SEQ ID NO: 3210340 - protein, 9 aa, Plasmodium falciparum
SNRQGPSQA

SEQ ID NO: 3210341 - protein, 13 aa, Plasmodium falciparum
SNTEGSSSSKIKI

SEQ ID NO: 3210342 - protein, 13 aa, Plasmodium falciparum
SNTIEESNKIEES

SEQ ID NO: 3210343 - protein, 13 aa, Plasmodium falciparum
SNVTKRGNVPPSL

SEQ ID NO: 3210344 - protein, 8 aa, Plasmodium falciparum
SNYDNDPQ

SEQ ID NO: 3210345 - protein, 4 aa, Plasmodium falciparum
SNYN

SEQ ID NO: 3210346 - protein, 33 aa, Plasmodium falciparum
SNYNNENIKNNNNNNNNNNNNNNNNSIYDDDDD

SEQ ID NO: 3210347 - protein, 4 aa, Plasmodium falciparum
SNYV

SEQ ID NO: 3210348 - protein, 4 aa, Plasmodium falciparum
SPHT

SEQ ID NO: 3210349 - protein, 16 aa, Plasmodium falciparum
SQESGLDYKDEYDGEF

SEQ ID NO: 3210350 - protein, 5 aa, Plasmodium falciparum
SQETL

SEQ ID NO: 3210351 - protein, 5 aa, Plasmodium falciparum
SRIKQ

SEQ ID NO: 3210352 - protein, 5 aa, Plasmodium falciparum
SRRFE

SEQ ID NO: 3210353 - protein, 12 aa, Plasmodium falciparum
SSAYKKNKTITN

SEQ ID NO: 3210354 - protein, 20 aa, Plasmodium falciparum
SSDEKDDEITNVRKEEKNIK

SEQ ID NO: 3210355 - protein, 13 aa, Plasmodium falciparum
SSDITSSESEYED

SEQ ID NO: 3210356 - protein, 14 aa, Plasmodium falciparum
SSDITSSSESEYEE

SEQ ID NO: 3210357 - protein, 9 aa, Plasmodium falciparum
SSENKNDEK

SEQ ID NO: 3210358 - protein, 9 aa, Plasmodium falciparum
SSENSSSEI

SEQ ID NO: 3210359 - protein, 6 aa, Plasmodium falciparum
SSEVYN

SEQ ID NO: 3210360 - protein, 4 aa, Plasmodium falciparum
SSEY

SEQ ID NO: 3210361 - protein, 6 aa, Plasmodium falciparum
SSHTSY

SEQ ID NO: 3210362 - protein, 8 aa, Plasmodium falciparum
SSKPLKNS

SEQ ID NO: 3210363 - protein, 6 aa, Plasmodium falciparum
SSLEKY

SEQ ID NO: 3210364 - protein, 5 aa, Plasmodium falciparum
SSNDL

SEQ ID NO: 3210365 - protein, 7 aa, Plasmodium falciparum
SSPNSNI

SEQ ID NO: 3210366 - protein, 5 aa, Plasmodium falciparum
SSQGI

SEQ ID NO: 3210367 - protein, 4 aa, Plasmodium falciparum
SSSY

SEQ ID NO: 3210368 - protein, 7 aa, Plasmodium falciparum
SSTGNYT

SEQ ID NO: 3210369 - protein, 8 aa, Plasmodium falciparum
SSVENNND

SEQ ID NO: 3210370 - protein, 7 aa, Plasmodium falciparum
STNRKEV

SEQ ID NO: 3210371 - protein, 5 aa, Plasmodium falciparum
STPIY

SEQ ID NO: 3210372 - protein, 11 aa, Plasmodium falciparum
SVSGEVDETEY

SEQ ID NO: 3210373 - protein, 4 aa, Plasmodium falciparum
SVYP

SEQ ID NO: 3210374 - protein, 4 aa, Plasmodium falciparum
SYEQ

SEQ ID NO: 3210375 - protein, 4 aa, Plasmodium falciparum
SYNN

SEQ ID NO: 3210376 - protein, 4 aa, Plasmodium falciparum
SYST

SEQ ID NO: 3210377 - protein, 11 aa, Plasmodium falciparum
TAKSAAANETA

SEQ ID NO: 3210378 - protein, 11 aa, Plasmodium falciparum
TCKENGKGSTC

SEQ ID NO: 3210379 - protein, 5 aa, Plasmodium falciparum
TCPPN

SEQ ID NO: 3210380 - protein, 4 aa, Plasmodium falciparum
TDDN

SEQ ID NO: 3210381 - protein, 17 aa, Plasmodium falciparum
TDSDNPQNKLNDGTIPP

SEQ ID NO: 3210382 - protein, 14 aa, Plasmodium falciparum
TDSGGSITEDKDVR

SEQ ID NO: 3210383 - protein, 6 aa, Plasmodium falciparum
TEADGI

SEQ ID NO: 3210384 - protein, 4 aa, Plasmodium falciparum
TEEL

SEQ ID NO: 3210385 - protein, 5 aa, Plasmodium falciparum
TEENE

SEQ ID NO: 3210386 - protein, 5 aa, Plasmodium falciparum
TEGGP

SEQ ID NO: 3210387 - protein, 18 aa, Plasmodium falciparum
TEKNDDKNNNNKDKGTFY

SEQ ID NO: 3210388 - protein, 18 aa, Plasmodium falciparum
TEKNGKNKSSEENTDDNI

SEQ ID NO: 3210389 - protein, 4 aa, Plasmodium falciparum
TEKQ

SEQ ID NO: 3210390 - protein, 17 aa, Plasmodium falciparum
TGARNLSERKISSSEES

SEQ ID NO: 3210391 - protein, 9 aa, Plasmodium falciparum
THNTIKQQK

SEQ ID NO: 3210392 - protein, 9 aa, Plasmodium falciparum
TIEEKNKSV

SEQ ID NO: 3210393 - protein, 5 aa, Plasmodium falciparum
TIETK

SEQ ID NO: 3210394 - protein, 4 aa, Plasmodium falciparum
TISS

SEQ ID NO: 3210395 - protein, 10 aa, Plasmodium falciparum
TKDKSGGDKK

SEQ ID NO: 3210396 - protein, 4 aa, Plasmodium falciparum
TKDN

SEQ ID NO: 3210397 - protein, 8 aa, Plasmodium falciparum
TKEKYKHR

SEQ ID NO: 3210398 - protein, 4 aa, Plasmodium falciparum
TKEN

SEQ ID NO: 3210399 - protein, 6 aa, Plasmodium falciparum
TKENEW

SEQ ID NO: 3210400 - protein, 4 aa, Plasmodium falciparum
TKET

SEQ ID NO: 3210401 - protein, 4 aa, Plasmodium falciparum
TKGD

SEQ ID NO: 3210402 - protein, 5 aa, Plasmodium falciparum
TKIPT

SEQ ID NO: 3210403 - protein, 4 aa, Plasmodium falciparum
TKNK

SEQ ID NO: 3210404 - protein, 9 aa, Plasmodium falciparum
TKNTCPNYN

SEQ ID NO: 3210405 - protein, 6 aa, Plasmodium falciparum
TKNTLA

SEQ ID NO: 3210406 - protein, 8 aa, Plasmodium falciparum
TKQVSNEA

SEQ ID NO: 3210407 - protein, 5 aa, Plasmodium falciparum
TKSTI

SEQ ID NO: 3210408 - protein, 13 aa, Plasmodium falciparum
TKTDQGSTCQNKC

SEQ ID NO: 3210409 - protein, 9 aa, Plasmodium falciparum
TKTKESKKL

SEQ ID NO: 3210410 - protein, 7 aa, Plasmodium falciparum
TLGRKAK

SEQ ID NO: 3210411 - protein, 8 aa, Plasmodium falciparum
TLGSSNFS

SEQ ID NO: 3210412 - protein, 4 aa, Plasmodium falciparum
TNDK

SEQ ID NO: 3210413 - protein, 13 aa, Plasmodium falciparum
TNEAKKSDTIKEK

SEQ ID NO: 3210414 - protein, 5 aa, Plasmodium falciparum
TNEER

SEQ ID NO: 3210415 - protein, 4 aa, Plasmodium falciparum
TNEL

SEQ ID NO: 3210416 - protein, 13 aa, Plasmodium falciparum
TNGDKNGKKQKTF

SEQ ID NO: 3210417 - protein, 19 aa, Plasmodium falciparum
TNGRNGVKDHYQDDNGGNY

SEQ ID NO: 3210418 - protein, 4 aa, Plasmodium falciparum
TNKN

SEQ ID NO: 3210419 - protein, 45 aa, Plasmodium falciparum
TNKNKNKNKKVKNVNTTTNSNEKNNEKNDKNNENNDKNNDNVTDD

SEQ ID NO: 3210420 - protein, 5 aa, Plasmodium falciparum
TNKNT

SEQ ID NO: 3210421 - protein, 4 aa, Plasmodium falciparum
TNLN

SEQ ID NO: 3210422 - protein, 9 aa, Plasmodium falciparum
TNSMDDTKY

SEQ ID NO: 3210423 - protein, 13 aa, Plasmodium falciparum
TNTEITPENPLED

SEQ ID NO: 3210424 - protein, 4 aa, Plasmodium falciparum
TNTH

SEQ ID NO: 3210425 - protein, 9 aa, Plasmodium falciparum
TNTMDDPKY

SEQ ID NO: 3210426 - protein, 9 aa, Plasmodium falciparum
TNTNNDIPK

SEQ ID NO: 3210427 - protein, 4 aa, Plasmodium falciparum
TNTY

SEQ ID NO: 3210428 - protein, 5 aa, Plasmodium falciparum
TNYKN

SEQ ID NO: 3210429 - protein, 9 aa, Plasmodium falciparum
TPEKGKTSI

SEQ ID NO: 3210430 - protein, 10 aa, Plasmodium falciparum
TPKSSNCKRS

SEQ ID NO: 3210431 - protein, 36 aa, Plasmodium falciparum
TPSGDQKATSEGNGDANRRVARQTSESGEKSGDKDG

SEQ ID NO: 3210432 - protein, 7 aa, Plasmodium falciparum
TPSTYNN

SEQ ID NO: 3210433 - protein, 5 aa, Plasmodium falciparum
TPYNT

SEQ ID NO: 3210434 - protein, 9 aa, Plasmodium falciparum
TQEKKNEIK

SEQ ID NO: 3210435 - protein, 5 aa, Plasmodium falciparum
TQGNV

SEQ ID NO: 3210436 - protein, 10 aa, Plasmodium falciparum
TQKYGGNNSR

SEQ ID NO: 3210437 - protein, 12 aa, Plasmodium falciparum
TQSSNYDKDTGM

SEQ ID NO: 3210438 - protein, 10 aa, Plasmodium falciparum
TQTSSDDPIH

SEQ ID NO: 3210439 - protein, 14 aa, Plasmodium falciparum
TQYKTQSKKYFDDK

SEQ ID NO: 3210440 - protein, 7 aa, Plasmodium falciparum
TSDDDLN

SEQ ID NO: 3210441 - protein, 11 aa, Plasmodium falciparum
TSDGKPNDQVP

SEQ ID NO: 3210442 - protein, 4 aa, Plasmodium falciparum
TSIN

SEQ ID NO: 3210443 - protein, 5 aa, Plasmodium falciparum
TSNNE

SEQ ID NO: 3210444 - protein, 9 aa, Plasmodium falciparum
TSTLENDSD

SEQ ID NO: 3210445 - protein, 7 aa, Plasmodium falciparum
TTASTSY

SEQ ID NO: 3210446 - protein, 5 aa, Plasmodium falciparum
TTREN

SEQ ID NO: 3210447 - protein, 24 aa, Plasmodium falciparum
TVAETAAKKATEEAIKASTDAVES

SEQ ID NO: 3210448 - protein, 25 aa, Plasmodium falciparum
TVSESGTSDATGNKTCDDKDKCDEC

SEQ ID NO: 3210449 - protein, 4 aa, Plasmodium falciparum
TYEK

SEQ ID NO: 3210450 - protein, 4 aa, Plasmodium falciparum
TYNE

SEQ ID NO: 3210451 - protein, 11 aa, Plasmodium falciparum
TYRTQRRDDKI

SEQ ID NO: 3210452 - protein, 15 aa, Plasmodium falciparum
TYTSKDAKTDSNINN

SEQ ID NO: 3210453 - protein, 11 aa, Plasmodium falciparum
VAGSNSRSKEL

SEQ ID NO: 3210454 - protein, 8 aa, Plasmodium falciparum
VAKKEGDD

SEQ ID NO: 3210455 - protein, 7 aa, Plasmodium falciparum
VASSTQA

SEQ ID NO: 3210456 - protein, 6 aa, Plasmodium falciparum
VDADNV

SEQ ID NO: 3210457 - protein, 32 aa, Plasmodium falciparum
VEDNTQEEGEQPVVPQQEEGSSSPTPAPAGPD

SEQ ID NO: 3210458 - protein, 8 aa, Plasmodium falciparum
VEESVAPS

SEQ ID NO: 3210459 - protein, 4 aa, Plasmodium falciparum
VENE

SEQ ID NO: 3210460 - protein, 4 aa, Plasmodium falciparum
VENK

SEQ ID NO: 3210461 - protein, 8 aa, Plasmodium falciparum
VHNNNNDN

SEQ ID NO: 3210462 - protein, 16 aa, Plasmodium falciparum
VKSSSAKNSDDSNKTF

SEQ ID NO: 3210463 - protein, 9 aa, Plasmodium falciparum
VKTATDEAI

SEQ ID NO: 3210464 - protein, 4 aa, Plasmodium falciparum
VNEE

SEQ ID NO: 3210465 - protein, 8 aa, Plasmodium falciparum
VNIQNGQS

SEQ ID NO: 3210466 - protein, 5 aa, Plasmodium falciparum
VNNND

SEQ ID NO: 3210467 - protein, 19 aa, Plasmodium falciparum
VNPHQQNNMNQKNKSQKYQ

SEQ ID NO: 3210468 - protein, 7 aa, Plasmodium falciparum
VQKKDRS

SEQ ID NO: 3210469 - protein, 43 aa, Plasmodium falciparum
VSDKKDNLQDSNKGLNVTTNKTNDKTKLEDNTKQIKKGTNPFM

SEQ ID NO: 3210470 - protein, 25 aa, Plasmodium falciparum
VSGEPQTQGEASSPSDKESSQSDKL

SEQ ID NO: 3210471 - protein, 16 aa, Plasmodium falciparum
VSNINNYDNNNEGHEI

SEQ ID NO: 3210472 - protein, 44 aa, Plasmodium falciparum
VSRSGASPDTASPDTKATEEKEEEEEEEEEEDLGEESEEPEDQA

SEQ ID NO: 3210473 - protein, 8 aa, Plasmodium falciparum
VSTESPMN

SEQ ID NO: 3210474 - protein, 10 aa, Plasmodium falciparum
VTPVKDQKNC

SEQ ID NO: 3210475 - protein, 9 aa, Plasmodium falciparum
WATATTPTT

SEQ ID NO: 3210476 - protein, 4 aa, Plasmodium falciparum
YASY

SEQ ID NO: 3210477 - protein, 9 aa, Plasmodium falciparum
YDCEKTKRA

SEQ ID NO: 3210478 - protein, 9 aa, Plasmodium falciparum
YDCTKTKRA

SEQ ID NO: 3210479 - protein, 4 aa, Plasmodium falciparum
YDDN

SEQ ID NO: 3210480 - protein, 20 aa, Plasmodium falciparum
YDEQKKKKQKIYKEKKDKDI

SEQ ID NO: 3210481 - protein, 14 aa, Plasmodium falciparum
YDIPTTKSSNRYVP

SEQ ID NO: 3210482 - protein, 9 aa, Plasmodium falciparum
YDNDPDMKS

SEQ ID NO: 3210483 - protein, 7 aa, Plasmodium falciparum
YDNDPEM

SEQ ID NO: 3210484 - protein, 7 aa, Plasmodium falciparum
YDNDPQM

SEQ ID NO: 3210485 - protein, 4 aa, Plasmodium falciparum
YDNN

SEQ ID NO: 3210486 - protein, 18 aa, Plasmodium falciparum
YDTDEKNDLSDEVDNTND

SEQ ID NO: 3210487 - protein, 4 aa, Plasmodium falciparum
YEEN

SEQ ID NO: 3210488 - protein, 6 aa, Plasmodium falciparum
YEGDSL

SEQ ID NO: 3210489 - protein, 6 aa, Plasmodium falciparum
YEGESL

SEQ ID NO: 3210490 - protein, 5 aa, Plasmodium falciparum
YENEK

SEQ ID NO: 3210491 - protein, 10 aa, Plasmodium falciparum
YENNDNNNNC

SEQ ID NO: 3210492 - protein, 4 aa, Plasmodium falciparum
YGTV

SEQ ID NO: 3210493 - protein, 7 aa, Plasmodium falciparum
YIKPKDK

SEQ ID NO: 3210494 - protein, 4 aa, Plasmodium falciparum
YIND

SEQ ID NO: 3210495 - protein, 7 aa, Plasmodium falciparum
YKGNENF

SEQ ID NO: 3210496 - protein, 19 aa, Plasmodium falciparum
YKKNTSNNSVAKNTNSDPI

SEQ ID NO: 3210497 - protein, 8 aa, Plasmodium falciparum
YKQNNDLK

SEQ ID NO: 3210498 - protein, 4 aa, Plasmodium falciparum
YKTS

SEQ ID NO: 3210499 - protein, 4 aa, Plasmodium falciparum
YNCN

SEQ ID NO: 3210500 - protein, 5 aa, Plasmodium falciparum
YNCNY

SEQ ID NO: 3210501 - protein, 4 aa, Plasmodium falciparum
YNDN

SEQ ID NO: 3210502 - protein, 4 aa, Plasmodium falciparum
YNNT

SEQ ID NO: 3210503 - protein, 4 aa, Plasmodium falciparum
YNSS

SEQ ID NO: 3210504 - protein, 4 aa, Plasmodium falciparum
YNTN

SEQ ID NO: 3210505 - protein, 9 aa, Plasmodium falciparum
YPRKENYPG

SEQ ID NO: 3210506 - protein, 5 aa, Plasmodium falciparum
YPYVS

SEQ ID NO: 3210507 - protein, 4 aa, Plasmodium falciparum
YQEN

SEQ ID NO: 3210508 - protein, 9 aa, Plasmodium falciparum
YQETHDPYK

SEQ ID NO: 3210509 - protein, 9 aa, Plasmodium falciparum
YQKSHDPYE

SEQ ID NO: 3210510 - protein, 15 aa, Plasmodium falciparum
YRGNKKENKQREKLE

SEQ ID NO: 3210511 - protein, 4 aa, Plasmodium falciparum
YRNN

SEQ ID NO: 3210512 - protein, 27 aa, Plasmodium falciparum
YSDSDAEEDDEDEAVTESLSPSESQPK

SEQ ID NO: 3210513 - protein, 6 aa, Plasmodium falciparum
YSGEEY

SEQ ID NO: 3210514 - protein, 10 aa, Plasmodium falciparum
YSKLNKEERE

SEQ ID NO: 3210515 - protein, 4 aa, Plasmodium falciparum
YSNN

SEQ ID NO: 3210516 - protein, 4 aa, Plasmodium falciparum
YSSG

SEQ ID NO: 3210517 - protein, 4 aa, Plasmodium falciparum
YTKD

SEQ ID NO: 3210518 - protein, 11 aa, Plasmodium falciparum
AAAATSAANAH

SEQ ID NO: 3210519 - protein, 10 aa, Plasmodium falciparum
AAAEAAGKAR

SEQ ID NO: 3210520 - protein, 20 aa, Plasmodium falciparum
AAAGREGAEAYNTTFSDSTT

SEQ ID NO: 3210521 - protein, 4 aa, Plasmodium falciparum
AAAI

SEQ ID NO: 3210522 - protein, 5 aa, Plasmodium falciparum
AAAPY

SEQ ID NO: 3210523 - protein, 5 aa, Plasmodium falciparum
AAARN

SEQ ID NO: 3210524 - protein, 8 aa, Plasmodium falciparum
AAASAAKG

SEQ ID NO: 3210525 - protein, 25 aa, Plasmodium falciparum
AAATAETATEEATTTLTAKNTGEVN

SEQ ID NO: 3210526 - protein, 9 aa, Plasmodium falciparum
AAATKDAIT

SEQ ID NO: 3210527 - protein, 22 aa, Plasmodium falciparum
AAATKEAIAEAAAKGAAAGLKA

SEQ ID NO: 3210528 - protein, 23 aa, Plasmodium falciparum
AAATKEAIAEGAAKGAAAGTKAG

SEQ ID NO: 3210529 - protein, 9 aa, Plasmodium falciparum
AADAGEAGK

SEQ ID NO: 3210530 - protein, 11 aa, Plasmodium falciparum
AADDKNAKEAV

SEQ ID NO: 3210531 - protein, 8 aa, Plasmodium falciparum
AADPQDDA

SEQ ID NO: 3210532 - protein, 5 aa, Plasmodium falciparum
AADQK

SEQ ID NO: 3210533 - protein, 5 aa, Plasmodium falciparum
AAEDN

SEQ ID NO: 3210534 - protein, 9 aa, Plasmodium falciparum
AAEGSYSSY

SEQ ID NO: 3210535 - protein, 12 aa, Plasmodium falciparum
AAEKSGLAAGKV

SEQ ID NO: 3210536 - protein, 17 aa, Plasmodium falciparum
AAEKTGAAQGAAAGLKA

SEQ ID NO: 3210537 - protein, 20 aa, Plasmodium falciparum
AAEQAGAAKGLAAGAAKGAT

SEQ ID NO: 3210538 - protein, 8 aa, Plasmodium falciparum
AAGAEAGK

SEQ ID NO: 3210539 - protein, 17 aa, Plasmodium falciparum
AAGATKIAEAAESAGAA

SEQ ID NO: 3210540 - protein, 9 aa, Plasmodium falciparum
AAGNTTAAI

SEQ ID NO: 3210541 - protein, 4 aa, Plasmodium falciparum
AAGS

SEQ ID NO: 3210542 - protein, 4 aa, Plasmodium falciparum
AAGT

SEQ ID NO: 3210543 - protein, 5 aa, Plasmodium falciparum
AAGTA

SEQ ID NO: 3210544 - protein, 9 aa, Plasmodium falciparum
AAHGSRYSS

SEQ ID NO: 3210545 - protein, 20 aa, Plasmodium falciparum
AAIAAGKAAGKIAGEAAGKK

SEQ ID NO: 3210546 - protein, 19 aa, Plasmodium falciparum
AAIAKGTAKGLAAGAAKGV

SEQ ID NO: 3210547 - protein, 5 aa, Plasmodium falciparum
AAIDT

SEQ ID NO: 3210548 - protein, 10 aa, Plasmodium falciparum
AAIESSKNTI

SEQ ID NO: 3210549 - protein, 17 aa, Plasmodium falciparum
AAISSDHGKYQETNNDV

SEQ ID NO: 3210550 - protein, 12 aa, Plasmodium falciparum
AAKEAGAAAGIK

SEQ ID NO: 3210551 - protein, 10 aa, Plasmodium falciparum
AAKGLAAGNV

SEQ ID NO: 3210552 - protein, 7 aa, Plasmodium falciparum
AAKNESL

SEQ ID NO: 3210553 - protein, 6 aa, Plasmodium falciparum
AAKQAG

SEQ ID NO: 3210554 - protein, 11 aa, Plasmodium falciparum
AAKRDNEENQI

SEQ ID NO: 3210555 - protein, 12 aa, Plasmodium falciparum
AALEKENESLKN

SEQ ID NO: 3210556 - protein, 4 aa, Plasmodium falciparum
AALS

SEQ ID NO: 3210557 - protein, 9 aa, Plasmodium falciparum
AANAAGEAM

SEQ ID NO: 3210558 - protein, 8 aa, Plasmodium falciparum
AANAAGEV

SEQ ID NO: 3210559 - protein, 8 aa, Plasmodium falciparum
AANEAGIA

SEQ ID NO: 3210560 - protein, 9 aa, Plasmodium falciparum
AANEEKEQD

SEQ ID NO: 3210561 - protein, 8 aa, Plasmodium falciparum
AANELPNI

SEQ ID NO: 3210562 - protein, 8 aa, Plasmodium falciparum
AANKAGMA

SEQ ID NO: 3210563 - protein, 47 aa, Plasmodium falciparum
AANNSTTTSTTKVTDNNKTNIKLTGNNSTTINTNSTENTSATKKVTE

SEQ ID NO: 3210564 - protein, 5 aa, Plasmodium falciparum
AAPEE

SEQ ID NO: 3210565 - protein, 6 aa, Plasmodium falciparum
AAPEVK

SEQ ID NO: 3210566 - protein, 7 aa, Plasmodium falciparum
AAPVTSG

SEQ ID NO: 3210567 - protein, 19 aa, Plasmodium falciparum
AAQKAGDAAGKIAGESKGV

SEQ ID NO: 3210568 - protein, 4 aa, Plasmodium falciparum
AAQR

SEQ ID NO: 3210569 - protein, 10 aa, Plasmodium falciparum
AARSENGKKR

SEQ ID NO: 3210570 - protein, 16 aa, Plasmodium falciparum
AARTDQSLKRTKPPVD

SEQ ID NO: 3210571 - protein, 25 aa, Plasmodium falciparum
AASAATTTSTTTTNNSNNNNNNNNN

SEQ ID NO: 3210572 - protein, 12 aa, Plasmodium falciparum
AASASDEAKAEA

SEQ ID NO: 3210573 - protein, 9 aa, Plasmodium falciparum
AASCPEGDQ

SEQ ID NO: 3210574 - protein, 20 aa, Plasmodium falciparum
AASGDRGKGASADSNSNKTF

SEQ ID NO: 3210575 - protein, 16 aa, Plasmodium falciparum
AASNQETLTSADPEGQ

SEQ ID NO: 3210576 - protein, 6 aa, Plasmodium falciparum
AASQDV

SEQ ID NO: 3210577 - protein, 6 aa, Plasmodium falciparum
AASTAA

SEQ ID NO: 3210578 - protein, 21 aa, Plasmodium falciparum
AASVPNPQRPGQQQQNSSLTR

SEQ ID NO: 3210579 - protein, 5 aa, Plasmodium falciparum
AATAA

SEQ ID NO: 3210580 - protein, 12 aa, Plasmodium falciparum
AATAAATQKGIE

SEQ ID NO: 3210581 - protein, 12 aa, Plasmodium falciparum
AATATATQKGIE

SEQ ID NO: 3210582 - protein, 11 aa, Plasmodium falciparum
AATDKAEHETL

SEQ ID NO: 3210583 - protein, 6 aa, Plasmodium falciparum
AATKAA

SEQ ID NO: 3210584 - protein, 8 aa, Plasmodium falciparum
AATKAGMK

SEQ ID NO: 3210585 - protein, 4 aa, Plasmodium falciparum
AATL

SEQ ID NO: 3210586 - protein, 17 aa, Plasmodium falciparum
AATNVTDAVSDTASGIG

SEQ ID NO: 3210587 - protein, 7 aa, Plasmodium falciparum
AATSAAI

SEQ ID NO: 3210588 - protein, 6 aa, Plasmodium falciparum
AATTPY

SEQ ID NO: 3210589 - protein, 10 aa, Plasmodium falciparum
AATTSPDPAT

SEQ ID NO: 3210590 - protein, 6 aa, Plasmodium falciparum
AATYSY

SEQ ID NO: 3210591 - protein, 9 aa, Plasmodium falciparum
AAVAATEAG

SEQ ID NO: 3210592 - protein, 4 aa, Plasmodium falciparum
AAVG

SEQ ID NO: 3210593 - protein, 4 aa, Plasmodium falciparum
AAVQ

SEQ ID NO: 3210594 - protein, 6 aa, Plasmodium falciparum
AAVQKG

SEQ ID NO: 3210595 - protein, 13 aa, Plasmodium falciparum
AAVTTNGKTCPTN

SEQ ID NO: 3210596 - protein, 29 aa, Plasmodium falciparum
AAYNQGGYNYSQNKDKENYDKSNSGQKGY

SEQ ID NO: 3210597 - protein, 12 aa, Plasmodium falciparum
ACEQITTQEEGR

SEQ ID NO: 3210598 - protein, 23 aa, Plasmodium falciparum
ACKTSDNRSRTQPLQNKNINKNE

SEQ ID NO: 3210599 - protein, 4 aa, Plasmodium falciparum
ACNG

SEQ ID NO: 3210600 - protein, 13 aa, Plasmodium falciparum
ACNGGKSSTPNKC

SEQ ID NO: 3210601 - protein, 11 aa, Plasmodium falciparum
ACPTKYGKNAP

SEQ ID NO: 3210602 - protein, 14 aa, Plasmodium falciparum
ACQDIKDDKEGGKI

SEQ ID NO: 3210603 - protein, 9 aa, Plasmodium falciparum
ACRDEKKRK

SEQ ID NO: 3210604 - protein, 25 aa, Plasmodium falciparum
ACREKGDDEYKCSGDGHDCTKNGNL

SEQ ID NO: 3210605 - protein, 6 aa, Plasmodium falciparum
ACRNDK

SEQ ID NO: 3210606 - protein, 4 aa, Plasmodium falciparum
ACSS

SEQ ID NO: 3210607 - protein, 13 aa, Plasmodium falciparum
ACSTKYGPKAPTS

SEQ ID NO: 3210608 - protein, 13 aa, Plasmodium falciparum
ACTAVDDDKGGKI

SEQ ID NO: 3210609 - protein, 12 aa, Plasmodium falciparum
ACTAVKDNDGGT

SEQ ID NO: 3210610 - protein, 4 aa, Plasmodium falciparum
ACTG

SEQ ID NO: 3210611 - protein, 9 aa, Plasmodium falciparum
ADAESVDPE

SEQ ID NO: 3210612 - protein, 6 aa, Plasmodium falciparum
ADAKAG

SEQ ID NO: 3210613 - protein, 18 aa, Plasmodium falciparum
ADAKPGSSQNNFLYHDDK

SEQ ID NO: 3210614 - protein, 51 aa, Plasmodium falciparum
ADAPNGYAYGGSAHDGSHGNLRGHDNKGSEGYGYEAPYNPGFNGAPGSNGM

SEQ ID NO: 3210615 - protein, 10 aa, Plasmodium falciparum
ADASPEEEGN

SEQ ID NO: 3210616 - protein, 19 aa, Plasmodium falciparum
ADASQGKYIRGGKEKKLNG

SEQ ID NO: 3210617 - protein, 8 aa, Plasmodium falciparum
ADATEKAT

SEQ ID NO: 3210618 - protein, 139 aa, Plasmodium falciparum
ADCDKKQKKEEEKEEEKGDIKNGLDENNNKVNVPEGEKDDDEEDDEEEDDEEDDDEEDDEEEDDGEDDDEEDDGDDDVNGDNEKKDKKDKNDKNDKNGKNGKNGKNEKNDGKNDGNNNSHNSHKYNKRKNKKYKKNNIS

SEQ ID NO: 3210619 - protein, 13 aa, Plasmodium falciparum
ADDGKKEEDEKPC

SEQ ID NO: 3210620 - protein, 4 aa, Plasmodium falciparum
ADDY

SEQ ID NO: 3210621 - protein, 5 aa, Plasmodium falciparum
ADEAV

SEQ ID NO: 3210622 - protein, 10 aa, Plasmodium falciparum
ADEDDELNNS

SEQ ID NO: 3210623 - protein, 19 aa, Plasmodium falciparum
ADEEERALEAAGKDENGDS

SEQ ID NO: 3210624 - protein, 27 aa, Plasmodium falciparum
ADEENKNKLKDKDNKDQEKKNKGESKC

SEQ ID NO: 3210625 - protein, 7 aa, Plasmodium falciparum
ADEEQKL

SEQ ID NO: 3210626 - protein, 6 aa, Plasmodium falciparum
ADEETN

SEQ ID NO: 3210627 - protein, 35 aa, Plasmodium falciparum
ADEGRGEHSRAATFKSKSKLSRNYSSKQHEMLDSQ

SEQ ID NO: 3210628 - protein, 8 aa, Plasmodium falciparum
ADEIKNSK

SEQ ID NO: 3210629 - protein, 9 aa, Plasmodium falciparum
ADENRTSNV

SEQ ID NO: 3210630 - protein, 6 aa, Plasmodium falciparum
ADFDNE

SEQ ID NO: 3210631 - protein, 8 aa, Plasmodium falciparum
ADGCSSDD

SEQ ID NO: 3210632 - protein, 10 aa, Plasmodium falciparum
ADGGLSNSTL

SEQ ID NO: 3210633 - protein, 7 aa, Plasmodium falciparum
ADGGTLS

SEQ ID NO: 3210634 - protein, 10 aa, Plasmodium falciparum
ADGLGSMGND

SEQ ID NO: 3210635 - protein, 6 aa, Plasmodium falciparum
ADGREC

SEQ ID NO: 3210636 - protein, 9 aa, Plasmodium falciparum
ADGTPREVY

SEQ ID NO: 3210637 - protein, 11 aa, Plasmodium falciparum
ADHNDIDEKNP

SEQ ID NO: 3210638 - protein, 21 aa, Plasmodium falciparum
ADIESRGDYKDDGKKGSTLSS

SEQ ID NO: 3210639 - protein, 19 aa, Plasmodium falciparum
ADINKTNSEGLTIDWILSQ

SEQ ID NO: 3210640 - protein, 6 aa, Plasmodium falciparum
ADINND

SEQ ID NO: 3210641 - protein, 4 aa, Plasmodium falciparum
ADKI

SEQ ID NO: 3210642 - protein, 12 aa, Plasmodium falciparum
ADKKKEEEQNKN

SEQ ID NO: 3210643 - protein, 9 aa, Plasmodium falciparum
ADKNEISEN

SEQ ID NO: 3210644 - protein, 10 aa, Plasmodium falciparum
ADKNKLSNEQ

SEQ ID NO: 3210645 - protein, 36 aa, Plasmodium falciparum
ADLNAEKTTDLNSEKTADLNSDKTTDLNPEKTTNFN

SEQ ID NO: 3210646 - protein, 58 aa, Plasmodium falciparum
ADNGSGNDEVQEEEESEEKNKGDAAPLPEKPSGDSTSTDQTEPPAPAPQPLPSDNTSD

SEQ ID NO: 3210647 - protein, 23 aa, Plasmodium falciparum
ADNKKRKKKYDKKNIKEGYDGNS

SEQ ID NO: 3210648 - protein, 14 aa, Plasmodium falciparum
ADNNDSKEKKNEIT

SEQ ID NO: 3210649 - protein, 36 aa, Plasmodium falciparum
ADNNEKSSNNSLDKNNTQGSIDEKGYKNNNNNNNNM

SEQ ID NO: 3210650 - protein, 13 aa, Plasmodium falciparum
ADNSQQKGDTPKD

SEQ ID NO: 3210651 - protein, 6 aa, Plasmodium falciparum
ADNSQR

SEQ ID NO: 3210652 - protein, 4 aa, Plasmodium falciparum
ADNT

SEQ ID NO: 3210653 - protein, 17 aa, Plasmodium falciparum
ADNYKYDTHNNKDNEKY

SEQ ID NO: 3210654 - protein, 11 aa, Plasmodium falciparum
ADPNIKDKERN

SEQ ID NO: 3210655 - protein, 8 aa, Plasmodium falciparum
ADPPNDRT

SEQ ID NO: 3210656 - protein, 7 aa, Plasmodium falciparum
ADPSKDK

SEQ ID NO: 3210657 - protein, 6 aa, Plasmodium falciparum
ADPVTK

SEQ ID NO: 3210658 - protein, 5 aa, Plasmodium falciparum
ADQAA

SEQ ID NO: 3210659 - protein, 7 aa, Plasmodium falciparum
ADQRKSH

SEQ ID NO: 3210660 - protein, 5 aa, Plasmodium falciparum
ADSCR

SEQ ID NO: 3210661 - protein, 7 aa, Plasmodium falciparum
ADSDEKS

SEQ ID NO: 3210662 - protein, 4 aa, Plasmodium falciparum
ADSK

SEQ ID NO: 3210663 - protein, 8 aa, Plasmodium falciparum
ADSPSTTV

SEQ ID NO: 3210664 - protein, 18 aa, Plasmodium falciparum
ADSTDDEREDGHDEDHSY

SEQ ID NO: 3210665 - protein, 12 aa, Plasmodium falciparum
ADTDDKKKGFQT

SEQ ID NO: 3210666 - protein, 10 aa, Plasmodium falciparum
ADTPCNTEAE

SEQ ID NO: 3210667 - protein, 9 aa, Plasmodium falciparum
ADTVTGGNS

SEQ ID NO: 3210668 - protein, 96 aa, Plasmodium falciparum
ADVGGKRNDGDNNDDDDNNDDGDNNDDGDNNDDDDNDDKSNNNNNNNNNGDPSSNNNNNNNNNNGDPSSNNNNNNNGDPSSNNNDDGDADEKRNDY

SEQ ID NO: 3210669 - protein, 8 aa, Plasmodium falciparum
ADVKDSTL

SEQ ID NO: 3210670 - protein, 5 aa, Plasmodium falciparum
ADVNK

SEQ ID NO: 3210671 - protein, 7 aa, Plasmodium falciparum
ADVPTQV

SEQ ID NO: 3210672 - protein, 34 aa, Plasmodium falciparum
ADVSNNDNSGHEENNKHKLNKKNSSNYKNDKSLD

SEQ ID NO: 3210673 - protein, 4 aa, Plasmodium falciparum
ADYA

SEQ ID NO: 3210674 - protein, 15 aa, Plasmodium falciparum
ADYTSESNDNSINKS

SEQ ID NO: 3210675 - protein, 15 aa, Plasmodium falciparum
AEAAGKVSKTTEEAG

SEQ ID NO: 3210676 - protein, 9 aa, Plasmodium falciparum
AEAEDDENF

SEQ ID NO: 3210677 - protein, 39 aa, Plasmodium falciparum
AEAEEPETAEEKKEEEKEEDTDGKVQPPPAATTPGVKPP

SEQ ID NO: 3210678 - protein, 14 aa, Plasmodium falciparum
AEAKAAEVAAAKTA

SEQ ID NO: 3210679 - protein, 14 aa, Plasmodium falciparum
AEATEVATSTTEEM

SEQ ID NO: 3210680 - protein, 19 aa, Plasmodium falciparum
AECANNRIKGNKGSNGDAC

SEQ ID NO: 3210681 - protein, 16 aa, Plasmodium falciparum
AECDTSNGTVKETKCT

SEQ ID NO: 3210682 - protein, 11 aa, Plasmodium falciparum
AEDDDNNRGDI

SEQ ID NO: 3210683 - protein, 6 aa, Plasmodium falciparum
AEDDGN

SEQ ID NO: 3210684 - protein, 28 aa, Plasmodium falciparum
AEDERKRKNPRASYAKSRQGTQASKPFL

SEQ ID NO: 3210685 - protein, 8 aa, Plasmodium falciparum
AEDGTIKP

SEQ ID NO: 3210686 - protein, 15 aa, Plasmodium falciparum
AEDNNRFKNNKSGVL

SEQ ID NO: 3210687 - protein, 8 aa, Plasmodium falciparum
AEDNYDKQ

SEQ ID NO: 3210688 - protein, 5 aa, Plasmodium falciparum
AEDTH

SEQ ID NO: 3210689 - protein, 31 aa, Plasmodium falciparum
AEDTKNYMTQDSSTELDSKMKNEEQEENEKI

SEQ ID NO: 3210690 - protein, 10 aa, Plasmodium falciparum
AEDTKTKCEK

SEQ ID NO: 3210691 - protein, 34 aa, Plasmodium falciparum
AEEARKSSTSPQPGESGVANASASSTSSPTDATQ

SEQ ID NO: 3210692 - protein, 32 aa, Plasmodium falciparum
AEEATQAAAEAAKKASESATAAFETAEKEAIE

SEQ ID NO: 3210693 - protein, 6 aa, Plasmodium falciparum
AEEEKD

SEQ ID NO: 3210694 - protein, 6 aa, Plasmodium falciparum
AEEERK

SEQ ID NO: 3210695 - protein, 11 aa, Plasmodium falciparum
AEEHKNINKNI

SEQ ID NO: 3210696 - protein, 13 aa, Plasmodium falciparum
AEEKLNKYYSLDS

SEQ ID NO: 3210697 - protein, 4 aa, Plasmodium falciparum
AEEN

SEQ ID NO: 3210698 - protein, 14 aa, Plasmodium falciparum
AEENPFNKEYTTNH

SEQ ID NO: 3210699 - protein, 14 aa, Plasmodium falciparum
AEENTKSTSQYNDY

SEQ ID NO: 3210700 - protein, 9 aa, Plasmodium falciparum
AEEPDDEKK

SEQ ID NO: 3210701 - protein, 4 aa, Plasmodium falciparum
AEET

SEQ ID NO: 3210702 - protein, 60 aa, Plasmodium falciparum
AEETTKGSKSQESGKAEGTSESSGSEASSPGGTSSQGEKSPQGLSTPASTSSPSNSRDDD

SEQ ID NO: 3210703 - protein, 23 aa, Plasmodium falciparum
AEEVRKDEEEAKRAEKERNNEEI

SEQ ID NO: 3210704 - protein, 12 aa, Plasmodium falciparum
AEEYIKGKEDDI

SEQ ID NO: 3210705 - protein, 8 aa, Plasmodium falciparum
AEGAAAGI

SEQ ID NO: 3210706 - protein, 11 aa, Plasmodium falciparum
AEGAAKGAVAA

SEQ ID NO: 3210707 - protein, 6 aa, Plasmodium falciparum
AEGANN

SEQ ID NO: 3210708 - protein, 7 aa, Plasmodium falciparum
AEGEYQN

SEQ ID NO: 3210709 - protein, 4 aa, Plasmodium falciparum
AEGI

SEQ ID NO: 3210710 - protein, 8 aa, Plasmodium falciparum
AEGKENYD

SEQ ID NO: 3210711 - protein, 5 aa, Plasmodium falciparum
AEGKN

SEQ ID NO: 3210712 - protein, 31 aa, Plasmodium falciparum
AEGKSTSKKNAKTALRKTKQTTLTSADPEGQ

SEQ ID NO: 3210713 - protein, 4 aa, Plasmodium falciparum
AEGN

SEQ ID NO: 3210714 - protein, 6 aa, Plasmodium falciparum
AEGTAD

SEQ ID NO: 3210715 - protein, 5 aa, Plasmodium falciparum
AEHKN

SEQ ID NO: 3210716 - protein, 10 aa, Plasmodium falciparum
AEKAAQEEME

SEQ ID NO: 3210717 - protein, 13 aa, Plasmodium falciparum
AEKAGAAEGLAAG

SEQ ID NO: 3210718 - protein, 40 aa, Plasmodium falciparum
AEKDALAKKESEAPKGSSTSDKNTTENQLNAEAQSEVKPQ

SEQ ID NO: 3210719 - protein, 4 aa, Plasmodium falciparum
AEKE

SEQ ID NO: 3210720 - protein, 4 aa, Plasmodium falciparum
AEKI

SEQ ID NO: 3210721 - protein, 9 aa, Plasmodium falciparum
AEKKEIDEN

SEQ ID NO: 3210722 - protein, 8 aa, Plasmodium falciparum
AEKKQSCD

SEQ ID NO: 3210723 - protein, 49 aa, Plasmodium falciparum
AEKKRGRPTEDGQQQNNTNISNSNNNNNNNDHNNNNDKMETEKNDNKMR

SEQ ID NO: 3210724 - protein, 7 aa, Plasmodium falciparum
AEKKRSS

SEQ ID NO: 3210725 - protein, 4 aa, Plasmodium falciparum
AEKN

SEQ ID NO: 3210726 - protein, 10 aa, Plasmodium falciparum
AEKNSRVDDK

SEQ ID NO: 3210727 - protein, 4 aa, Plasmodium falciparum
AEKQ

SEQ ID NO: 3210728 - protein, 10 aa, Plasmodium falciparum
AEKQNEKYKK

SEQ ID NO: 3210729 - protein, 28 aa, Plasmodium falciparum
AEKQSSQGGGAPQVSPSATASSGSQSDP

SEQ ID NO: 3210730 - protein, 5 aa, Plasmodium falciparum
AEKSL

SEQ ID NO: 3210731 - protein, 15 aa, Plasmodium falciparum
AEKTDRNINDIGRNN

SEQ ID NO: 3210732 - protein, 5 aa, Plasmodium falciparum
AEKTE

SEQ ID NO: 3210733 - protein, 24 aa, Plasmodium falciparum
AEKTTDVNLGKTTNHNVAKTTDQK

SEQ ID NO: 3210734 - protein, 16 aa, Plasmodium falciparum
AEKVAGEALEKATEGV

SEQ ID NO: 3210735 - protein, 5 aa, Plasmodium falciparum
AEKVE

SEQ ID NO: 3210736 - protein, 11 aa, Plasmodium falciparum
AELEKTKGRDK

SEQ ID NO: 3210737 - protein, 10 aa, Plasmodium falciparum
AENFENKTDV

SEQ ID NO: 3210738 - protein, 21 aa, Plasmodium falciparum
AENKDDNNMNNNKNDNINDNI

SEQ ID NO: 3210739 - protein, 17 aa, Plasmodium falciparum
AENKNEKKNEKKKINKN

SEQ ID NO: 3210740 - protein, 7 aa, Plasmodium falciparum
AENMDEE

SEQ ID NO: 3210741 - protein, 7 aa, Plasmodium falciparum
AENNKQI

SEQ ID NO: 3210742 - protein, 5 aa, Plasmodium falciparum
AENNN

SEQ ID NO: 3210743 - protein, 16 aa, Plasmodium falciparum
AENPRSYATPYSTEVT

SEQ ID NO: 3210744 - protein, 14 aa, Plasmodium falciparum
AENSKKIKDADKKD

SEQ ID NO: 3210745 - protein, 11 aa, Plasmodium falciparum
AENTKTQGGVG

SEQ ID NO: 3210746 - protein, 9 aa, Plasmodium falciparum
AENTKTQSE

SEQ ID NO: 3210747 - protein, 10 aa, Plasmodium falciparum
AENTKTQSVG

SEQ ID NO: 3210748 - protein, 5 aa, Plasmodium falciparum
AENTR

SEQ ID NO: 3210749 - protein, 15 aa, Plasmodium falciparum
AENTRDNKSPLGNGG

SEQ ID NO: 3210750 - protein, 20 aa, Plasmodium falciparum
AENVAAAAEQQATKDAIKAS

SEQ ID NO: 3210751 - protein, 7 aa, Plasmodium falciparum
AEPNSAS

SEQ ID NO: 3210752 - protein, 14 aa, Plasmodium falciparum
AEPSDYNSSDEEDY

SEQ ID NO: 3210753 - protein, 26 aa, Plasmodium falciparum
AEPVATAAAQQATEEAIKASTDAVES

SEQ ID NO: 3210754 - protein, 18 aa, Plasmodium falciparum
AEQAGAAKGLAAGAAKGV

SEQ ID NO: 3210755 - protein, 7 aa, Plasmodium falciparum
AEQHDNM

SEQ ID NO: 3210756 - protein, 4 aa, Plasmodium falciparum
AEQK

SEQ ID NO: 3210757 - protein, 15 aa, Plasmodium falciparum
AEQVEEEEKKKEEEL

SEQ ID NO: 3210758 - protein, 8 aa, Plasmodium falciparum
AERNKSGT

SEQ ID NO: 3210759 - protein, 9 aa, Plasmodium falciparum
AERRNNKNE

SEQ ID NO: 3210760 - protein, 166 aa, Plasmodium falciparum
AESKPSTGAGGSAGGSAGGSAGGSAGGSAGGSAGSGDGNGADAEGSSSTPATTTTTKTTTTTTTTNDAEASTSTSSENPNHKNAETNPKGKGEVQEPNQANKETQNNSNVQQDSQTKSNVPPTQDADTKSPTAQPEQAENSAPTAEQTESPELQSAPENKGTGQHG

SEQ ID NO: 3210761 - protein, 6 aa, Plasmodium falciparum
AESQTS

SEQ ID NO: 3210762 - protein, 7 aa, Plasmodium falciparum
AESRDIE

SEQ ID NO: 3210763 - protein, 12 aa, Plasmodium falciparum
AESSGKKGGKEN

SEQ ID NO: 3210764 - protein, 5 aa, Plasmodium falciparum
AESTD

SEQ ID NO: 3210765 - protein, 10 aa, Plasmodium falciparum
AETTAGATKE

SEQ ID NO: 3210766 - protein, 5 aa, Plasmodium falciparum
AEVSK

SEQ ID NO: 3210767 - protein, 7 aa, Plasmodium falciparum
AEVTSNN

SEQ ID NO: 3210768 - protein, 5 aa, Plasmodium falciparum
AEYEK

SEQ ID NO: 3210769 - protein, 11 aa, Plasmodium falciparum
AFDDEEENNIP

SEQ ID NO: 3210770 - protein, 5 aa, Plasmodium falciparum
AFEPN

SEQ ID NO: 3210771 - protein, 9 aa, Plasmodium falciparum
AFKNGGENG

SEQ ID NO: 3210772 - protein, 10 aa, Plasmodium falciparum
AFKNKRENSG

SEQ ID NO: 3210773 - protein, 10 aa, Plasmodium falciparum
AFPDDDPDYQ

SEQ ID NO: 3210774 - protein, 9 aa, Plasmodium falciparum
AFPENENNC

SEQ ID NO: 3210775 - protein, 16 aa, Plasmodium falciparum
AGAAMGKAAGDAAGAT

SEQ ID NO: 3210776 - protein, 9 aa, Plasmodium falciparum
AGADAYKTT

SEQ ID NO: 3210777 - protein, 5 aa, Plasmodium falciparum
AGAEA

SEQ ID NO: 3210778 - protein, 17 aa, Plasmodium falciparum
AGAEQAAEAKAANVRTT

SEQ ID NO: 3210779 - protein, 7 aa, Plasmodium falciparum
AGAGGNC

SEQ ID NO: 3210780 - protein, 8 aa, Plasmodium falciparum
AGAQAANE

SEQ ID NO: 3210781 - protein, 7 aa, Plasmodium falciparum
AGASNIS

SEQ ID NO: 3210782 - protein, 6 aa, Plasmodium falciparum
AGATGT

SEQ ID NO: 3210783 - protein, 4 aa, Plasmodium falciparum
AGDG

SEQ ID NO: 3210784 - protein, 6 aa, Plasmodium falciparum
AGDIEG

SEQ ID NO: 3210785 - protein, 33 aa, Plasmodium falciparum
AGDNTAASVSPQVRGETPLASTSASTPSGSHRD

SEQ ID NO: 3210786 - protein, 7 aa, Plasmodium falciparum
AGDSDEY

SEQ ID NO: 3210787 - protein, 17 aa, Plasmodium falciparum
AGDSNCKNFSSKNSSKY

SEQ ID NO: 3210788 - protein, 5 aa, Plasmodium falciparum
AGDTY

SEQ ID NO: 3210789 - protein, 4 aa, Plasmodium falciparum
AGEA

SEQ ID NO: 3210790 - protein, 23 aa, Plasmodium falciparum
AGEETKSAMGINNGSTNFQDENK

SEQ ID NO: 3210791 - protein, 15 aa, Plasmodium falciparum
AGEGKKLREKHDESC

SEQ ID NO: 3210792 - protein, 5 aa, Plasmodium falciparum
AGESL

SEQ ID NO: 3210793 - protein, 22 aa, Plasmodium falciparum
AGETQGDKSVPKVTDVKDDDSL

SEQ ID NO: 3210794 - protein, 15 aa, Plasmodium falciparum
AGGDKDTQASVSPQV

SEQ ID NO: 3210795 - protein, 15 aa, Plasmodium falciparum
AGGGEETPETSLKNG

SEQ ID NO: 3210796 - protein, 33 aa, Plasmodium falciparum
AGGGNTAASQGSGEAAQPVTVTQPQASGGNTQV

SEQ ID NO: 3210797 - protein, 5 aa, Plasmodium falciparum
AGGIE

SEQ ID NO: 3210798 - protein, 11 aa, Plasmodium falciparum
AGGKKEDESAK

SEQ ID NO: 3210799 - protein, 5 aa, Plasmodium falciparum
AGGLS

SEQ ID NO: 3210800 - protein, 5 aa, Plasmodium falciparum
AGGSQ

SEQ ID NO: 3210801 - protein, 4 aa, Plasmodium falciparum
AGGT

SEQ ID NO: 3210802 - protein, 15 aa, Plasmodium falciparum
AGGTDEKDKQKMKEI

SEQ ID NO: 3210803 - protein, 6 aa, Plasmodium falciparum
AGGTTE

SEQ ID NO: 3210804 - protein, 6 aa, Plasmodium falciparum
AGGYNG

SEQ ID NO: 3210805 - protein, 9 aa, Plasmodium falciparum
AGHSSTSLS

SEQ ID NO: 3210806 - protein, 21 aa, Plasmodium falciparum
AGHYNNQEGHKDYPLDNENNV

SEQ ID NO: 3210807 - protein, 4 aa, Plasmodium falciparum
AGIA

SEQ ID NO: 3210808 - protein, 6 aa, Plasmodium falciparum
AGIEEG

SEQ ID NO: 3210809 - protein, 5 aa, Plasmodium falciparum
AGIEH

SEQ ID NO: 3210810 - protein, 4 aa, Plasmodium falciparum
AGKK

SEQ ID NO: 3210811 - protein, 4 aa, Plasmodium falciparum
AGKN

SEQ ID NO: 3210812 - protein, 9 aa, Plasmodium falciparum
AGKNNSNNF

SEQ ID NO: 3210813 - protein, 5 aa, Plasmodium falciparum
AGKPE

SEQ ID NO: 3210814 - protein, 9 aa, Plasmodium falciparum
AGKSIKGIN

SEQ ID NO: 3210815 - protein, 6 aa, Plasmodium falciparum
AGMNST

SEQ ID NO: 3210816 - protein, 18 aa, Plasmodium falciparum
AGNAAEAAGKAANEKYAE

SEQ ID NO: 3210817 - protein, 6 aa, Plasmodium falciparum
AGNAAG

SEQ ID NO: 3210818 - protein, 4 aa, Plasmodium falciparum
AGNG

SEQ ID NO: 3210819 - protein, 6 aa, Plasmodium falciparum
AGNGKI

SEQ ID NO: 3210820 - protein, 13 aa, Plasmodium falciparum
AGNKTHKKIEKGN

SEQ ID NO: 3210821 - protein, 14 aa, Plasmodium falciparum
AGPCSKTNNGDDDI

SEQ ID NO: 3210822 - protein, 6 aa, Plasmodium falciparum
AGPPPG

SEQ ID NO: 3210823 - protein, 8 aa, Plasmodium falciparum
AGQGNKTL

SEQ ID NO: 3210824 - protein, 11 aa, Plasmodium falciparum
AGQKSSSNERD

SEQ ID NO: 3210825 - protein, 11 aa, Plasmodium falciparum
AGRDDSENNVS

SEQ ID NO: 3210826 - protein, 15 aa, Plasmodium falciparum
AGRGNITNKPTEVNH

SEQ ID NO: 3210827 - protein, 10 aa, Plasmodium falciparum
AGRSATRNQC

SEQ ID NO: 3210828 - protein, 12 aa, Plasmodium falciparum
AGSFGNEGDSIG

SEQ ID NO: 3210829 - protein, 7 aa, Plasmodium falciparum
AGSGRNI

SEQ ID NO: 3210830 - protein, 4 aa, Plasmodium falciparum
AGSL

SEQ ID NO: 3210831 - protein, 8 aa, Plasmodium falciparum
AGSLSTGT

SEQ ID NO: 3210832 - protein, 25 aa, Plasmodium falciparum
AGSNNNAGAPTGKKLTDIEKKKRNK

SEQ ID NO: 3210833 - protein, 6 aa, Plasmodium falciparum
AGSSAG

SEQ ID NO: 3210834 - protein, 9 aa, Plasmodium falciparum
AGSSAPGVT

SEQ ID NO: 3210835 - protein, 21 aa, Plasmodium falciparum
AGSSATGGTTAMTPNTPYSTA

SEQ ID NO: 3210836 - protein, 7 aa, Plasmodium falciparum
AGSTAAA

SEQ ID NO: 3210837 - protein, 7 aa, Plasmodium falciparum
AGSTGTR

SEQ ID NO: 3210838 - protein, 5 aa, Plasmodium falciparum
AGSTI

SEQ ID NO: 3210839 - protein, 7 aa, Plasmodium falciparum
AGSYDNE

SEQ ID NO: 3210840 - protein, 5 aa, Plasmodium falciparum
AGSYE

SEQ ID NO: 3210841 - protein, 16 aa, Plasmodium falciparum
AGTEAYNATLPTKTAA

SEQ ID NO: 3210842 - protein, 10 aa, Plasmodium falciparum
AGTGKTETTK

SEQ ID NO: 3210843 - protein, 6 aa, Plasmodium falciparum
AGTNNS

SEQ ID NO: 3210844 - protein, 7 aa, Plasmodium falciparum
AGTQQNS

SEQ ID NO: 3210845 - protein, 9 aa, Plasmodium falciparum
AGTRTNDKC

SEQ ID NO: 3210846 - protein, 10 aa, Plasmodium falciparum
AGTVSSAATT

SEQ ID NO: 3210847 - protein, 10 aa, Plasmodium falciparum
AHAEDKNKND

SEQ ID NO: 3210848 - protein, 4 aa, Plasmodium falciparum
AHEN

SEQ ID NO: 3210849 - protein, 11 aa, Plasmodium falciparum
AHENNKNGKIL

SEQ ID NO: 3210850 - protein, 46 aa, Plasmodium falciparum
AHENVKNDENVKNDENVKNDENVKNGKNRKIVKNDEDKCVDSPYGQ

SEQ ID NO: 3210851 - protein, 6 aa, Plasmodium falciparum
AHGGRT

SEQ ID NO: 3210852 - protein, 48 aa, Plasmodium falciparum
AHGGVSNDDEEGIQKGKLKKSTIKKNINSDKGEDSEKNVSKLNETKEK

SEQ ID NO: 3210853 - protein, 12 aa, Plasmodium falciparum
AHHTGERTSYTE

SEQ ID NO: 3210854 - protein, 4 aa, Plasmodium falciparum
AHIE

SEQ ID NO: 3210855 - protein, 14 aa, Plasmodium falciparum
AHKKQKESSFINGT

SEQ ID NO: 3210856 - protein, 13 aa, Plasmodium falciparum
AHNDEEEEDDEEE

SEQ ID NO: 3210857 - protein, 12 aa, Plasmodium falciparum
AHNEKSDINELN

SEQ ID NO: 3210858 - protein, 5 aa, Plasmodium falciparum
AHNIK

SEQ ID NO: 3210859 - protein, 6 aa, Plasmodium falciparum
AHNKNK

SEQ ID NO: 3210860 - protein, 7 aa, Plasmodium falciparum
AHNNDSS

SEQ ID NO: 3210861 - protein, 5 aa, Plasmodium falciparum
AHNPT

SEQ ID NO: 3210862 - protein, 12 aa, Plasmodium falciparum
AHPEKVKNNNNI

SEQ ID NO: 3210863 - protein, 8 aa, Plasmodium falciparum
AHPKDEAV

SEQ ID NO: 3210864 - protein, 7 aa, Plasmodium falciparum
AHPRATS

SEQ ID NO: 3210865 - protein, 8 aa, Plasmodium falciparum
AHRENGKK

SEQ ID NO: 3210866 - protein, 4 aa, Plasmodium falciparum
AHRT

SEQ ID NO: 3210867 - protein, 8 aa, Plasmodium falciparum
AHRTSKRG

SEQ ID NO: 3210868 - protein, 6 aa, Plasmodium falciparum
AHSKKK

SEQ ID NO: 3210869 - protein, 7 aa, Plasmodium falciparum
AHSSGNY

SEQ ID NO: 3210870 - protein, 18 aa, Plasmodium falciparum
AIAEGAAAGKAAGEAAGI

SEQ ID NO: 3210871 - protein, 17 aa, Plasmodium falciparum
AIAKGAAAGKIAGEAKG

SEQ ID NO: 3210872 - protein, 6 aa, Plasmodium falciparum
AIDNKN

SEQ ID NO: 3210873 - protein, 4 aa, Plasmodium falciparum
AIDP

SEQ ID NO: 3210874 - protein, 12 aa, Plasmodium falciparum
AIGNKNNDVNLN

SEQ ID NO: 3210875 - protein, 11 aa, Plasmodium falciparum
AIHNSDKSKNI

SEQ ID NO: 3210876 - protein, 10 aa, Plasmodium falciparum
AIKTNTTAVN

SEQ ID NO: 3210877 - protein, 12 aa, Plasmodium falciparum
AIKTQDNLKSEE

SEQ ID NO: 3210878 - protein, 16 aa, Plasmodium falciparum
AIKTSTEAIDAATTTY

SEQ ID NO: 3210879 - protein, 13 aa, Plasmodium falciparum
AINEKEKNKSTDM

SEQ ID NO: 3210880 - protein, 5 aa, Plasmodium falciparum
AIQKE

SEQ ID NO: 3210881 - protein, 7 aa, Plasmodium falciparum
AISKGTA

SEQ ID NO: 3210882 - protein, 4 aa, Plasmodium falciparum
AISQ

SEQ ID NO: 3210883 - protein, 8 aa, Plasmodium falciparum
AISSGTSF

SEQ ID NO: 3210884 - protein, 11 aa, Plasmodium falciparum
AISTNGNEEDA

SEQ ID NO: 3210885 - protein, 5 aa, Plasmodium falciparum
AITAA

SEQ ID NO: 3210886 - protein, 5 aa, Plasmodium falciparum
AITDS

SEQ ID NO: 3210887 - protein, 15 aa, Plasmodium falciparum
AKAATDAGIKEATEA

SEQ ID NO: 3210888 - protein, 10 aa, Plasmodium falciparum
AKAATNAGVK

SEQ ID NO: 3210889 - protein, 8 aa, Plasmodium falciparum
AKAATSKT

SEQ ID NO: 3210890 - protein, 14 aa, Plasmodium falciparum
AKAEEEKKKKEELK

SEQ ID NO: 3210891 - protein, 6 aa, Plasmodium falciparum
AKASFS

SEQ ID NO: 3210892 - protein, 6 aa, Plasmodium falciparum
AKASNT

SEQ ID NO: 3210893 - protein, 19 aa, Plasmodium falciparum
AKCNTSNGSVDKKECTEAC

SEQ ID NO: 3210894 - protein, 11 aa, Plasmodium falciparum
AKCSNRDDTNV

SEQ ID NO: 3210895 - protein, 6 aa, Plasmodium falciparum
AKDDTL

SEQ ID NO: 3210896 - protein, 9 aa, Plasmodium falciparum
AKDNCDTQQ

SEQ ID NO: 3210897 - protein, 21 aa, Plasmodium falciparum
AKDTASFKATEVSSATSSKII

SEQ ID NO: 3210898 - protein, 9 aa, Plasmodium falciparum
AKDTSQSVA

SEQ ID NO: 3210899 - protein, 6 aa, Plasmodium falciparum
AKDTYK

SEQ ID NO: 3210900 - protein, 10 aa, Plasmodium falciparum
AKEAAKDGAM

SEQ ID NO: 3210901 - protein, 89 aa, Plasmodium falciparum
AKEAERKNKEQKNYEDKNKEDKNDEEKNDEEENYEQKNYEQKNYEQKNYEQKNYEQKNYEQKNYEQKNYEQKNYEQKNYEQKNYEQKKK

SEQ ID NO: 3210902 - protein, 13 aa, Plasmodium falciparum
AKEAGAAKGAAVG

SEQ ID NO: 3210903 - protein, 10 aa, Plasmodium falciparum
AKEAGAAKGL

SEQ ID NO: 3210904 - protein, 9 aa, Plasmodium falciparum
AKEAVKDGA

SEQ ID NO: 3210905 - protein, 14 aa, Plasmodium falciparum
AKEDDNKKCDEKNY

SEQ ID NO: 3210906 - protein, 9 aa, Plasmodium falciparum
AKEECQNDS

SEQ ID NO: 3210907 - protein, 7 aa, Plasmodium falciparum
AKEESTK

SEQ ID NO: 3210908 - protein, 10 aa, Plasmodium falciparum
AKEGGAAKGL

SEQ ID NO: 3210909 - protein, 7 aa, Plasmodium falciparum
AKEKDEN

SEQ ID NO: 3210910 - protein, 6 aa, Plasmodium falciparum
AKEKEY

SEQ ID NO: 3210911 - protein, 8 aa, Plasmodium falciparum
AKEKKLPI

SEQ ID NO: 3210912 - protein, 6 aa, Plasmodium falciparum
AKEKLD

SEQ ID NO: 3210913 - protein, 9 aa, Plasmodium falciparum
AKEKPEMKE

SEQ ID NO: 3210914 - protein, 7 aa, Plasmodium falciparum
AKELNKN

SEQ ID NO: 3210915 - protein, 4 aa, Plasmodium falciparum
AKEQ

SEQ ID NO: 3210916 - protein, 5 aa, Plasmodium falciparum
AKEQT

SEQ ID NO: 3210917 - protein, 10 aa, Plasmodium falciparum
AKEQTVEQPL

SEQ ID NO: 3210918 - protein, 5 aa, Plasmodium falciparum
AKERN

SEQ ID NO: 3210919 - protein, 15 aa, Plasmodium falciparum
AKERNSNTNNDASDR

SEQ ID NO: 3210920 - protein, 6 aa, Plasmodium falciparum
AKESLR

SEQ ID NO: 3210921 - protein, 4 aa, Plasmodium falciparum
AKET

SEQ ID NO: 3210922 - protein, 10 aa, Plasmodium falciparum
AKEYDKKPYH

SEQ ID NO: 3210923 - protein, 8 aa, Plasmodium falciparum
AKEYTPDE

SEQ ID NO: 3210924 - protein, 8 aa, Plasmodium falciparum
AKGDERKN

SEQ ID NO: 3210925 - protein, 6 aa, Plasmodium falciparum
AKGGNN

SEQ ID NO: 3210926 - protein, 8 aa, Plasmodium falciparum
AKGLYGNE

SEQ ID NO: 3210927 - protein, 14 aa, Plasmodium falciparum
AKGNTMSCRNTSKS

SEQ ID NO: 3210928 - protein, 35 aa, Plasmodium falciparum
AKGSSRRSSSKKKGSLKINNKEDDEKSALDENQED

SEQ ID NO: 3210929 - protein, 20 aa, Plasmodium falciparum
AKGSVNGATTSSTTDEKDKD

SEQ ID NO: 3210930 - protein, 6 aa, Plasmodium falciparum
AKGSYY

SEQ ID NO: 3210931 - protein, 4 aa, Plasmodium falciparum
AKHK

SEQ ID NO: 3210932 - protein, 9 aa, Plasmodium falciparum
AKHTNSDPI

SEQ ID NO: 3210933 - protein, 8 aa, Plasmodium falciparum
AKINGDIQ

SEQ ID NO: 3210934 - protein, 18 aa, Plasmodium falciparum
AKINNPSSHIKENNKKKN

SEQ ID NO: 3210935 - protein, 7 aa, Plasmodium falciparum
AKINSEK

SEQ ID NO: 3210936 - protein, 13 aa, Plasmodium falciparum
AKKDAKKNDNDIN

SEQ ID NO: 3210937 - protein, 8 aa, Plasmodium falciparum
AKKEEIKE

SEQ ID NO: 3210938 - protein, 5 aa, Plasmodium falciparum
AKKEG

SEQ ID NO: 3210939 - protein, 13 aa, Plasmodium falciparum
AKKEKERKEKRKK

SEQ ID NO: 3210940 - protein, 9 aa, Plasmodium falciparum
AKKEQKIEN

SEQ ID NO: 3210941 - protein, 8 aa, Plasmodium falciparum
AKKGTEKN

SEQ ID NO: 3210942 - protein, 16 aa, Plasmodium falciparum
AKKKRIGNKSLEERNI

SEQ ID NO: 3210943 - protein, 8 aa, Plasmodium falciparum
AKKKTSKE

SEQ ID NO: 3210944 - protein, 5 aa, Plasmodium falciparum
AKKNF

SEQ ID NO: 3210945 - protein, 5 aa, Plasmodium falciparum
AKKNL

SEQ ID NO: 3210946 - protein, 7 aa, Plasmodium falciparum
AKKNNKP

SEQ ID NO: 3210947 - protein, 15 aa, Plasmodium falciparum
AKKNPHHNNNRNNDT

SEQ ID NO: 3210948 - protein, 8 aa, Plasmodium falciparum
AKKRKEWN

SEQ ID NO: 3210949 - protein, 58 aa, Plasmodium falciparum
AKKTKERNKEKDDKVEKAQRVKRTESTYRRNKTGYYNEDDSSGDNNSNDDNSDDEEWD

SEQ ID NO: 3210950 - protein, 8 aa, Plasmodium falciparum
AKKYKNNK

SEQ ID NO: 3210951 - protein, 10 aa, Plasmodium falciparum
AKLASETTAL

SEQ ID NO: 3210952 - protein, 16 aa, Plasmodium falciparum
AKLGEEMDNTNNEKQK

SEQ ID NO: 3210953 - protein, 8 aa, Plasmodium falciparum
AKLTNSDS

SEQ ID NO: 3210954 - protein, 4 aa, Plasmodium falciparum
AKNA

SEQ ID NO: 3210955 - protein, 6 aa, Plasmodium falciparum
AKNCSN

SEQ ID NO: 3210956 - protein, 7 aa, Plasmodium falciparum
AKNDAEY

SEQ ID NO: 3210957 - protein, 7 aa, Plasmodium falciparum
AKNDNLN

SEQ ID NO: 3210958 - protein, 12 aa, Plasmodium falciparum
AKNEESSRIPSG

SEQ ID NO: 3210959 - protein, 13 aa, Plasmodium falciparum
AKNESAVNSSTFN

SEQ ID NO: 3210960 - protein, 6 aa, Plasmodium falciparum
AKNGQK

SEQ ID NO: 3210961 - protein, 6 aa, Plasmodium falciparum
AKNKLK

SEQ ID NO: 3210962 - protein, 11 aa, Plasmodium falciparum
AKNKRKKSDHI

SEQ ID NO: 3210963 - protein, 4 aa, Plasmodium falciparum
AKNN

SEQ ID NO: 3210964 - protein, 11 aa, Plasmodium falciparum
AKNNKNDSAFS

SEQ ID NO: 3210965 - protein, 11 aa, Plasmodium falciparum
AKNNNSDHVNY

SEQ ID NO: 3210966 - protein, 6 aa, Plasmodium falciparum
AKNNNV

SEQ ID NO: 3210967 - protein, 7 aa, Plasmodium falciparum
AKNNQLE

SEQ ID NO: 3210968 - protein, 11 aa, Plasmodium falciparum
AKNRNPHYHND

SEQ ID NO: 3210969 - protein, 5 aa, Plasmodium falciparum
AKNSA

SEQ ID NO: 3210970 - protein, 10 aa, Plasmodium falciparum
AKNSNSKINK

SEQ ID NO: 3210971 - protein, 4 aa, Plasmodium falciparum
AKNT

SEQ ID NO: 3210972 - protein, 20 aa, Plasmodium falciparum
AKNTADKVTKAAIKTSTEAI

SEQ ID NO: 3210973 - protein, 10 aa, Plasmodium falciparum
AKNTNSDPIH

SEQ ID NO: 3210974 - protein, 7 aa, Plasmodium falciparum
AKNVENN

SEQ ID NO: 3210975 - protein, 25 aa, Plasmodium falciparum
AKNVQNNKNVENAKNVQNNKNDKDF

SEQ ID NO: 3210976 - protein, 17 aa, Plasmodium falciparum
AKPAKKLTPAERKKRNQ

SEQ ID NO: 3210977 - protein, 5 aa, Plasmodium falciparum
AKPEE

SEQ ID NO: 3210978 - protein, 6 aa, Plasmodium falciparum
AKPLNS

SEQ ID NO: 3210979 - protein, 8 aa, Plasmodium falciparum
AKPNGSYT

SEQ ID NO: 3210980 - protein, 7 aa, Plasmodium falciparum
AKPQERE

SEQ ID NO: 3210981 - protein, 5 aa, Plasmodium falciparum
AKPSK

SEQ ID NO: 3210982 - protein, 7 aa, Plasmodium falciparum
AKPVTKN

SEQ ID NO: 3210983 - protein, 15 aa, Plasmodium falciparum
AKQAGAAAGKIAGEA

SEQ ID NO: 3210984 - protein, 30 aa, Plasmodium falciparum
AKQECRGKEEGDKYCDGDGYDCTDKDKLRN

SEQ ID NO: 3210985 - protein, 18 aa, Plasmodium falciparum
AKQIDNEKGGEKKKVDTY

SEQ ID NO: 3210986 - protein, 12 aa, Plasmodium falciparum
AKQVAQQEAERS

SEQ ID NO: 3210987 - protein, 13 aa, Plasmodium falciparum
AKRKKEKSAAKEM

SEQ ID NO: 3210988 - protein, 41 aa, Plasmodium falciparum
AKRNGEKNDEMYEDPQRGVKKKKKNKLDGNNNNNNNNNNCD

SEQ ID NO: 3210989 - protein, 7 aa, Plasmodium falciparum
AKRNIDD

SEQ ID NO: 3210990 - protein, 11 aa, Plasmodium falciparum
AKSAAKGATAF

SEQ ID NO: 3210991 - protein, 20 aa, Plasmodium falciparum
AKSDDSKIDQSLKADPSEVQ

SEQ ID NO: 3210992 - protein, 17 aa, Plasmodium falciparum
AKSDEKKVKKMNNNMKD

SEQ ID NO: 3210993 - protein, 6 aa, Plasmodium falciparum
AKSDSY

SEQ ID NO: 3210994 - protein, 6 aa, Plasmodium falciparum
AKSDYK

SEQ ID NO: 3210995 - protein, 9 aa, Plasmodium falciparum
AKSKEPKDE

SEQ ID NO: 3210996 - protein, 10 aa, Plasmodium falciparum
AKSKLSDEEF

SEQ ID NO: 3210997 - protein, 16 aa, Plasmodium falciparum
AKSNAVSETANVTTRQ

SEQ ID NO: 3210998 - protein, 14 aa, Plasmodium falciparum
AKSPSLTESHNSAR

SEQ ID NO: 3210999 - protein, 7 aa, Plasmodium falciparum
AKSRNSL

SEQ ID NO: 3211000 - protein, 10 aa, Plasmodium falciparum
AKSSAIAEGN

SEQ ID NO: 3211001 - protein, 9 aa, Plasmodium falciparum
AKSTSSRLN

SEQ ID NO: 3211002 - protein, 5 aa, Plasmodium falciparum
AKSVS

SEQ ID NO: 3211003 - protein, 10 aa, Plasmodium falciparum
AKSYTGDGAI

SEQ ID NO: 3211004 - protein, 10 aa, Plasmodium falciparum
AKTAAKGALA

SEQ ID NO: 3211005 - protein, 8 aa, Plasmodium falciparum
AKTATAAA

SEQ ID NO: 3211006 - protein, 8 aa, Plasmodium falciparum
AKTCKVPS

SEQ ID NO: 3211007 - protein, 6 aa, Plasmodium falciparum
AKTDAA

SEQ ID NO: 3211008 - protein, 6 aa, Plasmodium falciparum
AKTHIT

SEQ ID NO: 3211009 - protein, 11 aa, Plasmodium falciparum
AKTKEKKKKHD

SEQ ID NO: 3211010 - protein, 8 aa, Plasmodium falciparum
AKTNESKN

SEQ ID NO: 3211011 - protein, 8 aa, Plasmodium falciparum
AKTPEERI

SEQ ID NO: 3211012 - protein, 5 aa, Plasmodium falciparum
AKTPK

SEQ ID NO: 3211013 - protein, 17 aa, Plasmodium falciparum
AKTTAEATKAQVASAEK

SEQ ID NO: 3211014 - protein, 4 aa, Plasmodium falciparum
AKTY

SEQ ID NO: 3211015 - protein, 8 aa, Plasmodium falciparum
AKVPEKRP

SEQ ID NO: 3211016 - protein, 4 aa, Plasmodium falciparum
AKYD

SEQ ID NO: 3211017 - protein, 9 aa, Plasmodium falciparum
AKYKEDTKY

SEQ ID NO: 3211018 - protein, 6 aa, Plasmodium falciparum
AKYKTK

SEQ ID NO: 3211019 - protein, 75 aa, Plasmodium falciparum
AKYNNLDQASKKKKKENEKEKERKRKEKEQEKEKEKQRKQKEQEKERKRKEKEQEKERKNKENKKKETKNKIKTW

SEQ ID NO: 3211020 - protein, 5 aa, Plasmodium falciparum
AKYSA

SEQ ID NO: 3211021 - protein, 4 aa, Plasmodium falciparum
AKYY

SEQ ID NO: 3211022 - protein, 5 aa, Plasmodium falciparum
ALATT

SEQ ID NO: 3211023 - protein, 5 aa, Plasmodium falciparum
ALDNP

SEQ ID NO: 3211024 - protein, 4 aa, Plasmodium falciparum
ALGG

SEQ ID NO: 3211025 - protein, 5 aa, Plasmodium falciparum
ALGGN

SEQ ID NO: 3211026 - protein, 5 aa, Plasmodium falciparum
ALKGK

SEQ ID NO: 3211027 - protein, 18 aa, Plasmodium falciparum
ALKGKDNKAMDEEEFWAL

SEQ ID NO: 3211028 - protein, 7 aa, Plasmodium falciparum
ALKKAYK

SEQ ID NO: 3211029 - protein, 10 aa, Plasmodium falciparum
ALKKKDEEIK

SEQ ID NO: 3211030 - protein, 68 aa, Plasmodium falciparum
ALKKQEQERQEQQQKEEALKRQEQERLQKEEELKRQEQERLEREKQEQLQKEEELRKKEQEKQQQRNI

SEQ ID NO: 3211031 - protein, 9 aa, Plasmodium falciparum
ALKRSGSEL

SEQ ID NO: 3211032 - protein, 6 aa, Plasmodium falciparum
ALPAEK

SEQ ID NO: 3211033 - protein, 7 aa, Plasmodium falciparum
ALPEPGQ

SEQ ID NO: 3211034 - protein, 7 aa, Plasmodium falciparum
ALPKETA

SEQ ID NO: 3211035 - protein, 9 aa, Plasmodium falciparum
ALPKTEDTN

SEQ ID NO: 3211036 - protein, 123 aa, Plasmodium falciparum
ALPPQEPPSTPESRGRSLNPPPDSPQPPRGPEEQEESASYSEEEEEEEEEEEENDEENDGDEEEVKTEDGGSDDEDEDEEDDEEEEENEVDVDEPQQEEVEEPPAKESAPTTQEPAVPEVKKQ

SEQ ID NO: 3211037 - protein, 8 aa, Plasmodium falciparum
ALPQKSTD

SEQ ID NO: 3211038 - protein, 4 aa, Plasmodium falciparum
ALRN

SEQ ID NO: 3211039 - protein, 8 aa, Plasmodium falciparum
ALSTSTQS

SEQ ID NO: 3211040 - protein, 8 aa, Plasmodium falciparum
ALTENNKK

SEQ ID NO: 3211041 - protein, 8 aa, Plasmodium falciparum
ALTESGNP

SEQ ID NO: 3211042 - protein, 7 aa, Plasmodium falciparum
ALTGDDL

SEQ ID NO: 3211043 - protein, 8 aa, Plasmodium falciparum
ALTGDTTA

SEQ ID NO: 3211044 - protein, 9 aa, Plasmodium falciparum
ALTNNDNLT

SEQ ID NO: 3211045 - protein, 12 aa, Plasmodium falciparum
ALTPAEKKKRNQ

SEQ ID NO: 3211046 - protein, 4 aa, Plasmodium falciparum
ALTS

SEQ ID NO: 3211047 - protein, 7 aa, Plasmodium falciparum
ALYESEK

SEQ ID NO: 3211048 - protein, 6 aa, Plasmodium falciparum
AMDDNS

SEQ ID NO: 3211049 - protein, 5 aa, Plasmodium falciparum
AMDNN

SEQ ID NO: 3211050 - protein, 4 aa, Plasmodium falciparum
AMDV

SEQ ID NO: 3211051 - protein, 27 aa, Plasmodium falciparum
AMNKEDSKLDDEEDAYKGQEKNKNGEM

SEQ ID NO: 3211052 - protein, 18 aa, Plasmodium falciparum
ANAASQAAETAANETTSG

SEQ ID NO: 3211053 - protein, 16 aa, Plasmodium falciparum
ANAGDNKLSKNAKENN

SEQ ID NO: 3211054 - protein, 21 aa, Plasmodium falciparum
ANAGSNITSNNNNNNHTNENQ

SEQ ID NO: 3211055 - protein, 6 aa, Plasmodium falciparum
ANAKNK

SEQ ID NO: 3211056 - protein, 4 aa, Plasmodium falciparum
ANAN

SEQ ID NO: 3211057 - protein, 9 aa, Plasmodium falciparum
ANANNDGKK

SEQ ID NO: 3211058 - protein, 7 aa, Plasmodium falciparum
ANANNDV

SEQ ID NO: 3211059 - protein, 18 aa, Plasmodium falciparum
ANATENEGIKKRNDIDIE

SEQ ID NO: 3211060 - protein, 11 aa, Plasmodium falciparum
ANCDNNNDNNI

SEQ ID NO: 3211061 - protein, 8 aa, Plasmodium falciparum
ANDDKRAL

SEQ ID NO: 3211062 - protein, 8 aa, Plasmodium falciparum
ANDDNSSF

SEQ ID NO: 3211063 - protein, 7 aa, Plasmodium falciparum
ANDEYTI

SEQ ID NO: 3211064 - protein, 4 aa, Plasmodium falciparum
ANDK

SEQ ID NO: 3211065 - protein, 8 aa, Plasmodium falciparum
ANDKENVG

SEQ ID NO: 3211066 - protein, 12 aa, Plasmodium falciparum
ANDKPNEEKGTF

SEQ ID NO: 3211067 - protein, 7 aa, Plasmodium falciparum
ANDNNSY

SEQ ID NO: 3211068 - protein, 15 aa, Plasmodium falciparum
ANDQEENKLEPYDKG

SEQ ID NO: 3211069 - protein, 15 aa, Plasmodium falciparum
ANDTESNVHNKPEEV

SEQ ID NO: 3211070 - protein, 54 aa, Plasmodium falciparum
ANEDDNNKTEIKKKNNKIKKNKIKNNNNNNNNNNNNNNNSSSSSSCCSNRNNDI

SEQ ID NO: 3211071 - protein, 4 aa, Plasmodium falciparum
ANEE

SEQ ID NO: 3211072 - protein, 5 aa, Plasmodium falciparum
ANEEN

SEQ ID NO: 3211073 - protein, 6 aa, Plasmodium falciparum
ANENDL

SEQ ID NO: 3211074 - protein, 8 aa, Plasmodium falciparum
ANEPDGCP

SEQ ID NO: 3211075 - protein, 6 aa, Plasmodium falciparum
ANEQTY

SEQ ID NO: 3211076 - protein, 6 aa, Plasmodium falciparum
ANESED

SEQ ID NO: 3211077 - protein, 4 aa, Plasmodium falciparum
ANET

SEQ ID NO: 3211078 - protein, 7 aa, Plasmodium falciparum
ANEYYKN

SEQ ID NO: 3211079 - protein, 30 aa, Plasmodium falciparum
ANGDTTNGTGGNGTGGSVAGGTGTSGSNEL

SEQ ID NO: 3211080 - protein, 9 aa, Plasmodium falciparum
ANGGNSTEI

SEQ ID NO: 3211081 - protein, 7 aa, Plasmodium falciparum
ANGVANA

SEQ ID NO: 3211082 - protein, 65 aa, Plasmodium falciparum
ANHNANHNANNNANNNANHNANHNANHNANHNANHNANHNTNHNTNHSSNHSSNQNKSVKGLNNI

SEQ ID NO: 3211083 - protein, 6 aa, Plasmodium falciparum
ANIENA

SEQ ID NO: 3211084 - protein, 11 aa, Plasmodium falciparum
ANIKENKKDLT

SEQ ID NO: 3211085 - protein, 6 aa, Plasmodium falciparum
ANISSE

SEQ ID NO: 3211086 - protein, 6 aa, Plasmodium falciparum
ANKENA

SEQ ID NO: 3211087 - protein, 12 aa, Plasmodium falciparum
ANKGSKEANGRS

SEQ ID NO: 3211088 - protein, 4 aa, Plasmodium falciparum
ANKI

SEQ ID NO: 3211089 - protein, 10 aa, Plasmodium falciparum
ANKKEINKNS

SEQ ID NO: 3211090 - protein, 10 aa, Plasmodium falciparum
ANKKLKKKEY

SEQ ID NO: 3211091 - protein, 10 aa, Plasmodium falciparum
ANKKNHVKST

SEQ ID NO: 3211092 - protein, 11 aa, Plasmodium falciparum
ANKKNKERKRY

SEQ ID NO: 3211093 - protein, 9 aa, Plasmodium falciparum
ANKNAKMNN

SEQ ID NO: 3211094 - protein, 5 aa, Plasmodium falciparum
ANKNE

SEQ ID NO: 3211095 - protein, 19 aa, Plasmodium falciparum
ANKNEDKEIENKNAEGKKI

SEQ ID NO: 3211096 - protein, 20 aa, Plasmodium falciparum
ANKRESLKKKKKKKKKNCIQ

SEQ ID NO: 3211097 - protein, 12 aa, Plasmodium falciparum
ANKRSKSNNELE

SEQ ID NO: 3211098 - protein, 9 aa, Plasmodium falciparum
ANKSRNQTN

SEQ ID NO: 3211099 - protein, 6 aa, Plasmodium falciparum
ANKSYS

SEQ ID NO: 3211100 - protein, 18 aa, Plasmodium falciparum
ANLGNGPNYMNTSGNNFN

SEQ ID NO: 3211101 - protein, 4 aa, Plasmodium falciparum
ANMK

SEQ ID NO: 3211102 - protein, 28 aa, Plasmodium falciparum
ANNDNVNYDNRSNDNVSRPFRSRKGTGY

SEQ ID NO: 3211103 - protein, 9 aa, Plasmodium falciparum
ANNEENKEI

SEQ ID NO: 3211104 - protein, 4 aa, Plasmodium falciparum
ANNG

SEQ ID NO: 3211105 - protein, 8 aa, Plasmodium falciparum
ANNGIPTT

SEQ ID NO: 3211106 - protein, 5 aa, Plasmodium falciparum
ANNIA

SEQ ID NO: 3211107 - protein, 21 aa, Plasmodium falciparum
ANNKDGTKYQEETKKYIPSSY

SEQ ID NO: 3211108 - protein, 13 aa, Plasmodium falciparum
ANNKGSTRGKRQT

SEQ ID NO: 3211109 - protein, 6 aa, Plasmodium falciparum
ANNKNY

SEQ ID NO: 3211110 - protein, 6 aa, Plasmodium falciparum
ANNKSN

SEQ ID NO: 3211111 - protein, 5 aa, Plasmodium falciparum
ANNKV

SEQ ID NO: 3211112 - protein, 6 aa, Plasmodium falciparum
ANNLTH

SEQ ID NO: 3211113 - protein, 9 aa, Plasmodium falciparum
ANNNNTQSN

SEQ ID NO: 3211114 - protein, 6 aa, Plasmodium falciparum
ANNNTY

SEQ ID NO: 3211115 - protein, 25 aa, Plasmodium falciparum
ANNNYDIQNDDYNNNNHIDQKQNGN

SEQ ID NO: 3211116 - protein, 12 aa, Plasmodium falciparum
ANNPMNNNNNNN

SEQ ID NO: 3211117 - protein, 7 aa, Plasmodium falciparum
ANNPTHN

SEQ ID NO: 3211118 - protein, 8 aa, Plasmodium falciparum
ANNQTKQA

SEQ ID NO: 3211119 - protein, 10 aa, Plasmodium falciparum
ANNTTNKQKH

SEQ ID NO: 3211120 - protein, 10 aa, Plasmodium falciparum
ANNTTNTYEK

SEQ ID NO: 3211121 - protein, 4 aa, Plasmodium falciparum
ANPE

SEQ ID NO: 3211122 - protein, 16 aa, Plasmodium falciparum
ANPEDGNKEFVIYCAT

SEQ ID NO: 3211123 - protein, 6 aa, Plasmodium falciparum
ANPGEV

SEQ ID NO: 3211124 - protein, 6 aa, Plasmodium falciparum
ANPKNL

SEQ ID NO: 3211125 - protein, 4 aa, Plasmodium falciparum
ANPN

SEQ ID NO: 3211126 - protein, 45 aa, Plasmodium falciparum
ANPNEESKTSRKYGWSSKNKKKHKNKNTSHGNDKSNNNDKNNNDI

SEQ ID NO: 3211127 - protein, 7 aa, Plasmodium falciparum
ANPNIKN

SEQ ID NO: 3211128 - protein, 7 aa, Plasmodium falciparum
ANPSTNI

SEQ ID NO: 3211129 - protein, 20 aa, Plasmodium falciparum
ANQAKDAAEAAGEAATGTFS

SEQ ID NO: 3211130 - protein, 10 aa, Plasmodium falciparum
ANQEESKNNK

SEQ ID NO: 3211131 - protein, 11 aa, Plasmodium falciparum
ANQIKKEEKLN

SEQ ID NO: 3211132 - protein, 20 aa, Plasmodium falciparum
ANQKDDKYKLRRQQKDERRK

SEQ ID NO: 3211133 - protein, 5 aa, Plasmodium falciparum
ANQKQ

SEQ ID NO: 3211134 - protein, 47 aa, Plasmodium falciparum
ANQNDDNKKKHVEQEENSSLNNSNNNNNNNNNNINSSSSSSRTRKQH

SEQ ID NO: 3211135 - protein, 14 aa, Plasmodium falciparum
ANQNSTNINTPNIN

SEQ ID NO: 3211136 - protein, 7 aa, Plasmodium falciparum
ANQTFTS

SEQ ID NO: 3211137 - protein, 5 aa, Plasmodium falciparum
ANQYY

SEQ ID NO: 3211138 - protein, 5 aa, Plasmodium falciparum
ANRKS

SEQ ID NO: 3211139 - protein, 7 aa, Plasmodium falciparum
ANRNIDR

SEQ ID NO: 3211140 - protein, 6 aa, Plasmodium falciparum
ANSCSN

SEQ ID NO: 3211141 - protein, 4 aa, Plasmodium falciparum
ANSD

SEQ ID NO: 3211142 - protein, 7 aa, Plasmodium falciparum
ANSEQNY

SEQ ID NO: 3211143 - protein, 6 aa, Plasmodium falciparum
ANSESD

SEQ ID NO: 3211144 - protein, 7 aa, Plasmodium falciparum
ANSGKSS

SEQ ID NO: 3211145 - protein, 10 aa, Plasmodium falciparum
ANSNRYPCGN

SEQ ID NO: 3211146 - protein, 5 aa, Plasmodium falciparum
ANSPI

SEQ ID NO: 3211147 - protein, 5 aa, Plasmodium falciparum
ANSPM

SEQ ID NO: 3211148 - protein, 11 aa, Plasmodium falciparum
ANSQNKNGHKD

SEQ ID NO: 3211149 - protein, 8 aa, Plasmodium falciparum
ANSRGSKN

SEQ ID NO: 3211150 - protein, 6 aa, Plasmodium falciparum
ANTEFD

SEQ ID NO: 3211151 - protein, 118 aa, Plasmodium falciparum
ANTEKNDNEKKDKLLGEGDKEDVKEKNDEQKDKVLGEGDKEDVKEKNDEQKDKVLGEGDKEDVKEKNDGKKDKVIGSEKTQKEIKEKVEKRVKKKCKKKVKKGIKENDTEGNDKVKGP

SEQ ID NO: 3211152 - protein, 4 aa, Plasmodium falciparum
ANTK

SEQ ID NO: 3211153 - protein, 15 aa, Plasmodium falciparum
ANTKVEDALISFMDG

SEQ ID NO: 3211154 - protein, 13 aa, Plasmodium falciparum
ANTNIKKTDNYSE

SEQ ID NO: 3211155 - protein, 43 aa, Plasmodium falciparum
ANTNNVNKNGSNKKNNANNNNMNKSGDKKKATKGKKGNANDNV

SEQ ID NO: 3211156 - protein, 6 aa, Plasmodium falciparum
ANTNQK

SEQ ID NO: 3211157 - protein, 15 aa, Plasmodium falciparum
ANTQTKSEKKGTIKN

SEQ ID NO: 3211158 - protein, 8 aa, Plasmodium falciparum
ANTSNYKD

SEQ ID NO: 3211159 - protein, 21 aa, Plasmodium falciparum
ANTVNDNNGINNNDDINNNDD

SEQ ID NO: 3211160 - protein, 6 aa, Plasmodium falciparum
ANVNAN

SEQ ID NO: 3211161 - protein, 6 aa, Plasmodium falciparum
ANVNKE

SEQ ID NO: 3211162 - protein, 14 aa, Plasmodium falciparum
ANVSKRNNNTGSDI

SEQ ID NO: 3211163 - protein, 9 aa, Plasmodium falciparum
ANYDNDPEM

SEQ ID NO: 3211164 - protein, 9 aa, Plasmodium falciparum
ANYDNDQEM

SEQ ID NO: 3211165 - protein, 7 aa, Plasmodium falciparum
ANYEESK

SEQ ID NO: 3211166 - protein, 5 aa, Plasmodium falciparum
ANYSS

SEQ ID NO: 3211167 - protein, 4 aa, Plasmodium falciparum
ANYT

SEQ ID NO: 3211168 - protein, 4 aa, Plasmodium falciparum
ANYY

SEQ ID NO: 3211169 - protein, 9 aa, Plasmodium falciparum
APAENNDDI

SEQ ID NO: 3211170 - protein, 17 aa, Plasmodium falciparum
APAGPAGTGKTETTKDL

SEQ ID NO: 3211171 - protein, 17 aa, Plasmodium falciparum
APDPYRDKNKKKNTIEN

SEQ ID NO: 3211172 - protein, 4 aa, Plasmodium falciparum
APDR

SEQ ID NO: 3211173 - protein, 5 aa, Plasmodium falciparum
APDTD

SEQ ID NO: 3211174 - protein, 9 aa, Plasmodium falciparum
APEGRGPQF

SEQ ID NO: 3211175 - protein, 4 aa, Plasmodium falciparum
APEN

SEQ ID NO: 3211176 - protein, 6 aa, Plasmodium falciparum
APERST

SEQ ID NO: 3211177 - protein, 7 aa, Plasmodium falciparum
APFNSSN

SEQ ID NO: 3211178 - protein, 5 aa, Plasmodium falciparum
APGQG

SEQ ID NO: 3211179 - protein, 13 aa, Plasmodium falciparum
APGRKNIKTKDAQ

SEQ ID NO: 3211180 - protein, 8 aa, Plasmodium falciparum
APGSGKSE

SEQ ID NO: 3211181 - protein, 7 aa, Plasmodium falciparum
APGTGKT

SEQ ID NO: 3211182 - protein, 29 aa, Plasmodium falciparum
APKDNNINNNNNNNNNDDDDDDDDYNNLD

SEQ ID NO: 3211183 - protein, 8 aa, Plasmodium falciparum
APKEKDDH

SEQ ID NO: 3211184 - protein, 6 aa, Plasmodium falciparum
APKGFE

SEQ ID NO: 3211185 - protein, 5 aa, Plasmodium falciparum
APKKR

SEQ ID NO: 3211186 - protein, 9 aa, Plasmodium falciparum
APKKSGDRK

SEQ ID NO: 3211187 - protein, 11 aa, Plasmodium falciparum
APKLEEKNKNI

SEQ ID NO: 3211188 - protein, 62 aa, Plasmodium falciparum
APKNDLSANDPEKGGRKSKALPTNNLNDKKEENVLPTNNLNDKKEENVLPTNNLNDKKEENV

SEQ ID NO: 3211189 - protein, 7 aa, Plasmodium falciparum
APKREIS

SEQ ID NO: 3211190 - protein, 15 aa, Plasmodium falciparum
APKTRASDYKDAQDA

SEQ ID NO: 3211191 - protein, 5 aa, Plasmodium falciparum
APLPD

SEQ ID NO: 3211192 - protein, 23 aa, Plasmodium falciparum
APPDAQYTKKGPHNHITESNKGQ

SEQ ID NO: 3211193 - protein, 12 aa, Plasmodium falciparum
APQDSPGKGGSV

SEQ ID NO: 3211194 - protein, 8 aa, Plasmodium falciparum
APRQVRKN

SEQ ID NO: 3211195 - protein, 5 aa, Plasmodium falciparum
APSCK

SEQ ID NO: 3211196 - protein, 4 aa, Plasmodium falciparum
APSD

SEQ ID NO: 3211197 - protein, 11 aa, Plasmodium falciparum
APSEIKEENVN

SEQ ID NO: 3211198 - protein, 5 aa, Plasmodium falciparum
APSKI

SEQ ID NO: 3211199 - protein, 5 aa, Plasmodium falciparum
APSSG

SEQ ID NO: 3211200 - protein, 8 aa, Plasmodium falciparum
APSTSSIT

SEQ ID NO: 3211201 - protein, 58 aa, Plasmodium falciparum
APSVEESVEENVEESVAENVEESVAENVEESVAENVEESVAENVEESVAENVEESVAE

SEQ ID NO: 3211202 - protein, 71 aa, Plasmodium falciparum
APTEPEEKGACDPAPTTPKETSPATDSGKETNTEPVTPQDQSPDTKTPKEKGPKPPKSLPQPPRQKREFTP

SEQ ID NO: 3211203 - protein, 7 aa, Plasmodium falciparum
APTITTS

SEQ ID NO: 3211204 - protein, 8 aa, Plasmodium falciparum
APTPSDIQ

SEQ ID NO: 3211205 - protein, 20 aa, Plasmodium falciparum
APVQDDDDDDDYDDEYDNGF

SEQ ID NO: 3211206 - protein, 6 aa, Plasmodium falciparum
APVTSG

SEQ ID NO: 3211207 - protein, 4 aa, Plasmodium falciparum
APYE

SEQ ID NO: 3211208 - protein, 5 aa, Plasmodium falciparum
APYID

SEQ ID NO: 3211209 - protein, 6 aa, Plasmodium falciparum
APYTSY

SEQ ID NO: 3211210 - protein, 6 aa, Plasmodium falciparum
AQCEEG

SEQ ID NO: 3211211 - protein, 10 aa, Plasmodium falciparum
AQDDKNISKL

SEQ ID NO: 3211212 - protein, 6 aa, Plasmodium falciparum
AQDEND

SEQ ID NO: 3211213 - protein, 17 aa, Plasmodium falciparum
AQEAAAAKGAVAGAEAG

SEQ ID NO: 3211214 - protein, 6 aa, Plasmodium falciparum
AQEAVK

SEQ ID NO: 3211215 - protein, 6 aa, Plasmodium falciparum
AQEEYS

SEQ ID NO: 3211216 - protein, 13 aa, Plasmodium falciparum
AQGAVAGEAAGRN

SEQ ID NO: 3211217 - protein, 6 aa, Plasmodium falciparum
AQGGNY

SEQ ID NO: 3211218 - protein, 4 aa, Plasmodium falciparum
AQGN

SEQ ID NO: 3211219 - protein, 6 aa, Plasmodium falciparum
AQGNIK

SEQ ID NO: 3211220 - protein, 5 aa, Plasmodium falciparum
AQGNT

SEQ ID NO: 3211221 - protein, 10 aa, Plasmodium falciparum
AQGNYMNGQT

SEQ ID NO: 3211222 - protein, 11 aa, Plasmodium falciparum
AQGSSGQTQEY

SEQ ID NO: 3211223 - protein, 6 aa, Plasmodium falciparum
AQHSSI

SEQ ID NO: 3211224 - protein, 7 aa, Plasmodium falciparum
AQIENRI

SEQ ID NO: 3211225 - protein, 6 aa, Plasmodium falciparum
AQINNR

SEQ ID NO: 3211226 - protein, 51 aa, Plasmodium falciparum
AQKEMKQNKQNKQNEQNKQNEQNINHQPNTTYNVNSNDNNNNNNKKHINSL

SEQ ID NO: 3211227 - protein, 11 aa, Plasmodium falciparum
AQKKNNPDNKM

SEQ ID NO: 3211228 - protein, 6 aa, Plasmodium falciparum
AQKKSV

SEQ ID NO: 3211229 - protein, 18 aa, Plasmodium falciparum
AQKQLHGNGSRNALKGNI

SEQ ID NO: 3211230 - protein, 10 aa, Plasmodium falciparum
AQKQNATFNP

SEQ ID NO: 3211231 - protein, 8 aa, Plasmodium falciparum
AQKSGALA

SEQ ID NO: 3211232 - protein, 14 aa, Plasmodium falciparum
AQKTNEKQESEKKN

SEQ ID NO: 3211233 - protein, 9 aa, Plasmodium falciparum
AQLTGSEGG

SEQ ID NO: 3211234 - protein, 10 aa, Plasmodium falciparum
AQMDTTSDDF

SEQ ID NO: 3211235 - protein, 15 aa, Plasmodium falciparum
AQNENNEKENLNDNS

SEQ ID NO: 3211236 - protein, 11 aa, Plasmodium falciparum
AQNFSSDDDKR

SEQ ID NO: 3211237 - protein, 17 aa, Plasmodium falciparum
AQNKNKKYNILVFKTPA

SEQ ID NO: 3211238 - protein, 16 aa, Plasmodium falciparum
AQNPAQCQESSPVGDV

SEQ ID NO: 3211239 - protein, 5 aa, Plasmodium falciparum
AQNQS

SEQ ID NO: 3211240 - protein, 60 aa, Plasmodium falciparum
AQNYKNKNNFNKKDRPKEKNNKNNKKKKRNNKNHDNNNDDDNNNDDDNNNNDDNNNNNTN

SEQ ID NO: 3211241 - protein, 9 aa, Plasmodium falciparum
AQPDGPDEN

SEQ ID NO: 3211242 - protein, 10 aa, Plasmodium falciparum
AQPQNNNKSI

SEQ ID NO: 3211243 - protein, 5 aa, Plasmodium falciparum
AQQAG

SEQ ID NO: 3211244 - protein, 18 aa, Plasmodium falciparum
AQQTNNNYEEEKKINTNE

SEQ ID NO: 3211245 - protein, 11 aa, Plasmodium falciparum
AQRSYSKDKRD

SEQ ID NO: 3211246 - protein, 5 aa, Plasmodium falciparum
AQSAA

SEQ ID NO: 3211247 - protein, 6 aa, Plasmodium falciparum
AQSTRE

SEQ ID NO: 3211248 - protein, 4 aa, Plasmodium falciparum
AQSY

SEQ ID NO: 3211249 - protein, 9 aa, Plasmodium falciparum
AQTGTEAGI

SEQ ID NO: 3211250 - protein, 15 aa, Plasmodium falciparum
AQTKDEKVEENNNNN

SEQ ID NO: 3211251 - protein, 11 aa, Plasmodium falciparum
AQTNEPNNNQY

SEQ ID NO: 3211252 - protein, 68 aa, Plasmodium falciparum
AQTPAPTPAPAPAPAPAPAPAPAPAPAPAPSARPNHDQNPPGTGTRKITKRRQKSDKTKKTSNPTPSN

SEQ ID NO: 3211253 - protein, 22 aa, Plasmodium falciparum
AQTQRNFKSKNGKASTKKNEDY

SEQ ID NO: 3211254 - protein, 13 aa, Plasmodium falciparum
AQTTTTSADPEGQ

SEQ ID NO: 3211255 - protein, 11 aa, Plasmodium falciparum
AQYASSASSSQ

SEQ ID NO: 3211256 - protein, 5 aa, Plasmodium falciparum
AQYGI

SEQ ID NO: 3211257 - protein, 6 aa, Plasmodium falciparum
AQYKGK

SEQ ID NO: 3211258 - protein, 4 aa, Plasmodium falciparum
ARAA

SEQ ID NO: 3211259 - protein, 14 aa, Plasmodium falciparum
AREETNDKEKISTQ

SEQ ID NO: 3211260 - protein, 13 aa, Plasmodium falciparum
ARENGLIPKSEVL

SEQ ID NO: 3211261 - protein, 5 aa, Plasmodium falciparum
ARESD

SEQ ID NO: 3211262 - protein, 14 aa, Plasmodium falciparum
ARFKDQKNTTTNPC

SEQ ID NO: 3211263 - protein, 5 aa, Plasmodium falciparum
ARGDL

SEQ ID NO: 3211264 - protein, 15 aa, Plasmodium falciparum
ARGDPCKKDGTGNDV

SEQ ID NO: 3211265 - protein, 43 aa, Plasmodium falciparum
ARGERNPCGNGSASEKRFSEVSGGECDDKKIEGNGRNNGGACA

SEQ ID NO: 3211266 - protein, 10 aa, Plasmodium falciparum
ARGGSVNDST

SEQ ID NO: 3211267 - protein, 11 aa, Plasmodium falciparum
ARGKRHPCGNR

SEQ ID NO: 3211268 - protein, 7 aa, Plasmodium falciparum
ARGKRYP

SEQ ID NO: 3211269 - protein, 20 aa, Plasmodium falciparum
ARGTCDGTDEEKKKKCEKAC

SEQ ID NO: 3211270 - protein, 12 aa, Plasmodium falciparum
ARHGDYKTKEDF

SEQ ID NO: 3211271 - protein, 7 aa, Plasmodium falciparum
ARHNSND

SEQ ID NO: 3211272 - protein, 11 aa, Plasmodium falciparum
ARHSQSYAETQ

SEQ ID NO: 3211273 - protein, 5 aa, Plasmodium falciparum
ARIPA

SEQ ID NO: 3211274 - protein, 4 aa, Plasmodium falciparum
ARKE

SEQ ID NO: 3211275 - protein, 8 aa, Plasmodium falciparum
ARKGGRGC

SEQ ID NO: 3211276 - protein, 4 aa, Plasmodium falciparum
ARKK

SEQ ID NO: 3211277 - protein, 44 aa, Plasmodium falciparum
ARKKKKKKKKKRQKEQKEQKKQKEQKEQKKQKEQKKQKEQQTNN

SEQ ID NO: 3211278 - protein, 7 aa, Plasmodium falciparum
ARKKKNL

SEQ ID NO: 3211279 - protein, 11 aa, Plasmodium falciparum
ARKKSETDKEE

SEQ ID NO: 3211280 - protein, 22 aa, Plasmodium falciparum
ARKNKKKEQKRQHLKKNKGKLN

SEQ ID NO: 3211281 - protein, 11 aa, Plasmodium falciparum
ARKNKKKGQMN

SEQ ID NO: 3211282 - protein, 6 aa, Plasmodium falciparum
ARKRNG

SEQ ID NO: 3211283 - protein, 5 aa, Plasmodium falciparum
ARNNK

SEQ ID NO: 3211284 - protein, 14 aa, Plasmodium falciparum
ARNQRKEQKTHISS

SEQ ID NO: 3211285 - protein, 6 aa, Plasmodium falciparum
ARNSNA

SEQ ID NO: 3211286 - protein, 9 aa, Plasmodium falciparum
ARNSPKGDV

SEQ ID NO: 3211287 - protein, 9 aa, Plasmodium falciparum
ARPEKGRKK

SEQ ID NO: 3211288 - protein, 7 aa, Plasmodium falciparum
ARPGGGF

SEQ ID NO: 3211289 - protein, 7 aa, Plasmodium falciparum
ARQKSQY

SEQ ID NO: 3211290 - protein, 17 aa, Plasmodium falciparum
ARRGTPGEKTATSSDSG

SEQ ID NO: 3211291 - protein, 6 aa, Plasmodium falciparum
ARRKTA

SEQ ID NO: 3211292 - protein, 7 aa, Plasmodium falciparum
ARRRGNS

SEQ ID NO: 3211293 - protein, 17 aa, Plasmodium falciparum
ARSAEPRGSEPTSDKGS

SEQ ID NO: 3211294 - protein, 83 aa, Plasmodium falciparum
ARSATGPRDPSSPAAPTAGPVESAAVDDEDDDNEEEEEEEEEEDEKEEVGGSDVVEEKEEKEEEKEPEEQVEPQPAATTTQND

SEQ ID NO: 3211295 - protein, 4 aa, Plasmodium falciparum
ARSK

SEQ ID NO: 3211296 - protein, 5 aa, Plasmodium falciparum
ARSTG

SEQ ID NO: 3211297 - protein, 13 aa, Plasmodium falciparum
ARTIKNNNSSRCG

SEQ ID NO: 3211298 - protein, 5 aa, Plasmodium falciparum
ARTNS

SEQ ID NO: 3211299 - protein, 7 aa, Plasmodium falciparum
ARTPKKK

SEQ ID NO: 3211300 - protein, 7 aa, Plasmodium falciparum
ARTPTIT

SEQ ID NO: 3211301 - protein, 12 aa, Plasmodium falciparum
ASAAQAAGIEAG

SEQ ID NO: 3211302 - protein, 14 aa, Plasmodium falciparum
ASASKSYEKDGTKV

SEQ ID NO: 3211303 - protein, 4 aa, Plasmodium falciparum
ASCG

SEQ ID NO: 3211304 - protein, 10 aa, Plasmodium falciparum
ASDANGVANA

SEQ ID NO: 3211305 - protein, 48 aa, Plasmodium falciparum
ASDEATKAKSQTGGGSESPSDGKPASQNDGKPGASTLSAASTEPSQTS

SEQ ID NO: 3211306 - protein, 23 aa, Plasmodium falciparum
ASDEHKNIYSQEDKVNHKKGSKI

SEQ ID NO: 3211307 - protein, 10 aa, Plasmodium falciparum
ASDERNKAAV

SEQ ID NO: 3211308 - protein, 13 aa, Plasmodium falciparum
ASDETKDNNNNID

SEQ ID NO: 3211309 - protein, 10 aa, Plasmodium falciparum
ASDHNNEANQ

SEQ ID NO: 3211310 - protein, 16 aa, Plasmodium falciparum
ASDIQKTYKEKDSLKD

SEQ ID NO: 3211311 - protein, 10 aa, Plasmodium falciparum
ASDISKNSIG

SEQ ID NO: 3211312 - protein, 63 aa, Plasmodium falciparum
ASDKSSSRKNSSQDTFDTNSSINEKAQDGFNDEPSNLEKAEESTNNSYKVNNNNINNDDDDDD

SEQ ID NO: 3211313 - protein, 6 aa, Plasmodium falciparum
ASDNIE

SEQ ID NO: 3211314 - protein, 11 aa, Plasmodium falciparum
ASDQEMQNNAD

SEQ ID NO: 3211315 - protein, 9 aa, Plasmodium falciparum
ASDQPKQYE

SEQ ID NO: 3211316 - protein, 9 aa, Plasmodium falciparum
ASDREKEEI

SEQ ID NO: 3211317 - protein, 11 aa, Plasmodium falciparum
ASDTPQKNNIK

SEQ ID NO: 3211318 - protein, 7 aa, Plasmodium falciparum
ASEEGKI

SEQ ID NO: 3211319 - protein, 5 aa, Plasmodium falciparum
ASEEI

SEQ ID NO: 3211320 - protein, 8 aa, Plasmodium falciparum
ASEEQKYP

SEQ ID NO: 3211321 - protein, 4 aa, Plasmodium falciparum
ASEF

SEQ ID NO: 3211322 - protein, 6 aa, Plasmodium falciparum
ASEGNI

SEQ ID NO: 3211323 - protein, 92 aa, Plasmodium falciparum
ASEGSEKDSSDQTDSLKKYKKKKKDNNDDNDDNDNNDDNNDDNNDDNDDNDDNNDDNNDDNNDDNNNDHISNHSNNHSSNHSSDHHNGINQK

SEQ ID NO: 3211324 - protein, 4 aa, Plasmodium falciparum
ASEK

SEQ ID NO: 3211325 - protein, 8 aa, Plasmodium falciparum
ASEKGEEK

SEQ ID NO: 3211326 - protein, 5 aa, Plasmodium falciparum
ASEKT

SEQ ID NO: 3211327 - protein, 16 aa, Plasmodium falciparum
ASEYDGSDSGANTTEA

SEQ ID NO: 3211328 - protein, 12 aa, Plasmodium falciparum
ASGGDNQNNTTI

SEQ ID NO: 3211329 - protein, 49 aa, Plasmodium falciparum
ASGGTTQVETQASGGNTETSQVSGETTPQGQTPSESEAQTASQDPSEKL

SEQ ID NO: 3211330 - protein, 9 aa, Plasmodium falciparum
ASGGVQNAP

SEQ ID NO: 3211331 - protein, 10 aa, Plasmodium falciparum
ASGIGQSKTV

SEQ ID NO: 3211332 - protein, 21 aa, Plasmodium falciparum
ASGMVDKDSTENNMNTDEHNY

SEQ ID NO: 3211333 - protein, 23 aa, Plasmodium falciparum
ASGNTQEDGKAQPQGDTPSQPDP

SEQ ID NO: 3211334 - protein, 26 aa, Plasmodium falciparum
ASGNTVVSGQAQTPQGDTTSPSDNKL

SEQ ID NO: 3211335 - protein, 92 aa, Plasmodium falciparum
ASHQNNRDPNSSSSSSNNNNNNNNNLTTNRDTNNTNERTNENNNIHNNNNNENDNNNNISQTRVNNNDQRQVSDLNKDKNQIKDKGSKIEKT

SEQ ID NO: 3211336 - protein, 4 aa, Plasmodium falciparum
ASID

SEQ ID NO: 3211337 - protein, 7 aa, Plasmodium falciparum
ASIGSKN

SEQ ID NO: 3211338 - protein, 11 aa, Plasmodium falciparum
ASIKKKKDNVI

SEQ ID NO: 3211339 - protein, 11 aa, Plasmodium falciparum
ASKDSTNYKNY

SEQ ID NO: 3211340 - protein, 14 aa, Plasmodium falciparum
ASKKNNNNNNNNYN

SEQ ID NO: 3211341 - protein, 8 aa, Plasmodium falciparum
ASKKNSID

SEQ ID NO: 3211342 - protein, 6 aa, Plasmodium falciparum
ASKLNK

SEQ ID NO: 3211343 - protein, 7 aa, Plasmodium falciparum
ASKNNNP

SEQ ID NO: 3211344 - protein, 10 aa, Plasmodium falciparum
ASKSATLTKA

SEQ ID NO: 3211345 - protein, 8 aa, Plasmodium falciparum
ASKTAEDA

SEQ ID NO: 3211346 - protein, 7 aa, Plasmodium falciparum
ASKTAEF

SEQ ID NO: 3211347 - protein, 8 aa, Plasmodium falciparum
ASKTDIQQ

SEQ ID NO: 3211348 - protein, 10 aa, Plasmodium falciparum
ASLDRNGLRP

SEQ ID NO: 3211349 - protein, 8 aa, Plasmodium falciparum
ASLNTKEE

SEQ ID NO: 3211350 - protein, 9 aa, Plasmodium falciparum
ASLSGSATN

SEQ ID NO: 3211351 - protein, 79 aa, Plasmodium falciparum
ASMKNGDQYNRKNLMVPMKERLLARIYHLTFRLMQRKEDMKKGDIPMFRATYVVRTDTNDKHEYASEHDKYQGPCTGKD

SEQ ID NO: 3211352 - protein, 5 aa, Plasmodium falciparum
ASMSM

SEQ ID NO: 3211353 - protein, 11 aa, Plasmodium falciparum
ASNEDEKKKNI

SEQ ID NO: 3211354 - protein, 6 aa, Plasmodium falciparum
ASNEET

SEQ ID NO: 3211355 - protein, 7 aa, Plasmodium falciparum
ASNGYSS

SEQ ID NO: 3211356 - protein, 9 aa, Plasmodium falciparum
ASNKKKSII

SEQ ID NO: 3211357 - protein, 17 aa, Plasmodium falciparum
ASNKYMDDQNYNEDNKC

SEQ ID NO: 3211358 - protein, 12 aa, Plasmodium falciparum
ASNLRGDPGNVN

SEQ ID NO: 3211359 - protein, 4 aa, Plasmodium falciparum
ASNM

SEQ ID NO: 3211360 - protein, 4 aa, Plasmodium falciparum
ASNN

SEQ ID NO: 3211361 - protein, 10 aa, Plasmodium falciparum
ASNNENEGNK

SEQ ID NO: 3211362 - protein, 9 aa, Plasmodium falciparum
ASNNKNNDM

SEQ ID NO: 3211363 - protein, 15 aa, Plasmodium falciparum
ASNNSNNNNNNNNNN

SEQ ID NO: 3211364 - protein, 12 aa, Plasmodium falciparum
ASNNSSSSTKNL

SEQ ID NO: 3211365 - protein, 95 aa, Plasmodium falciparum
ASNSRGIYNGNAENIGNSESFRNAENIGNSESFRNAENVGNSESRGRAENIGNSESFRNAENIGNSESFRNAENVGNAENVGNGENAENGEDAED

SEQ ID NO: 3211366 - protein, 8 aa, Plasmodium falciparum
ASPATVSR

SEQ ID NO: 3211367 - protein, 5 aa, Plasmodium falciparum
ASPDV

SEQ ID NO: 3211368 - protein, 7 aa, Plasmodium falciparum
ASPDYYS

SEQ ID NO: 3211369 - protein, 15 aa, Plasmodium falciparum
ASPEGNEELSEKAQT

SEQ ID NO: 3211370 - protein, 5 aa, Plasmodium falciparum
ASQAY

SEQ ID NO: 3211371 - protein, 5 aa, Plasmodium falciparum
ASQEI

SEQ ID NO: 3211372 - protein, 12 aa, Plasmodium falciparum
ASQEKNKNKDES

SEQ ID NO: 3211373 - protein, 8 aa, Plasmodium falciparum
ASQESNEL

SEQ ID NO: 3211374 - protein, 11 aa, Plasmodium falciparum
ASQKKKKIINN

SEQ ID NO: 3211375 - protein, 6 aa, Plasmodium falciparum
ASQKSE

SEQ ID NO: 3211376 - protein, 19 aa, Plasmodium falciparum
ASQNKNTDKNYEIDDENDE

SEQ ID NO: 3211377 - protein, 9 aa, Plasmodium falciparum
ASQNNKKKK

SEQ ID NO: 3211378 - protein, 5 aa, Plasmodium falciparum
ASQPD

SEQ ID NO: 3211379 - protein, 10 aa, Plasmodium falciparum
ASQYGRENYN

SEQ ID NO: 3211380 - protein, 40 aa, Plasmodium falciparum
ASRGGDEATKSQSQAGGSEAQPQGGEKSPSGKVSSQSDKL

SEQ ID NO: 3211381 - protein, 8 aa, Plasmodium falciparum
ASRHGQKG

SEQ ID NO: 3211382 - protein, 46 aa, Plasmodium falciparum
ASRKSSKACKNNVDDLDSDVEEADVTEESAVETKKDEVKTEEPKKE

SEQ ID NO: 3211383 - protein, 26 aa, Plasmodium falciparum
ASRQPQTSACSQEQQQQGNTSSTQNH

SEQ ID NO: 3211384 - protein, 27 aa, Plasmodium falciparum
ASRQPQTSACSQEQQQQNKSSTENNYP

SEQ ID NO: 3211385 - protein, 5 aa, Plasmodium falciparum
ASRYK

SEQ ID NO: 3211386 - protein, 22 aa, Plasmodium falciparum
ASSDPNNLAGADHSQKLCFCPL

SEQ ID NO: 3211387 - protein, 5 aa, Plasmodium falciparum
ASSDS

SEQ ID NO: 3211388 - protein, 6 aa, Plasmodium falciparum
ASSEAK

SEQ ID NO: 3211389 - protein, 11 aa, Plasmodium falciparum
ASSERNANNEY

SEQ ID NO: 3211390 - protein, 9 aa, Plasmodium falciparum
ASSESTKTC

SEQ ID NO: 3211391 - protein, 7 aa, Plasmodium falciparum
ASSKSDG

SEQ ID NO: 3211392 - protein, 8 aa, Plasmodium falciparum
ASSNDKYS

SEQ ID NO: 3211393 - protein, 9 aa, Plasmodium falciparum
ASSNQQGNM

SEQ ID NO: 3211394 - protein, 4 aa, Plasmodium falciparum
ASSP

SEQ ID NO: 3211395 - protein, 6 aa, Plasmodium falciparum
ASSPSL

SEQ ID NO: 3211396 - protein, 11 aa, Plasmodium falciparum
ASSQNKKQLQN

SEQ ID NO: 3211397 - protein, 6 aa, Plasmodium falciparum
ASSTTD

SEQ ID NO: 3211398 - protein, 11 aa, Plasmodium falciparum
ASSVENEEKYE

SEQ ID NO: 3211399 - protein, 10 aa, Plasmodium falciparum
ASSYSNNDNS

SEQ ID NO: 3211400 - protein, 6 aa, Plasmodium falciparum
ASTDEN

SEQ ID NO: 3211401 - protein, 18 aa, Plasmodium falciparum
ASTENKNNQEQKKDVEEN

SEQ ID NO: 3211402 - protein, 13 aa, Plasmodium falciparum
ASTEPSVDDENKS

SEQ ID NO: 3211403 - protein, 4 aa, Plasmodium falciparum
ASTH

SEQ ID NO: 3211404 - protein, 5 aa, Plasmodium falciparum
ASTLS

SEQ ID NO: 3211405 - protein, 8 aa, Plasmodium falciparum
ASTNEGEI

SEQ ID NO: 3211406 - protein, 11 aa, Plasmodium falciparum
ASTNETAKRRN

SEQ ID NO: 3211407 - protein, 9 aa, Plasmodium falciparum
ASTNKANIR

SEQ ID NO: 3211408 - protein, 6 aa, Plasmodium falciparum
ASTNKQ

SEQ ID NO: 3211409 - protein, 7 aa, Plasmodium falciparum
ASTNNNI

SEQ ID NO: 3211410 - protein, 21 aa, Plasmodium falciparum
ASTNVPNNQDKKKKKKSTKNE

SEQ ID NO: 3211411 - protein, 5 aa, Plasmodium falciparum
ASTSG

SEQ ID NO: 3211412 - protein, 8 aa, Plasmodium falciparum
ASTTSQSN

SEQ ID NO: 3211413 - protein, 5 aa, Plasmodium falciparum
ASTYS

SEQ ID NO: 3211414 - protein, 39 aa, Plasmodium falciparum
ASVDSSSEMSNGGRGGLKTKEMKGEEVTGITSKNDINLE

SEQ ID NO: 3211415 - protein, 15 aa, Plasmodium falciparum
ASVEAGEAAGTKAGK

SEQ ID NO: 3211416 - protein, 7 aa, Plasmodium falciparum
ASVNDEK

SEQ ID NO: 3211417 - protein, 4 aa, Plasmodium falciparum
ASVT

SEQ ID NO: 3211418 - protein, 5 aa, Plasmodium falciparum
ASYNN

SEQ ID NO: 3211419 - protein, 7 aa, Plasmodium falciparum
ASYNNNF

SEQ ID NO: 3211420 - protein, 6 aa, Plasmodium falciparum
ASYSEA

SEQ ID NO: 3211421 - protein, 6 aa, Plasmodium falciparum
ASYSEI

SEQ ID NO: 3211422 - protein, 6 aa, Plasmodium falciparum
ASYSNN

SEQ ID NO: 3211423 - protein, 4 aa, Plasmodium falciparum
ATAG

SEQ ID NO: 3211424 - protein, 16 aa, Plasmodium falciparum
ATAKNYDNKKSHDNYK

SEQ ID NO: 3211425 - protein, 6 aa, Plasmodium falciparum
ATANEE

SEQ ID NO: 3211426 - protein, 5 aa, Plasmodium falciparum
ATAQL

SEQ ID NO: 3211427 - protein, 4 aa, Plasmodium falciparum
ATCY

SEQ ID NO: 3211428 - protein, 6 aa, Plasmodium falciparum
ATDFGG

SEQ ID NO: 3211429 - protein, 17 aa, Plasmodium falciparum
ATDGENGKANQLRGRNG

SEQ ID NO: 3211430 - protein, 11 aa, Plasmodium falciparum
ATDKAERGSLD

SEQ ID NO: 3211431 - protein, 8 aa, Plasmodium falciparum
ATDVSTEL

SEQ ID NO: 3211432 - protein, 4 aa, Plasmodium falciparum
ATEE

SEQ ID NO: 3211433 - protein, 5 aa, Plasmodium falciparum
ATEEE

SEQ ID NO: 3211434 - protein, 7 aa, Plasmodium falciparum
ATEGSHP

SEQ ID NO: 3211435 - protein, 4 aa, Plasmodium falciparum
ATEN

SEQ ID NO: 3211436 - protein, 7 aa, Plasmodium falciparum
ATEQKKN

SEQ ID NO: 3211437 - protein, 8 aa, Plasmodium falciparum
ATGCSNEY

SEQ ID NO: 3211438 - protein, 4 aa, Plasmodium falciparum
ATGE

SEQ ID NO: 3211439 - protein, 13 aa, Plasmodium falciparum
ATGLGQNKTGGGI

SEQ ID NO: 3211440 - protein, 7 aa, Plasmodium falciparum
ATIGQSS

SEQ ID NO: 3211441 - protein, 11 aa, Plasmodium falciparum
ATKAATDVSGA

SEQ ID NO: 3211442 - protein, 11 aa, Plasmodium falciparum
ATKNENDHNMN

SEQ ID NO: 3211443 - protein, 9 aa, Plasmodium falciparum
ATKTHSPGP

SEQ ID NO: 3211444 - protein, 6 aa, Plasmodium falciparum
ATKYRD

SEQ ID NO: 3211445 - protein, 5 aa, Plasmodium falciparum
ATLNS

SEQ ID NO: 3211446 - protein, 15 aa, Plasmodium falciparum
ATLPQTNQQTTQQLT

SEQ ID NO: 3211447 - protein, 12 aa, Plasmodium falciparum
ATLTDNSNINSI

SEQ ID NO: 3211448 - protein, 5 aa, Plasmodium falciparum
ATMDQ

SEQ ID NO: 3211449 - protein, 12 aa, Plasmodium falciparum
ATMENNKKNNMG

SEQ ID NO: 3211450 - protein, 6 aa, Plasmodium falciparum
ATNDLT

SEQ ID NO: 3211451 - protein, 8 aa, Plasmodium falciparum
ATNEKEKE

SEQ ID NO: 3211452 - protein, 20 aa, Plasmodium falciparum
ATNGTNNKEKRKKDDDINKN

SEQ ID NO: 3211453 - protein, 5 aa, Plasmodium falciparum
ATNIS

SEQ ID NO: 3211454 - protein, 10 aa, Plasmodium falciparum
ATNYDNDPEV

SEQ ID NO: 3211455 - protein, 33 aa, Plasmodium falciparum
ATPCLSSTSDSSETPCENTPTTLDDDDPLEEEN

SEQ ID NO: 3211456 - protein, 7 aa, Plasmodium falciparum
ATPGLTT

SEQ ID NO: 3211457 - protein, 12 aa, Plasmodium falciparum
ATPKYNDKEKTY

SEQ ID NO: 3211458 - protein, 4 aa, Plasmodium falciparum
ATQA

SEQ ID NO: 3211459 - protein, 5 aa, Plasmodium falciparum
ATQAL

SEQ ID NO: 3211460 - protein, 13 aa, Plasmodium falciparum
ATQDGIDAAETVE

SEQ ID NO: 3211461 - protein, 17 aa, Plasmodium falciparum
ATQTADAVADAKSAQVT

SEQ ID NO: 3211462 - protein, 15 aa, Plasmodium falciparum
ATQTAEAAAKIAEKG

SEQ ID NO: 3211463 - protein, 5 aa, Plasmodium falciparum
ATRPI

SEQ ID NO: 3211464 - protein, 16 aa, Plasmodium falciparum
ATRSGNKDTYKKYSEL

SEQ ID NO: 3211465 - protein, 6 aa, Plasmodium falciparum
ATSAAI

SEQ ID NO: 3211466 - protein, 7 aa, Plasmodium falciparum
ATSAAID

SEQ ID NO: 3211467 - protein, 26 aa, Plasmodium falciparum
ATSCQSQHSDKTEQQCQEYTPEPDEE

SEQ ID NO: 3211468 - protein, 7 aa, Plasmodium falciparum
ATSENMS

SEQ ID NO: 3211469 - protein, 5 aa, Plasmodium falciparum
ATSKF

SEQ ID NO: 3211470 - protein, 6 aa, Plasmodium falciparum
ATSKKE

SEQ ID NO: 3211471 - protein, 26 aa, Plasmodium falciparum
ATSNHTSDKISDDISDQTDNFEEDEE

SEQ ID NO: 3211472 - protein, 5 aa, Plasmodium falciparum
ATSPR

SEQ ID NO: 3211473 - protein, 15 aa, Plasmodium falciparum
ATSQPNSSITDESEA

SEQ ID NO: 3211474 - protein, 5 aa, Plasmodium falciparum
ATSVY

SEQ ID NO: 3211475 - protein, 11 aa, Plasmodium falciparum
ATTASDAYYSA

SEQ ID NO: 3211476 - protein, 5 aa, Plasmodium falciparum
ATTEG

SEQ ID NO: 3211477 - protein, 11 aa, Plasmodium falciparum
ATTGNTYSDRI

SEQ ID NO: 3211478 - protein, 8 aa, Plasmodium falciparum
ATTNSNSS

SEQ ID NO: 3211479 - protein, 7 aa, Plasmodium falciparum
ATTPKSY

SEQ ID NO: 3211480 - protein, 5 aa, Plasmodium falciparum
ATTPY

SEQ ID NO: 3211481 - protein, 6 aa, Plasmodium falciparum
ATTSTK

SEQ ID NO: 3211482 - protein, 17 aa, Plasmodium falciparum
ATTTNRDNNNIVDENTK

SEQ ID NO: 3211483 - protein, 6 aa, Plasmodium falciparum
ATTTPY

SEQ ID NO: 3211484 - protein, 8 aa, Plasmodium falciparum
ATYASSQT

SEQ ID NO: 3211485 - protein, 7 aa, Plasmodium falciparum
ATYENGK

SEQ ID NO: 3211486 - protein, 7 aa, Plasmodium falciparum
ATYKDYG

SEQ ID NO: 3211487 - protein, 5 aa, Plasmodium falciparum
ATYKS

SEQ ID NO: 3211488 - protein, 11 aa, Plasmodium falciparum
ATYPGSGSTTC

SEQ ID NO: 3211489 - protein, 13 aa, Plasmodium falciparum
AVAGAEQAATTKT

SEQ ID NO: 3211490 - protein, 7 aa, Plasmodium falciparum
AVAGESA

SEQ ID NO: 3211491 - protein, 58 aa, Plasmodium falciparum
AVAPGAAKKAEEESGIPPAAEPEADKGPEQADTEKKVPPKAAPARPKDKKRPKRQPRN

SEQ ID NO: 3211492 - protein, 64 aa, Plasmodium falciparum
AVDPGGDGKPKGDQDGGTAAGPEADPEADPETEPAPAGDQKEASTSKVAPKPKPPRPQPQPPTQ

SEQ ID NO: 3211493 - protein, 22 aa, Plasmodium falciparum
AVDSGKGDKGESSSGKSSLEGD

SEQ ID NO: 3211494 - protein, 7 aa, Plasmodium falciparum
AVDTTYG

SEQ ID NO: 3211495 - protein, 86 aa, Plasmodium falciparum
AVEGERRRQKEKKNENVKDVDNDKGDNHKGDDDDDDDDDDDDDDDDDDDNDDDDDDDDDDDDDDDGDNQITKSNKATNTPNNYTDV

SEQ ID NO: 3211496 - protein, 11 aa, Plasmodium falciparum
AVETAKKNAIE

SEQ ID NO: 3211497 - protein, 6 aa, Plasmodium falciparum
AVKPNI

SEQ ID NO: 3211498 - protein, 21 aa, Plasmodium falciparum
AVKRPQQETQPEEAPTATDPS

SEQ ID NO: 3211499 - protein, 8 aa, Plasmodium falciparum
AVPETTEK

SEQ ID NO: 3211500 - protein, 28 aa, Plasmodium falciparum
AVQGAQAQLPDGAGGSDQTPEKQLAGGK

SEQ ID NO: 3211501 - protein, 18 aa, Plasmodium falciparum
AVSPGGAASSTSTTESSQ

SEQ ID NO: 3211502 - protein, 8 aa, Plasmodium falciparum
AWDQQKST

SEQ ID NO: 3211503 - protein, 8 aa, Plasmodium falciparum
AYADPEQM

SEQ ID NO: 3211504 - protein, 26 aa, Plasmodium falciparum
AYDDKNYKDNYKNYETNHQKCEQNYK

SEQ ID NO: 3211505 - protein, 5 aa, Plasmodium falciparum
AYDEA

SEQ ID NO: 3211506 - protein, 9 aa, Plasmodium falciparum
AYDEKTRKV

SEQ ID NO: 3211507 - protein, 4 aa, Plasmodium falciparum
AYDS

SEQ ID NO: 3211508 - protein, 5 aa, Plasmodium falciparum
AYEGK

SEQ ID NO: 3211509 - protein, 7 aa, Plasmodium falciparum
AYEPNNS

SEQ ID NO: 3211510 - protein, 7 aa, Plasmodium falciparum
AYERDPC

SEQ ID NO: 3211511 - protein, 6 aa, Plasmodium falciparum
AYETNE

SEQ ID NO: 3211512 - protein, 10 aa, Plasmodium falciparum
AYGDAKETEH

SEQ ID NO: 3211513 - protein, 7 aa, Plasmodium falciparum
AYGNEDA

SEQ ID NO: 3211514 - protein, 10 aa, Plasmodium falciparum
AYGNYEGKPV

SEQ ID NO: 3211515 - protein, 13 aa, Plasmodium falciparum
AYGQGGQWLNPVP

SEQ ID NO: 3211516 - protein, 5 aa, Plasmodium falciparum
AYGSN

SEQ ID NO: 3211517 - protein, 13 aa, Plasmodium falciparum
AYKPYDRPTLSKN

SEQ ID NO: 3211518 - protein, 8 aa, Plasmodium falciparum
AYKSYSPL

SEQ ID NO: 3211519 - protein, 11 aa, Plasmodium falciparum
AYKTKKKGNIT

SEQ ID NO: 3211520 - protein, 4 aa, Plasmodium falciparum
AYMN

SEQ ID NO: 3211521 - protein, 4 aa, Plasmodium falciparum
AYMP

SEQ ID NO: 3211522 - protein, 20 aa, Plasmodium falciparum
AYNEDEENDEEEGDDDENDH

SEQ ID NO: 3211523 - protein, 5 aa, Plasmodium falciparum
AYNSE

SEQ ID NO: 3211524 - protein, 7 aa, Plasmodium falciparum
AYPEGVS

SEQ ID NO: 3211525 - protein, 6 aa, Plasmodium falciparum
AYPSNV

SEQ ID NO: 3211526 - protein, 4 aa, Plasmodium falciparum
AYQD

SEQ ID NO: 3211527 - protein, 4 aa, Plasmodium falciparum
AYQS

SEQ ID NO: 3211528 - protein, 4 aa, Plasmodium falciparum
AYRT

SEQ ID NO: 3211529 - protein, 26 aa, Plasmodium falciparum
AYSADNTSFDYNNNKKKKKKKNNNNN

SEQ ID NO: 3211530 - protein, 27 aa, Plasmodium falciparum
AYSRNELRNDQEKKTTKKKNLEENETC

SEQ ID NO: 3211531 - protein, 8 aa, Plasmodium falciparum
AYSRSDTS

SEQ ID NO: 3211532 - protein, 5 aa, Plasmodium falciparum
AYTQT

SEQ ID NO: 3211533 - protein, 13 aa, Plasmodium falciparum
AYTTSKDHYNNDD

SEQ ID NO: 3211534 - protein, 139 aa, Plasmodium falciparum
CAEEKEKNKHKCSHKEKEKDKNKDYYKDNIKDKDSDKEKDSDKDSDKGKGKGKDSDKGKDKDSDKGIDSDKGKDSDKDKGKDSDKSKDKDSDKCKDNNKDKDSDKCKDNNKDKDSDKEKDKSKDKDIDKEKKKEKTKEK

SEQ ID NO: 3211535 - protein, 7 aa, Plasmodium falciparum
CAGTPQI

SEQ ID NO: 3211536 - protein, 6 aa, Plasmodium falciparum
CAKNEE

SEQ ID NO: 3211537 - protein, 10 aa, Plasmodium falciparum
CAKPSGNYPA

SEQ ID NO: 3211538 - protein, 5 aa, Plasmodium falciparum
CANSN

SEQ ID NO: 3211539 - protein, 10 aa, Plasmodium falciparum
CASQDSNSEY

SEQ ID NO: 3211540 - protein, 6 aa, Plasmodium falciparum
CASSTV

SEQ ID NO: 3211541 - protein, 12 aa, Plasmodium falciparum
CAYNNDDTKNES

SEQ ID NO: 3211542 - protein, 13 aa, Plasmodium falciparum
CDCDSESDSIDYD

SEQ ID NO: 3211543 - protein, 27 aa, Plasmodium falciparum
CDDHKYDKYDDHKYDKYDDHKYDKYDD

SEQ ID NO: 3211544 - protein, 36 aa, Plasmodium falciparum
CDDKNNYKYDDKNNYKYDDKNNYKYDDTKNHNDDSA

SEQ ID NO: 3211545 - protein, 16 aa, Plasmodium falciparum
CDDNDNNNNNNNNNNK

SEQ ID NO: 3211546 - protein, 12 aa, Plasmodium falciparum
CDDNGRRTKEEG

SEQ ID NO: 3211547 - protein, 9 aa, Plasmodium falciparum
CDDNKNEVC

SEQ ID NO: 3211548 - protein, 17 aa, Plasmodium falciparum
CDDNKNIPRDDNKSYNK

SEQ ID NO: 3211549 - protein, 6 aa, Plasmodium falciparum
CDDNNN

SEQ ID NO: 3211550 - protein, 20 aa, Plasmodium falciparum
CDECKNKSKKCEKDKPQCKN

SEQ ID NO: 3211551 - protein, 13 aa, Plasmodium falciparum
CDEEEKKGQGNDE

SEQ ID NO: 3211552 - protein, 5 aa, Plasmodium falciparum
CDEEY

SEQ ID NO: 3211553 - protein, 6 aa, Plasmodium falciparum
CDEGEK

SEQ ID NO: 3211554 - protein, 7 aa, Plasmodium falciparum
CDEHDGN

SEQ ID NO: 3211555 - protein, 7 aa, Plasmodium falciparum
CDEKSDF

SEQ ID NO: 3211556 - protein, 4 aa, Plasmodium falciparum
CDEN

SEQ ID NO: 3211557 - protein, 5 aa, Plasmodium falciparum
CDENE

SEQ ID NO: 3211558 - protein, 22 aa, Plasmodium falciparum
CDENKIKNNINENSVNNNYNND

SEQ ID NO: 3211559 - protein, 8 aa, Plasmodium falciparum
CDENKSKD

SEQ ID NO: 3211560 - protein, 12 aa, Plasmodium falciparum
CDENSVQDEYKN

SEQ ID NO: 3211561 - protein, 5 aa, Plasmodium falciparum
CDGDG

SEQ ID NO: 3211562 - protein, 17 aa, Plasmodium falciparum
CDGEEAHENTTYKSDKS

SEQ ID NO: 3211563 - protein, 27 aa, Plasmodium falciparum
CDGNNNKMCDGNNNKMCDGNNNKMCDG

SEQ ID NO: 3211564 - protein, 15 aa, Plasmodium falciparum
CDGYRNTKEGKEETI

SEQ ID NO: 3211565 - protein, 12 aa, Plasmodium falciparum
CDKDKNDKLKKE

SEQ ID NO: 3211566 - protein, 9 aa, Plasmodium falciparum
CDKDNNNNI

SEQ ID NO: 3211567 - protein, 13 aa, Plasmodium falciparum
CDKEEKKSSYDKI

SEQ ID NO: 3211568 - protein, 10 aa, Plasmodium falciparum
CDKKNKKEEL

SEQ ID NO: 3211569 - protein, 11 aa, Plasmodium falciparum
CDKNDDEKNKM

SEQ ID NO: 3211570 - protein, 16 aa, Plasmodium falciparum
CDKNDEHNKKKNKTNI

SEQ ID NO: 3211571 - protein, 93 aa, Plasmodium falciparum
CDKPPPAPTAGDRGPGARADPHDVQQPRPPGSGPGTDANDEDDDDDDDDDDEEDGEAKEEEEDEEKQEDVHQEEKAKKEEPQKEEVARTPKDD

SEQ ID NO: 3211572 - protein, 13 aa, Plasmodium falciparum
CDMDNDKKKFPSI

SEQ ID NO: 3211573 - protein, 9 aa, Plasmodium falciparum
CDNDSDEDC

SEQ ID NO: 3211574 - protein, 10 aa, Plasmodium falciparum
CDNDYRNNNI

SEQ ID NO: 3211575 - protein, 6 aa, Plasmodium falciparum
CDNEKS

SEQ ID NO: 3211576 - protein, 7 aa, Plasmodium falciparum
CDNENVN

SEQ ID NO: 3211577 - protein, 13 aa, Plasmodium falciparum
CDNHTSDNNTCNN

SEQ ID NO: 3211578 - protein, 24 aa, Plasmodium falciparum
CDNHTSDNNTCNNHTSDNNTCNNH

SEQ ID NO: 3211579 - protein, 6 aa, Plasmodium falciparum
CDNNES

SEQ ID NO: 3211580 - protein, 5 aa, Plasmodium falciparum
CDNNK

SEQ ID NO: 3211581 - protein, 12 aa, Plasmodium falciparum
CDNNKKEDTSSL

SEQ ID NO: 3211582 - protein, 9 aa, Plasmodium falciparum
CDNNTCNNH

SEQ ID NO: 3211583 - protein, 21 aa, Plasmodium falciparum
CDNTYNQNTNLNNDNCKTKNN

SEQ ID NO: 3211584 - protein, 9 aa, Plasmodium falciparum
CDNVEEEEN

SEQ ID NO: 3211585 - protein, 9 aa, Plasmodium falciparum
CDQKGYYDN

SEQ ID NO: 3211586 - protein, 5 aa, Plasmodium falciparum
CDQNN

SEQ ID NO: 3211587 - protein, 25 aa, Plasmodium falciparum
CDRTNTSNEGASADLEGPSCANSCS

SEQ ID NO: 3211588 - protein, 12 aa, Plasmodium falciparum
CDSTHQKKADEL

SEQ ID NO: 3211589 - protein, 21 aa, Plasmodium falciparum
CDTDGKKKNKKKKLKREGEKK

SEQ ID NO: 3211590 - protein, 82 aa, Plasmodium falciparum
CDTYNDNNNNKNNNNIKDNDDNNSNSKDNDDNNNNNSKDNNDINNSKDNNDINNSKDNNDNNNSKDNNDDDYNNNNNNEQNH

SEQ ID NO: 3211591 - protein, 7 aa, Plasmodium falciparum
CDYESSN

SEQ ID NO: 3211592 - protein, 5 aa, Plasmodium falciparum
CDYPN

SEQ ID NO: 3211593 - protein, 4 aa, Plasmodium falciparum
CDYQ

SEQ ID NO: 3211594 - protein, 9 aa, Plasmodium falciparum
CEDDPSSAG

SEQ ID NO: 3211595 - protein, 10 aa, Plasmodium falciparum
CEDKSKEPSF

SEQ ID NO: 3211596 - protein, 97 aa, Plasmodium falciparum
CEDPSNDNINEDNTKEDNTNGNNTKEDNTNGNNTNEHNTNGNNTNEHNTNEHNTNQNNTNNQGDDHYGDDHYGDDHYGDDHYGDDHYGDDHYGDNNY

SEQ ID NO: 3211597 - protein, 5 aa, Plasmodium falciparum
CEEEI

SEQ ID NO: 3211598 - protein, 11 aa, Plasmodium falciparum
CEEKEKEHIST

SEQ ID NO: 3211599 - protein, 10 aa, Plasmodium falciparum
CEENTEKKYM

SEQ ID NO: 3211600 - protein, 11 aa, Plasmodium falciparum
CEERKKKELVN

SEQ ID NO: 3211601 - protein, 39 aa, Plasmodium falciparum
CEESSSSNYEEGNSSSNEENNISTDKNISNTNNKNGVSL

SEQ ID NO: 3211602 - protein, 4 aa, Plasmodium falciparum
CEHF

SEQ ID NO: 3211603 - protein, 10 aa, Plasmodium falciparum
CEHFGDDDNS

SEQ ID NO: 3211604 - protein, 20 aa, Plasmodium falciparum
CEKDNSKVKKGKENNNNSTM

SEQ ID NO: 3211605 - protein, 12 aa, Plasmodium falciparum
CEKKTESKHPSA

SEQ ID NO: 3211606 - protein, 7 aa, Plasmodium falciparum
CEKNGKG

SEQ ID NO: 3211607 - protein, 10 aa, Plasmodium falciparum
CEKNKEDHIN

SEQ ID NO: 3211608 - protein, 7 aa, Plasmodium falciparum
CEKTKRG

SEQ ID NO: 3211609 - protein, 9 aa, Plasmodium falciparum
CEKTKRGRN

SEQ ID NO: 3211610 - protein, 7 aa, Plasmodium falciparum
CENGKDD

SEQ ID NO: 3211611 - protein, 79 aa, Plasmodium falciparum
CENNNENYSENHNENYSENHNEKYSENHNENYSENHNEKYSENHNENHNKNHNENHNENHNKNHNENHNENHNDLENSQ

SEQ ID NO: 3211612 - protein, 6 aa, Plasmodium falciparum
CENNPD

SEQ ID NO: 3211613 - protein, 7 aa, Plasmodium falciparum
CEPDTER

SEQ ID NO: 3211614 - protein, 16 aa, Plasmodium falciparum
CEQNFREKGKYNSLSN

SEQ ID NO: 3211615 - protein, 5 aa, Plasmodium falciparum
CEQNN

SEQ ID NO: 3211616 - protein, 14 aa, Plasmodium falciparum
CEQSKEKETHTHTQ

SEQ ID NO: 3211617 - protein, 33 aa, Plasmodium falciparum
CEQYGKDKDTKMNDPNNNMDNNMENNNDNNNDN

SEQ ID NO: 3211618 - protein, 12 aa, Plasmodium falciparum
CERTKSSNNNPY

SEQ ID NO: 3211619 - protein, 17 aa, Plasmodium falciparum
CESDTESSIYDNDEEIN

SEQ ID NO: 3211620 - protein, 6 aa, Plasmodium falciparum
CGAAPN

SEQ ID NO: 3211621 - protein, 4 aa, Plasmodium falciparum
CGAQ

SEQ ID NO: 3211622 - protein, 15 aa, Plasmodium falciparum
CGDHTHETSCHDNSS

SEQ ID NO: 3211623 - protein, 13 aa, Plasmodium falciparum
CGDNEKSVTQARD

SEQ ID NO: 3211624 - protein, 5 aa, Plasmodium falciparum
CGDNN

SEQ ID NO: 3211625 - protein, 19 aa, Plasmodium falciparum
CGDNNHYKNYDESGSSHNI

SEQ ID NO: 3211626 - protein, 4 aa, Plasmodium falciparum
CGEA

SEQ ID NO: 3211627 - protein, 8 aa, Plasmodium falciparum
CGEEDKDA

SEQ ID NO: 3211628 - protein, 13 aa, Plasmodium falciparum
CGGDNEKNSTLAS

SEQ ID NO: 3211629 - protein, 6 aa, Plasmodium falciparum
CGGEKK

SEQ ID NO: 3211630 - protein, 11 aa, Plasmodium falciparum
CGGGTTPTPNK

SEQ ID NO: 3211631 - protein, 9 aa, Plasmodium falciparum
CGGSEDTAG

SEQ ID NO: 3211632 - protein, 11 aa, Plasmodium falciparum
CGHNDDPPDYD

SEQ ID NO: 3211633 - protein, 12 aa, Plasmodium falciparum
CGHYEGAPPTNL

SEQ ID NO: 3211634 - protein, 32 aa, Plasmodium falciparum
CGKRDNTHNNNNNNNNNNNNDNNNNNNNGNNN

SEQ ID NO: 3211635 - protein, 17 aa, Plasmodium falciparum
CGNDKQEKKKKKKKSKT

SEQ ID NO: 3211636 - protein, 12 aa, Plasmodium falciparum
CGNGAKKNNIQE

SEQ ID NO: 3211637 - protein, 7 aa, Plasmodium falciparum
CGNNKHC

SEQ ID NO: 3211638 - protein, 6 aa, Plasmodium falciparum
CGNNNR

SEQ ID NO: 3211639 - protein, 15 aa, Plasmodium falciparum
CGNNSQNGKEGEDND

SEQ ID NO: 3211640 - protein, 4 aa, Plasmodium falciparum
CGNS

SEQ ID NO: 3211641 - protein, 7 aa, Plasmodium falciparum
CGNSNIS

SEQ ID NO: 3211642 - protein, 6 aa, Plasmodium falciparum
CGPAGR

SEQ ID NO: 3211643 - protein, 4 aa, Plasmodium falciparum
CGPC

SEQ ID NO: 3211644 - protein, 4 aa, Plasmodium falciparum
CGRF

SEQ ID NO: 3211645 - protein, 10 aa, Plasmodium falciparum
CGSGERTKDN

SEQ ID NO: 3211646 - protein, 10 aa, Plasmodium falciparum
CGSGNNATLA

SEQ ID NO: 3211647 - protein, 21 aa, Plasmodium falciparum
CGSGNNATQAKDKCRCSDNQV

SEQ ID NO: 3211648 - protein, 4 aa, Plasmodium falciparum
CGSN

SEQ ID NO: 3211649 - protein, 7 aa, Plasmodium falciparum
CGSSRGK

SEQ ID NO: 3211650 - protein, 25 aa, Plasmodium falciparum
CGSTEDTYGKKKKKKKNEKEYRNDN

SEQ ID NO: 3211651 - protein, 9 aa, Plasmodium falciparum
CGTGTPTHK

SEQ ID NO: 3211652 - protein, 10 aa, Plasmodium falciparum
CGVGNSLDKG

SEQ ID NO: 3211653 - protein, 10 aa, Plasmodium falciparum
CGYNPRNTNM

SEQ ID NO: 3211654 - protein, 5 aa, Plasmodium falciparum
CGYPN

SEQ ID NO: 3211655 - protein, 13 aa, Plasmodium falciparum
CHDKEENEKRNDN

SEQ ID NO: 3211656 - protein, 11 aa, Plasmodium falciparum
CHKKKKDHRVN

SEQ ID NO: 3211657 - protein, 5 aa, Plasmodium falciparum
CHTNR

SEQ ID NO: 3211658 - protein, 12 aa, Plasmodium falciparum
CIEPQNNNHNIN

SEQ ID NO: 3211659 - protein, 10 aa, Plasmodium falciparum
CIPKKKKKNL

SEQ ID NO: 3211660 - protein, 4 aa, Plasmodium falciparum
CIPP

SEQ ID NO: 3211661 - protein, 6 aa, Plasmodium falciparum
CIPPRT

SEQ ID NO: 3211662 - protein, 10 aa, Plasmodium falciparum
CKAKSKKAQV

SEQ ID NO: 3211663 - protein, 13 aa, Plasmodium falciparum
CKDEEGKNETNEV

SEQ ID NO: 3211664 - protein, 13 aa, Plasmodium falciparum
CKDEKGEHDTDQV

SEQ ID NO: 3211665 - protein, 6 aa, Plasmodium falciparum
CKDEQE

SEQ ID NO: 3211666 - protein, 11 aa, Plasmodium falciparum
CKDGQNNNDQN

SEQ ID NO: 3211667 - protein, 10 aa, Plasmodium falciparum
CKDINEEKEK

SEQ ID NO: 3211668 - protein, 8 aa, Plasmodium falciparum
CKDKEDNN

SEQ ID NO: 3211669 - protein, 20 aa, Plasmodium falciparum
CKDPKKDDHIKNKEKEENEK

SEQ ID NO: 3211670 - protein, 10 aa, Plasmodium falciparum
CKDPSPGEVI

SEQ ID NO: 3211671 - protein, 8 aa, Plasmodium falciparum
CKDYNSKI

SEQ ID NO: 3211672 - protein, 4 aa, Plasmodium falciparum
CKED

SEQ ID NO: 3211673 - protein, 8 aa, Plasmodium falciparum
CKEDEEKK

SEQ ID NO: 3211674 - protein, 41 aa, Plasmodium falciparum
CKEGDTDNINNNNLNDNKIRNSCEEDEENEKKKKKRKEKKN

SEQ ID NO: 3211675 - protein, 10 aa, Plasmodium falciparum
CKEGNKEDNV

SEQ ID NO: 3211676 - protein, 4 aa, Plasmodium falciparum
CKEL

SEQ ID NO: 3211677 - protein, 6 aa, Plasmodium falciparum
CKENMK

SEQ ID NO: 3211678 - protein, 28 aa, Plasmodium falciparum
CKENNYKKINNKTECNPKESIKNESIPK

SEQ ID NO: 3211679 - protein, 9 aa, Plasmodium falciparum
CKENSEQTI

SEQ ID NO: 3211680 - protein, 7 aa, Plasmodium falciparum
CKEQCDR

SEQ ID NO: 3211681 - protein, 11 aa, Plasmodium falciparum
CKESDKEWPMP

SEQ ID NO: 3211682 - protein, 11 aa, Plasmodium falciparum
CKESKNKSEDG

SEQ ID NO: 3211683 - protein, 6 aa, Plasmodium falciparum
CKEYGK

SEQ ID NO: 3211684 - protein, 4 aa, Plasmodium falciparum
CKGC

SEQ ID NO: 3211685 - protein, 28 aa, Plasmodium falciparum
CKGDKKNCRGKEDDCSNDERTENKQNIE

SEQ ID NO: 3211686 - protein, 10 aa, Plasmodium falciparum
CKGEKKYKYN

SEQ ID NO: 3211687 - protein, 14 aa, Plasmodium falciparum
CKGVSGTNQCDDDG

SEQ ID NO: 3211688 - protein, 11 aa, Plasmodium falciparum
CKKDNASGEGK

SEQ ID NO: 3211689 - protein, 10 aa, Plasmodium falciparum
CKKDNGEGKT

SEQ ID NO: 3211690 - protein, 17 aa, Plasmodium falciparum
CKKDSGEDNGNGNEEDK

SEQ ID NO: 3211691 - protein, 5 aa, Plasmodium falciparum
CKKED

SEQ ID NO: 3211692 - protein, 8 aa, Plasmodium falciparum
CKKNGENE

SEQ ID NO: 3211693 - protein, 13 aa, Plasmodium falciparum
CKKNKKDKEIKNE

SEQ ID NO: 3211694 - protein, 8 aa, Plasmodium falciparum
CKKPDSPI

SEQ ID NO: 3211695 - protein, 11 aa, Plasmodium falciparum
CKKSKNNKNIS

SEQ ID NO: 3211696 - protein, 5 aa, Plasmodium falciparum
CKNDK

SEQ ID NO: 3211697 - protein, 14 aa, Plasmodium falciparum
CKNDNVEDNGEDKL

SEQ ID NO: 3211698 - protein, 9 aa, Plasmodium falciparum
CKNGSGEKY

SEQ ID NO: 3211699 - protein, 7 aa, Plasmodium falciparum
CKNKETN

SEQ ID NO: 3211700 - protein, 11 aa, Plasmodium falciparum
CKNNDNGEGKI

SEQ ID NO: 3211701 - protein, 15 aa, Plasmodium falciparum
CKNNNRNENAEDNNK

SEQ ID NO: 3211702 - protein, 9 aa, Plasmodium falciparum
CKNNNSNNE

SEQ ID NO: 3211703 - protein, 10 aa, Plasmodium falciparum
CKNNSEEANI

SEQ ID NO: 3211704 - protein, 5 aa, Plasmodium falciparum
CKNRS

SEQ ID NO: 3211705 - protein, 9 aa, Plasmodium falciparum
CKNSETCKN

SEQ ID NO: 3211706 - protein, 14 aa, Plasmodium falciparum
CKNTAKGKNKYKHD

SEQ ID NO: 3211707 - protein, 16 aa, Plasmodium falciparum
CKPQPPPPAPAPTQSA

SEQ ID NO: 3211708 - protein, 6 aa, Plasmodium falciparum
CKPTKI

SEQ ID NO: 3211709 - protein, 49 aa, Plasmodium falciparum
CKRAEEPPKEPAPTGPKKPAPTAGGEEDQTEKDTEVNPLAPAPADETFD

SEQ ID NO: 3211710 - protein, 28 aa, Plasmodium falciparum
CKRERKEKNKKKNKHKNKNKEKKNMDNN

SEQ ID NO: 3211711 - protein, 11 aa, Plasmodium falciparum
CKRKRKNNNLK

SEQ ID NO: 3211712 - protein, 5 aa, Plasmodium falciparum
CKSDE

SEQ ID NO: 3211713 - protein, 12 aa, Plasmodium falciparum
CKSEQSKKNNKN

SEQ ID NO: 3211714 - protein, 8 aa, Plasmodium falciparum
CKSKDDVT

SEQ ID NO: 3211715 - protein, 6 aa, Plasmodium falciparum
CKSNNK

SEQ ID NO: 3211716 - protein, 35 aa, Plasmodium falciparum
CKSTPIDDNKKIDKKEHHSNSQIKDKKKGAGSNNE

SEQ ID NO: 3211717 - protein, 5 aa, Plasmodium falciparum
CKSVN

SEQ ID NO: 3211718 - protein, 5 aa, Plasmodium falciparum
CKTDN

SEQ ID NO: 3211719 - protein, 19 aa, Plasmodium falciparum
CKTNEKKKKTGSNNIGSNT

SEQ ID NO: 3211720 - protein, 14 aa, Plasmodium falciparum
CKTNNENNNGDDKL

SEQ ID NO: 3211721 - protein, 13 aa, Plasmodium falciparum
CKTNNGNESVEAN

SEQ ID NO: 3211722 - protein, 12 aa, Plasmodium falciparum
CKTNSELPPEQS

SEQ ID NO: 3211723 - protein, 4 aa, Plasmodium falciparum
CKTP

SEQ ID NO: 3211724 - protein, 12 aa, Plasmodium falciparum
CKVDDSGSGRGG

SEQ ID NO: 3211725 - protein, 19 aa, Plasmodium falciparum
CKVGQGNGKNGDKVCSGYG

SEQ ID NO: 3211726 - protein, 4 aa, Plasmodium falciparum
CLDD

SEQ ID NO: 3211727 - protein, 8 aa, Plasmodium falciparum
CLDDEGDK

SEQ ID NO: 3211728 - protein, 9 aa, Plasmodium falciparum
CLDENTKDC

SEQ ID NO: 3211729 - protein, 10 aa, Plasmodium falciparum
CLTGTNKKEK

SEQ ID NO: 3211730 - protein, 10 aa, Plasmodium falciparum
CMSSNKNEEE

SEQ ID NO: 3211731 - protein, 12 aa, Plasmodium falciparum
CNDDSEGGKCKK

SEQ ID NO: 3211732 - protein, 4 aa, Plasmodium falciparum
CNDE

SEQ ID NO: 3211733 - protein, 9 aa, Plasmodium falciparum
CNDKGENVN

SEQ ID NO: 3211734 - protein, 16 aa, Plasmodium falciparum
CNDKPNAGKPKAGNGD

SEQ ID NO: 3211735 - protein, 6 aa, Plasmodium falciparum
CNDNIK

SEQ ID NO: 3211736 - protein, 7 aa, Plasmodium falciparum
CNDSSRK

SEQ ID NO: 3211737 - protein, 12 aa, Plasmodium falciparum
CNDSTKKDQFDD

SEQ ID NO: 3211738 - protein, 44 aa, Plasmodium falciparum
CNDTNNYDNNSNNNNNNDNHNDNHSNNSGINSSFNNNNNVHNKN

SEQ ID NO: 3211739 - protein, 6 aa, Plasmodium falciparum
CNEDED

SEQ ID NO: 3211740 - protein, 71 aa, Plasmodium falciparum
CNEEDKNMSENNHKKDSKHKGDSNHKSDSNHKSDSNHKSDSNHKSGSNHKSDCNHKSGSNHKSDSNHQSDC

SEQ ID NO: 3211741 - protein, 5 aa, Plasmodium falciparum
CNEEN

SEQ ID NO: 3211742 - protein, 16 aa, Plasmodium falciparum
CNEENMDEKKKKCEDA

SEQ ID NO: 3211743 - protein, 10 aa, Plasmodium falciparum
CNEGKDDNIS

SEQ ID NO: 3211744 - protein, 51 aa, Plasmodium falciparum
CNEKNTQPYNETNKEPYNEKNTQPYNEKNTQPYNETNTQPYNETNKEPYNH

SEQ ID NO: 3211745 - protein, 6 aa, Plasmodium falciparum
CNEKTK

SEQ ID NO: 3211746 - protein, 4 aa, Plasmodium falciparum
CNEN

SEQ ID NO: 3211747 - protein, 7 aa, Plasmodium falciparum
CNENKEK

SEQ ID NO: 3211748 - protein, 11 aa, Plasmodium falciparum
CNESEKNVSKN

SEQ ID NO: 3211749 - protein, 8 aa, Plasmodium falciparum
CNGERNDD

SEQ ID NO: 3211750 - protein, 10 aa, Plasmodium falciparum
CNGESPTKGY

SEQ ID NO: 3211751 - protein, 19 aa, Plasmodium falciparum
CNGGHTKGKCKNKTITEED

SEQ ID NO: 3211752 - protein, 4 aa, Plasmodium falciparum
CNGK

SEQ ID NO: 3211753 - protein, 10 aa, Plasmodium falciparum
CNGNNADNNF

SEQ ID NO: 3211754 - protein, 20 aa, Plasmodium falciparum
CNGPSRRSGGNDQCTAVNGN

SEQ ID NO: 3211755 - protein, 19 aa, Plasmodium falciparum
CNGRRRTNPCTPDNGKGNK

SEQ ID NO: 3211756 - protein, 4 aa, Plasmodium falciparum
CNGS

SEQ ID NO: 3211757 - protein, 13 aa, Plasmodium falciparum
CNGSDKSQNGTQK

SEQ ID NO: 3211758 - protein, 6 aa, Plasmodium falciparum
CNKGGC

SEQ ID NO: 3211759 - protein, 4 aa, Plasmodium falciparum
CNKK

SEQ ID NO: 3211760 - protein, 9 aa, Plasmodium falciparum
CNKKEQEED

SEQ ID NO: 3211761 - protein, 10 aa, Plasmodium falciparum
CNKQNNTINC

SEQ ID NO: 3211762 - protein, 6 aa, Plasmodium falciparum
CNKSPK

SEQ ID NO: 3211763 - protein, 11 aa, Plasmodium falciparum
CNKTDNNIHGD

SEQ ID NO: 3211764 - protein, 65 aa, Plasmodium falciparum
CNKTNEEYSSYYNDDKNDNDSKYYDDGKHDDDSKYDDNSKYDDNSKYDNYNNNHHNNNNNNNDNN

SEQ ID NO: 3211765 - protein, 7 aa, Plasmodium falciparum
CNKYNSS

SEQ ID NO: 3211766 - protein, 6 aa, Plasmodium falciparum
CNNDDS

SEQ ID NO: 3211767 - protein, 5 aa, Plasmodium falciparum
CNNEN

SEQ ID NO: 3211768 - protein, 5 aa, Plasmodium falciparum
CNNGG

SEQ ID NO: 3211769 - protein, 9 aa, Plasmodium falciparum
CNNKNNESI

SEQ ID NO: 3211770 - protein, 6 aa, Plasmodium falciparum
CNNKRK

SEQ ID NO: 3211771 - protein, 5 aa, Plasmodium falciparum
CNNMK

SEQ ID NO: 3211772 - protein, 15 aa, Plasmodium falciparum
CNNNDAYNNNNNTYN

SEQ ID NO: 3211773 - protein, 6 aa, Plasmodium falciparum
CNNNED

SEQ ID NO: 3211774 - protein, 14 aa, Plasmodium falciparum
CNNNENDNNENQNI

SEQ ID NO: 3211775 - protein, 11 aa, Plasmodium falciparum
CNNNNNNLDDY

SEQ ID NO: 3211776 - protein, 9 aa, Plasmodium falciparum
CNNNNNNNI

SEQ ID NO: 3211777 - protein, 16 aa, Plasmodium falciparum
CNNNNNNNNNNNNDES

SEQ ID NO: 3211778 - protein, 20 aa, Plasmodium falciparum
CNNNNNNNNNNNNNNINNSY

SEQ ID NO: 3211779 - protein, 6 aa, Plasmodium falciparum
CNNNNY

SEQ ID NO: 3211780 - protein, 12 aa, Plasmodium falciparum
CNNNSNNSRNED

SEQ ID NO: 3211781 - protein, 5 aa, Plasmodium falciparum
CNPDI

SEQ ID NO: 3211782 - protein, 10 aa, Plasmodium falciparum
CNPEDETTCT

SEQ ID NO: 3211783 - protein, 5 aa, Plasmodium falciparum
CNQNK

SEQ ID NO: 3211784 - protein, 9 aa, Plasmodium falciparum
CNQSREHSS

SEQ ID NO: 3211785 - protein, 70 aa, Plasmodium falciparum
CNREGRRRGKKRYNAEYNKSRKGNNKYKKKEKEREQEREREQEREREQDREMEQEKEKEKEREKEKEYSN

SEQ ID NO: 3211786 - protein, 12 aa, Plasmodium falciparum
CNRSEKESEIST

SEQ ID NO: 3211787 - protein, 5 aa, Plasmodium falciparum
CNSAS

SEQ ID NO: 3211788 - protein, 10 aa, Plasmodium falciparum
CNSGKSSFNN

SEQ ID NO: 3211789 - protein, 4 aa, Plasmodium falciparum
CNSN

SEQ ID NO: 3211790 - protein, 5 aa, Plasmodium falciparum
CNSNN

SEQ ID NO: 3211791 - protein, 8 aa, Plasmodium falciparum
CNSRPKQV

SEQ ID NO: 3211792 - protein, 5 aa, Plasmodium falciparum
CNSSD

SEQ ID NO: 3211793 - protein, 20 aa, Plasmodium falciparum
CNSSDVSEYDQMKPEQDEPI

SEQ ID NO: 3211794 - protein, 24 aa, Plasmodium falciparum
CNSSGGGTKVECNGRNSGTTTITA

SEQ ID NO: 3211795 - protein, 18 aa, Plasmodium falciparum
CNSTENSEKGGKDGKKSD

SEQ ID NO: 3211796 - protein, 4 aa, Plasmodium falciparum
CNSY

SEQ ID NO: 3211797 - protein, 8 aa, Plasmodium falciparum
CNTKQNNS

SEQ ID NO: 3211798 - protein, 4 aa, Plasmodium falciparum
CNTL

SEQ ID NO: 3211799 - protein, 10 aa, Plasmodium falciparum
CNTNKKNIIP

SEQ ID NO: 3211800 - protein, 51 aa, Plasmodium falciparum
CNTTGKNNNNNNNNDNNKNKNNDNNKNKNNDNNKNKNNDNQIDDDLTGPYN

SEQ ID NO: 3211801 - protein, 25 aa, Plasmodium falciparum
CNVEENDNRPGGGITKQYSGDGESC

SEQ ID NO: 3211802 - protein, 12 aa, Plasmodium falciparum
CPDKNKDLKSDD

SEQ ID NO: 3211803 - protein, 70 aa, Plasmodium falciparum
CPDPPREGAGRSDTSRDSPSSRPAQEVGDSEEDEDEDEDDEEEHPDDGKGDANEEEAENHSNDQEDKDTL

SEQ ID NO: 3211804 - protein, 14 aa, Plasmodium falciparum
CPDSSQKKGDTPKD

SEQ ID NO: 3211805 - protein, 7 aa, Plasmodium falciparum
CPDTDQF

SEQ ID NO: 3211806 - protein, 6 aa, Plasmodium falciparum
CPGNST

SEQ ID NO: 3211807 - protein, 15 aa, Plasmodium falciparum
CPKDPESKKDEPDDC

SEQ ID NO: 3211808 - protein, 18 aa, Plasmodium falciparum
CPKETCTNEGKKKECSDA

SEQ ID NO: 3211809 - protein, 8 aa, Plasmodium falciparum
CPKPPEPK

SEQ ID NO: 3211810 - protein, 78 aa, Plasmodium falciparum
CPKPPKKEEQTEETCDKAADEKVEETVAQNEENNIPPAGPAPPADSPPAGPATDSGKENVVPEPPAPAAPPSPPIPPL

SEQ ID NO: 3211811 - protein, 15 aa, Plasmodium falciparum
CPKTSGGKAIKAGGD

SEQ ID NO: 3211812 - protein, 7 aa, Plasmodium falciparum
CPKTSGN

SEQ ID NO: 3211813 - protein, 8 aa, Plasmodium falciparum
CPKYSSDD

SEQ ID NO: 3211814 - protein, 33 aa, Plasmodium falciparum
CPNEQNEHEDEINEDNKKDVTKQQKKRKLNSVS

SEQ ID NO: 3211815 - protein, 15 aa, Plasmodium falciparum
CPNQSTNKKYGSTSL

SEQ ID NO: 3211816 - protein, 5 aa, Plasmodium falciparum
CPPNK

SEQ ID NO: 3211817 - protein, 65 aa, Plasmodium falciparum
CPPPEEKTEIEGTDDKCEEASSPVVPEQPAKEDGDPAAQPEDDTEKKAPVKPTPTKPQRPRRPRR

SEQ ID NO: 3211818 - protein, 73 aa, Plasmodium falciparum
CPPPEEKTEIEGTDKKCEEAPTTPPEPAPPAKSGEGTEELPSAPEPPQDKALPKPAAQPKDKKRPKRQPQNPW

SEQ ID NO: 3211819 - protein, 63 aa, Plasmodium falciparum
CPPQEGLARSATDPQPRSEEKEEEEEDDDEDDEDGDEVEEEEPHTEDTTEGSATEEKEAPKVV

SEQ ID NO: 3211820 - protein, 58 aa, Plasmodium falciparum
CPPQEGLARSESDTQRDTHSDDVEAEEEDEEEEEDDVGAEGESETVKDTEAPVETKKD

SEQ ID NO: 3211821 - protein, 70 aa, Plasmodium falciparum
CPPQTPPKQEEKDTCEPAAEETEPAEEKSSEEPDKQKPDQDKSADTPARAPAAPPSTPGPQPLPSDNTSD

SEQ ID NO: 3211822 - protein, 7 aa, Plasmodium falciparum
CPSEEKQ

SEQ ID NO: 3211823 - protein, 10 aa, Plasmodium falciparum
CPSGNTSANC

SEQ ID NO: 3211824 - protein, 5 aa, Plasmodium falciparum
CPSGY

SEQ ID NO: 3211825 - protein, 4 aa, Plasmodium falciparum
CPSK

SEQ ID NO: 3211826 - protein, 12 aa, Plasmodium falciparum
CPTKYGPKAPTS

SEQ ID NO: 3211827 - protein, 12 aa, Plasmodium falciparum
CPTKYGSKAPTS

SEQ ID NO: 3211828 - protein, 38 aa, Plasmodium falciparum
CPTPQQEPEAEDEGECKAASPATSEEQTNQTSNPHETP

SEQ ID NO: 3211829 - protein, 10 aa, Plasmodium falciparum
CQDEEKYKYP

SEQ ID NO: 3211830 - protein, 14 aa, Plasmodium falciparum
CQDQDNHKVSQAEK

SEQ ID NO: 3211831 - protein, 17 aa, Plasmodium falciparum
CQDSTNYTLKDREKKNL

SEQ ID NO: 3211832 - protein, 9 aa, Plasmodium falciparum
CQDTNGNIK

SEQ ID NO: 3211833 - protein, 13 aa, Plasmodium falciparum
CQEKEEENYQDEY

SEQ ID NO: 3211834 - protein, 69 aa, Plasmodium falciparum
CQETQKQPTGDGVADTSPDPSRDTNVDPEQEEEEEEDDSEEQDATVNGPEDGGGEATQQPQGPSEKKEE

SEQ ID NO: 3211835 - protein, 15 aa, Plasmodium falciparum
CQGNSDQTNNTDFNE

SEQ ID NO: 3211836 - protein, 9 aa, Plasmodium falciparum
CQNESSEKE

SEQ ID NO: 3211837 - protein, 6 aa, Plasmodium falciparum
CQNGEK

SEQ ID NO: 3211838 - protein, 12 aa, Plasmodium falciparum
CQNGNENGKGHI

SEQ ID NO: 3211839 - protein, 4 aa, Plasmodium falciparum
CQNN

SEQ ID NO: 3211840 - protein, 10 aa, Plasmodium falciparum
CQNPPPSDAN

SEQ ID NO: 3211841 - protein, 4 aa, Plasmodium falciparum
CQNS

SEQ ID NO: 3211842 - protein, 21 aa, Plasmodium falciparum
CQREKNDTHGTDNDKTTHNEY

SEQ ID NO: 3211843 - protein, 4 aa, Plasmodium falciparum
CQSG

SEQ ID NO: 3211844 - protein, 9 aa, Plasmodium falciparum
CQSGSTDQN

SEQ ID NO: 3211845 - protein, 8 aa, Plasmodium falciparum
CQSRNKKG

SEQ ID NO: 3211846 - protein, 9 aa, Plasmodium falciparum
CRAGKEERF

SEQ ID NO: 3211847 - protein, 13 aa, Plasmodium falciparum
CRDDESATYGNGR

SEQ ID NO: 3211848 - protein, 9 aa, Plasmodium falciparum
CRDNNRNNI

SEQ ID NO: 3211849 - protein, 11 aa, Plasmodium falciparum
CREEDENGENR

SEQ ID NO: 3211850 - protein, 8 aa, Plasmodium falciparum
CRENTTDK

SEQ ID NO: 3211851 - protein, 18 aa, Plasmodium falciparum
CRGDENITRYGSGYGEDC

SEQ ID NO: 3211852 - protein, 11 aa, Plasmodium falciparum
CRGEDKYGKDR

SEQ ID NO: 3211853 - protein, 8 aa, Plasmodium falciparum
CRGENNEK

SEQ ID NO: 3211854 - protein, 15 aa, Plasmodium falciparum
CRGESGKDKYCSGDG

SEQ ID NO: 3211855 - protein, 24 aa, Plasmodium falciparum
CRGEYPGEKYCGGDGHDCTENGEL

SEQ ID NO: 3211856 - protein, 10 aa, Plasmodium falciparum
CRGKNGEEKY

SEQ ID NO: 3211857 - protein, 9 aa, Plasmodium falciparum
CRGKNKDKY

SEQ ID NO: 3211858 - protein, 10 aa, Plasmodium falciparum
CRGKTKGEKY

SEQ ID NO: 3211859 - protein, 11 aa, Plasmodium falciparum
CRGQDGTGKDR

SEQ ID NO: 3211860 - protein, 11 aa, Plasmodium falciparum
CRNKDTSYNDE

SEQ ID NO: 3211861 - protein, 5 aa, Plasmodium falciparum
CRNKN

SEQ ID NO: 3211862 - protein, 17 aa, Plasmodium falciparum
CRNQPTTPLDNTKSTDI

SEQ ID NO: 3211863 - protein, 57 aa, Plasmodium falciparum
CRPPKPTGGPGAGESPARSDADSRGPATVGAGEVEEDGDEVDSEEEEDEVEEEPPAE

SEQ ID NO: 3211864 - protein, 9 aa, Plasmodium falciparum
CRPPSTPVD

SEQ ID NO: 3211865 - protein, 5 aa, Plasmodium falciparum
CRRER

SEQ ID NO: 3211866 - protein, 10 aa, Plasmodium falciparum
CRSNSDSNDL

SEQ ID NO: 3211867 - protein, 11 aa, Plasmodium falciparum
CRTNDESGKGT

SEQ ID NO: 3211868 - protein, 10 aa, Plasmodium falciparum
CRTPKGKEKY

SEQ ID NO: 3211869 - protein, 30 aa, Plasmodium falciparum
CRVEDGSKNCSGYGEDCDDQLGEDPSTVPS

SEQ ID NO: 3211870 - protein, 15 aa, Plasmodium falciparum
CSADASAQKNDGHKD

SEQ ID NO: 3211871 - protein, 7 aa, Plasmodium falciparum
CSDDKKR

SEQ ID NO: 3211872 - protein, 12 aa, Plasmodium falciparum
CSDDKTCSDDNI

SEQ ID NO: 3211873 - protein, 11 aa, Plasmodium falciparum
CSDEETKNIRS

SEQ ID NO: 3211874 - protein, 9 aa, Plasmodium falciparum
CSDESGECY

SEQ ID NO: 3211875 - protein, 12 aa, Plasmodium falciparum
CSDGKSQSQANK

SEQ ID NO: 3211876 - protein, 14 aa, Plasmodium falciparum
CSDGNSQSQATKQC

SEQ ID NO: 3211877 - protein, 10 aa, Plasmodium falciparum
CSDKEKKHEF

SEQ ID NO: 3211878 - protein, 54 aa, Plasmodium falciparum
CSDKENEEERYRKKKKNSKKGIKSDDNNNNNNNKSDDENDNNNENENYNQNNNL

SEQ ID NO: 3211879 - protein, 24 aa, Plasmodium falciparum
CSDNKSGSSSNGSCNNKNQEACEK

SEQ ID NO: 3211880 - protein, 10 aa, Plasmodium falciparum
CSDNSNTKDS

SEQ ID NO: 3211881 - protein, 14 aa, Plasmodium falciparum
CSDNSQKKNTDERD

SEQ ID NO: 3211882 - protein, 10 aa, Plasmodium falciparum
CSDQDKDEIK

SEQ ID NO: 3211883 - protein, 10 aa, Plasmodium falciparum
CSDSGTEQKT

SEQ ID NO: 3211884 - protein, 6 aa, Plasmodium falciparum
CSETSY

SEQ ID NO: 3211885 - protein, 4 aa, Plasmodium falciparum
CSGD

SEQ ID NO: 3211886 - protein, 12 aa, Plasmodium falciparum
CSGEKKKGEDLN

SEQ ID NO: 3211887 - protein, 8 aa, Plasmodium falciparum
CSGPTPLD

SEQ ID NO: 3211888 - protein, 5 aa, Plasmodium falciparum
CSGST

SEQ ID NO: 3211889 - protein, 21 aa, Plasmodium falciparum
CSGTDDKNYSNNKDDKISDDH

SEQ ID NO: 3211890 - protein, 13 aa, Plasmodium falciparum
CSHENESEQKEKR

SEQ ID NO: 3211891 - protein, 14 aa, Plasmodium falciparum
CSHSKNKKLNRNEN

SEQ ID NO: 3211892 - protein, 4 aa, Plasmodium falciparum
CSIG

SEQ ID NO: 3211893 - protein, 8 aa, Plasmodium falciparum
CSINSSAR

SEQ ID NO: 3211894 - protein, 13 aa, Plasmodium falciparum
CSKKDSESAQDEI

SEQ ID NO: 3211895 - protein, 13 aa, Plasmodium falciparum
CSKKVSEKDNEKI

SEQ ID NO: 3211896 - protein, 8 aa, Plasmodium falciparum
CSKNDIPE

SEQ ID NO: 3211897 - protein, 9 aa, Plasmodium falciparum
CSKNNGGCD

SEQ ID NO: 3211898 - protein, 16 aa, Plasmodium falciparum
CSKNNIKGTKKQQKIK

SEQ ID NO: 3211899 - protein, 5 aa, Plasmodium falciparum
CSKVT

SEQ ID NO: 3211900 - protein, 11 aa, Plasmodium falciparum
CSMQGSTDQSA

SEQ ID NO: 3211901 - protein, 11 aa, Plasmodium falciparum
CSNDDYSTSKY

SEQ ID NO: 3211902 - protein, 11 aa, Plasmodium falciparum
CSNDTSDTNEK

SEQ ID NO: 3211903 - protein, 4 aa, Plasmodium falciparum
CSNE

SEQ ID NO: 3211904 - protein, 6 aa, Plasmodium falciparum
CSNEDN

SEQ ID NO: 3211905 - protein, 4 aa, Plasmodium falciparum
CSNN

SEQ ID NO: 3211906 - protein, 10 aa, Plasmodium falciparum
CSNNNDNNIS

SEQ ID NO: 3211907 - protein, 6 aa, Plasmodium falciparum
CSNNNE

SEQ ID NO: 3211908 - protein, 16 aa, Plasmodium falciparum
CSNTRNKRKKRKCQEK

SEQ ID NO: 3211909 - protein, 9 aa, Plasmodium falciparum
CSQSKNVEE

SEQ ID NO: 3211910 - protein, 5 aa, Plasmodium falciparum
CSQSN

SEQ ID NO: 3211911 - protein, 10 aa, Plasmodium falciparum
CSRCNKKRNA

SEQ ID NO: 3211912 - protein, 13 aa, Plasmodium falciparum
CSRSYSEDQEKHE

SEQ ID NO: 3211913 - protein, 9 aa, Plasmodium falciparum
CSSKVKENQ

SEQ ID NO: 3211914 - protein, 12 aa, Plasmodium falciparum
CSSNSSENEDIE

SEQ ID NO: 3211915 - protein, 18 aa, Plasmodium falciparum
CSSSMSSLSDDSSDLSSG

SEQ ID NO: 3211916 - protein, 10 aa, Plasmodium falciparum
CSSSSFSYDD

SEQ ID NO: 3211917 - protein, 11 aa, Plasmodium falciparum
CSTDKINTNDV

SEQ ID NO: 3211918 - protein, 10 aa, Plasmodium falciparum
CSTPKETENL

SEQ ID NO: 3211919 - protein, 15 aa, Plasmodium falciparum
CSTSASSEKSKEDPI

SEQ ID NO: 3211920 - protein, 14 aa, Plasmodium falciparum
CSTSNEHLKNGDKD

SEQ ID NO: 3211921 - protein, 9 aa, Plasmodium falciparum
CSTTKNKST

SEQ ID NO: 3211922 - protein, 5 aa, Plasmodium falciparum
CSVTD

SEQ ID NO: 3211923 - protein, 13 aa, Plasmodium falciparum
CSYGSNGKSEGAC

SEQ ID NO: 3211924 - protein, 10 aa, Plasmodium falciparum
CSYGSNGTDV

SEQ ID NO: 3211925 - protein, 5 aa, Plasmodium falciparum
CTDTN

SEQ ID NO: 3211926 - protein, 4 aa, Plasmodium falciparum
CTEG

SEQ ID NO: 3211927 - protein, 14 aa, Plasmodium falciparum
CTEGGADSQNKTTI

SEQ ID NO: 3211928 - protein, 7 aa, Plasmodium falciparum
CTENEIS

SEQ ID NO: 3211929 - protein, 10 aa, Plasmodium falciparum
CTESNSNNQQ

SEQ ID NO: 3211930 - protein, 14 aa, Plasmodium falciparum
CTETDSSENSKEDA

SEQ ID NO: 3211931 - protein, 10 aa, Plasmodium falciparum
CTGHTSEQNI

SEQ ID NO: 3211932 - protein, 5 aa, Plasmodium falciparum
CTGYD

SEQ ID NO: 3211933 - protein, 9 aa, Plasmodium falciparum
CTHEKTDNI

SEQ ID NO: 3211934 - protein, 6 aa, Plasmodium falciparum
CTKDTS

SEQ ID NO: 3211935 - protein, 10 aa, Plasmodium falciparum
CTKKSRRTKN

SEQ ID NO: 3211936 - protein, 13 aa, Plasmodium falciparum
CTKNDKKSKCISG

SEQ ID NO: 3211937 - protein, 16 aa, Plasmodium falciparum
CTKNENVNMNEQDNNV

SEQ ID NO: 3211938 - protein, 6 aa, Plasmodium falciparum
CTKNPE

SEQ ID NO: 3211939 - protein, 8 aa, Plasmodium falciparum
CTKTKPAI

SEQ ID NO: 3211940 - protein, 5 aa, Plasmodium falciparum
CTNDD

SEQ ID NO: 3211941 - protein, 8 aa, Plasmodium falciparum
CTNDTKEK

SEQ ID NO: 3211942 - protein, 7 aa, Plasmodium falciparum
CTNGNRG

SEQ ID NO: 3211943 - protein, 24 aa, Plasmodium falciparum
CTNKENTNKNKDTKQKQNKEKENF

SEQ ID NO: 3211944 - protein, 4 aa, Plasmodium falciparum
CTNN

SEQ ID NO: 3211945 - protein, 8 aa, Plasmodium falciparum
CTNNGEGF

SEQ ID NO: 3211946 - protein, 14 aa, Plasmodium falciparum
CTNNGQGDKIQGDC

SEQ ID NO: 3211947 - protein, 9 aa, Plasmodium falciparum
CTNNNKSDV

SEQ ID NO: 3211948 - protein, 12 aa, Plasmodium falciparum
CTNSKNKNEKIQ

SEQ ID NO: 3211949 - protein, 10 aa, Plasmodium falciparum
CTNYTEKNDK

SEQ ID NO: 3211950 - protein, 18 aa, Plasmodium falciparum
CTQKGEKACSGDGNSKND

SEQ ID NO: 3211951 - protein, 5 aa, Plasmodium falciparum
CTRGC

SEQ ID NO: 3211952 - protein, 16 aa, Plasmodium falciparum
CTSGDMQNGCKDNKIN

SEQ ID NO: 3211953 - protein, 4 aa, Plasmodium falciparum
CTSM

SEQ ID NO: 3211954 - protein, 6 aa, Plasmodium falciparum
CTTEKH

SEQ ID NO: 3211955 - protein, 10 aa, Plasmodium falciparum
CTTKDQNKIH

SEQ ID NO: 3211956 - protein, 34 aa, Plasmodium falciparum
CTTTSTSSVNNMENNNNSNMNGCGDKKSEGSERH

SEQ ID NO: 3211957 - protein, 4 aa, Plasmodium falciparum
CVGK

SEQ ID NO: 3211958 - protein, 9 aa, Plasmodium falciparum
CVPTNDKPY

SEQ ID NO: 3211959 - protein, 88 aa, Plasmodium falciparum
CVRNNPDKDCPKKPPTGGPGGVHSDTASEDITHHDSSHDESEGSEDEEEEEEEDKEEEGEDGEDVQDDVAEEDTAKEEGSSTTETQLP

SEQ ID NO: 3211960 - protein, 36 aa, Plasmodium falciparum
CVSSGKKGKENKKEESNSKKKISKGKKENNDTKDVN

SEQ ID NO: 3211961 - protein, 31 aa, Plasmodium falciparum
CVTSSNKKDEKDKNLTKNDNLEESHKDIEKR

SEQ ID NO: 3211962 - protein, 10 aa, Plasmodium falciparum
CYDDDDEKYR

SEQ ID NO: 3211963 - protein, 12 aa, Plasmodium falciparum
CYKNGGRCSGDG

SEQ ID NO: 3211964 - protein, 8 aa, Plasmodium falciparum
CYNERNNY

SEQ ID NO: 3211965 - protein, 19 aa, Plasmodium falciparum
CYNNNNNDINNDNNGNNTN

SEQ ID NO: 3211966 - protein, 10 aa, Plasmodium falciparum
CYNNNNNNSY

SEQ ID NO: 3211967 - protein, 5 aa, Plasmodium falciparum
CYSSL

SEQ ID NO: 3211968 - protein, 14 aa, Plasmodium falciparum
DAADAARKAANEKL

SEQ ID NO: 3211969 - protein, 5 aa, Plasmodium falciparum
DAAPT

SEQ ID NO: 3211970 - protein, 7 aa, Plasmodium falciparum
DAASGLG

SEQ ID NO: 3211971 - protein, 7 aa, Plasmodium falciparum
DAASRNY

SEQ ID NO: 3211972 - protein, 4 aa, Plasmodium falciparum
DAAV

SEQ ID NO: 3211973 - protein, 4 aa, Plasmodium falciparum
DACG

SEQ ID NO: 3211974 - protein, 14 aa, Plasmodium falciparum
DACGTKYDKYGREK

SEQ ID NO: 3211975 - protein, 12 aa, Plasmodium falciparum
DACTYSKQNYNE

SEQ ID NO: 3211976 - protein, 7 aa, Plasmodium falciparum
DADEDKY

SEQ ID NO: 3211977 - protein, 7 aa, Plasmodium falciparum
DADEYSK

SEQ ID NO: 3211978 - protein, 7 aa, Plasmodium falciparum
DADTGNA

SEQ ID NO: 3211979 - protein, 15 aa, Plasmodium falciparum
DADYSEQQQKEKVHN

SEQ ID NO: 3211980 - protein, 6 aa, Plasmodium falciparum
DAEGNV

SEQ ID NO: 3211981 - protein, 11 aa, Plasmodium falciparum
DAEGPANTAAE

SEQ ID NO: 3211982 - protein, 7 aa, Plasmodium falciparum
DAEKKQY

SEQ ID NO: 3211983 - protein, 24 aa, Plasmodium falciparum
DAENAANAGIDAASAEAANLAPKT

SEQ ID NO: 3211984 - protein, 11 aa, Plasmodium falciparum
DAETCKNCEPR

SEQ ID NO: 3211985 - protein, 11 aa, Plasmodium falciparum
DAETTQNNTLH

SEQ ID NO: 3211986 - protein, 6 aa, Plasmodium falciparum
DAEYPK

SEQ ID NO: 3211987 - protein, 12 aa, Plasmodium falciparum
DAEYPSGSGHTT

SEQ ID NO: 3211988 - protein, 10 aa, Plasmodium falciparum
DAFSGTDKSR

SEQ ID NO: 3211989 - protein, 9 aa, Plasmodium falciparum
DAGGAKEEN

SEQ ID NO: 3211990 - protein, 7 aa, Plasmodium falciparum
DAGRDGA

SEQ ID NO: 3211991 - protein, 8 aa, Plasmodium falciparum
DAGSVTGE

SEQ ID NO: 3211992 - protein, 4 aa, Plasmodium falciparum
DAHE

SEQ ID NO: 3211993 - protein, 24 aa, Plasmodium falciparum
DAHESTNTYDEEKTREKHNNKNNN

SEQ ID NO: 3211994 - protein, 11 aa, Plasmodium falciparum
DAHQKNNENDD

SEQ ID NO: 3211995 - protein, 14 aa, Plasmodium falciparum
DAIGKKDDNGEYAN

SEQ ID NO: 3211996 - protein, 6 aa, Plasmodium falciparum
DAIKKN

SEQ ID NO: 3211997 - protein, 5 aa, Plasmodium falciparum
DAITG

SEQ ID NO: 3211998 - protein, 103 aa, Plasmodium falciparum
DAKDCQQKCDKKPPPPETPARNLPPPDTQRDPNQEESEEEEEEEDEDAPDDGEVDGDKGDGQETEPEEEEDTEDAKVEPAKDTTEDTEQDGQGPPVKKDEVNP

SEQ ID NO: 3211999 - protein, 9 aa, Plasmodium falciparum
DAKDGLDER

SEQ ID NO: 3212000 - protein, 7 aa, Plasmodium falciparum
DAKEKER

SEQ ID NO: 3212001 - protein, 15 aa, Plasmodium falciparum
DAKGTPIGPPASQAI

SEQ ID NO: 3212002 - protein, 17 aa, Plasmodium falciparum
DAKKAAAAAVKKATDEV

SEQ ID NO: 3212003 - protein, 9 aa, Plasmodium falciparum
DAKKNTSII

SEQ ID NO: 3212004 - protein, 9 aa, Plasmodium falciparum
DAKKSCSNY

SEQ ID NO: 3212005 - protein, 26 aa, Plasmodium falciparum
DAKRNRKAGTKNCGPSSTTNAAENKC

SEQ ID NO: 3212006 - protein, 17 aa, Plasmodium falciparum
DAKTNKNSKKKTETNNE

SEQ ID NO: 3212007 - protein, 5 aa, Plasmodium falciparum
DAKYD

SEQ ID NO: 3212008 - protein, 5 aa, Plasmodium falciparum
DALQN

SEQ ID NO: 3212009 - protein, 7 aa, Plasmodium falciparum
DALSDKL

SEQ ID NO: 3212010 - protein, 13 aa, Plasmodium falciparum
DALSGNKFRETSE

SEQ ID NO: 3212011 - protein, 74 aa, Plasmodium falciparum
DANDESYKTSEQTNENNKKNNKDKNNNSSDDTSNVNNNNDNNNDNNNNNNNNDNNNNNKNNYENKNKTNTSYEH

SEQ ID NO: 3212012 - protein, 28 aa, Plasmodium falciparum
DANDKAKKPAGKGSPSTLQTPGSSSGAS

SEQ ID NO: 3212013 - protein, 8 aa, Plasmodium falciparum
DANEELDD

SEQ ID NO: 3212014 - protein, 34 aa, Plasmodium falciparum
DANGHDEENGHALNNKKEGGKNNRNEDEDNSDNI

SEQ ID NO: 3212015 - protein, 78 aa, Plasmodium falciparum
DANIENEENIKKENIKKDNIKNDNVNNNDHIKNDNVNNNDHIKNDNIKNDNVNNNDHIKNDNIKNDSVNNNDHIKNNN

SEQ ID NO: 3212016 - protein, 10 aa, Plasmodium falciparum
DANKGSQNKK

SEQ ID NO: 3212017 - protein, 10 aa, Plasmodium falciparum
DANKRNQKNI

SEQ ID NO: 3212018 - protein, 13 aa, Plasmodium falciparum
DANNNNNNNNIKN

SEQ ID NO: 3212019 - protein, 7 aa, Plasmodium falciparum
DANNTVG

SEQ ID NO: 3212020 - protein, 8 aa, Plasmodium falciparum
DANPNQDL

SEQ ID NO: 3212021 - protein, 18 aa, Plasmodium falciparum
DANRCKETHKDDCSQQEV

SEQ ID NO: 3212022 - protein, 79 aa, Plasmodium falciparum
DANRCKNCEQRKPPGEEGGAARNLPGVDTTVDDANEDDLDDEDDEDEDDDGGGSDVGGSDVGEVEEETAKEATEETTTP

SEQ ID NO: 3212023 - protein, 7 aa, Plasmodium falciparum
DANVTNT

SEQ ID NO: 3212024 - protein, 7 aa, Plasmodium falciparum
DAPDNAK

SEQ ID NO: 3212025 - protein, 4 aa, Plasmodium falciparum
DAPI

SEQ ID NO: 3212026 - protein, 15 aa, Plasmodium falciparum
DAQNYKGKNRDDYNY

SEQ ID NO: 3212027 - protein, 4 aa, Plasmodium falciparum
DARN

SEQ ID NO: 3212028 - protein, 6 aa, Plasmodium falciparum
DARNQL

SEQ ID NO: 3212029 - protein, 4 aa, Plasmodium falciparum
DARQ

SEQ ID NO: 3212030 - protein, 8 aa, Plasmodium falciparum
DASAGSPR

SEQ ID NO: 3212031 - protein, 41 aa, Plasmodium falciparum
DASEQNKNKDAESSTGQIPTPTESSHGISDGKKDTSTNDMD

SEQ ID NO: 3212032 - protein, 8 aa, Plasmodium falciparum
DASINKQK

SEQ ID NO: 3212033 - protein, 13 aa, Plasmodium falciparum
DASISSNKNNDIN

SEQ ID NO: 3212034 - protein, 16 aa, Plasmodium falciparum
DASKGEYKHEGNPDDL

SEQ ID NO: 3212035 - protein, 4 aa, Plasmodium falciparum
DASS

SEQ ID NO: 3212036 - protein, 16 aa, Plasmodium falciparum
DASSLSENVGNKNIPN

SEQ ID NO: 3212037 - protein, 5 aa, Plasmodium falciparum
DASTD

SEQ ID NO: 3212038 - protein, 12 aa, Plasmodium falciparum
DASTVDSNAMDV

SEQ ID NO: 3212039 - protein, 5 aa, Plasmodium falciparum
DASVV

SEQ ID NO: 3212040 - protein, 4 aa, Plasmodium falciparum
DATK

SEQ ID NO: 3212041 - protein, 17 aa, Plasmodium falciparum
DATKGKNYINGHNSNDN

SEQ ID NO: 3212042 - protein, 5 aa, Plasmodium falciparum
DATKL

SEQ ID NO: 3212043 - protein, 15 aa, Plasmodium falciparum
DATQDKNSSEDNNCN

SEQ ID NO: 3212044 - protein, 4 aa, Plasmodium falciparum
DAVN

SEQ ID NO: 3212045 - protein, 8 aa, Plasmodium falciparum
DAVPSEAT

SEQ ID NO: 3212046 - protein, 4 aa, Plasmodium falciparum
DAYP

SEQ ID NO: 3212047 - protein, 11 aa, Plasmodium falciparum
DAYSQHGENNK

SEQ ID NO: 3212048 - protein, 4 aa, Plasmodium falciparum
DCDK

SEQ ID NO: 3212049 - protein, 11 aa, Plasmodium falciparum
DCDNNSDNNND

SEQ ID NO: 3212050 - protein, 9 aa, Plasmodium falciparum
DCEDTPITT

SEQ ID NO: 3212051 - protein, 14 aa, Plasmodium falciparum
DCEVDDDDNKCDGD

SEQ ID NO: 3212052 - protein, 12 aa, Plasmodium falciparum
DCINNNDTQNYK

SEQ ID NO: 3212053 - protein, 5 aa, Plasmodium falciparum
DCKDD

SEQ ID NO: 3212054 - protein, 7 aa, Plasmodium falciparum
DCKNNKN

SEQ ID NO: 3212055 - protein, 14 aa, Plasmodium falciparum
DCNNKNSKSYNEKE

SEQ ID NO: 3212056 - protein, 44 aa, Plasmodium falciparum
DCNNKSNSNNNEDMEDNNNNNNNNNNNGDKSKSRDRNKLKTNYN

SEQ ID NO: 3212057 - protein, 6 aa, Plasmodium falciparum
DCNNSD

SEQ ID NO: 3212058 - protein, 18 aa, Plasmodium falciparum
DCNSNYNKDIERESDKKK

SEQ ID NO: 3212059 - protein, 8 aa, Plasmodium falciparum
DCPNNGDK

SEQ ID NO: 3212060 - protein, 7 aa, Plasmodium falciparum
DCPQSND

SEQ ID NO: 3212061 - protein, 6 aa, Plasmodium falciparum
DCSKND

SEQ ID NO: 3212062 - protein, 7 aa, Plasmodium falciparum
DCSNKES

SEQ ID NO: 3212063 - protein, 9 aa, Plasmodium falciparum
DCSRNNGGC

SEQ ID NO: 3212064 - protein, 10 aa, Plasmodium falciparum
DCSSNQTNSK

SEQ ID NO: 3212065 - protein, 7 aa, Plasmodium falciparum
DCTNEDI

SEQ ID NO: 3212066 - protein, 7 aa, Plasmodium falciparum
DCTQDDI

SEQ ID NO: 3212067 - protein, 5 aa, Plasmodium falciparum
DCVQN

SEQ ID NO: 3212068 - protein, 45 aa, Plasmodium falciparum
DCVSGSGNSLTGSGDCASGSGNSLTGSGDCVSGSGNSYSKSCDNY

SEQ ID NO: 3212069 - protein, 7 aa, Plasmodium falciparum
DDAKKKH

SEQ ID NO: 3212070 - protein, 7 aa, Plasmodium falciparum
DDAKSNL

SEQ ID NO: 3212071 - protein, 10 aa, Plasmodium falciparum
DDANNDSHKI

SEQ ID NO: 3212072 - protein, 21 aa, Plasmodium falciparum
DDANSYDNSDKGDQGEHDDNE

SEQ ID NO: 3212073 - protein, 5 aa, Plasmodium falciparum
DDAPF

SEQ ID NO: 3212074 - protein, 23 aa, Plasmodium falciparum
DDAPKDDNNNNNNNNNEKTNSKF

SEQ ID NO: 3212075 - protein, 7 aa, Plasmodium falciparum
DDAPRIS

SEQ ID NO: 3212076 - protein, 11 aa, Plasmodium falciparum
DDASKPEKSDI

SEQ ID NO: 3212077 - protein, 5 aa, Plasmodium falciparum
DDATS

SEQ ID NO: 3212078 - protein, 14 aa, Plasmodium falciparum
DDAVDNKENEEKNS

SEQ ID NO: 3212079 - protein, 31 aa, Plasmodium falciparum
DDCNKNQAQNSVETQPSDENPAQCQDTHPDD

SEQ ID NO: 3212080 - protein, 5 aa, Plasmodium falciparum
DDDAK

SEQ ID NO: 3212081 - protein, 8 aa, Plasmodium falciparum
DDDDAKKY

SEQ ID NO: 3212082 - protein, 40 aa, Plasmodium falciparum
DDDDDDDDDDDDDDDDDDDYDDDDYDDDDEDDDDDNYKRK

SEQ ID NO: 3212083 - protein, 15 aa, Plasmodium falciparum
DDDDDDDDDSFRNKI

SEQ ID NO: 3212084 - protein, 50 aa, Plasmodium falciparum
DDDDDDEEENDKRREKRSKRKDSEKNKERKKEKKKSHINEEKYKDRNMNR

SEQ ID NO: 3212085 - protein, 12 aa, Plasmodium falciparum
DDDDDDNKSYPL

SEQ ID NO: 3212086 - protein, 9 aa, Plasmodium falciparum
DDDDDEDVE

SEQ ID NO: 3212087 - protein, 26 aa, Plasmodium falciparum
DDDDDEYSNKQGNEKRKKKKKKKKEG

SEQ ID NO: 3212088 - protein, 10 aa, Plasmodium falciparum
DDDDDKNKSK

SEQ ID NO: 3212089 - protein, 6 aa, Plasmodium falciparum
DDDDKD

SEQ ID NO: 3212090 - protein, 24 aa, Plasmodium falciparum
DDDDKKKYIKGQDENRQEDLEQER

SEQ ID NO: 3212091 - protein, 18 aa, Plasmodium falciparum
DDDDNENENDNDNIGNNN

SEQ ID NO: 3212092 - protein, 14 aa, Plasmodium falciparum
DDDDNNNNNNGEHR

SEQ ID NO: 3212093 - protein, 8 aa, Plasmodium falciparum
DDDDNNNY

SEQ ID NO: 3212094 - protein, 7 aa, Plasmodium falciparum
DDDDVKR

SEQ ID NO: 3212095 - protein, 16 aa, Plasmodium falciparum
DDDDYDGDDDSNNSYN

SEQ ID NO: 3212096 - protein, 15 aa, Plasmodium falciparum
DDDEEEEEEDHSNNT

SEQ ID NO: 3212097 - protein, 190 aa, Plasmodium falciparum
DDDEHNTDDIKEDDEHNADDIKEDDEHNVDDIKEDDENNADDIKEDDEHNADDIKEDDEHNTDDIKEDDEHNTDDIKEDDEHNADDIKEDDENNADDIKEDDEHNTDDIKEDDEHNTDDIKEDDEHNADDIKDDEHNTDDIKDDEHNTDDIKDDEHNADDIKDEDNDQVEDNQELNENLEGSDVPKDDEA

SEQ ID NO: 3212098 - protein, 15 aa, Plasmodium falciparum
DDDEKDDDEYQKPYD

SEQ ID NO: 3212099 - protein, 15 aa, Plasmodium falciparum
DDDEKNHEDEKKKTD

SEQ ID NO: 3212100 - protein, 9 aa, Plasmodium falciparum
DDDEQEEIQ

SEQ ID NO: 3212101 - protein, 6 aa, Plasmodium falciparum
DDDFSH

SEQ ID NO: 3212102 - protein, 16 aa, Plasmodium falciparum
DDDHMDDEPKKSNINT

SEQ ID NO: 3212103 - protein, 7 aa, Plasmodium falciparum
DDDIKNK

SEQ ID NO: 3212104 - protein, 22 aa, Plasmodium falciparum
DDDKASVDHNKMDNNNSDVPTK

SEQ ID NO: 3212105 - protein, 10 aa, Plasmodium falciparum
DDDKESVDDD

SEQ ID NO: 3212106 - protein, 7 aa, Plasmodium falciparum
DDDKKDM

SEQ ID NO: 3212107 - protein, 10 aa, Plasmodium falciparum
DDDKKDNVIN

SEQ ID NO: 3212108 - protein, 8 aa, Plasmodium falciparum
DDDKLANA

SEQ ID NO: 3212109 - protein, 7 aa, Plasmodium falciparum
DDDKLGG

SEQ ID NO: 3212110 - protein, 8 aa, Plasmodium falciparum
DDDKTSMD

SEQ ID NO: 3212111 - protein, 6 aa, Plasmodium falciparum
DDDNFI

SEQ ID NO: 3212112 - protein, 9 aa, Plasmodium falciparum
DDDNINNNH

SEQ ID NO: 3212113 - protein, 56 aa, Plasmodium falciparum
DDDNKEESKEKYFDNKNKSSEYNNNNNNNNNNNNEDNNEDNNENNIDNDNDNNNNI

SEQ ID NO: 3212114 - protein, 6 aa, Plasmodium falciparum
DDDNKM

SEQ ID NO: 3212115 - protein, 26 aa, Plasmodium falciparum
DDDNNNGNNNNNNNNNNNNNNNNNNN

SEQ ID NO: 3212116 - protein, 38 aa, Plasmodium falciparum
DDDNNNIYDESKRYKNKNALKNEVEEKEKEKTNVSNIN

SEQ ID NO: 3212117 - protein, 32 aa, Plasmodium falciparum
DDDNNNNDNNNNNNDNNNNNNNSNNFSNYPNN

SEQ ID NO: 3212118 - protein, 12 aa, Plasmodium falciparum
DDDNNNNNNNNK

SEQ ID NO: 3212119 - protein, 22 aa, Plasmodium falciparum
DDDNNTNKRNDVSSSSSSSSLY

SEQ ID NO: 3212120 - protein, 9 aa, Plasmodium falciparum
DDDNRYNPT

SEQ ID NO: 3212121 - protein, 7 aa, Plasmodium falciparum
DDDNYKE

SEQ ID NO: 3212122 - protein, 6 aa, Plasmodium falciparum
DDDPLN

SEQ ID NO: 3212123 - protein, 10 aa, Plasmodium falciparum
DDDPTNRNKG

SEQ ID NO: 3212124 - protein, 24 aa, Plasmodium falciparum
DDDQYEDNYDDDNDNDDDDEYDHD

SEQ ID NO: 3212125 - protein, 38 aa, Plasmodium falciparum
DDDREDNYRYKNNDKYDYNNDYNNDKGYSFEKKDEYKE

SEQ ID NO: 3212126 - protein, 4 aa, Plasmodium falciparum
DDDS

SEQ ID NO: 3212127 - protein, 35 aa, Plasmodium falciparum
DDDSCYEDSYESDGICNNGQKNKNKNKKKVEQKQI

SEQ ID NO: 3212128 - protein, 8 aa, Plasmodium falciparum
DDDSIDGD

SEQ ID NO: 3212129 - protein, 4 aa, Plasmodium falciparum
DDDT

SEQ ID NO: 3212130 - protein, 6 aa, Plasmodium falciparum
DDDTII

SEQ ID NO: 3212131 - protein, 19 aa, Plasmodium falciparum
DDDTSTFHGNTSSSENSNY

SEQ ID NO: 3212132 - protein, 12 aa, Plasmodium falciparum
DDDTSTQEKMSP

SEQ ID NO: 3212133 - protein, 8 aa, Plasmodium falciparum
DDDVESKI

SEQ ID NO: 3212134 - protein, 5 aa, Plasmodium falciparum
DDDVR

SEQ ID NO: 3212135 - protein, 25 aa, Plasmodium falciparum
DDDYDDNHNDAEKDMNNKMNEQDEE

SEQ ID NO: 3212136 - protein, 26 aa, Plasmodium falciparum
DDDYHDDTDEQNNNEYYNKDDTKKNI

SEQ ID NO: 3212137 - protein, 7 aa, Plasmodium falciparum
DDDYPNE

SEQ ID NO: 3212138 - protein, 5 aa, Plasmodium falciparum
DDDYV

SEQ ID NO: 3212139 - protein, 7 aa, Plasmodium falciparum
DDEAHIK

SEQ ID NO: 3212140 - protein, 4 aa, Plasmodium falciparum
DDED

SEQ ID NO: 3212141 - protein, 30 aa, Plasmodium falciparum
DDEDDDNNNKNNDNNNNNNNNNNNNNNNKG

SEQ ID NO: 3212142 - protein, 18 aa, Plasmodium falciparum
DDEDEEDDEDTAKPSTSS

SEQ ID NO: 3212143 - protein, 6 aa, Plasmodium falciparum
DDEDKE

SEQ ID NO: 3212144 - protein, 35 aa, Plasmodium falciparum
DDEDQTEQDKYNDDDYDDDDNIKKKFKSKKNADLT

SEQ ID NO: 3212145 - protein, 5 aa, Plasmodium falciparum
DDEDV

SEQ ID NO: 3212146 - protein, 7 aa, Plasmodium falciparum
DDEEADE

SEQ ID NO: 3212147 - protein, 14 aa, Plasmodium falciparum
DDEEEDDEGESETI

SEQ ID NO: 3212148 - protein, 15 aa, Plasmodium falciparum
DDEEEDNQNENGYQN

SEQ ID NO: 3212149 - protein, 23 aa, Plasmodium falciparum
DDEEEEEEEQENPQEQLKRGKIP

SEQ ID NO: 3212150 - protein, 15 aa, Plasmodium falciparum
DDEEEENNKDNTNNN

SEQ ID NO: 3212151 - protein, 5 aa, Plasmodium falciparum
DDEEI

SEQ ID NO: 3212152 - protein, 8 aa, Plasmodium falciparum
DDEEKKEM

SEQ ID NO: 3212153 - protein, 12 aa, Plasmodium falciparum
DDEEKKQRDELE

SEQ ID NO: 3212154 - protein, 13 aa, Plasmodium falciparum
DDEENSTNDPIEK

SEQ ID NO: 3212155 - protein, 7 aa, Plasmodium falciparum
DDEERKQ

SEQ ID NO: 3212156 - protein, 31 aa, Plasmodium falciparum
DDEETKNKNKTNVNQKKKKNPNDKLDKNERR

SEQ ID NO: 3212157 - protein, 170 aa, Plasmodium falciparum
DDEEVDDDVESDDLKNKSKNKSKSKQDEKKKNDKKKKNPHDTEDDEDEDLNEEDEEENDEDEEHKKKNEKKKKDGDDDEPDDEHDEEDEEKEKKKKKEKNKEKNNKKNNNKNIKPHEDHHKNDHDHEHHEENHKQKYKEENNKKHQEKQHEEHQNNNNHKENIKKEENHE

SEQ ID NO: 3212158 - protein, 5 aa, Plasmodium falciparum
DDEIY

SEQ ID NO: 3212159 - protein, 9 aa, Plasmodium falciparum
DDEKGTYNS

SEQ ID NO: 3212160 - protein, 15 aa, Plasmodium falciparum
DDEKHVHSERNQKYS

SEQ ID NO: 3212161 - protein, 21 aa, Plasmodium falciparum
DDEKKGNLSHERKYKKRDDNI

SEQ ID NO: 3212162 - protein, 7 aa, Plasmodium falciparum
DDEKKGQ

SEQ ID NO: 3212163 - protein, 33 aa, Plasmodium falciparum
DDEKKKKEQQQDDEEDEEDDEDDDEEDDADNDL

SEQ ID NO: 3212164 - protein, 18 aa, Plasmodium falciparum
DDEKKNKNNDGNDNRYDY

SEQ ID NO: 3212165 - protein, 31 aa, Plasmodium falciparum
DDEKNENTQNGDISANQHEQRNNDERAYSRL

SEQ ID NO: 3212166 - protein, 8 aa, Plasmodium falciparum
DDEKNKKK

SEQ ID NO: 3212167 - protein, 6 aa, Plasmodium falciparum
DDEKNV

SEQ ID NO: 3212168 - protein, 15 aa, Plasmodium falciparum
DDELENQKFETINID

SEQ ID NO: 3212169 - protein, 13 aa, Plasmodium falciparum
DDENIANEINEKK

SEQ ID NO: 3212170 - protein, 7 aa, Plasmodium falciparum
DDENIPC

SEQ ID NO: 3212171 - protein, 8 aa, Plasmodium falciparum
DDENISNN

SEQ ID NO: 3212172 - protein, 14 aa, Plasmodium falciparum
DDENMGNAINGGGK

SEQ ID NO: 3212173 - protein, 12 aa, Plasmodium falciparum
DDENNEDTEKKV

SEQ ID NO: 3212174 - protein, 9 aa, Plasmodium falciparum
DDENNKNRM

SEQ ID NO: 3212175 - protein, 8 aa, Plasmodium falciparum
DDENPSVD

SEQ ID NO: 3212176 - protein, 24 aa, Plasmodium falciparum
DDEQAEKNGTKDEEIKDKGDGYEE

SEQ ID NO: 3212177 - protein, 10 aa, Plasmodium falciparum
DDEQEKEQKG

SEQ ID NO: 3212178 - protein, 19 aa, Plasmodium falciparum
DDEQQNDVYEDTEEESDNY

SEQ ID NO: 3212179 - protein, 11 aa, Plasmodium falciparum
DDEQSDQDKEY

SEQ ID NO: 3212180 - protein, 9 aa, Plasmodium falciparum
DDERNNKNN

SEQ ID NO: 3212181 - protein, 6 aa, Plasmodium falciparum
DDERRR

SEQ ID NO: 3212182 - protein, 44 aa, Plasmodium falciparum
DDESDKKDKIQDNNKGLNVTTNKTNLKNKLGNNTKQINQGTKPF

SEQ ID NO: 3212183 - protein, 8 aa, Plasmodium falciparum
DDESTYDD

SEQ ID NO: 3212184 - protein, 4 aa, Plasmodium falciparum
DDET

SEQ ID NO: 3212185 - protein, 9 aa, Plasmodium falciparum
DDETNNSSS

SEQ ID NO: 3212186 - protein, 7 aa, Plasmodium falciparum
DDEVRKN

SEQ ID NO: 3212187 - protein, 15 aa, Plasmodium falciparum
DDEYKEKVANAEKSY

SEQ ID NO: 3212188 - protein, 14 aa, Plasmodium falciparum
DDFDNNNNNNNNNI

SEQ ID NO: 3212189 - protein, 5 aa, Plasmodium falciparum
DDFND

SEQ ID NO: 3212190 - protein, 5 aa, Plasmodium falciparum
DDFSN

SEQ ID NO: 3212191 - protein, 6 aa, Plasmodium falciparum
DDFSNY

SEQ ID NO: 3212192 - protein, 6 aa, Plasmodium falciparum
DDFTNG

SEQ ID NO: 3212193 - protein, 78 aa, Plasmodium falciparum
DDGDNEYEDHDDKNDDDKNYDNENDDDKNDDDKNDDDKNDDDKNDDDKNDDEENYNDTEEKVKNNDIHNSSANSNNEV

SEQ ID NO: 3212194 - protein, 7 aa, Plasmodium falciparum
DDGDNSL

SEQ ID NO: 3212195 - protein, 6 aa, Plasmodium falciparum
DDGDSH

SEQ ID NO: 3212196 - protein, 77 aa, Plasmodium falciparum
DDGEEEENVNNNDNNNDNNNDNDNSSDNNNNDDGSNDTESCSKINKSKYKGKEKKDVKENTDDKNLSDSNSNNSKKK

SEQ ID NO: 3212197 - protein, 26 aa, Plasmodium falciparum
DDGGEEPKEYSHKKKQVNNKKKWKKQ

SEQ ID NO: 3212198 - protein, 4 aa, Plasmodium falciparum
DDGK

SEQ ID NO: 3212199 - protein, 10 aa, Plasmodium falciparum
DDGKPKKEFS

SEQ ID NO: 3212200 - protein, 7 aa, Plasmodium falciparum
DDGNKNV

SEQ ID NO: 3212201 - protein, 5 aa, Plasmodium falciparum
DDGPH

SEQ ID NO: 3212202 - protein, 20 aa, Plasmodium falciparum
DDGRYNKKKEIKNRSPRERK

SEQ ID NO: 3212203 - protein, 14 aa, Plasmodium falciparum
DDGSYEEQSCARKR

SEQ ID NO: 3212204 - protein, 9 aa, Plasmodium falciparum
DDGYPSQSN

SEQ ID NO: 3212205 - protein, 14 aa, Plasmodium falciparum
DDHDNESYTSEASS

SEQ ID NO: 3212206 - protein, 15 aa, Plasmodium falciparum
DDHDTSTVDSNNMDV

SEQ ID NO: 3212207 - protein, 19 aa, Plasmodium falciparum
DDHHDKPYTYQSKDKEEIK

SEQ ID NO: 3212208 - protein, 7 aa, Plasmodium falciparum
DDHINND

SEQ ID NO: 3212209 - protein, 4 aa, Plasmodium falciparum
DDHK

SEQ ID NO: 3212210 - protein, 25 aa, Plasmodium falciparum
DDHNGWDDDEKKNKCSYYQEKRETD

SEQ ID NO: 3212211 - protein, 12 aa, Plasmodium falciparum
DDHNNDDSNNYY

SEQ ID NO: 3212212 - protein, 23 aa, Plasmodium falciparum
DDHNNNDRNNVSNNNNEDDDEDE

SEQ ID NO: 3212213 - protein, 16 aa, Plasmodium falciparum
DDHNNNNNNNNKMNES

SEQ ID NO: 3212214 - protein, 31 aa, Plasmodium falciparum
DDHSEEGKGQHKNQCQYDENDQNDQNEQSDL

SEQ ID NO: 3212215 - protein, 16 aa, Plasmodium falciparum
DDHTNNNRKDNSVSRE

SEQ ID NO: 3212216 - protein, 17 aa, Plasmodium falciparum
DDHTPMDEKNKDSRCEG

SEQ ID NO: 3212217 - protein, 5 aa, Plasmodium falciparum
DDHVD

SEQ ID NO: 3212218 - protein, 13 aa, Plasmodium falciparum
DDHVEKSIGSDGI

SEQ ID NO: 3212219 - protein, 5 aa, Plasmodium falciparum
DDIDH

SEQ ID NO: 3212220 - protein, 4 aa, Plasmodium falciparum
DDIE

SEQ ID NO: 3212221 - protein, 31 aa, Plasmodium falciparum
DDIGSNNFSYDSNDSSKIHNRKNNDKSIDMN

SEQ ID NO: 3212222 - protein, 7 aa, Plasmodium falciparum
DDIKDMK

SEQ ID NO: 3212223 - protein, 11 aa, Plasmodium falciparum
DDIKEKNESIN

SEQ ID NO: 3212224 - protein, 17 aa, Plasmodium falciparum
DDIKKDDVKDDIKKDDI

SEQ ID NO: 3212225 - protein, 13 aa, Plasmodium falciparum
DDIKKKDDIGQST

SEQ ID NO: 3212226 - protein, 12 aa, Plasmodium falciparum
DDIKKKNKSINE

SEQ ID NO: 3212227 - protein, 14 aa, Plasmodium falciparum
DDIKKRNINNSENN

SEQ ID NO: 3212228 - protein, 19 aa, Plasmodium falciparum
DDIKNNEVEKSSSSFTLPK

SEQ ID NO: 3212229 - protein, 11 aa, Plasmodium falciparum
DDIKRNSKDLK

SEQ ID NO: 3212230 - protein, 4 aa, Plasmodium falciparum
DDIN

SEQ ID NO: 3212231 - protein, 5 aa, Plasmodium falciparum
DDINC

SEQ ID NO: 3212232 - protein, 7 aa, Plasmodium falciparum
DDINDKD

SEQ ID NO: 3212233 - protein, 11 aa, Plasmodium falciparum
DDINKNNHVSN

SEQ ID NO: 3212234 - protein, 8 aa, Plasmodium falciparum
DDINNKNN

SEQ ID NO: 3212235 - protein, 35 aa, Plasmodium falciparum
DDINNNNKSSSTNIKKKKKSSKANNTVSNATSLKK

SEQ ID NO: 3212236 - protein, 12 aa, Plasmodium falciparum
DDINNNNNNNNN

SEQ ID NO: 3212237 - protein, 53 aa, Plasmodium falciparum
DDINQDQNTTNQQQEQYNTQQEHYNTQQEHYNTQQEHYNTQQEHYNTQQEQYN

SEQ ID NO: 3212238 - protein, 9 aa, Plasmodium falciparum
DDINSSNEI

SEQ ID NO: 3212239 - protein, 4 aa, Plasmodium falciparum
DDIP

SEQ ID NO: 3212240 - protein, 6 aa, Plasmodium falciparum
DDIPQE

SEQ ID NO: 3212241 - protein, 7 aa, Plasmodium falciparum
DDIPSRN

SEQ ID NO: 3212242 - protein, 16 aa, Plasmodium falciparum
DDIRDDKKKNEESEQN

SEQ ID NO: 3212243 - protein, 5 aa, Plasmodium falciparum
DDIRI

SEQ ID NO: 3212244 - protein, 12 aa, Plasmodium falciparum
DDIRNENSKLKK

SEQ ID NO: 3212245 - protein, 5 aa, Plasmodium falciparum
DDISD

SEQ ID NO: 3212246 - protein, 7 aa, Plasmodium falciparum
DDISTSS

SEQ ID NO: 3212247 - protein, 20 aa, Plasmodium falciparum
DDITEETNTENIQNVSDFLD

SEQ ID NO: 3212248 - protein, 30 aa, Plasmodium falciparum
DDITENEQNEDISKKEKEKIYDETTNDDQT

SEQ ID NO: 3212249 - protein, 5 aa, Plasmodium falciparum
DDITG

SEQ ID NO: 3212250 - protein, 6 aa, Plasmodium falciparum
DDITRK

SEQ ID NO: 3212251 - protein, 20 aa, Plasmodium falciparum
DDIYKEQKQENNKNAKKIKT

SEQ ID NO: 3212252 - protein, 5 aa, Plasmodium falciparum
DDIYN

SEQ ID NO: 3212253 - protein, 24 aa, Plasmodium falciparum
DDIYSGDDDYSGDDDYSGDDIYSG

SEQ ID NO: 3212254 - protein, 20 aa, Plasmodium falciparum
DDIYSGDDIYSGDDIYSGDD

SEQ ID NO: 3212255 - protein, 8 aa, Plasmodium falciparum
DDKASEDH

SEQ ID NO: 3212256 - protein, 5 aa, Plasmodium falciparum
DDKCN

SEQ ID NO: 3212257 - protein, 12 aa, Plasmodium falciparum
DDKDALSSGSIN

SEQ ID NO: 3212258 - protein, 9 aa, Plasmodium falciparum
DDKDDENKL

SEQ ID NO: 3212259 - protein, 8 aa, Plasmodium falciparum
DDKDEKVS

SEQ ID NO: 3212260 - protein, 5 aa, Plasmodium falciparum
DDKDK

SEQ ID NO: 3212261 - protein, 6 aa, Plasmodium falciparum
DDKDYS

SEQ ID NO: 3212262 - protein, 4 aa, Plasmodium falciparum
DDKE

SEQ ID NO: 3212263 - protein, 5 aa, Plasmodium falciparum
DDKEK

SEQ ID NO: 3212264 - protein, 9 aa, Plasmodium falciparum
DDKGSNEFE

SEQ ID NO: 3212265 - protein, 4 aa, Plasmodium falciparum
DDKI

SEQ ID NO: 3212266 - protein, 11 aa, Plasmodium falciparum
DDKIKDNKTNE

SEQ ID NO: 3212267 - protein, 5 aa, Plasmodium falciparum
DDKIN

SEQ ID NO: 3212268 - protein, 6 aa, Plasmodium falciparum
DDKKGS

SEQ ID NO: 3212269 - protein, 9 aa, Plasmodium falciparum
DDKKINKLS

SEQ ID NO: 3212270 - protein, 8 aa, Plasmodium falciparum
DDKKKKKI

SEQ ID NO: 3212271 - protein, 10 aa, Plasmodium falciparum
DDKKKTEAIP

SEQ ID NO: 3212272 - protein, 5 aa, Plasmodium falciparum
DDKKN

SEQ ID NO: 3212273 - protein, 8 aa, Plasmodium falciparum
DDKKNKST

SEQ ID NO: 3212274 - protein, 11 aa, Plasmodium falciparum
DDKKRGNECAS

SEQ ID NO: 3212275 - protein, 19 aa, Plasmodium falciparum
DDKKRKKSTESSTVDEKGD

SEQ ID NO: 3212276 - protein, 25 aa, Plasmodium falciparum
DDKKRRKKKKEKKSEYADDKNDELN

SEQ ID NO: 3212277 - protein, 6 aa, Plasmodium falciparum
DDKKTD

SEQ ID NO: 3212278 - protein, 9 aa, Plasmodium falciparum
DDKNDENID

SEQ ID NO: 3212279 - protein, 8 aa, Plasmodium falciparum
DDKNDNNL

SEQ ID NO: 3212280 - protein, 6 aa, Plasmodium falciparum
DDKNDY

SEQ ID NO: 3212281 - protein, 19 aa, Plasmodium falciparum
DDKNEEYPSRYNNKNLEES

SEQ ID NO: 3212282 - protein, 9 aa, Plasmodium falciparum
DDKNENNIT

SEQ ID NO: 3212283 - protein, 13 aa, Plasmodium falciparum
DDKNEYKKDKSKN

SEQ ID NO: 3212284 - protein, 14 aa, Plasmodium falciparum
DDKNGNKNNKDYQD

SEQ ID NO: 3212285 - protein, 12 aa, Plasmodium falciparum
DDKNKRKMNREN

SEQ ID NO: 3212286 - protein, 6 aa, Plasmodium falciparum
DDKNNN

SEQ ID NO: 3212287 - protein, 9 aa, Plasmodium falciparum
DDKNNNNNI

SEQ ID NO: 3212288 - protein, 14 aa, Plasmodium falciparum
DDKNNVKNKNSDIN

SEQ ID NO: 3212289 - protein, 23 aa, Plasmodium falciparum
DDKNSKKPKKKKKKLISPKDMPS

SEQ ID NO: 3212290 - protein, 8 aa, Plasmodium falciparum
DDKQNRNV

SEQ ID NO: 3212291 - protein, 6 aa, Plasmodium falciparum
DDKRTC

SEQ ID NO: 3212292 - protein, 5 aa, Plasmodium falciparum
DDKRY

SEQ ID NO: 3212293 - protein, 19 aa, Plasmodium falciparum
DDKSFGDTKGVGDTKGFGD

SEQ ID NO: 3212294 - protein, 9 aa, Plasmodium falciparum
DDKSKYKKK

SEQ ID NO: 3212295 - protein, 4 aa, Plasmodium falciparum
DDKT

SEQ ID NO: 3212296 - protein, 11 aa, Plasmodium falciparum
DDKTKKSDNIT

SEQ ID NO: 3212297 - protein, 5 aa, Plasmodium falciparum
DDKTN

SEQ ID NO: 3212298 - protein, 27 aa, Plasmodium falciparum
DDKVKNTDSITNPNNNHNNNNSGDNNF

SEQ ID NO: 3212299 - protein, 4 aa, Plasmodium falciparum
DDKY

SEQ ID NO: 3212300 - protein, 8 aa, Plasmodium falciparum
DDKYDKKE

SEQ ID NO: 3212301 - protein, 5 aa, Plasmodium falciparum
DDKYE

SEQ ID NO: 3212302 - protein, 8 aa, Plasmodium falciparum
DDKYEDYD

SEQ ID NO: 3212303 - protein, 9 aa, Plasmodium falciparum
DDKYGDNNN

SEQ ID NO: 3212304 - protein, 9 aa, Plasmodium falciparum
DDKYSLNKK

SEQ ID NO: 3212305 - protein, 5 aa, Plasmodium falciparum
DDKYY

SEQ ID NO: 3212306 - protein, 4 aa, Plasmodium falciparum
DDLD

SEQ ID NO: 3212307 - protein, 4 aa, Plasmodium falciparum
DDLE

SEQ ID NO: 3212308 - protein, 14 aa, Plasmodium falciparum
DDLEKEKRKKKSQH

SEQ ID NO: 3212309 - protein, 4 aa, Plasmodium falciparum
DDLH

SEQ ID NO: 3212310 - protein, 13 aa, Plasmodium falciparum
DDLHKTYETETIR

SEQ ID NO: 3212311 - protein, 9 aa, Plasmodium falciparum
DDLKEYAED

SEQ ID NO: 3212312 - protein, 9 aa, Plasmodium falciparum
DDLKNKKSG

SEQ ID NO: 3212313 - protein, 8 aa, Plasmodium falciparum
DDLKNSSY

SEQ ID NO: 3212314 - protein, 8 aa, Plasmodium falciparum
DDLSNGNN

SEQ ID NO: 3212315 - protein, 10 aa, Plasmodium falciparum
DDMDNNTSYN

SEQ ID NO: 3212316 - protein, 47 aa, Plasmodium falciparum
DDMENEDDDEDDIDDDDDEDDEEDVEDDDEVDDEVDDEVDDEVDDEE

SEQ ID NO: 3212317 - protein, 35 aa, Plasmodium falciparum
DDNAEYSMNENEDNSDNDDDNDDDNDNDDDNNKEW

SEQ ID NO: 3212318 - protein, 12 aa, Plasmodium falciparum
DDNDISSKNGNS

SEQ ID NO: 3212319 - protein, 10 aa, Plasmodium falciparum
DDNDISTVDS

SEQ ID NO: 3212320 - protein, 8 aa, Plasmodium falciparum
DDNDKSDN

SEQ ID NO: 3212321 - protein, 15 aa, Plasmodium falciparum
DDNDTSTVDSNNMDV

SEQ ID NO: 3212322 - protein, 11 aa, Plasmodium falciparum
DDNEDKKKKKI

SEQ ID NO: 3212323 - protein, 11 aa, Plasmodium falciparum
DDNEEDEYEEY

SEQ ID NO: 3212324 - protein, 5 aa, Plasmodium falciparum
DDNEK

SEQ ID NO: 3212325 - protein, 15 aa, Plasmodium falciparum
DDNEKEGKDINPNDN

SEQ ID NO: 3212326 - protein, 7 aa, Plasmodium falciparum
DDNESNE

SEQ ID NO: 3212327 - protein, 17 aa, Plasmodium falciparum
DDNFNNDDKKGFNDDTY

SEQ ID NO: 3212328 - protein, 7 aa, Plasmodium falciparum
DDNIEPV

SEQ ID NO: 3212329 - protein, 10 aa, Plasmodium falciparum
DDNIKENDNI

SEQ ID NO: 3212330 - protein, 73 aa, Plasmodium falciparum
DDNINDDNINDDNINDDNINDDNINDDNINDDNINDDNINDDNINDDNINDDNINDDNINDDNINDDNINDDN

SEQ ID NO: 3212331 - protein, 15 aa, Plasmodium falciparum
DDNINEKNRNNDKLD

SEQ ID NO: 3212332 - protein, 18 aa, Plasmodium falciparum
DDNINNNDVNDDNINNNH

SEQ ID NO: 3212333 - protein, 5 aa, Plasmodium falciparum
DDNIR

SEQ ID NO: 3212334 - protein, 10 aa, Plasmodium falciparum
DDNKERKNIS

SEQ ID NO: 3212335 - protein, 10 aa, Plasmodium falciparum
DDNKKEDKNS

SEQ ID NO: 3212336 - protein, 7 aa, Plasmodium falciparum
DDNKKVT

SEQ ID NO: 3212337 - protein, 9 aa, Plasmodium falciparum
DDNKNKSET

SEQ ID NO: 3212338 - protein, 28 aa, Plasmodium falciparum
DDNKNNKYDRKKDTNNDEYYNKNGNIKV

SEQ ID NO: 3212339 - protein, 20 aa, Plasmodium falciparum
DDNKYDKNGNVNYDNYNKND

SEQ ID NO: 3212340 - protein, 9 aa, Plasmodium falciparum
DDNKYKDNL

SEQ ID NO: 3212341 - protein, 26 aa, Plasmodium falciparum
DDNLKNEYKKHNEGKHNRDRKKSAED

SEQ ID NO: 3212342 - protein, 17 aa, Plasmodium falciparum
DDNLNYDDNEDDEYGNY

SEQ ID NO: 3212343 - protein, 11 aa, Plasmodium falciparum
DDNNDAKSLQT

SEQ ID NO: 3212344 - protein, 11 aa, Plasmodium falciparum
DDNNDDDEIEY

SEQ ID NO: 3212345 - protein, 17 aa, Plasmodium falciparum
DDNNDDNNGDNNGDNYN

SEQ ID NO: 3212346 - protein, 30 aa, Plasmodium falciparum
DDNNDEDDASCGGNHNGNNNRNGDSEDDDD

SEQ ID NO: 3212347 - protein, 9 aa, Plasmodium falciparum
DDNNDEEID

SEQ ID NO: 3212348 - protein, 9 aa, Plasmodium falciparum
DDNNDNNMK

SEQ ID NO: 3212349 - protein, 42 aa, Plasmodium falciparum
DDNNEEENNDHTDNNNKNNNNNNNNNNNKNNNNNNNNNKNNM

SEQ ID NO: 3212350 - protein, 9 aa, Plasmodium falciparum
DDNNENNDN

SEQ ID NO: 3212351 - protein, 23 aa, Plasmodium falciparum
DDNNIGDDEFNSEVNNDNNGSYE

SEQ ID NO: 3212352 - protein, 26 aa, Plasmodium falciparum
DDNNKEKKKKSKKKRACQKSEQMNEK

SEQ ID NO: 3212353 - protein, 7 aa, Plasmodium falciparum
DDNNKEN

SEQ ID NO: 3212354 - protein, 19 aa, Plasmodium falciparum
DDNNKPKTNAGPKSNPHDY

SEQ ID NO: 3212355 - protein, 9 aa, Plasmodium falciparum
DDNNLEGDS

SEQ ID NO: 3212356 - protein, 5 aa, Plasmodium falciparum
DDNNN

SEQ ID NO: 3212357 - protein, 15 aa, Plasmodium falciparum
DDNNNDDNNNDDNYE

SEQ ID NO: 3212358 - protein, 39 aa, Plasmodium falciparum
DDNNNDNNNNHDDNHDDDNHDDDNHDDDDHDDNLPTERP

SEQ ID NO: 3212359 - protein, 7 aa, Plasmodium falciparum
DDNNNNI

SEQ ID NO: 3212360 - protein, 8 aa, Plasmodium falciparum
DDNNNNIN

SEQ ID NO: 3212361 - protein, 33 aa, Plasmodium falciparum
DDNNNNNDDDNNGDDDNNNNDDNNGDDNNDDNN

SEQ ID NO: 3212362 - protein, 45 aa, Plasmodium falciparum
DDNNNNNNNNNNNNNNNNNNNNNNNNNNNNNNNNNNNNNNNNNNG

SEQ ID NO: 3212363 - protein, 15 aa, Plasmodium falciparum
DDNNNNNNNNVPTEN

SEQ ID NO: 3212364 - protein, 9 aa, Plasmodium falciparum
DDNNNNNNR

SEQ ID NO: 3212365 - protein, 5 aa, Plasmodium falciparum
DDNNY

SEQ ID NO: 3212366 - protein, 8 aa, Plasmodium falciparum
DDNNYNSP

SEQ ID NO: 3212367 - protein, 5 aa, Plasmodium falciparum
DDNQN

SEQ ID NO: 3212368 - protein, 4 aa, Plasmodium falciparum
DDNS

SEQ ID NO: 3212369 - protein, 6 aa, Plasmodium falciparum
DDNTED

SEQ ID NO: 3212370 - protein, 9 aa, Plasmodium falciparum
DDNTIDNKK

SEQ ID NO: 3212371 - protein, 8 aa, Plasmodium falciparum
DDNTLTNA

SEQ ID NO: 3212372 - protein, 8 aa, Plasmodium falciparum
DDNTNGNK

SEQ ID NO: 3212373 - protein, 57 aa, Plasmodium falciparum
DDNTNTCDNNTNTCDNNTNTCDNNTNTCDNNTNTCDNNTNTCDNNTNTCDNNTNTCD

SEQ ID NO: 3212374 - protein, 9 aa, Plasmodium falciparum
DDNTRNNMK

SEQ ID NO: 3212375 - protein, 21 aa, Plasmodium falciparum
DDNTSLNKQKINEKKKKNQNI

SEQ ID NO: 3212376 - protein, 6 aa, Plasmodium falciparum
DDNTYN

SEQ ID NO: 3212377 - protein, 14 aa, Plasmodium falciparum
DDNVDNDDEDQGLK

SEQ ID NO: 3212378 - protein, 11 aa, Plasmodium falciparum
DDNVKKENKMD

SEQ ID NO: 3212379 - protein, 32 aa, Plasmodium falciparum
DDNVSNKYRDDDKNVENNHKNTYKRNKQTSKN

SEQ ID NO: 3212380 - protein, 4 aa, Plasmodium falciparum
DDNY

SEQ ID NO: 3212381 - protein, 15 aa, Plasmodium falciparum
DDNYHYNKNDNETKN

SEQ ID NO: 3212382 - protein, 8 aa, Plasmodium falciparum
DDNYPEDK

SEQ ID NO: 3212383 - protein, 4 aa, Plasmodium falciparum
DDPI

SEQ ID NO: 3212384 - protein, 4 aa, Plasmodium falciparum
DDPK

SEQ ID NO: 3212385 - protein, 10 aa, Plasmodium falciparum
DDPKGKKEFS

SEQ ID NO: 3212386 - protein, 11 aa, Plasmodium falciparum
DDPKGKKEFSN

SEQ ID NO: 3212387 - protein, 4 aa, Plasmodium falciparum
DDPN

SEQ ID NO: 3212388 - protein, 5 aa, Plasmodium falciparum
DDPNN

SEQ ID NO: 3212389 - protein, 7 aa, Plasmodium falciparum
DDPSIKY

SEQ ID NO: 3212390 - protein, 12 aa, Plasmodium falciparum
DDPTYYNKSKRS

SEQ ID NO: 3212391 - protein, 9 aa, Plasmodium falciparum
DDQDNGEKI

SEQ ID NO: 3212392 - protein, 7 aa, Plasmodium falciparum
DDQDNID

SEQ ID NO: 3212393 - protein, 111 aa, Plasmodium falciparum
DDQEDQIEKKYDPDQADVKRGDNKRGDRKGGDRKRGDRKRGDDNYDDNYDDKYDDDNYDDKYDDDNYDDKYNDNNYDDNYDDEKKKNVHTSDYENNCSQSSKETTSESEHA

SEQ ID NO: 3212394 - protein, 6 aa, Plasmodium falciparum
DDQEIK

SEQ ID NO: 3212395 - protein, 4 aa, Plasmodium falciparum
DDQH

SEQ ID NO: 3212396 - protein, 20 aa, Plasmodium falciparum
DDQKCGEKNYMDDKEKTSNI

SEQ ID NO: 3212397 - protein, 10 aa, Plasmodium falciparum
DDQKEDDYGN

SEQ ID NO: 3212398 - protein, 13 aa, Plasmodium falciparum
DDQLDDNPSTDAD

SEQ ID NO: 3212399 - protein, 49 aa, Plasmodium falciparum
DDQNDDQNGDQNGDQNDDQNGDKKNMSGGNFQNDPSDKCNNDNPSFNNK

SEQ ID NO: 3212400 - protein, 8 aa, Plasmodium falciparum
DDQNETPN

SEQ ID NO: 3212401 - protein, 4 aa, Plasmodium falciparum
DDQR

SEQ ID NO: 3212402 - protein, 5 aa, Plasmodium falciparum
DDQSD

SEQ ID NO: 3212403 - protein, 18 aa, Plasmodium falciparum
DDQSETEAISNDNPTLEE

SEQ ID NO: 3212404 - protein, 5 aa, Plasmodium falciparum
DDREG

SEQ ID NO: 3212405 - protein, 39 aa, Plasmodium falciparum
DDRKGNKMGDDGDDNDDDDDGDDDNNNNNKSCVKPKTFA

SEQ ID NO: 3212406 - protein, 6 aa, Plasmodium falciparum
DDRREV

SEQ ID NO: 3212407 - protein, 8 aa, Plasmodium falciparum
DDSDHVDE

SEQ ID NO: 3212408 - protein, 14 aa, Plasmodium falciparum
DDSDNNSSDLDDFD

SEQ ID NO: 3212409 - protein, 11 aa, Plasmodium falciparum
DDSEHNTKPIS

SEQ ID NO: 3212410 - protein, 7 aa, Plasmodium falciparum
DDSENKH

SEQ ID NO: 3212411 - protein, 16 aa, Plasmodium falciparum
DDSEWREHNKKDRMTS

SEQ ID NO: 3212412 - protein, 12 aa, Plasmodium falciparum
DDSFDDKNPFDE

SEQ ID NO: 3212413 - protein, 11 aa, Plasmodium falciparum
DDSGDNGSYEN

SEQ ID NO: 3212414 - protein, 29 aa, Plasmodium falciparum
DDSINKDDNINKDNINNNNNNNNNNNDNK

SEQ ID NO: 3212415 - protein, 53 aa, Plasmodium falciparum
DDSKKTEDMEKNGETRKASKRDNTNNNNNNNNNNNNNNNYNNNNYNNNNNDKD

SEQ ID NO: 3212416 - protein, 7 aa, Plasmodium falciparum
DDSKNKC

SEQ ID NO: 3212417 - protein, 10 aa, Plasmodium falciparum
DDSKSATEFK

SEQ ID NO: 3212418 - protein, 8 aa, Plasmodium falciparum
DDSKYKDN

SEQ ID NO: 3212419 - protein, 9 aa, Plasmodium falciparum
DDSKYKDNL

SEQ ID NO: 3212420 - protein, 7 aa, Plasmodium falciparum
DDSLTSI

SEQ ID NO: 3212421 - protein, 216 aa, Plasmodium falciparum
DDSNESDKSDDNDERDDDDDSNDNDESDDSNESDESDDNDESDDDDERDDESDDDDERDDESDDNDDSNDNDENNDSNESDDNNESDDNNESDDDDERDDERDDNDDNDDSNESDDSNDNDESNDSNESDDNDDNDDSDNSNDSNESDNSNDGNESNDSDVCDDSNESDDNNDSHDNDESNNSNDSDVCDDSNESDESDHSNDCDDSNNSNDCDDK

SEQ ID NO: 3212422 - protein, 12 aa, Plasmodium falciparum
DDSNKENSSYTF

SEQ ID NO: 3212423 - protein, 7 aa, Plasmodium falciparum
DDSPGFK

SEQ ID NO: 3212424 - protein, 9 aa, Plasmodium falciparum
DDSPNGFDG

SEQ ID NO: 3212425 - protein, 7 aa, Plasmodium falciparum
DDSRARH

SEQ ID NO: 3212426 - protein, 107 aa, Plasmodium falciparum
DDSRQKKKNKYGKDHSDQEKDSPSKINNRSKRNKVKKDKEVGNINDDKINNNTNDDNKNNNINGDNKNNNINGDNKNNNINGDKINNNINGDKINNNINGDKISKNY

SEQ ID NO: 3212427 - protein, 7 aa, Plasmodium falciparum
DDSSSQS

SEQ ID NO: 3212428 - protein, 22 aa, Plasmodium falciparum
DDSVSSQESFNNNNNNNNVNMS

SEQ ID NO: 3212429 - protein, 8 aa, Plasmodium falciparum
DDSYQNHD

SEQ ID NO: 3212430 - protein, 7 aa, Plasmodium falciparum
DDTDEMN

SEQ ID NO: 3212431 - protein, 11 aa, Plasmodium falciparum
DDTDTYDPVPT

SEQ ID NO: 3212432 - protein, 7 aa, Plasmodium falciparum
DDTEEEP

SEQ ID NO: 3212433 - protein, 11 aa, Plasmodium falciparum
DDTEGEEMEDQ

SEQ ID NO: 3212434 - protein, 27 aa, Plasmodium falciparum
DDTHDNMDEKKKKKLIKNKKKKKKAIN

SEQ ID NO: 3212435 - protein, 21 aa, Plasmodium falciparum
DDTKIKSNDNNRKNNMVSSSN

SEQ ID NO: 3212436 - protein, 6 aa, Plasmodium falciparum
DDTKKK

SEQ ID NO: 3212437 - protein, 14 aa, Plasmodium falciparum
DDTKKQPKKEEYQY

SEQ ID NO: 3212438 - protein, 31 aa, Plasmodium falciparum
DDTKNNKFKNENNIDYNNEEGKIYEDNNYSN

SEQ ID NO: 3212439 - protein, 13 aa, Plasmodium falciparum
DDTKRNVKGASNI

SEQ ID NO: 3212440 - protein, 8 aa, Plasmodium falciparum
DDTKYDYN

SEQ ID NO: 3212441 - protein, 5 aa, Plasmodium falciparum
DDTNG

SEQ ID NO: 3212442 - protein, 7 aa, Plasmodium falciparum
DDTNNKL

SEQ ID NO: 3212443 - protein, 15 aa, Plasmodium falciparum
DDTNNNNNNNNNNNL

SEQ ID NO: 3212444 - protein, 13 aa, Plasmodium falciparum
DDTNYSSSCSSDE

SEQ ID NO: 3212445 - protein, 20 aa, Plasmodium falciparum
DDTPQNDNISNVDDNKNING

SEQ ID NO: 3212446 - protein, 5 aa, Plasmodium falciparum
DDTPT

SEQ ID NO: 3212447 - protein, 13 aa, Plasmodium falciparum
DDTQIYDSSKESN

SEQ ID NO: 3212448 - protein, 6 aa, Plasmodium falciparum
DDTRDE

SEQ ID NO: 3212449 - protein, 9 aa, Plasmodium falciparum
DDTSERGRS

SEQ ID NO: 3212450 - protein, 6 aa, Plasmodium falciparum
DDTSNY

SEQ ID NO: 3212451 - protein, 10 aa, Plasmodium falciparum
DDTSTENNIN

SEQ ID NO: 3212452 - protein, 31 aa, Plasmodium falciparum
DDTSTITTSTNNNNIRTDQNGDNKKDDSNKD

SEQ ID NO: 3212453 - protein, 8 aa, Plasmodium falciparum
DDTSYDEN

SEQ ID NO: 3212454 - protein, 6 aa, Plasmodium falciparum
DDTTLT

SEQ ID NO: 3212455 - protein, 5 aa, Plasmodium falciparum
DDTTY

SEQ ID NO: 3212456 - protein, 19 aa, Plasmodium falciparum
DDVADTEEDGVKKPKEYNA

SEQ ID NO: 3212457 - protein, 5 aa, Plasmodium falciparum
DDVGD

SEQ ID NO: 3212458 - protein, 9 aa, Plasmodium falciparum
DDVGKYKQK

SEQ ID NO: 3212459 - protein, 4 aa, Plasmodium falciparum
DDVI

SEQ ID NO: 3212460 - protein, 10 aa, Plasmodium falciparum
DDVINKEEDD

SEQ ID NO: 3212461 - protein, 24 aa, Plasmodium falciparum
DDVNHNKNNDNNGDDSESHLNDQG

SEQ ID NO: 3212462 - protein, 64 aa, Plasmodium falciparum
DDVNKSGGVSLNDDNINNDNNNTNNNTNNNTNNNNNNTNNNTNNNNNNKNCEGKANDQTNKKKK

SEQ ID NO: 3212463 - protein, 46 aa, Plasmodium falciparum
DDVNNDVNNDVDDDIDDDVNNDVDDDNDDDNDDDNDDDNDDDNGAD

SEQ ID NO: 3212464 - protein, 6 aa, Plasmodium falciparum
DDVRDK

SEQ ID NO: 3212465 - protein, 5 aa, Plasmodium falciparum
DDVRQ

SEQ ID NO: 3212466 - protein, 4 aa, Plasmodium falciparum
DDVS

SEQ ID NO: 3212467 - protein, 6 aa, Plasmodium falciparum
DDVSLK

SEQ ID NO: 3212468 - protein, 7 aa, Plasmodium falciparum
DDVSNNA

SEQ ID NO: 3212469 - protein, 6 aa, Plasmodium falciparum
DDVTNG

SEQ ID NO: 3212470 - protein, 5 aa, Plasmodium falciparum
DDVTP

SEQ ID NO: 3212471 - protein, 7 aa, Plasmodium falciparum
DDVTTSA

SEQ ID NO: 3212472 - protein, 9 aa, Plasmodium falciparum
DDYAENTPF

SEQ ID NO: 3212473 - protein, 18 aa, Plasmodium falciparum
DDYAENTPFNRTPDYYQS

SEQ ID NO: 3212474 - protein, 67 aa, Plasmodium falciparum
DDYDFEGDDDEYDNEYNPRGNRKCRNREYRSNGVNDDSDDQGVEYDEEEEEEDENYNEEEDDDEEED

SEQ ID NO: 3212475 - protein, 18 aa, Plasmodium falciparum
DDYDRNKSRIKNKKNVSF

SEQ ID NO: 3212476 - protein, 9 aa, Plasmodium falciparum
DDYEEKDLR

SEQ ID NO: 3212477 - protein, 25 aa, Plasmodium falciparum
DDYEQNEEFNDNNQSEDMKETNELD

SEQ ID NO: 3212478 - protein, 6 aa, Plasmodium falciparum
DDYETE

SEQ ID NO: 3212479 - protein, 38 aa, Plasmodium falciparum
DDYGDDCSDDYGDDYGDDYGDDYGDDYGDDYGDDYSDD

SEQ ID NO: 3212480 - protein, 4 aa, Plasmodium falciparum
DDYK

SEQ ID NO: 3212481 - protein, 7 aa, Plasmodium falciparum
DDYKQRS

SEQ ID NO: 3212482 - protein, 17 aa, Plasmodium falciparum
DDYLDEEGKVSKKKMKK

SEQ ID NO: 3212483 - protein, 16 aa, Plasmodium falciparum
DDYNDDNKDDYNDDNS

SEQ ID NO: 3212484 - protein, 6 aa, Plasmodium falciparum
DDYNDK

SEQ ID NO: 3212485 - protein, 6 aa, Plasmodium falciparum
DDYPDE

SEQ ID NO: 3212486 - protein, 25 aa, Plasmodium falciparum
DDYPNNYDNYNNEYSYSEEKTRTIN

SEQ ID NO: 3212487 - protein, 8 aa, Plasmodium falciparum
DDYSPPDV

SEQ ID NO: 3212488 - protein, 6 aa, Plasmodium falciparum
DEAKKY

SEQ ID NO: 3212489 - protein, 6 aa, Plasmodium falciparum
DEASNE

SEQ ID NO: 3212490 - protein, 4 aa, Plasmodium falciparum
DEAY

SEQ ID NO: 3212491 - protein, 10 aa, Plasmodium falciparum
DECKTDKEMY

SEQ ID NO: 3212492 - protein, 4 aa, Plasmodium falciparum
DEDA

SEQ ID NO: 3212493 - protein, 8 aa, Plasmodium falciparum
DEDADDND

SEQ ID NO: 3212494 - protein, 4 aa, Plasmodium falciparum
DEDD

SEQ ID NO: 3212495 - protein, 12 aa, Plasmodium falciparum
DEDDEESTGGRR

SEQ ID NO: 3212496 - protein, 6 aa, Plasmodium falciparum
DEDDEH

SEQ ID NO: 3212497 - protein, 7 aa, Plasmodium falciparum
DEDDERI

SEQ ID NO: 3212498 - protein, 18 aa, Plasmodium falciparum
DEDDQYENNNNNNHSNNN

SEQ ID NO: 3212499 - protein, 16 aa, Plasmodium falciparum
DEDEDEDDDETPRAHN

SEQ ID NO: 3212500 - protein, 10 aa, Plasmodium falciparum
DEDEDEDEEV

SEQ ID NO: 3212501 - protein, 9 aa, Plasmodium falciparum
DEDEEGKEA

SEQ ID NO: 3212502 - protein, 8 aa, Plasmodium falciparum
DEDEKDET

SEQ ID NO: 3212503 - protein, 6 aa, Plasmodium falciparum
DEDEKE

SEQ ID NO: 3212504 - protein, 14 aa, Plasmodium falciparum
DEDENTFASTSSSL

SEQ ID NO: 3212505 - protein, 10 aa, Plasmodium falciparum
DEDEQRNNSI

SEQ ID NO: 3212506 - protein, 29 aa, Plasmodium falciparum
DEDGPRDGKKCSGYGEDCKDNLSKKYDTL

SEQ ID NO: 3212507 - protein, 9 aa, Plasmodium falciparum
DEDIGEDKD

SEQ ID NO: 3212508 - protein, 5 aa, Plasmodium falciparum
DEDIP

SEQ ID NO: 3212509 - protein, 18 aa, Plasmodium falciparum
DEDIQDEDIQDEDIQDQN

SEQ ID NO: 3212510 - protein, 6 aa, Plasmodium falciparum
DEDITP

SEQ ID NO: 3212511 - protein, 8 aa, Plasmodium falciparum
DEDKAEEK

SEQ ID NO: 3212512 - protein, 6 aa, Plasmodium falciparum
DEDKKE

SEQ ID NO: 3212513 - protein, 21 aa, Plasmodium falciparum
DEDKKNMGNEPYGSSHTNNSN

SEQ ID NO: 3212514 - protein, 15 aa, Plasmodium falciparum
DEDKRDVSRVSRPRE

SEQ ID NO: 3212515 - protein, 8 aa, Plasmodium falciparum
DEDKTFGH

SEQ ID NO: 3212516 - protein, 16 aa, Plasmodium falciparum
DEDKYDKDDVCEETKR

SEQ ID NO: 3212517 - protein, 4 aa, Plasmodium falciparum
DEDN

SEQ ID NO: 3212518 - protein, 7 aa, Plasmodium falciparum
DEDNEGS

SEQ ID NO: 3212519 - protein, 7 aa, Plasmodium falciparum
DEDNEKD

SEQ ID NO: 3212520 - protein, 7 aa, Plasmodium falciparum
DEDNITE

SEQ ID NO: 3212521 - protein, 5 aa, Plasmodium falciparum
DEDNK

SEQ ID NO: 3212522 - protein, 11 aa, Plasmodium falciparum
DEDNKLKNETS

SEQ ID NO: 3212523 - protein, 20 aa, Plasmodium falciparum
DEDNKNEDIQGDKKTPKKNV

SEQ ID NO: 3212524 - protein, 10 aa, Plasmodium falciparum
DEDNVKKEEP

SEQ ID NO: 3212525 - protein, 6 aa, Plasmodium falciparum
DEDPNY

SEQ ID NO: 3212526 - protein, 15 aa, Plasmodium falciparum
DEDQRRKYDEGELNE

SEQ ID NO: 3212527 - protein, 7 aa, Plasmodium falciparum
DEDRLPS

SEQ ID NO: 3212528 - protein, 18 aa, Plasmodium falciparum
DEDRNNNTHADNNDTSIK

SEQ ID NO: 3212529 - protein, 8 aa, Plasmodium falciparum
DEDSDKCY

SEQ ID NO: 3212530 - protein, 11 aa, Plasmodium falciparum
DEDSDRPEDMN

SEQ ID NO: 3212531 - protein, 8 aa, Plasmodium falciparum
DEDSDYDN

SEQ ID NO: 3212532 - protein, 6 aa, Plasmodium falciparum
DEDSTN

SEQ ID NO: 3212533 - protein, 9 aa, Plasmodium falciparum
DEDSYKSDT

SEQ ID NO: 3212534 - protein, 7 aa, Plasmodium falciparum
DEDTGNK

SEQ ID NO: 3212535 - protein, 9 aa, Plasmodium falciparum
DEDTSNKMD

SEQ ID NO: 3212536 - protein, 4 aa, Plasmodium falciparum
DEEA

SEQ ID NO: 3212537 - protein, 17 aa, Plasmodium falciparum
DEEAKEINDKIKKKKDI

SEQ ID NO: 3212538 - protein, 5 aa, Plasmodium falciparum
DEECS

SEQ ID NO: 3212539 - protein, 4 aa, Plasmodium falciparum
DEED

SEQ ID NO: 3212540 - protein, 9 aa, Plasmodium falciparum
DEEDDYDEA

SEQ ID NO: 3212541 - protein, 5 aa, Plasmodium falciparum
DEEDF

SEQ ID NO: 3212542 - protein, 12 aa, Plasmodium falciparum
DEEDNEYDEDNY

SEQ ID NO: 3212543 - protein, 10 aa, Plasmodium falciparum
DEEDSVKDQN

SEQ ID NO: 3212544 - protein, 12 aa, Plasmodium falciparum
DEEDSVSEQAEE

SEQ ID NO: 3212545 - protein, 10 aa, Plasmodium falciparum
DEEDTYKNEK

SEQ ID NO: 3212546 - protein, 10 aa, Plasmodium falciparum
DEEEDDEDLD

SEQ ID NO: 3212547 - protein, 10 aa, Plasmodium falciparum
DEEEDKRLKE

SEQ ID NO: 3212548 - protein, 6 aa, Plasmodium falciparum
DEEEDN

SEQ ID NO: 3212549 - protein, 35 aa, Plasmodium falciparum
DEEEEEEEEDEEEVEEIEERKKKKRVGKKEEINEE

SEQ ID NO: 3212550 - protein, 20 aa, Plasmodium falciparum
DEEEEEGNHQKEKLNKDNIN

SEQ ID NO: 3212551 - protein, 15 aa, Plasmodium falciparum
DEEEEEKKKNKQEIN

SEQ ID NO: 3212552 - protein, 7 aa, Plasmodium falciparum
DEEEEID

SEQ ID NO: 3212553 - protein, 17 aa, Plasmodium falciparum
DEEEGGGNDECDDDHEE

SEQ ID NO: 3212554 - protein, 6 aa, Plasmodium falciparum
DEEEKK

SEQ ID NO: 3212555 - protein, 8 aa, Plasmodium falciparum
DEEEKKES

SEQ ID NO: 3212556 - protein, 10 aa, Plasmodium falciparum
DEEEKKKEKL

SEQ ID NO: 3212557 - protein, 8 aa, Plasmodium falciparum
DEEEKNGF

SEQ ID NO: 3212558 - protein, 8 aa, Plasmodium falciparum
DEEENDKI

SEQ ID NO: 3212559 - protein, 7 aa, Plasmodium falciparum
DEEENEI

SEQ ID NO: 3212560 - protein, 7 aa, Plasmodium falciparum
DEEENTS

SEQ ID NO: 3212561 - protein, 8 aa, Plasmodium falciparum
DEEERNTE

SEQ ID NO: 3212562 - protein, 21 aa, Plasmodium falciparum
DEEEYSNDDDFNEKKEEDKKI

SEQ ID NO: 3212563 - protein, 8 aa, Plasmodium falciparum
DEEGNIEQ

SEQ ID NO: 3212564 - protein, 7 aa, Plasmodium falciparum
DEEGVRK

SEQ ID NO: 3212565 - protein, 4 aa, Plasmodium falciparum
DEEI

SEQ ID NO: 3212566 - protein, 6 aa, Plasmodium falciparum
DEEINK

SEQ ID NO: 3212567 - protein, 13 aa, Plasmodium falciparum
DEEINQPYDDDEE

SEQ ID NO: 3212568 - protein, 14 aa, Plasmodium falciparum
DEEINQPYDDDEEI

SEQ ID NO: 3212569 - protein, 4 aa, Plasmodium falciparum
DEEK

SEQ ID NO: 3212570 - protein, 9 aa, Plasmodium falciparum
DEEKEKKKK

SEQ ID NO: 3212571 - protein, 5 aa, Plasmodium falciparum
DEEKG

SEQ ID NO: 3212572 - protein, 6 aa, Plasmodium falciparum
DEEKKD

SEQ ID NO: 3212573 - protein, 11 aa, Plasmodium falciparum
DEEKKKKQAEE

SEQ ID NO: 3212574 - protein, 24 aa, Plasmodium falciparum
DEEKKKRKKKRLSTGSNNNRYKND

SEQ ID NO: 3212575 - protein, 11 aa, Plasmodium falciparum
DEEKKKRNDDI

SEQ ID NO: 3212576 - protein, 8 aa, Plasmodium falciparum
DEEKKRDL

SEQ ID NO: 3212577 - protein, 9 aa, Plasmodium falciparum
DEEKNKEMN

SEQ ID NO: 3212578 - protein, 8 aa, Plasmodium falciparum
DEEKNKRN

SEQ ID NO: 3212579 - protein, 28 aa, Plasmodium falciparum
DEEKQKNQEETAGGCGPGVASDNKKETI

SEQ ID NO: 3212580 - protein, 7 aa, Plasmodium falciparum
DEEKRDI

SEQ ID NO: 3212581 - protein, 5 aa, Plasmodium falciparum
DEEKT

SEQ ID NO: 3212582 - protein, 5 aa, Plasmodium falciparum
DEELD

SEQ ID NO: 3212583 - protein, 20 aa, Plasmodium falciparum
DEELPSEGKQKVKGKSFDNE

SEQ ID NO: 3212584 - protein, 11 aa, Plasmodium falciparum
DEELQKKKKNE

SEQ ID NO: 3212585 - protein, 5 aa, Plasmodium falciparum
DEEMK

SEQ ID NO: 3212586 - protein, 8 aa, Plasmodium falciparum
DEEMKDEQ

SEQ ID NO: 3212587 - protein, 22 aa, Plasmodium falciparum
DEENEETQEEETAGADNQKKNT

SEQ ID NO: 3212588 - protein, 11 aa, Plasmodium falciparum
DEENEEVDRRM

SEQ ID NO: 3212589 - protein, 6 aa, Plasmodium falciparum
DEENFI

SEQ ID NO: 3212590 - protein, 19 aa, Plasmodium falciparum
DEENKEDKEEVDKKNEGDI

SEQ ID NO: 3212591 - protein, 22 aa, Plasmodium falciparum
DEENKGIDENTDINENVEENEY

SEQ ID NO: 3212592 - protein, 6 aa, Plasmodium falciparum
DEENKL

SEQ ID NO: 3212593 - protein, 10 aa, Plasmodium falciparum
DEENNKIYDQ

SEQ ID NO: 3212594 - protein, 6 aa, Plasmodium falciparum
DEENNM

SEQ ID NO: 3212595 - protein, 12 aa, Plasmodium falciparum
DEENNNKNENVK

SEQ ID NO: 3212596 - protein, 12 aa, Plasmodium falciparum
DEENNTKRKNQF

SEQ ID NO: 3212597 - protein, 6 aa, Plasmodium falciparum
DEENRM

SEQ ID NO: 3212598 - protein, 10 aa, Plasmodium falciparum
DEENSLKTQG

SEQ ID NO: 3212599 - protein, 5 aa, Plasmodium falciparum
DEENV

SEQ ID NO: 3212600 - protein, 9 aa, Plasmodium falciparum
DEEPLKNTG

SEQ ID NO: 3212601 - protein, 6 aa, Plasmodium falciparum
DEEPNR

SEQ ID NO: 3212602 - protein, 6 aa, Plasmodium falciparum
DEEPSL

SEQ ID NO: 3212603 - protein, 15 aa, Plasmodium falciparum
DEEQEERKQKERDQE

SEQ ID NO: 3212604 - protein, 19 aa, Plasmodium falciparum
DEEQKKNKEEADDGVGGGG

SEQ ID NO: 3212605 - protein, 12 aa, Plasmodium falciparum
DEEQKSDNDKYD

SEQ ID NO: 3212606 - protein, 12 aa, Plasmodium falciparum
DEERKQKKDNIY

SEQ ID NO: 3212607 - protein, 73 aa, Plasmodium falciparum
DEERKRKGAKRKKNDNNKKNDGNNNPNDGNNNPNDGNNNPNDGNNNPNDGNNNPNDGNNNQNDGNNNQNDDDY

SEQ ID NO: 3212608 - protein, 16 aa, Plasmodium falciparum
DEERREQYDNYGKNAT

SEQ ID NO: 3212609 - protein, 10 aa, Plasmodium falciparum
DEERSTSEDM

SEQ ID NO: 3212610 - protein, 20 aa, Plasmodium falciparum
DEERTKKKKYHEEYEKKDFQ

SEQ ID NO: 3212611 - protein, 8 aa, Plasmodium falciparum
DEESDSDY

SEQ ID NO: 3212612 - protein, 11 aa, Plasmodium falciparum
DEESPLTSNSL

SEQ ID NO: 3212613 - protein, 10 aa, Plasmodium falciparum
DEESRSNIDE

SEQ ID NO: 3212614 - protein, 6 aa, Plasmodium falciparum
DEESVT

SEQ ID NO: 3212615 - protein, 10 aa, Plasmodium falciparum
DEETNDDNDP

SEQ ID NO: 3212616 - protein, 8 aa, Plasmodium falciparum
DEETVTEE

SEQ ID NO: 3212617 - protein, 14 aa, Plasmodium falciparum
DEEYEETQKNNNIT

SEQ ID NO: 3212618 - protein, 5 aa, Plasmodium falciparum
DEFKN

SEQ ID NO: 3212619 - protein, 5 aa, Plasmodium falciparum
DEFVE

SEQ ID NO: 3212620 - protein, 7 aa, Plasmodium falciparum
DEFYNDS

SEQ ID NO: 3212621 - protein, 33 aa, Plasmodium falciparum
DEGGEYKKKENMTWGDTKRDGLYENGKHEKDGL

SEQ ID NO: 3212622 - protein, 7 aa, Plasmodium falciparum
DEGGMKA

SEQ ID NO: 3212623 - protein, 7 aa, Plasmodium falciparum
DEGHSAY

SEQ ID NO: 3212624 - protein, 38 aa, Plasmodium falciparum
DEGIEKSSEELSEEKIKKGKKYEKTKDNNFKPNDKSLY

SEQ ID NO: 3212625 - protein, 10 aa, Plasmodium falciparum
DEGKKRSSGA

SEQ ID NO: 3212626 - protein, 4 aa, Plasmodium falciparum
DEGN

SEQ ID NO: 3212627 - protein, 11 aa, Plasmodium falciparum
DEGNNKEEIKN

SEQ ID NO: 3212628 - protein, 6 aa, Plasmodium falciparum
DEGNVE

SEQ ID NO: 3212629 - protein, 8 aa, Plasmodium falciparum
DEGRSEIK

SEQ ID NO: 3212630 - protein, 7 aa, Plasmodium falciparum
DEGSVTE

SEQ ID NO: 3212631 - protein, 4 aa, Plasmodium falciparum
DEGT

SEQ ID NO: 3212632 - protein, 5 aa, Plasmodium falciparum
DEGTY

SEQ ID NO: 3212633 - protein, 8 aa, Plasmodium falciparum
DEGYSDDN

SEQ ID NO: 3212634 - protein, 5 aa, Plasmodium falciparum
DEGYT

SEQ ID NO: 3212635 - protein, 5 aa, Plasmodium falciparum
DEHGE

SEQ ID NO: 3212636 - protein, 29 aa, Plasmodium falciparum
DEHKKEGKNKQKNKKNNKNKKNNKNNNIN

SEQ ID NO: 3212637 - protein, 5 aa, Plasmodium falciparum
DEHKL

SEQ ID NO: 3212638 - protein, 15 aa, Plasmodium falciparum
DEHKNNINNKNNTCS

SEQ ID NO: 3212639 - protein, 15 aa, Plasmodium falciparum
DEHLTRNRQKKSTTS

SEQ ID NO: 3212640 - protein, 32 aa, Plasmodium falciparum
DEHMKKGNGYNRRNENDNIDNTNLKNEEIDKK

SEQ ID NO: 3212641 - protein, 7 aa, Plasmodium falciparum
DEHNAGY

SEQ ID NO: 3212642 - protein, 61 aa, Plasmodium falciparum
DEHNGNDEHNDDDEHNDDDEHNDDDEHNDDDEHNNDDEHNNDDEHNNDDNHINDENNDDYH

SEQ ID NO: 3212643 - protein, 11 aa, Plasmodium falciparum
DEHRGKKEEKC

SEQ ID NO: 3212644 - protein, 8 aa, Plasmodium falciparum
DEHTNDQD

SEQ ID NO: 3212645 - protein, 7 aa, Plasmodium falciparum
DEHVNSD

SEQ ID NO: 3212646 - protein, 5 aa, Plasmodium falciparum
DEIDK

SEQ ID NO: 3212647 - protein, 6 aa, Plasmodium falciparum
DEIEDR

SEQ ID NO: 3212648 - protein, 5 aa, Plasmodium falciparum
DEIEK

SEQ ID NO: 3212649 - protein, 18 aa, Plasmodium falciparum
DEIHEHDTPRKKKQKKKF

SEQ ID NO: 3212650 - protein, 4 aa, Plasmodium falciparum
DEIK

SEQ ID NO: 3212651 - protein, 7 aa, Plasmodium falciparum
DEIKNNT

SEQ ID NO: 3212652 - protein, 4 aa, Plasmodium falciparum
DEIN

SEQ ID NO: 3212653 - protein, 11 aa, Plasmodium falciparum
DEINEGRKHDK

SEQ ID NO: 3212654 - protein, 5 aa, Plasmodium falciparum
DEINQ

SEQ ID NO: 3212655 - protein, 14 aa, Plasmodium falciparum
DEINTTQDIPSMED

SEQ ID NO: 3212656 - protein, 14 aa, Plasmodium falciparum
DEIPPHSDEEETSL

SEQ ID NO: 3212657 - protein, 4 aa, Plasmodium falciparum
DEIS

SEQ ID NO: 3212658 - protein, 7 aa, Plasmodium falciparum
DEISAEY

SEQ ID NO: 3212659 - protein, 135 aa, Plasmodium falciparum
DEISKEKKESNKNDKHKKNDQHKKNDKSNQNGEDNQNGEDNQNDESNQNDEHKKNDEHKKNDEHNQNDEHNQNDEHNQNDEHNQNDEHNQNDEHNQNDEHNQNDEHNQNDESNQNDKNRKEIPPKEEKDKENNPS

SEQ ID NO: 3212660 - protein, 4 aa, Plasmodium falciparum
DEIY

SEQ ID NO: 3212661 - protein, 7 aa, Plasmodium falciparum
DEIYTDS

SEQ ID NO: 3212662 - protein, 38 aa, Plasmodium falciparum
DEKADGNKKHNKINNNNNNNKINNNSNMKKNHDDDTNI

SEQ ID NO: 3212663 - protein, 6 aa, Plasmodium falciparum
DEKCQE

SEQ ID NO: 3212664 - protein, 7 aa, Plasmodium falciparum
DEKDENK

SEQ ID NO: 3212665 - protein, 8 aa, Plasmodium falciparum
DEKDEYIT

SEQ ID NO: 3212666 - protein, 16 aa, Plasmodium falciparum
DEKDKSIQSTEQKSYL

SEQ ID NO: 3212667 - protein, 14 aa, Plasmodium falciparum
DEKDKSKKKESISS

SEQ ID NO: 3212668 - protein, 4 aa, Plasmodium falciparum
DEKE

SEQ ID NO: 3212669 - protein, 9 aa, Plasmodium falciparum
DEKEDTHYK

SEQ ID NO: 3212670 - protein, 39 aa, Plasmodium falciparum
DEKEENDSREQINKNEKIDKNVKNEKKKLSEKDINNNIN

SEQ ID NO: 3212671 - protein, 7 aa, Plasmodium falciparum
DEKEKLN

SEQ ID NO: 3212672 - protein, 47 aa, Plasmodium falciparum
DEKEKSFSINGDEKKESFSINGDEKKESFSINEDETKKSCSINDDER

SEQ ID NO: 3212673 - protein, 6 aa, Plasmodium falciparum
DEKERN

SEQ ID NO: 3212674 - protein, 7 aa, Plasmodium falciparum
DEKESHK

SEQ ID NO: 3212675 - protein, 4 aa, Plasmodium falciparum
DEKG

SEQ ID NO: 3212676 - protein, 7 aa, Plasmodium falciparum
DEKGERF

SEQ ID NO: 3212677 - protein, 16 aa, Plasmodium falciparum
DEKGGEGEGEDSEECQ

SEQ ID NO: 3212678 - protein, 11 aa, Plasmodium falciparum
DEKGKDKERND

SEQ ID NO: 3212679 - protein, 5 aa, Plasmodium falciparum
DEKGN

SEQ ID NO: 3212680 - protein, 7 aa, Plasmodium falciparum
DEKGSIP

SEQ ID NO: 3212681 - protein, 5 aa, Plasmodium falciparum
DEKIQ

SEQ ID NO: 3212682 - protein, 9 aa, Plasmodium falciparum
DEKISSGSK

SEQ ID NO: 3212683 - protein, 5 aa, Plasmodium falciparum
DEKKD

SEQ ID NO: 3212684 - protein, 16 aa, Plasmodium falciparum
DEKKDMNKEQKNDNHA

SEQ ID NO: 3212685 - protein, 13 aa, Plasmodium falciparum
DEKKEIKEKGEYS

SEQ ID NO: 3212686 - protein, 9 aa, Plasmodium falciparum
DEKKENNKI

SEQ ID NO: 3212687 - protein, 23 aa, Plasmodium falciparum
DEKKEQKKPSILNKEENGKKNKD

SEQ ID NO: 3212688 - protein, 6 aa, Plasmodium falciparum
DEKKES

SEQ ID NO: 3212689 - protein, 9 aa, Plasmodium falciparum
DEKKIKEKD

SEQ ID NO: 3212690 - protein, 6 aa, Plasmodium falciparum
DEKKKE

SEQ ID NO: 3212691 - protein, 10 aa, Plasmodium falciparum
DEKKKEIRRN

SEQ ID NO: 3212692 - protein, 14 aa, Plasmodium falciparum
DEKKKGGSKNQYDD

SEQ ID NO: 3212693 - protein, 34 aa, Plasmodium falciparum
DEKKKHNNNNNINNNDNNSNNSTTQKKVPSNSSF

SEQ ID NO: 3212694 - protein, 8 aa, Plasmodium falciparum
DEKKKKKE

SEQ ID NO: 3212695 - protein, 9 aa, Plasmodium falciparum
DEKKKKVEK

SEQ ID NO: 3212696 - protein, 5 aa, Plasmodium falciparum
DEKKN

SEQ ID NO: 3212697 - protein, 29 aa, Plasmodium falciparum
DEKKNEKNIKNHSEMQDPYASTKDTSRNF

SEQ ID NO: 3212698 - protein, 12 aa, Plasmodium falciparum
DEKKNEKREKNI

SEQ ID NO: 3212699 - protein, 13 aa, Plasmodium falciparum
DEKKNKNDIDGDD

SEQ ID NO: 3212700 - protein, 16 aa, Plasmodium falciparum
DEKKNKNNDGDDNKYD

SEQ ID NO: 3212701 - protein, 8 aa, Plasmodium falciparum
DEKKNLQS

SEQ ID NO: 3212702 - protein, 9 aa, Plasmodium falciparum
DEKKNQNDD

SEQ ID NO: 3212703 - protein, 6 aa, Plasmodium falciparum
DEKKNS

SEQ ID NO: 3212704 - protein, 6 aa, Plasmodium falciparum
DEKKNV

SEQ ID NO: 3212705 - protein, 9 aa, Plasmodium falciparum
DEKKSNNLV

SEQ ID NO: 3212706 - protein, 6 aa, Plasmodium falciparum
DEKKTF

SEQ ID NO: 3212707 - protein, 6 aa, Plasmodium falciparum
DEKKYS

SEQ ID NO: 3212708 - protein, 24 aa, Plasmodium falciparum
DEKLKKKKNVSDDIETDDDNNKGY

SEQ ID NO: 3212709 - protein, 17 aa, Plasmodium falciparum
DEKNEKLNDKEGEYEDV

SEQ ID NO: 3212710 - protein, 20 aa, Plasmodium falciparum
DEKNEKREETRKKKQLNECN

SEQ ID NO: 3212711 - protein, 19 aa, Plasmodium falciparum
DEKNEQDTSNNTITSNEGK

SEQ ID NO: 3212712 - protein, 10 aa, Plasmodium falciparum
DEKNIKNDYN

SEQ ID NO: 3212713 - protein, 26 aa, Plasmodium falciparum
DEKNINDEKNINDEKNINDEKNINDD

SEQ ID NO: 3212714 - protein, 16 aa, Plasmodium falciparum
DEKNISMTRSSEYNAT

SEQ ID NO: 3212715 - protein, 27 aa, Plasmodium falciparum
DEKNKKKKKNNKYGDITSTTNDRYNNY

SEQ ID NO: 3212716 - protein, 9 aa, Plasmodium falciparum
DEKNKLNKE

SEQ ID NO: 3212717 - protein, 9 aa, Plasmodium falciparum
DEKNKYDEM

SEQ ID NO: 3212718 - protein, 8 aa, Plasmodium falciparum
DEKNMEQN

SEQ ID NO: 3212719 - protein, 5 aa, Plasmodium falciparum
DEKNN

SEQ ID NO: 3212720 - protein, 16 aa, Plasmodium falciparum
DEKNNERKVKDPNYSN

SEQ ID NO: 3212721 - protein, 9 aa, Plasmodium falciparum
DEKNNNIEN

SEQ ID NO: 3212722 - protein, 31 aa, Plasmodium falciparum
DEKNSEQKKKNIKKKNKTCNEGKSKKDSTKL

SEQ ID NO: 3212723 - protein, 9 aa, Plasmodium falciparum
DEKNVEDNK

SEQ ID NO: 3212724 - protein, 21 aa, Plasmodium falciparum
DEKNYNDDQRSLSNYSDTSYG

SEQ ID NO: 3212725 - protein, 24 aa, Plasmodium falciparum
DEKQNAGDQNDLYDNNKDKEETIS

SEQ ID NO: 3212726 - protein, 9 aa, Plasmodium falciparum
DEKRCDTTC

SEQ ID NO: 3212727 - protein, 5 aa, Plasmodium falciparum
DEKRF

SEQ ID NO: 3212728 - protein, 13 aa, Plasmodium falciparum
DEKRKKQKKKRGS

SEQ ID NO: 3212729 - protein, 6 aa, Plasmodium falciparum
DEKRKM

SEQ ID NO: 3212730 - protein, 7 aa, Plasmodium falciparum
DEKRSND

SEQ ID NO: 3212731 - protein, 9 aa, Plasmodium falciparum
DEKSDDIDS

SEQ ID NO: 3212732 - protein, 24 aa, Plasmodium falciparum
DEKSFDKDKKSDNINEESHNTSNN

SEQ ID NO: 3212733 - protein, 7 aa, Plasmodium falciparum
DEKSGDK

SEQ ID NO: 3212734 - protein, 10 aa, Plasmodium falciparum
DEKSHSNSTL

SEQ ID NO: 3212735 - protein, 30 aa, Plasmodium falciparum
DEKSKGNIHDDTNKSIETSNKRKGKLNNKK

SEQ ID NO: 3212736 - protein, 30 aa, Plasmodium falciparum
DEKSKLSKYETGKKEVEKKDKKKKYYQEED

SEQ ID NO: 3212737 - protein, 9 aa, Plasmodium falciparum
DEKSNMKGE

SEQ ID NO: 3212738 - protein, 9 aa, Plasmodium falciparum
DEKSSYVNN

SEQ ID NO: 3212739 - protein, 9 aa, Plasmodium falciparum
DEKSYNNKN

SEQ ID NO: 3212740 - protein, 57 aa, Plasmodium falciparum
DEKSYSPNDHDNNSNNSNNNNNNDNNNSNNNNNNNNGGKNNSYYNEKTQKGVNDKET

SEQ ID NO: 3212741 - protein, 17 aa, Plasmodium falciparum
DEKTATSCPSHGNIDKE

SEQ ID NO: 3212742 - protein, 5 aa, Plasmodium falciparum
DEKTD

SEQ ID NO: 3212743 - protein, 9 aa, Plasmodium falciparum
DEKTNDKYK

SEQ ID NO: 3212744 - protein, 23 aa, Plasmodium falciparum
DEKTNKRTNISNDEKTNKHTTIS

SEQ ID NO: 3212745 - protein, 7 aa, Plasmodium falciparum
DEKTNRN

SEQ ID NO: 3212746 - protein, 7 aa, Plasmodium falciparum
DEKTPMG

SEQ ID NO: 3212747 - protein, 5 aa, Plasmodium falciparum
DEKYD

SEQ ID NO: 3212748 - protein, 25 aa, Plasmodium falciparum
DEKYKEKDGDKKEGEDKNNQNNMNK

SEQ ID NO: 3212749 - protein, 12 aa, Plasmodium falciparum
DEKYKKSNDDFT

SEQ ID NO: 3212750 - protein, 14 aa, Plasmodium falciparum
DEKYNGSNKSYGIN

SEQ ID NO: 3212751 - protein, 7 aa, Plasmodium falciparum
DEKYNSL

SEQ ID NO: 3212752 - protein, 6 aa, Plasmodium falciparum
DEKYNV

SEQ ID NO: 3212753 - protein, 13 aa, Plasmodium falciparum
DEKYSGKINSEEY

SEQ ID NO: 3212754 - protein, 12 aa, Plasmodium falciparum
DELDQKNNDFES

SEQ ID NO: 3212755 - protein, 6 aa, Plasmodium falciparum
DELDTK

SEQ ID NO: 3212756 - protein, 10 aa, Plasmodium falciparum
DELDTKPSEI

SEQ ID NO: 3212757 - protein, 21 aa, Plasmodium falciparum
DELEEKKKKKKNSSSITSNTK

SEQ ID NO: 3212758 - protein, 6 aa, Plasmodium falciparum
DELENN

SEQ ID NO: 3212759 - protein, 13 aa, Plasmodium falciparum
DELGENKKQIKEN

SEQ ID NO: 3212760 - protein, 21 aa, Plasmodium falciparum
DELKGKAYNNTIDANNQNIEY

SEQ ID NO: 3212761 - protein, 7 aa, Plasmodium falciparum
DELKPNT

SEQ ID NO: 3212762 - protein, 4 aa, Plasmodium falciparum
DELN

SEQ ID NO: 3212763 - protein, 9 aa, Plasmodium falciparum
DELNLDNST

SEQ ID NO: 3212764 - protein, 6 aa, Plasmodium falciparum
DELNPE

SEQ ID NO: 3212765 - protein, 9 aa, Plasmodium falciparum
DELNRTSEH

SEQ ID NO: 3212766 - protein, 6 aa, Plasmodium falciparum
DELSNK

SEQ ID NO: 3212767 - protein, 13 aa, Plasmodium falciparum
DELSSTEKARISD

SEQ ID NO: 3212768 - protein, 26 aa, Plasmodium falciparum
DEMKDDQNKRYKNISNKKKKYNTNSL

SEQ ID NO: 3212769 - protein, 49 aa, Plasmodium falciparum
DEMKGKERKRNYKKEEKRKENNDKNDKNNKNDKNNKNDNNNNNNNNNNN

SEQ ID NO: 3212770 - protein, 5 aa, Plasmodium falciparum
DENAN

SEQ ID NO: 3212771 - protein, 8 aa, Plasmodium falciparum
DENDDEKK

SEQ ID NO: 3212772 - protein, 10 aa, Plasmodium falciparum
DENDDLKDEY

SEQ ID NO: 3212773 - protein, 14 aa, Plasmodium falciparum
DENDKKEKHPKDKY

SEQ ID NO: 3212774 - protein, 5 aa, Plasmodium falciparum
DENDV

SEQ ID NO: 3212775 - protein, 8 aa, Plasmodium falciparum
DENDVEED

SEQ ID NO: 3212776 - protein, 14 aa, Plasmodium falciparum
DENEEEEDDEEYNN

SEQ ID NO: 3212777 - protein, 10 aa, Plasmodium falciparum
DENEEHNKDN

SEQ ID NO: 3212778 - protein, 7 aa, Plasmodium falciparum
DENEEVK

SEQ ID NO: 3212779 - protein, 16 aa, Plasmodium falciparum
DENEINEQGKNNFNDD

SEQ ID NO: 3212780 - protein, 7 aa, Plasmodium falciparum
DENEITD

SEQ ID NO: 3212781 - protein, 12 aa, Plasmodium falciparum
DENENKKDGNGA

SEQ ID NO: 3212782 - protein, 17 aa, Plasmodium falciparum
DENEQKVSSDEEQDFNE

SEQ ID NO: 3212783 - protein, 9 aa, Plasmodium falciparum
DENGDATRN

SEQ ID NO: 3212784 - protein, 5 aa, Plasmodium falciparum
DENGE

SEQ ID NO: 3212785 - protein, 9 aa, Plasmodium falciparum
DENGNHDDN

SEQ ID NO: 3212786 - protein, 8 aa, Plasmodium falciparum
DENHNTNG

SEQ ID NO: 3212787 - protein, 10 aa, Plasmodium falciparum
DENHPTATQG

SEQ ID NO: 3212788 - protein, 9 aa, Plasmodium falciparum
DENIEEEEG

SEQ ID NO: 3212789 - protein, 8 aa, Plasmodium falciparum
DENIKEKS

SEQ ID NO: 3212790 - protein, 25 aa, Plasmodium falciparum
DENIKNKNKNKNYGSNNNNNNINDR

SEQ ID NO: 3212791 - protein, 44 aa, Plasmodium falciparum
DENINEDKDDDINENKDDDINENKDENINEDKDEDSFSNLPSDD

SEQ ID NO: 3212792 - protein, 5 aa, Plasmodium falciparum
DENIT

SEQ ID NO: 3212793 - protein, 16 aa, Plasmodium falciparum
DENIYEKADTEDEEEK

SEQ ID NO: 3212794 - protein, 8 aa, Plasmodium falciparum
DENKDYKE

SEQ ID NO: 3212795 - protein, 6 aa, Plasmodium falciparum
DENKEH

SEQ ID NO: 3212796 - protein, 21 aa, Plasmodium falciparum
DENKEYNKHDSDDNNKNYKNK

SEQ ID NO: 3212797 - protein, 5 aa, Plasmodium falciparum
DENKG

SEQ ID NO: 3212798 - protein, 11 aa, Plasmodium falciparum
DENKGKKDLSN

SEQ ID NO: 3212799 - protein, 5 aa, Plasmodium falciparum
DENKK

SEQ ID NO: 3212800 - protein, 14 aa, Plasmodium falciparum
DENKKAKKCIKKET

SEQ ID NO: 3212801 - protein, 9 aa, Plasmodium falciparum
DENKKMDEN

SEQ ID NO: 3212802 - protein, 8 aa, Plasmodium falciparum
DENKSEEY

SEQ ID NO: 3212803 - protein, 14 aa, Plasmodium falciparum
DENKSNDNKENDNN

SEQ ID NO: 3212804 - protein, 8 aa, Plasmodium falciparum
DENKYSDD

SEQ ID NO: 3212805 - protein, 4 aa, Plasmodium falciparum
DENL

SEQ ID NO: 3212806 - protein, 8 aa, Plasmodium falciparum
DENMGNNS

SEQ ID NO: 3212807 - protein, 6 aa, Plasmodium falciparum
DENMKY

SEQ ID NO: 3212808 - protein, 6 aa, Plasmodium falciparum
DENNAE

SEQ ID NO: 3212809 - protein, 14 aa, Plasmodium falciparum
DENNEKNIRTNNNS

SEQ ID NO: 3212810 - protein, 25 aa, Plasmodium falciparum
DENNHNNNNIHNNNVDNNVNTVGHN

SEQ ID NO: 3212811 - protein, 5 aa, Plasmodium falciparum
DENNN

SEQ ID NO: 3212812 - protein, 12 aa, Plasmodium falciparum
DENNNVEDEKRK

SEQ ID NO: 3212813 - protein, 8 aa, Plasmodium falciparum
DENNRNRE

SEQ ID NO: 3212814 - protein, 11 aa, Plasmodium falciparum
DENNTSDSKSV

SEQ ID NO: 3212815 - protein, 9 aa, Plasmodium falciparum
DENNYNDND

SEQ ID NO: 3212816 - protein, 8 aa, Plasmodium falciparum
DENQKGKL

SEQ ID NO: 3212817 - protein, 6 aa, Plasmodium falciparum
DENQKS

SEQ ID NO: 3212818 - protein, 6 aa, Plasmodium falciparum
DENQYK

SEQ ID NO: 3212819 - protein, 4 aa, Plasmodium falciparum
DENR

SEQ ID NO: 3212820 - protein, 12 aa, Plasmodium falciparum
DENRLTDDTSEE

SEQ ID NO: 3212821 - protein, 7 aa, Plasmodium falciparum
DENRRKM

SEQ ID NO: 3212822 - protein, 22 aa, Plasmodium falciparum
DENSDTEAKDTKATAPSDNTPT

SEQ ID NO: 3212823 - protein, 14 aa, Plasmodium falciparum
DENSGTGDPLNNPK

SEQ ID NO: 3212824 - protein, 17 aa, Plasmodium falciparum
DENSGTGPKSNDPINNP

SEQ ID NO: 3212825 - protein, 17 aa, Plasmodium falciparum
DENSKKPKKNAGPESNI

SEQ ID NO: 3212826 - protein, 6 aa, Plasmodium falciparum
DENSKT

SEQ ID NO: 3212827 - protein, 20 aa, Plasmodium falciparum
DENSPNNAKASHENTSGSLV

SEQ ID NO: 3212828 - protein, 24 aa, Plasmodium falciparum
DENSVTDGPRTTSPGTSGDTPPTL

SEQ ID NO: 3212829 - protein, 5 aa, Plasmodium falciparum
DENTI

SEQ ID NO: 3212830 - protein, 5 aa, Plasmodium falciparum
DENTL

SEQ ID NO: 3212831 - protein, 4 aa, Plasmodium falciparum
DENV

SEQ ID NO: 3212832 - protein, 6 aa, Plasmodium falciparum
DENVKR

SEQ ID NO: 3212833 - protein, 12 aa, Plasmodium falciparum
DENYEKKKKKKN

SEQ ID NO: 3212834 - protein, 8 aa, Plasmodium falciparum
DENYNDNK

SEQ ID NO: 3212835 - protein, 16 aa, Plasmodium falciparum
DENYSKNQNRNYERKM

SEQ ID NO: 3212836 - protein, 6 aa, Plasmodium falciparum
DEPADD

SEQ ID NO: 3212837 - protein, 6 aa, Plasmodium falciparum
DEPHYG

SEQ ID NO: 3212838 - protein, 13 aa, Plasmodium falciparum
DEPKVKEEKADAV

SEQ ID NO: 3212839 - protein, 5 aa, Plasmodium falciparum
DEPSG

SEQ ID NO: 3212840 - protein, 6 aa, Plasmodium falciparum
DEPTQL

SEQ ID NO: 3212841 - protein, 29 aa, Plasmodium falciparum
DEPVDDHAGKHLKDEPVDDHAGKHMKDEP

SEQ ID NO: 3212842 - protein, 14 aa, Plasmodium falciparum
DEQAHNDKAPHEHK

SEQ ID NO: 3212843 - protein, 4 aa, Plasmodium falciparum
DEQC

SEQ ID NO: 3212844 - protein, 11 aa, Plasmodium falciparum
DEQDNHKQNEQ

SEQ ID NO: 3212845 - protein, 11 aa, Plasmodium falciparum
DEQEEIENNEQ

SEQ ID NO: 3212846 - protein, 12 aa, Plasmodium falciparum
DEQEESYNQNNH

SEQ ID NO: 3212847 - protein, 7 aa, Plasmodium falciparum
DEQINDD

SEQ ID NO: 3212848 - protein, 36 aa, Plasmodium falciparum
DEQINQPYDDDEEINQPYDDDEEQQNKINNNTNDDH

SEQ ID NO: 3212849 - protein, 24 aa, Plasmodium falciparum
DEQINQPYDDNEEINQPYDDDEEI

SEQ ID NO: 3212850 - protein, 13 aa, Plasmodium falciparum
DEQKEDKDKVNSI

SEQ ID NO: 3212851 - protein, 5 aa, Plasmodium falciparum
DEQKL

SEQ ID NO: 3212852 - protein, 6 aa, Plasmodium falciparum
DEQNDH

SEQ ID NO: 3212853 - protein, 10 aa, Plasmodium falciparum
DEQNKDKNKC

SEQ ID NO: 3212854 - protein, 48 aa, Plasmodium falciparum
DEQNKEKECNDNKDQEINNKKKKINDNKKEDMDKQNTTQNEEKKDEDS

SEQ ID NO: 3212855 - protein, 14 aa, Plasmodium falciparum
DEQNNSNNNNYNNY

SEQ ID NO: 3212856 - protein, 6 aa, Plasmodium falciparum
DEQPIQ

SEQ ID NO: 3212857 - protein, 6 aa, Plasmodium falciparum
DEQQKV

SEQ ID NO: 3212858 - protein, 15 aa, Plasmodium falciparum
DEQQRTDESNVDQQN

SEQ ID NO: 3212859 - protein, 18 aa, Plasmodium falciparum
DEQSHTKNKKNGKPLENK

SEQ ID NO: 3212860 - protein, 16 aa, Plasmodium falciparum
DERDENHLKESSAKYE

SEQ ID NO: 3212861 - protein, 6 aa, Plasmodium falciparum
DERDKR

SEQ ID NO: 3212862 - protein, 17 aa, Plasmodium falciparum
DERDRLKRNKNIQNRAK

SEQ ID NO: 3212863 - protein, 5 aa, Plasmodium falciparum
DEREN

SEQ ID NO: 3212864 - protein, 10 aa, Plasmodium falciparum
DERKKKKMYT

SEQ ID NO: 3212865 - protein, 7 aa, Plasmodium falciparum
DERKRYY

SEQ ID NO: 3212866 - protein, 5 aa, Plasmodium falciparum
DERLK

SEQ ID NO: 3212867 - protein, 11 aa, Plasmodium falciparum
DERMSTENINE

SEQ ID NO: 3212868 - protein, 4 aa, Plasmodium falciparum
DERN

SEQ ID NO: 3212869 - protein, 11 aa, Plasmodium falciparum
DERRKKKRKIY

SEQ ID NO: 3212870 - protein, 5 aa, Plasmodium falciparum
DERYN

SEQ ID NO: 3212871 - protein, 5 aa, Plasmodium falciparum
DESAK

SEQ ID NO: 3212872 - protein, 7 aa, Plasmodium falciparum
DESAKHA

SEQ ID NO: 3212873 - protein, 6 aa, Plasmodium falciparum
DESASN

SEQ ID NO: 3212874 - protein, 7 aa, Plasmodium falciparum
DESCNNS

SEQ ID NO: 3212875 - protein, 9 aa, Plasmodium falciparum
DESDDEDIY

SEQ ID NO: 3212876 - protein, 15 aa, Plasmodium falciparum
DESDDGRKKKRLKKV

SEQ ID NO: 3212877 - protein, 7 aa, Plasmodium falciparum
DESDDYT

SEQ ID NO: 3212878 - protein, 18 aa, Plasmodium falciparum
DESDNKESECSSRKDVKR

SEQ ID NO: 3212879 - protein, 9 aa, Plasmodium falciparum
DESEEEYDD

SEQ ID NO: 3212880 - protein, 10 aa, Plasmodium falciparum
DESELNKESF

SEQ ID NO: 3212881 - protein, 9 aa, Plasmodium falciparum
DESGEQNDV

SEQ ID NO: 3212882 - protein, 10 aa, Plasmodium falciparum
DESKKTINNY

SEQ ID NO: 3212883 - protein, 4 aa, Plasmodium falciparum
DESL

SEQ ID NO: 3212884 - protein, 11 aa, Plasmodium falciparum
DESLNDNNSKI

SEQ ID NO: 3212885 - protein, 18 aa, Plasmodium falciparum
DESNENEKERDSYSKRNY

SEQ ID NO: 3212886 - protein, 26 aa, Plasmodium falciparum
DESNGDYSDDNPEEETEKYSQDEENN

SEQ ID NO: 3212887 - protein, 24 aa, Plasmodium falciparum
DESNGGKNGINGCNPKDQVQPYPG

SEQ ID NO: 3212888 - protein, 6 aa, Plasmodium falciparum
DESQIK

SEQ ID NO: 3212889 - protein, 21 aa, Plasmodium falciparum
DESRSQCTKNRIKDSTSDTVG

SEQ ID NO: 3212890 - protein, 7 aa, Plasmodium falciparum
DESSDEN

SEQ ID NO: 3212891 - protein, 12 aa, Plasmodium falciparum
DESSEEESDEEM

SEQ ID NO: 3212892 - protein, 5 aa, Plasmodium falciparum
DESSH

SEQ ID NO: 3212893 - protein, 13 aa, Plasmodium falciparum
DESSKISKGEKLN

SEQ ID NO: 3212894 - protein, 11 aa, Plasmodium falciparum
DESSNDDDHPI

SEQ ID NO: 3212895 - protein, 33 aa, Plasmodium falciparum
DESSSESSHSTKALSEDSTSRKRNISERRDNIS

SEQ ID NO: 3212896 - protein, 19 aa, Plasmodium falciparum
DESTEDSEENSKNSLDSEE

SEQ ID NO: 3212897 - protein, 6 aa, Plasmodium falciparum
DESTKG

SEQ ID NO: 3212898 - protein, 46 aa, Plasmodium falciparum
DESTNGGTEVEGSTPSSPSDSNNNDGSSGDNTGDSNDKKGMGTGEK

SEQ ID NO: 3212899 - protein, 13 aa, Plasmodium falciparum
DESTSSENTTDDY

SEQ ID NO: 3212900 - protein, 10 aa, Plasmodium falciparum
DESTYNEDNK

SEQ ID NO: 3212901 - protein, 4 aa, Plasmodium falciparum
DESV

SEQ ID NO: 3212902 - protein, 4 aa, Plasmodium falciparum
DETC

SEQ ID NO: 3212903 - protein, 68 aa, Plasmodium falciparum
DETEEDEEDDDGEDDEEDDDEDDEEDDDEDDDDEDDGEDDDEEDDEEDEDEGEEEYEDVEEEDGDEEE

SEQ ID NO: 3212904 - protein, 7 aa, Plasmodium falciparum
DETEQSG

SEQ ID NO: 3212905 - protein, 7 aa, Plasmodium falciparum
DETETYI

SEQ ID NO: 3212906 - protein, 5 aa, Plasmodium falciparum
DETIN

SEQ ID NO: 3212907 - protein, 14 aa, Plasmodium falciparum
DETINNYNNNNNIN

SEQ ID NO: 3212908 - protein, 37 aa, Plasmodium falciparum
DETNDETDNETNDETDNETNDEKSIKKKKKKRKGKPR

SEQ ID NO: 3212909 - protein, 7 aa, Plasmodium falciparum
DETNEIA

SEQ ID NO: 3212910 - protein, 7 aa, Plasmodium falciparum
DETNEIE

SEQ ID NO: 3212911 - protein, 6 aa, Plasmodium falciparum
DETPTP

SEQ ID NO: 3212912 - protein, 5 aa, Plasmodium falciparum
DETSP

SEQ ID NO: 3212913 - protein, 7 aa, Plasmodium falciparum
DETSRRT

SEQ ID NO: 3212914 - protein, 5 aa, Plasmodium falciparum
DETSY

SEQ ID NO: 3212915 - protein, 7 aa, Plasmodium falciparum
DETTKDL

SEQ ID NO: 3212916 - protein, 14 aa, Plasmodium falciparum
DETTKKPKDEKYQY

SEQ ID NO: 3212917 - protein, 8 aa, Plasmodium falciparum
DETTNVQY

SEQ ID NO: 3212918 - protein, 4 aa, Plasmodium falciparum
DETY

SEQ ID NO: 3212919 - protein, 15 aa, Plasmodium falciparum
DETYNNTNEENSCKT

SEQ ID NO: 3212920 - protein, 26 aa, Plasmodium falciparum
DEVEDEVEDEDENENEVENENEDFND

SEQ ID NO: 3212921 - protein, 5 aa, Plasmodium falciparum
DEVEE

SEQ ID NO: 3212922 - protein, 12 aa, Plasmodium falciparum
DEVIKDNETQLK

SEQ ID NO: 3212923 - protein, 10 aa, Plasmodium falciparum
DEVKKEAKKY

SEQ ID NO: 3212924 - protein, 8 aa, Plasmodium falciparum
DEVNENLR

SEQ ID NO: 3212925 - protein, 7 aa, Plasmodium falciparum
DEVNPDE

SEQ ID NO: 3212926 - protein, 7 aa, Plasmodium falciparum
DEVRTSN

SEQ ID NO: 3212927 - protein, 8 aa, Plasmodium falciparum
DEVTNRTS

SEQ ID NO: 3212928 - protein, 4 aa, Plasmodium falciparum
DEWE

SEQ ID NO: 3212929 - protein, 8 aa, Plasmodium falciparum
DEWKKDKG

SEQ ID NO: 3212930 - protein, 7 aa, Plasmodium falciparum
DEWKKNK

SEQ ID NO: 3212931 - protein, 19 aa, Plasmodium falciparum
DEYDDDDDDDNYDENEYLN

SEQ ID NO: 3212932 - protein, 11 aa, Plasmodium falciparum
DEYDDEEENKN

SEQ ID NO: 3212933 - protein, 20 aa, Plasmodium falciparum
DEYDDNEEEQYNKDEDDYTD

SEQ ID NO: 3212934 - protein, 19 aa, Plasmodium falciparum
DEYDDSEEYDYDDKEYGES

SEQ ID NO: 3212935 - protein, 14 aa, Plasmodium falciparum
DEYDEDKEANKSPI

SEQ ID NO: 3212936 - protein, 9 aa, Plasmodium falciparum
DEYDQYDEN

SEQ ID NO: 3212937 - protein, 4 aa, Plasmodium falciparum
DEYE

SEQ ID NO: 3212938 - protein, 20 aa, Plasmodium falciparum
DEYEDNEDDKYNKDEDDYSE

SEQ ID NO: 3212939 - protein, 30 aa, Plasmodium falciparum
DEYEKQQKAYEQQKKNCEKESEGVENKSDI

SEQ ID NO: 3212940 - protein, 31 aa, Plasmodium falciparum
DEYEKQQKAYNEQRTNYTNKNKVSESNNHDK

SEQ ID NO: 3212941 - protein, 13 aa, Plasmodium falciparum
DEYGTPIAGPPNI

SEQ ID NO: 3212942 - protein, 4 aa, Plasmodium falciparum
DEYH

SEQ ID NO: 3212943 - protein, 18 aa, Plasmodium falciparum
DEYIKDEKKKKKKLENNK

SEQ ID NO: 3212944 - protein, 16 aa, Plasmodium falciparum
DEYINENKKKRNERDK

SEQ ID NO: 3212945 - protein, 7 aa, Plasmodium falciparum
DEYKNEK

SEQ ID NO: 3212946 - protein, 12 aa, Plasmodium falciparum
DEYMDKRESNTN

SEQ ID NO: 3212947 - protein, 5 aa, Plasmodium falciparum
DEYND

SEQ ID NO: 3212948 - protein, 6 aa, Plasmodium falciparum
DEYQGD

SEQ ID NO: 3212949 - protein, 12 aa, Plasmodium falciparum
DEYRKKKNYDDS

SEQ ID NO: 3212950 - protein, 6 aa, Plasmodium falciparum
DEYTSE

SEQ ID NO: 3212951 - protein, 4 aa, Plasmodium falciparum
DEYY

SEQ ID NO: 3212952 - protein, 26 aa, Plasmodium falciparum
DFEGEEKNKCKIKESEKSFKKENDCK

SEQ ID NO: 3212953 - protein, 13 aa, Plasmodium falciparum
DFGPQVENGGSGM

SEQ ID NO: 3212954 - protein, 8 aa, Plasmodium falciparum
DFGRTPYP

SEQ ID NO: 3212955 - protein, 7 aa, Plasmodium falciparum
DFGSKGG

SEQ ID NO: 3212956 - protein, 8 aa, Plasmodium falciparum
DFHDEEEK

SEQ ID NO: 3212957 - protein, 9 aa, Plasmodium falciparum
DFKTKEEKE

SEQ ID NO: 3212958 - protein, 4 aa, Plasmodium falciparum
DFNC

SEQ ID NO: 3212959 - protein, 5 aa, Plasmodium falciparum
DFPTT

SEQ ID NO: 3212960 - protein, 5 aa, Plasmodium falciparum
DFRTE

SEQ ID NO: 3212961 - protein, 7 aa, Plasmodium falciparum
DFSEGTK

SEQ ID NO: 3212962 - protein, 6 aa, Plasmodium falciparum
DFSRTH

SEQ ID NO: 3212963 - protein, 4 aa, Plasmodium falciparum
DFSS

SEQ ID NO: 3212964 - protein, 15 aa, Plasmodium falciparum
DFSSSEEDSSSYNDE

SEQ ID NO: 3212965 - protein, 12 aa, Plasmodium falciparum
DFSTSKKKRYRE

SEQ ID NO: 3212966 - protein, 5 aa, Plasmodium falciparum
DFTEN

SEQ ID NO: 3212967 - protein, 12 aa, Plasmodium falciparum
DFTNPKETFRPA

SEQ ID NO: 3212968 - protein, 8 aa, Plasmodium falciparum
DFTNTQTS

SEQ ID NO: 3212969 - protein, 7 aa, Plasmodium falciparum
DFTTSES

SEQ ID NO: 3212970 - protein, 9 aa, Plasmodium falciparum
DGDDNAVNR

SEQ ID NO: 3212971 - protein, 11 aa, Plasmodium falciparum
DGDEDKKKVNT

SEQ ID NO: 3212972 - protein, 24 aa, Plasmodium falciparum
DGDGNVDGNVDGNVDGNVDDDDDE

SEQ ID NO: 3212973 - protein, 11 aa, Plasmodium falciparum
DGDKNIGANDE

SEQ ID NO: 3212974 - protein, 10 aa, Plasmodium falciparum
DGDKNKDNEC

SEQ ID NO: 3212975 - protein, 9 aa, Plasmodium falciparum
DGDNNNDNG

SEQ ID NO: 3212976 - protein, 24 aa, Plasmodium falciparum
DGDNNNNINDDDDNDDDGHHDDGH

SEQ ID NO: 3212977 - protein, 7 aa, Plasmodium falciparum
DGDPNWE

SEQ ID NO: 3212978 - protein, 8 aa, Plasmodium falciparum
DGDPPTNL

SEQ ID NO: 3212979 - protein, 18 aa, Plasmodium falciparum
DGDQPGHDKSKAGKANDD

SEQ ID NO: 3212980 - protein, 29 aa, Plasmodium falciparum
DGDSDDNGDGHGHGHGDGHDDDNGDGHGD

SEQ ID NO: 3212981 - protein, 6 aa, Plasmodium falciparum
DGDSMN

SEQ ID NO: 3212982 - protein, 13 aa, Plasmodium falciparum
DGDTQKYSGDGEY

SEQ ID NO: 3212983 - protein, 6 aa, Plasmodium falciparum
DGDTSN

SEQ ID NO: 3212984 - protein, 20 aa, Plasmodium falciparum
DGDYTNDEEGTNKPKRNWKG

SEQ ID NO: 3212985 - protein, 11 aa, Plasmodium falciparum
DGECEKELSES

SEQ ID NO: 3212986 - protein, 5 aa, Plasmodium falciparum
DGEDI

SEQ ID NO: 3212987 - protein, 9 aa, Plasmodium falciparum
DGEFDDDKS

SEQ ID NO: 3212988 - protein, 5 aa, Plasmodium falciparum
DGEGY

SEQ ID NO: 3212989 - protein, 10 aa, Plasmodium falciparum
DGEIRKEDSQ

SEQ ID NO: 3212990 - protein, 16 aa, Plasmodium falciparum
DGEKRKSNKIKRKRIK

SEQ ID NO: 3212991 - protein, 9 aa, Plasmodium falciparum
DGENEYDNY

SEQ ID NO: 3212992 - protein, 38 aa, Plasmodium falciparum
DGENKKYKKKNKENNEKDKYENNWDSNNYNSDNEIKDG

SEQ ID NO: 3212993 - protein, 5 aa, Plasmodium falciparum
DGESN

SEQ ID NO: 3212994 - protein, 21 aa, Plasmodium falciparum
DGESNTNASNNNNNSNNNNIN

SEQ ID NO: 3212995 - protein, 15 aa, Plasmodium falciparum
DGEYLDHESSDALYT

SEQ ID NO: 3212996 - protein, 4 aa, Plasmodium falciparum
DGGD

SEQ ID NO: 3212997 - protein, 6 aa, Plasmodium falciparum
DGGECS

SEQ ID NO: 3212998 - protein, 6 aa, Plasmodium falciparum
DGGKNN

SEQ ID NO: 3212999 - protein, 8 aa, Plasmodium falciparum
DGGKTFNK

SEQ ID NO: 3213000 - protein, 5 aa, Plasmodium falciparum
DGGNY

SEQ ID NO: 3213001 - protein, 4 aa, Plasmodium falciparum
DGGR

SEQ ID NO: 3213002 - protein, 8 aa, Plasmodium falciparum
DGHDCTDK

SEQ ID NO: 3213003 - protein, 27 aa, Plasmodium falciparum
DGHKENKKNNSNNNINIDEKKKNDAYI

SEQ ID NO: 3213004 - protein, 5 aa, Plasmodium falciparum
DGIKN

SEQ ID NO: 3213005 - protein, 4 aa, Plasmodium falciparum
DGIN

SEQ ID NO: 3213006 - protein, 19 aa, Plasmodium falciparum
DGINEESSVQNKSEKNSFS

SEQ ID NO: 3213007 - protein, 4 aa, Plasmodium falciparum
DGIT

SEQ ID NO: 3213008 - protein, 6 aa, Plasmodium falciparum
DGITNN

SEQ ID NO: 3213009 - protein, 73 aa, Plasmodium falciparum
DGKANAEGGGQKGARGPNGGTEGANSGKGAQQQQEQQQEQQQEQQQQQQQQQQQQPHSTDSSSSPPSSNPRDV

SEQ ID NO: 3213010 - protein, 5 aa, Plasmodium falciparum
DGKCN

SEQ ID NO: 3213011 - protein, 10 aa, Plasmodium falciparum
DGKDIENESQ

SEQ ID NO: 3213012 - protein, 5 aa, Plasmodium falciparum
DGKDL

SEQ ID NO: 3213013 - protein, 21 aa, Plasmodium falciparum
DGKDSPMDNSNLGYGNNNYSS

SEQ ID NO: 3213014 - protein, 7 aa, Plasmodium falciparum
DGKDTNV

SEQ ID NO: 3213015 - protein, 4 aa, Plasmodium falciparum
DGKE

SEQ ID NO: 3213016 - protein, 5 aa, Plasmodium falciparum
DGKEL

SEQ ID NO: 3213017 - protein, 8 aa, Plasmodium falciparum
DGKENGEN

SEQ ID NO: 3213018 - protein, 6 aa, Plasmodium falciparum
DGKENY

SEQ ID NO: 3213019 - protein, 5 aa, Plasmodium falciparum
DGKHE

SEQ ID NO: 3213020 - protein, 28 aa, Plasmodium falciparum
DGKISDQGSQKSPPKELSNKQMTPAQRK

SEQ ID NO: 3213021 - protein, 7 aa, Plasmodium falciparum
DGKITRD

SEQ ID NO: 3213022 - protein, 10 aa, Plasmodium falciparum
DGKKKQSENL

SEQ ID NO: 3213023 - protein, 28 aa, Plasmodium falciparum
DGKKNTGSKKRDMSNKKGDKSCNKKNIC

SEQ ID NO: 3213024 - protein, 8 aa, Plasmodium falciparum
DGKKYTHA

SEQ ID NO: 3213025 - protein, 7 aa, Plasmodium falciparum
DGKNIGR

SEQ ID NO: 3213026 - protein, 7 aa, Plasmodium falciparum
DGKPILK

SEQ ID NO: 3213027 - protein, 7 aa, Plasmodium falciparum
DGKRKSV

SEQ ID NO: 3213028 - protein, 8 aa, Plasmodium falciparum
DGKTKKGH

SEQ ID NO: 3213029 - protein, 12 aa, Plasmodium falciparum
DGKWETKGEDDK

SEQ ID NO: 3213030 - protein, 9 aa, Plasmodium falciparum
DGKYGEAKN

SEQ ID NO: 3213031 - protein, 15 aa, Plasmodium falciparum
DGKYLDDDSSDALYT

SEQ ID NO: 3213032 - protein, 13 aa, Plasmodium falciparum
DGKYNCNSTVKKD

SEQ ID NO: 3213033 - protein, 6 aa, Plasmodium falciparum
DGLNNG

SEQ ID NO: 3213034 - protein, 9 aa, Plasmodium falciparum
DGLQSTSIS

SEQ ID NO: 3213035 - protein, 6 aa, Plasmodium falciparum
DGNAIN

SEQ ID NO: 3213036 - protein, 13 aa, Plasmodium falciparum
DGNGGEKNTQSNL

SEQ ID NO: 3213037 - protein, 6 aa, Plasmodium falciparum
DGNGNS

SEQ ID NO: 3213038 - protein, 8 aa, Plasmodium falciparum
DGNKKSDD

SEQ ID NO: 3213039 - protein, 5 aa, Plasmodium falciparum
DGNKN

SEQ ID NO: 3213040 - protein, 5 aa, Plasmodium falciparum
DGNNI

SEQ ID NO: 3213041 - protein, 8 aa, Plasmodium falciparum
DGNNKDIR

SEQ ID NO: 3213042 - protein, 10 aa, Plasmodium falciparum
DGNNKNNNNN

SEQ ID NO: 3213043 - protein, 9 aa, Plasmodium falciparum
DGNNMENDK

SEQ ID NO: 3213044 - protein, 5 aa, Plasmodium falciparum
DGNNN

SEQ ID NO: 3213045 - protein, 4 aa, Plasmodium falciparum
DGNP

SEQ ID NO: 3213046 - protein, 6 aa, Plasmodium falciparum
DGNQIY

SEQ ID NO: 3213047 - protein, 26 aa, Plasmodium falciparum
DGNSGNVDDEDKDPQKKLEKGDIPEE

SEQ ID NO: 3213048 - protein, 10 aa, Plasmodium falciparum
DGNSKYNNTH

SEQ ID NO: 3213049 - protein, 7 aa, Plasmodium falciparum
DGNSNEK

SEQ ID NO: 3213050 - protein, 8 aa, Plasmodium falciparum
DGNSQKKE

SEQ ID NO: 3213051 - protein, 8 aa, Plasmodium falciparum
DGNSYDTY

SEQ ID NO: 3213052 - protein, 8 aa, Plasmodium falciparum
DGNTYDSN

SEQ ID NO: 3213053 - protein, 10 aa, Plasmodium falciparum
DGNVNSKGFD

SEQ ID NO: 3213054 - protein, 6 aa, Plasmodium falciparum
DGNYDD

SEQ ID NO: 3213055 - protein, 6 aa, Plasmodium falciparum
DGNYKT

SEQ ID NO: 3213056 - protein, 18 aa, Plasmodium falciparum
DGPCKNDSEEGKKGRDKL

SEQ ID NO: 3213057 - protein, 14 aa, Plasmodium falciparum
DGPCKNNSEEDQKV

SEQ ID NO: 3213058 - protein, 8 aa, Plasmodium falciparum
DGPDETGE

SEQ ID NO: 3213059 - protein, 4 aa, Plasmodium falciparum
DGPL

SEQ ID NO: 3213060 - protein, 4 aa, Plasmodium falciparum
DGQE

SEQ ID NO: 3213061 - protein, 6 aa, Plasmodium falciparum
DGQEST

SEQ ID NO: 3213062 - protein, 4 aa, Plasmodium falciparum
DGQN

SEQ ID NO: 3213063 - protein, 10 aa, Plasmodium falciparum
DGQNTPPESN

SEQ ID NO: 3213064 - protein, 6 aa, Plasmodium falciparum
DGRDME

SEQ ID NO: 3213065 - protein, 8 aa, Plasmodium falciparum
DGRRNKGK

SEQ ID NO: 3213066 - protein, 13 aa, Plasmodium falciparum
DGRSTENSARTTK

SEQ ID NO: 3213067 - protein, 12 aa, Plasmodium falciparum
DGRYDSITEENL

SEQ ID NO: 3213068 - protein, 9 aa, Plasmodium falciparum
DGSDENKYS

SEQ ID NO: 3213069 - protein, 5 aa, Plasmodium falciparum
DGSLG

SEQ ID NO: 3213070 - protein, 18 aa, Plasmodium falciparum
DGSPSDKEMQERESKIKD

SEQ ID NO: 3213071 - protein, 12 aa, Plasmodium falciparum
DGSPSDKEMYTR

SEQ ID NO: 3213072 - protein, 5 aa, Plasmodium falciparum
DGSSL

SEQ ID NO: 3213073 - protein, 23 aa, Plasmodium falciparum
DGSSRNKYNEKCGDNDDGSSSSN

SEQ ID NO: 3213074 - protein, 8 aa, Plasmodium falciparum
DGSSYNNT

SEQ ID NO: 3213075 - protein, 7 aa, Plasmodium falciparum
DGSTGYQ

SEQ ID NO: 3213076 - protein, 4 aa, Plasmodium falciparum
DGSV

SEQ ID NO: 3213077 - protein, 5 aa, Plasmodium falciparum
DGSVT

SEQ ID NO: 3213078 - protein, 8 aa, Plasmodium falciparum
DGSVTEEV

SEQ ID NO: 3213079 - protein, 14 aa, Plasmodium falciparum
DGSVTGSGSSCDDI

SEQ ID NO: 3213080 - protein, 8 aa, Plasmodium falciparum
DGSVTKDV

SEQ ID NO: 3213081 - protein, 10 aa, Plasmodium falciparum
DGTKEDLPNK

SEQ ID NO: 3213082 - protein, 15 aa, Plasmodium falciparum
DGTNYKGCQDTSISG

SEQ ID NO: 3213083 - protein, 6 aa, Plasmodium falciparum
DGTPCN

SEQ ID NO: 3213084 - protein, 12 aa, Plasmodium falciparum
DGTSNHTNSYSS

SEQ ID NO: 3213085 - protein, 4 aa, Plasmodium falciparum
DGTY

SEQ ID NO: 3213086 - protein, 12 aa, Plasmodium falciparum
DGTYGAPGTTPI

SEQ ID NO: 3213087 - protein, 18 aa, Plasmodium falciparum
DGVADTEAARVTATKTAA

SEQ ID NO: 3213088 - protein, 14 aa, Plasmodium falciparum
DGVEDEDDEDDEVY

SEQ ID NO: 3213089 - protein, 9 aa, Plasmodium falciparum
DGVHGDGVH

SEQ ID NO: 3213090 - protein, 9 aa, Plasmodium falciparum
DGVKNDGVI

SEQ ID NO: 3213091 - protein, 23 aa, Plasmodium falciparum
DGVKNDGVKNDGVKNDGVKNDGV

SEQ ID NO: 3213092 - protein, 10 aa, Plasmodium falciparum
DGVNDAPALK

SEQ ID NO: 3213093 - protein, 6 aa, Plasmodium falciparum
DGVTNG

SEQ ID NO: 3213094 - protein, 6 aa, Plasmodium falciparum
DGYGDV

SEQ ID NO: 3213095 - protein, 10 aa, Plasmodium falciparum
DGYGNAKELE

SEQ ID NO: 3213096 - protein, 6 aa, Plasmodium falciparum
DGYTSQ

SEQ ID NO: 3213097 - protein, 7 aa, Plasmodium falciparum
DGYYEPN

SEQ ID NO: 3213098 - protein, 26 aa, Plasmodium falciparum
DHCDNSNGNNCKDNKITAEKIGNGVD

SEQ ID NO: 3213099 - protein, 78 aa, Plasmodium falciparum
DHDDNMDSNADHNMDSNADHNMDSNADHNMDSNADHNMDSNEDHNMDSNTDHNIDSNTDHNMDSNADHNMDSNTDHNM

SEQ ID NO: 3213100 - protein, 24 aa, Plasmodium falciparum
DHDDQHHNNNNNNDNNNNNKGDTL

SEQ ID NO: 3213101 - protein, 5 aa, Plasmodium falciparum
DHDEK

SEQ ID NO: 3213102 - protein, 4 aa, Plasmodium falciparum
DHDH

SEQ ID NO: 3213103 - protein, 8 aa, Plasmodium falciparum
DHDKKEIE

SEQ ID NO: 3213104 - protein, 11 aa, Plasmodium falciparum
DHDNDNYQGSS

SEQ ID NO: 3213105 - protein, 19 aa, Plasmodium falciparum
DHDNYSNKGNYNYRNDEYN

SEQ ID NO: 3213106 - protein, 11 aa, Plasmodium falciparum
DHDNYYSENNN

SEQ ID NO: 3213107 - protein, 16 aa, Plasmodium falciparum
DHEERYRTSQVSERSI

SEQ ID NO: 3213108 - protein, 12 aa, Plasmodium falciparum
DHEGTDKNINDG

SEQ ID NO: 3213109 - protein, 10 aa, Plasmodium falciparum
DHEKKKKELE

SEQ ID NO: 3213110 - protein, 12 aa, Plasmodium falciparum
DHEKKKKKKNTF

SEQ ID NO: 3213111 - protein, 11 aa, Plasmodium falciparum
DHENKKKNRNI

SEQ ID NO: 3213112 - protein, 18 aa, Plasmodium falciparum
DHENKSELKNNREDKNDH

SEQ ID NO: 3213113 - protein, 15 aa, Plasmodium falciparum
DHGDINNNNKDEGTF

SEQ ID NO: 3213114 - protein, 6 aa, Plasmodium falciparum
DHGERP

SEQ ID NO: 3213115 - protein, 7 aa, Plasmodium falciparum
DHGYTND

SEQ ID NO: 3213116 - protein, 9 aa, Plasmodium falciparum
DHHEETEDV

SEQ ID NO: 3213117 - protein, 28 aa, Plasmodium falciparum
DHIDNSGNKNKNVDGNKELGKKEYEHKT

SEQ ID NO: 3213118 - protein, 13 aa, Plasmodium falciparum
DHIKNKDNISYNK

SEQ ID NO: 3213119 - protein, 62 aa, Plasmodium falciparum
DHINDNEKEMYSSGSSRTSYTNKKKGYKYKNNYKKKKKKTEKNIYDNKKAKKKKKEKVEKKK

SEQ ID NO: 3213120 - protein, 9 aa, Plasmodium falciparum
DHINEERKE

SEQ ID NO: 3213121 - protein, 14 aa, Plasmodium falciparum
DHIPNGQKTDRQRQ

SEQ ID NO: 3213122 - protein, 15 aa, Plasmodium falciparum
DHKDEHDEKGTGKYI

SEQ ID NO: 3213123 - protein, 9 aa, Plasmodium falciparum
DHKHNNHRN

SEQ ID NO: 3213124 - protein, 11 aa, Plasmodium falciparum
DHKKKSHSQQL

SEQ ID NO: 3213125 - protein, 5 aa, Plasmodium falciparum
DHKNE

SEQ ID NO: 3213126 - protein, 9 aa, Plasmodium falciparum
DHKNINSQG

SEQ ID NO: 3213127 - protein, 19 aa, Plasmodium falciparum
DHKNNNKNNNNNNNNNEIN

SEQ ID NO: 3213128 - protein, 4 aa, Plasmodium falciparum
DHLG

SEQ ID NO: 3213129 - protein, 23 aa, Plasmodium falciparum
DHLNSPKNQFEDSSAKKKKNVDN

SEQ ID NO: 3213130 - protein, 27 aa, Plasmodium falciparum
DHMNKEDKQKNVIDQENNNKQKSNKTH

SEQ ID NO: 3213131 - protein, 5 aa, Plasmodium falciparum
DHNDN

SEQ ID NO: 3213132 - protein, 7 aa, Plasmodium falciparum
DHNDYQD

SEQ ID NO: 3213133 - protein, 6 aa, Plasmodium falciparum
DHNEKT

SEQ ID NO: 3213134 - protein, 7 aa, Plasmodium falciparum
DHNENGN

SEQ ID NO: 3213135 - protein, 5 aa, Plasmodium falciparum
DHNFN

SEQ ID NO: 3213136 - protein, 8 aa, Plasmodium falciparum
DHNGYQDI

SEQ ID NO: 3213137 - protein, 48 aa, Plasmodium falciparum
DHNHKSDHNHKSDHNHKSDNNHKSDSNHKSDSNHKSDHNHKSDSNHMS

SEQ ID NO: 3213138 - protein, 42 aa, Plasmodium falciparum
DHNHKSDHNHKSDNNHKSDSNHKSDSNHKSDHNHKSDSNHMS

SEQ ID NO: 3213139 - protein, 182 aa, Plasmodium falciparum
DHNHKSDHNHKSDNNHKSDSNHKSDSNHKSDSNHKSDHNHKSDHKHMSDNNHKSDNNHKSDHNHKSDNNHKSDHNHKSDSNHKSDSNHKSDSNHKSDSNHKSDNNHKSDHNHNSDSNHMSDHNHKSDHNHKSDHNHKSDNNHKSDNNHKSDHNHKSDHKKNNNNNKDNKNDDNDDSDASDAV

SEQ ID NO: 3213140 - protein, 58 aa, Plasmodium falciparum
DHNKEPKKKKNKSNETQINDDTNKKETHKNEIDHKEQKDTNCDNGIEEKKDQVSKSNN

SEQ ID NO: 3213141 - protein, 4 aa, Plasmodium falciparum
DHNN

SEQ ID NO: 3213142 - protein, 19 aa, Plasmodium falciparum
DHNNDHNDHNNDNNKNYNY

SEQ ID NO: 3213143 - protein, 7 aa, Plasmodium falciparum
DHNNENI

SEQ ID NO: 3213144 - protein, 5 aa, Plasmodium falciparum
DHNNN

SEQ ID NO: 3213145 - protein, 13 aa, Plasmodium falciparum
DHNNNNNSNSNNN

SEQ ID NO: 3213146 - protein, 8 aa, Plasmodium falciparum
DHNNNNYH

SEQ ID NO: 3213147 - protein, 16 aa, Plasmodium falciparum
DHNNYQDTDDHNNYNN

SEQ ID NO: 3213148 - protein, 8 aa, Plasmodium falciparum
DHNNYRTN

SEQ ID NO: 3213149 - protein, 14 aa, Plasmodium falciparum
DHNTNNNNKNNENN

SEQ ID NO: 3213150 - protein, 34 aa, Plasmodium falciparum
DHPRDNNNNNDDNNNNNNDNNNNDDNNNNNGGDI

SEQ ID NO: 3213151 - protein, 4 aa, Plasmodium falciparum
DHQE

SEQ ID NO: 3213152 - protein, 7 aa, Plasmodium falciparum
DHQNGTN

SEQ ID NO: 3213153 - protein, 41 aa, Plasmodium falciparum
DHQTGGKQGTDEKNEYNNTQDSSLTYGKDKDEEFTTESSNI

SEQ ID NO: 3213154 - protein, 11 aa, Plasmodium falciparum
DHRKQDDSSVQ

SEQ ID NO: 3213155 - protein, 10 aa, Plasmodium falciparum
DHSDHNDEKH

SEQ ID NO: 3213156 - protein, 18 aa, Plasmodium falciparum
DHSKEETLDDISQEDQQK

SEQ ID NO: 3213157 - protein, 15 aa, Plasmodium falciparum
DHSRNTQNTNETLDD

SEQ ID NO: 3213158 - protein, 7 aa, Plasmodium falciparum
DHSSNKI

SEQ ID NO: 3213159 - protein, 34 aa, Plasmodium falciparum
DHSSSSSSSPPSNNNNNNNNNINKYDEEDDEENK

SEQ ID NO: 3213160 - protein, 38 aa, Plasmodium falciparum
DHTDNHNNNDKNNNNFNNNNNFNNNNNFNNNNNFNNNC

SEQ ID NO: 3213161 - protein, 4 aa, Plasmodium falciparum
DHTP

SEQ ID NO: 3213162 - protein, 7 aa, Plasmodium falciparum
DHTPYRK

SEQ ID NO: 3213163 - protein, 5 aa, Plasmodium falciparum
DHTTK

SEQ ID NO: 3213164 - protein, 14 aa, Plasmodium falciparum
DHVPENSLKGTNEM

SEQ ID NO: 3213165 - protein, 8 aa, Plasmodium falciparum
DHYQDTDN

SEQ ID NO: 3213166 - protein, 16 aa, Plasmodium falciparum
DIASNSSSDDTDNDIN

SEQ ID NO: 3213167 - protein, 13 aa, Plasmodium falciparum
DIDDDKKKSFCKG

SEQ ID NO: 3213168 - protein, 39 aa, Plasmodium falciparum
DIDEEDDEYYNDGSDDSDDSDDSDGNDDSDDNDDDIDDL

SEQ ID NO: 3213169 - protein, 7 aa, Plasmodium falciparum
DIDEEYD

SEQ ID NO: 3213170 - protein, 7 aa, Plasmodium falciparum
DIDETSA

SEQ ID NO: 3213171 - protein, 31 aa, Plasmodium falciparum
DIDEYEEGINRNHKEEDNKNRTYHSNGEDSI

SEQ ID NO: 3213172 - protein, 9 aa, Plasmodium falciparum
DIDKNKKVG

SEQ ID NO: 3213173 - protein, 11 aa, Plasmodium falciparum
DIDNDDDDEDD

SEQ ID NO: 3213174 - protein, 11 aa, Plasmodium falciparum
DIDNDENNNYI

SEQ ID NO: 3213175 - protein, 19 aa, Plasmodium falciparum
DIDNEEEEEEDEEGGSSGG

SEQ ID NO: 3213176 - protein, 8 aa, Plasmodium falciparum
DIDPKEVE

SEQ ID NO: 3213177 - protein, 7 aa, Plasmodium falciparum
DIDSCGK

SEQ ID NO: 3213178 - protein, 24 aa, Plasmodium falciparum
DIDTKNKTDSDYKNKRDKEGVENK

SEQ ID NO: 3213179 - protein, 11 aa, Plasmodium falciparum
DIEEKEIKEKN

SEQ ID NO: 3213180 - protein, 22 aa, Plasmodium falciparum
DIEETKKDEKVALEKSTDNISN

SEQ ID NO: 3213181 - protein, 36 aa, Plasmodium falciparum
DIEEYTSKDKMSKSSTSNIDSYDTTHRGNDQNNNIE

SEQ ID NO: 3213182 - protein, 11 aa, Plasmodium falciparum
DIEKGSSHIDD

SEQ ID NO: 3213183 - protein, 20 aa, Plasmodium falciparum
DIEKHGDVDDDDADGNPLNA

SEQ ID NO: 3213184 - protein, 18 aa, Plasmodium falciparum
DIEKKKEKFDDLSSHKSD

SEQ ID NO: 3213185 - protein, 4 aa, Plasmodium falciparum
DIEN

SEQ ID NO: 3213186 - protein, 10 aa, Plasmodium falciparum
DIENKNNRDI

SEQ ID NO: 3213187 - protein, 13 aa, Plasmodium falciparum
DIEPTESFEKGEE

SEQ ID NO: 3213188 - protein, 4 aa, Plasmodium falciparum
DIEQ

SEQ ID NO: 3213189 - protein, 16 aa, Plasmodium falciparum
DIEQTKKKKKKNEQDI

SEQ ID NO: 3213190 - protein, 4 aa, Plasmodium falciparum
DIER

SEQ ID NO: 3213191 - protein, 6 aa, Plasmodium falciparum
DIESDT

SEQ ID NO: 3213192 - protein, 31 aa, Plasmodium falciparum
DIESDYSQSLQKEEEEGEEAYEQQEQRSDNK

SEQ ID NO: 3213193 - protein, 7 aa, Plasmodium falciparum
DIESTPQ

SEQ ID NO: 3213194 - protein, 9 aa, Plasmodium falciparum
DIGDGGNST

SEQ ID NO: 3213195 - protein, 34 aa, Plasmodium falciparum
DIGDKDTPYETQKSKIRSKDENVAHQNKGGNTLS

SEQ ID NO: 3213196 - protein, 12 aa, Plasmodium falciparum
DIGGEKKNIADR

SEQ ID NO: 3213197 - protein, 11 aa, Plasmodium falciparum
DIGPNKSERSY

SEQ ID NO: 3213198 - protein, 5 aa, Plasmodium falciparum
DIHNN

SEQ ID NO: 3213199 - protein, 9 aa, Plasmodium falciparum
DIHNNNDNY

SEQ ID NO: 3213200 - protein, 15 aa, Plasmodium falciparum
DIHNNNNNNNNNNTK

SEQ ID NO: 3213201 - protein, 5 aa, Plasmodium falciparum
DIHQN

SEQ ID NO: 3213202 - protein, 6 aa, Plasmodium falciparum
DIHRKK

SEQ ID NO: 3213203 - protein, 6 aa, Plasmodium falciparum
DIKDEK

SEQ ID NO: 3213204 - protein, 14 aa, Plasmodium falciparum
DIKDSNKATPPYQY

SEQ ID NO: 3213205 - protein, 11 aa, Plasmodium falciparum
DIKDTNEVKEI

SEQ ID NO: 3213206 - protein, 8 aa, Plasmodium falciparum
DIKEGKKN

SEQ ID NO: 3213207 - protein, 19 aa, Plasmodium falciparum
DIKEKSPSNKITQNNDSKH

SEQ ID NO: 3213208 - protein, 196 aa, Plasmodium falciparum
DIKENSGDIKENSGDIKENSGDIKKNSSDKKKNSGDKKKNSGDIKKNSSDKKKNSSDKKINSGDKKINSDDIKKNSDDIKKNSDDIKKNSGDKKKNSGDIKKNSGDKKKNSGDIKKNSSDNNIKNGDNNIKNGDNNIKNGDNDIKNDDNNINNGDNDIKNDDNNIKNGDNIKNGDNNINNGDNNNNNIEKTEPIKR

SEQ ID NO: 3213209 - protein, 7 aa, Plasmodium falciparum
DIKGQRK

SEQ ID NO: 3213210 - protein, 8 aa, Plasmodium falciparum
DIKGRRNK

SEQ ID NO: 3213211 - protein, 4 aa, Plasmodium falciparum
DIKK

SEQ ID NO: 3213212 - protein, 30 aa, Plasmodium falciparum
DIKKKKNDFSYKNNKSRDIPRNNEMKKKNT

SEQ ID NO: 3213213 - protein, 14 aa, Plasmodium falciparum
DIKKRRRKKKSYKE

SEQ ID NO: 3213214 - protein, 14 aa, Plasmodium falciparum
DIKKVNKKKIKKGH

SEQ ID NO: 3213215 - protein, 10 aa, Plasmodium falciparum
DIKNGGDSTE

SEQ ID NO: 3213216 - protein, 22 aa, Plasmodium falciparum
DIKNNNDVNDEKDENSTNEKKD

SEQ ID NO: 3213217 - protein, 7 aa, Plasmodium falciparum
DIKNTEE

SEQ ID NO: 3213218 - protein, 10 aa, Plasmodium falciparum
DIKPNTNNTK

SEQ ID NO: 3213219 - protein, 16 aa, Plasmodium falciparum
DIKRENERLKHYIFHN

SEQ ID NO: 3213220 - protein, 7 aa, Plasmodium falciparum
DIKRKQE

SEQ ID NO: 3213221 - protein, 134 aa, Plasmodium falciparum
DIKSDDVNKKSDSVNKKSDGVNKKSDGVNKKSDGVHKKSDGVHKKSDDVHKKSDDVHKKGDDIDKKSDDIDKKSDDIDKKSDDVHKKSDDIDKKSDDVHKKGDDIDKKSDDIDKKSDDIDKKSDDIDKKSNIAD

SEQ ID NO: 3213222 - protein, 19 aa, Plasmodium falciparum
DIKSKKKRKKEKKKKGKMK

SEQ ID NO: 3213223 - protein, 9 aa, Plasmodium falciparum
DIKSNEDIK

SEQ ID NO: 3213224 - protein, 20 aa, Plasmodium falciparum
DIKSRTKKKIRKKNKKRSKD

SEQ ID NO: 3213225 - protein, 4 aa, Plasmodium falciparum
DILG

SEQ ID NO: 3213226 - protein, 11 aa, Plasmodium falciparum
DINDKDKSNRL

SEQ ID NO: 3213227 - protein, 6 aa, Plasmodium falciparum
DINDND

SEQ ID NO: 3213228 - protein, 10 aa, Plasmodium falciparum
DINDNNDNID

SEQ ID NO: 3213229 - protein, 18 aa, Plasmodium falciparum
DINEEQPNDKFEGVPDEV

SEQ ID NO: 3213230 - protein, 13 aa, Plasmodium falciparum
DINELKNSDPPKE

SEQ ID NO: 3213231 - protein, 6 aa, Plasmodium falciparum
DINETY

SEQ ID NO: 3213232 - protein, 4 aa, Plasmodium falciparum
DINI

SEQ ID NO: 3213233 - protein, 5 aa, Plasmodium falciparum
DINKD

SEQ ID NO: 3213234 - protein, 12 aa, Plasmodium falciparum
DINKEEKEINNY

SEQ ID NO: 3213235 - protein, 7 aa, Plasmodium falciparum
DINKGEN

SEQ ID NO: 3213236 - protein, 16 aa, Plasmodium falciparum
DINKKENELSKKDQEI

SEQ ID NO: 3213237 - protein, 14 aa, Plasmodium falciparum
DINKNNNNNTSSDF

SEQ ID NO: 3213238 - protein, 8 aa, Plasmodium falciparum
DINKQELT

SEQ ID NO: 3213239 - protein, 73 aa, Plasmodium falciparum
DINNNENNDNNNNENNDNNNNENNDNNNNENNDNNNENNDDNNYNNYNNNEPFEDNLSNDEKYSQVKKRKTDM

SEQ ID NO: 3213240 - protein, 17 aa, Plasmodium falciparum
DINNNNNNNNNDNNNNT

SEQ ID NO: 3213241 - protein, 14 aa, Plasmodium falciparum
DINNNNNNNNYDYN

SEQ ID NO: 3213242 - protein, 26 aa, Plasmodium falciparum
DINNNSSSNNNNINNNNNNNQTNSYR

SEQ ID NO: 3213243 - protein, 6 aa, Plasmodium falciparum
DINNSE

SEQ ID NO: 3213244 - protein, 10 aa, Plasmodium falciparum
DINNSSNNSI

SEQ ID NO: 3213245 - protein, 6 aa, Plasmodium falciparum
DINNTQ

SEQ ID NO: 3213246 - protein, 17 aa, Plasmodium falciparum
DINPQSEDHDEKKHKLE

SEQ ID NO: 3213247 - protein, 8 aa, Plasmodium falciparum
DINSNRDD

SEQ ID NO: 3213248 - protein, 10 aa, Plasmodium falciparum
DINSNTYTEN

SEQ ID NO: 3213249 - protein, 9 aa, Plasmodium falciparum
DINSSKTSS

SEQ ID NO: 3213250 - protein, 7 aa, Plasmodium falciparum
DINTTIN

SEQ ID NO: 3213251 - protein, 5 aa, Plasmodium falciparum
DINYE

SEQ ID NO: 3213252 - protein, 5 aa, Plasmodium falciparum
DIPDS

SEQ ID NO: 3213253 - protein, 4 aa, Plasmodium falciparum
DIPE

SEQ ID NO: 3213254 - protein, 5 aa, Plasmodium falciparum
DIPEF

SEQ ID NO: 3213255 - protein, 9 aa, Plasmodium falciparum
DIPEKHRKS

SEQ ID NO: 3213256 - protein, 29 aa, Plasmodium falciparum
DIPKEGSADEYSQDNNNNKTDDQNNDDNK

SEQ ID NO: 3213257 - protein, 6 aa, Plasmodium falciparum
DIPKEQ

SEQ ID NO: 3213258 - protein, 5 aa, Plasmodium falciparum
DIPNN

SEQ ID NO: 3213259 - protein, 15 aa, Plasmodium falciparum
DIPNNMSEEKRDEKE

SEQ ID NO: 3213260 - protein, 5 aa, Plasmodium falciparum
DIPRS

SEQ ID NO: 3213261 - protein, 8 aa, Plasmodium falciparum
DIPSENRT

SEQ ID NO: 3213262 - protein, 6 aa, Plasmodium falciparum
DIPTDH

SEQ ID NO: 3213263 - protein, 14 aa, Plasmodium falciparum
DIQDRKNKKDGIIE

SEQ ID NO: 3213264 - protein, 5 aa, Plasmodium falciparum
DIQRS

SEQ ID NO: 3213265 - protein, 6 aa, Plasmodium falciparum
DIQSDS

SEQ ID NO: 3213266 - protein, 12 aa, Plasmodium falciparum
DIQSKNSKENEI

SEQ ID NO: 3213267 - protein, 18 aa, Plasmodium falciparum
DIRDNKNNISGNKIDGTS

SEQ ID NO: 3213268 - protein, 9 aa, Plasmodium falciparum
DIRDPDGTG

SEQ ID NO: 3213269 - protein, 5 aa, Plasmodium falciparum
DIREQ

SEQ ID NO: 3213270 - protein, 41 aa, Plasmodium falciparum
DIRKESGKKSDNSLKGNGNTYNNNCNNSMREEYANQNGETC

SEQ ID NO: 3213271 - protein, 12 aa, Plasmodium falciparum
DIRNEDNESYEY

SEQ ID NO: 3213272 - protein, 13 aa, Plasmodium falciparum
DIRTPDSIKEPGL

SEQ ID NO: 3213273 - protein, 5 aa, Plasmodium falciparum
DISDD

SEQ ID NO: 3213274 - protein, 17 aa, Plasmodium falciparum
DISDDNIEKKKKKNDGI

SEQ ID NO: 3213275 - protein, 5 aa, Plasmodium falciparum
DISDK

SEQ ID NO: 3213276 - protein, 23 aa, Plasmodium falciparum
DISDQKDKFQDSNKGLKKGTNPF

SEQ ID NO: 3213277 - protein, 8 aa, Plasmodium falciparum
DISGDEPY

SEQ ID NO: 3213278 - protein, 4 aa, Plasmodium falciparum
DISK

SEQ ID NO: 3213279 - protein, 14 aa, Plasmodium falciparum
DISKKKKKKKKKNC

SEQ ID NO: 3213280 - protein, 12 aa, Plasmodium falciparum
DISKNKEKKKKK

SEQ ID NO: 3213281 - protein, 5 aa, Plasmodium falciparum
DISKP

SEQ ID NO: 3213282 - protein, 8 aa, Plasmodium falciparum
DISKSGSV

SEQ ID NO: 3213283 - protein, 12 aa, Plasmodium falciparum
DISNGEKRKCEN

SEQ ID NO: 3213284 - protein, 13 aa, Plasmodium falciparum
DISNNNNNNNNIN

SEQ ID NO: 3213285 - protein, 11 aa, Plasmodium falciparum
DISNNSVTRAY

SEQ ID NO: 3213286 - protein, 6 aa, Plasmodium falciparum
DISNQN

SEQ ID NO: 3213287 - protein, 6 aa, Plasmodium falciparum
DISSDL

SEQ ID NO: 3213288 - protein, 8 aa, Plasmodium falciparum
DISSDTFN

SEQ ID NO: 3213289 - protein, 32 aa, Plasmodium falciparum
DISSELEKKSTTTYTSEDEYNISSKNSESSPM

SEQ ID NO: 3213290 - protein, 27 aa, Plasmodium falciparum
DISSKKKEKNICQNNGEEIKDDGNYVT

SEQ ID NO: 3213291 - protein, 8 aa, Plasmodium falciparum
DISSRSGE

SEQ ID NO: 3213292 - protein, 12 aa, Plasmodium falciparum
DISSSSNNNNNN

SEQ ID NO: 3213293 - protein, 7 aa, Plasmodium falciparum
DISSTKK

SEQ ID NO: 3213294 - protein, 6 aa, Plasmodium falciparum
DISTND

SEQ ID NO: 3213295 - protein, 9 aa, Plasmodium falciparum
DISTTNENI

SEQ ID NO: 3213296 - protein, 5 aa, Plasmodium falciparum
DISYN

SEQ ID NO: 3213297 - protein, 5 aa, Plasmodium falciparum
DITAS

SEQ ID NO: 3213298 - protein, 23 aa, Plasmodium falciparum
DITDDEDSDVDTSTSYDSQKNMN

SEQ ID NO: 3213299 - protein, 6 aa, Plasmodium falciparum
DITDEE

SEQ ID NO: 3213300 - protein, 6 aa, Plasmodium falciparum
DITEPL

SEQ ID NO: 3213301 - protein, 4 aa, Plasmodium falciparum
DITI

SEQ ID NO: 3213302 - protein, 13 aa, Plasmodium falciparum
DITKDDKITQKQN

SEQ ID NO: 3213303 - protein, 10 aa, Plasmodium falciparum
DITKNNPKGE

SEQ ID NO: 3213304 - protein, 32 aa, Plasmodium falciparum
DITKYNNNNNDNNNNDNNNNDNNNNDNKNGCD

SEQ ID NO: 3213305 - protein, 6 aa, Plasmodium falciparum
DITNDE

SEQ ID NO: 3213306 - protein, 15 aa, Plasmodium falciparum
DITNGSINNNNNNNM

SEQ ID NO: 3213307 - protein, 6 aa, Plasmodium falciparum
DITRAS

SEQ ID NO: 3213308 - protein, 11 aa, Plasmodium falciparum
DITRTKNTSDV

SEQ ID NO: 3213309 - protein, 21 aa, Plasmodium falciparum
DITSDTNNSPEIYSDNTSTKL

SEQ ID NO: 3213310 - protein, 5 aa, Plasmodium falciparum
DITTC

SEQ ID NO: 3213311 - protein, 5 aa, Plasmodium falciparum
DITTG

SEQ ID NO: 3213312 - protein, 32 aa, Plasmodium falciparum
DITTNDYNNNNINKNINSDNYSSSSSSNTISS

SEQ ID NO: 3213313 - protein, 13 aa, Plasmodium falciparum
DITTTDSDSSINE

SEQ ID NO: 3213314 - protein, 5 aa, Plasmodium falciparum
DIYDN

SEQ ID NO: 3213315 - protein, 29 aa, Plasmodium falciparum
DIYNNKKEKIEELKSDEKAFNTTETNCSQ

SEQ ID NO: 3213316 - protein, 19 aa, Plasmodium falciparum
DIYNNKNKNDSSNYNNGNS

SEQ ID NO: 3213317 - protein, 6 aa, Plasmodium falciparum
DIYNNN

SEQ ID NO: 3213318 - protein, 11 aa, Plasmodium falciparum
DIYNSNNSYDG

SEQ ID NO: 3213319 - protein, 5 aa, Plasmodium falciparum
DIYPS

SEQ ID NO: 3213320 - protein, 11 aa, Plasmodium falciparum
DIYQKKEPSEI

SEQ ID NO: 3213321 - protein, 4 aa, Plasmodium falciparum
DIYT

SEQ ID NO: 3213322 - protein, 6 aa, Plasmodium falciparum
DKADKT

SEQ ID NO: 3213323 - protein, 102 aa, Plasmodium falciparum
DKADSKEKKRDKPDTCGDVGRDESDRPGEQEDVNRRGNGDKKDEAERTKESKDSTGRHSDTGEGTIRSSDSSDASTEDSSKTSGRTNEDGDLSKGNEIPPVS

SEQ ID NO: 3213324 - protein, 22 aa, Plasmodium falciparum
DKAEDNYDGYNSSGSRYNNIND

SEQ ID NO: 3213325 - protein, 26 aa, Plasmodium falciparum
DKANDSGDNNNNNNNNNEKEPRNDIT

SEQ ID NO: 3213326 - protein, 9 aa, Plasmodium falciparum
DKANVDPPT

SEQ ID NO: 3213327 - protein, 7 aa, Plasmodium falciparum
DKAPSQE

SEQ ID NO: 3213328 - protein, 42 aa, Plasmodium falciparum
DKARKNHAAMKSNDQFAQEKNMTKEKSRTNIKSTQKDDATNK

SEQ ID NO: 3213329 - protein, 8 aa, Plasmodium falciparum
DKCDNSYS

SEQ ID NO: 3213330 - protein, 18 aa, Plasmodium falciparum
DKCDTRNKSTVDEKNGMD

SEQ ID NO: 3213331 - protein, 5 aa, Plasmodium falciparum
DKCKG

SEQ ID NO: 3213332 - protein, 6 aa, Plasmodium falciparum
DKCKSR

SEQ ID NO: 3213333 - protein, 16 aa, Plasmodium falciparum
DKCNNIPSNKSDMNNS

SEQ ID NO: 3213334 - protein, 20 aa, Plasmodium falciparum
DKCSGGNTKVKCDGKTPIDA

SEQ ID NO: 3213335 - protein, 6 aa, Plasmodium falciparum
DKDDNV

SEQ ID NO: 3213336 - protein, 6 aa, Plasmodium falciparum
DKDDSH

SEQ ID NO: 3213337 - protein, 8 aa, Plasmodium falciparum
DKDEDNEL

SEQ ID NO: 3213338 - protein, 33 aa, Plasmodium falciparum
DKDEKNDKNSSNNNNNNNNNNNNNNNNNNANVD

SEQ ID NO: 3213339 - protein, 8 aa, Plasmodium falciparum
DKDEKNEI

SEQ ID NO: 3213340 - protein, 11 aa, Plasmodium falciparum
DKDEKNKNKNS

SEQ ID NO: 3213341 - protein, 8 aa, Plasmodium falciparum
DKDENEIN

SEQ ID NO: 3213342 - protein, 9 aa, Plasmodium falciparum
DKDENKHWN

SEQ ID NO: 3213343 - protein, 9 aa, Plasmodium falciparum
DKDENVSSL

SEQ ID NO: 3213344 - protein, 6 aa, Plasmodium falciparum
DKDGEV

SEQ ID NO: 3213345 - protein, 12 aa, Plasmodium falciparum
DKDGKPLNPQYQ

SEQ ID NO: 3213346 - protein, 21 aa, Plasmodium falciparum
DKDGQNKKNHAHKPKNNHNKK

SEQ ID NO: 3213347 - protein, 6 aa, Plasmodium falciparum
DKDISN

SEQ ID NO: 3213348 - protein, 21 aa, Plasmodium falciparum
DKDKDSTTINGDNNKYEKEKC

SEQ ID NO: 3213349 - protein, 8 aa, Plasmodium falciparum
DKDKGAKI

SEQ ID NO: 3213350 - protein, 9 aa, Plasmodium falciparum
DKDKGKNKN

SEQ ID NO: 3213351 - protein, 6 aa, Plasmodium falciparum
DKDKNI

SEQ ID NO: 3213352 - protein, 9 aa, Plasmodium falciparum
DKDKNINST

SEQ ID NO: 3213353 - protein, 18 aa, Plasmodium falciparum
DKDKQDIQKLEEQEKALL

SEQ ID NO: 3213354 - protein, 21 aa, Plasmodium falciparum
DKDMEKLKEEEEKIIKAKTEI

SEQ ID NO: 3213355 - protein, 33 aa, Plasmodium falciparum
DKDNDSDGNNICDSNSNNSNSSDSYNNYNSNYN

SEQ ID NO: 3213356 - protein, 8 aa, Plasmodium falciparum
DKDNISND

SEQ ID NO: 3213357 - protein, 14 aa, Plasmodium falciparum
DKDNNKNGKENMDG

SEQ ID NO: 3213358 - protein, 10 aa, Plasmodium falciparum
DKDNSTYDKC

SEQ ID NO: 3213359 - protein, 25 aa, Plasmodium falciparum
DKDNYNSKGTFPENTFDDKKNCSYQ

SEQ ID NO: 3213360 - protein, 10 aa, Plasmodium falciparum
DKDPKYHAPN

SEQ ID NO: 3213361 - protein, 8 aa, Plasmodium falciparum
DKDPPLDD

SEQ ID NO: 3213362 - protein, 15 aa, Plasmodium falciparum
DKDQYEKQNSRRHIQ

SEQ ID NO: 3213363 - protein, 16 aa, Plasmodium falciparum
DKDSEQNKKNKKNKKM

SEQ ID NO: 3213364 - protein, 15 aa, Plasmodium falciparum
DKDSIETMFSSIKSI

SEQ ID NO: 3213365 - protein, 4 aa, Plasmodium falciparum
DKDT

SEQ ID NO: 3213366 - protein, 5 aa, Plasmodium falciparum
DKDTD

SEQ ID NO: 3213367 - protein, 7 aa, Plasmodium falciparum
DKDTHNK

SEQ ID NO: 3213368 - protein, 8 aa, Plasmodium falciparum
DKDTLNKE

SEQ ID NO: 3213369 - protein, 4 aa, Plasmodium falciparum
DKDV

SEQ ID NO: 3213370 - protein, 9 aa, Plasmodium falciparum
DKDVNDSNT

SEQ ID NO: 3213371 - protein, 16 aa, Plasmodium falciparum
DKEDIKKKKEKNEKED

SEQ ID NO: 3213372 - protein, 6 aa, Plasmodium falciparum
DKEDSV

SEQ ID NO: 3213373 - protein, 9 aa, Plasmodium falciparum
DKEEDQNVD

SEQ ID NO: 3213374 - protein, 14 aa, Plasmodium falciparum
DKEEHEHENKGKDI

SEQ ID NO: 3213375 - protein, 8 aa, Plasmodium falciparum
DKEEIKKE

SEQ ID NO: 3213376 - protein, 11 aa, Plasmodium falciparum
DKEEKEENKEE

SEQ ID NO: 3213377 - protein, 7 aa, Plasmodium falciparum
DKEEKHN

SEQ ID NO: 3213378 - protein, 8 aa, Plasmodium falciparum
DKEEKIQS

SEQ ID NO: 3213379 - protein, 14 aa, Plasmodium falciparum
DKEFNNNNNNKHQP

SEQ ID NO: 3213380 - protein, 12 aa, Plasmodium falciparum
DKEGASNEPISQ

SEQ ID NO: 3213381 - protein, 7 aa, Plasmodium falciparum
DKEGKDK

SEQ ID NO: 3213382 - protein, 17 aa, Plasmodium falciparum
DKEGSSKNVYSDSTEET

SEQ ID NO: 3213383 - protein, 17 aa, Plasmodium falciparum
DKEGVTTYSSSSPDEEA

SEQ ID NO: 3213384 - protein, 5 aa, Plasmodium falciparum
DKEHE

SEQ ID NO: 3213385 - protein, 4 aa, Plasmodium falciparum
DKEI

SEQ ID NO: 3213386 - protein, 12 aa, Plasmodium falciparum
DKEIAQREKTIK

SEQ ID NO: 3213387 - protein, 6 aa, Plasmodium falciparum
DKEIDD

SEQ ID NO: 3213388 - protein, 13 aa, Plasmodium falciparum
DKEIKGREEKIQE

SEQ ID NO: 3213389 - protein, 13 aa, Plasmodium falciparum
DKEIQEREKDIKG

SEQ ID NO: 3213390 - protein, 5 aa, Plasmodium falciparum
DKEIT

SEQ ID NO: 3213391 - protein, 4 aa, Plasmodium falciparum
DKEK

SEQ ID NO: 3213392 - protein, 7 aa, Plasmodium falciparum
DKEKDTI

SEQ ID NO: 3213393 - protein, 12 aa, Plasmodium falciparum
DKEKEDKEKNGR

SEQ ID NO: 3213394 - protein, 17 aa, Plasmodium falciparum
DKEKEEDRSTNNTTNYE

SEQ ID NO: 3213395 - protein, 11 aa, Plasmodium falciparum
DKEKEKRDQLE

SEQ ID NO: 3213396 - protein, 5 aa, Plasmodium falciparum
DKEKF

SEQ ID NO: 3213397 - protein, 8 aa, Plasmodium falciparum
DKEKIQDD

SEQ ID NO: 3213398 - protein, 7 aa, Plasmodium falciparum
DKEKKDI

SEQ ID NO: 3213399 - protein, 11 aa, Plasmodium falciparum
DKEKKEGDSNW

SEQ ID NO: 3213400 - protein, 6 aa, Plasmodium falciparum
DKEKKL

SEQ ID NO: 3213401 - protein, 9 aa, Plasmodium falciparum
DKEKKQEEL

SEQ ID NO: 3213402 - protein, 17 aa, Plasmodium falciparum
DKEKKTHSRKVDEETMT

SEQ ID NO: 3213403 - protein, 19 aa, Plasmodium falciparum
DKEKNKKNVDKGINDKNYS

SEQ ID NO: 3213404 - protein, 11 aa, Plasmodium falciparum
DKEKNKRDKNK

SEQ ID NO: 3213405 - protein, 8 aa, Plasmodium falciparum
DKEKQECI

SEQ ID NO: 3213406 - protein, 8 aa, Plasmodium falciparum
DKEKQNEL

SEQ ID NO: 3213407 - protein, 12 aa, Plasmodium falciparum
DKEKREKYHKEG

SEQ ID NO: 3213408 - protein, 13 aa, Plasmodium falciparum
DKEKREKYHKEGL

SEQ ID NO: 3213409 - protein, 6 aa, Plasmodium falciparum
DKEKTF

SEQ ID NO: 3213410 - protein, 9 aa, Plasmodium falciparum
DKEKTTDEY

SEQ ID NO: 3213411 - protein, 15 aa, Plasmodium falciparum
DKEKYEIEKSKNIKS

SEQ ID NO: 3213412 - protein, 6 aa, Plasmodium falciparum
DKELKD

SEQ ID NO: 3213413 - protein, 5 aa, Plasmodium falciparum
DKELS

SEQ ID NO: 3213414 - protein, 5 aa, Plasmodium falciparum
DKELT

SEQ ID NO: 3213415 - protein, 12 aa, Plasmodium falciparum
DKEMAQKEQNIK

SEQ ID NO: 3213416 - protein, 12 aa, Plasmodium falciparum
DKEMKEKEEKIK

SEQ ID NO: 3213417 - protein, 4 aa, Plasmodium falciparum
DKEN

SEQ ID NO: 3213418 - protein, 7 aa, Plasmodium falciparum
DKENCGG

SEQ ID NO: 3213419 - protein, 22 aa, Plasmodium falciparum
DKENDRKKNDDIKDKEESNNII

SEQ ID NO: 3213420 - protein, 12 aa, Plasmodium falciparum
DKENENLNKNIE

SEQ ID NO: 3213421 - protein, 9 aa, Plasmodium falciparum
DKENIKDKD

SEQ ID NO: 3213422 - protein, 26 aa, Plasmodium falciparum
DKENKKKKKLKQKKEHLSNDSMNNHN

SEQ ID NO: 3213423 - protein, 6 aa, Plasmodium falciparum
DKENNK

SEQ ID NO: 3213424 - protein, 8 aa, Plasmodium falciparum
DKENNKVN

SEQ ID NO: 3213425 - protein, 11 aa, Plasmodium falciparum
DKENPCKKRSD

SEQ ID NO: 3213426 - protein, 35 aa, Plasmodium falciparum
DKENSHKNYNNYSYDNKNNVNVGNNPCDNPKNNFT

SEQ ID NO: 3213427 - protein, 9 aa, Plasmodium falciparum
DKENVEEDN

SEQ ID NO: 3213428 - protein, 7 aa, Plasmodium falciparum
DKEPKDE

SEQ ID NO: 3213429 - protein, 9 aa, Plasmodium falciparum
DKEPKEVKG

SEQ ID NO: 3213430 - protein, 8 aa, Plasmodium falciparum
DKEQEKEY

SEQ ID NO: 3213431 - protein, 22 aa, Plasmodium falciparum
DKEQHKNNMKSNNNDDDVDNKI

SEQ ID NO: 3213432 - protein, 7 aa, Plasmodium falciparum
DKEQNIE

SEQ ID NO: 3213433 - protein, 8 aa, Plasmodium falciparum
DKEQRSNM

SEQ ID NO: 3213434 - protein, 8 aa, Plasmodium falciparum
DKEREQKY

SEQ ID NO: 3213435 - protein, 26 aa, Plasmodium falciparum
DKERESNDNDSTKQSMLNDDDADKLD

SEQ ID NO: 3213436 - protein, 7 aa, Plasmodium falciparum
DKERKKS

SEQ ID NO: 3213437 - protein, 8 aa, Plasmodium falciparum
DKESKEED

SEQ ID NO: 3213438 - protein, 7 aa, Plasmodium falciparum
DKETANE

SEQ ID NO: 3213439 - protein, 21 aa, Plasmodium falciparum
DKETNKTTTNNNNNDNNDNIC

SEQ ID NO: 3213440 - protein, 6 aa, Plasmodium falciparum
DKETNN

SEQ ID NO: 3213441 - protein, 6 aa, Plasmodium falciparum
DKETQL

SEQ ID NO: 3213442 - protein, 6 aa, Plasmodium falciparum
DKETYS

SEQ ID NO: 3213443 - protein, 7 aa, Plasmodium falciparum
DKEVNDR

SEQ ID NO: 3213444 - protein, 8 aa, Plasmodium falciparum
DKEYPQEL

SEQ ID NO: 3213445 - protein, 5 aa, Plasmodium falciparum
DKFRN

SEQ ID NO: 3213446 - protein, 4 aa, Plasmodium falciparum
DKFT

SEQ ID NO: 3213447 - protein, 8 aa, Plasmodium falciparum
DKGDADMS

SEQ ID NO: 3213448 - protein, 16 aa, Plasmodium falciparum
DKGDIKKGADIKEREG

SEQ ID NO: 3213449 - protein, 5 aa, Plasmodium falciparum
DKGDK

SEQ ID NO: 3213450 - protein, 11 aa, Plasmodium falciparum
DKGDKNDEHNI

SEQ ID NO: 3213451 - protein, 12 aa, Plasmodium falciparum
DKGEDKNDEKLR

SEQ ID NO: 3213452 - protein, 9 aa, Plasmodium falciparum
DKGEDRETK

SEQ ID NO: 3213453 - protein, 16 aa, Plasmodium falciparum
DKGEEEKKRKDEYNMS

SEQ ID NO: 3213454 - protein, 16 aa, Plasmodium falciparum
DKGEKGGKKKNPDDQI

SEQ ID NO: 3213455 - protein, 12 aa, Plasmodium falciparum
DKGEKKKKKERN

SEQ ID NO: 3213456 - protein, 9 aa, Plasmodium falciparum
DKGEKNGYS

SEQ ID NO: 3213457 - protein, 11 aa, Plasmodium falciparum
DKGENKSAGHP

SEQ ID NO: 3213458 - protein, 29 aa, Plasmodium falciparum
DKGENQYDTINSNKSVGNNNNNNINNNEN

SEQ ID NO: 3213459 - protein, 7 aa, Plasmodium falciparum
DKGGEDV

SEQ ID NO: 3213460 - protein, 14 aa, Plasmodium falciparum
DKGGHSGYDSSSGY

SEQ ID NO: 3213461 - protein, 7 aa, Plasmodium falciparum
DKGGQTM

SEQ ID NO: 3213462 - protein, 34 aa, Plasmodium falciparum
DKGGSVQNKEELSHGKDDGITNNYKDSKKCYKDK

SEQ ID NO: 3213463 - protein, 6 aa, Plasmodium falciparum
DKGKGK

SEQ ID NO: 3213464 - protein, 9 aa, Plasmodium falciparum
DKGKHDSLD

SEQ ID NO: 3213465 - protein, 8 aa, Plasmodium falciparum
DKGNEIKQ

SEQ ID NO: 3213466 - protein, 8 aa, Plasmodium falciparum
DKGNEIKS

SEQ ID NO: 3213467 - protein, 7 aa, Plasmodium falciparum
DKGNPKI

SEQ ID NO: 3213468 - protein, 7 aa, Plasmodium falciparum
DKGNVGN

SEQ ID NO: 3213469 - protein, 17 aa, Plasmodium falciparum
DKGRKHKRRSTRRNSID

SEQ ID NO: 3213470 - protein, 11 aa, Plasmodium falciparum
DKGRSRSSSNN

SEQ ID NO: 3213471 - protein, 4 aa, Plasmodium falciparum
DKGS

SEQ ID NO: 3213472 - protein, 23 aa, Plasmodium falciparum
DKGSDKSNNALKKKDKKTFSEEE

SEQ ID NO: 3213473 - protein, 7 aa, Plasmodium falciparum
DKHDEKD

SEQ ID NO: 3213474 - protein, 8 aa, Plasmodium falciparum
DKHDNTGA

SEQ ID NO: 3213475 - protein, 14 aa, Plasmodium falciparum
DKHGEEKKKKKNIN

SEQ ID NO: 3213476 - protein, 5 aa, Plasmodium falciparum
DKHHN

SEQ ID NO: 3213477 - protein, 4 aa, Plasmodium falciparum
DKHI

SEQ ID NO: 3213478 - protein, 7 aa, Plasmodium falciparum
DKHKNGL

SEQ ID NO: 3213479 - protein, 8 aa, Plasmodium falciparum
DKHKNKYN

SEQ ID NO: 3213480 - protein, 11 aa, Plasmodium falciparum
DKHNNNNNNNN

SEQ ID NO: 3213481 - protein, 10 aa, Plasmodium falciparum
DKHSESKKNN

SEQ ID NO: 3213482 - protein, 7 aa, Plasmodium falciparum
DKHSNEQ

SEQ ID NO: 3213483 - protein, 6 aa, Plasmodium falciparum
DKHTNY

SEQ ID NO: 3213484 - protein, 8 aa, Plasmodium falciparum
DKHVTSYN

SEQ ID NO: 3213485 - protein, 30 aa, Plasmodium falciparum
DKHYDKKNMEKKKKYSTNKESKKKKKNNIA

SEQ ID NO: 3213486 - protein, 6 aa, Plasmodium falciparum
DKIGLD

SEQ ID NO: 3213487 - protein, 9 aa, Plasmodium falciparum
DKIKKDNNF

SEQ ID NO: 3213488 - protein, 7 aa, Plasmodium falciparum
DKIKQTK

SEQ ID NO: 3213489 - protein, 14 aa, Plasmodium falciparum
DKINDKINDKINDK

SEQ ID NO: 3213490 - protein, 13 aa, Plasmodium falciparum
DKINKDKSSDDII

SEQ ID NO: 3213491 - protein, 11 aa, Plasmodium falciparum
DKINNYDNDED

SEQ ID NO: 3213492 - protein, 11 aa, Plasmodium falciparum
DKINRISPGEM

SEQ ID NO: 3213493 - protein, 6 aa, Plasmodium falciparum
DKIPDE

SEQ ID NO: 3213494 - protein, 4 aa, Plasmodium falciparum
DKIR

SEQ ID NO: 3213495 - protein, 8 aa, Plasmodium falciparum
DKIRGSGK

SEQ ID NO: 3213496 - protein, 6 aa, Plasmodium falciparum
DKISKS

SEQ ID NO: 3213497 - protein, 8 aa, Plasmodium falciparum
DKISNESY

SEQ ID NO: 3213498 - protein, 9 aa, Plasmodium falciparum
DKITSGISN

SEQ ID NO: 3213499 - protein, 9 aa, Plasmodium falciparum
DKKCESQNN

SEQ ID NO: 3213500 - protein, 5 aa, Plasmodium falciparum
DKKCR

SEQ ID NO: 3213501 - protein, 7 aa, Plasmodium falciparum
DKKCSDG

SEQ ID NO: 3213502 - protein, 9 aa, Plasmodium falciparum
DKKCSHSKN

SEQ ID NO: 3213503 - protein, 14 aa, Plasmodium falciparum
DKKDEKKHKSDDSI

SEQ ID NO: 3213504 - protein, 18 aa, Plasmodium falciparum
DKKDENKCNSYQKRASIS

SEQ ID NO: 3213505 - protein, 5 aa, Plasmodium falciparum
DKKDH

SEQ ID NO: 3213506 - protein, 11 aa, Plasmodium falciparum
DKKDHKKANEL

SEQ ID NO: 3213507 - protein, 7 aa, Plasmodium falciparum
DKKDINK

SEQ ID NO: 3213508 - protein, 7 aa, Plasmodium falciparum
DKKDNNI

SEQ ID NO: 3213509 - protein, 12 aa, Plasmodium falciparum
DKKDSSSNGGNS

SEQ ID NO: 3213510 - protein, 4 aa, Plasmodium falciparum
DKKE

SEQ ID NO: 3213511 - protein, 9 aa, Plasmodium falciparum
DKKEDNFED

SEQ ID NO: 3213512 - protein, 7 aa, Plasmodium falciparum
DKKEEIE

SEQ ID NO: 3213513 - protein, 9 aa, Plasmodium falciparum
DKKEEKRNV

SEQ ID NO: 3213514 - protein, 10 aa, Plasmodium falciparum
DKKEELENKS

SEQ ID NO: 3213515 - protein, 22 aa, Plasmodium falciparum
DKKEEPSNEQNEEQAKKNNNLV

SEQ ID NO: 3213516 - protein, 43 aa, Plasmodium falciparum
DKKEETKESKIAPHNKSYNGSTEESDKIDETMNDHKNDNKINN

SEQ ID NO: 3213517 - protein, 17 aa, Plasmodium falciparum
DKKEKDMNNKNIKKSYE

SEQ ID NO: 3213518 - protein, 8 aa, Plasmodium falciparum
DKKEKEWN

SEQ ID NO: 3213519 - protein, 7 aa, Plasmodium falciparum
DKKEKGK

SEQ ID NO: 3213520 - protein, 9 aa, Plasmodium falciparum
DKKEKINNI

SEQ ID NO: 3213521 - protein, 9 aa, Plasmodium falciparum
DKKEKKEYL

SEQ ID NO: 3213522 - protein, 12 aa, Plasmodium falciparum
DKKEKKKKKKKI

SEQ ID NO: 3213523 - protein, 8 aa, Plasmodium falciparum
DKKEKKRN

SEQ ID NO: 3213524 - protein, 7 aa, Plasmodium falciparum
DKKELEK

SEQ ID NO: 3213525 - protein, 9 aa, Plasmodium falciparum
DKKEMKNEN

SEQ ID NO: 3213526 - protein, 6 aa, Plasmodium falciparum
DKKENE

SEQ ID NO: 3213527 - protein, 7 aa, Plasmodium falciparum
DKKENID

SEQ ID NO: 3213528 - protein, 11 aa, Plasmodium falciparum
DKKENSNNEID

SEQ ID NO: 3213529 - protein, 8 aa, Plasmodium falciparum
DKKEPKCG

SEQ ID NO: 3213530 - protein, 8 aa, Plasmodium falciparum
DKKESSSI

SEQ ID NO: 3213531 - protein, 17 aa, Plasmodium falciparum
DKKESTYDERGETPELV

SEQ ID NO: 3213532 - protein, 7 aa, Plasmodium falciparum
DKKETFD

SEQ ID NO: 3213533 - protein, 17 aa, Plasmodium falciparum
DKKEYDEVEYDEKKNKE

SEQ ID NO: 3213534 - protein, 7 aa, Plasmodium falciparum
DKKEYEK

SEQ ID NO: 3213535 - protein, 4 aa, Plasmodium falciparum
DKKG

SEQ ID NO: 3213536 - protein, 8 aa, Plasmodium falciparum
DKKGDSLE

SEQ ID NO: 3213537 - protein, 17 aa, Plasmodium falciparum
DKKGKGSKKDMKNEYKS

SEQ ID NO: 3213538 - protein, 81 aa, Plasmodium falciparum
DKKGKTSNKEELEKEKEKEEHKLKEQQTVQEDQKVKDNKKIKDNQKVKDNKKIKDNQKVKDNKKIKQDNIEKTKNDKEEPI

SEQ ID NO: 3213539 - protein, 8 aa, Plasmodium falciparum
DKKGNENL

SEQ ID NO: 3213540 - protein, 6 aa, Plasmodium falciparum
DKKGNG

SEQ ID NO: 3213541 - protein, 8 aa, Plasmodium falciparum
DKKGNLNI

SEQ ID NO: 3213542 - protein, 7 aa, Plasmodium falciparum
DKKGPNE

SEQ ID NO: 3213543 - protein, 8 aa, Plasmodium falciparum
DKKGRPHG

SEQ ID NO: 3213544 - protein, 5 aa, Plasmodium falciparum
DKKGS

SEQ ID NO: 3213545 - protein, 7 aa, Plasmodium falciparum
DKKHTSA

SEQ ID NO: 3213546 - protein, 5 aa, Plasmodium falciparum
DKKIK

SEQ ID NO: 3213547 - protein, 44 aa, Plasmodium falciparum
DKKINEKNERNEKNERNEKNERNEKNEKNGKNEKNKDILSSTNN

SEQ ID NO: 3213548 - protein, 14 aa, Plasmodium falciparum
DKKKDKKKKASAEE

SEQ ID NO: 3213549 - protein, 39 aa, Plasmodium falciparum
DKKKEEEGETCTPASPAPAPAPAPASPSPTPAPADEPFD

SEQ ID NO: 3213550 - protein, 63 aa, Plasmodium falciparum
DKKKEEEGETCTPASPAPAPAPSEDPPVPAPAGDQKEASTPKVAPRPKPPRVKPQQPGDDPWE

SEQ ID NO: 3213551 - protein, 8 aa, Plasmodium falciparum
DKKKEENK

SEQ ID NO: 3213552 - protein, 8 aa, Plasmodium falciparum
DKKKEGSF

SEQ ID NO: 3213553 - protein, 8 aa, Plasmodium falciparum
DKKKGEIK

SEQ ID NO: 3213554 - protein, 9 aa, Plasmodium falciparum
DKKKGSILK

SEQ ID NO: 3213555 - protein, 5 aa, Plasmodium falciparum
DKKKK

SEQ ID NO: 3213556 - protein, 23 aa, Plasmodium falciparum
DKKKKIEKNNKESDHMSNNNNIE

SEQ ID NO: 3213557 - protein, 6 aa, Plasmodium falciparum
DKKKKK

SEQ ID NO: 3213558 - protein, 7 aa, Plasmodium falciparum
DKKKKKK

SEQ ID NO: 3213559 - protein, 11 aa, Plasmodium falciparum
DKKKKKKINKD

SEQ ID NO: 3213560 - protein, 18 aa, Plasmodium falciparum
DKKKKKKKKGKKKNPYTR

SEQ ID NO: 3213561 - protein, 12 aa, Plasmodium falciparum
DKKKKKKKKKKY

SEQ ID NO: 3213562 - protein, 10 aa, Plasmodium falciparum
DKKKKKNDYI

SEQ ID NO: 3213563 - protein, 22 aa, Plasmodium falciparum
DKKKKKQKNSTQGEYNNDDDNN

SEQ ID NO: 3213564 - protein, 9 aa, Plasmodium falciparum
DKKKKKRKS

SEQ ID NO: 3213565 - protein, 8 aa, Plasmodium falciparum
DKKKKKSL

SEQ ID NO: 3213566 - protein, 13 aa, Plasmodium falciparum
DKKKKKSQHTNEH

SEQ ID NO: 3213567 - protein, 16 aa, Plasmodium falciparum
DKKKKRKKKKKEINNC

SEQ ID NO: 3213568 - protein, 9 aa, Plasmodium falciparum
DKKKKRKLS

SEQ ID NO: 3213569 - protein, 7 aa, Plasmodium falciparum
DKKKLSD

SEQ ID NO: 3213570 - protein, 10 aa, Plasmodium falciparum
DKKKNISETP

SEQ ID NO: 3213571 - protein, 8 aa, Plasmodium falciparum
DKKKNNKY

SEQ ID NO: 3213572 - protein, 14 aa, Plasmodium falciparum
DKKKNVLNKDQKKC

SEQ ID NO: 3213573 - protein, 7 aa, Plasmodium falciparum
DKKKRAW

SEQ ID NO: 3213574 - protein, 6 aa, Plasmodium falciparum
DKKKRK

SEQ ID NO: 3213575 - protein, 13 aa, Plasmodium falciparum
DKKKRKKENTQGQ

SEQ ID NO: 3213576 - protein, 8 aa, Plasmodium falciparum
DKKKVRPK

SEQ ID NO: 3213577 - protein, 7 aa, Plasmodium falciparum
DKKKYTY

SEQ ID NO: 3213578 - protein, 20 aa, Plasmodium falciparum
DKKMNDDKKMNDEKKMNDDK

SEQ ID NO: 3213579 - protein, 4 aa, Plasmodium falciparum
DKKN

SEQ ID NO: 3213580 - protein, 14 aa, Plasmodium falciparum
DKKNEKRNNTSYNY

SEQ ID NO: 3213581 - protein, 63 aa, Plasmodium falciparum
DKKNEKSDKNEKNESSKSSKNTETYTNVNDKKSNNLITKGSNDKKKKKKDSKKNSSNNNNNNT

SEQ ID NO: 3213582 - protein, 12 aa, Plasmodium falciparum
DKKNGKEEDLNT

SEQ ID NO: 3213583 - protein, 17 aa, Plasmodium falciparum
DKKNKKNRKKNNVQNDY

SEQ ID NO: 3213584 - protein, 22 aa, Plasmodium falciparum
DKKNKTKKFDDSTTDNNMDPFS

SEQ ID NO: 3213585 - protein, 10 aa, Plasmodium falciparum
DKKNNFANDE

SEQ ID NO: 3213586 - protein, 9 aa, Plasmodium falciparum
DKKNNKKYL

SEQ ID NO: 3213587 - protein, 7 aa, Plasmodium falciparum
DKKNNNL

SEQ ID NO: 3213588 - protein, 12 aa, Plasmodium falciparum
DKKNNSNNKTDQ

SEQ ID NO: 3213589 - protein, 9 aa, Plasmodium falciparum
DKKNNYTNY

SEQ ID NO: 3213590 - protein, 8 aa, Plasmodium falciparum
DKKNRNNE

SEQ ID NO: 3213591 - protein, 7 aa, Plasmodium falciparum
DKKNRTQ

SEQ ID NO: 3213592 - protein, 9 aa, Plasmodium falciparum
DKKNSSDIN

SEQ ID NO: 3213593 - protein, 14 aa, Plasmodium falciparum
DKKNVKDDNGNMTN

SEQ ID NO: 3213594 - protein, 21 aa, Plasmodium falciparum
DKKNYDDNNYNNHNSNNYNSY

SEQ ID NO: 3213595 - protein, 5 aa, Plasmodium falciparum
DKKPN

SEQ ID NO: 3213596 - protein, 10 aa, Plasmodium falciparum
DKKQEWEKNK

SEQ ID NO: 3213597 - protein, 8 aa, Plasmodium falciparum
DKKQEYKE

SEQ ID NO: 3213598 - protein, 6 aa, Plasmodium falciparum
DKKQKK

SEQ ID NO: 3213599 - protein, 10 aa, Plasmodium falciparum
DKKQNKKKKK

SEQ ID NO: 3213600 - protein, 16 aa, Plasmodium falciparum
DKKQPDKQNSGTTPKT

SEQ ID NO: 3213601 - protein, 8 aa, Plasmodium falciparum
DKKQSGIV

SEQ ID NO: 3213602 - protein, 13 aa, Plasmodium falciparum
DKKQVSETTLTSQ

SEQ ID NO: 3213603 - protein, 4 aa, Plasmodium falciparum
DKKR

SEQ ID NO: 3213604 - protein, 23 aa, Plasmodium falciparum
DKKRAQNVGTREYKRKKKENVVQ

SEQ ID NO: 3213605 - protein, 6 aa, Plasmodium falciparum
DKKRKL

SEQ ID NO: 3213606 - protein, 10 aa, Plasmodium falciparum
DKKRKQENEM

SEQ ID NO: 3213607 - protein, 5 aa, Plasmodium falciparum
DKKRR

SEQ ID NO: 3213608 - protein, 6 aa, Plasmodium falciparum
DKKSAY

SEQ ID NO: 3213609 - protein, 7 aa, Plasmodium falciparum
DKKSDKI

SEQ ID NO: 3213610 - protein, 52 aa, Plasmodium falciparum
DKKSDKQNDNNEGNNNEGNNNDHINNNNNDNNNDHINNNNNDNNNDNNNNNY

SEQ ID NO: 3213611 - protein, 7 aa, Plasmodium falciparum
DKKSGFL

SEQ ID NO: 3213612 - protein, 6 aa, Plasmodium falciparum
DKKSGN

SEQ ID NO: 3213613 - protein, 6 aa, Plasmodium falciparum
DKKSIL

SEQ ID NO: 3213614 - protein, 5 aa, Plasmodium falciparum
DKKSL

SEQ ID NO: 3213615 - protein, 10 aa, Plasmodium falciparum
DKKSNDVKSN

SEQ ID NO: 3213616 - protein, 12 aa, Plasmodium falciparum
DKKSNNKKEKKV

SEQ ID NO: 3213617 - protein, 7 aa, Plasmodium falciparum
DKKSSYD

SEQ ID NO: 3213618 - protein, 4 aa, Plasmodium falciparum
DKKT

SEQ ID NO: 3213619 - protein, 11 aa, Plasmodium falciparum
DKKTGKPEGKY

SEQ ID NO: 3213620 - protein, 13 aa, Plasmodium falciparum
DKKTHNNNNNNNT

SEQ ID NO: 3213621 - protein, 9 aa, Plasmodium falciparum
DKKTKCKPM

SEQ ID NO: 3213622 - protein, 9 aa, Plasmodium falciparum
DKKTKNVEN

SEQ ID NO: 3213623 - protein, 6 aa, Plasmodium falciparum
DKKTNK

SEQ ID NO: 3213624 - protein, 7 aa, Plasmodium falciparum
DKKYEEH

SEQ ID NO: 3213625 - protein, 17 aa, Plasmodium falciparum
DKKYNIKNNNQNEEKNS

SEQ ID NO: 3213626 - protein, 71 aa, Plasmodium falciparum
DKKYSKGKKKEQHKEEEDDDDEEEEDNDEEEEEEEEDDDEEEEDNDEEEEEEEEDDDEEEEEEENKEEEDG

SEQ ID NO: 3213627 - protein, 8 aa, Plasmodium falciparum
DKKYTEKG

SEQ ID NO: 3213628 - protein, 17 aa, Plasmodium falciparum
DKLDGKDKNDKKKKKDL

SEQ ID NO: 3213629 - protein, 4 aa, Plasmodium falciparum
DKLE

SEQ ID NO: 3213630 - protein, 14 aa, Plasmodium falciparum
DKLEHNNSNNNNNN

SEQ ID NO: 3213631 - protein, 14 aa, Plasmodium falciparum
DKLKSPLVKQETDK

SEQ ID NO: 3213632 - protein, 15 aa, Plasmodium falciparum
DKLNNETYPEPPKKY

SEQ ID NO: 3213633 - protein, 13 aa, Plasmodium falciparum
DKLPGDKRKYNDN

SEQ ID NO: 3213634 - protein, 8 aa, Plasmodium falciparum
DKLSDENN

SEQ ID NO: 3213635 - protein, 14 aa, Plasmodium falciparum
DKMISQNEKSNISN

SEQ ID NO: 3213636 - protein, 7 aa, Plasmodium falciparum
DKMKSTT

SEQ ID NO: 3213637 - protein, 10 aa, Plasmodium falciparum
DKMNKEEEMN

SEQ ID NO: 3213638 - protein, 11 aa, Plasmodium falciparum
DKMRKKTKKND

SEQ ID NO: 3213639 - protein, 8 aa, Plasmodium falciparum
DKNAKDFA

SEQ ID NO: 3213640 - protein, 6 aa, Plasmodium falciparum
DKNANK

SEQ ID NO: 3213641 - protein, 9 aa, Plasmodium falciparum
DKNCTKKKV

SEQ ID NO: 3213642 - protein, 4 aa, Plasmodium falciparum
DKND

SEQ ID NO: 3213643 - protein, 15 aa, Plasmodium falciparum
DKNDDKRKRSIEENE

SEQ ID NO: 3213644 - protein, 8 aa, Plasmodium falciparum
DKNDGTIH

SEQ ID NO: 3213645 - protein, 42 aa, Plasmodium falciparum
DKNDITGFTKKEGQDINKKNNHVNNNINSNNNNNNNNDSKDE

SEQ ID NO: 3213646 - protein, 10 aa, Plasmodium falciparum
DKNDSQPTKT

SEQ ID NO: 3213647 - protein, 6 aa, Plasmodium falciparum
DKNEER

SEQ ID NO: 3213648 - protein, 18 aa, Plasmodium falciparum
DKNEESISKTSNNYQQQN

SEQ ID NO: 3213649 - protein, 6 aa, Plasmodium falciparum
DKNEKF

SEQ ID NO: 3213650 - protein, 9 aa, Plasmodium falciparum
DKNEKKRDD

SEQ ID NO: 3213651 - protein, 16 aa, Plasmodium falciparum
DKNEKKSNKTHSYGNN

SEQ ID NO: 3213652 - protein, 56 aa, Plasmodium falciparum
DKNEKNDEKNDEKNDEKNNEKNDEKNGDNNDDNNDNNNEDENNKKKKKKKKNDCNH

SEQ ID NO: 3213653 - protein, 17 aa, Plasmodium falciparum
DKNEKTEKKKSIQKNNN

SEQ ID NO: 3213654 - protein, 29 aa, Plasmodium falciparum
DKNEMNKDSSYDKKTDALDNYKNDSTIDM

SEQ ID NO: 3213655 - protein, 5 aa, Plasmodium falciparum
DKNEN

SEQ ID NO: 3213656 - protein, 9 aa, Plasmodium falciparum
DKNENKNSL

SEQ ID NO: 3213657 - protein, 9 aa, Plasmodium falciparum
DKNENNTNI

SEQ ID NO: 3213658 - protein, 13 aa, Plasmodium falciparum
DKNEQNKECEKKN

SEQ ID NO: 3213659 - protein, 8 aa, Plasmodium falciparum
DKNEQSYD

SEQ ID NO: 3213660 - protein, 30 aa, Plasmodium falciparum
DKNGEHEKGDKADDTSSSYNNNNINNMQNS

SEQ ID NO: 3213661 - protein, 12 aa, Plasmodium falciparum
DKNGGEQKTQGK

SEQ ID NO: 3213662 - protein, 7 aa, Plasmodium falciparum
DKNGIQN

SEQ ID NO: 3213663 - protein, 7 aa, Plasmodium falciparum
DKNGNGN

SEQ ID NO: 3213664 - protein, 16 aa, Plasmodium falciparum
DKNGRNNSKEKKEDNL

SEQ ID NO: 3213665 - protein, 12 aa, Plasmodium falciparum
DKNINDPEANEK

SEQ ID NO: 3213666 - protein, 7 aa, Plasmodium falciparum
DKNINEY

SEQ ID NO: 3213667 - protein, 7 aa, Plasmodium falciparum
DKNIPNN

SEQ ID NO: 3213668 - protein, 7 aa, Plasmodium falciparum
DKNIREL

SEQ ID NO: 3213669 - protein, 14 aa, Plasmodium falciparum
DKNITKKKGKDKNF

SEQ ID NO: 3213670 - protein, 17 aa, Plasmodium falciparum
DKNKDNVKNSSNGKNIS

SEQ ID NO: 3213671 - protein, 9 aa, Plasmodium falciparum
DKNKDQYSE

SEQ ID NO: 3213672 - protein, 38 aa, Plasmodium falciparum
DKNKEDKKDTEQVDDNKEDKKDPHQTDDKNDGASCEEE

SEQ ID NO: 3213673 - protein, 9 aa, Plasmodium falciparum
DKNKEDMKK

SEQ ID NO: 3213674 - protein, 12 aa, Plasmodium falciparum
DKNKEKRKRKRH

SEQ ID NO: 3213675 - protein, 7 aa, Plasmodium falciparum
DKNKENI

SEQ ID NO: 3213676 - protein, 34 aa, Plasmodium falciparum
DKNKIDENNNNNNNNKKRRRRKRRIEKKSDIDKT

SEQ ID NO: 3213677 - protein, 15 aa, Plasmodium falciparum
DKNKKDTINEGEQNG

SEQ ID NO: 3213678 - protein, 16 aa, Plasmodium falciparum
DKNKKEEKTVNEPEQF

SEQ ID NO: 3213679 - protein, 8 aa, Plasmodium falciparum
DKNKKGRL

SEQ ID NO: 3213680 - protein, 13 aa, Plasmodium falciparum
DKNKKIYKGENRS

SEQ ID NO: 3213681 - protein, 18 aa, Plasmodium falciparum
DKNKKTNKKTKEEKYSED

SEQ ID NO: 3213682 - protein, 8 aa, Plasmodium falciparum
DKNKKYNE

SEQ ID NO: 3213683 - protein, 5 aa, Plasmodium falciparum
DKNKN

SEQ ID NO: 3213684 - protein, 56 aa, Plasmodium falciparum
DKNKNIDKNIDKDKNIDKDKNIDKDKNIDKDKNIDKDKNIDKENNELSSNNKTTNV

SEQ ID NO: 3213685 - protein, 7 aa, Plasmodium falciparum
DKNKNIK

SEQ ID NO: 3213686 - protein, 24 aa, Plasmodium falciparum
DKNKQKTFNTNEYKDQQNNTYGKK

SEQ ID NO: 3213687 - protein, 9 aa, Plasmodium falciparum
DKNKRDVTP

SEQ ID NO: 3213688 - protein, 15 aa, Plasmodium falciparum
DKNKRSYIQTTEGNY

SEQ ID NO: 3213689 - protein, 13 aa, Plasmodium falciparum
DKNKTNDNNINNK

SEQ ID NO: 3213690 - protein, 8 aa, Plasmodium falciparum
DKNLENYQ

SEQ ID NO: 3213691 - protein, 6 aa, Plasmodium falciparum
DKNLSR

SEQ ID NO: 3213692 - protein, 4 aa, Plasmodium falciparum
DKNN

SEQ ID NO: 3213693 - protein, 46 aa, Plasmodium falciparum
DKNNDNIKNNDNIKNNDHINDNDHINDNDHINDKDHINNKDHINNK

SEQ ID NO: 3213694 - protein, 7 aa, Plasmodium falciparum
DKNNECK

SEQ ID NO: 3213695 - protein, 8 aa, Plasmodium falciparum
DKNNENAY

SEQ ID NO: 3213696 - protein, 7 aa, Plasmodium falciparum
DKNNFGQ

SEQ ID NO: 3213697 - protein, 5 aa, Plasmodium falciparum
DKNNI

SEQ ID NO: 3213698 - protein, 7 aa, Plasmodium falciparum
DKNNKQR

SEQ ID NO: 3213699 - protein, 5 aa, Plasmodium falciparum
DKNNL

SEQ ID NO: 3213700 - protein, 5 aa, Plasmodium falciparum
DKNNN

SEQ ID NO: 3213701 - protein, 16 aa, Plasmodium falciparum
DKNNNDDNDSKQKGNS

SEQ ID NO: 3213702 - protein, 7 aa, Plasmodium falciparum
DKNNNGH

SEQ ID NO: 3213703 - protein, 8 aa, Plasmodium falciparum
DKNNNIPN

SEQ ID NO: 3213704 - protein, 17 aa, Plasmodium falciparum
DKNNNISNDNNKKKRME

SEQ ID NO: 3213705 - protein, 21 aa, Plasmodium falciparum
DKNNNLKKKNFKNVKNNNYNS

SEQ ID NO: 3213706 - protein, 23 aa, Plasmodium falciparum
DKNNNNKTYDSNKYDSNKYDSNI

SEQ ID NO: 3213707 - protein, 17 aa, Plasmodium falciparum
DKNNNQFNEKTKKIEDN

SEQ ID NO: 3213708 - protein, 8 aa, Plasmodium falciparum
DKNNNTYM

SEQ ID NO: 3213709 - protein, 10 aa, Plasmodium falciparum
DKNNNYSQKN

SEQ ID NO: 3213710 - protein, 21 aa, Plasmodium falciparum
DKNNPVDNNNSTYNHRNPADI

SEQ ID NO: 3213711 - protein, 7 aa, Plasmodium falciparum
DKNNQDV

SEQ ID NO: 3213712 - protein, 13 aa, Plasmodium falciparum
DKNNQNQHPIEKP

SEQ ID NO: 3213713 - protein, 14 aa, Plasmodium falciparum
DKNNQNQHPIEKPT

SEQ ID NO: 3213714 - protein, 11 aa, Plasmodium falciparum
DKNNSDKSRDL

SEQ ID NO: 3213715 - protein, 7 aa, Plasmodium falciparum
DKNNSGL

SEQ ID NO: 3213716 - protein, 7 aa, Plasmodium falciparum
DKNNSHV

SEQ ID NO: 3213717 - protein, 10 aa, Plasmodium falciparum
DKNNTNDAYE

SEQ ID NO: 3213718 - protein, 6 aa, Plasmodium falciparum
DKNQKE

SEQ ID NO: 3213719 - protein, 10 aa, Plasmodium falciparum
DKNQNEENKI

SEQ ID NO: 3213720 - protein, 6 aa, Plasmodium falciparum
DKNRCN

SEQ ID NO: 3213721 - protein, 11 aa, Plasmodium falciparum
DKNRDKETLKE

SEQ ID NO: 3213722 - protein, 6 aa, Plasmodium falciparum
DKNRKD

SEQ ID NO: 3213723 - protein, 10 aa, Plasmodium falciparum
DKNRKNNIST

SEQ ID NO: 3213724 - protein, 6 aa, Plasmodium falciparum
DKNRNR

SEQ ID NO: 3213725 - protein, 10 aa, Plasmodium falciparum
DKNSENSLSL

SEQ ID NO: 3213726 - protein, 7 aa, Plasmodium falciparum
DKNSFEN

SEQ ID NO: 3213727 - protein, 7 aa, Plasmodium falciparum
DKNSHHI

SEQ ID NO: 3213728 - protein, 5 aa, Plasmodium falciparum
DKNSN

SEQ ID NO: 3213729 - protein, 6 aa, Plasmodium falciparum
DKNSNF

SEQ ID NO: 3213730 - protein, 6 aa, Plasmodium falciparum
DKNSNN

SEQ ID NO: 3213731 - protein, 8 aa, Plasmodium falciparum
DKNSNSYM

SEQ ID NO: 3213732 - protein, 5 aa, Plasmodium falciparum
DKNSS

SEQ ID NO: 3213733 - protein, 10 aa, Plasmodium falciparum
DKNSVEENKN

SEQ ID NO: 3213734 - protein, 19 aa, Plasmodium falciparum
DKNSVSSEYRNNIEDDTYK

SEQ ID NO: 3213735 - protein, 12 aa, Plasmodium falciparum
DKNSYRSSHKKI

SEQ ID NO: 3213736 - protein, 6 aa, Plasmodium falciparum
DKNTDV

SEQ ID NO: 3213737 - protein, 10 aa, Plasmodium falciparum
DKNTKENGKY

SEQ ID NO: 3213738 - protein, 8 aa, Plasmodium falciparum
DKNTKEPN

SEQ ID NO: 3213739 - protein, 7 aa, Plasmodium falciparum
DKNTPGV

SEQ ID NO: 3213740 - protein, 6 aa, Plasmodium falciparum
DKNTSI

SEQ ID NO: 3213741 - protein, 8 aa, Plasmodium falciparum
DKNTYYKS

SEQ ID NO: 3213742 - protein, 23 aa, Plasmodium falciparum
DKNVKSQQDDSKTNGTQKTGSVE

SEQ ID NO: 3213743 - protein, 7 aa, Plasmodium falciparum
DKNVPSN

SEQ ID NO: 3213744 - protein, 9 aa, Plasmodium falciparum
DKNYKEQNI

SEQ ID NO: 3213745 - protein, 15 aa, Plasmodium falciparum
DKNYNNRHNNGHNNI

SEQ ID NO: 3213746 - protein, 14 aa, Plasmodium falciparum
DKNYSSSYGSDDNN

SEQ ID NO: 3213747 - protein, 9 aa, Plasmodium falciparum
DKPKQNEKI

SEQ ID NO: 3213748 - protein, 7 aa, Plasmodium falciparum
DKPNDDI

SEQ ID NO: 3213749 - protein, 8 aa, Plasmodium falciparum
DKPNKDLS

SEQ ID NO: 3213750 - protein, 8 aa, Plasmodium falciparum
DKPNYTYE

SEQ ID NO: 3213751 - protein, 16 aa, Plasmodium falciparum
DKPPKKKSRKNKSIKN

SEQ ID NO: 3213752 - protein, 9 aa, Plasmodium falciparum
DKPSFKNRD

SEQ ID NO: 3213753 - protein, 7 aa, Plasmodium falciparum
DKPVEEK

SEQ ID NO: 3213754 - protein, 17 aa, Plasmodium falciparum
DKPVENPGDNSSVCNSK

SEQ ID NO: 3213755 - protein, 8 aa, Plasmodium falciparum
DKQAKENK

SEQ ID NO: 3213756 - protein, 7 aa, Plasmodium falciparum
DKQDIST

SEQ ID NO: 3213757 - protein, 5 aa, Plasmodium falciparum
DKQDK

SEQ ID NO: 3213758 - protein, 8 aa, Plasmodium falciparum
DKQFGDTT

SEQ ID NO: 3213759 - protein, 7 aa, Plasmodium falciparum
DKQGEPI

SEQ ID NO: 3213760 - protein, 8 aa, Plasmodium falciparum
DKQGESIA

SEQ ID NO: 3213761 - protein, 6 aa, Plasmodium falciparum
DKQGVI

SEQ ID NO: 3213762 - protein, 17 aa, Plasmodium falciparum
DKQIDSSNNVKEEVEEK

SEQ ID NO: 3213763 - protein, 7 aa, Plasmodium falciparum
DKQINKN

SEQ ID NO: 3213764 - protein, 4 aa, Plasmodium falciparum
DKQK

SEQ ID NO: 3213765 - protein, 5 aa, Plasmodium falciparum
DKQKI

SEQ ID NO: 3213766 - protein, 11 aa, Plasmodium falciparum
DKQKKKYTQEI

SEQ ID NO: 3213767 - protein, 5 aa, Plasmodium falciparum
DKQKN

SEQ ID NO: 3213768 - protein, 10 aa, Plasmodium falciparum
DKQKNNENFD

SEQ ID NO: 3213769 - protein, 11 aa, Plasmodium falciparum
DKQKRKYKSEI

SEQ ID NO: 3213770 - protein, 11 aa, Plasmodium falciparum
DKQKSISLKER

SEQ ID NO: 3213771 - protein, 16 aa, Plasmodium falciparum
DKQNDISSSNKKQNHI

SEQ ID NO: 3213772 - protein, 7 aa, Plasmodium falciparum
DKQNEQY

SEQ ID NO: 3213773 - protein, 7 aa, Plasmodium falciparum
DKQPAYN

SEQ ID NO: 3213774 - protein, 7 aa, Plasmodium falciparum
DKQPGFD

SEQ ID NO: 3213775 - protein, 5 aa, Plasmodium falciparum
DKQPI

SEQ ID NO: 3213776 - protein, 9 aa, Plasmodium falciparum
DKQQISNNA

SEQ ID NO: 3213777 - protein, 15 aa, Plasmodium falciparum
DKQSSIYDNDADMKS

SEQ ID NO: 3213778 - protein, 5 aa, Plasmodium falciparum
DKQYD

SEQ ID NO: 3213779 - protein, 5 aa, Plasmodium falciparum
DKQYE

SEQ ID NO: 3213780 - protein, 7 aa, Plasmodium falciparum
DKQYNSV

SEQ ID NO: 3213781 - protein, 11 aa, Plasmodium falciparum
DKRDKKSTHDT

SEQ ID NO: 3213782 - protein, 9 aa, Plasmodium falciparum
DKREDRETK

SEQ ID NO: 3213783 - protein, 8 aa, Plasmodium falciparum
DKREHKRG

SEQ ID NO: 3213784 - protein, 7 aa, Plasmodium falciparum
DKREKNV

SEQ ID NO: 3213785 - protein, 5 aa, Plasmodium falciparum
DKRER

SEQ ID NO: 3213786 - protein, 31 aa, Plasmodium falciparum
DKRGDHRKDYNDTNESYGNVDDVNKNDSRYV

SEQ ID NO: 3213787 - protein, 8 aa, Plasmodium falciparum
DKRKKKNL

SEQ ID NO: 3213788 - protein, 6 aa, Plasmodium falciparum
DKRKLD

SEQ ID NO: 3213789 - protein, 7 aa, Plasmodium falciparum
DKRKNRK

SEQ ID NO: 3213790 - protein, 7 aa, Plasmodium falciparum
DKRKSND

SEQ ID NO: 3213791 - protein, 17 aa, Plasmodium falciparum
DKRKYERSSNNYNNNVN

SEQ ID NO: 3213792 - protein, 4 aa, Plasmodium falciparum
DKRN

SEQ ID NO: 3213793 - protein, 8 aa, Plasmodium falciparum
DKRNEAMK

SEQ ID NO: 3213794 - protein, 8 aa, Plasmodium falciparum
DKRNNDNI

SEQ ID NO: 3213795 - protein, 6 aa, Plasmodium falciparum
DKRRKK

SEQ ID NO: 3213796 - protein, 7 aa, Plasmodium falciparum
DKRSVST

SEQ ID NO: 3213797 - protein, 6 aa, Plasmodium falciparum
DKRTGA

SEQ ID NO: 3213798 - protein, 6 aa, Plasmodium falciparum
DKRVSY

SEQ ID NO: 3213799 - protein, 15 aa, Plasmodium falciparum
DKRYYNKGSVRKESI

SEQ ID NO: 3213800 - protein, 5 aa, Plasmodium falciparum
DKSCN

SEQ ID NO: 3213801 - protein, 12 aa, Plasmodium falciparum
DKSDDDQSTTAD

SEQ ID NO: 3213802 - protein, 19 aa, Plasmodium falciparum
DKSDEEKERQLQKGENNKG

SEQ ID NO: 3213803 - protein, 8 aa, Plasmodium falciparum
DKSDEENK

SEQ ID NO: 3213804 - protein, 7 aa, Plasmodium falciparum
DKSDGDC

SEQ ID NO: 3213805 - protein, 6 aa, Plasmodium falciparum
DKSDLT

SEQ ID NO: 3213806 - protein, 13 aa, Plasmodium falciparum
DKSDNIKNEKKKK

SEQ ID NO: 3213807 - protein, 5 aa, Plasmodium falciparum
DKSDT

SEQ ID NO: 3213808 - protein, 8 aa, Plasmodium falciparum
DKSEEEIN

SEQ ID NO: 3213809 - protein, 12 aa, Plasmodium falciparum
DKSFTKETDQVP

SEQ ID NO: 3213810 - protein, 4 aa, Plasmodium falciparum
DKSH

SEQ ID NO: 3213811 - protein, 5 aa, Plasmodium falciparum
DKSHL

SEQ ID NO: 3213812 - protein, 8 aa, Plasmodium falciparum
DKSHRSNY

SEQ ID NO: 3213813 - protein, 8 aa, Plasmodium falciparum
DKSHTDKS

SEQ ID NO: 3213814 - protein, 4 aa, Plasmodium falciparum
DKSI

SEQ ID NO: 3213815 - protein, 6 aa, Plasmodium falciparum
DKSINR

SEQ ID NO: 3213816 - protein, 8 aa, Plasmodium falciparum
DKSKDDIQ

SEQ ID NO: 3213817 - protein, 8 aa, Plasmodium falciparum
DKSKEKID

SEQ ID NO: 3213818 - protein, 10 aa, Plasmodium falciparum
DKSKEQYSDI

SEQ ID NO: 3213819 - protein, 5 aa, Plasmodium falciparum
DKSKM

SEQ ID NO: 3213820 - protein, 7 aa, Plasmodium falciparum
DKSKNMD

SEQ ID NO: 3213821 - protein, 6 aa, Plasmodium falciparum
DKSKSL

SEQ ID NO: 3213822 - protein, 7 aa, Plasmodium falciparum
DKSNDSI

SEQ ID NO: 3213823 - protein, 6 aa, Plasmodium falciparum
DKSNGE

SEQ ID NO: 3213824 - protein, 6 aa, Plasmodium falciparum
DKSNIG

SEQ ID NO: 3213825 - protein, 10 aa, Plasmodium falciparum
DKSNKNKSMY

SEQ ID NO: 3213826 - protein, 8 aa, Plasmodium falciparum
DKSNNSLK

SEQ ID NO: 3213827 - protein, 10 aa, Plasmodium falciparum
DKSNSYNNNN

SEQ ID NO: 3213828 - protein, 8 aa, Plasmodium falciparum
DKSNYKKI

SEQ ID NO: 3213829 - protein, 5 aa, Plasmodium falciparum
DKSPN

SEQ ID NO: 3213830 - protein, 12 aa, Plasmodium falciparum
DKSSDNSYQGYD

SEQ ID NO: 3213831 - protein, 11 aa, Plasmodium falciparum
DKSSEIMEDDE

SEQ ID NO: 3213832 - protein, 9 aa, Plasmodium falciparum
DKSSKKKKK

SEQ ID NO: 3213833 - protein, 147 aa, Plasmodium falciparum
DKSSKNIKSKGKHKNHNTNKEDNDNNDNNNDNNNDNNNNNNNNNNNNNKDNHNKKDTNENEEDDEDDDNKNKNKGDKDDDRDDEEDYKSSTKENNLKKKKKKSDEDNEETEDIDDEGEEDDQNEEDDEDNNSKKKKFNNKTNNETDS

SEQ ID NO: 3213834 - protein, 5 aa, Plasmodium falciparum
DKSSP

SEQ ID NO: 3213835 - protein, 12 aa, Plasmodium falciparum
DKSSSSTHEETS

SEQ ID NO: 3213836 - protein, 7 aa, Plasmodium falciparum
DKSSTVK

SEQ ID NO: 3213837 - protein, 5 aa, Plasmodium falciparum
DKSTI

SEQ ID NO: 3213838 - protein, 11 aa, Plasmodium falciparum
DKSTLKNDESV

SEQ ID NO: 3213839 - protein, 9 aa, Plasmodium falciparum
DKSTNSNEK

SEQ ID NO: 3213840 - protein, 31 aa, Plasmodium falciparum
DKSTNTKNYEKIKRDKRNKEIKTDKDNKNSI

SEQ ID NO: 3213841 - protein, 24 aa, Plasmodium falciparum
DKSVNTDNIQDNEIESNKYNTSSC

SEQ ID NO: 3213842 - protein, 8 aa, Plasmodium falciparum
DKSVTGDV

SEQ ID NO: 3213843 - protein, 9 aa, Plasmodium falciparum
DKSVTSNND

SEQ ID NO: 3213844 - protein, 7 aa, Plasmodium falciparum
DKSYDDA

SEQ ID NO: 3213845 - protein, 5 aa, Plasmodium falciparum
DKSYI

SEQ ID NO: 3213846 - protein, 4 aa, Plasmodium falciparum
DKTA

SEQ ID NO: 3213847 - protein, 32 aa, Plasmodium falciparum
DKTATGEARAGRVARSPPETAPSSAKSGEPTG

SEQ ID NO: 3213848 - protein, 11 aa, Plasmodium falciparum
DKTGNNPETPE

SEQ ID NO: 3213849 - protein, 7 aa, Plasmodium falciparum
DKTGTLT

SEQ ID NO: 3213850 - protein, 7 aa, Plasmodium falciparum
DKTIQEK

SEQ ID NO: 3213851 - protein, 9 aa, Plasmodium falciparum
DKTKERQIK

SEQ ID NO: 3213852 - protein, 6 aa, Plasmodium falciparum
DKTKHI

SEQ ID NO: 3213853 - protein, 10 aa, Plasmodium falciparum
DKTKYGTTQS

SEQ ID NO: 3213854 - protein, 38 aa, Plasmodium falciparum
DKTMESETDKREHEANNTLSQEEHTNNKCDVKEKNNNM

SEQ ID NO: 3213855 - protein, 4 aa, Plasmodium falciparum
DKTN

SEQ ID NO: 3213856 - protein, 13 aa, Plasmodium falciparum
DKTNEPKKPQYQY

SEQ ID NO: 3213857 - protein, 13 aa, Plasmodium falciparum
DKTNEPKKSEYKY

SEQ ID NO: 3213858 - protein, 12 aa, Plasmodium falciparum
DKTNGVDKENEI

SEQ ID NO: 3213859 - protein, 40 aa, Plasmodium falciparum
DKTNQNNKDSSHNNDSNCCEDTQDSDINELSNKEEMKNTK

SEQ ID NO: 3213860 - protein, 10 aa, Plasmodium falciparum
DKTNRKRNTM

SEQ ID NO: 3213861 - protein, 6 aa, Plasmodium falciparum
DKTPDH

SEQ ID NO: 3213862 - protein, 6 aa, Plasmodium falciparum
DKTQNT

SEQ ID NO: 3213863 - protein, 13 aa, Plasmodium falciparum
DKTRSTSDPNVVT

SEQ ID NO: 3213864 - protein, 7 aa, Plasmodium falciparum
DKTSEIE

SEQ ID NO: 3213865 - protein, 9 aa, Plasmodium falciparum
DKTSSFPSC

SEQ ID NO: 3213866 - protein, 14 aa, Plasmodium falciparum
DKTYEKRKKGAQEL

SEQ ID NO: 3213867 - protein, 5 aa, Plasmodium falciparum
DKTYK

SEQ ID NO: 3213868 - protein, 4 aa, Plasmodium falciparum
DKVE

SEQ ID NO: 3213869 - protein, 7 aa, Plasmodium falciparum
DKVEKSN

SEQ ID NO: 3213870 - protein, 4 aa, Plasmodium falciparum
DKVH

SEQ ID NO: 3213871 - protein, 18 aa, Plasmodium falciparum
DKVKSEANQYKDDLKGNL

SEQ ID NO: 3213872 - protein, 15 aa, Plasmodium falciparum
DKVNQSKNGNPSLED

SEQ ID NO: 3213873 - protein, 12 aa, Plasmodium falciparum
DKVQEESKVMIQ

SEQ ID NO: 3213874 - protein, 6 aa, Plasmodium falciparum
DKVSSK

SEQ ID NO: 3213875 - protein, 11 aa, Plasmodium falciparum
DKWEKHENKKN

SEQ ID NO: 3213876 - protein, 6 aa, Plasmodium falciparum
DKYDKT

SEQ ID NO: 3213877 - protein, 5 aa, Plasmodium falciparum
DKYED

SEQ ID NO: 3213878 - protein, 6 aa, Plasmodium falciparum
DKYEEL

SEQ ID NO: 3213879 - protein, 14 aa, Plasmodium falciparum
DKYEGYSDNNKNNY

SEQ ID NO: 3213880 - protein, 15 aa, Plasmodium falciparum
DKYESKKKFEKENNV

SEQ ID NO: 3213881 - protein, 6 aa, Plasmodium falciparum
DKYGEF

SEQ ID NO: 3213882 - protein, 6 aa, Plasmodium falciparum
DKYGYN

SEQ ID NO: 3213883 - protein, 6 aa, Plasmodium falciparum
DKYKDE

SEQ ID NO: 3213884 - protein, 31 aa, Plasmodium falciparum
DKYKDEYKDEYKDKYKDEYKDEYKDTYKDYE

SEQ ID NO: 3213885 - protein, 9 aa, Plasmodium falciparum
DKYKKKKGT

SEQ ID NO: 3213886 - protein, 14 aa, Plasmodium falciparum
DKYKRNDKLTNNNN

SEQ ID NO: 3213887 - protein, 11 aa, Plasmodium falciparum
DKYNLDKNNTY

SEQ ID NO: 3213888 - protein, 11 aa, Plasmodium falciparum
DKYNNESKKKK

SEQ ID NO: 3213889 - protein, 5 aa, Plasmodium falciparum
DKYNT

SEQ ID NO: 3213890 - protein, 30 aa, Plasmodium falciparum
DKYNYDKKNNMGTNNNFNNTNTFANNKNNL

SEQ ID NO: 3213891 - protein, 10 aa, Plasmodium falciparum
DKYPKDQNYR

SEQ ID NO: 3213892 - protein, 13 aa, Plasmodium falciparum
DKYSDKENDHDNY

SEQ ID NO: 3213893 - protein, 6 aa, Plasmodium falciparum
DKYSDY

SEQ ID NO: 3213894 - protein, 7 aa, Plasmodium falciparum
DKYSEDD

SEQ ID NO: 3213895 - protein, 5 aa, Plasmodium falciparum
DKYSG

SEQ ID NO: 3213896 - protein, 10 aa, Plasmodium falciparum
DKYSGDQFRG

SEQ ID NO: 3213897 - protein, 15 aa, Plasmodium falciparum
DKYSLRRSKELNNSI

SEQ ID NO: 3213898 - protein, 7 aa, Plasmodium falciparum
DKYSNNY

SEQ ID NO: 3213899 - protein, 8 aa, Plasmodium falciparum
DKYSQKIK

SEQ ID NO: 3213900 - protein, 7 aa, Plasmodium falciparum
DKYTDEK

SEQ ID NO: 3213901 - protein, 12 aa, Plasmodium falciparum
DKYTKDKNKKMY

SEQ ID NO: 3213902 - protein, 7 aa, Plasmodium falciparum
DKYTKDS

SEQ ID NO: 3213903 - protein, 7 aa, Plasmodium falciparum
DKYTSNY

SEQ ID NO: 3213904 - protein, 11 aa, Plasmodium falciparum
DKYYGDEERAF

SEQ ID NO: 3213905 - protein, 9 aa, Plasmodium falciparum
DLAGTAASA

SEQ ID NO: 3213906 - protein, 13 aa, Plasmodium falciparum
DLDNNNKNNNNNN

SEQ ID NO: 3213907 - protein, 4 aa, Plasmodium falciparum
DLDP

SEQ ID NO: 3213908 - protein, 9 aa, Plasmodium falciparum
DLDTSSTKN

SEQ ID NO: 3213909 - protein, 16 aa, Plasmodium falciparum
DLEERQQKKIKKKEME

SEQ ID NO: 3213910 - protein, 8 aa, Plasmodium falciparum
DLEKENEK

SEQ ID NO: 3213911 - protein, 5 aa, Plasmodium falciparum
DLEPI

SEQ ID NO: 3213912 - protein, 14 aa, Plasmodium falciparum
DLESDNNSESITSD

SEQ ID NO: 3213913 - protein, 19 aa, Plasmodium falciparum
DLGEENKIEKDNYNKCDQV

SEQ ID NO: 3213914 - protein, 12 aa, Plasmodium falciparum
DLGEREYSYNNT

SEQ ID NO: 3213915 - protein, 13 aa, Plasmodium falciparum
DLGGSRSEDEVTQ

SEQ ID NO: 3213916 - protein, 5 aa, Plasmodium falciparum
DLGSS

SEQ ID NO: 3213917 - protein, 4 aa, Plasmodium falciparum
DLHN

SEQ ID NO: 3213918 - protein, 10 aa, Plasmodium falciparum
DLHNGNGKHE

SEQ ID NO: 3213919 - protein, 7 aa, Plasmodium falciparum
DLIPDSK

SEQ ID NO: 3213920 - protein, 12 aa, Plasmodium falciparum
DLKEKNKNTINT

SEQ ID NO: 3213921 - protein, 7 aa, Plasmodium falciparum
DLKGNND

SEQ ID NO: 3213922 - protein, 6 aa, Plasmodium falciparum
DLKKSE

SEQ ID NO: 3213923 - protein, 16 aa, Plasmodium falciparum
DLKNEENNINKEEKNM

SEQ ID NO: 3213924 - protein, 5 aa, Plasmodium falciparum
DLKRK

SEQ ID NO: 3213925 - protein, 27 aa, Plasmodium falciparum
DLKSEEHKTRRRGSTANNNDDEERNGY

SEQ ID NO: 3213926 - protein, 7 aa, Plasmodium falciparum
DLNEEYK

SEQ ID NO: 3213927 - protein, 4 aa, Plasmodium falciparum
DLNK

SEQ ID NO: 3213928 - protein, 12 aa, Plasmodium falciparum
DLNKDKNKDKNK

SEQ ID NO: 3213929 - protein, 4 aa, Plasmodium falciparum
DLNN

SEQ ID NO: 3213930 - protein, 11 aa, Plasmodium falciparum
DLNNKKKHDPY

SEQ ID NO: 3213931 - protein, 7 aa, Plasmodium falciparum
DLNNNNY

SEQ ID NO: 3213932 - protein, 8 aa, Plasmodium falciparum
DLNNSNNI

SEQ ID NO: 3213933 - protein, 7 aa, Plasmodium falciparum
DLNPTEC

SEQ ID NO: 3213934 - protein, 7 aa, Plasmodium falciparum
DLNPYKD

SEQ ID NO: 3213935 - protein, 9 aa, Plasmodium falciparum
DLNQEQKKE

SEQ ID NO: 3213936 - protein, 11 aa, Plasmodium falciparum
DLNSAQGESKD

SEQ ID NO: 3213937 - protein, 5 aa, Plasmodium falciparum
DLNSS

SEQ ID NO: 3213938 - protein, 10 aa, Plasmodium falciparum
DLNSSGENYF

SEQ ID NO: 3213939 - protein, 27 aa, Plasmodium falciparum
DLNSTGEKSKKKKKIINNNNDDHNNTM

SEQ ID NO: 3213940 - protein, 17 aa, Plasmodium falciparum
DLNTANGRSSETRYTTD

SEQ ID NO: 3213941 - protein, 13 aa, Plasmodium falciparum
DLPNVSPSASTFT

SEQ ID NO: 3213942 - protein, 5 aa, Plasmodium falciparum
DLPPP

SEQ ID NO: 3213943 - protein, 15 aa, Plasmodium falciparum
DLQNNGDNKNNQTMN

SEQ ID NO: 3213944 - protein, 4 aa, Plasmodium falciparum
DLSD

SEQ ID NO: 3213945 - protein, 8 aa, Plasmodium falciparum
DLSKDKEK

SEQ ID NO: 3213946 - protein, 9 aa, Plasmodium falciparum
DLSKNGSTA

SEQ ID NO: 3213947 - protein, 32 aa, Plasmodium falciparum
DLSYKKHENGIEKDKHISDQNSNNKNSGKSCP

SEQ ID NO: 3213948 - protein, 7 aa, Plasmodium falciparum
DLTEQYE

SEQ ID NO: 3213949 - protein, 9 aa, Plasmodium falciparum
DLTESEREN

SEQ ID NO: 3213950 - protein, 7 aa, Plasmodium falciparum
DLTGEES

SEQ ID NO: 3213951 - protein, 53 aa, Plasmodium falciparum
DLTGTKTNINHTTTTNHDKNNDHNNKNNDHNNKNNNNNNKNNDHNNNNKNNST

SEQ ID NO: 3213952 - protein, 16 aa, Plasmodium falciparum
DLTKNKNKKKIKNDDN

SEQ ID NO: 3213953 - protein, 13 aa, Plasmodium falciparum
DLTNDKKGKTKHE

SEQ ID NO: 3213954 - protein, 4 aa, Plasmodium falciparum
DLYD

SEQ ID NO: 3213955 - protein, 5 aa, Plasmodium falciparum
DMDDN

SEQ ID NO: 3213956 - protein, 5 aa, Plasmodium falciparum
DMDDR

SEQ ID NO: 3213957 - protein, 6 aa, Plasmodium falciparum
DMDEPR

SEQ ID NO: 3213958 - protein, 5 aa, Plasmodium falciparum
DMEEN

SEQ ID NO: 3213959 - protein, 11 aa, Plasmodium falciparum
DMEKNKSTSNI

SEQ ID NO: 3213960 - protein, 16 aa, Plasmodium falciparum
DMENDSDNNENKYEDI

SEQ ID NO: 3213961 - protein, 8 aa, Plasmodium falciparum
DMESTNDY

SEQ ID NO: 3213962 - protein, 12 aa, Plasmodium falciparum
DMGERASSNKTC

SEQ ID NO: 3213963 - protein, 12 aa, Plasmodium falciparum
DMGISNDNNKGI

SEQ ID NO: 3213964 - protein, 7 aa, Plasmodium falciparum
DMGPTTS

SEQ ID NO: 3213965 - protein, 10 aa, Plasmodium falciparum
DMGTQEKGHK

SEQ ID NO: 3213966 - protein, 24 aa, Plasmodium falciparum
DMKEEEEEEEEEEEKKKKKKNNNN

SEQ ID NO: 3213967 - protein, 12 aa, Plasmodium falciparum
DMKGKNNADDMK

SEQ ID NO: 3213968 - protein, 6 aa, Plasmodium falciparum
DMKKGR

SEQ ID NO: 3213969 - protein, 5 aa, Plasmodium falciparum
DMKNE

SEQ ID NO: 3213970 - protein, 13 aa, Plasmodium falciparum
DMKNYNEEQKNNE

SEQ ID NO: 3213971 - protein, 5 aa, Plasmodium falciparum
DMKSN

SEQ ID NO: 3213972 - protein, 7 aa, Plasmodium falciparum
DMKSTQS

SEQ ID NO: 3213973 - protein, 5 aa, Plasmodium falciparum
DMKSV

SEQ ID NO: 3213974 - protein, 10 aa, Plasmodium falciparum
DMNERKGASK

SEQ ID NO: 3213975 - protein, 38 aa, Plasmodium falciparum
DMNGNKKNEQEDNKKKDITDYETNYDDTDDHSSDDDVY

SEQ ID NO: 3213976 - protein, 10 aa, Plasmodium falciparum
DMNKRGNEKN

SEQ ID NO: 3213977 - protein, 9 aa, Plasmodium falciparum
DMNKSNISN

SEQ ID NO: 3213978 - protein, 5 aa, Plasmodium falciparum
DMNNK

SEQ ID NO: 3213979 - protein, 5 aa, Plasmodium falciparum
DMNNN

SEQ ID NO: 3213980 - protein, 33 aa, Plasmodium falciparum
DMNSSYSDEAHENNQHGGYYKKGGKKKKTHRNN

SEQ ID NO: 3213981 - protein, 5 aa, Plasmodium falciparum
DMNST

SEQ ID NO: 3213982 - protein, 14 aa, Plasmodium falciparum
DMPGDTEEMSNERR

SEQ ID NO: 3213983 - protein, 9 aa, Plasmodium falciparum
DMPPKEQYI

SEQ ID NO: 3213984 - protein, 4 aa, Plasmodium falciparum
DMPS

SEQ ID NO: 3213985 - protein, 6 aa, Plasmodium falciparum
DMQEQK

SEQ ID NO: 3213986 - protein, 12 aa, Plasmodium falciparum
DMQQKNKTKQND

SEQ ID NO: 3213987 - protein, 7 aa, Plasmodium falciparum
DMSTNEN

SEQ ID NO: 3213988 - protein, 16 aa, Plasmodium falciparum
DMSTNNDGTPRSAASE

SEQ ID NO: 3213989 - protein, 10 aa, Plasmodium falciparum
DNAESGFKGD

SEQ ID NO: 3213990 - protein, 7 aa, Plasmodium falciparum
DNAGTNL

SEQ ID NO: 3213991 - protein, 11 aa, Plasmodium falciparum
DNAKNEQAEKC

SEQ ID NO: 3213992 - protein, 6 aa, Plasmodium falciparum
DNAKTK

SEQ ID NO: 3213993 - protein, 6 aa, Plasmodium falciparum
DNANRK

SEQ ID NO: 3213994 - protein, 9 aa, Plasmodium falciparum
DNANVTNNE

SEQ ID NO: 3213995 - protein, 20 aa, Plasmodium falciparum
DNAPTINDKTCSTSDPNVVT

SEQ ID NO: 3213996 - protein, 5 aa, Plasmodium falciparum
DNARY

SEQ ID NO: 3213997 - protein, 7 aa, Plasmodium falciparum
DNASGRL

SEQ ID NO: 3213998 - protein, 4 aa, Plasmodium falciparum
DNCE

SEQ ID NO: 3213999 - protein, 6 aa, Plasmodium falciparum
DNCNNN

SEQ ID NO: 3214000 - protein, 6 aa, Plasmodium falciparum
DNCRSG

SEQ ID NO: 3214001 - protein, 4 aa, Plasmodium falciparum
DNCS

SEQ ID NO: 3214002 - protein, 27 aa, Plasmodium falciparum
DNCTEDGGKTKKCSGDGHDCTDGKRRY

SEQ ID NO: 3214003 - protein, 30 aa, Plasmodium falciparum
DNCTGANANTCTTRKISPKDIDEKTDPNGN

SEQ ID NO: 3214004 - protein, 18 aa, Plasmodium falciparum
DNCTKDDKQKYSGDGEEC

SEQ ID NO: 3214005 - protein, 8 aa, Plasmodium falciparum
DNDAEMKS

SEQ ID NO: 3214006 - protein, 7 aa, Plasmodium falciparum
DNDCKRR

SEQ ID NO: 3214007 - protein, 8 aa, Plasmodium falciparum
DNDDDGNN

SEQ ID NO: 3214008 - protein, 97 aa, Plasmodium falciparum
DNDDDNDDNDDDNDDNDDDNDDDNNDDNNDNDNNDDDNNDDDNNDDDNNDDDNNDDDNNDDDNNDDDNNDDDNNDDDNNDDDNDDNDEDSNLHGSSS

SEQ ID NO: 3214009 - protein, 20 aa, Plasmodium falciparum
DNDDDNINNNNNNNNDDAVN

SEQ ID NO: 3214010 - protein, 7 aa, Plasmodium falciparum
DNDEDIK

SEQ ID NO: 3214011 - protein, 7 aa, Plasmodium falciparum
DNDEGNK

SEQ ID NO: 3214012 - protein, 7 aa, Plasmodium falciparum
DNDEIHE

SEQ ID NO: 3214013 - protein, 7 aa, Plasmodium falciparum
DNDEMRN

SEQ ID NO: 3214014 - protein, 20 aa, Plasmodium falciparum
DNDENNNNNNDDNNNNNNNI

SEQ ID NO: 3214015 - protein, 5 aa, Plasmodium falciparum
DNDER

SEQ ID NO: 3214016 - protein, 144 aa, Plasmodium falciparum
DNDGDNNNDDDDNNNDDNNNDDNNNNGDDDNSEDNDNSGDYYDNNGEDNDNNGEDNDNNGEDNDNNGEDNDNNGEDNDNNGDYYDNNGDYYDNNGDDNDNNGDNNDNNGDNNDNNGDDNNNNYNNIDKDNTNNSNSNKHRKHDN

SEQ ID NO: 3214017 - protein, 5 aa, Plasmodium falciparum
DNDGE

SEQ ID NO: 3214018 - protein, 14 aa, Plasmodium falciparum
DNDGNKPKNDNYTY

SEQ ID NO: 3214019 - protein, 17 aa, Plasmodium falciparum
DNDISNRENSKKNIDGL

SEQ ID NO: 3214020 - protein, 17 aa, Plasmodium falciparum
DNDITQNHQDVEEEQDQ

SEQ ID NO: 3214021 - protein, 7 aa, Plasmodium falciparum
DNDKHEY

SEQ ID NO: 3214022 - protein, 10 aa, Plasmodium falciparum
DNDKKEKDHP

SEQ ID NO: 3214023 - protein, 22 aa, Plasmodium falciparum
DNDKKQISKNDCTENLNKQKNV

SEQ ID NO: 3214024 - protein, 33 aa, Plasmodium falciparum
DNDKNNKKYMSQNKKKGKKKTYIEKQEDYGKNY

SEQ ID NO: 3214025 - protein, 13 aa, Plasmodium falciparum
DNDKNYKNDNNDF

SEQ ID NO: 3214026 - protein, 8 aa, Plasmodium falciparum
DNDKQREM

SEQ ID NO: 3214027 - protein, 5 aa, Plasmodium falciparum
DNDLN

SEQ ID NO: 3214028 - protein, 5 aa, Plasmodium falciparum
DNDLV

SEQ ID NO: 3214029 - protein, 4 aa, Plasmodium falciparum
DNDN

SEQ ID NO: 3214030 - protein, 8 aa, Plasmodium falciparum
DNDNDNYL

SEQ ID NO: 3214031 - protein, 54 aa, Plasmodium falciparum
DNDNEESLNDDVTNGKNNNNDDKDSDIYNDDDHDDDHFSTNNKSVSNESDNNNL

SEQ ID NO: 3214032 - protein, 26 aa, Plasmodium falciparum
DNDNNKNKNNDNNNNNKNNDNNNNNN

SEQ ID NO: 3214033 - protein, 9 aa, Plasmodium falciparum
DNDNNYDNF

SEQ ID NO: 3214034 - protein, 15 aa, Plasmodium falciparum
DNDNPQTSLQNGTIP

SEQ ID NO: 3214035 - protein, 5 aa, Plasmodium falciparum
DNDNQ

SEQ ID NO: 3214036 - protein, 6 aa, Plasmodium falciparum
DNDNTL

SEQ ID NO: 3214037 - protein, 8 aa, Plasmodium falciparum
DNDNYNND

SEQ ID NO: 3214038 - protein, 4 aa, Plasmodium falciparum
DNDP

SEQ ID NO: 3214039 - protein, 7 aa, Plasmodium falciparum
DNDPDMK

SEQ ID NO: 3214040 - protein, 8 aa, Plasmodium falciparum
DNDPDMKS

SEQ ID NO: 3214041 - protein, 8 aa, Plasmodium falciparum
DNDPDMNS

SEQ ID NO: 3214042 - protein, 26 aa, Plasmodium falciparum
DNDPEIKKQKKNLLSEEKNSNTNNVD

SEQ ID NO: 3214043 - protein, 4 aa, Plasmodium falciparum
DNDQ

SEQ ID NO: 3214044 - protein, 9 aa, Plasmodium falciparum
DNDSDMKSV

SEQ ID NO: 3214045 - protein, 6 aa, Plasmodium falciparum
DNDSEM

SEQ ID NO: 3214046 - protein, 8 aa, Plasmodium falciparum
DNDSGENF

SEQ ID NO: 3214047 - protein, 7 aa, Plasmodium falciparum
DNDSTKY

SEQ ID NO: 3214048 - protein, 5 aa, Plasmodium falciparum
DNDTE

SEQ ID NO: 3214049 - protein, 10 aa, Plasmodium falciparum
DNDTKKNKKT

SEQ ID NO: 3214050 - protein, 9 aa, Plasmodium falciparum
DNDTNTFEG

SEQ ID NO: 3214051 - protein, 9 aa, Plasmodium falciparum
DNDTTKFEG

SEQ ID NO: 3214052 - protein, 11 aa, Plasmodium falciparum
DNDTYNHNNNN

SEQ ID NO: 3214053 - protein, 4 aa, Plasmodium falciparum
DNDV

SEQ ID NO: 3214054 - protein, 4 aa, Plasmodium falciparum
DNED

SEQ ID NO: 3214055 - protein, 15 aa, Plasmodium falciparum
DNEDNTNKGKSNDSY

SEQ ID NO: 3214056 - protein, 7 aa, Plasmodium falciparum
DNEDNYM

SEQ ID NO: 3214057 - protein, 16 aa, Plasmodium falciparum
DNEEDEGEEDKSEDYE

SEQ ID NO: 3214058 - protein, 7 aa, Plasmodium falciparum
DNEEEND

SEQ ID NO: 3214059 - protein, 51 aa, Plasmodium falciparum
DNEEIKKKNKKKNKKKKQKNNKKIEESCPKHDESTTIKQNDNNKEEKPNKS

SEQ ID NO: 3214060 - protein, 13 aa, Plasmodium falciparum
DNEEKTENSSNEK

SEQ ID NO: 3214061 - protein, 20 aa, Plasmodium falciparum
DNEENSSNNICDDNTSNSDL

SEQ ID NO: 3214062 - protein, 7 aa, Plasmodium falciparum
DNEEQNY

SEQ ID NO: 3214063 - protein, 8 aa, Plasmodium falciparum
DNEGNENL

SEQ ID NO: 3214064 - protein, 411 aa, Plasmodium falciparum
DNEGPSTLKEYDQTELAKGKDITNKPHESVDEYDQSELAKGKDITNKPHESVDEYDQTELAKGKEVTNKPHENLEEYNETDLAKGKEVTNKPHESVDEYDQSELAKGKDITNKPHESVDEYDQTELAKGKEVTNKPHENLEEYNETDLAKGKEVTNKAHENLEEYNETDLAKGKEVTNKAHENLEEYNETDLAKGKEVTNKAHENLEEYNETDLAKGKEVTNKARENLEEYNETDLAKGKEVTNKARENLEEYNETDLAKGKEVTNKAHENLEEYNETDLAKGKEVTNKAHENLEEYNETDLAKGKEVTNKAHENLEEYNETDLAKGKEVTNKARENLEEYNETDLAKGKEVTNKARENLEEYNETDLAKGKEVTNKARENLEEYNETDLAKGKEVTNKARENLEEYEEKD

SEQ ID NO: 3214065 - protein, 9 aa, Plasmodium falciparum
DNEGTINSR

SEQ ID NO: 3214066 - protein, 8 aa, Plasmodium falciparum
DNEHDNHK

SEQ ID NO: 3214067 - protein, 99 aa, Plasmodium falciparum
DNEHDNKRDNIKDNEHDNIKDSEHDNIKDSEHDNIKDNEHDNIKDNIKDSEHDNIKDNEHENNQDNIKDNKHENNQDNIKDNEHENNQDNIKDNKHDHI

SEQ ID NO: 3214068 - protein, 6 aa, Plasmodium falciparum
DNEIED

SEQ ID NO: 3214069 - protein, 6 aa, Plasmodium falciparum
DNEITS

SEQ ID NO: 3214070 - protein, 34 aa, Plasmodium falciparum
DNEIVSNTTTKKKQILQKKKKNKINKINNNNNNN

SEQ ID NO: 3214071 - protein, 13 aa, Plasmodium falciparum
DNEKDTKHNETNI

SEQ ID NO: 3214072 - protein, 7 aa, Plasmodium falciparum
DNEKITE

SEQ ID NO: 3214073 - protein, 55 aa, Plasmodium falciparum
DNEKKLENEKDNINMDPEKKNENDHKKDDKYDHKDENMKNDPTAQNNQNEENDLT

SEQ ID NO: 3214074 - protein, 5 aa, Plasmodium falciparum
DNEKL

SEQ ID NO: 3214075 - protein, 5 aa, Plasmodium falciparum
DNEKN

SEQ ID NO: 3214076 - protein, 16 aa, Plasmodium falciparum
DNEKNIKEDVERNVEN

SEQ ID NO: 3214077 - protein, 5 aa, Plasmodium falciparum
DNEKR

SEQ ID NO: 3214078 - protein, 5 aa, Plasmodium falciparum
DNELA

SEQ ID NO: 3214079 - protein, 51 aa, Plasmodium falciparum
DNELDNNNNKNNNNNKNNNNNKNNNNNNNNNNNNNNNNDNGVKKNDPAIIS

SEQ ID NO: 3214080 - protein, 8 aa, Plasmodium falciparum
DNELNGTA

SEQ ID NO: 3214081 - protein, 5 aa, Plasmodium falciparum
DNELY

SEQ ID NO: 3214082 - protein, 7 aa, Plasmodium falciparum
DNEMDKE

SEQ ID NO: 3214083 - protein, 4 aa, Plasmodium falciparum
DNEN

SEQ ID NO: 3214084 - protein, 6 aa, Plasmodium falciparum
DNENDN

SEQ ID NO: 3214085 - protein, 9 aa, Plasmodium falciparum
DNENEDSVP

SEQ ID NO: 3214086 - protein, 7 aa, Plasmodium falciparum
DNENEIH

SEQ ID NO: 3214087 - protein, 7 aa, Plasmodium falciparum
DNENKDN

SEQ ID NO: 3214088 - protein, 8 aa, Plasmodium falciparum
DNENKNEK

SEQ ID NO: 3214089 - protein, 5 aa, Plasmodium falciparum
DNENL

SEQ ID NO: 3214090 - protein, 5 aa, Plasmodium falciparum
DNENN

SEQ ID NO: 3214091 - protein, 6 aa, Plasmodium falciparum
DNENNS

SEQ ID NO: 3214092 - protein, 9 aa, Plasmodium falciparum
DNENYDNSN

SEQ ID NO: 3214093 - protein, 8 aa, Plasmodium falciparum
DNEPDYQD

SEQ ID NO: 3214094 - protein, 7 aa, Plasmodium falciparum
DNEQNND

SEQ ID NO: 3214095 - protein, 7 aa, Plasmodium falciparum
DNEQRVD

SEQ ID NO: 3214096 - protein, 33 aa, Plasmodium falciparum
DNESNNNNNYNNTNKSSNRKSLENKSSKTSPKF

SEQ ID NO: 3214097 - protein, 5 aa, Plasmodium falciparum
DNETK

SEQ ID NO: 3214098 - protein, 8 aa, Plasmodium falciparum
DNETNGST

SEQ ID NO: 3214099 - protein, 7 aa, Plasmodium falciparum
DNETNRK

SEQ ID NO: 3214100 - protein, 6 aa, Plasmodium falciparum
DNETTL

SEQ ID NO: 3214101 - protein, 4 aa, Plasmodium falciparum
DNEV

SEQ ID NO: 3214102 - protein, 4 aa, Plasmodium falciparum
DNEW

SEQ ID NO: 3214103 - protein, 5 aa, Plasmodium falciparum
DNEYK

SEQ ID NO: 3214104 - protein, 25 aa, Plasmodium falciparum
DNEYKGNNKSKREVERDDDKISNNL

SEQ ID NO: 3214105 - protein, 13 aa, Plasmodium falciparum
DNEYNKKKISPNV

SEQ ID NO: 3214106 - protein, 6 aa, Plasmodium falciparum
DNFDEK

SEQ ID NO: 3214107 - protein, 8 aa, Plasmodium falciparum
DNFDRQTS

SEQ ID NO: 3214108 - protein, 41 aa, Plasmodium falciparum
DNFENENENENNIKKKDIRKRNDKNKKNNIKDLNKNSNSSI

SEQ ID NO: 3214109 - protein, 4 aa, Plasmodium falciparum
DNFQ

SEQ ID NO: 3214110 - protein, 9 aa, Plasmodium falciparum
DNFRADKKP

SEQ ID NO: 3214111 - protein, 13 aa, Plasmodium falciparum
DNFTNDPTKSFGN

SEQ ID NO: 3214112 - protein, 13 aa, Plasmodium falciparum
DNFYSGRRKQSGL

SEQ ID NO: 3214113 - protein, 24 aa, Plasmodium falciparum
DNGERNDENNDNNNKHNKHNNDNN

SEQ ID NO: 3214114 - protein, 5 aa, Plasmodium falciparum
DNGEV

SEQ ID NO: 3214115 - protein, 7 aa, Plasmodium falciparum
DNGGQDI

SEQ ID NO: 3214116 - protein, 6 aa, Plasmodium falciparum
DNGHSD

SEQ ID NO: 3214117 - protein, 10 aa, Plasmodium falciparum
DNGKDMEEVK

SEQ ID NO: 3214118 - protein, 6 aa, Plasmodium falciparum
DNGLKE

SEQ ID NO: 3214119 - protein, 5 aa, Plasmodium falciparum
DNGLR

SEQ ID NO: 3214120 - protein, 10 aa, Plasmodium falciparum
DNGNNSNIQV

SEQ ID NO: 3214121 - protein, 21 aa, Plasmodium falciparum
DNGNNVNEYKRDDDSNGSEDK

SEQ ID NO: 3214122 - protein, 6 aa, Plasmodium falciparum
DNGNTY

SEQ ID NO: 3214123 - protein, 7 aa, Plasmodium falciparum
DNGQINN

SEQ ID NO: 3214124 - protein, 11 aa, Plasmodium falciparum
DNGSEDKSHEN

SEQ ID NO: 3214125 - protein, 7 aa, Plasmodium falciparum
DNGTTGF

SEQ ID NO: 3214126 - protein, 7 aa, Plasmodium falciparum
DNHKDIK

SEQ ID NO: 3214127 - protein, 6 aa, Plasmodium falciparum
DNHKKD

SEQ ID NO: 3214128 - protein, 8 aa, Plasmodium falciparum
DNHNEVNN

SEQ ID NO: 3214129 - protein, 35 aa, Plasmodium falciparum
DNHNNMKSENKNSSSDENYQYESEQYDSSISGSED

SEQ ID NO: 3214130 - protein, 9 aa, Plasmodium falciparum
DNHNNNENN

SEQ ID NO: 3214131 - protein, 10 aa, Plasmodium falciparum
DNHTNRNEDS

SEQ ID NO: 3214132 - protein, 11 aa, Plasmodium falciparum
DNHYDDDDDIN

SEQ ID NO: 3214133 - protein, 14 aa, Plasmodium falciparum
DNHYPSSNKNNKHG

SEQ ID NO: 3214134 - protein, 4 aa, Plasmodium falciparum
DNID

SEQ ID NO: 3214135 - protein, 14 aa, Plasmodium falciparum
DNIDDDKSTNYSSI

SEQ ID NO: 3214136 - protein, 6 aa, Plasmodium falciparum
DNIDDS

SEQ ID NO: 3214137 - protein, 5 aa, Plasmodium falciparum
DNIDG

SEQ ID NO: 3214138 - protein, 21 aa, Plasmodium falciparum
DNIDGNNINGNNINGNNINGD

SEQ ID NO: 3214139 - protein, 23 aa, Plasmodium falciparum
DNIDKYNNNNEDNNNNNNNSNNI

SEQ ID NO: 3214140 - protein, 11 aa, Plasmodium falciparum
DNIDPYDDSYD

SEQ ID NO: 3214141 - protein, 4 aa, Plasmodium falciparum
DNIE

SEQ ID NO: 3214142 - protein, 12 aa, Plasmodium falciparum
DNIENKANKHNY

SEQ ID NO: 3214143 - protein, 12 aa, Plasmodium falciparum
DNIESKKDNMDN

SEQ ID NO: 3214144 - protein, 8 aa, Plasmodium falciparum
DNIESNSV

SEQ ID NO: 3214145 - protein, 35 aa, Plasmodium falciparum
DNIKDDDDKNYHNNHNNNFNNSLNNNNDNASESLS

SEQ ID NO: 3214146 - protein, 17 aa, Plasmodium falciparum
DNIKSSNEMKNNKSSNI

SEQ ID NO: 3214147 - protein, 29 aa, Plasmodium falciparum
DNILNDNNNNENTVSKNQSSTNNQAYTTY

SEQ ID NO: 3214148 - protein, 4 aa, Plasmodium falciparum
DNIN

SEQ ID NO: 3214149 - protein, 10 aa, Plasmodium falciparum
DNINDNIKDN

SEQ ID NO: 3214150 - protein, 20 aa, Plasmodium falciparum
DNINDNINDNINDNINDNIN

SEQ ID NO: 3214151 - protein, 10 aa, Plasmodium falciparum
DNINEMTSDN

SEQ ID NO: 3214152 - protein, 6 aa, Plasmodium falciparum
DNINET

SEQ ID NO: 3214153 - protein, 18 aa, Plasmodium falciparum
DNINGDNINGDNINGDNI

SEQ ID NO: 3214154 - protein, 5 aa, Plasmodium falciparum
DNINK

SEQ ID NO: 3214155 - protein, 7 aa, Plasmodium falciparum
DNINKNE

SEQ ID NO: 3214156 - protein, 6 aa, Plasmodium falciparum
DNINKT

SEQ ID NO: 3214157 - protein, 20 aa, Plasmodium falciparum
DNINNNENNNYDNNINNKEE

SEQ ID NO: 3214158 - protein, 11 aa, Plasmodium falciparum
DNINNRDDNNI

SEQ ID NO: 3214159 - protein, 8 aa, Plasmodium falciparum
DNINNSSN

SEQ ID NO: 3214160 - protein, 5 aa, Plasmodium falciparum
DNINQ

SEQ ID NO: 3214161 - protein, 12 aa, Plasmodium falciparum
DNINRNEKNDKI

SEQ ID NO: 3214162 - protein, 9 aa, Plasmodium falciparum
DNINSRNKS

SEQ ID NO: 3214163 - protein, 6 aa, Plasmodium falciparum
DNINYN

SEQ ID NO: 3214164 - protein, 15 aa, Plasmodium falciparum
DNIPADDEKKSSHNE

SEQ ID NO: 3214165 - protein, 12 aa, Plasmodium falciparum
DNIPPKNDQNDL

SEQ ID NO: 3214166 - protein, 12 aa, Plasmodium falciparum
DNIPPKNNQNDL

SEQ ID NO: 3214167 - protein, 10 aa, Plasmodium falciparum
DNIPSKRDLT

SEQ ID NO: 3214168 - protein, 9 aa, Plasmodium falciparum
DNIPSNEYN

SEQ ID NO: 3214169 - protein, 7 aa, Plasmodium falciparum
DNIQKEN

SEQ ID NO: 3214170 - protein, 7 aa, Plasmodium falciparum
DNIQTST

SEQ ID NO: 3214171 - protein, 6 aa, Plasmodium falciparum
DNIRDE

SEQ ID NO: 3214172 - protein, 14 aa, Plasmodium falciparum
DNIRKNMDNTKNIE

SEQ ID NO: 3214173 - protein, 18 aa, Plasmodium falciparum
DNISKSKGRKKKKKKIPK

SEQ ID NO: 3214174 - protein, 8 aa, Plasmodium falciparum
DNISKSNV

SEQ ID NO: 3214175 - protein, 6 aa, Plasmodium falciparum
DNISSG

SEQ ID NO: 3214176 - protein, 38 aa, Plasmodium falciparum
DNISSGNIYNSNDKDMEISENDDYSSESIESENNYKEH

SEQ ID NO: 3214177 - protein, 10 aa, Plasmodium falciparum
DNISSYSSDD

SEQ ID NO: 3214178 - protein, 12 aa, Plasmodium falciparum
DNITEDDEHNTT

SEQ ID NO: 3214179 - protein, 19 aa, Plasmodium falciparum
DNITEHSSVSESQTDDQNQ

SEQ ID NO: 3214180 - protein, 13 aa, Plasmodium falciparum
DNITKKKDTSNNL

SEQ ID NO: 3214181 - protein, 5 aa, Plasmodium falciparum
DNITN

SEQ ID NO: 3214182 - protein, 8 aa, Plasmodium falciparum
DNKDDESL

SEQ ID NO: 3214183 - protein, 16 aa, Plasmodium falciparum
DNKDDHNNKNCATSEM

SEQ ID NO: 3214184 - protein, 10 aa, Plasmodium falciparum
DNKDDKKKYR

SEQ ID NO: 3214185 - protein, 83 aa, Plasmodium falciparum
DNKDDKYNTGGGDENDNHGNKNDNRGNKNDNDGEKNYNDGEKNYNDGEKNYNDGEKNYNDGEKNYNDGEKNYNDGDKNNISNN

SEQ ID NO: 3214186 - protein, 21 aa, Plasmodium falciparum
DNKDGAADQQVEEIVENWEDL

SEQ ID NO: 3214187 - protein, 14 aa, Plasmodium falciparum
DNKDSNTPKGIDTT

SEQ ID NO: 3214188 - protein, 12 aa, Plasmodium falciparum
DNKDSSTDAPVE

SEQ ID NO: 3214189 - protein, 4 aa, Plasmodium falciparum
DNKE

SEQ ID NO: 3214190 - protein, 12 aa, Plasmodium falciparum
DNKEEKKKNEQH

SEQ ID NO: 3214191 - protein, 8 aa, Plasmodium falciparum
DNKEENIK

SEQ ID NO: 3214192 - protein, 24 aa, Plasmodium falciparum
DNKEGKKESEKGTNATSNNTKNDL

SEQ ID NO: 3214193 - protein, 6 aa, Plasmodium falciparum
DNKEHF

SEQ ID NO: 3214194 - protein, 15 aa, Plasmodium falciparum
DNKENNEDNDNTPHW

SEQ ID NO: 3214195 - protein, 4 aa, Plasmodium falciparum
DNKG

SEQ ID NO: 3214196 - protein, 9 aa, Plasmodium falciparum
DNKGKINSS

SEQ ID NO: 3214197 - protein, 5 aa, Plasmodium falciparum
DNKGL

SEQ ID NO: 3214198 - protein, 22 aa, Plasmodium falciparum
DNKHNDKHNDKHNDKHNDIHND

SEQ ID NO: 3214199 - protein, 10 aa, Plasmodium falciparum
DNKKGKYAFK

SEQ ID NO: 3214200 - protein, 7 aa, Plasmodium falciparum
DNKKKDI

SEQ ID NO: 3214201 - protein, 7 aa, Plasmodium falciparum
DNKKKEF

SEQ ID NO: 3214202 - protein, 20 aa, Plasmodium falciparum
DNKKKHDVNVSSDSSSEVGE

SEQ ID NO: 3214203 - protein, 8 aa, Plasmodium falciparum
DNKKNITN

SEQ ID NO: 3214204 - protein, 8 aa, Plasmodium falciparum
DNKKNNGD

SEQ ID NO: 3214205 - protein, 10 aa, Plasmodium falciparum
DNKKSAENRK

SEQ ID NO: 3214206 - protein, 10 aa, Plasmodium falciparum
DNKKSMDENI

SEQ ID NO: 3214207 - protein, 6 aa, Plasmodium falciparum
DNKKTN

SEQ ID NO: 3214208 - protein, 7 aa, Plasmodium falciparum
DNKKTNY

SEQ ID NO: 3214209 - protein, 21 aa, Plasmodium falciparum
DNKKYEQENRENNNNNNNVEK

SEQ ID NO: 3214210 - protein, 14 aa, Plasmodium falciparum
DNKKYKEPIDKKGN

SEQ ID NO: 3214211 - protein, 7 aa, Plasmodium falciparum
DNKKYSH

SEQ ID NO: 3214212 - protein, 13 aa, Plasmodium falciparum
DNKMEDLGNKNKN

SEQ ID NO: 3214213 - protein, 4 aa, Plasmodium falciparum
DNKN

SEQ ID NO: 3214214 - protein, 7 aa, Plasmodium falciparum
DNKNAKM

SEQ ID NO: 3214215 - protein, 19 aa, Plasmodium falciparum
DNKNDNNKYNYSNNSSNIN

SEQ ID NO: 3214216 - protein, 35 aa, Plasmodium falciparum
DNKNEIEDKDNNIKNNDDINNSLNNEKENNIKIII

SEQ ID NO: 3214217 - protein, 9 aa, Plasmodium falciparum
DNKNENLNN

SEQ ID NO: 3214218 - protein, 5 aa, Plasmodium falciparum
DNKNK

SEQ ID NO: 3214219 - protein, 7 aa, Plasmodium falciparum
DNKNKKM

SEQ ID NO: 3214220 - protein, 9 aa, Plasmodium falciparum
DNKNKKYYS

SEQ ID NO: 3214221 - protein, 8 aa, Plasmodium falciparum
DNKNKSET

SEQ ID NO: 3214222 - protein, 7 aa, Plasmodium falciparum
DNKNKVY

SEQ ID NO: 3214223 - protein, 8 aa, Plasmodium falciparum
DNKNNDMG

SEQ ID NO: 3214224 - protein, 11 aa, Plasmodium falciparum
DNKNNRNEGNV

SEQ ID NO: 3214225 - protein, 11 aa, Plasmodium falciparum
DNKNNTNKIDN

SEQ ID NO: 3214226 - protein, 81 aa, Plasmodium falciparum
DNKNSHIKNNTQQEEKNKNTTNQKSDANNKIHENKKKVEEEEKHKKEKNPNEKENNDNNKNKNEKKNGKGNQGNNKDLPAY

SEQ ID NO: 3214227 - protein, 11 aa, Plasmodium falciparum
DNKNSPDNNQN

SEQ ID NO: 3214228 - protein, 11 aa, Plasmodium falciparum
DNKNTKNQEIE

SEQ ID NO: 3214229 - protein, 8 aa, Plasmodium falciparum
DNKNTSQI

SEQ ID NO: 3214230 - protein, 10 aa, Plasmodium falciparum
DNKNVEGNFT

SEQ ID NO: 3214231 - protein, 8 aa, Plasmodium falciparum
DNKNYNDV

SEQ ID NO: 3214232 - protein, 13 aa, Plasmodium falciparum
DNKPKKNPFTDTA

SEQ ID NO: 3214233 - protein, 19 aa, Plasmodium falciparum
DNKQKGKRGPHQKGDSTMV

SEQ ID NO: 3214234 - protein, 8 aa, Plasmodium falciparum
DNKQQRKD

SEQ ID NO: 3214235 - protein, 5 aa, Plasmodium falciparum
DNKQY

SEQ ID NO: 3214236 - protein, 73 aa, Plasmodium falciparum
DNKRDDNKRDDNKRDDNKRDDNKRDDNKRDDNKRDDNKRDDNKRDDNKRDDNKRDDNKRDDNKRDDKKDTHIQ

SEQ ID NO: 3214237 - protein, 6 aa, Plasmodium falciparum
DNKRKM

SEQ ID NO: 3214238 - protein, 7 aa, Plasmodium falciparum
DNKSELK

SEQ ID NO: 3214239 - protein, 10 aa, Plasmodium falciparum
DNKSEYNTSM

SEQ ID NO: 3214240 - protein, 10 aa, Plasmodium falciparum
DNKSGKSKTE

SEQ ID NO: 3214241 - protein, 6 aa, Plasmodium falciparum
DNKSIC

SEQ ID NO: 3214242 - protein, 9 aa, Plasmodium falciparum
DNKSKNIPI

SEQ ID NO: 3214243 - protein, 12 aa, Plasmodium falciparum
DNKSKTQNGDNN

SEQ ID NO: 3214244 - protein, 8 aa, Plasmodium falciparum
DNKSLKSI

SEQ ID NO: 3214245 - protein, 25 aa, Plasmodium falciparum
DNKSTNHNHKNNKNDNDNNNNNNNN

SEQ ID NO: 3214246 - protein, 5 aa, Plasmodium falciparum
DNKTD

SEQ ID NO: 3214247 - protein, 9 aa, Plasmodium falciparum
DNKTDNNKR

SEQ ID NO: 3214248 - protein, 7 aa, Plasmodium falciparum
DNKTHSK

SEQ ID NO: 3214249 - protein, 8 aa, Plasmodium falciparum
DNKTKEID

SEQ ID NO: 3214250 - protein, 13 aa, Plasmodium falciparum
DNKTNQEKKNMER

SEQ ID NO: 3214251 - protein, 6 aa, Plasmodium falciparum
DNKTTN

SEQ ID NO: 3214252 - protein, 6 aa, Plasmodium falciparum
DNKVNT

SEQ ID NO: 3214253 - protein, 62 aa, Plasmodium falciparum
DNKYDNNYDNNYDNNYDNNYDNNYDNNYDNNYDNNYDNNYDNNYDNNYDNKYDNNYDNDKKK

SEQ ID NO: 3214254 - protein, 9 aa, Plasmodium falciparum
DNKYEEDNN

SEQ ID NO: 3214255 - protein, 14 aa, Plasmodium falciparum
DNKYKYKNNLNSSS

SEQ ID NO: 3214256 - protein, 15 aa, Plasmodium falciparum
DNKYNNNNNNNNNNN

SEQ ID NO: 3214257 - protein, 6 aa, Plasmodium falciparum
DNKYYS

SEQ ID NO: 3214258 - protein, 4 aa, Plasmodium falciparum
DNLD

SEQ ID NO: 3214259 - protein, 9 aa, Plasmodium falciparum
DNLDGTNYM

SEQ ID NO: 3214260 - protein, 4 aa, Plasmodium falciparum
DNLE

SEQ ID NO: 3214261 - protein, 5 aa, Plasmodium falciparum
DNLEK

SEQ ID NO: 3214262 - protein, 76 aa, Plasmodium falciparum
DNLENEEPIHKNKTSKSMNDDTKSVSHYEETKKKNDDDDMSYDSSSDYPKDISYDTSDGSYRDNNNNGSGPNDVKQ

SEQ ID NO: 3214263 - protein, 5 aa, Plasmodium falciparum
DNLGG

SEQ ID NO: 3214264 - protein, 16 aa, Plasmodium falciparum
DNLGKSVENYKDDSYP

SEQ ID NO: 3214265 - protein, 9 aa, Plasmodium falciparum
DNLGRSGGD

SEQ ID NO: 3214266 - protein, 17 aa, Plasmodium falciparum
DNLKEKEISDYDNDPNY

SEQ ID NO: 3214267 - protein, 6 aa, Plasmodium falciparum
DNLKGS

SEQ ID NO: 3214268 - protein, 4 aa, Plasmodium falciparum
DNLL

SEQ ID NO: 3214269 - protein, 7 aa, Plasmodium falciparum
DNLNNDN

SEQ ID NO: 3214270 - protein, 13 aa, Plasmodium falciparum
DNLNNKNDVKKKK

SEQ ID NO: 3214271 - protein, 6 aa, Plasmodium falciparum
DNLNNN

SEQ ID NO: 3214272 - protein, 19 aa, Plasmodium falciparum
DNLNNNSNASEDDKKKEKV

SEQ ID NO: 3214273 - protein, 21 aa, Plasmodium falciparum
DNLNNTNEKLKNKKLESPKRI

SEQ ID NO: 3214274 - protein, 4 aa, Plasmodium falciparum
DNLP

SEQ ID NO: 3214275 - protein, 13 aa, Plasmodium falciparum
DNLPSKVNNEKTR

SEQ ID NO: 3214276 - protein, 17 aa, Plasmodium falciparum
DNLSESKPDTPNYSSKV

SEQ ID NO: 3214277 - protein, 21 aa, Plasmodium falciparum
DNLSNKPTDLRRTNNTDYGTK

SEQ ID NO: 3214278 - protein, 10 aa, Plasmodium falciparum
DNLSNPASLY

SEQ ID NO: 3214279 - protein, 8 aa, Plasmodium falciparum
DNLTNADM

SEQ ID NO: 3214280 - protein, 10 aa, Plasmodium falciparum
DNLTNSQTNY

SEQ ID NO: 3214281 - protein, 17 aa, Plasmodium falciparum
DNMAEGNYKSFEEKDQE

SEQ ID NO: 3214282 - protein, 84 aa, Plasmodium falciparum
DNMDDDDDDNNDNNNDDDSNNNNNDDDSNNNNNDDDSNNNNNDDDSNNNNNDDDSNNNNNDDSNNNNNDDSNNNNNDDSNNTGS

SEQ ID NO: 3214283 - protein, 8 aa, Plasmodium falciparum
DNMDDDKE

SEQ ID NO: 3214284 - protein, 17 aa, Plasmodium falciparum
DNMDTNLSDKSSRCSGK

SEQ ID NO: 3214285 - protein, 6 aa, Plasmodium falciparum
DNMENE

SEQ ID NO: 3214286 - protein, 9 aa, Plasmodium falciparum
DNMKNDNYN

SEQ ID NO: 3214287 - protein, 64 aa, Plasmodium falciparum
DNMKRNNNNNNNNNNNNNNNNNNNNNNNNNNNNNNNNNNNNNNNNNNNNNNNNNNNNNNNNNNN

SEQ ID NO: 3214288 - protein, 23 aa, Plasmodium falciparum
DNMNDENSTDITVSDDNSNIPNK

SEQ ID NO: 3214289 - protein, 9 aa, Plasmodium falciparum
DNMNNNRTY

SEQ ID NO: 3214290 - protein, 8 aa, Plasmodium falciparum
DNMNTNNE

SEQ ID NO: 3214291 - protein, 5 aa, Plasmodium falciparum
DNMRG

SEQ ID NO: 3214292 - protein, 18 aa, Plasmodium falciparum
DNMYDSNKNNDSNSNNNI

SEQ ID NO: 3214293 - protein, 27 aa, Plasmodium falciparum
DNMYNTNNNMNNTNNNMNNTNNNMNNS

SEQ ID NO: 3214294 - protein, 82 aa, Plasmodium falciparum
DNNAHNNTHNNTHNNTNNNTHNNTNNNTNNNTNNNTNNNTNNNTNNNTHNNTNNNTNNNTHNNTNNNRHNNRHNNRHNNSQN

SEQ ID NO: 3214295 - protein, 4 aa, Plasmodium falciparum
DNNC

SEQ ID NO: 3214296 - protein, 7 aa, Plasmodium falciparum
DNNCGNE

SEQ ID NO: 3214297 - protein, 42 aa, Plasmodium falciparum
DNNDAIKNNHSRQNNLTSQNNHTSQNNHTSQNNHTSQNNHTI

SEQ ID NO: 3214298 - protein, 8 aa, Plasmodium falciparum
DNNDENNN

SEQ ID NO: 3214299 - protein, 11 aa, Plasmodium falciparum
DNNDLDDKENT

SEQ ID NO: 3214300 - protein, 5 aa, Plasmodium falciparum
DNNDM

SEQ ID NO: 3214301 - protein, 5 aa, Plasmodium falciparum
DNNDN

SEQ ID NO: 3214302 - protein, 10 aa, Plasmodium falciparum
DNNDNNINDN

SEQ ID NO: 3214303 - protein, 45 aa, Plasmodium falciparum
DNNDNNKSLNDNIDYNKNNSGLNKERNNNLDYDKNGKYEKVSYDE

SEQ ID NO: 3214304 - protein, 20 aa, Plasmodium falciparum
DNNDNNNNNNNNNNNNYTNE

SEQ ID NO: 3214305 - protein, 9 aa, Plasmodium falciparum
DNNEDNNHN

SEQ ID NO: 3214306 - protein, 7 aa, Plasmodium falciparum
DNNEEIE

SEQ ID NO: 3214307 - protein, 17 aa, Plasmodium falciparum
DNNEHNEDNNGGYNNKS

SEQ ID NO: 3214308 - protein, 69 aa, Plasmodium falciparum
DNNEKNANVENEIDNDNNKKNDNNDNNKKNDNNDNNKKNDNNDDNNKKNDNNDNNNNNNNQTCVEKSNK

SEQ ID NO: 3214309 - protein, 12 aa, Plasmodium falciparum
DNNEKNKKFQGG

SEQ ID NO: 3214310 - protein, 7 aa, Plasmodium falciparum
DNNENIG

SEQ ID NO: 3214311 - protein, 11 aa, Plasmodium falciparum
DNNEYGVSPSC

SEQ ID NO: 3214312 - protein, 4 aa, Plasmodium falciparum
DNNF

SEQ ID NO: 3214313 - protein, 16 aa, Plasmodium falciparum
DNNGANPENFDDGTEN

SEQ ID NO: 3214314 - protein, 14 aa, Plasmodium falciparum
DNNGEYESSLTNEE

SEQ ID NO: 3214315 - protein, 11 aa, Plasmodium falciparum
DNNGKTNLYDT

SEQ ID NO: 3214316 - protein, 28 aa, Plasmodium falciparum
DNNGNDNDNDNDDNNDNDNNNNNNMNNQ

SEQ ID NO: 3214317 - protein, 52 aa, Plasmodium falciparum
DNNHDNNHDNNHHNNHDNNHDNNHHNNHDNNHGDGLDNPINDKRDSTKNHKI

SEQ ID NO: 3214318 - protein, 13 aa, Plasmodium falciparum
DNNHKDKKEDNHE

SEQ ID NO: 3214319 - protein, 16 aa, Plasmodium falciparum
DNNIDTKEAKKNEETE

SEQ ID NO: 3214320 - protein, 64 aa, Plasmodium falciparum
DNNIGRGDNNIGRGDNNIGRGDNNNGCDDNNIGRGDNNNGCDDNNIGRGDNNNGCDDNNIGRGY

SEQ ID NO: 3214321 - protein, 6 aa, Plasmodium falciparum
DNNIKK

SEQ ID NO: 3214322 - protein, 26 aa, Plasmodium falciparum
DNNINNNNINNNNNIHNNNKYDDHNN

SEQ ID NO: 3214323 - protein, 31 aa, Plasmodium falciparum
DNNISHSSSNDIQKEMKEKNNEMKNIPQNDN

SEQ ID NO: 3214324 - protein, 11 aa, Plasmodium falciparum
DNNISNDISNN

SEQ ID NO: 3214325 - protein, 13 aa, Plasmodium falciparum
DNNKINNNNPEKD

SEQ ID NO: 3214326 - protein, 7 aa, Plasmodium falciparum
DNNKKKH

SEQ ID NO: 3214327 - protein, 41 aa, Plasmodium falciparum
DNNKNDDNKNNDTNNNNNNDNNNNNNNNNNNNNNNNNNLND

SEQ ID NO: 3214328 - protein, 53 aa, Plasmodium falciparum
DNNKNGDNNKNGDNNKNGDNNKNGDNNKNGDNNKNGDNNKNGDNNKNDDNNNM

SEQ ID NO: 3214329 - protein, 9 aa, Plasmodium falciparum
DNNKNKENE

SEQ ID NO: 3214330 - protein, 10 aa, Plasmodium falciparum
DNNKNQNISN

SEQ ID NO: 3214331 - protein, 9 aa, Plasmodium falciparum
DNNKNTNAF

SEQ ID NO: 3214332 - protein, 6 aa, Plasmodium falciparum
DNNKRV

SEQ ID NO: 3214333 - protein, 10 aa, Plasmodium falciparum
DNNKSNVPTK

SEQ ID NO: 3214334 - protein, 11 aa, Plasmodium falciparum
DNNKTDKCNNT

SEQ ID NO: 3214335 - protein, 11 aa, Plasmodium falciparum
DNNLDNNSNND

SEQ ID NO: 3214336 - protein, 5 aa, Plasmodium falciparum
DNNLN

SEQ ID NO: 3214337 - protein, 6 aa, Plasmodium falciparum
DNNMDD

SEQ ID NO: 3214338 - protein, 6 aa, Plasmodium falciparum
DNNMKK

SEQ ID NO: 3214339 - protein, 5 aa, Plasmodium falciparum
DNNNC

SEQ ID NO: 3214340 - protein, 12 aa, Plasmodium falciparum
DNNNDLNSQRED

SEQ ID NO: 3214341 - protein, 15 aa, Plasmodium falciparum
DNNNDNHQLTDDKRK

SEQ ID NO: 3214342 - protein, 8 aa, Plasmodium falciparum
DNNNDNIQ

SEQ ID NO: 3214343 - protein, 18 aa, Plasmodium falciparum
DNNNDNNNNNDKDDYTFE

SEQ ID NO: 3214344 - protein, 9 aa, Plasmodium falciparum
DNNNDSNMN

SEQ ID NO: 3214345 - protein, 13 aa, Plasmodium falciparum
DNNNDVKNKGKTY

SEQ ID NO: 3214346 - protein, 9 aa, Plasmodium falciparum
DNNNEGNIN

SEQ ID NO: 3214347 - protein, 8 aa, Plasmodium falciparum
DNNNENID

SEQ ID NO: 3214348 - protein, 5 aa, Plasmodium falciparum
DNNNF

SEQ ID NO: 3214349 - protein, 6 aa, Plasmodium falciparum
DNNNIE

SEQ ID NO: 3214350 - protein, 5 aa, Plasmodium falciparum
DNNNK

SEQ ID NO: 3214351 - protein, 39 aa, Plasmodium falciparum
DNNNKKSNTTTTTTTTNNNNNNNNNNNNSNNNITNKDNS

SEQ ID NO: 3214352 - protein, 11 aa, Plasmodium falciparum
DNNNLKDPQND

SEQ ID NO: 3214353 - protein, 7 aa, Plasmodium falciparum
DNNNMNG

SEQ ID NO: 3214354 - protein, 9 aa, Plasmodium falciparum
DNNNNCDDN

SEQ ID NO: 3214355 - protein, 36 aa, Plasmodium falciparum
DNNNNDNKNNDDNKNNDDNKNNDDNKNNDDDDDDVS

SEQ ID NO: 3214356 - protein, 9 aa, Plasmodium falciparum
DNNNNEYDE

SEQ ID NO: 3214357 - protein, 8 aa, Plasmodium falciparum
DNNNNKNI

SEQ ID NO: 3214358 - protein, 10 aa, Plasmodium falciparum
DNNNNKNQLT

SEQ ID NO: 3214359 - protein, 6 aa, Plasmodium falciparum
DNNNNN

SEQ ID NO: 3214360 - protein, 10 aa, Plasmodium falciparum
DNNNNNDHTD

SEQ ID NO: 3214361 - protein, 25 aa, Plasmodium falciparum
DNNNNNDNNNNNNNEVDKNKKSLQE

SEQ ID NO: 3214362 - protein, 8 aa, Plasmodium falciparum
DNNNNNIN

SEQ ID NO: 3214363 - protein, 33 aa, Plasmodium falciparum
DNNNNNINKNYKYDKNDKHNNNNNNNNNNSNYS

SEQ ID NO: 3214364 - protein, 17 aa, Plasmodium falciparum
DNNNNNKKKNNKRKNNI

SEQ ID NO: 3214365 - protein, 9 aa, Plasmodium falciparum
DNNNNNNDI

SEQ ID NO: 3214366 - protein, 16 aa, Plasmodium falciparum
DNNNNNNDNNNNRGDE

SEQ ID NO: 3214367 - protein, 16 aa, Plasmodium falciparum
DNNNNNNGNNNGHNNG

SEQ ID NO: 3214368 - protein, 9 aa, Plasmodium falciparum
DNNNNNNNN

SEQ ID NO: 3214369 - protein, 18 aa, Plasmodium falciparum
DNNNNNNNNDNNNNLKKR

SEQ ID NO: 3214370 - protein, 25 aa, Plasmodium falciparum
DNNNNNNNNGDRKKENNIYNENEEG

SEQ ID NO: 3214371 - protein, 17 aa, Plasmodium falciparum
DNNNNNNNNLKNKPSEF

SEQ ID NO: 3214372 - protein, 13 aa, Plasmodium falciparum
DNNNNNNNNNDNI

SEQ ID NO: 3214373 - protein, 13 aa, Plasmodium falciparum
DNNNNNNNNNKSD

SEQ ID NO: 3214374 - protein, 30 aa, Plasmodium falciparum
DNNNNNNNNNKTCDDKKTIERNKQNDSDSI

SEQ ID NO: 3214375 - protein, 11 aa, Plasmodium falciparum
DNNNNNNNNNN

SEQ ID NO: 3214376 - protein, 15 aa, Plasmodium falciparum
DNNNNNNNNNNKDDN

SEQ ID NO: 3214377 - protein, 18 aa, Plasmodium falciparum
DNNNNNNNNNNNNTDNKQ

SEQ ID NO: 3214378 - protein, 13 aa, Plasmodium falciparum
DNNNNNNNNNNNY

SEQ ID NO: 3214379 - protein, 14 aa, Plasmodium falciparum
DNNNNNNNNNNSDM

SEQ ID NO: 3214380 - protein, 13 aa, Plasmodium falciparum
DNNNNNNNNNSFV

SEQ ID NO: 3214381 - protein, 15 aa, Plasmodium falciparum
DNNNNNNNNVTSDHT

SEQ ID NO: 3214382 - protein, 40 aa, Plasmodium falciparum
DNNNNNNNSNNNNSNSNNNSNSNIKTKESVSTTNHNNSSN

SEQ ID NO: 3214383 - protein, 39 aa, Plasmodium falciparum
DNNNNNNYDDDDDDDNDNDNDNDDYKSYKYNDKKKKYNE

SEQ ID NO: 3214384 - protein, 11 aa, Plasmodium falciparum
DNNNNNTVKRT

SEQ ID NO: 3214385 - protein, 8 aa, Plasmodium falciparum
DNNNNNYH

SEQ ID NO: 3214386 - protein, 9 aa, Plasmodium falciparum
DNNNNSCVG

SEQ ID NO: 3214387 - protein, 8 aa, Plasmodium falciparum
DNNNNVHT

SEQ ID NO: 3214388 - protein, 10 aa, Plasmodium falciparum
DNNNQETKEM

SEQ ID NO: 3214389 - protein, 23 aa, Plasmodium falciparum
DNNNSSGNSSVSSSSSTLSYKKR

SEQ ID NO: 3214390 - protein, 8 aa, Plasmodium falciparum
DNNNSYES

SEQ ID NO: 3214391 - protein, 6 aa, Plasmodium falciparum
DNNNTN

SEQ ID NO: 3214392 - protein, 20 aa, Plasmodium falciparum
DNNNVDDNKNGKDKKEKSGP

SEQ ID NO: 3214393 - protein, 5 aa, Plasmodium falciparum
DNNNY

SEQ ID NO: 3214394 - protein, 47 aa, Plasmodium falciparum
DNNPNNHVSNNGDPKKCENLSPDNDTSNSIHKNNNTNINEKKNGEKK

SEQ ID NO: 3214395 - protein, 5 aa, Plasmodium falciparum
DNNPY

SEQ ID NO: 3214396 - protein, 28 aa, Plasmodium falciparum
DNNQNHNGIPSDSHNLSDDNNSQESTTA

SEQ ID NO: 3214397 - protein, 6 aa, Plasmodium falciparum
DNNQNY

SEQ ID NO: 3214398 - protein, 39 aa, Plasmodium falciparum
DNNQRGVNNDDHPNNNNNNNNNYQNKEEPNLKDKARNKI

SEQ ID NO: 3214399 - protein, 13 aa, Plasmodium falciparum
DNNQSNKKTNNIK

SEQ ID NO: 3214400 - protein, 6 aa, Plasmodium falciparum
DNNQYS

SEQ ID NO: 3214401 - protein, 10 aa, Plasmodium falciparum
DNNRNEEEKG

SEQ ID NO: 3214402 - protein, 6 aa, Plasmodium falciparum
DNNRNN

SEQ ID NO: 3214403 - protein, 7 aa, Plasmodium falciparum
DNNRRNL

SEQ ID NO: 3214404 - protein, 12 aa, Plasmodium falciparum
DNNRSAKNKENL

SEQ ID NO: 3214405 - protein, 13 aa, Plasmodium falciparum
DNNSHTYKKRSSN

SEQ ID NO: 3214406 - protein, 6 aa, Plasmodium falciparum
DNNSIN

SEQ ID NO: 3214407 - protein, 7 aa, Plasmodium falciparum
DNNSLTQ

SEQ ID NO: 3214408 - protein, 7 aa, Plasmodium falciparum
DNNSNIQ

SEQ ID NO: 3214409 - protein, 6 aa, Plasmodium falciparum
DNNSQT

SEQ ID NO: 3214410 - protein, 6 aa, Plasmodium falciparum
DNNSSM

SEQ ID NO: 3214411 - protein, 12 aa, Plasmodium falciparum
DNNSSNSSSNYI

SEQ ID NO: 3214412 - protein, 19 aa, Plasmodium falciparum
DNNSYNNNSCDDEEKRKYP

SEQ ID NO: 3214413 - protein, 10 aa, Plasmodium falciparum
DNNTHGKMDG

SEQ ID NO: 3214414 - protein, 15 aa, Plasmodium falciparum
DNNTHPTMSRDNMEE

SEQ ID NO: 3214415 - protein, 12 aa, Plasmodium falciparum
DNNTHPTPSRHT

SEQ ID NO: 3214416 - protein, 9 aa, Plasmodium falciparum
DNNTNNYHN

SEQ ID NO: 3214417 - protein, 8 aa, Plasmodium falciparum
DNNTNPKT

SEQ ID NO: 3214418 - protein, 9 aa, Plasmodium falciparum
DNNTNTTMS

SEQ ID NO: 3214419 - protein, 14 aa, Plasmodium falciparum
DNNTNTTMSRDNME

SEQ ID NO: 3214420 - protein, 4 aa, Plasmodium falciparum
DNNV

SEQ ID NO: 3214421 - protein, 8 aa, Plasmodium falciparum
DNNVDNNK

SEQ ID NO: 3214422 - protein, 13 aa, Plasmodium falciparum
DNNVGDENNNRNY

SEQ ID NO: 3214423 - protein, 5 aa, Plasmodium falciparum
DNNVY

SEQ ID NO: 3214424 - protein, 7 aa, Plasmodium falciparum
DNNYISS

SEQ ID NO: 3214425 - protein, 7 aa, Plasmodium falciparum
DNNYNND

SEQ ID NO: 3214426 - protein, 9 aa, Plasmodium falciparum
DNNYNTSNN

SEQ ID NO: 3214427 - protein, 21 aa, Plasmodium falciparum
DNNYSGEKRGINPYLKKSVDI

SEQ ID NO: 3214428 - protein, 9 aa, Plasmodium falciparum
DNNYTNDDY

SEQ ID NO: 3214429 - protein, 8 aa, Plasmodium falciparum
DNPEDGPL

SEQ ID NO: 3214430 - protein, 6 aa, Plasmodium falciparum
DNPGHQ

SEQ ID NO: 3214431 - protein, 6 aa, Plasmodium falciparum
DNPIST

SEQ ID NO: 3214432 - protein, 9 aa, Plasmodium falciparum
DNPKPKNEF

SEQ ID NO: 3214433 - protein, 9 aa, Plasmodium falciparum
DNPKPTNEF

SEQ ID NO: 3214434 - protein, 9 aa, Plasmodium falciparum
DNPKTKNEF

SEQ ID NO: 3214435 - protein, 8 aa, Plasmodium falciparum
DNPKTTNE

SEQ ID NO: 3214436 - protein, 23 aa, Plasmodium falciparum
DNPMKYKTEGNKNNYAEKKESFE

SEQ ID NO: 3214437 - protein, 19 aa, Plasmodium falciparum
DNPSGIPSYNKSGSSDSYL

SEQ ID NO: 3214438 - protein, 7 aa, Plasmodium falciparum
DNPTNAS

SEQ ID NO: 3214439 - protein, 6 aa, Plasmodium falciparum
DNPYGY

SEQ ID NO: 3214440 - protein, 29 aa, Plasmodium falciparum
DNPYKNECKKNNYKNINTEQNYISSSSHE

SEQ ID NO: 3214441 - protein, 4 aa, Plasmodium falciparum
DNQE

SEQ ID NO: 3214442 - protein, 7 aa, Plasmodium falciparum
DNQEKNN

SEQ ID NO: 3214443 - protein, 5 aa, Plasmodium falciparum
DNQGH

SEQ ID NO: 3214444 - protein, 8 aa, Plasmodium falciparum
DNQIDNSN

SEQ ID NO: 3214445 - protein, 4 aa, Plasmodium falciparum
DNQK

SEQ ID NO: 3214446 - protein, 5 aa, Plasmodium falciparum
DNQKG

SEQ ID NO: 3214447 - protein, 16 aa, Plasmodium falciparum
DNQKKYNTSKTSFNSS

SEQ ID NO: 3214448 - protein, 10 aa, Plasmodium falciparum
DNQKSSNEFT

SEQ ID NO: 3214449 - protein, 12 aa, Plasmodium falciparum
DNQNTHDGFPSG

SEQ ID NO: 3214450 - protein, 6 aa, Plasmodium falciparum
DNQNYV

SEQ ID NO: 3214451 - protein, 6 aa, Plasmodium falciparum
DNQPLE

SEQ ID NO: 3214452 - protein, 4 aa, Plasmodium falciparum
DNQS

SEQ ID NO: 3214453 - protein, 5 aa, Plasmodium falciparum
DNQTD

SEQ ID NO: 3214454 - protein, 6 aa, Plasmodium falciparum
DNQTDE

SEQ ID NO: 3214455 - protein, 27 aa, Plasmodium falciparum
DNRHNNNHSNKYNNEENINVSKKNKEE

SEQ ID NO: 3214456 - protein, 8 aa, Plasmodium falciparum
DNRKKSLE

SEQ ID NO: 3214457 - protein, 20 aa, Plasmodium falciparum
DNRKNKVKKEREKERKQRET

SEQ ID NO: 3214458 - protein, 17 aa, Plasmodium falciparum
DNRNKNSSDNIDSNNYK

SEQ ID NO: 3214459 - protein, 8 aa, Plasmodium falciparum
DNRNKWGK

SEQ ID NO: 3214460 - protein, 14 aa, Plasmodium falciparum
DNRNTMNDTTPNVN

SEQ ID NO: 3214461 - protein, 14 aa, Plasmodium falciparum
DNRQMEDKTNDDNY

SEQ ID NO: 3214462 - protein, 7 aa, Plasmodium falciparum
DNRQTSH

SEQ ID NO: 3214463 - protein, 23 aa, Plasmodium falciparum
DNRRESPNVSHKTANSIKPKTHL

SEQ ID NO: 3214464 - protein, 7 aa, Plasmodium falciparum
DNRRKYK

SEQ ID NO: 3214465 - protein, 15 aa, Plasmodium falciparum
DNRSKLPKSKCKNNT

SEQ ID NO: 3214466 - protein, 5 aa, Plasmodium falciparum
DNRTE

SEQ ID NO: 3214467 - protein, 6 aa, Plasmodium falciparum
DNRTNQ

SEQ ID NO: 3214468 - protein, 8 aa, Plasmodium falciparum
DNRTSQRF

SEQ ID NO: 3214469 - protein, 8 aa, Plasmodium falciparum
DNRYTQES

SEQ ID NO: 3214470 - protein, 6 aa, Plasmodium falciparum
DNSANV

SEQ ID NO: 3214471 - protein, 7 aa, Plasmodium falciparum
DNSDHKF

SEQ ID NO: 3214472 - protein, 9 aa, Plasmodium falciparum
DNSDHKFDD

SEQ ID NO: 3214473 - protein, 8 aa, Plasmodium falciparum
DNSDHKFE

SEQ ID NO: 3214474 - protein, 5 aa, Plasmodium falciparum
DNSEN

SEQ ID NO: 3214475 - protein, 5 aa, Plasmodium falciparum
DNSET

SEQ ID NO: 3214476 - protein, 8 aa, Plasmodium falciparum
DNSEYDDE

SEQ ID NO: 3214477 - protein, 6 aa, Plasmodium falciparum
DNSFQH

SEQ ID NO: 3214478 - protein, 18 aa, Plasmodium falciparum
DNSFSNNKKKKNHDEISQ

SEQ ID NO: 3214479 - protein, 17 aa, Plasmodium falciparum
DNSGNGSQNDLKDCKTS

SEQ ID NO: 3214480 - protein, 8 aa, Plasmodium falciparum
DNSGNKFN

SEQ ID NO: 3214481 - protein, 9 aa, Plasmodium falciparum
DNSGNRFDG

SEQ ID NO: 3214482 - protein, 35 aa, Plasmodium falciparum
DNSHNDNNNNNNNNNNNNNNNNNNNNNNNNNNSFE

SEQ ID NO: 3214483 - protein, 7 aa, Plasmodium falciparum
DNSHYSN

SEQ ID NO: 3214484 - protein, 9 aa, Plasmodium falciparum
DNSINEKTK

SEQ ID NO: 3214485 - protein, 7 aa, Plasmodium falciparum
DNSKKNA

SEQ ID NO: 3214486 - protein, 11 aa, Plasmodium falciparum
DNSKKQRINSK

SEQ ID NO: 3214487 - protein, 11 aa, Plasmodium falciparum
DNSKNKKKIQK

SEQ ID NO: 3214488 - protein, 5 aa, Plasmodium falciparum
DNSLG

SEQ ID NO: 3214489 - protein, 9 aa, Plasmodium falciparum
DNSNKNRNQ

SEQ ID NO: 3214490 - protein, 9 aa, Plasmodium falciparum
DNSNKTASK

SEQ ID NO: 3214491 - protein, 16 aa, Plasmodium falciparum
DNSNNETSCRNNNEDK

SEQ ID NO: 3214492 - protein, 12 aa, Plasmodium falciparum
DNSNNNFNIELT

SEQ ID NO: 3214493 - protein, 29 aa, Plasmodium falciparum
DNSNNTNCKDEEQSNNTNCQDAEQSNITN

SEQ ID NO: 3214494 - protein, 7 aa, Plasmodium falciparum
DNSNTII

SEQ ID NO: 3214495 - protein, 7 aa, Plasmodium falciparum
DNSQNKK

SEQ ID NO: 3214496 - protein, 9 aa, Plasmodium falciparum
DNSQNSTQN

SEQ ID NO: 3214497 - protein, 8 aa, Plasmodium falciparum
DNSRDDAY

SEQ ID NO: 3214498 - protein, 5 aa, Plasmodium falciparum
DNSSL

SEQ ID NO: 3214499 - protein, 7 aa, Plasmodium falciparum
DNSSNNF

SEQ ID NO: 3214500 - protein, 8 aa, Plasmodium falciparum
DNSSSDKV

SEQ ID NO: 3214501 - protein, 11 aa, Plasmodium falciparum
DNSSSNSSISK

SEQ ID NO: 3214502 - protein, 10 aa, Plasmodium falciparum
DNSSSSNTSV

SEQ ID NO: 3214503 - protein, 14 aa, Plasmodium falciparum
DNSSSSSGSSNHSR

SEQ ID NO: 3214504 - protein, 13 aa, Plasmodium falciparum
DNSTNISSNKIEE

SEQ ID NO: 3214505 - protein, 8 aa, Plasmodium falciparum
DNSTTGFN

SEQ ID NO: 3214506 - protein, 8 aa, Plasmodium falciparum
DNSYKDYP

SEQ ID NO: 3214507 - protein, 7 aa, Plasmodium falciparum
DNSYKGE

SEQ ID NO: 3214508 - protein, 21 aa, Plasmodium falciparum
DNTATTTTTTTTTINNNNNNN

SEQ ID NO: 3214509 - protein, 4 aa, Plasmodium falciparum
DNTC

SEQ ID NO: 3214510 - protein, 5 aa, Plasmodium falciparum
DNTCN

SEQ ID NO: 3214511 - protein, 4 aa, Plasmodium falciparum
DNTD

SEQ ID NO: 3214512 - protein, 8 aa, Plasmodium falciparum
DNTDEKDV

SEQ ID NO: 3214513 - protein, 10 aa, Plasmodium falciparum
DNTDSEDKKI

SEQ ID NO: 3214514 - protein, 7 aa, Plasmodium falciparum
DNTEMND

SEQ ID NO: 3214515 - protein, 14 aa, Plasmodium falciparum
DNTGDEEKTNLNNM

SEQ ID NO: 3214516 - protein, 14 aa, Plasmodium falciparum
DNTIRKKQKEENKL

SEQ ID NO: 3214517 - protein, 6 aa, Plasmodium falciparum
DNTITS

SEQ ID NO: 3214518 - protein, 7 aa, Plasmodium falciparum
DNTKEDM

SEQ ID NO: 3214519 - protein, 16 aa, Plasmodium falciparum
DNTKGIHKNKSGDYNI

SEQ ID NO: 3214520 - protein, 4 aa, Plasmodium falciparum
DNTN

SEQ ID NO: 3214521 - protein, 24 aa, Plasmodium falciparum
DNTNANDTINDEKDNEIYEEKQNN

SEQ ID NO: 3214522 - protein, 14 aa, Plasmodium falciparum
DNTNGGPPTQDGEV

SEQ ID NO: 3214523 - protein, 13 aa, Plasmodium falciparum
DNTNGGPPTQDND

SEQ ID NO: 3214524 - protein, 34 aa, Plasmodium falciparum
DNTNHNNTDLDDDKYNKYHNNNNNNNNNSSFKSI

SEQ ID NO: 3214525 - protein, 30 aa, Plasmodium falciparum
DNTNISRRKDKSKENSSFKNVKSKSEISPC

SEQ ID NO: 3214526 - protein, 12 aa, Plasmodium falciparum
DNTNNNKGRTLH

SEQ ID NO: 3214527 - protein, 10 aa, Plasmodium falciparum
DNTNNNYEEN

SEQ ID NO: 3214528 - protein, 26 aa, Plasmodium falciparum
DNTNNSNSNNNNKNDNNNDNNNDNNN

SEQ ID NO: 3214529 - protein, 7 aa, Plasmodium falciparum
DNTNNVD

SEQ ID NO: 3214530 - protein, 6 aa, Plasmodium falciparum
DNTNTN

SEQ ID NO: 3214531 - protein, 4 aa, Plasmodium falciparum
DNTP

SEQ ID NO: 3214532 - protein, 7 aa, Plasmodium falciparum
DNTPNNI

SEQ ID NO: 3214533 - protein, 9 aa, Plasmodium falciparum
DNTQQYNEN

SEQ ID NO: 3214534 - protein, 15 aa, Plasmodium falciparum
DNTSGEEEKKNSHKR

SEQ ID NO: 3214535 - protein, 5 aa, Plasmodium falciparum
DNTSI

SEQ ID NO: 3214536 - protein, 8 aa, Plasmodium falciparum
DNTSNEYS

SEQ ID NO: 3214537 - protein, 6 aa, Plasmodium falciparum
DNTSSS

SEQ ID NO: 3214538 - protein, 10 aa, Plasmodium falciparum
DNTSTQSNVQ

SEQ ID NO: 3214539 - protein, 5 aa, Plasmodium falciparum
DNTTV

SEQ ID NO: 3214540 - protein, 4 aa, Plasmodium falciparum
DNTY

SEQ ID NO: 3214541 - protein, 6 aa, Plasmodium falciparum
DNTYAK

SEQ ID NO: 3214542 - protein, 6 aa, Plasmodium falciparum
DNTYDK

SEQ ID NO: 3214543 - protein, 14 aa, Plasmodium falciparum
DNTYNGKEEHINEY

SEQ ID NO: 3214544 - protein, 18 aa, Plasmodium falciparum
DNVASQAAQTTANETTSG

SEQ ID NO: 3214545 - protein, 37 aa, Plasmodium falciparum
DNVDDDTYNNNMDNGFKNDRNVNNNNIDGDDNGDGIN

SEQ ID NO: 3214546 - protein, 7 aa, Plasmodium falciparum
DNVDKNT

SEQ ID NO: 3214547 - protein, 5 aa, Plasmodium falciparum
DNVDR

SEQ ID NO: 3214548 - protein, 7 aa, Plasmodium falciparum
DNVEKKS

SEQ ID NO: 3214549 - protein, 14 aa, Plasmodium falciparum
DNVENNKKIDEQQN

SEQ ID NO: 3214550 - protein, 10 aa, Plasmodium falciparum
DNVESNDNKT

SEQ ID NO: 3214551 - protein, 10 aa, Plasmodium falciparum
DNVGKNGEDI

SEQ ID NO: 3214552 - protein, 4 aa, Plasmodium falciparum
DNVI

SEQ ID NO: 3214553 - protein, 6 aa, Plasmodium falciparum
DNVKNL

SEQ ID NO: 3214554 - protein, 14 aa, Plasmodium falciparum
DNVKTEREKKKKVI

SEQ ID NO: 3214555 - protein, 4 aa, Plasmodium falciparum
DNVN

SEQ ID NO: 3214556 - protein, 45 aa, Plasmodium falciparum
DNVNDSENTEESLNEENGQEDYSSNIESDASSSSSYYSSSDSRND

SEQ ID NO: 3214557 - protein, 37 aa, Plasmodium falciparum
DNVNEKNKVNDEIKKENNNNNKYNKYNKYNKYNNNKY

SEQ ID NO: 3214558 - protein, 8 aa, Plasmodium falciparum
DNVNKKSK

SEQ ID NO: 3214559 - protein, 7 aa, Plasmodium falciparum
DNVQGGN

SEQ ID NO: 3214560 - protein, 5 aa, Plasmodium falciparum
DNVRD

SEQ ID NO: 3214561 - protein, 4 aa, Plasmodium falciparum
DNVS

SEQ ID NO: 3214562 - protein, 8 aa, Plasmodium falciparum
DNVSEKKI

SEQ ID NO: 3214563 - protein, 17 aa, Plasmodium falciparum
DNVSGSKKKNSKGRNNN

SEQ ID NO: 3214564 - protein, 8 aa, Plasmodium falciparum
DNVSQGNN

SEQ ID NO: 3214565 - protein, 5 aa, Plasmodium falciparum
DNWPE

SEQ ID NO: 3214566 - protein, 8 aa, Plasmodium falciparum
DNYDELDA

SEQ ID NO: 3214567 - protein, 8 aa, Plasmodium falciparum
DNYDESHN

SEQ ID NO: 3214568 - protein, 8 aa, Plasmodium falciparum
DNYEQEKK

SEQ ID NO: 3214569 - protein, 7 aa, Plasmodium falciparum
DNYKGDN

SEQ ID NO: 3214570 - protein, 5 aa, Plasmodium falciparum
DNYNN

SEQ ID NO: 3214571 - protein, 12 aa, Plasmodium falciparum
DNYNNGANIYNN

SEQ ID NO: 3214572 - protein, 11 aa, Plasmodium falciparum
DNYNNGNDTSI

SEQ ID NO: 3214573 - protein, 11 aa, Plasmodium falciparum
DNYNNNTYSSA

SEQ ID NO: 3214574 - protein, 11 aa, Plasmodium falciparum
DNYNNRSENNN

SEQ ID NO: 3214575 - protein, 31 aa, Plasmodium falciparum
DNYQKDKSHSKPTNIENDKINNDHNDDKDEH

SEQ ID NO: 3214576 - protein, 4 aa, Plasmodium falciparum
DNYY

SEQ ID NO: 3214577 - protein, 15 aa, Plasmodium falciparum
DNYYSSYDDEDHNYT

SEQ ID NO: 3214578 - protein, 9 aa, Plasmodium falciparum
DPAHADKDP

SEQ ID NO: 3214579 - protein, 8 aa, Plasmodium falciparum
DPATPQAE

SEQ ID NO: 3214580 - protein, 5 aa, Plasmodium falciparum
DPCDE

SEQ ID NO: 3214581 - protein, 4 aa, Plasmodium falciparum
DPCK

SEQ ID NO: 3214582 - protein, 13 aa, Plasmodium falciparum
DPCYGREQNRFDE

SEQ ID NO: 3214583 - protein, 4 aa, Plasmodium falciparum
DPDM

SEQ ID NO: 3214584 - protein, 5 aa, Plasmodium falciparum
DPDMK

SEQ ID NO: 3214585 - protein, 25 aa, Plasmodium falciparum
DPDMSDQENQNDDDENNNNNNKGRL

SEQ ID NO: 3214586 - protein, 8 aa, Plasmodium falciparum
DPDNEKNQ

SEQ ID NO: 3214587 - protein, 11 aa, Plasmodium falciparum
DPDSYRKGQNR

SEQ ID NO: 3214588 - protein, 4 aa, Plasmodium falciparum
DPEG

SEQ ID NO: 3214589 - protein, 4 aa, Plasmodium falciparum
DPEI

SEQ ID NO: 3214590 - protein, 6 aa, Plasmodium falciparum
DPEKGY

SEQ ID NO: 3214591 - protein, 6 aa, Plasmodium falciparum
DPEKNN

SEQ ID NO: 3214592 - protein, 19 aa, Plasmodium falciparum
DPEKNNLKYEKRKKDDTYN

SEQ ID NO: 3214593 - protein, 35 aa, Plasmodium falciparum
DPENYRETDKKNNNLRTSSVSNSNRNENYLGASDR

SEQ ID NO: 3214594 - protein, 9 aa, Plasmodium falciparum
DPEYGNKNE

SEQ ID NO: 3214595 - protein, 6 aa, Plasmodium falciparum
DPGADK

SEQ ID NO: 3214596 - protein, 6 aa, Plasmodium falciparum
DPGKIS

SEQ ID NO: 3214597 - protein, 4 aa, Plasmodium falciparum
DPGL

SEQ ID NO: 3214598 - protein, 4 aa, Plasmodium falciparum
DPHN

SEQ ID NO: 3214599 - protein, 15 aa, Plasmodium falciparum
DPHNNNDNNQTKGLN

SEQ ID NO: 3214600 - protein, 8 aa, Plasmodium falciparum
DPHSDKCS

SEQ ID NO: 3214601 - protein, 12 aa, Plasmodium falciparum
DPIDDKQNQPFD

SEQ ID NO: 3214602 - protein, 4 aa, Plasmodium falciparum
DPIR

SEQ ID NO: 3214603 - protein, 8 aa, Plasmodium falciparum
DPISEPKY

SEQ ID NO: 3214604 - protein, 33 aa, Plasmodium falciparum
DPKDNTINDEANKKCTTNYPSTEQINNTTTATI

SEQ ID NO: 3214605 - protein, 23 aa, Plasmodium falciparum
DPKKQTNDINRDDYTNNNNSINN

SEQ ID NO: 3214606 - protein, 16 aa, Plasmodium falciparum
DPKKYSNANDIKKKGN

SEQ ID NO: 3214607 - protein, 7 aa, Plasmodium falciparum
DPKNIDN

SEQ ID NO: 3214608 - protein, 6 aa, Plasmodium falciparum
DPKPIN

SEQ ID NO: 3214609 - protein, 8 aa, Plasmodium falciparum
DPKPTNEF

SEQ ID NO: 3214610 - protein, 8 aa, Plasmodium falciparum
DPKQHNVN

SEQ ID NO: 3214611 - protein, 7 aa, Plasmodium falciparum
DPKQTNK

SEQ ID NO: 3214612 - protein, 6 aa, Plasmodium falciparum
DPKRKG

SEQ ID NO: 3214613 - protein, 7 aa, Plasmodium falciparum
DPKTTNE

SEQ ID NO: 3214614 - protein, 6 aa, Plasmodium falciparum
DPKYSE

SEQ ID NO: 3214615 - protein, 6 aa, Plasmodium falciparum
DPKYYK

SEQ ID NO: 3214616 - protein, 13 aa, Plasmodium falciparum
DPLKKEEAKPTDL

SEQ ID NO: 3214617 - protein, 5 aa, Plasmodium falciparum
DPLNP

SEQ ID NO: 3214618 - protein, 7 aa, Plasmodium falciparum
DPLNPQV

SEQ ID NO: 3214619 - protein, 6 aa, Plasmodium falciparum
DPLQDK

SEQ ID NO: 3214620 - protein, 15 aa, Plasmodium falciparum
DPLSVPKTVLYPSHF

SEQ ID NO: 3214621 - protein, 6 aa, Plasmodium falciparum
DPLTTK

SEQ ID NO: 3214622 - protein, 7 aa, Plasmodium falciparum
DPNDDRN

SEQ ID NO: 3214623 - protein, 8 aa, Plasmodium falciparum
DPNDPNNF

SEQ ID NO: 3214624 - protein, 6 aa, Plasmodium falciparum
DPNERY

SEQ ID NO: 3214625 - protein, 17 aa, Plasmodium falciparum
DPNESNSVSWDEIRKRN

SEQ ID NO: 3214626 - protein, 4 aa, Plasmodium falciparum
DPNF

SEQ ID NO: 3214627 - protein, 9 aa, Plasmodium falciparum
DPNIRGANY

SEQ ID NO: 3214628 - protein, 24 aa, Plasmodium falciparum
DPNIRNNEKMNESENMNSNDEQIN

SEQ ID NO: 3214629 - protein, 11 aa, Plasmodium falciparum
DPNNGLRNNPH

SEQ ID NO: 3214630 - protein, 10 aa, Plasmodium falciparum
DPNNKKDDNY

SEQ ID NO: 3214631 - protein, 11 aa, Plasmodium falciparum
DPNNSKNYSGK

SEQ ID NO: 3214632 - protein, 7 aa, Plasmodium falciparum
DPNPVNP

SEQ ID NO: 3214633 - protein, 8 aa, Plasmodium falciparum
DPNSIKTE

SEQ ID NO: 3214634 - protein, 5 aa, Plasmodium falciparum
DPNVD

SEQ ID NO: 3214635 - protein, 10 aa, Plasmodium falciparum
DPNVRGNKKN

SEQ ID NO: 3214636 - protein, 20 aa, Plasmodium falciparum
DPPDLSNDNITKYSTKLNSG

SEQ ID NO: 3214637 - protein, 8 aa, Plasmodium falciparum
DPPRPGVK

SEQ ID NO: 3214638 - protein, 6 aa, Plasmodium falciparum
DPPSIY

SEQ ID NO: 3214639 - protein, 32 aa, Plasmodium falciparum
DPPTSDNQNNNNNDHNNDRNNDYHNDRNNNDF

SEQ ID NO: 3214640 - protein, 5 aa, Plasmodium falciparum
DPQST

SEQ ID NO: 3214641 - protein, 5 aa, Plasmodium falciparum
DPRCD

SEQ ID NO: 3214642 - protein, 4 aa, Plasmodium falciparum
DPRN

SEQ ID NO: 3214643 - protein, 8 aa, Plasmodium falciparum
DPRSRKNN

SEQ ID NO: 3214644 - protein, 26 aa, Plasmodium falciparum
DPSEYKNSPFKESKISTSSHSTRSYE

SEQ ID NO: 3214645 - protein, 4 aa, Plasmodium falciparum
DPSI

SEQ ID NO: 3214646 - protein, 24 aa, Plasmodium falciparum
DPSIKGKTTTNSIKKKKIKKKKIK

SEQ ID NO: 3214647 - protein, 7 aa, Plasmodium falciparum
DPSKKNV

SEQ ID NO: 3214648 - protein, 18 aa, Plasmodium falciparum
DPSLNNNYNDDHDPPNNF

SEQ ID NO: 3214649 - protein, 7 aa, Plasmodium falciparum
DPSNEKE

SEQ ID NO: 3214650 - protein, 6 aa, Plasmodium falciparum
DPSPIS

SEQ ID NO: 3214651 - protein, 14 aa, Plasmodium falciparum
DPSQSENKQSDYTS

SEQ ID NO: 3214652 - protein, 23 aa, Plasmodium falciparum
DPSSDNDDMMDKDKKKKEKSDFI

SEQ ID NO: 3214653 - protein, 7 aa, Plasmodium falciparum
DPSSQED

SEQ ID NO: 3214654 - protein, 7 aa, Plasmodium falciparum
DPSVTNN

SEQ ID NO: 3214655 - protein, 7 aa, Plasmodium falciparum
DPSYDNK

SEQ ID NO: 3214656 - protein, 14 aa, Plasmodium falciparum
DPSYDPVNSTTINH

SEQ ID NO: 3214657 - protein, 6 aa, Plasmodium falciparum
DPSYTY

SEQ ID NO: 3214658 - protein, 7 aa, Plasmodium falciparum
DPTDNDS

SEQ ID NO: 3214659 - protein, 5 aa, Plasmodium falciparum
DPTED

SEQ ID NO: 3214660 - protein, 5 aa, Plasmodium falciparum
DPTEG

SEQ ID NO: 3214661 - protein, 7 aa, Plasmodium falciparum
DPTFDKN

SEQ ID NO: 3214662 - protein, 5 aa, Plasmodium falciparum
DPTLD

SEQ ID NO: 3214663 - protein, 4 aa, Plasmodium falciparum
DPTN

SEQ ID NO: 3214664 - protein, 5 aa, Plasmodium falciparum
DPYEM

SEQ ID NO: 3214665 - protein, 5 aa, Plasmodium falciparum
DPYNK

SEQ ID NO: 3214666 - protein, 4 aa, Plasmodium falciparum
DPYS

SEQ ID NO: 3214667 - protein, 6 aa, Plasmodium falciparum
DPYYSD

SEQ ID NO: 3214668 - protein, 5 aa, Plasmodium falciparum
DQADI

SEQ ID NO: 3214669 - protein, 8 aa, Plasmodium falciparum
DQCKEQCD

SEQ ID NO: 3214670 - protein, 6 aa, Plasmodium falciparum
DQCTQK

SEQ ID NO: 3214671 - protein, 63 aa, Plasmodium falciparum
DQDEEEDEDEEDDDEESGSEEGEGEDVDDSDSSEDENDEEDEDDSHHVDGGHQEEEPPDETEV

SEQ ID NO: 3214672 - protein, 9 aa, Plasmodium falciparum
DQDETFRPA

SEQ ID NO: 3214673 - protein, 4 aa, Plasmodium falciparum
DQDH

SEQ ID NO: 3214674 - protein, 17 aa, Plasmodium falciparum
DQDHPQKKLQKSGEIPN

SEQ ID NO: 3214675 - protein, 5 aa, Plasmodium falciparum
DQDIT

SEQ ID NO: 3214676 - protein, 7 aa, Plasmodium falciparum
DQDKTFK

SEQ ID NO: 3214677 - protein, 9 aa, Plasmodium falciparum
DQDNENDKN

SEQ ID NO: 3214678 - protein, 7 aa, Plasmodium falciparum
DQDNRVR

SEQ ID NO: 3214679 - protein, 9 aa, Plasmodium falciparum
DQDPSPNLI

SEQ ID NO: 3214680 - protein, 8 aa, Plasmodium falciparum
DQDQNEIN

SEQ ID NO: 3214681 - protein, 21 aa, Plasmodium falciparum
DQDSQLKKQRISEANSTSQPH

SEQ ID NO: 3214682 - protein, 18 aa, Plasmodium falciparum
DQDTNYEESVKNENSKDY

SEQ ID NO: 3214683 - protein, 7 aa, Plasmodium falciparum
DQDYKGI

SEQ ID NO: 3214684 - protein, 13 aa, Plasmodium falciparum
DQDYSNEDYSNDY

SEQ ID NO: 3214685 - protein, 8 aa, Plasmodium falciparum
DQEDINNS

SEQ ID NO: 3214686 - protein, 13 aa, Plasmodium falciparum
DQEDKGDNENSHD

SEQ ID NO: 3214687 - protein, 4 aa, Plasmodium falciparum
DQEE

SEQ ID NO: 3214688 - protein, 21 aa, Plasmodium falciparum
DQEEEYNKSNHNITKNNIDTN

SEQ ID NO: 3214689 - protein, 7 aa, Plasmodium falciparum
DQEIRQK

SEQ ID NO: 3214690 - protein, 10 aa, Plasmodium falciparum
DQENEHNEQN

SEQ ID NO: 3214691 - protein, 5 aa, Plasmodium falciparum
DQENN

SEQ ID NO: 3214692 - protein, 8 aa, Plasmodium falciparum
DQENNKKV

SEQ ID NO: 3214693 - protein, 20 aa, Plasmodium falciparum
DQFKRNNIPTKKSKKKNNDK

SEQ ID NO: 3214694 - protein, 7 aa, Plasmodium falciparum
DQGEYNK

SEQ ID NO: 3214695 - protein, 9 aa, Plasmodium falciparum
DQGHDGGNG

SEQ ID NO: 3214696 - protein, 7 aa, Plasmodium falciparum
DQGIDER

SEQ ID NO: 3214697 - protein, 4 aa, Plasmodium falciparum
DQGN

SEQ ID NO: 3214698 - protein, 16 aa, Plasmodium falciparum
DQGNDKNYDNEEKEIN

SEQ ID NO: 3214699 - protein, 9 aa, Plasmodium falciparum
DQHNDDDNN

SEQ ID NO: 3214700 - protein, 7 aa, Plasmodium falciparum
DQHQNDN

SEQ ID NO: 3214701 - protein, 12 aa, Plasmodium falciparum
DQHTKDSRRRRR

SEQ ID NO: 3214702 - protein, 10 aa, Plasmodium falciparum
DQIDRKETDN

SEQ ID NO: 3214703 - protein, 4 aa, Plasmodium falciparum
DQIN

SEQ ID NO: 3214704 - protein, 6 aa, Plasmodium falciparum
DQINTR

SEQ ID NO: 3214705 - protein, 20 aa, Plasmodium falciparum
DQIPKDPDNPQNKIRKNGEI

SEQ ID NO: 3214706 - protein, 10 aa, Plasmodium falciparum
DQIRNDNKTG

SEQ ID NO: 3214707 - protein, 9 aa, Plasmodium falciparum
DQKDKAAKY

SEQ ID NO: 3214708 - protein, 5 aa, Plasmodium falciparum
DQKEN

SEQ ID NO: 3214709 - protein, 6 aa, Plasmodium falciparum
DQKENV

SEQ ID NO: 3214710 - protein, 9 aa, Plasmodium falciparum
DQKEYEGNY

SEQ ID NO: 3214711 - protein, 27 aa, Plasmodium falciparum
DQKFSDNKNYASDDEEKKKKKRKNQTR

SEQ ID NO: 3214712 - protein, 4 aa, Plasmodium falciparum
DQKK

SEQ ID NO: 3214713 - protein, 7 aa, Plasmodium falciparum
DQKKEEN

SEQ ID NO: 3214714 - protein, 5 aa, Plasmodium falciparum
DQKKK

SEQ ID NO: 3214715 - protein, 8 aa, Plasmodium falciparum
DQKKKNYK

SEQ ID NO: 3214716 - protein, 4 aa, Plasmodium falciparum
DQKL

SEQ ID NO: 3214717 - protein, 16 aa, Plasmodium falciparum
DQKNKYEKKKKNVDEY

SEQ ID NO: 3214718 - protein, 7 aa, Plasmodium falciparum
DQKPTAV

SEQ ID NO: 3214719 - protein, 6 aa, Plasmodium falciparum
DQKSHE

SEQ ID NO: 3214720 - protein, 6 aa, Plasmodium falciparum
DQKVTS

SEQ ID NO: 3214721 - protein, 9 aa, Plasmodium falciparum
DQLKDDPSI

SEQ ID NO: 3214722 - protein, 11 aa, Plasmodium falciparum
DQNDSKMRNTS

SEQ ID NO: 3214723 - protein, 5 aa, Plasmodium falciparum
DQNED

SEQ ID NO: 3214724 - protein, 8 aa, Plasmodium falciparum
DQNEDSVP

SEQ ID NO: 3214725 - protein, 9 aa, Plasmodium falciparum
DQNENDDLE

SEQ ID NO: 3214726 - protein, 5 aa, Plasmodium falciparum
DQNEY

SEQ ID NO: 3214727 - protein, 4 aa, Plasmodium falciparum
DQNG

SEQ ID NO: 3214728 - protein, 5 aa, Plasmodium falciparum
DQNGV

SEQ ID NO: 3214729 - protein, 4 aa, Plasmodium falciparum
DQNI

SEQ ID NO: 3214730 - protein, 5 aa, Plasmodium falciparum
DQNKD

SEQ ID NO: 3214731 - protein, 9 aa, Plasmodium falciparum
DQNKEHSFQ

SEQ ID NO: 3214732 - protein, 37 aa, Plasmodium falciparum
DQNKIEKSKKKKKNKNKTNKNNNNNNDNNNKSKHKEI

SEQ ID NO: 3214733 - protein, 10 aa, Plasmodium falciparum
DQNKKENKHL

SEQ ID NO: 3214734 - protein, 5 aa, Plasmodium falciparum
DQNKN

SEQ ID NO: 3214735 - protein, 10 aa, Plasmodium falciparum
DQNNDAKRLQ

SEQ ID NO: 3214736 - protein, 7 aa, Plasmodium falciparum
DQNNDKE

SEQ ID NO: 3214737 - protein, 6 aa, Plasmodium falciparum
DQNNEH

SEQ ID NO: 3214738 - protein, 5 aa, Plasmodium falciparum
DQNNI

SEQ ID NO: 3214739 - protein, 7 aa, Plasmodium falciparum
DQNNINS

SEQ ID NO: 3214740 - protein, 5 aa, Plasmodium falciparum
DQNNM

SEQ ID NO: 3214741 - protein, 9 aa, Plasmodium falciparum
DQNNNNFND

SEQ ID NO: 3214742 - protein, 7 aa, Plasmodium falciparum
DQNNPIN

SEQ ID NO: 3214743 - protein, 22 aa, Plasmodium falciparum
DQNRRTLDNNNNNNNKKVNNTI

SEQ ID NO: 3214744 - protein, 4 aa, Plasmodium falciparum
DQNT

SEQ ID NO: 3214745 - protein, 8 aa, Plasmodium falciparum
DQNTDNTI

SEQ ID NO: 3214746 - protein, 14 aa, Plasmodium falciparum
DQNTHNRKGNNKNI

SEQ ID NO: 3214747 - protein, 4 aa, Plasmodium falciparum
DQNV

SEQ ID NO: 3214748 - protein, 5 aa, Plasmodium falciparum
DQPEH

SEQ ID NO: 3214749 - protein, 15 aa, Plasmodium falciparum
DQPKQKQKKPSKYDD

SEQ ID NO: 3214750 - protein, 7 aa, Plasmodium falciparum
DQPLKKN

SEQ ID NO: 3214751 - protein, 26 aa, Plasmodium falciparum
DQPLSAKSSKIVTPPGNNMNNNTNNV

SEQ ID NO: 3214752 - protein, 9 aa, Plasmodium falciparum
DQPPELNRS

SEQ ID NO: 3214753 - protein, 5 aa, Plasmodium falciparum
DQPYK

SEQ ID NO: 3214754 - protein, 22 aa, Plasmodium falciparum
DQQDNHDFNNNEKNNKNEEYDV

SEQ ID NO: 3214755 - protein, 13 aa, Plasmodium falciparum
DQQGSVSKSGSLK

SEQ ID NO: 3214756 - protein, 8 aa, Plasmodium falciparum
DQQTSQRL

SEQ ID NO: 3214757 - protein, 6 aa, Plasmodium falciparum
DQREKE

SEQ ID NO: 3214758 - protein, 12 aa, Plasmodium falciparum
DQRGGEKKKAHV

SEQ ID NO: 3214759 - protein, 8 aa, Plasmodium falciparum
DQRGKQLK

SEQ ID NO: 3214760 - protein, 6 aa, Plasmodium falciparum
DQRKKE

SEQ ID NO: 3214761 - protein, 6 aa, Plasmodium falciparum
DQRNDN

SEQ ID NO: 3214762 - protein, 13 aa, Plasmodium falciparum
DQRNSHELENEYD

SEQ ID NO: 3214763 - protein, 7 aa, Plasmodium falciparum
DQRRKTC

SEQ ID NO: 3214764 - protein, 20 aa, Plasmodium falciparum
DQRTQNGDTSYNDSTDTMDG

SEQ ID NO: 3214765 - protein, 7 aa, Plasmodium falciparum
DQSGKKK

SEQ ID NO: 3214766 - protein, 12 aa, Plasmodium falciparum
DQSIEEKLFTFF

SEQ ID NO: 3214767 - protein, 10 aa, Plasmodium falciparum
DQSINQSNSK

SEQ ID NO: 3214768 - protein, 4 aa, Plasmodium falciparum
DQSK

SEQ ID NO: 3214769 - protein, 4 aa, Plasmodium falciparum
DQSL

SEQ ID NO: 3214770 - protein, 7 aa, Plasmodium falciparum
DQSNIQN

SEQ ID NO: 3214771 - protein, 44 aa, Plasmodium falciparum
DQSNYSNDHNNDYYEDDDNDYYEDDDDDYDDDYDNDYDNDNDND

SEQ ID NO: 3214772 - protein, 20 aa, Plasmodium falciparum
DQSQNDKSFSTSNPCNNNNM

SEQ ID NO: 3214773 - protein, 5 aa, Plasmodium falciparum
DQTDS

SEQ ID NO: 3214774 - protein, 14 aa, Plasmodium falciparum
DQTKKNIEKLFADT

SEQ ID NO: 3214775 - protein, 17 aa, Plasmodium falciparum
DQTNESSKNSNNNKQIT

SEQ ID NO: 3214776 - protein, 6 aa, Plasmodium falciparum
DQTRDS

SEQ ID NO: 3214777 - protein, 6 aa, Plasmodium falciparum
DQTTLQ

SEQ ID NO: 3214778 - protein, 5 aa, Plasmodium falciparum
DQTYK

SEQ ID NO: 3214779 - protein, 15 aa, Plasmodium falciparum
DQVEKEAAGRGGSEL

SEQ ID NO: 3214780 - protein, 13 aa, Plasmodium falciparum
DQVEKEANQYKEA

SEQ ID NO: 3214781 - protein, 7 aa, Plasmodium falciparum
DQVETKK

SEQ ID NO: 3214782 - protein, 17 aa, Plasmodium falciparum
DQVKKEAKERSKGELTG

SEQ ID NO: 3214783 - protein, 19 aa, Plasmodium falciparum
DQVKNGADGTGASGDAKNY

SEQ ID NO: 3214784 - protein, 13 aa, Plasmodium falciparum
DQVKNSKKKKRNF

SEQ ID NO: 3214785 - protein, 32 aa, Plasmodium falciparum
DQYKKQSEKFTTDKEKPEYKDDPDVASSENAH

SEQ ID NO: 3214786 - protein, 12 aa, Plasmodium falciparum
DQYKSENSGDTF

SEQ ID NO: 3214787 - protein, 10 aa, Plasmodium falciparum
DQYKSNDSDV

SEQ ID NO: 3214788 - protein, 14 aa, Plasmodium falciparum
DRATDSMNLDPEKV

SEQ ID NO: 3214789 - protein, 6 aa, Plasmodium falciparum
DRDDIQ

SEQ ID NO: 3214790 - protein, 6 aa, Plasmodium falciparum
DRDEQI

SEQ ID NO: 3214791 - protein, 22 aa, Plasmodium falciparum
DRDKYNDKYKDKDINSNIQEET

SEQ ID NO: 3214792 - protein, 9 aa, Plasmodium falciparum
DRDNEEDKK

SEQ ID NO: 3214793 - protein, 6 aa, Plasmodium falciparum
DRDNYQ

SEQ ID NO: 3214794 - protein, 15 aa, Plasmodium falciparum
DRDPSGVGLPNKNAR

SEQ ID NO: 3214795 - protein, 5 aa, Plasmodium falciparum
DRDVS

SEQ ID NO: 3214796 - protein, 13 aa, Plasmodium falciparum
DREIDEEDVEKNL

SEQ ID NO: 3214797 - protein, 4 aa, Plasmodium falciparum
DREN

SEQ ID NO: 3214798 - protein, 8 aa, Plasmodium falciparum
DRENQINK

SEQ ID NO: 3214799 - protein, 6 aa, Plasmodium falciparum
DRENSY

SEQ ID NO: 3214800 - protein, 7 aa, Plasmodium falciparum
DRETQER

SEQ ID NO: 3214801 - protein, 31 aa, Plasmodium falciparum
DRFPDNDGAECDNSKIKGNKGKEDNSEGACA

SEQ ID NO: 3214802 - protein, 12 aa, Plasmodium falciparum
DRGQPNTNEKYP

SEQ ID NO: 3214803 - protein, 6 aa, Plasmodium falciparum
DRGSNS

SEQ ID NO: 3214804 - protein, 4 aa, Plasmodium falciparum
DRGT

SEQ ID NO: 3214805 - protein, 7 aa, Plasmodium falciparum
DRHKRDT

SEQ ID NO: 3214806 - protein, 8 aa, Plasmodium falciparum
DRIKETQT

SEQ ID NO: 3214807 - protein, 4 aa, Plasmodium falciparum
DRIR

SEQ ID NO: 3214808 - protein, 17 aa, Plasmodium falciparum
DRITSSNNIYDNTSEFS

SEQ ID NO: 3214809 - protein, 4 aa, Plasmodium falciparum
DRKE

SEQ ID NO: 3214810 - protein, 11 aa, Plasmodium falciparum
DRKEKSSSVGY

SEQ ID NO: 3214811 - protein, 8 aa, Plasmodium falciparum
DRKEYCDE

SEQ ID NO: 3214812 - protein, 22 aa, Plasmodium falciparum
DRKGSYDYNRNGYDEKGSYERN

SEQ ID NO: 3214813 - protein, 20 aa, Plasmodium falciparum
DRKGTLKTKPSTKVKSMKKA

SEQ ID NO: 3214814 - protein, 4 aa, Plasmodium falciparum
DRKK

SEQ ID NO: 3214815 - protein, 7 aa, Plasmodium falciparum
DRKKADS

SEQ ID NO: 3214816 - protein, 9 aa, Plasmodium falciparum
DRKKETKRR

SEQ ID NO: 3214817 - protein, 25 aa, Plasmodium falciparum
DRKKHSDNVYEESEQDGKQTEGRKK

SEQ ID NO: 3214818 - protein, 10 aa, Plasmodium falciparum
DRKKNIKNTS

SEQ ID NO: 3214819 - protein, 17 aa, Plasmodium falciparum
DRKKSRKIKKKQKKRKR

SEQ ID NO: 3214820 - protein, 7 aa, Plasmodium falciparum
DRKPKNM

SEQ ID NO: 3214821 - protein, 4 aa, Plasmodium falciparum
DRKT

SEQ ID NO: 3214822 - protein, 7 aa, Plasmodium falciparum
DRKTPTQ

SEQ ID NO: 3214823 - protein, 7 aa, Plasmodium falciparum
DRLGDGN

SEQ ID NO: 3214824 - protein, 18 aa, Plasmodium falciparum
DRMNEKRQKRKEQRDKNI

SEQ ID NO: 3214825 - protein, 4 aa, Plasmodium falciparum
DRMS

SEQ ID NO: 3214826 - protein, 22 aa, Plasmodium falciparum
DRNEEDNKGEDESDTHDEHGED

SEQ ID NO: 3214827 - protein, 5 aa, Plasmodium falciparum
DRNET

SEQ ID NO: 3214828 - protein, 10 aa, Plasmodium falciparum
DRNGERTMEK

SEQ ID NO: 3214829 - protein, 6 aa, Plasmodium falciparum
DRNHEK

SEQ ID NO: 3214830 - protein, 34 aa, Plasmodium falciparum
DRNKDNDMDKDNKDNDKDNDKDNDKYNDNDKECS

SEQ ID NO: 3214831 - protein, 34 aa, Plasmodium falciparum
DRNKVNNDESVNSTYNKQNNSIRRGGKKKKNKIY

SEQ ID NO: 3214832 - protein, 9 aa, Plasmodium falciparum
DRNNKEKKK

SEQ ID NO: 3214833 - protein, 13 aa, Plasmodium falciparum
DRNNNDKKEYTES

SEQ ID NO: 3214834 - protein, 8 aa, Plasmodium falciparum
DRNNPHVP

SEQ ID NO: 3214835 - protein, 31 aa, Plasmodium falciparum
DRNNRGNVIPQNRDSKKEQITDEENDTQGRI

SEQ ID NO: 3214836 - protein, 4 aa, Plasmodium falciparum
DRNR

SEQ ID NO: 3214837 - protein, 8 aa, Plasmodium falciparum
DRNRRKQL

SEQ ID NO: 3214838 - protein, 15 aa, Plasmodium falciparum
DRNRTKRTCSNNNME

SEQ ID NO: 3214839 - protein, 8 aa, Plasmodium falciparum
DRNSAIDN

SEQ ID NO: 3214840 - protein, 17 aa, Plasmodium falciparum
DRNSLSKPQNNNNNNTS

SEQ ID NO: 3214841 - protein, 5 aa, Plasmodium falciparum
DRNTS

SEQ ID NO: 3214842 - protein, 27 aa, Plasmodium falciparum
DRNYDENGNRIKRKNLKKKKKKTNKLE

SEQ ID NO: 3214843 - protein, 6 aa, Plasmodium falciparum
DRNYNN

SEQ ID NO: 3214844 - protein, 5 aa, Plasmodium falciparum
DRPEF

SEQ ID NO: 3214845 - protein, 14 aa, Plasmodium falciparum
DRPEQQIKKKEVED

SEQ ID NO: 3214846 - protein, 4 aa, Plasmodium falciparum
DRPH

SEQ ID NO: 3214847 - protein, 25 aa, Plasmodium falciparum
DRPSKCLSENSKHHVNSDNNKGNKL

SEQ ID NO: 3214848 - protein, 42 aa, Plasmodium falciparum
DRQEKPNDKENKNKNKNKNDRNNEQLDSNVNHDNVDENNTNS

SEQ ID NO: 3214849 - protein, 7 aa, Plasmodium falciparum
DRRAQRE

SEQ ID NO: 3214850 - protein, 12 aa, Plasmodium falciparum
DRSKEIKKNYKR

SEQ ID NO: 3214851 - protein, 4 aa, Plasmodium falciparum
DRSL

SEQ ID NO: 3214852 - protein, 9 aa, Plasmodium falciparum
DRSNYNNKN

SEQ ID NO: 3214853 - protein, 11 aa, Plasmodium falciparum
DRTNDTDWGGD

SEQ ID NO: 3214854 - protein, 7 aa, Plasmodium falciparum
DRTNIKT

SEQ ID NO: 3214855 - protein, 7 aa, Plasmodium falciparum
DRTPGSI

SEQ ID NO: 3214856 - protein, 4 aa, Plasmodium falciparum
DRTR

SEQ ID NO: 3214857 - protein, 7 aa, Plasmodium falciparum
DRTRPRK

SEQ ID NO: 3214858 - protein, 7 aa, Plasmodium falciparum
DRTSQRF

SEQ ID NO: 3214859 - protein, 6 aa, Plasmodium falciparum
DRTYNG

SEQ ID NO: 3214860 - protein, 4 aa, Plasmodium falciparum
DRVQ

SEQ ID NO: 3214861 - protein, 11 aa, Plasmodium falciparum
DRYKSHGKGYN

SEQ ID NO: 3214862 - protein, 5 aa, Plasmodium falciparum
DRYNG

SEQ ID NO: 3214863 - protein, 22 aa, Plasmodium falciparum
DRYNNVNTNDYTSYKDKGEQFN

SEQ ID NO: 3214864 - protein, 17 aa, Plasmodium falciparum
DRYQTESDKVRSDNGFS

SEQ ID NO: 3214865 - protein, 7 aa, Plasmodium falciparum
DSAAGKT

SEQ ID NO: 3214866 - protein, 13 aa, Plasmodium falciparum
DSADGKGSSVARN

SEQ ID NO: 3214867 - protein, 17 aa, Plasmodium falciparum
DSADVDRNNYSQNIDSK

SEQ ID NO: 3214868 - protein, 5 aa, Plasmodium falciparum
DSADY

SEQ ID NO: 3214869 - protein, 5 aa, Plasmodium falciparum
DSAIK

SEQ ID NO: 3214870 - protein, 6 aa, Plasmodium falciparum
DSANDY

SEQ ID NO: 3214871 - protein, 8 aa, Plasmodium falciparum
DSANGKEK

SEQ ID NO: 3214872 - protein, 8 aa, Plasmodium falciparum
DSATGFAG

SEQ ID NO: 3214873 - protein, 11 aa, Plasmodium falciparum
DSCASKAAQIS

SEQ ID NO: 3214874 - protein, 30 aa, Plasmodium falciparum
DSDCSEEECKEDENVSKNINDNKEKNINDE

SEQ ID NO: 3214875 - protein, 5 aa, Plasmodium falciparum
DSDDL

SEQ ID NO: 3214876 - protein, 45 aa, Plasmodium falciparum
DSDDSDDSDDNDDDNIDCDDDDNIDCDDDDNIDCDDDDNSDLFSD

SEQ ID NO: 3214877 - protein, 13 aa, Plasmodium falciparum
DSDEEENENDDAP

SEQ ID NO: 3214878 - protein, 6 aa, Plasmodium falciparum
DSDELD

SEQ ID NO: 3214879 - protein, 20 aa, Plasmodium falciparum
DSDERNEEMKSDDKKEKKVT

SEQ ID NO: 3214880 - protein, 5 aa, Plasmodium falciparum
DSDGL

SEQ ID NO: 3214881 - protein, 13 aa, Plasmodium falciparum
DSDNNMTEKEPVP

SEQ ID NO: 3214882 - protein, 25 aa, Plasmodium falciparum
DSDNSDESKKYDKSKKYDKSKKYDK

SEQ ID NO: 3214883 - protein, 15 aa, Plasmodium falciparum
DSDRTIDKEMDHGKN

SEQ ID NO: 3214884 - protein, 5 aa, Plasmodium falciparum
DSEDE

SEQ ID NO: 3214885 - protein, 5 aa, Plasmodium falciparum
DSEEE

SEQ ID NO: 3214886 - protein, 6 aa, Plasmodium falciparum
DSEEIQ

SEQ ID NO: 3214887 - protein, 7 aa, Plasmodium falciparum
DSEEPLN

SEQ ID NO: 3214888 - protein, 9 aa, Plasmodium falciparum
DSEGLSGNH

SEQ ID NO: 3214889 - protein, 4 aa, Plasmodium falciparum
DSEH

SEQ ID NO: 3214890 - protein, 9 aa, Plasmodium falciparum
DSEHNNNDV

SEQ ID NO: 3214891 - protein, 9 aa, Plasmodium falciparum
DSEKDVSNE

SEQ ID NO: 3214892 - protein, 11 aa, Plasmodium falciparum
DSEKFSESSTD

SEQ ID NO: 3214893 - protein, 9 aa, Plasmodium falciparum
DSEKQIEDF

SEQ ID NO: 3214894 - protein, 6 aa, Plasmodium falciparum
DSEKSF

SEQ ID NO: 3214895 - protein, 4 aa, Plasmodium falciparum
DSEL

SEQ ID NO: 3214896 - protein, 18 aa, Plasmodium falciparum
DSELSTNNRRKEKNGRRD

SEQ ID NO: 3214897 - protein, 9 aa, Plasmodium falciparum
DSEMNDPQK

SEQ ID NO: 3214898 - protein, 7 aa, Plasmodium falciparum
DSENDHM

SEQ ID NO: 3214899 - protein, 6 aa, Plasmodium falciparum
DSENIP

SEQ ID NO: 3214900 - protein, 7 aa, Plasmodium falciparum
DSENKIK

SEQ ID NO: 3214901 - protein, 8 aa, Plasmodium falciparum
DSENKYSS

SEQ ID NO: 3214902 - protein, 4 aa, Plasmodium falciparum
DSEQ

SEQ ID NO: 3214903 - protein, 20 aa, Plasmodium falciparum
DSEQKYNTAQKQYEQTKKDV

SEQ ID NO: 3214904 - protein, 8 aa, Plasmodium falciparum
DSETSTRY

SEQ ID NO: 3214905 - protein, 11 aa, Plasmodium falciparum
DSEYKNITSKT

SEQ ID NO: 3214906 - protein, 6 aa, Plasmodium falciparum
DSFDKE

SEQ ID NO: 3214907 - protein, 37 aa, Plasmodium falciparum
DSFEDANDDTHNVNDSFNNDKAENDNTNTDNNKPTRI

SEQ ID NO: 3214908 - protein, 7 aa, Plasmodium falciparum
DSFEDNE

SEQ ID NO: 3214909 - protein, 4 aa, Plasmodium falciparum
DSFH

SEQ ID NO: 3214910 - protein, 6 aa, Plasmodium falciparum
DSFKNN

SEQ ID NO: 3214911 - protein, 29 aa, Plasmodium falciparum
DSFNGVNNSQNNNNSYNNHDYGNNISEEY

SEQ ID NO: 3214912 - protein, 6 aa, Plasmodium falciparum
DSFNNM

SEQ ID NO: 3214913 - protein, 19 aa, Plasmodium falciparum
DSFRNKEDKEQNDNNYQEE

SEQ ID NO: 3214914 - protein, 5 aa, Plasmodium falciparum
DSFSD

SEQ ID NO: 3214915 - protein, 8 aa, Plasmodium falciparum
DSGDTSKD

SEQ ID NO: 3214916 - protein, 4 aa, Plasmodium falciparum
DSGG

SEQ ID NO: 3214917 - protein, 8 aa, Plasmodium falciparum
DSGKDEKK

SEQ ID NO: 3214918 - protein, 14 aa, Plasmodium falciparum
DSGKNEPKKPQYQY

SEQ ID NO: 3214919 - protein, 11 aa, Plasmodium falciparum
DSGKPQKNYQY

SEQ ID NO: 3214920 - protein, 5 aa, Plasmodium falciparum
DSGKT

SEQ ID NO: 3214921 - protein, 13 aa, Plasmodium falciparum
DSGMSRSNVRSTN

SEQ ID NO: 3214922 - protein, 11 aa, Plasmodium falciparum
DSGTDSGYTDH

SEQ ID NO: 3214923 - protein, 60 aa, Plasmodium falciparum
DSHEEPDDNDDDSSDEDGEDDVVEEAEEQTHKTTEGTGEGPKETTTQDTEVTDGPATDPS

SEQ ID NO: 3214924 - protein, 6 aa, Plasmodium falciparum
DSHEKQ

SEQ ID NO: 3214925 - protein, 5 aa, Plasmodium falciparum
DSHNK

SEQ ID NO: 3214926 - protein, 10 aa, Plasmodium falciparum
DSHRSGTFSQ

SEQ ID NO: 3214927 - protein, 39 aa, Plasmodium falciparum
DSHSNVHGDDHNNVHGDSHNNVHGDDHNNVHGDSHSNKP

SEQ ID NO: 3214928 - protein, 11 aa, Plasmodium falciparum
DSHTNDHSSEP

SEQ ID NO: 3214929 - protein, 8 aa, Plasmodium falciparum
DSIDKKKK

SEQ ID NO: 3214930 - protein, 51 aa, Plasmodium falciparum
DSIESDSKNNDIQQLEEQKSDIQNEKLNTSNEQEETRNTNNEHKENEVNMD

SEQ ID NO: 3214931 - protein, 4 aa, Plasmodium falciparum
DSII

SEQ ID NO: 3214932 - protein, 29 aa, Plasmodium falciparum
DSIKEEQTKQENNQNNEKVSSSEKQNDDI

SEQ ID NO: 3214933 - protein, 5 aa, Plasmodium falciparum
DSIKR

SEQ ID NO: 3214934 - protein, 12 aa, Plasmodium falciparum
DSINTENEINKT

SEQ ID NO: 3214935 - protein, 13 aa, Plasmodium falciparum
DSIPEIKSGQVER

SEQ ID NO: 3214936 - protein, 18 aa, Plasmodium falciparum
DSIPNEKDKNNQMENQKN

SEQ ID NO: 3214937 - protein, 12 aa, Plasmodium falciparum
DSITEKNDNITS

SEQ ID NO: 3214938 - protein, 18 aa, Plasmodium falciparum
DSITKKKNIHGKRKRRRK

SEQ ID NO: 3214939 - protein, 16 aa, Plasmodium falciparum
DSITSEKNNIDKSEQI

SEQ ID NO: 3214940 - protein, 18 aa, Plasmodium falciparum
DSIYSSDSNYNNENPSSV

SEQ ID NO: 3214941 - protein, 13 aa, Plasmodium falciparum
DSKDNIGPGGDYP

SEQ ID NO: 3214942 - protein, 7 aa, Plasmodium falciparum
DSKDQDV

SEQ ID NO: 3214943 - protein, 9 aa, Plasmodium falciparum
DSKEETLDK

SEQ ID NO: 3214944 - protein, 6 aa, Plasmodium falciparum
DSKEKN

SEQ ID NO: 3214945 - protein, 20 aa, Plasmodium falciparum
DSKGAKLKQKVQRNNNNNNK

SEQ ID NO: 3214946 - protein, 6 aa, Plasmodium falciparum
DSKGYD

SEQ ID NO: 3214947 - protein, 17 aa, Plasmodium falciparum
DSKIDEEDRNKEHTYNN

SEQ ID NO: 3214948 - protein, 6 aa, Plasmodium falciparum
DSKKDT

SEQ ID NO: 3214949 - protein, 8 aa, Plasmodium falciparum
DSKKNQPH

SEQ ID NO: 3214950 - protein, 8 aa, Plasmodium falciparum
DSKKTNQI

SEQ ID NO: 3214951 - protein, 8 aa, Plasmodium falciparum
DSKNKTFN

SEQ ID NO: 3214952 - protein, 9 aa, Plasmodium falciparum
DSKNSNLKK

SEQ ID NO: 3214953 - protein, 8 aa, Plasmodium falciparum
DSKNTKKC

SEQ ID NO: 3214954 - protein, 4 aa, Plasmodium falciparum
DSKS

SEQ ID NO: 3214955 - protein, 10 aa, Plasmodium falciparum
DSKSDIGSGL

SEQ ID NO: 3214956 - protein, 7 aa, Plasmodium falciparum
DSKTNDK

SEQ ID NO: 3214957 - protein, 4 aa, Plasmodium falciparum
DSKY

SEQ ID NO: 3214958 - protein, 5 aa, Plasmodium falciparum
DSLDE

SEQ ID NO: 3214959 - protein, 6 aa, Plasmodium falciparum
DSLDGR

SEQ ID NO: 3214960 - protein, 23 aa, Plasmodium falciparum
DSLDNEENISNEKDNAEYNTNGD

SEQ ID NO: 3214961 - protein, 5 aa, Plasmodium falciparum
DSLED

SEQ ID NO: 3214962 - protein, 17 aa, Plasmodium falciparum
DSLHPSDRSVKNRKNSM

SEQ ID NO: 3214963 - protein, 10 aa, Plasmodium falciparum
DSLKKKKTNK

SEQ ID NO: 3214964 - protein, 9 aa, Plasmodium falciparum
DSLKNAKKT

SEQ ID NO: 3214965 - protein, 6 aa, Plasmodium falciparum
DSLKND

SEQ ID NO: 3214966 - protein, 14 aa, Plasmodium falciparum
DSLKTKDDDENIKK

SEQ ID NO: 3214967 - protein, 10 aa, Plasmodium falciparum
DSLNQTNNSM

SEQ ID NO: 3214968 - protein, 12 aa, Plasmodium falciparum
DSLSNKLNNEND

SEQ ID NO: 3214969 - protein, 14 aa, Plasmodium falciparum
DSLSSSDYTDTQKD

SEQ ID NO: 3214970 - protein, 4 aa, Plasmodium falciparum
DSLT

SEQ ID NO: 3214971 - protein, 26 aa, Plasmodium falciparum
DSMDYDKTYDTTNYYNESNKNDSNYI

SEQ ID NO: 3214972 - protein, 6 aa, Plasmodium falciparum
DSMESG

SEQ ID NO: 3214973 - protein, 10 aa, Plasmodium falciparum
DSMHDENGTL

SEQ ID NO: 3214974 - protein, 9 aa, Plasmodium falciparum
DSNAPNNNN

SEQ ID NO: 3214975 - protein, 14 aa, Plasmodium falciparum
DSNCRDSNDGNNCR

SEQ ID NO: 3214976 - protein, 8 aa, Plasmodium falciparum
DSNDDDYS

SEQ ID NO: 3214977 - protein, 9 aa, Plasmodium falciparum
DSNDENTYD

SEQ ID NO: 3214978 - protein, 9 aa, Plasmodium falciparum
DSNDKEGLF

SEQ ID NO: 3214979 - protein, 8 aa, Plasmodium falciparum
DSNEKGTS

SEQ ID NO: 3214980 - protein, 8 aa, Plasmodium falciparum
DSNEKNKI

SEQ ID NO: 3214981 - protein, 6 aa, Plasmodium falciparum
DSNGCL

SEQ ID NO: 3214982 - protein, 8 aa, Plasmodium falciparum
DSNIESPE

SEQ ID NO: 3214983 - protein, 13 aa, Plasmodium falciparum
DSNKEVEKNMNSS

SEQ ID NO: 3214984 - protein, 5 aa, Plasmodium falciparum
DSNKL

SEQ ID NO: 3214985 - protein, 8 aa, Plasmodium falciparum
DSNKNNIK

SEQ ID NO: 3214986 - protein, 6 aa, Plasmodium falciparum
DSNKSN

SEQ ID NO: 3214987 - protein, 4 aa, Plasmodium falciparum
DSNL

SEQ ID NO: 3214988 - protein, 7 aa, Plasmodium falciparum
DSNLESA

SEQ ID NO: 3214989 - protein, 21 aa, Plasmodium falciparum
DSNNKSFTDAKSHKYMTREFY

SEQ ID NO: 3214990 - protein, 6 aa, Plasmodium falciparum
DSNNNC

SEQ ID NO: 3214991 - protein, 15 aa, Plasmodium falciparum
DSNNNINANYNNNGN

SEQ ID NO: 3214992 - protein, 12 aa, Plasmodium falciparum
DSNNNNNNNNNN

SEQ ID NO: 3214993 - protein, 25 aa, Plasmodium falciparum
DSNNNNNNNNNNDDDNYPSNVAKTP

SEQ ID NO: 3214994 - protein, 63 aa, Plasmodium falciparum
DSNNNNNNNNNNNDDEDNLDDEDNLDDEDNLDDEDNLDDEDNLDDEDNLDDEDNLDDVGDGDE

SEQ ID NO: 3214995 - protein, 18 aa, Plasmodium falciparum
DSNNNNNNNNNNNGENKS

SEQ ID NO: 3214996 - protein, 38 aa, Plasmodium falciparum
DSNNNNNNNNNNNNNNNNNNNNNNNNNNNNNNNNNNNN

SEQ ID NO: 3214997 - protein, 6 aa, Plasmodium falciparum
DSNNQV

SEQ ID NO: 3214998 - protein, 19 aa, Plasmodium falciparum
DSNNSRKQPANSNLDDIDS

SEQ ID NO: 3214999 - protein, 8 aa, Plasmodium falciparum
DSNQKKEN

SEQ ID NO: 3215000 - protein, 4 aa, Plasmodium falciparum
DSNR

SEQ ID NO: 3215001 - protein, 18 aa, Plasmodium falciparum
DSNSEDATDISEKNGEEE

SEQ ID NO: 3215002 - protein, 7 aa, Plasmodium falciparum
DSNTEYS

SEQ ID NO: 3215003 - protein, 9 aa, Plasmodium falciparum
DSNTKKGIS

SEQ ID NO: 3215004 - protein, 9 aa, Plasmodium falciparum
DSNTNGNKF

SEQ ID NO: 3215005 - protein, 21 aa, Plasmodium falciparum
DSNTYIPDEKKKKKKKNNKNA

SEQ ID NO: 3215006 - protein, 6 aa, Plasmodium falciparum
DSNVSS

SEQ ID NO: 3215007 - protein, 5 aa, Plasmodium falciparum
DSNYA

SEQ ID NO: 3215008 - protein, 10 aa, Plasmodium falciparum
DSNYSKKKNI

SEQ ID NO: 3215009 - protein, 13 aa, Plasmodium falciparum
DSPAQNKGSNIHE

SEQ ID NO: 3215010 - protein, 16 aa, Plasmodium falciparum
DSPDINEQEKNIKDEF

SEQ ID NO: 3215011 - protein, 4 aa, Plasmodium falciparum
DSPE

SEQ ID NO: 3215012 - protein, 6 aa, Plasmodium falciparum
DSPHKL

SEQ ID NO: 3215013 - protein, 16 aa, Plasmodium falciparum
DSPKFNNTSNKAIGKS

SEQ ID NO: 3215014 - protein, 4 aa, Plasmodium falciparum
DSPN

SEQ ID NO: 3215015 - protein, 18 aa, Plasmodium falciparum
DSPNKKCGKNKIKNEYDD

SEQ ID NO: 3215016 - protein, 9 aa, Plasmodium falciparum
DSQDENVTD

SEQ ID NO: 3215017 - protein, 8 aa, Plasmodium falciparum
DSQKKDEV

SEQ ID NO: 3215018 - protein, 13 aa, Plasmodium falciparum
DSQKKKKKKKMKS

SEQ ID NO: 3215019 - protein, 7 aa, Plasmodium falciparum
DSQNKNY

SEQ ID NO: 3215020 - protein, 4 aa, Plasmodium falciparum
DSRN

SEQ ID NO: 3215021 - protein, 18 aa, Plasmodium falciparum
DSRRNGEMTEGSESDVGE

SEQ ID NO: 3215022 - protein, 7 aa, Plasmodium falciparum
DSRYRKM

SEQ ID NO: 3215023 - protein, 13 aa, Plasmodium falciparum
DSSDESDLEIEEN

SEQ ID NO: 3215024 - protein, 8 aa, Plasmodium falciparum
DSSDKNDV

SEQ ID NO: 3215025 - protein, 5 aa, Plasmodium falciparum
DSSEN

SEQ ID NO: 3215026 - protein, 8 aa, Plasmodium falciparum
DSSESENL

SEQ ID NO: 3215027 - protein, 6 aa, Plasmodium falciparum
DSSEYL

SEQ ID NO: 3215028 - protein, 4 aa, Plasmodium falciparum
DSSG

SEQ ID NO: 3215029 - protein, 7 aa, Plasmodium falciparum
DSSGEEK

SEQ ID NO: 3215030 - protein, 13 aa, Plasmodium falciparum
DSSGLSSSKVNDS

SEQ ID NO: 3215031 - protein, 40 aa, Plasmodium falciparum
DSSIDNNGGDNGNGTEGNVNPDTPSCNDNDDDDKCNNDDS

SEQ ID NO: 3215032 - protein, 8 aa, Plasmodium falciparum
DSSINNNS

SEQ ID NO: 3215033 - protein, 8 aa, Plasmodium falciparum
DSSISSGS

SEQ ID NO: 3215034 - protein, 13 aa, Plasmodium falciparum
DSSKENRKKEEKK

SEQ ID NO: 3215035 - protein, 11 aa, Plasmodium falciparum
DSSKKNKNKNY

SEQ ID NO: 3215036 - protein, 6 aa, Plasmodium falciparum
DSSKNI

SEQ ID NO: 3215037 - protein, 7 aa, Plasmodium falciparum
DSSKSPV

SEQ ID NO: 3215038 - protein, 15 aa, Plasmodium falciparum
DSSKSRTYEKDGTKV

SEQ ID NO: 3215039 - protein, 4 aa, Plasmodium falciparum
DSSN

SEQ ID NO: 3215040 - protein, 18 aa, Plasmodium falciparum
DSSNIPKNIDTNKTNSKH

SEQ ID NO: 3215041 - protein, 8 aa, Plasmodium falciparum
DSSNNNMS

SEQ ID NO: 3215042 - protein, 29 aa, Plasmodium falciparum
DSSNTTRSSPPAPVASSTLSTSPEAGASA

SEQ ID NO: 3215043 - protein, 10 aa, Plasmodium falciparum
DSSQINNNLN

SEQ ID NO: 3215044 - protein, 7 aa, Plasmodium falciparum
DSSQNVD

SEQ ID NO: 3215045 - protein, 10 aa, Plasmodium falciparum
DSSRASRDSY

SEQ ID NO: 3215046 - protein, 6 aa, Plasmodium falciparum
DSSSEE

SEQ ID NO: 3215047 - protein, 14 aa, Plasmodium falciparum
DSSSLSENSLNESS

SEQ ID NO: 3215048 - protein, 20 aa, Plasmodium falciparum
DSSSSSTDCNKNYKKKEKAV

SEQ ID NO: 3215049 - protein, 6 aa, Plasmodium falciparum
DSSTTS

SEQ ID NO: 3215050 - protein, 8 aa, Plasmodium falciparum
DSSYDNYN

SEQ ID NO: 3215051 - protein, 6 aa, Plasmodium falciparum
DSSYDP

SEQ ID NO: 3215052 - protein, 40 aa, Plasmodium falciparum
DSSYEENTHGINNNNNNNNNNNNSNNNSNNKNYSNNSHNI

SEQ ID NO: 3215053 - protein, 9 aa, Plasmodium falciparum
DSTDEYENP

SEQ ID NO: 3215054 - protein, 9 aa, Plasmodium falciparum
DSTDTSYKD

SEQ ID NO: 3215055 - protein, 9 aa, Plasmodium falciparum
DSTGKYGEG

SEQ ID NO: 3215056 - protein, 14 aa, Plasmodium falciparum
DSTIASKSKNAYYT

SEQ ID NO: 3215057 - protein, 8 aa, Plasmodium falciparum
DSTKNKLT

SEQ ID NO: 3215058 - protein, 10 aa, Plasmodium falciparum
DSTPLEDDEE

SEQ ID NO: 3215059 - protein, 5 aa, Plasmodium falciparum
DSTRG

SEQ ID NO: 3215060 - protein, 4 aa, Plasmodium falciparum
DSTS

SEQ ID NO: 3215061 - protein, 4 aa, Plasmodium falciparum
DSTT

SEQ ID NO: 3215062 - protein, 6 aa, Plasmodium falciparum
DSTTEF

SEQ ID NO: 3215063 - protein, 15 aa, Plasmodium falciparum
DSTTKSGAPVKSGGS

SEQ ID NO: 3215064 - protein, 9 aa, Plasmodium falciparum
DSTTNEDNK

SEQ ID NO: 3215065 - protein, 4 aa, Plasmodium falciparum
DSTY

SEQ ID NO: 3215066 - protein, 13 aa, Plasmodium falciparum
DSTYVSNGSQYSD

SEQ ID NO: 3215067 - protein, 4 aa, Plasmodium falciparum
DSVD

SEQ ID NO: 3215068 - protein, 11 aa, Plasmodium falciparum
DSVNDDKIKEE

SEQ ID NO: 3215069 - protein, 51 aa, Plasmodium falciparum
DSVPLNGQTGVSNDTPQNLSSDASKSVPKDVQNKVKNEKTQTKQIKKKHTK

SEQ ID NO: 3215070 - protein, 4 aa, Plasmodium falciparum
DSVR

SEQ ID NO: 3215071 - protein, 14 aa, Plasmodium falciparum
DSVYDRSPKKKYIK

SEQ ID NO: 3215072 - protein, 6 aa, Plasmodium falciparum
DSWNSE

SEQ ID NO: 3215073 - protein, 11 aa, Plasmodium falciparum
DSYASSSPSMN

SEQ ID NO: 3215074 - protein, 18 aa, Plasmodium falciparum
DSYDAKNSGFAEQYDQQQ

SEQ ID NO: 3215075 - protein, 44 aa, Plasmodium falciparum
DSYDNNNNNNNNNNNNTNTNTNNNNNNNNNNNNNNNSSSSTNKY

SEQ ID NO: 3215076 - protein, 29 aa, Plasmodium falciparum
DSYEEGEEEGDGKLNTKIKKDKKSTENNI

SEQ ID NO: 3215077 - protein, 26 aa, Plasmodium falciparum
DSYEKEINEDEKLKNGKKIKKEKSKF

SEQ ID NO: 3215078 - protein, 18 aa, Plasmodium falciparum
DSYEKEMQKKKKDRHKKN

SEQ ID NO: 3215079 - protein, 7 aa, Plasmodium falciparum
DSYENKS

SEQ ID NO: 3215080 - protein, 4 aa, Plasmodium falciparum
DSYF

SEQ ID NO: 3215081 - protein, 25 aa, Plasmodium falciparum
DSYKDDYKNDDEYDYHSSNSTLSSE

SEQ ID NO: 3215082 - protein, 9 aa, Plasmodium falciparum
DSYKKEDQN

SEQ ID NO: 3215083 - protein, 10 aa, Plasmodium falciparum
DSYKSKYKNG

SEQ ID NO: 3215084 - protein, 5 aa, Plasmodium falciparum
DSYNN

SEQ ID NO: 3215085 - protein, 7 aa, Plasmodium falciparum
DSYNNKT

SEQ ID NO: 3215086 - protein, 4 aa, Plasmodium falciparum
DSYP

SEQ ID NO: 3215087 - protein, 9 aa, Plasmodium falciparum
DTAEKGDDN

SEQ ID NO: 3215088 - protein, 5 aa, Plasmodium falciparum
DTCAK

SEQ ID NO: 3215089 - protein, 16 aa, Plasmodium falciparum
DTCKTGDLASADKYLE

SEQ ID NO: 3215090 - protein, 60 aa, Plasmodium falciparum
DTCQKEKDKNKNINNNNNNKIKENKYNNSNDSNASIDSDDNTNNCNDKRDEEEKKANITY

SEQ ID NO: 3215091 - protein, 27 aa, Plasmodium falciparum
DTDDENLKRKRGRKKGKKRGRKKGVKN

SEQ ID NO: 3215092 - protein, 8 aa, Plasmodium falciparum
DTDDERAT

SEQ ID NO: 3215093 - protein, 4 aa, Plasmodium falciparum
DTDE

SEQ ID NO: 3215094 - protein, 5 aa, Plasmodium falciparum
DTDEK

SEQ ID NO: 3215095 - protein, 9 aa, Plasmodium falciparum
DTDGKEAND

SEQ ID NO: 3215096 - protein, 13 aa, Plasmodium falciparum
DTDGKKPKRDYQY

SEQ ID NO: 3215097 - protein, 6 aa, Plasmodium falciparum
DTDHTD

SEQ ID NO: 3215098 - protein, 7 aa, Plasmodium falciparum
DTDIQSD

SEQ ID NO: 3215099 - protein, 9 aa, Plasmodium falciparum
DTDKDENIE

SEQ ID NO: 3215100 - protein, 4 aa, Plasmodium falciparum
DTDN

SEQ ID NO: 3215101 - protein, 5 aa, Plasmodium falciparum
DTDNN

SEQ ID NO: 3215102 - protein, 13 aa, Plasmodium falciparum
DTDNNNNNINNNN

SEQ ID NO: 3215103 - protein, 19 aa, Plasmodium falciparum
DTDNTSDAGLSDSDYSDIS

SEQ ID NO: 3215104 - protein, 6 aa, Plasmodium falciparum
DTDQNI

SEQ ID NO: 3215105 - protein, 16 aa, Plasmodium falciparum
DTDSGAIGQPPQVDPQ

SEQ ID NO: 3215106 - protein, 6 aa, Plasmodium falciparum
DTDTKY

SEQ ID NO: 3215107 - protein, 5 aa, Plasmodium falciparum
DTECT

SEQ ID NO: 3215108 - protein, 4 aa, Plasmodium falciparum
DTEE

SEQ ID NO: 3215109 - protein, 7 aa, Plasmodium falciparum
DTEENEY

SEQ ID NO: 3215110 - protein, 7 aa, Plasmodium falciparum
DTEGHNE

SEQ ID NO: 3215111 - protein, 9 aa, Plasmodium falciparum
DTEGKEEKR

SEQ ID NO: 3215112 - protein, 7 aa, Plasmodium falciparum
DTEHSDD

SEQ ID NO: 3215113 - protein, 26 aa, Plasmodium falciparum
DTEKDKIKEENEENHTNTKGINNSTY

SEQ ID NO: 3215114 - protein, 5 aa, Plasmodium falciparum
DTEKG

SEQ ID NO: 3215115 - protein, 8 aa, Plasmodium falciparum
DTEKSNSS

SEQ ID NO: 3215116 - protein, 5 aa, Plasmodium falciparum
DTENI

SEQ ID NO: 3215117 - protein, 6 aa, Plasmodium falciparum
DTEPTL

SEQ ID NO: 3215118 - protein, 6 aa, Plasmodium falciparum
DTESIN

SEQ ID NO: 3215119 - protein, 14 aa, Plasmodium falciparum
DTESSIYDSDEEIN

SEQ ID NO: 3215120 - protein, 9 aa, Plasmodium falciparum
DTFNEGNKK

SEQ ID NO: 3215121 - protein, 4 aa, Plasmodium falciparum
DTFS

SEQ ID NO: 3215122 - protein, 4 aa, Plasmodium falciparum
DTFT

SEQ ID NO: 3215123 - protein, 10 aa, Plasmodium falciparum
DTGCGKSTQV

SEQ ID NO: 3215124 - protein, 26 aa, Plasmodium falciparum
DTGTKQERNNINEKNEHVEKKKEKKN

SEQ ID NO: 3215125 - protein, 4 aa, Plasmodium falciparum
DTHE

SEQ ID NO: 3215126 - protein, 11 aa, Plasmodium falciparum
DTHKKKNDINY

SEQ ID NO: 3215127 - protein, 14 aa, Plasmodium falciparum
DTHNNNNNDNNNNI

SEQ ID NO: 3215128 - protein, 21 aa, Plasmodium falciparum
DTHNNNNNNNSKYYKNKNKNK

SEQ ID NO: 3215129 - protein, 4 aa, Plasmodium falciparum
DTHP

SEQ ID NO: 3215130 - protein, 16 aa, Plasmodium falciparum
DTHQDSQNEHKTDEPK

SEQ ID NO: 3215131 - protein, 7 aa, Plasmodium falciparum
DTHTHTN

SEQ ID NO: 3215132 - protein, 9 aa, Plasmodium falciparum
DTHTNYGNS

SEQ ID NO: 3215133 - protein, 7 aa, Plasmodium falciparum
DTIEQQK

SEQ ID NO: 3215134 - protein, 7 aa, Plasmodium falciparum
DTIKNSE

SEQ ID NO: 3215135 - protein, 4 aa, Plasmodium falciparum
DTIN

SEQ ID NO: 3215136 - protein, 12 aa, Plasmodium falciparum
DTINEKKKKIIN

SEQ ID NO: 3215137 - protein, 4 aa, Plasmodium falciparum
DTIT

SEQ ID NO: 3215138 - protein, 5 aa, Plasmodium falciparum
DTKDE

SEQ ID NO: 3215139 - protein, 20 aa, Plasmodium falciparum
DTKENYEYTEKKNGSNKKMS

SEQ ID NO: 3215140 - protein, 5 aa, Plasmodium falciparum
DTKER

SEQ ID NO: 3215141 - protein, 19 aa, Plasmodium falciparum
DTKIDNDIDKEESEQINSD

SEQ ID NO: 3215142 - protein, 77 aa, Plasmodium falciparum
DTKKENDETGETCTSEDTITKETVETDSTDGPKQEEERIAPSAGDDGATRGPQEPSPKADSGDDNPETPQPKPPSNV

SEQ ID NO: 3215143 - protein, 56 aa, Plasmodium falciparum
DTKKENDETGETCTSEDTITKETVETDSTDGPKQEEPPAATRPTKPKGRKPRQPKE

SEQ ID NO: 3215144 - protein, 8 aa, Plasmodium falciparum
DTKKETYN

SEQ ID NO: 3215145 - protein, 6 aa, Plasmodium falciparum
DTKKND

SEQ ID NO: 3215146 - protein, 7 aa, Plasmodium falciparum
DTKKRLD

SEQ ID NO: 3215147 - protein, 7 aa, Plasmodium falciparum
DTKKTFK

SEQ ID NO: 3215148 - protein, 4 aa, Plasmodium falciparum
DTKL

SEQ ID NO: 3215149 - protein, 11 aa, Plasmodium falciparum
DTKLPQGDNQM

SEQ ID NO: 3215150 - protein, 6 aa, Plasmodium falciparum
DTKNDE

SEQ ID NO: 3215151 - protein, 6 aa, Plasmodium falciparum
DTKNEC

SEQ ID NO: 3215152 - protein, 11 aa, Plasmodium falciparum
DTKNKKSNEIY

SEQ ID NO: 3215153 - protein, 6 aa, Plasmodium falciparum
DTKNKN

SEQ ID NO: 3215154 - protein, 46 aa, Plasmodium falciparum
DTKNNHKKKKNHTNSKNNKHDSYHNNNSNDKNKKNCLKEKEENVCE

SEQ ID NO: 3215155 - protein, 6 aa, Plasmodium falciparum
DTKSEH

SEQ ID NO: 3215156 - protein, 70 aa, Plasmodium falciparum
DTKSNEEKNEEPPHINNEKEEKNNNNVNNNDDDNNNNDDDNNNDDDNNNNDDNNNNDDDNNNNNNHHNNN

SEQ ID NO: 3215157 - protein, 15 aa, Plasmodium falciparum
DTKSVATVKSDASGS

SEQ ID NO: 3215158 - protein, 16 aa, Plasmodium falciparum
DTKTVSEKSEESSAIE

SEQ ID NO: 3215159 - protein, 12 aa, Plasmodium falciparum
DTLDKKNTENYN

SEQ ID NO: 3215160 - protein, 10 aa, Plasmodium falciparum
DTLDTKKDTL

SEQ ID NO: 3215161 - protein, 14 aa, Plasmodium falciparum
DTLKNKSNEKSNFR

SEQ ID NO: 3215162 - protein, 6 aa, Plasmodium falciparum
DTLQNN

SEQ ID NO: 3215163 - protein, 4 aa, Plasmodium falciparum
DTLR

SEQ ID NO: 3215164 - protein, 15 aa, Plasmodium falciparum
DTLTNQKEKSNNNGI

SEQ ID NO: 3215165 - protein, 4 aa, Plasmodium falciparum
DTMK

SEQ ID NO: 3215166 - protein, 15 aa, Plasmodium falciparum
DTMPQEKKTSDRNHI

SEQ ID NO: 3215167 - protein, 11 aa, Plasmodium falciparum
DTNDENSTISS

SEQ ID NO: 3215168 - protein, 6 aa, Plasmodium falciparum
DTNDIE

SEQ ID NO: 3215169 - protein, 11 aa, Plasmodium falciparum
DTNDKTNNSMN

SEQ ID NO: 3215170 - protein, 5 aa, Plasmodium falciparum
DTNDM

SEQ ID NO: 3215171 - protein, 44 aa, Plasmodium falciparum
DTNENGFDNNTSTKEYTSQEKNMNTNNSKTNVRNNDKMNKEKTN

SEQ ID NO: 3215172 - protein, 8 aa, Plasmodium falciparum
DTNENIQN

SEQ ID NO: 3215173 - protein, 5 aa, Plasmodium falciparum
DTNHT

SEQ ID NO: 3215174 - protein, 4 aa, Plasmodium falciparum
DTNI

SEQ ID NO: 3215175 - protein, 23 aa, Plasmodium falciparum
DTNISSDQYSLSSSLPNTNTTCT

SEQ ID NO: 3215176 - protein, 25 aa, Plasmodium falciparum
DTNKNLRNQKTYNEEKKNNNNNSFS

SEQ ID NO: 3215177 - protein, 6 aa, Plasmodium falciparum
DTNKNM

SEQ ID NO: 3215178 - protein, 5 aa, Plasmodium falciparum
DTNLL

SEQ ID NO: 3215179 - protein, 5 aa, Plasmodium falciparum
DTNNC

SEQ ID NO: 3215180 - protein, 12 aa, Plasmodium falciparum
DTNNDDSSKAKH

SEQ ID NO: 3215181 - protein, 10 aa, Plasmodium falciparum
DTNNDSKAKH

SEQ ID NO: 3215182 - protein, 8 aa, Plasmodium falciparum
DTNNKQEK

SEQ ID NO: 3215183 - protein, 41 aa, Plasmodium falciparum
DTNQKKMKKKKKKNGQDNKVEEEEEEEKKKIKKSTHKKTNI

SEQ ID NO: 3215184 - protein, 19 aa, Plasmodium falciparum
DTNSGGEGKTTTITQDPNL

SEQ ID NO: 3215185 - protein, 25 aa, Plasmodium falciparum
DTNSKSDKDIQKNNMNDGDSNNKNS

SEQ ID NO: 3215186 - protein, 13 aa, Plasmodium falciparum
DTNSNEDEEDVKT

SEQ ID NO: 3215187 - protein, 8 aa, Plasmodium falciparum
DTNSPYTT

SEQ ID NO: 3215188 - protein, 6 aa, Plasmodium falciparum
DTNSRD

SEQ ID NO: 3215189 - protein, 64 aa, Plasmodium falciparum
DTNSYKSKSASHSFSDATSSHQEKQEKKNNLHNENASNKLNENTGNDADHIQNEDNKMSSQNNE

SEQ ID NO: 3215190 - protein, 15 aa, Plasmodium falciparum
DTNTASGKTPTQIPE

SEQ ID NO: 3215191 - protein, 68 aa, Plasmodium falciparum
DTNTNNNTNNNTNNNANNNANNNANNNANSNANNNANYNTNSNANSNANYNTNNNTNNNNNNNNNNIN

SEQ ID NO: 3215192 - protein, 12 aa, Plasmodium falciparum
DTNTQNKDASVN

SEQ ID NO: 3215193 - protein, 8 aa, Plasmodium falciparum
DTNTTYDN

SEQ ID NO: 3215194 - protein, 4 aa, Plasmodium falciparum
DTNV

SEQ ID NO: 3215195 - protein, 6 aa, Plasmodium falciparum
DTNYEE

SEQ ID NO: 3215196 - protein, 75 aa, Plasmodium falciparum
DTNYNKKDNTNGITKDTLDDNKEKKHTDDNISKNNHKNNNNNNNNNNNNKSNNNNNNKNNNKNNNINKENKVESG

SEQ ID NO: 3215197 - protein, 31 aa, Plasmodium falciparum
DTPEPADEDACKAAPKETAPSSEENQPETPV

SEQ ID NO: 3215198 - protein, 6 aa, Plasmodium falciparum
DTPGII

SEQ ID NO: 3215199 - protein, 18 aa, Plasmodium falciparum
DTPKYANNQNNQNNQNIQ

SEQ ID NO: 3215200 - protein, 6 aa, Plasmodium falciparum
DTPLSN

SEQ ID NO: 3215201 - protein, 9 aa, Plasmodium falciparum
DTPNKSQTC

SEQ ID NO: 3215202 - protein, 13 aa, Plasmodium falciparum
DTQEDIKNSTGVD

SEQ ID NO: 3215203 - protein, 6 aa, Plasmodium falciparum
DTQGYT

SEQ ID NO: 3215204 - protein, 8 aa, Plasmodium falciparum
DTQKNVEE

SEQ ID NO: 3215205 - protein, 9 aa, Plasmodium falciparum
DTQNKKQKT

SEQ ID NO: 3215206 - protein, 6 aa, Plasmodium falciparum
DTQNRD

SEQ ID NO: 3215207 - protein, 7 aa, Plasmodium falciparum
DTQRTTI

SEQ ID NO: 3215208 - protein, 4 aa, Plasmodium falciparum
DTQS

SEQ ID NO: 3215209 - protein, 14 aa, Plasmodium falciparum
DTQSSIHDNDEEIN

SEQ ID NO: 3215210 - protein, 14 aa, Plasmodium falciparum
DTQSTNYNNDEDIK

SEQ ID NO: 3215211 - protein, 9 aa, Plasmodium falciparum
DTQTNNHNN

SEQ ID NO: 3215212 - protein, 5 aa, Plasmodium falciparum
DTRMD

SEQ ID NO: 3215213 - protein, 7 aa, Plasmodium falciparum
DTRPIGD

SEQ ID NO: 3215214 - protein, 4 aa, Plasmodium falciparum
DTRT

SEQ ID NO: 3215215 - protein, 18 aa, Plasmodium falciparum
DTSDNNNNNNNYNGEGEM

SEQ ID NO: 3215216 - protein, 11 aa, Plasmodium falciparum
DTSDSNKKNTN

SEQ ID NO: 3215217 - protein, 7 aa, Plasmodium falciparum
DTSEDIK

SEQ ID NO: 3215218 - protein, 5 aa, Plasmodium falciparum
DTSEG

SEQ ID NO: 3215219 - protein, 4 aa, Plasmodium falciparum
DTSF

SEQ ID NO: 3215220 - protein, 4 aa, Plasmodium falciparum
DTSG

SEQ ID NO: 3215221 - protein, 8 aa, Plasmodium falciparum
DTSGDDDK

SEQ ID NO: 3215222 - protein, 8 aa, Plasmodium falciparum
DTSGDEDK

SEQ ID NO: 3215223 - protein, 7 aa, Plasmodium falciparum
DTSGSSM

SEQ ID NO: 3215224 - protein, 13 aa, Plasmodium falciparum
DTSHPPVDTTNTN

SEQ ID NO: 3215225 - protein, 7 aa, Plasmodium falciparum
DTSIQQN

SEQ ID NO: 3215226 - protein, 4 aa, Plasmodium falciparum
DTSK

SEQ ID NO: 3215227 - protein, 123 aa, Plasmodium falciparum
DTSKKDMKKNKNKKQNIKQGGKKEEVKQEGKKEEVKQEGKKEEVKQEGKKEEVKQEGKKEEVKQGGKKEEVKQGGKKEEVKQGGKKEEVKQGGKKEEVKQGGKKEEVKQGGKKEEVKKELKKN

SEQ ID NO: 3215228 - protein, 4 aa, Plasmodium falciparum
DTSN

SEQ ID NO: 3215229 - protein, 15 aa, Plasmodium falciparum
DTSNDINNSLTSGRT

SEQ ID NO: 3215230 - protein, 6 aa, Plasmodium falciparum
DTSNDS

SEQ ID NO: 3215231 - protein, 8 aa, Plasmodium falciparum
DTSNYQSY

SEQ ID NO: 3215232 - protein, 18 aa, Plasmodium falciparum
DTSNYSSTDERSAHIPPT

SEQ ID NO: 3215233 - protein, 10 aa, Plasmodium falciparum
DTSPDLSESE

SEQ ID NO: 3215234 - protein, 15 aa, Plasmodium falciparum
DTSRRVDKNTQGKAT

SEQ ID NO: 3215235 - protein, 7 aa, Plasmodium falciparum
DTSSSYR

SEQ ID NO: 3215236 - protein, 33 aa, Plasmodium falciparum
DTSSYSDISSLNSEDSSSKEKNIETYSSKKEEL

SEQ ID NO: 3215237 - protein, 29 aa, Plasmodium falciparum
DTTDITSSLESEEDIGVNNIYVPGSPKYK

SEQ ID NO: 3215238 - protein, 14 aa, Plasmodium falciparum
DTTDVTSSESEYEE

SEQ ID NO: 3215239 - protein, 66 aa, Plasmodium falciparum
DTTEPVKEEDEEECKAAESPAEPEQAAEEESVPAAETKDTENQPPQAPDVGPPPLAPAPADQPLDP

SEQ ID NO: 3215240 - protein, 13 aa, Plasmodium falciparum
DTTGNKPQSNKYQ

SEQ ID NO: 3215241 - protein, 6 aa, Plasmodium falciparum
DTTKCD

SEQ ID NO: 3215242 - protein, 10 aa, Plasmodium falciparum
DTTLSRDPKT

SEQ ID NO: 3215243 - protein, 8 aa, Plasmodium falciparum
DTTRNEIN

SEQ ID NO: 3215244 - protein, 4 aa, Plasmodium falciparum
DTTS

SEQ ID NO: 3215245 - protein, 7 aa, Plasmodium falciparum
DTTSEVN

SEQ ID NO: 3215246 - protein, 79 aa, Plasmodium falciparum
DTTSGNNENNNNNNNDGHNNNNNDSHNNNNNDGHNNNYDHNNDSTLENTNLPQNSYNNNGNNGNNSSEKHKDEDEDKDK

SEQ ID NO: 3215247 - protein, 10 aa, Plasmodium falciparum
DTTSSSYDKE

SEQ ID NO: 3215248 - protein, 4 aa, Plasmodium falciparum
DTTT

SEQ ID NO: 3215249 - protein, 15 aa, Plasmodium falciparum
DTTTGKSGDNTGSSG

SEQ ID NO: 3215250 - protein, 7 aa, Plasmodium falciparum
DTTTPHA

SEQ ID NO: 3215251 - protein, 13 aa, Plasmodium falciparum
DTTTTTSSNHTNS

SEQ ID NO: 3215252 - protein, 5 aa, Plasmodium falciparum
DTTYT

SEQ ID NO: 3215253 - protein, 4 aa, Plasmodium falciparum
DTVM

SEQ ID NO: 3215254 - protein, 13 aa, Plasmodium falciparum
DTVNGGKENKIKT

SEQ ID NO: 3215255 - protein, 12 aa, Plasmodium falciparum
DTVNGGNEDKIK

SEQ ID NO: 3215256 - protein, 6 aa, Plasmodium falciparum
DTYCND

SEQ ID NO: 3215257 - protein, 9 aa, Plasmodium falciparum
DTYDKENEE

SEQ ID NO: 3215258 - protein, 13 aa, Plasmodium falciparum
DTYEINEKDKDKN

SEQ ID NO: 3215259 - protein, 4 aa, Plasmodium falciparum
DTYF

SEQ ID NO: 3215260 - protein, 5 aa, Plasmodium falciparum
DTYGD

SEQ ID NO: 3215261 - protein, 7 aa, Plasmodium falciparum
DTYGDEE

SEQ ID NO: 3215262 - protein, 5 aa, Plasmodium falciparum
DTYGN

SEQ ID NO: 3215263 - protein, 23 aa, Plasmodium falciparum
DTYIDTKKESKNRKQSNGSQINN

SEQ ID NO: 3215264 - protein, 11 aa, Plasmodium falciparum
DTYKTQRRNDR

SEQ ID NO: 3215265 - protein, 4 aa, Plasmodium falciparum
DTYL

SEQ ID NO: 3215266 - protein, 5 aa, Plasmodium falciparum
DTYLK

SEQ ID NO: 3215267 - protein, 6 aa, Plasmodium falciparum
DTYNHN

SEQ ID NO: 3215268 - protein, 7 aa, Plasmodium falciparum
DTYNKQE

SEQ ID NO: 3215269 - protein, 49 aa, Plasmodium falciparum
DTYNNDNNNDNNNNNNNNNNNNNNNNNNNNNNNNNNDNNYVERKENSSI

SEQ ID NO: 3215270 - protein, 14 aa, Plasmodium falciparum
DTYNNRYNGEDNEM

SEQ ID NO: 3215271 - protein, 9 aa, Plasmodium falciparum
DTYPNNSSM

SEQ ID NO: 3215272 - protein, 9 aa, Plasmodium falciparum
DTYRNENLE

SEQ ID NO: 3215273 - protein, 4 aa, Plasmodium falciparum
DTYS

SEQ ID NO: 3215274 - protein, 9 aa, Plasmodium falciparum
DTYSKKTKV

SEQ ID NO: 3215275 - protein, 7 aa, Plasmodium falciparum
DTYSPVN

SEQ ID NO: 3215276 - protein, 7 aa, Plasmodium falciparum
DTYTEDQ

SEQ ID NO: 3215277 - protein, 8 aa, Plasmodium falciparum
DTYYTDEN

SEQ ID NO: 3215278 - protein, 6 aa, Plasmodium falciparum
DVAAGS

SEQ ID NO: 3215279 - protein, 15 aa, Plasmodium falciparum
DVAATETTNVTTTQT

SEQ ID NO: 3215280 - protein, 4 aa, Plasmodium falciparum
DVAG

SEQ ID NO: 3215281 - protein, 40 aa, Plasmodium falciparum
DVANPYTGSYGNRNKANIKKGEEKKEQKRNDKKEGEIGYK

SEQ ID NO: 3215282 - protein, 66 aa, Plasmodium falciparum
DVDDDNNNFDDNKNIDDNKNIDDNKNIDDNKNVDDNKNVDDNKNFDGEINEENKNMNRKKKRPSLN

SEQ ID NO: 3215283 - protein, 6 aa, Plasmodium falciparum
DVDDEY

SEQ ID NO: 3215284 - protein, 10 aa, Plasmodium falciparum
DVDEEDLGYD

SEQ ID NO: 3215285 - protein, 6 aa, Plasmodium falciparum
DVDGKS

SEQ ID NO: 3215286 - protein, 4 aa, Plasmodium falciparum
DVDK

SEQ ID NO: 3215287 - protein, 14 aa, Plasmodium falciparum
DVDKEEQLGETKNI

SEQ ID NO: 3215288 - protein, 9 aa, Plasmodium falciparum
DVDKYSEEY

SEQ ID NO: 3215289 - protein, 10 aa, Plasmodium falciparum
DVDNHGEPRN

SEQ ID NO: 3215290 - protein, 5 aa, Plasmodium falciparum
DVDRE

SEQ ID NO: 3215291 - protein, 20 aa, Plasmodium falciparum
DVDSGNDKKYDDIKNEKKNY

SEQ ID NO: 3215292 - protein, 22 aa, Plasmodium falciparum
DVEDAKGEKEEKGLKGDAGKNE

SEQ ID NO: 3215293 - protein, 10 aa, Plasmodium falciparum
DVEDKSCRSD

SEQ ID NO: 3215294 - protein, 13 aa, Plasmodium falciparum
DVEEKETFSSTNL

SEQ ID NO: 3215295 - protein, 6 aa, Plasmodium falciparum
DVEENK

SEQ ID NO: 3215296 - protein, 10 aa, Plasmodium falciparum
DVEEPKLPED

SEQ ID NO: 3215297 - protein, 8 aa, Plasmodium falciparum
DVEETSPF

SEQ ID NO: 3215298 - protein, 8 aa, Plasmodium falciparum
DVEKDNCG

SEQ ID NO: 3215299 - protein, 17 aa, Plasmodium falciparum
DVEKERKKQKGKSQQAE

SEQ ID NO: 3215300 - protein, 12 aa, Plasmodium falciparum
DVENIQNNTNHN

SEQ ID NO: 3215301 - protein, 17 aa, Plasmodium falciparum
DVEPEKKRKDKKEENKD

SEQ ID NO: 3215302 - protein, 5 aa, Plasmodium falciparum
DVETK

SEQ ID NO: 3215303 - protein, 19 aa, Plasmodium falciparum
DVGADLSGKNEYGIPEDDI

SEQ ID NO: 3215304 - protein, 79 aa, Plasmodium falciparum
DVGYKNNVNKNKGNDNVSNNNNNNNNNININSSSNNNNNNSSSNNNNNNSSNNNNNSSNNNNNSSSSNNNNVRNSNNEH

SEQ ID NO: 3215305 - protein, 12 aa, Plasmodium falciparum
DVHDKDEQNKGT

SEQ ID NO: 3215306 - protein, 12 aa, Plasmodium falciparum
DVIEETDKNHKV

SEQ ID NO: 3215307 - protein, 32 aa, Plasmodium falciparum
DVISTNDEENVDRSDDSESNDDKKYSKKKQSN

SEQ ID NO: 3215308 - protein, 16 aa, Plasmodium falciparum
DVKDEYTKNQDTYNNN

SEQ ID NO: 3215309 - protein, 5 aa, Plasmodium falciparum
DVKDG

SEQ ID NO: 3215310 - protein, 9 aa, Plasmodium falciparum
DVKKPKKEN

SEQ ID NO: 3215311 - protein, 4 aa, Plasmodium falciparum
DVKN

SEQ ID NO: 3215312 - protein, 8 aa, Plasmodium falciparum
DVKNANSQ

SEQ ID NO: 3215313 - protein, 7 aa, Plasmodium falciparum
DVKNEKK

SEQ ID NO: 3215314 - protein, 6 aa, Plasmodium falciparum
DVKNGG

SEQ ID NO: 3215315 - protein, 8 aa, Plasmodium falciparum
DVKNGLNK

SEQ ID NO: 3215316 - protein, 7 aa, Plasmodium falciparum
DVKNGNY

SEQ ID NO: 3215317 - protein, 6 aa, Plasmodium falciparum
DVKPPM

SEQ ID NO: 3215318 - protein, 7 aa, Plasmodium falciparum
DVKQNEN

SEQ ID NO: 3215319 - protein, 6 aa, Plasmodium falciparum
DVKTGG

SEQ ID NO: 3215320 - protein, 13 aa, Plasmodium falciparum
DVKTNNEKKKKKK

SEQ ID NO: 3215321 - protein, 15 aa, Plasmodium falciparum
DVKTQSELSHLLEMD

SEQ ID NO: 3215322 - protein, 17 aa, Plasmodium falciparum
DVKTQTELANLLQEKQL

SEQ ID NO: 3215323 - protein, 66 aa, Plasmodium falciparum
DVLNGNNDISNGNNDISNGNNDISNGNNDISNGNNDISNGNNDISNGNNDISNGNNDISNDNNETV

SEQ ID NO: 3215324 - protein, 30 aa, Plasmodium falciparum
DVLTGKNKTHSNNLEERTNNIPSEKISREE

SEQ ID NO: 3215325 - protein, 14 aa, Plasmodium falciparum
DVLTQSSDKLGNNT

SEQ ID NO: 3215326 - protein, 22 aa, Plasmodium falciparum
DVNDDDDDDDDDDDDDDELEDQ

SEQ ID NO: 3215327 - protein, 7 aa, Plasmodium falciparum
DVNDQNN

SEQ ID NO: 3215328 - protein, 47 aa, Plasmodium falciparum
DVNEEGPENKDKVTKQEKVKEVKKEVKKKVKKRVKKRNNKNERKDNV

SEQ ID NO: 3215329 - protein, 100 aa, Plasmodium falciparum
DVNEKDTANKDKEIEQEKEKEEVKEKEEVKEKEEVKEKEEVKEKEEVKEKEEVKEKEEVKEKEEVKEKDTESKDKEIEQEKEKEEVKEVKEKDTENKDKV

SEQ ID NO: 3215330 - protein, 7 aa, Plasmodium falciparum
DVNGGNK

SEQ ID NO: 3215331 - protein, 9 aa, Plasmodium falciparum
DVNGPASAR

SEQ ID NO: 3215332 - protein, 41 aa, Plasmodium falciparum
DVNKNKGDQNKKDKKGNKDKKLSRFTTTTNDKKKNTNEEND

SEQ ID NO: 3215333 - protein, 6 aa, Plasmodium falciparum
DVNNAN

SEQ ID NO: 3215334 - protein, 29 aa, Plasmodium falciparum
DVNNKRKKKKKKKKKKKKDETTKSPYNEE

SEQ ID NO: 3215335 - protein, 44 aa, Plasmodium falciparum
DVNNNDNDDNNNNKNNDNNNDDNNNNNNNNNNNNNSSSNSEQIN

SEQ ID NO: 3215336 - protein, 7 aa, Plasmodium falciparum
DVNNTNE

SEQ ID NO: 3215337 - protein, 8 aa, Plasmodium falciparum
DVNSRRNT

SEQ ID NO: 3215338 - protein, 109 aa, Plasmodium falciparum
DVNSSNDYSDHNCSSNDYSDHNCSSNDYSDHNCSSNNYSDHNCSSNNYSDHNCSSNNYSDHNCSSNNYSDHNCSSNNYSSNNYGSNNYGSNNYSSNNYSSNNYSSNNYS

SEQ ID NO: 3215339 - protein, 4 aa, Plasmodium falciparum
DVNT

SEQ ID NO: 3215340 - protein, 5 aa, Plasmodium falciparum
DVNTE

SEQ ID NO: 3215341 - protein, 12 aa, Plasmodium falciparum
DVNTPNNLKEND

SEQ ID NO: 3215342 - protein, 6 aa, Plasmodium falciparum
DVNTST

SEQ ID NO: 3215343 - protein, 6 aa, Plasmodium falciparum
DVPDDE

SEQ ID NO: 3215344 - protein, 4 aa, Plasmodium falciparum
DVPE

SEQ ID NO: 3215345 - protein, 5 aa, Plasmodium falciparum
DVPSR

SEQ ID NO: 3215346 - protein, 11 aa, Plasmodium falciparum
DVPSSGPMGNK

SEQ ID NO: 3215347 - protein, 8 aa, Plasmodium falciparum
DVQDEYDE

SEQ ID NO: 3215348 - protein, 10 aa, Plasmodium falciparum
DVQENSSKVV

SEQ ID NO: 3215349 - protein, 23 aa, Plasmodium falciparum
DVQGNSQHDNNLPGSNSVEYNPY

SEQ ID NO: 3215350 - protein, 7 aa, Plasmodium falciparum
DVQNSEN

SEQ ID NO: 3215351 - protein, 6 aa, Plasmodium falciparum
DVQTGG

SEQ ID NO: 3215352 - protein, 11 aa, Plasmodium falciparum
DVRGKQNFRNS

SEQ ID NO: 3215353 - protein, 23 aa, Plasmodium falciparum
DVRNDVKDDVRNDVKGDKKNDDI

SEQ ID NO: 3215354 - protein, 9 aa, Plasmodium falciparum
DVRYKRNGA

SEQ ID NO: 3215355 - protein, 8 aa, Plasmodium falciparum
DVSDNEEI

SEQ ID NO: 3215356 - protein, 7 aa, Plasmodium falciparum
DVSKKSS

SEQ ID NO: 3215357 - protein, 24 aa, Plasmodium falciparum
DVSNNDPKKDNNEKNTSSNNITHN

SEQ ID NO: 3215358 - protein, 15 aa, Plasmodium falciparum
DVSNSDDSNHTDNMK

SEQ ID NO: 3215359 - protein, 19 aa, Plasmodium falciparum
DVSPPSENPQTKLEGGNIP

SEQ ID NO: 3215360 - protein, 7 aa, Plasmodium falciparum
DVSPTED

SEQ ID NO: 3215361 - protein, 21 aa, Plasmodium falciparum
DVSQKKTDDINESASSDSENI

SEQ ID NO: 3215362 - protein, 15 aa, Plasmodium falciparum
DVSSSTNTLSYSNTS

SEQ ID NO: 3215363 - protein, 12 aa, Plasmodium falciparum
DVSTAGSNAMDV

SEQ ID NO: 3215364 - protein, 7 aa, Plasmodium falciparum
DVSTNKK

SEQ ID NO: 3215365 - protein, 7 aa, Plasmodium falciparum
DVSTVDS

SEQ ID NO: 3215366 - protein, 8 aa, Plasmodium falciparum
DVTGEDDS

SEQ ID NO: 3215367 - protein, 11 aa, Plasmodium falciparum
DVTKNDEEGHE

SEQ ID NO: 3215368 - protein, 24 aa, Plasmodium falciparum
DVTKSGNNKDALQERYQKDEKDGN

SEQ ID NO: 3215369 - protein, 23 aa, Plasmodium falciparum
DVTSSGSNKEALQERYNGDKENY

SEQ ID NO: 3215370 - protein, 12 aa, Plasmodium falciparum
DVYDKSEELTMN

SEQ ID NO: 3215371 - protein, 6 aa, Plasmodium falciparum
DVYDNN

SEQ ID NO: 3215372 - protein, 12 aa, Plasmodium falciparum
DVYEKGDNTYKY

SEQ ID NO: 3215373 - protein, 8 aa, Plasmodium falciparum
DVYSNNNK

SEQ ID NO: 3215374 - protein, 9 aa, Plasmodium falciparum
DWGKDTKGQ

SEQ ID NO: 3215375 - protein, 6 aa, Plasmodium falciparum
DWKREE

SEQ ID NO: 3215376 - protein, 5 aa, Plasmodium falciparum
DWTGN

SEQ ID NO: 3215377 - protein, 4 aa, Plasmodium falciparum
DYAD

SEQ ID NO: 3215378 - protein, 7 aa, Plasmodium falciparum
DYANETY

SEQ ID NO: 3215379 - protein, 6 aa, Plasmodium falciparum
DYCDNT

SEQ ID NO: 3215380 - protein, 9 aa, Plasmodium falciparum
DYDADDEEY

SEQ ID NO: 3215381 - protein, 8 aa, Plasmodium falciparum
DYDDDDDN

SEQ ID NO: 3215382 - protein, 10 aa, Plasmodium falciparum
DYDDDNMGNN

SEQ ID NO: 3215383 - protein, 6 aa, Plasmodium falciparum
DYDDET

SEQ ID NO: 3215384 - protein, 33 aa, Plasmodium falciparum
DYDDYDDDDNNDDNNDNNNNNNDDNNNNNDDDY

SEQ ID NO: 3215385 - protein, 4 aa, Plasmodium falciparum
DYDE

SEQ ID NO: 3215386 - protein, 6 aa, Plasmodium falciparum
DYDERE

SEQ ID NO: 3215387 - protein, 9 aa, Plasmodium falciparum
DYDGTGSAI

SEQ ID NO: 3215388 - protein, 11 aa, Plasmodium falciparum
DYDIPTKLSPN

SEQ ID NO: 3215389 - protein, 13 aa, Plasmodium falciparum
DYDIPTPKSSNRY

SEQ ID NO: 3215390 - protein, 22 aa, Plasmodium falciparum
DYDKKKKKKNTLETYDSDTKNS

SEQ ID NO: 3215391 - protein, 7 aa, Plasmodium falciparum
DYDKRNK

SEQ ID NO: 3215392 - protein, 4 aa, Plasmodium falciparum
DYDN

SEQ ID NO: 3215393 - protein, 6 aa, Plasmodium falciparum
DYDNSS

SEQ ID NO: 3215394 - protein, 6 aa, Plasmodium falciparum
DYDPEV

SEQ ID NO: 3215395 - protein, 8 aa, Plasmodium falciparum
DYDRRGTN

SEQ ID NO: 3215396 - protein, 4 aa, Plasmodium falciparum
DYDT

SEQ ID NO: 3215397 - protein, 7 aa, Plasmodium falciparum
DYDTNGK

SEQ ID NO: 3215398 - protein, 4 aa, Plasmodium falciparum
DYED

SEQ ID NO: 3215399 - protein, 5 aa, Plasmodium falciparum
DYEDV

SEQ ID NO: 3215400 - protein, 28 aa, Plasmodium falciparum
DYEDYEENEKGHREETYKEYEKKSHSTY

SEQ ID NO: 3215401 - protein, 19 aa, Plasmodium falciparum
DYEEKEEENDLSNNKKSDK

SEQ ID NO: 3215402 - protein, 15 aa, Plasmodium falciparum
DYEEQNPENKVGKPA

SEQ ID NO: 3215403 - protein, 9 aa, Plasmodium falciparum
DYEERKEKR

SEQ ID NO: 3215404 - protein, 12 aa, Plasmodium falciparum
DYEKRGANKNEH

SEQ ID NO: 3215405 - protein, 5 aa, Plasmodium falciparum
DYEKY

SEQ ID NO: 3215406 - protein, 10 aa, Plasmodium falciparum
DYENSNNNMN

SEQ ID NO: 3215407 - protein, 5 aa, Plasmodium falciparum
DYEQE

SEQ ID NO: 3215408 - protein, 89 aa, Plasmodium falciparum
DYERNKKERKKKNTNLYPTNSQTNNNENDDNNNNNNNNNNNNNNNNNNNNNNNNNDSRGDVNKPKNNNSFNNNSETKEGNKKKKKNHSD

SEQ ID NO: 3215409 - protein, 9 aa, Plasmodium falciparum
DYESDETKI

SEQ ID NO: 3215410 - protein, 10 aa, Plasmodium falciparum
DYGIEKKETY

SEQ ID NO: 3215411 - protein, 7 aa, Plasmodium falciparum
DYGMPTL

SEQ ID NO: 3215412 - protein, 10 aa, Plasmodium falciparum
DYGNKKEYHE

SEQ ID NO: 3215413 - protein, 4 aa, Plasmodium falciparum
DYGS

SEQ ID NO: 3215414 - protein, 13 aa, Plasmodium falciparum
DYHKRKTTKYEEY

SEQ ID NO: 3215415 - protein, 4 aa, Plasmodium falciparum
DYHQ

SEQ ID NO: 3215416 - protein, 23 aa, Plasmodium falciparum
DYIEKGNEKSVSSKKGEETYTNN

SEQ ID NO: 3215417 - protein, 4 aa, Plasmodium falciparum
DYIN

SEQ ID NO: 3215418 - protein, 6 aa, Plasmodium falciparum
DYKDAK

SEQ ID NO: 3215419 - protein, 8 aa, Plasmodium falciparum
DYKESTAI

SEQ ID NO: 3215420 - protein, 15 aa, Plasmodium falciparum
DYKGNNKNRKQDDVI

SEQ ID NO: 3215421 - protein, 14 aa, Plasmodium falciparum
DYKGRKKRNEDEDY

SEQ ID NO: 3215422 - protein, 5 aa, Plasmodium falciparum
DYKKK

SEQ ID NO: 3215423 - protein, 8 aa, Plasmodium falciparum
DYKNKEKL

SEQ ID NO: 3215424 - protein, 5 aa, Plasmodium falciparum
DYKPS

SEQ ID NO: 3215425 - protein, 10 aa, Plasmodium falciparum
DYKSKNDKEG

SEQ ID NO: 3215426 - protein, 8 aa, Plasmodium falciparum
DYKSNVSN

SEQ ID NO: 3215427 - protein, 6 aa, Plasmodium falciparum
DYKTAK

SEQ ID NO: 3215428 - protein, 9 aa, Plasmodium falciparum
DYLKDNEPN

SEQ ID NO: 3215429 - protein, 5 aa, Plasmodium falciparum
DYLKN

SEQ ID NO: 3215430 - protein, 8 aa, Plasmodium falciparum
DYNDDYND

SEQ ID NO: 3215431 - protein, 12 aa, Plasmodium falciparum
DYNESNKESKGL

SEQ ID NO: 3215432 - protein, 10 aa, Plasmodium falciparum
DYNKNNGDRL

SEQ ID NO: 3215433 - protein, 12 aa, Plasmodium falciparum
DYNNNGNGRNGC

SEQ ID NO: 3215434 - protein, 7 aa, Plasmodium falciparum
DYNNNNK

SEQ ID NO: 3215435 - protein, 13 aa, Plasmodium falciparum
DYNNYNSDNKNHN

SEQ ID NO: 3215436 - protein, 41 aa, Plasmodium falciparum
DYNPDRKKTRDDLNDDNENSCSSFTRRGKYNKTKTIKKSNK

SEQ ID NO: 3215437 - protein, 6 aa, Plasmodium falciparum
DYNPSL

SEQ ID NO: 3215438 - protein, 6 aa, Plasmodium falciparum
DYNRNN

SEQ ID NO: 3215439 - protein, 8 aa, Plasmodium falciparum
DYNSSNTY

SEQ ID NO: 3215440 - protein, 11 aa, Plasmodium falciparum
DYNTSNNINSE

SEQ ID NO: 3215441 - protein, 12 aa, Plasmodium falciparum
DYPGTTDSSQNH

SEQ ID NO: 3215442 - protein, 13 aa, Plasmodium falciparum
DYPHKQHRTYRNA

SEQ ID NO: 3215443 - protein, 8 aa, Plasmodium falciparum
DYPKEKNN

SEQ ID NO: 3215444 - protein, 5 aa, Plasmodium falciparum
DYQKS

SEQ ID NO: 3215445 - protein, 52 aa, Plasmodium falciparum
DYQNQDKDKDKDIDHDKDKDNDKDNDQDNDKDNDQDNDKDNDNDQDYDQDYD

SEQ ID NO: 3215446 - protein, 5 aa, Plasmodium falciparum
DYQTT

SEQ ID NO: 3215447 - protein, 10 aa, Plasmodium falciparum
DYSEKSQKPF

SEQ ID NO: 3215448 - protein, 5 aa, Plasmodium falciparum
DYSET

SEQ ID NO: 3215449 - protein, 10 aa, Plasmodium falciparum
DYSGIKTNQD

SEQ ID NO: 3215450 - protein, 4 aa, Plasmodium falciparum
DYSH

SEQ ID NO: 3215451 - protein, 5 aa, Plasmodium falciparum
DYSKD

SEQ ID NO: 3215452 - protein, 5 aa, Plasmodium falciparum
DYSNR

SEQ ID NO: 3215453 - protein, 5 aa, Plasmodium falciparum
DYSPP

SEQ ID NO: 3215454 - protein, 8 aa, Plasmodium falciparum
DYSQEKQK

SEQ ID NO: 3215455 - protein, 13 aa, Plasmodium falciparum
DYSQKKKKKMNHE

SEQ ID NO: 3215456 - protein, 20 aa, Plasmodium falciparum
DYSQQNNNIENNNVNNYTEQ

SEQ ID NO: 3215457 - protein, 19 aa, Plasmodium falciparum
DYSSKDMENNEEKKDKEAN

SEQ ID NO: 3215458 - protein, 6 aa, Plasmodium falciparum
DYSSLK

SEQ ID NO: 3215459 - protein, 8 aa, Plasmodium falciparum
DYSSPNLD

SEQ ID NO: 3215460 - protein, 10 aa, Plasmodium falciparum
DYSSSDTSNY

SEQ ID NO: 3215461 - protein, 72 aa, Plasmodium falciparum
DYSSSNDNLSDEQEYFTTSDDSEEEKKHNEKINKKRKKCKKYKKRRGKLREKKKGKSNLYHNGKNKKNVSNC

SEQ ID NO: 3215462 - protein, 28 aa, Plasmodium falciparum
DYTEGDIEKKEETEKSGGTNQKDVQGGH

SEQ ID NO: 3215463 - protein, 15 aa, Plasmodium falciparum
DYTNHIPTNENPNSY

SEQ ID NO: 3215464 - protein, 5 aa, Plasmodium falciparum
DYTNN

SEQ ID NO: 3215465 - protein, 8 aa, Plasmodium falciparum
DYTNRGTN

SEQ ID NO: 3215466 - protein, 7 aa, Plasmodium falciparum
DYTPVTK

SEQ ID NO: 3215467 - protein, 5 aa, Plasmodium falciparum
DYTSA

SEQ ID NO: 3215468 - protein, 6 aa, Plasmodium falciparum
DYTYNS

SEQ ID NO: 3215469 - protein, 5 aa, Plasmodium falciparum
DYYET

SEQ ID NO: 3215470 - protein, 34 aa, Plasmodium falciparum
DYYGNGNNYENGSYYDSDTYSNIDDSESGDDNPI

SEQ ID NO: 3215471 - protein, 40 aa, Plasmodium falciparum
DYYGNGNNYENGSYYGNGSYYDSDTYSNSDDSESGDDNPI

SEQ ID NO: 3215472 - protein, 11 aa, Plasmodium falciparum
DYYNNRGKTNS

SEQ ID NO: 3215473 - protein, 11 aa, Plasmodium falciparum
DYYNSSDYTNI

SEQ ID NO: 3215474 - protein, 8 aa, Plasmodium falciparum
EAAEEGEY

SEQ ID NO: 3215475 - protein, 17 aa, Plasmodium falciparum
EAAEKAGAAAAAEAGKN

SEQ ID NO: 3215476 - protein, 8 aa, Plasmodium falciparum
EAAGKARG

SEQ ID NO: 3215477 - protein, 4 aa, Plasmodium falciparum
EAAK

SEQ ID NO: 3215478 - protein, 19 aa, Plasmodium falciparum
EAAKAASAAGEAAKNAEKA

SEQ ID NO: 3215479 - protein, 5 aa, Plasmodium falciparum
EAAKE

SEQ ID NO: 3215480 - protein, 10 aa, Plasmodium falciparum
EAANSAGIQA

SEQ ID NO: 3215481 - protein, 6 aa, Plasmodium falciparum
EAASGI

SEQ ID NO: 3215482 - protein, 6 aa, Plasmodium falciparum
EAASSL

SEQ ID NO: 3215483 - protein, 10 aa, Plasmodium falciparum
EAATDNKYDN

SEQ ID NO: 3215484 - protein, 7 aa, Plasmodium falciparum
EAATESG

SEQ ID NO: 3215485 - protein, 7 aa, Plasmodium falciparum
EAATSMS

SEQ ID NO: 3215486 - protein, 7 aa, Plasmodium falciparum
EAATTSY

SEQ ID NO: 3215487 - protein, 5 aa, Plasmodium falciparum
EACNG

SEQ ID NO: 3215488 - protein, 37 aa, Plasmodium falciparum
EADAENESDQNDNNEEEETDKSDVEENIDNDENEDMD

SEQ ID NO: 3215489 - protein, 13 aa, Plasmodium falciparum
EADFTKKDNCENN

SEQ ID NO: 3215490 - protein, 10 aa, Plasmodium falciparum
EADTKNRPLK

SEQ ID NO: 3215491 - protein, 18 aa, Plasmodium falciparum
EAEDDEDEENDIDNQEEE

SEQ ID NO: 3215492 - protein, 12 aa, Plasmodium falciparum
EAEKKPNLDNPK

SEQ ID NO: 3215493 - protein, 15 aa, Plasmodium falciparum
EAEKSGREDKNYINS

SEQ ID NO: 3215494 - protein, 22 aa, Plasmodium falciparum
EAERDATSGSVKKRTQLSKEDQ

SEQ ID NO: 3215495 - protein, 13 aa, Plasmodium falciparum
EAFRKQKEKYAKE

SEQ ID NO: 3215496 - protein, 7 aa, Plasmodium falciparum
EAFTPAT

SEQ ID NO: 3215497 - protein, 6 aa, Plasmodium falciparum
EAGDAA

SEQ ID NO: 3215498 - protein, 14 aa, Plasmodium falciparum
EAGEKAAADATAAV

SEQ ID NO: 3215499 - protein, 7 aa, Plasmodium falciparum
EAGEVTG

SEQ ID NO: 3215500 - protein, 12 aa, Plasmodium falciparum
EAGGDTKKSENC

SEQ ID NO: 3215501 - protein, 12 aa, Plasmodium falciparum
EAGGKKTLTETY

SEQ ID NO: 3215502 - protein, 18 aa, Plasmodium falciparum
EAGKQAATAATESAKTTK

SEQ ID NO: 3215503 - protein, 8 aa, Plasmodium falciparum
EAGNAKDK

SEQ ID NO: 3215504 - protein, 7 aa, Plasmodium falciparum
EAGSSAC

SEQ ID NO: 3215505 - protein, 10 aa, Plasmodium falciparum
EAGTDAYNTT

SEQ ID NO: 3215506 - protein, 9 aa, Plasmodium falciparum
EAHTENNNE

SEQ ID NO: 3215507 - protein, 4 aa, Plasmodium falciparum
EAIH

SEQ ID NO: 3215508 - protein, 5 aa, Plasmodium falciparum
EAKAD

SEQ ID NO: 3215509 - protein, 5 aa, Plasmodium falciparum
EAKDM

SEQ ID NO: 3215510 - protein, 17 aa, Plasmodium falciparum
EAKEIRKKRKNEKSEKN

SEQ ID NO: 3215511 - protein, 15 aa, Plasmodium falciparum
EAKKHASDRTKTFSK

SEQ ID NO: 3215512 - protein, 18 aa, Plasmodium falciparum
EAKNNMDKDDSNNNNNIQ

SEQ ID NO: 3215513 - protein, 8 aa, Plasmodium falciparum
EAKSDDKY

SEQ ID NO: 3215514 - protein, 4 aa, Plasmodium falciparum
EALL

SEQ ID NO: 3215515 - protein, 12 aa, Plasmodium falciparum
EALSSTDRDHTR

SEQ ID NO: 3215516 - protein, 12 aa, Plasmodium falciparum
EANESNNNNNIN

SEQ ID NO: 3215517 - protein, 12 aa, Plasmodium falciparum
EANKKPKETKYQ

SEQ ID NO: 3215518 - protein, 34 aa, Plasmodium falciparum
EANKSSASKRSKRSTDGTTTDTLTPTTPYSTAEG

SEQ ID NO: 3215519 - protein, 4 aa, Plasmodium falciparum
EANM

SEQ ID NO: 3215520 - protein, 16 aa, Plasmodium falciparum
EANNKPKKDNGQQDYT

SEQ ID NO: 3215521 - protein, 19 aa, Plasmodium falciparum
EANNNMNNKKPAKKAMDNS

SEQ ID NO: 3215522 - protein, 11 aa, Plasmodium falciparum
EANNPSIKKDT

SEQ ID NO: 3215523 - protein, 6 aa, Plasmodium falciparum
EANNYY

SEQ ID NO: 3215524 - protein, 9 aa, Plasmodium falciparum
EANRSSGMS

SEQ ID NO: 3215525 - protein, 21 aa, Plasmodium falciparum
EANTQLNSPRPVHTRNTTNIN

SEQ ID NO: 3215526 - protein, 15 aa, Plasmodium falciparum
EANVEKNNVVNTNKE

SEQ ID NO: 3215527 - protein, 4 aa, Plasmodium falciparum
EAPE

SEQ ID NO: 3215528 - protein, 5 aa, Plasmodium falciparum
EAPEN

SEQ ID NO: 3215529 - protein, 6 aa, Plasmodium falciparum
EAPGYE

SEQ ID NO: 3215530 - protein, 6 aa, Plasmodium falciparum
EAPSAN

SEQ ID NO: 3215531 - protein, 47 aa, Plasmodium falciparum
EAQECKDNNREEKNCSKEPHDDLDDEDDLYEDETHYNPCSAQPGGRY

SEQ ID NO: 3215532 - protein, 30 aa, Plasmodium falciparum
EAQECKNNNPEDQKCNEPHDEEEYEDEHEE

SEQ ID NO: 3215533 - protein, 8 aa, Plasmodium falciparum
EAQEKKKE

SEQ ID NO: 3215534 - protein, 17 aa, Plasmodium falciparum
EAQENGNSSHKSTTEQD

SEQ ID NO: 3215535 - protein, 9 aa, Plasmodium falciparum
EAQGDPKAI

SEQ ID NO: 3215536 - protein, 6 aa, Plasmodium falciparum
EAQNDP

SEQ ID NO: 3215537 - protein, 7 aa, Plasmodium falciparum
EAQNDSR

SEQ ID NO: 3215538 - protein, 4 aa, Plasmodium falciparum
EAQR

SEQ ID NO: 3215539 - protein, 24 aa, Plasmodium falciparum
EARGEKHRDERNRNSHHDDDNNHH

SEQ ID NO: 3215540 - protein, 9 aa, Plasmodium falciparum
EARGNIPED

SEQ ID NO: 3215541 - protein, 17 aa, Plasmodium falciparum
EARKENPNENLTPEEEE

SEQ ID NO: 3215542 - protein, 23 aa, Plasmodium falciparum
EARNPQVENPSKTKEDFSYPPKT

SEQ ID NO: 3215543 - protein, 10 aa, Plasmodium falciparum
EARRYEDEKR

SEQ ID NO: 3215544 - protein, 5 aa, Plasmodium falciparum
EARTE

SEQ ID NO: 3215545 - protein, 7 aa, Plasmodium falciparum
EASDGLK

SEQ ID NO: 3215546 - protein, 4 aa, Plasmodium falciparum
EASE

SEQ ID NO: 3215547 - protein, 5 aa, Plasmodium falciparum
EASEK

SEQ ID NO: 3215548 - protein, 8 aa, Plasmodium falciparum
EASNTSCD

SEQ ID NO: 3215549 - protein, 10 aa, Plasmodium falciparum
EASPEEHNNL

SEQ ID NO: 3215550 - protein, 8 aa, Plasmodium falciparum
EASQRRRE

SEQ ID NO: 3215551 - protein, 5 aa, Plasmodium falciparum
EASRG

SEQ ID NO: 3215552 - protein, 10 aa, Plasmodium falciparum
EASSDKNIET

SEQ ID NO: 3215553 - protein, 6 aa, Plasmodium falciparum
EASVTE

SEQ ID NO: 3215554 - protein, 19 aa, Plasmodium falciparum
EATASQNDDNNNEDSSNEM

SEQ ID NO: 3215555 - protein, 30 aa, Plasmodium falciparum
EATEAQAGGDEATEASVPLGDGVSKNPKEA

SEQ ID NO: 3215556 - protein, 6 aa, Plasmodium falciparum
EATEDN

SEQ ID NO: 3215557 - protein, 22 aa, Plasmodium falciparum
EATEVTNKEQQIVNEEKKKTEI

SEQ ID NO: 3215558 - protein, 5 aa, Plasmodium falciparum
EATNA

SEQ ID NO: 3215559 - protein, 7 aa, Plasmodium falciparum
EATNAGV

SEQ ID NO: 3215560 - protein, 16 aa, Plasmodium falciparum
EATNNKNKAQEKLDQL

SEQ ID NO: 3215561 - protein, 26 aa, Plasmodium falciparum
EATQSDYTYEDEDINSYKTSSDTSSF

SEQ ID NO: 3215562 - protein, 21 aa, Plasmodium falciparum
EAVEESESITESVSQEEETEK

SEQ ID NO: 3215563 - protein, 11 aa, Plasmodium falciparum
EAVTQGKTNAI

SEQ ID NO: 3215564 - protein, 4 aa, Plasmodium falciparum
EAWG

SEQ ID NO: 3215565 - protein, 17 aa, Plasmodium falciparum
EAYDDNDKENNKDMKKK

SEQ ID NO: 3215566 - protein, 4 aa, Plasmodium falciparum
EAYG

SEQ ID NO: 3215567 - protein, 14 aa, Plasmodium falciparum
EAYGDERESKELEE

SEQ ID NO: 3215568 - protein, 9 aa, Plasmodium falciparum
EAYGKPEDI

SEQ ID NO: 3215569 - protein, 13 aa, Plasmodium falciparum
EAYTNSNKHSSKN

SEQ ID NO: 3215570 - protein, 19 aa, Plasmodium falciparum
ECDGKSPQAPKKEEEKKDA

SEQ ID NO: 3215571 - protein, 4 aa, Plasmodium falciparum
ECDP

SEQ ID NO: 3215572 - protein, 29 aa, Plasmodium falciparum
ECEEKPQRPQPGPPPRPGGESQQPHNDGD

SEQ ID NO: 3215573 - protein, 13 aa, Plasmodium falciparum
ECEHKNHNSNKYD

SEQ ID NO: 3215574 - protein, 19 aa, Plasmodium falciparum
ECEKTKEADHRVNEDTDDI

SEQ ID NO: 3215575 - protein, 5 aa, Plasmodium falciparum
ECENN

SEQ ID NO: 3215576 - protein, 7 aa, Plasmodium falciparum
ECKKYGR

SEQ ID NO: 3215577 - protein, 5 aa, Plasmodium falciparum
ECKNH

SEQ ID NO: 3215578 - protein, 8 aa, Plasmodium falciparum
ECKPEDEI

SEQ ID NO: 3215579 - protein, 9 aa, Plasmodium falciparum
ECKPNDPTL

SEQ ID NO: 3215580 - protein, 13 aa, Plasmodium falciparum
ECKRKSVDNITKG

SEQ ID NO: 3215581 - protein, 8 aa, Plasmodium falciparum
ECNEDEKK

SEQ ID NO: 3215582 - protein, 7 aa, Plasmodium falciparum
ECNNNQN

SEQ ID NO: 3215583 - protein, 9 aa, Plasmodium falciparum
ECNNQYSSY

SEQ ID NO: 3215584 - protein, 13 aa, Plasmodium falciparum
ECNSNGYSSLNSS

SEQ ID NO: 3215585 - protein, 28 aa, Plasmodium falciparum
ECPEKSNKKYSNLKQKDNSDNEEKGTIT

SEQ ID NO: 3215586 - protein, 5 aa, Plasmodium falciparum
ECPPK

SEQ ID NO: 3215587 - protein, 7 aa, Plasmodium falciparum
ECPPKEN

SEQ ID NO: 3215588 - protein, 6 aa, Plasmodium falciparum
ECPPND

SEQ ID NO: 3215589 - protein, 4 aa, Plasmodium falciparum
ECRE

SEQ ID NO: 3215590 - protein, 4 aa, Plasmodium falciparum
ECRG

SEQ ID NO: 3215591 - protein, 7 aa, Plasmodium falciparum
ECRGPYG

SEQ ID NO: 3215592 - protein, 26 aa, Plasmodium falciparum
ECRSGTGGHEYCSGDGHDCTDNDRKY

SEQ ID NO: 3215593 - protein, 16 aa, Plasmodium falciparum
ECSNNMNDKETQNGFD

SEQ ID NO: 3215594 - protein, 11 aa, Plasmodium falciparum
ECSNYKENNEM

SEQ ID NO: 3215595 - protein, 5 aa, Plasmodium falciparum
ECSRN

SEQ ID NO: 3215596 - protein, 24 aa, Plasmodium falciparum
ECSSDNDENKDHENNEEDKNKDEM

SEQ ID NO: 3215597 - protein, 7 aa, Plasmodium falciparum
ECSSDTC

SEQ ID NO: 3215598 - protein, 12 aa, Plasmodium falciparum
ECTKSQASSRNF

SEQ ID NO: 3215599 - protein, 37 aa, Plasmodium falciparum
ECTPNKNDKNVNRTDINNQNKTNEKLCDKKEKKRLPS

SEQ ID NO: 3215600 - protein, 4 aa, Plasmodium falciparum
ECTQ

SEQ ID NO: 3215601 - protein, 5 aa, Plasmodium falciparum
EDADE

SEQ ID NO: 3215602 - protein, 6 aa, Plasmodium falciparum
EDAEEY

SEQ ID NO: 3215603 - protein, 8 aa, Plasmodium falciparum
EDAEGDDK

SEQ ID NO: 3215604 - protein, 15 aa, Plasmodium falciparum
EDAEKRGKSLKGDYK

SEQ ID NO: 3215605 - protein, 8 aa, Plasmodium falciparum
EDAEVAGT

SEQ ID NO: 3215606 - protein, 8 aa, Plasmodium falciparum
EDAKDNKN

SEQ ID NO: 3215607 - protein, 12 aa, Plasmodium falciparum
EDAKNIHSKGWK

SEQ ID NO: 3215608 - protein, 9 aa, Plasmodium falciparum
EDAPATEEI

SEQ ID NO: 3215609 - protein, 6 aa, Plasmodium falciparum
EDASKI

SEQ ID NO: 3215610 - protein, 7 aa, Plasmodium falciparum
EDASNDI

SEQ ID NO: 3215611 - protein, 9 aa, Plasmodium falciparum
EDAVKGDPF

SEQ ID NO: 3215612 - protein, 5 aa, Plasmodium falciparum
EDAWS

SEQ ID NO: 3215613 - protein, 4 aa, Plasmodium falciparum
EDCI

SEQ ID NO: 3215614 - protein, 8 aa, Plasmodium falciparum
EDDANNHQ

SEQ ID NO: 3215615 - protein, 10 aa, Plasmodium falciparum
EDDDKTELDD

SEQ ID NO: 3215616 - protein, 9 aa, Plasmodium falciparum
EDDDNDKNS

SEQ ID NO: 3215617 - protein, 5 aa, Plasmodium falciparum
EDDDY

SEQ ID NO: 3215618 - protein, 4 aa, Plasmodium falciparum
EDDE

SEQ ID NO: 3215619 - protein, 10 aa, Plasmodium falciparum
EDDEDEENNM

SEQ ID NO: 3215620 - protein, 12 aa, Plasmodium falciparum
EDDEDIYDNKNG

SEQ ID NO: 3215621 - protein, 41 aa, Plasmodium falciparum
EDDEEDEEDDGDDDDDDDDDYDDEDEEEEDMKKKNYKNVPT

SEQ ID NO: 3215622 - protein, 16 aa, Plasmodium falciparum
EDDEENDEEEDSNEFA

SEQ ID NO: 3215623 - protein, 27 aa, Plasmodium falciparum
EDDEGGGPRGQTSSPSSGEKTTLNNPK

SEQ ID NO: 3215624 - protein, 7 aa, Plasmodium falciparum
EDDETQV

SEQ ID NO: 3215625 - protein, 13 aa, Plasmodium falciparum
EDDHSSSNVTNEV

SEQ ID NO: 3215626 - protein, 6 aa, Plasmodium falciparum
EDDIDH

SEQ ID NO: 3215627 - protein, 10 aa, Plasmodium falciparum
EDDIKNNNCD

SEQ ID NO: 3215628 - protein, 5 aa, Plasmodium falciparum
EDDKG

SEQ ID NO: 3215629 - protein, 6 aa, Plasmodium falciparum
EDDLEE

SEQ ID NO: 3215630 - protein, 4 aa, Plasmodium falciparum
EDDM

SEQ ID NO: 3215631 - protein, 15 aa, Plasmodium falciparum
EDDMKNNDYDNKINN

SEQ ID NO: 3215632 - protein, 7 aa, Plasmodium falciparum
EDDNKNT

SEQ ID NO: 3215633 - protein, 10 aa, Plasmodium falciparum
EDDNKRNINV

SEQ ID NO: 3215634 - protein, 16 aa, Plasmodium falciparum
EDDNNEKKEKKQKKKQ

SEQ ID NO: 3215635 - protein, 14 aa, Plasmodium falciparum
EDDNVDGHHKKTKA

SEQ ID NO: 3215636 - protein, 7 aa, Plasmodium falciparum
EDDQKNN

SEQ ID NO: 3215637 - protein, 8 aa, Plasmodium falciparum
EDDRSNDT

SEQ ID NO: 3215638 - protein, 21 aa, Plasmodium falciparum
EDDSDETRPKIGTSPSGEKTY

SEQ ID NO: 3215639 - protein, 7 aa, Plasmodium falciparum
EDDSNKK

SEQ ID NO: 3215640 - protein, 14 aa, Plasmodium falciparum
EDDSSIKQSRGYRA

SEQ ID NO: 3215641 - protein, 7 aa, Plasmodium falciparum
EDDSSKI

SEQ ID NO: 3215642 - protein, 84 aa, Plasmodium falciparum
EDDTTEQQEEEQDTCTPAGTVKEEEEEKEEKKDKGDEEEESPSGNSAPDPPESPSAGPNHNQHPPAIPTPATPAADPPQADEPF

SEQ ID NO: 3215643 - protein, 4 aa, Plasmodium falciparum
EDDY

SEQ ID NO: 3215644 - protein, 6 aa, Plasmodium falciparum
EDEAQK

SEQ ID NO: 3215645 - protein, 19 aa, Plasmodium falciparum
EDEDAAERNSNEVNDNNRN

SEQ ID NO: 3215646 - protein, 10 aa, Plasmodium falciparum
EDEDERNERI

SEQ ID NO: 3215647 - protein, 8 aa, Plasmodium falciparum
EDEEEDMT

SEQ ID NO: 3215648 - protein, 10 aa, Plasmodium falciparum
EDEEERRNYD

SEQ ID NO: 3215649 - protein, 17 aa, Plasmodium falciparum
EDEEGSINNEYDDSVEA

SEQ ID NO: 3215650 - protein, 6 aa, Plasmodium falciparum
EDEEIR

SEQ ID NO: 3215651 - protein, 12 aa, Plasmodium falciparum
EDEEKEKEETYY

SEQ ID NO: 3215652 - protein, 19 aa, Plasmodium falciparum
EDEEKERKKKDLELKKKED

SEQ ID NO: 3215653 - protein, 6 aa, Plasmodium falciparum
EDEEKQ

SEQ ID NO: 3215654 - protein, 16 aa, Plasmodium falciparum
EDEENGPKTGSSTQPL

SEQ ID NO: 3215655 - protein, 14 aa, Plasmodium falciparum
EDEENTKDEVSNDD

SEQ ID NO: 3215656 - protein, 7 aa, Plasmodium falciparum
EDEEQNT

SEQ ID NO: 3215657 - protein, 47 aa, Plasmodium falciparum
EDEFNTKEKVKKKHRDDKYNKKEKSKKKHRDDKYNKKEKSKKKYVED

SEQ ID NO: 3215658 - protein, 10 aa, Plasmodium falciparum
EDEHKDEYKD

SEQ ID NO: 3215659 - protein, 10 aa, Plasmodium falciparum
EDEHKDNTDR

SEQ ID NO: 3215660 - protein, 4 aa, Plasmodium falciparum
EDEI

SEQ ID NO: 3215661 - protein, 6 aa, Plasmodium falciparum
EDEIDD

SEQ ID NO: 3215662 - protein, 23 aa, Plasmodium falciparum
EDEIDSIGDSRNDNNHNKKNDDS

SEQ ID NO: 3215663 - protein, 4 aa, Plasmodium falciparum
EDEK

SEQ ID NO: 3215664 - protein, 5 aa, Plasmodium falciparum
EDEKE

SEQ ID NO: 3215665 - protein, 8 aa, Plasmodium falciparum
EDEKGNNE

SEQ ID NO: 3215666 - protein, 5 aa, Plasmodium falciparum
EDEKK

SEQ ID NO: 3215667 - protein, 12 aa, Plasmodium falciparum
EDEKKKKDDMEN

SEQ ID NO: 3215668 - protein, 9 aa, Plasmodium falciparum
EDEKKKNTL

SEQ ID NO: 3215669 - protein, 10 aa, Plasmodium falciparum
EDEKNEKMKN

SEQ ID NO: 3215670 - protein, 14 aa, Plasmodium falciparum
EDEKNKMRKNKRNN

SEQ ID NO: 3215671 - protein, 7 aa, Plasmodium falciparum
EDEKNPF

SEQ ID NO: 3215672 - protein, 8 aa, Plasmodium falciparum
EDEKTKSI

SEQ ID NO: 3215673 - protein, 10 aa, Plasmodium falciparum
EDEKTQPKKI

SEQ ID NO: 3215674 - protein, 8 aa, Plasmodium falciparum
EDEKTSNS

SEQ ID NO: 3215675 - protein, 4 aa, Plasmodium falciparum
EDEN

SEQ ID NO: 3215676 - protein, 30 aa, Plasmodium falciparum
EDENEYNSFDENEEENDEKTGDVNVGKTEA

SEQ ID NO: 3215677 - protein, 5 aa, Plasmodium falciparum
EDENI

SEQ ID NO: 3215678 - protein, 6 aa, Plasmodium falciparum
EDENKN

SEQ ID NO: 3215679 - protein, 10 aa, Plasmodium falciparum
EDENNNNKDI

SEQ ID NO: 3215680 - protein, 39 aa, Plasmodium falciparum
EDENSGTQALSPNAPASTASQTTQSSSTSENTPTTLTNP

SEQ ID NO: 3215681 - protein, 6 aa, Plasmodium falciparum
EDEQIE

SEQ ID NO: 3215682 - protein, 6 aa, Plasmodium falciparum
EDEQKN

SEQ ID NO: 3215683 - protein, 9 aa, Plasmodium falciparum
EDEQNNNTI

SEQ ID NO: 3215684 - protein, 18 aa, Plasmodium falciparum
EDEQNTVGKEKVGNKAPA

SEQ ID NO: 3215685 - protein, 6 aa, Plasmodium falciparum
EDERKG

SEQ ID NO: 3215686 - protein, 10 aa, Plasmodium falciparum
EDERNRQGDD

SEQ ID NO: 3215687 - protein, 15 aa, Plasmodium falciparum
EDESGAKTTGGDTPL

SEQ ID NO: 3215688 - protein, 20 aa, Plasmodium falciparum
EDESGGGPKPAGVNEAPPKL

SEQ ID NO: 3215689 - protein, 6 aa, Plasmodium falciparum
EDESIT

SEQ ID NO: 3215690 - protein, 22 aa, Plasmodium falciparum
EDESKESNQHNYKEGPSYEDKK

SEQ ID NO: 3215691 - protein, 6 aa, Plasmodium falciparum
EDESNE

SEQ ID NO: 3215692 - protein, 4 aa, Plasmodium falciparum
EDEY

SEQ ID NO: 3215693 - protein, 8 aa, Plasmodium falciparum
EDEYKKNK

SEQ ID NO: 3215694 - protein, 23 aa, Plasmodium falciparum
EDFDNSTKKIYDHDKKKDGHQYN

SEQ ID NO: 3215695 - protein, 4 aa, Plasmodium falciparum
EDFP

SEQ ID NO: 3215696 - protein, 10 aa, Plasmodium falciparum
EDGEGDLKDV

SEQ ID NO: 3215697 - protein, 7 aa, Plasmodium falciparum
EDGKTKE

SEQ ID NO: 3215698 - protein, 4 aa, Plasmodium falciparum
EDGN

SEQ ID NO: 3215699 - protein, 17 aa, Plasmodium falciparum
EDGSANEKIVEEEPSRV

SEQ ID NO: 3215700 - protein, 11 aa, Plasmodium falciparum
EDGVAKQNTTI

SEQ ID NO: 3215701 - protein, 8 aa, Plasmodium falciparum
EDHDNEDH

SEQ ID NO: 3215702 - protein, 6 aa, Plasmodium falciparum
EDHENY

SEQ ID NO: 3215703 - protein, 4 aa, Plasmodium falciparum
EDHI

SEQ ID NO: 3215704 - protein, 8 aa, Plasmodium falciparum
EDHKPSLK

SEQ ID NO: 3215705 - protein, 26 aa, Plasmodium falciparum
EDIDEDIEEDVEEDIEEDKVEDIDED

SEQ ID NO: 3215706 - protein, 6 aa, Plasmodium falciparum
EDIDHQ

SEQ ID NO: 3215707 - protein, 4 aa, Plasmodium falciparum
EDIE

SEQ ID NO: 3215708 - protein, 76 aa, Plasmodium falciparum
EDIEEETEEDIEEETEEETEEETEEEADEETVKEIEDKPEQEIKNKSLEEKQIDKNTDTSEKKGFNNSEKDEKARN

SEQ ID NO: 3215709 - protein, 6 aa, Plasmodium falciparum
EDIEKN

SEQ ID NO: 3215710 - protein, 8 aa, Plasmodium falciparum
EDIGLRDK

SEQ ID NO: 3215711 - protein, 30 aa, Plasmodium falciparum
EDIGRGDDEDITHNNNNNNNNNSNNSNNDI

SEQ ID NO: 3215712 - protein, 57 aa, Plasmodium falciparum
EDIHGKEDIHSNEDIHGNKDIHSNEDIHGNEDIHSNEDIHGKEDIHSNEDIHGKEDI

SEQ ID NO: 3215713 - protein, 6 aa, Plasmodium falciparum
EDIKEG

SEQ ID NO: 3215714 - protein, 17 aa, Plasmodium falciparum
EDINEDEKKKKMTGKEE

SEQ ID NO: 3215715 - protein, 13 aa, Plasmodium falciparum
EDINEPKNEDNIS

SEQ ID NO: 3215716 - protein, 20 aa, Plasmodium falciparum
EDINKSMNTNNYVDNKNENI

SEQ ID NO: 3215717 - protein, 5 aa, Plasmodium falciparum
EDINN

SEQ ID NO: 3215718 - protein, 9 aa, Plasmodium falciparum
EDINNEKEI

SEQ ID NO: 3215719 - protein, 12 aa, Plasmodium falciparum
EDINPPQKNDNS

SEQ ID NO: 3215720 - protein, 9 aa, Plasmodium falciparum
EDINSENKD

SEQ ID NO: 3215721 - protein, 13 aa, Plasmodium falciparum
EDIQKNKTEENYT

SEQ ID NO: 3215722 - protein, 4 aa, Plasmodium falciparum
EDIS

SEQ ID NO: 3215723 - protein, 9 aa, Plasmodium falciparum
EDISNDKSY

SEQ ID NO: 3215724 - protein, 4 aa, Plasmodium falciparum
EDIY

SEQ ID NO: 3215725 - protein, 14 aa, Plasmodium falciparum
EDIYNDEDEEHENE

SEQ ID NO: 3215726 - protein, 4 aa, Plasmodium falciparum
EDKA

SEQ ID NO: 3215727 - protein, 40 aa, Plasmodium falciparum
EDKANKCKTQTSGTDCHPSTPLEDDDEPLEETEENTVEQP

SEQ ID NO: 3215728 - protein, 14 aa, Plasmodium falciparum
EDKDKTKDDVEHSI

SEQ ID NO: 3215729 - protein, 9 aa, Plasmodium falciparum
EDKDNKKDN

SEQ ID NO: 3215730 - protein, 10 aa, Plasmodium falciparum
EDKDSHDSSS

SEQ ID NO: 3215731 - protein, 5 aa, Plasmodium falciparum
EDKEN

SEQ ID NO: 3215732 - protein, 11 aa, Plasmodium falciparum
EDKESIQPDED

SEQ ID NO: 3215733 - protein, 4 aa, Plasmodium falciparum
EDKI

SEQ ID NO: 3215734 - protein, 8 aa, Plasmodium falciparum
EDKIEQNI

SEQ ID NO: 3215735 - protein, 28 aa, Plasmodium falciparum
EDKIKEGKKKGKMKKISNKKSRKKKEAN

SEQ ID NO: 3215736 - protein, 9 aa, Plasmodium falciparum
EDKITDSGE

SEQ ID NO: 3215737 - protein, 14 aa, Plasmodium falciparum
EDKKEEDNLYSNDK

SEQ ID NO: 3215738 - protein, 25 aa, Plasmodium falciparum
EDKKESDNMKGDTSNIGNVNTNDFE

SEQ ID NO: 3215739 - protein, 37 aa, Plasmodium falciparum
EDKKFDDPKKNNIEKNDNNHNSKNNEYNENTKKDEQS

SEQ ID NO: 3215740 - protein, 15 aa, Plasmodium falciparum
EDKKKRKKKEQQQYI

SEQ ID NO: 3215741 - protein, 11 aa, Plasmodium falciparum
EDKKNDEKEKI

SEQ ID NO: 3215742 - protein, 9 aa, Plasmodium falciparum
EDKKNEETK

SEQ ID NO: 3215743 - protein, 12 aa, Plasmodium falciparum
EDKKNEKDDPNG

SEQ ID NO: 3215744 - protein, 4 aa, Plasmodium falciparum
EDKN

SEQ ID NO: 3215745 - protein, 6 aa, Plasmodium falciparum
EDKNEC

SEQ ID NO: 3215746 - protein, 34 aa, Plasmodium falciparum
EDKNIKQTDEKNIKQTDEKNIKQTDEKNIKLNDE

SEQ ID NO: 3215747 - protein, 15 aa, Plasmodium falciparum
EDKNKNKNKNTHQNE

SEQ ID NO: 3215748 - protein, 5 aa, Plasmodium falciparum
EDKNT

SEQ ID NO: 3215749 - protein, 5 aa, Plasmodium falciparum
EDKQI

SEQ ID NO: 3215750 - protein, 14 aa, Plasmodium falciparum
EDKQQQEQKKKNIN

SEQ ID NO: 3215751 - protein, 7 aa, Plasmodium falciparum
EDKRKKE

SEQ ID NO: 3215752 - protein, 9 aa, Plasmodium falciparum
EDKRKSTSI

SEQ ID NO: 3215753 - protein, 56 aa, Plasmodium falciparum
EDKSNDHNKKKDENIKKKNDDNNKKNDDNNKKNDDNNKNIDDNNKKKEENVKTEKQ

SEQ ID NO: 3215754 - protein, 6 aa, Plasmodium falciparum
EDKSPL

SEQ ID NO: 3215755 - protein, 8 aa, Plasmodium falciparum
EDKTKEPR

SEQ ID NO: 3215756 - protein, 4 aa, Plasmodium falciparum
EDKV

SEQ ID NO: 3215757 - protein, 5 aa, Plasmodium falciparum
EDKVE

SEQ ID NO: 3215758 - protein, 4 aa, Plasmodium falciparum
EDKY

SEQ ID NO: 3215759 - protein, 47 aa, Plasmodium falciparum
EDKYDKSSSTYNNNNNNNNYNNNNYNYNNSDDEINETRRRQDNQIDD

SEQ ID NO: 3215760 - protein, 71 aa, Plasmodium falciparum
EDLEDDDDTYEYSDEDSTHKDRNKKRRRKKRNNNKSKRKRKRKSKHDDYYDDNENEDSRKENDKEEESYYN

SEQ ID NO: 3215761 - protein, 25 aa, Plasmodium falciparum
EDLKNKTQISDEKNENIKKSVDPYN

SEQ ID NO: 3215762 - protein, 6 aa, Plasmodium falciparum
EDLKNS

SEQ ID NO: 3215763 - protein, 8 aa, Plasmodium falciparum
EDLKNSSY

SEQ ID NO: 3215764 - protein, 7 aa, Plasmodium falciparum
EDLNESQ

SEQ ID NO: 3215765 - protein, 14 aa, Plasmodium falciparum
EDLNNINKKKKGKC

SEQ ID NO: 3215766 - protein, 6 aa, Plasmodium falciparum
EDLSTQ

SEQ ID NO: 3215767 - protein, 23 aa, Plasmodium falciparum
EDMEYNEKEQMKDNEKEQMEYNE

SEQ ID NO: 3215768 - protein, 71 aa, Plasmodium falciparum
EDMGTDERGDSKCKRKDKIKEENEDDEDEEDEEDDDEDDDEDDDDDDDEDDDDDDDDDDDDDDDDHNNDNP

SEQ ID NO: 3215769 - protein, 13 aa, Plasmodium falciparum
EDMNNLKGTNEVK

SEQ ID NO: 3215770 - protein, 35 aa, Plasmodium falciparum
EDMSGNIHTSPNNIKTSINSNNNIYNNSNKYKDGV

SEQ ID NO: 3215771 - protein, 16 aa, Plasmodium falciparum
EDMSSNTSVNINGDTY

SEQ ID NO: 3215772 - protein, 28 aa, Plasmodium falciparum
EDNCNNDSEKNGDIEKNDNIEKNDNIEK

SEQ ID NO: 3215773 - protein, 5 aa, Plasmodium falciparum
EDNDF

SEQ ID NO: 3215774 - protein, 6 aa, Plasmodium falciparum
EDNDSS

SEQ ID NO: 3215775 - protein, 7 aa, Plasmodium falciparum
EDNDYSN

SEQ ID NO: 3215776 - protein, 4 aa, Plasmodium falciparum
EDNE

SEQ ID NO: 3215777 - protein, 5 aa, Plasmodium falciparum
EDNEK

SEQ ID NO: 3215778 - protein, 7 aa, Plasmodium falciparum
EDNEKNK

SEQ ID NO: 3215779 - protein, 59 aa, Plasmodium falciparum
EDNEKNNKINQNDKINKDDENIKYTNEDKYKINENKKNNNNNNNNNNNNNNNNNNNNNN

SEQ ID NO: 3215780 - protein, 6 aa, Plasmodium falciparum
EDNEND

SEQ ID NO: 3215781 - protein, 17 aa, Plasmodium falciparum
EDNGAKGTSNALQQNEE

SEQ ID NO: 3215782 - protein, 13 aa, Plasmodium falciparum
EDNGDTFEPAKDC

SEQ ID NO: 3215783 - protein, 18 aa, Plasmodium falciparum
EDNGEKKIEKVNDANGTD

SEQ ID NO: 3215784 - protein, 6 aa, Plasmodium falciparum
EDNGHS

SEQ ID NO: 3215785 - protein, 12 aa, Plasmodium falciparum
EDNKDTKEDSEQ

SEQ ID NO: 3215786 - protein, 8 aa, Plasmodium falciparum
EDNKEPQR

SEQ ID NO: 3215787 - protein, 6 aa, Plasmodium falciparum
EDNKGR

SEQ ID NO: 3215788 - protein, 81 aa, Plasmodium falciparum
EDNKKEDNKNEDNKKEDNKKEDNKNEDNKNEDNKNEDNKKEDNKKEDNKNEDNKNENNNIEDNKNENNNIEHNDNNRTNNL

SEQ ID NO: 3215789 - protein, 5 aa, Plasmodium falciparum
EDNKN

SEQ ID NO: 3215790 - protein, 8 aa, Plasmodium falciparum
EDNKNDMH

SEQ ID NO: 3215791 - protein, 16 aa, Plasmodium falciparum
EDNKNNNNINNNGGHL

SEQ ID NO: 3215792 - protein, 20 aa, Plasmodium falciparum
EDNKNSRNKKLYNSKKQNKN

SEQ ID NO: 3215793 - protein, 8 aa, Plasmodium falciparum
EDNKNSSD

SEQ ID NO: 3215794 - protein, 6 aa, Plasmodium falciparum
EDNKNV

SEQ ID NO: 3215795 - protein, 13 aa, Plasmodium falciparum
EDNKQKDELNEAN

SEQ ID NO: 3215796 - protein, 5 aa, Plasmodium falciparum
EDNKY

SEQ ID NO: 3215797 - protein, 14 aa, Plasmodium falciparum
EDNKYEENLPSEKI

SEQ ID NO: 3215798 - protein, 39 aa, Plasmodium falciparum
EDNNDNDNNKNDNNKNDNNKNDNNKNDNNNNNNNNNNNS

SEQ ID NO: 3215799 - protein, 11 aa, Plasmodium falciparum
EDNNGGEDLQN

SEQ ID NO: 3215800 - protein, 8 aa, Plasmodium falciparum
EDNNINKE

SEQ ID NO: 3215801 - protein, 8 aa, Plasmodium falciparum
EDNNNKMK

SEQ ID NO: 3215802 - protein, 8 aa, Plasmodium falciparum
EDNNNNPL

SEQ ID NO: 3215803 - protein, 13 aa, Plasmodium falciparum
EDNQGYSNDENIY

SEQ ID NO: 3215804 - protein, 6 aa, Plasmodium falciparum
EDNQRS

SEQ ID NO: 3215805 - protein, 11 aa, Plasmodium falciparum
EDNQSNINEEN

SEQ ID NO: 3215806 - protein, 49 aa, Plasmodium falciparum
EDNRKRKKTKKNKKKNLTKKKKKIIKKKNKKKIKNNNNNNNCSSNNSYK

SEQ ID NO: 3215807 - protein, 6 aa, Plasmodium falciparum
EDNRNE

SEQ ID NO: 3215808 - protein, 65 aa, Plasmodium falciparum
EDNRNNMENKNINNNNNDNINNNNNDNINNNNNDNINNNNNKNNNDNDNINNNDNINNNNNNNEQ

SEQ ID NO: 3215809 - protein, 7 aa, Plasmodium falciparum
EDNSEIQ

SEQ ID NO: 3215810 - protein, 11 aa, Plasmodium falciparum
EDNSLEPESED

SEQ ID NO: 3215811 - protein, 16 aa, Plasmodium falciparum
EDNSNMKKYNETNEHT

SEQ ID NO: 3215812 - protein, 15 aa, Plasmodium falciparum
EDNTTLEKSANKQNL

SEQ ID NO: 3215813 - protein, 9 aa, Plasmodium falciparum
EDNYEDDNY

SEQ ID NO: 3215814 - protein, 5 aa, Plasmodium falciparum
EDNYV

SEQ ID NO: 3215815 - protein, 14 aa, Plasmodium falciparum
EDPGNEHSKYEEGK

SEQ ID NO: 3215816 - protein, 4 aa, Plasmodium falciparum
EDPN

SEQ ID NO: 3215817 - protein, 9 aa, Plasmodium falciparum
EDPNKTSQN

SEQ ID NO: 3215818 - protein, 5 aa, Plasmodium falciparum
EDPNY

SEQ ID NO: 3215819 - protein, 4 aa, Plasmodium falciparum
EDPQ

SEQ ID NO: 3215820 - protein, 4 aa, Plasmodium falciparum
EDPT

SEQ ID NO: 3215821 - protein, 15 aa, Plasmodium falciparum
EDPTLKDEKKNEQGG

SEQ ID NO: 3215822 - protein, 4 aa, Plasmodium falciparum
EDQE

SEQ ID NO: 3215823 - protein, 7 aa, Plasmodium falciparum
EDQEERK

SEQ ID NO: 3215824 - protein, 4 aa, Plasmodium falciparum
EDQG

SEQ ID NO: 3215825 - protein, 5 aa, Plasmodium falciparum
EDQIT

SEQ ID NO: 3215826 - protein, 7 aa, Plasmodium falciparum
EDQKEKE

SEQ ID NO: 3215827 - protein, 11 aa, Plasmodium falciparum
EDQKKNENTQR

SEQ ID NO: 3215828 - protein, 6 aa, Plasmodium falciparum
EDQKMN

SEQ ID NO: 3215829 - protein, 4 aa, Plasmodium falciparum
EDQM

SEQ ID NO: 3215830 - protein, 9 aa, Plasmodium falciparum
EDQNEDEDK

SEQ ID NO: 3215831 - protein, 18 aa, Plasmodium falciparum
EDQPSNFSNDKKEKSSKG

SEQ ID NO: 3215832 - protein, 7 aa, Plasmodium falciparum
EDQQNQK

SEQ ID NO: 3215833 - protein, 18 aa, Plasmodium falciparum
EDRASRIYEEDRASGIYE

SEQ ID NO: 3215834 - protein, 20 aa, Plasmodium falciparum
EDREDIRDTDTHYNSKDGKG

SEQ ID NO: 3215835 - protein, 6 aa, Plasmodium falciparum
EDRKEI

SEQ ID NO: 3215836 - protein, 8 aa, Plasmodium falciparum
EDRKNSWD

SEQ ID NO: 3215837 - protein, 5 aa, Plasmodium falciparum
EDRLP

SEQ ID NO: 3215838 - protein, 7 aa, Plasmodium falciparum
EDRTSQR

SEQ ID NO: 3215839 - protein, 9 aa, Plasmodium falciparum
EDRYKTNQD

SEQ ID NO: 3215840 - protein, 5 aa, Plasmodium falciparum
EDSAI

SEQ ID NO: 3215841 - protein, 9 aa, Plasmodium falciparum
EDSANGKEK

SEQ ID NO: 3215842 - protein, 7 aa, Plasmodium falciparum
EDSDINE

SEQ ID NO: 3215843 - protein, 21 aa, Plasmodium falciparum
EDSDKSVKKHTRKNNINSRRK

SEQ ID NO: 3215844 - protein, 6 aa, Plasmodium falciparum
EDSDQL

SEQ ID NO: 3215845 - protein, 8 aa, Plasmodium falciparum
EDSENEEI

SEQ ID NO: 3215846 - protein, 4 aa, Plasmodium falciparum
EDSF

SEQ ID NO: 3215847 - protein, 16 aa, Plasmodium falciparum
EDSGDKGGKPTQNEQV

SEQ ID NO: 3215848 - protein, 8 aa, Plasmodium falciparum
EDSGGNSI

SEQ ID NO: 3215849 - protein, 6 aa, Plasmodium falciparum
EDSIKW

SEQ ID NO: 3215850 - protein, 6 aa, Plasmodium falciparum
EDSINK

SEQ ID NO: 3215851 - protein, 5 aa, Plasmodium falciparum
EDSKC

SEQ ID NO: 3215852 - protein, 28 aa, Plasmodium falciparum
EDSKDMTNSINDSEKSKIVASSSKTTNE

SEQ ID NO: 3215853 - protein, 6 aa, Plasmodium falciparum
EDSKNN

SEQ ID NO: 3215854 - protein, 5 aa, Plasmodium falciparum
EDSLN

SEQ ID NO: 3215855 - protein, 9 aa, Plasmodium falciparum
EDSNKIKQN

SEQ ID NO: 3215856 - protein, 20 aa, Plasmodium falciparum
EDSNKSTTPIKYDEKKNALQ

SEQ ID NO: 3215857 - protein, 12 aa, Plasmodium falciparum
EDSNNNNNNNNV

SEQ ID NO: 3215858 - protein, 4 aa, Plasmodium falciparum
EDSR

SEQ ID NO: 3215859 - protein, 8 aa, Plasmodium falciparum
EDSRRSNI

SEQ ID NO: 3215860 - protein, 17 aa, Plasmodium falciparum
EDSSGCTGTVPSGIEEC

SEQ ID NO: 3215861 - protein, 14 aa, Plasmodium falciparum
EDSSIKKNKRKSEI

SEQ ID NO: 3215862 - protein, 36 aa, Plasmodium falciparum
EDSSSEEENEFENNNSKGKSDLKNNDEENNSLYNQK

SEQ ID NO: 3215863 - protein, 4 aa, Plasmodium falciparum
EDSV

SEQ ID NO: 3215864 - protein, 8 aa, Plasmodium falciparum
EDSYGDTP

SEQ ID NO: 3215865 - protein, 6 aa, Plasmodium falciparum
EDSYYN

SEQ ID NO: 3215866 - protein, 19 aa, Plasmodium falciparum
EDTCKGDNNVRYNSKGGIS

SEQ ID NO: 3215867 - protein, 18 aa, Plasmodium falciparum
EDTEEKSEKGLDAEEAKE

SEQ ID NO: 3215868 - protein, 8 aa, Plasmodium falciparum
EDTEENDL

SEQ ID NO: 3215869 - protein, 13 aa, Plasmodium falciparum
EDTETVAEKEEGS

SEQ ID NO: 3215870 - protein, 6 aa, Plasmodium falciparum
EDTGAY

SEQ ID NO: 3215871 - protein, 10 aa, Plasmodium falciparum
EDTHARKGKN

SEQ ID NO: 3215872 - protein, 24 aa, Plasmodium falciparum
EDTIKNNNSNTSKNSYDNSEENNI

SEQ ID NO: 3215873 - protein, 51 aa, Plasmodium falciparum
EDTKENDKLPLESSTITSPTESGSSDTEETPSISEGPKGNEQKKRDDDSLS

SEQ ID NO: 3215874 - protein, 4 aa, Plasmodium falciparum
EDTL

SEQ ID NO: 3215875 - protein, 6 aa, Plasmodium falciparum
EDTPAM

SEQ ID NO: 3215876 - protein, 4 aa, Plasmodium falciparum
EDTQ

SEQ ID NO: 3215877 - protein, 6 aa, Plasmodium falciparum
EDTQDE

SEQ ID NO: 3215878 - protein, 20 aa, Plasmodium falciparum
EDTSNNEDLERQNKNKDDEV

SEQ ID NO: 3215879 - protein, 10 aa, Plasmodium falciparum
EDTTDSNKKL

SEQ ID NO: 3215880 - protein, 6 aa, Plasmodium falciparum
EDTVSN

SEQ ID NO: 3215881 - protein, 5 aa, Plasmodium falciparum
EDTYN

SEQ ID NO: 3215882 - protein, 23 aa, Plasmodium falciparum
EDTYNNNNNNNNDDDDKYNIESD

SEQ ID NO: 3215883 - protein, 16 aa, Plasmodium falciparum
EDVCTKNNDIKDGGNI

SEQ ID NO: 3215884 - protein, 4 aa, Plasmodium falciparum
EDVG

SEQ ID NO: 3215885 - protein, 4 aa, Plasmodium falciparum
EDVK

SEQ ID NO: 3215886 - protein, 14 aa, Plasmodium falciparum
EDVKYKDDLDNKDN

SEQ ID NO: 3215887 - protein, 7 aa, Plasmodium falciparum
EDVNKTE

SEQ ID NO: 3215888 - protein, 6 aa, Plasmodium falciparum
EDVNSE

SEQ ID NO: 3215889 - protein, 14 aa, Plasmodium falciparum
EDVRNDEKKNNSKM

SEQ ID NO: 3215890 - protein, 9 aa, Plasmodium falciparum
EDVSSSDIE

SEQ ID NO: 3215891 - protein, 13 aa, Plasmodium falciparum
EDVTAKGSKRGRT

SEQ ID NO: 3215892 - protein, 11 aa, Plasmodium falciparum
EDVYGEKKNDK

SEQ ID NO: 3215893 - protein, 17 aa, Plasmodium falciparum
EDWEDEDNNNNDNYNYN

SEQ ID NO: 3215894 - protein, 7 aa, Plasmodium falciparum
EDYDDDN

SEQ ID NO: 3215895 - protein, 5 aa, Plasmodium falciparum
EDYEE

SEQ ID NO: 3215896 - protein, 11 aa, Plasmodium falciparum
EDYEENNDDIT

SEQ ID NO: 3215897 - protein, 11 aa, Plasmodium falciparum
EDYEKSKKDYE

SEQ ID NO: 3215898 - protein, 17 aa, Plasmodium falciparum
EDYENKDNNKINRENKK

SEQ ID NO: 3215899 - protein, 6 aa, Plasmodium falciparum
EDYGDR

SEQ ID NO: 3215900 - protein, 12 aa, Plasmodium falciparum
EDYKKKKKWKNE

SEQ ID NO: 3215901 - protein, 17 aa, Plasmodium falciparum
EDYKNITSTNVETNNNH

SEQ ID NO: 3215902 - protein, 19 aa, Plasmodium falciparum
EDYNKNEIKDNDDNDNTNS

SEQ ID NO: 3215903 - protein, 23 aa, Plasmodium falciparum
EDYNKNKNEYINTGTDSSTENDM

SEQ ID NO: 3215904 - protein, 12 aa, Plasmodium falciparum
EDYPRKPTGSFY

SEQ ID NO: 3215905 - protein, 27 aa, Plasmodium falciparum
EEAAEKEAESEEQEEEEEDITESEDDD

SEQ ID NO: 3215906 - protein, 6 aa, Plasmodium falciparum
EEAEEI

SEQ ID NO: 3215907 - protein, 10 aa, Plasmodium falciparum
EEAEGTSNLK

SEQ ID NO: 3215908 - protein, 5 aa, Plasmodium falciparum
EEAEK

SEQ ID NO: 3215909 - protein, 6 aa, Plasmodium falciparum
EEAHTT

SEQ ID NO: 3215910 - protein, 71 aa, Plasmodium falciparum
EEAKEAKDCQSKHKDPCPKPQDGVAGRSAEHPEEQEEEEEDDDEEIEEKSEENDEESEKTVEDKETEAENV

SEQ ID NO: 3215911 - protein, 5 aa, Plasmodium falciparum
EEAKN

SEQ ID NO: 3215912 - protein, 28 aa, Plasmodium falciparum
EEAKVNEQNNNNNNNNNNNNNNDDDDDD

SEQ ID NO: 3215913 - protein, 10 aa, Plasmodium falciparum
EEAPGDINSE

SEQ ID NO: 3215914 - protein, 8 aa, Plasmodium falciparum
EEAQEDSN

SEQ ID NO: 3215915 - protein, 4 aa, Plasmodium falciparum
EEAS

SEQ ID NO: 3215916 - protein, 6 aa, Plasmodium falciparum
EEATRN

SEQ ID NO: 3215917 - protein, 11 aa, Plasmodium falciparum
EEAVAEGTQAA

SEQ ID NO: 3215918 - protein, 26 aa, Plasmodium falciparum
EEAVAEGTQAAETEAARVTATKTAAF

SEQ ID NO: 3215919 - protein, 28 aa, Plasmodium falciparum
EEAVAGAEQAAKAEVSNVTATKTTEFTT

SEQ ID NO: 3215920 - protein, 9 aa, Plasmodium falciparum
EEAYNDTLN

SEQ ID NO: 3215921 - protein, 8 aa, Plasmodium falciparum
EECKQHTT

SEQ ID NO: 3215922 - protein, 5 aa, Plasmodium falciparum
EECNN

SEQ ID NO: 3215923 - protein, 23 aa, Plasmodium falciparum
EECRGDRGGHQYCSGDGHDCTRE

SEQ ID NO: 3215924 - protein, 17 aa, Plasmodium falciparum
EECRSGNYGKEHCSGDG

SEQ ID NO: 3215925 - protein, 6 aa, Plasmodium falciparum
EECTIR

SEQ ID NO: 3215926 - protein, 5 aa, Plasmodium falciparum
EECYR

SEQ ID NO: 3215927 - protein, 25 aa, Plasmodium falciparum
EEDDDDDNNNNNNNNNNNNNNNNNN

SEQ ID NO: 3215928 - protein, 6 aa, Plasmodium falciparum
EEDDEM

SEQ ID NO: 3215929 - protein, 10 aa, Plasmodium falciparum
EEDDKEKNSL

SEQ ID NO: 3215930 - protein, 6 aa, Plasmodium falciparum
EEDDLQ

SEQ ID NO: 3215931 - protein, 25 aa, Plasmodium falciparum
EEDDNIKSKRGDNQNLQSDNQNYDI

SEQ ID NO: 3215932 - protein, 12 aa, Plasmodium falciparum
EEDDTNKDYNKE

SEQ ID NO: 3215933 - protein, 28 aa, Plasmodium falciparum
EEDEKEDEKEKEKKKGNEREQTNYNTNE

SEQ ID NO: 3215934 - protein, 28 aa, Plasmodium falciparum
EEDEKIKDKANKNEKRQSSNQYNHNDDT

SEQ ID NO: 3215935 - protein, 18 aa, Plasmodium falciparum
EEDEKKKKNSKNSKNGMN

SEQ ID NO: 3215936 - protein, 11 aa, Plasmodium falciparum
EEDESNDENQI

SEQ ID NO: 3215937 - protein, 5 aa, Plasmodium falciparum
EEDHD

SEQ ID NO: 3215938 - protein, 74 aa, Plasmodium falciparum
EEDHNGNNNNNNNNNNNNGNNHNDGNNHNDGNNHNDGNNRNGGNNRNDDNNHNSGNNHNNGNNDKHNNGNNDKH

SEQ ID NO: 3215939 - protein, 7 aa, Plasmodium falciparum
EEDKIEK

SEQ ID NO: 3215940 - protein, 92 aa, Plasmodium falciparum
EEDKKKRKNTTGPRTTKTIRKLNHSRFTNNVPYVFRLMFGKRYRCGWENYRNFLKKPNNTNLVENNKRYRGSNVLCIELYHQKKKKIQESVR

SEQ ID NO: 3215941 - protein, 4 aa, Plasmodium falciparum
EEDM

SEQ ID NO: 3215942 - protein, 7 aa, Plasmodium falciparum
EEDNGIY

SEQ ID NO: 3215943 - protein, 18 aa, Plasmodium falciparum
EEDNISSNYNNELQRTKR

SEQ ID NO: 3215944 - protein, 5 aa, Plasmodium falciparum
EEDNL

SEQ ID NO: 3215945 - protein, 8 aa, Plasmodium falciparum
EEDNNENE

SEQ ID NO: 3215946 - protein, 6 aa, Plasmodium falciparum
EEDPKN

SEQ ID NO: 3215947 - protein, 8 aa, Plasmodium falciparum
EEDPSNKN

SEQ ID NO: 3215948 - protein, 13 aa, Plasmodium falciparum
EEDQRNEKFTTEI

SEQ ID NO: 3215949 - protein, 22 aa, Plasmodium falciparum
EEDRNFSKNNNEDKKKNHEEEK

SEQ ID NO: 3215950 - protein, 9 aa, Plasmodium falciparum
EEDSDDLNK

SEQ ID NO: 3215951 - protein, 10 aa, Plasmodium falciparum
EEDSNDIEDI

SEQ ID NO: 3215952 - protein, 29 aa, Plasmodium falciparum
EEDTKTYEDKNKDDNNNNNNNNDNNNNNN

SEQ ID NO: 3215953 - protein, 13 aa, Plasmodium falciparum
EEDTTSKDNEKNM

SEQ ID NO: 3215954 - protein, 6 aa, Plasmodium falciparum
EEDYSK

SEQ ID NO: 3215955 - protein, 4 aa, Plasmodium falciparum
EEEA

SEQ ID NO: 3215956 - protein, 16 aa, Plasmodium falciparum
EEEAAGVTDNENKTTI

SEQ ID NO: 3215957 - protein, 6 aa, Plasmodium falciparum
EEEAER

SEQ ID NO: 3215958 - protein, 9 aa, Plasmodium falciparum
EEEASGAKI

SEQ ID NO: 3215959 - protein, 7 aa, Plasmodium falciparum
EEECKKN

SEQ ID NO: 3215960 - protein, 4 aa, Plasmodium falciparum
EEED

SEQ ID NO: 3215961 - protein, 11 aa, Plasmodium falciparum
EEEDANKCTGI

SEQ ID NO: 3215962 - protein, 8 aa, Plasmodium falciparum
EEEDGENE

SEQ ID NO: 3215963 - protein, 14 aa, Plasmodium falciparum
EEEDTRNVKEQESV

SEQ ID NO: 3215964 - protein, 37 aa, Plasmodium falciparum
EEEDYEEDDDDEDDDDDDDDDDDDDDDNNNNNNNNIR

SEQ ID NO: 3215965 - protein, 26 aa, Plasmodium falciparum
EEEEDEQEDEQEEEEREGDNEDGHPY

SEQ ID NO: 3215966 - protein, 11 aa, Plasmodium falciparum
EEEEDSDNIKV

SEQ ID NO: 3215967 - protein, 5 aa, Plasmodium falciparum
EEEEE

SEQ ID NO: 3215968 - protein, 8 aa, Plasmodium falciparum
EEEEEEED

SEQ ID NO: 3215969 - protein, 54 aa, Plasmodium falciparum
EEEEEEEEEEEEEEEEEEEEEEEEEEEEEEEEEEEEEEEKKYQHGNYEKGGSYK

SEQ ID NO: 3215970 - protein, 16 aa, Plasmodium falciparum
EEEEEEEEENENEKNN

SEQ ID NO: 3215971 - protein, 13 aa, Plasmodium falciparum
EEEEEKEKKKKKK

SEQ ID NO: 3215972 - protein, 12 aa, Plasmodium falciparum
EEEEEKKKKRRR

SEQ ID NO: 3215973 - protein, 8 aa, Plasmodium falciparum
EEEEELEE

SEQ ID NO: 3215974 - protein, 15 aa, Plasmodium falciparum
EEEEERKKKKEENKY

SEQ ID NO: 3215975 - protein, 6 aa, Plasmodium falciparum
EEEEIK

SEQ ID NO: 3215976 - protein, 33 aa, Plasmodium falciparum
EEEEKDNVENNEDRENKYEREEQLNEDKKEEDH

SEQ ID NO: 3215977 - protein, 61 aa, Plasmodium falciparum
EEEEKEEEEEKEKEKEEEEEDEKEEEEDKEKEKEEEKEEEKDKEEEDEKDKEKEKEEEIQK

SEQ ID NO: 3215978 - protein, 9 aa, Plasmodium falciparum
EEEEKEKND

SEQ ID NO: 3215979 - protein, 21 aa, Plasmodium falciparum
EEEEKKEVKKTNSEKEPKEIQ

SEQ ID NO: 3215980 - protein, 23 aa, Plasmodium falciparum
EEEEKKKKKKKRIKKKTISNQND

SEQ ID NO: 3215981 - protein, 24 aa, Plasmodium falciparum
EEEEKNKEEEEAGASGGENKNTSI

SEQ ID NO: 3215982 - protein, 5 aa, Plasmodium falciparum
EEEEM

SEQ ID NO: 3215983 - protein, 7 aa, Plasmodium falciparum
EEEENQV

SEQ ID NO: 3215984 - protein, 9 aa, Plasmodium falciparum
EEEENQVKA

SEQ ID NO: 3215985 - protein, 9 aa, Plasmodium falciparum
EEEEQKSDE

SEQ ID NO: 3215986 - protein, 6 aa, Plasmodium falciparum
EEEERE

SEQ ID NO: 3215987 - protein, 47 aa, Plasmodium falciparum
EEEERKERERLEKAKQEEERKERERIEKEKQEKERLEREKQEQLKKE

SEQ ID NO: 3215988 - protein, 190 aa, Plasmodium falciparum
EEEERKERERLEKAKQEEERKERERIEKEKQEKERLEREKQEQLKKEEELRKKEQERQEQQQKEEALKRQEQERLQKEEELKRQEQERLEREKQEQLQKEEELKRQEQERLQKEEALKRQEQERLQKEEELKRQEQERLEREKQEQLQKEEELKRQEQERLQKEEALKRQEQERLQKEEELKRQEQERLE

SEQ ID NO: 3215989 - protein, 25 aa, Plasmodium falciparum
EEEERKNQVEAADGGASSGKDNTTI

SEQ ID NO: 3215990 - protein, 4 aa, Plasmodium falciparum
EEEF

SEQ ID NO: 3215991 - protein, 4 aa, Plasmodium falciparum
EEEG

SEQ ID NO: 3215992 - protein, 6 aa, Plasmodium falciparum
EEEGHA

SEQ ID NO: 3215993 - protein, 7 aa, Plasmodium falciparum
EEEGLDN

SEQ ID NO: 3215994 - protein, 7 aa, Plasmodium falciparum
EEEGPVD

SEQ ID NO: 3215995 - protein, 7 aa, Plasmodium falciparum
EEEGSAT

SEQ ID NO: 3215996 - protein, 10 aa, Plasmodium falciparum
EEEGSPNEEI

SEQ ID NO: 3215997 - protein, 17 aa, Plasmodium falciparum
EEEGSTTEKVVKGSSTE

SEQ ID NO: 3215998 - protein, 13 aa, Plasmodium falciparum
EEEGSVNEEVEEE

SEQ ID NO: 3215999 - protein, 8 aa, Plasmodium falciparum
EEEGSVTE

SEQ ID NO: 3216000 - protein, 18 aa, Plasmodium falciparum
EEEGSVTKEVEEKESVTE

SEQ ID NO: 3216001 - protein, 8 aa, Plasmodium falciparum
EEEGSYTE

SEQ ID NO: 3216002 - protein, 24 aa, Plasmodium falciparum
EEEHSPDEYADGEYYDDDGNYEEV

SEQ ID NO: 3216003 - protein, 6 aa, Plasmodium falciparum
EEEHTI

SEQ ID NO: 3216004 - protein, 4 aa, Plasmodium falciparum
EEEI

SEQ ID NO: 3216005 - protein, 18 aa, Plasmodium falciparum
EEEIENTNTKQDPSNKIN

SEQ ID NO: 3216006 - protein, 103 aa, Plasmodium falciparum
EEEIGDESTDSSSMEIQDSTSNEQDENVKGMSSSQEMNSNNDENKNQDNESDDDVNNNNNNNNDDQDEQGNDGDVTSSMNKNEDNKDLEHGSSNDVNNNTDTL

SEQ ID NO: 3216007 - protein, 5 aa, Plasmodium falciparum
EEEIN

SEQ ID NO: 3216008 - protein, 5 aa, Plasmodium falciparum
EEEIS

SEQ ID NO: 3216009 - protein, 18 aa, Plasmodium falciparum
EEEISRNSNINDEFSETQ

SEQ ID NO: 3216010 - protein, 4 aa, Plasmodium falciparum
EEEK

SEQ ID NO: 3216011 - protein, 14 aa, Plasmodium falciparum
EEEKDYYENKENVH

SEQ ID NO: 3216012 - protein, 11 aa, Plasmodium falciparum
EEEKEKDSNNI

SEQ ID NO: 3216013 - protein, 12 aa, Plasmodium falciparum
EEEKEKKRKEGE

SEQ ID NO: 3216014 - protein, 5 aa, Plasmodium falciparum
EEEKK

SEQ ID NO: 3216015 - protein, 25 aa, Plasmodium falciparum
EEEKKEKEKKESKCKDDKQKYKNTQ

SEQ ID NO: 3216016 - protein, 11 aa, Plasmodium falciparum
EEEKKGKKRLA

SEQ ID NO: 3216017 - protein, 11 aa, Plasmodium falciparum
EEEKKKKKLQR

SEQ ID NO: 3216018 - protein, 18 aa, Plasmodium falciparum
EEEKKKKRKRKRKKKKIE

SEQ ID NO: 3216019 - protein, 10 aa, Plasmodium falciparum
EEEKKQQEKD

SEQ ID NO: 3216020 - protein, 10 aa, Plasmodium falciparum
EEEKKTASRS

SEQ ID NO: 3216021 - protein, 6 aa, Plasmodium falciparum
EEEKNE

SEQ ID NO: 3216022 - protein, 9 aa, Plasmodium falciparum
EEEKNGETI

SEQ ID NO: 3216023 - protein, 9 aa, Plasmodium falciparum
EEEKNKGIS

SEQ ID NO: 3216024 - protein, 28 aa, Plasmodium falciparum
EEEKNPMYSNKSNNTKEKKNHKRSRKSM

SEQ ID NO: 3216025 - protein, 21 aa, Plasmodium falciparum
EEEKRKNYEEKEIRKRKNYEQ

SEQ ID NO: 3216026 - protein, 15 aa, Plasmodium falciparum
EEEMNKKNLKQNDTI

SEQ ID NO: 3216027 - protein, 19 aa, Plasmodium falciparum
EEENDDELKNIESDDEQKW

SEQ ID NO: 3216028 - protein, 55 aa, Plasmodium falciparum
EEENDKRDEKFDKRDEKFDKRDEKYDKKDEKYDKRDEKYDKRDEKYDKNIQNNLN

SEQ ID NO: 3216029 - protein, 5 aa, Plasmodium falciparum
EEENE

SEQ ID NO: 3216030 - protein, 33 aa, Plasmodium falciparum
EEENIKDDNKYDKRDNKKGYLQDESKNNKINDS

SEQ ID NO: 3216031 - protein, 9 aa, Plasmodium falciparum
EEENIKGHK

SEQ ID NO: 3216032 - protein, 11 aa, Plasmodium falciparum
EEENINKENDN

SEQ ID NO: 3216033 - protein, 11 aa, Plasmodium falciparum
EEENKKKEEKH

SEQ ID NO: 3216034 - protein, 24 aa, Plasmodium falciparum
EEENKKKERRKTKKEKEMRGKNRK

SEQ ID NO: 3216035 - protein, 94 aa, Plasmodium falciparum
EEENKNMKQEDKGDLLSTSDGNDNENNDDNNDDNNDENNDDNNDDNNDDNNDDNNDDNNDDNNDDNNDDNNDDDEDEDDDDDEDDDEDDDEEYH

SEQ ID NO: 3216036 - protein, 6 aa, Plasmodium falciparum
EEENMK

SEQ ID NO: 3216037 - protein, 16 aa, Plasmodium falciparum
EEENNDNSNKNNINNN

SEQ ID NO: 3216038 - protein, 7 aa, Plasmodium falciparum
EEENNNM

SEQ ID NO: 3216039 - protein, 18 aa, Plasmodium falciparum
EEENNQNGLTTTSTTSNK

SEQ ID NO: 3216040 - protein, 9 aa, Plasmodium falciparum
EEENPKNMR

SEQ ID NO: 3216041 - protein, 12 aa, Plasmodium falciparum
EEENSKKKKKKS

SEQ ID NO: 3216042 - protein, 17 aa, Plasmodium falciparum
EEENSKNYKNDKNHIDD

SEQ ID NO: 3216043 - protein, 21 aa, Plasmodium falciparum
EEENSVESDIKESDIKESDYI

SEQ ID NO: 3216044 - protein, 12 aa, Plasmodium falciparum
EEENTANSAPEI

SEQ ID NO: 3216045 - protein, 21 aa, Plasmodium falciparum
EEENVKNKNATSNNNSSFSKK

SEQ ID NO: 3216046 - protein, 9 aa, Plasmodium falciparum
EEENYKKEE

SEQ ID NO: 3216047 - protein, 38 aa, Plasmodium falciparum
EEEPEATKAVKEDTDGEGGSPKEDEEAAKRPSQEDPKV

SEQ ID NO: 3216048 - protein, 5 aa, Plasmodium falciparum
EEEPK

SEQ ID NO: 3216049 - protein, 6 aa, Plasmodium falciparum
EEERDI

SEQ ID NO: 3216050 - protein, 9 aa, Plasmodium falciparum
EEERDTDEV

SEQ ID NO: 3216051 - protein, 9 aa, Plasmodium falciparum
EEESASQGI

SEQ ID NO: 3216052 - protein, 8 aa, Plasmodium falciparum
EEESATEE

SEQ ID NO: 3216053 - protein, 9 aa, Plasmodium falciparum
EEESDTKEV

SEQ ID NO: 3216054 - protein, 9 aa, Plasmodium falciparum
EEESEKSDD

SEQ ID NO: 3216055 - protein, 11 aa, Plasmodium falciparum
EEESSYEDSRN

SEQ ID NO: 3216056 - protein, 6 aa, Plasmodium falciparum
EEESVP

SEQ ID NO: 3216057 - protein, 6 aa, Plasmodium falciparum
EEESVT

SEQ ID NO: 3216058 - protein, 4 aa, Plasmodium falciparum
EEET

SEQ ID NO: 3216059 - protein, 6 aa, Plasmodium falciparum
EEETDM

SEQ ID NO: 3216060 - protein, 9 aa, Plasmodium falciparum
EEETKKKNK

SEQ ID NO: 3216061 - protein, 10 aa, Plasmodium falciparum
EEETNKKNCI

SEQ ID NO: 3216062 - protein, 5 aa, Plasmodium falciparum
EEETS

SEQ ID NO: 3216063 - protein, 4 aa, Plasmodium falciparum
EEEV

SEQ ID NO: 3216064 - protein, 5 aa, Plasmodium falciparum
EEEVD

SEQ ID NO: 3216065 - protein, 4 aa, Plasmodium falciparum
EEEY

SEQ ID NO: 3216066 - protein, 20 aa, Plasmodium falciparum
EEEYEGKDYDDDGNERKPKD

SEQ ID NO: 3216067 - protein, 6 aa, Plasmodium falciparum
EEFESE

SEQ ID NO: 3216068 - protein, 16 aa, Plasmodium falciparum
EEFHPKKGSIKKEEDI

SEQ ID NO: 3216069 - protein, 7 aa, Plasmodium falciparum
EEFNESN

SEQ ID NO: 3216070 - protein, 4 aa, Plasmodium falciparum
EEFS

SEQ ID NO: 3216071 - protein, 28 aa, Plasmodium falciparum
EEFTKQKERYETESDNAKSKSDDTSENE

SEQ ID NO: 3216072 - protein, 8 aa, Plasmodium falciparum
EEGAVSDE

SEQ ID NO: 3216073 - protein, 7 aa, Plasmodium falciparum
EEGDANI

SEQ ID NO: 3216074 - protein, 6 aa, Plasmodium falciparum
EEGDSF

SEQ ID NO: 3216075 - protein, 24 aa, Plasmodium falciparum
EEGEKKSNKKIKNNTQHNDNNNNN

SEQ ID NO: 3216076 - protein, 7 aa, Plasmodium falciparum
EEGENKM

SEQ ID NO: 3216077 - protein, 9 aa, Plasmodium falciparum
EEGENSKTN

SEQ ID NO: 3216078 - protein, 14 aa, Plasmodium falciparum
EEGEYDRNENINRN

SEQ ID NO: 3216079 - protein, 6 aa, Plasmodium falciparum
EEGIGE

SEQ ID NO: 3216080 - protein, 7 aa, Plasmodium falciparum
EEGKVEY

SEQ ID NO: 3216081 - protein, 7 aa, Plasmodium falciparum
EEGLDTE

SEQ ID NO: 3216082 - protein, 5 aa, Plasmodium falciparum
EEGME

SEQ ID NO: 3216083 - protein, 53 aa, Plasmodium falciparum
EEGNEKEIKEGRNKEIRERNDKEINEGNDKNFEKEIEKQSEEANEKEIKEGND

SEQ ID NO: 3216084 - protein, 9 aa, Plasmodium falciparum
EEGNKTKNN

SEQ ID NO: 3216085 - protein, 5 aa, Plasmodium falciparum
EEGPV

SEQ ID NO: 3216086 - protein, 6 aa, Plasmodium falciparum
EEGQEE

SEQ ID NO: 3216087 - protein, 4 aa, Plasmodium falciparum
EEGS

SEQ ID NO: 3216088 - protein, 9 aa, Plasmodium falciparum
EEGSASEEI

SEQ ID NO: 3216089 - protein, 9 aa, Plasmodium falciparum
EEGSATEEV

SEQ ID NO: 3216090 - protein, 10 aa, Plasmodium falciparum
EEGSATEEVV

SEQ ID NO: 3216091 - protein, 9 aa, Plasmodium falciparum
EEGSATEGI

SEQ ID NO: 3216092 - protein, 20 aa, Plasmodium falciparum
EEGSDTGEIVEEEGSDTEEI

SEQ ID NO: 3216093 - protein, 5 aa, Plasmodium falciparum
EEGSF

SEQ ID NO: 3216094 - protein, 6 aa, Plasmodium falciparum
EEGSIT

SEQ ID NO: 3216095 - protein, 12 aa, Plasmodium falciparum
EEGSVNEEVEEE

SEQ ID NO: 3216096 - protein, 6 aa, Plasmodium falciparum
EEGSVS

SEQ ID NO: 3216097 - protein, 6 aa, Plasmodium falciparum
EEGSVT

SEQ ID NO: 3216098 - protein, 7 aa, Plasmodium falciparum
EEGSYTE

SEQ ID NO: 3216099 - protein, 6 aa, Plasmodium falciparum
EEGTKD

SEQ ID NO: 3216100 - protein, 9 aa, Plasmodium falciparum
EEGVDAGGL

SEQ ID NO: 3216101 - protein, 14 aa, Plasmodium falciparum
EEHDDDEDDDPNKI

SEQ ID NO: 3216102 - protein, 10 aa, Plasmodium falciparum
EEHDHTKNPS

SEQ ID NO: 3216103 - protein, 5 aa, Plasmodium falciparum
EEHDR

SEQ ID NO: 3216104 - protein, 14 aa, Plasmodium falciparum
EEHHGNKEKKERKI

SEQ ID NO: 3216105 - protein, 9 aa, Plasmodium falciparum
EEHNDNSNM

SEQ ID NO: 3216106 - protein, 19 aa, Plasmodium falciparum
EEHNKQEVSYNSTDHHSKN

SEQ ID NO: 3216107 - protein, 14 aa, Plasmodium falciparum
EEHNKSSNITTNGN

SEQ ID NO: 3216108 - protein, 10 aa, Plasmodium falciparum
EEHNKTNINN

SEQ ID NO: 3216109 - protein, 7 aa, Plasmodium falciparum
EEHPNEE

SEQ ID NO: 3216110 - protein, 9 aa, Plasmodium falciparum
EEIAEEDKS

SEQ ID NO: 3216111 - protein, 13 aa, Plasmodium falciparum
EEIDTSKQHTDEK

SEQ ID NO: 3216112 - protein, 6 aa, Plasmodium falciparum
EEIEKK

SEQ ID NO: 3216113 - protein, 12 aa, Plasmodium falciparum
EEIEKKKKNYTT

SEQ ID NO: 3216114 - protein, 7 aa, Plasmodium falciparum
EEIEPST

SEQ ID NO: 3216115 - protein, 65 aa, Plasmodium falciparum
EEIEQEEEPEETSVDTTQDEEEPASEGGGPSGSPTEESGEPRENSDSSDPKPDQNPEANPEQTPI

SEQ ID NO: 3216116 - protein, 23 aa, Plasmodium falciparum
EEIEQNNDDDLNNINNDEDDEQI

SEQ ID NO: 3216117 - protein, 18 aa, Plasmodium falciparum
EEIKEGKKKKDNKNETKY

SEQ ID NO: 3216118 - protein, 12 aa, Plasmodium falciparum
EEIKGNKKKKME

SEQ ID NO: 3216119 - protein, 22 aa, Plasmodium falciparum
EEIKKEEKEPQESKPKENKPTL

SEQ ID NO: 3216120 - protein, 6 aa, Plasmodium falciparum
EEIKKK

SEQ ID NO: 3216121 - protein, 8 aa, Plasmodium falciparum
EEIKKRSK

SEQ ID NO: 3216122 - protein, 11 aa, Plasmodium falciparum
EEIKSPSKNKC

SEQ ID NO: 3216123 - protein, 9 aa, Plasmodium falciparum
EEIKSSENK

SEQ ID NO: 3216124 - protein, 4 aa, Plasmodium falciparum
EEIM

SEQ ID NO: 3216125 - protein, 10 aa, Plasmodium falciparum
EEINEKEKNI

SEQ ID NO: 3216126 - protein, 6 aa, Plasmodium falciparum
EEINKE

SEQ ID NO: 3216127 - protein, 10 aa, Plasmodium falciparum
EEINKNNKLS

SEQ ID NO: 3216128 - protein, 17 aa, Plasmodium falciparum
EEINNYSKANTITHSSN

SEQ ID NO: 3216129 - protein, 37 aa, Plasmodium falciparum
EEIQQRKTNHDNINNNDVNDDNINNNPINDDNISNNH

SEQ ID NO: 3216130 - protein, 4 aa, Plasmodium falciparum
EEIR

SEQ ID NO: 3216131 - protein, 8 aa, Plasmodium falciparum
EEISKQEE

SEQ ID NO: 3216132 - protein, 6 aa, Plasmodium falciparum
EEISKS

SEQ ID NO: 3216133 - protein, 38 aa, Plasmodium falciparum
EEISNNVEKSNNIEKEDNQNINYNDGEELNETDKNEIY

SEQ ID NO: 3216134 - protein, 13 aa, Plasmodium falciparum
EEITNNKTKFKNV

SEQ ID NO: 3216135 - protein, 4 aa, Plasmodium falciparum
EEIV

SEQ ID NO: 3216136 - protein, 44 aa, Plasmodium falciparum
EEKAKKCKEDHSSGEQTEKECQEYPPLPDEEYENEDENEKTNIQ

SEQ ID NO: 3216137 - protein, 43 aa, Plasmodium falciparum
EEKANKCKEDHSSGEQTEKECQESPSVEDEDDTLHEETEVKAP

SEQ ID NO: 3216138 - protein, 7 aa, Plasmodium falciparum
EEKDDKK

SEQ ID NO: 3216139 - protein, 76 aa, Plasmodium falciparum
EEKDDKYEDKYEDKYEDKYEDKYEDKYEDKYEDKYEDKYEDKYKDKYKDKYEDKYEDKYNDKYNDKERKKRNDSRN

SEQ ID NO: 3216140 - protein, 5 aa, Plasmodium falciparum
EEKDG

SEQ ID NO: 3216141 - protein, 9 aa, Plasmodium falciparum
EEKDKNYKT

SEQ ID NO: 3216142 - protein, 8 aa, Plasmodium falciparum
EEKEAQKC

SEQ ID NO: 3216143 - protein, 7 aa, Plasmodium falciparum
EEKEDLT

SEQ ID NO: 3216144 - protein, 54 aa, Plasmodium falciparum
EEKEEEEQEEEEEDEGDDGDGDGKGDVDQDNTVDVGAKEAPKVVEGPTTTQNEV

SEQ ID NO: 3216145 - protein, 5 aa, Plasmodium falciparum
EEKEG

SEQ ID NO: 3216146 - protein, 9 aa, Plasmodium falciparum
EEKEGSVNE

SEQ ID NO: 3216147 - protein, 5 aa, Plasmodium falciparum
EEKEK

SEQ ID NO: 3216148 - protein, 11 aa, Plasmodium falciparum
EEKEKDEKYQN

SEQ ID NO: 3216149 - protein, 11 aa, Plasmodium falciparum
EEKEKEKNKGS

SEQ ID NO: 3216150 - protein, 7 aa, Plasmodium falciparum
EEKEKKF

SEQ ID NO: 3216151 - protein, 39 aa, Plasmodium falciparum
EEKENENEKEVEKDENVHDEKDKVEQIEHEKKKEKDDKE

SEQ ID NO: 3216152 - protein, 13 aa, Plasmodium falciparum
EEKENENENENEK

SEQ ID NO: 3216153 - protein, 5 aa, Plasmodium falciparum
EEKEQ

SEQ ID NO: 3216154 - protein, 4 aa, Plasmodium falciparum
EEKF

SEQ ID NO: 3216155 - protein, 4 aa, Plasmodium falciparum
EEKI

SEQ ID NO: 3216156 - protein, 42 aa, Plasmodium falciparum
EEKIDEKKKKEDDNNNNNNNNNNNNNKNKKIESESVEKTSNN

SEQ ID NO: 3216157 - protein, 5 aa, Plasmodium falciparum
EEKIE

SEQ ID NO: 3216158 - protein, 13 aa, Plasmodium falciparum
EEKIENDNTQDIK

SEQ ID NO: 3216159 - protein, 7 aa, Plasmodium falciparum
EEKIPSE

SEQ ID NO: 3216160 - protein, 4 aa, Plasmodium falciparum
EEKK

SEQ ID NO: 3216161 - protein, 9 aa, Plasmodium falciparum
EEKKEKYNK

SEQ ID NO: 3216162 - protein, 9 aa, Plasmodium falciparum
EEKKINIDN

SEQ ID NO: 3216163 - protein, 15 aa, Plasmodium falciparum
EEKKIYQEKSNKKNI

SEQ ID NO: 3216164 - protein, 7 aa, Plasmodium falciparum
EEKKKDM

SEQ ID NO: 3216165 - protein, 19 aa, Plasmodium falciparum
EEKKKKKKKNRKNKELKEN

SEQ ID NO: 3216166 - protein, 14 aa, Plasmodium falciparum
EEKKKLKEEKKKLK

SEQ ID NO: 3216167 - protein, 8 aa, Plasmodium falciparum
EEKKKNDK

SEQ ID NO: 3216168 - protein, 22 aa, Plasmodium falciparum
EEKKKNEEEAADGTDNENKTTI

SEQ ID NO: 3216169 - protein, 9 aa, Plasmodium falciparum
EEKKKNQDA

SEQ ID NO: 3216170 - protein, 14 aa, Plasmodium falciparum
EEKKKNSLEEKNDD

SEQ ID NO: 3216171 - protein, 7 aa, Plasmodium falciparum
EEKKKNY

SEQ ID NO: 3216172 - protein, 10 aa, Plasmodium falciparum
EEKKKPQEGG

SEQ ID NO: 3216173 - protein, 7 aa, Plasmodium falciparum
EEKKKQV

SEQ ID NO: 3216174 - protein, 128 aa, Plasmodium falciparum
EEKKMKAEQLKKEEEEKIKAEQLKKEEEEKKKVEQLKKKEEEEKKKAEQLKKEEEENKIKAEQLKKKEEEEKKKAEELKKEEEEEKKKAEQLKKEEEEKKKVEQLKKKEEEEKKKAEQLKKEEEENKI

SEQ ID NO: 3216175 - protein, 13 aa, Plasmodium falciparum
EEKKNHKEIDEKN

SEQ ID NO: 3216176 - protein, 57 aa, Plasmodium falciparum
EEKKNQNLQNGNNNNNKGTSNNNNINNNNNNNNNNNNNNNNNHSDNNNNIPHSSHID

SEQ ID NO: 3216177 - protein, 21 aa, Plasmodium falciparum
EEKKQKENSNDMHNPKKNEGH

SEQ ID NO: 3216178 - protein, 13 aa, Plasmodium falciparum
EEKKREEEERADG

SEQ ID NO: 3216179 - protein, 13 aa, Plasmodium falciparum
EEKKRNKLSANNY

SEQ ID NO: 3216180 - protein, 18 aa, Plasmodium falciparum
EEKKRRNNEKEKETSRME

SEQ ID NO: 3216181 - protein, 9 aa, Plasmodium falciparum
EEKKSEIAN

SEQ ID NO: 3216182 - protein, 8 aa, Plasmodium falciparum
EEKKTEDF

SEQ ID NO: 3216183 - protein, 8 aa, Plasmodium falciparum
EEKKTMDE

SEQ ID NO: 3216184 - protein, 24 aa, Plasmodium falciparum
EEKKTMDEEIGDQGSVAEKVEEEE

SEQ ID NO: 3216185 - protein, 12 aa, Plasmodium falciparum
EEKKTPATQNGA

SEQ ID NO: 3216186 - protein, 9 aa, Plasmodium falciparum
EEKLEETGY

SEQ ID NO: 3216187 - protein, 5 aa, Plasmodium falciparum
EEKLK

SEQ ID NO: 3216188 - protein, 14 aa, Plasmodium falciparum
EEKLKKEKKSRHHD

SEQ ID NO: 3216189 - protein, 5 aa, Plasmodium falciparum
EEKLP

SEQ ID NO: 3216190 - protein, 9 aa, Plasmodium falciparum
EEKLSNTTK

SEQ ID NO: 3216191 - protein, 10 aa, Plasmodium falciparum
EEKMNEEKNE

SEQ ID NO: 3216192 - protein, 89 aa, Plasmodium falciparum
EEKNDVNVNNNDDNNDNNNNNNNNNNNNNNNNNNNNNNNNNNNNNNNNNNNNNNNNNINNSNNSNNHNRGNSFSNDEKHKDKMNEEGYD

SEQ ID NO: 3216193 - protein, 10 aa, Plasmodium falciparum
EEKNEDVDVE

SEQ ID NO: 3216194 - protein, 9 aa, Plasmodium falciparum
EEKNEEKEK

SEQ ID NO: 3216195 - protein, 13 aa, Plasmodium falciparum
EEKNEELEKSKES

SEQ ID NO: 3216196 - protein, 9 aa, Plasmodium falciparum
EEKNGKDIK

SEQ ID NO: 3216197 - protein, 8 aa, Plasmodium falciparum
EEKNGNSH

SEQ ID NO: 3216198 - protein, 6 aa, Plasmodium falciparum
EEKNIN

SEQ ID NO: 3216199 - protein, 9 aa, Plasmodium falciparum
EEKNKKKRL

SEQ ID NO: 3216200 - protein, 26 aa, Plasmodium falciparum
EEKNQGDNQKKRKRNKRGRNNNDDTS

SEQ ID NO: 3216201 - protein, 28 aa, Plasmodium falciparum
EEKNQHKQNTETSLNKDNRGSSNSTSNF

SEQ ID NO: 3216202 - protein, 15 aa, Plasmodium falciparum
EEKNTKENNNAGTPF

SEQ ID NO: 3216203 - protein, 4 aa, Plasmodium falciparum
EEKP

SEQ ID NO: 3216204 - protein, 81 aa, Plasmodium falciparum
EEKPNVDGVSTSNTPGGNESSSASPNLSDAAEKKDEKEASEQGEESHKKENSQESANGKDDVKEEKKTNEKKDDGKTDKVQ

SEQ ID NO: 3216205 - protein, 16 aa, Plasmodium falciparum
EEKPVEEKSVSEEIPV

SEQ ID NO: 3216206 - protein, 5 aa, Plasmodium falciparum
EEKQN

SEQ ID NO: 3216207 - protein, 6 aa, Plasmodium falciparum
EEKQNE

SEQ ID NO: 3216208 - protein, 8 aa, Plasmodium falciparum
EEKQNENM

SEQ ID NO: 3216209 - protein, 6 aa, Plasmodium falciparum
EEKQYL

SEQ ID NO: 3216210 - protein, 7 aa, Plasmodium falciparum
EEKRKEI

SEQ ID NO: 3216211 - protein, 6 aa, Plasmodium falciparum
EEKRKK

SEQ ID NO: 3216212 - protein, 11 aa, Plasmodium falciparum
EEKSESEKSLD

SEQ ID NO: 3216213 - protein, 16 aa, Plasmodium falciparum
EEKSINNVKDNDTINN

SEQ ID NO: 3216214 - protein, 8 aa, Plasmodium falciparum
EEKSKNVD

SEQ ID NO: 3216215 - protein, 6 aa, Plasmodium falciparum
EEKSNE

SEQ ID NO: 3216216 - protein, 6 aa, Plasmodium falciparum
EEKSNI

SEQ ID NO: 3216217 - protein, 6 aa, Plasmodium falciparum
EEKSSL

SEQ ID NO: 3216218 - protein, 36 aa, Plasmodium falciparum
EEKSTNQRDYYKDNKNDTKIYDEEQDDKHKDNFHNK

SEQ ID NO: 3216219 - protein, 8 aa, Plasmodium falciparum
EEKSVSEE

SEQ ID NO: 3216220 - protein, 10 aa, Plasmodium falciparum
EEKSVSEEIP

SEQ ID NO: 3216221 - protein, 21 aa, Plasmodium falciparum
EEKSVTEEVEEKESVKEEVEE

SEQ ID NO: 3216222 - protein, 9 aa, Plasmodium falciparum
EEKTKDQDL

SEQ ID NO: 3216223 - protein, 6 aa, Plasmodium falciparum
EEKTKK

SEQ ID NO: 3216224 - protein, 15 aa, Plasmodium falciparum
EEKTNKKKKKKMNDI

SEQ ID NO: 3216225 - protein, 18 aa, Plasmodium falciparum
EEKTSGSDGEKKIEKDDA

SEQ ID NO: 3216226 - protein, 22 aa, Plasmodium falciparum
EEKTSSASGGEKNTTITQDDGL

SEQ ID NO: 3216227 - protein, 4 aa, Plasmodium falciparum
EEKV

SEQ ID NO: 3216228 - protein, 5 aa, Plasmodium falciparum
EEKVR

SEQ ID NO: 3216229 - protein, 4 aa, Plasmodium falciparum
EEKY

SEQ ID NO: 3216230 - protein, 58 aa, Plasmodium falciparum
EEKYDDDDEAENEKKKQEKIKDNKKEEEDAYEDNEDNEDYDDYDDYDDYDEEQYDKNG

SEQ ID NO: 3216231 - protein, 29 aa, Plasmodium falciparum
EEKYESEKYEEDKTYQSSENNIYDSNNYE

SEQ ID NO: 3216232 - protein, 8 aa, Plasmodium falciparum
EEKYESKH

SEQ ID NO: 3216233 - protein, 4 aa, Plasmodium falciparum
EELD

SEQ ID NO: 3216234 - protein, 15 aa, Plasmodium falciparum
EELDNQKKVKKSERK

SEQ ID NO: 3216235 - protein, 7 aa, Plasmodium falciparum
EELDTEE

SEQ ID NO: 3216236 - protein, 4 aa, Plasmodium falciparum
EELE

SEQ ID NO: 3216237 - protein, 7 aa, Plasmodium falciparum
EELEEEY

SEQ ID NO: 3216238 - protein, 12 aa, Plasmodium falciparum
EELEKEKNKIQQ

SEQ ID NO: 3216239 - protein, 4 aa, Plasmodium falciparum
EELG

SEQ ID NO: 3216240 - protein, 154 aa, Plasmodium falciparum
EELGKEEEPYEKGDYEEVGKEEASYDKGDAEEIGKEEASDDKGDSEELGKEEEPYEKGDYEEVGKEEASYDKGDAEEIGKEEASDDKGDSEEVGKEEASDDKGYSEEVGKEEGSYDKGDAEEVEDEDEEHIRSKEEVKEPEIGTDIEEENKEKY

SEQ ID NO: 3216241 - protein, 38 aa, Plasmodium falciparum
EELGKNVGNNNNMANNNNNDNNDNNINNNNNNNNGENI

SEQ ID NO: 3216242 - protein, 4 aa, Plasmodium falciparum
EELK

SEQ ID NO: 3216243 - protein, 10 aa, Plasmodium falciparum
EELKKNQNNI

SEQ ID NO: 3216244 - protein, 7 aa, Plasmodium falciparum
EELKKQS

SEQ ID NO: 3216245 - protein, 11 aa, Plasmodium falciparum
EELKKYEEKKR

SEQ ID NO: 3216246 - protein, 5 aa, Plasmodium falciparum
EELKN

SEQ ID NO: 3216247 - protein, 4 aa, Plasmodium falciparum
EELN

SEQ ID NO: 3216248 - protein, 18 aa, Plasmodium falciparum
EELNKKKKKKMNKDDRIE

SEQ ID NO: 3216249 - protein, 6 aa, Plasmodium falciparum
EELNKS

SEQ ID NO: 3216250 - protein, 5 aa, Plasmodium falciparum
EELNN

SEQ ID NO: 3216251 - protein, 7 aa, Plasmodium falciparum
EELNNNI

SEQ ID NO: 3216252 - protein, 5 aa, Plasmodium falciparum
EELQE

SEQ ID NO: 3216253 - protein, 66 aa, Plasmodium falciparum
EELSNEKDMNKNKKRNLKNDHKNKKGNIDKNKKGNSNKKKNNTNDDNIKNNYSVDKNSDDDISNES

SEQ ID NO: 3216254 - protein, 9 aa, Plasmodium falciparum
EELSQEELK

SEQ ID NO: 3216255 - protein, 4 aa, Plasmodium falciparum
EELT

SEQ ID NO: 3216256 - protein, 14 aa, Plasmodium falciparum
EELTKDDQGEEDVD

SEQ ID NO: 3216257 - protein, 33 aa, Plasmodium falciparum
EEMNNEEDHKESDSNDKNNNDYSYDKNNNNNNN

SEQ ID NO: 3216258 - protein, 13 aa, Plasmodium falciparum
EEMSESINNTNNM

SEQ ID NO: 3216259 - protein, 6 aa, Plasmodium falciparum
EEMSNP

SEQ ID NO: 3216260 - protein, 4 aa, Plasmodium falciparum
EENA

SEQ ID NO: 3216261 - protein, 25 aa, Plasmodium falciparum
EENANKNKYTEEDKKEIKGNDKKNV

SEQ ID NO: 3216262 - protein, 5 aa, Plasmodium falciparum
EENDE

SEQ ID NO: 3216263 - protein, 8 aa, Plasmodium falciparum
EENDEEYK

SEQ ID NO: 3216264 - protein, 6 aa, Plasmodium falciparum
EENDKE

SEQ ID NO: 3216265 - protein, 13 aa, Plasmodium falciparum
EENDNTVKERKKK

SEQ ID NO: 3216266 - protein, 7 aa, Plasmodium falciparum
EENDSNW

SEQ ID NO: 3216267 - protein, 7 aa, Plasmodium falciparum
EENEDKK

SEQ ID NO: 3216268 - protein, 9 aa, Plasmodium falciparum
EENEEEDEN

SEQ ID NO: 3216269 - protein, 33 aa, Plasmodium falciparum
EENEEKNKLGTIPRHNTTTTNNNNNDNNNNSNN

SEQ ID NO: 3216270 - protein, 50 aa, Plasmodium falciparum
EENEENEESEEGEESEEGEGNEENEGNEENEGNEENEGNEENEKNKNYQI

SEQ ID NO: 3216271 - protein, 8 aa, Plasmodium falciparum
EENEENRN

SEQ ID NO: 3216272 - protein, 5 aa, Plasmodium falciparum
EENEK

SEQ ID NO: 3216273 - protein, 10 aa, Plasmodium falciparum
EENEKKKEEE

SEQ ID NO: 3216274 - protein, 57 aa, Plasmodium falciparum
EENENYKNKIKKSNNNNSDSDDNNKRDNHNNENNNNEYNNEYNNKCNNYDNNNNNNN

SEQ ID NO: 3216275 - protein, 7 aa, Plasmodium falciparum
EENEQSR

SEQ ID NO: 3216276 - protein, 11 aa, Plasmodium falciparum
EENETQQSNVK

SEQ ID NO: 3216277 - protein, 19 aa, Plasmodium falciparum
EENFQEGEDQYNNYDHNNS

SEQ ID NO: 3216278 - protein, 4 aa, Plasmodium falciparum
EENG

SEQ ID NO: 3216279 - protein, 9 aa, Plasmodium falciparum
EENGKNENV

SEQ ID NO: 3216280 - protein, 6 aa, Plasmodium falciparum
EENGSP

SEQ ID NO: 3216281 - protein, 6 aa, Plasmodium falciparum
EENGVD

SEQ ID NO: 3216282 - protein, 6 aa, Plasmodium falciparum
EENHSK

SEQ ID NO: 3216283 - protein, 5 aa, Plasmodium falciparum
EENID

SEQ ID NO: 3216284 - protein, 7 aa, Plasmodium falciparum
EENIHTN

SEQ ID NO: 3216285 - protein, 20 aa, Plasmodium falciparum
EENINEKNSNERKEQSVNSN

SEQ ID NO: 3216286 - protein, 14 aa, Plasmodium falciparum
EENINNDDDDDKKI

SEQ ID NO: 3216287 - protein, 6 aa, Plasmodium falciparum
EENKEF

SEQ ID NO: 3216288 - protein, 15 aa, Plasmodium falciparum
EENKEQCKDGHVKES

SEQ ID NO: 3216289 - protein, 14 aa, Plasmodium falciparum
EENKHISKESSDMY

SEQ ID NO: 3216290 - protein, 14 aa, Plasmodium falciparum
EENKINDIQDGNIS

SEQ ID NO: 3216291 - protein, 9 aa, Plasmodium falciparum
EENKKAAST

SEQ ID NO: 3216292 - protein, 12 aa, Plasmodium falciparum
EENKKDKTINNE

SEQ ID NO: 3216293 - protein, 7 aa, Plasmodium falciparum
EENKKGK

SEQ ID NO: 3216294 - protein, 6 aa, Plasmodium falciparum
EENKKI

SEQ ID NO: 3216295 - protein, 17 aa, Plasmodium falciparum
EENKKKINNSENDPLNT

SEQ ID NO: 3216296 - protein, 8 aa, Plasmodium falciparum
EENKKKNK

SEQ ID NO: 3216297 - protein, 11 aa, Plasmodium falciparum
EENKKKYEHAQ

SEQ ID NO: 3216298 - protein, 19 aa, Plasmodium falciparum
EENKKSINRLDTSKGYDNR

SEQ ID NO: 3216299 - protein, 15 aa, Plasmodium falciparum
EENKKVQIKENEENF

SEQ ID NO: 3216300 - protein, 8 aa, Plasmodium falciparum
EENKLGGN

SEQ ID NO: 3216301 - protein, 9 aa, Plasmodium falciparum
EENKNDESL

SEQ ID NO: 3216302 - protein, 6 aa, Plasmodium falciparum
EENKNI

SEQ ID NO: 3216303 - protein, 12 aa, Plasmodium falciparum
EENKNNKRHNIN

SEQ ID NO: 3216304 - protein, 7 aa, Plasmodium falciparum
EENKNNL

SEQ ID NO: 3216305 - protein, 8 aa, Plasmodium falciparum
EENKNNVS

SEQ ID NO: 3216306 - protein, 12 aa, Plasmodium falciparum
EENKREQYKENI

SEQ ID NO: 3216307 - protein, 15 aa, Plasmodium falciparum
EENKRSLNGEYSDNP

SEQ ID NO: 3216308 - protein, 14 aa, Plasmodium falciparum
EENKVERKKENKYL

SEQ ID NO: 3216309 - protein, 5 aa, Plasmodium falciparum
EENLN

SEQ ID NO: 3216310 - protein, 9 aa, Plasmodium falciparum
EENLTTPKK

SEQ ID NO: 3216311 - protein, 13 aa, Plasmodium falciparum
EENMSKEVEERNN

SEQ ID NO: 3216312 - protein, 6 aa, Plasmodium falciparum
EENNAI

SEQ ID NO: 3216313 - protein, 9 aa, Plasmodium falciparum
EENNDTNNI

SEQ ID NO: 3216314 - protein, 7 aa, Plasmodium falciparum
EENNEKT

SEQ ID NO: 3216315 - protein, 14 aa, Plasmodium falciparum
EENNEYDKNELQGY

SEQ ID NO: 3216316 - protein, 25 aa, Plasmodium falciparum
EENNGAMSTSPKSTSAAPSDNTPTT

SEQ ID NO: 3216317 - protein, 14 aa, Plasmodium falciparum
EENNLEDNVQNKDK

SEQ ID NO: 3216318 - protein, 7 aa, Plasmodium falciparum
EENNLET

SEQ ID NO: 3216319 - protein, 19 aa, Plasmodium falciparum
EENNMDKLNKDGRDVNKGV

SEQ ID NO: 3216320 - protein, 17 aa, Plasmodium falciparum
EENNNENVTNRKQNEQK

SEQ ID NO: 3216321 - protein, 12 aa, Plasmodium falciparum
EENNNNNDDNKN

SEQ ID NO: 3216322 - protein, 10 aa, Plasmodium falciparum
EENNPGESHN

SEQ ID NO: 3216323 - protein, 8 aa, Plasmodium falciparum
EENNSTSN

SEQ ID NO: 3216324 - protein, 9 aa, Plasmodium falciparum
EENNTIEEK

SEQ ID NO: 3216325 - protein, 11 aa, Plasmodium falciparum
EENNTNKTDIE

SEQ ID NO: 3216326 - protein, 5 aa, Plasmodium falciparum
EENPD

SEQ ID NO: 3216327 - protein, 8 aa, Plasmodium falciparum
EENPQIND

SEQ ID NO: 3216328 - protein, 4 aa, Plasmodium falciparum
EENQ

SEQ ID NO: 3216329 - protein, 8 aa, Plasmodium falciparum
EENQKLEK

SEQ ID NO: 3216330 - protein, 13 aa, Plasmodium falciparum
EENQNKNKNQYQN

SEQ ID NO: 3216331 - protein, 7 aa, Plasmodium falciparum
EENQTCS

SEQ ID NO: 3216332 - protein, 4 aa, Plasmodium falciparum
EENS

SEQ ID NO: 3216333 - protein, 8 aa, Plasmodium falciparum
EENSDNKC

SEQ ID NO: 3216334 - protein, 32 aa, Plasmodium falciparum
EENSGTGGPRGPNESPNSKPPSSTSENKPTTL

SEQ ID NO: 3216335 - protein, 14 aa, Plasmodium falciparum
EENSKTKECTNNIT

SEQ ID NO: 3216336 - protein, 20 aa, Plasmodium falciparum
EENSLNKSGKCKKKQLRDET

SEQ ID NO: 3216337 - protein, 14 aa, Plasmodium falciparum
EENSPTEEITTEYN

SEQ ID NO: 3216338 - protein, 8 aa, Plasmodium falciparum
EENSYTKL

SEQ ID NO: 3216339 - protein, 10 aa, Plasmodium falciparum
EENTENTVEA

SEQ ID NO: 3216340 - protein, 9 aa, Plasmodium falciparum
EENTHKKQE

SEQ ID NO: 3216341 - protein, 10 aa, Plasmodium falciparum
EENTNDTYEN

SEQ ID NO: 3216342 - protein, 36 aa, Plasmodium falciparum
EENTTSGNNNDNNDNNNDNDNKNDNDNDNNNDNDNI

SEQ ID NO: 3216343 - protein, 8 aa, Plasmodium falciparum
EENTVEAP

SEQ ID NO: 3216344 - protein, 7 aa, Plasmodium falciparum
EENTYSR

SEQ ID NO: 3216345 - protein, 8 aa, Plasmodium falciparum
EENVDNKN

SEQ ID NO: 3216346 - protein, 5 aa, Plasmodium falciparum
EENVE

SEQ ID NO: 3216347 - protein, 9 aa, Plasmodium falciparum
EENVEKEVE

SEQ ID NO: 3216348 - protein, 8 aa, Plasmodium falciparum
EENYKDAP

SEQ ID NO: 3216349 - protein, 7 aa, Plasmodium falciparum
EENYNGY

SEQ ID NO: 3216350 - protein, 10 aa, Plasmodium falciparum
EENYNISSSD

SEQ ID NO: 3216351 - protein, 13 aa, Plasmodium falciparum
EEPEEIKKGGSKT

SEQ ID NO: 3216352 - protein, 5 aa, Plasmodium falciparum
EEPKE

SEQ ID NO: 3216353 - protein, 6 aa, Plasmodium falciparum
EEPKYE

SEQ ID NO: 3216354 - protein, 8 aa, Plasmodium falciparum
EEPLNSGY

SEQ ID NO: 3216355 - protein, 7 aa, Plasmodium falciparum
EEPNKIE

SEQ ID NO: 3216356 - protein, 17 aa, Plasmodium falciparum
EEPPLSVTPNKTTNSNN

SEQ ID NO: 3216357 - protein, 5 aa, Plasmodium falciparum
EEPQK

SEQ ID NO: 3216358 - protein, 6 aa, Plasmodium falciparum
EEPVTD

SEQ ID NO: 3216359 - protein, 5 aa, Plasmodium falciparum
EEPYF

SEQ ID NO: 3216360 - protein, 57 aa, Plasmodium falciparum
EEQDAQKCVSNNPEKCEETQKPPTDGAPGGAGPSPDTGTDDNLEDIDSDGEEDDDVS

SEQ ID NO: 3216361 - protein, 11 aa, Plasmodium falciparum
EEQEDEEEEKK

SEQ ID NO: 3216362 - protein, 9 aa, Plasmodium falciparum
EEQEINEKS

SEQ ID NO: 3216363 - protein, 5 aa, Plasmodium falciparum
EEQEK

SEQ ID NO: 3216364 - protein, 35 aa, Plasmodium falciparum
EEQGGEEKIKTKKKKKKNDEKESIKRDDTPIYKES

SEQ ID NO: 3216365 - protein, 8 aa, Plasmodium falciparum
EEQGSENE

SEQ ID NO: 3216366 - protein, 17 aa, Plasmodium falciparum
EEQHYNGDNKSVHTNKN

SEQ ID NO: 3216367 - protein, 18 aa, Plasmodium falciparum
EEQINNDNTYDNEKETNN

SEQ ID NO: 3216368 - protein, 99 aa, Plasmodium falciparum
EEQKEKEEGDCDKAVTPDSDTGGNGEKEDSRSEEEEEVSGSGDQGSPPAPPPPESPQEKAPAPAPEELPPGPERPPKPAAPTSTPEVPAQPLPSDNTSD

SEQ ID NO: 3216369 - protein, 6 aa, Plasmodium falciparum
EEQKYG

SEQ ID NO: 3216370 - protein, 11 aa, Plasmodium falciparum
EEQLDSEEIKE

SEQ ID NO: 3216371 - protein, 21 aa, Plasmodium falciparum
EEQLDSEEIKEEQLDSEEIKE

SEQ ID NO: 3216372 - protein, 41 aa, Plasmodium falciparum
EEQLDSEEIKEEQLDSEEIKEEQLDSEEIKEEQLDSEEIKE

SEQ ID NO: 3216373 - protein, 49 aa, Plasmodium falciparum
EEQLDSEEIKEEQLDSEEIKEEQLDSEEIKEEQLDSEEIKEQKGSVNEE

SEQ ID NO: 3216374 - protein, 6 aa, Plasmodium falciparum
EEQLST

SEQ ID NO: 3216375 - protein, 15 aa, Plasmodium falciparum
EEQMKTRKKAQRPKL

SEQ ID NO: 3216376 - protein, 9 aa, Plasmodium falciparum
EEQNASCNK

SEQ ID NO: 3216377 - protein, 8 aa, Plasmodium falciparum
EEQNEHGQ

SEQ ID NO: 3216378 - protein, 21 aa, Plasmodium falciparum
EEQNIENGTSHNIQDKTKSGI

SEQ ID NO: 3216379 - protein, 5 aa, Plasmodium falciparum
EEQNK

SEQ ID NO: 3216380 - protein, 7 aa, Plasmodium falciparum
EEQNKND

SEQ ID NO: 3216381 - protein, 9 aa, Plasmodium falciparum
EEQNKNEDS

SEQ ID NO: 3216382 - protein, 7 aa, Plasmodium falciparum
EEQNKNG

SEQ ID NO: 3216383 - protein, 8 aa, Plasmodium falciparum
EEQNPENM

SEQ ID NO: 3216384 - protein, 8 aa, Plasmodium falciparum
EEQQHSSV

SEQ ID NO: 3216385 - protein, 6 aa, Plasmodium falciparum
EEQQNN

SEQ ID NO: 3216386 - protein, 13 aa, Plasmodium falciparum
EEQSKIKEKKLKE

SEQ ID NO: 3216387 - protein, 8 aa, Plasmodium falciparum
EEQTIKDA

SEQ ID NO: 3216388 - protein, 10 aa, Plasmodium falciparum
EEQTKKEKRT

SEQ ID NO: 3216389 - protein, 6 aa, Plasmodium falciparum
EEQTYK

SEQ ID NO: 3216390 - protein, 18 aa, Plasmodium falciparum
EERDKRRDVLNSSNDKDK

SEQ ID NO: 3216391 - protein, 9 aa, Plasmodium falciparum
EERENASKN

SEQ ID NO: 3216392 - protein, 6 aa, Plasmodium falciparum
EERGDR

SEQ ID NO: 3216393 - protein, 33 aa, Plasmodium falciparum
EERGENDEEDKENDKDMNEGDVNKNNNKKENNH

SEQ ID NO: 3216394 - protein, 7 aa, Plasmodium falciparum
EERKDDN

SEQ ID NO: 3216395 - protein, 33 aa, Plasmodium falciparum
EERKDNNEYDNDKYKKDSFEQDEENEKMRKKKE

SEQ ID NO: 3216396 - protein, 14 aa, Plasmodium falciparum
EERKEDIEKEKIKR

SEQ ID NO: 3216397 - protein, 17 aa, Plasmodium falciparum
EERKKKNVKDNNNSIDY

SEQ ID NO: 3216398 - protein, 14 aa, Plasmodium falciparum
EERKNNKNSRDDSY

SEQ ID NO: 3216399 - protein, 24 aa, Plasmodium falciparum
EERKRKKEQERKRKKKENLKENKR

SEQ ID NO: 3216400 - protein, 10 aa, Plasmodium falciparum
EERKTKDTLK

SEQ ID NO: 3216401 - protein, 4 aa, Plasmodium falciparum
EERN

SEQ ID NO: 3216402 - protein, 6 aa, Plasmodium falciparum
EERNKK

SEQ ID NO: 3216403 - protein, 6 aa, Plasmodium falciparum
EERQNK

SEQ ID NO: 3216404 - protein, 14 aa, Plasmodium falciparum
EERRNKSKANYRYS

SEQ ID NO: 3216405 - protein, 20 aa, Plasmodium falciparum
EERSVTEKPVEVERSATEDL

SEQ ID NO: 3216406 - protein, 4 aa, Plasmodium falciparum
EERV

SEQ ID NO: 3216407 - protein, 19 aa, Plasmodium falciparum
EERVEEESATEEVDERESV

SEQ ID NO: 3216408 - protein, 15 aa, Plasmodium falciparum
EERVNNARPVRTRKA

SEQ ID NO: 3216409 - protein, 9 aa, Plasmodium falciparum
EESDAGETR

SEQ ID NO: 3216410 - protein, 9 aa, Plasmodium falciparum
EESDKNNFS

SEQ ID NO: 3216411 - protein, 7 aa, Plasmodium falciparum
EESENEE

SEQ ID NO: 3216412 - protein, 13 aa, Plasmodium falciparum
EESEQVKEAKQDL

SEQ ID NO: 3216413 - protein, 10 aa, Plasmodium falciparum
EESESSNEKF

SEQ ID NO: 3216414 - protein, 4 aa, Plasmodium falciparum
EESF

SEQ ID NO: 3216415 - protein, 10 aa, Plasmodium falciparum
EESGNSSDSL

SEQ ID NO: 3216416 - protein, 54 aa, Plasmodium falciparum
EESHKRKKEEQKRKEELKKREEIKKKEDEGKEKIYNNKTNEKSNDIYKNEKNTN

SEQ ID NO: 3216417 - protein, 18 aa, Plasmodium falciparum
EESIEKENKNVYGKNEYN

SEQ ID NO: 3216418 - protein, 8 aa, Plasmodium falciparum
EESKGEHI

SEQ ID NO: 3216419 - protein, 48 aa, Plasmodium falciparum
EESLPSKEETNKNNNNNNNNNNNNSNNNNNNNNNSNNNNNVEDNRKED

SEQ ID NO: 3216420 - protein, 7 aa, Plasmodium falciparum
EESLSSN

SEQ ID NO: 3216421 - protein, 18 aa, Plasmodium falciparum
EESNDNISTKIDEEEKNR

SEQ ID NO: 3216422 - protein, 5 aa, Plasmodium falciparum
EESNE

SEQ ID NO: 3216423 - protein, 9 aa, Plasmodium falciparum
EESNITPKN

SEQ ID NO: 3216424 - protein, 10 aa, Plasmodium falciparum
EESNKKTKQI

SEQ ID NO: 3216425 - protein, 7 aa, Plasmodium falciparum
EESNNVV

SEQ ID NO: 3216426 - protein, 6 aa, Plasmodium falciparum
EESNSM

SEQ ID NO: 3216427 - protein, 7 aa, Plasmodium falciparum
EESPKSI

SEQ ID NO: 3216428 - protein, 6 aa, Plasmodium falciparum
EESQNK

SEQ ID NO: 3216429 - protein, 11 aa, Plasmodium falciparum
EESSDSDTYYE

SEQ ID NO: 3216430 - protein, 10 aa, Plasmodium falciparum
EESVKKYEAE

SEQ ID NO: 3216431 - protein, 17 aa, Plasmodium falciparum
EESVTKEVGETELSTQE

SEQ ID NO: 3216432 - protein, 4 aa, Plasmodium falciparum
EESY

SEQ ID NO: 3216433 - protein, 31 aa, Plasmodium falciparum
EESYSQETQSDNTDDEKDNDLPDTELMITRL

SEQ ID NO: 3216434 - protein, 7 aa, Plasmodium falciparum
EETATEE

SEQ ID NO: 3216435 - protein, 7 aa, Plasmodium falciparum
EETDDIN

SEQ ID NO: 3216436 - protein, 6 aa, Plasmodium falciparum
EETDDY

SEQ ID NO: 3216437 - protein, 5 aa, Plasmodium falciparum
EETDH

SEQ ID NO: 3216438 - protein, 7 aa, Plasmodium falciparum
EETDIDE

SEQ ID NO: 3216439 - protein, 5 aa, Plasmodium falciparum
EETEE

SEQ ID NO: 3216440 - protein, 6 aa, Plasmodium falciparum
EETEEG

SEQ ID NO: 3216441 - protein, 6 aa, Plasmodium falciparum
EETESI

SEQ ID NO: 3216442 - protein, 7 aa, Plasmodium falciparum
EETESVS

SEQ ID NO: 3216443 - protein, 5 aa, Plasmodium falciparum
EETFS

SEQ ID NO: 3216444 - protein, 6 aa, Plasmodium falciparum
EETGAV

SEQ ID NO: 3216445 - protein, 5 aa, Plasmodium falciparum
EETGP

SEQ ID NO: 3216446 - protein, 5 aa, Plasmodium falciparum
EETHY

SEQ ID NO: 3216447 - protein, 74 aa, Plasmodium falciparum
EETKEAVDEEGECKASSPAEPKVQEEKEEQKDKKDEETEQAAPTGDKGTKELPLTPRPRPGPQPKPPPQVEKNP

SEQ ID NO: 3216448 - protein, 18 aa, Plasmodium falciparum
EETKKEKEKKKKKKHNYN

SEQ ID NO: 3216449 - protein, 10 aa, Plasmodium falciparum
EETLDEEERR

SEQ ID NO: 3216450 - protein, 4 aa, Plasmodium falciparum
EETN

SEQ ID NO: 3216451 - protein, 7 aa, Plasmodium falciparum
EETNDCA

SEQ ID NO: 3216452 - protein, 8 aa, Plasmodium falciparum
EETNEINE

SEQ ID NO: 3216453 - protein, 15 aa, Plasmodium falciparum
EETNHDHEDREQKVT

SEQ ID NO: 3216454 - protein, 10 aa, Plasmodium falciparum
EETNKNKKIK

SEQ ID NO: 3216455 - protein, 10 aa, Plasmodium falciparum
EETQKRTSHN

SEQ ID NO: 3216456 - protein, 17 aa, Plasmodium falciparum
EETQVSNPLSYSEENII

SEQ ID NO: 3216457 - protein, 10 aa, Plasmodium falciparum
EETSSNENSE

SEQ ID NO: 3216458 - protein, 9 aa, Plasmodium falciparum
EETTAESVT

SEQ ID NO: 3216459 - protein, 7 aa, Plasmodium falciparum
EETTNEF

SEQ ID NO: 3216460 - protein, 15 aa, Plasmodium falciparum
EETTVDADNQNKTTI

SEQ ID NO: 3216461 - protein, 6 aa, Plasmodium falciparum
EETVDN

SEQ ID NO: 3216462 - protein, 6 aa, Plasmodium falciparum
EETYEN

SEQ ID NO: 3216463 - protein, 7 aa, Plasmodium falciparum
EETYTES

SEQ ID NO: 3216464 - protein, 4 aa, Plasmodium falciparum
EEVD

SEQ ID NO: 3216465 - protein, 6 aa, Plasmodium falciparum
EEVDEE

SEQ ID NO: 3216466 - protein, 10 aa, Plasmodium falciparum
EEVDENTNPL

SEQ ID NO: 3216467 - protein, 4 aa, Plasmodium falciparum
EEVE

SEQ ID NO: 3216468 - protein, 13 aa, Plasmodium falciparum
EEVEEEEKSVSEE

SEQ ID NO: 3216469 - protein, 13 aa, Plasmodium falciparum
EEVESKGKEKKKK

SEQ ID NO: 3216470 - protein, 67 aa, Plasmodium falciparum
EEVKEEEKCEAATAPPKEPAQPALDTESKTKANEEAKPPEPVKPAQPLPQPPSPVPPNQSDQPTNSI

SEQ ID NO: 3216471 - protein, 10 aa, Plasmodium falciparum
EEVKEKNLNT

SEQ ID NO: 3216472 - protein, 28 aa, Plasmodium falciparum
EEVKQKNKKKQNKTKKITNNNNNNNNNI

SEQ ID NO: 3216473 - protein, 10 aa, Plasmodium falciparum
EEVKSGKRNQ

SEQ ID NO: 3216474 - protein, 14 aa, Plasmodium falciparum
EEVNDDEKKKKLSR

SEQ ID NO: 3216475 - protein, 6 aa, Plasmodium falciparum
EEVNDI

SEQ ID NO: 3216476 - protein, 9 aa, Plasmodium falciparum
EEVNNNKKG

SEQ ID NO: 3216477 - protein, 11 aa, Plasmodium falciparum
EEVSSSDEVVE

SEQ ID NO: 3216478 - protein, 5 aa, Plasmodium falciparum
EEVTQ

SEQ ID NO: 3216479 - protein, 6 aa, Plasmodium falciparum
EEVTRT

SEQ ID NO: 3216480 - protein, 21 aa, Plasmodium falciparum
EEVTRTDTSCNNNNNNNNNNI

SEQ ID NO: 3216481 - protein, 4 aa, Plasmodium falciparum
EEWE

SEQ ID NO: 3216482 - protein, 7 aa, Plasmodium falciparum
EEWEKKE

SEQ ID NO: 3216483 - protein, 24 aa, Plasmodium falciparum
EEWENDTSTSGNTHPSDSNKTLNT

SEQ ID NO: 3216484 - protein, 4 aa, Plasmodium falciparum
EEWG

SEQ ID NO: 3216485 - protein, 17 aa, Plasmodium falciparum
EEWNKDNNKHNGENTIN

SEQ ID NO: 3216486 - protein, 54 aa, Plasmodium falciparum
EEWNKDNNSGNINPSGNINPSGNTPPTSDIPSGKLSDTPSDNNIPSSNKTLNTD

SEQ ID NO: 3216487 - protein, 22 aa, Plasmodium falciparum
EEWNKEKDGGNVPSDSNKRLNT

SEQ ID NO: 3216488 - protein, 22 aa, Plasmodium falciparum
EEWNKENKNNSNVTDTNGENNI

SEQ ID NO: 3216489 - protein, 27 aa, Plasmodium falciparum
EEWNKKNNNNSDLTHTSSNIPSGENSI

SEQ ID NO: 3216490 - protein, 4 aa, Plasmodium falciparum
EEWQ

SEQ ID NO: 3216491 - protein, 63 aa, Plasmodium falciparum
EEYDDDDDVDDSNIDKDDLSNSDDNDDDDDEDVSEEDDNDDNEDENINNNLDEKNKKDNKDDY

SEQ ID NO: 3216492 - protein, 19 aa, Plasmodium falciparum
EEYEDNEDEKYNKDEDDYA

SEQ ID NO: 3216493 - protein, 14 aa, Plasmodium falciparum
EEYEENNMDEKKKN

SEQ ID NO: 3216494 - protein, 6 aa, Plasmodium falciparum
EEYEKN

SEQ ID NO: 3216495 - protein, 16 aa, Plasmodium falciparum
EEYGENKNSHENSEDN

SEQ ID NO: 3216496 - protein, 17 aa, Plasmodium falciparum
EEYGKNKNSQENSEDNI

SEQ ID NO: 3216497 - protein, 10 aa, Plasmodium falciparum
EEYKDADEIT

SEQ ID NO: 3216498 - protein, 11 aa, Plasmodium falciparum
EEYKNGGSDEK

SEQ ID NO: 3216499 - protein, 8 aa, Plasmodium falciparum
EEYKNNSD

SEQ ID NO: 3216500 - protein, 4 aa, Plasmodium falciparum
EEYN

SEQ ID NO: 3216501 - protein, 4 aa, Plasmodium falciparum
EEYS

SEQ ID NO: 3216502 - protein, 5 aa, Plasmodium falciparum
EEYSI

SEQ ID NO: 3216503 - protein, 9 aa, Plasmodium falciparum
EEYSKDQNV

SEQ ID NO: 3216504 - protein, 10 aa, Plasmodium falciparum
EEYSQENKIN

SEQ ID NO: 3216505 - protein, 6 aa, Plasmodium falciparum
EEYSSL

SEQ ID NO: 3216506 - protein, 6 aa, Plasmodium falciparum
EEYSSM

SEQ ID NO: 3216507 - protein, 20 aa, Plasmodium falciparum
EEYSTLPNSKEMKNISGDNI

SEQ ID NO: 3216508 - protein, 5 aa, Plasmodium falciparum
EEYTK

SEQ ID NO: 3216509 - protein, 17 aa, Plasmodium falciparum
EEYTPQELKQLEYYMQI

SEQ ID NO: 3216510 - protein, 21 aa, Plasmodium falciparum
EFAEKAGAAMGKAAGDAAGAA

SEQ ID NO: 3216511 - protein, 10 aa, Plasmodium falciparum
EFDRNNDDTI

SEQ ID NO: 3216512 - protein, 7 aa, Plasmodium falciparum
EFEEGNK

SEQ ID NO: 3216513 - protein, 16 aa, Plasmodium falciparum
EFEKDNEKKKNYDNIN

SEQ ID NO: 3216514 - protein, 12 aa, Plasmodium falciparum
EFEKKKRKKNLL

SEQ ID NO: 3216515 - protein, 5 aa, Plasmodium falciparum
EFENS

SEQ ID NO: 3216516 - protein, 10 aa, Plasmodium falciparum
EFKEESETES

SEQ ID NO: 3216517 - protein, 7 aa, Plasmodium falciparum
EFKNGEE

SEQ ID NO: 3216518 - protein, 8 aa, Plasmodium falciparum
EFKSKEKN

SEQ ID NO: 3216519 - protein, 7 aa, Plasmodium falciparum
EFNEEGE

SEQ ID NO: 3216520 - protein, 6 aa, Plasmodium falciparum
EFNKGN

SEQ ID NO: 3216521 - protein, 6 aa, Plasmodium falciparum
EFNSNT

SEQ ID NO: 3216522 - protein, 13 aa, Plasmodium falciparum
EFPSNKKKDKIET

SEQ ID NO: 3216523 - protein, 14 aa, Plasmodium falciparum
EFRDNRKSEKCGKS

SEQ ID NO: 3216524 - protein, 5 aa, Plasmodium falciparum
EFRET

SEQ ID NO: 3216525 - protein, 7 aa, Plasmodium falciparum
EFSDGKN

SEQ ID NO: 3216526 - protein, 8 aa, Plasmodium falciparum
EFSNDENS

SEQ ID NO: 3216527 - protein, 4 aa, Plasmodium falciparum
EFTK

SEQ ID NO: 3216528 - protein, 6 aa, Plasmodium falciparum
EFTNNY

SEQ ID NO: 3216529 - protein, 18 aa, Plasmodium falciparum
EFTTNEDIESEERYSLDK

SEQ ID NO: 3216530 - protein, 4 aa, Plasmodium falciparum
EFYE

SEQ ID NO: 3216531 - protein, 13 aa, Plasmodium falciparum
EGAAKGLAAGNAH

SEQ ID NO: 3216532 - protein, 8 aa, Plasmodium falciparum
EGAASLAS

SEQ ID NO: 3216533 - protein, 22 aa, Plasmodium falciparum
EGAECNKSKVKGNEGNSEGACA

SEQ ID NO: 3216534 - protein, 11 aa, Plasmodium falciparum
EGAEPAPQEQN

SEQ ID NO: 3216535 - protein, 5 aa, Plasmodium falciparum
EGAGD

SEQ ID NO: 3216536 - protein, 25 aa, Plasmodium falciparum
EGAGNKNSNNLKDLDSNSDKDGIVS

SEQ ID NO: 3216537 - protein, 18 aa, Plasmodium falciparum
EGAKGAAANASKVASERV

SEQ ID NO: 3216538 - protein, 4 aa, Plasmodium falciparum
EGAN

SEQ ID NO: 3216539 - protein, 21 aa, Plasmodium falciparum
EGAPRSSSRKKRDAGGTTNYD

SEQ ID NO: 3216540 - protein, 30 aa, Plasmodium falciparum
EGARRDSDTNYTNDTKSENNNNDDDDQNSF

SEQ ID NO: 3216541 - protein, 10 aa, Plasmodium falciparum
EGASATSSLT

SEQ ID NO: 3216542 - protein, 22 aa, Plasmodium falciparum
EGASGGSRQRRNVRSNYDNGYE

SEQ ID NO: 3216543 - protein, 12 aa, Plasmodium falciparum
EGASVTSSLTTG

SEQ ID NO: 3216544 - protein, 4 aa, Plasmodium falciparum
EGAY

SEQ ID NO: 3216545 - protein, 5 aa, Plasmodium falciparum
EGAYS

SEQ ID NO: 3216546 - protein, 5 aa, Plasmodium falciparum
EGCSY

SEQ ID NO: 3216547 - protein, 7 aa, Plasmodium falciparum
EGDDNYN

SEQ ID NO: 3216548 - protein, 7 aa, Plasmodium falciparum
EGDEKGK

SEQ ID NO: 3216549 - protein, 9 aa, Plasmodium falciparum
EGDEQSPLN

SEQ ID NO: 3216550 - protein, 16 aa, Plasmodium falciparum
EGDNITVNKKEEATGF

SEQ ID NO: 3216551 - protein, 9 aa, Plasmodium falciparum
EGDNNDNCV

SEQ ID NO: 3216552 - protein, 4 aa, Plasmodium falciparum
EGDP

SEQ ID NO: 3216553 - protein, 10 aa, Plasmodium falciparum
EGDQKYLSRT

SEQ ID NO: 3216554 - protein, 4 aa, Plasmodium falciparum
EGDS

SEQ ID NO: 3216555 - protein, 5 aa, Plasmodium falciparum
EGDSI

SEQ ID NO: 3216556 - protein, 8 aa, Plasmodium falciparum
EGDTENNT

SEQ ID NO: 3216557 - protein, 38 aa, Plasmodium falciparum
EGEAPAHPSKDKSKHYNDNNNNNNDDNNSNNNNDYNNK

SEQ ID NO: 3216558 - protein, 45 aa, Plasmodium falciparum
EGEDAKKCTNSHNDQECNQQKKQQQQETPARSGTSPSSPRDPNHV

SEQ ID NO: 3216559 - protein, 14 aa, Plasmodium falciparum
EGEDKNINGDNIKT

SEQ ID NO: 3216560 - protein, 46 aa, Plasmodium falciparum
EGEDLQPKDEYIERKKKDDTNKYDSNNYDSNNYDSNKYDNNNYDSN

SEQ ID NO: 3216561 - protein, 6 aa, Plasmodium falciparum
EGEDNE

SEQ ID NO: 3216562 - protein, 59 aa, Plasmodium falciparum
EGEDTCARKEKTTLRKSKQKTSTRTVATQTKKDEENKSVVTEEQKVESDSEKQKRTKKV

SEQ ID NO: 3216563 - protein, 4 aa, Plasmodium falciparum
EGEE

SEQ ID NO: 3216564 - protein, 14 aa, Plasmodium falciparum
EGEEDKKKKKNSRI

SEQ ID NO: 3216565 - protein, 6 aa, Plasmodium falciparum
EGEEFN

SEQ ID NO: 3216566 - protein, 50 aa, Plasmodium falciparum
EGEEKEGKKRENTVNSNKSSSNSNSNNKKNNISSSGCNGSDNNNNNNVTQ

SEQ ID NO: 3216567 - protein, 30 aa, Plasmodium falciparum
EGEENEEEEERRKKLDKKKRSLKNRSSVAG

SEQ ID NO: 3216568 - protein, 7 aa, Plasmodium falciparum
EGEEYTY

SEQ ID NO: 3216569 - protein, 13 aa, Plasmodium falciparum
EGEGNDMDDNNSL

SEQ ID NO: 3216570 - protein, 19 aa, Plasmodium falciparum
EGEKYGRNEATDNEVDYKK

SEQ ID NO: 3216571 - protein, 34 aa, Plasmodium falciparum
EGENGTTNIENNPGNNGNMGPSGPKDKDKNIEKD

SEQ ID NO: 3216572 - protein, 11 aa, Plasmodium falciparum
EGEQAAFNTTK

SEQ ID NO: 3216573 - protein, 5 aa, Plasmodium falciparum
EGEQN

SEQ ID NO: 3216574 - protein, 9 aa, Plasmodium falciparum
EGEQNKDEK

SEQ ID NO: 3216575 - protein, 5 aa, Plasmodium falciparum
EGERK

SEQ ID NO: 3216576 - protein, 20 aa, Plasmodium falciparum
EGETLTTEHGKHQQTNNDSQ

SEQ ID NO: 3216577 - protein, 23 aa, Plasmodium falciparum
EGEVDGEVEGEGEVEGEVEGEVK

SEQ ID NO: 3216578 - protein, 4 aa, Plasmodium falciparum
EGEY

SEQ ID NO: 3216579 - protein, 7 aa, Plasmodium falciparum
EGEYGND

SEQ ID NO: 3216580 - protein, 5 aa, Plasmodium falciparum
EGEYT

SEQ ID NO: 3216581 - protein, 14 aa, Plasmodium falciparum
EGEYTSDNEETDED

SEQ ID NO: 3216582 - protein, 6 aa, Plasmodium falciparum
EGFEKT

SEQ ID NO: 3216583 - protein, 4 aa, Plasmodium falciparum
EGFG

SEQ ID NO: 3216584 - protein, 9 aa, Plasmodium falciparum
EGFKNKNAS

SEQ ID NO: 3216585 - protein, 14 aa, Plasmodium falciparum
EGGAVNNDEHEKEN

SEQ ID NO: 3216586 - protein, 9 aa, Plasmodium falciparum
EGGEKKKLR

SEQ ID NO: 3216587 - protein, 6 aa, Plasmodium falciparum
EGGFTS

SEQ ID NO: 3216588 - protein, 5 aa, Plasmodium falciparum
EGGGG

SEQ ID NO: 3216589 - protein, 8 aa, Plasmodium falciparum
EGGGLSGQ

SEQ ID NO: 3216590 - protein, 5 aa, Plasmodium falciparum
EGGIK

SEQ ID NO: 3216591 - protein, 6 aa, Plasmodium falciparum
EGGINR

SEQ ID NO: 3216592 - protein, 8 aa, Plasmodium falciparum
EGGSHDRT

SEQ ID NO: 3216593 - protein, 5 aa, Plasmodium falciparum
EGGSL

SEQ ID NO: 3216594 - protein, 4 aa, Plasmodium falciparum
EGGY

SEQ ID NO: 3216595 - protein, 7 aa, Plasmodium falciparum
EGHDNIN

SEQ ID NO: 3216596 - protein, 30 aa, Plasmodium falciparum
EGHDNNDDDNDDDNNDNDDNDNDDNNNNHV

SEQ ID NO: 3216597 - protein, 14 aa, Plasmodium falciparum
EGIAAGKIASDAAR

SEQ ID NO: 3216598 - protein, 34 aa, Plasmodium falciparum
EGIAAGKIASDTARIDTVIGIISNFDVHTINGST

SEQ ID NO: 3216599 - protein, 6 aa, Plasmodium falciparum
EGIERK

SEQ ID NO: 3216600 - protein, 4 aa, Plasmodium falciparum
EGIG

SEQ ID NO: 3216601 - protein, 6 aa, Plasmodium falciparum
EGIHNG

SEQ ID NO: 3216602 - protein, 17 aa, Plasmodium falciparum
EGIKNKDGVKEKVKTKK

SEQ ID NO: 3216603 - protein, 6 aa, Plasmodium falciparum
EGINEE

SEQ ID NO: 3216604 - protein, 4 aa, Plasmodium falciparum
EGKC

SEQ ID NO: 3216605 - protein, 13 aa, Plasmodium falciparum
EGKDGDKKHNNMN

SEQ ID NO: 3216606 - protein, 4 aa, Plasmodium falciparum
EGKE

SEQ ID NO: 3216607 - protein, 11 aa, Plasmodium falciparum
EGKEKNNLNDS

SEQ ID NO: 3216608 - protein, 8 aa, Plasmodium falciparum
EGKENGID

SEQ ID NO: 3216609 - protein, 5 aa, Plasmodium falciparum
EGKGD

SEQ ID NO: 3216610 - protein, 4 aa, Plasmodium falciparum
EGKI

SEQ ID NO: 3216611 - protein, 9 aa, Plasmodium falciparum
EGKKKKDMN

SEQ ID NO: 3216612 - protein, 7 aa, Plasmodium falciparum
EGKKKKK

SEQ ID NO: 3216613 - protein, 4 aa, Plasmodium falciparum
EGKN

SEQ ID NO: 3216614 - protein, 8 aa, Plasmodium falciparum
EGKNDMER

SEQ ID NO: 3216615 - protein, 10 aa, Plasmodium falciparum
EGKNIKEKDI

SEQ ID NO: 3216616 - protein, 8 aa, Plasmodium falciparum
EGKRKKEK

SEQ ID NO: 3216617 - protein, 10 aa, Plasmodium falciparum
EGKRRYISNG

SEQ ID NO: 3216618 - protein, 4 aa, Plasmodium falciparum
EGKS

SEQ ID NO: 3216619 - protein, 12 aa, Plasmodium falciparum
EGKSNVNPNSPY

SEQ ID NO: 3216620 - protein, 8 aa, Plasmodium falciparum
EGKSYTCT

SEQ ID NO: 3216621 - protein, 8 aa, Plasmodium falciparum
EGKTAESL

SEQ ID NO: 3216622 - protein, 10 aa, Plasmodium falciparum
EGKYNEQGSY

SEQ ID NO: 3216623 - protein, 4 aa, Plasmodium falciparum
EGLD

SEQ ID NO: 3216624 - protein, 11 aa, Plasmodium falciparum
EGLNTNPENAY

SEQ ID NO: 3216625 - protein, 12 aa, Plasmodium falciparum
EGMPYSRDPSIR

SEQ ID NO: 3216626 - protein, 9 aa, Plasmodium falciparum
EGNDGSCEK

SEQ ID NO: 3216627 - protein, 6 aa, Plasmodium falciparum
EGNDKI

SEQ ID NO: 3216628 - protein, 9 aa, Plasmodium falciparum
EGNDKTKKN

SEQ ID NO: 3216629 - protein, 6 aa, Plasmodium falciparum
EGNDVG

SEQ ID NO: 3216630 - protein, 10 aa, Plasmodium falciparum
EGNENFSSTT

SEQ ID NO: 3216631 - protein, 21 aa, Plasmodium falciparum
EGNGSDSTLNSLSKDITNLFK

SEQ ID NO: 3216632 - protein, 4 aa, Plasmodium falciparum
EGNK

SEQ ID NO: 3216633 - protein, 12 aa, Plasmodium falciparum
EGNKKTKKNVSY

SEQ ID NO: 3216634 - protein, 15 aa, Plasmodium falciparum
EGNKNINKKHNESNV

SEQ ID NO: 3216635 - protein, 6 aa, Plasmodium falciparum
EGNLAS

SEQ ID NO: 3216636 - protein, 8 aa, Plasmodium falciparum
EGNLTNNN

SEQ ID NO: 3216637 - protein, 5 aa, Plasmodium falciparum
EGNNK

SEQ ID NO: 3216638 - protein, 8 aa, Plasmodium falciparum
EGNNNNVK

SEQ ID NO: 3216639 - protein, 17 aa, Plasmodium falciparum
EGNNTSVNHDENSDADS

SEQ ID NO: 3216640 - protein, 25 aa, Plasmodium falciparum
EGNVEEEDEEDQGHHHDEDELEEDT

SEQ ID NO: 3216641 - protein, 5 aa, Plasmodium falciparum
EGNVG

SEQ ID NO: 3216642 - protein, 5 aa, Plasmodium falciparum
EGPCC

SEQ ID NO: 3216643 - protein, 8 aa, Plasmodium falciparum
EGPHSNSS

SEQ ID NO: 3216644 - protein, 7 aa, Plasmodium falciparum
EGPREVK

SEQ ID NO: 3216645 - protein, 5 aa, Plasmodium falciparum
EGPTL

SEQ ID NO: 3216646 - protein, 4 aa, Plasmodium falciparum
EGPY

SEQ ID NO: 3216647 - protein, 6 aa, Plasmodium falciparum
EGPYKK

SEQ ID NO: 3216648 - protein, 8 aa, Plasmodium falciparum
EGQAPNDL

SEQ ID NO: 3216649 - protein, 5 aa, Plasmodium falciparum
EGQKL

SEQ ID NO: 3216650 - protein, 9 aa, Plasmodium falciparum
EGQKYEDPV

SEQ ID NO: 3216651 - protein, 14 aa, Plasmodium falciparum
EGQLNKKNNNNNIN

SEQ ID NO: 3216652 - protein, 7 aa, Plasmodium falciparum
EGQNNTT

SEQ ID NO: 3216653 - protein, 11 aa, Plasmodium falciparum
EGQSIRGQHDK

SEQ ID NO: 3216654 - protein, 11 aa, Plasmodium falciparum
EGQSISQNHGK

SEQ ID NO: 3216655 - protein, 9 aa, Plasmodium falciparum
EGQSITQDY

SEQ ID NO: 3216656 - protein, 6 aa, Plasmodium falciparum
EGRDVA

SEQ ID NO: 3216657 - protein, 47 aa, Plasmodium falciparum
EGREDSDDEDEEDDEDEENKKEQEQEEEEEQEEEKEKTHEAYDEEKS

SEQ ID NO: 3216658 - protein, 23 aa, Plasmodium falciparum
EGRIKKKKIEKKEKKEKKENNNN

SEQ ID NO: 3216659 - protein, 16 aa, Plasmodium falciparum
EGRKKGKYNIEENNIN

SEQ ID NO: 3216660 - protein, 5 aa, Plasmodium falciparum
EGRKY

SEQ ID NO: 3216661 - protein, 5 aa, Plasmodium falciparum
EGRNE

SEQ ID NO: 3216662 - protein, 6 aa, Plasmodium falciparum
EGRNRQ

SEQ ID NO: 3216663 - protein, 5 aa, Plasmodium falciparum
EGRSC

SEQ ID NO: 3216664 - protein, 6 aa, Plasmodium falciparum
EGRSPS

SEQ ID NO: 3216665 - protein, 4 aa, Plasmodium falciparum
EGRY

SEQ ID NO: 3216666 - protein, 14 aa, Plasmodium falciparum
EGSAQDKQNSLDAK

SEQ ID NO: 3216667 - protein, 15 aa, Plasmodium falciparum
EGSATEEVVEEGSVS

SEQ ID NO: 3216668 - protein, 11 aa, Plasmodium falciparum
EGSELDSSIND

SEQ ID NO: 3216669 - protein, 45 aa, Plasmodium falciparum
EGSENGDVDSEDNDDNDDNNYNDDNNYNDDNNYNGNHNNNCGENL

SEQ ID NO: 3216670 - protein, 4 aa, Plasmodium falciparum
EGSF

SEQ ID NO: 3216671 - protein, 5 aa, Plasmodium falciparum
EGSHC

SEQ ID NO: 3216672 - protein, 7 aa, Plasmodium falciparum
EGSINRT

SEQ ID NO: 3216673 - protein, 6 aa, Plasmodium falciparum
EGSKVY

SEQ ID NO: 3216674 - protein, 6 aa, Plasmodium falciparum
EGSNKS

SEQ ID NO: 3216675 - protein, 7 aa, Plasmodium falciparum
EGSVTEE

SEQ ID NO: 3216676 - protein, 22 aa, Plasmodium falciparum
EGSVTEEIKEEESITENEAIEE

SEQ ID NO: 3216677 - protein, 7 aa, Plasmodium falciparum
EGTEEKR

SEQ ID NO: 3216678 - protein, 8 aa, Plasmodium falciparum
EGTESVTE

SEQ ID NO: 3216679 - protein, 21 aa, Plasmodium falciparum
EGTKEAADVAAEAARESATNA

SEQ ID NO: 3216680 - protein, 6 aa, Plasmodium falciparum
EGTRSV

SEQ ID NO: 3216681 - protein, 7 aa, Plasmodium falciparum
EGTTNEK

SEQ ID NO: 3216682 - protein, 4 aa, Plasmodium falciparum
EGTY

SEQ ID NO: 3216683 - protein, 16 aa, Plasmodium falciparum
EGVAADASAAKSAELT

SEQ ID NO: 3216684 - protein, 14 aa, Plasmodium falciparum
EGVAADASAVKSAE

SEQ ID NO: 3216685 - protein, 20 aa, Plasmodium falciparum
EGVATARAADVAAAKTAEFE

SEQ ID NO: 3216686 - protein, 10 aa, Plasmodium falciparum
EGVDEKEKIN

SEQ ID NO: 3216687 - protein, 10 aa, Plasmodium falciparum
EGVDENTRIK

SEQ ID NO: 3216688 - protein, 5 aa, Plasmodium falciparum
EGVEE

SEQ ID NO: 3216689 - protein, 5 aa, Plasmodium falciparum
EGVEG

SEQ ID NO: 3216690 - protein, 10 aa, Plasmodium falciparum
EGVKDTKKKK

SEQ ID NO: 3216691 - protein, 13 aa, Plasmodium falciparum
EGVSCSRKGPTPG

SEQ ID NO: 3216692 - protein, 13 aa, Plasmodium falciparum
EGVTNPYDKSEEN

SEQ ID NO: 3216693 - protein, 5 aa, Plasmodium falciparum
EGVYG

SEQ ID NO: 3216694 - protein, 9 aa, Plasmodium falciparum
EGWKPGNQI

SEQ ID NO: 3216695 - protein, 6 aa, Plasmodium falciparum
EGYDNK

SEQ ID NO: 3216696 - protein, 8 aa, Plasmodium falciparum
EGYGDANE

SEQ ID NO: 3216697 - protein, 6 aa, Plasmodium falciparum
EGYGDV

SEQ ID NO: 3216698 - protein, 18 aa, Plasmodium falciparum
EGYGKNKNSEKNKEEDIA

SEQ ID NO: 3216699 - protein, 8 aa, Plasmodium falciparum
EGYGNEKD

SEQ ID NO: 3216700 - protein, 5 aa, Plasmodium falciparum
EGYKN

SEQ ID NO: 3216701 - protein, 12 aa, Plasmodium falciparum
EGYKNKREETKE

SEQ ID NO: 3216702 - protein, 5 aa, Plasmodium falciparum
EGYNT

SEQ ID NO: 3216703 - protein, 9 aa, Plasmodium falciparum
EGYSSNPCN

SEQ ID NO: 3216704 - protein, 12 aa, Plasmodium falciparum
EHAEKEQTNNIH

SEQ ID NO: 3216705 - protein, 8 aa, Plasmodium falciparum
EHANNKEE

SEQ ID NO: 3216706 - protein, 4 aa, Plasmodium falciparum
EHAS

SEQ ID NO: 3216707 - protein, 6 aa, Plasmodium falciparum
EHASEN

SEQ ID NO: 3216708 - protein, 7 aa, Plasmodium falciparum
EHCGKED

SEQ ID NO: 3216709 - protein, 5 aa, Plasmodium falciparum
EHCNP

SEQ ID NO: 3216710 - protein, 7 aa, Plasmodium falciparum
EHDDYDE

SEQ ID NO: 3216711 - protein, 6 aa, Plasmodium falciparum
EHDSIT

SEQ ID NO: 3216712 - protein, 4 aa, Plasmodium falciparum
EHDV

SEQ ID NO: 3216713 - protein, 70 aa, Plasmodium falciparum
EHEDNNDNDDDNNDDDNKNNHNNNHNNNHNNNHNNNHNNIKDKKKDTHNGKIKEKSDNSYVQKNNNNSYY

SEQ ID NO: 3216714 - protein, 22 aa, Plasmodium falciparum
EHEKAQEASQGEGKDEAENAEL

SEQ ID NO: 3216715 - protein, 6 aa, Plasmodium falciparum
EHEKES

SEQ ID NO: 3216716 - protein, 14 aa, Plasmodium falciparum
EHEKNDIKDSAKVH

SEQ ID NO: 3216717 - protein, 14 aa, Plasmodium falciparum
EHEPPTKLPEYEKG

SEQ ID NO: 3216718 - protein, 13 aa, Plasmodium falciparum
EHEQDEKNKDKQF

SEQ ID NO: 3216719 - protein, 7 aa, Plasmodium falciparum
EHETQNN

SEQ ID NO: 3216720 - protein, 146 aa, Plasmodium falciparum
EHGTNGETIKEEPPKLPESSETLQSQEQLEAEAQKQKQEEEPKKKQEEEPKKKQEEEQKREQEQKQEQEEEEQKQEEEQQIQDQSQSGLDQSSKVGVASEQNEISSGQEQNVKSSSPEVVPQETTSENGSSQDTKISSTEPNENSV

SEQ ID NO: 3216721 - protein, 4 aa, Plasmodium falciparum
EHHK

SEQ ID NO: 3216722 - protein, 5 aa, Plasmodium falciparum
EHHNK

SEQ ID NO: 3216723 - protein, 14 aa, Plasmodium falciparum
EHIDGEDITNDEAM

SEQ ID NO: 3216724 - protein, 4 aa, Plasmodium falciparum
EHIK

SEQ ID NO: 3216725 - protein, 4 aa, Plasmodium falciparum
EHIN

SEQ ID NO: 3216726 - protein, 21 aa, Plasmodium falciparum
EHISNNNSLDKTIESDDKNGK

SEQ ID NO: 3216727 - protein, 10 aa, Plasmodium falciparum
EHKDNNSRNL

SEQ ID NO: 3216728 - protein, 13 aa, Plasmodium falciparum
EHKEKETTNKQNI

SEQ ID NO: 3216729 - protein, 5 aa, Plasmodium falciparum
EHKEY

SEQ ID NO: 3216730 - protein, 13 aa, Plasmodium falciparum
EHKNDNTPIVNSP

SEQ ID NO: 3216731 - protein, 9 aa, Plasmodium falciparum
EHKNGNYNE

SEQ ID NO: 3216732 - protein, 10 aa, Plasmodium falciparum
EHKNGNYNEY

SEQ ID NO: 3216733 - protein, 9 aa, Plasmodium falciparum
EHKNKQKQL

SEQ ID NO: 3216734 - protein, 8 aa, Plasmodium falciparum
EHKNNYPH

SEQ ID NO: 3216735 - protein, 9 aa, Plasmodium falciparum
EHKPNEQTM

SEQ ID NO: 3216736 - protein, 11 aa, Plasmodium falciparum
EHKSNDNSQAL

SEQ ID NO: 3216737 - protein, 7 aa, Plasmodium falciparum
EHKTERE

SEQ ID NO: 3216738 - protein, 8 aa, Plasmodium falciparum
EHKTNEEL

SEQ ID NO: 3216739 - protein, 7 aa, Plasmodium falciparum
EHLDERN

SEQ ID NO: 3216740 - protein, 4 aa, Plasmodium falciparum
EHLN

SEQ ID NO: 3216741 - protein, 22 aa, Plasmodium falciparum
EHLSSEDKENNNSTSSSSFSPL

SEQ ID NO: 3216742 - protein, 11 aa, Plasmodium falciparum
EHNDNDSGFNK

SEQ ID NO: 3216743 - protein, 83 aa, Plasmodium falciparum
EHNEKKNNNKKKNNNKKKNNNNDINNNNDINNNNDINNNNDNNNNNNDNNNNNNDNNNNNNDNNNNNNDNNNNNNDNNNNNND

SEQ ID NO: 3216744 - protein, 5 aa, Plasmodium falciparum
EHNKG

SEQ ID NO: 3216745 - protein, 23 aa, Plasmodium falciparum
EHNKKDEEREKNMSTYEGDELEG

SEQ ID NO: 3216746 - protein, 18 aa, Plasmodium falciparum
EHNKKYNDIQEEDDEIYE

SEQ ID NO: 3216747 - protein, 20 aa, Plasmodium falciparum
EHNKVQGISNDTNHQQENNM

SEQ ID NO: 3216748 - protein, 4 aa, Plasmodium falciparum
EHNN

SEQ ID NO: 3216749 - protein, 19 aa, Plasmodium falciparum
EHNNEKIDNYENSKNIYKE

SEQ ID NO: 3216750 - protein, 7 aa, Plasmodium falciparum
EHNQQKD

SEQ ID NO: 3216751 - protein, 6 aa, Plasmodium falciparum
EHNSKD

SEQ ID NO: 3216752 - protein, 8 aa, Plasmodium falciparum
EHNSNNKK

SEQ ID NO: 3216753 - protein, 25 aa, Plasmodium falciparum
EHNSTVPSYNKSSMEKSSNIRNNRG

SEQ ID NO: 3216754 - protein, 6 aa, Plasmodium falciparum
EHNTYD

SEQ ID NO: 3216755 - protein, 4 aa, Plasmodium falciparum
EHPC

SEQ ID NO: 3216756 - protein, 55 aa, Plasmodium falciparum
EHPDEVKETEEAEETEEGTDGGGEIPQKETQPAEATTEDGTGETTQITKEDGVKP

SEQ ID NO: 3216757 - protein, 6 aa, Plasmodium falciparum
EHQPTT

SEQ ID NO: 3216758 - protein, 7 aa, Plasmodium falciparum
EHQTELS

SEQ ID NO: 3216759 - protein, 5 aa, Plasmodium falciparum
EHREK

SEQ ID NO: 3216760 - protein, 4 aa, Plasmodium falciparum
EHRT

SEQ ID NO: 3216761 - protein, 7 aa, Plasmodium falciparum
EHSDESN

SEQ ID NO: 3216762 - protein, 13 aa, Plasmodium falciparum
EHSNNELKNQKCT

SEQ ID NO: 3216763 - protein, 15 aa, Plasmodium falciparum
EHSPYDDNSLEEPSK

SEQ ID NO: 3216764 - protein, 18 aa, Plasmodium falciparum
EHSRKSIRKKSMGISEYS

SEQ ID NO: 3216765 - protein, 15 aa, Plasmodium falciparum
EHTDNEEEDKKEDME

SEQ ID NO: 3216766 - protein, 5 aa, Plasmodium falciparum
EHTDQ

SEQ ID NO: 3216767 - protein, 5 aa, Plasmodium falciparum
EHTEE

SEQ ID NO: 3216768 - protein, 5 aa, Plasmodium falciparum
EHTET

SEQ ID NO: 3216769 - protein, 13 aa, Plasmodium falciparum
EHTKGYESKGFSS

SEQ ID NO: 3216770 - protein, 11 aa, Plasmodium falciparum
EHTNKNNNNIT

SEQ ID NO: 3216771 - protein, 9 aa, Plasmodium falciparum
EHTNQKKNL

SEQ ID NO: 3216772 - protein, 26 aa, Plasmodium falciparum
EHTNYQKRGGYNYRGPCTGKGNGKDT

SEQ ID NO: 3216773 - protein, 6 aa, Plasmodium falciparum
EHTQAN

SEQ ID NO: 3216774 - protein, 54 aa, Plasmodium falciparum
EHTSFNTHTNNNDNNNNDNNNDNNDNNNNNNNNNNNNNNNNNNNNNNDNNNDKC

SEQ ID NO: 3216775 - protein, 8 aa, Plasmodium falciparum
EHTTTNNL

SEQ ID NO: 3216776 - protein, 30 aa, Plasmodium falciparum
EHTYNQEYTSSSNDNKKKKKKKNQGESQKN

SEQ ID NO: 3216777 - protein, 35 aa, Plasmodium falciparum
EHVNEKEKGMKDEKDNVSQDKKKQKKGDKKKNIEE

SEQ ID NO: 3216778 - protein, 22 aa, Plasmodium falciparum
EHVNSQNNKSDEKKNGSDESQI

SEQ ID NO: 3216779 - protein, 12 aa, Plasmodium falciparum
EHVRGDNTGNNN

SEQ ID NO: 3216780 - protein, 5 aa, Plasmodium falciparum
EHYND

SEQ ID NO: 3216781 - protein, 6 aa, Plasmodium falciparum
EHYNRE

SEQ ID NO: 3216782 - protein, 17 aa, Plasmodium falciparum
EHYSSDSEHHKEESASI

SEQ ID NO: 3216783 - protein, 28 aa, Plasmodium falciparum
EIAKRKKQEHNELNDQGESGVEKKKDSF

SEQ ID NO: 3216784 - protein, 7 aa, Plasmodium falciparum
EIAQKNI

SEQ ID NO: 3216785 - protein, 5 aa, Plasmodium falciparum
EICDT

SEQ ID NO: 3216786 - protein, 5 aa, Plasmodium falciparum
EIDER

SEQ ID NO: 3216787 - protein, 6 aa, Plasmodium falciparum
EIDGGD

SEQ ID NO: 3216788 - protein, 9 aa, Plasmodium falciparum
EIDNKTVTS

SEQ ID NO: 3216789 - protein, 13 aa, Plasmodium falciparum
EIDPDDNNKSNVY

SEQ ID NO: 3216790 - protein, 5 aa, Plasmodium falciparum
EIDQN

SEQ ID NO: 3216791 - protein, 16 aa, Plasmodium falciparum
EIDSDENGNKSSSSIS

SEQ ID NO: 3216792 - protein, 6 aa, Plasmodium falciparum
EIDSEN

SEQ ID NO: 3216793 - protein, 30 aa, Plasmodium falciparum
EIECESESNSYCKKEDENDIKKKEDIDEKE

SEQ ID NO: 3216794 - protein, 15 aa, Plasmodium falciparum
EIEEEEQNEYAGKDE

SEQ ID NO: 3216795 - protein, 11 aa, Plasmodium falciparum
EIEKEDDTYLG

SEQ ID NO: 3216796 - protein, 6 aa, Plasmodium falciparum
EIEKEK

SEQ ID NO: 3216797 - protein, 8 aa, Plasmodium falciparum
EIEKKEKE

SEQ ID NO: 3216798 - protein, 13 aa, Plasmodium falciparum
EIEKQEEKGNKEN

SEQ ID NO: 3216799 - protein, 12 aa, Plasmodium falciparum
EIEKQKKNNKRK

SEQ ID NO: 3216800 - protein, 21 aa, Plasmodium falciparum
EIEKQVEEGIKENDTESKDKV

SEQ ID NO: 3216801 - protein, 30 aa, Plasmodium falciparum
EIEKYKNSKNSYFKNKENEEKKRKKREEKK

SEQ ID NO: 3216802 - protein, 4 aa, Plasmodium falciparum
EIEN

SEQ ID NO: 3216803 - protein, 13 aa, Plasmodium falciparum
EIENEDNIEKNKN

SEQ ID NO: 3216804 - protein, 6 aa, Plasmodium falciparum
EIENEN

SEQ ID NO: 3216805 - protein, 27 aa, Plasmodium falciparum
EIENTNKTITNNVGKEIKKKEQENDKY

SEQ ID NO: 3216806 - protein, 5 aa, Plasmodium falciparum
EIENV

SEQ ID NO: 3216807 - protein, 20 aa, Plasmodium falciparum
EIEPNDKKKNKIEEKENMDN

SEQ ID NO: 3216808 - protein, 34 aa, Plasmodium falciparum
EIEQNNNSSYNNNNNNNNNNNNNDEESTHANNNN

SEQ ID NO: 3216809 - protein, 6 aa, Plasmodium falciparum
EIESTN

SEQ ID NO: 3216810 - protein, 4 aa, Plasmodium falciparum
EIFG

SEQ ID NO: 3216811 - protein, 8 aa, Plasmodium falciparum
EIGPNENG

SEQ ID NO: 3216812 - protein, 4 aa, Plasmodium falciparum
EIGS

SEQ ID NO: 3216813 - protein, 37 aa, Plasmodium falciparum
EIIDGEDNNQTYSQHSTDNHTNKNKGHKNDNISSNKN

SEQ ID NO: 3216814 - protein, 18 aa, Plasmodium falciparum
EIIRSDEKNVQTEEYRNR

SEQ ID NO: 3216815 - protein, 5 aa, Plasmodium falciparum
EIKDE

SEQ ID NO: 3216816 - protein, 12 aa, Plasmodium falciparum
EIKDNNTSYNHS

SEQ ID NO: 3216817 - protein, 14 aa, Plasmodium falciparum
EIKEDEESISPNND

SEQ ID NO: 3216818 - protein, 16 aa, Plasmodium falciparum
EIKEDEQRNEDNTFST

SEQ ID NO: 3216819 - protein, 12 aa, Plasmodium falciparum
EIKEEEKKEYEK

SEQ ID NO: 3216820 - protein, 4 aa, Plasmodium falciparum
EIKK

SEQ ID NO: 3216821 - protein, 5 aa, Plasmodium falciparum
EIKKG

SEQ ID NO: 3216822 - protein, 49 aa, Plasmodium falciparum
EIKKQREKEKCHRDEKCDRGENYDRGEKYDRDEKYDKEEKGLKEDNYRD

SEQ ID NO: 3216823 - protein, 32 aa, Plasmodium falciparum
EIKNESEGESKSENKIEGNSNNESDGESEKRS

SEQ ID NO: 3216824 - protein, 7 aa, Plasmodium falciparum
EIKSENV

SEQ ID NO: 3216825 - protein, 7 aa, Plasmodium falciparum
EIKSNEY

SEQ ID NO: 3216826 - protein, 11 aa, Plasmodium falciparum
EIKTDKYTEPI

SEQ ID NO: 3216827 - protein, 4 aa, Plasmodium falciparum
EILS

SEQ ID NO: 3216828 - protein, 7 aa, Plasmodium falciparum
EILSKEE

SEQ ID NO: 3216829 - protein, 9 aa, Plasmodium falciparum
EILSPTKKG

SEQ ID NO: 3216830 - protein, 4 aa, Plasmodium falciparum
EIND

SEQ ID NO: 3216831 - protein, 5 aa, Plasmodium falciparum
EINDE

SEQ ID NO: 3216832 - protein, 10 aa, Plasmodium falciparum
EINDNTKNEH

SEQ ID NO: 3216833 - protein, 9 aa, Plasmodium falciparum
EINEDENKI

SEQ ID NO: 3216834 - protein, 9 aa, Plasmodium falciparum
EINEKNDKH

SEQ ID NO: 3216835 - protein, 18 aa, Plasmodium falciparum
EINEKNNNHHNSSSNNNP

SEQ ID NO: 3216836 - protein, 5 aa, Plasmodium falciparum
EINEN

SEQ ID NO: 3216837 - protein, 24 aa, Plasmodium falciparum
EINENKNIKSSEKIQNENKKDDKL

SEQ ID NO: 3216838 - protein, 5 aa, Plasmodium falciparum
EINIE

SEQ ID NO: 3216839 - protein, 4 aa, Plasmodium falciparum
EINK

SEQ ID NO: 3216840 - protein, 7 aa, Plasmodium falciparum
EINKDEL

SEQ ID NO: 3216841 - protein, 13 aa, Plasmodium falciparum
EINKEETDNPSDY

SEQ ID NO: 3216842 - protein, 11 aa, Plasmodium falciparum
EINKTRKGRYV

SEQ ID NO: 3216843 - protein, 17 aa, Plasmodium falciparum
EINKTYKDEINNMNSDQ

SEQ ID NO: 3216844 - protein, 4 aa, Plasmodium falciparum
EINN

SEQ ID NO: 3216845 - protein, 6 aa, Plasmodium falciparum
EINNEQ

SEQ ID NO: 3216846 - protein, 6 aa, Plasmodium falciparum
EINNKE

SEQ ID NO: 3216847 - protein, 11 aa, Plasmodium falciparum
EINNNNKKKTF

SEQ ID NO: 3216848 - protein, 25 aa, Plasmodium falciparum
EINNNSNNTNKFNNNSTELATKDTQ

SEQ ID NO: 3216849 - protein, 8 aa, Plasmodium falciparum
EINNSHNK

SEQ ID NO: 3216850 - protein, 6 aa, Plasmodium falciparum
EINNYD

SEQ ID NO: 3216851 - protein, 12 aa, Plasmodium falciparum
EINQPYDDDEEI

SEQ ID NO: 3216852 - protein, 9 aa, Plasmodium falciparum
EINRKKKKN

SEQ ID NO: 3216853 - protein, 43 aa, Plasmodium falciparum
EINRQNDVSKNTTYAENNEYTSENITKPSDQNTENYGTKMPSP

SEQ ID NO: 3216854 - protein, 31 aa, Plasmodium falciparum
EINRSASQRSKRSIDVTNTDPTLTSPYSSAA

SEQ ID NO: 3216855 - protein, 5 aa, Plasmodium falciparum
EINTD

SEQ ID NO: 3216856 - protein, 6 aa, Plasmodium falciparum
EINTDG

SEQ ID NO: 3216857 - protein, 12 aa, Plasmodium falciparum
EINTGDTTEKER

SEQ ID NO: 3216858 - protein, 4 aa, Plasmodium falciparum
EIPD

SEQ ID NO: 3216859 - protein, 5 aa, Plasmodium falciparum
EIPEE

SEQ ID NO: 3216860 - protein, 14 aa, Plasmodium falciparum
EIPNIPKDDISSDA

SEQ ID NO: 3216861 - protein, 4 aa, Plasmodium falciparum
EIPP

SEQ ID NO: 3216862 - protein, 7 aa, Plasmodium falciparum
EIPPRND

SEQ ID NO: 3216863 - protein, 7 aa, Plasmodium falciparum
EIPSDED

SEQ ID NO: 3216864 - protein, 5 aa, Plasmodium falciparum
EIPYD

SEQ ID NO: 3216865 - protein, 8 aa, Plasmodium falciparum
EIQEGGEY

SEQ ID NO: 3216866 - protein, 15 aa, Plasmodium falciparum
EIQENDSNKNEPSNE

SEQ ID NO: 3216867 - protein, 6 aa, Plasmodium falciparum
EIQENI

SEQ ID NO: 3216868 - protein, 10 aa, Plasmodium falciparum
EIQKKKKKKK

SEQ ID NO: 3216869 - protein, 21 aa, Plasmodium falciparum
EIQQGEKNKTNDMDEKKKDES

SEQ ID NO: 3216870 - protein, 6 aa, Plasmodium falciparum
EIQSNK

SEQ ID NO: 3216871 - protein, 13 aa, Plasmodium falciparum
EIRDKPIKKVRFN

SEQ ID NO: 3216872 - protein, 54 aa, Plasmodium falciparum
EIREGEEKDKKDDTNEQAGQMGKDKDDNQIKHNNNNNNNNNTRNDNINGDGNNP

SEQ ID NO: 3216873 - protein, 5 aa, Plasmodium falciparum
EIRNM

SEQ ID NO: 3216874 - protein, 7 aa, Plasmodium falciparum
EIRRDED

SEQ ID NO: 3216875 - protein, 4 aa, Plasmodium falciparum
EISE

SEQ ID NO: 3216876 - protein, 5 aa, Plasmodium falciparum
EISKD

SEQ ID NO: 3216877 - protein, 4 aa, Plasmodium falciparum
EISN

SEQ ID NO: 3216878 - protein, 12 aa, Plasmodium falciparum
EISNKSSNNQQD

SEQ ID NO: 3216879 - protein, 19 aa, Plasmodium falciparum
EISSDSKEETESIKDKEKD

SEQ ID NO: 3216880 - protein, 15 aa, Plasmodium falciparum
EISTTEEKLKEEASA

SEQ ID NO: 3216881 - protein, 17 aa, Plasmodium falciparum
EITAEAAKTEVAATKTA

SEQ ID NO: 3216882 - protein, 10 aa, Plasmodium falciparum
EITDSATGEV

SEQ ID NO: 3216883 - protein, 11 aa, Plasmodium falciparum
EITKKQNKIQD

SEQ ID NO: 3216884 - protein, 4 aa, Plasmodium falciparum
EITN

SEQ ID NO: 3216885 - protein, 100 aa, Plasmodium falciparum
EITNEKKKDNEKKKDNEKRRDNEKKKDNEKKKDNEKKRDNEKKRDNEKKRDNEKKRDNEKKNDNERKNDNEKKNDNEKKRDNEKKSHSENNKSKFVEKTN

SEQ ID NO: 3216886 - protein, 8 aa, Plasmodium falciparum
EITNPNSS

SEQ ID NO: 3216887 - protein, 12 aa, Plasmodium falciparum
EITNTTDDSKYV

SEQ ID NO: 3216888 - protein, 13 aa, Plasmodium falciparum
EITRGGSDHKGYE

SEQ ID NO: 3216889 - protein, 4 aa, Plasmodium falciparum
EITS

SEQ ID NO: 3216890 - protein, 86 aa, Plasmodium falciparum
EITTKGASAQSGASAQSGASAQSGASAQSGASAQSGASAQSGTSGPSGPSGTSPSSRSNTLPRSNTSSGASPPADASDSDAKSYAD

SEQ ID NO: 3216891 - protein, 6 aa, Plasmodium falciparum
EITYNK

SEQ ID NO: 3216892 - protein, 12 aa, Plasmodium falciparum
EIVKQTNKKINK

SEQ ID NO: 3216893 - protein, 19 aa, Plasmodium falciparum
EIYDNNNNHVGKKKKKKNI

SEQ ID NO: 3216894 - protein, 4 aa, Plasmodium falciparum
EIYT

SEQ ID NO: 3216895 - protein, 18 aa, Plasmodium falciparum
EKAANAADAARKAASGKF

SEQ ID NO: 3216896 - protein, 9 aa, Plasmodium falciparum
EKAEIQKEN

SEQ ID NO: 3216897 - protein, 11 aa, Plasmodium falciparum
EKAKNNVTKRR

SEQ ID NO: 3216898 - protein, 29 aa, Plasmodium falciparum
EKAKTCSTSTSEETQNTAQCQDTHPDDDL

SEQ ID NO: 3216899 - protein, 5 aa, Plasmodium falciparum
EKALK

SEQ ID NO: 3216900 - protein, 5 aa, Plasmodium falciparum
EKAME

SEQ ID NO: 3216901 - protein, 10 aa, Plasmodium falciparum
EKANDNKNQT

SEQ ID NO: 3216902 - protein, 5 aa, Plasmodium falciparum
EKANQ

SEQ ID NO: 3216903 - protein, 13 aa, Plasmodium falciparum
EKAPAGQQTPGNT

SEQ ID NO: 3216904 - protein, 26 aa, Plasmodium falciparum
EKAPQAAKAAKQIEAANYTSTTSSLT

SEQ ID NO: 3216905 - protein, 9 aa, Plasmodium falciparum
EKASDNKSN

SEQ ID NO: 3216906 - protein, 18 aa, Plasmodium falciparum
EKATQSAEALSETTAEDV

SEQ ID NO: 3216907 - protein, 28 aa, Plasmodium falciparum
EKATSCKDKNSDKQTKASCEESTPPDDE

SEQ ID NO: 3216908 - protein, 9 aa, Plasmodium falciparum
EKATSETSY

SEQ ID NO: 3216909 - protein, 87 aa, Plasmodium falciparum
EKCEETQPKPPGAGGPGAPSETGETTTLEDEEEEEDEEEDAGDEVEEGETVDTTEGDETETVEQPVKDTDREGEEEEAKKATDTTTS

SEQ ID NO: 3216910 - protein, 7 aa, Plasmodium falciparum
EKCEHEE

SEQ ID NO: 3216911 - protein, 19 aa, Plasmodium falciparum
EKCKDESNSLKSASNQEGD

SEQ ID NO: 3216912 - protein, 5 aa, Plasmodium falciparum
EKCKE

SEQ ID NO: 3216913 - protein, 9 aa, Plasmodium falciparum
EKCNSSEKM

SEQ ID NO: 3216914 - protein, 14 aa, Plasmodium falciparum
EKCQNNKSTTKNSL

SEQ ID NO: 3216915 - protein, 17 aa, Plasmodium falciparum
EKCTQKEKNACDEETKK

SEQ ID NO: 3216916 - protein, 42 aa, Plasmodium falciparum
EKDANSGSELKNTNNKEKEVKNKFNDTTDKMSQEKQDNQKEV

SEQ ID NO: 3216917 - protein, 39 aa, Plasmodium falciparum
EKDDDDNNKEKNINNNDNNNDEKNDNFNNDYNKDDYYDD

SEQ ID NO: 3216918 - protein, 6 aa, Plasmodium falciparum
EKDDDY

SEQ ID NO: 3216919 - protein, 14 aa, Plasmodium falciparum
EKDDIKNKQNEDNI

SEQ ID NO: 3216920 - protein, 9 aa, Plasmodium falciparum
EKDDKEDKK

SEQ ID NO: 3216921 - protein, 10 aa, Plasmodium falciparum
EKDDSGEDRQ

SEQ ID NO: 3216922 - protein, 10 aa, Plasmodium falciparum
EKDDTKEQNY

SEQ ID NO: 3216923 - protein, 25 aa, Plasmodium falciparum
EKDEAKKCKDCQETQPQPPGGDGVA

SEQ ID NO: 3216924 - protein, 8 aa, Plasmodium falciparum
EKDECDNV

SEQ ID NO: 3216925 - protein, 9 aa, Plasmodium falciparum
EKDEEKRKG

SEQ ID NO: 3216926 - protein, 22 aa, Plasmodium falciparum
EKDEKEDGVDDPQYEKDVKTGG

SEQ ID NO: 3216927 - protein, 18 aa, Plasmodium falciparum
EKDEKVKEKPAEKKKTTV

SEQ ID NO: 3216928 - protein, 8 aa, Plasmodium falciparum
EKDENFSN

SEQ ID NO: 3216929 - protein, 15 aa, Plasmodium falciparum
EKDESGGEGNKNNDD

SEQ ID NO: 3216930 - protein, 16 aa, Plasmodium falciparum
EKDESKIVSKKRKTRE

SEQ ID NO: 3216931 - protein, 6 aa, Plasmodium falciparum
EKDETF

SEQ ID NO: 3216932 - protein, 9 aa, Plasmodium falciparum
EKDGEKKQN

SEQ ID NO: 3216933 - protein, 24 aa, Plasmodium falciparum
EKDGGTGSYKNNSISSSTNNYYKN

SEQ ID NO: 3216934 - protein, 6 aa, Plasmodium falciparum
EKDGPP

SEQ ID NO: 3216935 - protein, 26 aa, Plasmodium falciparum
EKDHDEKYDNEKNKENTYNNQTNYNH

SEQ ID NO: 3216936 - protein, 11 aa, Plasmodium falciparum
EKDIEGREEGQ

SEQ ID NO: 3216937 - protein, 7 aa, Plasmodium falciparum
EKDINGD

SEQ ID NO: 3216938 - protein, 43 aa, Plasmodium falciparum
EKDKDKDKEKCLNESGDKNENLHTEKKKKNINSIRDNNNDYYD

SEQ ID NO: 3216939 - protein, 10 aa, Plasmodium falciparum
EKDKEEMEQK

SEQ ID NO: 3216940 - protein, 11 aa, Plasmodium falciparum
EKDKEGVDDPV

SEQ ID NO: 3216941 - protein, 6 aa, Plasmodium falciparum
EKDKEI

SEQ ID NO: 3216942 - protein, 22 aa, Plasmodium falciparum
EKDKEKDKKKKKDVKKKKNKIE

SEQ ID NO: 3216943 - protein, 17 aa, Plasmodium falciparum
EKDKESKNIIKGSQECA

SEQ ID NO: 3216944 - protein, 9 aa, Plasmodium falciparum
EKDKIKGNN

SEQ ID NO: 3216945 - protein, 18 aa, Plasmodium falciparum
EKDKITTKTLGGNAHGPT

SEQ ID NO: 3216946 - protein, 10 aa, Plasmodium falciparum
EKDKKCGKEE

SEQ ID NO: 3216947 - protein, 19 aa, Plasmodium falciparum
EKDKKKNRLDNKNKMKNKN

SEQ ID NO: 3216948 - protein, 9 aa, Plasmodium falciparum
EKDKNKKKV

SEQ ID NO: 3216949 - protein, 10 aa, Plasmodium falciparum
EKDKYGNERY

SEQ ID NO: 3216950 - protein, 10 aa, Plasmodium falciparum
EKDKYSNKKY

SEQ ID NO: 3216951 - protein, 4 aa, Plasmodium falciparum
EKDL

SEQ ID NO: 3216952 - protein, 5 aa, Plasmodium falciparum
EKDLK

SEQ ID NO: 3216953 - protein, 4 aa, Plasmodium falciparum
EKDM

SEQ ID NO: 3216954 - protein, 18 aa, Plasmodium falciparum
EKDMNDTGNNKNVTNAYT

SEQ ID NO: 3216955 - protein, 4 aa, Plasmodium falciparum
EKDN

SEQ ID NO: 3216956 - protein, 18 aa, Plasmodium falciparum
EKDNEKYTEKYRKTGTPH

SEQ ID NO: 3216957 - protein, 6 aa, Plasmodium falciparum
EKDNIN

SEQ ID NO: 3216958 - protein, 6 aa, Plasmodium falciparum
EKDNIT

SEQ ID NO: 3216959 - protein, 17 aa, Plasmodium falciparum
EKDNKTLKKKNSHNDNM

SEQ ID NO: 3216960 - protein, 7 aa, Plasmodium falciparum
EKDNNNY

SEQ ID NO: 3216961 - protein, 10 aa, Plasmodium falciparum
EKDNQEENKN

SEQ ID NO: 3216962 - protein, 7 aa, Plasmodium falciparum
EKDNSLK

SEQ ID NO: 3216963 - protein, 12 aa, Plasmodium falciparum
EKDNTGNGKWKD

SEQ ID NO: 3216964 - protein, 19 aa, Plasmodium falciparum
EKDQEKENDYDEEHKQEQQ

SEQ ID NO: 3216965 - protein, 7 aa, Plasmodium falciparum
EKDQHNS

SEQ ID NO: 3216966 - protein, 7 aa, Plasmodium falciparum
EKDQKKD

SEQ ID NO: 3216967 - protein, 4 aa, Plasmodium falciparum
EKDR

SEQ ID NO: 3216968 - protein, 6 aa, Plasmodium falciparum
EKDRLN

SEQ ID NO: 3216969 - protein, 7 aa, Plasmodium falciparum
EKDRNEF

SEQ ID NO: 3216970 - protein, 7 aa, Plasmodium falciparum
EKDSDKN

SEQ ID NO: 3216971 - protein, 6 aa, Plasmodium falciparum
EKDSKQ

SEQ ID NO: 3216972 - protein, 9 aa, Plasmodium falciparum
EKDSNNSDN

SEQ ID NO: 3216973 - protein, 16 aa, Plasmodium falciparum
EKDTDYAYNKKDKKKE

SEQ ID NO: 3216974 - protein, 12 aa, Plasmodium falciparum
EKDVEEEKEYDD

SEQ ID NO: 3216975 - protein, 6 aa, Plasmodium falciparum
EKDYKK

SEQ ID NO: 3216976 - protein, 13 aa, Plasmodium falciparum
EKEAADYRSSLQG

SEQ ID NO: 3216977 - protein, 33 aa, Plasmodium falciparum
EKEAKKCEQKHQNSGNPQQPCEGSTPPDDEEEE

SEQ ID NO: 3216978 - protein, 19 aa, Plasmodium falciparum
EKEANSQNTKVKKINEKKK

SEQ ID NO: 3216979 - protein, 6 aa, Plasmodium falciparum
EKEAST

SEQ ID NO: 3216980 - protein, 6 aa, Plasmodium falciparum
EKEAYM

SEQ ID NO: 3216981 - protein, 8 aa, Plasmodium falciparum
EKECKGIS

SEQ ID NO: 3216982 - protein, 14 aa, Plasmodium falciparum
EKECKNHPEVGEGK

SEQ ID NO: 3216983 - protein, 11 aa, Plasmodium falciparum
EKEDHNDNENN

SEQ ID NO: 3216984 - protein, 7 aa, Plasmodium falciparum
EKEDINA

SEQ ID NO: 3216985 - protein, 11 aa, Plasmodium falciparum
EKEDKNVERKN

SEQ ID NO: 3216986 - protein, 14 aa, Plasmodium falciparum
EKEDNNRNNNNNNI

SEQ ID NO: 3216987 - protein, 15 aa, Plasmodium falciparum
EKEDRKSFNYYSLSV

SEQ ID NO: 3216988 - protein, 5 aa, Plasmodium falciparum
EKEDY

SEQ ID NO: 3216989 - protein, 6 aa, Plasmodium falciparum
EKEDYT

SEQ ID NO: 3216990 - protein, 7 aa, Plasmodium falciparum
EKEEAEE

SEQ ID NO: 3216991 - protein, 12 aa, Plasmodium falciparum
EKEEEKKKKKDK

SEQ ID NO: 3216992 - protein, 9 aa, Plasmodium falciparum
EKEEGEEEI

SEQ ID NO: 3216993 - protein, 7 aa, Plasmodium falciparum
EKEEICD

SEQ ID NO: 3216994 - protein, 8 aa, Plasmodium falciparum
EKEEKERI

SEQ ID NO: 3216995 - protein, 12 aa, Plasmodium falciparum
EKEEKIDEEDDN

SEQ ID NO: 3216996 - protein, 12 aa, Plasmodium falciparum
EKEEKKKNKNDI

SEQ ID NO: 3216997 - protein, 8 aa, Plasmodium falciparum
EKEENKES

SEQ ID NO: 3216998 - protein, 8 aa, Plasmodium falciparum
EKEENTTL

SEQ ID NO: 3216999 - protein, 116 aa, Plasmodium falciparum
EKEEPDRKDECDENKNDDDEEEEEDDDEEEEEDDDEEEEEDDDEEEDDDDEQEDDDDEEDDDDEEDDEEEDDDDEQEDDDEEDDDDDDDDDDEEDDDDDDDDNYNDTYNDDDDYNN

SEQ ID NO: 3217000 - protein, 14 aa, Plasmodium falciparum
EKEERFDNKNEKSL

SEQ ID NO: 3217001 - protein, 6 aa, Plasmodium falciparum
EKEERK

SEQ ID NO: 3217002 - protein, 9 aa, Plasmodium falciparum
EKEERKNNA

SEQ ID NO: 3217003 - protein, 9 aa, Plasmodium falciparum
EKEESNYSR

SEQ ID NO: 3217004 - protein, 8 aa, Plasmodium falciparum
EKEESVTE

SEQ ID NO: 3217005 - protein, 12 aa, Plasmodium falciparum
EKEEYKYDENLN

SEQ ID NO: 3217006 - protein, 11 aa, Plasmodium falciparum
EKEEYNDKYEK

SEQ ID NO: 3217007 - protein, 7 aa, Plasmodium falciparum
EKEFDDD

SEQ ID NO: 3217008 - protein, 6 aa, Plasmodium falciparum
EKEFEK

SEQ ID NO: 3217009 - protein, 7 aa, Plasmodium falciparum
EKEGLPS

SEQ ID NO: 3217010 - protein, 8 aa, Plasmodium falciparum
EKEGSVNE

SEQ ID NO: 3217011 - protein, 7 aa, Plasmodium falciparum
EKEIKED

SEQ ID NO: 3217012 - protein, 12 aa, Plasmodium falciparum
EKEIKNKDDINN

SEQ ID NO: 3217013 - protein, 5 aa, Plasmodium falciparum
EKEIL

SEQ ID NO: 3217014 - protein, 8 aa, Plasmodium falciparum
EKEIRSGQ

SEQ ID NO: 3217015 - protein, 29 aa, Plasmodium falciparum
EKEITERTKSKKYRKGTYDAEKKEKSNIS

SEQ ID NO: 3217016 - protein, 7 aa, Plasmodium falciparum
EKEKEEE

SEQ ID NO: 3217017 - protein, 7 aa, Plasmodium falciparum
EKEKEEI

SEQ ID NO: 3217018 - protein, 8 aa, Plasmodium falciparum
EKEKEEKY

SEQ ID NO: 3217019 - protein, 6 aa, Plasmodium falciparum
EKEKEW

SEQ ID NO: 3217020 - protein, 8 aa, Plasmodium falciparum
EKEKEWPK

SEQ ID NO: 3217021 - protein, 20 aa, Plasmodium falciparum
EKEKGKENKELNTKDEQSKY

SEQ ID NO: 3217022 - protein, 9 aa, Plasmodium falciparum
EKEKINKQY

SEQ ID NO: 3217023 - protein, 16 aa, Plasmodium falciparum
EKEKKDEKYKRDKNYN

SEQ ID NO: 3217024 - protein, 11 aa, Plasmodium falciparum
EKEKKENFKRT

SEQ ID NO: 3217025 - protein, 11 aa, Plasmodium falciparum
EKEKKKEEQKY

SEQ ID NO: 3217026 - protein, 16 aa, Plasmodium falciparum
EKEKKPKKTDNDHDYT

SEQ ID NO: 3217027 - protein, 119 aa, Plasmodium falciparum
EKEKLKKKKWTEKEEQTKKVNYSEKVNHSEKVNHSEKLNHSEKLNHSEKLNHSEKVNHSEKVNHSEKVNHSEKVNHSEKVNHSEKVNHSEKLNHPNREKHSQKEKHTEKDDKRNNFKKN

SEQ ID NO: 3217028 - protein, 6 aa, Plasmodium falciparum
EKEKLN

SEQ ID NO: 3217029 - protein, 8 aa, Plasmodium falciparum
EKEKLQDS

SEQ ID NO: 3217030 - protein, 8 aa, Plasmodium falciparum
EKEKNADN

SEQ ID NO: 3217031 - protein, 8 aa, Plasmodium falciparum
EKEKNEHY

SEQ ID NO: 3217032 - protein, 9 aa, Plasmodium falciparum
EKEKNGTTI

SEQ ID NO: 3217033 - protein, 10 aa, Plasmodium falciparum
EKEKNNSTHF

SEQ ID NO: 3217034 - protein, 11 aa, Plasmodium falciparum
EKEKNRRKQLE

SEQ ID NO: 3217035 - protein, 16 aa, Plasmodium falciparum
EKEKNTGDKSVNYGEG

SEQ ID NO: 3217036 - protein, 7 aa, Plasmodium falciparum
EKEKNVN

SEQ ID NO: 3217037 - protein, 5 aa, Plasmodium falciparum
EKEKR

SEQ ID NO: 3217038 - protein, 6 aa, Plasmodium falciparum
EKEKRK

SEQ ID NO: 3217039 - protein, 11 aa, Plasmodium falciparum
EKEKSPYSSPQ

SEQ ID NO: 3217040 - protein, 12 aa, Plasmodium falciparum
EKEKYKNRLSQN

SEQ ID NO: 3217041 - protein, 5 aa, Plasmodium falciparum
EKELE

SEQ ID NO: 3217042 - protein, 5 aa, Plasmodium falciparum
EKELK

SEQ ID NO: 3217043 - protein, 8 aa, Plasmodium falciparum
EKEMDKDN

SEQ ID NO: 3217044 - protein, 13 aa, Plasmodium falciparum
EKENDFPSSTNCN

SEQ ID NO: 3217045 - protein, 11 aa, Plasmodium falciparum
EKENEEKNKRV

SEQ ID NO: 3217046 - protein, 9 aa, Plasmodium falciparum
EKENESSDI

SEQ ID NO: 3217047 - protein, 15 aa, Plasmodium falciparum
EKENIKNNEGGEESI

SEQ ID NO: 3217048 - protein, 7 aa, Plasmodium falciparum
EKENINK

SEQ ID NO: 3217049 - protein, 73 aa, Plasmodium falciparum
EKENISSNNNDDDNNEDDNNDDNNDDDNNDDNNDDNNDDNSNDHSNDHSNDHSNDHSNDDNSNLESNEFNENN

SEQ ID NO: 3217050 - protein, 9 aa, Plasmodium falciparum
EKENKARFE

SEQ ID NO: 3217051 - protein, 22 aa, Plasmodium falciparum
EKENKENGVNDDDYNNDVTTGG

SEQ ID NO: 3217052 - protein, 10 aa, Plasmodium falciparum
EKENKIKNTQ

SEQ ID NO: 3217053 - protein, 8 aa, Plasmodium falciparum
EKENKITD

SEQ ID NO: 3217054 - protein, 11 aa, Plasmodium falciparum
EKENKKEKEME

SEQ ID NO: 3217055 - protein, 9 aa, Plasmodium falciparum
EKENKNDSV

SEQ ID NO: 3217056 - protein, 12 aa, Plasmodium falciparum
EKENKNKTNTFS

SEQ ID NO: 3217057 - protein, 10 aa, Plasmodium falciparum
EKENNEADTK

SEQ ID NO: 3217058 - protein, 10 aa, Plasmodium falciparum
EKENNEYNKI

SEQ ID NO: 3217059 - protein, 12 aa, Plasmodium falciparum
EKENNKMNDSEY

SEQ ID NO: 3217060 - protein, 7 aa, Plasmodium falciparum
EKENNYI

SEQ ID NO: 3217061 - protein, 11 aa, Plasmodium falciparum
EKENTGTPNYR

SEQ ID NO: 3217062 - protein, 7 aa, Plasmodium falciparum
EKENTYN

SEQ ID NO: 3217063 - protein, 21 aa, Plasmodium falciparum
EKENYTSIESNNEKSKLNDEL

SEQ ID NO: 3217064 - protein, 8 aa, Plasmodium falciparum
EKEPSKNI

SEQ ID NO: 3217065 - protein, 7 aa, Plasmodium falciparum
EKEPTLK

SEQ ID NO: 3217066 - protein, 8 aa, Plasmodium falciparum
EKEQAEQC

SEQ ID NO: 3217067 - protein, 10 aa, Plasmodium falciparum
EKEQEDRNEI

SEQ ID NO: 3217068 - protein, 8 aa, Plasmodium falciparum
EKEQINNE

SEQ ID NO: 3217069 - protein, 4 aa, Plasmodium falciparum
EKES

SEQ ID NO: 3217070 - protein, 15 aa, Plasmodium falciparum
EKESEKKKKKNNTTC

SEQ ID NO: 3217071 - protein, 13 aa, Plasmodium falciparum
EKESKEKEKKQEN

SEQ ID NO: 3217072 - protein, 8 aa, Plasmodium falciparum
EKESKGKC

SEQ ID NO: 3217073 - protein, 17 aa, Plasmodium falciparum
EKESKLPKKKNNPFEDN

SEQ ID NO: 3217074 - protein, 9 aa, Plasmodium falciparum
EKESSTFQS

SEQ ID NO: 3217075 - protein, 7 aa, Plasmodium falciparum
EKESVEG

SEQ ID NO: 3217076 - protein, 34 aa, Plasmodium falciparum
EKETCSSNKKMNKLKKRKKKKGLKMKTQDDKNKF

SEQ ID NO: 3217077 - protein, 16 aa, Plasmodium falciparum
EKETISYKSKKKKKME

SEQ ID NO: 3217078 - protein, 5 aa, Plasmodium falciparum
EKETT

SEQ ID NO: 3217079 - protein, 16 aa, Plasmodium falciparum
EKETVPSIKEKEKTHD

SEQ ID NO: 3217080 - protein, 4 aa, Plasmodium falciparum
EKEW

SEQ ID NO: 3217081 - protein, 8 aa, Plasmodium falciparum
EKEWEKKK

SEQ ID NO: 3217082 - protein, 5 aa, Plasmodium falciparum
EKEYD

SEQ ID NO: 3217083 - protein, 15 aa, Plasmodium falciparum
EKEYEKGTNNNINID

SEQ ID NO: 3217084 - protein, 24 aa, Plasmodium falciparum
EKEYKKNYYNNEETNNYQSSNTID

SEQ ID NO: 3217085 - protein, 5 aa, Plasmodium falciparum
EKEYR

SEQ ID NO: 3217086 - protein, 80 aa, Plasmodium falciparum
EKFDDNNDVEGEDVEDDDVEDDETEDDDVEDDDTEDDDVEDDDTEDDDTEDDDVEDDSEDDAEDDVDDDDEDERGNNPHV

SEQ ID NO: 3217087 - protein, 10 aa, Plasmodium falciparum
EKFDKKKKIK

SEQ ID NO: 3217088 - protein, 4 aa, Plasmodium falciparum
EKFG

SEQ ID NO: 3217089 - protein, 9 aa, Plasmodium falciparum
EKFKERKDY

SEQ ID NO: 3217090 - protein, 6 aa, Plasmodium falciparum
EKFKNS

SEQ ID NO: 3217091 - protein, 13 aa, Plasmodium falciparum
EKFNENKKYQQND

SEQ ID NO: 3217092 - protein, 7 aa, Plasmodium falciparum
EKFPKDV

SEQ ID NO: 3217093 - protein, 10 aa, Plasmodium falciparum
EKGAEYKSYY

SEQ ID NO: 3217094 - protein, 7 aa, Plasmodium falciparum
EKGATCS

SEQ ID NO: 3217095 - protein, 9 aa, Plasmodium falciparum
EKGEEEFDE

SEQ ID NO: 3217096 - protein, 19 aa, Plasmodium falciparum
EKGEEENESNNNQKDYNKI

SEQ ID NO: 3217097 - protein, 8 aa, Plasmodium falciparum
EKGERKKK

SEQ ID NO: 3217098 - protein, 6 aa, Plasmodium falciparum
EKGHYN

SEQ ID NO: 3217099 - protein, 4 aa, Plasmodium falciparum
EKGI

SEQ ID NO: 3217100 - protein, 15 aa, Plasmodium falciparum
EKGIDEKKSDNQNEE

SEQ ID NO: 3217101 - protein, 6 aa, Plasmodium falciparum
EKGISG

SEQ ID NO: 3217102 - protein, 4 aa, Plasmodium falciparum
EKGK

SEQ ID NO: 3217103 - protein, 8 aa, Plasmodium falciparum
EKGKDNTC

SEQ ID NO: 3217104 - protein, 7 aa, Plasmodium falciparum
EKGKDSI

SEQ ID NO: 3217105 - protein, 18 aa, Plasmodium falciparum
EKGKDTDCGTISYMDESW

SEQ ID NO: 3217106 - protein, 5 aa, Plasmodium falciparum
EKGKH

SEQ ID NO: 3217107 - protein, 14 aa, Plasmodium falciparum
EKGKKKKKNVSNTR

SEQ ID NO: 3217108 - protein, 18 aa, Plasmodium falciparum
EKGKLDKSNLSDNEEKLD

SEQ ID NO: 3217109 - protein, 14 aa, Plasmodium falciparum
EKGKNKSSENIQSN

SEQ ID NO: 3217110 - protein, 16 aa, Plasmodium falciparum
EKGKNNNRNSEGGNNN

SEQ ID NO: 3217111 - protein, 8 aa, Plasmodium falciparum
EKGKSLSE

SEQ ID NO: 3217112 - protein, 13 aa, Plasmodium falciparum
EKGLPENSDEDAL

SEQ ID NO: 3217113 - protein, 6 aa, Plasmodium falciparum
EKGNDK

SEQ ID NO: 3217114 - protein, 6 aa, Plasmodium falciparum
EKGNDV

SEQ ID NO: 3217115 - protein, 10 aa, Plasmodium falciparum
EKGNGGGKGR

SEQ ID NO: 3217116 - protein, 5 aa, Plasmodium falciparum
EKGNM

SEQ ID NO: 3217117 - protein, 6 aa, Plasmodium falciparum
EKGNTL

SEQ ID NO: 3217118 - protein, 9 aa, Plasmodium falciparum
EKGPNTDEI

SEQ ID NO: 3217119 - protein, 6 aa, Plasmodium falciparum
EKGQEF

SEQ ID NO: 3217120 - protein, 6 aa, Plasmodium falciparum
EKGQEN

SEQ ID NO: 3217121 - protein, 6 aa, Plasmodium falciparum
EKGRHP

SEQ ID NO: 3217122 - protein, 27 aa, Plasmodium falciparum
EKGRKMNEEYDSKNNIDGDKKSQDKAY

SEQ ID NO: 3217123 - protein, 7 aa, Plasmodium falciparum
EKGRNKE

SEQ ID NO: 3217124 - protein, 7 aa, Plasmodium falciparum
EKGSIKT

SEQ ID NO: 3217125 - protein, 5 aa, Plasmodium falciparum
EKGTL

SEQ ID NO: 3217126 - protein, 8 aa, Plasmodium falciparum
EKGTTEEL

SEQ ID NO: 3217127 - protein, 18 aa, Plasmodium falciparum
EKGTTKQNGKTVGSGAEN

SEQ ID NO: 3217128 - protein, 8 aa, Plasmodium falciparum
EKHDNGEF

SEQ ID NO: 3217129 - protein, 50 aa, Plasmodium falciparum
EKHDTSNDGEKTGSNNMQKKQSKRKSLDNTNDNKKHNNKNNINNNKKKND

SEQ ID NO: 3217130 - protein, 7 aa, Plasmodium falciparum
EKHEAND

SEQ ID NO: 3217131 - protein, 8 aa, Plasmodium falciparum
EKHEEKNK

SEQ ID NO: 3217132 - protein, 5 aa, Plasmodium falciparum
EKHEV

SEQ ID NO: 3217133 - protein, 8 aa, Plasmodium falciparum
EKHHHSNN

SEQ ID NO: 3217134 - protein, 7 aa, Plasmodium falciparum
EKHHTSN

SEQ ID NO: 3217135 - protein, 8 aa, Plasmodium falciparum
EKHKEEQQ

SEQ ID NO: 3217136 - protein, 9 aa, Plasmodium falciparum
EKHKKKKSK

SEQ ID NO: 3217137 - protein, 6 aa, Plasmodium falciparum
EKHNKN

SEQ ID NO: 3217138 - protein, 10 aa, Plasmodium falciparum
EKHNNYNSSI

SEQ ID NO: 3217139 - protein, 20 aa, Plasmodium falciparum
EKHNSENSKSSNKNADFSKE

SEQ ID NO: 3217140 - protein, 22 aa, Plasmodium falciparum
EKHPGIEGNDKYVKDNENKQLR

SEQ ID NO: 3217141 - protein, 16 aa, Plasmodium falciparum
EKHRKKCKEVYKSREG

SEQ ID NO: 3217142 - protein, 7 aa, Plasmodium falciparum
EKHRNYQ

SEQ ID NO: 3217143 - protein, 15 aa, Plasmodium falciparum
EKHSGNSNDETKGTF

SEQ ID NO: 3217144 - protein, 7 aa, Plasmodium falciparum
EKHTPIN

SEQ ID NO: 3217145 - protein, 5 aa, Plasmodium falciparum
EKHTY

SEQ ID NO: 3217146 - protein, 4 aa, Plasmodium falciparum
EKIE

SEQ ID NO: 3217147 - protein, 12 aa, Plasmodium falciparum
EKIEDKNNNIKN

SEQ ID NO: 3217148 - protein, 13 aa, Plasmodium falciparum
EKIEKDDLDVKQK

SEQ ID NO: 3217149 - protein, 14 aa, Plasmodium falciparum
EKIEKSKTRGGKRV

SEQ ID NO: 3217150 - protein, 16 aa, Plasmodium falciparum
EKIEQNEEDKQYEQIR

SEQ ID NO: 3217151 - protein, 12 aa, Plasmodium falciparum
EKIERKPDISDE

SEQ ID NO: 3217152 - protein, 7 aa, Plasmodium falciparum
EKIGDQK

SEQ ID NO: 3217153 - protein, 24 aa, Plasmodium falciparum
EKIKDEKETDYSPKDTSSEVSTST

SEQ ID NO: 3217154 - protein, 21 aa, Plasmodium falciparum
EKIKKKKKNNKDTVSIEKKGT

SEQ ID NO: 3217155 - protein, 54 aa, Plasmodium falciparum
EKIKNEKKKNEDDNQNKKSNMQDNNKGLKVTTNKTNLKNKLGNNTKQIKQGANP

SEQ ID NO: 3217156 - protein, 251 aa, Plasmodium falciparum
EKIKNEKKKNEDDNQNKKSNPSSQNKTNSQNKQNSQDKTNKQSKLDTQNGKNEKNEKSIPNKLDSQNGKNEKNEKSIPNKLDSQNGKNEKNEKSIPNKLDSQNGKNEKNEKSIPNKLDSQNGKNEKNEKSIPNKLDSQNGKNEKNEKSIPNKLDSQNGKNEKNIPNKLDSQNVPNKQNIPNKLDSQNVKNEKDTPNKLDNENKENTQSNKNLNAKKSDIGTNGKSNIETSQDKQLTTKNNDENKNTVKNSK

SEQ ID NO: 3217157 - protein, 26 aa, Plasmodium falciparum
EKIKNKKRRRNKENMNNPLSPDNSEN

SEQ ID NO: 3217158 - protein, 22 aa, Plasmodium falciparum
EKIKNNAQNENIKNSSNNNNNV

SEQ ID NO: 3217159 - protein, 5 aa, Plasmodium falciparum
EKIKT

SEQ ID NO: 3217160 - protein, 61 aa, Plasmodium falciparum
EKINEEKNEKINEEKNEEKNEEKNEKINEEKNEEKNEKINEEKNEDTNKDPYEEKENDNIP

SEQ ID NO: 3217161 - protein, 7 aa, Plasmodium falciparum
EKINENV

SEQ ID NO: 3217162 - protein, 17 aa, Plasmodium falciparum
EKINKEKNVPIDEYDRN

SEQ ID NO: 3217163 - protein, 6 aa, Plasmodium falciparum
EKINKK

SEQ ID NO: 3217164 - protein, 8 aa, Plasmodium falciparum
EKINKKEE

SEQ ID NO: 3217165 - protein, 10 aa, Plasmodium falciparum
EKINKMDKDE

SEQ ID NO: 3217166 - protein, 23 aa, Plasmodium falciparum
EKINNKVNDEKNIKNEDDINNKE

SEQ ID NO: 3217167 - protein, 7 aa, Plasmodium falciparum
EKINQEK

SEQ ID NO: 3217168 - protein, 6 aa, Plasmodium falciparum
EKINSG

SEQ ID NO: 3217169 - protein, 29 aa, Plasmodium falciparum
EKINSKNQNKQTEYDNDINDNNNYNNSDN

SEQ ID NO: 3217170 - protein, 5 aa, Plasmodium falciparum
EKIPK

SEQ ID NO: 3217171 - protein, 7 aa, Plasmodium falciparum
EKIPNKK

SEQ ID NO: 3217172 - protein, 12 aa, Plasmodium falciparum
EKIPTSKTSTDT

SEQ ID NO: 3217173 - protein, 5 aa, Plasmodium falciparum
EKIRE

SEQ ID NO: 3217174 - protein, 5 aa, Plasmodium falciparum
EKIRK

SEQ ID NO: 3217175 - protein, 9 aa, Plasmodium falciparum
EKIRNTENN

SEQ ID NO: 3217176 - protein, 12 aa, Plasmodium falciparum
EKISNKKEMGGK

SEQ ID NO: 3217177 - protein, 11 aa, Plasmodium falciparum
EKISRNSKGKV

SEQ ID NO: 3217178 - protein, 24 aa, Plasmodium falciparum
EKITDIRSDNEDDSTSTMESIKKE

SEQ ID NO: 3217179 - protein, 6 aa, Plasmodium falciparum
EKIVKS

SEQ ID NO: 3217180 - protein, 15 aa, Plasmodium falciparum
EKKARKQAKHREQMN

SEQ ID NO: 3217181 - protein, 4 aa, Plasmodium falciparum
EKKC

SEQ ID NO: 3217182 - protein, 9 aa, Plasmodium falciparum
EKKCEYTDS

SEQ ID NO: 3217183 - protein, 13 aa, Plasmodium falciparum
EKKCPKNTTNITQ

SEQ ID NO: 3217184 - protein, 10 aa, Plasmodium falciparum
EKKDDKHKKI

SEQ ID NO: 3217185 - protein, 5 aa, Plasmodium falciparum
EKKDE

SEQ ID NO: 3217186 - protein, 8 aa, Plasmodium falciparum
EKKDEENK

SEQ ID NO: 3217187 - protein, 9 aa, Plasmodium falciparum
EKKDEKKEH

SEQ ID NO: 3217188 - protein, 14 aa, Plasmodium falciparum
EKKDGQTTNENNDS

SEQ ID NO: 3217189 - protein, 7 aa, Plasmodium falciparum
EKKDISN

SEQ ID NO: 3217190 - protein, 6 aa, Plasmodium falciparum
EKKDLE

SEQ ID NO: 3217191 - protein, 17 aa, Plasmodium falciparum
EKKDNKNISVDNNENDN

SEQ ID NO: 3217192 - protein, 6 aa, Plasmodium falciparum
EKKDNT

SEQ ID NO: 3217193 - protein, 7 aa, Plasmodium falciparum
EKKDQRK

SEQ ID NO: 3217194 - protein, 8 aa, Plasmodium falciparum
EKKDYDST

SEQ ID NO: 3217195 - protein, 9 aa, Plasmodium falciparum
EKKEEDCNK

SEQ ID NO: 3217196 - protein, 10 aa, Plasmodium falciparum
EKKEEQYQDE

SEQ ID NO: 3217197 - protein, 9 aa, Plasmodium falciparum
EKKEEYENI

SEQ ID NO: 3217198 - protein, 11 aa, Plasmodium falciparum
EKKEKEEGTCE

SEQ ID NO: 3217199 - protein, 8 aa, Plasmodium falciparum
EKKEKERN

SEQ ID NO: 3217200 - protein, 27 aa, Plasmodium falciparum
EKKEKSKKYSIKSQKKYSEHVNTDRSY

SEQ ID NO: 3217201 - protein, 26 aa, Plasmodium falciparum
EKKENEMNEANNNEDNYSDENNIPNE

SEQ ID NO: 3217202 - protein, 13 aa, Plasmodium falciparum
EKKENNNNQDGDV

SEQ ID NO: 3217203 - protein, 7 aa, Plasmodium falciparum
EKKENSQ

SEQ ID NO: 3217204 - protein, 22 aa, Plasmodium falciparum
EKKEQEKEKSDAKSQNDPDEIQ

SEQ ID NO: 3217205 - protein, 6 aa, Plasmodium falciparum
EKKEQQ

SEQ ID NO: 3217206 - protein, 7 aa, Plasmodium falciparum
EKKESGY

SEQ ID NO: 3217207 - protein, 7 aa, Plasmodium falciparum
EKKETRR

SEQ ID NO: 3217208 - protein, 68 aa, Plasmodium falciparum
EKKETVDEGKCGEDTSEPKKTEDEESKKKKDESTPDSPEPPPPATPEAPKEEKKVEPQPQPQPTTPQI

SEQ ID NO: 3217209 - protein, 11 aa, Plasmodium falciparum
EKKEYDIEQNT

SEQ ID NO: 3217210 - protein, 8 aa, Plasmodium falciparum
EKKEYGDK

SEQ ID NO: 3217211 - protein, 5 aa, Plasmodium falciparum
EKKFS

SEQ ID NO: 3217212 - protein, 9 aa, Plasmodium falciparum
EKKGGTCDR

SEQ ID NO: 3217213 - protein, 6 aa, Plasmodium falciparum
EKKHTQ

SEQ ID NO: 3217214 - protein, 6 aa, Plasmodium falciparum
EKKIKE

SEQ ID NO: 3217215 - protein, 8 aa, Plasmodium falciparum
EKKIKNNK

SEQ ID NO: 3217216 - protein, 5 aa, Plasmodium falciparum
EKKIN

SEQ ID NO: 3217217 - protein, 6 aa, Plasmodium falciparum
EKKINE

SEQ ID NO: 3217218 - protein, 12 aa, Plasmodium falciparum
EKKKANNPSYNN

SEQ ID NO: 3217219 - protein, 7 aa, Plasmodium falciparum
EKKKCSQ

SEQ ID NO: 3217220 - protein, 27 aa, Plasmodium falciparum
EKKKDDEGEEQEDEPPKPKPPSTPNPC

SEQ ID NO: 3217221 - protein, 40 aa, Plasmodium falciparum
EKKKDDPGNNKNVKKGKKSKTKNDISSVNHNTSGKKDEDD

SEQ ID NO: 3217222 - protein, 8 aa, Plasmodium falciparum
EKKKDKNM

SEQ ID NO: 3217223 - protein, 9 aa, Plasmodium falciparum
EKKKDNNIS

SEQ ID NO: 3217224 - protein, 29 aa, Plasmodium falciparum
EKKKEEEPEKKSDSDDEDLNKPKIPEQDH

SEQ ID NO: 3217225 - protein, 12 aa, Plasmodium falciparum
EKKKEEKKKKKE

SEQ ID NO: 3217226 - protein, 9 aa, Plasmodium falciparum
EKKKEENYE

SEQ ID NO: 3217227 - protein, 13 aa, Plasmodium falciparum
EKKKEKEETQGQV

SEQ ID NO: 3217228 - protein, 13 aa, Plasmodium falciparum
EKKKEKRKKKNLF

SEQ ID NO: 3217229 - protein, 6 aa, Plasmodium falciparum
EKKKEL

SEQ ID NO: 3217230 - protein, 6 aa, Plasmodium falciparum
EKKKEN

SEQ ID NO: 3217231 - protein, 14 aa, Plasmodium falciparum
EKKKGKKMKRRKTY

SEQ ID NO: 3217232 - protein, 10 aa, Plasmodium falciparum
EKKKHASSRS

SEQ ID NO: 3217233 - protein, 5 aa, Plasmodium falciparum
EKKKK

SEQ ID NO: 3217234 - protein, 18 aa, Plasmodium falciparum
EKKKKDNINKNDMNDYNT

SEQ ID NO: 3217235 - protein, 11 aa, Plasmodium falciparum
EKKKKEKKDNL

SEQ ID NO: 3217236 - protein, 11 aa, Plasmodium falciparum
EKKKKESYKCN

SEQ ID NO: 3217237 - protein, 7 aa, Plasmodium falciparum
EKKKKKK

SEQ ID NO: 3217238 - protein, 8 aa, Plasmodium falciparum
EKKKKKKD

SEQ ID NO: 3217239 - protein, 8 aa, Plasmodium falciparum
EKKKKKKI

SEQ ID NO: 3217240 - protein, 23 aa, Plasmodium falciparum
EKKKKKKIKESYDDNNVKDKYNE

SEQ ID NO: 3217241 - protein, 16 aa, Plasmodium falciparum
EKKKKKKKKKITNLNN

SEQ ID NO: 3217242 - protein, 11 aa, Plasmodium falciparum
EKKKKKKKKKK

SEQ ID NO: 3217243 - protein, 17 aa, Plasmodium falciparum
EKKKKKKKKKKEKKMES

SEQ ID NO: 3217244 - protein, 15 aa, Plasmodium falciparum
EKKKKKKKKKKKKMK

SEQ ID NO: 3217245 - protein, 13 aa, Plasmodium falciparum
EKKKKKKKKKNQN

SEQ ID NO: 3217246 - protein, 26 aa, Plasmodium falciparum
EKKKKKKKKKNVPQNNYKNHQEQNYN

SEQ ID NO: 3217247 - protein, 8 aa, Plasmodium falciparum
EKKKKKKN

SEQ ID NO: 3217248 - protein, 10 aa, Plasmodium falciparum
EKKKKKKNLL

SEQ ID NO: 3217249 - protein, 9 aa, Plasmodium falciparum
EKKKKKNNS

SEQ ID NO: 3217250 - protein, 23 aa, Plasmodium falciparum
EKKKKKNQEENEEKKKKEKKEHS

SEQ ID NO: 3217251 - protein, 12 aa, Plasmodium falciparum
EKKKKNEGNKKH

SEQ ID NO: 3217252 - protein, 13 aa, Plasmodium falciparum
EKKKKNKNKKYEK

SEQ ID NO: 3217253 - protein, 9 aa, Plasmodium falciparum
EKKKKNLKE

SEQ ID NO: 3217254 - protein, 7 aa, Plasmodium falciparum
EKKKKNR

SEQ ID NO: 3217255 - protein, 10 aa, Plasmodium falciparum
EKKKKQKKIK

SEQ ID NO: 3217256 - protein, 6 aa, Plasmodium falciparum
EKKKKR

SEQ ID NO: 3217257 - protein, 13 aa, Plasmodium falciparum
EKKKKSDKDMSSS

SEQ ID NO: 3217258 - protein, 13 aa, Plasmodium falciparum
EKKKKVKEDEKIN

SEQ ID NO: 3217259 - protein, 44 aa, Plasmodium falciparum
EKKKKYNEEEENNYDENNINNSDNFNSSEKLTDSSNSKQSEKNG

SEQ ID NO: 3217260 - protein, 5 aa, Plasmodium falciparum
EKKKN

SEQ ID NO: 3217261 - protein, 7 aa, Plasmodium falciparum
EKKKNCK

SEQ ID NO: 3217262 - protein, 8 aa, Plasmodium falciparum
EKKKNEEI

SEQ ID NO: 3217263 - protein, 16 aa, Plasmodium falciparum
EKKKNEIKKKNNNEMK

SEQ ID NO: 3217264 - protein, 14 aa, Plasmodium falciparum
EKKKNEMNKKKRKG

SEQ ID NO: 3217265 - protein, 12 aa, Plasmodium falciparum
EKKKNERNKMEK

SEQ ID NO: 3217266 - protein, 8 aa, Plasmodium falciparum
EKKKNEYK

SEQ ID NO: 3217267 - protein, 6 aa, Plasmodium falciparum
EKKKNI

SEQ ID NO: 3217268 - protein, 9 aa, Plasmodium falciparum
EKKKNKKKS

SEQ ID NO: 3217269 - protein, 12 aa, Plasmodium falciparum
EKKKNKQNDINE

SEQ ID NO: 3217270 - protein, 22 aa, Plasmodium falciparum
EKKKNNNNSNNNNSNSNNSNNN

SEQ ID NO: 3217271 - protein, 11 aa, Plasmodium falciparum
EKKKNQNYDDK

SEQ ID NO: 3217272 - protein, 10 aa, Plasmodium falciparum
EKKKQKGNDE

SEQ ID NO: 3217273 - protein, 6 aa, Plasmodium falciparum
EKKKQL

SEQ ID NO: 3217274 - protein, 7 aa, Plasmodium falciparum
EKKKQQL

SEQ ID NO: 3217275 - protein, 6 aa, Plasmodium falciparum
EKKKRI

SEQ ID NO: 3217276 - protein, 9 aa, Plasmodium falciparum
EKKKRKEKS

SEQ ID NO: 3217277 - protein, 9 aa, Plasmodium falciparum
EKKKSLTDE

SEQ ID NO: 3217278 - protein, 6 aa, Plasmodium falciparum
EKKKSY

SEQ ID NO: 3217279 - protein, 12 aa, Plasmodium falciparum
EKKKTEENSEEI

SEQ ID NO: 3217280 - protein, 11 aa, Plasmodium falciparum
EKKKTKKIHKR

SEQ ID NO: 3217281 - protein, 6 aa, Plasmodium falciparum
EKKKTS

SEQ ID NO: 3217282 - protein, 11 aa, Plasmodium falciparum
EKKKVNGYTSQ

SEQ ID NO: 3217283 - protein, 25 aa, Plasmodium falciparum
EKKKVNRREQIRTQREPQKSNYKAS

SEQ ID NO: 3217284 - protein, 7 aa, Plasmodium falciparum
EKKLSKR

SEQ ID NO: 3217285 - protein, 10 aa, Plasmodium falciparum
EKKLTKSEDI

SEQ ID NO: 3217286 - protein, 4 aa, Plasmodium falciparum
EKKM

SEQ ID NO: 3217287 - protein, 5 aa, Plasmodium falciparum
EKKMN

SEQ ID NO: 3217288 - protein, 9 aa, Plasmodium falciparum
EKKNDFENY

SEQ ID NO: 3217289 - protein, 6 aa, Plasmodium falciparum
EKKNEE

SEQ ID NO: 3217290 - protein, 6 aa, Plasmodium falciparum
EKKNEF

SEQ ID NO: 3217291 - protein, 9 aa, Plasmodium falciparum
EKKNENDNF

SEQ ID NO: 3217292 - protein, 13 aa, Plasmodium falciparum
EKKNGNTTNEEDV

SEQ ID NO: 3217293 - protein, 8 aa, Plasmodium falciparum
EKKNIENE

SEQ ID NO: 3217294 - protein, 7 aa, Plasmodium falciparum
EKKNIQK

SEQ ID NO: 3217295 - protein, 8 aa, Plasmodium falciparum
EKKNISTL

SEQ ID NO: 3217296 - protein, 8 aa, Plasmodium falciparum
EKKNIYPQ

SEQ ID NO: 3217297 - protein, 6 aa, Plasmodium falciparum
EKKNKD

SEQ ID NO: 3217298 - protein, 9 aa, Plasmodium falciparum
EKKNKEKSF

SEQ ID NO: 3217299 - protein, 8 aa, Plasmodium falciparum
EKKNKGGY

SEQ ID NO: 3217300 - protein, 10 aa, Plasmodium falciparum
EKKNKGKHDQ

SEQ ID NO: 3217301 - protein, 20 aa, Plasmodium falciparum
EKKNKINKNNNNNNNNNKNN

SEQ ID NO: 3217302 - protein, 31 aa, Plasmodium falciparum
EKKNKKKKDNTNKYESNYDSKYDNNNSRDHY

SEQ ID NO: 3217303 - protein, 8 aa, Plasmodium falciparum
EKKNKKYQ

SEQ ID NO: 3217304 - protein, 12 aa, Plasmodium falciparum
EKKNKNDDKKEI

SEQ ID NO: 3217305 - protein, 20 aa, Plasmodium falciparum
EKKNKNLKKQSDEEYDRNND

SEQ ID NO: 3217306 - protein, 20 aa, Plasmodium falciparum
EKKNKVNDDPFITYDSNLSK

SEQ ID NO: 3217307 - protein, 6 aa, Plasmodium falciparum
EKKNLN

SEQ ID NO: 3217308 - protein, 5 aa, Plasmodium falciparum
EKKNM

SEQ ID NO: 3217309 - protein, 5 aa, Plasmodium falciparum
EKKNN

SEQ ID NO: 3217310 - protein, 40 aa, Plasmodium falciparum
EKKNNDTTNVDDDNNDDNNDVNNDVNNDVNNDDDNNIQNN

SEQ ID NO: 3217311 - protein, 8 aa, Plasmodium falciparum
EKKNNKNL

SEQ ID NO: 3217312 - protein, 35 aa, Plasmodium falciparum
EKKNNLNEDNNKMKPNANDYQYNENDADTDSEEDL

SEQ ID NO: 3217313 - protein, 9 aa, Plasmodium falciparum
EKKNNLNNN

SEQ ID NO: 3217314 - protein, 13 aa, Plasmodium falciparum
EKKNNNDDAEEYY

SEQ ID NO: 3217315 - protein, 8 aa, Plasmodium falciparum
EKKNNNYD

SEQ ID NO: 3217316 - protein, 14 aa, Plasmodium falciparum
EKKNRRRKNNKTKD

SEQ ID NO: 3217317 - protein, 5 aa, Plasmodium falciparum
EKKNS

SEQ ID NO: 3217318 - protein, 11 aa, Plasmodium falciparum
EKKNSTNKNTC

SEQ ID NO: 3217319 - protein, 10 aa, Plasmodium falciparum
EKKPETEDEN

SEQ ID NO: 3217320 - protein, 14 aa, Plasmodium falciparum
EKKPETQQTPKDPC

SEQ ID NO: 3217321 - protein, 4 aa, Plasmodium falciparum
EKKQ

SEQ ID NO: 3217322 - protein, 9 aa, Plasmodium falciparum
EKKQDGTLR

SEQ ID NO: 3217323 - protein, 13 aa, Plasmodium falciparum
EKKQFNDNKNDLY

SEQ ID NO: 3217324 - protein, 5 aa, Plasmodium falciparum
EKKQI

SEQ ID NO: 3217325 - protein, 7 aa, Plasmodium falciparum
EKKQPTV

SEQ ID NO: 3217326 - protein, 4 aa, Plasmodium falciparum
EKKR

SEQ ID NO: 3217327 - protein, 5 aa, Plasmodium falciparum
EKKRD

SEQ ID NO: 3217328 - protein, 23 aa, Plasmodium falciparum
EKKRKEEQLKDMEEKNKKNKNDH

SEQ ID NO: 3217329 - protein, 8 aa, Plasmodium falciparum
EKKRKEKN

SEQ ID NO: 3217330 - protein, 8 aa, Plasmodium falciparum
EKKRKKEL

SEQ ID NO: 3217331 - protein, 15 aa, Plasmodium falciparum
EKKRKKKKKKQRNIG

SEQ ID NO: 3217332 - protein, 7 aa, Plasmodium falciparum
EKKRNKK

SEQ ID NO: 3217333 - protein, 8 aa, Plasmodium falciparum
EKKRTERK

SEQ ID NO: 3217334 - protein, 8 aa, Plasmodium falciparum
EKKSDVSD

SEQ ID NO: 3217335 - protein, 9 aa, Plasmodium falciparum
EKKSGYISS

SEQ ID NO: 3217336 - protein, 9 aa, Plasmodium falciparum
EKKSLKQSD

SEQ ID NO: 3217337 - protein, 6 aa, Plasmodium falciparum
EKKSMS

SEQ ID NO: 3217338 - protein, 8 aa, Plasmodium falciparum
EKKSNAEK

SEQ ID NO: 3217339 - protein, 19 aa, Plasmodium falciparum
EKKSQPDDDNKFRKNQDVE

SEQ ID NO: 3217340 - protein, 8 aa, Plasmodium falciparum
EKKSSINN

SEQ ID NO: 3217341 - protein, 8 aa, Plasmodium falciparum
EKKSTQNF

SEQ ID NO: 3217342 - protein, 7 aa, Plasmodium falciparum
EKKSVRK

SEQ ID NO: 3217343 - protein, 12 aa, Plasmodium falciparum
EKKTDNDPDEIQ

SEQ ID NO: 3217344 - protein, 34 aa, Plasmodium falciparum
EKKTESCSDEHSDQTHQTSCDSPPLVEDEDDTLH

SEQ ID NO: 3217345 - protein, 9 aa, Plasmodium falciparum
EKKTFPNSY

SEQ ID NO: 3217346 - protein, 11 aa, Plasmodium falciparum
EKKTKGVNGKS

SEQ ID NO: 3217347 - protein, 52 aa, Plasmodium falciparum
EKKTKKCKDDHPQPSAENQAQTCENSAHVEDDDEPLEEEGDQNPVGKQQPSF

SEQ ID NO: 3217348 - protein, 7 aa, Plasmodium falciparum
EKKTNEL

SEQ ID NO: 3217349 - protein, 24 aa, Plasmodium falciparum
EKKTNRNNNINNDNNLNNDNNMNL

SEQ ID NO: 3217350 - protein, 8 aa, Plasmodium falciparum
EKKTRNIS

SEQ ID NO: 3217351 - protein, 46 aa, Plasmodium falciparum
EKKTSHRKEVDDEKEHNRYDNKEKKKKDFDKRRTKFSSSDNRYKYA

SEQ ID NO: 3217352 - protein, 5 aa, Plasmodium falciparum
EKKVE

SEQ ID NO: 3217353 - protein, 8 aa, Plasmodium falciparum
EKKYEKED

SEQ ID NO: 3217354 - protein, 10 aa, Plasmodium falciparum
EKKYKEKCDK

SEQ ID NO: 3217355 - protein, 25 aa, Plasmodium falciparum
EKKYKGEHGKLRNDNCSGNDNKEYC

SEQ ID NO: 3217356 - protein, 9 aa, Plasmodium falciparum
EKKYKKGCD

SEQ ID NO: 3217357 - protein, 9 aa, Plasmodium falciparum
EKKYKKHQT

SEQ ID NO: 3217358 - protein, 17 aa, Plasmodium falciparum
EKKYPEQNSHRENNNDV

SEQ ID NO: 3217359 - protein, 7 aa, Plasmodium falciparum
EKKYSRQ

SEQ ID NO: 3217360 - protein, 8 aa, Plasmodium falciparum
EKKYTNNQ

SEQ ID NO: 3217361 - protein, 4 aa, Plasmodium falciparum
EKLA

SEQ ID NO: 3217362 - protein, 18 aa, Plasmodium falciparum
EKLDEKKKERNDDPTNKE

SEQ ID NO: 3217363 - protein, 5 aa, Plasmodium falciparum
EKLKD

SEQ ID NO: 3217364 - protein, 10 aa, Plasmodium falciparum
EKLKDEQVKN

SEQ ID NO: 3217365 - protein, 9 aa, Plasmodium falciparum
EKLKEEEEH

SEQ ID NO: 3217366 - protein, 21 aa, Plasmodium falciparum
EKLKEKKKNLLKQDSETKLEE

SEQ ID NO: 3217367 - protein, 13 aa, Plasmodium falciparum
EKLKTNKSKDPKI

SEQ ID NO: 3217368 - protein, 21 aa, Plasmodium falciparum
EKLNEEKKRKIYDNKDDSKIS

SEQ ID NO: 3217369 - protein, 7 aa, Plasmodium falciparum
EKLNEYN

SEQ ID NO: 3217370 - protein, 4 aa, Plasmodium falciparum
EKLP

SEQ ID NO: 3217371 - protein, 31 aa, Plasmodium falciparum
EKLQEQQSDLEQERRAKEKLQEQQSDLEQER

SEQ ID NO: 3217372 - protein, 48 aa, Plasmodium falciparum
EKLQEQQSDLEQERRAKEKLQEQQSDLEQERRAKEKLQEQQSDLEQDR

SEQ ID NO: 3217373 - protein, 80 aa, Plasmodium falciparum
EKLQEQQSDLEQERRAKEKLQEQQSDLEQERRAKEKLQEQQSDLEQERRAKEKLQEQQRDLEQRKADTKKNLERKKEHGD

SEQ ID NO: 3217374 - protein, 82 aa, Plasmodium falciparum
EKLQEQQSDLEQERRAKEKLQEQQSDLEQERRAKEKLQEQQSDLEQERRAKEKLQEQQSDLEQERRAKEKLQEQQSDLEQER

SEQ ID NO: 3217375 - protein, 30 aa, Plasmodium falciparum
EKLQEQQSDLEQERRAKEKLQEQQSDLERT

SEQ ID NO: 3217376 - protein, 48 aa, Plasmodium falciparum
EKLQEQQSDLEQERRAKEKLQEQQSDLERTKASTETLHEQQSDLEQER

SEQ ID NO: 3217377 - protein, 31 aa, Plasmodium falciparum
  misc_feature (15)..(15): Xaa can be any naturally occurring amino acid
EKLQEQQSDLEQERXAKEKLQEQQSDLEQER

SEQ ID NO: 3217378 - protein, 32 aa, Plasmodium falciparum
EKLQEQQSDLERTKASTETLREQQSDLEQEKL

SEQ ID NO: 3217379 - protein, 31 aa, Plasmodium falciparum
EKLQGQHSDLERTKASKETLQEQQSDLEQER

SEQ ID NO: 3217380 - protein, 10 aa, Plasmodium falciparum
EKLQKDKDYH

SEQ ID NO: 3217381 - protein, 18 aa, Plasmodium falciparum
EKLQRKRKKERKKKQIRK

SEQ ID NO: 3217382 - protein, 10 aa, Plasmodium falciparum
EKLSKEQRQS

SEQ ID NO: 3217383 - protein, 10 aa, Plasmodium falciparum
EKLSSYEKNK

SEQ ID NO: 3217384 - protein, 12 aa, Plasmodium falciparum
EKMDDKNDDMNN

SEQ ID NO: 3217385 - protein, 9 aa, Plasmodium falciparum
EKMDDRNNK

SEQ ID NO: 3217386 - protein, 11 aa, Plasmodium falciparum
EKMDNEDKKRN

SEQ ID NO: 3217387 - protein, 7 aa, Plasmodium falciparum
EKMEDSY

SEQ ID NO: 3217388 - protein, 9 aa, Plasmodium falciparum
EKMKDSNGN

SEQ ID NO: 3217389 - protein, 9 aa, Plasmodium falciparum
EKMNDPNVK

SEQ ID NO: 3217390 - protein, 17 aa, Plasmodium falciparum
EKMNNNKSSGGTKKESL

SEQ ID NO: 3217391 - protein, 13 aa, Plasmodium falciparum
EKMNSRKKTNIQN

SEQ ID NO: 3217392 - protein, 21 aa, Plasmodium falciparum
EKMPKKEENMQDKIERDKEFE

SEQ ID NO: 3217393 - protein, 18 aa, Plasmodium falciparum
EKMTEDNFNETPYELSNN

SEQ ID NO: 3217394 - protein, 5 aa, Plasmodium falciparum
EKNAP

SEQ ID NO: 3217395 - protein, 19 aa, Plasmodium falciparum
EKNDDNNIISSPKNETNPS

SEQ ID NO: 3217396 - protein, 12 aa, Plasmodium falciparum
EKNDKDDGNGDI

SEQ ID NO: 3217397 - protein, 18 aa, Plasmodium falciparum
EKNDKKNEKKNEKKNKKK

SEQ ID NO: 3217398 - protein, 22 aa, Plasmodium falciparum
EKNDKNKEINNTNHTNNNDNLE

SEQ ID NO: 3217399 - protein, 14 aa, Plasmodium falciparum
EKNDTLSSSLSNTI

SEQ ID NO: 3217400 - protein, 7 aa, Plasmodium falciparum
EKNDTYA

SEQ ID NO: 3217401 - protein, 6 aa, Plasmodium falciparum
EKNDYA

SEQ ID NO: 3217402 - protein, 20 aa, Plasmodium falciparum
EKNEDENKELQKQNEEKRKE

SEQ ID NO: 3217403 - protein, 5 aa, Plasmodium falciparum
EKNEE

SEQ ID NO: 3217404 - protein, 7 aa, Plasmodium falciparum
EKNEEDI

SEQ ID NO: 3217405 - protein, 16 aa, Plasmodium falciparum
EKNEELKEYKKTEDYH

SEQ ID NO: 3217406 - protein, 7 aa, Plasmodium falciparum
EKNEELN

SEQ ID NO: 3217407 - protein, 19 aa, Plasmodium falciparum
EKNEENMNKNDNNHDKNDD

SEQ ID NO: 3217408 - protein, 8 aa, Plasmodium falciparum
EKNEESEE

SEQ ID NO: 3217409 - protein, 7 aa, Plasmodium falciparum
EKNEITT

SEQ ID NO: 3217410 - protein, 7 aa, Plasmodium falciparum
EKNENDD

SEQ ID NO: 3217411 - protein, 8 aa, Plasmodium falciparum
EKNENDVD

SEQ ID NO: 3217412 - protein, 6 aa, Plasmodium falciparum
EKNENE

SEQ ID NO: 3217413 - protein, 8 aa, Plasmodium falciparum
EKNENKNI

SEQ ID NO: 3217414 - protein, 9 aa, Plasmodium falciparum
EKNENNIKD

SEQ ID NO: 3217415 - protein, 11 aa, Plasmodium falciparum
EKNENNINTKQ

SEQ ID NO: 3217416 - protein, 52 aa, Plasmodium falciparum
EKNENNNKNDKMSNNNNNNNHNNNHNNNNNHNNNHNNNNNHNNNHNNNHNNY

SEQ ID NO: 3217417 - protein, 7 aa, Plasmodium falciparum
EKNENVP

SEQ ID NO: 3217418 - protein, 7 aa, Plasmodium falciparum
EKNERTF

SEQ ID NO: 3217419 - protein, 7 aa, Plasmodium falciparum
EKNETSD

SEQ ID NO: 3217420 - protein, 9 aa, Plasmodium falciparum
EKNEVNTKH

SEQ ID NO: 3217421 - protein, 9 aa, Plasmodium falciparum
EKNFKDESS

SEQ ID NO: 3217422 - protein, 18 aa, Plasmodium falciparum
EKNGAKYTGGNDAEPMST

SEQ ID NO: 3217423 - protein, 8 aa, Plasmodium falciparum
EKNGDHNI

SEQ ID NO: 3217424 - protein, 5 aa, Plasmodium falciparum
EKNGE

SEQ ID NO: 3217425 - protein, 16 aa, Plasmodium falciparum
EKNGEENENADDTEYS

SEQ ID NO: 3217426 - protein, 15 aa, Plasmodium falciparum
EKNGENKNSQQNSDH

SEQ ID NO: 3217427 - protein, 14 aa, Plasmodium falciparum
EKNGKQYKSDINKP

SEQ ID NO: 3217428 - protein, 12 aa, Plasmodium falciparum
EKNGSQNRSGHV

SEQ ID NO: 3217429 - protein, 16 aa, Plasmodium falciparum
EKNGTINNNNNNNDIR

SEQ ID NO: 3217430 - protein, 9 aa, Plasmodium falciparum
EKNGTKHVG

SEQ ID NO: 3217431 - protein, 18 aa, Plasmodium falciparum
EKNGTKIRGGNSAEPMST

SEQ ID NO: 3217432 - protein, 18 aa, Plasmodium falciparum
EKNGTKYKGGNDAEPMST

SEQ ID NO: 3217433 - protein, 18 aa, Plasmodium falciparum
EKNGTKYSGGNDAEPIST

SEQ ID NO: 3217434 - protein, 19 aa, Plasmodium falciparum
EKNGTKYTGGNDAEPRSTL

SEQ ID NO: 3217435 - protein, 18 aa, Plasmodium falciparum
EKNGTKYTGGNDAKPMSA

SEQ ID NO: 3217436 - protein, 18 aa, Plasmodium falciparum
EKNGTKYTGGNDAKPMST

SEQ ID NO: 3217437 - protein, 16 aa, Plasmodium falciparum
EKNGTKYTGGNDVEPM

SEQ ID NO: 3217438 - protein, 19 aa, Plasmodium falciparum
EKNGTKYTGSNDAEPRSTL

SEQ ID NO: 3217439 - protein, 10 aa, Plasmodium falciparum
EKNHDREKKK

SEQ ID NO: 3217440 - protein, 8 aa, Plasmodium falciparum
EKNHKKED

SEQ ID NO: 3217441 - protein, 11 aa, Plasmodium falciparum
EKNIDDDVEKK

SEQ ID NO: 3217442 - protein, 6 aa, Plasmodium falciparum
EKNIDK

SEQ ID NO: 3217443 - protein, 24 aa, Plasmodium falciparum
EKNIDNKNIDNNKIDNNNDDNYNV

SEQ ID NO: 3217444 - protein, 12 aa, Plasmodium falciparum
EKNIKKKKKKYD

SEQ ID NO: 3217445 - protein, 7 aa, Plasmodium falciparum
EKNIKNN

SEQ ID NO: 3217446 - protein, 5 aa, Plasmodium falciparum
EKNIL

SEQ ID NO: 3217447 - protein, 9 aa, Plasmodium falciparum
EKNINNNNN

SEQ ID NO: 3217448 - protein, 7 aa, Plasmodium falciparum
EKNIRNN

SEQ ID NO: 3217449 - protein, 8 aa, Plasmodium falciparum
EKNISKRM

SEQ ID NO: 3217450 - protein, 10 aa, Plasmodium falciparum
EKNKDNEKID

SEQ ID NO: 3217451 - protein, 8 aa, Plasmodium falciparum
EKNKDNKI

SEQ ID NO: 3217452 - protein, 10 aa, Plasmodium falciparum
EKNKEAHKEH

SEQ ID NO: 3217453 - protein, 9 aa, Plasmodium falciparum
EKNKEEKEI

SEQ ID NO: 3217454 - protein, 13 aa, Plasmodium falciparum
EKNKEGDNDMKSS

SEQ ID NO: 3217455 - protein, 8 aa, Plasmodium falciparum
EKNKEGQT

SEQ ID NO: 3217456 - protein, 7 aa, Plasmodium falciparum
EKNKEKV

SEQ ID NO: 3217457 - protein, 9 aa, Plasmodium falciparum
EKNKERNVH

SEQ ID NO: 3217458 - protein, 7 aa, Plasmodium falciparum
EKNKEYT

SEQ ID NO: 3217459 - protein, 10 aa, Plasmodium falciparum
EKNKGSNTIY

SEQ ID NO: 3217460 - protein, 5 aa, Plasmodium falciparum
EKNKI

SEQ ID NO: 3217461 - protein, 8 aa, Plasmodium falciparum
EKNKKKDI

SEQ ID NO: 3217462 - protein, 11 aa, Plasmodium falciparum
EKNKKKEDETF

SEQ ID NO: 3217463 - protein, 9 aa, Plasmodium falciparum
EKNKKKEQE

SEQ ID NO: 3217464 - protein, 14 aa, Plasmodium falciparum
EKNKKKGFGKTTME

SEQ ID NO: 3217465 - protein, 28 aa, Plasmodium falciparum
EKNKKKRTRSYNNTDQKEKKQVENVPDD

SEQ ID NO: 3217466 - protein, 21 aa, Plasmodium falciparum
EKNKKTHETLNGDNKNDTCDD

SEQ ID NO: 3217467 - protein, 7 aa, Plasmodium falciparum
EKNKKYL

SEQ ID NO: 3217468 - protein, 9 aa, Plasmodium falciparum
EKNKMDKEE

SEQ ID NO: 3217469 - protein, 5 aa, Plasmodium falciparum
EKNKN

SEQ ID NO: 3217470 - protein, 8 aa, Plasmodium falciparum
EKNKNDDM

SEQ ID NO: 3217471 - protein, 8 aa, Plasmodium falciparum
EKNKNIDK

SEQ ID NO: 3217472 - protein, 7 aa, Plasmodium falciparum
EKNKNNH

SEQ ID NO: 3217473 - protein, 8 aa, Plasmodium falciparum
EKNKNTLK

SEQ ID NO: 3217474 - protein, 8 aa, Plasmodium falciparum
EKNKREKE

SEQ ID NO: 3217475 - protein, 11 aa, Plasmodium falciparum
EKNKRNKKKRS

SEQ ID NO: 3217476 - protein, 8 aa, Plasmodium falciparum
EKNKSNYV

SEQ ID NO: 3217477 - protein, 17 aa, Plasmodium falciparum
EKNKSSEENNMNTNTDF

SEQ ID NO: 3217478 - protein, 27 aa, Plasmodium falciparum
EKNKTMDYNKGYEEKEIEKKRIEEGTY

SEQ ID NO: 3217479 - protein, 9 aa, Plasmodium falciparum
EKNKYKKEI

SEQ ID NO: 3217480 - protein, 4 aa, Plasmodium falciparum
EKNL

SEQ ID NO: 3217481 - protein, 13 aa, Plasmodium falciparum
EKNMNDDKKKKKK

SEQ ID NO: 3217482 - protein, 4 aa, Plasmodium falciparum
EKNN

SEQ ID NO: 3217483 - protein, 9 aa, Plasmodium falciparum
EKNNANLKY

SEQ ID NO: 3217484 - protein, 8 aa, Plasmodium falciparum
EKNNEEIN

SEQ ID NO: 3217485 - protein, 15 aa, Plasmodium falciparum
EKNNEHLKSNNGFDE

SEQ ID NO: 3217486 - protein, 6 aa, Plasmodium falciparum
EKNNIK

SEQ ID NO: 3217487 - protein, 9 aa, Plasmodium falciparum
EKNNINGKD

SEQ ID NO: 3217488 - protein, 8 aa, Plasmodium falciparum
EKNNKAFR

SEQ ID NO: 3217489 - protein, 7 aa, Plasmodium falciparum
EKNNKNL

SEQ ID NO: 3217490 - protein, 17 aa, Plasmodium falciparum
EKNNKSINTLNDKTQEL

SEQ ID NO: 3217491 - protein, 17 aa, Plasmodium falciparum
EKNNKSNEQVKNTSVSK

SEQ ID NO: 3217492 - protein, 7 aa, Plasmodium falciparum
EKNNKYD

SEQ ID NO: 3217493 - protein, 6 aa, Plasmodium falciparum
EKNNLK

SEQ ID NO: 3217494 - protein, 7 aa, Plasmodium falciparum
EKNNLSH

SEQ ID NO: 3217495 - protein, 14 aa, Plasmodium falciparum
EKNNMKGGKKKMGN

SEQ ID NO: 3217496 - protein, 13 aa, Plasmodium falciparum
EKNNNKKNHISNN

SEQ ID NO: 3217497 - protein, 8 aa, Plasmodium falciparum
EKNNNSIY

SEQ ID NO: 3217498 - protein, 9 aa, Plasmodium falciparum
EKNNNTNMR

SEQ ID NO: 3217499 - protein, 8 aa, Plasmodium falciparum
EKNNNTSH

SEQ ID NO: 3217500 - protein, 5 aa, Plasmodium falciparum
EKNNR

SEQ ID NO: 3217501 - protein, 6 aa, Plasmodium falciparum
EKNNSS

SEQ ID NO: 3217502 - protein, 10 aa, Plasmodium falciparum
EKNNSSEHQS

SEQ ID NO: 3217503 - protein, 8 aa, Plasmodium falciparum
EKNNYDKN

SEQ ID NO: 3217504 - protein, 8 aa, Plasmodium falciparum
EKNNYGTV

SEQ ID NO: 3217505 - protein, 20 aa, Plasmodium falciparum
EKNPDENSSTELDDNESTVS

SEQ ID NO: 3217506 - protein, 14 aa, Plasmodium falciparum
EKNPPDKQTPEDPC

SEQ ID NO: 3217507 - protein, 6 aa, Plasmodium falciparum
EKNPQN

SEQ ID NO: 3217508 - protein, 4 aa, Plasmodium falciparum
EKNQ

SEQ ID NO: 3217509 - protein, 16 aa, Plasmodium falciparum
EKNQIKNKNKNKKKNL

SEQ ID NO: 3217510 - protein, 18 aa, Plasmodium falciparum
EKNQTKVTGGNDAEPMST

SEQ ID NO: 3217511 - protein, 18 aa, Plasmodium falciparum
EKNQYVQQNDEINQEDYQ

SEQ ID NO: 3217512 - protein, 4 aa, Plasmodium falciparum
EKNR

SEQ ID NO: 3217513 - protein, 27 aa, Plasmodium falciparum
EKNRNSNNNNNNNNTNNSNNSNNNNNI

SEQ ID NO: 3217514 - protein, 8 aa, Plasmodium falciparum
EKNRRAKE

SEQ ID NO: 3217515 - protein, 20 aa, Plasmodium falciparum
EKNRRKEDIDGTYKRKKNVS

SEQ ID NO: 3217516 - protein, 5 aa, Plasmodium falciparum
EKNSE

SEQ ID NO: 3217517 - protein, 9 aa, Plasmodium falciparum
EKNSEPYYD

SEQ ID NO: 3217518 - protein, 8 aa, Plasmodium falciparum
EKNSEYEA

SEQ ID NO: 3217519 - protein, 5 aa, Plasmodium falciparum
EKNSI

SEQ ID NO: 3217520 - protein, 6 aa, Plasmodium falciparum
EKNSPK

SEQ ID NO: 3217521 - protein, 6 aa, Plasmodium falciparum
EKNTAM

SEQ ID NO: 3217522 - protein, 5 aa, Plasmodium falciparum
EKNTI

SEQ ID NO: 3217523 - protein, 23 aa, Plasmodium falciparum
EKNTLYSSNPSDKEKSKSLNENY

SEQ ID NO: 3217524 - protein, 5 aa, Plasmodium falciparum
EKNTN

SEQ ID NO: 3217525 - protein, 7 aa, Plasmodium falciparum
EKNTNAA

SEQ ID NO: 3217526 - protein, 46 aa, Plasmodium falciparum
EKNTNKMKGNITNEEKINDEENINDKRNTYKSRDSVNNNNNNDKKV

SEQ ID NO: 3217527 - protein, 5 aa, Plasmodium falciparum
EKNTP

SEQ ID NO: 3217528 - protein, 14 aa, Plasmodium falciparum
EKNTYRRKENKTDI

SEQ ID NO: 3217529 - protein, 7 aa, Plasmodium falciparum
EKNVAEK

SEQ ID NO: 3217530 - protein, 5 aa, Plasmodium falciparum
EKNVD

SEQ ID NO: 3217531 - protein, 27 aa, Plasmodium falciparum
EKNVKTDSSDDKKKKEDNENNNKNKNN

SEQ ID NO: 3217532 - protein, 5 aa, Plasmodium falciparum
EKNVN

SEQ ID NO: 3217533 - protein, 10 aa, Plasmodium falciparum
EKNVPSSDIN

SEQ ID NO: 3217534 - protein, 16 aa, Plasmodium falciparum
EKNVRNNMKDHDNNNL

SEQ ID NO: 3217535 - protein, 4 aa, Plasmodium falciparum
EKNY

SEQ ID NO: 3217536 - protein, 5 aa, Plasmodium falciparum
EKNYE

SEQ ID NO: 3217537 - protein, 11 aa, Plasmodium falciparum
EKNYGKNGPDW

SEQ ID NO: 3217538 - protein, 11 aa, Plasmodium falciparum
EKNYNNVDTNN

SEQ ID NO: 3217539 - protein, 7 aa, Plasmodium falciparum
EKPAEEV

SEQ ID NO: 3217540 - protein, 9 aa, Plasmodium falciparum
EKPDDKLPE

SEQ ID NO: 3217541 - protein, 5 aa, Plasmodium falciparum
EKPDY

SEQ ID NO: 3217542 - protein, 9 aa, Plasmodium falciparum
EKPEKHNQI

SEQ ID NO: 3217543 - protein, 13 aa, Plasmodium falciparum
EKPEPKKKQEENL

SEQ ID NO: 3217544 - protein, 5 aa, Plasmodium falciparum
EKPKT

SEQ ID NO: 3217545 - protein, 7 aa, Plasmodium falciparum
EKPKTME

SEQ ID NO: 3217546 - protein, 5 aa, Plasmodium falciparum
EKPNE

SEQ ID NO: 3217547 - protein, 6 aa, Plasmodium falciparum
EKPNKV

SEQ ID NO: 3217548 - protein, 17 aa, Plasmodium falciparum
EKPSNVNTDNQKEIKDD

SEQ ID NO: 3217549 - protein, 6 aa, Plasmodium falciparum
EKPTLP

SEQ ID NO: 3217550 - protein, 6 aa, Plasmodium falciparum
EKPYET

SEQ ID NO: 3217551 - protein, 14 aa, Plasmodium falciparum
EKQEEDQKKKKKNI

SEQ ID NO: 3217552 - protein, 26 aa, Plasmodium falciparum
EKQENKNENNIKAKKNKSGSKTGAHK

SEQ ID NO: 3217553 - protein, 27 aa, Plasmodium falciparum
EKQEPPPPKVPEDSEDDRERSEPGEDA

SEQ ID NO: 3217554 - protein, 8 aa, Plasmodium falciparum
EKQGSVTE

SEQ ID NO: 3217555 - protein, 15 aa, Plasmodium falciparum
EKQGSVTEEKVQEGV

SEQ ID NO: 3217556 - protein, 4 aa, Plasmodium falciparum
EKQH

SEQ ID NO: 3217557 - protein, 25 aa, Plasmodium falciparum
EKQIENKEKQNQKKKEDAMLNNDYN

SEQ ID NO: 3217558 - protein, 22 aa, Plasmodium falciparum
EKQITKNKNYNYNEQEIDGGQG

SEQ ID NO: 3217559 - protein, 4 aa, Plasmodium falciparum
EKQK

SEQ ID NO: 3217560 - protein, 11 aa, Plasmodium falciparum
EKQKEKYTKEI

SEQ ID NO: 3217561 - protein, 10 aa, Plasmodium falciparum
EKQKEQIEKY

SEQ ID NO: 3217562 - protein, 8 aa, Plasmodium falciparum
EKQKLNNR

SEQ ID NO: 3217563 - protein, 6 aa, Plasmodium falciparum
EKQKNI

SEQ ID NO: 3217564 - protein, 13 aa, Plasmodium falciparum
EKQKQKEETSPGV

SEQ ID NO: 3217565 - protein, 29 aa, Plasmodium falciparum
EKQKQKQKHKKKEFHSSHTNSITNGYTDT

SEQ ID NO: 3217566 - protein, 38 aa, Plasmodium falciparum
EKQKQNKMKHQSNNNNNNNNNNKKKKNKKEKEKETENH

SEQ ID NO: 3217567 - protein, 5 aa, Plasmodium falciparum
EKQKS

SEQ ID NO: 3217568 - protein, 9 aa, Plasmodium falciparum
EKQKTEELL

SEQ ID NO: 3217569 - protein, 6 aa, Plasmodium falciparum
EKQLQE

SEQ ID NO: 3217570 - protein, 11 aa, Plasmodium falciparum
EKQLSSNSQDF

SEQ ID NO: 3217571 - protein, 5 aa, Plasmodium falciparum
EKQME

SEQ ID NO: 3217572 - protein, 6 aa, Plasmodium falciparum
EKQNED

SEQ ID NO: 3217573 - protein, 6 aa, Plasmodium falciparum
EKQNEI

SEQ ID NO: 3217574 - protein, 25 aa, Plasmodium falciparum
EKQNENESEYEKNNEIKYKNEENNI

SEQ ID NO: 3217575 - protein, 7 aa, Plasmodium falciparum
EKQNKMG

SEQ ID NO: 3217576 - protein, 7 aa, Plasmodium falciparum
EKQNKNK

SEQ ID NO: 3217577 - protein, 7 aa, Plasmodium falciparum
EKQNMKK

SEQ ID NO: 3217578 - protein, 8 aa, Plasmodium falciparum
EKQNNERA

SEQ ID NO: 3217579 - protein, 9 aa, Plasmodium falciparum
EKQNRPVNR

SEQ ID NO: 3217580 - protein, 5 aa, Plasmodium falciparum
EKQPF

SEQ ID NO: 3217581 - protein, 18 aa, Plasmodium falciparum
EKQPKFENEENEDSNNIN

SEQ ID NO: 3217582 - protein, 8 aa, Plasmodium falciparum
EKQQNHEY

SEQ ID NO: 3217583 - protein, 12 aa, Plasmodium falciparum
EKQTQSKELKNQ

SEQ ID NO: 3217584 - protein, 4 aa, Plasmodium falciparum
EKQY

SEQ ID NO: 3217585 - protein, 15 aa, Plasmodium falciparum
EKRDDNNNNIDNTDN

SEQ ID NO: 3217586 - protein, 6 aa, Plasmodium falciparum
EKRDIP

SEQ ID NO: 3217587 - protein, 4 aa, Plasmodium falciparum
EKRE

SEQ ID NO: 3217588 - protein, 15 aa, Plasmodium falciparum
EKREDRNIENESNRI

SEQ ID NO: 3217589 - protein, 19 aa, Plasmodium falciparum
EKREEELNEKTKNDQEKHK

SEQ ID NO: 3217590 - protein, 9 aa, Plasmodium falciparum
EKRENGPTI

SEQ ID NO: 3217591 - protein, 41 aa, Plasmodium falciparum
EKREQTKKKNKKKYHTNQKNIGKTKKNKSSKKIRNQHDEKK

SEQ ID NO: 3217592 - protein, 23 aa, Plasmodium falciparum
EKRGSRSRTNSIHTKSESRKSSI

SEQ ID NO: 3217593 - protein, 4 aa, Plasmodium falciparum
EKRI

SEQ ID NO: 3217594 - protein, 4 aa, Plasmodium falciparum
EKRK

SEQ ID NO: 3217595 - protein, 7 aa, Plasmodium falciparum
EKRKEAE

SEQ ID NO: 3217596 - protein, 9 aa, Plasmodium falciparum
EKRKEINVE

SEQ ID NO: 3217597 - protein, 8 aa, Plasmodium falciparum
EKRKERKN

SEQ ID NO: 3217598 - protein, 7 aa, Plasmodium falciparum
EKRKGEY

SEQ ID NO: 3217599 - protein, 6 aa, Plasmodium falciparum
EKRKGG

SEQ ID NO: 3217600 - protein, 7 aa, Plasmodium falciparum
EKRKGMD

SEQ ID NO: 3217601 - protein, 5 aa, Plasmodium falciparum
EKRKI

SEQ ID NO: 3217602 - protein, 5 aa, Plasmodium falciparum
EKRKK

SEQ ID NO: 3217603 - protein, 19 aa, Plasmodium falciparum
EKRKKKKKKKLKEEKNDNM

SEQ ID NO: 3217604 - protein, 15 aa, Plasmodium falciparum
EKRKKNEKNHIPSSS

SEQ ID NO: 3217605 - protein, 9 aa, Plasmodium falciparum
EKRKKNKMN

SEQ ID NO: 3217606 - protein, 21 aa, Plasmodium falciparum
EKRKNDPNYKEAYENKDYANN

SEQ ID NO: 3217607 - protein, 6 aa, Plasmodium falciparum
EKRKNI

SEQ ID NO: 3217608 - protein, 10 aa, Plasmodium falciparum
EKRKRENNMK

SEQ ID NO: 3217609 - protein, 10 aa, Plasmodium falciparum
EKRKSTQDIN

SEQ ID NO: 3217610 - protein, 7 aa, Plasmodium falciparum
EKRKTIN

SEQ ID NO: 3217611 - protein, 12 aa, Plasmodium falciparum
EKRKTPNKKPLK

SEQ ID NO: 3217612 - protein, 6 aa, Plasmodium falciparum
EKRNIQ

SEQ ID NO: 3217613 - protein, 6 aa, Plasmodium falciparum
EKRNKD

SEQ ID NO: 3217614 - protein, 11 aa, Plasmodium falciparum
EKRNTENNNSL

SEQ ID NO: 3217615 - protein, 7 aa, Plasmodium falciparum
EKRNTSS

SEQ ID NO: 3217616 - protein, 7 aa, Plasmodium falciparum
EKRPFEK

SEQ ID NO: 3217617 - protein, 6 aa, Plasmodium falciparum
EKRRDI

SEQ ID NO: 3217618 - protein, 45 aa, Plasmodium falciparum
EKRRKELEKKTKGEENEIEKKKENDLEKKKENEIEKKKENDLEKE

SEQ ID NO: 3217619 - protein, 15 aa, Plasmodium falciparum
EKRRKKKKHKTKNHQ

SEQ ID NO: 3217620 - protein, 12 aa, Plasmodium falciparum
EKRSNEEEYNNL

SEQ ID NO: 3217621 - protein, 14 aa, Plasmodium falciparum
EKRSNVHNNEDNNN

SEQ ID NO: 3217622 - protein, 7 aa, Plasmodium falciparum
EKRTTND

SEQ ID NO: 3217623 - protein, 4 aa, Plasmodium falciparum
EKRY

SEQ ID NO: 3217624 - protein, 8 aa, Plasmodium falciparum
EKSADKRI

SEQ ID NO: 3217625 - protein, 7 aa, Plasmodium falciparum
EKSDDNV

SEQ ID NO: 3217626 - protein, 5 aa, Plasmodium falciparum
EKSDQ

SEQ ID NO: 3217627 - protein, 42 aa, Plasmodium falciparum
EKSDSKKKKKKNDHHERDSDNNNNDSNNNNYYNSNNNSNYCG

SEQ ID NO: 3217628 - protein, 23 aa, Plasmodium falciparum
EKSDSTPRTPGTHSPSSGTTPQA

SEQ ID NO: 3217629 - protein, 22 aa, Plasmodium falciparum
EKSEDGSAQDTENSLDEEEAEE

SEQ ID NO: 3217630 - protein, 18 aa, Plasmodium falciparum
EKSEEEIEKENNENNEKN

SEQ ID NO: 3217631 - protein, 9 aa, Plasmodium falciparum
EKSEGEREK

SEQ ID NO: 3217632 - protein, 10 aa, Plasmodium falciparum
EKSEGNEKKI

SEQ ID NO: 3217633 - protein, 8 aa, Plasmodium falciparum
EKSEINEK

SEQ ID NO: 3217634 - protein, 8 aa, Plasmodium falciparum
EKSEQRKG

SEQ ID NO: 3217635 - protein, 7 aa, Plasmodium falciparum
EKSETFQ

SEQ ID NO: 3217636 - protein, 18 aa, Plasmodium falciparum
EKSETKLTGGNDAEPMST

SEQ ID NO: 3217637 - protein, 23 aa, Plasmodium falciparum
EKSGDTPSRTPPGQQPSDNDPKS

SEQ ID NO: 3217638 - protein, 6 aa, Plasmodium falciparum
EKSGKK

SEQ ID NO: 3217639 - protein, 19 aa, Plasmodium falciparum
EKSGSEAASGAQKNSGISR

SEQ ID NO: 3217640 - protein, 11 aa, Plasmodium falciparum
EKSHNNNSIEQ

SEQ ID NO: 3217641 - protein, 22 aa, Plasmodium falciparum
EKSIGQDKSMENNNVSTNDGKD

SEQ ID NO: 3217642 - protein, 4 aa, Plasmodium falciparum
EKSK

SEQ ID NO: 3217643 - protein, 5 aa, Plasmodium falciparum
EKSKE

SEQ ID NO: 3217644 - protein, 6 aa, Plasmodium falciparum
EKSKIY

SEQ ID NO: 3217645 - protein, 12 aa, Plasmodium falciparum
EKSKKHQSDYTN

SEQ ID NO: 3217646 - protein, 16 aa, Plasmodium falciparum
EKSKMDKSNGPTDNNN

SEQ ID NO: 3217647 - protein, 7 aa, Plasmodium falciparum
EKSKNTT

SEQ ID NO: 3217648 - protein, 8 aa, Plasmodium falciparum
EKSKRDYS

SEQ ID NO: 3217649 - protein, 9 aa, Plasmodium falciparum
EKSKRNKNY

SEQ ID NO: 3217650 - protein, 10 aa, Plasmodium falciparum
EKSKSTKRKN

SEQ ID NO: 3217651 - protein, 11 aa, Plasmodium falciparum
EKSKYEEENAN

SEQ ID NO: 3217652 - protein, 34 aa, Plasmodium falciparum
EKSKYNKTTTIPNNNNNNNNNNNSNNNKKNKKNY

SEQ ID NO: 3217653 - protein, 4 aa, Plasmodium falciparum
EKSL

SEQ ID NO: 3217654 - protein, 9 aa, Plasmodium falciparum
EKSLAEKVE

SEQ ID NO: 3217655 - protein, 9 aa, Plasmodium falciparum
EKSLAKKVE

SEQ ID NO: 3217656 - protein, 7 aa, Plasmodium falciparum
EKSLDES

SEQ ID NO: 3217657 - protein, 15 aa, Plasmodium falciparum
EKSLEDKVEKSLEEK

SEQ ID NO: 3217658 - protein, 7 aa, Plasmodium falciparum
EKSLEEK

SEQ ID NO: 3217659 - protein, 8 aa, Plasmodium falciparum
EKSLEEKV

SEQ ID NO: 3217660 - protein, 9 aa, Plasmodium falciparum
EKSLEEKVE

SEQ ID NO: 3217661 - protein, 17 aa, Plasmodium falciparum
EKSLPQKYHDNTNLTND

SEQ ID NO: 3217662 - protein, 9 aa, Plasmodium falciparum
EKSLSEKVE

SEQ ID NO: 3217663 - protein, 5 aa, Plasmodium falciparum
EKSLT

SEQ ID NO: 3217664 - protein, 6 aa, Plasmodium falciparum
EKSLTD

SEQ ID NO: 3217665 - protein, 10 aa, Plasmodium falciparum
EKSNEDENIK

SEQ ID NO: 3217666 - protein, 6 aa, Plasmodium falciparum
EKSNEI

SEQ ID NO: 3217667 - protein, 5 aa, Plasmodium falciparum
EKSNI

SEQ ID NO: 3217668 - protein, 6 aa, Plasmodium falciparum
EKSNIK

SEQ ID NO: 3217669 - protein, 12 aa, Plasmodium falciparum
EKSNINKEDSDE

SEQ ID NO: 3217670 - protein, 6 aa, Plasmodium falciparum
EKSNKI

SEQ ID NO: 3217671 - protein, 30 aa, Plasmodium falciparum
EKSNKSDNINLEKNKKSKKSIKKKILKDMN

SEQ ID NO: 3217672 - protein, 20 aa, Plasmodium falciparum
EKSNNKNGHSNNKDGHSNNI

SEQ ID NO: 3217673 - protein, 10 aa, Plasmodium falciparum
EKSPKESQMV

SEQ ID NO: 3217674 - protein, 4 aa, Plasmodium falciparum
EKSQ

SEQ ID NO: 3217675 - protein, 19 aa, Plasmodium falciparum
EKSQINNTLNREKTKKYQA

SEQ ID NO: 3217676 - protein, 5 aa, Plasmodium falciparum
EKSQQ

SEQ ID NO: 3217677 - protein, 15 aa, Plasmodium falciparum
EKSTESRVGSNIYDI

SEQ ID NO: 3217678 - protein, 7 aa, Plasmodium falciparum
EKSTEWT

SEQ ID NO: 3217679 - protein, 7 aa, Plasmodium falciparum
EKSTNHY

SEQ ID NO: 3217680 - protein, 7 aa, Plasmodium falciparum
EKSTTNS

SEQ ID NO: 3217681 - protein, 7 aa, Plasmodium falciparum
EKSVSNR

SEQ ID NO: 3217682 - protein, 4 aa, Plasmodium falciparum
EKSY

SEQ ID NO: 3217683 - protein, 6 aa, Plasmodium falciparum
EKSYNN

SEQ ID NO: 3217684 - protein, 6 aa, Plasmodium falciparum
EKSYNS

SEQ ID NO: 3217685 - protein, 7 aa, Plasmodium falciparum
EKSYRRR

SEQ ID NO: 3217686 - protein, 15 aa, Plasmodium falciparum
EKTCKDITDTEGGKI

SEQ ID NO: 3217687 - protein, 30 aa, Plasmodium falciparum
EKTCKDQPQVGNEKASPVDFTKGKTKETFS

SEQ ID NO: 3217688 - protein, 18 aa, Plasmodium falciparum
EKTCTKKLKDDDEDEGTI

SEQ ID NO: 3217689 - protein, 6 aa, Plasmodium falciparum
EKTDDY

SEQ ID NO: 3217690 - protein, 10 aa, Plasmodium falciparum
EKTDEGNLED

SEQ ID NO: 3217691 - protein, 8 aa, Plasmodium falciparum
EKTDQSIE

SEQ ID NO: 3217692 - protein, 8 aa, Plasmodium falciparum
EKTDTEKA

SEQ ID NO: 3217693 - protein, 9 aa, Plasmodium falciparum
EKTDYEKEE

SEQ ID NO: 3217694 - protein, 7 aa, Plasmodium falciparum
EKTEDCN

SEQ ID NO: 3217695 - protein, 6 aa, Plasmodium falciparum
EKTFDE

SEQ ID NO: 3217696 - protein, 5 aa, Plasmodium falciparum
EKTIK

SEQ ID NO: 3217697 - protein, 8 aa, Plasmodium falciparum
EKTKESYT

SEQ ID NO: 3217698 - protein, 24 aa, Plasmodium falciparum
EKTKGEDNTNNNNINNNNNNINNN

SEQ ID NO: 3217699 - protein, 10 aa, Plasmodium falciparum
EKTKINKRKE

SEQ ID NO: 3217700 - protein, 7 aa, Plasmodium falciparum
EKTKKGF

SEQ ID NO: 3217701 - protein, 6 aa, Plasmodium falciparum
EKTKKN

SEQ ID NO: 3217702 - protein, 6 aa, Plasmodium falciparum
EKTKSS

SEQ ID NO: 3217703 - protein, 8 aa, Plasmodium falciparum
EKTKSSKL

SEQ ID NO: 3217704 - protein, 6 aa, Plasmodium falciparum
EKTKTF

SEQ ID NO: 3217705 - protein, 32 aa, Plasmodium falciparum
EKTNDTIDNLNETGKNNTNDISIKGSDKNKEY

SEQ ID NO: 3217706 - protein, 16 aa, Plasmodium falciparum
EKTNETKSNNTHNKTT

SEQ ID NO: 3217707 - protein, 6 aa, Plasmodium falciparum
EKTNEW

SEQ ID NO: 3217708 - protein, 5 aa, Plasmodium falciparum
EKTNN

SEQ ID NO: 3217709 - protein, 12 aa, Plasmodium falciparum
EKTNPTKSWDTL

SEQ ID NO: 3217710 - protein, 5 aa, Plasmodium falciparum
EKTNS

SEQ ID NO: 3217711 - protein, 18 aa, Plasmodium falciparum
EKTNSASGSESKIEQNQK

SEQ ID NO: 3217712 - protein, 21 aa, Plasmodium falciparum
EKTNTKNSIDEKCKKKKNNLL

SEQ ID NO: 3217713 - protein, 7 aa, Plasmodium falciparum
EKTNYEY

SEQ ID NO: 3217714 - protein, 7 aa, Plasmodium falciparum
EKTPKNN

SEQ ID NO: 3217715 - protein, 5 aa, Plasmodium falciparum
EKTPM

SEQ ID NO: 3217716 - protein, 7 aa, Plasmodium falciparum
EKTPNHY

SEQ ID NO: 3217717 - protein, 9 aa, Plasmodium falciparum
EKTQQKNES

SEQ ID NO: 3217718 - protein, 15 aa, Plasmodium falciparum
EKTQSSKDDSSVTEN

SEQ ID NO: 3217719 - protein, 7 aa, Plasmodium falciparum
EKTSDIE

SEQ ID NO: 3217720 - protein, 19 aa, Plasmodium falciparum
EKTSGSDDKGVKIEQNEGL

SEQ ID NO: 3217721 - protein, 5 aa, Plasmodium falciparum
EKTSI

SEQ ID NO: 3217722 - protein, 7 aa, Plasmodium falciparum
EKTSNLR

SEQ ID NO: 3217723 - protein, 9 aa, Plasmodium falciparum
EKTVNKPCG

SEQ ID NO: 3217724 - protein, 6 aa, Plasmodium falciparum
EKTYNT

SEQ ID NO: 3217725 - protein, 5 aa, Plasmodium falciparum
EKVDD

SEQ ID NO: 3217726 - protein, 10 aa, Plasmodium falciparum
EKVDSNNYIS

SEQ ID NO: 3217727 - protein, 4 aa, Plasmodium falciparum
EKVE

SEQ ID NO: 3217728 - protein, 18 aa, Plasmodium falciparum
EKVEDSKEELGFKSHFVI

SEQ ID NO: 3217729 - protein, 8 aa, Plasmodium falciparum
EKVEKDAK

SEQ ID NO: 3217730 - protein, 7 aa, Plasmodium falciparum
EKVGKIK

SEQ ID NO: 3217731 - protein, 11 aa, Plasmodium falciparum
EKVKEKKDAEN

SEQ ID NO: 3217732 - protein, 8 aa, Plasmodium falciparum
EKVKTENI

SEQ ID NO: 3217733 - protein, 4 aa, Plasmodium falciparum
EKVM

SEQ ID NO: 3217734 - protein, 11 aa, Plasmodium falciparum
EKVNQTKSPLR

SEQ ID NO: 3217735 - protein, 20 aa, Plasmodium falciparum
EKVPKEREGEKEKNGGYYNE

SEQ ID NO: 3217736 - protein, 8 aa, Plasmodium falciparum
EKVPTSHT

SEQ ID NO: 3217737 - protein, 4 aa, Plasmodium falciparum
EKVQ

SEQ ID NO: 3217738 - protein, 5 aa, Plasmodium falciparum
EKVSI

SEQ ID NO: 3217739 - protein, 5 aa, Plasmodium falciparum
EKVSK

SEQ ID NO: 3217740 - protein, 5 aa, Plasmodium falciparum
EKVTP

SEQ ID NO: 3217741 - protein, 11 aa, Plasmodium falciparum
EKWKKKNGKKK

SEQ ID NO: 3217742 - protein, 6 aa, Plasmodium falciparum
EKYANL

SEQ ID NO: 3217743 - protein, 6 aa, Plasmodium falciparum
EKYANS

SEQ ID NO: 3217744 - protein, 6 aa, Plasmodium falciparum
EKYARG

SEQ ID NO: 3217745 - protein, 9 aa, Plasmodium falciparum
EKYDDSPSE

SEQ ID NO: 3217746 - protein, 13 aa, Plasmodium falciparum
EKYDDTEKKKEKW

SEQ ID NO: 3217747 - protein, 10 aa, Plasmodium falciparum
EKYEEDKSWS

SEQ ID NO: 3217748 - protein, 6 aa, Plasmodium falciparum
EKYEEE

SEQ ID NO: 3217749 - protein, 17 aa, Plasmodium falciparum
EKYEKKRKRKRKKKSKK

SEQ ID NO: 3217750 - protein, 9 aa, Plasmodium falciparum
EKYEKNNDI

SEQ ID NO: 3217751 - protein, 10 aa, Plasmodium falciparum
EKYENKTKKV

SEQ ID NO: 3217752 - protein, 15 aa, Plasmodium falciparum
EKYESEQERTSEKKC

SEQ ID NO: 3217753 - protein, 5 aa, Plasmodium falciparum
EKYGD

SEQ ID NO: 3217754 - protein, 7 aa, Plasmodium falciparum
EKYHNQN

SEQ ID NO: 3217755 - protein, 4 aa, Plasmodium falciparum
EKYK

SEQ ID NO: 3217756 - protein, 7 aa, Plasmodium falciparum
EKYKEDR

SEQ ID NO: 3217757 - protein, 6 aa, Plasmodium falciparum
EKYKEI

SEQ ID NO: 3217758 - protein, 30 aa, Plasmodium falciparum
EKYKERKKKKKYKKEKNKKGKKIRPVQKDS

SEQ ID NO: 3217759 - protein, 5 aa, Plasmodium falciparum
EKYKN

SEQ ID NO: 3217760 - protein, 22 aa, Plasmodium falciparum
EKYKNGTSNGTTTTKKTSNGPI

SEQ ID NO: 3217761 - protein, 8 aa, Plasmodium falciparum
EKYKNKHK

SEQ ID NO: 3217762 - protein, 13 aa, Plasmodium falciparum
EKYKNQDNINING

SEQ ID NO: 3217763 - protein, 4 aa, Plasmodium falciparum
EKYL

SEQ ID NO: 3217764 - protein, 8 aa, Plasmodium falciparum
EKYLKKNK

SEQ ID NO: 3217765 - protein, 4 aa, Plasmodium falciparum
EKYN

SEQ ID NO: 3217766 - protein, 5 aa, Plasmodium falciparum
EKYNA

SEQ ID NO: 3217767 - protein, 6 aa, Plasmodium falciparum
EKYNIR

SEQ ID NO: 3217768 - protein, 30 aa, Plasmodium falciparum
EKYNKNKKNNNNNDNNNNNNNNRDNESVSS

SEQ ID NO: 3217769 - protein, 19 aa, Plasmodium falciparum
EKYNLDETSSSSISSSLTN

SEQ ID NO: 3217770 - protein, 12 aa, Plasmodium falciparum
EKYNNNEDKTNR

SEQ ID NO: 3217771 - protein, 206 aa, Plasmodium falciparum
EKYNNYNSDNNNDNINDNHNNDNINDNHNNDNINDNYNNDNHDNNNNNNNNNNNNDNMNDNHNNNNDDNNNDDNNNDNNNNINNNINNNNNNINNNINNNNNNNNNNNDNNNNDNNNNNNNNNNNNNNNNNNNNNNNNNNNNNNDNNNNNNDNNNNNNNDNNNNNNDNNNNNNDNNNNNNDNVDNNNNNNNNNNNVDNNQENKEEI

SEQ ID NO: 3217772 - protein, 14 aa, Plasmodium falciparum
EKYREKRKKNSKHY

SEQ ID NO: 3217773 - protein, 8 aa, Plasmodium falciparum
EKYRRNQE

SEQ ID NO: 3217774 - protein, 6 aa, Plasmodium falciparum
EKYSEF

SEQ ID NO: 3217775 - protein, 6 aa, Plasmodium falciparum
EKYSMN

SEQ ID NO: 3217776 - protein, 8 aa, Plasmodium falciparum
EKYTEESR

SEQ ID NO: 3217777 - protein, 7 aa, Plasmodium falciparum
EKYTEKQ

SEQ ID NO: 3217778 - protein, 62 aa, Plasmodium falciparum
EKYTHGDKKNNDKKDNDKKDNDKKDSDKKNNDNNNDNNNDNNNDNSNDNINDNNNDDNNIYN

SEQ ID NO: 3217779 - protein, 28 aa, Plasmodium falciparum
EKYTNEASGSTGGRAKRSVSTTNYDGYE

SEQ ID NO: 3217780 - protein, 31 aa, Plasmodium falciparum
EKYTNEISGGKSRKKRAARSSSSSSYDNGYE

SEQ ID NO: 3217781 - protein, 55 aa, Plasmodium falciparum
EKYYGDKEEDSDDEDSDDEDNDDEDSDNEDNDDDDDDNYNNYNNYNNDDNNYYEE

SEQ ID NO: 3217782 - protein, 10 aa, Plasmodium falciparum
EKYYKDEKND

SEQ ID NO: 3217783 - protein, 5 aa, Plasmodium falciparum
ELANK

SEQ ID NO: 3217784 - protein, 10 aa, Plasmodium falciparum
ELDDTQNRYQ

SEQ ID NO: 3217785 - protein, 13 aa, Plasmodium falciparum
ELDKGEKKKKNSV

SEQ ID NO: 3217786 - protein, 21 aa, Plasmodium falciparum
ELDPVGNGRDEPNKDPYLPPV

SEQ ID NO: 3217787 - protein, 6 aa, Plasmodium falciparum
ELDTTK

SEQ ID NO: 3217788 - protein, 10 aa, Plasmodium falciparum
ELEGDSMENY

SEQ ID NO: 3217789 - protein, 9 aa, Plasmodium falciparum
ELEKKNEHI

SEQ ID NO: 3217790 - protein, 10 aa, Plasmodium falciparum
ELEKSKDEKN

SEQ ID NO: 3217791 - protein, 4 aa, Plasmodium falciparum
ELET

SEQ ID NO: 3217792 - protein, 19 aa, Plasmodium falciparum
ELGEKNEKNESLYEPSSDI

SEQ ID NO: 3217793 - protein, 5 aa, Plasmodium falciparum
ELGPE

SEQ ID NO: 3217794 - protein, 7 aa, Plasmodium falciparum
ELGSSNN

SEQ ID NO: 3217795 - protein, 12 aa, Plasmodium falciparum
ELHNNSDRLNGA

SEQ ID NO: 3217796 - protein, 13 aa, Plasmodium falciparum
ELINNDKKNDNLI

SEQ ID NO: 3217797 - protein, 8 aa, Plasmodium falciparum
ELKDEDKQ

SEQ ID NO: 3217798 - protein, 6 aa, Plasmodium falciparum
ELKEDE

SEQ ID NO: 3217799 - protein, 22 aa, Plasmodium falciparum
ELKEERRKSEKYERKYNEEKSE

SEQ ID NO: 3217800 - protein, 10 aa, Plasmodium falciparum
ELKEEVKQQC

SEQ ID NO: 3217801 - protein, 20 aa, Plasmodium falciparum
ELKEKKEEITLENKDKQEEI

SEQ ID NO: 3217802 - protein, 11 aa, Plasmodium falciparum
ELKEKKNSAIQ

SEQ ID NO: 3217803 - protein, 12 aa, Plasmodium falciparum
ELKEYEKKEGAK

SEQ ID NO: 3217804 - protein, 5 aa, Plasmodium falciparum
ELKGT

SEQ ID NO: 3217805 - protein, 8 aa, Plasmodium falciparum
ELKKESKI

SEQ ID NO: 3217806 - protein, 16 aa, Plasmodium falciparum
ELKKKNKDLSQNKTKK

SEQ ID NO: 3217807 - protein, 13 aa, Plasmodium falciparum
ELKKNQKKKMRST

SEQ ID NO: 3217808 - protein, 15 aa, Plasmodium falciparum
ELKKQKKKKKMNKTY

SEQ ID NO: 3217809 - protein, 8 aa, Plasmodium falciparum
ELKKSHEK

SEQ ID NO: 3217810 - protein, 4 aa, Plasmodium falciparum
ELKN

SEQ ID NO: 3217811 - protein, 12 aa, Plasmodium falciparum
ELKNERNENMKE

SEQ ID NO: 3217812 - protein, 19 aa, Plasmodium falciparum
ELKNNNTEKNNNNNNNNNY

SEQ ID NO: 3217813 - protein, 8 aa, Plasmodium falciparum
ELKRKSGE

SEQ ID NO: 3217814 - protein, 13 aa, Plasmodium falciparum
ELKRSGSEKYDKD

SEQ ID NO: 3217815 - protein, 5 aa, Plasmodium falciparum
ELNCG

SEQ ID NO: 3217816 - protein, 9 aa, Plasmodium falciparum
ELNDETLDK

SEQ ID NO: 3217817 - protein, 12 aa, Plasmodium falciparum
ELNKRSDNSLKK

SEQ ID NO: 3217818 - protein, 4 aa, Plasmodium falciparum
ELNN

SEQ ID NO: 3217819 - protein, 5 aa, Plasmodium falciparum
ELNNA

SEQ ID NO: 3217820 - protein, 6 aa, Plasmodium falciparum
ELNNKK

SEQ ID NO: 3217821 - protein, 8 aa, Plasmodium falciparum
ELNNSANN

SEQ ID NO: 3217822 - protein, 11 aa, Plasmodium falciparum
ELNNSNKNIQS

SEQ ID NO: 3217823 - protein, 16 aa, Plasmodium falciparum
ELNPKYDENTQGNDSF

SEQ ID NO: 3217824 - protein, 7 aa, Plasmodium falciparum
ELNSSDN

SEQ ID NO: 3217825 - protein, 7 aa, Plasmodium falciparum
ELNSTYN

SEQ ID NO: 3217826 - protein, 5 aa, Plasmodium falciparum
ELNTD

SEQ ID NO: 3217827 - protein, 5 aa, Plasmodium falciparum
ELNTN

SEQ ID NO: 3217828 - protein, 6 aa, Plasmodium falciparum
ELPNDK

SEQ ID NO: 3217829 - protein, 7 aa, Plasmodium falciparum
ELQDGEM

SEQ ID NO: 3217830 - protein, 10 aa, Plasmodium falciparum
ELQNEKNNKI

SEQ ID NO: 3217831 - protein, 13 aa, Plasmodium falciparum
ELQREQNKTCNNN

SEQ ID NO: 3217832 - protein, 6 aa, Plasmodium falciparum
ELQTNE

SEQ ID NO: 3217833 - protein, 6 aa, Plasmodium falciparum
ELREGK

SEQ ID NO: 3217834 - protein, 5 aa, Plasmodium falciparum
ELSDK

SEQ ID NO: 3217835 - protein, 17 aa, Plasmodium falciparum
ELSDNKSVKAADSPSFK

SEQ ID NO: 3217836 - protein, 8 aa, Plasmodium falciparum
ELSGSEEV

SEQ ID NO: 3217837 - protein, 7 aa, Plasmodium falciparum
ELSKNKK

SEQ ID NO: 3217838 - protein, 6 aa, Plasmodium falciparum
ELSPTQ

SEQ ID NO: 3217839 - protein, 10 aa, Plasmodium falciparum
ELSSDNNNEY

SEQ ID NO: 3217840 - protein, 5 aa, Plasmodium falciparum
ELTDS

SEQ ID NO: 3217841 - protein, 4 aa, Plasmodium falciparum
ELTG

SEQ ID NO: 3217842 - protein, 22 aa, Plasmodium falciparum
ELTKSGGNNKNGDYKNKNDNVL

SEQ ID NO: 3217843 - protein, 4 aa, Plasmodium falciparum
ELTN

SEQ ID NO: 3217844 - protein, 5 aa, Plasmodium falciparum
ELTQE

SEQ ID NO: 3217845 - protein, 7 aa, Plasmodium falciparum
ELTQSNQ

SEQ ID NO: 3217846 - protein, 5 aa, Plasmodium falciparum
ELTYD

SEQ ID NO: 3217847 - protein, 10 aa, Plasmodium falciparum
ELYDDSNKKD

SEQ ID NO: 3217848 - protein, 7 aa, Plasmodium falciparum
EMEDDDY

SEQ ID NO: 3217849 - protein, 22 aa, Plasmodium falciparum
EMEKNKNRKGTSASTNSNNINN

SEQ ID NO: 3217850 - protein, 23 aa, Plasmodium falciparum
EMENNEKEENYINSNNDRKQDSY

SEQ ID NO: 3217851 - protein, 13 aa, Plasmodium falciparum
EMENRKRNKKEME

SEQ ID NO: 3217852 - protein, 12 aa, Plasmodium falciparum
EMERETNGQMEN

SEQ ID NO: 3217853 - protein, 19 aa, Plasmodium falciparum
EMETPLKSTPMKKKNIENV

SEQ ID NO: 3217854 - protein, 13 aa, Plasmodium falciparum
EMEYEKKKKKRSK

SEQ ID NO: 3217855 - protein, 9 aa, Plasmodium falciparum
EMGKKEKEN

SEQ ID NO: 3217856 - protein, 59 aa, Plasmodium falciparum
EMGKNIPDDISDNNNNRHIDDNNKQDLSYNNKQDISYNNKQDISYNNKQDLSYNNKQDI

SEQ ID NO: 3217857 - protein, 11 aa, Plasmodium falciparum
EMGKTEKNGLL

SEQ ID NO: 3217858 - protein, 69 aa, Plasmodium falciparum
EMKEKRKKELKEKKKKIKENEQKIKESEQKIKESEQKIKESEQKIKESEQKIKESEQKINESKKKSIKS

SEQ ID NO: 3217859 - protein, 7 aa, Plasmodium falciparum
EMKGKNR

SEQ ID NO: 3217860 - protein, 10 aa, Plasmodium falciparum
EMKKKKKKCS

SEQ ID NO: 3217861 - protein, 7 aa, Plasmodium falciparum
EMKNEKD

SEQ ID NO: 3217862 - protein, 44 aa, Plasmodium falciparum
EMKSDYEKEVQEDNNKIKYKGKVKNVDKDDQKLLSQKKKEGLTI

SEQ ID NO: 3217863 - protein, 64 aa, Plasmodium falciparum
EMKSDYEKEVQEDNNKIKYKGKVKNVDKDDQKLLSQKKKGLTINERTNKKKKKNDLNSTKFSDN

SEQ ID NO: 3217864 - protein, 7 aa, Plasmodium falciparum
EMNEGNY

SEQ ID NO: 3217865 - protein, 12 aa, Plasmodium falciparum
EMNGETNNGRNH

SEQ ID NO: 3217866 - protein, 10 aa, Plasmodium falciparum
EMNNSDDMKE

SEQ ID NO: 3217867 - protein, 13 aa, Plasmodium falciparum
EMNNSNDKEISNN

SEQ ID NO: 3217868 - protein, 9 aa, Plasmodium falciparum
EMNNTNELN

SEQ ID NO: 3217869 - protein, 10 aa, Plasmodium falciparum
EMNTQGKKRK

SEQ ID NO: 3217870 - protein, 4 aa, Plasmodium falciparum
EMPE

SEQ ID NO: 3217871 - protein, 4 aa, Plasmodium falciparum
EMPS

SEQ ID NO: 3217872 - protein, 6 aa, Plasmodium falciparum
EMPTTT

SEQ ID NO: 3217873 - protein, 12 aa, Plasmodium falciparum
EMQRTNDAFKGG

SEQ ID NO: 3217874 - protein, 20 aa, Plasmodium falciparum
EMRNERNKKIYEKNSSINNN

SEQ ID NO: 3217875 - protein, 24 aa, Plasmodium falciparum
EMSENKCSRGYTDNIKKKQSMKGY

SEQ ID NO: 3217876 - protein, 5 aa, Plasmodium falciparum
EMTTL

SEQ ID NO: 3217877 - protein, 12 aa, Plasmodium falciparum
EMVSNNKNKKEH

SEQ ID NO: 3217878 - protein, 22 aa, Plasmodium falciparum
ENAENEFKKDNIQKTNHSGNIH

SEQ ID NO: 3217879 - protein, 5 aa, Plasmodium falciparum
ENAGV

SEQ ID NO: 3217880 - protein, 8 aa, Plasmodium falciparum
ENAHKNNV

SEQ ID NO: 3217881 - protein, 15 aa, Plasmodium falciparum
ENAKETGQKYENNDV

SEQ ID NO: 3217882 - protein, 9 aa, Plasmodium falciparum
ENAKSLEKE

SEQ ID NO: 3217883 - protein, 11 aa, Plasmodium falciparum
ENALSKRAAGI

SEQ ID NO: 3217884 - protein, 17 aa, Plasmodium falciparum
ENALSQRASEIAKNAAD

SEQ ID NO: 3217885 - protein, 4 aa, Plasmodium falciparum
ENAN

SEQ ID NO: 3217886 - protein, 8 aa, Plasmodium falciparum
ENANPNKL

SEQ ID NO: 3217887 - protein, 7 aa, Plasmodium falciparum
ENANSSL

SEQ ID NO: 3217888 - protein, 9 aa, Plasmodium falciparum
ENASEASVE

SEQ ID NO: 3217889 - protein, 7 aa, Plasmodium falciparum
ENAYEAQ

SEQ ID NO: 3217890 - protein, 6 aa, Plasmodium falciparum
ENAYKY

SEQ ID NO: 3217891 - protein, 15 aa, Plasmodium falciparum
ENCPNPESINSDHHP

SEQ ID NO: 3217892 - protein, 86 aa, Plasmodium falciparum
ENCQQQENTSGGRTGEPRPAATDPTASTGSGDDEDDDDDDDDEDDDDDDDDEDEEEAEAAEGDTEAENPEQGEEEEKGPSQEDPKV

SEQ ID NO: 3217893 - protein, 14 aa, Plasmodium falciparum
ENCRTDRNESLDTA

SEQ ID NO: 3217894 - protein, 12 aa, Plasmodium falciparum
ENCYSSDYNQDK

SEQ ID NO: 3217895 - protein, 39 aa, Plasmodium falciparum
ENDDDDDDDDDNNNNNNNIDERKKDLKKKQKNAITKGNE

SEQ ID NO: 3217896 - protein, 21 aa, Plasmodium falciparum
ENDDDNNNNNNNTYKEKKDSN

SEQ ID NO: 3217897 - protein, 11 aa, Plasmodium falciparum
ENDDEESTTSF

SEQ ID NO: 3217898 - protein, 15 aa, Plasmodium falciparum
ENDDFNKKKTRESYD

SEQ ID NO: 3217899 - protein, 36 aa, Plasmodium falciparum
ENDDGKKKRTRRRKTSDKSKTINKMTTGRRGRKSTS

SEQ ID NO: 3217900 - protein, 15 aa, Plasmodium falciparum
ENDDIGKKPNLYDED

SEQ ID NO: 3217901 - protein, 7 aa, Plasmodium falciparum
ENDDYND

SEQ ID NO: 3217902 - protein, 5 aa, Plasmodium falciparum
ENDED

SEQ ID NO: 3217903 - protein, 14 aa, Plasmodium falciparum
ENDEDEYKKNNNSI

SEQ ID NO: 3217904 - protein, 6 aa, Plasmodium falciparum
ENDEDI

SEQ ID NO: 3217905 - protein, 5 aa, Plasmodium falciparum
ENDEH

SEQ ID NO: 3217906 - protein, 7 aa, Plasmodium falciparum
ENDEKKH

SEQ ID NO: 3217907 - protein, 5 aa, Plasmodium falciparum
ENDEL

SEQ ID NO: 3217908 - protein, 9 aa, Plasmodium falciparum
ENDEMDNNY

SEQ ID NO: 3217909 - protein, 6 aa, Plasmodium falciparum
ENDEYN

SEQ ID NO: 3217910 - protein, 4 aa, Plasmodium falciparum
ENDF

SEQ ID NO: 3217911 - protein, 12 aa, Plasmodium falciparum
ENDGLQNSEMSN

SEQ ID NO: 3217912 - protein, 4 aa, Plasmodium falciparum
ENDH

SEQ ID NO: 3217913 - protein, 5 aa, Plasmodium falciparum
ENDHM

SEQ ID NO: 3217914 - protein, 7 aa, Plasmodium falciparum
ENDIENN

SEQ ID NO: 3217915 - protein, 7 aa, Plasmodium falciparum
ENDITSS

SEQ ID NO: 3217916 - protein, 12 aa, Plasmodium falciparum
ENDKDRKTIESG

SEQ ID NO: 3217917 - protein, 6 aa, Plasmodium falciparum
ENDKGK

SEQ ID NO: 3217918 - protein, 5 aa, Plasmodium falciparum
ENDKI

SEQ ID NO: 3217919 - protein, 20 aa, Plasmodium falciparum
ENDKKEKHEKEDEYEDNDES

SEQ ID NO: 3217920 - protein, 14 aa, Plasmodium falciparum
ENDKKGISDSKENN

SEQ ID NO: 3217921 - protein, 20 aa, Plasmodium falciparum
ENDKKGKNEKGKNCETQKNM

SEQ ID NO: 3217922 - protein, 11 aa, Plasmodium falciparum
ENDKKKNNKSK

SEQ ID NO: 3217923 - protein, 10 aa, Plasmodium falciparum
ENDKKRYNEY

SEQ ID NO: 3217924 - protein, 7 aa, Plasmodium falciparum
ENDKSKN

SEQ ID NO: 3217925 - protein, 7 aa, Plasmodium falciparum
ENDLNSV

SEQ ID NO: 3217926 - protein, 9 aa, Plasmodium falciparum
ENDLSSDED

SEQ ID NO: 3217927 - protein, 4 aa, Plasmodium falciparum
ENDN

SEQ ID NO: 3217928 - protein, 9 aa, Plasmodium falciparum
ENDNEDMSH

SEQ ID NO: 3217929 - protein, 9 aa, Plasmodium falciparum
ENDNEHRTR

SEQ ID NO: 3217930 - protein, 7 aa, Plasmodium falciparum
ENDNHND

SEQ ID NO: 3217931 - protein, 5 aa, Plasmodium falciparum
ENDNK

SEQ ID NO: 3217932 - protein, 7 aa, Plasmodium falciparum
ENDNQIS

SEQ ID NO: 3217933 - protein, 8 aa, Plasmodium falciparum
ENDNSSFT

SEQ ID NO: 3217934 - protein, 9 aa, Plasmodium falciparum
ENDNSSNCE

SEQ ID NO: 3217935 - protein, 8 aa, Plasmodium falciparum
ENDQLEND

SEQ ID NO: 3217936 - protein, 13 aa, Plasmodium falciparum
ENDQLENDQLEND

SEQ ID NO: 3217937 - protein, 18 aa, Plasmodium falciparum
ENDQLENDQLENDQLEND

SEQ ID NO: 3217938 - protein, 41 aa, Plasmodium falciparum
ENDQQHNNSNNNNNNSNNNNNNNNNNNNNNNNNNNNNNNNN

SEQ ID NO: 3217939 - protein, 101 aa, Plasmodium falciparum
ENDSDNKSVSDTDEETDEETDEETDEETDEETDEETDEETDEETDEETDEETDEETDEETDEQNDEKRNKNVEDNNNNNTNTSNEEEKKNISPKKSENTQL

SEQ ID NO: 3217940 - protein, 22 aa, Plasmodium falciparum
ENDSFTDDANIREKKKRNTLTY

SEQ ID NO: 3217941 - protein, 6 aa, Plasmodium falciparum
ENDSLS

SEQ ID NO: 3217942 - protein, 6 aa, Plasmodium falciparum
ENDSST

SEQ ID NO: 3217943 - protein, 5 aa, Plasmodium falciparum
ENDSV

SEQ ID NO: 3217944 - protein, 7 aa, Plasmodium falciparum
ENDTKNE

SEQ ID NO: 3217945 - protein, 10 aa, Plasmodium falciparum
ENDTNPNYNE

SEQ ID NO: 3217946 - protein, 7 aa, Plasmodium falciparum
ENDTSHD

SEQ ID NO: 3217947 - protein, 11 aa, Plasmodium falciparum
ENDTSSNQLNN

SEQ ID NO: 3217948 - protein, 5 aa, Plasmodium falciparum
ENDTY

SEQ ID NO: 3217949 - protein, 6 aa, Plasmodium falciparum
ENDYIK

SEQ ID NO: 3217950 - protein, 7 aa, Plasmodium falciparum
ENDYSEL

SEQ ID NO: 3217951 - protein, 14 aa, Plasmodium falciparum
ENDYSKDSSHSNIN

SEQ ID NO: 3217952 - protein, 5 aa, Plasmodium falciparum
ENEAM

SEQ ID NO: 3217953 - protein, 10 aa, Plasmodium falciparum
ENECKGINEQ

SEQ ID NO: 3217954 - protein, 26 aa, Plasmodium falciparum
ENECKNIDGKGGKIDFNNTDNKTFSH

SEQ ID NO: 3217955 - protein, 12 aa, Plasmodium falciparum
ENECTSNDIEED

SEQ ID NO: 3217956 - protein, 8 aa, Plasmodium falciparum
ENEDESSI

SEQ ID NO: 3217957 - protein, 16 aa, Plasmodium falciparum
ENEDMNDKLQDNSNDG

SEQ ID NO: 3217958 - protein, 6 aa, Plasmodium falciparum
ENEDMS

SEQ ID NO: 3217959 - protein, 8 aa, Plasmodium falciparum
ENEDNRIS

SEQ ID NO: 3217960 - protein, 40 aa, Plasmodium falciparum
ENEEDIERKNKINDNNNNNINCDNTKNNVDDEDVKTNDKV

SEQ ID NO: 3217961 - protein, 6 aa, Plasmodium falciparum
ENEEKD

SEQ ID NO: 3217962 - protein, 8 aa, Plasmodium falciparum
ENEEKEDA

SEQ ID NO: 3217963 - protein, 12 aa, Plasmodium falciparum
ENEEKEERHREE

SEQ ID NO: 3217964 - protein, 21 aa, Plasmodium falciparum
ENEEKKKNKELEKLNNEKEKI

SEQ ID NO: 3217965 - protein, 13 aa, Plasmodium falciparum
ENEEKKNIKRDKS

SEQ ID NO: 3217966 - protein, 20 aa, Plasmodium falciparum
ENEEKNQNNESSTNKGITGN

SEQ ID NO: 3217967 - protein, 6 aa, Plasmodium falciparum
ENEEKV

SEQ ID NO: 3217968 - protein, 5 aa, Plasmodium falciparum
ENEEL

SEQ ID NO: 3217969 - protein, 6 aa, Plasmodium falciparum
ENEENR

SEQ ID NO: 3217970 - protein, 7 aa, Plasmodium falciparum
ENEESNA

SEQ ID NO: 3217971 - protein, 8 aa, Plasmodium falciparum
ENEGDKNK

SEQ ID NO: 3217972 - protein, 6 aa, Plasmodium falciparum
ENEGKR

SEQ ID NO: 3217973 - protein, 11 aa, Plasmodium falciparum
ENEGNSEKEET

SEQ ID NO: 3217974 - protein, 14 aa, Plasmodium falciparum
ENEGSATEFEETES

SEQ ID NO: 3217975 - protein, 4 aa, Plasmodium falciparum
ENEH

SEQ ID NO: 3217976 - protein, 7 aa, Plasmodium falciparum
ENEIKGN

SEQ ID NO: 3217977 - protein, 5 aa, Plasmodium falciparum
ENEIN

SEQ ID NO: 3217978 - protein, 15 aa, Plasmodium falciparum
ENEKARQNENTNKGQ

SEQ ID NO: 3217979 - protein, 7 aa, Plasmodium falciparum
ENEKEAT

SEQ ID NO: 3217980 - protein, 9 aa, Plasmodium falciparum
ENEKEKFDD

SEQ ID NO: 3217981 - protein, 10 aa, Plasmodium falciparum
ENEKENDIDK

SEQ ID NO: 3217982 - protein, 12 aa, Plasmodium falciparum
ENEKENEKNIRK

SEQ ID NO: 3217983 - protein, 11 aa, Plasmodium falciparum
ENEKKEKEKEI

SEQ ID NO: 3217984 - protein, 10 aa, Plasmodium falciparum
ENEKKENDKL

SEQ ID NO: 3217985 - protein, 11 aa, Plasmodium falciparum
ENEKKKNEKEL

SEQ ID NO: 3217986 - protein, 7 aa, Plasmodium falciparum
ENEKLKN

SEQ ID NO: 3217987 - protein, 9 aa, Plasmodium falciparum
ENEKLNKNK

SEQ ID NO: 3217988 - protein, 9 aa, Plasmodium falciparum
ENEKNQPHS

SEQ ID NO: 3217989 - protein, 22 aa, Plasmodium falciparum
ENEKNSIQGNNMETKQKGNYNK

SEQ ID NO: 3217990 - protein, 9 aa, Plasmodium falciparum
ENEKREDKN

SEQ ID NO: 3217991 - protein, 23 aa, Plasmodium falciparum
ENEKSSVGHVPTEYTSKENIAEE

SEQ ID NO: 3217992 - protein, 7 aa, Plasmodium falciparum
ENEKTKK

SEQ ID NO: 3217993 - protein, 9 aa, Plasmodium falciparum
ENEKTKNKI

SEQ ID NO: 3217994 - protein, 10 aa, Plasmodium falciparum
ENELKSYETE

SEQ ID NO: 3217995 - protein, 6 aa, Plasmodium falciparum
ENELKT

SEQ ID NO: 3217996 - protein, 14 aa, Plasmodium falciparum
ENELNEKPNVAGRI

SEQ ID NO: 3217997 - protein, 26 aa, Plasmodium falciparum
ENELNKQKKKYNNENNYNNIQSSGNV

SEQ ID NO: 3217998 - protein, 4 aa, Plasmodium falciparum
ENEM

SEQ ID NO: 3217999 - protein, 10 aa, Plasmodium falciparum
ENEMSSKSNA

SEQ ID NO: 3218000 - protein, 4 aa, Plasmodium falciparum
ENEN

SEQ ID NO: 3218001 - protein, 13 aa, Plasmodium falciparum
ENENDTKNEESKM

SEQ ID NO: 3218002 - protein, 7 aa, Plasmodium falciparum
ENENDVD

SEQ ID NO: 3218003 - protein, 8 aa, Plasmodium falciparum
ENENEEDD

SEQ ID NO: 3218004 - protein, 19 aa, Plasmodium falciparum
ENENNDEKKKENDDEPPPT

SEQ ID NO: 3218005 - protein, 8 aa, Plasmodium falciparum
ENENQVEA

SEQ ID NO: 3218006 - protein, 16 aa, Plasmodium falciparum
ENENQVENQKVGNKAP

SEQ ID NO: 3218007 - protein, 9 aa, Plasmodium falciparum
ENENTHEKK

SEQ ID NO: 3218008 - protein, 5 aa, Plasmodium falciparum
ENENY

SEQ ID NO: 3218009 - protein, 9 aa, Plasmodium falciparum
ENEQEENYS

SEQ ID NO: 3218010 - protein, 25 aa, Plasmodium falciparum
ENEQSDSFKKNEKNNMQPVGENTKN

SEQ ID NO: 3218011 - protein, 5 aa, Plasmodium falciparum
ENEQV

SEQ ID NO: 3218012 - protein, 7 aa, Plasmodium falciparum
ENEQVKE

SEQ ID NO: 3218013 - protein, 15 aa, Plasmodium falciparum
ENERIPPASEDPSYK

SEQ ID NO: 3218014 - protein, 8 aa, Plasmodium falciparum
ENERKNRK

SEQ ID NO: 3218015 - protein, 6 aa, Plasmodium falciparum
ENERKS

SEQ ID NO: 3218016 - protein, 11 aa, Plasmodium falciparum
ENERKSNYEHN

SEQ ID NO: 3218017 - protein, 10 aa, Plasmodium falciparum
ENERNCDRQE

SEQ ID NO: 3218018 - protein, 7 aa, Plasmodium falciparum
ENERNHM

SEQ ID NO: 3218019 - protein, 4 aa, Plasmodium falciparum
ENES

SEQ ID NO: 3218020 - protein, 7 aa, Plasmodium falciparum
ENESDPR

SEQ ID NO: 3218021 - protein, 5 aa, Plasmodium falciparum
ENESF

SEQ ID NO: 3218022 - protein, 8 aa, Plasmodium falciparum
ENESGKEE

SEQ ID NO: 3218023 - protein, 5 aa, Plasmodium falciparum
ENESH

SEQ ID NO: 3218024 - protein, 102 aa, Plasmodium falciparum
ENESIANYSEEKKVEKNNKNDNKNDNKNDNKNDNKNDNKNDKHNKHNKHNKHHSNHHGKHNNKHHNKHHNKHHNKHHNKHHSKHHSKHHNKHHNKQPEQKTS

SEQ ID NO: 3218025 - protein, 5 aa, Plasmodium falciparum
ENESL

SEQ ID NO: 3218026 - protein, 9 aa, Plasmodium falciparum
ENESNGDEY

SEQ ID NO: 3218027 - protein, 7 aa, Plasmodium falciparum
ENESNVE

SEQ ID NO: 3218028 - protein, 14 aa, Plasmodium falciparum
ENESSGNRKLSSGM

SEQ ID NO: 3218029 - protein, 4 aa, Plasmodium falciparum
ENET

SEQ ID NO: 3218030 - protein, 4 aa, Plasmodium falciparum
ENEV

SEQ ID NO: 3218031 - protein, 6 aa, Plasmodium falciparum
ENEYKN

SEQ ID NO: 3218032 - protein, 6 aa, Plasmodium falciparum
ENEYNK

SEQ ID NO: 3218033 - protein, 4 aa, Plasmodium falciparum
ENFD

SEQ ID NO: 3218034 - protein, 6 aa, Plasmodium falciparum
ENFDKT

SEQ ID NO: 3218035 - protein, 11 aa, Plasmodium falciparum
ENFDRQASQRF

SEQ ID NO: 3218036 - protein, 12 aa, Plasmodium falciparum
ENFDRQSSRRFE

SEQ ID NO: 3218037 - protein, 12 aa, Plasmodium falciparum
ENFDRQTSERFE

SEQ ID NO: 3218038 - protein, 14 aa, Plasmodium falciparum
ENFDRQTSKRFDEY

SEQ ID NO: 3218039 - protein, 11 aa, Plasmodium falciparum
ENFDRQTSQRL

SEQ ID NO: 3218040 - protein, 11 aa, Plasmodium falciparum
ENFDRRTSQRF

SEQ ID NO: 3218041 - protein, 12 aa, Plasmodium falciparum
ENFEENNNREEN

SEQ ID NO: 3218042 - protein, 17 aa, Plasmodium falciparum
ENFENNNSNSNSNSNNY

SEQ ID NO: 3218043 - protein, 11 aa, Plasmodium falciparum
ENFERQTSQRF

SEQ ID NO: 3218044 - protein, 11 aa, Plasmodium falciparum
ENFERQTSRRF

SEQ ID NO: 3218045 - protein, 10 aa, Plasmodium falciparum
ENFERQTTQR

SEQ ID NO: 3218046 - protein, 7 aa, Plasmodium falciparum
ENFGNTN

SEQ ID NO: 3218047 - protein, 56 aa, Plasmodium falciparum
ENFKNTKENKNETTNEKTNETTNEKTNETTNETTNEKTNENTNETTNETTNENTND

SEQ ID NO: 3218048 - protein, 9 aa, Plasmodium falciparum
ENFNPENDL

SEQ ID NO: 3218049 - protein, 11 aa, Plasmodium falciparum
ENFPSSEKSEY

SEQ ID NO: 3218050 - protein, 6 aa, Plasmodium falciparum
ENFQKN

SEQ ID NO: 3218051 - protein, 5 aa, Plasmodium falciparum
ENFQN

SEQ ID NO: 3218052 - protein, 18 aa, Plasmodium falciparum
ENGARGTDGKTTLKRNDD

SEQ ID NO: 3218053 - protein, 9 aa, Plasmodium falciparum
ENGATNEPI

SEQ ID NO: 3218054 - protein, 9 aa, Plasmodium falciparum
ENGCGKNGC

SEQ ID NO: 3218055 - protein, 11 aa, Plasmodium falciparum
ENGDPFNENSQ

SEQ ID NO: 3218056 - protein, 22 aa, Plasmodium falciparum
ENGDSTINTSTRNTSSTHDESH

SEQ ID NO: 3218057 - protein, 7 aa, Plasmodium falciparum
ENGEAQN

SEQ ID NO: 3218058 - protein, 6 aa, Plasmodium falciparum
ENGENK

SEQ ID NO: 3218059 - protein, 32 aa, Plasmodium falciparum
ENGENKNFEENIEEDKISDKTQKSKISHENAE

SEQ ID NO: 3218060 - protein, 7 aa, Plasmodium falciparum
ENGFNDD

SEQ ID NO: 3218061 - protein, 8 aa, Plasmodium falciparum
ENGGNSTT

SEQ ID NO: 3218062 - protein, 4 aa, Plasmodium falciparum
ENGI

SEQ ID NO: 3218063 - protein, 11 aa, Plasmodium falciparum
ENGIDKPEVDT

SEQ ID NO: 3218064 - protein, 4 aa, Plasmodium falciparum
ENGK

SEQ ID NO: 3218065 - protein, 7 aa, Plasmodium falciparum
ENGKEKK

SEQ ID NO: 3218066 - protein, 10 aa, Plasmodium falciparum
ENGKGKEQKC

SEQ ID NO: 3218067 - protein, 10 aa, Plasmodium falciparum
ENGKKKERKN

SEQ ID NO: 3218068 - protein, 11 aa, Plasmodium falciparum
ENGKKPLKTKY

SEQ ID NO: 3218069 - protein, 9 aa, Plasmodium falciparum
ENGKYGEES

SEQ ID NO: 3218070 - protein, 5 aa, Plasmodium falciparum
ENGLN

SEQ ID NO: 3218071 - protein, 7 aa, Plasmodium falciparum
ENGNESA

SEQ ID NO: 3218072 - protein, 10 aa, Plasmodium falciparum
ENGNNEKRQN

SEQ ID NO: 3218073 - protein, 16 aa, Plasmodium falciparum
ENGNNIKKKKKKSGKK

SEQ ID NO: 3218074 - protein, 13 aa, Plasmodium falciparum
ENGNSLSNNSSNS

SEQ ID NO: 3218075 - protein, 8 aa, Plasmodium falciparum
ENGQKNGW

SEQ ID NO: 3218076 - protein, 5 aa, Plasmodium falciparum
ENGRT

SEQ ID NO: 3218077 - protein, 8 aa, Plasmodium falciparum
ENGSGKST

SEQ ID NO: 3218078 - protein, 8 aa, Plasmodium falciparum
ENGSMETT

SEQ ID NO: 3218079 - protein, 5 aa, Plasmodium falciparum
ENGST

SEQ ID NO: 3218080 - protein, 7 aa, Plasmodium falciparum
ENGSVTE

SEQ ID NO: 3218081 - protein, 16 aa, Plasmodium falciparum
ENGSVTEGVDETGSVT

SEQ ID NO: 3218082 - protein, 12 aa, Plasmodium falciparum
ENGTKSEDKQKF

SEQ ID NO: 3218083 - protein, 21 aa, Plasmodium falciparum
ENGTSNIKGTHTNISSDDKKL

SEQ ID NO: 3218084 - protein, 14 aa, Plasmodium falciparum
ENHMNKEKTETPRN

SEQ ID NO: 3218085 - protein, 8 aa, Plasmodium falciparum
ENHNKNNI

SEQ ID NO: 3218086 - protein, 6 aa, Plasmodium falciparum
ENHNSK

SEQ ID NO: 3218087 - protein, 9 aa, Plasmodium falciparum
ENHNSTDQI

SEQ ID NO: 3218088 - protein, 18 aa, Plasmodium falciparum
ENHNTPSSPNLKKRASNY

SEQ ID NO: 3218089 - protein, 8 aa, Plasmodium falciparum
ENHNTSNY

SEQ ID NO: 3218090 - protein, 13 aa, Plasmodium falciparum
ENIDDINKEKKND

SEQ ID NO: 3218091 - protein, 15 aa, Plasmodium falciparum
ENIEENAEENVEENI

SEQ ID NO: 3218092 - protein, 8 aa, Plasmodium falciparum
ENIEHEKK

SEQ ID NO: 3218093 - protein, 8 aa, Plasmodium falciparum
ENIEKDKY

SEQ ID NO: 3218094 - protein, 6 aa, Plasmodium falciparum
ENIEKE

SEQ ID NO: 3218095 - protein, 12 aa, Plasmodium falciparum
ENIHTKKESTIS

SEQ ID NO: 3218096 - protein, 39 aa, Plasmodium falciparum
ENIKERKDDNEDDNEDDNDNNDNNNNNNNNNNNNNNNMK

SEQ ID NO: 3218097 - protein, 35 aa, Plasmodium falciparum
ENIKKKKKNEQQKNEENKVEEKHNKENKIEEEHNK

SEQ ID NO: 3218098 - protein, 6 aa, Plasmodium falciparum
ENIKKQ

SEQ ID NO: 3218099 - protein, 5 aa, Plasmodium falciparum
ENIKN

SEQ ID NO: 3218100 - protein, 13 aa, Plasmodium falciparum
ENIKSEPNNENNL

SEQ ID NO: 3218101 - protein, 9 aa, Plasmodium falciparum
ENINDNKTN

SEQ ID NO: 3218102 - protein, 7 aa, Plasmodium falciparum
ENINEED

SEQ ID NO: 3218103 - protein, 6 aa, Plasmodium falciparum
ENINGE

SEQ ID NO: 3218104 - protein, 11 aa, Plasmodium falciparum
ENINKNDEKDY

SEQ ID NO: 3218105 - protein, 31 aa, Plasmodium falciparum
ENINKNKKRDTSKNKSKQTSKTKKKKNIPGE

SEQ ID NO: 3218106 - protein, 12 aa, Plasmodium falciparum
ENINKQKDLKKK

SEQ ID NO: 3218107 - protein, 12 aa, Plasmodium falciparum
ENINNNKSNVNK

SEQ ID NO: 3218108 - protein, 16 aa, Plasmodium falciparum
ENINNNNNNNNNNNDN

SEQ ID NO: 3218109 - protein, 5 aa, Plasmodium falciparum
ENINT

SEQ ID NO: 3218110 - protein, 5 aa, Plasmodium falciparum
ENIPE

SEQ ID NO: 3218111 - protein, 13 aa, Plasmodium falciparum
ENIPNADDIQNDI

SEQ ID NO: 3218112 - protein, 6 aa, Plasmodium falciparum
ENIPNE

SEQ ID NO: 3218113 - protein, 15 aa, Plasmodium falciparum
ENIPSKDNNNNNNNN

SEQ ID NO: 3218114 - protein, 14 aa, Plasmodium falciparum
ENIPSNNKQKDTTK

SEQ ID NO: 3218115 - protein, 4 aa, Plasmodium falciparum
ENIQ

SEQ ID NO: 3218116 - protein, 16 aa, Plasmodium falciparum
ENIQENKKYEEGGVTE

SEQ ID NO: 3218117 - protein, 16 aa, Plasmodium falciparum
ENIQENNNDTNNEFNK

SEQ ID NO: 3218118 - protein, 5 aa, Plasmodium falciparum
ENIQH

SEQ ID NO: 3218119 - protein, 12 aa, Plasmodium falciparum
ENIQNKRDGNGN

SEQ ID NO: 3218120 - protein, 16 aa, Plasmodium falciparum
ENIRGTEKKEQDHNKP

SEQ ID NO: 3218121 - protein, 24 aa, Plasmodium falciparum
ENIRKNTKTENLKNGNEGKGAGLE

SEQ ID NO: 3218122 - protein, 4 aa, Plasmodium falciparum
ENIS

SEQ ID NO: 3218123 - protein, 64 aa, Plasmodium falciparum
ENISDDQNISDENISDDQNISDDQNISDENISDDQNISDENISDDQNISDENISDENISNDDNM

SEQ ID NO: 3218124 - protein, 26 aa, Plasmodium falciparum
ENISKKKKNKKTNKNREEEKKKKNEI

SEQ ID NO: 3218125 - protein, 13 aa, Plasmodium falciparum
ENISNKGRNESSI

SEQ ID NO: 3218126 - protein, 18 aa, Plasmodium falciparum
ENISQENDEKKRSIGKKT

SEQ ID NO: 3218127 - protein, 12 aa, Plasmodium falciparum
ENISSKKKKNKF

SEQ ID NO: 3218128 - protein, 4 aa, Plasmodium falciparum
ENIT

SEQ ID NO: 3218129 - protein, 7 aa, Plasmodium falciparum
ENITEDK

SEQ ID NO: 3218130 - protein, 12 aa, Plasmodium falciparum
ENITKEKNNVNE

SEQ ID NO: 3218131 - protein, 51 aa, Plasmodium falciparum
ENITSDNDIRNNENTEDDKYNDLENVEKKDVETLSKKEEGKTTKKKKKLKK

SEQ ID NO: 3218132 - protein, 4 aa, Plasmodium falciparum
ENIY

SEQ ID NO: 3218133 - protein, 19 aa, Plasmodium falciparum
ENIYNKSDKINNNKESNNI

SEQ ID NO: 3218134 - protein, 4 aa, Plasmodium falciparum
ENKA

SEQ ID NO: 3218135 - protein, 11 aa, Plasmodium falciparum
ENKDDNKFTEA

SEQ ID NO: 3218136 - protein, 19 aa, Plasmodium falciparum
ENKDEEEDEEENVQKVKDA

SEQ ID NO: 3218137 - protein, 5 aa, Plasmodium falciparum
ENKDL

SEQ ID NO: 3218138 - protein, 10 aa, Plasmodium falciparum
ENKDLEKGKL

SEQ ID NO: 3218139 - protein, 15 aa, Plasmodium falciparum
ENKDNNIEKSSPYKR

SEQ ID NO: 3218140 - protein, 8 aa, Plasmodium falciparum
ENKDNSVD

SEQ ID NO: 3218141 - protein, 43 aa, Plasmodium falciparum
ENKEDERKEHKNDNNDNNDNNNDNNNDNNNNHNNSHNKGNEKR

SEQ ID NO: 3218142 - protein, 25 aa, Plasmodium falciparum
ENKEGSVEENMEGNMEGNMEGNMEE

SEQ ID NO: 3218143 - protein, 52 aa, Plasmodium falciparum
ENKEKEQNEKNGKKNEKNEISEKNEKNEKNEKNEKNEKNEKNEINKKDECHN

SEQ ID NO: 3218144 - protein, 9 aa, Plasmodium falciparum
ENKEKQHGN

SEQ ID NO: 3218145 - protein, 6 aa, Plasmodium falciparum
ENKEKS

SEQ ID NO: 3218146 - protein, 9 aa, Plasmodium falciparum
ENKEKSTIS

SEQ ID NO: 3218147 - protein, 9 aa, Plasmodium falciparum
ENKEKYEKI

SEQ ID NO: 3218148 - protein, 8 aa, Plasmodium falciparum
ENKEQNNY

SEQ ID NO: 3218149 - protein, 12 aa, Plasmodium falciparum
ENKEREFDQNNT

SEQ ID NO: 3218150 - protein, 16 aa, Plasmodium falciparum
ENKETEQTEEGNTEEF

SEQ ID NO: 3218151 - protein, 7 aa, Plasmodium falciparum
ENKETNE

SEQ ID NO: 3218152 - protein, 9 aa, Plasmodium falciparum
ENKETRKNK

SEQ ID NO: 3218153 - protein, 7 aa, Plasmodium falciparum
ENKEVYG

SEQ ID NO: 3218154 - protein, 4 aa, Plasmodium falciparum
ENKF

SEQ ID NO: 3218155 - protein, 5 aa, Plasmodium falciparum
ENKFH

SEQ ID NO: 3218156 - protein, 16 aa, Plasmodium falciparum
ENKGKNCIKDTPECND

SEQ ID NO: 3218157 - protein, 9 aa, Plasmodium falciparum
ENKGTDEIN

SEQ ID NO: 3218158 - protein, 9 aa, Plasmodium falciparum
ENKHDDNIK

SEQ ID NO: 3218159 - protein, 8 aa, Plasmodium falciparum
ENKHKQNY

SEQ ID NO: 3218160 - protein, 4 aa, Plasmodium falciparum
ENKI

SEQ ID NO: 3218161 - protein, 5 aa, Plasmodium falciparum
ENKIC

SEQ ID NO: 3218162 - protein, 14 aa, Plasmodium falciparum
ENKIEANDENITNS

SEQ ID NO: 3218163 - protein, 30 aa, Plasmodium falciparum
ENKIEEEKNVSSSTKYDVNNKNNKNNDNSE

SEQ ID NO: 3218164 - protein, 7 aa, Plasmodium falciparum
ENKIKKK

SEQ ID NO: 3218165 - protein, 19 aa, Plasmodium falciparum
ENKISNDNNNNNYNLNEQE

SEQ ID NO: 3218166 - protein, 13 aa, Plasmodium falciparum
ENKITKKQNKNDH

SEQ ID NO: 3218167 - protein, 5 aa, Plasmodium falciparum
ENKKD

SEQ ID NO: 3218168 - protein, 8 aa, Plasmodium falciparum
ENKKDTYD

SEQ ID NO: 3218169 - protein, 14 aa, Plasmodium falciparum
ENKKGKEKQKDKTK

SEQ ID NO: 3218170 - protein, 15 aa, Plasmodium falciparum
ENKKGKENKSTYESI

SEQ ID NO: 3218171 - protein, 5 aa, Plasmodium falciparum
ENKKK

SEQ ID NO: 3218172 - protein, 9 aa, Plasmodium falciparum
ENKKKEMAK

SEQ ID NO: 3218173 - protein, 9 aa, Plasmodium falciparum
ENKKKNVSN

SEQ ID NO: 3218174 - protein, 9 aa, Plasmodium falciparum
ENKKNERSN

SEQ ID NO: 3218175 - protein, 34 aa, Plasmodium falciparum
ENKKNIELSSHDNNSFDNEKRKTSLGMTKSKGYN

SEQ ID NO: 3218176 - protein, 9 aa, Plasmodium falciparum
ENKKNQEMQ

SEQ ID NO: 3218177 - protein, 5 aa, Plasmodium falciparum
ENKKR

SEQ ID NO: 3218178 - protein, 6 aa, Plasmodium falciparum
ENKKRN

SEQ ID NO: 3218179 - protein, 10 aa, Plasmodium falciparum
ENKKTEPAVD

SEQ ID NO: 3218180 - protein, 9 aa, Plasmodium falciparum
ENKKTNTNI

SEQ ID NO: 3218181 - protein, 12 aa, Plasmodium falciparum
ENKKTRGRSSSY

SEQ ID NO: 3218182 - protein, 10 aa, Plasmodium falciparum
ENKKVKSEYD

SEQ ID NO: 3218183 - protein, 5 aa, Plasmodium falciparum
ENKLK

SEQ ID NO: 3218184 - protein, 6 aa, Plasmodium falciparum
ENKLKK

SEQ ID NO: 3218185 - protein, 7 aa, Plasmodium falciparum
ENKMKGE

SEQ ID NO: 3218186 - protein, 9 aa, Plasmodium falciparum
ENKNAENEL

SEQ ID NO: 3218187 - protein, 16 aa, Plasmodium falciparum
ENKNCNNTDDHYEDTI

SEQ ID NO: 3218188 - protein, 7 aa, Plasmodium falciparum
ENKNDAK

SEQ ID NO: 3218189 - protein, 11 aa, Plasmodium falciparum
ENKNDNDNNMT

SEQ ID NO: 3218190 - protein, 9 aa, Plasmodium falciparum
ENKNDQTYK

SEQ ID NO: 3218191 - protein, 6 aa, Plasmodium falciparum
ENKNEE

SEQ ID NO: 3218192 - protein, 8 aa, Plasmodium falciparum
ENKNEKIN

SEQ ID NO: 3218193 - protein, 6 aa, Plasmodium falciparum
ENKNEN

SEQ ID NO: 3218194 - protein, 7 aa, Plasmodium falciparum
ENKNESL

SEQ ID NO: 3218195 - protein, 10 aa, Plasmodium falciparum
ENKNGTSHNY

SEQ ID NO: 3218196 - protein, 6 aa, Plasmodium falciparum
ENKNIL

SEQ ID NO: 3218197 - protein, 8 aa, Plasmodium falciparum
ENKNIQDM

SEQ ID NO: 3218198 - protein, 5 aa, Plasmodium falciparum
ENKNK

SEQ ID NO: 3218199 - protein, 19 aa, Plasmodium falciparum
ENKNKDDNRIDNNKGNFHT

SEQ ID NO: 3218200 - protein, 8 aa, Plasmodium falciparum
ENKNKDQI

SEQ ID NO: 3218201 - protein, 23 aa, Plasmodium falciparum
ENKNKNDKIKDDNYGNNDKRCGK

SEQ ID NO: 3218202 - protein, 16 aa, Plasmodium falciparum
ENKNLQGKELKPSRTV

SEQ ID NO: 3218203 - protein, 17 aa, Plasmodium falciparum
ENKNNIKIEDDAKNQIN

SEQ ID NO: 3218204 - protein, 9 aa, Plasmodium falciparum
ENKNNISQE

SEQ ID NO: 3218205 - protein, 25 aa, Plasmodium falciparum
ENKNNNNKNNNNNNNNNISKEEHVQ

SEQ ID NO: 3218206 - protein, 12 aa, Plasmodium falciparum
ENKNNNSNNNNN

SEQ ID NO: 3218207 - protein, 7 aa, Plasmodium falciparum
ENKNNQD

SEQ ID NO: 3218208 - protein, 51 aa, Plasmodium falciparum
ENKNRKKSKWNQSDKKIKDNEKKREKKKKKNQKKKYNISGAKKKRMTRQKR

SEQ ID NO: 3218209 - protein, 31 aa, Plasmodium falciparum
ENKNSMENKNSMENKNSMENKNNIENKNNIN

SEQ ID NO: 3218210 - protein, 5 aa, Plasmodium falciparum
ENKNT

SEQ ID NO: 3218211 - protein, 8 aa, Plasmodium falciparum
ENKNTYPK

SEQ ID NO: 3218212 - protein, 8 aa, Plasmodium falciparum
ENKNVEDN

SEQ ID NO: 3218213 - protein, 16 aa, Plasmodium falciparum
ENKNVEDNKDVEDNID

SEQ ID NO: 3218214 - protein, 17 aa, Plasmodium falciparum
ENKNYNNSNDNYNSNNN

SEQ ID NO: 3218215 - protein, 32 aa, Plasmodium falciparum
ENKPDDNQINNVQKKKKKKKRRKKKKKSVLNN

SEQ ID NO: 3218216 - protein, 5 aa, Plasmodium falciparum
ENKPK

SEQ ID NO: 3218217 - protein, 7 aa, Plasmodium falciparum
ENKPSNN

SEQ ID NO: 3218218 - protein, 8 aa, Plasmodium falciparum
ENKQEMEN

SEQ ID NO: 3218219 - protein, 5 aa, Plasmodium falciparum
ENKQI

SEQ ID NO: 3218220 - protein, 7 aa, Plasmodium falciparum
ENKQNEE

SEQ ID NO: 3218221 - protein, 10 aa, Plasmodium falciparum
ENKQNNAKDI

SEQ ID NO: 3218222 - protein, 11 aa, Plasmodium falciparum
ENKQSDDKIKN

SEQ ID NO: 3218223 - protein, 4 aa, Plasmodium falciparum
ENKR

SEQ ID NO: 3218224 - protein, 5 aa, Plasmodium falciparum
ENKRG

SEQ ID NO: 3218225 - protein, 9 aa, Plasmodium falciparum
ENKRKSDNI

SEQ ID NO: 3218226 - protein, 7 aa, Plasmodium falciparum
ENKRKVK

SEQ ID NO: 3218227 - protein, 25 aa, Plasmodium falciparum
ENKRNKNNNCNNNNIKKKKKNYNNE

SEQ ID NO: 3218228 - protein, 11 aa, Plasmodium falciparum
ENKRTNKMGRS

SEQ ID NO: 3218229 - protein, 19 aa, Plasmodium falciparum
ENKSDEKQNKDIKVEDIKN

SEQ ID NO: 3218230 - protein, 15 aa, Plasmodium falciparum
ENKSDSSYETEENVN

SEQ ID NO: 3218231 - protein, 5 aa, Plasmodium falciparum
ENKSE

SEQ ID NO: 3218232 - protein, 9 aa, Plasmodium falciparum
ENKSKGRVQ

SEQ ID NO: 3218233 - protein, 7 aa, Plasmodium falciparum
ENKSKSI

SEQ ID NO: 3218234 - protein, 4 aa, Plasmodium falciparum
ENKT

SEQ ID NO: 3218235 - protein, 24 aa, Plasmodium falciparum
ENKTDDKKPNIANKKSIQKRTNKR

SEQ ID NO: 3218236 - protein, 6 aa, Plasmodium falciparum
ENKTDK

SEQ ID NO: 3218237 - protein, 43 aa, Plasmodium falciparum
ENKTNTNNNHNNNNNNNHNHNNHNNNHNNHNNNNNNKYTKDNH

SEQ ID NO: 3218238 - protein, 8 aa, Plasmodium falciparum
ENKTNYNN

SEQ ID NO: 3218239 - protein, 8 aa, Plasmodium falciparum
ENKTTIQN

SEQ ID NO: 3218240 - protein, 15 aa, Plasmodium falciparum
ENKYKSDKEYTNKNK

SEQ ID NO: 3218241 - protein, 15 aa, Plasmodium falciparum
ENKYSNIENKTETRN

SEQ ID NO: 3218242 - protein, 4 aa, Plasmodium falciparum
ENLD

SEQ ID NO: 3218243 - protein, 24 aa, Plasmodium falciparum
ENLENTKKKNNNNIYNNNNNNSNI

SEQ ID NO: 3218244 - protein, 4 aa, Plasmodium falciparum
ENLG

SEQ ID NO: 3218245 - protein, 4 aa, Plasmodium falciparum
ENLI

SEQ ID NO: 3218246 - protein, 4 aa, Plasmodium falciparum
ENLK

SEQ ID NO: 3218247 - protein, 9 aa, Plasmodium falciparum
ENLKGRDRN

SEQ ID NO: 3218248 - protein, 6 aa, Plasmodium falciparum
ENLKNK

SEQ ID NO: 3218249 - protein, 4 aa, Plasmodium falciparum
ENLN

SEQ ID NO: 3218250 - protein, 7 aa, Plasmodium falciparum
ENLNDEQ

SEQ ID NO: 3218251 - protein, 5 aa, Plasmodium falciparum
ENLNE

SEQ ID NO: 3218252 - protein, 25 aa, Plasmodium falciparum
ENLNEQEAEEEAEEEAEEEEEEEDK

SEQ ID NO: 3218253 - protein, 29 aa, Plasmodium falciparum
ENLNKENLNKENLNEENLNKEKLNEENLN

SEQ ID NO: 3218254 - protein, 23 aa, Plasmodium falciparum
ENLNTQGNEIKKHNNHNDNQTIS

SEQ ID NO: 3218255 - protein, 5 aa, Plasmodium falciparum
ENLPE

SEQ ID NO: 3218256 - protein, 12 aa, Plasmodium falciparum
ENLQDKQKRNHG

SEQ ID NO: 3218257 - protein, 5 aa, Plasmodium falciparum
ENLQK

SEQ ID NO: 3218258 - protein, 9 aa, Plasmodium falciparum
ENLQNSKNK

SEQ ID NO: 3218259 - protein, 4 aa, Plasmodium falciparum
ENLR

SEQ ID NO: 3218260 - protein, 8 aa, Plasmodium falciparum
ENLSPEDI

SEQ ID NO: 3218261 - protein, 13 aa, Plasmodium falciparum
ENLYKDDEDNTNG

SEQ ID NO: 3218262 - protein, 23 aa, Plasmodium falciparum
ENMEENKEGSVEENKEENKPNDE

SEQ ID NO: 3218263 - protein, 58 aa, Plasmodium falciparum
ENMEENVEENVEENVEENVEENVEENVEENVEENVEENVEENVEENIEENVEENVEEN

SEQ ID NO: 3218264 - protein, 5 aa, Plasmodium falciparum
ENMKN

SEQ ID NO: 3218265 - protein, 4 aa, Plasmodium falciparum
ENMN

SEQ ID NO: 3218266 - protein, 5 aa, Plasmodium falciparum
ENMNE

SEQ ID NO: 3218267 - protein, 46 aa, Plasmodium falciparum
ENMNKTKANNNNNNNNNNNSNNNNNSNNNNNSNNNNNKCNDSYKEK

SEQ ID NO: 3218268 - protein, 13 aa, Plasmodium falciparum
ENMNNTKKEMENT

SEQ ID NO: 3218269 - protein, 11 aa, Plasmodium falciparum
ENMQKKKKKNY

SEQ ID NO: 3218270 - protein, 5 aa, Plasmodium falciparum
ENMQN

SEQ ID NO: 3218271 - protein, 17 aa, Plasmodium falciparum
ENMQNTNNYIDNNSNNC

SEQ ID NO: 3218272 - protein, 9 aa, Plasmodium falciparum
ENMSDSHDK

SEQ ID NO: 3218273 - protein, 8 aa, Plasmodium falciparum
ENMTNNDS

SEQ ID NO: 3218274 - protein, 12 aa, Plasmodium falciparum
ENMTNSEKSEDL

SEQ ID NO: 3218275 - protein, 6 aa, Plasmodium falciparum
ENMYSK

SEQ ID NO: 3218276 - protein, 12 aa, Plasmodium falciparum
ENNARRNRKDQM

SEQ ID NO: 3218277 - protein, 4 aa, Plasmodium falciparum
ENNC

SEQ ID NO: 3218278 - protein, 4 aa, Plasmodium falciparum
ENND

SEQ ID NO: 3218279 - protein, 15 aa, Plasmodium falciparum
ENNDDKKKNEDNTKI

SEQ ID NO: 3218280 - protein, 6 aa, Plasmodium falciparum
ENNDFE

SEQ ID NO: 3218281 - protein, 16 aa, Plasmodium falciparum
ENNDKMKGDNNIDNED

SEQ ID NO: 3218282 - protein, 10 aa, Plasmodium falciparum
ENNDKPKDAK

SEQ ID NO: 3218283 - protein, 6 aa, Plasmodium falciparum
ENNDLD

SEQ ID NO: 3218284 - protein, 11 aa, Plasmodium falciparum
ENNDNGKQKFQ

SEQ ID NO: 3218285 - protein, 17 aa, Plasmodium falciparum
ENNDQRLKKEKNSLQDK

SEQ ID NO: 3218286 - protein, 20 aa, Plasmodium falciparum
ENNDSKKDEYAASTNNSSNL

SEQ ID NO: 3218287 - protein, 15 aa, Plasmodium falciparum
ENNEENSKNSLDSEE

SEQ ID NO: 3218288 - protein, 6 aa, Plasmodium falciparum
ENNEEY

SEQ ID NO: 3218289 - protein, 9 aa, Plasmodium falciparum
ENNEEYSSI

SEQ ID NO: 3218290 - protein, 23 aa, Plasmodium falciparum
ENNEIEQDEDDESSSEWEIIAQP

SEQ ID NO: 3218291 - protein, 5 aa, Plasmodium falciparum
ENNEK

SEQ ID NO: 3218292 - protein, 7 aa, Plasmodium falciparum
ENNEKDN

SEQ ID NO: 3218293 - protein, 7 aa, Plasmodium falciparum
ENNEKYI

SEQ ID NO: 3218294 - protein, 10 aa, Plasmodium falciparum
ENNENIKNNT

SEQ ID NO: 3218295 - protein, 9 aa, Plasmodium falciparum
ENNENKKKK

SEQ ID NO: 3218296 - protein, 23 aa, Plasmodium falciparum
ENNENVENNENIENNENNENIEN

SEQ ID NO: 3218297 - protein, 40 aa, Plasmodium falciparum
ENNEPDENQEKEMEDNKEQKIEDNEEEQMGDNEEEQMGDT

SEQ ID NO: 3218298 - protein, 23 aa, Plasmodium falciparum
ENNEQSMNQSDDNALTNTSYEIK

SEQ ID NO: 3218299 - protein, 23 aa, Plasmodium falciparum
ENNERKRKRNKRRGKKNKYNTKN

SEQ ID NO: 3218300 - protein, 10 aa, Plasmodium falciparum
ENNESDEDES

SEQ ID NO: 3218301 - protein, 8 aa, Plasmodium falciparum
ENNESIEK

SEQ ID NO: 3218302 - protein, 33 aa, Plasmodium falciparum
ENNESLDDTLSNTSNEKKSKTKTSTNDDNDKIH

SEQ ID NO: 3218303 - protein, 13 aa, Plasmodium falciparum
ENNESTEKETSSK

SEQ ID NO: 3218304 - protein, 5 aa, Plasmodium falciparum
ENNET

SEQ ID NO: 3218305 - protein, 43 aa, Plasmodium falciparum
ENNETNKEDHNQNDNNENNTKKNNNNNDHNNDDHNNDDHNNND

SEQ ID NO: 3218306 - protein, 10 aa, Plasmodium falciparum
ENNEVKPNMS

SEQ ID NO: 3218307 - protein, 6 aa, Plasmodium falciparum
ENNEWQ

SEQ ID NO: 3218308 - protein, 25 aa, Plasmodium falciparum
ENNFNSSSHTSINSDHNMNDQGGPY

SEQ ID NO: 3218309 - protein, 7 aa, Plasmodium falciparum
ENNFSKN

SEQ ID NO: 3218310 - protein, 10 aa, Plasmodium falciparum
ENNGDVKNNE

SEQ ID NO: 3218311 - protein, 7 aa, Plasmodium falciparum
ENNGIKE

SEQ ID NO: 3218312 - protein, 7 aa, Plasmodium falciparum
ENNHRSN

SEQ ID NO: 3218313 - protein, 6 aa, Plasmodium falciparum
ENNIGK

SEQ ID NO: 3218314 - protein, 11 aa, Plasmodium falciparum
ENNIKKENKKN

SEQ ID NO: 3218315 - protein, 7 aa, Plasmodium falciparum
ENNIKNP

SEQ ID NO: 3218316 - protein, 7 aa, Plasmodium falciparum
ENNIKSS

SEQ ID NO: 3218317 - protein, 67 aa, Plasmodium falciparum
ENNINDNNINDNNMDENNINDNNMDENNINDNNINDNNINDNNINDNNINDNNINDNNINDNNINDD

SEQ ID NO: 3218318 - protein, 7 aa, Plasmodium falciparum
ENNINEN

SEQ ID NO: 3218319 - protein, 21 aa, Plasmodium falciparum
ENNINNKKDEFNKTKNCSNHC

SEQ ID NO: 3218320 - protein, 14 aa, Plasmodium falciparum
ENNINNNSNYSNNK

SEQ ID NO: 3218321 - protein, 6 aa, Plasmodium falciparum
ENNINT

SEQ ID NO: 3218322 - protein, 6 aa, Plasmodium falciparum
ENNIPI

SEQ ID NO: 3218323 - protein, 5 aa, Plasmodium falciparum
ENNIQ

SEQ ID NO: 3218324 - protein, 12 aa, Plasmodium falciparum
ENNIQSDQYSED

SEQ ID NO: 3218325 - protein, 22 aa, Plasmodium falciparum
ENNISNNASPINETHSTKLRNK

SEQ ID NO: 3218326 - protein, 6 aa, Plasmodium falciparum
ENNISS

SEQ ID NO: 3218327 - protein, 12 aa, Plasmodium falciparum
ENNKEIKSKQGY

SEQ ID NO: 3218328 - protein, 8 aa, Plasmodium falciparum
ENNKFNGK

SEQ ID NO: 3218329 - protein, 7 aa, Plasmodium falciparum
ENNKHTE

SEQ ID NO: 3218330 - protein, 36 aa, Plasmodium falciparum
ENNKKHKNKKNKKKNNNNNNNNNNKIKDQKEDHNEK

SEQ ID NO: 3218331 - protein, 8 aa, Plasmodium falciparum
ENNKNDEL

SEQ ID NO: 3218332 - protein, 10 aa, Plasmodium falciparum
ENNKNNIKNN

SEQ ID NO: 3218333 - protein, 20 aa, Plasmodium falciparum
ENNKNNINDEQIKNGTTSEI

SEQ ID NO: 3218334 - protein, 10 aa, Plasmodium falciparum
ENNKNNNEKM

SEQ ID NO: 3218335 - protein, 23 aa, Plasmodium falciparum
ENNKQKHSPYNTTNEEITNNGKN

SEQ ID NO: 3218336 - protein, 28 aa, Plasmodium falciparum
ENNKQVNDNNQMQDNNYNNNNNDNNSKL

SEQ ID NO: 3218337 - protein, 14 aa, Plasmodium falciparum
ENNKSGNANEETEN

SEQ ID NO: 3218338 - protein, 14 aa, Plasmodium falciparum
ENNKSNKRKKRNND

SEQ ID NO: 3218339 - protein, 5 aa, Plasmodium falciparum
ENNKT

SEQ ID NO: 3218340 - protein, 15 aa, Plasmodium falciparum
ENNLKNNNNNDDGVT

SEQ ID NO: 3218341 - protein, 7 aa, Plasmodium falciparum
ENNMEEK

SEQ ID NO: 3218342 - protein, 7 aa, Plasmodium falciparum
ENNMKND

SEQ ID NO: 3218343 - protein, 5 aa, Plasmodium falciparum
ENNND

SEQ ID NO: 3218344 - protein, 18 aa, Plasmodium falciparum
ENNNDNLSDTLQDERSIK

SEQ ID NO: 3218345 - protein, 20 aa, Plasmodium falciparum
ENNNDNPGSKPKTNGTYQEN

SEQ ID NO: 3218346 - protein, 8 aa, Plasmodium falciparum
ENNNEDNV

SEQ ID NO: 3218347 - protein, 8 aa, Plasmodium falciparum
ENNNEIPI

SEQ ID NO: 3218348 - protein, 6 aa, Plasmodium falciparum
ENNNEN

SEQ ID NO: 3218349 - protein, 10 aa, Plasmodium falciparum
ENNNEQDKSR

SEQ ID NO: 3218350 - protein, 5 aa, Plasmodium falciparum
ENNNI

SEQ ID NO: 3218351 - protein, 5 aa, Plasmodium falciparum
ENNNK

SEQ ID NO: 3218352 - protein, 69 aa, Plasmodium falciparum
ENNNKGDTYDDNNNNYDNNNNNYDNNNNNYDNNNNNYDNNNNYYDNNNNNYDNNNNNYDNNNNNYDYND

SEQ ID NO: 3218353 - protein, 16 aa, Plasmodium falciparum
ENNNKKEEEYSHNNNN

SEQ ID NO: 3218354 - protein, 6 aa, Plasmodium falciparum
ENNNKL

SEQ ID NO: 3218355 - protein, 47 aa, Plasmodium falciparum
ENNNNDNDNNNDNNNDNNNDNNNDNNNDNNNNNNDNNNDQEKDNMSD

SEQ ID NO: 3218356 - protein, 24 aa, Plasmodium falciparum
ENNNNKKKKKRKKKKKKKQTKQEI

SEQ ID NO: 3218357 - protein, 11 aa, Plasmodium falciparum
ENNNNKKYNQN

SEQ ID NO: 3218358 - protein, 9 aa, Plasmodium falciparum
ENNNNNKQN

SEQ ID NO: 3218359 - protein, 15 aa, Plasmodium falciparum
ENNNNNNDSTNNNSV

SEQ ID NO: 3218360 - protein, 10 aa, Plasmodium falciparum
ENNNNNNNYN

SEQ ID NO: 3218361 - protein, 7 aa, Plasmodium falciparum
ENNNNNY

SEQ ID NO: 3218362 - protein, 8 aa, Plasmodium falciparum
ENNNSSNV

SEQ ID NO: 3218363 - protein, 21 aa, Plasmodium falciparum
ENNNTDENTKKLKDEKYGRNR

SEQ ID NO: 3218364 - protein, 18 aa, Plasmodium falciparum
ENNNTNVNNNNTNVGNTN

SEQ ID NO: 3218365 - protein, 50 aa, Plasmodium falciparum
ENNNTSNEYNISNSNNMNHTSNSSNNNNNNNNNNNNNNNNYNNNNNNNNN

SEQ ID NO: 3218366 - protein, 6 aa, Plasmodium falciparum
ENNPDT

SEQ ID NO: 3218367 - protein, 5 aa, Plasmodium falciparum
ENNPF

SEQ ID NO: 3218368 - protein, 6 aa, Plasmodium falciparum
ENNPND

SEQ ID NO: 3218369 - protein, 4 aa, Plasmodium falciparum
ENNQ

SEQ ID NO: 3218370 - protein, 24 aa, Plasmodium falciparum
ENNQEEKNKQNNNNNNNDNNYNNK

SEQ ID NO: 3218371 - protein, 21 aa, Plasmodium falciparum
ENNQKEENKKQQNVNKDGINN

SEQ ID NO: 3218372 - protein, 27 aa, Plasmodium falciparum
ENNQMNESGRNGSLDEDLNRDEREGIN

SEQ ID NO: 3218373 - protein, 28 aa, Plasmodium falciparum
ENNREDLSNSNMKRKDKTTKDKDTKEIN

SEQ ID NO: 3218374 - protein, 18 aa, Plasmodium falciparum
ENNRETEKITTNNNPVTT

SEQ ID NO: 3218375 - protein, 7 aa, Plasmodium falciparum
ENNRKNL

SEQ ID NO: 3218376 - protein, 14 aa, Plasmodium falciparum
ENNRNHDGNKNNDF

SEQ ID NO: 3218377 - protein, 4 aa, Plasmodium falciparum
ENNS

SEQ ID NO: 3218378 - protein, 8 aa, Plasmodium falciparum
ENNSENIE

SEQ ID NO: 3218379 - protein, 13 aa, Plasmodium falciparum
ENNSGTEEEENED

SEQ ID NO: 3218380 - protein, 6 aa, Plasmodium falciparum
ENNSKL

SEQ ID NO: 3218381 - protein, 28 aa, Plasmodium falciparum
ENNSNENKSETDNENSDKKINNKMNDST

SEQ ID NO: 3218382 - protein, 66 aa, Plasmodium falciparum
ENNSNNSYQPYDSNNTNNNTNSNNNSNNNSNNNSNNNSNNYSNNNSNTNSNTNSNTNSNNNTTNYD

SEQ ID NO: 3218383 - protein, 13 aa, Plasmodium falciparum
ENNSNVKKKHTSN

SEQ ID NO: 3218384 - protein, 7 aa, Plasmodium falciparum
ENNSTDK

SEQ ID NO: 3218385 - protein, 7 aa, Plasmodium falciparum
ENNSVRK

SEQ ID NO: 3218386 - protein, 6 aa, Plasmodium falciparum
ENNSYD

SEQ ID NO: 3218387 - protein, 7 aa, Plasmodium falciparum
ENNTDIQ

SEQ ID NO: 3218388 - protein, 7 aa, Plasmodium falciparum
ENNTHLN

SEQ ID NO: 3218389 - protein, 13 aa, Plasmodium falciparum
ENNTKEKNVEKKV

SEQ ID NO: 3218390 - protein, 6 aa, Plasmodium falciparum
ENNTKH

SEQ ID NO: 3218391 - protein, 22 aa, Plasmodium falciparum
ENNTKQTYNKMNEQNKNYPQTE

SEQ ID NO: 3218392 - protein, 7 aa, Plasmodium falciparum
ENNTMNK

SEQ ID NO: 3218393 - protein, 32 aa, Plasmodium falciparum
ENNTYDEISKNKKDPNDNINYRNKNENFDQSN

SEQ ID NO: 3218394 - protein, 8 aa, Plasmodium falciparum
ENNTYNDD

SEQ ID NO: 3218395 - protein, 18 aa, Plasmodium falciparum
ENNTYNITENSKTTDQKY

SEQ ID NO: 3218396 - protein, 5 aa, Plasmodium falciparum
ENNVE

SEQ ID NO: 3218397 - protein, 12 aa, Plasmodium falciparum
ENNVEKKRKKMK

SEQ ID NO: 3218398 - protein, 5 aa, Plasmodium falciparum
ENNVK

SEQ ID NO: 3218399 - protein, 4 aa, Plasmodium falciparum
ENNY

SEQ ID NO: 3218400 - protein, 5 aa, Plasmodium falciparum
ENNYD

SEQ ID NO: 3218401 - protein, 5 aa, Plasmodium falciparum
ENPDL

SEQ ID NO: 3218402 - protein, 11 aa, Plasmodium falciparum
ENPDPNYVESK

SEQ ID NO: 3218403 - protein, 6 aa, Plasmodium falciparum
ENPENK

SEQ ID NO: 3218404 - protein, 19 aa, Plasmodium falciparum
ENPKNEEDAHDEDNAQDIV

SEQ ID NO: 3218405 - protein, 6 aa, Plasmodium falciparum
ENPKQY

SEQ ID NO: 3218406 - protein, 5 aa, Plasmodium falciparum
ENPLY

SEQ ID NO: 3218407 - protein, 5 aa, Plasmodium falciparum
ENPPG

SEQ ID NO: 3218408 - protein, 7 aa, Plasmodium falciparum
ENPQNDN

SEQ ID NO: 3218409 - protein, 5 aa, Plasmodium falciparum
ENPRK

SEQ ID NO: 3218410 - protein, 8 aa, Plasmodium falciparum
ENPRTNGQ

SEQ ID NO: 3218411 - protein, 7 aa, Plasmodium falciparum
ENPSRAK

SEQ ID NO: 3218412 - protein, 15 aa, Plasmodium falciparum
ENPSSGSSHIEDKGQ

SEQ ID NO: 3218413 - protein, 10 aa, Plasmodium falciparum
ENPSSYDNNN

SEQ ID NO: 3218414 - protein, 5 aa, Plasmodium falciparum
ENPTE

SEQ ID NO: 3218415 - protein, 6 aa, Plasmodium falciparum
ENPYDI

SEQ ID NO: 3218416 - protein, 15 aa, Plasmodium falciparum
ENPYEISNEGDDNTR

SEQ ID NO: 3218417 - protein, 11 aa, Plasmodium falciparum
ENQENDTSEKI

SEQ ID NO: 3218418 - protein, 8 aa, Plasmodium falciparum
ENQIEKEK

SEQ ID NO: 3218419 - protein, 5 aa, Plasmodium falciparum
ENQKG

SEQ ID NO: 3218420 - protein, 10 aa, Plasmodium falciparum
ENQKVTKQTK

SEQ ID NO: 3218421 - protein, 8 aa, Plasmodium falciparum
ENQKYSSL

SEQ ID NO: 3218422 - protein, 8 aa, Plasmodium falciparum
ENQLQDQT

SEQ ID NO: 3218423 - protein, 4 aa, Plasmodium falciparum
ENQN

SEQ ID NO: 3218424 - protein, 20 aa, Plasmodium falciparum
ENQNDEQKNYSDNIHNTSDN

SEQ ID NO: 3218425 - protein, 12 aa, Plasmodium falciparum
ENQNENDTISQN

SEQ ID NO: 3218426 - protein, 6 aa, Plasmodium falciparum
ENQNIY

SEQ ID NO: 3218427 - protein, 15 aa, Plasmodium falciparum
ENQNKDKNKKETKNI

SEQ ID NO: 3218428 - protein, 7 aa, Plasmodium falciparum
ENQNKTI

SEQ ID NO: 3218429 - protein, 9 aa, Plasmodium falciparum
ENQNSGLKN

SEQ ID NO: 3218430 - protein, 7 aa, Plasmodium falciparum
ENQQEFN

SEQ ID NO: 3218431 - protein, 5 aa, Plasmodium falciparum
ENQRK

SEQ ID NO: 3218432 - protein, 25 aa, Plasmodium falciparum
ENQRNKNTCDKIKKQQKKKQTNVKY

SEQ ID NO: 3218433 - protein, 12 aa, Plasmodium falciparum
ENQSEQKNDDKK

SEQ ID NO: 3218434 - protein, 10 aa, Plasmodium falciparum
ENQTEEDNMD

SEQ ID NO: 3218435 - protein, 21 aa, Plasmodium falciparum
ENQYCDTQNVSKKKKKDKMNS

SEQ ID NO: 3218436 - protein, 5 aa, Plasmodium falciparum
ENQYD

SEQ ID NO: 3218437 - protein, 5 aa, Plasmodium falciparum
ENQYI

SEQ ID NO: 3218438 - protein, 15 aa, Plasmodium falciparum
ENRDHEVNKEDISKS

SEQ ID NO: 3218439 - protein, 6 aa, Plasmodium falciparum
ENRENL

SEQ ID NO: 3218440 - protein, 6 aa, Plasmodium falciparum
ENRGEM

SEQ ID NO: 3218441 - protein, 5 aa, Plasmodium falciparum
ENRGI

SEQ ID NO: 3218442 - protein, 17 aa, Plasmodium falciparum
ENRHEKENSKNKKGPLQ

SEQ ID NO: 3218443 - protein, 7 aa, Plasmodium falciparum
ENRIKEE

SEQ ID NO: 3218444 - protein, 4 aa, Plasmodium falciparum
ENRK

SEQ ID NO: 3218445 - protein, 9 aa, Plasmodium falciparum
ENRKEEVDK

SEQ ID NO: 3218446 - protein, 10 aa, Plasmodium falciparum
ENRKNLRSKY

SEQ ID NO: 3218447 - protein, 9 aa, Plasmodium falciparum
ENRKQKIQD

SEQ ID NO: 3218448 - protein, 6 aa, Plasmodium falciparum
ENRNDN

SEQ ID NO: 3218449 - protein, 71 aa, Plasmodium falciparum
ENRNQTNKLKTNDNVSKDDNQIKPMGNKNNISSLDTKSDQNINNNNSNNTSNLNSNMNSHRNNFKNDSDFI

SEQ ID NO: 3218450 - protein, 12 aa, Plasmodium falciparum
ENRNSEEDLNKS

SEQ ID NO: 3218451 - protein, 8 aa, Plasmodium falciparum
ENRNYKND

SEQ ID NO: 3218452 - protein, 18 aa, Plasmodium falciparum
ENRRDKKYNRLEKNKRMN

SEQ ID NO: 3218453 - protein, 20 aa, Plasmodium falciparum
ENRRNGKNREIEKRYEGDKE

SEQ ID NO: 3218454 - protein, 4 aa, Plasmodium falciparum
ENRT

SEQ ID NO: 3218455 - protein, 16 aa, Plasmodium falciparum
ENRTSEKNKKKKIHVE

SEQ ID NO: 3218456 - protein, 9 aa, Plasmodium falciparum
ENSAENYEK

SEQ ID NO: 3218457 - protein, 9 aa, Plasmodium falciparum
ENSDDTLKR

SEQ ID NO: 3218458 - protein, 5 aa, Plasmodium falciparum
ENSDS

SEQ ID NO: 3218459 - protein, 7 aa, Plasmodium falciparum
ENSEDSI

SEQ ID NO: 3218460 - protein, 6 aa, Plasmodium falciparum
ENSEKT

SEQ ID NO: 3218461 - protein, 6 aa, Plasmodium falciparum
ENSENY

SEQ ID NO: 3218462 - protein, 23 aa, Plasmodium falciparum
ENSGPSPKLQTGSPGTSGDNTPL

SEQ ID NO: 3218463 - protein, 9 aa, Plasmodium falciparum
ENSGRNSSM

SEQ ID NO: 3218464 - protein, 5 aa, Plasmodium falciparum
ENSHD

SEQ ID NO: 3218465 - protein, 7 aa, Plasmodium falciparum
ENSHLNN

SEQ ID NO: 3218466 - protein, 10 aa, Plasmodium falciparum
ENSISNPDNN

SEQ ID NO: 3218467 - protein, 9 aa, Plasmodium falciparum
ENSKEGDEH

SEQ ID NO: 3218468 - protein, 14 aa, Plasmodium falciparum
ENSKISKDNSAEEI

SEQ ID NO: 3218469 - protein, 26 aa, Plasmodium falciparum
ENSKKEKLLEERDSDTSKDDKNSSYI

SEQ ID NO: 3218470 - protein, 10 aa, Plasmodium falciparum
ENSKNKTNHN

SEQ ID NO: 3218471 - protein, 7 aa, Plasmodium falciparum
ENSKTKT

SEQ ID NO: 3218472 - protein, 4 aa, Plasmodium falciparum
ENSL

SEQ ID NO: 3218473 - protein, 7 aa, Plasmodium falciparum
ENSLKQK

SEQ ID NO: 3218474 - protein, 4 aa, Plasmodium falciparum
ENSN

SEQ ID NO: 3218475 - protein, 11 aa, Plasmodium falciparum
ENSNAKKLKRE

SEQ ID NO: 3218476 - protein, 6 aa, Plasmodium falciparum
ENSNDA

SEQ ID NO: 3218477 - protein, 33 aa, Plasmodium falciparum
ENSNGSGTYKEYTNNCPNNNNKNNNNKNNKNNI

SEQ ID NO: 3218478 - protein, 7 aa, Plasmodium falciparum
ENSNIEN

SEQ ID NO: 3218479 - protein, 11 aa, Plasmodium falciparum
ENSNKNNVTHD

SEQ ID NO: 3218480 - protein, 6 aa, Plasmodium falciparum
ENSNKY

SEQ ID NO: 3218481 - protein, 15 aa, Plasmodium falciparum
ENSNNENKKKVKKKG

SEQ ID NO: 3218482 - protein, 12 aa, Plasmodium falciparum
ENSNVKGKTKFN

SEQ ID NO: 3218483 - protein, 7 aa, Plasmodium falciparum
ENSPCSN

SEQ ID NO: 3218484 - protein, 5 aa, Plasmodium falciparum
ENSQH

SEQ ID NO: 3218485 - protein, 11 aa, Plasmodium falciparum
ENSQKEEELNH

SEQ ID NO: 3218486 - protein, 7 aa, Plasmodium falciparum
ENSQNKH

SEQ ID NO: 3218487 - protein, 7 aa, Plasmodium falciparum
ENSQNNG

SEQ ID NO: 3218488 - protein, 8 aa, Plasmodium falciparum
ENSRNYNN

SEQ ID NO: 3218489 - protein, 4 aa, Plasmodium falciparum
ENSS

SEQ ID NO: 3218490 - protein, 12 aa, Plasmodium falciparum
ENSSGGEGKTIE

SEQ ID NO: 3218491 - protein, 9 aa, Plasmodium falciparum
ENSSKKDKL

SEQ ID NO: 3218492 - protein, 4 aa, Plasmodium falciparum
ENST

SEQ ID NO: 3218493 - protein, 12 aa, Plasmodium falciparum
ENSTNANRYQQV

SEQ ID NO: 3218494 - protein, 8 aa, Plasmodium falciparum
ENSTNEKN

SEQ ID NO: 3218495 - protein, 22 aa, Plasmodium falciparum
ENSTPLEDDDEPFEEEENPENM

SEQ ID NO: 3218496 - protein, 6 aa, Plasmodium falciparum
ENSTSI

SEQ ID NO: 3218497 - protein, 7 aa, Plasmodium falciparum
ENSTTEN

SEQ ID NO: 3218498 - protein, 18 aa, Plasmodium falciparum
ENSVREKDKNNNSFGSSQ

SEQ ID NO: 3218499 - protein, 27 aa, Plasmodium falciparum
ENSYDEFNKNKSNKIHSDNKNKSKKKM

SEQ ID NO: 3218500 - protein, 6 aa, Plasmodium falciparum
ENSYNN

SEQ ID NO: 3218501 - protein, 21 aa, Plasmodium falciparum
ENSYTKNYRTEDMKKGQGFTN

SEQ ID NO: 3218502 - protein, 7 aa, Plasmodium falciparum
ENTCSNK

SEQ ID NO: 3218503 - protein, 18 aa, Plasmodium falciparum
ENTDEDAENNVSAEEAKE

SEQ ID NO: 3218504 - protein, 6 aa, Plasmodium falciparum
ENTDND

SEQ ID NO: 3218505 - protein, 9 aa, Plasmodium falciparum
ENTDPYEIN

SEQ ID NO: 3218506 - protein, 17 aa, Plasmodium falciparum
ENTDSIYGQNNNNDNNY

SEQ ID NO: 3218507 - protein, 5 aa, Plasmodium falciparum
ENTEE

SEQ ID NO: 3218508 - protein, 7 aa, Plasmodium falciparum
ENTEETF

SEQ ID NO: 3218509 - protein, 9 aa, Plasmodium falciparum
ENTENDTRT

SEQ ID NO: 3218510 - protein, 9 aa, Plasmodium falciparum
ENTESVTEE

SEQ ID NO: 3218511 - protein, 8 aa, Plasmodium falciparum
ENTGSEKQ

SEQ ID NO: 3218512 - protein, 6 aa, Plasmodium falciparum
ENTHNN

SEQ ID NO: 3218513 - protein, 5 aa, Plasmodium falciparum
ENTHQ

SEQ ID NO: 3218514 - protein, 10 aa, Plasmodium falciparum
ENTITNDTIE

SEQ ID NO: 3218515 - protein, 7 aa, Plasmodium falciparum
ENTKIDK

SEQ ID NO: 3218516 - protein, 10 aa, Plasmodium falciparum
ENTKKANVKY

SEQ ID NO: 3218517 - protein, 30 aa, Plasmodium falciparum
ENTKKEKNDDDNTINTYDSEQDINKNDMKN

SEQ ID NO: 3218518 - protein, 6 aa, Plasmodium falciparum
ENTKKL

SEQ ID NO: 3218519 - protein, 7 aa, Plasmodium falciparum
ENTKNKY

SEQ ID NO: 3218520 - protein, 9 aa, Plasmodium falciparum
ENTKNSYDM

SEQ ID NO: 3218521 - protein, 7 aa, Plasmodium falciparum
ENTKQSN

SEQ ID NO: 3218522 - protein, 5 aa, Plasmodium falciparum
ENTKR

SEQ ID NO: 3218523 - protein, 8 aa, Plasmodium falciparum
ENTKSYKA

SEQ ID NO: 3218524 - protein, 4 aa, Plasmodium falciparum
ENTL

SEQ ID NO: 3218525 - protein, 5 aa, Plasmodium falciparum
ENTLY

SEQ ID NO: 3218526 - protein, 6 aa, Plasmodium falciparum
ENTNCP

SEQ ID NO: 3218527 - protein, 12 aa, Plasmodium falciparum
ENTNDFKSNNEE

SEQ ID NO: 3218528 - protein, 8 aa, Plasmodium falciparum
ENTNDYND

SEQ ID NO: 3218529 - protein, 11 aa, Plasmodium falciparum
ENTNKNKKEGF

SEQ ID NO: 3218530 - protein, 12 aa, Plasmodium falciparum
ENTNNDNLNNSD

SEQ ID NO: 3218531 - protein, 24 aa, Plasmodium falciparum
ENTNYKKREDNTNYNCKDDDNKDI

SEQ ID NO: 3218532 - protein, 7 aa, Plasmodium falciparum
ENTPSNN

SEQ ID NO: 3218533 - protein, 5 aa, Plasmodium falciparum
ENTPY

SEQ ID NO: 3218534 - protein, 9 aa, Plasmodium falciparum
ENTQGRDES

SEQ ID NO: 3218535 - protein, 11 aa, Plasmodium falciparum
ENTQSEEEKKE

SEQ ID NO: 3218536 - protein, 6 aa, Plasmodium falciparum
ENTQTY

SEQ ID NO: 3218537 - protein, 4 aa, Plasmodium falciparum
ENTS

SEQ ID NO: 3218538 - protein, 7 aa, Plasmodium falciparum
ENTSDDL

SEQ ID NO: 3218539 - protein, 19 aa, Plasmodium falciparum
ENTSEDTFTTNTRESSLNS

SEQ ID NO: 3218540 - protein, 8 aa, Plasmodium falciparum
ENTSNNSS

SEQ ID NO: 3218541 - protein, 13 aa, Plasmodium falciparum
ENTSTLKNGSKLK

SEQ ID NO: 3218542 - protein, 6 aa, Plasmodium falciparum
ENTTDS

SEQ ID NO: 3218543 - protein, 14 aa, Plasmodium falciparum
ENTTQEPNPSTEDK

SEQ ID NO: 3218544 - protein, 6 aa, Plasmodium falciparum
ENTTRN

SEQ ID NO: 3218545 - protein, 6 aa, Plasmodium falciparum
ENTVKA

SEQ ID NO: 3218546 - protein, 10 aa, Plasmodium falciparum
ENTVKNSAES

SEQ ID NO: 3218547 - protein, 53 aa, Plasmodium falciparum
ENVDNNSNNNNNNNNNNNNNNNNNNNNNNNGYKKKIKNKNKNKNKKKNKLNNY

SEQ ID NO: 3218548 - protein, 6 aa, Plasmodium falciparum
ENVDSI

SEQ ID NO: 3218549 - protein, 4 aa, Plasmodium falciparum
ENVE

SEQ ID NO: 3218550 - protein, 8 aa, Plasmodium falciparum
ENVEASHN

SEQ ID NO: 3218551 - protein, 7 aa, Plasmodium falciparum
ENVEEEY

SEQ ID NO: 3218552 - protein, 50 aa, Plasmodium falciparum
ENVEENVEENIEENVEENVEENAEENAEENAEENAEENDETPQEHNEEYD

SEQ ID NO: 3218553 - protein, 25 aa, Plasmodium falciparum
ENVEEQNVDESGEQQSDDESGEHQS

SEQ ID NO: 3218554 - protein, 13 aa, Plasmodium falciparum
ENVEGKKKKKGCP

SEQ ID NO: 3218555 - protein, 53 aa, Plasmodium falciparum
ENVENAENVENAENAENAENVENAENAENAENAENAENVDEQKKEKGDEGKAN

SEQ ID NO: 3218556 - protein, 12 aa, Plasmodium falciparum
ENVETSKGEYDE

SEQ ID NO: 3218557 - protein, 7 aa, Plasmodium falciparum
ENVGEEE

SEQ ID NO: 3218558 - protein, 24 aa, Plasmodium falciparum
ENVGENVSENVGENVSENVGENVD

SEQ ID NO: 3218559 - protein, 43 aa, Plasmodium falciparum
ENVGNSRNAEIHESNSPNHNGDKNVDPSDNVTGTKQDENETKN

SEQ ID NO: 3218560 - protein, 11 aa, Plasmodium falciparum
ENVGTNQSTRG

SEQ ID NO: 3218561 - protein, 10 aa, Plasmodium falciparum
ENVIKDDEKN

SEQ ID NO: 3218562 - protein, 21 aa, Plasmodium falciparum
ENVKEGENVKEVENAKEVENV

SEQ ID NO: 3218563 - protein, 59 aa, Plasmodium falciparum
ENVKKEESENEKELNQNESNQKKLNHNESNQKKLNHNESNQKKLNHNERYKQYNSTTSL

SEQ ID NO: 3218564 - protein, 8 aa, Plasmodium falciparum
ENVKKSCE

SEQ ID NO: 3218565 - protein, 13 aa, Plasmodium falciparum
ENVKNADSSNNDV

SEQ ID NO: 3218566 - protein, 16 aa, Plasmodium falciparum
ENVKNEIPKTKENDTF

SEQ ID NO: 3218567 - protein, 7 aa, Plasmodium falciparum
ENVNEKI

SEQ ID NO: 3218568 - protein, 6 aa, Plasmodium falciparum
ENVPSK

SEQ ID NO: 3218569 - protein, 13 aa, Plasmodium falciparum
ENVQDKQKNKIKK

SEQ ID NO: 3218570 - protein, 8 aa, Plasmodium falciparum
ENVQGKNS

SEQ ID NO: 3218571 - protein, 7 aa, Plasmodium falciparum
ENVTDKQ

SEQ ID NO: 3218572 - protein, 33 aa, Plasmodium falciparum
ENVTEKEIPSNVPNSNNLTNESSNDNHNKTTIE

SEQ ID NO: 3218573 - protein, 7 aa, Plasmodium falciparum
ENVVSDK

SEQ ID NO: 3218574 - protein, 35 aa, Plasmodium falciparum
ENYDDSNNNNDNVNKDYNNCSNNEKLNKNEKINKK

SEQ ID NO: 3218575 - protein, 5 aa, Plasmodium falciparum
ENYDP

SEQ ID NO: 3218576 - protein, 5 aa, Plasmodium falciparum
ENYDR

SEQ ID NO: 3218577 - protein, 6 aa, Plasmodium falciparum
ENYDSF

SEQ ID NO: 3218578 - protein, 4 aa, Plasmodium falciparum
ENYE

SEQ ID NO: 3218579 - protein, 9 aa, Plasmodium falciparum
ENYEKEKEK

SEQ ID NO: 3218580 - protein, 23 aa, Plasmodium falciparum
ENYENENNKYLKNNGDKLNDNNR

SEQ ID NO: 3218581 - protein, 7 aa, Plasmodium falciparum
ENYGNNK

SEQ ID NO: 3218582 - protein, 4 aa, Plasmodium falciparum
ENYK

SEQ ID NO: 3218583 - protein, 8 aa, Plasmodium falciparum
ENYKENSS

SEQ ID NO: 3218584 - protein, 5 aa, Plasmodium falciparum
ENYND

SEQ ID NO: 3218585 - protein, 11 aa, Plasmodium falciparum
ENYNESGGRNH

SEQ ID NO: 3218586 - protein, 15 aa, Plasmodium falciparum
ENYNKDITEEQTIKE

SEQ ID NO: 3218587 - protein, 15 aa, Plasmodium falciparum
ENYNNNNNNNNDTSN

SEQ ID NO: 3218588 - protein, 11 aa, Plasmodium falciparum
ENYNSEKEEFK

SEQ ID NO: 3218589 - protein, 17 aa, Plasmodium falciparum
ENYRKKKSKKHASDWKN

SEQ ID NO: 3218590 - protein, 5 aa, Plasmodium falciparum
ENYTD

SEQ ID NO: 3218591 - protein, 21 aa, Plasmodium falciparum
ENYVKEEKQNVSYDNKDDFKI

SEQ ID NO: 3218592 - protein, 19 aa, Plasmodium falciparum
EPCRPSVQETEGGKTGKGI

SEQ ID NO: 3218593 - protein, 4 aa, Plasmodium falciparum
EPCT

SEQ ID NO: 3218594 - protein, 6 aa, Plasmodium falciparum
EPDEET

SEQ ID NO: 3218595 - protein, 7 aa, Plasmodium falciparum
EPDEVPF

SEQ ID NO: 3218596 - protein, 13 aa, Plasmodium falciparum
EPDTKEYQPHTSN

SEQ ID NO: 3218597 - protein, 11 aa, Plasmodium falciparum
EPDTNSFDENV

SEQ ID NO: 3218598 - protein, 11 aa, Plasmodium falciparum
EPDYSSAKDAK

SEQ ID NO: 3218599 - protein, 6 aa, Plasmodium falciparum
EPEEEE

SEQ ID NO: 3218600 - protein, 13 aa, Plasmodium falciparum
EPEENFEEDADEE

SEQ ID NO: 3218601 - protein, 8 aa, Plasmodium falciparum
EPENGTNS

SEQ ID NO: 3218602 - protein, 30 aa, Plasmodium falciparum
EPERQKEETDDNNIGRGDNNNGCDDNNIGC

SEQ ID NO: 3218603 - protein, 4 aa, Plasmodium falciparum
EPES

SEQ ID NO: 3218604 - protein, 13 aa, Plasmodium falciparum
EPFNDRNKKNNFS

SEQ ID NO: 3218605 - protein, 5 aa, Plasmodium falciparum
EPFPS

SEQ ID NO: 3218606 - protein, 13 aa, Plasmodium falciparum
EPHNPEKNPCAIP

SEQ ID NO: 3218607 - protein, 13 aa, Plasmodium falciparum
EPINTDNDKTSRL

SEQ ID NO: 3218608 - protein, 8 aa, Plasmodium falciparum
EPIQNNNN

SEQ ID NO: 3218609 - protein, 4 aa, Plasmodium falciparum
EPIS

SEQ ID NO: 3218610 - protein, 5 aa, Plasmodium falciparum
EPIST

SEQ ID NO: 3218611 - protein, 12 aa, Plasmodium falciparum
EPITSNECTSPN

SEQ ID NO: 3218612 - protein, 9 aa, Plasmodium falciparum
EPKDETISS

SEQ ID NO: 3218613 - protein, 5 aa, Plasmodium falciparum
EPKER

SEQ ID NO: 3218614 - protein, 13 aa, Plasmodium falciparum
EPKFSSTDGNNNN

SEQ ID NO: 3218615 - protein, 6 aa, Plasmodium falciparum
EPKGNI

SEQ ID NO: 3218616 - protein, 6 aa, Plasmodium falciparum
EPKHKK

SEQ ID NO: 3218617 - protein, 5 aa, Plasmodium falciparum
EPKKN

SEQ ID NO: 3218618 - protein, 15 aa, Plasmodium falciparum
EPKKPKSLKNDKTAI

SEQ ID NO: 3218619 - protein, 5 aa, Plasmodium falciparum
EPKPL

SEQ ID NO: 3218620 - protein, 8 aa, Plasmodium falciparum
EPLSDKQT

SEQ ID NO: 3218621 - protein, 8 aa, Plasmodium falciparum
EPLTGKDK

SEQ ID NO: 3218622 - protein, 4 aa, Plasmodium falciparum
EPME

SEQ ID NO: 3218623 - protein, 10 aa, Plasmodium falciparum
EPMNNNSNTL

SEQ ID NO: 3218624 - protein, 4 aa, Plasmodium falciparum
EPMS

SEQ ID NO: 3218625 - protein, 21 aa, Plasmodium falciparum
EPNDIPNDYTSGDIPLNTQPN

SEQ ID NO: 3218626 - protein, 11 aa, Plasmodium falciparum
EPNDPFNRAPL

SEQ ID NO: 3218627 - protein, 4 aa, Plasmodium falciparum
EPNK

SEQ ID NO: 3218628 - protein, 11 aa, Plasmodium falciparum
EPNKCNEEENI

SEQ ID NO: 3218629 - protein, 37 aa, Plasmodium falciparum
EPNNNLAQNNYDKENDNVNEEKKKRKKSDIKKKKNHT

SEQ ID NO: 3218630 - protein, 13 aa, Plasmodium falciparum
EPNTNNKHNTNSC

SEQ ID NO: 3218631 - protein, 13 aa, Plasmodium falciparum
EPNVKKKKEPLYE

SEQ ID NO: 3218632 - protein, 22 aa, Plasmodium falciparum
EPNYKDSKKVLSQKKKKKKSTI

SEQ ID NO: 3218633 - protein, 5 aa, Plasmodium falciparum
EPPCD

SEQ ID NO: 3218634 - protein, 6 aa, Plasmodium falciparum
EPPHTP

SEQ ID NO: 3218635 - protein, 6 aa, Plasmodium falciparum
EPPVGL

SEQ ID NO: 3218636 - protein, 4 aa, Plasmodium falciparum
EPQA

SEQ ID NO: 3218637 - protein, 5 aa, Plasmodium falciparum
EPSAN

SEQ ID NO: 3218638 - protein, 7 aa, Plasmodium falciparum
EPSRNSY

SEQ ID NO: 3218639 - protein, 18 aa, Plasmodium falciparum
EPSSKKSPQKKKIVIVRK

SEQ ID NO: 3218640 - protein, 5 aa, Plasmodium falciparum
EPSVS

SEQ ID NO: 3218641 - protein, 5 aa, Plasmodium falciparum
EPTNI

SEQ ID NO: 3218642 - protein, 25 aa, Plasmodium falciparum
EPTNPLDDENPDPEDDTSTTSSRPK

SEQ ID NO: 3218643 - protein, 6 aa, Plasmodium falciparum
EPTPKY

SEQ ID NO: 3218644 - protein, 6 aa, Plasmodium falciparum
EPTRDQ

SEQ ID NO: 3218645 - protein, 11 aa, Plasmodium falciparum
EPTSSDLGNIG

SEQ ID NO: 3218646 - protein, 14 aa, Plasmodium falciparum
EPVDGQHEKEASTI

SEQ ID NO: 3218647 - protein, 8 aa, Plasmodium falciparum
EPVGQDNS

SEQ ID NO: 3218648 - protein, 58 aa, Plasmodium falciparum
EPVNENQYGDKNQDKNQDQYQDKNQDQYQDQYQDQYQDPNQYQYQDQNQDDGGGGSSF

SEQ ID NO: 3218649 - protein, 17 aa, Plasmodium falciparum
EPVTEDNKDYDPVDGTE

SEQ ID NO: 3218650 - protein, 11 aa, Plasmodium falciparum
EPYFSTDRNTN

SEQ ID NO: 3218651 - protein, 5 aa, Plasmodium falciparum
EPYYP

SEQ ID NO: 3218652 - protein, 17 aa, Plasmodium falciparum
EQAAATASKNASETVST

SEQ ID NO: 3218653 - protein, 11 aa, Plasmodium falciparum
EQAEEESASTI

SEQ ID NO: 3218654 - protein, 8 aa, Plasmodium falciparum
EQAEYDNK

SEQ ID NO: 3218655 - protein, 8 aa, Plasmodium falciparum
EQAKGENK

SEQ ID NO: 3218656 - protein, 5 aa, Plasmodium falciparum
EQANQ

SEQ ID NO: 3218657 - protein, 20 aa, Plasmodium falciparum
EQAQQVKRKSIDETNEDEEC

SEQ ID NO: 3218658 - protein, 8 aa, Plasmodium falciparum
EQASTTEE

SEQ ID NO: 3218659 - protein, 19 aa, Plasmodium falciparum
EQATKNGETSGTPNEKDKD

SEQ ID NO: 3218660 - protein, 6 aa, Plasmodium falciparum
EQDADK

SEQ ID NO: 3218661 - protein, 9 aa, Plasmodium falciparum
EQDDNEEDV

SEQ ID NO: 3218662 - protein, 6 aa, Plasmodium falciparum
EQDKNK

SEQ ID NO: 3218663 - protein, 8 aa, Plasmodium falciparum
EQDNETKE

SEQ ID NO: 3218664 - protein, 10 aa, Plasmodium falciparum
EQDNIQQHDD

SEQ ID NO: 3218665 - protein, 37 aa, Plasmodium falciparum
EQDNLNKGKKKNNKKCNSRTISKKEQSKLKNEKNNLS

SEQ ID NO: 3218666 - protein, 49 aa, Plasmodium falciparum
EQDNTNEQDNINKQDNINKQDNINKQDNTNKQDNTNEQDNTNEQNSVNE

SEQ ID NO: 3218667 - protein, 18 aa, Plasmodium falciparum
EQDNYSNKNNNNNIYNNN

SEQ ID NO: 3218668 - protein, 4 aa, Plasmodium falciparum
EQDR

SEQ ID NO: 3218669 - protein, 15 aa, Plasmodium falciparum
EQDTEEKGNTQNKEK

SEQ ID NO: 3218670 - protein, 4 aa, Plasmodium falciparum
EQED

SEQ ID NO: 3218671 - protein, 11 aa, Plasmodium falciparum
EQEDIPQPDVS

SEQ ID NO: 3218672 - protein, 8 aa, Plasmodium falciparum
EQEENDDD

SEQ ID NO: 3218673 - protein, 6 aa, Plasmodium falciparum
EQEENK

SEQ ID NO: 3218674 - protein, 6 aa, Plasmodium falciparum
EQEEQK

SEQ ID NO: 3218675 - protein, 10 aa, Plasmodium falciparum
EQEGEKKRSD

SEQ ID NO: 3218676 - protein, 7 aa, Plasmodium falciparum
EQEGENM

SEQ ID NO: 3218677 - protein, 19 aa, Plasmodium falciparum
EQEGSGKDESEAKESFTEE

SEQ ID NO: 3218678 - protein, 28 aa, Plasmodium falciparum
EQEGSNTEVAEDVEEKESASDEHEQEDV

SEQ ID NO: 3218679 - protein, 5 aa, Plasmodium falciparum
EQEHE

SEQ ID NO: 3218680 - protein, 5 aa, Plasmodium falciparum
EQEIK

SEQ ID NO: 3218681 - protein, 7 aa, Plasmodium falciparum
EQEKHTS

SEQ ID NO: 3218682 - protein, 14 aa, Plasmodium falciparum
EQEKIKGKKKYFNK

SEQ ID NO: 3218683 - protein, 15 aa, Plasmodium falciparum
EQEKKNNKPTYKNYT

SEQ ID NO: 3218684 - protein, 7 aa, Plasmodium falciparum
EQEKKST

SEQ ID NO: 3218685 - protein, 4 aa, Plasmodium falciparum
EQEN

SEQ ID NO: 3218686 - protein, 5 aa, Plasmodium falciparum
EQENN

SEQ ID NO: 3218687 - protein, 18 aa, Plasmodium falciparum
EQENQNDSADSKNSNTEY

SEQ ID NO: 3218688 - protein, 13 aa, Plasmodium falciparum
EQEQDEENNKDTY

SEQ ID NO: 3218689 - protein, 13 aa, Plasmodium falciparum
EQEQISDPSSNKT

SEQ ID NO: 3218690 - protein, 8 aa, Plasmodium falciparum
EQEQNLQS

SEQ ID NO: 3218691 - protein, 7 aa, Plasmodium falciparum
EQEQNYK

SEQ ID NO: 3218692 - protein, 20 aa, Plasmodium falciparum
EQERTNSCRRTKEEKKKPNC

SEQ ID NO: 3218693 - protein, 47 aa, Plasmodium falciparum
EQESMNENNENNEENENNEENEENENNENNENNENNEEIKEKEPNTF

SEQ ID NO: 3218694 - protein, 40 aa, Plasmodium falciparum
EQESYSSNEKIRKDYSDDNNYEPTPSYEKRKKEYGKDESY

SEQ ID NO: 3218695 - protein, 4 aa, Plasmodium falciparum
EQET

SEQ ID NO: 3218696 - protein, 7 aa, Plasmodium falciparum
EQEYSKN

SEQ ID NO: 3218697 - protein, 12 aa, Plasmodium falciparum
EQFENPDDENLK

SEQ ID NO: 3218698 - protein, 4 aa, Plasmodium falciparum
EQFT

SEQ ID NO: 3218699 - protein, 8 aa, Plasmodium falciparum
EQGENEEL

SEQ ID NO: 3218700 - protein, 5 aa, Plasmodium falciparum
EQGGE

SEQ ID NO: 3218701 - protein, 6 aa, Plasmodium falciparum
EQGGSI

SEQ ID NO: 3218702 - protein, 9 aa, Plasmodium falciparum
EQGLEGNEN

SEQ ID NO: 3218703 - protein, 12 aa, Plasmodium falciparum
EQGLTGGLPGLS

SEQ ID NO: 3218704 - protein, 21 aa, Plasmodium falciparum
EQGPPAKKIRKNDDTDNEMEK

SEQ ID NO: 3218705 - protein, 4 aa, Plasmodium falciparum
EQGQ

SEQ ID NO: 3218706 - protein, 6 aa, Plasmodium falciparum
EQGSVT

SEQ ID NO: 3218707 - protein, 7 aa, Plasmodium falciparum
EQGTEEE

SEQ ID NO: 3218708 - protein, 5 aa, Plasmodium falciparum
EQHKN

SEQ ID NO: 3218709 - protein, 8 aa, Plasmodium falciparum
EQHKQNEE

SEQ ID NO: 3218710 - protein, 7 aa, Plasmodium falciparum
EQHNESY

SEQ ID NO: 3218711 - protein, 12 aa, Plasmodium falciparum
EQHNQQCNNSSY

SEQ ID NO: 3218712 - protein, 21 aa, Plasmodium falciparum
EQIGTNQNISYTNNKYDHNKY

SEQ ID NO: 3218713 - protein, 4 aa, Plasmodium falciparum
EQIN

SEQ ID NO: 3218714 - protein, 6 aa, Plasmodium falciparum
EQINKG

SEQ ID NO: 3218715 - protein, 6 aa, Plasmodium falciparum
EQINNN

SEQ ID NO: 3218716 - protein, 5 aa, Plasmodium falciparum
EQIRE

SEQ ID NO: 3218717 - protein, 10 aa, Plasmodium falciparum
EQKCDKHDKH

SEQ ID NO: 3218718 - protein, 32 aa, Plasmodium falciparum
EQKEDDNKSDNPLYSNNNTLKEQNTSTPLPSH

SEQ ID NO: 3218719 - protein, 7 aa, Plasmodium falciparum
EQKEEIK

SEQ ID NO: 3218720 - protein, 10 aa, Plasmodium falciparum
EQKEGDEEER

SEQ ID NO: 3218721 - protein, 8 aa, Plasmodium falciparum
EQKEIDPL

SEQ ID NO: 3218722 - protein, 13 aa, Plasmodium falciparum
EQKELKDNESFSE

SEQ ID NO: 3218723 - protein, 10 aa, Plasmodium falciparum
EQKKDTPQIE

SEQ ID NO: 3218724 - protein, 8 aa, Plasmodium falciparum
EQKKEYND

SEQ ID NO: 3218725 - protein, 9 aa, Plasmodium falciparum
EQKKSPNYN

SEQ ID NO: 3218726 - protein, 9 aa, Plasmodium falciparum
EQKKYEKEA

SEQ ID NO: 3218727 - protein, 39 aa, Plasmodium falciparum
EQKLREEQEKNKDNKKNDTNNQTNDLNSNKDETSGSQVT

SEQ ID NO: 3218728 - protein, 6 aa, Plasmodium falciparum
EQKNEN

SEQ ID NO: 3218729 - protein, 10 aa, Plasmodium falciparum
EQKNKKNNYI

SEQ ID NO: 3218730 - protein, 8 aa, Plasmodium falciparum
EQKNTISN

SEQ ID NO: 3218731 - protein, 16 aa, Plasmodium falciparum
EQKQDDVKNKNVENED

SEQ ID NO: 3218732 - protein, 4 aa, Plasmodium falciparum
EQKR

SEQ ID NO: 3218733 - protein, 23 aa, Plasmodium falciparum
EQKRNNNNNNNNNNNNNNNNKCD

SEQ ID NO: 3218734 - protein, 13 aa, Plasmodium falciparum
EQKSQRTNSSNEM

SEQ ID NO: 3218735 - protein, 9 aa, Plasmodium falciparum
EQKSVNEEV

SEQ ID NO: 3218736 - protein, 4 aa, Plasmodium falciparum
EQKT

SEQ ID NO: 3218737 - protein, 5 aa, Plasmodium falciparum
EQKYK

SEQ ID NO: 3218738 - protein, 4 aa, Plasmodium falciparum
EQLN

SEQ ID NO: 3218739 - protein, 10 aa, Plasmodium falciparum
EQLNEKENKN

SEQ ID NO: 3218740 - protein, 6 aa, Plasmodium falciparum
EQMADK

SEQ ID NO: 3218741 - protein, 39 aa, Plasmodium falciparum
EQMKENSSYQNSQSCSNTSSVGFTNEDPTKRRNKEKNNL

SEQ ID NO: 3218742 - protein, 50 aa, Plasmodium falciparum
EQNDFAKEGYSREYDSKYNSAEFGTSRKKNDGRNPFNYQSNNENNKPASY

SEQ ID NO: 3218743 - protein, 10 aa, Plasmodium falciparum
EQNDHDDDIN

SEQ ID NO: 3218744 - protein, 10 aa, Plasmodium falciparum
EQNDHESSSS

SEQ ID NO: 3218745 - protein, 8 aa, Plasmodium falciparum
EQNDNKKE

SEQ ID NO: 3218746 - protein, 7 aa, Plasmodium falciparum
EQNDNTI

SEQ ID NO: 3218747 - protein, 13 aa, Plasmodium falciparum
EQNDQSNNSNEDS

SEQ ID NO: 3218748 - protein, 12 aa, Plasmodium falciparum
EQNDYDNNQTVN

SEQ ID NO: 3218749 - protein, 7 aa, Plasmodium falciparum
EQNEAPY

SEQ ID NO: 3218750 - protein, 7 aa, Plasmodium falciparum
EQNEDDN

SEQ ID NO: 3218751 - protein, 5 aa, Plasmodium falciparum
EQNEK

SEQ ID NO: 3218752 - protein, 7 aa, Plasmodium falciparum
EQNEKNE

SEQ ID NO: 3218753 - protein, 57 aa, Plasmodium falciparum
EQNENHNNSSRNNSLQNITNDKKNENLNNKIKSGKQDEQKEQEEKEEKEEKKENIKI

SEQ ID NO: 3218754 - protein, 23 aa, Plasmodium falciparum
EQNEQDDNNITNEMNEKKNSGIM

SEQ ID NO: 3218755 - protein, 43 aa, Plasmodium falciparum
EQNEQNEQNDQNDQNEQNEQYEQNEQNEQNEQYEQNEQSEQNN

SEQ ID NO: 3218756 - protein, 24 aa, Plasmodium falciparum
EQNEQNEQNEQYEQYEQHEQNNEN

SEQ ID NO: 3218757 - protein, 13 aa, Plasmodium falciparum
EQNGEVQKNETSN

SEQ ID NO: 3218758 - protein, 5 aa, Plasmodium falciparum
EQNGK

SEQ ID NO: 3218759 - protein, 21 aa, Plasmodium falciparum
EQNGNSKKNNSTLVNTNPNDL

SEQ ID NO: 3218760 - protein, 6 aa, Plasmodium falciparum
EQNHNN

SEQ ID NO: 3218761 - protein, 8 aa, Plasmodium falciparum
EQNHTKPT

SEQ ID NO: 3218762 - protein, 11 aa, Plasmodium falciparum
EQNIQTKKGNI

SEQ ID NO: 3218763 - protein, 5 aa, Plasmodium falciparum
EQNIS

SEQ ID NO: 3218764 - protein, 13 aa, Plasmodium falciparum
EQNKETNIQQNDH

SEQ ID NO: 3218765 - protein, 5 aa, Plasmodium falciparum
EQNKH

SEQ ID NO: 3218766 - protein, 14 aa, Plasmodium falciparum
EQNKQRGGKNYGKI

SEQ ID NO: 3218767 - protein, 9 aa, Plasmodium falciparum
EQNKQTIKY

SEQ ID NO: 3218768 - protein, 6 aa, Plasmodium falciparum
EQNKTS

SEQ ID NO: 3218769 - protein, 6 aa, Plasmodium falciparum
EQNNIK

SEQ ID NO: 3218770 - protein, 12 aa, Plasmodium falciparum
EQNNKPKNDYQY

SEQ ID NO: 3218771 - protein, 20 aa, Plasmodium falciparum
EQNNNLENSNITYEDDEVQN

SEQ ID NO: 3218772 - protein, 36 aa, Plasmodium falciparum
EQNQKEDVSTKKKKIKKNNNNDNNNDDKDGNSEANL

SEQ ID NO: 3218773 - protein, 22 aa, Plasmodium falciparum
EQNRSDGSSSGGGGKNSNNQEL

SEQ ID NO: 3218774 - protein, 7 aa, Plasmodium falciparum
EQNSEEY

SEQ ID NO: 3218775 - protein, 7 aa, Plasmodium falciparum
EQNSKKD

SEQ ID NO: 3218776 - protein, 7 aa, Plasmodium falciparum
EQNSQNQ

SEQ ID NO: 3218777 - protein, 5 aa, Plasmodium falciparum
EQNVN

SEQ ID NO: 3218778 - protein, 10 aa, Plasmodium falciparum
EQNVTSKENI

SEQ ID NO: 3218779 - protein, 13 aa, Plasmodium falciparum
EQNYQAKEKDPNI

SEQ ID NO: 3218780 - protein, 5 aa, Plasmodium falciparum
EQPEA

SEQ ID NO: 3218781 - protein, 6 aa, Plasmodium falciparum
EQPKDD

SEQ ID NO: 3218782 - protein, 10 aa, Plasmodium falciparum
EQPTEMSSKQ

SEQ ID NO: 3218783 - protein, 11 aa, Plasmodium falciparum
EQQENNNCNNN

SEQ ID NO: 3218784 - protein, 9 aa, Plasmodium falciparum
EQQHCGKEN

SEQ ID NO: 3218785 - protein, 6 aa, Plasmodium falciparum
EQQHEN

SEQ ID NO: 3218786 - protein, 34 aa, Plasmodium falciparum
EQQHHENSNSVNKDHTQNIQNEEKKITNDSSSTI

SEQ ID NO: 3218787 - protein, 7 aa, Plasmodium falciparum
EQQHTEI

SEQ ID NO: 3218788 - protein, 11 aa, Plasmodium falciparum
EQQLNKEKEEM

SEQ ID NO: 3218789 - protein, 36 aa, Plasmodium falciparum
EQQQQQKKKKKEEEEEEEEEEEEEEEKKKKNKENVL

SEQ ID NO: 3218790 - protein, 22 aa, Plasmodium falciparum
EQQQQQQEEQEEQKKKKEECEY

SEQ ID NO: 3218791 - protein, 7 aa, Plasmodium falciparum
EQRGANN

SEQ ID NO: 3218792 - protein, 14 aa, Plasmodium falciparum
EQRIEQDEKKEKHQ

SEQ ID NO: 3218793 - protein, 4 aa, Plasmodium falciparum
EQRL

SEQ ID NO: 3218794 - protein, 14 aa, Plasmodium falciparum
EQRTGTNEVAEARS

SEQ ID NO: 3218795 - protein, 14 aa, Plasmodium falciparum
EQSEEEKKKCKSAC

SEQ ID NO: 3218796 - protein, 7 aa, Plasmodium falciparum
EQSFKNN

SEQ ID NO: 3218797 - protein, 19 aa, Plasmodium falciparum
EQSKNENIITKGEGEEVEF

SEQ ID NO: 3218798 - protein, 34 aa, Plasmodium falciparum
EQSNESNNNNNNNNNNNNNNNNINNNGNKNNYGN

SEQ ID NO: 3218799 - protein, 24 aa, Plasmodium falciparum
EQSNNNNNNNNNNNNINNNNNNNN

SEQ ID NO: 3218800 - protein, 7 aa, Plasmodium falciparum
EQSPLSS

SEQ ID NO: 3218801 - protein, 4 aa, Plasmodium falciparum
EQSS

SEQ ID NO: 3218802 - protein, 10 aa, Plasmodium falciparum
EQSSETYNTE

SEQ ID NO: 3218803 - protein, 10 aa, Plasmodium falciparum
EQSSNKKELK

SEQ ID NO: 3218804 - protein, 16 aa, Plasmodium falciparum
EQSTLPKHSNKSVRKK

SEQ ID NO: 3218805 - protein, 9 aa, Plasmodium falciparum
EQSYNNYTK

SEQ ID NO: 3218806 - protein, 12 aa, Plasmodium falciparum
EQTHKKSKDEGY

SEQ ID NO: 3218807 - protein, 4 aa, Plasmodium falciparum
EQTI

SEQ ID NO: 3218808 - protein, 5 aa, Plasmodium falciparum
EQTIG

SEQ ID NO: 3218809 - protein, 4 aa, Plasmodium falciparum
EQTL

SEQ ID NO: 3218810 - protein, 4 aa, Plasmodium falciparum
EQTN

SEQ ID NO: 3218811 - protein, 22 aa, Plasmodium falciparum
EQTNEHKETGQSDLNHEKKEES

SEQ ID NO: 3218812 - protein, 6 aa, Plasmodium falciparum
EQTNNN

SEQ ID NO: 3218813 - protein, 11 aa, Plasmodium falciparum
EQTNSMERNKK

SEQ ID NO: 3218814 - protein, 5 aa, Plasmodium falciparum
EQTSE

SEQ ID NO: 3218815 - protein, 24 aa, Plasmodium falciparum
EQTSQYSQETLSENSSSSLEATNK

SEQ ID NO: 3218816 - protein, 7 aa, Plasmodium falciparum
EQTTGEI

SEQ ID NO: 3218817 - protein, 19 aa, Plasmodium falciparum
EQTVDDTNGTIEKNGDGNI

SEQ ID NO: 3218818 - protein, 6 aa, Plasmodium falciparum
EQTYEQ

SEQ ID NO: 3218819 - protein, 10 aa, Plasmodium falciparum
EQTYSKNNNL

SEQ ID NO: 3218820 - protein, 6 aa, Plasmodium falciparum
EQTYSS

SEQ ID NO: 3218821 - protein, 4 aa, Plasmodium falciparum
EQVC

SEQ ID NO: 3218822 - protein, 23 aa, Plasmodium falciparum
EQVENSKMENGNKKICDGEKDMN

SEQ ID NO: 3218823 - protein, 5 aa, Plasmodium falciparum
EQVNE

SEQ ID NO: 3218824 - protein, 6 aa, Plasmodium falciparum
EQVNNK

SEQ ID NO: 3218825 - protein, 28 aa, Plasmodium falciparum
EQVNQTKHSNNNIKEEIKTNGSNKLSDN

SEQ ID NO: 3218826 - protein, 24 aa, Plasmodium falciparum
EQVSTEKNDLQKMSKKKDDKINNY

SEQ ID NO: 3218827 - protein, 4 aa, Plasmodium falciparum
EQVT

SEQ ID NO: 3218828 - protein, 24 aa, Plasmodium falciparum
EQYDKQKKKSKKIKKQQKKKNMYK

SEQ ID NO: 3218829 - protein, 5 aa, Plasmodium falciparum
EQYDS

SEQ ID NO: 3218830 - protein, 9 aa, Plasmodium falciparum
EQYEKQPDL

SEQ ID NO: 3218831 - protein, 4 aa, Plasmodium falciparum
EQYK

SEQ ID NO: 3218832 - protein, 9 aa, Plasmodium falciparum
EQYNEENMN

SEQ ID NO: 3218833 - protein, 10 aa, Plasmodium falciparum
EQYNKDDESA

SEQ ID NO: 3218834 - protein, 6 aa, Plasmodium falciparum
EQYNPS

SEQ ID NO: 3218835 - protein, 18 aa, Plasmodium falciparum
EQYNPSSCLTGGSGADNS

SEQ ID NO: 3218836 - protein, 4 aa, Plasmodium falciparum
EQYP

SEQ ID NO: 3218837 - protein, 9 aa, Plasmodium falciparum
EQYTQEEYP

SEQ ID NO: 3218838 - protein, 7 aa, Plasmodium falciparum
EQYTQEY

SEQ ID NO: 3218839 - protein, 18 aa, Plasmodium falciparum
ERAKNTDLSVNNNPRINE

SEQ ID NO: 3218840 - protein, 4 aa, Plasmodium falciparum
ERAL

SEQ ID NO: 3218841 - protein, 22 aa, Plasmodium falciparum
ERCAEKKYEKKDKQKEKNMNEY

SEQ ID NO: 3218842 - protein, 41 aa, Plasmodium falciparum
ERCAGKVDNTNGGNKTNEPNEPNGPNGPNEPNEPNEPNIPY

SEQ ID NO: 3218843 - protein, 4 aa, Plasmodium falciparum
ERDF

SEQ ID NO: 3218844 - protein, 8 aa, Plasmodium falciparum
ERDHNNTT

SEQ ID NO: 3218845 - protein, 51 aa, Plasmodium falciparum
ERDKEDGHDNENKDEDKNKKHSNSNNNNNDGNDYDNDGSLHQHNTDNRRRT

SEQ ID NO: 3218846 - protein, 18 aa, Plasmodium falciparum
ERDKKKEINNNNNNNNIC

SEQ ID NO: 3218847 - protein, 7 aa, Plasmodium falciparum
ERDNSKP

SEQ ID NO: 3218848 - protein, 8 aa, Plasmodium falciparum
ERDTYSKS

SEQ ID NO: 3218849 - protein, 5 aa, Plasmodium falciparum
EREDY

SEQ ID NO: 3218850 - protein, 5 aa, Plasmodium falciparum
EREEN

SEQ ID NO: 3218851 - protein, 4 aa, Plasmodium falciparum
EREF

SEQ ID NO: 3218852 - protein, 5 aa, Plasmodium falciparum
EREFR

SEQ ID NO: 3218853 - protein, 6 aa, Plasmodium falciparum
EREFSD

SEQ ID NO: 3218854 - protein, 4 aa, Plasmodium falciparum
EREI

SEQ ID NO: 3218855 - protein, 22 aa, Plasmodium falciparum
EREKKDKNIKKRKKYNKKNFNP

SEQ ID NO: 3218856 - protein, 9 aa, Plasmodium falciparum
EREKKEEVV

SEQ ID NO: 3218857 - protein, 8 aa, Plasmodium falciparum
EREKMKKE

SEQ ID NO: 3218858 - protein, 18 aa, Plasmodium falciparum
EREKNSQNEIYEREKNSI

SEQ ID NO: 3218859 - protein, 16 aa, Plasmodium falciparum
ERENKQVPQKYTQDEK

SEQ ID NO: 3218860 - protein, 7 aa, Plasmodium falciparum
ERENTIK

SEQ ID NO: 3218861 - protein, 46 aa, Plasmodium falciparum
ERERKKKNKIKEKDNNNDNNNDDNNNDNNNDNNNEEEEKKNYKKEG

SEQ ID NO: 3218862 - protein, 6 aa, Plasmodium falciparum
ERESKR

SEQ ID NO: 3218863 - protein, 6 aa, Plasmodium falciparum
ERESSN

SEQ ID NO: 3218864 - protein, 4 aa, Plasmodium falciparum
ERET

SEQ ID NO: 3218865 - protein, 5 aa, Plasmodium falciparum
ERETD

SEQ ID NO: 3218866 - protein, 5 aa, Plasmodium falciparum
ERETY

SEQ ID NO: 3218867 - protein, 6 aa, Plasmodium falciparum
ERFGNE

SEQ ID NO: 3218868 - protein, 5 aa, Plasmodium falciparum
ERGEA

SEQ ID NO: 3218869 - protein, 9 aa, Plasmodium falciparum
ERGHSTANM

SEQ ID NO: 3218870 - protein, 4 aa, Plasmodium falciparum
ERGK

SEQ ID NO: 3218871 - protein, 27 aa, Plasmodium falciparum
ERGSRSALKGDASQGQYDRGGKADDFK

SEQ ID NO: 3218872 - protein, 9 aa, Plasmodium falciparum
ERGTSGPQF

SEQ ID NO: 3218873 - protein, 22 aa, Plasmodium falciparum
ERHQGDGSNNSTKQKRSKKRTK

SEQ ID NO: 3218874 - protein, 4 aa, Plasmodium falciparum
ERIC

SEQ ID NO: 3218875 - protein, 6 aa, Plasmodium falciparum
ERIEGN

SEQ ID NO: 3218876 - protein, 17 aa, Plasmodium falciparum
ERIKSSSNNITEHSKQT

SEQ ID NO: 3218877 - protein, 15 aa, Plasmodium falciparum
ERIQDKRKQFKEQCE

SEQ ID NO: 3218878 - protein, 6 aa, Plasmodium falciparum
ERITKE

SEQ ID NO: 3218879 - protein, 6 aa, Plasmodium falciparum
ERKDDE

SEQ ID NO: 3218880 - protein, 25 aa, Plasmodium falciparum
ERKDDNNKDDDNKDDDNNKNVNHNN

SEQ ID NO: 3218881 - protein, 48 aa, Plasmodium falciparum
ERKEKKKEKKKKKKKKNEYDKHNNNATNLDNNYNNDSQCSSSDTSDDE

SEQ ID NO: 3218882 - protein, 7 aa, Plasmodium falciparum
ERKHKNR

SEQ ID NO: 3218883 - protein, 4 aa, Plasmodium falciparum
ERKI

SEQ ID NO: 3218884 - protein, 14 aa, Plasmodium falciparum
ERKIDNQEHNQKVK

SEQ ID NO: 3218885 - protein, 10 aa, Plasmodium falciparum
ERKKETSEIK

SEQ ID NO: 3218886 - protein, 25 aa, Plasmodium falciparum
ERKKGNDNNNKKKKKKKKENNTNTI

SEQ ID NO: 3218887 - protein, 11 aa, Plasmodium falciparum
ERKKKDQRKRN

SEQ ID NO: 3218888 - protein, 31 aa, Plasmodium falciparum
ERKKKEEKVGSACKNDYEGCANTKDNGNGNC

SEQ ID NO: 3218889 - protein, 12 aa, Plasmodium falciparum
ERKKKKKNHSFG

SEQ ID NO: 3218890 - protein, 15 aa, Plasmodium falciparum
ERKKKKQSHNHHDDD

SEQ ID NO: 3218891 - protein, 8 aa, Plasmodium falciparum
ERKKKQSK

SEQ ID NO: 3218892 - protein, 5 aa, Plasmodium falciparum
ERKKN

SEQ ID NO: 3218893 - protein, 12 aa, Plasmodium falciparum
ERKLKRRAQGKK

SEQ ID NO: 3218894 - protein, 89 aa, Plasmodium falciparum
ERKNQKKKKKRKRRRKKKNVEGGENEGKPKQTIEGGEASDKCSINDQKGGKEYNKEGEREKEEEEEEEDDDEYDEYDEDDVEEEIDEEE

SEQ ID NO: 3218895 - protein, 5 aa, Plasmodium falciparum
ERKNV

SEQ ID NO: 3218896 - protein, 47 aa, Plasmodium falciparum
ERKPREDMNTKYKNDDINNNDVKDYGKDKSKNKLLSNKNKVKQINQE

SEQ ID NO: 3218897 - protein, 20 aa, Plasmodium falciparum
ERKRGVKKNSNYKKEESKIN

SEQ ID NO: 3218898 - protein, 7 aa, Plasmodium falciparum
ERKRKKG

SEQ ID NO: 3218899 - protein, 8 aa, Plasmodium falciparum
ERKRTHKK

SEQ ID NO: 3218900 - protein, 5 aa, Plasmodium falciparum
ERKSD

SEQ ID NO: 3218901 - protein, 8 aa, Plasmodium falciparum
ERKSSDSS

SEQ ID NO: 3218902 - protein, 5 aa, Plasmodium falciparum
ERKTN

SEQ ID NO: 3218903 - protein, 9 aa, Plasmodium falciparum
ERKYKNNFK

SEQ ID NO: 3218904 - protein, 4 aa, Plasmodium falciparum
ERLY

SEQ ID NO: 3218905 - protein, 17 aa, Plasmodium falciparum
ERMKDKRKKRKEERNKN

SEQ ID NO: 3218906 - protein, 16 aa, Plasmodium falciparum
ERMQGKRQKCKEQCDK

SEQ ID NO: 3218907 - protein, 4 aa, Plasmodium falciparum
ERNA

SEQ ID NO: 3218908 - protein, 8 aa, Plasmodium falciparum
ERNDKGKN

SEQ ID NO: 3218909 - protein, 24 aa, Plasmodium falciparum
ERNEEDVDKKKNTKENDESTKTTI

SEQ ID NO: 3218910 - protein, 18 aa, Plasmodium falciparum
ERNEENIKKKKNNKKSNH

SEQ ID NO: 3218911 - protein, 12 aa, Plasmodium falciparum
ERNEKKSSLSSF

SEQ ID NO: 3218912 - protein, 17 aa, Plasmodium falciparum
ERNESKAENKGACVPPR

SEQ ID NO: 3218913 - protein, 16 aa, Plasmodium falciparum
ERNGSGWEEKSGGTCD

SEQ ID NO: 3218914 - protein, 4 aa, Plasmodium falciparum
ERNM

SEQ ID NO: 3218915 - protein, 11 aa, Plasmodium falciparum
ERNNKEEKQMN

SEQ ID NO: 3218916 - protein, 7 aa, Plasmodium falciparum
ERNNSVS

SEQ ID NO: 3218917 - protein, 15 aa, Plasmodium falciparum
ERNYGDEDDDEENLE

SEQ ID NO: 3218918 - protein, 6 aa, Plasmodium falciparum
ERPNDN

SEQ ID NO: 3218919 - protein, 7 aa, Plasmodium falciparum
ERPNRFG

SEQ ID NO: 3218920 - protein, 7 aa, Plasmodium falciparum
ERPYPVK

SEQ ID NO: 3218921 - protein, 5 aa, Plasmodium falciparum
ERPYY

SEQ ID NO: 3218922 - protein, 32 aa, Plasmodium falciparum
ERQEKKNKNKNNYNNDNNIRTYQNHSKNKEHE

SEQ ID NO: 3218923 - protein, 5 aa, Plasmodium falciparum
ERQEV

SEQ ID NO: 3218924 - protein, 14 aa, Plasmodium falciparum
ERQKKKFKKWTSEN

SEQ ID NO: 3218925 - protein, 8 aa, Plasmodium falciparum
ERQRNKSI

SEQ ID NO: 3218926 - protein, 8 aa, Plasmodium falciparum
ERRKAKEK

SEQ ID NO: 3218927 - protein, 7 aa, Plasmodium falciparum
ERRKGKK

SEQ ID NO: 3218928 - protein, 5 aa, Plasmodium falciparum
ERRKK

SEQ ID NO: 3218929 - protein, 7 aa, Plasmodium falciparum
ERRKKKK

SEQ ID NO: 3218930 - protein, 8 aa, Plasmodium falciparum
ERRKYENL

SEQ ID NO: 3218931 - protein, 18 aa, Plasmodium falciparum
ERRRECKDETEKSNEKNI

SEQ ID NO: 3218932 - protein, 19 aa, Plasmodium falciparum
ERRRNSYQTKRKKSIDKQQ

SEQ ID NO: 3218933 - protein, 8 aa, Plasmodium falciparum
ERRTKEER

SEQ ID NO: 3218934 - protein, 12 aa, Plasmodium falciparum
ERSETNSQNHPY

SEQ ID NO: 3218935 - protein, 17 aa, Plasmodium falciparum
ERSGDKSGKGTENGESV

SEQ ID NO: 3218936 - protein, 6 aa, Plasmodium falciparum
ERSLEE

SEQ ID NO: 3218937 - protein, 5 aa, Plasmodium falciparum
ERSPS

SEQ ID NO: 3218938 - protein, 8 aa, Plasmodium falciparum
ERSSTDEI

SEQ ID NO: 3218939 - protein, 7 aa, Plasmodium falciparum
ERSVEKR

SEQ ID NO: 3218940 - protein, 11 aa, Plasmodium falciparum
ERTCDEEKRNK

SEQ ID NO: 3218941 - protein, 8 aa, Plasmodium falciparum
ERTGGESQ

SEQ ID NO: 3218942 - protein, 4 aa, Plasmodium falciparum
ERTK

SEQ ID NO: 3218943 - protein, 11 aa, Plasmodium falciparum
ERTKNKNNNVN

SEQ ID NO: 3218944 - protein, 6 aa, Plasmodium falciparum
ERTSER

SEQ ID NO: 3218945 - protein, 7 aa, Plasmodium falciparum
ERTSQRF

SEQ ID NO: 3218946 - protein, 5 aa, Plasmodium falciparum
ERTTD

SEQ ID NO: 3218947 - protein, 5 aa, Plasmodium falciparum
ERTTN

SEQ ID NO: 3218948 - protein, 6 aa, Plasmodium falciparum
ERVSYN

SEQ ID NO: 3218949 - protein, 14 aa, Plasmodium falciparum
ERVTENNTETRKHS

SEQ ID NO: 3218950 - protein, 5 aa, Plasmodium falciparum
ERYKG

SEQ ID NO: 3218951 - protein, 5 aa, Plasmodium falciparum
ERYNK

SEQ ID NO: 3218952 - protein, 9 aa, Plasmodium falciparum
ESAGTDDPC

SEQ ID NO: 3218953 - protein, 10 aa, Plasmodium falciparum
ESAGTDDPCQ

SEQ ID NO: 3218954 - protein, 8 aa, Plasmodium falciparum
ESAGTTDT

SEQ ID NO: 3218955 - protein, 9 aa, Plasmodium falciparum
ESAHTTEPC

SEQ ID NO: 3218956 - protein, 6 aa, Plasmodium falciparum
ESALSK

SEQ ID NO: 3218957 - protein, 5 aa, Plasmodium falciparum
ESCHD

SEQ ID NO: 3218958 - protein, 8 aa, Plasmodium falciparum
ESCKNDDN

SEQ ID NO: 3218959 - protein, 4 aa, Plasmodium falciparum
ESDA

SEQ ID NO: 3218960 - protein, 20 aa, Plasmodium falciparum
ESDEDDQKALSSNSKAITQI

SEQ ID NO: 3218961 - protein, 19 aa, Plasmodium falciparum
ESDEDIDELSESKEDKDDD

SEQ ID NO: 3218962 - protein, 16 aa, Plasmodium falciparum
ESDGKKPKKDKYGDYD

SEQ ID NO: 3218963 - protein, 4 aa, Plasmodium falciparum
ESDI

SEQ ID NO: 3218964 - protein, 11 aa, Plasmodium falciparum
ESDKKEKCKEI

SEQ ID NO: 3218965 - protein, 10 aa, Plasmodium falciparum
ESDKTETQEC

SEQ ID NO: 3218966 - protein, 10 aa, Plasmodium falciparum
ESDNSDVSSV

SEQ ID NO: 3218967 - protein, 17 aa, Plasmodium falciparum
ESDNTTTNEDKSSSSDV

SEQ ID NO: 3218968 - protein, 7 aa, Plasmodium falciparum
ESDNYKD

SEQ ID NO: 3218969 - protein, 9 aa, Plasmodium falciparum
ESDPMNNGS

SEQ ID NO: 3218970 - protein, 5 aa, Plasmodium falciparum
ESDSI

SEQ ID NO: 3218971 - protein, 6 aa, Plasmodium falciparum
ESDYGK

SEQ ID NO: 3218972 - protein, 18 aa, Plasmodium falciparum
ESEDISNTLKEKNNMKTG

SEQ ID NO: 3218973 - protein, 6 aa, Plasmodium falciparum
ESEDKN

SEQ ID NO: 3218974 - protein, 7 aa, Plasmodium falciparum
ESEDLNR

SEQ ID NO: 3218975 - protein, 8 aa, Plasmodium falciparum
ESEDNDEY

SEQ ID NO: 3218976 - protein, 4 aa, Plasmodium falciparum
ESEE

SEQ ID NO: 3218977 - protein, 8 aa, Plasmodium falciparum
ESEEFPKE

SEQ ID NO: 3218978 - protein, 5 aa, Plasmodium falciparum
ESEEL

SEQ ID NO: 3218979 - protein, 17 aa, Plasmodium falciparum
ESEENQEAGAGANGKKN

SEQ ID NO: 3218980 - protein, 13 aa, Plasmodium falciparum
ESEGNNKEKLNKA

SEQ ID NO: 3218981 - protein, 5 aa, Plasmodium falciparum
ESEGY

SEQ ID NO: 3218982 - protein, 5 aa, Plasmodium falciparum
ESEHS

SEQ ID NO: 3218983 - protein, 4 aa, Plasmodium falciparum
ESEK

SEQ ID NO: 3218984 - protein, 14 aa, Plasmodium falciparum
ESEKEKQKKKKNNI

SEQ ID NO: 3218985 - protein, 7 aa, Plasmodium falciparum
ESEKERK

SEQ ID NO: 3218986 - protein, 8 aa, Plasmodium falciparum
ESEKKNNV

SEQ ID NO: 3218987 - protein, 26 aa, Plasmodium falciparum
ESEKKRIETNNTPSIKNKQNIDNKNK

SEQ ID NO: 3218988 - protein, 7 aa, Plasmodium falciparum
ESEKNMN

SEQ ID NO: 3218989 - protein, 52 aa, Plasmodium falciparum
ESEKNPSVDKSEKNPSVDKSEKNPSVDKSEKNYEETQDNNLENTSSSDNNIN

SEQ ID NO: 3218990 - protein, 7 aa, Plasmodium falciparum
ESEKSPL

SEQ ID NO: 3218991 - protein, 9 aa, Plasmodium falciparum
ESELNEEKD

SEQ ID NO: 3218992 - protein, 8 aa, Plasmodium falciparum
ESENLDND

SEQ ID NO: 3218993 - protein, 10 aa, Plasmodium falciparum
ESENTVSSNN

SEQ ID NO: 3218994 - protein, 5 aa, Plasmodium falciparum
ESENY

SEQ ID NO: 3218995 - protein, 28 aa, Plasmodium falciparum
ESEPLTTSPPEHETSKMDTHAGGKNMEQ

SEQ ID NO: 3218996 - protein, 8 aa, Plasmodium falciparum
ESEQDHQN

SEQ ID NO: 3218997 - protein, 11 aa, Plasmodium falciparum
ESEQNEVKTST

SEQ ID NO: 3218998 - protein, 8 aa, Plasmodium falciparum
ESEQNYNN

SEQ ID NO: 3218999 - protein, 5 aa, Plasmodium falciparum
ESERK

SEQ ID NO: 3219000 - protein, 9 aa, Plasmodium falciparum
ESERRAQDI

SEQ ID NO: 3219001 - protein, 20 aa, Plasmodium falciparum
ESERRKQQEEENAKDIEEIR

SEQ ID NO: 3219002 - protein, 7 aa, Plasmodium falciparum
ESERTCK

SEQ ID NO: 3219003 - protein, 10 aa, Plasmodium falciparum
ESESNESDED

SEQ ID NO: 3219004 - protein, 7 aa, Plasmodium falciparum
ESESVNG

SEQ ID NO: 3219005 - protein, 17 aa, Plasmodium falciparum
ESETHQGEYKNSSSRNN

SEQ ID NO: 3219006 - protein, 4 aa, Plasmodium falciparum
ESEY

SEQ ID NO: 3219007 - protein, 5 aa, Plasmodium falciparum
ESEYD

SEQ ID NO: 3219008 - protein, 24 aa, Plasmodium falciparum
ESEYGKTSKGYYKNSSTMSSGGKV

SEQ ID NO: 3219009 - protein, 4 aa, Plasmodium falciparum
ESFE

SEQ ID NO: 3219010 - protein, 7 aa, Plasmodium falciparum
ESFLSQP

SEQ ID NO: 3219011 - protein, 11 aa, Plasmodium falciparum
ESFQDKSGKTR

SEQ ID NO: 3219012 - protein, 11 aa, Plasmodium falciparum
ESFSEENYKME

SEQ ID NO: 3219013 - protein, 5 aa, Plasmodium falciparum
ESFVG

SEQ ID NO: 3219014 - protein, 13 aa, Plasmodium falciparum
ESFVGDKDQNFDD

SEQ ID NO: 3219015 - protein, 5 aa, Plasmodium falciparum
ESGFN

SEQ ID NO: 3219016 - protein, 6 aa, Plasmodium falciparum
ESGKVG

SEQ ID NO: 3219017 - protein, 7 aa, Plasmodium falciparum
ESGLKKR

SEQ ID NO: 3219018 - protein, 48 aa, Plasmodium falciparum
ESGNVDDANGMNNVDDTNNMNNVDGTNNMNNVDGTNNMNNMDGRNNMN

SEQ ID NO: 3219019 - protein, 5 aa, Plasmodium falciparum
ESGQQ

SEQ ID NO: 3219020 - protein, 7 aa, Plasmodium falciparum
ESGQQKE

SEQ ID NO: 3219021 - protein, 9 aa, Plasmodium falciparum
ESGRCGRSG

SEQ ID NO: 3219022 - protein, 8 aa, Plasmodium falciparum
ESGSTNET

SEQ ID NO: 3219023 - protein, 14 aa, Plasmodium falciparum
ESGYYGGKNSQAHV

SEQ ID NO: 3219024 - protein, 4 aa, Plasmodium falciparum
ESHD

SEQ ID NO: 3219025 - protein, 4 aa, Plasmodium falciparum
ESHE

SEQ ID NO: 3219026 - protein, 7 aa, Plasmodium falciparum
ESHKKNN

SEQ ID NO: 3219027 - protein, 8 aa, Plasmodium falciparum
ESHSKNKK

SEQ ID NO: 3219028 - protein, 126 aa, Plasmodium falciparum
ESHSKSNGKSKVENNNKVKGEVKNRKSAKKCKSEKKHGDDYLGDDQQGKEDVHDDDKYKYDDNYDHEEDDYEDDYEDDYEDDYEDDYEDDYEDDYEDDYEDDYEDDYEDDYDDDYEDAYDEQKGHI

SEQ ID NO: 3219029 - protein, 59 aa, Plasmodium falciparum
ESHYKNKNNKNGNSNNNNNNNNNNNNEDEDDDNNQNNNNDNDGDDNNDNDNNEENNNID

SEQ ID NO: 3219030 - protein, 12 aa, Plasmodium falciparum
ESIGHKKKKASF

SEQ ID NO: 3219031 - protein, 34 aa, Plasmodium falciparum
ESIKNGDEFQKKDYKNGLEKKYGYPSGNSKKKNM

SEQ ID NO: 3219032 - protein, 11 aa, Plasmodium falciparum
ESINKNNVNPN

SEQ ID NO: 3219033 - protein, 5 aa, Plasmodium falciparum
ESINS

SEQ ID NO: 3219034 - protein, 7 aa, Plasmodium falciparum
ESIQRKT

SEQ ID NO: 3219035 - protein, 4 aa, Plasmodium falciparum
ESIR

SEQ ID NO: 3219036 - protein, 13 aa, Plasmodium falciparum
ESISTTDDEEDIE

SEQ ID NO: 3219037 - protein, 5 aa, Plasmodium falciparum
ESITK

SEQ ID NO: 3219038 - protein, 7 aa, Plasmodium falciparum
ESITTDE

SEQ ID NO: 3219039 - protein, 8 aa, Plasmodium falciparum
ESKDESNY

SEQ ID NO: 3219040 - protein, 9 aa, Plasmodium falciparum
ESKDKLNRA

SEQ ID NO: 3219041 - protein, 8 aa, Plasmodium falciparum
ESKDNKID

SEQ ID NO: 3219042 - protein, 23 aa, Plasmodium falciparum
ESKDTEVQNDEQKIDKNNEEDIK

SEQ ID NO: 3219043 - protein, 5 aa, Plasmodium falciparum
ESKDY

SEQ ID NO: 3219044 - protein, 4 aa, Plasmodium falciparum
ESKE

SEQ ID NO: 3219045 - protein, 8 aa, Plasmodium falciparum
ESKEDMGD

SEQ ID NO: 3219046 - protein, 6 aa, Plasmodium falciparum
ESKEGI

SEQ ID NO: 3219047 - protein, 8 aa, Plasmodium falciparum
ESKEKENM

SEQ ID NO: 3219048 - protein, 104 aa, Plasmodium falciparum
ESKETDESKETDESKETGESKETGESKETGESKETGESKETGESKETGESKETGESKETGESKETGESKETGESKETGESKETGESKETGESKETGESKETRIY

SEQ ID NO: 3219049 - protein, 5 aa, Plasmodium falciparum
ESKFQ

SEQ ID NO: 3219050 - protein, 8 aa, Plasmodium falciparum
ESKGKNKI

SEQ ID NO: 3219051 - protein, 6 aa, Plasmodium falciparum
ESKGLK

SEQ ID NO: 3219052 - protein, 12 aa, Plasmodium falciparum
ESKGQLKKRQKK

SEQ ID NO: 3219053 - protein, 9 aa, Plasmodium falciparum
ESKKKNKNN

SEQ ID NO: 3219054 - protein, 13 aa, Plasmodium falciparum
ESKKRNKKRNKKR

SEQ ID NO: 3219055 - protein, 11 aa, Plasmodium falciparum
ESKKSGQNDNC

SEQ ID NO: 3219056 - protein, 17 aa, Plasmodium falciparum
ESKLNESKLNESKLNEE

SEQ ID NO: 3219057 - protein, 5 aa, Plasmodium falciparum
ESKLY

SEQ ID NO: 3219058 - protein, 5 aa, Plasmodium falciparum
ESKNI

SEQ ID NO: 3219059 - protein, 10 aa, Plasmodium falciparum
ESKNKSRKYF

SEQ ID NO: 3219060 - protein, 28 aa, Plasmodium falciparum
ESKQVAQAQTTDTQTQVDAASTSTSQTS

SEQ ID NO: 3219061 - protein, 30 aa, Plasmodium falciparum
ESKQVTQPQEDGKAPLAPTPPTSSGSQSDP

SEQ ID NO: 3219062 - protein, 14 aa, Plasmodium falciparum
ESKTEKNIKKSVST

SEQ ID NO: 3219063 - protein, 6 aa, Plasmodium falciparum
ESKTEY

SEQ ID NO: 3219064 - protein, 12 aa, Plasmodium falciparum
ESKVKENHNKTN

SEQ ID NO: 3219065 - protein, 7 aa, Plasmodium falciparum
ESKYKSH

SEQ ID NO: 3219066 - protein, 4 aa, Plasmodium falciparum
ESLD

SEQ ID NO: 3219067 - protein, 8 aa, Plasmodium falciparum
ESLEDENS

SEQ ID NO: 3219068 - protein, 17 aa, Plasmodium falciparum
ESLEEGEKNKSGEEYNK

SEQ ID NO: 3219069 - protein, 7 aa, Plasmodium falciparum
ESLGNEK

SEQ ID NO: 3219070 - protein, 11 aa, Plasmodium falciparum
ESLHSKEDNKK

SEQ ID NO: 3219071 - protein, 11 aa, Plasmodium falciparum
ESLKNDSSGRF

SEQ ID NO: 3219072 - protein, 6 aa, Plasmodium falciparum
ESLQSK

SEQ ID NO: 3219073 - protein, 16 aa, Plasmodium falciparum
ESLQSKRKQCKDQCDK

SEQ ID NO: 3219074 - protein, 4 aa, Plasmodium falciparum
ESLT

SEQ ID NO: 3219075 - protein, 9 aa, Plasmodium falciparum
ESMDNNSTS

SEQ ID NO: 3219076 - protein, 6 aa, Plasmodium falciparum
ESMEGN

SEQ ID NO: 3219077 - protein, 8 aa, Plasmodium falciparum
ESMKNRYN

SEQ ID NO: 3219078 - protein, 8 aa, Plasmodium falciparum
ESMSEEEI

SEQ ID NO: 3219079 - protein, 36 aa, Plasmodium falciparum
ESNAENDDNNNNNNNNNNIGSSSSSSSSSNKEMINS

SEQ ID NO: 3219080 - protein, 10 aa, Plasmodium falciparum
ESNAKGYNKL

SEQ ID NO: 3219081 - protein, 5 aa, Plasmodium falciparum
ESNAT

SEQ ID NO: 3219082 - protein, 8 aa, Plasmodium falciparum
ESNDKALK

SEQ ID NO: 3219083 - protein, 5 aa, Plasmodium falciparum
ESNDM

SEQ ID NO: 3219084 - protein, 39 aa, Plasmodium falciparum
ESNENENDMCESGENENDMCESGENENNICESGENENNI

SEQ ID NO: 3219085 - protein, 17 aa, Plasmodium falciparum
ESNENNDEHSSNKSTMN

SEQ ID NO: 3219086 - protein, 10 aa, Plasmodium falciparum
ESNETGTEQQ

SEQ ID NO: 3219087 - protein, 9 aa, Plasmodium falciparum
ESNETNKEK

SEQ ID NO: 3219088 - protein, 9 aa, Plasmodium falciparum
ESNFTKKDN

SEQ ID NO: 3219089 - protein, 6 aa, Plasmodium falciparum
ESNGIP

SEQ ID NO: 3219090 - protein, 6 aa, Plasmodium falciparum
ESNGTT

SEQ ID NO: 3219091 - protein, 25 aa, Plasmodium falciparum
ESNHDKNKNVKQNEHDYKNTKIKEK

SEQ ID NO: 3219092 - protein, 10 aa, Plasmodium falciparum
ESNIANERSS

SEQ ID NO: 3219093 - protein, 47 aa, Plasmodium falciparum
ESNIEESNIDESNIEESDIEESDVKESDVKESDIKESDIKESDNDVY

SEQ ID NO: 3219094 - protein, 10 aa, Plasmodium falciparum
ESNIGNSDTI

SEQ ID NO: 3219095 - protein, 5 aa, Plasmodium falciparum
ESNIK

SEQ ID NO: 3219096 - protein, 8 aa, Plasmodium falciparum
ESNISESL

SEQ ID NO: 3219097 - protein, 10 aa, Plasmodium falciparum
ESNKANNTNS

SEQ ID NO: 3219098 - protein, 10 aa, Plasmodium falciparum
ESNKDRNEWK

SEQ ID NO: 3219099 - protein, 6 aa, Plasmodium falciparum
ESNKNK

SEQ ID NO: 3219100 - protein, 6 aa, Plasmodium falciparum
ESNKRI

SEQ ID NO: 3219101 - protein, 27 aa, Plasmodium falciparum
ESNKTTNIKEDEEKNKKINNNDKETNY

SEQ ID NO: 3219102 - protein, 26 aa, Plasmodium falciparum
ESNNMDKSLQKKKRIKENKKIKREQH

SEQ ID NO: 3219103 - protein, 15 aa, Plasmodium falciparum
ESNNNNNNNKKSKNM

SEQ ID NO: 3219104 - protein, 5 aa, Plasmodium falciparum
ESNNV

SEQ ID NO: 3219105 - protein, 10 aa, Plasmodium falciparum
ESNPSSTSTC

SEQ ID NO: 3219106 - protein, 8 aa, Plasmodium falciparum
ESNPYKTS

SEQ ID NO: 3219107 - protein, 12 aa, Plasmodium falciparum
ESNSKAKEEEEI

SEQ ID NO: 3219108 - protein, 10 aa, Plasmodium falciparum
ESNTDSTKLE

SEQ ID NO: 3219109 - protein, 10 aa, Plasmodium falciparum
ESNTQHISST

SEQ ID NO: 3219110 - protein, 19 aa, Plasmodium falciparum
ESNTSINEKEEKSISSVEE

SEQ ID NO: 3219111 - protein, 34 aa, Plasmodium falciparum
ESNYTNNVKNNQTNKHNAMDPSNNENISSTSLNV

SEQ ID NO: 3219112 - protein, 12 aa, Plasmodium falciparum
ESPADNNEEMSN

SEQ ID NO: 3219113 - protein, 7 aa, Plasmodium falciparum
ESPDDQF

SEQ ID NO: 3219114 - protein, 5 aa, Plasmodium falciparum
ESPIS

SEQ ID NO: 3219115 - protein, 6 aa, Plasmodium falciparum
ESPKNM

SEQ ID NO: 3219116 - protein, 6 aa, Plasmodium falciparum
ESPNYK

SEQ ID NO: 3219117 - protein, 5 aa, Plasmodium falciparum
ESPRN

SEQ ID NO: 3219118 - protein, 7 aa, Plasmodium falciparum
ESPSMAR

SEQ ID NO: 3219119 - protein, 6 aa, Plasmodium falciparum
ESPSSH

SEQ ID NO: 3219120 - protein, 14 aa, Plasmodium falciparum
ESPTNTSGTNSSYT

SEQ ID NO: 3219121 - protein, 7 aa, Plasmodium falciparum
ESPTYSY

SEQ ID NO: 3219122 - protein, 8 aa, Plasmodium falciparum
ESQGGSTY

SEQ ID NO: 3219123 - protein, 5 aa, Plasmodium falciparum
ESQKL

SEQ ID NO: 3219124 - protein, 6 aa, Plasmodium falciparum
ESQKQK

SEQ ID NO: 3219125 - protein, 6 aa, Plasmodium falciparum
ESQNSL

SEQ ID NO: 3219126 - protein, 20 aa, Plasmodium falciparum
ESQSKTLTSVNGDGNGSQEV

SEQ ID NO: 3219127 - protein, 8 aa, Plasmodium falciparum
ESQYNDEE

SEQ ID NO: 3219128 - protein, 14 aa, Plasmodium falciparum
ESREKRKKKKTTKI

SEQ ID NO: 3219129 - protein, 4 aa, Plasmodium falciparum
ESRK

SEQ ID NO: 3219130 - protein, 16 aa, Plasmodium falciparum
ESRKDLEKKGDKPNNI

SEQ ID NO: 3219131 - protein, 12 aa, Plasmodium falciparum
ESRKKEDNIKGR

SEQ ID NO: 3219132 - protein, 30 aa, Plasmodium falciparum
ESRKSKNQLMESKKNNNINDNNNNNNNNNN

SEQ ID NO: 3219133 - protein, 6 aa, Plasmodium falciparum
ESRNLN

SEQ ID NO: 3219134 - protein, 7 aa, Plasmodium falciparum
ESRPEAK

SEQ ID NO: 3219135 - protein, 6 aa, Plasmodium falciparum
ESRPEL

SEQ ID NO: 3219136 - protein, 17 aa, Plasmodium falciparum
ESRPQVPPKKKEDEEDV

SEQ ID NO: 3219137 - protein, 7 aa, Plasmodium falciparum
ESRTKES

SEQ ID NO: 3219138 - protein, 9 aa, Plasmodium falciparum
ESRYSEDRI

SEQ ID NO: 3219139 - protein, 6 aa, Plasmodium falciparum
ESSCNS

SEQ ID NO: 3219140 - protein, 8 aa, Plasmodium falciparum
ESSCTNDT

SEQ ID NO: 3219141 - protein, 7 aa, Plasmodium falciparum
ESSDVED

SEQ ID NO: 3219142 - protein, 9 aa, Plasmodium falciparum
ESSEDDGNV

SEQ ID NO: 3219143 - protein, 23 aa, Plasmodium falciparum
ESSEESKKVKKNKQNMYYCVAQK

SEQ ID NO: 3219144 - protein, 7 aa, Plasmodium falciparum
ESSEEVK

SEQ ID NO: 3219145 - protein, 4 aa, Plasmodium falciparum
ESSG

SEQ ID NO: 3219146 - protein, 14 aa, Plasmodium falciparum
ESSGGEDVKNDMNE

SEQ ID NO: 3219147 - protein, 7 aa, Plasmodium falciparum
ESSGNNA

SEQ ID NO: 3219148 - protein, 4 aa, Plasmodium falciparum
ESSI

SEQ ID NO: 3219149 - protein, 14 aa, Plasmodium falciparum
ESSIRTNKNDEIRD

SEQ ID NO: 3219150 - protein, 27 aa, Plasmodium falciparum
ESSKKGNNQKITRAQVSPDIDKESGDM

SEQ ID NO: 3219151 - protein, 6 aa, Plasmodium falciparum
ESSKKK

SEQ ID NO: 3219152 - protein, 5 aa, Plasmodium falciparum
ESSKM

SEQ ID NO: 3219153 - protein, 9 aa, Plasmodium falciparum
ESSNDDIEY

SEQ ID NO: 3219154 - protein, 28 aa, Plasmodium falciparum
ESSNDKTSHSNNSKKIYKEEKKKYSDYI

SEQ ID NO: 3219155 - protein, 7 aa, Plasmodium falciparum
ESSNKLS

SEQ ID NO: 3219156 - protein, 10 aa, Plasmodium falciparum
ESSNNKKQTK

SEQ ID NO: 3219157 - protein, 24 aa, Plasmodium falciparum
ESSNYIKNENKDIKKTIESKNKDD

SEQ ID NO: 3219158 - protein, 8 aa, Plasmodium falciparum
ESSRRKQR

SEQ ID NO: 3219159 - protein, 4 aa, Plasmodium falciparum
ESSS

SEQ ID NO: 3219160 - protein, 11 aa, Plasmodium falciparum
ESSSKEQKYRN

SEQ ID NO: 3219161 - protein, 7 aa, Plasmodium falciparum
ESSSSED

SEQ ID NO: 3219162 - protein, 7 aa, Plasmodium falciparum
ESSTCEE

SEQ ID NO: 3219163 - protein, 5 aa, Plasmodium falciparum
ESSYE

SEQ ID NO: 3219164 - protein, 32 aa, Plasmodium falciparum
ESTAEQKAEKKGGKAKAKTKVRTVDDDGNEIN

SEQ ID NO: 3219165 - protein, 6 aa, Plasmodium falciparum
ESTDKR

SEQ ID NO: 3219166 - protein, 31 aa, Plasmodium falciparum
ESTHINNNNDNNNDNNNDNNNDNNNNNNDNY

SEQ ID NO: 3219167 - protein, 8 aa, Plasmodium falciparum
ESTKINKD

SEQ ID NO: 3219168 - protein, 5 aa, Plasmodium falciparum
ESTKL

SEQ ID NO: 3219169 - protein, 17 aa, Plasmodium falciparum
ESTNHNNMDTSIENGNG

SEQ ID NO: 3219170 - protein, 6 aa, Plasmodium falciparum
ESTNRY

SEQ ID NO: 3219171 - protein, 10 aa, Plasmodium falciparum
ESTNTSTCTY

SEQ ID NO: 3219172 - protein, 8 aa, Plasmodium falciparum
ESTPLTTE

SEQ ID NO: 3219173 - protein, 5 aa, Plasmodium falciparum
ESTSS

SEQ ID NO: 3219174 - protein, 4 aa, Plasmodium falciparum
ESTT

SEQ ID NO: 3219175 - protein, 7 aa, Plasmodium falciparum
ESTTNKT

SEQ ID NO: 3219176 - protein, 6 aa, Plasmodium falciparum
ESTYGS

SEQ ID NO: 3219177 - protein, 15 aa, Plasmodium falciparum
ESVAAAKSAKVAAAE

SEQ ID NO: 3219178 - protein, 26 aa, Plasmodium falciparum
ESVDNNDYNNYGSNNNIQSESYHNDN

SEQ ID NO: 3219179 - protein, 7 aa, Plasmodium falciparum
ESVDSNE

SEQ ID NO: 3219180 - protein, 4 aa, Plasmodium falciparum
ESVE

SEQ ID NO: 3219181 - protein, 9 aa, Plasmodium falciparum
ESVENKNNV

SEQ ID NO: 3219182 - protein, 4 aa, Plasmodium falciparum
ESVI

SEQ ID NO: 3219183 - protein, 15 aa, Plasmodium falciparum
ESVKKREIKQENGKI

SEQ ID NO: 3219184 - protein, 10 aa, Plasmodium falciparum
ESVQDTNYST

SEQ ID NO: 3219185 - protein, 16 aa, Plasmodium falciparum
ESVQKEAKKQALGRSE

SEQ ID NO: 3219186 - protein, 4 aa, Plasmodium falciparum
ESVS

SEQ ID NO: 3219187 - protein, 4 aa, Plasmodium falciparum
ESVT

SEQ ID NO: 3219188 - protein, 12 aa, Plasmodium falciparum
ESVYNDKNKTSY

SEQ ID NO: 3219189 - protein, 9 aa, Plasmodium falciparum
ESYDNSNDQ

SEQ ID NO: 3219190 - protein, 7 aa, Plasmodium falciparum
ESYEGSE

SEQ ID NO: 3219191 - protein, 6 aa, Plasmodium falciparum
ESYHDN

SEQ ID NO: 3219192 - protein, 13 aa, Plasmodium falciparum
ESYKATKKNGESI

SEQ ID NO: 3219193 - protein, 4 aa, Plasmodium falciparum
ESYL

SEQ ID NO: 3219194 - protein, 5 aa, Plasmodium falciparum
ESYLE

SEQ ID NO: 3219195 - protein, 13 aa, Plasmodium falciparum
ESYNEDKEKNNHN

SEQ ID NO: 3219196 - protein, 13 aa, Plasmodium falciparum
ESYNESYNESYNE

SEQ ID NO: 3219197 - protein, 6 aa, Plasmodium falciparum
ESYNKT

SEQ ID NO: 3219198 - protein, 7 aa, Plasmodium falciparum
ESYPNEE

SEQ ID NO: 3219199 - protein, 15 aa, Plasmodium falciparum
ESYSLEKNDSSSIDN

SEQ ID NO: 3219200 - protein, 4 aa, Plasmodium falciparum
ESYT

SEQ ID NO: 3219201 - protein, 7 aa, Plasmodium falciparum
ESYTYQE

SEQ ID NO: 3219202 - protein, 8 aa, Plasmodium falciparum
ESYYDESD

SEQ ID NO: 3219203 - protein, 7 aa, Plasmodium falciparum
ETAENES

SEQ ID NO: 3219204 - protein, 17 aa, Plasmodium falciparum
ETAGNYYSDQRSKTSDI

SEQ ID NO: 3219205 - protein, 7 aa, Plasmodium falciparum
ETAKKKS

SEQ ID NO: 3219206 - protein, 4 aa, Plasmodium falciparum
ETAR

SEQ ID NO: 3219207 - protein, 8 aa, Plasmodium falciparum
ETATDEAI

SEQ ID NO: 3219208 - protein, 4 aa, Plasmodium falciparum
ETCE

SEQ ID NO: 3219209 - protein, 9 aa, Plasmodium falciparum
ETCKEKSKY

SEQ ID NO: 3219210 - protein, 10 aa, Plasmodium falciparum
ETDGKQKKNI

SEQ ID NO: 3219211 - protein, 50 aa, Plasmodium falciparum
ETDIGTKEEVNIDDDDAKEINIENDDKEINIENDDKEINIENDDKEINIE

SEQ ID NO: 3219212 - protein, 5 aa, Plasmodium falciparum
ETDKN

SEQ ID NO: 3219213 - protein, 9 aa, Plasmodium falciparum
ETDKSSASL

SEQ ID NO: 3219214 - protein, 10 aa, Plasmodium falciparum
ETDKTGNEKC

SEQ ID NO: 3219215 - protein, 30 aa, Plasmodium falciparum
ETDNAEMESNNNNNNNNNNSDCNNNVSTLS

SEQ ID NO: 3219216 - protein, 7 aa, Plasmodium falciparum
ETDNSTI

SEQ ID NO: 3219217 - protein, 6 aa, Plasmodium falciparum
ETDQKS

SEQ ID NO: 3219218 - protein, 7 aa, Plasmodium falciparum
ETDQTTS

SEQ ID NO: 3219219 - protein, 7 aa, Plasmodium falciparum
ETDSEYE

SEQ ID NO: 3219220 - protein, 8 aa, Plasmodium falciparum
ETDVNTNE

SEQ ID NO: 3219221 - protein, 5 aa, Plasmodium falciparum
ETDYD

SEQ ID NO: 3219222 - protein, 7 aa, Plasmodium falciparum
ETEDNNL

SEQ ID NO: 3219223 - protein, 5 aa, Plasmodium falciparum
ETEEI

SEQ ID NO: 3219224 - protein, 5 aa, Plasmodium falciparum
ETEEK

SEQ ID NO: 3219225 - protein, 7 aa, Plasmodium falciparum
ETEENKK

SEQ ID NO: 3219226 - protein, 5 aa, Plasmodium falciparum
ETEHT

SEQ ID NO: 3219227 - protein, 8 aa, Plasmodium falciparum
ETEKNKTF

SEQ ID NO: 3219228 - protein, 6 aa, Plasmodium falciparum
ETEKPH

SEQ ID NO: 3219229 - protein, 12 aa, Plasmodium falciparum
ETENEKKFEKCR

SEQ ID NO: 3219230 - protein, 22 aa, Plasmodium falciparum
ETENNDNTDEYYKNDEEENEAS

SEQ ID NO: 3219231 - protein, 7 aa, Plasmodium falciparum
ETENNQI

SEQ ID NO: 3219232 - protein, 4 aa, Plasmodium falciparum
ETES

SEQ ID NO: 3219233 - protein, 6 aa, Plasmodium falciparum
ETESVN

SEQ ID NO: 3219234 - protein, 7 aa, Plasmodium falciparum
ETESVTE

SEQ ID NO: 3219235 - protein, 6 aa, Plasmodium falciparum
ETETEI

SEQ ID NO: 3219236 - protein, 5 aa, Plasmodium falciparum
ETETN

SEQ ID NO: 3219237 - protein, 4 aa, Plasmodium falciparum
ETFG

SEQ ID NO: 3219238 - protein, 6 aa, Plasmodium falciparum
ETFGNK

SEQ ID NO: 3219239 - protein, 9 aa, Plasmodium falciparum
ETFKKKTEK

SEQ ID NO: 3219240 - protein, 4 aa, Plasmodium falciparum
ETGE

SEQ ID NO: 3219241 - protein, 24 aa, Plasmodium falciparum
ETGGKESNINRERETYNHQEDHTN

SEQ ID NO: 3219242 - protein, 9 aa, Plasmodium falciparum
ETGKNKNLN

SEQ ID NO: 3219243 - protein, 12 aa, Plasmodium falciparum
ETGKPNGPPAYQ

SEQ ID NO: 3219244 - protein, 5 aa, Plasmodium falciparum
ETGMK

SEQ ID NO: 3219245 - protein, 6 aa, Plasmodium falciparum
ETGNPF

SEQ ID NO: 3219246 - protein, 7 aa, Plasmodium falciparum
ETGSDQE

SEQ ID NO: 3219247 - protein, 35 aa, Plasmodium falciparum
ETGTASSSAHLPTDEKNVTENTSNLGDTCNNSEGL

SEQ ID NO: 3219248 - protein, 7 aa, Plasmodium falciparum
ETGVAGN

SEQ ID NO: 3219249 - protein, 8 aa, Plasmodium falciparum
ETGYRRPD

SEQ ID NO: 3219250 - protein, 5 aa, Plasmodium falciparum
ETHLD

SEQ ID NO: 3219251 - protein, 5 aa, Plasmodium falciparum
ETHNE

SEQ ID NO: 3219252 - protein, 9 aa, Plasmodium falciparum
ETHNNKQNH

SEQ ID NO: 3219253 - protein, 81 aa, Plasmodium falciparum
ETHTSDTCPKPPKPPPSTDKYAGRSDPPRVGPSRDPNDPHAGSGDEDEEEEEEEEEEEEGENTTVEHTETTAETQPAAPTV

SEQ ID NO: 3219254 - protein, 4 aa, Plasmodium falciparum
ETIC

SEQ ID NO: 3219255 - protein, 67 aa, Plasmodium falciparum
ETIDDKYEEEEYEDEGEEYEEEDDDEEEDEEEYGHNNDNQDDEGDKNKTTNEKNKKKKNKNNNNNNN

SEQ ID NO: 3219256 - protein, 10 aa, Plasmodium falciparum
ETIEKDSDRD

SEQ ID NO: 3219257 - protein, 15 aa, Plasmodium falciparum
ETIENDQDIEQKHDD

SEQ ID NO: 3219258 - protein, 10 aa, Plasmodium falciparum
ETIEREKKNY

SEQ ID NO: 3219259 - protein, 7 aa, Plasmodium falciparum
ETITEQV

SEQ ID NO: 3219260 - protein, 30 aa, Plasmodium falciparum
ETKAKKCKDPSSGENQKTPCQEYTPPDDDE

SEQ ID NO: 3219261 - protein, 4 aa, Plasmodium falciparum
ETKD

SEQ ID NO: 3219262 - protein, 6 aa, Plasmodium falciparum
ETKDDQ

SEQ ID NO: 3219263 - protein, 11 aa, Plasmodium falciparum
ETKEDEVNEDH

SEQ ID NO: 3219264 - protein, 7 aa, Plasmodium falciparum
ETKEDGE

SEQ ID NO: 3219265 - protein, 5 aa, Plasmodium falciparum
ETKEE

SEQ ID NO: 3219266 - protein, 10 aa, Plasmodium falciparum
ETKEEKTNMR

SEQ ID NO: 3219267 - protein, 10 aa, Plasmodium falciparum
ETKEMTNSNL

SEQ ID NO: 3219268 - protein, 6 aa, Plasmodium falciparum
ETKERK

SEQ ID NO: 3219269 - protein, 6 aa, Plasmodium falciparum
ETKFEN

SEQ ID NO: 3219270 - protein, 20 aa, Plasmodium falciparum
ETKGDKKKYYKSKKNDHHQY

SEQ ID NO: 3219271 - protein, 5 aa, Plasmodium falciparum
ETKGL

SEQ ID NO: 3219272 - protein, 12 aa, Plasmodium falciparum
ETKGTIYEDNNG

SEQ ID NO: 3219273 - protein, 4 aa, Plasmodium falciparum
ETKI

SEQ ID NO: 3219274 - protein, 9 aa, Plasmodium falciparum
ETKKDINKE

SEQ ID NO: 3219275 - protein, 6 aa, Plasmodium falciparum
ETKKDR

SEQ ID NO: 3219276 - protein, 17 aa, Plasmodium falciparum
ETKKNKDKRLNDPQDNF

SEQ ID NO: 3219277 - protein, 8 aa, Plasmodium falciparum
ETKKNNSF

SEQ ID NO: 3219278 - protein, 6 aa, Plasmodium falciparum
ETKKYY

SEQ ID NO: 3219279 - protein, 19 aa, Plasmodium falciparum
ETKNGSAGGGGGSNSEIKE

SEQ ID NO: 3219280 - protein, 10 aa, Plasmodium falciparum
ETKNIQDSNI

SEQ ID NO: 3219281 - protein, 7 aa, Plasmodium falciparum
ETKNKTS

SEQ ID NO: 3219282 - protein, 5 aa, Plasmodium falciparum
ETKNV

SEQ ID NO: 3219283 - protein, 11 aa, Plasmodium falciparum
ETKPKSDNHDN

SEQ ID NO: 3219284 - protein, 6 aa, Plasmodium falciparum
ETKPMD

SEQ ID NO: 3219285 - protein, 22 aa, Plasmodium falciparum
ETKQDDNAEESHINNNDHNDNI

SEQ ID NO: 3219286 - protein, 5 aa, Plasmodium falciparum
ETKQK

SEQ ID NO: 3219287 - protein, 11 aa, Plasmodium falciparum
ETKQKEFRGQT

SEQ ID NO: 3219288 - protein, 10 aa, Plasmodium falciparum
ETKQKNNKML

SEQ ID NO: 3219289 - protein, 11 aa, Plasmodium falciparum
ETKQNNIEETN

SEQ ID NO: 3219290 - protein, 4 aa, Plasmodium falciparum
ETKS

SEQ ID NO: 3219291 - protein, 7 aa, Plasmodium falciparum
ETKSDTY

SEQ ID NO: 3219292 - protein, 5 aa, Plasmodium falciparum
ETKTF

SEQ ID NO: 3219293 - protein, 11 aa, Plasmodium falciparum
ETLDEDKNKEL

SEQ ID NO: 3219294 - protein, 4 aa, Plasmodium falciparum
ETLN

SEQ ID NO: 3219295 - protein, 9 aa, Plasmodium falciparum
ETLTTNNND

SEQ ID NO: 3219296 - protein, 5 aa, Plasmodium falciparum
ETMNN

SEQ ID NO: 3219297 - protein, 4 aa, Plasmodium falciparum
ETMY

SEQ ID NO: 3219298 - protein, 4 aa, Plasmodium falciparum
ETND

SEQ ID NO: 3219299 - protein, 8 aa, Plasmodium falciparum
ETNDEAPF

SEQ ID NO: 3219300 - protein, 6 aa, Plasmodium falciparum
ETNDND

SEQ ID NO: 3219301 - protein, 11 aa, Plasmodium falciparum
ETNDVDNEKDK

SEQ ID NO: 3219302 - protein, 20 aa, Plasmodium falciparum
ETNEKQRKKTNKKKSVQKDD

SEQ ID NO: 3219303 - protein, 6 aa, Plasmodium falciparum
ETNESH

SEQ ID NO: 3219304 - protein, 31 aa, Plasmodium falciparum
ETNGKYNNNNNNNNSSRHKVHSDQNKNDDDI

SEQ ID NO: 3219305 - protein, 32 aa, Plasmodium falciparum
ETNKKPEAPPPPPPPQPPPPPPQPARPAEDQI

SEQ ID NO: 3219306 - protein, 8 aa, Plasmodium falciparum
ETNKNENY

SEQ ID NO: 3219307 - protein, 18 aa, Plasmodium falciparum
ETNKTTNMSSRSPKKRNY

SEQ ID NO: 3219308 - protein, 5 aa, Plasmodium falciparum
ETNMN

SEQ ID NO: 3219309 - protein, 10 aa, Plasmodium falciparum
ETNNIKSPNN

SEQ ID NO: 3219310 - protein, 8 aa, Plasmodium falciparum
ETNNKVRT

SEQ ID NO: 3219311 - protein, 6 aa, Plasmodium falciparum
ETNNNN

SEQ ID NO: 3219312 - protein, 8 aa, Plasmodium falciparum
ETNNQHSK

SEQ ID NO: 3219313 - protein, 8 aa, Plasmodium falciparum
ETNNSNNT

SEQ ID NO: 3219314 - protein, 6 aa, Plasmodium falciparum
ETNPIP

SEQ ID NO: 3219315 - protein, 23 aa, Plasmodium falciparum
ETNPPPCSNNNNNINKYNNNNNN

SEQ ID NO: 3219316 - protein, 5 aa, Plasmodium falciparum
ETNQV

SEQ ID NO: 3219317 - protein, 4 aa, Plasmodium falciparum
ETNS

SEQ ID NO: 3219318 - protein, 5 aa, Plasmodium falciparum
ETNSE

SEQ ID NO: 3219319 - protein, 7 aa, Plasmodium falciparum
ETNTEDT

SEQ ID NO: 3219320 - protein, 10 aa, Plasmodium falciparum
ETNYNNQENH

SEQ ID NO: 3219321 - protein, 5 aa, Plasmodium falciparum
ETNYS

SEQ ID NO: 3219322 - protein, 6 aa, Plasmodium falciparum
ETPDDF

SEQ ID NO: 3219323 - protein, 6 aa, Plasmodium falciparum
ETPLHN

SEQ ID NO: 3219324 - protein, 7 aa, Plasmodium falciparum
ETPNGDN

SEQ ID NO: 3219325 - protein, 10 aa, Plasmodium falciparum
ETPNLNTQED

SEQ ID NO: 3219326 - protein, 8 aa, Plasmodium falciparum
ETPSNAQS

SEQ ID NO: 3219327 - protein, 5 aa, Plasmodium falciparum
ETPTT

SEQ ID NO: 3219328 - protein, 10 aa, Plasmodium falciparum
ETPYRNENRK

SEQ ID NO: 3219329 - protein, 4 aa, Plasmodium falciparum
ETQA

SEQ ID NO: 3219330 - protein, 5 aa, Plasmodium falciparum
ETQEE

SEQ ID NO: 3219331 - protein, 10 aa, Plasmodium falciparum
ETQEKTGNES

SEQ ID NO: 3219332 - protein, 5 aa, Plasmodium falciparum
ETQEL

SEQ ID NO: 3219333 - protein, 5 aa, Plasmodium falciparum
ETQFN

SEQ ID NO: 3219334 - protein, 4 aa, Plasmodium falciparum
ETQK

SEQ ID NO: 3219335 - protein, 6 aa, Plasmodium falciparum
ETQNEA

SEQ ID NO: 3219336 - protein, 8 aa, Plasmodium falciparum
ETQNEGNE

SEQ ID NO: 3219337 - protein, 7 aa, Plasmodium falciparum
ETQNGEI

SEQ ID NO: 3219338 - protein, 14 aa, Plasmodium falciparum
ETQNGEIAKKNKMR

SEQ ID NO: 3219339 - protein, 7 aa, Plasmodium falciparum
ETQQNGM

SEQ ID NO: 3219340 - protein, 6 aa, Plasmodium falciparum
ETQSVN

SEQ ID NO: 3219341 - protein, 6 aa, Plasmodium falciparum
ETQTNV

SEQ ID NO: 3219342 - protein, 11 aa, Plasmodium falciparum
ETRDNTKKKNK

SEQ ID NO: 3219343 - protein, 6 aa, Plasmodium falciparum
ETREIT

SEQ ID NO: 3219344 - protein, 4 aa, Plasmodium falciparum
ETRK

SEQ ID NO: 3219345 - protein, 9 aa, Plasmodium falciparum
ETRNDNGHI

SEQ ID NO: 3219346 - protein, 7 aa, Plasmodium falciparum
ETRNRRK

SEQ ID NO: 3219347 - protein, 4 aa, Plasmodium falciparum
ETSD

SEQ ID NO: 3219348 - protein, 6 aa, Plasmodium falciparum
ETSDSV

SEQ ID NO: 3219349 - protein, 8 aa, Plasmodium falciparum
ETSDVPDD

SEQ ID NO: 3219350 - protein, 7 aa, Plasmodium falciparum
ETSINKN

SEQ ID NO: 3219351 - protein, 18 aa, Plasmodium falciparum
ETSKKEAPPFEPFSWKEE

SEQ ID NO: 3219352 - protein, 6 aa, Plasmodium falciparum
ETSNKR

SEQ ID NO: 3219353 - protein, 7 aa, Plasmodium falciparum
ETSPLTG

SEQ ID NO: 3219354 - protein, 8 aa, Plasmodium falciparum
ETSQDTYC

SEQ ID NO: 3219355 - protein, 9 aa, Plasmodium falciparum
ETSQNGDPL

SEQ ID NO: 3219356 - protein, 9 aa, Plasmodium falciparum
ETSSTPQGF

SEQ ID NO: 3219357 - protein, 4 aa, Plasmodium falciparum
ETST

SEQ ID NO: 3219358 - protein, 26 aa, Plasmodium falciparum
ETSTKLKNEKNSLNGKLNDDKRLSIF

SEQ ID NO: 3219359 - protein, 18 aa, Plasmodium falciparum
ETSTNIDDISSKRNSQKL

SEQ ID NO: 3219360 - protein, 4 aa, Plasmodium falciparum
ETSY

SEQ ID NO: 3219361 - protein, 5 aa, Plasmodium falciparum
ETSYE

SEQ ID NO: 3219362 - protein, 5 aa, Plasmodium falciparum
ETTCT

SEQ ID NO: 3219363 - protein, 11 aa, Plasmodium falciparum
ETTDDTNQHNT

SEQ ID NO: 3219364 - protein, 13 aa, Plasmodium falciparum
ETTENEKDNQKEE

SEQ ID NO: 3219365 - protein, 126 aa, Plasmodium falciparum
ETTENKDTQKKKKTYKKKETDNIENADKMEETDKKKETEKNKKKAQNKKTAKNKKTAKDKKTAENKKIAKNKKTAQNKKTAQNKKTAKNKKTAKNKKTAKNQETTKKQETPPNEETDKKKKPTLRK

SEQ ID NO: 3219366 - protein, 14 aa, Plasmodium falciparum
ETTKKPKDEKYQYQ

SEQ ID NO: 3219367 - protein, 13 aa, Plasmodium falciparum
ETTKPSTVKQRKK

SEQ ID NO: 3219368 - protein, 6 aa, Plasmodium falciparum
ETTSEN

SEQ ID NO: 3219369 - protein, 5 aa, Plasmodium falciparum
ETTYN

SEQ ID NO: 3219370 - protein, 15 aa, Plasmodium falciparum
ETVAGEASKKATEDV

SEQ ID NO: 3219371 - protein, 5 aa, Plasmodium falciparum
ETVAQ

SEQ ID NO: 3219372 - protein, 38 aa, Plasmodium falciparum
ETVDENVEEQAVDENEEQQTVDENVEQQTIDESQVQEE

SEQ ID NO: 3219373 - protein, 67 aa, Plasmodium falciparum
ETVDQKTKVEDEKCDKTRPVVPKEDRQEEEESKKKKDETALPPPEPPADSPPPAAPTKPLPSDNTSD

SEQ ID NO: 3219374 - protein, 20 aa, Plasmodium falciparum
ETVETRNEEDEDNEDDEEEF

SEQ ID NO: 3219375 - protein, 8 aa, Plasmodium falciparum
ETVNKKKE

SEQ ID NO: 3219376 - protein, 16 aa, Plasmodium falciparum
ETYDEENVRKSSNVND

SEQ ID NO: 3219377 - protein, 6 aa, Plasmodium falciparum
ETYENK

SEQ ID NO: 3219378 - protein, 6 aa, Plasmodium falciparum
ETYNNE

SEQ ID NO: 3219379 - protein, 7 aa, Plasmodium falciparum
ETYNNID

SEQ ID NO: 3219380 - protein, 6 aa, Plasmodium falciparum
ETYPIN

SEQ ID NO: 3219381 - protein, 9 aa, Plasmodium falciparum
ETYSNTSED

SEQ ID NO: 3219382 - protein, 9 aa, Plasmodium falciparum
ETYTSEDDI

SEQ ID NO: 3219383 - protein, 9 aa, Plasmodium falciparum
EVANKKTCN

SEQ ID NO: 3219384 - protein, 22 aa, Plasmodium falciparum
EVCEENHKKDEKVKGHKTRIND

SEQ ID NO: 3219385 - protein, 7 aa, Plasmodium falciparum
EVDAPNK

SEQ ID NO: 3219386 - protein, 4 aa, Plasmodium falciparum
EVDK

SEQ ID NO: 3219387 - protein, 4 aa, Plasmodium falciparum
EVDN

SEQ ID NO: 3219388 - protein, 5 aa, Plasmodium falciparum
EVDNT

SEQ ID NO: 3219389 - protein, 24 aa, Plasmodium falciparum
EVEEAEEKNKNKDNNSDNNNSNYF

SEQ ID NO: 3219390 - protein, 6 aa, Plasmodium falciparum
EVEEEI

SEQ ID NO: 3219391 - protein, 7 aa, Plasmodium falciparum
EVEEEKK

SEQ ID NO: 3219392 - protein, 4 aa, Plasmodium falciparum
EVEN

SEQ ID NO: 3219393 - protein, 4 aa, Plasmodium falciparum
EVEP

SEQ ID NO: 3219394 - protein, 4 aa, Plasmodium falciparum
EVES

SEQ ID NO: 3219395 - protein, 5 aa, Plasmodium falciparum
EVESS

SEQ ID NO: 3219396 - protein, 5 aa, Plasmodium falciparum
EVETA

SEQ ID NO: 3219397 - protein, 7 aa, Plasmodium falciparum
EVGDNQQ

SEQ ID NO: 3219398 - protein, 18 aa, Plasmodium falciparum
EVGRGGEKKKKKKKKKSY

SEQ ID NO: 3219399 - protein, 5 aa, Plasmodium falciparum
EVIDE

SEQ ID NO: 3219400 - protein, 4 aa, Plasmodium falciparum
EVKK

SEQ ID NO: 3219401 - protein, 25 aa, Plasmodium falciparum
EVKKRVNKEVNKRVNRRNRKNERKD

SEQ ID NO: 3219402 - protein, 10 aa, Plasmodium falciparum
EVKNGEAKNY

SEQ ID NO: 3219403 - protein, 13 aa, Plasmodium falciparum
EVKPQNEKYTYNQ

SEQ ID NO: 3219404 - protein, 18 aa, Plasmodium falciparum
EVKPTNTLKKEEAKPTDL

SEQ ID NO: 3219405 - protein, 10 aa, Plasmodium falciparum
EVKTPKNEKF

SEQ ID NO: 3219406 - protein, 10 aa, Plasmodium falciparum
EVLNNNSDDD

SEQ ID NO: 3219407 - protein, 29 aa, Plasmodium falciparum
EVNDSEDLTNSSLDYEKEENKSDYSSNEI

SEQ ID NO: 3219408 - protein, 7 aa, Plasmodium falciparum
EVNEEKN

SEQ ID NO: 3219409 - protein, 18 aa, Plasmodium falciparum
EVNEKDTKNNDKKIGKRV

SEQ ID NO: 3219410 - protein, 12 aa, Plasmodium falciparum
EVNFTGKNEEYL

SEQ ID NO: 3219411 - protein, 7 aa, Plasmodium falciparum
EVNNTNE

SEQ ID NO: 3219412 - protein, 7 aa, Plasmodium falciparum
EVNPEDS

SEQ ID NO: 3219413 - protein, 21 aa, Plasmodium falciparum
EVNQGSVSEESHSKTIDPSKI

SEQ ID NO: 3219414 - protein, 4 aa, Plasmodium falciparum
EVNS

SEQ ID NO: 3219415 - protein, 7 aa, Plasmodium falciparum
EVPPPCD

SEQ ID NO: 3219416 - protein, 14 aa, Plasmodium falciparum
EVPPTTQDNAEKPC

SEQ ID NO: 3219417 - protein, 4 aa, Plasmodium falciparum
EVPQ

SEQ ID NO: 3219418 - protein, 13 aa, Plasmodium falciparum
EVQDGQDESFKEE

SEQ ID NO: 3219419 - protein, 8 aa, Plasmodium falciparum
EVQEEDKP

SEQ ID NO: 3219420 - protein, 19 aa, Plasmodium falciparum
EVQENSYTNKSIKKKKNKY

SEQ ID NO: 3219421 - protein, 8 aa, Plasmodium falciparum
EVRKDNQH

SEQ ID NO: 3219422 - protein, 5 aa, Plasmodium falciparum
EVRSD

SEQ ID NO: 3219423 - protein, 15 aa, Plasmodium falciparum
EVSAKAAAKTAEAAN

SEQ ID NO: 3219424 - protein, 7 aa, Plasmodium falciparum
EVSDAEE

SEQ ID NO: 3219425 - protein, 12 aa, Plasmodium falciparum
EVSNEQVKNGVY

SEQ ID NO: 3219426 - protein, 18 aa, Plasmodium falciparum
EVSPEDDPEKQLQTGTIP

SEQ ID NO: 3219427 - protein, 7 aa, Plasmodium falciparum
EVSPSDY

SEQ ID NO: 3219428 - protein, 6 aa, Plasmodium falciparum
EVSQRQ

SEQ ID NO: 3219429 - protein, 8 aa, Plasmodium falciparum
EVSSSEEI

SEQ ID NO: 3219430 - protein, 7 aa, Plasmodium falciparum
EVSTDSG

SEQ ID NO: 3219431 - protein, 8 aa, Plasmodium falciparum
EVSTTEEV

SEQ ID NO: 3219432 - protein, 50 aa, Plasmodium falciparum
EVTEEENISDESVKKEEEEEEEEEKGVDVAEDEDALKDSTASGDSSTSRY

SEQ ID NO: 3219433 - protein, 4 aa, Plasmodium falciparum
EVTN

SEQ ID NO: 3219434 - protein, 12 aa, Plasmodium falciparum
EVTPEKKDEVNP

SEQ ID NO: 3219435 - protein, 11 aa, Plasmodium falciparum
EVTTSGPLSTK

SEQ ID NO: 3219436 - protein, 4 aa, Plasmodium falciparum
EVVS

SEQ ID NO: 3219437 - protein, 12 aa, Plasmodium falciparum
EWEAQKKAELQR

SEQ ID NO: 3219438 - protein, 13 aa, Plasmodium falciparum
EWEAQKKAEQEQS

SEQ ID NO: 3219439 - protein, 28 aa, Plasmodium falciparum
EWENDNSNSGNKTSGNITPTSDIPSGKL

SEQ ID NO: 3219440 - protein, 30 aa, Plasmodium falciparum
EWENDTSTSGNKHSDIPSGKLSDTPSDNNI

SEQ ID NO: 3219441 - protein, 28 aa, Plasmodium falciparum
EWENETHSGDINSGIPSGKLSDIPSDNN

SEQ ID NO: 3219442 - protein, 22 aa, Plasmodium falciparum
EWENETHSGNIHPSDSNKTLNT

SEQ ID NO: 3219443 - protein, 18 aa, Plasmodium falciparum
EWENETHSGNKHSDIPSG

SEQ ID NO: 3219444 - protein, 29 aa, Plasmodium falciparum
EWENETHSGNKHSDIPSGKLSDTPSDNNI

SEQ ID NO: 3219445 - protein, 42 aa, Plasmodium falciparum
EWENETHSGNNHPSDNTPPTSDIPSGKLSDIPSGKLSDIPSG

SEQ ID NO: 3219446 - protein, 17 aa, Plasmodium falciparum
EWEQDYNNNSDDIHTSD

SEQ ID NO: 3219447 - protein, 6 aa, Plasmodium falciparum
EWKEGE

SEQ ID NO: 3219448 - protein, 7 aa, Plasmodium falciparum
EWKEGER

SEQ ID NO: 3219449 - protein, 16 aa, Plasmodium falciparum
EWKKEETKEVKEGQYK

SEQ ID NO: 3219450 - protein, 13 aa, Plasmodium falciparum
EWKKEQNKDIKQD

SEQ ID NO: 3219451 - protein, 8 aa, Plasmodium falciparum
EWKNKNDF

SEQ ID NO: 3219452 - protein, 22 aa, Plasmodium falciparum
EWNKDNNSGDIHTSDSNKTLNT

SEQ ID NO: 3219453 - protein, 16 aa, Plasmodium falciparum
EWNKENNNNSGDINNR

SEQ ID NO: 3219454 - protein, 23 aa, Plasmodium falciparum
EWNKENNNNSGKTYNSDNKPSHN

SEQ ID NO: 3219455 - protein, 23 aa, Plasmodium falciparum
EWNKENNNSSAKTYNSDNKPSHN

SEQ ID NO: 3219456 - protein, 25 aa, Plasmodium falciparum
EWNKENNTNSSLTHTSNIPSGENSI

SEQ ID NO: 3219457 - protein, 7 aa, Plasmodium falciparum
EYAKEGS

SEQ ID NO: 3219458 - protein, 9 aa, Plasmodium falciparum
EYAKNKEYD

SEQ ID NO: 3219459 - protein, 4 aa, Plasmodium falciparum
EYDD

SEQ ID NO: 3219460 - protein, 15 aa, Plasmodium falciparum
EYDDKKKKKKKKKYI

SEQ ID NO: 3219461 - protein, 4 aa, Plasmodium falciparum
EYDE

SEQ ID NO: 3219462 - protein, 5 aa, Plasmodium falciparum
EYDET

SEQ ID NO: 3219463 - protein, 5 aa, Plasmodium falciparum
EYDEY

SEQ ID NO: 3219464 - protein, 5 aa, Plasmodium falciparum
EYDKG

SEQ ID NO: 3219465 - protein, 9 aa, Plasmodium falciparum
EYDKKGKNK

SEQ ID NO: 3219466 - protein, 9 aa, Plasmodium falciparum
EYDKSNYES

SEQ ID NO: 3219467 - protein, 8 aa, Plasmodium falciparum
EYDNGKSM

SEQ ID NO: 3219468 - protein, 19 aa, Plasmodium falciparum
EYDNNNNNNIKNELPKSNE

SEQ ID NO: 3219469 - protein, 9 aa, Plasmodium falciparum
EYDNTSYED

SEQ ID NO: 3219470 - protein, 7 aa, Plasmodium falciparum
EYDPNNQ

SEQ ID NO: 3219471 - protein, 5 aa, Plasmodium falciparum
EYDRE

SEQ ID NO: 3219472 - protein, 26 aa, Plasmodium falciparum
EYDSNKKNNDNSKKNNDNNNNENKYD

SEQ ID NO: 3219473 - protein, 7 aa, Plasmodium falciparum
EYDTNNY

SEQ ID NO: 3219474 - protein, 11 aa, Plasmodium falciparum
EYDTNSTRTRT

SEQ ID NO: 3219475 - protein, 15 aa, Plasmodium falciparum
EYDTTTTNNDNNKDN

SEQ ID NO: 3219476 - protein, 12 aa, Plasmodium falciparum
EYEARDRNTTNN

SEQ ID NO: 3219477 - protein, 16 aa, Plasmodium falciparum
EYEDGNEEKKKSTGKR

SEQ ID NO: 3219478 - protein, 47 aa, Plasmodium falciparum
EYEDTMKKKNKRKNKYTYENTNENINSLQNNSGVEYPGGPIRSTYGN

SEQ ID NO: 3219479 - protein, 18 aa, Plasmodium falciparum
EYEENDTNNINEYDDNEN

SEQ ID NO: 3219480 - protein, 11 aa, Plasmodium falciparum
EYEHDNKNKYE

SEQ ID NO: 3219481 - protein, 13 aa, Plasmodium falciparum
EYEIEQKNKGKNH

SEQ ID NO: 3219482 - protein, 4 aa, Plasmodium falciparum
EYEK

SEQ ID NO: 3219483 - protein, 25 aa, Plasmodium falciparum
EYEKKKSKKRNKKLSLSKNNIKEKE

SEQ ID NO: 3219484 - protein, 15 aa, Plasmodium falciparum
EYEKRKKEKEQNNSK

SEQ ID NO: 3219485 - protein, 5 aa, Plasmodium falciparum
EYEKV

SEQ ID NO: 3219486 - protein, 12 aa, Plasmodium falciparum
EYELSNKKEENN

SEQ ID NO: 3219487 - protein, 4 aa, Plasmodium falciparum
EYEN

SEQ ID NO: 3219488 - protein, 29 aa, Plasmodium falciparum
EYENATRSSSTTKVSSTASPITPYSSPEG

SEQ ID NO: 3219489 - protein, 137 aa, Plasmodium falciparum
EYENDEEETYEEEEEYIDEKNENYENKEDISDREDLSDMENNNDKDDLSDMENNNDKDDLSDMENNNDKDDLSDMENNNDKEDLSDKEDLSDKEDLSDKEDLSDREDLSDKEDLSDKEDLSDKEDLSDKEDLSDRED

SEQ ID NO: 3219490 - protein, 11 aa, Plasmodium falciparum
EYENKSEEELE

SEQ ID NO: 3219491 - protein, 13 aa, Plasmodium falciparum
EYENNKRKTELKD

SEQ ID NO: 3219492 - protein, 4 aa, Plasmodium falciparum
EYEP

SEQ ID NO: 3219493 - protein, 12 aa, Plasmodium falciparum
EYEPNNLKPSRI

SEQ ID NO: 3219494 - protein, 13 aa, Plasmodium falciparum
EYESGDRNKKQGL

SEQ ID NO: 3219495 - protein, 22 aa, Plasmodium falciparum
EYESGKQNDTNIHNKNNKKEYS

SEQ ID NO: 3219496 - protein, 5 aa, Plasmodium falciparum
EYEST

SEQ ID NO: 3219497 - protein, 21 aa, Plasmodium falciparum
EYETDTCDSDEQNEEQYKNTK

SEQ ID NO: 3219498 - protein, 13 aa, Plasmodium falciparum
EYETQKVPKENAE

SEQ ID NO: 3219499 - protein, 5 aa, Plasmodium falciparum
EYGDE

SEQ ID NO: 3219500 - protein, 4 aa, Plasmodium falciparum
EYGG

SEQ ID NO: 3219501 - protein, 5 aa, Plasmodium falciparum
EYGGN

SEQ ID NO: 3219502 - protein, 4 aa, Plasmodium falciparum
EYGK

SEQ ID NO: 3219503 - protein, 10 aa, Plasmodium falciparum
EYGKKNQEDF

SEQ ID NO: 3219504 - protein, 27 aa, Plasmodium falciparum
EYGNTQKFNDNNKTNNCKKKKKESYHT

SEQ ID NO: 3219505 - protein, 5 aa, Plasmodium falciparum
EYGQN

SEQ ID NO: 3219506 - protein, 6 aa, Plasmodium falciparum
EYGQVS

SEQ ID NO: 3219507 - protein, 5 aa, Plasmodium falciparum
EYGTS

SEQ ID NO: 3219508 - protein, 13 aa, Plasmodium falciparum
EYHQNNKEKHEKN

SEQ ID NO: 3219509 - protein, 16 aa, Plasmodium falciparum
EYHTNTNQSRDTNDHD

SEQ ID NO: 3219510 - protein, 5 aa, Plasmodium falciparum
EYIDG

SEQ ID NO: 3219511 - protein, 12 aa, Plasmodium falciparum
EYIEEKKNGNQN

SEQ ID NO: 3219512 - protein, 4 aa, Plasmodium falciparum
EYIG

SEQ ID NO: 3219513 - protein, 7 aa, Plasmodium falciparum
EYKENKR

SEQ ID NO: 3219514 - protein, 8 aa, Plasmodium falciparum
EYKHQKDR

SEQ ID NO: 3219515 - protein, 11 aa, Plasmodium falciparum
EYKKRDVNETR

SEQ ID NO: 3219516 - protein, 13 aa, Plasmodium falciparum
EYKMQSSKYKRDR

SEQ ID NO: 3219517 - protein, 10 aa, Plasmodium falciparum
EYKNFQTSNP

SEQ ID NO: 3219518 - protein, 13 aa, Plasmodium falciparum
EYKNGNKNKNEHV

SEQ ID NO: 3219519 - protein, 11 aa, Plasmodium falciparum
EYKNNEKEDNF

SEQ ID NO: 3219520 - protein, 12 aa, Plasmodium falciparum
EYKQPNNDSDTD

SEQ ID NO: 3219521 - protein, 9 aa, Plasmodium falciparum
EYKTCSNNI

SEQ ID NO: 3219522 - protein, 8 aa, Plasmodium falciparum
EYKTPESR

SEQ ID NO: 3219523 - protein, 26 aa, Plasmodium falciparum
EYLEEGGETEKKKKKKKKKKKLIKGN

SEQ ID NO: 3219524 - protein, 6 aa, Plasmodium falciparum
EYLKEN

SEQ ID NO: 3219525 - protein, 6 aa, Plasmodium falciparum
EYNDEP

SEQ ID NO: 3219526 - protein, 5 aa, Plasmodium falciparum
EYNDK

SEQ ID NO: 3219527 - protein, 4 aa, Plasmodium falciparum
EYNE

SEQ ID NO: 3219528 - protein, 36 aa, Plasmodium falciparum
EYNEPNQANEEEPKTSTKLNSNINGSIESRKEKNKS

SEQ ID NO: 3219529 - protein, 12 aa, Plasmodium falciparum
EYNEYKDNNTNK

SEQ ID NO: 3219530 - protein, 4 aa, Plasmodium falciparum
EYNG

SEQ ID NO: 3219531 - protein, 9 aa, Plasmodium falciparum
EYNKDNDIY

SEQ ID NO: 3219532 - protein, 17 aa, Plasmodium falciparum
EYNKEELKESVEKKQNI

SEQ ID NO: 3219533 - protein, 11 aa, Plasmodium falciparum
EYNKKEGKKKK

SEQ ID NO: 3219534 - protein, 56 aa, Plasmodium falciparum
EYNKKKNEKNKKSIDENKKQNDENKKQKCENKKKCGESKKKSEDNKKSNTENKKDV

SEQ ID NO: 3219535 - protein, 5 aa, Plasmodium falciparum
EYNKN

SEQ ID NO: 3219536 - protein, 9 aa, Plasmodium falciparum
EYNKNYDGE

SEQ ID NO: 3219537 - protein, 10 aa, Plasmodium falciparum
EYNNDTFEQN

SEQ ID NO: 3219538 - protein, 34 aa, Plasmodium falciparum
EYNNKNKNDNHNNNNHNNNNHNNNNNNNNKNDKD

SEQ ID NO: 3219539 - protein, 7 aa, Plasmodium falciparum
EYNNNDT

SEQ ID NO: 3219540 - protein, 27 aa, Plasmodium falciparum
EYNNNNNNNNINNNNSGSNNNQYSNSK

SEQ ID NO: 3219541 - protein, 9 aa, Plasmodium falciparum
EYNNNNREA

SEQ ID NO: 3219542 - protein, 6 aa, Plasmodium falciparum
EYNNSS

SEQ ID NO: 3219543 - protein, 6 aa, Plasmodium falciparum
EYNNTS

SEQ ID NO: 3219544 - protein, 11 aa, Plasmodium falciparum
EYNQGTKEFPR

SEQ ID NO: 3219545 - protein, 15 aa, Plasmodium falciparum
EYNQKSDNNSYSTNN

SEQ ID NO: 3219546 - protein, 32 aa, Plasmodium falciparum
EYNSLQEKREPTHNNDNNNDNNNNDNNNDNNY

SEQ ID NO: 3219547 - protein, 7 aa, Plasmodium falciparum
EYNSSDY

SEQ ID NO: 3219548 - protein, 5 aa, Plasmodium falciparum
EYNSY

SEQ ID NO: 3219549 - protein, 4 aa, Plasmodium falciparum
EYNT

SEQ ID NO: 3219550 - protein, 10 aa, Plasmodium falciparum
EYNTTDRKSN

SEQ ID NO: 3219551 - protein, 10 aa, Plasmodium falciparum
EYNTTNTSDQ

SEQ ID NO: 3219552 - protein, 4 aa, Plasmodium falciparum
EYPD

SEQ ID NO: 3219553 - protein, 9 aa, Plasmodium falciparum
EYPDNNNNC

SEQ ID NO: 3219554 - protein, 9 aa, Plasmodium falciparum
EYPDTNTTD

SEQ ID NO: 3219555 - protein, 19 aa, Plasmodium falciparum
EYPGSEMNNGKTGTTNSGI

SEQ ID NO: 3219556 - protein, 10 aa, Plasmodium falciparum
EYPPKEINGK

SEQ ID NO: 3219557 - protein, 11 aa, Plasmodium falciparum
EYPQNHNYESE

SEQ ID NO: 3219558 - protein, 6 aa, Plasmodium falciparum
EYPSKK

SEQ ID NO: 3219559 - protein, 5 aa, Plasmodium falciparum
EYQNS

SEQ ID NO: 3219560 - protein, 6 aa, Plasmodium falciparum
EYQSLN

SEQ ID NO: 3219561 - protein, 15 aa, Plasmodium falciparum
EYQTTENEENENDVE

SEQ ID NO: 3219562 - protein, 11 aa, Plasmodium falciparum
EYRDNKKYRMK

SEQ ID NO: 3219563 - protein, 6 aa, Plasmodium falciparum
EYRYSE

SEQ ID NO: 3219564 - protein, 31 aa, Plasmodium falciparum
EYSDDNNSNNDSNDNNNNNNNNNSSNDNNCK

SEQ ID NO: 3219565 - protein, 6 aa, Plasmodium falciparum
EYSKNS

SEQ ID NO: 3219566 - protein, 9 aa, Plasmodium falciparum
EYSKRNDHK

SEQ ID NO: 3219567 - protein, 47 aa, Plasmodium falciparum
EYSNDKDDFSDKEDINDREDFSDKENSYNEEYNNNGEEENFKREKYD

SEQ ID NO: 3219568 - protein, 7 aa, Plasmodium falciparum
EYSNTPP

SEQ ID NO: 3219569 - protein, 6 aa, Plasmodium falciparum
EYSSPT

SEQ ID NO: 3219570 - protein, 5 aa, Plasmodium falciparum
EYSTN

SEQ ID NO: 3219571 - protein, 6 aa, Plasmodium falciparum
EYTEMK

SEQ ID NO: 3219572 - protein, 6 aa, Plasmodium falciparum
EYTKYG

SEQ ID NO: 3219573 - protein, 5 aa, Plasmodium falciparum
EYTNI

SEQ ID NO: 3219574 - protein, 7 aa, Plasmodium falciparum
EYTNNDN

SEQ ID NO: 3219575 - protein, 24 aa, Plasmodium falciparum
EYTNNNKKKSISLSNNKTKNKNYF

SEQ ID NO: 3219576 - protein, 7 aa, Plasmodium falciparum
EYTSKKI

SEQ ID NO: 3219577 - protein, 32 aa, Plasmodium falciparum
EYTTDCSNEENNTSDDEENENRKNENDDDNIP

SEQ ID NO: 3219578 - protein, 6 aa, Plasmodium falciparum
EYYDND

SEQ ID NO: 3219579 - protein, 4 aa, Plasmodium falciparum
EYYG

SEQ ID NO: 3219580 - protein, 4 aa, Plasmodium falciparum
EYYN

SEQ ID NO: 3219581 - protein, 25 aa, Plasmodium falciparum
EYYNKGKNCENANINGGDNKKNVYE

SEQ ID NO: 3219582 - protein, 16 aa, Plasmodium falciparum
FAEKAGAAQGAIAGNA

SEQ ID NO: 3219583 - protein, 4 aa, Plasmodium falciparum
FALP

SEQ ID NO: 3219584 - protein, 8 aa, Plasmodium falciparum
FANESKET

SEQ ID NO: 3219585 - protein, 11 aa, Plasmodium falciparum
FANSASSTATL

SEQ ID NO: 3219586 - protein, 9 aa, Plasmodium falciparum
FAQAGSDAF

SEQ ID NO: 3219587 - protein, 10 aa, Plasmodium falciparum
FAQKKKENII

SEQ ID NO: 3219588 - protein, 5 aa, Plasmodium falciparum
FATDN

SEQ ID NO: 3219589 - protein, 95 aa, Plasmodium falciparum
FCPPPEKPPKEEPDEKCGDKEEEKEQEEEKDKGNEEQSGAPSSPSPSEGTKELPPPPEPPEEAKPPEPVKPTPAPAPAAPPAAPAQPTLPADEPF

SEQ ID NO: 3219590 - protein, 4 aa, Plasmodium falciparum
FDAP

SEQ ID NO: 3219591 - protein, 6 aa, Plasmodium falciparum
FDDDEK

SEQ ID NO: 3219592 - protein, 12 aa, Plasmodium falciparum
FDDDEKKKSHTP

SEQ ID NO: 3219593 - protein, 12 aa, Plasmodium falciparum
FDDEKKKKKNLI

SEQ ID NO: 3219594 - protein, 12 aa, Plasmodium falciparum
FDDGDEVFGSQS

SEQ ID NO: 3219595 - protein, 8 aa, Plasmodium falciparum
FDDNKSSY

SEQ ID NO: 3219596 - protein, 10 aa, Plasmodium falciparum
FDEEKSNSCT

SEQ ID NO: 3219597 - protein, 47 aa, Plasmodium falciparum
FDEGEESESDFSGTKEDKKKKKKKKKKKNKEKNKSSNNNNNNNIKEK

SEQ ID NO: 3219598 - protein, 36 aa, Plasmodium falciparum
FDERNQQVNDRRNFDERNQQVNDRRNFDERNQHVND

SEQ ID NO: 3219599 - protein, 5 aa, Plasmodium falciparum
FDGGI

SEQ ID NO: 3219600 - protein, 9 aa, Plasmodium falciparum
FDGNNKKKR

SEQ ID NO: 3219601 - protein, 8 aa, Plasmodium falciparum
FDGNTYSE

SEQ ID NO: 3219602 - protein, 4 aa, Plasmodium falciparum
FDGY

SEQ ID NO: 3219603 - protein, 4 aa, Plasmodium falciparum
FDHT

SEQ ID NO: 3219604 - protein, 4 aa, Plasmodium falciparum
FDKD

SEQ ID NO: 3219605 - protein, 11 aa, Plasmodium falciparum
FDKDGKKEHVR

SEQ ID NO: 3219606 - protein, 7 aa, Plasmodium falciparum
FDKHNDN

SEQ ID NO: 3219607 - protein, 4 aa, Plasmodium falciparum
FDKK

SEQ ID NO: 3219608 - protein, 15 aa, Plasmodium falciparum
FDKKNREKKNYGNLE

SEQ ID NO: 3219609 - protein, 4 aa, Plasmodium falciparum
FDKN

SEQ ID NO: 3219610 - protein, 14 aa, Plasmodium falciparum
FDKPTTENKTPRVS

SEQ ID NO: 3219611 - protein, 5 aa, Plasmodium falciparum
FDKQS

SEQ ID NO: 3219612 - protein, 14 aa, Plasmodium falciparum
FDKYNNKKKIRKND

SEQ ID NO: 3219613 - protein, 10 aa, Plasmodium falciparum
FDNKEEENLN

SEQ ID NO: 3219614 - protein, 8 aa, Plasmodium falciparum
FDNNDKDK

SEQ ID NO: 3219615 - protein, 6 aa, Plasmodium falciparum
FDNNEN

SEQ ID NO: 3219616 - protein, 11 aa, Plasmodium falciparum
FDNNNNNNNNN

SEQ ID NO: 3219617 - protein, 18 aa, Plasmodium falciparum
FDNNSKENIDKHTNNYSQ

SEQ ID NO: 3219618 - protein, 10 aa, Plasmodium falciparum
FDNNSSSDEL

SEQ ID NO: 3219619 - protein, 6 aa, Plasmodium falciparum
FDPQKS

SEQ ID NO: 3219620 - protein, 7 aa, Plasmodium falciparum
FDPSQNN

SEQ ID NO: 3219621 - protein, 12 aa, Plasmodium falciparum
FDQKELKRRKNY

SEQ ID NO: 3219622 - protein, 12 aa, Plasmodium falciparum
FDRNSNDKNNHM

SEQ ID NO: 3219623 - protein, 9 aa, Plasmodium falciparum
FDRQTSQRF

SEQ ID NO: 3219624 - protein, 5 aa, Plasmodium falciparum
FDRTT

SEQ ID NO: 3219625 - protein, 4 aa, Plasmodium falciparum
FDSD

SEQ ID NO: 3219626 - protein, 7 aa, Plasmodium falciparum
FDSEDAR

SEQ ID NO: 3219627 - protein, 12 aa, Plasmodium falciparum
FDSEGSIKYKEE

SEQ ID NO: 3219628 - protein, 6 aa, Plasmodium falciparum
FDSSQE

SEQ ID NO: 3219629 - protein, 21 aa, Plasmodium falciparum
FDSSRDSENGRGDTTSNTHDV

SEQ ID NO: 3219630 - protein, 17 aa, Plasmodium falciparum
FDSTTTTHSSNNYKGNN

SEQ ID NO: 3219631 - protein, 4 aa, Plasmodium falciparum
FDTD

SEQ ID NO: 3219632 - protein, 4 aa, Plasmodium falciparum
FDTH

SEQ ID NO: 3219633 - protein, 5 aa, Plasmodium falciparum
FDTNT

SEQ ID NO: 3219634 - protein, 11 aa, Plasmodium falciparum
FDYPDTKTNEI

SEQ ID NO: 3219635 - protein, 5 aa, Plasmodium falciparum
FDYQQ

SEQ ID NO: 3219636 - protein, 7 aa, Plasmodium falciparum
FEAQPKD

SEQ ID NO: 3219637 - protein, 68 aa, Plasmodium falciparum
FEDEKDKQPEFKDPGRESEDDDDDEDELPPEDEAKEQEEEEKGAGEDEAASEAEASGPKVEVEGKPPC

SEQ ID NO: 3219638 - protein, 4 aa, Plasmodium falciparum
FEED

SEQ ID NO: 3219639 - protein, 12 aa, Plasmodium falciparum
FEEDENNNKKND

SEQ ID NO: 3219640 - protein, 35 aa, Plasmodium falciparum
FEEEEFDEKEEFDEKEEFDEEEEEGGQDEESKKMS

SEQ ID NO: 3219641 - protein, 7 aa, Plasmodium falciparum
FEEENKN

SEQ ID NO: 3219642 - protein, 7 aa, Plasmodium falciparum
FEEGKKR

SEQ ID NO: 3219643 - protein, 10 aa, Plasmodium falciparum
FEEGKSVKSY

SEQ ID NO: 3219644 - protein, 4 aa, Plasmodium falciparum
FEEK

SEQ ID NO: 3219645 - protein, 88 aa, Plasmodium falciparum
FEEKKNKKKKKREKKEDKKENKKENKKEDKKDDKKDDKKEDKKEDKKEDKKEDKKEDKKDENKDDKKDDKKEDKNKSDIQIKDDKNEV

SEQ ID NO: 3219646 - protein, 10 aa, Plasmodium falciparum
FEENDDSVHE

SEQ ID NO: 3219647 - protein, 8 aa, Plasmodium falciparum
FEEPQDEK

SEQ ID NO: 3219648 - protein, 27 aa, Plasmodium falciparum
FEEQENAYEEQQKKNCVNGNNKGGVNG

SEQ ID NO: 3219649 - protein, 5 aa, Plasmodium falciparum
FEETK

SEQ ID NO: 3219650 - protein, 4 aa, Plasmodium falciparum
FEGD

SEQ ID NO: 3219651 - protein, 4 aa, Plasmodium falciparum
FEGE

SEQ ID NO: 3219652 - protein, 9 aa, Plasmodium falciparum
FEGKKRIRE

SEQ ID NO: 3219653 - protein, 5 aa, Plasmodium falciparum
FEGRG

SEQ ID NO: 3219654 - protein, 5 aa, Plasmodium falciparum
FEGRT

SEQ ID NO: 3219655 - protein, 9 aa, Plasmodium falciparum
FEGTAKNTS

SEQ ID NO: 3219656 - protein, 15 aa, Plasmodium falciparum
FEKAPKEQQTPSGPC

SEQ ID NO: 3219657 - protein, 19 aa, Plasmodium falciparum
FEKKDKSEINKQRNMTNER

SEQ ID NO: 3219658 - protein, 14 aa, Plasmodium falciparum
FEKNESDPQTPGDP

SEQ ID NO: 3219659 - protein, 13 aa, Plasmodium falciparum
FENEGKKYARMGT

SEQ ID NO: 3219660 - protein, 8 aa, Plasmodium falciparum
FENEKKKY

SEQ ID NO: 3219661 - protein, 12 aa, Plasmodium falciparum
FENKKGGVSGAK

SEQ ID NO: 3219662 - protein, 48 aa, Plasmodium falciparum
FENKTESKEESSDSDASCTTNGDNRRNRDVETSFDDDYASASITRSSC

SEQ ID NO: 3219663 - protein, 4 aa, Plasmodium falciparum
FENN

SEQ ID NO: 3219664 - protein, 6 aa, Plasmodium falciparum
FENNEK

SEQ ID NO: 3219665 - protein, 7 aa, Plasmodium falciparum
FENNENE

SEQ ID NO: 3219666 - protein, 13 aa, Plasmodium falciparum
FENTKKECKERCD

SEQ ID NO: 3219667 - protein, 11 aa, Plasmodium falciparum
FENTNSLNNES

SEQ ID NO: 3219668 - protein, 13 aa, Plasmodium falciparum
FENVEEKEKERIS

SEQ ID NO: 3219669 - protein, 4 aa, Plasmodium falciparum
FEPK

SEQ ID NO: 3219670 - protein, 6 aa, Plasmodium falciparum
FEPPKM

SEQ ID NO: 3219671 - protein, 6 aa, Plasmodium falciparum
FEQNNP

SEQ ID NO: 3219672 - protein, 9 aa, Plasmodium falciparum
FEQQAQKEK

SEQ ID NO: 3219673 - protein, 5 aa, Plasmodium falciparum
FERTS

SEQ ID NO: 3219674 - protein, 7 aa, Plasmodium falciparum
FETEDGN

SEQ ID NO: 3219675 - protein, 15 aa, Plasmodium falciparum
FETENEEYHENDHDE

SEQ ID NO: 3219676 - protein, 21 aa, Plasmodium falciparum
FETNTEKRKKQYNKGKNEDAV

SEQ ID NO: 3219677 - protein, 7 aa, Plasmodium falciparum
FETQNKA

SEQ ID NO: 3219678 - protein, 4 aa, Plasmodium falciparum
FETS

SEQ ID NO: 3219679 - protein, 4 aa, Plasmodium falciparum
FETT

SEQ ID NO: 3219680 - protein, 20 aa, Plasmodium falciparum
FFGEDKKGINNNNNNNNSGQ

SEQ ID NO: 3219681 - protein, 5 aa, Plasmodium falciparum
FFGPN

SEQ ID NO: 3219682 - protein, 14 aa, Plasmodium falciparum
FGDSTEKKKKGDKD

SEQ ID NO: 3219683 - protein, 15 aa, Plasmodium falciparum
FGEPAQKKKKTSKYD

SEQ ID NO: 3219684 - protein, 26 aa, Plasmodium falciparum
FGEQKSAYVKQKTKCKEESGGGGNGV

SEQ ID NO: 3219685 - protein, 12 aa, Plasmodium falciparum
FGETQNSDAHTE

SEQ ID NO: 3219686 - protein, 9 aa, Plasmodium falciparum
FGGNTDRVK

SEQ ID NO: 3219687 - protein, 14 aa, Plasmodium falciparum
FGGSEKEKKRNSST

SEQ ID NO: 3219688 - protein, 16 aa, Plasmodium falciparum
FGGTCENATDFTEPIL

SEQ ID NO: 3219689 - protein, 13 aa, Plasmodium falciparum
FGKGEYNKKIRKN

SEQ ID NO: 3219690 - protein, 8 aa, Plasmodium falciparum
FGKGLTPY

SEQ ID NO: 3219691 - protein, 11 aa, Plasmodium falciparum
FGKGNRENAPK

SEQ ID NO: 3219692 - protein, 4 aa, Plasmodium falciparum
FGKQ

SEQ ID NO: 3219693 - protein, 7 aa, Plasmodium falciparum
FGKSPNT

SEQ ID NO: 3219694 - protein, 16 aa, Plasmodium falciparum
FGNNKKGEKKLEEKGS

SEQ ID NO: 3219695 - protein, 10 aa, Plasmodium falciparum
FGNPKNKRPI

SEQ ID NO: 3219696 - protein, 10 aa, Plasmodium falciparum
FGNVPNNECD

SEQ ID NO: 3219697 - protein, 8 aa, Plasmodium falciparum
FGPNISRD

SEQ ID NO: 3219698 - protein, 6 aa, Plasmodium falciparum
FGQEVG

SEQ ID NO: 3219699 - protein, 4 aa, Plasmodium falciparum
FGRG

SEQ ID NO: 3219700 - protein, 5 aa, Plasmodium falciparum
FGRPQ

SEQ ID NO: 3219701 - protein, 25 aa, Plasmodium falciparum
FGSAEPSKRMEKMEKKKNKVVYKTV

SEQ ID NO: 3219702 - protein, 4 aa, Plasmodium falciparum
FGSK

SEQ ID NO: 3219703 - protein, 10 aa, Plasmodium falciparum
FGSPNSTSSM

SEQ ID NO: 3219704 - protein, 5 aa, Plasmodium falciparum
FGSQG

SEQ ID NO: 3219705 - protein, 6 aa, Plasmodium falciparum
FGSSTE

SEQ ID NO: 3219706 - protein, 9 aa, Plasmodium falciparum
FGSTGTGMT

SEQ ID NO: 3219707 - protein, 28 aa, Plasmodium falciparum
FGSTLNDESKKKKKRTKDQNNTENNNTS

SEQ ID NO: 3219708 - protein, 8 aa, Plasmodium falciparum
FGTAKSGV

SEQ ID NO: 3219709 - protein, 26 aa, Plasmodium falciparum
FGTNNTKKNTSTNSASKLTNSDPITN

SEQ ID NO: 3219710 - protein, 6 aa, Plasmodium falciparum
FGTPEY

SEQ ID NO: 3219711 - protein, 13 aa, Plasmodium falciparum
FGTTTNTASSSNL

SEQ ID NO: 3219712 - protein, 6 aa, Plasmodium falciparum
FGYPEG

SEQ ID NO: 3219713 - protein, 8 aa, Plasmodium falciparum
FHDSKDNT

SEQ ID NO: 3219714 - protein, 36 aa, Plasmodium falciparum
FHEKEKDKDNDKDNDKDDDKDNDKDNDKDNDNNDNI

SEQ ID NO: 3219715 - protein, 5 aa, Plasmodium falciparum
FHGND

SEQ ID NO: 3219716 - protein, 5 aa, Plasmodium falciparum
FHNTN

SEQ ID NO: 3219717 - protein, 18 aa, Plasmodium falciparum
FHSENTNSYSNSNKDDYL

SEQ ID NO: 3219718 - protein, 17 aa, Plasmodium falciparum
FHTTNDGNVNKNLKRSK

SEQ ID NO: 3219719 - protein, 14 aa, Plasmodium falciparum
FINNDKDDTKNDTM

SEQ ID NO: 3219720 - protein, 8 aa, Plasmodium falciparum
FISPRNEQ

SEQ ID NO: 3219721 - protein, 4 aa, Plasmodium falciparum
FKDI

SEQ ID NO: 3219722 - protein, 5 aa, Plasmodium falciparum
FKDNE

SEQ ID NO: 3219723 - protein, 10 aa, Plasmodium falciparum
FKEEGDNVNK

SEQ ID NO: 3219724 - protein, 18 aa, Plasmodium falciparum
FKEKEKKQKEQDKNINEI

SEQ ID NO: 3219725 - protein, 5 aa, Plasmodium falciparum
FKEKK

SEQ ID NO: 3219726 - protein, 9 aa, Plasmodium falciparum
FKEKNKNDV

SEQ ID NO: 3219727 - protein, 10 aa, Plasmodium falciparum
FKENDSKTFK

SEQ ID NO: 3219728 - protein, 8 aa, Plasmodium falciparum
FKEPDNSS

SEQ ID NO: 3219729 - protein, 22 aa, Plasmodium falciparum
FKEPTNKMNKKNNNNNNNKKKN

SEQ ID NO: 3219730 - protein, 4 aa, Plasmodium falciparum
FKEY

SEQ ID NO: 3219731 - protein, 7 aa, Plasmodium falciparum
FKEYKTS

SEQ ID NO: 3219732 - protein, 4 aa, Plasmodium falciparum
FKGE

SEQ ID NO: 3219733 - protein, 12 aa, Plasmodium falciparum
FKGEKKEKENSE

SEQ ID NO: 3219734 - protein, 8 aa, Plasmodium falciparum
FKGENSNF

SEQ ID NO: 3219735 - protein, 17 aa, Plasmodium falciparum
FKGKNNKYNKKQEYYNQ

SEQ ID NO: 3219736 - protein, 18 aa, Plasmodium falciparum
FKGNEKSIHSSSDSCSYS

SEQ ID NO: 3219737 - protein, 7 aa, Plasmodium falciparum
FKGPSYD

SEQ ID NO: 3219738 - protein, 9 aa, Plasmodium falciparum
FKGSNQNEL

SEQ ID NO: 3219739 - protein, 8 aa, Plasmodium falciparum
FKHTEKTK

SEQ ID NO: 3219740 - protein, 17 aa, Plasmodium falciparum
FKKDQESISNDKYCPDE

SEQ ID NO: 3219741 - protein, 12 aa, Plasmodium falciparum
FKKEGSDNTDVH

SEQ ID NO: 3219742 - protein, 8 aa, Plasmodium falciparum
FKKENTTK

SEQ ID NO: 3219743 - protein, 12 aa, Plasmodium falciparum
FKKKGDAQNDAE

SEQ ID NO: 3219744 - protein, 5 aa, Plasmodium falciparum
FKKND

SEQ ID NO: 3219745 - protein, 16 aa, Plasmodium falciparum
FKKNNDNGISSSNKKK

SEQ ID NO: 3219746 - protein, 10 aa, Plasmodium falciparum
FKKPPKKYER

SEQ ID NO: 3219747 - protein, 41 aa, Plasmodium falciparum
FKKQEKAYGGQKQNCKKERKAAESNDNDKQFCGTPETTCNT

SEQ ID NO: 3219748 - protein, 8 aa, Plasmodium falciparum
FKKQQKKK

SEQ ID NO: 3219749 - protein, 9 aa, Plasmodium falciparum
FKKSNNKVK

SEQ ID NO: 3219750 - protein, 29 aa, Plasmodium falciparum
FKNCEQRKTKINKQKNNNNNNSNNTYNNE

SEQ ID NO: 3219751 - protein, 5 aa, Plasmodium falciparum
FKNDD

SEQ ID NO: 3219752 - protein, 6 aa, Plasmodium falciparum
FKNDDE

SEQ ID NO: 3219753 - protein, 8 aa, Plasmodium falciparum
FKNDESYN

SEQ ID NO: 3219754 - protein, 46 aa, Plasmodium falciparum
FKNEESKNEESKNEESKNEESKNEEFKNEESKNEEFKNEEFKNEDM

SEQ ID NO: 3219755 - protein, 16 aa, Plasmodium falciparum
FKNEKKNINEEENNDE

SEQ ID NO: 3219756 - protein, 9 aa, Plasmodium falciparum
FKNESHEKK

SEQ ID NO: 3219757 - protein, 10 aa, Plasmodium falciparum
FKNKDNFKEP

SEQ ID NO: 3219758 - protein, 23 aa, Plasmodium falciparum
FKNKKKEAHKKQDKLSNQESYKK

SEQ ID NO: 3219759 - protein, 17 aa, Plasmodium falciparum
FKNNDDVSLNKESYPRR

SEQ ID NO: 3219760 - protein, 6 aa, Plasmodium falciparum
FKNNIS

SEQ ID NO: 3219761 - protein, 10 aa, Plasmodium falciparum
FKNNKYNHNK

SEQ ID NO: 3219762 - protein, 11 aa, Plasmodium falciparum
FKNNNKKASIH

SEQ ID NO: 3219763 - protein, 9 aa, Plasmodium falciparum
FKNPSDSEM

SEQ ID NO: 3219764 - protein, 11 aa, Plasmodium falciparum
FKNPTKNEGKE

SEQ ID NO: 3219765 - protein, 8 aa, Plasmodium falciparum
FKNSKFGQ

SEQ ID NO: 3219766 - protein, 11 aa, Plasmodium falciparum
FKNTPKDHDEA

SEQ ID NO: 3219767 - protein, 5 aa, Plasmodium falciparum
FKNTY

SEQ ID NO: 3219768 - protein, 9 aa, Plasmodium falciparum
FKPATNCKP

SEQ ID NO: 3219769 - protein, 12 aa, Plasmodium falciparum
FKPKGGTQSSHV

SEQ ID NO: 3219770 - protein, 7 aa, Plasmodium falciparum
FKPTPGM

SEQ ID NO: 3219771 - protein, 16 aa, Plasmodium falciparum
FKQDKNNNENRSNASC

SEQ ID NO: 3219772 - protein, 8 aa, Plasmodium falciparum
FKQSEEDV

SEQ ID NO: 3219773 - protein, 16 aa, Plasmodium falciparum
FKRKKTKTDDDLKDDT

SEQ ID NO: 3219774 - protein, 6 aa, Plasmodium falciparum
FKRNEN

SEQ ID NO: 3219775 - protein, 12 aa, Plasmodium falciparum
FKRNNEKKGDKR

SEQ ID NO: 3219776 - protein, 13 aa, Plasmodium falciparum
FKSKDEKKDTYNK

SEQ ID NO: 3219777 - protein, 11 aa, Plasmodium falciparum
FKSNSDGGINK

SEQ ID NO: 3219778 - protein, 25 aa, Plasmodium falciparum
FKTKKEEEKQKDNTKEDNDNNMEKE

SEQ ID NO: 3219779 - protein, 30 aa, Plasmodium falciparum
FKTSEDYEDEYNENSENDINDEYNENSDND

SEQ ID NO: 3219780 - protein, 13 aa, Plasmodium falciparum
FKYEDNSSSFKGS

SEQ ID NO: 3219781 - protein, 4 aa, Plasmodium falciparum
FLPS

SEQ ID NO: 3219782 - protein, 4 aa, Plasmodium falciparum
FMSN

SEQ ID NO: 3219783 - protein, 16 aa, Plasmodium falciparum
FNADRKKKKLSSKTTK

SEQ ID NO: 3219784 - protein, 18 aa, Plasmodium falciparum
FNDDDDNNYDDDGNSYSS

SEQ ID NO: 3219785 - protein, 6 aa, Plasmodium falciparum
FNDENN

SEQ ID NO: 3219786 - protein, 8 aa, Plasmodium falciparum
FNDGAKRN

SEQ ID NO: 3219787 - protein, 11 aa, Plasmodium falciparum
FNDKKKDIETM

SEQ ID NO: 3219788 - protein, 11 aa, Plasmodium falciparum
FNDKSSDSDDI

SEQ ID NO: 3219789 - protein, 10 aa, Plasmodium falciparum
FNDNDSYSSL

SEQ ID NO: 3219790 - protein, 11 aa, Plasmodium falciparum
FNDNNNNNNNN

SEQ ID NO: 3219791 - protein, 9 aa, Plasmodium falciparum
FNDPKTTFG

SEQ ID NO: 3219792 - protein, 13 aa, Plasmodium falciparum
FNDQPEEKKNNNL

SEQ ID NO: 3219793 - protein, 17 aa, Plasmodium falciparum
FNDQYKKENNEGTSSNL

SEQ ID NO: 3219794 - protein, 7 aa, Plasmodium falciparum
FNDTNTE

SEQ ID NO: 3219795 - protein, 7 aa, Plasmodium falciparum
FNEAGAK

SEQ ID NO: 3219796 - protein, 4 aa, Plasmodium falciparum
FNED

SEQ ID NO: 3219797 - protein, 10 aa, Plasmodium falciparum
FNEDDKLKKS

SEQ ID NO: 3219798 - protein, 7 aa, Plasmodium falciparum
FNEEEKN

SEQ ID NO: 3219799 - protein, 12 aa, Plasmodium falciparum
FNEESERNNGYF

SEQ ID NO: 3219800 - protein, 4 aa, Plasmodium falciparum
FNEK

SEQ ID NO: 3219801 - protein, 9 aa, Plasmodium falciparum
FNEKNITNY

SEQ ID NO: 3219802 - protein, 14 aa, Plasmodium falciparum
FNEMDKNKKKEAYK

SEQ ID NO: 3219803 - protein, 17 aa, Plasmodium falciparum
FNEPDETFKDADNCKPC

SEQ ID NO: 3219804 - protein, 11 aa, Plasmodium falciparum
FNERPNNENSS

SEQ ID NO: 3219805 - protein, 10 aa, Plasmodium falciparum
FNESNSSMNS

SEQ ID NO: 3219806 - protein, 14 aa, Plasmodium falciparum
FNIPPEKNKSYNNI

SEQ ID NO: 3219807 - protein, 16 aa, Plasmodium falciparum
FNISDDEKKEKRKRKH

SEQ ID NO: 3219808 - protein, 4 aa, Plasmodium falciparum
FNKN

SEQ ID NO: 3219809 - protein, 10 aa, Plasmodium falciparum
FNKNQGANKN

SEQ ID NO: 3219810 - protein, 7 aa, Plasmodium falciparum
FNKNSVK

SEQ ID NO: 3219811 - protein, 12 aa, Plasmodium falciparum
FNKTDDKDAFDR

SEQ ID NO: 3219812 - protein, 7 aa, Plasmodium falciparum
FNNNDKN

SEQ ID NO: 3219813 - protein, 9 aa, Plasmodium falciparum
FNNNDNNVI

SEQ ID NO: 3219814 - protein, 26 aa, Plasmodium falciparum
FNNNGINNRRQNKKLKGSTTKSININ

SEQ ID NO: 3219815 - protein, 5 aa, Plasmodium falciparum
FNNNK

SEQ ID NO: 3219816 - protein, 10 aa, Plasmodium falciparum
FNNNKEQSKN

SEQ ID NO: 3219817 - protein, 6 aa, Plasmodium falciparum
FNNNNN

SEQ ID NO: 3219818 - protein, 19 aa, Plasmodium falciparum
FNNNNSSYDPLKNNNINNT

SEQ ID NO: 3219819 - protein, 6 aa, Plasmodium falciparum
FNNNPK

SEQ ID NO: 3219820 - protein, 9 aa, Plasmodium falciparum
FNNNSNNSG

SEQ ID NO: 3219821 - protein, 4 aa, Plasmodium falciparum
FNNP

SEQ ID NO: 3219822 - protein, 11 aa, Plasmodium falciparum
FNNPEQTFRPA

SEQ ID NO: 3219823 - protein, 10 aa, Plasmodium falciparum
FNNQGYQKSD

SEQ ID NO: 3219824 - protein, 14 aa, Plasmodium falciparum
FNNRPSKNKKYRLS

SEQ ID NO: 3219825 - protein, 10 aa, Plasmodium falciparum
FNNSESNQHL

SEQ ID NO: 3219826 - protein, 21 aa, Plasmodium falciparum
FNNSSSIKNTGNNYKNDNIDK

SEQ ID NO: 3219827 - protein, 38 aa, Plasmodium falciparum
FNNTNGRNTCYTKRKKKGKDVANDQVKYKSSKKDKYKE

SEQ ID NO: 3219828 - protein, 9 aa, Plasmodium falciparum
FNNTNKQNK

SEQ ID NO: 3219829 - protein, 4 aa, Plasmodium falciparum
FNNY

SEQ ID NO: 3219830 - protein, 6 aa, Plasmodium falciparum
FNPNNG

SEQ ID NO: 3219831 - protein, 4 aa, Plasmodium falciparum
FNPP

SEQ ID NO: 3219832 - protein, 7 aa, Plasmodium falciparum
FNQNDKI

SEQ ID NO: 3219833 - protein, 13 aa, Plasmodium falciparum
FNQNEKKKKKEKK

SEQ ID NO: 3219834 - protein, 26 aa, Plasmodium falciparum
FNQNQTDHENLPEQVREKKNSQEEKN

SEQ ID NO: 3219835 - protein, 11 aa, Plasmodium falciparum
FNSDAKKKEWT

SEQ ID NO: 3219836 - protein, 13 aa, Plasmodium falciparum
FNSDNNWEKPYDT

SEQ ID NO: 3219837 - protein, 4 aa, Plasmodium falciparum
FNSE

SEQ ID NO: 3219838 - protein, 11 aa, Plasmodium falciparum
FNSEDNKLKGI

SEQ ID NO: 3219839 - protein, 45 aa, Plasmodium falciparum
FNSEECNKNEKKKNDNNVDENDDNVDKNDDNNNNNNNGDDNNNID

SEQ ID NO: 3219840 - protein, 10 aa, Plasmodium falciparum
FNSNSQNEKY

SEQ ID NO: 3219841 - protein, 28 aa, Plasmodium falciparum
FNSSNDKSGKDQNEKNNNNVENDKMGGH

SEQ ID NO: 3219842 - protein, 12 aa, Plasmodium falciparum
FNSTSNSNIIND

SEQ ID NO: 3219843 - protein, 15 aa, Plasmodium falciparum
FNSTYNKRNNMSDNC

SEQ ID NO: 3219844 - protein, 13 aa, Plasmodium falciparum
FNTEDNNENNKKL

SEQ ID NO: 3219845 - protein, 4 aa, Plasmodium falciparum
FNTN

SEQ ID NO: 3219846 - protein, 12 aa, Plasmodium falciparum
FNTPNNDTTNYD

SEQ ID NO: 3219847 - protein, 5 aa, Plasmodium falciparum
FPDEN

SEQ ID NO: 3219848 - protein, 6 aa, Plasmodium falciparum
FPDNIS

SEQ ID NO: 3219849 - protein, 4 aa, Plasmodium falciparum
FPDS

SEQ ID NO: 3219850 - protein, 11 aa, Plasmodium falciparum
FPEKLDDKSKE

SEQ ID NO: 3219851 - protein, 16 aa, Plasmodium falciparum
FPENKENNKNKRNSKF

SEQ ID NO: 3219852 - protein, 5 aa, Plasmodium falciparum
FPERN

SEQ ID NO: 3219853 - protein, 4 aa, Plasmodium falciparum
FPGG

SEQ ID NO: 3219854 - protein, 4 aa, Plasmodium falciparum
FPGQ

SEQ ID NO: 3219855 - protein, 28 aa, Plasmodium falciparum
FPKNDEHKDNLSSKESLEVEGENCSTRI

SEQ ID NO: 3219856 - protein, 9 aa, Plasmodium falciparum
FPKSGEENC

SEQ ID NO: 3219857 - protein, 8 aa, Plasmodium falciparum
FPKSSPNG

SEQ ID NO: 3219858 - protein, 11 aa, Plasmodium falciparum
FPLTPSNDSLK

SEQ ID NO: 3219859 - protein, 5 aa, Plasmodium falciparum
FPNDE

SEQ ID NO: 3219860 - protein, 4 aa, Plasmodium falciparum
FPNK

SEQ ID NO: 3219861 - protein, 9 aa, Plasmodium falciparum
FPNNTNNNI

SEQ ID NO: 3219862 - protein, 15 aa, Plasmodium falciparum
FPNYPRNRKAIFPYI

SEQ ID NO: 3219863 - protein, 5 aa, Plasmodium falciparum
FPPTE

SEQ ID NO: 3219864 - protein, 5 aa, Plasmodium falciparum
FPQIN

SEQ ID NO: 3219865 - protein, 5 aa, Plasmodium falciparum
FPRPK

SEQ ID NO: 3219866 - protein, 5 aa, Plasmodium falciparum
FPSES

SEQ ID NO: 3219867 - protein, 6 aa, Plasmodium falciparum
FPSGTN

SEQ ID NO: 3219868 - protein, 11 aa, Plasmodium falciparum
FPSKTGPSVNT

SEQ ID NO: 3219869 - protein, 8 aa, Plasmodium falciparum
FPSNDDKL

SEQ ID NO: 3219870 - protein, 4 aa, Plasmodium falciparum
FPSS

SEQ ID NO: 3219871 - protein, 43 aa, Plasmodium falciparum
FPSTGSSRLEDYEKEGSNVDITEEEEKEAESVDDNNKEGNESD

SEQ ID NO: 3219872 - protein, 4 aa, Plasmodium falciparum
FPTP

SEQ ID NO: 3219873 - protein, 5 aa, Plasmodium falciparum
FQDTY

SEQ ID NO: 3219874 - protein, 20 aa, Plasmodium falciparum
FQEEEKNEYYSNENNNNTIK

SEQ ID NO: 3219875 - protein, 14 aa, Plasmodium falciparum
FQGQSETDNYSTTS

SEQ ID NO: 3219876 - protein, 14 aa, Plasmodium falciparum
FQKSKKKNMNESEK

SEQ ID NO: 3219877 - protein, 4 aa, Plasmodium falciparum
FQKY

SEQ ID NO: 3219878 - protein, 4 aa, Plasmodium falciparum
FQNE

SEQ ID NO: 3219879 - protein, 13 aa, Plasmodium falciparum
FQNNNNDHSSNAK

SEQ ID NO: 3219880 - protein, 21 aa, Plasmodium falciparum
FQNSTDCTVAGSSENGVTNKK

SEQ ID NO: 3219881 - protein, 6 aa, Plasmodium falciparum
FQPEQN

SEQ ID NO: 3219882 - protein, 15 aa, Plasmodium falciparum
FQPNEENTQNVQNNG

SEQ ID NO: 3219883 - protein, 4 aa, Plasmodium falciparum
FQSG

SEQ ID NO: 3219884 - protein, 5 aa, Plasmodium falciparum
FQSTR

SEQ ID NO: 3219885 - protein, 7 aa, Plasmodium falciparum
FRAPDKK

SEQ ID NO: 3219886 - protein, 9 aa, Plasmodium falciparum
FRKDDEDKI

SEQ ID NO: 3219887 - protein, 7 aa, Plasmodium falciparum
FRKNSNG

SEQ ID NO: 3219888 - protein, 9 aa, Plasmodium falciparum
FRKQGENIA

SEQ ID NO: 3219889 - protein, 12 aa, Plasmodium falciparum
FRKQNNDNKKCS

SEQ ID NO: 3219890 - protein, 7 aa, Plasmodium falciparum
FRSNKDK

SEQ ID NO: 3219891 - protein, 4 aa, Plasmodium falciparum
FSAD

SEQ ID NO: 3219892 - protein, 14 aa, Plasmodium falciparum
FSADTQAAKVSSKI

SEQ ID NO: 3219893 - protein, 9 aa, Plasmodium falciparum
FSDKEGAEC

SEQ ID NO: 3219894 - protein, 14 aa, Plasmodium falciparum
FSDSDGKKNDPSYK

SEQ ID NO: 3219895 - protein, 5 aa, Plasmodium falciparum
FSDSI

SEQ ID NO: 3219896 - protein, 8 aa, Plasmodium falciparum
FSDTKGAK

SEQ ID NO: 3219897 - protein, 4 aa, Plasmodium falciparum
FSED

SEQ ID NO: 3219898 - protein, 11 aa, Plasmodium falciparum
FSEDESSYNDV

SEQ ID NO: 3219899 - protein, 12 aa, Plasmodium falciparum
FSEGKKENFEEN

SEQ ID NO: 3219900 - protein, 5 aa, Plasmodium falciparum
FSEKN

SEQ ID NO: 3219901 - protein, 5 aa, Plasmodium falciparum
FSENS

SEQ ID NO: 3219902 - protein, 10 aa, Plasmodium falciparum
FSGGEKKRNE

SEQ ID NO: 3219903 - protein, 20 aa, Plasmodium falciparum
FSGGGTTIQEHREKGGNLDK

SEQ ID NO: 3219904 - protein, 9 aa, Plasmodium falciparum
FSGNGNNVE

SEQ ID NO: 3219905 - protein, 19 aa, Plasmodium falciparum
FSHDEDENHVNNKSGEEIN

SEQ ID NO: 3219906 - protein, 4 aa, Plasmodium falciparum
FSIK

SEQ ID NO: 3219907 - protein, 81 aa, Plasmodium falciparum
FSKDFSDKSYSDNDGEKEDKDDAGQDNQKWEDDIKNENKDKHDKNEKNDKNEKNDKNEKNDKNEKNDKNEKNDKNDDDVQL

SEQ ID NO: 3219908 - protein, 10 aa, Plasmodium falciparum
FSKDNNSNSI

SEQ ID NO: 3219909 - protein, 5 aa, Plasmodium falciparum
FSKDP

SEQ ID NO: 3219910 - protein, 4 aa, Plasmodium falciparum
FSKE

SEQ ID NO: 3219911 - protein, 13 aa, Plasmodium falciparum
FSKEETKSKNEER

SEQ ID NO: 3219912 - protein, 8 aa, Plasmodium falciparum
FSKEETQE

SEQ ID NO: 3219913 - protein, 56 aa, Plasmodium falciparum
FSKGGNLQNEQKGDEDVKKEDVKKENVNKEEIKNGNNNNNNDENENEVDDNTVSTT

SEQ ID NO: 3219914 - protein, 19 aa, Plasmodium falciparum
FSKKKKKKKTEKKKKNISI

SEQ ID NO: 3219915 - protein, 6 aa, Plasmodium falciparum
FSKQKG

SEQ ID NO: 3219916 - protein, 10 aa, Plasmodium falciparum
FSKQNTYNNS

SEQ ID NO: 3219917 - protein, 6 aa, Plasmodium falciparum
FSKSNV

SEQ ID NO: 3219918 - protein, 11 aa, Plasmodium falciparum
FSKTNNLQEDY

SEQ ID NO: 3219919 - protein, 12 aa, Plasmodium falciparum
FSLSNTKKKINK

SEQ ID NO: 3219920 - protein, 7 aa, Plasmodium falciparum
FSNDESF

SEQ ID NO: 3219921 - protein, 6 aa, Plasmodium falciparum
FSNHKE

SEQ ID NO: 3219922 - protein, 4 aa, Plasmodium falciparum
FSNK

SEQ ID NO: 3219923 - protein, 11 aa, Plasmodium falciparum
FSNKKKDKLNE

SEQ ID NO: 3219924 - protein, 10 aa, Plasmodium falciparum
FSNKNNTKRV

SEQ ID NO: 3219925 - protein, 12 aa, Plasmodium falciparum
FSNNNSKNNDNY

SEQ ID NO: 3219926 - protein, 5 aa, Plasmodium falciparum
FSNNV

SEQ ID NO: 3219927 - protein, 10 aa, Plasmodium falciparum
FSNQSGSAED

SEQ ID NO: 3219928 - protein, 5 aa, Plasmodium falciparum
FSNSE

SEQ ID NO: 3219929 - protein, 24 aa, Plasmodium falciparum
FSNSGKPSTSVTPVTQPSGTTPQA

SEQ ID NO: 3219930 - protein, 9 aa, Plasmodium falciparum
FSNTFSKDN

SEQ ID NO: 3219931 - protein, 5 aa, Plasmodium falciparum
FSNTS

SEQ ID NO: 3219932 - protein, 4 aa, Plasmodium falciparum
FSNY

SEQ ID NO: 3219933 - protein, 4 aa, Plasmodium falciparum
FSPK

SEQ ID NO: 3219934 - protein, 7 aa, Plasmodium falciparum
FSPNNNP

SEQ ID NO: 3219935 - protein, 6 aa, Plasmodium falciparum
FSPYSN

SEQ ID NO: 3219936 - protein, 28 aa, Plasmodium falciparum
FSQNNNYSSTHNNNSVSKGKASGSYINS

SEQ ID NO: 3219937 - protein, 4 aa, Plasmodium falciparum
FSQP

SEQ ID NO: 3219938 - protein, 13 aa, Plasmodium falciparum
FSRKSNSNYDTNI

SEQ ID NO: 3219939 - protein, 45 aa, Plasmodium falciparum
FSRNDTCTKINKNGDIHSSDNKYTRDTYETYDSVTNTSTTANTYN

SEQ ID NO: 3219940 - protein, 19 aa, Plasmodium falciparum
FSRNRKNNYSNNNESSEKI

SEQ ID NO: 3219941 - protein, 7 aa, Plasmodium falciparum
FSRSKYP

SEQ ID NO: 3219942 - protein, 11 aa, Plasmodium falciparum
FSSDENNSINN

SEQ ID NO: 3219943 - protein, 10 aa, Plasmodium falciparum
FSSDKSENYC

SEQ ID NO: 3219944 - protein, 31 aa, Plasmodium falciparum
FSSDSKKMKNDLNNNNNNNNNSSRSGAKRNI

SEQ ID NO: 3219945 - protein, 27 aa, Plasmodium falciparum
FSSDTKEWSPNNLTSKKKKKKKEIRPK

SEQ ID NO: 3219946 - protein, 4 aa, Plasmodium falciparum
FSSE

SEQ ID NO: 3219947 - protein, 18 aa, Plasmodium falciparum
FSSEKKKTRSNLNNGDNK

SEQ ID NO: 3219948 - protein, 9 aa, Plasmodium falciparum
FSSENKDKM

SEQ ID NO: 3219949 - protein, 12 aa, Plasmodium falciparum
FSSENNKENSSD

SEQ ID NO: 3219950 - protein, 18 aa, Plasmodium falciparum
FSSHKNNNNNKNNISSNN

SEQ ID NO: 3219951 - protein, 6 aa, Plasmodium falciparum
FSSKEK

SEQ ID NO: 3219952 - protein, 5 aa, Plasmodium falciparum
FSSKK

SEQ ID NO: 3219953 - protein, 9 aa, Plasmodium falciparum
FSSKKEEKV

SEQ ID NO: 3219954 - protein, 41 aa, Plasmodium falciparum
FSSNKSKDIVEDSSSSNNNNNNNNNDKTNQNNENKNNSVSQ

SEQ ID NO: 3219955 - protein, 9 aa, Plasmodium falciparum
FSSRNTSSI

SEQ ID NO: 3219956 - protein, 9 aa, Plasmodium falciparum
FSSSGNTNN

SEQ ID NO: 3219957 - protein, 5 aa, Plasmodium falciparum
FSSSH

SEQ ID NO: 3219958 - protein, 10 aa, Plasmodium falciparum
FSSSPKDQCA

SEQ ID NO: 3219959 - protein, 9 aa, Plasmodium falciparum
FSSTKDEDE

SEQ ID NO: 3219960 - protein, 11 aa, Plasmodium falciparum
FSSTKTNQTTV

SEQ ID NO: 3219961 - protein, 48 aa, Plasmodium falciparum
FSTDGEQNNSRDMHNEQSSLNQDVQDSFSNGNGTHTSENNGRDRESTN

SEQ ID NO: 3219962 - protein, 26 aa, Plasmodium falciparum
FSTDSQTSIYNKNTSVENKSYNSRQI

SEQ ID NO: 3219963 - protein, 10 aa, Plasmodium falciparum
FSTNDNKNLE

SEQ ID NO: 3219964 - protein, 7 aa, Plasmodium falciparum
FSTPKLD

SEQ ID NO: 3219965 - protein, 5 aa, Plasmodium falciparum
FSTQE

SEQ ID NO: 3219966 - protein, 9 aa, Plasmodium falciparum
FSTQETIKT

SEQ ID NO: 3219967 - protein, 12 aa, Plasmodium falciparum
FSTQQKDEKDFD

SEQ ID NO: 3219968 - protein, 13 aa, Plasmodium falciparum
FSTTAKTHPENCP

SEQ ID NO: 3219969 - protein, 4 aa, Plasmodium falciparum
FSVQ

SEQ ID NO: 3219970 - protein, 6 aa, Plasmodium falciparum
FSYEGE

SEQ ID NO: 3219971 - protein, 5 aa, Plasmodium falciparum
FSYKP

SEQ ID NO: 3219972 - protein, 9 aa, Plasmodium falciparum
FSYSNDTVS

SEQ ID NO: 3219973 - protein, 27 aa, Plasmodium falciparum
FTANNNNNNNNNNNNNNNNNNNSNNNN

SEQ ID NO: 3219974 - protein, 10 aa, Plasmodium falciparum
FTATGGSKVP

SEQ ID NO: 3219975 - protein, 8 aa, Plasmodium falciparum
FTEDSSSS

SEQ ID NO: 3219976 - protein, 5 aa, Plasmodium falciparum
FTEKK

SEQ ID NO: 3219977 - protein, 10 aa, Plasmodium falciparum
FTENDTTYSF

SEQ ID NO: 3219978 - protein, 8 aa, Plasmodium falciparum
FTKKSSNN

SEQ ID NO: 3219979 - protein, 14 aa, Plasmodium falciparum
FTKPADKNSNNEGT

SEQ ID NO: 3219980 - protein, 4 aa, Plasmodium falciparum
FTKS

SEQ ID NO: 3219981 - protein, 11 aa, Plasmodium falciparum
FTLTPKKNKYL

SEQ ID NO: 3219982 - protein, 16 aa, Plasmodium falciparum
FTNETSTDLKSTKDQE

SEQ ID NO: 3219983 - protein, 4 aa, Plasmodium falciparum
FTNN

SEQ ID NO: 3219984 - protein, 6 aa, Plasmodium falciparum
FTNNEE

SEQ ID NO: 3219985 - protein, 9 aa, Plasmodium falciparum
FTNTSDKKN

SEQ ID NO: 3219986 - protein, 10 aa, Plasmodium falciparum
FTNTSSPLSS

SEQ ID NO: 3219987 - protein, 4 aa, Plasmodium falciparum
FTPE

SEQ ID NO: 3219988 - protein, 7 aa, Plasmodium falciparum
FTPKKNR

SEQ ID NO: 3219989 - protein, 6 aa, Plasmodium falciparum
FTPPPK

SEQ ID NO: 3219990 - protein, 9 aa, Plasmodium falciparum
FTPVGDPSR

SEQ ID NO: 3219991 - protein, 12 aa, Plasmodium falciparum
FTQDSNKNRYIN

SEQ ID NO: 3219992 - protein, 4 aa, Plasmodium falciparum
FTQN

SEQ ID NO: 3219993 - protein, 4 aa, Plasmodium falciparum
FTRD

SEQ ID NO: 3219994 - protein, 10 aa, Plasmodium falciparum
FTRTKENINN

SEQ ID NO: 3219995 - protein, 5 aa, Plasmodium falciparum
FTSGN

SEQ ID NO: 3219996 - protein, 14 aa, Plasmodium falciparum
FTSKGDAQPNIDQP

SEQ ID NO: 3219997 - protein, 10 aa, Plasmodium falciparum
FTSKSSKHNI

SEQ ID NO: 3219998 - protein, 4 aa, Plasmodium falciparum
FTSP

SEQ ID NO: 3219999 - protein, 5 aa, Plasmodium falciparum
FTTNN

SEQ ID NO: 3220000 - protein, 10 aa, Plasmodium falciparum
FTTNSNNISN

SEQ ID NO: 3220001 - protein, 5 aa, Plasmodium falciparum
FYDET

SEQ ID NO: 3220002 - protein, 24 aa, Plasmodium falciparum
FYEGSDNNKYKNVNKTNDNIDNTN

SEQ ID NO: 3220003 - protein, 6 aa, Plasmodium falciparum
FYNNNN

SEQ ID NO: 3220004 - protein, 10 aa, Plasmodium falciparum
FYSEKNSSNE

SEQ ID NO: 3220005 - protein, 4 aa, Plasmodium falciparum
FYSK

SEQ ID NO: 3220006 - protein, 10 aa, Plasmodium falciparum
FYSSNHNNYD

SEQ ID NO: 3220007 - protein, 5 aa, Plasmodium falciparum
GAAAG

SEQ ID NO: 3220008 - protein, 8 aa, Plasmodium falciparum
GAAPRIQG

SEQ ID NO: 3220009 - protein, 6 aa, Plasmodium falciparum
GAASGI

SEQ ID NO: 3220010 - protein, 8 aa, Plasmodium falciparum
GAASGIGS

SEQ ID NO: 3220011 - protein, 35 aa, Plasmodium falciparum
GAATAANTQEKKFNPTRNPSQSGPYRHHGPQGRTP

SEQ ID NO: 3220012 - protein, 5 aa, Plasmodium falciparum
GACPP

SEQ ID NO: 3220013 - protein, 9 aa, Plasmodium falciparum
GADGSITES

SEQ ID NO: 3220014 - protein, 7 aa, Plasmodium falciparum
GADPEKT

SEQ ID NO: 3220015 - protein, 10 aa, Plasmodium falciparum
GADQFSGDQF

SEQ ID NO: 3220016 - protein, 9 aa, Plasmodium falciparum
GADTKKNLN

SEQ ID NO: 3220017 - protein, 8 aa, Plasmodium falciparum
GAECDTNE

SEQ ID NO: 3220018 - protein, 21 aa, Plasmodium falciparum
GAECGNSKIHGNSKGGTGTEV

SEQ ID NO: 3220019 - protein, 4 aa, Plasmodium falciparum
GAEQ

SEQ ID NO: 3220020 - protein, 18 aa, Plasmodium falciparum
GAEQAAKAAAKAAEKGVT

SEQ ID NO: 3220021 - protein, 11 aa, Plasmodium falciparum
GAEQAAKAKAA

SEQ ID NO: 3220022 - protein, 14 aa, Plasmodium falciparum
GAESSKKSKNSNDN

SEQ ID NO: 3220023 - protein, 7 aa, Plasmodium falciparum
GAFPNKF

SEQ ID NO: 3220024 - protein, 8 aa, Plasmodium falciparum
GAGESDKY

SEQ ID NO: 3220025 - protein, 5 aa, Plasmodium falciparum
GAGGS

SEQ ID NO: 3220026 - protein, 9 aa, Plasmodium falciparum
GAGSDSDFH

SEQ ID NO: 3220027 - protein, 7 aa, Plasmodium falciparum
GAGTSDK

SEQ ID NO: 3220028 - protein, 6 aa, Plasmodium falciparum
GAIAST

SEQ ID NO: 3220029 - protein, 14 aa, Plasmodium falciparum
GAIPPPPSGTTPSS

SEQ ID NO: 3220030 - protein, 4 aa, Plasmodium falciparum
GAKA

SEQ ID NO: 3220031 - protein, 10 aa, Plasmodium falciparum
GAKDHYQKDG

SEQ ID NO: 3220032 - protein, 5 aa, Plasmodium falciparum
GAKDM

SEQ ID NO: 3220033 - protein, 12 aa, Plasmodium falciparum
GAKKLEDDLENK

SEQ ID NO: 3220034 - protein, 8 aa, Plasmodium falciparum
GAKNKEKE

SEQ ID NO: 3220035 - protein, 4 aa, Plasmodium falciparum
GAKR

SEQ ID NO: 3220036 - protein, 18 aa, Plasmodium falciparum
GALSPSGTLEPNDPNNIY

SEQ ID NO: 3220037 - protein, 31 aa, Plasmodium falciparum
GANDGKRHPCKKDGKGEEVPRFSDKQGAECA

SEQ ID NO: 3220038 - protein, 8 aa, Plasmodium falciparum
GANMNREN

SEQ ID NO: 3220039 - protein, 13 aa, Plasmodium falciparum
GANNMKDNNGQMK

SEQ ID NO: 3220040 - protein, 5 aa, Plasmodium falciparum
GANQN

SEQ ID NO: 3220041 - protein, 8 aa, Plasmodium falciparum
GANQNDIE

SEQ ID NO: 3220042 - protein, 7 aa, Plasmodium falciparum
GAPKEAQ

SEQ ID NO: 3220043 - protein, 13 aa, Plasmodium falciparum
GAQESESKNCTSE

SEQ ID NO: 3220044 - protein, 8 aa, Plasmodium falciparum
GAQNNNLN

SEQ ID NO: 3220045 - protein, 7 aa, Plasmodium falciparum
GAQSEGK

SEQ ID NO: 3220046 - protein, 7 aa, Plasmodium falciparum
GAREHYK

SEQ ID NO: 3220047 - protein, 20 aa, Plasmodium falciparum
GASGAKPQTKAKPTGGDTPL

SEQ ID NO: 3220048 - protein, 9 aa, Plasmodium falciparum
GASGKNLGK

SEQ ID NO: 3220049 - protein, 17 aa, Plasmodium falciparum
GASGTGAKSDDTINNPT

SEQ ID NO: 3220050 - protein, 4 aa, Plasmodium falciparum
GASK

SEQ ID NO: 3220051 - protein, 16 aa, Plasmodium falciparum
GASKEGVTNEKRNKIK

SEQ ID NO: 3220052 - protein, 8 aa, Plasmodium falciparum
GASPERAA

SEQ ID NO: 3220053 - protein, 15 aa, Plasmodium falciparum
GASQPPSGKRNDKHE

SEQ ID NO: 3220054 - protein, 6 aa, Plasmodium falciparum
GASRTI

SEQ ID NO: 3220055 - protein, 14 aa, Plasmodium falciparum
GASSPQKRKPSKYD

SEQ ID NO: 3220056 - protein, 7 aa, Plasmodium falciparum
GATAAYQ

SEQ ID NO: 3220057 - protein, 6 aa, Plasmodium falciparum
GATAHP

SEQ ID NO: 3220058 - protein, 9 aa, Plasmodium falciparum
GATGGGSLS

SEQ ID NO: 3220059 - protein, 4 aa, Plasmodium falciparum
GATS

SEQ ID NO: 3220060 - protein, 11 aa, Plasmodium falciparum
GATSSRSTSLN

SEQ ID NO: 3220061 - protein, 6 aa, Plasmodium falciparum
GATTFQ

SEQ ID NO: 3220062 - protein, 5 aa, Plasmodium falciparum
GATTG

SEQ ID NO: 3220063 - protein, 9 aa, Plasmodium falciparum
GAVESTYGG

SEQ ID NO: 3220064 - protein, 5 aa, Plasmodium falciparum
GAYNI

SEQ ID NO: 3220065 - protein, 24 aa, Plasmodium falciparum
GCDSKDGGKYNDDTTKEKSNNINY

SEQ ID NO: 3220066 - protein, 12 aa, Plasmodium falciparum
GCEHSRNSNDNS

SEQ ID NO: 3220067 - protein, 5 aa, Plasmodium falciparum
GCEKS

SEQ ID NO: 3220068 - protein, 42 aa, Plasmodium falciparum
GCENDDANEDVNDEEEGSYDSSSDSCEDYESTDDTHSIDERD

SEQ ID NO: 3220069 - protein, 5 aa, Plasmodium falciparum
GCGKS

SEQ ID NO: 3220070 - protein, 5 aa, Plasmodium falciparum
GCGKT

SEQ ID NO: 3220071 - protein, 5 aa, Plasmodium falciparum
GCGNS

SEQ ID NO: 3220072 - protein, 14 aa, Plasmodium falciparum
GCGTGGDSDNEKET

SEQ ID NO: 3220073 - protein, 4 aa, Plasmodium falciparum
GCKE

SEQ ID NO: 3220074 - protein, 11 aa, Plasmodium falciparum
GCKPKGNGNTW

SEQ ID NO: 3220075 - protein, 13 aa, Plasmodium falciparum
GCNEQTCDSECET

SEQ ID NO: 3220076 - protein, 10 aa, Plasmodium falciparum
GCNPKESYPE

SEQ ID NO: 3220077 - protein, 24 aa, Plasmodium falciparum
GCPSTSSSSDIVESNTESSSTSMQ

SEQ ID NO: 3220078 - protein, 8 aa, Plasmodium falciparum
GCSEPTHD

SEQ ID NO: 3220079 - protein, 4 aa, Plasmodium falciparum
GCSS

SEQ ID NO: 3220080 - protein, 11 aa, Plasmodium falciparum
GCSSKKKLKKG

SEQ ID NO: 3220081 - protein, 126 aa, Plasmodium falciparum
GCTTRDDNMKDDNMKDGNMKDDNMKDNNMKGRNTKCDNIKDNNMKGRNTKCDNIKDNNMKGRNTKCDNIKDNNNDNNSINNNSINNNSINNNSINNNSINNNSINNNSINNNSINNNNIKDKDEKH

SEQ ID NO: 3220082 - protein, 7 aa, Plasmodium falciparum
GDAGKYN

SEQ ID NO: 3220083 - protein, 4 aa, Plasmodium falciparum
GDAH

SEQ ID NO: 3220084 - protein, 4 aa, Plasmodium falciparum
GDAI

SEQ ID NO: 3220085 - protein, 13 aa, Plasmodium falciparum
GDANEQNKNGYQD

SEQ ID NO: 3220086 - protein, 9 aa, Plasmodium falciparum
GDANSNRYP

SEQ ID NO: 3220087 - protein, 6 aa, Plasmodium falciparum
GDAPIN

SEQ ID NO: 3220088 - protein, 6 aa, Plasmodium falciparum
GDAQAI

SEQ ID NO: 3220089 - protein, 19 aa, Plasmodium falciparum
GDASDKRQPCKKDTNGNDV

SEQ ID NO: 3220090 - protein, 18 aa, Plasmodium falciparum
GDATNDDNEDNIINSNDD

SEQ ID NO: 3220091 - protein, 14 aa, Plasmodium falciparum
GDCSNSTEKKCDAQ

SEQ ID NO: 3220092 - protein, 18 aa, Plasmodium falciparum
GDCTQGDDEYKCSGYGEN

SEQ ID NO: 3220093 - protein, 91 aa, Plasmodium falciparum
GDDGVEEREKISTEEVVGQDKSATGDVEEVSSTEDEEEVSSTEGLEEVSSTEGLEEVSNTEDVEEVSSTEDVEEGSVAENVKETKSITEEV

SEQ ID NO: 3220094 - protein, 9 aa, Plasmodium falciparum
GDDKNKSLN

SEQ ID NO: 3220095 - protein, 8 aa, Plasmodium falciparum
GDDKREST

SEQ ID NO: 3220096 - protein, 5 aa, Plasmodium falciparum
GDDNN

SEQ ID NO: 3220097 - protein, 69 aa, Plasmodium falciparum
GDDSEEDGPIDNSNPDSSEEEEFKQDKEKSIKQKNNNNNNNNNNKIHNKDSSDNDADIEEVEGESDDMS

SEQ ID NO: 3220098 - protein, 7 aa, Plasmodium falciparum
GDDTEEL

SEQ ID NO: 3220099 - protein, 8 aa, Plasmodium falciparum
GDDYKEEG

SEQ ID NO: 3220100 - protein, 7 aa, Plasmodium falciparum
GDDYSDA

SEQ ID NO: 3220101 - protein, 7 aa, Plasmodium falciparum
GDEDCNN

SEQ ID NO: 3220102 - protein, 50 aa, Plasmodium falciparum
GDEDDNMDDANENMDDANENMDDTNENMDETNENMDETNENMDDTNENVD

SEQ ID NO: 3220103 - protein, 97 aa, Plasmodium falciparum
GDEDNDGDEDEDNDGDEDEDNDDNDGDEDEDNDDNDGDEDNGGDEDNDGNDDDGNDDDDDNDDNNDDNNNDNNDDNNDDNNNDNNDDNNNDNNNDDD

SEQ ID NO: 3220104 - protein, 9 aa, Plasmodium falciparum
GDEEKGTKY

SEQ ID NO: 3220105 - protein, 7 aa, Plasmodium falciparum
GDEEKSS

SEQ ID NO: 3220106 - protein, 11 aa, Plasmodium falciparum
GDEEKTKDRYH

SEQ ID NO: 3220107 - protein, 17 aa, Plasmodium falciparum
GDEEQPPEKQLAGGKIP

SEQ ID NO: 3220108 - protein, 8 aa, Plasmodium falciparum
GDEIPPSS

SEQ ID NO: 3220109 - protein, 8 aa, Plasmodium falciparum
GDEISNNI

SEQ ID NO: 3220110 - protein, 13 aa, Plasmodium falciparum
GDEKESGKRNTNF

SEQ ID NO: 3220111 - protein, 11 aa, Plasmodium falciparum
GDEKNPSLTSK

SEQ ID NO: 3220112 - protein, 5 aa, Plasmodium falciparum
GDEKS

SEQ ID NO: 3220113 - protein, 7 aa, Plasmodium falciparum
GDELASS

SEQ ID NO: 3220114 - protein, 6 aa, Plasmodium falciparum
GDENIR

SEQ ID NO: 3220115 - protein, 8 aa, Plasmodium falciparum
GDEPTEIG

SEQ ID NO: 3220116 - protein, 12 aa, Plasmodium falciparum
GDEQIKKNNDIN

SEQ ID NO: 3220117 - protein, 8 aa, Plasmodium falciparum
GDESDDYT

SEQ ID NO: 3220118 - protein, 7 aa, Plasmodium falciparum
GDETDDY

SEQ ID NO: 3220119 - protein, 13 aa, Plasmodium falciparum
GDETKKKRTNDGI

SEQ ID NO: 3220120 - protein, 14 aa, Plasmodium falciparum
GDFKTTENNNHSLN

SEQ ID NO: 3220121 - protein, 4 aa, Plasmodium falciparum
GDFS

SEQ ID NO: 3220122 - protein, 4 aa, Plasmodium falciparum
GDGA

SEQ ID NO: 3220123 - protein, 8 aa, Plasmodium falciparum
GDGANDRN

SEQ ID NO: 3220124 - protein, 14 aa, Plasmodium falciparum
GDGKKKKKKNHINN

SEQ ID NO: 3220125 - protein, 17 aa, Plasmodium falciparum
GDGKNSSKLSKGENNAL

SEQ ID NO: 3220126 - protein, 7 aa, Plasmodium falciparum
GDGKSLS

SEQ ID NO: 3220127 - protein, 10 aa, Plasmodium falciparum
GDGKTNKKDV

SEQ ID NO: 3220128 - protein, 9 aa, Plasmodium falciparum
GDGLKGGKV

SEQ ID NO: 3220129 - protein, 4 aa, Plasmodium falciparum
GDGN

SEQ ID NO: 3220130 - protein, 8 aa, Plasmodium falciparum
GDGSNDCG

SEQ ID NO: 3220131 - protein, 12 aa, Plasmodium falciparum
GDGVNDAPALKS

SEQ ID NO: 3220132 - protein, 10 aa, Plasmodium falciparum
GDGVSERSQI

SEQ ID NO: 3220133 - protein, 7 aa, Plasmodium falciparum
GDHHNGP

SEQ ID NO: 3220134 - protein, 13 aa, Plasmodium falciparum
GDHKNEDKKSINK

SEQ ID NO: 3220135 - protein, 6 aa, Plasmodium falciparum
GDHSGL

SEQ ID NO: 3220136 - protein, 5 aa, Plasmodium falciparum
GDIEE

SEQ ID NO: 3220137 - protein, 5 aa, Plasmodium falciparum
GDIEG

SEQ ID NO: 3220138 - protein, 32 aa, Plasmodium falciparum
GDIEKNENIEKNENIEKNDNIEKNDNIEKTDN

SEQ ID NO: 3220139 - protein, 7 aa, Plasmodium falciparum
GDIENED

SEQ ID NO: 3220140 - protein, 6 aa, Plasmodium falciparum
GDISKE

SEQ ID NO: 3220141 - protein, 28 aa, Plasmodium falciparum
GDISSNEEHKKINSNFNDEKEIKNNTRE

SEQ ID NO: 3220142 - protein, 5 aa, Plasmodium falciparum
GDITS

SEQ ID NO: 3220143 - protein, 12 aa, Plasmodium falciparum
GDKDDNTKSSTY

SEQ ID NO: 3220144 - protein, 10 aa, Plasmodium falciparum
GDKDNKNGYN

SEQ ID NO: 3220145 - protein, 8 aa, Plasmodium falciparum
GDKDSFSK

SEQ ID NO: 3220146 - protein, 6 aa, Plasmodium falciparum
GDKDVT

SEQ ID NO: 3220147 - protein, 14 aa, Plasmodium falciparum
GDKEMKAKEEKIKE

SEQ ID NO: 3220148 - protein, 8 aa, Plasmodium falciparum
GDKENGNK

SEQ ID NO: 3220149 - protein, 10 aa, Plasmodium falciparum
GDKETTATRV

SEQ ID NO: 3220150 - protein, 14 aa, Plasmodium falciparum
GDKGKDDKKEKCTE

SEQ ID NO: 3220151 - protein, 8 aa, Plasmodium falciparum
GDKGRTIP

SEQ ID NO: 3220152 - protein, 9 aa, Plasmodium falciparum
GDKKSSDEV

SEQ ID NO: 3220153 - protein, 4 aa, Plasmodium falciparum
GDKN

SEQ ID NO: 3220154 - protein, 7 aa, Plasmodium falciparum
GDKNSKN

SEQ ID NO: 3220155 - protein, 90 aa, Plasmodium falciparum
GDKNYDDNKKNDDNINHDDNINNDDNMNHDDNINNEDNINNEDNINNDNNINNDNNINNDDNINNDDNINNDDNINNDDNINNDNNKNFN

SEQ ID NO: 3220156 - protein, 10 aa, Plasmodium falciparum
GDKPPPGSED

SEQ ID NO: 3220157 - protein, 11 aa, Plasmodium falciparum
GDKPSQNGHQD

SEQ ID NO: 3220158 - protein, 5 aa, Plasmodium falciparum
GDKQN

SEQ ID NO: 3220159 - protein, 4 aa, Plasmodium falciparum
GDKS

SEQ ID NO: 3220160 - protein, 10 aa, Plasmodium falciparum
GDKSFYQGDD

SEQ ID NO: 3220161 - protein, 8 aa, Plasmodium falciparum
GDKSINSD

SEQ ID NO: 3220162 - protein, 8 aa, Plasmodium falciparum
GDKTKRKK

SEQ ID NO: 3220163 - protein, 8 aa, Plasmodium falciparum
GDKTTFPP

SEQ ID NO: 3220164 - protein, 4 aa, Plasmodium falciparum
GDKV

SEQ ID NO: 3220165 - protein, 5 aa, Plasmodium falciparum
GDKYY

SEQ ID NO: 3220166 - protein, 44 aa, Plasmodium falciparum
GDLIKNKEGDLLKSKEGDLIKNKEGDLIKNKEGDLLKSKEGDLI

SEQ ID NO: 3220167 - protein, 7 aa, Plasmodium falciparum
GDLKRTE

SEQ ID NO: 3220168 - protein, 5 aa, Plasmodium falciparum
GDLNL

SEQ ID NO: 3220169 - protein, 10 aa, Plasmodium falciparum
GDLQKAPNIN

SEQ ID NO: 3220170 - protein, 17 aa, Plasmodium falciparum
GDLSKATFSSEETASSI

SEQ ID NO: 3220171 - protein, 6 aa, Plasmodium falciparum
GDMNQI

SEQ ID NO: 3220172 - protein, 6 aa, Plasmodium falciparum
GDNDNI

SEQ ID NO: 3220173 - protein, 11 aa, Plasmodium falciparum
GDNENIYSEDN

SEQ ID NO: 3220174 - protein, 16 aa, Plasmodium falciparum
GDNETVEPQQEEPVQD

SEQ ID NO: 3220175 - protein, 11 aa, Plasmodium falciparum
GDNHDDQNKFN

SEQ ID NO: 3220176 - protein, 18 aa, Plasmodium falciparum
GDNHTCDNHTSDSHTCDS

SEQ ID NO: 3220177 - protein, 4 aa, Plasmodium falciparum
GDNI

SEQ ID NO: 3220178 - protein, 14 aa, Plasmodium falciparum
GDNIGRNNLQGDNL

SEQ ID NO: 3220179 - protein, 21 aa, Plasmodium falciparum
GDNINNGDNINNGDNINNGDN

SEQ ID NO: 3220180 - protein, 11 aa, Plasmodium falciparum
GDNKEEEGNNN

SEQ ID NO: 3220181 - protein, 9 aa, Plasmodium falciparum
GDNKEGKNY

SEQ ID NO: 3220182 - protein, 21 aa, Plasmodium falciparum
GDNKKEKEEKSKNGKEKGKKK

SEQ ID NO: 3220183 - protein, 29 aa, Plasmodium falciparum
GDNKNIDTSSYKELTKEKEEKYKKKGYNM

SEQ ID NO: 3220184 - protein, 10 aa, Plasmodium falciparum
GDNKTSKKKI

SEQ ID NO: 3220185 - protein, 4 aa, Plasmodium falciparum
GDNN

SEQ ID NO: 3220186 - protein, 56 aa, Plasmodium falciparum
GDNNDDDNNNNNNNDDDNNNNDDDDNNNNNNNNDDDYNNNNNKIKEEKTNSVESNT

SEQ ID NO: 3220187 - protein, 15 aa, Plasmodium falciparum
GDNNDDKDDDDDDSY

SEQ ID NO: 3220188 - protein, 9 aa, Plasmodium falciparum
GDNNNGDST

SEQ ID NO: 3220189 - protein, 9 aa, Plasmodium falciparum
GDNNNIDDR

SEQ ID NO: 3220190 - protein, 8 aa, Plasmodium falciparum
GDNNNIKE

SEQ ID NO: 3220191 - protein, 8 aa, Plasmodium falciparum
GDNPMGGY

SEQ ID NO: 3220192 - protein, 9 aa, Plasmodium falciparum
GDNTKERLK

SEQ ID NO: 3220193 - protein, 46 aa, Plasmodium falciparum
GDNTRGSESESAGPSRSKRHTESSDSAVTATGSSGEATGKSGDKDG

SEQ ID NO: 3220194 - protein, 4 aa, Plasmodium falciparum
GDNV

SEQ ID NO: 3220195 - protein, 6 aa, Plasmodium falciparum
GDNVTN

SEQ ID NO: 3220196 - protein, 22 aa, Plasmodium falciparum
GDPCGSASEKRFSKERVDEYDK

SEQ ID NO: 3220197 - protein, 5 aa, Plasmodium falciparum
GDPLE

SEQ ID NO: 3220198 - protein, 6 aa, Plasmodium falciparum
GDPLEN

SEQ ID NO: 3220199 - protein, 6 aa, Plasmodium falciparum
GDPPTY

SEQ ID NO: 3220200 - protein, 15 aa, Plasmodium falciparum
GDPSNSTKGVDNYTN

SEQ ID NO: 3220201 - protein, 5 aa, Plasmodium falciparum
GDQEH

SEQ ID NO: 3220202 - protein, 8 aa, Plasmodium falciparum
GDQKYGQQ

SEQ ID NO: 3220203 - protein, 17 aa, Plasmodium falciparum
GDQLQHPKEIDENAEKI

SEQ ID NO: 3220204 - protein, 11 aa, Plasmodium falciparum
GDQNEGRRQEK

SEQ ID NO: 3220205 - protein, 15 aa, Plasmodium falciparum
GDQPGNDKENIDPPT

SEQ ID NO: 3220206 - protein, 9 aa, Plasmodium falciparum
GDQQDEDLM

SEQ ID NO: 3220207 - protein, 20 aa, Plasmodium falciparum
GDRGERHPCGNGSGKGEDVN

SEQ ID NO: 3220208 - protein, 7 aa, Plasmodium falciparum
GDRWPSS

SEQ ID NO: 3220209 - protein, 18 aa, Plasmodium falciparum
GDSEDGSAQDTQNSLDAE

SEQ ID NO: 3220210 - protein, 17 aa, Plasmodium falciparum
GDSEDSSEEKSENSLDA

SEQ ID NO: 3220211 - protein, 27 aa, Plasmodium falciparum
GDSEEDFEADSSEDSQSRDEDAQETKR

SEQ ID NO: 3220212 - protein, 9 aa, Plasmodium falciparum
GDSGDEDKY

SEQ ID NO: 3220213 - protein, 4 aa, Plasmodium falciparum
GDSI

SEQ ID NO: 3220214 - protein, 19 aa, Plasmodium falciparum
GDSIRGDHDKYKETNDSSQ

SEQ ID NO: 3220215 - protein, 5 aa, Plasmodium falciparum
GDSIS

SEQ ID NO: 3220216 - protein, 9 aa, Plasmodium falciparum
GDSKCENCT

SEQ ID NO: 3220217 - protein, 14 aa, Plasmodium falciparum
GDSKRKHDKSIDTN

SEQ ID NO: 3220218 - protein, 8 aa, Plasmodium falciparum
GDSKRNEK

SEQ ID NO: 3220219 - protein, 36 aa, Plasmodium falciparum
GDSLTKDGNDMEDREFSSGNYSDESETNSDSYQGVQ

SEQ ID NO: 3220220 - protein, 7 aa, Plasmodium falciparum
GDSQITK

SEQ ID NO: 3220221 - protein, 22 aa, Plasmodium falciparum
GDSQPPNGKHVTQTSDKTPQQT

SEQ ID NO: 3220222 - protein, 4 aa, Plasmodium falciparum
GDSR

SEQ ID NO: 3220223 - protein, 6 aa, Plasmodium falciparum
GDSSEV

SEQ ID NO: 3220224 - protein, 4 aa, Plasmodium falciparum
GDST

SEQ ID NO: 3220225 - protein, 8 aa, Plasmodium falciparum
GDTGTGKT

SEQ ID NO: 3220226 - protein, 8 aa, Plasmodium falciparum
GDTIPSSN

SEQ ID NO: 3220227 - protein, 12 aa, Plasmodium falciparum
GDTISDDNNPEK

SEQ ID NO: 3220228 - protein, 7 aa, Plasmodium falciparum
GDTKKKK

SEQ ID NO: 3220229 - protein, 15 aa, Plasmodium falciparum
GDTNISSYERRESKE

SEQ ID NO: 3220230 - protein, 9 aa, Plasmodium falciparum
GDTNNQTND

SEQ ID NO: 3220231 - protein, 4 aa, Plasmodium falciparum
GDTP

SEQ ID NO: 3220232 - protein, 7 aa, Plasmodium falciparum
GDTQKSV

SEQ ID NO: 3220233 - protein, 8 aa, Plasmodium falciparum
GDTRKSDM

SEQ ID NO: 3220234 - protein, 8 aa, Plasmodium falciparum
GDTSGDEK

SEQ ID NO: 3220235 - protein, 9 aa, Plasmodium falciparum
GDTSGDEKY

SEQ ID NO: 3220236 - protein, 7 aa, Plasmodium falciparum
GDTTENK

SEQ ID NO: 3220237 - protein, 5 aa, Plasmodium falciparum
GDVLE

SEQ ID NO: 3220238 - protein, 7 aa, Plasmodium falciparum
GDVNGNE

SEQ ID NO: 3220239 - protein, 18 aa, Plasmodium falciparum
GDVNSDSEKKDGDSNSDR

SEQ ID NO: 3220240 - protein, 4 aa, Plasmodium falciparum
GDYD

SEQ ID NO: 3220241 - protein, 5 aa, Plasmodium falciparum
GDYDI

SEQ ID NO: 3220242 - protein, 14 aa, Plasmodium falciparum
GDYGTPTSKSSNRY

SEQ ID NO: 3220243 - protein, 6 aa, Plasmodium falciparum
GDYKND

SEQ ID NO: 3220244 - protein, 20 aa, Plasmodium falciparum
GDYNNNNNNNMNNISSSYSA

SEQ ID NO: 3220245 - protein, 7 aa, Plasmodium falciparum
GDYNSDV

SEQ ID NO: 3220246 - protein, 6 aa, Plasmodium falciparum
GDYSNT

SEQ ID NO: 3220247 - protein, 8 aa, Plasmodium falciparum
GDYSPDCD

SEQ ID NO: 3220248 - protein, 16 aa, Plasmodium falciparum
GEAGKPVKWRGSSGNW

SEQ ID NO: 3220249 - protein, 7 aa, Plasmodium falciparum
GEAQEEV

SEQ ID NO: 3220250 - protein, 5 aa, Plasmodium falciparum
GEATT

SEQ ID NO: 3220251 - protein, 26 aa, Plasmodium falciparum
GECTSQPSGENEAQCENSSPFEDDDE

SEQ ID NO: 3220252 - protein, 4 aa, Plasmodium falciparum
GEDD

SEQ ID NO: 3220253 - protein, 5 aa, Plasmodium falciparum
GEDDA

SEQ ID NO: 3220254 - protein, 4 aa, Plasmodium falciparum
GEDE

SEQ ID NO: 3220255 - protein, 7 aa, Plasmodium falciparum
GEDEQSC

SEQ ID NO: 3220256 - protein, 9 aa, Plasmodium falciparum
GEDQNEDEH

SEQ ID NO: 3220257 - protein, 5 aa, Plasmodium falciparum
GEDYS

SEQ ID NO: 3220258 - protein, 4 aa, Plasmodium falciparum
GEEC

SEQ ID NO: 3220259 - protein, 8 aa, Plasmodium falciparum
GEEDKDAK

SEQ ID NO: 3220260 - protein, 5 aa, Plasmodium falciparum
GEEED

SEQ ID NO: 3220261 - protein, 20 aa, Plasmodium falciparum
GEEEEEGEEEETDNETEKEI

SEQ ID NO: 3220262 - protein, 20 aa, Plasmodium falciparum
GEEEEQPPQSKLQQTGEIPP

SEQ ID NO: 3220263 - protein, 5 aa, Plasmodium falciparum
GEEEG

SEQ ID NO: 3220264 - protein, 4 aa, Plasmodium falciparum
GEEF

SEQ ID NO: 3220265 - protein, 6 aa, Plasmodium falciparum
GEEGLP

SEQ ID NO: 3220266 - protein, 4 aa, Plasmodium falciparum
GEEI

SEQ ID NO: 3220267 - protein, 5 aa, Plasmodium falciparum
GEELG

SEQ ID NO: 3220268 - protein, 8 aa, Plasmodium falciparum
GEELSDEQ

SEQ ID NO: 3220269 - protein, 4 aa, Plasmodium falciparum
GEEN

SEQ ID NO: 3220270 - protein, 16 aa, Plasmodium falciparum
GEENNKKHNDNDNNYN

SEQ ID NO: 3220271 - protein, 10 aa, Plasmodium falciparum
GEEPRITEDN

SEQ ID NO: 3220272 - protein, 18 aa, Plasmodium falciparum
GEETANYGNFENESNTFS

SEQ ID NO: 3220273 - protein, 5 aa, Plasmodium falciparum
GEETE

SEQ ID NO: 3220274 - protein, 10 aa, Plasmodium falciparum
GEEVNTIPDG

SEQ ID NO: 3220275 - protein, 13 aa, Plasmodium falciparum
GEGDQSSPDSYPG

SEQ ID NO: 3220276 - protein, 13 aa, Plasmodium falciparum
GEGEQSSPNEQPG

SEQ ID NO: 3220277 - protein, 6 aa, Plasmodium falciparum
GEGGHL

SEQ ID NO: 3220278 - protein, 53 aa, Plasmodium falciparum
GEGKYTNSTISKTDHTSRSNNMDNNVKGNDNINGNHSDRESEKRQDMNQNNVN

SEQ ID NO: 3220279 - protein, 7 aa, Plasmodium falciparum
GEGNKCG

SEQ ID NO: 3220280 - protein, 5 aa, Plasmodium falciparum
GEGPK

SEQ ID NO: 3220281 - protein, 13 aa, Plasmodium falciparum
GEGPKADSTEPLT

SEQ ID NO: 3220282 - protein, 6 aa, Plasmodium falciparum
GEGSFT

SEQ ID NO: 3220283 - protein, 6 aa, Plasmodium falciparum
GEGSIT

SEQ ID NO: 3220284 - protein, 7 aa, Plasmodium falciparum
GEGSPGN

SEQ ID NO: 3220285 - protein, 10 aa, Plasmodium falciparum
GEHEKKRTHP

SEQ ID NO: 3220286 - protein, 13 aa, Plasmodium falciparum
GEHMNDQSDPLNQ

SEQ ID NO: 3220287 - protein, 15 aa, Plasmodium falciparum
GEHNDKRKNSNINTG

SEQ ID NO: 3220288 - protein, 11 aa, Plasmodium falciparum
GEHPDDKNLNN

SEQ ID NO: 3220289 - protein, 4 aa, Plasmodium falciparum
GEIK

SEQ ID NO: 3220290 - protein, 6 aa, Plasmodium falciparum
GEIKIG

SEQ ID NO: 3220291 - protein, 6 aa, Plasmodium falciparum
GEINGE

SEQ ID NO: 3220292 - protein, 5 aa, Plasmodium falciparum
GEIPD

SEQ ID NO: 3220293 - protein, 4 aa, Plasmodium falciparum
GEIT

SEQ ID NO: 3220294 - protein, 50 aa, Plasmodium falciparum
GEKAKTCEQKHQNSDKTEKPCQESSPDDEEPLEEEEEYTVGKEKVGNKAP

SEQ ID NO: 3220295 - protein, 9 aa, Plasmodium falciparum
GEKDKNNLQ

SEQ ID NO: 3220296 - protein, 6 aa, Plasmodium falciparum
GEKDKP

SEQ ID NO: 3220297 - protein, 15 aa, Plasmodium falciparum
GEKDNPNIEQNKNEY

SEQ ID NO: 3220298 - protein, 5 aa, Plasmodium falciparum
GEKDV

SEQ ID NO: 3220299 - protein, 10 aa, Plasmodium falciparum
GEKEGDGEEV

SEQ ID NO: 3220300 - protein, 6 aa, Plasmodium falciparum
GEKGTF

SEQ ID NO: 3220301 - protein, 8 aa, Plasmodium falciparum
GEKHDDIE

SEQ ID NO: 3220302 - protein, 7 aa, Plasmodium falciparum
GEKISED

SEQ ID NO: 3220303 - protein, 6 aa, Plasmodium falciparum
GEKKEQ

SEQ ID NO: 3220304 - protein, 9 aa, Plasmodium falciparum
GEKKKNQNG

SEQ ID NO: 3220305 - protein, 17 aa, Plasmodium falciparum
GEKKNYLKKKNNPDNIN

SEQ ID NO: 3220306 - protein, 9 aa, Plasmodium falciparum
GEKNGTPDN

SEQ ID NO: 3220307 - protein, 13 aa, Plasmodium falciparum
GEKNNNSQNELSN

SEQ ID NO: 3220308 - protein, 8 aa, Plasmodium falciparum
GEKNTHYN

SEQ ID NO: 3220309 - protein, 10 aa, Plasmodium falciparum
GEKNTSEYRK

SEQ ID NO: 3220310 - protein, 9 aa, Plasmodium falciparum
GEKRGDGMT

SEQ ID NO: 3220311 - protein, 34 aa, Plasmodium falciparum
GEKRNSLSNDNSLDDDPNTEKKTKSVKSKKISKP

SEQ ID NO: 3220312 - protein, 4 aa, Plasmodium falciparum
GEKS

SEQ ID NO: 3220313 - protein, 8 aa, Plasmodium falciparum
GEKSEEGG

SEQ ID NO: 3220314 - protein, 7 aa, Plasmodium falciparum
GEKTTFE

SEQ ID NO: 3220315 - protein, 9 aa, Plasmodium falciparum
GEKTYEKNH

SEQ ID NO: 3220316 - protein, 12 aa, Plasmodium falciparum
GEKVTYGDDASS

SEQ ID NO: 3220317 - protein, 12 aa, Plasmodium falciparum
GELATKTTATLS

SEQ ID NO: 3220318 - protein, 13 aa, Plasmodium falciparum
GELNTYQQSNDTC

SEQ ID NO: 3220319 - protein, 11 aa, Plasmodium falciparum
GENENDKNNLK

SEQ ID NO: 3220320 - protein, 5 aa, Plasmodium falciparum
GENGI

SEQ ID NO: 3220321 - protein, 5 aa, Plasmodium falciparum
GENIK

SEQ ID NO: 3220322 - protein, 9 aa, Plasmodium falciparum
GENKKNGEH

SEQ ID NO: 3220323 - protein, 10 aa, Plasmodium falciparum
GENKKNNGTK

SEQ ID NO: 3220324 - protein, 9 aa, Plasmodium falciparum
GENKKTDEH

SEQ ID NO: 3220325 - protein, 6 aa, Plasmodium falciparum
GENKVE

SEQ ID NO: 3220326 - protein, 34 aa, Plasmodium falciparum
GENNNNNNNNNNKSNNNDNNNNKNHNHKSNNVSS

SEQ ID NO: 3220327 - protein, 35 aa, Plasmodium falciparum
GENNTDNPVTTSTQNGSPRLPTGTTGNTEGTYEKT

SEQ ID NO: 3220328 - protein, 8 aa, Plasmodium falciparum
GENPSLRS

SEQ ID NO: 3220329 - protein, 9 aa, Plasmodium falciparum
GENTYNSND

SEQ ID NO: 3220330 - protein, 5 aa, Plasmodium falciparum
GENVS

SEQ ID NO: 3220331 - protein, 4 aa, Plasmodium falciparum
GENY

SEQ ID NO: 3220332 - protein, 8 aa, Plasmodium falciparum
GEPGTGKT

SEQ ID NO: 3220333 - protein, 5 aa, Plasmodium falciparum
GEPGY

SEQ ID NO: 3220334 - protein, 4 aa, Plasmodium falciparum
GEPK

SEQ ID NO: 3220335 - protein, 7 aa, Plasmodium falciparum
GEPNATA

SEQ ID NO: 3220336 - protein, 20 aa, Plasmodium falciparum
GEPQPKDKTYKKGMYDEERK

SEQ ID NO: 3220337 - protein, 5 aa, Plasmodium falciparum
GEQCN

SEQ ID NO: 3220338 - protein, 13 aa, Plasmodium falciparum
GEQDLGPDNQPLE

SEQ ID NO: 3220339 - protein, 5 aa, Plasmodium falciparum
GEQLD

SEQ ID NO: 3220340 - protein, 6 aa, Plasmodium falciparum
GEQQNR

SEQ ID NO: 3220341 - protein, 7 aa, Plasmodium falciparum
GERESRQ

SEQ ID NO: 3220342 - protein, 11 aa, Plasmodium falciparum
GERGTKLSIGE

SEQ ID NO: 3220343 - protein, 11 aa, Plasmodium falciparum
GERKKRKKTYT

SEQ ID NO: 3220344 - protein, 6 aa, Plasmodium falciparum
GERNND

SEQ ID NO: 3220345 - protein, 10 aa, Plasmodium falciparum
GERNRKDKNY

SEQ ID NO: 3220346 - protein, 4 aa, Plasmodium falciparum
GERV

SEQ ID NO: 3220347 - protein, 12 aa, Plasmodium falciparum
GERYSSGDGENC

SEQ ID NO: 3220348 - protein, 7 aa, Plasmodium falciparum
GESALSD

SEQ ID NO: 3220349 - protein, 13 aa, Plasmodium falciparum
GESCTKGSGECAT

SEQ ID NO: 3220350 - protein, 10 aa, Plasmodium falciparum
GESDEEDDDI

SEQ ID NO: 3220351 - protein, 34 aa, Plasmodium falciparum
GESDEYNSTNQSPRKLNDSSGLSKKKSGNISRKA

SEQ ID NO: 3220352 - protein, 11 aa, Plasmodium falciparum
GESEKKLEGDV

SEQ ID NO: 3220353 - protein, 6 aa, Plasmodium falciparum
GESEQK

SEQ ID NO: 3220354 - protein, 8 aa, Plasmodium falciparum
GESGPAIA

SEQ ID NO: 3220355 - protein, 9 aa, Plasmodium falciparum
GESGSGKSK

SEQ ID NO: 3220356 - protein, 5 aa, Plasmodium falciparum
GESID

SEQ ID NO: 3220357 - protein, 37 aa, Plasmodium falciparum
GESKFVNGEDNINNNNNNDNNNDSDNNSFYNNSKGEF

SEQ ID NO: 3220358 - protein, 5 aa, Plasmodium falciparum
GESKV

SEQ ID NO: 3220359 - protein, 5 aa, Plasmodium falciparum
GESNE

SEQ ID NO: 3220360 - protein, 9 aa, Plasmodium falciparum
GESQNNNNY

SEQ ID NO: 3220361 - protein, 27 aa, Plasmodium falciparum
GESRRPSQAQNQCRCSDKPKAIKAGGN

SEQ ID NO: 3220362 - protein, 15 aa, Plasmodium falciparum
GESRTNKNSLAGTKW

SEQ ID NO: 3220363 - protein, 6 aa, Plasmodium falciparum
GESYEK

SEQ ID NO: 3220364 - protein, 10 aa, Plasmodium falciparum
GETASTDKPC

SEQ ID NO: 3220365 - protein, 4 aa, Plasmodium falciparum
GETF

SEQ ID NO: 3220366 - protein, 10 aa, Plasmodium falciparum
GETGSGKSTC

SEQ ID NO: 3220367 - protein, 4 aa, Plasmodium falciparum
GETI

SEQ ID NO: 3220368 - protein, 5 aa, Plasmodium falciparum
GETIN

SEQ ID NO: 3220369 - protein, 20 aa, Plasmodium falciparum
GETLTTQHGQHQQTNPGTAS

SEQ ID NO: 3220370 - protein, 5 aa, Plasmodium falciparum
GETNL

SEQ ID NO: 3220371 - protein, 9 aa, Plasmodium falciparum
GETSGDDDK

SEQ ID NO: 3220372 - protein, 12 aa, Plasmodium falciparum
GETTPENSSGLA

SEQ ID NO: 3220373 - protein, 5 aa, Plasmodium falciparum
GEVDG

SEQ ID NO: 3220374 - protein, 5 aa, Plasmodium falciparum
GEVGG

SEQ ID NO: 3220375 - protein, 9 aa, Plasmodium falciparum
GEVNTTYGG

SEQ ID NO: 3220376 - protein, 11 aa, Plasmodium falciparum
GEVRNNDEELK

SEQ ID NO: 3220377 - protein, 7 aa, Plasmodium falciparum
GEVSNNI

SEQ ID NO: 3220378 - protein, 5 aa, Plasmodium falciparum
GEVST

SEQ ID NO: 3220379 - protein, 4 aa, Plasmodium falciparum
GEVT

SEQ ID NO: 3220380 - protein, 4 aa, Plasmodium falciparum
GEYK

SEQ ID NO: 3220381 - protein, 7 aa, Plasmodium falciparum
GEYKNQQ

SEQ ID NO: 3220382 - protein, 5 aa, Plasmodium falciparum
GEYNN

SEQ ID NO: 3220383 - protein, 6 aa, Plasmodium falciparum
GEYNPK

SEQ ID NO: 3220384 - protein, 5 aa, Plasmodium falciparum
GEYNT

SEQ ID NO: 3220385 - protein, 4 aa, Plasmodium falciparum
GEYR

SEQ ID NO: 3220386 - protein, 6 aa, Plasmodium falciparum
GEYSLG

SEQ ID NO: 3220387 - protein, 4 aa, Plasmodium falciparum
GFDG

SEQ ID NO: 3220388 - protein, 28 aa, Plasmodium falciparum
GFDPKSGDNVSYSGTIGSISDKTSPYSG

SEQ ID NO: 3220389 - protein, 7 aa, Plasmodium falciparum
GFEPTYT

SEQ ID NO: 3220390 - protein, 4 aa, Plasmodium falciparum
GFES

SEQ ID NO: 3220391 - protein, 10 aa, Plasmodium falciparum
GFGEQGSEKL

SEQ ID NO: 3220392 - protein, 4 aa, Plasmodium falciparum
GFGG

SEQ ID NO: 3220393 - protein, 9 aa, Plasmodium falciparum
GFKKNAHEI

SEQ ID NO: 3220394 - protein, 4 aa, Plasmodium falciparum
GFNE

SEQ ID NO: 3220395 - protein, 14 aa, Plasmodium falciparum
GFNNNSGNNRRTNP

SEQ ID NO: 3220396 - protein, 6 aa, Plasmodium falciparum
GFNPSG

SEQ ID NO: 3220397 - protein, 4 aa, Plasmodium falciparum
GFNS

SEQ ID NO: 3220398 - protein, 10 aa, Plasmodium falciparum
GFQENDNVET

SEQ ID NO: 3220399 - protein, 6 aa, Plasmodium falciparum
GFQGKE

SEQ ID NO: 3220400 - protein, 4 aa, Plasmodium falciparum
GFQK

SEQ ID NO: 3220401 - protein, 11 aa, Plasmodium falciparum
GFSNYRDDASK

SEQ ID NO: 3220402 - protein, 9 aa, Plasmodium falciparum
GFTGTASSN

SEQ ID NO: 3220403 - protein, 4 aa, Plasmodium falciparum
GFTN

SEQ ID NO: 3220404 - protein, 18 aa, Plasmodium falciparum
GFYNNNNNNSDCDGNNYN

SEQ ID NO: 3220405 - protein, 8 aa, Plasmodium falciparum
GGAGLTGY

SEQ ID NO: 3220406 - protein, 9 aa, Plasmodium falciparum
GGATAKPFE

SEQ ID NO: 3220407 - protein, 6 aa, Plasmodium falciparum
GGAWDN

SEQ ID NO: 3220408 - protein, 5 aa, Plasmodium falciparum
GGDGG

SEQ ID NO: 3220409 - protein, 5 aa, Plasmodium falciparum
GGDIC

SEQ ID NO: 3220410 - protein, 9 aa, Plasmodium falciparum
GGDKASMEK

SEQ ID NO: 3220411 - protein, 10 aa, Plasmodium falciparum
GGDMSGSNNV

SEQ ID NO: 3220412 - protein, 12 aa, Plasmodium falciparum
GGDQKSKDEMQT

SEQ ID NO: 3220413 - protein, 22 aa, Plasmodium falciparum
GGDQNKEQHKEREIKKDPRNVQ

SEQ ID NO: 3220414 - protein, 18 aa, Plasmodium falciparum
GGDQQQQHHHNNNNNNNI

SEQ ID NO: 3220415 - protein, 4 aa, Plasmodium falciparum
GGEA

SEQ ID NO: 3220416 - protein, 6 aa, Plasmodium falciparum
GGEASF

SEQ ID NO: 3220417 - protein, 17 aa, Plasmodium falciparum
GGECDKNKIRDNEDDRV

SEQ ID NO: 3220418 - protein, 20 aa, Plasmodium falciparum
GGECDKNKISGNKDDEGACA

SEQ ID NO: 3220419 - protein, 6 aa, Plasmodium falciparum
GGEDKT

SEQ ID NO: 3220420 - protein, 4 aa, Plasmodium falciparum
GGEE

SEQ ID NO: 3220421 - protein, 11 aa, Plasmodium falciparum
GGEGGKGNNMN

SEQ ID NO: 3220422 - protein, 8 aa, Plasmodium falciparum
GGEIKPND

SEQ ID NO: 3220423 - protein, 7 aa, Plasmodium falciparum
GGEKNKY

SEQ ID NO: 3220424 - protein, 10 aa, Plasmodium falciparum
GGEKTASTNK

SEQ ID NO: 3220425 - protein, 6 aa, Plasmodium falciparum
GGENYV

SEQ ID NO: 3220426 - protein, 4 aa, Plasmodium falciparum
GGET

SEQ ID NO: 3220427 - protein, 6 aa, Plasmodium falciparum
GGFQNN

SEQ ID NO: 3220428 - protein, 6 aa, Plasmodium falciparum
GGGPGF

SEQ ID NO: 3220429 - protein, 8 aa, Plasmodium falciparum
GGGSSNGA

SEQ ID NO: 3220430 - protein, 7 aa, Plasmodium falciparum
GGGTFPD

SEQ ID NO: 3220431 - protein, 8 aa, Plasmodium falciparum
GGHKERAT

SEQ ID NO: 3220432 - protein, 6 aa, Plasmodium falciparum
GGHRNS

SEQ ID NO: 3220433 - protein, 11 aa, Plasmodium falciparum
GGINENKNKHI

SEQ ID NO: 3220434 - protein, 5 aa, Plasmodium falciparum
GGIPE

SEQ ID NO: 3220435 - protein, 7 aa, Plasmodium falciparum
GGITNKI

SEQ ID NO: 3220436 - protein, 14 aa, Plasmodium falciparum
GGKCEEKKNSDGTC

SEQ ID NO: 3220437 - protein, 15 aa, Plasmodium falciparum
GGKDSDPENKQTGVE

SEQ ID NO: 3220438 - protein, 4 aa, Plasmodium falciparum
GGKK

SEQ ID NO: 3220439 - protein, 33 aa, Plasmodium falciparum
GGKKDKRNKKVMNTNSSGRRTISKNSPNLSSAK

SEQ ID NO: 3220440 - protein, 16 aa, Plasmodium falciparum
GGKKEKVRKRKNDIGG

SEQ ID NO: 3220441 - protein, 7 aa, Plasmodium falciparum
GGKKKNA

SEQ ID NO: 3220442 - protein, 4 aa, Plasmodium falciparum
GGKN

SEQ ID NO: 3220443 - protein, 10 aa, Plasmodium falciparum
GGKNPGDLSR

SEQ ID NO: 3220444 - protein, 9 aa, Plasmodium falciparum
GGKQETRIP

SEQ ID NO: 3220445 - protein, 10 aa, Plasmodium falciparum
GGKQSGTKEI

SEQ ID NO: 3220446 - protein, 6 aa, Plasmodium falciparum
GGLNNN

SEQ ID NO: 3220447 - protein, 6 aa, Plasmodium falciparum
GGLTGG

SEQ ID NO: 3220448 - protein, 5 aa, Plasmodium falciparum
GGMES

SEQ ID NO: 3220449 - protein, 42 aa, Plasmodium falciparum
GGMNKTEKSPQEYDTHNNDNNNNNNINNNEDCGNSCNTGDNN

SEQ ID NO: 3220450 - protein, 5 aa, Plasmodium falciparum
GGNAL

SEQ ID NO: 3220451 - protein, 4 aa, Plasmodium falciparum
GGND

SEQ ID NO: 3220452 - protein, 10 aa, Plasmodium falciparum
GGNDSGESYP

SEQ ID NO: 3220453 - protein, 6 aa, Plasmodium falciparum
GGNGRL

SEQ ID NO: 3220454 - protein, 6 aa, Plasmodium falciparum
GGNNFD

SEQ ID NO: 3220455 - protein, 11 aa, Plasmodium falciparum
GGNNKRRKQLD

SEQ ID NO: 3220456 - protein, 5 aa, Plasmodium falciparum
GGNPY

SEQ ID NO: 3220457 - protein, 4 aa, Plasmodium falciparum
GGNS

SEQ ID NO: 3220458 - protein, 9 aa, Plasmodium falciparum
GGPATDKSK

SEQ ID NO: 3220459 - protein, 13 aa, Plasmodium falciparum
GGPCTEGGVAEQN

SEQ ID NO: 3220460 - protein, 5 aa, Plasmodium falciparum
GGPFQ

SEQ ID NO: 3220461 - protein, 12 aa, Plasmodium falciparum
GGPPREKNPEEY

SEQ ID NO: 3220462 - protein, 34 aa, Plasmodium falciparum
GGPTTNIANNNNNNNNNNSSSSSHNYYGNKSNIN

SEQ ID NO: 3220463 - protein, 15 aa, Plasmodium falciparum
GGPVPGVPPVRPTDG

SEQ ID NO: 3220464 - protein, 4 aa, Plasmodium falciparum
GGQC

SEQ ID NO: 3220465 - protein, 21 aa, Plasmodium falciparum
GGQCTDQQIEGNDRKNGGACA

SEQ ID NO: 3220466 - protein, 21 aa, Plasmodium falciparum
GGQCTDQQIEGNDRNNGGACA

SEQ ID NO: 3220467 - protein, 13 aa, Plasmodium falciparum
GGQCTDSKMRRDG

SEQ ID NO: 3220468 - protein, 6 aa, Plasmodium falciparum
GGQCTN

SEQ ID NO: 3220469 - protein, 14 aa, Plasmodium falciparum
GGQCTNKKIEGNKY

SEQ ID NO: 3220470 - protein, 23 aa, Plasmodium falciparum
GGQCTNKKIKGNEYSTKSGKDCG

SEQ ID NO: 3220471 - protein, 4 aa, Plasmodium falciparum
GGQT

SEQ ID NO: 3220472 - protein, 7 aa, Plasmodium falciparum
GGQTFQH

SEQ ID NO: 3220473 - protein, 15 aa, Plasmodium falciparum
GGRDNEKKSDKDSLY

SEQ ID NO: 3220474 - protein, 11 aa, Plasmodium falciparum
GGREKSKQTLN

SEQ ID NO: 3220475 - protein, 7 aa, Plasmodium falciparum
GGRHGAR

SEQ ID NO: 3220476 - protein, 4 aa, Plasmodium falciparum
GGSD

SEQ ID NO: 3220477 - protein, 18 aa, Plasmodium falciparum
GGSDIDPENLAKKSELSE

SEQ ID NO: 3220478 - protein, 5 aa, Plasmodium falciparum
GGSEK

SEQ ID NO: 3220479 - protein, 10 aa, Plasmodium falciparum
GGSFENTNYT

SEQ ID NO: 3220480 - protein, 8 aa, Plasmodium falciparum
GGSGADKS

SEQ ID NO: 3220481 - protein, 8 aa, Plasmodium falciparum
GGSGPSET

SEQ ID NO: 3220482 - protein, 47 aa, Plasmodium falciparum
GGSIRQSDKIKNEKKDNNSSISSSDDGYDKNISSNNISDKNQSSNNI

SEQ ID NO: 3220483 - protein, 48 aa, Plasmodium falciparum
GGSNNNNNNNDNNNNNNNNNNNNNNNNNNNNNNNNNDSSSNNNNNNNI

SEQ ID NO: 3220484 - protein, 8 aa, Plasmodium falciparum
GGSNQKFN

SEQ ID NO: 3220485 - protein, 16 aa, Plasmodium falciparum
GGSSGTSTGLSGGKSI

SEQ ID NO: 3220486 - protein, 6 aa, Plasmodium falciparum
GGSSTQ

SEQ ID NO: 3220487 - protein, 14 aa, Plasmodium falciparum
GGTCANGAPDIAGT

SEQ ID NO: 3220488 - protein, 4 aa, Plasmodium falciparum
GGTF

SEQ ID NO: 3220489 - protein, 12 aa, Plasmodium falciparum
GGTGTSQNKTGN

SEQ ID NO: 3220490 - protein, 39 aa, Plasmodium falciparum
GGTHNDNNNDNNNNNDDNNNDNNNNDDNNNDNNNNNNNI

SEQ ID NO: 3220491 - protein, 5 aa, Plasmodium falciparum
GGTHY

SEQ ID NO: 3220492 - protein, 7 aa, Plasmodium falciparum
GGTITPD

SEQ ID NO: 3220493 - protein, 7 aa, Plasmodium falciparum
GGVGKNL

SEQ ID NO: 3220494 - protein, 11 aa, Plasmodium falciparum
GGVQGNNGDGA

SEQ ID NO: 3220495 - protein, 6 aa, Plasmodium falciparum
GGVSKG

SEQ ID NO: 3220496 - protein, 13 aa, Plasmodium falciparum
GGVTKGNCNGGRI

SEQ ID NO: 3220497 - protein, 5 aa, Plasmodium falciparum
GGYEK

SEQ ID NO: 3220498 - protein, 12 aa, Plasmodium falciparum
GGYKKEKNNNII

SEQ ID NO: 3220499 - protein, 8 aa, Plasmodium falciparum
GGYNENST

SEQ ID NO: 3220500 - protein, 12 aa, Plasmodium falciparum
GHAYKKNTETNE

SEQ ID NO: 3220501 - protein, 7 aa, Plasmodium falciparum
GHDTDPP

SEQ ID NO: 3220502 - protein, 8 aa, Plasmodium falciparum
GHGESEGW

SEQ ID NO: 3220503 - protein, 4 aa, Plasmodium falciparum
GHIK

SEQ ID NO: 3220504 - protein, 4 aa, Plasmodium falciparum
GHKD

SEQ ID NO: 3220505 - protein, 11 aa, Plasmodium falciparum
GHKGGSTTKME

SEQ ID NO: 3220506 - protein, 6 aa, Plasmodium falciparum
GHKQTC

SEQ ID NO: 3220507 - protein, 5 aa, Plasmodium falciparum
GHKSS

SEQ ID NO: 3220508 - protein, 14 aa, Plasmodium falciparum
GHKTNGVHTNSDKT

SEQ ID NO: 3220509 - protein, 14 aa, Plasmodium falciparum
GHNNGDAKGGNNPL

SEQ ID NO: 3220510 - protein, 10 aa, Plasmodium falciparum
GHNNKNDTYM

SEQ ID NO: 3220511 - protein, 4 aa, Plasmodium falciparum
GHNY

SEQ ID NO: 3220512 - protein, 13 aa, Plasmodium falciparum
GHNYNNNNNNNNI

SEQ ID NO: 3220513 - protein, 6 aa, Plasmodium falciparum
GHPGGT

SEQ ID NO: 3220514 - protein, 15 aa, Plasmodium falciparum
GHRDYKGPCTGKDGH

SEQ ID NO: 3220515 - protein, 11 aa, Plasmodium falciparum
GHSAEGSTSPY

SEQ ID NO: 3220516 - protein, 7 aa, Plasmodium falciparum
GHSENAK

SEQ ID NO: 3220517 - protein, 4 aa, Plasmodium falciparum
GHSF

SEQ ID NO: 3220518 - protein, 10 aa, Plasmodium falciparum
GHSGSGKTEN

SEQ ID NO: 3220519 - protein, 7 aa, Plasmodium falciparum
GHTFDSS

SEQ ID NO: 3220520 - protein, 46 aa, Plasmodium falciparum
GHTKNEKMEDGSLKNPHVNTNTTHPTEYDDNNTERKNLSEIDDTQT

SEQ ID NO: 3220521 - protein, 4 aa, Plasmodium falciparum
GHTN

SEQ ID NO: 3220522 - protein, 4 aa, Plasmodium falciparum
GHVT

SEQ ID NO: 3220523 - protein, 4 aa, Plasmodium falciparum
GIAP

SEQ ID NO: 3220524 - protein, 13 aa, Plasmodium falciparum
GIAQNSNNNENNI

SEQ ID NO: 3220525 - protein, 4 aa, Plasmodium falciparum
GIDG

SEQ ID NO: 3220526 - protein, 26 aa, Plasmodium falciparum
GIDPTSANHDSYSDKNDPISDNHHPY

SEQ ID NO: 3220527 - protein, 33 aa, Plasmodium falciparum
GIDPTSDNRDPYSDKKDPISGTKDPISDNHHPY

SEQ ID NO: 3220528 - protein, 26 aa, Plasmodium falciparum
GIDPTSDNRGPYSDKNDRISDNHHPY

SEQ ID NO: 3220529 - protein, 4 aa, Plasmodium falciparum
GIEA

SEQ ID NO: 3220530 - protein, 6 aa, Plasmodium falciparum
GIEDTT

SEQ ID NO: 3220531 - protein, 4 aa, Plasmodium falciparum
GIGK

SEQ ID NO: 3220532 - protein, 31 aa, Plasmodium falciparum
GIKEAKDDDLNKSSLNKKKCHDKDNNDQPHY

SEQ ID NO: 3220533 - protein, 4 aa, Plasmodium falciparum
GIKG

SEQ ID NO: 3220534 - protein, 10 aa, Plasmodium falciparum
GIKGGKKNNL

SEQ ID NO: 3220535 - protein, 4 aa, Plasmodium falciparum
GIKK

SEQ ID NO: 3220536 - protein, 7 aa, Plasmodium falciparum
GIKKKSN

SEQ ID NO: 3220537 - protein, 4 aa, Plasmodium falciparum
GIKS

SEQ ID NO: 3220538 - protein, 11 aa, Plasmodium falciparum
GINKSASNNNM

SEQ ID NO: 3220539 - protein, 18 aa, Plasmodium falciparum
GINQNNHYDHDKKKSSSS

SEQ ID NO: 3220540 - protein, 17 aa, Plasmodium falciparum
GINSNDDNRSDNSSTCE

SEQ ID NO: 3220541 - protein, 4 aa, Plasmodium falciparum
GIPQ

SEQ ID NO: 3220542 - protein, 11 aa, Plasmodium falciparum
GIQTNDPNTLD

SEQ ID NO: 3220543 - protein, 53 aa, Plasmodium falciparum
GIQYDGDSMKCDGDNIKGDGDNIKGDGDSIKGNGDSIKGNGDNIKGDGEDIKC

SEQ ID NO: 3220544 - protein, 14 aa, Plasmodium falciparum
GIRNQTNNKSHNYK

SEQ ID NO: 3220545 - protein, 4 aa, Plasmodium falciparum
GISA

SEQ ID NO: 3220546 - protein, 11 aa, Plasmodium falciparum
GISEEEANNIS

SEQ ID NO: 3220547 - protein, 28 aa, Plasmodium falciparum
GISHDEKNNSNTSRTRGNNRNDHMDPQI

SEQ ID NO: 3220548 - protein, 17 aa, Plasmodium falciparum
GISSSNNNNSSSSSNNM

SEQ ID NO: 3220549 - protein, 6 aa, Plasmodium falciparum
GISTHD

SEQ ID NO: 3220550 - protein, 20 aa, Plasmodium falciparum
GITDETTKKQYEKDDTDNKQ

SEQ ID NO: 3220551 - protein, 6 aa, Plasmodium falciparum
GITEGI

SEQ ID NO: 3220552 - protein, 9 aa, Plasmodium falciparum
GITNEERFS

SEQ ID NO: 3220553 - protein, 7 aa, Plasmodium falciparum
GITNNHN

SEQ ID NO: 3220554 - protein, 6 aa, Plasmodium falciparum
GITNSS

SEQ ID NO: 3220555 - protein, 7 aa, Plasmodium falciparum
GITPNNT

SEQ ID NO: 3220556 - protein, 8 aa, Plasmodium falciparum
GITTTIPK

SEQ ID NO: 3220557 - protein, 6 aa, Plasmodium falciparum
GIVKNK

SEQ ID NO: 3220558 - protein, 19 aa, Plasmodium falciparum
GIYNKGEKKKKKKVKGNKE

SEQ ID NO: 3220559 - protein, 11 aa, Plasmodium falciparum
GIYTNDENQFD

SEQ ID NO: 3220560 - protein, 5 aa, Plasmodium falciparum
GIYTS

SEQ ID NO: 3220561 - protein, 8 aa, Plasmodium falciparum
GKAKEYSI

SEQ ID NO: 3220562 - protein, 11 aa, Plasmodium falciparum
GKANLPDKEAV

SEQ ID NO: 3220563 - protein, 6 aa, Plasmodium falciparum
GKANTT

SEQ ID NO: 3220564 - protein, 6 aa, Plasmodium falciparum
GKARLS

SEQ ID NO: 3220565 - protein, 15 aa, Plasmodium falciparum
GKASEETLKATESQM

SEQ ID NO: 3220566 - protein, 15 aa, Plasmodium falciparum
GKCKSGDTKGKCDGI

SEQ ID NO: 3220567 - protein, 31 aa, Plasmodium falciparum
GKCSNGDGTKVNCNGNNKTITAEDINGSTAD

SEQ ID NO: 3220568 - protein, 10 aa, Plasmodium falciparum
GKCTQGNGEC

SEQ ID NO: 3220569 - protein, 8 aa, Plasmodium falciparum
GKDENTTV

SEQ ID NO: 3220570 - protein, 6 aa, Plasmodium falciparum
GKDESE

SEQ ID NO: 3220571 - protein, 22 aa, Plasmodium falciparum
GKDNIKKKSKRNKIQTAYSNKD

SEQ ID NO: 3220572 - protein, 8 aa, Plasmodium falciparum
GKDNNGTY

SEQ ID NO: 3220573 - protein, 7 aa, Plasmodium falciparum
GKDNTTI

SEQ ID NO: 3220574 - protein, 12 aa, Plasmodium falciparum
GKDSNKNDDSKK

SEQ ID NO: 3220575 - protein, 8 aa, Plasmodium falciparum
GKDSRNPH

SEQ ID NO: 3220576 - protein, 10 aa, Plasmodium falciparum
GKDSTTPTQE

SEQ ID NO: 3220577 - protein, 29 aa, Plasmodium falciparum
GKDTHDDNKDNKDNDDNDDNDDNNDHNDH

SEQ ID NO: 3220578 - protein, 12 aa, Plasmodium falciparum
GKDTIKNKSNYN

SEQ ID NO: 3220579 - protein, 7 aa, Plasmodium falciparum
GKEDNID

SEQ ID NO: 3220580 - protein, 14 aa, Plasmodium falciparum
GKEDNYRSSRAHKL

SEQ ID NO: 3220581 - protein, 16 aa, Plasmodium falciparum
GKEDPEDSFNENQEHN

SEQ ID NO: 3220582 - protein, 8 aa, Plasmodium falciparum
GKEEIEEY

SEQ ID NO: 3220583 - protein, 5 aa, Plasmodium falciparum
GKEES

SEQ ID NO: 3220584 - protein, 4 aa, Plasmodium falciparum
GKEG

SEQ ID NO: 3220585 - protein, 5 aa, Plasmodium falciparum
GKEGI

SEQ ID NO: 3220586 - protein, 5 aa, Plasmodium falciparum
GKEGL

SEQ ID NO: 3220587 - protein, 13 aa, Plasmodium falciparum
GKEGLQAARSSDF

SEQ ID NO: 3220588 - protein, 8 aa, Plasmodium falciparum
GKEHVDDK

SEQ ID NO: 3220589 - protein, 10 aa, Plasmodium falciparum
GKEIDEQENQ

SEQ ID NO: 3220590 - protein, 11 aa, Plasmodium falciparum
GKEKEKKQNII

SEQ ID NO: 3220591 - protein, 6 aa, Plasmodium falciparum
GKEKIQ

SEQ ID NO: 3220592 - protein, 10 aa, Plasmodium falciparum
GKEKNMDNSK

SEQ ID NO: 3220593 - protein, 14 aa, Plasmodium falciparum
GKEKNRRNKKEISK

SEQ ID NO: 3220594 - protein, 9 aa, Plasmodium falciparum
GKEMKSDKC

SEQ ID NO: 3220595 - protein, 8 aa, Plasmodium falciparum
GKENDYTY

SEQ ID NO: 3220596 - protein, 7 aa, Plasmodium falciparum
GKENLNK

SEQ ID NO: 3220597 - protein, 81 aa, Plasmodium falciparum
GKENNDDTLIEGDNKNDEETSANNNNNEDDNNEDDNNEDDNNEDDNNENDNNNNNEDDNNNDDDDDEDNEEEDEEKQKSLR

SEQ ID NO: 3220598 - protein, 65 aa, Plasmodium falciparum
GKEPRQSLGSYAMWVTWRSNGKRSSNLSRLSCWKSQGRYRISVFSLVFRMERFLPKTKKTVGRVG

SEQ ID NO: 3220599 - protein, 7 aa, Plasmodium falciparum
GKEPSLK

SEQ ID NO: 3220600 - protein, 11 aa, Plasmodium falciparum
GKEQDKKCNND

SEQ ID NO: 3220601 - protein, 8 aa, Plasmodium falciparum
GKEVGDNE

SEQ ID NO: 3220602 - protein, 4 aa, Plasmodium falciparum
GKEW

SEQ ID NO: 3220603 - protein, 4 aa, Plasmodium falciparum
GKEY

SEQ ID NO: 3220604 - protein, 4 aa, Plasmodium falciparum
GKFP

SEQ ID NO: 3220605 - protein, 33 aa, Plasmodium falciparum
GKFPNQDRKEDPTDREKTDVNEGQNGKRLTQEK

SEQ ID NO: 3220606 - protein, 4 aa, Plasmodium falciparum
GKGF

SEQ ID NO: 3220607 - protein, 8 aa, Plasmodium falciparum
GKGGFGAN

SEQ ID NO: 3220608 - protein, 11 aa, Plasmodium falciparum
GKGKTSDKMDN

SEQ ID NO: 3220609 - protein, 6 aa, Plasmodium falciparum
GKGLNG

SEQ ID NO: 3220610 - protein, 10 aa, Plasmodium falciparum
GKGNDNEVNF

SEQ ID NO: 3220611 - protein, 6 aa, Plasmodium falciparum
GKGNED

SEQ ID NO: 3220612 - protein, 5 aa, Plasmodium falciparum
GKGNI

SEQ ID NO: 3220613 - protein, 12 aa, Plasmodium falciparum
GKGNKLAEYKPN

SEQ ID NO: 3220614 - protein, 13 aa, Plasmodium falciparum
GKGNNKKDNNKKY

SEQ ID NO: 3220615 - protein, 13 aa, Plasmodium falciparum
GKGRSIKDSNYIE

SEQ ID NO: 3220616 - protein, 10 aa, Plasmodium falciparum
GKGSHDARNE

SEQ ID NO: 3220617 - protein, 5 aa, Plasmodium falciparum
GKGSI

SEQ ID NO: 3220618 - protein, 21 aa, Plasmodium falciparum
GKGSSNTSNSSSNKNNNNNNN

SEQ ID NO: 3220619 - protein, 11 aa, Plasmodium falciparum
GKGSYNSYTEI

SEQ ID NO: 3220620 - protein, 7 aa, Plasmodium falciparum
GKGTDIT

SEQ ID NO: 3220621 - protein, 12 aa, Plasmodium falciparum
GKGTISKDYNNN

SEQ ID NO: 3220622 - protein, 7 aa, Plasmodium falciparum
GKGTNMK

SEQ ID NO: 3220623 - protein, 21 aa, Plasmodium falciparum
GKHDDKEKKSTIIDGKQPTTI

SEQ ID NO: 3220624 - protein, 7 aa, Plasmodium falciparum
GKHEQVK

SEQ ID NO: 3220625 - protein, 93 aa, Plasmodium falciparum
GKHGNNEQHKEDEKYKVDEKYKDEKYKEDEKYKDVEKYRRDEKYKEDEKYKDVEKYRRDEKYKDDEKYKDDEKYKDDEKYKDDEKYKDDEVNH

SEQ ID NO: 3220626 - protein, 13 aa, Plasmodium falciparum
GKHIPKSLSSKIN

SEQ ID NO: 3220627 - protein, 6 aa, Plasmodium falciparum
GKHNEN

SEQ ID NO: 3220628 - protein, 11 aa, Plasmodium falciparum
GKHRKNTKTNL

SEQ ID NO: 3220629 - protein, 10 aa, Plasmodium falciparum
GKHRNKDPDP

SEQ ID NO: 3220630 - protein, 8 aa, Plasmodium falciparum
GKHTNNKV

SEQ ID NO: 3220631 - protein, 4 aa, Plasmodium falciparum
GKID

SEQ ID NO: 3220632 - protein, 5 aa, Plasmodium falciparum
GKIEN

SEQ ID NO: 3220633 - protein, 18 aa, Plasmodium falciparum
GKIKDTAINNNSFRNNNN

SEQ ID NO: 3220634 - protein, 6 aa, Plasmodium falciparum
GKIKTN

SEQ ID NO: 3220635 - protein, 11 aa, Plasmodium falciparum
GKINNSDDLTD

SEQ ID NO: 3220636 - protein, 5 aa, Plasmodium falciparum
GKIPD

SEQ ID NO: 3220637 - protein, 15 aa, Plasmodium falciparum
GKIYDDDNNNDNNNF

SEQ ID NO: 3220638 - protein, 27 aa, Plasmodium falciparum
GKKAEKCHDQHSDNPQEKCDEPPPELD

SEQ ID NO: 3220639 - protein, 13 aa, Plasmodium falciparum
GKKAKEKTDDEIQ

SEQ ID NO: 3220640 - protein, 5 aa, Plasmodium falciparum
GKKAL

SEQ ID NO: 3220641 - protein, 11 aa, Plasmodium falciparum
GKKCNNNNPVD

SEQ ID NO: 3220642 - protein, 15 aa, Plasmodium falciparum
GKKDNIKSNQSNDEN

SEQ ID NO: 3220643 - protein, 11 aa, Plasmodium falciparum
GKKDREYKSNT

SEQ ID NO: 3220644 - protein, 8 aa, Plasmodium falciparum
GKKDTVKS

SEQ ID NO: 3220645 - protein, 44 aa, Plasmodium falciparum
GKKEEKKKNDDEKKNDDEKKNDDEKKNMDGKKKHIDDENKNDNM

SEQ ID NO: 3220646 - protein, 8 aa, Plasmodium falciparum
GKKEGKGI

SEQ ID NO: 3220647 - protein, 9 aa, Plasmodium falciparum
GKKEGNLNA

SEQ ID NO: 3220648 - protein, 91 aa, Plasmodium falciparum
GKKEKEKNIKEEPQSDALDKDDNKEDDNNDDDNNDNHHNNDDNNDDHHNDDDDNNNDHHNNDDDNNDDHHNDDENMENIQSKRDNDNVEEE

SEQ ID NO: 3220649 - protein, 18 aa, Plasmodium falciparum
GKKEKTNPFENQSSKNNP

SEQ ID NO: 3220650 - protein, 10 aa, Plasmodium falciparum
GKKERDVTNL

SEQ ID NO: 3220651 - protein, 9 aa, Plasmodium falciparum
GKKERNENI

SEQ ID NO: 3220652 - protein, 7 aa, Plasmodium falciparum
GKKGNLY

SEQ ID NO: 3220653 - protein, 27 aa, Plasmodium falciparum
GKKGTSNNNNNNNNNNNNNSGHNNTIN

SEQ ID NO: 3220654 - protein, 4 aa, Plasmodium falciparum
GKKI

SEQ ID NO: 3220655 - protein, 5 aa, Plasmodium falciparum
GKKIK

SEQ ID NO: 3220656 - protein, 6 aa, Plasmodium falciparum
GKKKDD

SEQ ID NO: 3220657 - protein, 7 aa, Plasmodium falciparum
GKKKEEV

SEQ ID NO: 3220658 - protein, 65 aa, Plasmodium falciparum
GKKKEKNKKKKKDDEDDDDIDEEDDDLDIEGKNNEFNADEEENSKDLKNNNIDDNEEDGTTDEDD

SEQ ID NO: 3220659 - protein, 28 aa, Plasmodium falciparum
GKKKKKVKQKLGERKKPKRRSAKRRRGV

SEQ ID NO: 3220660 - protein, 9 aa, Plasmodium falciparum
GKKKKQKYN

SEQ ID NO: 3220661 - protein, 9 aa, Plasmodium falciparum
GKKKNENKR

SEQ ID NO: 3220662 - protein, 10 aa, Plasmodium falciparum
GKKKNYDKEG

SEQ ID NO: 3220663 - protein, 32 aa, Plasmodium falciparum
GKKKRGGKKMKQKKNDLKEPNYRPYDMIFNYF

SEQ ID NO: 3220664 - protein, 11 aa, Plasmodium falciparum
GKKNAEEKYPI

SEQ ID NO: 3220665 - protein, 8 aa, Plasmodium falciparum
GKKNGKTL

SEQ ID NO: 3220666 - protein, 7 aa, Plasmodium falciparum
GKKNKEN

SEQ ID NO: 3220667 - protein, 13 aa, Plasmodium falciparum
GKKNKKEKHHEKK

SEQ ID NO: 3220668 - protein, 15 aa, Plasmodium falciparum
GKKNKNEKIKKNNIN

SEQ ID NO: 3220669 - protein, 20 aa, Plasmodium falciparum
GKKNNINDKSMSKNNNNVNN

SEQ ID NO: 3220670 - protein, 6 aa, Plasmodium falciparum
GKKNNQ

SEQ ID NO: 3220671 - protein, 26 aa, Plasmodium falciparum
GKKQTYDEKNHSNSFSSSTNTDIDNN

SEQ ID NO: 3220672 - protein, 8 aa, Plasmodium falciparum
GKKRKEKI

SEQ ID NO: 3220673 - protein, 9 aa, Plasmodium falciparum
GKKRRRKKI

SEQ ID NO: 3220674 - protein, 7 aa, Plasmodium falciparum
GKKSSSK

SEQ ID NO: 3220675 - protein, 9 aa, Plasmodium falciparum
GKKVDFPNQ

SEQ ID NO: 3220676 - protein, 4 aa, Plasmodium falciparum
GKKY

SEQ ID NO: 3220677 - protein, 9 aa, Plasmodium falciparum
GKKYPSEDN

SEQ ID NO: 3220678 - protein, 6 aa, Plasmodium falciparum
GKLGNH

SEQ ID NO: 3220679 - protein, 9 aa, Plasmodium falciparum
GKLKKRNKY

SEQ ID NO: 3220680 - protein, 6 aa, Plasmodium falciparum
GKLNEK

SEQ ID NO: 3220681 - protein, 12 aa, Plasmodium falciparum
GKLSDTPSDNNI

SEQ ID NO: 3220682 - protein, 9 aa, Plasmodium falciparum
GKLSQSNYK

SEQ ID NO: 3220683 - protein, 7 aa, Plasmodium falciparum
GKLTSGN

SEQ ID NO: 3220684 - protein, 14 aa, Plasmodium falciparum
GKNANNSSFTNHHS

SEQ ID NO: 3220685 - protein, 7 aa, Plasmodium falciparum
GKNAPTS

SEQ ID NO: 3220686 - protein, 10 aa, Plasmodium falciparum
GKNDNGPKYR

SEQ ID NO: 3220687 - protein, 9 aa, Plasmodium falciparum
GKNEDDKDV

SEQ ID NO: 3220688 - protein, 11 aa, Plasmodium falciparum
GKNEKNNYEEE

SEQ ID NO: 3220689 - protein, 16 aa, Plasmodium falciparum
GKNENNENKENTTNDM

SEQ ID NO: 3220690 - protein, 23 aa, Plasmodium falciparum
GKNGINSNLRKRKNNNLNDSSTT

SEQ ID NO: 3220691 - protein, 41 aa, Plasmodium falciparum
GKNGPYSDKNDLYSGNHDSLSGNRDPTSANHDSYSGNHHPY

SEQ ID NO: 3220692 - protein, 14 aa, Plasmodium falciparum
GKNIKTTDKKNAMY

SEQ ID NO: 3220693 - protein, 6 aa, Plasmodium falciparum
GKNINS

SEQ ID NO: 3220694 - protein, 7 aa, Plasmodium falciparum
GKNKDTV

SEQ ID NO: 3220695 - protein, 16 aa, Plasmodium falciparum
GKNKKKKKEHQHNSSY

SEQ ID NO: 3220696 - protein, 26 aa, Plasmodium falciparum
GKNKLKNNKKKNKIKAKKKKKDKKEK

SEQ ID NO: 3220697 - protein, 11 aa, Plasmodium falciparum
GKNKNGKTCED

SEQ ID NO: 3220698 - protein, 9 aa, Plasmodium falciparum
GKNKYNDSL

SEQ ID NO: 3220699 - protein, 6 aa, Plasmodium falciparum
GKNMAR

SEQ ID NO: 3220700 - protein, 4 aa, Plasmodium falciparum
GKNN

SEQ ID NO: 3220701 - protein, 8 aa, Plasmodium falciparum
GKNNNNNI

SEQ ID NO: 3220702 - protein, 14 aa, Plasmodium falciparum
GKNNSSSENENTLS

SEQ ID NO: 3220703 - protein, 6 aa, Plasmodium falciparum
GKNNTS

SEQ ID NO: 3220704 - protein, 4 aa, Plasmodium falciparum
GKNP

SEQ ID NO: 3220705 - protein, 8 aa, Plasmodium falciparum
GKNPTMQS

SEQ ID NO: 3220706 - protein, 10 aa, Plasmodium falciparum
GKNQSQARNQ

SEQ ID NO: 3220707 - protein, 14 aa, Plasmodium falciparum
GKNSTELSEPPKKK

SEQ ID NO: 3220708 - protein, 6 aa, Plasmodium falciparum
GKNTNN

SEQ ID NO: 3220709 - protein, 7 aa, Plasmodium falciparum
GKNTWSQ

SEQ ID NO: 3220710 - protein, 4 aa, Plasmodium falciparum
GKNV

SEQ ID NO: 3220711 - protein, 5 aa, Plasmodium falciparum
GKNVD

SEQ ID NO: 3220712 - protein, 6 aa, Plasmodium falciparum
GKPFRK

SEQ ID NO: 3220713 - protein, 13 aa, Plasmodium falciparum
GKPGSKFENAYGT

SEQ ID NO: 3220714 - protein, 15 aa, Plasmodium falciparum
GKPKHEDISPSGEEL

SEQ ID NO: 3220715 - protein, 9 aa, Plasmodium falciparum
GKPKYEPPE

SEQ ID NO: 3220716 - protein, 7 aa, Plasmodium falciparum
GKPLNKQ

SEQ ID NO: 3220717 - protein, 13 aa, Plasmodium falciparum
GKPNISLSSKTGL

SEQ ID NO: 3220718 - protein, 8 aa, Plasmodium falciparum
GKPSDSSI

SEQ ID NO: 3220719 - protein, 6 aa, Plasmodium falciparum
GKPSQR

SEQ ID NO: 3220720 - protein, 5 aa, Plasmodium falciparum
GKPTF

SEQ ID NO: 3220721 - protein, 13 aa, Plasmodium falciparum
GKQATTTTTETVK

SEQ ID NO: 3220722 - protein, 15 aa, Plasmodium falciparum
GKQEDMKEQIRGADP

SEQ ID NO: 3220723 - protein, 11 aa, Plasmodium falciparum
GKQENIKNYEE

SEQ ID NO: 3220724 - protein, 12 aa, Plasmodium falciparum
GKQHRKEQKVTS

SEQ ID NO: 3220725 - protein, 15 aa, Plasmodium falciparum
GKQINNDKNRNEDYY

SEQ ID NO: 3220726 - protein, 10 aa, Plasmodium falciparum
GKQITGSNKG

SEQ ID NO: 3220727 - protein, 5 aa, Plasmodium falciparum
GKQKK

SEQ ID NO: 3220728 - protein, 40 aa, Plasmodium falciparum
GKQKKEMQENEDEKIKNKGKNKTKTNDDKKKNSSINNNND

SEQ ID NO: 3220729 - protein, 11 aa, Plasmodium falciparum
GKQKSSHRDQL

SEQ ID NO: 3220730 - protein, 7 aa, Plasmodium falciparum
GKQLKNV

SEQ ID NO: 3220731 - protein, 9 aa, Plasmodium falciparum
GKQNPQTNK

SEQ ID NO: 3220732 - protein, 5 aa, Plasmodium falciparum
GKQPF

SEQ ID NO: 3220733 - protein, 6 aa, Plasmodium falciparum
GKQTQQ

SEQ ID NO: 3220734 - protein, 97 aa, Plasmodium falciparum
GKRDDNNDEKRDDNNDEKRDHNNIEKRDDNNIEKRDDNNIEKRDDNNIEKRDDNNDEKRDENNDKKRDENNNYSDDNDDDLNNEDSSSTYNKKGKKK

SEQ ID NO: 3220735 - protein, 11 aa, Plasmodium falciparum
GKRDKKNIGSN

SEQ ID NO: 3220736 - protein, 6 aa, Plasmodium falciparum
GKRESI

SEQ ID NO: 3220737 - protein, 17 aa, Plasmodium falciparum
GKRKAKRKSYNNNNNNY

SEQ ID NO: 3220738 - protein, 9 aa, Plasmodium falciparum
GKRKDKQNN

SEQ ID NO: 3220739 - protein, 11 aa, Plasmodium falciparum
GKRKKEITSSS

SEQ ID NO: 3220740 - protein, 12 aa, Plasmodium falciparum
GKRKKKKKKKNN

SEQ ID NO: 3220741 - protein, 65 aa, Plasmodium falciparum
GKRKNDNNIRDDKINGYSNNNDNNNEHNNNNDNNNEHNDHNNEHNNEHNNEHNNEHKNYKESTDK

SEQ ID NO: 3220742 - protein, 10 aa, Plasmodium falciparum
GKRKNGSKQL

SEQ ID NO: 3220743 - protein, 6 aa, Plasmodium falciparum
GKRNPY

SEQ ID NO: 3220744 - protein, 8 aa, Plasmodium falciparum
GKRNSSNI

SEQ ID NO: 3220745 - protein, 5 aa, Plasmodium falciparum
GKRNT

SEQ ID NO: 3220746 - protein, 8 aa, Plasmodium falciparum
GKRRNKPK

SEQ ID NO: 3220747 - protein, 12 aa, Plasmodium falciparum
GKRRRRKKKREA

SEQ ID NO: 3220748 - protein, 11 aa, Plasmodium falciparum
GKRSGSDGRSN

SEQ ID NO: 3220749 - protein, 4 aa, Plasmodium falciparum
GKRT

SEQ ID NO: 3220750 - protein, 9 aa, Plasmodium falciparum
GKSAPGVHS

SEQ ID NO: 3220751 - protein, 9 aa, Plasmodium falciparum
GKSASPEAV

SEQ ID NO: 3220752 - protein, 7 aa, Plasmodium falciparum
GKSATDY

SEQ ID NO: 3220753 - protein, 14 aa, Plasmodium falciparum
GKSDQDEENSKNDD

SEQ ID NO: 3220754 - protein, 7 aa, Plasmodium falciparum
GKSGKIG

SEQ ID NO: 3220755 - protein, 9 aa, Plasmodium falciparum
GKSGSGKSS

SEQ ID NO: 3220756 - protein, 9 aa, Plasmodium falciparum
GKSGSGKST

SEQ ID NO: 3220757 - protein, 9 aa, Plasmodium falciparum
GKSGSGKTT

SEQ ID NO: 3220758 - protein, 8 aa, Plasmodium falciparum
GKSHTEDS

SEQ ID NO: 3220759 - protein, 4 aa, Plasmodium falciparum
GKSI

SEQ ID NO: 3220760 - protein, 5 aa, Plasmodium falciparum
GKSIS

SEQ ID NO: 3220761 - protein, 10 aa, Plasmodium falciparum
GKSKDYRRTT

SEQ ID NO: 3220762 - protein, 9 aa, Plasmodium falciparum
GKSKNKTHN

SEQ ID NO: 3220763 - protein, 6 aa, Plasmodium falciparum
GKSKSL

SEQ ID NO: 3220764 - protein, 21 aa, Plasmodium falciparum
GKSKTKGKYKKKNKSNKMNMG

SEQ ID NO: 3220765 - protein, 25 aa, Plasmodium falciparum
GKSLKTSKKDYKIKNKEEETDENKK

SEQ ID NO: 3220766 - protein, 15 aa, Plasmodium falciparum
GKSNNLKSKNGEDSF

SEQ ID NO: 3220767 - protein, 16 aa, Plasmodium falciparum
GKSRKSMNNNTSIDGK

SEQ ID NO: 3220768 - protein, 70 aa, Plasmodium falciparum
GKSRNCEKDKQKDKQKDKQKDKQKDKQKDKQKDKQKDKQKDKQKDKQKDKQKDKQKERKIKNEQTNIPSD

SEQ ID NO: 3220769 - protein, 5 aa, Plasmodium falciparum
GKSTL

SEQ ID NO: 3220770 - protein, 5 aa, Plasmodium falciparum
GKSTT

SEQ ID NO: 3220771 - protein, 6 aa, Plasmodium falciparum
GKTAEE

SEQ ID NO: 3220772 - protein, 7 aa, Plasmodium falciparum
GKTAPTG

SEQ ID NO: 3220773 - protein, 24 aa, Plasmodium falciparum
GKTASQPNSHPTLSPSSNPRDDGL

SEQ ID NO: 3220774 - protein, 24 aa, Plasmodium falciparum
GKTETCHSSYKTGDIPNSFMEIPE

SEQ ID NO: 3220775 - protein, 15 aa, Plasmodium falciparum
GKTFDNSNHISDEGY

SEQ ID NO: 3220776 - protein, 7 aa, Plasmodium falciparum
GKTGGKI

SEQ ID NO: 3220777 - protein, 9 aa, Plasmodium falciparum
GKTNKGNNN

SEQ ID NO: 3220778 - protein, 6 aa, Plasmodium falciparum
GKTNKL

SEQ ID NO: 3220779 - protein, 9 aa, Plasmodium falciparum
GKTNMKSSI

SEQ ID NO: 3220780 - protein, 7 aa, Plasmodium falciparum
GKTNTTD

SEQ ID NO: 3220781 - protein, 5 aa, Plasmodium falciparum
GKTNY

SEQ ID NO: 3220782 - protein, 10 aa, Plasmodium falciparum
GKTSNQKKKI

SEQ ID NO: 3220783 - protein, 4 aa, Plasmodium falciparum
GKTT

SEQ ID NO: 3220784 - protein, 29 aa, Plasmodium falciparum
GKTYGSKCKNKKKIYNNPKSNNDNKLNSY

SEQ ID NO: 3220785 - protein, 14 aa, Plasmodium falciparum
GKVCSGDGEDCKDQ

SEQ ID NO: 3220786 - protein, 12 aa, Plasmodium falciparum
GKVEKSKLSKDK

SEQ ID NO: 3220787 - protein, 6 aa, Plasmodium falciparum
GKVENI

SEQ ID NO: 3220788 - protein, 4 aa, Plasmodium falciparum
GKVI

SEQ ID NO: 3220789 - protein, 40 aa, Plasmodium falciparum
GKVKNNGLVSNKKDEVKTKDEINKNDSENVYEKTKQNSYY

SEQ ID NO: 3220790 - protein, 6 aa, Plasmodium falciparum
GKVKQS

SEQ ID NO: 3220791 - protein, 8 aa, Plasmodium falciparum
GKVNPNKS

SEQ ID NO: 3220792 - protein, 6 aa, Plasmodium falciparum
GKVQNE

SEQ ID NO: 3220793 - protein, 15 aa, Plasmodium falciparum
GKVRNKEDVKNDKNI

SEQ ID NO: 3220794 - protein, 14 aa, Plasmodium falciparum
GKWNNNDDKEKNLK

SEQ ID NO: 3220795 - protein, 25 aa, Plasmodium falciparum
GKYCDSEKNKHERNNDYNKKEASDF

SEQ ID NO: 3220796 - protein, 5 aa, Plasmodium falciparum
GKYEE

SEQ ID NO: 3220797 - protein, 23 aa, Plasmodium falciparum
GKYENEIKTYESDNDISNSNINT

SEQ ID NO: 3220798 - protein, 9 aa, Plasmodium falciparum
GKYENSSNI

SEQ ID NO: 3220799 - protein, 14 aa, Plasmodium falciparum
GKYKKKKKKQEKVN

SEQ ID NO: 3220800 - protein, 8 aa, Plasmodium falciparum
GKYNEDEK

SEQ ID NO: 3220801 - protein, 7 aa, Plasmodium falciparum
GKYPNEL

SEQ ID NO: 3220802 - protein, 6 aa, Plasmodium falciparum
GKYSNE

SEQ ID NO: 3220803 - protein, 7 aa, Plasmodium falciparum
GKYSTAV

SEQ ID NO: 3220804 - protein, 5 aa, Plasmodium falciparum
GLDPN

SEQ ID NO: 3220805 - protein, 16 aa, Plasmodium falciparum
GLEEKLKTDKEKNIKG

SEQ ID NO: 3220806 - protein, 5 aa, Plasmodium falciparum
GLEET

SEQ ID NO: 3220807 - protein, 7 aa, Plasmodium falciparum
GLEGTEK

SEQ ID NO: 3220808 - protein, 6 aa, Plasmodium falciparum
GLEKAE

SEQ ID NO: 3220809 - protein, 8 aa, Plasmodium falciparum
GLESTNNY

SEQ ID NO: 3220810 - protein, 10 aa, Plasmodium falciparum
GLETNFNESS

SEQ ID NO: 3220811 - protein, 8 aa, Plasmodium falciparum
GLGENEKN

SEQ ID NO: 3220812 - protein, 7 aa, Plasmodium falciparum
GLHSQNN

SEQ ID NO: 3220813 - protein, 5 aa, Plasmodium falciparum
GLKAS

SEQ ID NO: 3220814 - protein, 5 aa, Plasmodium falciparum
GLKAT

SEQ ID NO: 3220815 - protein, 7 aa, Plasmodium falciparum
GLKEKEV

SEQ ID NO: 3220816 - protein, 7 aa, Plasmodium falciparum
GLKKTTR

SEQ ID NO: 3220817 - protein, 13 aa, Plasmodium falciparum
GLKNSDSMIASLK

SEQ ID NO: 3220818 - protein, 14 aa, Plasmodium falciparum
GLNGTDNSQNGNNN

SEQ ID NO: 3220819 - protein, 4 aa, Plasmodium falciparum
GLNK

SEQ ID NO: 3220820 - protein, 9 aa, Plasmodium falciparum
GLNNRPDTL

SEQ ID NO: 3220821 - protein, 10 aa, Plasmodium falciparum
GLNSPNVNKR

SEQ ID NO: 3220822 - protein, 17 aa, Plasmodium falciparum
GLNSPTSNRNKKSVTTF

SEQ ID NO: 3220823 - protein, 4 aa, Plasmodium falciparum
GLPA

SEQ ID NO: 3220824 - protein, 8 aa, Plasmodium falciparum
GLPSDDDI

SEQ ID NO: 3220825 - protein, 5 aa, Plasmodium falciparum
GLPVS

SEQ ID NO: 3220826 - protein, 15 aa, Plasmodium falciparum
GLQNKRNEEISNTEM

SEQ ID NO: 3220827 - protein, 17 aa, Plasmodium falciparum
GLSEEAKKKYQDGDGNY

SEQ ID NO: 3220828 - protein, 10 aa, Plasmodium falciparum
GLSESEKKTK

SEQ ID NO: 3220829 - protein, 7 aa, Plasmodium falciparum
GLSNDEF

SEQ ID NO: 3220830 - protein, 8 aa, Plasmodium falciparum
GLSNPSNS

SEQ ID NO: 3220831 - protein, 4 aa, Plasmodium falciparum
GLSQ

SEQ ID NO: 3220832 - protein, 13 aa, Plasmodium falciparum
GLSSDNVQKSKGV

SEQ ID NO: 3220833 - protein, 8 aa, Plasmodium falciparum
GLSSPGNP

SEQ ID NO: 3220834 - protein, 7 aa, Plasmodium falciparum
GLSSSFG

SEQ ID NO: 3220835 - protein, 14 aa, Plasmodium falciparum
GLTDDEKKNEIKTK

SEQ ID NO: 3220836 - protein, 10 aa, Plasmodium falciparum
GLTDTSLPGS

SEQ ID NO: 3220837 - protein, 16 aa, Plasmodium falciparum
GLTKKDAQTYYDENGG

SEQ ID NO: 3220838 - protein, 4 aa, Plasmodium falciparum
GLTT

SEQ ID NO: 3220839 - protein, 5 aa, Plasmodium falciparum
GLYTD

SEQ ID NO: 3220840 - protein, 13 aa, Plasmodium falciparum
GMAAAKAEGAAAG

SEQ ID NO: 3220841 - protein, 12 aa, Plasmodium falciparum
GMDITNKSSGSI

SEQ ID NO: 3220842 - protein, 12 aa, Plasmodium falciparum
GMEETQQLQQER

SEQ ID NO: 3220843 - protein, 33 aa, Plasmodium falciparum
GMEKNKNNNNNNNNNNNNSNNNKNNNSNNNNHI

SEQ ID NO: 3220844 - protein, 11 aa, Plasmodium falciparum
GMENENPQKNI

SEQ ID NO: 3220845 - protein, 4 aa, Plasmodium falciparum
GMKS

SEQ ID NO: 3220846 - protein, 6 aa, Plasmodium falciparum
GMKSSG

SEQ ID NO: 3220847 - protein, 110 aa, Plasmodium falciparum
GMNGEELQEETQEDKYEDDEEERDINDNYEEYDDKDDDKDDDEEEEDDDEEDDDEEDDDEEDDDEEDDNDEEEDDDDEEEDDDGDDEEEEEDEEEGYNEQKKDLKNKKYK

SEQ ID NO: 3220848 - protein, 10 aa, Plasmodium falciparum
GMNNADDMKG

SEQ ID NO: 3220849 - protein, 14 aa, Plasmodium falciparum
GMPPNDDDRSDKSI

SEQ ID NO: 3220850 - protein, 12 aa, Plasmodium falciparum
GMPYSKSPSVKG

SEQ ID NO: 3220851 - protein, 13 aa, Plasmodium falciparum
GMSPNVDEKSSTF

SEQ ID NO: 3220852 - protein, 12 aa, Plasmodium falciparum
GMSSGDKGGSTA

SEQ ID NO: 3220853 - protein, 35 aa, Plasmodium falciparum
GMYPNDDEGSDTSSRCECSDTNNTDLAKTKGKDKY

SEQ ID NO: 3220854 - protein, 5 aa, Plasmodium falciparum
GNAPE

SEQ ID NO: 3220855 - protein, 5 aa, Plasmodium falciparum
GNASD

SEQ ID NO: 3220856 - protein, 19 aa, Plasmodium falciparum
GNCNARSNLNKDTKYMNEE

SEQ ID NO: 3220857 - protein, 6 aa, Plasmodium falciparum
GNCNKN

SEQ ID NO: 3220858 - protein, 20 aa, Plasmodium falciparum
GNCPSNGMASSQRNDNSNKN

SEQ ID NO: 3220859 - protein, 14 aa, Plasmodium falciparum
GNCTKNPEGSCTEQ

SEQ ID NO: 3220860 - protein, 9 aa, Plasmodium falciparum
GNDCPDEEK

SEQ ID NO: 3220861 - protein, 12 aa, Plasmodium falciparum
GNDDDNNMKPEC

SEQ ID NO: 3220862 - protein, 12 aa, Plasmodium falciparum
GNDEEEKKDDTN

SEQ ID NO: 3220863 - protein, 13 aa, Plasmodium falciparum
GNDEEKKKRDELE

SEQ ID NO: 3220864 - protein, 20 aa, Plasmodium falciparum
GNDEQNETSEKLESNDINEK

SEQ ID NO: 3220865 - protein, 22 aa, Plasmodium falciparum
GNDESHKTNKKANGKSKENDIL

SEQ ID NO: 3220866 - protein, 35 aa, Plasmodium falciparum
GNDESKESKKTNERKYKKNEYPKDDPKTKQNIPEV

SEQ ID NO: 3220867 - protein, 4 aa, Plasmodium falciparum
GNDG

SEQ ID NO: 3220868 - protein, 7 aa, Plasmodium falciparum
GNDGINE

SEQ ID NO: 3220869 - protein, 13 aa, Plasmodium falciparum
GNDHLEDRSPRIN

SEQ ID NO: 3220870 - protein, 8 aa, Plasmodium falciparum
GNDKDTMK

SEQ ID NO: 3220871 - protein, 8 aa, Plasmodium falciparum
GNDNDDDK

SEQ ID NO: 3220872 - protein, 15 aa, Plasmodium falciparum
GNDNIKNTKKKKKGL

SEQ ID NO: 3220873 - protein, 14 aa, Plasmodium falciparum
GNDNPCSGESDHTP

SEQ ID NO: 3220874 - protein, 9 aa, Plasmodium falciparum
GNDNPCSGV

SEQ ID NO: 3220875 - protein, 19 aa, Plasmodium falciparum
GNDQNRNNNNDNNNNNYNN

SEQ ID NO: 3220876 - protein, 10 aa, Plasmodium falciparum
GNDSGDGETI

SEQ ID NO: 3220877 - protein, 7 aa, Plasmodium falciparum
GNDSIGD

SEQ ID NO: 3220878 - protein, 10 aa, Plasmodium falciparum
GNDSINNGNY

SEQ ID NO: 3220879 - protein, 11 aa, Plasmodium falciparum
GNDSYESEKGL

SEQ ID NO: 3220880 - protein, 9 aa, Plasmodium falciparum
GNDTKMSSK

SEQ ID NO: 3220881 - protein, 7 aa, Plasmodium falciparum
GNDVDGI

SEQ ID NO: 3220882 - protein, 9 aa, Plasmodium falciparum
GNDVGDVEN

SEQ ID NO: 3220883 - protein, 18 aa, Plasmodium falciparum
GNEAKKCEEKQQTSGIPE

SEQ ID NO: 3220884 - protein, 8 aa, Plasmodium falciparum
GNEEDNNL

SEQ ID NO: 3220885 - protein, 9 aa, Plasmodium falciparum
GNEEKKKEF

SEQ ID NO: 3220886 - protein, 8 aa, Plasmodium falciparum
GNEEQTKE

SEQ ID NO: 3220887 - protein, 7 aa, Plasmodium falciparum
GNEGDKQ

SEQ ID NO: 3220888 - protein, 29 aa, Plasmodium falciparum
GNEGGKKENEEKKKENEGKKKENDCTTCD

SEQ ID NO: 3220889 - protein, 15 aa, Plasmodium falciparum
GNEHDKSNKNKSSSY

SEQ ID NO: 3220890 - protein, 4 aa, Plasmodium falciparum
GNEK

SEQ ID NO: 3220891 - protein, 15 aa, Plasmodium falciparum
GNEKNPNIFPGSPRN

SEQ ID NO: 3220892 - protein, 6 aa, Plasmodium falciparum
GNELTT

SEQ ID NO: 3220893 - protein, 8 aa, Plasmodium falciparum
GNENETED

SEQ ID NO: 3220894 - protein, 7 aa, Plasmodium falciparum
GNENKNI

SEQ ID NO: 3220895 - protein, 12 aa, Plasmodium falciparum
GNENNSNGTACV

SEQ ID NO: 3220896 - protein, 9 aa, Plasmodium falciparum
GNENSASNK

SEQ ID NO: 3220897 - protein, 5 aa, Plasmodium falciparum
GNEQI

SEQ ID NO: 3220898 - protein, 7 aa, Plasmodium falciparum
GNERTCS

SEQ ID NO: 3220899 - protein, 6 aa, Plasmodium falciparum
GNESYE

SEQ ID NO: 3220900 - protein, 33 aa, Plasmodium falciparum
GNETEDNSNSNSSLSSDTEEYNSYSDDNNNVDN

SEQ ID NO: 3220901 - protein, 9 aa, Plasmodium falciparum
GNETHNSAR

SEQ ID NO: 3220902 - protein, 12 aa, Plasmodium falciparum
GNETSKKEKDIR

SEQ ID NO: 3220903 - protein, 6 aa, Plasmodium falciparum
GNETTD

SEQ ID NO: 3220904 - protein, 18 aa, Plasmodium falciparum
GNFKSHNNNSGDNNINNN

SEQ ID NO: 3220905 - protein, 5 aa, Plasmodium falciparum
GNFNP

SEQ ID NO: 3220906 - protein, 4 aa, Plasmodium falciparum
GNFT

SEQ ID NO: 3220907 - protein, 15 aa, Plasmodium falciparum
GNGGNHNNSDDNDIY

SEQ ID NO: 3220908 - protein, 7 aa, Plasmodium falciparum
GNGKGKR

SEQ ID NO: 3220909 - protein, 10 aa, Plasmodium falciparum
GNGKNLSESS

SEQ ID NO: 3220910 - protein, 7 aa, Plasmodium falciparum
GNGNGYG

SEQ ID NO: 3220911 - protein, 7 aa, Plasmodium falciparum
GNGPDAG

SEQ ID NO: 3220912 - protein, 17 aa, Plasmodium falciparum
GNGQGCTKDSSDGECEK

SEQ ID NO: 3220913 - protein, 17 aa, Plasmodium falciparum
GNGQGCTKDSSDGECKK

SEQ ID NO: 3220914 - protein, 4 aa, Plasmodium falciparum
GNGS

SEQ ID NO: 3220915 - protein, 5 aa, Plasmodium falciparum
GNGTE

SEQ ID NO: 3220916 - protein, 6 aa, Plasmodium falciparum
GNGTYN

SEQ ID NO: 3220917 - protein, 7 aa, Plasmodium falciparum
GNGVKND

SEQ ID NO: 3220918 - protein, 5 aa, Plasmodium falciparum
GNGYD

SEQ ID NO: 3220919 - protein, 6 aa, Plasmodium falciparum
GNGYDC

SEQ ID NO: 3220920 - protein, 7 aa, Plasmodium falciparum
GNHEKSD

SEQ ID NO: 3220921 - protein, 9 aa, Plasmodium falciparum
GNHKNVNDS

SEQ ID NO: 3220922 - protein, 12 aa, Plasmodium falciparum
GNHNESSNNKMC

SEQ ID NO: 3220923 - protein, 10 aa, Plasmodium falciparum
GNIDSSNERA

SEQ ID NO: 3220924 - protein, 109 aa, Plasmodium falciparum
GNIESSDEYEQSGCDNYNDNNNDDKYDDHISDDNKNDDDNMSDDNMSDDNMSDDNISDDNISDDNMSDDNISDDNISDDNISDDDNISDDNKNDDDNKNDDDNTSDDNN

SEQ ID NO: 3220925 - protein, 5 aa, Plasmodium falciparum
GNIGQ

SEQ ID NO: 3220926 - protein, 4 aa, Plasmodium falciparum
GNIK

SEQ ID NO: 3220927 - protein, 10 aa, Plasmodium falciparum
GNIKNDKKKK

SEQ ID NO: 3220928 - protein, 5 aa, Plasmodium falciparum
GNIKR

SEQ ID NO: 3220929 - protein, 4 aa, Plasmodium falciparum
GNIN

SEQ ID NO: 3220930 - protein, 6 aa, Plasmodium falciparum
GNINNT

SEQ ID NO: 3220931 - protein, 6 aa, Plasmodium falciparum
GNINTY

SEQ ID NO: 3220932 - protein, 19 aa, Plasmodium falciparum
GNIPTRRNRNSHKKSSNNI

SEQ ID NO: 3220933 - protein, 4 aa, Plasmodium falciparum
GNIR

SEQ ID NO: 3220934 - protein, 8 aa, Plasmodium falciparum
GNISENDR

SEQ ID NO: 3220935 - protein, 14 aa, Plasmodium falciparum
GNISNEKNGYHTYE

SEQ ID NO: 3220936 - protein, 7 aa, Plasmodium falciparum
GNISNNC

SEQ ID NO: 3220937 - protein, 10 aa, Plasmodium falciparum
GNISTETKEQ

SEQ ID NO: 3220938 - protein, 10 aa, Plasmodium falciparum
GNISYKDDDN

SEQ ID NO: 3220939 - protein, 10 aa, Plasmodium falciparum
GNKAQNSISQ

SEQ ID NO: 3220940 - protein, 8 aa, Plasmodium falciparum
GNKDNDNV

SEQ ID NO: 3220941 - protein, 9 aa, Plasmodium falciparum
GNKEDGNRD

SEQ ID NO: 3220942 - protein, 10 aa, Plasmodium falciparum
GNKEETDTQR

SEQ ID NO: 3220943 - protein, 21 aa, Plasmodium falciparum
GNKEGKDNNNKLNENNITKED

SEQ ID NO: 3220944 - protein, 10 aa, Plasmodium falciparum
GNKEGSIHEN

SEQ ID NO: 3220945 - protein, 18 aa, Plasmodium falciparum
GNKEGTPHVPKNPVQTPQ

SEQ ID NO: 3220946 - protein, 11 aa, Plasmodium falciparum
GNKGAADDIQG

SEQ ID NO: 3220947 - protein, 6 aa, Plasmodium falciparum
GNKGTY

SEQ ID NO: 3220948 - protein, 12 aa, Plasmodium falciparum
GNKKCGNQKCEK

SEQ ID NO: 3220949 - protein, 6 aa, Plasmodium falciparum
GNKKEK

SEQ ID NO: 3220950 - protein, 12 aa, Plasmodium falciparum
GNKKEKQKGENK

SEQ ID NO: 3220951 - protein, 10 aa, Plasmodium falciparum
GNKKENYIGN

SEQ ID NO: 3220952 - protein, 50 aa, Plasmodium falciparum
GNKKGEEREEIKDSKEIKEREEIKEREEIKDSKESKERDDNNNNIDDDDD

SEQ ID NO: 3220953 - protein, 9 aa, Plasmodium falciparum
GNKKKKREH

SEQ ID NO: 3220954 - protein, 17 aa, Plasmodium falciparum
GNKKKREKTKKNYKKKK

SEQ ID NO: 3220955 - protein, 17 aa, Plasmodium falciparum
GNKKKSENKREKEKLEE

SEQ ID NO: 3220956 - protein, 22 aa, Plasmodium falciparum
GNKKNVVKKKKSPCNDSPNHSF

SEQ ID NO: 3220957 - protein, 8 aa, Plasmodium falciparum
GNKNEMKK

SEQ ID NO: 3220958 - protein, 8 aa, Plasmodium falciparum
GNKNFGNA

SEQ ID NO: 3220959 - protein, 7 aa, Plasmodium falciparum
GNKNMSP

SEQ ID NO: 3220960 - protein, 5 aa, Plasmodium falciparum
GNKNV

SEQ ID NO: 3220961 - protein, 9 aa, Plasmodium falciparum
GNKRDEENI

SEQ ID NO: 3220962 - protein, 10 aa, Plasmodium falciparum
GNKSGKSNLQ

SEQ ID NO: 3220963 - protein, 7 aa, Plasmodium falciparum
GNKSPLI

SEQ ID NO: 3220964 - protein, 7 aa, Plasmodium falciparum
GNKSQFR

SEQ ID NO: 3220965 - protein, 6 aa, Plasmodium falciparum
GNKTHE

SEQ ID NO: 3220966 - protein, 8 aa, Plasmodium falciparum
GNKTPADA

SEQ ID NO: 3220967 - protein, 4 aa, Plasmodium falciparum
GNKV

SEQ ID NO: 3220968 - protein, 5 aa, Plasmodium falciparum
GNLQK

SEQ ID NO: 3220969 - protein, 8 aa, Plasmodium falciparum
GNLSKKNN

SEQ ID NO: 3220970 - protein, 8 aa, Plasmodium falciparum
GNLSNDRS

SEQ ID NO: 3220971 - protein, 14 aa, Plasmodium falciparum
GNLSTQRKNEISDE

SEQ ID NO: 3220972 - protein, 1096 aa, Plasmodium falciparum
GNMEQQNTGLKNTPSKGQQNTGLKNTPNERQQNTGLKNTPSEGQQNTGLKNTPSEGQQNTGLKNTPNERQQNTGLKNTPSEGQQNTGLKNTPIEGQQNTGLKNTPSEGQQNTGLKNTPNERQQNTGLKNAANKGQQNTGLKNTPSKGQQNTGLKNTPNERQQNTGLKNTPNERQQNTGLKNTPSEGQQNNDLKNTPNERQQNTGLKNTASKGQQNTGLKNAPNERQQNTGLKNTPSEGQQNTGLKNTPSEGQQNTGLKNTPNERQQNTGLKNTASKGQQNTGLKNAPNERQQNTGLKNTPSEGQQNTGLKNSASKGQQNTGLKNTPSEGQQNNDLKNAPNERQQNTGLKNTPSEGQQNTGLKNTPSEGQQNTGLKNTPSGGQQNTGLKNTPNERQQNTGLKNTPSEGQQNTGLKNTPNERQQNTGLKNAANKGQQNTGLKNTPNEGQQNTGLKNTPSEGQQNTGLKNTPSEGQQNTGLKNTPSEGQQNTGLKNTPNERQQNTGLKNAANKGQQNTGLKNTPNEGQQNTGLKNTPSEGQQNTGLKNTPSEGQQNTGLKNTPSEGQQNTGLKNAANKGQQNTGLKNTPSGGQQNTGLKNTPNEGQQNTGLKNTPSEGQQNTGLKNTPSEGQQNTGLKNTPNERQQNTGLKNTPSEGQQNTGLKNTPSEGQPNTGLKNTPNEGQQNTGLKNTPSEGQQNTGLKNAANKGQQNTGLKNTPNEGQQNTGLKNTPSEGQQNTGLKNTPSEGQQNTGLKNTPSEGQQNTGLKNAANKGQQNTGLKNTPNERQQNTGLKNTPNEGQQNTGLKNTPSEGQQNTGLKNTPSEGQQNTGLKNTPSEGQQNTGLKNTPSEGQPNTGLKNTPNEGQQNTGLKNTPSEGQQNTGLKNAANKGQQNTGLKNTPSEGQQNTGLKNTPSEGQQNTGLKNAANKGQQNTGLKNTPSEGQQNTGLKNTPSEGQQNTGLKNAANKGQQNTGLKNTPSEGQPNTGLKNTPNEGQQNTGLKNTPSEGQQNTGLKNTPNEGQQNTGLKNTPSEGQQNTGLKNTPNEGQQNNDLKNKASKGQQNNDLENDGLKHKPNQGQKHTELNNKNLKNKPTDGLKN

SEQ ID NO: 3220973 - protein, 4 aa, Plasmodium falciparum
GNMS

SEQ ID NO: 3220974 - protein, 9 aa, Plasmodium falciparum
GNNDDSTKE

SEQ ID NO: 3220975 - protein, 28 aa, Plasmodium falciparum
GNNEDSEKSLLGRNKNNIKNKDNEYNSV

SEQ ID NO: 3220976 - protein, 9 aa, Plasmodium falciparum
GNNEKIKNS

SEQ ID NO: 3220977 - protein, 45 aa, Plasmodium falciparum
GNNENNIDENNDKINNIDEKNDKINNIDEKNNKINNIDEKNNQLS

SEQ ID NO: 3220978 - protein, 11 aa, Plasmodium falciparum
GNNENTTKGFN

SEQ ID NO: 3220979 - protein, 6 aa, Plasmodium falciparum
GNNGRN

SEQ ID NO: 3220980 - protein, 20 aa, Plasmodium falciparum
GNNINNNNMNNYSNNYYNNS

SEQ ID NO: 3220981 - protein, 9 aa, Plasmodium falciparum
GNNIQESKN

SEQ ID NO: 3220982 - protein, 14 aa, Plasmodium falciparum
GNNISDNKNDLNEK

SEQ ID NO: 3220983 - protein, 5 aa, Plasmodium falciparum
GNNKE

SEQ ID NO: 3220984 - protein, 11 aa, Plasmodium falciparum
GNNKEKKQLEE

SEQ ID NO: 3220985 - protein, 7 aa, Plasmodium falciparum
GNNKNKE

SEQ ID NO: 3220986 - protein, 17 aa, Plasmodium falciparum
GNNKNNMKRNKENDTLK

SEQ ID NO: 3220987 - protein, 22 aa, Plasmodium falciparum
GNNKNNSNNSNSNSSSNNNYNY

SEQ ID NO: 3220988 - protein, 16 aa, Plasmodium falciparum
GNNKRMNNVKSGSHND

SEQ ID NO: 3220989 - protein, 5 aa, Plasmodium falciparum
GNNNI

SEQ ID NO: 3220990 - protein, 6 aa, Plasmodium falciparum
GNNNIS

SEQ ID NO: 3220991 - protein, 5 aa, Plasmodium falciparum
GNNNN

SEQ ID NO: 3220992 - protein, 32 aa, Plasmodium falciparum
GNNNNKICTSTKDNDDDYNNGNKNDDSNNNIN

SEQ ID NO: 3220993 - protein, 16 aa, Plasmodium falciparum
GNNNNKNNKNNRHSRG

SEQ ID NO: 3220994 - protein, 9 aa, Plasmodium falciparum
GNNNNMDNS

SEQ ID NO: 3220995 - protein, 8 aa, Plasmodium falciparum
GNNNNNNF

SEQ ID NO: 3220996 - protein, 46 aa, Plasmodium falciparum
GNNNNNNNNNYDNNDNYDNNNNNNYDNNNNNYDNNNNNYDNNNNRC

SEQ ID NO: 3220997 - protein, 17 aa, Plasmodium falciparum
GNNNNNNSNSSSSNNYY

SEQ ID NO: 3220998 - protein, 15 aa, Plasmodium falciparum
GNNNNSNTHQDTEKN

SEQ ID NO: 3220999 - protein, 8 aa, Plasmodium falciparum
GNNNNTNM

SEQ ID NO: 3221000 - protein, 8 aa, Plasmodium falciparum
GNNNSNKK

SEQ ID NO: 3221001 - protein, 121 aa, Plasmodium falciparum
GNNNTTTNTSTTEHNNNINTNTNSTDNSNTNTNLTDNTSTTKKLTDNINTTQNLTTSTNTTTVSTDNNNINTKPIDNNNTDIKSTDNYNTGTKETDNKNTDIKATDNNNITTTTDNTNTNV

SEQ ID NO: 3221002 - protein, 36 aa, Plasmodium falciparum
GNNNTTTNTSTTEHNNNINTNTNSTENTSATKKVTE

SEQ ID NO: 3221003 - protein, 8 aa, Plasmodium falciparum
GNNPFDEG

SEQ ID NO: 3221004 - protein, 21 aa, Plasmodium falciparum
GNNPQGFEKKEREEKEQEKTY

SEQ ID NO: 3221005 - protein, 6 aa, Plasmodium falciparum
GNNQSI

SEQ ID NO: 3221006 - protein, 5 aa, Plasmodium falciparum
GNNQY

SEQ ID NO: 3221007 - protein, 5 aa, Plasmodium falciparum
GNNSM

SEQ ID NO: 3221008 - protein, 8 aa, Plasmodium falciparum
GNNSNIPD

SEQ ID NO: 3221009 - protein, 14 aa, Plasmodium falciparum
GNNSNNNNDNSGEI

SEQ ID NO: 3221010 - protein, 4 aa, Plasmodium falciparum
GNNT

SEQ ID NO: 3221011 - protein, 7 aa, Plasmodium falciparum
GNNTDTS

SEQ ID NO: 3221012 - protein, 5 aa, Plasmodium falciparum
GNNTE

SEQ ID NO: 3221013 - protein, 7 aa, Plasmodium falciparum
GNNTNQN

SEQ ID NO: 3221014 - protein, 12 aa, Plasmodium falciparum
GNNTTDKNMDDE

SEQ ID NO: 3221015 - protein, 12 aa, Plasmodium falciparum
GNNTYNNNDNTF

SEQ ID NO: 3221016 - protein, 10 aa, Plasmodium falciparum
GNNVDENNTT

SEQ ID NO: 3221017 - protein, 5 aa, Plasmodium falciparum
GNNWK

SEQ ID NO: 3221018 - protein, 15 aa, Plasmodium falciparum
GNNYNTYDSEIEDYN

SEQ ID NO: 3221019 - protein, 9 aa, Plasmodium falciparum
GNPDENTED

SEQ ID NO: 3221020 - protein, 5 aa, Plasmodium falciparum
GNPMK

SEQ ID NO: 3221021 - protein, 5 aa, Plasmodium falciparum
GNPNL

SEQ ID NO: 3221022 - protein, 5 aa, Plasmodium falciparum
GNPPQ

SEQ ID NO: 3221023 - protein, 14 aa, Plasmodium falciparum
GNPQEKGKRDELDK

SEQ ID NO: 3221024 - protein, 9 aa, Plasmodium falciparum
GNPQESAQR

SEQ ID NO: 3221025 - protein, 8 aa, Plasmodium falciparum
GNPQESTQ

SEQ ID NO: 3221026 - protein, 17 aa, Plasmodium falciparum
GNPRMQENSEKKNSYSS

SEQ ID NO: 3221027 - protein, 7 aa, Plasmodium falciparum
GNPSHAK

SEQ ID NO: 3221028 - protein, 16 aa, Plasmodium falciparum
GNQEDFKNKGESGEGD

SEQ ID NO: 3221029 - protein, 39 aa, Plasmodium falciparum
GNQENNTNNDKNEGMNHRNNNNNNNNYNNNYNNNNNYNN

SEQ ID NO: 3221030 - protein, 7 aa, Plasmodium falciparum
GNQNIKD

SEQ ID NO: 3221031 - protein, 8 aa, Plasmodium falciparum
GNQSNKYK

SEQ ID NO: 3221032 - protein, 7 aa, Plasmodium falciparum
GNRDNIK

SEQ ID NO: 3221033 - protein, 5 aa, Plasmodium falciparum
GNREE

SEQ ID NO: 3221034 - protein, 13 aa, Plasmodium falciparum
GNRKEKEKEKLQK

SEQ ID NO: 3221035 - protein, 9 aa, Plasmodium falciparum
GNRNNLNNR

SEQ ID NO: 3221036 - protein, 4 aa, Plasmodium falciparum
GNSA

SEQ ID NO: 3221037 - protein, 9 aa, Plasmodium falciparum
GNSCTSPTG

SEQ ID NO: 3221038 - protein, 11 aa, Plasmodium falciparum
GNSDSNNTNDS

SEQ ID NO: 3221039 - protein, 7 aa, Plasmodium falciparum
GNSGKYE

SEQ ID NO: 3221040 - protein, 4 aa, Plasmodium falciparum
GNSI

SEQ ID NO: 3221041 - protein, 8 aa, Plasmodium falciparum
GNSISSYA

SEQ ID NO: 3221042 - protein, 14 aa, Plasmodium falciparum
GNSKEKEKRDELET

SEQ ID NO: 3221043 - protein, 5 aa, Plasmodium falciparum
GNSKI

SEQ ID NO: 3221044 - protein, 6 aa, Plasmodium falciparum
GNSKLN

SEQ ID NO: 3221045 - protein, 4 aa, Plasmodium falciparum
GNSN

SEQ ID NO: 3221046 - protein, 32 aa, Plasmodium falciparum
GNSNERCDNNNRCDNNNRCDNNNRCDGDKSKY

SEQ ID NO: 3221047 - protein, 15 aa, Plasmodium falciparum
GNSPKGKKGIKGISK

SEQ ID NO: 3221048 - protein, 9 aa, Plasmodium falciparum
GNSQKRNNG

SEQ ID NO: 3221049 - protein, 11 aa, Plasmodium falciparum
GNSREKEKLQT

SEQ ID NO: 3221050 - protein, 19 aa, Plasmodium falciparum
GNSSRRRGAGGATTTNYEE

SEQ ID NO: 3221051 - protein, 5 aa, Plasmodium falciparum
GNSSY

SEQ ID NO: 3221052 - protein, 5 aa, Plasmodium falciparum
GNSTL

SEQ ID NO: 3221053 - protein, 8 aa, Plasmodium falciparum
GNSTNQKK

SEQ ID NO: 3221054 - protein, 6 aa, Plasmodium falciparum
GNTEFK

SEQ ID NO: 3221055 - protein, 6 aa, Plasmodium falciparum
GNTESV

SEQ ID NO: 3221056 - protein, 14 aa, Plasmodium falciparum
GNTGATSQNKTGGI

SEQ ID NO: 3221057 - protein, 8 aa, Plasmodium falciparum
GNTKINDD

SEQ ID NO: 3221058 - protein, 22 aa, Plasmodium falciparum
GNTKRSDDMNNAENKKKKNEKD

SEQ ID NO: 3221059 - protein, 19 aa, Plasmodium falciparum
GNTLTESVDDNKNLEEAED

SEQ ID NO: 3221060 - protein, 10 aa, Plasmodium falciparum
GNTPSDINNS

SEQ ID NO: 3221061 - protein, 5 aa, Plasmodium falciparum
GNTQV

SEQ ID NO: 3221062 - protein, 35 aa, Plasmodium falciparum
GNTRNTNAQNYQNNMDNRNADCNNENQTMNEQNEG

SEQ ID NO: 3221063 - protein, 13 aa, Plasmodium falciparum
GNTRSYNDSSPFT

SEQ ID NO: 3221064 - protein, 6 aa, Plasmodium falciparum
GNTTDI

SEQ ID NO: 3221065 - protein, 14 aa, Plasmodium falciparum
GNTTGHAQDKCENG

SEQ ID NO: 3221066 - protein, 6 aa, Plasmodium falciparum
GNTYDN

SEQ ID NO: 3221067 - protein, 6 aa, Plasmodium falciparum
GNTYNN

SEQ ID NO: 3221068 - protein, 15 aa, Plasmodium falciparum
GNTYNQERDKVTNPY

SEQ ID NO: 3221069 - protein, 10 aa, Plasmodium falciparum
GNVDTDNNIK

SEQ ID NO: 3221070 - protein, 55 aa, Plasmodium falciparum
GNVEQKQNGKSPERASHESEEEEKKKKKNINKQKDDLASSEKDKETNKKKDGIDK

SEQ ID NO: 3221071 - protein, 4 aa, Plasmodium falciparum
GNVF

SEQ ID NO: 3221072 - protein, 4 aa, Plasmodium falciparum
GNVK

SEQ ID NO: 3221073 - protein, 5 aa, Plasmodium falciparum
GNVKK

SEQ ID NO: 3221074 - protein, 19 aa, Plasmodium falciparum
GNVNSETNEMTNNSGTQNI

SEQ ID NO: 3221075 - protein, 13 aa, Plasmodium falciparum
GNVNVSSNQYVNS

SEQ ID NO: 3221076 - protein, 13 aa, Plasmodium falciparum
GNVSGKGEDVSRF

SEQ ID NO: 3221077 - protein, 5 aa, Plasmodium falciparum
GNVST

SEQ ID NO: 3221078 - protein, 13 aa, Plasmodium falciparum
GNVTKANTKGFSV

SEQ ID NO: 3221079 - protein, 14 aa, Plasmodium falciparum
GNVTNGSNQKIVNN

SEQ ID NO: 3221080 - protein, 8 aa, Plasmodium falciparum
GNVTSNLT

SEQ ID NO: 3221081 - protein, 9 aa, Plasmodium falciparum
GNVTTTGGA

SEQ ID NO: 3221082 - protein, 4 aa, Plasmodium falciparum
GNYD

SEQ ID NO: 3221083 - protein, 9 aa, Plasmodium falciparum
GNYDNSDNI

SEQ ID NO: 3221084 - protein, 64 aa, Plasmodium falciparum
GNYENVEEGNHVDDADGDYDGEDDVEDDDDDDDVEDDDDEDDGEDDDDDEDDDEDDDDDDEDDD

SEQ ID NO: 3221085 - protein, 65 aa, Plasmodium falciparum
GNYEYKDDNNKDDNNKDDNNKDGTNKDDNNKDGTNKDDNNTDDNNKDGNNKDDNNINNNNNIDDN

SEQ ID NO: 3221086 - protein, 5 aa, Plasmodium falciparum
GNYHY

SEQ ID NO: 3221087 - protein, 4 aa, Plasmodium falciparum
GNYL

SEQ ID NO: 3221088 - protein, 4 aa, Plasmodium falciparum
GNYN

SEQ ID NO: 3221089 - protein, 5 aa, Plasmodium falciparum
GNYNF

SEQ ID NO: 3221090 - protein, 14 aa, Plasmodium falciparum
GNYNSNNNKKKNIH

SEQ ID NO: 3221091 - protein, 13 aa, Plasmodium falciparum
GNYNYEKKKRTEP

SEQ ID NO: 3221092 - protein, 21 aa, Plasmodium falciparum
GNYTREANYNYNNNNNTTNLS

SEQ ID NO: 3221093 - protein, 5 aa, Plasmodium falciparum
GPAAK

SEQ ID NO: 3221094 - protein, 12 aa, Plasmodium falciparum
GPAGIGKTTTAK

SEQ ID NO: 3221095 - protein, 5 aa, Plasmodium falciparum
GPANS

SEQ ID NO: 3221096 - protein, 15 aa, Plasmodium falciparum
GPAPAPASASTTYGS

SEQ ID NO: 3221097 - protein, 4 aa, Plasmodium falciparum
GPAT

SEQ ID NO: 3221098 - protein, 9 aa, Plasmodium falciparum
GPCNNTSVP

SEQ ID NO: 3221099 - protein, 4 aa, Plasmodium falciparum
GPCP

SEQ ID NO: 3221100 - protein, 19 aa, Plasmodium falciparum
GPCSSIKKNKTNLDTSKDT

SEQ ID NO: 3221101 - protein, 13 aa, Plasmodium falciparum
GPDGKITESNKGQ

SEQ ID NO: 3221102 - protein, 4 aa, Plasmodium falciparum
GPDY

SEQ ID NO: 3221103 - protein, 8 aa, Plasmodium falciparum
GPEGSVTE

SEQ ID NO: 3221104 - protein, 7 aa, Plasmodium falciparum
GPEMKSP

SEQ ID NO: 3221105 - protein, 4 aa, Plasmodium falciparum
GPFS

SEQ ID NO: 3221106 - protein, 11 aa, Plasmodium falciparum
GPFSRKSNKVD

SEQ ID NO: 3221107 - protein, 9 aa, Plasmodium falciparum
GPGSGKGTQ

SEQ ID NO: 3221108 - protein, 9 aa, Plasmodium falciparum
GPGSTIPKE

SEQ ID NO: 3221109 - protein, 5 aa, Plasmodium falciparum
GPHKK

SEQ ID NO: 3221110 - protein, 10 aa, Plasmodium falciparum
GPISDNAGGI

SEQ ID NO: 3221111 - protein, 36 aa, Plasmodium falciparum
GPIVNQQENVKETIQEDKNVEEGDKIKNDDKNVTPC

SEQ ID NO: 3221112 - protein, 14 aa, Plasmodium falciparum
GPKTANHKPPRGIT

SEQ ID NO: 3221113 - protein, 9 aa, Plasmodium falciparum
GPKYKNKKN

SEQ ID NO: 3221114 - protein, 4 aa, Plasmodium falciparum
GPLG

SEQ ID NO: 3221115 - protein, 7 aa, Plasmodium falciparum
GPMKKDT

SEQ ID NO: 3221116 - protein, 15 aa, Plasmodium falciparum
GPNNCNEQEQSKNED

SEQ ID NO: 3221117 - protein, 9 aa, Plasmodium falciparum
GPNSNNSIY

SEQ ID NO: 3221118 - protein, 6 aa, Plasmodium falciparum
GPNSQL

SEQ ID NO: 3221119 - protein, 8 aa, Plasmodium falciparum
GPPGSGKT

SEQ ID NO: 3221120 - protein, 5 aa, Plasmodium falciparum
GPPRR

SEQ ID NO: 3221121 - protein, 13 aa, Plasmodium falciparum
GPPVPGAGANKPI

SEQ ID NO: 3221122 - protein, 6 aa, Plasmodium falciparum
GPPYAN

SEQ ID NO: 3221123 - protein, 5 aa, Plasmodium falciparum
GPPYN

SEQ ID NO: 3221124 - protein, 6 aa, Plasmodium falciparum
GPRISP

SEQ ID NO: 3221125 - protein, 32 aa, Plasmodium falciparum
GPSREENYSTESKIEQNDKNNNNNNNNNINNN

SEQ ID NO: 3221126 - protein, 5 aa, Plasmodium falciparum
GPSTC

SEQ ID NO: 3221127 - protein, 4 aa, Plasmodium falciparum
GPYG

SEQ ID NO: 3221128 - protein, 5 aa, Plasmodium falciparum
GPYME

SEQ ID NO: 3221129 - protein, 19 aa, Plasmodium falciparum
GQAEGPAKVAADAARQTVT

SEQ ID NO: 3221130 - protein, 10 aa, Plasmodium falciparum
GQAGSTSEEI

SEQ ID NO: 3221131 - protein, 13 aa, Plasmodium falciparum
GQAPPEKEIRQES

SEQ ID NO: 3221132 - protein, 4 aa, Plasmodium falciparum
GQAV

SEQ ID NO: 3221133 - protein, 10 aa, Plasmodium falciparum
GQAYSSSLKD

SEQ ID NO: 3221134 - protein, 19 aa, Plasmodium falciparum
GQCTDNKINGNDDETGGTC

SEQ ID NO: 3221135 - protein, 7 aa, Plasmodium falciparum
GQDDSFD

SEQ ID NO: 3221136 - protein, 5 aa, Plasmodium falciparum
GQDGT

SEQ ID NO: 3221137 - protein, 8 aa, Plasmodium falciparum
GQDITSNK

SEQ ID NO: 3221138 - protein, 9 aa, Plasmodium falciparum
GQDNKSELR

SEQ ID NO: 3221139 - protein, 13 aa, Plasmodium falciparum
GQDYPTNNQTNYM

SEQ ID NO: 3221140 - protein, 10 aa, Plasmodium falciparum
GQEDKHESNP

SEQ ID NO: 3221141 - protein, 10 aa, Plasmodium falciparum
GQEEKEDKEK

SEQ ID NO: 3221142 - protein, 42 aa, Plasmodium falciparum
GQEESAGNSVNYKDNPKRSNFSSENDHKKNIQEYNSRDTKRV

SEQ ID NO: 3221143 - protein, 68 aa, Plasmodium falciparum
GQEGNNEKKTKNDDKKKKKSDDEKKKKSDDEKKKKSDDEKKKKSDDEKKKKSDDKKNDDDNNNNSDNN

SEQ ID NO: 3221144 - protein, 7 aa, Plasmodium falciparum
GQEGSMN

SEQ ID NO: 3221145 - protein, 6 aa, Plasmodium falciparum
GQEGVQ

SEQ ID NO: 3221146 - protein, 9 aa, Plasmodium falciparum
GQEKNGEDN

SEQ ID NO: 3221147 - protein, 10 aa, Plasmodium falciparum
GQEKPKEFSK

SEQ ID NO: 3221148 - protein, 5 aa, Plasmodium falciparum
GQEKQ

SEQ ID NO: 3221149 - protein, 5 aa, Plasmodium falciparum
GQESN

SEQ ID NO: 3221150 - protein, 40 aa, Plasmodium falciparum
GQFDESRSQGKQRRKKGKGKGRKKGHNKLEGKSSPNVEGT

SEQ ID NO: 3221151 - protein, 20 aa, Plasmodium falciparum
GQFLDSSTKNSYKRDITHNS

SEQ ID NO: 3221152 - protein, 6 aa, Plasmodium falciparum
GQGGTP

SEQ ID NO: 3221153 - protein, 16 aa, Plasmodium falciparum
GQGQEEKYSEEKNQDL

SEQ ID NO: 3221154 - protein, 14 aa, Plasmodium falciparum
GQGRGGRKQKTPQC

SEQ ID NO: 3221155 - protein, 60 aa, Plasmodium falciparum
GQINSTQIKETNNKINNNNNNNNNNNNNNNNNNNNGNNTSVDNKDSKKTDKSNNTNDAEQ

SEQ ID NO: 3221156 - protein, 4 aa, Plasmodium falciparum
GQIR

SEQ ID NO: 3221157 - protein, 11 aa, Plasmodium falciparum
GQKIREEEKNV

SEQ ID NO: 3221158 - protein, 4 aa, Plasmodium falciparum
GQKL

SEQ ID NO: 3221159 - protein, 7 aa, Plasmodium falciparum
GQKLSDN

SEQ ID NO: 3221160 - protein, 6 aa, Plasmodium falciparum
GQLGEP

SEQ ID NO: 3221161 - protein, 8 aa, Plasmodium falciparum
GQNDENKI

SEQ ID NO: 3221162 - protein, 12 aa, Plasmodium falciparum
GQNENKENTPKM

SEQ ID NO: 3221163 - protein, 13 aa, Plasmodium falciparum
GQNPYNDYNPSSK

SEQ ID NO: 3221164 - protein, 4 aa, Plasmodium falciparum
GQPD

SEQ ID NO: 3221165 - protein, 4 aa, Plasmodium falciparum
GQPL

SEQ ID NO: 3221166 - protein, 6 aa, Plasmodium falciparum
GQPNKV

SEQ ID NO: 3221167 - protein, 5 aa, Plasmodium falciparum
GQPYP

SEQ ID NO: 3221168 - protein, 7 aa, Plasmodium falciparum
GQQESVT

SEQ ID NO: 3221169 - protein, 4 aa, Plasmodium falciparum
GQQG

SEQ ID NO: 3221170 - protein, 7 aa, Plasmodium falciparum
GQQNSYP

SEQ ID NO: 3221171 - protein, 9 aa, Plasmodium falciparum
GQQQNNTSP

SEQ ID NO: 3221172 - protein, 12 aa, Plasmodium falciparum
GQRKEKGVSSYK

SEQ ID NO: 3221173 - protein, 5 aa, Plasmodium falciparum
GQRKL

SEQ ID NO: 3221174 - protein, 7 aa, Plasmodium falciparum
GQSLEKE

SEQ ID NO: 3221175 - protein, 21 aa, Plasmodium falciparum
GQSTDTDHSKKNQEIKETKEI

SEQ ID NO: 3221176 - protein, 31 aa, Plasmodium falciparum
GQSYSQQYEHPYNQTNGQSYPQQHEHPYNQP

SEQ ID NO: 3221177 - protein, 7 aa, Plasmodium falciparum
GQTCEKK

SEQ ID NO: 3221178 - protein, 4 aa, Plasmodium falciparum
GQVA

SEQ ID NO: 3221179 - protein, 13 aa, Plasmodium falciparum
GQVRRSGGQGSET

SEQ ID NO: 3221180 - protein, 7 aa, Plasmodium falciparum
GQVSLPT

SEQ ID NO: 3221181 - protein, 7 aa, Plasmodium falciparum
GRDRTGE

SEQ ID NO: 3221182 - protein, 17 aa, Plasmodium falciparum
GREIENEENREYNNNDI

SEQ ID NO: 3221183 - protein, 4 aa, Plasmodium falciparum
GREN

SEQ ID NO: 3221184 - protein, 16 aa, Plasmodium falciparum
GRENTNVPNVRNDNHN

SEQ ID NO: 3221185 - protein, 4 aa, Plasmodium falciparum
GRET

SEQ ID NO: 3221186 - protein, 5 aa, Plasmodium falciparum
GRGND

SEQ ID NO: 3221187 - protein, 55 aa, Plasmodium falciparum
GRIDNGEDDEESDEEDFEEEELENDDAGGGSDVGEEEDVSNHQEDKGPQKEDTPQ

SEQ ID NO: 3221188 - protein, 4 aa, Plasmodium falciparum
GRIG

SEQ ID NO: 3221189 - protein, 9 aa, Plasmodium falciparum
GRIGNTEMD

SEQ ID NO: 3221190 - protein, 6 aa, Plasmodium falciparum
GRISNT

SEQ ID NO: 3221191 - protein, 12 aa, Plasmodium falciparum
GRKKSKGTSQNI

SEQ ID NO: 3221192 - protein, 6 aa, Plasmodium falciparum
GRKKSV

SEQ ID NO: 3221193 - protein, 5 aa, Plasmodium falciparum
GRKNE

SEQ ID NO: 3221194 - protein, 5 aa, Plasmodium falciparum
GRKSS

SEQ ID NO: 3221195 - protein, 13 aa, Plasmodium falciparum
GRKTGIPSHSQTT

SEQ ID NO: 3221196 - protein, 10 aa, Plasmodium falciparum
GRMDNSVNSN

SEQ ID NO: 3221197 - protein, 11 aa, Plasmodium falciparum
GRNEGAPPTNL

SEQ ID NO: 3221198 - protein, 10 aa, Plasmodium falciparum
GRNGSGKSTL

SEQ ID NO: 3221199 - protein, 4 aa, Plasmodium falciparum
GRNK

SEQ ID NO: 3221200 - protein, 6 aa, Plasmodium falciparum
GRNLTP

SEQ ID NO: 3221201 - protein, 7 aa, Plasmodium falciparum
GRNNEQN

SEQ ID NO: 3221202 - protein, 8 aa, Plasmodium falciparum
GRNNIQEN

SEQ ID NO: 3221203 - protein, 9 aa, Plasmodium falciparum
GRNPNTQNL

SEQ ID NO: 3221204 - protein, 6 aa, Plasmodium falciparum
GRNRNR

SEQ ID NO: 3221205 - protein, 9 aa, Plasmodium falciparum
GRNTTGGVE

SEQ ID NO: 3221206 - protein, 17 aa, Plasmodium falciparum
GRPFDKSDIDKKVIYTN

SEQ ID NO: 3221207 - protein, 4 aa, Plasmodium falciparum
GRPV

SEQ ID NO: 3221208 - protein, 22 aa, Plasmodium falciparum
GRRARSGGNDQCTPVNGNGNTW

SEQ ID NO: 3221209 - protein, 17 aa, Plasmodium falciparum
GRRRRRYHDENGNEEEN

SEQ ID NO: 3221210 - protein, 10 aa, Plasmodium falciparum
GRSETGSGKT

SEQ ID NO: 3221211 - protein, 18 aa, Plasmodium falciparum
GRSGGRNGCNVKDNEDKW

SEQ ID NO: 3221212 - protein, 4 aa, Plasmodium falciparum
GRSI

SEQ ID NO: 3221213 - protein, 8 aa, Plasmodium falciparum
GRSIGGKS

SEQ ID NO: 3221214 - protein, 12 aa, Plasmodium falciparum
GRSKKENDKNND

SEQ ID NO: 3221215 - protein, 7 aa, Plasmodium falciparum
GRSRDNT

SEQ ID NO: 3221216 - protein, 5 aa, Plasmodium falciparum
GRSSE

SEQ ID NO: 3221217 - protein, 8 aa, Plasmodium falciparum
GRSSLSTN

SEQ ID NO: 3221218 - protein, 9 aa, Plasmodium falciparum
GRSSYDESK

SEQ ID NO: 3221219 - protein, 16 aa, Plasmodium falciparum
GRSSYKKVNYSEKKYK

SEQ ID NO: 3221220 - protein, 12 aa, Plasmodium falciparum
GRTGRANKKGTS

SEQ ID NO: 3221221 - protein, 4 aa, Plasmodium falciparum
GRTM

SEQ ID NO: 3221222 - protein, 7 aa, Plasmodium falciparum
GRTPPTV

SEQ ID NO: 3221223 - protein, 5 aa, Plasmodium falciparum
GRTSM

SEQ ID NO: 3221224 - protein, 6 aa, Plasmodium falciparum
GRTTGQ

SEQ ID NO: 3221225 - protein, 9 aa, Plasmodium falciparum
GRVKTSNNL

SEQ ID NO: 3221226 - protein, 18 aa, Plasmodium falciparum
GRYPNDDDESDDSSSCGC

SEQ ID NO: 3221227 - protein, 18 aa, Plasmodium falciparum
GRYPNDDDKSDDSSSCEC

SEQ ID NO: 3221228 - protein, 19 aa, Plasmodium falciparum
GRYPNDDDKTNEKSSSCEC

SEQ ID NO: 3221229 - protein, 18 aa, Plasmodium falciparum
GRYQNGDDVSDDSSSCDC

SEQ ID NO: 3221230 - protein, 8 aa, Plasmodium falciparum
GSAAYNEK

SEQ ID NO: 3221231 - protein, 9 aa, Plasmodium falciparum
GSALTGSFS

SEQ ID NO: 3221232 - protein, 8 aa, Plasmodium falciparum
GSAVGGSS

SEQ ID NO: 3221233 - protein, 6 aa, Plasmodium falciparum
GSCPNY

SEQ ID NO: 3221234 - protein, 5 aa, Plasmodium falciparum
GSDAY

SEQ ID NO: 3221235 - protein, 13 aa, Plasmodium falciparum
GSDDMGRTYDNDT

SEQ ID NO: 3221236 - protein, 8 aa, Plasmodium falciparum
GSDDRNKE

SEQ ID NO: 3221237 - protein, 19 aa, Plasmodium falciparum
GSDEALTDYESSSDENMNT

SEQ ID NO: 3221238 - protein, 8 aa, Plasmodium falciparum
GSDEDDTC

SEQ ID NO: 3221239 - protein, 5 aa, Plasmodium falciparum
GSDEI

SEQ ID NO: 3221240 - protein, 7 aa, Plasmodium falciparum
GSDESTR

SEQ ID NO: 3221241 - protein, 5 aa, Plasmodium falciparum
GSDEV

SEQ ID NO: 3221242 - protein, 34 aa, Plasmodium falciparum
GSDGNYEDGNYEDGNYEDGNYEDGNYEDGNYEDD

SEQ ID NO: 3221243 - protein, 19 aa, Plasmodium falciparum
GSDKEDEEEKEKNNKKKNV

SEQ ID NO: 3221244 - protein, 6 aa, Plasmodium falciparum
GSDNGT

SEQ ID NO: 3221245 - protein, 6 aa, Plasmodium falciparum
GSDPGT

SEQ ID NO: 3221246 - protein, 5 aa, Plasmodium falciparum
GSDPT

SEQ ID NO: 3221247 - protein, 7 aa, Plasmodium falciparum
GSDWGEG

SEQ ID NO: 3221248 - protein, 24 aa, Plasmodium falciparum
GSEDESVEDNEEEHSGEANEEELS

SEQ ID NO: 3221249 - protein, 5 aa, Plasmodium falciparum
GSEEK

SEQ ID NO: 3221250 - protein, 5 aa, Plasmodium falciparum
GSEEM

SEQ ID NO: 3221251 - protein, 6 aa, Plasmodium falciparum
GSEFNP

SEQ ID NO: 3221252 - protein, 6 aa, Plasmodium falciparum
GSEKHE

SEQ ID NO: 3221253 - protein, 5 aa, Plasmodium falciparum
GSERL

SEQ ID NO: 3221254 - protein, 40 aa, Plasmodium falciparum
GSFSYAPPPYQGVENSSNKNQKYLTQRKERQQIVATKSPF

SEQ ID NO: 3221255 - protein, 7 aa, Plasmodium falciparum
GSGAEKP

SEQ ID NO: 3221256 - protein, 6 aa, Plasmodium falciparum
GSGDDK

SEQ ID NO: 3221257 - protein, 6 aa, Plasmodium falciparum
GSGEWA

SEQ ID NO: 3221258 - protein, 4 aa, Plasmodium falciparum
GSGG

SEQ ID NO: 3221259 - protein, 17 aa, Plasmodium falciparum
GSGIKDKRKNQSKYTDK

SEQ ID NO: 3221260 - protein, 6 aa, Plasmodium falciparum
GSGKQS

SEQ ID NO: 3221261 - protein, 5 aa, Plasmodium falciparum
GSGKS

SEQ ID NO: 3221262 - protein, 6 aa, Plasmodium falciparum
GSGKTT

SEQ ID NO: 3221263 - protein, 8 aa, Plasmodium falciparum
GSGNLNDA

SEQ ID NO: 3221264 - protein, 10 aa, Plasmodium falciparum
GSGPAGLTAA

SEQ ID NO: 3221265 - protein, 8 aa, Plasmodium falciparum
GSGPATDN

SEQ ID NO: 3221266 - protein, 9 aa, Plasmodium falciparum
GSGREDKDA

SEQ ID NO: 3221267 - protein, 49 aa, Plasmodium falciparum
GSGVAARGHPCGNESVSEKRFSKERVDEYDEKKIKDNKGNRGNNEGECA

SEQ ID NO: 3221268 - protein, 25 aa, Plasmodium falciparum
GSHKYKDKKNQQIYNEKNNETRQKQ

SEQ ID NO: 3221269 - protein, 4 aa, Plasmodium falciparum
GSHM

SEQ ID NO: 3221270 - protein, 13 aa, Plasmodium falciparum
GSIASSSHDKENE

SEQ ID NO: 3221271 - protein, 8 aa, Plasmodium falciparum
GSIPDTEE

SEQ ID NO: 3221272 - protein, 6 aa, Plasmodium falciparum
GSITED

SEQ ID NO: 3221273 - protein, 11 aa, Plasmodium falciparum
GSKASGTENKE

SEQ ID NO: 3221274 - protein, 10 aa, Plasmodium falciparum
GSKASKKNLH

SEQ ID NO: 3221275 - protein, 13 aa, Plasmodium falciparum
GSKDDNTKSSTYN

SEQ ID NO: 3221276 - protein, 11 aa, Plasmodium falciparum
GSKDEKSSTYN

SEQ ID NO: 3221277 - protein, 4 aa, Plasmodium falciparum
GSKH

SEQ ID NO: 3221278 - protein, 6 aa, Plasmodium falciparum
GSKKNK

SEQ ID NO: 3221279 - protein, 13 aa, Plasmodium falciparum
GSKMSGTKSNVIE

SEQ ID NO: 3221280 - protein, 10 aa, Plasmodium falciparum
GSKNKDKDKH

SEQ ID NO: 3221281 - protein, 12 aa, Plasmodium falciparum
GSKNNMGGKGYQ

SEQ ID NO: 3221282 - protein, 8 aa, Plasmodium falciparum
GSKNRKNI

SEQ ID NO: 3221283 - protein, 9 aa, Plasmodium falciparum
GSKRRISQR

SEQ ID NO: 3221284 - protein, 9 aa, Plasmodium falciparum
GSKSKMEYS

SEQ ID NO: 3221285 - protein, 7 aa, Plasmodium falciparum
GSKYGSY

SEQ ID NO: 3221286 - protein, 6 aa, Plasmodium falciparum
GSKYTK

SEQ ID NO: 3221287 - protein, 7 aa, Plasmodium falciparum
GSLQGSI

SEQ ID NO: 3221288 - protein, 8 aa, Plasmodium falciparum
GSMTGSPK

SEQ ID NO: 3221289 - protein, 10 aa, Plasmodium falciparum
GSNASKDNIS

SEQ ID NO: 3221290 - protein, 14 aa, Plasmodium falciparum
GSNASKLSGGQKQR

SEQ ID NO: 3221291 - protein, 19 aa, Plasmodium falciparum
GSNDTTSGSKDTSSGSNDN

SEQ ID NO: 3221292 - protein, 7 aa, Plasmodium falciparum
GSNEDDE

SEQ ID NO: 3221293 - protein, 5 aa, Plasmodium falciparum
GSNEM

SEQ ID NO: 3221294 - protein, 9 aa, Plasmodium falciparum
GSNGNSNNM

SEQ ID NO: 3221295 - protein, 5 aa, Plasmodium falciparum
GSNGT

SEQ ID NO: 3221296 - protein, 5 aa, Plasmodium falciparum
GSNIN

SEQ ID NO: 3221297 - protein, 8 aa, Plasmodium falciparum
GSNIPVTN

SEQ ID NO: 3221298 - protein, 4 aa, Plasmodium falciparum
GSNK

SEQ ID NO: 3221299 - protein, 9 aa, Plasmodium falciparum
GSNNDGNNS

SEQ ID NO: 3221300 - protein, 9 aa, Plasmodium falciparum
GSNNETGKE

SEQ ID NO: 3221301 - protein, 16 aa, Plasmodium falciparum
GSNNIKNDDDNNNNNM

SEQ ID NO: 3221302 - protein, 17 aa, Plasmodium falciparum
GSNNLSNNKMNNQGGNH

SEQ ID NO: 3221303 - protein, 5 aa, Plasmodium falciparum
GSNNV

SEQ ID NO: 3221304 - protein, 20 aa, Plasmodium falciparum
GSNQNKMNLSNDEKDHWGGN

SEQ ID NO: 3221305 - protein, 5 aa, Plasmodium falciparum
GSNTN

SEQ ID NO: 3221306 - protein, 8 aa, Plasmodium falciparum
GSNTSTNV

SEQ ID NO: 3221307 - protein, 14 aa, Plasmodium falciparum
GSNVTSKKDNMKNV

SEQ ID NO: 3221308 - protein, 6 aa, Plasmodium falciparum
GSPEKI

SEQ ID NO: 3221309 - protein, 6 aa, Plasmodium falciparum
GSPGVG

SEQ ID NO: 3221310 - protein, 17 aa, Plasmodium falciparum
GSPHKNPSITPKFPPNT

SEQ ID NO: 3221311 - protein, 7 aa, Plasmodium falciparum
GSPLSSS

SEQ ID NO: 3221312 - protein, 24 aa, Plasmodium falciparum
GSPNDETHKNKQEDRTKHNGQNNV

SEQ ID NO: 3221313 - protein, 20 aa, Plasmodium falciparum
GSPSSTANGKSNASGYKSPE

SEQ ID NO: 3221314 - protein, 17 aa, Plasmodium falciparum
GSQEEEQKENDVSHRNN

SEQ ID NO: 3221315 - protein, 6 aa, Plasmodium falciparum
GSQNQL

SEQ ID NO: 3221316 - protein, 17 aa, Plasmodium falciparum
GSRGKQKQKYSGDGEEC

SEQ ID NO: 3221317 - protein, 5 aa, Plasmodium falciparum
GSRNI

SEQ ID NO: 3221318 - protein, 8 aa, Plasmodium falciparum
GSRPRPPS

SEQ ID NO: 3221319 - protein, 4 aa, Plasmodium falciparum
GSSA

SEQ ID NO: 3221320 - protein, 6 aa, Plasmodium falciparum
GSSCEN

SEQ ID NO: 3221321 - protein, 25 aa, Plasmodium falciparum
GSSDDEEAEKERVPSSIDSSESYDG

SEQ ID NO: 3221322 - protein, 49 aa, Plasmodium falciparum
GSSDPADNANPDADSESNGEPNAGPQVTAQDVTPEQPQGDDNNLVSGTE

SEQ ID NO: 3221323 - protein, 9 aa, Plasmodium falciparum
GSSGEEDAK

SEQ ID NO: 3221324 - protein, 9 aa, Plasmodium falciparum
GSSGKGKTT

SEQ ID NO: 3221325 - protein, 5 aa, Plasmodium falciparum
GSSGS

SEQ ID NO: 3221326 - protein, 10 aa, Plasmodium falciparum
GSSGSGGVKK

SEQ ID NO: 3221327 - protein, 14 aa, Plasmodium falciparum
GSSHKNAPTEEYPS

SEQ ID NO: 3221328 - protein, 4 aa, Plasmodium falciparum
GSSI

SEQ ID NO: 3221329 - protein, 6 aa, Plasmodium falciparum
GSSINE

SEQ ID NO: 3221330 - protein, 7 aa, Plasmodium falciparum
GSSKYNN

SEQ ID NO: 3221331 - protein, 5 aa, Plasmodium falciparum
GSSNI

SEQ ID NO: 3221332 - protein, 8 aa, Plasmodium falciparum
GSSNIPNK

SEQ ID NO: 3221333 - protein, 25 aa, Plasmodium falciparum
GSSPFSGINPRSGSGYTTSKSFSSM

SEQ ID NO: 3221334 - protein, 52 aa, Plasmodium falciparum
GSSPNDNINVTEQGDNISGVNSKPLSDDVRPDKNHEEVKEHTSNSDNVQQSG

SEQ ID NO: 3221335 - protein, 12 aa, Plasmodium falciparum
GSSRKKKHMDDD

SEQ ID NO: 3221336 - protein, 12 aa, Plasmodium falciparum
GSSRSNNEKKKK

SEQ ID NO: 3221337 - protein, 5 aa, Plasmodium falciparum
GSSSL

SEQ ID NO: 3221338 - protein, 7 aa, Plasmodium falciparum
GSSSNTR

SEQ ID NO: 3221339 - protein, 8 aa, Plasmodium falciparum
GSSTGQDR

SEQ ID NO: 3221340 - protein, 5 aa, Plasmodium falciparum
GSSTL

SEQ ID NO: 3221341 - protein, 8 aa, Plasmodium falciparum
GSSYNRTK

SEQ ID NO: 3221342 - protein, 64 aa, Plasmodium falciparum
GSTANSNMENKNSNNNNNNNNNTGSKQSVNNSRASNNRKRINNTSSNNGNDDDEDEKYQNKRKK

SEQ ID NO: 3221343 - protein, 5 aa, Plasmodium falciparum
GSTDK

SEQ ID NO: 3221344 - protein, 5 aa, Plasmodium falciparum
GSTDV

SEQ ID NO: 3221345 - protein, 8 aa, Plasmodium falciparum
GSTEKIKQ

SEQ ID NO: 3221346 - protein, 16 aa, Plasmodium falciparum
GSTGGLNQSKPSTGNV

SEQ ID NO: 3221347 - protein, 13 aa, Plasmodium falciparum
GSTGNNNKNDQEK

SEQ ID NO: 3221348 - protein, 6 aa, Plasmodium falciparum
GSTKIK

SEQ ID NO: 3221349 - protein, 15 aa, Plasmodium falciparum
GSTNNVNNNANRNNY

SEQ ID NO: 3221350 - protein, 22 aa, Plasmodium falciparum
GSTNTESNESSNNESSTSSLEK

SEQ ID NO: 3221351 - protein, 8 aa, Plasmodium falciparum
GSTPDLKQ

SEQ ID NO: 3221352 - protein, 7 aa, Plasmodium falciparum
GSTTEKC

SEQ ID NO: 3221353 - protein, 4 aa, Plasmodium falciparum
GSTV

SEQ ID NO: 3221354 - protein, 5 aa, Plasmodium falciparum
GSVEM

SEQ ID NO: 3221355 - protein, 6 aa, Plasmodium falciparum
GSVGTA

SEQ ID NO: 3221356 - protein, 6 aa, Plasmodium falciparum
GSYDNY

SEQ ID NO: 3221357 - protein, 7 aa, Plasmodium falciparum
GSYDSYE

SEQ ID NO: 3221358 - protein, 4 aa, Plasmodium falciparum
GSYE

SEQ ID NO: 3221359 - protein, 39 aa, Plasmodium falciparum
GSYENDKNGKNYENGKNYENGINDKNDENNKNDKNDENS

SEQ ID NO: 3221360 - protein, 7 aa, Plasmodium falciparum
GSYESKG

SEQ ID NO: 3221361 - protein, 12 aa, Plasmodium falciparum
GSYKNSVGNNKC

SEQ ID NO: 3221362 - protein, 9 aa, Plasmodium falciparum
GSYKNTISN

SEQ ID NO: 3221363 - protein, 25 aa, Plasmodium falciparum
GSYNKGNNKEIINDNNKKKDKHKDI

SEQ ID NO: 3221364 - protein, 12 aa, Plasmodium falciparum
GSYNNHDEKKNN

SEQ ID NO: 3221365 - protein, 5 aa, Plasmodium falciparum
GSYNY

SEQ ID NO: 3221366 - protein, 7 aa, Plasmodium falciparum
GSYPIPP

SEQ ID NO: 3221367 - protein, 13 aa, Plasmodium falciparum
GSYQYSQPTCGRG

SEQ ID NO: 3221368 - protein, 8 aa, Plasmodium falciparum
GSYTENES

SEQ ID NO: 3221369 - protein, 7 aa, Plasmodium falciparum
GSYTSTQ

SEQ ID NO: 3221370 - protein, 8 aa, Plasmodium falciparum
GTAAASAS

SEQ ID NO: 3221371 - protein, 4 aa, Plasmodium falciparum
GTAP

SEQ ID NO: 3221372 - protein, 5 aa, Plasmodium falciparum
GTCEN

SEQ ID NO: 3221373 - protein, 4 aa, Plasmodium falciparum
GTDD

SEQ ID NO: 3221374 - protein, 15 aa, Plasmodium falciparum
GTDKSKDAYSVDGER

SEQ ID NO: 3221375 - protein, 10 aa, Plasmodium falciparum
GTDKYKNDCS

SEQ ID NO: 3221376 - protein, 11 aa, Plasmodium falciparum
GTDLKDTKKDR

SEQ ID NO: 3221377 - protein, 23 aa, Plasmodium falciparum
GTDNDDDSEKNEEIGNEENDKKY

SEQ ID NO: 3221378 - protein, 5 aa, Plasmodium falciparum
GTDNI

SEQ ID NO: 3221379 - protein, 5 aa, Plasmodium falciparum
GTDNN

SEQ ID NO: 3221380 - protein, 11 aa, Plasmodium falciparum
GTDSKERGDNR

SEQ ID NO: 3221381 - protein, 7 aa, Plasmodium falciparum
GTEARDY

SEQ ID NO: 3221382 - protein, 4 aa, Plasmodium falciparum
GTEE

SEQ ID NO: 3221383 - protein, 5 aa, Plasmodium falciparum
GTEIK

SEQ ID NO: 3221384 - protein, 6 aa, Plasmodium falciparum
GTEIQT

SEQ ID NO: 3221385 - protein, 5 aa, Plasmodium falciparum
GTEIR

SEQ ID NO: 3221386 - protein, 13 aa, Plasmodium falciparum
GTENTKRTSTYSV

SEQ ID NO: 3221387 - protein, 7 aa, Plasmodium falciparum
GTERTDN

SEQ ID NO: 3221388 - protein, 6 aa, Plasmodium falciparum
GTEYNY

SEQ ID NO: 3221389 - protein, 12 aa, Plasmodium falciparum
GTEYQDKEKESS

SEQ ID NO: 3221390 - protein, 4 aa, Plasmodium falciparum
GTFD

SEQ ID NO: 3221391 - protein, 12 aa, Plasmodium falciparum
GTFDRQASQRFE

SEQ ID NO: 3221392 - protein, 11 aa, Plasmodium falciparum
GTFDRQTSQRF

SEQ ID NO: 3221393 - protein, 12 aa, Plasmodium falciparum
GTFDRQTSQRFE

SEQ ID NO: 3221394 - protein, 16 aa, Plasmodium falciparum
GTFEEKPKNESGECDG

SEQ ID NO: 3221395 - protein, 4 aa, Plasmodium falciparum
GTGG

SEQ ID NO: 3221396 - protein, 13 aa, Plasmodium falciparum
GTGKTKKEEKMKE

SEQ ID NO: 3221397 - protein, 6 aa, Plasmodium falciparum
GTGNNI

SEQ ID NO: 3221398 - protein, 12 aa, Plasmodium falciparum
GTGSAGVMYGLP

SEQ ID NO: 3221399 - protein, 9 aa, Plasmodium falciparum
GTGTPTDDK

SEQ ID NO: 3221400 - protein, 6 aa, Plasmodium falciparum
GTHEGD

SEQ ID NO: 3221401 - protein, 5 aa, Plasmodium falciparum
GTHNV

SEQ ID NO: 3221402 - protein, 6 aa, Plasmodium falciparum
GTINSD

SEQ ID NO: 3221403 - protein, 4 aa, Plasmodium falciparum
GTIQ

SEQ ID NO: 3221404 - protein, 17 aa, Plasmodium falciparum
GTIYTGGNGAEPMSTTE

SEQ ID NO: 3221405 - protein, 5 aa, Plasmodium falciparum
GTKDN

SEQ ID NO: 3221406 - protein, 15 aa, Plasmodium falciparum
GTKKGSHESSKSRND

SEQ ID NO: 3221407 - protein, 19 aa, Plasmodium falciparum
GTKNNEEKKKKSYEKDKEV

SEQ ID NO: 3221408 - protein, 12 aa, Plasmodium falciparum
GTKSSNTTSTNT

SEQ ID NO: 3221409 - protein, 11 aa, Plasmodium falciparum
GTKSVKAKNPT

SEQ ID NO: 3221410 - protein, 15 aa, Plasmodium falciparum
GTKTRAQNYDNNHME

SEQ ID NO: 3221411 - protein, 16 aa, Plasmodium falciparum
GTLGAKYARDDPPYTN

SEQ ID NO: 3221412 - protein, 4 aa, Plasmodium falciparum
GTLN

SEQ ID NO: 3221413 - protein, 4 aa, Plasmodium falciparum
GTLT

SEQ ID NO: 3221414 - protein, 5 aa, Plasmodium falciparum
GTLTE

SEQ ID NO: 3221415 - protein, 10 aa, Plasmodium falciparum
GTMEDRGGNT

SEQ ID NO: 3221416 - protein, 5 aa, Plasmodium falciparum
GTMNE

SEQ ID NO: 3221417 - protein, 9 aa, Plasmodium falciparum
GTNAQNLNQ

SEQ ID NO: 3221418 - protein, 5 aa, Plasmodium falciparum
GTNDM

SEQ ID NO: 3221419 - protein, 12 aa, Plasmodium falciparum
GTNENEKNKSRD

SEQ ID NO: 3221420 - protein, 5 aa, Plasmodium falciparum
GTNFS

SEQ ID NO: 3221421 - protein, 8 aa, Plasmodium falciparum
GTNGNLKT

SEQ ID NO: 3221422 - protein, 6 aa, Plasmodium falciparum
GTNGNS

SEQ ID NO: 3221423 - protein, 4 aa, Plasmodium falciparum
GTNI

SEQ ID NO: 3221424 - protein, 7 aa, Plasmodium falciparum
GTNKSAT

SEQ ID NO: 3221425 - protein, 13 aa, Plasmodium falciparum
GTNNNTNPNINTS

SEQ ID NO: 3221426 - protein, 11 aa, Plasmodium falciparum
GTNNPKRTSTY

SEQ ID NO: 3221427 - protein, 12 aa, Plasmodium falciparum
GTNNPKRTSTYS

SEQ ID NO: 3221428 - protein, 20 aa, Plasmodium falciparum
GTNPDIQNEINNNSNHDKKS

SEQ ID NO: 3221429 - protein, 11 aa, Plasmodium falciparum
GTNQSENSCKT

SEQ ID NO: 3221430 - protein, 5 aa, Plasmodium falciparum
GTNRE

SEQ ID NO: 3221431 - protein, 8 aa, Plasmodium falciparum
GTNSNLEQ

SEQ ID NO: 3221432 - protein, 9 aa, Plasmodium falciparum
GTNTTPAVY

SEQ ID NO: 3221433 - protein, 4 aa, Plasmodium falciparum
GTNY

SEQ ID NO: 3221434 - protein, 6 aa, Plasmodium falciparum
GTPDID

SEQ ID NO: 3221435 - protein, 4 aa, Plasmodium falciparum
GTPG

SEQ ID NO: 3221436 - protein, 12 aa, Plasmodium falciparum
GTPGYTAPEGGA

SEQ ID NO: 3221437 - protein, 15 aa, Plasmodium falciparum
GTPHSKNENENENER

SEQ ID NO: 3221438 - protein, 23 aa, Plasmodium falciparum
GTPNGNPLPQPGTNGTSNEPISQ

SEQ ID NO: 3221439 - protein, 5 aa, Plasmodium falciparum
GTPNR

SEQ ID NO: 3221440 - protein, 5 aa, Plasmodium falciparum
GTPRW

SEQ ID NO: 3221441 - protein, 10 aa, Plasmodium falciparum
GTQINKDNEH

SEQ ID NO: 3221442 - protein, 11 aa, Plasmodium falciparum
GTQPEQVADPN

SEQ ID NO: 3221443 - protein, 8 aa, Plasmodium falciparum
GTQSTPPF

SEQ ID NO: 3221444 - protein, 6 aa, Plasmodium falciparum
GTRNEN

SEQ ID NO: 3221445 - protein, 8 aa, Plasmodium falciparum
GTRSGPVA

SEQ ID NO: 3221446 - protein, 6 aa, Plasmodium falciparum
GTSAIT

SEQ ID NO: 3221447 - protein, 31 aa, Plasmodium falciparum
GTSFTNNSSSSNNSSSNNSCSSITTKKKHTK

SEQ ID NO: 3221448 - protein, 11 aa, Plasmodium falciparum
GTSGGTGASKW

SEQ ID NO: 3221449 - protein, 15 aa, Plasmodium falciparum
GTSHMDSSSNQTSHG

SEQ ID NO: 3221450 - protein, 10 aa, Plasmodium falciparum
GTSLSGGQKQ

SEQ ID NO: 3221451 - protein, 4 aa, Plasmodium falciparum
GTSP

SEQ ID NO: 3221452 - protein, 10 aa, Plasmodium falciparum
GTSSEKINTG

SEQ ID NO: 3221453 - protein, 6 aa, Plasmodium falciparum
GTSSPS

SEQ ID NO: 3221454 - protein, 19 aa, Plasmodium falciparum
GTSSSSRKTRAARGSNVNG

SEQ ID NO: 3221455 - protein, 12 aa, Plasmodium falciparum
GTSTNQSTGGGL

SEQ ID NO: 3221456 - protein, 16 aa, Plasmodium falciparum
GTSTTDSSNNDNIPES

SEQ ID NO: 3221457 - protein, 5 aa, Plasmodium falciparum
GTTEN

SEQ ID NO: 3221458 - protein, 8 aa, Plasmodium falciparum
GTTNKTMT

SEQ ID NO: 3221459 - protein, 9 aa, Plasmodium falciparum
GTTQGTDDL

SEQ ID NO: 3221460 - protein, 12 aa, Plasmodium falciparum
GTTQGTSQGLTS

SEQ ID NO: 3221461 - protein, 7 aa, Plasmodium falciparum
GTTRSRI

SEQ ID NO: 3221462 - protein, 13 aa, Plasmodium falciparum
GTTSARKEKGTEK

SEQ ID NO: 3221463 - protein, 6 aa, Plasmodium falciparum
GTTSNG

SEQ ID NO: 3221464 - protein, 10 aa, Plasmodium falciparum
GTTSSNNMNN

SEQ ID NO: 3221465 - protein, 7 aa, Plasmodium falciparum
GTTTINE

SEQ ID NO: 3221466 - protein, 9 aa, Plasmodium falciparum
GTTTNTNNN

SEQ ID NO: 3221467 - protein, 5 aa, Plasmodium falciparum
GTTYS

SEQ ID NO: 3221468 - protein, 8 aa, Plasmodium falciparum
GTVSTAAT

SEQ ID NO: 3221469 - protein, 7 aa, Plasmodium falciparum
GTYEGYE

SEQ ID NO: 3221470 - protein, 4 aa, Plasmodium falciparum
GTYK

SEQ ID NO: 3221471 - protein, 12 aa, Plasmodium falciparum
GTYKGTSEDTPN

SEQ ID NO: 3221472 - protein, 12 aa, Plasmodium falciparum
GTYKKSRYNKTE

SEQ ID NO: 3221473 - protein, 5 aa, Plasmodium falciparum
GTYKN

SEQ ID NO: 3221474 - protein, 25 aa, Plasmodium falciparum
GVAEATKTQVTSETTAELTAKQTTA

SEQ ID NO: 3221475 - protein, 6 aa, Plasmodium falciparum
GVAETY

SEQ ID NO: 3221476 - protein, 4 aa, Plasmodium falciparum
GVDA

SEQ ID NO: 3221477 - protein, 7 aa, Plasmodium falciparum
GVDDPAA

SEQ ID NO: 3221478 - protein, 7 aa, Plasmodium falciparum
GVDEGRE

SEQ ID NO: 3221479 - protein, 16 aa, Plasmodium falciparum
GVDQPKQPKNKFIKIR

SEQ ID NO: 3221480 - protein, 7 aa, Plasmodium falciparum
GVDYDTS

SEQ ID NO: 3221481 - protein, 6 aa, Plasmodium falciparum
GVENTA

SEQ ID NO: 3221482 - protein, 5 aa, Plasmodium falciparum
GVEPT

SEQ ID NO: 3221483 - protein, 5 aa, Plasmodium falciparum
GVFGK

SEQ ID NO: 3221484 - protein, 6 aa, Plasmodium falciparum
GVGGEE

SEQ ID NO: 3221485 - protein, 12 aa, Plasmodium falciparum
GVGGGEKKKKKK

SEQ ID NO: 3221486 - protein, 4 aa, Plasmodium falciparum
GVGK

SEQ ID NO: 3221487 - protein, 16 aa, Plasmodium falciparum
GVGKNIKNNEKINAGN

SEQ ID NO: 3221488 - protein, 13 aa, Plasmodium falciparum
GVGKNNDEKKLSG

SEQ ID NO: 3221489 - protein, 8 aa, Plasmodium falciparum
GVGQNEKR

SEQ ID NO: 3221490 - protein, 15 aa, Plasmodium falciparum
GVGVENGDDENNPEK

SEQ ID NO: 3221491 - protein, 14 aa, Plasmodium falciparum
GVIPTTGSGTNNKN

SEQ ID NO: 3221492 - protein, 12 aa, Plasmodium falciparum
GVKNDGVKNDGV

SEQ ID NO: 3221493 - protein, 20 aa, Plasmodium falciparum
GVKNDGVKNEKRPKSLNDSI

SEQ ID NO: 3221494 - protein, 6 aa, Plasmodium falciparum
GVKNSH

SEQ ID NO: 3221495 - protein, 6 aa, Plasmodium falciparum
GVKPNV

SEQ ID NO: 3221496 - protein, 9 aa, Plasmodium falciparum
GVNDAYDDN

SEQ ID NO: 3221497 - protein, 6 aa, Plasmodium falciparum
GVNEYE

SEQ ID NO: 3221498 - protein, 5 aa, Plasmodium falciparum
GVNNG

SEQ ID NO: 3221499 - protein, 10 aa, Plasmodium falciparum
GVNNTKDINH

SEQ ID NO: 3221500 - protein, 10 aa, Plasmodium falciparum
GVNNYSSDEC

SEQ ID NO: 3221501 - protein, 6 aa, Plasmodium falciparum
GVNQEK

SEQ ID NO: 3221502 - protein, 13 aa, Plasmodium falciparum
GVNRKGDHTYANE

SEQ ID NO: 3221503 - protein, 25 aa, Plasmodium falciparum
GVNSNNNNNNVNSNVNSNLNNNVNS

SEQ ID NO: 3221504 - protein, 9 aa, Plasmodium falciparum
GVPGAGPQL

SEQ ID NO: 3221505 - protein, 5 aa, Plasmodium falciparum
GVQQE

SEQ ID NO: 3221506 - protein, 7 aa, Plasmodium falciparum
GVQSIKD

SEQ ID NO: 3221507 - protein, 8 aa, Plasmodium falciparum
GVRANAQQ

SEQ ID NO: 3221508 - protein, 14 aa, Plasmodium falciparum
GVRPEKRKTKGNNI

SEQ ID NO: 3221509 - protein, 8 aa, Plasmodium falciparum
GVRSGEEI

SEQ ID NO: 3221510 - protein, 4 aa, Plasmodium falciparum
GVSQ

SEQ ID NO: 3221511 - protein, 44 aa, Plasmodium falciparum
GVSTATSGEGGDAKSRERREAGVPTATSSGNTTGGGKDGATGGS

SEQ ID NO: 3221512 - protein, 6 aa, Plasmodium falciparum
GVTTKE

SEQ ID NO: 3221513 - protein, 6 aa, Plasmodium falciparum
GVTYES

SEQ ID NO: 3221514 - protein, 5 aa, Plasmodium falciparum
GVVSS

SEQ ID NO: 3221515 - protein, 26 aa, Plasmodium falciparum
GVYHEEREETINKDHEGKIKNANTYP

SEQ ID NO: 3221516 - protein, 5 aa, Plasmodium falciparum
GWNNG

SEQ ID NO: 3221517 - protein, 8 aa, Plasmodium falciparum
GWTQKDMQ

SEQ ID NO: 3221518 - protein, 5 aa, Plasmodium falciparum
GWYPK

SEQ ID NO: 3221519 - protein, 10 aa, Plasmodium falciparum
GYAGRTELPE

SEQ ID NO: 3221520 - protein, 10 aa, Plasmodium falciparum
GYANSGNNKQ

SEQ ID NO: 3221521 - protein, 8 aa, Plasmodium falciparum
GYDDDEEV

SEQ ID NO: 3221522 - protein, 8 aa, Plasmodium falciparum
GYDDEPSN

SEQ ID NO: 3221523 - protein, 12 aa, Plasmodium falciparum
GYDEKGGKYKTE

SEQ ID NO: 3221524 - protein, 9 aa, Plasmodium falciparum
GYDKKNFKK

SEQ ID NO: 3221525 - protein, 8 aa, Plasmodium falciparum
GYDTEENA

SEQ ID NO: 3221526 - protein, 29 aa, Plasmodium falciparum
GYEKTNHKNTNKNNNMISNDNNKSNQNNI

SEQ ID NO: 3221527 - protein, 6 aa, Plasmodium falciparum
GYGNPM

SEQ ID NO: 3221528 - protein, 9 aa, Plasmodium falciparum
GYGNSHVRG

SEQ ID NO: 3221529 - protein, 4 aa, Plasmodium falciparum
GYGQ

SEQ ID NO: 3221530 - protein, 7 aa, Plasmodium falciparum
GYGQDKD

SEQ ID NO: 3221531 - protein, 4 aa, Plasmodium falciparum
GYHT

SEQ ID NO: 3221532 - protein, 16 aa, Plasmodium falciparum
GYHTNETNLPSNGPFT

SEQ ID NO: 3221533 - protein, 4 aa, Plasmodium falciparum
GYKK

SEQ ID NO: 3221534 - protein, 10 aa, Plasmodium falciparum
GYKNDDGKKI

SEQ ID NO: 3221535 - protein, 10 aa, Plasmodium falciparum
GYKNTKKETK

SEQ ID NO: 3221536 - protein, 29 aa, Plasmodium falciparum
GYKSSGNYYNKSYNSNNNNNNNSNNSYYD

SEQ ID NO: 3221537 - protein, 13 aa, Plasmodium falciparum
GYNGSSNSGAQFT

SEQ ID NO: 3221538 - protein, 17 aa, Plasmodium falciparum
GYNIQNRQNSIERAQSN

SEQ ID NO: 3221539 - protein, 51 aa, Plasmodium falciparum
GYNKKDKDNDAKCGDKYGDKYGDKYGDKYGDKYGDKYGDKYDDKYDNKYDD

SEQ ID NO: 3221540 - protein, 10 aa, Plasmodium falciparum
GYNKQNVENG

SEQ ID NO: 3221541 - protein, 19 aa, Plasmodium falciparum
GYNNNNNNNNNNNNNIQSN

SEQ ID NO: 3221542 - protein, 10 aa, Plasmodium falciparum
GYNSGEYTTE

SEQ ID NO: 3221543 - protein, 7 aa, Plasmodium falciparum
GYNTSKD

SEQ ID NO: 3221544 - protein, 5 aa, Plasmodium falciparum
GYPKK

SEQ ID NO: 3221545 - protein, 121 aa, Plasmodium falciparum
GYPSSEKTDEGESISGQVEDDEEDDDIDEDDDDIDEDDDDIDEDDDNVDEDDDNVDEEDDNVDEDDVEEGGIHDEKEDDHDKKEDVHNDENDINKYNNDDNHNEEENSSYEKFSSENHINN

SEQ ID NO: 3221546 - protein, 10 aa, Plasmodium falciparum
GYQNESPEYF

SEQ ID NO: 3221547 - protein, 5 aa, Plasmodium falciparum
GYQSY

SEQ ID NO: 3221548 - protein, 6 aa, Plasmodium falciparum
GYRQGN

SEQ ID NO: 3221549 - protein, 9 aa, Plasmodium falciparum
GYRSNSKQS

SEQ ID NO: 3221550 - protein, 15 aa, Plasmodium falciparum
GYSDNVGDNKLKSKG

SEQ ID NO: 3221551 - protein, 6 aa, Plasmodium falciparum
GYSEEA

SEQ ID NO: 3221552 - protein, 10 aa, Plasmodium falciparum
GYSKNSSDDL

SEQ ID NO: 3221553 - protein, 6 aa, Plasmodium falciparum
GYSPTD

SEQ ID NO: 3221554 - protein, 10 aa, Plasmodium falciparum
GYSTKAENKI

SEQ ID NO: 3221555 - protein, 6 aa, Plasmodium falciparum
GYSTRN

SEQ ID NO: 3221556 - protein, 12 aa, Plasmodium falciparum
GYTENNRRRENY

SEQ ID NO: 3221557 - protein, 6 aa, Plasmodium falciparum
GYTLTN

SEQ ID NO: 3221558 - protein, 4 aa, Plasmodium falciparum
GYTN

SEQ ID NO: 3221559 - protein, 7 aa, Plasmodium falciparum
GYTYKEK

SEQ ID NO: 3221560 - protein, 5 aa, Plasmodium falciparum
GYYTK

SEQ ID NO: 3221561 - protein, 24 aa, Plasmodium falciparum
HAAPTNARLGRSTMTPKAEKSTLD

SEQ ID NO: 3221562 - protein, 5 aa, Plasmodium falciparum
HADAG

SEQ ID NO: 3221563 - protein, 12 aa, Plasmodium falciparum
HADSQKQNEHHS

SEQ ID NO: 3221564 - protein, 6 aa, Plasmodium falciparum
HAENNY

SEQ ID NO: 3221565 - protein, 51 aa, Plasmodium falciparum
HAESVEGSANDENSHDHAQDGSNISNVQKGKKSEAKSKSGANENSNNNTVD

SEQ ID NO: 3221566 - protein, 31 aa, Plasmodium falciparum
HAFDDNKSKKKPKDNKRYGSGSHDHEEEVVE

SEQ ID NO: 3221567 - protein, 6 aa, Plasmodium falciparum
HAGGTI

SEQ ID NO: 3221568 - protein, 8 aa, Plasmodium falciparum
HAKKNNPS

SEQ ID NO: 3221569 - protein, 5 aa, Plasmodium falciparum
HALDE

SEQ ID NO: 3221570 - protein, 4 aa, Plasmodium falciparum
HANG

SEQ ID NO: 3221571 - protein, 7 aa, Plasmodium falciparum
HANKKNK

SEQ ID NO: 3221572 - protein, 10 aa, Plasmodium falciparum
HAPKTKTTKI

SEQ ID NO: 3221573 - protein, 14 aa, Plasmodium falciparum
HASDSYSTGGNEKE

SEQ ID NO: 3221574 - protein, 5 aa, Plasmodium falciparum
HASSP

SEQ ID NO: 3221575 - protein, 4 aa, Plasmodium falciparum
HASY

SEQ ID NO: 3221576 - protein, 4 aa, Plasmodium falciparum
HAVG

SEQ ID NO: 3221577 - protein, 6 aa, Plasmodium falciparum
HCKNNT

SEQ ID NO: 3221578 - protein, 33 aa, Plasmodium falciparum
HDASNTQGSVSNTSDITNGHSESSLNRTTNAQD

SEQ ID NO: 3221579 - protein, 14 aa, Plasmodium falciparum
HDASNVDSNNMDVP

SEQ ID NO: 3221580 - protein, 13 aa, Plasmodium falciparum
HDASTVDSNAMDV

SEQ ID NO: 3221581 - protein, 14 aa, Plasmodium falciparum
HDASTVDSNAVNVP

SEQ ID NO: 3221582 - protein, 14 aa, Plasmodium falciparum
HDASTVDSNNMDVP

SEQ ID NO: 3221583 - protein, 13 aa, Plasmodium falciparum
HDASTVDSNTMDI

SEQ ID NO: 3221584 - protein, 9 aa, Plasmodium falciparum
HDASTVDTN

SEQ ID NO: 3221585 - protein, 12 aa, Plasmodium falciparum
HDCTKGKKSVLP

SEQ ID NO: 3221586 - protein, 9 aa, Plasmodium falciparum
HDDEDDNYY

SEQ ID NO: 3221587 - protein, 11 aa, Plasmodium falciparum
HDDEKQNNEHL

SEQ ID NO: 3221588 - protein, 8 aa, Plasmodium falciparum
HDDNKNVQ

SEQ ID NO: 3221589 - protein, 11 aa, Plasmodium falciparum
HDDNSEKKNNN

SEQ ID NO: 3221590 - protein, 49 aa, Plasmodium falciparum
HDDQKKNFNKNKVADNKKDSNQDNNMEKKKKEEEEEKEIEIEKKSDTIN

SEQ ID NO: 3221591 - protein, 6 aa, Plasmodium falciparum
HDDSPT

SEQ ID NO: 3221592 - protein, 11 aa, Plasmodium falciparum
HDDSSEESEKE

SEQ ID NO: 3221593 - protein, 7 aa, Plasmodium falciparum
HDDTDDY

SEQ ID NO: 3221594 - protein, 18 aa, Plasmodium falciparum
HDEDDDNDNDDNNDNDDN

SEQ ID NO: 3221595 - protein, 8 aa, Plasmodium falciparum
HDEDKEVN

SEQ ID NO: 3221596 - protein, 7 aa, Plasmodium falciparum
HDEEENY

SEQ ID NO: 3221597 - protein, 4 aa, Plasmodium falciparum
HDEI

SEQ ID NO: 3221598 - protein, 9 aa, Plasmodium falciparum
HDEKKVNER

SEQ ID NO: 3221599 - protein, 8 aa, Plasmodium falciparum
HDEKNNNI

SEQ ID NO: 3221600 - protein, 5 aa, Plasmodium falciparum
HDEKS

SEQ ID NO: 3221601 - protein, 12 aa, Plasmodium falciparum
HDENNFSDKSGS

SEQ ID NO: 3221602 - protein, 11 aa, Plasmodium falciparum
HDERKIKKQEN

SEQ ID NO: 3221603 - protein, 7 aa, Plasmodium falciparum
HDERKKP

SEQ ID NO: 3221604 - protein, 7 aa, Plasmodium falciparum
HDESNKY

SEQ ID NO: 3221605 - protein, 21 aa, Plasmodium falciparum
HDETRNQDNIGKDIKNDTYNM

SEQ ID NO: 3221606 - protein, 4 aa, Plasmodium falciparum
HDEY

SEQ ID NO: 3221607 - protein, 11 aa, Plasmodium falciparum
HDEYKNKINNS

SEQ ID NO: 3221608 - protein, 59 aa, Plasmodium falciparum
HDGEHSSDEDEEEEEEEEQQPPAEGTEQGEEKSESKEVVEQQETPQKDTEKTVPTTTPT

SEQ ID NO: 3221609 - protein, 11 aa, Plasmodium falciparum
HDGNNKKVERI

SEQ ID NO: 3221610 - protein, 23 aa, Plasmodium falciparum
HDHGHDHGHDHGHDHGHDHGHGH

SEQ ID NO: 3221611 - protein, 12 aa, Plasmodium falciparum
HDHSNNSNYYND

SEQ ID NO: 3221612 - protein, 4 aa, Plasmodium falciparum
HDID

SEQ ID NO: 3221613 - protein, 10 aa, Plasmodium falciparum
HDIEPNREDE

SEQ ID NO: 3221614 - protein, 4 aa, Plasmodium falciparum
HDKE

SEQ ID NO: 3221615 - protein, 8 aa, Plasmodium falciparum
HDKKNPDV

SEQ ID NO: 3221616 - protein, 11 aa, Plasmodium falciparum
HDKTRNNNNMK

SEQ ID NO: 3221617 - protein, 12 aa, Plasmodium falciparum
HDNDNEIKKGCP

SEQ ID NO: 3221618 - protein, 13 aa, Plasmodium falciparum
HDNHNSCKDEIEG

SEQ ID NO: 3221619 - protein, 4 aa, Plasmodium falciparum
HDNK

SEQ ID NO: 3221620 - protein, 48 aa, Plasmodium falciparum
HDNKKDKKNNADKNKNKKNTTTGEENKDSNKSLVNNDSKKNDSSKNKY

SEQ ID NO: 3221621 - protein, 11 aa, Plasmodium falciparum
HDNKNNDQKGT

SEQ ID NO: 3221622 - protein, 4 aa, Plasmodium falciparum
HDNM

SEQ ID NO: 3221623 - protein, 30 aa, Plasmodium falciparum
HDNNNDNNDDDGYDDDGYDDDNDNDDVNDY

SEQ ID NO: 3221624 - protein, 21 aa, Plasmodium falciparum
HDNNNNNDNNINNNNKMEGVN

SEQ ID NO: 3221625 - protein, 10 aa, Plasmodium falciparum
HDNNPGSKLR

SEQ ID NO: 3221626 - protein, 11 aa, Plasmodium falciparum
HDNNTNHDNNI

SEQ ID NO: 3221627 - protein, 4 aa, Plasmodium falciparum
HDNP

SEQ ID NO: 3221628 - protein, 7 aa, Plasmodium falciparum
HDNQENI

SEQ ID NO: 3221629 - protein, 4 aa, Plasmodium falciparum
HDNS

SEQ ID NO: 3221630 - protein, 10 aa, Plasmodium falciparum
HDNSKTNITL

SEQ ID NO: 3221631 - protein, 7 aa, Plasmodium falciparum
HDNSSND

SEQ ID NO: 3221632 - protein, 10 aa, Plasmodium falciparum
HDNSTTSGYE

SEQ ID NO: 3221633 - protein, 22 aa, Plasmodium falciparum
HDNYRGKPKQDENSGKQSNVYN

SEQ ID NO: 3221634 - protein, 7 aa, Plasmodium falciparum
HDPNNKY

SEQ ID NO: 3221635 - protein, 4 aa, Plasmodium falciparum
HDPY

SEQ ID NO: 3221636 - protein, 6 aa, Plasmodium falciparum
HDQDPD

SEQ ID NO: 3221637 - protein, 8 aa, Plasmodium falciparum
HDQEDNNI

SEQ ID NO: 3221638 - protein, 7 aa, Plasmodium falciparum
HDQHSDI

SEQ ID NO: 3221639 - protein, 7 aa, Plasmodium falciparum
HDQSNSD

SEQ ID NO: 3221640 - protein, 11 aa, Plasmodium falciparum
HDSETSKRLSN

SEQ ID NO: 3221641 - protein, 18 aa, Plasmodium falciparum
HDSKDIYGKNDTLSYNQG

SEQ ID NO: 3221642 - protein, 6 aa, Plasmodium falciparum
HDSNIN

SEQ ID NO: 3221643 - protein, 22 aa, Plasmodium falciparum
HDSNNNNNDNMNSTNYNSLDEN

SEQ ID NO: 3221644 - protein, 8 aa, Plasmodium falciparum
HDSNYNRI

SEQ ID NO: 3221645 - protein, 6 aa, Plasmodium falciparum
HDSSDN

SEQ ID NO: 3221646 - protein, 9 aa, Plasmodium falciparum
HDTKIKNDN

SEQ ID NO: 3221647 - protein, 4 aa, Plasmodium falciparum
HDTN

SEQ ID NO: 3221648 - protein, 25 aa, Plasmodium falciparum
HDTNDDKNNNNSSNNNNNNKTSVMG

SEQ ID NO: 3221649 - protein, 23 aa, Plasmodium falciparum
HDTNNNNNNNNNNNNNSNNNNNN

SEQ ID NO: 3221650 - protein, 31 aa, Plasmodium falciparum
HDTNYKKNEKMNKQKKKNNNNNNKMERKQSK

SEQ ID NO: 3221651 - protein, 21 aa, Plasmodium falciparum
HDTSRNVDNEKYNSNDDLPNL

SEQ ID NO: 3221652 - protein, 13 aa, Plasmodium falciparum
HDTSTADSNAMDV

SEQ ID NO: 3221653 - protein, 9 aa, Plasmodium falciparum
HDTSTVDSN

SEQ ID NO: 3221654 - protein, 13 aa, Plasmodium falciparum
HDTSTVDSNNMDV

SEQ ID NO: 3221655 - protein, 13 aa, Plasmodium falciparum
HDTSTVDSNTMDV

SEQ ID NO: 3221656 - protein, 16 aa, Plasmodium falciparum
HDTSTVNPNNMEKPSK

SEQ ID NO: 3221657 - protein, 39 aa, Plasmodium falciparum
HDTTTNEMHSNERSNNIYEGNNVNSENNYNNMSSNHSTH

SEQ ID NO: 3221658 - protein, 6 aa, Plasmodium falciparum
HEDEHN

SEQ ID NO: 3221659 - protein, 9 aa, Plasmodium falciparum
HEDKDAKDC

SEQ ID NO: 3221660 - protein, 10 aa, Plasmodium falciparum
HEDKDAKGCL

SEQ ID NO: 3221661 - protein, 111 aa, Plasmodium falciparum
HEDKDATKCKNCQEPTKPASKPEDLARSGASPDTPREDSPPADLDDEEHDEDDEDEDDDAEEEEEEEKKEEEEEHKEEENEAAPEEKKEEGSSSPEEVEEKAKEAPAGPDA

SEQ ID NO: 3221662 - protein, 6 aa, Plasmodium falciparum
HEDNQE

SEQ ID NO: 3221663 - protein, 20 aa, Plasmodium falciparum
HEDPTTLPDLGSSCPKSCSS

SEQ ID NO: 3221664 - protein, 7 aa, Plasmodium falciparum
HEEDEAN

SEQ ID NO: 3221665 - protein, 6 aa, Plasmodium falciparum
HEEDED

SEQ ID NO: 3221666 - protein, 5 aa, Plasmodium falciparum
HEEDY

SEQ ID NO: 3221667 - protein, 18 aa, Plasmodium falciparum
HEEKNNNGTIEQKHSNYD

SEQ ID NO: 3221668 - protein, 12 aa, Plasmodium falciparum
HEENKDKINDHK

SEQ ID NO: 3221669 - protein, 9 aa, Plasmodium falciparum
HEENKERIS

SEQ ID NO: 3221670 - protein, 14 aa, Plasmodium falciparum
HEENKNGNKDNNDL

SEQ ID NO: 3221671 - protein, 7 aa, Plasmodium falciparum
HEENNIN

SEQ ID NO: 3221672 - protein, 9 aa, Plasmodium falciparum
HEEQDATKC

SEQ ID NO: 3221673 - protein, 6 aa, Plasmodium falciparum
HEERKY

SEQ ID NO: 3221674 - protein, 26 aa, Plasmodium falciparum
HEETQHTTNTNNIKKHAGKNSSDGYN

SEQ ID NO: 3221675 - protein, 4 aa, Plasmodium falciparum
HEEV

SEQ ID NO: 3221676 - protein, 4 aa, Plasmodium falciparum
HEEW

SEQ ID NO: 3221677 - protein, 9 aa, Plasmodium falciparum
HEGDDANNC

SEQ ID NO: 3221678 - protein, 9 aa, Plasmodium falciparum
HEGDEAGEC

SEQ ID NO: 3221679 - protein, 45 aa, Plasmodium falciparum
HEGDGNNITINNQGKDTEIGRHKEKDTEIGRHKEKDTETERHREK

SEQ ID NO: 3221680 - protein, 6 aa, Plasmodium falciparum
HEGDSL

SEQ ID NO: 3221681 - protein, 8 aa, Plasmodium falciparum
HEGEEAKD

SEQ ID NO: 3221682 - protein, 5 aa, Plasmodium falciparum
HEGES

SEQ ID NO: 3221683 - protein, 7 aa, Plasmodium falciparum
HEGNSIN

SEQ ID NO: 3221684 - protein, 6 aa, Plasmodium falciparum
HEGQSI

SEQ ID NO: 3221685 - protein, 8 aa, Plasmodium falciparum
HEGSTTEQ

SEQ ID NO: 3221686 - protein, 4 aa, Plasmodium falciparum
HEHD

SEQ ID NO: 3221687 - protein, 14 aa, Plasmodium falciparum
HEHDDNNNNNNNNN

SEQ ID NO: 3221688 - protein, 4 aa, Plasmodium falciparum
HEHF

SEQ ID NO: 3221689 - protein, 6 aa, Plasmodium falciparum
HEHSEK

SEQ ID NO: 3221690 - protein, 11 aa, Plasmodium falciparum
HEHSNKDSPSQ

SEQ ID NO: 3221691 - protein, 10 aa, Plasmodium falciparum
HEIENKKQNL

SEQ ID NO: 3221692 - protein, 10 aa, Plasmodium falciparum
HEISKDNNYL

SEQ ID NO: 3221693 - protein, 8 aa, Plasmodium falciparum
HEKAEKDF

SEQ ID NO: 3221694 - protein, 11 aa, Plasmodium falciparum
HEKAKSEAKNY

SEQ ID NO: 3221695 - protein, 80 aa, Plasmodium falciparum
HEKDEADKCKQIQEECNKQKQQERGGPGGRSADPSPPADLDEHSSDEGEEDDDDDEEEENANEETAEDATEDTQVDGTEV

SEQ ID NO: 3221696 - protein, 18 aa, Plasmodium falciparum
HEKDKTKKKKQKKNKKKN

SEQ ID NO: 3221697 - protein, 5 aa, Plasmodium falciparum
HEKEK

SEQ ID NO: 3221698 - protein, 11 aa, Plasmodium falciparum
HEKETKKDNDK

SEQ ID NO: 3221699 - protein, 10 aa, Plasmodium falciparum
HEKGNDRTWS

SEQ ID NO: 3221700 - protein, 4 aa, Plasmodium falciparum
HEKK

SEQ ID NO: 3221701 - protein, 15 aa, Plasmodium falciparum
HEKKGDDEGDINNSE

SEQ ID NO: 3221702 - protein, 10 aa, Plasmodium falciparum
HEKKTSDDRI

SEQ ID NO: 3221703 - protein, 45 aa, Plasmodium falciparum
HEKNAGTNNNNNNNDNDNDNNNNNNNNNNNNNNNNNNNNNNNNNV

SEQ ID NO: 3221704 - protein, 8 aa, Plasmodium falciparum
HEKNDRSK

SEQ ID NO: 3221705 - protein, 13 aa, Plasmodium falciparum
HEKNDVEKNQNGH

SEQ ID NO: 3221706 - protein, 13 aa, Plasmodium falciparum
HEKNQEHNKINNY

SEQ ID NO: 3221707 - protein, 8 aa, Plasmodium falciparum
HEKRKQAV

SEQ ID NO: 3221708 - protein, 5 aa, Plasmodium falciparum
HEKRQ

SEQ ID NO: 3221709 - protein, 4 aa, Plasmodium falciparum
HEKS

SEQ ID NO: 3221710 - protein, 4 aa, Plasmodium falciparum
HELD

SEQ ID NO: 3221711 - protein, 34 aa, Plasmodium falciparum
HENDKKKKNSDKMSIKEKEQKNEKNEKNEEYDEC

SEQ ID NO: 3221712 - protein, 15 aa, Plasmodium falciparum
HENENENNHNKQRDT

SEQ ID NO: 3221713 - protein, 38 aa, Plasmodium falciparum
HENETKNELQSNSKNNNNNNNNNNNNNNNNNNNNYDDD

SEQ ID NO: 3221714 - protein, 6 aa, Plasmodium falciparum
HENIGK

SEQ ID NO: 3221715 - protein, 18 aa, Plasmodium falciparum
HENISSQKSSDEKDNNIE

SEQ ID NO: 3221716 - protein, 11 aa, Plasmodium falciparum
HENKNSHFSSD

SEQ ID NO: 3221717 - protein, 15 aa, Plasmodium falciparum
HENNCSSSNKAVDEE

SEQ ID NO: 3221718 - protein, 6 aa, Plasmodium falciparum
HENNEN

SEQ ID NO: 3221719 - protein, 7 aa, Plasmodium falciparum
HENNKNE

SEQ ID NO: 3221720 - protein, 10 aa, Plasmodium falciparum
HENPNDSFDQ

SEQ ID NO: 3221721 - protein, 5 aa, Plasmodium falciparum
HENRK

SEQ ID NO: 3221722 - protein, 7 aa, Plasmodium falciparum
HENSNKS

SEQ ID NO: 3221723 - protein, 11 aa, Plasmodium falciparum
HENTKIEEHKQ

SEQ ID NO: 3221724 - protein, 12 aa, Plasmodium falciparum
HENVSTKEEPNI

SEQ ID NO: 3221725 - protein, 5 aa, Plasmodium falciparum
HENYD

SEQ ID NO: 3221726 - protein, 6 aa, Plasmodium falciparum
HENYNE

SEQ ID NO: 3221727 - protein, 9 aa, Plasmodium falciparum
HEPISNESN

SEQ ID NO: 3221728 - protein, 7 aa, Plasmodium falciparum
HEPKDQG

SEQ ID NO: 3221729 - protein, 26 aa, Plasmodium falciparum
HEPNNNNNHINGTKKKNKNDNNDTKQ

SEQ ID NO: 3221730 - protein, 6 aa, Plasmodium falciparum
HEQEKK

SEQ ID NO: 3221731 - protein, 9 aa, Plasmodium falciparum
HEQNSQKIK

SEQ ID NO: 3221732 - protein, 23 aa, Plasmodium falciparum
HEQQSKDNHQGNREKKQKNGNHE

SEQ ID NO: 3221733 - protein, 12 aa, Plasmodium falciparum
HEQRGSNKKNKI

SEQ ID NO: 3221734 - protein, 12 aa, Plasmodium falciparum
HEQTGEKNINEN

SEQ ID NO: 3221735 - protein, 18 aa, Plasmodium falciparum
HEQTNNTTSSLGSSSSDI

SEQ ID NO: 3221736 - protein, 26 aa, Plasmodium falciparum
HEREHEGKNEGKNEHKNEHKNEHKNE

SEQ ID NO: 3221737 - protein, 16 aa, Plasmodium falciparum
HERNEQNRRYSNNNYS

SEQ ID NO: 3221738 - protein, 7 aa, Plasmodium falciparum
HERQSRK

SEQ ID NO: 3221739 - protein, 14 aa, Plasmodium falciparum
HESKDNELNEMKKK

SEQ ID NO: 3221740 - protein, 7 aa, Plasmodium falciparum
HESQFKE

SEQ ID NO: 3221741 - protein, 12 aa, Plasmodium falciparum
HESQQNIQKTHQ

SEQ ID NO: 3221742 - protein, 6 aa, Plasmodium falciparum
HESTHN

SEQ ID NO: 3221743 - protein, 10 aa, Plasmodium falciparum
HETESEPEGF

SEQ ID NO: 3221744 - protein, 6 aa, Plasmodium falciparum
HETETN

SEQ ID NO: 3221745 - protein, 8 aa, Plasmodium falciparum
HETGYKNK

SEQ ID NO: 3221746 - protein, 34 aa, Plasmodium falciparum
HEVKGADKNKDKNFNQNKGESQNVNPNTQQNQYD

SEQ ID NO: 3221747 - protein, 15 aa, Plasmodium falciparum
HEYCGGDGHDCTRDG

SEQ ID NO: 3221748 - protein, 17 aa, Plasmodium falciparum
HEYEELDTKEKSQEKPF

SEQ ID NO: 3221749 - protein, 14 aa, Plasmodium falciparum
HEYHKEQDNNINGS

SEQ ID NO: 3221750 - protein, 23 aa, Plasmodium falciparum
HEYNSNNSGSSSDGKKSNSSYSA

SEQ ID NO: 3221751 - protein, 34 aa, Plasmodium falciparum
HGDEEEDDEEDDEEDDEEDEEEEEEDEDEEDVED

SEQ ID NO: 3221752 - protein, 10 aa, Plasmodium falciparum
HGDKSEKVKP

SEQ ID NO: 3221753 - protein, 6 aa, Plasmodium falciparum
HGDNHS

SEQ ID NO: 3221754 - protein, 6 aa, Plasmodium falciparum
HGDPRA

SEQ ID NO: 3221755 - protein, 6 aa, Plasmodium falciparum
HGDSKT

SEQ ID NO: 3221756 - protein, 45 aa, Plasmodium falciparum
HGDYEDKNEYHGKSNIENNKDFPEQGQKDEEKEKEAKKKAEEFEK

SEQ ID NO: 3221757 - protein, 12 aa, Plasmodium falciparum
HGEAKKYKEALK

SEQ ID NO: 3221758 - protein, 6 aa, Plasmodium falciparum
HGEDKK

SEQ ID NO: 3221759 - protein, 5 aa, Plasmodium falciparum
HGEIS

SEQ ID NO: 3221760 - protein, 10 aa, Plasmodium falciparum
HGENHNLDKD

SEQ ID NO: 3221761 - protein, 7 aa, Plasmodium falciparum
HGENYSD

SEQ ID NO: 3221762 - protein, 7 aa, Plasmodium falciparum
HGEPCDR

SEQ ID NO: 3221763 - protein, 4 aa, Plasmodium falciparum
HGET

SEQ ID NO: 3221764 - protein, 7 aa, Plasmodium falciparum
HGGGDYN

SEQ ID NO: 3221765 - protein, 6 aa, Plasmodium falciparum
HGGKEM

SEQ ID NO: 3221766 - protein, 10 aa, Plasmodium falciparum
HGKDDTEEDY

SEQ ID NO: 3221767 - protein, 17 aa, Plasmodium falciparum
HGKEDIHSNEDIHSNED

SEQ ID NO: 3221768 - protein, 17 aa, Plasmodium falciparum
HGKNKEENENFSSDEEV

SEQ ID NO: 3221769 - protein, 14 aa, Plasmodium falciparum
HGKNNYNTANGEYV

SEQ ID NO: 3221770 - protein, 4 aa, Plasmodium falciparum
HGND

SEQ ID NO: 3221771 - protein, 10 aa, Plasmodium falciparum
HGNDGFKKES

SEQ ID NO: 3221772 - protein, 4 aa, Plasmodium falciparum
HGNI

SEQ ID NO: 3221773 - protein, 8 aa, Plasmodium falciparum
HGNKDEGL

SEQ ID NO: 3221774 - protein, 9 aa, Plasmodium falciparum
HGNNNNKTY

SEQ ID NO: 3221775 - protein, 18 aa, Plasmodium falciparum
HGNSYDKYNTSKHNRRKN

SEQ ID NO: 3221776 - protein, 24 aa, Plasmodium falciparum
HGNTNETKYKKNKYPKDDAKTKQK

SEQ ID NO: 3221777 - protein, 5 aa, Plasmodium falciparum
HGPER

SEQ ID NO: 3221778 - protein, 7 aa, Plasmodium falciparum
HGPSGHD

SEQ ID NO: 3221779 - protein, 5 aa, Plasmodium falciparum
HGQDQ

SEQ ID NO: 3221780 - protein, 41 aa, Plasmodium falciparum
HGQEDGKEYNGDDDHNNKNNAHDDDDDDDDDDDEDEENYED

SEQ ID NO: 3221781 - protein, 10 aa, Plasmodium falciparum
HGRKQKEKIK

SEQ ID NO: 3221782 - protein, 6 aa, Plasmodium falciparum
HGRNTF

SEQ ID NO: 3221783 - protein, 9 aa, Plasmodium falciparum
HGRTGPLRG

SEQ ID NO: 3221784 - protein, 28 aa, Plasmodium falciparum
HGRVKSNDENTKSTEHIKNKNTINKGYD

SEQ ID NO: 3221785 - protein, 6 aa, Plasmodium falciparum
HGSDIN

SEQ ID NO: 3221786 - protein, 5 aa, Plasmodium falciparum
HGSKE

SEQ ID NO: 3221787 - protein, 12 aa, Plasmodium falciparum
HGSKKRGADHSE

SEQ ID NO: 3221788 - protein, 7 aa, Plasmodium falciparum
HGSNDYS

SEQ ID NO: 3221789 - protein, 17 aa, Plasmodium falciparum
HGTHINNSDVSQNFSNN

SEQ ID NO: 3221790 - protein, 10 aa, Plasmodium falciparum
HGTPASTAIR

SEQ ID NO: 3221791 - protein, 4 aa, Plasmodium falciparum
HGYG

SEQ ID NO: 3221792 - protein, 21 aa, Plasmodium falciparum
HGYNSNKKKNSNNNVDHDNIN

SEQ ID NO: 3221793 - protein, 12 aa, Plasmodium falciparum
HHEKFEDEQEDG

SEQ ID NO: 3221794 - protein, 38 aa, Plasmodium falciparum
HHENSNAKEDDNESEKKELESHNETEVSNNDQEKKNIS

SEQ ID NO: 3221795 - protein, 67 aa, Plasmodium falciparum
HHGKKNKKNKKSKTSKKDNLNQKYNDEQMKEKDNNKKIQNKNNVNNDNNSNNNYYSDSNGHLSSTSN

SEQ ID NO: 3221796 - protein, 14 aa, Plasmodium falciparum
HHGNRQDRGGNSGN

SEQ ID NO: 3221797 - protein, 19 aa, Plasmodium falciparum
HHGRKKKNKKKNKKKQNIK

SEQ ID NO: 3221798 - protein, 14 aa, Plasmodium falciparum
HHHNNNSNNNVEGN

SEQ ID NO: 3221799 - protein, 5 aa, Plasmodium falciparum
HHKKK

SEQ ID NO: 3221800 - protein, 16 aa, Plasmodium falciparum
HHKNEQKMDDTQTNDT

SEQ ID NO: 3221801 - protein, 9 aa, Plasmodium falciparum
HHKNKTDKY

SEQ ID NO: 3221802 - protein, 4 aa, Plasmodium falciparum
HHLP

SEQ ID NO: 3221803 - protein, 21 aa, Plasmodium falciparum
HHNDDHNDHHNDHNKEDNMDN

SEQ ID NO: 3221804 - protein, 8 aa, Plasmodium falciparum
HHNEDNLN

SEQ ID NO: 3221805 - protein, 9 aa, Plasmodium falciparum
HHNKTQGNF

SEQ ID NO: 3221806 - protein, 7 aa, Plasmodium falciparum
HHNNNSN

SEQ ID NO: 3221807 - protein, 10 aa, Plasmodium falciparum
HHSEAEGRNK

SEQ ID NO: 3221808 - protein, 4 aa, Plasmodium falciparum
HHSN

SEQ ID NO: 3221809 - protein, 10 aa, Plasmodium falciparum
HHTNDKNELY

SEQ ID NO: 3221810 - protein, 7 aa, Plasmodium falciparum
HHTNKSD

SEQ ID NO: 3221811 - protein, 5 aa, Plasmodium falciparum
HIDKS

SEQ ID NO: 3221812 - protein, 4 aa, Plasmodium falciparum
HIDY

SEQ ID NO: 3221813 - protein, 6 aa, Plasmodium falciparum
HIEGSD

SEQ ID NO: 3221814 - protein, 11 aa, Plasmodium falciparum
HIEKNNKNEEI

SEQ ID NO: 3221815 - protein, 7 aa, Plasmodium falciparum
HIENEKK

SEQ ID NO: 3221816 - protein, 6 aa, Plasmodium falciparum
HIGKSG

SEQ ID NO: 3221817 - protein, 42 aa, Plasmodium falciparum
HIKENTKECTKENTKENTKDNTKENTKENTKEYTKDNTKNQY

SEQ ID NO: 3221818 - protein, 11 aa, Plasmodium falciparum
HINNDKNNNNN

SEQ ID NO: 3221819 - protein, 10 aa, Plasmodium falciparum
HINNKSTKNF

SEQ ID NO: 3221820 - protein, 18 aa, Plasmodium falciparum
HINNNNNNNNVKNNDNNM

SEQ ID NO: 3221821 - protein, 42 aa, Plasmodium falciparum
HINNSQTENRKDSLKKNSLNDTKNNDNIDTNNNNNKKKKKLI

SEQ ID NO: 3221822 - protein, 11 aa, Plasmodium falciparum
HINSNSQAQNT

SEQ ID NO: 3221823 - protein, 11 aa, Plasmodium falciparum
HIPEDDPRNPA

SEQ ID NO: 3221824 - protein, 26 aa, Plasmodium falciparum
HIQPQTSTQTLTQSPTQSSTSKPCNY

SEQ ID NO: 3221825 - protein, 20 aa, Plasmodium falciparum
HIREKEKEEKKKKREKMKNE

SEQ ID NO: 3221826 - protein, 4 aa, Plasmodium falciparum
HISN

SEQ ID NO: 3221827 - protein, 5 aa, Plasmodium falciparum
HISNN

SEQ ID NO: 3221828 - protein, 12 aa, Plasmodium falciparum
HISSSDNNKINK

SEQ ID NO: 3221829 - protein, 7 aa, Plasmodium falciparum
HISSSQQ

SEQ ID NO: 3221830 - protein, 12 aa, Plasmodium falciparum
HITKEGNHISNN

SEQ ID NO: 3221831 - protein, 9 aa, Plasmodium falciparum
HITTPNKRS

SEQ ID NO: 3221832 - protein, 9 aa, Plasmodium falciparum
HKAERTKKS

SEQ ID NO: 3221833 - protein, 9 aa, Plasmodium falciparum
HKAKKGHKK

SEQ ID NO: 3221834 - protein, 10 aa, Plasmodium falciparum
HKAKTNKLKN

SEQ ID NO: 3221835 - protein, 4 aa, Plasmodium falciparum
HKDD

SEQ ID NO: 3221836 - protein, 15 aa, Plasmodium falciparum
HKDGNITNEQDKNRI

SEQ ID NO: 3221837 - protein, 8 aa, Plasmodium falciparum
HKDKKGAY

SEQ ID NO: 3221838 - protein, 4 aa, Plasmodium falciparum
HKDS

SEQ ID NO: 3221839 - protein, 9 aa, Plasmodium falciparum
HKEEEGSVA

SEQ ID NO: 3221840 - protein, 17 aa, Plasmodium falciparum
HKEEGEKNTINKTKQIN

SEQ ID NO: 3221841 - protein, 10 aa, Plasmodium falciparum
HKEEKNVTDK

SEQ ID NO: 3221842 - protein, 13 aa, Plasmodium falciparum
HKEIKKESEQINK

SEQ ID NO: 3221843 - protein, 10 aa, Plasmodium falciparum
HKEISDNDDI

SEQ ID NO: 3221844 - protein, 8 aa, Plasmodium falciparum
HKEKDKKN

SEQ ID NO: 3221845 - protein, 5 aa, Plasmodium falciparum
HKEKK

SEQ ID NO: 3221846 - protein, 10 aa, Plasmodium falciparum
HKEKKNKKKN

SEQ ID NO: 3221847 - protein, 18 aa, Plasmodium falciparum
HKEKKRNCSSNTNKNNIS

SEQ ID NO: 3221848 - protein, 6 aa, Plasmodium falciparum
HKEKNK

SEQ ID NO: 3221849 - protein, 42 aa, Plasmodium falciparum
HKENNNNNNNNNNNNNNNNNNNNNNNNNNNNNNNNNNKKSKK

SEQ ID NO: 3221850 - protein, 4 aa, Plasmodium falciparum
HKEP

SEQ ID NO: 3221851 - protein, 7 aa, Plasmodium falciparum
HKEQNYM

SEQ ID NO: 3221852 - protein, 9 aa, Plasmodium falciparum
HKESEHVQD

SEQ ID NO: 3221853 - protein, 5 aa, Plasmodium falciparum
HKESN

SEQ ID NO: 3221854 - protein, 8 aa, Plasmodium falciparum
HKGENSMA

SEQ ID NO: 3221855 - protein, 10 aa, Plasmodium falciparum
HKGRDIDENR

SEQ ID NO: 3221856 - protein, 12 aa, Plasmodium falciparum
HKHEHNSNDKVV

SEQ ID NO: 3221857 - protein, 12 aa, Plasmodium falciparum
HKHKKKQKKNSK

SEQ ID NO: 3221858 - protein, 6 aa, Plasmodium falciparum
HKHNKR

SEQ ID NO: 3221859 - protein, 13 aa, Plasmodium falciparum
HKHNSKNKRKQQN

SEQ ID NO: 3221860 - protein, 9 aa, Plasmodium falciparum
HKIKNNTDN

SEQ ID NO: 3221861 - protein, 6 aa, Plasmodium falciparum
HKINPS

SEQ ID NO: 3221862 - protein, 19 aa, Plasmodium falciparum
HKISKKGSKLSDKRKSSNV

SEQ ID NO: 3221863 - protein, 7 aa, Plasmodium falciparum
HKIYDEK

SEQ ID NO: 3221864 - protein, 17 aa, Plasmodium falciparum
HKIYDENDKNKIYDEKD

SEQ ID NO: 3221865 - protein, 35 aa, Plasmodium falciparum
HKIYDENDKNKIYDEKDKNKIYDEKDKNKIYDEND

SEQ ID NO: 3221866 - protein, 4 aa, Plasmodium falciparum
HKKD

SEQ ID NO: 3221867 - protein, 6 aa, Plasmodium falciparum
HKKDSN

SEQ ID NO: 3221868 - protein, 16 aa, Plasmodium falciparum
HKKDTITSLDTDDTLR

SEQ ID NO: 3221869 - protein, 8 aa, Plasmodium falciparum
HKKDYRSS

SEQ ID NO: 3221870 - protein, 21 aa, Plasmodium falciparum
HKKECSKDATFSNNKGDDNGH

SEQ ID NO: 3221871 - protein, 26 aa, Plasmodium falciparum
HKKEECNYNDKKNVTEHSKKSRKNFK

SEQ ID NO: 3221872 - protein, 10 aa, Plasmodium falciparum
HKKENGDDML

SEQ ID NO: 3221873 - protein, 9 aa, Plasmodium falciparum
HKKENSENY

SEQ ID NO: 3221874 - protein, 9 aa, Plasmodium falciparum
HKKEPKQKN

SEQ ID NO: 3221875 - protein, 16 aa, Plasmodium falciparum
HKKEQLTNRTKGAEKK

SEQ ID NO: 3221876 - protein, 6 aa, Plasmodium falciparum
HKKERK

SEQ ID NO: 3221877 - protein, 8 aa, Plasmodium falciparum
HKKEVNNK

SEQ ID NO: 3221878 - protein, 9 aa, Plasmodium falciparum
HKKGGTHMS

SEQ ID NO: 3221879 - protein, 18 aa, Plasmodium falciparum
HKKHKDKNVKDIKKETND

SEQ ID NO: 3221880 - protein, 11 aa, Plasmodium falciparum
HKKKKKKKKGN

SEQ ID NO: 3221881 - protein, 9 aa, Plasmodium falciparum
HKKKKKKNL

SEQ ID NO: 3221882 - protein, 17 aa, Plasmodium falciparum
HKKKKYKKTENNDSQFN

SEQ ID NO: 3221883 - protein, 7 aa, Plasmodium falciparum
HKKKTSF

SEQ ID NO: 3221884 - protein, 9 aa, Plasmodium falciparum
HKKNEEYHK

SEQ ID NO: 3221885 - protein, 16 aa, Plasmodium falciparum
HKKPKRNTNENIKERN

SEQ ID NO: 3221886 - protein, 18 aa, Plasmodium falciparum
HKKQNLSDLSSDTSTGTY

SEQ ID NO: 3221887 - protein, 17 aa, Plasmodium falciparum
HKKQSNTRSDEKMNSSY

SEQ ID NO: 3221888 - protein, 6 aa, Plasmodium falciparum
HKKRES

SEQ ID NO: 3221889 - protein, 11 aa, Plasmodium falciparum
HKKRSSNENCT

SEQ ID NO: 3221890 - protein, 10 aa, Plasmodium falciparum
HKKYGNKLGS

SEQ ID NO: 3221891 - protein, 39 aa, Plasmodium falciparum
HKKYNDKKYNQKENNNNNNNTTSSNNSNSNSNSSNNRPN

SEQ ID NO: 3221892 - protein, 6 aa, Plasmodium falciparum
HKKYYT

SEQ ID NO: 3221893 - protein, 11 aa, Plasmodium falciparum
HKLDNNNSSSQ

SEQ ID NO: 3221894 - protein, 16 aa, Plasmodium falciparum
HKLSNYNDNGDSKYTK

SEQ ID NO: 3221895 - protein, 6 aa, Plasmodium falciparum
HKLSSN

SEQ ID NO: 3221896 - protein, 9 aa, Plasmodium falciparum
HKNATYSDD

SEQ ID NO: 3221897 - protein, 59 aa, Plasmodium falciparum
HKNDDNHMNSDNHKNDEYHKNDEYHKNDEDHNDDNYDNHADGDKRSKERKSKIQTTNES

SEQ ID NO: 3221898 - protein, 24 aa, Plasmodium falciparum
HKNDQEENMEGDNKNEQKKKDEDF

SEQ ID NO: 3221899 - protein, 18 aa, Plasmodium falciparum
HKNDSINENVRNKSTITQ

SEQ ID NO: 3221900 - protein, 30 aa, Plasmodium falciparum
HKNDSNNLSFSSSQKLNNNDGDNSYDNEND

SEQ ID NO: 3221901 - protein, 4 aa, Plasmodium falciparum
HKNE

SEQ ID NO: 3221902 - protein, 38 aa, Plasmodium falciparum
HKNEHNNNKKEDEKRKREKKNTYTTNHDKRENNNTHIN

SEQ ID NO: 3221903 - protein, 70 aa, Plasmodium falciparum
HKNGDTHKNDEAHQNGDTHKNDEAHQNGETHQNGGTHQNGGTHQNDEAHQNDEAHQNDEAHQNNETHQKH

SEQ ID NO: 3221904 - protein, 4 aa, Plasmodium falciparum
HKNK

SEQ ID NO: 3221905 - protein, 16 aa, Plasmodium falciparum
HKNKENDFSSNDQNIS

SEQ ID NO: 3221906 - protein, 8 aa, Plasmodium falciparum
HKNKEPQN

SEQ ID NO: 3221907 - protein, 6 aa, Plasmodium falciparum
HKNKHH

SEQ ID NO: 3221908 - protein, 12 aa, Plasmodium falciparum
HKNKKEKTTPNS

SEQ ID NO: 3221909 - protein, 8 aa, Plasmodium falciparum
HKNKKKTN

SEQ ID NO: 3221910 - protein, 19 aa, Plasmodium falciparum
HKNKMKNEKNKKAGSQEIQ

SEQ ID NO: 3221911 - protein, 9 aa, Plasmodium falciparum
HKNKNDDTI

SEQ ID NO: 3221912 - protein, 15 aa, Plasmodium falciparum
HKNKNENNKTERNHK

SEQ ID NO: 3221913 - protein, 11 aa, Plasmodium falciparum
HKNKNNNLKNK

SEQ ID NO: 3221914 - protein, 7 aa, Plasmodium falciparum
HKNKPIK

SEQ ID NO: 3221915 - protein, 36 aa, Plasmodium falciparum
HKNKTKQKSDCKKKCSNNQLSKSNNNNVVGESNNSL

SEQ ID NO: 3221916 - protein, 9 aa, Plasmodium falciparum
HKNNDKRNS

SEQ ID NO: 3221917 - protein, 10 aa, Plasmodium falciparum
HKNNEDAGDF

SEQ ID NO: 3221918 - protein, 26 aa, Plasmodium falciparum
HKNNIKTKHDEESCSETYNSPINNAP

SEQ ID NO: 3221919 - protein, 57 aa, Plasmodium falciparum
HKNNNDNNMNSNKNNNDNNMNSNNNNNDNNMNSNNNNNDNNMNSNNNNNNNYNSSSD

SEQ ID NO: 3221920 - protein, 6 aa, Plasmodium falciparum
HKNNNI

SEQ ID NO: 3221921 - protein, 12 aa, Plasmodium falciparum
HKNNNNDNNNDN

SEQ ID NO: 3221922 - protein, 9 aa, Plasmodium falciparum
HKNNNSNHS

SEQ ID NO: 3221923 - protein, 10 aa, Plasmodium falciparum
HKNNNSSDCG

SEQ ID NO: 3221924 - protein, 17 aa, Plasmodium falciparum
HKNNNTYGNNKCNSNYP

SEQ ID NO: 3221925 - protein, 8 aa, Plasmodium falciparum
HKNNPTFS

SEQ ID NO: 3221926 - protein, 6 aa, Plasmodium falciparum
HKNNTS

SEQ ID NO: 3221927 - protein, 5 aa, Plasmodium falciparum
HKNSK

SEQ ID NO: 3221928 - protein, 22 aa, Plasmodium falciparum
HKNSRKKKTKKKRSVDNSPQSY

SEQ ID NO: 3221929 - protein, 8 aa, Plasmodium falciparum
HKNTQNNI

SEQ ID NO: 3221930 - protein, 8 aa, Plasmodium falciparum
HKPNGKHN

SEQ ID NO: 3221931 - protein, 13 aa, Plasmodium falciparum
HKPSSSVYNKRNK

SEQ ID NO: 3221932 - protein, 4 aa, Plasmodium falciparum
HKPV

SEQ ID NO: 3221933 - protein, 4 aa, Plasmodium falciparum
HKPY

SEQ ID NO: 3221934 - protein, 8 aa, Plasmodium falciparum
HKQEKNTK

SEQ ID NO: 3221935 - protein, 10 aa, Plasmodium falciparum
HKQKDSNQDS

SEQ ID NO: 3221936 - protein, 7 aa, Plasmodium falciparum
HKQKNKK

SEQ ID NO: 3221937 - protein, 5 aa, Plasmodium falciparum
HKQKR

SEQ ID NO: 3221938 - protein, 5 aa, Plasmodium falciparum
HKQNL

SEQ ID NO: 3221939 - protein, 20 aa, Plasmodium falciparum
HKQPGKDIYSSDNIKSDKTI

SEQ ID NO: 3221940 - protein, 6 aa, Plasmodium falciparum
HKQQQC

SEQ ID NO: 3221941 - protein, 8 aa, Plasmodium falciparum
HKQTNDCT

SEQ ID NO: 3221942 - protein, 10 aa, Plasmodium falciparum
HKRDKEHNIN

SEQ ID NO: 3221943 - protein, 4 aa, Plasmodium falciparum
HKRE

SEQ ID NO: 3221944 - protein, 6 aa, Plasmodium falciparum
HKRGGR

SEQ ID NO: 3221945 - protein, 12 aa, Plasmodium falciparum
HKRKKQKEKKLQ

SEQ ID NO: 3221946 - protein, 9 aa, Plasmodium falciparum
HKRNESYED

SEQ ID NO: 3221947 - protein, 14 aa, Plasmodium falciparum
HKRYDNDNDNYTYN

SEQ ID NO: 3221948 - protein, 11 aa, Plasmodium falciparum
HKSDNEENSKK

SEQ ID NO: 3221949 - protein, 33 aa, Plasmodium falciparum
HKSDNKDEGNDKKGSNDSKNKSQEGSTPLLTAK

SEQ ID NO: 3221950 - protein, 5 aa, Plasmodium falciparum
HKSEK

SEQ ID NO: 3221951 - protein, 7 aa, Plasmodium falciparum
HKSERKI

SEQ ID NO: 3221952 - protein, 30 aa, Plasmodium falciparum
HKSNDNKHHKNNKHNNKHYNNNNDDDDDND

SEQ ID NO: 3221953 - protein, 8 aa, Plasmodium falciparum
HKSPIPHK

SEQ ID NO: 3221954 - protein, 7 aa, Plasmodium falciparum
HKSSDIN

SEQ ID NO: 3221955 - protein, 8 aa, Plasmodium falciparum
HKSSKKNY

SEQ ID NO: 3221956 - protein, 14 aa, Plasmodium falciparum
HKTAMKKYKSKNVS

SEQ ID NO: 3221957 - protein, 16 aa, Plasmodium falciparum
HKTATSCPSHNDIDNE

SEQ ID NO: 3221958 - protein, 6 aa, Plasmodium falciparum
HKTDKY

SEQ ID NO: 3221959 - protein, 6 aa, Plasmodium falciparum
HKTNET

SEQ ID NO: 3221960 - protein, 11 aa, Plasmodium falciparum
HKTNIDPSQIK

SEQ ID NO: 3221961 - protein, 12 aa, Plasmodium falciparum
HKTNKYNNYPFN

SEQ ID NO: 3221962 - protein, 8 aa, Plasmodium falciparum
HKTQNKKK

SEQ ID NO: 3221963 - protein, 25 aa, Plasmodium falciparum
HKTSQLNSSANQGDINNNAKQVGGL

SEQ ID NO: 3221964 - protein, 6 aa, Plasmodium falciparum
HKTSSS

SEQ ID NO: 3221965 - protein, 10 aa, Plasmodium falciparum
HKTTKAPKHK

SEQ ID NO: 3221966 - protein, 6 aa, Plasmodium falciparum
HKTTQS

SEQ ID NO: 3221967 - protein, 15 aa, Plasmodium falciparum
HKTTRKKHKDNPDYE

SEQ ID NO: 3221968 - protein, 6 aa, Plasmodium falciparum
HKTTSK

SEQ ID NO: 3221969 - protein, 8 aa, Plasmodium falciparum
HKTYDTEN

SEQ ID NO: 3221970 - protein, 13 aa, Plasmodium falciparum
HKVKKKKKKHQRK

SEQ ID NO: 3221971 - protein, 32 aa, Plasmodium falciparum
HKVTQNGNDGQTTNDDYDNHNESKNKTDGSYM

SEQ ID NO: 3221972 - protein, 9 aa, Plasmodium falciparum
HKYEKNQNI

SEQ ID NO: 3221973 - protein, 13 aa, Plasmodium falciparum
HKYNTNTDSNNID

SEQ ID NO: 3221974 - protein, 7 aa, Plasmodium falciparum
HKYQGEY

SEQ ID NO: 3221975 - protein, 12 aa, Plasmodium falciparum
HKYTDENINSNI

SEQ ID NO: 3221976 - protein, 6 aa, Plasmodium falciparum
HLDSTN

SEQ ID NO: 3221977 - protein, 15 aa, Plasmodium falciparum
HLKEDEKNKHSENPA

SEQ ID NO: 3221978 - protein, 11 aa, Plasmodium falciparum
HLNDEDKVEAE

SEQ ID NO: 3221979 - protein, 6 aa, Plasmodium falciparum
HLNNKQ

SEQ ID NO: 3221980 - protein, 23 aa, Plasmodium falciparum
HLNNRKDNSNDDAELKKKNEKIE

SEQ ID NO: 3221981 - protein, 9 aa, Plasmodium falciparum
HLSKYGKSN

SEQ ID NO: 3221982 - protein, 8 aa, Plasmodium falciparum
HLTNNTDD

SEQ ID NO: 3221983 - protein, 13 aa, Plasmodium falciparum
HMDDTSDDENNNI

SEQ ID NO: 3221984 - protein, 11 aa, Plasmodium falciparum
HMKNDDEENSY

SEQ ID NO: 3221985 - protein, 4 aa, Plasmodium falciparum
HMNR

SEQ ID NO: 3221986 - protein, 10 aa, Plasmodium falciparum
HMNSTSQYNM

SEQ ID NO: 3221987 - protein, 4 aa, Plasmodium falciparum
HMSK

SEQ ID NO: 3221988 - protein, 14 aa, Plasmodium falciparum
HMSPQKNDNDMNKI

SEQ ID NO: 3221989 - protein, 6 aa, Plasmodium falciparum
HNAEYN

SEQ ID NO: 3221990 - protein, 20 aa, Plasmodium falciparum
HNCSSGGNTQGKCDGKTTIA

SEQ ID NO: 3221991 - protein, 10 aa, Plasmodium falciparum
HNDDSSDTWS

SEQ ID NO: 3221992 - protein, 6 aa, Plasmodium falciparum
HNDEIS

SEQ ID NO: 3221993 - protein, 15 aa, Plasmodium falciparum
HNDIHNDKHNDKHND

SEQ ID NO: 3221994 - protein, 10 aa, Plasmodium falciparum
HNDKNINDKF

SEQ ID NO: 3221995 - protein, 7 aa, Plasmodium falciparum
HNDKSEL

SEQ ID NO: 3221996 - protein, 10 aa, Plasmodium falciparum
HNDNKIDNYK

SEQ ID NO: 3221997 - protein, 11 aa, Plasmodium falciparum
HNDNNKEIITQ

SEQ ID NO: 3221998 - protein, 8 aa, Plasmodium falciparum
HNDNNNDN

SEQ ID NO: 3221999 - protein, 15 aa, Plasmodium falciparum
HNDNSDNDNRKTTLG

SEQ ID NO: 3222000 - protein, 12 aa, Plasmodium falciparum
HNDQMKEEEESE

SEQ ID NO: 3222001 - protein, 13 aa, Plasmodium falciparum
HNDRRNKNKKVEH

SEQ ID NO: 3222002 - protein, 4 aa, Plasmodium falciparum
HNDT

SEQ ID NO: 3222003 - protein, 12 aa, Plasmodium falciparum
HNEDKNQETPQY

SEQ ID NO: 3222004 - protein, 6 aa, Plasmodium falciparum
HNEDKT

SEQ ID NO: 3222005 - protein, 6 aa, Plasmodium falciparum
HNEDSG

SEQ ID NO: 3222006 - protein, 6 aa, Plasmodium falciparum
HNEDSN

SEQ ID NO: 3222007 - protein, 13 aa, Plasmodium falciparum
HNEDSNNLTKCDE

SEQ ID NO: 3222008 - protein, 10 aa, Plasmodium falciparum
HNEERKQKKN

SEQ ID NO: 3222009 - protein, 19 aa, Plasmodium falciparum
HNEEVKKKDNKNEKEVEQQ

SEQ ID NO: 3222010 - protein, 4 aa, Plasmodium falciparum
HNEI

SEQ ID NO: 3222011 - protein, 20 aa, Plasmodium falciparum
HNEKPTSSSMEQKNSNNNVS

SEQ ID NO: 3222012 - protein, 6 aa, Plasmodium falciparum
HNEKQT

SEQ ID NO: 3222013 - protein, 8 aa, Plasmodium falciparum
HNEKSKNY

SEQ ID NO: 3222014 - protein, 35 aa, Plasmodium falciparum
HNENMSDPNTNTEPDASLKDDKKEVDDAKKELQST

SEQ ID NO: 3222015 - protein, 9 aa, Plasmodium falciparum
HNENNGNIN

SEQ ID NO: 3222016 - protein, 7 aa, Plasmodium falciparum
HNENPKD

SEQ ID NO: 3222017 - protein, 19 aa, Plasmodium falciparum
HNEQNDKKHDTSPADINNK

SEQ ID NO: 3222018 - protein, 8 aa, Plasmodium falciparum
HNEQYDKS

SEQ ID NO: 3222019 - protein, 6 aa, Plasmodium falciparum
HNESSS

SEQ ID NO: 3222020 - protein, 14 aa, Plasmodium falciparum
HNEYSKEKKNITNI

SEQ ID NO: 3222021 - protein, 4 aa, Plasmodium falciparum
HNGG

SEQ ID NO: 3222022 - protein, 7 aa, Plasmodium falciparum
HNGKDNI

SEQ ID NO: 3222023 - protein, 9 aa, Plasmodium falciparum
HNGNDNGEY

SEQ ID NO: 3222024 - protein, 22 aa, Plasmodium falciparum
HNGSEWKEKNNGQCKGGKRYTI

SEQ ID NO: 3222025 - protein, 15 aa, Plasmodium falciparum
HNGSSSNNNNNNNSV

SEQ ID NO: 3222026 - protein, 23 aa, Plasmodium falciparum
HNHKSDNNHKSDHNHKSDSNHMS

SEQ ID NO: 3222027 - protein, 45 aa, Plasmodium falciparum
HNHKSDNNHKSDNNHMSDHNHKSDNNHKSDNNHKSDNNHKSDHNH

SEQ ID NO: 3222028 - protein, 129 aa, Plasmodium falciparum
HNHKSDNNHKSDSSHKSDSSHKSDSSHKSGSNHKSDNNHKSDSSHKSGSNHKSDHNHKSDSNHKSDSNHKNESNHKNESNHKNESNHKNESNHKNESNHKNDSNHKSDSNHMSDHNHKSDNNHKSDHNH

SEQ ID NO: 3222029 - protein, 18 aa, Plasmodium falciparum
HNHNQNQKDSTKLQEQDI

SEQ ID NO: 3222030 - protein, 35 aa, Plasmodium falciparum
HNHSNNNNDNMKQSSGEKNTTTTKHTSRNNYNNDT

SEQ ID NO: 3222031 - protein, 4 aa, Plasmodium falciparum
HNHV

SEQ ID NO: 3222032 - protein, 4 aa, Plasmodium falciparum
HNIE

SEQ ID NO: 3222033 - protein, 8 aa, Plasmodium falciparum
HNISTNNQ

SEQ ID NO: 3222034 - protein, 5 aa, Plasmodium falciparum
HNKDP

SEQ ID NO: 3222035 - protein, 7 aa, Plasmodium falciparum
HNKDPSS

SEQ ID NO: 3222036 - protein, 4 aa, Plasmodium falciparum
HNKE

SEQ ID NO: 3222037 - protein, 5 aa, Plasmodium falciparum
HNKEE

SEQ ID NO: 3222038 - protein, 21 aa, Plasmodium falciparum
HNKEKEKKNGKDNDQCENNKI

SEQ ID NO: 3222039 - protein, 13 aa, Plasmodium falciparum
HNKENNNNSSNLE

SEQ ID NO: 3222040 - protein, 7 aa, Plasmodium falciparum
HNKIERK

SEQ ID NO: 3222041 - protein, 21 aa, Plasmodium falciparum
HNKKEDKKKENMKVNKRKSKT

SEQ ID NO: 3222042 - protein, 21 aa, Plasmodium falciparum
HNKKSKNRKTIKSSQRKSHPN

SEQ ID NO: 3222043 - protein, 9 aa, Plasmodium falciparum
HNKNDNKYI

SEQ ID NO: 3222044 - protein, 5 aa, Plasmodium falciparum
HNKNI

SEQ ID NO: 3222045 - protein, 19 aa, Plasmodium falciparum
HNKNKASITPHHTRSTTSR

SEQ ID NO: 3222046 - protein, 19 aa, Plasmodium falciparum
HNKNKPSITPHHTRSTTSR

SEQ ID NO: 3222047 - protein, 16 aa, Plasmodium falciparum
HNKNKPSITSHHTPRY

SEQ ID NO: 3222048 - protein, 9 aa, Plasmodium falciparum
HNKNKPYIT

SEQ ID NO: 3222049 - protein, 17 aa, Plasmodium falciparum
HNKNMNKNVNNKNSVSL

SEQ ID NO: 3222050 - protein, 19 aa, Plasmodium falciparum
HNKQSPDNNNNNNNNNTDV

SEQ ID NO: 3222051 - protein, 5 aa, Plasmodium falciparum
HNKRN

SEQ ID NO: 3222052 - protein, 24 aa, Plasmodium falciparum
HNKSKSNNNYNSFSNYSSDSIYSS

SEQ ID NO: 3222053 - protein, 5 aa, Plasmodium falciparum
HNKSN

SEQ ID NO: 3222054 - protein, 9 aa, Plasmodium falciparum
HNKSSPIAQ

SEQ ID NO: 3222055 - protein, 17 aa, Plasmodium falciparum
HNKTNSSNTLQGNDREA

SEQ ID NO: 3222056 - protein, 6 aa, Plasmodium falciparum
HNLDSN

SEQ ID NO: 3222057 - protein, 4 aa, Plasmodium falciparum
HNLE

SEQ ID NO: 3222058 - protein, 4 aa, Plasmodium falciparum
HNLN

SEQ ID NO: 3222059 - protein, 14 aa, Plasmodium falciparum
HNLPKEKNISTYTD

SEQ ID NO: 3222060 - protein, 7 aa, Plasmodium falciparum
HNLSKGQ

SEQ ID NO: 3222061 - protein, 5 aa, Plasmodium falciparum
HNNDD

SEQ ID NO: 3222062 - protein, 8 aa, Plasmodium falciparum
HNNDDDKI

SEQ ID NO: 3222063 - protein, 6 aa, Plasmodium falciparum
HNNDHN

SEQ ID NO: 3222064 - protein, 19 aa, Plasmodium falciparum
HNNDHNNDHNSGHNNNNDT

SEQ ID NO: 3222065 - protein, 11 aa, Plasmodium falciparum
HNNDNNQEDNN

SEQ ID NO: 3222066 - protein, 10 aa, Plasmodium falciparum
HNNENTKNTL

SEQ ID NO: 3222067 - protein, 6 aa, Plasmodium falciparum
HNNGHN

SEQ ID NO: 3222068 - protein, 13 aa, Plasmodium falciparum
HNNHSSKGNHTNK

SEQ ID NO: 3222069 - protein, 4 aa, Plasmodium falciparum
HNNI

SEQ ID NO: 3222070 - protein, 8 aa, Plasmodium falciparum
HNNKEGGY

SEQ ID NO: 3222071 - protein, 11 aa, Plasmodium falciparum
HNNKNKNKNMN

SEQ ID NO: 3222072 - protein, 11 aa, Plasmodium falciparum
HNNKQNNDFNN

SEQ ID NO: 3222073 - protein, 6 aa, Plasmodium falciparum
HNNKVE

SEQ ID NO: 3222074 - protein, 5 aa, Plasmodium falciparum
HNNKY

SEQ ID NO: 3222075 - protein, 10 aa, Plasmodium falciparum
HNNLSSHNNL

SEQ ID NO: 3222076 - protein, 5 aa, Plasmodium falciparum
HNNND

SEQ ID NO: 3222077 - protein, 11 aa, Plasmodium falciparum
HNNNDACGDTS

SEQ ID NO: 3222078 - protein, 8 aa, Plasmodium falciparum
HNNNDDNY

SEQ ID NO: 3222079 - protein, 9 aa, Plasmodium falciparum
HNNNGLKKN

SEQ ID NO: 3222080 - protein, 10 aa, Plasmodium falciparum
HNNNHNNNHN

SEQ ID NO: 3222081 - protein, 9 aa, Plasmodium falciparum
HNNNHNQNV

SEQ ID NO: 3222082 - protein, 7 aa, Plasmodium falciparum
HNNNINN

SEQ ID NO: 3222083 - protein, 6 aa, Plasmodium falciparum
HNNNKE

SEQ ID NO: 3222084 - protein, 6 aa, Plasmodium falciparum
HNNNKI

SEQ ID NO: 3222085 - protein, 26 aa, Plasmodium falciparum
HNNNKKNNKKKKKDDLHEHNNKEKLQ

SEQ ID NO: 3222086 - protein, 10 aa, Plasmodium falciparum
HNNNKKSLYK

SEQ ID NO: 3222087 - protein, 19 aa, Plasmodium falciparum
HNNNKNNYYDDDNKSCSSK

SEQ ID NO: 3222088 - protein, 26 aa, Plasmodium falciparum
HNNNKSNNNYNNNNNECNNNNYHNDS

SEQ ID NO: 3222089 - protein, 6 aa, Plasmodium falciparum
HNNNMS

SEQ ID NO: 3222090 - protein, 7 aa, Plasmodium falciparum
HNNNNDN

SEQ ID NO: 3222091 - protein, 22 aa, Plasmodium falciparum
HNNNNDNIKYDGAHNNNNDNIK

SEQ ID NO: 3222092 - protein, 35 aa, Plasmodium falciparum
HNNNNDNIKYDGAHNNNNDNIKYDGAHNNNNDNIK

SEQ ID NO: 3222093 - protein, 30 aa, Plasmodium falciparum
HNNNNDNNIDNNNNNINNNNNNNNNNNNKN

SEQ ID NO: 3222094 - protein, 10 aa, Plasmodium falciparum
HNNNNKNNVQ

SEQ ID NO: 3222095 - protein, 17 aa, Plasmodium falciparum
HNNNNKYNNKIDSYDPY

SEQ ID NO: 3222096 - protein, 9 aa, Plasmodium falciparum
HNNNNNDLN

SEQ ID NO: 3222097 - protein, 18 aa, Plasmodium falciparum
HNNNNNEEESISDNNNSH

SEQ ID NO: 3222098 - protein, 9 aa, Plasmodium falciparum
HNNNNNINE

SEQ ID NO: 3222099 - protein, 10 aa, Plasmodium falciparum
HNNNNNNDLP

SEQ ID NO: 3222100 - protein, 16 aa, Plasmodium falciparum
HNNNNNNISIDKNKET

SEQ ID NO: 3222101 - protein, 11 aa, Plasmodium falciparum
HNNNNNNKTPD

SEQ ID NO: 3222102 - protein, 9 aa, Plasmodium falciparum
HNNNNNNNC

SEQ ID NO: 3222103 - protein, 18 aa, Plasmodium falciparum
HNNNNNNNDDDDNGEGDI

SEQ ID NO: 3222104 - protein, 9 aa, Plasmodium falciparum
HNNNNNNNN

SEQ ID NO: 3222105 - protein, 10 aa, Plasmodium falciparum
HNNNNNNNNC

SEQ ID NO: 3222106 - protein, 10 aa, Plasmodium falciparum
HNNNNNNNNN

SEQ ID NO: 3222107 - protein, 17 aa, Plasmodium falciparum
HNNNNNNNNNNNNNNNN

SEQ ID NO: 3222108 - protein, 18 aa, Plasmodium falciparum
HNNNNNNNNNNNNNNNNI

SEQ ID NO: 3222109 - protein, 22 aa, Plasmodium falciparum
HNNNNNNNNSSRENNSYYKNSE

SEQ ID NO: 3222110 - protein, 11 aa, Plasmodium falciparum
HNNNNNNNRVS

SEQ ID NO: 3222111 - protein, 9 aa, Plasmodium falciparum
HNNNNNNNY

SEQ ID NO: 3222112 - protein, 8 aa, Plasmodium falciparum
HNNNNNNY

SEQ ID NO: 3222113 - protein, 20 aa, Plasmodium falciparum
HNNNNSNNNNNNNNSNSNDD

SEQ ID NO: 3222114 - protein, 13 aa, Plasmodium falciparum
HNNNQHNNNQHNN

SEQ ID NO: 3222115 - protein, 6 aa, Plasmodium falciparum
HNNNQN

SEQ ID NO: 3222116 - protein, 16 aa, Plasmodium falciparum
HNNNQQTSHSFSPSPL

SEQ ID NO: 3222117 - protein, 9 aa, Plasmodium falciparum
HNNNSEKNC

SEQ ID NO: 3222118 - protein, 21 aa, Plasmodium falciparum
HNNNTYNQINDEKTKRKKKSC

SEQ ID NO: 3222119 - protein, 9 aa, Plasmodium falciparum
HNNQKNKEK

SEQ ID NO: 3222120 - protein, 9 aa, Plasmodium falciparum
HNNQNNNYN

SEQ ID NO: 3222121 - protein, 6 aa, Plasmodium falciparum
HNNQSY

SEQ ID NO: 3222122 - protein, 13 aa, Plasmodium falciparum
HNNRESENAYKDL

SEQ ID NO: 3222123 - protein, 25 aa, Plasmodium falciparum
HNNRNKEDIYNNDDNNNNIKDNTEK

SEQ ID NO: 3222124 - protein, 5 aa, Plasmodium falciparum
HNNSE

SEQ ID NO: 3222125 - protein, 9 aa, Plasmodium falciparum
HNNSEKYNL

SEQ ID NO: 3222126 - protein, 9 aa, Plasmodium falciparum
HNNSNINSN

SEQ ID NO: 3222127 - protein, 22 aa, Plasmodium falciparum
HNNSRRRLNNTSKNNISNNNNN

SEQ ID NO: 3222128 - protein, 18 aa, Plasmodium falciparum
HNNSSNNISVTTQSDIKD

SEQ ID NO: 3222129 - protein, 8 aa, Plasmodium falciparum
HNNTDHTY

SEQ ID NO: 3222130 - protein, 9 aa, Plasmodium falciparum
HNNTKKNRK

SEQ ID NO: 3222131 - protein, 9 aa, Plasmodium falciparum
HNNYKEPKE

SEQ ID NO: 3222132 - protein, 16 aa, Plasmodium falciparum
HNNYTNEEISKKESDL

SEQ ID NO: 3222133 - protein, 6 aa, Plasmodium falciparum
HNPETY

SEQ ID NO: 3222134 - protein, 10 aa, Plasmodium falciparum
HNPNISDNRN

SEQ ID NO: 3222135 - protein, 7 aa, Plasmodium falciparum
HNPSNDK

SEQ ID NO: 3222136 - protein, 10 aa, Plasmodium falciparum
HNPYSNNSNH

SEQ ID NO: 3222137 - protein, 25 aa, Plasmodium falciparum
HNQDGNQSYNHPSHHTSQQQINTPS

SEQ ID NO: 3222138 - protein, 4 aa, Plasmodium falciparum
HNQI

SEQ ID NO: 3222139 - protein, 8 aa, Plasmodium falciparum
HNQKEPSQ

SEQ ID NO: 3222140 - protein, 11 aa, Plasmodium falciparum
HNQKKKHSLQT

SEQ ID NO: 3222141 - protein, 31 aa, Plasmodium falciparum
HNQKNDNLKQDTKDNSSEQTYNNSNNNIEDN

SEQ ID NO: 3222142 - protein, 10 aa, Plasmodium falciparum
HNQKNSRQMS

SEQ ID NO: 3222143 - protein, 14 aa, Plasmodium falciparum
HNQQQNNDENDIQT

SEQ ID NO: 3222144 - protein, 11 aa, Plasmodium falciparum
HNREGSESKYV

SEQ ID NO: 3222145 - protein, 7 aa, Plasmodium falciparum
HNRNPMN

SEQ ID NO: 3222146 - protein, 5 aa, Plasmodium falciparum
HNRST

SEQ ID NO: 3222147 - protein, 5 aa, Plasmodium falciparum
HNSDD

SEQ ID NO: 3222148 - protein, 5 aa, Plasmodium falciparum
HNSEN

SEQ ID NO: 3222149 - protein, 6 aa, Plasmodium falciparum
HNSETF

SEQ ID NO: 3222150 - protein, 4 aa, Plasmodium falciparum
HNSI

SEQ ID NO: 3222151 - protein, 9 aa, Plasmodium falciparum
HNSKGYKNK

SEQ ID NO: 3222152 - protein, 4 aa, Plasmodium falciparum
HNSN

SEQ ID NO: 3222153 - protein, 47 aa, Plasmodium falciparum
HNSNQNSNPDYSHDDNYSDSSDDDEDDDDQQKEQKDEKQEENEPRYN

SEQ ID NO: 3222154 - protein, 28 aa, Plasmodium falciparum
HNSNTTDYSGYSTDELDEETSDENCEGY

SEQ ID NO: 3222155 - protein, 6 aa, Plasmodium falciparum
HNSSDS

SEQ ID NO: 3222156 - protein, 28 aa, Plasmodium falciparum
HNSSDYHKDNDNMRNNVNSSNSNFHNNN

SEQ ID NO: 3222157 - protein, 4 aa, Plasmodium falciparum
HNSY

SEQ ID NO: 3222158 - protein, 4 aa, Plasmodium falciparum
HNTD

SEQ ID NO: 3222159 - protein, 13 aa, Plasmodium falciparum
HNTDNEKTENRTF

SEQ ID NO: 3222160 - protein, 11 aa, Plasmodium falciparum
HNTKSNKQHNN

SEQ ID NO: 3222161 - protein, 4 aa, Plasmodium falciparum
HNTL

SEQ ID NO: 3222162 - protein, 10 aa, Plasmodium falciparum
HNTNEEKHSR

SEQ ID NO: 3222163 - protein, 8 aa, Plasmodium falciparum
HNTNNSDS

SEQ ID NO: 3222164 - protein, 4 aa, Plasmodium falciparum
HNTQ

SEQ ID NO: 3222165 - protein, 10 aa, Plasmodium falciparum
HNVDSKDSTK

SEQ ID NO: 3222166 - protein, 10 aa, Plasmodium falciparum
HNVDTYKNNK

SEQ ID NO: 3222167 - protein, 5 aa, Plasmodium falciparum
HNVGD

SEQ ID NO: 3222168 - protein, 16 aa, Plasmodium falciparum
HNVGDDHTDNLQGDTD

SEQ ID NO: 3222169 - protein, 13 aa, Plasmodium falciparum
HNVNNNNNNNNID

SEQ ID NO: 3222170 - protein, 20 aa, Plasmodium falciparum
HNYNDSDNNVSSMDEQEECK

SEQ ID NO: 3222171 - protein, 8 aa, Plasmodium falciparum
HNYPYDGK

SEQ ID NO: 3222172 - protein, 16 aa, Plasmodium falciparum
HNYSSGPCGGKDGRNE

SEQ ID NO: 3222173 - protein, 8 aa, Plasmodium falciparum
HPALKEKK

SEQ ID NO: 3222174 - protein, 28 aa, Plasmodium falciparum
HPAPAYTDNEEKVTGLRKREKKNDNSSC

SEQ ID NO: 3222175 - protein, 4 aa, Plasmodium falciparum
HPDD

SEQ ID NO: 3222176 - protein, 8 aa, Plasmodium falciparum
HPDDNQFS

SEQ ID NO: 3222177 - protein, 9 aa, Plasmodium falciparum
HPDKNENNI

SEQ ID NO: 3222178 - protein, 14 aa, Plasmodium falciparum
HPDKNKDKGAEEAF

SEQ ID NO: 3222179 - protein, 11 aa, Plasmodium falciparum
HPDKNKGDEEA

SEQ ID NO: 3222180 - protein, 13 aa, Plasmodium falciparum
HPDKNPDESANSS

SEQ ID NO: 3222181 - protein, 13 aa, Plasmodium falciparum
HPDKNSNGNKSGI

SEQ ID NO: 3222182 - protein, 16 aa, Plasmodium falciparum
HPDPITSDTTTSEYEQ

SEQ ID NO: 3222183 - protein, 11 aa, Plasmodium falciparum
HPDSTTTDLSK

SEQ ID NO: 3222184 - protein, 6 aa, Plasmodium falciparum
HPEQQT

SEQ ID NO: 3222185 - protein, 9 aa, Plasmodium falciparum
HPGETNSSY

SEQ ID NO: 3222186 - protein, 8 aa, Plasmodium falciparum
HPHDNNQN

SEQ ID NO: 3222187 - protein, 8 aa, Plasmodium falciparum
HPHKENSE

SEQ ID NO: 3222188 - protein, 8 aa, Plasmodium falciparum
HPHKETSD

SEQ ID NO: 3222189 - protein, 4 aa, Plasmodium falciparum
HPIN

SEQ ID NO: 3222190 - protein, 8 aa, Plasmodium falciparum
HPKEKPVQ

SEQ ID NO: 3222191 - protein, 21 aa, Plasmodium falciparum
HPKHTNTHNVTKSSNSDPIDN

SEQ ID NO: 3222192 - protein, 21 aa, Plasmodium falciparum
HPKHTNTHSVTKSSNSDPIDN

SEQ ID NO: 3222193 - protein, 14 aa, Plasmodium falciparum
HPKKKTHHEEKQKK

SEQ ID NO: 3222194 - protein, 14 aa, Plasmodium falciparum
HPKKRKKKKLDNTS

SEQ ID NO: 3222195 - protein, 11 aa, Plasmodium falciparum
HPKNYEHTNNK

SEQ ID NO: 3222196 - protein, 6 aa, Plasmodium falciparum
HPKRTT

SEQ ID NO: 3222197 - protein, 5 aa, Plasmodium falciparum
HPLGK

SEQ ID NO: 3222198 - protein, 11 aa, Plasmodium falciparum
HPLNKEKKKKK

SEQ ID NO: 3222199 - protein, 19 aa, Plasmodium falciparum
HPMDQQKDEHDSNNAHTNT

SEQ ID NO: 3222200 - protein, 14 aa, Plasmodium falciparum
HPNGEKSSHNNKSN

SEQ ID NO: 3222201 - protein, 12 aa, Plasmodium falciparum
HPNHQKPQNTTQ

SEQ ID NO: 3222202 - protein, 5 aa, Plasmodium falciparum
HPNKM

SEQ ID NO: 3222203 - protein, 6 aa, Plasmodium falciparum
HPNNTS

SEQ ID NO: 3222204 - protein, 7 aa, Plasmodium falciparum
HPNRGSS

SEQ ID NO: 3222205 - protein, 8 aa, Plasmodium falciparum
HPNSGCTR

SEQ ID NO: 3222206 - protein, 5 aa, Plasmodium falciparum
HPNYQ

SEQ ID NO: 3222207 - protein, 6 aa, Plasmodium falciparum
HPPKEY

SEQ ID NO: 3222208 - protein, 8 aa, Plasmodium falciparum
HPPKEYKD

SEQ ID NO: 3222209 - protein, 5 aa, Plasmodium falciparum
HPSAL

SEQ ID NO: 3222210 - protein, 11 aa, Plasmodium falciparum
HPSDQNKDNLT

SEQ ID NO: 3222211 - protein, 4 aa, Plasmodium falciparum
HPSN

SEQ ID NO: 3222212 - protein, 13 aa, Plasmodium falciparum
HPSNIGGEKITHN

SEQ ID NO: 3222213 - protein, 16 aa, Plasmodium falciparum
HPSNNLKKKQNKGTRK

SEQ ID NO: 3222214 - protein, 4 aa, Plasmodium falciparum
HPTD

SEQ ID NO: 3222215 - protein, 11 aa, Plasmodium falciparum
HPTNNNSNNNY

SEQ ID NO: 3222216 - protein, 20 aa, Plasmodium falciparum
HPYQNNNTYKNTAGTKPYDN

SEQ ID NO: 3222217 - protein, 5 aa, Plasmodium falciparum
HQAPH

SEQ ID NO: 3222218 - protein, 5 aa, Plasmodium falciparum
HQAPQ

SEQ ID NO: 3222219 - protein, 5 aa, Plasmodium falciparum
HQATV

SEQ ID NO: 3222220 - protein, 8 aa, Plasmodium falciparum
HQDHTKSV

SEQ ID NO: 3222221 - protein, 8 aa, Plasmodium falciparum
HQDKDQNI

SEQ ID NO: 3222222 - protein, 15 aa, Plasmodium falciparum
HQEDEEVDNENDQLD

SEQ ID NO: 3222223 - protein, 9 aa, Plasmodium falciparum
HQEDNSKEN

SEQ ID NO: 3222224 - protein, 53 aa, Plasmodium falciparum
HQEDRDDNMNNNDNNDNNNNNDNNNNNDNNNNNDNNNNDNNNNDNNNSGEDQL

SEQ ID NO: 3222225 - protein, 10 aa, Plasmodium falciparum
HQEKKKKKKL

SEQ ID NO: 3222226 - protein, 8 aa, Plasmodium falciparum
HQENTNSE

SEQ ID NO: 3222227 - protein, 7 aa, Plasmodium falciparum
HQESSSD

SEQ ID NO: 3222228 - protein, 25 aa, Plasmodium falciparum
HQGQTEPNKGDNNNERENHESNVGS

SEQ ID NO: 3222229 - protein, 15 aa, Plasmodium falciparum
HQHNNNNNNNNNNNN

SEQ ID NO: 3222230 - protein, 14 aa, Plasmodium falciparum
HQHTNEQDKSTQGI

SEQ ID NO: 3222231 - protein, 6 aa, Plasmodium falciparum
HQKDIT

SEQ ID NO: 3222232 - protein, 7 aa, Plasmodium falciparum
HQKECSR

SEQ ID NO: 3222233 - protein, 6 aa, Plasmodium falciparum
HQKEQK

SEQ ID NO: 3222234 - protein, 5 aa, Plasmodium falciparum
HQKIG

SEQ ID NO: 3222235 - protein, 13 aa, Plasmodium falciparum
HQKKNSLFSEFIN

SEQ ID NO: 3222236 - protein, 18 aa, Plasmodium falciparum
HQKKQKHSNHKKKKLNKK

SEQ ID NO: 3222237 - protein, 11 aa, Plasmodium falciparum
HQKPSSTPRHI

SEQ ID NO: 3222238 - protein, 8 aa, Plasmodium falciparum
HQKYTRRN

SEQ ID NO: 3222239 - protein, 8 aa, Plasmodium falciparum
HQNDNNKI

SEQ ID NO: 3222240 - protein, 19 aa, Plasmodium falciparum
HQNDNNNISSSDNKTEEPI

SEQ ID NO: 3222241 - protein, 90 aa, Plasmodium falciparum
HQNGKNNNHNDYNNKCEDNKNNDYNNNKCDDNNNNDYNNNKCDDNKNNDYNNKCEDNKNNDYNNNKCDDNNNDDYNNKCDDNNHNDYNNK

SEQ ID NO: 3222242 - protein, 13 aa, Plasmodium falciparum
HQNKAKKNKRNKK

SEQ ID NO: 3222243 - protein, 14 aa, Plasmodium falciparum
HQNKDHKKNEYTSE

SEQ ID NO: 3222244 - protein, 4 aa, Plasmodium falciparum
HQNN

SEQ ID NO: 3222245 - protein, 9 aa, Plasmodium falciparum
HQNNDNDDD

SEQ ID NO: 3222246 - protein, 28 aa, Plasmodium falciparum
HQNNGNNSINNNNNNNNNNNNNNNSIQD

SEQ ID NO: 3222247 - protein, 8 aa, Plasmodium falciparum
HQNQRISS

SEQ ID NO: 3222248 - protein, 9 aa, Plasmodium falciparum
HQNTTNNKI

SEQ ID NO: 3222249 - protein, 18 aa, Plasmodium falciparum
HQPKINQQKDKSTNLNNS

SEQ ID NO: 3222250 - protein, 4 aa, Plasmodium falciparum
HQPP

SEQ ID NO: 3222251 - protein, 12 aa, Plasmodium falciparum
HQQQNKVKNRPC

SEQ ID NO: 3222252 - protein, 18 aa, Plasmodium falciparum
HQRQYQDHDRDEEGREKI

SEQ ID NO: 3222253 - protein, 5 aa, Plasmodium falciparum
HQSTR

SEQ ID NO: 3222254 - protein, 14 aa, Plasmodium falciparum
HRARSDGGQRQRPL

SEQ ID NO: 3222255 - protein, 7 aa, Plasmodium falciparum
HREHPKE

SEQ ID NO: 3222256 - protein, 11 aa, Plasmodium falciparum
HREQDELTYEE

SEQ ID NO: 3222257 - protein, 7 aa, Plasmodium falciparum
HRESTEN

SEQ ID NO: 3222258 - protein, 16 aa, Plasmodium falciparum
HRKNEHSEKDDDDDKY

SEQ ID NO: 3222259 - protein, 5 aa, Plasmodium falciparum
HRKNN

SEQ ID NO: 3222260 - protein, 15 aa, Plasmodium falciparum
HRNEKKEKHTKKEEP

SEQ ID NO: 3222261 - protein, 8 aa, Plasmodium falciparum
HRNKTNKE

SEQ ID NO: 3222262 - protein, 12 aa, Plasmodium falciparum
HRNNNYDNNNNI

SEQ ID NO: 3222263 - protein, 14 aa, Plasmodium falciparum
HRNSKKNKNGRTKK

SEQ ID NO: 3222264 - protein, 10 aa, Plasmodium falciparum
HRQTSTSRVL

SEQ ID NO: 3222265 - protein, 10 aa, Plasmodium falciparum
HRRHRNEEEI

SEQ ID NO: 3222266 - protein, 44 aa, Plasmodium falciparum
HRRSSSNSHVESNTFQNKEETEVNADSAEQQNYDKEPSQKGKDV

SEQ ID NO: 3222267 - protein, 5 aa, Plasmodium falciparum
HRSKA

SEQ ID NO: 3222268 - protein, 6 aa, Plasmodium falciparum
HRSTKW

SEQ ID NO: 3222269 - protein, 7 aa, Plasmodium falciparum
HRTCSDK

SEQ ID NO: 3222270 - protein, 34 aa, Plasmodium falciparum
HRTETRTDERKNQEPANKDLKNPQQSVGENGTKD

SEQ ID NO: 3222271 - protein, 19 aa, Plasmodium falciparum
HRTSHEHGHYSSNTIKKNS

SEQ ID NO: 3222272 - protein, 4 aa, Plasmodium falciparum
HRYN

SEQ ID NO: 3222273 - protein, 4 aa, Plasmodium falciparum
HSDD

SEQ ID NO: 3222274 - protein, 9 aa, Plasmodium falciparum
HSDDENINS

SEQ ID NO: 3222275 - protein, 4 aa, Plasmodium falciparum
HSDI

SEQ ID NO: 3222276 - protein, 8 aa, Plasmodium falciparum
HSDKNDMG

SEQ ID NO: 3222277 - protein, 4 aa, Plasmodium falciparum
HSDN

SEQ ID NO: 3222278 - protein, 7 aa, Plasmodium falciparum
HSDNMYK

SEQ ID NO: 3222279 - protein, 11 aa, Plasmodium falciparum
HSDSGTNDPCD

SEQ ID NO: 3222280 - protein, 8 aa, Plasmodium falciparum
HSDSINNS

SEQ ID NO: 3222281 - protein, 8 aa, Plasmodium falciparum
HSEDKKPY

SEQ ID NO: 3222282 - protein, 15 aa, Plasmodium falciparum
HSEDTKKNQDTFNFP

SEQ ID NO: 3222283 - protein, 6 aa, Plasmodium falciparum
HSEISS

SEQ ID NO: 3222284 - protein, 10 aa, Plasmodium falciparum
HSEKGINNEE

SEQ ID NO: 3222285 - protein, 4 aa, Plasmodium falciparum
HSEL

SEQ ID NO: 3222286 - protein, 13 aa, Plasmodium falciparum
HSENSENDVNNDN

SEQ ID NO: 3222287 - protein, 12 aa, Plasmodium falciparum
HSEPGPKTVNTE

SEQ ID NO: 3222288 - protein, 40 aa, Plasmodium falciparum
HSESHNSNYESSDKDKVSISEKRGGEHMTNNGNRNTNNID

SEQ ID NO: 3222289 - protein, 12 aa, Plasmodium falciparum
HSESSNNNVVPK

SEQ ID NO: 3222290 - protein, 9 aa, Plasmodium falciparum
HSESYNKPT

SEQ ID NO: 3222291 - protein, 33 aa, Plasmodium falciparum
HSGAASSSKLSKKNISSSSNYSLEDDDDDNSSI

SEQ ID NO: 3222292 - protein, 20 aa, Plasmodium falciparum
HSGDDNLQHNNNNNNNDSVY

SEQ ID NO: 3222293 - protein, 19 aa, Plasmodium falciparum
HSGENSSTQPIDNKSHENI

SEQ ID NO: 3222294 - protein, 15 aa, Plasmodium falciparum
HSGSAKKGDGNNKTF

SEQ ID NO: 3222295 - protein, 6 aa, Plasmodium falciparum
HSHAEN

SEQ ID NO: 3222296 - protein, 42 aa, Plasmodium falciparum
HSHNTQYEHSGASQNNINSEQSGASQKNKNSEQSGANPENVH

SEQ ID NO: 3222297 - protein, 24 aa, Plasmodium falciparum
HSIETYNNNNNNNNNNNNNNKNNI

SEQ ID NO: 3222298 - protein, 4 aa, Plasmodium falciparum
HSIH

SEQ ID NO: 3222299 - protein, 17 aa, Plasmodium falciparum
HSINNDLGKSNKENECN

SEQ ID NO: 3222300 - protein, 44 aa, Plasmodium falciparum
HSKDNKTNISEHTDNNNNNMKDANKRKKKKNQPNAKSSSSKTKY

SEQ ID NO: 3222301 - protein, 51 aa, Plasmodium falciparum
HSKDSDDIKGNNNKISKNRYNNNNNNNNSNYSNIDSGKYSHNNKKNHHHNN

SEQ ID NO: 3222302 - protein, 17 aa, Plasmodium falciparum
HSKEHSKEHSKEHSKVE

SEQ ID NO: 3222303 - protein, 6 aa, Plasmodium falciparum
HSKGVL

SEQ ID NO: 3222304 - protein, 5 aa, Plasmodium falciparum
HSKIG

SEQ ID NO: 3222305 - protein, 16 aa, Plasmodium falciparum
HSKKEDNIDDENKNHK

SEQ ID NO: 3222306 - protein, 7 aa, Plasmodium falciparum
HSKKKGC

SEQ ID NO: 3222307 - protein, 21 aa, Plasmodium falciparum
HSKKQANTRNNDFNNKNNNVH

SEQ ID NO: 3222308 - protein, 9 aa, Plasmodium falciparum
HSKKRNARI

SEQ ID NO: 3222309 - protein, 4 aa, Plasmodium falciparum
HSKN

SEQ ID NO: 3222310 - protein, 6 aa, Plasmodium falciparum
HSKNDD

SEQ ID NO: 3222311 - protein, 9 aa, Plasmodium falciparum
HSKNDEENY

SEQ ID NO: 3222312 - protein, 19 aa, Plasmodium falciparum
HSKNGNSNSNTTENNNKRR

SEQ ID NO: 3222313 - protein, 9 aa, Plasmodium falciparum
HSKNSRHYN

SEQ ID NO: 3222314 - protein, 5 aa, Plasmodium falciparum
HSKPL

SEQ ID NO: 3222315 - protein, 6 aa, Plasmodium falciparum
HSLNSG

SEQ ID NO: 3222316 - protein, 4 aa, Plasmodium falciparum
HSLS

SEQ ID NO: 3222317 - protein, 8 aa, Plasmodium falciparum
HSLSKGQK

SEQ ID NO: 3222318 - protein, 4 aa, Plasmodium falciparum
HSNA

SEQ ID NO: 3222319 - protein, 9 aa, Plasmodium falciparum
HSNDNATTI

SEQ ID NO: 3222320 - protein, 7 aa, Plasmodium falciparum
HSNHQNK

SEQ ID NO: 3222321 - protein, 6 aa, Plasmodium falciparum
HSNINN

SEQ ID NO: 3222322 - protein, 4 aa, Plasmodium falciparum
HSNK

SEQ ID NO: 3222323 - protein, 18 aa, Plasmodium falciparum
HSNKHTKNKYINSQQTCT

SEQ ID NO: 3222324 - protein, 8 aa, Plasmodium falciparum
HSNNNNNM

SEQ ID NO: 3222325 - protein, 6 aa, Plasmodium falciparum
HSNNVH

SEQ ID NO: 3222326 - protein, 18 aa, Plasmodium falciparum
HSNSKTTYSNISKQKSQH

SEQ ID NO: 3222327 - protein, 36 aa, Plasmodium falciparum
HSNSSNYNNNNNNNSDSNNKKSIKMNSNENNNTTTT

SEQ ID NO: 3222328 - protein, 9 aa, Plasmodium falciparum
HSNVSNEDD

SEQ ID NO: 3222329 - protein, 4 aa, Plasmodium falciparum
HSPH

SEQ ID NO: 3222330 - protein, 17 aa, Plasmodium falciparum
HSPSNSYDINKESSSLC

SEQ ID NO: 3222331 - protein, 16 aa, Plasmodium falciparum
HSQKKNLQHSNSHTQK

SEQ ID NO: 3222332 - protein, 8 aa, Plasmodium falciparum
HSQQSEHN

SEQ ID NO: 3222333 - protein, 12 aa, Plasmodium falciparum
HSRNKNKKYNRK

SEQ ID NO: 3222334 - protein, 5 aa, Plasmodium falciparum
HSSAA

SEQ ID NO: 3222335 - protein, 5 aa, Plasmodium falciparum
HSSDI

SEQ ID NO: 3222336 - protein, 5 aa, Plasmodium falciparum
HSSDN

SEQ ID NO: 3222337 - protein, 9 aa, Plasmodium falciparum
HSSEDDIST

SEQ ID NO: 3222338 - protein, 11 aa, Plasmodium falciparum
HSSHDKDTNRL

SEQ ID NO: 3222339 - protein, 10 aa, Plasmodium falciparum
HSSKDQKNRF

SEQ ID NO: 3222340 - protein, 12 aa, Plasmodium falciparum
HSSKEEKEDAEK

SEQ ID NO: 3222341 - protein, 4 aa, Plasmodium falciparum
HSSN

SEQ ID NO: 3222342 - protein, 12 aa, Plasmodium falciparum
HSSNDNIKNTYP

SEQ ID NO: 3222343 - protein, 20 aa, Plasmodium falciparum
HSSNLDSSNLHSSNAPKSNI

SEQ ID NO: 3222344 - protein, 8 aa, Plasmodium falciparum
HSSSNNQS

SEQ ID NO: 3222345 - protein, 9 aa, Plasmodium falciparum
HSTNGKDDA

SEQ ID NO: 3222346 - protein, 11 aa, Plasmodium falciparum
HSTSSNDASSS

SEQ ID NO: 3222347 - protein, 6 aa, Plasmodium falciparum
HSTTLY

SEQ ID NO: 3222348 - protein, 12 aa, Plasmodium falciparum
HSVNNNKDTMDI

SEQ ID NO: 3222349 - protein, 9 aa, Plasmodium falciparum
HTAKANEKI

SEQ ID NO: 3222350 - protein, 7 aa, Plasmodium falciparum
HTASTYK

SEQ ID NO: 3222351 - protein, 100 aa, Plasmodium falciparum
HTCGGEKGNIDGGEKGNIDGGEKENIGGGEKGNIDGGEKENIGGGEKENIGDGEKENIGGGEKENIGDGEKENIGGDEKEHVGGDEKEHTCGDNQASPCD

SEQ ID NO: 3222352 - protein, 12 aa, Plasmodium falciparum
HTDELNKDNKNS

SEQ ID NO: 3222353 - protein, 6 aa, Plasmodium falciparum
HTDERH

SEQ ID NO: 3222354 - protein, 17 aa, Plasmodium falciparum
HTDESSKSNNNQDKTVY

SEQ ID NO: 3222355 - protein, 11 aa, Plasmodium falciparum
HTDETRQEQNR

SEQ ID NO: 3222356 - protein, 11 aa, Plasmodium falciparum
HTDPENKKHLN

SEQ ID NO: 3222357 - protein, 9 aa, Plasmodium falciparum
HTEDTSSSY

SEQ ID NO: 3222358 - protein, 4 aa, Plasmodium falciparum
HTEE

SEQ ID NO: 3222359 - protein, 7 aa, Plasmodium falciparum
HTEENEK

SEQ ID NO: 3222360 - protein, 7 aa, Plasmodium falciparum
HTEEQSI

SEQ ID NO: 3222361 - protein, 11 aa, Plasmodium falciparum
HTFQGSGNRRE

SEQ ID NO: 3222362 - protein, 4 aa, Plasmodium falciparum
HTFR

SEQ ID NO: 3222363 - protein, 5 aa, Plasmodium falciparum
HTGDL

SEQ ID NO: 3222364 - protein, 4 aa, Plasmodium falciparum
HTGE

SEQ ID NO: 3222365 - protein, 28 aa, Plasmodium falciparum
HTGGPQQQPGSVSDDPQSKLQKSGEIPT

SEQ ID NO: 3222366 - protein, 5 aa, Plasmodium falciparum
HTGKT

SEQ ID NO: 3222367 - protein, 5 aa, Plasmodium falciparum
HTGNI

SEQ ID NO: 3222368 - protein, 9 aa, Plasmodium falciparum
HTGSGKTTI

SEQ ID NO: 3222369 - protein, 39 aa, Plasmodium falciparum
HTHDNNNNNNNNDNNNDNNNIDKEENKNVINKDEDKNNN

SEQ ID NO: 3222370 - protein, 4 aa, Plasmodium falciparum
HTHG

SEQ ID NO: 3222371 - protein, 6 aa, Plasmodium falciparum
HTKEKI

SEQ ID NO: 3222372 - protein, 6 aa, Plasmodium falciparum
HTKESL

SEQ ID NO: 3222373 - protein, 9 aa, Plasmodium falciparum
HTKGETETK

SEQ ID NO: 3222374 - protein, 7 aa, Plasmodium falciparum
HTKHTTT

SEQ ID NO: 3222375 - protein, 21 aa, Plasmodium falciparum
HTKKNTSTNSVAKNTNSDPIH

SEQ ID NO: 3222376 - protein, 11 aa, Plasmodium falciparum
HTKNKPHNTNN

SEQ ID NO: 3222377 - protein, 7 aa, Plasmodium falciparum
HTKNTDY

SEQ ID NO: 3222378 - protein, 5 aa, Plasmodium falciparum
HTKQY

SEQ ID NO: 3222379 - protein, 6 aa, Plasmodium falciparum
HTKTTR

SEQ ID NO: 3222380 - protein, 4 aa, Plasmodium falciparum
HTLN

SEQ ID NO: 3222381 - protein, 8 aa, Plasmodium falciparum
HTNDNRNY

SEQ ID NO: 3222382 - protein, 5 aa, Plasmodium falciparum
HTNED

SEQ ID NO: 3222383 - protein, 13 aa, Plasmodium falciparum
HTNEDRQSDINET

SEQ ID NO: 3222384 - protein, 5 aa, Plasmodium falciparum
HTNEK

SEQ ID NO: 3222385 - protein, 13 aa, Plasmodium falciparum
HTNGGGKGKRYPC

SEQ ID NO: 3222386 - protein, 15 aa, Plasmodium falciparum
HTNHYTQKKKKKKYD

SEQ ID NO: 3222387 - protein, 4 aa, Plasmodium falciparum
HTNK

SEQ ID NO: 3222388 - protein, 34 aa, Plasmodium falciparum
HTNKKDDEKNYKKKSTKIQKDIKTQENKNDITKE

SEQ ID NO: 3222389 - protein, 18 aa, Plasmodium falciparum
HTNKKEDAEENDKNKNIN

SEQ ID NO: 3222390 - protein, 7 aa, Plasmodium falciparum
HTNKRDD

SEQ ID NO: 3222391 - protein, 28 aa, Plasmodium falciparum
HTNMKEKRKSKKDNKSNSRKGNKTKGHE

SEQ ID NO: 3222392 - protein, 5 aa, Plasmodium falciparum
HTNMN

SEQ ID NO: 3222393 - protein, 4 aa, Plasmodium falciparum
HTNN

SEQ ID NO: 3222394 - protein, 8 aa, Plasmodium falciparum
HTNNDKKE

SEQ ID NO: 3222395 - protein, 11 aa, Plasmodium falciparum
HTNNENETHQC

SEQ ID NO: 3222396 - protein, 10 aa, Plasmodium falciparum
HTNNLNKNEQ

SEQ ID NO: 3222397 - protein, 11 aa, Plasmodium falciparum
HTNNNNNNDNH

SEQ ID NO: 3222398 - protein, 15 aa, Plasmodium falciparum
HTNNNNNNSDDDNYF

SEQ ID NO: 3222399 - protein, 22 aa, Plasmodium falciparum
HTNNNQTTLQSNTDKNNTSIET

SEQ ID NO: 3222400 - protein, 7 aa, Plasmodium falciparum
HTNNNSM

SEQ ID NO: 3222401 - protein, 7 aa, Plasmodium falciparum
HTNNTDV

SEQ ID NO: 3222402 - protein, 6 aa, Plasmodium falciparum
HTNRYK

SEQ ID NO: 3222403 - protein, 11 aa, Plasmodium falciparum
HTNSTNHTNNM

SEQ ID NO: 3222404 - protein, 18 aa, Plasmodium falciparum
HTNTHNVTKSSNSDPIDN

SEQ ID NO: 3222405 - protein, 7 aa, Plasmodium falciparum
HTPKGHE

SEQ ID NO: 3222406 - protein, 9 aa, Plasmodium falciparum
HTPNGCQNE

SEQ ID NO: 3222407 - protein, 10 aa, Plasmodium falciparum
HTPNTTKIPT

SEQ ID NO: 3222408 - protein, 8 aa, Plasmodium falciparum
HTPNTTSR

SEQ ID NO: 3222409 - protein, 8 aa, Plasmodium falciparum
HTPSQESL

SEQ ID NO: 3222410 - protein, 5 aa, Plasmodium falciparum
HTPTI

SEQ ID NO: 3222411 - protein, 8 aa, Plasmodium falciparum
HTPTNTSR

SEQ ID NO: 3222412 - protein, 7 aa, Plasmodium falciparum
HTPTTKS

SEQ ID NO: 3222413 - protein, 7 aa, Plasmodium falciparum
HTPTTRS

SEQ ID NO: 3222414 - protein, 7 aa, Plasmodium falciparum
HTPTTTS

SEQ ID NO: 3222415 - protein, 8 aa, Plasmodium falciparum
HTPTTTSR

SEQ ID NO: 3222416 - protein, 9 aa, Plasmodium falciparum
HTQNRTTKQ

SEQ ID NO: 3222417 - protein, 15 aa, Plasmodium falciparum
HTQPLENSNTYENNM

SEQ ID NO: 3222418 - protein, 9 aa, Plasmodium falciparum
HTQRNNQYN

SEQ ID NO: 3222419 - protein, 4 aa, Plasmodium falciparum
HTRK

SEQ ID NO: 3222420 - protein, 8 aa, Plasmodium falciparum
HTRTTTSR

SEQ ID NO: 3222421 - protein, 6 aa, Plasmodium falciparum
HTSKKR

SEQ ID NO: 3222422 - protein, 4 aa, Plasmodium falciparum
HTSN

SEQ ID NO: 3222423 - protein, 27 aa, Plasmodium falciparum
HTSQNHKENISQSTTTKNNDMNSSNNY

SEQ ID NO: 3222424 - protein, 17 aa, Plasmodium falciparum
HTSQQINSESNGSYGYN

SEQ ID NO: 3222425 - protein, 6 aa, Plasmodium falciparum
HTSTHS

SEQ ID NO: 3222426 - protein, 16 aa, Plasmodium falciparum
HTSTHSVAKNTNSDPI

SEQ ID NO: 3222427 - protein, 8 aa, Plasmodium falciparum
HTSTTTSR

SEQ ID NO: 3222428 - protein, 4 aa, Plasmodium falciparum
HTTN

SEQ ID NO: 3222429 - protein, 5 aa, Plasmodium falciparum
HTTNK

SEQ ID NO: 3222430 - protein, 33 aa, Plasmodium falciparum
HTTSNERNTQNSKNDKYDRYQEGEEEEEYEEDH

SEQ ID NO: 3222431 - protein, 9 aa, Plasmodium falciparum
HTYDNGGNV

SEQ ID NO: 3222432 - protein, 21 aa, Plasmodium falciparum
HTYTNSAEYKNENIKADEEDD

SEQ ID NO: 3222433 - protein, 5 aa, Plasmodium falciparum
HVDNS

SEQ ID NO: 3222434 - protein, 14 aa, Plasmodium falciparum
HVEEKEEDKDEHKY

SEQ ID NO: 3222435 - protein, 5 aa, Plasmodium falciparum
HVEGE

SEQ ID NO: 3222436 - protein, 20 aa, Plasmodium falciparum
HVHDTKGDTYDNEKKKHSKL

SEQ ID NO: 3222437 - protein, 15 aa, Plasmodium falciparum
HVKGTNMDDQNNFKE

SEQ ID NO: 3222438 - protein, 12 aa, Plasmodium falciparum
HVKKNKNNHIRD

SEQ ID NO: 3222439 - protein, 11 aa, Plasmodium falciparum
HVNEKKDRNEI

SEQ ID NO: 3222440 - protein, 13 aa, Plasmodium falciparum
HVNKGSKVEAEEK

SEQ ID NO: 3222441 - protein, 11 aa, Plasmodium falciparum
HVNTNSKENAS

SEQ ID NO: 3222442 - protein, 4 aa, Plasmodium falciparum
HVQR

SEQ ID NO: 3222443 - protein, 5 aa, Plasmodium falciparum
HVQTN

SEQ ID NO: 3222444 - protein, 13 aa, Plasmodium falciparum
HVSSNQSTEEIKK

SEQ ID NO: 3222445 - protein, 44 aa, Plasmodium falciparum
HVTSDESLEKIKEENGNTRKNKGSINNEEKIEEEKENVKNDETI

SEQ ID NO: 3222446 - protein, 5 aa, Plasmodium falciparum
HVTYS

SEQ ID NO: 3222447 - protein, 9 aa, Plasmodium falciparum
HWGSQDPMD

SEQ ID NO: 3222448 - protein, 4 aa, Plasmodium falciparum
HYDI

SEQ ID NO: 3222449 - protein, 18 aa, Plasmodium falciparum
HYDNSGRIRQGPAPSNLE

SEQ ID NO: 3222450 - protein, 12 aa, Plasmodium falciparum
HYDTQKKKNELG

SEQ ID NO: 3222451 - protein, 14 aa, Plasmodium falciparum
HYEKQKPKNGDNNM

SEQ ID NO: 3222452 - protein, 6 aa, Plasmodium falciparum
HYESDT

SEQ ID NO: 3222453 - protein, 13 aa, Plasmodium falciparum
HYESKNDNENSYN

SEQ ID NO: 3222454 - protein, 8 aa, Plasmodium falciparum
HYHPEKTT

SEQ ID NO: 3222455 - protein, 5 aa, Plasmodium falciparum
HYKGY

SEQ ID NO: 3222456 - protein, 11 aa, Plasmodium falciparum
HYNDNNKSVNN

SEQ ID NO: 3222457 - protein, 30 aa, Plasmodium falciparum
HYNDQNKERRDQINNDRGIENYDDNKWKEN

SEQ ID NO: 3222458 - protein, 6 aa, Plasmodium falciparum
HYNKNP

SEQ ID NO: 3222459 - protein, 51 aa, Plasmodium falciparum
HYNKQGDSTNDTKEKMENENSHGGNSHDDDNNNYNNYNNTDDANSNDSDAD

SEQ ID NO: 3222460 - protein, 10 aa, Plasmodium falciparum
HYNNEKGFGE

SEQ ID NO: 3222461 - protein, 6 aa, Plasmodium falciparum
HYNNKK

SEQ ID NO: 3222462 - protein, 11 aa, Plasmodium falciparum
HYNNNDDNHIN

SEQ ID NO: 3222463 - protein, 21 aa, Plasmodium falciparum
HYNNNNNNNNHSNHKNNDTNA

SEQ ID NO: 3222464 - protein, 23 aa, Plasmodium falciparum
HYNNNSNNSNNNNNNNNNNNNNV

SEQ ID NO: 3222465 - protein, 9 aa, Plasmodium falciparum
HYQDDDPNY

SEQ ID NO: 3222466 - protein, 116 aa, Plasmodium falciparum
HYSGKHNKDTSYDALEEDSNDSEEDSENDSEDESEVESENESENESEDQSENDTENDTENETEQESEEQSQNESDGESENESEEESDDEPVKKNAPKNKEDTKNEEKKDLRQGKGD

SEQ ID NO: 3222467 - protein, 6 aa, Plasmodium falciparum
HYSNNE

SEQ ID NO: 3222468 - protein, 7 aa, Plasmodium falciparum
HYSSGIK

SEQ ID NO: 3222469 - protein, 8 aa, Plasmodium falciparum
HYTKNGTN

SEQ ID NO: 3222470 - protein, 24 aa, Plasmodium falciparum
HYYKQNKNNTHNYNNNNNNNNNGV

SEQ ID NO: 3222471 - protein, 4 aa, Plasmodium falciparum
IAAA

SEQ ID NO: 3222472 - protein, 10 aa, Plasmodium falciparum
IAAETQCDPG

SEQ ID NO: 3222473 - protein, 6 aa, Plasmodium falciparum
IADDPA

SEQ ID NO: 3222474 - protein, 5 aa, Plasmodium falciparum
IADGE

SEQ ID NO: 3222475 - protein, 22 aa, Plasmodium falciparum
IAEATEKAKAIKTSTDAIEAAS

SEQ ID NO: 3222476 - protein, 23 aa, Plasmodium falciparum
IAEATEKAKAIKTSTDAIEAAST

SEQ ID NO: 3222477 - protein, 10 aa, Plasmodium falciparum
IAEEKDYKDP

SEQ ID NO: 3222478 - protein, 5 aa, Plasmodium falciparum
IAEGT

SEQ ID NO: 3222479 - protein, 6 aa, Plasmodium falciparum
IAEGTA

SEQ ID NO: 3222480 - protein, 7 aa, Plasmodium falciparum
IAEKAEK

SEQ ID NO: 3222481 - protein, 20 aa, Plasmodium falciparum
IAEKKKKKRFLSEESKARMK

SEQ ID NO: 3222482 - protein, 9 aa, Plasmodium falciparum
IAKKNKNKN

SEQ ID NO: 3222483 - protein, 21 aa, Plasmodium falciparum
IANEKENEKNKKNNNNNKSIY

SEQ ID NO: 3222484 - protein, 5 aa, Plasmodium falciparum
IANES

SEQ ID NO: 3222485 - protein, 19 aa, Plasmodium falciparum
IANSADKIAEAANSAGIQA

SEQ ID NO: 3222486 - protein, 8 aa, Plasmodium falciparum
IAPNNNEN

SEQ ID NO: 3222487 - protein, 15 aa, Plasmodium falciparum
IAPSSLDKTNDKNNV

SEQ ID NO: 3222488 - protein, 4 aa, Plasmodium falciparum
IARN

SEQ ID NO: 3222489 - protein, 9 aa, Plasmodium falciparum
IASAGANTY

SEQ ID NO: 3222490 - protein, 19 aa, Plasmodium falciparum
IASDDNVNKAMNQLDDMFM

SEQ ID NO: 3222491 - protein, 8 aa, Plasmodium falciparum
IASPNKQK

SEQ ID NO: 3222492 - protein, 12 aa, Plasmodium falciparum
IASSQKKNGEYK

SEQ ID NO: 3222493 - protein, 27 aa, Plasmodium falciparum
IASSSFSNSEYEIKKKNEKIMNGSGNQ

SEQ ID NO: 3222494 - protein, 6 aa, Plasmodium falciparum
IATATN

SEQ ID NO: 3222495 - protein, 8 aa, Plasmodium falciparum
IATDNSND

SEQ ID NO: 3222496 - protein, 10 aa, Plasmodium falciparum
IATDSSTVNG

SEQ ID NO: 3222497 - protein, 7 aa, Plasmodium falciparum
IATKSYS

SEQ ID NO: 3222498 - protein, 5 aa, Plasmodium falciparum
IATYP

SEQ ID NO: 3222499 - protein, 13 aa, Plasmodium falciparum
ICDDNKKEADSKI

SEQ ID NO: 3222500 - protein, 14 aa, Plasmodium falciparum
ICDENNKNNIYDEK

SEQ ID NO: 3222501 - protein, 4 aa, Plasmodium falciparum
ICER

SEQ ID NO: 3222502 - protein, 4 aa, Plasmodium falciparum
ICGD

SEQ ID NO: 3222503 - protein, 11 aa, Plasmodium falciparum
ICPSSTNNINS

SEQ ID NO: 3222504 - protein, 4 aa, Plasmodium falciparum
ICSE

SEQ ID NO: 3222505 - protein, 9 aa, Plasmodium falciparum
ICSSKSEKI

SEQ ID NO: 3222506 - protein, 4 aa, Plasmodium falciparum
ICTP

SEQ ID NO: 3222507 - protein, 4 aa, Plasmodium falciparum
ICTS

SEQ ID NO: 3222508 - protein, 6 aa, Plasmodium falciparum
IDAPNK

SEQ ID NO: 3222509 - protein, 8 aa, Plasmodium falciparum
IDAPNRKP

SEQ ID NO: 3222510 - protein, 8 aa, Plasmodium falciparum
IDAQDSDA

SEQ ID NO: 3222511 - protein, 5 aa, Plasmodium falciparum
IDCGD

SEQ ID NO: 3222512 - protein, 6 aa, Plasmodium falciparum
IDCGDN

SEQ ID NO: 3222513 - protein, 5 aa, Plasmodium falciparum
IDDDG

SEQ ID NO: 3222514 - protein, 14 aa, Plasmodium falciparum
IDDDYNNEKKNENY

SEQ ID NO: 3222515 - protein, 6 aa, Plasmodium falciparum
IDDEDE

SEQ ID NO: 3222516 - protein, 14 aa, Plasmodium falciparum
IDDEEGKEKREDVN

SEQ ID NO: 3222517 - protein, 12 aa, Plasmodium falciparum
IDDENKNDKNNI

SEQ ID NO: 3222518 - protein, 9 aa, Plasmodium falciparum
IDDGDNDDN

SEQ ID NO: 3222519 - protein, 8 aa, Plasmodium falciparum
IDDGKDNV

SEQ ID NO: 3222520 - protein, 9 aa, Plasmodium falciparum
IDDKDNKSV

SEQ ID NO: 3222521 - protein, 6 aa, Plasmodium falciparum
IDDKGG

SEQ ID NO: 3222522 - protein, 18 aa, Plasmodium falciparum
IDDKKKKGKKKKKETESY

SEQ ID NO: 3222523 - protein, 4 aa, Plasmodium falciparum
IDDN

SEQ ID NO: 3222524 - protein, 6 aa, Plasmodium falciparum
IDDNSN

SEQ ID NO: 3222525 - protein, 16 aa, Plasmodium falciparum
IDDPQTQLNGGEIPED

SEQ ID NO: 3222526 - protein, 20 aa, Plasmodium falciparum
IDDPSNSTKQELQNSDYENM

SEQ ID NO: 3222527 - protein, 4 aa, Plasmodium falciparum
IDDQ

SEQ ID NO: 3222528 - protein, 16 aa, Plasmodium falciparum
IDDRDKSRTANKYDDK

SEQ ID NO: 3222529 - protein, 9 aa, Plasmodium falciparum
IDDVSTNYG

SEQ ID NO: 3222530 - protein, 61 aa, Plasmodium falciparum
IDDYNNNTDGYNNNIDGYNNNIDGYNNNIDGYNNNTNDYNNNTNDYNNNTDDYNKPNSSSN

SEQ ID NO: 3222531 - protein, 18 aa, Plasmodium falciparum
IDECKRKPGENSGQTCNE

SEQ ID NO: 3222532 - protein, 5 aa, Plasmodium falciparum
IDEDI

SEQ ID NO: 3222533 - protein, 8 aa, Plasmodium falciparum
IDEDNSDA

SEQ ID NO: 3222534 - protein, 65 aa, Plasmodium falciparum
IDEEAEKEKKENEKNEENGKNEKNEENGKNEKNEENGKNEKNEENGKNEKNEENGKNGKNEKNID

SEQ ID NO: 3222535 - protein, 15 aa, Plasmodium falciparum
IDEEEKNKIKSTYSY

SEQ ID NO: 3222536 - protein, 16 aa, Plasmodium falciparum
IDEEGMKKDENSHNNY

SEQ ID NO: 3222537 - protein, 14 aa, Plasmodium falciparum
IDEEKEKKKPNENF

SEQ ID NO: 3222538 - protein, 12 aa, Plasmodium falciparum
IDEEKKEENNIY

SEQ ID NO: 3222539 - protein, 13 aa, Plasmodium falciparum
IDEEKKESKIEDK

SEQ ID NO: 3222540 - protein, 14 aa, Plasmodium falciparum
IDEEKKESKIEGKN

SEQ ID NO: 3222541 - protein, 6 aa, Plasmodium falciparum
IDEENK

SEQ ID NO: 3222542 - protein, 30 aa, Plasmodium falciparum
IDEEQNEKKNIYEEEHEDDENDDKLNDDDC

SEQ ID NO: 3222543 - protein, 16 aa, Plasmodium falciparum
IDEERANQLHKNDRKR

SEQ ID NO: 3222544 - protein, 10 aa, Plasmodium falciparum
IDEETQEKYR

SEQ ID NO: 3222545 - protein, 6 aa, Plasmodium falciparum
IDEGEK

SEQ ID NO: 3222546 - protein, 10 aa, Plasmodium falciparum
IDEHGQHTTY

SEQ ID NO: 3222547 - protein, 4 aa, Plasmodium falciparum
IDEI

SEQ ID NO: 3222548 - protein, 11 aa, Plasmodium falciparum
IDEKENSHVNQ

SEQ ID NO: 3222549 - protein, 11 aa, Plasmodium falciparum
IDEKKKENANI

SEQ ID NO: 3222550 - protein, 11 aa, Plasmodium falciparum
IDENKNIKDHN

SEQ ID NO: 3222551 - protein, 13 aa, Plasmodium falciparum
IDENTTNNNSTDI

SEQ ID NO: 3222552 - protein, 10 aa, Plasmodium falciparum
IDEPEQIYNE

SEQ ID NO: 3222553 - protein, 20 aa, Plasmodium falciparum
IDEQENKIDNTNNEFNDRYK

SEQ ID NO: 3222554 - protein, 11 aa, Plasmodium falciparum
IDETDNGNNIN

SEQ ID NO: 3222555 - protein, 8 aa, Plasmodium falciparum
IDETYKKN

SEQ ID NO: 3222556 - protein, 6 aa, Plasmodium falciparum
IDEVSE

SEQ ID NO: 3222557 - protein, 6 aa, Plasmodium falciparum
IDEYEN

SEQ ID NO: 3222558 - protein, 81 aa, Plasmodium falciparum
IDGKGSHGSKNEGTSHSESSTSDKKTRKGRPEYPKKNRGGADSGEGRNKKDKRGKGKHRLTESGDEQLKRRKETISPEPPY

SEQ ID NO: 3222559 - protein, 9 aa, Plasmodium falciparum
IDGNGYNDG

SEQ ID NO: 3222560 - protein, 4 aa, Plasmodium falciparum
IDGT

SEQ ID NO: 3222561 - protein, 14 aa, Plasmodium falciparum
IDIKKNSEDAYDGA

SEQ ID NO: 3222562 - protein, 11 aa, Plasmodium falciparum
IDINNKGDTYT

SEQ ID NO: 3222563 - protein, 10 aa, Plasmodium falciparum
IDKEEKEKIH

SEQ ID NO: 3222564 - protein, 41 aa, Plasmodium falciparum
IDKEKEKKKKKSKKEKKKERKRERKEKKKKRKEKRKEIREQ

SEQ ID NO: 3222565 - protein, 10 aa, Plasmodium falciparum
IDKENKRNDM

SEQ ID NO: 3222566 - protein, 19 aa, Plasmodium falciparum
IDKHSNDNDYDDEKKKEKM

SEQ ID NO: 3222567 - protein, 4 aa, Plasmodium falciparum
IDKK

SEQ ID NO: 3222568 - protein, 12 aa, Plasmodium falciparum
IDKKERNEIYEN

SEQ ID NO: 3222569 - protein, 6 aa, Plasmodium falciparum
IDKKKN

SEQ ID NO: 3222570 - protein, 4 aa, Plasmodium falciparum
IDKN

SEQ ID NO: 3222571 - protein, 21 aa, Plasmodium falciparum
IDKNKGNEEYENYKDKEAHDY

SEQ ID NO: 3222572 - protein, 8 aa, Plasmodium falciparum
IDKNNEHM

SEQ ID NO: 3222573 - protein, 4 aa, Plasmodium falciparum
IDKR

SEQ ID NO: 3222574 - protein, 9 aa, Plasmodium falciparum
IDKSKEKKK

SEQ ID NO: 3222575 - protein, 22 aa, Plasmodium falciparum
IDKSQNKPGYEDYSGKKASEYL

SEQ ID NO: 3222576 - protein, 8 aa, Plasmodium falciparum
IDKTKKDV

SEQ ID NO: 3222577 - protein, 12 aa, Plasmodium falciparum
IDNAKRQLSNNN

SEQ ID NO: 3222578 - protein, 9 aa, Plasmodium falciparum
IDNAPNEQN

SEQ ID NO: 3222579 - protein, 4 aa, Plasmodium falciparum
IDND

SEQ ID NO: 3222580 - protein, 6 aa, Plasmodium falciparum
IDNDDK

SEQ ID NO: 3222581 - protein, 8 aa, Plasmodium falciparum
IDNDKREF

SEQ ID NO: 3222582 - protein, 5 aa, Plasmodium falciparum
IDNDP

SEQ ID NO: 3222583 - protein, 12 aa, Plasmodium falciparum
IDNEEKEDTQKI

SEQ ID NO: 3222584 - protein, 7 aa, Plasmodium falciparum
IDNEKDK

SEQ ID NO: 3222585 - protein, 16 aa, Plasmodium falciparum
IDNGNNNNNVHQNYNT

SEQ ID NO: 3222586 - protein, 4 aa, Plasmodium falciparum
IDNK

SEQ ID NO: 3222587 - protein, 10 aa, Plasmodium falciparum
IDNKEQMAND

SEQ ID NO: 3222588 - protein, 13 aa, Plasmodium falciparum
IDNKKNKNENNKC

SEQ ID NO: 3222589 - protein, 10 aa, Plasmodium falciparum
IDNKNKEDKL

SEQ ID NO: 3222590 - protein, 9 aa, Plasmodium falciparum
IDNKSSDVD

SEQ ID NO: 3222591 - protein, 27 aa, Plasmodium falciparum
IDNKSYDNKISNNHEEKDGFKSDDRSL

SEQ ID NO: 3222592 - protein, 7 aa, Plasmodium falciparum
IDNNNNN

SEQ ID NO: 3222593 - protein, 10 aa, Plasmodium falciparum
IDNNNNNNNN

SEQ ID NO: 3222594 - protein, 11 aa, Plasmodium falciparum
IDNNTKGIGET

SEQ ID NO: 3222595 - protein, 7 aa, Plasmodium falciparum
IDNPNES

SEQ ID NO: 3222596 - protein, 40 aa, Plasmodium falciparum
IDNSSNGRNPTTNNKNNTYNDSTYNDNDNNNNNSKPPCSD

SEQ ID NO: 3222597 - protein, 13 aa, Plasmodium falciparum
IDNTNNIDNTNNM

SEQ ID NO: 3222598 - protein, 8 aa, Plasmodium falciparum
IDNTNNMD

SEQ ID NO: 3222599 - protein, 9 aa, Plasmodium falciparum
IDNTSAQNV

SEQ ID NO: 3222600 - protein, 7 aa, Plasmodium falciparum
IDNTSRN

SEQ ID NO: 3222601 - protein, 6 aa, Plasmodium falciparum
IDPFEK

SEQ ID NO: 3222602 - protein, 8 aa, Plasmodium falciparum
IDPKNSNY

SEQ ID NO: 3222603 - protein, 4 aa, Plasmodium falciparum
IDPR

SEQ ID NO: 3222604 - protein, 12 aa, Plasmodium falciparum
IDPTSANHDSYS

SEQ ID NO: 3222605 - protein, 9 aa, Plasmodium falciparum
IDQKEKDEL

SEQ ID NO: 3222606 - protein, 9 aa, Plasmodium falciparum
IDQTNKSDM

SEQ ID NO: 3222607 - protein, 4 aa, Plasmodium falciparum
IDSD

SEQ ID NO: 3222608 - protein, 8 aa, Plasmodium falciparum
IDSDKARH

SEQ ID NO: 3222609 - protein, 7 aa, Plasmodium falciparum
IDSDNER

SEQ ID NO: 3222610 - protein, 8 aa, Plasmodium falciparum
IDSEKKKN

SEQ ID NO: 3222611 - protein, 25 aa, Plasmodium falciparum
IDSELKDSEREDENDSSEESAKKKL

SEQ ID NO: 3222612 - protein, 11 aa, Plasmodium falciparum
IDSGVQKRNSI

SEQ ID NO: 3222613 - protein, 10 aa, Plasmodium falciparum
IDSHDEQINS

SEQ ID NO: 3222614 - protein, 9 aa, Plasmodium falciparum
IDSHQKKKN

SEQ ID NO: 3222615 - protein, 14 aa, Plasmodium falciparum
IDSKKKNKKKKEKY

SEQ ID NO: 3222616 - protein, 18 aa, Plasmodium falciparum
IDSNSSVRKDKNKSININ

SEQ ID NO: 3222617 - protein, 8 aa, Plasmodium falciparum
IDSPLSNT

SEQ ID NO: 3222618 - protein, 6 aa, Plasmodium falciparum
IDSQKT

SEQ ID NO: 3222619 - protein, 10 aa, Plasmodium falciparum
IDSRRDKYKE

SEQ ID NO: 3222620 - protein, 22 aa, Plasmodium falciparum
IDSRYSKRIDKESRDKISDKTN

SEQ ID NO: 3222621 - protein, 8 aa, Plasmodium falciparum
IDSSENVC

SEQ ID NO: 3222622 - protein, 21 aa, Plasmodium falciparum
IDSSTSDSIEKKRRNRRREKM

SEQ ID NO: 3222623 - protein, 6 aa, Plasmodium falciparum
IDSTNN

SEQ ID NO: 3222624 - protein, 11 aa, Plasmodium falciparum
IDSTSSTDKYH

SEQ ID NO: 3222625 - protein, 6 aa, Plasmodium falciparum
IDTAKD

SEQ ID NO: 3222626 - protein, 8 aa, Plasmodium falciparum
IDTDDIPT

SEQ ID NO: 3222627 - protein, 11 aa, Plasmodium falciparum
IDTDENADHRH

SEQ ID NO: 3222628 - protein, 11 aa, Plasmodium falciparum
IDTDNSKNHTY

SEQ ID NO: 3222629 - protein, 13 aa, Plasmodium falciparum
IDTDTSKKGQHEY

SEQ ID NO: 3222630 - protein, 23 aa, Plasmodium falciparum
IDTEKQNEEQNEENTEKLDFSFV

SEQ ID NO: 3222631 - protein, 8 aa, Plasmodium falciparum
IDTKGKKI

SEQ ID NO: 3222632 - protein, 9 aa, Plasmodium falciparum
IDTNDDNDI

SEQ ID NO: 3222633 - protein, 7 aa, Plasmodium falciparum
IDTNEKN

SEQ ID NO: 3222634 - protein, 7 aa, Plasmodium falciparum
IDTNNVD

SEQ ID NO: 3222635 - protein, 12 aa, Plasmodium falciparum
IDTNYSKSTLND

SEQ ID NO: 3222636 - protein, 20 aa, Plasmodium falciparum
IDTPNIKNYDDSSKHINTNP

SEQ ID NO: 3222637 - protein, 4 aa, Plasmodium falciparum
IDTQ

SEQ ID NO: 3222638 - protein, 12 aa, Plasmodium falciparum
IDTSKGKNSINK

SEQ ID NO: 3222639 - protein, 5 aa, Plasmodium falciparum
IDTTD

SEQ ID NO: 3222640 - protein, 23 aa, Plasmodium falciparum
IDTTNNNKKINKTKDDEHEHEHE

SEQ ID NO: 3222641 - protein, 10 aa, Plasmodium falciparum
IDTTSTTSDT

SEQ ID NO: 3222642 - protein, 6 aa, Plasmodium falciparum
IDTYNT

SEQ ID NO: 3222643 - protein, 9 aa, Plasmodium falciparum
IDVRDDGGI

SEQ ID NO: 3222644 - protein, 14 aa, Plasmodium falciparum
IDYNKKKNNNDNSN

SEQ ID NO: 3222645 - protein, 4 aa, Plasmodium falciparum
IDYQ

SEQ ID NO: 3222646 - protein, 13 aa, Plasmodium falciparum
IEASTENIAACKQ

SEQ ID NO: 3222647 - protein, 14 aa, Plasmodium falciparum
IEATEKKECKGSAK

SEQ ID NO: 3222648 - protein, 9 aa, Plasmodium falciparum
IEDEDYDDK

SEQ ID NO: 3222649 - protein, 17 aa, Plasmodium falciparum
IEDEEEEKKKKNLNREK

SEQ ID NO: 3222650 - protein, 11 aa, Plasmodium falciparum
IEDENKEDTSK

SEQ ID NO: 3222651 - protein, 9 aa, Plasmodium falciparum
IEDETGNNI

SEQ ID NO: 3222652 - protein, 8 aa, Plasmodium falciparum
IEDGRKLD

SEQ ID NO: 3222653 - protein, 9 aa, Plasmodium falciparum
IEDKDNNHK

SEQ ID NO: 3222654 - protein, 10 aa, Plasmodium falciparum
IEDKENKKYN

SEQ ID NO: 3222655 - protein, 9 aa, Plasmodium falciparum
IEDKERTHI

SEQ ID NO: 3222656 - protein, 5 aa, Plasmodium falciparum
IEDKV

SEQ ID NO: 3222657 - protein, 4 aa, Plasmodium falciparum
IEDN

SEQ ID NO: 3222658 - protein, 10 aa, Plasmodium falciparum
IEDNNSSNSL

SEQ ID NO: 3222659 - protein, 13 aa, Plasmodium falciparum
IEDPEKKCKNGCN

SEQ ID NO: 3222660 - protein, 5 aa, Plasmodium falciparum
IEDRN

SEQ ID NO: 3222661 - protein, 35 aa, Plasmodium falciparum
IEDSTYNENDNVGEYNGKKEELRDSRKNEQEHTER

SEQ ID NO: 3222662 - protein, 9 aa, Plasmodium falciparum
IEDSYGYKN

SEQ ID NO: 3222663 - protein, 12 aa, Plasmodium falciparum
IEDTENENDEED

SEQ ID NO: 3222664 - protein, 12 aa, Plasmodium falciparum
IEDTKRNNQHYK

SEQ ID NO: 3222665 - protein, 38 aa, Plasmodium falciparum
IEDTSEEQKETDDKIESGSVRDKKNEGSTEKKIETKKG

SEQ ID NO: 3222666 - protein, 38 aa, Plasmodium falciparum
IEDTSRNKNNNNNNNNNNNNNNNNNNNNNNNNNYYSGN

SEQ ID NO: 3222667 - protein, 6 aa, Plasmodium falciparum
IEDTTA

SEQ ID NO: 3222668 - protein, 8 aa, Plasmodium falciparum
IEDTTAKH

SEQ ID NO: 3222669 - protein, 29 aa, Plasmodium falciparum
IEECQSKHSVEKTEKECQEYTPPVEDDEE

SEQ ID NO: 3222670 - protein, 19 aa, Plasmodium falciparum
IEEDEEKNKKKTCLKNNDN

SEQ ID NO: 3222671 - protein, 11 aa, Plasmodium falciparum
IEEDEKEKNYH

SEQ ID NO: 3222672 - protein, 18 aa, Plasmodium falciparum
IEEDGKERNEDEYREHQQ

SEQ ID NO: 3222673 - protein, 16 aa, Plasmodium falciparum
IEEDSENDNNSRQGKS

SEQ ID NO: 3222674 - protein, 4 aa, Plasmodium falciparum
IEEE

SEQ ID NO: 3222675 - protein, 5 aa, Plasmodium falciparum
IEEED

SEQ ID NO: 3222676 - protein, 11 aa, Plasmodium falciparum
IEEEEEKSVTE

SEQ ID NO: 3222677 - protein, 5 aa, Plasmodium falciparum
IEEEI

SEQ ID NO: 3222678 - protein, 6 aa, Plasmodium falciparum
IEEEKD

SEQ ID NO: 3222679 - protein, 12 aa, Plasmodium falciparum
IEEEKKKQRLTK

SEQ ID NO: 3222680 - protein, 5 aa, Plasmodium falciparum
IEEEN

SEQ ID NO: 3222681 - protein, 6 aa, Plasmodium falciparum
IEEEQN

SEQ ID NO: 3222682 - protein, 15 aa, Plasmodium falciparum
IEEESATEQHSEQEL

SEQ ID NO: 3222683 - protein, 6 aa, Plasmodium falciparum
IEEHNK

SEQ ID NO: 3222684 - protein, 8 aa, Plasmodium falciparum
IEEKDTKE

SEQ ID NO: 3222685 - protein, 6 aa, Plasmodium falciparum
IEEKEN

SEQ ID NO: 3222686 - protein, 9 aa, Plasmodium falciparum
IEEKNNNAH

SEQ ID NO: 3222687 - protein, 9 aa, Plasmodium falciparum
IEEKNNNMS

SEQ ID NO: 3222688 - protein, 7 aa, Plasmodium falciparum
IEEKQNA

SEQ ID NO: 3222689 - protein, 14 aa, Plasmodium falciparum
IEEKQNKINTNRDD

SEQ ID NO: 3222690 - protein, 9 aa, Plasmodium falciparum
IEEKTKDAL

SEQ ID NO: 3222691 - protein, 8 aa, Plasmodium falciparum
IEENGDAK

SEQ ID NO: 3222692 - protein, 5 aa, Plasmodium falciparum
IEENK

SEQ ID NO: 3222693 - protein, 5 aa, Plasmodium falciparum
IEENN

SEQ ID NO: 3222694 - protein, 6 aa, Plasmodium falciparum
IEENNT

SEQ ID NO: 3222695 - protein, 9 aa, Plasmodium falciparum
IEENRKDEV

SEQ ID NO: 3222696 - protein, 6 aa, Plasmodium falciparum
IEENSG

SEQ ID NO: 3222697 - protein, 7 aa, Plasmodium falciparum
IEENSNC

SEQ ID NO: 3222698 - protein, 4 aa, Plasmodium falciparum
IEER

SEQ ID NO: 3222699 - protein, 10 aa, Plasmodium falciparum
IEESETSSYG

SEQ ID NO: 3222700 - protein, 35 aa, Plasmodium falciparum
IEESKNGNEDKNSGNMEKSRKPRDRRTERKEKDQD

SEQ ID NO: 3222701 - protein, 16 aa, Plasmodium falciparum
IEETEKKKKNLSNKEC

SEQ ID NO: 3222702 - protein, 13 aa, Plasmodium falciparum
IEETHSSSNTYEQ

SEQ ID NO: 3222703 - protein, 8 aa, Plasmodium falciparum
IEETNPKR

SEQ ID NO: 3222704 - protein, 8 aa, Plasmodium falciparum
IEEYNKEN

SEQ ID NO: 3222705 - protein, 18 aa, Plasmodium falciparum
IEEYNTSSKNKKCKEEIQ

SEQ ID NO: 3222706 - protein, 5 aa, Plasmodium falciparum
IEGAH

SEQ ID NO: 3222707 - protein, 22 aa, Plasmodium falciparum
IEGDPNTEKAKNKNNNNNDDIN

SEQ ID NO: 3222708 - protein, 15 aa, Plasmodium falciparum
IEGIQQGKNSESAGS

SEQ ID NO: 3222709 - protein, 9 aa, Plasmodium falciparum
IEGKPKEIY

SEQ ID NO: 3222710 - protein, 4 aa, Plasmodium falciparum
IEGN

SEQ ID NO: 3222711 - protein, 5 aa, Plasmodium falciparum
IEGNE

SEQ ID NO: 3222712 - protein, 74 aa, Plasmodium falciparum
IEGNKETAAQNDDNKNKGNYYNSTRDGYNNTSDGYNNTSDGYNNTSDVYNNPSDGYNNTPRQHDNHTYQNNPAH

SEQ ID NO: 3222713 - protein, 53 aa, Plasmodium falciparum
IEGNKSGNGEEHNKHKRRQVDNQEDDYDVDEYGNPKSGAPYKSEEEHAEQQNY

SEQ ID NO: 3222714 - protein, 14 aa, Plasmodium falciparum
IEGNTKRNYENNTN

SEQ ID NO: 3222715 - protein, 25 aa, Plasmodium falciparum
IEGSNNNNNNNNNNYNYNNYNNNNY

SEQ ID NO: 3222716 - protein, 22 aa, Plasmodium falciparum
IEHNHNTNSNNNNNNNNNNVCN

SEQ ID NO: 3222717 - protein, 5 aa, Plasmodium falciparum
IEIPK

SEQ ID NO: 3222718 - protein, 5 aa, Plasmodium falciparum
IEKAA

SEQ ID NO: 3222719 - protein, 7 aa, Plasmodium falciparum
IEKAPKE

SEQ ID NO: 3222720 - protein, 12 aa, Plasmodium falciparum
IEKDTGTNVDEE

SEQ ID NO: 3222721 - protein, 26 aa, Plasmodium falciparum
IEKEDNQNINYNDGKELNETDKNEIY

SEQ ID NO: 3222722 - protein, 6 aa, Plasmodium falciparum
IEKEGR

SEQ ID NO: 3222723 - protein, 9 aa, Plasmodium falciparum
IEKEQKKRE

SEQ ID NO: 3222724 - protein, 11 aa, Plasmodium falciparum
IEKESSLISDK

SEQ ID NO: 3222725 - protein, 37 aa, Plasmodium falciparum
IEKGDNQNINYNDDEELNETDKNEFYNNDEENENDDI

SEQ ID NO: 3222726 - protein, 15 aa, Plasmodium falciparum
IEKGENKNKNKNNIY

SEQ ID NO: 3222727 - protein, 21 aa, Plasmodium falciparum
IEKGNIKNKNSHTNVGNNNYD

SEQ ID NO: 3222728 - protein, 17 aa, Plasmodium falciparum
IEKGSSCSRENKCTGCS

SEQ ID NO: 3222729 - protein, 7 aa, Plasmodium falciparum
IEKHNEE

SEQ ID NO: 3222730 - protein, 22 aa, Plasmodium falciparum
IEKIPKEKSPVDKNTSTHINGY

SEQ ID NO: 3222731 - protein, 45 aa, Plasmodium falciparum
IEKKKEKEKIRKPKKKVEKEIKPKEVKGVKGKLKKDVKAKHLKGS

SEQ ID NO: 3222732 - protein, 12 aa, Plasmodium falciparum
IEKKKKKLSTQG

SEQ ID NO: 3222733 - protein, 11 aa, Plasmodium falciparum
IEKKKSSTHMK

SEQ ID NO: 3222734 - protein, 18 aa, Plasmodium falciparum
IEKKNNNNNDNLKNNKEN

SEQ ID NO: 3222735 - protein, 6 aa, Plasmodium falciparum
IEKKRK

SEQ ID NO: 3222736 - protein, 9 aa, Plasmodium falciparum
IEKKSGNNI

SEQ ID NO: 3222737 - protein, 73 aa, Plasmodium falciparum
IEKKTKKKKKKKKKGTSCCSSSSVDYSHSEKYNKNDDENNNSDDDNDDNNNNNNNNNNNNNNNNNNNDDDDDD

SEQ ID NO: 3222738 - protein, 18 aa, Plasmodium falciparum
IEKNDEEESAIQNTSEHI

SEQ ID NO: 3222739 - protein, 9 aa, Plasmodium falciparum
IEKNKGQKI

SEQ ID NO: 3222740 - protein, 6 aa, Plasmodium falciparum
IEKNKV

SEQ ID NO: 3222741 - protein, 5 aa, Plasmodium falciparum
IEKNN

SEQ ID NO: 3222742 - protein, 9 aa, Plasmodium falciparum
IEKNPKIYK

SEQ ID NO: 3222743 - protein, 8 aa, Plasmodium falciparum
IEKRKKGY

SEQ ID NO: 3222744 - protein, 19 aa, Plasmodium falciparum
IEKRKNEKKEKKEKLQRKN

SEQ ID NO: 3222745 - protein, 5 aa, Plasmodium falciparum
IEKSA

SEQ ID NO: 3222746 - protein, 5 aa, Plasmodium falciparum
IEKSL

SEQ ID NO: 3222747 - protein, 6 aa, Plasmodium falciparum
IEKSSE

SEQ ID NO: 3222748 - protein, 11 aa, Plasmodium falciparum
IEKVGKQQDCN

SEQ ID NO: 3222749 - protein, 16 aa, Plasmodium falciparum
IEKYDNNDDSNNNVRK

SEQ ID NO: 3222750 - protein, 19 aa, Plasmodium falciparum
IELPHNNNNNNNNSNERKD

SEQ ID NO: 3222751 - protein, 5 aa, Plasmodium falciparum
IENDK

SEQ ID NO: 3222752 - protein, 11 aa, Plasmodium falciparum
IENDKIEKTKE

SEQ ID NO: 3222753 - protein, 5 aa, Plasmodium falciparum
IENDN

SEQ ID NO: 3222754 - protein, 63 aa, Plasmodium falciparum
IENDNDDNNDNDNDNDNDNNNDNNNNNDDDNNDNNNDDNNDNNNDNNDNNNNNYVDGEDVNTT

SEQ ID NO: 3222755 - protein, 4 aa, Plasmodium falciparum
IENE

SEQ ID NO: 3222756 - protein, 10 aa, Plasmodium falciparum
IENEDKEQSV

SEQ ID NO: 3222757 - protein, 12 aa, Plasmodium falciparum
IENEDKREIYTN

SEQ ID NO: 3222758 - protein, 13 aa, Plasmodium falciparum
IENEGKKKNLDLT

SEQ ID NO: 3222759 - protein, 9 aa, Plasmodium falciparum
IENEKKKKV

SEQ ID NO: 3222760 - protein, 12 aa, Plasmodium falciparum
IENFGEKDKLPM

SEQ ID NO: 3222761 - protein, 5 aa, Plasmodium falciparum
IENKD

SEQ ID NO: 3222762 - protein, 11 aa, Plasmodium falciparum
IENKDKEKEKE

SEQ ID NO: 3222763 - protein, 8 aa, Plasmodium falciparum
IENKDKKL

SEQ ID NO: 3222764 - protein, 9 aa, Plasmodium falciparum
IENKKKTNI

SEQ ID NO: 3222765 - protein, 17 aa, Plasmodium falciparum
IENKRNTQNELDDNEQN

SEQ ID NO: 3222766 - protein, 30 aa, Plasmodium falciparum
IENKSESNSMKRSSKRSIGSENEQAISDNT

SEQ ID NO: 3222767 - protein, 7 aa, Plasmodium falciparum
IENKTDV

SEQ ID NO: 3222768 - protein, 31 aa, Plasmodium falciparum
IENNENNENNENIENNENNENNENSSIMNSE

SEQ ID NO: 3222769 - protein, 9 aa, Plasmodium falciparum
IENNNKNDI

SEQ ID NO: 3222770 - protein, 4 aa, Plasmodium falciparum
IENP

SEQ ID NO: 3222771 - protein, 5 aa, Plasmodium falciparum
IENPN

SEQ ID NO: 3222772 - protein, 4 aa, Plasmodium falciparum
IENR

SEQ ID NO: 3222773 - protein, 8 aa, Plasmodium falciparum
IENSDEKY

SEQ ID NO: 3222774 - protein, 12 aa, Plasmodium falciparum
IENTIENSPCGT

SEQ ID NO: 3222775 - protein, 7 aa, Plasmodium falciparum
IENTKNT

SEQ ID NO: 3222776 - protein, 5 aa, Plasmodium falciparum
IENTN

SEQ ID NO: 3222777 - protein, 12 aa, Plasmodium falciparum
IEPNKNDDTYER

SEQ ID NO: 3222778 - protein, 4 aa, Plasmodium falciparum
IEPQ

SEQ ID NO: 3222779 - protein, 32 aa, Plasmodium falciparum
IEQDDPYDKDQKKKRKKKKKEKQKQKKKERKK

SEQ ID NO: 3222780 - protein, 39 aa, Plasmodium falciparum
IEQEEDKKKIINNNNNNINSNNNINSNNNINSNNNMNDE

SEQ ID NO: 3222781 - protein, 10 aa, Plasmodium falciparum
IEQGNNNINN

SEQ ID NO: 3222782 - protein, 5 aa, Plasmodium falciparum
IEQGP

SEQ ID NO: 3222783 - protein, 13 aa, Plasmodium falciparum
IEQNDSQKKKQII

SEQ ID NO: 3222784 - protein, 10 aa, Plasmodium falciparum
IEQNENTTNL

SEQ ID NO: 3222785 - protein, 10 aa, Plasmodium falciparum
IEQNKNTNII

SEQ ID NO: 3222786 - protein, 11 aa, Plasmodium falciparum
IEQNQKKSLKK

SEQ ID NO: 3222787 - protein, 9 aa, Plasmodium falciparum
IEQNTQPLK

SEQ ID NO: 3222788 - protein, 5 aa, Plasmodium falciparum
IEQQT

SEQ ID NO: 3222789 - protein, 11 aa, Plasmodium falciparum
IERDNKKEINY

SEQ ID NO: 3222790 - protein, 11 aa, Plasmodium falciparum
IEREDDDHYNY

SEQ ID NO: 3222791 - protein, 19 aa, Plasmodium falciparum
IEREKKKKKKKKIMIRIRW

SEQ ID NO: 3222792 - protein, 11 aa, Plasmodium falciparum
IERKGSQSKNS

SEQ ID NO: 3222793 - protein, 6 aa, Plasmodium falciparum
IERPQE

SEQ ID NO: 3222794 - protein, 108 aa, Plasmodium falciparum
IERRKKKNNTNEKNNTNEKDNTNEKNNTNEKDNTNEKDNTNEKDNTNEKDNTNEKDNTNEKNNTNEKDNTNEKDNTNEKDNTNEKDNTNEKNNTNEKNNTNEKDNDLQ

SEQ ID NO: 3222795 - protein, 9 aa, Plasmodium falciparum
IERTKETKN

SEQ ID NO: 3222796 - protein, 5 aa, Plasmodium falciparum
IERTN

SEQ ID NO: 3222797 - protein, 5 aa, Plasmodium falciparum
IERYE

SEQ ID NO: 3222798 - protein, 8 aa, Plasmodium falciparum
IESDEKEN

SEQ ID NO: 3222799 - protein, 25 aa, Plasmodium falciparum
IESDENSNIGNINSDNSNEENKKEK

SEQ ID NO: 3222800 - protein, 17 aa, Plasmodium falciparum
IESDMKNKTSNKKISTG

SEQ ID NO: 3222801 - protein, 8 aa, Plasmodium falciparum
IESDNGEV

SEQ ID NO: 3222802 - protein, 10 aa, Plasmodium falciparum
IESESATESD

SEQ ID NO: 3222803 - protein, 5 aa, Plasmodium falciparum
IESGA

SEQ ID NO: 3222804 - protein, 7 aa, Plasmodium falciparum
IESGDTK

SEQ ID NO: 3222805 - protein, 17 aa, Plasmodium falciparum
IESKKIPKNNGSNKPSV

SEQ ID NO: 3222806 - protein, 6 aa, Plasmodium falciparum
IESKYT

SEQ ID NO: 3222807 - protein, 114 aa, Plasmodium falciparum
IESNENDNITNAQLGSHNEQLENTELNNDNNNNNNNTNNGFNPNEGDNDSDSDSNSDSNSDSDSDDYNDNSDNNNNNDNNNDNNDNNNDNNNENQNNVNNDEDHLEEENEEDYK

SEQ ID NO: 3222808 - protein, 6 aa, Plasmodium falciparum
IESNTR

SEQ ID NO: 3222809 - protein, 4 aa, Plasmodium falciparum
IESS

SEQ ID NO: 3222810 - protein, 10 aa, Plasmodium falciparum
IESSKNNNKT

SEQ ID NO: 3222811 - protein, 7 aa, Plasmodium falciparum
IESSKRK

SEQ ID NO: 3222812 - protein, 11 aa, Plasmodium falciparum
IESSQKLKKQD

SEQ ID NO: 3222813 - protein, 16 aa, Plasmodium falciparum
IESTQTSHRSNTHGQQ

SEQ ID NO: 3222814 - protein, 9 aa, Plasmodium falciparum
IETDDEEET

SEQ ID NO: 3222815 - protein, 6 aa, Plasmodium falciparum
IETNNK

SEQ ID NO: 3222816 - protein, 10 aa, Plasmodium falciparum
IETSNYNSLD

SEQ ID NO: 3222817 - protein, 11 aa, Plasmodium falciparum
IETTSKTASDT

SEQ ID NO: 3222818 - protein, 11 aa, Plasmodium falciparum
IETTSKTSTDT

SEQ ID NO: 3222819 - protein, 42 aa, Plasmodium falciparum
IETYPSSTSGSEQCTTPPSNLDDYTHTDDDDAHEKEKQSPKF

SEQ ID NO: 3222820 - protein, 17 aa, Plasmodium falciparum
IGAGGSETNSDDDDNNK

SEQ ID NO: 3222821 - protein, 5 aa, Plasmodium falciparum
IGANN

SEQ ID NO: 3222822 - protein, 36 aa, Plasmodium falciparum
IGASQKKEKKKRKNKSATTPKKNNKVPNNDDQIDDK

SEQ ID NO: 3222823 - protein, 8 aa, Plasmodium falciparum
IGDDNNNN

SEQ ID NO: 3222824 - protein, 6 aa, Plasmodium falciparum
IGDEKK

SEQ ID NO: 3222825 - protein, 5 aa, Plasmodium falciparum
IGDEN

SEQ ID NO: 3222826 - protein, 6 aa, Plasmodium falciparum
IGDGAN

SEQ ID NO: 3222827 - protein, 4 aa, Plasmodium falciparum
IGDK

SEQ ID NO: 3222828 - protein, 6 aa, Plasmodium falciparum
IGDKTN

SEQ ID NO: 3222829 - protein, 32 aa, Plasmodium falciparum
IGDMENKNDNVENKNDNVGNKNDNVKNASSDL

SEQ ID NO: 3222830 - protein, 24 aa, Plasmodium falciparum
IGDNEKKEKRAKTFENNDFKNEKS

SEQ ID NO: 3222831 - protein, 19 aa, Plasmodium falciparum
IGDNKNKPPLLPTPKNESY

SEQ ID NO: 3222832 - protein, 29 aa, Plasmodium falciparum
IGDNNNNNNNDGNNNNNNNDGNNNNNNNH

SEQ ID NO: 3222833 - protein, 12 aa, Plasmodium falciparum
IGDNNQTHLRDE

SEQ ID NO: 3222834 - protein, 33 aa, Plasmodium falciparum
IGDNRNGNIGDNTNGNIGDNRNGNTGNNRNGNI

SEQ ID NO: 3222835 - protein, 13 aa, Plasmodium falciparum
IGDTENQKEGKNV

SEQ ID NO: 3222836 - protein, 29 aa, Plasmodium falciparum
IGECKKNHAKTSGSDCNTAPTSDTTLDDE

SEQ ID NO: 3222837 - protein, 6 aa, Plasmodium falciparum
IGEDKR

SEQ ID NO: 3222838 - protein, 14 aa, Plasmodium falciparum
IGEEKSNRNKNNIP

SEQ ID NO: 3222839 - protein, 4 aa, Plasmodium falciparum
IGEK

SEQ ID NO: 3222840 - protein, 7 aa, Plasmodium falciparum
IGEKVEK

SEQ ID NO: 3222841 - protein, 7 aa, Plasmodium falciparum
IGENKNM

SEQ ID NO: 3222842 - protein, 28 aa, Plasmodium falciparum
IGENSTSGTVNKKLQKKETQCEDNKGPL

SEQ ID NO: 3222843 - protein, 8 aa, Plasmodium falciparum
IGEPSSPP

SEQ ID NO: 3222844 - protein, 4 aa, Plasmodium falciparum
IGGD

SEQ ID NO: 3222845 - protein, 26 aa, Plasmodium falciparum
IGGEGAEGQLQSTDSKDAARGEKTPL

SEQ ID NO: 3222846 - protein, 10 aa, Plasmodium falciparum
IGGKKGFKSG

SEQ ID NO: 3222847 - protein, 21 aa, Plasmodium falciparum
IGGKRSSGSVNGAGQREHDQT

SEQ ID NO: 3222848 - protein, 8 aa, Plasmodium falciparum
IGGNDKVK

SEQ ID NO: 3222849 - protein, 7 aa, Plasmodium falciparum
IGGPSLP

SEQ ID NO: 3222850 - protein, 7 aa, Plasmodium falciparum
IGGPTTA

SEQ ID NO: 3222851 - protein, 17 aa, Plasmodium falciparum
IGGQCTKEKISGSTNTC

SEQ ID NO: 3222852 - protein, 5 aa, Plasmodium falciparum
IGHNS

SEQ ID NO: 3222853 - protein, 13 aa, Plasmodium falciparum
IGKADNTKDISTT

SEQ ID NO: 3222854 - protein, 18 aa, Plasmodium falciparum
IGKEASLDENNNERQIKS

SEQ ID NO: 3222855 - protein, 47 aa, Plasmodium falciparum
IGKKKKNNNKNNNNNENDNNNNNNNNNNNNNNNNNNNCKRKKKKMTP

SEQ ID NO: 3222856 - protein, 19 aa, Plasmodium falciparum
IGKNAEHKSTSVYNNNNNN

SEQ ID NO: 3222857 - protein, 8 aa, Plasmodium falciparum
IGKNGEDI

SEQ ID NO: 3222858 - protein, 7 aa, Plasmodium falciparum
IGKNSNN

SEQ ID NO: 3222859 - protein, 18 aa, Plasmodium falciparum
IGKNTKKKKQKKKNKELY

SEQ ID NO: 3222860 - protein, 10 aa, Plasmodium falciparum
IGNEENVESL

SEQ ID NO: 3222861 - protein, 10 aa, Plasmodium falciparum
IGNKKKKESV

SEQ ID NO: 3222862 - protein, 8 aa, Plasmodium falciparum
IGNKNNSV

SEQ ID NO: 3222863 - protein, 6 aa, Plasmodium falciparum
IGNNNT

SEQ ID NO: 3222864 - protein, 6 aa, Plasmodium falciparum
IGNRTK

SEQ ID NO: 3222865 - protein, 7 aa, Plasmodium falciparum
IGNSVNE

SEQ ID NO: 3222866 - protein, 16 aa, Plasmodium falciparum
IGNTKKDKTQSGEKRN

SEQ ID NO: 3222867 - protein, 13 aa, Plasmodium falciparum
IGNTNQMSSSNKN

SEQ ID NO: 3222868 - protein, 7 aa, Plasmodium falciparum
IGPNDNL

SEQ ID NO: 3222869 - protein, 4 aa, Plasmodium falciparum
IGPS

SEQ ID NO: 3222870 - protein, 15 aa, Plasmodium falciparum
IGQNSEKQESVSENV

SEQ ID NO: 3222871 - protein, 4 aa, Plasmodium falciparum
IGQP

SEQ ID NO: 3222872 - protein, 4 aa, Plasmodium falciparum
IGRK

SEQ ID NO: 3222873 - protein, 7 aa, Plasmodium falciparum
IGRNGED

SEQ ID NO: 3222874 - protein, 5 aa, Plasmodium falciparum
IGRRN

SEQ ID NO: 3222875 - protein, 26 aa, Plasmodium falciparum
IGRSGNEQSDNQENSSHSSDNSGSLT

SEQ ID NO: 3222876 - protein, 8 aa, Plasmodium falciparum
IGRSGNSN

SEQ ID NO: 3222877 - protein, 4 aa, Plasmodium falciparum
IGSC

SEQ ID NO: 3222878 - protein, 10 aa, Plasmodium falciparum
IGSDKKPEHS

SEQ ID NO: 3222879 - protein, 13 aa, Plasmodium falciparum
IGSGNDVEKVKPN

SEQ ID NO: 3222880 - protein, 9 aa, Plasmodium falciparum
IGSKSKSSK

SEQ ID NO: 3222881 - protein, 10 aa, Plasmodium falciparum
IGSNEDTQDN

SEQ ID NO: 3222882 - protein, 7 aa, Plasmodium falciparum
IGSNKTF

SEQ ID NO: 3222883 - protein, 5 aa, Plasmodium falciparum
IGSNQ

SEQ ID NO: 3222884 - protein, 10 aa, Plasmodium falciparum
IGSSETGSGK

SEQ ID NO: 3222885 - protein, 8 aa, Plasmodium falciparum
IGSSSANK

SEQ ID NO: 3222886 - protein, 7 aa, Plasmodium falciparum
IGSTGKI

SEQ ID NO: 3222887 - protein, 4 aa, Plasmodium falciparum
IGSV

SEQ ID NO: 3222888 - protein, 7 aa, Plasmodium falciparum
IGTDDKK

SEQ ID NO: 3222889 - protein, 36 aa, Plasmodium falciparum
IGTNNNNNNNNNSNNNSNNNSNNNSNNNNNNNNNIN

SEQ ID NO: 3222890 - protein, 29 aa, Plasmodium falciparum
IGTQKNSTINNKRKSHKNNSNNNNNNSNN

SEQ ID NO: 3222891 - protein, 5 aa, Plasmodium falciparum
IGTRY

SEQ ID NO: 3222892 - protein, 21 aa, Plasmodium falciparum
IGYDNNNESKDNIKENSGDME

SEQ ID NO: 3222893 - protein, 4 aa, Plasmodium falciparum
IGYQ

SEQ ID NO: 3222894 - protein, 34 aa, Plasmodium falciparum
IHDDDSDSKTEDEDQDELDPAGPLSPSEPRPKRL

SEQ ID NO: 3222895 - protein, 8 aa, Plasmodium falciparum
IHDKGETY

SEQ ID NO: 3222896 - protein, 10 aa, Plasmodium falciparum
IHDKNNNKQL

SEQ ID NO: 3222897 - protein, 13 aa, Plasmodium falciparum
IHDNENDNKNKMH

SEQ ID NO: 3222898 - protein, 7 aa, Plasmodium falciparum
IHDNNDD

SEQ ID NO: 3222899 - protein, 8 aa, Plasmodium falciparum
IHDSESEI

SEQ ID NO: 3222900 - protein, 13 aa, Plasmodium falciparum
IHEEDGDHKNDVE

SEQ ID NO: 3222901 - protein, 4 aa, Plasmodium falciparum
IHGN

SEQ ID NO: 3222902 - protein, 9 aa, Plasmodium falciparum
IHGSGPSET

SEQ ID NO: 3222903 - protein, 16 aa, Plasmodium falciparum
IHKKNKSDLYRKEKNN

SEQ ID NO: 3222904 - protein, 10 aa, Plasmodium falciparum
IHLDNSDDNM

SEQ ID NO: 3222905 - protein, 5 aa, Plasmodium falciparum
IHNDG

SEQ ID NO: 3222906 - protein, 13 aa, Plasmodium falciparum
IHNDQNNNAQYDN

SEQ ID NO: 3222907 - protein, 29 aa, Plasmodium falciparum
IHNENEDKQGDKNLKKSDRKNDEKENNSY

SEQ ID NO: 3222908 - protein, 101 aa, Plasmodium falciparum
IHNGYENDKDTEQKDDNKEDKKDIEQVDDNKEDKKDIEQVDDNKEDKKDIEQVDDNKEDKKDIEQVDDNKEDKKDTEQVDDNKEDKKDTEQVDDNKEDKKY

SEQ ID NO: 3222909 - protein, 13 aa, Plasmodium falciparum
IHNNDTVNNNMTT

SEQ ID NO: 3222910 - protein, 6 aa, Plasmodium falciparum
IHNNNN

SEQ ID NO: 3222911 - protein, 16 aa, Plasmodium falciparum
IHNNQSPQKQKEQQQQ

SEQ ID NO: 3222912 - protein, 7 aa, Plasmodium falciparum
IHNNSDD

SEQ ID NO: 3222913 - protein, 10 aa, Plasmodium falciparum
IHNTNNEQTY

SEQ ID NO: 3222914 - protein, 12 aa, Plasmodium falciparum
IHPNKTYNHNNQ

SEQ ID NO: 3222915 - protein, 4 aa, Plasmodium falciparum
IHPQ

SEQ ID NO: 3222916 - protein, 4 aa, Plasmodium falciparum
IHSD

SEQ ID NO: 3222917 - protein, 17 aa, Plasmodium falciparum
IHSEDEDNKDDDSKSVK

SEQ ID NO: 3222918 - protein, 7 aa, Plasmodium falciparum
IHSNNNN

SEQ ID NO: 3222919 - protein, 7 aa, Plasmodium falciparum
IHSSEND

SEQ ID NO: 3222920 - protein, 4 aa, Plasmodium falciparum
IHTK

SEQ ID NO: 3222921 - protein, 5 aa, Plasmodium falciparum
IHTSF

SEQ ID NO: 3222922 - protein, 5 aa, Plasmodium falciparum
IHTSN

SEQ ID NO: 3222923 - protein, 14 aa, Plasmodium falciparum
IIDEEKKESKIEDK

SEQ ID NO: 3222924 - protein, 14 aa, Plasmodium falciparum
IIKPSNKNKNKLSK

SEQ ID NO: 3222925 - protein, 11 aa, Plasmodium falciparum
IINKSNSKNYV

SEQ ID NO: 3222926 - protein, 10 aa, Plasmodium falciparum
IISEKDKEKI

SEQ ID NO: 3222927 - protein, 7 aa, Plasmodium falciparum
IISKDGK

SEQ ID NO: 3222928 - protein, 7 aa, Plasmodium falciparum
IISPDKK

SEQ ID NO: 3222929 - protein, 4 aa, Plasmodium falciparum
IITS

SEQ ID NO: 3222930 - protein, 301 aa, Plasmodium falciparum
IKAEEKRKADELKKAEEKKKADELKKSEEKKKADELKKKAEEKKKADELKKKAEEKKKADELKKKAEEKKKADEVKKAEEKKKADELKKSEEKKKADELKKSEEKKKADELKKKAEEKKKADELKKKAEEKKKADELKKKAEEKKKADELKKKAEEKKKADELKKKAEEKKKADELKKKAEEKKKAENLKKAEEKKKADELKKKAEEKKKADELKKKAEEKKKADELKKKAEEKKKADELKKAEEKKKADELKKAEEKKKADELKKAEEKKKADELKKAEELKKAEEKKKVEQKKREEERR

SEQ ID NO: 3222931 - protein, 39 aa, Plasmodium falciparum
IKAKEKKEKEDAKGQIYESAGEDDEDKDPQEELQRGDIP

SEQ ID NO: 3222932 - protein, 7 aa, Plasmodium falciparum
IKANKKK

SEQ ID NO: 3222933 - protein, 6 aa, Plasmodium falciparum
IKANTS

SEQ ID NO: 3222934 - protein, 10 aa, Plasmodium falciparum
IKAQEDDKQD

SEQ ID NO: 3222935 - protein, 10 aa, Plasmodium falciparum
IKASSNESLN

SEQ ID NO: 3222936 - protein, 5 aa, Plasmodium falciparum
IKAST

SEQ ID NO: 3222937 - protein, 11 aa, Plasmodium falciparum
IKCPKNSSSIK

SEQ ID NO: 3222938 - protein, 24 aa, Plasmodium falciparum
IKCSKTSTYNSEKYNSNERNSNLE

SEQ ID NO: 3222939 - protein, 11 aa, Plasmodium falciparum
IKCSNSEGACA

SEQ ID NO: 3222940 - protein, 8 aa, Plasmodium falciparum
IKDDHMNS

SEQ ID NO: 3222941 - protein, 9 aa, Plasmodium falciparum
IKDDKEQNK

SEQ ID NO: 3222942 - protein, 16 aa, Plasmodium falciparum
IKDDNQEEQKAPEIDP

SEQ ID NO: 3222943 - protein, 23 aa, Plasmodium falciparum
IKDDNYNDDENNKNNIQNDEKEY

SEQ ID NO: 3222944 - protein, 39 aa, Plasmodium falciparum
IKDDTTKQNNNNNNNNNRYHNNNRYHNNNRYHNNNRYHN

SEQ ID NO: 3222945 - protein, 20 aa, Plasmodium falciparum
IKDEDKSNIQCEEDKKKKNI

SEQ ID NO: 3222946 - protein, 10 aa, Plasmodium falciparum
IKDEDTINDE

SEQ ID NO: 3222947 - protein, 8 aa, Plasmodium falciparum
IKDEKEKI

SEQ ID NO: 3222948 - protein, 7 aa, Plasmodium falciparum
IKDEQKD

SEQ ID NO: 3222949 - protein, 10 aa, Plasmodium falciparum
IKDETFSREN

SEQ ID NO: 3222950 - protein, 14 aa, Plasmodium falciparum
IKDETYNSSDVCSE

SEQ ID NO: 3222951 - protein, 17 aa, Plasmodium falciparum
IKDGEDNTHQKKDSYKL

SEQ ID NO: 3222952 - protein, 8 aa, Plasmodium falciparum
IKDGESGE

SEQ ID NO: 3222953 - protein, 20 aa, Plasmodium falciparum
IKDHNKKNKNKKKNKQTQQV

SEQ ID NO: 3222954 - protein, 46 aa, Plasmodium falciparum
IKDKEKKEKEERERENAGLDPFGGSVDDEASTPDPQTQLQSGTIPP

SEQ ID NO: 3222955 - protein, 7 aa, Plasmodium falciparum
IKDKEQK

SEQ ID NO: 3222956 - protein, 11 aa, Plasmodium falciparum
IKDKETNLEKN

SEQ ID NO: 3222957 - protein, 6 aa, Plasmodium falciparum
IKDKKN

SEQ ID NO: 3222958 - protein, 6 aa, Plasmodium falciparum
IKDKKY

SEQ ID NO: 3222959 - protein, 8 aa, Plasmodium falciparum
IKDKNGSL

SEQ ID NO: 3222960 - protein, 9 aa, Plasmodium falciparum
IKDKQHKNT

SEQ ID NO: 3222961 - protein, 15 aa, Plasmodium falciparum
IKDKRQKRKEERDKD

SEQ ID NO: 3222962 - protein, 15 aa, Plasmodium falciparum
IKDKRQKRKEERDKN

SEQ ID NO: 3222963 - protein, 18 aa, Plasmodium falciparum
IKDKSGKTQIVSNEKGGI

SEQ ID NO: 3222964 - protein, 12 aa, Plasmodium falciparum
IKDKTEKESKHV

SEQ ID NO: 3222965 - protein, 16 aa, Plasmodium falciparum
IKDKWSKNKRISSIGD

SEQ ID NO: 3222966 - protein, 10 aa, Plasmodium falciparum
IKDNEEKVNK

SEQ ID NO: 3222967 - protein, 50 aa, Plasmodium falciparum
IKDNINDYNNNNNNNSCSSRGKKGRKGKNKENEEKVETKRENNEEKNREQ

SEQ ID NO: 3222968 - protein, 8 aa, Plasmodium falciparum
IKDNKHDH

SEQ ID NO: 3222969 - protein, 5 aa, Plasmodium falciparum
IKDNN

SEQ ID NO: 3222970 - protein, 9 aa, Plasmodium falciparum
IKDNNNDDE

SEQ ID NO: 3222971 - protein, 7 aa, Plasmodium falciparum
IKDNSNN

SEQ ID NO: 3222972 - protein, 16 aa, Plasmodium falciparum
IKDSDLDTNQTNPNGC

SEQ ID NO: 3222973 - protein, 6 aa, Plasmodium falciparum
IKDSKN

SEQ ID NO: 3222974 - protein, 9 aa, Plasmodium falciparum
IKDSTTDTV

SEQ ID NO: 3222975 - protein, 8 aa, Plasmodium falciparum
IKDTEKAY

SEQ ID NO: 3222976 - protein, 5 aa, Plasmodium falciparum
IKDTN

SEQ ID NO: 3222977 - protein, 9 aa, Plasmodium falciparum
IKDTNETSV

SEQ ID NO: 3222978 - protein, 7 aa, Plasmodium falciparum
IKDTNID

SEQ ID NO: 3222979 - protein, 16 aa, Plasmodium falciparum
IKDTYNDDDDYDYEKE

SEQ ID NO: 3222980 - protein, 7 aa, Plasmodium falciparum
IKEATKE

SEQ ID NO: 3222981 - protein, 6 aa, Plasmodium falciparum
IKEDEK

SEQ ID NO: 3222982 - protein, 18 aa, Plasmodium falciparum
IKEDTKHEKENAKQMNEE

SEQ ID NO: 3222983 - protein, 7 aa, Plasmodium falciparum
IKEDTKK

SEQ ID NO: 3222984 - protein, 6 aa, Plasmodium falciparum
IKEDTQ

SEQ ID NO: 3222985 - protein, 4 aa, Plasmodium falciparum
IKEE

SEQ ID NO: 3222986 - protein, 6 aa, Plasmodium falciparum
IKEEAS

SEQ ID NO: 3222987 - protein, 8 aa, Plasmodium falciparum
IKEEEENN

SEQ ID NO: 3222988 - protein, 8 aa, Plasmodium falciparum
IKEEGKKY

SEQ ID NO: 3222989 - protein, 5 aa, Plasmodium falciparum
IKEEK

SEQ ID NO: 3222990 - protein, 6 aa, Plasmodium falciparum
IKEEKM

SEQ ID NO: 3222991 - protein, 7 aa, Plasmodium falciparum
IKEENNE

SEQ ID NO: 3222992 - protein, 8 aa, Plasmodium falciparum
IKEENSSY

SEQ ID NO: 3222993 - protein, 7 aa, Plasmodium falciparum
IKEESHS

SEQ ID NO: 3222994 - protein, 5 aa, Plasmodium falciparum
IKEGE

SEQ ID NO: 3222995 - protein, 10 aa, Plasmodium falciparum
IKEGGSDNIY

SEQ ID NO: 3222996 - protein, 15 aa, Plasmodium falciparum
IKEGNINQIEQKYIK

SEQ ID NO: 3222997 - protein, 7 aa, Plasmodium falciparum
IKEHGGS

SEQ ID NO: 3222998 - protein, 8 aa, Plasmodium falciparum
IKEHTANN

SEQ ID NO: 3222999 - protein, 15 aa, Plasmodium falciparum
IKEKEKKEKKKTYEQ

SEQ ID NO: 3223000 - protein, 40 aa, Plasmodium falciparum
IKEKEKKEKQEEAQGNVYTQTDENKNKDPQNELNGGKIPD

SEQ ID NO: 3223001 - protein, 20 aa, Plasmodium falciparum
IKEKEKQEEQQRQQENGGRL

SEQ ID NO: 3223002 - protein, 9 aa, Plasmodium falciparum
IKEKESEFD

SEQ ID NO: 3223003 - protein, 12 aa, Plasmodium falciparum
IKEKIRNKKRKK

SEQ ID NO: 3223004 - protein, 19 aa, Plasmodium falciparum
IKEKKKKIKKKKNNCKKDL

SEQ ID NO: 3223005 - protein, 11 aa, Plasmodium falciparum
IKEKKKSKKMK

SEQ ID NO: 3223006 - protein, 12 aa, Plasmodium falciparum
IKEKKSNSAVSN

SEQ ID NO: 3223007 - protein, 16 aa, Plasmodium falciparum
IKEKNECDNTTNNEYD

SEQ ID NO: 3223008 - protein, 15 aa, Plasmodium falciparum
IKEKNEKKTKSSLAQ

SEQ ID NO: 3223009 - protein, 11 aa, Plasmodium falciparum
IKEKNKKPKIK

SEQ ID NO: 3223010 - protein, 10 aa, Plasmodium falciparum
IKEKQKEKLK

SEQ ID NO: 3223011 - protein, 9 aa, Plasmodium falciparum
IKEKQRNNY

SEQ ID NO: 3223012 - protein, 9 aa, Plasmodium falciparum
IKEKSIESH

SEQ ID NO: 3223013 - protein, 19 aa, Plasmodium falciparum
IKEKSIKEQNQLNQNEKEA

SEQ ID NO: 3223014 - protein, 33 aa, Plasmodium falciparum
IKEKSKKIKKKKKKHVQQGEIKEKREDESDDEA

SEQ ID NO: 3223015 - protein, 5 aa, Plasmodium falciparum
IKELK

SEQ ID NO: 3223016 - protein, 7 aa, Plasmodium falciparum
IKENDNK

SEQ ID NO: 3223017 - protein, 5 aa, Plasmodium falciparum
IKENE

SEQ ID NO: 3223018 - protein, 11 aa, Plasmodium falciparum
IKENEENADKK

SEQ ID NO: 3223019 - protein, 12 aa, Plasmodium falciparum
IKENEKEKEKYN

SEQ ID NO: 3223020 - protein, 8 aa, Plasmodium falciparum
IKENEQDA

SEQ ID NO: 3223021 - protein, 12 aa, Plasmodium falciparum
IKENGKKENKDP

SEQ ID NO: 3223022 - protein, 26 aa, Plasmodium falciparum
IKENKDDIDYDDDKYDKNYEHDEKKE

SEQ ID NO: 3223023 - protein, 16 aa, Plasmodium falciparum
IKENKIEDEKREEPKN

SEQ ID NO: 3223024 - protein, 9 aa, Plasmodium falciparum
IKENKNLNK

SEQ ID NO: 3223025 - protein, 23 aa, Plasmodium falciparum
IKENNSDNKKDEQSKVETQNTED

SEQ ID NO: 3223026 - protein, 12 aa, Plasmodium falciparum
IKEQEKKIKPTE

SEQ ID NO: 3223027 - protein, 11 aa, Plasmodium falciparum
IKEQKGDDSLK

SEQ ID NO: 3223028 - protein, 7 aa, Plasmodium falciparum
IKEQNVS

SEQ ID NO: 3223029 - protein, 6 aa, Plasmodium falciparum
IKERDT

SEQ ID NO: 3223030 - protein, 26 aa, Plasmodium falciparum
IKESDEKGNVISNNNNNNNNNNNNHN

SEQ ID NO: 3223031 - protein, 5 aa, Plasmodium falciparum
IKESF

SEQ ID NO: 3223032 - protein, 8 aa, Plasmodium falciparum
IKESKEKI

SEQ ID NO: 3223033 - protein, 11 aa, Plasmodium falciparum
IKETFKDKKKV

SEQ ID NO: 3223034 - protein, 8 aa, Plasmodium falciparum
IKETQGKD

SEQ ID NO: 3223035 - protein, 9 aa, Plasmodium falciparum
IKETSNNSV

SEQ ID NO: 3223036 - protein, 47 aa, Plasmodium falciparum
IKGDDSSDDEKDNSYDDEKDNSYDDEKDNSYDDEKDNSYDGDDKSGH

SEQ ID NO: 3223037 - protein, 17 aa, Plasmodium falciparum
IKGEEKKKKKNKKKKNK

SEQ ID NO: 3223038 - protein, 9 aa, Plasmodium falciparum
IKGENNKKM

SEQ ID NO: 3223039 - protein, 12 aa, Plasmodium falciparum
IKGGDKEEYSNQ

SEQ ID NO: 3223040 - protein, 13 aa, Plasmodium falciparum
IKGGGNKKIDDYN

SEQ ID NO: 3223041 - protein, 14 aa, Plasmodium falciparum
IKGKEKDTNDNEEQ

SEQ ID NO: 3223042 - protein, 8 aa, Plasmodium falciparum
IKGKKEKI

SEQ ID NO: 3223043 - protein, 14 aa, Plasmodium falciparum
IKGKKKKEKEKTIK

SEQ ID NO: 3223044 - protein, 15 aa, Plasmodium falciparum
IKGKKNDKKKASIKN

SEQ ID NO: 3223045 - protein, 19 aa, Plasmodium falciparum
IKGKKNDNKKINNNKIEEV

SEQ ID NO: 3223046 - protein, 12 aa, Plasmodium falciparum
IKGKNPKKKKAK

SEQ ID NO: 3223047 - protein, 9 aa, Plasmodium falciparum
IKGKYTGTK

SEQ ID NO: 3223048 - protein, 11 aa, Plasmodium falciparum
IKGNDKSSFIN

SEQ ID NO: 3223049 - protein, 8 aa, Plasmodium falciparum
IKGNEEEL

SEQ ID NO: 3223050 - protein, 5 aa, Plasmodium falciparum
IKGNH

SEQ ID NO: 3223051 - protein, 30 aa, Plasmodium falciparum
IKGNKDINKENNEEYNKENNEEHNKDYNKT

SEQ ID NO: 3223052 - protein, 16 aa, Plasmodium falciparum
IKGNKKKKKKKKKDGM

SEQ ID NO: 3223053 - protein, 13 aa, Plasmodium falciparum
IKGNNKKKNIGNI

SEQ ID NO: 3223054 - protein, 9 aa, Plasmodium falciparum
IKGNTKQKY

SEQ ID NO: 3223055 - protein, 20 aa, Plasmodium falciparum
IKGPEDKVEKLEDGDNPVEK

SEQ ID NO: 3223056 - protein, 11 aa, Plasmodium falciparum
IKGRDNNLNDG

SEQ ID NO: 3223057 - protein, 10 aa, Plasmodium falciparum
IKGSPSRDKE

SEQ ID NO: 3223058 - protein, 11 aa, Plasmodium falciparum
IKGYNKDDMHS

SEQ ID NO: 3223059 - protein, 10 aa, Plasmodium falciparum
IKHDEKEKQC

SEQ ID NO: 3223060 - protein, 12 aa, Plasmodium falciparum
IKHDTGDKDIYR

SEQ ID NO: 3223061 - protein, 8 aa, Plasmodium falciparum
IKHESSGN

SEQ ID NO: 3223062 - protein, 20 aa, Plasmodium falciparum
IKHGESQKTKGAISYPSDSS

SEQ ID NO: 3223063 - protein, 7 aa, Plasmodium falciparum
IKIDNND

SEQ ID NO: 3223064 - protein, 20 aa, Plasmodium falciparum
IKITPSEIKNKSKKQENKVG

SEQ ID NO: 3223065 - protein, 20 aa, Plasmodium falciparum
IKKDDKKKSTSKYKSLNSKK

SEQ ID NO: 3223066 - protein, 7 aa, Plasmodium falciparum
IKKDDLK

SEQ ID NO: 3223067 - protein, 5 aa, Plasmodium falciparum
IKKDE

SEQ ID NO: 3223068 - protein, 10 aa, Plasmodium falciparum
IKKDEIKNDE

SEQ ID NO: 3223069 - protein, 7 aa, Plasmodium falciparum
IKKDENK

SEQ ID NO: 3223070 - protein, 10 aa, Plasmodium falciparum
IKKDKQKVTE

SEQ ID NO: 3223071 - protein, 22 aa, Plasmodium falciparum
IKKDNDKKKKYEKKNIEGNSNN

SEQ ID NO: 3223072 - protein, 12 aa, Plasmodium falciparum
IKKDSKEESENT

SEQ ID NO: 3223073 - protein, 11 aa, Plasmodium falciparum
IKKEEESMKRE

SEQ ID NO: 3223074 - protein, 8 aa, Plasmodium falciparum
IKKEEKEY

SEQ ID NO: 3223075 - protein, 7 aa, Plasmodium falciparum
IKKEGEN

SEQ ID NO: 3223076 - protein, 8 aa, Plasmodium falciparum
IKKEKNDK

SEQ ID NO: 3223077 - protein, 16 aa, Plasmodium falciparum
IKKENEKKEIEKDKNK

SEQ ID NO: 3223078 - protein, 12 aa, Plasmodium falciparum
IKKENPKTKDNL

SEQ ID NO: 3223079 - protein, 14 aa, Plasmodium falciparum
IKKEREREKRKSVE

SEQ ID NO: 3223080 - protein, 6 aa, Plasmodium falciparum
IKKETN

SEQ ID NO: 3223081 - protein, 17 aa, Plasmodium falciparum
IKKETNEQHNINNKNDD

SEQ ID NO: 3223082 - protein, 5 aa, Plasmodium falciparum
IKKEY

SEQ ID NO: 3223083 - protein, 32 aa, Plasmodium falciparum
IKKGENNSCNNKGKRKYKKNITNSYNNDERKN

SEQ ID NO: 3223084 - protein, 12 aa, Plasmodium falciparum
IKKGIDKDEKSI

SEQ ID NO: 3223085 - protein, 8 aa, Plasmodium falciparum
IKKGNNFS

SEQ ID NO: 3223086 - protein, 11 aa, Plasmodium falciparum
IKKGSPPEARY

SEQ ID NO: 3223087 - protein, 9 aa, Plasmodium falciparum
IKKGTFDQT

SEQ ID NO: 3223088 - protein, 11 aa, Plasmodium falciparum
IKKGTHKSNEI

SEQ ID NO: 3223089 - protein, 19 aa, Plasmodium falciparum
IKKHKKDNMNNNDDNNYNF

SEQ ID NO: 3223090 - protein, 4 aa, Plasmodium falciparum
IKKK

SEQ ID NO: 3223091 - protein, 11 aa, Plasmodium falciparum
IKKKDKENLRK

SEQ ID NO: 3223092 - protein, 7 aa, Plasmodium falciparum
IKKKEQK

SEQ ID NO: 3223093 - protein, 9 aa, Plasmodium falciparum
IKKKGQHKM

SEQ ID NO: 3223094 - protein, 10 aa, Plasmodium falciparum
IKKKKKKKIL

SEQ ID NO: 3223095 - protein, 11 aa, Plasmodium falciparum
IKKKKKKKKMK

SEQ ID NO: 3223096 - protein, 9 aa, Plasmodium falciparum
IKKKKKKKV

SEQ ID NO: 3223097 - protein, 11 aa, Plasmodium falciparum
IKKKKKKSLSS

SEQ ID NO: 3223098 - protein, 7 aa, Plasmodium falciparum
IKKKMKK

SEQ ID NO: 3223099 - protein, 10 aa, Plasmodium falciparum
IKKKNNNDFI

SEQ ID NO: 3223100 - protein, 11 aa, Plasmodium falciparum
IKKKNSEQNTI

SEQ ID NO: 3223101 - protein, 8 aa, Plasmodium falciparum
IKKKRNSV

SEQ ID NO: 3223102 - protein, 21 aa, Plasmodium falciparum
IKKKSKKSINKNENDKYGYNS

SEQ ID NO: 3223103 - protein, 9 aa, Plasmodium falciparum
IKKKYKKDE

SEQ ID NO: 3223104 - protein, 23 aa, Plasmodium falciparum
IKKNDGKRSELSTPISYADDLMN

SEQ ID NO: 3223105 - protein, 6 aa, Plasmodium falciparum
IKKNEE

SEQ ID NO: 3223106 - protein, 67 aa, Plasmodium falciparum
IKKNEKNENDENDEKYENDEKYENDEKYENDENNEKDENDEKNKKNESTLYDDQKKGGDNRNDNHYD

SEQ ID NO: 3223107 - protein, 5 aa, Plasmodium falciparum
IKKNG

SEQ ID NO: 3223108 - protein, 29 aa, Plasmodium falciparum
IKKNKDNKKDNEGENNSFNDNDNKNKYSW

SEQ ID NO: 3223109 - protein, 11 aa, Plasmodium falciparum
IKKNKKNNSYY

SEQ ID NO: 3223110 - protein, 7 aa, Plasmodium falciparum
IKKNKNE

SEQ ID NO: 3223111 - protein, 10 aa, Plasmodium falciparum
IKKNKQKEHV

SEQ ID NO: 3223112 - protein, 7 aa, Plasmodium falciparum
IKKNNAN

SEQ ID NO: 3223113 - protein, 24 aa, Plasmodium falciparum
IKKNNDDDHDDDENNKCHKNPMNE

SEQ ID NO: 3223114 - protein, 11 aa, Plasmodium falciparum
IKKNNKNQNVN

SEQ ID NO: 3223115 - protein, 11 aa, Plasmodium falciparum
IKKNNNLKNSL

SEQ ID NO: 3223116 - protein, 6 aa, Plasmodium falciparum
IKKNNS

SEQ ID NO: 3223117 - protein, 24 aa, Plasmodium falciparum
IKKNNSISNNEYNKKGDVESRDHA

SEQ ID NO: 3223118 - protein, 9 aa, Plasmodium falciparum
IKKNSQDSI

SEQ ID NO: 3223119 - protein, 4 aa, Plasmodium falciparum
IKKQ

SEQ ID NO: 3223120 - protein, 25 aa, Plasmodium falciparum
IKKQVEDGIKENDTEGNDKVKGPEI

SEQ ID NO: 3223121 - protein, 25 aa, Plasmodium falciparum
IKKQVEEGIKENDTEGNDKVKGPEI

SEQ ID NO: 3223122 - protein, 19 aa, Plasmodium falciparum
IKKQVEEGIKENDTESKDK

SEQ ID NO: 3223123 - protein, 8 aa, Plasmodium falciparum
IKKRDEND

SEQ ID NO: 3223124 - protein, 12 aa, Plasmodium falciparum
IKKREKYDTAET

SEQ ID NO: 3223125 - protein, 9 aa, Plasmodium falciparum
IKKRNTDKY

SEQ ID NO: 3223126 - protein, 13 aa, Plasmodium falciparum
IKKRSQKNKGYDN

SEQ ID NO: 3223127 - protein, 8 aa, Plasmodium falciparum
IKKSENSC

SEQ ID NO: 3223128 - protein, 9 aa, Plasmodium falciparum
IKKSTSKRL

SEQ ID NO: 3223129 - protein, 10 aa, Plasmodium falciparum
IKKSYTPERI

SEQ ID NO: 3223130 - protein, 4 aa, Plasmodium falciparum
IKKT

SEQ ID NO: 3223131 - protein, 11 aa, Plasmodium falciparum
IKKTKNKKEDY

SEQ ID NO: 3223132 - protein, 9 aa, Plasmodium falciparum
IKKTKQKKD

SEQ ID NO: 3223133 - protein, 10 aa, Plasmodium falciparum
IKKTRIKKND

SEQ ID NO: 3223134 - protein, 5 aa, Plasmodium falciparum
IKLND

SEQ ID NO: 3223135 - protein, 14 aa, Plasmodium falciparum
IKNAEEEKKKVEDI

SEQ ID NO: 3223136 - protein, 10 aa, Plasmodium falciparum
IKNANTDENV

SEQ ID NO: 3223137 - protein, 15 aa, Plasmodium falciparum
IKNDDHMNENNHNNN

SEQ ID NO: 3223138 - protein, 6 aa, Plasmodium falciparum
IKNDEE

SEQ ID NO: 3223139 - protein, 6 aa, Plasmodium falciparum
IKNDEK

SEQ ID NO: 3223140 - protein, 25 aa, Plasmodium falciparum
IKNDGNNYTQNDDNNYTQNDGNYYR

SEQ ID NO: 3223141 - protein, 9 aa, Plasmodium falciparum
IKNDHDRKI

SEQ ID NO: 3223142 - protein, 15 aa, Plasmodium falciparum
IKNDKDKIGDNNKYD

SEQ ID NO: 3223143 - protein, 16 aa, Plasmodium falciparum
IKNDNKKQTKINGNNE

SEQ ID NO: 3223144 - protein, 8 aa, Plasmodium falciparum
IKNDNNKL

SEQ ID NO: 3223145 - protein, 21 aa, Plasmodium falciparum
IKNDNNNNNNNNNNNNSNEYY

SEQ ID NO: 3223146 - protein, 12 aa, Plasmodium falciparum
IKNEEKKPYDTL

SEQ ID NO: 3223147 - protein, 19 aa, Plasmodium falciparum
IKNEGEKKEKKQLKGNEKN

SEQ ID NO: 3223148 - protein, 13 aa, Plasmodium falciparum
IKNEKRESENNNK

SEQ ID NO: 3223149 - protein, 10 aa, Plasmodium falciparum
IKNEKSDKKK

SEQ ID NO: 3223150 - protein, 8 aa, Plasmodium falciparum
IKNENKIY

SEQ ID NO: 3223151 - protein, 16 aa, Plasmodium falciparum
IKNENTKQNINNKSNN

SEQ ID NO: 3223152 - protein, 6 aa, Plasmodium falciparum
IKNEPS

SEQ ID NO: 3223153 - protein, 9 aa, Plasmodium falciparum
IKNETDSSD

SEQ ID NO: 3223154 - protein, 8 aa, Plasmodium falciparum
IKNGDGTN

SEQ ID NO: 3223155 - protein, 8 aa, Plasmodium falciparum
IKNGESRN

SEQ ID NO: 3223156 - protein, 8 aa, Plasmodium falciparum
IKNGETPF

SEQ ID NO: 3223157 - protein, 5 aa, Plasmodium falciparum
IKNGL

SEQ ID NO: 3223158 - protein, 6 aa, Plasmodium falciparum
IKNGSK

SEQ ID NO: 3223159 - protein, 4 aa, Plasmodium falciparum
IKNK

SEQ ID NO: 3223160 - protein, 5 aa, Plasmodium falciparum
IKNKE

SEQ ID NO: 3223161 - protein, 12 aa, Plasmodium falciparum
IKNKENEHGKCN

SEQ ID NO: 3223162 - protein, 26 aa, Plasmodium falciparum
IKNKESGKSSILTTGTSNNNNNVNNM

SEQ ID NO: 3223163 - protein, 12 aa, Plasmodium falciparum
IKNKGQKDNTEM

SEQ ID NO: 3223164 - protein, 6 aa, Plasmodium falciparum
IKNKKN

SEQ ID NO: 3223165 - protein, 10 aa, Plasmodium falciparum
IKNKKTIKKK

SEQ ID NO: 3223166 - protein, 9 aa, Plasmodium falciparum
IKNKNDLHE

SEQ ID NO: 3223167 - protein, 6 aa, Plasmodium falciparum
IKNKNE

SEQ ID NO: 3223168 - protein, 7 aa, Plasmodium falciparum
IKNKNEK

SEQ ID NO: 3223169 - protein, 41 aa, Plasmodium falciparum
IKNKNESKTEKKSKTENKSKSKSKNKSKSKNKSKRKKVIVI

SEQ ID NO: 3223170 - protein, 6 aa, Plasmodium falciparum
IKNKNK

SEQ ID NO: 3223171 - protein, 7 aa, Plasmodium falciparum
IKNKNNN

SEQ ID NO: 3223172 - protein, 6 aa, Plasmodium falciparum
IKNKNT

SEQ ID NO: 3223173 - protein, 4 aa, Plasmodium falciparum
IKNL

SEQ ID NO: 3223174 - protein, 25 aa, Plasmodium falciparum
IKNMQNKNVKEKNINKKHNKYNKHN

SEQ ID NO: 3223175 - protein, 4 aa, Plasmodium falciparum
IKNN

SEQ ID NO: 3223176 - protein, 7 aa, Plasmodium falciparum
IKNNDEK

SEQ ID NO: 3223177 - protein, 36 aa, Plasmodium falciparum
IKNNDNNNDDNDNDNNNNNNNNDNYNNNDHNKKEFK

SEQ ID NO: 3223178 - protein, 5 aa, Plasmodium falciparum
IKNNE

SEQ ID NO: 3223179 - protein, 8 aa, Plasmodium falciparum
IKNNEDTG

SEQ ID NO: 3223180 - protein, 11 aa, Plasmodium falciparum
IKNNEDYKSEK

SEQ ID NO: 3223181 - protein, 13 aa, Plasmodium falciparum
IKNNESESNNYKK

SEQ ID NO: 3223182 - protein, 7 aa, Plasmodium falciparum
IKNNKKG

SEQ ID NO: 3223183 - protein, 5 aa, Plasmodium falciparum
IKNNM

SEQ ID NO: 3223184 - protein, 6 aa, Plasmodium falciparum
IKNNMN

SEQ ID NO: 3223185 - protein, 10 aa, Plasmodium falciparum
IKNNNNDDHH

SEQ ID NO: 3223186 - protein, 9 aa, Plasmodium falciparum
IKNNNYNDK

SEQ ID NO: 3223187 - protein, 14 aa, Plasmodium falciparum
IKNNQGDHDNNEGD

SEQ ID NO: 3223188 - protein, 18 aa, Plasmodium falciparum
IKNNSKSHFPRNKTDKHN

SEQ ID NO: 3223189 - protein, 5 aa, Plasmodium falciparum
IKNNT

SEQ ID NO: 3223190 - protein, 5 aa, Plasmodium falciparum
IKNNY

SEQ ID NO: 3223191 - protein, 9 aa, Plasmodium falciparum
IKNNYSNNK

SEQ ID NO: 3223192 - protein, 16 aa, Plasmodium falciparum
IKNPPPANSGNTPNTL

SEQ ID NO: 3223193 - protein, 15 aa, Plasmodium falciparum
IKNQEQRDSSRYTND

SEQ ID NO: 3223194 - protein, 6 aa, Plasmodium falciparum
IKNQKK

SEQ ID NO: 3223195 - protein, 26 aa, Plasmodium falciparum
IKNQKKKKKSIKNIQKKKNKNDINEK

SEQ ID NO: 3223196 - protein, 98 aa, Plasmodium falciparum
IKNQTKEKEKEKKKKKKTDKDDKDKEHENEHDNLKNDKKKNNENLKHEDRENENHSDGHNAERNDIDEEDSDEDDDDDDDDDVDEDDNDYDDDFDDDD

SEQ ID NO: 3223197 - protein, 12 aa, Plasmodium falciparum
IKNSKANKSNKK

SEQ ID NO: 3223198 - protein, 9 aa, Plasmodium falciparum
IKNSKPSRI

SEQ ID NO: 3223199 - protein, 12 aa, Plasmodium falciparum
IKNSNNTASYSN

SEQ ID NO: 3223200 - protein, 7 aa, Plasmodium falciparum
IKNSNRY

SEQ ID NO: 3223201 - protein, 6 aa, Plasmodium falciparum
IKNSYS

SEQ ID NO: 3223202 - protein, 7 aa, Plasmodium falciparum
IKNTDDY

SEQ ID NO: 3223203 - protein, 7 aa, Plasmodium falciparum
IKNTKNL

SEQ ID NO: 3223204 - protein, 8 aa, Plasmodium falciparum
IKNTSGER

SEQ ID NO: 3223205 - protein, 36 aa, Plasmodium falciparum
IKNTSQKKITYDKYNKNKENMNNEKNDNKDNKDNIY

SEQ ID NO: 3223206 - protein, 9 aa, Plasmodium falciparum
IKNVKGKGN

SEQ ID NO: 3223207 - protein, 4 aa, Plasmodium falciparum
IKNY

SEQ ID NO: 3223208 - protein, 7 aa, Plasmodium falciparum
IKNYEKR

SEQ ID NO: 3223209 - protein, 14 aa, Plasmodium falciparum
IKNYSSNIKQKRKG

SEQ ID NO: 3223210 - protein, 23 aa, Plasmodium falciparum
IKPCNSHPKPTPNPCGKNNNGGK

SEQ ID NO: 3223211 - protein, 4 aa, Plasmodium falciparum
IKPD

SEQ ID NO: 3223212 - protein, 7 aa, Plasmodium falciparum
IKPENYK

SEQ ID NO: 3223213 - protein, 8 aa, Plasmodium falciparum
IKPHSNKN

SEQ ID NO: 3223214 - protein, 8 aa, Plasmodium falciparum
IKPNGSTQ

SEQ ID NO: 3223215 - protein, 7 aa, Plasmodium falciparum
IKPRNMS

SEQ ID NO: 3223216 - protein, 5 aa, Plasmodium falciparum
IKPSD

SEQ ID NO: 3223217 - protein, 24 aa, Plasmodium falciparum
IKPSDQNDHHNTINNTQKKFNTNV

SEQ ID NO: 3223218 - protein, 6 aa, Plasmodium falciparum
IKPSTN

SEQ ID NO: 3223219 - protein, 6 aa, Plasmodium falciparum
IKQAEQ

SEQ ID NO: 3223220 - protein, 7 aa, Plasmodium falciparum
IKQDTQK

SEQ ID NO: 3223221 - protein, 4 aa, Plasmodium falciparum
IKQE

SEQ ID NO: 3223222 - protein, 12 aa, Plasmodium falciparum
IKQEINKKDQEI

SEQ ID NO: 3223223 - protein, 32 aa, Plasmodium falciparum
IKQEKEYYGERKQQFGKPNQDYEYEEKRNAME

SEQ ID NO: 3223224 - protein, 44 aa, Plasmodium falciparum
IKQGGDNKGDDDDDGDNNGDNNDDDDDNDDDNNDDDDNNNNNND

SEQ ID NO: 3223225 - protein, 9 aa, Plasmodium falciparum
IKQKETPSI

SEQ ID NO: 3223226 - protein, 7 aa, Plasmodium falciparum
IKQNKKI

SEQ ID NO: 3223227 - protein, 7 aa, Plasmodium falciparum
IKQNTQQ

SEQ ID NO: 3223228 - protein, 14 aa, Plasmodium falciparum
IKQPSQQKSRKGNL

SEQ ID NO: 3223229 - protein, 7 aa, Plasmodium falciparum
IKQSGSN

SEQ ID NO: 3223230 - protein, 4 aa, Plasmodium falciparum
IKRD

SEQ ID NO: 3223231 - protein, 90 aa, Plasmodium falciparum
IKRDDIKRDDIKRDNIKRDDIKRDDIKRDDIKRDNIKRDDIKRDDIKRDNIKRDNIKRDDIKRDDIKRDNIKRDNIKRDNIKRDNIKRDN

SEQ ID NO: 3223232 - protein, 5 aa, Plasmodium falciparum
IKRDK

SEQ ID NO: 3223233 - protein, 14 aa, Plasmodium falciparum
IKRDKQKEKKYEDN

SEQ ID NO: 3223234 - protein, 47 aa, Plasmodium falciparum
IKRENDNNKSNDNNNKNNHNNNNNKNNHNNNNNKNNEKTQNVDEQRR

SEQ ID NO: 3223235 - protein, 8 aa, Plasmodium falciparum
IKRENGKE

SEQ ID NO: 3223236 - protein, 6 aa, Plasmodium falciparum
IKRENK

SEQ ID NO: 3223237 - protein, 7 aa, Plasmodium falciparum
IKRENKI

SEQ ID NO: 3223238 - protein, 8 aa, Plasmodium falciparum
IKRGKNKR

SEQ ID NO: 3223239 - protein, 4 aa, Plasmodium falciparum
IKRK

SEQ ID NO: 3223240 - protein, 14 aa, Plasmodium falciparum
IKRKGEKKKKKKIN

SEQ ID NO: 3223241 - protein, 8 aa, Plasmodium falciparum
IKRKKDGL

SEQ ID NO: 3223242 - protein, 12 aa, Plasmodium falciparum
IKRKKKKKEIKT

SEQ ID NO: 3223243 - protein, 14 aa, Plasmodium falciparum
IKRKRNEEKKKNYK

SEQ ID NO: 3223244 - protein, 30 aa, Plasmodium falciparum
IKRNEKDENNGNNNNNNNNNNNNNNNNNNY

SEQ ID NO: 3223245 - protein, 31 aa, Plasmodium falciparum
IKRNNINKSNIKRNNINKSNVKRSNTDKSNV

SEQ ID NO: 3223246 - protein, 6 aa, Plasmodium falciparum
IKRPNI

SEQ ID NO: 3223247 - protein, 32 aa, Plasmodium falciparum
IKRRKGNNTMDDKDKSINNNDNNNKENDKGNY

SEQ ID NO: 3223248 - protein, 9 aa, Plasmodium falciparum
IKRRKKGRI

SEQ ID NO: 3223249 - protein, 12 aa, Plasmodium falciparum
IKRSRNSSCNKQ

SEQ ID NO: 3223250 - protein, 13 aa, Plasmodium falciparum
IKRVRKGEKEGND

SEQ ID NO: 3223251 - protein, 4 aa, Plasmodium falciparum
IKRY

SEQ ID NO: 3223252 - protein, 22 aa, Plasmodium falciparum
IKSAKDNNNTLTQSPKETEEIK

SEQ ID NO: 3223253 - protein, 4 aa, Plasmodium falciparum
IKSD

SEQ ID NO: 3223254 - protein, 8 aa, Plasmodium falciparum
IKSDDDIT

SEQ ID NO: 3223255 - protein, 7 aa, Plasmodium falciparum
IKSDDDT

SEQ ID NO: 3223256 - protein, 11 aa, Plasmodium falciparum
IKSDGNNQINN

SEQ ID NO: 3223257 - protein, 7 aa, Plasmodium falciparum
IKSDKKD

SEQ ID NO: 3223258 - protein, 7 aa, Plasmodium falciparum
IKSDNMK

SEQ ID NO: 3223259 - protein, 7 aa, Plasmodium falciparum
IKSDNTL

SEQ ID NO: 3223260 - protein, 6 aa, Plasmodium falciparum
IKSDSA

SEQ ID NO: 3223261 - protein, 10 aa, Plasmodium falciparum
IKSEGSTNKS

SEQ ID NO: 3223262 - protein, 5 aa, Plasmodium falciparum
IKSGL

SEQ ID NO: 3223263 - protein, 5 aa, Plasmodium falciparum
IKSGN

SEQ ID NO: 3223264 - protein, 9 aa, Plasmodium falciparum
IKSKEGKCN

SEQ ID NO: 3223265 - protein, 6 aa, Plasmodium falciparum
IKSKEN

SEQ ID NO: 3223266 - protein, 28 aa, Plasmodium falciparum
IKSKEVDGDVKKKKNKINSLKEESESYI

SEQ ID NO: 3223267 - protein, 9 aa, Plasmodium falciparum
IKSKGDTQC

SEQ ID NO: 3223268 - protein, 8 aa, Plasmodium falciparum
IKSKGGNP

SEQ ID NO: 3223269 - protein, 5 aa, Plasmodium falciparum
IKSLN

SEQ ID NO: 3223270 - protein, 9 aa, Plasmodium falciparum
IKSNGNKYY

SEQ ID NO: 3223271 - protein, 10 aa, Plasmodium falciparum
IKSNINTETY

SEQ ID NO: 3223272 - protein, 11 aa, Plasmodium falciparum
IKSNSNISKTK

SEQ ID NO: 3223273 - protein, 11 aa, Plasmodium falciparum
IKSNYNDSEGN

SEQ ID NO: 3223274 - protein, 5 aa, Plasmodium falciparum
IKSPE

SEQ ID NO: 3223275 - protein, 15 aa, Plasmodium falciparum
IKSPEQNVNGHKRKD

SEQ ID NO: 3223276 - protein, 5 aa, Plasmodium falciparum
IKSRE

SEQ ID NO: 3223277 - protein, 12 aa, Plasmodium falciparum
IKSSGEKIKSQA

SEQ ID NO: 3223278 - protein, 32 aa, Plasmodium falciparum
IKSSHTFNNNENVKRTQVDKNKTKETIPSNMS

SEQ ID NO: 3223279 - protein, 7 aa, Plasmodium falciparum
IKSSNDL

SEQ ID NO: 3223280 - protein, 7 aa, Plasmodium falciparum
IKSSYNN

SEQ ID NO: 3223281 - protein, 13 aa, Plasmodium falciparum
IKSTGETCEANSG

SEQ ID NO: 3223282 - protein, 5 aa, Plasmodium falciparum
IKSTN

SEQ ID NO: 3223283 - protein, 10 aa, Plasmodium falciparum
IKSVTNEDHL

SEQ ID NO: 3223284 - protein, 11 aa, Plasmodium falciparum
IKTDEKGGDVE

SEQ ID NO: 3223285 - protein, 9 aa, Plasmodium falciparum
IKTEAGTKA

SEQ ID NO: 3223286 - protein, 6 aa, Plasmodium falciparum
IKTEHE

SEQ ID NO: 3223287 - protein, 18 aa, Plasmodium falciparum
IKTEKSNEKSKTKSNRPY

SEQ ID NO: 3223288 - protein, 6 aa, Plasmodium falciparum
IKTEQD

SEQ ID NO: 3223289 - protein, 7 aa, Plasmodium falciparum
IKTGAPT

SEQ ID NO: 3223290 - protein, 11 aa, Plasmodium falciparum
IKTGKQKSDAI

SEQ ID NO: 3223291 - protein, 19 aa, Plasmodium falciparum
IKTHEKGSQKMDKKTNSFK

SEQ ID NO: 3223292 - protein, 7 aa, Plasmodium falciparum
IKTKEEY

SEQ ID NO: 3223293 - protein, 6 aa, Plasmodium falciparum
IKTKKD

SEQ ID NO: 3223294 - protein, 24 aa, Plasmodium falciparum
IKTKKKSKQPNSGDHNNDNNNYDN

SEQ ID NO: 3223295 - protein, 6 aa, Plasmodium falciparum
IKTKNK

SEQ ID NO: 3223296 - protein, 6 aa, Plasmodium falciparum
IKTKQN

SEQ ID NO: 3223297 - protein, 19 aa, Plasmodium falciparum
IKTNDDNKKLRENKTKNKR

SEQ ID NO: 3223298 - protein, 16 aa, Plasmodium falciparum
IKTNEDMNNISKAGDP

SEQ ID NO: 3223299 - protein, 6 aa, Plasmodium falciparum
IKTNEE

SEQ ID NO: 3223300 - protein, 26 aa, Plasmodium falciparum
IKTNHNTTGYNKRNNDRYNYSSTPNF

SEQ ID NO: 3223301 - protein, 5 aa, Plasmodium falciparum
IKTNN

SEQ ID NO: 3223302 - protein, 7 aa, Plasmodium falciparum
IKTNNNT

SEQ ID NO: 3223303 - protein, 11 aa, Plasmodium falciparum
IKTNNSKNVTI

SEQ ID NO: 3223304 - protein, 25 aa, Plasmodium falciparum
IKTNSNELKNQDSSNSLISTNSNTM

SEQ ID NO: 3223305 - protein, 8 aa, Plasmodium falciparum
IKTNTHTN

SEQ ID NO: 3223306 - protein, 9 aa, Plasmodium falciparum
IKTNYKKNN

SEQ ID NO: 3223307 - protein, 36 aa, Plasmodium falciparum
IKTPSKPKKISDISSSRQVNKNAGNTNGKMSHKDGN

SEQ ID NO: 3223308 - protein, 11 aa, Plasmodium falciparum
IKTQNGNAINN

SEQ ID NO: 3223309 - protein, 4 aa, Plasmodium falciparum
IKTS

SEQ ID NO: 3223310 - protein, 8 aa, Plasmodium falciparum
IKTSAQDK

SEQ ID NO: 3223311 - protein, 11 aa, Plasmodium falciparum
IKTSSEEQPNI

SEQ ID NO: 3223312 - protein, 4 aa, Plasmodium falciparum
IKTT

SEQ ID NO: 3223313 - protein, 18 aa, Plasmodium falciparum
IKTYKENEQYGDTESKIK

SEQ ID NO: 3223314 - protein, 4 aa, Plasmodium falciparum
IKVG

SEQ ID NO: 3223315 - protein, 12 aa, Plasmodium falciparum
IKVKEEEEEEVK

SEQ ID NO: 3223316 - protein, 7 aa, Plasmodium falciparum
IKVKKEN

SEQ ID NO: 3223317 - protein, 7 aa, Plasmodium falciparum
IKYDKKR

SEQ ID NO: 3223318 - protein, 23 aa, Plasmodium falciparum
IKYENDKDSYTNDPDTKQSPQAY

SEQ ID NO: 3223319 - protein, 10 aa, Plasmodium falciparum
IKYGNKTKYD

SEQ ID NO: 3223320 - protein, 7 aa, Plasmodium falciparum
IKYNDNT

SEQ ID NO: 3223321 - protein, 8 aa, Plasmodium falciparum
IKYPEIGE

SEQ ID NO: 3223322 - protein, 5 aa, Plasmodium falciparum
ILESS

SEQ ID NO: 3223323 - protein, 14 aa, Plasmodium falciparum
ILGQAKPTDFFIKY

SEQ ID NO: 3223324 - protein, 13 aa, Plasmodium falciparum
ILNGPYNNSYEER

SEQ ID NO: 3223325 - protein, 9 aa, Plasmodium falciparum
ILPKKKNKK

SEQ ID NO: 3223326 - protein, 5 aa, Plasmodium falciparum
ILQNG

SEQ ID NO: 3223327 - protein, 6 aa, Plasmodium falciparum
IMDDDN

SEQ ID NO: 3223328 - protein, 12 aa, Plasmodium falciparum
IMSPNDNDNDII

SEQ ID NO: 3223329 - protein, 11 aa, Plasmodium falciparum
INAQEKEDNLT

SEQ ID NO: 3223330 - protein, 11 aa, Plasmodium falciparum
INCKNKKDTIC

SEQ ID NO: 3223331 - protein, 9 aa, Plasmodium falciparum
INDAKNHYT

SEQ ID NO: 3223332 - protein, 6 aa, Plasmodium falciparum
INDCND

SEQ ID NO: 3223333 - protein, 14 aa, Plasmodium falciparum
INDCNDNNINDCND

SEQ ID NO: 3223334 - protein, 22 aa, Plasmodium falciparum
INDCNDNNINDCNDNNINDCND

SEQ ID NO: 3223335 - protein, 9 aa, Plasmodium falciparum
INDDNKNII

SEQ ID NO: 3223336 - protein, 23 aa, Plasmodium falciparum
INDDNNKNKVRRKGKRSKDPKDM

SEQ ID NO: 3223337 - protein, 13 aa, Plasmodium falciparum
INDEGHKKVSTNN

SEQ ID NO: 3223338 - protein, 9 aa, Plasmodium falciparum
INDEGRPPC

SEQ ID NO: 3223339 - protein, 5 aa, Plasmodium falciparum
INDEK

SEQ ID NO: 3223340 - protein, 5 aa, Plasmodium falciparum
INDEN

SEQ ID NO: 3223341 - protein, 17 aa, Plasmodium falciparum
INDENDNHNFNKKRSSI

SEQ ID NO: 3223342 - protein, 7 aa, Plasmodium falciparum
INDENEK

SEQ ID NO: 3223343 - protein, 7 aa, Plasmodium falciparum
INDENSM

SEQ ID NO: 3223344 - protein, 13 aa, Plasmodium falciparum
INDETQKNKYNTC

SEQ ID NO: 3223345 - protein, 9 aa, Plasmodium falciparum
INDGKEPKC

SEQ ID NO: 3223346 - protein, 47 aa, Plasmodium falciparum
INDKENKYGINRTTKREDKKEHNKLHNNNNNDHDDDDNKDKNNNYEV

SEQ ID NO: 3223347 - protein, 16 aa, Plasmodium falciparum
INDKESENISSEEPKE

SEQ ID NO: 3223348 - protein, 9 aa, Plasmodium falciparum
INDKTNDEI

SEQ ID NO: 3223349 - protein, 4 aa, Plasmodium falciparum
INDN

SEQ ID NO: 3223350 - protein, 6 aa, Plasmodium falciparum
INDNDQ

SEQ ID NO: 3223351 - protein, 12 aa, Plasmodium falciparum
INDNNNKDMNNI

SEQ ID NO: 3223352 - protein, 9 aa, Plasmodium falciparum
INDNNNNNN

SEQ ID NO: 3223353 - protein, 19 aa, Plasmodium falciparum
INDNNNNNNNKSQKYRQSN

SEQ ID NO: 3223354 - protein, 14 aa, Plasmodium falciparum
INDNNSDDNRCNDN

SEQ ID NO: 3223355 - protein, 15 aa, Plasmodium falciparum
INDNNSNNNKKNKLN

SEQ ID NO: 3223356 - protein, 6 aa, Plasmodium falciparum
INDNTA

SEQ ID NO: 3223357 - protein, 26 aa, Plasmodium falciparum
INDPINDPINDPINDPINDPINDPIN

SEQ ID NO: 3223358 - protein, 54 aa, Plasmodium falciparum
INDPINDPINDPTNDQINDPINDPINDPTNDPINDPTNDPTNDPTNDPTNDPIN

SEQ ID NO: 3223359 - protein, 5 aa, Plasmodium falciparum
INDQH

SEQ ID NO: 3223360 - protein, 9 aa, Plasmodium falciparum
INDQKRKKK

SEQ ID NO: 3223361 - protein, 22 aa, Plasmodium falciparum
INDQNGRTKITPQNVNQKEKEI

SEQ ID NO: 3223362 - protein, 10 aa, Plasmodium falciparum
INDQPSNGYN

SEQ ID NO: 3223363 - protein, 6 aa, Plasmodium falciparum
INDRRE

SEQ ID NO: 3223364 - protein, 6 aa, Plasmodium falciparum
INDRSK

SEQ ID NO: 3223365 - protein, 4 aa, Plasmodium falciparum
INDS

SEQ ID NO: 3223366 - protein, 11 aa, Plasmodium falciparum
INDSKEEQVEQ

SEQ ID NO: 3223367 - protein, 11 aa, Plasmodium falciparum
INDSNKNNNFN

SEQ ID NO: 3223368 - protein, 31 aa, Plasmodium falciparum
INDSSNDDYGEDEADDGYNSRDHDKPNKKKK

SEQ ID NO: 3223369 - protein, 11 aa, Plasmodium falciparum
INDTKESPVTD

SEQ ID NO: 3223370 - protein, 7 aa, Plasmodium falciparum
INDTNTN

SEQ ID NO: 3223371 - protein, 10 aa, Plasmodium falciparum
INDTNVSPNR

SEQ ID NO: 3223372 - protein, 37 aa, Plasmodium falciparum
INEDHKGEINNNDNDNSKSVSGMGEREVSNEENREDE

SEQ ID NO: 3223373 - protein, 6 aa, Plasmodium falciparum
INEDIN

SEQ ID NO: 3223374 - protein, 8 aa, Plasmodium falciparum
INEDKNGD

SEQ ID NO: 3223375 - protein, 6 aa, Plasmodium falciparum
INEDND

SEQ ID NO: 3223376 - protein, 9 aa, Plasmodium falciparum
INEDNEKEE

SEQ ID NO: 3223377 - protein, 12 aa, Plasmodium falciparum
INEDNKKRKINN

SEQ ID NO: 3223378 - protein, 15 aa, Plasmodium falciparum
INEEDYTSKNSNENN

SEQ ID NO: 3223379 - protein, 5 aa, Plasmodium falciparum
INEEE

SEQ ID NO: 3223380 - protein, 104 aa, Plasmodium falciparum
INEEENENTKVGGANTKVRGENKKVRGANKKVRGANKKVGSKNTKVGGENKKAGSSNKKAGNEKEKAGTENKKAGTENKKAGTENKKAGTENTKDKSGKENKKK

SEQ ID NO: 3223381 - protein, 10 aa, Plasmodium falciparum
INEEIDKDNN

SEQ ID NO: 3223382 - protein, 9 aa, Plasmodium falciparum
INEEKERKA

SEQ ID NO: 3223383 - protein, 7 aa, Plasmodium falciparum
INEEKKT

SEQ ID NO: 3223384 - protein, 16 aa, Plasmodium falciparum
INEEKNLKSKKEVGLK

SEQ ID NO: 3223385 - protein, 12 aa, Plasmodium falciparum
INEENSEKKKIN

SEQ ID NO: 3223386 - protein, 25 aa, Plasmodium falciparum
INEENTKKKKVTDKYKKIYQEKNKN

SEQ ID NO: 3223387 - protein, 9 aa, Plasmodium falciparum
INEEQKDKI

SEQ ID NO: 3223388 - protein, 15 aa, Plasmodium falciparum
INEEQNQNRNRKDNY

SEQ ID NO: 3223389 - protein, 15 aa, Plasmodium falciparum
INEESRSHKKNKKSV

SEQ ID NO: 3223390 - protein, 9 aa, Plasmodium falciparum
INEETQNLK

SEQ ID NO: 3223391 - protein, 54 aa, Plasmodium falciparum
INEGKQNDVNNDNNNDHNNDHNNDHNNDDNNNDDNNNNDHNNDHNNNNNDSDNT

SEQ ID NO: 3223392 - protein, 5 aa, Plasmodium falciparum
INEIE

SEQ ID NO: 3223393 - protein, 11 aa, Plasmodium falciparum
INEKDGVDNSR

SEQ ID NO: 3223394 - protein, 10 aa, Plasmodium falciparum
INEKDRHNKY

SEQ ID NO: 3223395 - protein, 15 aa, Plasmodium falciparum
INEKEKEREKANQDE

SEQ ID NO: 3223396 - protein, 10 aa, Plasmodium falciparum
INEKEKLEDY

SEQ ID NO: 3223397 - protein, 5 aa, Plasmodium falciparum
INEKK

SEQ ID NO: 3223398 - protein, 9 aa, Plasmodium falciparum
INEKKKNYK

SEQ ID NO: 3223399 - protein, 14 aa, Plasmodium falciparum
INEKRKKKKKKNRK

SEQ ID NO: 3223400 - protein, 5 aa, Plasmodium falciparum
INEKT

SEQ ID NO: 3223401 - protein, 4 aa, Plasmodium falciparum
INEL

SEQ ID NO: 3223402 - protein, 9 aa, Plasmodium falciparum
INEMKDEEY

SEQ ID NO: 3223403 - protein, 4 aa, Plasmodium falciparum
INEN

SEQ ID NO: 3223404 - protein, 10 aa, Plasmodium falciparum
INENADNNEE

SEQ ID NO: 3223405 - protein, 8 aa, Plasmodium falciparum
INENKNDI

SEQ ID NO: 3223406 - protein, 10 aa, Plasmodium falciparum
INENKNNIKV

SEQ ID NO: 3223407 - protein, 6 aa, Plasmodium falciparum
INENLQ

SEQ ID NO: 3223408 - protein, 76 aa, Plasmodium falciparum
INENNDINNDDNIDSNDDDNIGSNDDDNIGSNDDDNNISNDDDNNISNDDDNIGSNDDDNIGSNDDKNNDSNDKIC

SEQ ID NO: 3223409 - protein, 9 aa, Plasmodium falciparum
INENNDKEI

SEQ ID NO: 3223410 - protein, 6 aa, Plasmodium falciparum
INENNK

SEQ ID NO: 3223411 - protein, 13 aa, Plasmodium falciparum
INENNKEDNSNNN

SEQ ID NO: 3223412 - protein, 7 aa, Plasmodium falciparum
INENNKL

SEQ ID NO: 3223413 - protein, 19 aa, Plasmodium falciparum
INENNKQSNLNNQEETEFQ

SEQ ID NO: 3223414 - protein, 20 aa, Plasmodium falciparum
INENNNENSKNDDSSSSVCA

SEQ ID NO: 3223415 - protein, 7 aa, Plasmodium falciparum
INENNNS

SEQ ID NO: 3223416 - protein, 36 aa, Plasmodium falciparum
INENNNSITKTMNDSTTTTNNSNNNNNNNGDNINES

SEQ ID NO: 3223417 - protein, 12 aa, Plasmodium falciparum
INENNSNHNEQR

SEQ ID NO: 3223418 - protein, 4 aa, Plasmodium falciparum
INEP

SEQ ID NO: 3223419 - protein, 9 aa, Plasmodium falciparum
INEPSEEYD

SEQ ID NO: 3223420 - protein, 11 aa, Plasmodium falciparum
INEQENTPQYE

SEQ ID NO: 3223421 - protein, 32 aa, Plasmodium falciparum
INEQQSGKDTSNTGNSETSDSPVSHEPESDAA

SEQ ID NO: 3223422 - protein, 17 aa, Plasmodium falciparum
INERNDKKKGSGKYKQS

SEQ ID NO: 3223423 - protein, 4 aa, Plasmodium falciparum
INES

SEQ ID NO: 3223424 - protein, 8 aa, Plasmodium falciparum
INESDNVK

SEQ ID NO: 3223425 - protein, 6 aa, Plasmodium falciparum
INETYT

SEQ ID NO: 3223426 - protein, 7 aa, Plasmodium falciparum
INETYTD

SEQ ID NO: 3223427 - protein, 6 aa, Plasmodium falciparum
INEYEE

SEQ ID NO: 3223428 - protein, 12 aa, Plasmodium falciparum
INEYKDGSENKK

SEQ ID NO: 3223429 - protein, 13 aa, Plasmodium falciparum
INEYKEKETSDKI

SEQ ID NO: 3223430 - protein, 10 aa, Plasmodium falciparum
INEYSKEENK

SEQ ID NO: 3223431 - protein, 7 aa, Plasmodium falciparum
INGDSNL

SEQ ID NO: 3223432 - protein, 5 aa, Plasmodium falciparum
INGEI

SEQ ID NO: 3223433 - protein, 11 aa, Plasmodium falciparum
INGENKRTCNN

SEQ ID NO: 3223434 - protein, 5 aa, Plasmodium falciparum
INGHN

SEQ ID NO: 3223435 - protein, 4 aa, Plasmodium falciparum
INGK

SEQ ID NO: 3223436 - protein, 5 aa, Plasmodium falciparum
INGKA

SEQ ID NO: 3223437 - protein, 23 aa, Plasmodium falciparum
INGKDKDKEKDKEKEKKRETSKG

SEQ ID NO: 3223438 - protein, 6 aa, Plasmodium falciparum
INGNEY

SEQ ID NO: 3223439 - protein, 10 aa, Plasmodium falciparum
INGNKNNRDN

SEQ ID NO: 3223440 - protein, 9 aa, Plasmodium falciparum
INGNNKTEV

SEQ ID NO: 3223441 - protein, 11 aa, Plasmodium falciparum
INGNPTITSTI

SEQ ID NO: 3223442 - protein, 8 aa, Plasmodium falciparum
INGNVPNE

SEQ ID NO: 3223443 - protein, 7 aa, Plasmodium falciparum
INGRTEK

SEQ ID NO: 3223444 - protein, 4 aa, Plasmodium falciparum
INGT

SEQ ID NO: 3223445 - protein, 8 aa, Plasmodium falciparum
INGTKNIT

SEQ ID NO: 3223446 - protein, 10 aa, Plasmodium falciparum
INGTTNNSNM

SEQ ID NO: 3223447 - protein, 17 aa, Plasmodium falciparum
INHDKDKIKQDNNGEVQ

SEQ ID NO: 3223448 - protein, 6 aa, Plasmodium falciparum
INHEGD

SEQ ID NO: 3223449 - protein, 6 aa, Plasmodium falciparum
INHSND

SEQ ID NO: 3223450 - protein, 34 aa, Plasmodium falciparum
INIQNGQSVNGQNDEDINDQNNKDINVQNGQSLN

SEQ ID NO: 3223451 - protein, 18 aa, Plasmodium falciparum
INKDDNNNINGDDTNNTV

SEQ ID NO: 3223452 - protein, 9 aa, Plasmodium falciparum
INKDNDKYI

SEQ ID NO: 3223453 - protein, 6 aa, Plasmodium falciparum
INKDNH

SEQ ID NO: 3223454 - protein, 12 aa, Plasmodium falciparum
INKDPNKEKCVD

SEQ ID NO: 3223455 - protein, 4 aa, Plasmodium falciparum
INKE

SEQ ID NO: 3223456 - protein, 5 aa, Plasmodium falciparum
INKEE

SEQ ID NO: 3223457 - protein, 5 aa, Plasmodium falciparum
INKEK

SEQ ID NO: 3223458 - protein, 10 aa, Plasmodium falciparum
INKEKRKKTL

SEQ ID NO: 3223459 - protein, 18 aa, Plasmodium falciparum
INKENKENSDDDNYNNEI

SEQ ID NO: 3223460 - protein, 11 aa, Plasmodium falciparum
INKENKNKENC

SEQ ID NO: 3223461 - protein, 14 aa, Plasmodium falciparum
INKERGRYPKNDSI

SEQ ID NO: 3223462 - protein, 13 aa, Plasmodium falciparum
INKESKSVNNKSY

SEQ ID NO: 3223463 - protein, 10 aa, Plasmodium falciparum
INKETEDQRY

SEQ ID NO: 3223464 - protein, 27 aa, Plasmodium falciparum
INKGKNTNDDYIGNNNNNNNKKNSRNV

SEQ ID NO: 3223465 - protein, 10 aa, Plasmodium falciparum
INKGMSGSPL

SEQ ID NO: 3223466 - protein, 17 aa, Plasmodium falciparum
INKINNNNNNNNNNNNN

SEQ ID NO: 3223467 - protein, 28 aa, Plasmodium falciparum
INKKDDSKIKRGKDEDSNSNSSSSSSIS

SEQ ID NO: 3223468 - protein, 6 aa, Plasmodium falciparum
INKKEG

SEQ ID NO: 3223469 - protein, 12 aa, Plasmodium falciparum
INKKEKKNKVNN

SEQ ID NO: 3223470 - protein, 12 aa, Plasmodium falciparum
INKKEKQKYMNG

SEQ ID NO: 3223471 - protein, 7 aa, Plasmodium falciparum
INKKETK

SEQ ID NO: 3223472 - protein, 10 aa, Plasmodium falciparum
INKKGGEKKM

SEQ ID NO: 3223473 - protein, 10 aa, Plasmodium falciparum
INKKKKTTDI

SEQ ID NO: 3223474 - protein, 12 aa, Plasmodium falciparum
INKKNDDTYGSS

SEQ ID NO: 3223475 - protein, 12 aa, Plasmodium falciparum
INKKNKNYFQNS

SEQ ID NO: 3223476 - protein, 17 aa, Plasmodium falciparum
INKKNSLSSIKQEKKNI

SEQ ID NO: 3223477 - protein, 16 aa, Plasmodium falciparum
INKKSYEENFNPTQST

SEQ ID NO: 3223478 - protein, 5 aa, Plasmodium falciparum
INKKW

SEQ ID NO: 3223479 - protein, 4 aa, Plasmodium falciparum
INKN

SEQ ID NO: 3223480 - protein, 41 aa, Plasmodium falciparum
INKNCGEKNVGAQNAKLKNSSSSNTTITTTTTNNNNNSDYT

SEQ ID NO: 3223481 - protein, 10 aa, Plasmodium falciparum
INKNDASYNN

SEQ ID NO: 3223482 - protein, 8 aa, Plasmodium falciparum
INKNDNTY

SEQ ID NO: 3223483 - protein, 9 aa, Plasmodium falciparum
INKNDSNNK

SEQ ID NO: 3223484 - protein, 15 aa, Plasmodium falciparum
INKNEDNNSHEENKN

SEQ ID NO: 3223485 - protein, 21 aa, Plasmodium falciparum
INKNEKKNSLSTNEKKETQSL

SEQ ID NO: 3223486 - protein, 7 aa, Plasmodium falciparum
INKNEMD

SEQ ID NO: 3223487 - protein, 12 aa, Plasmodium falciparum
INKNGNSFPKED

SEQ ID NO: 3223488 - protein, 10 aa, Plasmodium falciparum
INKNGSTNIN

SEQ ID NO: 3223489 - protein, 15 aa, Plasmodium falciparum
INKNINNKNNNDNNH

SEQ ID NO: 3223490 - protein, 10 aa, Plasmodium falciparum
INKNKKEEID

SEQ ID NO: 3223491 - protein, 5 aa, Plasmodium falciparum
INKNL

SEQ ID NO: 3223492 - protein, 9 aa, Plasmodium falciparum
INKNNDQSF

SEQ ID NO: 3223493 - protein, 7 aa, Plasmodium falciparum
INKNNNI

SEQ ID NO: 3223494 - protein, 33 aa, Plasmodium falciparum
INKNNNNDKNNNNNNDKNNNNNDKNNNNNDNNK

SEQ ID NO: 3223495 - protein, 9 aa, Plasmodium falciparum
INKNNTTLE

SEQ ID NO: 3223496 - protein, 7 aa, Plasmodium falciparum
INKNREE

SEQ ID NO: 3223497 - protein, 17 aa, Plasmodium falciparum
INKNSNHTNKLKGTLSN

SEQ ID NO: 3223498 - protein, 8 aa, Plasmodium falciparum
INKNTNNE

SEQ ID NO: 3223499 - protein, 6 aa, Plasmodium falciparum
INKPSN

SEQ ID NO: 3223500 - protein, 7 aa, Plasmodium falciparum
INKQENK

SEQ ID NO: 3223501 - protein, 9 aa, Plasmodium falciparum
INKQPKKKV

SEQ ID NO: 3223502 - protein, 7 aa, Plasmodium falciparum
INKQQTC

SEQ ID NO: 3223503 - protein, 16 aa, Plasmodium falciparum
INKQTDEDDIHNKENN

SEQ ID NO: 3223504 - protein, 7 aa, Plasmodium falciparum
INKRNNS

SEQ ID NO: 3223505 - protein, 50 aa, Plasmodium falciparum
INKSDKDSYSPNNNNNNINNINNNNNNNNNNNNNNNNSSSSSKCKSNNKN

SEQ ID NO: 3223506 - protein, 9 aa, Plasmodium falciparum
INKSSKQIN

SEQ ID NO: 3223507 - protein, 10 aa, Plasmodium falciparum
INKSTHNNNN

SEQ ID NO: 3223508 - protein, 86 aa, Plasmodium falciparum
INKSYGSNKSYGINKSYGSNKSYGSNKSYGINKSYGSNKSYGSNKSYGNNKSYGNNNSYDSDDSHDSDDSRDSDNSHHGDDKNNDL

SEQ ID NO: 3223509 - protein, 13 aa, Plasmodium falciparum
INKTEGRKNKNKL

SEQ ID NO: 3223510 - protein, 43 aa, Plasmodium falciparum
INKTNSKNKQQQVNEHDTNSKKDNKIISTKETNIPKDNNVEGK

SEQ ID NO: 3223511 - protein, 10 aa, Plasmodium falciparum
INKTSHNNFS

SEQ ID NO: 3223512 - protein, 9 aa, Plasmodium falciparum
INKTTRDQN

SEQ ID NO: 3223513 - protein, 9 aa, Plasmodium falciparum
INKYNNNVS

SEQ ID NO: 3223514 - protein, 8 aa, Plasmodium falciparum
INLEGKSK

SEQ ID NO: 3223515 - protein, 8 aa, Plasmodium falciparum
INLENGEK

SEQ ID NO: 3223516 - protein, 13 aa, Plasmodium falciparum
INMPGSGGGSGVN

SEQ ID NO: 3223517 - protein, 5 aa, Plasmodium falciparum
INMQQ

SEQ ID NO: 3223518 - protein, 61 aa, Plasmodium falciparum
INNADDNNDDDNINDDDNINDDDNINDDDNNNDDDNNNDDNNDDNNINNDNNDDDNNNNNN

SEQ ID NO: 3223519 - protein, 6 aa, Plasmodium falciparum
INNAEE

SEQ ID NO: 3223520 - protein, 15 aa, Plasmodium falciparum
INNAGDTNNAGDINN

SEQ ID NO: 3223521 - protein, 4 aa, Plasmodium falciparum
INND

SEQ ID NO: 3223522 - protein, 21 aa, Plasmodium falciparum
INNDAGSTSSHCRNNNSGHND

SEQ ID NO: 3223523 - protein, 5 aa, Plasmodium falciparum
INNDE

SEQ ID NO: 3223524 - protein, 19 aa, Plasmodium falciparum
INNDKKKKNTKKTSQNQYY

SEQ ID NO: 3223525 - protein, 8 aa, Plasmodium falciparum
INNDKKSI

SEQ ID NO: 3223526 - protein, 7 aa, Plasmodium falciparum
INNDNDK

SEQ ID NO: 3223527 - protein, 51 aa, Plasmodium falciparum
INNDNNDNNENNDNNENNDNNIPVNNKKNSHTPHVPKDTKNNIEKNHSNYN

SEQ ID NO: 3223528 - protein, 6 aa, Plasmodium falciparum
INNDYK

SEQ ID NO: 3223529 - protein, 4 aa, Plasmodium falciparum
INNE

SEQ ID NO: 3223530 - protein, 5 aa, Plasmodium falciparum
INNEE

SEQ ID NO: 3223531 - protein, 9 aa, Plasmodium falciparum
INNEETKPF

SEQ ID NO: 3223532 - protein, 6 aa, Plasmodium falciparum
INNEEY

SEQ ID NO: 3223533 - protein, 7 aa, Plasmodium falciparum
INNEGES

SEQ ID NO: 3223534 - protein, 7 aa, Plasmodium falciparum
INNEKDY

SEQ ID NO: 3223535 - protein, 7 aa, Plasmodium falciparum
INNEKEG

SEQ ID NO: 3223536 - protein, 21 aa, Plasmodium falciparum
INNENKNNNISDDKDLKSDGV

SEQ ID NO: 3223537 - protein, 6 aa, Plasmodium falciparum
INNENL

SEQ ID NO: 3223538 - protein, 30 aa, Plasmodium falciparum
INNEPNDNKNDNNDNNDSNNNDNNNNQHDS

SEQ ID NO: 3223539 - protein, 9 aa, Plasmodium falciparum
INNETNDVK

SEQ ID NO: 3223540 - protein, 18 aa, Plasmodium falciparum
INNETYNDTLNDTPNDTL

SEQ ID NO: 3223541 - protein, 5 aa, Plasmodium falciparum
INNEV

SEQ ID NO: 3223542 - protein, 10 aa, Plasmodium falciparum
INNGDRNDGV

SEQ ID NO: 3223543 - protein, 8 aa, Plasmodium falciparum
INNGNNKY

SEQ ID NO: 3223544 - protein, 12 aa, Plasmodium falciparum
INNGRNTSSNNE

SEQ ID NO: 3223545 - protein, 9 aa, Plasmodium falciparum
INNGSNITN

SEQ ID NO: 3223546 - protein, 4 aa, Plasmodium falciparum
INNH

SEQ ID NO: 3223547 - protein, 15 aa, Plasmodium falciparum
INNIEDENNKRGSSK

SEQ ID NO: 3223548 - protein, 26 aa, Plasmodium falciparum
INNIEGEQKDDINNSQTHNYKNKDVS

SEQ ID NO: 3223549 - protein, 7 aa, Plasmodium falciparum
INNINNN

SEQ ID NO: 3223550 - protein, 5 aa, Plasmodium falciparum
INNIS

SEQ ID NO: 3223551 - protein, 9 aa, Plasmodium falciparum
INNKFGEKK

SEQ ID NO: 3223552 - protein, 5 aa, Plasmodium falciparum
INNKG

SEQ ID NO: 3223553 - protein, 14 aa, Plasmodium falciparum
INNKHNNYNNINNN

SEQ ID NO: 3223554 - protein, 7 aa, Plasmodium falciparum
INNKKKH

SEQ ID NO: 3223555 - protein, 11 aa, Plasmodium falciparum
INNKNIKNNDN

SEQ ID NO: 3223556 - protein, 9 aa, Plasmodium falciparum
INNKNKAYL

SEQ ID NO: 3223557 - protein, 10 aa, Plasmodium falciparum
INNKNKEQKQ

SEQ ID NO: 3223558 - protein, 9 aa, Plasmodium falciparum
INNKSKNEH

SEQ ID NO: 3223559 - protein, 21 aa, Plasmodium falciparum
INNKSSDDKTTDIINDGKEKV

SEQ ID NO: 3223560 - protein, 7 aa, Plasmodium falciparum
INNKTDN

SEQ ID NO: 3223561 - protein, 32 aa, Plasmodium falciparum
INNNDSNNCGDSNNCGDSNNCDDSNNCDDNVK

SEQ ID NO: 3223562 - protein, 16 aa, Plasmodium falciparum
INNNFNPNGPNNNVNS

SEQ ID NO: 3223563 - protein, 8 aa, Plasmodium falciparum
INNNGELK

SEQ ID NO: 3223564 - protein, 35 aa, Plasmodium falciparum
INNNINNNNNNTISSSSSISSSISSSSMNNNIDSN

SEQ ID NO: 3223565 - protein, 11 aa, Plasmodium falciparum
INNNKKNNNNK

SEQ ID NO: 3223566 - protein, 14 aa, Plasmodium falciparum
INNNKNKLDEEEKL

SEQ ID NO: 3223567 - protein, 9 aa, Plasmodium falciparum
INNNKSSCN

SEQ ID NO: 3223568 - protein, 32 aa, Plasmodium falciparum
INNNNDDNKNNNNNNDSSDNNNNNNNDDDNNN

SEQ ID NO: 3223569 - protein, 11 aa, Plasmodium falciparum
INNNNDKEQLK

SEQ ID NO: 3223570 - protein, 21 aa, Plasmodium falciparum
INNNNGNNNNGNNNNGNNNHC

SEQ ID NO: 3223571 - protein, 6 aa, Plasmodium falciparum
INNNNN

SEQ ID NO: 3223572 - protein, 37 aa, Plasmodium falciparum
INNNNNKKNKNKCGNNNYSNSKENRYNYNDKNKNDSK

SEQ ID NO: 3223573 - protein, 9 aa, Plasmodium falciparum
INNNNNMNN

SEQ ID NO: 3223574 - protein, 9 aa, Plasmodium falciparum
INNNNNNIY

SEQ ID NO: 3223575 - protein, 19 aa, Plasmodium falciparum
INNNNNNKNNNGDNNNNCD

SEQ ID NO: 3223576 - protein, 10 aa, Plasmodium falciparum
INNNNNNNIN

SEQ ID NO: 3223577 - protein, 31 aa, Plasmodium falciparum
INNNNNNNINNINNNNNNNNNNNNNKVNNYE

SEQ ID NO: 3223578 - protein, 10 aa, Plasmodium falciparum
INNNNNNNIY

SEQ ID NO: 3223579 - protein, 12 aa, Plasmodium falciparum
INNNNNNNMKNG

SEQ ID NO: 3223580 - protein, 19 aa, Plasmodium falciparum
INNNNNNNNISENNNIRSN

SEQ ID NO: 3223581 - protein, 20 aa, Plasmodium falciparum
INNNNNNNNNNACSSGSSSN

SEQ ID NO: 3223582 - protein, 36 aa, Plasmodium falciparum
INNNNNNNNNNINNNNDDGGGGNSCDNNKIQRSTDV

SEQ ID NO: 3223583 - protein, 14 aa, Plasmodium falciparum
INNNNNNNNNNNIH

SEQ ID NO: 3223584 - protein, 17 aa, Plasmodium falciparum
INNNNNNNNNNNINNDN

SEQ ID NO: 3223585 - protein, 14 aa, Plasmodium falciparum
INNNNNNNNNNNNN

SEQ ID NO: 3223586 - protein, 21 aa, Plasmodium falciparum
INNNNNNNNNNNNNNNNNNDN

SEQ ID NO: 3223587 - protein, 33 aa, Plasmodium falciparum
INNNNNNNNNNSNNNNNNNNNNNNNNNNNNNSF

SEQ ID NO: 3223588 - protein, 22 aa, Plasmodium falciparum
INNNNNNNNNNSYNNAYNKDKR

SEQ ID NO: 3223589 - protein, 12 aa, Plasmodium falciparum
INNNNNNNNNRN

SEQ ID NO: 3223590 - protein, 13 aa, Plasmodium falciparum
INNNNNNNNNTKM

SEQ ID NO: 3223591 - protein, 17 aa, Plasmodium falciparum
INNNNNNNTNNMNPSHP

SEQ ID NO: 3223592 - protein, 11 aa, Plasmodium falciparum
INNNNNNSEYS

SEQ ID NO: 3223593 - protein, 25 aa, Plasmodium falciparum
INNNNNNYKENHKKLGKNDDERIKD

SEQ ID NO: 3223594 - protein, 19 aa, Plasmodium falciparum
INNNNNYNNNNNYNNKRSY

SEQ ID NO: 3223595 - protein, 21 aa, Plasmodium falciparum
INNNNSNNNNNNNNNNNNNIN

SEQ ID NO: 3223596 - protein, 32 aa, Plasmodium falciparum
INNNNYNNNNNNDNNKINYDQNYNKDISANDI

SEQ ID NO: 3223597 - protein, 15 aa, Plasmodium falciparum
INNNPNTKLKDMKKK

SEQ ID NO: 3223598 - protein, 8 aa, Plasmodium falciparum
INNNQHNI

SEQ ID NO: 3223599 - protein, 8 aa, Plasmodium falciparum
INNNSGTQ

SEQ ID NO: 3223600 - protein, 75 aa, Plasmodium falciparum
INNNSKKYRNNQTEYYKKKEKKKKYDQKNDQTNEQKCAQKNDQTNEQKNDQTNDQTNDQTNDQTNDQTNDQTNDK

SEQ ID NO: 3223601 - protein, 47 aa, Plasmodium falciparum
INNNSNESNNSNNNSNNNNNNNNNNNNNNNNNNNNNNKNKDDQKVQT

SEQ ID NO: 3223602 - protein, 9 aa, Plasmodium falciparum
INNNSNNNI

SEQ ID NO: 3223603 - protein, 11 aa, Plasmodium falciparum
INNNSSGDYKE

SEQ ID NO: 3223604 - protein, 24 aa, Plasmodium falciparum
INNNTDDHSEDSHSQYSSDEEVRK

SEQ ID NO: 3223605 - protein, 10 aa, Plasmodium falciparum
INNNTSSSNY

SEQ ID NO: 3223606 - protein, 8 aa, Plasmodium falciparum
INNPDEKV

SEQ ID NO: 3223607 - protein, 14 aa, Plasmodium falciparum
INNPKRKKCRNECK

SEQ ID NO: 3223608 - protein, 5 aa, Plasmodium falciparum
INNPT

SEQ ID NO: 3223609 - protein, 9 aa, Plasmodium falciparum
INNQEKSEL

SEQ ID NO: 3223610 - protein, 65 aa, Plasmodium falciparum
INNQKGKMKNKKKIKRKNQHTKQHTKQHTREHTREHTRQHTKQHTRQHTKQHTKQHTKQHTKQNN

SEQ ID NO: 3223611 - protein, 5 aa, Plasmodium falciparum
INNQN

SEQ ID NO: 3223612 - protein, 10 aa, Plasmodium falciparum
INNQPNQINR

SEQ ID NO: 3223613 - protein, 5 aa, Plasmodium falciparum
INNRN

SEQ ID NO: 3223614 - protein, 12 aa, Plasmodium falciparum
INNRRQKKSEYE

SEQ ID NO: 3223615 - protein, 13 aa, Plasmodium falciparum
INNSDLNNNDNKM

SEQ ID NO: 3223616 - protein, 7 aa, Plasmodium falciparum
INNSDNI

SEQ ID NO: 3223617 - protein, 12 aa, Plasmodium falciparum
INNSENEEDEYE

SEQ ID NO: 3223618 - protein, 26 aa, Plasmodium falciparum
INNSGTNVGQGNNNNTTNENNPRNQR

SEQ ID NO: 3223619 - protein, 8 aa, Plasmodium falciparum
INNSKENI

SEQ ID NO: 3223620 - protein, 11 aa, Plasmodium falciparum
INNSKKNDKKM

SEQ ID NO: 3223621 - protein, 5 aa, Plasmodium falciparum
INNSN

SEQ ID NO: 3223622 - protein, 20 aa, Plasmodium falciparum
INNSNNNNNNNNNNNNNNNN

SEQ ID NO: 3223623 - protein, 7 aa, Plasmodium falciparum
INNSNNV

SEQ ID NO: 3223624 - protein, 9 aa, Plasmodium falciparum
INNSNTTRW

SEQ ID NO: 3223625 - protein, 11 aa, Plasmodium falciparum
INNSNTYKNNN

SEQ ID NO: 3223626 - protein, 8 aa, Plasmodium falciparum
INNSREQK

SEQ ID NO: 3223627 - protein, 7 aa, Plasmodium falciparum
INNSTDD

SEQ ID NO: 3223628 - protein, 6 aa, Plasmodium falciparum
INNSYN

SEQ ID NO: 3223629 - protein, 10 aa, Plasmodium falciparum
INNTEDINKN

SEQ ID NO: 3223630 - protein, 6 aa, Plasmodium falciparum
INNTKG

SEQ ID NO: 3223631 - protein, 7 aa, Plasmodium falciparum
INNTKKK

SEQ ID NO: 3223632 - protein, 6 aa, Plasmodium falciparum
INNTKN

SEQ ID NO: 3223633 - protein, 24 aa, Plasmodium falciparum
INNTNNFDNTNNIDNTNNIGNTNN

SEQ ID NO: 3223634 - protein, 13 aa, Plasmodium falciparum
INNTNNSENENNK

SEQ ID NO: 3223635 - protein, 8 aa, Plasmodium falciparum
INNTNTKR

SEQ ID NO: 3223636 - protein, 7 aa, Plasmodium falciparum
INNTNTS

SEQ ID NO: 3223637 - protein, 9 aa, Plasmodium falciparum
INNTRNSIS

SEQ ID NO: 3223638 - protein, 18 aa, Plasmodium falciparum
INNTTNSYINNQSSYSQV

SEQ ID NO: 3223639 - protein, 4 aa, Plasmodium falciparum
INNY

SEQ ID NO: 3223640 - protein, 29 aa, Plasmodium falciparum
INNYNNNYNNNYNNNYNNNYNNNNNNMST

SEQ ID NO: 3223641 - protein, 4 aa, Plasmodium falciparum
INPD

SEQ ID NO: 3223642 - protein, 8 aa, Plasmodium falciparum
INPDNGTK

SEQ ID NO: 3223643 - protein, 4 aa, Plasmodium falciparum
INPE

SEQ ID NO: 3223644 - protein, 10 aa, Plasmodium falciparum
INPEKNTINQ

SEQ ID NO: 3223645 - protein, 4 aa, Plasmodium falciparum
INPI

SEQ ID NO: 3223646 - protein, 4 aa, Plasmodium falciparum
INPK

SEQ ID NO: 3223647 - protein, 8 aa, Plasmodium falciparum
INPKEEKY

SEQ ID NO: 3223648 - protein, 10 aa, Plasmodium falciparum
INPNDDTKNI

SEQ ID NO: 3223649 - protein, 6 aa, Plasmodium falciparum
INPNDE

SEQ ID NO: 3223650 - protein, 35 aa, Plasmodium falciparum
INPNGESSKGLSNNTVENKDCKSINDNEVTNNNDI

SEQ ID NO: 3223651 - protein, 5 aa, Plasmodium falciparum
INPNL

SEQ ID NO: 3223652 - protein, 9 aa, Plasmodium falciparum
INPPPKPYM

SEQ ID NO: 3223653 - protein, 25 aa, Plasmodium falciparum
INPPYGQYNNSHDNIYNNNNNKYDH

SEQ ID NO: 3223654 - protein, 12 aa, Plasmodium falciparum
INPSSDSEKSSI

SEQ ID NO: 3223655 - protein, 5 aa, Plasmodium falciparum
INPSY

SEQ ID NO: 3223656 - protein, 6 aa, Plasmodium falciparum
INPTND

SEQ ID NO: 3223657 - protein, 5 aa, Plasmodium falciparum
INPTY

SEQ ID NO: 3223658 - protein, 30 aa, Plasmodium falciparum
INQHKNDEKIDEKNDKKIDKKIDKKNNDNI

SEQ ID NO: 3223659 - protein, 10 aa, Plasmodium falciparum
INQKDNNDEN

SEQ ID NO: 3223660 - protein, 10 aa, Plasmodium falciparum
INQKEKEKNE

SEQ ID NO: 3223661 - protein, 25 aa, Plasmodium falciparum
INQKRNEQNCKSFNDEKNENARDPN

SEQ ID NO: 3223662 - protein, 4 aa, Plasmodium falciparum
INQN

SEQ ID NO: 3223663 - protein, 8 aa, Plasmodium falciparum
INQNEKEK

SEQ ID NO: 3223664 - protein, 19 aa, Plasmodium falciparum
INQPNENHTRHNDPCDNMK

SEQ ID NO: 3223665 - protein, 6 aa, Plasmodium falciparum
INQQQI

SEQ ID NO: 3223666 - protein, 10 aa, Plasmodium falciparum
INQQQMNQQQ

SEQ ID NO: 3223667 - protein, 6 aa, Plasmodium falciparum
INQSND

SEQ ID NO: 3223668 - protein, 9 aa, Plasmodium falciparum
INQSSNTIK

SEQ ID NO: 3223669 - protein, 9 aa, Plasmodium falciparum
INQSTKEQE

SEQ ID NO: 3223670 - protein, 18 aa, Plasmodium falciparum
INQTTNNNTYNNQTSNHM

SEQ ID NO: 3223671 - protein, 10 aa, Plasmodium falciparum
INRDNNPYSG

SEQ ID NO: 3223672 - protein, 4 aa, Plasmodium falciparum
INRN

SEQ ID NO: 3223673 - protein, 16 aa, Plasmodium falciparum
INRNDNINSSNEYDVR

SEQ ID NO: 3223674 - protein, 8 aa, Plasmodium falciparum
INRNRKNE

SEQ ID NO: 3223675 - protein, 8 aa, Plasmodium falciparum
INRPSSAH

SEQ ID NO: 3223676 - protein, 4 aa, Plasmodium falciparum
INRR

SEQ ID NO: 3223677 - protein, 4 aa, Plasmodium falciparum
INRT

SEQ ID NO: 3223678 - protein, 21 aa, Plasmodium falciparum
INSAEKKNWNKTVNNKTKNTG

SEQ ID NO: 3223679 - protein, 6 aa, Plasmodium falciparum
INSANN

SEQ ID NO: 3223680 - protein, 9 aa, Plasmodium falciparum
INSDPTNLN

SEQ ID NO: 3223681 - protein, 12 aa, Plasmodium falciparum
INSDRNKNDYIP

SEQ ID NO: 3223682 - protein, 5 aa, Plasmodium falciparum
INSDV

SEQ ID NO: 3223683 - protein, 4 aa, Plasmodium falciparum
INSE

SEQ ID NO: 3223684 - protein, 19 aa, Plasmodium falciparum
INSEKENIKIKGDEKSTNQ

SEQ ID NO: 3223685 - protein, 10 aa, Plasmodium falciparum
INSENKINNQ

SEQ ID NO: 3223686 - protein, 7 aa, Plasmodium falciparum
INSIPDH

SEQ ID NO: 3223687 - protein, 9 aa, Plasmodium falciparum
INSKENEKV

SEQ ID NO: 3223688 - protein, 50 aa, Plasmodium falciparum
INSKGCDNADNDDDNNDDNNDGDNNNDDDNNNDDNNIDDNDGDNNNDEKD

SEQ ID NO: 3223689 - protein, 12 aa, Plasmodium falciparum
INSKQADTIERV

SEQ ID NO: 3223690 - protein, 14 aa, Plasmodium falciparum
INSKQIAQSNSYTQ

SEQ ID NO: 3223691 - protein, 7 aa, Plasmodium falciparum
INSKSDN

SEQ ID NO: 3223692 - protein, 7 aa, Plasmodium falciparum
INSKSNE

SEQ ID NO: 3223693 - protein, 7 aa, Plasmodium falciparum
INSKYST

SEQ ID NO: 3223694 - protein, 4 aa, Plasmodium falciparum
INSL

SEQ ID NO: 3223695 - protein, 4 aa, Plasmodium falciparum
INSN

SEQ ID NO: 3223696 - protein, 7 aa, Plasmodium falciparum
INSNDQN

SEQ ID NO: 3223697 - protein, 24 aa, Plasmodium falciparum
INSNINNNINSNINNNINSNINNN

SEQ ID NO: 3223698 - protein, 14 aa, Plasmodium falciparum
INSNINNNNPLSSA

SEQ ID NO: 3223699 - protein, 13 aa, Plasmodium falciparum
INSNMNNNNNNNV

SEQ ID NO: 3223700 - protein, 17 aa, Plasmodium falciparum
INSNNDIDKNNETNDND

SEQ ID NO: 3223701 - protein, 11 aa, Plasmodium falciparum
INSNNNNINNN

SEQ ID NO: 3223702 - protein, 55 aa, Plasmodium falciparum
INSNNNNNSNNNNNSNNNSNNKSNNKSNNKSNNKSNNKSNYNNNSSNNNRNNNNN

SEQ ID NO: 3223703 - protein, 6 aa, Plasmodium falciparum
INSNSE

SEQ ID NO: 3223704 - protein, 10 aa, Plasmodium falciparum
INSNSKNKNY

SEQ ID NO: 3223705 - protein, 20 aa, Plasmodium falciparum
INSNSNDAHTNKVGEKKDEN

SEQ ID NO: 3223706 - protein, 6 aa, Plasmodium falciparum
INSPEI

SEQ ID NO: 3223707 - protein, 11 aa, Plasmodium falciparum
INSQNNDKIPL

SEQ ID NO: 3223708 - protein, 15 aa, Plasmodium falciparum
INSRTKKNKSNKLYQ

SEQ ID NO: 3223709 - protein, 20 aa, Plasmodium falciparum
INSSNNINSSSNNNNSNNNI

SEQ ID NO: 3223710 - protein, 7 aa, Plasmodium falciparum
INSSNNN

SEQ ID NO: 3223711 - protein, 42 aa, Plasmodium falciparum
INSSNSINHSNGIGRKENTTSNKNKGNVKTNTDKKNKKQKKQ

SEQ ID NO: 3223712 - protein, 59 aa, Plasmodium falciparum
INSSSSSFGSSSLSSSSFSSSSSSKSYKSSRNISDVNNDLDKKRGDKKVTNNYERNDDR

SEQ ID NO: 3223713 - protein, 11 aa, Plasmodium falciparum
INSSSSSSIQY

SEQ ID NO: 3223714 - protein, 9 aa, Plasmodium falciparum
INSTSEEKK

SEQ ID NO: 3223715 - protein, 24 aa, Plasmodium falciparum
INSTSKKKHKYNKNETDERDRNEV

SEQ ID NO: 3223716 - protein, 27 aa, Plasmodium falciparum
INSTTKNTNDLKNNVNDNIDDNTDGNI

SEQ ID NO: 3223717 - protein, 13 aa, Plasmodium falciparum
INSTTNNNITEKE

SEQ ID NO: 3223718 - protein, 4 aa, Plasmodium falciparum
INSV

SEQ ID NO: 3223719 - protein, 12 aa, Plasmodium falciparum
INSVNNNNNISD

SEQ ID NO: 3223720 - protein, 8 aa, Plasmodium falciparum
INSYDNNI

SEQ ID NO: 3223721 - protein, 11 aa, Plasmodium falciparum
INSYSDQSNNI

SEQ ID NO: 3223722 - protein, 5 aa, Plasmodium falciparum
INTAR

SEQ ID NO: 3223723 - protein, 5 aa, Plasmodium falciparum
INTDD

SEQ ID NO: 3223724 - protein, 11 aa, Plasmodium falciparum
INTDKKKKCEH

SEQ ID NO: 3223725 - protein, 14 aa, Plasmodium falciparum
INTDKVKKKDENNS

SEQ ID NO: 3223726 - protein, 26 aa, Plasmodium falciparum
INTDQNDNNQVYDNQNNDESKNSNHD

SEQ ID NO: 3223727 - protein, 5 aa, Plasmodium falciparum
INTED

SEQ ID NO: 3223728 - protein, 38 aa, Plasmodium falciparum
INTHKENNNDDGNNNVDGNNNDDDNNNNDDNNNNNCNN

SEQ ID NO: 3223729 - protein, 7 aa, Plasmodium falciparum
INTINND

SEQ ID NO: 3223730 - protein, 5 aa, Plasmodium falciparum
INTKE

SEQ ID NO: 3223731 - protein, 5 aa, Plasmodium falciparum
INTKR

SEQ ID NO: 3223732 - protein, 14 aa, Plasmodium falciparum
INTKRKNSQRDKSN

SEQ ID NO: 3223733 - protein, 4 aa, Plasmodium falciparum
INTN

SEQ ID NO: 3223734 - protein, 36 aa, Plasmodium falciparum
INTNANTNNNINTNGSVNDNTGINSNLQNNNKAYNN

SEQ ID NO: 3223735 - protein, 9 aa, Plasmodium falciparum
INTNDGNYT

SEQ ID NO: 3223736 - protein, 5 aa, Plasmodium falciparum
INTNE

SEQ ID NO: 3223737 - protein, 6 aa, Plasmodium falciparum
INTNEK

SEQ ID NO: 3223738 - protein, 10 aa, Plasmodium falciparum
INTNENTSNH

SEQ ID NO: 3223739 - protein, 12 aa, Plasmodium falciparum
INTNKDQEEVES

SEQ ID NO: 3223740 - protein, 11 aa, Plasmodium falciparum
INTNNDQSSYN

SEQ ID NO: 3223741 - protein, 25 aa, Plasmodium falciparum
INTNNNDKNEPADTNIKDNSNNTIK

SEQ ID NO: 3223742 - protein, 8 aa, Plasmodium falciparum
INTNNNNI

SEQ ID NO: 3223743 - protein, 32 aa, Plasmodium falciparum
INTNNNNNNNNNNNKNNNNKNNNNNNNNNNNY

SEQ ID NO: 3223744 - protein, 35 aa, Plasmodium falciparum
INTNQYDKSIDESSTCGCTDNNKAKLETTKGKDKY

SEQ ID NO: 3223745 - protein, 6 aa, Plasmodium falciparum
INTNSN

SEQ ID NO: 3223746 - protein, 10 aa, Plasmodium falciparum
INTNTNTNIN

SEQ ID NO: 3223747 - protein, 6 aa, Plasmodium falciparum
INTPND

SEQ ID NO: 3223748 - protein, 8 aa, Plasmodium falciparum
INTPSNEE

SEQ ID NO: 3223749 - protein, 9 aa, Plasmodium falciparum
INTPSSYNI

SEQ ID NO: 3223750 - protein, 5 aa, Plasmodium falciparum
INTRE

SEQ ID NO: 3223751 - protein, 7 aa, Plasmodium falciparum
INTRSDA

SEQ ID NO: 3223752 - protein, 4 aa, Plasmodium falciparum
INTS

SEQ ID NO: 3223753 - protein, 6 aa, Plasmodium falciparum
INTSNC

SEQ ID NO: 3223754 - protein, 7 aa, Plasmodium falciparum
INTSNKN

SEQ ID NO: 3223755 - protein, 9 aa, Plasmodium falciparum
INTSQDNNY

SEQ ID NO: 3223756 - protein, 62 aa, Plasmodium falciparum
INTSQRTIDDSNMDRNNRYNTSSQQKNNLHTNNNSNSRYNNNHDKQNEHKYNQGKSSGKDNA

SEQ ID NO: 3223757 - protein, 5 aa, Plasmodium falciparum
INTSY

SEQ ID NO: 3223758 - protein, 22 aa, Plasmodium falciparum
INTTNNINTTNNINTTNNINTT

SEQ ID NO: 3223759 - protein, 32 aa, Plasmodium falciparum
INTTNNINTTNNINTTNNINTTNNIKTPHNIN

SEQ ID NO: 3223760 - protein, 8 aa, Plasmodium falciparum
INTTNNVN

SEQ ID NO: 3223761 - protein, 5 aa, Plasmodium falciparum
INTTP

SEQ ID NO: 3223762 - protein, 6 aa, Plasmodium falciparum
INTTTH

SEQ ID NO: 3223763 - protein, 4 aa, Plasmodium falciparum
INTY

SEQ ID NO: 3223764 - protein, 11 aa, Plasmodium falciparum
INVPDNNKKYL

SEQ ID NO: 3223765 - protein, 14 aa, Plasmodium falciparum
INVPTNDQINDPIN

SEQ ID NO: 3223766 - protein, 10 aa, Plasmodium falciparum
INVSQQKYAQ

SEQ ID NO: 3223767 - protein, 9 aa, Plasmodium falciparum
INYDNQNTY

SEQ ID NO: 3223768 - protein, 28 aa, Plasmodium falciparum
INYEEDNNLNGQDEYYEENEEGDYTNEK

SEQ ID NO: 3223769 - protein, 6 aa, Plasmodium falciparum
INYNDS

SEQ ID NO: 3223770 - protein, 12 aa, Plasmodium falciparum
INYNNDEKKKSE

SEQ ID NO: 3223771 - protein, 40 aa, Plasmodium falciparum
INYNNENNDESDGENNNTPYNYTNGSYDNNENITQTNNSI

SEQ ID NO: 3223772 - protein, 4 aa, Plasmodium falciparum
INYS

SEQ ID NO: 3223773 - protein, 15 aa, Plasmodium falciparum
IPANNDKNHVDNKNN

SEQ ID NO: 3223774 - protein, 4 aa, Plasmodium falciparum
IPCG

SEQ ID NO: 3223775 - protein, 7 aa, Plasmodium falciparum
IPDDNKN

SEQ ID NO: 3223776 - protein, 10 aa, Plasmodium falciparum
IPDGKGKNIQ

SEQ ID NO: 3223777 - protein, 14 aa, Plasmodium falciparum
IPDINNKTELESEN

SEQ ID NO: 3223778 - protein, 11 aa, Plasmodium falciparum
IPDKSSISARE

SEQ ID NO: 3223779 - protein, 7 aa, Plasmodium falciparum
IPDKSTM

SEQ ID NO: 3223780 - protein, 4 aa, Plasmodium falciparum
IPDN

SEQ ID NO: 3223781 - protein, 12 aa, Plasmodium falciparum
IPDNDKNSNYKY

SEQ ID NO: 3223782 - protein, 9 aa, Plasmodium falciparum
IPDPSSDVK

SEQ ID NO: 3223783 - protein, 6 aa, Plasmodium falciparum
IPEDEK

SEQ ID NO: 3223784 - protein, 5 aa, Plasmodium falciparum
IPEGG

SEQ ID NO: 3223785 - protein, 5 aa, Plasmodium falciparum
IPEKE

SEQ ID NO: 3223786 - protein, 5 aa, Plasmodium falciparum
IPEKT

SEQ ID NO: 3223787 - protein, 5 aa, Plasmodium falciparum
IPENC

SEQ ID NO: 3223788 - protein, 11 aa, Plasmodium falciparum
IPENGGKTTTI

SEQ ID NO: 3223789 - protein, 6 aa, Plasmodium falciparum
IPEPPL

SEQ ID NO: 3223790 - protein, 12 aa, Plasmodium falciparum
IPEPSKYKRTEI

SEQ ID NO: 3223791 - protein, 11 aa, Plasmodium falciparum
IPGEKGKNLTE

SEQ ID NO: 3223792 - protein, 9 aa, Plasmodium falciparum
IPGKTSPKL

SEQ ID NO: 3223793 - protein, 11 aa, Plasmodium falciparum
IPGKVSSTYNS

SEQ ID NO: 3223794 - protein, 9 aa, Plasmodium falciparum
IPGSNRPNA

SEQ ID NO: 3223795 - protein, 9 aa, Plasmodium falciparum
IPISGKNDV

SEQ ID NO: 3223796 - protein, 52 aa, Plasmodium falciparum
IPKGEDQTLGKSDAIPNIGEPETGISTTEESRHEEGHNKQALSTSVDEPELS

SEQ ID NO: 3223797 - protein, 4 aa, Plasmodium falciparum
IPKI

SEQ ID NO: 3223798 - protein, 10 aa, Plasmodium falciparum
IPKKKKGVPK

SEQ ID NO: 3223799 - protein, 11 aa, Plasmodium falciparum
IPKKKKKNQKC

SEQ ID NO: 3223800 - protein, 14 aa, Plasmodium falciparum
IPKKNKKTDNQSPV

SEQ ID NO: 3223801 - protein, 8 aa, Plasmodium falciparum
IPKKNPEM

SEQ ID NO: 3223802 - protein, 4 aa, Plasmodium falciparum
IPKN

SEQ ID NO: 3223803 - protein, 14 aa, Plasmodium falciparum
IPKNDSKNRIHSST

SEQ ID NO: 3223804 - protein, 9 aa, Plasmodium falciparum
IPKNEKTNS

SEQ ID NO: 3223805 - protein, 5 aa, Plasmodium falciparum
IPKRK

SEQ ID NO: 3223806 - protein, 4 aa, Plasmodium falciparum
IPKS

SEQ ID NO: 3223807 - protein, 5 aa, Plasmodium falciparum
IPKSI

SEQ ID NO: 3223808 - protein, 32 aa, Plasmodium falciparum
IPKSPASVQSLDKGEDNNDNDEKGESGEDTQV

SEQ ID NO: 3223809 - protein, 5 aa, Plasmodium falciparum
IPKYD

SEQ ID NO: 3223810 - protein, 5 aa, Plasmodium falciparum
IPLQN

SEQ ID NO: 3223811 - protein, 5 aa, Plasmodium falciparum
IPNDN

SEQ ID NO: 3223812 - protein, 7 aa, Plasmodium falciparum
IPNEECS

SEQ ID NO: 3223813 - protein, 4 aa, Plasmodium falciparum
IPNG

SEQ ID NO: 3223814 - protein, 12 aa, Plasmodium falciparum
IPNGGKGGNGGS

SEQ ID NO: 3223815 - protein, 20 aa, Plasmodium falciparum
IPNKNNKKNINNNMTTSSIG

SEQ ID NO: 3223816 - protein, 4 aa, Plasmodium falciparum
IPNN

SEQ ID NO: 3223817 - protein, 6 aa, Plasmodium falciparum
IPNNPY

SEQ ID NO: 3223818 - protein, 5 aa, Plasmodium falciparum
IPNNY

SEQ ID NO: 3223819 - protein, 4 aa, Plasmodium falciparum
IPNQ

SEQ ID NO: 3223820 - protein, 5 aa, Plasmodium falciparum
IPNSN

SEQ ID NO: 3223821 - protein, 12 aa, Plasmodium falciparum
IPNSRTETNVES

SEQ ID NO: 3223822 - protein, 11 aa, Plasmodium falciparum
IPPAKYDKDND

SEQ ID NO: 3223823 - protein, 6 aa, Plasmodium falciparum
IPPEVS

SEQ ID NO: 3223824 - protein, 7 aa, Plasmodium falciparum
IPPHDDE

SEQ ID NO: 3223825 - protein, 6 aa, Plasmodium falciparum
IPPKSE

SEQ ID NO: 3223826 - protein, 4 aa, Plasmodium falciparum
IPPP

SEQ ID NO: 3223827 - protein, 9 aa, Plasmodium falciparum
IPPPYGDND

SEQ ID NO: 3223828 - protein, 8 aa, Plasmodium falciparum
IPPSPTSL

SEQ ID NO: 3223829 - protein, 5 aa, Plasmodium falciparum
IPQDE

SEQ ID NO: 3223830 - protein, 12 aa, Plasmodium falciparum
IPQGDNKEEHDN

SEQ ID NO: 3223831 - protein, 5 aa, Plasmodium falciparum
IPQPR

SEQ ID NO: 3223832 - protein, 5 aa, Plasmodium falciparum
IPQRG

SEQ ID NO: 3223833 - protein, 7 aa, Plasmodium falciparum
IPRDNET

SEQ ID NO: 3223834 - protein, 7 aa, Plasmodium falciparum
IPRKTSY

SEQ ID NO: 3223835 - protein, 6 aa, Plasmodium falciparum
IPSAGE

SEQ ID NO: 3223836 - protein, 10 aa, Plasmodium falciparum
IPSEEKQANF

SEQ ID NO: 3223837 - protein, 14 aa, Plasmodium falciparum
IPSEQGNKKHHTTW

SEQ ID NO: 3223838 - protein, 4 aa, Plasmodium falciparum
IPSI

SEQ ID NO: 3223839 - protein, 4 aa, Plasmodium falciparum
IPSK

SEQ ID NO: 3223840 - protein, 9 aa, Plasmodium falciparum
IPSKKKHKN

SEQ ID NO: 3223841 - protein, 4 aa, Plasmodium falciparum
IPSN

SEQ ID NO: 3223842 - protein, 5 aa, Plasmodium falciparum
IPSND

SEQ ID NO: 3223843 - protein, 11 aa, Plasmodium falciparum
IPSNDDNKKKD

SEQ ID NO: 3223844 - protein, 8 aa, Plasmodium falciparum
IPSNKKKS

SEQ ID NO: 3223845 - protein, 61 aa, Plasmodium falciparum
IPSNNNNNNNNNNNNNNNNNNNNNNNSSNNNSSSNNNNSSSNNNNSSNNNNNNAKAANPME

SEQ ID NO: 3223846 - protein, 7 aa, Plasmodium falciparum
IPSNNQQ

SEQ ID NO: 3223847 - protein, 9 aa, Plasmodium falciparum
IPSSRNISS

SEQ ID NO: 3223848 - protein, 7 aa, Plasmodium falciparum
IPSTAYS

SEQ ID NO: 3223849 - protein, 4 aa, Plasmodium falciparum
IPSY

SEQ ID NO: 3223850 - protein, 14 aa, Plasmodium falciparum
IPTKGYNTERGRGH

SEQ ID NO: 3223851 - protein, 6 aa, Plasmodium falciparum
IPTNTS

SEQ ID NO: 3223852 - protein, 45 aa, Plasmodium falciparum
IPTQGDKNETDEGNKNETDEGDKNETDEGDKNETDEGNKNETEEI

SEQ ID NO: 3223853 - protein, 7 aa, Plasmodium falciparum
IPTSAEK

SEQ ID NO: 3223854 - protein, 5 aa, Plasmodium falciparum
IPTSP

SEQ ID NO: 3223855 - protein, 12 aa, Plasmodium falciparum
IPTTKETVDEDA

SEQ ID NO: 3223856 - protein, 9 aa, Plasmodium falciparum
IPVTDENKH

SEQ ID NO: 3223857 - protein, 4 aa, Plasmodium falciparum
IPYD

SEQ ID NO: 3223858 - protein, 11 aa, Plasmodium falciparum
IPYKSSTNRYV

SEQ ID NO: 3223859 - protein, 24 aa, Plasmodium falciparum
IPYSPNNNMKKKKKKKKKNLKEKL

SEQ ID NO: 3223860 - protein, 14 aa, Plasmodium falciparum
IPYTNENNKSLSES

SEQ ID NO: 3223861 - protein, 16 aa, Plasmodium falciparum
IQDDEEEDNETIRSDS

SEQ ID NO: 3223862 - protein, 18 aa, Plasmodium falciparum
IQDDNTANTNIADETIPD

SEQ ID NO: 3223863 - protein, 6 aa, Plasmodium falciparum
IQDNIN

SEQ ID NO: 3223864 - protein, 5 aa, Plasmodium falciparum
IQDQT

SEQ ID NO: 3223865 - protein, 4 aa, Plasmodium falciparum
IQDT

SEQ ID NO: 3223866 - protein, 5 aa, Plasmodium falciparum
IQDTI

SEQ ID NO: 3223867 - protein, 11 aa, Plasmodium falciparum
IQEERKKYTSN

SEQ ID NO: 3223868 - protein, 28 aa, Plasmodium falciparum
IQEKDPNNRNYNTQGNNVQTMNQSNGNV

SEQ ID NO: 3223869 - protein, 32 aa, Plasmodium falciparum
IQEKKQYKRNIREQKKKNEKEKNMNNSVKTKP

SEQ ID NO: 3223870 - protein, 9 aa, Plasmodium falciparum
IQEKQDNND

SEQ ID NO: 3223871 - protein, 15 aa, Plasmodium falciparum
IQEKRQKRKEERDKN

SEQ ID NO: 3223872 - protein, 11 aa, Plasmodium falciparum
IQEKYDDNNKH

SEQ ID NO: 3223873 - protein, 18 aa, Plasmodium falciparum
IQENNETKTDDDQPIGEN

SEQ ID NO: 3223874 - protein, 6 aa, Plasmodium falciparum
IQENNN

SEQ ID NO: 3223875 - protein, 7 aa, Plasmodium falciparum
IQENSDR

SEQ ID NO: 3223876 - protein, 5 aa, Plasmodium falciparum
IQEQE

SEQ ID NO: 3223877 - protein, 7 aa, Plasmodium falciparum
IQEQKAI

SEQ ID NO: 3223878 - protein, 8 aa, Plasmodium falciparum
IQETGSKM

SEQ ID NO: 3223879 - protein, 11 aa, Plasmodium falciparum
IQGDENEKIKE

SEQ ID NO: 3223880 - protein, 5 aa, Plasmodium falciparum
IQGNT

SEQ ID NO: 3223881 - protein, 6 aa, Plasmodium falciparum
IQHGED

SEQ ID NO: 3223882 - protein, 8 aa, Plasmodium falciparum
IQKGQQKK

SEQ ID NO: 3223883 - protein, 11 aa, Plasmodium falciparum
IQKKDTCTQNN

SEQ ID NO: 3223884 - protein, 6 aa, Plasmodium falciparum
IQKKEK

SEQ ID NO: 3223885 - protein, 16 aa, Plasmodium falciparum
IQKKNYKSNDGDNNNI

SEQ ID NO: 3223886 - protein, 5 aa, Plasmodium falciparum
IQKKT

SEQ ID NO: 3223887 - protein, 4 aa, Plasmodium falciparum
IQKN

SEQ ID NO: 3223888 - protein, 5 aa, Plasmodium falciparum
IQKND

SEQ ID NO: 3223889 - protein, 8 aa, Plasmodium falciparum
IQKNEPLE

SEQ ID NO: 3223890 - protein, 5 aa, Plasmodium falciparum
IQKNN

SEQ ID NO: 3223891 - protein, 8 aa, Plasmodium falciparum
IQKNSGKW

SEQ ID NO: 3223892 - protein, 10 aa, Plasmodium falciparum
IQKNTDDKID

SEQ ID NO: 3223893 - protein, 10 aa, Plasmodium falciparum
IQKSNSVNTN

SEQ ID NO: 3223894 - protein, 7 aa, Plasmodium falciparum
IQKSSEL

SEQ ID NO: 3223895 - protein, 5 aa, Plasmodium falciparum
IQKYK

SEQ ID NO: 3223896 - protein, 22 aa, Plasmodium falciparum
IQNANNKKLDNQNVNNETTQNI

SEQ ID NO: 3223897 - protein, 11 aa, Plasmodium falciparum
IQNDATNSDTY

SEQ ID NO: 3223898 - protein, 6 aa, Plasmodium falciparum
IQNDEN

SEQ ID NO: 3223899 - protein, 17 aa, Plasmodium falciparum
IQNDYDEKNGDDNHTYN

SEQ ID NO: 3223900 - protein, 12 aa, Plasmodium falciparum
IQNEEDRNKYSN

SEQ ID NO: 3223901 - protein, 26 aa, Plasmodium falciparum
IQNEGEEDDDDDEDDEDDEDGEDGKG

SEQ ID NO: 3223902 - protein, 25 aa, Plasmodium falciparum
IQNENKRKVEDIKTKEGDLKYKEEE

SEQ ID NO: 3223903 - protein, 11 aa, Plasmodium falciparum
IQNENNKKKMG

SEQ ID NO: 3223904 - protein, 10 aa, Plasmodium falciparum
IQNETNDESM

SEQ ID NO: 3223905 - protein, 4 aa, Plasmodium falciparum
IQNH

SEQ ID NO: 3223906 - protein, 6 aa, Plasmodium falciparum
IQNKEN

SEQ ID NO: 3223907 - protein, 23 aa, Plasmodium falciparum
IQNKKKELPKSVHSTKNINNNIK

SEQ ID NO: 3223908 - protein, 4 aa, Plasmodium falciparum
IQNN

SEQ ID NO: 3223909 - protein, 39 aa, Plasmodium falciparum
IQNNATNTEPKEEQNTTETKQNDKENNTNSNTRRKPTKL

SEQ ID NO: 3223910 - protein, 10 aa, Plasmodium falciparum
IQNNDSSINY

SEQ ID NO: 3223911 - protein, 8 aa, Plasmodium falciparum
IQNNEESP

SEQ ID NO: 3223912 - protein, 12 aa, Plasmodium falciparum
IQNNEYSEQNNN

SEQ ID NO: 3223913 - protein, 10 aa, Plasmodium falciparum
IQNNNDIKNS

SEQ ID NO: 3223914 - protein, 17 aa, Plasmodium falciparum
IQNNNNNNNNNNNNNNT

SEQ ID NO: 3223915 - protein, 12 aa, Plasmodium falciparum
IQNNSLNNKNKN

SEQ ID NO: 3223916 - protein, 8 aa, Plasmodium falciparum
IQNNSNDY

SEQ ID NO: 3223917 - protein, 7 aa, Plasmodium falciparum
IQNNSYG

SEQ ID NO: 3223918 - protein, 29 aa, Plasmodium falciparum
IQNNTQNNTQNNTQNNTQNNTQNNTQGNI

SEQ ID NO: 3223919 - protein, 298 aa, Plasmodium falciparum
IQNQDREKDDQNERQKRERKEMEEREERERNERKKREEHERNEREKQENKERKEREKQERKEREERENKERKEREKQERKEREEREKKERKEREEREKKERKKREEREKKECEQREKRLKKEKQKRDKEERKERERRERQLKKEREKQEKRESKQREKQEKQERQKREKEERKERKQRDKREKKEKEEREKREKKEKEEREKREKKEKEEREKREKKEKEEREKREKKEKEEREKREKKEKEEREKREKKEKEEREKREKKEKEERDKREKKEKEEREKQEKKEKEEREKQEKMKMEN

SEQ ID NO: 3223920 - protein, 5 aa, Plasmodium falciparum
IQNVS

SEQ ID NO: 3223921 - protein, 10 aa, Plasmodium falciparum
IQNYSKKKKI

SEQ ID NO: 3223922 - protein, 7 aa, Plasmodium falciparum
IQPITSS

SEQ ID NO: 3223923 - protein, 15 aa, Plasmodium falciparum
IQPNNLEKKNASSNI

SEQ ID NO: 3223924 - protein, 6 aa, Plasmodium falciparum
IQPNNP

SEQ ID NO: 3223925 - protein, 7 aa, Plasmodium falciparum
IQPSQQY

SEQ ID NO: 3223926 - protein, 21 aa, Plasmodium falciparum
IQQEKEKLGTRGDKSKGSKII

SEQ ID NO: 3223927 - protein, 10 aa, Plasmodium falciparum
IQQNEDPCYN

SEQ ID NO: 3223928 - protein, 7 aa, Plasmodium falciparum
IQQPERK

SEQ ID NO: 3223929 - protein, 11 aa, Plasmodium falciparum
IQQYTNDDNTT

SEQ ID NO: 3223930 - protein, 8 aa, Plasmodium falciparum
IQRKGRAG

SEQ ID NO: 3223931 - protein, 15 aa, Plasmodium falciparum
IQSAKSSDYLEYHVD

SEQ ID NO: 3223932 - protein, 4 aa, Plasmodium falciparum
IQSD

SEQ ID NO: 3223933 - protein, 5 aa, Plasmodium falciparum
IQSDA

SEQ ID NO: 3223934 - protein, 5 aa, Plasmodium falciparum
IQSDD

SEQ ID NO: 3223935 - protein, 16 aa, Plasmodium falciparum
IQSDGIPSSKITDNEW

SEQ ID NO: 3223936 - protein, 5 aa, Plasmodium falciparum
IQSDS

SEQ ID NO: 3223937 - protein, 5 aa, Plasmodium falciparum
IQSKH

SEQ ID NO: 3223938 - protein, 9 aa, Plasmodium falciparum
IQSLNTEQK

SEQ ID NO: 3223939 - protein, 6 aa, Plasmodium falciparum
IQSNDE

SEQ ID NO: 3223940 - protein, 19 aa, Plasmodium falciparum
IQSQTNTYMNDPKKKNDLQ

SEQ ID NO: 3223941 - protein, 10 aa, Plasmodium falciparum
IQSSSYKKDS

SEQ ID NO: 3223942 - protein, 16 aa, Plasmodium falciparum
IQTEKAKEQNIKEPYE

SEQ ID NO: 3223943 - protein, 85 aa, Plasmodium falciparum
IQTEKGKKKKKNLHDNKKGSKGIRDNKKGNKGIRDNKKGNKRIRDNKKGNRRIRDNKKGNRRIRDNKKGNRRIRDNNIDNNNNID

SEQ ID NO: 3223944 - protein, 4 aa, Plasmodium falciparum
IQTK

SEQ ID NO: 3223945 - protein, 6 aa, Plasmodium falciparum
IQTNLG

SEQ ID NO: 3223946 - protein, 11 aa, Plasmodium falciparum
IQTQNNKDYKN

SEQ ID NO: 3223947 - protein, 6 aa, Plasmodium falciparum
IQVNPN

SEQ ID NO: 3223948 - protein, 11 aa, Plasmodium falciparum
IQVQNQQNTNY

SEQ ID NO: 3223949 - protein, 10 aa, Plasmodium falciparum
IQYDQNNTQH

SEQ ID NO: 3223950 - protein, 4 aa, Plasmodium falciparum
IRAQ

SEQ ID NO: 3223951 - protein, 5 aa, Plasmodium falciparum
IRCQE

SEQ ID NO: 3223952 - protein, 6 aa, Plasmodium falciparum
IRDDNI

SEQ ID NO: 3223953 - protein, 4 aa, Plasmodium falciparum
IRDN

SEQ ID NO: 3223954 - protein, 8 aa, Plasmodium falciparum
IRDSNTKT

SEQ ID NO: 3223955 - protein, 4 aa, Plasmodium falciparum
IREE

SEQ ID NO: 3223956 - protein, 9 aa, Plasmodium falciparum
IREEKEQQE

SEQ ID NO: 3223957 - protein, 11 aa, Plasmodium falciparum
IREKKKNNKEV

SEQ ID NO: 3223958 - protein, 8 aa, Plasmodium falciparum
IREKTNDI

SEQ ID NO: 3223959 - protein, 5 aa, Plasmodium falciparum
IREPN

SEQ ID NO: 3223960 - protein, 25 aa, Plasmodium falciparum
IRGEEGNERKVKEEDNNIKEEGNSF

SEQ ID NO: 3223961 - protein, 17 aa, Plasmodium falciparum
IRGGEKKKGRTKKEYGG

SEQ ID NO: 3223962 - protein, 4 aa, Plasmodium falciparum
IRGP

SEQ ID NO: 3223963 - protein, 20 aa, Plasmodium falciparum
IRKEREKKSDNSLKGNGTDI

SEQ ID NO: 3223964 - protein, 12 aa, Plasmodium falciparum
IRKGNSSEVSSK

SEQ ID NO: 3223965 - protein, 7 aa, Plasmodium falciparum
IRKGNTN

SEQ ID NO: 3223966 - protein, 10 aa, Plasmodium falciparum
IRKKKKKNHD

SEQ ID NO: 3223967 - protein, 10 aa, Plasmodium falciparum
IRKKSKKYGN

SEQ ID NO: 3223968 - protein, 5 aa, Plasmodium falciparum
IRKKT

SEQ ID NO: 3223969 - protein, 4 aa, Plasmodium falciparum
IRKN

SEQ ID NO: 3223970 - protein, 5 aa, Plasmodium falciparum
IRKTT

SEQ ID NO: 3223971 - protein, 64 aa, Plasmodium falciparum
IRNEDMDNNKNNSNNNKNNNNKNNSNNNDNNNNKQSNYHNSHDGIKKGVGYKNNSSSNTNDNKI

SEQ ID NO: 3223972 - protein, 11 aa, Plasmodium falciparum
IRNEKKDKENI

SEQ ID NO: 3223973 - protein, 5 aa, Plasmodium falciparum
IRNGN

SEQ ID NO: 3223974 - protein, 10 aa, Plasmodium falciparum
IRNNNEDKIN

SEQ ID NO: 3223975 - protein, 9 aa, Plasmodium falciparum
IRNNQNKSD

SEQ ID NO: 3223976 - protein, 26 aa, Plasmodium falciparum
IRNSEYEKNKINGKYKNYDNIDTNHS

SEQ ID NO: 3223977 - protein, 20 aa, Plasmodium falciparum
IRNSNNNNNNNNNNNSSSNN

SEQ ID NO: 3223978 - protein, 6 aa, Plasmodium falciparum
IRNTDY

SEQ ID NO: 3223979 - protein, 6 aa, Plasmodium falciparum
IRNTQD

SEQ ID NO: 3223980 - protein, 10 aa, Plasmodium falciparum
IRPKEKKDKL

SEQ ID NO: 3223981 - protein, 19 aa, Plasmodium falciparum
IRPNEKKEKSFGIKNNGKD

SEQ ID NO: 3223982 - protein, 8 aa, Plasmodium falciparum
IRQGNSQR

SEQ ID NO: 3223983 - protein, 7 aa, Plasmodium falciparum
IRREEKE

SEQ ID NO: 3223984 - protein, 8 aa, Plasmodium falciparum
IRRKEEHK

SEQ ID NO: 3223985 - protein, 12 aa, Plasmodium falciparum
IRRKKDNKNNVH

SEQ ID NO: 3223986 - protein, 55 aa, Plasmodium falciparum
IRRKKKKKKKKPRIKSQPPKKSADGDNEDDEDNEDDEDDEDGEDVNHEGDDINSK

SEQ ID NO: 3223987 - protein, 14 aa, Plasmodium falciparum
IRRSSTLSQGNYSN

SEQ ID NO: 3223988 - protein, 4 aa, Plasmodium falciparum
IRSD

SEQ ID NO: 3223989 - protein, 21 aa, Plasmodium falciparum
IRSDDECDADSHNEGDNIEDA

SEQ ID NO: 3223990 - protein, 16 aa, Plasmodium falciparum
IRTKGNDNIYKQRSNH

SEQ ID NO: 3223991 - protein, 12 aa, Plasmodium falciparum
IRTKNKEKINQG

SEQ ID NO: 3223992 - protein, 6 aa, Plasmodium falciparum
IRTNNQ

SEQ ID NO: 3223993 - protein, 9 aa, Plasmodium falciparum
IRTTNKGEE

SEQ ID NO: 3223994 - protein, 4 aa, Plasmodium falciparum
IRYN

SEQ ID NO: 3223995 - protein, 8 aa, Plasmodium falciparum
ISAKKDPI

SEQ ID NO: 3223996 - protein, 10 aa, Plasmodium falciparum
ISAKKKKNKI

SEQ ID NO: 3223997 - protein, 17 aa, Plasmodium falciparum
ISANDQKKNNKNSSNIH

SEQ ID NO: 3223998 - protein, 4 aa, Plasmodium falciparum
ISCD

SEQ ID NO: 3223999 - protein, 52 aa, Plasmodium falciparum
ISCGGTPKEPGEKKVRRRRRRTKKNATGDTNITGDDNKEDINNKEEGVEPGA

SEQ ID NO: 3224000 - protein, 11 aa, Plasmodium falciparum
ISDAKNKKMNK

SEQ ID NO: 3224001 - protein, 4 aa, Plasmodium falciparum
ISDD

SEQ ID NO: 3224002 - protein, 13 aa, Plasmodium falciparum
ISDDINDAKQKNM

SEQ ID NO: 3224003 - protein, 10 aa, Plasmodium falciparum
ISDDNNNNNN

SEQ ID NO: 3224004 - protein, 6 aa, Plasmodium falciparum
ISDDQK

SEQ ID NO: 3224005 - protein, 24 aa, Plasmodium falciparum
ISDDRNEYKSKNNNNSNNSDNNKA

SEQ ID NO: 3224006 - protein, 8 aa, Plasmodium falciparum
ISDEANNE

SEQ ID NO: 3224007 - protein, 16 aa, Plasmodium falciparum
ISDEEKSSSSNDEFSS

SEQ ID NO: 3224008 - protein, 13 aa, Plasmodium falciparum
ISDEENPNHPNLK

SEQ ID NO: 3224009 - protein, 11 aa, Plasmodium falciparum
ISDEQDGEDTL

SEQ ID NO: 3224010 - protein, 4 aa, Plasmodium falciparum
ISDN

SEQ ID NO: 3224011 - protein, 7 aa, Plasmodium falciparum
ISDNKDN

SEQ ID NO: 3224012 - protein, 17 aa, Plasmodium falciparum
ISDNKYEEDFSKYTSNN

SEQ ID NO: 3224013 - protein, 9 aa, Plasmodium falciparum
ISDNQVTSN

SEQ ID NO: 3224014 - protein, 6 aa, Plasmodium falciparum
ISDNSL

SEQ ID NO: 3224015 - protein, 6 aa, Plasmodium falciparum
ISDSDN

SEQ ID NO: 3224016 - protein, 31 aa, Plasmodium falciparum
ISDSEKKKRDSAEVPSNNVDDINNNNSSSYY

SEQ ID NO: 3224017 - protein, 26 aa, Plasmodium falciparum
ISDSSSDKSDGNHSNNSDHSTSDNET

SEQ ID NO: 3224018 - protein, 6 aa, Plasmodium falciparum
ISDSTS

SEQ ID NO: 3224019 - protein, 10 aa, Plasmodium falciparum
ISEDGSPNED

SEQ ID NO: 3224020 - protein, 4 aa, Plasmodium falciparum
ISEE

SEQ ID NO: 3224021 - protein, 23 aa, Plasmodium falciparum
ISEEDNKKENNNNNDDEVKPELK

SEQ ID NO: 3224022 - protein, 12 aa, Plasmodium falciparum
ISEEDTSESENE

SEQ ID NO: 3224023 - protein, 22 aa, Plasmodium falciparum
ISEEKEKHNQHIKNSNTKDEKE

SEQ ID NO: 3224024 - protein, 6 aa, Plasmodium falciparum
ISEEKR

SEQ ID NO: 3224025 - protein, 6 aa, Plasmodium falciparum
ISEGTA

SEQ ID NO: 3224026 - protein, 13 aa, Plasmodium falciparum
ISEIKDNAEGNHV

SEQ ID NO: 3224027 - protein, 48 aa, Plasmodium falciparum
ISEKKEDQIEKDKPKNDNTKNDNTKEDKNQNDDNKTNTSIPKTPKNEV

SEQ ID NO: 3224028 - protein, 8 aa, Plasmodium falciparum
ISENEDYE

SEQ ID NO: 3224029 - protein, 7 aa, Plasmodium falciparum
ISENPMP

SEQ ID NO: 3224030 - protein, 4 aa, Plasmodium falciparum
ISEQ

SEQ ID NO: 3224031 - protein, 30 aa, Plasmodium falciparum
ISEQEKKKKNDNKNKEINKSNNNNNNNNNL

SEQ ID NO: 3224032 - protein, 13 aa, Plasmodium falciparum
ISEQNTKDNNLNT

SEQ ID NO: 3224033 - protein, 8 aa, Plasmodium falciparum
ISERMNRK

SEQ ID NO: 3224034 - protein, 15 aa, Plasmodium falciparum
ISESNSGNKKKPNTL

SEQ ID NO: 3224035 - protein, 10 aa, Plasmodium falciparum
ISESSSDPTT

SEQ ID NO: 3224036 - protein, 5 aa, Plasmodium falciparum
ISETE

SEQ ID NO: 3224037 - protein, 6 aa, Plasmodium falciparum
ISETKK

SEQ ID NO: 3224038 - protein, 5 aa, Plasmodium falciparum
ISETN

SEQ ID NO: 3224039 - protein, 11 aa, Plasmodium falciparum
ISFSDKDTTDI

SEQ ID NO: 3224040 - protein, 5 aa, Plasmodium falciparum
ISGDE

SEQ ID NO: 3224041 - protein, 10 aa, Plasmodium falciparum
ISGDKNMDTI

SEQ ID NO: 3224042 - protein, 8 aa, Plasmodium falciparum
ISGDNNNK

SEQ ID NO: 3224043 - protein, 12 aa, Plasmodium falciparum
ISGDNNNNNNNT

SEQ ID NO: 3224044 - protein, 8 aa, Plasmodium falciparum
ISGDSKNY

SEQ ID NO: 3224045 - protein, 6 aa, Plasmodium falciparum
ISGEDR

SEQ ID NO: 3224046 - protein, 10 aa, Plasmodium falciparum
ISGGNGVSPE

SEQ ID NO: 3224047 - protein, 5 aa, Plasmodium falciparum
ISGHY

SEQ ID NO: 3224048 - protein, 5 aa, Plasmodium falciparum
ISGIP

SEQ ID NO: 3224049 - protein, 7 aa, Plasmodium falciparum
ISGKNTV

SEQ ID NO: 3224050 - protein, 4 aa, Plasmodium falciparum
ISGL

SEQ ID NO: 3224051 - protein, 11 aa, Plasmodium falciparum
ISGNGGKSSTI

SEQ ID NO: 3224052 - protein, 5 aa, Plasmodium falciparum
ISGNS

SEQ ID NO: 3224053 - protein, 5 aa, Plasmodium falciparum
ISHGS

SEQ ID NO: 3224054 - protein, 12 aa, Plasmodium falciparum
ISHRNDRMGNEN

SEQ ID NO: 3224055 - protein, 24 aa, Plasmodium falciparum
ISHRNNRSNIKNGLNNEDRQNKRH

SEQ ID NO: 3224056 - protein, 19 aa, Plasmodium falciparum
ISHTTKQNKDEKKKSKNIF

SEQ ID NO: 3224057 - protein, 10 aa, Plasmodium falciparum
ISIGKDNKQY

SEQ ID NO: 3224058 - protein, 12 aa, Plasmodium falciparum
ISINDTDQRNIE

SEQ ID NO: 3224059 - protein, 6 aa, Plasmodium falciparum
ISISSD

SEQ ID NO: 3224060 - protein, 72 aa, Plasmodium falciparum
ISKCSRKKMRSKNAKTKMKPKNAKTKMKPKNSKTKMRSKNSKTTMRSKNSKTTVRPKNEPKDEEKKKKRRLS

SEQ ID NO: 3224061 - protein, 10 aa, Plasmodium falciparum
ISKDNTSKKK

SEQ ID NO: 3224062 - protein, 4 aa, Plasmodium falciparum
ISKE

SEQ ID NO: 3224063 - protein, 8 aa, Plasmodium falciparum
ISKEENQK

SEQ ID NO: 3224064 - protein, 9 aa, Plasmodium falciparum
ISKEKKEEN

SEQ ID NO: 3224065 - protein, 13 aa, Plasmodium falciparum
ISKEKRKKEINDK

SEQ ID NO: 3224066 - protein, 5 aa, Plasmodium falciparum
ISKEN

SEQ ID NO: 3224067 - protein, 80 aa, Plasmodium falciparum
ISKENNEHNKNEHNKSEHNKNEHNINEHNKNEHNKSEHNINEHNKNEHNKSEHNKNEHNKNEHNKKDELNKCDDNSNNIL

SEQ ID NO: 3224068 - protein, 16 aa, Plasmodium falciparum
ISKENYEKYGNPDGPG

SEQ ID NO: 3224069 - protein, 4 aa, Plasmodium falciparum
ISKI

SEQ ID NO: 3224070 - protein, 10 aa, Plasmodium falciparum
ISKKGNEKMK

SEQ ID NO: 3224071 - protein, 6 aa, Plasmodium falciparum
ISKKKK

SEQ ID NO: 3224072 - protein, 20 aa, Plasmodium falciparum
ISKKKKTKQMDDYSKNKLKR

SEQ ID NO: 3224073 - protein, 9 aa, Plasmodium falciparum
ISKKSANIN

SEQ ID NO: 3224074 - protein, 5 aa, Plasmodium falciparum
ISKNE

SEQ ID NO: 3224075 - protein, 8 aa, Plasmodium falciparum
ISKNNTLK

SEQ ID NO: 3224076 - protein, 5 aa, Plasmodium falciparum
ISKNT

SEQ ID NO: 3224077 - protein, 18 aa, Plasmodium falciparum
ISKQTNISNNNHKKYDTF

SEQ ID NO: 3224078 - protein, 8 aa, Plasmodium falciparum
ISKREKKK

SEQ ID NO: 3224079 - protein, 7 aa, Plasmodium falciparum
ISKRNKD

SEQ ID NO: 3224080 - protein, 8 aa, Plasmodium falciparum
ISKSGVRT

SEQ ID NO: 3224081 - protein, 5 aa, Plasmodium falciparum
ISKSK

SEQ ID NO: 3224082 - protein, 7 aa, Plasmodium falciparum
ISKSKKK

SEQ ID NO: 3224083 - protein, 13 aa, Plasmodium falciparum
ISKSKKNVKKKRG

SEQ ID NO: 3224084 - protein, 7 aa, Plasmodium falciparum
ISKSRLS

SEQ ID NO: 3224085 - protein, 5 aa, Plasmodium falciparum
ISLNE

SEQ ID NO: 3224086 - protein, 47 aa, Plasmodium falciparum
ISLPSDDDNCDDNYSDENYSDDNCDDNYSDENYSDENYSDDNYSDEI

SEQ ID NO: 3224087 - protein, 10 aa, Plasmodium falciparum
ISNANNNSVI

SEQ ID NO: 3224088 - protein, 4 aa, Plasmodium falciparum
ISND

SEQ ID NO: 3224089 - protein, 28 aa, Plasmodium falciparum
ISNDKKDIKCNNQNGNKETDSMTTKKSL

SEQ ID NO: 3224090 - protein, 6 aa, Plasmodium falciparum
ISNDKN

SEQ ID NO: 3224091 - protein, 9 aa, Plasmodium falciparum
ISNDLGTPC

SEQ ID NO: 3224092 - protein, 7 aa, Plasmodium falciparum
ISNDPRG

SEQ ID NO: 3224093 - protein, 10 aa, Plasmodium falciparum
ISNDTQKKKK

SEQ ID NO: 3224094 - protein, 5 aa, Plasmodium falciparum
ISNED

SEQ ID NO: 3224095 - protein, 8 aa, Plasmodium falciparum
ISNEGSDS

SEQ ID NO: 3224096 - protein, 28 aa, Plasmodium falciparum
ISNENKKKYTTKKNNNLNNNNNNNNNNY

SEQ ID NO: 3224097 - protein, 6 aa, Plasmodium falciparum
ISNENS

SEQ ID NO: 3224098 - protein, 5 aa, Plasmodium falciparum
ISNEQ

SEQ ID NO: 3224099 - protein, 6 aa, Plasmodium falciparum
ISNESI

SEQ ID NO: 3224100 - protein, 9 aa, Plasmodium falciparum
ISNESNNRV

SEQ ID NO: 3224101 - protein, 18 aa, Plasmodium falciparum
ISNETNNNNSFNSMNQNN

SEQ ID NO: 3224102 - protein, 9 aa, Plasmodium falciparum
ISNHDEPYN

SEQ ID NO: 3224103 - protein, 8 aa, Plasmodium falciparum
ISNHEPQT

SEQ ID NO: 3224104 - protein, 34 aa, Plasmodium falciparum
ISNHNNNNNNSNNNNNSNNSNNNNNSNNSNNSNR

SEQ ID NO: 3224105 - protein, 16 aa, Plasmodium falciparum
ISNITSSDSESKSFTQ

SEQ ID NO: 3224106 - protein, 9 aa, Plasmodium falciparum
ISNKDMKNK

SEQ ID NO: 3224107 - protein, 10 aa, Plasmodium falciparum
ISNKDSSLDY

SEQ ID NO: 3224108 - protein, 9 aa, Plasmodium falciparum
ISNKGSKSH

SEQ ID NO: 3224109 - protein, 9 aa, Plasmodium falciparum
ISNKKKKNI

SEQ ID NO: 3224110 - protein, 8 aa, Plasmodium falciparum
ISNKQRHK

SEQ ID NO: 3224111 - protein, 6 aa, Plasmodium falciparum
ISNMKR

SEQ ID NO: 3224112 - protein, 4 aa, Plasmodium falciparum
ISNN

SEQ ID NO: 3224113 - protein, 10 aa, Plasmodium falciparum
ISNNAKDRKM

SEQ ID NO: 3224114 - protein, 30 aa, Plasmodium falciparum
ISNNKPNNKNPNDKRDIKHNNNNNNNKMKK

SEQ ID NO: 3224115 - protein, 6 aa, Plasmodium falciparum
ISNNNK

SEQ ID NO: 3224116 - protein, 14 aa, Plasmodium falciparum
ISNNNKTTQNNTIN

SEQ ID NO: 3224117 - protein, 23 aa, Plasmodium falciparum
ISNNNKYKSEEGNVDNKKENMDD

SEQ ID NO: 3224118 - protein, 10 aa, Plasmodium falciparum
ISNNNNDNVI

SEQ ID NO: 3224119 - protein, 7 aa, Plasmodium falciparum
ISNNNNN

SEQ ID NO: 3224120 - protein, 16 aa, Plasmodium falciparum
ISNNNNNDYNSDKQSI

SEQ ID NO: 3224121 - protein, 16 aa, Plasmodium falciparum
ISNNNNNNNNNNNDPL

SEQ ID NO: 3224122 - protein, 18 aa, Plasmodium falciparum
ISNNNNNNNNRNPNGSVR

SEQ ID NO: 3224123 - protein, 29 aa, Plasmodium falciparum
ISNNNNSNNITYDDDPNNNNNNNNNNNYN

SEQ ID NO: 3224124 - protein, 10 aa, Plasmodium falciparum
ISNNNTKENK

SEQ ID NO: 3224125 - protein, 11 aa, Plasmodium falciparum
ISNNSDGKAYV

SEQ ID NO: 3224126 - protein, 10 aa, Plasmodium falciparum
ISNNSNATPK

SEQ ID NO: 3224127 - protein, 8 aa, Plasmodium falciparum
ISNPLNKQ

SEQ ID NO: 3224128 - protein, 12 aa, Plasmodium falciparum
ISNPPPKNVQKQ

SEQ ID NO: 3224129 - protein, 8 aa, Plasmodium falciparum
ISNQKKNP

SEQ ID NO: 3224130 - protein, 7 aa, Plasmodium falciparum
ISNSNDN

SEQ ID NO: 3224131 - protein, 5 aa, Plasmodium falciparum
ISNTE

SEQ ID NO: 3224132 - protein, 6 aa, Plasmodium falciparum
ISNTLR

SEQ ID NO: 3224133 - protein, 20 aa, Plasmodium falciparum
ISNTLSKDEKEKKEKKYAYS

SEQ ID NO: 3224134 - protein, 16 aa, Plasmodium falciparum
ISNTQNFNNTNESLNY

SEQ ID NO: 3224135 - protein, 13 aa, Plasmodium falciparum
ISNTSHKNNTPID

SEQ ID NO: 3224136 - protein, 10 aa, Plasmodium falciparum
ISNVKDKNDK

SEQ ID NO: 3224137 - protein, 10 aa, Plasmodium falciparum
ISPDKKDFNC

SEQ ID NO: 3224138 - protein, 5 aa, Plasmodium falciparum
ISPFS

SEQ ID NO: 3224139 - protein, 7 aa, Plasmodium falciparum
ISPLKKK

SEQ ID NO: 3224140 - protein, 21 aa, Plasmodium falciparum
ISPLTSTKNHCGHKDDPPDYD

SEQ ID NO: 3224141 - protein, 21 aa, Plasmodium falciparum
ISPNNNNNNKYNQQHNNNSHS

SEQ ID NO: 3224142 - protein, 8 aa, Plasmodium falciparum
ISPPDNMN

SEQ ID NO: 3224143 - protein, 20 aa, Plasmodium falciparum
ISPPPTGINYSSERNKNPLN

SEQ ID NO: 3224144 - protein, 5 aa, Plasmodium falciparum
ISPSH

SEQ ID NO: 3224145 - protein, 9 aa, Plasmodium falciparum
ISPSPSPMK

SEQ ID NO: 3224146 - protein, 10 aa, Plasmodium falciparum
ISPTKTFPER

SEQ ID NO: 3224147 - protein, 6 aa, Plasmodium falciparum
ISPYNE

SEQ ID NO: 3224148 - protein, 5 aa, Plasmodium falciparum
ISQAI

SEQ ID NO: 3224149 - protein, 8 aa, Plasmodium falciparum
ISQEKKKN

SEQ ID NO: 3224150 - protein, 11 aa, Plasmodium falciparum
ISQEVQAKSNL

SEQ ID NO: 3224151 - protein, 4 aa, Plasmodium falciparum
ISQG

SEQ ID NO: 3224152 - protein, 8 aa, Plasmodium falciparum
ISQGNSNN

SEQ ID NO: 3224153 - protein, 6 aa, Plasmodium falciparum
ISQGTY

SEQ ID NO: 3224154 - protein, 10 aa, Plasmodium falciparum
ISQKKEGEDY

SEQ ID NO: 3224155 - protein, 10 aa, Plasmodium falciparum
ISQNGNQSFT

SEQ ID NO: 3224156 - protein, 7 aa, Plasmodium falciparum
ISQNKSY

SEQ ID NO: 3224157 - protein, 10 aa, Plasmodium falciparum
ISQNYTNRKR

SEQ ID NO: 3224158 - protein, 27 aa, Plasmodium falciparum
ISQQNYNQENQEKSKMIDSENEKLEKY

SEQ ID NO: 3224159 - protein, 11 aa, Plasmodium falciparum
ISQRRGEDDDI

SEQ ID NO: 3224160 - protein, 6 aa, Plasmodium falciparum
ISQTSY

SEQ ID NO: 3224161 - protein, 6 aa, Plasmodium falciparum
ISREEV

SEQ ID NO: 3224162 - protein, 7 aa, Plasmodium falciparum
ISRKRRS

SEQ ID NO: 3224163 - protein, 7 aa, Plasmodium falciparum
ISRKTKN

SEQ ID NO: 3224164 - protein, 5 aa, Plasmodium falciparum
ISRNP

SEQ ID NO: 3224165 - protein, 10 aa, Plasmodium falciparum
ISRRKSDEFI

SEQ ID NO: 3224166 - protein, 4 aa, Plasmodium falciparum
ISRS

SEQ ID NO: 3224167 - protein, 13 aa, Plasmodium falciparum
ISRYEEKKNEEDI

SEQ ID NO: 3224168 - protein, 8 aa, Plasmodium falciparum
ISSAKYKK

SEQ ID NO: 3224169 - protein, 9 aa, Plasmodium falciparum
ISSARDDIQ

SEQ ID NO: 3224170 - protein, 30 aa, Plasmodium falciparum
ISSDDHKNYDNKSDMITSDNSTSSNNKTKK

SEQ ID NO: 3224171 - protein, 9 aa, Plasmodium falciparum
ISSDDSDEE

SEQ ID NO: 3224172 - protein, 15 aa, Plasmodium falciparum
ISSDKEYNKINDTNQ

SEQ ID NO: 3224173 - protein, 5 aa, Plasmodium falciparum
ISSDM

SEQ ID NO: 3224174 - protein, 5 aa, Plasmodium falciparum
ISSDN

SEQ ID NO: 3224175 - protein, 10 aa, Plasmodium falciparum
ISSDNNNNIN

SEQ ID NO: 3224176 - protein, 15 aa, Plasmodium falciparum
ISSDTKDDLKKKSRF

SEQ ID NO: 3224177 - protein, 16 aa, Plasmodium falciparum
ISSEKKNISNDGEKKN

SEQ ID NO: 3224178 - protein, 8 aa, Plasmodium falciparum
ISSEKRKK

SEQ ID NO: 3224179 - protein, 7 aa, Plasmodium falciparum
ISSEPEK

SEQ ID NO: 3224180 - protein, 57 aa, Plasmodium falciparum
ISSGADEQYGNKRGTQEKEEEEKKEKKEKKEEEKEEEKKEEKKEKKEQEKEKKNNKI

SEQ ID NO: 3224181 - protein, 7 aa, Plasmodium falciparum
ISSGEDC

SEQ ID NO: 3224182 - protein, 6 aa, Plasmodium falciparum
ISSGGY

SEQ ID NO: 3224183 - protein, 12 aa, Plasmodium falciparum
ISSGTCSNEERK

SEQ ID NO: 3224184 - protein, 35 aa, Plasmodium falciparum
ISSHYKKSHKNDETQNNNNNNNDNNNDNNNNNMNK

SEQ ID NO: 3224185 - protein, 4 aa, Plasmodium falciparum
ISSI

SEQ ID NO: 3224186 - protein, 5 aa, Plasmodium falciparum
ISSND

SEQ ID NO: 3224187 - protein, 10 aa, Plasmodium falciparum
ISSNDNVTMD

SEQ ID NO: 3224188 - protein, 9 aa, Plasmodium falciparum
ISSNEEEIR

SEQ ID NO: 3224189 - protein, 8 aa, Plasmodium falciparum
ISSNEQIK

SEQ ID NO: 3224190 - protein, 14 aa, Plasmodium falciparum
ISSNGSSDSNLSSD

SEQ ID NO: 3224191 - protein, 5 aa, Plasmodium falciparum
ISSNI

SEQ ID NO: 3224192 - protein, 5 aa, Plasmodium falciparum
ISSNN

SEQ ID NO: 3224193 - protein, 8 aa, Plasmodium falciparum
ISSNNISN

SEQ ID NO: 3224194 - protein, 5 aa, Plasmodium falciparum
ISSNR

SEQ ID NO: 3224195 - protein, 5 aa, Plasmodium falciparum
ISSPA

SEQ ID NO: 3224196 - protein, 18 aa, Plasmodium falciparum
ISSQGEEQIKSNESPEAI

SEQ ID NO: 3224197 - protein, 9 aa, Plasmodium falciparum
ISSRKENKY

SEQ ID NO: 3224198 - protein, 4 aa, Plasmodium falciparum
ISSS

SEQ ID NO: 3224199 - protein, 6 aa, Plasmodium falciparum
ISSSES

SEQ ID NO: 3224200 - protein, 9 aa, Plasmodium falciparum
ISSSKRNIN

SEQ ID NO: 3224201 - protein, 17 aa, Plasmodium falciparum
ISSSNTKLASRDNTYQD

SEQ ID NO: 3224202 - protein, 59 aa, Plasmodium falciparum
ISSSSDDNNVSSEKDIKRKELDAEEKINEDGDEEDDDHNDINNNNNNNNNNNSNNNNVD

SEQ ID NO: 3224203 - protein, 9 aa, Plasmodium falciparum
ISSTATDGL

SEQ ID NO: 3224204 - protein, 10 aa, Plasmodium falciparum
ISSTEGVQET

SEQ ID NO: 3224205 - protein, 6 aa, Plasmodium falciparum
ISSTND

SEQ ID NO: 3224206 - protein, 11 aa, Plasmodium falciparum
ISSTQNNAYTT

SEQ ID NO: 3224207 - protein, 37 aa, Plasmodium falciparum
ISSTSSSKTETNISNTDVSTSSKSSCKYRNKDSVNSS

SEQ ID NO: 3224208 - protein, 32 aa, Plasmodium falciparum
ISSYGNIKNTSDSHKKGSVHKSETEKKDMNPI

SEQ ID NO: 3224209 - protein, 18 aa, Plasmodium falciparum
ISSYKQKNLSQEENKNSN

SEQ ID NO: 3224210 - protein, 10 aa, Plasmodium falciparum
ISSYNNKKSK

SEQ ID NO: 3224211 - protein, 81 aa, Plasmodium falciparum
ISSYSGSNNLSSNSDSNNLLSNSDSNNLSSNSDNNNVSSNSDSNNLLSNSDSNNLLSNSDNNNVSSNSDNNNVSSNSETKI

SEQ ID NO: 3224212 - protein, 11 aa, Plasmodium falciparum
ISSYSKKHHNL

SEQ ID NO: 3224213 - protein, 4 aa, Plasmodium falciparum
ISTD

SEQ ID NO: 3224214 - protein, 5 aa, Plasmodium falciparum
ISTDD

SEQ ID NO: 3224215 - protein, 31 aa, Plasmodium falciparum
ISTDNSKTNVISTDNSKTNTISTDNDNADTI

SEQ ID NO: 3224216 - protein, 5 aa, Plasmodium falciparum
ISTDT

SEQ ID NO: 3224217 - protein, 4 aa, Plasmodium falciparum
ISTE

SEQ ID NO: 3224218 - protein, 10 aa, Plasmodium falciparum
ISTENSNGYD

SEQ ID NO: 3224219 - protein, 4 aa, Plasmodium falciparum
ISTI

SEQ ID NO: 3224220 - protein, 11 aa, Plasmodium falciparum
ISTKEDNNNYY

SEQ ID NO: 3224221 - protein, 4 aa, Plasmodium falciparum
ISTL

SEQ ID NO: 3224222 - protein, 5 aa, Plasmodium falciparum
ISTLP

SEQ ID NO: 3224223 - protein, 5 aa, Plasmodium falciparum
ISTNK

SEQ ID NO: 3224224 - protein, 18 aa, Plasmodium falciparum
ISTNKSGISKNEKKEIYN

SEQ ID NO: 3224225 - protein, 11 aa, Plasmodium falciparum
ISTNNNTLGNI

SEQ ID NO: 3224226 - protein, 27 aa, Plasmodium falciparum
ISTNNSDITKKGNDLSEMDTEDNKLKD

SEQ ID NO: 3224227 - protein, 12 aa, Plasmodium falciparum
ISTNSDTKEDDM

SEQ ID NO: 3224228 - protein, 6 aa, Plasmodium falciparum
ISTNSN

SEQ ID NO: 3224229 - protein, 10 aa, Plasmodium falciparum
ISTNYSKDRN

SEQ ID NO: 3224230 - protein, 4 aa, Plasmodium falciparum
ISTP

SEQ ID NO: 3224231 - protein, 17 aa, Plasmodium falciparum
ISTPHHNDNKKHPCDDP

SEQ ID NO: 3224232 - protein, 6 aa, Plasmodium falciparum
ISTSSF

SEQ ID NO: 3224233 - protein, 9 aa, Plasmodium falciparum
ISTTNNNKN

SEQ ID NO: 3224234 - protein, 13 aa, Plasmodium falciparum
ISTTTNEGNSQCN

SEQ ID NO: 3224235 - protein, 14 aa, Plasmodium falciparum
ISTVSNDIKSEKSN

SEQ ID NO: 3224236 - protein, 14 aa, Plasmodium falciparum
ISTYEKDNEQSLGT

SEQ ID NO: 3224237 - protein, 9 aa, Plasmodium falciparum
ISVTPTDEE

SEQ ID NO: 3224238 - protein, 6 aa, Plasmodium falciparum
ISYKDE

SEQ ID NO: 3224239 - protein, 4 aa, Plasmodium falciparum
ISYQ

SEQ ID NO: 3224240 - protein, 19 aa, Plasmodium falciparum
ITAEAAKTQVAASKTAAAI

SEQ ID NO: 3224241 - protein, 33 aa, Plasmodium falciparum
ITCEGNKEKCANKDMERKNDMNNLNEKERNNNM

SEQ ID NO: 3224242 - protein, 4 aa, Plasmodium falciparum
ITDD

SEQ ID NO: 3224243 - protein, 9 aa, Plasmodium falciparum
ITDENNPHV

SEQ ID NO: 3224244 - protein, 27 aa, Plasmodium falciparum
ITDESSTSHNNLSRSSSNNTKHNSNKL

SEQ ID NO: 3224245 - protein, 4 aa, Plasmodium falciparum
ITED

SEQ ID NO: 3224246 - protein, 22 aa, Plasmodium falciparum
ITEDENKKMSPSKKSTYTSNHY

SEQ ID NO: 3224247 - protein, 7 aa, Plasmodium falciparum
ITEEENT

SEQ ID NO: 3224248 - protein, 6 aa, Plasmodium falciparum
ITEEQT

SEQ ID NO: 3224249 - protein, 103 aa, Plasmodium falciparum
ITEESKDREGNKVSGPYENSENSNVTSESEETKKLAEKEENEGEKLGENVNDGASENSEDPKKLTEQEENGTKESSEETKDDKPEENEKKADNKKKSKKKKKS

SEQ ID NO: 3224250 - protein, 12 aa, Plasmodium falciparum
ITEEVEKKESVT

SEQ ID NO: 3224251 - protein, 4 aa, Plasmodium falciparum
ITEG

SEQ ID NO: 3224252 - protein, 6 aa, Plasmodium falciparum
ITEGSP

SEQ ID NO: 3224253 - protein, 7 aa, Plasmodium falciparum
ITEGTAD

SEQ ID NO: 3224254 - protein, 7 aa, Plasmodium falciparum
ITEKETA

SEQ ID NO: 3224255 - protein, 5 aa, Plasmodium falciparum
ITEKQ

SEQ ID NO: 3224256 - protein, 9 aa, Plasmodium falciparum
ITEQHETKE

SEQ ID NO: 3224257 - protein, 8 aa, Plasmodium falciparum
ITERDKRK

SEQ ID NO: 3224258 - protein, 5 aa, Plasmodium falciparum
ITERQ

SEQ ID NO: 3224259 - protein, 4 aa, Plasmodium falciparum
ITET

SEQ ID NO: 3224260 - protein, 16 aa, Plasmodium falciparum
ITETKSYKSDDNSDDD

SEQ ID NO: 3224261 - protein, 10 aa, Plasmodium falciparum
ITGERNNISD

SEQ ID NO: 3224262 - protein, 83 aa, Plasmodium falciparum
ITGGVNESEGQKNKKGKKRTRDEIGDNDDNDNDNDDNNDDNNNDDNNDDNNDDNNNDDNNDDNNNDDNNNDDNNNDDELNEGY

SEQ ID NO: 3224263 - protein, 4 aa, Plasmodium falciparum
ITGK

SEQ ID NO: 3224264 - protein, 21 aa, Plasmodium falciparum
ITHDKKKKGHFKKTKQNKSYE

SEQ ID NO: 3224265 - protein, 5 aa, Plasmodium falciparum
ITHER

SEQ ID NO: 3224266 - protein, 8 aa, Plasmodium falciparum
ITHQETQS

SEQ ID NO: 3224267 - protein, 16 aa, Plasmodium falciparum
ITINGSNGNPSSKKDI

SEQ ID NO: 3224268 - protein, 7 aa, Plasmodium falciparum
ITKEDEN

SEQ ID NO: 3224269 - protein, 13 aa, Plasmodium falciparum
ITKEKEKKRYRKK

SEQ ID NO: 3224270 - protein, 15 aa, Plasmodium falciparum
ITKEKNNNNNDDDDD

SEQ ID NO: 3224271 - protein, 8 aa, Plasmodium falciparum
ITKKNDKK

SEQ ID NO: 3224272 - protein, 4 aa, Plasmodium falciparum
ITKN

SEQ ID NO: 3224273 - protein, 5 aa, Plasmodium falciparum
ITKND

SEQ ID NO: 3224274 - protein, 5 aa, Plasmodium falciparum
ITKNT

SEQ ID NO: 3224275 - protein, 4 aa, Plasmodium falciparum
ITKS

SEQ ID NO: 3224276 - protein, 18 aa, Plasmodium falciparum
ITKSGSYNNSNNNEEINT

SEQ ID NO: 3224277 - protein, 9 aa, Plasmodium falciparum
ITKTDRECE

SEQ ID NO: 3224278 - protein, 8 aa, Plasmodium falciparum
ITNDDNIT

SEQ ID NO: 3224279 - protein, 7 aa, Plasmodium falciparum
ITNDENY

SEQ ID NO: 3224280 - protein, 20 aa, Plasmodium falciparum
ITNDNHNNNTHNSVSYKNDE

SEQ ID NO: 3224281 - protein, 10 aa, Plasmodium falciparum
ITNDTPYITP

SEQ ID NO: 3224282 - protein, 4 aa, Plasmodium falciparum
ITNE

SEQ ID NO: 3224283 - protein, 6 aa, Plasmodium falciparum
ITNENK

SEQ ID NO: 3224284 - protein, 37 aa, Plasmodium falciparum
ITNEQGTSADNNTTENNVSTSQVDEQPEASTSGVERM

SEQ ID NO: 3224285 - protein, 8 aa, Plasmodium falciparum
ITNEQKES

SEQ ID NO: 3224286 - protein, 5 aa, Plasmodium falciparum
ITNEY

SEQ ID NO: 3224287 - protein, 12 aa, Plasmodium falciparum
ITNKEKEENYDN

SEQ ID NO: 3224288 - protein, 9 aa, Plasmodium falciparum
ITNKKDKNE

SEQ ID NO: 3224289 - protein, 10 aa, Plasmodium falciparum
ITNKSKTYTY

SEQ ID NO: 3224290 - protein, 12 aa, Plasmodium falciparum
ITNKTKQKKIKY

SEQ ID NO: 3224291 - protein, 11 aa, Plasmodium falciparum
ITNKTNKNKTF

SEQ ID NO: 3224292 - protein, 5 aa, Plasmodium falciparum
ITNKY

SEQ ID NO: 3224293 - protein, 9 aa, Plasmodium falciparum
ITNNENTSN

SEQ ID NO: 3224294 - protein, 6 aa, Plasmodium falciparum
ITNNNA

SEQ ID NO: 3224295 - protein, 39 aa, Plasmodium falciparum
ITNNNNNINNNSNNNNNNKNNINNNNNNNNNNNNNNNNL

SEQ ID NO: 3224296 - protein, 11 aa, Plasmodium falciparum
ITNNNTKENDI

SEQ ID NO: 3224297 - protein, 30 aa, Plasmodium falciparum
ITNNQNGINVNDGDDNNKRNNEINEETNEI

SEQ ID NO: 3224298 - protein, 8 aa, Plasmodium falciparum
ITNPTSTF

SEQ ID NO: 3224299 - protein, 5 aa, Plasmodium falciparum
ITNQY

SEQ ID NO: 3224300 - protein, 12 aa, Plasmodium falciparum
ITNSNRKKYNSF

SEQ ID NO: 3224301 - protein, 4 aa, Plasmodium falciparum
ITNY

SEQ ID NO: 3224302 - protein, 17 aa, Plasmodium falciparum
ITPKEETSNGQNKDKEK

SEQ ID NO: 3224303 - protein, 5 aa, Plasmodium falciparum
ITPNE

SEQ ID NO: 3224304 - protein, 5 aa, Plasmodium falciparum
ITPPH

SEQ ID NO: 3224305 - protein, 5 aa, Plasmodium falciparum
ITPRH

SEQ ID NO: 3224306 - protein, 8 aa, Plasmodium falciparum
ITPSNQSV

SEQ ID NO: 3224307 - protein, 41 aa, Plasmodium falciparum
ITPSSSNNNNDNNKENDCDKEQLDKYNKDKENKLKLNDKDE

SEQ ID NO: 3224308 - protein, 5 aa, Plasmodium falciparum
ITQEN

SEQ ID NO: 3224309 - protein, 12 aa, Plasmodium falciparum
ITQGGNKTQHEK

SEQ ID NO: 3224310 - protein, 17 aa, Plasmodium falciparum
ITQNEESTTYTNQTNSK

SEQ ID NO: 3224311 - protein, 9 aa, Plasmodium falciparum
ITQNNNPMS

SEQ ID NO: 3224312 - protein, 18 aa, Plasmodium falciparum
ITQSTIQDNPNDQTDEDS

SEQ ID NO: 3224313 - protein, 10 aa, Plasmodium falciparum
ITRNDKNGNI

SEQ ID NO: 3224314 - protein, 5 aa, Plasmodium falciparum
ITRNN

SEQ ID NO: 3224315 - protein, 7 aa, Plasmodium falciparum
ITSAGAN

SEQ ID NO: 3224316 - protein, 6 aa, Plasmodium falciparum
ITSAKR

SEQ ID NO: 3224317 - protein, 16 aa, Plasmodium falciparum
ITSCQNKHNPNGKTAC

SEQ ID NO: 3224318 - protein, 6 aa, Plasmodium falciparum
ITSDNS

SEQ ID NO: 3224319 - protein, 17 aa, Plasmodium falciparum
ITSDSTQKGRKNTTSKM

SEQ ID NO: 3224320 - protein, 5 aa, Plasmodium falciparum
ITSEN

SEQ ID NO: 3224321 - protein, 5 aa, Plasmodium falciparum
ITSGQ

SEQ ID NO: 3224322 - protein, 11 aa, Plasmodium falciparum
ITSHDDGTSHN

SEQ ID NO: 3224323 - protein, 9 aa, Plasmodium falciparum
ITSHNNNDH

SEQ ID NO: 3224324 - protein, 4 aa, Plasmodium falciparum
ITSI

SEQ ID NO: 3224325 - protein, 14 aa, Plasmodium falciparum
ITSKGSDGNGIGNN

SEQ ID NO: 3224326 - protein, 10 aa, Plasmodium falciparum
ITSNDNKMRK

SEQ ID NO: 3224327 - protein, 5 aa, Plasmodium falciparum
ITSNH

SEQ ID NO: 3224328 - protein, 44 aa, Plasmodium falciparum
ITSNKDNKEQQNKNYNNDNNNDNNDNNNNDNNNDKNNNKSNTYD

SEQ ID NO: 3224329 - protein, 6 aa, Plasmodium falciparum
ITSNSS

SEQ ID NO: 3224330 - protein, 10 aa, Plasmodium falciparum
ITSPKEKEEI

SEQ ID NO: 3224331 - protein, 9 aa, Plasmodium falciparum
ITSSEKEKK

SEQ ID NO: 3224332 - protein, 12 aa, Plasmodium falciparum
ITSSKEKNDEKK

SEQ ID NO: 3224333 - protein, 5 aa, Plasmodium falciparum
ITSSN

SEQ ID NO: 3224334 - protein, 12 aa, Plasmodium falciparum
ITSSSYSQYSES

SEQ ID NO: 3224335 - protein, 4 aa, Plasmodium falciparum
ITST

SEQ ID NO: 3224336 - protein, 10 aa, Plasmodium falciparum
ITSTKSDNTV

SEQ ID NO: 3224337 - protein, 4 aa, Plasmodium falciparum
ITTD

SEQ ID NO: 3224338 - protein, 27 aa, Plasmodium falciparum
ITTDGGDGRHPCHGRENNRFSESQEYG

SEQ ID NO: 3224339 - protein, 34 aa, Plasmodium falciparum
ITTDSNSSSNNNNNNNNNSGGRFSSTKDHRNNYT

SEQ ID NO: 3224340 - protein, 5 aa, Plasmodium falciparum
ITTED

SEQ ID NO: 3224341 - protein, 8 aa, Plasmodium falciparum
ITTEKNSN

SEQ ID NO: 3224342 - protein, 6 aa, Plasmodium falciparum
ITTEQN

SEQ ID NO: 3224343 - protein, 7 aa, Plasmodium falciparum
ITTQDDQ

SEQ ID NO: 3224344 - protein, 35 aa, Plasmodium falciparum
ITTSFRSNSEKSSQEFSDASNHIKQSKTSNDHNNN

SEQ ID NO: 3224345 - protein, 28 aa, Plasmodium falciparum
ITTSTKEKRQDDDLEEHKQNKKKGNINQ

SEQ ID NO: 3224346 - protein, 6 aa, Plasmodium falciparum
ITTTKK

SEQ ID NO: 3224347 - protein, 39 aa, Plasmodium falciparum
ITTTKKNSGKNKSEKNESDVDNNSTSNNNNNNNNLKGSS

SEQ ID NO: 3224348 - protein, 29 aa, Plasmodium falciparum
ITTTTTTTTTNNNNNNNNNNNNNNNNNNN

SEQ ID NO: 3224349 - protein, 5 aa, Plasmodium falciparum
ITYGA

SEQ ID NO: 3224350 - protein, 15 aa, Plasmodium falciparum
ITYKDNNTHNNHDKE

SEQ ID NO: 3224351 - protein, 5 aa, Plasmodium falciparum
ITYKR

SEQ ID NO: 3224352 - protein, 6 aa, Plasmodium falciparum
ITYTGA

SEQ ID NO: 3224353 - protein, 20 aa, Plasmodium falciparum
IVDNKKSQDMPKNKNDGTIN

SEQ ID NO: 3224354 - protein, 13 aa, Plasmodium falciparum
IVEKEDNGFYSNE

SEQ ID NO: 3224355 - protein, 4 aa, Plasmodium falciparum
IVES

SEQ ID NO: 3224356 - protein, 12 aa, Plasmodium falciparum
IVSEKNKNNIKE

SEQ ID NO: 3224357 - protein, 8 aa, Plasmodium falciparum
IYDDEKKK

SEQ ID NO: 3224358 - protein, 12 aa, Plasmodium falciparum
IYDDEKKQTNNL

SEQ ID NO: 3224359 - protein, 4 aa, Plasmodium falciparum
IYDN

SEQ ID NO: 3224360 - protein, 6 aa, Plasmodium falciparum
IYDNDN

SEQ ID NO: 3224361 - protein, 14 aa, Plasmodium falciparum
IYDNKKKQRETKKK

SEQ ID NO: 3224362 - protein, 6 aa, Plasmodium falciparum
IYDNNG

SEQ ID NO: 3224363 - protein, 5 aa, Plasmodium falciparum
IYDNQ

SEQ ID NO: 3224364 - protein, 7 aa, Plasmodium falciparum
IYEENKK

SEQ ID NO: 3224365 - protein, 4 aa, Plasmodium falciparum
IYEN

SEQ ID NO: 3224366 - protein, 15 aa, Plasmodium falciparum
IYEREETNQENSPNH

SEQ ID NO: 3224367 - protein, 13 aa, Plasmodium falciparum
IYKKSDKNNFEDP

SEQ ID NO: 3224368 - protein, 6 aa, Plasmodium falciparum
IYKSGD

SEQ ID NO: 3224369 - protein, 5 aa, Plasmodium falciparum
IYNDD

SEQ ID NO: 3224370 - protein, 5 aa, Plasmodium falciparum
IYNKN

SEQ ID NO: 3224371 - protein, 14 aa, Plasmodium falciparum
IYNNKKKEEDIKNK

SEQ ID NO: 3224372 - protein, 23 aa, Plasmodium falciparum
IYNNNSNNMHKRSSSYKNLNNET

SEQ ID NO: 3224373 - protein, 39 aa, Plasmodium falciparum
IYNNSNNKKKKKNKIKNINKNTADNSSESSHEEQNGKSD

SEQ ID NO: 3224374 - protein, 9 aa, Plasmodium falciparum
IYNQTKEEQ

SEQ ID NO: 3224375 - protein, 4 aa, Plasmodium falciparum
IYNS

SEQ ID NO: 3224376 - protein, 16 aa, Plasmodium falciparum
IYNSDSSSSVSSSLSD

SEQ ID NO: 3224377 - protein, 10 aa, Plasmodium falciparum
IYNTNEEQNM

SEQ ID NO: 3224378 - protein, 18 aa, Plasmodium falciparum
IYNTTTANSSSSNNNDNY

SEQ ID NO: 3224379 - protein, 13 aa, Plasmodium falciparum
IYPDPNDQEEFQY

SEQ ID NO: 3224380 - protein, 5 aa, Plasmodium falciparum
IYPNN

SEQ ID NO: 3224381 - protein, 8 aa, Plasmodium falciparum
IYQNQKNE

SEQ ID NO: 3224382 - protein, 6 aa, Plasmodium falciparum
IYSGDG

SEQ ID NO: 3224383 - protein, 8 aa, Plasmodium falciparum
IYSKNKDY

SEQ ID NO: 3224384 - protein, 6 aa, Plasmodium falciparum
IYSSDN

SEQ ID NO: 3224385 - protein, 20 aa, Plasmodium falciparum
IYSSPESENKGKNEKKNEKQ

SEQ ID NO: 3224386 - protein, 5 aa, Plasmodium falciparum
IYTPH

SEQ ID NO: 3224387 - protein, 10 aa, Plasmodium falciparum
KAADPSSSNL

SEQ ID NO: 3224388 - protein, 13 aa, Plasmodium falciparum
KAAEEKTIEAAST

SEQ ID NO: 3224389 - protein, 16 aa, Plasmodium falciparum
KAAHDAKLASETTALT

SEQ ID NO: 3224390 - protein, 13 aa, Plasmodium falciparum
KAAIAEGAEAGIA

SEQ ID NO: 3224391 - protein, 15 aa, Plasmodium falciparum
KAAIAKATDLATQAG

SEQ ID NO: 3224392 - protein, 19 aa, Plasmodium falciparum
KAAKAAAAKAASDAATQAG

SEQ ID NO: 3224393 - protein, 22 aa, Plasmodium falciparum
KAAKAAKAAAAKAASDAATQAG

SEQ ID NO: 3224394 - protein, 11 aa, Plasmodium falciparum
KAALAEATDAA

SEQ ID NO: 3224395 - protein, 8 aa, Plasmodium falciparum
KAATESGE

SEQ ID NO: 3224396 - protein, 10 aa, Plasmodium falciparum
KAAVTEATDA

SEQ ID NO: 3224397 - protein, 4 aa, Plasmodium falciparum
KACE

SEQ ID NO: 3224398 - protein, 13 aa, Plasmodium falciparum
KACENGGSSNIEG

SEQ ID NO: 3224399 - protein, 11 aa, Plasmodium falciparum
KACKEVKDGGK

SEQ ID NO: 3224400 - protein, 12 aa, Plasmodium falciparum
KACKEVKDGGTI

SEQ ID NO: 3224401 - protein, 14 aa, Plasmodium falciparum
KACQEVKDSEGGKI

SEQ ID NO: 3224402 - protein, 6 aa, Plasmodium falciparum
KACSGF

SEQ ID NO: 3224403 - protein, 12 aa, Plasmodium falciparum
KADAKTYKDELR

SEQ ID NO: 3224404 - protein, 6 aa, Plasmodium falciparum
KADASS

SEQ ID NO: 3224405 - protein, 7 aa, Plasmodium falciparum
KADDDKC

SEQ ID NO: 3224406 - protein, 9 aa, Plasmodium falciparum
KADDNNQIR

SEQ ID NO: 3224407 - protein, 7 aa, Plasmodium falciparum
KADLEDN

SEQ ID NO: 3224408 - protein, 12 aa, Plasmodium falciparum
KADNENKGSARL

SEQ ID NO: 3224409 - protein, 7 aa, Plasmodium falciparum
KADNSNR

SEQ ID NO: 3224410 - protein, 7 aa, Plasmodium falciparum
KADPQRI

SEQ ID NO: 3224411 - protein, 9 aa, Plasmodium falciparum
KADWDKNKG

SEQ ID NO: 3224412 - protein, 7 aa, Plasmodium falciparum
KAEDDYD

SEQ ID NO: 3224413 - protein, 5 aa, Plasmodium falciparum
KAEDS

SEQ ID NO: 3224414 - protein, 13 aa, Plasmodium falciparum
KAEEDGGNKVGTD

SEQ ID NO: 3224415 - protein, 41 aa, Plasmodium falciparum
KAEEEYQKNKKRIKSQNKNSYKNKKEDDEEEKDYDEDDNNN

SEQ ID NO: 3224416 - protein, 48 aa, Plasmodium falciparum
KAEEIKTDDNKCNINNNNNNNNNNNNNNNNNNNNNNNNNYNNNNYNNN

SEQ ID NO: 3224417 - protein, 8 aa, Plasmodium falciparum
KAEEKKKI

SEQ ID NO: 3224418 - protein, 21 aa, Plasmodium falciparum
KAEEKKKKKNVDRKRKRKKKK

SEQ ID NO: 3224419 - protein, 6 aa, Plasmodium falciparum
KAEEQN

SEQ ID NO: 3224420 - protein, 17 aa, Plasmodium falciparum
KAEESTNESEVIKTEDK

SEQ ID NO: 3224421 - protein, 6 aa, Plasmodium falciparum
KAEEYR

SEQ ID NO: 3224422 - protein, 9 aa, Plasmodium falciparum
KAEGPANAA

SEQ ID NO: 3224423 - protein, 15 aa, Plasmodium falciparum
KAEGPANTAAEIAEA

SEQ ID NO: 3224424 - protein, 20 aa, Plasmodium falciparum
KAEKNDGDTSSGTDDVKEEN

SEQ ID NO: 3224425 - protein, 5 aa, Plasmodium falciparum
KAELK

SEQ ID NO: 3224426 - protein, 17 aa, Plasmodium falciparum
KAENTESEKSLLESSVF

SEQ ID NO: 3224427 - protein, 5 aa, Plasmodium falciparum
KAEQK

SEQ ID NO: 3224428 - protein, 5 aa, Plasmodium falciparum
KAEQN

SEQ ID NO: 3224429 - protein, 10 aa, Plasmodium falciparum
KAERSSNKRK

SEQ ID NO: 3224430 - protein, 9 aa, Plasmodium falciparum
KAESKEEFI

SEQ ID NO: 3224431 - protein, 21 aa, Plasmodium falciparum
KAETAASTETAKVTASETATL

SEQ ID NO: 3224432 - protein, 7 aa, Plasmodium falciparum
KAETEEG

SEQ ID NO: 3224433 - protein, 7 aa, Plasmodium falciparum
KAGDAAG

SEQ ID NO: 3224434 - protein, 4 aa, Plasmodium falciparum
KAGG

SEQ ID NO: 3224435 - protein, 16 aa, Plasmodium falciparum
KAGGIECGGDPTPEDY

SEQ ID NO: 3224436 - protein, 6 aa, Plasmodium falciparum
KAGGTM

SEQ ID NO: 3224437 - protein, 7 aa, Plasmodium falciparum
KAGSAAF

SEQ ID NO: 3224438 - protein, 18 aa, Plasmodium falciparum
KAHGSSNDYNASNSQDKT

SEQ ID NO: 3224439 - protein, 7 aa, Plasmodium falciparum
KAIETTS

SEQ ID NO: 3224440 - protein, 15 aa, Plasmodium falciparum
KAIKNEKDNFKRDAK

SEQ ID NO: 3224441 - protein, 9 aa, Plasmodium falciparum
KAKDKYKRI

SEQ ID NO: 3224442 - protein, 21 aa, Plasmodium falciparum
KAKEKENIKKKNKINHHDEDK

SEQ ID NO: 3224443 - protein, 12 aa, Plasmodium falciparum
KAKERNSSHHSI

SEQ ID NO: 3224444 - protein, 37 aa, Plasmodium falciparum
KAKGKHKRNHNGGDNNGDNNGDNNYDDNYDDNNYNDG

SEQ ID NO: 3224445 - protein, 7 aa, Plasmodium falciparum
KAKGTAD

SEQ ID NO: 3224446 - protein, 20 aa, Plasmodium falciparum
KAKIKQKNVYNNNNNNNNNM

SEQ ID NO: 3224447 - protein, 9 aa, Plasmodium falciparum
KAKKESNKW

SEQ ID NO: 3224448 - protein, 8 aa, Plasmodium falciparum
KAKKKSDM

SEQ ID NO: 3224449 - protein, 10 aa, Plasmodium falciparum
KAKKNAEQYR

SEQ ID NO: 3224450 - protein, 12 aa, Plasmodium falciparum
KAKKNAEQYRSQ

SEQ ID NO: 3224451 - protein, 7 aa, Plasmodium falciparum
KAKLKNS

SEQ ID NO: 3224452 - protein, 4 aa, Plasmodium falciparum
KAKN

SEQ ID NO: 3224453 - protein, 56 aa, Plasmodium falciparum
KAKNGNKNNNDDNNNNDDNNNNDNNNNNNNNNNNNNNNNNNNNNNNNNNNNNNNNN

SEQ ID NO: 3224454 - protein, 15 aa, Plasmodium falciparum
KAKNNLKKPKKKIKR

SEQ ID NO: 3224455 - protein, 4 aa, Plasmodium falciparum
KAKR

SEQ ID NO: 3224456 - protein, 8 aa, Plasmodium falciparum
KAKRGDDY

SEQ ID NO: 3224457 - protein, 8 aa, Plasmodium falciparum
KAKRGKLE

SEQ ID NO: 3224458 - protein, 12 aa, Plasmodium falciparum
KAKSGDDLGGNN

SEQ ID NO: 3224459 - protein, 9 aa, Plasmodium falciparum
KAKSNVIQK

SEQ ID NO: 3224460 - protein, 10 aa, Plasmodium falciparum
KALSEDSKEI

SEQ ID NO: 3224461 - protein, 9 aa, Plasmodium falciparum
KANDQNDNV

SEQ ID NO: 3224462 - protein, 11 aa, Plasmodium falciparum
KANETNISEGK

SEQ ID NO: 3224463 - protein, 7 aa, Plasmodium falciparum
KANHENE

SEQ ID NO: 3224464 - protein, 9 aa, Plasmodium falciparum
KANHNGDNN

SEQ ID NO: 3224465 - protein, 17 aa, Plasmodium falciparum
KANNGDKTGDDKVYSTA

SEQ ID NO: 3224466 - protein, 7 aa, Plasmodium falciparum
KANNGNF

SEQ ID NO: 3224467 - protein, 8 aa, Plasmodium falciparum
KANNNKVE

SEQ ID NO: 3224468 - protein, 12 aa, Plasmodium falciparum
KANSGKKNTQDK

SEQ ID NO: 3224469 - protein, 4 aa, Plasmodium falciparum
KANT

SEQ ID NO: 3224470 - protein, 6 aa, Plasmodium falciparum
KANTSQ

SEQ ID NO: 3224471 - protein, 7 aa, Plasmodium falciparum
KANVPKG

SEQ ID NO: 3224472 - protein, 6 aa, Plasmodium falciparum
KAPKTV

SEQ ID NO: 3224473 - protein, 5 aa, Plasmodium falciparum
KAPND

SEQ ID NO: 3224474 - protein, 7 aa, Plasmodium falciparum
KAPNNVD

SEQ ID NO: 3224475 - protein, 6 aa, Plasmodium falciparum
KAPNSV

SEQ ID NO: 3224476 - protein, 60 aa, Plasmodium falciparum
KAPPKQEEKGGCEPASPLEPEEVEEETASVPPGSEPEADKGPVKPAELPKPPKRNKRQPK

SEQ ID NO: 3224477 - protein, 17 aa, Plasmodium falciparum
KAPQAAEEAAKVTTTYK

SEQ ID NO: 3224478 - protein, 8 aa, Plasmodium falciparum
KAPSDADD

SEQ ID NO: 3224479 - protein, 7 aa, Plasmodium falciparum
KAPSITN

SEQ ID NO: 3224480 - protein, 5 aa, Plasmodium falciparum
KAPTA

SEQ ID NO: 3224481 - protein, 6 aa, Plasmodium falciparum
KAPWTT

SEQ ID NO: 3224482 - protein, 17 aa, Plasmodium falciparum
KAQDNLNGNERKAYDPF

SEQ ID NO: 3224483 - protein, 9 aa, Plasmodium falciparum
KAQEENKTK

SEQ ID NO: 3224484 - protein, 8 aa, Plasmodium falciparum
KAQGDPQH

SEQ ID NO: 3224485 - protein, 14 aa, Plasmodium falciparum
KAQGNLGKSSCEKD

SEQ ID NO: 3224486 - protein, 8 aa, Plasmodium falciparum
KAQKKYKS

SEQ ID NO: 3224487 - protein, 16 aa, Plasmodium falciparum
KAQMQKEKKRTKEEKE

SEQ ID NO: 3224488 - protein, 7 aa, Plasmodium falciparum
KAQMTKN

SEQ ID NO: 3224489 - protein, 19 aa, Plasmodium falciparum
KAQNSDTSNSGTTYPKDEK

SEQ ID NO: 3224490 - protein, 17 aa, Plasmodium falciparum
KARKKKKNMKKKKIDAN

SEQ ID NO: 3224491 - protein, 7 aa, Plasmodium falciparum
KARPISS

SEQ ID NO: 3224492 - protein, 22 aa, Plasmodium falciparum
KASDEGWPGDKVEENPDGRGYA

SEQ ID NO: 3224493 - protein, 7 aa, Plasmodium falciparum
KASEAAG

SEQ ID NO: 3224494 - protein, 9 aa, Plasmodium falciparum
KASGDNNIE

SEQ ID NO: 3224495 - protein, 10 aa, Plasmodium falciparum
KASGDNPTNK

SEQ ID NO: 3224496 - protein, 4 aa, Plasmodium falciparum
KASL

SEQ ID NO: 3224497 - protein, 9 aa, Plasmodium falciparum
KASNKKYDY

SEQ ID NO: 3224498 - protein, 11 aa, Plasmodium falciparum
KASQEIKSTMD

SEQ ID NO: 3224499 - protein, 10 aa, Plasmodium falciparum
KASSDKNIET

SEQ ID NO: 3224500 - protein, 7 aa, Plasmodium falciparum
KATDEAI

SEQ ID NO: 3224501 - protein, 8 aa, Plasmodium falciparum
KATKDVKR

SEQ ID NO: 3224502 - protein, 18 aa, Plasmodium falciparum
KATKPGVTTSNNPKDEKD

SEQ ID NO: 3224503 - protein, 4 aa, Plasmodium falciparum
KATN

SEQ ID NO: 3224504 - protein, 7 aa, Plasmodium falciparum
KATNNKY

SEQ ID NO: 3224505 - protein, 11 aa, Plasmodium falciparum
KATQTAEAEAA

SEQ ID NO: 3224506 - protein, 9 aa, Plasmodium falciparum
KATSAGVAK

SEQ ID NO: 3224507 - protein, 5 aa, Plasmodium falciparum
KATSL

SEQ ID NO: 3224508 - protein, 8 aa, Plasmodium falciparum
KATSNGRY

SEQ ID NO: 3224509 - protein, 6 aa, Plasmodium falciparum
KAVSTS

SEQ ID NO: 3224510 - protein, 8 aa, Plasmodium falciparum
KAVTGAEN

SEQ ID NO: 3224511 - protein, 6 aa, Plasmodium falciparum
KAYKKT

SEQ ID NO: 3224512 - protein, 11 aa, Plasmodium falciparum
KAYNEGKDENI

SEQ ID NO: 3224513 - protein, 7 aa, Plasmodium falciparum
KAYNSNS

SEQ ID NO: 3224514 - protein, 6 aa, Plasmodium falciparum
KAYSEL

SEQ ID NO: 3224515 - protein, 25 aa, Plasmodium falciparum
KAYVDRKDKYKTENKGAESKHHSIS

SEQ ID NO: 3224516 - protein, 10 aa, Plasmodium falciparum
KCANSNSNDF

SEQ ID NO: 3224517 - protein, 8 aa, Plasmodium falciparum
KCDDGKQI

SEQ ID NO: 3224518 - protein, 10 aa, Plasmodium falciparum
KCDEDVHEDE

SEQ ID NO: 3224519 - protein, 76 aa, Plasmodium falciparum
KCDEPKPEGAAGGRSDGPPGSPPRPAEKDEDHHSDESDEEEDEEHTEQGEEKTEGKTEEQPEEVKEHTETPEDEVN

SEQ ID NO: 3224520 - protein, 42 aa, Plasmodium falciparum
KCDKCEQEEDDAKNVSSFNKNNNETSEPSSSAKVEKIDEDSL

SEQ ID NO: 3224521 - protein, 6 aa, Plasmodium falciparum
KCDNKK

SEQ ID NO: 3224522 - protein, 13 aa, Plasmodium falciparum
KCDTSNEKHADED

SEQ ID NO: 3224523 - protein, 14 aa, Plasmodium falciparum
KCEEAQKPQQERED

SEQ ID NO: 3224524 - protein, 13 aa, Plasmodium falciparum
KCEEDNKSICSKE

SEQ ID NO: 3224525 - protein, 9 aa, Plasmodium falciparum
KCEEQDKKV

SEQ ID NO: 3224526 - protein, 13 aa, Plasmodium falciparum
KCEEYDKNGYINS

SEQ ID NO: 3224527 - protein, 14 aa, Plasmodium falciparum
KCEHKKKNITHSNN

SEQ ID NO: 3224528 - protein, 20 aa, Plasmodium falciparum
KCENKNSDSGNKKVKKHNDE

SEQ ID NO: 3224529 - protein, 5 aa, Plasmodium falciparum
KCENS

SEQ ID NO: 3224530 - protein, 6 aa, Plasmodium falciparum
KCEQKA

SEQ ID NO: 3224531 - protein, 4 aa, Plasmodium falciparum
KCGL

SEQ ID NO: 3224532 - protein, 6 aa, Plasmodium falciparum
KCGPNS

SEQ ID NO: 3224533 - protein, 5 aa, Plasmodium falciparum
KCIDG

SEQ ID NO: 3224534 - protein, 24 aa, Plasmodium falciparum
KCISSNDDKHSFSKQNESNVSKEE

SEQ ID NO: 3224535 - protein, 11 aa, Plasmodium falciparum
KCKDDEKKKDI

SEQ ID NO: 3224536 - protein, 6 aa, Plasmodium falciparum
KCKDKN

SEQ ID NO: 3224537 - protein, 8 aa, Plasmodium falciparum
KCKDRCNK

SEQ ID NO: 3224538 - protein, 9 aa, Plasmodium falciparum
KCKEDNKEN

SEQ ID NO: 3224539 - protein, 8 aa, Plasmodium falciparum
KCKEQCNK

SEQ ID NO: 3224540 - protein, 24 aa, Plasmodium falciparum
KCKKQNNKQIKSYKNNDLEQKDTS

SEQ ID NO: 3224541 - protein, 16 aa, Plasmodium falciparum
KCKNKEKNRGSKNNNI

SEQ ID NO: 3224542 - protein, 7 aa, Plasmodium falciparum
KCKQGNG

SEQ ID NO: 3224543 - protein, 26 aa, Plasmodium falciparum
KCKRGGGKKKKKKKKKKDIKLTSNDT

SEQ ID NO: 3224544 - protein, 7 aa, Plasmodium falciparum
KCKSPEE

SEQ ID NO: 3224545 - protein, 30 aa, Plasmodium falciparum
KCLSNNNNSNNNNNNNNNNSEKSVTDTNNL

SEQ ID NO: 3224546 - protein, 20 aa, Plasmodium falciparum
KCNCRSSGKGNTCNDKNSID

SEQ ID NO: 3224547 - protein, 4 aa, Plasmodium falciparum
KCND

SEQ ID NO: 3224548 - protein, 34 aa, Plasmodium falciparum
KCNDNNNDNDNNNDNNNNNDNNNDNSNNSNNNNK

SEQ ID NO: 3224549 - protein, 9 aa, Plasmodium falciparum
KCNKMDDDF

SEQ ID NO: 3224550 - protein, 5 aa, Plasmodium falciparum
KCNKN

SEQ ID NO: 3224551 - protein, 39 aa, Plasmodium falciparum
KCNNKESKKKEKKDIEKDHKEKKKGSKKKIKDENNEMKD

SEQ ID NO: 3224552 - protein, 9 aa, Plasmodium falciparum
KCNNNSNEE

SEQ ID NO: 3224553 - protein, 6 aa, Plasmodium falciparum
KCNNNT

SEQ ID NO: 3224554 - protein, 7 aa, Plasmodium falciparum
KCNNRNE

SEQ ID NO: 3224555 - protein, 13 aa, Plasmodium falciparum
KCNPTETKIDENG

SEQ ID NO: 3224556 - protein, 34 aa, Plasmodium falciparum
KCNQQKKQKTPGGGDDARSDTSHDGARPQPPPIT

SEQ ID NO: 3224557 - protein, 7 aa, Plasmodium falciparum
KCNTNNK

SEQ ID NO: 3224558 - protein, 9 aa, Plasmodium falciparum
KCNYDQSYA

SEQ ID NO: 3224559 - protein, 9 aa, Plasmodium falciparum
KCPDPPKPC

SEQ ID NO: 3224560 - protein, 6 aa, Plasmodium falciparum
KCPTPQ

SEQ ID NO: 3224561 - protein, 21 aa, Plasmodium falciparum
KCQNHSEEFGNSDNSSLNDTK

SEQ ID NO: 3224562 - protein, 6 aa, Plasmodium falciparum
KCQNNL

SEQ ID NO: 3224563 - protein, 15 aa, Plasmodium falciparum
KCRGGSSNDKYCSGN

SEQ ID NO: 3224564 - protein, 9 aa, Plasmodium falciparum
KCRKGCKNP

SEQ ID NO: 3224565 - protein, 7 aa, Plasmodium falciparum
KCSETNK

SEQ ID NO: 3224566 - protein, 7 aa, Plasmodium falciparum
KCSGYGE

SEQ ID NO: 3224567 - protein, 12 aa, Plasmodium falciparum
KCSKNRNRNRYI

SEQ ID NO: 3224568 - protein, 10 aa, Plasmodium falciparum
KCSNGEGACA

SEQ ID NO: 3224569 - protein, 14 aa, Plasmodium falciparum
KCSNGSNGKNEGAC

SEQ ID NO: 3224570 - protein, 17 aa, Plasmodium falciparum
KCSNGSNGSNGKNEGAC

SEQ ID NO: 3224571 - protein, 7 aa, Plasmodium falciparum
KCSNYSN

SEQ ID NO: 3224572 - protein, 7 aa, Plasmodium falciparum
KCSSLTD

SEQ ID NO: 3224573 - protein, 5 aa, Plasmodium falciparum
KCSTL

SEQ ID NO: 3224574 - protein, 7 aa, Plasmodium falciparum
KCSTYKK

SEQ ID NO: 3224575 - protein, 11 aa, Plasmodium falciparum
KCTGNNGKSLC

SEQ ID NO: 3224576 - protein, 20 aa, Plasmodium falciparum
KCTGPNKDNCTRDNNDCNTC

SEQ ID NO: 3224577 - protein, 8 aa, Plasmodium falciparum
KCTSEEEK

SEQ ID NO: 3224578 - protein, 6 aa, Plasmodium falciparum
KCTTSS

SEQ ID NO: 3224579 - protein, 9 aa, Plasmodium falciparum
KCVNSTNDN

SEQ ID NO: 3224580 - protein, 13 aa, Plasmodium falciparum
KDAAIAKATDAAI

SEQ ID NO: 3224581 - protein, 6 aa, Plasmodium falciparum
KDADNK

SEQ ID NO: 3224582 - protein, 22 aa, Plasmodium falciparum
KDADNMPRTYDNKNDYDDKNYM

SEQ ID NO: 3224583 - protein, 13 aa, Plasmodium falciparum
KDAEQSNNTNSSH

SEQ ID NO: 3224584 - protein, 8 aa, Plasmodium falciparum
KDAFSNNK

SEQ ID NO: 3224585 - protein, 5 aa, Plasmodium falciparum
KDAHT

SEQ ID NO: 3224586 - protein, 10 aa, Plasmodium falciparum
KDAKGEEVPR

SEQ ID NO: 3224587 - protein, 11 aa, Plasmodium falciparum
KDAKKDSKKIP

SEQ ID NO: 3224588 - protein, 10 aa, Plasmodium falciparum
KDANEKNKKK

SEQ ID NO: 3224589 - protein, 13 aa, Plasmodium falciparum
KDANIKKDIEKEE

SEQ ID NO: 3224590 - protein, 5 aa, Plasmodium falciparum
KDANN

SEQ ID NO: 3224591 - protein, 4 aa, Plasmodium falciparum
KDAS

SEQ ID NO: 3224592 - protein, 114 aa, Plasmodium falciparum
KDATKCKQDCEQRKPPGAGGGDVRSDTVPSRDPLTPGPTDGHEDSEDEEEEEEEEDEEHGPDDKEGTEENVEETETVEDQVEEEKAKDNTDGKGEEEEDNQGETTQITTQDGVN

SEQ ID NO: 3224593 - protein, 19 aa, Plasmodium falciparum
KDATYSKKPDNQEKPSDPC

SEQ ID NO: 3224594 - protein, 4 aa, Plasmodium falciparum
KDCE

SEQ ID NO: 3224595 - protein, 7 aa, Plasmodium falciparum
KDCGSSE

SEQ ID NO: 3224596 - protein, 10 aa, Plasmodium falciparum
KDCKPPEESL

SEQ ID NO: 3224597 - protein, 4 aa, Plasmodium falciparum
KDCN

SEQ ID NO: 3224598 - protein, 5 aa, Plasmodium falciparum
KDCNN

SEQ ID NO: 3224599 - protein, 11 aa, Plasmodium falciparum
KDCRNASNNMC

SEQ ID NO: 3224600 - protein, 8 aa, Plasmodium falciparum
KDCTKGNY

SEQ ID NO: 3224601 - protein, 7 aa, Plasmodium falciparum
KDCYEKY

SEQ ID NO: 3224602 - protein, 8 aa, Plasmodium falciparum
KDDADAKK

SEQ ID NO: 3224603 - protein, 10 aa, Plasmodium falciparum
KDDAEKYKEA

SEQ ID NO: 3224604 - protein, 45 aa, Plasmodium falciparum
KDDAKTEQNIPDITEKNTERTKSKKYRKGKYDTDKKEKSNMSSSS

SEQ ID NO: 3224605 - protein, 13 aa, Plasmodium falciparum
KDDAKTEQNITDV

SEQ ID NO: 3224606 - protein, 8 aa, Plasmodium falciparum
KDDAQAKK

SEQ ID NO: 3224607 - protein, 5 aa, Plasmodium falciparum
KDDDA

SEQ ID NO: 3224608 - protein, 7 aa, Plasmodium falciparum
KDDDDEY

SEQ ID NO: 3224609 - protein, 6 aa, Plasmodium falciparum
KDDDIE

SEQ ID NO: 3224610 - protein, 38 aa, Plasmodium falciparum
KDDDKIFDEGDENRESKELNEDEDEEEDEEEDEEEDEE

SEQ ID NO: 3224611 - protein, 5 aa, Plasmodium falciparum
KDDDM

SEQ ID NO: 3224612 - protein, 8 aa, Plasmodium falciparum
KDDDNGLK

SEQ ID NO: 3224613 - protein, 7 aa, Plasmodium falciparum
KDDDNYK

SEQ ID NO: 3224614 - protein, 5 aa, Plasmodium falciparum
KDDDR

SEQ ID NO: 3224615 - protein, 6 aa, Plasmodium falciparum
KDDDSI

SEQ ID NO: 3224616 - protein, 8 aa, Plasmodium falciparum
KDDDSILS

SEQ ID NO: 3224617 - protein, 7 aa, Plasmodium falciparum
KDDDTCD

SEQ ID NO: 3224618 - protein, 17 aa, Plasmodium falciparum
KDDEDTLCPPVKKNNNM

SEQ ID NO: 3224619 - protein, 9 aa, Plasmodium falciparum
KDDEEIKQK

SEQ ID NO: 3224620 - protein, 8 aa, Plasmodium falciparum
KDDEENDL

SEQ ID NO: 3224621 - protein, 5 aa, Plasmodium falciparum
KDDEK

SEQ ID NO: 3224622 - protein, 12 aa, Plasmodium falciparum
KDDEKKNVHEKD

SEQ ID NO: 3224623 - protein, 5 aa, Plasmodium falciparum
KDDEL

SEQ ID NO: 3224624 - protein, 7 aa, Plasmodium falciparum
KDDELNV

SEQ ID NO: 3224625 - protein, 7 aa, Plasmodium falciparum
KDDENDI

SEQ ID NO: 3224626 - protein, 7 aa, Plasmodium falciparum
KDDENLD

SEQ ID NO: 3224627 - protein, 18 aa, Plasmodium falciparum
KDDENSDMKNIELAEIFH

SEQ ID NO: 3224628 - protein, 40 aa, Plasmodium falciparum
KDDENSHHEDNAQQDENLHNEEKDDDDDDNNNIEEDLDNE

SEQ ID NO: 3224629 - protein, 6 aa, Plasmodium falciparum
KDDEQY

SEQ ID NO: 3224630 - protein, 15 aa, Plasmodium falciparum
KDDETNNHRTSSNKK

SEQ ID NO: 3224631 - protein, 6 aa, Plasmodium falciparum
KDDEYC

SEQ ID NO: 3224632 - protein, 8 aa, Plasmodium falciparum
KDDGKNQY

SEQ ID NO: 3224633 - protein, 15 aa, Plasmodium falciparum
KDDGQRHGEDSDSMN

SEQ ID NO: 3224634 - protein, 6 aa, Plasmodium falciparum
KDDHRY

SEQ ID NO: 3224635 - protein, 5 aa, Plasmodium falciparum
KDDHV

SEQ ID NO: 3224636 - protein, 18 aa, Plasmodium falciparum
KDDIKKDDIKKDDIKKDD

SEQ ID NO: 3224637 - protein, 38 aa, Plasmodium falciparum
KDDIPTTSKRKDTQKPDDLNKNTDINNKGNINNNVNNN

SEQ ID NO: 3224638 - protein, 11 aa, Plasmodium falciparum
KDDIRNEKKIK

SEQ ID NO: 3224639 - protein, 4 aa, Plasmodium falciparum
KDDK

SEQ ID NO: 3224640 - protein, 9 aa, Plasmodium falciparum
KDDKDFNRH

SEQ ID NO: 3224641 - protein, 8 aa, Plasmodium falciparum
KDDKHDGD

SEQ ID NO: 3224642 - protein, 7 aa, Plasmodium falciparum
KDDKNRF

SEQ ID NO: 3224643 - protein, 9 aa, Plasmodium falciparum
KDDKSKCIS

SEQ ID NO: 3224644 - protein, 9 aa, Plasmodium falciparum
KDDLDNKDN

SEQ ID NO: 3224645 - protein, 6 aa, Plasmodium falciparum
KDDLHK

SEQ ID NO: 3224646 - protein, 12 aa, Plasmodium falciparum
KDDLKKNNQHMS

SEQ ID NO: 3224647 - protein, 10 aa, Plasmodium falciparum
KDDLKKNVDN

SEQ ID NO: 3224648 - protein, 10 aa, Plasmodium falciparum
KDDLKNKNFQ

SEQ ID NO: 3224649 - protein, 48 aa, Plasmodium falciparum
KDDLNKKKIKKKKNKENNEDSKEQNINKNKDSCNNVTDANSMKKEDSI

SEQ ID NO: 3224650 - protein, 11 aa, Plasmodium falciparum
KDDMDDTHNHN

SEQ ID NO: 3224651 - protein, 16 aa, Plasmodium falciparum
KDDNGNDISEGTKKIK

SEQ ID NO: 3224652 - protein, 6 aa, Plasmodium falciparum
KDDNKI

SEQ ID NO: 3224653 - protein, 5 aa, Plasmodium falciparum
KDDNM

SEQ ID NO: 3224654 - protein, 20 aa, Plasmodium falciparum
KDDNNNNNKNINKNDENDFT

SEQ ID NO: 3224655 - protein, 64 aa, Plasmodium falciparum
KDDNTYDGPINKDNNTYDGPINKDNNTYDGPINKDNNTYDGPINKDNNTYDGPINKDNNTYYGP

SEQ ID NO: 3224656 - protein, 10 aa, Plasmodium falciparum
KDDPPDNDYI

SEQ ID NO: 3224657 - protein, 9 aa, Plasmodium falciparum
KDDQNNVDY

SEQ ID NO: 3224658 - protein, 5 aa, Plasmodium falciparum
KDDRK

SEQ ID NO: 3224659 - protein, 5 aa, Plasmodium falciparum
KDDSI

SEQ ID NO: 3224660 - protein, 8 aa, Plasmodium falciparum
KDDSLTND

SEQ ID NO: 3224661 - protein, 11 aa, Plasmodium falciparum
KDDSNKLTDEE

SEQ ID NO: 3224662 - protein, 7 aa, Plasmodium falciparum
KDDSYDS

SEQ ID NO: 3224663 - protein, 28 aa, Plasmodium falciparum
KDDTNNNNNNNNNNNNNNSSSSSSSSYY

SEQ ID NO: 3224664 - protein, 9 aa, Plasmodium falciparum
KDDTYRNNN

SEQ ID NO: 3224665 - protein, 7 aa, Plasmodium falciparum
KDDTYSF

SEQ ID NO: 3224666 - protein, 10 aa, Plasmodium falciparum
KDDVDNNHMS

SEQ ID NO: 3224667 - protein, 28 aa, Plasmodium falciparum
KDDVKDDIKKDDIKKKDDIKKDDIKKDD

SEQ ID NO: 3224668 - protein, 5 aa, Plasmodium falciparum
KDDYE

SEQ ID NO: 3224669 - protein, 6 aa, Plasmodium falciparum
KDDYNS

SEQ ID NO: 3224670 - protein, 6 aa, Plasmodium falciparum
KDEAIE

SEQ ID NO: 3224671 - protein, 14 aa, Plasmodium falciparum
KDECKKSKLSLNEE

SEQ ID NO: 3224672 - protein, 8 aa, Plasmodium falciparum
KDEDLDKK

SEQ ID NO: 3224673 - protein, 10 aa, Plasmodium falciparum
KDEDTSNSNN

SEQ ID NO: 3224674 - protein, 5 aa, Plasmodium falciparum
KDEDV

SEQ ID NO: 3224675 - protein, 5 aa, Plasmodium falciparum
KDEED

SEQ ID NO: 3224676 - protein, 9 aa, Plasmodium falciparum
KDEEDTSED

SEQ ID NO: 3224677 - protein, 18 aa, Plasmodium falciparum
KDEEEKRQNINDKNRKKK

SEQ ID NO: 3224678 - protein, 6 aa, Plasmodium falciparum
KDEEEN

SEQ ID NO: 3224679 - protein, 14 aa, Plasmodium falciparum
KDEEERLKRRGGVP

SEQ ID NO: 3224680 - protein, 5 aa, Plasmodium falciparum
KDEEG

SEQ ID NO: 3224681 - protein, 24 aa, Plasmodium falciparum
KDEEGKNVKIQREDEKIKNDNTNE

SEQ ID NO: 3224682 - protein, 9 aa, Plasmodium falciparum
KDEEKHSTL

SEQ ID NO: 3224683 - protein, 122 aa, Plasmodium falciparum
KDEEKSYNEEGTSQTDNSDKETEQMENSEAETSENDKDENKTSENDINENKTSENDINENKTSENNKNKEDSIQNDKNKEESIQNDKNKEESIQNDKNKEEAIQNDKNKEEAIQNDKNKDLK

SEQ ID NO: 3224684 - protein, 5 aa, Plasmodium falciparum
KDEEL

SEQ ID NO: 3224685 - protein, 9 aa, Plasmodium falciparum
KDEEMKDEE

SEQ ID NO: 3224686 - protein, 21 aa, Plasmodium falciparum
KDEENETQEKTNSSDLKKSQK

SEQ ID NO: 3224687 - protein, 8 aa, Plasmodium falciparum
KDEEPYNT

SEQ ID NO: 3224688 - protein, 8 aa, Plasmodium falciparum
KDEEQKKD

SEQ ID NO: 3224689 - protein, 8 aa, Plasmodium falciparum
KDEETSEL

SEQ ID NO: 3224690 - protein, 12 aa, Plasmodium falciparum
KDEEYKKNNKYI

SEQ ID NO: 3224691 - protein, 4 aa, Plasmodium falciparum
KDEF

SEQ ID NO: 3224692 - protein, 9 aa, Plasmodium falciparum
KDEFKKQEK

SEQ ID NO: 3224693 - protein, 27 aa, Plasmodium falciparum
KDEFTEQKNAYSKQKEKCKEGSESSKQ

SEQ ID NO: 3224694 - protein, 28 aa, Plasmodium falciparum
KDEFTKHSNAYGDQKAKCQAKSGGGGNG

SEQ ID NO: 3224695 - protein, 14 aa, Plasmodium falciparum
KDEGENEHYSDSEE

SEQ ID NO: 3224696 - protein, 6 aa, Plasmodium falciparum
KDEGVT

SEQ ID NO: 3224697 - protein, 17 aa, Plasmodium falciparum
KDEHEQDQYRRKKQNRY

SEQ ID NO: 3224698 - protein, 8 aa, Plasmodium falciparum
KDEHSSER

SEQ ID NO: 3224699 - protein, 6 aa, Plasmodium falciparum
KDEIAS

SEQ ID NO: 3224700 - protein, 18 aa, Plasmodium falciparum
KDEIEEEEKKKKIIEEKE

SEQ ID NO: 3224701 - protein, 6 aa, Plasmodium falciparum
KDEISK

SEQ ID NO: 3224702 - protein, 4 aa, Plasmodium falciparum
KDEK

SEQ ID NO: 3224703 - protein, 6 aa, Plasmodium falciparum
KDEKCK

SEQ ID NO: 3224704 - protein, 8 aa, Plasmodium falciparum
KDEKDEIL

SEQ ID NO: 3224705 - protein, 7 aa, Plasmodium falciparum
KDEKDIN

SEQ ID NO: 3224706 - protein, 7 aa, Plasmodium falciparum
KDEKEKE

SEQ ID NO: 3224707 - protein, 5 aa, Plasmodium falciparum
KDEKI

SEQ ID NO: 3224708 - protein, 14 aa, Plasmodium falciparum
KDEKIGNIPSNTNM

SEQ ID NO: 3224709 - protein, 28 aa, Plasmodium falciparum
KDEKKNKKEYASNYSHSRTSSNMSSCSS

SEQ ID NO: 3224710 - protein, 12 aa, Plasmodium falciparum
KDEKKNNQSNSM

SEQ ID NO: 3224711 - protein, 7 aa, Plasmodium falciparum
KDEKKNR

SEQ ID NO: 3224712 - protein, 52 aa, Plasmodium falciparum
KDEKLNNDKDSTIQSVAEPTNTTTENNHNQNNNHNNNNIHNNNHNNNHNNHN

SEQ ID NO: 3224713 - protein, 6 aa, Plasmodium falciparum
KDEKMG

SEQ ID NO: 3224714 - protein, 10 aa, Plasmodium falciparum
KDEKNNDTNK

SEQ ID NO: 3224715 - protein, 10 aa, Plasmodium falciparum
KDEKNNQNDV

SEQ ID NO: 3224716 - protein, 6 aa, Plasmodium falciparum
KDEKNY

SEQ ID NO: 3224717 - protein, 7 aa, Plasmodium falciparum
KDEKNYK

SEQ ID NO: 3224718 - protein, 5 aa, Plasmodium falciparum
KDEKR

SEQ ID NO: 3224719 - protein, 19 aa, Plasmodium falciparum
KDEKRSLSASPKKKKKKKK

SEQ ID NO: 3224720 - protein, 8 aa, Plasmodium falciparum
KDEKSNKC

SEQ ID NO: 3224721 - protein, 23 aa, Plasmodium falciparum
KDEKVKGEKKMNKTNNIEKGKDN

SEQ ID NO: 3224722 - protein, 33 aa, Plasmodium falciparum
KDEKYKQEYEEEKEIYDNTNTSQEKNETNNEQN

SEQ ID NO: 3224723 - protein, 24 aa, Plasmodium falciparum
KDEKYNTDNINDNSFESYSSGTNI

SEQ ID NO: 3224724 - protein, 5 aa, Plasmodium falciparum
KDEMD

SEQ ID NO: 3224725 - protein, 7 aa, Plasmodium falciparum
KDENEDT

SEQ ID NO: 3224726 - protein, 15 aa, Plasmodium falciparum
KDENETLNEKKVDDT

SEQ ID NO: 3224727 - protein, 10 aa, Plasmodium falciparum
KDENGKKKGN

SEQ ID NO: 3224728 - protein, 17 aa, Plasmodium falciparum
KDENKKGSKTKKLDPQI

SEQ ID NO: 3224729 - protein, 20 aa, Plasmodium falciparum
KDENKLGGHNFGKNKKKDLN

SEQ ID NO: 3224730 - protein, 7 aa, Plasmodium falciparum
KDENKNI

SEQ ID NO: 3224731 - protein, 5 aa, Plasmodium falciparum
KDENL

SEQ ID NO: 3224732 - protein, 21 aa, Plasmodium falciparum
KDENNNNNNNNNNVEKTNPYA

SEQ ID NO: 3224733 - protein, 106 aa, Plasmodium falciparum
KDENSEDDQDDDLNDQNDDPINNPTNNLTDNPTNNSTDNPTNNSIDNPTNNSIDNPTNNSIDNPTNNSIDNPTNNSIDNPTNNSIDNPTNNSTDNPINSPNYQQVT

SEQ ID NO: 3224734 - protein, 30 aa, Plasmodium falciparum
KDENSGTEGAKPFTPKTVSSSSGEKNPPKL

SEQ ID NO: 3224735 - protein, 17 aa, Plasmodium falciparum
KDENSGTQAKSNDDTKL

SEQ ID NO: 3224736 - protein, 11 aa, Plasmodium falciparum
KDEPKVKEETI

SEQ ID NO: 3224737 - protein, 11 aa, Plasmodium falciparum
KDEPVDDNTSN

SEQ ID NO: 3224738 - protein, 12 aa, Plasmodium falciparum
KDEPVQKEVEKE

SEQ ID NO: 3224739 - protein, 16 aa, Plasmodium falciparum
KDEQQEGVVNNTEQNL

SEQ ID NO: 3224740 - protein, 15 aa, Plasmodium falciparum
KDEQSGGDSTLNNPK

SEQ ID NO: 3224741 - protein, 6 aa, Plasmodium falciparum
KDEQTN

SEQ ID NO: 3224742 - protein, 32 aa, Plasmodium falciparum
KDEQTQNKKDKHNQDDVEDVDSDNKKEEEQNI

SEQ ID NO: 3224743 - protein, 14 aa, Plasmodium falciparum
KDERDRKRRNQEKY

SEQ ID NO: 3224744 - protein, 5 aa, Plasmodium falciparum
KDERS

SEQ ID NO: 3224745 - protein, 9 aa, Plasmodium falciparum
KDERYGETI

SEQ ID NO: 3224746 - protein, 12 aa, Plasmodium falciparum
KDESNKKKKNKL

SEQ ID NO: 3224747 - protein, 6 aa, Plasmodium falciparum
KDESRK

SEQ ID NO: 3224748 - protein, 25 aa, Plasmodium falciparum
KDESSETQDKTNESTSAASSDTPTL

SEQ ID NO: 3224749 - protein, 8 aa, Plasmodium falciparum
KDETNEQN

SEQ ID NO: 3224750 - protein, 6 aa, Plasmodium falciparum
KDETRN

SEQ ID NO: 3224751 - protein, 5 aa, Plasmodium falciparum
KDEWE

SEQ ID NO: 3224752 - protein, 7 aa, Plasmodium falciparum
KDEWEEH

SEQ ID NO: 3224753 - protein, 21 aa, Plasmodium falciparum
KDEYDDKSDNKISESFSSSTN

SEQ ID NO: 3224754 - protein, 6 aa, Plasmodium falciparum
KDEYED

SEQ ID NO: 3224755 - protein, 15 aa, Plasmodium falciparum
KDEYEGCEKEKNGKC

SEQ ID NO: 3224756 - protein, 5 aa, Plasmodium falciparum
KDEYI

SEQ ID NO: 3224757 - protein, 6 aa, Plasmodium falciparum
KDEYNK

SEQ ID NO: 3224758 - protein, 31 aa, Plasmodium falciparum
KDEYNKQKSAYNEQKTKYENGNNKGGGGNGV

SEQ ID NO: 3224759 - protein, 6 aa, Plasmodium falciparum
KDEYTQ

SEQ ID NO: 3224760 - protein, 16 aa, Plasmodium falciparum
KDEYTYTTNDEHNNHK

SEQ ID NO: 3224761 - protein, 15 aa, Plasmodium falciparum
KDEYYNDENNVSVET

SEQ ID NO: 3224762 - protein, 10 aa, Plasmodium falciparum
KDFGCPNTRT

SEQ ID NO: 3224763 - protein, 70 aa, Plasmodium falciparum
KDFKDEGEDESEEKSENENVDKSEEDDNDDDEEEENTSEGYSGEKKNTNYDNHNVNDKEGLNKSGDDNSY

SEQ ID NO: 3224764 - protein, 13 aa, Plasmodium falciparum
KDFPKENKKKKKS

SEQ ID NO: 3224765 - protein, 6 aa, Plasmodium falciparum
KDFRKE

SEQ ID NO: 3224766 - protein, 4 aa, Plasmodium falciparum
KDFS

SEQ ID NO: 3224767 - protein, 6 aa, Plasmodium falciparum
KDFSSK

SEQ ID NO: 3224768 - protein, 13 aa, Plasmodium falciparum
KDFSYDEKKSKYN

SEQ ID NO: 3224769 - protein, 13 aa, Plasmodium falciparum
KDGDSTKEKNDFI

SEQ ID NO: 3224770 - protein, 14 aa, Plasmodium falciparum
KDGEEGKSPQVDTT

SEQ ID NO: 3224771 - protein, 7 aa, Plasmodium falciparum
KDGERDD

SEQ ID NO: 3224772 - protein, 8 aa, Plasmodium falciparum
KDGETEDC

SEQ ID NO: 3224773 - protein, 19 aa, Plasmodium falciparum
KDGGEGKKIEKVNDANGDD

SEQ ID NO: 3224774 - protein, 8 aa, Plasmodium falciparum
KDGGEIKT

SEQ ID NO: 3224775 - protein, 27 aa, Plasmodium falciparum
KDGGNKEGHAENESKEYESQTEQTHEE

SEQ ID NO: 3224776 - protein, 6 aa, Plasmodium falciparum
KDGIHR

SEQ ID NO: 3224777 - protein, 59 aa, Plasmodium falciparum
KDGINRDDNINEGDNINRDDNINEGDNINKGDNINKGDNINKGDNINKGDNINKDGYIN

SEQ ID NO: 3224778 - protein, 13 aa, Plasmodium falciparum
KDGKDDTDKDNEL

SEQ ID NO: 3224779 - protein, 8 aa, Plasmodium falciparum
KDGKQSES

SEQ ID NO: 3224780 - protein, 9 aa, Plasmodium falciparum
KDGKYKKSI

SEQ ID NO: 3224781 - protein, 10 aa, Plasmodium falciparum
KDGNNERVNN

SEQ ID NO: 3224782 - protein, 10 aa, Plasmodium falciparum
KDGNPKNPQY

SEQ ID NO: 3224783 - protein, 52 aa, Plasmodium falciparum
KDGPNNDNRVDANDKNVNGNDKNVNDNDKNVNSQDNQGNQKDHFDDEDEEYF

SEQ ID NO: 3224784 - protein, 7 aa, Plasmodium falciparum
KDGQENI

SEQ ID NO: 3224785 - protein, 8 aa, Plasmodium falciparum
KDGQNDSC

SEQ ID NO: 3224786 - protein, 23 aa, Plasmodium falciparum
KDGQNSEDDTDKSEEDKKNNKID

SEQ ID NO: 3224787 - protein, 18 aa, Plasmodium falciparum
KDGQTGGEKKSNDQDNKI

SEQ ID NO: 3224788 - protein, 21 aa, Plasmodium falciparum
KDGQTGGEKNKTHFENPETTF

SEQ ID NO: 3224789 - protein, 15 aa, Plasmodium falciparum
KDGQTSEEKDNDNKI

SEQ ID NO: 3224790 - protein, 5 aa, Plasmodium falciparum
KDGRI

SEQ ID NO: 3224791 - protein, 14 aa, Plasmodium falciparum
KDGSKSPSGTTTPQ

SEQ ID NO: 3224792 - protein, 8 aa, Plasmodium falciparum
KDGTIPDD

SEQ ID NO: 3224793 - protein, 7 aa, Plasmodium falciparum
KDGTKQK

SEQ ID NO: 3224794 - protein, 9 aa, Plasmodium falciparum
KDGTNTQHT

SEQ ID NO: 3224795 - protein, 7 aa, Plasmodium falciparum
KDGTYCS

SEQ ID NO: 3224796 - protein, 5 aa, Plasmodium falciparum
KDGYG

SEQ ID NO: 3224797 - protein, 10 aa, Plasmodium falciparum
KDGYGNAKEL

SEQ ID NO: 3224798 - protein, 11 aa, Plasmodium falciparum
KDGYPKENSYE

SEQ ID NO: 3224799 - protein, 7 aa, Plasmodium falciparum
KDHETSR

SEQ ID NO: 3224800 - protein, 12 aa, Plasmodium falciparum
KDHGGSTRTVGG

SEQ ID NO: 3224801 - protein, 5 aa, Plasmodium falciparum
KDHGM

SEQ ID NO: 3224802 - protein, 6 aa, Plasmodium falciparum
KDHIDS

SEQ ID NO: 3224803 - protein, 6 aa, Plasmodium falciparum
KDHKKE

SEQ ID NO: 3224804 - protein, 10 aa, Plasmodium falciparum
KDHKPNCAAE

SEQ ID NO: 3224805 - protein, 24 aa, Plasmodium falciparum
KDHSNATHNYPQGPCHGKNNDKSM

SEQ ID NO: 3224806 - protein, 15 aa, Plasmodium falciparum
KDHSTNSDKYSTAGR

SEQ ID NO: 3224807 - protein, 19 aa, Plasmodium falciparum
KDHTKDDTKDHMKDHTKDH

SEQ ID NO: 3224808 - protein, 4 aa, Plasmodium falciparum
KDID

SEQ ID NO: 3224809 - protein, 14 aa, Plasmodium falciparum
KDIDKKKNKKKSVK

SEQ ID NO: 3224810 - protein, 14 aa, Plasmodium falciparum
KDIDNGEDNKINFN

SEQ ID NO: 3224811 - protein, 8 aa, Plasmodium falciparum
KDIDNSSV

SEQ ID NO: 3224812 - protein, 6 aa, Plasmodium falciparum
KDIDRK

SEQ ID NO: 3224813 - protein, 4 aa, Plasmodium falciparum
KDIE

SEQ ID NO: 3224814 - protein, 13 aa, Plasmodium falciparum
KDIEEEKSTTQEI

SEQ ID NO: 3224815 - protein, 8 aa, Plasmodium falciparum
KDIEKGKV

SEQ ID NO: 3224816 - protein, 7 aa, Plasmodium falciparum
KDIETKG

SEQ ID NO: 3224817 - protein, 41 aa, Plasmodium falciparum
KDIHEKDDAYEDITEENKNKIEQNHKKKEKKKDNNKNNSSI

SEQ ID NO: 3224818 - protein, 4 aa, Plasmodium falciparum
KDII

SEQ ID NO: 3224819 - protein, 37 aa, Plasmodium falciparum
KDIKENDADDDVREKKKNYKNIEEQKIDEEKKKYIKT

SEQ ID NO: 3224820 - protein, 6 aa, Plasmodium falciparum
KDINGI

SEQ ID NO: 3224821 - protein, 56 aa, Plasmodium falciparum
KDINKDKEIKTKETNIEEEEEVEEEEVEEEEEEEEEEEEEEEKEEKEEEEEQEEQF

SEQ ID NO: 3224822 - protein, 6 aa, Plasmodium falciparum
KDINKE

SEQ ID NO: 3224823 - protein, 12 aa, Plasmodium falciparum
KDINKEKKSLKK

SEQ ID NO: 3224824 - protein, 13 aa, Plasmodium falciparum
KDINKKDKPNVVE

SEQ ID NO: 3224825 - protein, 14 aa, Plasmodium falciparum
KDINKNDNIESNHQ

SEQ ID NO: 3224826 - protein, 6 aa, Plasmodium falciparum
KDINNC

SEQ ID NO: 3224827 - protein, 7 aa, Plasmodium falciparum
KDINNDG

SEQ ID NO: 3224828 - protein, 9 aa, Plasmodium falciparum
KDINNEPNN

SEQ ID NO: 3224829 - protein, 33 aa, Plasmodium falciparum
KDINNITSASGNRHNNIERDKNNIQTNKTSNNF

SEQ ID NO: 3224830 - protein, 6 aa, Plasmodium falciparum
KDINNS

SEQ ID NO: 3224831 - protein, 6 aa, Plasmodium falciparum
KDINRQ

SEQ ID NO: 3224832 - protein, 7 aa, Plasmodium falciparum
KDIPQYE

SEQ ID NO: 3224833 - protein, 5 aa, Plasmodium falciparum
KDIQA

SEQ ID NO: 3224834 - protein, 8 aa, Plasmodium falciparum
KDIQGFDP

SEQ ID NO: 3224835 - protein, 4 aa, Plasmodium falciparum
KDIR

SEQ ID NO: 3224836 - protein, 4 aa, Plasmodium falciparum
KDIS

SEQ ID NO: 3224837 - protein, 6 aa, Plasmodium falciparum
KDISKH

SEQ ID NO: 3224838 - protein, 7 aa, Plasmodium falciparum
KDISNER

SEQ ID NO: 3224839 - protein, 19 aa, Plasmodium falciparum
KDISNESQDDTNNYTDHDN

SEQ ID NO: 3224840 - protein, 21 aa, Plasmodium falciparum
KDISNNNDEEDNMSNENNTTY

SEQ ID NO: 3224841 - protein, 32 aa, Plasmodium falciparum
KDISNYANGGMSNNKNDTSHSEKNESYDNSHD

SEQ ID NO: 3224842 - protein, 36 aa, Plasmodium falciparum
KDISQNDKISNMKNNNNNYDNYDNTYRGGDVSNSDI

SEQ ID NO: 3224843 - protein, 17 aa, Plasmodium falciparum
KDISTRQLQNNHNNNIN

SEQ ID NO: 3224844 - protein, 41 aa, Plasmodium falciparum
KDITKKKNKNVKKNKNVKKNKNLKKNKNLKKNKNLKKNKES

SEQ ID NO: 3224845 - protein, 5 aa, Plasmodium falciparum
KDITN

SEQ ID NO: 3224846 - protein, 5 aa, Plasmodium falciparum
KDITS

SEQ ID NO: 3224847 - protein, 4 aa, Plasmodium falciparum
KDIY

SEQ ID NO: 3224848 - protein, 5 aa, Plasmodium falciparum
KDIYD

SEQ ID NO: 3224849 - protein, 4 aa, Plasmodium falciparum
KDKA

SEQ ID NO: 3224850 - protein, 13 aa, Plasmodium falciparum
KDKATDIYNKHNS

SEQ ID NO: 3224851 - protein, 7 aa, Plasmodium falciparum
KDKCKGK

SEQ ID NO: 3224852 - protein, 5 aa, Plasmodium falciparum
KDKDE

SEQ ID NO: 3224853 - protein, 13 aa, Plasmodium falciparum
KDKDEKKRKNDNL

SEQ ID NO: 3224854 - protein, 8 aa, Plasmodium falciparum
KDKDEMRN

SEQ ID NO: 3224855 - protein, 7 aa, Plasmodium falciparum
KDKDINS

SEQ ID NO: 3224856 - protein, 20 aa, Plasmodium falciparum
KDKDKDTKENQNNNKNKKIQ

SEQ ID NO: 3224857 - protein, 18 aa, Plasmodium falciparum
KDKDKNKNKDKNKNKENI

SEQ ID NO: 3224858 - protein, 6 aa, Plasmodium falciparum
KDKDKY

SEQ ID NO: 3224859 - protein, 16 aa, Plasmodium falciparum
KDKECEKVDDEEGGKI

SEQ ID NO: 3224860 - protein, 8 aa, Plasmodium falciparum
KDKEDYEH

SEQ ID NO: 3224861 - protein, 9 aa, Plasmodium falciparum
KDKEEKENI

SEQ ID NO: 3224862 - protein, 14 aa, Plasmodium falciparum
KDKEEKKNVKDDLK

SEQ ID NO: 3224863 - protein, 7 aa, Plasmodium falciparum
KDKEGGL

SEQ ID NO: 3224864 - protein, 10 aa, Plasmodium falciparum
KDKEHGSCMP

SEQ ID NO: 3224865 - protein, 152 aa, Plasmodium falciparum
KDKEKKKKKESRDKIRRGEEEKMSADENMKEEQKMREEQKVGEEQKVGEEQKVGEEQKLREEQKMREEQKMREEQKMREEQKMREEQKVREEQKMREEQKMREEQKMREEQKVREEQKLREEQKMREEQKMREEQKMREEEKIREEEQMKRE

SEQ ID NO: 3224866 - protein, 13 aa, Plasmodium falciparum
KDKEKKKKPQQQH

SEQ ID NO: 3224867 - protein, 11 aa, Plasmodium falciparum
KDKEKKNTRQT

SEQ ID NO: 3224868 - protein, 43 aa, Plasmodium falciparum
KDKEKLEEQQRQRENGELPGLSSSGDGDSNDPQSKLEKGEIPD

SEQ ID NO: 3224869 - protein, 7 aa, Plasmodium falciparum
KDKEKNN

SEQ ID NO: 3224870 - protein, 11 aa, Plasmodium falciparum
KDKENFDKKKN

SEQ ID NO: 3224871 - protein, 8 aa, Plasmodium falciparum
KDKENNVI

SEQ ID NO: 3224872 - protein, 16 aa, Plasmodium falciparum
KDKENSERQKHGLPPD

SEQ ID NO: 3224873 - protein, 9 aa, Plasmodium falciparum
KDKGGSNDL

SEQ ID NO: 3224874 - protein, 22 aa, Plasmodium falciparum
KDKGNDDKRNDNVKNDDEMNNH

SEQ ID NO: 3224875 - protein, 37 aa, Plasmodium falciparum
KDKHNKKNSDIKNVSTDKKKENDNNKKNNNNKKNNKK

SEQ ID NO: 3224876 - protein, 19 aa, Plasmodium falciparum
KDKIANPNMSGNSDIYNNS

SEQ ID NO: 3224877 - protein, 19 aa, Plasmodium falciparum
KDKIGNDNKGGNRTTAEDN

SEQ ID NO: 3224878 - protein, 6 aa, Plasmodium falciparum
KDKIKD

SEQ ID NO: 3224879 - protein, 6 aa, Plasmodium falciparum
KDKINL

SEQ ID NO: 3224880 - protein, 9 aa, Plasmodium falciparum
KDKISKDSV

SEQ ID NO: 3224881 - protein, 16 aa, Plasmodium falciparum
KDKISNDKEDNIVPPE

SEQ ID NO: 3224882 - protein, 9 aa, Plasmodium falciparum
KDKKDENVK

SEQ ID NO: 3224883 - protein, 8 aa, Plasmodium falciparum
KDKKECNN

SEQ ID NO: 3224884 - protein, 9 aa, Plasmodium falciparum
KDKKGYVNN

SEQ ID NO: 3224885 - protein, 13 aa, Plasmodium falciparum
KDKKIENKKDDLI

SEQ ID NO: 3224886 - protein, 10 aa, Plasmodium falciparum
KDKKIKGENF

SEQ ID NO: 3224887 - protein, 19 aa, Plasmodium falciparum
KDKKIKINNNNNNNNNNKN

SEQ ID NO: 3224888 - protein, 10 aa, Plasmodium falciparum
KDKKKPHNRL

SEQ ID NO: 3224889 - protein, 9 aa, Plasmodium falciparum
KDKKKRNIK

SEQ ID NO: 3224890 - protein, 7 aa, Plasmodium falciparum
KDKKNDL

SEQ ID NO: 3224891 - protein, 9 aa, Plasmodium falciparum
KDKKNRKEL

SEQ ID NO: 3224892 - protein, 9 aa, Plasmodium falciparum
KDKKYSSFK

SEQ ID NO: 3224893 - protein, 13 aa, Plasmodium falciparum
KDKLDSGKRKMND

SEQ ID NO: 3224894 - protein, 5 aa, Plasmodium falciparum
KDKMN

SEQ ID NO: 3224895 - protein, 12 aa, Plasmodium falciparum
KDKMSNMPNSNA

SEQ ID NO: 3224896 - protein, 4 aa, Plasmodium falciparum
KDKN

SEQ ID NO: 3224897 - protein, 41 aa, Plasmodium falciparum
KDKNDKNDKNDKTHMKDNSNLENKEKGEIGKDKEQKEKEKE

SEQ ID NO: 3224898 - protein, 7 aa, Plasmodium falciparum
KDKNEEI

SEQ ID NO: 3224899 - protein, 5 aa, Plasmodium falciparum
KDKNG

SEQ ID NO: 3224900 - protein, 8 aa, Plasmodium falciparum
KDKNNESI

SEQ ID NO: 3224901 - protein, 15 aa, Plasmodium falciparum
KDKNNNNNNNNNNNL

SEQ ID NO: 3224902 - protein, 9 aa, Plasmodium falciparum
KDKNQSDEH

SEQ ID NO: 3224903 - protein, 7 aa, Plasmodium falciparum
KDKNSKD

SEQ ID NO: 3224904 - protein, 9 aa, Plasmodium falciparum
KDKNTDPWK

SEQ ID NO: 3224905 - protein, 17 aa, Plasmodium falciparum
KDKNVDAEKKLEQGEIP

SEQ ID NO: 3224906 - protein, 12 aa, Plasmodium falciparum
KDKQHSNTYNDN

SEQ ID NO: 3224907 - protein, 6 aa, Plasmodium falciparum
KDKQNV

SEQ ID NO: 3224908 - protein, 11 aa, Plasmodium falciparum
KDKREKSLEEK

SEQ ID NO: 3224909 - protein, 6 aa, Plasmodium falciparum
KDKRGY

SEQ ID NO: 3224910 - protein, 14 aa, Plasmodium falciparum
KDKRQKRKEERDKN

SEQ ID NO: 3224911 - protein, 8 aa, Plasmodium falciparum
KDKRRSNK

SEQ ID NO: 3224912 - protein, 7 aa, Plasmodium falciparum
KDKRRYT

SEQ ID NO: 3224913 - protein, 6 aa, Plasmodium falciparum
KDKSDS

SEQ ID NO: 3224914 - protein, 10 aa, Plasmodium falciparum
KDKSGNISNE

SEQ ID NO: 3224915 - protein, 13 aa, Plasmodium falciparum
KDKSIKKRENAFQ

SEQ ID NO: 3224916 - protein, 5 aa, Plasmodium falciparum
KDKSK

SEQ ID NO: 3224917 - protein, 8 aa, Plasmodium falciparum
KDKSQGEH

SEQ ID NO: 3224918 - protein, 24 aa, Plasmodium falciparum
KDKSRDDNKAQNNNSTDNEEHDEI

SEQ ID NO: 3224919 - protein, 9 aa, Plasmodium falciparum
KDKSSIDEH

SEQ ID NO: 3224920 - protein, 7 aa, Plasmodium falciparum
KDKTFGH

SEQ ID NO: 3224921 - protein, 12 aa, Plasmodium falciparum
KDKTFGPSPNCK

SEQ ID NO: 3224922 - protein, 6 aa, Plasmodium falciparum
KDKTKK

SEQ ID NO: 3224923 - protein, 22 aa, Plasmodium falciparum
KDKTKKKETLGEQAEKYRAKNE

SEQ ID NO: 3224924 - protein, 10 aa, Plasmodium falciparum
KDKTNQGNIG

SEQ ID NO: 3224925 - protein, 8 aa, Plasmodium falciparum
KDKTSPGY

SEQ ID NO: 3224926 - protein, 7 aa, Plasmodium falciparum
KDKWKSE

SEQ ID NO: 3224927 - protein, 4 aa, Plasmodium falciparum
KDKY

SEQ ID NO: 3224928 - protein, 8 aa, Plasmodium falciparum
KDKYDKEI

SEQ ID NO: 3224929 - protein, 9 aa, Plasmodium falciparum
KDKYESRDN

SEQ ID NO: 3224930 - protein, 30 aa, Plasmodium falciparum
KDKYIEPKENIKKKKEEIKKNEITKKHEIN

SEQ ID NO: 3224931 - protein, 15 aa, Plasmodium falciparum
KDKYKDDDKATPKYK

SEQ ID NO: 3224932 - protein, 14 aa, Plasmodium falciparum
KDKYSPSDHEKQNS

SEQ ID NO: 3224933 - protein, 7 aa, Plasmodium falciparum
KDKYSYD

SEQ ID NO: 3224934 - protein, 9 aa, Plasmodium falciparum
KDLDGKLNE

SEQ ID NO: 3224935 - protein, 5 aa, Plasmodium falciparum
KDLEK

SEQ ID NO: 3224936 - protein, 11 aa, Plasmodium falciparum
KDLEKGTKQLN

SEQ ID NO: 3224937 - protein, 7 aa, Plasmodium falciparum
KDLEKNK

SEQ ID NO: 3224938 - protein, 14 aa, Plasmodium falciparum
KDLHKSTKAYKKMD

SEQ ID NO: 3224939 - protein, 13 aa, Plasmodium falciparum
KDLKEKKRKRPRS

SEQ ID NO: 3224940 - protein, 15 aa, Plasmodium falciparum
KDLKNSEQSKDSNDL

SEQ ID NO: 3224941 - protein, 10 aa, Plasmodium falciparum
KDLKTNSNNY

SEQ ID NO: 3224942 - protein, 99 aa, Plasmodium falciparum
KDLNQNNKDDVNQNNEDDVNQNNENDVNQNNEDDVNQNNEKDVNQNNKEDVNQNNKDDVNQNNENDVNQNNENDVNQNNENDVNKNNENDVNQNNNSNI

SEQ ID NO: 3224943 - protein, 12 aa, Plasmodium falciparum
KDLPNKDKNEVS

SEQ ID NO: 3224944 - protein, 8 aa, Plasmodium falciparum
KDLSKEEN

SEQ ID NO: 3224945 - protein, 9 aa, Plasmodium falciparum
KDLSKRENH

SEQ ID NO: 3224946 - protein, 8 aa, Plasmodium falciparum
KDLSNDHT

SEQ ID NO: 3224947 - protein, 14 aa, Plasmodium falciparum
KDLSPKKAYDDDNY

SEQ ID NO: 3224948 - protein, 10 aa, Plasmodium falciparum
KDLSSDCSNE

SEQ ID NO: 3224949 - protein, 12 aa, Plasmodium falciparum
KDLTGKGSSEKS

SEQ ID NO: 3224950 - protein, 11 aa, Plasmodium falciparum
KDMDNNKNKNK

SEQ ID NO: 3224951 - protein, 18 aa, Plasmodium falciparum
KDMNNSEDWSKRKVPKNT

SEQ ID NO: 3224952 - protein, 6 aa, Plasmodium falciparum
KDMNQN

SEQ ID NO: 3224953 - protein, 5 aa, Plasmodium falciparum
KDMYE

SEQ ID NO: 3224954 - protein, 6 aa, Plasmodium falciparum
KDMYNN

SEQ ID NO: 3224955 - protein, 8 aa, Plasmodium falciparum
KDNAPSTN

SEQ ID NO: 3224956 - protein, 8 aa, Plasmodium falciparum
KDNASQNF

SEQ ID NO: 3224957 - protein, 4 aa, Plasmodium falciparum
KDND

SEQ ID NO: 3224958 - protein, 14 aa, Plasmodium falciparum
KDNDAKGQTPTQIQ

SEQ ID NO: 3224959 - protein, 10 aa, Plasmodium falciparum
KDNDDSFNSE

SEQ ID NO: 3224960 - protein, 7 aa, Plasmodium falciparum
KDNDELK

SEQ ID NO: 3224961 - protein, 6 aa, Plasmodium falciparum
KDNDES

SEQ ID NO: 3224962 - protein, 5 aa, Plasmodium falciparum
KDNDI

SEQ ID NO: 3224963 - protein, 6 aa, Plasmodium falciparum
KDNDIN

SEQ ID NO: 3224964 - protein, 8 aa, Plasmodium falciparum
KDNDINNN

SEQ ID NO: 3224965 - protein, 10 aa, Plasmodium falciparum
KDNDMDDEGE

SEQ ID NO: 3224966 - protein, 13 aa, Plasmodium falciparum
KDNDNTCKNSCKR

SEQ ID NO: 3224967 - protein, 11 aa, Plasmodium falciparum
KDNDTNFKSED

SEQ ID NO: 3224968 - protein, 19 aa, Plasmodium falciparum
KDNEHIQKDTSDDSSDTTL

SEQ ID NO: 3224969 - protein, 5 aa, Plasmodium falciparum
KDNEK

SEQ ID NO: 3224970 - protein, 6 aa, Plasmodium falciparum
KDNEKR

SEQ ID NO: 3224971 - protein, 6 aa, Plasmodium falciparum
KDNENM

SEQ ID NO: 3224972 - protein, 8 aa, Plasmodium falciparum
KDNENNYE

SEQ ID NO: 3224973 - protein, 9 aa, Plasmodium falciparum
KDNEVSQCG

SEQ ID NO: 3224974 - protein, 5 aa, Plasmodium falciparum
KDNFD

SEQ ID NO: 3224975 - protein, 15 aa, Plasmodium falciparum
KDNFKEDDDSTLDTS

SEQ ID NO: 3224976 - protein, 7 aa, Plasmodium falciparum
KDNFNEA

SEQ ID NO: 3224977 - protein, 4 aa, Plasmodium falciparum
KDNG

SEQ ID NO: 3224978 - protein, 14 aa, Plasmodium falciparum
KDNGDKGKPQVDDT

SEQ ID NO: 3224979 - protein, 9 aa, Plasmodium falciparum
KDNGEEDIN

SEQ ID NO: 3224980 - protein, 8 aa, Plasmodium falciparum
KDNGEKKI

SEQ ID NO: 3224981 - protein, 12 aa, Plasmodium falciparum
KDNGLKNEELDD

SEQ ID NO: 3224982 - protein, 13 aa, Plasmodium falciparum
KDNGLNDLKDKET

SEQ ID NO: 3224983 - protein, 7 aa, Plasmodium falciparum
KDNGNNK

SEQ ID NO: 3224984 - protein, 4 aa, Plasmodium falciparum
KDNH

SEQ ID NO: 3224985 - protein, 10 aa, Plasmodium falciparum
KDNIGKESDK

SEQ ID NO: 3224986 - protein, 15 aa, Plasmodium falciparum
KDNIHNDKYKDPHTY

SEQ ID NO: 3224987 - protein, 7 aa, Plasmodium falciparum
KDNINHD

SEQ ID NO: 3224988 - protein, 6 aa, Plasmodium falciparum
KDNISA

SEQ ID NO: 3224989 - protein, 18 aa, Plasmodium falciparum
KDNKESEKKGLKKTKEIN

SEQ ID NO: 3224990 - protein, 12 aa, Plasmodium falciparum
KDNKHDHNQANI

SEQ ID NO: 3224991 - protein, 8 aa, Plasmodium falciparum
KDNKIDDI

SEQ ID NO: 3224992 - protein, 23 aa, Plasmodium falciparum
KDNKKNVQYNNNDVKKTNPNITK

SEQ ID NO: 3224993 - protein, 7 aa, Plasmodium falciparum
KDNKKYD

SEQ ID NO: 3224994 - protein, 8 aa, Plasmodium falciparum
KDNKLNHV

SEQ ID NO: 3224995 - protein, 10 aa, Plasmodium falciparum
KDNKNELRAS

SEQ ID NO: 3224996 - protein, 7 aa, Plasmodium falciparum
KDNKNNN

SEQ ID NO: 3224997 - protein, 5 aa, Plasmodium falciparum
KDNKT

SEQ ID NO: 3224998 - protein, 7 aa, Plasmodium falciparum
KDNKYSS

SEQ ID NO: 3224999 - protein, 6 aa, Plasmodium falciparum
KDNLKN

SEQ ID NO: 3225000 - protein, 6 aa, Plasmodium falciparum
KDNMNN

SEQ ID NO: 3225001 - protein, 15 aa, Plasmodium falciparum
KDNMNNNDDNNNVKK

SEQ ID NO: 3225002 - protein, 26 aa, Plasmodium falciparum
KDNNDKPGTTGTNTGTTGTPTGTYND

SEQ ID NO: 3225003 - protein, 7 aa, Plasmodium falciparum
KDNNEYK

SEQ ID NO: 3225004 - protein, 16 aa, Plasmodium falciparum
KDNNFKRRGGEKGRRN

SEQ ID NO: 3225005 - protein, 8 aa, Plasmodium falciparum
KDNNGYHA

SEQ ID NO: 3225006 - protein, 46 aa, Plasmodium falciparum
KDNNHVKDKNNVDDKNNVDDKNNVDDKNNVDDNNHVDDNNHVDDNN

SEQ ID NO: 3225007 - protein, 14 aa, Plasmodium falciparum
KDNNKNCETNNKEE

SEQ ID NO: 3225008 - protein, 20 aa, Plasmodium falciparum
KDNNKNNNDYINNNPYDDRM

SEQ ID NO: 3225009 - protein, 6 aa, Plasmodium falciparum
KDNNKV

SEQ ID NO: 3225010 - protein, 24 aa, Plasmodium falciparum
KDNNNNNNKNNPSFNSDISNTRKL

SEQ ID NO: 3225011 - protein, 12 aa, Plasmodium falciparum
KDNNNNNNNNKY

SEQ ID NO: 3225012 - protein, 8 aa, Plasmodium falciparum
KDNNREME

SEQ ID NO: 3225013 - protein, 8 aa, Plasmodium falciparum
KDNNSDQN

SEQ ID NO: 3225014 - protein, 8 aa, Plasmodium falciparum
KDNNSELH

SEQ ID NO: 3225015 - protein, 16 aa, Plasmodium falciparum
KDNNTEDTIKQNENIE

SEQ ID NO: 3225016 - protein, 27 aa, Plasmodium falciparum
KDNNTNEACETSRNRKTNPCAKPHGKK

SEQ ID NO: 3225017 - protein, 20 aa, Plasmodium falciparum
KDNNTNNNNNNSNNNAEHVN

SEQ ID NO: 3225018 - protein, 9 aa, Plasmodium falciparum
KDNNYKYKN

SEQ ID NO: 3225019 - protein, 82 aa, Plasmodium falciparum
KDNPNDNNKTLENNKTLENNKTLENNKTLENNKTLENNKTLENNKTLENNKTLENNKTLENDKTFENNKTFENNKTFENDKT

SEQ ID NO: 3225020 - protein, 8 aa, Plasmodium falciparum
KDNPNGNY

SEQ ID NO: 3225021 - protein, 15 aa, Plasmodium falciparum
KDNQHTSTKKKIQKK

SEQ ID NO: 3225022 - protein, 7 aa, Plasmodium falciparum
KDNQKGS

SEQ ID NO: 3225023 - protein, 7 aa, Plasmodium falciparum
KDNQNCN

SEQ ID NO: 3225024 - protein, 6 aa, Plasmodium falciparum
KDNQSS

SEQ ID NO: 3225025 - protein, 14 aa, Plasmodium falciparum
KDNREKKNKNSDNI

SEQ ID NO: 3225026 - protein, 9 aa, Plasmodium falciparum
KDNRNNDKE

SEQ ID NO: 3225027 - protein, 7 aa, Plasmodium falciparum
KDNSDIK

SEQ ID NO: 3225028 - protein, 8 aa, Plasmodium falciparum
KDNSINND

SEQ ID NO: 3225029 - protein, 9 aa, Plasmodium falciparum
KDNSKDRYM

SEQ ID NO: 3225030 - protein, 10 aa, Plasmodium falciparum
KDNSKDTDDI

SEQ ID NO: 3225031 - protein, 11 aa, Plasmodium falciparum
KDNSKNENNIY

SEQ ID NO: 3225032 - protein, 5 aa, Plasmodium falciparum
KDNSP

SEQ ID NO: 3225033 - protein, 5 aa, Plasmodium falciparum
KDNST

SEQ ID NO: 3225034 - protein, 19 aa, Plasmodium falciparum
KDNTDSGAKGKPPTQDTQV

SEQ ID NO: 3225035 - protein, 5 aa, Plasmodium falciparum
KDNTF

SEQ ID NO: 3225036 - protein, 7 aa, Plasmodium falciparum
KDNTLNE

SEQ ID NO: 3225037 - protein, 7 aa, Plasmodium falciparum
KDNTNGF

SEQ ID NO: 3225038 - protein, 6 aa, Plasmodium falciparum
KDNTTI

SEQ ID NO: 3225039 - protein, 10 aa, Plasmodium falciparum
KDNVNAEREL

SEQ ID NO: 3225040 - protein, 8 aa, Plasmodium falciparum
KDNYETNK

SEQ ID NO: 3225041 - protein, 20 aa, Plasmodium falciparum
KDNYKRNEEDKEKRQKNTKQ

SEQ ID NO: 3225042 - protein, 9 aa, Plasmodium falciparum
KDNYSKSTQ

SEQ ID NO: 3225043 - protein, 6 aa, Plasmodium falciparum
KDPEER

SEQ ID NO: 3225044 - protein, 7 aa, Plasmodium falciparum
KDPKGYV

SEQ ID NO: 3225045 - protein, 7 aa, Plasmodium falciparum
KDPNEKS

SEQ ID NO: 3225046 - protein, 6 aa, Plasmodium falciparum
KDPNKI

SEQ ID NO: 3225047 - protein, 9 aa, Plasmodium falciparum
KDPNNNSNI

SEQ ID NO: 3225048 - protein, 7 aa, Plasmodium falciparum
KDPNTHT

SEQ ID NO: 3225049 - protein, 5 aa, Plasmodium falciparum
KDPPA

SEQ ID NO: 3225050 - protein, 6 aa, Plasmodium falciparum
KDPRSL

SEQ ID NO: 3225051 - protein, 4 aa, Plasmodium falciparum
KDPS

SEQ ID NO: 3225052 - protein, 5 aa, Plasmodium falciparum
KDPSC

SEQ ID NO: 3225053 - protein, 7 aa, Plasmodium falciparum
KDPSEQY

SEQ ID NO: 3225054 - protein, 7 aa, Plasmodium falciparum
KDPSNNP

SEQ ID NO: 3225055 - protein, 6 aa, Plasmodium falciparum
KDPSYM

SEQ ID NO: 3225056 - protein, 6 aa, Plasmodium falciparum
KDPTDK

SEQ ID NO: 3225057 - protein, 13 aa, Plasmodium falciparum
KDPTTKNDKSKKY

SEQ ID NO: 3225058 - protein, 7 aa, Plasmodium falciparum
KDPTTLP

SEQ ID NO: 3225059 - protein, 13 aa, Plasmodium falciparum
KDQAHTNKKQNIK

SEQ ID NO: 3225060 - protein, 4 aa, Plasmodium falciparum
KDQC

SEQ ID NO: 3225061 - protein, 7 aa, Plasmodium falciparum
KDQEDRE

SEQ ID NO: 3225062 - protein, 5 aa, Plasmodium falciparum
KDQKE

SEQ ID NO: 3225063 - protein, 9 aa, Plasmodium falciparum
KDQKGNEKY

SEQ ID NO: 3225064 - protein, 6 aa, Plasmodium falciparum
KDQKQS

SEQ ID NO: 3225065 - protein, 14 aa, Plasmodium falciparum
KDQKRESFRPNESI

SEQ ID NO: 3225066 - protein, 8 aa, Plasmodium falciparum
KDQNEKYK

SEQ ID NO: 3225067 - protein, 6 aa, Plasmodium falciparum
KDQNIE

SEQ ID NO: 3225068 - protein, 6 aa, Plasmodium falciparum
KDQNIN

SEQ ID NO: 3225069 - protein, 4 aa, Plasmodium falciparum
KDQQ

SEQ ID NO: 3225070 - protein, 7 aa, Plasmodium falciparum
KDQSTSI

SEQ ID NO: 3225071 - protein, 6 aa, Plasmodium falciparum
KDRAGS

SEQ ID NO: 3225072 - protein, 6 aa, Plasmodium falciparum
KDRDIP

SEQ ID NO: 3225073 - protein, 15 aa, Plasmodium falciparum
KDRDNLEKKNKKEKN

SEQ ID NO: 3225074 - protein, 4 aa, Plasmodium falciparum
KDRE

SEQ ID NO: 3225075 - protein, 11 aa, Plasmodium falciparum
KDREDESNGAH

SEQ ID NO: 3225076 - protein, 7 aa, Plasmodium falciparum
KDREYSK

SEQ ID NO: 3225077 - protein, 6 aa, Plasmodium falciparum
KDRFDE

SEQ ID NO: 3225078 - protein, 5 aa, Plasmodium falciparum
KDRGK

SEQ ID NO: 3225079 - protein, 4 aa, Plasmodium falciparum
KDRK

SEQ ID NO: 3225080 - protein, 11 aa, Plasmodium falciparum
KDRKDKSFAEK

SEQ ID NO: 3225081 - protein, 24 aa, Plasmodium falciparum
KDRKKEDNIKEKKNIKESKKEYTC

SEQ ID NO: 3225082 - protein, 9 aa, Plasmodium falciparum
KDRKRYKDE

SEQ ID NO: 3225083 - protein, 5 aa, Plasmodium falciparum
KDRNM

SEQ ID NO: 3225084 - protein, 8 aa, Plasmodium falciparum
KDRNNNDD

SEQ ID NO: 3225085 - protein, 8 aa, Plasmodium falciparum
KDRQPELV

SEQ ID NO: 3225086 - protein, 4 aa, Plasmodium falciparum
KDRR

SEQ ID NO: 3225087 - protein, 8 aa, Plasmodium falciparum
KDRSQNNA

SEQ ID NO: 3225088 - protein, 12 aa, Plasmodium falciparum
KDRVQKKKLQDS

SEQ ID NO: 3225089 - protein, 4 aa, Plasmodium falciparum
KDRY

SEQ ID NO: 3225090 - protein, 7 aa, Plasmodium falciparum
KDSAASL

SEQ ID NO: 3225091 - protein, 8 aa, Plasmodium falciparum
KDSDNTKD

SEQ ID NO: 3225092 - protein, 6 aa, Plasmodium falciparum
KDSEIN

SEQ ID NO: 3225093 - protein, 14 aa, Plasmodium falciparum
KDSENDSNKNDANN

SEQ ID NO: 3225094 - protein, 6 aa, Plasmodium falciparum
KDSENK

SEQ ID NO: 3225095 - protein, 21 aa, Plasmodium falciparum
KDSEQPNKNGNFPLTKNNEND

SEQ ID NO: 3225096 - protein, 6 aa, Plasmodium falciparum
KDSFEN

SEQ ID NO: 3225097 - protein, 11 aa, Plasmodium falciparum
KDSGDENIKDI

SEQ ID NO: 3225098 - protein, 5 aa, Plasmodium falciparum
KDSGE

SEQ ID NO: 3225099 - protein, 8 aa, Plasmodium falciparum
KDSGSTEM

SEQ ID NO: 3225100 - protein, 7 aa, Plasmodium falciparum
KDSHKNE

SEQ ID NO: 3225101 - protein, 19 aa, Plasmodium falciparum
KDSHNNNNNNDNNNTSMKD

SEQ ID NO: 3225102 - protein, 4 aa, Plasmodium falciparum
KDSI

SEQ ID NO: 3225103 - protein, 46 aa, Plasmodium falciparum
KDSIEGNKDDNANISNDDEEHEKTQELKEEGKEDDAHSSDEKDGKN

SEQ ID NO: 3225104 - protein, 8 aa, Plasmodium falciparum
KDSITRDY

SEQ ID NO: 3225105 - protein, 4 aa, Plasmodium falciparum
KDSK

SEQ ID NO: 3225106 - protein, 10 aa, Plasmodium falciparum
KDSKEGDNKV

SEQ ID NO: 3225107 - protein, 6 aa, Plasmodium falciparum
KDSKNL

SEQ ID NO: 3225108 - protein, 9 aa, Plasmodium falciparum
KDSKNPNDI

SEQ ID NO: 3225109 - protein, 5 aa, Plasmodium falciparum
KDSLG

SEQ ID NO: 3225110 - protein, 5 aa, Plasmodium falciparum
KDSLK

SEQ ID NO: 3225111 - protein, 12 aa, Plasmodium falciparum
KDSLKSDHDYNS

SEQ ID NO: 3225112 - protein, 8 aa, Plasmodium falciparum
KDSNKQVS

SEQ ID NO: 3225113 - protein, 6 aa, Plasmodium falciparum
KDSNRI

SEQ ID NO: 3225114 - protein, 22 aa, Plasmodium falciparum
KDSNTSEQLNNSNNSLNNLENN

SEQ ID NO: 3225115 - protein, 16 aa, Plasmodium falciparum
KDSNYNNKVPPPQEPN

SEQ ID NO: 3225116 - protein, 4 aa, Plasmodium falciparum
KDSP

SEQ ID NO: 3225117 - protein, 9 aa, Plasmodium falciparum
KDSPGNFTS

SEQ ID NO: 3225118 - protein, 7 aa, Plasmodium falciparum
KDSPRNV

SEQ ID NO: 3225119 - protein, 8 aa, Plasmodium falciparum
KDSQKCKR

SEQ ID NO: 3225120 - protein, 6 aa, Plasmodium falciparum
KDSRHN

SEQ ID NO: 3225121 - protein, 10 aa, Plasmodium falciparum
KDSSDNQEEY

SEQ ID NO: 3225122 - protein, 15 aa, Plasmodium falciparum
KDSSKVNTREHGGES

SEQ ID NO: 3225123 - protein, 5 aa, Plasmodium falciparum
KDSSN

SEQ ID NO: 3225124 - protein, 9 aa, Plasmodium falciparum
KDSSNISKH

SEQ ID NO: 3225125 - protein, 51 aa, Plasmodium falciparum
KDSSTNNTTITKKDNSNNNNDNDNTNNNNDNDNSNNNNDNGSNNDNSSNNN

SEQ ID NO: 3225126 - protein, 6 aa, Plasmodium falciparum
KDSSTY

SEQ ID NO: 3225127 - protein, 15 aa, Plasmodium falciparum
KDSTKAKEVVEEETE

SEQ ID NO: 3225128 - protein, 7 aa, Plasmodium falciparum
KDSTTAF

SEQ ID NO: 3225129 - protein, 4 aa, Plasmodium falciparum
KDSV

SEQ ID NO: 3225130 - protein, 7 aa, Plasmodium falciparum
KDSVSDT

SEQ ID NO: 3225131 - protein, 7 aa, Plasmodium falciparum
KDSYEDE

SEQ ID NO: 3225132 - protein, 9 aa, Plasmodium falciparum
KDSYIKSRT

SEQ ID NO: 3225133 - protein, 4 aa, Plasmodium falciparum
KDTE

SEQ ID NO: 3225134 - protein, 8 aa, Plasmodium falciparum
KDTENNKI

SEQ ID NO: 3225135 - protein, 7 aa, Plasmodium falciparum
KDTGENY

SEQ ID NO: 3225136 - protein, 14 aa, Plasmodium falciparum
KDTGHTKKQGYKPE

SEQ ID NO: 3225137 - protein, 5 aa, Plasmodium falciparum
KDTHS

SEQ ID NO: 3225138 - protein, 4 aa, Plasmodium falciparum
KDTI

SEQ ID NO: 3225139 - protein, 8 aa, Plasmodium falciparum
KDTIRKGN

SEQ ID NO: 3225140 - protein, 5 aa, Plasmodium falciparum
KDTIT

SEQ ID NO: 3225141 - protein, 5 aa, Plasmodium falciparum
KDTKE

SEQ ID NO: 3225142 - protein, 8 aa, Plasmodium falciparum
KDTKEYEK

SEQ ID NO: 3225143 - protein, 7 aa, Plasmodium falciparum
KDTKKNL

SEQ ID NO: 3225144 - protein, 4 aa, Plasmodium falciparum
KDTL

SEQ ID NO: 3225145 - protein, 7 aa, Plasmodium falciparum
KDTLDKK

SEQ ID NO: 3225146 - protein, 54 aa, Plasmodium falciparum
KDTLENPSSSLDEGKAHEELSEPNLSSDQDMSNTPGPLDNTSEETTERISNNEY

SEQ ID NO: 3225147 - protein, 4 aa, Plasmodium falciparum
KDTN

SEQ ID NO: 3225148 - protein, 7 aa, Plasmodium falciparum
KDTNEKV

SEQ ID NO: 3225149 - protein, 11 aa, Plasmodium falciparum
KDTNIPQNEAE

SEQ ID NO: 3225150 - protein, 5 aa, Plasmodium falciparum
KDTNN

SEQ ID NO: 3225151 - protein, 10 aa, Plasmodium falciparum
KDTNNENNAS

SEQ ID NO: 3225152 - protein, 8 aa, Plasmodium falciparum
KDTNNLEY

SEQ ID NO: 3225153 - protein, 9 aa, Plasmodium falciparum
KDTNNNDHM

SEQ ID NO: 3225154 - protein, 8 aa, Plasmodium falciparum
KDTNNNHI

SEQ ID NO: 3225155 - protein, 7 aa, Plasmodium falciparum
KDTPDPS

SEQ ID NO: 3225156 - protein, 7 aa, Plasmodium falciparum
KDTPNGY

SEQ ID NO: 3225157 - protein, 10 aa, Plasmodium falciparum
KDTPSSMSEY

SEQ ID NO: 3225158 - protein, 7 aa, Plasmodium falciparum
KDTQEAI

SEQ ID NO: 3225159 - protein, 5 aa, Plasmodium falciparum
KDTQK

SEQ ID NO: 3225160 - protein, 7 aa, Plasmodium falciparum
KDTQREY

SEQ ID NO: 3225161 - protein, 4 aa, Plasmodium falciparum
KDTR

SEQ ID NO: 3225162 - protein, 14 aa, Plasmodium falciparum
KDTRRRREYDKSVT

SEQ ID NO: 3225163 - protein, 4 aa, Plasmodium falciparum
KDTS

SEQ ID NO: 3225164 - protein, 17 aa, Plasmodium falciparum
KDTSKNEDIIDNEKDDN

SEQ ID NO: 3225165 - protein, 10 aa, Plasmodium falciparum
KDTSSSSNYI

SEQ ID NO: 3225166 - protein, 6 aa, Plasmodium falciparum
KDTSTF

SEQ ID NO: 3225167 - protein, 6 aa, Plasmodium falciparum
KDTTEK

SEQ ID NO: 3225168 - protein, 13 aa, Plasmodium falciparum
KDTTTELRTSDDT

SEQ ID NO: 3225169 - protein, 12 aa, Plasmodium falciparum
KDTYEEDTKSNL

SEQ ID NO: 3225170 - protein, 5 aa, Plasmodium falciparum
KDTYK

SEQ ID NO: 3225171 - protein, 19 aa, Plasmodium falciparum
KDTYNASSNDGKDEAGNKV

SEQ ID NO: 3225172 - protein, 7 aa, Plasmodium falciparum
KDVDEKM

SEQ ID NO: 3225173 - protein, 4 aa, Plasmodium falciparum
KDVE

SEQ ID NO: 3225174 - protein, 11 aa, Plasmodium falciparum
KDVEEKKSGQI

SEQ ID NO: 3225175 - protein, 17 aa, Plasmodium falciparum
KDVEKKIDDDNKKNNII

SEQ ID NO: 3225176 - protein, 15 aa, Plasmodium falciparum
KDVETKGDTKISQTD

SEQ ID NO: 3225177 - protein, 9 aa, Plasmodium falciparum
KDVKDKDLE

SEQ ID NO: 3225178 - protein, 14 aa, Plasmodium falciparum
KDVKDQKAENCNKG

SEQ ID NO: 3225179 - protein, 13 aa, Plasmodium falciparum
KDVKEDRKLENTD

SEQ ID NO: 3225180 - protein, 12 aa, Plasmodium falciparum
KDVKNESHNSAR

SEQ ID NO: 3225181 - protein, 10 aa, Plasmodium falciparum
KDVKVSGNNN

SEQ ID NO: 3225182 - protein, 8 aa, Plasmodium falciparum
KDVLEENK

SEQ ID NO: 3225183 - protein, 44 aa, Plasmodium falciparum
KDVNKTKDNENNIKGNAQQVDENKNSIKNNGENSNVEKKSNVST

SEQ ID NO: 3225184 - protein, 81 aa, Plasmodium falciparum
KDVNNEENDTIKQDDHKNMNADSNKNNDNNYDNNDECDDNNDECGEYNDEDDEDKNNDNEDNNNDDDEEDEDDDDEDDEEA

SEQ ID NO: 3225185 - protein, 5 aa, Plasmodium falciparum
KDVPG

SEQ ID NO: 3225186 - protein, 4 aa, Plasmodium falciparum
KDYA

SEQ ID NO: 3225187 - protein, 5 aa, Plasmodium falciparum
KDYDD

SEQ ID NO: 3225188 - protein, 25 aa, Plasmodium falciparum
KDYDQQEDEQEDVNKQKQQNNQYQE

SEQ ID NO: 3225189 - protein, 16 aa, Plasmodium falciparum
KDYEENNKKKNGKNEV

SEQ ID NO: 3225190 - protein, 6 aa, Plasmodium falciparum
KDYGKE

SEQ ID NO: 3225191 - protein, 5 aa, Plasmodium falciparum
KDYIE

SEQ ID NO: 3225192 - protein, 18 aa, Plasmodium falciparum
KDYKNNNDNSDKDNNSYD

SEQ ID NO: 3225193 - protein, 6 aa, Plasmodium falciparum
KDYPES

SEQ ID NO: 3225194 - protein, 6 aa, Plasmodium falciparum
KDYVEE

SEQ ID NO: 3225195 - protein, 6 aa, Plasmodium falciparum
KDYYND

SEQ ID NO: 3225196 - protein, 6 aa, Plasmodium falciparum
KEACEG

SEQ ID NO: 3225197 - protein, 4 aa, Plasmodium falciparum
KEAD

SEQ ID NO: 3225198 - protein, 32 aa, Plasmodium falciparum
KEAEGSTEHSNSNHDYSSEKENAYNPNGSFSS

SEQ ID NO: 3225199 - protein, 14 aa, Plasmodium falciparum
KEAEIAETENTLEN

SEQ ID NO: 3225200 - protein, 66 aa, Plasmodium falciparum
KEAEQCKNCPKPKAQQEGPGGARSADSPPAGTEDHPDAEDDDDEDDDDDDDEDEEEEEEEEDPQCK

SEQ ID NO: 3225201 - protein, 13 aa, Plasmodium falciparum
KEAEQGQSGLPGI

SEQ ID NO: 3225202 - protein, 13 aa, Plasmodium falciparum
KEAEQRSKGELEG

SEQ ID NO: 3225203 - protein, 4 aa, Plasmodium falciparum
KEAG

SEQ ID NO: 3225204 - protein, 15 aa, Plasmodium falciparum
KEAGAALSSGSDHVK

SEQ ID NO: 3225205 - protein, 44 aa, Plasmodium falciparum
KEAGDDTDDDDDDDDDDDDEEEDDDDEDDDDEDDEEEDDEEDLG

SEQ ID NO: 3225206 - protein, 16 aa, Plasmodium falciparum
KEAGMAAAKAEGAAAG

SEQ ID NO: 3225207 - protein, 4 aa, Plasmodium falciparum
KEAI

SEQ ID NO: 3225208 - protein, 6 aa, Plasmodium falciparum
KEAIKG

SEQ ID NO: 3225209 - protein, 8 aa, Plasmodium falciparum
KEAKEQNL

SEQ ID NO: 3225210 - protein, 5 aa, Plasmodium falciparum
KEAKS

SEQ ID NO: 3225211 - protein, 7 aa, Plasmodium falciparum
KEANEEI

SEQ ID NO: 3225212 - protein, 10 aa, Plasmodium falciparum
KEAQKEQSKN

SEQ ID NO: 3225213 - protein, 4 aa, Plasmodium falciparum
KEAR

SEQ ID NO: 3225214 - protein, 125 aa, Plasmodium falciparum
KEATSCPGKTSDKTQAKCQESTPPDDDESLEEEENTVGKQQPSFCPKPPEPKPEDEGGCETAQTTPKEPTADGGEGTENQPPVIKPEKEDTKSKDIQPQPPTAPPEEKNNLPQPSHPLPSDNTSD

SEQ ID NO: 3225215 - protein, 7 aa, Plasmodium falciparum
KEAYDEE

SEQ ID NO: 3225216 - protein, 6 aa, Plasmodium falciparum
KECDEE

SEQ ID NO: 3225217 - protein, 9 aa, Plasmodium falciparum
KECKEQCDK

SEQ ID NO: 3225218 - protein, 9 aa, Plasmodium falciparum
KECKEQCEQ

SEQ ID NO: 3225219 - protein, 12 aa, Plasmodium falciparum
KECKGINEQEEK

SEQ ID NO: 3225220 - protein, 14 aa, Plasmodium falciparum
KECKNHPEVGDGKK

SEQ ID NO: 3225221 - protein, 13 aa, Plasmodium falciparum
KECSADKPLDEPQ

SEQ ID NO: 3225222 - protein, 16 aa, Plasmodium falciparum
KECSNYNTSNDGHGHG

SEQ ID NO: 3225223 - protein, 12 aa, Plasmodium falciparum
KECTNKENTKYY

SEQ ID NO: 3225224 - protein, 13 aa, Plasmodium falciparum
KECYNDKDKNNEN

SEQ ID NO: 3225225 - protein, 26 aa, Plasmodium falciparum
KEDDDQSGAKTPSASSGSNDPINNPQ

SEQ ID NO: 3225226 - protein, 12 aa, Plasmodium falciparum
KEDDEKNVGALN

SEQ ID NO: 3225227 - protein, 9 aa, Plasmodium falciparum
KEDDEKSKI

SEQ ID NO: 3225228 - protein, 25 aa, Plasmodium falciparum
KEDDESGSSNKSINNKAKGNDDTMN

SEQ ID NO: 3225229 - protein, 8 aa, Plasmodium falciparum
KEDDHYER

SEQ ID NO: 3225230 - protein, 15 aa, Plasmodium falciparum
KEDDKYSKNITNNNK

SEQ ID NO: 3225231 - protein, 5 aa, Plasmodium falciparum
KEDDN

SEQ ID NO: 3225232 - protein, 51 aa, Plasmodium falciparum
KEDDNKNGNNGDNNKDESNINNDEYNNDDNNINNDQYNNDDNNINNDEYNN

SEQ ID NO: 3225233 - protein, 11 aa, Plasmodium falciparum
KEDDNKNIDYN

SEQ ID NO: 3225234 - protein, 9 aa, Plasmodium falciparum
KEDDNTNTL

SEQ ID NO: 3225235 - protein, 10 aa, Plasmodium falciparum
KEDDQDEGIG

SEQ ID NO: 3225236 - protein, 21 aa, Plasmodium falciparum
KEDDRKNSEPEQYKKINKNKK

SEQ ID NO: 3225237 - protein, 6 aa, Plasmodium falciparum
KEDDRY

SEQ ID NO: 3225238 - protein, 5 aa, Plasmodium falciparum
KEDDS

SEQ ID NO: 3225239 - protein, 20 aa, Plasmodium falciparum
KEDDSGEKAANVPAKVEPTT

SEQ ID NO: 3225240 - protein, 5 aa, Plasmodium falciparum
KEDEE

SEQ ID NO: 3225241 - protein, 14 aa, Plasmodium falciparum
KEDEEESNKTRELN

SEQ ID NO: 3225242 - protein, 67 aa, Plasmodium falciparum
KEDEGRVQDDEDVDEDDYDDDDDEDDDDDDEDDDEDDDEEDDDEEDEEVNIPNNEKNDTQNLDDKKS

SEQ ID NO: 3225243 - protein, 8 aa, Plasmodium falciparum
KEDEKNKN

SEQ ID NO: 3225244 - protein, 9 aa, Plasmodium falciparum
KEDENEQFE

SEQ ID NO: 3225245 - protein, 9 aa, Plasmodium falciparum
KEDENHGNI

SEQ ID NO: 3225246 - protein, 25 aa, Plasmodium falciparum
KEDENKSKNKKCDTNNSKDNIGEDN

SEQ ID NO: 3225247 - protein, 7 aa, Plasmodium falciparum
KEDEQTN

SEQ ID NO: 3225248 - protein, 8 aa, Plasmodium falciparum
KEDESKEN

SEQ ID NO: 3225249 - protein, 10 aa, Plasmodium falciparum
KEDETRKKGD

SEQ ID NO: 3225250 - protein, 8 aa, Plasmodium falciparum
KEDGNDDM

SEQ ID NO: 3225251 - protein, 18 aa, Plasmodium falciparum
KEDHTNQNIQSESYYTQS

SEQ ID NO: 3225252 - protein, 12 aa, Plasmodium falciparum
KEDIKKKETNES

SEQ ID NO: 3225253 - protein, 7 aa, Plasmodium falciparum
KEDIQEE

SEQ ID NO: 3225254 - protein, 12 aa, Plasmodium falciparum
KEDISKKYNGRG

SEQ ID NO: 3225255 - protein, 6 aa, Plasmodium falciparum
KEDIYK

SEQ ID NO: 3225256 - protein, 13 aa, Plasmodium falciparum
KEDKDTNDYITSK

SEQ ID NO: 3225257 - protein, 6 aa, Plasmodium falciparum
KEDKEN

SEQ ID NO: 3225258 - protein, 8 aa, Plasmodium falciparum
KEDKENLN

SEQ ID NO: 3225259 - protein, 8 aa, Plasmodium falciparum
KEDKITNK

SEQ ID NO: 3225260 - protein, 20 aa, Plasmodium falciparum
KEDKKEDEEDEDEVKEEDYL

SEQ ID NO: 3225261 - protein, 33 aa, Plasmodium falciparum
KEDKKNDKMRKEDVNKSSVKKENKKWSGNSNDI

SEQ ID NO: 3225262 - protein, 9 aa, Plasmodium falciparum
KEDKNFNEI

SEQ ID NO: 3225263 - protein, 8 aa, Plasmodium falciparum
KEDKNKSI

SEQ ID NO: 3225264 - protein, 13 aa, Plasmodium falciparum
KEDKQNETASTEL

SEQ ID NO: 3225265 - protein, 62 aa, Plasmodium falciparum
KEDKTDDGNNNDKNGDKNGDKNGDKNDDKDDDDNDDDDNDDNDDNNDDDNNDDDNNDDDNNY

SEQ ID NO: 3225266 - protein, 8 aa, Plasmodium falciparum
KEDKTNYP

SEQ ID NO: 3225267 - protein, 6 aa, Plasmodium falciparum
KEDKYK

SEQ ID NO: 3225268 - protein, 10 aa, Plasmodium falciparum
KEDLFEENKK

SEQ ID NO: 3225269 - protein, 4 aa, Plasmodium falciparum
KEDN

SEQ ID NO: 3225270 - protein, 22 aa, Plasmodium falciparum
KEDNDKNKNSENNNGLTNTSNI

SEQ ID NO: 3225271 - protein, 7 aa, Plasmodium falciparum
KEDNDNI

SEQ ID NO: 3225272 - protein, 6 aa, Plasmodium falciparum
KEDNEI

SEQ ID NO: 3225273 - protein, 21 aa, Plasmodium falciparum
KEDNGQHKVQRDNTKNTSNDN

SEQ ID NO: 3225274 - protein, 5 aa, Plasmodium falciparum
KEDNK

SEQ ID NO: 3225275 - protein, 5 aa, Plasmodium falciparum
KEDNN

SEQ ID NO: 3225276 - protein, 32 aa, Plasmodium falciparum
KEDNNDINNNDVNNNDVNNNDDNNDDNNDDDN

SEQ ID NO: 3225277 - protein, 8 aa, Plasmodium falciparum
KEDNNDLP

SEQ ID NO: 3225278 - protein, 22 aa, Plasmodium falciparum
KEDNNGGEDLQNQLKSGKIPED

SEQ ID NO: 3225279 - protein, 8 aa, Plasmodium falciparum
KEDNPALK

SEQ ID NO: 3225280 - protein, 6 aa, Plasmodium falciparum
KEDQNK

SEQ ID NO: 3225281 - protein, 5 aa, Plasmodium falciparum
KEDQQ

SEQ ID NO: 3225282 - protein, 8 aa, Plasmodium falciparum
KEDQSKDY

SEQ ID NO: 3225283 - protein, 6 aa, Plasmodium falciparum
KEDRGQ

SEQ ID NO: 3225284 - protein, 9 aa, Plasmodium falciparum
KEDRPNTSL

SEQ ID NO: 3225285 - protein, 7 aa, Plasmodium falciparum
KEDSDEE

SEQ ID NO: 3225286 - protein, 11 aa, Plasmodium falciparum
KEDSNNKESYT

SEQ ID NO: 3225287 - protein, 10 aa, Plasmodium falciparum
KEDSQKENIQ

SEQ ID NO: 3225288 - protein, 6 aa, Plasmodium falciparum
KEDTGK

SEQ ID NO: 3225289 - protein, 8 aa, Plasmodium falciparum
KEDTKNKD

SEQ ID NO: 3225290 - protein, 5 aa, Plasmodium falciparum
KEDTS

SEQ ID NO: 3225291 - protein, 23 aa, Plasmodium falciparum
KEDTSGAKGESAKIEQDNEVETK

SEQ ID NO: 3225292 - protein, 7 aa, Plasmodium falciparum
KEDTYTQ

SEQ ID NO: 3225293 - protein, 6 aa, Plasmodium falciparum
KEDVKK

SEQ ID NO: 3225294 - protein, 7 aa, Plasmodium falciparum
KEDVNDK

SEQ ID NO: 3225295 - protein, 18 aa, Plasmodium falciparum
KEDVQEQKQGKSQEVESK

SEQ ID NO: 3225296 - protein, 7 aa, Plasmodium falciparum
KEDVTDK

SEQ ID NO: 3225297 - protein, 5 aa, Plasmodium falciparum
KEDYK

SEQ ID NO: 3225298 - protein, 6 aa, Plasmodium falciparum
KEDYKK

SEQ ID NO: 3225299 - protein, 5 aa, Plasmodium falciparum
KEDYN

SEQ ID NO: 3225300 - protein, 15 aa, Plasmodium falciparum
KEDYNNPKQSTKKRK

SEQ ID NO: 3225301 - protein, 6 aa, Plasmodium falciparum
KEDYYY

SEQ ID NO: 3225302 - protein, 4 aa, Plasmodium falciparum
KEEA

SEQ ID NO: 3225303 - protein, 32 aa, Plasmodium falciparum
KEEAKPKDPLKKEEVKPSDTLKKEVKPTNTLK

SEQ ID NO: 3225304 - protein, 8 aa, Plasmodium falciparum
KEEALNKQ

SEQ ID NO: 3225305 - protein, 14 aa, Plasmodium falciparum
KEEANESNNSKGHI

SEQ ID NO: 3225306 - protein, 7 aa, Plasmodium falciparum
KEECKRS

SEQ ID NO: 3225307 - protein, 5 aa, Plasmodium falciparum
KEEDF

SEQ ID NO: 3225308 - protein, 14 aa, Plasmodium falciparum
KEEDHYSQQSKEME

SEQ ID NO: 3225309 - protein, 6 aa, Plasmodium falciparum
KEEDKN

SEQ ID NO: 3225310 - protein, 12 aa, Plasmodium falciparum
KEEDKNRDKNVN

SEQ ID NO: 3225311 - protein, 14 aa, Plasmodium falciparum
KEEDKVSKGDISTY

SEQ ID NO: 3225312 - protein, 29 aa, Plasmodium falciparum
KEEDSGQKASTASQTPSPRASGENKPTTL

SEQ ID NO: 3225313 - protein, 5 aa, Plasmodium falciparum
KEEDY

SEQ ID NO: 3225314 - protein, 16 aa, Plasmodium falciparum
KEEDYEKDIKKPDFEE

SEQ ID NO: 3225315 - protein, 4 aa, Plasmodium falciparum
KEEE

SEQ ID NO: 3225316 - protein, 8 aa, Plasmodium falciparum
KEEEEEKE

SEQ ID NO: 3225317 - protein, 13 aa, Plasmodium falciparum
KEEEEKSGESKGE

SEQ ID NO: 3225318 - protein, 7 aa, Plasmodium falciparum
KEEEEVK

SEQ ID NO: 3225319 - protein, 16 aa, Plasmodium falciparum
KEEEHQKKLKRSELYN

SEQ ID NO: 3225320 - protein, 12 aa, Plasmodium falciparum
KEEEIENEKGGT

SEQ ID NO: 3225321 - protein, 9 aa, Plasmodium falciparum
KEEEKHFDT

SEQ ID NO: 3225322 - protein, 12 aa, Plasmodium falciparum
KEEEKKEQTYNG

SEQ ID NO: 3225323 - protein, 7 aa, Plasmodium falciparum
KEEEKKI

SEQ ID NO: 3225324 - protein, 12 aa, Plasmodium falciparum
KEEEKKKSGKIK

SEQ ID NO: 3225325 - protein, 7 aa, Plasmodium falciparum
KEEEKNK

SEQ ID NO: 3225326 - protein, 10 aa, Plasmodium falciparum
KEEEKNKGDI

SEQ ID NO: 3225327 - protein, 13 aa, Plasmodium falciparum
KEEEKNLNKDDET

SEQ ID NO: 3225328 - protein, 9 aa, Plasmodium falciparum
KEEENAPKS

SEQ ID NO: 3225329 - protein, 14 aa, Plasmodium falciparum
KEEENKEKNKEKYD

SEQ ID NO: 3225330 - protein, 11 aa, Plasmodium falciparum
KEEENNEEKTG

SEQ ID NO: 3225331 - protein, 5 aa, Plasmodium falciparum
KEEEW

SEQ ID NO: 3225332 - protein, 8 aa, Plasmodium falciparum
KEEEYKGD

SEQ ID NO: 3225333 - protein, 4 aa, Plasmodium falciparum
KEEF

SEQ ID NO: 3225334 - protein, 6 aa, Plasmodium falciparum
KEEFDK

SEQ ID NO: 3225335 - protein, 6 aa, Plasmodium falciparum
KEEFTE

SEQ ID NO: 3225336 - protein, 7 aa, Plasmodium falciparum
KEEFTKQ

SEQ ID NO: 3225337 - protein, 4 aa, Plasmodium falciparum
KEEG

SEQ ID NO: 3225338 - protein, 5 aa, Plasmodium falciparum
KEEGD

SEQ ID NO: 3225339 - protein, 17 aa, Plasmodium falciparum
KEEGEEMKDEEMKDEEM

SEQ ID NO: 3225340 - protein, 10 aa, Plasmodium falciparum
KEEGKKGNLG

SEQ ID NO: 3225341 - protein, 15 aa, Plasmodium falciparum
KEEGNEKNNIYTHQN

SEQ ID NO: 3225342 - protein, 71 aa, Plasmodium falciparum
KEEGSASEKVVKEEGSASEKIVEEEGSVTEETASEEIVEEEGSVTEESSSEEIVEDEGSVTEESSSEEIVE

SEQ ID NO: 3225343 - protein, 9 aa, Plasmodium falciparum
KEEGVSSSF

SEQ ID NO: 3225344 - protein, 12 aa, Plasmodium falciparum
KEEHEQNKNKIK

SEQ ID NO: 3225345 - protein, 5 aa, Plasmodium falciparum
KEEHI

SEQ ID NO: 3225346 - protein, 6 aa, Plasmodium falciparum
KEEHNI

SEQ ID NO: 3225347 - protein, 7 aa, Plasmodium falciparum
KEEHNNN

SEQ ID NO: 3225348 - protein, 6 aa, Plasmodium falciparum
KEEIEY

SEQ ID NO: 3225349 - protein, 7 aa, Plasmodium falciparum
KEEIKDK

SEQ ID NO: 3225350 - protein, 7 aa, Plasmodium falciparum
KEEIKNG

SEQ ID NO: 3225351 - protein, 5 aa, Plasmodium falciparum
KEEIN

SEQ ID NO: 3225352 - protein, 6 aa, Plasmodium falciparum
KEEIND

SEQ ID NO: 3225353 - protein, 6 aa, Plasmodium falciparum
KEEITE

SEQ ID NO: 3225354 - protein, 10 aa, Plasmodium falciparum
KEEKDKRQIE

SEQ ID NO: 3225355 - protein, 7 aa, Plasmodium falciparum
KEEKDRE

SEQ ID NO: 3225356 - protein, 6 aa, Plasmodium falciparum
KEEKEE

SEQ ID NO: 3225357 - protein, 8 aa, Plasmodium falciparum
KEEKEIND

SEQ ID NO: 3225358 - protein, 28 aa, Plasmodium falciparum
KEEKEKFPSSPPTTPPSPAKTDEQKKES

SEQ ID NO: 3225359 - protein, 6 aa, Plasmodium falciparum
KEEKEN

SEQ ID NO: 3225360 - protein, 7 aa, Plasmodium falciparum
KEEKENM

SEQ ID NO: 3225361 - protein, 11 aa, Plasmodium falciparum
KEEKERNKQNY

SEQ ID NO: 3225362 - protein, 8 aa, Plasmodium falciparum
KEEKGEYH

SEQ ID NO: 3225363 - protein, 5 aa, Plasmodium falciparum
KEEKI

SEQ ID NO: 3225364 - protein, 13 aa, Plasmodium falciparum
KEEKIEEVKENKQ

SEQ ID NO: 3225365 - protein, 6 aa, Plasmodium falciparum
KEEKKE

SEQ ID NO: 3225366 - protein, 70 aa, Plasmodium falciparum
KEEKKENDKQNDKQNDKENDKENDKENDKEKYNDKENDKEKYNDKHKEKNKDNNIEKENDEHKDHKNDHN

SEQ ID NO: 3225367 - protein, 7 aa, Plasmodium falciparum
KEEKKES

SEQ ID NO: 3225368 - protein, 7 aa, Plasmodium falciparum
KEEKKGR

SEQ ID NO: 3225369 - protein, 7 aa, Plasmodium falciparum
KEEKKKK

SEQ ID NO: 3225370 - protein, 15 aa, Plasmodium falciparum
KEEKKKKNKRNINEE

SEQ ID NO: 3225371 - protein, 22 aa, Plasmodium falciparum
KEEKKKQKKGNKETKQKGRRMK

SEQ ID NO: 3225372 - protein, 12 aa, Plasmodium falciparum
KEEKKKRKADKE

SEQ ID NO: 3225373 - protein, 13 aa, Plasmodium falciparum
KEEKKNKKKKNGK

SEQ ID NO: 3225374 - protein, 16 aa, Plasmodium falciparum
KEEKKNNYEDYTNNSI

SEQ ID NO: 3225375 - protein, 9 aa, Plasmodium falciparum
KEEKKNTKV

SEQ ID NO: 3225376 - protein, 8 aa, Plasmodium falciparum
KEEKKPYE

SEQ ID NO: 3225377 - protein, 9 aa, Plasmodium falciparum
KEEKKQNNY

SEQ ID NO: 3225378 - protein, 7 aa, Plasmodium falciparum
KEEKKSI

SEQ ID NO: 3225379 - protein, 19 aa, Plasmodium falciparum
KEEKNDIKEEQEKHDNSSS

SEQ ID NO: 3225380 - protein, 8 aa, Plasmodium falciparum
KEEKNGPL

SEQ ID NO: 3225381 - protein, 7 aa, Plasmodium falciparum
KEEKNNV

SEQ ID NO: 3225382 - protein, 7 aa, Plasmodium falciparum
KEEKNRF

SEQ ID NO: 3225383 - protein, 10 aa, Plasmodium falciparum
KEEKQQKCEK

SEQ ID NO: 3225384 - protein, 6 aa, Plasmodium falciparum
KEEKTN

SEQ ID NO: 3225385 - protein, 15 aa, Plasmodium falciparum
KEEKTNLEKEKHNYH

SEQ ID NO: 3225386 - protein, 7 aa, Plasmodium falciparum
KEEKTNT

SEQ ID NO: 3225387 - protein, 6 aa, Plasmodium falciparum
KEEKYE

SEQ ID NO: 3225388 - protein, 12 aa, Plasmodium falciparum
KEELENGCEEKL

SEQ ID NO: 3225389 - protein, 8 aa, Plasmodium falciparum
KEELKEKE

SEQ ID NO: 3225390 - protein, 7 aa, Plasmodium falciparum
KEEMDKI

SEQ ID NO: 3225391 - protein, 30 aa, Plasmodium falciparum
KEEMKTKPEDNNNNNNNNNNNNNNNNNNNN

SEQ ID NO: 3225392 - protein, 4 aa, Plasmodium falciparum
KEEN

SEQ ID NO: 3225393 - protein, 11 aa, Plasmodium falciparum
KEENCNNHQNS

SEQ ID NO: 3225394 - protein, 12 aa, Plasmodium falciparum
KEENDESIGESS

SEQ ID NO: 3225395 - protein, 19 aa, Plasmodium falciparum
KEENDTEVKGQDGLTPQTT

SEQ ID NO: 3225396 - protein, 7 aa, Plasmodium falciparum
KEENEET

SEQ ID NO: 3225397 - protein, 10 aa, Plasmodium falciparum
KEENEKDKNI

SEQ ID NO: 3225398 - protein, 7 aa, Plasmodium falciparum
KEENEMQ

SEQ ID NO: 3225399 - protein, 7 aa, Plasmodium falciparum
KEENENE

SEQ ID NO: 3225400 - protein, 5 aa, Plasmodium falciparum
KEENG

SEQ ID NO: 3225401 - protein, 7 aa, Plasmodium falciparum
KEENGKI

SEQ ID NO: 3225402 - protein, 8 aa, Plasmodium falciparum
KEENINNN

SEQ ID NO: 3225403 - protein, 6 aa, Plasmodium falciparum
KEENKD

SEQ ID NO: 3225404 - protein, 10 aa, Plasmodium falciparum
KEENKDTKLK

SEQ ID NO: 3225405 - protein, 8 aa, Plasmodium falciparum
KEENKNNK

SEQ ID NO: 3225406 - protein, 7 aa, Plasmodium falciparum
KEENLKK

SEQ ID NO: 3225407 - protein, 7 aa, Plasmodium falciparum
KEENNKS

SEQ ID NO: 3225408 - protein, 7 aa, Plasmodium falciparum
KEENNTM

SEQ ID NO: 3225409 - protein, 43 aa, Plasmodium falciparum
KEENQKNKQVMENNDKDETNHNQNGYRNNHKNKQFDEYDDHLF

SEQ ID NO: 3225410 - protein, 8 aa, Plasmodium falciparum
KEENRIKE

SEQ ID NO: 3225411 - protein, 7 aa, Plasmodium falciparum
KEENRKD

SEQ ID NO: 3225412 - protein, 8 aa, Plasmodium falciparum
KEENRSTY

SEQ ID NO: 3225413 - protein, 6 aa, Plasmodium falciparum
KEENSD

SEQ ID NO: 3225414 - protein, 22 aa, Plasmodium falciparum
KEENSGPKGQTESSSPSGDNTP

SEQ ID NO: 3225415 - protein, 23 aa, Plasmodium falciparum
KEENSGTGVTKGHAEAPGDNTPL

SEQ ID NO: 3225416 - protein, 8 aa, Plasmodium falciparum
KEENSVNE

SEQ ID NO: 3225417 - protein, 16 aa, Plasmodium falciparum
KEENYEENKSNHKENI

SEQ ID NO: 3225418 - protein, 8 aa, Plasmodium falciparum
KEEPCEKN

SEQ ID NO: 3225419 - protein, 9 aa, Plasmodium falciparum
KEEPPSPSS

SEQ ID NO: 3225420 - protein, 6 aa, Plasmodium falciparum
KEEPRS

SEQ ID NO: 3225421 - protein, 103 aa, Plasmodium falciparum
KEEPSGNYSQDEDEDEDEDEDEDEDDDDEEDDDEEDDDDEDDDDEDDDEEDDDEEDDDDEDDDDEDDDGDDDEEDDDGDDDDDEDDDDEDNDDDHHDDDHDDH

SEQ ID NO: 3225422 - protein, 4 aa, Plasmodium falciparum
KEEQ

SEQ ID NO: 3225423 - protein, 5 aa, Plasmodium falciparum
KEEQK

SEQ ID NO: 3225424 - protein, 8 aa, Plasmodium falciparum
KEEQKNND

SEQ ID NO: 3225425 - protein, 8 aa, Plasmodium falciparum
KEEQLNEK

SEQ ID NO: 3225426 - protein, 13 aa, Plasmodium falciparum
KEEQSNDPAKNTH

SEQ ID NO: 3225427 - protein, 18 aa, Plasmodium falciparum
KEERDKYDFSKEKEYNEF

SEQ ID NO: 3225428 - protein, 15 aa, Plasmodium falciparum
KEERGNQENIQQNDS

SEQ ID NO: 3225429 - protein, 7 aa, Plasmodium falciparum
KEERGQQ

SEQ ID NO: 3225430 - protein, 6 aa, Plasmodium falciparum
KEERKE

SEQ ID NO: 3225431 - protein, 7 aa, Plasmodium falciparum
KEERKKF

SEQ ID NO: 3225432 - protein, 12 aa, Plasmodium falciparum
KEERKKYSLRNK

SEQ ID NO: 3225433 - protein, 21 aa, Plasmodium falciparum
KEESEENTAKHKKEEEINQGN

SEQ ID NO: 3225434 - protein, 13 aa, Plasmodium falciparum
KEESESKIDYSTN

SEQ ID NO: 3225435 - protein, 8 aa, Plasmodium falciparum
KEESHKPI

SEQ ID NO: 3225436 - protein, 12 aa, Plasmodium falciparum
KEESKEGYEDIE

SEQ ID NO: 3225437 - protein, 6 aa, Plasmodium falciparum
KEESNF

SEQ ID NO: 3225438 - protein, 9 aa, Plasmodium falciparum
KEESNNIKN

SEQ ID NO: 3225439 - protein, 11 aa, Plasmodium falciparum
KEESNSCRKQY

SEQ ID NO: 3225440 - protein, 8 aa, Plasmodium falciparum
KEESNSSS

SEQ ID NO: 3225441 - protein, 7 aa, Plasmodium falciparum
KEESNVV

SEQ ID NO: 3225442 - protein, 9 aa, Plasmodium falciparum
KEESPVSNS

SEQ ID NO: 3225443 - protein, 7 aa, Plasmodium falciparum
KEETNED

SEQ ID NO: 3225444 - protein, 10 aa, Plasmodium falciparum
KEETNTNTSL

SEQ ID NO: 3225445 - protein, 6 aa, Plasmodium falciparum
KEETQI

SEQ ID NO: 3225446 - protein, 5 aa, Plasmodium falciparum
KEEVC

SEQ ID NO: 3225447 - protein, 40 aa, Plasmodium falciparum
KEEVKDKDGCKPAAAPSAETDKEKPVPKPPSQPTNPPNPF

SEQ ID NO: 3225448 - protein, 12 aa, Plasmodium falciparum
KEEVKNEKTEKY

SEQ ID NO: 3225449 - protein, 8 aa, Plasmodium falciparum
KEEWDKNK

SEQ ID NO: 3225450 - protein, 5 aa, Plasmodium falciparum
KEEWE

SEQ ID NO: 3225451 - protein, 9 aa, Plasmodium falciparum
KEEWEESKG

SEQ ID NO: 3225452 - protein, 6 aa, Plasmodium falciparum
KEEWEK

SEQ ID NO: 3225453 - protein, 5 aa, Plasmodium falciparum
KEEWK

SEQ ID NO: 3225454 - protein, 13 aa, Plasmodium falciparum
KEEYEEEEDDEDI

SEQ ID NO: 3225455 - protein, 5 aa, Plasmodium falciparum
KEEYH

SEQ ID NO: 3225456 - protein, 55 aa, Plasmodium falciparum
KEEYKKEKDNNVYDKNSDHNYSNNNDNNNNSNNNNSSNRNSHSNNNNNNNNSWNN

SEQ ID NO: 3225457 - protein, 5 aa, Plasmodium falciparum
KEEYL

SEQ ID NO: 3225458 - protein, 5 aa, Plasmodium falciparum
KEEYN

SEQ ID NO: 3225459 - protein, 7 aa, Plasmodium falciparum
KEEYNKM

SEQ ID NO: 3225460 - protein, 7 aa, Plasmodium falciparum
KEEYNNN

SEQ ID NO: 3225461 - protein, 8 aa, Plasmodium falciparum
KEEYSEEN

SEQ ID NO: 3225462 - protein, 25 aa, Plasmodium falciparum
KEFEEQSNAYTGQKDKCKKDSNNGF

SEQ ID NO: 3225463 - protein, 11 aa, Plasmodium falciparum
KEFKKKTEKGK

SEQ ID NO: 3225464 - protein, 7 aa, Plasmodium falciparum
KEFNGKD

SEQ ID NO: 3225465 - protein, 5 aa, Plasmodium falciparum
KEFPK

SEQ ID NO: 3225466 - protein, 7 aa, Plasmodium falciparum
KEFSEQK

SEQ ID NO: 3225467 - protein, 6 aa, Plasmodium falciparum
KEFSKV

SEQ ID NO: 3225468 - protein, 9 aa, Plasmodium falciparum
KEGDDSNKD

SEQ ID NO: 3225469 - protein, 14 aa, Plasmodium falciparum
KEGDERNADNNLKN

SEQ ID NO: 3225470 - protein, 5 aa, Plasmodium falciparum
KEGDI

SEQ ID NO: 3225471 - protein, 10 aa, Plasmodium falciparum
KEGDIKESDY

SEQ ID NO: 3225472 - protein, 6 aa, Plasmodium falciparum
KEGDNI

SEQ ID NO: 3225473 - protein, 4 aa, Plasmodium falciparum
KEGE

SEQ ID NO: 3225474 - protein, 35 aa, Plasmodium falciparum
KEGEIGHKKEDELGDKKEDNNEDQNQDNKQDKIEN

SEQ ID NO: 3225475 - protein, 8 aa, Plasmodium falciparum
KEGEIGYK

SEQ ID NO: 3225476 - protein, 10 aa, Plasmodium falciparum
KEGEKGKEDG

SEQ ID NO: 3225477 - protein, 6 aa, Plasmodium falciparum
KEGEKS

SEQ ID NO: 3225478 - protein, 6 aa, Plasmodium falciparum
KEGEPL

SEQ ID NO: 3225479 - protein, 13 aa, Plasmodium falciparum
KEGHNDEQKENIK

SEQ ID NO: 3225480 - protein, 19 aa, Plasmodium falciparum
KEGHQDDKNEDDDDNDSNI

SEQ ID NO: 3225481 - protein, 21 aa, Plasmodium falciparum
KEGISEDNRQNQRNADNNSLN

SEQ ID NO: 3225482 - protein, 10 aa, Plasmodium falciparum
KEGKINSQEK

SEQ ID NO: 3225483 - protein, 18 aa, Plasmodium falciparum
KEGKKEENKTIKKKTVER

SEQ ID NO: 3225484 - protein, 72 aa, Plasmodium falciparum
KEGKKGKINKDEKKGNIHKEEKKGNIHKDEKKGNIHKDEKKNKKLKKSKSNKSSDKKYDKNKYEQPNNNTYC

SEQ ID NO: 3225485 - protein, 16 aa, Plasmodium falciparum
KEGKKRNSINEEEEEY

SEQ ID NO: 3225486 - protein, 6 aa, Plasmodium falciparum
KEGKQV

SEQ ID NO: 3225487 - protein, 7 aa, Plasmodium falciparum
KEGLDTE

SEQ ID NO: 3225488 - protein, 6 aa, Plasmodium falciparum
KEGMQE

SEQ ID NO: 3225489 - protein, 4 aa, Plasmodium falciparum
KEGN

SEQ ID NO: 3225490 - protein, 6 aa, Plasmodium falciparum
KEGNEK

SEQ ID NO: 3225491 - protein, 21 aa, Plasmodium falciparum
KEGNEKEINEGNDKEIKEGEY

SEQ ID NO: 3225492 - protein, 21 aa, Plasmodium falciparum
KEGNEKEINEGNDKEINEGEY

SEQ ID NO: 3225493 - protein, 6 aa, Plasmodium falciparum
KEGNEN

SEQ ID NO: 3225494 - protein, 9 aa, Plasmodium falciparum
KEGNGKKEE

SEQ ID NO: 3225495 - protein, 6 aa, Plasmodium falciparum
KEGPAS

SEQ ID NO: 3225496 - protein, 6 aa, Plasmodium falciparum
KEGPIQ

SEQ ID NO: 3225497 - protein, 9 aa, Plasmodium falciparum
KEGSATEEI

SEQ ID NO: 3225498 - protein, 12 aa, Plasmodium falciparum
KEGSDNINNQYN

SEQ ID NO: 3225499 - protein, 5 aa, Plasmodium falciparum
KEGSE

SEQ ID NO: 3225500 - protein, 15 aa, Plasmodium falciparum
KEGSGKCTGSSDEEE

SEQ ID NO: 3225501 - protein, 8 aa, Plasmodium falciparum
KEGSQNVE

SEQ ID NO: 3225502 - protein, 7 aa, Plasmodium falciparum
KEGSVTE

SEQ ID NO: 3225503 - protein, 13 aa, Plasmodium falciparum
KEGSVTEDIGQEG

SEQ ID NO: 3225504 - protein, 7 aa, Plasmodium falciparum
KEGSYGN

SEQ ID NO: 3225505 - protein, 9 aa, Plasmodium falciparum
KEGVDGKDA

SEQ ID NO: 3225506 - protein, 14 aa, Plasmodium falciparum
KEGYQKEIDENQNM

SEQ ID NO: 3225507 - protein, 6 aa, Plasmodium falciparum
KEGYTN

SEQ ID NO: 3225508 - protein, 6 aa, Plasmodium falciparum
KEHANP

SEQ ID NO: 3225509 - protein, 14 aa, Plasmodium falciparum
KEHCKGSNAHKNSV

SEQ ID NO: 3225510 - protein, 4 aa, Plasmodium falciparum
KEHD

SEQ ID NO: 3225511 - protein, 39 aa, Plasmodium falciparum
KEHEDDINDEEKINKRDISNDYSYNNNNNYNNNNNNNYN

SEQ ID NO: 3225512 - protein, 14 aa, Plasmodium falciparum
KEHEKTKQEDVPKK

SEQ ID NO: 3225513 - protein, 6 aa, Plasmodium falciparum
KEHEQY

SEQ ID NO: 3225514 - protein, 6 aa, Plasmodium falciparum
KEHESY

SEQ ID NO: 3225515 - protein, 5 aa, Plasmodium falciparum
KEHFE

SEQ ID NO: 3225516 - protein, 41 aa, Plasmodium falciparum
KEHHHEKSHNNGQNSNVPKNSFQNNKSQNHVQKSKVENQKV

SEQ ID NO: 3225517 - protein, 4 aa, Plasmodium falciparum
KEHL

SEQ ID NO: 3225518 - protein, 91 aa, Plasmodium falciparum
KEHNHKDANKNVDTNKNIDTNKNLDTNKNLDTNKNIDTNKNLDTNKNLDTNKNIDTNKNLDTNKNLDTNKKIDTNKNLDTNKNLDTNDDIK

SEQ ID NO: 3225519 - protein, 14 aa, Plasmodium falciparum
KEHNNVPNMNNGSN

SEQ ID NO: 3225520 - protein, 7 aa, Plasmodium falciparum
KEHSDEQ

SEQ ID NO: 3225521 - protein, 8 aa, Plasmodium falciparum
KEHTTKNY

SEQ ID NO: 3225522 - protein, 13 aa, Plasmodium falciparum
KEHTTNNTNLPNN

SEQ ID NO: 3225523 - protein, 5 aa, Plasmodium falciparum
KEIDE

SEQ ID NO: 3225524 - protein, 10 aa, Plasmodium falciparum
KEIDNEKNKL

SEQ ID NO: 3225525 - protein, 12 aa, Plasmodium falciparum
KEIEDQKKNNMN

SEQ ID NO: 3225526 - protein, 7 aa, Plasmodium falciparum
KEIEENT

SEQ ID NO: 3225527 - protein, 5 aa, Plasmodium falciparum
KEIEK

SEQ ID NO: 3225528 - protein, 13 aa, Plasmodium falciparum
KEIEKKQQQKNGL

SEQ ID NO: 3225529 - protein, 6 aa, Plasmodium falciparum
KEIENY

SEQ ID NO: 3225530 - protein, 7 aa, Plasmodium falciparum
KEIHKDD

SEQ ID NO: 3225531 - protein, 12 aa, Plasmodium falciparum
KEIHKNGDNNKK

SEQ ID NO: 3225532 - protein, 9 aa, Plasmodium falciparum
KEIISSPNN

SEQ ID NO: 3225533 - protein, 12 aa, Plasmodium falciparum
KEIKDNKSNYDN

SEQ ID NO: 3225534 - protein, 9 aa, Plasmodium falciparum
KEIKDNNNN

SEQ ID NO: 3225535 - protein, 5 aa, Plasmodium falciparum
KEIKN

SEQ ID NO: 3225536 - protein, 11 aa, Plasmodium falciparum
KEIKNKGDMNY

SEQ ID NO: 3225537 - protein, 6 aa, Plasmodium falciparum
KEILNK

SEQ ID NO: 3225538 - protein, 80 aa, Plasmodium falciparum
KEINEGKNKEFEEGNNKDVKEENEKEINEGNEEEINEGNEKEIKEGNEKEIKEGNDKKFEEGNDKEIKEGNDKEIKEGDY

SEQ ID NO: 3225539 - protein, 63 aa, Plasmodium falciparum
KEININNNKEDNKKDNKKDNKKDNKKDNKKDNNNNNNNNNNNKDNKKEITSNFTSDNNNSNYN

SEQ ID NO: 3225540 - protein, 20 aa, Plasmodium falciparum
KEINKEKKENTGNNTDNNNL

SEQ ID NO: 3225541 - protein, 5 aa, Plasmodium falciparum
KEINN

SEQ ID NO: 3225542 - protein, 11 aa, Plasmodium falciparum
KEINNEPIDNV

SEQ ID NO: 3225543 - protein, 12 aa, Plasmodium falciparum
KEINNGKKTNHN

SEQ ID NO: 3225544 - protein, 20 aa, Plasmodium falciparum
KEINNLSSTDTADVKSNSND

SEQ ID NO: 3225545 - protein, 6 aa, Plasmodium falciparum
KEINPQ

SEQ ID NO: 3225546 - protein, 5 aa, Plasmodium falciparum
KEINY

SEQ ID NO: 3225547 - protein, 5 aa, Plasmodium falciparum
KEIPP

SEQ ID NO: 3225548 - protein, 7 aa, Plasmodium falciparum
KEIPTEN

SEQ ID NO: 3225549 - protein, 23 aa, Plasmodium falciparum
KEIQKSNTQLSQNSSQNYIPSNE

SEQ ID NO: 3225550 - protein, 8 aa, Plasmodium falciparum
KEIREGKR

SEQ ID NO: 3225551 - protein, 4 aa, Plasmodium falciparum
KEIS

SEQ ID NO: 3225552 - protein, 11 aa, Plasmodium falciparum
KEISDQSSFSN

SEQ ID NO: 3225553 - protein, 5 aa, Plasmodium falciparum
KEISK

SEQ ID NO: 3225554 - protein, 17 aa, Plasmodium falciparum
KEISKRKFNTKNVDSDH

SEQ ID NO: 3225555 - protein, 7 aa, Plasmodium falciparum
KEISNDR

SEQ ID NO: 3225556 - protein, 6 aa, Plasmodium falciparum
KEISSN

SEQ ID NO: 3225557 - protein, 31 aa, Plasmodium falciparum
KEISTTSDGKIKDMEDPKNISNKNENYDNTN

SEQ ID NO: 3225558 - protein, 4 aa, Plasmodium falciparum
KEIT

SEQ ID NO: 3225559 - protein, 7 aa, Plasmodium falciparum
KEITINK

SEQ ID NO: 3225560 - protein, 5 aa, Plasmodium falciparum
KEITN

SEQ ID NO: 3225561 - protein, 9 aa, Plasmodium falciparum
KEITNQTNK

SEQ ID NO: 3225562 - protein, 33 aa, Plasmodium falciparum
KEKAMKNKDKKCIETSNYGNNKKKSNNGYEQKE

SEQ ID NO: 3225563 - protein, 8 aa, Plasmodium falciparum
KEKATEDT

SEQ ID NO: 3225564 - protein, 8 aa, Plasmodium falciparum
KEKCKQER

SEQ ID NO: 3225565 - protein, 5 aa, Plasmodium falciparum
KEKDE

SEQ ID NO: 3225566 - protein, 6 aa, Plasmodium falciparum
KEKDEN

SEQ ID NO: 3225567 - protein, 7 aa, Plasmodium falciparum
KEKDEWD

SEQ ID NO: 3225568 - protein, 8 aa, Plasmodium falciparum
KEKDHNNN

SEQ ID NO: 3225569 - protein, 16 aa, Plasmodium falciparum
KEKDHNSSNDEDNIND

SEQ ID NO: 3225570 - protein, 5 aa, Plasmodium falciparum
KEKDI

SEQ ID NO: 3225571 - protein, 15 aa, Plasmodium falciparum
KEKDIKKYENNSYSL

SEQ ID NO: 3225572 - protein, 8 aa, Plasmodium falciparum
KEKDIQES

SEQ ID NO: 3225573 - protein, 15 aa, Plasmodium falciparum
KEKDKEKDKEKEVET

SEQ ID NO: 3225574 - protein, 10 aa, Plasmodium falciparum
KEKDKGRYNR

SEQ ID NO: 3225575 - protein, 6 aa, Plasmodium falciparum
KEKDKI

SEQ ID NO: 3225576 - protein, 6 aa, Plasmodium falciparum
KEKDKN

SEQ ID NO: 3225577 - protein, 7 aa, Plasmodium falciparum
KEKDKNY

SEQ ID NO: 3225578 - protein, 53 aa, Plasmodium falciparum
KEKDQEKDSDQPKNEDDNGSTEEDPDVVEDSDEDKREGGDNGDTGKPNDHSDR

SEQ ID NO: 3225579 - protein, 7 aa, Plasmodium falciparum
KEKDRKI

SEQ ID NO: 3225580 - protein, 13 aa, Plasmodium falciparum
KEKDRNNFLKKKI

SEQ ID NO: 3225581 - protein, 7 aa, Plasmodium falciparum
KEKDSNK

SEQ ID NO: 3225582 - protein, 7 aa, Plasmodium falciparum
KEKDSPS

SEQ ID NO: 3225583 - protein, 9 aa, Plasmodium falciparum
KEKEDENEN

SEQ ID NO: 3225584 - protein, 7 aa, Plasmodium falciparum
KEKEEGK

SEQ ID NO: 3225585 - protein, 15 aa, Plasmodium falciparum
KEKEHGMDKRNDTNI

SEQ ID NO: 3225586 - protein, 9 aa, Plasmodium falciparum
KEKEHNIDT

SEQ ID NO: 3225587 - protein, 21 aa, Plasmodium falciparum
KEKEIDDGLSREGEGDQHEEE

SEQ ID NO: 3225588 - protein, 15 aa, Plasmodium falciparum
KEKEIEEKKKQENEK

SEQ ID NO: 3225589 - protein, 15 aa, Plasmodium falciparum
KEKEIEEKRKRENGE

SEQ ID NO: 3225590 - protein, 5 aa, Plasmodium falciparum
KEKEK

SEQ ID NO: 3225591 - protein, 7 aa, Plasmodium falciparum
KEKEKEK

SEQ ID NO: 3225592 - protein, 20 aa, Plasmodium falciparum
KEKEKEKEDIEKNGQDTVAY

SEQ ID NO: 3225593 - protein, 28 aa, Plasmodium falciparum
KEKEKEKEQEQEQEQEQINKHKDNNNMY

SEQ ID NO: 3225594 - protein, 8 aa, Plasmodium falciparum
KEKEKKCT

SEQ ID NO: 3225595 - protein, 9 aa, Plasmodium falciparum
KEKEKNKNN

SEQ ID NO: 3225596 - protein, 10 aa, Plasmodium falciparum
KEKEKRKEKK

SEQ ID NO: 3225597 - protein, 25 aa, Plasmodium falciparum
KEKEKVKKKKKKKLASQNKVKRKSQ

SEQ ID NO: 3225598 - protein, 5 aa, Plasmodium falciparum
KEKEN

SEQ ID NO: 3225599 - protein, 6 aa, Plasmodium falciparum
KEKENC

SEQ ID NO: 3225600 - protein, 29 aa, Plasmodium falciparum
KEKENDNCDVNNKDTQGELSSQKGNEENI

SEQ ID NO: 3225601 - protein, 7 aa, Plasmodium falciparum
KEKENKN

SEQ ID NO: 3225602 - protein, 9 aa, Plasmodium falciparum
KEKENLEED

SEQ ID NO: 3225603 - protein, 14 aa, Plasmodium falciparum
KEKENSLSNTSNYS

SEQ ID NO: 3225604 - protein, 17 aa, Plasmodium falciparum
KEKENYENNKTYNKEES

SEQ ID NO: 3225605 - protein, 17 aa, Plasmodium falciparum
KEKEREEKEKNEQDVQY

SEQ ID NO: 3225606 - protein, 16 aa, Plasmodium falciparum
KEKEREYKEEKQRNGE

SEQ ID NO: 3225607 - protein, 5 aa, Plasmodium falciparum
KEKET

SEQ ID NO: 3225608 - protein, 6 aa, Plasmodium falciparum
KEKEWG

SEQ ID NO: 3225609 - protein, 4 aa, Plasmodium falciparum
KEKG

SEQ ID NO: 3225610 - protein, 20 aa, Plasmodium falciparum
KEKGIPKVSKENAKNKKKNV

SEQ ID NO: 3225611 - protein, 9 aa, Plasmodium falciparum
KEKGKKDFK

SEQ ID NO: 3225612 - protein, 10 aa, Plasmodium falciparum
KEKGKNKETV

SEQ ID NO: 3225613 - protein, 9 aa, Plasmodium falciparum
KEKGLNEKK

SEQ ID NO: 3225614 - protein, 6 aa, Plasmodium falciparum
KEKGNA

SEQ ID NO: 3225615 - protein, 7 aa, Plasmodium falciparum
KEKGNQW

SEQ ID NO: 3225616 - protein, 13 aa, Plasmodium falciparum
KEKGQKNKRNNNK

SEQ ID NO: 3225617 - protein, 6 aa, Plasmodium falciparum
KEKGSI

SEQ ID NO: 3225618 - protein, 13 aa, Plasmodium falciparum
KEKGSSKNNNNCV

SEQ ID NO: 3225619 - protein, 9 aa, Plasmodium falciparum
KEKGSYNIN

SEQ ID NO: 3225620 - protein, 6 aa, Plasmodium falciparum
KEKGTS

SEQ ID NO: 3225621 - protein, 6 aa, Plasmodium falciparum
KEKGYI

SEQ ID NO: 3225622 - protein, 6 aa, Plasmodium falciparum
KEKHEE

SEQ ID NO: 3225623 - protein, 14 aa, Plasmodium falciparum
KEKHNEAKERHEQN

SEQ ID NO: 3225624 - protein, 18 aa, Plasmodium falciparum
KEKHPQPSAENQTTCDES

SEQ ID NO: 3225625 - protein, 4 aa, Plasmodium falciparum
KEKI

SEQ ID NO: 3225626 - protein, 7 aa, Plasmodium falciparum
KEKIDQS

SEQ ID NO: 3225627 - protein, 49 aa, Plasmodium falciparum
KEKIEDLKESKKKNKKKNKKKEKVQKGEDHKDEDQKGEDQKEVQKEESY

SEQ ID NO: 3225628 - protein, 6 aa, Plasmodium falciparum
KEKIEN

SEQ ID NO: 3225629 - protein, 9 aa, Plasmodium falciparum
KEKIESAQN

SEQ ID NO: 3225630 - protein, 13 aa, Plasmodium falciparum
KEKIKRKKKKACD

SEQ ID NO: 3225631 - protein, 8 aa, Plasmodium falciparum
KEKINDEK

SEQ ID NO: 3225632 - protein, 10 aa, Plasmodium falciparum
KEKINGDKKG

SEQ ID NO: 3225633 - protein, 12 aa, Plasmodium falciparum
KEKIREKTNQNV

SEQ ID NO: 3225634 - protein, 10 aa, Plasmodium falciparum
KEKISSEGKE

SEQ ID NO: 3225635 - protein, 8 aa, Plasmodium falciparum
KEKISSNY

SEQ ID NO: 3225636 - protein, 4 aa, Plasmodium falciparum
KEKK

SEQ ID NO: 3225637 - protein, 15 aa, Plasmodium falciparum
KEKKDENSTKDEKEN

SEQ ID NO: 3225638 - protein, 38 aa, Plasmodium falciparum
KEKKDETESTKRSGTDHTNSSESTTDDNTNDRNFSRSK

SEQ ID NO: 3225639 - protein, 8 aa, Plasmodium falciparum
KEKKDEWE

SEQ ID NO: 3225640 - protein, 6 aa, Plasmodium falciparum
KEKKDN

SEQ ID NO: 3225641 - protein, 9 aa, Plasmodium falciparum
KEKKEESAF

SEQ ID NO: 3225642 - protein, 15 aa, Plasmodium falciparum
KEKKEGKKDKKNTTK

SEQ ID NO: 3225643 - protein, 12 aa, Plasmodium falciparum
KEKKEKRKNNET

SEQ ID NO: 3225644 - protein, 6 aa, Plasmodium falciparum
KEKKEL

SEQ ID NO: 3225645 - protein, 26 aa, Plasmodium falciparum
KEKKGKKKSYNRKKKENYNNDNYNIN

SEQ ID NO: 3225646 - protein, 9 aa, Plasmodium falciparum
KEKKGKYEK

SEQ ID NO: 3225647 - protein, 5 aa, Plasmodium falciparum
KEKKI

SEQ ID NO: 3225648 - protein, 31 aa, Plasmodium falciparum
KEKKITKKRNIKEDNSTDDLTGDSDNSSTNN

SEQ ID NO: 3225649 - protein, 10 aa, Plasmodium falciparum
KEKKKDNNKI

SEQ ID NO: 3225650 - protein, 21 aa, Plasmodium falciparum
KEKKKEEHQSFKKKRKEEQKY

SEQ ID NO: 3225651 - protein, 15 aa, Plasmodium falciparum
KEKKKEKDHKTKEGL

SEQ ID NO: 3225652 - protein, 8 aa, Plasmodium falciparum
KEKKKEQL

SEQ ID NO: 3225653 - protein, 8 aa, Plasmodium falciparum
KEKKKKKA

SEQ ID NO: 3225654 - protein, 16 aa, Plasmodium falciparum
KEKKKKKKKDSISKDI

SEQ ID NO: 3225655 - protein, 20 aa, Plasmodium falciparum
KEKKKKKKKKKKLDNSNDKI

SEQ ID NO: 3225656 - protein, 20 aa, Plasmodium falciparum
KEKKKKKKKRRRKKKDSEIK

SEQ ID NO: 3225657 - protein, 13 aa, Plasmodium falciparum
KEKKKKKKNNNND

SEQ ID NO: 3225658 - protein, 18 aa, Plasmodium falciparum
KEKKKKKKSVLTKNGPIL

SEQ ID NO: 3225659 - protein, 9 aa, Plasmodium falciparum
KEKKKKRKN

SEQ ID NO: 3225660 - protein, 8 aa, Plasmodium falciparum
KEKKKNDL

SEQ ID NO: 3225661 - protein, 22 aa, Plasmodium falciparum
KEKKKNEEETTVGNDSQKKTTI

SEQ ID NO: 3225662 - protein, 8 aa, Plasmodium falciparum
KEKKKNFG

SEQ ID NO: 3225663 - protein, 10 aa, Plasmodium falciparum
KEKKKNRKTN

SEQ ID NO: 3225664 - protein, 10 aa, Plasmodium falciparum
KEKKKNSIIE

SEQ ID NO: 3225665 - protein, 11 aa, Plasmodium falciparum
KEKKKRLKGKK

SEQ ID NO: 3225666 - protein, 10 aa, Plasmodium falciparum
KEKKKSIDEH

SEQ ID NO: 3225667 - protein, 12 aa, Plasmodium falciparum
KEKKLENIQDEY

SEQ ID NO: 3225668 - protein, 9 aa, Plasmodium falciparum
KEKKLEQNH

SEQ ID NO: 3225669 - protein, 8 aa, Plasmodium falciparum
KEKKLNDY

SEQ ID NO: 3225670 - protein, 46 aa, Plasmodium falciparum
KEKKMEKKMERQKEDQTDNQKDGQKDGQTDGQTDGQTNNQKDNTKN

SEQ ID NO: 3225671 - protein, 5 aa, Plasmodium falciparum
KEKKN

SEQ ID NO: 3225672 - protein, 8 aa, Plasmodium falciparum
KEKKNDQI

SEQ ID NO: 3225673 - protein, 10 aa, Plasmodium falciparum
KEKKNKKNIK

SEQ ID NO: 3225674 - protein, 11 aa, Plasmodium falciparum
KEKKNKNKKKN

SEQ ID NO: 3225675 - protein, 8 aa, Plasmodium falciparum
KEKKNKTN

SEQ ID NO: 3225676 - protein, 9 aa, Plasmodium falciparum
KEKKNSEQA

SEQ ID NO: 3225677 - protein, 20 aa, Plasmodium falciparum
KEKKNSNYEHTTTRQNENKN

SEQ ID NO: 3225678 - protein, 7 aa, Plasmodium falciparum
KEKKNVN

SEQ ID NO: 3225679 - protein, 7 aa, Plasmodium falciparum
KEKKNYN

SEQ ID NO: 3225680 - protein, 13 aa, Plasmodium falciparum
KEKKQKEKKKNRI

SEQ ID NO: 3225681 - protein, 17 aa, Plasmodium falciparum
KEKKRHSKNLRNSYNDE

SEQ ID NO: 3225682 - protein, 6 aa, Plasmodium falciparum
KEKKSI

SEQ ID NO: 3225683 - protein, 6 aa, Plasmodium falciparum
KEKKYK

SEQ ID NO: 3225684 - protein, 8 aa, Plasmodium falciparum
KEKLEKDK

SEQ ID NO: 3225685 - protein, 15 aa, Plasmodium falciparum
KEKLQGQQSDLEQER

SEQ ID NO: 3225686 - protein, 5 aa, Plasmodium falciparum
KEKND

SEQ ID NO: 3225687 - protein, 31 aa, Plasmodium falciparum
KEKNDGSGVPLNKEDNNKDTKINKNENNDDI

SEQ ID NO: 3225688 - protein, 8 aa, Plasmodium falciparum
KEKNDLSS

SEQ ID NO: 3225689 - protein, 6 aa, Plasmodium falciparum
KEKNEH

SEQ ID NO: 3225690 - protein, 7 aa, Plasmodium falciparum
KEKNEIG

SEQ ID NO: 3225691 - protein, 7 aa, Plasmodium falciparum
KEKNEIH

SEQ ID NO: 3225692 - protein, 8 aa, Plasmodium falciparum
KEKNETHK

SEQ ID NO: 3225693 - protein, 8 aa, Plasmodium falciparum
KEKNEVTN

SEQ ID NO: 3225694 - protein, 11 aa, Plasmodium falciparum
KEKNGNNKETK

SEQ ID NO: 3225695 - protein, 5 aa, Plasmodium falciparum
KEKNK

SEQ ID NO: 3225696 - protein, 15 aa, Plasmodium falciparum
KEKNKKDKKNEKGKM

SEQ ID NO: 3225697 - protein, 12 aa, Plasmodium falciparum
KEKNKKNKNRIN

SEQ ID NO: 3225698 - protein, 65 aa, Plasmodium falciparum
KEKNKSEERDGRKGKRKGKKKESLSNNKKNNNSKEQIKKKGYNNKMKNKSLKDKPYVDDDNVPRP

SEQ ID NO: 3225699 - protein, 7 aa, Plasmodium falciparum
KEKNLNE

SEQ ID NO: 3225700 - protein, 7 aa, Plasmodium falciparum
KEKNMRE

SEQ ID NO: 3225701 - protein, 5 aa, Plasmodium falciparum
KEKNN

SEQ ID NO: 3225702 - protein, 11 aa, Plasmodium falciparum
KEKNNENYKDS

SEQ ID NO: 3225703 - protein, 17 aa, Plasmodium falciparum
KEKNNNNEDDNNNNNNN

SEQ ID NO: 3225704 - protein, 9 aa, Plasmodium falciparum
KEKNNSHIT

SEQ ID NO: 3225705 - protein, 9 aa, Plasmodium falciparum
KEKNRVNTI

SEQ ID NO: 3225706 - protein, 7 aa, Plasmodium falciparum
KEKNTDI

SEQ ID NO: 3225707 - protein, 7 aa, Plasmodium falciparum
KEKNVYT

SEQ ID NO: 3225708 - protein, 8 aa, Plasmodium falciparum
KEKNYDSE

SEQ ID NO: 3225709 - protein, 9 aa, Plasmodium falciparum
KEKNYENNT

SEQ ID NO: 3225710 - protein, 8 aa, Plasmodium falciparum
KEKNYNEH

SEQ ID NO: 3225711 - protein, 10 aa, Plasmodium falciparum
KEKPCEDDNC

SEQ ID NO: 3225712 - protein, 5 aa, Plasmodium falciparum
KEKPI

SEQ ID NO: 3225713 - protein, 6 aa, Plasmodium falciparum
KEKPNL

SEQ ID NO: 3225714 - protein, 13 aa, Plasmodium falciparum
KEKPSKKNNNCVE

SEQ ID NO: 3225715 - protein, 10 aa, Plasmodium falciparum
KEKPTKHTFD

SEQ ID NO: 3225716 - protein, 25 aa, Plasmodium falciparum
KEKPTKNNEEDEEDEEEEKKNHEVL

SEQ ID NO: 3225717 - protein, 5 aa, Plasmodium falciparum
KEKQK

SEQ ID NO: 3225718 - protein, 7 aa, Plasmodium falciparum
KEKQKKQ

SEQ ID NO: 3225719 - protein, 22 aa, Plasmodium falciparum
KEKQKNKEEEAGASGGEDNTTI

SEQ ID NO: 3225720 - protein, 7 aa, Plasmodium falciparum
KEKQLNE

SEQ ID NO: 3225721 - protein, 8 aa, Plasmodium falciparum
KEKQNEEY

SEQ ID NO: 3225722 - protein, 15 aa, Plasmodium falciparum
KEKQNGYSEKKNNNI

SEQ ID NO: 3225723 - protein, 23 aa, Plasmodium falciparum
KEKQNKNNADHNNKHHETNSDSM

SEQ ID NO: 3225724 - protein, 36 aa, Plasmodium falciparum
KEKQNKVNNTNNQHTNNNKIKKKNAIQKNDTSHKNY

SEQ ID NO: 3225725 - protein, 6 aa, Plasmodium falciparum
KEKQNN

SEQ ID NO: 3225726 - protein, 25 aa, Plasmodium falciparum
KEKQNNNDKNKESNIEKDKNEQTKF

SEQ ID NO: 3225727 - protein, 8 aa, Plasmodium falciparum
KEKQRKEL

SEQ ID NO: 3225728 - protein, 8 aa, Plasmodium falciparum
KEKQTDKN

SEQ ID NO: 3225729 - protein, 12 aa, Plasmodium falciparum
KEKQTEHKSNNI

SEQ ID NO: 3225730 - protein, 13 aa, Plasmodium falciparum
KEKQTNTEETNNT

SEQ ID NO: 3225731 - protein, 4 aa, Plasmodium falciparum
KEKR

SEQ ID NO: 3225732 - protein, 8 aa, Plasmodium falciparum
KEKRAQYD

SEQ ID NO: 3225733 - protein, 8 aa, Plasmodium falciparum
KEKRKENL

SEQ ID NO: 3225734 - protein, 7 aa, Plasmodium falciparum
KEKRKKN

SEQ ID NO: 3225735 - protein, 13 aa, Plasmodium falciparum
KEKRKKRKMNKEP

SEQ ID NO: 3225736 - protein, 6 aa, Plasmodium falciparum
KEKRQR

SEQ ID NO: 3225737 - protein, 12 aa, Plasmodium falciparum
KEKRRKKEYSLC

SEQ ID NO: 3225738 - protein, 16 aa, Plasmodium falciparum
KEKRTKNKNKNENENE

SEQ ID NO: 3225739 - protein, 23 aa, Plasmodium falciparum
KEKSDPLKGNNNNNNNNNNNNNN

SEQ ID NO: 3225740 - protein, 24 aa, Plasmodium falciparum
KEKSEDASAQDNQNSLDAEEAKEL

SEQ ID NO: 3225741 - protein, 8 aa, Plasmodium falciparum
KEKSEELD

SEQ ID NO: 3225742 - protein, 10 aa, Plasmodium falciparum
KEKSGSKFKR

SEQ ID NO: 3225743 - protein, 12 aa, Plasmodium falciparum
KEKSIETEESIK

SEQ ID NO: 3225744 - protein, 6 aa, Plasmodium falciparum
KEKSKH

SEQ ID NO: 3225745 - protein, 7 aa, Plasmodium falciparum
KEKSKRN

SEQ ID NO: 3225746 - protein, 6 aa, Plasmodium falciparum
KEKSLN

SEQ ID NO: 3225747 - protein, 11 aa, Plasmodium falciparum
KEKSSKDADKY

SEQ ID NO: 3225748 - protein, 8 aa, Plasmodium falciparum
KEKSSNNI

SEQ ID NO: 3225749 - protein, 7 aa, Plasmodium falciparum
KEKTKNI

SEQ ID NO: 3225750 - protein, 32 aa, Plasmodium falciparum
KEKTKNKCNNNRKNNKKNKNNNNNENKRENYN

SEQ ID NO: 3225751 - protein, 12 aa, Plasmodium falciparum
KEKTKVEQNDDN

SEQ ID NO: 3225752 - protein, 9 aa, Plasmodium falciparum
KEKTNKKTT

SEQ ID NO: 3225753 - protein, 11 aa, Plasmodium falciparum
KEKTQEKKETV

SEQ ID NO: 3225754 - protein, 7 aa, Plasmodium falciparum
KEKTQVD

SEQ ID NO: 3225755 - protein, 9 aa, Plasmodium falciparum
KEKTRRTKR

SEQ ID NO: 3225756 - protein, 8 aa, Plasmodium falciparum
KEKTSAAD

SEQ ID NO: 3225757 - protein, 12 aa, Plasmodium falciparum
KEKTSKTKNEKI

SEQ ID NO: 3225758 - protein, 8 aa, Plasmodium falciparum
KEKTVYPY

SEQ ID NO: 3225759 - protein, 10 aa, Plasmodium falciparum
KEKVENDYPK

SEQ ID NO: 3225760 - protein, 6 aa, Plasmodium falciparum
KEKVGI

SEQ ID NO: 3225761 - protein, 4 aa, Plasmodium falciparum
KEKY

SEQ ID NO: 3225762 - protein, 6 aa, Plasmodium falciparum
KEKYDE

SEQ ID NO: 3225763 - protein, 7 aa, Plasmodium falciparum
KEKYDNT

SEQ ID NO: 3225764 - protein, 5 aa, Plasmodium falciparum
KEKYK

SEQ ID NO: 3225765 - protein, 6 aa, Plasmodium falciparum
KEKYKY

SEQ ID NO: 3225766 - protein, 20 aa, Plasmodium falciparum
KEKYRNKEEQNLQNNNNHTE

SEQ ID NO: 3225767 - protein, 19 aa, Plasmodium falciparum
KELADAETTDTSDSEDEDH

SEQ ID NO: 3225768 - protein, 16 aa, Plasmodium falciparum
KELAEKAGALAGEAAR

SEQ ID NO: 3225769 - protein, 11 aa, Plasmodium falciparum
KELAQKGEDQS

SEQ ID NO: 3225770 - protein, 21 aa, Plasmodium falciparum
KELDKGKKNKGKNNNTNNKSK

SEQ ID NO: 3225771 - protein, 7 aa, Plasmodium falciparum
KELDTDK

SEQ ID NO: 3225772 - protein, 14 aa, Plasmodium falciparum
KELDTDKKKPLKKN

SEQ ID NO: 3225773 - protein, 5 aa, Plasmodium falciparum
KELGK

SEQ ID NO: 3225774 - protein, 7 aa, Plasmodium falciparum
KELGQDK

SEQ ID NO: 3225775 - protein, 12 aa, Plasmodium falciparum
KELHEREKEIKG

SEQ ID NO: 3225776 - protein, 5 aa, Plasmodium falciparum
KELKN

SEQ ID NO: 3225777 - protein, 6 aa, Plasmodium falciparum
KELKQH

SEQ ID NO: 3225778 - protein, 5 aa, Plasmodium falciparum
KELKS

SEQ ID NO: 3225779 - protein, 5 aa, Plasmodium falciparum
KELNE

SEQ ID NO: 3225780 - protein, 6 aa, Plasmodium falciparum
KELPSD

SEQ ID NO: 3225781 - protein, 4 aa, Plasmodium falciparum
KELQ

SEQ ID NO: 3225782 - protein, 21 aa, Plasmodium falciparum
KELQKGRNTRLGNNKVNTKRY

SEQ ID NO: 3225783 - protein, 6 aa, Plasmodium falciparum
KELQNR

SEQ ID NO: 3225784 - protein, 9 aa, Plasmodium falciparum
KELSEKSKL

SEQ ID NO: 3225785 - protein, 6 aa, Plasmodium falciparum
KELSIQ

SEQ ID NO: 3225786 - protein, 12 aa, Plasmodium falciparum
KELSKKKNKMRN

SEQ ID NO: 3225787 - protein, 11 aa, Plasmodium falciparum
KELSNEKKTYE

SEQ ID NO: 3225788 - protein, 10 aa, Plasmodium falciparum
KELSNRKNEE

SEQ ID NO: 3225789 - protein, 18 aa, Plasmodium falciparum
KELSSKNNGTNLNDDISS

SEQ ID NO: 3225790 - protein, 10 aa, Plasmodium falciparum
KELSSNSSNI

SEQ ID NO: 3225791 - protein, 5 aa, Plasmodium falciparum
KELYN

SEQ ID NO: 3225792 - protein, 4 aa, Plasmodium falciparum
KEMD

SEQ ID NO: 3225793 - protein, 6 aa, Plasmodium falciparum
KEMKEN

SEQ ID NO: 3225794 - protein, 12 aa, Plasmodium falciparum
KEMKKRNSDKNY

SEQ ID NO: 3225795 - protein, 22 aa, Plasmodium falciparum
KEMKNNKSTTSYDNNNNNNNNQ

SEQ ID NO: 3225796 - protein, 4 aa, Plasmodium falciparum
KEMN

SEQ ID NO: 3225797 - protein, 5 aa, Plasmodium falciparum
KEMNK

SEQ ID NO: 3225798 - protein, 22 aa, Plasmodium falciparum
KEMTNQDNCRKSSHNKKRGYSL

SEQ ID NO: 3225799 - protein, 33 aa, Plasmodium falciparum
KENAEKNINEEIDEQYNGHKNNDECNSRNNNET

SEQ ID NO: 3225800 - protein, 8 aa, Plasmodium falciparum
KENANSKL

SEQ ID NO: 3225801 - protein, 5 aa, Plasmodium falciparum
KENCE

SEQ ID NO: 3225802 - protein, 8 aa, Plasmodium falciparum
KENDASTH

SEQ ID NO: 3225803 - protein, 6 aa, Plasmodium falciparum
KENDDI

SEQ ID NO: 3225804 - protein, 14 aa, Plasmodium falciparum
KENDDIEKKGNDLS

SEQ ID NO: 3225805 - protein, 49 aa, Plasmodium falciparum
KENDDNSDHLDTPVEQAKKRKLQNNNNKNNCDDNNKNNCDDNNKNNCDN

SEQ ID NO: 3225806 - protein, 8 aa, Plasmodium falciparum
KENDEKKI

SEQ ID NO: 3225807 - protein, 5 aa, Plasmodium falciparum
KENDI

SEQ ID NO: 3225808 - protein, 11 aa, Plasmodium falciparum
KENDKDKYSND

SEQ ID NO: 3225809 - protein, 6 aa, Plasmodium falciparum
KENDKF

SEQ ID NO: 3225810 - protein, 12 aa, Plasmodium falciparum
KENDKGEKYEKR

SEQ ID NO: 3225811 - protein, 5 aa, Plasmodium falciparum
KENDL

SEQ ID NO: 3225812 - protein, 7 aa, Plasmodium falciparum
KENDMKY

SEQ ID NO: 3225813 - protein, 6 aa, Plasmodium falciparum
KENDNE

SEQ ID NO: 3225814 - protein, 6 aa, Plasmodium falciparum
KENDNI

SEQ ID NO: 3225815 - protein, 42 aa, Plasmodium falciparum
KENDNLNNQQNYPANNNYHNNNNNNISTSLNTSTSNTQRSYY

SEQ ID NO: 3225816 - protein, 12 aa, Plasmodium falciparum
KENDNNNNCTIP

SEQ ID NO: 3225817 - protein, 29 aa, Plasmodium falciparum
KENDNNNNNNNNNNKNNNNYNSSSSSSNF

SEQ ID NO: 3225818 - protein, 12 aa, Plasmodium falciparum
KENDTEESSMEH

SEQ ID NO: 3225819 - protein, 7 aa, Plasmodium falciparum
KENEEKY

SEQ ID NO: 3225820 - protein, 10 aa, Plasmodium falciparum
KENEEREREQ

SEQ ID NO: 3225821 - protein, 15 aa, Plasmodium falciparum
KENEEVQDPLKTKKT

SEQ ID NO: 3225822 - protein, 8 aa, Plasmodium falciparum
KENEEVTH

SEQ ID NO: 3225823 - protein, 5 aa, Plasmodium falciparum
KENEI

SEQ ID NO: 3225824 - protein, 13 aa, Plasmodium falciparum
KENEKDKSTKGKI

SEQ ID NO: 3225825 - protein, 16 aa, Plasmodium falciparum
KENEKEIYSDDKDQKF

SEQ ID NO: 3225826 - protein, 11 aa, Plasmodium falciparum
KENEKINNQNG

SEQ ID NO: 3225827 - protein, 7 aa, Plasmodium falciparum
KENEKKK

SEQ ID NO: 3225828 - protein, 23 aa, Plasmodium falciparum
KENEKLEENSNLVPSSQQHCSEN

SEQ ID NO: 3225829 - protein, 30 aa, Plasmodium falciparum
KENEKNDQNHNNSNNNIDTSVKDKNKDNKL

SEQ ID NO: 3225830 - protein, 16 aa, Plasmodium falciparum
KENELDKQKNKYTKEI

SEQ ID NO: 3225831 - protein, 6 aa, Plasmodium falciparum
KENELN

SEQ ID NO: 3225832 - protein, 7 aa, Plasmodium falciparum
KENELNE

SEQ ID NO: 3225833 - protein, 12 aa, Plasmodium falciparum
KENEMNEKKNNM

SEQ ID NO: 3225834 - protein, 5 aa, Plasmodium falciparum
KENEN

SEQ ID NO: 3225835 - protein, 11 aa, Plasmodium falciparum
KENENDATDKI

SEQ ID NO: 3225836 - protein, 6 aa, Plasmodium falciparum
KENENI

SEQ ID NO: 3225837 - protein, 21 aa, Plasmodium falciparum
KENENNEQEASGGNNSQKKNT

SEQ ID NO: 3225838 - protein, 8 aa, Plasmodium falciparum
KENENNRS

SEQ ID NO: 3225839 - protein, 6 aa, Plasmodium falciparum
KENENS

SEQ ID NO: 3225840 - protein, 5 aa, Plasmodium falciparum
KENES

SEQ ID NO: 3225841 - protein, 8 aa, Plasmodium falciparum
KENESFGT

SEQ ID NO: 3225842 - protein, 6 aa, Plasmodium falciparum
KENESI

SEQ ID NO: 3225843 - protein, 5 aa, Plasmodium falciparum
KENEV

SEQ ID NO: 3225844 - protein, 10 aa, Plasmodium falciparum
KENEYDNSCS

SEQ ID NO: 3225845 - protein, 8 aa, Plasmodium falciparum
KENGEDIR

SEQ ID NO: 3225846 - protein, 8 aa, Plasmodium falciparum
KENGERKK

SEQ ID NO: 3225847 - protein, 15 aa, Plasmodium falciparum
KENGGETCNENSKND

SEQ ID NO: 3225848 - protein, 15 aa, Plasmodium falciparum
KENGGNKCSEESKKN

SEQ ID NO: 3225849 - protein, 8 aa, Plasmodium falciparum
KENGNGYI

SEQ ID NO: 3225850 - protein, 68 aa, Plasmodium falciparum
KENGTTDKENGTTDKENGMTDKESGTTDKENGMTDKESGTTDKENGTKDKENGTTDKDNITTDKEYEI

SEQ ID NO: 3225851 - protein, 4 aa, Plasmodium falciparum
KENH

SEQ ID NO: 3225852 - protein, 4 aa, Plasmodium falciparum
KENI

SEQ ID NO: 3225853 - protein, 6 aa, Plasmodium falciparum
KENIHS

SEQ ID NO: 3225854 - protein, 6 aa, Plasmodium falciparum
KENIKK

SEQ ID NO: 3225855 - protein, 6 aa, Plasmodium falciparum
KENIKQ

SEQ ID NO: 3225856 - protein, 17 aa, Plasmodium falciparum
KENIKRRGKRIKKDNME

SEQ ID NO: 3225857 - protein, 9 aa, Plasmodium falciparum
KENINGDKK

SEQ ID NO: 3225858 - protein, 6 aa, Plasmodium falciparum
KENIQN

SEQ ID NO: 3225859 - protein, 23 aa, Plasmodium falciparum
KENIRKDKINKNKCDKDTYDDYN

SEQ ID NO: 3225860 - protein, 6 aa, Plasmodium falciparum
KENIRS

SEQ ID NO: 3225861 - protein, 6 aa, Plasmodium falciparum
KENISK

SEQ ID NO: 3225862 - protein, 13 aa, Plasmodium falciparum
KENISSKSSSYDM

SEQ ID NO: 3225863 - protein, 5 aa, Plasmodium falciparum
KENIY

SEQ ID NO: 3225864 - protein, 21 aa, Plasmodium falciparum
KENKDDNKNFDNNKSFDNNKN

SEQ ID NO: 3225865 - protein, 11 aa, Plasmodium falciparum
KENKDDTGENM

SEQ ID NO: 3225866 - protein, 9 aa, Plasmodium falciparum
KENKDENEI

SEQ ID NO: 3225867 - protein, 32 aa, Plasmodium falciparum
KENKDKTKSIDQKEEDNNKSLNNIGSAKYTRK

SEQ ID NO: 3225868 - protein, 8 aa, Plasmodium falciparum
KENKEGDI

SEQ ID NO: 3225869 - protein, 10 aa, Plasmodium falciparum
KENKEIPNGI

SEQ ID NO: 3225870 - protein, 13 aa, Plasmodium falciparum
KENKENKRNESKI

SEQ ID NO: 3225871 - protein, 8 aa, Plasmodium falciparum
KENKETIC

SEQ ID NO: 3225872 - protein, 10 aa, Plasmodium falciparum
KENKIKEVDE

SEQ ID NO: 3225873 - protein, 11 aa, Plasmodium falciparum
KENKKDKNYKN

SEQ ID NO: 3225874 - protein, 20 aa, Plasmodium falciparum
KENKKKDNKNISVENNENDN

SEQ ID NO: 3225875 - protein, 40 aa, Plasmodium falciparum
KENKKNNDNNDNDKYSTSEEDTSDFSDTDDEDGDEEEKFS

SEQ ID NO: 3225876 - protein, 6 aa, Plasmodium falciparum
KENKKR

SEQ ID NO: 3225877 - protein, 7 aa, Plasmodium falciparum
KENKNDN

SEQ ID NO: 3225878 - protein, 6 aa, Plasmodium falciparum
KENKNI

SEQ ID NO: 3225879 - protein, 10 aa, Plasmodium falciparum
KENKNNNLSK

SEQ ID NO: 3225880 - protein, 13 aa, Plasmodium falciparum
KENKNTERKGSYI

SEQ ID NO: 3225881 - protein, 7 aa, Plasmodium falciparum
KENKNTI

SEQ ID NO: 3225882 - protein, 6 aa, Plasmodium falciparum
KENKPS

SEQ ID NO: 3225883 - protein, 9 aa, Plasmodium falciparum
KENKRNDIK

SEQ ID NO: 3225884 - protein, 8 aa, Plasmodium falciparum
KENKSREK

SEQ ID NO: 3225885 - protein, 19 aa, Plasmodium falciparum
KENKTHNNNNNNIHDGNGD

SEQ ID NO: 3225886 - protein, 12 aa, Plasmodium falciparum
KENKTNNNNKKK

SEQ ID NO: 3225887 - protein, 9 aa, Plasmodium falciparum
KENKTNYTY

SEQ ID NO: 3225888 - protein, 9 aa, Plasmodium falciparum
KENKTQNTS

SEQ ID NO: 3225889 - protein, 10 aa, Plasmodium falciparum
KENKTYSHTG

SEQ ID NO: 3225890 - protein, 23 aa, Plasmodium falciparum
KENKYGKREKQKKNDENNKYNND

SEQ ID NO: 3225891 - protein, 5 aa, Plasmodium falciparum
KENLN

SEQ ID NO: 3225892 - protein, 24 aa, Plasmodium falciparum
KENLSDKEDLSDMEYSNDKDDFSD

SEQ ID NO: 3225893 - protein, 22 aa, Plasmodium falciparum
KENLYNNNNNINEKNKKEVDNI

SEQ ID NO: 3225894 - protein, 6 aa, Plasmodium falciparum
KENMEQ

SEQ ID NO: 3225895 - protein, 6 aa, Plasmodium falciparum
KENNDK

SEQ ID NO: 3225896 - protein, 13 aa, Plasmodium falciparum
KENNEKLKSLTDD

SEQ ID NO: 3225897 - protein, 8 aa, Plasmodium falciparum
KENNINKR

SEQ ID NO: 3225898 - protein, 6 aa, Plasmodium falciparum
KENNIS

SEQ ID NO: 3225899 - protein, 7 aa, Plasmodium falciparum
KENNKKY

SEQ ID NO: 3225900 - protein, 10 aa, Plasmodium falciparum
KENNKMKKTN

SEQ ID NO: 3225901 - protein, 15 aa, Plasmodium falciparum
KENNKNGDDKIDCDD

SEQ ID NO: 3225902 - protein, 13 aa, Plasmodium falciparum
KENNKNTNKQTND

SEQ ID NO: 3225903 - protein, 6 aa, Plasmodium falciparum
KENNLN

SEQ ID NO: 3225904 - protein, 6 aa, Plasmodium falciparum
KENNND

SEQ ID NO: 3225905 - protein, 6 aa, Plasmodium falciparum
KENNNE

SEQ ID NO: 3225906 - protein, 15 aa, Plasmodium falciparum
KENNNEHEESKNEKH

SEQ ID NO: 3225907 - protein, 6 aa, Plasmodium falciparum
KENNNK

SEQ ID NO: 3225908 - protein, 8 aa, Plasmodium falciparum
KENNNLRN

SEQ ID NO: 3225909 - protein, 44 aa, Plasmodium falciparum
KENNNNNNNNNNNNNNNNNNNNKNNNNNNNNNNNKNNNNNNYYD

SEQ ID NO: 3225910 - protein, 14 aa, Plasmodium falciparum
KENNNTKKKKKKNF

SEQ ID NO: 3225911 - protein, 49 aa, Plasmodium falciparum
KENNQNNESNQNNESNQNNESNQNNESNQSNQNNHSINNNHDSNNYGEY

SEQ ID NO: 3225912 - protein, 19 aa, Plasmodium falciparum
KENNRRKSSVFDKSTKKLS

SEQ ID NO: 3225913 - protein, 13 aa, Plasmodium falciparum
KENNSKLKSLTDD

SEQ ID NO: 3225914 - protein, 8 aa, Plasmodium falciparum
KENNSNKY

SEQ ID NO: 3225915 - protein, 7 aa, Plasmodium falciparum
KENNTDM

SEQ ID NO: 3225916 - protein, 25 aa, Plasmodium falciparum
KENNVSHPYKEKKINKNKKTSSNSM

SEQ ID NO: 3225917 - protein, 5 aa, Plasmodium falciparum
KENPK

SEQ ID NO: 3225918 - protein, 6 aa, Plasmodium falciparum
KENQDK

SEQ ID NO: 3225919 - protein, 7 aa, Plasmodium falciparum
KENQDNY

SEQ ID NO: 3225920 - protein, 15 aa, Plasmodium falciparum
KENQEKGNKQESKVL

SEQ ID NO: 3225921 - protein, 7 aa, Plasmodium falciparum
KENQEKL

SEQ ID NO: 3225922 - protein, 17 aa, Plasmodium falciparum
KENRKCSNTLGNVDRNK

SEQ ID NO: 3225923 - protein, 42 aa, Plasmodium falciparum
KENRRKDNDKKKKKNKNIKSYNNDNYNKGDDNNNHSKRKQFH

SEQ ID NO: 3225924 - protein, 14 aa, Plasmodium falciparum
KENSEEDSEKYSDM

SEQ ID NO: 3225925 - protein, 8 aa, Plasmodium falciparum
KENSEYSH

SEQ ID NO: 3225926 - protein, 10 aa, Plasmodium falciparum
KENSKNPFKT

SEQ ID NO: 3225927 - protein, 12 aa, Plasmodium falciparum
KENSKSNDEPIE

SEQ ID NO: 3225928 - protein, 23 aa, Plasmodium falciparum
KENSSSSKEKNINNDKKSNMKYD

SEQ ID NO: 3225929 - protein, 9 aa, Plasmodium falciparum
KENSVTDNY

SEQ ID NO: 3225930 - protein, 12 aa, Plasmodium falciparum
KENTENKINMGN

SEQ ID NO: 3225931 - protein, 46 aa, Plasmodium falciparum
KENTKDDTKDDTKDDTKDDTKDDTKDDTKDDTKDDTKDDTKDDTKE

SEQ ID NO: 3225932 - protein, 16 aa, Plasmodium falciparum
KENTKDDTKDDTKDHI

SEQ ID NO: 3225933 - protein, 15 aa, Plasmodium falciparum
KENTKDDTKDHTKDH

SEQ ID NO: 3225934 - protein, 18 aa, Plasmodium falciparum
KENTKRQGGGAGGLGGVP

SEQ ID NO: 3225935 - protein, 12 aa, Plasmodium falciparum
KENTKRQSGSPL

SEQ ID NO: 3225936 - protein, 15 aa, Plasmodium falciparum
KENTKTQSVGSPLGG

SEQ ID NO: 3225937 - protein, 12 aa, Plasmodium falciparum
KENTLDEKNEDD

SEQ ID NO: 3225938 - protein, 8 aa, Plasmodium falciparum
KENTQEND

SEQ ID NO: 3225939 - protein, 31 aa, Plasmodium falciparum
KENTTFNHDSDTTVSEISTRKNRNKYIPDTN

SEQ ID NO: 3225940 - protein, 18 aa, Plasmodium falciparum
KENTTNTKKEEKKNDPEI

SEQ ID NO: 3225941 - protein, 7 aa, Plasmodium falciparum
KENVEND

SEQ ID NO: 3225942 - protein, 6 aa, Plasmodium falciparum
KENVQI

SEQ ID NO: 3225943 - protein, 5 aa, Plasmodium falciparum
KENVS

SEQ ID NO: 3225944 - protein, 9 aa, Plasmodium falciparum
KENVSNSSY

SEQ ID NO: 3225945 - protein, 9 aa, Plasmodium falciparum
KENVSSNTL

SEQ ID NO: 3225946 - protein, 13 aa, Plasmodium falciparum
KENVTINNEEECN

SEQ ID NO: 3225947 - protein, 4 aa, Plasmodium falciparum
KENY

SEQ ID NO: 3225948 - protein, 15 aa, Plasmodium falciparum
KENYENEEETKKNTH

SEQ ID NO: 3225949 - protein, 11 aa, Plasmodium falciparum
KENYETCSTET

SEQ ID NO: 3225950 - protein, 15 aa, Plasmodium falciparum
KENYKSGGNDLPRKE

SEQ ID NO: 3225951 - protein, 12 aa, Plasmodium falciparum
KEPDANEPNANE

SEQ ID NO: 3225952 - protein, 6 aa, Plasmodium falciparum
KEPFEQ

SEQ ID NO: 3225953 - protein, 6 aa, Plasmodium falciparum
KEPIYS

SEQ ID NO: 3225954 - protein, 23 aa, Plasmodium falciparum
KEPNDDIENDYDTKKSRYEELNE

SEQ ID NO: 3225955 - protein, 6 aa, Plasmodium falciparum
KEPPRI

SEQ ID NO: 3225956 - protein, 6 aa, Plasmodium falciparum
KEPPYH

SEQ ID NO: 3225957 - protein, 4 aa, Plasmodium falciparum
KEPR

SEQ ID NO: 3225958 - protein, 7 aa, Plasmodium falciparum
KEPSDDI

SEQ ID NO: 3225959 - protein, 7 aa, Plasmodium falciparum
KEPSDKR

SEQ ID NO: 3225960 - protein, 11 aa, Plasmodium falciparum
KEPSENIQNEN

SEQ ID NO: 3225961 - protein, 6 aa, Plasmodium falciparum
KEPSMY

SEQ ID NO: 3225962 - protein, 8 aa, Plasmodium falciparum
KEQAGNNA

SEQ ID NO: 3225963 - protein, 6 aa, Plasmodium falciparum
KEQCEK

SEQ ID NO: 3225964 - protein, 5 aa, Plasmodium falciparum
KEQCR

SEQ ID NO: 3225965 - protein, 7 aa, Plasmodium falciparum
KEQDEGE

SEQ ID NO: 3225966 - protein, 6 aa, Plasmodium falciparum
KEQDNN

SEQ ID NO: 3225967 - protein, 4 aa, Plasmodium falciparum
KEQE

SEQ ID NO: 3225968 - protein, 61 aa, Plasmodium falciparum
KEQEEDEKEKEQEEQEEQKEQEEQKEQKGQEEQKGQKEQKGQKEQKGQKEQEEQKEQEEQN

SEQ ID NO: 3225969 - protein, 16 aa, Plasmodium falciparum
KEQEEQRKKNKNSFKI

SEQ ID NO: 3225970 - protein, 8 aa, Plasmodium falciparum
KEQEEYDN

SEQ ID NO: 3225971 - protein, 12 aa, Plasmodium falciparum
KEQEGLEKQEEY

SEQ ID NO: 3225972 - protein, 120 aa, Plasmodium falciparum
KEQEIEHERKNETKEEKEQSIKEGKNKEFEEGRNKEFEEGRNKEFEEGRNKEFEEGRNKEFEEGRNKEFEEGRNKEFEDGRNKEFEEGRNKEFEERRNKEFEEGRNKEFEEGKNKEIKEV

SEQ ID NO: 3225973 - protein, 67 aa, Plasmodium falciparum
KEQEKEKQDEREKEKQDEREKEKQDEREKEKQDEREKEKQEEREKEKQEEREKEKQEEREKEKQEER

SEQ ID NO: 3225974 - protein, 10 aa, Plasmodium falciparum
KEQEKKKVEH

SEQ ID NO: 3225975 - protein, 5 aa, Plasmodium falciparum
KEQFD

SEQ ID NO: 3225976 - protein, 6 aa, Plasmodium falciparum
KEQFDK

SEQ ID NO: 3225977 - protein, 15 aa, Plasmodium falciparum
KEQFDKQKKKYDEEI

SEQ ID NO: 3225978 - protein, 13 aa, Plasmodium falciparum
KEQFDKQKQKYDK

SEQ ID NO: 3225979 - protein, 36 aa, Plasmodium falciparum
KEQFDKQKQKYQNEISGGGGRRQKRSTHSTKEYEGY

SEQ ID NO: 3225980 - protein, 5 aa, Plasmodium falciparum
KEQFH

SEQ ID NO: 3225981 - protein, 9 aa, Plasmodium falciparum
KEQGTKKRK

SEQ ID NO: 3225982 - protein, 14 aa, Plasmodium falciparum
KEQIKKKEKRNNIR

SEQ ID NO: 3225983 - protein, 18 aa, Plasmodium falciparum
KEQIQKDNNKKKNENITN

SEQ ID NO: 3225984 - protein, 4 aa, Plasmodium falciparum
KEQK

SEQ ID NO: 3225985 - protein, 6 aa, Plasmodium falciparum
KEQKCY

SEQ ID NO: 3225986 - protein, 7 aa, Plasmodium falciparum
KEQKDNL

SEQ ID NO: 3225987 - protein, 9 aa, Plasmodium falciparum
KEQKEENGK

SEQ ID NO: 3225988 - protein, 7 aa, Plasmodium falciparum
KEQKKEL

SEQ ID NO: 3225989 - protein, 6 aa, Plasmodium falciparum
KEQKNK

SEQ ID NO: 3225990 - protein, 17 aa, Plasmodium falciparum
KEQKQNKYEEKKDDAIN

SEQ ID NO: 3225991 - protein, 4 aa, Plasmodium falciparum
KEQL

SEQ ID NO: 3225992 - protein, 6 aa, Plasmodium falciparum
KEQLEN

SEQ ID NO: 3225993 - protein, 11 aa, Plasmodium falciparum
KEQLPENNKNF

SEQ ID NO: 3225994 - protein, 4 aa, Plasmodium falciparum
KEQM

SEQ ID NO: 3225995 - protein, 28 aa, Plasmodium falciparum
KEQMEYNEKEQVKDSEENNNINSSNNTM

SEQ ID NO: 3225996 - protein, 5 aa, Plasmodium falciparum
KEQMK

SEQ ID NO: 3225997 - protein, 7 aa, Plasmodium falciparum
KEQNEEN

SEQ ID NO: 3225998 - protein, 7 aa, Plasmodium falciparum
KEQNEEV

SEQ ID NO: 3225999 - protein, 26 aa, Plasmodium falciparum
KEQNKKKKKHNDRKHEKRNNRESIRK

SEQ ID NO: 3226000 - protein, 8 aa, Plasmodium falciparum
KEQNKTDF

SEQ ID NO: 3226001 - protein, 7 aa, Plasmodium falciparum
KEQNLEQ

SEQ ID NO: 3226002 - protein, 7 aa, Plasmodium falciparum
KEQNSEN

SEQ ID NO: 3226003 - protein, 7 aa, Plasmodium falciparum
KEQNVYN

SEQ ID NO: 3226004 - protein, 5 aa, Plasmodium falciparum
KEQNY

SEQ ID NO: 3226005 - protein, 6 aa, Plasmodium falciparum
KEQPEI

SEQ ID NO: 3226006 - protein, 16 aa, Plasmodium falciparum
KEQPETYENNSDSKNL

SEQ ID NO: 3226007 - protein, 5 aa, Plasmodium falciparum
KEQPN

SEQ ID NO: 3226008 - protein, 6 aa, Plasmodium falciparum
KEQQSK

SEQ ID NO: 3226009 - protein, 16 aa, Plasmodium falciparum
KEQQYKKLEQNDHQSN

SEQ ID NO: 3226010 - protein, 9 aa, Plasmodium falciparum
KEQRKKNEY

SEQ ID NO: 3226011 - protein, 17 aa, Plasmodium falciparum
KEQSGTINKKKNKNIKN

SEQ ID NO: 3226012 - protein, 43 aa, Plasmodium falciparum
KEQSKSTSAASTSDEISGSEGPSTESTSTGNQGEDKTTDNTYK

SEQ ID NO: 3226013 - protein, 8 aa, Plasmodium falciparum
KEQSPDMK

SEQ ID NO: 3226014 - protein, 6 aa, Plasmodium falciparum
KEQSSD

SEQ ID NO: 3226015 - protein, 7 aa, Plasmodium falciparum
KEQSSGN

SEQ ID NO: 3226016 - protein, 13 aa, Plasmodium falciparum
KEQTCSEESKNDC

SEQ ID NO: 3226017 - protein, 16 aa, Plasmodium falciparum
KEQTNNNQYRNVNNTK

SEQ ID NO: 3226018 - protein, 6 aa, Plasmodium falciparum
KEQYEE

SEQ ID NO: 3226019 - protein, 7 aa, Plasmodium falciparum
KERCQSN

SEQ ID NO: 3226020 - protein, 13 aa, Plasmodium falciparum
KEREEQKKNKLNV

SEQ ID NO: 3226021 - protein, 5 aa, Plasmodium falciparum
KEREG

SEQ ID NO: 3226022 - protein, 8 aa, Plasmodium falciparum
KEREGSVT

SEQ ID NO: 3226023 - protein, 6 aa, Plasmodium falciparum
KEREIE

SEQ ID NO: 3226024 - protein, 8 aa, Plasmodium falciparum
KEREKTGE

SEQ ID NO: 3226025 - protein, 19 aa, Plasmodium falciparum
KERETDDDNDDDNSNKMND

SEQ ID NO: 3226026 - protein, 7 aa, Plasmodium falciparum
KERGENV

SEQ ID NO: 3226027 - protein, 49 aa, Plasmodium falciparum
KERGTQQQNNNGNNNNDDNNDNKYDNDDNNDNKYDNNYNKYDNNNNNNI

SEQ ID NO: 3226028 - protein, 7 aa, Plasmodium falciparum
KERIKNK

SEQ ID NO: 3226029 - protein, 9 aa, Plasmodium falciparum
KERIKNNSM

SEQ ID NO: 3226030 - protein, 5 aa, Plasmodium falciparum
KERKE

SEQ ID NO: 3226031 - protein, 6 aa, Plasmodium falciparum
KERKEI

SEQ ID NO: 3226032 - protein, 8 aa, Plasmodium falciparum
KERKEKTH

SEQ ID NO: 3226033 - protein, 5 aa, Plasmodium falciparum
KERKN

SEQ ID NO: 3226034 - protein, 43 aa, Plasmodium falciparum
KERKNLSDNNINDKINNNNNYNNNNNNNIEDTTYYPTGNEKKE

SEQ ID NO: 3226035 - protein, 6 aa, Plasmodium falciparum
KERKNS

SEQ ID NO: 3226036 - protein, 9 aa, Plasmodium falciparum
KERKQYEND

SEQ ID NO: 3226037 - protein, 9 aa, Plasmodium falciparum
KERKSKENK

SEQ ID NO: 3226038 - protein, 7 aa, Plasmodium falciparum
KERKSSS

SEQ ID NO: 3226039 - protein, 6 aa, Plasmodium falciparum
KERKTY

SEQ ID NO: 3226040 - protein, 4 aa, Plasmodium falciparum
KERL

SEQ ID NO: 3226041 - protein, 6 aa, Plasmodium falciparum
KERMGT

SEQ ID NO: 3226042 - protein, 4 aa, Plasmodium falciparum
KERN

SEQ ID NO: 3226043 - protein, 28 aa, Plasmodium falciparum
KERNKEKEKKKKEKNNNNNNNNNNNNNN

SEQ ID NO: 3226044 - protein, 12 aa, Plasmodium falciparum
KERNNRNITYEE

SEQ ID NO: 3226045 - protein, 6 aa, Plasmodium falciparum
KERPIK

SEQ ID NO: 3226046 - protein, 8 aa, Plasmodium falciparum
KERPQGLN

SEQ ID NO: 3226047 - protein, 5 aa, Plasmodium falciparum
KERQI

SEQ ID NO: 3226048 - protein, 5 aa, Plasmodium falciparum
KERRA

SEQ ID NO: 3226049 - protein, 8 aa, Plasmodium falciparum
KERRASRR

SEQ ID NO: 3226050 - protein, 8 aa, Plasmodium falciparum
KERREDDI

SEQ ID NO: 3226051 - protein, 13 aa, Plasmodium falciparum
KERRKKEEHENEG

SEQ ID NO: 3226052 - protein, 6 aa, Plasmodium falciparum
KERRND

SEQ ID NO: 3226053 - protein, 4 aa, Plasmodium falciparum
KERS

SEQ ID NO: 3226054 - protein, 11 aa, Plasmodium falciparum
KERSEKLSNIE

SEQ ID NO: 3226055 - protein, 12 aa, Plasmodium falciparum
KERSKNKRNFTS

SEQ ID NO: 3226056 - protein, 6 aa, Plasmodium falciparum
KERTSI

SEQ ID NO: 3226057 - protein, 4 aa, Plasmodium falciparum
KERY

SEQ ID NO: 3226058 - protein, 6 aa, Plasmodium falciparum
KERYNQ

SEQ ID NO: 3226059 - protein, 9 aa, Plasmodium falciparum
KERYTNDGG

SEQ ID NO: 3226060 - protein, 5 aa, Plasmodium falciparum
KESAP

SEQ ID NO: 3226061 - protein, 7 aa, Plasmodium falciparum
KESDAEE

SEQ ID NO: 3226062 - protein, 8 aa, Plasmodium falciparum
KESDEEIN

SEQ ID NO: 3226063 - protein, 11 aa, Plasmodium falciparum
KESDEESPQNL

SEQ ID NO: 3226064 - protein, 18 aa, Plasmodium falciparum
KESDKEINEKDDHAHTND

SEQ ID NO: 3226065 - protein, 5 aa, Plasmodium falciparum
KESDR

SEQ ID NO: 3226066 - protein, 8 aa, Plasmodium falciparum
KESEDSYK

SEQ ID NO: 3226067 - protein, 5 aa, Plasmodium falciparum
KESEE

SEQ ID NO: 3226068 - protein, 61 aa, Plasmodium falciparum
KESEIKKGDNVKSKGIERSTTGKDEYVSDDDNDDSDHINDNNMNGSNNMHSSNNLTNSNKI

SEQ ID NO: 3226069 - protein, 5 aa, Plasmodium falciparum
KESEL

SEQ ID NO: 3226070 - protein, 15 aa, Plasmodium falciparum
KESENGDKTIEKDEQ

SEQ ID NO: 3226071 - protein, 8 aa, Plasmodium falciparum
KESENVND

SEQ ID NO: 3226072 - protein, 7 aa, Plasmodium falciparum
KESEYGK

SEQ ID NO: 3226073 - protein, 4 aa, Plasmodium falciparum
KESF

SEQ ID NO: 3226074 - protein, 11 aa, Plasmodium falciparum
KESGGDLRSAY

SEQ ID NO: 3226075 - protein, 8 aa, Plasmodium falciparum
KESGNNIN

SEQ ID NO: 3226076 - protein, 7 aa, Plasmodium falciparum
KESHAKN

SEQ ID NO: 3226077 - protein, 14 aa, Plasmodium falciparum
KESHKSNSSIRTDI

SEQ ID NO: 3226078 - protein, 5 aa, Plasmodium falciparum
KESHL

SEQ ID NO: 3226079 - protein, 5 aa, Plasmodium falciparum
KESID

SEQ ID NO: 3226080 - protein, 21 aa, Plasmodium falciparum
KESISGTRKRSNKNKKSHHEI

SEQ ID NO: 3226081 - protein, 6 aa, Plasmodium falciparum
KESKCK

SEQ ID NO: 3226082 - protein, 10 aa, Plasmodium falciparum
KESKDGSYKY

SEQ ID NO: 3226083 - protein, 9 aa, Plasmodium falciparum
KESKEIENK

SEQ ID NO: 3226084 - protein, 8 aa, Plasmodium falciparum
KESKKELN

SEQ ID NO: 3226085 - protein, 10 aa, Plasmodium falciparum
KESKKKGGLK

SEQ ID NO: 3226086 - protein, 27 aa, Plasmodium falciparum
KESKKNDQKYKTGKDNNNNNNNEITGV

SEQ ID NO: 3226087 - protein, 10 aa, Plasmodium falciparum
KESKNGDKTI

SEQ ID NO: 3226088 - protein, 7 aa, Plasmodium falciparum
KESLEDV

SEQ ID NO: 3226089 - protein, 13 aa, Plasmodium falciparum
KESLQHEKNIDGK

SEQ ID NO: 3226090 - protein, 13 aa, Plasmodium falciparum
KESLSNTCTNEDS

SEQ ID NO: 3226091 - protein, 21 aa, Plasmodium falciparum
KESNGGGGNTKWKRKEDMDKC

SEQ ID NO: 3226092 - protein, 5 aa, Plasmodium falciparum
KESNK

SEQ ID NO: 3226093 - protein, 9 aa, Plasmodium falciparum
KESNRSNRI

SEQ ID NO: 3226094 - protein, 13 aa, Plasmodium falciparum
KESNVSGDDDNVY

SEQ ID NO: 3226095 - protein, 5 aa, Plasmodium falciparum
KESQQ

SEQ ID NO: 3226096 - protein, 6 aa, Plasmodium falciparum
KESQTP

SEQ ID NO: 3226097 - protein, 27 aa, Plasmodium falciparum
KESREKSNIDDKKKKKMSKMKKKTNPA

SEQ ID NO: 3226098 - protein, 8 aa, Plasmodium falciparum
KESRKRND

SEQ ID NO: 3226099 - protein, 6 aa, Plasmodium falciparum
KESRLS

SEQ ID NO: 3226100 - protein, 6 aa, Plasmodium falciparum
KESSSS

SEQ ID NO: 3226101 - protein, 8 aa, Plasmodium falciparum
KESTDDKK

SEQ ID NO: 3226102 - protein, 7 aa, Plasmodium falciparum
KESTKAC

SEQ ID NO: 3226103 - protein, 4 aa, Plasmodium falciparum
KESY

SEQ ID NO: 3226104 - protein, 8 aa, Plasmodium falciparum
KESYNDTY

SEQ ID NO: 3226105 - protein, 6 aa, Plasmodium falciparum
KETCKD

SEQ ID NO: 3226106 - protein, 87 aa, Plasmodium falciparum
KETCPDEGLGRTAAGYRPPSVTKGGDEEEELSTDEEEEEDEDDTEESPQAEPEEAESEDPDGESSTAETTQQEAVAPTTQDNAEKPC

SEQ ID NO: 3226107 - protein, 42 aa, Plasmodium falciparum
KETDEFEQEEEHVGDKNYRGSKYNRANEKYGDDKKLKNDEQH

SEQ ID NO: 3226108 - protein, 7 aa, Plasmodium falciparum
KETDKDE

SEQ ID NO: 3226109 - protein, 9 aa, Plasmodium falciparum
KETDNNQNN

SEQ ID NO: 3226110 - protein, 17 aa, Plasmodium falciparum
KETDSEEDQNNKKNKNN

SEQ ID NO: 3226111 - protein, 9 aa, Plasmodium falciparum
KETDSLENS

SEQ ID NO: 3226112 - protein, 8 aa, Plasmodium falciparum
KETDTELN

SEQ ID NO: 3226113 - protein, 8 aa, Plasmodium falciparum
KETEEENV

SEQ ID NO: 3226114 - protein, 5 aa, Plasmodium falciparum
KETEI

SEQ ID NO: 3226115 - protein, 7 aa, Plasmodium falciparum
KETEIKG

SEQ ID NO: 3226116 - protein, 27 aa, Plasmodium falciparum
KETEKKKNKVDDDNNISDMKNNKENIK

SEQ ID NO: 3226117 - protein, 13 aa, Plasmodium falciparum
KETEKKQDTVKEV

SEQ ID NO: 3226118 - protein, 5 aa, Plasmodium falciparum
KETEN

SEQ ID NO: 3226119 - protein, 6 aa, Plasmodium falciparum
KETEQR

SEQ ID NO: 3226120 - protein, 6 aa, Plasmodium falciparum
KETGYQ

SEQ ID NO: 3226121 - protein, 13 aa, Plasmodium falciparum
KETKAEKKESPEY

SEQ ID NO: 3226122 - protein, 8 aa, Plasmodium falciparum
KETKEEYN

SEQ ID NO: 3226123 - protein, 17 aa, Plasmodium falciparum
KETKETDEQNKRRNTEV

SEQ ID NO: 3226124 - protein, 14 aa, Plasmodium falciparum
KETKGNEEKKKKNY

SEQ ID NO: 3226125 - protein, 18 aa, Plasmodium falciparum
KETKKNNQKNYISKEEKE

SEQ ID NO: 3226126 - protein, 8 aa, Plasmodium falciparum
KETKREEE

SEQ ID NO: 3226127 - protein, 4 aa, Plasmodium falciparum
KETN

SEQ ID NO: 3226128 - protein, 5 aa, Plasmodium falciparum
KETND

SEQ ID NO: 3226129 - protein, 6 aa, Plasmodium falciparum
KETNDN

SEQ ID NO: 3226130 - protein, 7 aa, Plasmodium falciparum
KETNDNM

SEQ ID NO: 3226131 - protein, 17 aa, Plasmodium falciparum
KETNDTYSKNPIDSPYP

SEQ ID NO: 3226132 - protein, 6 aa, Plasmodium falciparum
KETNKN

SEQ ID NO: 3226133 - protein, 7 aa, Plasmodium falciparum
KETNKNK

SEQ ID NO: 3226134 - protein, 5 aa, Plasmodium falciparum
KETNL

SEQ ID NO: 3226135 - protein, 9 aa, Plasmodium falciparum
KETNNTEKV

SEQ ID NO: 3226136 - protein, 10 aa, Plasmodium falciparum
KETPKFERKP

SEQ ID NO: 3226137 - protein, 25 aa, Plasmodium falciparum
KETPKKNKKKSQRNNTNNNKTDNYD

SEQ ID NO: 3226138 - protein, 13 aa, Plasmodium falciparum
KETQHPKLSPQKF

SEQ ID NO: 3226139 - protein, 8 aa, Plasmodium falciparum
KETQIDGD

SEQ ID NO: 3226140 - protein, 10 aa, Plasmodium falciparum
KETQSNKRNI

SEQ ID NO: 3226141 - protein, 16 aa, Plasmodium falciparum
KETRGINGSSHNNVSI

SEQ ID NO: 3226142 - protein, 4 aa, Plasmodium falciparum
KETS

SEQ ID NO: 3226143 - protein, 21 aa, Plasmodium falciparum
KETSGSGEKGEKTTITQDGTL

SEQ ID NO: 3226144 - protein, 17 aa, Plasmodium falciparum
KETSGSGGEKQIEKDSD

SEQ ID NO: 3226145 - protein, 26 aa, Plasmodium falciparum
KETSQEKNNNKKNCTLNNNNQEEFNE

SEQ ID NO: 3226146 - protein, 92 aa, Plasmodium falciparum
KETSRVVDNKKKKKRGKHMDDEEEDDDDDKGDKGGSGNNNNNNIDNDNYNDNNNDNYNDNYNDNYDDNYDDNKIGEKDNSHSKKREDEEDEN

SEQ ID NO: 3226147 - protein, 38 aa, Plasmodium falciparum
KETSTQNTNENNNNNNDDNNDDNNNDDNNNNTETKSGN

SEQ ID NO: 3226148 - protein, 5 aa, Plasmodium falciparum
KETTL

SEQ ID NO: 3226149 - protein, 30 aa, Plasmodium falciparum
KETYAQKDEKIDELNNDKTEEEKHIPTESV

SEQ ID NO: 3226150 - protein, 6 aa, Plasmodium falciparum
KETYKP

SEQ ID NO: 3226151 - protein, 4 aa, Plasmodium falciparum
KEVA

SEQ ID NO: 3226152 - protein, 5 aa, Plasmodium falciparum
KEVAE

SEQ ID NO: 3226153 - protein, 8 aa, Plasmodium falciparum
KEVDADDE

SEQ ID NO: 3226154 - protein, 13 aa, Plasmodium falciparum
KEVDDNDKNITNK

SEQ ID NO: 3226155 - protein, 18 aa, Plasmodium falciparum
KEVDKEVSKALESKNDVT

SEQ ID NO: 3226156 - protein, 6 aa, Plasmodium falciparum
KEVEGA

SEQ ID NO: 3226157 - protein, 5 aa, Plasmodium falciparum
KEVEK

SEQ ID NO: 3226158 - protein, 10 aa, Plasmodium falciparum
KEVENDDDDD

SEQ ID NO: 3226159 - protein, 13 aa, Plasmodium falciparum
KEVERTKNRPIAN

SEQ ID NO: 3226160 - protein, 9 aa, Plasmodium falciparum
KEVESSNHS

SEQ ID NO: 3226161 - protein, 6 aa, Plasmodium falciparum
KEVEST

SEQ ID NO: 3226162 - protein, 9 aa, Plasmodium falciparum
KEVKESQRK

SEQ ID NO: 3226163 - protein, 7 aa, Plasmodium falciparum
KEVKGSG

SEQ ID NO: 3226164 - protein, 10 aa, Plasmodium falciparum
KEVQTATQQS

SEQ ID NO: 3226165 - protein, 5 aa, Plasmodium falciparum
KEVRN

SEQ ID NO: 3226166 - protein, 25 aa, Plasmodium falciparum
KEVSEYKKKEKNNIKQGNEKGIDNK

SEQ ID NO: 3226167 - protein, 7 aa, Plasmodium falciparum
KEVSNNN

SEQ ID NO: 3226168 - protein, 31 aa, Plasmodium falciparum
KEVTDQDINGKELSEMDNKEIKENKKLDGEE

SEQ ID NO: 3226169 - protein, 6 aa, Plasmodium falciparum
KEVVGN

SEQ ID NO: 3226170 - protein, 14 aa, Plasmodium falciparum
KEWDDNKKKNSKTI

SEQ ID NO: 3226171 - protein, 4 aa, Plasmodium falciparum
KEWT

SEQ ID NO: 3226172 - protein, 4 aa, Plasmodium falciparum
KEYD

SEQ ID NO: 3226173 - protein, 15 aa, Plasmodium falciparum
KEYDDEDEDKKDSDM

SEQ ID NO: 3226174 - protein, 7 aa, Plasmodium falciparum
KEYDEKN

SEQ ID NO: 3226175 - protein, 6 aa, Plasmodium falciparum
KEYEQK

SEQ ID NO: 3226176 - protein, 10 aa, Plasmodium falciparum
KEYEQKKAKK

SEQ ID NO: 3226177 - protein, 13 aa, Plasmodium falciparum
KEYGNDNNDDVDK

SEQ ID NO: 3226178 - protein, 13 aa, Plasmodium falciparum
KEYIDNKESEKSV

SEQ ID NO: 3226179 - protein, 12 aa, Plasmodium falciparum
KEYIKKKKKKKI

SEQ ID NO: 3226180 - protein, 6 aa, Plasmodium falciparum
KEYKED

SEQ ID NO: 3226181 - protein, 17 aa, Plasmodium falciparum
KEYKETRKEMKTKSKTF

SEQ ID NO: 3226182 - protein, 12 aa, Plasmodium falciparum
KEYKHSEEKKRN

SEQ ID NO: 3226183 - protein, 18 aa, Plasmodium falciparum
KEYKNAKEKKKKKNEKFN

SEQ ID NO: 3226184 - protein, 8 aa, Plasmodium falciparum
KEYKNNSS

SEQ ID NO: 3226185 - protein, 14 aa, Plasmodium falciparum
KEYKQPKENYEKNR

SEQ ID NO: 3226186 - protein, 9 aa, Plasmodium falciparum
KEYKSYEDD

SEQ ID NO: 3226187 - protein, 4 aa, Plasmodium falciparum
KEYN

SEQ ID NO: 3226188 - protein, 12 aa, Plasmodium falciparum
KEYNDSNKRRRN

SEQ ID NO: 3226189 - protein, 18 aa, Plasmodium falciparum
KEYNEDNKMSNGNRKEQI

SEQ ID NO: 3226190 - protein, 16 aa, Plasmodium falciparum
KEYNKDNNKKNDDSYF

SEQ ID NO: 3226191 - protein, 12 aa, Plasmodium falciparum
KEYNKQKNTYEP

SEQ ID NO: 3226192 - protein, 11 aa, Plasmodium falciparum
KEYNNKKENIG

SEQ ID NO: 3226193 - protein, 6 aa, Plasmodium falciparum
KEYNNS

SEQ ID NO: 3226194 - protein, 5 aa, Plasmodium falciparum
KEYNQ

SEQ ID NO: 3226195 - protein, 17 aa, Plasmodium falciparum
KEYNSKALNEKDNIKKE

SEQ ID NO: 3226196 - protein, 4 aa, Plasmodium falciparum
KEYP

SEQ ID NO: 3226197 - protein, 6 aa, Plasmodium falciparum
KEYPDY

SEQ ID NO: 3226198 - protein, 9 aa, Plasmodium falciparum
KEYRRTKKE

SEQ ID NO: 3226199 - protein, 8 aa, Plasmodium falciparum
KEYSEKEH

SEQ ID NO: 3226200 - protein, 6 aa, Plasmodium falciparum
KEYSSE

SEQ ID NO: 3226201 - protein, 8 aa, Plasmodium falciparum
KEYTNNEY

SEQ ID NO: 3226202 - protein, 6 aa, Plasmodium falciparum
KEYVDK

SEQ ID NO: 3226203 - protein, 12 aa, Plasmodium falciparum
KEYYDKEQDEQN

SEQ ID NO: 3226204 - protein, 5 aa, Plasmodium falciparum
KFDDE

SEQ ID NO: 3226205 - protein, 14 aa, Plasmodium falciparum
KFDEKNQKTKENIN

SEQ ID NO: 3226206 - protein, 7 aa, Plasmodium falciparum
KFDENYE

SEQ ID NO: 3226207 - protein, 6 aa, Plasmodium falciparum
KFDEQN

SEQ ID NO: 3226208 - protein, 6 aa, Plasmodium falciparum
KFDGNQ

SEQ ID NO: 3226209 - protein, 16 aa, Plasmodium falciparum
KFDSENDMEQNYTNDN

SEQ ID NO: 3226210 - protein, 10 aa, Plasmodium falciparum
KFDTSDKFDT

SEQ ID NO: 3226211 - protein, 21 aa, Plasmodium falciparum
KFEEETEKQIEEGNDKEIEEE

SEQ ID NO: 3226212 - protein, 29 aa, Plasmodium falciparum
KFEEETEKQIEEGNDKEIKEGDHKKFEEK

SEQ ID NO: 3226213 - protein, 23 aa, Plasmodium falciparum
KFEEETEKQIEEGNDKEIKEGEY

SEQ ID NO: 3226214 - protein, 4 aa, Plasmodium falciparum
KFEG

SEQ ID NO: 3226215 - protein, 5 aa, Plasmodium falciparum
KFENK

SEQ ID NO: 3226216 - protein, 16 aa, Plasmodium falciparum
KFGDNREKKLGKHEHH

SEQ ID NO: 3226217 - protein, 16 aa, Plasmodium falciparum
KFGPSVESAGTANSQD

SEQ ID NO: 3226218 - protein, 27 aa, Plasmodium falciparum
KFKGTEKYDSDSHHDKSYYGEHTDNQD

SEQ ID NO: 3226219 - protein, 10 aa, Plasmodium falciparum
KFKKHTNHNN

SEQ ID NO: 3226220 - protein, 17 aa, Plasmodium falciparum
KFKKKEKKKKNNYEPCT

SEQ ID NO: 3226221 - protein, 11 aa, Plasmodium falciparum
KFKNGASPSSL

SEQ ID NO: 3226222 - protein, 9 aa, Plasmodium falciparum
KFKNGEEGA

SEQ ID NO: 3226223 - protein, 16 aa, Plasmodium falciparum
KFKNNSTNKNQTINTP

SEQ ID NO: 3226224 - protein, 40 aa, Plasmodium falciparum
KFKNSQNSENYFSGNGNNNQYENGYQNDDKNNDENEDEAN

SEQ ID NO: 3226225 - protein, 5 aa, Plasmodium falciparum
KFKSS

SEQ ID NO: 3226226 - protein, 4 aa, Plasmodium falciparum
KFND

SEQ ID NO: 3226227 - protein, 11 aa, Plasmodium falciparum
KFNPNKSRTFT

SEQ ID NO: 3226228 - protein, 7 aa, Plasmodium falciparum
KFNTSTR

SEQ ID NO: 3226229 - protein, 15 aa, Plasmodium falciparum
KFPKSTPTIQNKEKG

SEQ ID NO: 3226230 - protein, 12 aa, Plasmodium falciparum
KFPNMNKTDTED

SEQ ID NO: 3226231 - protein, 17 aa, Plasmodium falciparum
KFPSHRPDDLKKNERKL

SEQ ID NO: 3226232 - protein, 5 aa, Plasmodium falciparum
KFQAR

SEQ ID NO: 3226233 - protein, 5 aa, Plasmodium falciparum
KFQDD

SEQ ID NO: 3226234 - protein, 6 aa, Plasmodium falciparum
KFQEEK

SEQ ID NO: 3226235 - protein, 7 aa, Plasmodium falciparum
KFQNPFS

SEQ ID NO: 3226236 - protein, 4 aa, Plasmodium falciparum
KFSG

SEQ ID NO: 3226237 - protein, 9 aa, Plasmodium falciparum
KFSKEKNNN

SEQ ID NO: 3226238 - protein, 7 aa, Plasmodium falciparum
KFSNNRN

SEQ ID NO: 3226239 - protein, 6 aa, Plasmodium falciparum
KFSSNN

SEQ ID NO: 3226240 - protein, 9 aa, Plasmodium falciparum
KFSTKSEDI

SEQ ID NO: 3226241 - protein, 34 aa, Plasmodium falciparum
KFSTPTTTKEAKKTTSINSNNNNNNNNNKKDQEK

SEQ ID NO: 3226242 - protein, 8 aa, Plasmodium falciparum
KFTDEPNF

SEQ ID NO: 3226243 - protein, 6 aa, Plasmodium falciparum
KFTKEQ

SEQ ID NO: 3226244 - protein, 8 aa, Plasmodium falciparum
KFTNDPTY

SEQ ID NO: 3226245 - protein, 4 aa, Plasmodium falciparum
KFTP

SEQ ID NO: 3226246 - protein, 7 aa, Plasmodium falciparum
KFTPINK

SEQ ID NO: 3226247 - protein, 8 aa, Plasmodium falciparum
KFTSRGGK

SEQ ID NO: 3226248 - protein, 6 aa, Plasmodium falciparum
KFTTNS

SEQ ID NO: 3226249 - protein, 5 aa, Plasmodium falciparum
KFVTQ

SEQ ID NO: 3226250 - protein, 7 aa, Plasmodium falciparum
KGAAAGK

SEQ ID NO: 3226251 - protein, 9 aa, Plasmodium falciparum
KGAALHPST

SEQ ID NO: 3226252 - protein, 17 aa, Plasmodium falciparum
KGAEKELYENVAGRYMY

SEQ ID NO: 3226253 - protein, 4 aa, Plasmodium falciparum
KGAF

SEQ ID NO: 3226254 - protein, 6 aa, Plasmodium falciparum
KGAFEK

SEQ ID NO: 3226255 - protein, 6 aa, Plasmodium falciparum
KGAIEE

SEQ ID NO: 3226256 - protein, 15 aa, Plasmodium falciparum
KGANEDMNTKSNNNI

SEQ ID NO: 3226257 - protein, 7 aa, Plasmodium falciparum
KGANQYV

SEQ ID NO: 3226258 - protein, 7 aa, Plasmodium falciparum
KGAPIEN

SEQ ID NO: 3226259 - protein, 7 aa, Plasmodium falciparum
KGAQSDV

SEQ ID NO: 3226260 - protein, 9 aa, Plasmodium falciparum
KGARNIRRK

SEQ ID NO: 3226261 - protein, 11 aa, Plasmodium falciparum
KGCESSSSRNN

SEQ ID NO: 3226262 - protein, 8 aa, Plasmodium falciparum
KGCKEAQR

SEQ ID NO: 3226263 - protein, 4 aa, Plasmodium falciparum
KGCQ

SEQ ID NO: 3226264 - protein, 7 aa, Plasmodium falciparum
KGCRNGD

SEQ ID NO: 3226265 - protein, 8 aa, Plasmodium falciparum
KGCSEDDL

SEQ ID NO: 3226266 - protein, 17 aa, Plasmodium falciparum
KGDATKGKYTKKNGKAV

SEQ ID NO: 3226267 - protein, 9 aa, Plasmodium falciparum
KGDDEDTDN

SEQ ID NO: 3226268 - protein, 8 aa, Plasmodium falciparum
KGDDETRD

SEQ ID NO: 3226269 - protein, 9 aa, Plasmodium falciparum
KGDDKNDND

SEQ ID NO: 3226270 - protein, 19 aa, Plasmodium falciparum
KGDDTYENQNKRGKDRCEG

SEQ ID NO: 3226271 - protein, 5 aa, Plasmodium falciparum
KGDEK

SEQ ID NO: 3226272 - protein, 50 aa, Plasmodium falciparum
KGDELLGDSGERHPCGNGSASEKRFSEVSGGECDDKKIEGNGRNNGGACA

SEQ ID NO: 3226273 - protein, 25 aa, Plasmodium falciparum
KGDELLGDSGERHPCGNTTGKEDVD

SEQ ID NO: 3226274 - protein, 11 aa, Plasmodium falciparum
KGDERSKNKNK

SEQ ID NO: 3226275 - protein, 7 aa, Plasmodium falciparum
KGDETKP

SEQ ID NO: 3226276 - protein, 72 aa, Plasmodium falciparum
KGDGEENNGNQNNGEEYNGKEYNGNQNNGNQNNGKQNNGNQNNGKQNNGNQNNVKQNNGEDTNKNNNNDDIN

SEQ ID NO: 3226277 - protein, 7 aa, Plasmodium falciparum
KGDHDES

SEQ ID NO: 3226278 - protein, 9 aa, Plasmodium falciparum
KGDHDIPTL

SEQ ID NO: 3226279 - protein, 8 aa, Plasmodium falciparum
KGDHHNDD

SEQ ID NO: 3226280 - protein, 9 aa, Plasmodium falciparum
KGDHHNDDF

SEQ ID NO: 3226281 - protein, 4 aa, Plasmodium falciparum
KGDK

SEQ ID NO: 3226282 - protein, 8 aa, Plasmodium falciparum
KGDKDKGD

SEQ ID NO: 3226283 - protein, 16 aa, Plasmodium falciparum
KGDKEVSENKEEDNDY

SEQ ID NO: 3226284 - protein, 20 aa, Plasmodium falciparum
KGDLNTANGYNSETRGTTDP

SEQ ID NO: 3226285 - protein, 22 aa, Plasmodium falciparum
KGDLRKEKVHNKSSVQNNNKYK

SEQ ID NO: 3226286 - protein, 6 aa, Plasmodium falciparum
KGDLSQ

SEQ ID NO: 3226287 - protein, 22 aa, Plasmodium falciparum
KGDLSSATFPTGRRHEKPQSES

SEQ ID NO: 3226288 - protein, 38 aa, Plasmodium falciparum
KGDMKDKEDTKNQTIKEKGGDIKKKDDIKKKDDIKKDD

SEQ ID NO: 3226289 - protein, 9 aa, Plasmodium falciparum
KGDMKRSNR

SEQ ID NO: 3226290 - protein, 9 aa, Plasmodium falciparum
KGDNGQKVN

SEQ ID NO: 3226291 - protein, 6 aa, Plasmodium falciparum
KGDNII

SEQ ID NO: 3226292 - protein, 7 aa, Plasmodium falciparum
KGDNKNN

SEQ ID NO: 3226293 - protein, 7 aa, Plasmodium falciparum
KGDQNKI

SEQ ID NO: 3226294 - protein, 7 aa, Plasmodium falciparum
KGDSDKV

SEQ ID NO: 3226295 - protein, 26 aa, Plasmodium falciparum
KGDSEDENKEKETKDHRLKDGGDTFE

SEQ ID NO: 3226296 - protein, 8 aa, Plasmodium falciparum
KGDSENAK

SEQ ID NO: 3226297 - protein, 35 aa, Plasmodium falciparum
KGDSKKDEMKKENPKEENDNNNDNKSNSNSNNNYK

SEQ ID NO: 3226298 - protein, 5 aa, Plasmodium falciparum
KGDSN

SEQ ID NO: 3226299 - protein, 7 aa, Plasmodium falciparum
KGDVKDD

SEQ ID NO: 3226300 - protein, 9 aa, Plasmodium falciparum
KGDYGIPTM

SEQ ID NO: 3226301 - protein, 15 aa, Plasmodium falciparum
KGDYGIPTPKSSNRY

SEQ ID NO: 3226302 - protein, 23 aa, Plasmodium falciparum
KGDYHNNDNYKKHNNNNNNNNNM

SEQ ID NO: 3226303 - protein, 6 aa, Plasmodium falciparum
KGDYNI

SEQ ID NO: 3226304 - protein, 19 aa, Plasmodium falciparum
KGEDEKSINKNKRKDIDGK

SEQ ID NO: 3226305 - protein, 6 aa, Plasmodium falciparum
KGEDNV

SEQ ID NO: 3226306 - protein, 7 aa, Plasmodium falciparum
KGEDPGK

SEQ ID NO: 3226307 - protein, 6 aa, Plasmodium falciparum
KGEDVK

SEQ ID NO: 3226308 - protein, 16 aa, Plasmodium falciparum
KGEDVKYKDDLDNKEN

SEQ ID NO: 3226309 - protein, 28 aa, Plasmodium falciparum
KGEEENKDNFSKKEEKSDNENSNEEIDK

SEQ ID NO: 3226310 - protein, 17 aa, Plasmodium falciparum
KGEEENKNNDDDNLRKD

SEQ ID NO: 3226311 - protein, 42 aa, Plasmodium falciparum
KGEEIQNNEKIKEEENQNNKKKDDQTKANEDDVNRDDTYKND

SEQ ID NO: 3226312 - protein, 6 aa, Plasmodium falciparum
KGEEKN

SEQ ID NO: 3226313 - protein, 10 aa, Plasmodium falciparum
KGEEKTNKKS

SEQ ID NO: 3226314 - protein, 123 aa, Plasmodium falciparum
KGEGCVDNNDGNNNDGDNNDGDNNDGNSNDDNNNDDNNNIDNNDGNSNDDNNNDDNNNIDNNDDNNNIDNNDDNNDDNNNEKGKSSNCNDETMDEQANQYDNKLANQKDDKNVEEKNNAENRI

SEQ ID NO: 3226315 - protein, 6 aa, Plasmodium falciparum
KGEGHE

SEQ ID NO: 3226316 - protein, 4 aa, Plasmodium falciparum
KGEH

SEQ ID NO: 3226317 - protein, 6 aa, Plasmodium falciparum
KGEIPD

SEQ ID NO: 3226318 - protein, 11 aa, Plasmodium falciparum
KGEKKKRGNHN

SEQ ID NO: 3226319 - protein, 11 aa, Plasmodium falciparum
KGEKTEKNENV

SEQ ID NO: 3226320 - protein, 8 aa, Plasmodium falciparum
KGELTGEQ

SEQ ID NO: 3226321 - protein, 7 aa, Plasmodium falciparum
KGENQIN

SEQ ID NO: 3226322 - protein, 7 aa, Plasmodium falciparum
KGEPSDE

SEQ ID NO: 3226323 - protein, 39 aa, Plasmodium falciparum
KGESNTNDTNINNNNNNYNNNYNNNYNNNYNNYNYNNNN

SEQ ID NO: 3226324 - protein, 8 aa, Plasmodium falciparum
KGESYDNY

SEQ ID NO: 3226325 - protein, 6 aa, Plasmodium falciparum
KGETHE

SEQ ID NO: 3226326 - protein, 13 aa, Plasmodium falciparum
KGETQNKDNTNKY

SEQ ID NO: 3226327 - protein, 5 aa, Plasmodium falciparum
KGETV

SEQ ID NO: 3226328 - protein, 4 aa, Plasmodium falciparum
KGEY

SEQ ID NO: 3226329 - protein, 16 aa, Plasmodium falciparum
KGEYGIPTSKSKNRYI

SEQ ID NO: 3226330 - protein, 6 aa, Plasmodium falciparum
KGFDRN

SEQ ID NO: 3226331 - protein, 4 aa, Plasmodium falciparum
KGFE

SEQ ID NO: 3226332 - protein, 15 aa, Plasmodium falciparum
KGFEKRKKTKEEDFD

SEQ ID NO: 3226333 - protein, 6 aa, Plasmodium falciparum
KGFPTD

SEQ ID NO: 3226334 - protein, 10 aa, Plasmodium falciparum
KGGDGTAGSS

SEQ ID NO: 3226335 - protein, 8 aa, Plasmodium falciparum
KGGDLVSP

SEQ ID NO: 3226336 - protein, 5 aa, Plasmodium falciparum
KGGEG

SEQ ID NO: 3226337 - protein, 8 aa, Plasmodium falciparum
KGGEKIGE

SEQ ID NO: 3226338 - protein, 6 aa, Plasmodium falciparum
KGGENI

SEQ ID NO: 3226339 - protein, 5 aa, Plasmodium falciparum
KGGKH

SEQ ID NO: 3226340 - protein, 10 aa, Plasmodium falciparum
KGGKKGKNII

SEQ ID NO: 3226341 - protein, 6 aa, Plasmodium falciparum
KGGKTK

SEQ ID NO: 3226342 - protein, 7 aa, Plasmodium falciparum
KGGLPGM

SEQ ID NO: 3226343 - protein, 8 aa, Plasmodium falciparum
KGGNENIS

SEQ ID NO: 3226344 - protein, 10 aa, Plasmodium falciparum
KGGNKKNDTE

SEQ ID NO: 3226345 - protein, 14 aa, Plasmodium falciparum
KGGNPSTAEGQNKI

SEQ ID NO: 3226346 - protein, 10 aa, Plasmodium falciparum
KGGNVKYKNN

SEQ ID NO: 3226347 - protein, 4 aa, Plasmodium falciparum
KGGR

SEQ ID NO: 3226348 - protein, 12 aa, Plasmodium falciparum
KGGSYSSNNNNN

SEQ ID NO: 3226349 - protein, 7 aa, Plasmodium falciparum
KGGTHPN

SEQ ID NO: 3226350 - protein, 7 aa, Plasmodium falciparum
KGGWGVK

SEQ ID NO: 3226351 - protein, 18 aa, Plasmodium falciparum
KGHCDNAANGKDCPTGKI

SEQ ID NO: 3226352 - protein, 11 aa, Plasmodium falciparum
KGHDDKEKKKN

SEQ ID NO: 3226353 - protein, 8 aa, Plasmodium falciparum
KGHGIGSE

SEQ ID NO: 3226354 - protein, 21 aa, Plasmodium falciparum
KGHNYHKNEEDEMNKRSNTKI

SEQ ID NO: 3226355 - protein, 7 aa, Plasmodium falciparum
KGHSNNK

SEQ ID NO: 3226356 - protein, 11 aa, Plasmodium falciparum
KGIDKRNSLPI

SEQ ID NO: 3226357 - protein, 114 aa, Plasmodium falciparum
KGIGAEKGKQNCYDDGDDEHFDDDDDEQLDDGDDEQLDDDDDEQLDDDDDEQLDDDDDEQLDDDDDEQLDDSDDEIYDNQKEYSHDDEMYNDEKNVDKANYPKTTSDSQNELTN

SEQ ID NO: 3226358 - protein, 13 aa, Plasmodium falciparum
KGIGNEIIVHTRI

SEQ ID NO: 3226359 - protein, 13 aa, Plasmodium falciparum
KGINEKDENGVYK

SEQ ID NO: 3226360 - protein, 9 aa, Plasmodium falciparum
KGINKYNNE

SEQ ID NO: 3226361 - protein, 33 aa, Plasmodium falciparum
KGIPTKKENKDDMINKESNKEDITNEGKSNSLN

SEQ ID NO: 3226362 - protein, 5 aa, Plasmodium falciparum
KGIRG

SEQ ID NO: 3226363 - protein, 7 aa, Plasmodium falciparum
KGIRGRN

SEQ ID NO: 3226364 - protein, 8 aa, Plasmodium falciparum
KGIRRTEK

SEQ ID NO: 3226365 - protein, 6 aa, Plasmodium falciparum
KGISEK

SEQ ID NO: 3226366 - protein, 14 aa, Plasmodium falciparum
KGISEKQKKNKNKI

SEQ ID NO: 3226367 - protein, 16 aa, Plasmodium falciparum
KGISRNKIKKNHDNNC

SEQ ID NO: 3226368 - protein, 8 aa, Plasmodium falciparum
KGITNNDN

SEQ ID NO: 3226369 - protein, 20 aa, Plasmodium falciparum
KGITSREKNAEEINNNEKKD

SEQ ID NO: 3226370 - protein, 5 aa, Plasmodium falciparum
KGIYK

SEQ ID NO: 3226371 - protein, 6 aa, Plasmodium falciparum
KGIYSN

SEQ ID NO: 3226372 - protein, 4 aa, Plasmodium falciparum
KGKA

SEQ ID NO: 3226373 - protein, 15 aa, Plasmodium falciparum
KGKAISKGNGKYPNE

SEQ ID NO: 3226374 - protein, 5 aa, Plasmodium falciparum
KGKCE

SEQ ID NO: 3226375 - protein, 27 aa, Plasmodium falciparum
KGKDDKSKTKNEKQDKGKNKDEFDNDD

SEQ ID NO: 3226376 - protein, 5 aa, Plasmodium falciparum
KGKDE

SEQ ID NO: 3226377 - protein, 11 aa, Plasmodium falciparum
KGKDGETTEIN

SEQ ID NO: 3226378 - protein, 7 aa, Plasmodium falciparum
KGKDIQK

SEQ ID NO: 3226379 - protein, 5 aa, Plasmodium falciparum
KGKDK

SEQ ID NO: 3226380 - protein, 6 aa, Plasmodium falciparum
KGKDTY

SEQ ID NO: 3226381 - protein, 4 aa, Plasmodium falciparum
KGKE

SEQ ID NO: 3226382 - protein, 9 aa, Plasmodium falciparum
KGKEDKGNE

SEQ ID NO: 3226383 - protein, 9 aa, Plasmodium falciparum
KGKEENNPF

SEQ ID NO: 3226384 - protein, 6 aa, Plasmodium falciparum
KGKEIN

SEQ ID NO: 3226385 - protein, 10 aa, Plasmodium falciparum
KGKEKKDKIK

SEQ ID NO: 3226386 - protein, 10 aa, Plasmodium falciparum
KGKEKKIRNN

SEQ ID NO: 3226387 - protein, 9 aa, Plasmodium falciparum
KGKEKNSDI

SEQ ID NO: 3226388 - protein, 6 aa, Plasmodium falciparum
KGKEKS

SEQ ID NO: 3226389 - protein, 5 aa, Plasmodium falciparum
KGKEL

SEQ ID NO: 3226390 - protein, 6 aa, Plasmodium falciparum
KGKEQF

SEQ ID NO: 3226391 - protein, 6 aa, Plasmodium falciparum
KGKEWE

SEQ ID NO: 3226392 - protein, 12 aa, Plasmodium falciparum
KGKGEGKVIEES

SEQ ID NO: 3226393 - protein, 9 aa, Plasmodium falciparum
KGKGNEMNE

SEQ ID NO: 3226394 - protein, 7 aa, Plasmodium falciparum
KGKHESL

SEQ ID NO: 3226395 - protein, 8 aa, Plasmodium falciparum
KGKHKDNK

SEQ ID NO: 3226396 - protein, 29 aa, Plasmodium falciparum
KGKHNYNNINNNNNNNIISSSNGSSNNNK

SEQ ID NO: 3226397 - protein, 14 aa, Plasmodium falciparum
KGKHQNNYSDQHPC

SEQ ID NO: 3226398 - protein, 5 aa, Plasmodium falciparum
KGKIE

SEQ ID NO: 3226399 - protein, 6 aa, Plasmodium falciparum
KGKKEI

SEQ ID NO: 3226400 - protein, 6 aa, Plasmodium falciparum
KGKKEK

SEQ ID NO: 3226401 - protein, 9 aa, Plasmodium falciparum
KGKKKEIDI

SEQ ID NO: 3226402 - protein, 6 aa, Plasmodium falciparum
KGKKKH

SEQ ID NO: 3226403 - protein, 5 aa, Plasmodium falciparum
KGKKN

SEQ ID NO: 3226404 - protein, 8 aa, Plasmodium falciparum
KGKKRKNV

SEQ ID NO: 3226405 - protein, 6 aa, Plasmodium falciparum
KGKKTE

SEQ ID NO: 3226406 - protein, 9 aa, Plasmodium falciparum
KGKKTQELK

SEQ ID NO: 3226407 - protein, 12 aa, Plasmodium falciparum
KGKLQKAASTIS

SEQ ID NO: 3226408 - protein, 8 aa, Plasmodium falciparum
KGKNEDYM

SEQ ID NO: 3226409 - protein, 6 aa, Plasmodium falciparum
KGKNIS

SEQ ID NO: 3226410 - protein, 18 aa, Plasmodium falciparum
KGKNKYFTQNADDSNSDI

SEQ ID NO: 3226411 - protein, 22 aa, Plasmodium falciparum
KGKNNQKKMNNNNNNNKKYTCT

SEQ ID NO: 3226412 - protein, 7 aa, Plasmodium falciparum
KGKNYNK

SEQ ID NO: 3226413 - protein, 26 aa, Plasmodium falciparum
KGKQDGQAINEKRDGQAINERQDGQI

SEQ ID NO: 3226414 - protein, 6 aa, Plasmodium falciparum
KGKQDY

SEQ ID NO: 3226415 - protein, 10 aa, Plasmodium falciparum
KGKRGISKEE

SEQ ID NO: 3226416 - protein, 9 aa, Plasmodium falciparum
KGKRGKAKK

SEQ ID NO: 3226417 - protein, 7 aa, Plasmodium falciparum
KGKRSTH

SEQ ID NO: 3226418 - protein, 8 aa, Plasmodium falciparum
KGKSTDMN

SEQ ID NO: 3226419 - protein, 15 aa, Plasmodium falciparum
KGKTECNDAGDYKED

SEQ ID NO: 3226420 - protein, 7 aa, Plasmodium falciparum
KGKTKNC

SEQ ID NO: 3226421 - protein, 5 aa, Plasmodium falciparum
KGKTL

SEQ ID NO: 3226422 - protein, 5 aa, Plasmodium falciparum
KGKVN

SEQ ID NO: 3226423 - protein, 7 aa, Plasmodium falciparum
KGKVNTH

SEQ ID NO: 3226424 - protein, 4 aa, Plasmodium falciparum
KGKY

SEQ ID NO: 3226425 - protein, 11 aa, Plasmodium falciparum
KGKYKKEDKIK

SEQ ID NO: 3226426 - protein, 13 aa, Plasmodium falciparum
KGKYRKDKRKTYK

SEQ ID NO: 3226427 - protein, 11 aa, Plasmodium falciparum
KGLAAGEAARI

SEQ ID NO: 3226428 - protein, 7 aa, Plasmodium falciparum
KGLDQED

SEQ ID NO: 3226429 - protein, 30 aa, Plasmodium falciparum
KGLENDSSKKNKKEKPTNKLPDTGNNKELN

SEQ ID NO: 3226430 - protein, 7 aa, Plasmodium falciparum
KGLEPGP

SEQ ID NO: 3226431 - protein, 9 aa, Plasmodium falciparum
KGLGEGTAL

SEQ ID NO: 3226432 - protein, 4 aa, Plasmodium falciparum
KGLK

SEQ ID NO: 3226433 - protein, 5 aa, Plasmodium falciparum
KGLKQ

SEQ ID NO: 3226434 - protein, 5 aa, Plasmodium falciparum
KGLNE

SEQ ID NO: 3226435 - protein, 8 aa, Plasmodium falciparum
KGLNPKLN

SEQ ID NO: 3226436 - protein, 4 aa, Plasmodium falciparum
KGLS

SEQ ID NO: 3226437 - protein, 14 aa, Plasmodium falciparum
KGLTEGAAMGATEG

SEQ ID NO: 3226438 - protein, 6 aa, Plasmodium falciparum
KGLTNN

SEQ ID NO: 3226439 - protein, 4 aa, Plasmodium falciparum
KGMD

SEQ ID NO: 3226440 - protein, 49 aa, Plasmodium falciparum
KGMDNNNDQLDKQKKKTSKGTTTTTTTNNNNNNNNNNNNNSCSSSNSSA

SEQ ID NO: 3226441 - protein, 13 aa, Plasmodium falciparum
KGMGERASSNKTC

SEQ ID NO: 3226442 - protein, 20 aa, Plasmodium falciparum
KGMGNNTNDISKNKGKNKLG

SEQ ID NO: 3226443 - protein, 8 aa, Plasmodium falciparum
KGMPKEEE

SEQ ID NO: 3226444 - protein, 4 aa, Plasmodium falciparum
KGMS

SEQ ID NO: 3226445 - protein, 11 aa, Plasmodium falciparum
KGMSKKSESDI

SEQ ID NO: 3226446 - protein, 6 aa, Plasmodium falciparum
KGMTNR

SEQ ID NO: 3226447 - protein, 26 aa, Plasmodium falciparum
KGNAEKYDKMDEPQDYGKSNSRNDEM

SEQ ID NO: 3226448 - protein, 7 aa, Plasmodium falciparum
KGNAPIN

SEQ ID NO: 3226449 - protein, 21 aa, Plasmodium falciparum
KGNCDKTKGQECNGKKTIDAQ

SEQ ID NO: 3226450 - protein, 5 aa, Plasmodium falciparum
KGNDD

SEQ ID NO: 3226451 - protein, 52 aa, Plasmodium falciparum
KGNDNKDGNMKDKKNDGMNDKKNDDMNDKKNDDMNDNMNDNMNDNMNDNMND

SEQ ID NO: 3226452 - protein, 6 aa, Plasmodium falciparum
KGNDYI

SEQ ID NO: 3226453 - protein, 5 aa, Plasmodium falciparum
KGNED

SEQ ID NO: 3226454 - protein, 8 aa, Plasmodium falciparum
KGNELETE

SEQ ID NO: 3226455 - protein, 6 aa, Plasmodium falciparum
KGNELN

SEQ ID NO: 3226456 - protein, 7 aa, Plasmodium falciparum
KGNENMN

SEQ ID NO: 3226457 - protein, 12 aa, Plasmodium falciparum
KGNFKRTASVTS

SEQ ID NO: 3226458 - protein, 6 aa, Plasmodium falciparum
KGNGEI

SEQ ID NO: 3226459 - protein, 6 aa, Plasmodium falciparum
KGNGND

SEQ ID NO: 3226460 - protein, 9 aa, Plasmodium falciparum
KGNGPHDGY

SEQ ID NO: 3226461 - protein, 29 aa, Plasmodium falciparum
KGNHRRHNNNEKKNYADDTKKGIEENNKH

SEQ ID NO: 3226462 - protein, 9 aa, Plasmodium falciparum
KGNICSNED

SEQ ID NO: 3226463 - protein, 6 aa, Plasmodium falciparum
KGNIKN

SEQ ID NO: 3226464 - protein, 15 aa, Plasmodium falciparum
KGNITNRDTNNFKNN

SEQ ID NO: 3226465 - protein, 6 aa, Plasmodium falciparum
KGNKIK

SEQ ID NO: 3226466 - protein, 14 aa, Plasmodium falciparum
KGNKIVDAKESNDF

SEQ ID NO: 3226467 - protein, 8 aa, Plasmodium falciparum
KGNKKKSV

SEQ ID NO: 3226468 - protein, 12 aa, Plasmodium falciparum
KGNKNIKKKKSR

SEQ ID NO: 3226469 - protein, 12 aa, Plasmodium falciparum
KGNKNNKKTTSL

SEQ ID NO: 3226470 - protein, 20 aa, Plasmodium falciparum
KGNNEKKKNKNKINNNNYNK

SEQ ID NO: 3226471 - protein, 8 aa, Plasmodium falciparum
KGNNERTI

SEQ ID NO: 3226472 - protein, 6 aa, Plasmodium falciparum
KGNNGL

SEQ ID NO: 3226473 - protein, 6 aa, Plasmodium falciparum
KGNNHH

SEQ ID NO: 3226474 - protein, 6 aa, Plasmodium falciparum
KGNNIM

SEQ ID NO: 3226475 - protein, 7 aa, Plasmodium falciparum
KGNNLNN

SEQ ID NO: 3226476 - protein, 8 aa, Plasmodium falciparum
KGNNNKMN

SEQ ID NO: 3226477 - protein, 23 aa, Plasmodium falciparum
KGNNNNNNNDDDHNNDNYNDNYN

SEQ ID NO: 3226478 - protein, 6 aa, Plasmodium falciparum
KGNNNP

SEQ ID NO: 3226479 - protein, 10 aa, Plasmodium falciparum
KGNNSNNSSI

SEQ ID NO: 3226480 - protein, 7 aa, Plasmodium falciparum
KGNNVTD

SEQ ID NO: 3226481 - protein, 7 aa, Plasmodium falciparum
KGNPESE

SEQ ID NO: 3226482 - protein, 8 aa, Plasmodium falciparum
KGNQTLNN

SEQ ID NO: 3226483 - protein, 9 aa, Plasmodium falciparum
KGNSKKNLS

SEQ ID NO: 3226484 - protein, 10 aa, Plasmodium falciparum
KGNSKMENEE

SEQ ID NO: 3226485 - protein, 6 aa, Plasmodium falciparum
KGNSTF

SEQ ID NO: 3226486 - protein, 7 aa, Plasmodium falciparum
KGNTIPP

SEQ ID NO: 3226487 - protein, 6 aa, Plasmodium falciparum
KGNTLH

SEQ ID NO: 3226488 - protein, 9 aa, Plasmodium falciparum
KGNTNGVNN

SEQ ID NO: 3226489 - protein, 6 aa, Plasmodium falciparum
KGNYGT

SEQ ID NO: 3226490 - protein, 7 aa, Plasmodium falciparum
KGNYKKE

SEQ ID NO: 3226491 - protein, 18 aa, Plasmodium falciparum
KGPCSKTYNESGEDNNKI

SEQ ID NO: 3226492 - protein, 11 aa, Plasmodium falciparum
KGPNDDEGSAI

SEQ ID NO: 3226493 - protein, 6 aa, Plasmodium falciparum
KGPNKD

SEQ ID NO: 3226494 - protein, 18 aa, Plasmodium falciparum
KGPNQSLAEDSQKVKGSL

SEQ ID NO: 3226495 - protein, 5 aa, Plasmodium falciparum
KGPQE

SEQ ID NO: 3226496 - protein, 10 aa, Plasmodium falciparum
KGPQSKGKYE

SEQ ID NO: 3226497 - protein, 5 aa, Plasmodium falciparum
KGPSI

SEQ ID NO: 3226498 - protein, 8 aa, Plasmodium falciparum
KGPTNISS

SEQ ID NO: 3226499 - protein, 10 aa, Plasmodium falciparum
KGPVAGQNTT

SEQ ID NO: 3226500 - protein, 5 aa, Plasmodium falciparum
KGPVE

SEQ ID NO: 3226501 - protein, 6 aa, Plasmodium falciparum
KGQATN

SEQ ID NO: 3226502 - protein, 29 aa, Plasmodium falciparum
KGQDYNTSAQNRNKNINKKNKSQPKKGQE

SEQ ID NO: 3226503 - protein, 4 aa, Plasmodium falciparum
KGQE

SEQ ID NO: 3226504 - protein, 8 aa, Plasmodium falciparum
KGQEDAHD

SEQ ID NO: 3226505 - protein, 25 aa, Plasmodium falciparum
KGQNNNKKHNNNNNNNINEGKKKRN

SEQ ID NO: 3226506 - protein, 9 aa, Plasmodium falciparum
KGQPEDHNN

SEQ ID NO: 3226507 - protein, 11 aa, Plasmodium falciparum
KGQRNEEDNTY

SEQ ID NO: 3226508 - protein, 9 aa, Plasmodium falciparum
KGQSCNSKD

SEQ ID NO: 3226509 - protein, 17 aa, Plasmodium falciparum
KGQTTIGNHNNNNNNNN

SEQ ID NO: 3226510 - protein, 7 aa, Plasmodium falciparum
KGQYRNR

SEQ ID NO: 3226511 - protein, 10 aa, Plasmodium falciparum
KGRDNTSGLR

SEQ ID NO: 3226512 - protein, 16 aa, Plasmodium falciparum
KGREDESLNSHSPRVT

SEQ ID NO: 3226513 - protein, 37 aa, Plasmodium falciparum
KGREKEKQQDDEKEEEHKRKNQQKQNEFHNKEDERKG

SEQ ID NO: 3226514 - protein, 5 aa, Plasmodium falciparum
KGREM

SEQ ID NO: 3226515 - protein, 6 aa, Plasmodium falciparum
KGREQK

SEQ ID NO: 3226516 - protein, 5 aa, Plasmodium falciparum
KGRGI

SEQ ID NO: 3226517 - protein, 28 aa, Plasmodium falciparum
KGRINTNKNKMYDDNFDDDKDKNESNGN

SEQ ID NO: 3226518 - protein, 13 aa, Plasmodium falciparum
KGRNGNLDEENID

SEQ ID NO: 3226519 - protein, 19 aa, Plasmodium falciparum
KGRNPNKNKEKNKNKETEF

SEQ ID NO: 3226520 - protein, 26 aa, Plasmodium falciparum
KGRSTLEGQDEKGLQEDTTKNIEKKD

SEQ ID NO: 3226521 - protein, 6 aa, Plasmodium falciparum
KGRTPF

SEQ ID NO: 3226522 - protein, 7 aa, Plasmodium falciparum
KGSDPVH

SEQ ID NO: 3226523 - protein, 9 aa, Plasmodium falciparum
KGSDRKIHP

SEQ ID NO: 3226524 - protein, 6 aa, Plasmodium falciparum
KGSDTE

SEQ ID NO: 3226525 - protein, 4 aa, Plasmodium falciparum
KGSE

SEQ ID NO: 3226526 - protein, 7 aa, Plasmodium falciparum
KGSEHEN

SEQ ID NO: 3226527 - protein, 15 aa, Plasmodium falciparum
KGSEYSKDDYGNHDE

SEQ ID NO: 3226528 - protein, 6 aa, Plasmodium falciparum
KGSGGL

SEQ ID NO: 3226529 - protein, 8 aa, Plasmodium falciparum
KGSGSEKN

SEQ ID NO: 3226530 - protein, 37 aa, Plasmodium falciparum
KGSGSGGVAARGHPCGNGSASASDKRFSKERVDEYDE

SEQ ID NO: 3226531 - protein, 5 aa, Plasmodium falciparum
KGSGV

SEQ ID NO: 3226532 - protein, 5 aa, Plasmodium falciparum
KGSIS

SEQ ID NO: 3226533 - protein, 4 aa, Plasmodium falciparum
KGSK

SEQ ID NO: 3226534 - protein, 9 aa, Plasmodium falciparum
KGSKGKSVK

SEQ ID NO: 3226535 - protein, 12 aa, Plasmodium falciparum
KGSKKKKLAPGT

SEQ ID NO: 3226536 - protein, 9 aa, Plasmodium falciparum
KGSKNYDNK

SEQ ID NO: 3226537 - protein, 7 aa, Plasmodium falciparum
KGSNENQ

SEQ ID NO: 3226538 - protein, 10 aa, Plasmodium falciparum
KGSNESSYSN

SEQ ID NO: 3226539 - protein, 7 aa, Plasmodium falciparum
KGSNKLN

SEQ ID NO: 3226540 - protein, 18 aa, Plasmodium falciparum
KGSNMNNPCNHQNKNRED

SEQ ID NO: 3226541 - protein, 7 aa, Plasmodium falciparum
KGSNNEK

SEQ ID NO: 3226542 - protein, 6 aa, Plasmodium falciparum
KGSNTY

SEQ ID NO: 3226543 - protein, 6 aa, Plasmodium falciparum
KGSPEI

SEQ ID NO: 3226544 - protein, 15 aa, Plasmodium falciparum
KGSPRNSIKREDSNM

SEQ ID NO: 3226545 - protein, 37 aa, Plasmodium falciparum
KGSPYFPSRSKNGNINSDRRKNYNIQNSDNSNIGDSE

SEQ ID NO: 3226546 - protein, 6 aa, Plasmodium falciparum
KGSPYY

SEQ ID NO: 3226547 - protein, 5 aa, Plasmodium falciparum
KGSRI

SEQ ID NO: 3226548 - protein, 14 aa, Plasmodium falciparum
KGSRSTKQDEEKAS

SEQ ID NO: 3226549 - protein, 4 aa, Plasmodium falciparum
KGSS

SEQ ID NO: 3226550 - protein, 5 aa, Plasmodium falciparum
KGSSE

SEQ ID NO: 3226551 - protein, 28 aa, Plasmodium falciparum
KGSSEGETSSKKAQEKSVEPTKKPSKYT

SEQ ID NO: 3226552 - protein, 28 aa, Plasmodium falciparum
KGSSEGETSSNEKQEESNVATKKPSKYT

SEQ ID NO: 3226553 - protein, 7 aa, Plasmodium falciparum
KGSSIYP

SEQ ID NO: 3226554 - protein, 14 aa, Plasmodium falciparum
KGSTQNSSLSNMSD

SEQ ID NO: 3226555 - protein, 28 aa, Plasmodium falciparum
KGSVPYKNKKNDENINNNNNNNDNMNGD

SEQ ID NO: 3226556 - protein, 8 aa, Plasmodium falciparum
KGSWENNK

SEQ ID NO: 3226557 - protein, 15 aa, Plasmodium falciparum
KGTCKRGKTKEEDDI

SEQ ID NO: 3226558 - protein, 6 aa, Plasmodium falciparum
KGTDTI

SEQ ID NO: 3226559 - protein, 7 aa, Plasmodium falciparum
KGTDYKD

SEQ ID NO: 3226560 - protein, 13 aa, Plasmodium falciparum
KGTFDRQASQRFE

SEQ ID NO: 3226561 - protein, 14 aa, Plasmodium falciparum
KGTFGKADLSSKIN

SEQ ID NO: 3226562 - protein, 22 aa, Plasmodium falciparum
KGTHKKKQTKEKIDPNNYSINE

SEQ ID NO: 3226563 - protein, 11 aa, Plasmodium falciparum
KGTKNDSNTFD

SEQ ID NO: 3226564 - protein, 5 aa, Plasmodium falciparum
KGTKS

SEQ ID NO: 3226565 - protein, 7 aa, Plasmodium falciparum
KGTLGGG

SEQ ID NO: 3226566 - protein, 5 aa, Plasmodium falciparum
KGTLS

SEQ ID NO: 3226567 - protein, 7 aa, Plasmodium falciparum
KGTNKKY

SEQ ID NO: 3226568 - protein, 8 aa, Plasmodium falciparum
KGTNQDNN

SEQ ID NO: 3226569 - protein, 13 aa, Plasmodium falciparum
KGTPITNENDVDN

SEQ ID NO: 3226570 - protein, 4 aa, Plasmodium falciparum
KGTS

SEQ ID NO: 3226571 - protein, 5 aa, Plasmodium falciparum
KGTSM

SEQ ID NO: 3226572 - protein, 7 aa, Plasmodium falciparum
KGTSNFH

SEQ ID NO: 3226573 - protein, 6 aa, Plasmodium falciparum
KGTSPW

SEQ ID NO: 3226574 - protein, 7 aa, Plasmodium falciparum
KGTSSTI

SEQ ID NO: 3226575 - protein, 4 aa, Plasmodium falciparum
KGTT

SEQ ID NO: 3226576 - protein, 7 aa, Plasmodium falciparum
KGTTSKC

SEQ ID NO: 3226577 - protein, 8 aa, Plasmodium falciparum
KGTYKEPS

SEQ ID NO: 3226578 - protein, 38 aa, Plasmodium falciparum
KGTYSSTTKNERVDEKYSSSNTDSSVNPKKKKKKKIDK

SEQ ID NO: 3226579 - protein, 4 aa, Plasmodium falciparum
KGVA

SEQ ID NO: 3226580 - protein, 7 aa, Plasmodium falciparum
KGVEKKK

SEQ ID NO: 3226581 - protein, 6 aa, Plasmodium falciparum
KGVKIT

SEQ ID NO: 3226582 - protein, 11 aa, Plasmodium falciparum
KGVKNKATKPI

SEQ ID NO: 3226583 - protein, 88 aa, Plasmodium falciparum
KGVQNGDNKEDVDDDKEDDDNDDDEDEDTEDDNNDDDNDDDNDDDNDDDNDDDNDDDNDDDNDNNNDDDNDDDNDDDNDNNNDDDNYV

SEQ ID NO: 3226584 - protein, 8 aa, Plasmodium falciparum
KGVTPGRR

SEQ ID NO: 3226585 - protein, 7 aa, Plasmodium falciparum
KGYDEEK

SEQ ID NO: 3226586 - protein, 7 aa, Plasmodium falciparum
KGYDESN

SEQ ID NO: 3226587 - protein, 6 aa, Plasmodium falciparum
KGYDQN

SEQ ID NO: 3226588 - protein, 4 aa, Plasmodium falciparum
KGYE

SEQ ID NO: 3226589 - protein, 7 aa, Plasmodium falciparum
KGYEDDG

SEQ ID NO: 3226590 - protein, 6 aa, Plasmodium falciparum
KGYEEQ

SEQ ID NO: 3226591 - protein, 19 aa, Plasmodium falciparum
KGYENTYGKKKTQNNKRGK

SEQ ID NO: 3226592 - protein, 6 aa, Plasmodium falciparum
KGYEQE

SEQ ID NO: 3226593 - protein, 14 aa, Plasmodium falciparum
KGYNDNTNNNVNTQ

SEQ ID NO: 3226594 - protein, 12 aa, Plasmodium falciparum
KGYSDGSSFKKE

SEQ ID NO: 3226595 - protein, 11 aa, Plasmodium falciparum
KGYSEKDNIES

SEQ ID NO: 3226596 - protein, 14 aa, Plasmodium falciparum
KGYSNNNSSNFENQ

SEQ ID NO: 3226597 - protein, 6 aa, Plasmodium falciparum
KGYTNN

SEQ ID NO: 3226598 - protein, 60 aa, Plasmodium falciparum
KGYTRNGGVDKEEYYNDDDNEKEDYDDDDDDIEKEDYDDNEDGVEREDYYDDNDSVEKED

SEQ ID NO: 3226599 - protein, 14 aa, Plasmodium falciparum
KGYTYDKNKSYTSI

SEQ ID NO: 3226600 - protein, 11 aa, Plasmodium falciparum
KHANSSHENYT

SEQ ID NO: 3226601 - protein, 81 aa, Plasmodium falciparum
KHDDDNNNNKCDDDNNKHDDNNNKHDDNNNNNKCDDNNNNNKCDDNNNNNKCDDNNNNNKCDDNAKNDGEHNNNNNNNNFN

SEQ ID NO: 3226602 - protein, 19 aa, Plasmodium falciparum
KHDDENINKSDIRNTLDSE

SEQ ID NO: 3226603 - protein, 14 aa, Plasmodium falciparum
KHDDNNNDKEKGTF

SEQ ID NO: 3226604 - protein, 6 aa, Plasmodium falciparum
KHDDYH

SEQ ID NO: 3226605 - protein, 60 aa, Plasmodium falciparum
KHDEDEYNNNDEDDYNNNDEDEYNNNDEDDYNNNDEDEYNNNDEDEYNNNNNEDNYNNNV

SEQ ID NO: 3226606 - protein, 23 aa, Plasmodium falciparum
KHDEDSEGNTKAFNEENKTEDNH

SEQ ID NO: 3226607 - protein, 8 aa, Plasmodium falciparum
KHDNEERR

SEQ ID NO: 3226608 - protein, 7 aa, Plasmodium falciparum
KHDNGVD

SEQ ID NO: 3226609 - protein, 7 aa, Plasmodium falciparum
KHDNIEK

SEQ ID NO: 3226610 - protein, 13 aa, Plasmodium falciparum
KHDNLSSRKKRKI

SEQ ID NO: 3226611 - protein, 14 aa, Plasmodium falciparum
KHDNNNNDEKEGTF

SEQ ID NO: 3226612 - protein, 12 aa, Plasmodium falciparum
KHDNSDDNINNS

SEQ ID NO: 3226613 - protein, 9 aa, Plasmodium falciparum
KHDSKYTSK

SEQ ID NO: 3226614 - protein, 7 aa, Plasmodium falciparum
KHDTDEL

SEQ ID NO: 3226615 - protein, 9 aa, Plasmodium falciparum
KHEDGDNDM

SEQ ID NO: 3226616 - protein, 5 aa, Plasmodium falciparum
KHEED

SEQ ID NO: 3226617 - protein, 12 aa, Plasmodium falciparum
KHEEEKKKKKGL

SEQ ID NO: 3226618 - protein, 5 aa, Plasmodium falciparum
KHEEK

SEQ ID NO: 3226619 - protein, 15 aa, Plasmodium falciparum
KHEENHKHEENHKPQ

SEQ ID NO: 3226620 - protein, 7 aa, Plasmodium falciparum
KHEEQLK

SEQ ID NO: 3226621 - protein, 7 aa, Plasmodium falciparum
KHEEYKK

SEQ ID NO: 3226622 - protein, 7 aa, Plasmodium falciparum
KHEGRPW

SEQ ID NO: 3226623 - protein, 6 aa, Plasmodium falciparum
KHEKYS

SEQ ID NO: 3226624 - protein, 9 aa, Plasmodium falciparum
KHENGDNNM

SEQ ID NO: 3226625 - protein, 16 aa, Plasmodium falciparum
KHENKDESLENSNKNF

SEQ ID NO: 3226626 - protein, 8 aa, Plasmodium falciparum
KHENNSNN

SEQ ID NO: 3226627 - protein, 91 aa, Plasmodium falciparum
KHESGTIPNHNTEREYTSNVDNNDGNNKNNDGNNKNNDENNNNSDGNNNNNDGNNKYNDVNNKYNDVNNKNNDVNNKYNDGHNKNNNEHVT

SEQ ID NO: 3226628 - protein, 15 aa, Plasmodium falciparum
KHESRNNSSNEPEQF

SEQ ID NO: 3226629 - protein, 6 aa, Plasmodium falciparum
KHESTK

SEQ ID NO: 3226630 - protein, 8 aa, Plasmodium falciparum
KHETCNKY

SEQ ID NO: 3226631 - protein, 6 aa, Plasmodium falciparum
KHEYEN

SEQ ID NO: 3226632 - protein, 5 aa, Plasmodium falciparum
KHFEK

SEQ ID NO: 3226633 - protein, 5 aa, Plasmodium falciparum
KHFKN

SEQ ID NO: 3226634 - protein, 18 aa, Plasmodium falciparum
KHGGTTPTGTNDTDAPYT

SEQ ID NO: 3226635 - protein, 6 aa, Plasmodium falciparum
KHGNLN

SEQ ID NO: 3226636 - protein, 5 aa, Plasmodium falciparum
KHGRP

SEQ ID NO: 3226637 - protein, 7 aa, Plasmodium falciparum
KHHEKGV

SEQ ID NO: 3226638 - protein, 9 aa, Plasmodium falciparum
KHIDSEHNG

SEQ ID NO: 3226639 - protein, 8 aa, Plasmodium falciparum
KHINTTEQ

SEQ ID NO: 3226640 - protein, 4 aa, Plasmodium falciparum
KHIQ

SEQ ID NO: 3226641 - protein, 13 aa, Plasmodium falciparum
KHIQNDQDDVCNR

SEQ ID NO: 3226642 - protein, 10 aa, Plasmodium falciparum
KHISEGKSGV

SEQ ID NO: 3226643 - protein, 6 aa, Plasmodium falciparum
KHKDEL

SEQ ID NO: 3226644 - protein, 13 aa, Plasmodium falciparum
KHKDYPKNTISIQ

SEQ ID NO: 3226645 - protein, 8 aa, Plasmodium falciparum
KHKEKYRD

SEQ ID NO: 3226646 - protein, 21 aa, Plasmodium falciparum
KHKENTTKHNHNNNYNMNNNN

SEQ ID NO: 3226647 - protein, 5 aa, Plasmodium falciparum
KHKGI

SEQ ID NO: 3226648 - protein, 12 aa, Plasmodium falciparum
KHKKETSKNKEL

SEQ ID NO: 3226649 - protein, 40 aa, Plasmodium falciparum
KHKKNDMKKNKNNKNNKNNNNNNNKEKDDNYNIKNTNEKM

SEQ ID NO: 3226650 - protein, 18 aa, Plasmodium falciparum
KHKKRKKIETKTNNVVNN

SEQ ID NO: 3226651 - protein, 16 aa, Plasmodium falciparum
KHKKSEDKIENEADKL

SEQ ID NO: 3226652 - protein, 5 aa, Plasmodium falciparum
KHKLY

SEQ ID NO: 3226653 - protein, 9 aa, Plasmodium falciparum
KHKNGYKNT

SEQ ID NO: 3226654 - protein, 23 aa, Plasmodium falciparum
KHKNKTNTTNYYDTNSTINNPNI

SEQ ID NO: 3226655 - protein, 20 aa, Plasmodium falciparum
KHKNSLKNSKEDDLNNNQNL

SEQ ID NO: 3226656 - protein, 11 aa, Plasmodium falciparum
KHKQNDTKKNH

SEQ ID NO: 3226657 - protein, 15 aa, Plasmodium falciparum
KHKQTTNNKYNHNNY

SEQ ID NO: 3226658 - protein, 16 aa, Plasmodium falciparum
KHKRKGSDSSHKNEKT

SEQ ID NO: 3226659 - protein, 8 aa, Plasmodium falciparum
KHKSGHNI

SEQ ID NO: 3226660 - protein, 8 aa, Plasmodium falciparum
KHKTNISS

SEQ ID NO: 3226661 - protein, 12 aa, Plasmodium falciparum
KHLGEKKNKINK

SEQ ID NO: 3226662 - protein, 13 aa, Plasmodium falciparum
KHLNNKPKLNNKE

SEQ ID NO: 3226663 - protein, 5 aa, Plasmodium falciparum
KHMNG

SEQ ID NO: 3226664 - protein, 16 aa, Plasmodium falciparum
KHNDEESKDSTNSTTY

SEQ ID NO: 3226665 - protein, 7 aa, Plasmodium falciparum
KHNDYDE

SEQ ID NO: 3226666 - protein, 6 aa, Plasmodium falciparum
KHNEDN

SEQ ID NO: 3226667 - protein, 16 aa, Plasmodium falciparum
KHNEDNIKDRSKEGTS

SEQ ID NO: 3226668 - protein, 13 aa, Plasmodium falciparum
KHNEEKEKKNLQD

SEQ ID NO: 3226669 - protein, 19 aa, Plasmodium falciparum
KHNEERTVQEKDEKKSEDC

SEQ ID NO: 3226670 - protein, 6 aa, Plasmodium falciparum
KHNENK

SEQ ID NO: 3226671 - protein, 20 aa, Plasmodium falciparum
KHNESNKKPLNHNKHTEDRT

SEQ ID NO: 3226672 - protein, 17 aa, Plasmodium falciparum
KHNESTKDDKDKQERQD

SEQ ID NO: 3226673 - protein, 16 aa, Plasmodium falciparum
KHNGNENSDDIKHPYP

SEQ ID NO: 3226674 - protein, 4 aa, Plasmodium falciparum
KHNI

SEQ ID NO: 3226675 - protein, 11 aa, Plasmodium falciparum
KHNIPKEQYEK

SEQ ID NO: 3226676 - protein, 8 aa, Plasmodium falciparum
KHNKGYNQ

SEQ ID NO: 3226677 - protein, 10 aa, Plasmodium falciparum
KHNKKTKMKR

SEQ ID NO: 3226678 - protein, 24 aa, Plasmodium falciparum
KHNNDHNDDNNNNNNNNNNKDDIY

SEQ ID NO: 3226679 - protein, 8 aa, Plasmodium falciparum
KHNNHNNH

SEQ ID NO: 3226680 - protein, 5 aa, Plasmodium falciparum
KHNNI

SEQ ID NO: 3226681 - protein, 6 aa, Plasmodium falciparum
KHNNKK

SEQ ID NO: 3226682 - protein, 7 aa, Plasmodium falciparum
KHNNNKI

SEQ ID NO: 3226683 - protein, 9 aa, Plasmodium falciparum
KHNNNNNND

SEQ ID NO: 3226684 - protein, 12 aa, Plasmodium falciparum
KHNNNNNNNDEN

SEQ ID NO: 3226685 - protein, 5 aa, Plasmodium falciparum
KHNPS

SEQ ID NO: 3226686 - protein, 10 aa, Plasmodium falciparum
KHNSAYDENN

SEQ ID NO: 3226687 - protein, 7 aa, Plasmodium falciparum
KHNSDNI

SEQ ID NO: 3226688 - protein, 30 aa, Plasmodium falciparum
KHNTDASEARGSEAPSPSGTDTHTQPDPQK

SEQ ID NO: 3226689 - protein, 12 aa, Plasmodium falciparum
KHNTENDNNNNN

SEQ ID NO: 3226690 - protein, 8 aa, Plasmodium falciparum
KHNTSNDS

SEQ ID NO: 3226691 - protein, 14 aa, Plasmodium falciparum
KHNVDNKESFDNKQ

SEQ ID NO: 3226692 - protein, 11 aa, Plasmodium falciparum
KHNVSSKSIYN

SEQ ID NO: 3226693 - protein, 17 aa, Plasmodium falciparum
KHPNGGGDVSDKRYPCK

SEQ ID NO: 3226694 - protein, 8 aa, Plasmodium falciparum
KHPNRGSS

SEQ ID NO: 3226695 - protein, 5 aa, Plasmodium falciparum
KHQDK

SEQ ID NO: 3226696 - protein, 92 aa, Plasmodium falciparum
KHQGKEIEKKNKKGQHKYGDEAHEYGDEAHEYGDEAHEYGDEAHEYGDEAHEYGDEAHEYGDEAHEYGDDEHEYGDEEHEYGDEEHEYGDEA

SEQ ID NO: 3226697 - protein, 8 aa, Plasmodium falciparum
KHQTNNPS

SEQ ID NO: 3226698 - protein, 96 aa, Plasmodium falciparum
KHRDAEKKKNDHKKGKDDKSDGRGNEYEDDNVDDDDSDYNVNSDYNVNSDYNVNSDYNVNSDYNVNSDYNVNSDYNVNSDYNVNSDYNVNSDYSDY

SEQ ID NO: 3226699 - protein, 19 aa, Plasmodium falciparum
KHREDENEDEEKEEEEEES

SEQ ID NO: 3226700 - protein, 13 aa, Plasmodium falciparum
KHRSTLSTKAYRA

SEQ ID NO: 3226701 - protein, 7 aa, Plasmodium falciparum
KHRTTDN

SEQ ID NO: 3226702 - protein, 7 aa, Plasmodium falciparum
KHSKKEG

SEQ ID NO: 3226703 - protein, 21 aa, Plasmodium falciparum
KHSNARSNSLNPCNGKDNNKV

SEQ ID NO: 3226704 - protein, 22 aa, Plasmodium falciparum
KHSNDSRRDGEPCKGKDGNNER

SEQ ID NO: 3226705 - protein, 18 aa, Plasmodium falciparum
KHSNHKRVRNNTNTYHQN

SEQ ID NO: 3226706 - protein, 8 aa, Plasmodium falciparum
KHSNNTLD

SEQ ID NO: 3226707 - protein, 14 aa, Plasmodium falciparum
KHSNTKEKKKKSDI

SEQ ID NO: 3226708 - protein, 10 aa, Plasmodium falciparum
KHSPKSPASK

SEQ ID NO: 3226709 - protein, 23 aa, Plasmodium falciparum
KHSSISSSKNIHSYDEKKKKKND

SEQ ID NO: 3226710 - protein, 5 aa, Plasmodium falciparum
KHSSR

SEQ ID NO: 3226711 - protein, 7 aa, Plasmodium falciparum
KHSTKNN

SEQ ID NO: 3226712 - protein, 41 aa, Plasmodium falciparum
KHTDDNEDINKDDNEDINKANNKDINKANNKDINKANNTYI

SEQ ID NO: 3226713 - protein, 20 aa, Plasmodium falciparum
KHTETVATKAAAEATSVTDA

SEQ ID NO: 3226714 - protein, 11 aa, Plasmodium falciparum
KHTKNKNKELY

SEQ ID NO: 3226715 - protein, 5 aa, Plasmodium falciparum
KHTNK

SEQ ID NO: 3226716 - protein, 19 aa, Plasmodium falciparum
KHTQNEIKKSEDKNSYNSS

SEQ ID NO: 3226717 - protein, 7 aa, Plasmodium falciparum
KHTSASE

SEQ ID NO: 3226718 - protein, 4 aa, Plasmodium falciparum
KHTT

SEQ ID NO: 3226719 - protein, 5 aa, Plasmodium falciparum
KHTTN

SEQ ID NO: 3226720 - protein, 4 aa, Plasmodium falciparum
KHTW

SEQ ID NO: 3226721 - protein, 13 aa, Plasmodium falciparum
KHVGGNDTEPMST

SEQ ID NO: 3226722 - protein, 14 aa, Plasmodium falciparum
KHVSETNSQIEPDQ

SEQ ID NO: 3226723 - protein, 12 aa, Plasmodium falciparum
KHVTKNQTHGTL

SEQ ID NO: 3226724 - protein, 13 aa, Plasmodium falciparum
KHYDSDKSSEDII

SEQ ID NO: 3226725 - protein, 50 aa, Plasmodium falciparum
KHYEDDDDDDDYQPPRHSSLPNERKTSSSSRQAARSHSSSSSVYASANAE

SEQ ID NO: 3226726 - protein, 6 aa, Plasmodium falciparum
KHYKEK

SEQ ID NO: 3226727 - protein, 15 aa, Plasmodium falciparum
KHYNHKDSYSDNKGH

SEQ ID NO: 3226728 - protein, 10 aa, Plasmodium falciparum
KHYQKDAPNY

SEQ ID NO: 3226729 - protein, 4 aa, Plasmodium falciparum
KIAD

SEQ ID NO: 3226730 - protein, 7 aa, Plasmodium falciparum
KIAGDAA

SEQ ID NO: 3226731 - protein, 5 aa, Plasmodium falciparum
KIAKE

SEQ ID NO: 3226732 - protein, 6 aa, Plasmodium falciparum
KIAPPD

SEQ ID NO: 3226733 - protein, 5 aa, Plasmodium falciparum
KIAQN

SEQ ID NO: 3226734 - protein, 12 aa, Plasmodium falciparum
KIASQSGADVVG

SEQ ID NO: 3226735 - protein, 5 aa, Plasmodium falciparum
KICSD

SEQ ID NO: 3226736 - protein, 5 aa, Plasmodium falciparum
KICSN

SEQ ID NO: 3226737 - protein, 6 aa, Plasmodium falciparum
KIDCGD

SEQ ID NO: 3226738 - protein, 5 aa, Plasmodium falciparum
KIDDD

SEQ ID NO: 3226739 - protein, 9 aa, Plasmodium falciparum
KIDDNDEDI

SEQ ID NO: 3226740 - protein, 10 aa, Plasmodium falciparum
KIDDSDKQKV

SEQ ID NO: 3226741 - protein, 5 aa, Plasmodium falciparum
KIDEC

SEQ ID NO: 3226742 - protein, 5 aa, Plasmodium falciparum
KIDEK

SEQ ID NO: 3226743 - protein, 23 aa, Plasmodium falciparum
KIDEKQNNVTSEENKAANDKQIK

SEQ ID NO: 3226744 - protein, 7 aa, Plasmodium falciparum
KIDGETD

SEQ ID NO: 3226745 - protein, 7 aa, Plasmodium falciparum
KIDGQGR

SEQ ID NO: 3226746 - protein, 30 aa, Plasmodium falciparum
KIDKDKERFKDDNYDDNNNNNNNNDGDDAL

SEQ ID NO: 3226747 - protein, 50 aa, Plasmodium falciparum
KIDKDKSKEILDETSSKPKEEDTSHVQPPPLPPKPSTPEVEPLPSDEPFD

SEQ ID NO: 3226748 - protein, 5 aa, Plasmodium falciparum
KIDKN

SEQ ID NO: 3226749 - protein, 6 aa, Plasmodium falciparum
KIDKPI

SEQ ID NO: 3226750 - protein, 5 aa, Plasmodium falciparum
KIDKQ

SEQ ID NO: 3226751 - protein, 4 aa, Plasmodium falciparum
KIDN

SEQ ID NO: 3226752 - protein, 5 aa, Plasmodium falciparum
KIDNI

SEQ ID NO: 3226753 - protein, 17 aa, Plasmodium falciparum
KIDSSKENIGTGNTQDT

SEQ ID NO: 3226754 - protein, 17 aa, Plasmodium falciparum
KIDSSRKNAGNEDSEGA

SEQ ID NO: 3226755 - protein, 14 aa, Plasmodium falciparum
KIDTNEKNDDNNNI

SEQ ID NO: 3226756 - protein, 18 aa, Plasmodium falciparum
KIDTPYNDNMKKGNKNND

SEQ ID NO: 3226757 - protein, 8 aa, Plasmodium falciparum
KIDTSDKF

SEQ ID NO: 3226758 - protein, 21 aa, Plasmodium falciparum
KIDVEQNDVSRRTKNERKKSS

SEQ ID NO: 3226759 - protein, 9 aa, Plasmodium falciparum
KIEDGAKPI

SEQ ID NO: 3226760 - protein, 11 aa, Plasmodium falciparum
KIEDKKNNVTY

SEQ ID NO: 3226761 - protein, 5 aa, Plasmodium falciparum
KIEDN

SEQ ID NO: 3226762 - protein, 9 aa, Plasmodium falciparum
KIEDNINNK

SEQ ID NO: 3226763 - protein, 5 aa, Plasmodium falciparum
KIEDS

SEQ ID NO: 3226764 - protein, 39 aa, Plasmodium falciparum
KIEEANDKKFEEGNDKEIKEGNEKEINEGNDKEIKEGEY

SEQ ID NO: 3226765 - protein, 102 aa, Plasmodium falciparum
KIEEANEKKIKEENDKKFEEGNDKEVKEENDKEVKKGNDKEFEEGNDKKFEEGNDKEIKEGNEKEIKEGNEKEIKEGNEKEIKEGNEKEIKEGNDKNFEEDD

SEQ ID NO: 3226766 - protein, 10 aa, Plasmodium falciparum
KIEEDEEESF

SEQ ID NO: 3226767 - protein, 16 aa, Plasmodium falciparum
KIEEETKEDVVEEQNE

SEQ ID NO: 3226768 - protein, 10 aa, Plasmodium falciparum
KIEEKKHDEE

SEQ ID NO: 3226769 - protein, 12 aa, Plasmodium falciparum
KIEEKSKNTRGH

SEQ ID NO: 3226770 - protein, 6 aa, Plasmodium falciparum
KIEGRT

SEQ ID NO: 3226771 - protein, 4 aa, Plasmodium falciparum
KIEH

SEQ ID NO: 3226772 - protein, 14 aa, Plasmodium falciparum
KIEKKKKEELEKEE

SEQ ID NO: 3226773 - protein, 30 aa, Plasmodium falciparum
KIENEDDPVNDKEENHNEHKKEDVSNKEKK

SEQ ID NO: 3226774 - protein, 8 aa, Plasmodium falciparum
KIENEKSK

SEQ ID NO: 3226775 - protein, 8 aa, Plasmodium falciparum
KIENKSNT

SEQ ID NO: 3226776 - protein, 19 aa, Plasmodium falciparum
KIENNKDNINITKNEKQSM

SEQ ID NO: 3226777 - protein, 9 aa, Plasmodium falciparum
KIENNNNKV

SEQ ID NO: 3226778 - protein, 11 aa, Plasmodium falciparum
KIENNTKNKKH

SEQ ID NO: 3226779 - protein, 37 aa, Plasmodium falciparum
KIENQRKDIYQDNNNNNNNNNNNNNNDNTSATRKNDE

SEQ ID NO: 3226780 - protein, 7 aa, Plasmodium falciparum
KIEQDAP

SEQ ID NO: 3226781 - protein, 15 aa, Plasmodium falciparum
KIEQKKNEKKQAQIK

SEQ ID NO: 3226782 - protein, 12 aa, Plasmodium falciparum
KIEQNKQNEQIE

SEQ ID NO: 3226783 - protein, 6 aa, Plasmodium falciparum
KIEQRG

SEQ ID NO: 3226784 - protein, 23 aa, Plasmodium falciparum
KIERKENQNKENTNNKDISPNNA

SEQ ID NO: 3226785 - protein, 6 aa, Plasmodium falciparum
KIERNN

SEQ ID NO: 3226786 - protein, 13 aa, Plasmodium falciparum
KIESNKNDKEERL

SEQ ID NO: 3226787 - protein, 9 aa, Plasmodium falciparum
KIESSNKIN

SEQ ID NO: 3226788 - protein, 5 aa, Plasmodium falciparum
KIETN

SEQ ID NO: 3226789 - protein, 18 aa, Plasmodium falciparum
KIETVEEGTKESKIEGKN

SEQ ID NO: 3226790 - protein, 8 aa, Plasmodium falciparum
KIGDGEVT

SEQ ID NO: 3226791 - protein, 6 aa, Plasmodium falciparum
KIGDPT

SEQ ID NO: 3226792 - protein, 4 aa, Plasmodium falciparum
KIGK

SEQ ID NO: 3226793 - protein, 9 aa, Plasmodium falciparum
KIGKKEEKS

SEQ ID NO: 3226794 - protein, 7 aa, Plasmodium falciparum
KIGKNED

SEQ ID NO: 3226795 - protein, 4 aa, Plasmodium falciparum
KIGQ

SEQ ID NO: 3226796 - protein, 63 aa, Plasmodium falciparum
KIGQPRSEVQPEEEEEEEEEEEEEDKEDDDDLDRKDAEDQEAEVETAKEGDVVTTKETTVEDP

SEQ ID NO: 3226797 - protein, 6 aa, Plasmodium falciparum
KIGTDD

SEQ ID NO: 3226798 - protein, 4 aa, Plasmodium falciparum
KIHA

SEQ ID NO: 3226799 - protein, 5 aa, Plasmodium falciparum
KIHGN

SEQ ID NO: 3226800 - protein, 28 aa, Plasmodium falciparum
KIIENNKHEKNIQDREDENQEDNKNDMK

SEQ ID NO: 3226801 - protein, 12 aa, Plasmodium falciparum
KIINESNKIQNN

SEQ ID NO: 3226802 - protein, 12 aa, Plasmodium falciparum
KIINKNKNNQMK

SEQ ID NO: 3226803 - protein, 62 aa, Plasmodium falciparum
KIINNENNENVKNNENVKNNGNSDNNGNSDNNGNSDNNGNSDNSDNNGNSDNNDNSDNNDNN

SEQ ID NO: 3226804 - protein, 21 aa, Plasmodium falciparum
KIISKNKKEYKKGKKKKKFGE

SEQ ID NO: 3226805 - protein, 4 aa, Plasmodium falciparum
KIKD

SEQ ID NO: 3226806 - protein, 12 aa, Plasmodium falciparum
KIKDEKEKNIKQ

SEQ ID NO: 3226807 - protein, 6 aa, Plasmodium falciparum
KIKDKE

SEQ ID NO: 3226808 - protein, 15 aa, Plasmodium falciparum
KIKDKNDNSNDEGNV

SEQ ID NO: 3226809 - protein, 23 aa, Plasmodium falciparum
KIKDTKDNFENIQEGNNKNTPYI

SEQ ID NO: 3226810 - protein, 6 aa, Plasmodium falciparum
KIKDYR

SEQ ID NO: 3226811 - protein, 8 aa, Plasmodium falciparum
KIKEEEYK

SEQ ID NO: 3226812 - protein, 7 aa, Plasmodium falciparum
KIKENDS

SEQ ID NO: 3226813 - protein, 27 aa, Plasmodium falciparum
KIKENKCDNMSTDNLSQMGSRETKNIT

SEQ ID NO: 3226814 - protein, 8 aa, Plasmodium falciparum
KIKENNET

SEQ ID NO: 3226815 - protein, 10 aa, Plasmodium falciparum
KIKENYKSKE

SEQ ID NO: 3226816 - protein, 8 aa, Plasmodium falciparum
KIKEPEKK

SEQ ID NO: 3226817 - protein, 5 aa, Plasmodium falciparum
KIKEY

SEQ ID NO: 3226818 - protein, 14 aa, Plasmodium falciparum
KIKGKDNNEEEGDE

SEQ ID NO: 3226819 - protein, 12 aa, Plasmodium falciparum
KIKGNGKKEESY

SEQ ID NO: 3226820 - protein, 8 aa, Plasmodium falciparum
KIKKEKYD

SEQ ID NO: 3226821 - protein, 8 aa, Plasmodium falciparum
KIKKENEK

SEQ ID NO: 3226822 - protein, 9 aa, Plasmodium falciparum
KIKKGSNIN

SEQ ID NO: 3226823 - protein, 14 aa, Plasmodium falciparum
KIKKKISSTHNNKT

SEQ ID NO: 3226824 - protein, 11 aa, Plasmodium falciparum
KIKKNKKKNIT

SEQ ID NO: 3226825 - protein, 19 aa, Plasmodium falciparum
KIKKQNKGKNNNPQNNGNI

SEQ ID NO: 3226826 - protein, 17 aa, Plasmodium falciparum
KIKKSEKENKKIKETPT

SEQ ID NO: 3226827 - protein, 15 aa, Plasmodium falciparum
KIKKTNNINNNNNIN

SEQ ID NO: 3226828 - protein, 4 aa, Plasmodium falciparum
KIKN

SEQ ID NO: 3226829 - protein, 16 aa, Plasmodium falciparum
KIKNDKPQDEKTNTNL

SEQ ID NO: 3226830 - protein, 5 aa, Plasmodium falciparum
KIKNE

SEQ ID NO: 3226831 - protein, 18 aa, Plasmodium falciparum
KIKNKNNNNNDNYDNDNN

SEQ ID NO: 3226832 - protein, 11 aa, Plasmodium falciparum
KIKNKTKHKGD

SEQ ID NO: 3226833 - protein, 22 aa, Plasmodium falciparum
KIKNNDDNNDNNNDNNNDDDNN

SEQ ID NO: 3226834 - protein, 9 aa, Plasmodium falciparum
KIKPGARAR

SEQ ID NO: 3226835 - protein, 7 aa, Plasmodium falciparum
KIKPNKK

SEQ ID NO: 3226836 - protein, 5 aa, Plasmodium falciparum
KIKPP

SEQ ID NO: 3226837 - protein, 14 aa, Plasmodium falciparum
KIKQKKKRRRTNKE

SEQ ID NO: 3226838 - protein, 7 aa, Plasmodium falciparum
KIKQNNQ

SEQ ID NO: 3226839 - protein, 4 aa, Plasmodium falciparum
KIKR

SEQ ID NO: 3226840 - protein, 7 aa, Plasmodium falciparum
KIKRENE

SEQ ID NO: 3226841 - protein, 8 aa, Plasmodium falciparum
KIKRPTKY

SEQ ID NO: 3226842 - protein, 17 aa, Plasmodium falciparum
KIKSDKKKKNKKKIKKQ

SEQ ID NO: 3226843 - protein, 16 aa, Plasmodium falciparum
KIKSDKNETQDNDTIG

SEQ ID NO: 3226844 - protein, 5 aa, Plasmodium falciparum
KIKSG

SEQ ID NO: 3226845 - protein, 16 aa, Plasmodium falciparum
KIKSNKNTNTNANNIN

SEQ ID NO: 3226846 - protein, 11 aa, Plasmodium falciparum
KIKTDSEDINE

SEQ ID NO: 3226847 - protein, 65 aa, Plasmodium falciparum
KIKTEKKTNTKIKTNTNTKIKTDTNTKIKTNTNTKTQKETNRNTKNTDKKQFPKKKNNQNKNDTE

SEQ ID NO: 3226848 - protein, 18 aa, Plasmodium falciparum
KIKTKKNMAKEKYKKNEK

SEQ ID NO: 3226849 - protein, 4 aa, Plasmodium falciparum
KIKY

SEQ ID NO: 3226850 - protein, 14 aa, Plasmodium falciparum
KILEQNGQTDNNSN

SEQ ID NO: 3226851 - protein, 4 aa, Plasmodium falciparum
KIMQ

SEQ ID NO: 3226852 - protein, 24 aa, Plasmodium falciparum
KINANVNKKSSYLENSNKENVSKR

SEQ ID NO: 3226853 - protein, 5 aa, Plasmodium falciparum
KINDD

SEQ ID NO: 3226854 - protein, 42 aa, Plasmodium falciparum
KINDDDDDDDDDDDNNNKSSSNKCLNNNNNNNSSSKSYSNNH

SEQ ID NO: 3226855 - protein, 8 aa, Plasmodium falciparum
KINDDKEN

SEQ ID NO: 3226856 - protein, 6 aa, Plasmodium falciparum
KINDDM

SEQ ID NO: 3226857 - protein, 5 aa, Plasmodium falciparum
KINDE

SEQ ID NO: 3226858 - protein, 9 aa, Plasmodium falciparum
KINDEKYNK

SEQ ID NO: 3226859 - protein, 31 aa, Plasmodium falciparum
KINDHDENCSSPNKKGGCNKMDERQNDEYKK

SEQ ID NO: 3226860 - protein, 6 aa, Plasmodium falciparum
KINDKK

SEQ ID NO: 3226861 - protein, 7 aa, Plasmodium falciparum
KINDKNS

SEQ ID NO: 3226862 - protein, 11 aa, Plasmodium falciparum
KINDKQNNDKM

SEQ ID NO: 3226863 - protein, 7 aa, Plasmodium falciparum
KINDNSY

SEQ ID NO: 3226864 - protein, 12 aa, Plasmodium falciparum
KINDTNNTKKNE

SEQ ID NO: 3226865 - protein, 55 aa, Plasmodium falciparum
KINDTQANQKKNNKKEYMNKAQTTTNVKANTHTKTLNDHNKSKTTKNKESSSTSF

SEQ ID NO: 3226866 - protein, 6 aa, Plasmodium falciparum
KINEEN

SEQ ID NO: 3226867 - protein, 17 aa, Plasmodium falciparum
KINEKKNVYSNNPENNI

SEQ ID NO: 3226868 - protein, 7 aa, Plasmodium falciparum
KINEKKS

SEQ ID NO: 3226869 - protein, 6 aa, Plasmodium falciparum
KINENI

SEQ ID NO: 3226870 - protein, 8 aa, Plasmodium falciparum
KINERDNI

SEQ ID NO: 3226871 - protein, 5 aa, Plasmodium falciparum
KINKE

SEQ ID NO: 3226872 - protein, 13 aa, Plasmodium falciparum
KINKKDQYTKLLK

SEQ ID NO: 3226873 - protein, 8 aa, Plasmodium falciparum
KINKMDKD

SEQ ID NO: 3226874 - protein, 6 aa, Plasmodium falciparum
KINKNK

SEQ ID NO: 3226875 - protein, 7 aa, Plasmodium falciparum
KINKNKS

SEQ ID NO: 3226876 - protein, 6 aa, Plasmodium falciparum
KINKNN

SEQ ID NO: 3226877 - protein, 18 aa, Plasmodium falciparum
KINKNNSKYGSLNNGKKC

SEQ ID NO: 3226878 - protein, 8 aa, Plasmodium falciparum
KINKSNDN

SEQ ID NO: 3226879 - protein, 4 aa, Plasmodium falciparum
KINN

SEQ ID NO: 3226880 - protein, 5 aa, Plasmodium falciparum
KINND

SEQ ID NO: 3226881 - protein, 8 aa, Plasmodium falciparum
KINNEQDK

SEQ ID NO: 3226882 - protein, 11 aa, Plasmodium falciparum
KINNEQSNNKL

SEQ ID NO: 3226883 - protein, 12 aa, Plasmodium falciparum
KINNGRKPNPLT

SEQ ID NO: 3226884 - protein, 13 aa, Plasmodium falciparum
KINNKEQNGNTKK

SEQ ID NO: 3226885 - protein, 24 aa, Plasmodium falciparum
KINNKNNNNNNNNNNNNNNNNNNN

SEQ ID NO: 3226886 - protein, 9 aa, Plasmodium falciparum
KINNKSSNI

SEQ ID NO: 3226887 - protein, 10 aa, Plasmodium falciparum
KINNNDTYDV

SEQ ID NO: 3226888 - protein, 25 aa, Plasmodium falciparum
KINNNKNKYFSSDERTTCDEKEYSS

SEQ ID NO: 3226889 - protein, 7 aa, Plasmodium falciparum
KINNNNM

SEQ ID NO: 3226890 - protein, 15 aa, Plasmodium falciparum
KINNNNNNNNNNNND

SEQ ID NO: 3226891 - protein, 12 aa, Plasmodium falciparum
KINNNQTKNKID

SEQ ID NO: 3226892 - protein, 8 aa, Plasmodium falciparum
KINNNSTN

SEQ ID NO: 3226893 - protein, 10 aa, Plasmodium falciparum
KINNNTKKNY

SEQ ID NO: 3226894 - protein, 12 aa, Plasmodium falciparum
KINNRRKKEYKK

SEQ ID NO: 3226895 - protein, 8 aa, Plasmodium falciparum
KINNSLDT

SEQ ID NO: 3226896 - protein, 7 aa, Plasmodium falciparum
KINNSTE

SEQ ID NO: 3226897 - protein, 11 aa, Plasmodium falciparum
KINNSYNNNDI

SEQ ID NO: 3226898 - protein, 13 aa, Plasmodium falciparum
KINNTYNTCKDNE

SEQ ID NO: 3226899 - protein, 31 aa, Plasmodium falciparum
KINNVNNNKPIGNKKKKSKKKKVPKDKIQKE

SEQ ID NO: 3226900 - protein, 10 aa, Plasmodium falciparum
KINPDTMKKN

SEQ ID NO: 3226901 - protein, 16 aa, Plasmodium falciparum
KINPKKDVKEKDKFDD

SEQ ID NO: 3226902 - protein, 17 aa, Plasmodium falciparum
KINQENNKGELNKNKMT

SEQ ID NO: 3226903 - protein, 11 aa, Plasmodium falciparum
KINQKNNTNTS

SEQ ID NO: 3226904 - protein, 24 aa, Plasmodium falciparum
KINQNIDNSLKKNKKLYKKQEKNE

SEQ ID NO: 3226905 - protein, 11 aa, Plasmodium falciparum
KINQNNDSNIN

SEQ ID NO: 3226906 - protein, 4 aa, Plasmodium falciparum
KINS

SEQ ID NO: 3226907 - protein, 11 aa, Plasmodium falciparum
KINSEKKKKKH

SEQ ID NO: 3226908 - protein, 21 aa, Plasmodium falciparum
KINSKSKGKSQHNKEKNSIDD

SEQ ID NO: 3226909 - protein, 6 aa, Plasmodium falciparum
KINTIK

SEQ ID NO: 3226910 - protein, 12 aa, Plasmodium falciparum
KINTNKKCDENS

SEQ ID NO: 3226911 - protein, 9 aa, Plasmodium falciparum
KINTPNSIH

SEQ ID NO: 3226912 - protein, 6 aa, Plasmodium falciparum
KINTYK

SEQ ID NO: 3226913 - protein, 4 aa, Plasmodium falciparum
KINV

SEQ ID NO: 3226914 - protein, 19 aa, Plasmodium falciparum
KIPLKQKNKKVKKRTFSES

SEQ ID NO: 3226915 - protein, 9 aa, Plasmodium falciparum
KIPNEKTRE

SEQ ID NO: 3226916 - protein, 10 aa, Plasmodium falciparum
KIPNNDKNSN

SEQ ID NO: 3226917 - protein, 5 aa, Plasmodium falciparum
KIPPM

SEQ ID NO: 3226918 - protein, 14 aa, Plasmodium falciparum
KIPPPKKKTVQNIR

SEQ ID NO: 3226919 - protein, 5 aa, Plasmodium falciparum
KIPST

SEQ ID NO: 3226920 - protein, 11 aa, Plasmodium falciparum
KIPTNKNNQSI

SEQ ID NO: 3226921 - protein, 9 aa, Plasmodium falciparum
KIPTSSTKH

SEQ ID NO: 3226922 - protein, 15 aa, Plasmodium falciparum
KIQDKRKQCKEKCEK

SEQ ID NO: 3226923 - protein, 6 aa, Plasmodium falciparum
KIQDNE

SEQ ID NO: 3226924 - protein, 17 aa, Plasmodium falciparum
KIQEKKKISENYYEEKD

SEQ ID NO: 3226925 - protein, 11 aa, Plasmodium falciparum
KIQEKNERNCN

SEQ ID NO: 3226926 - protein, 6 aa, Plasmodium falciparum
KIQESG

SEQ ID NO: 3226927 - protein, 5 aa, Plasmodium falciparum
KIQKD

SEQ ID NO: 3226928 - protein, 6 aa, Plasmodium falciparum
KIQKST

SEQ ID NO: 3226929 - protein, 12 aa, Plasmodium falciparum
KIQNKTTTMNNT

SEQ ID NO: 3226930 - protein, 13 aa, Plasmodium falciparum
KIQNNIKNKNDNI

SEQ ID NO: 3226931 - protein, 8 aa, Plasmodium falciparum
KIQQPNNA

SEQ ID NO: 3226932 - protein, 7 aa, Plasmodium falciparum
KIQQRNK

SEQ ID NO: 3226933 - protein, 24 aa, Plasmodium falciparum
KIQRKKKVPYKNKERDNKDDLDEK

SEQ ID NO: 3226934 - protein, 12 aa, Plasmodium falciparum
KIQSDEKNVPTT

SEQ ID NO: 3226935 - protein, 17 aa, Plasmodium falciparum
KIQSVSSKDYDKDKNNI

SEQ ID NO: 3226936 - protein, 11 aa, Plasmodium falciparum
KIQTKKSIKNS

SEQ ID NO: 3226937 - protein, 4 aa, Plasmodium falciparum
KIRD

SEQ ID NO: 3226938 - protein, 15 aa, Plasmodium falciparum
KIRDEATKKKYSDAQ

SEQ ID NO: 3226939 - protein, 5 aa, Plasmodium falciparum
KIRDT

SEQ ID NO: 3226940 - protein, 5 aa, Plasmodium falciparum
KIREK

SEQ ID NO: 3226941 - protein, 13 aa, Plasmodium falciparum
KIRGNENNSNAGA

SEQ ID NO: 3226942 - protein, 11 aa, Plasmodium falciparum
KIRKNKQSSNI

SEQ ID NO: 3226943 - protein, 7 aa, Plasmodium falciparum
KIRKSDN

SEQ ID NO: 3226944 - protein, 11 aa, Plasmodium falciparum
KIRNEKNINTY

SEQ ID NO: 3226945 - protein, 11 aa, Plasmodium falciparum
KIRNEYKQNSI

SEQ ID NO: 3226946 - protein, 6 aa, Plasmodium falciparum
KIRPKN

SEQ ID NO: 3226947 - protein, 12 aa, Plasmodium falciparum
KIRRKNNKINNN

SEQ ID NO: 3226948 - protein, 5 aa, Plasmodium falciparum
KISDA

SEQ ID NO: 3226949 - protein, 4 aa, Plasmodium falciparum
KISE

SEQ ID NO: 3226950 - protein, 7 aa, Plasmodium falciparum
KISEKLK

SEQ ID NO: 3226951 - protein, 9 aa, Plasmodium falciparum
KISKSNKKM

SEQ ID NO: 3226952 - protein, 13 aa, Plasmodium falciparum
KISKYKSNKNMDK

SEQ ID NO: 3226953 - protein, 16 aa, Plasmodium falciparum
KISNGDDNYKSPSSNY

SEQ ID NO: 3226954 - protein, 6 aa, Plasmodium falciparum
KISNNN

SEQ ID NO: 3226955 - protein, 5 aa, Plasmodium falciparum
KISNS

SEQ ID NO: 3226956 - protein, 10 aa, Plasmodium falciparum
KISPKEVEEP

SEQ ID NO: 3226957 - protein, 7 aa, Plasmodium falciparum
KISPSKH

SEQ ID NO: 3226958 - protein, 8 aa, Plasmodium falciparum
KISQDKTF

SEQ ID NO: 3226959 - protein, 19 aa, Plasmodium falciparum
KISQDSIKDELSRNNENDY

SEQ ID NO: 3226960 - protein, 8 aa, Plasmodium falciparum
KISQTATS

SEQ ID NO: 3226961 - protein, 19 aa, Plasmodium falciparum
KISREQKKRSKKKKTVTNS

SEQ ID NO: 3226962 - protein, 5 aa, Plasmodium falciparum
KISRK

SEQ ID NO: 3226963 - protein, 37 aa, Plasmodium falciparum
KISSKNKKKEILNTGKKKENAHLNESDVSKKKDVDNN

SEQ ID NO: 3226964 - protein, 35 aa, Plasmodium falciparum
KISSNKSSNNGNDNGSDNKSSAYKDSDTGNDADNM

SEQ ID NO: 3226965 - protein, 64 aa, Plasmodium falciparum
KISSPHPDHDKANDKKGNQPTEKKDKQKNIDNKKNNNNNKNNNNNNNNNNNNNKNNNNNNNNYY

SEQ ID NO: 3226966 - protein, 8 aa, Plasmodium falciparum
KISSSTSI

SEQ ID NO: 3226967 - protein, 9 aa, Plasmodium falciparum
KISTQDDSY

SEQ ID NO: 3226968 - protein, 16 aa, Plasmodium falciparum
KISTSNHLSKLKRMFS

SEQ ID NO: 3226969 - protein, 11 aa, Plasmodium falciparum
KISYDKESKIY

SEQ ID NO: 3226970 - protein, 8 aa, Plasmodium falciparum
KITDGNYR

SEQ ID NO: 3226971 - protein, 4 aa, Plasmodium falciparum
KITE

SEQ ID NO: 3226972 - protein, 13 aa, Plasmodium falciparum
KITEGDRNKGAYT

SEQ ID NO: 3226973 - protein, 12 aa, Plasmodium falciparum
KITGKQKKEYEE

SEQ ID NO: 3226974 - protein, 9 aa, Plasmodium falciparum
KITHEEETY

SEQ ID NO: 3226975 - protein, 4 aa, Plasmodium falciparum
KITI

SEQ ID NO: 3226976 - protein, 6 aa, Plasmodium falciparum
KITNNK

SEQ ID NO: 3226977 - protein, 25 aa, Plasmodium falciparum
KITNNTNDKYVNNKSNENEEKYEKE

SEQ ID NO: 3226978 - protein, 13 aa, Plasmodium falciparum
KITNSYNNNNNNN

SEQ ID NO: 3226979 - protein, 6 aa, Plasmodium falciparum
KITPES

SEQ ID NO: 3226980 - protein, 6 aa, Plasmodium falciparum
KITPNY

SEQ ID NO: 3226981 - protein, 7 aa, Plasmodium falciparum
KITQKKK

SEQ ID NO: 3226982 - protein, 28 aa, Plasmodium falciparum
KITQSRKTRSVSSKKSVHSSNSSVGSSL

SEQ ID NO: 3226983 - protein, 10 aa, Plasmodium falciparum
KITRKEPSQT

SEQ ID NO: 3226984 - protein, 12 aa, Plasmodium falciparum
KITSLSTNSSSS

SEQ ID NO: 3226985 - protein, 6 aa, Plasmodium falciparum
KITTED

SEQ ID NO: 3226986 - protein, 5 aa, Plasmodium falciparum
KITTK

SEQ ID NO: 3226987 - protein, 12 aa, Plasmodium falciparum
KIVQNGDEYNNT

SEQ ID NO: 3226988 - protein, 6 aa, Plasmodium falciparum
KIYDEN

SEQ ID NO: 3226989 - protein, 16 aa, Plasmodium falciparum
KIYDENDKNKIYDEND

SEQ ID NO: 3226990 - protein, 47 aa, Plasmodium falciparum
KIYDENNKNNIYDENDKNKIYDENNKNNIYDKKNNVEKNNKIDNKTN

SEQ ID NO: 3226991 - protein, 16 aa, Plasmodium falciparum
KIYDKSGRIATGQNSN

SEQ ID NO: 3226992 - protein, 9 aa, Plasmodium falciparum
KIYEKPKKE

SEQ ID NO: 3226993 - protein, 5 aa, Plasmodium falciparum
KIYND

SEQ ID NO: 3226994 - protein, 32 aa, Plasmodium falciparum
KIYNNNNNNNNNKNDSNNNKNDSNNKDYPSIQ

SEQ ID NO: 3226995 - protein, 18 aa, Plasmodium falciparum
KIYSKEESKKNDNEKERN

SEQ ID NO: 3226996 - protein, 4 aa, Plasmodium falciparum
KKAA

SEQ ID NO: 3226997 - protein, 12 aa, Plasmodium falciparum
KKADHSNTYSEQ

SEQ ID NO: 3226998 - protein, 9 aa, Plasmodium falciparum
KKADNSANL

SEQ ID NO: 3226999 - protein, 25 aa, Plasmodium falciparum
KKADNSDNKEDVETLETRNDTDVNK

SEQ ID NO: 3227000 - protein, 36 aa, Plasmodium falciparum
KKAEKCQNQNETACDTPSTCDKNLTPDVEDDDEEPY

SEQ ID NO: 3227001 - protein, 20 aa, Plasmodium falciparum
KKAEKYKDNHETSGEEKECD

SEQ ID NO: 3227002 - protein, 8 aa, Plasmodium falciparum
KKAESDTR

SEQ ID NO: 3227003 - protein, 7 aa, Plasmodium falciparum
KKAEVSN

SEQ ID NO: 3227004 - protein, 8 aa, Plasmodium falciparum
KKAEYEKQ

SEQ ID NO: 3227005 - protein, 5 aa, Plasmodium falciparum
KKAFD

SEQ ID NO: 3227006 - protein, 6 aa, Plasmodium falciparum
KKAFYE

SEQ ID NO: 3227007 - protein, 8 aa, Plasmodium falciparum
KKAHEENK

SEQ ID NO: 3227008 - protein, 5 aa, Plasmodium falciparum
KKAHK

SEQ ID NO: 3227009 - protein, 6 aa, Plasmodium falciparum
KKAHYS

SEQ ID NO: 3227010 - protein, 11 aa, Plasmodium falciparum
KKAIEATTTPY

SEQ ID NO: 3227011 - protein, 14 aa, Plasmodium falciparum
KKAKADEETSSRNI

SEQ ID NO: 3227012 - protein, 27 aa, Plasmodium falciparum
KKAKEKSQANRSISEESKRKKSIEKGM

SEQ ID NO: 3227013 - protein, 15 aa, Plasmodium falciparum
KKAKGSNKKINRGIT

SEQ ID NO: 3227014 - protein, 9 aa, Plasmodium falciparum
KKAKKKKEI

SEQ ID NO: 3227015 - protein, 6 aa, Plasmodium falciparum
KKALTD

SEQ ID NO: 3227016 - protein, 4 aa, Plasmodium falciparum
KKAN

SEQ ID NO: 3227017 - protein, 8 aa, Plasmodium falciparum
KKANKNDK

SEQ ID NO: 3227018 - protein, 40 aa, Plasmodium falciparum
KKAQNIKAQEKKINKNINSTNTQNVENDNNKKLESKKEKE

SEQ ID NO: 3227019 - protein, 11 aa, Plasmodium falciparum
KKAQSDDEHNE

SEQ ID NO: 3227020 - protein, 11 aa, Plasmodium falciparum
KKAQSKDTEED

SEQ ID NO: 3227021 - protein, 6 aa, Plasmodium falciparum
KKARKR

SEQ ID NO: 3227022 - protein, 10 aa, Plasmodium falciparum
KKASNKKYDY

SEQ ID NO: 3227023 - protein, 19 aa, Plasmodium falciparum
KKASPGEYLSDDEQSENDS

SEQ ID NO: 3227024 - protein, 17 aa, Plasmodium falciparum
KKATKTRGGYGAEPMST

SEQ ID NO: 3227025 - protein, 5 aa, Plasmodium falciparum
KKATN

SEQ ID NO: 3227026 - protein, 24 aa, Plasmodium falciparum
KKATSCPAPTSGENPTQCQEPPLV

SEQ ID NO: 3227027 - protein, 9 aa, Plasmodium falciparum
KKAYDNSKG

SEQ ID NO: 3227028 - protein, 19 aa, Plasmodium falciparum
KKAYGKNGTTTKETSNGPI

SEQ ID NO: 3227029 - protein, 8 aa, Plasmodium falciparum
KKCDDSNI

SEQ ID NO: 3227030 - protein, 20 aa, Plasmodium falciparum
KKCDEDIESNDDKKNLCENN

SEQ ID NO: 3227031 - protein, 6 aa, Plasmodium falciparum
KKCDND

SEQ ID NO: 3227032 - protein, 43 aa, Plasmodium falciparum
KKCDNENEVNNKDTNKRNTGEPKSCCSGNSESNQNENENDDAT

SEQ ID NO: 3227033 - protein, 52 aa, Plasmodium falciparum
KKCEKKCEKKCEKKCEKKCEKKCEKKCEKKCEKKCEKKCEKKCEKKCEKKCE

SEQ ID NO: 3227034 - protein, 5 aa, Plasmodium falciparum
KKCEN

SEQ ID NO: 3227035 - protein, 6 aa, Plasmodium falciparum
KKCENE

SEQ ID NO: 3227036 - protein, 11 aa, Plasmodium falciparum
KKCEQHEPVQK

SEQ ID NO: 3227037 - protein, 9 aa, Plasmodium falciparum
KKCKEQCDK

SEQ ID NO: 3227038 - protein, 20 aa, Plasmodium falciparum
KKCKKNMKNEEISKQKNGNI

SEQ ID NO: 3227039 - protein, 7 aa, Plasmodium falciparum
KKCNGNN

SEQ ID NO: 3227040 - protein, 13 aa, Plasmodium falciparum
KKCNKSLANNTNN

SEQ ID NO: 3227041 - protein, 14 aa, Plasmodium falciparum
KKCNNTTDNNSNNN

SEQ ID NO: 3227042 - protein, 6 aa, Plasmodium falciparum
KKCQSL

SEQ ID NO: 3227043 - protein, 5 aa, Plasmodium falciparum
KKCST

SEQ ID NO: 3227044 - protein, 5 aa, Plasmodium falciparum
KKCTE

SEQ ID NO: 3227045 - protein, 44 aa, Plasmodium falciparum
KKCTETHNDEKCKEQEESGGRSLNPDPESDDEEETDNVKENPCA

SEQ ID NO: 3227046 - protein, 7 aa, Plasmodium falciparum
KKCTKDD

SEQ ID NO: 3227047 - protein, 41 aa, Plasmodium falciparum
KKCTKNEDNNNNNNNNDDNNNDDDNNNDDNIYNNDDDNYHD

SEQ ID NO: 3227048 - protein, 15 aa, Plasmodium falciparum
KKCYNNDTSKCTKSN

SEQ ID NO: 3227049 - protein, 19 aa, Plasmodium falciparum
KKDATSDNGNKYDSNCDGK

SEQ ID NO: 3227050 - protein, 15 aa, Plasmodium falciparum
KKDCDENTCKNKCSE

SEQ ID NO: 3227051 - protein, 4 aa, Plasmodium falciparum
KKDD

SEQ ID NO: 3227052 - protein, 12 aa, Plasmodium falciparum
KKDDINKNINED

SEQ ID NO: 3227053 - protein, 9 aa, Plasmodium falciparum
KKDDNHNNH

SEQ ID NO: 3227054 - protein, 9 aa, Plasmodium falciparum
KKDDNNNNI

SEQ ID NO: 3227055 - protein, 10 aa, Plasmodium falciparum
KKDDNNNNNN

SEQ ID NO: 3227056 - protein, 15 aa, Plasmodium falciparum
KKDDNVEETIQSNDK

SEQ ID NO: 3227057 - protein, 7 aa, Plasmodium falciparum
KKDDQIN

SEQ ID NO: 3227058 - protein, 5 aa, Plasmodium falciparum
KKDDR

SEQ ID NO: 3227059 - protein, 9 aa, Plasmodium falciparum
KKDDSINNL

SEQ ID NO: 3227060 - protein, 7 aa, Plasmodium falciparum
KKDDTNI

SEQ ID NO: 3227061 - protein, 8 aa, Plasmodium falciparum
KKDDYSLN

SEQ ID NO: 3227062 - protein, 4 aa, Plasmodium falciparum
KKDE

SEQ ID NO: 3227063 - protein, 9 aa, Plasmodium falciparum
KKDEDENDM

SEQ ID NO: 3227064 - protein, 7 aa, Plasmodium falciparum
KKDEEDY

SEQ ID NO: 3227065 - protein, 9 aa, Plasmodium falciparum
KKDEEGFYE

SEQ ID NO: 3227066 - protein, 6 aa, Plasmodium falciparum
KKDEEL

SEQ ID NO: 3227067 - protein, 8 aa, Plasmodium falciparum
KKDEGRYN

SEQ ID NO: 3227068 - protein, 10 aa, Plasmodium falciparum
KKDEKDEEKI

SEQ ID NO: 3227069 - protein, 12 aa, Plasmodium falciparum
KKDEKEKEKVQK

SEQ ID NO: 3227070 - protein, 19 aa, Plasmodium falciparum
KKDEKENKKTHDDDEKTKE

SEQ ID NO: 3227071 - protein, 6 aa, Plasmodium falciparum
KKDELN

SEQ ID NO: 3227072 - protein, 8 aa, Plasmodium falciparum
KKDENEVE

SEQ ID NO: 3227073 - protein, 6 aa, Plasmodium falciparum
KKDENT

SEQ ID NO: 3227074 - protein, 8 aa, Plasmodium falciparum
KKDEQHET

SEQ ID NO: 3227075 - protein, 14 aa, Plasmodium falciparum
KKDEQNSSEEKKEQ

SEQ ID NO: 3227076 - protein, 13 aa, Plasmodium falciparum
KKDERKSQNTSKM

SEQ ID NO: 3227077 - protein, 6 aa, Plasmodium falciparum
KKDEWK

SEQ ID NO: 3227078 - protein, 7 aa, Plasmodium falciparum
KKDEWKP

SEQ ID NO: 3227079 - protein, 34 aa, Plasmodium falciparum
KKDEYDEQESAYGQQQKEYVNGSKGAGRNNDDKE

SEQ ID NO: 3227080 - protein, 7 aa, Plasmodium falciparum
KKDEYDI

SEQ ID NO: 3227081 - protein, 10 aa, Plasmodium falciparum
KKDEYKKKES

SEQ ID NO: 3227082 - protein, 17 aa, Plasmodium falciparum
KKDGGNEWEKKKEDEKC

SEQ ID NO: 3227083 - protein, 7 aa, Plasmodium falciparum
KKDGKWI

SEQ ID NO: 3227084 - protein, 7 aa, Plasmodium falciparum
KKDGSFE

SEQ ID NO: 3227085 - protein, 74 aa, Plasmodium falciparum
KKDGSSNNDKNDNSNKNRNNYNNNDDNNNNDDNNNNNDDNDDNDNINNNYNNNNNNNNRNNSNSNNSNNSDNNN

SEQ ID NO: 3227086 - protein, 18 aa, Plasmodium falciparum
KKDGTGSGDCGGNSDPSL

SEQ ID NO: 3227087 - protein, 17 aa, Plasmodium falciparum
KKDHEGCNKPNTKGNHG

SEQ ID NO: 3227088 - protein, 7 aa, Plasmodium falciparum
KKDHFEK

SEQ ID NO: 3227089 - protein, 5 aa, Plasmodium falciparum
KKDHI

SEQ ID NO: 3227090 - protein, 8 aa, Plasmodium falciparum
KKDIDEKT

SEQ ID NO: 3227091 - protein, 6 aa, Plasmodium falciparum
KKDIDN

SEQ ID NO: 3227092 - protein, 5 aa, Plasmodium falciparum
KKDIE

SEQ ID NO: 3227093 - protein, 15 aa, Plasmodium falciparum
KKDIEENRNETNKDD

SEQ ID NO: 3227094 - protein, 13 aa, Plasmodium falciparum
KKDIEKKIKKHGY

SEQ ID NO: 3227095 - protein, 13 aa, Plasmodium falciparum
KKDIHKDSQDKKK

SEQ ID NO: 3227096 - protein, 7 aa, Plasmodium falciparum
KKDIHPS

SEQ ID NO: 3227097 - protein, 19 aa, Plasmodium falciparum
KKDIKEEKKQNDSLQKYNK

SEQ ID NO: 3227098 - protein, 8 aa, Plasmodium falciparum
KKDIKGNT

SEQ ID NO: 3227099 - protein, 9 aa, Plasmodium falciparum
KKDIKSSRD

SEQ ID NO: 3227100 - protein, 8 aa, Plasmodium falciparum
KKDINKNR

SEQ ID NO: 3227101 - protein, 41 aa, Plasmodium falciparum
KKDINKTKSNINKMKCNEKLHENYSINNDHGNSNMENKNNG

SEQ ID NO: 3227102 - protein, 6 aa, Plasmodium falciparum
KKDISH

SEQ ID NO: 3227103 - protein, 18 aa, Plasmodium falciparum
KKDISRENTGEDISPNKY

SEQ ID NO: 3227104 - protein, 7 aa, Plasmodium falciparum
KKDISTS

SEQ ID NO: 3227105 - protein, 5 aa, Plasmodium falciparum
KKDKE

SEQ ID NO: 3227106 - protein, 13 aa, Plasmodium falciparum
KKDKEKKKNQMDG

SEQ ID NO: 3227107 - protein, 8 aa, Plasmodium falciparum
KKDKELAD

SEQ ID NO: 3227108 - protein, 6 aa, Plasmodium falciparum
KKDKIN

SEQ ID NO: 3227109 - protein, 7 aa, Plasmodium falciparum
KKDKINK

SEQ ID NO: 3227110 - protein, 9 aa, Plasmodium falciparum
KKDKKKKCC

SEQ ID NO: 3227111 - protein, 10 aa, Plasmodium falciparum
KKDKKKYEQY

SEQ ID NO: 3227112 - protein, 9 aa, Plasmodium falciparum
KKDKKNKSI

SEQ ID NO: 3227113 - protein, 5 aa, Plasmodium falciparum
KKDKN

SEQ ID NO: 3227114 - protein, 52 aa, Plasmodium falciparum
KKDKNDENDKNDENDKNDENDKNDENDENDENDKNDKNDKNDKNDKNDKNDE

SEQ ID NO: 3227115 - protein, 13 aa, Plasmodium falciparum
KKDKNHNDDYDGN

SEQ ID NO: 3227116 - protein, 9 aa, Plasmodium falciparum
KKDKNKYEQ

SEQ ID NO: 3227117 - protein, 13 aa, Plasmodium falciparum
KKDKNNKDSSHGT

SEQ ID NO: 3227118 - protein, 7 aa, Plasmodium falciparum
KKDKNVN

SEQ ID NO: 3227119 - protein, 11 aa, Plasmodium falciparum
KKDKRKRKKEF

SEQ ID NO: 3227120 - protein, 5 aa, Plasmodium falciparum
KKDKS

SEQ ID NO: 3227121 - protein, 7 aa, Plasmodium falciparum
KKDKSNM

SEQ ID NO: 3227122 - protein, 7 aa, Plasmodium falciparum
KKDKTKK

SEQ ID NO: 3227123 - protein, 5 aa, Plasmodium falciparum
KKDKY

SEQ ID NO: 3227124 - protein, 7 aa, Plasmodium falciparum
KKDKYET

SEQ ID NO: 3227125 - protein, 5 aa, Plasmodium falciparum
KKDLN

SEQ ID NO: 3227126 - protein, 7 aa, Plasmodium falciparum
KKDLQNK

SEQ ID NO: 3227127 - protein, 5 aa, Plasmodium falciparum
KKDMN

SEQ ID NO: 3227128 - protein, 13 aa, Plasmodium falciparum
KKDMNKIKDQKKI

SEQ ID NO: 3227129 - protein, 47 aa, Plasmodium falciparum
KKDNDDDKNKHKDNNNNNNNNKNKHKDNNKNKHKDNNNNNNKNKHSD

SEQ ID NO: 3227130 - protein, 8 aa, Plasmodium falciparum
KKDNERTS

SEQ ID NO: 3227131 - protein, 7 aa, Plasmodium falciparum
KKDNEVY

SEQ ID NO: 3227132 - protein, 9 aa, Plasmodium falciparum
KKDNGEGTI

SEQ ID NO: 3227133 - protein, 6 aa, Plasmodium falciparum
KKDNHV

SEQ ID NO: 3227134 - protein, 6 aa, Plasmodium falciparum
KKDNIE

SEQ ID NO: 3227135 - protein, 26 aa, Plasmodium falciparum
KKDNIKNNNKQKNAPNYNKNKQEYYS

SEQ ID NO: 3227136 - protein, 17 aa, Plasmodium falciparum
KKDNINESNIKEDKKEE

SEQ ID NO: 3227137 - protein, 10 aa, Plasmodium falciparum
KKDNKKKAQV

SEQ ID NO: 3227138 - protein, 6 aa, Plasmodium falciparum
KKDNKY

SEQ ID NO: 3227139 - protein, 5 aa, Plasmodium falciparum
KKDNL

SEQ ID NO: 3227140 - protein, 7 aa, Plasmodium falciparum
KKDNLDE

SEQ ID NO: 3227141 - protein, 15 aa, Plasmodium falciparum
KKDNLDNIKEQHDDN

SEQ ID NO: 3227142 - protein, 5 aa, Plasmodium falciparum
KKDNN

SEQ ID NO: 3227143 - protein, 14 aa, Plasmodium falciparum
KKDNNGINNNSEEH

SEQ ID NO: 3227144 - protein, 8 aa, Plasmodium falciparum
KKDNNMNV

SEQ ID NO: 3227145 - protein, 7 aa, Plasmodium falciparum
KKDNQNC

SEQ ID NO: 3227146 - protein, 10 aa, Plasmodium falciparum
KKDNSSEERY

SEQ ID NO: 3227147 - protein, 7 aa, Plasmodium falciparum
KKDNSTI

SEQ ID NO: 3227148 - protein, 7 aa, Plasmodium falciparum
KKDNYND

SEQ ID NO: 3227149 - protein, 10 aa, Plasmodium falciparum
KKDNYNNDDS

SEQ ID NO: 3227150 - protein, 7 aa, Plasmodium falciparum
KKDPIEM

SEQ ID NO: 3227151 - protein, 6 aa, Plasmodium falciparum
KKDPNI

SEQ ID NO: 3227152 - protein, 8 aa, Plasmodium falciparum
KKDQCKKS

SEQ ID NO: 3227153 - protein, 13 aa, Plasmodium falciparum
KKDQDNDKKEEYN

SEQ ID NO: 3227154 - protein, 7 aa, Plasmodium falciparum
KKDQENN

SEQ ID NO: 3227155 - protein, 7 aa, Plasmodium falciparum
KKDQRVS

SEQ ID NO: 3227156 - protein, 40 aa, Plasmodium falciparum
KKDRSRDTYEDEESREGAYGENTTEDLNEDTQEGHKNKKK

SEQ ID NO: 3227157 - protein, 8 aa, Plasmodium falciparum
KKDRSSLQ

SEQ ID NO: 3227158 - protein, 12 aa, Plasmodium falciparum
KKDRYEGDTKNY

SEQ ID NO: 3227159 - protein, 9 aa, Plasmodium falciparum
KKDSCSDLQ

SEQ ID NO: 3227160 - protein, 9 aa, Plasmodium falciparum
KKDSDGKHC

SEQ ID NO: 3227161 - protein, 12 aa, Plasmodium falciparum
KKDSDSSEQVLT

SEQ ID NO: 3227162 - protein, 9 aa, Plasmodium falciparum
KKDSKQTCN

SEQ ID NO: 3227163 - protein, 8 aa, Plasmodium falciparum
KKDSKYDK

SEQ ID NO: 3227164 - protein, 8 aa, Plasmodium falciparum
KKDSNNNI

SEQ ID NO: 3227165 - protein, 23 aa, Plasmodium falciparum
KKDSNNNNNIKNNGNQDDDGNRD

SEQ ID NO: 3227166 - protein, 11 aa, Plasmodium falciparum
KKDSQSEKNKS

SEQ ID NO: 3227167 - protein, 12 aa, Plasmodium falciparum
KKDSRENEKCTQ

SEQ ID NO: 3227168 - protein, 10 aa, Plasmodium falciparum
KKDSSYSKSN

SEQ ID NO: 3227169 - protein, 15 aa, Plasmodium falciparum
KKDSTTKQENTSSSL

SEQ ID NO: 3227170 - protein, 23 aa, Plasmodium falciparum
KKDSYKKTKTNNCTKENKNEDKY

SEQ ID NO: 3227171 - protein, 31 aa, Plasmodium falciparum
KKDTHENSNNNQDDITHPNNNYKNANDSNDY

SEQ ID NO: 3227172 - protein, 6 aa, Plasmodium falciparum
KKDTKK

SEQ ID NO: 3227173 - protein, 6 aa, Plasmodium falciparum
KKDTKT

SEQ ID NO: 3227174 - protein, 10 aa, Plasmodium falciparum
KKDTLSSESE

SEQ ID NO: 3227175 - protein, 5 aa, Plasmodium falciparum
KKDTM

SEQ ID NO: 3227176 - protein, 5 aa, Plasmodium falciparum
KKDTN

SEQ ID NO: 3227177 - protein, 12 aa, Plasmodium falciparum
KKDTNGQEGDKK

SEQ ID NO: 3227178 - protein, 14 aa, Plasmodium falciparum
KKDVEKQNEERDKE

SEQ ID NO: 3227179 - protein, 8 aa, Plasmodium falciparum
KKDVKKEC

SEQ ID NO: 3227180 - protein, 7 aa, Plasmodium falciparum
KKDVKKK

SEQ ID NO: 3227181 - protein, 15 aa, Plasmodium falciparum
KKDVSKEGNSETLGD

SEQ ID NO: 3227182 - protein, 6 aa, Plasmodium falciparum
KKDYLQ

SEQ ID NO: 3227183 - protein, 12 aa, Plasmodium falciparum
KKDYSNESEGEV

SEQ ID NO: 3227184 - protein, 12 aa, Plasmodium falciparum
KKEAERRSKGEL

SEQ ID NO: 3227185 - protein, 18 aa, Plasmodium falciparum
KKEAKEENTFPEEPNREI

SEQ ID NO: 3227186 - protein, 7 aa, Plasmodium falciparum
KKEAPLS

SEQ ID NO: 3227187 - protein, 24 aa, Plasmodium falciparum
KKECRGKYPNGDKQYCSGDGHDCE

SEQ ID NO: 3227188 - protein, 9 aa, Plasmodium falciparum
KKEDDKFNQ

SEQ ID NO: 3227189 - protein, 9 aa, Plasmodium falciparum
KKEDDVNVE

SEQ ID NO: 3227190 - protein, 7 aa, Plasmodium falciparum
KKEDEKD

SEQ ID NO: 3227191 - protein, 7 aa, Plasmodium falciparum
KKEDEWK

SEQ ID NO: 3227192 - protein, 15 aa, Plasmodium falciparum
KKEDIDKTKANANDL

SEQ ID NO: 3227193 - protein, 7 aa, Plasmodium falciparum
KKEDLYN

SEQ ID NO: 3227194 - protein, 16 aa, Plasmodium falciparum
KKEDNKEEGKEKEPHE

SEQ ID NO: 3227195 - protein, 11 aa, Plasmodium falciparum
KKEDNKNLTSD

SEQ ID NO: 3227196 - protein, 33 aa, Plasmodium falciparum
KKEDNNNNNNNNDNNSNNNNSNSGKNDKNCKEE

SEQ ID NO: 3227197 - protein, 7 aa, Plasmodium falciparum
KKEDPIN

SEQ ID NO: 3227198 - protein, 28 aa, Plasmodium falciparum
KKEDRNNKIKNNEENKYIEKKKKKKKYS

SEQ ID NO: 3227199 - protein, 8 aa, Plasmodium falciparum
KKEDSKTC

SEQ ID NO: 3227200 - protein, 8 aa, Plasmodium falciparum
KKEDSYIH

SEQ ID NO: 3227201 - protein, 5 aa, Plasmodium falciparum
KKEDT

SEQ ID NO: 3227202 - protein, 13 aa, Plasmodium falciparum
KKEDTKNNNENNI

SEQ ID NO: 3227203 - protein, 7 aa, Plasmodium falciparum
KKEEALP

SEQ ID NO: 3227204 - protein, 22 aa, Plasmodium falciparum
KKEEDESYNTFNGTKKNNTSNS

SEQ ID NO: 3227205 - protein, 15 aa, Plasmodium falciparum
KKEEDKERKKKDDEI

SEQ ID NO: 3227206 - protein, 25 aa, Plasmodium falciparum
KKEEDKKEEEEEEEKKNKSNNNPCN

SEQ ID NO: 3227207 - protein, 16 aa, Plasmodium falciparum
KKEEEDQVNAYSSEQN

SEQ ID NO: 3227208 - protein, 41 aa, Plasmodium falciparum
KKEEEEEKKKAEELKKEEEEKKKVQQLKKEEEKKAEEIRKE

SEQ ID NO: 3227209 - protein, 8 aa, Plasmodium falciparum
KKEEEKLK

SEQ ID NO: 3227210 - protein, 16 aa, Plasmodium falciparum
KKEEFDKQSKKYENEI

SEQ ID NO: 3227211 - protein, 18 aa, Plasmodium falciparum
KKEEGEAKSQNEPDEIQK

SEQ ID NO: 3227212 - protein, 7 aa, Plasmodium falciparum
KKEEGKT

SEQ ID NO: 3227213 - protein, 8 aa, Plasmodium falciparum
KKEEHSEA

SEQ ID NO: 3227214 - protein, 24 aa, Plasmodium falciparum
KKEEHTSFNKSNNSNNNNNNLKNT

SEQ ID NO: 3227215 - protein, 10 aa, Plasmodium falciparum
KKEEIKSQDH

SEQ ID NO: 3227216 - protein, 5 aa, Plasmodium falciparum
KKEEK

SEQ ID NO: 3227217 - protein, 16 aa, Plasmodium falciparum
KKEEKEKKGAKDKGKD

SEQ ID NO: 3227218 - protein, 8 aa, Plasmodium falciparum
KKEEKIKE

SEQ ID NO: 3227219 - protein, 12 aa, Plasmodium falciparum
KKEEKKDNFNNS

SEQ ID NO: 3227220 - protein, 7 aa, Plasmodium falciparum
KKEEKKI

SEQ ID NO: 3227221 - protein, 5 aa, Plasmodium falciparum
KKEEL

SEQ ID NO: 3227222 - protein, 7 aa, Plasmodium falciparum
KKEELDN

SEQ ID NO: 3227223 - protein, 7 aa, Plasmodium falciparum
KKEENED

SEQ ID NO: 3227224 - protein, 7 aa, Plasmodium falciparum
KKEENEI

SEQ ID NO: 3227225 - protein, 9 aa, Plasmodium falciparum
KKEENEVNQ

SEQ ID NO: 3227226 - protein, 7 aa, Plasmodium falciparum
KKEENKM

SEQ ID NO: 3227227 - protein, 9 aa, Plasmodium falciparum
KKEENSKTK

SEQ ID NO: 3227228 - protein, 10 aa, Plasmodium falciparum
KKEENTESDD

SEQ ID NO: 3227229 - protein, 9 aa, Plasmodium falciparum
KKEEQQEQQ

SEQ ID NO: 3227230 - protein, 6 aa, Plasmodium falciparum
KKEEQS

SEQ ID NO: 3227231 - protein, 7 aa, Plasmodium falciparum
KKEERLD

SEQ ID NO: 3227232 - protein, 9 aa, Plasmodium falciparum
KKEERRKRK

SEQ ID NO: 3227233 - protein, 14 aa, Plasmodium falciparum
KKEESSFSNKVTNE

SEQ ID NO: 3227234 - protein, 7 aa, Plasmodium falciparum
KKEESYI

SEQ ID NO: 3227235 - protein, 14 aa, Plasmodium falciparum
KKEETKDQKVTEQV

SEQ ID NO: 3227236 - protein, 8 aa, Plasmodium falciparum
KKEETNKI

SEQ ID NO: 3227237 - protein, 7 aa, Plasmodium falciparum
KKEEWET

SEQ ID NO: 3227238 - protein, 7 aa, Plasmodium falciparum
KKEEWGK

SEQ ID NO: 3227239 - protein, 6 aa, Plasmodium falciparum
KKEEWK

SEQ ID NO: 3227240 - protein, 7 aa, Plasmodium falciparum
KKEEWKN

SEQ ID NO: 3227241 - protein, 5 aa, Plasmodium falciparum
KKEEY

SEQ ID NO: 3227242 - protein, 21 aa, Plasmodium falciparum
KKEEYNKQAKQYQEYQKGNNY

SEQ ID NO: 3227243 - protein, 8 aa, Plasmodium falciparum
KKEEYSGE

SEQ ID NO: 3227244 - protein, 4 aa, Plasmodium falciparum
KKEF

SEQ ID NO: 3227245 - protein, 14 aa, Plasmodium falciparum
KKEFEKQKKKCEKE

SEQ ID NO: 3227246 - protein, 15 aa, Plasmodium falciparum
KKEFEKQKKKYEKEI

SEQ ID NO: 3227247 - protein, 15 aa, Plasmodium falciparum
KKEFEKQKNKYDKEI

SEQ ID NO: 3227248 - protein, 29 aa, Plasmodium falciparum
KKEFNKQKEKYKEEINESKPGVNSEHGKY

SEQ ID NO: 3227249 - protein, 28 aa, Plasmodium falciparum
KKEFNKQKKKYEKEVDATQNNDNNENGI

SEQ ID NO: 3227250 - protein, 8 aa, Plasmodium falciparum
KKEFNKQS

SEQ ID NO: 3227251 - protein, 6 aa, Plasmodium falciparum
KKEFNT

SEQ ID NO: 3227252 - protein, 7 aa, Plasmodium falciparum
KKEGGLA

SEQ ID NO: 3227253 - protein, 11 aa, Plasmodium falciparum
KKEGIEKDDNL

SEQ ID NO: 3227254 - protein, 7 aa, Plasmodium falciparum
KKEGTEY

SEQ ID NO: 3227255 - protein, 5 aa, Plasmodium falciparum
KKEHM

SEQ ID NO: 3227256 - protein, 8 aa, Plasmodium falciparum
KKEHNKKK

SEQ ID NO: 3227257 - protein, 7 aa, Plasmodium falciparum
KKEHNNV

SEQ ID NO: 3227258 - protein, 7 aa, Plasmodium falciparum
KKEIEKD

SEQ ID NO: 3227259 - protein, 11 aa, Plasmodium falciparum
KKEIKKKENFD

SEQ ID NO: 3227260 - protein, 7 aa, Plasmodium falciparum
KKEIKKN

SEQ ID NO: 3227261 - protein, 32 aa, Plasmodium falciparum
KKEIQKKVKKENQKKVKKENQYEEKKKGGANK

SEQ ID NO: 3227262 - protein, 11 aa, Plasmodium falciparum
KKEKDEEDTFE

SEQ ID NO: 3227263 - protein, 8 aa, Plasmodium falciparum
KKEKDEKI

SEQ ID NO: 3227264 - protein, 16 aa, Plasmodium falciparum
KKEKDEKKNLKKTNTY

SEQ ID NO: 3227265 - protein, 17 aa, Plasmodium falciparum
KKEKDHSYGTLNNKETK

SEQ ID NO: 3227266 - protein, 9 aa, Plasmodium falciparum
KKEKDNKYL

SEQ ID NO: 3227267 - protein, 5 aa, Plasmodium falciparum
KKEKE

SEQ ID NO: 3227268 - protein, 53 aa, Plasmodium falciparum
KKEKEKEKKKKKKKNDIKKEEKEENNINNEKKNNNNNNNINSEKKKKNDINGH

SEQ ID NO: 3227269 - protein, 12 aa, Plasmodium falciparum
KKEKEKKKPQEG

SEQ ID NO: 3227270 - protein, 11 aa, Plasmodium falciparum
KKEKEKNIDDS

SEQ ID NO: 3227271 - protein, 8 aa, Plasmodium falciparum
KKEKEKRK

SEQ ID NO: 3227272 - protein, 7 aa, Plasmodium falciparum
KKEKENI

SEQ ID NO: 3227273 - protein, 7 aa, Plasmodium falciparum
KKEKENN

SEQ ID NO: 3227274 - protein, 9 aa, Plasmodium falciparum
KKEKENRKK

SEQ ID NO: 3227275 - protein, 7 aa, Plasmodium falciparum
KKEKEWK

SEQ ID NO: 3227276 - protein, 7 aa, Plasmodium falciparum
KKEKEWT

SEQ ID NO: 3227277 - protein, 10 aa, Plasmodium falciparum
KKEKHQNEDN

SEQ ID NO: 3227278 - protein, 11 aa, Plasmodium falciparum
KKEKIRQGSFP

SEQ ID NO: 3227279 - protein, 6 aa, Plasmodium falciparum
KKEKKE

SEQ ID NO: 3227280 - protein, 18 aa, Plasmodium falciparum
KKEKKEKKGKKKKEKYYY

SEQ ID NO: 3227281 - protein, 12 aa, Plasmodium falciparum
KKEKKGIKKKNE

SEQ ID NO: 3227282 - protein, 7 aa, Plasmodium falciparum
KKEKKIQ

SEQ ID NO: 3227283 - protein, 11 aa, Plasmodium falciparum
KKEKKIQRKED

SEQ ID NO: 3227284 - protein, 46 aa, Plasmodium falciparum
KKEKKKEESGKPEENKHANEASKKQEPKASKVSQKPSTSTRSNNEV

SEQ ID NO: 3227285 - protein, 13 aa, Plasmodium falciparum
KKEKKKEKKKGMS

SEQ ID NO: 3227286 - protein, 8 aa, Plasmodium falciparum
KKEKKKKD

SEQ ID NO: 3227287 - protein, 11 aa, Plasmodium falciparum
KKEKKKKKKKI

SEQ ID NO: 3227288 - protein, 12 aa, Plasmodium falciparum
KKEKKKKKNDEQ

SEQ ID NO: 3227289 - protein, 9 aa, Plasmodium falciparum
KKEKKQEYA

SEQ ID NO: 3227290 - protein, 8 aa, Plasmodium falciparum
KKEKKRNV

SEQ ID NO: 3227291 - protein, 16 aa, Plasmodium falciparum
KKEKKTDNDPDEIQKT

SEQ ID NO: 3227292 - protein, 11 aa, Plasmodium falciparum
KKEKKYNNGEL

SEQ ID NO: 3227293 - protein, 18 aa, Plasmodium falciparum
KKEKLKIKEDNDINKMNE

SEQ ID NO: 3227294 - protein, 5 aa, Plasmodium falciparum
KKEKM

SEQ ID NO: 3227295 - protein, 5 aa, Plasmodium falciparum
KKEKN

SEQ ID NO: 3227296 - protein, 7 aa, Plasmodium falciparum
KKEKNEY

SEQ ID NO: 3227297 - protein, 7 aa, Plasmodium falciparum
KKEKNKG

SEQ ID NO: 3227298 - protein, 8 aa, Plasmodium falciparum
KKEKNNSD

SEQ ID NO: 3227299 - protein, 9 aa, Plasmodium falciparum
KKEKNTINS

SEQ ID NO: 3227300 - protein, 15 aa, Plasmodium falciparum
KKEKQKKKKKKNINI

SEQ ID NO: 3227301 - protein, 8 aa, Plasmodium falciparum
KKEKQTDE

SEQ ID NO: 3227302 - protein, 12 aa, Plasmodium falciparum
KKEKQYQHGDNI

SEQ ID NO: 3227303 - protein, 7 aa, Plasmodium falciparum
KKEKRKK

SEQ ID NO: 3227304 - protein, 27 aa, Plasmodium falciparum
KKEKRYFNNNGKNKRTKNGKKKKNTIH

SEQ ID NO: 3227305 - protein, 17 aa, Plasmodium falciparum
KKEKSEGKSQNDPDEIQ

SEQ ID NO: 3227306 - protein, 21 aa, Plasmodium falciparum
KKEKSGRKLKSSGKEKHTYEI

SEQ ID NO: 3227307 - protein, 6 aa, Plasmodium falciparum
KKEKSS

SEQ ID NO: 3227308 - protein, 10 aa, Plasmodium falciparum
KKEKSYSCTP

SEQ ID NO: 3227309 - protein, 10 aa, Plasmodium falciparum
KKEKTKEIKD

SEQ ID NO: 3227310 - protein, 6 aa, Plasmodium falciparum
KKEKTQ

SEQ ID NO: 3227311 - protein, 7 aa, Plasmodium falciparum
KKEKVEP

SEQ ID NO: 3227312 - protein, 22 aa, Plasmodium falciparum
KKEKYESVKKDNINSSNNNVSK

SEQ ID NO: 3227313 - protein, 7 aa, Plasmodium falciparum
KKELEEK

SEQ ID NO: 3227314 - protein, 8 aa, Plasmodium falciparum
KKELSRKN

SEQ ID NO: 3227315 - protein, 7 aa, Plasmodium falciparum
KKELSSP

SEQ ID NO: 3227316 - protein, 5 aa, Plasmodium falciparum
KKELT

SEQ ID NO: 3227317 - protein, 5 aa, Plasmodium falciparum
KKEME

SEQ ID NO: 3227318 - protein, 49 aa, Plasmodium falciparum
KKEMEEAKTYNNNNNKNNINNNNNNNDNNNNNNNNNNNNNNNNNNMKKK

SEQ ID NO: 3227319 - protein, 5 aa, Plasmodium falciparum
KKEMT

SEQ ID NO: 3227320 - protein, 13 aa, Plasmodium falciparum
KKENDDKEKDGEE

SEQ ID NO: 3227321 - protein, 8 aa, Plasmodium falciparum
KKENDDSI

SEQ ID NO: 3227322 - protein, 9 aa, Plasmodium falciparum
KKENEEDTL

SEQ ID NO: 3227323 - protein, 11 aa, Plasmodium falciparum
KKENEEKKRKR

SEQ ID NO: 3227324 - protein, 9 aa, Plasmodium falciparum
KKENEEKTT

SEQ ID NO: 3227325 - protein, 31 aa, Plasmodium falciparum
KKENEKDVQNQFNGNEQISSNVSQTEGERKE

SEQ ID NO: 3227326 - protein, 7 aa, Plasmodium falciparum
KKENEKK

SEQ ID NO: 3227327 - protein, 14 aa, Plasmodium falciparum
KKENEKKKKTYSQN

SEQ ID NO: 3227328 - protein, 9 aa, Plasmodium falciparum
KKENEKNKN

SEQ ID NO: 3227329 - protein, 8 aa, Plasmodium falciparum
KKENENIS

SEQ ID NO: 3227330 - protein, 7 aa, Plasmodium falciparum
KKENENV

SEQ ID NO: 3227331 - protein, 7 aa, Plasmodium falciparum
KKENEPV

SEQ ID NO: 3227332 - protein, 17 aa, Plasmodium falciparum
KKENEYLNNTKTSLNKQ

SEQ ID NO: 3227333 - protein, 7 aa, Plasmodium falciparum
KKENFNE

SEQ ID NO: 3227334 - protein, 25 aa, Plasmodium falciparum
KKENGDEDESEDESEDDSEEDEKKI

SEQ ID NO: 3227335 - protein, 46 aa, Plasmodium falciparum
KKENHDKNHDKNHDKNHDKNHDKNHDKNHDKNHDKNHDKNHDKNHV

SEQ ID NO: 3227336 - protein, 5 aa, Plasmodium falciparum
KKENI

SEQ ID NO: 3227337 - protein, 8 aa, Plasmodium falciparum
KKENIKEY

SEQ ID NO: 3227338 - protein, 10 aa, Plasmodium falciparum
KKENINPKEL

SEQ ID NO: 3227339 - protein, 7 aa, Plasmodium falciparum
KKENKDK

SEQ ID NO: 3227340 - protein, 8 aa, Plasmodium falciparum
KKENKEHK

SEQ ID NO: 3227341 - protein, 27 aa, Plasmodium falciparum
KKENKTNNNRNDNNNDNINNSNSVERV

SEQ ID NO: 3227342 - protein, 9 aa, Plasmodium falciparum
KKENNEKEN

SEQ ID NO: 3227343 - protein, 14 aa, Plasmodium falciparum
KKENNEKLKSLTDD

SEQ ID NO: 3227344 - protein, 12 aa, Plasmodium falciparum
KKENNEKRQSLE

SEQ ID NO: 3227345 - protein, 8 aa, Plasmodium falciparum
KKENNENI

SEQ ID NO: 3227346 - protein, 26 aa, Plasmodium falciparum
KKENNNDKNDHGNSHPQGNNNHQNKQ

SEQ ID NO: 3227347 - protein, 10 aa, Plasmodium falciparum
KKENNNNINN

SEQ ID NO: 3227348 - protein, 14 aa, Plasmodium falciparum
KKENNQNYSHDTNE

SEQ ID NO: 3227349 - protein, 6 aa, Plasmodium falciparum
KKENNS

SEQ ID NO: 3227350 - protein, 14 aa, Plasmodium falciparum
KKENNSKLKSLTDD

SEQ ID NO: 3227351 - protein, 21 aa, Plasmodium falciparum
KKENNYNIEQENQDNKSEEKN

SEQ ID NO: 3227352 - protein, 7 aa, Plasmodium falciparum
KKENPIE

SEQ ID NO: 3227353 - protein, 12 aa, Plasmodium falciparum
KKENQENDTKSV

SEQ ID NO: 3227354 - protein, 7 aa, Plasmodium falciparum
KKENRRY

SEQ ID NO: 3227355 - protein, 6 aa, Plasmodium falciparum
KKENSN

SEQ ID NO: 3227356 - protein, 28 aa, Plasmodium falciparum
KKENSNREEINDKVSKQGCNLNDSDSSN

SEQ ID NO: 3227357 - protein, 7 aa, Plasmodium falciparum
KKENSYQ

SEQ ID NO: 3227358 - protein, 15 aa, Plasmodium falciparum
KKENTDNKNTNIQDK

SEQ ID NO: 3227359 - protein, 8 aa, Plasmodium falciparum
KKENTKRQ

SEQ ID NO: 3227360 - protein, 8 aa, Plasmodium falciparum
KKENTNDL

SEQ ID NO: 3227361 - protein, 7 aa, Plasmodium falciparum
KKENTNF

SEQ ID NO: 3227362 - protein, 261 aa, Plasmodium falciparum
KKENVEDQKDTEEVREEASEDKGDIEEVGKEEASEDKEDTEEVKEQEVSEDKEDAEEVGKGEVSEDIEDKEEEGEKEVSEDIEDKEEEGEKEESEDKGDKEEEGKKEVSEDKENAEEVREEEASEDKEDAEELGKGEVSEDMEDKEEEGKKEESEDKENAEELGKREVSEDKENAEEVREEEASEDKEDAEELGKGEVSEDIEDKEEEGEKEESEDKGDKEEEGKKEESEDKENAEEVGKEEASEDKEDAEELGKGEVSED

SEQ ID NO: 3227363 - protein, 6 aa, Plasmodium falciparum
KKENYK

SEQ ID NO: 3227364 - protein, 7 aa, Plasmodium falciparum
KKEPDLK

SEQ ID NO: 3227365 - protein, 9 aa, Plasmodium falciparum
KKEPNENKY

SEQ ID NO: 3227366 - protein, 9 aa, Plasmodium falciparum
KKEPYDKDN

SEQ ID NO: 3227367 - protein, 4 aa, Plasmodium falciparum
KKEQ

SEQ ID NO: 3227368 - protein, 5 aa, Plasmodium falciparum
KKEQE

SEQ ID NO: 3227369 - protein, 12 aa, Plasmodium falciparum
KKEQEEKNKKIK

SEQ ID NO: 3227370 - protein, 7 aa, Plasmodium falciparum
KKEQENF

SEQ ID NO: 3227371 - protein, 7 aa, Plasmodium falciparum
KKEQEWD

SEQ ID NO: 3227372 - protein, 13 aa, Plasmodium falciparum
KKEQIEDKKKTHK

SEQ ID NO: 3227373 - protein, 15 aa, Plasmodium falciparum
KKEQKKLIKEIFKES

SEQ ID NO: 3227374 - protein, 14 aa, Plasmodium falciparum
KKEQNDEREKGKVN

SEQ ID NO: 3227375 - protein, 4 aa, Plasmodium falciparum
KKER

SEQ ID NO: 3227376 - protein, 7 aa, Plasmodium falciparum
KKERDDK

SEQ ID NO: 3227377 - protein, 7 aa, Plasmodium falciparum
KKERDIT

SEQ ID NO: 3227378 - protein, 8 aa, Plasmodium falciparum
KKEREIRE

SEQ ID NO: 3227379 - protein, 8 aa, Plasmodium falciparum
KKERKAIK

SEQ ID NO: 3227380 - protein, 10 aa, Plasmodium falciparum
KKERKDNKKI

SEQ ID NO: 3227381 - protein, 7 aa, Plasmodium falciparum
KKERKKN

SEQ ID NO: 3227382 - protein, 12 aa, Plasmodium falciparum
KKERKNEIKKDK

SEQ ID NO: 3227383 - protein, 6 aa, Plasmodium falciparum
KKERKY

SEQ ID NO: 3227384 - protein, 5 aa, Plasmodium falciparum
KKERN

SEQ ID NO: 3227385 - protein, 11 aa, Plasmodium falciparum
KKERNQKETKI

SEQ ID NO: 3227386 - protein, 6 aa, Plasmodium falciparum
KKERNT

SEQ ID NO: 3227387 - protein, 7 aa, Plasmodium falciparum
KKERTEE

SEQ ID NO: 3227388 - protein, 8 aa, Plasmodium falciparum
KKERTRRT

SEQ ID NO: 3227389 - protein, 5 aa, Plasmodium falciparum
KKERY

SEQ ID NO: 3227390 - protein, 4 aa, Plasmodium falciparum
KKES

SEQ ID NO: 3227391 - protein, 7 aa, Plasmodium falciparum
KKESDEK

SEQ ID NO: 3227392 - protein, 8 aa, Plasmodium falciparum
KKESDKNL

SEQ ID NO: 3227393 - protein, 9 aa, Plasmodium falciparum
KKESFKKEK

SEQ ID NO: 3227394 - protein, 6 aa, Plasmodium falciparum
KKESFN

SEQ ID NO: 3227395 - protein, 7 aa, Plasmodium falciparum
KKESKKK

SEQ ID NO: 3227396 - protein, 20 aa, Plasmodium falciparum
KKESLYSSNNLPRDDKNYLT

SEQ ID NO: 3227397 - protein, 37 aa, Plasmodium falciparum
KKESPLNNVEDTKKEESYSKNIENANKEEYESNEETY

SEQ ID NO: 3227398 - protein, 14 aa, Plasmodium falciparum
KKESPSEEEKYYEE

SEQ ID NO: 3227399 - protein, 22 aa, Plasmodium falciparum
KKESPYEENIKKNNKAEKKTRR

SEQ ID NO: 3227400 - protein, 6 aa, Plasmodium falciparum
KKESSK

SEQ ID NO: 3227401 - protein, 8 aa, Plasmodium falciparum
KKESSSVR

SEQ ID NO: 3227402 - protein, 6 aa, Plasmodium falciparum
KKETED

SEQ ID NO: 3227403 - protein, 17 aa, Plasmodium falciparum
KKETEQNNKNKKEEIGK

SEQ ID NO: 3227404 - protein, 24 aa, Plasmodium falciparum
KKETNNDNINNNDDGNNNNNDDDG

SEQ ID NO: 3227405 - protein, 13 aa, Plasmodium falciparum
KKETNTNNIQNNE

SEQ ID NO: 3227406 - protein, 41 aa, Plasmodium falciparum
KKETQNDKRNNSSKRNVKPQIKTKKDNDTRNVTKEYEKNNI

SEQ ID NO: 3227407 - protein, 7 aa, Plasmodium falciparum
KKETYNE

SEQ ID NO: 3227408 - protein, 48 aa, Plasmodium falciparum
KKEVEEKKEQVEEKKEEMEEKKEQVEEKENQEQKENTNLQETKTINES

SEQ ID NO: 3227409 - protein, 8 aa, Plasmodium falciparum
KKEVHTSS

SEQ ID NO: 3227410 - protein, 10 aa, Plasmodium falciparum
KKEVNDDNKN

SEQ ID NO: 3227411 - protein, 8 aa, Plasmodium falciparum
KKEWEENK

SEQ ID NO: 3227412 - protein, 6 aa, Plasmodium falciparum
KKEWEN

SEQ ID NO: 3227413 - protein, 6 aa, Plasmodium falciparum
KKEWGE

SEQ ID NO: 3227414 - protein, 5 aa, Plasmodium falciparum
KKEWK

SEQ ID NO: 3227415 - protein, 5 aa, Plasmodium falciparum
KKEWQ

SEQ ID NO: 3227416 - protein, 4 aa, Plasmodium falciparum
KKEY

SEQ ID NO: 3227417 - protein, 6 aa, Plasmodium falciparum
KKEYDE

SEQ ID NO: 3227418 - protein, 6 aa, Plasmodium falciparum
KKEYES

SEQ ID NO: 3227419 - protein, 8 aa, Plasmodium falciparum
KKEYETSL

SEQ ID NO: 3227420 - protein, 6 aa, Plasmodium falciparum
KKEYKK

SEQ ID NO: 3227421 - protein, 22 aa, Plasmodium falciparum
KKEYKKDEGNEYDKKMNTDDNY

SEQ ID NO: 3227422 - protein, 7 aa, Plasmodium falciparum
KKEYNKK

SEQ ID NO: 3227423 - protein, 7 aa, Plasmodium falciparum
KKEYNSL

SEQ ID NO: 3227424 - protein, 7 aa, Plasmodium falciparum
KKEYYTN

SEQ ID NO: 3227425 - protein, 6 aa, Plasmodium falciparum
KKFANK

SEQ ID NO: 3227426 - protein, 13 aa, Plasmodium falciparum
KKFDKQKKNQNIC

SEQ ID NO: 3227427 - protein, 5 aa, Plasmodium falciparum
KKFEE

SEQ ID NO: 3227428 - protein, 14 aa, Plasmodium falciparum
KKFEEGKNKEFEER

SEQ ID NO: 3227429 - protein, 30 aa, Plasmodium falciparum
KKFEEGKNKEIKEGNKKKVQEQNDKKFNEE

SEQ ID NO: 3227430 - protein, 5 aa, Plasmodium falciparum
KKFEL

SEQ ID NO: 3227431 - protein, 17 aa, Plasmodium falciparum
KKFEPSEKNTRTTDSQD

SEQ ID NO: 3227432 - protein, 8 aa, Plasmodium falciparum
KKFKNTKK

SEQ ID NO: 3227433 - protein, 12 aa, Plasmodium falciparum
KKFKRENKKAHE

SEQ ID NO: 3227434 - protein, 14 aa, Plasmodium falciparum
KKFNKNNKDGSSST

SEQ ID NO: 3227435 - protein, 21 aa, Plasmodium falciparum
KKFNSRDTCEGEKKERTEDSI

SEQ ID NO: 3227436 - protein, 7 aa, Plasmodium falciparum
KKFPPKF

SEQ ID NO: 3227437 - protein, 6 aa, Plasmodium falciparum
KKFSES

SEQ ID NO: 3227438 - protein, 4 aa, Plasmodium falciparum
KKFT

SEQ ID NO: 3227439 - protein, 22 aa, Plasmodium falciparum
KKFTNDKHHEDETNDSNGEQID

SEQ ID NO: 3227440 - protein, 5 aa, Plasmodium falciparum
KKGAE

SEQ ID NO: 3227441 - protein, 6 aa, Plasmodium falciparum
KKGAIE

SEQ ID NO: 3227442 - protein, 6 aa, Plasmodium falciparum
KKGDFS

SEQ ID NO: 3227443 - protein, 13 aa, Plasmodium falciparum
KKGDKKKKKNKNV

SEQ ID NO: 3227444 - protein, 10 aa, Plasmodium falciparum
KKGDNNGELD

SEQ ID NO: 3227445 - protein, 11 aa, Plasmodium falciparum
KKGDNTSLSDM

SEQ ID NO: 3227446 - protein, 9 aa, Plasmodium falciparum
KKGDSKKEI

SEQ ID NO: 3227447 - protein, 6 aa, Plasmodium falciparum
KKGDTL

SEQ ID NO: 3227448 - protein, 9 aa, Plasmodium falciparum
KKGDTSNVD

SEQ ID NO: 3227449 - protein, 8 aa, Plasmodium falciparum
KKGEDNEL

SEQ ID NO: 3227450 - protein, 7 aa, Plasmodium falciparum
KKGEEWK

SEQ ID NO: 3227451 - protein, 8 aa, Plasmodium falciparum
KKGEHVTR

SEQ ID NO: 3227452 - protein, 8 aa, Plasmodium falciparum
KKGEKIKT

SEQ ID NO: 3227453 - protein, 9 aa, Plasmodium falciparum
KKGEKKESY

SEQ ID NO: 3227454 - protein, 11 aa, Plasmodium falciparum
KKGFPKKPSVH

SEQ ID NO: 3227455 - protein, 8 aa, Plasmodium falciparum
KKGGKEDI

SEQ ID NO: 3227456 - protein, 8 aa, Plasmodium falciparum
KKGGKKNY

SEQ ID NO: 3227457 - protein, 6 aa, Plasmodium falciparum
KKGGKR

SEQ ID NO: 3227458 - protein, 17 aa, Plasmodium falciparum
KKGGKWEAKNDDKCKRG

SEQ ID NO: 3227459 - protein, 8 aa, Plasmodium falciparum
KKGGRRKN

SEQ ID NO: 3227460 - protein, 15 aa, Plasmodium falciparum
KKGIQKNKKNKKNEE

SEQ ID NO: 3227461 - protein, 18 aa, Plasmodium falciparum
KKGIRGRNKGKDERDNED

SEQ ID NO: 3227462 - protein, 5 aa, Plasmodium falciparum
KKGIS

SEQ ID NO: 3227463 - protein, 7 aa, Plasmodium falciparum
KKGISTK

SEQ ID NO: 3227464 - protein, 14 aa, Plasmodium falciparum
KKGKDGEGCTQKTQ

SEQ ID NO: 3227465 - protein, 9 aa, Plasmodium falciparum
KKGKDKDND

SEQ ID NO: 3227466 - protein, 24 aa, Plasmodium falciparum
KKGKDTNNKNIQKKKKKEEEKKQI

SEQ ID NO: 3227467 - protein, 6 aa, Plasmodium falciparum
KKGKEF

SEQ ID NO: 3227468 - protein, 7 aa, Plasmodium falciparum
KKGKGEL

SEQ ID NO: 3227469 - protein, 10 aa, Plasmodium falciparum
KKGKGNCKNL

SEQ ID NO: 3227470 - protein, 14 aa, Plasmodium falciparum
KKGKHGKKGKETKV

SEQ ID NO: 3227471 - protein, 7 aa, Plasmodium falciparum
KKGKHNF

SEQ ID NO: 3227472 - protein, 6 aa, Plasmodium falciparum
KKGKIR

SEQ ID NO: 3227473 - protein, 6 aa, Plasmodium falciparum
KKGKKD

SEQ ID NO: 3227474 - protein, 8 aa, Plasmodium falciparum
KKGKKETC

SEQ ID NO: 3227475 - protein, 8 aa, Plasmodium falciparum
KKGKKHGK

SEQ ID NO: 3227476 - protein, 9 aa, Plasmodium falciparum
KKGKKNISH

SEQ ID NO: 3227477 - protein, 15 aa, Plasmodium falciparum
KKGKKNNYKKGHIGS

SEQ ID NO: 3227478 - protein, 10 aa, Plasmodium falciparum
KKGKKTKKKI

SEQ ID NO: 3227479 - protein, 14 aa, Plasmodium falciparum
KKGKKTSYSTSGLY

SEQ ID NO: 3227480 - protein, 18 aa, Plasmodium falciparum
KKGKKYKNKDAKSLSGNI

SEQ ID NO: 3227481 - protein, 5 aa, Plasmodium falciparum
KKGKL

SEQ ID NO: 3227482 - protein, 12 aa, Plasmodium falciparum
KKGKNKKGNTNK

SEQ ID NO: 3227483 - protein, 86 aa, Plasmodium falciparum
KKGKNKNGENKNGENKNGDIKNDDIKNDDIKNDDIRNDDDKNDENEENTKECKNESNNIDNNNSSNDSLSDVDNNKDNGKSKNKKY

SEQ ID NO: 3227484 - protein, 9 aa, Plasmodium falciparum
KKGKNNSFD

SEQ ID NO: 3227485 - protein, 6 aa, Plasmodium falciparum
KKGKNY

SEQ ID NO: 3227486 - protein, 13 aa, Plasmodium falciparum
KKGKYHKNEDCSS

SEQ ID NO: 3227487 - protein, 4 aa, Plasmodium falciparum
KKGL

SEQ ID NO: 3227488 - protein, 7 aa, Plasmodium falciparum
KKGLEEE

SEQ ID NO: 3227489 - protein, 4 aa, Plasmodium falciparum
KKGN

SEQ ID NO: 3227490 - protein, 34 aa, Plasmodium falciparum
KKGNDSTTKDYDNNNNINDDKKNINDDNNNNNIY

SEQ ID NO: 3227491 - protein, 5 aa, Plasmodium falciparum
KKGNE

SEQ ID NO: 3227492 - protein, 8 aa, Plasmodium falciparum
KKGNEDVK

SEQ ID NO: 3227493 - protein, 7 aa, Plasmodium falciparum
KKGNKQV

SEQ ID NO: 3227494 - protein, 38 aa, Plasmodium falciparum
KKGNNINNNNNNDDDDNDNEDDDYYNDDDDDDDDDDDN

SEQ ID NO: 3227495 - protein, 8 aa, Plasmodium falciparum
KKGNNKNV

SEQ ID NO: 3227496 - protein, 14 aa, Plasmodium falciparum
KKGNTEKKQKDEIS

SEQ ID NO: 3227497 - protein, 20 aa, Plasmodium falciparum
KKGNYKKPKDKKKNIQTKKE

SEQ ID NO: 3227498 - protein, 5 aa, Plasmodium falciparum
KKGRE

SEQ ID NO: 3227499 - protein, 10 aa, Plasmodium falciparum
KKGRHTNDNH

SEQ ID NO: 3227500 - protein, 10 aa, Plasmodium falciparum
KKGRQDNFNK

SEQ ID NO: 3227501 - protein, 7 aa, Plasmodium falciparum
KKGSIES

SEQ ID NO: 3227502 - protein, 10 aa, Plasmodium falciparum
KKGSPDNIPA

SEQ ID NO: 3227503 - protein, 10 aa, Plasmodium falciparum
KKGSSKNITE

SEQ ID NO: 3227504 - protein, 8 aa, Plasmodium falciparum
KKGSSNYH

SEQ ID NO: 3227505 - protein, 7 aa, Plasmodium falciparum
KKGSYNI

SEQ ID NO: 3227506 - protein, 6 aa, Plasmodium falciparum
KKGTCK

SEQ ID NO: 3227507 - protein, 14 aa, Plasmodium falciparum
KKGTKGTTKDNVTN

SEQ ID NO: 3227508 - protein, 17 aa, Plasmodium falciparum
KKGTKPVGEHGTEPMST

SEQ ID NO: 3227509 - protein, 8 aa, Plasmodium falciparum
KKGTKSTL

SEQ ID NO: 3227510 - protein, 10 aa, Plasmodium falciparum
KKGTNPLGGH

SEQ ID NO: 3227511 - protein, 11 aa, Plasmodium falciparum
KKGTSNDCNDN

SEQ ID NO: 3227512 - protein, 16 aa, Plasmodium falciparum
KKGTYGPSEKQNVYTD

SEQ ID NO: 3227513 - protein, 18 aa, Plasmodium falciparum
KKGVGSSRNGRDSNPKNL

SEQ ID NO: 3227514 - protein, 5 aa, Plasmodium falciparum
KKGVS

SEQ ID NO: 3227515 - protein, 6 aa, Plasmodium falciparum
KKGYDK

SEQ ID NO: 3227516 - protein, 7 aa, Plasmodium falciparum
KKGYPDF

SEQ ID NO: 3227517 - protein, 7 aa, Plasmodium falciparum
KKGYSTK

SEQ ID NO: 3227518 - protein, 5 aa, Plasmodium falciparum
KKGYY

SEQ ID NO: 3227519 - protein, 29 aa, Plasmodium falciparum
KKHDETTKEISGNRRKKRSLTTKNYKGYD

SEQ ID NO: 3227520 - protein, 99 aa, Plasmodium falciparum
KKHDNKKSGKHNKHNDEDYNDTNSDYSHNKVSSHSSCNSSSSEDEDEDEDEDEEEENEEKYSKKRSRNLSDSSHNSKKSSSSVSSHKSKNSSDNSDDNE

SEQ ID NO: 3227521 - protein, 19 aa, Plasmodium falciparum
KKHDTKKGNQINDSNGCTN

SEQ ID NO: 3227522 - protein, 11 aa, Plasmodium falciparum
KKHEEKGEKPC

SEQ ID NO: 3227523 - protein, 11 aa, Plasmodium falciparum
KKHEKGDDGMT

SEQ ID NO: 3227524 - protein, 6 aa, Plasmodium falciparum
KKHENS

SEQ ID NO: 3227525 - protein, 5 aa, Plasmodium falciparum
KKHEP

SEQ ID NO: 3227526 - protein, 5 aa, Plasmodium falciparum
KKHGY

SEQ ID NO: 3227527 - protein, 39 aa, Plasmodium falciparum
KKHHNEKKQYNEKKQYNEKKQFNEKKKFNEKKHPNEKKH

SEQ ID NO: 3227528 - protein, 33 aa, Plasmodium falciparum
KKHHRRKKKKKKKNYNNSNSDSNSNSNSNSNKY

SEQ ID NO: 3227529 - protein, 11 aa, Plasmodium falciparum
KKHKKENTYTN

SEQ ID NO: 3227530 - protein, 19 aa, Plasmodium falciparum
KKHKKKSLKNKKKSNKKYE

SEQ ID NO: 3227531 - protein, 19 aa, Plasmodium falciparum
KKHKNKEINEYDNKKSDKI

SEQ ID NO: 3227532 - protein, 10 aa, Plasmodium falciparum
KKHKNKNSYV

SEQ ID NO: 3227533 - protein, 6 aa, Plasmodium falciparum
KKHKRK

SEQ ID NO: 3227534 - protein, 16 aa, Plasmodium falciparum
KKHKRKKYKNSKDEKG

SEQ ID NO: 3227535 - protein, 9 aa, Plasmodium falciparum
KKHNINNNE

SEQ ID NO: 3227536 - protein, 5 aa, Plasmodium falciparum
KKHNN

SEQ ID NO: 3227537 - protein, 7 aa, Plasmodium falciparum
KKHNTQH

SEQ ID NO: 3227538 - protein, 10 aa, Plasmodium falciparum
KKHRNDFKKH

SEQ ID NO: 3227539 - protein, 8 aa, Plasmodium falciparum
KKHRNKDM

SEQ ID NO: 3227540 - protein, 6 aa, Plasmodium falciparum
KKHSFE

SEQ ID NO: 3227541 - protein, 8 aa, Plasmodium falciparum
KKHSNNIQ

SEQ ID NO: 3227542 - protein, 33 aa, Plasmodium falciparum
KKHSNNNDDNNNNNNNDEEKKKKLLTSNEYNHK

SEQ ID NO: 3227543 - protein, 60 aa, Plasmodium falciparum
KKHSSNKNLNDDEEKNTYQEEDQDSYDDISDNANDYNNNYNNNYNNNYNNNYNNNYDNNY

SEQ ID NO: 3227544 - protein, 7 aa, Plasmodium falciparum
KKIAQEN

SEQ ID NO: 3227545 - protein, 49 aa, Plasmodium falciparum
KKIASTDNKRKKNISQDKSNHNNNNNNSNNSNNSNNCNNSNNNHSNNNN

SEQ ID NO: 3227546 - protein, 8 aa, Plasmodium falciparum
KKIDEEEK

SEQ ID NO: 3227547 - protein, 7 aa, Plasmodium falciparum
KKIDNVN

SEQ ID NO: 3227548 - protein, 11 aa, Plasmodium falciparum
KKIDPKKNKVD

SEQ ID NO: 3227549 - protein, 4 aa, Plasmodium falciparum
KKIE

SEQ ID NO: 3227550 - protein, 7 aa, Plasmodium falciparum
KKIEDVE

SEQ ID NO: 3227551 - protein, 8 aa, Plasmodium falciparum
KKIEEHEE

SEQ ID NO: 3227552 - protein, 6 aa, Plasmodium falciparum
KKIEGI

SEQ ID NO: 3227553 - protein, 8 aa, Plasmodium falciparum
KKIENGKE

SEQ ID NO: 3227554 - protein, 19 aa, Plasmodium falciparum
KKIENKEYNNEEQKGFKDD

SEQ ID NO: 3227555 - protein, 7 aa, Plasmodium falciparum
KKIENVG

SEQ ID NO: 3227556 - protein, 6 aa, Plasmodium falciparum
KKIETD

SEQ ID NO: 3227557 - protein, 7 aa, Plasmodium falciparum
KKIGNNQ

SEQ ID NO: 3227558 - protein, 11 aa, Plasmodium falciparum
KKIGSNENIGN

SEQ ID NO: 3227559 - protein, 28 aa, Plasmodium falciparum
KKIGSQSRNKRINSKNNNDSNKNKKNDY

SEQ ID NO: 3227560 - protein, 5 aa, Plasmodium falciparum
KKIGT

SEQ ID NO: 3227561 - protein, 6 aa, Plasmodium falciparum
KKIGTS

SEQ ID NO: 3227562 - protein, 101 aa, Plasmodium falciparum
KKIHANENGDTNKNGDTNENGDTNENGDTNKNGDTNKNGDTNENGDTNENGDTNKNGDTNKNGDTNKNGDTNKGCDTNKGCDTNNGCGSSTENYYNNKNSV

SEQ ID NO: 3227563 - protein, 6 aa, Plasmodium falciparum
KKIHED

SEQ ID NO: 3227564 - protein, 39 aa, Plasmodium falciparum
KKIHEKKKKIHDKKEEIDEKKKKIHDKKDESHDKNEDIT

SEQ ID NO: 3227565 - protein, 4 aa, Plasmodium falciparum
KKII

SEQ ID NO: 3227566 - protein, 7 aa, Plasmodium falciparum
KKIINND

SEQ ID NO: 3227567 - protein, 17 aa, Plasmodium falciparum
KKIINNNKRNDNYNNYN

SEQ ID NO: 3227568 - protein, 10 aa, Plasmodium falciparum
KKIKCKNKTQ

SEQ ID NO: 3227569 - protein, 40 aa, Plasmodium falciparum
KKIKEANDKEINEGNNNTIEVGTEKENKDKKEDKLAPQEF

SEQ ID NO: 3227570 - protein, 6 aa, Plasmodium falciparum
KKIKEE

SEQ ID NO: 3227571 - protein, 10 aa, Plasmodium falciparum
KKIKENKENI

SEQ ID NO: 3227572 - protein, 12 aa, Plasmodium falciparum
KKIKGKKNSKRN

SEQ ID NO: 3227573 - protein, 27 aa, Plasmodium falciparum
KKIKITNKHKKKKYYDSNSSISPNEDA

SEQ ID NO: 3227574 - protein, 18 aa, Plasmodium falciparum
KKIKKKKKEKKKKKKNDS

SEQ ID NO: 3227575 - protein, 7 aa, Plasmodium falciparum
KKIKKNK

SEQ ID NO: 3227576 - protein, 11 aa, Plasmodium falciparum
KKIKKNKNVYP

SEQ ID NO: 3227577 - protein, 18 aa, Plasmodium falciparum
KKIKKRKKKLQKKNYENE

SEQ ID NO: 3227578 - protein, 13 aa, Plasmodium falciparum
KKIKNDEKKNYLE

SEQ ID NO: 3227579 - protein, 6 aa, Plasmodium falciparum
KKIKNE

SEQ ID NO: 3227580 - protein, 20 aa, Plasmodium falciparum
KKIKNGSNNLNDRNKNKGTN

SEQ ID NO: 3227581 - protein, 27 aa, Plasmodium falciparum
KKIKNIKNKKNIKNKNNIKNKNNNNNI

SEQ ID NO: 3227582 - protein, 12 aa, Plasmodium falciparum
KKIKNNNNEKLE

SEQ ID NO: 3227583 - protein, 15 aa, Plasmodium falciparum
KKIKNSSHNKNNSRK

SEQ ID NO: 3227584 - protein, 10 aa, Plasmodium falciparum
KKIKRKEKKR

SEQ ID NO: 3227585 - protein, 13 aa, Plasmodium falciparum
KKIKTTDNVNNHY

SEQ ID NO: 3227586 - protein, 4 aa, Plasmodium falciparum
KKIN

SEQ ID NO: 3227587 - protein, 5 aa, Plasmodium falciparum
KKINE

SEQ ID NO: 3227588 - protein, 6 aa, Plasmodium falciparum
KKINEE

SEQ ID NO: 3227589 - protein, 26 aa, Plasmodium falciparum
KKINERKYNEIDKNDSDDSNASYDDE

SEQ ID NO: 3227590 - protein, 14 aa, Plasmodium falciparum
KKINESKEDNNYYQ

SEQ ID NO: 3227591 - protein, 119 aa, Plasmodium falciparum
KKINGDDNKMNGDNKMNGDNKMNGDNKMNGDNKMNGDNKMNGDNKMNGDNKMNGDNKMNGDNKMNGDNKMNGDNKMNGDNKMNGDDNKINGDDNKNCDDNKNCDDNKNCDDNKNCDDNK

SEQ ID NO: 3227592 - protein, 5 aa, Plasmodium falciparum
KKINK

SEQ ID NO: 3227593 - protein, 14 aa, Plasmodium falciparum
KKINKKLKKKKKEL

SEQ ID NO: 3227594 - protein, 6 aa, Plasmodium falciparum
KKINKN

SEQ ID NO: 3227595 - protein, 34 aa, Plasmodium falciparum
KKINKNVKNKVKNKVKKNVKKKVKKNVKKNMKKE

SEQ ID NO: 3227596 - protein, 59 aa, Plasmodium falciparum
KKINKQNKKINKQNKKTKKKNKKRNKKKNKKNNTTKNATKNRTKNTTKNIKNHNNNDKY

SEQ ID NO: 3227597 - protein, 26 aa, Plasmodium falciparum
KKINKSKKKKKKKKKFKYNNKSQSKV

SEQ ID NO: 3227598 - protein, 8 aa, Plasmodium falciparum
KKINNNIN

SEQ ID NO: 3227599 - protein, 60 aa, Plasmodium falciparum
KKINNNNNNNNNNKNNVNKENNKYDEKNKYCEKKKNCEKKKNCEKKKNCEKNINSEKNKS

SEQ ID NO: 3227600 - protein, 14 aa, Plasmodium falciparum
KKINNNNNNNNNNN

SEQ ID NO: 3227601 - protein, 27 aa, Plasmodium falciparum
KKINNNNNNNNNNNNNNNNNNNKNNNI

SEQ ID NO: 3227602 - protein, 7 aa, Plasmodium falciparum
KKINNQG

SEQ ID NO: 3227603 - protein, 7 aa, Plasmodium falciparum
KKINQKS

SEQ ID NO: 3227604 - protein, 8 aa, Plasmodium falciparum
KKINRQRE

SEQ ID NO: 3227605 - protein, 8 aa, Plasmodium falciparum
KKINTNAY

SEQ ID NO: 3227606 - protein, 5 aa, Plasmodium falciparum
KKIPK

SEQ ID NO: 3227607 - protein, 6 aa, Plasmodium falciparum
KKIPKF

SEQ ID NO: 3227608 - protein, 6 aa, Plasmodium falciparum
KKIPSD

SEQ ID NO: 3227609 - protein, 4 aa, Plasmodium falciparum
KKIQ

SEQ ID NO: 3227610 - protein, 6 aa, Plasmodium falciparum
KKIQEE

SEQ ID NO: 3227611 - protein, 13 aa, Plasmodium falciparum
KKIQGQIKNENNY

SEQ ID NO: 3227612 - protein, 5 aa, Plasmodium falciparum
KKIQN

SEQ ID NO: 3227613 - protein, 20 aa, Plasmodium falciparum
KKIRKIKNEQDGDEEEEKEE

SEQ ID NO: 3227614 - protein, 12 aa, Plasmodium falciparum
KKIRKKKRLRIK

SEQ ID NO: 3227615 - protein, 8 aa, Plasmodium falciparum
KKIRKNKQ

SEQ ID NO: 3227616 - protein, 6 aa, Plasmodium falciparum
KKIRPH

SEQ ID NO: 3227617 - protein, 7 aa, Plasmodium falciparum
KKISDTV

SEQ ID NO: 3227618 - protein, 7 aa, Plasmodium falciparum
KKISKDS

SEQ ID NO: 3227619 - protein, 45 aa, Plasmodium falciparum
KKISKKDNHLNKDKKKTKQNKIDKSNQSNMNKKEYNNNDKKKDDI

SEQ ID NO: 3227620 - protein, 5 aa, Plasmodium falciparum
KKISV

SEQ ID NO: 3227621 - protein, 8 aa, Plasmodium falciparum
KKITRQGG

SEQ ID NO: 3227622 - protein, 7 aa, Plasmodium falciparum
KKIYQNT

SEQ ID NO: 3227623 - protein, 10 aa, Plasmodium falciparum
KKKAKKRKGS

SEQ ID NO: 3227624 - protein, 7 aa, Plasmodium falciparum
KKKAKNI

SEQ ID NO: 3227625 - protein, 7 aa, Plasmodium falciparum
KKKAPNN

SEQ ID NO: 3227626 - protein, 31 aa, Plasmodium falciparum
KKKASYDEEAKDNQIKDKSFENEKDSFANKK

SEQ ID NO: 3227627 - protein, 16 aa, Plasmodium falciparum
KKKCNNDNITEEGENM

SEQ ID NO: 3227628 - protein, 8 aa, Plasmodium falciparum
KKKCPPNS

SEQ ID NO: 3227629 - protein, 7 aa, Plasmodium falciparum
KKKCTKN

SEQ ID NO: 3227630 - protein, 7 aa, Plasmodium falciparum
KKKDDEK

SEQ ID NO: 3227631 - protein, 6 aa, Plasmodium falciparum
KKKDDN

SEQ ID NO: 3227632 - protein, 14 aa, Plasmodium falciparum
KKKDDVNNNNNNNN

SEQ ID NO: 3227633 - protein, 24 aa, Plasmodium falciparum
KKKDEEQNCNTQQDEKKEEKSDTL

SEQ ID NO: 3227634 - protein, 6 aa, Plasmodium falciparum
KKKDEP

SEQ ID NO: 3227635 - protein, 10 aa, Plasmodium falciparum
KKKDEREYGN

SEQ ID NO: 3227636 - protein, 8 aa, Plasmodium falciparum
KKKDEWKP

SEQ ID NO: 3227637 - protein, 7 aa, Plasmodium falciparum
KKKDHMG

SEQ ID NO: 3227638 - protein, 7 aa, Plasmodium falciparum
KKKDHVN

SEQ ID NO: 3227639 - protein, 7 aa, Plasmodium falciparum
KKKDIAK

SEQ ID NO: 3227640 - protein, 9 aa, Plasmodium falciparum
KKKDIDNKN

SEQ ID NO: 3227641 - protein, 7 aa, Plasmodium falciparum
KKKDIKT

SEQ ID NO: 3227642 - protein, 15 aa, Plasmodium falciparum
KKKDKDINNNENQNK

SEQ ID NO: 3227643 - protein, 26 aa, Plasmodium falciparum
KKKDKENLDRAKKKETGNVQEEGSAS

SEQ ID NO: 3227644 - protein, 16 aa, Plasmodium falciparum
KKKDKKKSKKKNGNIN

SEQ ID NO: 3227645 - protein, 6 aa, Plasmodium falciparum
KKKDKL

SEQ ID NO: 3227646 - protein, 71 aa, Plasmodium falciparum
KKKDKRKSKLAKKKKLKDKKKKKKKKSKKDKQKKKKKKKKKKKKNKNIKKNKKNKLRKNKKDKYEDDEYDD

SEQ ID NO: 3227647 - protein, 9 aa, Plasmodium falciparum
KKKDLSGED

SEQ ID NO: 3227648 - protein, 7 aa, Plasmodium falciparum
KKKDNIS

SEQ ID NO: 3227649 - protein, 10 aa, Plasmodium falciparum
KKKDNKEKNK

SEQ ID NO: 3227650 - protein, 115 aa, Plasmodium falciparum
KKKDNKKEGEEKNEEDLNSNKNIESNKGSAVTSNVGDTNNDAKARDNNNNDDNDDNDENDDNDDNDDIDEIDERDDNDDNGDDDDDNDDDDDNNDNNNKNNSNNLTDTKKEGEKI

SEQ ID NO: 3227651 - protein, 8 aa, Plasmodium falciparum
KKKDNKRT

SEQ ID NO: 3227652 - protein, 11 aa, Plasmodium falciparum
KKKDNQYKHDN

SEQ ID NO: 3227653 - protein, 11 aa, Plasmodium falciparum
KKKDNTPDDQV

SEQ ID NO: 3227654 - protein, 62 aa, Plasmodium falciparum
KKKDSRRKRGDKKRNEEYKDDSDDNSDDNSDDNSDDNFYDDDGDDDDDGNKNQMPTASNEVS

SEQ ID NO: 3227655 - protein, 17 aa, Plasmodium falciparum
KKKDTYIKESKEKNNNI

SEQ ID NO: 3227656 - protein, 10 aa, Plasmodium falciparum
KKKDVNSIND

SEQ ID NO: 3227657 - protein, 42 aa, Plasmodium falciparum
KKKDVQKNKKENNSDNVKSSTQNKKKKHFSSNSSEDSETFSH

SEQ ID NO: 3227658 - protein, 10 aa, Plasmodium falciparum
KKKDYNGDEN

SEQ ID NO: 3227659 - protein, 14 aa, Plasmodium falciparum
KKKDYSNENSSEEI

SEQ ID NO: 3227660 - protein, 4 aa, Plasmodium falciparum
KKKE

SEQ ID NO: 3227661 - protein, 9 aa, Plasmodium falciparum
KKKEAENSF

SEQ ID NO: 3227662 - protein, 13 aa, Plasmodium falciparum
KKKEAPPPEPPAN

SEQ ID NO: 3227663 - protein, 8 aa, Plasmodium falciparum
KKKECTHN

SEQ ID NO: 3227664 - protein, 8 aa, Plasmodium falciparum
KKKEDLNN

SEQ ID NO: 3227665 - protein, 16 aa, Plasmodium falciparum
KKKEEAETDYKDDAPD

SEQ ID NO: 3227666 - protein, 67 aa, Plasmodium falciparum
KKKEEEKRIKEEEERIKEEEKRIKEEEERIKEEEKRLKEEEERRLKEEEERRLKEEEERRLKEEEKE

SEQ ID NO: 3227667 - protein, 34 aa, Plasmodium falciparum
KKKEEETKKEEGIKKEEDVKKEEDIIKENDGKVG

SEQ ID NO: 3227668 - protein, 9 aa, Plasmodium falciparum
KKKEEIEKY

SEQ ID NO: 3227669 - protein, 9 aa, Plasmodium falciparum
KKKEEKRKY

SEQ ID NO: 3227670 - protein, 7 aa, Plasmodium falciparum
KKKEEWT

SEQ ID NO: 3227671 - protein, 5 aa, Plasmodium falciparum
KKKEF

SEQ ID NO: 3227672 - protein, 5 aa, Plasmodium falciparum
KKKEG

SEQ ID NO: 3227673 - protein, 32 aa, Plasmodium falciparum
KKKEGNYKNYEDLDSDINKKNNYYDDKHKNKR

SEQ ID NO: 3227674 - protein, 13 aa, Plasmodium falciparum
KKKEHSENINKKA

SEQ ID NO: 3227675 - protein, 5 aa, Plasmodium falciparum
KKKEI

SEQ ID NO: 3227676 - protein, 16 aa, Plasmodium falciparum
KKKEKEEELNNDNSRK

SEQ ID NO: 3227677 - protein, 19 aa, Plasmodium falciparum
KKKEKEHENYNSKSSNSSF

SEQ ID NO: 3227678 - protein, 20 aa, Plasmodium falciparum
KKKEKEKNGNEQEEAEEETE

SEQ ID NO: 3227679 - protein, 18 aa, Plasmodium falciparum
KKKEKEPTDTKKGKIRGR

SEQ ID NO: 3227680 - protein, 7 aa, Plasmodium falciparum
KKKEKFD

SEQ ID NO: 3227681 - protein, 7 aa, Plasmodium falciparum
KKKEKGK

SEQ ID NO: 3227682 - protein, 6 aa, Plasmodium falciparum
KKKEKK

SEQ ID NO: 3227683 - protein, 42 aa, Plasmodium falciparum
KKKEKKKILKKKNKNEIDKKEDDHYDQEYNNNNDNNNDDNSL

SEQ ID NO: 3227684 - protein, 18 aa, Plasmodium falciparum
KKKEKKKKKKDANYNKKN

SEQ ID NO: 3227685 - protein, 16 aa, Plasmodium falciparum
KKKEKKKQKKDDHSLG

SEQ ID NO: 3227686 - protein, 50 aa, Plasmodium falciparum
KKKEKKNKDDPNNNTMNNKSNSKHNYSGNNNNNNNNNNNNNNNNSNNNNN

SEQ ID NO: 3227687 - protein, 22 aa, Plasmodium falciparum
KKKEKKNSIDDTHSQKNKYRDA

SEQ ID NO: 3227688 - protein, 11 aa, Plasmodium falciparum
KKKEKNTYKEK

SEQ ID NO: 3227689 - protein, 19 aa, Plasmodium falciparum
KKKEKQKKEEDTNKNDMND

SEQ ID NO: 3227690 - protein, 9 aa, Plasmodium falciparum
KKKEKQKYT

SEQ ID NO: 3227691 - protein, 7 aa, Plasmodium falciparum
KKKEMTD

SEQ ID NO: 3227692 - protein, 12 aa, Plasmodium falciparum
KKKENDKEKLDE

SEQ ID NO: 3227693 - protein, 13 aa, Plasmodium falciparum
KKKENDKKNNITN

SEQ ID NO: 3227694 - protein, 10 aa, Plasmodium falciparum
KKKENEKNDH

SEQ ID NO: 3227695 - protein, 12 aa, Plasmodium falciparum
KKKENISEQKDE

SEQ ID NO: 3227696 - protein, 7 aa, Plasmodium falciparum
KKKENIT

SEQ ID NO: 3227697 - protein, 6 aa, Plasmodium falciparum
KKKENK

SEQ ID NO: 3227698 - protein, 16 aa, Plasmodium falciparum
KKKENKKSYTSSDEHY

SEQ ID NO: 3227699 - protein, 8 aa, Plasmodium falciparum
KKKENKNE

SEQ ID NO: 3227700 - protein, 8 aa, Plasmodium falciparum
KKKENKNY

SEQ ID NO: 3227701 - protein, 9 aa, Plasmodium falciparum
KKKENKQNC

SEQ ID NO: 3227702 - protein, 7 aa, Plasmodium falciparum
KKKENLN

SEQ ID NO: 3227703 - protein, 17 aa, Plasmodium falciparum
KKKENNNNNNNNQNNYI

SEQ ID NO: 3227704 - protein, 37 aa, Plasmodium falciparum
KKKENTNTNTNTSTNTSANTNTSTNTSANTNTSTKES

SEQ ID NO: 3227705 - protein, 7 aa, Plasmodium falciparum
KKKENYY

SEQ ID NO: 3227706 - protein, 17 aa, Plasmodium falciparum
KKKEQNDESITDNEEDN

SEQ ID NO: 3227707 - protein, 13 aa, Plasmodium falciparum
KKKEQQREKDKEK

SEQ ID NO: 3227708 - protein, 8 aa, Plasmodium falciparum
KKKERHKL

SEQ ID NO: 3227709 - protein, 10 aa, Plasmodium falciparum
KKKERTKPKE

SEQ ID NO: 3227710 - protein, 8 aa, Plasmodium falciparum
KKKESHIS

SEQ ID NO: 3227711 - protein, 7 aa, Plasmodium falciparum
KKKESND

SEQ ID NO: 3227712 - protein, 7 aa, Plasmodium falciparum
KKKESYT

SEQ ID NO: 3227713 - protein, 13 aa, Plasmodium falciparum
KKKETEKKISNEL

SEQ ID NO: 3227714 - protein, 6 aa, Plasmodium falciparum
KKKETK

SEQ ID NO: 3227715 - protein, 19 aa, Plasmodium falciparum
KKKETNSLASEYNKYNENY

SEQ ID NO: 3227716 - protein, 7 aa, Plasmodium falciparum
KKKEVEE

SEQ ID NO: 3227717 - protein, 7 aa, Plasmodium falciparum
KKKEVSR

SEQ ID NO: 3227718 - protein, 6 aa, Plasmodium falciparum
KKKEWD

SEQ ID NO: 3227719 - protein, 4 aa, Plasmodium falciparum
KKKF

SEQ ID NO: 3227720 - protein, 5 aa, Plasmodium falciparum
KKKFI

SEQ ID NO: 3227721 - protein, 6 aa, Plasmodium falciparum
KKKFQN

SEQ ID NO: 3227722 - protein, 13 aa, Plasmodium falciparum
KKKGDKTHKGYSG

SEQ ID NO: 3227723 - protein, 6 aa, Plasmodium falciparum
KKKGDL

SEQ ID NO: 3227724 - protein, 9 aa, Plasmodium falciparum
KKKGEEENI

SEQ ID NO: 3227725 - protein, 7 aa, Plasmodium falciparum
KKKGEKH

SEQ ID NO: 3227726 - protein, 11 aa, Plasmodium falciparum
KKKGGKKDDQL

SEQ ID NO: 3227727 - protein, 45 aa, Plasmodium falciparum
KKKGKDKNDSDDNDKNLNDNKENKNKQNDNNCDNNNNNNNNNNNN

SEQ ID NO: 3227728 - protein, 8 aa, Plasmodium falciparum
KKKGKKKS

SEQ ID NO: 3227729 - protein, 11 aa, Plasmodium falciparum
KKKGKKNYKGS

SEQ ID NO: 3227730 - protein, 9 aa, Plasmodium falciparum
KKKGNFKKE

SEQ ID NO: 3227731 - protein, 6 aa, Plasmodium falciparum
KKKGNG

SEQ ID NO: 3227732 - protein, 8 aa, Plasmodium falciparum
KKKGNNNL

SEQ ID NO: 3227733 - protein, 22 aa, Plasmodium falciparum
KKKGSDKTNDKEKDMGEDENNV

SEQ ID NO: 3227734 - protein, 9 aa, Plasmodium falciparum
KKKGSIKRK

SEQ ID NO: 3227735 - protein, 20 aa, Plasmodium falciparum
KKKGSKTAKKSRSKNTPSNY

SEQ ID NO: 3227736 - protein, 8 aa, Plasmodium falciparum
KKKGSVTY

SEQ ID NO: 3227737 - protein, 7 aa, Plasmodium falciparum
KKKGYIE

SEQ ID NO: 3227738 - protein, 33 aa, Plasmodium falciparum
KKKHDENKKTPCDPLPPLPDENDETLEENPVAQ

SEQ ID NO: 3227739 - protein, 8 aa, Plasmodium falciparum
KKKHEGRY

SEQ ID NO: 3227740 - protein, 12 aa, Plasmodium falciparum
KKKHKDENNMNN

SEQ ID NO: 3227741 - protein, 8 aa, Plasmodium falciparum
KKKHKKSY

SEQ ID NO: 3227742 - protein, 8 aa, Plasmodium falciparum
KKKHNKYD

SEQ ID NO: 3227743 - protein, 6 aa, Plasmodium falciparum
KKKHNY

SEQ ID NO: 3227744 - protein, 6 aa, Plasmodium falciparum
KKKHPT

SEQ ID NO: 3227745 - protein, 4 aa, Plasmodium falciparum
KKKI

SEQ ID NO: 3227746 - protein, 21 aa, Plasmodium falciparum
KKKIDEKGKLYGNKNVASQNK

SEQ ID NO: 3227747 - protein, 6 aa, Plasmodium falciparum
KKKIDP

SEQ ID NO: 3227748 - protein, 8 aa, Plasmodium falciparum
KKKIEEQI

SEQ ID NO: 3227749 - protein, 8 aa, Plasmodium falciparum
KKKIEKKK

SEQ ID NO: 3227750 - protein, 5 aa, Plasmodium falciparum
KKKIK

SEQ ID NO: 3227751 - protein, 6 aa, Plasmodium falciparum
KKKIKT

SEQ ID NO: 3227752 - protein, 8 aa, Plasmodium falciparum
KKKIKTQN

SEQ ID NO: 3227753 - protein, 6 aa, Plasmodium falciparum
KKKINK

SEQ ID NO: 3227754 - protein, 10 aa, Plasmodium falciparum
KKKINKKKKK

SEQ ID NO: 3227755 - protein, 7 aa, Plasmodium falciparum
KKKINKN

SEQ ID NO: 3227756 - protein, 20 aa, Plasmodium falciparum
KKKINNDNINNNGNNYRNNY

SEQ ID NO: 3227757 - protein, 8 aa, Plasmodium falciparum
KKKIPNVK

SEQ ID NO: 3227758 - protein, 8 aa, Plasmodium falciparum
KKKIQAPY

SEQ ID NO: 3227759 - protein, 12 aa, Plasmodium falciparum
KKKIQDDKDKQI

SEQ ID NO: 3227760 - protein, 9 aa, Plasmodium falciparum
KKKISSESN

SEQ ID NO: 3227761 - protein, 6 aa, Plasmodium falciparum
KKKITN

SEQ ID NO: 3227762 - protein, 6 aa, Plasmodium falciparum
KKKIYS

SEQ ID NO: 3227763 - protein, 13 aa, Plasmodium falciparum
KKKKAKKKKSSYL

SEQ ID NO: 3227764 - protein, 8 aa, Plasmodium falciparum
KKKKANTL

SEQ ID NO: 3227765 - protein, 8 aa, Plasmodium falciparum
KKKKAYKN

SEQ ID NO: 3227766 - protein, 9 aa, Plasmodium falciparum
KKKKAYQKY

SEQ ID NO: 3227767 - protein, 10 aa, Plasmodium falciparum
KKKKDDEKKN

SEQ ID NO: 3227768 - protein, 18 aa, Plasmodium falciparum
KKKKDDKNSKEENDESDN

SEQ ID NO: 3227769 - protein, 32 aa, Plasmodium falciparum
KKKKDMNKENMKKTDEQKIKEEIKQTQDEEDT

SEQ ID NO: 3227770 - protein, 12 aa, Plasmodium falciparum
KKKKDSHKENYN

SEQ ID NO: 3227771 - protein, 8 aa, Plasmodium falciparum
KKKKEDME

SEQ ID NO: 3227772 - protein, 9 aa, Plasmodium falciparum
KKKKEEEDD

SEQ ID NO: 3227773 - protein, 9 aa, Plasmodium falciparum
KKKKEEKKK

SEQ ID NO: 3227774 - protein, 17 aa, Plasmodium falciparum
KKKKEENRKNNNDVENN

SEQ ID NO: 3227775 - protein, 7 aa, Plasmodium falciparum
KKKKEFN

SEQ ID NO: 3227776 - protein, 14 aa, Plasmodium falciparum
KKKKEGKYNNDDNK

SEQ ID NO: 3227777 - protein, 8 aa, Plasmodium falciparum
KKKKEKCS

SEQ ID NO: 3227778 - protein, 12 aa, Plasmodium falciparum
KKKKEKGKISQN

SEQ ID NO: 3227779 - protein, 27 aa, Plasmodium falciparum
KKKKEKKKKKKKKSDNKNNKNKKYIKG

SEQ ID NO: 3227780 - protein, 10 aa, Plasmodium falciparum
KKKKEKKKLD

SEQ ID NO: 3227781 - protein, 12 aa, Plasmodium falciparum
KKKKEKKKRKTE

SEQ ID NO: 3227782 - protein, 11 aa, Plasmodium falciparum
KKKKEKKNKRK

SEQ ID NO: 3227783 - protein, 10 aa, Plasmodium falciparum
KKKKEKKNRM

SEQ ID NO: 3227784 - protein, 13 aa, Plasmodium falciparum
KKKKEKKRKKKKN

SEQ ID NO: 3227785 - protein, 8 aa, Plasmodium falciparum
KKKKEKNN

SEQ ID NO: 3227786 - protein, 13 aa, Plasmodium falciparum
KKKKEKNVTNHQN

SEQ ID NO: 3227787 - protein, 9 aa, Plasmodium falciparum
KKKKEKQIN

SEQ ID NO: 3227788 - protein, 21 aa, Plasmodium falciparum
KKKKEKRYTDDHNNNNNDHDD

SEQ ID NO: 3227789 - protein, 13 aa, Plasmodium falciparum
KKKKEKSNDKDNT

SEQ ID NO: 3227790 - protein, 15 aa, Plasmodium falciparum
KKKKEKTKNNKVENN

SEQ ID NO: 3227791 - protein, 16 aa, Plasmodium falciparum
KKKKEKVEENLNDIEQ

SEQ ID NO: 3227792 - protein, 17 aa, Plasmodium falciparum
KKKKETKKISKTRSDET

SEQ ID NO: 3227793 - protein, 5 aa, Plasmodium falciparum
KKKKF

SEQ ID NO: 3227794 - protein, 6 aa, Plasmodium falciparum
KKKKFE

SEQ ID NO: 3227795 - protein, 23 aa, Plasmodium falciparum
KKKKFRRTSENFNETNGTSDTYT

SEQ ID NO: 3227796 - protein, 26 aa, Plasmodium falciparum
KKKKGASSINSYDESSPNVSPPSMYS

SEQ ID NO: 3227797 - protein, 14 aa, Plasmodium falciparum
KKKKGKDSSNTNNS

SEQ ID NO: 3227798 - protein, 10 aa, Plasmodium falciparum
KKKKGKETKN

SEQ ID NO: 3227799 - protein, 9 aa, Plasmodium falciparum
KKKKGKLKR

SEQ ID NO: 3227800 - protein, 27 aa, Plasmodium falciparum
KKKKGKSKDREDDEDASSTDEEQEEDE

SEQ ID NO: 3227801 - protein, 9 aa, Plasmodium falciparum
KKKKGTKEN

SEQ ID NO: 3227802 - protein, 10 aa, Plasmodium falciparum
KKKKHPSVRN

SEQ ID NO: 3227803 - protein, 9 aa, Plasmodium falciparum
KKKKIKGSS

SEQ ID NO: 3227804 - protein, 8 aa, Plasmodium falciparum
KKKKIKKI

SEQ ID NO: 3227805 - protein, 17 aa, Plasmodium falciparum
KKKKIKKINNNKRTSKN

SEQ ID NO: 3227806 - protein, 15 aa, Plasmodium falciparum
KKKKIKRKKNNSYTQ

SEQ ID NO: 3227807 - protein, 9 aa, Plasmodium falciparum
KKKKINNNN

SEQ ID NO: 3227808 - protein, 8 aa, Plasmodium falciparum
KKKKIQKG

SEQ ID NO: 3227809 - protein, 9 aa, Plasmodium falciparum
KKKKISNKD

SEQ ID NO: 3227810 - protein, 8 aa, Plasmodium falciparum
KKKKKDKI

SEQ ID NO: 3227811 - protein, 19 aa, Plasmodium falciparum
KKKKKDKTNQINDELNSSN

SEQ ID NO: 3227812 - protein, 7 aa, Plasmodium falciparum
KKKKKDN

SEQ ID NO: 3227813 - protein, 11 aa, Plasmodium falciparum
KKKKKDSYQSI

SEQ ID NO: 3227814 - protein, 15 aa, Plasmodium falciparum
KKKKKDTSKEESNDI

SEQ ID NO: 3227815 - protein, 17 aa, Plasmodium falciparum
KKKKKDVYNTNNKRQYK

SEQ ID NO: 3227816 - protein, 9 aa, Plasmodium falciparum
KKKKKEEED

SEQ ID NO: 3227817 - protein, 12 aa, Plasmodium falciparum
KKKKKEKETYSD

SEQ ID NO: 3227818 - protein, 22 aa, Plasmodium falciparum
KKKKKEKKIGLNNSTNERNNLK

SEQ ID NO: 3227819 - protein, 26 aa, Plasmodium falciparum
KKKKKEKKKKKNEKNGNCNDNSNELV

SEQ ID NO: 3227820 - protein, 16 aa, Plasmodium falciparum
KKKKKEKKNVSTTYKQ

SEQ ID NO: 3227821 - protein, 12 aa, Plasmodium falciparum
KKKKKEREKENH

SEQ ID NO: 3227822 - protein, 7 aa, Plasmodium falciparum
KKKKKES

SEQ ID NO: 3227823 - protein, 9 aa, Plasmodium falciparum
KKKKKGKIN

SEQ ID NO: 3227824 - protein, 9 aa, Plasmodium falciparum
KKKKKGSLI

SEQ ID NO: 3227825 - protein, 16 aa, Plasmodium falciparum
KKKKKIDKGQGEEKIE

SEQ ID NO: 3227826 - protein, 22 aa, Plasmodium falciparum
KKKKKIDNEKPNELANDKDTQN

SEQ ID NO: 3227827 - protein, 7 aa, Plasmodium falciparum
KKKKKIH

SEQ ID NO: 3227828 - protein, 58 aa, Plasmodium falciparum
KKKKKIKKKNKTKKEKMTKEKMTNDKMTNDKMTNDKMTNDKMTNDKMTNDKITKEKKI

SEQ ID NO: 3227829 - protein, 8 aa, Plasmodium falciparum
KKKKKKCT

SEQ ID NO: 3227830 - protein, 18 aa, Plasmodium falciparum
KKKKKKESYQKDYSHNNN

SEQ ID NO: 3227831 - protein, 9 aa, Plasmodium falciparum
KKKKKKGYK

SEQ ID NO: 3227832 - protein, 9 aa, Plasmodium falciparum
KKKKKKGYM

SEQ ID NO: 3227833 - protein, 7 aa, Plasmodium falciparum
KKKKKKH

SEQ ID NO: 3227834 - protein, 21 aa, Plasmodium falciparum
KKKKKKHVKEEEVNVSDDESM

SEQ ID NO: 3227835 - protein, 14 aa, Plasmodium falciparum
KKKKKKHYKKDTRR

SEQ ID NO: 3227836 - protein, 10 aa, Plasmodium falciparum
KKKKKKIEKK

SEQ ID NO: 3227837 - protein, 12 aa, Plasmodium falciparum
KKKKKKIKNKSK

SEQ ID NO: 3227838 - protein, 20 aa, Plasmodium falciparum
KKKKKKIKSEEKCKTNSSKC

SEQ ID NO: 3227839 - protein, 15 aa, Plasmodium falciparum
KKKKKKINNSNDNKK

SEQ ID NO: 3227840 - protein, 13 aa, Plasmodium falciparum
KKKKKKKCKYDKE

SEQ ID NO: 3227841 - protein, 8 aa, Plasmodium falciparum
KKKKKKKE

SEQ ID NO: 3227842 - protein, 35 aa, Plasmodium falciparum
KKKKKKKERNEVEEDDNSYDDNNENNNKLKNNDNN

SEQ ID NO: 3227843 - protein, 10 aa, Plasmodium falciparum
KKKKKKKIDK

SEQ ID NO: 3227844 - protein, 8 aa, Plasmodium falciparum
KKKKKKKK

SEQ ID NO: 3227845 - protein, 18 aa, Plasmodium falciparum
KKKKKKKKKKFSKNINTN

SEQ ID NO: 3227846 - protein, 36 aa, Plasmodium falciparum
KKKKKKKKKKGINNKRNEMEQNKDDNNYEKEEDEGS

SEQ ID NO: 3227847 - protein, 11 aa, Plasmodium falciparum
KKKKKKKKKKI

SEQ ID NO: 3227848 - protein, 12 aa, Plasmodium falciparum
KKKKKKKKKKKK

SEQ ID NO: 3227849 - protein, 63 aa, Plasmodium falciparum
KKKKKKKKKKKKFNNKNNHNNNNNNNNNNNNNNNNNNNNNNNNNNNNNNNNNNNNNNSNNNNY

SEQ ID NO: 3227850 - protein, 15 aa, Plasmodium falciparum
KKKKKKKKKKKKQET

SEQ ID NO: 3227851 - protein, 12 aa, Plasmodium falciparum
KKKKKKKKKKNI

SEQ ID NO: 3227852 - protein, 10 aa, Plasmodium falciparum
KKKKKKKKKL

SEQ ID NO: 3227853 - protein, 18 aa, Plasmodium falciparum
KKKKKKKKKRKKKENEIQ

SEQ ID NO: 3227854 - protein, 12 aa, Plasmodium falciparum
KKKKKKKKKRVP

SEQ ID NO: 3227855 - protein, 11 aa, Plasmodium falciparum
KKKKKKKKKSE

SEQ ID NO: 3227856 - protein, 44 aa, Plasmodium falciparum
KKKKKKKKKTNNNNDNDNNNYDNNYNNNNNYDNNYNNISQSSNK

SEQ ID NO: 3227857 - protein, 25 aa, Plasmodium falciparum
KKKKKKKKLKSKLSYEQKDKKENNI

SEQ ID NO: 3227858 - protein, 19 aa, Plasmodium falciparum
KKKKKKKKNDVIKNKPNIK

SEQ ID NO: 3227859 - protein, 10 aa, Plasmodium falciparum
KKKKKKKKNV

SEQ ID NO: 3227860 - protein, 9 aa, Plasmodium falciparum
KKKKKKKKR

SEQ ID NO: 3227861 - protein, 9 aa, Plasmodium falciparum
KKKKKKKKV

SEQ ID NO: 3227862 - protein, 25 aa, Plasmodium falciparum
KKKKKKKMKNNMEHEKKEKNKKFSN

SEQ ID NO: 3227863 - protein, 9 aa, Plasmodium falciparum
KKKKKKKNI

SEQ ID NO: 3227864 - protein, 11 aa, Plasmodium falciparum
KKKKKKKNKFE

SEQ ID NO: 3227865 - protein, 15 aa, Plasmodium falciparum
KKKKKKKNSYHPKSR

SEQ ID NO: 3227866 - protein, 12 aa, Plasmodium falciparum
KKKKKKKRKKKK

SEQ ID NO: 3227867 - protein, 13 aa, Plasmodium falciparum
KKKKKKKRKSNKY

SEQ ID NO: 3227868 - protein, 12 aa, Plasmodium falciparum
KKKKKKKSGDIK

SEQ ID NO: 3227869 - protein, 9 aa, Plasmodium falciparum
KKKKKKKVH

SEQ ID NO: 3227870 - protein, 10 aa, Plasmodium falciparum
KKKKKKKYCS

SEQ ID NO: 3227871 - protein, 17 aa, Plasmodium falciparum
KKKKKKKYDNGKKNDDM

SEQ ID NO: 3227872 - protein, 9 aa, Plasmodium falciparum
KKKKKKLKY

SEQ ID NO: 3227873 - protein, 12 aa, Plasmodium falciparum
KKKKKKLSSNNN

SEQ ID NO: 3227874 - protein, 9 aa, Plasmodium falciparum
KKKKKKNAL

SEQ ID NO: 3227875 - protein, 13 aa, Plasmodium falciparum
KKKKKKNASNDPL

SEQ ID NO: 3227876 - protein, 8 aa, Plasmodium falciparum
KKKKKKND

SEQ ID NO: 3227877 - protein, 13 aa, Plasmodium falciparum
KKKKKKNDRSYSL

SEQ ID NO: 3227878 - protein, 10 aa, Plasmodium falciparum
KKKKKKNFCK

SEQ ID NO: 3227879 - protein, 10 aa, Plasmodium falciparum
KKKKKKNGIL

SEQ ID NO: 3227880 - protein, 9 aa, Plasmodium falciparum
KKKKKKNIH

SEQ ID NO: 3227881 - protein, 60 aa, Plasmodium falciparum
KKKKKKNKDKKKKKKKRKNEKEDLNDEMGNNENDDMGNDNYDEMGNDNYDEMGNDNYDQM

SEQ ID NO: 3227882 - protein, 51 aa, Plasmodium falciparum
KKKKKKNKGTKKNKETKKNKETKKNKETKQKKNKATKQKKNKETKQTQSKY

SEQ ID NO: 3227883 - protein, 18 aa, Plasmodium falciparum
KKKKKKNKKKKKKKNKNI

SEQ ID NO: 3227884 - protein, 8 aa, Plasmodium falciparum
KKKKKKNL

SEQ ID NO: 3227885 - protein, 9 aa, Plasmodium falciparum
KKKKKKNLS

SEQ ID NO: 3227886 - protein, 46 aa, Plasmodium falciparum
KKKKKKNNNNNNNNNNNNNNNNNNNNNLNNNNNNNNVNTSDDDGDF

SEQ ID NO: 3227887 - protein, 12 aa, Plasmodium falciparum
KKKKKKNSDQFS

SEQ ID NO: 3227888 - protein, 9 aa, Plasmodium falciparum
KKKKKKNVH

SEQ ID NO: 3227889 - protein, 7 aa, Plasmodium falciparum
KKKKKKS

SEQ ID NO: 3227890 - protein, 26 aa, Plasmodium falciparum
KKKKKKSINKGKRKGNKLYNNNNDIN

SEQ ID NO: 3227891 - protein, 10 aa, Plasmodium falciparum
KKKKKKSSIK

SEQ ID NO: 3227892 - protein, 17 aa, Plasmodium falciparum
KKKKKKTETERERDQLE

SEQ ID NO: 3227893 - protein, 11 aa, Plasmodium falciparum
KKKKKKYITDG

SEQ ID NO: 3227894 - protein, 9 aa, Plasmodium falciparum
KKKKKKYNA

SEQ ID NO: 3227895 - protein, 12 aa, Plasmodium falciparum
KKKKKMYKRKPY

SEQ ID NO: 3227896 - protein, 8 aa, Plasmodium falciparum
KKKKKNEI

SEQ ID NO: 3227897 - protein, 20 aa, Plasmodium falciparum
KKKKKNFHTYDSSDDDRQKK

SEQ ID NO: 3227898 - protein, 11 aa, Plasmodium falciparum
KKKKKNIKKKK

SEQ ID NO: 3227899 - protein, 15 aa, Plasmodium falciparum
KKKKKNIYKSESKTN

SEQ ID NO: 3227900 - protein, 11 aa, Plasmodium falciparum
KKKKKNKKECN

SEQ ID NO: 3227901 - protein, 8 aa, Plasmodium falciparum
KKKKKNPN

SEQ ID NO: 3227902 - protein, 14 aa, Plasmodium falciparum
KKKKKNQDTSKTYP

SEQ ID NO: 3227903 - protein, 9 aa, Plasmodium falciparum
KKKKKNQKK

SEQ ID NO: 3227904 - protein, 11 aa, Plasmodium falciparum
KKKKKNSDTIN

SEQ ID NO: 3227905 - protein, 10 aa, Plasmodium falciparum
KKKKKNSIKR

SEQ ID NO: 3227906 - protein, 24 aa, Plasmodium falciparum
KKKKKNTNGNNNNSNNNKCSRRKR

SEQ ID NO: 3227907 - protein, 7 aa, Plasmodium falciparum
KKKKKNY

SEQ ID NO: 3227908 - protein, 11 aa, Plasmodium falciparum
KKKKKNYDNAN

SEQ ID NO: 3227909 - protein, 20 aa, Plasmodium falciparum
KKKKKQENENNKNNKNYSNH

SEQ ID NO: 3227910 - protein, 17 aa, Plasmodium falciparum
KKKKKQNGKETEREKLE

SEQ ID NO: 3227911 - protein, 10 aa, Plasmodium falciparum
KKKKKQNNIS

SEQ ID NO: 3227912 - protein, 8 aa, Plasmodium falciparum
KKKKKREK

SEQ ID NO: 3227913 - protein, 20 aa, Plasmodium falciparum
KKKKKRKKEKYRMDNKRKVD

SEQ ID NO: 3227914 - protein, 10 aa, Plasmodium falciparum
KKKKKRKREK

SEQ ID NO: 3227915 - protein, 9 aa, Plasmodium falciparum
KKKKKRPYI

SEQ ID NO: 3227916 - protein, 11 aa, Plasmodium falciparum
KKKKKRTDDDI

SEQ ID NO: 3227917 - protein, 10 aa, Plasmodium falciparum
KKKKKSETLV

SEQ ID NO: 3227918 - protein, 9 aa, Plasmodium falciparum
KKKKKSGII

SEQ ID NO: 3227919 - protein, 11 aa, Plasmodium falciparum
KKKKKSNINND

SEQ ID NO: 3227920 - protein, 8 aa, Plasmodium falciparum
KKKKKSYD

SEQ ID NO: 3227921 - protein, 46 aa, Plasmodium falciparum
KKKKKTKKKNNKINHTDRKHNNGSNYSTHSTHNNNNNNDMDNCGSS

SEQ ID NO: 3227922 - protein, 8 aa, Plasmodium falciparum
KKKKKTLH

SEQ ID NO: 3227923 - protein, 6 aa, Plasmodium falciparum
KKKKKV

SEQ ID NO: 3227924 - protein, 7 aa, Plasmodium falciparum
KKKKKVD

SEQ ID NO: 3227925 - protein, 6 aa, Plasmodium falciparum
KKKKLS

SEQ ID NO: 3227926 - protein, 29 aa, Plasmodium falciparum
KKKKLTTLKSSGVNKRNCSSIKNNKKNIT

SEQ ID NO: 3227927 - protein, 5 aa, Plasmodium falciparum
KKKKM

SEQ ID NO: 3227928 - protein, 6 aa, Plasmodium falciparum
KKKKMR

SEQ ID NO: 3227929 - protein, 10 aa, Plasmodium falciparum
KKKKMSVSSY

SEQ ID NO: 3227930 - protein, 5 aa, Plasmodium falciparum
KKKKN

SEQ ID NO: 3227931 - protein, 7 aa, Plasmodium falciparum
KKKKNAF

SEQ ID NO: 3227932 - protein, 13 aa, Plasmodium falciparum
KKKKNAKSVNGKT

SEQ ID NO: 3227933 - protein, 16 aa, Plasmodium falciparum
KKKKNCNTRHRGNTQI

SEQ ID NO: 3227934 - protein, 19 aa, Plasmodium falciparum
KKKKNDKTIERNESAENKI

SEQ ID NO: 3227935 - protein, 11 aa, Plasmodium falciparum
KKKKNDSSSIF

SEQ ID NO: 3227936 - protein, 8 aa, Plasmodium falciparum
KKKKNEIQ

SEQ ID NO: 3227937 - protein, 14 aa, Plasmodium falciparum
KKKKNIKENRTTFD

SEQ ID NO: 3227938 - protein, 16 aa, Plasmodium falciparum
KKKKNKDDTYNNNDNM

SEQ ID NO: 3227939 - protein, 14 aa, Plasmodium falciparum
KKKKNKDEVASNEE

SEQ ID NO: 3227940 - protein, 18 aa, Plasmodium falciparum
KKKKNKKKDEYKSGERKC

SEQ ID NO: 3227941 - protein, 37 aa, Plasmodium falciparum
KKKKNKKKKQNQQIGNDNKENINGAQLTNNNNDGMEK

SEQ ID NO: 3227942 - protein, 13 aa, Plasmodium falciparum
KKKKNKKRKYSKV

SEQ ID NO: 3227943 - protein, 14 aa, Plasmodium falciparum
KKKKNKNKIETERN

SEQ ID NO: 3227944 - protein, 7 aa, Plasmodium falciparum
KKKKNKY

SEQ ID NO: 3227945 - protein, 10 aa, Plasmodium falciparum
KKKKNKYKEK

SEQ ID NO: 3227946 - protein, 10 aa, Plasmodium falciparum
KKKKNLDPQI

SEQ ID NO: 3227947 - protein, 14 aa, Plasmodium falciparum
KKKKNNDEVASNEE

SEQ ID NO: 3227948 - protein, 16 aa, Plasmodium falciparum
KKKKNNKKKKTHDFNT

SEQ ID NO: 3227949 - protein, 22 aa, Plasmodium falciparum
KKKKNNNDNNNNNNNSSNQTNF

SEQ ID NO: 3227950 - protein, 9 aa, Plasmodium falciparum
KKKKNNNIK

SEQ ID NO: 3227951 - protein, 17 aa, Plasmodium falciparum
KKKKNNNKKKNNNIYKN

SEQ ID NO: 3227952 - protein, 14 aa, Plasmodium falciparum
KKKKNNYDNNNNNI

SEQ ID NO: 3227953 - protein, 9 aa, Plasmodium falciparum
KKKKNQEQH

SEQ ID NO: 3227954 - protein, 8 aa, Plasmodium falciparum
KKKKNQSF

SEQ ID NO: 3227955 - protein, 6 aa, Plasmodium falciparum
KKKKNR

SEQ ID NO: 3227956 - protein, 8 aa, Plasmodium falciparum
KKKKNSFK

SEQ ID NO: 3227957 - protein, 7 aa, Plasmodium falciparum
KKKKNSV

SEQ ID NO: 3227958 - protein, 11 aa, Plasmodium falciparum
KKKKNTGNRNN

SEQ ID NO: 3227959 - protein, 7 aa, Plasmodium falciparum
KKKKNYT

SEQ ID NO: 3227960 - protein, 8 aa, Plasmodium falciparum
KKKKPDDK

SEQ ID NO: 3227961 - protein, 8 aa, Plasmodium falciparum
KKKKPTTV

SEQ ID NO: 3227962 - protein, 7 aa, Plasmodium falciparum
KKKKQKK

SEQ ID NO: 3227963 - protein, 8 aa, Plasmodium falciparum
KKKKQKKN

SEQ ID NO: 3227964 - protein, 12 aa, Plasmodium falciparum
KKKKQKNSMSEK

SEQ ID NO: 3227965 - protein, 19 aa, Plasmodium falciparum
KKKKQNKNNHKNKNKNKYN

SEQ ID NO: 3227966 - protein, 32 aa, Plasmodium falciparum
KKKKQQQQEEKEQEKEQQQQEEKEQQQEESNY

SEQ ID NO: 3227967 - protein, 5 aa, Plasmodium falciparum
KKKKR

SEQ ID NO: 3227968 - protein, 8 aa, Plasmodium falciparum
KKKKREKT

SEQ ID NO: 3227969 - protein, 8 aa, Plasmodium falciparum
KKKKREVG

SEQ ID NO: 3227970 - protein, 13 aa, Plasmodium falciparum
KKKKRKEEGGGTN

SEQ ID NO: 3227971 - protein, 13 aa, Plasmodium falciparum
KKKKRKEKKIKDK

SEQ ID NO: 3227972 - protein, 9 aa, Plasmodium falciparum
KKKKRKEYY

SEQ ID NO: 3227973 - protein, 7 aa, Plasmodium falciparum
KKKKRKH

SEQ ID NO: 3227974 - protein, 8 aa, Plasmodium falciparum
KKKKRKIS

SEQ ID NO: 3227975 - protein, 12 aa, Plasmodium falciparum
KKKKRKKSNKKN

SEQ ID NO: 3227976 - protein, 7 aa, Plasmodium falciparum
KKKKRPT

SEQ ID NO: 3227977 - protein, 8 aa, Plasmodium falciparum
KKKKRSRK

SEQ ID NO: 3227978 - protein, 16 aa, Plasmodium falciparum
KKKKRTSIEKNNKHND

SEQ ID NO: 3227979 - protein, 7 aa, Plasmodium falciparum
KKKKRYT

SEQ ID NO: 3227980 - protein, 7 aa, Plasmodium falciparum
KKKKSID

SEQ ID NO: 3227981 - protein, 12 aa, Plasmodium falciparum
KKKKSKEYKTSF

SEQ ID NO: 3227982 - protein, 9 aa, Plasmodium falciparum
KKKKSKKNS

SEQ ID NO: 3227983 - protein, 34 aa, Plasmodium falciparum
KKKKSLKKTVNKNNENDVQDEINNNNSNNNLPEN

SEQ ID NO: 3227984 - protein, 8 aa, Plasmodium falciparum
KKKKSNDM

SEQ ID NO: 3227985 - protein, 12 aa, Plasmodium falciparum
KKKKSNNLESKE

SEQ ID NO: 3227986 - protein, 9 aa, Plasmodium falciparum
KKKKSNYYK

SEQ ID NO: 3227987 - protein, 8 aa, Plasmodium falciparum
KKKKSSNF

SEQ ID NO: 3227988 - protein, 6 aa, Plasmodium falciparum
KKKKSY

SEQ ID NO: 3227989 - protein, 9 aa, Plasmodium falciparum
KKKKTDMLK

SEQ ID NO: 3227990 - protein, 32 aa, Plasmodium falciparum
KKKKTEENKLDDNKINNTEEKTVNEEKKDIHN

SEQ ID NO: 3227991 - protein, 25 aa, Plasmodium falciparum
KKKKTFNRKKKKTKKTKKKRTKHIK

SEQ ID NO: 3227992 - protein, 10 aa, Plasmodium falciparum
KKKKTIKNNK

SEQ ID NO: 3227993 - protein, 8 aa, Plasmodium falciparum
KKKKTKDR

SEQ ID NO: 3227994 - protein, 16 aa, Plasmodium falciparum
KKKKTKRKRKRKRKRK

SEQ ID NO: 3227995 - protein, 12 aa, Plasmodium falciparum
KKKKTKSKEYPQ

SEQ ID NO: 3227996 - protein, 13 aa, Plasmodium falciparum
KKKKTNKKSYNKM

SEQ ID NO: 3227997 - protein, 10 aa, Plasmodium falciparum
KKKKTNNINY

SEQ ID NO: 3227998 - protein, 12 aa, Plasmodium falciparum
KKKKTTKKDKNV

SEQ ID NO: 3227999 - protein, 8 aa, Plasmodium falciparum
KKKKVEEK

SEQ ID NO: 3228000 - protein, 34 aa, Plasmodium falciparum
KKKKVRNVNNKNSNENKKKGIQENQDEQNYTEQY

SEQ ID NO: 3228001 - protein, 6 aa, Plasmodium falciparum
KKKKVT

SEQ ID NO: 3228002 - protein, 10 aa, Plasmodium falciparum
KKKKYKSKKI

SEQ ID NO: 3228003 - protein, 6 aa, Plasmodium falciparum
KKKKYQ

SEQ ID NO: 3228004 - protein, 9 aa, Plasmodium falciparum
KKKKYQNGY

SEQ ID NO: 3228005 - protein, 33 aa, Plasmodium falciparum
KKKKYSDEDIRDEDYIDEKKKSYNDNNNNNNLK

SEQ ID NO: 3228006 - protein, 7 aa, Plasmodium falciparum
KKKKYSQ

SEQ ID NO: 3228007 - protein, 4 aa, Plasmodium falciparum
KKKL

SEQ ID NO: 3228008 - protein, 6 aa, Plasmodium falciparum
KKKLED

SEQ ID NO: 3228009 - protein, 7 aa, Plasmodium falciparum
KKKLKDV

SEQ ID NO: 3228010 - protein, 23 aa, Plasmodium falciparum
KKKLKKEMNNKLEQQTNQNNNTI

SEQ ID NO: 3228011 - protein, 12 aa, Plasmodium falciparum
KKKLKTNKINKK

SEQ ID NO: 3228012 - protein, 22 aa, Plasmodium falciparum
KKKLNEDQTNDNNNNNNNNNIQ

SEQ ID NO: 3228013 - protein, 8 aa, Plasmodium falciparum
KKKLNENE

SEQ ID NO: 3228014 - protein, 8 aa, Plasmodium falciparum
KKKLPNVK

SEQ ID NO: 3228015 - protein, 8 aa, Plasmodium falciparum
KKKLQNQK

SEQ ID NO: 3228016 - protein, 9 aa, Plasmodium falciparum
KKKLTNKEH

SEQ ID NO: 3228017 - protein, 5 aa, Plasmodium falciparum
KKKMD

SEQ ID NO: 3228018 - protein, 44 aa, Plasmodium falciparum
KKKMHKPRDNLRTKSCQESNTSIGAHGSDSSLSNYSNEKTLNDD

SEQ ID NO: 3228019 - protein, 5 aa, Plasmodium falciparum
KKKMK

SEQ ID NO: 3228020 - protein, 15 aa, Plasmodium falciparum
KKKMKKKLQYIKLLN

SEQ ID NO: 3228021 - protein, 15 aa, Plasmodium falciparum
KKKMKKKVQYMKLLK

SEQ ID NO: 3228022 - protein, 11 aa, Plasmodium falciparum
KKKMKYRRRRG

SEQ ID NO: 3228023 - protein, 20 aa, Plasmodium falciparum
KKKMNEKKNMKDKKDGNFSG

SEQ ID NO: 3228024 - protein, 9 aa, Plasmodium falciparum
KKKMNKKAH

SEQ ID NO: 3228025 - protein, 5 aa, Plasmodium falciparum
KKKMQ

SEQ ID NO: 3228026 - protein, 4 aa, Plasmodium falciparum
KKKN

SEQ ID NO: 3228027 - protein, 5 aa, Plasmodium falciparum
KKKNA

SEQ ID NO: 3228028 - protein, 10 aa, Plasmodium falciparum
KKKNDNIKEI

SEQ ID NO: 3228029 - protein, 7 aa, Plasmodium falciparum
KKKNDNM

SEQ ID NO: 3228030 - protein, 15 aa, Plasmodium falciparum
KKKNDNNNDINNDIN

SEQ ID NO: 3228031 - protein, 7 aa, Plasmodium falciparum
KKKNDST

SEQ ID NO: 3228032 - protein, 7 aa, Plasmodium falciparum
KKKNDTI

SEQ ID NO: 3228033 - protein, 6 aa, Plasmodium falciparum
KKKNDV

SEQ ID NO: 3228034 - protein, 10 aa, Plasmodium falciparum
KKKNEEFNNS

SEQ ID NO: 3228035 - protein, 8 aa, Plasmodium falciparum
KKKNEIND

SEQ ID NO: 3228036 - protein, 16 aa, Plasmodium falciparum
KKKNEKNEKNEKKKKK

SEQ ID NO: 3228037 - protein, 7 aa, Plasmodium falciparum
KKKNELD

SEQ ID NO: 3228038 - protein, 20 aa, Plasmodium falciparum
KKKNENQQNQKNQKNHQNQQ

SEQ ID NO: 3228039 - protein, 8 aa, Plasmodium falciparum
KKKNERTN

SEQ ID NO: 3228040 - protein, 7 aa, Plasmodium falciparum
KKKNEWE

SEQ ID NO: 3228041 - protein, 5 aa, Plasmodium falciparum
KKKNF

SEQ ID NO: 3228042 - protein, 16 aa, Plasmodium falciparum
KKKNFSSTSRRKRNNN

SEQ ID NO: 3228043 - protein, 9 aa, Plasmodium falciparum
KKKNGKPQQ

SEQ ID NO: 3228044 - protein, 9 aa, Plasmodium falciparum
KKKNGLKDG

SEQ ID NO: 3228045 - protein, 34 aa, Plasmodium falciparum
KKKNGNNNHNNNDHNDHNDHNDHNKKKYDNNYDN

SEQ ID NO: 3228046 - protein, 15 aa, Plasmodium falciparum
KKKNGSANGNEINEK

SEQ ID NO: 3228047 - protein, 10 aa, Plasmodium falciparum
KKKNGSTSQV

SEQ ID NO: 3228048 - protein, 8 aa, Plasmodium falciparum
KKKNGYNN

SEQ ID NO: 3228049 - protein, 7 aa, Plasmodium falciparum
KKKNIKR

SEQ ID NO: 3228050 - protein, 10 aa, Plasmodium falciparum
KKKNIYNTTR

SEQ ID NO: 3228051 - protein, 9 aa, Plasmodium falciparum
KKKNKEDSY

SEQ ID NO: 3228052 - protein, 39 aa, Plasmodium falciparum
KKKNKKKKNNKKKKKSQINNGSKKYVDTQKMDNNKNNIY

SEQ ID NO: 3228053 - protein, 15 aa, Plasmodium falciparum
KKKNKKKLQYIKLLK

SEQ ID NO: 3228054 - protein, 8 aa, Plasmodium falciparum
KKKNKKSK

SEQ ID NO: 3228055 - protein, 9 aa, Plasmodium falciparum
KKKNKKSNI

SEQ ID NO: 3228056 - protein, 11 aa, Plasmodium falciparum
KKKNKKYKSTK

SEQ ID NO: 3228057 - protein, 25 aa, Plasmodium falciparum
KKKNKNKEKNKITKEKEKKKNETLT

SEQ ID NO: 3228058 - protein, 19 aa, Plasmodium falciparum
KKKNKNNKQKDKNKHNNIN

SEQ ID NO: 3228059 - protein, 8 aa, Plasmodium falciparum
KKKNKQNN

SEQ ID NO: 3228060 - protein, 10 aa, Plasmodium falciparum
KKKNKRKKKK

SEQ ID NO: 3228061 - protein, 12 aa, Plasmodium falciparum
KKKNKRSNQQNL

SEQ ID NO: 3228062 - protein, 7 aa, Plasmodium falciparum
KKKNKSI

SEQ ID NO: 3228063 - protein, 10 aa, Plasmodium falciparum
KKKNKTPGGM

SEQ ID NO: 3228064 - protein, 11 aa, Plasmodium falciparum
KKKNKTTKKQI

SEQ ID NO: 3228065 - protein, 12 aa, Plasmodium falciparum
KKKNLEKSSYMN

SEQ ID NO: 3228066 - protein, 23 aa, Plasmodium falciparum
KKKNLNKSNNYQTYEKKNSYNNI

SEQ ID NO: 3228067 - protein, 15 aa, Plasmodium falciparum
KKKNMESKDSSNSMS

SEQ ID NO: 3228068 - protein, 6 aa, Plasmodium falciparum
KKKNMN

SEQ ID NO: 3228069 - protein, 6 aa, Plasmodium falciparum
KKKNNE

SEQ ID NO: 3228070 - protein, 11 aa, Plasmodium falciparum
KKKNNENDMGA

SEQ ID NO: 3228071 - protein, 15 aa, Plasmodium falciparum
KKKNNGIIKGGSKHN

SEQ ID NO: 3228072 - protein, 6 aa, Plasmodium falciparum
KKKNNI

SEQ ID NO: 3228073 - protein, 22 aa, Plasmodium falciparum
KKKNNKKRKGKKKNEQEENRHN

SEQ ID NO: 3228074 - protein, 10 aa, Plasmodium falciparum
KKKNNKNKRN

SEQ ID NO: 3228075 - protein, 30 aa, Plasmodium falciparum
KKKNNKNYNDNNDDNNDNNDDDDDDDENRD

SEQ ID NO: 3228076 - protein, 10 aa, Plasmodium falciparum
KKKNNKRNTI

SEQ ID NO: 3228077 - protein, 11 aa, Plasmodium falciparum
KKKNNNLNNEN

SEQ ID NO: 3228078 - protein, 14 aa, Plasmodium falciparum
KKKNNNNKNTSDNH

SEQ ID NO: 3228079 - protein, 23 aa, Plasmodium falciparum
KKKNNNNNNNNNNIESVENNSIN

SEQ ID NO: 3228080 - protein, 32 aa, Plasmodium falciparum
KKKNNNNQNVHYDDDDDDGNDNNDDEEEKRKR

SEQ ID NO: 3228081 - protein, 31 aa, Plasmodium falciparum
KKKNNNYDINESDGVGDYGDDECEEESEIEN

SEQ ID NO: 3228082 - protein, 10 aa, Plasmodium falciparum
KKKNNPQGYN

SEQ ID NO: 3228083 - protein, 8 aa, Plasmodium falciparum
KKKNNRHT

SEQ ID NO: 3228084 - protein, 47 aa, Plasmodium falciparum
KKKNNTNNSNKNNNNKNNNNNNNNNNNNNNNNNNNNNNNNNNNNCNS

SEQ ID NO: 3228085 - protein, 9 aa, Plasmodium falciparum
KKKNPLNDN

SEQ ID NO: 3228086 - protein, 14 aa, Plasmodium falciparum
KKKNPNINTQKKNY

SEQ ID NO: 3228087 - protein, 16 aa, Plasmodium falciparum
KKKNQNRNNISSKKMN

SEQ ID NO: 3228088 - protein, 7 aa, Plasmodium falciparum
KKKNRIK

SEQ ID NO: 3228089 - protein, 19 aa, Plasmodium falciparum
KKKNRKRKGKKEKTKIERN

SEQ ID NO: 3228090 - protein, 9 aa, Plasmodium falciparum
KKKNRNTYK

SEQ ID NO: 3228091 - protein, 8 aa, Plasmodium falciparum
KKKNRNYN

SEQ ID NO: 3228092 - protein, 9 aa, Plasmodium falciparum
KKKNRRSIS

SEQ ID NO: 3228093 - protein, 9 aa, Plasmodium falciparum
KKKNRYSSC

SEQ ID NO: 3228094 - protein, 5 aa, Plasmodium falciparum
KKKNS

SEQ ID NO: 3228095 - protein, 15 aa, Plasmodium falciparum
KKKNSEENKQENKDL

SEQ ID NO: 3228096 - protein, 13 aa, Plasmodium falciparum
KKKNSGLLNKNEK

SEQ ID NO: 3228097 - protein, 7 aa, Plasmodium falciparum
KKKNSLN

SEQ ID NO: 3228098 - protein, 7 aa, Plasmodium falciparum
KKKNSTI

SEQ ID NO: 3228099 - protein, 31 aa, Plasmodium falciparum
KKKNSTQEKFKTKKKNHNNKKKKKKKNLREE

SEQ ID NO: 3228100 - protein, 17 aa, Plasmodium falciparum
KKKNSVNTTGNRSSYVN

SEQ ID NO: 3228101 - protein, 5 aa, Plasmodium falciparum
KKKNT

SEQ ID NO: 3228102 - protein, 61 aa, Plasmodium falciparum
KKKNTEKHNADTKEQGEKNNADTKEQGEKNNADTKEQGEKNNADTKEQGEKNNVDKTKNIP

SEQ ID NO: 3228103 - protein, 8 aa, Plasmodium falciparum
KKKNTTKV

SEQ ID NO: 3228104 - protein, 8 aa, Plasmodium falciparum
KKKNVDDN

SEQ ID NO: 3228105 - protein, 8 aa, Plasmodium falciparum
KKKNVKAV

SEQ ID NO: 3228106 - protein, 7 aa, Plasmodium falciparum
KKKNVNI

SEQ ID NO: 3228107 - protein, 7 aa, Plasmodium falciparum
KKKNVSY

SEQ ID NO: 3228108 - protein, 18 aa, Plasmodium falciparum
KKKNVTKKKKVDEKSEIN

SEQ ID NO: 3228109 - protein, 13 aa, Plasmodium falciparum
KKKNYEDDNNQTY

SEQ ID NO: 3228110 - protein, 9 aa, Plasmodium falciparum
KKKNYESNV

SEQ ID NO: 3228111 - protein, 9 aa, Plasmodium falciparum
KKKPGKNMN

SEQ ID NO: 3228112 - protein, 6 aa, Plasmodium falciparum
KKKPVN

SEQ ID NO: 3228113 - protein, 4 aa, Plasmodium falciparum
KKKQ

SEQ ID NO: 3228114 - protein, 30 aa, Plasmodium falciparum
KKKQANTNKSVNINTNKSLGVNKNVGNNNN

SEQ ID NO: 3228115 - protein, 8 aa, Plasmodium falciparum
KKKQAQNN

SEQ ID NO: 3228116 - protein, 7 aa, Plasmodium falciparum
KKKQDNS

SEQ ID NO: 3228117 - protein, 6 aa, Plasmodium falciparum
KKKQEN

SEQ ID NO: 3228118 - protein, 20 aa, Plasmodium falciparum
KKKQGSNKQISRNIKSSDDY

SEQ ID NO: 3228119 - protein, 14 aa, Plasmodium falciparum
KKKQKAQDNNENIC

SEQ ID NO: 3228120 - protein, 16 aa, Plasmodium falciparum
KKKQKINQKKKQRKDY

SEQ ID NO: 3228121 - protein, 6 aa, Plasmodium falciparum
KKKQKK

SEQ ID NO: 3228122 - protein, 17 aa, Plasmodium falciparum
KKKQKKGENNDKNVENV

SEQ ID NO: 3228123 - protein, 22 aa, Plasmodium falciparum
KKKQKKKNMNRSGKKDDKNERF

SEQ ID NO: 3228124 - protein, 6 aa, Plasmodium falciparum
KKKQLS

SEQ ID NO: 3228125 - protein, 9 aa, Plasmodium falciparum
KKKQNKKNC

SEQ ID NO: 3228126 - protein, 9 aa, Plasmodium falciparum
KKKQNNVDT

SEQ ID NO: 3228127 - protein, 10 aa, Plasmodium falciparum
KKKQNSNKMN

SEQ ID NO: 3228128 - protein, 12 aa, Plasmodium falciparum
KKKQSKGSYKTY

SEQ ID NO: 3228129 - protein, 8 aa, Plasmodium falciparum
KKKQSTKY

SEQ ID NO: 3228130 - protein, 11 aa, Plasmodium falciparum
KKKQYNTQKEK

SEQ ID NO: 3228131 - protein, 5 aa, Plasmodium falciparum
KKKRC

SEQ ID NO: 3228132 - protein, 7 aa, Plasmodium falciparum
KKKREKK

SEQ ID NO: 3228133 - protein, 8 aa, Plasmodium falciparum
KKKREKNS

SEQ ID NO: 3228134 - protein, 9 aa, Plasmodium falciparum
KKKREKQMN

SEQ ID NO: 3228135 - protein, 8 aa, Plasmodium falciparum
KKKRGKNE

SEQ ID NO: 3228136 - protein, 7 aa, Plasmodium falciparum
KKKRGSY

SEQ ID NO: 3228137 - protein, 7 aa, Plasmodium falciparum
KKKRHET

SEQ ID NO: 3228138 - protein, 8 aa, Plasmodium falciparum
KKKRIEDI

SEQ ID NO: 3228139 - protein, 7 aa, Plasmodium falciparum
KKKRIYS

SEQ ID NO: 3228140 - protein, 5 aa, Plasmodium falciparum
KKKRK

SEQ ID NO: 3228141 - protein, 8 aa, Plasmodium falciparum
KKKRKEKE

SEQ ID NO: 3228142 - protein, 19 aa, Plasmodium falciparum
KKKRKITSNTTDDSKYLSN

SEQ ID NO: 3228143 - protein, 10 aa, Plasmodium falciparum
KKKRKKQKGI

SEQ ID NO: 3228144 - protein, 7 aa, Plasmodium falciparum
KKKRKKR

SEQ ID NO: 3228145 - protein, 8 aa, Plasmodium falciparum
KKKRKMYD

SEQ ID NO: 3228146 - protein, 8 aa, Plasmodium falciparum
KKKRKRSI

SEQ ID NO: 3228147 - protein, 11 aa, Plasmodium falciparum
KKKRKYKTRGK

SEQ ID NO: 3228148 - protein, 16 aa, Plasmodium falciparum
KKKRMSSKNNEDNDLS

SEQ ID NO: 3228149 - protein, 7 aa, Plasmodium falciparum
KKKRNEK

SEQ ID NO: 3228150 - protein, 9 aa, Plasmodium falciparum
KKKRNEQSQ

SEQ ID NO: 3228151 - protein, 7 aa, Plasmodium falciparum
KKKRNQT

SEQ ID NO: 3228152 - protein, 8 aa, Plasmodium falciparum
KKKRPSDY

SEQ ID NO: 3228153 - protein, 9 aa, Plasmodium falciparum
KKKRRKRNT

SEQ ID NO: 3228154 - protein, 18 aa, Plasmodium falciparum
KKKRRNENIHNNNNYNSN

SEQ ID NO: 3228155 - protein, 7 aa, Plasmodium falciparum
KKKRRRQ

SEQ ID NO: 3228156 - protein, 5 aa, Plasmodium falciparum
KKKRS

SEQ ID NO: 3228157 - protein, 14 aa, Plasmodium falciparum
KKKRSSEKNDPYYK

SEQ ID NO: 3228158 - protein, 6 aa, Plasmodium falciparum
KKKRTF

SEQ ID NO: 3228159 - protein, 21 aa, Plasmodium falciparum
KKKRTNMKKNKCTSSSVSSLT

SEQ ID NO: 3228160 - protein, 7 aa, Plasmodium falciparum
KKKRTSI

SEQ ID NO: 3228161 - protein, 4 aa, Plasmodium falciparum
KKKS

SEQ ID NO: 3228162 - protein, 21 aa, Plasmodium falciparum
KKKSDDEYVDKDNYNTTENNF

SEQ ID NO: 3228163 - protein, 16 aa, Plasmodium falciparum
KKKSDKYDESNNNEIH

SEQ ID NO: 3228164 - protein, 7 aa, Plasmodium falciparum
KKKSDNI

SEQ ID NO: 3228165 - protein, 9 aa, Plasmodium falciparum
KKKSELKKK

SEQ ID NO: 3228166 - protein, 32 aa, Plasmodium falciparum
KKKSETEASNKNVESNDNVDGKLENEYNEDET

SEQ ID NO: 3228167 - protein, 7 aa, Plasmodium falciparum
KKKSFKN

SEQ ID NO: 3228168 - protein, 53 aa, Plasmodium falciparum
KKKSHDYNSSSHKLKKRKNKKKKSKKKRKSKSKIKTNAQGIYEESENDEGRDH

SEQ ID NO: 3228169 - protein, 7 aa, Plasmodium falciparum
KKKSHHD

SEQ ID NO: 3228170 - protein, 8 aa, Plasmodium falciparum
KKKSISNS

SEQ ID NO: 3228171 - protein, 20 aa, Plasmodium falciparum
KKKSKCNDNNNDDDDNNNNY

SEQ ID NO: 3228172 - protein, 44 aa, Plasmodium falciparum
KKKSKKHTTSSVEGNEYKKGEMNKEKKDTHKIKNATNNSKDINN

SEQ ID NO: 3228173 - protein, 12 aa, Plasmodium falciparum
KKKSKMKEASRK

SEQ ID NO: 3228174 - protein, 14 aa, Plasmodium falciparum
KKKSKNKDKHTKKN

SEQ ID NO: 3228175 - protein, 25 aa, Plasmodium falciparum
KKKSKNNININNNPNNNLNNNGQID

SEQ ID NO: 3228176 - protein, 13 aa, Plasmodium falciparum
KKKSKRKGRYTKT

SEQ ID NO: 3228177 - protein, 27 aa, Plasmodium falciparum
KKKSLNTNNESNNWNQNSDMKNNGSYS

SEQ ID NO: 3228178 - protein, 6 aa, Plasmodium falciparum
KKKSND

SEQ ID NO: 3228179 - protein, 21 aa, Plasmodium falciparum
KKKSNDNKKKQMDEKDKENAV

SEQ ID NO: 3228180 - protein, 14 aa, Plasmodium falciparum
KKKSNNSTKQNKNY

SEQ ID NO: 3228181 - protein, 8 aa, Plasmodium falciparum
KKKSNTVN

SEQ ID NO: 3228182 - protein, 18 aa, Plasmodium falciparum
KKKSPKKKVIRQVVKKTP

SEQ ID NO: 3228183 - protein, 36 aa, Plasmodium falciparum
KKKSQLTENEENNMKSVDDNNNNNKNNDNIVKGGNN

SEQ ID NO: 3228184 - protein, 6 aa, Plasmodium falciparum
KKKSRR

SEQ ID NO: 3228185 - protein, 7 aa, Plasmodium falciparum
KKKSSEH

SEQ ID NO: 3228186 - protein, 14 aa, Plasmodium falciparum
KKKSSKNYKTHETT

SEQ ID NO: 3228187 - protein, 7 aa, Plasmodium falciparum
KKKSSLK

SEQ ID NO: 3228188 - protein, 11 aa, Plasmodium falciparum
KKKSSSSNKVH

SEQ ID NO: 3228189 - protein, 8 aa, Plasmodium falciparum
KKKSTNKC

SEQ ID NO: 3228190 - protein, 9 aa, Plasmodium falciparum
KKKSYDKQY

SEQ ID NO: 3228191 - protein, 15 aa, Plasmodium falciparum
KKKTAKKKKNKKRKI

SEQ ID NO: 3228192 - protein, 11 aa, Plasmodium falciparum
KKKTDDDGTKV

SEQ ID NO: 3228193 - protein, 23 aa, Plasmodium falciparum
KKKTDKKEDINNNNNTTENNENI

SEQ ID NO: 3228194 - protein, 8 aa, Plasmodium falciparum
KKKTIKQK

SEQ ID NO: 3228195 - protein, 8 aa, Plasmodium falciparum
KKKTKHIN

SEQ ID NO: 3228196 - protein, 6 aa, Plasmodium falciparum
KKKTKK

SEQ ID NO: 3228197 - protein, 14 aa, Plasmodium falciparum
KKKTKKINKEQQTI

SEQ ID NO: 3228198 - protein, 11 aa, Plasmodium falciparum
KKKTKKKSTKF

SEQ ID NO: 3228199 - protein, 15 aa, Plasmodium falciparum
KKKTKLNSKNSMNNK

SEQ ID NO: 3228200 - protein, 10 aa, Plasmodium falciparum
KKKTKQEMER

SEQ ID NO: 3228201 - protein, 6 aa, Plasmodium falciparum
KKKTKY

SEQ ID NO: 3228202 - protein, 7 aa, Plasmodium falciparum
KKKTLDK

SEQ ID NO: 3228203 - protein, 7 aa, Plasmodium falciparum
KKKTMKM

SEQ ID NO: 3228204 - protein, 14 aa, Plasmodium falciparum
KKKTNETGKKEVDD

SEQ ID NO: 3228205 - protein, 6 aa, Plasmodium falciparum
KKKTNI

SEQ ID NO: 3228206 - protein, 8 aa, Plasmodium falciparum
KKKTNKMC

SEQ ID NO: 3228207 - protein, 7 aa, Plasmodium falciparum
KKKTNRK

SEQ ID NO: 3228208 - protein, 9 aa, Plasmodium falciparum
KKKTNVNDT

SEQ ID NO: 3228209 - protein, 17 aa, Plasmodium falciparum
KKKTPNLQSDNNNNNMR

SEQ ID NO: 3228210 - protein, 7 aa, Plasmodium falciparum
KKKTSED

SEQ ID NO: 3228211 - protein, 36 aa, Plasmodium falciparum
KKKTSKQENNISSSTSDLNETNSMESYKSCDKSKVG

SEQ ID NO: 3228212 - protein, 6 aa, Plasmodium falciparum
KKKTSL

SEQ ID NO: 3228213 - protein, 8 aa, Plasmodium falciparum
KKKTTSCS

SEQ ID NO: 3228214 - protein, 13 aa, Plasmodium falciparum
KKKTTSDKKKNNQ

SEQ ID NO: 3228215 - protein, 5 aa, Plasmodium falciparum
KKKTY

SEQ ID NO: 3228216 - protein, 8 aa, Plasmodium falciparum
KKKTYNYS

SEQ ID NO: 3228217 - protein, 13 aa, Plasmodium falciparum
KKKVDNSNQNNIG

SEQ ID NO: 3228218 - protein, 23 aa, Plasmodium falciparum
KKKVENAKKKCRGENNDKYCSRN

SEQ ID NO: 3228219 - protein, 16 aa, Plasmodium falciparum
KKKVGEKKKKKKKKIY

SEQ ID NO: 3228220 - protein, 15 aa, Plasmodium falciparum
KKKVNKKLQYIKLLN

SEQ ID NO: 3228221 - protein, 7 aa, Plasmodium falciparum
KKKVSEQ

SEQ ID NO: 3228222 - protein, 8 aa, Plasmodium falciparum
KKKVSSHQ

SEQ ID NO: 3228223 - protein, 9 aa, Plasmodium falciparum
KKKYARNSK

SEQ ID NO: 3228224 - protein, 30 aa, Plasmodium falciparum
KKKYDEDKLSEATDQEKKSKNNEKYKHEHA

SEQ ID NO: 3228225 - protein, 8 aa, Plasmodium falciparum
KKKYEPTN

SEQ ID NO: 3228226 - protein, 18 aa, Plasmodium falciparum
KKKYETVNKKEKSKYYQT

SEQ ID NO: 3228227 - protein, 11 aa, Plasmodium falciparum
KKKYGNVQKTD

SEQ ID NO: 3228228 - protein, 5 aa, Plasmodium falciparum
KKKYI

SEQ ID NO: 3228229 - protein, 8 aa, Plasmodium falciparum
KKKYKDKS

SEQ ID NO: 3228230 - protein, 14 aa, Plasmodium falciparum
KKKYKEKNKMKGNY

SEQ ID NO: 3228231 - protein, 6 aa, Plasmodium falciparum
KKKYKK

SEQ ID NO: 3228232 - protein, 18 aa, Plasmodium falciparum
KKKYKNKKMPKTIDGNDT

SEQ ID NO: 3228233 - protein, 7 aa, Plasmodium falciparum
KKKYNNF

SEQ ID NO: 3228234 - protein, 21 aa, Plasmodium falciparum
KKKYNNNNNNNNNNDNDNNNI

SEQ ID NO: 3228235 - protein, 13 aa, Plasmodium falciparum
KKKYNSKKKKGNL

SEQ ID NO: 3228236 - protein, 7 aa, Plasmodium falciparum
KKKYRKK

SEQ ID NO: 3228237 - protein, 6 aa, Plasmodium falciparum
KKKYRN

SEQ ID NO: 3228238 - protein, 6 aa, Plasmodium falciparum
KKKYSD

SEQ ID NO: 3228239 - protein, 22 aa, Plasmodium falciparum
KKKYSNKTNDKIYNNEKNDMID

SEQ ID NO: 3228240 - protein, 6 aa, Plasmodium falciparum
KKKYTN

SEQ ID NO: 3228241 - protein, 7 aa, Plasmodium falciparum
KKKYTNT

SEQ ID NO: 3228242 - protein, 8 aa, Plasmodium falciparum
KKKYTYGK

SEQ ID NO: 3228243 - protein, 4 aa, Plasmodium falciparum
KKLC

SEQ ID NO: 3228244 - protein, 4 aa, Plasmodium falciparum
KKLD

SEQ ID NO: 3228245 - protein, 7 aa, Plasmodium falciparum
KKLDANS

SEQ ID NO: 3228246 - protein, 20 aa, Plasmodium falciparum
KKLDEKKKKELQKEEKKTKL

SEQ ID NO: 3228247 - protein, 11 aa, Plasmodium falciparum
KKLDKEKKKNV

SEQ ID NO: 3228248 - protein, 12 aa, Plasmodium falciparum
KKLDKPINKKRK

SEQ ID NO: 3228249 - protein, 18 aa, Plasmodium falciparum
KKLDKTKKNIYTSNNEKY

SEQ ID NO: 3228250 - protein, 18 aa, Plasmodium falciparum
KKLDPIGQVNTDKKKSSN

SEQ ID NO: 3228251 - protein, 11 aa, Plasmodium falciparum
KKLDREKDNNI

SEQ ID NO: 3228252 - protein, 6 aa, Plasmodium falciparum
KKLEEN

SEQ ID NO: 3228253 - protein, 26 aa, Plasmodium falciparum
KKLEKKKKKMLEKNKKKKKEDTLDDK

SEQ ID NO: 3228254 - protein, 16 aa, Plasmodium falciparum
KKLENIESQKCTNKDN

SEQ ID NO: 3228255 - protein, 10 aa, Plasmodium falciparum
KKLENNNKKI

SEQ ID NO: 3228256 - protein, 5 aa, Plasmodium falciparum
KKLIE

SEQ ID NO: 3228257 - protein, 18 aa, Plasmodium falciparum
KKLKEEAEERYKKDGDNY

SEQ ID NO: 3228258 - protein, 22 aa, Plasmodium falciparum
KKLKEEKKLKEKEEKKKEKEKF

SEQ ID NO: 3228259 - protein, 10 aa, Plasmodium falciparum
KKLKKNKNMY

SEQ ID NO: 3228260 - protein, 22 aa, Plasmodium falciparum
KKLKKNKNSISNYNKKQENNDI

SEQ ID NO: 3228261 - protein, 9 aa, Plasmodium falciparum
KKLKNDENY

SEQ ID NO: 3228262 - protein, 5 aa, Plasmodium falciparum
KKLKS

SEQ ID NO: 3228263 - protein, 6 aa, Plasmodium falciparum
KKLKSS

SEQ ID NO: 3228264 - protein, 6 aa, Plasmodium falciparum
KKLKTN

SEQ ID NO: 3228265 - protein, 14 aa, Plasmodium falciparum
KKLKTNKSKNSDSL

SEQ ID NO: 3228266 - protein, 8 aa, Plasmodium falciparum
KKLKYSDD

SEQ ID NO: 3228267 - protein, 5 aa, Plasmodium falciparum
KKLND

SEQ ID NO: 3228268 - protein, 36 aa, Plasmodium falciparum
KKLNDQKGEQKGEQNGEQKCEQKYEQKYEHQGSSVK

SEQ ID NO: 3228269 - protein, 6 aa, Plasmodium falciparum
KKLNIN

SEQ ID NO: 3228270 - protein, 7 aa, Plasmodium falciparum
KKLNKNK

SEQ ID NO: 3228271 - protein, 5 aa, Plasmodium falciparum
KKLNN

SEQ ID NO: 3228272 - protein, 13 aa, Plasmodium falciparum
KKLNSERINDDKN

SEQ ID NO: 3228273 - protein, 8 aa, Plasmodium falciparum
KKLNTENN

SEQ ID NO: 3228274 - protein, 21 aa, Plasmodium falciparum
KKLNVSDRNIPTEDNTKRSLN

SEQ ID NO: 3228275 - protein, 8 aa, Plasmodium falciparum
KKLPNDHT

SEQ ID NO: 3228276 - protein, 7 aa, Plasmodium falciparum
KKLPPYK

SEQ ID NO: 3228277 - protein, 9 aa, Plasmodium falciparum
KKLPSKSSQ

SEQ ID NO: 3228278 - protein, 8 aa, Plasmodium falciparum
KKLPSSQY

SEQ ID NO: 3228279 - protein, 4 aa, Plasmodium falciparum
KKLQ

SEQ ID NO: 3228280 - protein, 6 aa, Plasmodium falciparum
KKLQED

SEQ ID NO: 3228281 - protein, 9 aa, Plasmodium falciparum
KKLQENNTN

SEQ ID NO: 3228282 - protein, 7 aa, Plasmodium falciparum
KKLQEQN

SEQ ID NO: 3228283 - protein, 7 aa, Plasmodium falciparum
KKLQGTD

SEQ ID NO: 3228284 - protein, 6 aa, Plasmodium falciparum
KKLQNA

SEQ ID NO: 3228285 - protein, 7 aa, Plasmodium falciparum
KKLRKKG

SEQ ID NO: 3228286 - protein, 10 aa, Plasmodium falciparum
KKLRNTNSQN

SEQ ID NO: 3228287 - protein, 4 aa, Plasmodium falciparum
KKLS

SEQ ID NO: 3228288 - protein, 7 aa, Plasmodium falciparum
KKLSTTT

SEQ ID NO: 3228289 - protein, 11 aa, Plasmodium falciparum
KKLTPAEIKKR

SEQ ID NO: 3228290 - protein, 4 aa, Plasmodium falciparum
KKLV

SEQ ID NO: 3228291 - protein, 24 aa, Plasmodium falciparum
KKLVTDNTKDLNKCSSYKSSKRDK

SEQ ID NO: 3228292 - protein, 4 aa, Plasmodium falciparum
KKLY

SEQ ID NO: 3228293 - protein, 6 aa, Plasmodium falciparum
KKLYKK

SEQ ID NO: 3228294 - protein, 14 aa, Plasmodium falciparum
KKLYNPSNKNVQRT

SEQ ID NO: 3228295 - protein, 4 aa, Plasmodium falciparum
KKMD

SEQ ID NO: 3228296 - protein, 41 aa, Plasmodium falciparum
KKMDDERKTPQSENDEDQQGGYDKMEENEKEDTQMDNDDYE

SEQ ID NO: 3228297 - protein, 12 aa, Plasmodium falciparum
KKMDDKSDYYDS

SEQ ID NO: 3228298 - protein, 12 aa, Plasmodium falciparum
KKMDEKEDTVVE

SEQ ID NO: 3228299 - protein, 6 aa, Plasmodium falciparum
KKMDND

SEQ ID NO: 3228300 - protein, 83 aa, Plasmodium falciparum
KKMEHDKNQTQNEQNEQNKDNKQNEQNKDNKQNEQNKDNKQNKDNKQNKDNKQNKDNKQNKDNKQNKDYKDYKDNKQKSKLYN

SEQ ID NO: 3228301 - protein, 15 aa, Plasmodium falciparum
KKMEKDSLNENRSLP

SEQ ID NO: 3228302 - protein, 42 aa, Plasmodium falciparum
KKMEKSNNNNNDDHNNDHNNDHNNDHNNDHNNDHNNDHGNNC

SEQ ID NO: 3228303 - protein, 4 aa, Plasmodium falciparum
KKMG

SEQ ID NO: 3228304 - protein, 4 aa, Plasmodium falciparum
KKMK

SEQ ID NO: 3228305 - protein, 8 aa, Plasmodium falciparum
KKMKDEKV

SEQ ID NO: 3228306 - protein, 10 aa, Plasmodium falciparum
KKMKGDKIKD

SEQ ID NO: 3228307 - protein, 14 aa, Plasmodium falciparum
KKMKKKDQYTKLLN

SEQ ID NO: 3228308 - protein, 14 aa, Plasmodium falciparum
KKMKKKEQYTKLLN

SEQ ID NO: 3228309 - protein, 14 aa, Plasmodium falciparum
KKMKKKVQYLKLLN

SEQ ID NO: 3228310 - protein, 21 aa, Plasmodium falciparum
KKMKNNIKKSSVKKKIHGRSN

SEQ ID NO: 3228311 - protein, 14 aa, Plasmodium falciparum
KKMKQKQQYTKLLN

SEQ ID NO: 3228312 - protein, 7 aa, Plasmodium falciparum
KKMKQQR

SEQ ID NO: 3228313 - protein, 17 aa, Plasmodium falciparum
KKMKTNKRFKNKHKNKN

SEQ ID NO: 3228314 - protein, 5 aa, Plasmodium falciparum
KKMMD

SEQ ID NO: 3228315 - protein, 4 aa, Plasmodium falciparum
KKMN

SEQ ID NO: 3228316 - protein, 18 aa, Plasmodium falciparum
KKMNDLKKKKKSNENGRY

SEQ ID NO: 3228317 - protein, 13 aa, Plasmodium falciparum
KKMNDTNKNIDDQ

SEQ ID NO: 3228318 - protein, 6 aa, Plasmodium falciparum
KKMNKD

SEQ ID NO: 3228319 - protein, 14 aa, Plasmodium falciparum
KKMNKKAEYTKLLN

SEQ ID NO: 3228320 - protein, 13 aa, Plasmodium falciparum
KKMNKKKNYNTQN

SEQ ID NO: 3228321 - protein, 15 aa, Plasmodium falciparum
KKMRREEKKKRVQEP

SEQ ID NO: 3228322 - protein, 4 aa, Plasmodium falciparum
KKMS

SEQ ID NO: 3228323 - protein, 6 aa, Plasmodium falciparum
KKMSKV

SEQ ID NO: 3228324 - protein, 5 aa, Plasmodium falciparum
KKMTN

SEQ ID NO: 3228325 - protein, 6 aa, Plasmodium falciparum
KKNAEA

SEQ ID NO: 3228326 - protein, 58 aa, Plasmodium falciparum
KKNANSDLETDKKNKVKKKQDEEMDETNKNNKNETNEKDEKDEKEEKDDNINDNNDDI

SEQ ID NO: 3228327 - protein, 16 aa, Plasmodium falciparum
KKNAPISSSNLTGENT

SEQ ID NO: 3228328 - protein, 5 aa, Plasmodium falciparum
KKNCK

SEQ ID NO: 3228329 - protein, 17 aa, Plasmodium falciparum
KKNCKESTLNYENNPKT

SEQ ID NO: 3228330 - protein, 6 aa, Plasmodium falciparum
KKNCSY

SEQ ID NO: 3228331 - protein, 4 aa, Plasmodium falciparum
KKND

SEQ ID NO: 3228332 - protein, 9 aa, Plasmodium falciparum
KKNDCTPNN

SEQ ID NO: 3228333 - protein, 24 aa, Plasmodium falciparum
KKNDDENYENEEEEEDDDDDDDDD

SEQ ID NO: 3228334 - protein, 7 aa, Plasmodium falciparum
KKNDDGK

SEQ ID NO: 3228335 - protein, 6 aa, Plasmodium falciparum
KKNDEK

SEQ ID NO: 3228336 - protein, 25 aa, Plasmodium falciparum
KKNDEKKKKKKEKKSTRTQAKSLDT

SEQ ID NO: 3228337 - protein, 5 aa, Plasmodium falciparum
KKNDF

SEQ ID NO: 3228338 - protein, 16 aa, Plasmodium falciparum
KKNDGKRKKSKNNFDI

SEQ ID NO: 3228339 - protein, 7 aa, Plasmodium falciparum
KKNDGQW

SEQ ID NO: 3228340 - protein, 6 aa, Plasmodium falciparum
KKNDHI

SEQ ID NO: 3228341 - protein, 7 aa, Plasmodium falciparum
KKNDHKT

SEQ ID NO: 3228342 - protein, 6 aa, Plasmodium falciparum
KKNDIN

SEQ ID NO: 3228343 - protein, 13 aa, Plasmodium falciparum
KKNDINKNMNHKG

SEQ ID NO: 3228344 - protein, 19 aa, Plasmodium falciparum
KKNDINKYNEGNNNNNADF

SEQ ID NO: 3228345 - protein, 6 aa, Plasmodium falciparum
KKNDIS

SEQ ID NO: 3228346 - protein, 6 aa, Plasmodium falciparum
KKNDIT

SEQ ID NO: 3228347 - protein, 6 aa, Plasmodium falciparum
KKNDKI

SEQ ID NO: 3228348 - protein, 14 aa, Plasmodium falciparum
KKNDKKRKNDKTRV

SEQ ID NO: 3228349 - protein, 7 aa, Plasmodium falciparum
KKNDKNR

SEQ ID NO: 3228350 - protein, 141 aa, Plasmodium falciparum
KKNDLQCASQKKSRKNQRAASVKRRGAEGKDKKDGSRSLDRKKDKVTRRSNKYEESANDSDGKKNNGDDKKKGDNIGKNNNNNNNNNDDDSNNNGDDSNNNGDDSNNNGDGNNNINGDGNNNINGDGNNNINGDGNNNNDC

SEQ ID NO: 3228351 - protein, 12 aa, Plasmodium falciparum
KKNDMNKKKKDY

SEQ ID NO: 3228352 - protein, 5 aa, Plasmodium falciparum
KKNDN

SEQ ID NO: 3228353 - protein, 10 aa, Plasmodium falciparum
KKNDNDEYGE

SEQ ID NO: 3228354 - protein, 8 aa, Plasmodium falciparum
KKNDNLNN

SEQ ID NO: 3228355 - protein, 10 aa, Plasmodium falciparum
KKNDNNNKCV

SEQ ID NO: 3228356 - protein, 8 aa, Plasmodium falciparum
KKNDNNVG

SEQ ID NO: 3228357 - protein, 6 aa, Plasmodium falciparum
KKNDQL

SEQ ID NO: 3228358 - protein, 7 aa, Plasmodium falciparum
KKNDRSN

SEQ ID NO: 3228359 - protein, 10 aa, Plasmodium falciparum
KKNDSDKSSI

SEQ ID NO: 3228360 - protein, 9 aa, Plasmodium falciparum
KKNDSKDTI

SEQ ID NO: 3228361 - protein, 7 aa, Plasmodium falciparum
KKNDSNI

SEQ ID NO: 3228362 - protein, 7 aa, Plasmodium falciparum
KKNDSQV

SEQ ID NO: 3228363 - protein, 7 aa, Plasmodium falciparum
KKNDYNK

SEQ ID NO: 3228364 - protein, 7 aa, Plasmodium falciparum
KKNDYNN

SEQ ID NO: 3228365 - protein, 8 aa, Plasmodium falciparum
KKNEDKYG

SEQ ID NO: 3228366 - protein, 6 aa, Plasmodium falciparum
KKNEEC

SEQ ID NO: 3228367 - protein, 13 aa, Plasmodium falciparum
KKNEEELKPTSSL

SEQ ID NO: 3228368 - protein, 6 aa, Plasmodium falciparum
KKNEEF

SEQ ID NO: 3228369 - protein, 8 aa, Plasmodium falciparum
KKNEEKTT

SEQ ID NO: 3228370 - protein, 6 aa, Plasmodium falciparum
KKNEEL

SEQ ID NO: 3228371 - protein, 9 aa, Plasmodium falciparum
KKNEENYYK

SEQ ID NO: 3228372 - protein, 9 aa, Plasmodium falciparum
KKNEESNNK

SEQ ID NO: 3228373 - protein, 17 aa, Plasmodium falciparum
KKNEETKNKDISENNDT

SEQ ID NO: 3228374 - protein, 5 aa, Plasmodium falciparum
KKNEI

SEQ ID NO: 3228375 - protein, 8 aa, Plasmodium falciparum
KKNEIDYS

SEQ ID NO: 3228376 - protein, 7 aa, Plasmodium falciparum
KKNEIQK

SEQ ID NO: 3228377 - protein, 5 aa, Plasmodium falciparum
KKNEK

SEQ ID NO: 3228378 - protein, 8 aa, Plasmodium falciparum
KKNEKKKN

SEQ ID NO: 3228379 - protein, 19 aa, Plasmodium falciparum
KKNEKKLKKNKRKSIEQEH

SEQ ID NO: 3228380 - protein, 11 aa, Plasmodium falciparum
KKNEKKNSLGA

SEQ ID NO: 3228381 - protein, 6 aa, Plasmodium falciparum
KKNEKL

SEQ ID NO: 3228382 - protein, 9 aa, Plasmodium falciparum
KKNEKNDQD

SEQ ID NO: 3228383 - protein, 8 aa, Plasmodium falciparum
KKNEKQKE

SEQ ID NO: 3228384 - protein, 24 aa, Plasmodium falciparum
KKNEKRESRKNKTNDFLSSSSSEE

SEQ ID NO: 3228385 - protein, 10 aa, Plasmodium falciparum
KKNELDAKKK

SEQ ID NO: 3228386 - protein, 8 aa, Plasmodium falciparum
KKNEMSYG

SEQ ID NO: 3228387 - protein, 13 aa, Plasmodium falciparum
KKNENDKNYKNRN

SEQ ID NO: 3228388 - protein, 6 aa, Plasmodium falciparum
KKNENE

SEQ ID NO: 3228389 - protein, 9 aa, Plasmodium falciparum
KKNENENNI

SEQ ID NO: 3228390 - protein, 6 aa, Plasmodium falciparum
KKNENI

SEQ ID NO: 3228391 - protein, 7 aa, Plasmodium falciparum
KKNENIK

SEQ ID NO: 3228392 - protein, 6 aa, Plasmodium falciparum
KKNEQE

SEQ ID NO: 3228393 - protein, 17 aa, Plasmodium falciparum
KKNEQGQGVQNGFNTDN

SEQ ID NO: 3228394 - protein, 9 aa, Plasmodium falciparum
KKNEQKGIN

SEQ ID NO: 3228395 - protein, 7 aa, Plasmodium falciparum
KKNEQME

SEQ ID NO: 3228396 - protein, 8 aa, Plasmodium falciparum
KKNEQTPY

SEQ ID NO: 3228397 - protein, 8 aa, Plasmodium falciparum
KKNERTNK

SEQ ID NO: 3228398 - protein, 8 aa, Plasmodium falciparum
KKNESEKL

SEQ ID NO: 3228399 - protein, 24 aa, Plasmodium falciparum
KKNESNVDEKSKIMDRDKSKDNFK

SEQ ID NO: 3228400 - protein, 7 aa, Plasmodium falciparum
KKNESTN

SEQ ID NO: 3228401 - protein, 11 aa, Plasmodium falciparum
KKNETNDPIKG

SEQ ID NO: 3228402 - protein, 11 aa, Plasmodium falciparum
KKNETNKLSQT

SEQ ID NO: 3228403 - protein, 6 aa, Plasmodium falciparum
KKNEWE

SEQ ID NO: 3228404 - protein, 17 aa, Plasmodium falciparum
KKNEYEKKNKDISSSQY

SEQ ID NO: 3228405 - protein, 6 aa, Plasmodium falciparum
KKNFEN

SEQ ID NO: 3228406 - protein, 8 aa, Plasmodium falciparum
KKNFNKYS

SEQ ID NO: 3228407 - protein, 69 aa, Plasmodium falciparum
KKNFNNENESKENDNHNDVNNKNDNHNDVNNKNDNHNDDNNKNDNHNDDNNKNDNHNDVNNNNNNSYKP

SEQ ID NO: 3228408 - protein, 8 aa, Plasmodium falciparum
KKNFQSKE

SEQ ID NO: 3228409 - protein, 16 aa, Plasmodium falciparum
KKNGDNKKSSDQNINN

SEQ ID NO: 3228410 - protein, 7 aa, Plasmodium falciparum
KKNGEKL

SEQ ID NO: 3228411 - protein, 12 aa, Plasmodium falciparum
KKNGENKYSTKN

SEQ ID NO: 3228412 - protein, 7 aa, Plasmodium falciparum
KKNGNAF

SEQ ID NO: 3228413 - protein, 41 aa, Plasmodium falciparum
KKNGNEKTGNNNKKKNNKEDKNDYINNNNNNNNNNNNDNNI

SEQ ID NO: 3228414 - protein, 16 aa, Plasmodium falciparum
KKNGNEWKKKDTDQCK

SEQ ID NO: 3228415 - protein, 8 aa, Plasmodium falciparum
KKNGNIKN

SEQ ID NO: 3228416 - protein, 7 aa, Plasmodium falciparum
KKNGNKI

SEQ ID NO: 3228417 - protein, 8 aa, Plasmodium falciparum
KKNGNRPI

SEQ ID NO: 3228418 - protein, 13 aa, Plasmodium falciparum
KKNGRGKNEINTN

SEQ ID NO: 3228419 - protein, 6 aa, Plasmodium falciparum
KKNGVD

SEQ ID NO: 3228420 - protein, 7 aa, Plasmodium falciparum
KKNGVDQ

SEQ ID NO: 3228421 - protein, 6 aa, Plasmodium falciparum
KKNGYR

SEQ ID NO: 3228422 - protein, 12 aa, Plasmodium falciparum
KKNHKKKNITKT

SEQ ID NO: 3228423 - protein, 10 aa, Plasmodium falciparum
KKNHNDAIEE

SEQ ID NO: 3228424 - protein, 17 aa, Plasmodium falciparum
KKNHNNNNINKKNTKKI

SEQ ID NO: 3228425 - protein, 21 aa, Plasmodium falciparum
KKNHRNNQTNLDKENKEYYKK

SEQ ID NO: 3228426 - protein, 14 aa, Plasmodium falciparum
KKNHTHPNEEKRTF

SEQ ID NO: 3228427 - protein, 16 aa, Plasmodium falciparum
KKNHTMSNAYNNNNDC

SEQ ID NO: 3228428 - protein, 6 aa, Plasmodium falciparum
KKNIEK

SEQ ID NO: 3228429 - protein, 5 aa, Plasmodium falciparum
KKNIH

SEQ ID NO: 3228430 - protein, 19 aa, Plasmodium falciparum
KKNIHDDNDEIKKKNYNKL

SEQ ID NO: 3228431 - protein, 14 aa, Plasmodium falciparum
KKNIHNKNDNMKAD

SEQ ID NO: 3228432 - protein, 24 aa, Plasmodium falciparum
KKNIKGKVTNDETLKGKEIKDDQR

SEQ ID NO: 3228433 - protein, 8 aa, Plasmodium falciparum
KKNIKSKT

SEQ ID NO: 3228434 - protein, 31 aa, Plasmodium falciparum
KKNINKNDKCKTYDTCEKDDTYRTDKKSKLK

SEQ ID NO: 3228435 - protein, 15 aa, Plasmodium falciparum
KKNINKSLDAESNYG

SEQ ID NO: 3228436 - protein, 20 aa, Plasmodium falciparum
KKNINNNNKKNKKKKKNYYS

SEQ ID NO: 3228437 - protein, 18 aa, Plasmodium falciparum
KKNIPNSNNMNEAGTRNN

SEQ ID NO: 3228438 - protein, 13 aa, Plasmodium falciparum
KKNIQNNNAHRVE

SEQ ID NO: 3228439 - protein, 16 aa, Plasmodium falciparum
KKNIQSSKYKNSNPMY

SEQ ID NO: 3228440 - protein, 8 aa, Plasmodium falciparum
KKNIQTNI

SEQ ID NO: 3228441 - protein, 20 aa, Plasmodium falciparum
KKNIRNKDKDDNKKDLDTSV

SEQ ID NO: 3228442 - protein, 5 aa, Plasmodium falciparum
KKNIS

SEQ ID NO: 3228443 - protein, 7 aa, Plasmodium falciparum
KKNISKS

SEQ ID NO: 3228444 - protein, 8 aa, Plasmodium falciparum
KKNISSKP

SEQ ID NO: 3228445 - protein, 4 aa, Plasmodium falciparum
KKNK

SEQ ID NO: 3228446 - protein, 8 aa, Plasmodium falciparum
KKNKDEHI

SEQ ID NO: 3228447 - protein, 7 aa, Plasmodium falciparum
KKNKDKI

SEQ ID NO: 3228448 - protein, 6 aa, Plasmodium falciparum
KKNKDN

SEQ ID NO: 3228449 - protein, 9 aa, Plasmodium falciparum
KKNKEPNKN

SEQ ID NO: 3228450 - protein, 12 aa, Plasmodium falciparum
KKNKERNNNATS

SEQ ID NO: 3228451 - protein, 6 aa, Plasmodium falciparum
KKNKES

SEQ ID NO: 3228452 - protein, 21 aa, Plasmodium falciparum
KKNKEYISSTYNDNKNNYKNL

SEQ ID NO: 3228453 - protein, 24 aa, Plasmodium falciparum
KKNKGLKNSDDSTKQDKKKDNKNI

SEQ ID NO: 3228454 - protein, 8 aa, Plasmodium falciparum
KKNKGNAK

SEQ ID NO: 3228455 - protein, 7 aa, Plasmodium falciparum
KKNKGYS

SEQ ID NO: 3228456 - protein, 6 aa, Plasmodium falciparum
KKNKIE

SEQ ID NO: 3228457 - protein, 6 aa, Plasmodium falciparum
KKNKIK

SEQ ID NO: 3228458 - protein, 19 aa, Plasmodium falciparum
KKNKKCNKGNELDRNSTIQ

SEQ ID NO: 3228459 - protein, 10 aa, Plasmodium falciparum
KKNKKEKLTT

SEQ ID NO: 3228460 - protein, 8 aa, Plasmodium falciparum
KKNKKGIE

SEQ ID NO: 3228461 - protein, 7 aa, Plasmodium falciparum
KKNKKGY

SEQ ID NO: 3228462 - protein, 6 aa, Plasmodium falciparum
KKNKKI

SEQ ID NO: 3228463 - protein, 7 aa, Plasmodium falciparum
KKNKKKI

SEQ ID NO: 3228464 - protein, 14 aa, Plasmodium falciparum
KKNKKKKKKNHDVN

SEQ ID NO: 3228465 - protein, 14 aa, Plasmodium falciparum
KKNKKKSTPEQVTT

SEQ ID NO: 3228466 - protein, 11 aa, Plasmodium falciparum
KKNKKNDYNNN

SEQ ID NO: 3228467 - protein, 7 aa, Plasmodium falciparum
KKNKKNK

SEQ ID NO: 3228468 - protein, 21 aa, Plasmodium falciparum
KKNKKNKKNKKKKNKKTKNTQ

SEQ ID NO: 3228469 - protein, 60 aa, Plasmodium falciparum
KKNKKNKQKKKKNNKRRRKRRKKGNNNNYDEHEDYDDDHKNHDTHHDDEAEELEEKKHEL

SEQ ID NO: 3228470 - protein, 7 aa, Plasmodium falciparum
KKNKKNM

SEQ ID NO: 3228471 - protein, 7 aa, Plasmodium falciparum
KKNKKNN

SEQ ID NO: 3228472 - protein, 8 aa, Plasmodium falciparum
KKNKKRER

SEQ ID NO: 3228473 - protein, 27 aa, Plasmodium falciparum
KKNKKRKNKRKKGINTKDDDSDSIEED

SEQ ID NO: 3228474 - protein, 7 aa, Plasmodium falciparum
KKNKKSN

SEQ ID NO: 3228475 - protein, 9 aa, Plasmodium falciparum
KKNKKSNNV

SEQ ID NO: 3228476 - protein, 33 aa, Plasmodium falciparum
KKNKMELKKEKDNNKKDKKMNKKMKKENGDISD

SEQ ID NO: 3228477 - protein, 6 aa, Plasmodium falciparum
KKNKMK

SEQ ID NO: 3228478 - protein, 5 aa, Plasmodium falciparum
KKNKN

SEQ ID NO: 3228479 - protein, 16 aa, Plasmodium falciparum
KKNKNADNNDNMKRDT

SEQ ID NO: 3228480 - protein, 7 aa, Plasmodium falciparum
KKNKNEY

SEQ ID NO: 3228481 - protein, 16 aa, Plasmodium falciparum
KKNKNKIEYSKQQKEF

SEQ ID NO: 3228482 - protein, 14 aa, Plasmodium falciparum
KKNKNKKKKKKGKN

SEQ ID NO: 3228483 - protein, 62 aa, Plasmodium falciparum
KKNKNKNKEKRKTRNIQKEKKNEIEKENEIEKENEIEKENEIEKKNEIEKKNEIEKDKENDI

SEQ ID NO: 3228484 - protein, 9 aa, Plasmodium falciparum
KKNKNKNKI

SEQ ID NO: 3228485 - protein, 39 aa, Plasmodium falciparum
KKNKNKNKKINNNNNNNNNNNNNNNSNSSSCSSCSSSSS

SEQ ID NO: 3228486 - protein, 11 aa, Plasmodium falciparum
KKNKNNENSSA

SEQ ID NO: 3228487 - protein, 7 aa, Plasmodium falciparum
KKNKNNI

SEQ ID NO: 3228488 - protein, 9 aa, Plasmodium falciparum
KKNKNRNKY

SEQ ID NO: 3228489 - protein, 7 aa, Plasmodium falciparum
KKNKNSL

SEQ ID NO: 3228490 - protein, 10 aa, Plasmodium falciparum
KKNKRKDNKM

SEQ ID NO: 3228491 - protein, 26 aa, Plasmodium falciparum
KKNKRKKGTNINRNQNQNQNKNKNNN

SEQ ID NO: 3228492 - protein, 28 aa, Plasmodium falciparum
KKNKSKSNMKQDDYYTDSDQEENVQMNT

SEQ ID NO: 3228493 - protein, 9 aa, Plasmodium falciparum
KKNKSNSNY

SEQ ID NO: 3228494 - protein, 13 aa, Plasmodium falciparum
KKNKSSEKKIKNS

SEQ ID NO: 3228495 - protein, 8 aa, Plasmodium falciparum
KKNKTIKS

SEQ ID NO: 3228496 - protein, 16 aa, Plasmodium falciparum
KKNKTKDINNNKLPDS

SEQ ID NO: 3228497 - protein, 8 aa, Plasmodium falciparum
KKNKTKEN

SEQ ID NO: 3228498 - protein, 7 aa, Plasmodium falciparum
KKNKVGK

SEQ ID NO: 3228499 - protein, 7 aa, Plasmodium falciparum
KKNKVQE

SEQ ID NO: 3228500 - protein, 5 aa, Plasmodium falciparum
KKNKY

SEQ ID NO: 3228501 - protein, 15 aa, Plasmodium falciparum
KKNKYEENKNNNNIN

SEQ ID NO: 3228502 - protein, 13 aa, Plasmodium falciparum
KKNKYGKNAYEND

SEQ ID NO: 3228503 - protein, 5 aa, Plasmodium falciparum
KKNLE

SEQ ID NO: 3228504 - protein, 8 aa, Plasmodium falciparum
KKNLKEEK

SEQ ID NO: 3228505 - protein, 7 aa, Plasmodium falciparum
KKNLKKK

SEQ ID NO: 3228506 - protein, 7 aa, Plasmodium falciparum
KKNLNVK

SEQ ID NO: 3228507 - protein, 6 aa, Plasmodium falciparum
KKNLQS

SEQ ID NO: 3228508 - protein, 6 aa, Plasmodium falciparum
KKNLQY

SEQ ID NO: 3228509 - protein, 6 aa, Plasmodium falciparum
KKNMES

SEQ ID NO: 3228510 - protein, 111 aa, Plasmodium falciparum
KKNNAHKKCHDDKKNSDDGKKISDDKKISDDKKISDDKKISDDKKISDDKKISDDKKISDDKKISDDKKISDDKKISDDKKISDDKKISDDKKISDDKKISDDKQNNEYNN

SEQ ID NO: 3228511 - protein, 22 aa, Plasmodium falciparum
KKNNALNTGKRKNDRENYTNNH

SEQ ID NO: 3228512 - protein, 18 aa, Plasmodium falciparum
KKNNDHHYNNKSDNTNQF

SEQ ID NO: 3228513 - protein, 6 aa, Plasmodium falciparum
KKNNDI

SEQ ID NO: 3228514 - protein, 11 aa, Plasmodium falciparum
KKNNDNDNETY

SEQ ID NO: 3228515 - protein, 5 aa, Plasmodium falciparum
KKNNE

SEQ ID NO: 3228516 - protein, 8 aa, Plasmodium falciparum
KKNNEKED

SEQ ID NO: 3228517 - protein, 7 aa, Plasmodium falciparum
KKNNEKP

SEQ ID NO: 3228518 - protein, 7 aa, Plasmodium falciparum
KKNNEYY

SEQ ID NO: 3228519 - protein, 11 aa, Plasmodium falciparum
KKNNHVSSASE

SEQ ID NO: 3228520 - protein, 12 aa, Plasmodium falciparum
KKNNIKNNNNNN

SEQ ID NO: 3228521 - protein, 8 aa, Plasmodium falciparum
KKNNINNM

SEQ ID NO: 3228522 - protein, 15 aa, Plasmodium falciparum
KKNNITSQKCGSNNK

SEQ ID NO: 3228523 - protein, 6 aa, Plasmodium falciparum
KKNNKK

SEQ ID NO: 3228524 - protein, 7 aa, Plasmodium falciparum
KKNNKKK

SEQ ID NO: 3228525 - protein, 7 aa, Plasmodium falciparum
KKNNKLN

SEQ ID NO: 3228526 - protein, 13 aa, Plasmodium falciparum
KKNNKNGDNEGSD

SEQ ID NO: 3228527 - protein, 8 aa, Plasmodium falciparum
KKNNKRNM

SEQ ID NO: 3228528 - protein, 7 aa, Plasmodium falciparum
KKNNKSD

SEQ ID NO: 3228529 - protein, 8 aa, Plasmodium falciparum
KKNNKTTQ

SEQ ID NO: 3228530 - protein, 12 aa, Plasmodium falciparum
KKNNLNNNLNKS

SEQ ID NO: 3228531 - protein, 7 aa, Plasmodium falciparum
KKNNNFQ

SEQ ID NO: 3228532 - protein, 11 aa, Plasmodium falciparum
KKNNNGNVKKG

SEQ ID NO: 3228533 - protein, 23 aa, Plasmodium falciparum
KKNNNKDYEKKELSKDYNYKKEE

SEQ ID NO: 3228534 - protein, 6 aa, Plasmodium falciparum
KKNNNL

SEQ ID NO: 3228535 - protein, 6 aa, Plasmodium falciparum
KKNNNN

SEQ ID NO: 3228536 - protein, 7 aa, Plasmodium falciparum
KKNNNNI

SEQ ID NO: 3228537 - protein, 8 aa, Plasmodium falciparum
KKNNNNNN

SEQ ID NO: 3228538 - protein, 9 aa, Plasmodium falciparum
KKNNNNNNN

SEQ ID NO: 3228539 - protein, 15 aa, Plasmodium falciparum
KKNNNNNNNNNTFGD

SEQ ID NO: 3228540 - protein, 12 aa, Plasmodium falciparum
KKNNNPNDHNKN

SEQ ID NO: 3228541 - protein, 6 aa, Plasmodium falciparum
KKNNNV

SEQ ID NO: 3228542 - protein, 13 aa, Plasmodium falciparum
KKNNPGTDDTTKT

SEQ ID NO: 3228543 - protein, 8 aa, Plasmodium falciparum
KKNNPRNQ

SEQ ID NO: 3228544 - protein, 20 aa, Plasmodium falciparum
KKNNQEKVYSETEKNKEGFD

SEQ ID NO: 3228545 - protein, 6 aa, Plasmodium falciparum
KKNNQN

SEQ ID NO: 3228546 - protein, 10 aa, Plasmodium falciparum
KKNNRNDDIN

SEQ ID NO: 3228547 - protein, 5 aa, Plasmodium falciparum
KKNNS

SEQ ID NO: 3228548 - protein, 16 aa, Plasmodium falciparum
KKNNSGQMEENNTNDI

SEQ ID NO: 3228549 - protein, 13 aa, Plasmodium falciparum
KKNNSNNNNNNNN

SEQ ID NO: 3228550 - protein, 27 aa, Plasmodium falciparum
KKNNSTKVSNSSKKSTISNEDEISQKN

SEQ ID NO: 3228551 - protein, 46 aa, Plasmodium falciparum
KKNNTINNDNENNNNNNNSNNNNSNNNNNSNNNNSNNNNNNNNNNY

SEQ ID NO: 3228552 - protein, 6 aa, Plasmodium falciparum
KKNNTL

SEQ ID NO: 3228553 - protein, 6 aa, Plasmodium falciparum
KKNNVN

SEQ ID NO: 3228554 - protein, 19 aa, Plasmodium falciparum
KKNNVSYQNNNNNNNINVS

SEQ ID NO: 3228555 - protein, 7 aa, Plasmodium falciparum
KKNPKNL

SEQ ID NO: 3228556 - protein, 5 aa, Plasmodium falciparum
KKNPL

SEQ ID NO: 3228557 - protein, 89 aa, Plasmodium falciparum
KKNPLDKCNQQKKQKQQEQDTGPARSNTSADTPRNGPTVEEVDSEEELENEEEGEEGTPPEENGGGGGAEAKDTDRKGDRKVKETTEVT

SEQ ID NO: 3228558 - protein, 6 aa, Plasmodium falciparum
KKNPNQ

SEQ ID NO: 3228559 - protein, 7 aa, Plasmodium falciparum
KKNPTKF

SEQ ID NO: 3228560 - protein, 17 aa, Plasmodium falciparum
KKNPTNYYDSKNNGMST

SEQ ID NO: 3228561 - protein, 7 aa, Plasmodium falciparum
KKNPYQK

SEQ ID NO: 3228562 - protein, 4 aa, Plasmodium falciparum
KKNQ

SEQ ID NO: 3228563 - protein, 10 aa, Plasmodium falciparum
KKNQDHKAHG

SEQ ID NO: 3228564 - protein, 6 aa, Plasmodium falciparum
KKNQDL

SEQ ID NO: 3228565 - protein, 5 aa, Plasmodium falciparum
KKNQH

SEQ ID NO: 3228566 - protein, 8 aa, Plasmodium falciparum
KKNQKHKE

SEQ ID NO: 3228567 - protein, 6 aa, Plasmodium falciparum
KKNQKM

SEQ ID NO: 3228568 - protein, 6 aa, Plasmodium falciparum
KKNQKN

SEQ ID NO: 3228569 - protein, 8 aa, Plasmodium falciparum
KKNQKNEK

SEQ ID NO: 3228570 - protein, 9 aa, Plasmodium falciparum
KKNQNEHIS

SEQ ID NO: 3228571 - protein, 12 aa, Plasmodium falciparum
KKNQNKKKDEID

SEQ ID NO: 3228572 - protein, 7 aa, Plasmodium falciparum
KKNQNNI

SEQ ID NO: 3228573 - protein, 11 aa, Plasmodium falciparum
KKNQQKITHRN

SEQ ID NO: 3228574 - protein, 4 aa, Plasmodium falciparum
KKNR

SEQ ID NO: 3228575 - protein, 13 aa, Plasmodium falciparum
KKNRRDRKYKDNI

SEQ ID NO: 3228576 - protein, 28 aa, Plasmodium falciparum
KKNRRGKKAMAKRNNNNNNNNNNQNDNK

SEQ ID NO: 3228577 - protein, 7 aa, Plasmodium falciparum
KKNRTPK

SEQ ID NO: 3228578 - protein, 5 aa, Plasmodium falciparum
KKNRY

SEQ ID NO: 3228579 - protein, 6 aa, Plasmodium falciparum
KKNRYN

SEQ ID NO: 3228580 - protein, 9 aa, Plasmodium falciparum
KKNSEENNA

SEQ ID NO: 3228581 - protein, 10 aa, Plasmodium falciparum
KKNSGECKQS

SEQ ID NO: 3228582 - protein, 9 aa, Plasmodium falciparum
KKNSGGLEY

SEQ ID NO: 3228583 - protein, 7 aa, Plasmodium falciparum
KKNSGNY

SEQ ID NO: 3228584 - protein, 9 aa, Plasmodium falciparum
KKNSGVDKN

SEQ ID NO: 3228585 - protein, 7 aa, Plasmodium falciparum
KKNSIDN

SEQ ID NO: 3228586 - protein, 17 aa, Plasmodium falciparum
KKNSKSWDNQPNPEVKN

SEQ ID NO: 3228587 - protein, 42 aa, Plasmodium falciparum
KKNSLSVKKKTKKKYSSKAFKNKKENNTKNVYENKTHKKKKN

SEQ ID NO: 3228588 - protein, 13 aa, Plasmodium falciparum
KKNSNCSSSSNDV

SEQ ID NO: 3228589 - protein, 9 aa, Plasmodium falciparum
KKNSNNLNN

SEQ ID NO: 3228590 - protein, 8 aa, Plasmodium falciparum
KKNSQKEF

SEQ ID NO: 3228591 - protein, 8 aa, Plasmodium falciparum
KKNSSGLT

SEQ ID NO: 3228592 - protein, 7 aa, Plasmodium falciparum
KKNSSSY

SEQ ID NO: 3228593 - protein, 7 aa, Plasmodium falciparum
KKNSSYK

SEQ ID NO: 3228594 - protein, 7 aa, Plasmodium falciparum
KKNSTNV

SEQ ID NO: 3228595 - protein, 10 aa, Plasmodium falciparum
KKNSTTYKEE

SEQ ID NO: 3228596 - protein, 6 aa, Plasmodium falciparum
KKNSYE

SEQ ID NO: 3228597 - protein, 7 aa, Plasmodium falciparum
KKNSYLG

SEQ ID NO: 3228598 - protein, 7 aa, Plasmodium falciparum
KKNSYMN

SEQ ID NO: 3228599 - protein, 6 aa, Plasmodium falciparum
KKNTDI

SEQ ID NO: 3228600 - protein, 8 aa, Plasmodium falciparum
KKNTEKDR

SEQ ID NO: 3228601 - protein, 5 aa, Plasmodium falciparum
KKNTG

SEQ ID NO: 3228602 - protein, 26 aa, Plasmodium falciparum
KKNTKNRRKANTPNIYQTNKKKTGQW

SEQ ID NO: 3228603 - protein, 5 aa, Plasmodium falciparum
KKNTN

SEQ ID NO: 3228604 - protein, 8 aa, Plasmodium falciparum
KKNTNKEY

SEQ ID NO: 3228605 - protein, 6 aa, Plasmodium falciparum
KKNTNN

SEQ ID NO: 3228606 - protein, 12 aa, Plasmodium falciparum
KKNTSDNSFDNN

SEQ ID NO: 3228607 - protein, 18 aa, Plasmodium falciparum
KKNTSTNSVAKNTNSDPI

SEQ ID NO: 3228608 - protein, 7 aa, Plasmodium falciparum
KKNTTEK

SEQ ID NO: 3228609 - protein, 5 aa, Plasmodium falciparum
KKNTY

SEQ ID NO: 3228610 - protein, 8 aa, Plasmodium falciparum
KKNTYQMN

SEQ ID NO: 3228611 - protein, 4 aa, Plasmodium falciparum
KKNV

SEQ ID NO: 3228612 - protein, 6 aa, Plasmodium falciparum
KKNVDN

SEQ ID NO: 3228613 - protein, 9 aa, Plasmodium falciparum
KKNVDNKDI

SEQ ID NO: 3228614 - protein, 14 aa, Plasmodium falciparum
KKNVDNNDKVEKDN

SEQ ID NO: 3228615 - protein, 24 aa, Plasmodium falciparum
KKNVKEKDIHNNNNIDSSDNDVEA

SEQ ID NO: 3228616 - protein, 8 aa, Plasmodium falciparum
KKNVNENN

SEQ ID NO: 3228617 - protein, 8 aa, Plasmodium falciparum
KKNVNEYK

SEQ ID NO: 3228618 - protein, 8 aa, Plasmodium falciparum
KKNVSRTN

SEQ ID NO: 3228619 - protein, 20 aa, Plasmodium falciparum
KKNVSYNSQKKNESNSYNIR

SEQ ID NO: 3228620 - protein, 7 aa, Plasmodium falciparum
KKNVYKN

SEQ ID NO: 3228621 - protein, 6 aa, Plasmodium falciparum
KKNYDN

SEQ ID NO: 3228622 - protein, 7 aa, Plasmodium falciparum
KKNYIKN

SEQ ID NO: 3228623 - protein, 28 aa, Plasmodium falciparum
KKNYKKEHMNKNNKDNNNNNNNSNKDDH

SEQ ID NO: 3228624 - protein, 50 aa, Plasmodium falciparum
KKNYKKRNNNDDNNNNNNNNNNNNNNNNNNNNNNNNNNNNNNNNSSTCNN

SEQ ID NO: 3228625 - protein, 7 aa, Plasmodium falciparum
KKNYKQN

SEQ ID NO: 3228626 - protein, 6 aa, Plasmodium falciparum
KKNYNE

SEQ ID NO: 3228627 - protein, 7 aa, Plasmodium falciparum
KKNYNED

SEQ ID NO: 3228628 - protein, 7 aa, Plasmodium falciparum
KKNYNES

SEQ ID NO: 3228629 - protein, 7 aa, Plasmodium falciparum
KKNYNKL

SEQ ID NO: 3228630 - protein, 6 aa, Plasmodium falciparum
KKNYNQ

SEQ ID NO: 3228631 - protein, 8 aa, Plasmodium falciparum
KKNYPQKD

SEQ ID NO: 3228632 - protein, 9 aa, Plasmodium falciparum
KKNYSNNNI

SEQ ID NO: 3228633 - protein, 5 aa, Plasmodium falciparum
KKNYT

SEQ ID NO: 3228634 - protein, 6 aa, Plasmodium falciparum
KKNYTN

SEQ ID NO: 3228635 - protein, 22 aa, Plasmodium falciparum
KKNYTSCRKRSKELSNDGNTYK

SEQ ID NO: 3228636 - protein, 7 aa, Plasmodium falciparum
KKNYTSL

SEQ ID NO: 3228637 - protein, 25 aa, Plasmodium falciparum
KKNYYQYESENSSSDDDEEENKERL

SEQ ID NO: 3228638 - protein, 12 aa, Plasmodium falciparum
KKPAQKHYSDPH

SEQ ID NO: 3228639 - protein, 7 aa, Plasmodium falciparum
KKPAQKT

SEQ ID NO: 3228640 - protein, 8 aa, Plasmodium falciparum
KKPEKKLS

SEQ ID NO: 3228641 - protein, 7 aa, Plasmodium falciparum
KKPEVTR

SEQ ID NO: 3228642 - protein, 4 aa, Plasmodium falciparum
KKPF

SEQ ID NO: 3228643 - protein, 46 aa, Plasmodium falciparum
KKPHDDKSQNKYDPHNDQNYNNNNNNNNNNNNNNNNNNNNNNNNDN

SEQ ID NO: 3228644 - protein, 7 aa, Plasmodium falciparum
KKPHNIE

SEQ ID NO: 3228645 - protein, 17 aa, Plasmodium falciparum
KKPHSSDENGSLNDEDK

SEQ ID NO: 3228646 - protein, 8 aa, Plasmodium falciparum
KKPHTTAR

SEQ ID NO: 3228647 - protein, 93 aa, Plasmodium falciparum
KKPIDDCKKEREVQEESEEESEEESEEESEEESEEESEEESEEESEEESEEESEEESEEESEEESEEESEEESEEESEEESEEESDEEKNTSG

SEQ ID NO: 3228648 - protein, 8 aa, Plasmodium falciparum
KKPITPEG

SEQ ID NO: 3228649 - protein, 8 aa, Plasmodium falciparum
KKPKEAEK

SEQ ID NO: 3228650 - protein, 6 aa, Plasmodium falciparum
KKPKEE

SEQ ID NO: 3228651 - protein, 9 aa, Plasmodium falciparum
KKPKNKKGV

SEQ ID NO: 3228652 - protein, 20 aa, Plasmodium falciparum
KKPNANLDDTSLSSNNLKST

SEQ ID NO: 3228653 - protein, 21 aa, Plasmodium falciparum
KKPNKREEGIHKNDNKEIYTN

SEQ ID NO: 3228654 - protein, 9 aa, Plasmodium falciparum
KKPNNTNKV

SEQ ID NO: 3228655 - protein, 10 aa, Plasmodium falciparum
KKPNQSKENI

SEQ ID NO: 3228656 - protein, 14 aa, Plasmodium falciparum
KKPNSDNGDDSYYE

SEQ ID NO: 3228657 - protein, 8 aa, Plasmodium falciparum
KKPPKSNY

SEQ ID NO: 3228658 - protein, 7 aa, Plasmodium falciparum
KKPPNAL

SEQ ID NO: 3228659 - protein, 9 aa, Plasmodium falciparum
KKPPNNGVN

SEQ ID NO: 3228660 - protein, 6 aa, Plasmodium falciparum
KKPPQP

SEQ ID NO: 3228661 - protein, 13 aa, Plasmodium falciparum
KKPPYTPPDGAKC

SEQ ID NO: 3228662 - protein, 4 aa, Plasmodium falciparum
KKPQ

SEQ ID NO: 3228663 - protein, 31 aa, Plasmodium falciparum
KKPQKYTINEKRDDIKTKKKRSKEKKKQDKL

SEQ ID NO: 3228664 - protein, 7 aa, Plasmodium falciparum
KKPSIEE

SEQ ID NO: 3228665 - protein, 7 aa, Plasmodium falciparum
KKPSISP

SEQ ID NO: 3228666 - protein, 6 aa, Plasmodium falciparum
KKPSIT

SEQ ID NO: 3228667 - protein, 9 aa, Plasmodium falciparum
KKPSITPHH

SEQ ID NO: 3228668 - protein, 7 aa, Plasmodium falciparum
KKPSITS

SEQ ID NO: 3228669 - protein, 14 aa, Plasmodium falciparum
KKPSKPNKNKGKFK

SEQ ID NO: 3228670 - protein, 7 aa, Plasmodium falciparum
KKPSKYE

SEQ ID NO: 3228671 - protein, 4 aa, Plasmodium falciparum
KKPT

SEQ ID NO: 3228672 - protein, 6 aa, Plasmodium falciparum
KKQDKK

SEQ ID NO: 3228673 - protein, 6 aa, Plasmodium falciparum
KKQEDL

SEQ ID NO: 3228674 - protein, 12 aa, Plasmodium falciparum
KKQEEDKKKEET

SEQ ID NO: 3228675 - protein, 15 aa, Plasmodium falciparum
KKQEGEDNNYNSNIN

SEQ ID NO: 3228676 - protein, 22 aa, Plasmodium falciparum
KKQELQKNASGVKKDSSRHSNN

SEQ ID NO: 3228677 - protein, 8 aa, Plasmodium falciparum
KKQENTYK

SEQ ID NO: 3228678 - protein, 7 aa, Plasmodium falciparum
KKQENVH

SEQ ID NO: 3228679 - protein, 7 aa, Plasmodium falciparum
KKQGNIQ

SEQ ID NO: 3228680 - protein, 12 aa, Plasmodium falciparum
KKQGQNEETVDK

SEQ ID NO: 3228681 - protein, 7 aa, Plasmodium falciparum
KKQHISS

SEQ ID NO: 3228682 - protein, 6 aa, Plasmodium falciparum
KKQHLT

SEQ ID NO: 3228683 - protein, 6 aa, Plasmodium falciparum
KKQIEE

SEQ ID NO: 3228684 - protein, 6 aa, Plasmodium falciparum
KKQIEK

SEQ ID NO: 3228685 - protein, 44 aa, Plasmodium falciparum
KKQKDENNSNNYSNNSSNNNSPNNDDNIYNNNNNNNNNNNDYNN

SEQ ID NO: 3228686 - protein, 48 aa, Plasmodium falciparum
KKQKDGILNESSNEEDEEKYTLNSETYNNKNNVSNIKNDSIKSKKEEY

SEQ ID NO: 3228687 - protein, 9 aa, Plasmodium falciparum
KKQKDYNDN

SEQ ID NO: 3228688 - protein, 9 aa, Plasmodium falciparum
KKQKEEEID

SEQ ID NO: 3228689 - protein, 16 aa, Plasmodium falciparum
KKQKGNCKKESAGATE

SEQ ID NO: 3228690 - protein, 8 aa, Plasmodium falciparum
KKQKKKNI

SEQ ID NO: 3228691 - protein, 5 aa, Plasmodium falciparum
KKQKN

SEQ ID NO: 3228692 - protein, 29 aa, Plasmodium falciparum
KKQKNDSKITKERTAQDDNSSVLSDGKSM

SEQ ID NO: 3228693 - protein, 9 aa, Plasmodium falciparum
KKQKPEEEN

SEQ ID NO: 3228694 - protein, 9 aa, Plasmodium falciparum
KKQKPPKNL

SEQ ID NO: 3228695 - protein, 5 aa, Plasmodium falciparum
KKQKS

SEQ ID NO: 3228696 - protein, 10 aa, Plasmodium falciparum
KKQKYNNYNN

SEQ ID NO: 3228697 - protein, 12 aa, Plasmodium falciparum
KKQLGSSSSRAL

SEQ ID NO: 3228698 - protein, 5 aa, Plasmodium falciparum
KKQLK

SEQ ID NO: 3228699 - protein, 6 aa, Plasmodium falciparum
KKQLTD

SEQ ID NO: 3228700 - protein, 7 aa, Plasmodium falciparum
KKQMENR

SEQ ID NO: 3228701 - protein, 6 aa, Plasmodium falciparum
KKQNEF

SEQ ID NO: 3228702 - protein, 12 aa, Plasmodium falciparum
KKQNKKKKCTNE

SEQ ID NO: 3228703 - protein, 8 aa, Plasmodium falciparum
KKQNKQKK

SEQ ID NO: 3228704 - protein, 11 aa, Plasmodium falciparum
KKQNKRDKQRL

SEQ ID NO: 3228705 - protein, 8 aa, Plasmodium falciparum
KKQNMANK

SEQ ID NO: 3228706 - protein, 10 aa, Plasmodium falciparum
KKQNNDSNID

SEQ ID NO: 3228707 - protein, 9 aa, Plasmodium falciparum
KKQNNKKKN

SEQ ID NO: 3228708 - protein, 10 aa, Plasmodium falciparum
KKQPAQEGAG

SEQ ID NO: 3228709 - protein, 29 aa, Plasmodium falciparum
KKQQQKYKKNIKRNKKDKDNEKIETKKKK

SEQ ID NO: 3228710 - protein, 19 aa, Plasmodium falciparum
KKQQQNKIRGKKNKNTKAI

SEQ ID NO: 3228711 - protein, 9 aa, Plasmodium falciparum
KKQQTDDNT

SEQ ID NO: 3228712 - protein, 8 aa, Plasmodium falciparum
KKQRKKKN

SEQ ID NO: 3228713 - protein, 10 aa, Plasmodium falciparum
KKQRKNGDNV

SEQ ID NO: 3228714 - protein, 25 aa, Plasmodium falciparum
KKQRNKKKNNTNDKNAQPEKDDDGF

SEQ ID NO: 3228715 - protein, 4 aa, Plasmodium falciparum
KKQS

SEQ ID NO: 3228716 - protein, 6 aa, Plasmodium falciparum
KKQSDN

SEQ ID NO: 3228717 - protein, 7 aa, Plasmodium falciparum
KKQSQDI

SEQ ID NO: 3228718 - protein, 6 aa, Plasmodium falciparum
KKQSTD

SEQ ID NO: 3228719 - protein, 54 aa, Plasmodium falciparum
KKQTDKRRRERGRERGREKGRDIDRNRERERERRRRKKKKKKKKGIKRKENDDI

SEQ ID NO: 3228720 - protein, 6 aa, Plasmodium falciparum
KKQTFQ

SEQ ID NO: 3228721 - protein, 5 aa, Plasmodium falciparum
KKQTI

SEQ ID NO: 3228722 - protein, 7 aa, Plasmodium falciparum
KKQTKIN

SEQ ID NO: 3228723 - protein, 30 aa, Plasmodium falciparum
KKQTKRNNINQNKKKKKKNNNNNNNNNNNN

SEQ ID NO: 3228724 - protein, 8 aa, Plasmodium falciparum
KKQTNQND

SEQ ID NO: 3228725 - protein, 7 aa, Plasmodium falciparum
KKQTPSY

SEQ ID NO: 3228726 - protein, 9 aa, Plasmodium falciparum
KKQTSRRCK

SEQ ID NO: 3228727 - protein, 6 aa, Plasmodium falciparum
KKQTYK

SEQ ID NO: 3228728 - protein, 12 aa, Plasmodium falciparum
KKQVKTKSHTDK

SEQ ID NO: 3228729 - protein, 8 aa, Plasmodium falciparum
KKQYINND

SEQ ID NO: 3228730 - protein, 6 aa, Plasmodium falciparum
KKQYNN

SEQ ID NO: 3228731 - protein, 8 aa, Plasmodium falciparum
KKQYNNYD

SEQ ID NO: 3228732 - protein, 4 aa, Plasmodium falciparum
KKRA

SEQ ID NO: 3228733 - protein, 28 aa, Plasmodium falciparum
KKRCKKSKPKENKNYSYENKQDEDIKEE

SEQ ID NO: 3228734 - protein, 15 aa, Plasmodium falciparum
KKRDEKNNKFGENNM

SEQ ID NO: 3228735 - protein, 18 aa, Plasmodium falciparum
KKRDGIISDDESENNSSK

SEQ ID NO: 3228736 - protein, 6 aa, Plasmodium falciparum
KKRDNH

SEQ ID NO: 3228737 - protein, 4 aa, Plasmodium falciparum
KKRE

SEQ ID NO: 3228738 - protein, 12 aa, Plasmodium falciparum
KKREEEKRRRRR

SEQ ID NO: 3228739 - protein, 31 aa, Plasmodium falciparum
KKREGNNNSLENFNNNNNSKYKKEEDNYTNV

SEQ ID NO: 3228740 - protein, 7 aa, Plasmodium falciparum
KKREKDF

SEQ ID NO: 3228741 - protein, 12 aa, Plasmodium falciparum
KKREKKISYTEN

SEQ ID NO: 3228742 - protein, 13 aa, Plasmodium falciparum
KKRERKKKESQKI

SEQ ID NO: 3228743 - protein, 9 aa, Plasmodium falciparum
KKREWSNNK

SEQ ID NO: 3228744 - protein, 11 aa, Plasmodium falciparum
KKRFENNQERN

SEQ ID NO: 3228745 - protein, 14 aa, Plasmodium falciparum
KKRGEYKKNESNNN

SEQ ID NO: 3228746 - protein, 5 aa, Plasmodium falciparum
KKRGK

SEQ ID NO: 3228747 - protein, 8 aa, Plasmodium falciparum
KKRGKCTN

SEQ ID NO: 3228748 - protein, 9 aa, Plasmodium falciparum
KKRGKRRKR

SEQ ID NO: 3228749 - protein, 8 aa, Plasmodium falciparum
KKRGNEKR

SEQ ID NO: 3228750 - protein, 7 aa, Plasmodium falciparum
KKRGNKS

SEQ ID NO: 3228751 - protein, 9 aa, Plasmodium falciparum
KKRGPNECK

SEQ ID NO: 3228752 - protein, 8 aa, Plasmodium falciparum
KKRGSKKL

SEQ ID NO: 3228753 - protein, 7 aa, Plasmodium falciparum
KKRGTGL

SEQ ID NO: 3228754 - protein, 7 aa, Plasmodium falciparum
KKRHDKK

SEQ ID NO: 3228755 - protein, 7 aa, Plasmodium falciparum
KKRINKM

SEQ ID NO: 3228756 - protein, 7 aa, Plasmodium falciparum
KKRKCNN

SEQ ID NO: 3228757 - protein, 9 aa, Plasmodium falciparum
KKRKDQGYN

SEQ ID NO: 3228758 - protein, 5 aa, Plasmodium falciparum
KKRKE

SEQ ID NO: 3228759 - protein, 10 aa, Plasmodium falciparum
KKRKEEYNKK

SEQ ID NO: 3228760 - protein, 7 aa, Plasmodium falciparum
KKRKGAK

SEQ ID NO: 3228761 - protein, 8 aa, Plasmodium falciparum
KKRKIEKK

SEQ ID NO: 3228762 - protein, 14 aa, Plasmodium falciparum
KKRKIQTNKPNETI

SEQ ID NO: 3228763 - protein, 12 aa, Plasmodium falciparum
KKRKKEKKRKQK

SEQ ID NO: 3228764 - protein, 8 aa, Plasmodium falciparum
KKRKKGNV

SEQ ID NO: 3228765 - protein, 8 aa, Plasmodium falciparum
KKRKKGSK

SEQ ID NO: 3228766 - protein, 6 aa, Plasmodium falciparum
KKRKKK

SEQ ID NO: 3228767 - protein, 13 aa, Plasmodium falciparum
KKRKKKHTGRRKE

SEQ ID NO: 3228768 - protein, 22 aa, Plasmodium falciparum
KKRKKKITIKNSAKRKNNKNIK

SEQ ID NO: 3228769 - protein, 9 aa, Plasmodium falciparum
KKRKKKKKK

SEQ ID NO: 3228770 - protein, 8 aa, Plasmodium falciparum
KKRKKKKL

SEQ ID NO: 3228771 - protein, 39 aa, Plasmodium falciparum
KKRKKKRKKKNEQEKNKEHEKEKEKYQEQQEEHKEEATR

SEQ ID NO: 3228772 - protein, 7 aa, Plasmodium falciparum
KKRKKNI

SEQ ID NO: 3228773 - protein, 14 aa, Plasmodium falciparum
KKRKKRKKEKKIDQ

SEQ ID NO: 3228774 - protein, 6 aa, Plasmodium falciparum
KKRKNK

SEQ ID NO: 3228775 - protein, 8 aa, Plasmodium falciparum
KKRKNMKR

SEQ ID NO: 3228776 - protein, 9 aa, Plasmodium falciparum
KKRKNTKKD

SEQ ID NO: 3228777 - protein, 19 aa, Plasmodium falciparum
KKRKNVSTYGTNNNDENQY

SEQ ID NO: 3228778 - protein, 6 aa, Plasmodium falciparum
KKRKPL

SEQ ID NO: 3228779 - protein, 11 aa, Plasmodium falciparum
KKRKQNYKGES

SEQ ID NO: 3228780 - protein, 14 aa, Plasmodium falciparum
KKRKSRLEENNDKK

SEQ ID NO: 3228781 - protein, 9 aa, Plasmodium falciparum
KKRKTKVKK

SEQ ID NO: 3228782 - protein, 7 aa, Plasmodium falciparum
KKRKTLG

SEQ ID NO: 3228783 - protein, 4 aa, Plasmodium falciparum
KKRL

SEQ ID NO: 3228784 - protein, 8 aa, Plasmodium falciparum
KKRLDEKK

SEQ ID NO: 3228785 - protein, 5 aa, Plasmodium falciparum
KKRLE

SEQ ID NO: 3228786 - protein, 4 aa, Plasmodium falciparum
KKRN

SEQ ID NO: 3228787 - protein, 18 aa, Plasmodium falciparum
KKRNDSTGNDNDNDNDNN

SEQ ID NO: 3228788 - protein, 9 aa, Plasmodium falciparum
KKRNEEESS

SEQ ID NO: 3228789 - protein, 7 aa, Plasmodium falciparum
KKRNEHI

SEQ ID NO: 3228790 - protein, 8 aa, Plasmodium falciparum
KKRNESKN

SEQ ID NO: 3228791 - protein, 10 aa, Plasmodium falciparum
KKRNISQSTS

SEQ ID NO: 3228792 - protein, 8 aa, Plasmodium falciparum
KKRNKHKI

SEQ ID NO: 3228793 - protein, 7 aa, Plasmodium falciparum
KKRNKIN

SEQ ID NO: 3228794 - protein, 9 aa, Plasmodium falciparum
KKRNKLNDN

SEQ ID NO: 3228795 - protein, 9 aa, Plasmodium falciparum
KKRNKNDNI

SEQ ID NO: 3228796 - protein, 8 aa, Plasmodium falciparum
KKRNKQKE

SEQ ID NO: 3228797 - protein, 60 aa, Plasmodium falciparum
KKRNNKSNHNNKNNNNNKNNNNNKNNNKNNNNNKDNNKNNSNDNNNINMDNNNKNNNNKI

SEQ ID NO: 3228798 - protein, 9 aa, Plasmodium falciparum
KKRNNPMYN

SEQ ID NO: 3228799 - protein, 9 aa, Plasmodium falciparum
KKRNNRIED

SEQ ID NO: 3228800 - protein, 5 aa, Plasmodium falciparum
KKRNR

SEQ ID NO: 3228801 - protein, 7 aa, Plasmodium falciparum
KKRNSLQ

SEQ ID NO: 3228802 - protein, 8 aa, Plasmodium falciparum
KKRNTGHE

SEQ ID NO: 3228803 - protein, 6 aa, Plasmodium falciparum
KKRNVK

SEQ ID NO: 3228804 - protein, 8 aa, Plasmodium falciparum
KKRNYEEL

SEQ ID NO: 3228805 - protein, 8 aa, Plasmodium falciparum
KKRNYKTI

SEQ ID NO: 3228806 - protein, 8 aa, Plasmodium falciparum
KKRPNQEK

SEQ ID NO: 3228807 - protein, 22 aa, Plasmodium falciparum
KKRPQRGSTPDEKYKGGEIKGN

SEQ ID NO: 3228808 - protein, 5 aa, Plasmodium falciparum
KKRQI

SEQ ID NO: 3228809 - protein, 11 aa, Plasmodium falciparum
KKRQKNEKGLE

SEQ ID NO: 3228810 - protein, 9 aa, Plasmodium falciparum
KKRQPFEGN

SEQ ID NO: 3228811 - protein, 7 aa, Plasmodium falciparum
KKRQQSR

SEQ ID NO: 3228812 - protein, 5 aa, Plasmodium falciparum
KKRQT

SEQ ID NO: 3228813 - protein, 37 aa, Plasmodium falciparum
KKRRKQCTDNNTNDIHTRKDKRSNIDKPCTDKNKIPN

SEQ ID NO: 3228814 - protein, 7 aa, Plasmodium falciparum
KKRRNKH

SEQ ID NO: 3228815 - protein, 12 aa, Plasmodium falciparum
KKRRNVEDDGKM

SEQ ID NO: 3228816 - protein, 25 aa, Plasmodium falciparum
KKRRNVQNNKIGKDKKNKSKDTERE

SEQ ID NO: 3228817 - protein, 13 aa, Plasmodium falciparum
KKRSASRSPHLKL

SEQ ID NO: 3228818 - protein, 13 aa, Plasmodium falciparum
KKRTHEKTKGKNY

SEQ ID NO: 3228819 - protein, 7 aa, Plasmodium falciparum
KKRTIND

SEQ ID NO: 3228820 - protein, 46 aa, Plasmodium falciparum
KKRTKEKTKKKIESNINNNNNNNNKNNSDDDDNKNEDAKRTRREEV

SEQ ID NO: 3228821 - protein, 25 aa, Plasmodium falciparum
KKRTPTSLSHSNNKKDVTTDNYKSS

SEQ ID NO: 3228822 - protein, 12 aa, Plasmodium falciparum
KKRTQFSQETKT

SEQ ID NO: 3228823 - protein, 5 aa, Plasmodium falciparum
KKRVE

SEQ ID NO: 3228824 - protein, 9 aa, Plasmodium falciparum
KKRVRKNTN

SEQ ID NO: 3228825 - protein, 27 aa, Plasmodium falciparum
KKRVSSDDEDDDDNEQGKNKNNSNNKV

SEQ ID NO: 3228826 - protein, 9 aa, Plasmodium falciparum
KKRYNKSHE

SEQ ID NO: 3228827 - protein, 11 aa, Plasmodium falciparum
KKSAKNPDEER

SEQ ID NO: 3228828 - protein, 6 aa, Plasmodium falciparum
KKSALR

SEQ ID NO: 3228829 - protein, 17 aa, Plasmodium falciparum
KKSAYKGNKKLGNNKKS

SEQ ID NO: 3228830 - protein, 7 aa, Plasmodium falciparum
KKSDENI

SEQ ID NO: 3228831 - protein, 21 aa, Plasmodium falciparum
KKSDGSGGWEKRSETDNCTRG

SEQ ID NO: 3228832 - protein, 6 aa, Plasmodium falciparum
KKSDIC

SEQ ID NO: 3228833 - protein, 15 aa, Plasmodium falciparum
KKSDNKEKEEEEEEV

SEQ ID NO: 3228834 - protein, 11 aa, Plasmodium falciparum
KKSDPHNNDFQ

SEQ ID NO: 3228835 - protein, 15 aa, Plasmodium falciparum
KKSDTRGENGAISGN

SEQ ID NO: 3228836 - protein, 8 aa, Plasmodium falciparum
KKSEFNHP

SEQ ID NO: 3228837 - protein, 28 aa, Plasmodium falciparum
KKSEGKKNEIPVENKNTKDNVKRNEKNV

SEQ ID NO: 3228838 - protein, 6 aa, Plasmodium falciparum
KKSEGN

SEQ ID NO: 3228839 - protein, 6 aa, Plasmodium falciparum
KKSEIE

SEQ ID NO: 3228840 - protein, 15 aa, Plasmodium falciparum
KKSERNNSKEENVNN

SEQ ID NO: 3228841 - protein, 8 aa, Plasmodium falciparum
KKSEYDKE

SEQ ID NO: 3228842 - protein, 4 aa, Plasmodium falciparum
KKSF

SEQ ID NO: 3228843 - protein, 5 aa, Plasmodium falciparum
KKSFN

SEQ ID NO: 3228844 - protein, 6 aa, Plasmodium falciparum
KKSFRN

SEQ ID NO: 3228845 - protein, 19 aa, Plasmodium falciparum
KKSFSKKCENDENNNDSYS

SEQ ID NO: 3228846 - protein, 8 aa, Plasmodium falciparum
KKSGDKDM

SEQ ID NO: 3228847 - protein, 7 aa, Plasmodium falciparum
KKSGERR

SEQ ID NO: 3228848 - protein, 7 aa, Plasmodium falciparum
KKSGHGG

SEQ ID NO: 3228849 - protein, 11 aa, Plasmodium falciparum
KKSGKKNEMKN

SEQ ID NO: 3228850 - protein, 8 aa, Plasmodium falciparum
KKSGMEKK

SEQ ID NO: 3228851 - protein, 7 aa, Plasmodium falciparum
KKSGNKI

SEQ ID NO: 3228852 - protein, 7 aa, Plasmodium falciparum
KKSGNKN

SEQ ID NO: 3228853 - protein, 8 aa, Plasmodium falciparum
KKSGNTYN

SEQ ID NO: 3228854 - protein, 8 aa, Plasmodium falciparum
KKSHNDNN

SEQ ID NO: 3228855 - protein, 6 aa, Plasmodium falciparum
KKSHWK

SEQ ID NO: 3228856 - protein, 18 aa, Plasmodium falciparum
KKSIEETKENEKNGRVRK

SEQ ID NO: 3228857 - protein, 6 aa, Plasmodium falciparum
KKSIES

SEQ ID NO: 3228858 - protein, 13 aa, Plasmodium falciparum
KKSIKDSTTPNLT

SEQ ID NO: 3228859 - protein, 8 aa, Plasmodium falciparum
KKSIKDTK

SEQ ID NO: 3228860 - protein, 6 aa, Plasmodium falciparum
KKSILK

SEQ ID NO: 3228861 - protein, 9 aa, Plasmodium falciparum
KKSINDADD

SEQ ID NO: 3228862 - protein, 15 aa, Plasmodium falciparum
KKSININTNQNRIDQ

SEQ ID NO: 3228863 - protein, 7 aa, Plasmodium falciparum
KKSITGR

SEQ ID NO: 3228864 - protein, 8 aa, Plasmodium falciparum
KKSIYNKK

SEQ ID NO: 3228865 - protein, 15 aa, Plasmodium falciparum
KKSKCLKEGGLKQSL

SEQ ID NO: 3228866 - protein, 6 aa, Plasmodium falciparum
KKSKDE

SEQ ID NO: 3228867 - protein, 13 aa, Plasmodium falciparum
KKSKDKKKMKKEI

SEQ ID NO: 3228868 - protein, 8 aa, Plasmodium falciparum
KKSKHTQN

SEQ ID NO: 3228869 - protein, 20 aa, Plasmodium falciparum
KKSKKEKENTQQKGGNNPNV

SEQ ID NO: 3228870 - protein, 12 aa, Plasmodium falciparum
KKSKKKKKKKSL

SEQ ID NO: 3228871 - protein, 9 aa, Plasmodium falciparum
KKSKKNRYE

SEQ ID NO: 3228872 - protein, 13 aa, Plasmodium falciparum
KKSKMKENTPKNL

SEQ ID NO: 3228873 - protein, 8 aa, Plasmodium falciparum
KKSKNLKG

SEQ ID NO: 3228874 - protein, 35 aa, Plasmodium falciparum
KKSKNNMNNNMNNNNDHNNHNNTDSNKEVESNNSY

SEQ ID NO: 3228875 - protein, 7 aa, Plasmodium falciparum
KKSKPFN

SEQ ID NO: 3228876 - protein, 16 aa, Plasmodium falciparum
KKSKPGEECEDENEHE

SEQ ID NO: 3228877 - protein, 6 aa, Plasmodium falciparum
KKSKRE

SEQ ID NO: 3228878 - protein, 11 aa, Plasmodium falciparum
KKSKSIKTPIS

SEQ ID NO: 3228879 - protein, 6 aa, Plasmodium falciparum
KKSKVK

SEQ ID NO: 3228880 - protein, 4 aa, Plasmodium falciparum
KKSL

SEQ ID NO: 3228881 - protein, 7 aa, Plasmodium falciparum
KKSLDEK

SEQ ID NO: 3228882 - protein, 13 aa, Plasmodium falciparum
KKSMGRKKVTSEY

SEQ ID NO: 3228883 - protein, 7 aa, Plasmodium falciparum
KKSMSTL

SEQ ID NO: 3228884 - protein, 4 aa, Plasmodium falciparum
KKSN

SEQ ID NO: 3228885 - protein, 8 aa, Plasmodium falciparum
KKSNAKNN

SEQ ID NO: 3228886 - protein, 15 aa, Plasmodium falciparum
KKSNDKKNNNQDDTH

SEQ ID NO: 3228887 - protein, 7 aa, Plasmodium falciparum
KKSNDNL

SEQ ID NO: 3228888 - protein, 14 aa, Plasmodium falciparum
KKSNEETKKNISEN

SEQ ID NO: 3228889 - protein, 7 aa, Plasmodium falciparum
KKSNHTY

SEQ ID NO: 3228890 - protein, 6 aa, Plasmodium falciparum
KKSNLK

SEQ ID NO: 3228891 - protein, 9 aa, Plasmodium falciparum
KKSNNKINE

SEQ ID NO: 3228892 - protein, 9 aa, Plasmodium falciparum
KKSNNSSSS

SEQ ID NO: 3228893 - protein, 14 aa, Plasmodium falciparum
KKSNNTKQNLSTYT

SEQ ID NO: 3228894 - protein, 7 aa, Plasmodium falciparum
KKSNRGN

SEQ ID NO: 3228895 - protein, 6 aa, Plasmodium falciparum
KKSNTH

SEQ ID NO: 3228896 - protein, 10 aa, Plasmodium falciparum
KKSNTNKEVY

SEQ ID NO: 3228897 - protein, 12 aa, Plasmodium falciparum
KKSNYDKTKKRP

SEQ ID NO: 3228898 - protein, 6 aa, Plasmodium falciparum
KKSNYT

SEQ ID NO: 3228899 - protein, 8 aa, Plasmodium falciparum
KKSPIEED

SEQ ID NO: 3228900 - protein, 9 aa, Plasmodium falciparum
KKSPLNEEE

SEQ ID NO: 3228901 - protein, 13 aa, Plasmodium falciparum
KKSPSDSNSENDL

SEQ ID NO: 3228902 - protein, 8 aa, Plasmodium falciparum
KKSPSNQD

SEQ ID NO: 3228903 - protein, 7 aa, Plasmodium falciparum
KKSQDRL

SEQ ID NO: 3228904 - protein, 9 aa, Plasmodium falciparum
KKSQNYNSL

SEQ ID NO: 3228905 - protein, 8 aa, Plasmodium falciparum
KKSQSFKH

SEQ ID NO: 3228906 - protein, 8 aa, Plasmodium falciparum
KKSREDDL

SEQ ID NO: 3228907 - protein, 8 aa, Plasmodium falciparum
KKSRGNIY

SEQ ID NO: 3228908 - protein, 8 aa, Plasmodium falciparum
KKSRKGKD

SEQ ID NO: 3228909 - protein, 21 aa, Plasmodium falciparum
KKSRKGSRRNSKNRANTQNIA

SEQ ID NO: 3228910 - protein, 5 aa, Plasmodium falciparum
KKSRL

SEQ ID NO: 3228911 - protein, 6 aa, Plasmodium falciparum
KKSRNY

SEQ ID NO: 3228912 - protein, 6 aa, Plasmodium falciparum
KKSRRN

SEQ ID NO: 3228913 - protein, 8 aa, Plasmodium falciparum
KKSRSKNC

SEQ ID NO: 3228914 - protein, 7 aa, Plasmodium falciparum
KKSSDEN

SEQ ID NO: 3228915 - protein, 5 aa, Plasmodium falciparum
KKSSE

SEQ ID NO: 3228916 - protein, 14 aa, Plasmodium falciparum
KKSSEHKSIDGNAN

SEQ ID NO: 3228917 - protein, 7 aa, Plasmodium falciparum
KKSSEYN

SEQ ID NO: 3228918 - protein, 5 aa, Plasmodium falciparum
KKSSI

SEQ ID NO: 3228919 - protein, 7 aa, Plasmodium falciparum
KKSSIIK

SEQ ID NO: 3228920 - protein, 19 aa, Plasmodium falciparum
KKSSNDDKDNNENCSNEKK

SEQ ID NO: 3228921 - protein, 7 aa, Plasmodium falciparum
KKSSSSF

SEQ ID NO: 3228922 - protein, 25 aa, Plasmodium falciparum
KKSSSSSSYDEGSSNLSNMDSSEYL

SEQ ID NO: 3228923 - protein, 8 aa, Plasmodium falciparum
KKSSTNDL

SEQ ID NO: 3228924 - protein, 7 aa, Plasmodium falciparum
KKSSVQI

SEQ ID NO: 3228925 - protein, 6 aa, Plasmodium falciparum
KKSTKR

SEQ ID NO: 3228926 - protein, 11 aa, Plasmodium falciparum
KKSTKYKNNNA

SEQ ID NO: 3228927 - protein, 6 aa, Plasmodium falciparum
KKSTNA

SEQ ID NO: 3228928 - protein, 7 aa, Plasmodium falciparum
KKSTNTI

SEQ ID NO: 3228929 - protein, 8 aa, Plasmodium falciparum
KKSTTLGI

SEQ ID NO: 3228930 - protein, 4 aa, Plasmodium falciparum
KKSV

SEQ ID NO: 3228931 - protein, 6 aa, Plasmodium falciparum
KKSVGE

SEQ ID NO: 3228932 - protein, 5 aa, Plasmodium falciparum
KKSVM

SEQ ID NO: 3228933 - protein, 4 aa, Plasmodium falciparum
KKSY

SEQ ID NO: 3228934 - protein, 9 aa, Plasmodium falciparum
KKSYEESNS

SEQ ID NO: 3228935 - protein, 7 aa, Plasmodium falciparum
KKSYLGS

SEQ ID NO: 3228936 - protein, 6 aa, Plasmodium falciparum
KKSYSN

SEQ ID NO: 3228937 - protein, 6 aa, Plasmodium falciparum
KKSYSR

SEQ ID NO: 3228938 - protein, 6 aa, Plasmodium falciparum
KKTAGS

SEQ ID NO: 3228939 - protein, 5 aa, Plasmodium falciparum
KKTDE

SEQ ID NO: 3228940 - protein, 10 aa, Plasmodium falciparum
KKTDEQKNRE

SEQ ID NO: 3228941 - protein, 8 aa, Plasmodium falciparum
KKTDNFNN

SEQ ID NO: 3228942 - protein, 23 aa, Plasmodium falciparum
KKTDQKENTQQEQSIEKNEKEKS

SEQ ID NO: 3228943 - protein, 13 aa, Plasmodium falciparum
KKTDTDHNKNTYN

SEQ ID NO: 3228944 - protein, 8 aa, Plasmodium falciparum
KKTEENVN

SEQ ID NO: 3228945 - protein, 7 aa, Plasmodium falciparum
KKTEEWP

SEQ ID NO: 3228946 - protein, 6 aa, Plasmodium falciparum
KKTEHK

SEQ ID NO: 3228947 - protein, 7 aa, Plasmodium falciparum
KKTEQRD

SEQ ID NO: 3228948 - protein, 7 aa, Plasmodium falciparum
KKTEQRF

SEQ ID NO: 3228949 - protein, 9 aa, Plasmodium falciparum
KKTEYDEQQ

SEQ ID NO: 3228950 - protein, 8 aa, Plasmodium falciparum
KKTEYEKQ

SEQ ID NO: 3228951 - protein, 39 aa, Plasmodium falciparum
KKTEYEKQKKAYEEQKSNYENEQKDKCQTQSNNNANEFS

SEQ ID NO: 3228952 - protein, 28 aa, Plasmodium falciparum
KKTEYEKQKKEYSEQQKKCVNGSNNHRN

SEQ ID NO: 3228953 - protein, 28 aa, Plasmodium falciparum
KKTEYENQQKAYTGQKKKYEEESKGGVN

SEQ ID NO: 3228954 - protein, 14 aa, Plasmodium falciparum
KKTEYMQEEEEEEE

SEQ ID NO: 3228955 - protein, 4 aa, Plasmodium falciparum
KKTF

SEQ ID NO: 3228956 - protein, 5 aa, Plasmodium falciparum
KKTHE

SEQ ID NO: 3228957 - protein, 6 aa, Plasmodium falciparum
KKTHPF

SEQ ID NO: 3228958 - protein, 7 aa, Plasmodium falciparum
KKTKEPN

SEQ ID NO: 3228959 - protein, 6 aa, Plasmodium falciparum
KKTKER

SEQ ID NO: 3228960 - protein, 20 aa, Plasmodium falciparum
KKTKFPPDPYIPSEDEKESS

SEQ ID NO: 3228961 - protein, 13 aa, Plasmodium falciparum
KKTKKDQKKKNVV

SEQ ID NO: 3228962 - protein, 7 aa, Plasmodium falciparum
KKTKKKK

SEQ ID NO: 3228963 - protein, 21 aa, Plasmodium falciparum
KKTKKKKNNKIKNNNKNKPTI

SEQ ID NO: 3228964 - protein, 12 aa, Plasmodium falciparum
KKTKKKVQDKKI

SEQ ID NO: 3228965 - protein, 8 aa, Plasmodium falciparum
KKTKKRTC

SEQ ID NO: 3228966 - protein, 16 aa, Plasmodium falciparum
KKTKKSKKKTSKNKYA

SEQ ID NO: 3228967 - protein, 9 aa, Plasmodium falciparum
KKTKNEEQK

SEQ ID NO: 3228968 - protein, 11 aa, Plasmodium falciparum
KKTKNGAKYNY

SEQ ID NO: 3228969 - protein, 16 aa, Plasmodium falciparum
KKTKNGNGWEEKDTNQ

SEQ ID NO: 3228970 - protein, 8 aa, Plasmodium falciparum
KKTKNKIS

SEQ ID NO: 3228971 - protein, 9 aa, Plasmodium falciparum
KKTKNKSIQ

SEQ ID NO: 3228972 - protein, 12 aa, Plasmodium falciparum
KKTKNNQDEEKK

SEQ ID NO: 3228973 - protein, 21 aa, Plasmodium falciparum
KKTKRKKKKKKNKKKNKTNKI

SEQ ID NO: 3228974 - protein, 49 aa, Plasmodium falciparum
KKTKRQKRKIEDEKIEKEETEEEKSKIKKESKDITNENSKYEKNQNNLR

SEQ ID NO: 3228975 - protein, 11 aa, Plasmodium falciparum
KKTKSDSNDIK

SEQ ID NO: 3228976 - protein, 9 aa, Plasmodium falciparum
KKTKTDDEN

SEQ ID NO: 3228977 - protein, 7 aa, Plasmodium falciparum
KKTKTKS

SEQ ID NO: 3228978 - protein, 6 aa, Plasmodium falciparum
KKTLEQ

SEQ ID NO: 3228979 - protein, 9 aa, Plasmodium falciparum
KKTMHKESK

SEQ ID NO: 3228980 - protein, 4 aa, Plasmodium falciparum
KKTN

SEQ ID NO: 3228981 - protein, 8 aa, Plasmodium falciparum
KKTNDYRP

SEQ ID NO: 3228982 - protein, 12 aa, Plasmodium falciparum
KKTNEHSSNNYT

SEQ ID NO: 3228983 - protein, 9 aa, Plasmodium falciparum
KKTNGQDNN

SEQ ID NO: 3228984 - protein, 15 aa, Plasmodium falciparum
KKTNIGKNNNNNELS

SEQ ID NO: 3228985 - protein, 7 aa, Plasmodium falciparum
KKTNIKD

SEQ ID NO: 3228986 - protein, 11 aa, Plasmodium falciparum
KKTNNLNETAD

SEQ ID NO: 3228987 - protein, 8 aa, Plasmodium falciparum
KKTNNLQN

SEQ ID NO: 3228988 - protein, 11 aa, Plasmodium falciparum
KKTNNNNNNKD

SEQ ID NO: 3228989 - protein, 7 aa, Plasmodium falciparum
KKTNSLY

SEQ ID NO: 3228990 - protein, 8 aa, Plasmodium falciparum
KKTNSNVS

SEQ ID NO: 3228991 - protein, 6 aa, Plasmodium falciparum
KKTNST

SEQ ID NO: 3228992 - protein, 12 aa, Plasmodium falciparum
KKTNTDTTGSDK

SEQ ID NO: 3228993 - protein, 6 aa, Plasmodium falciparum
KKTPCQ

SEQ ID NO: 3228994 - protein, 5 aa, Plasmodium falciparum
KKTPH

SEQ ID NO: 3228995 - protein, 9 aa, Plasmodium falciparum
KKTPKEISD

SEQ ID NO: 3228996 - protein, 16 aa, Plasmodium falciparum
KKTPNKIKKNDHKDPH

SEQ ID NO: 3228997 - protein, 7 aa, Plasmodium falciparum
KKTQGFR

SEQ ID NO: 3228998 - protein, 7 aa, Plasmodium falciparum
KKTQKKK

SEQ ID NO: 3228999 - protein, 8 aa, Plasmodium falciparum
KKTQRVDR

SEQ ID NO: 3229000 - protein, 7 aa, Plasmodium falciparum
KKTQSPK

SEQ ID NO: 3229001 - protein, 24 aa, Plasmodium falciparum
KKTQYEKQKDRYKTEIDQAKSDNE

SEQ ID NO: 3229002 - protein, 35 aa, Plasmodium falciparum
KKTQYEKQKEAYGEQQKKCQKENNGAQGNNGGNGV

SEQ ID NO: 3229003 - protein, 7 aa, Plasmodium falciparum
KKTRKKK

SEQ ID NO: 3229004 - protein, 10 aa, Plasmodium falciparum
KKTRRGEQKL

SEQ ID NO: 3229005 - protein, 9 aa, Plasmodium falciparum
KKTSGKKKY

SEQ ID NO: 3229006 - protein, 7 aa, Plasmodium falciparum
KKTSITP

SEQ ID NO: 3229007 - protein, 9 aa, Plasmodium falciparum
KKTSQNENI

SEQ ID NO: 3229008 - protein, 6 aa, Plasmodium falciparum
KKTTEW

SEQ ID NO: 3229009 - protein, 5 aa, Plasmodium falciparum
KKTTI

SEQ ID NO: 3229010 - protein, 10 aa, Plasmodium falciparum
KKTTNGTTPL

SEQ ID NO: 3229011 - protein, 9 aa, Plasmodium falciparum
KKTTNNKGE

SEQ ID NO: 3229012 - protein, 9 aa, Plasmodium falciparum
KKTTTKNAY

SEQ ID NO: 3229013 - protein, 16 aa, Plasmodium falciparum
KKTTYNNNTNQSCDDE

SEQ ID NO: 3229014 - protein, 8 aa, Plasmodium falciparum
KKTVETQT

SEQ ID NO: 3229015 - protein, 7 aa, Plasmodium falciparum
KKTYGKI

SEQ ID NO: 3229016 - protein, 5 aa, Plasmodium falciparum
KKTYY

SEQ ID NO: 3229017 - protein, 18 aa, Plasmodium falciparum
KKTYYSEKSTSTKRNEYS

SEQ ID NO: 3229018 - protein, 7 aa, Plasmodium falciparum
KKVDSIK

SEQ ID NO: 3229019 - protein, 16 aa, Plasmodium falciparum
KKVDVTPKSQDPTKSV

SEQ ID NO: 3229020 - protein, 5 aa, Plasmodium falciparum
KKVED

SEQ ID NO: 3229021 - protein, 15 aa, Plasmodium falciparum
KKVEGKSRKGNNIRN

SEQ ID NO: 3229022 - protein, 6 aa, Plasmodium falciparum
KKVEKD

SEQ ID NO: 3229023 - protein, 11 aa, Plasmodium falciparum
KKVEKQRNELN

SEQ ID NO: 3229024 - protein, 11 aa, Plasmodium falciparum
KKVKEKEKKEN

SEQ ID NO: 3229025 - protein, 9 aa, Plasmodium falciparum
KKVKGKDYH

SEQ ID NO: 3229026 - protein, 9 aa, Plasmodium falciparum
KKVKNDDIE

SEQ ID NO: 3229027 - protein, 21 aa, Plasmodium falciparum
KKVKNGEEEDDEEDVQEVKDA

SEQ ID NO: 3229028 - protein, 7 aa, Plasmodium falciparum
KKVLNNS

SEQ ID NO: 3229029 - protein, 5 aa, Plasmodium falciparum
KKVLS

SEQ ID NO: 3229030 - protein, 11 aa, Plasmodium falciparum
KKVNDEEDINE

SEQ ID NO: 3229031 - protein, 11 aa, Plasmodium falciparum
KKVNEKKNNVK

SEQ ID NO: 3229032 - protein, 15 aa, Plasmodium falciparum
KKVNGEKGSGENNDQ

SEQ ID NO: 3229033 - protein, 12 aa, Plasmodium falciparum
KKVNKEKNEEIN

SEQ ID NO: 3229034 - protein, 8 aa, Plasmodium falciparum
KKVNKKEM

SEQ ID NO: 3229035 - protein, 8 aa, Plasmodium falciparum
KKVPEPKV

SEQ ID NO: 3229036 - protein, 43 aa, Plasmodium falciparum
KKVPSDPPPAPAPAAPPSTPAAPKHPRGGEEKKAKPSLPNPPT

SEQ ID NO: 3229037 - protein, 10 aa, Plasmodium falciparum
KKVQKNKSQF

SEQ ID NO: 3229038 - protein, 5 aa, Plasmodium falciparum
KKVQP

SEQ ID NO: 3229039 - protein, 13 aa, Plasmodium falciparum
KKVSEENTKKKSI

SEQ ID NO: 3229040 - protein, 8 aa, Plasmodium falciparum
KKVSKSSD

SEQ ID NO: 3229041 - protein, 5 aa, Plasmodium falciparum
KKVTG

SEQ ID NO: 3229042 - protein, 16 aa, Plasmodium falciparum
KKVTKNDKNDKDNINI

SEQ ID NO: 3229043 - protein, 10 aa, Plasmodium falciparum
KKVTKNMNKQ

SEQ ID NO: 3229044 - protein, 16 aa, Plasmodium falciparum
KKVTYKKKKKKKKHLK

SEQ ID NO: 3229045 - protein, 4 aa, Plasmodium falciparum
KKWG

SEQ ID NO: 3229046 - protein, 5 aa, Plasmodium falciparum
KKWGE

SEQ ID NO: 3229047 - protein, 4 aa, Plasmodium falciparum
KKWP

SEQ ID NO: 3229048 - protein, 12 aa, Plasmodium falciparum
KKWSSDLNQNSE

SEQ ID NO: 3229049 - protein, 6 aa, Plasmodium falciparum
KKWTRK

SEQ ID NO: 3229050 - protein, 4 aa, Plasmodium falciparum
KKYA

SEQ ID NO: 3229051 - protein, 39 aa, Plasmodium falciparum
KKYDAGYSSRRRKKKTQELNQTNSERTNVTNENTQQSVE

SEQ ID NO: 3229052 - protein, 14 aa, Plasmodium falciparum
KKYDDKDIQENHTN

SEQ ID NO: 3229053 - protein, 12 aa, Plasmodium falciparum
KKYDKKKTNENM

SEQ ID NO: 3229054 - protein, 37 aa, Plasmodium falciparum
KKYDNKKYDNKKYDNKKYDNKKYDNKKYDNKKGKDHN

SEQ ID NO: 3229055 - protein, 6 aa, Plasmodium falciparum
KKYDQH

SEQ ID NO: 3229056 - protein, 5 aa, Plasmodium falciparum
KKYDS

SEQ ID NO: 3229057 - protein, 7 aa, Plasmodium falciparum
KKYDTHN

SEQ ID NO: 3229058 - protein, 9 aa, Plasmodium falciparum
KKYDTPYYS

SEQ ID NO: 3229059 - protein, 13 aa, Plasmodium falciparum
KKYDTQNKENTYR

SEQ ID NO: 3229060 - protein, 13 aa, Plasmodium falciparum
KKYEDDIDSDNIQ

SEQ ID NO: 3229061 - protein, 6 aa, Plasmodium falciparum
KKYEHE

SEQ ID NO: 3229062 - protein, 6 aa, Plasmodium falciparum
KKYEIN

SEQ ID NO: 3229063 - protein, 5 aa, Plasmodium falciparum
KKYEK

SEQ ID NO: 3229064 - protein, 6 aa, Plasmodium falciparum
KKYENN

SEQ ID NO: 3229065 - protein, 11 aa, Plasmodium falciparum
KKYENNNTQVK

SEQ ID NO: 3229066 - protein, 7 aa, Plasmodium falciparum
KKYENYG

SEQ ID NO: 3229067 - protein, 19 aa, Plasmodium falciparum
KKYERGGKKKVKIPKSNEQ

SEQ ID NO: 3229068 - protein, 7 aa, Plasmodium falciparum
KKYESDI

SEQ ID NO: 3229069 - protein, 31 aa, Plasmodium falciparum
KKYETEISGGGGRKKRAARSSGSNSNYDGYE

SEQ ID NO: 3229070 - protein, 6 aa, Plasmodium falciparum
KKYGGS

SEQ ID NO: 3229071 - protein, 5 aa, Plasmodium falciparum
KKYGK

SEQ ID NO: 3229072 - protein, 16 aa, Plasmodium falciparum
KKYGKLEKRKKEKNDL

SEQ ID NO: 3229073 - protein, 8 aa, Plasmodium falciparum
KKYGKNEN

SEQ ID NO: 3229074 - protein, 5 aa, Plasmodium falciparum
KKYHP

SEQ ID NO: 3229075 - protein, 4 aa, Plasmodium falciparum
KKYI

SEQ ID NO: 3229076 - protein, 6 aa, Plasmodium falciparum
KKYIEK

SEQ ID NO: 3229077 - protein, 5 aa, Plasmodium falciparum
KKYIK

SEQ ID NO: 3229078 - protein, 6 aa, Plasmodium falciparum
KKYKEE

SEQ ID NO: 3229079 - protein, 9 aa, Plasmodium falciparum
KKYKEQCDK

SEQ ID NO: 3229080 - protein, 6 aa, Plasmodium falciparum
KKYKEY

SEQ ID NO: 3229081 - protein, 60 aa, Plasmodium falciparum
KKYKHNNNNNNDDDNNNDDDNNNDDDNNNDDDNNNDDDNYNNYDNNNDDDNYNNYDNCGE

SEQ ID NO: 3229082 - protein, 45 aa, Plasmodium falciparum
KKYKKNGKKKKKKKKKQKQKQKQKQKQKQKQKQKQKTNKYNNNNE

SEQ ID NO: 3229083 - protein, 11 aa, Plasmodium falciparum
KKYKNDLKKYK

SEQ ID NO: 3229084 - protein, 21 aa, Plasmodium falciparum
KKYKNEIKEREPTKKTSHGTI

SEQ ID NO: 3229085 - protein, 32 aa, Plasmodium falciparum
KKYKNTNKKSSEKKNISNSSKYNKKNVTSSEL

SEQ ID NO: 3229086 - protein, 23 aa, Plasmodium falciparum
KKYKRKGKRYSSDSYKDDSPQYM

SEQ ID NO: 3229087 - protein, 5 aa, Plasmodium falciparum
KKYKS

SEQ ID NO: 3229088 - protein, 4 aa, Plasmodium falciparum
KKYL

SEQ ID NO: 3229089 - protein, 9 aa, Plasmodium falciparum
KKYLSKKSP

SEQ ID NO: 3229090 - protein, 7 aa, Plasmodium falciparum
KKYLTER

SEQ ID NO: 3229091 - protein, 6 aa, Plasmodium falciparum
KKYNCN

SEQ ID NO: 3229092 - protein, 16 aa, Plasmodium falciparum
KKYNDSSRKDTTNKDD

SEQ ID NO: 3229093 - protein, 8 aa, Plasmodium falciparum
KKYNGEGK

SEQ ID NO: 3229094 - protein, 9 aa, Plasmodium falciparum
KKYNKRERG

SEQ ID NO: 3229095 - protein, 12 aa, Plasmodium falciparum
KKYNNDENNRNI

SEQ ID NO: 3229096 - protein, 6 aa, Plasmodium falciparum
KKYNNK

SEQ ID NO: 3229097 - protein, 7 aa, Plasmodium falciparum
KKYNNNI

SEQ ID NO: 3229098 - protein, 12 aa, Plasmodium falciparum
KKYNNNNNNNNI

SEQ ID NO: 3229099 - protein, 6 aa, Plasmodium falciparum
KKYNNS

SEQ ID NO: 3229100 - protein, 14 aa, Plasmodium falciparum
KKYNNTKEDHNNNN

SEQ ID NO: 3229101 - protein, 5 aa, Plasmodium falciparum
KKYNS

SEQ ID NO: 3229102 - protein, 8 aa, Plasmodium falciparum
KKYNSKYR

SEQ ID NO: 3229103 - protein, 15 aa, Plasmodium falciparum
KKYNSRKSTKKHSSA

SEQ ID NO: 3229104 - protein, 6 aa, Plasmodium falciparum
KKYNSY

SEQ ID NO: 3229105 - protein, 5 aa, Plasmodium falciparum
KKYNY

SEQ ID NO: 3229106 - protein, 6 aa, Plasmodium falciparum
KKYPKE

SEQ ID NO: 3229107 - protein, 7 aa, Plasmodium falciparum
KKYQDKE

SEQ ID NO: 3229108 - protein, 7 aa, Plasmodium falciparum
KKYQKTD

SEQ ID NO: 3229109 - protein, 6 aa, Plasmodium falciparum
KKYQSQ

SEQ ID NO: 3229110 - protein, 4 aa, Plasmodium falciparum
KKYR

SEQ ID NO: 3229111 - protein, 23 aa, Plasmodium falciparum
KKYRNDQHKENMNNTTSTSNLSE

SEQ ID NO: 3229112 - protein, 7 aa, Plasmodium falciparum
KKYRNIS

SEQ ID NO: 3229113 - protein, 6 aa, Plasmodium falciparum
KKYRRN

SEQ ID NO: 3229114 - protein, 8 aa, Plasmodium falciparum
KKYSDEQK

SEQ ID NO: 3229115 - protein, 6 aa, Plasmodium falciparum
KKYSDF

SEQ ID NO: 3229116 - protein, 19 aa, Plasmodium falciparum
KKYSEEKENVINNEKDVEE

SEQ ID NO: 3229117 - protein, 12 aa, Plasmodium falciparum
KKYSEGKRNDIA

SEQ ID NO: 3229118 - protein, 7 aa, Plasmodium falciparum
KKYSKED

SEQ ID NO: 3229119 - protein, 6 aa, Plasmodium falciparum
KKYSNN

SEQ ID NO: 3229120 - protein, 4 aa, Plasmodium falciparum
KKYT

SEQ ID NO: 3229121 - protein, 5 aa, Plasmodium falciparum
KKYTK

SEQ ID NO: 3229122 - protein, 31 aa, Plasmodium falciparum
KKYTKEITSGGSCGGSGRKKRDATTTNYEEY

SEQ ID NO: 3229123 - protein, 7 aa, Plasmodium falciparum
KKYTPYT

SEQ ID NO: 3229124 - protein, 14 aa, Plasmodium falciparum
KKYTSQRKSLEQQF

SEQ ID NO: 3229125 - protein, 8 aa, Plasmodium falciparum
KKYTVEQE

SEQ ID NO: 3229126 - protein, 5 aa, Plasmodium falciparum
KKYYY

SEQ ID NO: 3229127 - protein, 12 aa, Plasmodium falciparum
KLAEISETSYSS

SEQ ID NO: 3229128 - protein, 11 aa, Plasmodium falciparum
KLATTKGKDKY

SEQ ID NO: 3229129 - protein, 15 aa, Plasmodium falciparum
KLCKKGNKCYSNDKE

SEQ ID NO: 3229130 - protein, 8 aa, Plasmodium falciparum
KLCSEEKQ

SEQ ID NO: 3229131 - protein, 18 aa, Plasmodium falciparum
KLDDKEKVNKNDDNIDDA

SEQ ID NO: 3229132 - protein, 10 aa, Plasmodium falciparum
KLDEDQSNIS

SEQ ID NO: 3229133 - protein, 7 aa, Plasmodium falciparum
KLDENRR

SEQ ID NO: 3229134 - protein, 15 aa, Plasmodium falciparum
KLDKKEKEKNQKKEE

SEQ ID NO: 3229135 - protein, 11 aa, Plasmodium falciparum
KLDNKDEREPR

SEQ ID NO: 3229136 - protein, 4 aa, Plasmodium falciparum
KLDP

SEQ ID NO: 3229137 - protein, 7 aa, Plasmodium falciparum
KLDPNQE

SEQ ID NO: 3229138 - protein, 10 aa, Plasmodium falciparum
KLDPSQEINE

SEQ ID NO: 3229139 - protein, 11 aa, Plasmodium falciparum
KLDQDEYEISR

SEQ ID NO: 3229140 - protein, 12 aa, Plasmodium falciparum
KLDQKEYNEFSN

SEQ ID NO: 3229141 - protein, 15 aa, Plasmodium falciparum
KLDSEAQTRYNDATG

SEQ ID NO: 3229142 - protein, 8 aa, Plasmodium falciparum
KLDTNTPK

SEQ ID NO: 3229143 - protein, 8 aa, Plasmodium falciparum
KLDTNTPN

SEQ ID NO: 3229144 - protein, 7 aa, Plasmodium falciparum
KLDTNTQ

SEQ ID NO: 3229145 - protein, 7 aa, Plasmodium falciparum
KLDYDQN

SEQ ID NO: 3229146 - protein, 17 aa, Plasmodium falciparum
KLEEHQRKKKKTCTNSN

SEQ ID NO: 3229147 - protein, 5 aa, Plasmodium falciparum
KLEEK

SEQ ID NO: 3229148 - protein, 25 aa, Plasmodium falciparum
KLEEKNSGAKQNRNPTAPSDNKPTT

SEQ ID NO: 3229149 - protein, 27 aa, Plasmodium falciparum
KLEEKNSGTKPTNQTPSSTSDNTPTTL

SEQ ID NO: 3229150 - protein, 20 aa, Plasmodium falciparum
KLEERKNQEKKKKKKKKNFY

SEQ ID NO: 3229151 - protein, 9 aa, Plasmodium falciparum
KLEHNPNDD

SEQ ID NO: 3229152 - protein, 9 aa, Plasmodium falciparum
KLEHPDRNI

SEQ ID NO: 3229153 - protein, 67 aa, Plasmodium falciparum
KLEKEKDDNKMEEHDKDENKKEKEKEKEKENENENEKEKENENEKENENEKENENEKENEKEKENNI

SEQ ID NO: 3229154 - protein, 12 aa, Plasmodium falciparum
KLEKKLEKDKNK

SEQ ID NO: 3229155 - protein, 10 aa, Plasmodium falciparum
KLEKTKGRDK

SEQ ID NO: 3229156 - protein, 4 aa, Plasmodium falciparum
KLEN

SEQ ID NO: 3229157 - protein, 5 aa, Plasmodium falciparum
KLENA

SEQ ID NO: 3229158 - protein, 12 aa, Plasmodium falciparum
KLENEKKIEQIE

SEQ ID NO: 3229159 - protein, 28 aa, Plasmodium falciparum
KLEQEEKYEYNEYNENNNNMNDHNQNIS

SEQ ID NO: 3229160 - protein, 14 aa, Plasmodium falciparum
KLEQKDQEKENKDK

SEQ ID NO: 3229161 - protein, 7 aa, Plasmodium falciparum
KLEQNIG

SEQ ID NO: 3229162 - protein, 12 aa, Plasmodium falciparum
KLESAKQNDKEL

SEQ ID NO: 3229163 - protein, 14 aa, Plasmodium falciparum
KLETNTNKKHQTEY

SEQ ID NO: 3229164 - protein, 15 aa, Plasmodium falciparum
KLETRSKKNKETVAY

SEQ ID NO: 3229165 - protein, 7 aa, Plasmodium falciparum
KLGDNGQ

SEQ ID NO: 3229166 - protein, 57 aa, Plasmodium falciparum
KLGEEENESECNNEGECNNEGECNNEGECNNEGECNNEGECNNEGEGNNESEIASTK

SEQ ID NO: 3229167 - protein, 23 aa, Plasmodium falciparum
KLGENKDFNRDNNINNNNNNNIN

SEQ ID NO: 3229168 - protein, 9 aa, Plasmodium falciparum
KLGENNEDD

SEQ ID NO: 3229169 - protein, 12 aa, Plasmodium falciparum
KLGNNKSSSARN

SEQ ID NO: 3229170 - protein, 8 aa, Plasmodium falciparum
KLGSKAKE

SEQ ID NO: 3229171 - protein, 5 aa, Plasmodium falciparum
KLGSY

SEQ ID NO: 3229172 - protein, 9 aa, Plasmodium falciparum
KLGTTTKCD

SEQ ID NO: 3229173 - protein, 11 aa, Plasmodium falciparum
KLHKNKKKSKF

SEQ ID NO: 3229174 - protein, 7 aa, Plasmodium falciparum
KLHRDDN

SEQ ID NO: 3229175 - protein, 10 aa, Plasmodium falciparum
KLKAGKNEAF

SEQ ID NO: 3229176 - protein, 7 aa, Plasmodium falciparum
KLKDQKS

SEQ ID NO: 3229177 - protein, 8 aa, Plasmodium falciparum
KLKDSDDK

SEQ ID NO: 3229178 - protein, 5 aa, Plasmodium falciparum
KLKEE

SEQ ID NO: 3229179 - protein, 8 aa, Plasmodium falciparum
KLKEEDGN

SEQ ID NO: 3229180 - protein, 8 aa, Plasmodium falciparum
KLKEEKDV

SEQ ID NO: 3229181 - protein, 7 aa, Plasmodium falciparum
KLKEEKS

SEQ ID NO: 3229182 - protein, 6 aa, Plasmodium falciparum
KLKEER

SEQ ID NO: 3229183 - protein, 5 aa, Plasmodium falciparum
KLKEK

SEQ ID NO: 3229184 - protein, 14 aa, Plasmodium falciparum
KLKEKKLKETTEKA

SEQ ID NO: 3229185 - protein, 8 aa, Plasmodium falciparum
KLKEQKNK

SEQ ID NO: 3229186 - protein, 9 aa, Plasmodium falciparum
KLKGNKASC

SEQ ID NO: 3229187 - protein, 6 aa, Plasmodium falciparum
KLKKEI

SEQ ID NO: 3229188 - protein, 9 aa, Plasmodium falciparum
KLKKQQRLT

SEQ ID NO: 3229189 - protein, 8 aa, Plasmodium falciparum
KLKNGKAE

SEQ ID NO: 3229190 - protein, 11 aa, Plasmodium falciparum
KLKNKKKNLKK

SEQ ID NO: 3229191 - protein, 10 aa, Plasmodium falciparum
KLKRKNSKKY

SEQ ID NO: 3229192 - protein, 6 aa, Plasmodium falciparum
KLKRRK

SEQ ID NO: 3229193 - protein, 4 aa, Plasmodium falciparum
KLKS

SEQ ID NO: 3229194 - protein, 164 aa, Plasmodium falciparum
KLKSGDNKCGDNKCGDDKCGDDKCGDDKCGDDKCGDDKCGDDKCGDDKCGDDKCGDDKCGDDKCGDNKCGDNKCGDNKCGDNKCGDNKCGDNKCGDNKCGDNKCGDNKCGDNKCGDNKCGDNKCGDNKCGDNKCGDNKCGDNKCGDNKCGDNKCGDNKCGDNNK

SEQ ID NO: 3229195 - protein, 6 aa, Plasmodium falciparum
KLKSSC

SEQ ID NO: 3229196 - protein, 7 aa, Plasmodium falciparum
KLKTESK

SEQ ID NO: 3229197 - protein, 12 aa, Plasmodium falciparum
KLKTKTEKTNRN

SEQ ID NO: 3229198 - protein, 7 aa, Plasmodium falciparum
KLKTSEN

SEQ ID NO: 3229199 - protein, 12 aa, Plasmodium falciparum
KLKTTGCQRKYK

SEQ ID NO: 3229200 - protein, 10 aa, Plasmodium falciparum
KLKYTKKRTP

SEQ ID NO: 3229201 - protein, 4 aa, Plasmodium falciparum
KLNA

SEQ ID NO: 3229202 - protein, 4 aa, Plasmodium falciparum
KLND

SEQ ID NO: 3229203 - protein, 23 aa, Plasmodium falciparum
KLNDANDENISNDENNANDENNV

SEQ ID NO: 3229204 - protein, 6 aa, Plasmodium falciparum
KLNDEQ

SEQ ID NO: 3229205 - protein, 15 aa, Plasmodium falciparum
KLNDIEGEKKEKKIK

SEQ ID NO: 3229206 - protein, 6 aa, Plasmodium falciparum
KLNDNH

SEQ ID NO: 3229207 - protein, 12 aa, Plasmodium falciparum
KLNDQGEEEGTI

SEQ ID NO: 3229208 - protein, 4 aa, Plasmodium falciparum
KLNE

SEQ ID NO: 3229209 - protein, 9 aa, Plasmodium falciparum
KLNEEEVEN

SEQ ID NO: 3229210 - protein, 8 aa, Plasmodium falciparum
KLNEEKKK

SEQ ID NO: 3229211 - protein, 15 aa, Plasmodium falciparum
KLNEIGEKYKKGEML

SEQ ID NO: 3229212 - protein, 7 aa, Plasmodium falciparum
KLNEQNK

SEQ ID NO: 3229213 - protein, 6 aa, Plasmodium falciparum
KLNGDM

SEQ ID NO: 3229214 - protein, 6 aa, Plasmodium falciparum
KLNKEG

SEQ ID NO: 3229215 - protein, 15 aa, Plasmodium falciparum
KLNKYTKKNKHKFKH

SEQ ID NO: 3229216 - protein, 19 aa, Plasmodium falciparum
KLNNDKNSNIDNAEKINKK

SEQ ID NO: 3229217 - protein, 13 aa, Plasmodium falciparum
KLNNEKDKYTKLS

SEQ ID NO: 3229218 - protein, 29 aa, Plasmodium falciparum
KLNNEKQQGKSSKKNKNNINNKEGSSTFL

SEQ ID NO: 3229219 - protein, 11 aa, Plasmodium falciparum
KLNNETLKEDD

SEQ ID NO: 3229220 - protein, 6 aa, Plasmodium falciparum
KLNNGK

SEQ ID NO: 3229221 - protein, 13 aa, Plasmodium falciparum
KLNNKEENITDPN

SEQ ID NO: 3229222 - protein, 7 aa, Plasmodium falciparum
KLNNSDK

SEQ ID NO: 3229223 - protein, 13 aa, Plasmodium falciparum
KLNQSEKKNKDNQ

SEQ ID NO: 3229224 - protein, 18 aa, Plasmodium falciparum
KLNRQKKKKNANNNNKIN

SEQ ID NO: 3229225 - protein, 7 aa, Plasmodium falciparum
KLNSDSS

SEQ ID NO: 3229226 - protein, 8 aa, Plasmodium falciparum
KLNSEYKN

SEQ ID NO: 3229227 - protein, 23 aa, Plasmodium falciparum
KLNSNSKHEDKTMQDDKSIRSNN

SEQ ID NO: 3229228 - protein, 5 aa, Plasmodium falciparum
KLNSP

SEQ ID NO: 3229229 - protein, 7 aa, Plasmodium falciparum
KLNSSSL

SEQ ID NO: 3229230 - protein, 4 aa, Plasmodium falciparum
KLNY

SEQ ID NO: 3229231 - protein, 25 aa, Plasmodium falciparum
KLNYKQTKKNGFSTQQYHNDSSKEN

SEQ ID NO: 3229232 - protein, 15 aa, Plasmodium falciparum
KLPEKEQKKYSNDGK

SEQ ID NO: 3229233 - protein, 33 aa, Plasmodium falciparum
KLPEYDYTKNDNDNDKDNDEDNDEDNDEDNEMD

SEQ ID NO: 3229234 - protein, 8 aa, Plasmodium falciparum
KLPGGLDE

SEQ ID NO: 3229235 - protein, 31 aa, Plasmodium falciparum
KLPPPPPNIPPSYDRSSQRRTSNFYNNDDSS

SEQ ID NO: 3229236 - protein, 16 aa, Plasmodium falciparum
KLPQNDMNKSGEKEEH

SEQ ID NO: 3229237 - protein, 6 aa, Plasmodium falciparum
KLPTDN

SEQ ID NO: 3229238 - protein, 7 aa, Plasmodium falciparum
KLPTEDE

SEQ ID NO: 3229239 - protein, 7 aa, Plasmodium falciparum
KLPTTSI

SEQ ID NO: 3229240 - protein, 7 aa, Plasmodium falciparum
KLQEGVG

SEQ ID NO: 3229241 - protein, 11 aa, Plasmodium falciparum
KLQEKKLRNSK

SEQ ID NO: 3229242 - protein, 13 aa, Plasmodium falciparum
KLQERQSDLEQER

SEQ ID NO: 3229243 - protein, 10 aa, Plasmodium falciparum
KLQKARDKIE

SEQ ID NO: 3229244 - protein, 14 aa, Plasmodium falciparum
KLQKTAKDSYEDYK

SEQ ID NO: 3229245 - protein, 18 aa, Plasmodium falciparum
KLQNAKEQCRGKNGEDKY

SEQ ID NO: 3229246 - protein, 5 aa, Plasmodium falciparum
KLQNI

SEQ ID NO: 3229247 - protein, 7 aa, Plasmodium falciparum
KLQNRSN

SEQ ID NO: 3229248 - protein, 37 aa, Plasmodium falciparum
KLQNSLSENKFNTDLTESDMDEVDEDEKDEKTISDDG

SEQ ID NO: 3229249 - protein, 20 aa, Plasmodium falciparum
KLQQSYHNNKEEKEPNKNNN

SEQ ID NO: 3229250 - protein, 13 aa, Plasmodium falciparum
KLRENKSKSDINF

SEQ ID NO: 3229251 - protein, 24 aa, Plasmodium falciparum
KLRENQEKKRKQNQEKENKKQEKI

SEQ ID NO: 3229252 - protein, 19 aa, Plasmodium falciparum
KLRESKESKIHKAEEERLS

SEQ ID NO: 3229253 - protein, 19 aa, Plasmodium falciparum
KLRGKKKRKHKRQKENYKE

SEQ ID NO: 3229254 - protein, 9 aa, Plasmodium falciparum
KLRGKPRDR

SEQ ID NO: 3229255 - protein, 12 aa, Plasmodium falciparum
KLRKKKIAGSNY

SEQ ID NO: 3229256 - protein, 5 aa, Plasmodium falciparum
KLRNE

SEQ ID NO: 3229257 - protein, 4 aa, Plasmodium falciparum
KLRP

SEQ ID NO: 3229258 - protein, 5 aa, Plasmodium falciparum
KLRPT

SEQ ID NO: 3229259 - protein, 23 aa, Plasmodium falciparum
KLRQSQEYHPNNNNNNSNNYNNM

SEQ ID NO: 3229260 - protein, 18 aa, Plasmodium falciparum
KLSAQDNQTNNNNNMENH

SEQ ID NO: 3229261 - protein, 25 aa, Plasmodium falciparum
KLSDQNNEDNHDVNNNNEDPSGGNL

SEQ ID NO: 3229262 - protein, 17 aa, Plasmodium falciparum
KLSDSQNVRDKKNIGDN

SEQ ID NO: 3229263 - protein, 8 aa, Plasmodium falciparum
KLSEEPRH

SEQ ID NO: 3229264 - protein, 13 aa, Plasmodium falciparum
KLSEKKNASTVTN

SEQ ID NO: 3229265 - protein, 4 aa, Plasmodium falciparum
KLSG

SEQ ID NO: 3229266 - protein, 18 aa, Plasmodium falciparum
KLSGGEIAGTTDPCSSDY

SEQ ID NO: 3229267 - protein, 10 aa, Plasmodium falciparum
KLSGKEEDTI

SEQ ID NO: 3229268 - protein, 11 aa, Plasmodium falciparum
KLSGKEEKEKF

SEQ ID NO: 3229269 - protein, 5 aa, Plasmodium falciparum
KLSKD

SEQ ID NO: 3229270 - protein, 9 aa, Plasmodium falciparum
KLSKEELDR

SEQ ID NO: 3229271 - protein, 6 aa, Plasmodium falciparum
KLSKNS

SEQ ID NO: 3229272 - protein, 8 aa, Plasmodium falciparum
KLSKRPEV

SEQ ID NO: 3229273 - protein, 11 aa, Plasmodium falciparum
KLSKSCKKSLS

SEQ ID NO: 3229274 - protein, 5 aa, Plasmodium falciparum
KLSLQ

SEQ ID NO: 3229275 - protein, 4 aa, Plasmodium falciparum
KLSN

SEQ ID NO: 3229276 - protein, 5 aa, Plasmodium falciparum
KLSNA

SEQ ID NO: 3229277 - protein, 7 aa, Plasmodium falciparum
KLSNKDK

SEQ ID NO: 3229278 - protein, 4 aa, Plasmodium falciparum
KLSS

SEQ ID NO: 3229279 - protein, 9 aa, Plasmodium falciparum
KLSSETSAI

SEQ ID NO: 3229280 - protein, 10 aa, Plasmodium falciparum
KLSSFGTTDY

SEQ ID NO: 3229281 - protein, 8 aa, Plasmodium falciparum
KLSSKNGN

SEQ ID NO: 3229282 - protein, 12 aa, Plasmodium falciparum
KLSSKQNNIEQE

SEQ ID NO: 3229283 - protein, 7 aa, Plasmodium falciparum
KLSSQNK

SEQ ID NO: 3229284 - protein, 19 aa, Plasmodium falciparum
KLSSVNSSYTSTEDNEFYS

SEQ ID NO: 3229285 - protein, 36 aa, Plasmodium falciparum
KLSTDNHKEEGERKKEETNKKHDIDTNNMDDNEEKN

SEQ ID NO: 3229286 - protein, 6 aa, Plasmodium falciparum
KLSTTT

SEQ ID NO: 3229287 - protein, 6 aa, Plasmodium falciparum
KLTATY

SEQ ID NO: 3229288 - protein, 4 aa, Plasmodium falciparum
KLTD

SEQ ID NO: 3229289 - protein, 24 aa, Plasmodium falciparum
KLTEEEKLTEEEKLTEEEKLTEDE

SEQ ID NO: 3229290 - protein, 51 aa, Plasmodium falciparum
KLTEEEKLTEEEKLTEEEKLTEEEKLTEEEKLTEEEKLTEEEKLTEEEKLT

SEQ ID NO: 3229291 - protein, 7 aa, Plasmodium falciparum
KLTEKSI

SEQ ID NO: 3229292 - protein, 7 aa, Plasmodium falciparum
KLTKDGI

SEQ ID NO: 3229293 - protein, 6 aa, Plasmodium falciparum
KLTKRE

SEQ ID NO: 3229294 - protein, 11 aa, Plasmodium falciparum
KLTKSKADNNM

SEQ ID NO: 3229295 - protein, 11 aa, Plasmodium falciparum
KLTKTKGKDKY

SEQ ID NO: 3229296 - protein, 11 aa, Plasmodium falciparum
KLTNDNTPSEY

SEQ ID NO: 3229297 - protein, 7 aa, Plasmodium falciparum
KLTNKTN

SEQ ID NO: 3229298 - protein, 13 aa, Plasmodium falciparum
KLTNNNCSGSDNT

SEQ ID NO: 3229299 - protein, 10 aa, Plasmodium falciparum
KLTPKQETQT

SEQ ID NO: 3229300 - protein, 6 aa, Plasmodium falciparum
KLTPNQ

SEQ ID NO: 3229301 - protein, 4 aa, Plasmodium falciparum
KLTR

SEQ ID NO: 3229302 - protein, 7 aa, Plasmodium falciparum
KLTTHSQ

SEQ ID NO: 3229303 - protein, 10 aa, Plasmodium falciparum
KLYEAEKGKY

SEQ ID NO: 3229304 - protein, 10 aa, Plasmodium falciparum
KLYKDTNNQP

SEQ ID NO: 3229305 - protein, 4 aa, Plasmodium falciparum
KLYN

SEQ ID NO: 3229306 - protein, 6 aa, Plasmodium falciparum
KLYNNG

SEQ ID NO: 3229307 - protein, 16 aa, Plasmodium falciparum
KLYNNSSNEQNEENEN

SEQ ID NO: 3229308 - protein, 4 aa, Plasmodium falciparum
KLYQ

SEQ ID NO: 3229309 - protein, 12 aa, Plasmodium falciparum
KLYRPKGGKDVT

SEQ ID NO: 3229310 - protein, 12 aa, Plasmodium falciparum
KLYSNEEKSLES

SEQ ID NO: 3229311 - protein, 17 aa, Plasmodium falciparum
KLYTNDELSSTDMKREE

SEQ ID NO: 3229312 - protein, 27 aa, Plasmodium falciparum
KMDDDKNKNTQTYKYGNKDMDNKENSK

SEQ ID NO: 3229313 - protein, 15 aa, Plasmodium falciparum
KMDDKSTQKYGRNQE

SEQ ID NO: 3229314 - protein, 22 aa, Plasmodium falciparum
KMDEKEKVQDKQKTRKNFGNKK

SEQ ID NO: 3229315 - protein, 13 aa, Plasmodium falciparum
KMDKSKISKANNI

SEQ ID NO: 3229316 - protein, 10 aa, Plasmodium falciparum
KMDKSLAEKV

SEQ ID NO: 3229317 - protein, 11 aa, Plasmodium falciparum
KMDKSLAEKVE

SEQ ID NO: 3229318 - protein, 10 aa, Plasmodium falciparum
KMDNDDKGNF

SEQ ID NO: 3229319 - protein, 8 aa, Plasmodium falciparum
KMDNDNNI

SEQ ID NO: 3229320 - protein, 5 aa, Plasmodium falciparum
KMDNE

SEQ ID NO: 3229321 - protein, 12 aa, Plasmodium falciparum
KMDNNNSDVPTN

SEQ ID NO: 3229322 - protein, 18 aa, Plasmodium falciparum
KMDRSKRISTSYKNTQYN

SEQ ID NO: 3229323 - protein, 9 aa, Plasmodium falciparum
KMDSTKIKD

SEQ ID NO: 3229324 - protein, 6 aa, Plasmodium falciparum
KMDTEE

SEQ ID NO: 3229325 - protein, 15 aa, Plasmodium falciparum
KMDTKCSSKKKEQEN

SEQ ID NO: 3229326 - protein, 5 aa, Plasmodium falciparum
KMEDD

SEQ ID NO: 3229327 - protein, 9 aa, Plasmodium falciparum
KMEDTYSRV

SEQ ID NO: 3229328 - protein, 8 aa, Plasmodium falciparum
KMEKKEKD

SEQ ID NO: 3229329 - protein, 6 aa, Plasmodium falciparum
KMEKSL

SEQ ID NO: 3229330 - protein, 11 aa, Plasmodium falciparum
KMENEDKKKNE

SEQ ID NO: 3229331 - protein, 9 aa, Plasmodium falciparum
KMENEKEEI

SEQ ID NO: 3229332 - protein, 10 aa, Plasmodium falciparum
KMEQNKKGLN

SEQ ID NO: 3229333 - protein, 9 aa, Plasmodium falciparum
KMGDNNHSY

SEQ ID NO: 3229334 - protein, 17 aa, Plasmodium falciparum
KMGDSQMGKMEGNQMGK

SEQ ID NO: 3229335 - protein, 6 aa, Plasmodium falciparum
KMGKEE

SEQ ID NO: 3229336 - protein, 16 aa, Plasmodium falciparum
KMGNSKGKNLDHDDGD

SEQ ID NO: 3229337 - protein, 13 aa, Plasmodium falciparum
KMHHTDDNNLSNE

SEQ ID NO: 3229338 - protein, 9 aa, Plasmodium falciparum
KMKETSKNK

SEQ ID NO: 3229339 - protein, 11 aa, Plasmodium falciparum
KMKGDTNNENK

SEQ ID NO: 3229340 - protein, 6 aa, Plasmodium falciparum
KMKGEK

SEQ ID NO: 3229341 - protein, 11 aa, Plasmodium falciparum
KMKGEKKNNTL

SEQ ID NO: 3229342 - protein, 5 aa, Plasmodium falciparum
KMKKE

SEQ ID NO: 3229343 - protein, 23 aa, Plasmodium falciparum
KMKKKEEKEEKKRKKKKEDIEDK

SEQ ID NO: 3229344 - protein, 9 aa, Plasmodium falciparum
KMKKKKKNQ

SEQ ID NO: 3229345 - protein, 7 aa, Plasmodium falciparum
KMKNENM

SEQ ID NO: 3229346 - protein, 9 aa, Plasmodium falciparum
KMKNSKEQD

SEQ ID NO: 3229347 - protein, 9 aa, Plasmodium falciparum
KMKPKTAKS

SEQ ID NO: 3229348 - protein, 5 aa, Plasmodium falciparum
KMKTN

SEQ ID NO: 3229349 - protein, 7 aa, Plasmodium falciparum
KMKTQQL

SEQ ID NO: 3229350 - protein, 9 aa, Plasmodium falciparum
KMLSNTSSD

SEQ ID NO: 3229351 - protein, 5 aa, Plasmodium falciparum
KMNDD

SEQ ID NO: 3229352 - protein, 4 aa, Plasmodium falciparum
KMNE

SEQ ID NO: 3229353 - protein, 28 aa, Plasmodium falciparum
KMNEADSADSDDEKDFDTPDNELMIARF

SEQ ID NO: 3229354 - protein, 28 aa, Plasmodium falciparum
KMNEADSADSDDEKDSDTPDDELMISRF

SEQ ID NO: 3229355 - protein, 10 aa, Plasmodium falciparum
KMNEDEQKYN

SEQ ID NO: 3229356 - protein, 5 aa, Plasmodium falciparum
KMNEE

SEQ ID NO: 3229357 - protein, 8 aa, Plasmodium falciparum
KMNETDEV

SEQ ID NO: 3229358 - protein, 6 aa, Plasmodium falciparum
KMNETT

SEQ ID NO: 3229359 - protein, 6 aa, Plasmodium falciparum
KMNGGD

SEQ ID NO: 3229360 - protein, 4 aa, Plasmodium falciparum
KMNK

SEQ ID NO: 3229361 - protein, 13 aa, Plasmodium falciparum
KMNKKAQYTKLLK

SEQ ID NO: 3229362 - protein, 13 aa, Plasmodium falciparum
KMNKKAQYTKLLN

SEQ ID NO: 3229363 - protein, 13 aa, Plasmodium falciparum
KMNKRAQYTKLLN

SEQ ID NO: 3229364 - protein, 6 aa, Plasmodium falciparum
KMNNAS

SEQ ID NO: 3229365 - protein, 22 aa, Plasmodium falciparum
KMNNKKKKSKNKKNKKTKLNNI

SEQ ID NO: 3229366 - protein, 7 aa, Plasmodium falciparum
KMNNNNE

SEQ ID NO: 3229367 - protein, 7 aa, Plasmodium falciparum
KMNNSEP

SEQ ID NO: 3229368 - protein, 4 aa, Plasmodium falciparum
KMNR

SEQ ID NO: 3229369 - protein, 12 aa, Plasmodium falciparum
KMNSKDDDCSIE

SEQ ID NO: 3229370 - protein, 10 aa, Plasmodium falciparum
KMNTDSGRKV

SEQ ID NO: 3229371 - protein, 26 aa, Plasmodium falciparum
KMPTPPPKKPEQGPKQRKKQKRQLPT

SEQ ID NO: 3229372 - protein, 5 aa, Plasmodium falciparum
KMQRK

SEQ ID NO: 3229373 - protein, 8 aa, Plasmodium falciparum
KMRESQNY

SEQ ID NO: 3229374 - protein, 7 aa, Plasmodium falciparum
KMRKDKN

SEQ ID NO: 3229375 - protein, 11 aa, Plasmodium falciparum
KMRKEKNDMSS

SEQ ID NO: 3229376 - protein, 11 aa, Plasmodium falciparum
KMRNGNHNNIN

SEQ ID NO: 3229377 - protein, 5 aa, Plasmodium falciparum
KMRRE

SEQ ID NO: 3229378 - protein, 4 aa, Plasmodium falciparum
KMRS

SEQ ID NO: 3229379 - protein, 18 aa, Plasmodium falciparum
KMSKENKGDQENKVDQEY

SEQ ID NO: 3229380 - protein, 6 aa, Plasmodium falciparum
KMSRNN

SEQ ID NO: 3229381 - protein, 4 aa, Plasmodium falciparum
KMSS

SEQ ID NO: 3229382 - protein, 5 aa, Plasmodium falciparum
KMSSE

SEQ ID NO: 3229383 - protein, 6 aa, Plasmodium falciparum
KMSSQN

SEQ ID NO: 3229384 - protein, 9 aa, Plasmodium falciparum
KMSSYNKDL

SEQ ID NO: 3229385 - protein, 6 aa, Plasmodium falciparum
KMTGTD

SEQ ID NO: 3229386 - protein, 11 aa, Plasmodium falciparum
KMTKEEGQNGY

SEQ ID NO: 3229387 - protein, 5 aa, Plasmodium falciparum
KMYNN

SEQ ID NO: 3229388 - protein, 10 aa, Plasmodium falciparum
KNAASKNTKR

SEQ ID NO: 3229389 - protein, 9 aa, Plasmodium falciparum
KNADSGDTF

SEQ ID NO: 3229390 - protein, 6 aa, Plasmodium falciparum
KNAELD

SEQ ID NO: 3229391 - protein, 5 aa, Plasmodium falciparum
KNAFQ

SEQ ID NO: 3229392 - protein, 11 aa, Plasmodium falciparum
KNAGAVEKENL

SEQ ID NO: 3229393 - protein, 9 aa, Plasmodium falciparum
KNAGGSDDY

SEQ ID NO: 3229394 - protein, 10 aa, Plasmodium falciparum
KNAKDKLNQK

SEQ ID NO: 3229395 - protein, 9 aa, Plasmodium falciparum
KNAKNEKVK

SEQ ID NO: 3229396 - protein, 15 aa, Plasmodium falciparum
KNAKNKLKEKNGEQK

SEQ ID NO: 3229397 - protein, 7 aa, Plasmodium falciparum
KNANDTT

SEQ ID NO: 3229398 - protein, 6 aa, Plasmodium falciparum
KNANYY

SEQ ID NO: 3229399 - protein, 10 aa, Plasmodium falciparum
KNAPKRTINK

SEQ ID NO: 3229400 - protein, 10 aa, Plasmodium falciparum
KNAQNDECSQ

SEQ ID NO: 3229401 - protein, 20 aa, Plasmodium falciparum
KNAQSEPEAKQTKQNIEGEK

SEQ ID NO: 3229402 - protein, 5 aa, Plasmodium falciparum
KNASK

SEQ ID NO: 3229403 - protein, 20 aa, Plasmodium falciparum
KNASSSSSGIKNNNKNIDNN

SEQ ID NO: 3229404 - protein, 17 aa, Plasmodium falciparum
KNASTNSSISENSAQEY

SEQ ID NO: 3229405 - protein, 7 aa, Plasmodium falciparum
KNASTTV

SEQ ID NO: 3229406 - protein, 9 aa, Plasmodium falciparum
KNATDYEKP

SEQ ID NO: 3229407 - protein, 7 aa, Plasmodium falciparum
KNATNPC

SEQ ID NO: 3229408 - protein, 38 aa, Plasmodium falciparum
KNATSTRNDDISTMPQSDKSDTYNKNNSNEGKKKSMHT

SEQ ID NO: 3229409 - protein, 6 aa, Plasmodium falciparum
KNAYTE

SEQ ID NO: 3229410 - protein, 15 aa, Plasmodium falciparum
KNCDENNINKKEEKH

SEQ ID NO: 3229411 - protein, 25 aa, Plasmodium falciparum
KNCEKQKYTNDKNEKKKKSADQQEI

SEQ ID NO: 3229412 - protein, 5 aa, Plasmodium falciparum
KNCKN

SEQ ID NO: 3229413 - protein, 5 aa, Plasmodium falciparum
KNCNK

SEQ ID NO: 3229414 - protein, 6 aa, Plasmodium falciparum
KNCTYD

SEQ ID NO: 3229415 - protein, 19 aa, Plasmodium falciparum
KNDCNDSDNQMVDDGDNQI

SEQ ID NO: 3229416 - protein, 4 aa, Plasmodium falciparum
KNDD

SEQ ID NO: 3229417 - protein, 7 aa, Plasmodium falciparum
KNDDDNI

SEQ ID NO: 3229418 - protein, 20 aa, Plasmodium falciparum
KNDDDNNNKVNDNKKDYKID

SEQ ID NO: 3229419 - protein, 6 aa, Plasmodium falciparum
KNDDHD

SEQ ID NO: 3229420 - protein, 13 aa, Plasmodium falciparum
KNDDHELGDPEKI

SEQ ID NO: 3229421 - protein, 7 aa, Plasmodium falciparum
KNDDKFI

SEQ ID NO: 3229422 - protein, 11 aa, Plasmodium falciparum
KNDDKGCNNST

SEQ ID NO: 3229423 - protein, 10 aa, Plasmodium falciparum
KNDDKGKDIS

SEQ ID NO: 3229424 - protein, 7 aa, Plasmodium falciparum
KNDDKTK

SEQ ID NO: 3229425 - protein, 7 aa, Plasmodium falciparum
KNDDNFN

SEQ ID NO: 3229426 - protein, 6 aa, Plasmodium falciparum
KNDDNN

SEQ ID NO: 3229427 - protein, 12 aa, Plasmodium falciparum
KNDDNNNNIEES

SEQ ID NO: 3229428 - protein, 8 aa, Plasmodium falciparum
KNDDNNYY

SEQ ID NO: 3229429 - protein, 8 aa, Plasmodium falciparum
KNDDPDYD

SEQ ID NO: 3229430 - protein, 14 aa, Plasmodium falciparum
KNDDQDDSSNNELY

SEQ ID NO: 3229431 - protein, 10 aa, Plasmodium falciparum
KNDDRTQNKI

SEQ ID NO: 3229432 - protein, 12 aa, Plasmodium falciparum
KNDDSASKGTNE

SEQ ID NO: 3229433 - protein, 47 aa, Plasmodium falciparum
KNDDVTIKQNDDVTIKQNDDVTIKQNDDVTIKQNDDVTIKQNDEVTI

SEQ ID NO: 3229434 - protein, 8 aa, Plasmodium falciparum
KNDEDTNV

SEQ ID NO: 3229435 - protein, 10 aa, Plasmodium falciparum
KNDEENSYPA

SEQ ID NO: 3229436 - protein, 11 aa, Plasmodium falciparum
KNDEKKKEDNL

SEQ ID NO: 3229437 - protein, 10 aa, Plasmodium falciparum
KNDEKKNVDN

SEQ ID NO: 3229438 - protein, 11 aa, Plasmodium falciparum
KNDEKSEYNYS

SEQ ID NO: 3229439 - protein, 8 aa, Plasmodium falciparum
KNDEKVNN

SEQ ID NO: 3229440 - protein, 8 aa, Plasmodium falciparum
KNDENKEN

SEQ ID NO: 3229441 - protein, 11 aa, Plasmodium falciparum
KNDENNKEKLK

SEQ ID NO: 3229442 - protein, 9 aa, Plasmodium falciparum
KNDEQHNKN

SEQ ID NO: 3229443 - protein, 16 aa, Plasmodium falciparum
KNDEQMNKENKSSSNY

SEQ ID NO: 3229444 - protein, 7 aa, Plasmodium falciparum
KNDEQVN

SEQ ID NO: 3229445 - protein, 6 aa, Plasmodium falciparum
KNDFNN

SEQ ID NO: 3229446 - protein, 6 aa, Plasmodium falciparum
KNDFST

SEQ ID NO: 3229447 - protein, 6 aa, Plasmodium falciparum
KNDGNM

SEQ ID NO: 3229448 - protein, 6 aa, Plasmodium falciparum
KNDGNR

SEQ ID NO: 3229449 - protein, 5 aa, Plasmodium falciparum
KNDGT

SEQ ID NO: 3229450 - protein, 7 aa, Plasmodium falciparum
KNDHENY

SEQ ID NO: 3229451 - protein, 15 aa, Plasmodium falciparum
KNDHIDTNKGENYSN

SEQ ID NO: 3229452 - protein, 7 aa, Plasmodium falciparum
KNDHVHN

SEQ ID NO: 3229453 - protein, 7 aa, Plasmodium falciparum
KNDIDNT

SEQ ID NO: 3229454 - protein, 7 aa, Plasmodium falciparum
KNDIKSQ

SEQ ID NO: 3229455 - protein, 15 aa, Plasmodium falciparum
KNDINDNSNNYTSNN

SEQ ID NO: 3229456 - protein, 12 aa, Plasmodium falciparum
KNDINTADDINN

SEQ ID NO: 3229457 - protein, 6 aa, Plasmodium falciparum
KNDISK

SEQ ID NO: 3229458 - protein, 12 aa, Plasmodium falciparum
KNDITQNGKRTI

SEQ ID NO: 3229459 - protein, 7 aa, Plasmodium falciparum
KNDIYDN

SEQ ID NO: 3229460 - protein, 26 aa, Plasmodium falciparum
KNDKEEKKGNESITQEKNKEHGSMEP

SEQ ID NO: 3229461 - protein, 16 aa, Plasmodium falciparum
KNDKEKMNRQNNQRSM

SEQ ID NO: 3229462 - protein, 12 aa, Plasmodium falciparum
KNDKETNVYSNE

SEQ ID NO: 3229463 - protein, 16 aa, Plasmodium falciparum
KNDKEVNNTSISDKKN

SEQ ID NO: 3229464 - protein, 15 aa, Plasmodium falciparum
KNDKKKEKNTNSSFN

SEQ ID NO: 3229465 - protein, 18 aa, Plasmodium falciparum
KNDKKKSSQTTNTEGRKI

SEQ ID NO: 3229466 - protein, 6 aa, Plasmodium falciparum
KNDKKV

SEQ ID NO: 3229467 - protein, 5 aa, Plasmodium falciparum
KNDKL

SEQ ID NO: 3229468 - protein, 8 aa, Plasmodium falciparum
KNDKLENN

SEQ ID NO: 3229469 - protein, 7 aa, Plasmodium falciparum
KNDKNGK

SEQ ID NO: 3229470 - protein, 6 aa, Plasmodium falciparum
KNDKNN

SEQ ID NO: 3229471 - protein, 15 aa, Plasmodium falciparum
KNDKSDDSDETHNSD

SEQ ID NO: 3229472 - protein, 7 aa, Plasmodium falciparum
KNDKSQL

SEQ ID NO: 3229473 - protein, 29 aa, Plasmodium falciparum
KNDKTSEKLRKKDEKKKMKKIKKNSTSSI

SEQ ID NO: 3229474 - protein, 15 aa, Plasmodium falciparum
KNDKYNNNNNNNNSD

SEQ ID NO: 3229475 - protein, 6 aa, Plasmodium falciparum
KNDLAD

SEQ ID NO: 3229476 - protein, 5 aa, Plasmodium falciparum
KNDLE

SEQ ID NO: 3229477 - protein, 17 aa, Plasmodium falciparum
KNDNETPKNNYDNNKDM

SEQ ID NO: 3229478 - protein, 18 aa, Plasmodium falciparum
KNDNGIGWEEKNDSEECK

SEQ ID NO: 3229479 - protein, 5 aa, Plasmodium falciparum
KNDNI

SEQ ID NO: 3229480 - protein, 6 aa, Plasmodium falciparum
KNDNIK

SEQ ID NO: 3229481 - protein, 22 aa, Plasmodium falciparum
KNDNKDDTKNDCDNEKDDDDYV

SEQ ID NO: 3229482 - protein, 10 aa, Plasmodium falciparum
KNDNKNSTKL

SEQ ID NO: 3229483 - protein, 8 aa, Plasmodium falciparum
KNDNKNTL

SEQ ID NO: 3229484 - protein, 19 aa, Plasmodium falciparum
KNDNKQNKNLTKKSPHDKF

SEQ ID NO: 3229485 - protein, 5 aa, Plasmodium falciparum
KNDNL

SEQ ID NO: 3229486 - protein, 12 aa, Plasmodium falciparum
KNDNLNNNKVDE

SEQ ID NO: 3229487 - protein, 30 aa, Plasmodium falciparum
KNDNNMNDNNINGDKINGDNINADNINGDN

SEQ ID NO: 3229488 - protein, 9 aa, Plasmodium falciparum
KNDNNNNNN

SEQ ID NO: 3229489 - protein, 36 aa, Plasmodium falciparum
KNDNNNNNNNNNNNYNNNNNKNNYNNNNKKNYSYSN

SEQ ID NO: 3229490 - protein, 8 aa, Plasmodium falciparum
KNDNNYKK

SEQ ID NO: 3229491 - protein, 22 aa, Plasmodium falciparum
KNDNSFDRNKESYNPNVGNEKD

SEQ ID NO: 3229492 - protein, 18 aa, Plasmodium falciparum
KNDNSRSAKSMKKKKKRK

SEQ ID NO: 3229493 - protein, 28 aa, Plasmodium falciparum
KNDNSYKNKKEGTGKNNDNNDPNNNNNK

SEQ ID NO: 3229494 - protein, 9 aa, Plasmodium falciparum
KNDNTNNYE

SEQ ID NO: 3229495 - protein, 4 aa, Plasmodium falciparum
KNDP

SEQ ID NO: 3229496 - protein, 13 aa, Plasmodium falciparum
KNDQENKGTFDER

SEQ ID NO: 3229497 - protein, 7 aa, Plasmodium falciparum
KNDQGSV

SEQ ID NO: 3229498 - protein, 7 aa, Plasmodium falciparum
KNDQNAY

SEQ ID NO: 3229499 - protein, 9 aa, Plasmodium falciparum
KNDQNDNYN

SEQ ID NO: 3229500 - protein, 15 aa, Plasmodium falciparum
KNDQNIQNRKREKRT

SEQ ID NO: 3229501 - protein, 40 aa, Plasmodium falciparum
KNDQSNDTLSTYKNNNEMTVEGKPNNLASGEGKKEIHNTT

SEQ ID NO: 3229502 - protein, 14 aa, Plasmodium falciparum
KNDRDKNGNEESQT

SEQ ID NO: 3229503 - protein, 7 aa, Plasmodium falciparum
KNDRTEI

SEQ ID NO: 3229504 - protein, 6 aa, Plasmodium falciparum
KNDRVK

SEQ ID NO: 3229505 - protein, 18 aa, Plasmodium falciparum
KNDSDGNVGNFDNNSTYS

SEQ ID NO: 3229506 - protein, 10 aa, Plasmodium falciparum
KNDSDYKETT

SEQ ID NO: 3229507 - protein, 16 aa, Plasmodium falciparum
KNDSLKNTQPEKDADQ

SEQ ID NO: 3229508 - protein, 6 aa, Plasmodium falciparum
KNDSNK

SEQ ID NO: 3229509 - protein, 15 aa, Plasmodium falciparum
KNDSNKMKKYDEPCN

SEQ ID NO: 3229510 - protein, 21 aa, Plasmodium falciparum
KNDSNSDNNYNNDNNIQNNTC

SEQ ID NO: 3229511 - protein, 18 aa, Plasmodium falciparum
KNDSNSNSHSSNGSSKTL

SEQ ID NO: 3229512 - protein, 10 aa, Plasmodium falciparum
KNDSSAYNNS

SEQ ID NO: 3229513 - protein, 17 aa, Plasmodium falciparum
KNDSSLQYEQNNDTDKF

SEQ ID NO: 3229514 - protein, 37 aa, Plasmodium falciparum
KNDSTSHMKKKKDEGSNRKGNINMDSNNNDDNNNNIN

SEQ ID NO: 3229515 - protein, 19 aa, Plasmodium falciparum
KNDSYDNFGKGNDFNSGNN

SEQ ID NO: 3229516 - protein, 12 aa, Plasmodium falciparum
KNDTLSNSRDNK

SEQ ID NO: 3229517 - protein, 6 aa, Plasmodium falciparum
KNDTLY

SEQ ID NO: 3229518 - protein, 5 aa, Plasmodium falciparum
KNDTM

SEQ ID NO: 3229519 - protein, 6 aa, Plasmodium falciparum
KNDTRE

SEQ ID NO: 3229520 - protein, 13 aa, Plasmodium falciparum
KNDTSEKSSQKNL

SEQ ID NO: 3229521 - protein, 7 aa, Plasmodium falciparum
KNDTYKC

SEQ ID NO: 3229522 - protein, 19 aa, Plasmodium falciparum
KNDVEEDVSVEDEDDSDYD

SEQ ID NO: 3229523 - protein, 10 aa, Plasmodium falciparum
KNDYKDDNSP

SEQ ID NO: 3229524 - protein, 21 aa, Plasmodium falciparum
KNDYNNKSYDNDNEKKRTRKK

SEQ ID NO: 3229525 - protein, 6 aa, Plasmodium falciparum
KNDYQN

SEQ ID NO: 3229526 - protein, 7 aa, Plasmodium falciparum
KNDYQRK

SEQ ID NO: 3229527 - protein, 13 aa, Plasmodium falciparum
KNDYTKDKRNNNL

SEQ ID NO: 3229528 - protein, 14 aa, Plasmodium falciparum
KNECNENKNESNKY

SEQ ID NO: 3229529 - protein, 8 aa, Plasmodium falciparum
KNEDEKEF

SEQ ID NO: 3229530 - protein, 7 aa, Plasmodium falciparum
KNEDEYN

SEQ ID NO: 3229531 - protein, 6 aa, Plasmodium falciparum
KNEDGK

SEQ ID NO: 3229532 - protein, 7 aa, Plasmodium falciparum
KNEDGSL

SEQ ID NO: 3229533 - protein, 6 aa, Plasmodium falciparum
KNEDIE

SEQ ID NO: 3229534 - protein, 9 aa, Plasmodium falciparum
KNEDKDKEI

SEQ ID NO: 3229535 - protein, 9 aa, Plasmodium falciparum
KNEDKENNT

SEQ ID NO: 3229536 - protein, 5 aa, Plasmodium falciparum
KNEDL

SEQ ID NO: 3229537 - protein, 7 aa, Plasmodium falciparum
KNEDNFT

SEQ ID NO: 3229538 - protein, 27 aa, Plasmodium falciparum
KNEDNKNKNKNLSSNNINYNNDETDDI

SEQ ID NO: 3229539 - protein, 7 aa, Plasmodium falciparum
KNEDNMA

SEQ ID NO: 3229540 - protein, 7 aa, Plasmodium falciparum
KNEDNND

SEQ ID NO: 3229541 - protein, 13 aa, Plasmodium falciparum
KNEDNNRYDEEEM

SEQ ID NO: 3229542 - protein, 8 aa, Plasmodium falciparum
KNEDNTLY

SEQ ID NO: 3229543 - protein, 7 aa, Plasmodium falciparum
KNEDQNI

SEQ ID NO: 3229544 - protein, 8 aa, Plasmodium falciparum
KNEECDEY

SEQ ID NO: 3229545 - protein, 7 aa, Plasmodium falciparum
KNEEDKN

SEQ ID NO: 3229546 - protein, 8 aa, Plasmodium falciparum
KNEEDTQE

SEQ ID NO: 3229547 - protein, 7 aa, Plasmodium falciparum
KNEEEMK

SEQ ID NO: 3229548 - protein, 7 aa, Plasmodium falciparum
KNEEERE

SEQ ID NO: 3229549 - protein, 7 aa, Plasmodium falciparum
KNEEGDL

SEQ ID NO: 3229550 - protein, 6 aa, Plasmodium falciparum
KNEEGI

SEQ ID NO: 3229551 - protein, 22 aa, Plasmodium falciparum
KNEEGKNFNDNHKNIEKHDNDT

SEQ ID NO: 3229552 - protein, 8 aa, Plasmodium falciparum
KNEEGYVA

SEQ ID NO: 3229553 - protein, 6 aa, Plasmodium falciparum
KNEEKE

SEQ ID NO: 3229554 - protein, 10 aa, Plasmodium falciparum
KNEEKEETDD

SEQ ID NO: 3229555 - protein, 8 aa, Plasmodium falciparum
KNEEKHSK

SEQ ID NO: 3229556 - protein, 7 aa, Plasmodium falciparum
KNEEMRN

SEQ ID NO: 3229557 - protein, 13 aa, Plasmodium falciparum
KNEENENKNTGIQ

SEQ ID NO: 3229558 - protein, 8 aa, Plasmodium falciparum
KNEENKNI

SEQ ID NO: 3229559 - protein, 30 aa, Plasmodium falciparum
KNEENQNGKAPTDNENQKPISKENEKIKEQ

SEQ ID NO: 3229560 - protein, 9 aa, Plasmodium falciparum
KNEENYSYS

SEQ ID NO: 3229561 - protein, 27 aa, Plasmodium falciparum
KNEEPNEEKGERTDETKNKGNNKENCS

SEQ ID NO: 3229562 - protein, 111 aa, Plasmodium falciparum
KNEERSETQKDQKDQKDQKDQKDQKDQKDQKDQKDQKDQKDQKDQKDQKDQKDQKDQKDQKNVNTDGKMDGYTDDKMNGYTNDASYYGQEEDETYEGENKKCKDIKTCESK

SEQ ID NO: 3229563 - protein, 5 aa, Plasmodium falciparum
KNEES

SEQ ID NO: 3229564 - protein, 8 aa, Plasmodium falciparum
KNEESNFK

SEQ ID NO: 3229565 - protein, 20 aa, Plasmodium falciparum
KNEETNKKDTKLKKKRNVKT

SEQ ID NO: 3229566 - protein, 6 aa, Plasmodium falciparum
KNEEYG

SEQ ID NO: 3229567 - protein, 16 aa, Plasmodium falciparum
KNEGDDEKDNYTNNKN

SEQ ID NO: 3229568 - protein, 6 aa, Plasmodium falciparum
KNEGEN

SEQ ID NO: 3229569 - protein, 8 aa, Plasmodium falciparum
KNEGKDPS

SEQ ID NO: 3229570 - protein, 5 aa, Plasmodium falciparum
KNEGN

SEQ ID NO: 3229571 - protein, 9 aa, Plasmodium falciparum
KNEGNMNKR

SEQ ID NO: 3229572 - protein, 6 aa, Plasmodium falciparum
KNEGNP

SEQ ID NO: 3229573 - protein, 11 aa, Plasmodium falciparum
KNEHEKNDGRI

SEQ ID NO: 3229574 - protein, 9 aa, Plasmodium falciparum
KNEHGEHNK

SEQ ID NO: 3229575 - protein, 6 aa, Plasmodium falciparum
KNEHIN

SEQ ID NO: 3229576 - protein, 32 aa, Plasmodium falciparum
KNEHKRKKNKQKKKKNKLKNKKKHINKTKHNT

SEQ ID NO: 3229577 - protein, 9 aa, Plasmodium falciparum
KNEHRDTEA

SEQ ID NO: 3229578 - protein, 4 aa, Plasmodium falciparum
KNEI

SEQ ID NO: 3229579 - protein, 23 aa, Plasmodium falciparum
KNEIEENNYPDKYPMNSKNSYVT

SEQ ID NO: 3229580 - protein, 17 aa, Plasmodium falciparum
KNEIKKNEIKRNESERN

SEQ ID NO: 3229581 - protein, 5 aa, Plasmodium falciparum
KNEIN

SEQ ID NO: 3229582 - protein, 7 aa, Plasmodium falciparum
KNEINSY

SEQ ID NO: 3229583 - protein, 14 aa, Plasmodium falciparum
KNEIQPKDKIYKPN

SEQ ID NO: 3229584 - protein, 6 aa, Plasmodium falciparum
KNEIRT

SEQ ID NO: 3229585 - protein, 6 aa, Plasmodium falciparum
KNEITG

SEQ ID NO: 3229586 - protein, 4 aa, Plasmodium falciparum
KNEK

SEQ ID NO: 3229587 - protein, 5 aa, Plasmodium falciparum
KNEKA

SEQ ID NO: 3229588 - protein, 7 aa, Plasmodium falciparum
KNEKDDK

SEQ ID NO: 3229589 - protein, 9 aa, Plasmodium falciparum
KNEKDNCNN

SEQ ID NO: 3229590 - protein, 26 aa, Plasmodium falciparum
KNEKDQHDQHDQNDQHDQNDQNDQKD

SEQ ID NO: 3229591 - protein, 10 aa, Plasmodium falciparum
KNEKDVTEKS

SEQ ID NO: 3229592 - protein, 6 aa, Plasmodium falciparum
KNEKEI

SEQ ID NO: 3229593 - protein, 12 aa, Plasmodium falciparum
KNEKEKKNDNIN

SEQ ID NO: 3229594 - protein, 17 aa, Plasmodium falciparum
KNEKFKEVKEEEPNVEN

SEQ ID NO: 3229595 - protein, 8 aa, Plasmodium falciparum
KNEKFYND

SEQ ID NO: 3229596 - protein, 6 aa, Plasmodium falciparum
KNEKIQ

SEQ ID NO: 3229597 - protein, 8 aa, Plasmodium falciparum
KNEKKIQR

SEQ ID NO: 3229598 - protein, 11 aa, Plasmodium falciparum
KNEKKKKKNII

SEQ ID NO: 3229599 - protein, 13 aa, Plasmodium falciparum
KNEKKKKNLPITN

SEQ ID NO: 3229600 - protein, 18 aa, Plasmodium falciparum
KNEKKKKYKNYNKYSKGM

SEQ ID NO: 3229601 - protein, 33 aa, Plasmodium falciparum
KNEKMKNDKEETGNEQANNCNKTLDGNKTLDGN

SEQ ID NO: 3229602 - protein, 7 aa, Plasmodium falciparum
KNEKNDK

SEQ ID NO: 3229603 - protein, 14 aa, Plasmodium falciparum
KNEKNEKKKITNNL

SEQ ID NO: 3229604 - protein, 9 aa, Plasmodium falciparum
KNEKNEKYQ

SEQ ID NO: 3229605 - protein, 12 aa, Plasmodium falciparum
KNEKNKKKSNLQ

SEQ ID NO: 3229606 - protein, 13 aa, Plasmodium falciparum
KNEKNKRKYLSNT

SEQ ID NO: 3229607 - protein, 7 aa, Plasmodium falciparum
KNEKNNI

SEQ ID NO: 3229608 - protein, 7 aa, Plasmodium falciparum
KNEKNQG

SEQ ID NO: 3229609 - protein, 9 aa, Plasmodium falciparum
KNEKNQMKK

SEQ ID NO: 3229610 - protein, 10 aa, Plasmodium falciparum
KNEKNSSDGI

SEQ ID NO: 3229611 - protein, 8 aa, Plasmodium falciparum
KNEKNTRN

SEQ ID NO: 3229612 - protein, 8 aa, Plasmodium falciparum
KNEKPIEN

SEQ ID NO: 3229613 - protein, 5 aa, Plasmodium falciparum
KNEKR

SEQ ID NO: 3229614 - protein, 22 aa, Plasmodium falciparum
KNEKREKPEKKKKERKKETANI

SEQ ID NO: 3229615 - protein, 24 aa, Plasmodium falciparum
KNEKREYDNNNNNNNNNNNNNNNI

SEQ ID NO: 3229616 - protein, 37 aa, Plasmodium falciparum
KNEKRSSNNIKKSSEKRKRRNRNENTKCAEKKNIDNY

SEQ ID NO: 3229617 - protein, 6 aa, Plasmodium falciparum
KNEKSE

SEQ ID NO: 3229618 - protein, 7 aa, Plasmodium falciparum
KNEKSKK

SEQ ID NO: 3229619 - protein, 7 aa, Plasmodium falciparum
KNEKSSQ

SEQ ID NO: 3229620 - protein, 13 aa, Plasmodium falciparum
KNEKTDGEKKNNE

SEQ ID NO: 3229621 - protein, 9 aa, Plasmodium falciparum
KNEKTEEEN

SEQ ID NO: 3229622 - protein, 10 aa, Plasmodium falciparum
KNEKTNDTYD

SEQ ID NO: 3229623 - protein, 15 aa, Plasmodium falciparum
KNEKVPEEKQKDNDH

SEQ ID NO: 3229624 - protein, 5 aa, Plasmodium falciparum
KNEKY

SEQ ID NO: 3229625 - protein, 8 aa, Plasmodium falciparum
KNEKYQPS

SEQ ID NO: 3229626 - protein, 5 aa, Plasmodium falciparum
KNELD

SEQ ID NO: 3229627 - protein, 5 aa, Plasmodium falciparum
KNELE

SEQ ID NO: 3229628 - protein, 6 aa, Plasmodium falciparum
KNELEK

SEQ ID NO: 3229629 - protein, 7 aa, Plasmodium falciparum
KNELKDD

SEQ ID NO: 3229630 - protein, 6 aa, Plasmodium falciparum
KNELKG

SEQ ID NO: 3229631 - protein, 7 aa, Plasmodium falciparum
KNELTNN

SEQ ID NO: 3229632 - protein, 13 aa, Plasmodium falciparum
KNEMDKKKDQMDI

SEQ ID NO: 3229633 - protein, 31 aa, Plasmodium falciparum
KNEMGNVRSSQHDNSNNNNNEVNNNNNNNNV

SEQ ID NO: 3229634 - protein, 5 aa, Plasmodium falciparum
KNEND

SEQ ID NO: 3229635 - protein, 10 aa, Plasmodium falciparum
KNENDKQMQQ

SEQ ID NO: 3229636 - protein, 24 aa, Plasmodium falciparum
KNENDYNQYNNNNNNNNNNNNNSS

SEQ ID NO: 3229637 - protein, 9 aa, Plasmodium falciparum
KNENEAKKF

SEQ ID NO: 3229638 - protein, 13 aa, Plasmodium falciparum
KNENEKSNGNTLK

SEQ ID NO: 3229639 - protein, 8 aa, Plasmodium falciparum
KNENENRI

SEQ ID NO: 3229640 - protein, 11 aa, Plasmodium falciparum
KNENENSDNHE

SEQ ID NO: 3229641 - protein, 8 aa, Plasmodium falciparum
KNENGTDL

SEQ ID NO: 3229642 - protein, 5 aa, Plasmodium falciparum
KNENH

SEQ ID NO: 3229643 - protein, 8 aa, Plasmodium falciparum
KNENKETV

SEQ ID NO: 3229644 - protein, 8 aa, Plasmodium falciparum
KNENKKND

SEQ ID NO: 3229645 - protein, 8 aa, Plasmodium falciparum
KNENKTNK

SEQ ID NO: 3229646 - protein, 7 aa, Plasmodium falciparum
KNENKYK

SEQ ID NO: 3229647 - protein, 7 aa, Plasmodium falciparum
KNENMNS

SEQ ID NO: 3229648 - protein, 5 aa, Plasmodium falciparum
KNENN

SEQ ID NO: 3229649 - protein, 12 aa, Plasmodium falciparum
KNENNDEDQSTL

SEQ ID NO: 3229650 - protein, 20 aa, Plasmodium falciparum
KNENNGEGISLSSEKQKVSF

SEQ ID NO: 3229651 - protein, 28 aa, Plasmodium falciparum
KNENNINDEKEKKSSNVITKNNKEQNEI

SEQ ID NO: 3229652 - protein, 10 aa, Plasmodium falciparum
KNENNKREES

SEQ ID NO: 3229653 - protein, 8 aa, Plasmodium falciparum
KNENNYQN

SEQ ID NO: 3229654 - protein, 10 aa, Plasmodium falciparum
KNENRNTNNY

SEQ ID NO: 3229655 - protein, 10 aa, Plasmodium falciparum
KNENSTKHPN

SEQ ID NO: 3229656 - protein, 8 aa, Plasmodium falciparum
KNENTKFD

SEQ ID NO: 3229657 - protein, 5 aa, Plasmodium falciparum
KNENV

SEQ ID NO: 3229658 - protein, 7 aa, Plasmodium falciparum
KNENVDV

SEQ ID NO: 3229659 - protein, 7 aa, Plasmodium falciparum
KNENYEE

SEQ ID NO: 3229660 - protein, 6 aa, Plasmodium falciparum
KNENYR

SEQ ID NO: 3229661 - protein, 7 aa, Plasmodium falciparum
KNENYTS

SEQ ID NO: 3229662 - protein, 8 aa, Plasmodium falciparum
KNENYYEQ

SEQ ID NO: 3229663 - protein, 13 aa, Plasmodium falciparum
KNEPHTTPHHPPN

SEQ ID NO: 3229664 - protein, 6 aa, Plasmodium falciparum
KNEPIN

SEQ ID NO: 3229665 - protein, 6 aa, Plasmodium falciparum
KNEPKL

SEQ ID NO: 3229666 - protein, 16 aa, Plasmodium falciparum
KNEPQEIKEKEKEKEP

SEQ ID NO: 3229667 - protein, 13 aa, Plasmodium falciparum
KNEQDNSKKFKEK

SEQ ID NO: 3229668 - protein, 18 aa, Plasmodium falciparum
KNEQDTNNTHTPNHDEYS

SEQ ID NO: 3229669 - protein, 7 aa, Plasmodium falciparum
KNEQEEY

SEQ ID NO: 3229670 - protein, 10 aa, Plasmodium falciparum
KNEQINNTKV

SEQ ID NO: 3229671 - protein, 8 aa, Plasmodium falciparum
KNEQKNNY

SEQ ID NO: 3229672 - protein, 10 aa, Plasmodium falciparum
KNEQNKIDKT

SEQ ID NO: 3229673 - protein, 8 aa, Plasmodium falciparum
KNEQNNDN

SEQ ID NO: 3229674 - protein, 19 aa, Plasmodium falciparum
KNEQNTSCPNSQQTNHENI

SEQ ID NO: 3229675 - protein, 6 aa, Plasmodium falciparum
KNEQTT

SEQ ID NO: 3229676 - protein, 6 aa, Plasmodium falciparum
KNEQVN

SEQ ID NO: 3229677 - protein, 6 aa, Plasmodium falciparum
KNEREL

SEQ ID NO: 3229678 - protein, 5 aa, Plasmodium falciparum
KNERI

SEQ ID NO: 3229679 - protein, 7 aa, Plasmodium falciparum
KNERNAD

SEQ ID NO: 3229680 - protein, 7 aa, Plasmodium falciparum
KNERNKK

SEQ ID NO: 3229681 - protein, 14 aa, Plasmodium falciparum
KNERNKKKKSKHIY

SEQ ID NO: 3229682 - protein, 7 aa, Plasmodium falciparum
KNERQND

SEQ ID NO: 3229683 - protein, 10 aa, Plasmodium falciparum
KNESDVNKSI

SEQ ID NO: 3229684 - protein, 7 aa, Plasmodium falciparum
KNESKSF

SEQ ID NO: 3229685 - protein, 10 aa, Plasmodium falciparum
KNESNQEIEE

SEQ ID NO: 3229686 - protein, 12 aa, Plasmodium falciparum
KNESNQKNKKEN

SEQ ID NO: 3229687 - protein, 15 aa, Plasmodium falciparum
KNESPDFNKSYNDSL

SEQ ID NO: 3229688 - protein, 5 aa, Plasmodium falciparum
KNESR

SEQ ID NO: 3229689 - protein, 9 aa, Plasmodium falciparum
KNESRNIET

SEQ ID NO: 3229690 - protein, 7 aa, Plasmodium falciparum
KNESSSP

SEQ ID NO: 3229691 - protein, 7 aa, Plasmodium falciparum
KNESTYT

SEQ ID NO: 3229692 - protein, 7 aa, Plasmodium falciparum
KNETCNK

SEQ ID NO: 3229693 - protein, 27 aa, Plasmodium falciparum
KNETDEGNKNETEEIYKNDNDDDNYDD

SEQ ID NO: 3229694 - protein, 5 aa, Plasmodium falciparum
KNETI

SEQ ID NO: 3229695 - protein, 6 aa, Plasmodium falciparum
KNETKN

SEQ ID NO: 3229696 - protein, 14 aa, Plasmodium falciparum
KNETKTKSRNSEQV

SEQ ID NO: 3229697 - protein, 12 aa, Plasmodium falciparum
KNETLQKKSKIK

SEQ ID NO: 3229698 - protein, 19 aa, Plasmodium falciparum
KNETNDNYPNSTIRNQHPN

SEQ ID NO: 3229699 - protein, 5 aa, Plasmodium falciparum
KNETS

SEQ ID NO: 3229700 - protein, 10 aa, Plasmodium falciparum
KNEVTPSNKN

SEQ ID NO: 3229701 - protein, 5 aa, Plasmodium falciparum
KNEWE

SEQ ID NO: 3229702 - protein, 14 aa, Plasmodium falciparum
KNEYDKQKSKYVNE

SEQ ID NO: 3229703 - protein, 5 aa, Plasmodium falciparum
KNEYE

SEQ ID NO: 3229704 - protein, 6 aa, Plasmodium falciparum
KNEYGN

SEQ ID NO: 3229705 - protein, 8 aa, Plasmodium falciparum
KNEYNKKD

SEQ ID NO: 3229706 - protein, 7 aa, Plasmodium falciparum
KNEYTTK

SEQ ID NO: 3229707 - protein, 12 aa, Plasmodium falciparum
KNFAQDPSEVFP

SEQ ID NO: 3229708 - protein, 5 aa, Plasmodium falciparum
KNFDK

SEQ ID NO: 3229709 - protein, 4 aa, Plasmodium falciparum
KNFE

SEQ ID NO: 3229710 - protein, 14 aa, Plasmodium falciparum
KNFEGNQDKNDHRT

SEQ ID NO: 3229711 - protein, 56 aa, Plasmodium falciparum
KNFERTNNNNNNNNGNNNGNNNGNNNGNNNDNNNDNNNDNNNGNNNDNNNYNNNGE

SEQ ID NO: 3229712 - protein, 6 aa, Plasmodium falciparum
KNFGTN

SEQ ID NO: 3229713 - protein, 6 aa, Plasmodium falciparum
KNFHTQ

SEQ ID NO: 3229714 - protein, 49 aa, Plasmodium falciparum
KNFNEDKKKKKHHNQNQNNNQNDAYSNASKGVTIQANDKNVNSDINTSI

SEQ ID NO: 3229715 - protein, 6 aa, Plasmodium falciparum
KNFNRK

SEQ ID NO: 3229716 - protein, 7 aa, Plasmodium falciparum
KNFPISN

SEQ ID NO: 3229717 - protein, 6 aa, Plasmodium falciparum
KNFPSN

SEQ ID NO: 3229718 - protein, 10 aa, Plasmodium falciparum
KNGADGTAKK

SEQ ID NO: 3229719 - protein, 15 aa, Plasmodium falciparum
KNGATGEKSKNGNQI

SEQ ID NO: 3229720 - protein, 8 aa, Plasmodium falciparum
KNGDDNKC

SEQ ID NO: 3229721 - protein, 7 aa, Plasmodium falciparum
KNGDESE

SEQ ID NO: 3229722 - protein, 17 aa, Plasmodium falciparum
KNGDKPTNGEEKVDNEK

SEQ ID NO: 3229723 - protein, 6 aa, Plasmodium falciparum
KNGDNN

SEQ ID NO: 3229724 - protein, 7 aa, Plasmodium falciparum
KNGDPLT

SEQ ID NO: 3229725 - protein, 4 aa, Plasmodium falciparum
KNGE

SEQ ID NO: 3229726 - protein, 11 aa, Plasmodium falciparum
KNGEAKNNRRK

SEQ ID NO: 3229727 - protein, 11 aa, Plasmodium falciparum
KNGEDENEKKL

SEQ ID NO: 3229728 - protein, 6 aa, Plasmodium falciparum
KNGEDP

SEQ ID NO: 3229729 - protein, 10 aa, Plasmodium falciparum
KNGEGEYNDM

SEQ ID NO: 3229730 - protein, 9 aa, Plasmodium falciparum
KNGEIDDNT

SEQ ID NO: 3229731 - protein, 7 aa, Plasmodium falciparum
KNGEKKK

SEQ ID NO: 3229732 - protein, 20 aa, Plasmodium falciparum
KNGEKNGKENDLKDENNCSI

SEQ ID NO: 3229733 - protein, 9 aa, Plasmodium falciparum
KNGESNNNT

SEQ ID NO: 3229734 - protein, 8 aa, Plasmodium falciparum
KNGESTNM

SEQ ID NO: 3229735 - protein, 9 aa, Plasmodium falciparum
KNGETFGSS

SEQ ID NO: 3229736 - protein, 16 aa, Plasmodium falciparum
KNGETLPSGRDNDKYA

SEQ ID NO: 3229737 - protein, 32 aa, Plasmodium falciparum
KNGHKTNSGNNKINDNRNNKINDNRNNKINES

SEQ ID NO: 3229738 - protein, 11 aa, Plasmodium falciparum
KNGHQNITDTN

SEQ ID NO: 3229739 - protein, 8 aa, Plasmodium falciparum
KNGIEKNK

SEQ ID NO: 3229740 - protein, 16 aa, Plasmodium falciparum
KNGISGENKNDKKPTE

SEQ ID NO: 3229741 - protein, 15 aa, Plasmodium falciparum
KNGKCDNDKGGDCNG

SEQ ID NO: 3229742 - protein, 6 aa, Plasmodium falciparum
KNGKHE

SEQ ID NO: 3229743 - protein, 7 aa, Plasmodium falciparum
KNGKIKT

SEQ ID NO: 3229744 - protein, 9 aa, Plasmodium falciparum
KNGKPNNIE

SEQ ID NO: 3229745 - protein, 7 aa, Plasmodium falciparum
KNGKTKH

SEQ ID NO: 3229746 - protein, 11 aa, Plasmodium falciparum
KNGKTNGEEEL

SEQ ID NO: 3229747 - protein, 24 aa, Plasmodium falciparum
KNGKTNGKKGEIETRYKKDDEDGN

SEQ ID NO: 3229748 - protein, 5 aa, Plasmodium falciparum
KNGLK

SEQ ID NO: 3229749 - protein, 11 aa, Plasmodium falciparum
KNGLNRNSTTF

SEQ ID NO: 3229750 - protein, 16 aa, Plasmodium falciparum
KNGLSKNNDDSSIGLS

SEQ ID NO: 3229751 - protein, 34 aa, Plasmodium falciparum
KNGNDTCSDEMNGDETINGNETINGNIKKNNTSQ

SEQ ID NO: 3229752 - protein, 12 aa, Plasmodium falciparum
KNGNEETGIDGG

SEQ ID NO: 3229753 - protein, 7 aa, Plasmodium falciparum
KNGNGYI

SEQ ID NO: 3229754 - protein, 11 aa, Plasmodium falciparum
KNGNIKSEEEI

SEQ ID NO: 3229755 - protein, 14 aa, Plasmodium falciparum
KNGNLKVNNNNQVS

SEQ ID NO: 3229756 - protein, 10 aa, Plasmodium falciparum
KNGNNNNTKY

SEQ ID NO: 3229757 - protein, 10 aa, Plasmodium falciparum
KNGNNQHDHD

SEQ ID NO: 3229758 - protein, 12 aa, Plasmodium falciparum
KNGNNQNNENYE

SEQ ID NO: 3229759 - protein, 22 aa, Plasmodium falciparum
KNGNNRNNVYNDNNKKSNNYKY

SEQ ID NO: 3229760 - protein, 13 aa, Plasmodium falciparum
KNGNTCKKNNCKD

SEQ ID NO: 3229761 - protein, 14 aa, Plasmodium falciparum
KNGPLKKEYSTQIL

SEQ ID NO: 3229762 - protein, 11 aa, Plasmodium falciparum
KNGPNNDIDNN

SEQ ID NO: 3229763 - protein, 44 aa, Plasmodium falciparum
KNGQGNVKSNDEEDEDNEESGEKDSSSDEDSSDFDNSVGENGEE

SEQ ID NO: 3229764 - protein, 6 aa, Plasmodium falciparum
KNGQNK

SEQ ID NO: 3229765 - protein, 7 aa, Plasmodium falciparum
KNGQSKC

SEQ ID NO: 3229766 - protein, 14 aa, Plasmodium falciparum
KNGQTGENHKDITE

SEQ ID NO: 3229767 - protein, 7 aa, Plasmodium falciparum
KNGRQDH

SEQ ID NO: 3229768 - protein, 11 aa, Plasmodium falciparum
KNGRQKKKSSL

SEQ ID NO: 3229769 - protein, 9 aa, Plasmodium falciparum
KNGRRKKGD

SEQ ID NO: 3229770 - protein, 29 aa, Plasmodium falciparum
KNGRYTAKDQKYPDCRNEKYDPNNAETTD

SEQ ID NO: 3229771 - protein, 15 aa, Plasmodium falciparum
KNGSFKNTNKLNDNK

SEQ ID NO: 3229772 - protein, 8 aa, Plasmodium falciparum
KNGTGIEY

SEQ ID NO: 3229773 - protein, 17 aa, Plasmodium falciparum
KNGTKIRGEHAAEPMST

SEQ ID NO: 3229774 - protein, 25 aa, Plasmodium falciparum
KNGTKLTGGNNAEPISTTDKEIAKT

SEQ ID NO: 3229775 - protein, 17 aa, Plasmodium falciparum
KNGTKTKSRYSEEEMST

SEQ ID NO: 3229776 - protein, 62 aa, Plasmodium falciparum
KNGVGKHKQRTNKSQKNTKYNKKYNTQNDIDSNTQNDIDSNTQNDIDSNTENNTDDNTENNI

SEQ ID NO: 3229777 - protein, 13 aa, Plasmodium falciparum
KNGVKAANDAEDV

SEQ ID NO: 3229778 - protein, 6 aa, Plasmodium falciparum
KNGVPP

SEQ ID NO: 3229779 - protein, 4 aa, Plasmodium falciparum
KNGY

SEQ ID NO: 3229780 - protein, 5 aa, Plasmodium falciparum
KNGYE

SEQ ID NO: 3229781 - protein, 6 aa, Plasmodium falciparum
KNGYMD

SEQ ID NO: 3229782 - protein, 7 aa, Plasmodium falciparum
KNHDGYK

SEQ ID NO: 3229783 - protein, 16 aa, Plasmodium falciparum
KNHETKKDTKKPKQYH

SEQ ID NO: 3229784 - protein, 12 aa, Plasmodium falciparum
KNHGEKKTQENL

SEQ ID NO: 3229785 - protein, 5 aa, Plasmodium falciparum
KNHMD

SEQ ID NO: 3229786 - protein, 5 aa, Plasmodium falciparum
KNHND

SEQ ID NO: 3229787 - protein, 15 aa, Plasmodium falciparum
KNHNNDEKRKKEYIN

SEQ ID NO: 3229788 - protein, 8 aa, Plasmodium falciparum
KNHNNKSV

SEQ ID NO: 3229789 - protein, 7 aa, Plasmodium falciparum
KNHNNLK

SEQ ID NO: 3229790 - protein, 7 aa, Plasmodium falciparum
KNHNNNI

SEQ ID NO: 3229791 - protein, 8 aa, Plasmodium falciparum
KNHNPHYH

SEQ ID NO: 3229792 - protein, 36 aa, Plasmodium falciparum
KNHPNGNNNNNKKNYNNSKNYNKDKNFNNNVSSNGY

SEQ ID NO: 3229793 - protein, 4 aa, Plasmodium falciparum
KNHS

SEQ ID NO: 3229794 - protein, 20 aa, Plasmodium falciparum
KNHSNGKGDSNNPCNNKGNR

SEQ ID NO: 3229795 - protein, 7 aa, Plasmodium falciparum
KNHTIQT

SEQ ID NO: 3229796 - protein, 8 aa, Plasmodium falciparum
KNHTTNNI

SEQ ID NO: 3229797 - protein, 10 aa, Plasmodium falciparum
KNHYNDTPDY

SEQ ID NO: 3229798 - protein, 4 aa, Plasmodium falciparum
KNID

SEQ ID NO: 3229799 - protein, 7 aa, Plasmodium falciparum
KNIDEYP

SEQ ID NO: 3229800 - protein, 5 aa, Plasmodium falciparum
KNIDI

SEQ ID NO: 3229801 - protein, 5 aa, Plasmodium falciparum
KNIDN

SEQ ID NO: 3229802 - protein, 15 aa, Plasmodium falciparum
KNIDNNNNINNNYPY

SEQ ID NO: 3229803 - protein, 10 aa, Plasmodium falciparum
KNIDNNNNVD

SEQ ID NO: 3229804 - protein, 12 aa, Plasmodium falciparum
KNIDNVKTKKNK

SEQ ID NO: 3229805 - protein, 6 aa, Plasmodium falciparum
KNIDQR

SEQ ID NO: 3229806 - protein, 41 aa, Plasmodium falciparum
KNIDSNKYNNDNNYNNNDDNNNYKTNKFSNTNKTNNKEKHK

SEQ ID NO: 3229807 - protein, 6 aa, Plasmodium falciparum
KNIDTP

SEQ ID NO: 3229808 - protein, 4 aa, Plasmodium falciparum
KNIE

SEQ ID NO: 3229809 - protein, 7 aa, Plasmodium falciparum
KNIEEKK

SEQ ID NO: 3229810 - protein, 6 aa, Plasmodium falciparum
KNIEEN

SEQ ID NO: 3229811 - protein, 6 aa, Plasmodium falciparum
KNIEPT

SEQ ID NO: 3229812 - protein, 7 aa, Plasmodium falciparum
KNIERGI

SEQ ID NO: 3229813 - protein, 5 aa, Plasmodium falciparum
KNIES

SEQ ID NO: 3229814 - protein, 16 aa, Plasmodium falciparum
KNIETHEKNEKEYEPE

SEQ ID NO: 3229815 - protein, 6 aa, Plasmodium falciparum
KNIETN

SEQ ID NO: 3229816 - protein, 6 aa, Plasmodium falciparum
KNIGNK

SEQ ID NO: 3229817 - protein, 4 aa, Plasmodium falciparum
KNIH

SEQ ID NO: 3229818 - protein, 15 aa, Plasmodium falciparum
KNIHEDKKKDNLNEP

SEQ ID NO: 3229819 - protein, 18 aa, Plasmodium falciparum
KNIHGEKKNNDEYENSQR

SEQ ID NO: 3229820 - protein, 34 aa, Plasmodium falciparum
KNIHNNNNNNNNNNNNNNNNNNNNNNNNNNNNGA

SEQ ID NO: 3229821 - protein, 15 aa, Plasmodium falciparum
KNIINQSEKEFSVNE

SEQ ID NO: 3229822 - protein, 8 aa, Plasmodium falciparum
KNIKDDEE

SEQ ID NO: 3229823 - protein, 8 aa, Plasmodium falciparum
KNIKDGEV

SEQ ID NO: 3229824 - protein, 48 aa, Plasmodium falciparum
KNIKGNIKKKRTQNIHGDTQTNSYNDNTKPQSKGKQKVNTLNNESNTY

SEQ ID NO: 3229825 - protein, 8 aa, Plasmodium falciparum
KNIKGTYN

SEQ ID NO: 3229826 - protein, 6 aa, Plasmodium falciparum
KNIKNK

SEQ ID NO: 3229827 - protein, 13 aa, Plasmodium falciparum
KNIKQKKKNKINK

SEQ ID NO: 3229828 - protein, 11 aa, Plasmodium falciparum
KNIKYGDASND

SEQ ID NO: 3229829 - protein, 18 aa, Plasmodium falciparum
KNIKYNNDDMNKNERNKK

SEQ ID NO: 3229830 - protein, 4 aa, Plasmodium falciparum
KNIN

SEQ ID NO: 3229831 - protein, 15 aa, Plasmodium falciparum
KNINEDKSFSEEQTK

SEQ ID NO: 3229832 - protein, 14 aa, Plasmodium falciparum
KNINEDNNNPHNYQ

SEQ ID NO: 3229833 - protein, 23 aa, Plasmodium falciparum
KNINEKKQTYEKDKSDNKQIEST

SEQ ID NO: 3229834 - protein, 7 aa, Plasmodium falciparum
KNINEKN

SEQ ID NO: 3229835 - protein, 23 aa, Plasmodium falciparum
KNINGDHYDDDVENIEKKKNYKE

SEQ ID NO: 3229836 - protein, 9 aa, Plasmodium falciparum
KNINKEKIN

SEQ ID NO: 3229837 - protein, 18 aa, Plasmodium falciparum
KNINKQKNKKDDKKNTKK

SEQ ID NO: 3229838 - protein, 14 aa, Plasmodium falciparum
KNINNNNNNNDSKI

SEQ ID NO: 3229839 - protein, 6 aa, Plasmodium falciparum
KNINQN

SEQ ID NO: 3229840 - protein, 7 aa, Plasmodium falciparum
KNINSNN

SEQ ID NO: 3229841 - protein, 8 aa, Plasmodium falciparum
KNINSPGT

SEQ ID NO: 3229842 - protein, 6 aa, Plasmodium falciparum
KNINSY

SEQ ID NO: 3229843 - protein, 9 aa, Plasmodium falciparum
KNINTDKNV

SEQ ID NO: 3229844 - protein, 4 aa, Plasmodium falciparum
KNIP

SEQ ID NO: 3229845 - protein, 9 aa, Plasmodium falciparum
KNIPKKNDY

SEQ ID NO: 3229846 - protein, 7 aa, Plasmodium falciparum
KNIPNDN

SEQ ID NO: 3229847 - protein, 7 aa, Plasmodium falciparum
KNIPPDL

SEQ ID NO: 3229848 - protein, 63 aa, Plasmodium falciparum
KNIPQLNENGNSNSNGNSNGNSNGNSNGNSNGNSNGNSNKNSNKNSNENSNENSNKDNKISYQ

SEQ ID NO: 3229849 - protein, 11 aa, Plasmodium falciparum
KNIPTKHPNEH

SEQ ID NO: 3229850 - protein, 5 aa, Plasmodium falciparum
KNIPY

SEQ ID NO: 3229851 - protein, 35 aa, Plasmodium falciparum
KNIQDNQKEYYDYNNNNGDDYNNNRDDNKNNFDNY

SEQ ID NO: 3229852 - protein, 5 aa, Plasmodium falciparum
KNIQE

SEQ ID NO: 3229853 - protein, 6 aa, Plasmodium falciparum
KNIQES

SEQ ID NO: 3229854 - protein, 12 aa, Plasmodium falciparum
KNIQKQSLGMLF

SEQ ID NO: 3229855 - protein, 15 aa, Plasmodium falciparum
KNIQNESYNNYKNND

SEQ ID NO: 3229856 - protein, 17 aa, Plasmodium falciparum
KNIQRDKENKKKGNRQI

SEQ ID NO: 3229857 - protein, 4 aa, Plasmodium falciparum
KNIR

SEQ ID NO: 3229858 - protein, 24 aa, Plasmodium falciparum
KNIRDNNKSNDDDNNKNNNNNDKY

SEQ ID NO: 3229859 - protein, 13 aa, Plasmodium falciparum
KNIRDTKNKPDDV

SEQ ID NO: 3229860 - protein, 5 aa, Plasmodium falciparum
KNIRG

SEQ ID NO: 3229861 - protein, 6 aa, Plasmodium falciparum
KNIRNR

SEQ ID NO: 3229862 - protein, 6 aa, Plasmodium falciparum
KNIRNY

SEQ ID NO: 3229863 - protein, 10 aa, Plasmodium falciparum
KNISDSTKAH

SEQ ID NO: 3229864 - protein, 53 aa, Plasmodium falciparum
KNISKKNTHSIKNNQNDKNKEKNKEKDKNIKKDRDKDIQTKRTSHQSQDQNNH

SEQ ID NO: 3229865 - protein, 8 aa, Plasmodium falciparum
KNISKNNV

SEQ ID NO: 3229866 - protein, 12 aa, Plasmodium falciparum
KNISNKREDMYN

SEQ ID NO: 3229867 - protein, 7 aa, Plasmodium falciparum
KNISNNY

SEQ ID NO: 3229868 - protein, 5 aa, Plasmodium falciparum
KNISS

SEQ ID NO: 3229869 - protein, 15 aa, Plasmodium falciparum
KNISSTNNIRPNQNM

SEQ ID NO: 3229870 - protein, 4 aa, Plasmodium falciparum
KNIT

SEQ ID NO: 3229871 - protein, 8 aa, Plasmodium falciparum
KNITDSAN

SEQ ID NO: 3229872 - protein, 14 aa, Plasmodium falciparum
KNITGIKKKKDADN

SEQ ID NO: 3229873 - protein, 12 aa, Plasmodium falciparum
KNITNNANNANN

SEQ ID NO: 3229874 - protein, 5 aa, Plasmodium falciparum
KNITR

SEQ ID NO: 3229875 - protein, 5 aa, Plasmodium falciparum
KNITS

SEQ ID NO: 3229876 - protein, 8 aa, Plasmodium falciparum
KNITSKNS

SEQ ID NO: 3229877 - protein, 5 aa, Plasmodium falciparum
KNIYD

SEQ ID NO: 3229878 - protein, 22 aa, Plasmodium falciparum
KNIYSDKKKKKIYSDNNNNNNN

SEQ ID NO: 3229879 - protein, 9 aa, Plasmodium falciparum
KNKAISKDI

SEQ ID NO: 3229880 - protein, 19 aa, Plasmodium falciparum
KNKAKPNNEFDQGKKKNAD

SEQ ID NO: 3229881 - protein, 14 aa, Plasmodium falciparum
KNKAQEADVSVSNE

SEQ ID NO: 3229882 - protein, 8 aa, Plasmodium falciparum
KNKASTNI

SEQ ID NO: 3229883 - protein, 21 aa, Plasmodium falciparum
KNKASTTTQDENITKQSPQMK

SEQ ID NO: 3229884 - protein, 5 aa, Plasmodium falciparum
KNKCK

SEQ ID NO: 3229885 - protein, 9 aa, Plasmodium falciparum
KNKCNEDRK

SEQ ID NO: 3229886 - protein, 7 aa, Plasmodium falciparum
KNKCNND

SEQ ID NO: 3229887 - protein, 10 aa, Plasmodium falciparum
KNKCSDLNSA

SEQ ID NO: 3229888 - protein, 17 aa, Plasmodium falciparum
KNKCSNKNYTVNNRKEY

SEQ ID NO: 3229889 - protein, 12 aa, Plasmodium falciparum
KNKDDDKKKIKK

SEQ ID NO: 3229890 - protein, 8 aa, Plasmodium falciparum
KNKDDTPK

SEQ ID NO: 3229891 - protein, 7 aa, Plasmodium falciparum
KNKDDWD

SEQ ID NO: 3229892 - protein, 10 aa, Plasmodium falciparum
KNKDGKEGLG

SEQ ID NO: 3229893 - protein, 7 aa, Plasmodium falciparum
KNKDKEK

SEQ ID NO: 3229894 - protein, 7 aa, Plasmodium falciparum
KNKDKKL

SEQ ID NO: 3229895 - protein, 8 aa, Plasmodium falciparum
KNKDKLEK

SEQ ID NO: 3229896 - protein, 7 aa, Plasmodium falciparum
KNKDKNK

SEQ ID NO: 3229897 - protein, 10 aa, Plasmodium falciparum
KNKDKNNYDH

SEQ ID NO: 3229898 - protein, 7 aa, Plasmodium falciparum
KNKDNED

SEQ ID NO: 3229899 - protein, 13 aa, Plasmodium falciparum
KNKDNLLNNNNNN

SEQ ID NO: 3229900 - protein, 15 aa, Plasmodium falciparum
KNKDNTYDNNINNTY

SEQ ID NO: 3229901 - protein, 143 aa, Plasmodium falciparum
KNKDPSDNKNDNPSDNKKDNPSDNKKDNPSDNKKDNPYDNKKDNPSDNKKDNPYDNKKDNPSDNKKDNPYDNKKDNPSDNKKDNPYDNKKDNPYDNKKDNPYDNKKDNPYDNKKDNPYDNKKDNPYDNKKDNPYDNKKDENFC

SEQ ID NO: 3229902 - protein, 7 aa, Plasmodium falciparum
KNKDRKK

SEQ ID NO: 3229903 - protein, 6 aa, Plasmodium falciparum
KNKDTY

SEQ ID NO: 3229904 - protein, 7 aa, Plasmodium falciparum
KNKDTYK

SEQ ID NO: 3229905 - protein, 8 aa, Plasmodium falciparum
KNKDVKGQ

SEQ ID NO: 3229906 - protein, 5 aa, Plasmodium falciparum
KNKEC

SEQ ID NO: 3229907 - protein, 6 aa, Plasmodium falciparum
KNKEDE

SEQ ID NO: 3229908 - protein, 8 aa, Plasmodium falciparum
KNKEDGKN

SEQ ID NO: 3229909 - protein, 7 aa, Plasmodium falciparum
KNKEDGV

SEQ ID NO: 3229910 - protein, 6 aa, Plasmodium falciparum
KNKEDN

SEQ ID NO: 3229911 - protein, 6 aa, Plasmodium falciparum
KNKEEC

SEQ ID NO: 3229912 - protein, 15 aa, Plasmodium falciparum
KNKEEEKHKNVDNTE

SEQ ID NO: 3229913 - protein, 19 aa, Plasmodium falciparum
KNKEEKKEKEKKSEEEPAE

SEQ ID NO: 3229914 - protein, 8 aa, Plasmodium falciparum
KNKEGDLL

SEQ ID NO: 3229915 - protein, 24 aa, Plasmodium falciparum
KNKEGDLLKSKEGDLIKNKEGDLI

SEQ ID NO: 3229916 - protein, 5 aa, Plasmodium falciparum
KNKEI

SEQ ID NO: 3229917 - protein, 18 aa, Plasmodium falciparum
KNKEIAEKKQRDSTNPFG

SEQ ID NO: 3229918 - protein, 16 aa, Plasmodium falciparum
KNKEINEIENPNKKHD

SEQ ID NO: 3229919 - protein, 15 aa, Plasmodium falciparum
KNKEINMNQQSDNKM

SEQ ID NO: 3229920 - protein, 7 aa, Plasmodium falciparum
KNKEIYK

SEQ ID NO: 3229921 - protein, 29 aa, Plasmodium falciparum
KNKEKEIIPSRDNNYNNKYNNNKYNNKYN

SEQ ID NO: 3229922 - protein, 6 aa, Plasmodium falciparum
KNKEKK

SEQ ID NO: 3229923 - protein, 19 aa, Plasmodium falciparum
KNKEKKNVGNKDKEKDAFN

SEQ ID NO: 3229924 - protein, 24 aa, Plasmodium falciparum
KNKEKMNSNKNKKGNYKDDHMNSY

SEQ ID NO: 3229925 - protein, 7 aa, Plasmodium falciparum
KNKEKPY

SEQ ID NO: 3229926 - protein, 12 aa, Plasmodium falciparum
KNKEKYSEYNDD

SEQ ID NO: 3229927 - protein, 5 aa, Plasmodium falciparum
KNKEM

SEQ ID NO: 3229928 - protein, 7 aa, Plasmodium falciparum
KNKENHN

SEQ ID NO: 3229929 - protein, 6 aa, Plasmodium falciparum
KNKENN

SEQ ID NO: 3229930 - protein, 7 aa, Plasmodium falciparum
KNKENNK

SEQ ID NO: 3229931 - protein, 19 aa, Plasmodium falciparum
KNKENNNKISDNAKSTNAT

SEQ ID NO: 3229932 - protein, 9 aa, Plasmodium falciparum
KNKENNNYT

SEQ ID NO: 3229933 - protein, 9 aa, Plasmodium falciparum
KNKENPNKE

SEQ ID NO: 3229934 - protein, 12 aa, Plasmodium falciparum
KNKENSIGGGDK

SEQ ID NO: 3229935 - protein, 7 aa, Plasmodium falciparum
KNKENYG

SEQ ID NO: 3229936 - protein, 6 aa, Plasmodium falciparum
KNKEPG

SEQ ID NO: 3229937 - protein, 6 aa, Plasmodium falciparum
KNKEQV

SEQ ID NO: 3229938 - protein, 11 aa, Plasmodium falciparum
KNKERKNYNNV

SEQ ID NO: 3229939 - protein, 10 aa, Plasmodium falciparum
KNKERQSNHN

SEQ ID NO: 3229940 - protein, 20 aa, Plasmodium falciparum
KNKESNEDNNSDERNKNKHL

SEQ ID NO: 3229941 - protein, 7 aa, Plasmodium falciparum
KNKEYTN

SEQ ID NO: 3229942 - protein, 7 aa, Plasmodium falciparum
KNKFPQN

SEQ ID NO: 3229943 - protein, 12 aa, Plasmodium falciparum
KNKFTKKNINKK

SEQ ID NO: 3229944 - protein, 4 aa, Plasmodium falciparum
KNKG

SEQ ID NO: 3229945 - protein, 5 aa, Plasmodium falciparum
KNKGI

SEQ ID NO: 3229946 - protein, 11 aa, Plasmodium falciparum
KNKGKKKQQGI

SEQ ID NO: 3229947 - protein, 8 aa, Plasmodium falciparum
KNKGPGII

SEQ ID NO: 3229948 - protein, 8 aa, Plasmodium falciparum
KNKGRTKN

SEQ ID NO: 3229949 - protein, 11 aa, Plasmodium falciparum
KNKGTKNMDNR

SEQ ID NO: 3229950 - protein, 8 aa, Plasmodium falciparum
KNKHKNIN

SEQ ID NO: 3229951 - protein, 9 aa, Plasmodium falciparum
KNKHKNTKK

SEQ ID NO: 3229952 - protein, 17 aa, Plasmodium falciparum
KNKHNGSSSNEHSSYSD

SEQ ID NO: 3229953 - protein, 13 aa, Plasmodium falciparum
KNKHNKNNNNNDR

SEQ ID NO: 3229954 - protein, 9 aa, Plasmodium falciparum
KNKHNNNVD

SEQ ID NO: 3229955 - protein, 16 aa, Plasmodium falciparum
KNKHRGGTERNEEDTK

SEQ ID NO: 3229956 - protein, 6 aa, Plasmodium falciparum
KNKIDY

SEQ ID NO: 3229957 - protein, 9 aa, Plasmodium falciparum
KNKIEHNTK

SEQ ID NO: 3229958 - protein, 8 aa, Plasmodium falciparum
KNKIGEKK

SEQ ID NO: 3229959 - protein, 23 aa, Plasmodium falciparum
KNKIMDKNNNNNKYNNNNNNNMK

SEQ ID NO: 3229960 - protein, 7 aa, Plasmodium falciparum
KNKISIK

SEQ ID NO: 3229961 - protein, 8 aa, Plasmodium falciparum
KNKISKEG

SEQ ID NO: 3229962 - protein, 18 aa, Plasmodium falciparum
KNKISKKDVSKEINKNNN

SEQ ID NO: 3229963 - protein, 7 aa, Plasmodium falciparum
KNKITNN

SEQ ID NO: 3229964 - protein, 22 aa, Plasmodium falciparum
KNKKCNNNNNNKYNNDNNNNIN

SEQ ID NO: 3229965 - protein, 5 aa, Plasmodium falciparum
KNKKD

SEQ ID NO: 3229966 - protein, 13 aa, Plasmodium falciparum
KNKKDAEVKRNNE

SEQ ID NO: 3229967 - protein, 7 aa, Plasmodium falciparum
KNKKDEC

SEQ ID NO: 3229968 - protein, 8 aa, Plasmodium falciparum
KNKKDEDI

SEQ ID NO: 3229969 - protein, 12 aa, Plasmodium falciparum
KNKKDKENEHNN

SEQ ID NO: 3229970 - protein, 10 aa, Plasmodium falciparum
KNKKDNHNEK

SEQ ID NO: 3229971 - protein, 19 aa, Plasmodium falciparum
KNKKDNQENTQKTNSKNVS

SEQ ID NO: 3229972 - protein, 9 aa, Plasmodium falciparum
KNKKDTKID

SEQ ID NO: 3229973 - protein, 7 aa, Plasmodium falciparum
KNKKEEF

SEQ ID NO: 3229974 - protein, 13 aa, Plasmodium falciparum
KNKKEINNAKNAR

SEQ ID NO: 3229975 - protein, 10 aa, Plasmodium falciparum
KNKKEKRKTN

SEQ ID NO: 3229976 - protein, 9 aa, Plasmodium falciparum
KNKKENIDN

SEQ ID NO: 3229977 - protein, 5 aa, Plasmodium falciparum
KNKKF

SEQ ID NO: 3229978 - protein, 6 aa, Plasmodium falciparum
KNKKFN

SEQ ID NO: 3229979 - protein, 41 aa, Plasmodium falciparum
KNKKGEEVDEYKEEDNNENNNNDDNNNNNNNNNNNNNNNID

SEQ ID NO: 3229980 - protein, 16 aa, Plasmodium falciparum
KNKKGIENEQKKEQKL

SEQ ID NO: 3229981 - protein, 13 aa, Plasmodium falciparum
KNKKGRKKKDNLR

SEQ ID NO: 3229982 - protein, 8 aa, Plasmodium falciparum
KNKKHERK

SEQ ID NO: 3229983 - protein, 7 aa, Plasmodium falciparum
KNKKHKN

SEQ ID NO: 3229984 - protein, 10 aa, Plasmodium falciparum
KNKKHNKDEI

SEQ ID NO: 3229985 - protein, 5 aa, Plasmodium falciparum
KNKKI

SEQ ID NO: 3229986 - protein, 8 aa, Plasmodium falciparum
KNKKINYE

SEQ ID NO: 3229987 - protein, 6 aa, Plasmodium falciparum
KNKKIT

SEQ ID NO: 3229988 - protein, 16 aa, Plasmodium falciparum
KNKKKDNLNNEEDQVN

SEQ ID NO: 3229989 - protein, 9 aa, Plasmodium falciparum
KNKKKFKDN

SEQ ID NO: 3229990 - protein, 7 aa, Plasmodium falciparum
KNKKKIK

SEQ ID NO: 3229991 - protein, 9 aa, Plasmodium falciparum
KNKKKKEDH

SEQ ID NO: 3229992 - protein, 10 aa, Plasmodium falciparum
KNKKKKKKFE

SEQ ID NO: 3229993 - protein, 12 aa, Plasmodium falciparum
KNKKKKKKTKKM

SEQ ID NO: 3229994 - protein, 14 aa, Plasmodium falciparum
KNKKKKQKKINKTY

SEQ ID NO: 3229995 - protein, 10 aa, Plasmodium falciparum
KNKKKNGDMH

SEQ ID NO: 3229996 - protein, 7 aa, Plasmodium falciparum
KNKKKNN

SEQ ID NO: 3229997 - protein, 9 aa, Plasmodium falciparum
KNKKKNNSM

SEQ ID NO: 3229998 - protein, 7 aa, Plasmodium falciparum
KNKKKNT

SEQ ID NO: 3229999 - protein, 7 aa, Plasmodium falciparum
KNKKKSY

SEQ ID NO: 3230000 - protein, 26 aa, Plasmodium falciparum
KNKKLKKQKRPKKQKIKNKKYKHKND

SEQ ID NO: 3230001 - protein, 6 aa, Plasmodium falciparum
KNKKND

SEQ ID NO: 3230002 - protein, 6 aa, Plasmodium falciparum
KNKKNE

SEQ ID NO: 3230003 - protein, 9 aa, Plasmodium falciparum
KNKKNENYI

SEQ ID NO: 3230004 - protein, 8 aa, Plasmodium falciparum
KNKKNKYN

SEQ ID NO: 3230005 - protein, 7 aa, Plasmodium falciparum
KNKKNNL

SEQ ID NO: 3230006 - protein, 7 aa, Plasmodium falciparum
KNKKNTY

SEQ ID NO: 3230007 - protein, 6 aa, Plasmodium falciparum
KNKKRI

SEQ ID NO: 3230008 - protein, 25 aa, Plasmodium falciparum
KNKKRKTSTCYNNNNNNDDDDDKLS

SEQ ID NO: 3230009 - protein, 7 aa, Plasmodium falciparum
KNKKSEE

SEQ ID NO: 3230010 - protein, 8 aa, Plasmodium falciparum
KNKKSGEV

SEQ ID NO: 3230011 - protein, 9 aa, Plasmodium falciparum
KNKKSKGEH

SEQ ID NO: 3230012 - protein, 7 aa, Plasmodium falciparum
KNKKSKS

SEQ ID NO: 3230013 - protein, 7 aa, Plasmodium falciparum
KNKKSTI

SEQ ID NO: 3230014 - protein, 8 aa, Plasmodium falciparum
KNKKTDTC

SEQ ID NO: 3230015 - protein, 8 aa, Plasmodium falciparum
KNKKTNVN

SEQ ID NO: 3230016 - protein, 14 aa, Plasmodium falciparum
KNKKVDDEKTETNN

SEQ ID NO: 3230017 - protein, 5 aa, Plasmodium falciparum
KNKKY

SEQ ID NO: 3230018 - protein, 11 aa, Plasmodium falciparum
KNKKYKKESED

SEQ ID NO: 3230019 - protein, 5 aa, Plasmodium falciparum
KNKLR

SEQ ID NO: 3230020 - protein, 5 aa, Plasmodium falciparum
KNKMC

SEQ ID NO: 3230021 - protein, 18 aa, Plasmodium falciparum
KNKMNKDNYTNNTCSKDS

SEQ ID NO: 3230022 - protein, 15 aa, Plasmodium falciparum
KNKMNKKAHYTKLLK

SEQ ID NO: 3230023 - protein, 7 aa, Plasmodium falciparum
KNKMSNK

SEQ ID NO: 3230024 - protein, 4 aa, Plasmodium falciparum
KNKN

SEQ ID NO: 3230025 - protein, 12 aa, Plasmodium falciparum
KNKNADCEQTQY

SEQ ID NO: 3230026 - protein, 5 aa, Plasmodium falciparum
KNKND

SEQ ID NO: 3230027 - protein, 13 aa, Plasmodium falciparum
KNKNDDNKTKHEI

SEQ ID NO: 3230028 - protein, 8 aa, Plasmodium falciparum
KNKNDKNN

SEQ ID NO: 3230029 - protein, 5 aa, Plasmodium falciparum
KNKNE

SEQ ID NO: 3230030 - protein, 7 aa, Plasmodium falciparum
KNKNEEI

SEQ ID NO: 3230031 - protein, 11 aa, Plasmodium falciparum
KNKNEYKTNEK

SEQ ID NO: 3230032 - protein, 29 aa, Plasmodium falciparum
KNKNFTSTKGNLDKNNSNRNNTYNNSNVS

SEQ ID NO: 3230033 - protein, 8 aa, Plasmodium falciparum
KNKNGIQK

SEQ ID NO: 3230034 - protein, 9 aa, Plasmodium falciparum
KNKNKDLNK

SEQ ID NO: 3230035 - protein, 10 aa, Plasmodium falciparum
KNKNKEIKYN

SEQ ID NO: 3230036 - protein, 11 aa, Plasmodium falciparum
KNKNKHEKEIE

SEQ ID NO: 3230037 - protein, 7 aa, Plasmodium falciparum
KNKNKIR

SEQ ID NO: 3230038 - protein, 8 aa, Plasmodium falciparum
KNKNKITK

SEQ ID NO: 3230039 - protein, 6 aa, Plasmodium falciparum
KNKNKN

SEQ ID NO: 3230040 - protein, 18 aa, Plasmodium falciparum
KNKNKNKNKNKNKNMEQI

SEQ ID NO: 3230041 - protein, 19 aa, Plasmodium falciparum
KNKNKNSKINKKTVDNKET

SEQ ID NO: 3230042 - protein, 13 aa, Plasmodium falciparum
KNKNKRKKRKSRS

SEQ ID NO: 3230043 - protein, 16 aa, Plasmodium falciparum
KNKNKTNNTTQGQNNN

SEQ ID NO: 3230044 - protein, 7 aa, Plasmodium falciparum
KNKNKYN

SEQ ID NO: 3230045 - protein, 5 aa, Plasmodium falciparum
KNKNM

SEQ ID NO: 3230046 - protein, 7 aa, Plasmodium falciparum
KNKNMNN

SEQ ID NO: 3230047 - protein, 15 aa, Plasmodium falciparum
KNKNNISYSSNDTSL

SEQ ID NO: 3230048 - protein, 8 aa, Plasmodium falciparum
KNKNNMNN

SEQ ID NO: 3230049 - protein, 20 aa, Plasmodium falciparum
KNKNNNNNNINNNNNNNNSN

SEQ ID NO: 3230050 - protein, 24 aa, Plasmodium falciparum
KNKNNNNNNSNNKRKKNEKNEKID

SEQ ID NO: 3230051 - protein, 8 aa, Plasmodium falciparum
KNKNNSNY

SEQ ID NO: 3230052 - protein, 24 aa, Plasmodium falciparum
KNKNNSSVSSAEEYSLEDSNDDDD

SEQ ID NO: 3230053 - protein, 9 aa, Plasmodium falciparum
KNKNNSTNE

SEQ ID NO: 3230054 - protein, 9 aa, Plasmodium falciparum
KNKNNYQKK

SEQ ID NO: 3230055 - protein, 7 aa, Plasmodium falciparum
KNKNRNP

SEQ ID NO: 3230056 - protein, 9 aa, Plasmodium falciparum
KNKNRSYDS

SEQ ID NO: 3230057 - protein, 20 aa, Plasmodium falciparum
KNKNTNNNNNNNNNNSNNNN

SEQ ID NO: 3230058 - protein, 5 aa, Plasmodium falciparum
KNKNY

SEQ ID NO: 3230059 - protein, 8 aa, Plasmodium falciparum
KNKNYGYN

SEQ ID NO: 3230060 - protein, 16 aa, Plasmodium falciparum
KNKPHTTPHHTPTTTT

SEQ ID NO: 3230061 - protein, 8 aa, Plasmodium falciparum
KNKPNHLT

SEQ ID NO: 3230062 - protein, 9 aa, Plasmodium falciparum
KNKPNNNYN

SEQ ID NO: 3230063 - protein, 8 aa, Plasmodium falciparum
KNKPSITS

SEQ ID NO: 3230064 - protein, 14 aa, Plasmodium falciparum
KNKPSITSHHTPRY

SEQ ID NO: 3230065 - protein, 5 aa, Plasmodium falciparum
KNKPT

SEQ ID NO: 3230066 - protein, 7 aa, Plasmodium falciparum
KNKPYIT

SEQ ID NO: 3230067 - protein, 7 aa, Plasmodium falciparum
KNKPYLK

SEQ ID NO: 3230068 - protein, 6 aa, Plasmodium falciparum
KNKPYM

SEQ ID NO: 3230069 - protein, 9 aa, Plasmodium falciparum
KNKQENDTN

SEQ ID NO: 3230070 - protein, 12 aa, Plasmodium falciparum
KNKQETKLNTTT

SEQ ID NO: 3230071 - protein, 7 aa, Plasmodium falciparum
KNKQGDL

SEQ ID NO: 3230072 - protein, 8 aa, Plasmodium falciparum
KNKQKNNL

SEQ ID NO: 3230073 - protein, 6 aa, Plasmodium falciparum
KNKQNI

SEQ ID NO: 3230074 - protein, 6 aa, Plasmodium falciparum
KNKQNK

SEQ ID NO: 3230075 - protein, 12 aa, Plasmodium falciparum
KNKQTINSTTNK

SEQ ID NO: 3230076 - protein, 19 aa, Plasmodium falciparum
KNKQTKKTKYFNKKERKKN

SEQ ID NO: 3230077 - protein, 24 aa, Plasmodium falciparum
KNKQTNDKNLKSNPSDNKGTNNSE

SEQ ID NO: 3230078 - protein, 10 aa, Plasmodium falciparum
KNKQTNSQQY

SEQ ID NO: 3230079 - protein, 4 aa, Plasmodium falciparum
KNKR

SEQ ID NO: 3230080 - protein, 6 aa, Plasmodium falciparum
KNKRGN

SEQ ID NO: 3230081 - protein, 10 aa, Plasmodium falciparum
KNKRKKKKFK

SEQ ID NO: 3230082 - protein, 7 aa, Plasmodium falciparum
KNKRRKR

SEQ ID NO: 3230083 - protein, 5 aa, Plasmodium falciparum
KNKRS

SEQ ID NO: 3230084 - protein, 5 aa, Plasmodium falciparum
KNKRT

SEQ ID NO: 3230085 - protein, 8 aa, Plasmodium falciparum
KNKRVENN

SEQ ID NO: 3230086 - protein, 8 aa, Plasmodium falciparum
KNKRVQNV

SEQ ID NO: 3230087 - protein, 4 aa, Plasmodium falciparum
KNKS

SEQ ID NO: 3230088 - protein, 9 aa, Plasmodium falciparum
KNKSDEEKC

SEQ ID NO: 3230089 - protein, 6 aa, Plasmodium falciparum
KNKSED

SEQ ID NO: 3230090 - protein, 12 aa, Plasmodium falciparum
KNKSEKCKNECN

SEQ ID NO: 3230091 - protein, 7 aa, Plasmodium falciparum
KNKSIHQ

SEQ ID NO: 3230092 - protein, 19 aa, Plasmodium falciparum
KNKSKGSQSNSQKEPDEIQ

SEQ ID NO: 3230093 - protein, 9 aa, Plasmodium falciparum
KNKSKHTLN

SEQ ID NO: 3230094 - protein, 8 aa, Plasmodium falciparum
KNKSKNEK

SEQ ID NO: 3230095 - protein, 8 aa, Plasmodium falciparum
KNKSKNLK

SEQ ID NO: 3230096 - protein, 5 aa, Plasmodium falciparum
KNKSL

SEQ ID NO: 3230097 - protein, 23 aa, Plasmodium falciparum
KNKSLKDEKSGMHNDNNNNNNNN

SEQ ID NO: 3230098 - protein, 21 aa, Plasmodium falciparum
KNKSNKKNKKMKKKEIKNNSR

SEQ ID NO: 3230099 - protein, 7 aa, Plasmodium falciparum
KNKSNKN

SEQ ID NO: 3230100 - protein, 5 aa, Plasmodium falciparum
KNKSP

SEQ ID NO: 3230101 - protein, 6 aa, Plasmodium falciparum
KNKSSD

SEQ ID NO: 3230102 - protein, 17 aa, Plasmodium falciparum
KNKSSNVINNDSEYNHP

SEQ ID NO: 3230103 - protein, 48 aa, Plasmodium falciparum
KNKSTDKKNGKSKINIKNEKKKKINNSKINKGRKGINKKDKGKGDDNN

SEQ ID NO: 3230104 - protein, 11 aa, Plasmodium falciparum
KNKSYKYKNNN

SEQ ID NO: 3230105 - protein, 8 aa, Plasmodium falciparum
KNKSYNMK

SEQ ID NO: 3230106 - protein, 7 aa, Plasmodium falciparum
KNKSYTT

SEQ ID NO: 3230107 - protein, 9 aa, Plasmodium falciparum
KNKTDDNHN

SEQ ID NO: 3230108 - protein, 7 aa, Plasmodium falciparum
KNKTEET

SEQ ID NO: 3230109 - protein, 15 aa, Plasmodium falciparum
KNKTESKSNTKGERT

SEQ ID NO: 3230110 - protein, 5 aa, Plasmodium falciparum
KNKTG

SEQ ID NO: 3230111 - protein, 6 aa, Plasmodium falciparum
KNKTIS

SEQ ID NO: 3230112 - protein, 11 aa, Plasmodium falciparum
KNKTKEDDQND

SEQ ID NO: 3230113 - protein, 7 aa, Plasmodium falciparum
KNKTKIT

SEQ ID NO: 3230114 - protein, 7 aa, Plasmodium falciparum
KNKTKNK

SEQ ID NO: 3230115 - protein, 9 aa, Plasmodium falciparum
KNKTKQNKT

SEQ ID NO: 3230116 - protein, 6 aa, Plasmodium falciparum
KNKTND

SEQ ID NO: 3230117 - protein, 10 aa, Plasmodium falciparum
KNKTNKTNIN

SEQ ID NO: 3230118 - protein, 6 aa, Plasmodium falciparum
KNKTNN

SEQ ID NO: 3230119 - protein, 10 aa, Plasmodium falciparum
KNKTNNDKYK

SEQ ID NO: 3230120 - protein, 10 aa, Plasmodium falciparum
KNKTNNNGEM

SEQ ID NO: 3230121 - protein, 40 aa, Plasmodium falciparum
KNKTRNKHNNNNNNNNNNNNNNNNNNNNNNNNNNNNNNNN

SEQ ID NO: 3230122 - protein, 10 aa, Plasmodium falciparum
KNKTSKRKKY

SEQ ID NO: 3230123 - protein, 22 aa, Plasmodium falciparum
KNKTSTKKDDLNENIKDSTIKN

SEQ ID NO: 3230124 - protein, 15 aa, Plasmodium falciparum
KNKTTLIEKSSNKTD

SEQ ID NO: 3230125 - protein, 5 aa, Plasmodium falciparum
KNKVK

SEQ ID NO: 3230126 - protein, 16 aa, Plasmodium falciparum
KNKVNNNNLESNSDVS

SEQ ID NO: 3230127 - protein, 6 aa, Plasmodium falciparum
KNKYDD

SEQ ID NO: 3230128 - protein, 9 aa, Plasmodium falciparum
KNKYDQADQ

SEQ ID NO: 3230129 - protein, 11 aa, Plasmodium falciparum
KNKYKNDNEEY

SEQ ID NO: 3230130 - protein, 10 aa, Plasmodium falciparum
KNKYNDEEKM

SEQ ID NO: 3230131 - protein, 8 aa, Plasmodium falciparum
KNKYNNKN

SEQ ID NO: 3230132 - protein, 10 aa, Plasmodium falciparum
KNKYNTKKEC

SEQ ID NO: 3230133 - protein, 5 aa, Plasmodium falciparum
KNKYY

SEQ ID NO: 3230134 - protein, 49 aa, Plasmodium falciparum
KNLDDQTNNQMDNQKDDQTNNQMDNQNDDQTNNQKNNQINNQTNNQMDE

SEQ ID NO: 3230135 - protein, 5 aa, Plasmodium falciparum
KNLDG

SEQ ID NO: 3230136 - protein, 4 aa, Plasmodium falciparum
KNLE

SEQ ID NO: 3230137 - protein, 5 aa, Plasmodium falciparum
KNLEA

SEQ ID NO: 3230138 - protein, 6 aa, Plasmodium falciparum
KNLENK

SEQ ID NO: 3230139 - protein, 7 aa, Plasmodium falciparum
KNLGNYN

SEQ ID NO: 3230140 - protein, 11 aa, Plasmodium falciparum
KNLKDKNNNTR

SEQ ID NO: 3230141 - protein, 17 aa, Plasmodium falciparum
KNLKPSHEKKNDDNGKK

SEQ ID NO: 3230142 - protein, 10 aa, Plasmodium falciparum
KNLKREDNIN

SEQ ID NO: 3230143 - protein, 4 aa, Plasmodium falciparum
KNLN

SEQ ID NO: 3230144 - protein, 64 aa, Plasmodium falciparum
KNLNEQENKNMNEEENKRMNEQENKSMNEQENKSMNEQENKSMNEQENKSMNDQGEQRNDYVKN

SEQ ID NO: 3230145 - protein, 7 aa, Plasmodium falciparum
KNLNNSY

SEQ ID NO: 3230146 - protein, 8 aa, Plasmodium falciparum
KNLNNTNN

SEQ ID NO: 3230147 - protein, 13 aa, Plasmodium falciparum
KNLNQNDDNQKSF

SEQ ID NO: 3230148 - protein, 8 aa, Plasmodium falciparum
KNLSKEDI

SEQ ID NO: 3230149 - protein, 8 aa, Plasmodium falciparum
KNLSREDK

SEQ ID NO: 3230150 - protein, 63 aa, Plasmodium falciparum
KNLSSNKRSQKGYNSNSDDIKKKKKSNCNENEGSLDKYNDKEKKNDKINNGDTKNSDDGKIDM

SEQ ID NO: 3230151 - protein, 5 aa, Plasmodium falciparum
KNLST

SEQ ID NO: 3230152 - protein, 10 aa, Plasmodium falciparum
KNLSYKDDDI

SEQ ID NO: 3230153 - protein, 6 aa, Plasmodium falciparum
KNLTET

SEQ ID NO: 3230154 - protein, 7 aa, Plasmodium falciparum
KNLTETE

SEQ ID NO: 3230155 - protein, 19 aa, Plasmodium falciparum
KNLTRIDENKKQAENNNPM

SEQ ID NO: 3230156 - protein, 20 aa, Plasmodium falciparum
KNLYDNQDNSMKDDINNNDK

SEQ ID NO: 3230157 - protein, 7 aa, Plasmodium falciparum
KNMEGTS

SEQ ID NO: 3230158 - protein, 18 aa, Plasmodium falciparum
KNMEKDKVTPNNCKDSRF

SEQ ID NO: 3230159 - protein, 5 aa, Plasmodium falciparum
KNMEQ

SEQ ID NO: 3230160 - protein, 34 aa, Plasmodium falciparum
KNMETDSYNYNNDNNYDGNYDNNYDNNYDQNNNK

SEQ ID NO: 3230161 - protein, 15 aa, Plasmodium falciparum
KNMETQDHMNKSQKK

SEQ ID NO: 3230162 - protein, 16 aa, Plasmodium falciparum
KNMGEKNIDEKNISQD

SEQ ID NO: 3230163 - protein, 6 aa, Plasmodium falciparum
KNMHNK

SEQ ID NO: 3230164 - protein, 4 aa, Plasmodium falciparum
KNMK

SEQ ID NO: 3230165 - protein, 5 aa, Plasmodium falciparum
KNMKK

SEQ ID NO: 3230166 - protein, 10 aa, Plasmodium falciparum
KNMKKKKKKG

SEQ ID NO: 3230167 - protein, 8 aa, Plasmodium falciparum
KNMNENDD

SEQ ID NO: 3230168 - protein, 12 aa, Plasmodium falciparum
KNMNNNNNKISR

SEQ ID NO: 3230169 - protein, 7 aa, Plasmodium falciparum
KNMQKQN

SEQ ID NO: 3230170 - protein, 4 aa, Plasmodium falciparum
KNMS

SEQ ID NO: 3230171 - protein, 7 aa, Plasmodium falciparum
KNMSGSS

SEQ ID NO: 3230172 - protein, 6 aa, Plasmodium falciparum
KNMSKK

SEQ ID NO: 3230173 - protein, 8 aa, Plasmodium falciparum
KNMTDEES

SEQ ID NO: 3230174 - protein, 30 aa, Plasmodium falciparum
KNNACTKQNDACRKQNNACRKQNDACRKQS

SEQ ID NO: 3230175 - protein, 5 aa, Plasmodium falciparum
KNNAP

SEQ ID NO: 3230176 - protein, 4 aa, Plasmodium falciparum
KNNC

SEQ ID NO: 3230177 - protein, 4 aa, Plasmodium falciparum
KNND

SEQ ID NO: 3230178 - protein, 5 aa, Plasmodium falciparum
KNNDD

SEQ ID NO: 3230179 - protein, 17 aa, Plasmodium falciparum
KNNDDEDLKKESYTTKS

SEQ ID NO: 3230180 - protein, 18 aa, Plasmodium falciparum
KNNDDGDINNEISTPKNY

SEQ ID NO: 3230181 - protein, 18 aa, Plasmodium falciparum
KNNDDGGLKKEISTPKNY

SEQ ID NO: 3230182 - protein, 6 aa, Plasmodium falciparum
KNNDDL

SEQ ID NO: 3230183 - protein, 60 aa, Plasmodium falciparum
KNNDDNNKYNDNNNKNDDDNNQNNDDNNQNNDGNNKNNDRSDTNDVLNNSNSLASEKNNQ

SEQ ID NO: 3230184 - protein, 7 aa, Plasmodium falciparum
KNNDDTW

SEQ ID NO: 3230185 - protein, 5 aa, Plasmodium falciparum
KNNDE

SEQ ID NO: 3230186 - protein, 10 aa, Plasmodium falciparum
KNNDEDPFSL

SEQ ID NO: 3230187 - protein, 14 aa, Plasmodium falciparum
KNNDEKKNKNKNNI

SEQ ID NO: 3230188 - protein, 10 aa, Plasmodium falciparum
KNNDGGFGGG

SEQ ID NO: 3230189 - protein, 26 aa, Plasmodium falciparum
KNNDHDGSSEANGNTSSYNDKKEDVE

SEQ ID NO: 3230190 - protein, 8 aa, Plasmodium falciparum
KNNDHLSN

SEQ ID NO: 3230191 - protein, 6 aa, Plasmodium falciparum
KNNDKL

SEQ ID NO: 3230192 - protein, 15 aa, Plasmodium falciparum
KNNDKNDDEENNSKD

SEQ ID NO: 3230193 - protein, 7 aa, Plasmodium falciparum
KNNDKSD

SEQ ID NO: 3230194 - protein, 5 aa, Plasmodium falciparum
KNNDL

SEQ ID NO: 3230195 - protein, 6 aa, Plasmodium falciparum
KNNDLK

SEQ ID NO: 3230196 - protein, 22 aa, Plasmodium falciparum
KNNDNETINDEKNLDHNSTNTL

SEQ ID NO: 3230197 - protein, 8 aa, Plasmodium falciparum
KNNDNGLM

SEQ ID NO: 3230198 - protein, 7 aa, Plasmodium falciparum
KNNDNIM

SEQ ID NO: 3230199 - protein, 23 aa, Plasmodium falciparum
KNNDNNNNNNYNNYNNNSYNNNN

SEQ ID NO: 3230200 - protein, 6 aa, Plasmodium falciparum
KNNDRV

SEQ ID NO: 3230201 - protein, 5 aa, Plasmodium falciparum
KNNDS

SEQ ID NO: 3230202 - protein, 7 aa, Plasmodium falciparum
KNNDTTD

SEQ ID NO: 3230203 - protein, 6 aa, Plasmodium falciparum
KNNDYV

SEQ ID NO: 3230204 - protein, 5 aa, Plasmodium falciparum
KNNEC

SEQ ID NO: 3230205 - protein, 8 aa, Plasmodium falciparum
KNNEDDYE

SEQ ID NO: 3230206 - protein, 7 aa, Plasmodium falciparum
KNNEDNN

SEQ ID NO: 3230207 - protein, 6 aa, Plasmodium falciparum
KNNEED

SEQ ID NO: 3230208 - protein, 8 aa, Plasmodium falciparum
KNNEEDNL

SEQ ID NO: 3230209 - protein, 8 aa, Plasmodium falciparum
KNNEEERI

SEQ ID NO: 3230210 - protein, 12 aa, Plasmodium falciparum
KNNEEKKKNINN

SEQ ID NO: 3230211 - protein, 7 aa, Plasmodium falciparum
KNNEENN

SEQ ID NO: 3230212 - protein, 7 aa, Plasmodium falciparum
KNNEENV

SEQ ID NO: 3230213 - protein, 10 aa, Plasmodium falciparum
KNNEETETSD

SEQ ID NO: 3230214 - protein, 6 aa, Plasmodium falciparum
KNNEEV

SEQ ID NO: 3230215 - protein, 19 aa, Plasmodium falciparum
KNNEGDEEKEEDKKNNKID

SEQ ID NO: 3230216 - protein, 14 aa, Plasmodium falciparum
KNNEGDGSDPKNKI

SEQ ID NO: 3230217 - protein, 9 aa, Plasmodium falciparum
KNNEGDKNE

SEQ ID NO: 3230218 - protein, 7 aa, Plasmodium falciparum
KNNEGLN

SEQ ID NO: 3230219 - protein, 5 aa, Plasmodium falciparum
KNNEI

SEQ ID NO: 3230220 - protein, 15 aa, Plasmodium falciparum
KNNEINDKKEDYDNI

SEQ ID NO: 3230221 - protein, 6 aa, Plasmodium falciparum
KNNEKI

SEQ ID NO: 3230222 - protein, 10 aa, Plasmodium falciparum
KNNEKKKKKI

SEQ ID NO: 3230223 - protein, 31 aa, Plasmodium falciparum
KNNEKKKNISEKKLSSSNEHIDDNNNSNNII

SEQ ID NO: 3230224 - protein, 10 aa, Plasmodium falciparum
KNNEKLNSEM

SEQ ID NO: 3230225 - protein, 10 aa, Plasmodium falciparum
KNNEKNNSED

SEQ ID NO: 3230226 - protein, 10 aa, Plasmodium falciparum
KNNEKSSEKS

SEQ ID NO: 3230227 - protein, 9 aa, Plasmodium falciparum
KNNENGYSN

SEQ ID NO: 3230228 - protein, 9 aa, Plasmodium falciparum
KNNENKKKN

SEQ ID NO: 3230229 - protein, 41 aa, Plasmodium falciparum
KNNENNENNENNNNNNNNNNNNNNNNNNNNNNNNNNNNNNN

SEQ ID NO: 3230230 - protein, 11 aa, Plasmodium falciparum
KNNENNSTHFN

SEQ ID NO: 3230231 - protein, 28 aa, Plasmodium falciparum
KNNENSNKNRKMDMDEGKGTYIQNKESH

SEQ ID NO: 3230232 - protein, 8 aa, Plasmodium falciparum
KNNEQEDL

SEQ ID NO: 3230233 - protein, 6 aa, Plasmodium falciparum
KNNERD

SEQ ID NO: 3230234 - protein, 7 aa, Plasmodium falciparum
KNNERNS

SEQ ID NO: 3230235 - protein, 11 aa, Plasmodium falciparum
KNNESSENNLN

SEQ ID NO: 3230236 - protein, 10 aa, Plasmodium falciparum
KNNETQKKEK

SEQ ID NO: 3230237 - protein, 25 aa, Plasmodium falciparum
KNNETTKHTNAEGRSRSSNNIYTNE

SEQ ID NO: 3230238 - protein, 6 aa, Plasmodium falciparum
KNNEYD

SEQ ID NO: 3230239 - protein, 4 aa, Plasmodium falciparum
KNNF

SEQ ID NO: 3230240 - protein, 44 aa, Plasmodium falciparum
KNNFKENHQTGDNNNDNNNNKNNKNDNNNNNNNNKDIKNKEENN

SEQ ID NO: 3230241 - protein, 8 aa, Plasmodium falciparum
KNNFNKNN

SEQ ID NO: 3230242 - protein, 58 aa, Plasmodium falciparum
KNNFNREEKDITNSDDYDENSTDESCSYNPNITSSENSEEDCYEPSSDDKPSNNTSDH

SEQ ID NO: 3230243 - protein, 30 aa, Plasmodium falciparum
KNNFVKKSNKHKKNNRNNTPNLENNNNNNV

SEQ ID NO: 3230244 - protein, 9 aa, Plasmodium falciparum
KNNGAREHY

SEQ ID NO: 3230245 - protein, 6 aa, Plasmodium falciparum
KNNGDF

SEQ ID NO: 3230246 - protein, 42 aa, Plasmodium falciparum
KNNGDNNNNDRNNNRYNNNNGDNNNDDRNNNGYNNNNGDNNI

SEQ ID NO: 3230247 - protein, 15 aa, Plasmodium falciparum
KNNGKNQKKSENTDN

SEQ ID NO: 3230248 - protein, 12 aa, Plasmodium falciparum
KNNGNNVNNAPY

SEQ ID NO: 3230249 - protein, 13 aa, Plasmodium falciparum
KNNGNSIENSNGK

SEQ ID NO: 3230250 - protein, 13 aa, Plasmodium falciparum
KNNGPENMLGPSI

SEQ ID NO: 3230251 - protein, 7 aa, Plasmodium falciparum
KNNGTLG

SEQ ID NO: 3230252 - protein, 4 aa, Plasmodium falciparum
KNNH

SEQ ID NO: 3230253 - protein, 14 aa, Plasmodium falciparum
KNNHDGDEHRNKNI

SEQ ID NO: 3230254 - protein, 6 aa, Plasmodium falciparum
KNNHHH

SEQ ID NO: 3230255 - protein, 11 aa, Plasmodium falciparum
KNNHHQNDERQ

SEQ ID NO: 3230256 - protein, 6 aa, Plasmodium falciparum
KNNHLN

SEQ ID NO: 3230257 - protein, 12 aa, Plasmodium falciparum
KNNHYEKKEKVS

SEQ ID NO: 3230258 - protein, 36 aa, Plasmodium falciparum
KNNIHGEYEDENYYSEHTKDNNNNNNNNNYKNEYNN

SEQ ID NO: 3230259 - protein, 6 aa, Plasmodium falciparum
KNNIHQ

SEQ ID NO: 3230260 - protein, 16 aa, Plasmodium falciparum
KNNILNNNNNNNNNNI

SEQ ID NO: 3230261 - protein, 8 aa, Plasmodium falciparum
KNNINEDI

SEQ ID NO: 3230262 - protein, 9 aa, Plasmodium falciparum
KNNINKKKN

SEQ ID NO: 3230263 - protein, 31 aa, Plasmodium falciparum
KNNINNDNNNNNINNNINNDNNNNNINNNIN

SEQ ID NO: 3230264 - protein, 18 aa, Plasmodium falciparum
KNNINNNNTLKRSSQSVR

SEQ ID NO: 3230265 - protein, 26 aa, Plasmodium falciparum
KNNINSNNINSNNINSNNINSNNINS

SEQ ID NO: 3230266 - protein, 11 aa, Plasmodium falciparum
KNNINTTNNVN

SEQ ID NO: 3230267 - protein, 5 aa, Plasmodium falciparum
KNNIP

SEQ ID NO: 3230268 - protein, 9 aa, Plasmodium falciparum
KNNIPENST

SEQ ID NO: 3230269 - protein, 14 aa, Plasmodium falciparum
KNNIPNQKISSKDD

SEQ ID NO: 3230270 - protein, 6 aa, Plasmodium falciparum
KNNIPY

SEQ ID NO: 3230271 - protein, 6 aa, Plasmodium falciparum
KNNISG

SEQ ID NO: 3230272 - protein, 4 aa, Plasmodium falciparum
KNNK

SEQ ID NO: 3230273 - protein, 5 aa, Plasmodium falciparum
KNNKD

SEQ ID NO: 3230274 - protein, 7 aa, Plasmodium falciparum
KNNKEGV

SEQ ID NO: 3230275 - protein, 9 aa, Plasmodium falciparum
KNNKEHSDT

SEQ ID NO: 3230276 - protein, 11 aa, Plasmodium falciparum
KNNKESNKKNV

SEQ ID NO: 3230277 - protein, 6 aa, Plasmodium falciparum
KNNKEY

SEQ ID NO: 3230278 - protein, 16 aa, Plasmodium falciparum
KNNKGYNESDDKTKYL

SEQ ID NO: 3230279 - protein, 10 aa, Plasmodium falciparum
KNNKGYRKTN

SEQ ID NO: 3230280 - protein, 10 aa, Plasmodium falciparum
KNNKIGENKN

SEQ ID NO: 3230281 - protein, 19 aa, Plasmodium falciparum
KNNKIGKNNKIGKNNKTIR

SEQ ID NO: 3230282 - protein, 10 aa, Plasmodium falciparum
KNNKIQKKNL

SEQ ID NO: 3230283 - protein, 32 aa, Plasmodium falciparum
KNNKISTNTKNKEDNNKNDDTKNSRNKENKKE

SEQ ID NO: 3230284 - protein, 16 aa, Plasmodium falciparum
KNNKKCKRKKKKKKKK

SEQ ID NO: 3230285 - protein, 10 aa, Plasmodium falciparum
KNNKKGNKKK

SEQ ID NO: 3230286 - protein, 15 aa, Plasmodium falciparum
KNNKKIKNKNCTNIG

SEQ ID NO: 3230287 - protein, 11 aa, Plasmodium falciparum
KNNKKKKMRIQ

SEQ ID NO: 3230288 - protein, 30 aa, Plasmodium falciparum
KNNKKKKNAKMDNNNNNNNNNNNKNNDDDD

SEQ ID NO: 3230289 - protein, 11 aa, Plasmodium falciparum
KNNKKKKNDII

SEQ ID NO: 3230290 - protein, 15 aa, Plasmodium falciparum
KNNKLKKKEKKNNSY

SEQ ID NO: 3230291 - protein, 10 aa, Plasmodium falciparum
KNNKLQEEKE

SEQ ID NO: 3230292 - protein, 5 aa, Plasmodium falciparum
KNNKN

SEQ ID NO: 3230293 - protein, 6 aa, Plasmodium falciparum
KNNKND

SEQ ID NO: 3230294 - protein, 11 aa, Plasmodium falciparum
KNNKNDGERNH

SEQ ID NO: 3230295 - protein, 7 aa, Plasmodium falciparum
KNNKNDL

SEQ ID NO: 3230296 - protein, 8 aa, Plasmodium falciparum
KNNKNEKL

SEQ ID NO: 3230297 - protein, 7 aa, Plasmodium falciparum
KNNKNIS

SEQ ID NO: 3230298 - protein, 20 aa, Plasmodium falciparum
KNNKNNLNISSNKASYTNNK

SEQ ID NO: 3230299 - protein, 5 aa, Plasmodium falciparum
KNNKQ

SEQ ID NO: 3230300 - protein, 17 aa, Plasmodium falciparum
KNNKQEYDKEQEKQQQN

SEQ ID NO: 3230301 - protein, 7 aa, Plasmodium falciparum
KNNKQKK

SEQ ID NO: 3230302 - protein, 8 aa, Plasmodium falciparum
KNNKRHGY

SEQ ID NO: 3230303 - protein, 6 aa, Plasmodium falciparum
KNNKRR

SEQ ID NO: 3230304 - protein, 8 aa, Plasmodium falciparum
KNNKVELG

SEQ ID NO: 3230305 - protein, 58 aa, Plasmodium falciparum
KNNKYGYITPDNDDGDDYNDDNDNDDNYNDDNYNDDNYNDDNYNDDNYNDEKKKKKNN

SEQ ID NO: 3230306 - protein, 13 aa, Plasmodium falciparum
KNNLKGKTYNSNI

SEQ ID NO: 3230307 - protein, 6 aa, Plasmodium falciparum
KNNLKK

SEQ ID NO: 3230308 - protein, 5 aa, Plasmodium falciparum
KNNLN

SEQ ID NO: 3230309 - protein, 9 aa, Plasmodium falciparum
KNNLNKANT

SEQ ID NO: 3230310 - protein, 6 aa, Plasmodium falciparum
KNNLSI

SEQ ID NO: 3230311 - protein, 13 aa, Plasmodium falciparum
KNNLSNNDPIDKS

SEQ ID NO: 3230312 - protein, 7 aa, Plasmodium falciparum
KNNLSSA

SEQ ID NO: 3230313 - protein, 11 aa, Plasmodium falciparum
KNNMDNADMSK

SEQ ID NO: 3230314 - protein, 5 aa, Plasmodium falciparum
KNNMM

SEQ ID NO: 3230315 - protein, 6 aa, Plasmodium falciparum
KNNMSF

SEQ ID NO: 3230316 - protein, 6 aa, Plasmodium falciparum
KNNNDD

SEQ ID NO: 3230317 - protein, 8 aa, Plasmodium falciparum
KNNNDDNY

SEQ ID NO: 3230318 - protein, 11 aa, Plasmodium falciparum
KNNNDHEHNNK

SEQ ID NO: 3230319 - protein, 19 aa, Plasmodium falciparum
KNNNDHNNNNYNNNNNNKM

SEQ ID NO: 3230320 - protein, 7 aa, Plasmodium falciparum
KNNNDNI

SEQ ID NO: 3230321 - protein, 13 aa, Plasmodium falciparum
KNNNDNMKKNKKL

SEQ ID NO: 3230322 - protein, 15 aa, Plasmodium falciparum
KNNNDVQNSNMNSNY

SEQ ID NO: 3230323 - protein, 7 aa, Plasmodium falciparum
KNNNDYK

SEQ ID NO: 3230324 - protein, 20 aa, Plasmodium falciparum
KNNNEHKDNPINVNKKKKKV

SEQ ID NO: 3230325 - protein, 9 aa, Plasmodium falciparum
KNNNEKKKI

SEQ ID NO: 3230326 - protein, 11 aa, Plasmodium falciparum
KNNNENEQESV

SEQ ID NO: 3230327 - protein, 5 aa, Plasmodium falciparum
KNNNF

SEQ ID NO: 3230328 - protein, 22 aa, Plasmodium falciparum
KNNNGGSGGGNKWEEKHESDKC

SEQ ID NO: 3230329 - protein, 6 aa, Plasmodium falciparum
KNNNGK

SEQ ID NO: 3230330 - protein, 8 aa, Plasmodium falciparum
KNNNGRTD

SEQ ID NO: 3230331 - protein, 6 aa, Plasmodium falciparum
KNNNHH

SEQ ID NO: 3230332 - protein, 7 aa, Plasmodium falciparum
KNNNIGT

SEQ ID NO: 3230333 - protein, 9 aa, Plasmodium falciparum
KNNNINEGV

SEQ ID NO: 3230334 - protein, 12 aa, Plasmodium falciparum
KNNNINNNGDNI

SEQ ID NO: 3230335 - protein, 11 aa, Plasmodium falciparum
KNNNINYNPND

SEQ ID NO: 3230336 - protein, 8 aa, Plasmodium falciparum
KNNNITNN

SEQ ID NO: 3230337 - protein, 25 aa, Plasmodium falciparum
KNNNKKKNNNNNNNNNNSSLPNEQT

SEQ ID NO: 3230338 - protein, 10 aa, Plasmodium falciparum
KNNNKNNNNT

SEQ ID NO: 3230339 - protein, 18 aa, Plasmodium falciparum
KNNNLNDTHNEDPPMKKD

SEQ ID NO: 3230340 - protein, 7 aa, Plasmodium falciparum
KNNNLNN

SEQ ID NO: 3230341 - protein, 5 aa, Plasmodium falciparum
KNNNM

SEQ ID NO: 3230342 - protein, 7 aa, Plasmodium falciparum
KNNNNAV

SEQ ID NO: 3230343 - protein, 39 aa, Plasmodium falciparum
KNNNNDNNNENNENNENNDNNENNENNDNNNNNNNNNNV

SEQ ID NO: 3230344 - protein, 8 aa, Plasmodium falciparum
KNNNNEYS

SEQ ID NO: 3230345 - protein, 89 aa, Plasmodium falciparum
KNNNNICNDDNNKENDNNKNNDDNNKDNDNNKNNDDNNKNNDNNKNNDNNKNNDNNKNNDNNKDNDNNYIEPTSTDGHIKEEGGKQNDV

SEQ ID NO: 3230346 - protein, 26 aa, Plasmodium falciparum
KNNNNINNVNSNNNNNNNNNNNINNI

SEQ ID NO: 3230347 - protein, 16 aa, Plasmodium falciparum
KNNNNKNKSKKQKKKY

SEQ ID NO: 3230348 - protein, 13 aa, Plasmodium falciparum
KNNNNLSSVSSTY

SEQ ID NO: 3230349 - protein, 37 aa, Plasmodium falciparum
KNNNNNNDYNDDDDNNNDDNNNNNNDNDDNDNEDDIT

SEQ ID NO: 3230350 - protein, 22 aa, Plasmodium falciparum
KNNNNNNKKCKTNGSDSINSSS

SEQ ID NO: 3230351 - protein, 8 aa, Plasmodium falciparum
KNNNNNNN

SEQ ID NO: 3230352 - protein, 57 aa, Plasmodium falciparum
KNNNNNNNNKNNNKNNHYNNNNNNNKNNHYNNNKNNHYNNNKNNHYNNNNDKNDKKF

SEQ ID NO: 3230353 - protein, 24 aa, Plasmodium falciparum
KNNNNNNNNNKDKDNYDDDNNNCH

SEQ ID NO: 3230354 - protein, 17 aa, Plasmodium falciparum
KNNNNNNNNNKNNNDNY

SEQ ID NO: 3230355 - protein, 22 aa, Plasmodium falciparum
KNNNNNNNNNKYHNNNNKYNKN

SEQ ID NO: 3230356 - protein, 32 aa, Plasmodium falciparum
KNNNNNNNNNNKNNNNNNNKNNNNKNNKNNNN

SEQ ID NO: 3230357 - protein, 7 aa, Plasmodium falciparum
KNNNNQM

SEQ ID NO: 3230358 - protein, 7 aa, Plasmodium falciparum
KNNNQPD

SEQ ID NO: 3230359 - protein, 9 aa, Plasmodium falciparum
KNNNSDDNI

SEQ ID NO: 3230360 - protein, 10 aa, Plasmodium falciparum
KNNNSNNNNI

SEQ ID NO: 3230361 - protein, 6 aa, Plasmodium falciparum
KNNNST

SEQ ID NO: 3230362 - protein, 8 aa, Plasmodium falciparum
KNNNSVNY

SEQ ID NO: 3230363 - protein, 7 aa, Plasmodium falciparum
KNNNTIN

SEQ ID NO: 3230364 - protein, 9 aa, Plasmodium falciparum
KNNNTNPYI

SEQ ID NO: 3230365 - protein, 17 aa, Plasmodium falciparum
KNNNTTKGSTLGGENDL

SEQ ID NO: 3230366 - protein, 7 aa, Plasmodium falciparum
KNNNTYN

SEQ ID NO: 3230367 - protein, 6 aa, Plasmodium falciparum
KNNNYN

SEQ ID NO: 3230368 - protein, 8 aa, Plasmodium falciparum
KNNPAPSN

SEQ ID NO: 3230369 - protein, 7 aa, Plasmodium falciparum
KNNPKQH

SEQ ID NO: 3230370 - protein, 6 aa, Plasmodium falciparum
KNNPKY

SEQ ID NO: 3230371 - protein, 6 aa, Plasmodium falciparum
KNNPNA

SEQ ID NO: 3230372 - protein, 6 aa, Plasmodium falciparum
KNNPQY

SEQ ID NO: 3230373 - protein, 8 aa, Plasmodium falciparum
KNNPSDLT

SEQ ID NO: 3230374 - protein, 6 aa, Plasmodium falciparum
KNNPYD

SEQ ID NO: 3230375 - protein, 6 aa, Plasmodium falciparum
KNNQES

SEQ ID NO: 3230376 - protein, 7 aa, Plasmodium falciparum
KNNQHNN

SEQ ID NO: 3230377 - protein, 13 aa, Plasmodium falciparum
KNNQKEDENNKEE

SEQ ID NO: 3230378 - protein, 14 aa, Plasmodium falciparum
KNNQNIKNNQNIKN

SEQ ID NO: 3230379 - protein, 10 aa, Plasmodium falciparum
KNNQNKGDDI

SEQ ID NO: 3230380 - protein, 37 aa, Plasmodium falciparum
KNNQNNGDNNDANNYEYNGANNENNNVHHNDDNNNHY

SEQ ID NO: 3230381 - protein, 16 aa, Plasmodium falciparum
KNNQNVERGQHGSSTY

SEQ ID NO: 3230382 - protein, 7 aa, Plasmodium falciparum
KNNQPKK

SEQ ID NO: 3230383 - protein, 8 aa, Plasmodium falciparum
KNNQSNKN

SEQ ID NO: 3230384 - protein, 30 aa, Plasmodium falciparum
KNNQTEQNERETPQGIDHNDDDNNNNNNNN

SEQ ID NO: 3230385 - protein, 13 aa, Plasmodium falciparum
KNNRKKKSKKLNY

SEQ ID NO: 3230386 - protein, 15 aa, Plasmodium falciparum
KNNRPTEEKTKNFNY

SEQ ID NO: 3230387 - protein, 12 aa, Plasmodium falciparum
KNNRQNNNNGII

SEQ ID NO: 3230388 - protein, 5 aa, Plasmodium falciparum
KNNRS

SEQ ID NO: 3230389 - protein, 12 aa, Plasmodium falciparum
KNNRYNDDTPEY

SEQ ID NO: 3230390 - protein, 8 aa, Plasmodium falciparum
KNNSDEQA

SEQ ID NO: 3230391 - protein, 20 aa, Plasmodium falciparum
KNNSDLTRSTNIDHPSPSST

SEQ ID NO: 3230392 - protein, 7 aa, Plasmodium falciparum
KNNSDSY

SEQ ID NO: 3230393 - protein, 6 aa, Plasmodium falciparum
KNNSES

SEQ ID NO: 3230394 - protein, 21 aa, Plasmodium falciparum
KNNSGKSKEKKIEDTKRKELE

SEQ ID NO: 3230395 - protein, 8 aa, Plasmodium falciparum
KNNSGKSS

SEQ ID NO: 3230396 - protein, 47 aa, Plasmodium falciparum
KNNSIKGKNRVDKEGDIKKYDNNDDNKMDNSYDYKNKSIKENETKIR

SEQ ID NO: 3230397 - protein, 9 aa, Plasmodium falciparum
KNNSNNVDI

SEQ ID NO: 3230398 - protein, 6 aa, Plasmodium falciparum
KNNSNQ

SEQ ID NO: 3230399 - protein, 15 aa, Plasmodium falciparum
KNNSNSINEKDENKL

SEQ ID NO: 3230400 - protein, 61 aa, Plasmodium falciparum
KNNSNYNKNDDNNNDDNNNDDNNDGNNNNDENDDNNYGNNNNNNNNNNSVDKCKGGNTNEP

SEQ ID NO: 3230401 - protein, 10 aa, Plasmodium falciparum
KNNSSKEGSS

SEQ ID NO: 3230402 - protein, 10 aa, Plasmodium falciparum
KNNSSSEKQK

SEQ ID NO: 3230403 - protein, 7 aa, Plasmodium falciparum
KNNSTLN

SEQ ID NO: 3230404 - protein, 25 aa, Plasmodium falciparum
KNNSTNNTNNNSNSNNNNSSSSKLL

SEQ ID NO: 3230405 - protein, 9 aa, Plasmodium falciparum
KNNSTNSDE

SEQ ID NO: 3230406 - protein, 20 aa, Plasmodium falciparum
KNNSYDEKVTKGENKNDPTS

SEQ ID NO: 3230407 - protein, 8 aa, Plasmodium falciparum
KNNSYEDT

SEQ ID NO: 3230408 - protein, 6 aa, Plasmodium falciparum
KNNSYN

SEQ ID NO: 3230409 - protein, 4 aa, Plasmodium falciparum
KNNT

SEQ ID NO: 3230410 - protein, 14 aa, Plasmodium falciparum
KNNTAEQDTSYSSL

SEQ ID NO: 3230411 - protein, 36 aa, Plasmodium falciparum
KNNTDGNNNYNDDNNDSFDNNHNDNGLDDDASYINN

SEQ ID NO: 3230412 - protein, 7 aa, Plasmodium falciparum
KNNTDLL

SEQ ID NO: 3230413 - protein, 8 aa, Plasmodium falciparum
KNNTENYS

SEQ ID NO: 3230414 - protein, 6 aa, Plasmodium falciparum
KNNTFH

SEQ ID NO: 3230415 - protein, 6 aa, Plasmodium falciparum
KNNTFV

SEQ ID NO: 3230416 - protein, 6 aa, Plasmodium falciparum
KNNTGF

SEQ ID NO: 3230417 - protein, 10 aa, Plasmodium falciparum
KNNTLQSKNT

SEQ ID NO: 3230418 - protein, 7 aa, Plasmodium falciparum
KNNTNEL

SEQ ID NO: 3230419 - protein, 10 aa, Plasmodium falciparum
KNNTNNSKYT

SEQ ID NO: 3230420 - protein, 5 aa, Plasmodium falciparum
KNNTP

SEQ ID NO: 3230421 - protein, 8 aa, Plasmodium falciparum
KNNTQKTN

SEQ ID NO: 3230422 - protein, 7 aa, Plasmodium falciparum
KNNTSDD

SEQ ID NO: 3230423 - protein, 24 aa, Plasmodium falciparum
KNNTSDNMRNEQKTLEKNKEYSNL

SEQ ID NO: 3230424 - protein, 24 aa, Plasmodium falciparum
KNNTSNKLNNNNNNNNNDNNMNSE

SEQ ID NO: 3230425 - protein, 21 aa, Plasmodium falciparum
KNNTSSYPSSYDKKKKKYIKN

SEQ ID NO: 3230426 - protein, 8 aa, Plasmodium falciparum
KNNTTFSK

SEQ ID NO: 3230427 - protein, 12 aa, Plasmodium falciparum
KNNTTSFDNGIN

SEQ ID NO: 3230428 - protein, 22 aa, Plasmodium falciparum
KNNTYNANNTYNANNTNNGKVS

SEQ ID NO: 3230429 - protein, 4 aa, Plasmodium falciparum
KNNV

SEQ ID NO: 3230430 - protein, 7 aa, Plasmodium falciparum
KNNVDDD

SEQ ID NO: 3230431 - protein, 5 aa, Plasmodium falciparum
KNNVE

SEQ ID NO: 3230432 - protein, 6 aa, Plasmodium falciparum
KNNVGN

SEQ ID NO: 3230433 - protein, 51 aa, Plasmodium falciparum
KNNVKEEDDEDDDYDNDNDDDEEGTELKEKEKVKEEKYEDIKKKKKRQKRN

SEQ ID NO: 3230434 - protein, 6 aa, Plasmodium falciparum
KNNVYP

SEQ ID NO: 3230435 - protein, 18 aa, Plasmodium falciparum
KNNYDNYDNDDDDNDDNY

SEQ ID NO: 3230436 - protein, 6 aa, Plasmodium falciparum
KNNYGT

SEQ ID NO: 3230437 - protein, 7 aa, Plasmodium falciparum
KNNYGTV

SEQ ID NO: 3230438 - protein, 8 aa, Plasmodium falciparum
KNNYNNNH

SEQ ID NO: 3230439 - protein, 24 aa, Plasmodium falciparum
KNNYNNNNNNFNNNNNNNNYNNYN

SEQ ID NO: 3230440 - protein, 11 aa, Plasmodium falciparum
KNNYSNNNNMN

SEQ ID NO: 3230441 - protein, 6 aa, Plasmodium falciparum
KNNYTH

SEQ ID NO: 3230442 - protein, 6 aa, Plasmodium falciparum
KNPEAS

SEQ ID NO: 3230443 - protein, 6 aa, Plasmodium falciparum
KNPENP

SEQ ID NO: 3230444 - protein, 11 aa, Plasmodium falciparum
KNPESENNRDY

SEQ ID NO: 3230445 - protein, 5 aa, Plasmodium falciparum
KNPFE

SEQ ID NO: 3230446 - protein, 6 aa, Plasmodium falciparum
KNPHKV

SEQ ID NO: 3230447 - protein, 4 aa, Plasmodium falciparum
KNPI

SEQ ID NO: 3230448 - protein, 4 aa, Plasmodium falciparum
KNPK

SEQ ID NO: 3230449 - protein, 10 aa, Plasmodium falciparum
KNPKGDTYPK

SEQ ID NO: 3230450 - protein, 9 aa, Plasmodium falciparum
KNPKGKNNY

SEQ ID NO: 3230451 - protein, 6 aa, Plasmodium falciparum
KNPKHR

SEQ ID NO: 3230452 - protein, 6 aa, Plasmodium falciparum
KNPKIE

SEQ ID NO: 3230453 - protein, 6 aa, Plasmodium falciparum
KNPKKA

SEQ ID NO: 3230454 - protein, 5 aa, Plasmodium falciparum
KNPKL

SEQ ID NO: 3230455 - protein, 22 aa, Plasmodium falciparum
KNPKYFPNSKNSNEIKKDHKNK

SEQ ID NO: 3230456 - protein, 5 aa, Plasmodium falciparum
KNPLA

SEQ ID NO: 3230457 - protein, 4 aa, Plasmodium falciparum
KNPN

SEQ ID NO: 3230458 - protein, 5 aa, Plasmodium falciparum
KNPNA

SEQ ID NO: 3230459 - protein, 7 aa, Plasmodium falciparum
KNPNEYV

SEQ ID NO: 3230460 - protein, 6 aa, Plasmodium falciparum
KNPPHG

SEQ ID NO: 3230461 - protein, 24 aa, Plasmodium falciparum
KNPPNPLRDPNDLPPERHPHAPED

SEQ ID NO: 3230462 - protein, 14 aa, Plasmodium falciparum
KNPRKGKTINKNIE

SEQ ID NO: 3230463 - protein, 4 aa, Plasmodium falciparum
KNPS

SEQ ID NO: 3230464 - protein, 7 aa, Plasmodium falciparum
KNPSDPQ

SEQ ID NO: 3230465 - protein, 8 aa, Plasmodium falciparum
KNPSEKKK

SEQ ID NO: 3230466 - protein, 8 aa, Plasmodium falciparum
KNPSPQNV

SEQ ID NO: 3230467 - protein, 4 aa, Plasmodium falciparum
KNPT

SEQ ID NO: 3230468 - protein, 6 aa, Plasmodium falciparum
KNPTEY

SEQ ID NO: 3230469 - protein, 10 aa, Plasmodium falciparum
KNPTSEKTNS

SEQ ID NO: 3230470 - protein, 4 aa, Plasmodium falciparum
KNPY

SEQ ID NO: 3230471 - protein, 7 aa, Plasmodium falciparum
KNPYNCQ

SEQ ID NO: 3230472 - protein, 21 aa, Plasmodium falciparum
KNQDQNNSNNVSSMDSNTNYM

SEQ ID NO: 3230473 - protein, 12 aa, Plasmodium falciparum
KNQEENYSTYEN

SEQ ID NO: 3230474 - protein, 7 aa, Plasmodium falciparum
KNQEERK

SEQ ID NO: 3230475 - protein, 10 aa, Plasmodium falciparum
KNQEIEKKSD

SEQ ID NO: 3230476 - protein, 6 aa, Plasmodium falciparum
KNQEIN

SEQ ID NO: 3230477 - protein, 8 aa, Plasmodium falciparum
KNQELKEE

SEQ ID NO: 3230478 - protein, 13 aa, Plasmodium falciparum
KNQEPAGANGQKT

SEQ ID NO: 3230479 - protein, 9 aa, Plasmodium falciparum
KNQFNNPHQ

SEQ ID NO: 3230480 - protein, 8 aa, Plasmodium falciparum
KNQGNKNL

SEQ ID NO: 3230481 - protein, 5 aa, Plasmodium falciparum
KNQHD

SEQ ID NO: 3230482 - protein, 9 aa, Plasmodium falciparum
KNQHKKKKQ

SEQ ID NO: 3230483 - protein, 7 aa, Plasmodium falciparum
KNQKKFK

SEQ ID NO: 3230484 - protein, 10 aa, Plasmodium falciparum
KNQKKNKSYI

SEQ ID NO: 3230485 - protein, 6 aa, Plasmodium falciparum
KNQKNN

SEQ ID NO: 3230486 - protein, 6 aa, Plasmodium falciparum
KNQKNQ

SEQ ID NO: 3230487 - protein, 4 aa, Plasmodium falciparum
KNQN

SEQ ID NO: 3230488 - protein, 13 aa, Plasmodium falciparum
KNQNDSYERTNEN

SEQ ID NO: 3230489 - protein, 12 aa, Plasmodium falciparum
KNQNGDSDSRNI

SEQ ID NO: 3230490 - protein, 12 aa, Plasmodium falciparum
KNQNHKRGNHNN

SEQ ID NO: 3230491 - protein, 14 aa, Plasmodium falciparum
KNQNMQSPNYPKNA

SEQ ID NO: 3230492 - protein, 8 aa, Plasmodium falciparum
KNQNNQDH

SEQ ID NO: 3230493 - protein, 8 aa, Plasmodium falciparum
KNQNNTDQ

SEQ ID NO: 3230494 - protein, 6 aa, Plasmodium falciparum
KNQNRV

SEQ ID NO: 3230495 - protein, 7 aa, Plasmodium falciparum
KNQPENK

SEQ ID NO: 3230496 - protein, 6 aa, Plasmodium falciparum
KNQPFY

SEQ ID NO: 3230497 - protein, 9 aa, Plasmodium falciparum
KNQPTESTL

SEQ ID NO: 3230498 - protein, 14 aa, Plasmodium falciparum
KNQQAGAGATGKRT

SEQ ID NO: 3230499 - protein, 8 aa, Plasmodium falciparum
KNQQSKEF

SEQ ID NO: 3230500 - protein, 6 aa, Plasmodium falciparum
KNQRNQ

SEQ ID NO: 3230501 - protein, 13 aa, Plasmodium falciparum
KNQRTDKVASNEE

SEQ ID NO: 3230502 - protein, 13 aa, Plasmodium falciparum
KNQSLLKKSSEKL

SEQ ID NO: 3230503 - protein, 7 aa, Plasmodium falciparum
KNQSNKI

SEQ ID NO: 3230504 - protein, 5 aa, Plasmodium falciparum
KNQSY

SEQ ID NO: 3230505 - protein, 4 aa, Plasmodium falciparum
KNQT

SEQ ID NO: 3230506 - protein, 8 aa, Plasmodium falciparum
KNQTDNEK

SEQ ID NO: 3230507 - protein, 17 aa, Plasmodium falciparum
KNQTTKKKGYEKNDKYN

SEQ ID NO: 3230508 - protein, 11 aa, Plasmodium falciparum
KNQVKNKNESY

SEQ ID NO: 3230509 - protein, 6 aa, Plasmodium falciparum
KNQVQK

SEQ ID NO: 3230510 - protein, 5 aa, Plasmodium falciparum
KNRAK

SEQ ID NO: 3230511 - protein, 15 aa, Plasmodium falciparum
KNRDGNRKSVLNDDR

SEQ ID NO: 3230512 - protein, 4 aa, Plasmodium falciparum
KNRE

SEQ ID NO: 3230513 - protein, 18 aa, Plasmodium falciparum
KNREKIKNVSNNKPMEKA

SEQ ID NO: 3230514 - protein, 7 aa, Plasmodium falciparum
KNRENIE

SEQ ID NO: 3230515 - protein, 9 aa, Plasmodium falciparum
KNREPTKSY

SEQ ID NO: 3230516 - protein, 14 aa, Plasmodium falciparum
KNREQKYGQGNDIK

SEQ ID NO: 3230517 - protein, 28 aa, Plasmodium falciparum
KNREQNREHNREHNREQNRDSNNTFSTY

SEQ ID NO: 3230518 - protein, 9 aa, Plasmodium falciparum
KNRERLSSS

SEQ ID NO: 3230519 - protein, 11 aa, Plasmodium falciparum
KNRGKEKTELT

SEQ ID NO: 3230520 - protein, 7 aa, Plasmodium falciparum
KNRGLRS

SEQ ID NO: 3230521 - protein, 14 aa, Plasmodium falciparum
KNRIKNKQNENMNK

SEQ ID NO: 3230522 - protein, 6 aa, Plasmodium falciparum
KNRINE

SEQ ID NO: 3230523 - protein, 5 aa, Plasmodium falciparum
KNRIT

SEQ ID NO: 3230524 - protein, 4 aa, Plasmodium falciparum
KNRK

SEQ ID NO: 3230525 - protein, 15 aa, Plasmodium falciparum
KNRKEKKSEKEPEQF

SEQ ID NO: 3230526 - protein, 9 aa, Plasmodium falciparum
KNRKGNNKC

SEQ ID NO: 3230527 - protein, 10 aa, Plasmodium falciparum
KNRKKKKSIS

SEQ ID NO: 3230528 - protein, 7 aa, Plasmodium falciparum
KNRKKYI

SEQ ID NO: 3230529 - protein, 7 aa, Plasmodium falciparum
KNRLDKN

SEQ ID NO: 3230530 - protein, 6 aa, Plasmodium falciparum
KNRLNY

SEQ ID NO: 3230531 - protein, 25 aa, Plasmodium falciparum
KNRNETLTQNEKIDNNNNAKQNDQL

SEQ ID NO: 3230532 - protein, 9 aa, Plasmodium falciparum
KNRNGHQQR

SEQ ID NO: 3230533 - protein, 12 aa, Plasmodium falciparum
KNRNNDENNTCS

SEQ ID NO: 3230534 - protein, 16 aa, Plasmodium falciparum
KNRNQKDGDGNDMKSS

SEQ ID NO: 3230535 - protein, 17 aa, Plasmodium falciparum
KNRQEDSNLGYNEDDEI

SEQ ID NO: 3230536 - protein, 5 aa, Plasmodium falciparum
KNRQK

SEQ ID NO: 3230537 - protein, 5 aa, Plasmodium falciparum
KNRQS

SEQ ID NO: 3230538 - protein, 15 aa, Plasmodium falciparum
KNRRHANNSNKDGNI

SEQ ID NO: 3230539 - protein, 4 aa, Plasmodium falciparum
KNRS

SEQ ID NO: 3230540 - protein, 6 aa, Plasmodium falciparum
KNRSDS

SEQ ID NO: 3230541 - protein, 7 aa, Plasmodium falciparum
KNRSEEN

SEQ ID NO: 3230542 - protein, 5 aa, Plasmodium falciparum
KNRTQ

SEQ ID NO: 3230543 - protein, 14 aa, Plasmodium falciparum
KNRYDKDIKNQKDE

SEQ ID NO: 3230544 - protein, 8 aa, Plasmodium falciparum
KNSAGKNV

SEQ ID NO: 3230545 - protein, 5 aa, Plasmodium falciparum
KNSAS

SEQ ID NO: 3230546 - protein, 4 aa, Plasmodium falciparum
KNSC

SEQ ID NO: 3230547 - protein, 8 aa, Plasmodium falciparum
KNSCHDND

SEQ ID NO: 3230548 - protein, 7 aa, Plasmodium falciparum
KNSDEDS

SEQ ID NO: 3230549 - protein, 6 aa, Plasmodium falciparum
KNSDEN

SEQ ID NO: 3230550 - protein, 5 aa, Plasmodium falciparum
KNSDF

SEQ ID NO: 3230551 - protein, 11 aa, Plasmodium falciparum
KNSDGNNGGQI

SEQ ID NO: 3230552 - protein, 23 aa, Plasmodium falciparum
KNSEDQDDTYNNEYSDSNSDNHS

SEQ ID NO: 3230553 - protein, 31 aa, Plasmodium falciparum
KNSEEGNLSAENVPSDENTINDKTKEGSTTL

SEQ ID NO: 3230554 - protein, 6 aa, Plasmodium falciparum
KNSEEI

SEQ ID NO: 3230555 - protein, 9 aa, Plasmodium falciparum
KNSEGDFNR

SEQ ID NO: 3230556 - protein, 5 aa, Plasmodium falciparum
KNSEI

SEQ ID NO: 3230557 - protein, 7 aa, Plasmodium falciparum
KNSEIKK

SEQ ID NO: 3230558 - protein, 16 aa, Plasmodium falciparum
KNSEISNEENNATYEN

SEQ ID NO: 3230559 - protein, 8 aa, Plasmodium falciparum
KNSEKDEI

SEQ ID NO: 3230560 - protein, 7 aa, Plasmodium falciparum
KNSEYNK

SEQ ID NO: 3230561 - protein, 4 aa, Plasmodium falciparum
KNSF

SEQ ID NO: 3230562 - protein, 6 aa, Plasmodium falciparum
KNSFED

SEQ ID NO: 3230563 - protein, 20 aa, Plasmodium falciparum
KNSFNSNRSKQSTCSNSNLQ

SEQ ID NO: 3230564 - protein, 5 aa, Plasmodium falciparum
KNSFP

SEQ ID NO: 3230565 - protein, 19 aa, Plasmodium falciparum
KNSGDKKIEQVKTADDGED

SEQ ID NO: 3230566 - protein, 7 aa, Plasmodium falciparum
KNSGKTT

SEQ ID NO: 3230567 - protein, 6 aa, Plasmodium falciparum
KNSGNS

SEQ ID NO: 3230568 - protein, 6 aa, Plasmodium falciparum
KNSGTV

SEQ ID NO: 3230569 - protein, 8 aa, Plasmodium falciparum
KNSGWSEV

SEQ ID NO: 3230570 - protein, 25 aa, Plasmodium falciparum
KNSHIKKKRDNNNNNNNNKNNQNKR

SEQ ID NO: 3230571 - protein, 5 aa, Plasmodium falciparum
KNSHK

SEQ ID NO: 3230572 - protein, 5 aa, Plasmodium falciparum
KNSHL

SEQ ID NO: 3230573 - protein, 22 aa, Plasmodium falciparum
KNSHNMENGSVKKNFSTKRYKN

SEQ ID NO: 3230574 - protein, 17 aa, Plasmodium falciparum
KNSHNNNNNNNNNDNNN

SEQ ID NO: 3230575 - protein, 7 aa, Plasmodium falciparum
KNSIRNA

SEQ ID NO: 3230576 - protein, 6 aa, Plasmodium falciparum
KNSIYN

SEQ ID NO: 3230577 - protein, 17 aa, Plasmodium falciparum
KNSIYSHSKKNKDILRN

SEQ ID NO: 3230578 - protein, 7 aa, Plasmodium falciparum
KNSKDLS

SEQ ID NO: 3230579 - protein, 8 aa, Plasmodium falciparum
KNSKEIEN

SEQ ID NO: 3230580 - protein, 14 aa, Plasmodium falciparum
KNSKETSKKDSSRY

SEQ ID NO: 3230581 - protein, 14 aa, Plasmodium falciparum
KNSKEYKKKEKTKI

SEQ ID NO: 3230582 - protein, 5 aa, Plasmodium falciparum
KNSKI

SEQ ID NO: 3230583 - protein, 8 aa, Plasmodium falciparum
KNSKITTD

SEQ ID NO: 3230584 - protein, 10 aa, Plasmodium falciparum
KNSKKKSKGM

SEQ ID NO: 3230585 - protein, 9 aa, Plasmodium falciparum
KNSKMKKRK

SEQ ID NO: 3230586 - protein, 10 aa, Plasmodium falciparum
KNSKNHQNNH

SEQ ID NO: 3230587 - protein, 6 aa, Plasmodium falciparum
KNSKNS

SEQ ID NO: 3230588 - protein, 8 aa, Plasmodium falciparum
KNSKTLKE

SEQ ID NO: 3230589 - protein, 5 aa, Plasmodium falciparum
KNSKY

SEQ ID NO: 3230590 - protein, 12 aa, Plasmodium falciparum
KNSKYDNFDEDG

SEQ ID NO: 3230591 - protein, 4 aa, Plasmodium falciparum
KNSL

SEQ ID NO: 3230592 - protein, 10 aa, Plasmodium falciparum
KNSLNNTTSV

SEQ ID NO: 3230593 - protein, 6 aa, Plasmodium falciparum
KNSLPL

SEQ ID NO: 3230594 - protein, 6 aa, Plasmodium falciparum
KNSLSN

SEQ ID NO: 3230595 - protein, 5 aa, Plasmodium falciparum
KNSME

SEQ ID NO: 3230596 - protein, 6 aa, Plasmodium falciparum
KNSMNE

SEQ ID NO: 3230597 - protein, 15 aa, Plasmodium falciparum
KNSMSTNKNNKSSIL

SEQ ID NO: 3230598 - protein, 12 aa, Plasmodium falciparum
KNSNDNNSNPNF

SEQ ID NO: 3230599 - protein, 7 aa, Plasmodium falciparum
KNSNEDD

SEQ ID NO: 3230600 - protein, 5 aa, Plasmodium falciparum
KNSNH

SEQ ID NO: 3230601 - protein, 10 aa, Plasmodium falciparum
KNSNIEKNND

SEQ ID NO: 3230602 - protein, 19 aa, Plasmodium falciparum
KNSNISCDEDKKKKKEKKF

SEQ ID NO: 3230603 - protein, 10 aa, Plasmodium falciparum
KNSNISNSFD

SEQ ID NO: 3230604 - protein, 10 aa, Plasmodium falciparum
KNSNMKTSRK

SEQ ID NO: 3230605 - protein, 10 aa, Plasmodium falciparum
KNSNNENITT

SEQ ID NO: 3230606 - protein, 11 aa, Plasmodium falciparum
KNSNNIENHSN

SEQ ID NO: 3230607 - protein, 6 aa, Plasmodium falciparum
KNSNNL

SEQ ID NO: 3230608 - protein, 27 aa, Plasmodium falciparum
KNSNNYNNNDDNNNNDSNDNDSNDYDS

SEQ ID NO: 3230609 - protein, 31 aa, Plasmodium falciparum
KNSNQDIEKNVGNRRRSNSNTINDQNENINK

SEQ ID NO: 3230610 - protein, 53 aa, Plasmodium falciparum
KNSNQNNKNEKMVENNNTRGYINSGKDNLKESFETKDDSDTSCSINLNNLIMI

SEQ ID NO: 3230611 - protein, 6 aa, Plasmodium falciparum
KNSNYA

SEQ ID NO: 3230612 - protein, 8 aa, Plasmodium falciparum
KNSPVDND

SEQ ID NO: 3230613 - protein, 5 aa, Plasmodium falciparum
KNSQD

SEQ ID NO: 3230614 - protein, 15 aa, Plasmodium falciparum
KNSQKKKKSSDDQNI

SEQ ID NO: 3230615 - protein, 8 aa, Plasmodium falciparum
KNSQQYQN

SEQ ID NO: 3230616 - protein, 6 aa, Plasmodium falciparum
KNSQTY

SEQ ID NO: 3230617 - protein, 6 aa, Plasmodium falciparum
KNSQYK

SEQ ID NO: 3230618 - protein, 15 aa, Plasmodium falciparum
KNSRRKKGNYSDHES

SEQ ID NO: 3230619 - protein, 10 aa, Plasmodium falciparum
KNSRTNKRTT

SEQ ID NO: 3230620 - protein, 4 aa, Plasmodium falciparum
KNSS

SEQ ID NO: 3230621 - protein, 8 aa, Plasmodium falciparum
KNSSACDD

SEQ ID NO: 3230622 - protein, 7 aa, Plasmodium falciparum
KNSSDKK

SEQ ID NO: 3230623 - protein, 20 aa, Plasmodium falciparum
KNSSECSHHAKSYKNLLMNE

SEQ ID NO: 3230624 - protein, 8 aa, Plasmodium falciparum
KNSSEGHT

SEQ ID NO: 3230625 - protein, 7 aa, Plasmodium falciparum
KNSSGSI

SEQ ID NO: 3230626 - protein, 7 aa, Plasmodium falciparum
KNSSIHK

SEQ ID NO: 3230627 - protein, 13 aa, Plasmodium falciparum
KNSSKEKNKDDQL

SEQ ID NO: 3230628 - protein, 9 aa, Plasmodium falciparum
KNSSKISSG

SEQ ID NO: 3230629 - protein, 10 aa, Plasmodium falciparum
KNSSKNNTYQ

SEQ ID NO: 3230630 - protein, 10 aa, Plasmodium falciparum
KNSSRNEQEA

SEQ ID NO: 3230631 - protein, 6 aa, Plasmodium falciparum
KNSSTY

SEQ ID NO: 3230632 - protein, 4 aa, Plasmodium falciparum
KNST

SEQ ID NO: 3230633 - protein, 6 aa, Plasmodium falciparum
KNSTCE

SEQ ID NO: 3230634 - protein, 13 aa, Plasmodium falciparum
KNSTDKLSSTNKV

SEQ ID NO: 3230635 - protein, 8 aa, Plasmodium falciparum
KNSTEDTI

SEQ ID NO: 3230636 - protein, 126 aa, Plasmodium falciparum
KNSTKFNSNEKTVNEKSHQKNISGKTLPTNITSKAPQNNVQNKPRQNIQNQHEKNVQSKAPQQNIQNRAPQKNKQNNTPVQNTISKSQVQNRVNKSPVQNDYSKHNGRGPNQMNRPNPNRHVAQPL

SEQ ID NO: 3230637 - protein, 8 aa, Plasmodium falciparum
KNSTNQQI

SEQ ID NO: 3230638 - protein, 7 aa, Plasmodium falciparum
KNSTTIE

SEQ ID NO: 3230639 - protein, 9 aa, Plasmodium falciparum
KNSTTYEYG

SEQ ID NO: 3230640 - protein, 8 aa, Plasmodium falciparum
KNSVDTNT

SEQ ID NO: 3230641 - protein, 6 aa, Plasmodium falciparum
KNSVGE

SEQ ID NO: 3230642 - protein, 5 aa, Plasmodium falciparum
KNSVN

SEQ ID NO: 3230643 - protein, 13 aa, Plasmodium falciparum
KNSWKHECKKHLC

SEQ ID NO: 3230644 - protein, 13 aa, Plasmodium falciparum
KNSYKHECKKHLC

SEQ ID NO: 3230645 - protein, 10 aa, Plasmodium falciparum
KNSYKKKSLS

SEQ ID NO: 3230646 - protein, 5 aa, Plasmodium falciparum
KNSYN

SEQ ID NO: 3230647 - protein, 8 aa, Plasmodium falciparum
KNTADEVT

SEQ ID NO: 3230648 - protein, 14 aa, Plasmodium falciparum
KNTAHSKLNNDTNK

SEQ ID NO: 3230649 - protein, 6 aa, Plasmodium falciparum
KNTAPV

SEQ ID NO: 3230650 - protein, 6 aa, Plasmodium falciparum
KNTASG

SEQ ID NO: 3230651 - protein, 4 aa, Plasmodium falciparum
KNTD

SEQ ID NO: 3230652 - protein, 8 aa, Plasmodium falciparum
KNTDHNKN

SEQ ID NO: 3230653 - protein, 10 aa, Plasmodium falciparum
KNTDKTKSSI

SEQ ID NO: 3230654 - protein, 10 aa, Plasmodium falciparum
KNTDNSATFY

SEQ ID NO: 3230655 - protein, 8 aa, Plasmodium falciparum
KNTDNTIY

SEQ ID NO: 3230656 - protein, 24 aa, Plasmodium falciparum
KNTEDVNKKRIKQKTKESKKTYGS

SEQ ID NO: 3230657 - protein, 6 aa, Plasmodium falciparum
KNTEEC

SEQ ID NO: 3230658 - protein, 8 aa, Plasmodium falciparum
KNTEEKNF

SEQ ID NO: 3230659 - protein, 16 aa, Plasmodium falciparum
KNTEETGKDNKTKENV

SEQ ID NO: 3230660 - protein, 6 aa, Plasmodium falciparum
KNTEEY

SEQ ID NO: 3230661 - protein, 10 aa, Plasmodium falciparum
KNTEKKKSID

SEQ ID NO: 3230662 - protein, 6 aa, Plasmodium falciparum
KNTEKY

SEQ ID NO: 3230663 - protein, 5 aa, Plasmodium falciparum
KNTEN

SEQ ID NO: 3230664 - protein, 6 aa, Plasmodium falciparum
KNTENE

SEQ ID NO: 3230665 - protein, 7 aa, Plasmodium falciparum
KNTENNL

SEQ ID NO: 3230666 - protein, 8 aa, Plasmodium falciparum
KNTEPIKS

SEQ ID NO: 3230667 - protein, 6 aa, Plasmodium falciparum
KNTERS

SEQ ID NO: 3230668 - protein, 7 aa, Plasmodium falciparum
KNTGKSL

SEQ ID NO: 3230669 - protein, 6 aa, Plasmodium falciparum
KNTGTV

SEQ ID NO: 3230670 - protein, 10 aa, Plasmodium falciparum
KNTHTNYSQQ

SEQ ID NO: 3230671 - protein, 4 aa, Plasmodium falciparum
KNTI

SEQ ID NO: 3230672 - protein, 6 aa, Plasmodium falciparum
KNTINN

SEQ ID NO: 3230673 - protein, 7 aa, Plasmodium falciparum
KNTISQD

SEQ ID NO: 3230674 - protein, 19 aa, Plasmodium falciparum
KNTKAPEKKKEETPPAGPN

SEQ ID NO: 3230675 - protein, 7 aa, Plasmodium falciparum
KNTKDND

SEQ ID NO: 3230676 - protein, 9 aa, Plasmodium falciparum
KNTKDNSYM

SEQ ID NO: 3230677 - protein, 11 aa, Plasmodium falciparum
KNTKEYKLRNG

SEQ ID NO: 3230678 - protein, 6 aa, Plasmodium falciparum
KNTKID

SEQ ID NO: 3230679 - protein, 7 aa, Plasmodium falciparum
KNTKKNM

SEQ ID NO: 3230680 - protein, 8 aa, Plasmodium falciparum
KNTKLDSV

SEQ ID NO: 3230681 - protein, 5 aa, Plasmodium falciparum
KNTKN

SEQ ID NO: 3230682 - protein, 7 aa, Plasmodium falciparum
KNTKSRA

SEQ ID NO: 3230683 - protein, 14 aa, Plasmodium falciparum
KNTLGNKRKNGYMN

SEQ ID NO: 3230684 - protein, 7 aa, Plasmodium falciparum
KNTNAEK

SEQ ID NO: 3230685 - protein, 11 aa, Plasmodium falciparum
KNTNENKNNCD

SEQ ID NO: 3230686 - protein, 32 aa, Plasmodium falciparum
KNTNISKNTNISKNTNISKNTNISKNTNTNKK

SEQ ID NO: 3230687 - protein, 12 aa, Plasmodium falciparum
KNTNKKSNGNTL

SEQ ID NO: 3230688 - protein, 7 aa, Plasmodium falciparum
KNTNKKY

SEQ ID NO: 3230689 - protein, 39 aa, Plasmodium falciparum
KNTNKNKNTNKNKNKNKNTNKNKKRKKEKKNSEENTSLD

SEQ ID NO: 3230690 - protein, 7 aa, Plasmodium falciparum
KNTNMNK

SEQ ID NO: 3230691 - protein, 22 aa, Plasmodium falciparum
KNTNNDNKGDMKNEIGTNEGYE

SEQ ID NO: 3230692 - protein, 12 aa, Plasmodium falciparum
KNTNNKSKQKRF

SEQ ID NO: 3230693 - protein, 7 aa, Plasmodium falciparum
KNTNNNI

SEQ ID NO: 3230694 - protein, 10 aa, Plasmodium falciparum
KNTNNSECEI

SEQ ID NO: 3230695 - protein, 6 aa, Plasmodium falciparum
KNTNQI

SEQ ID NO: 3230696 - protein, 7 aa, Plasmodium falciparum
KNTNQNL

SEQ ID NO: 3230697 - protein, 6 aa, Plasmodium falciparum
KNTNSE

SEQ ID NO: 3230698 - protein, 18 aa, Plasmodium falciparum
KNTNSIGDNDNNKTYQGS

SEQ ID NO: 3230699 - protein, 12 aa, Plasmodium falciparum
KNTNTDGNKNIN

SEQ ID NO: 3230700 - protein, 11 aa, Plasmodium falciparum
KNTNTLEGYEK

SEQ ID NO: 3230701 - protein, 8 aa, Plasmodium falciparum
KNTNYSKT

SEQ ID NO: 3230702 - protein, 5 aa, Plasmodium falciparum
KNTPN

SEQ ID NO: 3230703 - protein, 8 aa, Plasmodium falciparum
KNTPPTKI

SEQ ID NO: 3230704 - protein, 14 aa, Plasmodium falciparum
KNTQGSKKTEQRSF

SEQ ID NO: 3230705 - protein, 10 aa, Plasmodium falciparum
KNTQKTTIKS

SEQ ID NO: 3230706 - protein, 5 aa, Plasmodium falciparum
KNTQN

SEQ ID NO: 3230707 - protein, 6 aa, Plasmodium falciparum
KNTQND

SEQ ID NO: 3230708 - protein, 8 aa, Plasmodium falciparum
KNTQRTTI

SEQ ID NO: 3230709 - protein, 13 aa, Plasmodium falciparum
KNTQTDYSHDSQK

SEQ ID NO: 3230710 - protein, 5 aa, Plasmodium falciparum
KNTRN

SEQ ID NO: 3230711 - protein, 4 aa, Plasmodium falciparum
KNTS

SEQ ID NO: 3230712 - protein, 10 aa, Plasmodium falciparum
KNTSEKTKNV

SEQ ID NO: 3230713 - protein, 5 aa, Plasmodium falciparum
KNTSF

SEQ ID NO: 3230714 - protein, 7 aa, Plasmodium falciparum
KNTSKIN

SEQ ID NO: 3230715 - protein, 15 aa, Plasmodium falciparum
KNTSLNSKEQNTDHN

SEQ ID NO: 3230716 - protein, 11 aa, Plasmodium falciparum
KNTSNTSGELK

SEQ ID NO: 3230717 - protein, 7 aa, Plasmodium falciparum
KNTSSNY

SEQ ID NO: 3230718 - protein, 11 aa, Plasmodium falciparum
KNTSSSLSSPF

SEQ ID NO: 3230719 - protein, 5 aa, Plasmodium falciparum
KNTST

SEQ ID NO: 3230720 - protein, 5 aa, Plasmodium falciparum
KNTTF

SEQ ID NO: 3230721 - protein, 13 aa, Plasmodium falciparum
KNTTPVDNMTPTN

SEQ ID NO: 3230722 - protein, 8 aa, Plasmodium falciparum
KNTTSDNT

SEQ ID NO: 3230723 - protein, 6 aa, Plasmodium falciparum
KNTYET

SEQ ID NO: 3230724 - protein, 21 aa, Plasmodium falciparum
KNTYGKEKQKLNGNSNDGDNT

SEQ ID NO: 3230725 - protein, 8 aa, Plasmodium falciparum
KNTYKGKK

SEQ ID NO: 3230726 - protein, 8 aa, Plasmodium falciparum
KNTYTGDE

SEQ ID NO: 3230727 - protein, 5 aa, Plasmodium falciparum
KNTYV

SEQ ID NO: 3230728 - protein, 26 aa, Plasmodium falciparum
KNVDAYYDEDKEKYFRSSQNNETNNT

SEQ ID NO: 3230729 - protein, 10 aa, Plasmodium falciparum
KNVDGESNVK

SEQ ID NO: 3230730 - protein, 5 aa, Plasmodium falciparum
KNVDT

SEQ ID NO: 3230731 - protein, 5 aa, Plasmodium falciparum
KNVED

SEQ ID NO: 3230732 - protein, 5 aa, Plasmodium falciparum
KNVEE

SEQ ID NO: 3230733 - protein, 13 aa, Plasmodium falciparum
KNVEENNNLNRCP

SEQ ID NO: 3230734 - protein, 10 aa, Plasmodium falciparum
KNVEGNQNRQ

SEQ ID NO: 3230735 - protein, 13 aa, Plasmodium falciparum
KNVEKKRTMSSNM

SEQ ID NO: 3230736 - protein, 6 aa, Plasmodium falciparum
KNVERS

SEQ ID NO: 3230737 - protein, 14 aa, Plasmodium falciparum
KNVESENSNNKADS

SEQ ID NO: 3230738 - protein, 4 aa, Plasmodium falciparum
KNVG

SEQ ID NO: 3230739 - protein, 14 aa, Plasmodium falciparum
KNVISSKKEKVKDK

SEQ ID NO: 3230740 - protein, 12 aa, Plasmodium falciparum
KNVKDKKYMNGK

SEQ ID NO: 3230741 - protein, 6 aa, Plasmodium falciparum
KNVKES

SEQ ID NO: 3230742 - protein, 7 aa, Plasmodium falciparum
KNVKKED

SEQ ID NO: 3230743 - protein, 19 aa, Plasmodium falciparum
KNVKPKQHRTNNGDHFNQK

SEQ ID NO: 3230744 - protein, 9 aa, Plasmodium falciparum
KNVKQSGNQ

SEQ ID NO: 3230745 - protein, 11 aa, Plasmodium falciparum
KNVKQSTHNTQ

SEQ ID NO: 3230746 - protein, 4 aa, Plasmodium falciparum
KNVN

SEQ ID NO: 3230747 - protein, 31 aa, Plasmodium falciparum
KNVNGDEDDDDDEEEEEGDSGTDRKVKTQEK

SEQ ID NO: 3230748 - protein, 11 aa, Plasmodium falciparum
KNVNGQNGDGN

SEQ ID NO: 3230749 - protein, 7 aa, Plasmodium falciparum
KNVNKNN

SEQ ID NO: 3230750 - protein, 30 aa, Plasmodium falciparum
KNVNNNDNINNSNNSYVNNTDNINESQDDS

SEQ ID NO: 3230751 - protein, 7 aa, Plasmodium falciparum
KNVNPLQ

SEQ ID NO: 3230752 - protein, 5 aa, Plasmodium falciparum
KNVNR

SEQ ID NO: 3230753 - protein, 4 aa, Plasmodium falciparum
KNVP

SEQ ID NO: 3230754 - protein, 7 aa, Plasmodium falciparum
KNVPGNM

SEQ ID NO: 3230755 - protein, 6 aa, Plasmodium falciparum
KNVQGT

SEQ ID NO: 3230756 - protein, 10 aa, Plasmodium falciparum
KNVRKKEKER

SEQ ID NO: 3230757 - protein, 7 aa, Plasmodium falciparum
KNVRNDV

SEQ ID NO: 3230758 - protein, 6 aa, Plasmodium falciparum
KNVSDE

SEQ ID NO: 3230759 - protein, 7 aa, Plasmodium falciparum
KNVSEEI

SEQ ID NO: 3230760 - protein, 7 aa, Plasmodium falciparum
KNVSEIK

SEQ ID NO: 3230761 - protein, 9 aa, Plasmodium falciparum
KNVSENNEK

SEQ ID NO: 3230762 - protein, 5 aa, Plasmodium falciparum
KNVSK

SEQ ID NO: 3230763 - protein, 11 aa, Plasmodium falciparum
KNVSNEQGQNN

SEQ ID NO: 3230764 - protein, 12 aa, Plasmodium falciparum
KNVSNGNEGMGS

SEQ ID NO: 3230765 - protein, 6 aa, Plasmodium falciparum
KNVSNI

SEQ ID NO: 3230766 - protein, 13 aa, Plasmodium falciparum
KNVSNNNNTNNIN

SEQ ID NO: 3230767 - protein, 9 aa, Plasmodium falciparum
KNVSSKGEE

SEQ ID NO: 3230768 - protein, 7 aa, Plasmodium falciparum
KNVTDET

SEQ ID NO: 3230769 - protein, 15 aa, Plasmodium falciparum
KNWETHASNNYNQKV

SEQ ID NO: 3230770 - protein, 6 aa, Plasmodium falciparum
KNYANE

SEQ ID NO: 3230771 - protein, 8 aa, Plasmodium falciparum
KNYDEIEK

SEQ ID NO: 3230772 - protein, 5 aa, Plasmodium falciparum
KNYDN

SEQ ID NO: 3230773 - protein, 9 aa, Plasmodium falciparum
KNYDNDNKG

SEQ ID NO: 3230774 - protein, 10 aa, Plasmodium falciparum
KNYDNHDEHS

SEQ ID NO: 3230775 - protein, 31 aa, Plasmodium falciparum
KNYDNNMKKNTHHDNSNAQNENGNTRNYSNG

SEQ ID NO: 3230776 - protein, 7 aa, Plasmodium falciparum
KNYDSTY

SEQ ID NO: 3230777 - protein, 5 aa, Plasmodium falciparum
KNYEE

SEQ ID NO: 3230778 - protein, 6 aa, Plasmodium falciparum
KNYEKK

SEQ ID NO: 3230779 - protein, 7 aa, Plasmodium falciparum
KNYENIS

SEQ ID NO: 3230780 - protein, 5 aa, Plasmodium falciparum
KNYES

SEQ ID NO: 3230781 - protein, 5 aa, Plasmodium falciparum
KNYGN

SEQ ID NO: 3230782 - protein, 6 aa, Plasmodium falciparum
KNYGNS

SEQ ID NO: 3230783 - protein, 22 aa, Plasmodium falciparum
KNYGQENIKSYENNKNDVNGAN

SEQ ID NO: 3230784 - protein, 5 aa, Plasmodium falciparum
KNYHK

SEQ ID NO: 3230785 - protein, 4 aa, Plasmodium falciparum
KNYI

SEQ ID NO: 3230786 - protein, 5 aa, Plasmodium falciparum
KNYID

SEQ ID NO: 3230787 - protein, 7 aa, Plasmodium falciparum
KNYKEKQ

SEQ ID NO: 3230788 - protein, 13 aa, Plasmodium falciparum
KNYKENENLSEDM

SEQ ID NO: 3230789 - protein, 14 aa, Plasmodium falciparum
KNYKGTKNFDDTTN

SEQ ID NO: 3230790 - protein, 6 aa, Plasmodium falciparum
KNYKKE

SEQ ID NO: 3230791 - protein, 6 aa, Plasmodium falciparum
KNYKKI

SEQ ID NO: 3230792 - protein, 7 aa, Plasmodium falciparum
KNYKNEI

SEQ ID NO: 3230793 - protein, 13 aa, Plasmodium falciparum
KNYKNNKYGCSQD

SEQ ID NO: 3230794 - protein, 6 aa, Plasmodium falciparum
KNYKNS

SEQ ID NO: 3230795 - protein, 5 aa, Plasmodium falciparum
KNYKR

SEQ ID NO: 3230796 - protein, 14 aa, Plasmodium falciparum
KNYKRKKKKYKKKI

SEQ ID NO: 3230797 - protein, 8 aa, Plasmodium falciparum
KNYNDQKG

SEQ ID NO: 3230798 - protein, 6 aa, Plasmodium falciparum
KNYNDY

SEQ ID NO: 3230799 - protein, 6 aa, Plasmodium falciparum
KNYNEL

SEQ ID NO: 3230800 - protein, 9 aa, Plasmodium falciparum
KNYNETEKR

SEQ ID NO: 3230801 - protein, 10 aa, Plasmodium falciparum
KNYNGSSNKV

SEQ ID NO: 3230802 - protein, 29 aa, Plasmodium falciparum
KNYNNNDNNNNNDNNNNNDNNNNNDNNNK

SEQ ID NO: 3230803 - protein, 31 aa, Plasmodium falciparum
KNYNNNNNNNNNKNNNNISNNNSNSNSKSNR

SEQ ID NO: 3230804 - protein, 24 aa, Plasmodium falciparum
KNYNNNNNNNNNNSSSSSSSEYTN

SEQ ID NO: 3230805 - protein, 6 aa, Plasmodium falciparum
KNYNNT

SEQ ID NO: 3230806 - protein, 4 aa, Plasmodium falciparum
KNYP

SEQ ID NO: 3230807 - protein, 5 aa, Plasmodium falciparum
KNYPD

SEQ ID NO: 3230808 - protein, 6 aa, Plasmodium falciparum
KNYQEE

SEQ ID NO: 3230809 - protein, 8 aa, Plasmodium falciparum
KNYQPKSS

SEQ ID NO: 3230810 - protein, 8 aa, Plasmodium falciparum
KNYQSESN

SEQ ID NO: 3230811 - protein, 33 aa, Plasmodium falciparum
KNYSDDQFSEGSSNESTKLSNNYTGNIKNQNAE

SEQ ID NO: 3230812 - protein, 8 aa, Plasmodium falciparum
KNYSNEKS

SEQ ID NO: 3230813 - protein, 8 aa, Plasmodium falciparum
KNYSNNNV

SEQ ID NO: 3230814 - protein, 31 aa, Plasmodium falciparum
KNYSNSKENDFNSTSSKISTFSSDTNNSSSC

SEQ ID NO: 3230815 - protein, 11 aa, Plasmodium falciparum
KNYSTNNKKKI

SEQ ID NO: 3230816 - protein, 8 aa, Plasmodium falciparum
KNYTESMT

SEQ ID NO: 3230817 - protein, 19 aa, Plasmodium falciparum
KNYTGNSPSENNKKVNEAL

SEQ ID NO: 3230818 - protein, 9 aa, Plasmodium falciparum
KNYTNDNNI

SEQ ID NO: 3230819 - protein, 8 aa, Plasmodium falciparum
KNYTPTIQ

SEQ ID NO: 3230820 - protein, 14 aa, Plasmodium falciparum
KNYTSKNDNNIYPN

SEQ ID NO: 3230821 - protein, 8 aa, Plasmodium falciparum
KPARDDPI

SEQ ID NO: 3230822 - protein, 9 aa, Plasmodium falciparum
KPARDDPIT

SEQ ID NO: 3230823 - protein, 12 aa, Plasmodium falciparum
KPCKKNGEGSPC

SEQ ID NO: 3230824 - protein, 7 aa, Plasmodium falciparum
KPCNRYK

SEQ ID NO: 3230825 - protein, 7 aa, Plasmodium falciparum
KPCSQNK

SEQ ID NO: 3230826 - protein, 12 aa, Plasmodium falciparum
KPCTKSENKSTC

SEQ ID NO: 3230827 - protein, 15 aa, Plasmodium falciparum
KPDDTFKDADNCKPC

SEQ ID NO: 3230828 - protein, 6 aa, Plasmodium falciparum
KPDEKP

SEQ ID NO: 3230829 - protein, 4 aa, Plasmodium falciparum
KPDF

SEQ ID NO: 3230830 - protein, 14 aa, Plasmodium falciparum
KPDGIRPGLPDKDA

SEQ ID NO: 3230831 - protein, 7 aa, Plasmodium falciparum
KPDINER

SEQ ID NO: 3230832 - protein, 6 aa, Plasmodium falciparum
KPDISD

SEQ ID NO: 3230833 - protein, 13 aa, Plasmodium falciparum
KPDKANDDKNNKL

SEQ ID NO: 3230834 - protein, 5 aa, Plasmodium falciparum
KPDNI

SEQ ID NO: 3230835 - protein, 5 aa, Plasmodium falciparum
KPDPG

SEQ ID NO: 3230836 - protein, 7 aa, Plasmodium falciparum
KPDQITS

SEQ ID NO: 3230837 - protein, 6 aa, Plasmodium falciparum
KPDTKK

SEQ ID NO: 3230838 - protein, 7 aa, Plasmodium falciparum
KPDTLKQ

SEQ ID NO: 3230839 - protein, 12 aa, Plasmodium falciparum
KPDTQHNIRNPK

SEQ ID NO: 3230840 - protein, 4 aa, Plasmodium falciparum
KPDY

SEQ ID NO: 3230841 - protein, 6 aa, Plasmodium falciparum
KPEAPY

SEQ ID NO: 3230842 - protein, 5 aa, Plasmodium falciparum
KPEDN

SEQ ID NO: 3230843 - protein, 16 aa, Plasmodium falciparum
KPEDNLRKEESKTYDT

SEQ ID NO: 3230844 - protein, 7 aa, Plasmodium falciparum
KPEDTGT

SEQ ID NO: 3230845 - protein, 7 aa, Plasmodium falciparum
KPEEANK

SEQ ID NO: 3230846 - protein, 24 aa, Plasmodium falciparum
KPEEEAPAPEEPPPAPPPLAPSDE

SEQ ID NO: 3230847 - protein, 28 aa, Plasmodium falciparum
KPEEEAPPPAQAPDVAPPARAPADQPFD

SEQ ID NO: 3230848 - protein, 31 aa, Plasmodium falciparum
KPEEEAPTPEAETKKDKAPVKPPSQPTTPQI

SEQ ID NO: 3230849 - protein, 5 aa, Plasmodium falciparum
KPEEF

SEQ ID NO: 3230850 - protein, 5 aa, Plasmodium falciparum
KPEEL

SEQ ID NO: 3230851 - protein, 15 aa, Plasmodium falciparum
KPEGSMASEGSYSSY

SEQ ID NO: 3230852 - protein, 6 aa, Plasmodium falciparum
KPELEK

SEQ ID NO: 3230853 - protein, 6 aa, Plasmodium falciparum
KPENLS

SEQ ID NO: 3230854 - protein, 5 aa, Plasmodium falciparum
KPEQT

SEQ ID NO: 3230855 - protein, 5 aa, Plasmodium falciparum
KPEYL

SEQ ID NO: 3230856 - protein, 4 aa, Plasmodium falciparum
KPFL

SEQ ID NO: 3230857 - protein, 5 aa, Plasmodium falciparum
KPFQD

SEQ ID NO: 3230858 - protein, 13 aa, Plasmodium falciparum
KPGSANKPKDELD

SEQ ID NO: 3230859 - protein, 7 aa, Plasmodium falciparum
KPHDHDT

SEQ ID NO: 3230860 - protein, 5 aa, Plasmodium falciparum
KPINT

SEQ ID NO: 3230861 - protein, 7 aa, Plasmodium falciparum
KPISDDP

SEQ ID NO: 3230862 - protein, 8 aa, Plasmodium falciparum
KPISDDPL

SEQ ID NO: 3230863 - protein, 8 aa, Plasmodium falciparum
KPKATPNE

SEQ ID NO: 3230864 - protein, 5 aa, Plasmodium falciparum
KPKAV

SEQ ID NO: 3230865 - protein, 11 aa, Plasmodium falciparum
KPKDIELTQEE

SEQ ID NO: 3230866 - protein, 7 aa, Plasmodium falciparum
KPKDKSD

SEQ ID NO: 3230867 - protein, 7 aa, Plasmodium falciparum
KPKDTFG

SEQ ID NO: 3230868 - protein, 18 aa, Plasmodium falciparum
KPKEGNRETVRGEKNDDK

SEQ ID NO: 3230869 - protein, 6 aa, Plasmodium falciparum
KPKENY

SEQ ID NO: 3230870 - protein, 9 aa, Plasmodium falciparum
KPKERETHD

SEQ ID NO: 3230871 - protein, 6 aa, Plasmodium falciparum
KPKGNG

SEQ ID NO: 3230872 - protein, 5 aa, Plasmodium falciparum
KPKHE

SEQ ID NO: 3230873 - protein, 8 aa, Plasmodium falciparum
KPKHRTKN

SEQ ID NO: 3230874 - protein, 11 aa, Plasmodium falciparum
KPKKGKDNNIY

SEQ ID NO: 3230875 - protein, 6 aa, Plasmodium falciparum
KPKKNY

SEQ ID NO: 3230876 - protein, 11 aa, Plasmodium falciparum
KPKKPKTREYY

SEQ ID NO: 3230877 - protein, 8 aa, Plasmodium falciparum
KPKKQDNI

SEQ ID NO: 3230878 - protein, 6 aa, Plasmodium falciparum
KPKLNG

SEQ ID NO: 3230879 - protein, 6 aa, Plasmodium falciparum
KPKNEF

SEQ ID NO: 3230880 - protein, 8 aa, Plasmodium falciparum
KPKNNAPI

SEQ ID NO: 3230881 - protein, 19 aa, Plasmodium falciparum
KPKNQGGNIHNNNNNNNED

SEQ ID NO: 3230882 - protein, 9 aa, Plasmodium falciparum
KPKPFKKNE

SEQ ID NO: 3230883 - protein, 5 aa, Plasmodium falciparum
KPKPI

SEQ ID NO: 3230884 - protein, 6 aa, Plasmodium falciparum
KPKQVN

SEQ ID NO: 3230885 - protein, 6 aa, Plasmodium falciparum
KPKSLI

SEQ ID NO: 3230886 - protein, 15 aa, Plasmodium falciparum
KPKSSEIVGSNNKSL

SEQ ID NO: 3230887 - protein, 6 aa, Plasmodium falciparum
KPKSTV

SEQ ID NO: 3230888 - protein, 8 aa, Plasmodium falciparum
KPKTNEQI

SEQ ID NO: 3230889 - protein, 6 aa, Plasmodium falciparum
KPKTPV

SEQ ID NO: 3230890 - protein, 18 aa, Plasmodium falciparum
KPKTQKNEKINDQNQPKS

SEQ ID NO: 3230891 - protein, 12 aa, Plasmodium falciparum
KPKVEKKENDIK

SEQ ID NO: 3230892 - protein, 10 aa, Plasmodium falciparum
KPKYNTCTKT

SEQ ID NO: 3230893 - protein, 11 aa, Plasmodium falciparum
KPLDENGKNSV

SEQ ID NO: 3230894 - protein, 23 aa, Plasmodium falciparum
KPLGGGKFQDKETKRKKCEGEKL

SEQ ID NO: 3230895 - protein, 4 aa, Plasmodium falciparum
KPLK

SEQ ID NO: 3230896 - protein, 7 aa, Plasmodium falciparum
KPLNNKE

SEQ ID NO: 3230897 - protein, 12 aa, Plasmodium falciparum
KPMKEEREKHAE

SEQ ID NO: 3230898 - protein, 12 aa, Plasmodium falciparum
KPNDEKKKEMEE

SEQ ID NO: 3230899 - protein, 5 aa, Plasmodium falciparum
KPNED

SEQ ID NO: 3230900 - protein, 13 aa, Plasmodium falciparum
KPNENFKNTHTDY

SEQ ID NO: 3230901 - protein, 8 aa, Plasmodium falciparum
KPNESYNT

SEQ ID NO: 3230902 - protein, 5 aa, Plasmodium falciparum
KPNET

SEQ ID NO: 3230903 - protein, 20 aa, Plasmodium falciparum
KPNFESSKENESNKGTNVPD

SEQ ID NO: 3230904 - protein, 6 aa, Plasmodium falciparum
KPNGVP

SEQ ID NO: 3230905 - protein, 6 aa, Plasmodium falciparum
KPNIKQ

SEQ ID NO: 3230906 - protein, 11 aa, Plasmodium falciparum
KPNIKSAKIQT

SEQ ID NO: 3230907 - protein, 9 aa, Plasmodium falciparum
KPNNTTTGF

SEQ ID NO: 3230908 - protein, 7 aa, Plasmodium falciparum
KPNNTYG

SEQ ID NO: 3230909 - protein, 13 aa, Plasmodium falciparum
KPNPADRPSAADV

SEQ ID NO: 3230910 - protein, 7 aa, Plasmodium falciparum
KPNPAYL

SEQ ID NO: 3230911 - protein, 5 aa, Plasmodium falciparum
KPNPS

SEQ ID NO: 3230912 - protein, 7 aa, Plasmodium falciparum
KPNQKNY

SEQ ID NO: 3230913 - protein, 5 aa, Plasmodium falciparum
KPNQN

SEQ ID NO: 3230914 - protein, 6 aa, Plasmodium falciparum
KPNQVD

SEQ ID NO: 3230915 - protein, 39 aa, Plasmodium falciparum
KPNRNKNVNVNDNDNGNNNNNSNNNNNNSNGNSATLNNN

SEQ ID NO: 3230916 - protein, 8 aa, Plasmodium falciparum
KPNSNMES

SEQ ID NO: 3230917 - protein, 15 aa, Plasmodium falciparum
KPNSSQNDNMTKENK

SEQ ID NO: 3230918 - protein, 4 aa, Plasmodium falciparum
KPNT

SEQ ID NO: 3230919 - protein, 31 aa, Plasmodium falciparum
KPNVSMDNTNNSPISNSEITESDDIDNSENI

SEQ ID NO: 3230920 - protein, 4 aa, Plasmodium falciparum
KPNY

SEQ ID NO: 3230921 - protein, 14 aa, Plasmodium falciparum
KPPLQGDNNNNNNF

SEQ ID NO: 3230922 - protein, 13 aa, Plasmodium falciparum
KPPPPASNNTSDI

SEQ ID NO: 3230923 - protein, 9 aa, Plasmodium falciparum
KPPQNQEEK

SEQ ID NO: 3230924 - protein, 6 aa, Plasmodium falciparum
KPPYKN

SEQ ID NO: 3230925 - protein, 12 aa, Plasmodium falciparum
KPPYSPFNASTS

SEQ ID NO: 3230926 - protein, 6 aa, Plasmodium falciparum
KPQDDP

SEQ ID NO: 3230927 - protein, 9 aa, Plasmodium falciparum
KPQKIENPE

SEQ ID NO: 3230928 - protein, 8 aa, Plasmodium falciparum
KPQNENNN

SEQ ID NO: 3230929 - protein, 4 aa, Plasmodium falciparum
KPQR

SEQ ID NO: 3230930 - protein, 11 aa, Plasmodium falciparum
KPRDDKGGTPI

SEQ ID NO: 3230931 - protein, 9 aa, Plasmodium falciparum
KPRDDKVGT

SEQ ID NO: 3230932 - protein, 12 aa, Plasmodium falciparum
KPRDKKKNTENK

SEQ ID NO: 3230933 - protein, 6 aa, Plasmodium falciparum
KPREDQ

SEQ ID NO: 3230934 - protein, 8 aa, Plasmodium falciparum
KPREGGDI

SEQ ID NO: 3230935 - protein, 5 aa, Plasmodium falciparum
KPRNS

SEQ ID NO: 3230936 - protein, 6 aa, Plasmodium falciparum
KPRRKK

SEQ ID NO: 3230937 - protein, 11 aa, Plasmodium falciparum
KPRSGQGGTPI

SEQ ID NO: 3230938 - protein, 6 aa, Plasmodium falciparum
KPRTFE

SEQ ID NO: 3230939 - protein, 8 aa, Plasmodium falciparum
KPSARRTN

SEQ ID NO: 3230940 - protein, 6 aa, Plasmodium falciparum
KPSCAT

SEQ ID NO: 3230941 - protein, 5 aa, Plasmodium falciparum
KPSEG

SEQ ID NO: 3230942 - protein, 20 aa, Plasmodium falciparum
KPSGSSPPAPGKKNPVQTPK

SEQ ID NO: 3230943 - protein, 5 aa, Plasmodium falciparum
KPSIT

SEQ ID NO: 3230944 - protein, 12 aa, Plasmodium falciparum
KPSKEKIKSTRY

SEQ ID NO: 3230945 - protein, 6 aa, Plasmodium falciparum
KPSLEQ

SEQ ID NO: 3230946 - protein, 6 aa, Plasmodium falciparum
KPSMNR

SEQ ID NO: 3230947 - protein, 4 aa, Plasmodium falciparum
KPSN

SEQ ID NO: 3230948 - protein, 8 aa, Plasmodium falciparum
KPSNINNK

SEQ ID NO: 3230949 - protein, 5 aa, Plasmodium falciparum
KPSPY

SEQ ID NO: 3230950 - protein, 6 aa, Plasmodium falciparum
KPSRAN

SEQ ID NO: 3230951 - protein, 6 aa, Plasmodium falciparum
KPSSGV

SEQ ID NO: 3230952 - protein, 8 aa, Plasmodium falciparum
KPSSLNSE

SEQ ID NO: 3230953 - protein, 4 aa, Plasmodium falciparum
KPTA

SEQ ID NO: 3230954 - protein, 4 aa, Plasmodium falciparum
KPTF

SEQ ID NO: 3230955 - protein, 6 aa, Plasmodium falciparum
KPTGGT

SEQ ID NO: 3230956 - protein, 14 aa, Plasmodium falciparum
KPTGIEQQIDQKKK

SEQ ID NO: 3230957 - protein, 8 aa, Plasmodium falciparum
KPTHKKKS

SEQ ID NO: 3230958 - protein, 6 aa, Plasmodium falciparum
KPTKQT

SEQ ID NO: 3230959 - protein, 6 aa, Plasmodium falciparum
KPTKSD

SEQ ID NO: 3230960 - protein, 22 aa, Plasmodium falciparum
KPTNSNVYKKSTNNSKKGPYQN

SEQ ID NO: 3230961 - protein, 8 aa, Plasmodium falciparum
KPTRDDPI

SEQ ID NO: 3230962 - protein, 6 aa, Plasmodium falciparum
KPTRSY

SEQ ID NO: 3230963 - protein, 10 aa, Plasmodium falciparum
KPTSSAKPTE

SEQ ID NO: 3230964 - protein, 6 aa, Plasmodium falciparum
KPTTTS

SEQ ID NO: 3230965 - protein, 5 aa, Plasmodium falciparum
KPTVE

SEQ ID NO: 3230966 - protein, 6 aa, Plasmodium falciparum
KPTYEV

SEQ ID NO: 3230967 - protein, 11 aa, Plasmodium falciparum
KPVSPNEPITK

SEQ ID NO: 3230968 - protein, 8 aa, Plasmodium falciparum
KPYAKSNE

SEQ ID NO: 3230969 - protein, 6 aa, Plasmodium falciparum
KPYDHD

SEQ ID NO: 3230970 - protein, 7 aa, Plasmodium falciparum
KPYENQN

SEQ ID NO: 3230971 - protein, 4 aa, Plasmodium falciparum
KPYI

SEQ ID NO: 3230972 - protein, 18 aa, Plasmodium falciparum
KPYIDDNNKKCDKNEHDI

SEQ ID NO: 3230973 - protein, 15 aa, Plasmodium falciparum
KPYITPRHTPNTTSR

SEQ ID NO: 3230974 - protein, 5 aa, Plasmodium falciparum
KPYNE

SEQ ID NO: 3230975 - protein, 5 aa, Plasmodium falciparum
KPYNK

SEQ ID NO: 3230976 - protein, 6 aa, Plasmodium falciparum
KPYPVK

SEQ ID NO: 3230977 - protein, 6 aa, Plasmodium falciparum
KPYSSA

SEQ ID NO: 3230978 - protein, 5 aa, Plasmodium falciparum
KPYTL

SEQ ID NO: 3230979 - protein, 6 aa, Plasmodium falciparum
KQAADY

SEQ ID NO: 3230980 - protein, 10 aa, Plasmodium falciparum
KQANDDIEKE

SEQ ID NO: 3230981 - protein, 5 aa, Plasmodium falciparum
KQANQ

SEQ ID NO: 3230982 - protein, 7 aa, Plasmodium falciparum
KQAQQRF

SEQ ID NO: 3230983 - protein, 7 aa, Plasmodium falciparum
KQASDVV

SEQ ID NO: 3230984 - protein, 9 aa, Plasmodium falciparum
KQCKEQCEK

SEQ ID NO: 3230985 - protein, 19 aa, Plasmodium falciparum
KQCRGDNGTDRYCSGNGYD

SEQ ID NO: 3230986 - protein, 17 aa, Plasmodium falciparum
KQCRKKDNSSDDRYCSR

SEQ ID NO: 3230987 - protein, 10 aa, Plasmodium falciparum
KQDDNEEKDH

SEQ ID NO: 3230988 - protein, 7 aa, Plasmodium falciparum
KQDDVNN

SEQ ID NO: 3230989 - protein, 4 aa, Plasmodium falciparum
KQDE

SEQ ID NO: 3230990 - protein, 6 aa, Plasmodium falciparum
KQDEWN

SEQ ID NO: 3230991 - protein, 6 aa, Plasmodium falciparum
KQDGNY

SEQ ID NO: 3230992 - protein, 5 aa, Plasmodium falciparum
KQDID

SEQ ID NO: 3230993 - protein, 14 aa, Plasmodium falciparum
KQDIQNHNSSNIPH

SEQ ID NO: 3230994 - protein, 4 aa, Plasmodium falciparum
KQDN

SEQ ID NO: 3230995 - protein, 6 aa, Plasmodium falciparum
KQDNDK

SEQ ID NO: 3230996 - protein, 6 aa, Plasmodium falciparum
KQDNSN

SEQ ID NO: 3230997 - protein, 4 aa, Plasmodium falciparum
KQDQ

SEQ ID NO: 3230998 - protein, 15 aa, Plasmodium falciparum
KQDTDIKTNKLSKEN

SEQ ID NO: 3230999 - protein, 19 aa, Plasmodium falciparum
KQDTSYNDFQNEETEKDIY

SEQ ID NO: 3231000 - protein, 8 aa, Plasmodium falciparum
KQDTYYNK

SEQ ID NO: 3231001 - protein, 8 aa, Plasmodium falciparum
KQDYNDYT

SEQ ID NO: 3231002 - protein, 7 aa, Plasmodium falciparum
KQEDGKW

SEQ ID NO: 3231003 - protein, 7 aa, Plasmodium falciparum
KQEDGNW

SEQ ID NO: 3231004 - protein, 13 aa, Plasmodium falciparum
KQEDIKQETGMDP

SEQ ID NO: 3231005 - protein, 29 aa, Plasmodium falciparum
KQEECKEQERGGVARSGTGPRPPSAGDTV

SEQ ID NO: 3231006 - protein, 10 aa, Plasmodium falciparum
KQEENEKSNL

SEQ ID NO: 3231007 - protein, 15 aa, Plasmodium falciparum
KQEFDKQKNKYAEEI

SEQ ID NO: 3231008 - protein, 15 aa, Plasmodium falciparum
KQEFEKQKGKYTKEM

SEQ ID NO: 3231009 - protein, 14 aa, Plasmodium falciparum
KQEFEKQKNKYENE

SEQ ID NO: 3231010 - protein, 15 aa, Plasmodium falciparum
KQEFEKQKNKYTNEI

SEQ ID NO: 3231011 - protein, 4 aa, Plasmodium falciparum
KQEG

SEQ ID NO: 3231012 - protein, 7 aa, Plasmodium falciparum
KQEGKSK

SEQ ID NO: 3231013 - protein, 30 aa, Plasmodium falciparum
KQEIKEKKKEQNKINSNNDINNISKNDTNL

SEQ ID NO: 3231014 - protein, 10 aa, Plasmodium falciparum
KQEISEGSIN

SEQ ID NO: 3231015 - protein, 8 aa, Plasmodium falciparum
KQEKDNKE

SEQ ID NO: 3231016 - protein, 6 aa, Plasmodium falciparum
KQEKEE

SEQ ID NO: 3231017 - protein, 10 aa, Plasmodium falciparum
KQEKKYEEEH

SEQ ID NO: 3231018 - protein, 8 aa, Plasmodium falciparum
KQEKLNRR

SEQ ID NO: 3231019 - protein, 9 aa, Plasmodium falciparum
KQEKNKKIK

SEQ ID NO: 3231020 - protein, 8 aa, Plasmodium falciparum
KQEKQNDT

SEQ ID NO: 3231021 - protein, 40 aa, Plasmodium falciparum
KQENDNNNNNNNNNNNNNNNNNNNNNNNNNNNNNNNDNNL

SEQ ID NO: 3231022 - protein, 9 aa, Plasmodium falciparum
KQENKNKNK

SEQ ID NO: 3231023 - protein, 9 aa, Plasmodium falciparum
KQENKQKKK

SEQ ID NO: 3231024 - protein, 7 aa, Plasmodium falciparum
KQENNYY

SEQ ID NO: 3231025 - protein, 6 aa, Plasmodium falciparum
KQENQN

SEQ ID NO: 3231026 - protein, 8 aa, Plasmodium falciparum
KQEPNYDD

SEQ ID NO: 3231027 - protein, 4 aa, Plasmodium falciparum
KQEQ

SEQ ID NO: 3231028 - protein, 30 aa, Plasmodium falciparum
KQEQDRNKETQKGNDIDESKKQKEKEQHTN

SEQ ID NO: 3231029 - protein, 7 aa, Plasmodium falciparum
KQERDSL

SEQ ID NO: 3231030 - protein, 35 aa, Plasmodium falciparum
KQERRKLNSKKKKKTITEDNKDELIDSDDYEEEHE

SEQ ID NO: 3231031 - protein, 6 aa, Plasmodium falciparum
KQESDV

SEQ ID NO: 3231032 - protein, 9 aa, Plasmodium falciparum
KQESNSTTG

SEQ ID NO: 3231033 - protein, 8 aa, Plasmodium falciparum
KQETKSKG

SEQ ID NO: 3231034 - protein, 8 aa, Plasmodium falciparum
KQEVNKRS

SEQ ID NO: 3231035 - protein, 6 aa, Plasmodium falciparum
KQFDKQ

SEQ ID NO: 3231036 - protein, 7 aa, Plasmodium falciparum
KQFSSSS

SEQ ID NO: 3231037 - protein, 8 aa, Plasmodium falciparum
KQGERNET

SEQ ID NO: 3231038 - protein, 38 aa, Plasmodium falciparum
KQGGKRLSHKSHKKTNDDNDKDKKKKNHHKKKSSNENN

SEQ ID NO: 3231039 - protein, 9 aa, Plasmodium falciparum
KQGHSQTTK

SEQ ID NO: 3231040 - protein, 7 aa, Plasmodium falciparum
KQGKLSY

SEQ ID NO: 3231041 - protein, 6 aa, Plasmodium falciparum
KQHNDY

SEQ ID NO: 3231042 - protein, 7 aa, Plasmodium falciparum
KQHNSVE

SEQ ID NO: 3231043 - protein, 17 aa, Plasmodium falciparum
KQHRKQKKKKKNFRRTL

SEQ ID NO: 3231044 - protein, 6 aa, Plasmodium falciparum
KQIDDN

SEQ ID NO: 3231045 - protein, 26 aa, Plasmodium falciparum
KQIEDKKISGEQNQGEYVKGEKDNGV

SEQ ID NO: 3231046 - protein, 5 aa, Plasmodium falciparum
KQIEL

SEQ ID NO: 3231047 - protein, 8 aa, Plasmodium falciparum
KQIENQKK

SEQ ID NO: 3231048 - protein, 9 aa, Plasmodium falciparum
KQIGNSQVE

SEQ ID NO: 3231049 - protein, 6 aa, Plasmodium falciparum
KQIGSE

SEQ ID NO: 3231050 - protein, 6 aa, Plasmodium falciparum
KQIKDN

SEQ ID NO: 3231051 - protein, 8 aa, Plasmodium falciparum
KQIKEDKS

SEQ ID NO: 3231052 - protein, 5 aa, Plasmodium falciparum
KQIKQ

SEQ ID NO: 3231053 - protein, 12 aa, Plasmodium falciparum
KQIKRSKSKEQF

SEQ ID NO: 3231054 - protein, 4 aa, Plasmodium falciparum
KQIN

SEQ ID NO: 3231055 - protein, 5 aa, Plasmodium falciparum
KQINN

SEQ ID NO: 3231056 - protein, 6 aa, Plasmodium falciparum
KQIPST

SEQ ID NO: 3231057 - protein, 6 aa, Plasmodium falciparum
KQISYN

SEQ ID NO: 3231058 - protein, 4 aa, Plasmodium falciparum
KQKD

SEQ ID NO: 3231059 - protein, 6 aa, Plasmodium falciparum
KQKDEQ

SEQ ID NO: 3231060 - protein, 11 aa, Plasmodium falciparum
KQKDIGDETNC

SEQ ID NO: 3231061 - protein, 9 aa, Plasmodium falciparum
KQKDIPPGF

SEQ ID NO: 3231062 - protein, 4 aa, Plasmodium falciparum
KQKE

SEQ ID NO: 3231063 - protein, 28 aa, Plasmodium falciparum
KQKEEAEEEEEEEDGDENSVSSSSTVKQ

SEQ ID NO: 3231064 - protein, 12 aa, Plasmodium falciparum
KQKEKKPQEGSL

SEQ ID NO: 3231065 - protein, 16 aa, Plasmodium falciparum
KQKELDEKKKQQRESG

SEQ ID NO: 3231066 - protein, 9 aa, Plasmodium falciparum
KQKEQEQLQ

SEQ ID NO: 3231067 - protein, 14 aa, Plasmodium falciparum
KQKHQASGKNTAQC

SEQ ID NO: 3231068 - protein, 29 aa, Plasmodium falciparum
KQKHTYTSSDDDDDDDNNTLSSSNNDMSE

SEQ ID NO: 3231069 - protein, 7 aa, Plasmodium falciparum
KQKKANK

SEQ ID NO: 3231070 - protein, 8 aa, Plasmodium falciparum
KQKKEQML

SEQ ID NO: 3231071 - protein, 30 aa, Plasmodium falciparum
KQKKKGNNQKQNHNYNDDINNKENNNNNNV

SEQ ID NO: 3231072 - protein, 10 aa, Plasmodium falciparum
KQKKKKKEKI

SEQ ID NO: 3231073 - protein, 12 aa, Plasmodium falciparum
KQKKKKKKKKKA

SEQ ID NO: 3231074 - protein, 8 aa, Plasmodium falciparum
KQKKKTKI

SEQ ID NO: 3231075 - protein, 19 aa, Plasmodium falciparum
KQKKNKKKTKKNFDDDEEK

SEQ ID NO: 3231076 - protein, 14 aa, Plasmodium falciparum
KQKKNSDKEKQKQR

SEQ ID NO: 3231077 - protein, 15 aa, Plasmodium falciparum
KQKKRYEMEKSKRKD

SEQ ID NO: 3231078 - protein, 9 aa, Plasmodium falciparum
KQKLESKDY

SEQ ID NO: 3231079 - protein, 17 aa, Plasmodium falciparum
KQKMKVNNNNDNNKEDL

SEQ ID NO: 3231080 - protein, 11 aa, Plasmodium falciparum
KQKNDTSKENV

SEQ ID NO: 3231081 - protein, 28 aa, Plasmodium falciparum
KQKNIIPSHDNNNCNDHPNDPNKNKNLQ

SEQ ID NO: 3231082 - protein, 14 aa, Plasmodium falciparum
KQKNKQKNNKINNK

SEQ ID NO: 3231083 - protein, 8 aa, Plasmodium falciparum
KQKNNNNS

SEQ ID NO: 3231084 - protein, 9 aa, Plasmodium falciparum
KQKNTNKNK

SEQ ID NO: 3231085 - protein, 7 aa, Plasmodium falciparum
KQKPDYE

SEQ ID NO: 3231086 - protein, 133 aa, Plasmodium falciparum
KQKRDYPNDQKRDHSNEQKRDYPNEQKRDYPNEQKRDYPNEQKRDYPNEQKRDYPNEQKRDYPNEQKRDYPNEQKRDYPNEQKRDYPNEQKRDYPNKQKRDYPNKQKRDYPNKQKRDQSNEQKRNQPNGQQND

SEQ ID NO: 3231087 - protein, 8 aa, Plasmodium falciparum
KQKREIDG

SEQ ID NO: 3231088 - protein, 4 aa, Plasmodium falciparum
KQKS

SEQ ID NO: 3231089 - protein, 33 aa, Plasmodium falciparum
KQKSITSTDKRKNKKNKKNDEKMDNAEEHGKKE

SEQ ID NO: 3231090 - protein, 5 aa, Plasmodium falciparum
KQKSL

SEQ ID NO: 3231091 - protein, 5 aa, Plasmodium falciparum
KQKTI

SEQ ID NO: 3231092 - protein, 7 aa, Plasmodium falciparum
KQKTSAA

SEQ ID NO: 3231093 - protein, 5 aa, Plasmodium falciparum
KQKYL

SEQ ID NO: 3231094 - protein, 5 aa, Plasmodium falciparum
KQLDG

SEQ ID NO: 3231095 - protein, 5 aa, Plasmodium falciparum
KQLEE

SEQ ID NO: 3231096 - protein, 4 aa, Plasmodium falciparum
KQLK

SEQ ID NO: 3231097 - protein, 11 aa, Plasmodium falciparum
KQLKDKKRNED

SEQ ID NO: 3231098 - protein, 7 aa, Plasmodium falciparum
KQLNEQY

SEQ ID NO: 3231099 - protein, 8 aa, Plasmodium falciparum
KQLPATTF

SEQ ID NO: 3231100 - protein, 4 aa, Plasmodium falciparum
KQLS

SEQ ID NO: 3231101 - protein, 5 aa, Plasmodium falciparum
KQLSR

SEQ ID NO: 3231102 - protein, 5 aa, Plasmodium falciparum
KQMKE

SEQ ID NO: 3231103 - protein, 5 aa, Plasmodium falciparum
KQNCK

SEQ ID NO: 3231104 - protein, 91 aa, Plasmodium falciparum
KQNDCNKQSPPTGGPGGAGGRSQTPHAGGATAPKKGDSEGEDEDEVEDGEESESEEKEKEEKEKEEDRKVKEEVKETKVDGESPKETTKEV

SEQ ID NO: 3231105 - protein, 6 aa, Plasmodium falciparum
KQNDDD

SEQ ID NO: 3231106 - protein, 12 aa, Plasmodium falciparum
KQNDDENSKACQ

SEQ ID NO: 3231107 - protein, 6 aa, Plasmodium falciparum
KQNDNI

SEQ ID NO: 3231108 - protein, 8 aa, Plasmodium falciparum
KQNDNIKD

SEQ ID NO: 3231109 - protein, 20 aa, Plasmodium falciparum
KQNDNVKSSHDQDNQNDDTF

SEQ ID NO: 3231110 - protein, 8 aa, Plasmodium falciparum
KQNDTHTN

SEQ ID NO: 3231111 - protein, 8 aa, Plasmodium falciparum
KQNDTTIM

SEQ ID NO: 3231112 - protein, 11 aa, Plasmodium falciparum
KQNEELNTQNE

SEQ ID NO: 3231113 - protein, 7 aa, Plasmodium falciparum
KQNENDE

SEQ ID NO: 3231114 - protein, 11 aa, Plasmodium falciparum
KQNEQKRHSLN

SEQ ID NO: 3231115 - protein, 8 aa, Plasmodium falciparum
KQNESLDN

SEQ ID NO: 3231116 - protein, 8 aa, Plasmodium falciparum
KQNESQDD

SEQ ID NO: 3231117 - protein, 10 aa, Plasmodium falciparum
KQNETNSNKD

SEQ ID NO: 3231118 - protein, 13 aa, Plasmodium falciparum
KQNEYNNKSYSNI

SEQ ID NO: 3231119 - protein, 7 aa, Plasmodium falciparum
KQNEYSK

SEQ ID NO: 3231120 - protein, 15 aa, Plasmodium falciparum
KQNINEEDNNINNSI

SEQ ID NO: 3231121 - protein, 19 aa, Plasmodium falciparum
KQNITKHNYNEKKQKKTKL

SEQ ID NO: 3231122 - protein, 33 aa, Plasmodium falciparum
KQNKCTNKSTDKNTNKSTNKSTNKNTNKSTNKI

SEQ ID NO: 3231123 - protein, 16 aa, Plasmodium falciparum
KQNKFEKNCNDGSNDN

SEQ ID NO: 3231124 - protein, 11 aa, Plasmodium falciparum
KQNKKEKHNLR

SEQ ID NO: 3231125 - protein, 21 aa, Plasmodium falciparum
KQNKKNVQNKEINKNTYNEKN

SEQ ID NO: 3231126 - protein, 23 aa, Plasmodium falciparum
KQNKNNNNNNNNNNNDKRKKKKK

SEQ ID NO: 3231127 - protein, 7 aa, Plasmodium falciparum
KQNKQNN

SEQ ID NO: 3231128 - protein, 31 aa, Plasmodium falciparum
KQNLNASNSSGQENKQNESDGKENEEDEENK

SEQ ID NO: 3231129 - protein, 6 aa, Plasmodium falciparum
KQNLSS

SEQ ID NO: 3231130 - protein, 6 aa, Plasmodium falciparum
KQNMRG

SEQ ID NO: 3231131 - protein, 7 aa, Plasmodium falciparum
KQNNAIT

SEQ ID NO: 3231132 - protein, 26 aa, Plasmodium falciparum
KQNNIKDSTQEKEDNIKDSTQEVEDN

SEQ ID NO: 3231133 - protein, 6 aa, Plasmodium falciparum
KQNNKI

SEQ ID NO: 3231134 - protein, 17 aa, Plasmodium falciparum
KQNNKIEKLEKENQKVI

SEQ ID NO: 3231135 - protein, 13 aa, Plasmodium falciparum
KQNNKKKKHPEGI

SEQ ID NO: 3231136 - protein, 6 aa, Plasmodium falciparum
KQNNNE

SEQ ID NO: 3231137 - protein, 7 aa, Plasmodium falciparum
KQNPSEY

SEQ ID NO: 3231138 - protein, 19 aa, Plasmodium falciparum
KQNQGDNIKKDQKNNQANE

SEQ ID NO: 3231139 - protein, 17 aa, Plasmodium falciparum
KQNQNEGTENKKDFNKI

SEQ ID NO: 3231140 - protein, 6 aa, Plasmodium falciparum
KQNQQM

SEQ ID NO: 3231141 - protein, 5 aa, Plasmodium falciparum
KQNRK

SEQ ID NO: 3231142 - protein, 6 aa, Plasmodium falciparum
KQNSNK

SEQ ID NO: 3231143 - protein, 6 aa, Plasmodium falciparum
KQNSYK

SEQ ID NO: 3231144 - protein, 20 aa, Plasmodium falciparum
KQNTISQNNKEQNDNNSIKQ

SEQ ID NO: 3231145 - protein, 10 aa, Plasmodium falciparum
KQNTNNRDHL

SEQ ID NO: 3231146 - protein, 6 aa, Plasmodium falciparum
KQNVKE

SEQ ID NO: 3231147 - protein, 8 aa, Plasmodium falciparum
KQNVSHKK

SEQ ID NO: 3231148 - protein, 4 aa, Plasmodium falciparum
KQNY

SEQ ID NO: 3231149 - protein, 8 aa, Plasmodium falciparum
KQPPPEYK

SEQ ID NO: 3231150 - protein, 6 aa, Plasmodium falciparum
KQPQII

SEQ ID NO: 3231151 - protein, 10 aa, Plasmodium falciparum
KQPRTEANPA

SEQ ID NO: 3231152 - protein, 7 aa, Plasmodium falciparum
KQPSKHS

SEQ ID NO: 3231153 - protein, 6 aa, Plasmodium falciparum
KQQDNQ

SEQ ID NO: 3231154 - protein, 4 aa, Plasmodium falciparum
KQQE

SEQ ID NO: 3231155 - protein, 10 aa, Plasmodium falciparum
KQQEKEIEEE

SEQ ID NO: 3231156 - protein, 5 aa, Plasmodium falciparum
KQQEQ

SEQ ID NO: 3231157 - protein, 6 aa, Plasmodium falciparum
KQQEWG

SEQ ID NO: 3231158 - protein, 6 aa, Plasmodium falciparum
KQQEWS

SEQ ID NO: 3231159 - protein, 7 aa, Plasmodium falciparum
KQQHRKM

SEQ ID NO: 3231160 - protein, 4 aa, Plasmodium falciparum
KQQK

SEQ ID NO: 3231161 - protein, 14 aa, Plasmodium falciparum
KQQKRSKRNIKPER

SEQ ID NO: 3231162 - protein, 7 aa, Plasmodium falciparum
KQQMKDN

SEQ ID NO: 3231163 - protein, 4 aa, Plasmodium falciparum
KQQN

SEQ ID NO: 3231164 - protein, 6 aa, Plasmodium falciparum
KQQNEQ

SEQ ID NO: 3231165 - protein, 7 aa, Plasmodium falciparum
KQQNQKN

SEQ ID NO: 3231166 - protein, 26 aa, Plasmodium falciparum
KQQTPPKQEDEDGCVPAEAPKEVVPE

SEQ ID NO: 3231167 - protein, 9 aa, Plasmodium falciparum
KQRDISEEE

SEQ ID NO: 3231168 - protein, 7 aa, Plasmodium falciparum
KQRDYNS

SEQ ID NO: 3231169 - protein, 12 aa, Plasmodium falciparum
KQREKEKSIKSN

SEQ ID NO: 3231170 - protein, 4 aa, Plasmodium falciparum
KQRF

SEQ ID NO: 3231171 - protein, 6 aa, Plasmodium falciparum
KQRKKN

SEQ ID NO: 3231172 - protein, 17 aa, Plasmodium falciparum
KQRNKEDEYDEKKIGYN

SEQ ID NO: 3231173 - protein, 4 aa, Plasmodium falciparum
KQRR

SEQ ID NO: 3231174 - protein, 19 aa, Plasmodium falciparum
KQRRNEALREQDDNLNIQN

SEQ ID NO: 3231175 - protein, 7 aa, Plasmodium falciparum
KQRSKRS

SEQ ID NO: 3231176 - protein, 15 aa, Plasmodium falciparum
KQRYNNKFSSSNNSV

SEQ ID NO: 3231177 - protein, 6 aa, Plasmodium falciparum
KQSDKL

SEQ ID NO: 3231178 - protein, 4 aa, Plasmodium falciparum
KQSE

SEQ ID NO: 3231179 - protein, 14 aa, Plasmodium falciparum
KQSEKEKKKAKNRA

SEQ ID NO: 3231180 - protein, 10 aa, Plasmodium falciparum
KQSEKEQYEQ

SEQ ID NO: 3231181 - protein, 24 aa, Plasmodium falciparum
KQSEMKNNKKSNYTKSNKRHDGDD

SEQ ID NO: 3231182 - protein, 5 aa, Plasmodium falciparum
KQSGL

SEQ ID NO: 3231183 - protein, 24 aa, Plasmodium falciparum
KQSGTHPPTPPGPPQTSVEKTTRE

SEQ ID NO: 3231184 - protein, 24 aa, Plasmodium falciparum
KQSGTTPPTPVTHSPSSGTTPSSW

SEQ ID NO: 3231185 - protein, 7 aa, Plasmodium falciparum
KQSISHN

SEQ ID NO: 3231186 - protein, 6 aa, Plasmodium falciparum
KQSKNN

SEQ ID NO: 3231187 - protein, 5 aa, Plasmodium falciparum
KQSLC

SEQ ID NO: 3231188 - protein, 12 aa, Plasmodium falciparum
KQSLNDTHSKSD

SEQ ID NO: 3231189 - protein, 6 aa, Plasmodium falciparum
KQSNEI

SEQ ID NO: 3231190 - protein, 8 aa, Plasmodium falciparum
KQSNKVNY

SEQ ID NO: 3231191 - protein, 6 aa, Plasmodium falciparum
KQSNLG

SEQ ID NO: 3231192 - protein, 19 aa, Plasmodium falciparum
KQSRNNQQSGQKSENPRDT

SEQ ID NO: 3231193 - protein, 19 aa, Plasmodium falciparum
KQSRNNQQSGQKSGTTPQT

SEQ ID NO: 3231194 - protein, 7 aa, Plasmodium falciparum
KQSSYSN

SEQ ID NO: 3231195 - protein, 10 aa, Plasmodium falciparum
KQSTRTKNFK

SEQ ID NO: 3231196 - protein, 6 aa, Plasmodium falciparum
KQSYQH

SEQ ID NO: 3231197 - protein, 94 aa, Plasmodium falciparum
KQTCPPPEESPDRSQTPPASRSDSPRVDQKEEEEEEEEEDDEDEDEVEDTAEGETQAETEQVEDQVNGEGEQPVEDHSDQVEEGTTQDNAEKPC

SEQ ID NO: 3231198 - protein, 10 aa, Plasmodium falciparum
KQTDIPTGLT

SEQ ID NO: 3231199 - protein, 7 aa, Plasmodium falciparum
KQTEQRF

SEQ ID NO: 3231200 - protein, 23 aa, Plasmodium falciparum
KQTERKPKKKNKKNIENKKDKKK

SEQ ID NO: 3231201 - protein, 5 aa, Plasmodium falciparum
KQTHN

SEQ ID NO: 3231202 - protein, 9 aa, Plasmodium falciparum
KQTKKIQKK

SEQ ID NO: 3231203 - protein, 17 aa, Plasmodium falciparum
KQTKKQTQTQTQTQKQT

SEQ ID NO: 3231204 - protein, 14 aa, Plasmodium falciparum
KQTNKNNAKEINEE

SEQ ID NO: 3231205 - protein, 13 aa, Plasmodium falciparum
KQTNQKKKTKKKK

SEQ ID NO: 3231206 - protein, 6 aa, Plasmodium falciparum
KQTPNV

SEQ ID NO: 3231207 - protein, 11 aa, Plasmodium falciparum
KQTQQRSHEYD

SEQ ID NO: 3231208 - protein, 6 aa, Plasmodium falciparum
KQTRNI

SEQ ID NO: 3231209 - protein, 15 aa, Plasmodium falciparum
KQTSEDIQKNEKQND

SEQ ID NO: 3231210 - protein, 7 aa, Plasmodium falciparum
KQTSNRY

SEQ ID NO: 3231211 - protein, 17 aa, Plasmodium falciparum
KQTSTHSVAKNTNSDPV

SEQ ID NO: 3231212 - protein, 6 aa, Plasmodium falciparum
KQTTHN

SEQ ID NO: 3231213 - protein, 7 aa, Plasmodium falciparum
KQTTNNY

SEQ ID NO: 3231214 - protein, 5 aa, Plasmodium falciparum
KQTTW

SEQ ID NO: 3231215 - protein, 4 aa, Plasmodium falciparum
KQTY

SEQ ID NO: 3231216 - protein, 13 aa, Plasmodium falciparum
KQTYKDEKQNKSF

SEQ ID NO: 3231217 - protein, 5 aa, Plasmodium falciparum
KQTYY

SEQ ID NO: 3231218 - protein, 31 aa, Plasmodium falciparum
KQVDKKEKRKRRKKKKQEKKSLASNSKGYKN

SEQ ID NO: 3231219 - protein, 6 aa, Plasmodium falciparum
KQVEEG

SEQ ID NO: 3231220 - protein, 7 aa, Plasmodium falciparum
KQVGTKN

SEQ ID NO: 3231221 - protein, 7 aa, Plasmodium falciparum
KQVKPKS

SEQ ID NO: 3231222 - protein, 5 aa, Plasmodium falciparum
KQVNE

SEQ ID NO: 3231223 - protein, 8 aa, Plasmodium falciparum
KQVNGEIE

SEQ ID NO: 3231224 - protein, 6 aa, Plasmodium falciparum
KQVNNK

SEQ ID NO: 3231225 - protein, 4 aa, Plasmodium falciparum
KQVS

SEQ ID NO: 3231226 - protein, 12 aa, Plasmodium falciparum
KQVSNEEGNDTK

SEQ ID NO: 3231227 - protein, 6 aa, Plasmodium falciparum
KQYASE

SEQ ID NO: 3231228 - protein, 16 aa, Plasmodium falciparum
KQYEDNKESFKNIPSD

SEQ ID NO: 3231229 - protein, 9 aa, Plasmodium falciparum
KQYENQKKE

SEQ ID NO: 3231230 - protein, 8 aa, Plasmodium falciparum
KQYGPNGV

SEQ ID NO: 3231231 - protein, 5 aa, Plasmodium falciparum
KQYGS

SEQ ID NO: 3231232 - protein, 17 aa, Plasmodium falciparum
KQYGTSHNNNNNKKNNN

SEQ ID NO: 3231233 - protein, 9 aa, Plasmodium falciparum
KQYNDNHNS

SEQ ID NO: 3231234 - protein, 6 aa, Plasmodium falciparum
KQYNEA

SEQ ID NO: 3231235 - protein, 12 aa, Plasmodium falciparum
KQYNKKRKNERH

SEQ ID NO: 3231236 - protein, 7 aa, Plasmodium falciparum
KQYSNEM

SEQ ID NO: 3231237 - protein, 6 aa, Plasmodium falciparum
KQYYGQ

SEQ ID NO: 3231238 - protein, 6 aa, Plasmodium falciparum
KRADYN

SEQ ID NO: 3231239 - protein, 7 aa, Plasmodium falciparum
KRAGEGM

SEQ ID NO: 3231240 - protein, 10 aa, Plasmodium falciparum
KRANAQKQNV

SEQ ID NO: 3231241 - protein, 14 aa, Plasmodium falciparum
KRANQNNTSNNNTI

SEQ ID NO: 3231242 - protein, 6 aa, Plasmodium falciparum
KRANYD

SEQ ID NO: 3231243 - protein, 15 aa, Plasmodium falciparum
KRASHTTPVLMEKPY

SEQ ID NO: 3231244 - protein, 9 aa, Plasmodium falciparum
KRCKEQCDK

SEQ ID NO: 3231245 - protein, 27 aa, Plasmodium falciparum
KRCSNDENIDNNNNNSDYNSDDDDDEK

SEQ ID NO: 3231246 - protein, 17 aa, Plasmodium falciparum
KRCTPDCKNSTSYKSPQ

SEQ ID NO: 3231247 - protein, 7 aa, Plasmodium falciparum
KRDANPD

SEQ ID NO: 3231248 - protein, 82 aa, Plasmodium falciparum
KRDDNHTAQRSNDNTPNNNNTDNNNTSDNNNTSNNNNTSDNNNTSDNNNTSDNNNTSNNNNTDNNNTSNNKNSCSKNLTEER

SEQ ID NO: 3231249 - protein, 16 aa, Plasmodium falciparum
KRDDYSNAADDDDHEH

SEQ ID NO: 3231250 - protein, 11 aa, Plasmodium falciparum
KRDEDKGKTNY

SEQ ID NO: 3231251 - protein, 32 aa, Plasmodium falciparum
KRDEFNKQSNAYSEQKKKYEEENDSAQKNNGV

SEQ ID NO: 3231252 - protein, 17 aa, Plasmodium falciparum
KRDENEVDNNNNNNNIT

SEQ ID NO: 3231253 - protein, 9 aa, Plasmodium falciparum
KRDENNEKE

SEQ ID NO: 3231254 - protein, 12 aa, Plasmodium falciparum
KRDKESNLRSTD

SEQ ID NO: 3231255 - protein, 71 aa, Plasmodium falciparum
KRDNDHNNNNNNNNDDDNNNNNNNDDDNNNNNNNNDDHNNNNNNNDDDNNNNNNNDDDNNKDPTLDGETRS

SEQ ID NO: 3231256 - protein, 15 aa, Plasmodium falciparum
KRDNKRNKENDEDIT

SEQ ID NO: 3231257 - protein, 4 aa, Plasmodium falciparum
KRDP

SEQ ID NO: 3231258 - protein, 7 aa, Plasmodium falciparum
KRDPNII

SEQ ID NO: 3231259 - protein, 9 aa, Plasmodium falciparum
KRDQNDNHN

SEQ ID NO: 3231260 - protein, 9 aa, Plasmodium falciparum
KRDQRKESN

SEQ ID NO: 3231261 - protein, 13 aa, Plasmodium falciparum
KRDVSNNAKRHGK

SEQ ID NO: 3231262 - protein, 20 aa, Plasmodium falciparum
KRDYENMKNEKNDKNEKNEK

SEQ ID NO: 3231263 - protein, 11 aa, Plasmodium falciparum
KREDDKGDDMA

SEQ ID NO: 3231264 - protein, 35 aa, Plasmodium falciparum
KREDEKEEENNNNKSNLSQDKNGNKKGKGEKKGIY

SEQ ID NO: 3231265 - protein, 13 aa, Plasmodium falciparum
KREDHKNKENIER

SEQ ID NO: 3231266 - protein, 5 aa, Plasmodium falciparum
KREDI

SEQ ID NO: 3231267 - protein, 20 aa, Plasmodium falciparum
KREEDDKEYDVHKDKDKDKD

SEQ ID NO: 3231268 - protein, 6 aa, Plasmodium falciparum
KREEDE

SEQ ID NO: 3231269 - protein, 6 aa, Plasmodium falciparum
KREEDG

SEQ ID NO: 3231270 - protein, 38 aa, Plasmodium falciparum
KREENHKMEGEGERNKKKTQSDDISENNKINQKDEHNK

SEQ ID NO: 3231271 - protein, 11 aa, Plasmodium falciparum
KREENLRSSSN

SEQ ID NO: 3231272 - protein, 16 aa, Plasmodium falciparum
KREENLTKEKKAKEQF

SEQ ID NO: 3231273 - protein, 13 aa, Plasmodium falciparum
KREEQYKNEKSEK

SEQ ID NO: 3231274 - protein, 33 aa, Plasmodium falciparum
KREERKPYDPLKRDATQTQDNLRREEGKPYDPL

SEQ ID NO: 3231275 - protein, 6 aa, Plasmodium falciparum
KREGGN

SEQ ID NO: 3231276 - protein, 7 aa, Plasmodium falciparum
KREGGNM

SEQ ID NO: 3231277 - protein, 6 aa, Plasmodium falciparum
KREGLD

SEQ ID NO: 3231278 - protein, 6 aa, Plasmodium falciparum
KREKKI

SEQ ID NO: 3231279 - protein, 6 aa, Plasmodium falciparum
KREKQN

SEQ ID NO: 3231280 - protein, 11 aa, Plasmodium falciparum
KREKSISPHSY

SEQ ID NO: 3231281 - protein, 7 aa, Plasmodium falciparum
KREKYYD

SEQ ID NO: 3231282 - protein, 4 aa, Plasmodium falciparum
KREL

SEQ ID NO: 3231283 - protein, 7 aa, Plasmodium falciparum
KRELKKK

SEQ ID NO: 3231284 - protein, 7 aa, Plasmodium falciparum
KRENDKI

SEQ ID NO: 3231285 - protein, 5 aa, Plasmodium falciparum
KRENE

SEQ ID NO: 3231286 - protein, 12 aa, Plasmodium falciparum
KRENERKYNDKL

SEQ ID NO: 3231287 - protein, 8 aa, Plasmodium falciparum
KRENGTSI

SEQ ID NO: 3231288 - protein, 10 aa, Plasmodium falciparum
KRENKKNNLK

SEQ ID NO: 3231289 - protein, 6 aa, Plasmodium falciparum
KRENNI

SEQ ID NO: 3231290 - protein, 25 aa, Plasmodium falciparum
KRENNLKYDNNNNNNNNNNNTYGNS

SEQ ID NO: 3231291 - protein, 12 aa, Plasmodium falciparum
KRENVKGKKKEM

SEQ ID NO: 3231292 - protein, 25 aa, Plasmodium falciparum
KRENVSKNDLQDVKDDNDKTRNGDI

SEQ ID NO: 3231293 - protein, 5 aa, Plasmodium falciparum
KREQS

SEQ ID NO: 3231294 - protein, 10 aa, Plasmodium falciparum
KRERKGPYTL

SEQ ID NO: 3231295 - protein, 8 aa, Plasmodium falciparum
KRERNDSN

SEQ ID NO: 3231296 - protein, 17 aa, Plasmodium falciparum
KRERTKYIPSTEEQENR

SEQ ID NO: 3231297 - protein, 9 aa, Plasmodium falciparum
KRESASKTN

SEQ ID NO: 3231298 - protein, 8 aa, Plasmodium falciparum
KRESCTSN

SEQ ID NO: 3231299 - protein, 6 aa, Plasmodium falciparum
KRETID

SEQ ID NO: 3231300 - protein, 6 aa, Plasmodium falciparum
KRETTY

SEQ ID NO: 3231301 - protein, 18 aa, Plasmodium falciparum
KRETYDKGKEAKSKRSRY

SEQ ID NO: 3231302 - protein, 7 aa, Plasmodium falciparum
KREYSEN

SEQ ID NO: 3231303 - protein, 11 aa, Plasmodium falciparum
KRFKDNDKKDL

SEQ ID NO: 3231304 - protein, 13 aa, Plasmodium falciparum
KRFSDKEGAECTN

SEQ ID NO: 3231305 - protein, 70 aa, Plasmodium falciparum
KRGDKKNNSDNKTTTANNTDNNKSSNADINKTTTTDTSKKTDNNNNNSSSNNKNTKSNEEKSSSSKNYVE

SEQ ID NO: 3231306 - protein, 7 aa, Plasmodium falciparum
KRGDNCE

SEQ ID NO: 3231307 - protein, 6 aa, Plasmodium falciparum
KRGDTG

SEQ ID NO: 3231308 - protein, 27 aa, Plasmodium falciparum
KRGEENMGEKKRNNKRTKYKVQEEKEN

SEQ ID NO: 3231309 - protein, 7 aa, Plasmodium falciparum
KRGEYEY

SEQ ID NO: 3231310 - protein, 17 aa, Plasmodium falciparum
KRGGESNLKGDATRGTY

SEQ ID NO: 3231311 - protein, 8 aa, Plasmodium falciparum
KRGINDDG

SEQ ID NO: 3231312 - protein, 4 aa, Plasmodium falciparum
KRGN

SEQ ID NO: 3231313 - protein, 12 aa, Plasmodium falciparum
KRGNDQENYKKY

SEQ ID NO: 3231314 - protein, 8 aa, Plasmodium falciparum
KRGNYGNN

SEQ ID NO: 3231315 - protein, 27 aa, Plasmodium falciparum
KRGSDASKKGEENKDEQENKNEEDNID

SEQ ID NO: 3231316 - protein, 9 aa, Plasmodium falciparum
KRGSRYRSK

SEQ ID NO: 3231317 - protein, 5 aa, Plasmodium falciparum
KRGSS

SEQ ID NO: 3231318 - protein, 11 aa, Plasmodium falciparum
KRGSSNKKHIE

SEQ ID NO: 3231319 - protein, 6 aa, Plasmodium falciparum
KRGSTE

SEQ ID NO: 3231320 - protein, 13 aa, Plasmodium falciparum
KRGTIGTTTGISG

SEQ ID NO: 3231321 - protein, 14 aa, Plasmodium falciparum
KRGTSVQQFLSIYD

SEQ ID NO: 3231322 - protein, 5 aa, Plasmodium falciparum
KRGYR

SEQ ID NO: 3231323 - protein, 8 aa, Plasmodium falciparum
KRHANNSN

SEQ ID NO: 3231324 - protein, 4 aa, Plasmodium falciparum
KRHE

SEQ ID NO: 3231325 - protein, 13 aa, Plasmodium falciparum
KRHNKKKKKYKKL

SEQ ID NO: 3231326 - protein, 14 aa, Plasmodium falciparum
KRHPKKNFEFINFW

SEQ ID NO: 3231327 - protein, 7 aa, Plasmodium falciparum
KRHYKSK

SEQ ID NO: 3231328 - protein, 4 aa, Plasmodium falciparum
KRID

SEQ ID NO: 3231329 - protein, 4 aa, Plasmodium falciparum
KRIE

SEQ ID NO: 3231330 - protein, 23 aa, Plasmodium falciparum
KRIEKVKEKKKKLEKKVEEGVSG

SEQ ID NO: 3231331 - protein, 16 aa, Plasmodium falciparum
KRIKTNIQNQTNNKPR

SEQ ID NO: 3231332 - protein, 4 aa, Plasmodium falciparum
KRIN

SEQ ID NO: 3231333 - protein, 6 aa, Plasmodium falciparum
KRINEP

SEQ ID NO: 3231334 - protein, 22 aa, Plasmodium falciparum
KRINKNKTKFGSNVNSNVTQSM

SEQ ID NO: 3231335 - protein, 8 aa, Plasmodium falciparum
KRINKNTN

SEQ ID NO: 3231336 - protein, 7 aa, Plasmodium falciparum
KRINPST

SEQ ID NO: 3231337 - protein, 11 aa, Plasmodium falciparum
KRIPEKPSEQV

SEQ ID NO: 3231338 - protein, 4 aa, Plasmodium falciparum
KRIS

SEQ ID NO: 3231339 - protein, 5 aa, Plasmodium falciparum
KRISN

SEQ ID NO: 3231340 - protein, 33 aa, Plasmodium falciparum
KRISNKKNKRMNKKGKKKKKDIEPSNASATSSC

SEQ ID NO: 3231341 - protein, 8 aa, Plasmodium falciparum
KRISNTAA

SEQ ID NO: 3231342 - protein, 9 aa, Plasmodium falciparum
KRISNTDAY

SEQ ID NO: 3231343 - protein, 7 aa, Plasmodium falciparum
KRISSKG

SEQ ID NO: 3231344 - protein, 4 aa, Plasmodium falciparum
KRIT

SEQ ID NO: 3231345 - protein, 5 aa, Plasmodium falciparum
KRKCN

SEQ ID NO: 3231346 - protein, 11 aa, Plasmodium falciparum
KRKDEGNAEYP

SEQ ID NO: 3231347 - protein, 7 aa, Plasmodium falciparum
KRKDEQI

SEQ ID NO: 3231348 - protein, 18 aa, Plasmodium falciparum
KRKDNQWKDKYDGKCTRG

SEQ ID NO: 3231349 - protein, 10 aa, Plasmodium falciparum
KRKDNSGYTN

SEQ ID NO: 3231350 - protein, 6 aa, Plasmodium falciparum
KRKEDE

SEQ ID NO: 3231351 - protein, 15 aa, Plasmodium falciparum
KRKEEESIDKNTLRT

SEQ ID NO: 3231352 - protein, 7 aa, Plasmodium falciparum
KRKEENE

SEQ ID NO: 3231353 - protein, 6 aa, Plasmodium falciparum
KRKEGC

SEQ ID NO: 3231354 - protein, 5 aa, Plasmodium falciparum
KRKEI

SEQ ID NO: 3231355 - protein, 60 aa, Plasmodium falciparum
KRKEKNKSTNMSSDEKKTNKHTNISSDEKKKNKHTNISSDEKKKKKRTNITNDEKTNKHT

SEQ ID NO: 3231356 - protein, 8 aa, Plasmodium falciparum
KRKEKNVD

SEQ ID NO: 3231357 - protein, 7 aa, Plasmodium falciparum
KRKEKRY

SEQ ID NO: 3231358 - protein, 12 aa, Plasmodium falciparum
KRKELTKNKEKE

SEQ ID NO: 3231359 - protein, 6 aa, Plasmodium falciparum
KRKENL

SEQ ID NO: 3231360 - protein, 5 aa, Plasmodium falciparum
KRKEP

SEQ ID NO: 3231361 - protein, 18 aa, Plasmodium falciparum
KRKESLKKNAKEKNINST

SEQ ID NO: 3231362 - protein, 4 aa, Plasmodium falciparum
KRKG

SEQ ID NO: 3231363 - protein, 9 aa, Plasmodium falciparum
KRKGAKRNY

SEQ ID NO: 3231364 - protein, 8 aa, Plasmodium falciparum
KRKGESLN

SEQ ID NO: 3231365 - protein, 14 aa, Plasmodium falciparum
KRKGGNEGRIVFIF

SEQ ID NO: 3231366 - protein, 17 aa, Plasmodium falciparum
KRKGHNMDNNKNIASQS

SEQ ID NO: 3231367 - protein, 12 aa, Plasmodium falciparum
KRKGKKKQTYRR

SEQ ID NO: 3231368 - protein, 8 aa, Plasmodium falciparum
KRKGNKNE

SEQ ID NO: 3231369 - protein, 11 aa, Plasmodium falciparum
KRKGTNNYDED

SEQ ID NO: 3231370 - protein, 13 aa, Plasmodium falciparum
KRKHKNRCNVGSN

SEQ ID NO: 3231371 - protein, 8 aa, Plasmodium falciparum
KRKINKEK

SEQ ID NO: 3231372 - protein, 41 aa, Plasmodium falciparum
KRKINNKKKKNNKKKNNNNKNNDNNNNNNNNDGDNNYTSNN

SEQ ID NO: 3231373 - protein, 13 aa, Plasmodium falciparum
KRKIQKENQKDPF

SEQ ID NO: 3231374 - protein, 4 aa, Plasmodium falciparum
KRKK

SEQ ID NO: 3231375 - protein, 11 aa, Plasmodium falciparum
KRKKDINGEHI

SEQ ID NO: 3231376 - protein, 5 aa, Plasmodium falciparum
KRKKE

SEQ ID NO: 3231377 - protein, 7 aa, Plasmodium falciparum
KRKKEDH

SEQ ID NO: 3231378 - protein, 9 aa, Plasmodium falciparum
KRKKELSKE

SEQ ID NO: 3231379 - protein, 6 aa, Plasmodium falciparum
KRKKEQ

SEQ ID NO: 3231380 - protein, 6 aa, Plasmodium falciparum
KRKKET

SEQ ID NO: 3231381 - protein, 13 aa, Plasmodium falciparum
KRKKGGVTTSNIP

SEQ ID NO: 3231382 - protein, 7 aa, Plasmodium falciparum
KRKKGKR

SEQ ID NO: 3231383 - protein, 7 aa, Plasmodium falciparum
KRKKKGR

SEQ ID NO: 3231384 - protein, 9 aa, Plasmodium falciparum
KRKKKIQNV

SEQ ID NO: 3231385 - protein, 8 aa, Plasmodium falciparum
KRKKKKKK

SEQ ID NO: 3231386 - protein, 14 aa, Plasmodium falciparum
KRKKKKKKKKNKLK

SEQ ID NO: 3231387 - protein, 6 aa, Plasmodium falciparum
KRKKKN

SEQ ID NO: 3231388 - protein, 25 aa, Plasmodium falciparum
KRKKKQNKTKQNDDDDNNNNNNNNI

SEQ ID NO: 3231389 - protein, 59 aa, Plasmodium falciparum
KRKKKYNNNKNKNDNNNDNDNVWGNEKNDQNQNQYNQGQESFKKDSNIYTNDVSNKKNH

SEQ ID NO: 3231390 - protein, 10 aa, Plasmodium falciparum
KRKKSDTNYY

SEQ ID NO: 3231391 - protein, 6 aa, Plasmodium falciparum
KRKKSN

SEQ ID NO: 3231392 - protein, 6 aa, Plasmodium falciparum
KRKKSS

SEQ ID NO: 3231393 - protein, 5 aa, Plasmodium falciparum
KRKKY

SEQ ID NO: 3231394 - protein, 11 aa, Plasmodium falciparum
KRKLDNDGYEK

SEQ ID NO: 3231395 - protein, 5 aa, Plasmodium falciparum
KRKLR

SEQ ID NO: 3231396 - protein, 4 aa, Plasmodium falciparum
KRKN

SEQ ID NO: 3231397 - protein, 7 aa, Plasmodium falciparum
KRKNAQV

SEQ ID NO: 3231398 - protein, 9 aa, Plasmodium falciparum
KRKNDGMDS

SEQ ID NO: 3231399 - protein, 8 aa, Plasmodium falciparum
KRKNEKEE

SEQ ID NO: 3231400 - protein, 6 aa, Plasmodium falciparum
KRKNHS

SEQ ID NO: 3231401 - protein, 9 aa, Plasmodium falciparum
KRKNITNDY

SEQ ID NO: 3231402 - protein, 9 aa, Plasmodium falciparum
KRKNKISKK

SEQ ID NO: 3231403 - protein, 10 aa, Plasmodium falciparum
KRKNKKRNDI

SEQ ID NO: 3231404 - protein, 15 aa, Plasmodium falciparum
KRKNKNNKIKPEKRQ

SEQ ID NO: 3231405 - protein, 26 aa, Plasmodium falciparum
KRKNKNSHNKKKNNKKNKKRNSSSLD

SEQ ID NO: 3231406 - protein, 8 aa, Plasmodium falciparum
KRKNKQLE

SEQ ID NO: 3231407 - protein, 5 aa, Plasmodium falciparum
KRKNL

SEQ ID NO: 3231408 - protein, 10 aa, Plasmodium falciparum
KRKNNEANSF

SEQ ID NO: 3231409 - protein, 9 aa, Plasmodium falciparum
KRKNQENYH

SEQ ID NO: 3231410 - protein, 10 aa, Plasmodium falciparum
KRKNSKKRRL

SEQ ID NO: 3231411 - protein, 8 aa, Plasmodium falciparum
KRKNTTDI

SEQ ID NO: 3231412 - protein, 8 aa, Plasmodium falciparum
KRKQEKTK

SEQ ID NO: 3231413 - protein, 8 aa, Plasmodium falciparum
KRKQFKPT

SEQ ID NO: 3231414 - protein, 12 aa, Plasmodium falciparum
KRKQIKKKKNNK

SEQ ID NO: 3231415 - protein, 5 aa, Plasmodium falciparum
KRKRE

SEQ ID NO: 3231416 - protein, 8 aa, Plasmodium falciparum
KRKRGRKR

SEQ ID NO: 3231417 - protein, 11 aa, Plasmodium falciparum
KRKRKKKKMKR

SEQ ID NO: 3231418 - protein, 7 aa, Plasmodium falciparum
KRKRNED

SEQ ID NO: 3231419 - protein, 9 aa, Plasmodium falciparum
KRKRNNKSR

SEQ ID NO: 3231420 - protein, 12 aa, Plasmodium falciparum
KRKRNRKEAYNT

SEQ ID NO: 3231421 - protein, 6 aa, Plasmodium falciparum
KRKRTH

SEQ ID NO: 3231422 - protein, 7 aa, Plasmodium falciparum
KRKSKDI

SEQ ID NO: 3231423 - protein, 55 aa, Plasmodium falciparum
KRKSKNEKQKEKEKEKEKEKEKEKEKEKEKEKEKESTKRKKNSTNVITEHTNEYI

SEQ ID NO: 3231424 - protein, 12 aa, Plasmodium falciparum
KRKSKRKRKRKI

SEQ ID NO: 3231425 - protein, 8 aa, Plasmodium falciparum
KRKSKYKL

SEQ ID NO: 3231426 - protein, 9 aa, Plasmodium falciparum
KRKSNRDSH

SEQ ID NO: 3231427 - protein, 22 aa, Plasmodium falciparum
KRKSNRGEKRNYNNEKNDKNSL

SEQ ID NO: 3231428 - protein, 10 aa, Plasmodium falciparum
KRKSQKSNHK

SEQ ID NO: 3231429 - protein, 7 aa, Plasmodium falciparum
KRKSSNK

SEQ ID NO: 3231430 - protein, 10 aa, Plasmodium falciparum
KRKSTDGNAR

SEQ ID NO: 3231431 - protein, 6 aa, Plasmodium falciparum
KRKSTL

SEQ ID NO: 3231432 - protein, 5 aa, Plasmodium falciparum
KRKSV

SEQ ID NO: 3231433 - protein, 5 aa, Plasmodium falciparum
KRKSY

SEQ ID NO: 3231434 - protein, 12 aa, Plasmodium falciparum
KRKSYREKSYPH

SEQ ID NO: 3231435 - protein, 4 aa, Plasmodium falciparum
KRKT

SEQ ID NO: 3231436 - protein, 12 aa, Plasmodium falciparum
KRKTKKKKKKKC

SEQ ID NO: 3231437 - protein, 19 aa, Plasmodium falciparum
KRKTNEKEKEEDKDGYKNN

SEQ ID NO: 3231438 - protein, 26 aa, Plasmodium falciparum
KRKVKEKEEETNEDMNKYSNECKENN

SEQ ID NO: 3231439 - protein, 22 aa, Plasmodium falciparum
KRKVKKIKNKDTSRNRKGSNNM

SEQ ID NO: 3231440 - protein, 13 aa, Plasmodium falciparum
KRLNDTKNQRNVY

SEQ ID NO: 3231441 - protein, 13 aa, Plasmodium falciparum
KRLQEEQNEECDE

SEQ ID NO: 3231442 - protein, 5 aa, Plasmodium falciparum
KRLQK

SEQ ID NO: 3231443 - protein, 11 aa, Plasmodium falciparum
KRMEKKKNKIN

SEQ ID NO: 3231444 - protein, 6 aa, Plasmodium falciparum
KRNCGN

SEQ ID NO: 3231445 - protein, 8 aa, Plasmodium falciparum
KRNDINNN

SEQ ID NO: 3231446 - protein, 15 aa, Plasmodium falciparum
KRNDNEDEEEVTYIN

SEQ ID NO: 3231447 - protein, 6 aa, Plasmodium falciparum
KRNDQL

SEQ ID NO: 3231448 - protein, 6 aa, Plasmodium falciparum
KRNEND

SEQ ID NO: 3231449 - protein, 10 aa, Plasmodium falciparum
KRNEYNKSDY

SEQ ID NO: 3231450 - protein, 31 aa, Plasmodium falciparum
KRNGKTPSSSSSSSSNKRKYNDNINNDDEPI

SEQ ID NO: 3231451 - protein, 5 aa, Plasmodium falciparum
KRNHA

SEQ ID NO: 3231452 - protein, 5 aa, Plasmodium falciparum
KRNHQ

SEQ ID NO: 3231453 - protein, 39 aa, Plasmodium falciparum
KRNIENNKNNIENNKNNNENNKNNIENNKNNIENNKNDI

SEQ ID NO: 3231454 - protein, 44 aa, Plasmodium falciparum
KRNIKKDDAYINKEDEEGGGYYNKDDNKKKDILGKKQKKNNNNV

SEQ ID NO: 3231455 - protein, 14 aa, Plasmodium falciparum
KRNIRNSECKRRRN

SEQ ID NO: 3231456 - protein, 6 aa, Plasmodium falciparum
KRNIRR

SEQ ID NO: 3231457 - protein, 9 aa, Plasmodium falciparum
KRNKALSEN

SEQ ID NO: 3231458 - protein, 6 aa, Plasmodium falciparum
KRNKDL

SEQ ID NO: 3231459 - protein, 15 aa, Plasmodium falciparum
KRNKEQKKLKEDKEK

SEQ ID NO: 3231460 - protein, 6 aa, Plasmodium falciparum
KRNKGK

SEQ ID NO: 3231461 - protein, 5 aa, Plasmodium falciparum
KRNKK

SEQ ID NO: 3231462 - protein, 8 aa, Plasmodium falciparum
KRNKKKIK

SEQ ID NO: 3231463 - protein, 18 aa, Plasmodium falciparum
KRNKKNIGNKQNHDGKED

SEQ ID NO: 3231464 - protein, 5 aa, Plasmodium falciparum
KRNKN

SEQ ID NO: 3231465 - protein, 11 aa, Plasmodium falciparum
KRNKNGKSGVK

SEQ ID NO: 3231466 - protein, 7 aa, Plasmodium falciparum
KRNKRNI

SEQ ID NO: 3231467 - protein, 8 aa, Plasmodium falciparum
KRNKRRKN

SEQ ID NO: 3231468 - protein, 16 aa, Plasmodium falciparum
KRNKSIKKKAKIKNYS

SEQ ID NO: 3231469 - protein, 16 aa, Plasmodium falciparum
KRNNANNNVDNNNNIH

SEQ ID NO: 3231470 - protein, 5 aa, Plasmodium falciparum
KRNNC

SEQ ID NO: 3231471 - protein, 5 aa, Plasmodium falciparum
KRNNH

SEQ ID NO: 3231472 - protein, 9 aa, Plasmodium falciparum
KRNNHSDEC

SEQ ID NO: 3231473 - protein, 12 aa, Plasmodium falciparum
KRNNKINTNDSM

SEQ ID NO: 3231474 - protein, 6 aa, Plasmodium falciparum
KRNNKY

SEQ ID NO: 3231475 - protein, 8 aa, Plasmodium falciparum
KRNNNTTS

SEQ ID NO: 3231476 - protein, 6 aa, Plasmodium falciparum
KRNNNY

SEQ ID NO: 3231477 - protein, 5 aa, Plasmodium falciparum
KRNNQ

SEQ ID NO: 3231478 - protein, 9 aa, Plasmodium falciparum
KRNNSNTNS

SEQ ID NO: 3231479 - protein, 7 aa, Plasmodium falciparum
KRNNSSL

SEQ ID NO: 3231480 - protein, 13 aa, Plasmodium falciparum
KRNNTKLDGTTSI

SEQ ID NO: 3231481 - protein, 76 aa, Plasmodium falciparum
KRNNYYESQEKEDTWKNQKHKGINKHKDDSHEDDSHEDDSHEDDSHEDDSHENDSHEDDSHEDDSHENDSHEEKEQ

SEQ ID NO: 3231482 - protein, 7 aa, Plasmodium falciparum
KRNQHPE

SEQ ID NO: 3231483 - protein, 5 aa, Plasmodium falciparum
KRNQS

SEQ ID NO: 3231484 - protein, 4 aa, Plasmodium falciparum
KRNR

SEQ ID NO: 3231485 - protein, 18 aa, Plasmodium falciparum
KRNRKKSGDKISGNEISG

SEQ ID NO: 3231486 - protein, 34 aa, Plasmodium falciparum
KRNRKKSGDKISGNEISGNEISGNKISGNKISGK

SEQ ID NO: 3231487 - protein, 11 aa, Plasmodium falciparum
KRNRKNQRHRK

SEQ ID NO: 3231488 - protein, 6 aa, Plasmodium falciparum
KRNRRS

SEQ ID NO: 3231489 - protein, 7 aa, Plasmodium falciparum
KRNSETF

SEQ ID NO: 3231490 - protein, 5 aa, Plasmodium falciparum
KRNSL

SEQ ID NO: 3231491 - protein, 8 aa, Plasmodium falciparum
KRNSSEEY

SEQ ID NO: 3231492 - protein, 9 aa, Plasmodium falciparum
KRNSSTNKN

SEQ ID NO: 3231493 - protein, 7 aa, Plasmodium falciparum
KRNSYEC

SEQ ID NO: 3231494 - protein, 5 aa, Plasmodium falciparum
KRNTH

SEQ ID NO: 3231495 - protein, 10 aa, Plasmodium falciparum
KRNTNEERFS

SEQ ID NO: 3231496 - protein, 7 aa, Plasmodium falciparum
KRNTNNT

SEQ ID NO: 3231497 - protein, 5 aa, Plasmodium falciparum
KRNTS

SEQ ID NO: 3231498 - protein, 6 aa, Plasmodium falciparum
KRNTSP

SEQ ID NO: 3231499 - protein, 5 aa, Plasmodium falciparum
KRNVH

SEQ ID NO: 3231500 - protein, 15 aa, Plasmodium falciparum
KRNVHNSNVNDGRNS

SEQ ID NO: 3231501 - protein, 4 aa, Plasmodium falciparum
KRNY

SEQ ID NO: 3231502 - protein, 19 aa, Plasmodium falciparum
KRNYEGGVKNELKNESKDI

SEQ ID NO: 3231503 - protein, 16 aa, Plasmodium falciparum
KRPKMDEKKKQKNQIS

SEQ ID NO: 3231504 - protein, 6 aa, Plasmodium falciparum
KRPKRL

SEQ ID NO: 3231505 - protein, 6 aa, Plasmodium falciparum
KRPLSN

SEQ ID NO: 3231506 - protein, 6 aa, Plasmodium falciparum
KRQDHY

SEQ ID NO: 3231507 - protein, 22 aa, Plasmodium falciparum
KRQGKNIYNKEKGEKNKEKINT

SEQ ID NO: 3231508 - protein, 9 aa, Plasmodium falciparum
KRQKDQENL

SEQ ID NO: 3231509 - protein, 22 aa, Plasmodium falciparum
KRQKEKKKKKNNNNNNNNNNNN

SEQ ID NO: 3231510 - protein, 7 aa, Plasmodium falciparum
KRQKSID

SEQ ID NO: 3231511 - protein, 13 aa, Plasmodium falciparum
KRQPKNMEPSTHN

SEQ ID NO: 3231512 - protein, 9 aa, Plasmodium falciparum
KRQPSKNSF

SEQ ID NO: 3231513 - protein, 7 aa, Plasmodium falciparum
KRQTNKN

SEQ ID NO: 3231514 - protein, 11 aa, Plasmodium falciparum
KRRASSTLTSS

SEQ ID NO: 3231515 - protein, 10 aa, Plasmodium falciparum
KRRDDKNVSK

SEQ ID NO: 3231516 - protein, 5 aa, Plasmodium falciparum
KRREA

SEQ ID NO: 3231517 - protein, 100 aa, Plasmodium falciparum
KRRFDGDQENITSSFERTQKSVKYDSDESEELSEAESNGGIPEQNGYDNEDVVSGSDENSDIEKNTEIEEANGYGSEDNSCATEEGSDSNLEENTEEGIE

SEQ ID NO: 3231518 - protein, 27 aa, Plasmodium falciparum
KRRGSFKTNQQNQYENKKEDEKKKKHV

SEQ ID NO: 3231519 - protein, 4 aa, Plasmodium falciparum
KRRK

SEQ ID NO: 3231520 - protein, 6 aa, Plasmodium falciparum
KRRKEI

SEQ ID NO: 3231521 - protein, 10 aa, Plasmodium falciparum
KRRKKKKRIY

SEQ ID NO: 3231522 - protein, 12 aa, Plasmodium falciparum
KRRKKKTKKIRV

SEQ ID NO: 3231523 - protein, 21 aa, Plasmodium falciparum
KRRKKQKKYIKSKNDRKGSVV

SEQ ID NO: 3231524 - protein, 21 aa, Plasmodium falciparum
KRRKNKRDRKKNKRGKGNKKK

SEQ ID NO: 3231525 - protein, 5 aa, Plasmodium falciparum
KRRKR

SEQ ID NO: 3231526 - protein, 8 aa, Plasmodium falciparum
KRRNEDNK

SEQ ID NO: 3231527 - protein, 13 aa, Plasmodium falciparum
KRRNENKKEYSDV

SEQ ID NO: 3231528 - protein, 12 aa, Plasmodium falciparum
KRRQKQNKRKRN

SEQ ID NO: 3231529 - protein, 6 aa, Plasmodium falciparum
KRRRNK

SEQ ID NO: 3231530 - protein, 16 aa, Plasmodium falciparum
KRRRRRRRKKKKANID

SEQ ID NO: 3231531 - protein, 10 aa, Plasmodium falciparum
KRRRRRRRQT

SEQ ID NO: 3231532 - protein, 4 aa, Plasmodium falciparum
KRRS

SEQ ID NO: 3231533 - protein, 18 aa, Plasmodium falciparum
KRRSKSKSLDDSNGGIEN

SEQ ID NO: 3231534 - protein, 20 aa, Plasmodium falciparum
KRRTKKKKKLKRNKKNNNKY

SEQ ID NO: 3231535 - protein, 13 aa, Plasmodium falciparum
KRRTRKDIETDLS

SEQ ID NO: 3231536 - protein, 13 aa, Plasmodium falciparum
KRSESLEKNTAIT

SEQ ID NO: 3231537 - protein, 5 aa, Plasmodium falciparum
KRSFE

SEQ ID NO: 3231538 - protein, 6 aa, Plasmodium falciparum
KRSFSS

SEQ ID NO: 3231539 - protein, 11 aa, Plasmodium falciparum
KRSGGKKRDHY

SEQ ID NO: 3231540 - protein, 5 aa, Plasmodium falciparum
KRSIQ

SEQ ID NO: 3231541 - protein, 12 aa, Plasmodium falciparum
KRSKKLRKNNSY

SEQ ID NO: 3231542 - protein, 10 aa, Plasmodium falciparum
KRSKPEKYRT

SEQ ID NO: 3231543 - protein, 36 aa, Plasmodium falciparum
KRSKRESVQYKDRKEENIDDEKYPSTSKDKDDNINE

SEQ ID NO: 3231544 - protein, 12 aa, Plasmodium falciparum
KRSKRSQNLDQD

SEQ ID NO: 3231545 - protein, 11 aa, Plasmodium falciparum
KRSKYSKAGYI

SEQ ID NO: 3231546 - protein, 6 aa, Plasmodium falciparum
KRSLSE

SEQ ID NO: 3231547 - protein, 9 aa, Plasmodium falciparum
KRSLTSKDD

SEQ ID NO: 3231548 - protein, 6 aa, Plasmodium falciparum
KRSMND

SEQ ID NO: 3231549 - protein, 7 aa, Plasmodium falciparum
KRSNPNL

SEQ ID NO: 3231550 - protein, 7 aa, Plasmodium falciparum
KRSQNKR

SEQ ID NO: 3231551 - protein, 6 aa, Plasmodium falciparum
KRSQSL

SEQ ID NO: 3231552 - protein, 7 aa, Plasmodium falciparum
KRSRDVT

SEQ ID NO: 3231553 - protein, 6 aa, Plasmodium falciparum
KRSRSY

SEQ ID NO: 3231554 - protein, 36 aa, Plasmodium falciparum
KRSSDDDDDNDDEGDNDDDDDDNDNNNNNNNNNNNM

SEQ ID NO: 3231555 - protein, 8 aa, Plasmodium falciparum
KRSSHGSH

SEQ ID NO: 3231556 - protein, 8 aa, Plasmodium falciparum
KRSVNNIN

SEQ ID NO: 3231557 - protein, 13 aa, Plasmodium falciparum
KRSWKHEYKKHLC

SEQ ID NO: 3231558 - protein, 10 aa, Plasmodium falciparum
KRTDERSNTS

SEQ ID NO: 3231559 - protein, 5 aa, Plasmodium falciparum
KRTDL

SEQ ID NO: 3231560 - protein, 6 aa, Plasmodium falciparum
KRTDTF

SEQ ID NO: 3231561 - protein, 5 aa, Plasmodium falciparum
KRTDV

SEQ ID NO: 3231562 - protein, 34 aa, Plasmodium falciparum
KRTEFEKQSNAYEQQKTKYQRETKGAENTDHDNG

SEQ ID NO: 3231563 - protein, 8 aa, Plasmodium falciparum
KRTGGLPK

SEQ ID NO: 3231564 - protein, 20 aa, Plasmodium falciparum
KRTHSSSLSSSSSSGPNITP

SEQ ID NO: 3231565 - protein, 11 aa, Plasmodium falciparum
KRTKKKKNRGE

SEQ ID NO: 3231566 - protein, 7 aa, Plasmodium falciparum
KRTKKQN

SEQ ID NO: 3231567 - protein, 8 aa, Plasmodium falciparum
KRTKQNER

SEQ ID NO: 3231568 - protein, 8 aa, Plasmodium falciparum
KRTNEENV

SEQ ID NO: 3231569 - protein, 6 aa, Plasmodium falciparum
KRTNEK

SEQ ID NO: 3231570 - protein, 6 aa, Plasmodium falciparum
KRTNEQ

SEQ ID NO: 3231571 - protein, 8 aa, Plasmodium falciparum
KRTNKNES

SEQ ID NO: 3231572 - protein, 7 aa, Plasmodium falciparum
KRTNQRE

SEQ ID NO: 3231573 - protein, 7 aa, Plasmodium falciparum
KRTNRNN

SEQ ID NO: 3231574 - protein, 7 aa, Plasmodium falciparum
KRTPKRK

SEQ ID NO: 3231575 - protein, 6 aa, Plasmodium falciparum
KRTPPI

SEQ ID NO: 3231576 - protein, 4 aa, Plasmodium falciparum
KRTS

SEQ ID NO: 3231577 - protein, 19 aa, Plasmodium falciparum
KRTSNNENDYKNGNPPVMN

SEQ ID NO: 3231578 - protein, 13 aa, Plasmodium falciparum
KRTVDKKPCECTP

SEQ ID NO: 3231579 - protein, 4 aa, Plasmodium falciparum
KRTY

SEQ ID NO: 3231580 - protein, 5 aa, Plasmodium falciparum
KRTYG

SEQ ID NO: 3231581 - protein, 87 aa, Plasmodium falciparum
KRVDEKKKKKPTRGKKKKRVAKYKSEVNEDSYENDDNDENVNDNDNDESVGDNDESVDDNDKSVDDNDQSDYNNDQSYDDNVENNIN

SEQ ID NO: 3231582 - protein, 8 aa, Plasmodium falciparum
KRVEESEL

SEQ ID NO: 3231583 - protein, 4 aa, Plasmodium falciparum
KRVK

SEQ ID NO: 3231584 - protein, 5 aa, Plasmodium falciparum
KRWPK

SEQ ID NO: 3231585 - protein, 11 aa, Plasmodium falciparum
KRYDKDDNNVE

SEQ ID NO: 3231586 - protein, 7 aa, Plasmodium falciparum
KRYDYQS

SEQ ID NO: 3231587 - protein, 18 aa, Plasmodium falciparum
KRYEEEKYNNNNNKSKNS

SEQ ID NO: 3231588 - protein, 6 aa, Plasmodium falciparum
KRYEYD

SEQ ID NO: 3231589 - protein, 6 aa, Plasmodium falciparum
KRYINN

SEQ ID NO: 3231590 - protein, 9 aa, Plasmodium falciparum
KRYKDTDNY

SEQ ID NO: 3231591 - protein, 6 aa, Plasmodium falciparum
KRYKNY

SEQ ID NO: 3231592 - protein, 4 aa, Plasmodium falciparum
KRYN

SEQ ID NO: 3231593 - protein, 4 aa, Plasmodium falciparum
KRYQ

SEQ ID NO: 3231594 - protein, 10 aa, Plasmodium falciparum
KRYRGDKDND

SEQ ID NO: 3231595 - protein, 8 aa, Plasmodium falciparum
KRYSKNNK

SEQ ID NO: 3231596 - protein, 16 aa, Plasmodium falciparum
KSAAEISAAANAAGIQ

SEQ ID NO: 3231597 - protein, 8 aa, Plasmodium falciparum
KSAAEVGK

SEQ ID NO: 3231598 - protein, 6 aa, Plasmodium falciparum
KSAAKI

SEQ ID NO: 3231599 - protein, 20 aa, Plasmodium falciparum
KSAAVSETAKVTASETETLK

SEQ ID NO: 3231600 - protein, 5 aa, Plasmodium falciparum
KSADG

SEQ ID NO: 3231601 - protein, 4 aa, Plasmodium falciparum
KSAE

SEQ ID NO: 3231602 - protein, 8 aa, Plasmodium falciparum
KSAEHKET

SEQ ID NO: 3231603 - protein, 6 aa, Plasmodium falciparum
KSAGQK

SEQ ID NO: 3231604 - protein, 5 aa, Plasmodium falciparum
KSAHV

SEQ ID NO: 3231605 - protein, 9 aa, Plasmodium falciparum
KSAKELKKT

SEQ ID NO: 3231606 - protein, 6 aa, Plasmodium falciparum
KSAKKE

SEQ ID NO: 3231607 - protein, 7 aa, Plasmodium falciparum
KSAKNAK

SEQ ID NO: 3231608 - protein, 6 aa, Plasmodium falciparum
KSALTG

SEQ ID NO: 3231609 - protein, 16 aa, Plasmodium falciparum
KSANSSYNKKGSDNLG

SEQ ID NO: 3231610 - protein, 4 aa, Plasmodium falciparum
KSAR

SEQ ID NO: 3231611 - protein, 5 aa, Plasmodium falciparum
KSARN

SEQ ID NO: 3231612 - protein, 5 aa, Plasmodium falciparum
KSASN

SEQ ID NO: 3231613 - protein, 12 aa, Plasmodium falciparum
KSASSENLQNDP

SEQ ID NO: 3231614 - protein, 50 aa, Plasmodium falciparum
KSASSKNKRGIQETGKGNSKNKMDHDNRKEVVNSDKDEKHLKEQKDPKVM

SEQ ID NO: 3231615 - protein, 4 aa, Plasmodium falciparum
KSAV

SEQ ID NO: 3231616 - protein, 4 aa, Plasmodium falciparum
KSAY

SEQ ID NO: 3231617 - protein, 8 aa, Plasmodium falciparum
KSCDDEKV

SEQ ID NO: 3231618 - protein, 4 aa, Plasmodium falciparum
KSCE

SEQ ID NO: 3231619 - protein, 6 aa, Plasmodium falciparum
KSCEAA

SEQ ID NO: 3231620 - protein, 4 aa, Plasmodium falciparum
KSCH

SEQ ID NO: 3231621 - protein, 17 aa, Plasmodium falciparum
KSCRGEDKESKDRYCSR

SEQ ID NO: 3231622 - protein, 5 aa, Plasmodium falciparum
KSCRS

SEQ ID NO: 3231623 - protein, 4 aa, Plasmodium falciparum
KSCS

SEQ ID NO: 3231624 - protein, 73 aa, Plasmodium falciparum
KSCTNGNDVDGVKSKYHKNDHSGDNNNDINNNSDSNNNNNNNNNNNNNNNNNNNNNNNNNNNNNNNNNSCTNN

SEQ ID NO: 3231625 - protein, 26 aa, Plasmodium falciparum
KSCVGEKKDVPVKSQETKQSTSRTSV

SEQ ID NO: 3231626 - protein, 8 aa, Plasmodium falciparum
KSDCTNNS

SEQ ID NO: 3231627 - protein, 4 aa, Plasmodium falciparum
KSDD

SEQ ID NO: 3231628 - protein, 16 aa, Plasmodium falciparum
KSDDEKDKTNKITTGG

SEQ ID NO: 3231629 - protein, 5 aa, Plasmodium falciparum
KSDDI

SEQ ID NO: 3231630 - protein, 7 aa, Plasmodium falciparum
KSDDNKK

SEQ ID NO: 3231631 - protein, 21 aa, Plasmodium falciparum
KSDDTRKKQGKYKSLNISNIM

SEQ ID NO: 3231632 - protein, 8 aa, Plasmodium falciparum
KSDEFDNN

SEQ ID NO: 3231633 - protein, 7 aa, Plasmodium falciparum
KSDENKL

SEQ ID NO: 3231634 - protein, 17 aa, Plasmodium falciparum
KSDENSGLLGTDSNSTI

SEQ ID NO: 3231635 - protein, 10 aa, Plasmodium falciparum
KSDEQNEVSI

SEQ ID NO: 3231636 - protein, 11 aa, Plasmodium falciparum
KSDGGRCSGDG

SEQ ID NO: 3231637 - protein, 6 aa, Plasmodium falciparum
KSDIPA

SEQ ID NO: 3231638 - protein, 9 aa, Plasmodium falciparum
KSDIQEEDL

SEQ ID NO: 3231639 - protein, 4 aa, Plasmodium falciparum
KSDK

SEQ ID NO: 3231640 - protein, 9 aa, Plasmodium falciparum
KSDKDCSIK

SEQ ID NO: 3231641 - protein, 6 aa, Plasmodium falciparum
KSDKEA

SEQ ID NO: 3231642 - protein, 14 aa, Plasmodium falciparum
KSDKKHEQGSENLN

SEQ ID NO: 3231643 - protein, 24 aa, Plasmodium falciparum
KSDKKKKNTKNNTNNKNNSSISNT

SEQ ID NO: 3231644 - protein, 7 aa, Plasmodium falciparum
KSDKNIK

SEQ ID NO: 3231645 - protein, 6 aa, Plasmodium falciparum
KSDKNN

SEQ ID NO: 3231646 - protein, 8 aa, Plasmodium falciparum
KSDKNPQL

SEQ ID NO: 3231647 - protein, 4 aa, Plasmodium falciparum
KSDL

SEQ ID NO: 3231648 - protein, 7 aa, Plasmodium falciparum
KSDMTDD

SEQ ID NO: 3231649 - protein, 4 aa, Plasmodium falciparum
KSDN

SEQ ID NO: 3231650 - protein, 10 aa, Plasmodium falciparum
KSDNHKKECS

SEQ ID NO: 3231651 - protein, 5 aa, Plasmodium falciparum
KSDNK

SEQ ID NO: 3231652 - protein, 6 aa, Plasmodium falciparum
KSDNLE

SEQ ID NO: 3231653 - protein, 12 aa, Plasmodium falciparum
KSDNNLKNENNN

SEQ ID NO: 3231654 - protein, 7 aa, Plasmodium falciparum
KSDNSIC

SEQ ID NO: 3231655 - protein, 11 aa, Plasmodium falciparum
KSDPTPNNEDT

SEQ ID NO: 3231656 - protein, 5 aa, Plasmodium falciparum
KSDPV

SEQ ID NO: 3231657 - protein, 5 aa, Plasmodium falciparum
KSDQE

SEQ ID NO: 3231658 - protein, 16 aa, Plasmodium falciparum
KSDRIGQKKDNTIEDN

SEQ ID NO: 3231659 - protein, 7 aa, Plasmodium falciparum
KSDSEQC

SEQ ID NO: 3231660 - protein, 7 aa, Plasmodium falciparum
KSDTKLT

SEQ ID NO: 3231661 - protein, 8 aa, Plasmodium falciparum
KSDTNFNT

SEQ ID NO: 3231662 - protein, 6 aa, Plasmodium falciparum
KSDVCS

SEQ ID NO: 3231663 - protein, 7 aa, Plasmodium falciparum
KSDVEEN

SEQ ID NO: 3231664 - protein, 18 aa, Plasmodium falciparum
KSDVTNENCASTENNESL

SEQ ID NO: 3231665 - protein, 9 aa, Plasmodium falciparum
KSDYDIPTL

SEQ ID NO: 3231666 - protein, 9 aa, Plasmodium falciparum
KSDYGMPTK

SEQ ID NO: 3231667 - protein, 12 aa, Plasmodium falciparum
KSDYLEKKAGEL

SEQ ID NO: 3231668 - protein, 4 aa, Plasmodium falciparum
KSEA

SEQ ID NO: 3231669 - protein, 5 aa, Plasmodium falciparum
KSEAE

SEQ ID NO: 3231670 - protein, 6 aa, Plasmodium falciparum
KSEDRK

SEQ ID NO: 3231671 - protein, 7 aa, Plasmodium falciparum
KSEDTKN

SEQ ID NO: 3231672 - protein, 13 aa, Plasmodium falciparum
KSEDTKRKNKNYI

SEQ ID NO: 3231673 - protein, 9 aa, Plasmodium falciparum
KSEEDDDNF

SEQ ID NO: 3231674 - protein, 17 aa, Plasmodium falciparum
KSEEDSYDDDSKHFSDN

SEQ ID NO: 3231675 - protein, 30 aa, Plasmodium falciparum
KSEEHDDMTSDSNKEDTKIEEGRKKSNEVN

SEQ ID NO: 3231676 - protein, 34 aa, Plasmodium falciparum
KSEEIKNISNNDNNNNNNNKGDEISDKEQDTSFK

SEQ ID NO: 3231677 - protein, 8 aa, Plasmodium falciparum
KSEEKNRN

SEQ ID NO: 3231678 - protein, 16 aa, Plasmodium falciparum
KSEEMDASVNTTNNKT

SEQ ID NO: 3231679 - protein, 6 aa, Plasmodium falciparum
KSEENY

SEQ ID NO: 3231680 - protein, 10 aa, Plasmodium falciparum
KSEEQKQEIS

SEQ ID NO: 3231681 - protein, 5 aa, Plasmodium falciparum
KSEGL

SEQ ID NO: 3231682 - protein, 4 aa, Plasmodium falciparum
KSEH

SEQ ID NO: 3231683 - protein, 8 aa, Plasmodium falciparum
KSEHNNKS

SEQ ID NO: 3231684 - protein, 14 aa, Plasmodium falciparum
KSEHVRRKNKEEKY

SEQ ID NO: 3231685 - protein, 9 aa, Plasmodium falciparum
KSEHYEDED

SEQ ID NO: 3231686 - protein, 27 aa, Plasmodium falciparum
KSEIKKNDKDDNKKEKNKNMDNKKEKD

SEQ ID NO: 3231687 - protein, 11 aa, Plasmodium falciparum
KSEINELNPNN

SEQ ID NO: 3231688 - protein, 28 aa, Plasmodium falciparum
KSEITGGAGGKGKTRKRRSASNENYEGY

SEQ ID NO: 3231689 - protein, 9 aa, Plasmodium falciparum
KSEKKDDTY

SEQ ID NO: 3231690 - protein, 7 aa, Plasmodium falciparum
KSEKLTT

SEQ ID NO: 3231691 - protein, 6 aa, Plasmodium falciparum
KSEKNI

SEQ ID NO: 3231692 - protein, 12 aa, Plasmodium falciparum
KSEKPIKRREKQ

SEQ ID NO: 3231693 - protein, 7 aa, Plasmodium falciparum
KSEKQVH

SEQ ID NO: 3231694 - protein, 12 aa, Plasmodium falciparum
KSEKSFEKEKGR

SEQ ID NO: 3231695 - protein, 48 aa, Plasmodium falciparum
KSEKSGDSKNSFLSEKTDEQDDSYEDSEKEEEGKKSKKENLKKEPSSD

SEQ ID NO: 3231696 - protein, 21 aa, Plasmodium falciparum
KSENDNQNIENKEEDKKRKIK

SEQ ID NO: 3231697 - protein, 9 aa, Plasmodium falciparum
KSENEEITT

SEQ ID NO: 3231698 - protein, 6 aa, Plasmodium falciparum
KSENER

SEQ ID NO: 3231699 - protein, 11 aa, Plasmodium falciparum
KSENGNNVSTN

SEQ ID NO: 3231700 - protein, 5 aa, Plasmodium falciparum
KSENN

SEQ ID NO: 3231701 - protein, 8 aa, Plasmodium falciparum
KSENSIEK

SEQ ID NO: 3231702 - protein, 12 aa, Plasmodium falciparum
KSENTEHKKECK

SEQ ID NO: 3231703 - protein, 14 aa, Plasmodium falciparum
KSENTNNKSKYTDV

SEQ ID NO: 3231704 - protein, 22 aa, Plasmodium falciparum
KSENYMTTKDKNSDDKSSDDIK

SEQ ID NO: 3231705 - protein, 4 aa, Plasmodium falciparum
KSEP

SEQ ID NO: 3231706 - protein, 8 aa, Plasmodium falciparum
KSERLKKK

SEQ ID NO: 3231707 - protein, 13 aa, Plasmodium falciparum
KSERQNKKKSSWY

SEQ ID NO: 3231708 - protein, 6 aa, Plasmodium falciparum
KSESGK

SEQ ID NO: 3231709 - protein, 7 aa, Plasmodium falciparum
KSESSSL

SEQ ID NO: 3231710 - protein, 62 aa, Plasmodium falciparum
KSESYVTTKNKSIDDKSSDDQISDDKINDDKSSVDQISDDKINDDKSSVDQISDDKSSDDIK

SEQ ID NO: 3231711 - protein, 16 aa, Plasmodium falciparum
KSETKSDVKRGSNKSF

SEQ ID NO: 3231712 - protein, 6 aa, Plasmodium falciparum
KSETMN

SEQ ID NO: 3231713 - protein, 7 aa, Plasmodium falciparum
KSETNDL

SEQ ID NO: 3231714 - protein, 7 aa, Plasmodium falciparum
KSETNRK

SEQ ID NO: 3231715 - protein, 13 aa, Plasmodium falciparum
KSETQTDINNYEQ

SEQ ID NO: 3231716 - protein, 5 aa, Plasmodium falciparum
KSETV

SEQ ID NO: 3231717 - protein, 9 aa, Plasmodium falciparum
KSETYEEKQ

SEQ ID NO: 3231718 - protein, 40 aa, Plasmodium falciparum
KSEYDTYKSEYDTYKSQYDTYKSQYDDRNKYSYPSREGNY

SEQ ID NO: 3231719 - protein, 14 aa, Plasmodium falciparum
KSEYETDKKETPLY

SEQ ID NO: 3231720 - protein, 20 aa, Plasmodium falciparum
KSEYNSNDLQYDNKRERTSI

SEQ ID NO: 3231721 - protein, 6 aa, Plasmodium falciparum
KSEYSD

SEQ ID NO: 3231722 - protein, 9 aa, Plasmodium falciparum
KSEYSEDKE

SEQ ID NO: 3231723 - protein, 5 aa, Plasmodium falciparum
KSFDE

SEQ ID NO: 3231724 - protein, 5 aa, Plasmodium falciparum
KSFDK

SEQ ID NO: 3231725 - protein, 6 aa, Plasmodium falciparum
KSFDKS

SEQ ID NO: 3231726 - protein, 4 aa, Plasmodium falciparum
KSFE

SEQ ID NO: 3231727 - protein, 5 aa, Plasmodium falciparum
KSFED

SEQ ID NO: 3231728 - protein, 11 aa, Plasmodium falciparum
KSFENKSNQIN

SEQ ID NO: 3231729 - protein, 9 aa, Plasmodium falciparum
KSFENSNNK

SEQ ID NO: 3231730 - protein, 5 aa, Plasmodium falciparum
KSFKS

SEQ ID NO: 3231731 - protein, 6 aa, Plasmodium falciparum
KSFNVS

SEQ ID NO: 3231732 - protein, 21 aa, Plasmodium falciparum
KSFSNEEINTDDEYNNQEQRR

SEQ ID NO: 3231733 - protein, 8 aa, Plasmodium falciparum
KSFSNKYK

SEQ ID NO: 3231734 - protein, 7 aa, Plasmodium falciparum
KSFSTDN

SEQ ID NO: 3231735 - protein, 4 aa, Plasmodium falciparum
KSFT

SEQ ID NO: 3231736 - protein, 9 aa, Plasmodium falciparum
KSGACQKNA

SEQ ID NO: 3231737 - protein, 5 aa, Plasmodium falciparum
KSGCQ

SEQ ID NO: 3231738 - protein, 24 aa, Plasmodium falciparum
KSGDGHCDNNKGNHCQSKSSIEAK

SEQ ID NO: 3231739 - protein, 10 aa, Plasmodium falciparum
KSGDKKDEEI

SEQ ID NO: 3231740 - protein, 9 aa, Plasmodium falciparum
KSGDKKNTV

SEQ ID NO: 3231741 - protein, 8 aa, Plasmodium falciparum
KSGGGKST

SEQ ID NO: 3231742 - protein, 7 aa, Plasmodium falciparum
KSGKEYV

SEQ ID NO: 3231743 - protein, 7 aa, Plasmodium falciparum
KSGLADD

SEQ ID NO: 3231744 - protein, 17 aa, Plasmodium falciparum
KSGNDEINHKHENKELK

SEQ ID NO: 3231745 - protein, 7 aa, Plasmodium falciparum
KSGNEQN

SEQ ID NO: 3231746 - protein, 15 aa, Plasmodium falciparum
KSGNGSQNDLKDCEG

SEQ ID NO: 3231747 - protein, 18 aa, Plasmodium falciparum
KSGNLNNKIKKGRERYGG

SEQ ID NO: 3231748 - protein, 8 aa, Plasmodium falciparum
KSGPYKGK

SEQ ID NO: 3231749 - protein, 20 aa, Plasmodium falciparum
KSGQKEDQNIEEDIPDDLED

SEQ ID NO: 3231750 - protein, 9 aa, Plasmodium falciparum
KSGRNPRNY

SEQ ID NO: 3231751 - protein, 23 aa, Plasmodium falciparum
KSGSERCSGDGEDCNDQLDADPT

SEQ ID NO: 3231752 - protein, 5 aa, Plasmodium falciparum
KSGSK

SEQ ID NO: 3231753 - protein, 42 aa, Plasmodium falciparum
KSGSTCHTDYNNNEDNEDNENNEDNENNENKENNEDNKMRDD

SEQ ID NO: 3231754 - protein, 30 aa, Plasmodium falciparum
KSGSVNNNNNINNNNNNINNNNNINNNNNN

SEQ ID NO: 3231755 - protein, 8 aa, Plasmodium falciparum
KSGTAKDV

SEQ ID NO: 3231756 - protein, 12 aa, Plasmodium falciparum
KSGTIGLGGYPD

SEQ ID NO: 3231757 - protein, 8 aa, Plasmodium falciparum
KSGVSPNK

SEQ ID NO: 3231758 - protein, 15 aa, Plasmodium falciparum
KSGYDIKGEKRNNEI

SEQ ID NO: 3231759 - protein, 6 aa, Plasmodium falciparum
KSGYID

SEQ ID NO: 3231760 - protein, 9 aa, Plasmodium falciparum
KSHDNNNDN

SEQ ID NO: 3231761 - protein, 7 aa, Plasmodium falciparum
KSHKGKK

SEQ ID NO: 3231762 - protein, 4 aa, Plasmodium falciparum
KSHN

SEQ ID NO: 3231763 - protein, 18 aa, Plasmodium falciparum
KSHNDKESETNNSSSYQE

SEQ ID NO: 3231764 - protein, 9 aa, Plasmodium falciparum
KSHNKKEEC

SEQ ID NO: 3231765 - protein, 8 aa, Plasmodium falciparum
KSHNLEDK

SEQ ID NO: 3231766 - protein, 6 aa, Plasmodium falciparum
KSHNNN

SEQ ID NO: 3231767 - protein, 17 aa, Plasmodium falciparum
KSHNTNHKGAKTYENQK

SEQ ID NO: 3231768 - protein, 10 aa, Plasmodium falciparum
KSHPNKNNAQ

SEQ ID NO: 3231769 - protein, 6 aa, Plasmodium falciparum
KSHTAQ

SEQ ID NO: 3231770 - protein, 4 aa, Plasmodium falciparum
KSHY

SEQ ID NO: 3231771 - protein, 4 aa, Plasmodium falciparum
KSIA

SEQ ID NO: 3231772 - protein, 4 aa, Plasmodium falciparum
KSID

SEQ ID NO: 3231773 - protein, 10 aa, Plasmodium falciparum
KSIDSSSSYF

SEQ ID NO: 3231774 - protein, 44 aa, Plasmodium falciparum
KSIETKGETDPRSNDQEDATDDVVENSRDDNNSLSNSVDNQSNV

SEQ ID NO: 3231775 - protein, 4 aa, Plasmodium falciparum
KSIF

SEQ ID NO: 3231776 - protein, 6 aa, Plasmodium falciparum
KSIGDY

SEQ ID NO: 3231777 - protein, 12 aa, Plasmodium falciparum
KSIKAIGSYSNN

SEQ ID NO: 3231778 - protein, 28 aa, Plasmodium falciparum
KSIKKQETKENKNNNKFDDNHSTTHHDS

SEQ ID NO: 3231779 - protein, 11 aa, Plasmodium falciparum
KSINDKVSDKH

SEQ ID NO: 3231780 - protein, 5 aa, Plasmodium falciparum
KSINE

SEQ ID NO: 3231781 - protein, 10 aa, Plasmodium falciparum
KSIPGHGGVT

SEQ ID NO: 3231782 - protein, 10 aa, Plasmodium falciparum
KSIPNDDKHT

SEQ ID NO: 3231783 - protein, 12 aa, Plasmodium falciparum
KSIRNNVQEEGH

SEQ ID NO: 3231784 - protein, 5 aa, Plasmodium falciparum
KSISK

SEQ ID NO: 3231785 - protein, 26 aa, Plasmodium falciparum
KSISKGPTQETTTASSYSSSSPAEND

SEQ ID NO: 3231786 - protein, 8 aa, Plasmodium falciparum
KSISKNPR

SEQ ID NO: 3231787 - protein, 20 aa, Plasmodium falciparum
KSISQSNTLYNKSSAGGSII

SEQ ID NO: 3231788 - protein, 5 aa, Plasmodium falciparum
KSIST

SEQ ID NO: 3231789 - protein, 4 aa, Plasmodium falciparum
KSIT

SEQ ID NO: 3231790 - protein, 56 aa, Plasmodium falciparum
KSITQKETTKNYDNNNDNNNDNNNDNNNDNNNDNNNDNNNDNNNDNNNNNNNNNVN

SEQ ID NO: 3231791 - protein, 7 aa, Plasmodium falciparum
KSIYEEK

SEQ ID NO: 3231792 - protein, 28 aa, Plasmodium falciparum
KSIYNNNNINNNNNINNNNNNNNSNNNN

SEQ ID NO: 3231793 - protein, 6 aa, Plasmodium falciparum
KSKDKR

SEQ ID NO: 3231794 - protein, 9 aa, Plasmodium falciparum
KSKDSVAKP

SEQ ID NO: 3231795 - protein, 7 aa, Plasmodium falciparum
KSKDSVM

SEQ ID NO: 3231796 - protein, 33 aa, Plasmodium falciparum
KSKDYSSKCNTYNEKDTSKNSMHNNNNNNNNNN

SEQ ID NO: 3231797 - protein, 7 aa, Plasmodium falciparum
KSKECKD

SEQ ID NO: 3231798 - protein, 12 aa, Plasmodium falciparum
KSKEDNSKFNYL

SEQ ID NO: 3231799 - protein, 12 aa, Plasmodium falciparum
KSKEEKKKESNI

SEQ ID NO: 3231800 - protein, 19 aa, Plasmodium falciparum
KSKEGLNNINGEKNDDNNS

SEQ ID NO: 3231801 - protein, 5 aa, Plasmodium falciparum
KSKEI

SEQ ID NO: 3231802 - protein, 12 aa, Plasmodium falciparum
KSKEKIKPCTND

SEQ ID NO: 3231803 - protein, 6 aa, Plasmodium falciparum
KSKENV

SEQ ID NO: 3231804 - protein, 15 aa, Plasmodium falciparum
KSKESKDKIQKDEDL

SEQ ID NO: 3231805 - protein, 13 aa, Plasmodium falciparum
KSKESNKEKKSDV

SEQ ID NO: 3231806 - protein, 9 aa, Plasmodium falciparum
KSKETETST

SEQ ID NO: 3231807 - protein, 18 aa, Plasmodium falciparum
KSKETFAKKLTKVKVSDK

SEQ ID NO: 3231808 - protein, 9 aa, Plasmodium falciparum
KSKEYDSYK

SEQ ID NO: 3231809 - protein, 4 aa, Plasmodium falciparum
KSKG

SEQ ID NO: 3231810 - protein, 13 aa, Plasmodium falciparum
KSKGQKSKKHLKH

SEQ ID NO: 3231811 - protein, 10 aa, Plasmodium falciparum
KSKIKSHEQS

SEQ ID NO: 3231812 - protein, 20 aa, Plasmodium falciparum
KSKKEKKQDDNNKKKQKIND

SEQ ID NO: 3231813 - protein, 19 aa, Plasmodium falciparum
KSKKKETHQIDKQQDIKQN

SEQ ID NO: 3231814 - protein, 16 aa, Plasmodium falciparum
KSKKKKKKKNGKNSYK

SEQ ID NO: 3231815 - protein, 11 aa, Plasmodium falciparum
KSKKKNKNEIN

SEQ ID NO: 3231816 - protein, 10 aa, Plasmodium falciparum
KSKKKQSTKY

SEQ ID NO: 3231817 - protein, 8 aa, Plasmodium falciparum
KSKKNDCV

SEQ ID NO: 3231818 - protein, 9 aa, Plasmodium falciparum
KSKKNENHV

SEQ ID NO: 3231819 - protein, 7 aa, Plasmodium falciparum
KSKKNER

SEQ ID NO: 3231820 - protein, 6 aa, Plasmodium falciparum
KSKKNI

SEQ ID NO: 3231821 - protein, 6 aa, Plasmodium falciparum
KSKKNR

SEQ ID NO: 3231822 - protein, 13 aa, Plasmodium falciparum
KSKKSKAKVGKGK

SEQ ID NO: 3231823 - protein, 7 aa, Plasmodium falciparum
KSKKSPV

SEQ ID NO: 3231824 - protein, 18 aa, Plasmodium falciparum
KSKLNEKEEKVGEKVEEK

SEQ ID NO: 3231825 - protein, 5 aa, Plasmodium falciparum
KSKLT

SEQ ID NO: 3231826 - protein, 7 aa, Plasmodium falciparum
KSKMETM

SEQ ID NO: 3231827 - protein, 28 aa, Plasmodium falciparum
KSKMKNKKKNKKKSKKKNKKKQNVDILM

SEQ ID NO: 3231828 - protein, 4 aa, Plasmodium falciparum
KSKN

SEQ ID NO: 3231829 - protein, 56 aa, Plasmodium falciparum
KSKNESQTETNNTWKKDSWKKKTEEQQNAEAQQEVKSPYEKYSYNKETKPQNDKYT

SEQ ID NO: 3231830 - protein, 9 aa, Plasmodium falciparum
KSKNGEFPS

SEQ ID NO: 3231831 - protein, 7 aa, Plasmodium falciparum
KSKNGIK

SEQ ID NO: 3231832 - protein, 13 aa, Plasmodium falciparum
KSKNKKDEKKMST

SEQ ID NO: 3231833 - protein, 6 aa, Plasmodium falciparum
KSKNKR

SEQ ID NO: 3231834 - protein, 18 aa, Plasmodium falciparum
KSKNKYSRKDTYKKKKKH

SEQ ID NO: 3231835 - protein, 6 aa, Plasmodium falciparum
KSKNNA

SEQ ID NO: 3231836 - protein, 9 aa, Plasmodium falciparum
KSKNNSTYR

SEQ ID NO: 3231837 - protein, 7 aa, Plasmodium falciparum
KSKNTKD

SEQ ID NO: 3231838 - protein, 10 aa, Plasmodium falciparum
KSKPDEKEHH

SEQ ID NO: 3231839 - protein, 7 aa, Plasmodium falciparum
KSKPFAK

SEQ ID NO: 3231840 - protein, 6 aa, Plasmodium falciparum
KSKPRV

SEQ ID NO: 3231841 - protein, 7 aa, Plasmodium falciparum
KSKPYDD

SEQ ID NO: 3231842 - protein, 20 aa, Plasmodium falciparum
KSKQCNATASSEKGKDGNKS

SEQ ID NO: 3231843 - protein, 12 aa, Plasmodium falciparum
KSKQEDDEIKDK

SEQ ID NO: 3231844 - protein, 7 aa, Plasmodium falciparum
KSKQHRE

SEQ ID NO: 3231845 - protein, 7 aa, Plasmodium falciparum
KSKQPSI

SEQ ID NO: 3231846 - protein, 8 aa, Plasmodium falciparum
KSKQRNKN

SEQ ID NO: 3231847 - protein, 16 aa, Plasmodium falciparum
KSKSDASNKNMSYDEK

SEQ ID NO: 3231848 - protein, 14 aa, Plasmodium falciparum
KSKSDGSTCSSSHS

SEQ ID NO: 3231849 - protein, 6 aa, Plasmodium falciparum
KSKSIN

SEQ ID NO: 3231850 - protein, 10 aa, Plasmodium falciparum
KSKSKRRTNT

SEQ ID NO: 3231851 - protein, 15 aa, Plasmodium falciparum
KSKSKYNNDKKEQKK

SEQ ID NO: 3231852 - protein, 6 aa, Plasmodium falciparum
KSKSLS

SEQ ID NO: 3231853 - protein, 14 aa, Plasmodium falciparum
KSKSNFAGEEVPKG

SEQ ID NO: 3231854 - protein, 38 aa, Plasmodium falciparum
KSKSSDKTFKKQTDMNCSEKNEHISSDKNVNDEHNDNE

SEQ ID NO: 3231855 - protein, 6 aa, Plasmodium falciparum
KSKSSV

SEQ ID NO: 3231856 - protein, 7 aa, Plasmodium falciparum
KSKSSVG

SEQ ID NO: 3231857 - protein, 6 aa, Plasmodium falciparum
KSKSTI

SEQ ID NO: 3231858 - protein, 15 aa, Plasmodium falciparum
KSKSVSVKKNDHGKS

SEQ ID NO: 3231859 - protein, 8 aa, Plasmodium falciparum
KSKTDTNS

SEQ ID NO: 3231860 - protein, 6 aa, Plasmodium falciparum
KSKTLS

SEQ ID NO: 3231861 - protein, 4 aa, Plasmodium falciparum
KSKY

SEQ ID NO: 3231862 - protein, 14 aa, Plasmodium falciparum
KSKYRSPAKQPEED

SEQ ID NO: 3231863 - protein, 20 aa, Plasmodium falciparum
KSKYVKEENYGKAKKLKEKE

SEQ ID NO: 3231864 - protein, 6 aa, Plasmodium falciparum
KSLAEK

SEQ ID NO: 3231865 - protein, 6 aa, Plasmodium falciparum
KSLEDI

SEQ ID NO: 3231866 - protein, 9 aa, Plasmodium falciparum
KSLEESKDN

SEQ ID NO: 3231867 - protein, 5 aa, Plasmodium falciparum
KSLEK

SEQ ID NO: 3231868 - protein, 55 aa, Plasmodium falciparum
KSLETNKNAALNNRELRNSKKNKLLTKNNQSETNKTNNKTTKSASTIEGKSPRVK

SEQ ID NO: 3231869 - protein, 16 aa, Plasmodium falciparum
KSLKKHNNNNNNNNNI

SEQ ID NO: 3231870 - protein, 5 aa, Plasmodium falciparum
KSLKN

SEQ ID NO: 3231871 - protein, 6 aa, Plasmodium falciparum
KSLNDL

SEQ ID NO: 3231872 - protein, 4 aa, Plasmodium falciparum
KSLQ

SEQ ID NO: 3231873 - protein, 9 aa, Plasmodium falciparum
KSLQNSNGE

SEQ ID NO: 3231874 - protein, 8 aa, Plasmodium falciparum
KSLSDKVE

SEQ ID NO: 3231875 - protein, 18 aa, Plasmodium falciparum
KSLSRNKSYKEEKRKNSS

SEQ ID NO: 3231876 - protein, 26 aa, Plasmodium falciparum
KSLSSSCYTSNNSMSYETSDESSHSI

SEQ ID NO: 3231877 - protein, 13 aa, Plasmodium falciparum
KSLSSYTHSESVS

SEQ ID NO: 3231878 - protein, 8 aa, Plasmodium falciparum
KSLTEKVE

SEQ ID NO: 3231879 - protein, 7 aa, Plasmodium falciparum
KSLTKDK

SEQ ID NO: 3231880 - protein, 7 aa, Plasmodium falciparum
KSLYGNT

SEQ ID NO: 3231881 - protein, 21 aa, Plasmodium falciparum
KSMETQNGGGKYEEDMNSTFK

SEQ ID NO: 3231882 - protein, 4 aa, Plasmodium falciparum
KSMG

SEQ ID NO: 3231883 - protein, 8 aa, Plasmodium falciparum
KSMKDRYN

SEQ ID NO: 3231884 - protein, 64 aa, Plasmodium falciparum
KSMQEENQTNNQSSKQTNNQSSKQTNKQSINQSNNQSINQTNNQSIKQTNIQTNKQKGNSTTNK

SEQ ID NO: 3231885 - protein, 36 aa, Plasmodium falciparum
KSMSEKKKKNKDNLKSSYSEFDDNSSDSFSSASNRI

SEQ ID NO: 3231886 - protein, 6 aa, Plasmodium falciparum
KSNASS

SEQ ID NO: 3231887 - protein, 6 aa, Plasmodium falciparum
KSNDFI

SEQ ID NO: 3231888 - protein, 5 aa, Plasmodium falciparum
KSNDM

SEQ ID NO: 3231889 - protein, 12 aa, Plasmodium falciparum
KSNDNEKNKTKD

SEQ ID NO: 3231890 - protein, 9 aa, Plasmodium falciparum
KSNDNKKKE

SEQ ID NO: 3231891 - protein, 8 aa, Plasmodium falciparum
KSNDNTYN

SEQ ID NO: 3231892 - protein, 6 aa, Plasmodium falciparum
KSNDRV

SEQ ID NO: 3231893 - protein, 4 aa, Plasmodium falciparum
KSNE

SEQ ID NO: 3231894 - protein, 8 aa, Plasmodium falciparum
KSNEEDEY

SEQ ID NO: 3231895 - protein, 11 aa, Plasmodium falciparum
KSNEKEKLGYN

SEQ ID NO: 3231896 - protein, 7 aa, Plasmodium falciparum
KSNEKSN

SEQ ID NO: 3231897 - protein, 9 aa, Plasmodium falciparum
KSNELSNKQ

SEQ ID NO: 3231898 - protein, 7 aa, Plasmodium falciparum
KSNENMS

SEQ ID NO: 3231899 - protein, 8 aa, Plasmodium falciparum
KSNENTII

SEQ ID NO: 3231900 - protein, 16 aa, Plasmodium falciparum
KSNENTKLNDKEQNDI

SEQ ID NO: 3231901 - protein, 6 aa, Plasmodium falciparum
KSNESF

SEQ ID NO: 3231902 - protein, 7 aa, Plasmodium falciparum
KSNESLF

SEQ ID NO: 3231903 - protein, 12 aa, Plasmodium falciparum
KSNETSTSSNMS

SEQ ID NO: 3231904 - protein, 5 aa, Plasmodium falciparum
KSNEV

SEQ ID NO: 3231905 - protein, 11 aa, Plasmodium falciparum
KSNEYNKNVPS

SEQ ID NO: 3231906 - protein, 5 aa, Plasmodium falciparum
KSNFI

SEQ ID NO: 3231907 - protein, 31 aa, Plasmodium falciparum
KSNFNNEKKNERKTFEENKKAVSLSKDNDDL

SEQ ID NO: 3231908 - protein, 7 aa, Plasmodium falciparum
KSNGQNQ

SEQ ID NO: 3231909 - protein, 35 aa, Plasmodium falciparum
KSNHNETDQSIKEVPNKDNTTNIYDENNKSDNNQI

SEQ ID NO: 3231910 - protein, 31 aa, Plasmodium falciparum
KSNHYEEGEEHEYDTNSNEYKTKEKKELSNQ

SEQ ID NO: 3231911 - protein, 5 aa, Plasmodium falciparum
KSNIE

SEQ ID NO: 3231912 - protein, 25 aa, Plasmodium falciparum
KSNINKNNEKYVENDVSSDTLQMEP

SEQ ID NO: 3231913 - protein, 8 aa, Plasmodium falciparum
KSNINSTK

SEQ ID NO: 3231914 - protein, 17 aa, Plasmodium falciparum
KSNISSDDNNSTDISQI

SEQ ID NO: 3231915 - protein, 8 aa, Plasmodium falciparum
KSNISTDE

SEQ ID NO: 3231916 - protein, 4 aa, Plasmodium falciparum
KSNK

SEQ ID NO: 3231917 - protein, 5 aa, Plasmodium falciparum
KSNKA

SEQ ID NO: 3231918 - protein, 31 aa, Plasmodium falciparum
KSNKEETKKNIKKNEHVKNKYSGKNTQKCSP

SEQ ID NO: 3231919 - protein, 7 aa, Plasmodium falciparum
KSNKEKL

SEQ ID NO: 3231920 - protein, 11 aa, Plasmodium falciparum
KSNKESEDGKD

SEQ ID NO: 3231921 - protein, 9 aa, Plasmodium falciparum
KSNKINKYT

SEQ ID NO: 3231922 - protein, 6 aa, Plasmodium falciparum
KSNKIS

SEQ ID NO: 3231923 - protein, 58 aa, Plasmodium falciparum
KSNKKPEVSGDEKDESKKVDAGKNNKESKADKSEEKLHKSDDRESKSSSSKSTAVPTT

SEQ ID NO: 3231924 - protein, 77 aa, Plasmodium falciparum
KSNKNNNNKKKNKNNYNNNNINNNNNNNNNNNINNNNNNKCKLSNSKRYNIRNNNNNKKAKNNEKNNIDDSNLEKKK

SEQ ID NO: 3231925 - protein, 9 aa, Plasmodium falciparum
KSNKSQLDT

SEQ ID NO: 3231926 - protein, 7 aa, Plasmodium falciparum
KSNKTNI

SEQ ID NO: 3231927 - protein, 6 aa, Plasmodium falciparum
KSNKTV

SEQ ID NO: 3231928 - protein, 7 aa, Plasmodium falciparum
KSNLDEQ

SEQ ID NO: 3231929 - protein, 22 aa, Plasmodium falciparum
KSNLKNTSSLNNNNDNNKVRTN

SEQ ID NO: 3231930 - protein, 8 aa, Plasmodium falciparum
KSNMGTGS

SEQ ID NO: 3231931 - protein, 6 aa, Plasmodium falciparum
KSNMNN

SEQ ID NO: 3231932 - protein, 8 aa, Plasmodium falciparum
KSNNDLKE

SEQ ID NO: 3231933 - protein, 8 aa, Plasmodium falciparum
KSNNEEIK

SEQ ID NO: 3231934 - protein, 6 aa, Plasmodium falciparum
KSNNEI

SEQ ID NO: 3231935 - protein, 8 aa, Plasmodium falciparum
KSNNEKSW

SEQ ID NO: 3231936 - protein, 9 aa, Plasmodium falciparum
KSNNENPNM

SEQ ID NO: 3231937 - protein, 5 aa, Plasmodium falciparum
KSNNI

SEQ ID NO: 3231938 - protein, 10 aa, Plasmodium falciparum
KSNNIEEGEN

SEQ ID NO: 3231939 - protein, 13 aa, Plasmodium falciparum
KSNNNEKGEIGQI

SEQ ID NO: 3231940 - protein, 10 aa, Plasmodium falciparum
KSNNNKGETN

SEQ ID NO: 3231941 - protein, 10 aa, Plasmodium falciparum
KSNNNKKGKS

SEQ ID NO: 3231942 - protein, 7 aa, Plasmodium falciparum
KSNNNNN

SEQ ID NO: 3231943 - protein, 23 aa, Plasmodium falciparum
KSNNNNNNNNNSNESKINNPEDV

SEQ ID NO: 3231944 - protein, 7 aa, Plasmodium falciparum
KSNNNPL

SEQ ID NO: 3231945 - protein, 7 aa, Plasmodium falciparum
KSNNSYM

SEQ ID NO: 3231946 - protein, 5 aa, Plasmodium falciparum
KSNNV

SEQ ID NO: 3231947 - protein, 19 aa, Plasmodium falciparum
KSNNVAKENIKQEDESNTL

SEQ ID NO: 3231948 - protein, 7 aa, Plasmodium falciparum
KSNPDDL

SEQ ID NO: 3231949 - protein, 5 aa, Plasmodium falciparum
KSNPI

SEQ ID NO: 3231950 - protein, 7 aa, Plasmodium falciparum
KSNPKEQ

SEQ ID NO: 3231951 - protein, 12 aa, Plasmodium falciparum
KSNQMDNEEKKK

SEQ ID NO: 3231952 - protein, 7 aa, Plasmodium falciparum
KSNQNSL

SEQ ID NO: 3231953 - protein, 6 aa, Plasmodium falciparum
KSNQNY

SEQ ID NO: 3231954 - protein, 10 aa, Plasmodium falciparum
KSNQQRIDKR

SEQ ID NO: 3231955 - protein, 6 aa, Plasmodium falciparum
KSNRCS

SEQ ID NO: 3231956 - protein, 6 aa, Plasmodium falciparum
KSNSGL

SEQ ID NO: 3231957 - protein, 10 aa, Plasmodium falciparum
KSNSNALSIN

SEQ ID NO: 3231958 - protein, 7 aa, Plasmodium falciparum
KSNSNKV

SEQ ID NO: 3231959 - protein, 8 aa, Plasmodium falciparum
KSNSNMND

SEQ ID NO: 3231960 - protein, 6 aa, Plasmodium falciparum
KSNSQN

SEQ ID NO: 3231961 - protein, 13 aa, Plasmodium falciparum
KSNSSNRSYSKNY

SEQ ID NO: 3231962 - protein, 8 aa, Plasmodium falciparum
KSNSTYNY

SEQ ID NO: 3231963 - protein, 12 aa, Plasmodium falciparum
KSNTCKKHEQNV

SEQ ID NO: 3231964 - protein, 5 aa, Plasmodium falciparum
KSNTF

SEQ ID NO: 3231965 - protein, 26 aa, Plasmodium falciparum
KSNTGEGGEAEERIKTANNEINTNSA

SEQ ID NO: 3231966 - protein, 14 aa, Plasmodium falciparum
KSNTLDSTNKYEDK

SEQ ID NO: 3231967 - protein, 24 aa, Plasmodium falciparum
KSNTNNNNNNNNNNNKDDDYYDDN

SEQ ID NO: 3231968 - protein, 19 aa, Plasmodium falciparum
KSNTTFKKGKTLKKVGKKK

SEQ ID NO: 3231969 - protein, 6 aa, Plasmodium falciparum
KSNTTY

SEQ ID NO: 3231970 - protein, 17 aa, Plasmodium falciparum
KSNTVDNNPYDGQYKKK

SEQ ID NO: 3231971 - protein, 6 aa, Plasmodium falciparum
KSNVDK

SEQ ID NO: 3231972 - protein, 13 aa, Plasmodium falciparum
KSNVKENNDKEYY

SEQ ID NO: 3231973 - protein, 7 aa, Plasmodium falciparum
KSNVTNV

SEQ ID NO: 3231974 - protein, 25 aa, Plasmodium falciparum
KSNVTTKETQSEKPCNNNQTKQATN

SEQ ID NO: 3231975 - protein, 4 aa, Plasmodium falciparum
KSNY

SEQ ID NO: 3231976 - protein, 14 aa, Plasmodium falciparum
KSNYENESNNHDKG

SEQ ID NO: 3231977 - protein, 5 aa, Plasmodium falciparum
KSNYQ

SEQ ID NO: 3231978 - protein, 6 aa, Plasmodium falciparum
KSNYQY

SEQ ID NO: 3231979 - protein, 9 aa, Plasmodium falciparum
KSPAKYSSS

SEQ ID NO: 3231980 - protein, 6 aa, Plasmodium falciparum
KSPDYG

SEQ ID NO: 3231981 - protein, 7 aa, Plasmodium falciparum
KSPEQVA

SEQ ID NO: 3231982 - protein, 12 aa, Plasmodium falciparum
KSPIASQGIFMN

SEQ ID NO: 3231983 - protein, 8 aa, Plasmodium falciparum
KSPIENPG

SEQ ID NO: 3231984 - protein, 8 aa, Plasmodium falciparum
KSPISNNE

SEQ ID NO: 3231985 - protein, 5 aa, Plasmodium falciparum
KSPIT

SEQ ID NO: 3231986 - protein, 4 aa, Plasmodium falciparum
KSPL

SEQ ID NO: 3231987 - protein, 10 aa, Plasmodium falciparum
KSPLNEEEKN

SEQ ID NO: 3231988 - protein, 7 aa, Plasmodium falciparum
KSPLYNK

SEQ ID NO: 3231989 - protein, 8 aa, Plasmodium falciparum
KSPMKNQN

SEQ ID NO: 3231990 - protein, 17 aa, Plasmodium falciparum
KSPQRNDSNISNDSNKN

SEQ ID NO: 3231991 - protein, 14 aa, Plasmodium falciparum
KSPQYDHQKDTNQN

SEQ ID NO: 3231992 - protein, 5 aa, Plasmodium falciparum
KSPRI

SEQ ID NO: 3231993 - protein, 10 aa, Plasmodium falciparum
KSPSENSEEM

SEQ ID NO: 3231994 - protein, 6 aa, Plasmodium falciparum
KSPSPC

SEQ ID NO: 3231995 - protein, 7 aa, Plasmodium falciparum
KSPTPKR

SEQ ID NO: 3231996 - protein, 4 aa, Plasmodium falciparum
KSPV

SEQ ID NO: 3231997 - protein, 4 aa, Plasmodium falciparum
KSQD

SEQ ID NO: 3231998 - protein, 6 aa, Plasmodium falciparum
KSQEDL

SEQ ID NO: 3231999 - protein, 7 aa, Plasmodium falciparum
KSQEEHL

SEQ ID NO: 3232000 - protein, 20 aa, Plasmodium falciparum
KSQESLTDNKKTNADNEKQL

SEQ ID NO: 3232001 - protein, 47 aa, Plasmodium falciparum
KSQGTLSNDGSNNMNNNNVNNNNVNNNNVNNNNVNNNNVNNNNVNNN

SEQ ID NO: 3232002 - protein, 5 aa, Plasmodium falciparum
KSQIK

SEQ ID NO: 3232003 - protein, 19 aa, Plasmodium falciparum
KSQINYSNSDDKKIKDIQN

SEQ ID NO: 3232004 - protein, 4 aa, Plasmodium falciparum
KSQK

SEQ ID NO: 3232005 - protein, 8 aa, Plasmodium falciparum
KSQKDNRD

SEQ ID NO: 3232006 - protein, 12 aa, Plasmodium falciparum
KSQKLENSENPL

SEQ ID NO: 3232007 - protein, 22 aa, Plasmodium falciparum
KSQKLNETSKYIPGNAANYTTY

SEQ ID NO: 3232008 - protein, 22 aa, Plasmodium falciparum
KSQKSKDSKKQNGDNKDNKIEN

SEQ ID NO: 3232009 - protein, 27 aa, Plasmodium falciparum
KSQLKDSQINKNTHDNEKNKISSPQTE

SEQ ID NO: 3232010 - protein, 25 aa, Plasmodium falciparum
KSQNISSSTYSSSSSSSNLYNTNAE

SEQ ID NO: 3232011 - protein, 5 aa, Plasmodium falciparum
KSQNN

SEQ ID NO: 3232012 - protein, 6 aa, Plasmodium falciparum
KSQNNE

SEQ ID NO: 3232013 - protein, 6 aa, Plasmodium falciparum
KSQNNH

SEQ ID NO: 3232014 - protein, 6 aa, Plasmodium falciparum
KSQNSV

SEQ ID NO: 3232015 - protein, 8 aa, Plasmodium falciparum
KSQRKATK

SEQ ID NO: 3232016 - protein, 18 aa, Plasmodium falciparum
KSRDAEKDSEKENENVKN

SEQ ID NO: 3232017 - protein, 5 aa, Plasmodium falciparum
KSRDI

SEQ ID NO: 3232018 - protein, 6 aa, Plasmodium falciparum
KSRDSN

SEQ ID NO: 3232019 - protein, 6 aa, Plasmodium falciparum
KSRGIN

SEQ ID NO: 3232020 - protein, 13 aa, Plasmodium falciparum
KSRKKGRENKNDE

SEQ ID NO: 3232021 - protein, 7 aa, Plasmodium falciparum
KSRKTNK

SEQ ID NO: 3232022 - protein, 8 aa, Plasmodium falciparum
KSRNNEYE

SEQ ID NO: 3232023 - protein, 9 aa, Plasmodium falciparum
KSRNNNTQV

SEQ ID NO: 3232024 - protein, 8 aa, Plasmodium falciparum
KSRNPDKC

SEQ ID NO: 3232025 - protein, 14 aa, Plasmodium falciparum
KSRRKRSIGSDTYD

SEQ ID NO: 3232026 - protein, 4 aa, Plasmodium falciparum
KSRS

SEQ ID NO: 3232027 - protein, 5 aa, Plasmodium falciparum
KSRSE

SEQ ID NO: 3232028 - protein, 9 aa, Plasmodium falciparum
KSRSTYNSN

SEQ ID NO: 3232029 - protein, 6 aa, Plasmodium falciparum
KSRSVN

SEQ ID NO: 3232030 - protein, 5 aa, Plasmodium falciparum
KSRTL

SEQ ID NO: 3232031 - protein, 12 aa, Plasmodium falciparum
KSRTPREAGSSH

SEQ ID NO: 3232032 - protein, 6 aa, Plasmodium falciparum
KSRYYN

SEQ ID NO: 3232033 - protein, 4 aa, Plasmodium falciparum
KSSA

SEQ ID NO: 3232034 - protein, 8 aa, Plasmodium falciparum
KSSAEIAG

SEQ ID NO: 3232035 - protein, 17 aa, Plasmodium falciparum
KSSAHNNNNNKNEHSLK

SEQ ID NO: 3232036 - protein, 9 aa, Plasmodium falciparum
KSSASSIEN

SEQ ID NO: 3232037 - protein, 8 aa, Plasmodium falciparum
KSSCAAKT

SEQ ID NO: 3232038 - protein, 6 aa, Plasmodium falciparum
KSSCKD

SEQ ID NO: 3232039 - protein, 44 aa, Plasmodium falciparum
KSSDEISGGNKGKKNKEKISNNNEKNNVNEKKNNKNAQNDLNDN

SEQ ID NO: 3232040 - protein, 11 aa, Plasmodium falciparum
KSSDNEKYEKV

SEQ ID NO: 3232041 - protein, 14 aa, Plasmodium falciparum
KSSDNFEKEKMKEN

SEQ ID NO: 3232042 - protein, 32 aa, Plasmodium falciparum
KSSDNIKSSDNIKSSDNINSSDNIKSSDNNNV

SEQ ID NO: 3232043 - protein, 6 aa, Plasmodium falciparum
KSSDNV

SEQ ID NO: 3232044 - protein, 4 aa, Plasmodium falciparum
KSSE

SEQ ID NO: 3232045 - protein, 19 aa, Plasmodium falciparum
KSSENQEVEEDQEEEKKKK

SEQ ID NO: 3232046 - protein, 8 aa, Plasmodium falciparum
KSSESWKR

SEQ ID NO: 3232047 - protein, 6 aa, Plasmodium falciparum
KSSETL

SEQ ID NO: 3232048 - protein, 5 aa, Plasmodium falciparum
KSSFH

SEQ ID NO: 3232049 - protein, 6 aa, Plasmodium falciparum
KSSFTN

SEQ ID NO: 3232050 - protein, 6 aa, Plasmodium falciparum
KSSGAF

SEQ ID NO: 3232051 - protein, 8 aa, Plasmodium falciparum
KSSGDAIG

SEQ ID NO: 3232052 - protein, 10 aa, Plasmodium falciparum
KSSGDDTNVG

SEQ ID NO: 3232053 - protein, 7 aa, Plasmodium falciparum
KSSGECQ

SEQ ID NO: 3232054 - protein, 27 aa, Plasmodium falciparum
KSSGGTENKCPKGKISADDIPSLGNST

SEQ ID NO: 3232055 - protein, 6 aa, Plasmodium falciparum
KSSGKT

SEQ ID NO: 3232056 - protein, 25 aa, Plasmodium falciparum
KSSGYDSSYNDLQSSSLPNPSSNEV

SEQ ID NO: 3232057 - protein, 6 aa, Plasmodium falciparum
KSSHFE

SEQ ID NO: 3232058 - protein, 7 aa, Plasmodium falciparum
KSSITQN

SEQ ID NO: 3232059 - protein, 4 aa, Plasmodium falciparum
KSSK

SEQ ID NO: 3232060 - protein, 7 aa, Plasmodium falciparum
KSSKETT

SEQ ID NO: 3232061 - protein, 8 aa, Plasmodium falciparum
KSSKEVHQ

SEQ ID NO: 3232062 - protein, 11 aa, Plasmodium falciparum
KSSKKNQGEYI

SEQ ID NO: 3232063 - protein, 7 aa, Plasmodium falciparum
KSSKMEN

SEQ ID NO: 3232064 - protein, 8 aa, Plasmodium falciparum
KSSKSSNN

SEQ ID NO: 3232065 - protein, 11 aa, Plasmodium falciparum
KSSLRKENPQE

SEQ ID NO: 3232066 - protein, 8 aa, Plasmodium falciparum
KSSLTSKI

SEQ ID NO: 3232067 - protein, 6 aa, Plasmodium falciparum
KSSMDN

SEQ ID NO: 3232068 - protein, 4 aa, Plasmodium falciparum
KSSN

SEQ ID NO: 3232069 - protein, 6 aa, Plasmodium falciparum
KSSNDN

SEQ ID NO: 3232070 - protein, 8 aa, Plasmodium falciparum
KSSNGESI

SEQ ID NO: 3232071 - protein, 7 aa, Plasmodium falciparum
KSSNKLT

SEQ ID NO: 3232072 - protein, 15 aa, Plasmodium falciparum
KSSNKNNLTKDSFKD

SEQ ID NO: 3232073 - protein, 8 aa, Plasmodium falciparum
KSSNKSFK

SEQ ID NO: 3232074 - protein, 5 aa, Plasmodium falciparum
KSSNN

SEQ ID NO: 3232075 - protein, 10 aa, Plasmodium falciparum
KSSNNKFNTS

SEQ ID NO: 3232076 - protein, 6 aa, Plasmodium falciparum
KSSNRY

SEQ ID NO: 3232077 - protein, 6 aa, Plasmodium falciparum
KSSNVD

SEQ ID NO: 3232078 - protein, 14 aa, Plasmodium falciparum
KSSPFNKETRKEKS

SEQ ID NO: 3232079 - protein, 6 aa, Plasmodium falciparum
KSSPNN

SEQ ID NO: 3232080 - protein, 4 aa, Plasmodium falciparum
KSSQ

SEQ ID NO: 3232081 - protein, 11 aa, Plasmodium falciparum
KSSQEQQDKAL

SEQ ID NO: 3232082 - protein, 8 aa, Plasmodium falciparum
KSSQIDEK

SEQ ID NO: 3232083 - protein, 36 aa, Plasmodium falciparum
KSSQNKTAFSKNENTNVNNNNNNNNNNSYSNNNNGI

SEQ ID NO: 3232084 - protein, 4 aa, Plasmodium falciparum
KSSR

SEQ ID NO: 3232085 - protein, 14 aa, Plasmodium falciparum
KSSRIGVQKSQSAH

SEQ ID NO: 3232086 - protein, 34 aa, Plasmodium falciparum
KSSSASGGAAGTSSTSGGGTSGDSGTNNENEGTF

SEQ ID NO: 3232087 - protein, 16 aa, Plasmodium falciparum
KSSSDDEINDDNINEE

SEQ ID NO: 3232088 - protein, 7 aa, Plasmodium falciparum
KSSSDSK

SEQ ID NO: 3232089 - protein, 8 aa, Plasmodium falciparum
KSSSMSMN

SEQ ID NO: 3232090 - protein, 11 aa, Plasmodium falciparum
KSSSNLSSSDD

SEQ ID NO: 3232091 - protein, 7 aa, Plasmodium falciparum
KSSSPEF

SEQ ID NO: 3232092 - protein, 11 aa, Plasmodium falciparum
KSSSSRNGKNK

SEQ ID NO: 3232093 - protein, 25 aa, Plasmodium falciparum
KSSTSNNNTKENEDTNDIAKRSSKE

SEQ ID NO: 3232094 - protein, 6 aa, Plasmodium falciparum
KSSVDN

SEQ ID NO: 3232095 - protein, 6 aa, Plasmodium falciparum
KSSYDY

SEQ ID NO: 3232096 - protein, 8 aa, Plasmodium falciparum
KSSYERAH

SEQ ID NO: 3232097 - protein, 9 aa, Plasmodium falciparum
KSSYNNNYN

SEQ ID NO: 3232098 - protein, 8 aa, Plasmodium falciparum
KSSYNSLY

SEQ ID NO: 3232099 - protein, 6 aa, Plasmodium falciparum
KSTCEK

SEQ ID NO: 3232100 - protein, 8 aa, Plasmodium falciparum
KSTDEETC

SEQ ID NO: 3232101 - protein, 5 aa, Plasmodium falciparum
KSTDI

SEQ ID NO: 3232102 - protein, 7 aa, Plasmodium falciparum
KSTDIND

SEQ ID NO: 3232103 - protein, 7 aa, Plasmodium falciparum
KSTEPDW

SEQ ID NO: 3232104 - protein, 6 aa, Plasmodium falciparum
KSTEWD

SEQ ID NO: 3232105 - protein, 6 aa, Plasmodium falciparum
KSTEWG

SEQ ID NO: 3232106 - protein, 6 aa, Plasmodium falciparum
KSTEWK

SEQ ID NO: 3232107 - protein, 4 aa, Plasmodium falciparum
KSTF

SEQ ID NO: 3232108 - protein, 7 aa, Plasmodium falciparum
KSTGKEL

SEQ ID NO: 3232109 - protein, 4 aa, Plasmodium falciparum
KSTI

SEQ ID NO: 3232110 - protein, 7 aa, Plasmodium falciparum
KSTKEKW

SEQ ID NO: 3232111 - protein, 7 aa, Plasmodium falciparum
KSTKTES

SEQ ID NO: 3232112 - protein, 6 aa, Plasmodium falciparum
KSTLER

SEQ ID NO: 3232113 - protein, 11 aa, Plasmodium falciparum
KSTLKKKKYNN

SEQ ID NO: 3232114 - protein, 7 aa, Plasmodium falciparum
KSTNDSK

SEQ ID NO: 3232115 - protein, 7 aa, Plasmodium falciparum
KSTNEYL

SEQ ID NO: 3232116 - protein, 6 aa, Plasmodium falciparum
KSTNHK

SEQ ID NO: 3232117 - protein, 6 aa, Plasmodium falciparum
KSTNIE

SEQ ID NO: 3232118 - protein, 7 aa, Plasmodium falciparum
KSTNKNI

SEQ ID NO: 3232119 - protein, 7 aa, Plasmodium falciparum
KSTNKNL

SEQ ID NO: 3232120 - protein, 15 aa, Plasmodium falciparum
KSTNKSNNKSNNNNN

SEQ ID NO: 3232121 - protein, 22 aa, Plasmodium falciparum
KSTNKTSKKNKNKSKVEQNNTN

SEQ ID NO: 3232122 - protein, 7 aa, Plasmodium falciparum
KSTNNGF

SEQ ID NO: 3232123 - protein, 14 aa, Plasmodium falciparum
KSTNNGQPKTKDEY

SEQ ID NO: 3232124 - protein, 13 aa, Plasmodium falciparum
KSTNNKSTMQGQD

SEQ ID NO: 3232125 - protein, 6 aa, Plasmodium falciparum
KSTNSK

SEQ ID NO: 3232126 - protein, 6 aa, Plasmodium falciparum
KSTPKY

SEQ ID NO: 3232127 - protein, 7 aa, Plasmodium falciparum
KSTPVYT

SEQ ID NO: 3232128 - protein, 5 aa, Plasmodium falciparum
KSTQH

SEQ ID NO: 3232129 - protein, 5 aa, Plasmodium falciparum
KSTQL

SEQ ID NO: 3232130 - protein, 6 aa, Plasmodium falciparum
KSTQSG

SEQ ID NO: 3232131 - protein, 5 aa, Plasmodium falciparum
KSTRD

SEQ ID NO: 3232132 - protein, 4 aa, Plasmodium falciparum
KSTS

SEQ ID NO: 3232133 - protein, 11 aa, Plasmodium falciparum
KSTSHQNSKDV

SEQ ID NO: 3232134 - protein, 18 aa, Plasmodium falciparum
KSTSPYNNDNDVNKSTHA

SEQ ID NO: 3232135 - protein, 11 aa, Plasmodium falciparum
KSTSSINNNEN

SEQ ID NO: 3232136 - protein, 12 aa, Plasmodium falciparum
KSTTHHTPKVPT

SEQ ID NO: 3232137 - protein, 5 aa, Plasmodium falciparum
KSTYE

SEQ ID NO: 3232138 - protein, 13 aa, Plasmodium falciparum
KSTYNQKEKTNYK

SEQ ID NO: 3232139 - protein, 7 aa, Plasmodium falciparum
KSVAEKV

SEQ ID NO: 3232140 - protein, 30 aa, Plasmodium falciparum
KSVAERNKKSASQDSLGAGFSDSDSDSEYE

SEQ ID NO: 3232141 - protein, 22 aa, Plasmodium falciparum
KSVASQNETKKKKKKKKNSEQN

SEQ ID NO: 3232142 - protein, 13 aa, Plasmodium falciparum
KSVDDKQEKPEEK

SEQ ID NO: 3232143 - protein, 12 aa, Plasmodium falciparum
KSVDEKRDNNID

SEQ ID NO: 3232144 - protein, 4 aa, Plasmodium falciparum
KSVE

SEQ ID NO: 3232145 - protein, 20 aa, Plasmodium falciparum
KSVEDDKVVDDENTKRKLNN

SEQ ID NO: 3232146 - protein, 5 aa, Plasmodium falciparum
KSVEK

SEQ ID NO: 3232147 - protein, 8 aa, Plasmodium falciparum
KSVENNNI

SEQ ID NO: 3232148 - protein, 9 aa, Plasmodium falciparum
KSVGEDNPI

SEQ ID NO: 3232149 - protein, 4 aa, Plasmodium falciparum
KSVK

SEQ ID NO: 3232150 - protein, 8 aa, Plasmodium falciparum
KSVKKKRS

SEQ ID NO: 3232151 - protein, 7 aa, Plasmodium falciparum
KSVKSVK

SEQ ID NO: 3232152 - protein, 5 aa, Plasmodium falciparum
KSVLS

SEQ ID NO: 3232153 - protein, 4 aa, Plasmodium falciparum
KSVN

SEQ ID NO: 3232154 - protein, 12 aa, Plasmodium falciparum
KSVNDRKEKKIP

SEQ ID NO: 3232155 - protein, 14 aa, Plasmodium falciparum
KSVNITESEKSARN

SEQ ID NO: 3232156 - protein, 6 aa, Plasmodium falciparum
KSVPSA

SEQ ID NO: 3232157 - protein, 12 aa, Plasmodium falciparum
KSVQKRSYKSKK

SEQ ID NO: 3232158 - protein, 5 aa, Plasmodium falciparum
KSVRP

SEQ ID NO: 3232159 - protein, 8 aa, Plasmodium falciparum
KSVSDKVE

SEQ ID NO: 3232160 - protein, 8 aa, Plasmodium falciparum
KSVTSQQD

SEQ ID NO: 3232161 - protein, 12 aa, Plasmodium falciparum
KSVYEKSTSKVN

SEQ ID NO: 3232162 - protein, 12 aa, Plasmodium falciparum
KSWKHECKKHLC

SEQ ID NO: 3232163 - protein, 8 aa, Plasmodium falciparum
KSYDNQNE

SEQ ID NO: 3232164 - protein, 5 aa, Plasmodium falciparum
KSYEK

SEQ ID NO: 3232165 - protein, 6 aa, Plasmodium falciparum
KSYEND

SEQ ID NO: 3232166 - protein, 7 aa, Plasmodium falciparum
KSYHEKN

SEQ ID NO: 3232167 - protein, 24 aa, Plasmodium falciparum
KSYHQTKDSNNNNNNNNDHHHNSK

SEQ ID NO: 3232168 - protein, 4 aa, Plasmodium falciparum
KSYI

SEQ ID NO: 3232169 - protein, 22 aa, Plasmodium falciparum
KSYIRNNSTEINDHKEKNTYDT

SEQ ID NO: 3232170 - protein, 12 aa, Plasmodium falciparum
KSYITPQNTRNT

SEQ ID NO: 3232171 - protein, 7 aa, Plasmodium falciparum
KSYKNEF

SEQ ID NO: 3232172 - protein, 10 aa, Plasmodium falciparum
KSYKNRENHN

SEQ ID NO: 3232173 - protein, 9 aa, Plasmodium falciparum
KSYKSQEKN

SEQ ID NO: 3232174 - protein, 6 aa, Plasmodium falciparum
KSYNDD

SEQ ID NO: 3232175 - protein, 9 aa, Plasmodium falciparum
KSYNDNNNN

SEQ ID NO: 3232176 - protein, 28 aa, Plasmodium falciparum
KSYNEDINEQKKMSKNGKKSKKGKTSVL

SEQ ID NO: 3232177 - protein, 8 aa, Plasmodium falciparum
KSYNEKRS

SEQ ID NO: 3232178 - protein, 5 aa, Plasmodium falciparum
KSYNK

SEQ ID NO: 3232179 - protein, 15 aa, Plasmodium falciparum
KSYNNSYKNEGNDDS

SEQ ID NO: 3232180 - protein, 6 aa, Plasmodium falciparum
KSYNTL

SEQ ID NO: 3232181 - protein, 5 aa, Plasmodium falciparum
KSYPY

SEQ ID NO: 3232182 - protein, 9 aa, Plasmodium falciparum
KSYRNENNI

SEQ ID NO: 3232183 - protein, 14 aa, Plasmodium falciparum
KSYSNSNNNNNNNI

SEQ ID NO: 3232184 - protein, 6 aa, Plasmodium falciparum
KSYYDP

SEQ ID NO: 3232185 - protein, 10 aa, Plasmodium falciparum
KTAEATSTSA

SEQ ID NO: 3232186 - protein, 4 aa, Plasmodium falciparum
KTAK

SEQ ID NO: 3232187 - protein, 10 aa, Plasmodium falciparum
KTAKKYPGDL

SEQ ID NO: 3232188 - protein, 10 aa, Plasmodium falciparum
KTANSGTSRI

SEQ ID NO: 3232189 - protein, 9 aa, Plasmodium falciparum
KTARETKSD

SEQ ID NO: 3232190 - protein, 6 aa, Plasmodium falciparum
KTASKI

SEQ ID NO: 3232191 - protein, 4 aa, Plasmodium falciparum
KTAT

SEQ ID NO: 3232192 - protein, 6 aa, Plasmodium falciparum
KTATAS

SEQ ID NO: 3232193 - protein, 7 aa, Plasmodium falciparum
KTCEDLN

SEQ ID NO: 3232194 - protein, 18 aa, Plasmodium falciparum
KTCKDKKNKYCDKQNKNV

SEQ ID NO: 3232195 - protein, 6 aa, Plasmodium falciparum
KTCKHK

SEQ ID NO: 3232196 - protein, 6 aa, Plasmodium falciparum
KTCKHS

SEQ ID NO: 3232197 - protein, 17 aa, Plasmodium falciparum
KTCKKNGANFAKGSPDC

SEQ ID NO: 3232198 - protein, 6 aa, Plasmodium falciparum
KTCNGD

SEQ ID NO: 3232199 - protein, 12 aa, Plasmodium falciparum
KTCNHEKNGYTN

SEQ ID NO: 3232200 - protein, 7 aa, Plasmodium falciparum
KTCNKNE

SEQ ID NO: 3232201 - protein, 4 aa, Plasmodium falciparum
KTCP

SEQ ID NO: 3232202 - protein, 5 aa, Plasmodium falciparum
KTCSP

SEQ ID NO: 3232203 - protein, 14 aa, Plasmodium falciparum
KTCTQKTDDDKNCR

SEQ ID NO: 3232204 - protein, 7 aa, Plasmodium falciparum
KTCTQND

SEQ ID NO: 3232205 - protein, 20 aa, Plasmodium falciparum
KTDAPQPDVKEEEEEKEEEI

SEQ ID NO: 3232206 - protein, 6 aa, Plasmodium falciparum
KTDDSI

SEQ ID NO: 3232207 - protein, 8 aa, Plasmodium falciparum
KTDEKEYQ

SEQ ID NO: 3232208 - protein, 9 aa, Plasmodium falciparum
KTDFNQGKD

SEQ ID NO: 3232209 - protein, 12 aa, Plasmodium falciparum
KTDHSNNTYYNE

SEQ ID NO: 3232210 - protein, 9 aa, Plasmodium falciparum
KTDINSDEY

SEQ ID NO: 3232211 - protein, 8 aa, Plasmodium falciparum
KTDIYGRP

SEQ ID NO: 3232212 - protein, 4 aa, Plasmodium falciparum
KTDK

SEQ ID NO: 3232213 - protein, 7 aa, Plasmodium falciparum
KTDKIEN

SEQ ID NO: 3232214 - protein, 9 aa, Plasmodium falciparum
KTDLESGTY

SEQ ID NO: 3232215 - protein, 5 aa, Plasmodium falciparum
KTDLS

SEQ ID NO: 3232216 - protein, 12 aa, Plasmodium falciparum
KTDMDDNMNNKK

SEQ ID NO: 3232217 - protein, 22 aa, Plasmodium falciparum
KTDNNSDTKLQTQLESGQIPEE

SEQ ID NO: 3232218 - protein, 5 aa, Plasmodium falciparum
KTDPI

SEQ ID NO: 3232219 - protein, 9 aa, Plasmodium falciparum
KTDPLDNSE

SEQ ID NO: 3232220 - protein, 15 aa, Plasmodium falciparum
KTDPNLPGAKQKTPL

SEQ ID NO: 3232221 - protein, 7 aa, Plasmodium falciparum
KTDQCSN

SEQ ID NO: 3232222 - protein, 6 aa, Plasmodium falciparum
KTDQNN

SEQ ID NO: 3232223 - protein, 12 aa, Plasmodium falciparum
KTDQVKRKSNQI

SEQ ID NO: 3232224 - protein, 5 aa, Plasmodium falciparum
KTDSE

SEQ ID NO: 3232225 - protein, 10 aa, Plasmodium falciparum
KTDTSNEDVH

SEQ ID NO: 3232226 - protein, 10 aa, Plasmodium falciparum
KTDTVTKTTS

SEQ ID NO: 3232227 - protein, 4 aa, Plasmodium falciparum
KTEC

SEQ ID NO: 3232228 - protein, 7 aa, Plasmodium falciparum
KTEDDES

SEQ ID NO: 3232229 - protein, 5 aa, Plasmodium falciparum
KTEDL

SEQ ID NO: 3232230 - protein, 8 aa, Plasmodium falciparum
KTEDMSKN

SEQ ID NO: 3232231 - protein, 5 aa, Plasmodium falciparum
KTEED

SEQ ID NO: 3232232 - protein, 9 aa, Plasmodium falciparum
KTEEKNNTN

SEQ ID NO: 3232233 - protein, 9 aa, Plasmodium falciparum
KTEENGEEK

SEQ ID NO: 3232234 - protein, 11 aa, Plasmodium falciparum
KTEENNRIPPK

SEQ ID NO: 3232235 - protein, 15 aa, Plasmodium falciparum
KTEEPSDYLYLTRNI

SEQ ID NO: 3232236 - protein, 31 aa, Plasmodium falciparum
KTEESVPNKITPMKKDKSDITNEVKEEKDDD

SEQ ID NO: 3232237 - protein, 7 aa, Plasmodium falciparum
KTEETQN

SEQ ID NO: 3232238 - protein, 13 aa, Plasmodium falciparum
KTEGKKKKNALQN

SEQ ID NO: 3232239 - protein, 43 aa, Plasmodium falciparum
KTEGWKDEKDISNNKENCKHKEYNKDDINNKNNVPLNNNNNQH

SEQ ID NO: 3232240 - protein, 31 aa, Plasmodium falciparum
KTEGYDDDAEGEGEEEPEKENEKEKEESHKF

SEQ ID NO: 3232241 - protein, 4 aa, Plasmodium falciparum
KTEK

SEQ ID NO: 3232242 - protein, 9 aa, Plasmodium falciparum
KTEKSSNDI

SEQ ID NO: 3232243 - protein, 22 aa, Plasmodium falciparum
KTEKVNESELDSSKKKIPQDDE

SEQ ID NO: 3232244 - protein, 14 aa, Plasmodium falciparum
KTEKVVQEETKEEN

SEQ ID NO: 3232245 - protein, 5 aa, Plasmodium falciparum
KTELN

SEQ ID NO: 3232246 - protein, 12 aa, Plasmodium falciparum
KTENNNNDIKTN

SEQ ID NO: 3232247 - protein, 7 aa, Plasmodium falciparum
KTENNTK

SEQ ID NO: 3232248 - protein, 14 aa, Plasmodium falciparum
KTENTTNGSLNNEK

SEQ ID NO: 3232249 - protein, 5 aa, Plasmodium falciparum
KTENY

SEQ ID NO: 3232250 - protein, 8 aa, Plasmodium falciparum
KTEPCESQ

SEQ ID NO: 3232251 - protein, 8 aa, Plasmodium falciparum
KTEQSEEL

SEQ ID NO: 3232252 - protein, 6 aa, Plasmodium falciparum
KTESKR

SEQ ID NO: 3232253 - protein, 5 aa, Plasmodium falciparum
KTESN

SEQ ID NO: 3232254 - protein, 8 aa, Plasmodium falciparum
KTESSTSD

SEQ ID NO: 3232255 - protein, 29 aa, Plasmodium falciparum
KTETLSNEKKINDKNEVCDKENKTNGDKN

SEQ ID NO: 3232256 - protein, 4 aa, Plasmodium falciparum
KTEW

SEQ ID NO: 3232257 - protein, 5 aa, Plasmodium falciparum
KTEWT

SEQ ID NO: 3232258 - protein, 6 aa, Plasmodium falciparum
KTEWTE

SEQ ID NO: 3232259 - protein, 4 aa, Plasmodium falciparum
KTFL

SEQ ID NO: 3232260 - protein, 14 aa, Plasmodium falciparum
KTFNQKNSKMNDEY

SEQ ID NO: 3232261 - protein, 13 aa, Plasmodium falciparum
KTFSYNQKDNYQE

SEQ ID NO: 3232262 - protein, 5 aa, Plasmodium falciparum
KTGEL

SEQ ID NO: 3232263 - protein, 6 aa, Plasmodium falciparum
KTGENN

SEQ ID NO: 3232264 - protein, 9 aa, Plasmodium falciparum
KTGEVTTTY

SEQ ID NO: 3232265 - protein, 8 aa, Plasmodium falciparum
KTGKYQSP

SEQ ID NO: 3232266 - protein, 29 aa, Plasmodium falciparum
KTGNNKDENNSGMGKKEKNNTLDEEYEPT

SEQ ID NO: 3232267 - protein, 4 aa, Plasmodium falciparum
KTGQ

SEQ ID NO: 3232268 - protein, 5 aa, Plasmodium falciparum
KTGQK

SEQ ID NO: 3232269 - protein, 6 aa, Plasmodium falciparum
KTGRGI

SEQ ID NO: 3232270 - protein, 7 aa, Plasmodium falciparum
KTGSSIP

SEQ ID NO: 3232271 - protein, 20 aa, Plasmodium falciparum
KTGTGSAKDEMADKENKIKE

SEQ ID NO: 3232272 - protein, 20 aa, Plasmodium falciparum
KTGTGSAKDEMADKESKIKE

SEQ ID NO: 3232273 - protein, 5 aa, Plasmodium falciparum
KTGTL

SEQ ID NO: 3232274 - protein, 8 aa, Plasmodium falciparum
KTGTLTEG

SEQ ID NO: 3232275 - protein, 9 aa, Plasmodium falciparum
KTGTLTTNQ

SEQ ID NO: 3232276 - protein, 7 aa, Plasmodium falciparum
KTGTRDE

SEQ ID NO: 3232277 - protein, 7 aa, Plasmodium falciparum
KTGYEYE

SEQ ID NO: 3232278 - protein, 5 aa, Plasmodium falciparum
KTGYN

SEQ ID NO: 3232279 - protein, 8 aa, Plasmodium falciparum
KTHAHKRR

SEQ ID NO: 3232280 - protein, 7 aa, Plasmodium falciparum
KTHAKSP

SEQ ID NO: 3232281 - protein, 7 aa, Plasmodium falciparum
KTHDTLQ

SEQ ID NO: 3232282 - protein, 6 aa, Plasmodium falciparum
KTHEHN

SEQ ID NO: 3232283 - protein, 13 aa, Plasmodium falciparum
KTHGNKAEDEKNE

SEQ ID NO: 3232284 - protein, 5 aa, Plasmodium falciparum
KTHIS

SEQ ID NO: 3232285 - protein, 6 aa, Plasmodium falciparum
KTHNKD

SEQ ID NO: 3232286 - protein, 6 aa, Plasmodium falciparum
KTHNRD

SEQ ID NO: 3232287 - protein, 20 aa, Plasmodium falciparum
KTIAEKTAKMATENVTKGAI

SEQ ID NO: 3232288 - protein, 18 aa, Plasmodium falciparum
KTIATKKIPNQVTKSNTH

SEQ ID NO: 3232289 - protein, 22 aa, Plasmodium falciparum
KTIDNSKTSEVVEEKKTEDVDS

SEQ ID NO: 3232290 - protein, 10 aa, Plasmodium falciparum
KTIDNSTNNH

SEQ ID NO: 3232291 - protein, 13 aa, Plasmodium falciparum
KTIEENQNNELEG

SEQ ID NO: 3232292 - protein, 12 aa, Plasmodium falciparum
KTIEKEKKKNDI

SEQ ID NO: 3232293 - protein, 5 aa, Plasmodium falciparum
KTIEN

SEQ ID NO: 3232294 - protein, 14 aa, Plasmodium falciparum
KTIENKIKKSKTDN

SEQ ID NO: 3232295 - protein, 6 aa, Plasmodium falciparum
KTIGES

SEQ ID NO: 3232296 - protein, 6 aa, Plasmodium falciparum
KTIHYG

SEQ ID NO: 3232297 - protein, 14 aa, Plasmodium falciparum
KTIKEKYPISDVWD

SEQ ID NO: 3232298 - protein, 60 aa, Plasmodium falciparum
KTIKKNGKSKKIKEITTSSLSSYSSSYSSNSMYNKDDELKNKKNNENNKNKKKNKRSKHK

SEQ ID NO: 3232299 - protein, 10 aa, Plasmodium falciparum
KTINKNKERP

SEQ ID NO: 3232300 - protein, 23 aa, Plasmodium falciparum
KTINTNGASNHNINDKDDDTSNN

SEQ ID NO: 3232301 - protein, 4 aa, Plasmodium falciparum
KTIQ

SEQ ID NO: 3232302 - protein, 5 aa, Plasmodium falciparum
KTIRG

SEQ ID NO: 3232303 - protein, 10 aa, Plasmodium falciparum
KTISTNKHTC

SEQ ID NO: 3232304 - protein, 4 aa, Plasmodium falciparum
KTIY

SEQ ID NO: 3232305 - protein, 10 aa, Plasmodium falciparum
KTKDKKTENV

SEQ ID NO: 3232306 - protein, 6 aa, Plasmodium falciparum
KTKDNF

SEQ ID NO: 3232307 - protein, 6 aa, Plasmodium falciparum
KTKEDV

SEQ ID NO: 3232308 - protein, 7 aa, Plasmodium falciparum
KTKEEKE

SEQ ID NO: 3232309 - protein, 18 aa, Plasmodium falciparum
KTKEEKKNKDDNDDINYD

SEQ ID NO: 3232310 - protein, 5 aa, Plasmodium falciparum
KTKEF

SEQ ID NO: 3232311 - protein, 8 aa, Plasmodium falciparum
KTKEFKNE

SEQ ID NO: 3232312 - protein, 8 aa, Plasmodium falciparum
KTKEKEKI

SEQ ID NO: 3232313 - protein, 8 aa, Plasmodium falciparum
KTKEKEWE

SEQ ID NO: 3232314 - protein, 9 aa, Plasmodium falciparum
KTKEKHSNS

SEQ ID NO: 3232315 - protein, 16 aa, Plasmodium falciparum
KTKEKKKEEKEKNKEF

SEQ ID NO: 3232316 - protein, 7 aa, Plasmodium falciparum
KTKEPAK

SEQ ID NO: 3232317 - protein, 10 aa, Plasmodium falciparum
KTKEQQKKDI

SEQ ID NO: 3232318 - protein, 5 aa, Plasmodium falciparum
KTKER

SEQ ID NO: 3232319 - protein, 8 aa, Plasmodium falciparum
KTKESSEK

SEQ ID NO: 3232320 - protein, 16 aa, Plasmodium falciparum
KTKGNQWENKSKNDQC

SEQ ID NO: 3232321 - protein, 6 aa, Plasmodium falciparum
KTKHGS

SEQ ID NO: 3232322 - protein, 7 aa, Plasmodium falciparum
KTKIKAD

SEQ ID NO: 3232323 - protein, 12 aa, Plasmodium falciparum
KTKIQKENKRKW

SEQ ID NO: 3232324 - protein, 4 aa, Plasmodium falciparum
KTKK

SEQ ID NO: 3232325 - protein, 5 aa, Plasmodium falciparum
KTKKG

SEQ ID NO: 3232326 - protein, 17 aa, Plasmodium falciparum
KTKKIKNKIQDKNDKMN

SEQ ID NO: 3232327 - protein, 8 aa, Plasmodium falciparum
KTKKKKEP

SEQ ID NO: 3232328 - protein, 11 aa, Plasmodium falciparum
KTKKKKQKKKL

SEQ ID NO: 3232329 - protein, 9 aa, Plasmodium falciparum
KTKKKKYPF

SEQ ID NO: 3232330 - protein, 6 aa, Plasmodium falciparum
KTKKKN

SEQ ID NO: 3232331 - protein, 13 aa, Plasmodium falciparum
KTKKNKDKHRKEK

SEQ ID NO: 3232332 - protein, 9 aa, Plasmodium falciparum
KTKKSHDNK

SEQ ID NO: 3232333 - protein, 6 aa, Plasmodium falciparum
KTKLDK

SEQ ID NO: 3232334 - protein, 9 aa, Plasmodium falciparum
KTKLREKEY

SEQ ID NO: 3232335 - protein, 13 aa, Plasmodium falciparum
KTKLTEAGGIVKL

SEQ ID NO: 3232336 - protein, 27 aa, Plasmodium falciparum
KTKNADDDKGDKDKDKDNTDEGDEGDD

SEQ ID NO: 3232337 - protein, 6 aa, Plasmodium falciparum
KTKNDN

SEQ ID NO: 3232338 - protein, 15 aa, Plasmodium falciparum
KTKNDVKDKKKIKNK

SEQ ID NO: 3232339 - protein, 13 aa, Plasmodium falciparum
KTKNEKDKINTQL

SEQ ID NO: 3232340 - protein, 5 aa, Plasmodium falciparum
KTKNF

SEQ ID NO: 3232341 - protein, 8 aa, Plasmodium falciparum
KTKNGRSD

SEQ ID NO: 3232342 - protein, 7 aa, Plasmodium falciparum
KTKNKGY

SEQ ID NO: 3232343 - protein, 10 aa, Plasmodium falciparum
KTKNKKNSFM

SEQ ID NO: 3232344 - protein, 11 aa, Plasmodium falciparum
KTKNKNNRTGI

SEQ ID NO: 3232345 - protein, 9 aa, Plasmodium falciparum
KTKNKNSIE

SEQ ID NO: 3232346 - protein, 5 aa, Plasmodium falciparum
KTKPK

SEQ ID NO: 3232347 - protein, 7 aa, Plasmodium falciparum
KTKRHRK

SEQ ID NO: 3232348 - protein, 14 aa, Plasmodium falciparum
KTKRKRSSKRNNSS

SEQ ID NO: 3232349 - protein, 6 aa, Plasmodium falciparum
KTKRKY

SEQ ID NO: 3232350 - protein, 7 aa, Plasmodium falciparum
KTKSSND

SEQ ID NO: 3232351 - protein, 5 aa, Plasmodium falciparum
KTKSY

SEQ ID NO: 3232352 - protein, 31 aa, Plasmodium falciparum
KTKSYKKQKKRNKKKNKNKNKKKKKNSSDDY

SEQ ID NO: 3232353 - protein, 13 aa, Plasmodium falciparum
KTKTFGPSENCKP

SEQ ID NO: 3232354 - protein, 8 aa, Plasmodium falciparum
KTKVPNPL

SEQ ID NO: 3232355 - protein, 5 aa, Plasmodium falciparum
KTKYV

SEQ ID NO: 3232356 - protein, 16 aa, Plasmodium falciparum
KTLDDSNDGELKEQNM

SEQ ID NO: 3232357 - protein, 12 aa, Plasmodium falciparum
KTLENNNNNNMN

SEQ ID NO: 3232358 - protein, 10 aa, Plasmodium falciparum
KTLKNDEGIP

SEQ ID NO: 3232359 - protein, 38 aa, Plasmodium falciparum
KTLNDQDDEEDEEYEAPPPPTPPRTQKNPCVNGQNQKV

SEQ ID NO: 3232360 - protein, 26 aa, Plasmodium falciparum
KTLNGDNNQESGSSPSLSGKKTTPKD

SEQ ID NO: 3232361 - protein, 27 aa, Plasmodium falciparum
KTLPEPTDDPQTDSDTHDTPDIPPGDV

SEQ ID NO: 3232362 - protein, 6 aa, Plasmodium falciparum
KTLPQE

SEQ ID NO: 3232363 - protein, 7 aa, Plasmodium falciparum
KTLQNNN

SEQ ID NO: 3232364 - protein, 15 aa, Plasmodium falciparum
KTLQQKKKKKSVNLN

SEQ ID NO: 3232365 - protein, 7 aa, Plasmodium falciparum
KTLSDSR

SEQ ID NO: 3232366 - protein, 27 aa, Plasmodium falciparum
KTLSSRAPSKHVDDYEASNVAQNNNSF

SEQ ID NO: 3232367 - protein, 6 aa, Plasmodium falciparum
KTLTRE

SEQ ID NO: 3232368 - protein, 4 aa, Plasmodium falciparum
KTMI

SEQ ID NO: 3232369 - protein, 6 aa, Plasmodium falciparum
KTNAIK

SEQ ID NO: 3232370 - protein, 10 aa, Plasmodium falciparum
KTNAQNKDDQ

SEQ ID NO: 3232371 - protein, 17 aa, Plasmodium falciparum
KTNCRDEKEKYCSGNGY

SEQ ID NO: 3232372 - protein, 15 aa, Plasmodium falciparum
KTNCRGENGTDRYCS

SEQ ID NO: 3232373 - protein, 22 aa, Plasmodium falciparum
KTNDDEKKKTCYPDKNEKKTYS

SEQ ID NO: 3232374 - protein, 14 aa, Plasmodium falciparum
KTNDDNDHNNQNNN

SEQ ID NO: 3232375 - protein, 7 aa, Plasmodium falciparum
KTNDDYI

SEQ ID NO: 3232376 - protein, 6 aa, Plasmodium falciparum
KTNDKQ

SEQ ID NO: 3232377 - protein, 6 aa, Plasmodium falciparum
KTNEDA

SEQ ID NO: 3232378 - protein, 8 aa, Plasmodium falciparum
KTNEDVPT

SEQ ID NO: 3232379 - protein, 10 aa, Plasmodium falciparum
KTNEKNHKVT

SEQ ID NO: 3232380 - protein, 6 aa, Plasmodium falciparum
KTNENS

SEQ ID NO: 3232381 - protein, 15 aa, Plasmodium falciparum
KTNEQKVTKNITKES

SEQ ID NO: 3232382 - protein, 12 aa, Plasmodium falciparum
KTNERKETKKKK

SEQ ID NO: 3232383 - protein, 5 aa, Plasmodium falciparum
KTNEY

SEQ ID NO: 3232384 - protein, 4 aa, Plasmodium falciparum
KTNF

SEQ ID NO: 3232385 - protein, 5 aa, Plasmodium falciparum
KTNFK

SEQ ID NO: 3232386 - protein, 18 aa, Plasmodium falciparum
KTNHLEKKDNNDHSNDNI

SEQ ID NO: 3232387 - protein, 7 aa, Plasmodium falciparum
KTNINES

SEQ ID NO: 3232388 - protein, 5 aa, Plasmodium falciparum
KTNIT

SEQ ID NO: 3232389 - protein, 4 aa, Plasmodium falciparum
KTNK

SEQ ID NO: 3232390 - protein, 6 aa, Plasmodium falciparum
KTNKDK

SEQ ID NO: 3232391 - protein, 6 aa, Plasmodium falciparum
KTNKIE

SEQ ID NO: 3232392 - protein, 8 aa, Plasmodium falciparum
KTNKIKAD

SEQ ID NO: 3232393 - protein, 7 aa, Plasmodium falciparum
KTNKKEI

SEQ ID NO: 3232394 - protein, 21 aa, Plasmodium falciparum
KTNKKKKTKKKKKKKKKKNIF

SEQ ID NO: 3232395 - protein, 8 aa, Plasmodium falciparum
KTNKNEYA

SEQ ID NO: 3232396 - protein, 8 aa, Plasmodium falciparum
KTNKNKDI

SEQ ID NO: 3232397 - protein, 6 aa, Plasmodium falciparum
KTNKSN

SEQ ID NO: 3232398 - protein, 15 aa, Plasmodium falciparum
KTNKTKFDNNKNDYK

SEQ ID NO: 3232399 - protein, 7 aa, Plasmodium falciparum
KTNLNST

SEQ ID NO: 3232400 - protein, 6 aa, Plasmodium falciparum
KTNNKK

SEQ ID NO: 3232401 - protein, 5 aa, Plasmodium falciparum
KTNNN

SEQ ID NO: 3232402 - protein, 6 aa, Plasmodium falciparum
KTNNNM

SEQ ID NO: 3232403 - protein, 6 aa, Plasmodium falciparum
KTNNNN

SEQ ID NO: 3232404 - protein, 30 aa, Plasmodium falciparum
KTNNNNNNDIYNNNNNNNNNNNDDDIYNNN

SEQ ID NO: 3232405 - protein, 7 aa, Plasmodium falciparum
KTNNQLK

SEQ ID NO: 3232406 - protein, 8 aa, Plasmodium falciparum
KTNNSDIK

SEQ ID NO: 3232407 - protein, 10 aa, Plasmodium falciparum
KTNNSNDVQA

SEQ ID NO: 3232408 - protein, 7 aa, Plasmodium falciparum
KTNNSTS

SEQ ID NO: 3232409 - protein, 8 aa, Plasmodium falciparum
KTNNTYTI

SEQ ID NO: 3232410 - protein, 8 aa, Plasmodium falciparum
KTNNVSES

SEQ ID NO: 3232411 - protein, 6 aa, Plasmodium falciparum
KTNPKG

SEQ ID NO: 3232412 - protein, 6 aa, Plasmodium falciparum
KTNPKL

SEQ ID NO: 3232413 - protein, 23 aa, Plasmodium falciparum
KTNQSISKNSQTNNKSSTNLSSI

SEQ ID NO: 3232414 - protein, 8 aa, Plasmodium falciparum
KTNQSSSS

SEQ ID NO: 3232415 - protein, 13 aa, Plasmodium falciparum
KTNRTTKDDTYNN

SEQ ID NO: 3232416 - protein, 7 aa, Plasmodium falciparum
KTNSCGK

SEQ ID NO: 3232417 - protein, 15 aa, Plasmodium falciparum
KTNSNNKKKTNDNFD

SEQ ID NO: 3232418 - protein, 19 aa, Plasmodium falciparum
KTNSTNKRKNKSKNDQNLK

SEQ ID NO: 3232419 - protein, 5 aa, Plasmodium falciparum
KTNTF

SEQ ID NO: 3232420 - protein, 12 aa, Plasmodium falciparum
KTNTHKNDNQLV

SEQ ID NO: 3232421 - protein, 10 aa, Plasmodium falciparum
KTNTHVNDDV

SEQ ID NO: 3232422 - protein, 8 aa, Plasmodium falciparum
KTNTPTEN

SEQ ID NO: 3232423 - protein, 6 aa, Plasmodium falciparum
KTNTTE

SEQ ID NO: 3232424 - protein, 6 aa, Plasmodium falciparum
KTNVLS

SEQ ID NO: 3232425 - protein, 12 aa, Plasmodium falciparum
KTNVNNNNNNNI

SEQ ID NO: 3232426 - protein, 11 aa, Plasmodium falciparum
KTNVQDNNENK

SEQ ID NO: 3232427 - protein, 7 aa, Plasmodium falciparum
KTNVQQS

SEQ ID NO: 3232428 - protein, 11 aa, Plasmodium falciparum
KTNVSNDISED

SEQ ID NO: 3232429 - protein, 4 aa, Plasmodium falciparum
KTNY

SEQ ID NO: 3232430 - protein, 7 aa, Plasmodium falciparum
KTNYEEK

SEQ ID NO: 3232431 - protein, 6 aa, Plasmodium falciparum
KTNYGS

SEQ ID NO: 3232432 - protein, 11 aa, Plasmodium falciparum
KTNYLGSSNDN

SEQ ID NO: 3232433 - protein, 14 aa, Plasmodium falciparum
KTNYNDKEKNKSCN

SEQ ID NO: 3232434 - protein, 13 aa, Plasmodium falciparum
KTNYTKNKKNINN

SEQ ID NO: 3232435 - protein, 6 aa, Plasmodium falciparum
KTPCNV

SEQ ID NO: 3232436 - protein, 6 aa, Plasmodium falciparum
KTPDEH

SEQ ID NO: 3232437 - protein, 4 aa, Plasmodium falciparum
KTPF

SEQ ID NO: 3232438 - protein, 28 aa, Plasmodium falciparum
KTPGDKRGNYEKKHNAAQETKNDHLKKE

SEQ ID NO: 3232439 - protein, 5 aa, Plasmodium falciparum
KTPHI

SEQ ID NO: 3232440 - protein, 14 aa, Plasmodium falciparum
KTPHNKKKHTKVGM

SEQ ID NO: 3232441 - protein, 42 aa, Plasmodium falciparum
KTPKVSAPAGGKKSKNARDSTEPKHHKEKGKYDRIKKTSEQI

SEQ ID NO: 3232442 - protein, 5 aa, Plasmodium falciparum
KTPLN

SEQ ID NO: 3232443 - protein, 6 aa, Plasmodium falciparum
KTPMEY

SEQ ID NO: 3232444 - protein, 5 aa, Plasmodium falciparum
KTPNA

SEQ ID NO: 3232445 - protein, 7 aa, Plasmodium falciparum
KTPNSKI

SEQ ID NO: 3232446 - protein, 65 aa, Plasmodium falciparum
KTPPKQEEGEEKCEPAQTAPKKPAADSERQTPEEKLPPPPAAKEEKPPKQNAEKTKPKRSPRPID

SEQ ID NO: 3232447 - protein, 6 aa, Plasmodium falciparum
KTPSKN

SEQ ID NO: 3232448 - protein, 6 aa, Plasmodium falciparum
KTPTNI

SEQ ID NO: 3232449 - protein, 4 aa, Plasmodium falciparum
KTPV

SEQ ID NO: 3232450 - protein, 6 aa, Plasmodium falciparum
KTPVSK

SEQ ID NO: 3232451 - protein, 6 aa, Plasmodium falciparum
KTQAPV

SEQ ID NO: 3232452 - protein, 18 aa, Plasmodium falciparum
KTQEGLDNEGENGIPEST

SEQ ID NO: 3232453 - protein, 7 aa, Plasmodium falciparum
KTQEREN

SEQ ID NO: 3232454 - protein, 5 aa, Plasmodium falciparum
KTQIY

SEQ ID NO: 3232455 - protein, 6 aa, Plasmodium falciparum
KTQKDE

SEQ ID NO: 3232456 - protein, 8 aa, Plasmodium falciparum
KTQKKGIT

SEQ ID NO: 3232457 - protein, 27 aa, Plasmodium falciparum
KTQKNNLQYDNNNNNNNNIGRKNSSLN

SEQ ID NO: 3232458 - protein, 16 aa, Plasmodium falciparum
KTQKNTNDEKKKKNNN

SEQ ID NO: 3232459 - protein, 7 aa, Plasmodium falciparum
KTQKRKK

SEQ ID NO: 3232460 - protein, 6 aa, Plasmodium falciparum
KTQMRN

SEQ ID NO: 3232461 - protein, 9 aa, Plasmodium falciparum
KTQNESDKK

SEQ ID NO: 3232462 - protein, 38 aa, Plasmodium falciparum
KTQNEYPVEEHTSNEVEKNKKDIDSTNKTKYPSNRNYY

SEQ ID NO: 3232463 - protein, 7 aa, Plasmodium falciparum
KTQNGGG

SEQ ID NO: 3232464 - protein, 13 aa, Plasmodium falciparum
KTQNGTGDSNIDS

SEQ ID NO: 3232465 - protein, 22 aa, Plasmodium falciparum
KTQNGTGGGGGGSGGNSEKKEL

SEQ ID NO: 3232466 - protein, 8 aa, Plasmodium falciparum
KTQNKRQH

SEQ ID NO: 3232467 - protein, 9 aa, Plasmodium falciparum
KTQNNSTAQ

SEQ ID NO: 3232468 - protein, 5 aa, Plasmodium falciparum
KTQNY

SEQ ID NO: 3232469 - protein, 5 aa, Plasmodium falciparum
KTQQI

SEQ ID NO: 3232470 - protein, 10 aa, Plasmodium falciparum
KTQQNQNDAS

SEQ ID NO: 3232471 - protein, 10 aa, Plasmodium falciparum
KTQQQNNNAI

SEQ ID NO: 3232472 - protein, 9 aa, Plasmodium falciparum
KTQRDDSLD

SEQ ID NO: 3232473 - protein, 7 aa, Plasmodium falciparum
KTQRFSK

SEQ ID NO: 3232474 - protein, 13 aa, Plasmodium falciparum
KTQRKKINKYKND

SEQ ID NO: 3232475 - protein, 8 aa, Plasmodium falciparum
KTQSFRNK

SEQ ID NO: 3232476 - protein, 17 aa, Plasmodium falciparum
KTQSTHNLESEEENNHS

SEQ ID NO: 3232477 - protein, 8 aa, Plasmodium falciparum
KTQTPTSS

SEQ ID NO: 3232478 - protein, 6 aa, Plasmodium falciparum
KTQTPV

SEQ ID NO: 3232479 - protein, 10 aa, Plasmodium falciparum
KTQVDDKKRK

SEQ ID NO: 3232480 - protein, 25 aa, Plasmodium falciparum
KTQYEKQEKAYNNQKANVQNNNDNG

SEQ ID NO: 3232481 - protein, 6 aa, Plasmodium falciparum
KTQYEN

SEQ ID NO: 3232482 - protein, 8 aa, Plasmodium falciparum
KTQYPKTR

SEQ ID NO: 3232483 - protein, 5 aa, Plasmodium falciparum
KTREP

SEQ ID NO: 3232484 - protein, 9 aa, Plasmodium falciparum
KTRGKQSMH

SEQ ID NO: 3232485 - protein, 8 aa, Plasmodium falciparum
KTRMSYNK

SEQ ID NO: 3232486 - protein, 4 aa, Plasmodium falciparum
KTRN

SEQ ID NO: 3232487 - protein, 6 aa, Plasmodium falciparum
KTRQHD

SEQ ID NO: 3232488 - protein, 14 aa, Plasmodium falciparum
KTRREKKKEREEIR

SEQ ID NO: 3232489 - protein, 11 aa, Plasmodium falciparum
KTRSETTNGNI

SEQ ID NO: 3232490 - protein, 16 aa, Plasmodium falciparum
KTRSYPKSGHKGHTKL

SEQ ID NO: 3232491 - protein, 5 aa, Plasmodium falciparum
KTSDD

SEQ ID NO: 3232492 - protein, 10 aa, Plasmodium falciparum
KTSDNKERIN

SEQ ID NO: 3232493 - protein, 9 aa, Plasmodium falciparum
KTSEDETKR

SEQ ID NO: 3232494 - protein, 5 aa, Plasmodium falciparum
KTSEE

SEQ ID NO: 3232495 - protein, 8 aa, Plasmodium falciparum
KTSELDSE

SEQ ID NO: 3232496 - protein, 5 aa, Plasmodium falciparum
KTSEN

SEQ ID NO: 3232497 - protein, 8 aa, Plasmodium falciparum
KTSEQFSN

SEQ ID NO: 3232498 - protein, 10 aa, Plasmodium falciparum
KTSIDEKKKK

SEQ ID NO: 3232499 - protein, 7 aa, Plasmodium falciparum
KTSISTK

SEQ ID NO: 3232500 - protein, 8 aa, Plasmodium falciparum
KTSKKQEN

SEQ ID NO: 3232501 - protein, 6 aa, Plasmodium falciparum
KTSNCD

SEQ ID NO: 3232502 - protein, 7 aa, Plasmodium falciparum
KTSNCPK

SEQ ID NO: 3232503 - protein, 25 aa, Plasmodium falciparum
KTSNEKFEEENGSHEEDQKKNIYDD

SEQ ID NO: 3232504 - protein, 28 aa, Plasmodium falciparum
KTSNRNENNRKSKKRRNYDVTKKKETLE

SEQ ID NO: 3232505 - protein, 4 aa, Plasmodium falciparum
KTSP

SEQ ID NO: 3232506 - protein, 4 aa, Plasmodium falciparum
KTSQ

SEQ ID NO: 3232507 - protein, 49 aa, Plasmodium falciparum
KTSRNRDKVKKKKKYTKNETRNNYDESSLSGDKNYQNYQNYQNDQNDQI

SEQ ID NO: 3232508 - protein, 11 aa, Plasmodium falciparum
KTSSEEDTTNI

SEQ ID NO: 3232509 - protein, 7 aa, Plasmodium falciparum
KTSSGKT

SEQ ID NO: 3232510 - protein, 6 aa, Plasmodium falciparum
KTSTNY

SEQ ID NO: 3232511 - protein, 17 aa, Plasmodium falciparum
KTSVEKNKKNYNNYDEH

SEQ ID NO: 3232512 - protein, 4 aa, Plasmodium falciparum
KTSY

SEQ ID NO: 3232513 - protein, 7 aa, Plasmodium falciparum
KTTCKKR

SEQ ID NO: 3232514 - protein, 7 aa, Plasmodium falciparum
KTTDDSY

SEQ ID NO: 3232515 - protein, 8 aa, Plasmodium falciparum
KTTDSKDW

SEQ ID NO: 3232516 - protein, 16 aa, Plasmodium falciparum
KTTDTVTSNVTASEIP

SEQ ID NO: 3232517 - protein, 7 aa, Plasmodium falciparum
KTTEDSK

SEQ ID NO: 3232518 - protein, 5 aa, Plasmodium falciparum
KTTEW

SEQ ID NO: 3232519 - protein, 5 aa, Plasmodium falciparum
KTTFG

SEQ ID NO: 3232520 - protein, 8 aa, Plasmodium falciparum
KTTFSNSS

SEQ ID NO: 3232521 - protein, 7 aa, Plasmodium falciparum
KTTGELD

SEQ ID NO: 3232522 - protein, 7 aa, Plasmodium falciparum
KTTGKNT

SEQ ID NO: 3232523 - protein, 13 aa, Plasmodium falciparum
KTTHDTTSSFNDN

SEQ ID NO: 3232524 - protein, 16 aa, Plasmodium falciparum
KTTITTTTTTKKKKNT

SEQ ID NO: 3232525 - protein, 9 aa, Plasmodium falciparum
KTTKDTSIN

SEQ ID NO: 3232526 - protein, 6 aa, Plasmodium falciparum
KTTKIQ

SEQ ID NO: 3232527 - protein, 10 aa, Plasmodium falciparum
KTTLNEEEFE

SEQ ID NO: 3232528 - protein, 8 aa, Plasmodium falciparum
KTTMTDKA

SEQ ID NO: 3232529 - protein, 5 aa, Plasmodium falciparum
KTTNG

SEQ ID NO: 3232530 - protein, 6 aa, Plasmodium falciparum
KTTNMS

SEQ ID NO: 3232531 - protein, 7 aa, Plasmodium falciparum
KTTNQQA

SEQ ID NO: 3232532 - protein, 6 aa, Plasmodium falciparum
KTTNYT

SEQ ID NO: 3232533 - protein, 9 aa, Plasmodium falciparum
KTTPTPRQQ

SEQ ID NO: 3232534 - protein, 5 aa, Plasmodium falciparum
KTTRE

SEQ ID NO: 3232535 - protein, 13 aa, Plasmodium falciparum
KTTRQKCKEQCDK

SEQ ID NO: 3232536 - protein, 4 aa, Plasmodium falciparum
KTTS

SEQ ID NO: 3232537 - protein, 8 aa, Plasmodium falciparum
KTTSETVT

SEQ ID NO: 3232538 - protein, 7 aa, Plasmodium falciparum
KTTSSAT

SEQ ID NO: 3232539 - protein, 5 aa, Plasmodium falciparum
KTTVN

SEQ ID NO: 3232540 - protein, 5 aa, Plasmodium falciparum
KTTVS

SEQ ID NO: 3232541 - protein, 6 aa, Plasmodium falciparum
KTTYED

SEQ ID NO: 3232542 - protein, 7 aa, Plasmodium falciparum
KTVDASV

SEQ ID NO: 3232543 - protein, 9 aa, Plasmodium falciparum
KTVENQDGK

SEQ ID NO: 3232544 - protein, 9 aa, Plasmodium falciparum
KTVKEEKPV

SEQ ID NO: 3232545 - protein, 13 aa, Plasmodium falciparum
KTVNDVAKAKDKI

SEQ ID NO: 3232546 - protein, 6 aa, Plasmodium falciparum
KTVSPK

SEQ ID NO: 3232547 - protein, 8 aa, Plasmodium falciparum
KTWDENKR

SEQ ID NO: 3232548 - protein, 13 aa, Plasmodium falciparum
KTWRSSSNNFSDT

SEQ ID NO: 3232549 - protein, 5 aa, Plasmodium falciparum
KTYCD

SEQ ID NO: 3232550 - protein, 6 aa, Plasmodium falciparum
KTYCDN

SEQ ID NO: 3232551 - protein, 43 aa, Plasmodium falciparum
KTYDNYQRNNNKNDDDNNNDDDDDDNNNNNNNNNNNNNNNNNI

SEQ ID NO: 3232552 - protein, 7 aa, Plasmodium falciparum
KTYDSKN

SEQ ID NO: 3232553 - protein, 6 aa, Plasmodium falciparum
KTYEPN

SEQ ID NO: 3232554 - protein, 5 aa, Plasmodium falciparum
KTYES

SEQ ID NO: 3232555 - protein, 6 aa, Plasmodium falciparum
KTYIKN

SEQ ID NO: 3232556 - protein, 11 aa, Plasmodium falciparum
KTYKFKKNDKK

SEQ ID NO: 3232557 - protein, 5 aa, Plasmodium falciparum
KTYKS

SEQ ID NO: 3232558 - protein, 6 aa, Plasmodium falciparum
KTYNGD

SEQ ID NO: 3232559 - protein, 6 aa, Plasmodium falciparum
KTYNQD

SEQ ID NO: 3232560 - protein, 10 aa, Plasmodium falciparum
KTYPESNTTD

SEQ ID NO: 3232561 - protein, 10 aa, Plasmodium falciparum
KTYPTPPVNS

SEQ ID NO: 3232562 - protein, 5 aa, Plasmodium falciparum
KTYRG

SEQ ID NO: 3232563 - protein, 6 aa, Plasmodium falciparum
KTYRGQ

SEQ ID NO: 3232564 - protein, 22 aa, Plasmodium falciparum
KTYSNDSRGTPTDGPCEGKGDR

SEQ ID NO: 3232565 - protein, 7 aa, Plasmodium falciparum
KTYSNSV

SEQ ID NO: 3232566 - protein, 4 aa, Plasmodium falciparum
KTYT

SEQ ID NO: 3232567 - protein, 6 aa, Plasmodium falciparum
KTYTNK

SEQ ID NO: 3232568 - protein, 11 aa, Plasmodium falciparum
KVAEQKGGLTT

SEQ ID NO: 3232569 - protein, 12 aa, Plasmodium falciparum
KVANGSTDLSGD

SEQ ID NO: 3232570 - protein, 13 aa, Plasmodium falciparum
KVARSEKSKNGDQ

SEQ ID NO: 3232571 - protein, 13 aa, Plasmodium falciparum
KVASGSSRKTRAA

SEQ ID NO: 3232572 - protein, 8 aa, Plasmodium falciparum
KVDDIKDE

SEQ ID NO: 3232573 - protein, 13 aa, Plasmodium falciparum
KVDEENKPKSCKE

SEQ ID NO: 3232574 - protein, 5 aa, Plasmodium falciparum
KVDEK

SEQ ID NO: 3232575 - protein, 13 aa, Plasmodium falciparum
KVDKRQSTHQTNH

SEQ ID NO: 3232576 - protein, 9 aa, Plasmodium falciparum
KVDKSKNIP

SEQ ID NO: 3232577 - protein, 5 aa, Plasmodium falciparum
KVDLN

SEQ ID NO: 3232578 - protein, 9 aa, Plasmodium falciparum
KVDNPERDD

SEQ ID NO: 3232579 - protein, 7 aa, Plasmodium falciparum
KVDQSNS

SEQ ID NO: 3232580 - protein, 13 aa, Plasmodium falciparum
KVDSNNNKSYDIN

SEQ ID NO: 3232581 - protein, 5 aa, Plasmodium falciparum
KVEDN

SEQ ID NO: 3232582 - protein, 13 aa, Plasmodium falciparum
KVEDYEEDEGKSE

SEQ ID NO: 3232583 - protein, 7 aa, Plasmodium falciparum
KVEDYTE

SEQ ID NO: 3232584 - protein, 5 aa, Plasmodium falciparum
KVEEA

SEQ ID NO: 3232585 - protein, 6 aa, Plasmodium falciparum
KVEEEK

SEQ ID NO: 3232586 - protein, 21 aa, Plasmodium falciparum
KVEENNIHNNNNNNNNNSSIP

SEQ ID NO: 3232587 - protein, 7 aa, Plasmodium falciparum
KVEENNQ

SEQ ID NO: 3232588 - protein, 16 aa, Plasmodium falciparum
KVEESEGVDENRKSSK

SEQ ID NO: 3232589 - protein, 7 aa, Plasmodium falciparum
KVEGEQK

SEQ ID NO: 3232590 - protein, 26 aa, Plasmodium falciparum
KVEGGWKAKEENCSQTKDYDPDKTTT

SEQ ID NO: 3232591 - protein, 10 aa, Plasmodium falciparum
KVEKGGEQIE

SEQ ID NO: 3232592 - protein, 13 aa, Plasmodium falciparum
KVEKSKSKKKSDA

SEQ ID NO: 3232593 - protein, 16 aa, Plasmodium falciparum
KVEKVEKNSDENQCSN

SEQ ID NO: 3232594 - protein, 7 aa, Plasmodium falciparum
KVENEEI

SEQ ID NO: 3232595 - protein, 13 aa, Plasmodium falciparum
KVENGGKKQNPKC

SEQ ID NO: 3232596 - protein, 9 aa, Plasmodium falciparum
KVENKDKSL

SEQ ID NO: 3232597 - protein, 26 aa, Plasmodium falciparum
KVENKNVENEEDNNNLKKTENKNVDK

SEQ ID NO: 3232598 - protein, 5 aa, Plasmodium falciparum
KVERP

SEQ ID NO: 3232599 - protein, 12 aa, Plasmodium falciparum
KVESKVKDSTVE

SEQ ID NO: 3232600 - protein, 5 aa, Plasmodium falciparum
KVETS

SEQ ID NO: 3232601 - protein, 7 aa, Plasmodium falciparum
KVEYGRK

SEQ ID NO: 3232602 - protein, 12 aa, Plasmodium falciparum
KVFSGGKNNELK

SEQ ID NO: 3232603 - protein, 7 aa, Plasmodium falciparum
KVGDVND

SEQ ID NO: 3232604 - protein, 17 aa, Plasmodium falciparum
KVGERKKEKKKVRYSSY

SEQ ID NO: 3232605 - protein, 5 aa, Plasmodium falciparum
KVGEV

SEQ ID NO: 3232606 - protein, 7 aa, Plasmodium falciparum
KVGQKIP

SEQ ID NO: 3232607 - protein, 18 aa, Plasmodium falciparum
KVHDKAKNAALDRSNSDL

SEQ ID NO: 3232608 - protein, 7 aa, Plasmodium falciparum
KVHEQNT

SEQ ID NO: 3232609 - protein, 12 aa, Plasmodium falciparum
KVHSNEDSYNTT

SEQ ID NO: 3232610 - protein, 5 aa, Plasmodium falciparum
KVIAN

SEQ ID NO: 3232611 - protein, 20 aa, Plasmodium falciparum
KVIDNNSMTNQNSLKNNTNE

SEQ ID NO: 3232612 - protein, 15 aa, Plasmodium falciparum
KVIPKKNDQNESFDG

SEQ ID NO: 3232613 - protein, 136 aa, Plasmodium falciparum
KVKDDEKIKDDDKIKDDDKIKNDDKVKNDDKVKNDDKVKNDDKVKNDDKVKNDDKIKNDDKIKNDDKVKNDDKIKNDDKVKNDDKVKNDDKVKNDDKIKNDDKVKNDDKIKNDDKVKNDDKIKNDDNNKKNNIPVG

SEQ ID NO: 3232614 - protein, 6 aa, Plasmodium falciparum
KVKDMN

SEQ ID NO: 3232615 - protein, 5 aa, Plasmodium falciparum
KVKDN

SEQ ID NO: 3232616 - protein, 9 aa, Plasmodium falciparum
KVKEDNDKI

SEQ ID NO: 3232617 - protein, 7 aa, Plasmodium falciparum
KVKEQSN

SEQ ID NO: 3232618 - protein, 4 aa, Plasmodium falciparum
KVKK

SEQ ID NO: 3232619 - protein, 9 aa, Plasmodium falciparum
KVKKESKRL

SEQ ID NO: 3232620 - protein, 11 aa, Plasmodium falciparum
KVKKGSDSENV

SEQ ID NO: 3232621 - protein, 7 aa, Plasmodium falciparum
KVKNDEQ

SEQ ID NO: 3232622 - protein, 20 aa, Plasmodium falciparum
KVKNKEKSTSDKELTNSLPS

SEQ ID NO: 3232623 - protein, 5 aa, Plasmodium falciparum
KVKNL

SEQ ID NO: 3232624 - protein, 11 aa, Plasmodium falciparum
KVKNNNNNNKN

SEQ ID NO: 3232625 - protein, 4 aa, Plasmodium falciparum
KVKR

SEQ ID NO: 3232626 - protein, 4 aa, Plasmodium falciparum
KVKS

SEQ ID NO: 3232627 - protein, 9 aa, Plasmodium falciparum
KVKTADDKD

SEQ ID NO: 3232628 - protein, 4 aa, Plasmodium falciparum
KVLG

SEQ ID NO: 3232629 - protein, 11 aa, Plasmodium falciparum
KVLGKNEHHED

SEQ ID NO: 3232630 - protein, 105 aa, Plasmodium falciparum
KVNDSNNSNDANEGNNANYSNDSSNTNNNTSSSTNNSNNNTSCSSQNTTTSSENNDSLENKRNEEDEDEEDDQKDTQKEKNNLEQEDMSPYEDRNKNDEKNINEQ

SEQ ID NO: 3232631 - protein, 4 aa, Plasmodium falciparum
KVNE

SEQ ID NO: 3232632 - protein, 8 aa, Plasmodium falciparum
KVNEKSHE

SEQ ID NO: 3232633 - protein, 13 aa, Plasmodium falciparum
KVNEREGERTLTK

SEQ ID NO: 3232634 - protein, 7 aa, Plasmodium falciparum
KVNGGFS

SEQ ID NO: 3232635 - protein, 24 aa, Plasmodium falciparum
KVNGQNGKGGKWEPKNEACSQEEE

SEQ ID NO: 3232636 - protein, 12 aa, Plasmodium falciparum
KVNKDKKRNEES

SEQ ID NO: 3232637 - protein, 19 aa, Plasmodium falciparum
KVNKKGKIAEEKKRKNIKN

SEQ ID NO: 3232638 - protein, 9 aa, Plasmodium falciparum
KVNNGTTNF

SEQ ID NO: 3232639 - protein, 9 aa, Plasmodium falciparum
KVNNPYECE

SEQ ID NO: 3232640 - protein, 6 aa, Plasmodium falciparum
KVNPTI

SEQ ID NO: 3232641 - protein, 14 aa, Plasmodium falciparum
KVNQSQNGNPSLED

SEQ ID NO: 3232642 - protein, 11 aa, Plasmodium falciparum
KVNTEKGDKYK

SEQ ID NO: 3232643 - protein, 12 aa, Plasmodium falciparum
KVNTTNNAPNEI

SEQ ID NO: 3232644 - protein, 8 aa, Plasmodium falciparum
KVNTTSDN

SEQ ID NO: 3232645 - protein, 18 aa, Plasmodium falciparum
KVPGKEWEKKNDNCTSGK

SEQ ID NO: 3232646 - protein, 6 aa, Plasmodium falciparum
KVPHEY

SEQ ID NO: 3232647 - protein, 12 aa, Plasmodium falciparum
KVPKNKKNNKIK

SEQ ID NO: 3232648 - protein, 5 aa, Plasmodium falciparum
KVPNP

SEQ ID NO: 3232649 - protein, 6 aa, Plasmodium falciparum
KVPPKE

SEQ ID NO: 3232650 - protein, 7 aa, Plasmodium falciparum
KVPQNGT

SEQ ID NO: 3232651 - protein, 11 aa, Plasmodium falciparum
KVPSKNEDDID

SEQ ID NO: 3232652 - protein, 7 aa, Plasmodium falciparum
KVPTNLS

SEQ ID NO: 3232653 - protein, 7 aa, Plasmodium falciparum
KVQANIN

SEQ ID NO: 3232654 - protein, 5 aa, Plasmodium falciparum
KVQEI

SEQ ID NO: 3232655 - protein, 23 aa, Plasmodium falciparum
KVQGQGEEEDEDEVEEEDDLKSA

SEQ ID NO: 3232656 - protein, 5 aa, Plasmodium falciparum
KVQNS

SEQ ID NO: 3232657 - protein, 81 aa, Plasmodium falciparum
KVQPPKVQQQKVQPPKSQQQKVQPPKSQQQKVQPPKVQQQKVQPPKVQKPKLQNQKGQKQVSPKAKGNNQAKPTKGNKLKK

SEQ ID NO: 3232658 - protein, 22 aa, Plasmodium falciparum
KVREEKTSEKNNENKQSSKNEN

SEQ ID NO: 3232659 - protein, 13 aa, Plasmodium falciparum
KVREIKEKDEIDG

SEQ ID NO: 3232660 - protein, 9 aa, Plasmodium falciparum
KVRNKDTDI

SEQ ID NO: 3232661 - protein, 5 aa, Plasmodium falciparum
KVSAA

SEQ ID NO: 3232662 - protein, 7 aa, Plasmodium falciparum
KVSDSNG

SEQ ID NO: 3232663 - protein, 7 aa, Plasmodium falciparum
KVSEDTN

SEQ ID NO: 3232664 - protein, 5 aa, Plasmodium falciparum
KVSEE

SEQ ID NO: 3232665 - protein, 24 aa, Plasmodium falciparum
KVSKKERAQEKEKGNISEEADNPL

SEQ ID NO: 3232666 - protein, 6 aa, Plasmodium falciparum
KVSNEN

SEQ ID NO: 3232667 - protein, 18 aa, Plasmodium falciparum
KVSPQEIKKNEDKDNINS

SEQ ID NO: 3232668 - protein, 8 aa, Plasmodium falciparum
KVSPSEEV

SEQ ID NO: 3232669 - protein, 11 aa, Plasmodium falciparum
KVSRKRFDSNA

SEQ ID NO: 3232670 - protein, 4 aa, Plasmodium falciparum
KVSS

SEQ ID NO: 3232671 - protein, 5 aa, Plasmodium falciparum
KVSSH

SEQ ID NO: 3232672 - protein, 9 aa, Plasmodium falciparum
KVTDKNTTY

SEQ ID NO: 3232673 - protein, 5 aa, Plasmodium falciparum
KVTFN

SEQ ID NO: 3232674 - protein, 70 aa, Plasmodium falciparum
KVTGKISKKTAQEGACENDVQEGACKNDVQEGSCENDVQEGACKNDVQEGACKNDVQEGACKNNVQEGAC

SEQ ID NO: 3232675 - protein, 4 aa, Plasmodium falciparum
KVTN

SEQ ID NO: 3232676 - protein, 23 aa, Plasmodium falciparum
KVTNQDVQNTNNKKKIDTANENK

SEQ ID NO: 3232677 - protein, 7 aa, Plasmodium falciparum
KVTSTGA

SEQ ID NO: 3232678 - protein, 10 aa, Plasmodium falciparum
KVTTSAGAYS

SEQ ID NO: 3232679 - protein, 7 aa, Plasmodium falciparum
KVTTTRK

SEQ ID NO: 3232680 - protein, 8 aa, Plasmodium falciparum
KVVEEGNK

SEQ ID NO: 3232681 - protein, 20 aa, Plasmodium falciparum
KVVEGGRNKEFEEGKNKQFE

SEQ ID NO: 3232682 - protein, 13 aa, Plasmodium falciparum
KVYDTGSSNNDQI

SEQ ID NO: 3232683 - protein, 5 aa, Plasmodium falciparum
KVYET

SEQ ID NO: 3232684 - protein, 4 aa, Plasmodium falciparum
KVYN

SEQ ID NO: 3232685 - protein, 5 aa, Plasmodium falciparum
KVYSN

SEQ ID NO: 3232686 - protein, 13 aa, Plasmodium falciparum
KWDDNRKDKNTKK

SEQ ID NO: 3232687 - protein, 15 aa, Plasmodium falciparum
KWENDNDGGNVPSGN

SEQ ID NO: 3232688 - protein, 29 aa, Plasmodium falciparum
KWENETHSGDINSGIPSGKLSDTPSDNNI

SEQ ID NO: 3232689 - protein, 22 aa, Plasmodium falciparum
KWENETHSGNIHPSDSNKTLNT

SEQ ID NO: 3232690 - protein, 22 aa, Plasmodium falciparum
KWENETHSGNTHPSDSNKTLNT

SEQ ID NO: 3232691 - protein, 26 aa, Plasmodium falciparum
KWGGGTPTSQANNNTNNHMNTQGGKL

SEQ ID NO: 3232692 - protein, 19 aa, Plasmodium falciparum
KWKGSSNNHNNDLNNNNNN

SEQ ID NO: 3232693 - protein, 9 aa, Plasmodium falciparum
KWKPTTNDD

SEQ ID NO: 3232694 - protein, 8 aa, Plasmodium falciparum
KWKSSNLS

SEQ ID NO: 3232695 - protein, 20 aa, Plasmodium falciparum
KYANDSVKNEGEDKNIERKA

SEQ ID NO: 3232696 - protein, 6 aa, Plasmodium falciparum
KYANEK

SEQ ID NO: 3232697 - protein, 31 aa, Plasmodium falciparum
KYANNTSNNNLQTQNDNKEKIYDGKDEEMNT

SEQ ID NO: 3232698 - protein, 9 aa, Plasmodium falciparum
KYASETKYN

SEQ ID NO: 3232699 - protein, 6 aa, Plasmodium falciparum
KYASQK

SEQ ID NO: 3232700 - protein, 4 aa, Plasmodium falciparum
KYCD

SEQ ID NO: 3232701 - protein, 16 aa, Plasmodium falciparum
KYDDEDEETIPEKKML

SEQ ID NO: 3232702 - protein, 8 aa, Plasmodium falciparum
KYDDNNNG

SEQ ID NO: 3232703 - protein, 5 aa, Plasmodium falciparum
KYDDP

SEQ ID NO: 3232704 - protein, 6 aa, Plasmodium falciparum
KYDEEI

SEQ ID NO: 3232705 - protein, 9 aa, Plasmodium falciparum
KYDEKENLT

SEQ ID NO: 3232706 - protein, 5 aa, Plasmodium falciparum
KYDEN

SEQ ID NO: 3232707 - protein, 16 aa, Plasmodium falciparum
KYDENKNDNDNNEELK

SEQ ID NO: 3232708 - protein, 9 aa, Plasmodium falciparum
KYDERKKKK

SEQ ID NO: 3232709 - protein, 26 aa, Plasmodium falciparum
KYDESKIYDNGKYGKGKKKRKKSKLY

SEQ ID NO: 3232710 - protein, 5 aa, Plasmodium falciparum
KYDEY

SEQ ID NO: 3232711 - protein, 7 aa, Plasmodium falciparum
KYDEYND

SEQ ID NO: 3232712 - protein, 9 aa, Plasmodium falciparum
KYDGINPYP

SEQ ID NO: 3232713 - protein, 71 aa, Plasmodium falciparum
KYDHTNDTTINNNNNKYNDGHGDNNNKYNDGHGDNNNKYNDGHGDNNNKYNDGHGDDNNVDKGTHKNKPIQ

SEQ ID NO: 3232714 - protein, 5 aa, Plasmodium falciparum
KYDKI

SEQ ID NO: 3232715 - protein, 5 aa, Plasmodium falciparum
KYDKK

SEQ ID NO: 3232716 - protein, 8 aa, Plasmodium falciparum
KYDKKDET

SEQ ID NO: 3232717 - protein, 17 aa, Plasmodium falciparum
KYDKQQEITKSKNAITK

SEQ ID NO: 3232718 - protein, 5 aa, Plasmodium falciparum
KYDKY

SEQ ID NO: 3232719 - protein, 11 aa, Plasmodium falciparum
KYDNDQNTTNN

SEQ ID NO: 3232720 - protein, 11 aa, Plasmodium falciparum
KYDNEKINNKR

SEQ ID NO: 3232721 - protein, 9 aa, Plasmodium falciparum
KYDNENNDF

SEQ ID NO: 3232722 - protein, 6 aa, Plasmodium falciparum
KYDNKV

SEQ ID NO: 3232723 - protein, 5 aa, Plasmodium falciparum
KYDNQ

SEQ ID NO: 3232724 - protein, 9 aa, Plasmodium falciparum
KYDNTKAKH

SEQ ID NO: 3232725 - protein, 8 aa, Plasmodium falciparum
KYDNTNDY

SEQ ID NO: 3232726 - protein, 24 aa, Plasmodium falciparum
KYDNVSKNNNNNNNNNGNNPNSQM

SEQ ID NO: 3232727 - protein, 17 aa, Plasmodium falciparum
KYDQNGCNKYEGENDVS

SEQ ID NO: 3232728 - protein, 26 aa, Plasmodium falciparum
KYDRDDNVHRKSSTNMSYDDNQNMEG

SEQ ID NO: 3232729 - protein, 16 aa, Plasmodium falciparum
KYDSNNNKNNDKYDNN

SEQ ID NO: 3232730 - protein, 10 aa, Plasmodium falciparum
KYDTKDGQYV

SEQ ID NO: 3232731 - protein, 16 aa, Plasmodium falciparum
KYDTQTNKENNNIKTN

SEQ ID NO: 3232732 - protein, 4 aa, Plasmodium falciparum
KYDY

SEQ ID NO: 3232733 - protein, 22 aa, Plasmodium falciparum
KYDYYNKRKDKNEKKKKTKKKH

SEQ ID NO: 3232734 - protein, 4 aa, Plasmodium falciparum
KYED

SEQ ID NO: 3232735 - protein, 16 aa, Plasmodium falciparum
KYEDTNMNNNINNNEG

SEQ ID NO: 3232736 - protein, 5 aa, Plasmodium falciparum
KYEDY

SEQ ID NO: 3232737 - protein, 6 aa, Plasmodium falciparum
KYEENT

SEQ ID NO: 3232738 - protein, 5 aa, Plasmodium falciparum
KYEEQ

SEQ ID NO: 3232739 - protein, 19 aa, Plasmodium falciparum
KYEFTNTEETYKNNEKNHN

SEQ ID NO: 3232740 - protein, 5 aa, Plasmodium falciparum
KYEGD

SEQ ID NO: 3232741 - protein, 8 aa, Plasmodium falciparum
KYEGDKNI

SEQ ID NO: 3232742 - protein, 12 aa, Plasmodium falciparum
KYEGDYKSGKKL

SEQ ID NO: 3232743 - protein, 5 aa, Plasmodium falciparum
KYEHK

SEQ ID NO: 3232744 - protein, 7 aa, Plasmodium falciparum
KYEKCTK

SEQ ID NO: 3232745 - protein, 11 aa, Plasmodium falciparum
KYEKEKENYNS

SEQ ID NO: 3232746 - protein, 43 aa, Plasmodium falciparum
KYEKKKEKENKNYDKNKKSSNTNDKSYNITQNDPRKNNQNKEF

SEQ ID NO: 3232747 - protein, 11 aa, Plasmodium falciparum
KYEKKNNTMED

SEQ ID NO: 3232748 - protein, 6 aa, Plasmodium falciparum
KYEKKQ

SEQ ID NO: 3232749 - protein, 19 aa, Plasmodium falciparum
KYEKKSNIDNNEENIKESC

SEQ ID NO: 3232750 - protein, 6 aa, Plasmodium falciparum
KYEKQN

SEQ ID NO: 3232751 - protein, 11 aa, Plasmodium falciparum
KYEKSKKSINI

SEQ ID NO: 3232752 - protein, 64 aa, Plasmodium falciparum
KYEKSKNYEVNNNDRETNDISSKMETQNEPTIKNSNDTNDVKKEDTNITQQGRVNSNSSNINGV

SEQ ID NO: 3232753 - protein, 23 aa, Plasmodium falciparum
KYENGAPRSSGGRAKRAAPSNIN

SEQ ID NO: 3232754 - protein, 24 aa, Plasmodium falciparum
KYENGASSSSRKTRAASTTNYEEY

SEQ ID NO: 3232755 - protein, 6 aa, Plasmodium falciparum
KYENGK

SEQ ID NO: 3232756 - protein, 12 aa, Plasmodium falciparum
KYENKRHNYNDS

SEQ ID NO: 3232757 - protein, 8 aa, Plasmodium falciparum
KYENNDDH

SEQ ID NO: 3232758 - protein, 16 aa, Plasmodium falciparum
KYENNENMEEQNKDDS

SEQ ID NO: 3232759 - protein, 16 aa, Plasmodium falciparum
KYENNKKNKTGSDRLS

SEQ ID NO: 3232760 - protein, 19 aa, Plasmodium falciparum
KYENNNNNNKDKNKDKNKN

SEQ ID NO: 3232761 - protein, 7 aa, Plasmodium falciparum
KYENTLS

SEQ ID NO: 3232762 - protein, 10 aa, Plasmodium falciparum
KYEQDNTNKY

SEQ ID NO: 3232763 - protein, 8 aa, Plasmodium falciparum
KYEQEQYE

SEQ ID NO: 3232764 - protein, 5 aa, Plasmodium falciparum
KYEQS

SEQ ID NO: 3232765 - protein, 47 aa, Plasmodium falciparum
KYERDDTKYESDEKKYKSDEKKLENYDEKENLEKKQKRKNKVNDKKI

SEQ ID NO: 3232766 - protein, 6 aa, Plasmodium falciparum
KYFKQK

SEQ ID NO: 3232767 - protein, 6 aa, Plasmodium falciparum
KYGDEK

SEQ ID NO: 3232768 - protein, 4 aa, Plasmodium falciparum
KYGE

SEQ ID NO: 3232769 - protein, 7 aa, Plasmodium falciparum
KYGEEYK

SEQ ID NO: 3232770 - protein, 5 aa, Plasmodium falciparum
KYGET

SEQ ID NO: 3232771 - protein, 5 aa, Plasmodium falciparum
KYGEY

SEQ ID NO: 3232772 - protein, 14 aa, Plasmodium falciparum
KYGIPTTKSPNKYI

SEQ ID NO: 3232773 - protein, 4 aa, Plasmodium falciparum
KYGK

SEQ ID NO: 3232774 - protein, 282 aa, Plasmodium falciparum
KYGKHGDEKHHSSKKHEGNDGEGEKKKKSKKHKDHDGEKKKSKKHKDNEDAESVKSKKHKSHDCEKKKSKKHKDNEDAESVKSKKSVKEKGEKHNGKKPCSKKTNEENKNKEKTNNSKSDGSKAHEKKENETKNTAGENKKVDSTSADNKSTNAATPGAKDKTQGGKTDKTGASTNAATNKGQCAAEGATKGATKEASTSKEATKEASTSKEATKEASTSKEATKEASTSKGATKEASTTEGATKGASTTAGSTTGATTGANAVQSKDETADKNAANNGEQV

SEQ ID NO: 3232775 - protein, 9 aa, Plasmodium falciparum
KYGKHKNQQ

SEQ ID NO: 3232776 - protein, 5 aa, Plasmodium falciparum
KYGKK

SEQ ID NO: 3232777 - protein, 4 aa, Plasmodium falciparum
KYGN

SEQ ID NO: 3232778 - protein, 10 aa, Plasmodium falciparum
KYGNDKSNEY

SEQ ID NO: 3232779 - protein, 19 aa, Plasmodium falciparum
KYGNNKMGEIKKSNDIRNT

SEQ ID NO: 3232780 - protein, 10 aa, Plasmodium falciparum
KYGPGGKEKF

SEQ ID NO: 3232781 - protein, 10 aa, Plasmodium falciparum
KYGPGGKERF

SEQ ID NO: 3232782 - protein, 10 aa, Plasmodium falciparum
KYGPGGKERY

SEQ ID NO: 3232783 - protein, 9 aa, Plasmodium falciparum
KYGRGGSSK

SEQ ID NO: 3232784 - protein, 36 aa, Plasmodium falciparum
KYGTEISDGGSGSGAAGGGGGRKKRGTSTTNYDGYE

SEQ ID NO: 3232785 - protein, 7 aa, Plasmodium falciparum
KYGYGGA

SEQ ID NO: 3232786 - protein, 5 aa, Plasmodium falciparum
KYGYP

SEQ ID NO: 3232787 - protein, 14 aa, Plasmodium falciparum
KYHNDNTNKKNHSD

SEQ ID NO: 3232788 - protein, 4 aa, Plasmodium falciparum
KYHQ

SEQ ID NO: 3232789 - protein, 30 aa, Plasmodium falciparum
KYHQKNQEKNQNQTKYQSVDTSTTSKEKHE

SEQ ID NO: 3232790 - protein, 20 aa, Plasmodium falciparum
KYHTSSKNFSNNNSNSVTSK

SEQ ID NO: 3232791 - protein, 6 aa, Plasmodium falciparum
KYIEGD

SEQ ID NO: 3232792 - protein, 4 aa, Plasmodium falciparum
KYIK

SEQ ID NO: 3232793 - protein, 13 aa, Plasmodium falciparum
KYINDKNKYHNDN

SEQ ID NO: 3232794 - protein, 13 aa, Plasmodium falciparum
KYIQNEKEKNDED

SEQ ID NO: 3232795 - protein, 23 aa, Plasmodium falciparum
KYITDHKSNNQVKNISDDETYSN

SEQ ID NO: 3232796 - protein, 8 aa, Plasmodium falciparum
KYKDAQKY

SEQ ID NO: 3232797 - protein, 7 aa, Plasmodium falciparum
KYKDEGL

SEQ ID NO: 3232798 - protein, 8 aa, Plasmodium falciparum
KYKDKEAQ

SEQ ID NO: 3232799 - protein, 8 aa, Plasmodium falciparum
KYKDKGLK

SEQ ID NO: 3232800 - protein, 17 aa, Plasmodium falciparum
KYKDQKEKVNENNINSV

SEQ ID NO: 3232801 - protein, 9 aa, Plasmodium falciparum
KYKDSGSTM

SEQ ID NO: 3232802 - protein, 17 aa, Plasmodium falciparum
KYKDTGENKVKDKGKAN

SEQ ID NO: 3232803 - protein, 4 aa, Plasmodium falciparum
KYKG

SEQ ID NO: 3232804 - protein, 11 aa, Plasmodium falciparum
KYKGENNNYNN

SEQ ID NO: 3232805 - protein, 8 aa, Plasmodium falciparum
KYKGPKEV

SEQ ID NO: 3232806 - protein, 10 aa, Plasmodium falciparum
KYKGPNGTNV

SEQ ID NO: 3232807 - protein, 20 aa, Plasmodium falciparum
KYKGRSEKEKINKNKYENES

SEQ ID NO: 3232808 - protein, 15 aa, Plasmodium falciparum
KYKIDNDKKTPNITT

SEQ ID NO: 3232809 - protein, 8 aa, Plasmodium falciparum
KYKKEFNS

SEQ ID NO: 3232810 - protein, 11 aa, Plasmodium falciparum
KYKKKKENIYK

SEQ ID NO: 3232811 - protein, 13 aa, Plasmodium falciparum
KYKKKSNSKLTEK

SEQ ID NO: 3232812 - protein, 8 aa, Plasmodium falciparum
KYKKNYKN

SEQ ID NO: 3232813 - protein, 5 aa, Plasmodium falciparum
KYKLR

SEQ ID NO: 3232814 - protein, 20 aa, Plasmodium falciparum
KYKNGESRSGSDGNKYDGYE

SEQ ID NO: 3232815 - protein, 16 aa, Plasmodium falciparum
KYKNGTKQATNGTTNN

SEQ ID NO: 3232816 - protein, 14 aa, Plasmodium falciparum
KYKNKKRRKYNDNT

SEQ ID NO: 3232817 - protein, 14 aa, Plasmodium falciparum
KYKNNYDCNNNNNN

SEQ ID NO: 3232818 - protein, 8 aa, Plasmodium falciparum
KYKNRSPS

SEQ ID NO: 3232819 - protein, 7 aa, Plasmodium falciparum
KYKNTVD

SEQ ID NO: 3232820 - protein, 7 aa, Plasmodium falciparum
KYKNVED

SEQ ID NO: 3232821 - protein, 5 aa, Plasmodium falciparum
KYKNY

SEQ ID NO: 3232822 - protein, 7 aa, Plasmodium falciparum
KYKPDRS

SEQ ID NO: 3232823 - protein, 7 aa, Plasmodium falciparum
KYKPSTT

SEQ ID NO: 3232824 - protein, 9 aa, Plasmodium falciparum
KYKQEQKKS

SEQ ID NO: 3232825 - protein, 8 aa, Plasmodium falciparum
KYKQTQQS

SEQ ID NO: 3232826 - protein, 6 aa, Plasmodium falciparum
KYKRID

SEQ ID NO: 3232827 - protein, 6 aa, Plasmodium falciparum
KYKRPT

SEQ ID NO: 3232828 - protein, 6 aa, Plasmodium falciparum
KYKRQK

SEQ ID NO: 3232829 - protein, 6 aa, Plasmodium falciparum
KYKSDG

SEQ ID NO: 3232830 - protein, 15 aa, Plasmodium falciparum
KYKSEVKKKKYSSYE

SEQ ID NO: 3232831 - protein, 78 aa, Plasmodium falciparum
KYKSSTSLNNKRGRKGKNKNNNNNKNNDDNNNIDDNKIDDNNNDDNKIDDNNNDDNKIDDNKIDDNKIDDNNYNDEND

SEQ ID NO: 3232832 - protein, 5 aa, Plasmodium falciparum
KYKTA

SEQ ID NO: 3232833 - protein, 26 aa, Plasmodium falciparum
KYKTEISDGGGRQKRDAGGTTKYEGY

SEQ ID NO: 3232834 - protein, 7 aa, Plasmodium falciparum
KYKTNDK

SEQ ID NO: 3232835 - protein, 5 aa, Plasmodium falciparum
KYKYE

SEQ ID NO: 3232836 - protein, 5 aa, Plasmodium falciparum
KYKYG

SEQ ID NO: 3232837 - protein, 5 aa, Plasmodium falciparum
KYNAP

SEQ ID NO: 3232838 - protein, 30 aa, Plasmodium falciparum
KYNDDNKYNDDNKYNDDNYNDDDNKYNDDD

SEQ ID NO: 3232839 - protein, 7 aa, Plasmodium falciparum
KYNDHNN

SEQ ID NO: 3232840 - protein, 6 aa, Plasmodium falciparum
KYNDNA

SEQ ID NO: 3232841 - protein, 6 aa, Plasmodium falciparum
KYNDNK

SEQ ID NO: 3232842 - protein, 12 aa, Plasmodium falciparum
KYNDNNCDNNCD

SEQ ID NO: 3232843 - protein, 8 aa, Plasmodium falciparum
KYNDNNSD

SEQ ID NO: 3232844 - protein, 4 aa, Plasmodium falciparum
KYNE

SEQ ID NO: 3232845 - protein, 10 aa, Plasmodium falciparum
KYNEAKRSTR

SEQ ID NO: 3232846 - protein, 5 aa, Plasmodium falciparum
KYNEL

SEQ ID NO: 3232847 - protein, 9 aa, Plasmodium falciparum
KYNEQSNYK

SEQ ID NO: 3232848 - protein, 126 aa, Plasmodium falciparum
KYNEQSSESISSYESGSENNLTEDEDKSDENKSDESKSDESKSDESKSDESKSDESKSDDSKSDESKSDESKSDESKSDDSKSEECKDENNKINNESDEDSNESYSSKESSSKPSSLDQTSEYSSS

SEQ ID NO: 3232849 - protein, 7 aa, Plasmodium falciparum
KYNESNA

SEQ ID NO: 3232850 - protein, 5 aa, Plasmodium falciparum
KYNET

SEQ ID NO: 3232851 - protein, 10 aa, Plasmodium falciparum
KYNGEKSNIG

SEQ ID NO: 3232852 - protein, 20 aa, Plasmodium falciparum
KYNGSNKNDYVKNNTYDNKG

SEQ ID NO: 3232853 - protein, 5 aa, Plasmodium falciparum
KYNHN

SEQ ID NO: 3232854 - protein, 18 aa, Plasmodium falciparum
KYNKGEEKHDKNNEEEKN

SEQ ID NO: 3232855 - protein, 10 aa, Plasmodium falciparum
KYNKNENKKY

SEQ ID NO: 3232856 - protein, 6 aa, Plasmodium falciparum
KYNKNI

SEQ ID NO: 3232857 - protein, 15 aa, Plasmodium falciparum
KYNKPSEQINNTQGI

SEQ ID NO: 3232858 - protein, 13 aa, Plasmodium falciparum
KYNKRKKKEKDNK

SEQ ID NO: 3232859 - protein, 8 aa, Plasmodium falciparum
KYNKRNNS

SEQ ID NO: 3232860 - protein, 73 aa, Plasmodium falciparum
KYNKSSDDYENDSNSSSNNNNNNNTYSDDDFNSYNRNRRNTQRKSKQMKNERFQKKNKKKNKIDQEDSTMSDE

SEQ ID NO: 3232861 - protein, 6 aa, Plasmodium falciparum
KYNMSQ

SEQ ID NO: 3232862 - protein, 8 aa, Plasmodium falciparum
KYNNERDV

SEQ ID NO: 3232863 - protein, 30 aa, Plasmodium falciparum
KYNNKKNQQVENSSNAKQNINQRKRNSSTF

SEQ ID NO: 3232864 - protein, 12 aa, Plasmodium falciparum
KYNNKNEKDIKS

SEQ ID NO: 3232865 - protein, 12 aa, Plasmodium falciparum
KYNNNNNNKNKK

SEQ ID NO: 3232866 - protein, 12 aa, Plasmodium falciparum
KYNNNNNNNNNN

SEQ ID NO: 3232867 - protein, 20 aa, Plasmodium falciparum
KYNNNNNVGEESNSPDKTNY

SEQ ID NO: 3232868 - protein, 7 aa, Plasmodium falciparum
KYNNNRR

SEQ ID NO: 3232869 - protein, 10 aa, Plasmodium falciparum
KYNNNSNNMK

SEQ ID NO: 3232870 - protein, 5 aa, Plasmodium falciparum
KYNNP

SEQ ID NO: 3232871 - protein, 6 aa, Plasmodium falciparum
KYNNSE

SEQ ID NO: 3232872 - protein, 10 aa, Plasmodium falciparum
KYNNTKKEDL

SEQ ID NO: 3232873 - protein, 6 aa, Plasmodium falciparum
KYNNTY

SEQ ID NO: 3232874 - protein, 13 aa, Plasmodium falciparum
KYNPDKEKYDDYN

SEQ ID NO: 3232875 - protein, 41 aa, Plasmodium falciparum
KYNPFKKSGSNNNGKVNNTNENVDEDNNDNVDDNNTKKKHR

SEQ ID NO: 3232876 - protein, 6 aa, Plasmodium falciparum
KYNPNI

SEQ ID NO: 3232877 - protein, 5 aa, Plasmodium falciparum
KYNQN

SEQ ID NO: 3232878 - protein, 14 aa, Plasmodium falciparum
KYNQTIHKTNNNNY

SEQ ID NO: 3232879 - protein, 7 aa, Plasmodium falciparum
KYNSDTN

SEQ ID NO: 3232880 - protein, 7 aa, Plasmodium falciparum
KYNSKNI

SEQ ID NO: 3232881 - protein, 6 aa, Plasmodium falciparum
KYNSSD

SEQ ID NO: 3232882 - protein, 7 aa, Plasmodium falciparum
KYNTESF

SEQ ID NO: 3232883 - protein, 5 aa, Plasmodium falciparum
KYNTN

SEQ ID NO: 3232884 - protein, 6 aa, Plasmodium falciparum
KYNTRQ

SEQ ID NO: 3232885 - protein, 6 aa, Plasmodium falciparum
KYNTYD

SEQ ID NO: 3232886 - protein, 20 aa, Plasmodium falciparum
KYNYNGEDTIKKEDINTQCN

SEQ ID NO: 3232887 - protein, 15 aa, Plasmodium falciparum
KYNYNKDNGNDKNKM

SEQ ID NO: 3232888 - protein, 4 aa, Plasmodium falciparum
KYPD

SEQ ID NO: 3232889 - protein, 6 aa, Plasmodium falciparum
KYPDAK

SEQ ID NO: 3232890 - protein, 13 aa, Plasmodium falciparum
KYPDGEKFTKEQY

SEQ ID NO: 3232891 - protein, 11 aa, Plasmodium falciparum
KYPDHENENEL

SEQ ID NO: 3232892 - protein, 12 aa, Plasmodium falciparum
KYPDISDQDRHI

SEQ ID NO: 3232893 - protein, 5 aa, Plasmodium falciparum
KYPNM

SEQ ID NO: 3232894 - protein, 7 aa, Plasmodium falciparum
KYPPPGQ

SEQ ID NO: 3232895 - protein, 5 aa, Plasmodium falciparum
KYPTG

SEQ ID NO: 3232896 - protein, 12 aa, Plasmodium falciparum
KYPTHQLKDNSN

SEQ ID NO: 3232897 - protein, 6 aa, Plasmodium falciparum
KYPYQA

SEQ ID NO: 3232898 - protein, 6 aa, Plasmodium falciparum
KYQENK

SEQ ID NO: 3232899 - protein, 8 aa, Plasmodium falciparum
KYQGEERY

SEQ ID NO: 3232900 - protein, 4 aa, Plasmodium falciparum
KYQK

SEQ ID NO: 3232901 - protein, 16 aa, Plasmodium falciparum
KYQKNVQDENGPKCNN

SEQ ID NO: 3232902 - protein, 11 aa, Plasmodium falciparum
KYQNREHNKDP

SEQ ID NO: 3232903 - protein, 13 aa, Plasmodium falciparum
KYQNVDEKSSTCE

SEQ ID NO: 3232904 - protein, 20 aa, Plasmodium falciparum
KYQQKKKYKIKNKKKIQSVR

SEQ ID NO: 3232905 - protein, 5 aa, Plasmodium falciparum
KYQSY

SEQ ID NO: 3232906 - protein, 10 aa, Plasmodium falciparum
KYRKKKEEDL

SEQ ID NO: 3232907 - protein, 9 aa, Plasmodium falciparum
KYRKKNSSI

SEQ ID NO: 3232908 - protein, 15 aa, Plasmodium falciparum
KYRNSSLHRDEYNSS

SEQ ID NO: 3232909 - protein, 5 aa, Plasmodium falciparum
KYRNY

SEQ ID NO: 3232910 - protein, 8 aa, Plasmodium falciparum
KYRPRTNK

SEQ ID NO: 3232911 - protein, 5 aa, Plasmodium falciparum
KYRSV

SEQ ID NO: 3232912 - protein, 6 aa, Plasmodium falciparum
KYSDEI

SEQ ID NO: 3232913 - protein, 18 aa, Plasmodium falciparum
KYSDIDKKKKSDDNEDTQ

SEQ ID NO: 3232914 - protein, 5 aa, Plasmodium falciparum
KYSDY

SEQ ID NO: 3232915 - protein, 6 aa, Plasmodium falciparum
KYSEKL

SEQ ID NO: 3232916 - protein, 7 aa, Plasmodium falciparum
KYSGRQY

SEQ ID NO: 3232917 - protein, 7 aa, Plasmodium falciparum
KYSKKSM

SEQ ID NO: 3232918 - protein, 7 aa, Plasmodium falciparum
KYSNDMN

SEQ ID NO: 3232919 - protein, 11 aa, Plasmodium falciparum
KYSNSNNIANE

SEQ ID NO: 3232920 - protein, 19 aa, Plasmodium falciparum
KYSNVQNDKYNNIGNNNYS

SEQ ID NO: 3232921 - protein, 10 aa, Plasmodium falciparum
KYSPGGKPKI

SEQ ID NO: 3232922 - protein, 8 aa, Plasmodium falciparum
KYSPSGGR

SEQ ID NO: 3232923 - protein, 5 aa, Plasmodium falciparum
KYSQF

SEQ ID NO: 3232924 - protein, 11 aa, Plasmodium falciparum
KYSRQKEKYKE

SEQ ID NO: 3232925 - protein, 4 aa, Plasmodium falciparum
KYSS

SEQ ID NO: 3232926 - protein, 11 aa, Plasmodium falciparum
KYSSENPPYTT

SEQ ID NO: 3232927 - protein, 4 aa, Plasmodium falciparum
KYST

SEQ ID NO: 3232928 - protein, 26 aa, Plasmodium falciparum
KYSTNNKIAKNNDQPNSKQPRGSKMS

SEQ ID NO: 3232929 - protein, 11 aa, Plasmodium falciparum
KYTENSKGHYV

SEQ ID NO: 3232930 - protein, 16 aa, Plasmodium falciparum
KYTGNTGESKSQEGVL

SEQ ID NO: 3232931 - protein, 7 aa, Plasmodium falciparum
KYTKSDM

SEQ ID NO: 3232932 - protein, 6 aa, Plasmodium falciparum
KYTNES

SEQ ID NO: 3232933 - protein, 10 aa, Plasmodium falciparum
KYTNKDTYEG

SEQ ID NO: 3232934 - protein, 9 aa, Plasmodium falciparum
KYTNKNGDV

SEQ ID NO: 3232935 - protein, 24 aa, Plasmodium falciparum
KYTNPKDEIGKNKKKMTFSKGSTE

SEQ ID NO: 3232936 - protein, 5 aa, Plasmodium falciparum
KYTRG

SEQ ID NO: 3232937 - protein, 6 aa, Plasmodium falciparum
KYTSDN

SEQ ID NO: 3232938 - protein, 34 aa, Plasmodium falciparum
KYTSRSSTNNNSNNINSNNRSSNNNNHYNNSKNI

SEQ ID NO: 3232939 - protein, 5 aa, Plasmodium falciparum
KYTST

SEQ ID NO: 3232940 - protein, 19 aa, Plasmodium falciparum
KYVDDNNSIESSTNYNNGM

SEQ ID NO: 3232941 - protein, 13 aa, Plasmodium falciparum
KYVPKKPVPPQHI

SEQ ID NO: 3232942 - protein, 4 aa, Plasmodium falciparum
KYYD

SEQ ID NO: 3232943 - protein, 5 aa, Plasmodium falciparum
KYYDP

SEQ ID NO: 3232944 - protein, 7 aa, Plasmodium falciparum
KYYENQN

SEQ ID NO: 3232945 - protein, 22 aa, Plasmodium falciparum
KYYGKKKEYNKDDDNNKKYPNL

SEQ ID NO: 3232946 - protein, 6 aa, Plasmodium falciparum
KYYNDD

SEQ ID NO: 3232947 - protein, 5 aa, Plasmodium falciparum
KYYNN

SEQ ID NO: 3232948 - protein, 11 aa, Plasmodium falciparum
KYYNNDGGEHN

SEQ ID NO: 3232949 - protein, 17 aa, Plasmodium falciparum
KYYPSSDPKKEGLSKPN

SEQ ID NO: 3232950 - protein, 9 aa, Plasmodium falciparum
KYYQATSAK

SEQ ID NO: 3232951 - protein, 8 aa, Plasmodium falciparum
KYYSKDDD

SEQ ID NO: 3232952 - protein, 4 aa, Plasmodium falciparum
KYYT

SEQ ID NO: 3232953 - protein, 20 aa, Plasmodium falciparum
LAAAKKAAIAEGAAKGLAEG

SEQ ID NO: 3232954 - protein, 12 aa, Plasmodium falciparum
LAADNDKNSYGD

SEQ ID NO: 3232955 - protein, 20 aa, Plasmodium falciparum
LAAEAGAAEGASQGAAAGAT

SEQ ID NO: 3232956 - protein, 19 aa, Plasmodium falciparum
LAAEAGAAKGLAAGAEVGK

SEQ ID NO: 3232957 - protein, 11 aa, Plasmodium falciparum
LAANGTAATIN

SEQ ID NO: 3232958 - protein, 17 aa, Plasmodium falciparum
LAASKNAAVAEATAKGV

SEQ ID NO: 3232959 - protein, 8 aa, Plasmodium falciparum
LAASPENV

SEQ ID NO: 3232960 - protein, 7 aa, Plasmodium falciparum
LADTGSL

SEQ ID NO: 3232961 - protein, 15 aa, Plasmodium falciparum
LAEGSSESKETKVKD

SEQ ID NO: 3232962 - protein, 12 aa, Plasmodium falciparum
LAEKAGAAAGLK

SEQ ID NO: 3232963 - protein, 17 aa, Plasmodium falciparum
LAEKAGAAKGLAEGNAH

SEQ ID NO: 3232964 - protein, 7 aa, Plasmodium falciparum
LAEKNKQ

SEQ ID NO: 3232965 - protein, 6 aa, Plasmodium falciparum
LAENQV

SEQ ID NO: 3232966 - protein, 7 aa, Plasmodium falciparum
LAEQERI

SEQ ID NO: 3232967 - protein, 27 aa, Plasmodium falciparum
LAKREGKMKRRNKKEKRRKEKDNKKMN

SEQ ID NO: 3232968 - protein, 10 aa, Plasmodium falciparum
LANKNKSKRY

SEQ ID NO: 3232969 - protein, 11 aa, Plasmodium falciparum
LANQEKKLSEQ

SEQ ID NO: 3232970 - protein, 12 aa, Plasmodium falciparum
LANSTKKEIEPK

SEQ ID NO: 3232971 - protein, 9 aa, Plasmodium falciparum
LAPNNRENF

SEQ ID NO: 3232972 - protein, 11 aa, Plasmodium falciparum
LASLPSDDKIN

SEQ ID NO: 3232973 - protein, 5 aa, Plasmodium falciparum
LASQD

SEQ ID NO: 3232974 - protein, 11 aa, Plasmodium falciparum
LASQEKKKEKR

SEQ ID NO: 3232975 - protein, 4 aa, Plasmodium falciparum
LASS

SEQ ID NO: 3232976 - protein, 18 aa, Plasmodium falciparum
LASSDSPPLEDTQMKEIN

SEQ ID NO: 3232977 - protein, 10 aa, Plasmodium falciparum
LATPAATSAS

SEQ ID NO: 3232978 - protein, 7 aa, Plasmodium falciparum
LATPLPT

SEQ ID NO: 3232979 - protein, 14 aa, Plasmodium falciparum
LCDSNDDEKKQPFI

SEQ ID NO: 3232980 - protein, 8 aa, Plasmodium falciparum
LCDSSSKQ

SEQ ID NO: 3232981 - protein, 5 aa, Plasmodium falciparum
LCEND

SEQ ID NO: 3232982 - protein, 10 aa, Plasmodium falciparum
LCSNKQPNEL

SEQ ID NO: 3232983 - protein, 35 aa, Plasmodium falciparum
LCTENNDNNNNNNNNNNDNNNNNNNNNNNNNNNNK

SEQ ID NO: 3232984 - protein, 9 aa, Plasmodium falciparum
LCTSSDDEE

SEQ ID NO: 3232985 - protein, 5 aa, Plasmodium falciparum
LDATD

SEQ ID NO: 3232986 - protein, 14 aa, Plasmodium falciparum
LDDAEEKKEKEKDI

SEQ ID NO: 3232987 - protein, 8 aa, Plasmodium falciparum
LDDAHNDP

SEQ ID NO: 3232988 - protein, 18 aa, Plasmodium falciparum
LDDEDNNNLNDENDKYNY

SEQ ID NO: 3232989 - protein, 15 aa, Plasmodium falciparum
LDDEQKNLNEPQQAI

SEQ ID NO: 3232990 - protein, 6 aa, Plasmodium falciparum
LDDHKK

SEQ ID NO: 3232991 - protein, 10 aa, Plasmodium falciparum
LDDKNENVKY

SEQ ID NO: 3232992 - protein, 6 aa, Plasmodium falciparum
LDDKNK

SEQ ID NO: 3232993 - protein, 11 aa, Plasmodium falciparum
LDDNEKTGKDH

SEQ ID NO: 3232994 - protein, 17 aa, Plasmodium falciparum
LDDNNNNNNNYNNDNIR

SEQ ID NO: 3232995 - protein, 40 aa, Plasmodium falciparum
LDDNYSKRNSEQSDAEESSEGSLNSDDYFEEEKKKKRKSI

SEQ ID NO: 3232996 - protein, 4 aa, Plasmodium falciparum
LDDP

SEQ ID NO: 3232997 - protein, 9 aa, Plasmodium falciparum
LDDSSSNDI

SEQ ID NO: 3232998 - protein, 4 aa, Plasmodium falciparum
LDDT

SEQ ID NO: 3232999 - protein, 12 aa, Plasmodium falciparum
LDEDEDTGKENL

SEQ ID NO: 3233000 - protein, 72 aa, Plasmodium falciparum
LDEDSTENINEPNHLDGQNNKNNRKTNNDNTLKQNHRKSRGTSVQGRKNKINRGSKGKHNSINIPKDRKTNI

SEQ ID NO: 3233001 - protein, 4 aa, Plasmodium falciparum
LDEI

SEQ ID NO: 3233002 - protein, 5 aa, Plasmodium falciparum
LDEKN

SEQ ID NO: 3233003 - protein, 8 aa, Plasmodium falciparum
LDEKNKSN

SEQ ID NO: 3233004 - protein, 9 aa, Plasmodium falciparum
LDEKPSDTA

SEQ ID NO: 3233005 - protein, 8 aa, Plasmodium falciparum
LDENDYSN

SEQ ID NO: 3233006 - protein, 9 aa, Plasmodium falciparum
LDENEEPYV

SEQ ID NO: 3233007 - protein, 7 aa, Plasmodium falciparum
LDENGKS

SEQ ID NO: 3233008 - protein, 10 aa, Plasmodium falciparum
LDENNNDNND

SEQ ID NO: 3233009 - protein, 25 aa, Plasmodium falciparum
LDENSGDGPKTSQPPSAPSDTPTTL

SEQ ID NO: 3233010 - protein, 26 aa, Plasmodium falciparum
LDENSGTEAKTNEPSSPSSDNTPTTL

SEQ ID NO: 3233011 - protein, 18 aa, Plasmodium falciparum
LDEPRKRKHKKKKKQKNI

SEQ ID NO: 3233012 - protein, 6 aa, Plasmodium falciparum
LDEPTN

SEQ ID NO: 3233013 - protein, 8 aa, Plasmodium falciparum
LDEQRYSD

SEQ ID NO: 3233014 - protein, 58 aa, Plasmodium falciparum
LDERYKNTKRNFAQENDETHGEDNDELTDEEQDELGNEQGENNKQRKKKNKNKKNTVY

SEQ ID NO: 3233015 - protein, 14 aa, Plasmodium falciparum
LDESTEDSSRGLDS

SEQ ID NO: 3233016 - protein, 11 aa, Plasmodium falciparum
LDEVNKPIKEY

SEQ ID NO: 3233017 - protein, 4 aa, Plasmodium falciparum
LDGA

SEQ ID NO: 3233018 - protein, 12 aa, Plasmodium falciparum
LDGDTQKGDIEK

SEQ ID NO: 3233019 - protein, 21 aa, Plasmodium falciparum
LDGEGKKPKQNGTNGKDYTYG

SEQ ID NO: 3233020 - protein, 21 aa, Plasmodium falciparum
LDGKNGKKTLQERYKGDTTNY

SEQ ID NO: 3233021 - protein, 9 aa, Plasmodium falciparum
LDGKSLNNY

SEQ ID NO: 3233022 - protein, 62 aa, Plasmodium falciparum
LDGQKESQLYKNNSDGSTENHLSGSNSDGRNSSQHSVGSHSVSSQEHKKEHSTHDLPAGRNY

SEQ ID NO: 3233023 - protein, 8 aa, Plasmodium falciparum
LDGSDDRL

SEQ ID NO: 3233024 - protein, 6 aa, Plasmodium falciparum
LDIPSQ

SEQ ID NO: 3233025 - protein, 30 aa, Plasmodium falciparum
LDKDETLDSMKESTECIDPNKPKGKPCNNN

SEQ ID NO: 3233026 - protein, 10 aa, Plasmodium falciparum
LDKEEDEENY

SEQ ID NO: 3233027 - protein, 8 aa, Plasmodium falciparum
LDKEEKKL

SEQ ID NO: 3233028 - protein, 17 aa, Plasmodium falciparum
LDKEHNKNVDENSPCDN

SEQ ID NO: 3233029 - protein, 22 aa, Plasmodium falciparum
LDKEKPKKKKSKRKKKRDSSSD

SEQ ID NO: 3233030 - protein, 15 aa, Plasmodium falciparum
LDKESDKAKENLEEE

SEQ ID NO: 3233031 - protein, 12 aa, Plasmodium falciparum
LDKHRDSGHLEN

SEQ ID NO: 3233032 - protein, 4 aa, Plasmodium falciparum
LDKK

SEQ ID NO: 3233033 - protein, 21 aa, Plasmodium falciparum
LDKKKKKQNVSYSKNGTYNNP

SEQ ID NO: 3233034 - protein, 11 aa, Plasmodium falciparum
LDKKKQEEGVL

SEQ ID NO: 3233035 - protein, 8 aa, Plasmodium falciparum
LDKKNEEL

SEQ ID NO: 3233036 - protein, 5 aa, Plasmodium falciparum
LDKNR

SEQ ID NO: 3233037 - protein, 8 aa, Plasmodium falciparum
LDKNSRGE

SEQ ID NO: 3233038 - protein, 10 aa, Plasmodium falciparum
LDKNSSQHNN

SEQ ID NO: 3233039 - protein, 8 aa, Plasmodium falciparum
LDKNSTIV

SEQ ID NO: 3233040 - protein, 8 aa, Plasmodium falciparum
LDKPNVNK

SEQ ID NO: 3233041 - protein, 38 aa, Plasmodium falciparum
LDKQKKKYKSEITRGASGKSPKRTKRGARASDDNGYES

SEQ ID NO: 3233042 - protein, 9 aa, Plasmodium falciparum
LDKQKNNNT

SEQ ID NO: 3233043 - protein, 8 aa, Plasmodium falciparum
LDKSEKGI

SEQ ID NO: 3233044 - protein, 24 aa, Plasmodium falciparum
LDKSEKKLNEQKDGNGVPKSSNDK

SEQ ID NO: 3233045 - protein, 10 aa, Plasmodium falciparum
LDNGNKKNVD

SEQ ID NO: 3233046 - protein, 8 aa, Plasmodium falciparum
LDNHSENF

SEQ ID NO: 3233047 - protein, 17 aa, Plasmodium falciparum
LDNNKRKKSIRGTGEDL

SEQ ID NO: 3233048 - protein, 7 aa, Plasmodium falciparum
LDNNNNN

SEQ ID NO: 3233049 - protein, 8 aa, Plasmodium falciparum
LDNNQKSA

SEQ ID NO: 3233050 - protein, 7 aa, Plasmodium falciparum
LDNNSEE

SEQ ID NO: 3233051 - protein, 10 aa, Plasmodium falciparum
LDNNSPPAAC

SEQ ID NO: 3233052 - protein, 11 aa, Plasmodium falciparum
LDNNTKAAINQ

SEQ ID NO: 3233053 - protein, 4 aa, Plasmodium falciparum
LDNQ

SEQ ID NO: 3233054 - protein, 11 aa, Plasmodium falciparum
LDPKQNRKIPP

SEQ ID NO: 3233055 - protein, 4 aa, Plasmodium falciparum
LDPQ

SEQ ID NO: 3233056 - protein, 6 aa, Plasmodium falciparum
LDPSNN

SEQ ID NO: 3233057 - protein, 6 aa, Plasmodium falciparum
LDPSYT

SEQ ID NO: 3233058 - protein, 8 aa, Plasmodium falciparum
LDQEDNKL

SEQ ID NO: 3233059 - protein, 19 aa, Plasmodium falciparum
LDQEKKKKKLKKKNNDGNC

SEQ ID NO: 3233060 - protein, 5 aa, Plasmodium falciparum
LDQVK

SEQ ID NO: 3233061 - protein, 21 aa, Plasmodium falciparum
LDRGEEKSSEEEKKEKGNAGK

SEQ ID NO: 3233062 - protein, 30 aa, Plasmodium falciparum
LDRKDKDNDKDNDNNNDNHIDNNNDNNNEN

SEQ ID NO: 3233063 - protein, 9 aa, Plasmodium falciparum
LDRNTEHEQ

SEQ ID NO: 3233064 - protein, 5 aa, Plasmodium falciparum
LDSDA

SEQ ID NO: 3233065 - protein, 17 aa, Plasmodium falciparum
LDSENKRRNNYSHDDLT

SEQ ID NO: 3233066 - protein, 6 aa, Plasmodium falciparum
LDSESL

SEQ ID NO: 3233067 - protein, 48 aa, Plasmodium falciparum
LDSKDPEDQVEEEKAKDNTDETVETAKETKEDTDRKGEEKQPKEEVDN

SEQ ID NO: 3233068 - protein, 13 aa, Plasmodium falciparum
LDSNKKEATYNNN

SEQ ID NO: 3233069 - protein, 11 aa, Plasmodium falciparum
LDSNKLTDEEW

SEQ ID NO: 3233070 - protein, 7 aa, Plasmodium falciparum
LDSQISN

SEQ ID NO: 3233071 - protein, 8 aa, Plasmodium falciparum
LDSQNKCE

SEQ ID NO: 3233072 - protein, 112 aa, Plasmodium falciparum
LDSRTTGSFNSIDSKNEGSKGDDNKCDDNKCDDNKCDDNKCDDNKCDDNKCDDNKCDDNKCDDNKCDDNKCDDNKCDDNKCDDNKCDDNKCDDNKCDDNKCDDNKCDDNKCD

SEQ ID NO: 3233073 - protein, 8 aa, Plasmodium falciparum
LDSSEVSK

SEQ ID NO: 3233074 - protein, 12 aa, Plasmodium falciparum
LDSSNNSSSNKI

SEQ ID NO: 3233075 - protein, 7 aa, Plasmodium falciparum
LDSTNNQ

SEQ ID NO: 3233076 - protein, 23 aa, Plasmodium falciparum
LDSTRNHNYEETINKNKSKDMSQ

SEQ ID NO: 3233077 - protein, 7 aa, Plasmodium falciparum
LDTETYG

SEQ ID NO: 3233078 - protein, 4 aa, Plasmodium falciparum
LDTG

SEQ ID NO: 3233079 - protein, 4 aa, Plasmodium falciparum
LDTP

SEQ ID NO: 3233080 - protein, 149 aa, Plasmodium falciparum
LDTQRDPKKEESEPESEEEEDDAEEEEEPAKETATTETTQPAAPAGPPVTPVPELPGPPAPAGPAADGPIEDDEDAENEDDDDVGSATGTEDDDDDEDDDDEDEEDSADEGEGEGDGGDVGEEEDEDHGGQEAEGVVPQPAAPQPPTPQ

SEQ ID NO: 3233081 - protein, 6 aa, Plasmodium falciparum
LDYNGS

SEQ ID NO: 3233082 - protein, 14 aa, Plasmodium falciparum
LEAERSKNKKKQLY

SEQ ID NO: 3233083 - protein, 6 aa, Plasmodium falciparum
LEAGDD

SEQ ID NO: 3233084 - protein, 13 aa, Plasmodium falciparum
LEDDKKKAQESAD

SEQ ID NO: 3233085 - protein, 12 aa, Plasmodium falciparum
LEDDNDKVQSDN

SEQ ID NO: 3233086 - protein, 28 aa, Plasmodium falciparum
LEDEDDINENKKKTNNYHNNNNNNNKNE

SEQ ID NO: 3233087 - protein, 19 aa, Plasmodium falciparum
LEDESGEKRPDSSASGTKL

SEQ ID NO: 3233088 - protein, 5 aa, Plasmodium falciparum
LEDEV

SEQ ID NO: 3233089 - protein, 8 aa, Plasmodium falciparum
LEDGNTKN

SEQ ID NO: 3233090 - protein, 7 aa, Plasmodium falciparum
LEDKENM

SEQ ID NO: 3233091 - protein, 15 aa, Plasmodium falciparum
LEDKKNKLEAQNQTV

SEQ ID NO: 3233092 - protein, 5 aa, Plasmodium falciparum
LEDKM

SEQ ID NO: 3233093 - protein, 7 aa, Plasmodium falciparum
LEDKNNV

SEQ ID NO: 3233094 - protein, 34 aa, Plasmodium falciparum
LEDNKKDDGHVDKQNYSLEKKDNEEHTNNNSDPI

SEQ ID NO: 3233095 - protein, 19 aa, Plasmodium falciparum
LEDPNSYNNALKNNDSRYN

SEQ ID NO: 3233096 - protein, 10 aa, Plasmodium falciparum
LEDQNEKDNA

SEQ ID NO: 3233097 - protein, 21 aa, Plasmodium falciparum
LEDTSGAKPKDPKASPSGEKT

SEQ ID NO: 3233098 - protein, 11 aa, Plasmodium falciparum
LEEAKKKDKEV

SEQ ID NO: 3233099 - protein, 8 aa, Plasmodium falciparum
LEEDGNEI

SEQ ID NO: 3233100 - protein, 5 aa, Plasmodium falciparum
LEEDN

SEQ ID NO: 3233101 - protein, 34 aa, Plasmodium falciparum
LEEDNTSSAMSTSPRTSETTSASSDNTPTLNNPK

SEQ ID NO: 3233102 - protein, 6 aa, Plasmodium falciparum
LEEDPK

SEQ ID NO: 3233103 - protein, 4 aa, Plasmodium falciparum
LEEE

SEQ ID NO: 3233104 - protein, 31 aa, Plasmodium falciparum
LEEEDSENQAKGSSSQHPENPSTTSENKPTH

SEQ ID NO: 3233105 - protein, 8 aa, Plasmodium falciparum
LEEEGRKI

SEQ ID NO: 3233106 - protein, 9 aa, Plasmodium falciparum
LEEEKNQFE

SEQ ID NO: 3233107 - protein, 10 aa, Plasmodium falciparum
LEEENTVEQP

SEQ ID NO: 3233108 - protein, 11 aa, Plasmodium falciparum
LEEEPVEKGIK

SEQ ID NO: 3233109 - protein, 20 aa, Plasmodium falciparum
LEEETNNKADNTSNNNDNIN

SEQ ID NO: 3233110 - protein, 10 aa, Plasmodium falciparum
LEEGRQSHTE

SEQ ID NO: 3233111 - protein, 13 aa, Plasmodium falciparum
LEEKEKEKEQDVD

SEQ ID NO: 3233112 - protein, 5 aa, Plasmodium falciparum
LEEKI

SEQ ID NO: 3233113 - protein, 5 aa, Plasmodium falciparum
LEEKK

SEQ ID NO: 3233114 - protein, 22 aa, Plasmodium falciparum
LEEKKDGSIKPEQKEDKSADIQ

SEQ ID NO: 3233115 - protein, 10 aa, Plasmodium falciparum
LEEKNKKMEY

SEQ ID NO: 3233116 - protein, 9 aa, Plasmodium falciparum
LEEKRNTTV

SEQ ID NO: 3233117 - protein, 12 aa, Plasmodium falciparum
LEEKSANQEPLK

SEQ ID NO: 3233118 - protein, 7 aa, Plasmodium falciparum
LEEKSEN

SEQ ID NO: 3233119 - protein, 4 aa, Plasmodium falciparum
LEEN

SEQ ID NO: 3233120 - protein, 9 aa, Plasmodium falciparum
LEENNYDEN

SEQ ID NO: 3233121 - protein, 24 aa, Plasmodium falciparum
LEENSGAKPTQPPSPSGDNTPTTL

SEQ ID NO: 3233122 - protein, 8 aa, Plasmodium falciparum
LEEQDKKI

SEQ ID NO: 3233123 - protein, 9 aa, Plasmodium falciparum
LEEQKKPEI

SEQ ID NO: 3233124 - protein, 4 aa, Plasmodium falciparum
LEES

SEQ ID NO: 3233125 - protein, 13 aa, Plasmodium falciparum
LEETEENTEEAKK

SEQ ID NO: 3233126 - protein, 12 aa, Plasmodium falciparum
LEETEEVKAPNI

SEQ ID NO: 3233127 - protein, 9 aa, Plasmodium falciparum
LEETQSNKV

SEQ ID NO: 3233128 - protein, 62 aa, Plasmodium falciparum
LEGATKQGKDKEQEEKKKKNNKKNEKKEKNEKNEKIEKNEKNEKIEKNEKNEMNEGNEKNSI

SEQ ID NO: 3233129 - protein, 4 aa, Plasmodium falciparum
LEGD

SEQ ID NO: 3233130 - protein, 7 aa, Plasmodium falciparum
LEGETSV

SEQ ID NO: 3233131 - protein, 46 aa, Plasmodium falciparum
LEGGGKEEEDGKRGQSEVKEEEKNKKEQKEKKNNICDESEYGQEDY

SEQ ID NO: 3233132 - protein, 11 aa, Plasmodium falciparum
LEGGTEGEENM

SEQ ID NO: 3233133 - protein, 7 aa, Plasmodium falciparum
LEGKNKE

SEQ ID NO: 3233134 - protein, 10 aa, Plasmodium falciparum
LEGSDQRNME

SEQ ID NO: 3233135 - protein, 9 aa, Plasmodium falciparum
LEHATEKEH

SEQ ID NO: 3233136 - protein, 12 aa, Plasmodium falciparum
LEHPDEQNQSLN

SEQ ID NO: 3233137 - protein, 9 aa, Plasmodium falciparum
LEIKTTPKY

SEQ ID NO: 3233138 - protein, 10 aa, Plasmodium falciparum
LEKDKEQFQK

SEQ ID NO: 3233139 - protein, 10 aa, Plasmodium falciparum
LEKFKKKDSD

SEQ ID NO: 3233140 - protein, 17 aa, Plasmodium falciparum
LEKGETNTGLQKGEKNV

SEQ ID NO: 3233141 - protein, 48 aa, Plasmodium falciparum
LEKGNLDKSNMSDSEGKLDGNHMKNNEDGNLSAENVSSDEKKIYDKSK

SEQ ID NO: 3233142 - protein, 12 aa, Plasmodium falciparum
LEKKSKRIKDEL

SEQ ID NO: 3233143 - protein, 4 aa, Plasmodium falciparum
LEKN

SEQ ID NO: 3233144 - protein, 28 aa, Plasmodium falciparum
LEKNGNYENEKETLNEKGTLNEKENNHD

SEQ ID NO: 3233145 - protein, 5 aa, Plasmodium falciparum
LEKNP

SEQ ID NO: 3233146 - protein, 10 aa, Plasmodium falciparum
LEKNTKEAAS

SEQ ID NO: 3233147 - protein, 4 aa, Plasmodium falciparum
LEKQ

SEQ ID NO: 3233148 - protein, 11 aa, Plasmodium falciparum
LEKQERQYDNL

SEQ ID NO: 3233149 - protein, 11 aa, Plasmodium falciparum
LEKQKKKYDEE

SEQ ID NO: 3233150 - protein, 5 aa, Plasmodium falciparum
LEKRK

SEQ ID NO: 3233151 - protein, 9 aa, Plasmodium falciparum
LEKSEYSYK

SEQ ID NO: 3233152 - protein, 6 aa, Plasmodium falciparum
LEKSGA

SEQ ID NO: 3233153 - protein, 10 aa, Plasmodium falciparum
LEKSKSHLND

SEQ ID NO: 3233154 - protein, 24 aa, Plasmodium falciparum
LEKSNDDIKDKNKKNSNVLDSTTR

SEQ ID NO: 3233155 - protein, 7 aa, Plasmodium falciparum
LELPQTP

SEQ ID NO: 3233156 - protein, 9 aa, Plasmodium falciparum
LELSTKSKI

SEQ ID NO: 3233157 - protein, 24 aa, Plasmodium falciparum
LENADQEYKDYKTTQGPSKQGNDY

SEQ ID NO: 3233158 - protein, 15 aa, Plasmodium falciparum
LENAKEQCREKDKYY

SEQ ID NO: 3233159 - protein, 17 aa, Plasmodium falciparum
LENDETYSCDTQNVPDD

SEQ ID NO: 3233160 - protein, 5 aa, Plasmodium falciparum
LENEE

SEQ ID NO: 3233161 - protein, 8 aa, Plasmodium falciparum
LENEENES

SEQ ID NO: 3233162 - protein, 8 aa, Plasmodium falciparum
LENEKKDA

SEQ ID NO: 3233163 - protein, 12 aa, Plasmodium falciparum
LENEKRKNEEYE

SEQ ID NO: 3233164 - protein, 12 aa, Plasmodium falciparum
LENGDKKNATVD

SEQ ID NO: 3233165 - protein, 6 aa, Plasmodium falciparum
LENGSL

SEQ ID NO: 3233166 - protein, 5 aa, Plasmodium falciparum
LENHP

SEQ ID NO: 3233167 - protein, 5 aa, Plasmodium falciparum
LENKD

SEQ ID NO: 3233168 - protein, 9 aa, Plasmodium falciparum
LENKKDSVN

SEQ ID NO: 3233169 - protein, 18 aa, Plasmodium falciparum
LENKNKDIDTQNCPNDQD

SEQ ID NO: 3233170 - protein, 4 aa, Plasmodium falciparum
LENN

SEQ ID NO: 3233171 - protein, 13 aa, Plasmodium falciparum
LENNDKNDKNNNI

SEQ ID NO: 3233172 - protein, 12 aa, Plasmodium falciparum
LENNEENTNEHI

SEQ ID NO: 3233173 - protein, 6 aa, Plasmodium falciparum
LENNNS

SEQ ID NO: 3233174 - protein, 9 aa, Plasmodium falciparum
LENNSGQIN

SEQ ID NO: 3233175 - protein, 63 aa, Plasmodium falciparum
LENNSKKKNTKMRKTSEYSVTRNESKINNNSDVYNDNSITKDDSNIDLDDKPSKSKKSISSTS

SEQ ID NO: 3233176 - protein, 8 aa, Plasmodium falciparum
LENNSNDL

SEQ ID NO: 3233177 - protein, 13 aa, Plasmodium falciparum
LENPPTSERGDSV

SEQ ID NO: 3233178 - protein, 15 aa, Plasmodium falciparum
LENQNHEKKHIQDDK

SEQ ID NO: 3233179 - protein, 4 aa, Plasmodium falciparum
LENS

SEQ ID NO: 3233180 - protein, 18 aa, Plasmodium falciparum
LENSDTQAISNDTINNPK

SEQ ID NO: 3233181 - protein, 5 aa, Plasmodium falciparum
LENSR

SEQ ID NO: 3233182 - protein, 4 aa, Plasmodium falciparum
LENT

SEQ ID NO: 3233183 - protein, 5 aa, Plasmodium falciparum
LEPCG

SEQ ID NO: 3233184 - protein, 10 aa, Plasmodium falciparum
LEPGKDDTIN

SEQ ID NO: 3233185 - protein, 9 aa, Plasmodium falciparum
LEPGKNTST

SEQ ID NO: 3233186 - protein, 8 aa, Plasmodium falciparum
LEPGSPTY

SEQ ID NO: 3233187 - protein, 6 aa, Plasmodium falciparum
LEPKKE

SEQ ID NO: 3233188 - protein, 18 aa, Plasmodium falciparum
LEPQQNEITEKYSKKNDT

SEQ ID NO: 3233189 - protein, 7 aa, Plasmodium falciparum
LEPSLRN

SEQ ID NO: 3233190 - protein, 17 aa, Plasmodium falciparum
LEQGKLDKSNMSDNEEK

SEQ ID NO: 3233191 - protein, 4 aa, Plasmodium falciparum
LEQK

SEQ ID NO: 3233192 - protein, 33 aa, Plasmodium falciparum
LEQQKQKQEEEEEEEEEDDKKKIQNNYTHDDSM

SEQ ID NO: 3233193 - protein, 28 aa, Plasmodium falciparum
LEQRAAKDAQEEMRKRAEKQKKKKSKRR

SEQ ID NO: 3233194 - protein, 5 aa, Plasmodium falciparum
LEQYK

SEQ ID NO: 3233195 - protein, 20 aa, Plasmodium falciparum
LEREEKKGEDKIDESKCEEY

SEQ ID NO: 3233196 - protein, 7 aa, Plasmodium falciparum
LERGNIP

SEQ ID NO: 3233197 - protein, 6 aa, Plasmodium falciparum
LERRKD

SEQ ID NO: 3233198 - protein, 11 aa, Plasmodium falciparum
LESAEKKYNNF

SEQ ID NO: 3233199 - protein, 8 aa, Plasmodium falciparum
LESDDEEQ

SEQ ID NO: 3233200 - protein, 10 aa, Plasmodium falciparum
LESDDEEQFH

SEQ ID NO: 3233201 - protein, 8 aa, Plasmodium falciparum
LESDDEKE

SEQ ID NO: 3233202 - protein, 6 aa, Plasmodium falciparum
LESDEE

SEQ ID NO: 3233203 - protein, 14 aa, Plasmodium falciparum
LESDEESDEESEEF

SEQ ID NO: 3233204 - protein, 46 aa, Plasmodium falciparum
LESEEEELEEELRDEEKHDEKHDEKHDEKHNDNKNNDKNNDKNNIS

SEQ ID NO: 3233205 - protein, 19 aa, Plasmodium falciparum
LESENNDQLKENEVKGDEL

SEQ ID NO: 3233206 - protein, 6 aa, Plasmodium falciparum
LESGKD

SEQ ID NO: 3233207 - protein, 12 aa, Plasmodium falciparum
LESGKRSSINIS

SEQ ID NO: 3233208 - protein, 9 aa, Plasmodium falciparum
LESKGDQKL

SEQ ID NO: 3233209 - protein, 7 aa, Plasmodium falciparum
LESKGYT

SEQ ID NO: 3233210 - protein, 6 aa, Plasmodium falciparum
LESKHG

SEQ ID NO: 3233211 - protein, 10 aa, Plasmodium falciparum
LESRKGKDKY

SEQ ID NO: 3233212 - protein, 11 aa, Plasmodium falciparum
LESSGKKESKI

SEQ ID NO: 3233213 - protein, 19 aa, Plasmodium falciparum
LESSKNKKDKNKKKLPKEY

SEQ ID NO: 3233214 - protein, 4 aa, Plasmodium falciparum
LETN

SEQ ID NO: 3233215 - protein, 6 aa, Plasmodium falciparum
LETYSD

SEQ ID NO: 3233216 - protein, 4 aa, Plasmodium falciparum
LEYN

SEQ ID NO: 3233217 - protein, 23 aa, Plasmodium falciparum
LEYNEENNISSGTKKGNLSTEKK

SEQ ID NO: 3233218 - protein, 54 aa, Plasmodium falciparum
LEYSDNNNVDSGYDSDINSNKYNSNNNKQQQKINNNNINNNNNNNNNIDSNNIR

SEQ ID NO: 3233219 - protein, 6 aa, Plasmodium falciparum
LEYTNN

SEQ ID NO: 3233220 - protein, 7 aa, Plasmodium falciparum
LFGDGNQ

SEQ ID NO: 3233221 - protein, 5 aa, Plasmodium falciparum
LFNTE

SEQ ID NO: 3233222 - protein, 4 aa, Plasmodium falciparum
LFPG

SEQ ID NO: 3233223 - protein, 6 aa, Plasmodium falciparum
LFSDSK

SEQ ID NO: 3233224 - protein, 4 aa, Plasmodium falciparum
LFSP

SEQ ID NO: 3233225 - protein, 8 aa, Plasmodium falciparum
LGAGGSSL

SEQ ID NO: 3233226 - protein, 8 aa, Plasmodium falciparum
LGASPTAA

SEQ ID NO: 3233227 - protein, 11 aa, Plasmodium falciparum
LGDKTSKSYAE

SEQ ID NO: 3233228 - protein, 6 aa, Plasmodium falciparum
LGDKVE

SEQ ID NO: 3233229 - protein, 10 aa, Plasmodium falciparum
LGDQFDDNTY

SEQ ID NO: 3233230 - protein, 6 aa, Plasmodium falciparum
LGDSPW

SEQ ID NO: 3233231 - protein, 6 aa, Plasmodium falciparum
LGEASK

SEQ ID NO: 3233232 - protein, 5 aa, Plasmodium falciparum
LGEDQ

SEQ ID NO: 3233233 - protein, 11 aa, Plasmodium falciparum
LGEERNNNDDI

SEQ ID NO: 3233234 - protein, 7 aa, Plasmodium falciparum
LGEGKGI

SEQ ID NO: 3233235 - protein, 16 aa, Plasmodium falciparum
LGESQVNGELASEEVK

SEQ ID NO: 3233236 - protein, 4 aa, Plasmodium falciparum
LGGD

SEQ ID NO: 3233237 - protein, 6 aa, Plasmodium falciparum
LGGDKH

SEQ ID NO: 3233238 - protein, 26 aa, Plasmodium falciparum
LGGGESATETSKSNLEKPKDVEPSHE

SEQ ID NO: 3233239 - protein, 5 aa, Plasmodium falciparum
LGGKD

SEQ ID NO: 3233240 - protein, 5 aa, Plasmodium falciparum
LGGKN

SEQ ID NO: 3233241 - protein, 19 aa, Plasmodium falciparum
LGGQCTNKKIEGNKNNCGA

SEQ ID NO: 3233242 - protein, 14 aa, Plasmodium falciparum
LGGQCTNSKMRSGC

SEQ ID NO: 3233243 - protein, 41 aa, Plasmodium falciparum
LGGQPSSSGRSFSGSKYNTSNLASSSTTESSVSGLNTNEAH

SEQ ID NO: 3233244 - protein, 4 aa, Plasmodium falciparum
LGGR

SEQ ID NO: 3233245 - protein, 22 aa, Plasmodium falciparum
LGGTHKEKGPYNKNEKCNKKVN

SEQ ID NO: 3233246 - protein, 9 aa, Plasmodium falciparum
LGKKEKDLE

SEQ ID NO: 3233247 - protein, 7 aa, Plasmodium falciparum
LGKKGQG

SEQ ID NO: 3233248 - protein, 11 aa, Plasmodium falciparum
LGKNSADSKKC

SEQ ID NO: 3233249 - protein, 7 aa, Plasmodium falciparum
LGKPEED

SEQ ID NO: 3233250 - protein, 30 aa, Plasmodium falciparum
LGKSPKKNNTLNKYNEQSSYDDNYEQEDEE

SEQ ID NO: 3233251 - protein, 9 aa, Plasmodium falciparum
LGKTKGRDK

SEQ ID NO: 3233252 - protein, 15 aa, Plasmodium falciparum
LGNEKKNDYRTEDQT

SEQ ID NO: 3233253 - protein, 9 aa, Plasmodium falciparum
LGNGDTHKD

SEQ ID NO: 3233254 - protein, 8 aa, Plasmodium falciparum
LGNHPAST

SEQ ID NO: 3233255 - protein, 12 aa, Plasmodium falciparum
LGNKEKEPCPEN

SEQ ID NO: 3233256 - protein, 13 aa, Plasmodium falciparum
LGNKTKKSKIKNT

SEQ ID NO: 3233257 - protein, 38 aa, Plasmodium falciparum
LGNTNNLGNNNNLSNNNNLGNNNNLGNNNNLGNNNNMN

SEQ ID NO: 3233258 - protein, 6 aa, Plasmodium falciparum
LGPDVS

SEQ ID NO: 3233259 - protein, 4 aa, Plasmodium falciparum
LGPL

SEQ ID NO: 3233260 - protein, 16 aa, Plasmodium falciparum
LGPNSTDDSPTVSSLG

SEQ ID NO: 3233261 - protein, 9 aa, Plasmodium falciparum
LGPSSGPIT

SEQ ID NO: 3233262 - protein, 5 aa, Plasmodium falciparum
LGQDL

SEQ ID NO: 3233263 - protein, 8 aa, Plasmodium falciparum
LGQTSTPF

SEQ ID NO: 3233264 - protein, 5 aa, Plasmodium falciparum
LGQYY

SEQ ID NO: 3233265 - protein, 20 aa, Plasmodium falciparum
LGRDEPNRNPYLKTPDSGRE

SEQ ID NO: 3233266 - protein, 4 aa, Plasmodium falciparum
LGRK

SEQ ID NO: 3233267 - protein, 18 aa, Plasmodium falciparum
LGRKEKKEKRHKDKQNGF

SEQ ID NO: 3233268 - protein, 9 aa, Plasmodium falciparum
LGRNKYGNV

SEQ ID NO: 3233269 - protein, 9 aa, Plasmodium falciparum
LGSAGEVPP

SEQ ID NO: 3233270 - protein, 6 aa, Plasmodium falciparum
LGSDHK

SEQ ID NO: 3233271 - protein, 11 aa, Plasmodium falciparum
LGSKKRKNKKI

SEQ ID NO: 3233272 - protein, 13 aa, Plasmodium falciparum
LGSNKEQHPKEKL

SEQ ID NO: 3233273 - protein, 8 aa, Plasmodium falciparum
LGSQEDKD

SEQ ID NO: 3233274 - protein, 6 aa, Plasmodium falciparum
LGTGSY

SEQ ID NO: 3233275 - protein, 15 aa, Plasmodium falciparum
LGTHEKKHYENDTAN

SEQ ID NO: 3233276 - protein, 8 aa, Plasmodium falciparum
LGTNTLSA

SEQ ID NO: 3233277 - protein, 5 aa, Plasmodium falciparum
LGTSH

SEQ ID NO: 3233278 - protein, 12 aa, Plasmodium falciparum
LHDPSGKPEAQC

SEQ ID NO: 3233279 - protein, 12 aa, Plasmodium falciparum
LHDQEKGTNNDS

SEQ ID NO: 3233280 - protein, 15 aa, Plasmodium falciparum
LHEEEKRKARETQQA

SEQ ID NO: 3233281 - protein, 52 aa, Plasmodium falciparum
LHEQNGKLHEQNGDLHEQNGKLHEQNGKLHEQNGDLHDQSGDLHEQNSLTEN

SEQ ID NO: 3233282 - protein, 33 aa, Plasmodium falciparum
LHEQNNDLHEQNNNLHEQNNDLHEQNNDLHEQN

SEQ ID NO: 3233283 - protein, 4 aa, Plasmodium falciparum
LHGN

SEQ ID NO: 3233284 - protein, 10 aa, Plasmodium falciparum
LHKKKKKNPI

SEQ ID NO: 3233285 - protein, 8 aa, Plasmodium falciparum
LHKKNKKN

SEQ ID NO: 3233286 - protein, 5 aa, Plasmodium falciparum
LHNNN

SEQ ID NO: 3233287 - protein, 16 aa, Plasmodium falciparum
LHNNNSDESEEKENNH

SEQ ID NO: 3233288 - protein, 6 aa, Plasmodium falciparum
LHPRGP

SEQ ID NO: 3233289 - protein, 18 aa, Plasmodium falciparum
LHSKENQQTDATDTKNKT

SEQ ID NO: 3233290 - protein, 17 aa, Plasmodium falciparum
LHSNNNNNFNDDVQKNG

SEQ ID NO: 3233291 - protein, 6 aa, Plasmodium falciparum
LHTNNK

SEQ ID NO: 3233292 - protein, 14 aa, Plasmodium falciparum
LHTSSKKKSITKER

SEQ ID NO: 3233293 - protein, 10 aa, Plasmodium falciparum
LIDEKNNAIE

SEQ ID NO: 3233294 - protein, 12 aa, Plasmodium falciparum
LIKEKDKDYEQK

SEQ ID NO: 3233295 - protein, 15 aa, Plasmodium falciparum
LIKNDDNKYIEDNNN

SEQ ID NO: 3233296 - protein, 9 aa, Plasmodium falciparum
LISDEKEKS

SEQ ID NO: 3233297 - protein, 7 aa, Plasmodium falciparum
LKAKEQF

SEQ ID NO: 3233298 - protein, 12 aa, Plasmodium falciparum
LKCKTKKQANDS

SEQ ID NO: 3233299 - protein, 5 aa, Plasmodium falciparum
LKCSQ

SEQ ID NO: 3233300 - protein, 17 aa, Plasmodium falciparum
LKDAKNKCRGDSGNDRY

SEQ ID NO: 3233301 - protein, 19 aa, Plasmodium falciparum
LKDDAQKFNKENKKGMNKN

SEQ ID NO: 3233302 - protein, 11 aa, Plasmodium falciparum
LKDEPSHNNNI

SEQ ID NO: 3233303 - protein, 5 aa, Plasmodium falciparum
LKDEY

SEQ ID NO: 3233304 - protein, 11 aa, Plasmodium falciparum
LKDISKEKLQE

SEQ ID NO: 3233305 - protein, 4 aa, Plasmodium falciparum
LKDK

SEQ ID NO: 3233306 - protein, 18 aa, Plasmodium falciparum
LKDKEGAETRYGSDTTNY

SEQ ID NO: 3233307 - protein, 16 aa, Plasmodium falciparum
LKDKKKKKVDKKKKSY

SEQ ID NO: 3233308 - protein, 14 aa, Plasmodium falciparum
LKDKKQKSTNRSTI

SEQ ID NO: 3233309 - protein, 11 aa, Plasmodium falciparum
LKDKTKNNIKE

SEQ ID NO: 3233310 - protein, 10 aa, Plasmodium falciparum
LKDNAQDGNI

SEQ ID NO: 3233311 - protein, 14 aa, Plasmodium falciparum
LKDNKSNKNRALTK

SEQ ID NO: 3233312 - protein, 25 aa, Plasmodium falciparum
LKDNNNNNNINSNNFGNSYNAYTKK

SEQ ID NO: 3233313 - protein, 10 aa, Plasmodium falciparum
LKDNSKSNYD

SEQ ID NO: 3233314 - protein, 10 aa, Plasmodium falciparum
LKDNSNDNNM

SEQ ID NO: 3233315 - protein, 11 aa, Plasmodium falciparum
LKDQENESNPL

SEQ ID NO: 3233316 - protein, 5 aa, Plasmodium falciparum
LKDSI

SEQ ID NO: 3233317 - protein, 6 aa, Plasmodium falciparum
LKDSIQ

SEQ ID NO: 3233318 - protein, 20 aa, Plasmodium falciparum
LKDTNSNIKSSTSSNTISNV

SEQ ID NO: 3233319 - protein, 6 aa, Plasmodium falciparum
LKDTQN

SEQ ID NO: 3233320 - protein, 22 aa, Plasmodium falciparum
LKEDANEYNNDKENKNNKTKEI

SEQ ID NO: 3233321 - protein, 9 aa, Plasmodium falciparum
LKEDENNKI

SEQ ID NO: 3233322 - protein, 10 aa, Plasmodium falciparum
LKEDGNEKKN

SEQ ID NO: 3233323 - protein, 7 aa, Plasmodium falciparum
LKEDTLN

SEQ ID NO: 3233324 - protein, 8 aa, Plasmodium falciparum
LKEEHNKV

SEQ ID NO: 3233325 - protein, 8 aa, Plasmodium falciparum
LKEENEKC

SEQ ID NO: 3233326 - protein, 19 aa, Plasmodium falciparum
LKEENEKEKPEQKNEDNQF

SEQ ID NO: 3233327 - protein, 7 aa, Plasmodium falciparum
LKEENNV

SEQ ID NO: 3233328 - protein, 28 aa, Plasmodium falciparum
LKEENSDTQPITPGSSSPSGGDPINNPK

SEQ ID NO: 3233329 - protein, 12 aa, Plasmodium falciparum
LKEEQRTKKIKI

SEQ ID NO: 3233330 - protein, 14 aa, Plasmodium falciparum
LKEESKNRKDDEEE

SEQ ID NO: 3233331 - protein, 26 aa, Plasmodium falciparum
LKEESSDTKPQIASAPSDTPTLNNPK

SEQ ID NO: 3233332 - protein, 5 aa, Plasmodium falciparum
LKEEY

SEQ ID NO: 3233333 - protein, 6 aa, Plasmodium falciparum
LKEGDK

SEQ ID NO: 3233334 - protein, 10 aa, Plasmodium falciparum
LKEGEEKNEH

SEQ ID NO: 3233335 - protein, 8 aa, Plasmodium falciparum
LKEGEIPP

SEQ ID NO: 3233336 - protein, 11 aa, Plasmodium falciparum
LKEGKKHGKRN

SEQ ID NO: 3233337 - protein, 8 aa, Plasmodium falciparum
LKEGSKKL

SEQ ID NO: 3233338 - protein, 35 aa, Plasmodium falciparum
LKEKDDKNTTSYENDDKNTTSYENDDKNTTNYEND

SEQ ID NO: 3233339 - protein, 12 aa, Plasmodium falciparum
LKEKKGELKTTY

SEQ ID NO: 3233340 - protein, 9 aa, Plasmodium falciparum
LKEKKNKTT

SEQ ID NO: 3233341 - protein, 11 aa, Plasmodium falciparum
LKEKKNQKNIY

SEQ ID NO: 3233342 - protein, 8 aa, Plasmodium falciparum
LKEKNDVS

SEQ ID NO: 3233343 - protein, 37 aa, Plasmodium falciparum
LKEKNNEKEDLKKKEIKNNEEKLNTNKNESNQNSSHE

SEQ ID NO: 3233344 - protein, 15 aa, Plasmodium falciparum
LKEKNTNHHGGKDNT

SEQ ID NO: 3233345 - protein, 14 aa, Plasmodium falciparum
LKEKQENECNSQEE

SEQ ID NO: 3233346 - protein, 15 aa, Plasmodium falciparum
LKEKRQKCKDKCDKE

SEQ ID NO: 3233347 - protein, 4 aa, Plasmodium falciparum
LKEM

SEQ ID NO: 3233348 - protein, 31 aa, Plasmodium falciparum
LKEMENDKDDGNNHNNNKYDDDNNNNNNRSN

SEQ ID NO: 3233349 - protein, 17 aa, Plasmodium falciparum
LKENDKKNIKLSDSDNK

SEQ ID NO: 3233350 - protein, 14 aa, Plasmodium falciparum
LKENDKNIKGKEDI

SEQ ID NO: 3233351 - protein, 6 aa, Plasmodium falciparum
LKENKN

SEQ ID NO: 3233352 - protein, 6 aa, Plasmodium falciparum
LKENNE

SEQ ID NO: 3233353 - protein, 6 aa, Plasmodium falciparum
LKENNR

SEQ ID NO: 3233354 - protein, 10 aa, Plasmodium falciparum
LKENNTDKNE

SEQ ID NO: 3233355 - protein, 12 aa, Plasmodium falciparum
LKENRNKEHDGE

SEQ ID NO: 3233356 - protein, 10 aa, Plasmodium falciparum
LKEQQKRKEI

SEQ ID NO: 3233357 - protein, 15 aa, Plasmodium falciparum
LKESNEIKTNINTSS

SEQ ID NO: 3233358 - protein, 8 aa, Plasmodium falciparum
LKESNPNM

SEQ ID NO: 3233359 - protein, 8 aa, Plasmodium falciparum
LKESNSVH

SEQ ID NO: 3233360 - protein, 5 aa, Plasmodium falciparum
LKESR

SEQ ID NO: 3233361 - protein, 15 aa, Plasmodium falciparum
LKETLGKNNMNDGAS

SEQ ID NO: 3233362 - protein, 12 aa, Plasmodium falciparum
LKGAQNKTEYQQ

SEQ ID NO: 3233363 - protein, 19 aa, Plasmodium falciparum
LKGEGKLKGDSKLKGDNKL

SEQ ID NO: 3233364 - protein, 11 aa, Plasmodium falciparum
LKGEPDNNVEK

SEQ ID NO: 3233365 - protein, 90 aa, Plasmodium falciparum
LKGEVPEEHNDDNNDDDNNDDDNNNDDNNNDDNNNDDNNNDDNNNDDNNNDDNNNDDNNNDDNNNDNNNNDDNNNDNNNYDNNNSSCKNH

SEQ ID NO: 3233366 - protein, 12 aa, Plasmodium falciparum
LKGINKSKNQIN

SEQ ID NO: 3233367 - protein, 5 aa, Plasmodium falciparum
LKGKG

SEQ ID NO: 3233368 - protein, 6 aa, Plasmodium falciparum
LKGKKN

SEQ ID NO: 3233369 - protein, 7 aa, Plasmodium falciparum
LKGKLSQ

SEQ ID NO: 3233370 - protein, 4 aa, Plasmodium falciparum
LKGL

SEQ ID NO: 3233371 - protein, 25 aa, Plasmodium falciparum
LKGNHDDEDEDEEDDEENEEQELEE

SEQ ID NO: 3233372 - protein, 14 aa, Plasmodium falciparum
LKGNKNNIEKTNGN

SEQ ID NO: 3233373 - protein, 11 aa, Plasmodium falciparum
LKGNTGNKGSV

SEQ ID NO: 3233374 - protein, 8 aa, Plasmodium falciparum
LKGPDDKE

SEQ ID NO: 3233375 - protein, 9 aa, Plasmodium falciparum
LKGSNKYNT

SEQ ID NO: 3233376 - protein, 29 aa, Plasmodium falciparum
LKGSSGGKTSSNKESNESNEPTKKPSKYT

SEQ ID NO: 3233377 - protein, 29 aa, Plasmodium falciparum
LKGSSGSETSSTKESNDSNGATKKPSKYT

SEQ ID NO: 3233378 - protein, 5 aa, Plasmodium falciparum
LKHKE

SEQ ID NO: 3233379 - protein, 7 aa, Plasmodium falciparum
LKHNPST

SEQ ID NO: 3233380 - protein, 4 aa, Plasmodium falciparum
LKHT

SEQ ID NO: 3233381 - protein, 15 aa, Plasmodium falciparum
LKKASKKGDVNNSNS

SEQ ID NO: 3233382 - protein, 18 aa, Plasmodium falciparum
LKKDGNTNNDILEEEDKK

SEQ ID NO: 3233383 - protein, 17 aa, Plasmodium falciparum
LKKDKMNKKQEYKENKY

SEQ ID NO: 3233384 - protein, 10 aa, Plasmodium falciparum
LKKDNDDNDV

SEQ ID NO: 3233385 - protein, 10 aa, Plasmodium falciparum
LKKEDEKRRM

SEQ ID NO: 3233386 - protein, 32 aa, Plasmodium falciparum
LKKEKKKEKKKKKKSYTDEEEYNEDKMDDAKY

SEQ ID NO: 3233387 - protein, 12 aa, Plasmodium falciparum
LKKEQGGLYENG

SEQ ID NO: 3233388 - protein, 9 aa, Plasmodium falciparum
LKKEREEIR

SEQ ID NO: 3233389 - protein, 8 aa, Plasmodium falciparum
LKKGSKSF

SEQ ID NO: 3233390 - protein, 6 aa, Plasmodium falciparum
LKKHGA

SEQ ID NO: 3233391 - protein, 4 aa, Plasmodium falciparum
LKKK

SEQ ID NO: 3233392 - protein, 7 aa, Plasmodium falciparum
LKKKDTN

SEQ ID NO: 3233393 - protein, 7 aa, Plasmodium falciparum
LKKKEKR

SEQ ID NO: 3233394 - protein, 21 aa, Plasmodium falciparum
LKKKIKKNIKKKAKNEKDNNL

SEQ ID NO: 3233395 - protein, 8 aa, Plasmodium falciparum
LKKKKEEI

SEQ ID NO: 3233396 - protein, 64 aa, Plasmodium falciparum
LKKKKKKKKKDDKNNNNINNNNNNNKNNNNKNNNNKNNNNKNNNNDNNNNDNNNNNNNNNNDCN

SEQ ID NO: 3233397 - protein, 20 aa, Plasmodium falciparum
LKKKKKKKLKKYDHKTNCQH

SEQ ID NO: 3233398 - protein, 7 aa, Plasmodium falciparum
LKKKKNL

SEQ ID NO: 3233399 - protein, 8 aa, Plasmodium falciparum
LKKKKYNS

SEQ ID NO: 3233400 - protein, 17 aa, Plasmodium falciparum
LKKKNAYDDNKEEYTNN

SEQ ID NO: 3233401 - protein, 11 aa, Plasmodium falciparum
LKKKNKTMKMN

SEQ ID NO: 3233402 - protein, 9 aa, Plasmodium falciparum
LKKKNTIKK

SEQ ID NO: 3233403 - protein, 9 aa, Plasmodium falciparum
LKKKRSKSN

SEQ ID NO: 3233404 - protein, 8 aa, Plasmodium falciparum
LKKKSTAS

SEQ ID NO: 3233405 - protein, 9 aa, Plasmodium falciparum
LKKKTKKEN

SEQ ID NO: 3233406 - protein, 12 aa, Plasmodium falciparum
LKKNDNNKSNNY

SEQ ID NO: 3233407 - protein, 11 aa, Plasmodium falciparum
LKKNKNIKNNY

SEQ ID NO: 3233408 - protein, 13 aa, Plasmodium falciparum
LKKNNDKKKSKDI

SEQ ID NO: 3233409 - protein, 20 aa, Plasmodium falciparum
LKKNVNTLNEENNNNENIDN

SEQ ID NO: 3233410 - protein, 9 aa, Plasmodium falciparum
LKKQNNKGD

SEQ ID NO: 3233411 - protein, 6 aa, Plasmodium falciparum
LKKQRE

SEQ ID NO: 3233412 - protein, 9 aa, Plasmodium falciparum
LKKRNEPKM

SEQ ID NO: 3233413 - protein, 9 aa, Plasmodium falciparum
LKKRRKEKE

SEQ ID NO: 3233414 - protein, 18 aa, Plasmodium falciparum
LKKRRRKIKRNKNGKNIQ

SEQ ID NO: 3233415 - protein, 16 aa, Plasmodium falciparum
LKKSKDVEDISTNKGE

SEQ ID NO: 3233416 - protein, 39 aa, Plasmodium falciparum
LKKSKKSQETERKYVEEENDNYVNNNNNNNKLKNDNNKN

SEQ ID NO: 3233417 - protein, 27 aa, Plasmodium falciparum
LKKSKNKKCVQEHKNNDNHNNNNNHNN

SEQ ID NO: 3233418 - protein, 9 aa, Plasmodium falciparum
LKKSNNEVY

SEQ ID NO: 3233419 - protein, 57 aa, Plasmodium falciparum
LKKTNAESSHIEATTSQATTSQATTSQATTSQATTSQATTSQATSSQESDEQGLTAP

SEQ ID NO: 3233420 - protein, 15 aa, Plasmodium falciparum
LKKTNKYSLQDKNSK

SEQ ID NO: 3233421 - protein, 14 aa, Plasmodium falciparum
LKKYNKKKNNSCTI

SEQ ID NO: 3233422 - protein, 12 aa, Plasmodium falciparum
LKKYNSKDIQNK

SEQ ID NO: 3233423 - protein, 6 aa, Plasmodium falciparum
LKMEGE

SEQ ID NO: 3233424 - protein, 6 aa, Plasmodium falciparum
LKMKGE

SEQ ID NO: 3233425 - protein, 8 aa, Plasmodium falciparum
LKNDDHNS

SEQ ID NO: 3233426 - protein, 55 aa, Plasmodium falciparum
LKNDDQEKGKRGTSRNNNIHTNENNINNEHTNENNINNEHTNEKNINNEHANEKN

SEQ ID NO: 3233427 - protein, 5 aa, Plasmodium falciparum
LKNDE

SEQ ID NO: 3233428 - protein, 10 aa, Plasmodium falciparum
LKNDKTNGLS

SEQ ID NO: 3233429 - protein, 14 aa, Plasmodium falciparum
LKNDQKKKKENSGY

SEQ ID NO: 3233430 - protein, 14 aa, Plasmodium falciparum
LKNDQNKNNHNTKT

SEQ ID NO: 3233431 - protein, 9 aa, Plasmodium falciparum
LKNEDDKNN

SEQ ID NO: 3233432 - protein, 7 aa, Plasmodium falciparum
LKNEDND

SEQ ID NO: 3233433 - protein, 11 aa, Plasmodium falciparum
LKNEENPRMPS

SEQ ID NO: 3233434 - protein, 9 aa, Plasmodium falciparum
LKNEFSDSC

SEQ ID NO: 3233435 - protein, 10 aa, Plasmodium falciparum
LKNEGDKEEL

SEQ ID NO: 3233436 - protein, 18 aa, Plasmodium falciparum
LKNEGEKIKETNKNEENM

SEQ ID NO: 3233437 - protein, 7 aa, Plasmodium falciparum
LKNEKDL

SEQ ID NO: 3233438 - protein, 11 aa, Plasmodium falciparum
LKNEQNKNTYK

SEQ ID NO: 3233439 - protein, 6 aa, Plasmodium falciparum
LKNGDT

SEQ ID NO: 3233440 - protein, 8 aa, Plasmodium falciparum
LKNGEIDD

SEQ ID NO: 3233441 - protein, 17 aa, Plasmodium falciparum
LKNGKTNGIEERYGNDP

SEQ ID NO: 3233442 - protein, 12 aa, Plasmodium falciparum
LKNGNDINNRKK

SEQ ID NO: 3233443 - protein, 9 aa, Plasmodium falciparum
LKNGTIPDD

SEQ ID NO: 3233444 - protein, 13 aa, Plasmodium falciparum
LKNKGNQKYNYDD

SEQ ID NO: 3233445 - protein, 43 aa, Plasmodium falciparum
LKNKKNSAHNKKDDPHINDNTSSSEYEEDTDVNSTESEKIQNK

SEQ ID NO: 3233446 - protein, 15 aa, Plasmodium falciparum
LKNKNINDHDNDNDD

SEQ ID NO: 3233447 - protein, 19 aa, Plasmodium falciparum
LKNKNNKNESDGEEEKGNI

SEQ ID NO: 3233448 - protein, 8 aa, Plasmodium falciparum
LKNKNNYH

SEQ ID NO: 3233449 - protein, 8 aa, Plasmodium falciparum
LKNKTEFN

SEQ ID NO: 3233450 - protein, 6 aa, Plasmodium falciparum
LKNKTK

SEQ ID NO: 3233451 - protein, 10 aa, Plasmodium falciparum
LKNNDKNDDN

SEQ ID NO: 3233452 - protein, 11 aa, Plasmodium falciparum
LKNNEKKKEIL

SEQ ID NO: 3233453 - protein, 5 aa, Plasmodium falciparum
LKNNK

SEQ ID NO: 3233454 - protein, 8 aa, Plasmodium falciparum
LKNNKKEC

SEQ ID NO: 3233455 - protein, 15 aa, Plasmodium falciparum
LKNNKTKETHNNDED

SEQ ID NO: 3233456 - protein, 34 aa, Plasmodium falciparum
LKNNNNDNNNNNNNNMYDNKSNNIHNNNNNNSDN

SEQ ID NO: 3233457 - protein, 10 aa, Plasmodium falciparum
LKNNNNNNKK

SEQ ID NO: 3233458 - protein, 7 aa, Plasmodium falciparum
LKNPKGC

SEQ ID NO: 3233459 - protein, 6 aa, Plasmodium falciparum
LKNPKN

SEQ ID NO: 3233460 - protein, 25 aa, Plasmodium falciparum
LKNQEKKKKKKKNNNNNNNNNKYGN

SEQ ID NO: 3233461 - protein, 8 aa, Plasmodium falciparum
LKNQNTHM

SEQ ID NO: 3233462 - protein, 12 aa, Plasmodium falciparum
LKNQQKKNQQKK

SEQ ID NO: 3233463 - protein, 10 aa, Plasmodium falciparum
LKNRKNKNHV

SEQ ID NO: 3233464 - protein, 14 aa, Plasmodium falciparum
LKNSDYSKNNESNY

SEQ ID NO: 3233465 - protein, 12 aa, Plasmodium falciparum
LKNSGSETTDRK

SEQ ID NO: 3233466 - protein, 10 aa, Plasmodium falciparum
LKNSSTYSSI

SEQ ID NO: 3233467 - protein, 5 aa, Plasmodium falciparum
LKPDH

SEQ ID NO: 3233468 - protein, 9 aa, Plasmodium falciparum
LKPESPNQD

SEQ ID NO: 3233469 - protein, 6 aa, Plasmodium falciparum
LKPHGL

SEQ ID NO: 3233470 - protein, 7 aa, Plasmodium falciparum
LKPKGCN

SEQ ID NO: 3233471 - protein, 13 aa, Plasmodium falciparum
LKPLDNKQTDESE

SEQ ID NO: 3233472 - protein, 8 aa, Plasmodium falciparum
LKPTEQLA

SEQ ID NO: 3233473 - protein, 15 aa, Plasmodium falciparum
LKPTYKEETKQNQPF

SEQ ID NO: 3233474 - protein, 15 aa, Plasmodium falciparum
LKPYKNGSKSLNKRK

SEQ ID NO: 3233475 - protein, 11 aa, Plasmodium falciparum
LKREESKTYDT

SEQ ID NO: 3233476 - protein, 25 aa, Plasmodium falciparum
LKRKKGKKKKKKKKKKKKKNFDKEE

SEQ ID NO: 3233477 - protein, 7 aa, Plasmodium falciparum
LKRKSSI

SEQ ID NO: 3233478 - protein, 10 aa, Plasmodium falciparum
LKRNDNKNNK

SEQ ID NO: 3233479 - protein, 27 aa, Plasmodium falciparum
LKRNENEQYENNDDNKDEQKKNDLNSN

SEQ ID NO: 3233480 - protein, 5 aa, Plasmodium falciparum
LKRRP

SEQ ID NO: 3233481 - protein, 21 aa, Plasmodium falciparum
LKSAGDTNNMYKNNKQHDTFS

SEQ ID NO: 3233482 - protein, 21 aa, Plasmodium falciparum
LKSDNNEREDKKKKDESFEKN

SEQ ID NO: 3233483 - protein, 14 aa, Plasmodium falciparum
LKSDSEKAYGGPKA

SEQ ID NO: 3233484 - protein, 7 aa, Plasmodium falciparum
LKSEERL

SEQ ID NO: 3233485 - protein, 8 aa, Plasmodium falciparum
LKSEMKQN

SEQ ID NO: 3233486 - protein, 49 aa, Plasmodium falciparum
LKSGEPQNRDDIQTEETKKEKMNTRTHNDEDNTKKKNIKDKKKANGDDK

SEQ ID NO: 3233487 - protein, 4 aa, Plasmodium falciparum
LKSI

SEQ ID NO: 3233488 - protein, 8 aa, Plasmodium falciparum
LKSKDNKL

SEQ ID NO: 3233489 - protein, 7 aa, Plasmodium falciparum
LKSKGSK

SEQ ID NO: 3233490 - protein, 8 aa, Plasmodium falciparum
LKSKKESL

SEQ ID NO: 3233491 - protein, 24 aa, Plasmodium falciparum
LKSQEPSMGETSSSDNDRNEGSEG

SEQ ID NO: 3233492 - protein, 13 aa, Plasmodium falciparum
LKSQINPEKSKDI

SEQ ID NO: 3233493 - protein, 6 aa, Plasmodium falciparum
LKSSCE

SEQ ID NO: 3233494 - protein, 7 aa, Plasmodium falciparum
LKSSDEK

SEQ ID NO: 3233495 - protein, 9 aa, Plasmodium falciparum
LKSSDNNSI

SEQ ID NO: 3233496 - protein, 9 aa, Plasmodium falciparum
LKSSYKNSA

SEQ ID NO: 3233497 - protein, 8 aa, Plasmodium falciparum
LKSTKKKG

SEQ ID NO: 3233498 - protein, 14 aa, Plasmodium falciparum
LKSYGNSETMRQNG

SEQ ID NO: 3233499 - protein, 15 aa, Plasmodium falciparum
LKTENGDITKAKSNI

SEQ ID NO: 3233500 - protein, 4 aa, Plasmodium falciparum
LKTG

SEQ ID NO: 3233501 - protein, 6 aa, Plasmodium falciparum
LKTNDE

SEQ ID NO: 3233502 - protein, 41 aa, Plasmodium falciparum
LKTNDSSNVNVNGKKLDDNPYDSQKDVNKMENEYRKSENEV

SEQ ID NO: 3233503 - protein, 7 aa, Plasmodium falciparum
LKTNENL

SEQ ID NO: 3233504 - protein, 14 aa, Plasmodium falciparum
LKTNESINCGDDTK

SEQ ID NO: 3233505 - protein, 8 aa, Plasmodium falciparum
LKTNEVEK

SEQ ID NO: 3233506 - protein, 26 aa, Plasmodium falciparum
LKTNHNKKIGKLKGNSTHNNNNRNNY

SEQ ID NO: 3233507 - protein, 8 aa, Plasmodium falciparum
LKTNKDCS

SEQ ID NO: 3233508 - protein, 6 aa, Plasmodium falciparum
LKTRGI

SEQ ID NO: 3233509 - protein, 4 aa, Plasmodium falciparum
LKYD

SEQ ID NO: 3233510 - protein, 6 aa, Plasmodium falciparum
LKYNDQ

SEQ ID NO: 3233511 - protein, 6 aa, Plasmodium falciparum
LKYNKK

SEQ ID NO: 3233512 - protein, 7 aa, Plasmodium falciparum
LKYNSTD

SEQ ID NO: 3233513 - protein, 11 aa, Plasmodium falciparum
LLDNKENDGMT

SEQ ID NO: 3233514 - protein, 9 aa, Plasmodium falciparum
LLKNEEGDL

SEQ ID NO: 3233515 - protein, 10 aa, Plasmodium falciparum
LLNNEKSKIA

SEQ ID NO: 3233516 - protein, 6 aa, Plasmodium falciparum
LLNNSS

SEQ ID NO: 3233517 - protein, 9 aa, Plasmodium falciparum
LLSNSYAKD

SEQ ID NO: 3233518 - protein, 10 aa, Plasmodium falciparum
LLSSKNNNMN

SEQ ID NO: 3233519 - protein, 12 aa, Plasmodium falciparum
LNADSEGLSGNH

SEQ ID NO: 3233520 - protein, 13 aa, Plasmodium falciparum
LNAKKNKDKRKDK

SEQ ID NO: 3233521 - protein, 7 aa, Plasmodium falciparum
LNANEQR

SEQ ID NO: 3233522 - protein, 47 aa, Plasmodium falciparum
LNDDETKEKIQKQSHEGNIKKKKKKNEKIKNKKKINNTDNENKRGTL

SEQ ID NO: 3233523 - protein, 5 aa, Plasmodium falciparum
LNDDK

SEQ ID NO: 3233524 - protein, 15 aa, Plasmodium falciparum
LNDDKTHNGNYNGDD

SEQ ID NO: 3233525 - protein, 6 aa, Plasmodium falciparum
LNDDNI

SEQ ID NO: 3233526 - protein, 15 aa, Plasmodium falciparum
LNDDNNNNNNNNHNI

SEQ ID NO: 3233527 - protein, 4 aa, Plasmodium falciparum
LNDE

SEQ ID NO: 3233528 - protein, 90 aa, Plasmodium falciparum
LNDEGKKKQSGLINENEDGKNNKSNNNKKVQHNKINRKGNNSVTKKTDEHKNDGDAENKKNGEHKNDGDGKNKKNGEHKNDGDGKNKKMD

SEQ ID NO: 3233529 - protein, 5 aa, Plasmodium falciparum
LNDEN

SEQ ID NO: 3233530 - protein, 9 aa, Plasmodium falciparum
LNDEPNDAN

SEQ ID NO: 3233531 - protein, 19 aa, Plasmodium falciparum
LNDEQKNIKKNKDSGDNNN

SEQ ID NO: 3233532 - protein, 5 aa, Plasmodium falciparum
LNDEY

SEQ ID NO: 3233533 - protein, 4 aa, Plasmodium falciparum
LNDK

SEQ ID NO: 3233534 - protein, 8 aa, Plasmodium falciparum
LNDKNNKQ

SEQ ID NO: 3233535 - protein, 7 aa, Plasmodium falciparum
LNDKPIN

SEQ ID NO: 3233536 - protein, 11 aa, Plasmodium falciparum
LNDNDDEGNKK

SEQ ID NO: 3233537 - protein, 6 aa, Plasmodium falciparum
LNDNED

SEQ ID NO: 3233538 - protein, 5 aa, Plasmodium falciparum
LNDPA

SEQ ID NO: 3233539 - protein, 5 aa, Plasmodium falciparum
LNDPF

SEQ ID NO: 3233540 - protein, 5 aa, Plasmodium falciparum
LNDPK

SEQ ID NO: 3233541 - protein, 11 aa, Plasmodium falciparum
LNDQNKKNKVV

SEQ ID NO: 3233542 - protein, 13 aa, Plasmodium falciparum
LNDSGKNKTPLEN

SEQ ID NO: 3233543 - protein, 7 aa, Plasmodium falciparum
LNDSLSH

SEQ ID NO: 3233544 - protein, 15 aa, Plasmodium falciparum
LNDTESSKKKDGDKR

SEQ ID NO: 3233545 - protein, 10 aa, Plasmodium falciparum
LNDTNSQHIN

SEQ ID NO: 3233546 - protein, 5 aa, Plasmodium falciparum
LNDTS

SEQ ID NO: 3233547 - protein, 63 aa, Plasmodium falciparum
LNDVSADNNTSNKLKDEPVDNNTSNKLKDEPVDNNTSNKLKDEPVDDNTSNKLKDEPVDNNTI

SEQ ID NO: 3233548 - protein, 9 aa, Plasmodium falciparum
LNDYSTEDE

SEQ ID NO: 3233549 - protein, 11 aa, Plasmodium falciparum
LNEDGTRKPEY

SEQ ID NO: 3233550 - protein, 42 aa, Plasmodium falciparum
LNEDNSSSKVKKKNKINDNNNNSNNNSNNNSNNNNNNNSRSQ

SEQ ID NO: 3233551 - protein, 62 aa, Plasmodium falciparum
LNEEEKDSNEKNYDTNKSCTKDIKRNNNDNNDNNDNNDNNNDNDNNNNNNNNNNNDNNRGNA

SEQ ID NO: 3233552 - protein, 10 aa, Plasmodium falciparum
LNEEEKKNIK

SEQ ID NO: 3233553 - protein, 7 aa, Plasmodium falciparum
LNEEELK

SEQ ID NO: 3233554 - protein, 6 aa, Plasmodium falciparum
LNEEER

SEQ ID NO: 3233555 - protein, 8 aa, Plasmodium falciparum
LNEEETND

SEQ ID NO: 3233556 - protein, 5 aa, Plasmodium falciparum
LNEEK

SEQ ID NO: 3233557 - protein, 9 aa, Plasmodium falciparum
LNEENGKNF

SEQ ID NO: 3233558 - protein, 9 aa, Plasmodium falciparum
LNEEQKNDV

SEQ ID NO: 3233559 - protein, 87 aa, Plasmodium falciparum
LNEGNQKDDDNKNNYDDKENNYDDKENNYDDKENNYDDNKNNYDDNKNNYDDKKNNYDDKKNNYDDNKNNYDYNNNKNDDDDSINVS

SEQ ID NO: 3233560 - protein, 4 aa, Plasmodium falciparum
LNEK

SEQ ID NO: 3233561 - protein, 6 aa, Plasmodium falciparum
LNEKNE

SEQ ID NO: 3233562 - protein, 23 aa, Plasmodium falciparum
LNEKQKKKNKKNKKKKNEDIKGD

SEQ ID NO: 3233563 - protein, 4 aa, Plasmodium falciparum
LNEN

SEQ ID NO: 3233564 - protein, 10 aa, Plasmodium falciparum
LNENDMNTSY

SEQ ID NO: 3233565 - protein, 5 aa, Plasmodium falciparum
LNENE

SEQ ID NO: 3233566 - protein, 7 aa, Plasmodium falciparum
LNENKNK

SEQ ID NO: 3233567 - protein, 9 aa, Plasmodium falciparum
LNENNENGY

SEQ ID NO: 3233568 - protein, 20 aa, Plasmodium falciparum
LNENNKKDSKNMKNKKNINN

SEQ ID NO: 3233569 - protein, 11 aa, Plasmodium falciparum
LNENNNHDFTT

SEQ ID NO: 3233570 - protein, 11 aa, Plasmodium falciparum
LNENTRGKTAT

SEQ ID NO: 3233571 - protein, 5 aa, Plasmodium falciparum
LNERT

SEQ ID NO: 3233572 - protein, 5 aa, Plasmodium falciparum
LNEWN

SEQ ID NO: 3233573 - protein, 10 aa, Plasmodium falciparum
LNGDAEQNIN

SEQ ID NO: 3233574 - protein, 7 aa, Plasmodium falciparum
LNGDGVK

SEQ ID NO: 3233575 - protein, 4 aa, Plasmodium falciparum
LNGG

SEQ ID NO: 3233576 - protein, 12 aa, Plasmodium falciparum
LNGINKNNKEKK

SEQ ID NO: 3233577 - protein, 4 aa, Plasmodium falciparum
LNGK

SEQ ID NO: 3233578 - protein, 26 aa, Plasmodium falciparum
LNGNDNNDNNYNNDNYNDNYNNNYND

SEQ ID NO: 3233579 - protein, 9 aa, Plasmodium falciparum
LNGNEENNF

SEQ ID NO: 3233580 - protein, 8 aa, Plasmodium falciparum
LNGNNSSL

SEQ ID NO: 3233581 - protein, 11 aa, Plasmodium falciparum
LNGNSNGNNNC

SEQ ID NO: 3233582 - protein, 13 aa, Plasmodium falciparum
LNGSGKRKRTNSQ

SEQ ID NO: 3233583 - protein, 8 aa, Plasmodium falciparum
LNGSLTNN

SEQ ID NO: 3233584 - protein, 4 aa, Plasmodium falciparum
LNGT

SEQ ID NO: 3233585 - protein, 17 aa, Plasmodium falciparum
LNHDKKDIGTVDKEKKN

SEQ ID NO: 3233586 - protein, 20 aa, Plasmodium falciparum
LNHNNKNSNSNNSNNNNNNN

SEQ ID NO: 3233587 - protein, 7 aa, Plasmodium falciparum
LNHTNQQ

SEQ ID NO: 3233588 - protein, 5 aa, Plasmodium falciparum
LNIQN

SEQ ID NO: 3233589 - protein, 5 aa, Plasmodium falciparum
LNKAG

SEQ ID NO: 3233590 - protein, 117 aa, Plasmodium falciparum
LNKDKENDQDGHTNGDIEQNDKHNGKQNAKQNDKHNDKQNDKQNDKQNHKQYDKQNDKQNDKQNDKQNDKQNDKQNDKQNHKQYDKQNDKQYDKQNDKQYDKQNDKQYDKQNDKQYD

SEQ ID NO: 3233591 - protein, 4 aa, Plasmodium falciparum
LNKE

SEQ ID NO: 3233592 - protein, 11 aa, Plasmodium falciparum
LNKEKKSSEDI

SEQ ID NO: 3233593 - protein, 6 aa, Plasmodium falciparum
LNKEKS

SEQ ID NO: 3233594 - protein, 29 aa, Plasmodium falciparum
LNKENNNNNNNNNNNNNNNNNNNNNATSN

SEQ ID NO: 3233595 - protein, 10 aa, Plasmodium falciparum
LNKESEYNVN

SEQ ID NO: 3233596 - protein, 17 aa, Plasmodium falciparum
LNKESSLNNKKEEKYNS

SEQ ID NO: 3233597 - protein, 23 aa, Plasmodium falciparum
LNKGNDNTNDTNNLSSAKTSNIS

SEQ ID NO: 3233598 - protein, 4 aa, Plasmodium falciparum
LNKK

SEQ ID NO: 3233599 - protein, 6 aa, Plasmodium falciparum
LNKKEE

SEQ ID NO: 3233600 - protein, 7 aa, Plasmodium falciparum
LNKKKSP

SEQ ID NO: 3233601 - protein, 9 aa, Plasmodium falciparum
LNKNEKDDS

SEQ ID NO: 3233602 - protein, 10 aa, Plasmodium falciparum
LNKNKKDENI

SEQ ID NO: 3233603 - protein, 8 aa, Plasmodium falciparum
LNKNKKKL

SEQ ID NO: 3233604 - protein, 11 aa, Plasmodium falciparum
LNKNKKNNINY

SEQ ID NO: 3233605 - protein, 18 aa, Plasmodium falciparum
LNKNNEQIKSNNYEKEKM

SEQ ID NO: 3233606 - protein, 13 aa, Plasmodium falciparum
LNKNNKDEKDEKK

SEQ ID NO: 3233607 - protein, 13 aa, Plasmodium falciparum
LNKNRDDTINNNN

SEQ ID NO: 3233608 - protein, 7 aa, Plasmodium falciparum
LNKPKKI

SEQ ID NO: 3233609 - protein, 7 aa, Plasmodium falciparum
LNKSQQE

SEQ ID NO: 3233610 - protein, 5 aa, Plasmodium falciparum
LNKSY

SEQ ID NO: 3233611 - protein, 20 aa, Plasmodium falciparum
LNLGGDDSNPQTQLQKSGTI

SEQ ID NO: 3233612 - protein, 12 aa, Plasmodium falciparum
LNLSSRKNRNNN

SEQ ID NO: 3233613 - protein, 4 aa, Plasmodium falciparum
LNLT

SEQ ID NO: 3233614 - protein, 6 aa, Plasmodium falciparum
LNNDDN

SEQ ID NO: 3233615 - protein, 12 aa, Plasmodium falciparum
LNNDEKKVGTSY

SEQ ID NO: 3233616 - protein, 9 aa, Plasmodium falciparum
LNNDEQDEW

SEQ ID NO: 3233617 - protein, 5 aa, Plasmodium falciparum
LNNDG

SEQ ID NO: 3233618 - protein, 78 aa, Plasmodium falciparum
LNNDHNNDHNNDHSNDHNNDHNNDHNNDHNNDLNNDHNNDHNNDHNNDHNNDHNNDHNNDHNNDHNNDHNNNNNYNNE

SEQ ID NO: 3233619 - protein, 15 aa, Plasmodium falciparum
LNNDNNKNDNDFSKN

SEQ ID NO: 3233620 - protein, 8 aa, Plasmodium falciparum
LNNDTATN

SEQ ID NO: 3233621 - protein, 10 aa, Plasmodium falciparum
LNNEDYGETY

SEQ ID NO: 3233622 - protein, 9 aa, Plasmodium falciparum
LNNEENKHL

SEQ ID NO: 3233623 - protein, 8 aa, Plasmodium falciparum
LNNEKKKN

SEQ ID NO: 3233624 - protein, 11 aa, Plasmodium falciparum
LNNENKKNKNY

SEQ ID NO: 3233625 - protein, 11 aa, Plasmodium falciparum
LNNENNEFERN

SEQ ID NO: 3233626 - protein, 11 aa, Plasmodium falciparum
LNNERQKKYMR

SEQ ID NO: 3233627 - protein, 10 aa, Plasmodium falciparum
LNNGSHRNSI

SEQ ID NO: 3233628 - protein, 17 aa, Plasmodium falciparum
LNNKDNNIDQMKSDNNN

SEQ ID NO: 3233629 - protein, 7 aa, Plasmodium falciparum
LNNKKKK

SEQ ID NO: 3233630 - protein, 6 aa, Plasmodium falciparum
LNNKNV

SEQ ID NO: 3233631 - protein, 4 aa, Plasmodium falciparum
LNNN

SEQ ID NO: 3233632 - protein, 12 aa, Plasmodium falciparum
LNNNDGEEEEEC

SEQ ID NO: 3233633 - protein, 17 aa, Plasmodium falciparum
LNNNGYDNINKGSTSYY

SEQ ID NO: 3233634 - protein, 25 aa, Plasmodium falciparum
LNNNINSNLNNNVNSNLNNNVNSNM

SEQ ID NO: 3233635 - protein, 6 aa, Plasmodium falciparum
LNNNKK

SEQ ID NO: 3233636 - protein, 22 aa, Plasmodium falciparum
LNNNKKNNSYNKGQYNINDNTN

SEQ ID NO: 3233637 - protein, 5 aa, Plasmodium falciparum
LNNNN

SEQ ID NO: 3233638 - protein, 12 aa, Plasmodium falciparum
LNNNNKKNDASY

SEQ ID NO: 3233639 - protein, 10 aa, Plasmodium falciparum
LNNNNNNNDH

SEQ ID NO: 3233640 - protein, 12 aa, Plasmodium falciparum
LNNNNNNNNNNN

SEQ ID NO: 3233641 - protein, 16 aa, Plasmodium falciparum
LNNNNNNNNNNNDGDE

SEQ ID NO: 3233642 - protein, 22 aa, Plasmodium falciparum
LNNNNNNNNNNNNNNNNNECHN

SEQ ID NO: 3233643 - protein, 29 aa, Plasmodium falciparum
LNNNNNNNNNNNNNNNNNGDNLKYQGSVD

SEQ ID NO: 3233644 - protein, 45 aa, Plasmodium falciparum
LNNNNNNNNNNNNNNNNNNNNNSNNFNDSSFNSDNNSDDGEEGGM

SEQ ID NO: 3233645 - protein, 8 aa, Plasmodium falciparum
LNNNYDKN

SEQ ID NO: 3233646 - protein, 5 aa, Plasmodium falciparum
LNNPY

SEQ ID NO: 3233647 - protein, 5 aa, Plasmodium falciparum
LNNQK

SEQ ID NO: 3233648 - protein, 5 aa, Plasmodium falciparum
LNNQN

SEQ ID NO: 3233649 - protein, 9 aa, Plasmodium falciparum
LNNQRGNYS

SEQ ID NO: 3233650 - protein, 9 aa, Plasmodium falciparum
LNNQYNNDD

SEQ ID NO: 3233651 - protein, 7 aa, Plasmodium falciparum
LNNRSGL

SEQ ID NO: 3233652 - protein, 4 aa, Plasmodium falciparum
LNNS

SEQ ID NO: 3233653 - protein, 21 aa, Plasmodium falciparum
LNNSDKNIDESNNKNEKGHDM

SEQ ID NO: 3233654 - protein, 7 aa, Plasmodium falciparum
LNNSKQI

SEQ ID NO: 3233655 - protein, 9 aa, Plasmodium falciparum
LNNSNNINN

SEQ ID NO: 3233656 - protein, 6 aa, Plasmodium falciparum
LNNSQI

SEQ ID NO: 3233657 - protein, 7 aa, Plasmodium falciparum
LNNSTHT

SEQ ID NO: 3233658 - protein, 5 aa, Plasmodium falciparum
LNNSY

SEQ ID NO: 3233659 - protein, 5 aa, Plasmodium falciparum
LNNTD

SEQ ID NO: 3233660 - protein, 10 aa, Plasmodium falciparum
LNNTKDKNRY

SEQ ID NO: 3233661 - protein, 7 aa, Plasmodium falciparum
LNNTPSN

SEQ ID NO: 3233662 - protein, 6 aa, Plasmodium falciparum
LNNTQT

SEQ ID NO: 3233663 - protein, 14 aa, Plasmodium falciparum
LNNTSGNKSIDGSN

SEQ ID NO: 3233664 - protein, 4 aa, Plasmodium falciparum
LNNV

SEQ ID NO: 3233665 - protein, 7 aa, Plasmodium falciparum
LNNYNKK

SEQ ID NO: 3233666 - protein, 10 aa, Plasmodium falciparum
LNPCRNNGEV

SEQ ID NO: 3233667 - protein, 11 aa, Plasmodium falciparum
LNPNNTQRTTI

SEQ ID NO: 3233668 - protein, 9 aa, Plasmodium falciparum
LNPPSGATD

SEQ ID NO: 3233669 - protein, 8 aa, Plasmodium falciparum
LNPQNSTD

SEQ ID NO: 3233670 - protein, 9 aa, Plasmodium falciparum
LNPSGNNSF

SEQ ID NO: 3233671 - protein, 5 aa, Plasmodium falciparum
LNPSL

SEQ ID NO: 3233672 - protein, 6 aa, Plasmodium falciparum
LNPSSH

SEQ ID NO: 3233673 - protein, 6 aa, Plasmodium falciparum
LNPTSK

SEQ ID NO: 3233674 - protein, 6 aa, Plasmodium falciparum
LNQEDN

SEQ ID NO: 3233675 - protein, 6 aa, Plasmodium falciparum
LNQETL

SEQ ID NO: 3233676 - protein, 13 aa, Plasmodium falciparum
LNQKEVNDLKLRN

SEQ ID NO: 3233677 - protein, 5 aa, Plasmodium falciparum
LNQNS

SEQ ID NO: 3233678 - protein, 6 aa, Plasmodium falciparum
LNQRKR

SEQ ID NO: 3233679 - protein, 9 aa, Plasmodium falciparum
LNQSDEDIN

SEQ ID NO: 3233680 - protein, 10 aa, Plasmodium falciparum
LNQTNNNISQ

SEQ ID NO: 3233681 - protein, 22 aa, Plasmodium falciparum
LNQTRRKRIEESRSISQGNHNE

SEQ ID NO: 3233682 - protein, 4 aa, Plasmodium falciparum
LNRK

SEQ ID NO: 3233683 - protein, 11 aa, Plasmodium falciparum
LNRNEQNKKLT

SEQ ID NO: 3233684 - protein, 6 aa, Plasmodium falciparum
LNRNSN

SEQ ID NO: 3233685 - protein, 4 aa, Plasmodium falciparum
LNSD

SEQ ID NO: 3233686 - protein, 9 aa, Plasmodium falciparum
LNSDDQKRY

SEQ ID NO: 3233687 - protein, 10 aa, Plasmodium falciparum
LNSDENEKMR

SEQ ID NO: 3233688 - protein, 6 aa, Plasmodium falciparum
LNSEED

SEQ ID NO: 3233689 - protein, 6 aa, Plasmodium falciparum
LNSEQN

SEQ ID NO: 3233690 - protein, 8 aa, Plasmodium falciparum
LNSEQSSF

SEQ ID NO: 3233691 - protein, 11 aa, Plasmodium falciparum
LNSGDQRSSYS

SEQ ID NO: 3233692 - protein, 5 aa, Plasmodium falciparum
LNSGN

SEQ ID NO: 3233693 - protein, 24 aa, Plasmodium falciparum
LNSGNNTHSSNNVVSTNNIESRNY

SEQ ID NO: 3233694 - protein, 5 aa, Plasmodium falciparum
LNSIP

SEQ ID NO: 3233695 - protein, 4 aa, Plasmodium falciparum
LNSK

SEQ ID NO: 3233696 - protein, 15 aa, Plasmodium falciparum
LNSKEKKEKKNKQKI

SEQ ID NO: 3233697 - protein, 8 aa, Plasmodium falciparum
LNSKSNTN

SEQ ID NO: 3233698 - protein, 7 aa, Plasmodium falciparum
LNSLKKN

SEQ ID NO: 3233699 - protein, 13 aa, Plasmodium falciparum
LNSNQNINHTQQK

SEQ ID NO: 3233700 - protein, 20 aa, Plasmodium falciparum
LNSPHNNNNDNYNNNYTYDE

SEQ ID NO: 3233701 - protein, 9 aa, Plasmodium falciparum
LNSPNANII

SEQ ID NO: 3233702 - protein, 7 aa, Plasmodium falciparum
LNSSESK

SEQ ID NO: 3233703 - protein, 15 aa, Plasmodium falciparum
LNSTQQQQQQQNNNV

SEQ ID NO: 3233704 - protein, 4 aa, Plasmodium falciparum
LNTC

SEQ ID NO: 3233705 - protein, 5 aa, Plasmodium falciparum
LNTEE

SEQ ID NO: 3233706 - protein, 7 aa, Plasmodium falciparum
LNTEENR

SEQ ID NO: 3233707 - protein, 25 aa, Plasmodium falciparum
LNTINNNNDKKKQNQKNKNRKYSKN

SEQ ID NO: 3233708 - protein, 12 aa, Plasmodium falciparum
LNTKKPDATLGG

SEQ ID NO: 3233709 - protein, 16 aa, Plasmodium falciparum
LNTKNNVEENKSVKNC

SEQ ID NO: 3233710 - protein, 38 aa, Plasmodium falciparum
LNTKRQGVGAGAPQLQEEDDNDEEEENPQQELEDGTIP

SEQ ID NO: 3233711 - protein, 4 aa, Plasmodium falciparum
LNTM

SEQ ID NO: 3233712 - protein, 4 aa, Plasmodium falciparum
LNTN

SEQ ID NO: 3233713 - protein, 6 aa, Plasmodium falciparum
LNTNEK

SEQ ID NO: 3233714 - protein, 21 aa, Plasmodium falciparum
LNTNEKEEYNKNEVKNYPNNN

SEQ ID NO: 3233715 - protein, 11 aa, Plasmodium falciparum
LNTPQSGSPLL

SEQ ID NO: 3233716 - protein, 4 aa, Plasmodium falciparum
LNTQ

SEQ ID NO: 3233717 - protein, 13 aa, Plasmodium falciparum
LNTQEENNSLENN

SEQ ID NO: 3233718 - protein, 5 aa, Plasmodium falciparum
LNTSD

SEQ ID NO: 3233719 - protein, 32 aa, Plasmodium falciparum
LNTSSKMEDSDKPENGDRKVTTNKMNKKKQNT

SEQ ID NO: 3233720 - protein, 9 aa, Plasmodium falciparum
LNTTDPSKA

SEQ ID NO: 3233721 - protein, 7 aa, Plasmodium falciparum
LNTTETQ

SEQ ID NO: 3233722 - protein, 8 aa, Plasmodium falciparum
LNTTTENI

SEQ ID NO: 3233723 - protein, 17 aa, Plasmodium falciparum
LNTTTTLEGTSQKPSAV

SEQ ID NO: 3233724 - protein, 6 aa, Plasmodium falciparum
LNVPEK

SEQ ID NO: 3233725 - protein, 4 aa, Plasmodium falciparum
LNYN

SEQ ID NO: 3233726 - protein, 6 aa, Plasmodium falciparum
LNYNGS

SEQ ID NO: 3233727 - protein, 5 aa, Plasmodium falciparum
LPAET

SEQ ID NO: 3233728 - protein, 5 aa, Plasmodium falciparum
LPATL

SEQ ID NO: 3233729 - protein, 9 aa, Plasmodium falciparum
LPDDPTTLP

SEQ ID NO: 3233730 - protein, 9 aa, Plasmodium falciparum
LPDDTEEIK

SEQ ID NO: 3233731 - protein, 12 aa, Plasmodium falciparum
LPDDTSNDNQHY

SEQ ID NO: 3233732 - protein, 8 aa, Plasmodium falciparum
LPDNKQNE

SEQ ID NO: 3233733 - protein, 17 aa, Plasmodium falciparum
LPDPSLKQTTQQENQPV

SEQ ID NO: 3233734 - protein, 43 aa, Plasmodium falciparum
LPDSPTTTSNSNNNNNNNNSNNNNNNNNYDKGEVKGLRTSSEQ

SEQ ID NO: 3233735 - protein, 6 aa, Plasmodium falciparum
LPDTPT

SEQ ID NO: 3233736 - protein, 7 aa, Plasmodium falciparum
LPDYTSE

SEQ ID NO: 3233737 - protein, 5 aa, Plasmodium falciparum
LPEDI

SEQ ID NO: 3233738 - protein, 5 aa, Plasmodium falciparum
LPENI

SEQ ID NO: 3233739 - protein, 6 aa, Plasmodium falciparum
LPEQEE

SEQ ID NO: 3233740 - protein, 68 aa, Plasmodium falciparum
LPEQNSNNLKNLENRQDLKKKKSYKKKENDNSTTSSKDKNEKDNISKYEKKKKKSDDEKKKDNKKRDF

SEQ ID NO: 3233741 - protein, 4 aa, Plasmodium falciparum
LPET

SEQ ID NO: 3233742 - protein, 6 aa, Plasmodium falciparum
LPGAEP

SEQ ID NO: 3233743 - protein, 4 aa, Plasmodium falciparum
LPGD

SEQ ID NO: 3233744 - protein, 15 aa, Plasmodium falciparum
LPGIQGKYADDERNI

SEQ ID NO: 3233745 - protein, 7 aa, Plasmodium falciparum
LPGSVSP

SEQ ID NO: 3233746 - protein, 12 aa, Plasmodium falciparum
LPHASQGSSRTV

SEQ ID NO: 3233747 - protein, 66 aa, Plasmodium falciparum
LPIGDSNNSSNYNNNSNNNNNNNNNSNSNNNNNNNSNNNNNNNNNNNNNNNNNNNNNNSNSNNERS

SEQ ID NO: 3233748 - protein, 7 aa, Plasmodium falciparum
LPKGSNK

SEQ ID NO: 3233749 - protein, 8 aa, Plasmodium falciparum
LPKKNSYY

SEQ ID NO: 3233750 - protein, 4 aa, Plasmodium falciparum
LPKN

SEQ ID NO: 3233751 - protein, 56 aa, Plasmodium falciparum
LPKPEENPEPVEKPNPEENPNPVEKPTPEENPNPVEKPTPEENPNPVEKPEPEKNP

SEQ ID NO: 3233752 - protein, 8 aa, Plasmodium falciparum
LPKPPYGT

SEQ ID NO: 3233753 - protein, 14 aa, Plasmodium falciparum
LPKSDSDSDTNYKI

SEQ ID NO: 3233754 - protein, 8 aa, Plasmodium falciparum
LPKSSSLI

SEQ ID NO: 3233755 - protein, 15 aa, Plasmodium falciparum
LPLGDDKKEKLNEEN

SEQ ID NO: 3233756 - protein, 9 aa, Plasmodium falciparum
LPNEEQTNY

SEQ ID NO: 3233757 - protein, 43 aa, Plasmodium falciparum
LPNGNETDAKKNVDENNNENDSNLNENSTNLKKNNVDNNKDNV

SEQ ID NO: 3233758 - protein, 11 aa, Plasmodium falciparum
LPNKTNQASSQ

SEQ ID NO: 3233759 - protein, 4 aa, Plasmodium falciparum
LPNL

SEQ ID NO: 3233760 - protein, 4 aa, Plasmodium falciparum
LPNN

SEQ ID NO: 3233761 - protein, 5 aa, Plasmodium falciparum
LPNND

SEQ ID NO: 3233762 - protein, 6 aa, Plasmodium falciparum
LPNNLN

SEQ ID NO: 3233763 - protein, 5 aa, Plasmodium falciparum
LPNNS

SEQ ID NO: 3233764 - protein, 4 aa, Plasmodium falciparum
LPNP

SEQ ID NO: 3233765 - protein, 4 aa, Plasmodium falciparum
LPPK

SEQ ID NO: 3233766 - protein, 4 aa, Plasmodium falciparum
LPPN

SEQ ID NO: 3233767 - protein, 5 aa, Plasmodium falciparum
LPPNT

SEQ ID NO: 3233768 - protein, 4 aa, Plasmodium falciparum
LPPQ

SEQ ID NO: 3233769 - protein, 5 aa, Plasmodium falciparum
LPPRT

SEQ ID NO: 3233770 - protein, 6 aa, Plasmodium falciparum
LPPSGI

SEQ ID NO: 3233771 - protein, 4 aa, Plasmodium falciparum
LPPT

SEQ ID NO: 3233772 - protein, 7 aa, Plasmodium falciparum
LPPTGGL

SEQ ID NO: 3233773 - protein, 7 aa, Plasmodium falciparum
LPQATSP

SEQ ID NO: 3233774 - protein, 4 aa, Plasmodium falciparum
LPQG

SEQ ID NO: 3233775 - protein, 4 aa, Plasmodium falciparum
LPQY

SEQ ID NO: 3233776 - protein, 7 aa, Plasmodium falciparum
LPSIDEK

SEQ ID NO: 3233777 - protein, 7 aa, Plasmodium falciparum
LPSISKK

SEQ ID NO: 3233778 - protein, 14 aa, Plasmodium falciparum
LPSKEFKPKRSLGQ

SEQ ID NO: 3233779 - protein, 10 aa, Plasmodium falciparum
LPSKPTELTN

SEQ ID NO: 3233780 - protein, 8 aa, Plasmodium falciparum
LPSKTTQN

SEQ ID NO: 3233781 - protein, 5 aa, Plasmodium falciparum
LPSMP

SEQ ID NO: 3233782 - protein, 12 aa, Plasmodium falciparum
LPSNKKNSSDAT

SEQ ID NO: 3233783 - protein, 7 aa, Plasmodium falciparum
LPSPPDR

SEQ ID NO: 3233784 - protein, 16 aa, Plasmodium falciparum
LPSSEASVNDSAYNDY

SEQ ID NO: 3233785 - protein, 6 aa, Plasmodium falciparum
LPTDEK

SEQ ID NO: 3233786 - protein, 15 aa, Plasmodium falciparum
LPTGSTLSTSDVSAE

SEQ ID NO: 3233787 - protein, 8 aa, Plasmodium falciparum
LPTTESED

SEQ ID NO: 3233788 - protein, 4 aa, Plasmodium falciparum
LPVN

SEQ ID NO: 3233789 - protein, 4 aa, Plasmodium falciparum
LQAN

SEQ ID NO: 3233790 - protein, 5 aa, Plasmodium falciparum
LQDDV

SEQ ID NO: 3233791 - protein, 8 aa, Plasmodium falciparum
LQEGVSST

SEQ ID NO: 3233792 - protein, 31 aa, Plasmodium falciparum
LQEKAKKCHDQHSDNPQEKCDDPHPDEPDEE

SEQ ID NO: 3233793 - protein, 10 aa, Plasmodium falciparum
LQEKDKQKKL

SEQ ID NO: 3233794 - protein, 6 aa, Plasmodium falciparum
LQENEN

SEQ ID NO: 3233795 - protein, 6 aa, Plasmodium falciparum
LQENNN

SEQ ID NO: 3233796 - protein, 7 aa, Plasmodium falciparum
LQEQNEE

SEQ ID NO: 3233797 - protein, 27 aa, Plasmodium falciparum
LQERKDEKNKNDKTIYNNNEEQTDDLN

SEQ ID NO: 3233798 - protein, 4 aa, Plasmodium falciparum
LQGA

SEQ ID NO: 3233799 - protein, 9 aa, Plasmodium falciparum
LQGDSDDEL

SEQ ID NO: 3233800 - protein, 7 aa, Plasmodium falciparum
LQKEEDT

SEQ ID NO: 3233801 - protein, 7 aa, Plasmodium falciparum
LQKGNQP

SEQ ID NO: 3233802 - protein, 8 aa, Plasmodium falciparum
LQKKEKEI

SEQ ID NO: 3233803 - protein, 4 aa, Plasmodium falciparum
LQKN

SEQ ID NO: 3233804 - protein, 7 aa, Plasmodium falciparum
LQKQQND

SEQ ID NO: 3233805 - protein, 5 aa, Plasmodium falciparum
LQKRG

SEQ ID NO: 3233806 - protein, 9 aa, Plasmodium falciparum
LQKRTSISS

SEQ ID NO: 3233807 - protein, 10 aa, Plasmodium falciparum
LQLKKSKKSC

SEQ ID NO: 3233808 - protein, 17 aa, Plasmodium falciparum
LQNAKNKCREKHKDGKK

SEQ ID NO: 3233809 - protein, 7 aa, Plasmodium falciparum
LQNDGNG

SEQ ID NO: 3233810 - protein, 12 aa, Plasmodium falciparum
LQNEDNNVEDMN

SEQ ID NO: 3233811 - protein, 16 aa, Plasmodium falciparum
LQNEENNNNNNTQDNV

SEQ ID NO: 3233812 - protein, 12 aa, Plasmodium falciparum
LQNEKKNTYNKA

SEQ ID NO: 3233813 - protein, 7 aa, Plasmodium falciparum
LQNGDHN

SEQ ID NO: 3233814 - protein, 10 aa, Plasmodium falciparum
LQNKDERKIK

SEQ ID NO: 3233815 - protein, 14 aa, Plasmodium falciparum
LQNKDKKKYTNSIE

SEQ ID NO: 3233816 - protein, 7 aa, Plasmodium falciparum
LQNKEKK

SEQ ID NO: 3233817 - protein, 12 aa, Plasmodium falciparum
LQNNNNNDNNKY

SEQ ID NO: 3233818 - protein, 7 aa, Plasmodium falciparum
LQNPPKE

SEQ ID NO: 3233819 - protein, 11 aa, Plasmodium falciparum
LQNSTKNEEFY

SEQ ID NO: 3233820 - protein, 6 aa, Plasmodium falciparum
LQNSYN

SEQ ID NO: 3233821 - protein, 4 aa, Plasmodium falciparum
LQNT

SEQ ID NO: 3233822 - protein, 15 aa, Plasmodium falciparum
LQPEANDTKNNENIK

SEQ ID NO: 3233823 - protein, 4 aa, Plasmodium falciparum
LQPG

SEQ ID NO: 3233824 - protein, 5 aa, Plasmodium falciparum
LQPTE

SEQ ID NO: 3233825 - protein, 6 aa, Plasmodium falciparum
LQPTKA

SEQ ID NO: 3233826 - protein, 6 aa, Plasmodium falciparum
LQPTRS

SEQ ID NO: 3233827 - protein, 4 aa, Plasmodium falciparum
LQQQ

SEQ ID NO: 3233828 - protein, 8 aa, Plasmodium falciparum
LQRSNGAL

SEQ ID NO: 3233829 - protein, 10 aa, Plasmodium falciparum
LQSDPQGKKK

SEQ ID NO: 3233830 - protein, 24 aa, Plasmodium falciparum
LQSEHNQDDENKTGDKNKISGGNK

SEQ ID NO: 3233831 - protein, 6 aa, Plasmodium falciparum
LQSEPF

SEQ ID NO: 3233832 - protein, 17 aa, Plasmodium falciparum
LQSERKESNQKKKNKKQ

SEQ ID NO: 3233833 - protein, 15 aa, Plasmodium falciparum
LQSKRKQYKDKCDKE

SEQ ID NO: 3233834 - protein, 4 aa, Plasmodium falciparum
LQTE

SEQ ID NO: 3233835 - protein, 15 aa, Plasmodium falciparum
LQTEDQGNNMNSQEL

SEQ ID NO: 3233836 - protein, 6 aa, Plasmodium falciparum
LQTGKD

SEQ ID NO: 3233837 - protein, 4 aa, Plasmodium falciparum
LQTN

SEQ ID NO: 3233838 - protein, 18 aa, Plasmodium falciparum
LQTNEDKNGNYKDSCENI

SEQ ID NO: 3233839 - protein, 34 aa, Plasmodium falciparum
LQTPSSQNKTNDPHQHTPQPLEENNNNNNNNNPY

SEQ ID NO: 3233840 - protein, 5 aa, Plasmodium falciparum
LQTVD

SEQ ID NO: 3233841 - protein, 4 aa, Plasmodium falciparum
LREG

SEQ ID NO: 3233842 - protein, 11 aa, Plasmodium falciparum
LREKKSNNFYS

SEQ ID NO: 3233843 - protein, 7 aa, Plasmodium falciparum
LREQTEH

SEQ ID NO: 3233844 - protein, 4 aa, Plasmodium falciparum
LRET

SEQ ID NO: 3233845 - protein, 4 aa, Plasmodium falciparum
LRGP

SEQ ID NO: 3233846 - protein, 7 aa, Plasmodium falciparum
LRKERTN

SEQ ID NO: 3233847 - protein, 15 aa, Plasmodium falciparum
LRKGADDCDDNSNIE

SEQ ID NO: 3233848 - protein, 10 aa, Plasmodium falciparum
LRKKKRKKEI

SEQ ID NO: 3233849 - protein, 8 aa, Plasmodium falciparum
LRKRGYPT

SEQ ID NO: 3233850 - protein, 5 aa, Plasmodium falciparum
LRKRK

SEQ ID NO: 3233851 - protein, 21 aa, Plasmodium falciparum
LRKRRDLNNNNNNNNNNNMKN

SEQ ID NO: 3233852 - protein, 11 aa, Plasmodium falciparum
LRKSNSTNPAV

SEQ ID NO: 3233853 - protein, 11 aa, Plasmodium falciparum
LRNEEKDSIKE

SEQ ID NO: 3233854 - protein, 6 aa, Plasmodium falciparum
LRNEEN

SEQ ID NO: 3233855 - protein, 8 aa, Plasmodium falciparum
LRNEGKDV

SEQ ID NO: 3233856 - protein, 11 aa, Plasmodium falciparum
LRNEKEEKIKN

SEQ ID NO: 3233857 - protein, 7 aa, Plasmodium falciparum
LRNETKN

SEQ ID NO: 3233858 - protein, 7 aa, Plasmodium falciparum
LRNGGTA

SEQ ID NO: 3233859 - protein, 4 aa, Plasmodium falciparum
LRNK

SEQ ID NO: 3233860 - protein, 10 aa, Plasmodium falciparum
LRNKKNEDIS

SEQ ID NO: 3233861 - protein, 24 aa, Plasmodium falciparum
LRNNNSYEEKKKQKQKQKQNQNNV

SEQ ID NO: 3233862 - protein, 14 aa, Plasmodium falciparum
LRNTKYKNNDSEDN

SEQ ID NO: 3233863 - protein, 4 aa, Plasmodium falciparum
LRPG

SEQ ID NO: 3233864 - protein, 20 aa, Plasmodium falciparum
LRPPTPPRNQPKMRELNFGA

SEQ ID NO: 3233865 - protein, 12 aa, Plasmodium falciparum
LRRTKEGHRYST

SEQ ID NO: 3233866 - protein, 20 aa, Plasmodium falciparum
LRSGSSNSRNRINEEKHEKK

SEQ ID NO: 3233867 - protein, 6 aa, Plasmodium falciparum
LRSPYS

SEQ ID NO: 3233868 - protein, 32 aa, Plasmodium falciparum
LRSSTSRGNDNIESNNNNNNNNNNNNNNNNNN

SEQ ID NO: 3233869 - protein, 5 aa, Plasmodium falciparum
LRTKR

SEQ ID NO: 3233870 - protein, 11 aa, Plasmodium falciparum
LSAATKAALDS

SEQ ID NO: 3233871 - protein, 11 aa, Plasmodium falciparum
LSAKRSKKTYY

SEQ ID NO: 3233872 - protein, 11 aa, Plasmodium falciparum
LSAPKDQTGAT

SEQ ID NO: 3233873 - protein, 14 aa, Plasmodium falciparum
LSCSNKNDLPSDEY

SEQ ID NO: 3233874 - protein, 11 aa, Plasmodium falciparum
LSDDQKKEINN

SEQ ID NO: 3233875 - protein, 7 aa, Plasmodium falciparum
LSDDSAR

SEQ ID NO: 3233876 - protein, 17 aa, Plasmodium falciparum
LSDDSDERKNKNDRTIK

SEQ ID NO: 3233877 - protein, 49 aa, Plasmodium falciparum
LSDEDDDDDDNDDDNDDDNDDDNDNDNDNDDDNNNNNNNNNNNNNNSVD

SEQ ID NO: 3233878 - protein, 6 aa, Plasmodium falciparum
LSDEQK

SEQ ID NO: 3233879 - protein, 13 aa, Plasmodium falciparum
LSDHNKKNNIKNN

SEQ ID NO: 3233880 - protein, 41 aa, Plasmodium falciparum
LSDKKSNMQDNNKGLKVTTNKTNLKNKLGNNTKQIKQGANP

SEQ ID NO: 3233881 - protein, 5 aa, Plasmodium falciparum
LSDKL

SEQ ID NO: 3233882 - protein, 31 aa, Plasmodium falciparum
LSDNDGDGTSAPVAQHASRDAPHTSTANGSI

SEQ ID NO: 3233883 - protein, 22 aa, Plasmodium falciparum
LSDNEKEKEKEKEKEKEKENKE

SEQ ID NO: 3233884 - protein, 6 aa, Plasmodium falciparum
LSDNET

SEQ ID NO: 3233885 - protein, 17 aa, Plasmodium falciparum
LSDNNENVQNKEIEKKN

SEQ ID NO: 3233886 - protein, 7 aa, Plasmodium falciparum
LSDNQED

SEQ ID NO: 3233887 - protein, 12 aa, Plasmodium falciparum
LSDPNKKENETY

SEQ ID NO: 3233888 - protein, 9 aa, Plasmodium falciparum
LSDSPDKSL

SEQ ID NO: 3233889 - protein, 6 aa, Plasmodium falciparum
LSDSQN

SEQ ID NO: 3233890 - protein, 10 aa, Plasmodium falciparum
LSDSSKRSED

SEQ ID NO: 3233891 - protein, 15 aa, Plasmodium falciparum
LSDSSTHNGTNNNNI

SEQ ID NO: 3233892 - protein, 5 aa, Plasmodium falciparum
LSDTD

SEQ ID NO: 3233893 - protein, 12 aa, Plasmodium falciparum
LSDYDSGDDYDY

SEQ ID NO: 3233894 - protein, 7 aa, Plasmodium falciparum
LSEAQTR

SEQ ID NO: 3233895 - protein, 7 aa, Plasmodium falciparum
LSEASCD

SEQ ID NO: 3233896 - protein, 5 aa, Plasmodium falciparum
LSECK

SEQ ID NO: 3233897 - protein, 9 aa, Plasmodium falciparum
LSEDDYEKN

SEQ ID NO: 3233898 - protein, 5 aa, Plasmodium falciparum
LSEDN

SEQ ID NO: 3233899 - protein, 32 aa, Plasmodium falciparum
LSEDNKNDDKKKQHKREQKKKQKNKKTKKNNI

SEQ ID NO: 3233900 - protein, 5 aa, Plasmodium falciparum
LSEED

SEQ ID NO: 3233901 - protein, 9 aa, Plasmodium falciparum
LSEEKKETS

SEQ ID NO: 3233902 - protein, 5 aa, Plasmodium falciparum
LSEES

SEQ ID NO: 3233903 - protein, 5 aa, Plasmodium falciparum
LSEGT

SEQ ID NO: 3233904 - protein, 33 aa, Plasmodium falciparum
LSEKNSEQARRKKKKDYKEQISSHNYNKTNSEH

SEQ ID NO: 3233905 - protein, 9 aa, Plasmodium falciparum
LSEKSKRKS

SEQ ID NO: 3233906 - protein, 4 aa, Plasmodium falciparum
LSEN

SEQ ID NO: 3233907 - protein, 5 aa, Plasmodium falciparum
LSENK

SEQ ID NO: 3233908 - protein, 67 aa, Plasmodium falciparum
LSENNQNVDNNQSGDNNQNVDNNQSGDNNQNVDNNQNVDNSQNVDNSQNVENNESANSNPDNIDDGV

SEQ ID NO: 3233909 - protein, 6 aa, Plasmodium falciparum
LSENSI

SEQ ID NO: 3233910 - protein, 6 aa, Plasmodium falciparum
LSEPNV

SEQ ID NO: 3233911 - protein, 16 aa, Plasmodium falciparum
LSEPPQIKYRPVKQTK

SEQ ID NO: 3233912 - protein, 8 aa, Plasmodium falciparum
LSEQKHHN

SEQ ID NO: 3233913 - protein, 19 aa, Plasmodium falciparum
LSESEREYARNKANEIEDK

SEQ ID NO: 3233914 - protein, 8 aa, Plasmodium falciparum
LSETEKDH

SEQ ID NO: 3233915 - protein, 12 aa, Plasmodium falciparum
LSGDEKKEEDSI

SEQ ID NO: 3233916 - protein, 12 aa, Plasmodium falciparum
LSGDESSSETRG

SEQ ID NO: 3233917 - protein, 15 aa, Plasmodium falciparum
LSGDNNIKKNKKNRW

SEQ ID NO: 3233918 - protein, 7 aa, Plasmodium falciparum
LSGDSND

SEQ ID NO: 3233919 - protein, 9 aa, Plasmodium falciparum
LSGEKTEDI

SEQ ID NO: 3233920 - protein, 9 aa, Plasmodium falciparum
LSGGQKQKI

SEQ ID NO: 3233921 - protein, 6 aa, Plasmodium falciparum
LSGKLE

SEQ ID NO: 3233922 - protein, 5 aa, Plasmodium falciparum
LSGLG

SEQ ID NO: 3233923 - protein, 8 aa, Plasmodium falciparum
LSGNDNSR

SEQ ID NO: 3233924 - protein, 8 aa, Plasmodium falciparum
LSGNESQV

SEQ ID NO: 3233925 - protein, 7 aa, Plasmodium falciparum
LSGNQPI

SEQ ID NO: 3233926 - protein, 4 aa, Plasmodium falciparum
LSGP

SEQ ID NO: 3233927 - protein, 7 aa, Plasmodium falciparum
LSGQGLK

SEQ ID NO: 3233928 - protein, 6 aa, Plasmodium falciparum
LSGSNV

SEQ ID NO: 3233929 - protein, 12 aa, Plasmodium falciparum
LSGTTGKEESEL

SEQ ID NO: 3233930 - protein, 10 aa, Plasmodium falciparum
LSKDKSPYVR

SEQ ID NO: 3233931 - protein, 10 aa, Plasmodium falciparum
LSKEETKETM

SEQ ID NO: 3233932 - protein, 13 aa, Plasmodium falciparum
LSKENEKKQPFST

SEQ ID NO: 3233933 - protein, 5 aa, Plasmodium falciparum
LSKKE

SEQ ID NO: 3233934 - protein, 13 aa, Plasmodium falciparum
LSKKKNRNHKNNE

SEQ ID NO: 3233935 - protein, 5 aa, Plasmodium falciparum
LSKKT

SEQ ID NO: 3233936 - protein, 9 aa, Plasmodium falciparum
LSKKTTNDY

SEQ ID NO: 3233937 - protein, 8 aa, Plasmodium falciparum
LSKNKDED

SEQ ID NO: 3233938 - protein, 21 aa, Plasmodium falciparum
LSKNNNNNNNNNNNHYNDDGN

SEQ ID NO: 3233939 - protein, 8 aa, Plasmodium falciparum
LSKNRNNL

SEQ ID NO: 3233940 - protein, 7 aa, Plasmodium falciparum
LSKNSDK

SEQ ID NO: 3233941 - protein, 8 aa, Plasmodium falciparum
LSKQENNI

SEQ ID NO: 3233942 - protein, 8 aa, Plasmodium falciparum
LSKSEKQS

SEQ ID NO: 3233943 - protein, 6 aa, Plasmodium falciparum
LSKSRY

SEQ ID NO: 3233944 - protein, 10 aa, Plasmodium falciparum
LSKSSSAIGS

SEQ ID NO: 3233945 - protein, 7 aa, Plasmodium falciparum
LSKTNKL

SEQ ID NO: 3233946 - protein, 13 aa, Plasmodium falciparum
LSLPDEKLDNNDD

SEQ ID NO: 3233947 - protein, 6 aa, Plasmodium falciparum
LSLPSS

SEQ ID NO: 3233948 - protein, 12 aa, Plasmodium falciparum
LSNDGNNMKNSS

SEQ ID NO: 3233949 - protein, 23 aa, Plasmodium falciparum
LSNDQLSNDQLSNDKVNNEQLPN

SEQ ID NO: 3233950 - protein, 8 aa, Plasmodium falciparum
LSNEANSY

SEQ ID NO: 3233951 - protein, 9 aa, Plasmodium falciparum
LSNECNNRE

SEQ ID NO: 3233952 - protein, 7 aa, Plasmodium falciparum
LSNEDMK

SEQ ID NO: 3233953 - protein, 6 aa, Plasmodium falciparum
LSNENN

SEQ ID NO: 3233954 - protein, 7 aa, Plasmodium falciparum
LSNEPQE

SEQ ID NO: 3233955 - protein, 14 aa, Plasmodium falciparum
LSNGGKDDNNEQPL

SEQ ID NO: 3233956 - protein, 8 aa, Plasmodium falciparum
LSNGVDKK

SEQ ID NO: 3233957 - protein, 12 aa, Plasmodium falciparum
LSNHSNSSYMNN

SEQ ID NO: 3233958 - protein, 16 aa, Plasmodium falciparum
LSNKENEYNYKETNNN

SEQ ID NO: 3233959 - protein, 9 aa, Plasmodium falciparum
LSNKENKYK

SEQ ID NO: 3233960 - protein, 14 aa, Plasmodium falciparum
LSNKKENNNNNSNY

SEQ ID NO: 3233961 - protein, 6 aa, Plasmodium falciparum
LSNKSK

SEQ ID NO: 3233962 - protein, 6 aa, Plasmodium falciparum
LSNNKK

SEQ ID NO: 3233963 - protein, 10 aa, Plasmodium falciparum
LSNNKNNNLD

SEQ ID NO: 3233964 - protein, 8 aa, Plasmodium falciparum
LSNNNKNK

SEQ ID NO: 3233965 - protein, 9 aa, Plasmodium falciparum
LSNNNNDSC

SEQ ID NO: 3233966 - protein, 8 aa, Plasmodium falciparum
LSNNNPFN

SEQ ID NO: 3233967 - protein, 8 aa, Plasmodium falciparum
LSNNQNKS

SEQ ID NO: 3233968 - protein, 11 aa, Plasmodium falciparum
LSNPNSDDEYI

SEQ ID NO: 3233969 - protein, 6 aa, Plasmodium falciparum
LSNPRS

SEQ ID NO: 3233970 - protein, 17 aa, Plasmodium falciparum
LSNRTTNHYSSKDKQIS

SEQ ID NO: 3233971 - protein, 7 aa, Plasmodium falciparum
LSNSDYN

SEQ ID NO: 3233972 - protein, 5 aa, Plasmodium falciparum
LSNSK

SEQ ID NO: 3233973 - protein, 24 aa, Plasmodium falciparum
LSNSLNQGITNANANANTITNTNA

SEQ ID NO: 3233974 - protein, 7 aa, Plasmodium falciparum
LSNSSSH

SEQ ID NO: 3233975 - protein, 4 aa, Plasmodium falciparum
LSNT

SEQ ID NO: 3233976 - protein, 8 aa, Plasmodium falciparum
LSNTEPRE

SEQ ID NO: 3233977 - protein, 7 aa, Plasmodium falciparum
LSNYNGR

SEQ ID NO: 3233978 - protein, 9 aa, Plasmodium falciparum
LSNYSSDKS

SEQ ID NO: 3233979 - protein, 6 aa, Plasmodium falciparum
LSPEEF

SEQ ID NO: 3233980 - protein, 16 aa, Plasmodium falciparum
LSPEQKRTLKETLENT

SEQ ID NO: 3233981 - protein, 11 aa, Plasmodium falciparum
LSPKKSDDENI

SEQ ID NO: 3233982 - protein, 4 aa, Plasmodium falciparum
LSPM

SEQ ID NO: 3233983 - protein, 4 aa, Plasmodium falciparum
LSPN

SEQ ID NO: 3233984 - protein, 5 aa, Plasmodium falciparum
LSPNN

SEQ ID NO: 3233985 - protein, 7 aa, Plasmodium falciparum
LSPNYDS

SEQ ID NO: 3233986 - protein, 6 aa, Plasmodium falciparum
LSPPSY

SEQ ID NO: 3233987 - protein, 24 aa, Plasmodium falciparum
LSPQNNDYISQNNSSSSHKDNNTL

SEQ ID NO: 3233988 - protein, 4 aa, Plasmodium falciparum
LSPS

SEQ ID NO: 3233989 - protein, 6 aa, Plasmodium falciparum
LSPYDN

SEQ ID NO: 3233990 - protein, 14 aa, Plasmodium falciparum
LSQEDHTNKQQHNV

SEQ ID NO: 3233991 - protein, 8 aa, Plasmodium falciparum
LSQETANS

SEQ ID NO: 3233992 - protein, 103 aa, Plasmodium falciparum
LSQHNDKSSQHNDKSSQHNDKSSQHNDKSSQHNDKSSQHNDKSSQHNDKSSQHNDKSSQHNDISSEHNDKSSDHNDKSSDHNDKSSDHNDKSSEQKEVSPNPH

SEQ ID NO: 3233993 - protein, 5 aa, Plasmodium falciparum
LSQNE

SEQ ID NO: 3233994 - protein, 9 aa, Plasmodium falciparum
LSQNEDEQN

SEQ ID NO: 3233995 - protein, 8 aa, Plasmodium falciparum
LSQNKKEY

SEQ ID NO: 3233996 - protein, 4 aa, Plasmodium falciparum
LSQP

SEQ ID NO: 3233997 - protein, 44 aa, Plasmodium falciparum
LSQTNEDKKNITKNNNFNSNKNNINNINNSNNINNNNNNNNINN

SEQ ID NO: 3233998 - protein, 11 aa, Plasmodium falciparum
LSQYPKDTNFE

SEQ ID NO: 3233999 - protein, 20 aa, Plasmodium falciparum
LSRATYPKDESPKGTTSPDP

SEQ ID NO: 3234000 - protein, 14 aa, Plasmodium falciparum
LSRDPDDISNFFSL

SEQ ID NO: 3234001 - protein, 5 aa, Plasmodium falciparum
LSREE

SEQ ID NO: 3234002 - protein, 40 aa, Plasmodium falciparum
LSREENKISPKDDSTGKNNTTNNNISNNNNISNNINNNNN

SEQ ID NO: 3234003 - protein, 8 aa, Plasmodium falciparum
LSREKAAN

SEQ ID NO: 3234004 - protein, 9 aa, Plasmodium falciparum
LSREQDIRE

SEQ ID NO: 3234005 - protein, 5 aa, Plasmodium falciparum
LSREY

SEQ ID NO: 3234006 - protein, 12 aa, Plasmodium falciparum
LSSAHQNKRIKY

SEQ ID NO: 3234007 - protein, 10 aa, Plasmodium falciparum
LSSDEDEINN

SEQ ID NO: 3234008 - protein, 10 aa, Plasmodium falciparum
LSSDGKKSEY

SEQ ID NO: 3234009 - protein, 22 aa, Plasmodium falciparum
LSSENESSSEYTDNSLEGESDE

SEQ ID NO: 3234010 - protein, 10 aa, Plasmodium falciparum
LSSEQKTPFN

SEQ ID NO: 3234011 - protein, 4 aa, Plasmodium falciparum
LSSG

SEQ ID NO: 3234012 - protein, 17 aa, Plasmodium falciparum
LSSGATSNTGTQQSGNL

SEQ ID NO: 3234013 - protein, 18 aa, Plasmodium falciparum
LSSGSSSLEQHSKEDVKK

SEQ ID NO: 3234014 - protein, 16 aa, Plasmodium falciparum
LSSGTTTNTSTQQSGN

SEQ ID NO: 3234015 - protein, 4 aa, Plasmodium falciparum
LSSK

SEQ ID NO: 3234016 - protein, 11 aa, Plasmodium falciparum
LSSKKETEEYV

SEQ ID NO: 3234017 - protein, 5 aa, Plasmodium falciparum
LSSKN

SEQ ID NO: 3234018 - protein, 8 aa, Plasmodium falciparum
LSSKNNMS

SEQ ID NO: 3234019 - protein, 11 aa, Plasmodium falciparum
LSSKSKKRIST

SEQ ID NO: 3234020 - protein, 54 aa, Plasmodium falciparum
LSSKSTLTFTGSSSSSSSSSTSSSSSSSTSSSSSSSTSSSSSSSTSSPSPGVSP

SEQ ID NO: 3234021 - protein, 4 aa, Plasmodium falciparum
LSSM

SEQ ID NO: 3234022 - protein, 11 aa, Plasmodium falciparum
LSSNENSNKMT

SEQ ID NO: 3234023 - protein, 11 aa, Plasmodium falciparum
LSSNGRGGYTG

SEQ ID NO: 3234024 - protein, 6 aa, Plasmodium falciparum
LSSNIQ

SEQ ID NO: 3234025 - protein, 9 aa, Plasmodium falciparum
LSSRNHGYA

SEQ ID NO: 3234026 - protein, 16 aa, Plasmodium falciparum
LSSSNNINDNKITEPI

SEQ ID NO: 3234027 - protein, 10 aa, Plasmodium falciparum
LSSSNNTDDI

SEQ ID NO: 3234028 - protein, 9 aa, Plasmodium falciparum
LSSSNRYQY

SEQ ID NO: 3234029 - protein, 9 aa, Plasmodium falciparum
LSSSNSSNN

SEQ ID NO: 3234030 - protein, 12 aa, Plasmodium falciparum
LSSSPKGSKNND

SEQ ID NO: 3234031 - protein, 8 aa, Plasmodium falciparum
LSSSQSNI

SEQ ID NO: 3234032 - protein, 10 aa, Plasmodium falciparum
LSSSSTSSNI

SEQ ID NO: 3234033 - protein, 15 aa, Plasmodium falciparum
LSSTCSSETEDENGS

SEQ ID NO: 3234034 - protein, 11 aa, Plasmodium falciparum
LSSTDSKLNKR

SEQ ID NO: 3234035 - protein, 7 aa, Plasmodium falciparum
LSSTHQN

SEQ ID NO: 3234036 - protein, 5 aa, Plasmodium falciparum
LSSTN

SEQ ID NO: 3234037 - protein, 10 aa, Plasmodium falciparum
LSSTSGDNLA

SEQ ID NO: 3234038 - protein, 5 aa, Plasmodium falciparum
LSSYN

SEQ ID NO: 3234039 - protein, 9 aa, Plasmodium falciparum
LSTDDEDYR

SEQ ID NO: 3234040 - protein, 7 aa, Plasmodium falciparum
LSTDTDD

SEQ ID NO: 3234041 - protein, 6 aa, Plasmodium falciparum
LSTEEN

SEQ ID NO: 3234042 - protein, 8 aa, Plasmodium falciparum
LSTGNTTG

SEQ ID NO: 3234043 - protein, 10 aa, Plasmodium falciparum
LSTGTSSTQA

SEQ ID NO: 3234044 - protein, 15 aa, Plasmodium falciparum
LSTGTTSQGSTSSRH

SEQ ID NO: 3234045 - protein, 5 aa, Plasmodium falciparum
LSTIE

SEQ ID NO: 3234046 - protein, 9 aa, Plasmodium falciparum
LSTKDNDNI

SEQ ID NO: 3234047 - protein, 5 aa, Plasmodium falciparum
LSTKE

SEQ ID NO: 3234048 - protein, 12 aa, Plasmodium falciparum
LSTKKKKSSHKC

SEQ ID NO: 3234049 - protein, 5 aa, Plasmodium falciparum
LSTNH

SEQ ID NO: 3234050 - protein, 4 aa, Plasmodium falciparum
LSTP

SEQ ID NO: 3234051 - protein, 13 aa, Plasmodium falciparum
LSTQKNKNKWTSS

SEQ ID NO: 3234052 - protein, 4 aa, Plasmodium falciparum
LSTR

SEQ ID NO: 3234053 - protein, 17 aa, Plasmodium falciparum
LSTTDKTNTKPKGPMTY

SEQ ID NO: 3234054 - protein, 6 aa, Plasmodium falciparum
LSTTSD

SEQ ID NO: 3234055 - protein, 14 aa, Plasmodium falciparum
LSTYENTEQTKKGN

SEQ ID NO: 3234056 - protein, 23 aa, Plasmodium falciparum
LSTYSDDTNVSDDKKKKNNNNIN

SEQ ID NO: 3234057 - protein, 10 aa, Plasmodium falciparum
LSVDEKHKKK

SEQ ID NO: 3234058 - protein, 10 aa, Plasmodium falciparum
LSVTNKNIPD

SEQ ID NO: 3234059 - protein, 15 aa, Plasmodium falciparum
LSYDSSDKSDQSLRK

SEQ ID NO: 3234060 - protein, 4 aa, Plasmodium falciparum
LSYE

SEQ ID NO: 3234061 - protein, 10 aa, Plasmodium falciparum
LSYPDSPSQL

SEQ ID NO: 3234062 - protein, 10 aa, Plasmodium falciparum
LTAEKTGEIA

SEQ ID NO: 3234063 - protein, 8 aa, Plasmodium falciparum
LTAQKTGA

SEQ ID NO: 3234064 - protein, 9 aa, Plasmodium falciparum
LTDAQKKKK

SEQ ID NO: 3234065 - protein, 26 aa, Plasmodium falciparum
LTDDDDDDDEEEEEEEEEENENNEIN

SEQ ID NO: 3234066 - protein, 19 aa, Plasmodium falciparum
LTDDGEEGSIDEADPYSDY

SEQ ID NO: 3234067 - protein, 4 aa, Plasmodium falciparum
LTDE

SEQ ID NO: 3234068 - protein, 5 aa, Plasmodium falciparum
LTDEE

SEQ ID NO: 3234069 - protein, 9 aa, Plasmodium falciparum
LTDPSKNNM

SEQ ID NO: 3234070 - protein, 7 aa, Plasmodium falciparum
LTDQTNL

SEQ ID NO: 3234071 - protein, 7 aa, Plasmodium falciparum
LTDSDDK

SEQ ID NO: 3234072 - protein, 6 aa, Plasmodium falciparum
LTEDGN

SEQ ID NO: 3234073 - protein, 5 aa, Plasmodium falciparum
LTEEG

SEQ ID NO: 3234074 - protein, 6 aa, Plasmodium falciparum
LTELSS

SEQ ID NO: 3234075 - protein, 30 aa, Plasmodium falciparum
LTENSDYLSSNDDYEEDVTKADEQENYYEN

SEQ ID NO: 3234076 - protein, 6 aa, Plasmodium falciparum
LTENTK

SEQ ID NO: 3234077 - protein, 10 aa, Plasmodium falciparum
LTESGNNNIP

SEQ ID NO: 3234078 - protein, 5 aa, Plasmodium falciparum
LTETN

SEQ ID NO: 3234079 - protein, 19 aa, Plasmodium falciparum
LTGAAISGQNQNGINNNQN

SEQ ID NO: 3234080 - protein, 5 aa, Plasmodium falciparum
LTGDD

SEQ ID NO: 3234081 - protein, 9 aa, Plasmodium falciparum
LTGGKSYEN

SEQ ID NO: 3234082 - protein, 7 aa, Plasmodium falciparum
LTGPRQD

SEQ ID NO: 3234083 - protein, 6 aa, Plasmodium falciparum
LTHQQT

SEQ ID NO: 3234084 - protein, 6 aa, Plasmodium falciparum
LTIPPN

SEQ ID NO: 3234085 - protein, 4 aa, Plasmodium falciparum
LTKE

SEQ ID NO: 3234086 - protein, 11 aa, Plasmodium falciparum
LTKEDKKKMNN

SEQ ID NO: 3234087 - protein, 8 aa, Plasmodium falciparum
LTKEKDEI

SEQ ID NO: 3234088 - protein, 10 aa, Plasmodium falciparum
LTKEKNESIK

SEQ ID NO: 3234089 - protein, 12 aa, Plasmodium falciparum
LTKHKKKSLYNE

SEQ ID NO: 3234090 - protein, 17 aa, Plasmodium falciparum
LTKKGAEARYKDNDENY

SEQ ID NO: 3234091 - protein, 7 aa, Plasmodium falciparum
LTKQGKK

SEQ ID NO: 3234092 - protein, 13 aa, Plasmodium falciparum
LTKRRNNYYGTPN

SEQ ID NO: 3234093 - protein, 9 aa, Plasmodium falciparum
LTNDDNDEK

SEQ ID NO: 3234094 - protein, 4 aa, Plasmodium falciparum
LTNE

SEQ ID NO: 3234095 - protein, 5 aa, Plasmodium falciparum
LTNEF

SEQ ID NO: 3234096 - protein, 12 aa, Plasmodium falciparum
LTNEKKKKKNFK

SEQ ID NO: 3234097 - protein, 10 aa, Plasmodium falciparum
LTNEKSGNTF

SEQ ID NO: 3234098 - protein, 6 aa, Plasmodium falciparum
LTNKGS

SEQ ID NO: 3234099 - protein, 26 aa, Plasmodium falciparum
LTNKNDEKYISTDEYSTDSEKSGKEI

SEQ ID NO: 3234100 - protein, 8 aa, Plasmodium falciparum
LTNNKSHE

SEQ ID NO: 3234101 - protein, 24 aa, Plasmodium falciparum
LTNNPNINKNRNSKFKTDSNQGNY

SEQ ID NO: 3234102 - protein, 8 aa, Plasmodium falciparum
LTNNTRKR

SEQ ID NO: 3234103 - protein, 8 aa, Plasmodium falciparum
LTNNTRSI

SEQ ID NO: 3234104 - protein, 4 aa, Plasmodium falciparum
LTNQ

SEQ ID NO: 3234105 - protein, 6 aa, Plasmodium falciparum
LTNQQI

SEQ ID NO: 3234106 - protein, 10 aa, Plasmodium falciparum
LTNQTEEPKN

SEQ ID NO: 3234107 - protein, 4 aa, Plasmodium falciparum
LTNS

SEQ ID NO: 3234108 - protein, 5 aa, Plasmodium falciparum
LTNSD

SEQ ID NO: 3234109 - protein, 7 aa, Plasmodium falciparum
LTNSDPI

SEQ ID NO: 3234110 - protein, 16 aa, Plasmodium falciparum
LTNSKKKKKKKKRENH

SEQ ID NO: 3234111 - protein, 6 aa, Plasmodium falciparum
LTNSNA

SEQ ID NO: 3234112 - protein, 7 aa, Plasmodium falciparum
LTNSSNI

SEQ ID NO: 3234113 - protein, 8 aa, Plasmodium falciparum
LTNSTQEY

SEQ ID NO: 3234114 - protein, 10 aa, Plasmodium falciparum
LTNTGNVTTT

SEQ ID NO: 3234115 - protein, 8 aa, Plasmodium falciparum
LTPATNTL

SEQ ID NO: 3234116 - protein, 6 aa, Plasmodium falciparum
LTPDDE

SEQ ID NO: 3234117 - protein, 7 aa, Plasmodium falciparum
LTPTTKR

SEQ ID NO: 3234118 - protein, 5 aa, Plasmodium falciparum
LTQEA

SEQ ID NO: 3234119 - protein, 21 aa, Plasmodium falciparum
LTQPSGEKQAECEKYTPPDDE

SEQ ID NO: 3234120 - protein, 4 aa, Plasmodium falciparum
LTQT

SEQ ID NO: 3234121 - protein, 6 aa, Plasmodium falciparum
LTREQA

SEQ ID NO: 3234122 - protein, 27 aa, Plasmodium falciparum
LTRESTKLDTSKIKNERRHKKVSDDKN

SEQ ID NO: 3234123 - protein, 4 aa, Plasmodium falciparum
LTRY

SEQ ID NO: 3234124 - protein, 36 aa, Plasmodium falciparum
LTSAGTSSESPQGGSESSRASDVSQGNGGDDITTTE

SEQ ID NO: 3234125 - protein, 4 aa, Plasmodium falciparum
LTSE

SEQ ID NO: 3234126 - protein, 5 aa, Plasmodium falciparum
LTSGE

SEQ ID NO: 3234127 - protein, 21 aa, Plasmodium falciparum
LTSGNSSSKNSKKNSNNESIQ

SEQ ID NO: 3234128 - protein, 5 aa, Plasmodium falciparum
LTSHH

SEQ ID NO: 3234129 - protein, 6 aa, Plasmodium falciparum
LTSNEE

SEQ ID NO: 3234130 - protein, 9 aa, Plasmodium falciparum
LTSNKEKTN

SEQ ID NO: 3234131 - protein, 11 aa, Plasmodium falciparum
LTSNNKNTEYY

SEQ ID NO: 3234132 - protein, 14 aa, Plasmodium falciparum
LTSRSSDAKENKNY

SEQ ID NO: 3234133 - protein, 6 aa, Plasmodium falciparum
LTSSQK

SEQ ID NO: 3234134 - protein, 26 aa, Plasmodium falciparum
LTSTNGKKGKKQALQARYQDDGSGNY

SEQ ID NO: 3234135 - protein, 23 aa, Plasmodium falciparum
LTSTRGKQNGELQKRYKGDAKKN

SEQ ID NO: 3234136 - protein, 33 aa, Plasmodium falciparum
LTSTSQDNNIDTASSLSSKSFSASYDEDEHSNI

SEQ ID NO: 3234137 - protein, 6 aa, Plasmodium falciparum
LTTDKK

SEQ ID NO: 3234138 - protein, 6 aa, Plasmodium falciparum
LTTKDE

SEQ ID NO: 3234139 - protein, 11 aa, Plasmodium falciparum
LTTKSNVQNTS

SEQ ID NO: 3234140 - protein, 13 aa, Plasmodium falciparum
LTTPGFGQSGGSN

SEQ ID NO: 3234141 - protein, 7 aa, Plasmodium falciparum
LTTPGNL

SEQ ID NO: 3234142 - protein, 6 aa, Plasmodium falciparum
LTTQKK

SEQ ID NO: 3234143 - protein, 13 aa, Plasmodium falciparum
LTTSAKTAKEAVG

SEQ ID NO: 3234144 - protein, 20 aa, Plasmodium falciparum
LTTSGKNVDKAKARYNDPKG

SEQ ID NO: 3234145 - protein, 7 aa, Plasmodium falciparum
LTTSNED

SEQ ID NO: 3234146 - protein, 4 aa, Plasmodium falciparum
LTTT

SEQ ID NO: 3234147 - protein, 27 aa, Plasmodium falciparum
LTTTTTTNNNNNNNNDNNNDNNDNNIN

SEQ ID NO: 3234148 - protein, 15 aa, Plasmodium falciparum
LTTTYKQKEKGKKNY

SEQ ID NO: 3234149 - protein, 4 aa, Plasmodium falciparum
LTYD

SEQ ID NO: 3234150 - protein, 6 aa, Plasmodium falciparum
LVEPEE

SEQ ID NO: 3234151 - protein, 4 aa, Plasmodium falciparum
LVEQ

SEQ ID NO: 3234152 - protein, 6 aa, Plasmodium falciparum
LVNNEK

SEQ ID NO: 3234153 - protein, 9 aa, Plasmodium falciparum
LVNSGGTTS

SEQ ID NO: 3234154 - protein, 6 aa, Plasmodium falciparum
LVPKGK

SEQ ID NO: 3234155 - protein, 12 aa, Plasmodium falciparum
LVTTKGKLKPSW

SEQ ID NO: 3234156 - protein, 5 aa, Plasmodium falciparum
LYANN

SEQ ID NO: 3234157 - protein, 34 aa, Plasmodium falciparum
LYDDTKNTTKLKNTKDYHNENNKDSDNKQNFKNT

SEQ ID NO: 3234158 - protein, 9 aa, Plasmodium falciparum
LYDEDDEQI

SEQ ID NO: 3234159 - protein, 11 aa, Plasmodium falciparum
LYDEGSKKRIH

SEQ ID NO: 3234160 - protein, 12 aa, Plasmodium falciparum
LYDQNGNNNETI

SEQ ID NO: 3234161 - protein, 13 aa, Plasmodium falciparum
LYDTNKKNISKPF

SEQ ID NO: 3234162 - protein, 24 aa, Plasmodium falciparum
LYEEEDKEHYNKVDKENDSSNIKQ

SEQ ID NO: 3234163 - protein, 14 aa, Plasmodium falciparum
LYEEEKKRNENDNI

SEQ ID NO: 3234164 - protein, 11 aa, Plasmodium falciparum
LYEEEKQSQKI

SEQ ID NO: 3234165 - protein, 6 aa, Plasmodium falciparum
LYEKDG

SEQ ID NO: 3234166 - protein, 6 aa, Plasmodium falciparum
LYENKN

SEQ ID NO: 3234167 - protein, 12 aa, Plasmodium falciparum
LYEPKGDAEGTP

SEQ ID NO: 3234168 - protein, 12 aa, Plasmodium falciparum
LYEPTSSAKPTE

SEQ ID NO: 3234169 - protein, 17 aa, Plasmodium falciparum
LYGGSKKEKEKRKQLDD

SEQ ID NO: 3234170 - protein, 50 aa, Plasmodium falciparum
LYKSESNNIKSNNIKSNNIKSNNIKSNNIKSNNIKSNNIQSNNIKSNNIQ

SEQ ID NO: 3234171 - protein, 4 aa, Plasmodium falciparum
LYNE

SEQ ID NO: 3234172 - protein, 4 aa, Plasmodium falciparum
LYNK

SEQ ID NO: 3234173 - protein, 9 aa, Plasmodium falciparum
LYNNGNNEK

SEQ ID NO: 3234174 - protein, 7 aa, Plasmodium falciparum
LYNQHND

SEQ ID NO: 3234175 - protein, 7 aa, Plasmodium falciparum
LYNSGRN

SEQ ID NO: 3234176 - protein, 5 aa, Plasmodium falciparum
LYNSS

SEQ ID NO: 3234177 - protein, 5 aa, Plasmodium falciparum
LYNTN

SEQ ID NO: 3234178 - protein, 6 aa, Plasmodium falciparum
LYNTSK

SEQ ID NO: 3234179 - protein, 20 aa, Plasmodium falciparum
LYPSTSSVLSSSSNSPLSSS

SEQ ID NO: 3234180 - protein, 9 aa, Plasmodium falciparum
LYSDSDVEY

SEQ ID NO: 3234181 - protein, 13 aa, Plasmodium falciparum
LYSGNKKKEKLEQ

SEQ ID NO: 3234182 - protein, 17 aa, Plasmodium falciparum
LYSGNKKKKQTEREKLE

SEQ ID NO: 3234183 - protein, 8 aa, Plasmodium falciparum
LYSGSSNL

SEQ ID NO: 3234184 - protein, 14 aa, Plasmodium falciparum
LYTSESSYTQSDEI

SEQ ID NO: 3234185 - protein, 7 aa, Plasmodium falciparum
LYTSTTG

SEQ ID NO: 3234186 - protein, 5 aa, Plasmodium falciparum
MADKT

SEQ ID NO: 3234187 - protein, 13 aa, Plasmodium falciparum
MAEATAKGAEAGV

SEQ ID NO: 3234188 - protein, 16 aa, Plasmodium falciparum
MANKKNKKRNLKENHK

SEQ ID NO: 3234189 - protein, 6 aa, Plasmodium falciparum
MASTEK

SEQ ID NO: 3234190 - protein, 4 aa, Plasmodium falciparum
MATG

SEQ ID NO: 3234191 - protein, 22 aa, Plasmodium falciparum
MDDDNEKNNSNNNNNNNNNIGN

SEQ ID NO: 3234192 - protein, 10 aa, Plasmodium falciparum
MDDGDDDDDY

SEQ ID NO: 3234193 - protein, 10 aa, Plasmodium falciparum
MDDGNQIDEH

SEQ ID NO: 3234194 - protein, 6 aa, Plasmodium falciparum
MDDPKY

SEQ ID NO: 3234195 - protein, 15 aa, Plasmodium falciparum
MDDPNGKYKGPGFNN

SEQ ID NO: 3234196 - protein, 7 aa, Plasmodium falciparum
MDDREQS

SEQ ID NO: 3234197 - protein, 9 aa, Plasmodium falciparum
MDDSEGEYH

SEQ ID NO: 3234198 - protein, 27 aa, Plasmodium falciparum
MDDSMNGDNINHGDDINHGDDINHGDD

SEQ ID NO: 3234199 - protein, 5 aa, Plasmodium falciparum
MDDSY

SEQ ID NO: 3234200 - protein, 15 aa, Plasmodium falciparum
MDEAKNKNEHNNDNN

SEQ ID NO: 3234201 - protein, 54 aa, Plasmodium falciparum
MDEHNNDDDNKNDFNNNNNNNNNNKNDFNNNNNNNINNYNNNNINNYNNNINNT

SEQ ID NO: 3234202 - protein, 16 aa, Plasmodium falciparum
MDENINSDNNNNNNNI

SEQ ID NO: 3234203 - protein, 5 aa, Plasmodium falciparum
MDEQN

SEQ ID NO: 3234204 - protein, 7 aa, Plasmodium falciparum
MDESDVE

SEQ ID NO: 3234205 - protein, 10 aa, Plasmodium falciparum
MDGDDNKNVC

SEQ ID NO: 3234206 - protein, 11 aa, Plasmodium falciparum
MDGRNTSQGNF

SEQ ID NO: 3234207 - protein, 55 aa, Plasmodium falciparum
MDIEQNKEMDNERNKEMDNEQNKDMDNERNKEMDNEQNKDMDNERNKEMDNEQIN

SEQ ID NO: 3234208 - protein, 5 aa, Plasmodium falciparum
MDINS

SEQ ID NO: 3234209 - protein, 16 aa, Plasmodium falciparum
MDKDDQNLKSEGEEKN

SEQ ID NO: 3234210 - protein, 8 aa, Plasmodium falciparum
MDKDENQK

SEQ ID NO: 3234211 - protein, 6 aa, Plasmodium falciparum
MDKENS

SEQ ID NO: 3234212 - protein, 25 aa, Plasmodium falciparum
MDKGSKDMTTSTSSRIDNDKNINDY

SEQ ID NO: 3234213 - protein, 9 aa, Plasmodium falciparum
MDKSLAEKV

SEQ ID NO: 3234214 - protein, 10 aa, Plasmodium falciparum
MDKSLAEKVE

SEQ ID NO: 3234215 - protein, 10 aa, Plasmodium falciparum
MDKSSKKKYI

SEQ ID NO: 3234216 - protein, 23 aa, Plasmodium falciparum
MDKTTEKKHTNENVVSSNNKANV

SEQ ID NO: 3234217 - protein, 27 aa, Plasmodium falciparum
MDLTTSQKNIDKKQIEYKDKDNINDKE

SEQ ID NO: 3234218 - protein, 4 aa, Plasmodium falciparum
MDNI

SEQ ID NO: 3234219 - protein, 5 aa, Plasmodium falciparum
MDNIT

SEQ ID NO: 3234220 - protein, 4 aa, Plasmodium falciparum
MDNK

SEQ ID NO: 3234221 - protein, 5 aa, Plasmodium falciparum
MDNLE

SEQ ID NO: 3234222 - protein, 13 aa, Plasmodium falciparum
MDNNEDDNNNNEK

SEQ ID NO: 3234223 - protein, 10 aa, Plasmodium falciparum
MDNNENETNV

SEQ ID NO: 3234224 - protein, 21 aa, Plasmodium falciparum
MDNNNNQMNDDNNQMNDFDDN

SEQ ID NO: 3234225 - protein, 6 aa, Plasmodium falciparum
MDNPQN

SEQ ID NO: 3234226 - protein, 23 aa, Plasmodium falciparum
MDNPSNSNININNGNDANDANDV

SEQ ID NO: 3234227 - protein, 44 aa, Plasmodium falciparum
MDNQSKIVSQGEKNKKKKKKKKKKKKKSQRDKKNHREKENQNEY

SEQ ID NO: 3234228 - protein, 32 aa, Plasmodium falciparum
MDNSMDNNIDNNIDNNIDNNIDNNIDNNIDNN

SEQ ID NO: 3234229 - protein, 7 aa, Plasmodium falciparum
MDNTEMD

SEQ ID NO: 3234230 - protein, 5 aa, Plasmodium falciparum
MDNYE

SEQ ID NO: 3234231 - protein, 7 aa, Plasmodium falciparum
MDPNSDD

SEQ ID NO: 3234232 - protein, 23 aa, Plasmodium falciparum
MDQQTDEYTDDGKKETKKETNIN

SEQ ID NO: 3234233 - protein, 6 aa, Plasmodium falciparum
MDRKSY

SEQ ID NO: 3234234 - protein, 5 aa, Plasmodium falciparum
MDSDE

SEQ ID NO: 3234235 - protein, 5 aa, Plasmodium falciparum
MDSDS

SEQ ID NO: 3234236 - protein, 23 aa, Plasmodium falciparum
MDSMNDNRINENNINNNDNKRHN

SEQ ID NO: 3234237 - protein, 8 aa, Plasmodium falciparum
MDSNMDNN

SEQ ID NO: 3234238 - protein, 7 aa, Plasmodium falciparum
MDSNSSH

SEQ ID NO: 3234239 - protein, 8 aa, Plasmodium falciparum
MDSPENKK

SEQ ID NO: 3234240 - protein, 6 aa, Plasmodium falciparum
MDSQKI

SEQ ID NO: 3234241 - protein, 11 aa, Plasmodium falciparum
MDSSKSPNDHG

SEQ ID NO: 3234242 - protein, 14 aa, Plasmodium falciparum
MDTNEYKEENKREE

SEQ ID NO: 3234243 - protein, 10 aa, Plasmodium falciparum
MDTPTSKETI

SEQ ID NO: 3234244 - protein, 11 aa, Plasmodium falciparum
MDTTPDKSTMN

SEQ ID NO: 3234245 - protein, 5 aa, Plasmodium falciparum
MDYEE

SEQ ID NO: 3234246 - protein, 16 aa, Plasmodium falciparum
MDYNNNNNNKKKKKIN

SEQ ID NO: 3234247 - protein, 20 aa, Plasmodium falciparum
MEAEEQKEVRKKEESNKKDI

SEQ ID NO: 3234248 - protein, 8 aa, Plasmodium falciparum
MECEENKN

SEQ ID NO: 3234249 - protein, 10 aa, Plasmodium falciparum
MEDAKDRSGK

SEQ ID NO: 3234250 - protein, 7 aa, Plasmodium falciparum
MEDNESS

SEQ ID NO: 3234251 - protein, 15 aa, Plasmodium falciparum
MEDNIESDNNNTFGD

SEQ ID NO: 3234252 - protein, 9 aa, Plasmodium falciparum
MEEDDKNVG

SEQ ID NO: 3234253 - protein, 19 aa, Plasmodium falciparum
MEEDETKDVNDDEKKKQVT

SEQ ID NO: 3234254 - protein, 4 aa, Plasmodium falciparum
MEEE

SEQ ID NO: 3234255 - protein, 6 aa, Plasmodium falciparum
MEEEKR

SEQ ID NO: 3234256 - protein, 14 aa, Plasmodium falciparum
MEEHKKKEEKKKIR

SEQ ID NO: 3234257 - protein, 13 aa, Plasmodium falciparum
MEEKTHEKNNHNY

SEQ ID NO: 3234258 - protein, 5 aa, Plasmodium falciparum
MEENN

SEQ ID NO: 3234259 - protein, 20 aa, Plasmodium falciparum
MEERKKKKNSYNDDNNNNNN

SEQ ID NO: 3234260 - protein, 4 aa, Plasmodium falciparum
MEES

SEQ ID NO: 3234261 - protein, 6 aa, Plasmodium falciparum
MEESSN

SEQ ID NO: 3234262 - protein, 10 aa, Plasmodium falciparum
MEETEKENEI

SEQ ID NO: 3234263 - protein, 19 aa, Plasmodium falciparum
MEETNNITGNVQSKKTHNN

SEQ ID NO: 3234264 - protein, 15 aa, Plasmodium falciparum
MEGIGKEKEKENKNM

SEQ ID NO: 3234265 - protein, 4 aa, Plasmodium falciparum
MEGL

SEQ ID NO: 3234266 - protein, 16 aa, Plasmodium falciparum
MEHDEDNLDVDDEDEQ

SEQ ID NO: 3234267 - protein, 13 aa, Plasmodium falciparum
MEKEDKNNKDKMD

SEQ ID NO: 3234268 - protein, 13 aa, Plasmodium falciparum
MEKKGTTKIKDKN

SEQ ID NO: 3234269 - protein, 7 aa, Plasmodium falciparum
MEKKKKK

SEQ ID NO: 3234270 - protein, 35 aa, Plasmodium falciparum
MEKKRKESEGDITGEDENEIKEEQKDNEKEDETYE

SEQ ID NO: 3234271 - protein, 10 aa, Plasmodium falciparum
MEKKSKTNNL

SEQ ID NO: 3234272 - protein, 14 aa, Plasmodium falciparum
MEKNNSPKNEIEKN

SEQ ID NO: 3234273 - protein, 4 aa, Plasmodium falciparum
MEKS

SEQ ID NO: 3234274 - protein, 5 aa, Plasmodium falciparum
MEKSE

SEQ ID NO: 3234275 - protein, 9 aa, Plasmodium falciparum
MENAPDEQY

SEQ ID NO: 3234276 - protein, 8 aa, Plasmodium falciparum
MENDQRKR

SEQ ID NO: 3234277 - protein, 10 aa, Plasmodium falciparum
MENEGNGNIK

SEQ ID NO: 3234278 - protein, 5 aa, Plasmodium falciparum
MENKS

SEQ ID NO: 3234279 - protein, 18 aa, Plasmodium falciparum
MENMNTNNDTNNDTNNNA

SEQ ID NO: 3234280 - protein, 10 aa, Plasmodium falciparum
MENNNDKKKD

SEQ ID NO: 3234281 - protein, 10 aa, Plasmodium falciparum
MENNSSDKIG

SEQ ID NO: 3234282 - protein, 34 aa, Plasmodium falciparum
MENQKNDKKKKIDNKNKEHNNNNNNNYNSDNHYS

SEQ ID NO: 3234283 - protein, 13 aa, Plasmodium falciparum
MENTKNNYNKMKN

SEQ ID NO: 3234284 - protein, 6 aa, Plasmodium falciparum
MEPGYY

SEQ ID NO: 3234285 - protein, 62 aa, Plasmodium falciparum
MEPTKEKKKNNSSNKKKKNKKINERKNKKDTQNNNSDSNNSDSNNNNNYSDCSNNNNNHSDV

SEQ ID NO: 3234286 - protein, 15 aa, Plasmodium falciparum
MEQTEEQQKNQKREM

SEQ ID NO: 3234287 - protein, 10 aa, Plasmodium falciparum
MERKNKKLKD

SEQ ID NO: 3234288 - protein, 53 aa, Plasmodium falciparum
MERRKEEEKKKSRKLEEDEEDDEDEEEDNDEKWKEENKNNSSSSSSSSSNNFN

SEQ ID NO: 3234289 - protein, 11 aa, Plasmodium falciparum
MESEEEKNKIN

SEQ ID NO: 3234290 - protein, 10 aa, Plasmodium falciparum
MESSEKNKTF

SEQ ID NO: 3234291 - protein, 34 aa, Plasmodium falciparum
METEKRDEKVEQNKENKENKENKENHINKENQID

SEQ ID NO: 3234292 - protein, 7 aa, Plasmodium falciparum
METHGPN

SEQ ID NO: 3234293 - protein, 10 aa, Plasmodium falciparum
MGDDTNVDVS

SEQ ID NO: 3234294 - protein, 15 aa, Plasmodium falciparum
MGDGYSSNRLSAQTV

SEQ ID NO: 3234295 - protein, 5 aa, Plasmodium falciparum
MGDKK

SEQ ID NO: 3234296 - protein, 6 aa, Plasmodium falciparum
MGDKLQ

SEQ ID NO: 3234297 - protein, 4 aa, Plasmodium falciparum
MGDM

SEQ ID NO: 3234298 - protein, 6 aa, Plasmodium falciparum
MGEEPQ

SEQ ID NO: 3234299 - protein, 68 aa, Plasmodium falciparum
MGGNNNDNDDNDNNDENNYKPKNTCNDDDNDNDNDGGNKNNSGKYNNSVNKNDNNNNNNSTDGVYGNN

SEQ ID NO: 3234300 - protein, 7 aa, Plasmodium falciparum
MGGQGKL

SEQ ID NO: 3234301 - protein, 4 aa, Plasmodium falciparum
MGGY

SEQ ID NO: 3234302 - protein, 4 aa, Plasmodium falciparum
MGIQ

SEQ ID NO: 3234303 - protein, 22 aa, Plasmodium falciparum
MGNKKDKEEDNNYHNDKNNYSD

SEQ ID NO: 3234304 - protein, 27 aa, Plasmodium falciparum
MGNKKKSKSNYNNNDDDKNSSKEKNNT

SEQ ID NO: 3234305 - protein, 10 aa, Plasmodium falciparum
MGNSQNKYGI

SEQ ID NO: 3234306 - protein, 41 aa, Plasmodium falciparum
MGQNRNETLTKNNNNNNNNNNNNNNNNNNMSLEKKKKKVEK

SEQ ID NO: 3234307 - protein, 11 aa, Plasmodium falciparum
MGQTYSQGTNK

SEQ ID NO: 3234308 - protein, 10 aa, Plasmodium falciparum
MGRTRDEKMK

SEQ ID NO: 3234309 - protein, 10 aa, Plasmodium falciparum
MGTGKTDDIH

SEQ ID NO: 3234310 - protein, 7 aa, Plasmodium falciparum
MHNDDTA

SEQ ID NO: 3234311 - protein, 52 aa, Plasmodium falciparum
MHNKDNDNVEKNEKNDQKMKDMSNRKNNIRSNDNIKTKNSREKKNEHSNNSN

SEQ ID NO: 3234312 - protein, 43 aa, Plasmodium falciparum
MHNTTNGNYANGNYANGNYSKGDYTNGDYTNGDYTNGDYTNGI

SEQ ID NO: 3234313 - protein, 17 aa, Plasmodium falciparum
MHPNDDDISDTSSSCEC

SEQ ID NO: 3234314 - protein, 48 aa, Plasmodium falciparum
MHSGEDEKEELGEPKEKGSKSCQEEEEQDEEEEDEDEEEEEDQGVNNY

SEQ ID NO: 3234315 - protein, 4 aa, Plasmodium falciparum
MIQS

SEQ ID NO: 3234316 - protein, 22 aa, Plasmodium falciparum
MKDDNNTFQGKKKKKKKNESIY

SEQ ID NO: 3234317 - protein, 7 aa, Plasmodium falciparum
MKDEEHR

SEQ ID NO: 3234318 - protein, 8 aa, Plasmodium falciparum
MKDEQKNI

SEQ ID NO: 3234319 - protein, 4 aa, Plasmodium falciparum
MKDH

SEQ ID NO: 3234320 - protein, 8 aa, Plasmodium falciparum
MKDKENKK

SEQ ID NO: 3234321 - protein, 15 aa, Plasmodium falciparum
MKDKRQKCKDKCDKE

SEQ ID NO: 3234322 - protein, 15 aa, Plasmodium falciparum
MKDKRQKHKEERDKN

SEQ ID NO: 3234323 - protein, 15 aa, Plasmodium falciparum
MKDKRQKRKEERDKN

SEQ ID NO: 3234324 - protein, 16 aa, Plasmodium falciparum
MKDKRQKRKEQRDKNI

SEQ ID NO: 3234325 - protein, 14 aa, Plasmodium falciparum
MKDNENSEEKKSID

SEQ ID NO: 3234326 - protein, 9 aa, Plasmodium falciparum
MKDNGKDPF

SEQ ID NO: 3234327 - protein, 11 aa, Plasmodium falciparum
MKDNKKDNITN

SEQ ID NO: 3234328 - protein, 7 aa, Plasmodium falciparum
MKDNNHN

SEQ ID NO: 3234329 - protein, 13 aa, Plasmodium falciparum
MKDSNSGSTGKKV

SEQ ID NO: 3234330 - protein, 18 aa, Plasmodium falciparum
MKDVNNENEENRESSSLL

SEQ ID NO: 3234331 - protein, 5 aa, Plasmodium falciparum
MKEDV

SEQ ID NO: 3234332 - protein, 4 aa, Plasmodium falciparum
MKEK

SEQ ID NO: 3234333 - protein, 5 aa, Plasmodium falciparum
MKEKE

SEQ ID NO: 3234334 - protein, 7 aa, Plasmodium falciparum
MKEKKEN

SEQ ID NO: 3234335 - protein, 8 aa, Plasmodium falciparum
MKEKNDVK

SEQ ID NO: 3234336 - protein, 15 aa, Plasmodium falciparum
MKEKQQKRKEQRDKN

SEQ ID NO: 3234337 - protein, 15 aa, Plasmodium falciparum
MKEKRQKCKEQRDKS

SEQ ID NO: 3234338 - protein, 15 aa, Plasmodium falciparum
MKEKRQKRKEQRDKN

SEQ ID NO: 3234339 - protein, 16 aa, Plasmodium falciparum
MKEKRQKRKEQRDKNV

SEQ ID NO: 3234340 - protein, 7 aa, Plasmodium falciparum
MKENKIN

SEQ ID NO: 3234341 - protein, 12 aa, Plasmodium falciparum
MKENNNKKFNYN

SEQ ID NO: 3234342 - protein, 31 aa, Plasmodium falciparum
MKEQNIKKNEEKKKDADQAKPKLGSKDNSSF

SEQ ID NO: 3234343 - protein, 56 aa, Plasmodium falciparum
MKETYKDEEIKTKNKNNNNNNNNNDNSNNNDNNNDNNNNNNNSNNNDNSNNSNNND

SEQ ID NO: 3234344 - protein, 72 aa, Plasmodium falciparum
MKGEDDDDFDEDDDDFDEDDEDDEDDEDDEDDVDDEDDLDVEDNVDDEYDDEHNHNYNDDKLSENPEKYSNY

SEQ ID NO: 3234345 - protein, 4 aa, Plasmodium falciparum
MKGI

SEQ ID NO: 3234346 - protein, 19 aa, Plasmodium falciparum
MKGKGSHKKNEKHSTNYNQ

SEQ ID NO: 3234347 - protein, 4 aa, Plasmodium falciparum
MKGN

SEQ ID NO: 3234348 - protein, 6 aa, Plasmodium falciparum
MKGSKK

SEQ ID NO: 3234349 - protein, 4 aa, Plasmodium falciparum
MKGT

SEQ ID NO: 3234350 - protein, 25 aa, Plasmodium falciparum
MKHNRDKKEYGNGNEKLNDSEKHNI

SEQ ID NO: 3234351 - protein, 12 aa, Plasmodium falciparum
MKHSTKGDTAIS

SEQ ID NO: 3234352 - protein, 8 aa, Plasmodium falciparum
MKKEKEKN

SEQ ID NO: 3234353 - protein, 5 aa, Plasmodium falciparum
MKKEQ

SEQ ID NO: 3234354 - protein, 8 aa, Plasmodium falciparum
MKKESNQI

SEQ ID NO: 3234355 - protein, 34 aa, Plasmodium falciparum
MKKGEYSRKYKNSKSNESGYASKQTSDSDDSDIE

SEQ ID NO: 3234356 - protein, 10 aa, Plasmodium falciparum
MKKKKKKIKE

SEQ ID NO: 3234357 - protein, 10 aa, Plasmodium falciparum
MKKKKKKKMR

SEQ ID NO: 3234358 - protein, 9 aa, Plasmodium falciparum
MKKKKKMYS

SEQ ID NO: 3234359 - protein, 7 aa, Plasmodium falciparum
MKKKKKN

SEQ ID NO: 3234360 - protein, 12 aa, Plasmodium falciparum
MKKKLEYMKLLK

SEQ ID NO: 3234361 - protein, 12 aa, Plasmodium falciparum
MKKKLQYMKLIK

SEQ ID NO: 3234362 - protein, 12 aa, Plasmodium falciparum
MKKKLQYVKLLK

SEQ ID NO: 3234363 - protein, 10 aa, Plasmodium falciparum
MKKNGSLKKD

SEQ ID NO: 3234364 - protein, 8 aa, Plasmodium falciparum
MKKNKEQE

SEQ ID NO: 3234365 - protein, 6 aa, Plasmodium falciparum
MKKNKK

SEQ ID NO: 3234366 - protein, 11 aa, Plasmodium falciparum
MKKNNNKKNMD

SEQ ID NO: 3234367 - protein, 5 aa, Plasmodium falciparum
MKKNT

SEQ ID NO: 3234368 - protein, 10 aa, Plasmodium falciparum
MKKRNDKKRL

SEQ ID NO: 3234369 - protein, 4 aa, Plasmodium falciparum
MKKS

SEQ ID NO: 3234370 - protein, 140 aa, Plasmodium falciparum
MKKSGEGTQENNDNENNNNDESNNNNNNNNNESNNNNNNNESNNNNNNNNNNESNNNNNNNESNNNNHGNNNNSSNNNNNNNNNNNNNNNNNNNNNNNNNNNNNNNNNDKNEDDENTTGKGKKTEVKKRAGRKRNDSTMY

SEQ ID NO: 3234371 - protein, 8 aa, Plasmodium falciparum
MKKSSNME

SEQ ID NO: 3234372 - protein, 14 aa, Plasmodium falciparum
MKKTKKKKKEQINE

SEQ ID NO: 3234373 - protein, 81 aa, Plasmodium falciparum
MKLENEENGKNAENGKNEENGENGKNAENGKNEQNEQNGKNGKNEENEENGKNEENGKNEENGKNGKNEQNKNNEKTSKKH

SEQ ID NO: 3234374 - protein, 21 aa, Plasmodium falciparum
MKNDDNLKNDDNLKNDAHNNI

SEQ ID NO: 3234375 - protein, 14 aa, Plasmodium falciparum
MKNEQDMNKDDKNN

SEQ ID NO: 3234376 - protein, 11 aa, Plasmodium falciparum
MKNERSPNYNN

SEQ ID NO: 3234377 - protein, 16 aa, Plasmodium falciparum
MKNGAESKEGVAQNEE

SEQ ID NO: 3234378 - protein, 11 aa, Plasmodium falciparum
MKNIKDTDFNN

SEQ ID NO: 3234379 - protein, 7 aa, Plasmodium falciparum
MKNITND

SEQ ID NO: 3234380 - protein, 8 aa, Plasmodium falciparum
MKNKEEKK

SEQ ID NO: 3234381 - protein, 17 aa, Plasmodium falciparum
MKNKKSKDDKVSSTSCG

SEQ ID NO: 3234382 - protein, 60 aa, Plasmodium falciparum
MKNKNKKNKYKNNKNKKNNNENNENNYSTSSKNSSNSTIENYSEEENSNGPLNSSKHNNI

SEQ ID NO: 3234383 - protein, 31 aa, Plasmodium falciparum
MKNKNKNKKNNKNVRRNEYPNYTSSSKDGVS

SEQ ID NO: 3234384 - protein, 5 aa, Plasmodium falciparum
MKNKS

SEQ ID NO: 3234385 - protein, 44 aa, Plasmodium falciparum
MKNNDGKNEDNNNNKNNNNNNNNNNNNNNNNSNDNNNNRNGNNN

SEQ ID NO: 3234386 - protein, 11 aa, Plasmodium falciparum
MKNNPEKAKAH

SEQ ID NO: 3234387 - protein, 10 aa, Plasmodium falciparum
MKNPSNNSFN

SEQ ID NO: 3234388 - protein, 13 aa, Plasmodium falciparum
MKNPYPKKLSDEV

SEQ ID NO: 3234389 - protein, 10 aa, Plasmodium falciparum
MKNQDEEQNE

SEQ ID NO: 3234390 - protein, 4 aa, Plasmodium falciparum
MKNR

SEQ ID NO: 3234391 - protein, 5 aa, Plasmodium falciparum
MKNSN

SEQ ID NO: 3234392 - protein, 11 aa, Plasmodium falciparum
MKNSQNTNPID

SEQ ID NO: 3234393 - protein, 8 aa, Plasmodium falciparum
MKNTPSTN

SEQ ID NO: 3234394 - protein, 7 aa, Plasmodium falciparum
MKNYSDS

SEQ ID NO: 3234395 - protein, 17 aa, Plasmodium falciparum
MKNYTAEDDNNNENYNN

SEQ ID NO: 3234396 - protein, 17 aa, Plasmodium falciparum
MKPEDDDDQQDYENMKN

SEQ ID NO: 3234397 - protein, 16 aa, Plasmodium falciparum
MKPEHKKEQQQGQSQN

SEQ ID NO: 3234398 - protein, 9 aa, Plasmodium falciparum
MKPKTPTKL

SEQ ID NO: 3234399 - protein, 4 aa, Plasmodium falciparum
MKPS

SEQ ID NO: 3234400 - protein, 5 aa, Plasmodium falciparum
MKQEN

SEQ ID NO: 3234401 - protein, 7 aa, Plasmodium falciparum
MKQSDNN

SEQ ID NO: 3234402 - protein, 80 aa, Plasmodium falciparum
MKRGEKNVEQKNNTMDNNNNDENNGHSGDEKSGHHNDDQKSGHHNDDQKSVHSDDQKSVHSDDQKSVHSDDQKSVHSDDE

SEQ ID NO: 3234403 - protein, 19 aa, Plasmodium falciparum
MKRKKKMKKKKKKKIPEKK

SEQ ID NO: 3234404 - protein, 8 aa, Plasmodium falciparum
MKRKNNSI

SEQ ID NO: 3234405 - protein, 22 aa, Plasmodium falciparum
MKRNNSNKKMKYKKKQIKSSSL

SEQ ID NO: 3234406 - protein, 7 aa, Plasmodium falciparum
MKRSTKE

SEQ ID NO: 3234407 - protein, 14 aa, Plasmodium falciparum
MKSDQEYNENEKDH

SEQ ID NO: 3234408 - protein, 7 aa, Plasmodium falciparum
MKSEDSS

SEQ ID NO: 3234409 - protein, 8 aa, Plasmodium falciparum
MKSKEEKP

SEQ ID NO: 3234410 - protein, 12 aa, Plasmodium falciparum
MKSKRSKRRNRR

SEQ ID NO: 3234411 - protein, 8 aa, Plasmodium falciparum
MKSNENIK

SEQ ID NO: 3234412 - protein, 16 aa, Plasmodium falciparum
MKSNNDDDNNNNNNNH

SEQ ID NO: 3234413 - protein, 10 aa, Plasmodium falciparum
MKSPQNKNDK

SEQ ID NO: 3234414 - protein, 21 aa, Plasmodium falciparum
MKSSDKLSSSNEADEPNKMQE

SEQ ID NO: 3234415 - protein, 8 aa, Plasmodium falciparum
MKTKTIKD

SEQ ID NO: 3234416 - protein, 28 aa, Plasmodium falciparum
MKTNNKIKRNYSYKNNHKNNNSNISNKA

SEQ ID NO: 3234417 - protein, 7 aa, Plasmodium falciparum
MKTSNEK

SEQ ID NO: 3234418 - protein, 8 aa, Plasmodium falciparum
MKTTKDNV

SEQ ID NO: 3234419 - protein, 9 aa, Plasmodium falciparum
MKTTRQKCK

SEQ ID NO: 3234420 - protein, 14 aa, Plasmodium falciparum
MKTTRQKCKDKCDE

SEQ ID NO: 3234421 - protein, 13 aa, Plasmodium falciparum
MKTTRQKCKDQFD

SEQ ID NO: 3234422 - protein, 14 aa, Plasmodium falciparum
MKTTRQKCKEQCEK

SEQ ID NO: 3234423 - protein, 14 aa, Plasmodium falciparum
MKTTRQKCKERCDK

SEQ ID NO: 3234424 - protein, 16 aa, Plasmodium falciparum
MKYENNKYNSKEIYNN

SEQ ID NO: 3234425 - protein, 12 aa, Plasmodium falciparum
MKYNNNESNNVH

SEQ ID NO: 3234426 - protein, 12 aa, Plasmodium falciparum
MLESSESTTNIR

SEQ ID NO: 3234427 - protein, 9 aa, Plasmodium falciparum
MMESPTSDN

SEQ ID NO: 3234428 - protein, 4 aa, Plasmodium falciparum
MMNP

SEQ ID NO: 3234429 - protein, 13 aa, Plasmodium falciparum
MNAGGYDSGSNSQ

SEQ ID NO: 3234430 - protein, 5 aa, Plasmodium falciparum
MNANE

SEQ ID NO: 3234431 - protein, 4 aa, Plasmodium falciparum
MNDD

SEQ ID NO: 3234432 - protein, 19 aa, Plasmodium falciparum
MNDDYSNQNNMNSNSNSYN

SEQ ID NO: 3234433 - protein, 4 aa, Plasmodium falciparum
MNDE

SEQ ID NO: 3234434 - protein, 9 aa, Plasmodium falciparum
MNDEDPSYM

SEQ ID NO: 3234435 - protein, 21 aa, Plasmodium falciparum
MNDGKKKKKECDKKNDGKYGN

SEQ ID NO: 3234436 - protein, 12 aa, Plasmodium falciparum
MNDGNESSCRNK

SEQ ID NO: 3234437 - protein, 9 aa, Plasmodium falciparum
MNDKKGNVS

SEQ ID NO: 3234438 - protein, 4 aa, Plasmodium falciparum
MNDN

SEQ ID NO: 3234439 - protein, 10 aa, Plasmodium falciparum
MNDNTENNTN

SEQ ID NO: 3234440 - protein, 11 aa, Plasmodium falciparum
MNDNTNSKSCT

SEQ ID NO: 3234441 - protein, 10 aa, Plasmodium falciparum
MNDQGGNMND

SEQ ID NO: 3234442 - protein, 5 aa, Plasmodium falciparum
MNDSG

SEQ ID NO: 3234443 - protein, 7 aa, Plasmodium falciparum
MNDSNNK

SEQ ID NO: 3234444 - protein, 9 aa, Plasmodium falciparum
MNDSSNDEF

SEQ ID NO: 3234445 - protein, 12 aa, Plasmodium falciparum
MNDTDNKSMDIN

SEQ ID NO: 3234446 - protein, 12 aa, Plasmodium falciparum
MNDTNKGDDNRS

SEQ ID NO: 3234447 - protein, 12 aa, Plasmodium falciparum
MNDVKSDGITNL

SEQ ID NO: 3234448 - protein, 7 aa, Plasmodium falciparum
MNEDEKM

SEQ ID NO: 3234449 - protein, 11 aa, Plasmodium falciparum
MNEDEKNIKTQ

SEQ ID NO: 3234450 - protein, 7 aa, Plasmodium falciparum
MNEDNYS

SEQ ID NO: 3234451 - protein, 7 aa, Plasmodium falciparum
MNEDRKI

SEQ ID NO: 3234452 - protein, 7 aa, Plasmodium falciparum
MNEEDTY

SEQ ID NO: 3234453 - protein, 5 aa, Plasmodium falciparum
MNEEN

SEQ ID NO: 3234454 - protein, 43 aa, Plasmodium falciparum
MNEERYNDDYQDEIGKKKFNDDVDEKENDDVDEEENDDVDEEE

SEQ ID NO: 3234455 - protein, 11 aa, Plasmodium falciparum
MNEGDSEKTYK

SEQ ID NO: 3234456 - protein, 4 aa, Plasmodium falciparum
MNEH

SEQ ID NO: 3234457 - protein, 5 aa, Plasmodium falciparum
MNEKQ

SEQ ID NO: 3234458 - protein, 23 aa, Plasmodium falciparum
MNEKRESTDHNYHDENYKRTNYY

SEQ ID NO: 3234459 - protein, 15 aa, Plasmodium falciparum
MNEKRQKSKEQRDKN

SEQ ID NO: 3234460 - protein, 4 aa, Plasmodium falciparum
MNEN

SEQ ID NO: 3234461 - protein, 8 aa, Plasmodium falciparum
MNEQEKDK

SEQ ID NO: 3234462 - protein, 4 aa, Plasmodium falciparum
MNER

SEQ ID NO: 3234463 - protein, 7 aa, Plasmodium falciparum
MNESDDT

SEQ ID NO: 3234464 - protein, 7 aa, Plasmodium falciparum
MNESSKG

SEQ ID NO: 3234465 - protein, 20 aa, Plasmodium falciparum
MNESTTDTKKKKKKIDISKE

SEQ ID NO: 3234466 - protein, 6 aa, Plasmodium falciparum
MNGENI

SEQ ID NO: 3234467 - protein, 11 aa, Plasmodium falciparum
MNGKKKSSNIQ

SEQ ID NO: 3234468 - protein, 21 aa, Plasmodium falciparum
MNGNKNNDDNDDNDDNDVNDV

SEQ ID NO: 3234469 - protein, 12 aa, Plasmodium falciparum
MNGNNMNENNMN

SEQ ID NO: 3234470 - protein, 76 aa, Plasmodium falciparum
MNGPIKNNEENNNNNDNNNNNNNNNNNNNNNNNNNNNNNNNNNNNNNNNNNNNNNNNNNNNNKSKKNTQKKKDHVN

SEQ ID NO: 3234471 - protein, 14 aa, Plasmodium falciparum
MNGQENNYLNSQTN

SEQ ID NO: 3234472 - protein, 12 aa, Plasmodium falciparum
MNGQENNYMNGQ

SEQ ID NO: 3234473 - protein, 9 aa, Plasmodium falciparum
MNHNNSLKK

SEQ ID NO: 3234474 - protein, 4 aa, Plasmodium falciparum
MNIS

SEQ ID NO: 3234475 - protein, 16 aa, Plasmodium falciparum
MNKDEENEDKGDGDDF

SEQ ID NO: 3234476 - protein, 6 aa, Plasmodium falciparum
MNKDMN

SEQ ID NO: 3234477 - protein, 6 aa, Plasmodium falciparum
MNKDTI

SEQ ID NO: 3234478 - protein, 5 aa, Plasmodium falciparum
MNKEE

SEQ ID NO: 3234479 - protein, 8 aa, Plasmodium falciparum
MNKEKDSK

SEQ ID NO: 3234480 - protein, 9 aa, Plasmodium falciparum
MNKERTRKS

SEQ ID NO: 3234481 - protein, 59 aa, Plasmodium falciparum
MNKGNDQDVNRTYKNEKNKEEDKYGKNEKNEKYDKYDKYEKYEKYDKYKKDNKNQHDDP

SEQ ID NO: 3234482 - protein, 15 aa, Plasmodium falciparum
MNKKNSSNNVNNPME

SEQ ID NO: 3234483 - protein, 4 aa, Plasmodium falciparum
MNKM

SEQ ID NO: 3234484 - protein, 25 aa, Plasmodium falciparum
MNKNEDSIQKKNREKEDDEFRSTHK

SEQ ID NO: 3234485 - protein, 26 aa, Plasmodium falciparum
MNKNGQDMQSKGNYTTTKNSTTNYNN

SEQ ID NO: 3234486 - protein, 14 aa, Plasmodium falciparum
MNKNRQKCKDECDK

SEQ ID NO: 3234487 - protein, 14 aa, Plasmodium falciparum
MNKNRQKCKEQCNK

SEQ ID NO: 3234488 - protein, 14 aa, Plasmodium falciparum
MNKNRQKCKEQCNR

SEQ ID NO: 3234489 - protein, 15 aa, Plasmodium falciparum
MNKNRQKCKEQRDKD

SEQ ID NO: 3234490 - protein, 7 aa, Plasmodium falciparum
MNKNTNE

SEQ ID NO: 3234491 - protein, 6 aa, Plasmodium falciparum
MNKRDN

SEQ ID NO: 3234492 - protein, 10 aa, Plasmodium falciparum
MNKSGKMSEN

SEQ ID NO: 3234493 - protein, 8 aa, Plasmodium falciparum
MNKSINKD

SEQ ID NO: 3234494 - protein, 26 aa, Plasmodium falciparum
MNKSISNNKQNLVDNEKNNNEINNEN

SEQ ID NO: 3234495 - protein, 11 aa, Plasmodium falciparum
MNKTNDGKKNL

SEQ ID NO: 3234496 - protein, 6 aa, Plasmodium falciparum
MNNASQ

SEQ ID NO: 3234497 - protein, 4 aa, Plasmodium falciparum
MNND

SEQ ID NO: 3234498 - protein, 7 aa, Plasmodium falciparum
MNNDNME

SEQ ID NO: 3234499 - protein, 17 aa, Plasmodium falciparum
MNNDNTNKRVNNNNNNY

SEQ ID NO: 3234500 - protein, 4 aa, Plasmodium falciparum
MNNE

SEQ ID NO: 3234501 - protein, 18 aa, Plasmodium falciparum
MNNEENITNEKNEQNTND

SEQ ID NO: 3234502 - protein, 10 aa, Plasmodium falciparum
MNNEKDGAKY

SEQ ID NO: 3234503 - protein, 7 aa, Plasmodium falciparum
MNNEYGS

SEQ ID NO: 3234504 - protein, 12 aa, Plasmodium falciparum
MNNGQNEDVDYS

SEQ ID NO: 3234505 - protein, 24 aa, Plasmodium falciparum
MNNISQPKKTLGNKFRSRSDAPFS

SEQ ID NO: 3234506 - protein, 4 aa, Plasmodium falciparum
MNNK

SEQ ID NO: 3234507 - protein, 13 aa, Plasmodium falciparum
MNNKKKKKKKKFK

SEQ ID NO: 3234508 - protein, 8 aa, Plasmodium falciparum
MNNKKKNK

SEQ ID NO: 3234509 - protein, 11 aa, Plasmodium falciparum
MNNKQKAELDK

SEQ ID NO: 3234510 - protein, 17 aa, Plasmodium falciparum
MNNNDNMNNMNNNDNIN

SEQ ID NO: 3234511 - protein, 12 aa, Plasmodium falciparum
MNNNEKHPCSNN

SEQ ID NO: 3234512 - protein, 22 aa, Plasmodium falciparum
MNNNENNNNNNNMGISRSSSNM

SEQ ID NO: 3234513 - protein, 8 aa, Plasmodium falciparum
MNNNETLG

SEQ ID NO: 3234514 - protein, 38 aa, Plasmodium falciparum
MNNNKNKVKKYKKANKKNNNMDDDYNNDNNNNNNNNNN

SEQ ID NO: 3234515 - protein, 18 aa, Plasmodium falciparum
MNNNNDNNNNSQKNNLSE

SEQ ID NO: 3234516 - protein, 8 aa, Plasmodium falciparum
MNNNNKIE

SEQ ID NO: 3234517 - protein, 14 aa, Plasmodium falciparum
MNNNNNLKNEQPTE

SEQ ID NO: 3234518 - protein, 19 aa, Plasmodium falciparum
MNNNNNNNNNNNNKQGDDM

SEQ ID NO: 3234519 - protein, 10 aa, Plasmodium falciparum
MNNNSDHLQQ

SEQ ID NO: 3234520 - protein, 9 aa, Plasmodium falciparum
MNNRNNNQF

SEQ ID NO: 3234521 - protein, 5 aa, Plasmodium falciparum
MNNRP

SEQ ID NO: 3234522 - protein, 10 aa, Plasmodium falciparum
MNNSDGSPCI

SEQ ID NO: 3234523 - protein, 11 aa, Plasmodium falciparum
MNNSERHNESE

SEQ ID NO: 3234524 - protein, 17 aa, Plasmodium falciparum
MNNSQNSIKRKYSTSNF

SEQ ID NO: 3234525 - protein, 10 aa, Plasmodium falciparum
MNNSTNKNDH

SEQ ID NO: 3234526 - protein, 4 aa, Plasmodium falciparum
MNNT

SEQ ID NO: 3234527 - protein, 30 aa, Plasmodium falciparum
MNNTKNDNQNNDINNNNNNNNNNNNISKNK

SEQ ID NO: 3234528 - protein, 9 aa, Plasmodium falciparum
MNNTNNTNN

SEQ ID NO: 3234529 - protein, 7 aa, Plasmodium falciparum
MNNTPIN

SEQ ID NO: 3234530 - protein, 37 aa, Plasmodium falciparum
MNNTSQHNKNNNKFVGQQNEQLKKPKKKCTNVNTSQS

SEQ ID NO: 3234531 - protein, 4 aa, Plasmodium falciparum
MNNY

SEQ ID NO: 3234532 - protein, 11 aa, Plasmodium falciparum
MNPEQVTKDND

SEQ ID NO: 3234533 - protein, 6 aa, Plasmodium falciparum
MNPIET

SEQ ID NO: 3234534 - protein, 87 aa, Plasmodium falciparum
MNPNNNNNNNKNNDNNNNNNKNNDNNNNNNKNNDNNNNNNKNNDNNNNNNKNNDNNNNNNKNNDNNNNNNKNNDNNNGDNVDYEENS

SEQ ID NO: 3234535 - protein, 6 aa, Plasmodium falciparum
MNPPQN

SEQ ID NO: 3234536 - protein, 5 aa, Plasmodium falciparum
MNPSN

SEQ ID NO: 3234537 - protein, 12 aa, Plasmodium falciparum
MNQEDNNSISKN

SEQ ID NO: 3234538 - protein, 30 aa, Plasmodium falciparum
MNQENDEDDSKNKKKTNNNKNNNNNNNNND

SEQ ID NO: 3234539 - protein, 4 aa, Plasmodium falciparum
MNQI

SEQ ID NO: 3234540 - protein, 15 aa, Plasmodium falciparum
MNQNDDDKSSTCECT

SEQ ID NO: 3234541 - protein, 26 aa, Plasmodium falciparum
MNQPGDVNKNDKTSNDQANSSDSDCE

SEQ ID NO: 3234542 - protein, 9 aa, Plasmodium falciparum
MNQPSTNNF

SEQ ID NO: 3234543 - protein, 13 aa, Plasmodium falciparum
MNQTKDDNGCTKE

SEQ ID NO: 3234544 - protein, 8 aa, Plasmodium falciparum
MNQTNQTN

SEQ ID NO: 3234545 - protein, 24 aa, Plasmodium falciparum
MNRIDENKGNMNRMDENKGNMNRM

SEQ ID NO: 3234546 - protein, 4 aa, Plasmodium falciparum
MNRK

SEQ ID NO: 3234547 - protein, 16 aa, Plasmodium falciparum
MNRKTQHNNSHEEENR

SEQ ID NO: 3234548 - protein, 12 aa, Plasmodium falciparum
MNRNNSNSVNSN

SEQ ID NO: 3234549 - protein, 5 aa, Plasmodium falciparum
MNRNS

SEQ ID NO: 3234550 - protein, 40 aa, Plasmodium falciparum
MNRPRKSKYNNTNKNNKVKGNLNKKKKKKKNKKKAAQKYY

SEQ ID NO: 3234551 - protein, 15 aa, Plasmodium falciparum
MNSDNQINKGEKKRN

SEQ ID NO: 3234552 - protein, 6 aa, Plasmodium falciparum
MNSGSN

SEQ ID NO: 3234553 - protein, 4 aa, Plasmodium falciparum
MNSN

SEQ ID NO: 3234554 - protein, 13 aa, Plasmodium falciparum
MNSNNNNNNMSNN

SEQ ID NO: 3234555 - protein, 17 aa, Plasmodium falciparum
MNSQTSSKENTMSDNNN

SEQ ID NO: 3234556 - protein, 11 aa, Plasmodium falciparum
MNSSKSIKKTS

SEQ ID NO: 3234557 - protein, 15 aa, Plasmodium falciparum
MNSSMNSNNNSTNIH

SEQ ID NO: 3234558 - protein, 17 aa, Plasmodium falciparum
MNSSNVQIDTEKTRTMN

SEQ ID NO: 3234559 - protein, 8 aa, Plasmodium falciparum
MNSTKLNK

SEQ ID NO: 3234560 - protein, 6 aa, Plasmodium falciparum
MNSTNN

SEQ ID NO: 3234561 - protein, 8 aa, Plasmodium falciparum
MNSTNSIN

SEQ ID NO: 3234562 - protein, 23 aa, Plasmodium falciparum
MNTDENNTTTTKKKKDDNDNQND

SEQ ID NO: 3234563 - protein, 13 aa, Plasmodium falciparum
MNTKQNNKYVQDK

SEQ ID NO: 3234564 - protein, 4 aa, Plasmodium falciparum
MNTL

SEQ ID NO: 3234565 - protein, 11 aa, Plasmodium falciparum
MNTNDDNISNK

SEQ ID NO: 3234566 - protein, 35 aa, Plasmodium falciparum
MNTNNNNNNNNNNSNNNNNSNNNNNNNNSSSSSSC

SEQ ID NO: 3234567 - protein, 14 aa, Plasmodium falciparum
MNTNVDEKSSTCGC

SEQ ID NO: 3234568 - protein, 7 aa, Plasmodium falciparum
MNTPDNI

SEQ ID NO: 3234569 - protein, 8 aa, Plasmodium falciparum
MNTSDGKY

SEQ ID NO: 3234570 - protein, 6 aa, Plasmodium falciparum
MNTTND

SEQ ID NO: 3234571 - protein, 13 aa, Plasmodium falciparum
MNTTNKEESYGTE

SEQ ID NO: 3234572 - protein, 4 aa, Plasmodium falciparum
MNTV

SEQ ID NO: 3234573 - protein, 12 aa, Plasmodium falciparum
MNVDNSSNSIEK

SEQ ID NO: 3234574 - protein, 11 aa, Plasmodium falciparum
MNYNNNNNNNI

SEQ ID NO: 3234575 - protein, 15 aa, Plasmodium falciparum
MNYPTSSTGKGTPRR

SEQ ID NO: 3234576 - protein, 10 aa, Plasmodium falciparum
MPEKPKTDSD

SEQ ID NO: 3234577 - protein, 9 aa, Plasmodium falciparum
MPGTGKTAT

SEQ ID NO: 3234578 - protein, 6 aa, Plasmodium falciparum
MPKNGN

SEQ ID NO: 3234579 - protein, 12 aa, Plasmodium falciparum
MPNNKKETHNNF

SEQ ID NO: 3234580 - protein, 8 aa, Plasmodium falciparum
MPNSAGKV

SEQ ID NO: 3234581 - protein, 8 aa, Plasmodium falciparum
MPPQNKKS

SEQ ID NO: 3234582 - protein, 11 aa, Plasmodium falciparum
MPRPPGSVPGP

SEQ ID NO: 3234583 - protein, 5 aa, Plasmodium falciparum
MPSNN

SEQ ID NO: 3234584 - protein, 39 aa, Plasmodium falciparum
MPSPTNNNNENNNENNNENNNENNNENNNENNNNNCSNS

SEQ ID NO: 3234585 - protein, 14 aa, Plasmodium falciparum
MPSSTGAVRGASEP

SEQ ID NO: 3234586 - protein, 39 aa, Plasmodium falciparum
MPTQPETKEEEVEKCEEASPAPKAPEPTQPADGGEQTPV

SEQ ID NO: 3234587 - protein, 6 aa, Plasmodium falciparum
MQDDNQ

SEQ ID NO: 3234588 - protein, 15 aa, Plasmodium falciparum
MQDPAKSHYSGDSSD

SEQ ID NO: 3234589 - protein, 11 aa, Plasmodium falciparum
MQEEKDKEGRN

SEQ ID NO: 3234590 - protein, 6 aa, Plasmodium falciparum
MQEGMQ

SEQ ID NO: 3234591 - protein, 14 aa, Plasmodium falciparum
MQEKRKECKDQCEK

SEQ ID NO: 3234592 - protein, 14 aa, Plasmodium falciparum
MQEKRQKRKEKCDK

SEQ ID NO: 3234593 - protein, 15 aa, Plasmodium falciparum
MQEKRQKRKEQRDKN

SEQ ID NO: 3234594 - protein, 14 aa, Plasmodium falciparum
MQEKRQTCKEQCDK

SEQ ID NO: 3234595 - protein, 14 aa, Plasmodium falciparum
MQEKRRKCKEQCDK

SEQ ID NO: 3234596 - protein, 13 aa, Plasmodium falciparum
MQENKSVNNFEGE

SEQ ID NO: 3234597 - protein, 7 aa, Plasmodium falciparum
MQESSSS

SEQ ID NO: 3234598 - protein, 15 aa, Plasmodium falciparum
MQGKRQKCKDKCDKE

SEQ ID NO: 3234599 - protein, 10 aa, Plasmodium falciparum
MQKEEKKNIT

SEQ ID NO: 3234600 - protein, 8 aa, Plasmodium falciparum
MQKKKQQQ

SEQ ID NO: 3234601 - protein, 67 aa, Plasmodium falciparum
MQKNEQQNEQQNEQKNEQKNEQKNEQKNEQKNEQNEQKNERKNERKNERKNERKKKYPNNNKNKENK

SEQ ID NO: 3234602 - protein, 11 aa, Plasmodium falciparum
MQKSRNSINNK

SEQ ID NO: 3234603 - protein, 4 aa, Plasmodium falciparum
MQLQ

SEQ ID NO: 3234604 - protein, 26 aa, Plasmodium falciparum
MQNDDDKEKEEYTAEDTFSERRNSRD

SEQ ID NO: 3234605 - protein, 4 aa, Plasmodium falciparum
MQNE

SEQ ID NO: 3234606 - protein, 10 aa, Plasmodium falciparum
MQNKNDNYNE

SEQ ID NO: 3234607 - protein, 4 aa, Plasmodium falciparum
MQNN

SEQ ID NO: 3234608 - protein, 6 aa, Plasmodium falciparum
MQPNQN

SEQ ID NO: 3234609 - protein, 4 aa, Plasmodium falciparum
MQQD

SEQ ID NO: 3234610 - protein, 4 aa, Plasmodium falciparum
MQQN

SEQ ID NO: 3234611 - protein, 13 aa, Plasmodium falciparum
MQTKKKEKIKNKD

SEQ ID NO: 3234612 - protein, 6 aa, Plasmodium falciparum
MRDTKS

SEQ ID NO: 3234613 - protein, 10 aa, Plasmodium falciparum
MRKGSFPKEL

SEQ ID NO: 3234614 - protein, 21 aa, Plasmodium falciparum
MRNEENEDSEGELTNVDSIIT

SEQ ID NO: 3234615 - protein, 12 aa, Plasmodium falciparum
MRNEENESTTFD

SEQ ID NO: 3234616 - protein, 22 aa, Plasmodium falciparum
MRNNNNNNNNNMRGDNNSMRGG

SEQ ID NO: 3234617 - protein, 4 aa, Plasmodium falciparum
MRRS

SEQ ID NO: 3234618 - protein, 10 aa, Plasmodium falciparum
MSAPKSAREI

SEQ ID NO: 3234619 - protein, 28 aa, Plasmodium falciparum
MSDEEKIEKKEKIEKNEKIEKNENGDHP

SEQ ID NO: 3234620 - protein, 9 aa, Plasmodium falciparum
MSDKNGNYT

SEQ ID NO: 3234621 - protein, 18 aa, Plasmodium falciparum
MSDQNEEKNKLKNSNEMD

SEQ ID NO: 3234622 - protein, 47 aa, Plasmodium falciparum
MSDSSYDSLDDNYSSDDDSSSSNYDDDDEDNDNDEDNVDNNNDHGGE

SEQ ID NO: 3234623 - protein, 6 aa, Plasmodium falciparum
MSECNN

SEQ ID NO: 3234624 - protein, 14 aa, Plasmodium falciparum
MSEDDNKKIQYDED

SEQ ID NO: 3234625 - protein, 4 aa, Plasmodium falciparum
MSEQ

SEQ ID NO: 3234626 - protein, 7 aa, Plasmodium falciparum
MSEQNNN

SEQ ID NO: 3234627 - protein, 5 aa, Plasmodium falciparum
MSGGE

SEQ ID NO: 3234628 - protein, 5 aa, Plasmodium falciparum
MSGTT

SEQ ID NO: 3234629 - protein, 14 aa, Plasmodium falciparum
MSHDGSKRNNIKEE

SEQ ID NO: 3234630 - protein, 8 aa, Plasmodium falciparum
MSKEKTSN

SEQ ID NO: 3234631 - protein, 9 aa, Plasmodium falciparum
MSKNNNSYP

SEQ ID NO: 3234632 - protein, 17 aa, Plasmodium falciparum
MSKRSSKSKTDVGSKEP

SEQ ID NO: 3234633 - protein, 9 aa, Plasmodium falciparum
MSKSEKNVE

SEQ ID NO: 3234634 - protein, 10 aa, Plasmodium falciparum
MSLNGSTTHP

SEQ ID NO: 3234635 - protein, 7 aa, Plasmodium falciparum
MSNEKRV

SEQ ID NO: 3234636 - protein, 9 aa, Plasmodium falciparum
MSNKASSIE

SEQ ID NO: 3234637 - protein, 6 aa, Plasmodium falciparum
MSNKEK

SEQ ID NO: 3234638 - protein, 56 aa, Plasmodium falciparum
MSNNNTCDKDGYTDKRNNNIQNDDNNKNYKNNKNYKNNKNNNNKVDNNDHEKENNH

SEQ ID NO: 3234639 - protein, 11 aa, Plasmodium falciparum
MSPEKKKNNNI

SEQ ID NO: 3234640 - protein, 12 aa, Plasmodium falciparum
MSPNFDEKSSTC

SEQ ID NO: 3234641 - protein, 5 aa, Plasmodium falciparum
MSPSI

SEQ ID NO: 3234642 - protein, 4 aa, Plasmodium falciparum
MSPT

SEQ ID NO: 3234643 - protein, 8 aa, Plasmodium falciparum
MSQGGTEW

SEQ ID NO: 3234644 - protein, 16 aa, Plasmodium falciparum
MSQNGNDDKSKYDYSY

SEQ ID NO: 3234645 - protein, 13 aa, Plasmodium falciparum
MSQNVDEKSSTCE

SEQ ID NO: 3234646 - protein, 4 aa, Plasmodium falciparum
MSSD

SEQ ID NO: 3234647 - protein, 9 aa, Plasmodium falciparum
MSSDPQESN

SEQ ID NO: 3234648 - protein, 4 aa, Plasmodium falciparum
MSSG

SEQ ID NO: 3234649 - protein, 18 aa, Plasmodium falciparum
MSSGTTGITTNTTAQSGN

SEQ ID NO: 3234650 - protein, 8 aa, Plasmodium falciparum
MSSNDDMN

SEQ ID NO: 3234651 - protein, 15 aa, Plasmodium falciparum
MSSPHSDEDNNMNAN

SEQ ID NO: 3234652 - protein, 12 aa, Plasmodium falciparum
MSSRQNAKKKRK

SEQ ID NO: 3234653 - protein, 8 aa, Plasmodium falciparum
MSSSGSKE

SEQ ID NO: 3234654 - protein, 18 aa, Plasmodium falciparum
MSSSSSYSSSFSSTYSPS

SEQ ID NO: 3234655 - protein, 15 aa, Plasmodium falciparum
MSTENDKYGKMGNEN

SEQ ID NO: 3234656 - protein, 42 aa, Plasmodium falciparum
MSTNQKSSHKKEGEKSHSACEYKDNKNELGYRENEKDVGREN

SEQ ID NO: 3234657 - protein, 10 aa, Plasmodium falciparum
MSTNSGENNL

SEQ ID NO: 3234658 - protein, 10 aa, Plasmodium falciparum
MSTNSGENNV

SEQ ID NO: 3234659 - protein, 36 aa, Plasmodium falciparum
MSTNSGGNGSYSGISPISDNPDSLSDKNGPTSGNHN

SEQ ID NO: 3234660 - protein, 10 aa, Plasmodium falciparum
MSTNSGQNNV

SEQ ID NO: 3234661 - protein, 4 aa, Plasmodium falciparum
MSTR

SEQ ID NO: 3234662 - protein, 9 aa, Plasmodium falciparum
MSTSNEKQK

SEQ ID NO: 3234663 - protein, 5 aa, Plasmodium falciparum
MTDKV

SEQ ID NO: 3234664 - protein, 4 aa, Plasmodium falciparum
MTEE

SEQ ID NO: 3234665 - protein, 7 aa, Plasmodium falciparum
MTEESID

SEQ ID NO: 3234666 - protein, 4 aa, Plasmodium falciparum
MTIN

SEQ ID NO: 3234667 - protein, 15 aa, Plasmodium falciparum
MTKENNKKKNSSIDD

SEQ ID NO: 3234668 - protein, 5 aa, Plasmodium falciparum
MTKGH

SEQ ID NO: 3234669 - protein, 10 aa, Plasmodium falciparum
MTKKSTLSNI

SEQ ID NO: 3234670 - protein, 18 aa, Plasmodium falciparum
MTKNNKNSSYIQSEEENF

SEQ ID NO: 3234671 - protein, 5 aa, Plasmodium falciparum
MTNED

SEQ ID NO: 3234672 - protein, 65 aa, Plasmodium falciparum
MTNKQKTYKLDTSNVTKDISSTDNNNNNNNNNNNSNNNNSNNSNNNNSNNNYSNNSNNYDSNKKN

SEQ ID NO: 3234673 - protein, 21 aa, Plasmodium falciparum
MTNNNKNNMSDVDNSNRSSNV

SEQ ID NO: 3234674 - protein, 4 aa, Plasmodium falciparum
MTPE

SEQ ID NO: 3234675 - protein, 4 aa, Plasmodium falciparum
MTPK

SEQ ID NO: 3234676 - protein, 4 aa, Plasmodium falciparum
MTPP

SEQ ID NO: 3234677 - protein, 7 aa, Plasmodium falciparum
MTQGGAV

SEQ ID NO: 3234678 - protein, 37 aa, Plasmodium falciparum
MTQGKQEKEKEKEKEKKQEKEKEKKQEKEQEKEQYNN

SEQ ID NO: 3234679 - protein, 8 aa, Plasmodium falciparum
MTQPGSTN

SEQ ID NO: 3234680 - protein, 12 aa, Plasmodium falciparum
MTQTQDKNSNTN

SEQ ID NO: 3234681 - protein, 33 aa, Plasmodium falciparum
MTSNNNNNNNNNSDINNNNNHHHNNHDYNKNEK

SEQ ID NO: 3234682 - protein, 66 aa, Plasmodium falciparum
MVNEEEDQEVDDDDDDDDNDGDDSDGDDNDGDDSDGDDNDGDDSDGDDNDGDDSDGDDNDGDDSDE

SEQ ID NO: 3234683 - protein, 20 aa, Plasmodium falciparum
MYDNKTKDCTLKKKKQDNSF

SEQ ID NO: 3234684 - protein, 15 aa, Plasmodium falciparum
MYDNNDNNDNINSND

SEQ ID NO: 3234685 - protein, 15 aa, Plasmodium falciparum
MYDSDDESLPKPQTN

SEQ ID NO: 3234686 - protein, 5 aa, Plasmodium falciparum
MYGNK

SEQ ID NO: 3234687 - protein, 10 aa, Plasmodium falciparum
MYPSTSRGTS

SEQ ID NO: 3234688 - protein, 20 aa, Plasmodium falciparum
MYSEKNKNKNNNINNNNNDN

SEQ ID NO: 3234689 - protein, 10 aa, Plasmodium falciparum
MYTGQTTKNN

SEQ ID NO: 3234690 - protein, 5 aa, Plasmodium falciparum
MYTNR

SEQ ID NO: 3234691 - protein, 8 aa, Plasmodium falciparum
NAADSKYY

SEQ ID NO: 3234692 - protein, 16 aa, Plasmodium falciparum
NAAEAAGNAANGKYAE

SEQ ID NO: 3234693 - protein, 8 aa, Plasmodium falciparum
NAAGNAKG

SEQ ID NO: 3234694 - protein, 9 aa, Plasmodium falciparum
NAANASFSS

SEQ ID NO: 3234695 - protein, 6 aa, Plasmodium falciparum
NAARGR

SEQ ID NO: 3234696 - protein, 10 aa, Plasmodium falciparum
NAASKKEADN

SEQ ID NO: 3234697 - protein, 6 aa, Plasmodium falciparum
NACTGN

SEQ ID NO: 3234698 - protein, 5 aa, Plasmodium falciparum
NADAL

SEQ ID NO: 3234699 - protein, 13 aa, Plasmodium falciparum
NADCTSDDNNCNL

SEQ ID NO: 3234700 - protein, 7 aa, Plasmodium falciparum
NADDDLD

SEQ ID NO: 3234701 - protein, 5 aa, Plasmodium falciparum
NADDN

SEQ ID NO: 3234702 - protein, 6 aa, Plasmodium falciparum
NADNGI

SEQ ID NO: 3234703 - protein, 12 aa, Plasmodium falciparum
NADNKRHARKSM

SEQ ID NO: 3234704 - protein, 9 aa, Plasmodium falciparum
NADNMSDGN

SEQ ID NO: 3234705 - protein, 7 aa, Plasmodium falciparum
NADQQNN

SEQ ID NO: 3234706 - protein, 7 aa, Plasmodium falciparum
NADRDNY

SEQ ID NO: 3234707 - protein, 11 aa, Plasmodium falciparum
NAEEGEEIPKP

SEQ ID NO: 3234708 - protein, 11 aa, Plasmodium falciparum
NAEENKINDNY

SEQ ID NO: 3234709 - protein, 5 aa, Plasmodium falciparum
NAEKM

SEQ ID NO: 3234710 - protein, 7 aa, Plasmodium falciparum
NAENKDI

SEQ ID NO: 3234711 - protein, 13 aa, Plasmodium falciparum
NAENTINKKKGKS

SEQ ID NO: 3234712 - protein, 13 aa, Plasmodium falciparum
NAERDIKSHSKQT

SEQ ID NO: 3234713 - protein, 6 aa, Plasmodium falciparum
NAESTN

SEQ ID NO: 3234714 - protein, 8 aa, Plasmodium falciparum
NAESYNNI

SEQ ID NO: 3234715 - protein, 5 aa, Plasmodium falciparum
NAFPD

SEQ ID NO: 3234716 - protein, 8 aa, Plasmodium falciparum
NAGEENNI

SEQ ID NO: 3234717 - protein, 7 aa, Plasmodium falciparum
NAGGDNK

SEQ ID NO: 3234718 - protein, 7 aa, Plasmodium falciparum
NAGGGNR

SEQ ID NO: 3234719 - protein, 9 aa, Plasmodium falciparum
NAHDSYNDN

SEQ ID NO: 3234720 - protein, 5 aa, Plasmodium falciparum
NAHEE

SEQ ID NO: 3234721 - protein, 6 aa, Plasmodium falciparum
NAHQKN

SEQ ID NO: 3234722 - protein, 7 aa, Plasmodium falciparum
NAIDGEE

SEQ ID NO: 3234723 - protein, 13 aa, Plasmodium falciparum
NAIKSDTKKFPSY

SEQ ID NO: 3234724 - protein, 5 aa, Plasmodium falciparum
NAINN

SEQ ID NO: 3234725 - protein, 4 aa, Plasmodium falciparum
NAIQ

SEQ ID NO: 3234726 - protein, 11 aa, Plasmodium falciparum
NAKASEPPKPL

SEQ ID NO: 3234727 - protein, 5 aa, Plasmodium falciparum
NAKDD

SEQ ID NO: 3234728 - protein, 9 aa, Plasmodium falciparum
NAKDEQSKV

SEQ ID NO: 3234729 - protein, 16 aa, Plasmodium falciparum
NAKEEKKKRKKEIGKK

SEQ ID NO: 3234730 - protein, 5 aa, Plasmodium falciparum
NAKEQ

SEQ ID NO: 3234731 - protein, 10 aa, Plasmodium falciparum
NAKHPPPDDY

SEQ ID NO: 3234732 - protein, 4 aa, Plasmodium falciparum
NAKI

SEQ ID NO: 3234733 - protein, 5 aa, Plasmodium falciparum
NAKKT

SEQ ID NO: 3234734 - protein, 5 aa, Plasmodium falciparum
NAKNN

SEQ ID NO: 3234735 - protein, 14 aa, Plasmodium falciparum
NAKPYQDKYKNGDS

SEQ ID NO: 3234736 - protein, 25 aa, Plasmodium falciparum
NAKSNEKHKQLSKDMKKEAQNKEYQ

SEQ ID NO: 3234737 - protein, 15 aa, Plasmodium falciparum
NAKSQNCKNNEKCNK

SEQ ID NO: 3234738 - protein, 42 aa, Plasmodium falciparum
NAKSSDSTSPYTEKNKEEDEQQEEQQQDEQERDEQEQDEINN

SEQ ID NO: 3234739 - protein, 5 aa, Plasmodium falciparum
NAKTL

SEQ ID NO: 3234740 - protein, 12 aa, Plasmodium falciparum
NAKTSKNNNCNR

SEQ ID NO: 3234741 - protein, 6 aa, Plasmodium falciparum
NALGKR

SEQ ID NO: 3234742 - protein, 8 aa, Plasmodium falciparum
NAMQDQGT

SEQ ID NO: 3234743 - protein, 9 aa, Plasmodium falciparum
NANANYAQT

SEQ ID NO: 3234744 - protein, 8 aa, Plasmodium falciparum
NANATSSN

SEQ ID NO: 3234745 - protein, 11 aa, Plasmodium falciparum
NANDKKIPEVN

SEQ ID NO: 3234746 - protein, 7 aa, Plasmodium falciparum
NANDPKD

SEQ ID NO: 3234747 - protein, 4 aa, Plasmodium falciparum
NANE

SEQ ID NO: 3234748 - protein, 8 aa, Plasmodium falciparum
NANGDPKV

SEQ ID NO: 3234749 - protein, 7 aa, Plasmodium falciparum
NANGKNY

SEQ ID NO: 3234750 - protein, 13 aa, Plasmodium falciparum
NANGQNVSNVPGT

SEQ ID NO: 3234751 - protein, 4 aa, Plasmodium falciparum
NANH

SEQ ID NO: 3234752 - protein, 5 aa, Plasmodium falciparum
NANHV

SEQ ID NO: 3234753 - protein, 35 aa, Plasmodium falciparum
NANNDDSTKDINNINKNSSNKSKSEKTSNYNNDQY

SEQ ID NO: 3234754 - protein, 9 aa, Plasmodium falciparum
NANNNNPFS

SEQ ID NO: 3234755 - protein, 26 aa, Plasmodium falciparum
NANNSKTKEHEEINNDNSNVENKNVT

SEQ ID NO: 3234756 - protein, 7 aa, Plasmodium falciparum
NANNSNN

SEQ ID NO: 3234757 - protein, 8 aa, Plasmodium falciparum
NANNYNQN

SEQ ID NO: 3234758 - protein, 6 aa, Plasmodium falciparum
NANQKE

SEQ ID NO: 3234759 - protein, 6 aa, Plasmodium falciparum
NANQRM

SEQ ID NO: 3234760 - protein, 6 aa, Plasmodium falciparum
NANSES

SEQ ID NO: 3234761 - protein, 17 aa, Plasmodium falciparum
NANYQTYNQIDDNKNNP

SEQ ID NO: 3234762 - protein, 8 aa, Plasmodium falciparum
NAPCTSRK

SEQ ID NO: 3234763 - protein, 6 aa, Plasmodium falciparum
NAPKDA

SEQ ID NO: 3234764 - protein, 5 aa, Plasmodium falciparum
NAPKY

SEQ ID NO: 3234765 - protein, 6 aa, Plasmodium falciparum
NAPNGV

SEQ ID NO: 3234766 - protein, 6 aa, Plasmodium falciparum
NAPPNY

SEQ ID NO: 3234767 - protein, 4 aa, Plasmodium falciparum
NAPT

SEQ ID NO: 3234768 - protein, 7 aa, Plasmodium falciparum
NAQKEKK

SEQ ID NO: 3234769 - protein, 9 aa, Plasmodium falciparum
NAQSKGEVL

SEQ ID NO: 3234770 - protein, 9 aa, Plasmodium falciparum
NARNNSYEE

SEQ ID NO: 3234771 - protein, 6 aa, Plasmodium falciparum
NARQKN

SEQ ID NO: 3234772 - protein, 16 aa, Plasmodium falciparum
NARTDIQKQKKNQHVR

SEQ ID NO: 3234773 - protein, 6 aa, Plasmodium falciparum
NASDNI

SEQ ID NO: 3234774 - protein, 7 aa, Plasmodium falciparum
NASDSEK

SEQ ID NO: 3234775 - protein, 17 aa, Plasmodium falciparum
NASKGEYKHEGNPDDFK

SEQ ID NO: 3234776 - protein, 10 aa, Plasmodium falciparum
NASKGKEFTR

SEQ ID NO: 3234777 - protein, 5 aa, Plasmodium falciparum
NASKK

SEQ ID NO: 3234778 - protein, 8 aa, Plasmodium falciparum
NASNNNMN

SEQ ID NO: 3234779 - protein, 9 aa, Plasmodium falciparum
NASNNSYHN

SEQ ID NO: 3234780 - protein, 10 aa, Plasmodium falciparum
NASPNKLNKS

SEQ ID NO: 3234781 - protein, 8 aa, Plasmodium falciparum
NASPYDEH

SEQ ID NO: 3234782 - protein, 15 aa, Plasmodium falciparum
NASRGEYRKGVNKTD

SEQ ID NO: 3234783 - protein, 9 aa, Plasmodium falciparum
NASTKSRQK

SEQ ID NO: 3234784 - protein, 52 aa, Plasmodium falciparum
NASTNVPNKDTNHNKRKITKKKIKNKDNINNNNSNNNNSNNNSNNNSNNNSN

SEQ ID NO: 3234785 - protein, 9 aa, Plasmodium falciparum
NATEEELKE

SEQ ID NO: 3234786 - protein, 7 aa, Plasmodium falciparum
NATIQKN

SEQ ID NO: 3234787 - protein, 5 aa, Plasmodium falciparum
NATPE

SEQ ID NO: 3234788 - protein, 6 aa, Plasmodium falciparum
NATSNI

SEQ ID NO: 3234789 - protein, 21 aa, Plasmodium falciparum
NATTCKDNNSLEEDENCPKTK

SEQ ID NO: 3234790 - protein, 18 aa, Plasmodium falciparum
NATTRNNRTSNGSSNSVA

SEQ ID NO: 3234791 - protein, 7 aa, Plasmodium falciparum
NATTSEM

SEQ ID NO: 3234792 - protein, 9 aa, Plasmodium falciparum
NATYSDSRS

SEQ ID NO: 3234793 - protein, 9 aa, Plasmodium falciparum
NAVADGEAS

SEQ ID NO: 3234794 - protein, 13 aa, Plasmodium falciparum
NAVEQKNKIQSGE

SEQ ID NO: 3234795 - protein, 11 aa, Plasmodium falciparum
NAVESNENVAE

SEQ ID NO: 3234796 - protein, 7 aa, Plasmodium falciparum
NAVNAAK

SEQ ID NO: 3234797 - protein, 6 aa, Plasmodium falciparum
NAVSDA

SEQ ID NO: 3234798 - protein, 20 aa, Plasmodium falciparum
NAYEDNEPYNDYNDNNNNII

SEQ ID NO: 3234799 - protein, 28 aa, Plasmodium falciparum
NAYGGQKNNYVNEQKDKCQTQSNNHDNG

SEQ ID NO: 3234800 - protein, 19 aa, Plasmodium falciparum
NAYGGQKTKCQTESETAKE

SEQ ID NO: 3234801 - protein, 18 aa, Plasmodium falciparum
NAYKEQKTNFQTQSETAK

SEQ ID NO: 3234802 - protein, 10 aa, Plasmodium falciparum
NAYNEKKDDK

SEQ ID NO: 3234803 - protein, 23 aa, Plasmodium falciparum
NAYTEQQNKCQSKSDKAKSDNGF

SEQ ID NO: 3234804 - protein, 4 aa, Plasmodium falciparum
NAYY

SEQ ID NO: 3234805 - protein, 4 aa, Plasmodium falciparum
NCDE

SEQ ID NO: 3234806 - protein, 7 aa, Plasmodium falciparum
NCDENNP

SEQ ID NO: 3234807 - protein, 6 aa, Plasmodium falciparum
NCEEVE

SEQ ID NO: 3234808 - protein, 13 aa, Plasmodium falciparum
NCEINDEGNKYNS

SEQ ID NO: 3234809 - protein, 6 aa, Plasmodium falciparum
NCENRE

SEQ ID NO: 3234810 - protein, 6 aa, Plasmodium falciparum
NCEQPN

SEQ ID NO: 3234811 - protein, 5 aa, Plasmodium falciparum
NCGKT

SEQ ID NO: 3234812 - protein, 15 aa, Plasmodium falciparum
NCGSDAKGNTCTTGK

SEQ ID NO: 3234813 - protein, 35 aa, Plasmodium falciparum
NCGSNELEDGLQSNKRKDKKKKNYNNNNNNNNNNE

SEQ ID NO: 3234814 - protein, 4 aa, Plasmodium falciparum
NCHS

SEQ ID NO: 3234815 - protein, 5 aa, Plasmodium falciparum
NCKDH

SEQ ID NO: 3234816 - protein, 7 aa, Plasmodium falciparum
NCKKKKK

SEQ ID NO: 3234817 - protein, 15 aa, Plasmodium falciparum
NCKQNNINKDSMTNS

SEQ ID NO: 3234818 - protein, 24 aa, Plasmodium falciparum
NCKSENDITGYSKKKNSKKKKKQF

SEQ ID NO: 3234819 - protein, 35 aa, Plasmodium falciparum
NCKSNNNIEVKDKKKKGTTNKKKKEKGNENLNGTV

SEQ ID NO: 3234820 - protein, 18 aa, Plasmodium falciparum
NCKSSEKKNVKKKRKKKI

SEQ ID NO: 3234821 - protein, 8 aa, Plasmodium falciparum
NCKSTFEE

SEQ ID NO: 3234822 - protein, 19 aa, Plasmodium falciparum
NCNDGNDSCDDNSHHNPNN

SEQ ID NO: 3234823 - protein, 84 aa, Plasmodium falciparum
NCNDNDKEKEQNGPLKQDNNDNNKDNNKDSNNGNNNVNNNNDNNNDNNNNNDNNNDNNNNNDNNNDNNDKDEKKKKKKNQSNYY

SEQ ID NO: 3234824 - protein, 25 aa, Plasmodium falciparum
NCNGSGRGTRGKDPCTPHNEKGKSW

SEQ ID NO: 3234825 - protein, 4 aa, Plasmodium falciparum
NCNI

SEQ ID NO: 3234826 - protein, 12 aa, Plasmodium falciparum
NCNMTKDGNINP

SEQ ID NO: 3234827 - protein, 12 aa, Plasmodium falciparum
NCNNGNGSGDSF

SEQ ID NO: 3234828 - protein, 6 aa, Plasmodium falciparum
NCNNKN

SEQ ID NO: 3234829 - protein, 8 aa, Plasmodium falciparum
NCNTPSDI

SEQ ID NO: 3234830 - protein, 6 aa, Plasmodium falciparum
NCQNNQ

SEQ ID NO: 3234831 - protein, 15 aa, Plasmodium falciparum
NCRGENNKKYCSGDG

SEQ ID NO: 3234832 - protein, 11 aa, Plasmodium falciparum
NCRNKKASKFD

SEQ ID NO: 3234833 - protein, 4 aa, Plasmodium falciparum
NCSE

SEQ ID NO: 3234834 - protein, 7 aa, Plasmodium falciparum
NCSESEK

SEQ ID NO: 3234835 - protein, 12 aa, Plasmodium falciparum
NCSNDNIKKERQ

SEQ ID NO: 3234836 - protein, 8 aa, Plasmodium falciparum
NCSNGKYK

SEQ ID NO: 3234837 - protein, 9 aa, Plasmodium falciparum
NCSNYNNPY

SEQ ID NO: 3234838 - protein, 13 aa, Plasmodium falciparum
NCTDGKEKEKNIK

SEQ ID NO: 3234839 - protein, 9 aa, Plasmodium falciparum
NCTKENKKN

SEQ ID NO: 3234840 - protein, 6 aa, Plasmodium falciparum
NCTPYN

SEQ ID NO: 3234841 - protein, 16 aa, Plasmodium falciparum
NCTQHGKKQYSGDGEY

SEQ ID NO: 3234842 - protein, 13 aa, Plasmodium falciparum
NDADGNNSGEENK

SEQ ID NO: 3234843 - protein, 7 aa, Plasmodium falciparum
NDADNNI

SEQ ID NO: 3234844 - protein, 20 aa, Plasmodium falciparum
NDAGINKGTEYNKNQTSHNN

SEQ ID NO: 3234845 - protein, 7 aa, Plasmodium falciparum
NDAGYAY

SEQ ID NO: 3234846 - protein, 25 aa, Plasmodium falciparum
NDAIPSKEKKNDPEADSKNSQNQHD

SEQ ID NO: 3234847 - protein, 6 aa, Plasmodium falciparum
NDALPV

SEQ ID NO: 3234848 - protein, 4 aa, Plasmodium falciparum
NDAN

SEQ ID NO: 3234849 - protein, 6 aa, Plasmodium falciparum
NDANNL

SEQ ID NO: 3234850 - protein, 8 aa, Plasmodium falciparum
NDANNNNN

SEQ ID NO: 3234851 - protein, 8 aa, Plasmodium falciparum
NDAQKNEL

SEQ ID NO: 3234852 - protein, 9 aa, Plasmodium falciparum
NDASKGGIS

SEQ ID NO: 3234853 - protein, 12 aa, Plasmodium falciparum
NDATPLDGVKPT

SEQ ID NO: 3234854 - protein, 7 aa, Plasmodium falciparum
NDCDPQN

SEQ ID NO: 3234855 - protein, 4 aa, Plasmodium falciparum
NDCG

SEQ ID NO: 3234856 - protein, 14 aa, Plasmodium falciparum
NDDANLSKDENYNN

SEQ ID NO: 3234857 - protein, 4 aa, Plasmodium falciparum
NDDC

SEQ ID NO: 3234858 - protein, 10 aa, Plasmodium falciparum
NDDDAYDESH

SEQ ID NO: 3234859 - protein, 154 aa, Plasmodium falciparum
NDDDDDDDDNNNDDDNNDDDNNNDDNNNDDDNNNDDDNNNDDDNNNNDDNNNNDDIKLPKGKRKNSKKKEPIKKTTINKRGGRKPKNKVEDIKKEDNEQVNNHEHDTEEMNKEEETNECDNKKGKRGRRNSTKSKRNEDTENLKEETIQNNKEE

SEQ ID NO: 3234860 - protein, 32 aa, Plasmodium falciparum
NDDDDDDDNDKNNNNNNNNSNNNNSNSSKKNI

SEQ ID NO: 3234861 - protein, 8 aa, Plasmodium falciparum
NDDDDDDI

SEQ ID NO: 3234862 - protein, 16 aa, Plasmodium falciparum
NDDDDDNDSEEKKSIN

SEQ ID NO: 3234863 - protein, 9 aa, Plasmodium falciparum
NDDDDDNDV

SEQ ID NO: 3234864 - protein, 8 aa, Plasmodium falciparum
NDDDMKSV

SEQ ID NO: 3234865 - protein, 7 aa, Plasmodium falciparum
NDDDNIN

SEQ ID NO: 3234866 - protein, 8 aa, Plasmodium falciparum
NDDDTEYI

SEQ ID NO: 3234867 - protein, 7 aa, Plasmodium falciparum
NDDEEND

SEQ ID NO: 3234868 - protein, 11 aa, Plasmodium falciparum
NDDEGTPFKRE

SEQ ID NO: 3234869 - protein, 12 aa, Plasmodium falciparum
NDDEHEQEQNVS

SEQ ID NO: 3234870 - protein, 5 aa, Plasmodium falciparum
NDDEI

SEQ ID NO: 3234871 - protein, 11 aa, Plasmodium falciparum
NDDEIYNNNYN

SEQ ID NO: 3234872 - protein, 7 aa, Plasmodium falciparum
NDDEKDK

SEQ ID NO: 3234873 - protein, 5 aa, Plasmodium falciparum
NDDEN

SEQ ID NO: 3234874 - protein, 11 aa, Plasmodium falciparum
NDDENKNKYAS

SEQ ID NO: 3234875 - protein, 14 aa, Plasmodium falciparum
NDDEPYSIESSEKV

SEQ ID NO: 3234876 - protein, 5 aa, Plasmodium falciparum
NDDGD

SEQ ID NO: 3234877 - protein, 17 aa, Plasmodium falciparum
NDDGQIPKKSIAKNSQE

SEQ ID NO: 3234878 - protein, 7 aa, Plasmodium falciparum
NDDGSYH

SEQ ID NO: 3234879 - protein, 4 aa, Plasmodium falciparum
NDDI

SEQ ID NO: 3234880 - protein, 12 aa, Plasmodium falciparum
NDDINNDDNMNN

SEQ ID NO: 3234881 - protein, 9 aa, Plasmodium falciparum
NDDITNDDI

SEQ ID NO: 3234882 - protein, 7 aa, Plasmodium falciparum
NDDITNK

SEQ ID NO: 3234883 - protein, 7 aa, Plasmodium falciparum
NDDIYSN

SEQ ID NO: 3234884 - protein, 4 aa, Plasmodium falciparum
NDDK

SEQ ID NO: 3234885 - protein, 9 aa, Plasmodium falciparum
NDDKEKEIN

SEQ ID NO: 3234886 - protein, 9 aa, Plasmodium falciparum
NDDKEKIKN

SEQ ID NO: 3234887 - protein, 9 aa, Plasmodium falciparum
NDDKINEYK

SEQ ID NO: 3234888 - protein, 7 aa, Plasmodium falciparum
NDDKINN

SEQ ID NO: 3234889 - protein, 35 aa, Plasmodium falciparum
NDDKNDKILKDENNKNNYNESYNITNKKNRSQSEY

SEQ ID NO: 3234890 - protein, 15 aa, Plasmodium falciparum
NDDKNINIDRDDNTY

SEQ ID NO: 3234891 - protein, 16 aa, Plasmodium falciparum
NDDKNINTKKIQNSKN

SEQ ID NO: 3234892 - protein, 38 aa, Plasmodium falciparum
NDDKNNDDKNNDDKNNDDKNNDNNNNDNNNNDNNNNND

SEQ ID NO: 3234893 - protein, 17 aa, Plasmodium falciparum
NDDKNNENNNRKNKLED

SEQ ID NO: 3234894 - protein, 10 aa, Plasmodium falciparum
NDDKNSPQYK

SEQ ID NO: 3234895 - protein, 7 aa, Plasmodium falciparum
NDDKTKL

SEQ ID NO: 3234896 - protein, 8 aa, Plasmodium falciparum
NDDKYNSL

SEQ ID NO: 3234897 - protein, 4 aa, Plasmodium falciparum
NDDL

SEQ ID NO: 3234898 - protein, 4 aa, Plasmodium falciparum
NDDN

SEQ ID NO: 3234899 - protein, 20 aa, Plasmodium falciparum
NDDNDDNDDNDDNDNETLNV

SEQ ID NO: 3234900 - protein, 53 aa, Plasmodium falciparum
NDDNDKKKNDNKEKNNDNDEKKNDNNEKKNDNNDDNNDDSNNNNYNNSNSYNS

SEQ ID NO: 3234901 - protein, 6 aa, Plasmodium falciparum
NDDNDL

SEQ ID NO: 3234902 - protein, 7 aa, Plasmodium falciparum
NDDNHEN

SEQ ID NO: 3234903 - protein, 7 aa, Plasmodium falciparum
NDDNHKN

SEQ ID NO: 3234904 - protein, 15 aa, Plasmodium falciparum
NDDNINDNNNDNNNE

SEQ ID NO: 3234905 - protein, 7 aa, Plasmodium falciparum
NDDNINN

SEQ ID NO: 3234906 - protein, 9 aa, Plasmodium falciparum
NDDNINNNH

SEQ ID NO: 3234907 - protein, 19 aa, Plasmodium falciparum
NDDNKKAEEELKSGTIPEN

SEQ ID NO: 3234908 - protein, 17 aa, Plasmodium falciparum
NDDNMGEKQSSEIDNKS

SEQ ID NO: 3234909 - protein, 5 aa, Plasmodium falciparum
NDDNN

SEQ ID NO: 3234910 - protein, 9 aa, Plasmodium falciparum
NDDNNEEAD

SEQ ID NO: 3234911 - protein, 11 aa, Plasmodium falciparum
NDDNNNNIEND

SEQ ID NO: 3234912 - protein, 61 aa, Plasmodium falciparum
NDDNNNNKKKKKKKKKKKTNNNKVDNEDNKNNTDCYNDNNNNNNINNNNNNNNNNKDCNHS

SEQ ID NO: 3234913 - protein, 10 aa, Plasmodium falciparum
NDDNRNTTYG

SEQ ID NO: 3234914 - protein, 7 aa, Plasmodium falciparum
NDDNSNY

SEQ ID NO: 3234915 - protein, 8 aa, Plasmodium falciparum
NDDNTTNC

SEQ ID NO: 3234916 - protein, 13 aa, Plasmodium falciparum
NDDQNDEHGNDKM

SEQ ID NO: 3234917 - protein, 16 aa, Plasmodium falciparum
NDDQPNADKPNTDPPT

SEQ ID NO: 3234918 - protein, 15 aa, Plasmodium falciparum
NDDSKSSSDVDKISE

SEQ ID NO: 3234919 - protein, 7 aa, Plasmodium falciparum
NDDTFKN

SEQ ID NO: 3234920 - protein, 5 aa, Plasmodium falciparum
NDDTI

SEQ ID NO: 3234921 - protein, 13 aa, Plasmodium falciparum
NDDTIKKNTSIEV

SEQ ID NO: 3234922 - protein, 7 aa, Plasmodium falciparum
NDDTKKD

SEQ ID NO: 3234923 - protein, 7 aa, Plasmodium falciparum
NDDTNNM

SEQ ID NO: 3234924 - protein, 8 aa, Plasmodium falciparum
NDDTPRND

SEQ ID NO: 3234925 - protein, 7 aa, Plasmodium falciparum
NDDTSRY

SEQ ID NO: 3234926 - protein, 15 aa, Plasmodium falciparum
NDDTTNSNNLGEGTH

SEQ ID NO: 3234927 - protein, 59 aa, Plasmodium falciparum
NDDVTNDDVTNDDIKNDDVTNDDIKNDDIKNDDIKNDDIKKDDIKNNDIKNDDIKNNDL

SEQ ID NO: 3234928 - protein, 15 aa, Plasmodium falciparum
NDEAIEEENSVTQPN

SEQ ID NO: 3234929 - protein, 4 aa, Plasmodium falciparum
NDED

SEQ ID NO: 3234930 - protein, 11 aa, Plasmodium falciparum
NDEDDASKKER

SEQ ID NO: 3234931 - protein, 7 aa, Plasmodium falciparum
NDEDDNN

SEQ ID NO: 3234932 - protein, 32 aa, Plasmodium falciparum
NDEDDTTTTTTTNNNNNNNNYSNNNNYSNNNN

SEQ ID NO: 3234933 - protein, 7 aa, Plasmodium falciparum
NDEDEKK

SEQ ID NO: 3234934 - protein, 22 aa, Plasmodium falciparum
NDEDNNACASYQTGNGIKNNKY

SEQ ID NO: 3234935 - protein, 7 aa, Plasmodium falciparum
NDEDNNI

SEQ ID NO: 3234936 - protein, 30 aa, Plasmodium falciparum
NDEDNNNNNNDKGKSHYDMNSSPKPVRSKK

SEQ ID NO: 3234937 - protein, 7 aa, Plasmodium falciparum
NDEDSID

SEQ ID NO: 3234938 - protein, 10 aa, Plasmodium falciparum
NDEDYHNNGL

SEQ ID NO: 3234939 - protein, 4 aa, Plasmodium falciparum
NDEE

SEQ ID NO: 3234940 - protein, 37 aa, Plasmodium falciparum
NDEEDDEEQDDEPPAPKPLPTPNPCVNGGDDTSGAQI

SEQ ID NO: 3234941 - protein, 8 aa, Plasmodium falciparum
NDEEDISK

SEQ ID NO: 3234942 - protein, 6 aa, Plasmodium falciparum
NDEEDV

SEQ ID NO: 3234943 - protein, 6 aa, Plasmodium falciparum
NDEEEK

SEQ ID NO: 3234944 - protein, 7 aa, Plasmodium falciparum
NDEEEKK

SEQ ID NO: 3234945 - protein, 7 aa, Plasmodium falciparum
NDEEEKM

SEQ ID NO: 3234946 - protein, 42 aa, Plasmodium falciparum
NDEEEQAEDDNWNYNNEESEDNEDSVKSEDSENSKCEEENTD

SEQ ID NO: 3234947 - protein, 7 aa, Plasmodium falciparum
NDEEFEN

SEQ ID NO: 3234948 - protein, 5 aa, Plasmodium falciparum
NDEEK

SEQ ID NO: 3234949 - protein, 6 aa, Plasmodium falciparum
NDEEKI

SEQ ID NO: 3234950 - protein, 9 aa, Plasmodium falciparum
NDEEKKKNI

SEQ ID NO: 3234951 - protein, 13 aa, Plasmodium falciparum
NDEEKKKRDELEE

SEQ ID NO: 3234952 - protein, 29 aa, Plasmodium falciparum
NDEEKKQNKIKNKNINETNNISENNEIEI

SEQ ID NO: 3234953 - protein, 11 aa, Plasmodium falciparum
NDEEKNKENYV

SEQ ID NO: 3234954 - protein, 61 aa, Plasmodium falciparum
NDEENNDMSNNDEENDVERDDEDVEGDDDEDVEVDDDEEVDVDEDEEEVDVDEDEEEVEEM

SEQ ID NO: 3234955 - protein, 9 aa, Plasmodium falciparum
NDEERKKQN

SEQ ID NO: 3234956 - protein, 27 aa, Plasmodium falciparum
NDEFTKKYEQDKYHSYDGRHDNDDNVD

SEQ ID NO: 3234957 - protein, 6 aa, Plasmodium falciparum
NDEHKD

SEQ ID NO: 3234958 - protein, 5 aa, Plasmodium falciparum
NDEHY

SEQ ID NO: 3234959 - protein, 4 aa, Plasmodium falciparum
NDEI

SEQ ID NO: 3234960 - protein, 14 aa, Plasmodium falciparum
NDEIDTNLDGNRKY

SEQ ID NO: 3234961 - protein, 58 aa, Plasmodium falciparum
NDEINDKRNNEENNDESNEVNNEESNEVNNEENNDVYNEENNEINKEENNEVNNEEMN

SEQ ID NO: 3234962 - protein, 14 aa, Plasmodium falciparum
NDEKDSINNLEEPS

SEQ ID NO: 3234963 - protein, 9 aa, Plasmodium falciparum
NDEKEKENN

SEQ ID NO: 3234964 - protein, 7 aa, Plasmodium falciparum
NDEKENI

SEQ ID NO: 3234965 - protein, 7 aa, Plasmodium falciparum
NDEKENK

SEQ ID NO: 3234966 - protein, 6 aa, Plasmodium falciparum
NDEKGI

SEQ ID NO: 3234967 - protein, 45 aa, Plasmodium falciparum
NDEKINDEKINDEKINDEKINDDNKKSCDDKKSCDDKKSCDGNNN

SEQ ID NO: 3234968 - protein, 10 aa, Plasmodium falciparum
NDEKKKKKKN

SEQ ID NO: 3234969 - protein, 20 aa, Plasmodium falciparum
NDEKKKKSKKKMKEEGIQNE

SEQ ID NO: 3234970 - protein, 8 aa, Plasmodium falciparum
NDEKNFKD

SEQ ID NO: 3234971 - protein, 6 aa, Plasmodium falciparum
NDEKYN

SEQ ID NO: 3234972 - protein, 19 aa, Plasmodium falciparum
NDEKYTNKNEDEYTKSSKK

SEQ ID NO: 3234973 - protein, 9 aa, Plasmodium falciparum
NDELNEEKD

SEQ ID NO: 3234974 - protein, 22 aa, Plasmodium falciparum
NDELNKNTTMDQNDMKKNENMN

SEQ ID NO: 3234975 - protein, 12 aa, Plasmodium falciparum
NDEMNNSDHPGE

SEQ ID NO: 3234976 - protein, 4 aa, Plasmodium falciparum
NDEN

SEQ ID NO: 3234977 - protein, 24 aa, Plasmodium falciparum
NDENDENDENDENDENDDYSKKPL

SEQ ID NO: 3234978 - protein, 9 aa, Plasmodium falciparum
NDENEKGSL

SEQ ID NO: 3234979 - protein, 9 aa, Plasmodium falciparum
NDENETNNQ

SEQ ID NO: 3234980 - protein, 8 aa, Plasmodium falciparum
NDENIKEE

SEQ ID NO: 3234981 - protein, 5 aa, Plasmodium falciparum
NDENK

SEQ ID NO: 3234982 - protein, 11 aa, Plasmodium falciparum
NDENKKNEKKI

SEQ ID NO: 3234983 - protein, 6 aa, Plasmodium falciparum
NDENMK

SEQ ID NO: 3234984 - protein, 11 aa, Plasmodium falciparum
NDENNDEEINK

SEQ ID NO: 3234985 - protein, 14 aa, Plasmodium falciparum
NDENNKNNPSPQSD

SEQ ID NO: 3234986 - protein, 7 aa, Plasmodium falciparum
NDENRYQ

SEQ ID NO: 3234987 - protein, 12 aa, Plasmodium falciparum
NDENSNMGPDQE

SEQ ID NO: 3234988 - protein, 7 aa, Plasmodium falciparum
NDENTNS

SEQ ID NO: 3234989 - protein, 107 aa, Plasmodium falciparum
NDENVKTNTNTNTNTNTNTNTNKNSDTDNHNDAYNHNDAYNHNDAYNHNDAYNHNDAYNHNDAYNHNDAYNHNDAYNHNDAYNHNDADNHNDTDNHSDNYNSHKYKG

SEQ ID NO: 3234990 - protein, 6 aa, Plasmodium falciparum
NDENYF

SEQ ID NO: 3234991 - protein, 6 aa, Plasmodium falciparum
NDEQGK

SEQ ID NO: 3234992 - protein, 9 aa, Plasmodium falciparum
NDEQNNNTS

SEQ ID NO: 3234993 - protein, 9 aa, Plasmodium falciparum
NDEQNYKNS

SEQ ID NO: 3234994 - protein, 5 aa, Plasmodium falciparum
NDEQY

SEQ ID NO: 3234995 - protein, 18 aa, Plasmodium falciparum
NDERENRGNPNGNMEETK

SEQ ID NO: 3234996 - protein, 5 aa, Plasmodium falciparum
NDERH

SEQ ID NO: 3234997 - protein, 14 aa, Plasmodium falciparum
NDERKKREKKNNKI

SEQ ID NO: 3234998 - protein, 7 aa, Plasmodium falciparum
NDERNCS

SEQ ID NO: 3234999 - protein, 41 aa, Plasmodium falciparum
NDERSQNEIKKEKTKEKIEKNENEKQGETQKENIKDENIKD

SEQ ID NO: 3235000 - protein, 8 aa, Plasmodium falciparum
NDESDESR

SEQ ID NO: 3235001 - protein, 16 aa, Plasmodium falciparum
NDESDTSEESDENDAI

SEQ ID NO: 3235002 - protein, 7 aa, Plasmodium falciparum
NDESEYI

SEQ ID NO: 3235003 - protein, 8 aa, Plasmodium falciparum
NDESKNNM

SEQ ID NO: 3235004 - protein, 21 aa, Plasmodium falciparum
NDESMSEPKKKLSLTSDTDVN

SEQ ID NO: 3235005 - protein, 8 aa, Plasmodium falciparum
NDESNKME

SEQ ID NO: 3235006 - protein, 7 aa, Plasmodium falciparum
NDETEQN

SEQ ID NO: 3235007 - protein, 5 aa, Plasmodium falciparum
NDETH

SEQ ID NO: 3235008 - protein, 9 aa, Plasmodium falciparum
NDETKDNIS

SEQ ID NO: 3235009 - protein, 7 aa, Plasmodium falciparum
NDETLTE

SEQ ID NO: 3235010 - protein, 7 aa, Plasmodium falciparum
NDETNVK

SEQ ID NO: 3235011 - protein, 8 aa, Plasmodium falciparum
NDETPFNN

SEQ ID NO: 3235012 - protein, 29 aa, Plasmodium falciparum
NDETSEDVNDTSDDINKNNDDNNKYDDNN

SEQ ID NO: 3235013 - protein, 8 aa, Plasmodium falciparum
NDETYTNN

SEQ ID NO: 3235014 - protein, 4 aa, Plasmodium falciparum
NDEY

SEQ ID NO: 3235015 - protein, 16 aa, Plasmodium falciparum
NDEYDNDDVSNNNRYE

SEQ ID NO: 3235016 - protein, 6 aa, Plasmodium falciparum
NDEYEN

SEQ ID NO: 3235017 - protein, 32 aa, Plasmodium falciparum
NDEYQKDIKSEDQQKSNNNYVSDDTNEKDSDY

SEQ ID NO: 3235018 - protein, 5 aa, Plasmodium falciparum
NDFES

SEQ ID NO: 3235019 - protein, 14 aa, Plasmodium falciparum
NDFESTYKEESYPN

SEQ ID NO: 3235020 - protein, 11 aa, Plasmodium falciparum
NDFNNYSNNNF

SEQ ID NO: 3235021 - protein, 6 aa, Plasmodium falciparum
NDFNTK

SEQ ID NO: 3235022 - protein, 4 aa, Plasmodium falciparum
NDFT

SEQ ID NO: 3235023 - protein, 55 aa, Plasmodium falciparum
NDGANKKKKIKKKKNNKKKNNKKKNNKKKNNKKKNNNNNNGGGDGDYSGDDIYSG

SEQ ID NO: 3235024 - protein, 4 aa, Plasmodium falciparum
NDGD

SEQ ID NO: 3235025 - protein, 16 aa, Plasmodium falciparum
NDGDENKSDISSKSFS

SEQ ID NO: 3235026 - protein, 7 aa, Plasmodium falciparum
NDGDMKS

SEQ ID NO: 3235027 - protein, 6 aa, Plasmodium falciparum
NDGDSF

SEQ ID NO: 3235028 - protein, 28 aa, Plasmodium falciparum
NDGKNKKFVQKKKQKETAKQRRLTLKRN

SEQ ID NO: 3235029 - protein, 13 aa, Plasmodium falciparum
NDGKQKNKEKQNT

SEQ ID NO: 3235030 - protein, 7 aa, Plasmodium falciparum
NDGKQLD

SEQ ID NO: 3235031 - protein, 18 aa, Plasmodium falciparum
NDGLTSKNKENPEKNHNP

SEQ ID NO: 3235032 - protein, 8 aa, Plasmodium falciparum
NDGNTATC

SEQ ID NO: 3235033 - protein, 15 aa, Plasmodium falciparum
NDGPEPRTTRYENSA

SEQ ID NO: 3235034 - protein, 7 aa, Plasmodium falciparum
NDGQNTL

SEQ ID NO: 3235035 - protein, 6 aa, Plasmodium falciparum
NDGRIE

SEQ ID NO: 3235036 - protein, 115 aa, Plasmodium falciparum
NDGSNNENKNKENKNKSSEKSKAKDNNNNKKDNNNNNNNKKDNNNNNNKKDNNNSNNNNNNNNLSNNGEEDPNDSDSDKDKKKKNKKKDNKNINDDSDDNNKNKKKLKNNIKNSD

SEQ ID NO: 3235037 - protein, 7 aa, Plasmodium falciparum
NDGSSDI

SEQ ID NO: 3235038 - protein, 14 aa, Plasmodium falciparum
NDGSYQYDRKEEDH

SEQ ID NO: 3235039 - protein, 10 aa, Plasmodium falciparum
NDGTENKNSN

SEQ ID NO: 3235040 - protein, 7 aa, Plasmodium falciparum
NDGTYRR

SEQ ID NO: 3235041 - protein, 29 aa, Plasmodium falciparum
NDGVENKDNIHEGNNNLENDSFNEDTIEE

SEQ ID NO: 3235042 - protein, 7 aa, Plasmodium falciparum
NDGYNYN

SEQ ID NO: 3235043 - protein, 10 aa, Plasmodium falciparum
NDHDKKENEH

SEQ ID NO: 3235044 - protein, 12 aa, Plasmodium falciparum
NDHHDEKGDGHP

SEQ ID NO: 3235045 - protein, 19 aa, Plasmodium falciparum
NDHHDNRKDYDTTEDQNKC

SEQ ID NO: 3235046 - protein, 19 aa, Plasmodium falciparum
NDHHHNDDNQNDDEEKKGY

SEQ ID NO: 3235047 - protein, 15 aa, Plasmodium falciparum
NDHKDGRHNNNNNHY

SEQ ID NO: 3235048 - protein, 11 aa, Plasmodium falciparum
NDHKDSHSNND

SEQ ID NO: 3235049 - protein, 10 aa, Plasmodium falciparum
NDHKEDNSQL

SEQ ID NO: 3235050 - protein, 23 aa, Plasmodium falciparum
NDHKEEIKEDNSNEYNINNKNDN

SEQ ID NO: 3235051 - protein, 10 aa, Plasmodium falciparum
NDHKNIGTSK

SEQ ID NO: 3235052 - protein, 10 aa, Plasmodium falciparum
NDHKNINENV

SEQ ID NO: 3235053 - protein, 10 aa, Plasmodium falciparum
NDHKTNQQNN

SEQ ID NO: 3235054 - protein, 7 aa, Plasmodium falciparum
NDHMSNE

SEQ ID NO: 3235055 - protein, 14 aa, Plasmodium falciparum
NDHNDTHKENSSDH

SEQ ID NO: 3235056 - protein, 8 aa, Plasmodium falciparum
NDHNNNSH

SEQ ID NO: 3235057 - protein, 6 aa, Plasmodium falciparum
NDHNNS

SEQ ID NO: 3235058 - protein, 6 aa, Plasmodium falciparum
NDHPKE

SEQ ID NO: 3235059 - protein, 6 aa, Plasmodium falciparum
NDHPTK

SEQ ID NO: 3235060 - protein, 33 aa, Plasmodium falciparum
NDHSNNYDNNNKNNNNNNNNNNKNNNNSISSSE

SEQ ID NO: 3235061 - protein, 5 aa, Plasmodium falciparum
NDHSY

SEQ ID NO: 3235062 - protein, 7 aa, Plasmodium falciparum
NDHTNYY

SEQ ID NO: 3235063 - protein, 15 aa, Plasmodium falciparum
NDHTYGHKSKTQKHY

SEQ ID NO: 3235064 - protein, 6 aa, Plasmodium falciparum
NDHYDN

SEQ ID NO: 3235065 - protein, 21 aa, Plasmodium falciparum
NDIAKDAGKAATKMTTQTTEA

SEQ ID NO: 3235066 - protein, 17 aa, Plasmodium falciparum
NDIDDNNTRDGQVNSDS

SEQ ID NO: 3235067 - protein, 12 aa, Plasmodium falciparum
NDIDEEEYNKEK

SEQ ID NO: 3235068 - protein, 7 aa, Plasmodium falciparum
NDIDPNG

SEQ ID NO: 3235069 - protein, 6 aa, Plasmodium falciparum
NDIEEL

SEQ ID NO: 3235070 - protein, 30 aa, Plasmodium falciparum
NDIEKNKLRRKQTRNENEEQINELENKKNE

SEQ ID NO: 3235071 - protein, 12 aa, Plasmodium falciparum
NDIENKNQTNSS

SEQ ID NO: 3235072 - protein, 7 aa, Plasmodium falciparum
NDIESYT

SEQ ID NO: 3235073 - protein, 8 aa, Plasmodium falciparum
NDIGKGNT

SEQ ID NO: 3235074 - protein, 32 aa, Plasmodium falciparum
NDIIEKQKKEKEQKNDNVTRYSEEDLQSDDKY

SEQ ID NO: 3235075 - protein, 9 aa, Plasmodium falciparum
NDIINNKTS

SEQ ID NO: 3235076 - protein, 6 aa, Plasmodium falciparum
NDIKRD

SEQ ID NO: 3235077 - protein, 5 aa, Plasmodium falciparum
NDIND

SEQ ID NO: 3235078 - protein, 8 aa, Plasmodium falciparum
NDINDEYS

SEQ ID NO: 3235079 - protein, 10 aa, Plasmodium falciparum
NDINDKPNNT

SEQ ID NO: 3235080 - protein, 13 aa, Plasmodium falciparum
NDINDYEQEQADY

SEQ ID NO: 3235081 - protein, 12 aa, Plasmodium falciparum
NDINEKDEQTNS

SEQ ID NO: 3235082 - protein, 5 aa, Plasmodium falciparum
NDINN

SEQ ID NO: 3235083 - protein, 45 aa, Plasmodium falciparum
NDINNDINNDINNDINNDYNNDYNNDYNNDYNNDYNNDYNNNDYY

SEQ ID NO: 3235084 - protein, 12 aa, Plasmodium falciparum
NDINQDDDKRNS

SEQ ID NO: 3235085 - protein, 13 aa, Plasmodium falciparum
NDINRRDDDNISI

SEQ ID NO: 3235086 - protein, 6 aa, Plasmodium falciparum
NDINRS

SEQ ID NO: 3235087 - protein, 5 aa, Plasmodium falciparum
NDINS

SEQ ID NO: 3235088 - protein, 13 aa, Plasmodium falciparum
NDINSINEDTNRN

SEQ ID NO: 3235089 - protein, 9 aa, Plasmodium falciparum
NDINSKRYN

SEQ ID NO: 3235090 - protein, 13 aa, Plasmodium falciparum
NDINYNNNNNNNN

SEQ ID NO: 3235091 - protein, 14 aa, Plasmodium falciparum
NDIPISGKNGTYSG

SEQ ID NO: 3235092 - protein, 9 aa, Plasmodium falciparum
NDIPNKNKI

SEQ ID NO: 3235093 - protein, 7 aa, Plasmodium falciparum
NDIQKKS

SEQ ID NO: 3235094 - protein, 14 aa, Plasmodium falciparum
NDIRENKKEEIYNT

SEQ ID NO: 3235095 - protein, 4 aa, Plasmodium falciparum
NDIS

SEQ ID NO: 3235096 - protein, 5 aa, Plasmodium falciparum
NDISK

SEQ ID NO: 3235097 - protein, 6 aa, Plasmodium falciparum
NDISKK

SEQ ID NO: 3235098 - protein, 19 aa, Plasmodium falciparum
NDISKNEEDSDKKNIEENT

SEQ ID NO: 3235099 - protein, 9 aa, Plasmodium falciparum
NDISKNTFD

SEQ ID NO: 3235100 - protein, 13 aa, Plasmodium falciparum
NDISKYQTENKTK

SEQ ID NO: 3235101 - protein, 16 aa, Plasmodium falciparum
NDISNEINKNDTLNDL

SEQ ID NO: 3235102 - protein, 9 aa, Plasmodium falciparum
NDISQDNDN

SEQ ID NO: 3235103 - protein, 9 aa, Plasmodium falciparum
NDITEDEEN

SEQ ID NO: 3235104 - protein, 5 aa, Plasmodium falciparum
NDITN

SEQ ID NO: 3235105 - protein, 7 aa, Plasmodium falciparum
NDITNAK

SEQ ID NO: 3235106 - protein, 5 aa, Plasmodium falciparum
NDITT

SEQ ID NO: 3235107 - protein, 5 aa, Plasmodium falciparum
NDIYE

SEQ ID NO: 3235108 - protein, 4 aa, Plasmodium falciparum
NDKA

SEQ ID NO: 3235109 - protein, 7 aa, Plasmodium falciparum
NDKASQD

SEQ ID NO: 3235110 - protein, 19 aa, Plasmodium falciparum
NDKASTSSYNTSACNNTNK

SEQ ID NO: 3235111 - protein, 4 aa, Plasmodium falciparum
NDKC

SEQ ID NO: 3235112 - protein, 8 aa, Plasmodium falciparum
NDKCNSNV

SEQ ID NO: 3235113 - protein, 8 aa, Plasmodium falciparum
NDKDKEDI

SEQ ID NO: 3235114 - protein, 7 aa, Plasmodium falciparum
NDKDKIS

SEQ ID NO: 3235115 - protein, 7 aa, Plasmodium falciparum
NDKDNNI

SEQ ID NO: 3235116 - protein, 9 aa, Plasmodium falciparum
NDKDNVNQH

SEQ ID NO: 3235117 - protein, 13 aa, Plasmodium falciparum
NDKDTNKSLNNNY

SEQ ID NO: 3235118 - protein, 6 aa, Plasmodium falciparum
NDKEAK

SEQ ID NO: 3235119 - protein, 19 aa, Plasmodium falciparum
NDKEDISNNLSSRNTPKIK

SEQ ID NO: 3235120 - protein, 5 aa, Plasmodium falciparum
NDKEE

SEQ ID NO: 3235121 - protein, 13 aa, Plasmodium falciparum
NDKEEDKDEEAKY

SEQ ID NO: 3235122 - protein, 7 aa, Plasmodium falciparum
NDKEEGY

SEQ ID NO: 3235123 - protein, 8 aa, Plasmodium falciparum
NDKEEIPD

SEQ ID NO: 3235124 - protein, 15 aa, Plasmodium falciparum
NDKEEKDKINKEEIN

SEQ ID NO: 3235125 - protein, 6 aa, Plasmodium falciparum
NDKEEY

SEQ ID NO: 3235126 - protein, 57 aa, Plasmodium falciparum
NDKEHEKDNEDNDEDNDEDDDDEDDDEDDEDDDDDDDDDDDDDDDDDYDEDYDEDYD

SEQ ID NO: 3235127 - protein, 9 aa, Plasmodium falciparum
NDKEKNKCL

SEQ ID NO: 3235128 - protein, 16 aa, Plasmodium falciparum
NDKEKYKKEKEHNNKN

SEQ ID NO: 3235129 - protein, 11 aa, Plasmodium falciparum
NDKEMQQDDNI

SEQ ID NO: 3235130 - protein, 9 aa, Plasmodium falciparum
NDKEQNKNN

SEQ ID NO: 3235131 - protein, 10 aa, Plasmodium falciparum
NDKETNNCNI

SEQ ID NO: 3235132 - protein, 8 aa, Plasmodium falciparum
NDKGEYRA

SEQ ID NO: 3235133 - protein, 6 aa, Plasmodium falciparum
NDKGQK

SEQ ID NO: 3235134 - protein, 11 aa, Plasmodium falciparum
NDKHKNNKDKK

SEQ ID NO: 3235135 - protein, 41 aa, Plasmodium falciparum
NDKIDGKKNEWEKKNEGEKKNRNNQHNLNDNESNLENNIQN

SEQ ID NO: 3235136 - protein, 14 aa, Plasmodium falciparum
NDKINEKKNGHINE

SEQ ID NO: 3235137 - protein, 7 aa, Plasmodium falciparum
NDKISTK

SEQ ID NO: 3235138 - protein, 6 aa, Plasmodium falciparum
NDKKDG

SEQ ID NO: 3235139 - protein, 9 aa, Plasmodium falciparum
NDKKDVEKS

SEQ ID NO: 3235140 - protein, 8 aa, Plasmodium falciparum
NDKKEKEK

SEQ ID NO: 3235141 - protein, 32 aa, Plasmodium falciparum
NDKKEKEKDTKDEKKNKKKNKINYPNNDNEII

SEQ ID NO: 3235142 - protein, 8 aa, Plasmodium falciparum
NDKKGTKV

SEQ ID NO: 3235143 - protein, 8 aa, Plasmodium falciparum
NDKKKDQT

SEQ ID NO: 3235144 - protein, 12 aa, Plasmodium falciparum
NDKKKKKDVQAD

SEQ ID NO: 3235145 - protein, 10 aa, Plasmodium falciparum
NDKKKKKSYI

SEQ ID NO: 3235146 - protein, 9 aa, Plasmodium falciparum
NDKKKSTSK

SEQ ID NO: 3235147 - protein, 9 aa, Plasmodium falciparum
NDKKNKTNI

SEQ ID NO: 3235148 - protein, 20 aa, Plasmodium falciparum
NDKKPSKGKKRTSTTTEGTQ

SEQ ID NO: 3235149 - protein, 6 aa, Plasmodium falciparum
NDKKRY

SEQ ID NO: 3235150 - protein, 14 aa, Plasmodium falciparum
NDKKTCGKKKCNRD

SEQ ID NO: 3235151 - protein, 27 aa, Plasmodium falciparum
NDKKYDPNNIHGNNNNNNNNNNSNKLN

SEQ ID NO: 3235152 - protein, 30 aa, Plasmodium falciparum
NDKKYKKKKKKYSELQDSNISSNNTLTSKR

SEQ ID NO: 3235153 - protein, 6 aa, Plasmodium falciparum
NDKLDE

SEQ ID NO: 3235154 - protein, 12 aa, Plasmodium falciparum
NDKLKNEQNYPS

SEQ ID NO: 3235155 - protein, 7 aa, Plasmodium falciparum
NDKLKNV

SEQ ID NO: 3235156 - protein, 6 aa, Plasmodium falciparum
NDKMGD

SEQ ID NO: 3235157 - protein, 10 aa, Plasmodium falciparum
NDKMKSPGKS

SEQ ID NO: 3235158 - protein, 4 aa, Plasmodium falciparum
NDKN

SEQ ID NO: 3235159 - protein, 5 aa, Plasmodium falciparum
NDKND

SEQ ID NO: 3235160 - protein, 12 aa, Plasmodium falciparum
NDKNEDDENSKQ

SEQ ID NO: 3235161 - protein, 15 aa, Plasmodium falciparum
NDKNEISKKKKKLKS

SEQ ID NO: 3235162 - protein, 28 aa, Plasmodium falciparum
NDKNEKNEKNDNDIMNSNKENDNKDGKS

SEQ ID NO: 3235163 - protein, 8 aa, Plasmodium falciparum
NDKNFDTN

SEQ ID NO: 3235164 - protein, 6 aa, Plasmodium falciparum
NDKNIE

SEQ ID NO: 3235165 - protein, 6 aa, Plasmodium falciparum
NDKNKI

SEQ ID NO: 3235166 - protein, 20 aa, Plasmodium falciparum
NDKNNASTEYNSEKAKHPKK

SEQ ID NO: 3235167 - protein, 8 aa, Plasmodium falciparum
NDKNNGGI

SEQ ID NO: 3235168 - protein, 13 aa, Plasmodium falciparum
NDKNNKNNKNNKN

SEQ ID NO: 3235169 - protein, 9 aa, Plasmodium falciparum
NDKNNPNNI

SEQ ID NO: 3235170 - protein, 10 aa, Plasmodium falciparum
NDKNSIANQS

SEQ ID NO: 3235171 - protein, 6 aa, Plasmodium falciparum
NDKNSS

SEQ ID NO: 3235172 - protein, 7 aa, Plasmodium falciparum
NDKNTNI

SEQ ID NO: 3235173 - protein, 7 aa, Plasmodium falciparum
NDKNVNE

SEQ ID NO: 3235174 - protein, 5 aa, Plasmodium falciparum
NDKPI

SEQ ID NO: 3235175 - protein, 8 aa, Plasmodium falciparum
NDKPNYFD

SEQ ID NO: 3235176 - protein, 4 aa, Plasmodium falciparum
NDKR

SEQ ID NO: 3235177 - protein, 5 aa, Plasmodium falciparum
NDKRK

SEQ ID NO: 3235178 - protein, 18 aa, Plasmodium falciparum
NDKRKKDLGKNNLQKSNE

SEQ ID NO: 3235179 - protein, 7 aa, Plasmodium falciparum
NDKRKKG

SEQ ID NO: 3235180 - protein, 8 aa, Plasmodium falciparum
NDKRNSYS

SEQ ID NO: 3235181 - protein, 14 aa, Plasmodium falciparum
NDKRQKCKEQREKD

SEQ ID NO: 3235182 - protein, 5 aa, Plasmodium falciparum
NDKRY

SEQ ID NO: 3235183 - protein, 4 aa, Plasmodium falciparum
NDKS

SEQ ID NO: 3235184 - protein, 12 aa, Plasmodium falciparum
NDKSDPGTNNNN

SEQ ID NO: 3235185 - protein, 5 aa, Plasmodium falciparum
NDKSI

SEQ ID NO: 3235186 - protein, 5 aa, Plasmodium falciparum
NDKSK

SEQ ID NO: 3235187 - protein, 17 aa, Plasmodium falciparum
NDKSKYQHYNNDSDNTF

SEQ ID NO: 3235188 - protein, 8 aa, Plasmodium falciparum
NDKSLPPL

SEQ ID NO: 3235189 - protein, 9 aa, Plasmodium falciparum
NDKSNKNDD

SEQ ID NO: 3235190 - protein, 6 aa, Plasmodium falciparum
NDKSPL

SEQ ID NO: 3235191 - protein, 10 aa, Plasmodium falciparum
NDKSPPNDKY

SEQ ID NO: 3235192 - protein, 16 aa, Plasmodium falciparum
NDKSSSQNEENTNHNK

SEQ ID NO: 3235193 - protein, 7 aa, Plasmodium falciparum
NDKTNHM

SEQ ID NO: 3235194 - protein, 13 aa, Plasmodium falciparum
NDKTNNSTNDNNI

SEQ ID NO: 3235195 - protein, 13 aa, Plasmodium falciparum
NDKVHDNNNYSSM

SEQ ID NO: 3235196 - protein, 18 aa, Plasmodium falciparum
NDKYDEEDEEDEEDIEED

SEQ ID NO: 3235197 - protein, 7 aa, Plasmodium falciparum
NDKYGKP

SEQ ID NO: 3235198 - protein, 9 aa, Plasmodium falciparum
NDLEGSDEI

SEQ ID NO: 3235199 - protein, 15 aa, Plasmodium falciparum
NDLGKRGNKIKPKHK

SEQ ID NO: 3235200 - protein, 6 aa, Plasmodium falciparum
NDLKDD

SEQ ID NO: 3235201 - protein, 54 aa, Plasmodium falciparum
NDLKNKSKDKKKKKRNQNDDNDYNDDDNDYNDDDNDDVNNDDDNNNDNNDNNNN

SEQ ID NO: 3235202 - protein, 10 aa, Plasmodium falciparum
NDLKSEEHEQ

SEQ ID NO: 3235203 - protein, 10 aa, Plasmodium falciparum
NDLLDNKDNY

SEQ ID NO: 3235204 - protein, 7 aa, Plasmodium falciparum
NDLNASG

SEQ ID NO: 3235205 - protein, 16 aa, Plasmodium falciparum
NDLNNDDKSVSKAISE

SEQ ID NO: 3235206 - protein, 23 aa, Plasmodium falciparum
NDLNNSNDFSINEEKKNNKDTKK

SEQ ID NO: 3235207 - protein, 4 aa, Plasmodium falciparum
NDLP

SEQ ID NO: 3235208 - protein, 6 aa, Plasmodium falciparum
NDLRKN

SEQ ID NO: 3235209 - protein, 8 aa, Plasmodium falciparum
NDLSNSNI

SEQ ID NO: 3235210 - protein, 9 aa, Plasmodium falciparum
NDLSSKGEN

SEQ ID NO: 3235211 - protein, 6 aa, Plasmodium falciparum
NDLTEQ

SEQ ID NO: 3235212 - protein, 5 aa, Plasmodium falciparum
NDLYE

SEQ ID NO: 3235213 - protein, 12 aa, Plasmodium falciparum
NDMDSTKTYSHY

SEQ ID NO: 3235214 - protein, 40 aa, Plasmodium falciparum
NDMGTHSSPRNKDFNETYNSSKKDQKRSSKKLGFLKYLSR

SEQ ID NO: 3235215 - protein, 4 aa, Plasmodium falciparum
NDMI

SEQ ID NO: 3235216 - protein, 6 aa, Plasmodium falciparum
NDMNGS

SEQ ID NO: 3235217 - protein, 16 aa, Plasmodium falciparum
NDMNNNINQQNKKDEE

SEQ ID NO: 3235218 - protein, 12 aa, Plasmodium falciparum
NDMNNNNNNNNK

SEQ ID NO: 3235219 - protein, 17 aa, Plasmodium falciparum
NDMNNNNNNNNNDDDEL

SEQ ID NO: 3235220 - protein, 5 aa, Plasmodium falciparum
NDMNS

SEQ ID NO: 3235221 - protein, 13 aa, Plasmodium falciparum
NDMNTQKNKIPKE

SEQ ID NO: 3235222 - protein, 6 aa, Plasmodium falciparum
NDMPKC

SEQ ID NO: 3235223 - protein, 6 aa, Plasmodium falciparum
NDMPYD

SEQ ID NO: 3235224 - protein, 26 aa, Plasmodium falciparum
NDMSENLNKNSKDHSFESSSDNNFQS

SEQ ID NO: 3235225 - protein, 7 aa, Plasmodium falciparum
NDMTNIP

SEQ ID NO: 3235226 - protein, 5 aa, Plasmodium falciparum
NDNCL

SEQ ID NO: 3235227 - protein, 4 aa, Plasmodium falciparum
NDND

SEQ ID NO: 3235228 - protein, 9 aa, Plasmodium falciparum
NDNDKNVNN

SEQ ID NO: 3235229 - protein, 13 aa, Plasmodium falciparum
NDNDNDDDDGEKS

SEQ ID NO: 3235230 - protein, 25 aa, Plasmodium falciparum
NDNDNDDDEYTSNNCSDSDTSGCPD

SEQ ID NO: 3235231 - protein, 8 aa, Plasmodium falciparum
NDNDTFSR

SEQ ID NO: 3235232 - protein, 8 aa, Plasmodium falciparum
NDNEDPKY

SEQ ID NO: 3235233 - protein, 10 aa, Plasmodium falciparum
NDNEHDDDIS

SEQ ID NO: 3235234 - protein, 6 aa, Plasmodium falciparum
NDNEKD

SEQ ID NO: 3235235 - protein, 14 aa, Plasmodium falciparum
NDNENENKDSNLDT

SEQ ID NO: 3235236 - protein, 14 aa, Plasmodium falciparum
NDNENNSVHDKNNT

SEQ ID NO: 3235237 - protein, 34 aa, Plasmodium falciparum
NDNENQNESQNEGQGQGQGQGQNQSENAEQKDYY

SEQ ID NO: 3235238 - protein, 6 aa, Plasmodium falciparum
NDNENS

SEQ ID NO: 3235239 - protein, 9 aa, Plasmodium falciparum
NDNESDTQN

SEQ ID NO: 3235240 - protein, 13 aa, Plasmodium falciparum
NDNFETQQMGEEN

SEQ ID NO: 3235241 - protein, 4 aa, Plasmodium falciparum
NDNH

SEQ ID NO: 3235242 - protein, 6 aa, Plasmodium falciparum
NDNHLN

SEQ ID NO: 3235243 - protein, 5 aa, Plasmodium falciparum
NDNHN

SEQ ID NO: 3235244 - protein, 6 aa, Plasmodium falciparum
NDNHNE

SEQ ID NO: 3235245 - protein, 8 aa, Plasmodium falciparum
NDNHSNDF

SEQ ID NO: 3235246 - protein, 10 aa, Plasmodium falciparum
NDNHTQDMSD

SEQ ID NO: 3235247 - protein, 16 aa, Plasmodium falciparum
NDNHTRISSKPKNSYE

SEQ ID NO: 3235248 - protein, 4 aa, Plasmodium falciparum
NDNI

SEQ ID NO: 3235249 - protein, 6 aa, Plasmodium falciparum
NDNIDD

SEQ ID NO: 3235250 - protein, 14 aa, Plasmodium falciparum
NDNIEEKKNVSSNI

SEQ ID NO: 3235251 - protein, 11 aa, Plasmodium falciparum
NDNIKNNKNYK

SEQ ID NO: 3235252 - protein, 5 aa, Plasmodium falciparum
NDNIN

SEQ ID NO: 3235253 - protein, 11 aa, Plasmodium falciparum
NDNINDANNNM

SEQ ID NO: 3235254 - protein, 9 aa, Plasmodium falciparum
NDNINKKDN

SEQ ID NO: 3235255 - protein, 21 aa, Plasmodium falciparum
NDNINNNDSNNDNINNSISNK

SEQ ID NO: 3235256 - protein, 7 aa, Plasmodium falciparum
NDNISQE

SEQ ID NO: 3235257 - protein, 9 aa, Plasmodium falciparum
NDNKDDINK

SEQ ID NO: 3235258 - protein, 7 aa, Plasmodium falciparum
NDNKIDD

SEQ ID NO: 3235259 - protein, 6 aa, Plasmodium falciparum
NDNKIN

SEQ ID NO: 3235260 - protein, 9 aa, Plasmodium falciparum
NDNKISNTL

SEQ ID NO: 3235261 - protein, 5 aa, Plasmodium falciparum
NDNKK

SEQ ID NO: 3235262 - protein, 10 aa, Plasmodium falciparum
NDNKKPEPVS

SEQ ID NO: 3235263 - protein, 20 aa, Plasmodium falciparum
NDNKKSGDKNDVHATNSASM

SEQ ID NO: 3235264 - protein, 5 aa, Plasmodium falciparum
NDNKN

SEQ ID NO: 3235265 - protein, 9 aa, Plasmodium falciparum
NDNKNELKK

SEQ ID NO: 3235266 - protein, 14 aa, Plasmodium falciparum
NDNKNMNRSNRNEN

SEQ ID NO: 3235267 - protein, 26 aa, Plasmodium falciparum
NDNKNNDNEDNKQDDEEKNDEDDNKS

SEQ ID NO: 3235268 - protein, 40 aa, Plasmodium falciparum
NDNKNNTSSSSNNNNNNKNNNNNNDNNNDNDNICSNSNNN

SEQ ID NO: 3235269 - protein, 6 aa, Plasmodium falciparum
NDNKSK

SEQ ID NO: 3235270 - protein, 15 aa, Plasmodium falciparum
NDNKSRCNEKTNSYD

SEQ ID NO: 3235271 - protein, 7 aa, Plasmodium falciparum
NDNKSSN

SEQ ID NO: 3235272 - protein, 16 aa, Plasmodium falciparum
NDNKTNNKKNNKKKYS

SEQ ID NO: 3235273 - protein, 7 aa, Plasmodium falciparum
NDNKTPI

SEQ ID NO: 3235274 - protein, 7 aa, Plasmodium falciparum
NDNKYNS

SEQ ID NO: 3235275 - protein, 5 aa, Plasmodium falciparum
NDNLD

SEQ ID NO: 3235276 - protein, 5 aa, Plasmodium falciparum
NDNME

SEQ ID NO: 3235277 - protein, 5 aa, Plasmodium falciparum
NDNMN

SEQ ID NO: 3235278 - protein, 7 aa, Plasmodium falciparum
NDNMNKD

SEQ ID NO: 3235279 - protein, 4 aa, Plasmodium falciparum
NDNN

SEQ ID NO: 3235280 - protein, 14 aa, Plasmodium falciparum
NDNNDNNDNNYHNR

SEQ ID NO: 3235281 - protein, 17 aa, Plasmodium falciparum
NDNNDNNNNNNNNNNNS

SEQ ID NO: 3235282 - protein, 9 aa, Plasmodium falciparum
NDNNDNNSI

SEQ ID NO: 3235283 - protein, 5 aa, Plasmodium falciparum
NDNNE

SEQ ID NO: 3235284 - protein, 8 aa, Plasmodium falciparum
NDNNENTE

SEQ ID NO: 3235285 - protein, 16 aa, Plasmodium falciparum
NDNNIDKNKTNSYNDM

SEQ ID NO: 3235286 - protein, 9 aa, Plasmodium falciparum
NDNNINKYN

SEQ ID NO: 3235287 - protein, 9 aa, Plasmodium falciparum
NDNNINNNI

SEQ ID NO: 3235288 - protein, 12 aa, Plasmodium falciparum
NDNNKKNKNNLI

SEQ ID NO: 3235289 - protein, 6 aa, Plasmodium falciparum
NDNNKN

SEQ ID NO: 3235290 - protein, 9 aa, Plasmodium falciparum
NDNNKNAKE

SEQ ID NO: 3235291 - protein, 39 aa, Plasmodium falciparum
NDNNKNDNNKNNKNGNNKNNKNGNNKKSNNNNNNLCSNE

SEQ ID NO: 3235292 - protein, 9 aa, Plasmodium falciparum
NDNNKNDTN

SEQ ID NO: 3235293 - protein, 9 aa, Plasmodium falciparum
NDNNKNMDN

SEQ ID NO: 3235294 - protein, 11 aa, Plasmodium falciparum
NDNNNDNDDIK

SEQ ID NO: 3235295 - protein, 27 aa, Plasmodium falciparum
NDNNNDNNDNDIDIDNSTDDDDDDDDN

SEQ ID NO: 3235296 - protein, 10 aa, Plasmodium falciparum
NDNNNGACMP

SEQ ID NO: 3235297 - protein, 7 aa, Plasmodium falciparum
NDNNNNI

SEQ ID NO: 3235298 - protein, 7 aa, Plasmodium falciparum
NDNNNNN

SEQ ID NO: 3235299 - protein, 60 aa, Plasmodium falciparum
NDNNNNNNNNNNNNNNNNNNNNINNNNSNNNNNNNNNNNNNNNNNNNNNNNNNNNNNNNY

SEQ ID NO: 3235300 - protein, 14 aa, Plasmodium falciparum
NDNNNNNNNNNNYS

SEQ ID NO: 3235301 - protein, 34 aa, Plasmodium falciparum
NDNNRSNNIPNEGSKNRFDESEKNNNKKENLQNE

SEQ ID NO: 3235302 - protein, 10 aa, Plasmodium falciparum
NDNNSNMSTE

SEQ ID NO: 3235303 - protein, 9 aa, Plasmodium falciparum
NDNNSNNEN

SEQ ID NO: 3235304 - protein, 11 aa, Plasmodium falciparum
NDNNSNNTNDI

SEQ ID NO: 3235305 - protein, 8 aa, Plasmodium falciparum
NDNNSSDI

SEQ ID NO: 3235306 - protein, 7 aa, Plasmodium falciparum
NDNPHDN

SEQ ID NO: 3235307 - protein, 7 aa, Plasmodium falciparum
NDNPQNQ

SEQ ID NO: 3235308 - protein, 7 aa, Plasmodium falciparum
NDNQEEK

SEQ ID NO: 3235309 - protein, 18 aa, Plasmodium falciparum
NDNQKNSNEDRQKIEKEQ

SEQ ID NO: 3235310 - protein, 12 aa, Plasmodium falciparum
NDNRGKEEEYNE

SEQ ID NO: 3235311 - protein, 25 aa, Plasmodium falciparum
NDNRLNNNYRSGFDDTKKNNINDDK

SEQ ID NO: 3235312 - protein, 47 aa, Plasmodium falciparum
NDNSEKGKENQKKKEKTKKKTETDTDTDTDTETKKNISNEENSGDVK

SEQ ID NO: 3235313 - protein, 5 aa, Plasmodium falciparum
NDNSF

SEQ ID NO: 3235314 - protein, 15 aa, Plasmodium falciparum
NDNSPNHKTQKNKNE

SEQ ID NO: 3235315 - protein, 19 aa, Plasmodium falciparum
NDNSTSYSSSKMEPESNRY

SEQ ID NO: 3235316 - protein, 6 aa, Plasmodium falciparum
NDNTHN

SEQ ID NO: 3235317 - protein, 7 aa, Plasmodium falciparum
NDNTNNI

SEQ ID NO: 3235318 - protein, 13 aa, Plasmodium falciparum
NDNTNNKSHNNIN

SEQ ID NO: 3235319 - protein, 8 aa, Plasmodium falciparum
NDNTNQSH

SEQ ID NO: 3235320 - protein, 8 aa, Plasmodium falciparum
NDNTSIDN

SEQ ID NO: 3235321 - protein, 8 aa, Plasmodium falciparum
NDNTTNRY

SEQ ID NO: 3235322 - protein, 8 aa, Plasmodium falciparum
NDNTYNKK

SEQ ID NO: 3235323 - protein, 25 aa, Plasmodium falciparum
NDNVSNNVSNNNNIQGEYNHKGDVP

SEQ ID NO: 3235324 - protein, 5 aa, Plasmodium falciparum
NDNYE

SEQ ID NO: 3235325 - protein, 10 aa, Plasmodium falciparum
NDNYKNNNEH

SEQ ID NO: 3235326 - protein, 6 aa, Plasmodium falciparum
NDNYNK

SEQ ID NO: 3235327 - protein, 6 aa, Plasmodium falciparum
NDPDDD

SEQ ID NO: 3235328 - protein, 10 aa, Plasmodium falciparum
NDPDNNKRCD

SEQ ID NO: 3235329 - protein, 4 aa, Plasmodium falciparum
NDPE

SEQ ID NO: 3235330 - protein, 5 aa, Plasmodium falciparum
NDPEM

SEQ ID NO: 3235331 - protein, 41 aa, Plasmodium falciparum
NDPINDPTNDQINDPINDPTNDQINDPINDPTNDQINDPIN

SEQ ID NO: 3235332 - protein, 6 aa, Plasmodium falciparum
NDPINE

SEQ ID NO: 3235333 - protein, 51 aa, Plasmodium falciparum
NDPKGKGDGECDGEGEGEDDDEDDDDNNNNNKDDGNGKKKKKEREREKKKN

SEQ ID NO: 3235334 - protein, 10 aa, Plasmodium falciparum
NDPKQNYMSN

SEQ ID NO: 3235335 - protein, 7 aa, Plasmodium falciparum
NDPKSVE

SEQ ID NO: 3235336 - protein, 7 aa, Plasmodium falciparum
NDPLEEK

SEQ ID NO: 3235337 - protein, 9 aa, Plasmodium falciparum
NDPNDLTKT

SEQ ID NO: 3235338 - protein, 28 aa, Plasmodium falciparum
NDPNNSYNKGKDKNVCPAKDTNEYFNNT

SEQ ID NO: 3235339 - protein, 5 aa, Plasmodium falciparum
NDPNP

SEQ ID NO: 3235340 - protein, 6 aa, Plasmodium falciparum
NDPSDT

SEQ ID NO: 3235341 - protein, 20 aa, Plasmodium falciparum
NDPTDSKNNNINNSNSQDEI

SEQ ID NO: 3235342 - protein, 5 aa, Plasmodium falciparum
NDPTK

SEQ ID NO: 3235343 - protein, 11 aa, Plasmodium falciparum
NDPTSKPNNKN

SEQ ID NO: 3235344 - protein, 4 aa, Plasmodium falciparum
NDPY

SEQ ID NO: 3235345 - protein, 23 aa, Plasmodium falciparum
NDQEISDERADMEASHKSKKSKL

SEQ ID NO: 3235346 - protein, 18 aa, Plasmodium falciparum
NDQENKNINIKNEEKSTI

SEQ ID NO: 3235347 - protein, 13 aa, Plasmodium falciparum
NDQGGNTMDGNNE

SEQ ID NO: 3235348 - protein, 31 aa, Plasmodium falciparum
NDQGTENLDDMNSDEYMNNNNNNNNNNNNNI

SEQ ID NO: 3235349 - protein, 4 aa, Plasmodium falciparum
NDQH

SEQ ID NO: 3235350 - protein, 22 aa, Plasmodium falciparum
NDQHEETHGNYNNMKGDKENLI

SEQ ID NO: 3235351 - protein, 20 aa, Plasmodium falciparum
NDQIDGEQGNQEDKKNNEIK

SEQ ID NO: 3235352 - protein, 60 aa, Plasmodium falciparum
NDQINNNSENQKDNVKENLKDTSSTQNVCEEKNNNDTCNEQNKDNNNNNNNNNNNNNNQL

SEQ ID NO: 3235353 - protein, 5 aa, Plasmodium falciparum
NDQKD

SEQ ID NO: 3235354 - protein, 8 aa, Plasmodium falciparum
NDQKDSHV

SEQ ID NO: 3235355 - protein, 12 aa, Plasmodium falciparum
NDQKKNIQKSSR

SEQ ID NO: 3235356 - protein, 9 aa, Plasmodium falciparum
NDQKNAYNS

SEQ ID NO: 3235357 - protein, 4 aa, Plasmodium falciparum
NDQL

SEQ ID NO: 3235358 - protein, 13 aa, Plasmodium falciparum
NDQLKQNKLNNTI

SEQ ID NO: 3235359 - protein, 4 aa, Plasmodium falciparum
NDQM

SEQ ID NO: 3235360 - protein, 6 aa, Plasmodium falciparum
NDQNRN

SEQ ID NO: 3235361 - protein, 14 aa, Plasmodium falciparum
NDQNSRNNTPNLRK

SEQ ID NO: 3235362 - protein, 36 aa, Plasmodium falciparum
NDQNYTTNAYENNQAYNNNNNNIETNAQNKNNKYED

SEQ ID NO: 3235363 - protein, 4 aa, Plasmodium falciparum
NDQR

SEQ ID NO: 3235364 - protein, 8 aa, Plasmodium falciparum
NDQSSNII

SEQ ID NO: 3235365 - protein, 7 aa, Plasmodium falciparum
NDQTDEN

SEQ ID NO: 3235366 - protein, 9 aa, Plasmodium falciparum
NDQTNNSSY

SEQ ID NO: 3235367 - protein, 41 aa, Plasmodium falciparum
NDQYKDGNHIDDQYKDGNHIDEKHKDGNRIDDQYKDGNRID

SEQ ID NO: 3235368 - protein, 10 aa, Plasmodium falciparum
NDQYKNDSQI

SEQ ID NO: 3235369 - protein, 6 aa, Plasmodium falciparum
NDRDIP

SEQ ID NO: 3235370 - protein, 6 aa, Plasmodium falciparum
NDREPD

SEQ ID NO: 3235371 - protein, 10 aa, Plasmodium falciparum
NDRGEEDEDY

SEQ ID NO: 3235372 - protein, 12 aa, Plasmodium falciparum
NDRKISNAKRKY

SEQ ID NO: 3235373 - protein, 6 aa, Plasmodium falciparum
NDRKKN

SEQ ID NO: 3235374 - protein, 6 aa, Plasmodium falciparum
NDRMNN

SEQ ID NO: 3235375 - protein, 8 aa, Plasmodium falciparum
NDRNKKLQ

SEQ ID NO: 3235376 - protein, 14 aa, Plasmodium falciparum
NDRREEKRKNKIQQ

SEQ ID NO: 3235377 - protein, 10 aa, Plasmodium falciparum
NDRRESNGHP

SEQ ID NO: 3235378 - protein, 16 aa, Plasmodium falciparum
NDRRNFDERNQHVNER

SEQ ID NO: 3235379 - protein, 28 aa, Plasmodium falciparum
NDRRNFDERNQQVNDRRNFDERNQHVNE

SEQ ID NO: 3235380 - protein, 9 aa, Plasmodium falciparum
NDRTNRGGL

SEQ ID NO: 3235381 - protein, 8 aa, Plasmodium falciparum
NDRTRKNS

SEQ ID NO: 3235382 - protein, 4 aa, Plasmodium falciparum
NDRY

SEQ ID NO: 3235383 - protein, 9 aa, Plasmodium falciparum
NDSAKNGFV

SEQ ID NO: 3235384 - protein, 21 aa, Plasmodium falciparum
NDSCSSSCSSSKKSDQSSYNN

SEQ ID NO: 3235385 - protein, 5 aa, Plasmodium falciparum
NDSDF

SEQ ID NO: 3235386 - protein, 7 aa, Plasmodium falciparum
NDSDKSN

SEQ ID NO: 3235387 - protein, 4 aa, Plasmodium falciparum
NDSE

SEQ ID NO: 3235388 - protein, 50 aa, Plasmodium falciparum
NDSEESSVGREETQKDMAGQEDNSAPDITTQDVSPTNSTIDGSENGNKGI

SEQ ID NO: 3235389 - protein, 7 aa, Plasmodium falciparum
NDSEGKK

SEQ ID NO: 3235390 - protein, 8 aa, Plasmodium falciparum
NDSESDEF

SEQ ID NO: 3235391 - protein, 7 aa, Plasmodium falciparum
NDSETPM

SEQ ID NO: 3235392 - protein, 6 aa, Plasmodium falciparum
NDSEYN

SEQ ID NO: 3235393 - protein, 15 aa, Plasmodium falciparum
NDSGYISKTESNDSL

SEQ ID NO: 3235394 - protein, 66 aa, Plasmodium falciparum
NDSHGYKNKQDIQNDGNNQNNQNNQNNQNNQNNQNNQNNQNNQNNQNNQNNQNNQNNDSHNNHYNH

SEQ ID NO: 3235395 - protein, 9 aa, Plasmodium falciparum
NDSITNNEY

SEQ ID NO: 3235396 - protein, 5 aa, Plasmodium falciparum
NDSIY

SEQ ID NO: 3235397 - protein, 7 aa, Plasmodium falciparum
NDSKEKE

SEQ ID NO: 3235398 - protein, 15 aa, Plasmodium falciparum
NDSMNDEGKSSSKND

SEQ ID NO: 3235399 - protein, 18 aa, Plasmodium falciparum
NDSNDDQIHSNNNYNGNN

SEQ ID NO: 3235400 - protein, 5 aa, Plasmodium falciparum
NDSNI

SEQ ID NO: 3235401 - protein, 7 aa, Plasmodium falciparum
NDSNIKN

SEQ ID NO: 3235402 - protein, 6 aa, Plasmodium falciparum
NDSNIN

SEQ ID NO: 3235403 - protein, 7 aa, Plasmodium falciparum
NDSNKEE

SEQ ID NO: 3235404 - protein, 13 aa, Plasmodium falciparum
NDSNKNKKKNELN

SEQ ID NO: 3235405 - protein, 9 aa, Plasmodium falciparum
NDSNKTDFN

SEQ ID NO: 3235406 - protein, 13 aa, Plasmodium falciparum
NDSNKTEKKKKQA

SEQ ID NO: 3235407 - protein, 7 aa, Plasmodium falciparum
NDSNNIK

SEQ ID NO: 3235408 - protein, 21 aa, Plasmodium falciparum
NDSNNRKAKKKTPEKVETNNY

SEQ ID NO: 3235409 - protein, 11 aa, Plasmodium falciparum
NDSNSDRPIDG

SEQ ID NO: 3235410 - protein, 9 aa, Plasmodium falciparum
NDSNVNNES

SEQ ID NO: 3235411 - protein, 17 aa, Plasmodium falciparum
NDSPPWKPKPEKECRDQ

SEQ ID NO: 3235412 - protein, 30 aa, Plasmodium falciparum
NDSQDDSDEQEDENGEDNDDEEHNDEVSNN

SEQ ID NO: 3235413 - protein, 36 aa, Plasmodium falciparum
NDSRNSKSWSPTKGSLSYNKNDSINNNSSSNNNNNN

SEQ ID NO: 3235414 - protein, 7 aa, Plasmodium falciparum
NDSSCKE

SEQ ID NO: 3235415 - protein, 6 aa, Plasmodium falciparum
NDSSNY

SEQ ID NO: 3235416 - protein, 8 aa, Plasmodium falciparum
NDSSPKEQ

SEQ ID NO: 3235417 - protein, 5 aa, Plasmodium falciparum
NDSSQ

SEQ ID NO: 3235418 - protein, 19 aa, Plasmodium falciparum
NDSSSDKLSSKSDSINSNN

SEQ ID NO: 3235419 - protein, 9 aa, Plasmodium falciparum
NDSTEKKGM

SEQ ID NO: 3235420 - protein, 11 aa, Plasmodium falciparum
NDSTEKNKYDN

SEQ ID NO: 3235421 - protein, 22 aa, Plasmodium falciparum
NDSTEVNESNKIDDTKKGESYT

SEQ ID NO: 3235422 - protein, 8 aa, Plasmodium falciparum
NDSTKEKF

SEQ ID NO: 3235423 - protein, 9 aa, Plasmodium falciparum
NDSTNQKNN

SEQ ID NO: 3235424 - protein, 14 aa, Plasmodium falciparum
NDSTYRGQYYDPSN

SEQ ID NO: 3235425 - protein, 13 aa, Plasmodium falciparum
NDSVEKNTKETNK

SEQ ID NO: 3235426 - protein, 6 aa, Plasmodium falciparum
NDSVLS

SEQ ID NO: 3235427 - protein, 4 aa, Plasmodium falciparum
NDSY

SEQ ID NO: 3235428 - protein, 5 aa, Plasmodium falciparum
NDSYN

SEQ ID NO: 3235429 - protein, 5 aa, Plasmodium falciparum
NDSYS

SEQ ID NO: 3235430 - protein, 4 aa, Plasmodium falciparum
NDTC

SEQ ID NO: 3235431 - protein, 22 aa, Plasmodium falciparum
NDTCNDTCNDTCNDTCNDTCNN

SEQ ID NO: 3235432 - protein, 5 aa, Plasmodium falciparum
NDTCS

SEQ ID NO: 3235433 - protein, 5 aa, Plasmodium falciparum
NDTDE

SEQ ID NO: 3235434 - protein, 6 aa, Plasmodium falciparum
NDTEES

SEQ ID NO: 3235435 - protein, 7 aa, Plasmodium falciparum
NDTEIND

SEQ ID NO: 3235436 - protein, 10 aa, Plasmodium falciparum
NDTEKGKKEN

SEQ ID NO: 3235437 - protein, 5 aa, Plasmodium falciparum
NDTEM

SEQ ID NO: 3235438 - protein, 6 aa, Plasmodium falciparum
NDTEMK

SEQ ID NO: 3235439 - protein, 9 aa, Plasmodium falciparum
NDTGGNSFK

SEQ ID NO: 3235440 - protein, 6 aa, Plasmodium falciparum
NDTHTN

SEQ ID NO: 3235441 - protein, 4 aa, Plasmodium falciparum
NDTI

SEQ ID NO: 3235442 - protein, 7 aa, Plasmodium falciparum
NDTIKSD

SEQ ID NO: 3235443 - protein, 22 aa, Plasmodium falciparum
NDTKDIGDKYQRNYKRNNYYNG

SEQ ID NO: 3235444 - protein, 37 aa, Plasmodium falciparum
NDTKKNEKKSNSVSKNKSTISEDYDKNQNNVEQNYQS

SEQ ID NO: 3235445 - protein, 9 aa, Plasmodium falciparum
NDTKKSIEE

SEQ ID NO: 3235446 - protein, 8 aa, Plasmodium falciparum
NDTLEGDK

SEQ ID NO: 3235447 - protein, 4 aa, Plasmodium falciparum
NDTN

SEQ ID NO: 3235448 - protein, 12 aa, Plasmodium falciparum
NDTNEENSTTNI

SEQ ID NO: 3235449 - protein, 6 aa, Plasmodium falciparum
NDTNEN

SEQ ID NO: 3235450 - protein, 7 aa, Plasmodium falciparum
NDTNEQD

SEQ ID NO: 3235451 - protein, 10 aa, Plasmodium falciparum
NDTNKFDGGL

SEQ ID NO: 3235452 - protein, 15 aa, Plasmodium falciparum
NDTNKKINNNNNNNN

SEQ ID NO: 3235453 - protein, 5 aa, Plasmodium falciparum
NDTNL

SEQ ID NO: 3235454 - protein, 22 aa, Plasmodium falciparum
NDTNNMNDTNNINNMNDTNNIN

SEQ ID NO: 3235455 - protein, 5 aa, Plasmodium falciparum
NDTNQ

SEQ ID NO: 3235456 - protein, 6 aa, Plasmodium falciparum
NDTNSE

SEQ ID NO: 3235457 - protein, 16 aa, Plasmodium falciparum
NDTNSIKGKKNKQNNK

SEQ ID NO: 3235458 - protein, 15 aa, Plasmodium falciparum
NDTNVNKVKNNANDN

SEQ ID NO: 3235459 - protein, 75 aa, Plasmodium falciparum
NDTNVTPNQINDTSVSPHKSNDTNVSPNQINDTNVSPNQINDTTVSPHKSSDTNVSPNQINDTTVSPHKSNDTNE

SEQ ID NO: 3235460 - protein, 5 aa, Plasmodium falciparum
NDTPI

SEQ ID NO: 3235461 - protein, 6 aa, Plasmodium falciparum
NDTQHT

SEQ ID NO: 3235462 - protein, 5 aa, Plasmodium falciparum
NDTRT

SEQ ID NO: 3235463 - protein, 4 aa, Plasmodium falciparum
NDTS

SEQ ID NO: 3235464 - protein, 18 aa, Plasmodium falciparum
NDTSEEKESGNVQEDEEQ

SEQ ID NO: 3235465 - protein, 11 aa, Plasmodium falciparum
NDTSRADINGT

SEQ ID NO: 3235466 - protein, 6 aa, Plasmodium falciparum
NDTSYT

SEQ ID NO: 3235467 - protein, 9 aa, Plasmodium falciparum
NDTTKPLTK

SEQ ID NO: 3235468 - protein, 6 aa, Plasmodium falciparum
NDTTNY

SEQ ID NO: 3235469 - protein, 7 aa, Plasmodium falciparum
NDTTTIT

SEQ ID NO: 3235470 - protein, 5 aa, Plasmodium falciparum
NDTVR

SEQ ID NO: 3235471 - protein, 12 aa, Plasmodium falciparum
NDTYERDKKKSL

SEQ ID NO: 3235472 - protein, 6 aa, Plasmodium falciparum
NDTYEY

SEQ ID NO: 3235473 - protein, 24 aa, Plasmodium falciparum
NDTYHTSHKDRKSFTNKEEKQNNT

SEQ ID NO: 3235474 - protein, 6 aa, Plasmodium falciparum
NDTYIE

SEQ ID NO: 3235475 - protein, 17 aa, Plasmodium falciparum
NDVDKNNNNNNNNNNIS

SEQ ID NO: 3235476 - protein, 9 aa, Plasmodium falciparum
NDVDNNSSL

SEQ ID NO: 3235477 - protein, 5 aa, Plasmodium falciparum
NDVDY

SEQ ID NO: 3235478 - protein, 5 aa, Plasmodium falciparum
NDVEQ

SEQ ID NO: 3235479 - protein, 4 aa, Plasmodium falciparum
NDVG

SEQ ID NO: 3235480 - protein, 9 aa, Plasmodium falciparum
NDVHPSNSY

SEQ ID NO: 3235481 - protein, 10 aa, Plasmodium falciparum
NDVKKNKSNN

SEQ ID NO: 3235482 - protein, 7 aa, Plasmodium falciparum
NDVNNNY

SEQ ID NO: 3235483 - protein, 6 aa, Plasmodium falciparum
NDVNNV

SEQ ID NO: 3235484 - protein, 7 aa, Plasmodium falciparum
NDVPPTF

SEQ ID NO: 3235485 - protein, 14 aa, Plasmodium falciparum
NDVPSNDNASSLNV

SEQ ID NO: 3235486 - protein, 5 aa, Plasmodium falciparum
NDVQE

SEQ ID NO: 3235487 - protein, 15 aa, Plasmodium falciparum
NDVQQINNSQNNNDN

SEQ ID NO: 3235488 - protein, 21 aa, Plasmodium falciparum
NDVTDKQKKFKKKNEQIKPTS

SEQ ID NO: 3235489 - protein, 4 aa, Plasmodium falciparum
NDVY

SEQ ID NO: 3235490 - protein, 10 aa, Plasmodium falciparum
NDYASKSHGM

SEQ ID NO: 3235491 - protein, 8 aa, Plasmodium falciparum
NDYDEGDG

SEQ ID NO: 3235492 - protein, 18 aa, Plasmodium falciparum
NDYDTSDDDCDDNKISKY

SEQ ID NO: 3235493 - protein, 4 aa, Plasmodium falciparum
NDYE

SEQ ID NO: 3235494 - protein, 18 aa, Plasmodium falciparum
NDYEKNSKIVDKKNNEIR

SEQ ID NO: 3235495 - protein, 6 aa, Plasmodium falciparum
NDYENE

SEQ ID NO: 3235496 - protein, 4 aa, Plasmodium falciparum
NDYK

SEQ ID NO: 3235497 - protein, 5 aa, Plasmodium falciparum
NDYKK

SEQ ID NO: 3235498 - protein, 4 aa, Plasmodium falciparum
NDYN

SEQ ID NO: 3235499 - protein, 15 aa, Plasmodium falciparum
NDYNDDKKKLSSYKN

SEQ ID NO: 3235500 - protein, 7 aa, Plasmodium falciparum
NDYNDEQ

SEQ ID NO: 3235501 - protein, 45 aa, Plasmodium falciparum
NDYNDKNDDDDDDDNNDHNNNDHNNNNNNTGYCSTSNKYHKQNDK

SEQ ID NO: 3235502 - protein, 7 aa, Plasmodium falciparum
NDYNNIK

SEQ ID NO: 3235503 - protein, 8 aa, Plasmodium falciparum
NDYNSTEG

SEQ ID NO: 3235504 - protein, 8 aa, Plasmodium falciparum
NDYNTNES

SEQ ID NO: 3235505 - protein, 13 aa, Plasmodium falciparum
NDYNTRKKEKRKR

SEQ ID NO: 3235506 - protein, 12 aa, Plasmodium falciparum
NDYQNNKNKSYV

SEQ ID NO: 3235507 - protein, 7 aa, Plasmodium falciparum
NDYQPKR

SEQ ID NO: 3235508 - protein, 20 aa, Plasmodium falciparum
NDYQTVSNNMNNKTNENGIE

SEQ ID NO: 3235509 - protein, 4 aa, Plasmodium falciparum
NDYS

SEQ ID NO: 3235510 - protein, 14 aa, Plasmodium falciparum
NDYSYESRKKDYTT

SEQ ID NO: 3235511 - protein, 6 aa, Plasmodium falciparum
NDYTGK

SEQ ID NO: 3235512 - protein, 6 aa, Plasmodium falciparum
NDYYGK

SEQ ID NO: 3235513 - protein, 16 aa, Plasmodium falciparum
NDYYNNNNNNNNNIYG

SEQ ID NO: 3235514 - protein, 13 aa, Plasmodium falciparum
NDYYREKNKYQQK

SEQ ID NO: 3235515 - protein, 21 aa, Plasmodium falciparum
NEADDKKINEECNNKKNLPNL

SEQ ID NO: 3235516 - protein, 16 aa, Plasmodium falciparum
NEAEDRNDSSDGDNKM

SEQ ID NO: 3235517 - protein, 5 aa, Plasmodium falciparum
NEAEG

SEQ ID NO: 3235518 - protein, 10 aa, Plasmodium falciparum
NEAEKDNKMN

SEQ ID NO: 3235519 - protein, 81 aa, Plasmodium falciparum
NEANENNDQINDLTKDKTSEEENNNDHVNDPTKDQTNDEKKKNKNKKNKNNNNNENNCHSNDNSNNNNNKEVHKNDDNINH

SEQ ID NO: 3235520 - protein, 20 aa, Plasmodium falciparum
NEANQNKRKQQIDSSNNNNN

SEQ ID NO: 3235521 - protein, 54 aa, Plasmodium falciparum
NEAQKYESSSVTVPTSSTINQVNNDNVSTHTGSNENGTVQKKDEIPETNRKENK

SEQ ID NO: 3235522 - protein, 7 aa, Plasmodium falciparum
NEARLSN

SEQ ID NO: 3235523 - protein, 6 aa, Plasmodium falciparum
NEASKG

SEQ ID NO: 3235524 - protein, 25 aa, Plasmodium falciparum
NEASSSSGSGRQRRGARNENYDGYE

SEQ ID NO: 3235525 - protein, 5 aa, Plasmodium falciparum
NECDV

SEQ ID NO: 3235526 - protein, 11 aa, Plasmodium falciparum
NECENEKEAHS

SEQ ID NO: 3235527 - protein, 8 aa, Plasmodium falciparum
NECNTNEE

SEQ ID NO: 3235528 - protein, 24 aa, Plasmodium falciparum
NECRGETSGKRYCSGDGYDCTKTD

SEQ ID NO: 3235529 - protein, 6 aa, Plasmodium falciparum
NEDATE

SEQ ID NO: 3235530 - protein, 5 aa, Plasmodium falciparum
NEDDE

SEQ ID NO: 3235531 - protein, 5 aa, Plasmodium falciparum
NEDDK

SEQ ID NO: 3235532 - protein, 7 aa, Plasmodium falciparum
NEDDKEY

SEQ ID NO: 3235533 - protein, 10 aa, Plasmodium falciparum
NEDDNSSSCN

SEQ ID NO: 3235534 - protein, 7 aa, Plasmodium falciparum
NEDDNVS

SEQ ID NO: 3235535 - protein, 17 aa, Plasmodium falciparum
NEDDVKKTKQNGNPKDN

SEQ ID NO: 3235536 - protein, 12 aa, Plasmodium falciparum
NEDEEKIKCSPE

SEQ ID NO: 3235537 - protein, 6 aa, Plasmodium falciparum
NEDEHT

SEQ ID NO: 3235538 - protein, 9 aa, Plasmodium falciparum
NEDENDDPS

SEQ ID NO: 3235539 - protein, 29 aa, Plasmodium falciparum
NEDENDKKEYYYNSEENATTLGRETSKDK

SEQ ID NO: 3235540 - protein, 9 aa, Plasmodium falciparum
NEDENKKEH

SEQ ID NO: 3235541 - protein, 11 aa, Plasmodium falciparum
NEDENNKLNPI

SEQ ID NO: 3235542 - protein, 10 aa, Plasmodium falciparum
NEDETNVTYN

SEQ ID NO: 3235543 - protein, 7 aa, Plasmodium falciparum
NEDGKEH

SEQ ID NO: 3235544 - protein, 6 aa, Plasmodium falciparum
NEDGSE

SEQ ID NO: 3235545 - protein, 6 aa, Plasmodium falciparum
NEDHHK

SEQ ID NO: 3235546 - protein, 9 aa, Plasmodium falciparum
NEDHNKNEI

SEQ ID NO: 3235547 - protein, 5 aa, Plasmodium falciparum
NEDIN

SEQ ID NO: 3235548 - protein, 6 aa, Plasmodium falciparum
NEDINK

SEQ ID NO: 3235549 - protein, 7 aa, Plasmodium falciparum
NEDINSS

SEQ ID NO: 3235550 - protein, 11 aa, Plasmodium falciparum
NEDKDKEKALE

SEQ ID NO: 3235551 - protein, 8 aa, Plasmodium falciparum
NEDKEDDA

SEQ ID NO: 3235552 - protein, 6 aa, Plasmodium falciparum
NEDKEN

SEQ ID NO: 3235553 - protein, 21 aa, Plasmodium falciparum
NEDKFKESSENVTTRRISENE

SEQ ID NO: 3235554 - protein, 10 aa, Plasmodium falciparum
NEDKKNPFIN

SEQ ID NO: 3235555 - protein, 6 aa, Plasmodium falciparum
NEDKQD

SEQ ID NO: 3235556 - protein, 8 aa, Plasmodium falciparum
NEDKSSNK

SEQ ID NO: 3235557 - protein, 55 aa, Plasmodium falciparum
NEDLNNDPMKKSKQNNININTQKDKGNGKDNMEGEQNVNGGDNNENIQDDQLSRN

SEQ ID NO: 3235558 - protein, 6 aa, Plasmodium falciparum
NEDLPS

SEQ ID NO: 3235559 - protein, 31 aa, Plasmodium falciparum
NEDMPNNKMDDEEDKKPWNDHKEADKKIISS

SEQ ID NO: 3235560 - protein, 4 aa, Plasmodium falciparum
NEDN

SEQ ID NO: 3235561 - protein, 73 aa, Plasmodium falciparum
NEDNEDNEDNEDNEDNEDNEDNEDNEDNEDNEDNEDNEDNKDNKDNEDNEDNEDNEDNKDNEDNDDEKINETP

SEQ ID NO: 3235562 - protein, 6 aa, Plasmodium falciparum
NEDNER

SEQ ID NO: 3235563 - protein, 7 aa, Plasmodium falciparum
NEDNFTD

SEQ ID NO: 3235564 - protein, 19 aa, Plasmodium falciparum
NEDNNNDENEDNNNNNNNI

SEQ ID NO: 3235565 - protein, 14 aa, Plasmodium falciparum
NEDNSTNRPLNEEE

SEQ ID NO: 3235566 - protein, 13 aa, Plasmodium falciparum
NEDNTNNKEDTPI

SEQ ID NO: 3235567 - protein, 36 aa, Plasmodium falciparum
NEDNVNVNEEEDDDEEEDDNINGNNNYENDGDTKMN

SEQ ID NO: 3235568 - protein, 6 aa, Plasmodium falciparum
NEDPKL

SEQ ID NO: 3235569 - protein, 7 aa, Plasmodium falciparum
NEDPSYE

SEQ ID NO: 3235570 - protein, 7 aa, Plasmodium falciparum
NEDPTIN

SEQ ID NO: 3235571 - protein, 8 aa, Plasmodium falciparum
NEDQTNNL

SEQ ID NO: 3235572 - protein, 5 aa, Plasmodium falciparum
NEDRK

SEQ ID NO: 3235573 - protein, 6 aa, Plasmodium falciparum
NEDRNN

SEQ ID NO: 3235574 - protein, 13 aa, Plasmodium falciparum
NEDSHKERDEENR

SEQ ID NO: 3235575 - protein, 47 aa, Plasmodium falciparum
NEDSITDNNKSNKKSDNNNDKKNDDDNNNNNNNNNNNNNNNNNNDNH

SEQ ID NO: 3235576 - protein, 26 aa, Plasmodium falciparum
NEDSKDKKQDRDKDKDKDKHKHKHNS

SEQ ID NO: 3235577 - protein, 7 aa, Plasmodium falciparum
NEDSVTE

SEQ ID NO: 3235578 - protein, 6 aa, Plasmodium falciparum
NEDTDK

SEQ ID NO: 3235579 - protein, 14 aa, Plasmodium falciparum
NEDTDNHKKNDAEY

SEQ ID NO: 3235580 - protein, 6 aa, Plasmodium falciparum
NEDTGR

SEQ ID NO: 3235581 - protein, 18 aa, Plasmodium falciparum
NEDTSGAKGKQPQQDQSL

SEQ ID NO: 3235582 - protein, 6 aa, Plasmodium falciparum
NEDTTD

SEQ ID NO: 3235583 - protein, 6 aa, Plasmodium falciparum
NEDVDD

SEQ ID NO: 3235584 - protein, 5 aa, Plasmodium falciparum
NEDVI

SEQ ID NO: 3235585 - protein, 9 aa, Plasmodium falciparum
NEDVKKNNL

SEQ ID NO: 3235586 - protein, 5 aa, Plasmodium falciparum
NEDVN

SEQ ID NO: 3235587 - protein, 15 aa, Plasmodium falciparum
NEDVNKYYKNKEKNH

SEQ ID NO: 3235588 - protein, 7 aa, Plasmodium falciparum
NEDYTNS

SEQ ID NO: 3235589 - protein, 5 aa, Plasmodium falciparum
NEEAK

SEQ ID NO: 3235590 - protein, 8 aa, Plasmodium falciparum
NEEAKHKI

SEQ ID NO: 3235591 - protein, 13 aa, Plasmodium falciparum
NEEAQSNKGRIFE

SEQ ID NO: 3235592 - protein, 13 aa, Plasmodium falciparum
NEECESNTQGDNI

SEQ ID NO: 3235593 - protein, 5 aa, Plasmodium falciparum
NEECT

SEQ ID NO: 3235594 - protein, 6 aa, Plasmodium falciparum
NEEDAI

SEQ ID NO: 3235595 - protein, 10 aa, Plasmodium falciparum
NEEDEIENEI

SEQ ID NO: 3235596 - protein, 5 aa, Plasmodium falciparum
NEEDI

SEQ ID NO: 3235597 - protein, 16 aa, Plasmodium falciparum
NEEDKLSKEKTERFSN

SEQ ID NO: 3235598 - protein, 5 aa, Plasmodium falciparum
NEEDN

SEQ ID NO: 3235599 - protein, 8 aa, Plasmodium falciparum
NEEDNEKH

SEQ ID NO: 3235600 - protein, 6 aa, Plasmodium falciparum
NEEDNK

SEQ ID NO: 3235601 - protein, 16 aa, Plasmodium falciparum
NEEDNKKVKDDSMNKN

SEQ ID NO: 3235602 - protein, 20 aa, Plasmodium falciparum
NEEDNKNDESCLSKKKRKDT

SEQ ID NO: 3235603 - protein, 8 aa, Plasmodium falciparum
NEEDNKYV

SEQ ID NO: 3235604 - protein, 11 aa, Plasmodium falciparum
NEEDRHDNSND

SEQ ID NO: 3235605 - protein, 30 aa, Plasmodium falciparum
NEEDSTKNTETSSNNNDTPSNNNDTSSYNN

SEQ ID NO: 3235606 - protein, 26 aa, Plasmodium falciparum
NEEDTNNMDEDEKNNMKDDINEEQNN

SEQ ID NO: 3235607 - protein, 15 aa, Plasmodium falciparum
NEEDVSEEKKHNEDH

SEQ ID NO: 3235608 - protein, 7 aa, Plasmodium falciparum
NEEEAFK

SEQ ID NO: 3235609 - protein, 22 aa, Plasmodium falciparum
NEEEEENNKNEPDDTNDLTQND

SEQ ID NO: 3235610 - protein, 5 aa, Plasmodium falciparum
NEEEI

SEQ ID NO: 3235611 - protein, 26 aa, Plasmodium falciparum
NEEEIEKKEMNEKNDLNDNNKNGVNV

SEQ ID NO: 3235612 - protein, 5 aa, Plasmodium falciparum
NEEEK

SEQ ID NO: 3235613 - protein, 14 aa, Plasmodium falciparum
NEEEKENEKKRRLS

SEQ ID NO: 3235614 - protein, 12 aa, Plasmodium falciparum
NEEEKNDKNENI

SEQ ID NO: 3235615 - protein, 5 aa, Plasmodium falciparum
NEEEN

SEQ ID NO: 3235616 - protein, 8 aa, Plasmodium falciparum
NEEENIKS

SEQ ID NO: 3235617 - protein, 8 aa, Plasmodium falciparum
NEEENKNI

SEQ ID NO: 3235618 - protein, 9 aa, Plasmodium falciparum
NEEENNTNN

SEQ ID NO: 3235619 - protein, 16 aa, Plasmodium falciparum
NEEEQEDDDKKNNVNI

SEQ ID NO: 3235620 - protein, 8 aa, Plasmodium falciparum
NEEERKRR

SEQ ID NO: 3235621 - protein, 4 aa, Plasmodium falciparum
NEEG

SEQ ID NO: 3235622 - protein, 7 aa, Plasmodium falciparum
NEEGEIT

SEQ ID NO: 3235623 - protein, 5 aa, Plasmodium falciparum
NEEGI

SEQ ID NO: 3235624 - protein, 5 aa, Plasmodium falciparum
NEEGK

SEQ ID NO: 3235625 - protein, 6 aa, Plasmodium falciparum
NEEHGG

SEQ ID NO: 3235626 - protein, 5 aa, Plasmodium falciparum
NEEHI

SEQ ID NO: 3235627 - protein, 26 aa, Plasmodium falciparum
NEEHKAEASKEQSKSTSDSSTSTQQT

SEQ ID NO: 3235628 - protein, 11 aa, Plasmodium falciparum
NEEIEETDLST

SEQ ID NO: 3235629 - protein, 5 aa, Plasmodium falciparum
NEEIG

SEQ ID NO: 3235630 - protein, 9 aa, Plasmodium falciparum
NEEIKKKKN

SEQ ID NO: 3235631 - protein, 6 aa, Plasmodium falciparum
NEEIKP

SEQ ID NO: 3235632 - protein, 5 aa, Plasmodium falciparum
NEEIN

SEQ ID NO: 3235633 - protein, 26 aa, Plasmodium falciparum
NEEINNNSKKNNNNSNNSNNNNNNNE

SEQ ID NO: 3235634 - protein, 17 aa, Plasmodium falciparum
NEEKENENKESNRTEHI

SEQ ID NO: 3235635 - protein, 10 aa, Plasmodium falciparum
NEEKIEKDDR

SEQ ID NO: 3235636 - protein, 6 aa, Plasmodium falciparum
NEEKIN

SEQ ID NO: 3235637 - protein, 15 aa, Plasmodium falciparum
NEEKKETQTKSVQHS

SEQ ID NO: 3235638 - protein, 8 aa, Plasmodium falciparum
NEEKKGRK

SEQ ID NO: 3235639 - protein, 8 aa, Plasmodium falciparum
NEEKKIRG

SEQ ID NO: 3235640 - protein, 10 aa, Plasmodium falciparum
NEEKKKGITQ

SEQ ID NO: 3235641 - protein, 8 aa, Plasmodium falciparum
NEEKKKIQ

SEQ ID NO: 3235642 - protein, 17 aa, Plasmodium falciparum
NEEKKKIQKKEKMDTQN

SEQ ID NO: 3235643 - protein, 7 aa, Plasmodium falciparum
NEEKKND

SEQ ID NO: 3235644 - protein, 6 aa, Plasmodium falciparum
NEEKNE

SEQ ID NO: 3235645 - protein, 5 aa, Plasmodium falciparum
NEEKQ

SEQ ID NO: 3235646 - protein, 8 aa, Plasmodium falciparum
NEEKQDNL

SEQ ID NO: 3235647 - protein, 7 aa, Plasmodium falciparum
NEEKQNM

SEQ ID NO: 3235648 - protein, 5 aa, Plasmodium falciparum
NEEKR

SEQ ID NO: 3235649 - protein, 9 aa, Plasmodium falciparum
NEEKRKSKN

SEQ ID NO: 3235650 - protein, 15 aa, Plasmodium falciparum
NEEKSPKKKNEYRNL

SEQ ID NO: 3235651 - protein, 6 aa, Plasmodium falciparum
NEEKSY

SEQ ID NO: 3235652 - protein, 18 aa, Plasmodium falciparum
NEEKVETKKKKKEKQKKA

SEQ ID NO: 3235653 - protein, 7 aa, Plasmodium falciparum
NEEKYDD

SEQ ID NO: 3235654 - protein, 20 aa, Plasmodium falciparum
NEEKYKNVKENQEENDHKSV

SEQ ID NO: 3235655 - protein, 11 aa, Plasmodium falciparum
NEEKYKSNNYI

SEQ ID NO: 3235656 - protein, 11 aa, Plasmodium falciparum
NEELNNANKNL

SEQ ID NO: 3235657 - protein, 13 aa, Plasmodium falciparum
NEEMEDDSKGEKN

SEQ ID NO: 3235658 - protein, 65 aa, Plasmodium falciparum
NEEMEPNQEMQQDKDNELKEKNDKEEKNDQEEKNDQEEKNDKEEKNDKEEKNDQEKKNDQEEKNN

SEQ ID NO: 3235659 - protein, 4 aa, Plasmodium falciparum
NEEN

SEQ ID NO: 3235660 - protein, 13 aa, Plasmodium falciparum
NEENDDYDKKKKK

SEQ ID NO: 3235661 - protein, 10 aa, Plasmodium falciparum
NEENDNDKDV

SEQ ID NO: 3235662 - protein, 7 aa, Plasmodium falciparum
NEENEEN

SEQ ID NO: 3235663 - protein, 10 aa, Plasmodium falciparum
NEENETSKKR

SEQ ID NO: 3235664 - protein, 6 aa, Plasmodium falciparum
NEENEV

SEQ ID NO: 3235665 - protein, 19 aa, Plasmodium falciparum
NEENIKNKRSANDNKNEKS

SEQ ID NO: 3235666 - protein, 13 aa, Plasmodium falciparum
NEENKHRKIKNNK

SEQ ID NO: 3235667 - protein, 33 aa, Plasmodium falciparum
NEENKKTNNEVSKSEKYNNHNKNNKKSQGDKNM

SEQ ID NO: 3235668 - protein, 7 aa, Plasmodium falciparum
NEENKKV

SEQ ID NO: 3235669 - protein, 11 aa, Plasmodium falciparum
NEENKNDEYEK

SEQ ID NO: 3235670 - protein, 29 aa, Plasmodium falciparum
NEENKNDITTKNNNNNNNNNNNNNNNKVN

SEQ ID NO: 3235671 - protein, 25 aa, Plasmodium falciparum
NEENKNIQRNSQSIENDNSNEEDTY

SEQ ID NO: 3235672 - protein, 13 aa, Plasmodium falciparum
NEENKRQGDKPFE

SEQ ID NO: 3235673 - protein, 34 aa, Plasmodium falciparum
NEENKSNEENKSNEENKSNEKNVSNEESDEHNPI

SEQ ID NO: 3235674 - protein, 8 aa, Plasmodium falciparum
NEENKSSI

SEQ ID NO: 3235675 - protein, 6 aa, Plasmodium falciparum
NEENLN

SEQ ID NO: 3235676 - protein, 12 aa, Plasmodium falciparum
NEENNKKKKGNI

SEQ ID NO: 3235677 - protein, 14 aa, Plasmodium falciparum
NEENPKQSYNNSED

SEQ ID NO: 3235678 - protein, 41 aa, Plasmodium falciparum
NEENPKRKTMNKSNGMNKSNGMNKSNSMSKNKKKIKQSNNL

SEQ ID NO: 3235679 - protein, 47 aa, Plasmodium falciparum
NEENSNLNNNDNIHTNNSNNNNIHTNNSNNNNIHTNNSNNKNNSSDL

SEQ ID NO: 3235680 - protein, 5 aa, Plasmodium falciparum
NEENT

SEQ ID NO: 3235681 - protein, 9 aa, Plasmodium falciparum
NEENTCSDK

SEQ ID NO: 3235682 - protein, 8 aa, Plasmodium falciparum
NEENVESM

SEQ ID NO: 3235683 - protein, 5 aa, Plasmodium falciparum
NEEPF

SEQ ID NO: 3235684 - protein, 5 aa, Plasmodium falciparum
NEEPV

SEQ ID NO: 3235685 - protein, 8 aa, Plasmodium falciparum
NEEQKGNT

SEQ ID NO: 3235686 - protein, 81 aa, Plasmodium falciparum
NEEQTSGDQNDLSDNNENNQETITSDDTLEKGKLDNSNMGDSDEKLKDDMKNNEHENLSAENVPSDENTINDKTKEGSTTL

SEQ ID NO: 3235687 - protein, 81 aa, Plasmodium falciparum
NEEQTSGDQNDLYDNNKDKEETISSDDTLEKGKLDNSNMGDSDEKLKDDMKNNEHENLSAENVPSDENTINDKTKEGSTTL

SEQ ID NO: 3235688 - protein, 18 aa, Plasmodium falciparum
NEEQTSGDQNDLYDNNKY

SEQ ID NO: 3235689 - protein, 20 aa, Plasmodium falciparum
NEEQTSGDQNYLSDANKEKE

SEQ ID NO: 3235690 - protein, 7 aa, Plasmodium falciparum
NEEQYDR

SEQ ID NO: 3235691 - protein, 7 aa, Plasmodium falciparum
NEERGER

SEQ ID NO: 3235692 - protein, 6 aa, Plasmodium falciparum
NEERGI

SEQ ID NO: 3235693 - protein, 10 aa, Plasmodium falciparum
NEERKKKKKK

SEQ ID NO: 3235694 - protein, 10 aa, Plasmodium falciparum
NEESANTNVQ

SEQ ID NO: 3235695 - protein, 10 aa, Plasmodium falciparum
NEESNGNDQQ

SEQ ID NO: 3235696 - protein, 14 aa, Plasmodium falciparum
NEESNIDDENKKEN

SEQ ID NO: 3235697 - protein, 12 aa, Plasmodium falciparum
NEESVDGNISNM

SEQ ID NO: 3235698 - protein, 29 aa, Plasmodium falciparum
NEETKCKSTENTDKESKIDFNDSEKTFSA

SEQ ID NO: 3235699 - protein, 14 aa, Plasmodium falciparum
NEETKGINSGVSNT

SEQ ID NO: 3235700 - protein, 12 aa, Plasmodium falciparum
NEETKNDDYSKL

SEQ ID NO: 3235701 - protein, 4 aa, Plasmodium falciparum
NEEV

SEQ ID NO: 3235702 - protein, 18 aa, Plasmodium falciparum
NEEVKTSSVHSTTSNINS

SEQ ID NO: 3235703 - protein, 9 aa, Plasmodium falciparum
NEEWEKNKG

SEQ ID NO: 3235704 - protein, 7 aa, Plasmodium falciparum
NEEYKKE

SEQ ID NO: 3235705 - protein, 23 aa, Plasmodium falciparum
NEEYNTSYESQRVKDNNNSNYNN

SEQ ID NO: 3235706 - protein, 16 aa, Plasmodium falciparum
NEEYQKVKNEKDQNEI

SEQ ID NO: 3235707 - protein, 13 aa, Plasmodium falciparum
NEFNKQKKKFENE

SEQ ID NO: 3235708 - protein, 10 aa, Plasmodium falciparum
NEFNNNEENC

SEQ ID NO: 3235709 - protein, 12 aa, Plasmodium falciparum
NEFNNNIKKNKD

SEQ ID NO: 3235710 - protein, 14 aa, Plasmodium falciparum
NEFPESLENDNSYD

SEQ ID NO: 3235711 - protein, 8 aa, Plasmodium falciparum
NEFPSSNI

SEQ ID NO: 3235712 - protein, 5 aa, Plasmodium falciparum
NEFQS

SEQ ID NO: 3235713 - protein, 7 aa, Plasmodium falciparum
NEFRNEK

SEQ ID NO: 3235714 - protein, 13 aa, Plasmodium falciparum
NEFSPSKTAQRRA

SEQ ID NO: 3235715 - protein, 4 aa, Plasmodium falciparum
NEFT

SEQ ID NO: 3235716 - protein, 79 aa, Plasmodium falciparum
NEGDKNCEEDVKDEDKENNSDNNKNDDKKKKDNKKKKVDKRNENKNENESSKEDDEKGLDKVPKKKKSKEKNVSKENNI

SEQ ID NO: 3235717 - protein, 35 aa, Plasmodium falciparum
NEGDRKKLKKDDLYNNNNYDNNNNNNNNNNNNNNF

SEQ ID NO: 3235718 - protein, 4 aa, Plasmodium falciparum
NEGE

SEQ ID NO: 3235719 - protein, 6 aa, Plasmodium falciparum
NEGEEY

SEQ ID NO: 3235720 - protein, 7 aa, Plasmodium falciparum
NEGEPYK

SEQ ID NO: 3235721 - protein, 11 aa, Plasmodium falciparum
NEGEVQNVEDY

SEQ ID NO: 3235722 - protein, 6 aa, Plasmodium falciparum
NEGGID

SEQ ID NO: 3235723 - protein, 8 aa, Plasmodium falciparum
NEGHDDNY

SEQ ID NO: 3235724 - protein, 24 aa, Plasmodium falciparum
NEGIEKNKDESKITTEKRKHNNNN

SEQ ID NO: 3235725 - protein, 7 aa, Plasmodium falciparum
NEGKENH

SEQ ID NO: 3235726 - protein, 9 aa, Plasmodium falciparum
NEGKKKSKK

SEQ ID NO: 3235727 - protein, 11 aa, Plasmodium falciparum
NEGKKNGKSGF

SEQ ID NO: 3235728 - protein, 29 aa, Plasmodium falciparum
NEGKKQKKKKKKKDKKKKFYGNDQDYNNL

SEQ ID NO: 3235729 - protein, 11 aa, Plasmodium falciparum
NEGNKKNITNI

SEQ ID NO: 3235730 - protein, 6 aa, Plasmodium falciparum
NEGNKY

SEQ ID NO: 3235731 - protein, 10 aa, Plasmodium falciparum
NEGPKNNRIK

SEQ ID NO: 3235732 - protein, 7 aa, Plasmodium falciparum
NEGRTPE

SEQ ID NO: 3235733 - protein, 6 aa, Plasmodium falciparum
NEGRYT

SEQ ID NO: 3235734 - protein, 4 aa, Plasmodium falciparum
NEGS

SEQ ID NO: 3235735 - protein, 20 aa, Plasmodium falciparum
NEGSKMRDNDMNSDSEDSIY

SEQ ID NO: 3235736 - protein, 6 aa, Plasmodium falciparum
NEGSVT

SEQ ID NO: 3235737 - protein, 4 aa, Plasmodium falciparum
NEHC

SEQ ID NO: 3235738 - protein, 8 aa, Plasmodium falciparum
NEHDNTEG

SEQ ID NO: 3235739 - protein, 7 aa, Plasmodium falciparum
NEHDNYN

SEQ ID NO: 3235740 - protein, 11 aa, Plasmodium falciparum
NEHEEEEPDKI

SEQ ID NO: 3235741 - protein, 8 aa, Plasmodium falciparum
NEHEEKNM

SEQ ID NO: 3235742 - protein, 7 aa, Plasmodium falciparum
NEHEETG

SEQ ID NO: 3235743 - protein, 5 aa, Plasmodium falciparum
NEHEN

SEQ ID NO: 3235744 - protein, 29 aa, Plasmodium falciparum
NEHENNKMNPNNKKNNNNNDNNDSNNNYD

SEQ ID NO: 3235745 - protein, 7 aa, Plasmodium falciparum
NEHEPRP

SEQ ID NO: 3235746 - protein, 6 aa, Plasmodium falciparum
NEHEYK

SEQ ID NO: 3235747 - protein, 8 aa, Plasmodium falciparum
NEHGEYDR

SEQ ID NO: 3235748 - protein, 14 aa, Plasmodium falciparum
NEHGNHSDSYPYGN

SEQ ID NO: 3235749 - protein, 37 aa, Plasmodium falciparum
NEHGNKKEDSSNKKGKNETKVGKKGSKNSNATTLSRK

SEQ ID NO: 3235750 - protein, 5 aa, Plasmodium falciparum
NEHID

SEQ ID NO: 3235751 - protein, 6 aa, Plasmodium falciparum
NEHING

SEQ ID NO: 3235752 - protein, 6 aa, Plasmodium falciparum
NEHKHE

SEQ ID NO: 3235753 - protein, 4 aa, Plasmodium falciparum
NEHL

SEQ ID NO: 3235754 - protein, 14 aa, Plasmodium falciparum
NEHNEEQIKKKEED

SEQ ID NO: 3235755 - protein, 9 aa, Plasmodium falciparum
NEHNEHNGI

SEQ ID NO: 3235756 - protein, 16 aa, Plasmodium falciparum
NEHNKNNMYGSDESDK

SEQ ID NO: 3235757 - protein, 20 aa, Plasmodium falciparum
NEHNNHNEHNHNNEHSHHNE

SEQ ID NO: 3235758 - protein, 25 aa, Plasmodium falciparum
NEHQEGHKKKNQVQKKKERKNGEHI

SEQ ID NO: 3235759 - protein, 13 aa, Plasmodium falciparum
NEHTESYKNLDTS

SEQ ID NO: 3235760 - protein, 9 aa, Plasmodium falciparum
NEHTNENNI

SEQ ID NO: 3235761 - protein, 24 aa, Plasmodium falciparum
NEHTQQAPTNHTHHNNNNNNKKPL

SEQ ID NO: 3235762 - protein, 7 aa, Plasmodium falciparum
NEHVDNK

SEQ ID NO: 3235763 - protein, 4 aa, Plasmodium falciparum
NEHY

SEQ ID NO: 3235764 - protein, 6 aa, Plasmodium falciparum
NEIDDN

SEQ ID NO: 3235765 - protein, 14 aa, Plasmodium falciparum
NEIDKNDEENLKEC

SEQ ID NO: 3235766 - protein, 13 aa, Plasmodium falciparum
NEIEENEKSKNNP

SEQ ID NO: 3235767 - protein, 6 aa, Plasmodium falciparum
NEIEKI

SEQ ID NO: 3235768 - protein, 11 aa, Plasmodium falciparum
NEIERDTKDAY

SEQ ID NO: 3235769 - protein, 7 aa, Plasmodium falciparum
NEIESEL

SEQ ID NO: 3235770 - protein, 6 aa, Plasmodium falciparum
NEIESS

SEQ ID NO: 3235771 - protein, 9 aa, Plasmodium falciparum
NEIKDYSKS

SEQ ID NO: 3235772 - protein, 9 aa, Plasmodium falciparum
NEIKSYDPF

SEQ ID NO: 3235773 - protein, 4 aa, Plasmodium falciparum
NEIN

SEQ ID NO: 3235774 - protein, 5 aa, Plasmodium falciparum
NEINK

SEQ ID NO: 3235775 - protein, 47 aa, Plasmodium falciparum
NEINNDNNNDNNDNNNNNNTNTTTNNNSNNNNNNNNNNEVENEKVPK

SEQ ID NO: 3235776 - protein, 9 aa, Plasmodium falciparum
NEINNKTTE

SEQ ID NO: 3235777 - protein, 4 aa, Plasmodium falciparum
NEIQ

SEQ ID NO: 3235778 - protein, 6 aa, Plasmodium falciparum
NEIQEE

SEQ ID NO: 3235779 - protein, 5 aa, Plasmodium falciparum
NEIQK

SEQ ID NO: 3235780 - protein, 6 aa, Plasmodium falciparum
NEIQTN

SEQ ID NO: 3235781 - protein, 5 aa, Plasmodium falciparum
NEISD

SEQ ID NO: 3235782 - protein, 22 aa, Plasmodium falciparum
NEISKTYEKNNKNKKMFTPKNG

SEQ ID NO: 3235783 - protein, 6 aa, Plasmodium falciparum
NEISTK

SEQ ID NO: 3235784 - protein, 4 aa, Plasmodium falciparum
NEIT

SEQ ID NO: 3235785 - protein, 5 aa, Plasmodium falciparum
NEITN

SEQ ID NO: 3235786 - protein, 5 aa, Plasmodium falciparum
NEITS

SEQ ID NO: 3235787 - protein, 5 aa, Plasmodium falciparum
NEITT

SEQ ID NO: 3235788 - protein, 14 aa, Plasmodium falciparum
NEIVKKQKTKNIRE

SEQ ID NO: 3235789 - protein, 4 aa, Plasmodium falciparum
NEIY

SEQ ID NO: 3235790 - protein, 7 aa, Plasmodium falciparum
NEIYTNK

SEQ ID NO: 3235791 - protein, 44 aa, Plasmodium falciparum
NEKCKKGDSNNKKNINSNNKKKNINSNNKKKYINSNNNNNNNNY

SEQ ID NO: 3235792 - protein, 4 aa, Plasmodium falciparum
NEKD

SEQ ID NO: 3235793 - protein, 64 aa, Plasmodium falciparum
NEKDEKDERNEKDEKDERNEKDEKDERNERNEKDEKDERNEKDEKDERNKKNENDEKDKRDDKI

SEQ ID NO: 3235794 - protein, 8 aa, Plasmodium falciparum
NEKDEKYT

SEQ ID NO: 3235795 - protein, 23 aa, Plasmodium falciparum
NEKDIPNKLDSQNVKNEKDTPNK

SEQ ID NO: 3235796 - protein, 33 aa, Plasmodium falciparum
NEKDISSDNKNKNKNNDNNNNNNNNNNDDDFHN

SEQ ID NO: 3235797 - protein, 10 aa, Plasmodium falciparum
NEKDKDVKKD

SEQ ID NO: 3235798 - protein, 8 aa, Plasmodium falciparum
NEKDKEYL

SEQ ID NO: 3235799 - protein, 8 aa, Plasmodium falciparum
NEKDKNKD

SEQ ID NO: 3235800 - protein, 18 aa, Plasmodium falciparum
NEKDKQDPNKNTSNQNDT

SEQ ID NO: 3235801 - protein, 5 aa, Plasmodium falciparum
NEKDL

SEQ ID NO: 3235802 - protein, 7 aa, Plasmodium falciparum
NEKDNIS

SEQ ID NO: 3235803 - protein, 10 aa, Plasmodium falciparum
NEKDTGEKKQ

SEQ ID NO: 3235804 - protein, 6 aa, Plasmodium falciparum
NEKEAY

SEQ ID NO: 3235805 - protein, 12 aa, Plasmodium falciparum
NEKEDIYNERKK

SEQ ID NO: 3235806 - protein, 14 aa, Plasmodium falciparum
NEKEEDIEIDTSSS

SEQ ID NO: 3235807 - protein, 10 aa, Plasmodium falciparum
NEKEENKNEY

SEQ ID NO: 3235808 - protein, 6 aa, Plasmodium falciparum
NEKEET

SEQ ID NO: 3235809 - protein, 6 aa, Plasmodium falciparum
NEKEFS

SEQ ID NO: 3235810 - protein, 11 aa, Plasmodium falciparum
NEKEHNRNYTT

SEQ ID NO: 3235811 - protein, 19 aa, Plasmodium falciparum
NEKEIKKKIKEDKKRQKEE

SEQ ID NO: 3235812 - protein, 13 aa, Plasmodium falciparum
NEKEKHKKELENE

SEQ ID NO: 3235813 - protein, 6 aa, Plasmodium falciparum
NEKEKI

SEQ ID NO: 3235814 - protein, 6 aa, Plasmodium falciparum
NEKEKK

SEQ ID NO: 3235815 - protein, 13 aa, Plasmodium falciparum
NEKEKMETQTHST

SEQ ID NO: 3235816 - protein, 8 aa, Plasmodium falciparum
NEKELSSY

SEQ ID NO: 3235817 - protein, 5 aa, Plasmodium falciparum
NEKEN

SEQ ID NO: 3235818 - protein, 12 aa, Plasmodium falciparum
NEKENDTYKQDD

SEQ ID NO: 3235819 - protein, 12 aa, Plasmodium falciparum
NEKENTNNITTY

SEQ ID NO: 3235820 - protein, 12 aa, Plasmodium falciparum
NEKEQKSGNPFY

SEQ ID NO: 3235821 - protein, 7 aa, Plasmodium falciparum
NEKEQNK

SEQ ID NO: 3235822 - protein, 10 aa, Plasmodium falciparum
NEKERKQKKN

SEQ ID NO: 3235823 - protein, 26 aa, Plasmodium falciparum
NEKETNKDKNKKKDIDINKKKKKDID

SEQ ID NO: 3235824 - protein, 22 aa, Plasmodium falciparum
NEKETSSKNNNNDNEKNDDNNN

SEQ ID NO: 3235825 - protein, 4 aa, Plasmodium falciparum
NEKF

SEQ ID NO: 3235826 - protein, 7 aa, Plasmodium falciparum
NEKGAVK

SEQ ID NO: 3235827 - protein, 32 aa, Plasmodium falciparum
NEKGKRTKLTKEKATVDIPSNVDTKENDKKMK

SEQ ID NO: 3235828 - protein, 7 aa, Plasmodium falciparum
NEKGKTY

SEQ ID NO: 3235829 - protein, 13 aa, Plasmodium falciparum
NEKHDSPKEEQDE

SEQ ID NO: 3235830 - protein, 5 aa, Plasmodium falciparum
NEKHV

SEQ ID NO: 3235831 - protein, 8 aa, Plasmodium falciparum
NEKIDSDG

SEQ ID NO: 3235832 - protein, 8 aa, Plasmodium falciparum
NEKIEKES

SEQ ID NO: 3235833 - protein, 8 aa, Plasmodium falciparum
NEKIKTEQ

SEQ ID NO: 3235834 - protein, 5 aa, Plasmodium falciparum
NEKIN

SEQ ID NO: 3235835 - protein, 6 aa, Plasmodium falciparum
NEKINK

SEQ ID NO: 3235836 - protein, 8 aa, Plasmodium falciparum
NEKINKDK

SEQ ID NO: 3235837 - protein, 6 aa, Plasmodium falciparum
NEKINS

SEQ ID NO: 3235838 - protein, 9 aa, Plasmodium falciparum
NEKIPNDNS

SEQ ID NO: 3235839 - protein, 5 aa, Plasmodium falciparum
NEKKD

SEQ ID NO: 3235840 - protein, 7 aa, Plasmodium falciparum
NEKKDFD

SEQ ID NO: 3235841 - protein, 37 aa, Plasmodium falciparum
NEKKDGQIINEKKDGQIINEKKDGQIINEKKDGQIIN

SEQ ID NO: 3235842 - protein, 76 aa, Plasmodium falciparum
NEKKDNLPSQGTVEGYSTYGRKNHQIRNDNNEKKKKINNNNNNNNSDYNNNNNNNNSDNNNDYNNDDNNDDDNNNY

SEQ ID NO: 3235843 - protein, 12 aa, Plasmodium falciparum
NEKKDNTNDNIK

SEQ ID NO: 3235844 - protein, 12 aa, Plasmodium falciparum
NEKKDTKTEACN

SEQ ID NO: 3235845 - protein, 22 aa, Plasmodium falciparum
NEKKEEEKQNNNNNNNKKEYLE

SEQ ID NO: 3235846 - protein, 12 aa, Plasmodium falciparum
NEKKEKMNSVNE

SEQ ID NO: 3235847 - protein, 11 aa, Plasmodium falciparum
NEKKERRKDNI

SEQ ID NO: 3235848 - protein, 11 aa, Plasmodium falciparum
NEKKGTNNRTN

SEQ ID NO: 3235849 - protein, 9 aa, Plasmodium falciparum
NEKKKDNIY

SEQ ID NO: 3235850 - protein, 11 aa, Plasmodium falciparum
NEKKKKENKMS

SEQ ID NO: 3235851 - protein, 42 aa, Plasmodium falciparum
NEKKKKKGSITKQVTENDDNNNMNKNNYNNNCNADAPSTGLD

SEQ ID NO: 3235852 - protein, 9 aa, Plasmodium falciparum
NEKKKKQKK

SEQ ID NO: 3235853 - protein, 23 aa, Plasmodium falciparum
NEKKKNSKKKMTKHNKTSSSYND

SEQ ID NO: 3235854 - protein, 7 aa, Plasmodium falciparum
NEKKKTN

SEQ ID NO: 3235855 - protein, 6 aa, Plasmodium falciparum
NEKKKY

SEQ ID NO: 3235856 - protein, 5 aa, Plasmodium falciparum
NEKKN

SEQ ID NO: 3235857 - protein, 13 aa, Plasmodium falciparum
NEKKNEELKGNPN

SEQ ID NO: 3235858 - protein, 23 aa, Plasmodium falciparum
NEKKNETNKSIEEQSEDSNGIEN

SEQ ID NO: 3235859 - protein, 14 aa, Plasmodium falciparum
NEKKNKNNKNTSMN

SEQ ID NO: 3235860 - protein, 9 aa, Plasmodium falciparum
NEKKNTKIK

SEQ ID NO: 3235861 - protein, 7 aa, Plasmodium falciparum
NEKKNTY

SEQ ID NO: 3235862 - protein, 32 aa, Plasmodium falciparum
NEKKQNSKISDTNKKNVTKTKNQIKDKKKNSF

SEQ ID NO: 3235863 - protein, 5 aa, Plasmodium falciparum
NEKKR

SEQ ID NO: 3235864 - protein, 9 aa, Plasmodium falciparum
NEKKRNEFQ

SEQ ID NO: 3235865 - protein, 6 aa, Plasmodium falciparum
NEKKSD

SEQ ID NO: 3235866 - protein, 12 aa, Plasmodium falciparum
NEKKSTTKKNQA

SEQ ID NO: 3235867 - protein, 18 aa, Plasmodium falciparum
NEKKTKRKKKKKRKKKEI

SEQ ID NO: 3235868 - protein, 12 aa, Plasmodium falciparum
NEKKTKTSKMTT

SEQ ID NO: 3235869 - protein, 16 aa, Plasmodium falciparum
NEKKYESSEMSSNLSS

SEQ ID NO: 3235870 - protein, 5 aa, Plasmodium falciparum
NEKLG

SEQ ID NO: 3235871 - protein, 24 aa, Plasmodium falciparum
NEKMKERERINKKKKIGKKNNRRK

SEQ ID NO: 3235872 - protein, 8 aa, Plasmodium falciparum
NEKMKSES

SEQ ID NO: 3235873 - protein, 24 aa, Plasmodium falciparum
NEKMSNNKINNNDIYSNGKNNLNS

SEQ ID NO: 3235874 - protein, 10 aa, Plasmodium falciparum
NEKNDKDKDC

SEQ ID NO: 3235875 - protein, 9 aa, Plasmodium falciparum
NEKNDKKEE

SEQ ID NO: 3235876 - protein, 5 aa, Plasmodium falciparum
NEKNE

SEQ ID NO: 3235877 - protein, 8 aa, Plasmodium falciparum
NEKNEEYD

SEQ ID NO: 3235878 - protein, 10 aa, Plasmodium falciparum
NEKNHDNNNM

SEQ ID NO: 3235879 - protein, 11 aa, Plasmodium falciparum
NEKNHKNKYEN

SEQ ID NO: 3235880 - protein, 7 aa, Plasmodium falciparum
NEKNIEE

SEQ ID NO: 3235881 - protein, 6 aa, Plasmodium falciparum
NEKNIK

SEQ ID NO: 3235882 - protein, 17 aa, Plasmodium falciparum
NEKNKEQNNQINNNRST

SEQ ID NO: 3235883 - protein, 10 aa, Plasmodium falciparum
NEKNKKKNIK

SEQ ID NO: 3235884 - protein, 10 aa, Plasmodium falciparum
NEKNKKYNYL

SEQ ID NO: 3235885 - protein, 11 aa, Plasmodium falciparum
NEKNKRNESRY

SEQ ID NO: 3235886 - protein, 14 aa, Plasmodium falciparum
NEKNKSCSCPNNQS

SEQ ID NO: 3235887 - protein, 6 aa, Plasmodium falciparum
NEKNMN

SEQ ID NO: 3235888 - protein, 6 aa, Plasmodium falciparum
NEKNNI

SEQ ID NO: 3235889 - protein, 9 aa, Plasmodium falciparum
NEKNNNDIY

SEQ ID NO: 3235890 - protein, 8 aa, Plasmodium falciparum
NEKNNSVY

SEQ ID NO: 3235891 - protein, 20 aa, Plasmodium falciparum
NEKNNTLKENNKDLSNNTNT

SEQ ID NO: 3235892 - protein, 9 aa, Plasmodium falciparum
NEKNPEEKE

SEQ ID NO: 3235893 - protein, 10 aa, Plasmodium falciparum
NEKNSDDSCV

SEQ ID NO: 3235894 - protein, 11 aa, Plasmodium falciparum
NEKNSKHSHLN

SEQ ID NO: 3235895 - protein, 8 aa, Plasmodium falciparum
NEKPKEEK

SEQ ID NO: 3235896 - protein, 9 aa, Plasmodium falciparum
NEKPNPSTL

SEQ ID NO: 3235897 - protein, 14 aa, Plasmodium falciparum
NEKQKNKTHMDDQE

SEQ ID NO: 3235898 - protein, 10 aa, Plasmodium falciparum
NEKQNPDVKK

SEQ ID NO: 3235899 - protein, 9 aa, Plasmodium falciparum
NEKQNTSKY

SEQ ID NO: 3235900 - protein, 15 aa, Plasmodium falciparum
NEKQQEQKKDYEKDK

SEQ ID NO: 3235901 - protein, 8 aa, Plasmodium falciparum
NEKQQLNK

SEQ ID NO: 3235902 - protein, 9 aa, Plasmodium falciparum
NEKQTNDTF

SEQ ID NO: 3235903 - protein, 4 aa, Plasmodium falciparum
NEKR

SEQ ID NO: 3235904 - protein, 9 aa, Plasmodium falciparum
NEKRDNSKI

SEQ ID NO: 3235905 - protein, 6 aa, Plasmodium falciparum
NEKREK

SEQ ID NO: 3235906 - protein, 21 aa, Plasmodium falciparum
NEKRKKKKKKKKKKKTQAPNV

SEQ ID NO: 3235907 - protein, 13 aa, Plasmodium falciparum
NEKRNKKMKTKNV

SEQ ID NO: 3235908 - protein, 7 aa, Plasmodium falciparum
NEKRNKL

SEQ ID NO: 3235909 - protein, 12 aa, Plasmodium falciparum
NEKRPREKNKME

SEQ ID NO: 3235910 - protein, 6 aa, Plasmodium falciparum
NEKSEC

SEQ ID NO: 3235911 - protein, 10 aa, Plasmodium falciparum
NEKSEKNDNY

SEQ ID NO: 3235912 - protein, 12 aa, Plasmodium falciparum
NEKSGRDEYILL

SEQ ID NO: 3235913 - protein, 7 aa, Plasmodium falciparum
NEKSKEA

SEQ ID NO: 3235914 - protein, 10 aa, Plasmodium falciparum
NEKSKNKKGA

SEQ ID NO: 3235915 - protein, 13 aa, Plasmodium falciparum
NEKSMRKEDDIDY

SEQ ID NO: 3235916 - protein, 6 aa, Plasmodium falciparum
NEKSNC

SEQ ID NO: 3235917 - protein, 14 aa, Plasmodium falciparum
NEKSQKKGKKKQKK

SEQ ID NO: 3235918 - protein, 11 aa, Plasmodium falciparum
NEKSRDKYTDN

SEQ ID NO: 3235919 - protein, 7 aa, Plasmodium falciparum
NEKSTTP

SEQ ID NO: 3235920 - protein, 7 aa, Plasmodium falciparum
NEKTEEV

SEQ ID NO: 3235921 - protein, 5 aa, Plasmodium falciparum
NEKTK

SEQ ID NO: 3235922 - protein, 27 aa, Plasmodium falciparum
NEKTKKNVEKNKDKKKTKNNNSQKFNE

SEQ ID NO: 3235923 - protein, 10 aa, Plasmodium falciparum
NEKTKKYEAN

SEQ ID NO: 3235924 - protein, 6 aa, Plasmodium falciparum
NEKTKN

SEQ ID NO: 3235925 - protein, 10 aa, Plasmodium falciparum
NEKTKRKKKK

SEQ ID NO: 3235926 - protein, 9 aa, Plasmodium falciparum
NEKTKSNLN

SEQ ID NO: 3235927 - protein, 22 aa, Plasmodium falciparum
NEKVERNEPIGENKRIENNDGV

SEQ ID NO: 3235928 - protein, 7 aa, Plasmodium falciparum
NEKVKNI

SEQ ID NO: 3235929 - protein, 13 aa, Plasmodium falciparum
NEKVKSEAQTYKE

SEQ ID NO: 3235930 - protein, 6 aa, Plasmodium falciparum
NEKVNT

SEQ ID NO: 3235931 - protein, 5 aa, Plasmodium falciparum
NEKYD

SEQ ID NO: 3235932 - protein, 6 aa, Plasmodium falciparum
NEKYGM

SEQ ID NO: 3235933 - protein, 9 aa, Plasmodium falciparum
NEKYKQNSN

SEQ ID NO: 3235934 - protein, 7 aa, Plasmodium falciparum
NEKYNQE

SEQ ID NO: 3235935 - protein, 21 aa, Plasmodium falciparum
NEKYNSNTSPCEENTSNDFNY

SEQ ID NO: 3235936 - protein, 20 aa, Plasmodium falciparum
NEKYPNNKQTKNKKDDRHEN

SEQ ID NO: 3235937 - protein, 5 aa, Plasmodium falciparum
NELDK

SEQ ID NO: 3235938 - protein, 6 aa, Plasmodium falciparum
NELDKD

SEQ ID NO: 3235939 - protein, 10 aa, Plasmodium falciparum
NELEKDNNSF

SEQ ID NO: 3235940 - protein, 9 aa, Plasmodium falciparum
NELENQEKN

SEQ ID NO: 3235941 - protein, 9 aa, Plasmodium falciparum
NELGKENHQ

SEQ ID NO: 3235942 - protein, 26 aa, Plasmodium falciparum
NELGTNESIKTNSDQNDNVKEKNDSN

SEQ ID NO: 3235943 - protein, 87 aa, Plasmodium falciparum
NELNQSNELSESNESNKLSESNESNKLSESNESNKLSESNESNKLSESNESNKLSESNESNELRESNKLSDSNESNQSNQSNQSNIS

SEQ ID NO: 3235944 - protein, 13 aa, Plasmodium falciparum
NELPARESRNLKK

SEQ ID NO: 3235945 - protein, 184 aa, Plasmodium falciparum
NELQNKGSDGLKENAELKNKELRNKGSDGLKENAELKNKELRNKGSDGLKENAELKNKELQNKGSEGLKENAELKNKELQNKGSEGLKENAELKNKELRNKGSEGLKENAELKNKELQNKGSEGLKENAELKNKELQNKGSEGLKENAELKNKELQNKGSEGLKENAELKNKELRNKGSEGLKE

SEQ ID NO: 3235946 - protein, 9 aa, Plasmodium falciparum
NELRGSNNK

SEQ ID NO: 3235947 - protein, 7 aa, Plasmodium falciparum
NELSEKG

SEQ ID NO: 3235948 - protein, 8 aa, Plasmodium falciparum
NELSGNDE

SEQ ID NO: 3235949 - protein, 7 aa, Plasmodium falciparum
NELSGYS

SEQ ID NO: 3235950 - protein, 31 aa, Plasmodium falciparum
NELTKGNNSKDNNNNNNNNNNNNNNKNNMGQ

SEQ ID NO: 3235951 - protein, 8 aa, Plasmodium falciparum
NELTSEKK

SEQ ID NO: 3235952 - protein, 4 aa, Plasmodium falciparum
NELY

SEQ ID NO: 3235953 - protein, 5 aa, Plasmodium falciparum
NELYN

SEQ ID NO: 3235954 - protein, 12 aa, Plasmodium falciparum
NEMDKTKGKEKV

SEQ ID NO: 3235955 - protein, 7 aa, Plasmodium falciparum
NEMDNND

SEQ ID NO: 3235956 - protein, 109 aa, Plasmodium falciparum
NEMDQNNERDEPTVERKSDDSRNDKDDNSHSDYSNDTNNSNDTNNSNNSNDTNNSNNSNDSNNSNNSNNSNNSNNSNNSNNSNNSNNSNNSNSNSPNDDLSKNQLNDDI

SEQ ID NO: 3235957 - protein, 14 aa, Plasmodium falciparum
NEMEDQNNKHVGSN

SEQ ID NO: 3235958 - protein, 4 aa, Plasmodium falciparum
NEMK

SEQ ID NO: 3235959 - protein, 9 aa, Plasmodium falciparum
NEMKEENNK

SEQ ID NO: 3235960 - protein, 6 aa, Plasmodium falciparum
NEMKKG

SEQ ID NO: 3235961 - protein, 8 aa, Plasmodium falciparum
NEMKRNTR

SEQ ID NO: 3235962 - protein, 6 aa, Plasmodium falciparum
NEMKTS

SEQ ID NO: 3235963 - protein, 17 aa, Plasmodium falciparum
NEMNEKEDNDEEKEKTF

SEQ ID NO: 3235964 - protein, 24 aa, Plasmodium falciparum
NEMNENKENKENKENNENNENTIN

SEQ ID NO: 3235965 - protein, 11 aa, Plasmodium falciparum
NEMNTTKNYNN

SEQ ID NO: 3235966 - protein, 6 aa, Plasmodium falciparum
NEMRKE

SEQ ID NO: 3235967 - protein, 6 aa, Plasmodium falciparum
NEMTSD

SEQ ID NO: 3235968 - protein, 9 aa, Plasmodium falciparum
NENAPECPQ

SEQ ID NO: 3235969 - protein, 20 aa, Plasmodium falciparum
NENDDNVDNAKAIGKTENDY

SEQ ID NO: 3235970 - protein, 17 aa, Plasmodium falciparum
NENDDYISNQKKNKDSE

SEQ ID NO: 3235971 - protein, 12 aa, Plasmodium falciparum
NENDGSTDSNDL

SEQ ID NO: 3235972 - protein, 27 aa, Plasmodium falciparum
NENDHNNEYNNNNNNNNNEYDNNNNNP

SEQ ID NO: 3235973 - protein, 6 aa, Plasmodium falciparum
NENDHT

SEQ ID NO: 3235974 - protein, 6 aa, Plasmodium falciparum
NENDKN

SEQ ID NO: 3235975 - protein, 29 aa, Plasmodium falciparum
NENDKSEKNNNIDDNKNKNNKENDSNNIN

SEQ ID NO: 3235976 - protein, 5 aa, Plasmodium falciparum
NENDL

SEQ ID NO: 3235977 - protein, 5 aa, Plasmodium falciparum
NENDN

SEQ ID NO: 3235978 - protein, 16 aa, Plasmodium falciparum
NENDNTMKNKKEEKEN

SEQ ID NO: 3235979 - protein, 9 aa, Plasmodium falciparum
NENDSIKDK

SEQ ID NO: 3235980 - protein, 4 aa, Plasmodium falciparum
NENE

SEQ ID NO: 3235981 - protein, 7 aa, Plasmodium falciparum
NENEDRN

SEQ ID NO: 3235982 - protein, 5 aa, Plasmodium falciparum
NENEE

SEQ ID NO: 3235983 - protein, 21 aa, Plasmodium falciparum
NENEEDDEKNKENNDNNGNAY

SEQ ID NO: 3235984 - protein, 46 aa, Plasmodium falciparum
NENEKKGKSKNEDKNKTSNLATKNSNKGCNKLKSPPKDDMNDINKD

SEQ ID NO: 3235985 - protein, 21 aa, Plasmodium falciparum
NENEKKKSDELENFNDEKKEE

SEQ ID NO: 3235986 - protein, 19 aa, Plasmodium falciparum
NENEKKNIKYDDKHEESYN

SEQ ID NO: 3235987 - protein, 8 aa, Plasmodium falciparum
NENEKNIK

SEQ ID NO: 3235988 - protein, 23 aa, Plasmodium falciparum
NENEKSNEKEKSNEKEKSNEKNI

SEQ ID NO: 3235989 - protein, 12 aa, Plasmodium falciparum
NENEMKKNENNF

SEQ ID NO: 3235990 - protein, 64 aa, Plasmodium falciparum
NENENKNENKNENKNENKNENKNENKNENKNENKNENKNENKNENKNENKNENENENKNKNKNN

SEQ ID NO: 3235991 - protein, 10 aa, Plasmodium falciparum
NENENKSEYI

SEQ ID NO: 3235992 - protein, 10 aa, Plasmodium falciparum
NENESNNDKI

SEQ ID NO: 3235993 - protein, 21 aa, Plasmodium falciparum
NENETEQRDNDGDDNKEYHKK

SEQ ID NO: 3235994 - protein, 26 aa, Plasmodium falciparum
NENEYNANNNTHKNSYFSSNENYNKY

SEQ ID NO: 3235995 - protein, 7 aa, Plasmodium falciparum
NENGIKD

SEQ ID NO: 3235996 - protein, 6 aa, Plasmodium falciparum
NENGIR

SEQ ID NO: 3235997 - protein, 7 aa, Plasmodium falciparum
NENGKKI

SEQ ID NO: 3235998 - protein, 5 aa, Plasmodium falciparum
NENGN

SEQ ID NO: 3235999 - protein, 27 aa, Plasmodium falciparum
NENGNDNEKDIQKNTTNEKPEKKNIYQ

SEQ ID NO: 3236000 - protein, 6 aa, Plasmodium falciparum
NENGTI

SEQ ID NO: 3236001 - protein, 8 aa, Plasmodium falciparum
NENGTYDI

SEQ ID NO: 3236002 - protein, 4 aa, Plasmodium falciparum
NENH

SEQ ID NO: 3236003 - protein, 12 aa, Plasmodium falciparum
NENHDNSNNKVY

SEQ ID NO: 3236004 - protein, 9 aa, Plasmodium falciparum
NENHTKDDA

SEQ ID NO: 3236005 - protein, 10 aa, Plasmodium falciparum
NENIDKKKSI

SEQ ID NO: 3236006 - protein, 32 aa, Plasmodium falciparum
NENINNQIDNSHDEKSFEGNNFSNNTNNQTNL

SEQ ID NO: 3236007 - protein, 15 aa, Plasmodium falciparum
NENISNNEQKHNQND

SEQ ID NO: 3236008 - protein, 21 aa, Plasmodium falciparum
NENISNNRNCKNTAENEKEEK

SEQ ID NO: 3236009 - protein, 17 aa, Plasmodium falciparum
NENITTPDSNNNNNNIN

SEQ ID NO: 3236010 - protein, 6 aa, Plasmodium falciparum
NENKCK

SEQ ID NO: 3236011 - protein, 10 aa, Plasmodium falciparum
NENKDNNSRN

SEQ ID NO: 3236012 - protein, 10 aa, Plasmodium falciparum
NENKDNQNVK

SEQ ID NO: 3236013 - protein, 6 aa, Plasmodium falciparum
NENKEN

SEQ ID NO: 3236014 - protein, 28 aa, Plasmodium falciparum
NENKGTGGMQGNNIKKKKDRGKKKDMDE

SEQ ID NO: 3236015 - protein, 11 aa, Plasmodium falciparum
NENKKESEEDY

SEQ ID NO: 3236016 - protein, 11 aa, Plasmodium falciparum
NENKKKKIKGH

SEQ ID NO: 3236017 - protein, 18 aa, Plasmodium falciparum
NENKKKNKNEKNTSENDE

SEQ ID NO: 3236018 - protein, 6 aa, Plasmodium falciparum
NENKKR

SEQ ID NO: 3236019 - protein, 64 aa, Plasmodium falciparum
NENKNENNKKNDNYNDQKNDNYNDQKNDIYNDQKNDIYNDQKNDIYNDQKNDIYNNQKDNYVDN

SEQ ID NO: 3236020 - protein, 12 aa, Plasmodium falciparum
NENKNNNNHNDG

SEQ ID NO: 3236021 - protein, 9 aa, Plasmodium falciparum
NENKNNQIS

SEQ ID NO: 3236022 - protein, 8 aa, Plasmodium falciparum
NENKNSTQ

SEQ ID NO: 3236023 - protein, 7 aa, Plasmodium falciparum
NENKNVE

SEQ ID NO: 3236024 - protein, 5 aa, Plasmodium falciparum
NENKQ

SEQ ID NO: 3236025 - protein, 31 aa, Plasmodium falciparum
NENKRRSNVDNKKIHNNNNNNNNNSNNSNIC

SEQ ID NO: 3236026 - protein, 10 aa, Plasmodium falciparum
NENKSMDPKH

SEQ ID NO: 3236027 - protein, 6 aa, Plasmodium falciparum
NENKSY

SEQ ID NO: 3236028 - protein, 8 aa, Plasmodium falciparum
NENKTNSI

SEQ ID NO: 3236029 - protein, 7 aa, Plasmodium falciparum
NENLDDL

SEQ ID NO: 3236030 - protein, 8 aa, Plasmodium falciparum
NENLDNSK

SEQ ID NO: 3236031 - protein, 19 aa, Plasmodium falciparum
NENLGENKNENANVNTPEN

SEQ ID NO: 3236032 - protein, 14 aa, Plasmodium falciparum
NENLNNDDEEMEEP

SEQ ID NO: 3236033 - protein, 6 aa, Plasmodium falciparum
NENLTD

SEQ ID NO: 3236034 - protein, 10 aa, Plasmodium falciparum
NENMKNKNTQ

SEQ ID NO: 3236035 - protein, 26 aa, Plasmodium falciparum
NENMQSKKAKDNLEGTKKKRDINNSD

SEQ ID NO: 3236036 - protein, 8 aa, Plasmodium falciparum
NENNAEGY

SEQ ID NO: 3236037 - protein, 6 aa, Plasmodium falciparum
NENNDT

SEQ ID NO: 3236038 - protein, 51 aa, Plasmodium falciparum
NENNEEEVTSDDNNKNNNNNSSNNNNNNSSNSNNNKMSNDRNGTNPERNVS

SEQ ID NO: 3236039 - protein, 10 aa, Plasmodium falciparum
NENNEENRKE

SEQ ID NO: 3236040 - protein, 10 aa, Plasmodium falciparum
NENNEKDYNN

SEQ ID NO: 3236041 - protein, 8 aa, Plasmodium falciparum
NENNEKIH

SEQ ID NO: 3236042 - protein, 13 aa, Plasmodium falciparum
NENNENKNVYDST

SEQ ID NO: 3236043 - protein, 27 aa, Plasmodium falciparum
NENNENNENNENNENNENNENNENNEN

SEQ ID NO: 3236044 - protein, 34 aa, Plasmodium falciparum
NENNENNKNNENNKNNKNNENNKNNHNSKNNIDN

SEQ ID NO: 3236045 - protein, 6 aa, Plasmodium falciparum
NENNHN

SEQ ID NO: 3236046 - protein, 47 aa, Plasmodium falciparum
NENNINKTDDNKNDDNKNDKNDDNKNNNNSNNNNNNDYNDNNNNKKN

SEQ ID NO: 3236047 - protein, 5 aa, Plasmodium falciparum
NENNK

SEQ ID NO: 3236048 - protein, 20 aa, Plasmodium falciparum
NENNKKKKNKKKEKKNSDLS

SEQ ID NO: 3236049 - protein, 9 aa, Plasmodium falciparum
NENNKKNNN

SEQ ID NO: 3236050 - protein, 6 aa, Plasmodium falciparum
NENNKN

SEQ ID NO: 3236051 - protein, 10 aa, Plasmodium falciparum
NENNKNENIY

SEQ ID NO: 3236052 - protein, 8 aa, Plasmodium falciparum
NENNKSYK

SEQ ID NO: 3236053 - protein, 6 aa, Plasmodium falciparum
NENNKY

SEQ ID NO: 3236054 - protein, 7 aa, Plasmodium falciparum
NENNLSS

SEQ ID NO: 3236055 - protein, 5 aa, Plasmodium falciparum
NENNN

SEQ ID NO: 3236056 - protein, 22 aa, Plasmodium falciparum
NENNNKDDKDMTQERRVNNGLS

SEQ ID NO: 3236057 - protein, 44 aa, Plasmodium falciparum
NENNNNINSNNIDNIDSNNINNIDSNNINNIDSNNINNIDSNNN

SEQ ID NO: 3236058 - protein, 19 aa, Plasmodium falciparum
NENNNNNNNNNNNNKESYE

SEQ ID NO: 3236059 - protein, 20 aa, Plasmodium falciparum
NENNNTNEHYSSRGDTQTKK

SEQ ID NO: 3236060 - protein, 10 aa, Plasmodium falciparum
NENNQRCTRD

SEQ ID NO: 3236061 - protein, 6 aa, Plasmodium falciparum
NENNSH

SEQ ID NO: 3236062 - protein, 9 aa, Plasmodium falciparum
NENNSNPTY

SEQ ID NO: 3236063 - protein, 12 aa, Plasmodium falciparum
NENNTDDEKKKK

SEQ ID NO: 3236064 - protein, 8 aa, Plasmodium falciparum
NENNTSSN

SEQ ID NO: 3236065 - protein, 7 aa, Plasmodium falciparum
NENNYSD

SEQ ID NO: 3236066 - protein, 14 aa, Plasmodium falciparum
NENPAPHATNNIKN

SEQ ID NO: 3236067 - protein, 7 aa, Plasmodium falciparum
NENPIKT

SEQ ID NO: 3236068 - protein, 9 aa, Plasmodium falciparum
NENPSKNSF

SEQ ID NO: 3236069 - protein, 8 aa, Plasmodium falciparum
NENQDDYD

SEQ ID NO: 3236070 - protein, 7 aa, Plasmodium falciparum
NENQDNP

SEQ ID NO: 3236071 - protein, 8 aa, Plasmodium falciparum
NENQIKTE

SEQ ID NO: 3236072 - protein, 77 aa, Plasmodium falciparum
NENQTGPNQTGPNQTGPNQTGPNQTGPNQTGPNQTGPNQTGPNQTGPNQTGQNQTNDNQSKKSDEYIKDNKNKTMED

SEQ ID NO: 3236073 - protein, 6 aa, Plasmodium falciparum
NENRKK

SEQ ID NO: 3236074 - protein, 7 aa, Plasmodium falciparum
NENRLND

SEQ ID NO: 3236075 - protein, 9 aa, Plasmodium falciparum
NENSIKTHQ

SEQ ID NO: 3236076 - protein, 19 aa, Plasmodium falciparum
NENSKEDAENNVSAEEAKE

SEQ ID NO: 3236077 - protein, 13 aa, Plasmodium falciparum
NENSNNNINNNEN

SEQ ID NO: 3236078 - protein, 13 aa, Plasmodium falciparum
NENSQHSKNNNIE

SEQ ID NO: 3236079 - protein, 9 aa, Plasmodium falciparum
NENSRSKSF

SEQ ID NO: 3236080 - protein, 26 aa, Plasmodium falciparum
NENSSSGLLPNNNNNNNNSNDSSSNY

SEQ ID NO: 3236081 - protein, 4 aa, Plasmodium falciparum
NENT

SEQ ID NO: 3236082 - protein, 7 aa, Plasmodium falciparum
NENTDSL

SEQ ID NO: 3236083 - protein, 9 aa, Plasmodium falciparum
NENTEQNNK

SEQ ID NO: 3236084 - protein, 5 aa, Plasmodium falciparum
NENTK

SEQ ID NO: 3236085 - protein, 7 aa, Plasmodium falciparum
NENTKNM

SEQ ID NO: 3236086 - protein, 5 aa, Plasmodium falciparum
NENTL

SEQ ID NO: 3236087 - protein, 30 aa, Plasmodium falciparum
NENTLQHTQKEEEIKRTRKPIDNFENDGTN

SEQ ID NO: 3236088 - protein, 6 aa, Plasmodium falciparum
NENTND

SEQ ID NO: 3236089 - protein, 10 aa, Plasmodium falciparum
NENTNDQNKN

SEQ ID NO: 3236090 - protein, 7 aa, Plasmodium falciparum
NENTNRT

SEQ ID NO: 3236091 - protein, 7 aa, Plasmodium falciparum
NENTSYE

SEQ ID NO: 3236092 - protein, 5 aa, Plasmodium falciparum
NENVE

SEQ ID NO: 3236093 - protein, 70 aa, Plasmodium falciparum
NENVNNNNDNNKNNENIDDNNNNNNDNNNDNNNDNNNDNDNDNVVSEKNKVGTRKYSDSKNSCSSINARN

SEQ ID NO: 3236094 - protein, 4 aa, Plasmodium falciparum
NENW

SEQ ID NO: 3236095 - protein, 5 aa, Plasmodium falciparum
NENYE

SEQ ID NO: 3236096 - protein, 21 aa, Plasmodium falciparum
NENYEEKKKKTSNNLTAQNED

SEQ ID NO: 3236097 - protein, 6 aa, Plasmodium falciparum
NENYKE

SEQ ID NO: 3236098 - protein, 25 aa, Plasmodium falciparum
NENYKNSCDNDEYVNKKNGSNSSYN

SEQ ID NO: 3236099 - protein, 8 aa, Plasmodium falciparum
NENYNNNK

SEQ ID NO: 3236100 - protein, 18 aa, Plasmodium falciparum
NENYYNKKSNTFNNNNMN

SEQ ID NO: 3236101 - protein, 6 aa, Plasmodium falciparum
NEPDDY

SEQ ID NO: 3236102 - protein, 5 aa, Plasmodium falciparum
NEPEY

SEQ ID NO: 3236103 - protein, 4 aa, Plasmodium falciparum
NEPI

SEQ ID NO: 3236104 - protein, 12 aa, Plasmodium falciparum
NEPIKNGYADTY

SEQ ID NO: 3236105 - protein, 18 aa, Plasmodium falciparum
NEPKENKVSNQNNNLNKN

SEQ ID NO: 3236106 - protein, 5 aa, Plasmodium falciparum
NEPKI

SEQ ID NO: 3236107 - protein, 13 aa, Plasmodium falciparum
NEPKKKKKKLDKL

SEQ ID NO: 3236108 - protein, 6 aa, Plasmodium falciparum
NEPKNN

SEQ ID NO: 3236109 - protein, 21 aa, Plasmodium falciparum
NEPNDIPNDYSSGDIPFNTQP

SEQ ID NO: 3236110 - protein, 9 aa, Plasmodium falciparum
NEPNQPRSY

SEQ ID NO: 3236111 - protein, 8 aa, Plasmodium falciparum
NEPNTEQN

SEQ ID NO: 3236112 - protein, 5 aa, Plasmodium falciparum
NEPSF

SEQ ID NO: 3236113 - protein, 6 aa, Plasmodium falciparum
NEPSNI

SEQ ID NO: 3236114 - protein, 4 aa, Plasmodium falciparum
NEQA

SEQ ID NO: 3236115 - protein, 5 aa, Plasmodium falciparum
NEQAK

SEQ ID NO: 3236116 - protein, 10 aa, Plasmodium falciparum
NEQDDNQLKG

SEQ ID NO: 3236117 - protein, 5 aa, Plasmodium falciparum
NEQDT

SEQ ID NO: 3236118 - protein, 14 aa, Plasmodium falciparum
NEQEDGKNEEGEEA

SEQ ID NO: 3236119 - protein, 8 aa, Plasmodium falciparum
NEQEEINN

SEQ ID NO: 3236120 - protein, 9 aa, Plasmodium falciparum
NEQEEKSDF

SEQ ID NO: 3236121 - protein, 8 aa, Plasmodium falciparum
NEQEIDEK

SEQ ID NO: 3236122 - protein, 6 aa, Plasmodium falciparum
NEQEIN

SEQ ID NO: 3236123 - protein, 6 aa, Plasmodium falciparum
NEQEKE

SEQ ID NO: 3236124 - protein, 48 aa, Plasmodium falciparum
NEQEKEKEKEKEKEKEKEKEKEKEKEKEKEEEKIVDDPKKKNIKYKKD

SEQ ID NO: 3236125 - protein, 10 aa, Plasmodium falciparum
NEQEKQTSNI

SEQ ID NO: 3236126 - protein, 4 aa, Plasmodium falciparum
NEQF

SEQ ID NO: 3236127 - protein, 11 aa, Plasmodium falciparum
NEQGDNKNKRP

SEQ ID NO: 3236128 - protein, 10 aa, Plasmodium falciparum
NEQGENKIED

SEQ ID NO: 3236129 - protein, 20 aa, Plasmodium falciparum
NEQGYDQYEQNEQNEENKKN

SEQ ID NO: 3236130 - protein, 8 aa, Plasmodium falciparum
NEQHESNS

SEQ ID NO: 3236131 - protein, 8 aa, Plasmodium falciparum
NEQHSNPM

SEQ ID NO: 3236132 - protein, 14 aa, Plasmodium falciparum
NEQIKKKNTKKKKE

SEQ ID NO: 3236133 - protein, 5 aa, Plasmodium falciparum
NEQIY

SEQ ID NO: 3236134 - protein, 4 aa, Plasmodium falciparum
NEQK

SEQ ID NO: 3236135 - protein, 22 aa, Plasmodium falciparum
NEQKDLPKNNISGNTPMNTQPN

SEQ ID NO: 3236136 - protein, 19 aa, Plasmodium falciparum
NEQKEESIKNIDNGNVDSL

SEQ ID NO: 3236137 - protein, 8 aa, Plasmodium falciparum
NEQKENNK

SEQ ID NO: 3236138 - protein, 16 aa, Plasmodium falciparum
NEQKGKLENKSNYNIE

SEQ ID NO: 3236139 - protein, 23 aa, Plasmodium falciparum
NEQKGNYYEPNKNINNKYTEDLT

SEQ ID NO: 3236140 - protein, 7 aa, Plasmodium falciparum
NEQKIPT

SEQ ID NO: 3236141 - protein, 7 aa, Plasmodium falciparum
NEQKKNT

SEQ ID NO: 3236142 - protein, 11 aa, Plasmodium falciparum
NEQLKKKNLEE

SEQ ID NO: 3236143 - protein, 15 aa, Plasmodium falciparum
NEQLQNKYNKKKRIK

SEQ ID NO: 3236144 - protein, 8 aa, Plasmodium falciparum
NEQNEEDL

SEQ ID NO: 3236145 - protein, 9 aa, Plasmodium falciparum
NEQNEIANN

SEQ ID NO: 3236146 - protein, 6 aa, Plasmodium falciparum
NEQNIN

SEQ ID NO: 3236147 - protein, 6 aa, Plasmodium falciparum
NEQNNF

SEQ ID NO: 3236148 - protein, 11 aa, Plasmodium falciparum
NEQNNNYHDNT

SEQ ID NO: 3236149 - protein, 7 aa, Plasmodium falciparum
NEQPSNK

SEQ ID NO: 3236150 - protein, 8 aa, Plasmodium falciparum
NEQRNNNI

SEQ ID NO: 3236151 - protein, 7 aa, Plasmodium falciparum
NEQSETF

SEQ ID NO: 3236152 - protein, 37 aa, Plasmodium falciparum
NEQSEVDGKSKKNAKKKKKEKKKDHHNKQQTNDEQNI

SEQ ID NO: 3236153 - protein, 5 aa, Plasmodium falciparum
NEQSI

SEQ ID NO: 3236154 - protein, 6 aa, Plasmodium falciparum
NEQSNN

SEQ ID NO: 3236155 - protein, 7 aa, Plasmodium falciparum
NEQSNNK

SEQ ID NO: 3236156 - protein, 11 aa, Plasmodium falciparum
NEQSPYHNKNN

SEQ ID NO: 3236157 - protein, 20 aa, Plasmodium falciparum
NEQTKNATRSYNMNEEENEM

SEQ ID NO: 3236158 - protein, 5 aa, Plasmodium falciparum
NEQTN

SEQ ID NO: 3236159 - protein, 16 aa, Plasmodium falciparum
NEQTSQEAVPEESTEI

SEQ ID NO: 3236160 - protein, 6 aa, Plasmodium falciparum
NEQTST

SEQ ID NO: 3236161 - protein, 9 aa, Plasmodium falciparum
NEQTVEDYK

SEQ ID NO: 3236162 - protein, 18 aa, Plasmodium falciparum
NEQYEIDQKNKEDRKNNN

SEQ ID NO: 3236163 - protein, 13 aa, Plasmodium falciparum
NEQYKNGNEGDYP

SEQ ID NO: 3236164 - protein, 12 aa, Plasmodium falciparum
NEQYKSKTSDEY

SEQ ID NO: 3236165 - protein, 4 aa, Plasmodium falciparum
NERD

SEQ ID NO: 3236166 - protein, 11 aa, Plasmodium falciparum
NERDDSMGKES

SEQ ID NO: 3236167 - protein, 16 aa, Plasmodium falciparum
NERDKKNKKQNEPHNN

SEQ ID NO: 3236168 - protein, 6 aa, Plasmodium falciparum
NERDNY

SEQ ID NO: 3236169 - protein, 9 aa, Plasmodium falciparum
NERDVESTS

SEQ ID NO: 3236170 - protein, 6 aa, Plasmodium falciparum
NERGEK

SEQ ID NO: 3236171 - protein, 8 aa, Plasmodium falciparum
NERGETLS

SEQ ID NO: 3236172 - protein, 7 aa, Plasmodium falciparum
NERGVSN

SEQ ID NO: 3236173 - protein, 15 aa, Plasmodium falciparum
NERHAATKETTETTN

SEQ ID NO: 3236174 - protein, 5 aa, Plasmodium falciparum
NERKK

SEQ ID NO: 3236175 - protein, 10 aa, Plasmodium falciparum
NERKKEKQEL

SEQ ID NO: 3236176 - protein, 10 aa, Plasmodium falciparum
NERKKKQNGM

SEQ ID NO: 3236177 - protein, 18 aa, Plasmodium falciparum
NERKNIHNNNDDYNTNCD

SEQ ID NO: 3236178 - protein, 7 aa, Plasmodium falciparum
NERKNSL

SEQ ID NO: 3236179 - protein, 15 aa, Plasmodium falciparum
NERKSSNKGNGTNNV

SEQ ID NO: 3236180 - protein, 5 aa, Plasmodium falciparum
NERKV

SEQ ID NO: 3236181 - protein, 6 aa, Plasmodium falciparum
NERLGV

SEQ ID NO: 3236182 - protein, 13 aa, Plasmodium falciparum
NERLNKKNKRLNV

SEQ ID NO: 3236183 - protein, 21 aa, Plasmodium falciparum
NERNELKGNPNESCKSRGHSD

SEQ ID NO: 3236184 - protein, 5 aa, Plasmodium falciparum
NERNK

SEQ ID NO: 3236185 - protein, 7 aa, Plasmodium falciparum
NERNKGD

SEQ ID NO: 3236186 - protein, 9 aa, Plasmodium falciparum
NERNKKGKH

SEQ ID NO: 3236187 - protein, 25 aa, Plasmodium falciparum
NERRNFDERNQQVNDRRNFDERNQH

SEQ ID NO: 3236188 - protein, 6 aa, Plasmodium falciparum
NERSKN

SEQ ID NO: 3236189 - protein, 5 aa, Plasmodium falciparum
NERTI

SEQ ID NO: 3236190 - protein, 20 aa, Plasmodium falciparum
NERTNKKKKKNDLNSTNFSD

SEQ ID NO: 3236191 - protein, 5 aa, Plasmodium falciparum
NERTY

SEQ ID NO: 3236192 - protein, 12 aa, Plasmodium falciparum
NESAKKTENRAT

SEQ ID NO: 3236193 - protein, 5 aa, Plasmodium falciparum
NESAY

SEQ ID NO: 3236194 - protein, 5 aa, Plasmodium falciparum
NESDN

SEQ ID NO: 3236195 - protein, 8 aa, Plasmodium falciparum
NESEEENE

SEQ ID NO: 3236196 - protein, 6 aa, Plasmodium falciparum
NESELK

SEQ ID NO: 3236197 - protein, 5 aa, Plasmodium falciparum
NESFE

SEQ ID NO: 3236198 - protein, 27 aa, Plasmodium falciparum
NESHHNNMNNNKNSFSNNNNNNNNQYD

SEQ ID NO: 3236199 - protein, 5 aa, Plasmodium falciparum
NESIN

SEQ ID NO: 3236200 - protein, 5 aa, Plasmodium falciparum
NESIQ

SEQ ID NO: 3236201 - protein, 5 aa, Plasmodium falciparum
NESIS

SEQ ID NO: 3236202 - protein, 5 aa, Plasmodium falciparum
NESIT

SEQ ID NO: 3236203 - protein, 9 aa, Plasmodium falciparum
NESKEKRKS

SEQ ID NO: 3236204 - protein, 5 aa, Plasmodium falciparum
NESKK

SEQ ID NO: 3236205 - protein, 7 aa, Plasmodium falciparum
NESKYSN

SEQ ID NO: 3236206 - protein, 9 aa, Plasmodium falciparum
NESLQENNN

SEQ ID NO: 3236207 - protein, 5 aa, Plasmodium falciparum
NESLS

SEQ ID NO: 3236208 - protein, 4 aa, Plasmodium falciparum
NESM

SEQ ID NO: 3236209 - protein, 7 aa, Plasmodium falciparum
NESNDDN

SEQ ID NO: 3236210 - protein, 5 aa, Plasmodium falciparum
NESNE

SEQ ID NO: 3236211 - protein, 7 aa, Plasmodium falciparum
NESNEKD

SEQ ID NO: 3236212 - protein, 20 aa, Plasmodium falciparum
NESNEKRNSLTNNYENTNYS

SEQ ID NO: 3236213 - protein, 18 aa, Plasmodium falciparum
NESNGRKDKLESKAKRRI

SEQ ID NO: 3236214 - protein, 6 aa, Plasmodium falciparum
NESNIE

SEQ ID NO: 3236215 - protein, 9 aa, Plasmodium falciparum
NESNNNEHL

SEQ ID NO: 3236216 - protein, 13 aa, Plasmodium falciparum
NESNNNNNNNNYN

SEQ ID NO: 3236217 - protein, 7 aa, Plasmodium falciparum
NESNTTI

SEQ ID NO: 3236218 - protein, 4 aa, Plasmodium falciparum
NESP

SEQ ID NO: 3236219 - protein, 8 aa, Plasmodium falciparum
NESPNEYE

SEQ ID NO: 3236220 - protein, 7 aa, Plasmodium falciparum
NESQGGH

SEQ ID NO: 3236221 - protein, 22 aa, Plasmodium falciparum
NESREEKRNENMNSYDEDNNNY

SEQ ID NO: 3236222 - protein, 8 aa, Plasmodium falciparum
NESRSKNA

SEQ ID NO: 3236223 - protein, 14 aa, Plasmodium falciparum
NESSHVKKNNDTYD

SEQ ID NO: 3236224 - protein, 6 aa, Plasmodium falciparum
NESSMK

SEQ ID NO: 3236225 - protein, 8 aa, Plasmodium falciparum
NESSNIKQ

SEQ ID NO: 3236226 - protein, 7 aa, Plasmodium falciparum
NESSSRE

SEQ ID NO: 3236227 - protein, 17 aa, Plasmodium falciparum
NESTIDHSNNNNNNNNV

SEQ ID NO: 3236228 - protein, 7 aa, Plasmodium falciparum
NESTNDI

SEQ ID NO: 3236229 - protein, 10 aa, Plasmodium falciparum
NESTQNGHNN

SEQ ID NO: 3236230 - protein, 13 aa, Plasmodium falciparum
NESTRNKKSEKNC

SEQ ID NO: 3236231 - protein, 13 aa, Plasmodium falciparum
NESTSKRAIKNRK

SEQ ID NO: 3236232 - protein, 7 aa, Plasmodium falciparum
NESTTYD

SEQ ID NO: 3236233 - protein, 4 aa, Plasmodium falciparum
NESV

SEQ ID NO: 3236234 - protein, 9 aa, Plasmodium falciparum
NESYKKEEY

SEQ ID NO: 3236235 - protein, 13 aa, Plasmodium falciparum
NESYRKTNYNNIQ

SEQ ID NO: 3236236 - protein, 4 aa, Plasmodium falciparum
NETC

SEQ ID NO: 3236237 - protein, 5 aa, Plasmodium falciparum
NETDA

SEQ ID NO: 3236238 - protein, 6 aa, Plasmodium falciparum
NETDTN

SEQ ID NO: 3236239 - protein, 30 aa, Plasmodium falciparum
NETDTRNKDLSTYNNHDDNNNNNNNNIENY

SEQ ID NO: 3236240 - protein, 4 aa, Plasmodium falciparum
NETE

SEQ ID NO: 3236241 - protein, 12 aa, Plasmodium falciparum
NETEEYNEQYSD

SEQ ID NO: 3236242 - protein, 18 aa, Plasmodium falciparum
NETEKENIKNTIPGKENE

SEQ ID NO: 3236243 - protein, 67 aa, Plasmodium falciparum
NETGGEGTNNDKEKKRQTKVSNTQGYNKDNINNKEKETNKNEEQQQGEAEGKREGEGEEGEGGEEEE

SEQ ID NO: 3236244 - protein, 26 aa, Plasmodium falciparum
NETHSGNKHNGIQSNIPSSDIHPSDI

SEQ ID NO: 3236245 - protein, 5 aa, Plasmodium falciparum
NETIK

SEQ ID NO: 3236246 - protein, 12 aa, Plasmodium falciparum
NETKACKNGCNK

SEQ ID NO: 3236247 - protein, 6 aa, Plasmodium falciparum
NETKEH

SEQ ID NO: 3236248 - protein, 6 aa, Plasmodium falciparum
NETKGK

SEQ ID NO: 3236249 - protein, 9 aa, Plasmodium falciparum
NETKINRKS

SEQ ID NO: 3236250 - protein, 22 aa, Plasmodium falciparum
NETKNKIKSENGDSNRNGSSYN

SEQ ID NO: 3236251 - protein, 5 aa, Plasmodium falciparum
NETLN

SEQ ID NO: 3236252 - protein, 10 aa, Plasmodium falciparum
NETLQKNYSS

SEQ ID NO: 3236253 - protein, 8 aa, Plasmodium falciparum
NETNAIKY

SEQ ID NO: 3236254 - protein, 10 aa, Plasmodium falciparum
NETNKYTPSD

SEQ ID NO: 3236255 - protein, 7 aa, Plasmodium falciparum
NETNQKN

SEQ ID NO: 3236256 - protein, 10 aa, Plasmodium falciparum
NETNSNDSYL

SEQ ID NO: 3236257 - protein, 12 aa, Plasmodium falciparum
NETNYTNKQDSK

SEQ ID NO: 3236258 - protein, 9 aa, Plasmodium falciparum
NETPKKSTG

SEQ ID NO: 3236259 - protein, 8 aa, Plasmodium falciparum
NETRNETS

SEQ ID NO: 3236260 - protein, 11 aa, Plasmodium falciparum
NETRQKEENKV

SEQ ID NO: 3236261 - protein, 4 aa, Plasmodium falciparum
NETS

SEQ ID NO: 3236262 - protein, 11 aa, Plasmodium falciparum
NETYENAAQQF

SEQ ID NO: 3236263 - protein, 27 aa, Plasmodium falciparum
NETYGSEKEMKENEESKENIKNNKNIE

SEQ ID NO: 3236264 - protein, 5 aa, Plasmodium falciparum
NETYN

SEQ ID NO: 3236265 - protein, 13 aa, Plasmodium falciparum
NETYTKPTDEYIE

SEQ ID NO: 3236266 - protein, 4 aa, Plasmodium falciparum
NEVG

SEQ ID NO: 3236267 - protein, 14 aa, Plasmodium falciparum
NEVGKKKKKKSINN

SEQ ID NO: 3236268 - protein, 4 aa, Plasmodium falciparum
NEVK

SEQ ID NO: 3236269 - protein, 17 aa, Plasmodium falciparum
NEVKNEKTHENNTNDED

SEQ ID NO: 3236270 - protein, 238 aa, Plasmodium falciparum
NEVNNEEMNEVNNEENNEENNEENNEENNEEMNEVNNEENNEVNNEENNEVNNETNKEENNKGNDEINNEGNNEENNETNKEENNKGNDETNKEENNKGNDEINNEGNNKGNDDMNNDMNKEENNEGNNEINKEENNKINDDMNKEENNEGNNEINKKENNKINDDMNKEENNEGNNEINKEENNEENNEENNETNKEENNKGNDEINNEENNEEDNEEYDYYDSDDDYEESLSSSDE

SEQ ID NO: 3236271 - protein, 22 aa, Plasmodium falciparum
NEVQTQSMSQENNVSHSNEEYM

SEQ ID NO: 3236272 - protein, 7 aa, Plasmodium falciparum
NEVSDET

SEQ ID NO: 3236273 - protein, 12 aa, Plasmodium falciparum
NEWYPKKKKDNY

SEQ ID NO: 3236274 - protein, 8 aa, Plasmodium falciparum
NEYANDDT

SEQ ID NO: 3236275 - protein, 10 aa, Plasmodium falciparum
NEYDDKNYNY

SEQ ID NO: 3236276 - protein, 5 aa, Plasmodium falciparum
NEYDE

SEQ ID NO: 3236277 - protein, 6 aa, Plasmodium falciparum
NEYDEE

SEQ ID NO: 3236278 - protein, 11 aa, Plasmodium falciparum
NEYDKNDINEN

SEQ ID NO: 3236279 - protein, 9 aa, Plasmodium falciparum
NEYDNNNNN

SEQ ID NO: 3236280 - protein, 13 aa, Plasmodium falciparum
NEYDRAKKKENKR

SEQ ID NO: 3236281 - protein, 5 aa, Plasmodium falciparum
NEYEK

SEQ ID NO: 3236282 - protein, 6 aa, Plasmodium falciparum
NEYHSD

SEQ ID NO: 3236283 - protein, 11 aa, Plasmodium falciparum
NEYKKKNNNKI

SEQ ID NO: 3236284 - protein, 8 aa, Plasmodium falciparum
NEYKKNDY

SEQ ID NO: 3236285 - protein, 7 aa, Plasmodium falciparum
NEYKRDD

SEQ ID NO: 3236286 - protein, 14 aa, Plasmodium falciparum
NEYLEQEDNLGRHT

SEQ ID NO: 3236287 - protein, 6 aa, Plasmodium falciparum
NEYMNK

SEQ ID NO: 3236288 - protein, 9 aa, Plasmodium falciparum
NEYNDDYNN

SEQ ID NO: 3236289 - protein, 5 aa, Plasmodium falciparum
NEYNI

SEQ ID NO: 3236290 - protein, 7 aa, Plasmodium falciparum
NEYNLNK

SEQ ID NO: 3236291 - protein, 7 aa, Plasmodium falciparum
NEYNNEE

SEQ ID NO: 3236292 - protein, 12 aa, Plasmodium falciparum
NEYPNGQNIEED

SEQ ID NO: 3236293 - protein, 4 aa, Plasmodium falciparum
NEYQ

SEQ ID NO: 3236294 - protein, 17 aa, Plasmodium falciparum
NEYRRKQRENLLKEKSI

SEQ ID NO: 3236295 - protein, 12 aa, Plasmodium falciparum
NEYSKKKEKENI

SEQ ID NO: 3236296 - protein, 5 aa, Plasmodium falciparum
NEYSN

SEQ ID NO: 3236297 - protein, 8 aa, Plasmodium falciparum
NEYTGSAN

SEQ ID NO: 3236298 - protein, 13 aa, Plasmodium falciparum
NEYTNNDDNTKNL

SEQ ID NO: 3236299 - protein, 9 aa, Plasmodium falciparum
NEYTQESSS

SEQ ID NO: 3236300 - protein, 5 aa, Plasmodium falciparum
NEYTR

SEQ ID NO: 3236301 - protein, 7 aa, Plasmodium falciparum
NEYTSDN

SEQ ID NO: 3236302 - protein, 6 aa, Plasmodium falciparum
NEYVPN

SEQ ID NO: 3236303 - protein, 6 aa, Plasmodium falciparum
NEYYNK

SEQ ID NO: 3236304 - protein, 8 aa, Plasmodium falciparum
NFAQGTSI

SEQ ID NO: 3236305 - protein, 8 aa, Plasmodium falciparum
NFDDRDQN

SEQ ID NO: 3236306 - protein, 7 aa, Plasmodium falciparum
NFDDSTK

SEQ ID NO: 3236307 - protein, 18 aa, Plasmodium falciparum
NFDEGDDSYNSKSKDQSI

SEQ ID NO: 3236308 - protein, 44 aa, Plasmodium falciparum
NFDKQKKNNNNNNNKYNDDNNNNNNNNNNNNKNNNNNNNNNDNP

SEQ ID NO: 3236309 - protein, 5 aa, Plasmodium falciparum
NFDPQ

SEQ ID NO: 3236310 - protein, 7 aa, Plasmodium falciparum
NFDQGEY

SEQ ID NO: 3236311 - protein, 11 aa, Plasmodium falciparum
NFDQRAPNVEE

SEQ ID NO: 3236312 - protein, 11 aa, Plasmodium falciparum
NFDRQTSQRFE

SEQ ID NO: 3236313 - protein, 6 aa, Plasmodium falciparum
NFEERK

SEQ ID NO: 3236314 - protein, 5 aa, Plasmodium falciparum
NFEKH

SEQ ID NO: 3236315 - protein, 5 aa, Plasmodium falciparum
NFEKK

SEQ ID NO: 3236316 - protein, 5 aa, Plasmodium falciparum
NFENE

SEQ ID NO: 3236317 - protein, 4 aa, Plasmodium falciparum
NFEQ

SEQ ID NO: 3236318 - protein, 10 aa, Plasmodium falciparum
NFERQTSQRF

SEQ ID NO: 3236319 - protein, 6 aa, Plasmodium falciparum
NFESNK

SEQ ID NO: 3236320 - protein, 5 aa, Plasmodium falciparum
NFGCD

SEQ ID NO: 3236321 - protein, 4 aa, Plasmodium falciparum
NFGE

SEQ ID NO: 3236322 - protein, 11 aa, Plasmodium falciparum
NFGGEASYDNN

SEQ ID NO: 3236323 - protein, 19 aa, Plasmodium falciparum
NFGPSEGKEKNNTQNETHK

SEQ ID NO: 3236324 - protein, 10 aa, Plasmodium falciparum
NFGSASRTTC

SEQ ID NO: 3236325 - protein, 9 aa, Plasmodium falciparum
NFKENNTES

SEQ ID NO: 3236326 - protein, 10 aa, Plasmodium falciparum
NFKETTKRKK

SEQ ID NO: 3236327 - protein, 7 aa, Plasmodium falciparum
NFKGDHK

SEQ ID NO: 3236328 - protein, 8 aa, Plasmodium falciparum
NFKPPNPW

SEQ ID NO: 3236329 - protein, 12 aa, Plasmodium falciparum
NFKTKGGKKKKK

SEQ ID NO: 3236330 - protein, 14 aa, Plasmodium falciparum
NFMEETEKKYSYQE

SEQ ID NO: 3236331 - protein, 6 aa, Plasmodium falciparum
NFNDGY

SEQ ID NO: 3236332 - protein, 12 aa, Plasmodium falciparum
NFNEASDNFNEA

SEQ ID NO: 3236333 - protein, 6 aa, Plasmodium falciparum
NFNENK

SEQ ID NO: 3236334 - protein, 6 aa, Plasmodium falciparum
NFNKKN

SEQ ID NO: 3236335 - protein, 8 aa, Plasmodium falciparum
NFNNNKDN

SEQ ID NO: 3236336 - protein, 10 aa, Plasmodium falciparum
NFNSKNSSKY

SEQ ID NO: 3236337 - protein, 4 aa, Plasmodium falciparum
NFPK

SEQ ID NO: 3236338 - protein, 5 aa, Plasmodium falciparum
NFPLE

SEQ ID NO: 3236339 - protein, 13 aa, Plasmodium falciparum
NFPSKNKNDNSIN

SEQ ID NO: 3236340 - protein, 34 aa, Plasmodium falciparum
NFPYEKENSSNTIENNDNNEDNLNSKNKNKNENL

SEQ ID NO: 3236341 - protein, 5 aa, Plasmodium falciparum
NFQDD

SEQ ID NO: 3236342 - protein, 4 aa, Plasmodium falciparum
NFQK

SEQ ID NO: 3236343 - protein, 4 aa, Plasmodium falciparum
NFRD

SEQ ID NO: 3236344 - protein, 23 aa, Plasmodium falciparum
NFRKKKEKKYKERKNKNKIYSSK

SEQ ID NO: 3236345 - protein, 12 aa, Plasmodium falciparum
NFSDENRSTLEE

SEQ ID NO: 3236346 - protein, 16 aa, Plasmodium falciparum
NFSKQNNNNNNNNNNN

SEQ ID NO: 3236347 - protein, 7 aa, Plasmodium falciparum
NFSKSST

SEQ ID NO: 3236348 - protein, 11 aa, Plasmodium falciparum
NFSNKSSKKES

SEQ ID NO: 3236349 - protein, 6 aa, Plasmodium falciparum
NFSNNN

SEQ ID NO: 3236350 - protein, 8 aa, Plasmodium falciparum
NFSNNNNN

SEQ ID NO: 3236351 - protein, 14 aa, Plasmodium falciparum
NFSPNKDGDPSQNI

SEQ ID NO: 3236352 - protein, 8 aa, Plasmodium falciparum
NFSPTTSV

SEQ ID NO: 3236353 - protein, 7 aa, Plasmodium falciparum
NFSSDNK

SEQ ID NO: 3236354 - protein, 10 aa, Plasmodium falciparum
NFSSKKTNEI

SEQ ID NO: 3236355 - protein, 8 aa, Plasmodium falciparum
NFSTSNKF

SEQ ID NO: 3236356 - protein, 11 aa, Plasmodium falciparum
NFTESNRSCSN

SEQ ID NO: 3236357 - protein, 4 aa, Plasmodium falciparum
NFTS

SEQ ID NO: 3236358 - protein, 7 aa, Plasmodium falciparum
NFTSSDA

SEQ ID NO: 3236359 - protein, 34 aa, Plasmodium falciparum
NFTTKKKKSKKSLKIKSKRSNSIDESYSSQISST

SEQ ID NO: 3236360 - protein, 12 aa, Plasmodium falciparum
NFYDNQEKKRRT

SEQ ID NO: 3236361 - protein, 5 aa, Plasmodium falciparum
NFYSD

SEQ ID NO: 3236362 - protein, 22 aa, Plasmodium falciparum
NGACGDSNTQKKCNGITPIDGN

SEQ ID NO: 3236363 - protein, 14 aa, Plasmodium falciparum
NGADAKQLDNGTIP

SEQ ID NO: 3236364 - protein, 10 aa, Plasmodium falciparum
NGARGKESGV

SEQ ID NO: 3236365 - protein, 38 aa, Plasmodium falciparum
NGASESGSQGSRSDSSSSSSSDSSQGTTSATSQSPNGD

SEQ ID NO: 3236366 - protein, 21 aa, Plasmodium falciparum
NGASGIRRQKRGTTTKYEGYE

SEQ ID NO: 3236367 - protein, 10 aa, Plasmodium falciparum
NGATGFKGDD

SEQ ID NO: 3236368 - protein, 5 aa, Plasmodium falciparum
NGCEK

SEQ ID NO: 3236369 - protein, 5 aa, Plasmodium falciparum
NGCKT

SEQ ID NO: 3236370 - protein, 4 aa, Plasmodium falciparum
NGCN

SEQ ID NO: 3236371 - protein, 9 aa, Plasmodium falciparum
NGCQDGEAV

SEQ ID NO: 3236372 - protein, 9 aa, Plasmodium falciparum
NGCSENTGL

SEQ ID NO: 3236373 - protein, 4 aa, Plasmodium falciparum
NGCY

SEQ ID NO: 3236374 - protein, 7 aa, Plasmodium falciparum
NGDCSQA

SEQ ID NO: 3236375 - protein, 9 aa, Plasmodium falciparum
NGDDDWEKQ

SEQ ID NO: 3236376 - protein, 9 aa, Plasmodium falciparum
NGDDHDENN

SEQ ID NO: 3236377 - protein, 12 aa, Plasmodium falciparum
NGDDINGDDINE

SEQ ID NO: 3236378 - protein, 8 aa, Plasmodium falciparum
NGDDNENN

SEQ ID NO: 3236379 - protein, 15 aa, Plasmodium falciparum
NGDENSKKNNDNQDA

SEQ ID NO: 3236380 - protein, 15 aa, Plasmodium falciparum
NGDESSKKENGNEDA

SEQ ID NO: 3236381 - protein, 16 aa, Plasmodium falciparum
NGDGCRGGANGNTCNK

SEQ ID NO: 3236382 - protein, 5 aa, Plasmodium falciparum
NGDGS

SEQ ID NO: 3236383 - protein, 15 aa, Plasmodium falciparum
NGDKKPDGGTTPSSW

SEQ ID NO: 3236384 - protein, 7 aa, Plasmodium falciparum
NGDKNNI

SEQ ID NO: 3236385 - protein, 6 aa, Plasmodium falciparum
NGDNET

SEQ ID NO: 3236386 - protein, 11 aa, Plasmodium falciparum
NGDNINGDNIN

SEQ ID NO: 3236387 - protein, 8 aa, Plasmodium falciparum
NGDNTALN

SEQ ID NO: 3236388 - protein, 6 aa, Plasmodium falciparum
NGDNTH

SEQ ID NO: 3236389 - protein, 10 aa, Plasmodium falciparum
NGDPNNYKKD

SEQ ID NO: 3236390 - protein, 11 aa, Plasmodium falciparum
NGDQGGNTNQV

SEQ ID NO: 3236391 - protein, 16 aa, Plasmodium falciparum
NGDSQLPSGKPGDERK

SEQ ID NO: 3236392 - protein, 21 aa, Plasmodium falciparum
NGDSQPLSGKPVTQSSDKRTA

SEQ ID NO: 3236393 - protein, 15 aa, Plasmodium falciparum
NGDTQDENNNNNNDI

SEQ ID NO: 3236394 - protein, 22 aa, Plasmodium falciparum
NGDVVSEQEVNEKKKGENEMNK

SEQ ID NO: 3236395 - protein, 10 aa, Plasmodium falciparum
NGDYKEKVSN

SEQ ID NO: 3236396 - protein, 8 aa, Plasmodium falciparum
NGDYTGVS

SEQ ID NO: 3236397 - protein, 7 aa, Plasmodium falciparum
NGECNKY

SEQ ID NO: 3236398 - protein, 9 aa, Plasmodium falciparum
NGEDTPYTL

SEQ ID NO: 3236399 - protein, 4 aa, Plasmodium falciparum
NGEE

SEQ ID NO: 3236400 - protein, 15 aa, Plasmodium falciparum
NGEEEEISKQNEAND

SEQ ID NO: 3236401 - protein, 6 aa, Plasmodium falciparum
NGEEEY

SEQ ID NO: 3236402 - protein, 11 aa, Plasmodium falciparum
NGEEKNKNCEN

SEQ ID NO: 3236403 - protein, 19 aa, Plasmodium falciparum
NGEGQNDQGFNSMNKNDAS

SEQ ID NO: 3236404 - protein, 7 aa, Plasmodium falciparum
NGEGSTC

SEQ ID NO: 3236405 - protein, 4 aa, Plasmodium falciparum
NGEI

SEQ ID NO: 3236406 - protein, 5 aa, Plasmodium falciparum
NGEIN

SEQ ID NO: 3236407 - protein, 9 aa, Plasmodium falciparum
NGEKCSSTC

SEQ ID NO: 3236408 - protein, 8 aa, Plasmodium falciparum
NGEKIKKD

SEQ ID NO: 3236409 - protein, 9 aa, Plasmodium falciparum
NGEKKDELS

SEQ ID NO: 3236410 - protein, 33 aa, Plasmodium falciparum
NGEKKYVKEQNGKTNKLTHENNNNNNNNNNNID

SEQ ID NO: 3236411 - protein, 14 aa, Plasmodium falciparum
NGEKPDDKKGVEQR

SEQ ID NO: 3236412 - protein, 14 aa, Plasmodium falciparum
NGELSEKCREQSSG

SEQ ID NO: 3236413 - protein, 9 aa, Plasmodium falciparum
NGENTSSGY

SEQ ID NO: 3236414 - protein, 16 aa, Plasmodium falciparum
NGEPKENKQEKFSNDT

SEQ ID NO: 3236415 - protein, 9 aa, Plasmodium falciparum
NGEQEMTKN

SEQ ID NO: 3236416 - protein, 6 aa, Plasmodium falciparum
NGEQVK

SEQ ID NO: 3236417 - protein, 13 aa, Plasmodium falciparum
NGESALSKRAAGI

SEQ ID NO: 3236418 - protein, 9 aa, Plasmodium falciparum
NGESEIKES

SEQ ID NO: 3236419 - protein, 9 aa, Plasmodium falciparum
NGESSPLKT

SEQ ID NO: 3236420 - protein, 14 aa, Plasmodium falciparum
NGETFDAKKKGENQ

SEQ ID NO: 3236421 - protein, 12 aa, Plasmodium falciparum
NGETNKNRNDNI

SEQ ID NO: 3236422 - protein, 9 aa, Plasmodium falciparum
NGETQTTAE

SEQ ID NO: 3236423 - protein, 15 aa, Plasmodium falciparum
NGETSIEKDADATNY

SEQ ID NO: 3236424 - protein, 6 aa, Plasmodium falciparum
NGEVTI

SEQ ID NO: 3236425 - protein, 7 aa, Plasmodium falciparum
NGEYKQK

SEQ ID NO: 3236426 - protein, 6 aa, Plasmodium falciparum
NGEYNN

SEQ ID NO: 3236427 - protein, 5 aa, Plasmodium falciparum
NGFND

SEQ ID NO: 3236428 - protein, 9 aa, Plasmodium falciparum
NGFNNTSED

SEQ ID NO: 3236429 - protein, 14 aa, Plasmodium falciparum
NGGDVSGERNPCRK

SEQ ID NO: 3236430 - protein, 10 aa, Plasmodium falciparum
NGGEPPHSSN

SEQ ID NO: 3236431 - protein, 5 aa, Plasmodium falciparum
NGGKG

SEQ ID NO: 3236432 - protein, 10 aa, Plasmodium falciparum
NGGKGSELQG

SEQ ID NO: 3236433 - protein, 12 aa, Plasmodium falciparum
NGGKKGPPPDTH

SEQ ID NO: 3236434 - protein, 14 aa, Plasmodium falciparum
NGGKLSKTKGRDKY

SEQ ID NO: 3236435 - protein, 16 aa, Plasmodium falciparum
NGGNIEETKSQSYSVT

SEQ ID NO: 3236436 - protein, 11 aa, Plasmodium falciparum
NGGNKSDEERE

SEQ ID NO: 3236437 - protein, 14 aa, Plasmodium falciparum
NGGNNNINNVNNTN

SEQ ID NO: 3236438 - protein, 7 aa, Plasmodium falciparum
NGGPGYY

SEQ ID NO: 3236439 - protein, 14 aa, Plasmodium falciparum
NGGYDKLPEDNNCG

SEQ ID NO: 3236440 - protein, 18 aa, Plasmodium falciparum
NGHEKDDNISANKKNKKY

SEQ ID NO: 3236441 - protein, 10 aa, Plasmodium falciparum
NGHETNTNDS

SEQ ID NO: 3236442 - protein, 19 aa, Plasmodium falciparum
NGHNYNKDINDKNYKDNFN

SEQ ID NO: 3236443 - protein, 13 aa, Plasmodium falciparum
NGHQSDHYNDNNV

SEQ ID NO: 3236444 - protein, 5 aa, Plasmodium falciparum
NGHVE

SEQ ID NO: 3236445 - protein, 18 aa, Plasmodium falciparum
NGIKQGKKNKQKKIDENS

SEQ ID NO: 3236446 - protein, 13 aa, Plasmodium falciparum
NGINKNNKKKKNK

SEQ ID NO: 3236447 - protein, 6 aa, Plasmodium falciparum
NGINND

SEQ ID NO: 3236448 - protein, 4 aa, Plasmodium falciparum
NGIR

SEQ ID NO: 3236449 - protein, 4 aa, Plasmodium falciparum
NGIS

SEQ ID NO: 3236450 - protein, 10 aa, Plasmodium falciparum
NGISENDYSV

SEQ ID NO: 3236451 - protein, 9 aa, Plasmodium falciparum
NGISETNNK

SEQ ID NO: 3236452 - protein, 7 aa, Plasmodium falciparum
NGITTKE

SEQ ID NO: 3236453 - protein, 20 aa, Plasmodium falciparum
NGKCKSGDGDTKEKCNEKTT

SEQ ID NO: 3236454 - protein, 22 aa, Plasmodium falciparum
NGKCKSGDTKVNCNRKNTIDAT

SEQ ID NO: 3236455 - protein, 10 aa, Plasmodium falciparum
NGKCKSSLNR

SEQ ID NO: 3236456 - protein, 16 aa, Plasmodium falciparum
NGKCSDEEKRKCNGTT

SEQ ID NO: 3236457 - protein, 21 aa, Plasmodium falciparum
NGKCSGGGKKVNCNRKNTIAA

SEQ ID NO: 3236458 - protein, 8 aa, Plasmodium falciparum
NGKDGDHI

SEQ ID NO: 3236459 - protein, 5 aa, Plasmodium falciparum
NGKDK

SEQ ID NO: 3236460 - protein, 7 aa, Plasmodium falciparum
NGKDNDY

SEQ ID NO: 3236461 - protein, 7 aa, Plasmodium falciparum
NGKGKIN

SEQ ID NO: 3236462 - protein, 10 aa, Plasmodium falciparum
NGKIKSDEEW

SEQ ID NO: 3236463 - protein, 9 aa, Plasmodium falciparum
NGKKDPKGE

SEQ ID NO: 3236464 - protein, 35 aa, Plasmodium falciparum
NGKKGETTEKCKNGKKAESTEKCNNGKKGETTEKC

SEQ ID NO: 3236465 - protein, 15 aa, Plasmodium falciparum
NGKKHDAEYEKDDNT

SEQ ID NO: 3236466 - protein, 10 aa, Plasmodium falciparum
NGKKKNKRNY

SEQ ID NO: 3236467 - protein, 11 aa, Plasmodium falciparum
NGKKQQTENNY

SEQ ID NO: 3236468 - protein, 4 aa, Plasmodium falciparum
NGKL

SEQ ID NO: 3236469 - protein, 4 aa, Plasmodium falciparum
NGKN

SEQ ID NO: 3236470 - protein, 9 aa, Plasmodium falciparum
NGKNEIPED

SEQ ID NO: 3236471 - protein, 7 aa, Plasmodium falciparum
NGKNENV

SEQ ID NO: 3236472 - protein, 10 aa, Plasmodium falciparum
NGKNNGNVTS

SEQ ID NO: 3236473 - protein, 19 aa, Plasmodium falciparum
NGKNTCKAKSVGYGSTKSL

SEQ ID NO: 3236474 - protein, 11 aa, Plasmodium falciparum
NGKPRNINQKE

SEQ ID NO: 3236475 - protein, 4 aa, Plasmodium falciparum
NGKQ

SEQ ID NO: 3236476 - protein, 6 aa, Plasmodium falciparum
NGKRKF

SEQ ID NO: 3236477 - protein, 8 aa, Plasmodium falciparum
NGKRNEKD

SEQ ID NO: 3236478 - protein, 4 aa, Plasmodium falciparum
NGKS

SEQ ID NO: 3236479 - protein, 9 aa, Plasmodium falciparum
NGKSSINSY

SEQ ID NO: 3236480 - protein, 7 aa, Plasmodium falciparum
NGKTKLS

SEQ ID NO: 3236481 - protein, 9 aa, Plasmodium falciparum
NGKTPDGKN

SEQ ID NO: 3236482 - protein, 5 aa, Plasmodium falciparum
NGKVD

SEQ ID NO: 3236483 - protein, 5 aa, Plasmodium falciparum
NGKYS

SEQ ID NO: 3236484 - protein, 14 aa, Plasmodium falciparum
NGLHNDTHRGNISE

SEQ ID NO: 3236485 - protein, 7 aa, Plasmodium falciparum
NGLKKKS

SEQ ID NO: 3236486 - protein, 8 aa, Plasmodium falciparum
NGLQEKVP

SEQ ID NO: 3236487 - protein, 4 aa, Plasmodium falciparum
NGLR

SEQ ID NO: 3236488 - protein, 12 aa, Plasmodium falciparum
NGLSKDKWSDRN

SEQ ID NO: 3236489 - protein, 7 aa, Plasmodium falciparum
NGLTNDR

SEQ ID NO: 3236490 - protein, 8 aa, Plasmodium falciparum
NGLTPAKN

SEQ ID NO: 3236491 - protein, 5 aa, Plasmodium falciparum
NGMKS

SEQ ID NO: 3236492 - protein, 21 aa, Plasmodium falciparum
NGMNDNINKNKNVDKDKNINK

SEQ ID NO: 3236493 - protein, 7 aa, Plasmodium falciparum
NGNASHS

SEQ ID NO: 3236494 - protein, 8 aa, Plasmodium falciparum
NGNASNSL

SEQ ID NO: 3236495 - protein, 21 aa, Plasmodium falciparum
NGNCGSDPKVECNGKNKNSIS

SEQ ID NO: 3236496 - protein, 20 aa, Plasmodium falciparum
NGNCKGANGNTCNGETVTAE

SEQ ID NO: 3236497 - protein, 12 aa, Plasmodium falciparum
NGNCSDTSNGNM

SEQ ID NO: 3236498 - protein, 6 aa, Plasmodium falciparum
NGNDKR

SEQ ID NO: 3236499 - protein, 6 aa, Plasmodium falciparum
NGNDNN

SEQ ID NO: 3236500 - protein, 11 aa, Plasmodium falciparum
NGNDNTIKEKR

SEQ ID NO: 3236501 - protein, 6 aa, Plasmodium falciparum
NGNEIN

SEQ ID NO: 3236502 - protein, 13 aa, Plasmodium falciparum
NGNEKYADKVTDK

SEQ ID NO: 3236503 - protein, 18 aa, Plasmodium falciparum
NGNGGNGAPATATGGGQI

SEQ ID NO: 3236504 - protein, 27 aa, Plasmodium falciparum
NGNGGNGEKSATPNATSREKGKKGDQM

SEQ ID NO: 3236505 - protein, 5 aa, Plasmodium falciparum
NGNGI

SEQ ID NO: 3236506 - protein, 10 aa, Plasmodium falciparum
NGNGSICTSD

SEQ ID NO: 3236507 - protein, 12 aa, Plasmodium falciparum
NGNGSKCTNDCP

SEQ ID NO: 3236508 - protein, 5 aa, Plasmodium falciparum
NGNHL

SEQ ID NO: 3236509 - protein, 7 aa, Plasmodium falciparum
NGNINPN

SEQ ID NO: 3236510 - protein, 35 aa, Plasmodium falciparum
NGNISSNDLENNIQTNNRNNNKNNNYNNNNNNNNI

SEQ ID NO: 3236511 - protein, 19 aa, Plasmodium falciparum
NGNKEAAPRGSTQTQPSEK

SEQ ID NO: 3236512 - protein, 58 aa, Plasmodium falciparum
NGNKEDDDKDDDKDDYKDDYKDDDKDDDKDDYKDDYKDDDKDDYKDDDKDDDKDEYYD

SEQ ID NO: 3236513 - protein, 20 aa, Plasmodium falciparum
NGNKINDKSYDEYTSYDNNC

SEQ ID NO: 3236514 - protein, 20 aa, Plasmodium falciparum
NGNKNDDINNVNKNKTNYYN

SEQ ID NO: 3236515 - protein, 6 aa, Plasmodium falciparum
NGNKSS

SEQ ID NO: 3236516 - protein, 8 aa, Plasmodium falciparum
NGNLNKDE

SEQ ID NO: 3236517 - protein, 6 aa, Plasmodium falciparum
NGNLTS

SEQ ID NO: 3236518 - protein, 11 aa, Plasmodium falciparum
NGNNDLSTNKE

SEQ ID NO: 3236519 - protein, 6 aa, Plasmodium falciparum
NGNNEN

SEQ ID NO: 3236520 - protein, 7 aa, Plasmodium falciparum
NGNNFND

SEQ ID NO: 3236521 - protein, 71 aa, Plasmodium falciparum
NGNNINGNNINGNNINNNNINSNNINSNNINSNNINSNNINSNNINSNNINSNNINSNNINSNNINSNNIN

SEQ ID NO: 3236522 - protein, 7 aa, Plasmodium falciparum
NGNNKYI

SEQ ID NO: 3236523 - protein, 40 aa, Plasmodium falciparum
NGNNLENSKNLQNEEKSPTIKEKNIPNNNNNNNNNNNKNN

SEQ ID NO: 3236524 - protein, 10 aa, Plasmodium falciparum
NGNNNNNNNC

SEQ ID NO: 3236525 - protein, 8 aa, Plasmodium falciparum
NGNNNSPS

SEQ ID NO: 3236526 - protein, 6 aa, Plasmodium falciparum
NGNNSE

SEQ ID NO: 3236527 - protein, 11 aa, Plasmodium falciparum
NGNQNYKTSTF

SEQ ID NO: 3236528 - protein, 4 aa, Plasmodium falciparum
NGNR

SEQ ID NO: 3236529 - protein, 9 aa, Plasmodium falciparum
NGNSKDKGI

SEQ ID NO: 3236530 - protein, 15 aa, Plasmodium falciparum
NGNSNNIEETKTYKN

SEQ ID NO: 3236531 - protein, 10 aa, Plasmodium falciparum
NGNTSAGNGL

SEQ ID NO: 3236532 - protein, 10 aa, Plasmodium falciparum
NGNTTTCNNS

SEQ ID NO: 3236533 - protein, 4 aa, Plasmodium falciparum
NGNV

SEQ ID NO: 3236534 - protein, 7 aa, Plasmodium falciparum
NGNYNEK

SEQ ID NO: 3236535 - protein, 6 aa, Plasmodium falciparum
NGNYPP

SEQ ID NO: 3236536 - protein, 9 aa, Plasmodium falciparum
NGPAKNDVD

SEQ ID NO: 3236537 - protein, 6 aa, Plasmodium falciparum
NGPCGR

SEQ ID NO: 3236538 - protein, 15 aa, Plasmodium falciparum
NGPCKKENGKDNDEY

SEQ ID NO: 3236539 - protein, 21 aa, Plasmodium falciparum
NGPCKNDNVDDSGKDKTGNSH

SEQ ID NO: 3236540 - protein, 18 aa, Plasmodium falciparum
NGPCKNESEENKKAEDEI

SEQ ID NO: 3236541 - protein, 14 aa, Plasmodium falciparum
NGPCKNNDNGEGKI

SEQ ID NO: 3236542 - protein, 14 aa, Plasmodium falciparum
NGPCKNNNDNGEEH

SEQ ID NO: 3236543 - protein, 21 aa, Plasmodium falciparum
NGPCSKINSAEDNGNGNEEDK

SEQ ID NO: 3236544 - protein, 6 aa, Plasmodium falciparum
NGPEAC

SEQ ID NO: 3236545 - protein, 4 aa, Plasmodium falciparum
NGPF

SEQ ID NO: 3236546 - protein, 6 aa, Plasmodium falciparum
NGPKKV

SEQ ID NO: 3236547 - protein, 14 aa, Plasmodium falciparum
NGPNSSQKKDVERR

SEQ ID NO: 3236548 - protein, 4 aa, Plasmodium falciparum
NGPS

SEQ ID NO: 3236549 - protein, 8 aa, Plasmodium falciparum
NGQTTRGN

SEQ ID NO: 3236550 - protein, 14 aa, Plasmodium falciparum
NGQYTKENDDAISS

SEQ ID NO: 3236551 - protein, 10 aa, Plasmodium falciparum
NGRKEELPNL

SEQ ID NO: 3236552 - protein, 6 aa, Plasmodium falciparum
NGRKWE

SEQ ID NO: 3236553 - protein, 6 aa, Plasmodium falciparum
NGRNKK

SEQ ID NO: 3236554 - protein, 5 aa, Plasmodium falciparum
NGRNR

SEQ ID NO: 3236555 - protein, 4 aa, Plasmodium falciparum
NGRT

SEQ ID NO: 3236556 - protein, 5 aa, Plasmodium falciparum
NGRTV

SEQ ID NO: 3236557 - protein, 28 aa, Plasmodium falciparum
NGSAGGGGSGNASGSSGDCGGGNSDSSL

SEQ ID NO: 3236558 - protein, 4 aa, Plasmodium falciparum
NGSD

SEQ ID NO: 3236559 - protein, 8 aa, Plasmodium falciparum
NGSDEGDN

SEQ ID NO: 3236560 - protein, 4 aa, Plasmodium falciparum
NGSH

SEQ ID NO: 3236561 - protein, 4 aa, Plasmodium falciparum
NGSL

SEQ ID NO: 3236562 - protein, 19 aa, Plasmodium falciparum
NGSNNGSCKGTKTKKDDAL

SEQ ID NO: 3236563 - protein, 31 aa, Plasmodium falciparum
NGSNNNNNNNINSNNNINSNNNINSNNIKNS

SEQ ID NO: 3236564 - protein, 10 aa, Plasmodium falciparum
NGSNSKTLKR

SEQ ID NO: 3236565 - protein, 29 aa, Plasmodium falciparum
NGSNSSNNNSSSSNSSSNNSNSSSSSNTY

SEQ ID NO: 3236566 - protein, 10 aa, Plasmodium falciparum
NGSSEKSTNF

SEQ ID NO: 3236567 - protein, 11 aa, Plasmodium falciparum
NGSSGSDKDMV

SEQ ID NO: 3236568 - protein, 5 aa, Plasmodium falciparum
NGSSL

SEQ ID NO: 3236569 - protein, 4 aa, Plasmodium falciparum
NGST

SEQ ID NO: 3236570 - protein, 6 aa, Plasmodium falciparum
NGSTFK

SEQ ID NO: 3236571 - protein, 11 aa, Plasmodium falciparum
NGSTGGSAAER

SEQ ID NO: 3236572 - protein, 7 aa, Plasmodium falciparum
NGSVDEN

SEQ ID NO: 3236573 - protein, 8 aa, Plasmodium falciparum
NGSYATSS

SEQ ID NO: 3236574 - protein, 18 aa, Plasmodium falciparum
NGSYDDKYENIKEQTNFK

SEQ ID NO: 3236575 - protein, 7 aa, Plasmodium falciparum
NGSYDTQ

SEQ ID NO: 3236576 - protein, 24 aa, Plasmodium falciparum
NGTANVEKDKKRVSNGATGKKGNQ

SEQ ID NO: 3236577 - protein, 7 aa, Plasmodium falciparum
NGTCSEE

SEQ ID NO: 3236578 - protein, 4 aa, Plasmodium falciparum
NGTE

SEQ ID NO: 3236579 - protein, 6 aa, Plasmodium falciparum
NGTEDI

SEQ ID NO: 3236580 - protein, 17 aa, Plasmodium falciparum
NGTHGKETNKKKIKKKI

SEQ ID NO: 3236581 - protein, 8 aa, Plasmodium falciparum
NGTKGGAK

SEQ ID NO: 3236582 - protein, 4 aa, Plasmodium falciparum
NGTL

SEQ ID NO: 3236583 - protein, 9 aa, Plasmodium falciparum
NGTNQNVYE

SEQ ID NO: 3236584 - protein, 7 aa, Plasmodium falciparum
NGTPSIR

SEQ ID NO: 3236585 - protein, 8 aa, Plasmodium falciparum
NGTPVDQS

SEQ ID NO: 3236586 - protein, 5 aa, Plasmodium falciparum
NGTQK

SEQ ID NO: 3236587 - protein, 4 aa, Plasmodium falciparum
NGTS

SEQ ID NO: 3236588 - protein, 15 aa, Plasmodium falciparum
NGTSYITSSNNDIST

SEQ ID NO: 3236589 - protein, 7 aa, Plasmodium falciparum
NGTTGSK

SEQ ID NO: 3236590 - protein, 4 aa, Plasmodium falciparum
NGTY

SEQ ID NO: 3236591 - protein, 31 aa, Plasmodium falciparum
NGVDEDDEDYDDEDEDDEEEEEEEDAYNYDS

SEQ ID NO: 3236592 - protein, 10 aa, Plasmodium falciparum
NGVEKKNDVQ

SEQ ID NO: 3236593 - protein, 15 aa, Plasmodium falciparum
NGVENGTYKSSYHNG

SEQ ID NO: 3236594 - protein, 7 aa, Plasmodium falciparum
NGVIKNK

SEQ ID NO: 3236595 - protein, 7 aa, Plasmodium falciparum
NGVQKND

SEQ ID NO: 3236596 - protein, 4 aa, Plasmodium falciparum
NGVS

SEQ ID NO: 3236597 - protein, 17 aa, Plasmodium falciparum
NGVSDGVGTAVGTATTA

SEQ ID NO: 3236598 - protein, 14 aa, Plasmodium falciparum
NGYDKKGEDEEKYN

SEQ ID NO: 3236599 - protein, 9 aa, Plasmodium falciparum
NGYEGTGKT

SEQ ID NO: 3236600 - protein, 6 aa, Plasmodium falciparum
NGYHQK

SEQ ID NO: 3236601 - protein, 14 aa, Plasmodium falciparum
NGYISSSSSCGESS

SEQ ID NO: 3236602 - protein, 5 aa, Plasmodium falciparum
NGYNI

SEQ ID NO: 3236603 - protein, 6 aa, Plasmodium falciparum
NGYNKE

SEQ ID NO: 3236604 - protein, 16 aa, Plasmodium falciparum
NGYNKKRKKNNQYQNQ

SEQ ID NO: 3236605 - protein, 11 aa, Plasmodium falciparum
NGYNNDGSKQV

SEQ ID NO: 3236606 - protein, 9 aa, Plasmodium falciparum
NGYPPARNP

SEQ ID NO: 3236607 - protein, 42 aa, Plasmodium falciparum
NGYPPARNPCDGRNQERFSNDGESKCGSDKIRGNENNSNAGA

SEQ ID NO: 3236608 - protein, 9 aa, Plasmodium falciparum
NGYRNKQNL

SEQ ID NO: 3236609 - protein, 15 aa, Plasmodium falciparum
NGYSKYEKKDEEKYY

SEQ ID NO: 3236610 - protein, 5 aa, Plasmodium falciparum
NGYSS

SEQ ID NO: 3236611 - protein, 6 aa, Plasmodium falciparum
NHCNNK

SEQ ID NO: 3236612 - protein, 4 aa, Plasmodium falciparum
NHDD

SEQ ID NO: 3236613 - protein, 9 aa, Plasmodium falciparum
NHDDDIETD

SEQ ID NO: 3236614 - protein, 5 aa, Plasmodium falciparum
NHDDN

SEQ ID NO: 3236615 - protein, 6 aa, Plasmodium falciparum
NHDDNK

SEQ ID NO: 3236616 - protein, 9 aa, Plasmodium falciparum
NHDEDDKNI

SEQ ID NO: 3236617 - protein, 19 aa, Plasmodium falciparum
NHDEDEDSTYLSDDKENAD

SEQ ID NO: 3236618 - protein, 6 aa, Plasmodium falciparum
NHDHKE

SEQ ID NO: 3236619 - protein, 4 aa, Plasmodium falciparum
NHDK

SEQ ID NO: 3236620 - protein, 13 aa, Plasmodium falciparum
NHDKENKNEEIEN

SEQ ID NO: 3236621 - protein, 9 aa, Plasmodium falciparum
NHDNDENYT

SEQ ID NO: 3236622 - protein, 5 aa, Plasmodium falciparum
NHDNI

SEQ ID NO: 3236623 - protein, 21 aa, Plasmodium falciparum
NHDNNETSRFPKKNVPKYDEK

SEQ ID NO: 3236624 - protein, 9 aa, Plasmodium falciparum
NHDNNKDKH

SEQ ID NO: 3236625 - protein, 19 aa, Plasmodium falciparum
NHDNSSNMKRRRKEKKKKL

SEQ ID NO: 3236626 - protein, 51 aa, Plasmodium falciparum
NHEDQNNCDTQNEITDDNNNNNNINNNNNNIHNNHNNNYNNNNHNNNNNRC

SEQ ID NO: 3236627 - protein, 6 aa, Plasmodium falciparum
NHENKN

SEQ ID NO: 3236628 - protein, 5 aa, Plasmodium falciparum
NHENN

SEQ ID NO: 3236629 - protein, 14 aa, Plasmodium falciparum
NHEQGDTTHDNKNV

SEQ ID NO: 3236630 - protein, 6 aa, Plasmodium falciparum
NHEQKL

SEQ ID NO: 3236631 - protein, 4 aa, Plasmodium falciparum
NHER

SEQ ID NO: 3236632 - protein, 24 aa, Plasmodium falciparum
NHFSDTSSNIENYSTSSSSTENSV

SEQ ID NO: 3236633 - protein, 5 aa, Plasmodium falciparum
NHFTK

SEQ ID NO: 3236634 - protein, 6 aa, Plasmodium falciparum
NHGEKK

SEQ ID NO: 3236635 - protein, 14 aa, Plasmodium falciparum
NHHHNNNNNNNNVD

SEQ ID NO: 3236636 - protein, 23 aa, Plasmodium falciparum
NHHNEHDNNNNKVTKSQSASSHL

SEQ ID NO: 3236637 - protein, 16 aa, Plasmodium falciparum
NHHNNNLEQKSTIQSQ

SEQ ID NO: 3236638 - protein, 8 aa, Plasmodium falciparum
NHHNNTNN

SEQ ID NO: 3236639 - protein, 5 aa, Plasmodium falciparum
NHHQI

SEQ ID NO: 3236640 - protein, 10 aa, Plasmodium falciparum
NHHSKNKHEV

SEQ ID NO: 3236641 - protein, 11 aa, Plasmodium falciparum
NHINDNDSNME

SEQ ID NO: 3236642 - protein, 12 aa, Plasmodium falciparum
NHINSNNKDDHI

SEQ ID NO: 3236643 - protein, 12 aa, Plasmodium falciparum
NHIRKNNEETNI

SEQ ID NO: 3236644 - protein, 4 aa, Plasmodium falciparum
NHIS

SEQ ID NO: 3236645 - protein, 8 aa, Plasmodium falciparum
NHISNNKN

SEQ ID NO: 3236646 - protein, 22 aa, Plasmodium falciparum
NHISSNKDYDKKYYSNNNYHNN

SEQ ID NO: 3236647 - protein, 38 aa, Plasmodium falciparum
NHISSNNNNNNNNNNNNNNNNNSNNNNNDNNRSRYSIS

SEQ ID NO: 3236648 - protein, 9 aa, Plasmodium falciparum
NHITNKSPS

SEQ ID NO: 3236649 - protein, 11 aa, Plasmodium falciparum
NHKEEKNKNVP

SEQ ID NO: 3236650 - protein, 12 aa, Plasmodium falciparum
NHKETKRKKNTS

SEQ ID NO: 3236651 - protein, 5 aa, Plasmodium falciparum
NHKGN

SEQ ID NO: 3236652 - protein, 19 aa, Plasmodium falciparum
NHKHNNNNNNNNNNNNNNN

SEQ ID NO: 3236653 - protein, 4 aa, Plasmodium falciparum
NHKI

SEQ ID NO: 3236654 - protein, 5 aa, Plasmodium falciparum
NHKKD

SEQ ID NO: 3236655 - protein, 7 aa, Plasmodium falciparum
NHKKKIK

SEQ ID NO: 3236656 - protein, 8 aa, Plasmodium falciparum
NHKKKKNK

SEQ ID NO: 3236657 - protein, 18 aa, Plasmodium falciparum
NHKKKNKKKKNPKEKRDR

SEQ ID NO: 3236658 - protein, 7 aa, Plasmodium falciparum
NHKNDFP

SEQ ID NO: 3236659 - protein, 13 aa, Plasmodium falciparum
NHKNEYNSTSQSD

SEQ ID NO: 3236660 - protein, 21 aa, Plasmodium falciparum
NHKNLSSDKFQKKSNDHYNYN

SEQ ID NO: 3236661 - protein, 9 aa, Plasmodium falciparum
NHKNNEDLN

SEQ ID NO: 3236662 - protein, 10 aa, Plasmodium falciparum
NHKNNKMDTA

SEQ ID NO: 3236663 - protein, 9 aa, Plasmodium falciparum
NHKNSSRNI

SEQ ID NO: 3236664 - protein, 15 aa, Plasmodium falciparum
NHKSTTPHTPNHTQT

SEQ ID NO: 3236665 - protein, 14 aa, Plasmodium falciparum
NHKSTTPNHTQTTR

SEQ ID NO: 3236666 - protein, 24 aa, Plasmodium falciparum
NHKTSHEKDKNTSTFKKETGNVND

SEQ ID NO: 3236667 - protein, 6 aa, Plasmodium falciparum
NHLNTS

SEQ ID NO: 3236668 - protein, 6 aa, Plasmodium falciparum
NHLQNP

SEQ ID NO: 3236669 - protein, 7 aa, Plasmodium falciparum
NHMDDQH

SEQ ID NO: 3236670 - protein, 12 aa, Plasmodium falciparum
NHMENKENIRKQ

SEQ ID NO: 3236671 - protein, 8 aa, Plasmodium falciparum
NHMTNSNN

SEQ ID NO: 3236672 - protein, 7 aa, Plasmodium falciparum
NHNAVDD

SEQ ID NO: 3236673 - protein, 4 aa, Plasmodium falciparum
NHND

SEQ ID NO: 3236674 - protein, 8 aa, Plasmodium falciparum
NHNDEKEI

SEQ ID NO: 3236675 - protein, 12 aa, Plasmodium falciparum
NHNHNQNNHHNQ

SEQ ID NO: 3236676 - protein, 4 aa, Plasmodium falciparum
NHNI

SEQ ID NO: 3236677 - protein, 5 aa, Plasmodium falciparum
NHNKK

SEQ ID NO: 3236678 - protein, 16 aa, Plasmodium falciparum
NHNKKKKYKLKQPYTN

SEQ ID NO: 3236679 - protein, 5 aa, Plasmodium falciparum
NHNMK

SEQ ID NO: 3236680 - protein, 18 aa, Plasmodium falciparum
NHNNEYNYKNEHNRHNEH

SEQ ID NO: 3236681 - protein, 6 aa, Plasmodium falciparum
NHNNHR

SEQ ID NO: 3236682 - protein, 25 aa, Plasmodium falciparum
NHNNNNDKKNNNNYSYYTSSDEYQQ

SEQ ID NO: 3236683 - protein, 12 aa, Plasmodium falciparum
NHNNNNKNYDTP

SEQ ID NO: 3236684 - protein, 9 aa, Plasmodium falciparum
NHNNNNNNN

SEQ ID NO: 3236685 - protein, 11 aa, Plasmodium falciparum
NHNNNNNNNIH

SEQ ID NO: 3236686 - protein, 11 aa, Plasmodium falciparum
NHNNNNNNNNI

SEQ ID NO: 3236687 - protein, 17 aa, Plasmodium falciparum
NHNNSTYHTSNTKLTKT

SEQ ID NO: 3236688 - protein, 5 aa, Plasmodium falciparum
NHNPV

SEQ ID NO: 3236689 - protein, 8 aa, Plasmodium falciparum
NHNQGNTL

SEQ ID NO: 3236690 - protein, 5 aa, Plasmodium falciparum
NHNQI

SEQ ID NO: 3236691 - protein, 6 aa, Plasmodium falciparum
NHNQKC

SEQ ID NO: 3236692 - protein, 17 aa, Plasmodium falciparum
NHNQSNAKDDKDGNDVI

SEQ ID NO: 3236693 - protein, 6 aa, Plasmodium falciparum
NHNSGH

SEQ ID NO: 3236694 - protein, 8 aa, Plasmodium falciparum
NHNTDEEN

SEQ ID NO: 3236695 - protein, 4 aa, Plasmodium falciparum
NHNY

SEQ ID NO: 3236696 - protein, 6 aa, Plasmodium falciparum
NHPDDE

SEQ ID NO: 3236697 - protein, 9 aa, Plasmodium falciparum
NHPDTNSSN

SEQ ID NO: 3236698 - protein, 12 aa, Plasmodium falciparum
NHPHNNNNNNYS

SEQ ID NO: 3236699 - protein, 4 aa, Plasmodium falciparum
NHPI

SEQ ID NO: 3236700 - protein, 20 aa, Plasmodium falciparum
NHPKNTSNNSVAKLTNSDPI

SEQ ID NO: 3236701 - protein, 5 aa, Plasmodium falciparum
NHPKS

SEQ ID NO: 3236702 - protein, 5 aa, Plasmodium falciparum
NHPMN

SEQ ID NO: 3236703 - protein, 18 aa, Plasmodium falciparum
NHPNGHSNEYTNNASNNL

SEQ ID NO: 3236704 - protein, 9 aa, Plasmodium falciparum
NHPSHSNNY

SEQ ID NO: 3236705 - protein, 5 aa, Plasmodium falciparum
NHPSL

SEQ ID NO: 3236706 - protein, 7 aa, Plasmodium falciparum
NHQKEDD

SEQ ID NO: 3236707 - protein, 7 aa, Plasmodium falciparum
NHQKNDN

SEQ ID NO: 3236708 - protein, 37 aa, Plasmodium falciparum
NHQNEDNNNHNNKNNHNNNHNNNHNNNNKNNHNNNEQ

SEQ ID NO: 3236709 - protein, 7 aa, Plasmodium falciparum
NHQNKHS

SEQ ID NO: 3236710 - protein, 13 aa, Plasmodium falciparum
NHQNNKNHENVNT

SEQ ID NO: 3236711 - protein, 8 aa, Plasmodium falciparum
NHQTKQAE

SEQ ID NO: 3236712 - protein, 34 aa, Plasmodium falciparum
NHQTNENNNNNNNNSNNNNNNNNNNNNNNNNNNI

SEQ ID NO: 3236713 - protein, 6 aa, Plasmodium falciparum
NHRDND

SEQ ID NO: 3236714 - protein, 12 aa, Plasmodium falciparum
NHRKKNASNSMN

SEQ ID NO: 3236715 - protein, 9 aa, Plasmodium falciparum
NHRNNSSKI

SEQ ID NO: 3236716 - protein, 5 aa, Plasmodium falciparum
NHRNY

SEQ ID NO: 3236717 - protein, 6 aa, Plasmodium falciparum
NHSDSF

SEQ ID NO: 3236718 - protein, 4 aa, Plasmodium falciparum
NHSN

SEQ ID NO: 3236719 - protein, 6 aa, Plasmodium falciparum
NHSNDS

SEQ ID NO: 3236720 - protein, 19 aa, Plasmodium falciparum
NHSNKKSTKQKNNRNKSSY

SEQ ID NO: 3236721 - protein, 6 aa, Plasmodium falciparum
NHSNNI

SEQ ID NO: 3236722 - protein, 10 aa, Plasmodium falciparum
NHSNNNVNQK

SEQ ID NO: 3236723 - protein, 11 aa, Plasmodium falciparum
NHSQNNDCDEN

SEQ ID NO: 3236724 - protein, 23 aa, Plasmodium falciparum
NHSRTHPRKGDTHALNKNERKKK

SEQ ID NO: 3236725 - protein, 16 aa, Plasmodium falciparum
NHSSNELNNEKCTNMG

SEQ ID NO: 3236726 - protein, 8 aa, Plasmodium falciparum
NHSSSIHD

SEQ ID NO: 3236727 - protein, 20 aa, Plasmodium falciparum
NHSSSSINTNSTYYNKDHQN

SEQ ID NO: 3236728 - protein, 8 aa, Plasmodium falciparum
NHSTGHYG

SEQ ID NO: 3236729 - protein, 5 aa, Plasmodium falciparum
NHSVN

SEQ ID NO: 3236730 - protein, 13 aa, Plasmodium falciparum
NHTECPKKSSSIK

SEQ ID NO: 3236731 - protein, 11 aa, Plasmodium falciparum
NHTGDKLPDGF

SEQ ID NO: 3236732 - protein, 14 aa, Plasmodium falciparum
NHTHESTNHDHSHN

SEQ ID NO: 3236733 - protein, 14 aa, Plasmodium falciparum
NHTIEQETSEESEI

SEQ ID NO: 3236734 - protein, 9 aa, Plasmodium falciparum
NHTKEQNKK

SEQ ID NO: 3236735 - protein, 20 aa, Plasmodium falciparum
NHTKNTSNNSVAKNTNSDSI

SEQ ID NO: 3236736 - protein, 8 aa, Plasmodium falciparum
NHTKNTTF

SEQ ID NO: 3236737 - protein, 5 aa, Plasmodium falciparum
NHTNC

SEQ ID NO: 3236738 - protein, 5 aa, Plasmodium falciparum
NHTNN

SEQ ID NO: 3236739 - protein, 17 aa, Plasmodium falciparum
NHTTQYEKNTRHNYNSP

SEQ ID NO: 3236740 - protein, 4 aa, Plasmodium falciparum
NHTY

SEQ ID NO: 3236741 - protein, 4 aa, Plasmodium falciparum
NHVN

SEQ ID NO: 3236742 - protein, 5 aa, Plasmodium falciparum
NHVND

SEQ ID NO: 3236743 - protein, 4 aa, Plasmodium falciparum
NHYE

SEQ ID NO: 3236744 - protein, 12 aa, Plasmodium falciparum
NHYESSNSYMGD

SEQ ID NO: 3236745 - protein, 4 aa, Plasmodium falciparum
NHYN

SEQ ID NO: 3236746 - protein, 5 aa, Plasmodium falciparum
NHYNE

SEQ ID NO: 3236747 - protein, 6 aa, Plasmodium falciparum
NHYPEM

SEQ ID NO: 3236748 - protein, 10 aa, Plasmodium falciparum
NICDNNKKYD

SEQ ID NO: 3236749 - protein, 5 aa, Plasmodium falciparum
NICGD

SEQ ID NO: 3236750 - protein, 4 aa, Plasmodium falciparum
NICS

SEQ ID NO: 3236751 - protein, 10 aa, Plasmodium falciparum
NIDEDTKKMQ

SEQ ID NO: 3236752 - protein, 8 aa, Plasmodium falciparum
NIDEKSKQ

SEQ ID NO: 3236753 - protein, 8 aa, Plasmodium falciparum
NIDENTPL

SEQ ID NO: 3236754 - protein, 30 aa, Plasmodium falciparum
NIDGKKKKKNKNNKNKNKNNKNNNKNNNNN

SEQ ID NO: 3236755 - protein, 7 aa, Plasmodium falciparum
NIDGYEK

SEQ ID NO: 3236756 - protein, 50 aa, Plasmodium falciparum
NIDHDDNNIDHDDNNIDHDDDNINHDDDNINHDDDNIDHDDNNIDHDEDK

SEQ ID NO: 3236757 - protein, 8 aa, Plasmodium falciparum
NIDKDDDN

SEQ ID NO: 3236758 - protein, 12 aa, Plasmodium falciparum
NIDKKKGKKKFT

SEQ ID NO: 3236759 - protein, 21 aa, Plasmodium falciparum
NIDKKKKKKKEKRKKKKKKKK

SEQ ID NO: 3236760 - protein, 9 aa, Plasmodium falciparum
NIDKNDRNL

SEQ ID NO: 3236761 - protein, 24 aa, Plasmodium falciparum
NIDMNKNEKEEQIKKNVNNNSPIN

SEQ ID NO: 3236762 - protein, 4 aa, Plasmodium falciparum
NIDN

SEQ ID NO: 3236763 - protein, 11 aa, Plasmodium falciparum
NIDNEENKSEE

SEQ ID NO: 3236764 - protein, 33 aa, Plasmodium falciparum
NIDNEKNKKTKDNEKEGKNKKKKEKNKNNAKNE

SEQ ID NO: 3236765 - protein, 19 aa, Plasmodium falciparum
NIDNKEKHDDQCSKKTINE

SEQ ID NO: 3236766 - protein, 5 aa, Plasmodium falciparum
NIDSD

SEQ ID NO: 3236767 - protein, 7 aa, Plasmodium falciparum
NIDSKKN

SEQ ID NO: 3236768 - protein, 8 aa, Plasmodium falciparum
NIDTQAND

SEQ ID NO: 3236769 - protein, 11 aa, Plasmodium falciparum
NIEATDVSTNK

SEQ ID NO: 3236770 - protein, 4 aa, Plasmodium falciparum
NIED

SEQ ID NO: 3236771 - protein, 10 aa, Plasmodium falciparum
NIEDDEDEKN

SEQ ID NO: 3236772 - protein, 17 aa, Plasmodium falciparum
NIEDGDYLSSENSVSAN

SEQ ID NO: 3236773 - protein, 24 aa, Plasmodium falciparum
NIEDKENNDDKENNKGKKINKEKK

SEQ ID NO: 3236774 - protein, 7 aa, Plasmodium falciparum
NIEEDEK

SEQ ID NO: 3236775 - protein, 6 aa, Plasmodium falciparum
NIEEEN

SEQ ID NO: 3236776 - protein, 7 aa, Plasmodium falciparum
NIEEGEE

SEQ ID NO: 3236777 - protein, 5 aa, Plasmodium falciparum
NIEEK

SEQ ID NO: 3236778 - protein, 11 aa, Plasmodium falciparum
NIEEKDDERKV

SEQ ID NO: 3236779 - protein, 26 aa, Plasmodium falciparum
NIEEKENDEKENEEKENDEKENDGVI

SEQ ID NO: 3236780 - protein, 7 aa, Plasmodium falciparum
NIEETSI

SEQ ID NO: 3236781 - protein, 5 aa, Plasmodium falciparum
NIEEY

SEQ ID NO: 3236782 - protein, 4 aa, Plasmodium falciparum
NIEG

SEQ ID NO: 3236783 - protein, 5 aa, Plasmodium falciparum
NIEGK

SEQ ID NO: 3236784 - protein, 14 aa, Plasmodium falciparum
NIEGSQQAGDTEHS

SEQ ID NO: 3236785 - protein, 6 aa, Plasmodium falciparum
NIEKEN

SEQ ID NO: 3236786 - protein, 24 aa, Plasmodium falciparum
NIEKKNNNNNNNNNNNNNNNNNIN

SEQ ID NO: 3236787 - protein, 9 aa, Plasmodium falciparum
NIEKNKNGM

SEQ ID NO: 3236788 - protein, 4 aa, Plasmodium falciparum
NIEN

SEQ ID NO: 3236789 - protein, 6 aa, Plasmodium falciparum
NIENEA

SEQ ID NO: 3236790 - protein, 5 aa, Plasmodium falciparum
NIENT

SEQ ID NO: 3236791 - protein, 5 aa, Plasmodium falciparum
NIEQD

SEQ ID NO: 3236792 - protein, 13 aa, Plasmodium falciparum
NIEQKENKTNEDS

SEQ ID NO: 3236793 - protein, 12 aa, Plasmodium falciparum
NIEQTNKNNETH

SEQ ID NO: 3236794 - protein, 13 aa, Plasmodium falciparum
NIERENNNNINNN

SEQ ID NO: 3236795 - protein, 12 aa, Plasmodium falciparum
NIERKENGEEGD

SEQ ID NO: 3236796 - protein, 4 aa, Plasmodium falciparum
NIES

SEQ ID NO: 3236797 - protein, 13 aa, Plasmodium falciparum
NIESDISSKDTNK

SEQ ID NO: 3236798 - protein, 8 aa, Plasmodium falciparum
NIETNNSN

SEQ ID NO: 3236799 - protein, 20 aa, Plasmodium falciparum
NIEYNNKKKKTNMKTRRNKY

SEQ ID NO: 3236800 - protein, 5 aa, Plasmodium falciparum
NIEYT

SEQ ID NO: 3236801 - protein, 12 aa, Plasmodium falciparum
NIFSTNNKGLNK

SEQ ID NO: 3236802 - protein, 11 aa, Plasmodium falciparum
NIGDDKDYNEE

SEQ ID NO: 3236803 - protein, 5 aa, Plasmodium falciparum
NIGDT

SEQ ID NO: 3236804 - protein, 18 aa, Plasmodium falciparum
NIGKEKKNMEMEKRQEEE

SEQ ID NO: 3236805 - protein, 5 aa, Plasmodium falciparum
NIGKN

SEQ ID NO: 3236806 - protein, 21 aa, Plasmodium falciparum
NIGKNKGNEAQNITSLDNKED

SEQ ID NO: 3236807 - protein, 4 aa, Plasmodium falciparum
NIGN

SEQ ID NO: 3236808 - protein, 13 aa, Plasmodium falciparum
NIGNDDEDINNEK

SEQ ID NO: 3236809 - protein, 38 aa, Plasmodium falciparum
NIGNDNNNYDNNYNNNHDNNYDNNYNKHKRKEKKKTYH

SEQ ID NO: 3236810 - protein, 13 aa, Plasmodium falciparum
NIGQKNEEIQEGM

SEQ ID NO: 3236811 - protein, 4 aa, Plasmodium falciparum
NIGS

SEQ ID NO: 3236812 - protein, 5 aa, Plasmodium falciparum
NIGSR

SEQ ID NO: 3236813 - protein, 6 aa, Plasmodium falciparum
NIGTST

SEQ ID NO: 3236814 - protein, 27 aa, Plasmodium falciparum
NIGVDNENNYDKDNNSSYKFGSDKNIE

SEQ ID NO: 3236815 - protein, 4 aa, Plasmodium falciparum
NIHE

SEQ ID NO: 3236816 - protein, 8 aa, Plasmodium falciparum
NIHKNDKI

SEQ ID NO: 3236817 - protein, 14 aa, Plasmodium falciparum
NIHPPEENTQSGKL

SEQ ID NO: 3236818 - protein, 10 aa, Plasmodium falciparum
NIHSSNKPCN

SEQ ID NO: 3236819 - protein, 10 aa, Plasmodium falciparum
NIHTPTNTND

SEQ ID NO: 3236820 - protein, 11 aa, Plasmodium falciparum
NIIKGKGSSFL

SEQ ID NO: 3236821 - protein, 10 aa, Plasmodium falciparum
NIKDEKDENI

SEQ ID NO: 3236822 - protein, 12 aa, Plasmodium falciparum
NIKDENSNNNES

SEQ ID NO: 3236823 - protein, 29 aa, Plasmodium falciparum
NIKDGDKNITNIKDDDKNITNMKKKNNKN

SEQ ID NO: 3236824 - protein, 10 aa, Plasmodium falciparum
NIKDNSKTLQ

SEQ ID NO: 3236825 - protein, 7 aa, Plasmodium falciparum
NIKEEDT

SEQ ID NO: 3236826 - protein, 28 aa, Plasmodium falciparum
NIKEEEKINRNNDKRTNRISRNDQKNGN

SEQ ID NO: 3236827 - protein, 7 aa, Plasmodium falciparum
NIKENYK

SEQ ID NO: 3236828 - protein, 8 aa, Plasmodium falciparum
NIKEQDKI

SEQ ID NO: 3236829 - protein, 11 aa, Plasmodium falciparum
NIKGKDLKEQD

SEQ ID NO: 3236830 - protein, 21 aa, Plasmodium falciparum
NIKGNDEYIKSDNNIKDHPNN

SEQ ID NO: 3236831 - protein, 23 aa, Plasmodium falciparum
NIKGNDNNNNNNNSNKEHQNELE

SEQ ID NO: 3236832 - protein, 4 aa, Plasmodium falciparum
NIKK

SEQ ID NO: 3236833 - protein, 6 aa, Plasmodium falciparum
NIKKDE

SEQ ID NO: 3236834 - protein, 10 aa, Plasmodium falciparum
NIKKEDAYDD

SEQ ID NO: 3236835 - protein, 10 aa, Plasmodium falciparum
NIKKENRINH

SEQ ID NO: 3236836 - protein, 41 aa, Plasmodium falciparum
NIKKESDINEQIDDTSNNDNNSDNKKDTDEGKQKENDTNVQ

SEQ ID NO: 3236837 - protein, 58 aa, Plasmodium falciparum
NIKKESNTIQEQNKKIKKTQMKENMNTNEQNVKHTKQKIGNQNNKSKAKEKEKTNKIT

SEQ ID NO: 3236838 - protein, 10 aa, Plasmodium falciparum
NIKKNENNKP

SEQ ID NO: 3236839 - protein, 16 aa, Plasmodium falciparum
NIKKNNKKKKNNKRRN

SEQ ID NO: 3236840 - protein, 5 aa, Plasmodium falciparum
NIKKS

SEQ ID NO: 3236841 - protein, 4 aa, Plasmodium falciparum
NIKN

SEQ ID NO: 3236842 - protein, 14 aa, Plasmodium falciparum
NIKNEINDSSNNYM

SEQ ID NO: 3236843 - protein, 7 aa, Plasmodium falciparum
NIKNEND

SEQ ID NO: 3236844 - protein, 68 aa, Plasmodium falciparum
NIKNGDNDKSFDNNKNFDNNKNFDNNKNFDNNKNFDNNKNFDNNKNFDNNKNFDNNNSYSSDHSNNNY

SEQ ID NO: 3236845 - protein, 7 aa, Plasmodium falciparum
NIKNKEH

SEQ ID NO: 3236846 - protein, 7 aa, Plasmodium falciparum
NIKNKNT

SEQ ID NO: 3236847 - protein, 5 aa, Plasmodium falciparum
NIKNM

SEQ ID NO: 3236848 - protein, 5 aa, Plasmodium falciparum
NIKNN

SEQ ID NO: 3236849 - protein, 9 aa, Plasmodium falciparum
NIKNNDNET

SEQ ID NO: 3236850 - protein, 8 aa, Plasmodium falciparum
NIKNNGNH

SEQ ID NO: 3236851 - protein, 8 aa, Plasmodium falciparum
NIKNNKKK

SEQ ID NO: 3236852 - protein, 10 aa, Plasmodium falciparum
NIKNNNNEIY

SEQ ID NO: 3236853 - protein, 9 aa, Plasmodium falciparum
NIKNQQDHT

SEQ ID NO: 3236854 - protein, 21 aa, Plasmodium falciparum
NIKNRYDNKTCTNNIKTKKNK

SEQ ID NO: 3236855 - protein, 11 aa, Plasmodium falciparum
NIKNTNVQNDI

SEQ ID NO: 3236856 - protein, 14 aa, Plasmodium falciparum
NIKPLKNEHNEEYQ

SEQ ID NO: 3236857 - protein, 8 aa, Plasmodium falciparum
NIKPNENN

SEQ ID NO: 3236858 - protein, 5 aa, Plasmodium falciparum
NIKPV

SEQ ID NO: 3236859 - protein, 4 aa, Plasmodium falciparum
NIKQ

SEQ ID NO: 3236860 - protein, 22 aa, Plasmodium falciparum
NIKQNKKKRLRNKTSKINRPRQ

SEQ ID NO: 3236861 - protein, 16 aa, Plasmodium falciparum
NIKQNTNDCTYSNDNI

SEQ ID NO: 3236862 - protein, 7 aa, Plasmodium falciparum
NIKQPDI

SEQ ID NO: 3236863 - protein, 4 aa, Plasmodium falciparum
NIKR

SEQ ID NO: 3236864 - protein, 5 aa, Plasmodium falciparum
NIKRD

SEQ ID NO: 3236865 - protein, 4 aa, Plasmodium falciparum
NIKS

SEQ ID NO: 3236866 - protein, 5 aa, Plasmodium falciparum
NIKSK

SEQ ID NO: 3236867 - protein, 10 aa, Plasmodium falciparum
NIKSKNDNIE

SEQ ID NO: 3236868 - protein, 7 aa, Plasmodium falciparum
NIKSNNE

SEQ ID NO: 3236869 - protein, 9 aa, Plasmodium falciparum
NIKSQKNKN

SEQ ID NO: 3236870 - protein, 4 aa, Plasmodium falciparum
NIKT

SEQ ID NO: 3236871 - protein, 11 aa, Plasmodium falciparum
NIKTEDNTGIC

SEQ ID NO: 3236872 - protein, 11 aa, Plasmodium falciparum
NIKTTDKKNME

SEQ ID NO: 3236873 - protein, 6 aa, Plasmodium falciparum
NIKTTN

SEQ ID NO: 3236874 - protein, 21 aa, Plasmodium falciparum
NIKVESNKKNSKDKDSNHNEP

SEQ ID NO: 3236875 - protein, 4 aa, Plasmodium falciparum
NIMP

SEQ ID NO: 3236876 - protein, 43 aa, Plasmodium falciparum
NIMSDQKEEEKKKINNNDNNNKNENNNKNESNNTNENNNDNNC

SEQ ID NO: 3236877 - protein, 10 aa, Plasmodium falciparum
NINDDDSYNF

SEQ ID NO: 3236878 - protein, 8 aa, Plasmodium falciparum
NINDDNDN

SEQ ID NO: 3236879 - protein, 9 aa, Plasmodium falciparum
NINDDNNGY

SEQ ID NO: 3236880 - protein, 25 aa, Plasmodium falciparum
NINDDSNEDGDERQKKEKTKSTYND

SEQ ID NO: 3236881 - protein, 12 aa, Plasmodium falciparum
NINDDYKDEENF

SEQ ID NO: 3236882 - protein, 10 aa, Plasmodium falciparum
NINDKNKKSY

SEQ ID NO: 3236883 - protein, 10 aa, Plasmodium falciparum
NINDNGDDNI

SEQ ID NO: 3236884 - protein, 5 aa, Plasmodium falciparum
NINDT

SEQ ID NO: 3236885 - protein, 6 aa, Plasmodium falciparum
NINDTQ

SEQ ID NO: 3236886 - protein, 23 aa, Plasmodium falciparum
NINDTSRKKKNKQEKDEEQDEHK

SEQ ID NO: 3236887 - protein, 16 aa, Plasmodium falciparum
NINDYDDNMNDQLDDN

SEQ ID NO: 3236888 - protein, 5 aa, Plasmodium falciparum
NINED

SEQ ID NO: 3236889 - protein, 5 aa, Plasmodium falciparum
NINEE

SEQ ID NO: 3236890 - protein, 6 aa, Plasmodium falciparum
NINEED

SEQ ID NO: 3236891 - protein, 32 aa, Plasmodium falciparum
NINEEENNNTTNSYNNNNNNNIGDDKKNVSSS

SEQ ID NO: 3236892 - protein, 23 aa, Plasmodium falciparum
NINEEKKKKKKNSYNSNYNTREI

SEQ ID NO: 3236893 - protein, 11 aa, Plasmodium falciparum
NINEENKEIEN

SEQ ID NO: 3236894 - protein, 6 aa, Plasmodium falciparum
NINEES

SEQ ID NO: 3236895 - protein, 6 aa, Plasmodium falciparum
NINEKK

SEQ ID NO: 3236896 - protein, 23 aa, Plasmodium falciparum
NINEKKKLSNTLGTNGKINNNMT

SEQ ID NO: 3236897 - protein, 9 aa, Plasmodium falciparum
NINEKSSTF

SEQ ID NO: 3236898 - protein, 14 aa, Plasmodium falciparum
NINEKTDENDNDNI

SEQ ID NO: 3236899 - protein, 11 aa, Plasmodium falciparum
NINENIKKESD

SEQ ID NO: 3236900 - protein, 8 aa, Plasmodium falciparum
NINENNEK

SEQ ID NO: 3236901 - protein, 7 aa, Plasmodium falciparum
NINENSE

SEQ ID NO: 3236902 - protein, 7 aa, Plasmodium falciparum
NINEPRK

SEQ ID NO: 3236903 - protein, 5 aa, Plasmodium falciparum
NINEQ

SEQ ID NO: 3236904 - protein, 15 aa, Plasmodium falciparum
NINERDDNKKGNPHI

SEQ ID NO: 3236905 - protein, 13 aa, Plasmodium falciparum
NINESKKKIRRKE

SEQ ID NO: 3236906 - protein, 5 aa, Plasmodium falciparum
NINET

SEQ ID NO: 3236907 - protein, 7 aa, Plasmodium falciparum
NINGEKK

SEQ ID NO: 3236908 - protein, 5 aa, Plasmodium falciparum
NINGN

SEQ ID NO: 3236909 - protein, 35 aa, Plasmodium falciparum
NINGSSSNNNNNNNNNNNNNNNNNNNNNSYKNEGN

SEQ ID NO: 3236910 - protein, 18 aa, Plasmodium falciparum
NINHNNNNNDDNNNNNND

SEQ ID NO: 3236911 - protein, 4 aa, Plasmodium falciparum
NINK

SEQ ID NO: 3236912 - protein, 9 aa, Plasmodium falciparum
NINKDDTNH

SEQ ID NO: 3236913 - protein, 6 aa, Plasmodium falciparum
NINKDK

SEQ ID NO: 3236914 - protein, 8 aa, Plasmodium falciparum
NINKDSIN

SEQ ID NO: 3236915 - protein, 10 aa, Plasmodium falciparum
NINKENTINE

SEQ ID NO: 3236916 - protein, 11 aa, Plasmodium falciparum
NINKESDKEEA

SEQ ID NO: 3236917 - protein, 8 aa, Plasmodium falciparum
NINKETDT

SEQ ID NO: 3236918 - protein, 34 aa, Plasmodium falciparum
NINKEVENKNDENNNKNYKNSKNNKNNKTEYDNH

SEQ ID NO: 3236919 - protein, 5 aa, Plasmodium falciparum
NINKN

SEQ ID NO: 3236920 - protein, 17 aa, Plasmodium falciparum
NINKNDDMNNTNDENVK

SEQ ID NO: 3236921 - protein, 33 aa, Plasmodium falciparum
NINKNKNKNNVDINKNKNNVDINKNNGDINKNN

SEQ ID NO: 3236922 - protein, 7 aa, Plasmodium falciparum
NINKNKS

SEQ ID NO: 3236923 - protein, 8 aa, Plasmodium falciparum
NINKNNNI

SEQ ID NO: 3236924 - protein, 30 aa, Plasmodium falciparum
NINKSNDNNNENVNQHNNNNNNNNINSYNN

SEQ ID NO: 3236925 - protein, 5 aa, Plasmodium falciparum
NINKT

SEQ ID NO: 3236926 - protein, 9 aa, Plasmodium falciparum
NINKTEEQL

SEQ ID NO: 3236927 - protein, 20 aa, Plasmodium falciparum
NINNDKDNGKRINNNDQLES

SEQ ID NO: 3236928 - protein, 74 aa, Plasmodium falciparum
NINNDNGIYNGNNINNDNGIYNGNNINNDNGIYNDNDINNDNDINNDNDINNDNDINNDNDINNDTNNGNNIYN

SEQ ID NO: 3236929 - protein, 20 aa, Plasmodium falciparum
NINNDNNENINNNNENINND

SEQ ID NO: 3236930 - protein, 13 aa, Plasmodium falciparum
NINNEDESDNQYN

SEQ ID NO: 3236931 - protein, 8 aa, Plasmodium falciparum
NINNEKDD

SEQ ID NO: 3236932 - protein, 8 aa, Plasmodium falciparum
NINNERNK

SEQ ID NO: 3236933 - protein, 5 aa, Plasmodium falciparum
NINNK

SEQ ID NO: 3236934 - protein, 9 aa, Plasmodium falciparum
NINNKAKNS

SEQ ID NO: 3236935 - protein, 6 aa, Plasmodium falciparum
NINNKE

SEQ ID NO: 3236936 - protein, 9 aa, Plasmodium falciparum
NINNKTTKY

SEQ ID NO: 3236937 - protein, 7 aa, Plasmodium falciparum
NINNNDD

SEQ ID NO: 3236938 - protein, 31 aa, Plasmodium falciparum
NINNNDNINNNDNINNNDNINNNDNINNNDN

SEQ ID NO: 3236939 - protein, 31 aa, Plasmodium falciparum
NINNNDNTNNNDNTNNYDNTNNYDNTNNYDN

SEQ ID NO: 3236940 - protein, 6 aa, Plasmodium falciparum
NINNNE

SEQ ID NO: 3236941 - protein, 6 aa, Plasmodium falciparum
NINNNN

SEQ ID NO: 3236942 - protein, 33 aa, Plasmodium falciparum
NINNNNGGSSNNNKKICNEKNNNNNNNNKENAI

SEQ ID NO: 3236943 - protein, 13 aa, Plasmodium falciparum
NINNNNISNNNNN

SEQ ID NO: 3236944 - protein, 13 aa, Plasmodium falciparum
NINNNNNINNQHN

SEQ ID NO: 3236945 - protein, 9 aa, Plasmodium falciparum
NINNNNNNN

SEQ ID NO: 3236946 - protein, 16 aa, Plasmodium falciparum
NINNNNNNNNKMNNNK

SEQ ID NO: 3236947 - protein, 11 aa, Plasmodium falciparum
NINNNNNNNNN

SEQ ID NO: 3236948 - protein, 13 aa, Plasmodium falciparum
NINNNNNNNNNNN

SEQ ID NO: 3236949 - protein, 12 aa, Plasmodium falciparum
NINNNNNNNSPN

SEQ ID NO: 3236950 - protein, 26 aa, Plasmodium falciparum
NINNNNSNNGIHNDNTKNRPAAGSLK

SEQ ID NO: 3236951 - protein, 6 aa, Plasmodium falciparum
NINNNQ

SEQ ID NO: 3236952 - protein, 64 aa, Plasmodium falciparum
NINNNYDNNCGNNCDDNYDNNCDDNHDNNCDNNCDNNCDNNCDNNYDNNHDNNHDNNHTNNQHN

SEQ ID NO: 3236953 - protein, 23 aa, Plasmodium falciparum
NINNQANKMNSTYNNNNYNNNNS

SEQ ID NO: 3236954 - protein, 87 aa, Plasmodium falciparum
NINNQTNDAIHSNNNNNNNNNNNNNNNNNINNNNNNINNNNNNINNNNNNINNNNNNINNNNNNINNNNNNINNNNNNINNNNNNNV

SEQ ID NO: 3236955 - protein, 5 aa, Plasmodium falciparum
NINNS

SEQ ID NO: 3236956 - protein, 6 aa, Plasmodium falciparum
NINNSK

SEQ ID NO: 3236957 - protein, 7 aa, Plasmodium falciparum
NINNTND

SEQ ID NO: 3236958 - protein, 8 aa, Plasmodium falciparum
NINNTNKE

SEQ ID NO: 3236959 - protein, 46 aa, Plasmodium falciparum
NINNTNNTNNTNNTYNTNNTYNTYNTNYNNNYNNNNNSSSNKINNA

SEQ ID NO: 3236960 - protein, 9 aa, Plasmodium falciparum
NINPSNEHS

SEQ ID NO: 3236961 - protein, 8 aa, Plasmodium falciparum
NINQKNNE

SEQ ID NO: 3236962 - protein, 8 aa, Plasmodium falciparum
NINQSEKK

SEQ ID NO: 3236963 - protein, 4 aa, Plasmodium falciparum
NINR

SEQ ID NO: 3236964 - protein, 6 aa, Plasmodium falciparum
NINRDD

SEQ ID NO: 3236965 - protein, 9 aa, Plasmodium falciparum
NINRPNSIT

SEQ ID NO: 3236966 - protein, 12 aa, Plasmodium falciparum
NINSDNNKNDIH

SEQ ID NO: 3236967 - protein, 6 aa, Plasmodium falciparum
NINSEQ

SEQ ID NO: 3236968 - protein, 7 aa, Plasmodium falciparum
NINSKNY

SEQ ID NO: 3236969 - protein, 11 aa, Plasmodium falciparum
NINSKQNQDMP

SEQ ID NO: 3236970 - protein, 18 aa, Plasmodium falciparum
NINSNINKKDTNENYQEK

SEQ ID NO: 3236971 - protein, 7 aa, Plasmodium falciparum
NINSNNN

SEQ ID NO: 3236972 - protein, 8 aa, Plasmodium falciparum
NINSNNSL

SEQ ID NO: 3236973 - protein, 15 aa, Plasmodium falciparum
NINSNSKETQSVGDD

SEQ ID NO: 3236974 - protein, 9 aa, Plasmodium falciparum
NINSPNDKD

SEQ ID NO: 3236975 - protein, 9 aa, Plasmodium falciparum
NINSRGSYI

SEQ ID NO: 3236976 - protein, 5 aa, Plasmodium falciparum
NINSS

SEQ ID NO: 3236977 - protein, 8 aa, Plasmodium falciparum
NINSSKND

SEQ ID NO: 3236978 - protein, 6 aa, Plasmodium falciparum
NINSSY

SEQ ID NO: 3236979 - protein, 29 aa, Plasmodium falciparum
NINSSYNNEELNNNNNNNIRSTSENNVNT

SEQ ID NO: 3236980 - protein, 21 aa, Plasmodium falciparum
NINSTEKKEYNDTDLVDDAHT

SEQ ID NO: 3236981 - protein, 4 aa, Plasmodium falciparum
NINT

SEQ ID NO: 3236982 - protein, 18 aa, Plasmodium falciparum
NINTDDNNNNNNNNNNNI

SEQ ID NO: 3236983 - protein, 6 aa, Plasmodium falciparum
NINTDN

SEQ ID NO: 3236984 - protein, 11 aa, Plasmodium falciparum
NINTQSDSCNH

SEQ ID NO: 3236985 - protein, 28 aa, Plasmodium falciparum
NINTTTTTNTTTTNNTTTTSHNNNNNNC

SEQ ID NO: 3236986 - protein, 4 aa, Plasmodium falciparum
NINV

SEQ ID NO: 3236987 - protein, 24 aa, Plasmodium falciparum
NINYNNNNNNNNNNNNNSNDEETT

SEQ ID NO: 3236988 - protein, 9 aa, Plasmodium falciparum
NIPDESSYD

SEQ ID NO: 3236989 - protein, 17 aa, Plasmodium falciparum
NIPDTSGDNTPTLNTPT

SEQ ID NO: 3236990 - protein, 5 aa, Plasmodium falciparum
NIPFG

SEQ ID NO: 3236991 - protein, 6 aa, Plasmodium falciparum
NIPIPE

SEQ ID NO: 3236992 - protein, 4 aa, Plasmodium falciparum
NIPK

SEQ ID NO: 3236993 - protein, 5 aa, Plasmodium falciparum
NIPKD

SEQ ID NO: 3236994 - protein, 12 aa, Plasmodium falciparum
NIPKDNVNDEEK

SEQ ID NO: 3236995 - protein, 5 aa, Plasmodium falciparum
NIPKN

SEQ ID NO: 3236996 - protein, 11 aa, Plasmodium falciparum
NIPKSSNNYNI

SEQ ID NO: 3236997 - protein, 5 aa, Plasmodium falciparum
NIPKY

SEQ ID NO: 3236998 - protein, 7 aa, Plasmodium falciparum
NIPNDGS

SEQ ID NO: 3236999 - protein, 5 aa, Plasmodium falciparum
NIPNN

SEQ ID NO: 3237000 - protein, 7 aa, Plasmodium falciparum
NIPNNNE

SEQ ID NO: 3237001 - protein, 10 aa, Plasmodium falciparum
NIPNRQDKMN

SEQ ID NO: 3237002 - protein, 5 aa, Plasmodium falciparum
NIPQE

SEQ ID NO: 3237003 - protein, 7 aa, Plasmodium falciparum
NIPQEEK

SEQ ID NO: 3237004 - protein, 20 aa, Plasmodium falciparum
NIPRTNNNNSKNAAINKKPI

SEQ ID NO: 3237005 - protein, 8 aa, Plasmodium falciparum
NIPSDNTI

SEQ ID NO: 3237006 - protein, 5 aa, Plasmodium falciparum
NIPSE

SEQ ID NO: 3237007 - protein, 8 aa, Plasmodium falciparum
NIPTEEST

SEQ ID NO: 3237008 - protein, 7 aa, Plasmodium falciparum
NIPVTDK

SEQ ID NO: 3237009 - protein, 5 aa, Plasmodium falciparum
NIPYK

SEQ ID NO: 3237010 - protein, 5 aa, Plasmodium falciparum
NIPYN

SEQ ID NO: 3237011 - protein, 12 aa, Plasmodium falciparum
NIQAQKKDFRQH

SEQ ID NO: 3237012 - protein, 5 aa, Plasmodium falciparum
NIQDK

SEQ ID NO: 3237013 - protein, 5 aa, Plasmodium falciparum
NIQDN

SEQ ID NO: 3237014 - protein, 11 aa, Plasmodium falciparum
NIQDRKSGLKE

SEQ ID NO: 3237015 - protein, 5 aa, Plasmodium falciparum
NIQEI

SEQ ID NO: 3237016 - protein, 8 aa, Plasmodium falciparum
NIQHNTND

SEQ ID NO: 3237017 - protein, 7 aa, Plasmodium falciparum
NIQKENV

SEQ ID NO: 3237018 - protein, 5 aa, Plasmodium falciparum
NIQKK

SEQ ID NO: 3237019 - protein, 8 aa, Plasmodium falciparum
NIQKKKTK

SEQ ID NO: 3237020 - protein, 5 aa, Plasmodium falciparum
NIQND

SEQ ID NO: 3237021 - protein, 7 aa, Plasmodium falciparum
NIQNDKD

SEQ ID NO: 3237022 - protein, 54 aa, Plasmodium falciparum
NIQNKNYNNNNNNNNNNNNNNNNNNNNNNNNNNNNNNNNNNNNNNNNNNNNNNF

SEQ ID NO: 3237023 - protein, 29 aa, Plasmodium falciparum
NIQRPKGVSTFGTHQDNKKINSNEGNESL

SEQ ID NO: 3237024 - protein, 4 aa, Plasmodium falciparum
NIQS

SEQ ID NO: 3237025 - protein, 5 aa, Plasmodium falciparum
NIQSK

SEQ ID NO: 3237026 - protein, 5 aa, Plasmodium falciparum
NIQSN

SEQ ID NO: 3237027 - protein, 5 aa, Plasmodium falciparum
NIQTN

SEQ ID NO: 3237028 - protein, 10 aa, Plasmodium falciparum
NIQTNQDKNK

SEQ ID NO: 3237029 - protein, 13 aa, Plasmodium falciparum
NIRDAEVNTIYKG

SEQ ID NO: 3237030 - protein, 6 aa, Plasmodium falciparum
NIRDSL

SEQ ID NO: 3237031 - protein, 4 aa, Plasmodium falciparum
NIRE

SEQ ID NO: 3237032 - protein, 5 aa, Plasmodium falciparum
NIRHS

SEQ ID NO: 3237033 - protein, 6 aa, Plasmodium falciparum
NIRNTE

SEQ ID NO: 3237034 - protein, 18 aa, Plasmodium falciparum
NIRQRTNNEQDNNYKDDE

SEQ ID NO: 3237035 - protein, 11 aa, Plasmodium falciparum
NIRSNNNNTDL

SEQ ID NO: 3237036 - protein, 6 aa, Plasmodium falciparum
NIRTQN

SEQ ID NO: 3237037 - protein, 9 aa, Plasmodium falciparum
NIRTSSGEC

SEQ ID NO: 3237038 - protein, 11 aa, Plasmodium falciparum
NISDDENNSVY

SEQ ID NO: 3237039 - protein, 7 aa, Plasmodium falciparum
NISDREQ

SEQ ID NO: 3237040 - protein, 4 aa, Plasmodium falciparum
NISE

SEQ ID NO: 3237041 - protein, 5 aa, Plasmodium falciparum
NISED

SEQ ID NO: 3237042 - protein, 14 aa, Plasmodium falciparum
NISEDNNKKERSNI

SEQ ID NO: 3237043 - protein, 32 aa, Plasmodium falciparum
NISEGSVSVEEERDNRKTRKDYGNYSDDKEGC

SEQ ID NO: 3237044 - protein, 7 aa, Plasmodium falciparum
NISENSS

SEQ ID NO: 3237045 - protein, 9 aa, Plasmodium falciparum
NISENTNKN

SEQ ID NO: 3237046 - protein, 11 aa, Plasmodium falciparum
NISESDETNSY

SEQ ID NO: 3237047 - protein, 4 aa, Plasmodium falciparum
NISG

SEQ ID NO: 3237048 - protein, 6 aa, Plasmodium falciparum
NISGNG

SEQ ID NO: 3237049 - protein, 7 aa, Plasmodium falciparum
NISHNNT

SEQ ID NO: 3237050 - protein, 5 aa, Plasmodium falciparum
NISKE

SEQ ID NO: 3237051 - protein, 7 aa, Plasmodium falciparum
NISKESK

SEQ ID NO: 3237052 - protein, 11 aa, Plasmodium falciparum
NISKNNEKEKH

SEQ ID NO: 3237053 - protein, 12 aa, Plasmodium falciparum
NISKPNTFGSTE

SEQ ID NO: 3237054 - protein, 17 aa, Plasmodium falciparum
NISKSNSLNKHNSSING

SEQ ID NO: 3237055 - protein, 5 aa, Plasmodium falciparum
NISND

SEQ ID NO: 3237056 - protein, 17 aa, Plasmodium falciparum
NISNDSKEKYKNDNKKV

SEQ ID NO: 3237057 - protein, 9 aa, Plasmodium falciparum
NISNEADKL

SEQ ID NO: 3237058 - protein, 13 aa, Plasmodium falciparum
NISNEYDNNINNA

SEQ ID NO: 3237059 - protein, 8 aa, Plasmodium falciparum
NISNGKRA

SEQ ID NO: 3237060 - protein, 20 aa, Plasmodium falciparum
NISNHSSDSKHSSDTNNSNK

SEQ ID NO: 3237061 - protein, 10 aa, Plasmodium falciparum
NISNNENNQS

SEQ ID NO: 3237062 - protein, 6 aa, Plasmodium falciparum
NISNNN

SEQ ID NO: 3237063 - protein, 10 aa, Plasmodium falciparum
NISNNNNLNN

SEQ ID NO: 3237064 - protein, 8 aa, Plasmodium falciparum
NISNNNNN

SEQ ID NO: 3237065 - protein, 17 aa, Plasmodium falciparum
NISNNVSNQFKDDKEKD

SEQ ID NO: 3237066 - protein, 5 aa, Plasmodium falciparum
NISNT

SEQ ID NO: 3237067 - protein, 35 aa, Plasmodium falciparum
NISNTNNTSTVNDTNNTNNVSNVSNVGNTNNVNSV

SEQ ID NO: 3237068 - protein, 6 aa, Plasmodium falciparum
NISPNQ

SEQ ID NO: 3237069 - protein, 6 aa, Plasmodium falciparum
NISPQD

SEQ ID NO: 3237070 - protein, 5 aa, Plasmodium falciparum
NISQE

SEQ ID NO: 3237071 - protein, 5 aa, Plasmodium falciparum
NISSE

SEQ ID NO: 3237072 - protein, 25 aa, Plasmodium falciparum
NISSGKSIDDSTDNSKNKNSTDYSD

SEQ ID NO: 3237073 - protein, 5 aa, Plasmodium falciparum
NISSN

SEQ ID NO: 3237074 - protein, 7 aa, Plasmodium falciparum
NISSNNK

SEQ ID NO: 3237075 - protein, 5 aa, Plasmodium falciparum
NISSP

SEQ ID NO: 3237076 - protein, 12 aa, Plasmodium falciparum
NISSPSDLHVHL

SEQ ID NO: 3237077 - protein, 9 aa, Plasmodium falciparum
NISSSRSSV

SEQ ID NO: 3237078 - protein, 23 aa, Plasmodium falciparum
NISSSSDESEESDVSATTSESEE

SEQ ID NO: 3237079 - protein, 9 aa, Plasmodium falciparum
NISSSSSAF

SEQ ID NO: 3237080 - protein, 5 aa, Plasmodium falciparum
NISST

SEQ ID NO: 3237081 - protein, 7 aa, Plasmodium falciparum
NISTDQN

SEQ ID NO: 3237082 - protein, 9 aa, Plasmodium falciparum
NISTEEKEK

SEQ ID NO: 3237083 - protein, 5 aa, Plasmodium falciparum
NISTT

SEQ ID NO: 3237084 - protein, 20 aa, Plasmodium falciparum
NISTYNKKNTTKKNENLNNS

SEQ ID NO: 3237085 - protein, 4 aa, Plasmodium falciparum
NISY

SEQ ID NO: 3237086 - protein, 6 aa, Plasmodium falciparum
NISYDD

SEQ ID NO: 3237087 - protein, 15 aa, Plasmodium falciparum
NISYDSSSTSQASKQ

SEQ ID NO: 3237088 - protein, 7 aa, Plasmodium falciparum
NITANGG

SEQ ID NO: 3237089 - protein, 7 aa, Plasmodium falciparum
NITAQNK

SEQ ID NO: 3237090 - protein, 13 aa, Plasmodium falciparum
NITDEEKRKKKKQ

SEQ ID NO: 3237091 - protein, 13 aa, Plasmodium falciparum
NITGEKKEKINKN

SEQ ID NO: 3237092 - protein, 21 aa, Plasmodium falciparum
NITGTKEIKNEGEKKKEKEEV

SEQ ID NO: 3237093 - protein, 7 aa, Plasmodium falciparum
NITHSNN

SEQ ID NO: 3237094 - protein, 6 aa, Plasmodium falciparum
NITKDS

SEQ ID NO: 3237095 - protein, 45 aa, Plasmodium falciparum
NITKDTVKRRGRKPKALSQPNKNTVEEGMPNESEETYESTSSNKS

SEQ ID NO: 3237096 - protein, 6 aa, Plasmodium falciparum
NITKGD

SEQ ID NO: 3237097 - protein, 11 aa, Plasmodium falciparum
NITKNKRNDNI

SEQ ID NO: 3237098 - protein, 11 aa, Plasmodium falciparum
NITKQKKNTLS

SEQ ID NO: 3237099 - protein, 7 aa, Plasmodium falciparum
NITKTNN

SEQ ID NO: 3237100 - protein, 4 aa, Plasmodium falciparum
NITM

SEQ ID NO: 3237101 - protein, 4 aa, Plasmodium falciparum
NITN

SEQ ID NO: 3237102 - protein, 5 aa, Plasmodium falciparum
NITNN

SEQ ID NO: 3237103 - protein, 9 aa, Plasmodium falciparum
NITNNKKKD

SEQ ID NO: 3237104 - protein, 12 aa, Plasmodium falciparum
NITNNKNITNNI

SEQ ID NO: 3237105 - protein, 14 aa, Plasmodium falciparum
NITNNNKNNYNNNN

SEQ ID NO: 3237106 - protein, 9 aa, Plasmodium falciparum
NITNSNNIN

SEQ ID NO: 3237107 - protein, 5 aa, Plasmodium falciparum
NITRK

SEQ ID NO: 3237108 - protein, 7 aa, Plasmodium falciparum
NITSDNG

SEQ ID NO: 3237109 - protein, 35 aa, Plasmodium falciparum
NITSEDELGTQKKDNERNKEDKSPNGVEENHQEND

SEQ ID NO: 3237110 - protein, 18 aa, Plasmodium falciparum
NITSNNSDCSDNISTEEI

SEQ ID NO: 3237111 - protein, 4 aa, Plasmodium falciparum
NITT

SEQ ID NO: 3237112 - protein, 5 aa, Plasmodium falciparum
NITTE

SEQ ID NO: 3237113 - protein, 5 aa, Plasmodium falciparum
NITTN

SEQ ID NO: 3237114 - protein, 22 aa, Plasmodium falciparum
NITTSNLANDTNDMNGINGNKL

SEQ ID NO: 3237115 - protein, 13 aa, Plasmodium falciparum
NITTSPKRSSSGI

SEQ ID NO: 3237116 - protein, 13 aa, Plasmodium falciparum
NITVPNNTKYNTN

SEQ ID NO: 3237117 - protein, 5 aa, Plasmodium falciparum
NITYN

SEQ ID NO: 3237118 - protein, 13 aa, Plasmodium falciparum
NIVNKSKSVLQKK

SEQ ID NO: 3237119 - protein, 11 aa, Plasmodium falciparum
NIYDNNNNKKC

SEQ ID NO: 3237120 - protein, 6 aa, Plasmodium falciparum
NIYEGT

SEQ ID NO: 3237121 - protein, 13 aa, Plasmodium falciparum
NIYGNGDSYLKTE

SEQ ID NO: 3237122 - protein, 6 aa, Plasmodium falciparum
NIYKEK

SEQ ID NO: 3237123 - protein, 15 aa, Plasmodium falciparum
NIYNKSSFSDNTSVD

SEQ ID NO: 3237124 - protein, 27 aa, Plasmodium falciparum
NIYNNDNNNNNNNNNIDTYDEGYDHTP

SEQ ID NO: 3237125 - protein, 17 aa, Plasmodium falciparum
NIYNNNNKQIERNENDY

SEQ ID NO: 3237126 - protein, 28 aa, Plasmodium falciparum
NIYSDDDNNNIYNDDDNNNIYNDDDNNI

SEQ ID NO: 3237127 - protein, 12 aa, Plasmodium falciparum
NIYSEDSKTNEC

SEQ ID NO: 3237128 - protein, 13 aa, Plasmodium falciparum
NIYSSNKDYTNYN

SEQ ID NO: 3237129 - protein, 5 aa, Plasmodium falciparum
NIYTK

SEQ ID NO: 3237130 - protein, 7 aa, Plasmodium falciparum
NIYTNNK

SEQ ID NO: 3237131 - protein, 7 aa, Plasmodium falciparum
NKADNNL

SEQ ID NO: 3237132 - protein, 4 aa, Plasmodium falciparum
NKAE

SEQ ID NO: 3237133 - protein, 22 aa, Plasmodium falciparum
NKAEDPQHNQEDHQNENKTINH

SEQ ID NO: 3237134 - protein, 6 aa, Plasmodium falciparum
NKAEEY

SEQ ID NO: 3237135 - protein, 36 aa, Plasmodium falciparum
NKAEKKGNVQVTNKTEKTTKVDKNNKVPKKSRTQKS

SEQ ID NO: 3237136 - protein, 12 aa, Plasmodium falciparum
NKAKKKPGEPCD

SEQ ID NO: 3237137 - protein, 6 aa, Plasmodium falciparum
NKALGN

SEQ ID NO: 3237138 - protein, 5 aa, Plasmodium falciparum
NKANE

SEQ ID NO: 3237139 - protein, 7 aa, Plasmodium falciparum
NKANEKL

SEQ ID NO: 3237140 - protein, 15 aa, Plasmodium falciparum
NKAPSNINQGNNTSV

SEQ ID NO: 3237141 - protein, 18 aa, Plasmodium falciparum
NKATLGKNGSALSNDEVK

SEQ ID NO: 3237142 - protein, 5 aa, Plasmodium falciparum
NKCDN

SEQ ID NO: 3237143 - protein, 17 aa, Plasmodium falciparum
NKCEKDEEKKKKKMTNE

SEQ ID NO: 3237144 - protein, 25 aa, Plasmodium falciparum
NKCKKKNDDNIINNNNDDVNNCGDN

SEQ ID NO: 3237145 - protein, 4 aa, Plasmodium falciparum
NKCN

SEQ ID NO: 3237146 - protein, 8 aa, Plasmodium falciparum
NKCSGGGS

SEQ ID NO: 3237147 - protein, 6 aa, Plasmodium falciparum
NKCTNI

SEQ ID NO: 3237148 - protein, 7 aa, Plasmodium falciparum
NKCTNNE

SEQ ID NO: 3237149 - protein, 7 aa, Plasmodium falciparum
NKCYESN

SEQ ID NO: 3237150 - protein, 8 aa, Plasmodium falciparum
NKDDENVD

SEQ ID NO: 3237151 - protein, 7 aa, Plasmodium falciparum
NKDDEYN

SEQ ID NO: 3237152 - protein, 7 aa, Plasmodium falciparum
NKDDHIN

SEQ ID NO: 3237153 - protein, 10 aa, Plasmodium falciparum
NKDDHKKKSV

SEQ ID NO: 3237154 - protein, 7 aa, Plasmodium falciparum
NKDDMDG

SEQ ID NO: 3237155 - protein, 16 aa, Plasmodium falciparum
NKDDTIKEHNEQTNIE

SEQ ID NO: 3237156 - protein, 10 aa, Plasmodium falciparum
NKDDTKLSIT

SEQ ID NO: 3237157 - protein, 5 aa, Plasmodium falciparum
NKDDV

SEQ ID NO: 3237158 - protein, 9 aa, Plasmodium falciparum
NKDEEIKKE

SEQ ID NO: 3237159 - protein, 7 aa, Plasmodium falciparum
NKDEKKK

SEQ ID NO: 3237160 - protein, 20 aa, Plasmodium falciparum
NKDENNNNKEHNYYNKNDDD

SEQ ID NO: 3237161 - protein, 23 aa, Plasmodium falciparum
NKDESFNMEEKEKKNILNDNKDE

SEQ ID NO: 3237162 - protein, 6 aa, Plasmodium falciparum
NKDETK

SEQ ID NO: 3237163 - protein, 6 aa, Plasmodium falciparum
NKDGDY

SEQ ID NO: 3237164 - protein, 5 aa, Plasmodium falciparum
NKDGK

SEQ ID NO: 3237165 - protein, 5 aa, Plasmodium falciparum
NKDGL

SEQ ID NO: 3237166 - protein, 78 aa, Plasmodium falciparum
NKDHNSYSTRQHNEKLSKQKTKQNKNKNHKKNNNSNDIYEKKDNKQGNSKNYSNNHQNNNKDQEEGKKKNINSSNESY

SEQ ID NO: 3237167 - protein, 4 aa, Plasmodium falciparum
NKDI

SEQ ID NO: 3237168 - protein, 10 aa, Plasmodium falciparum
NKDIETSEQM

SEQ ID NO: 3237169 - protein, 14 aa, Plasmodium falciparum
NKDIKVSKNSGCTR

SEQ ID NO: 3237170 - protein, 5 aa, Plasmodium falciparum
NKDIN

SEQ ID NO: 3237171 - protein, 8 aa, Plasmodium falciparum
NKDIQKQA

SEQ ID NO: 3237172 - protein, 8 aa, Plasmodium falciparum
NKDISNKD

SEQ ID NO: 3237173 - protein, 4 aa, Plasmodium falciparum
NKDK

SEQ ID NO: 3237174 - protein, 9 aa, Plasmodium falciparum
NKDKANGND

SEQ ID NO: 3237175 - protein, 10 aa, Plasmodium falciparum
NKDKEENKIR

SEQ ID NO: 3237176 - protein, 7 aa, Plasmodium falciparum
NKDKEFD

SEQ ID NO: 3237177 - protein, 28 aa, Plasmodium falciparum
NKDKENVNKINNNNNNNNKKKYDHDNNI

SEQ ID NO: 3237178 - protein, 7 aa, Plasmodium falciparum
NKDKETL

SEQ ID NO: 3237179 - protein, 12 aa, Plasmodium falciparum
NKDKFNDKSNCN

SEQ ID NO: 3237180 - protein, 10 aa, Plasmodium falciparum
NKDKLDSTSS

SEQ ID NO: 3237181 - protein, 6 aa, Plasmodium falciparum
NKDKNI

SEQ ID NO: 3237182 - protein, 9 aa, Plasmodium falciparum
NKDKNKKLL

SEQ ID NO: 3237183 - protein, 8 aa, Plasmodium falciparum
NKDKNNYD

SEQ ID NO: 3237184 - protein, 7 aa, Plasmodium falciparum
NKDKNSL

SEQ ID NO: 3237185 - protein, 7 aa, Plasmodium falciparum
NKDKRQF

SEQ ID NO: 3237186 - protein, 8 aa, Plasmodium falciparum
NKDKTINK

SEQ ID NO: 3237187 - protein, 5 aa, Plasmodium falciparum
NKDLY

SEQ ID NO: 3237188 - protein, 7 aa, Plasmodium falciparum
NKDMYKN

SEQ ID NO: 3237189 - protein, 6 aa, Plasmodium falciparum
NKDNCE

SEQ ID NO: 3237190 - protein, 5 aa, Plasmodium falciparum
NKDND

SEQ ID NO: 3237191 - protein, 7 aa, Plasmodium falciparum
NKDNDKR

SEQ ID NO: 3237192 - protein, 17 aa, Plasmodium falciparum
NKDNDNTCRNNKKCNKE

SEQ ID NO: 3237193 - protein, 8 aa, Plasmodium falciparum
NKDNGYNN

SEQ ID NO: 3237194 - protein, 15 aa, Plasmodium falciparum
NKDNIKNKKNFDSTL

SEQ ID NO: 3237195 - protein, 10 aa, Plasmodium falciparum
NKDNKHTNGI

SEQ ID NO: 3237196 - protein, 19 aa, Plasmodium falciparum
NKDNKSNKSNICSSSSSSK

SEQ ID NO: 3237197 - protein, 9 aa, Plasmodium falciparum
NKDNKTPIP

SEQ ID NO: 3237198 - protein, 7 aa, Plasmodium falciparum
NKDNKYK

SEQ ID NO: 3237199 - protein, 5 aa, Plasmodium falciparum
NKDNM

SEQ ID NO: 3237200 - protein, 10 aa, Plasmodium falciparum
NKDNNKDLSC

SEQ ID NO: 3237201 - protein, 7 aa, Plasmodium falciparum
NKDNNNE

SEQ ID NO: 3237202 - protein, 23 aa, Plasmodium falciparum
NKDNNTYDGPINKDNNTYDGPIN

SEQ ID NO: 3237203 - protein, 10 aa, Plasmodium falciparum
NKDNNTYYGP

SEQ ID NO: 3237204 - protein, 8 aa, Plasmodium falciparum
NKDNTDYN

SEQ ID NO: 3237205 - protein, 10 aa, Plasmodium falciparum
NKDPLKNQNN

SEQ ID NO: 3237206 - protein, 6 aa, Plasmodium falciparum
NKDPYP

SEQ ID NO: 3237207 - protein, 9 aa, Plasmodium falciparum
NKDQLSDTY

SEQ ID NO: 3237208 - protein, 22 aa, Plasmodium falciparum
NKDQPNVSIENNRNKGSIPKNV

SEQ ID NO: 3237209 - protein, 6 aa, Plasmodium falciparum
NKDRAS

SEQ ID NO: 3237210 - protein, 7 aa, Plasmodium falciparum
NKDRDNY

SEQ ID NO: 3237211 - protein, 9 aa, Plasmodium falciparum
NKDSDAPAS

SEQ ID NO: 3237212 - protein, 12 aa, Plasmodium falciparum
NKDSGNSDPSLY

SEQ ID NO: 3237213 - protein, 13 aa, Plasmodium falciparum
NKDSHNEKPINKD

SEQ ID NO: 3237214 - protein, 8 aa, Plasmodium falciparum
NKDSIKEN

SEQ ID NO: 3237215 - protein, 8 aa, Plasmodium falciparum
NKDSMKGD

SEQ ID NO: 3237216 - protein, 10 aa, Plasmodium falciparum
NKDSNKLEED

SEQ ID NO: 3237217 - protein, 7 aa, Plasmodium falciparum
NKDSPIN

SEQ ID NO: 3237218 - protein, 6 aa, Plasmodium falciparum
NKDSRH

SEQ ID NO: 3237219 - protein, 9 aa, Plasmodium falciparum
NKDSSKSNK

SEQ ID NO: 3237220 - protein, 9 aa, Plasmodium falciparum
NKDSSTNKN

SEQ ID NO: 3237221 - protein, 6 aa, Plasmodium falciparum
NKDSSY

SEQ ID NO: 3237222 - protein, 10 aa, Plasmodium falciparum
NKDTAPSSSL

SEQ ID NO: 3237223 - protein, 8 aa, Plasmodium falciparum
NKDTFKKR

SEQ ID NO: 3237224 - protein, 11 aa, Plasmodium falciparum
NKDTNKTNNKF

SEQ ID NO: 3237225 - protein, 8 aa, Plasmodium falciparum
NKDVPGKD

SEQ ID NO: 3237226 - protein, 5 aa, Plasmodium falciparum
NKDYD

SEQ ID NO: 3237227 - protein, 17 aa, Plasmodium falciparum
NKDYNNKKKKEDEQHNI

SEQ ID NO: 3237228 - protein, 5 aa, Plasmodium falciparum
NKDYT

SEQ ID NO: 3237229 - protein, 4 aa, Plasmodium falciparum
NKEA

SEQ ID NO: 3237230 - protein, 5 aa, Plasmodium falciparum
NKEAH

SEQ ID NO: 3237231 - protein, 14 aa, Plasmodium falciparum
NKEAQEESSPIGDH

SEQ ID NO: 3237232 - protein, 13 aa, Plasmodium falciparum
NKEAQKESSPIGD

SEQ ID NO: 3237233 - protein, 4 aa, Plasmodium falciparum
NKED

SEQ ID NO: 3237234 - protein, 18 aa, Plasmodium falciparum
NKEDDIIEESENNESDED

SEQ ID NO: 3237235 - protein, 15 aa, Plasmodium falciparum
NKEDDLLKNKEGDLL

SEQ ID NO: 3237236 - protein, 5 aa, Plasmodium falciparum
NKEDI

SEQ ID NO: 3237237 - protein, 18 aa, Plasmodium falciparum
NKEDIKGHSQSEKNDNMY

SEQ ID NO: 3237238 - protein, 7 aa, Plasmodium falciparum
NKEDIND

SEQ ID NO: 3237239 - protein, 11 aa, Plasmodium falciparum
NKEDKKKENKI

SEQ ID NO: 3237240 - protein, 17 aa, Plasmodium falciparum
NKEDKNNKGNEKKDKLK

SEQ ID NO: 3237241 - protein, 6 aa, Plasmodium falciparum
NKEDNL

SEQ ID NO: 3237242 - protein, 8 aa, Plasmodium falciparum
NKEDNNMN

SEQ ID NO: 3237243 - protein, 13 aa, Plasmodium falciparum
NKEDRNDDNYDNK

SEQ ID NO: 3237244 - protein, 8 aa, Plasmodium falciparum
NKEDTEKI

SEQ ID NO: 3237245 - protein, 11 aa, Plasmodium falciparum
NKEDTENNSGN

SEQ ID NO: 3237246 - protein, 5 aa, Plasmodium falciparum
NKEDY

SEQ ID NO: 3237247 - protein, 8 aa, Plasmodium falciparum
NKEDYNKT

SEQ ID NO: 3237248 - protein, 5 aa, Plasmodium falciparum
NKEEA

SEQ ID NO: 3237249 - protein, 6 aa, Plasmodium falciparum
NKEEDT

SEQ ID NO: 3237250 - protein, 14 aa, Plasmodium falciparum
NKEEEDNKNKYDIN

SEQ ID NO: 3237251 - protein, 42 aa, Plasmodium falciparum
NKEEENGKHNKEEIKNEKYDNNNYENKNNENNKNIDSNNRED

SEQ ID NO: 3237252 - protein, 7 aa, Plasmodium falciparum
NKEEKEY

SEQ ID NO: 3237253 - protein, 21 aa, Plasmodium falciparum
NKEEKKNKSYKKGEQDKSSKR

SEQ ID NO: 3237254 - protein, 7 aa, Plasmodium falciparum
NKEEKNK

SEQ ID NO: 3237255 - protein, 8 aa, Plasmodium falciparum
NKEEKNVK

SEQ ID NO: 3237256 - protein, 7 aa, Plasmodium falciparum
NKEELND

SEQ ID NO: 3237257 - protein, 8 aa, Plasmodium falciparum
NKEENFEN

SEQ ID NO: 3237258 - protein, 11 aa, Plasmodium falciparum
NKEENKPKNHN

SEQ ID NO: 3237259 - protein, 9 aa, Plasmodium falciparum
NKEENNIKY

SEQ ID NO: 3237260 - protein, 8 aa, Plasmodium falciparum
NKEEQNQA

SEQ ID NO: 3237261 - protein, 5 aa, Plasmodium falciparum
NKEER

SEQ ID NO: 3237262 - protein, 6 aa, Plasmodium falciparum
NKEERK

SEQ ID NO: 3237263 - protein, 15 aa, Plasmodium falciparum
NKEGGDEKKNKRKRK

SEQ ID NO: 3237264 - protein, 6 aa, Plasmodium falciparum
NKEGHQ

SEQ ID NO: 3237265 - protein, 55 aa, Plasmodium falciparum
NKEGKNISTTTTNSNNNNNNDDNNNNNDNNNNHNNNNHNNNHNNNHNNNDNTIGT

SEQ ID NO: 3237266 - protein, 6 aa, Plasmodium falciparum
NKEGQN

SEQ ID NO: 3237267 - protein, 6 aa, Plasmodium falciparum
NKEGTN

SEQ ID NO: 3237268 - protein, 12 aa, Plasmodium falciparum
NKEHDPNSPYNN

SEQ ID NO: 3237269 - protein, 4 aa, Plasmodium falciparum
NKEI

SEQ ID NO: 3237270 - protein, 5 aa, Plasmodium falciparum
NKEIE

SEQ ID NO: 3237271 - protein, 28 aa, Plasmodium falciparum
NKEIQRREKKKQEEEKKDEEEKNKKKEE

SEQ ID NO: 3237272 - protein, 6 aa, Plasmodium falciparum
NKEISQ

SEQ ID NO: 3237273 - protein, 9 aa, Plasmodium falciparum
NKEKDFSSF

SEQ ID NO: 3237274 - protein, 8 aa, Plasmodium falciparum
NKEKDINE

SEQ ID NO: 3237275 - protein, 9 aa, Plasmodium falciparum
NKEKDKNTY

SEQ ID NO: 3237276 - protein, 17 aa, Plasmodium falciparum
NKEKEEEEKKKNTITTN

SEQ ID NO: 3237277 - protein, 6 aa, Plasmodium falciparum
NKEKEG

SEQ ID NO: 3237278 - protein, 6 aa, Plasmodium falciparum
NKEKEI

SEQ ID NO: 3237279 - protein, 9 aa, Plasmodium falciparum
NKEKEKENY

SEQ ID NO: 3237280 - protein, 15 aa, Plasmodium falciparum
NKEKEKIPPLPSSHG

SEQ ID NO: 3237281 - protein, 11 aa, Plasmodium falciparum
NKEKEKKKKFR

SEQ ID NO: 3237282 - protein, 9 aa, Plasmodium falciparum
NKEKEQFTK

SEQ ID NO: 3237283 - protein, 33 aa, Plasmodium falciparum
NKEKEQNKEKEQNKEKEQNKEKEQNKEKEQNNY

SEQ ID NO: 3237284 - protein, 7 aa, Plasmodium falciparum
NKEKETI

SEQ ID NO: 3237285 - protein, 8 aa, Plasmodium falciparum
NKEKEYSI

SEQ ID NO: 3237286 - protein, 7 aa, Plasmodium falciparum
NKEKGVN

SEQ ID NO: 3237287 - protein, 9 aa, Plasmodium falciparum
NKEKIADNK

SEQ ID NO: 3237288 - protein, 16 aa, Plasmodium falciparum
NKEKIYKENDSHNNNM

SEQ ID NO: 3237289 - protein, 9 aa, Plasmodium falciparum
NKEKKKGVH

SEQ ID NO: 3237290 - protein, 9 aa, Plasmodium falciparum
NKEKKKKKR

SEQ ID NO: 3237291 - protein, 9 aa, Plasmodium falciparum
NKEKKMNNK

SEQ ID NO: 3237292 - protein, 10 aa, Plasmodium falciparum
NKEKKNIEKK

SEQ ID NO: 3237293 - protein, 9 aa, Plasmodium falciparum
NKEKKYGSD

SEQ ID NO: 3237294 - protein, 5 aa, Plasmodium falciparum
NKEKL

SEQ ID NO: 3237295 - protein, 6 aa, Plasmodium falciparum
NKEKNG

SEQ ID NO: 3237296 - protein, 16 aa, Plasmodium falciparum
NKEKNKAKKKKYNKKY

SEQ ID NO: 3237297 - protein, 6 aa, Plasmodium falciparum
NKEKNM

SEQ ID NO: 3237298 - protein, 11 aa, Plasmodium falciparum
NKEKNQNQNEN

SEQ ID NO: 3237299 - protein, 16 aa, Plasmodium falciparum
NKEKNTGTKENEEHKK

SEQ ID NO: 3237300 - protein, 7 aa, Plasmodium falciparum
NKEKNVS

SEQ ID NO: 3237301 - protein, 11 aa, Plasmodium falciparum
NKEKQKLQEEK

SEQ ID NO: 3237302 - protein, 10 aa, Plasmodium falciparum
NKEKQKNSIN

SEQ ID NO: 3237303 - protein, 13 aa, Plasmodium falciparum
NKEKRNKELPTNY

SEQ ID NO: 3237304 - protein, 7 aa, Plasmodium falciparum
NKEKSFK

SEQ ID NO: 3237305 - protein, 8 aa, Plasmodium falciparum
NKEKSNIN

SEQ ID NO: 3237306 - protein, 9 aa, Plasmodium falciparum
NKEKTEQHI

SEQ ID NO: 3237307 - protein, 15 aa, Plasmodium falciparum
NKEKTNNNTNVTNTG

SEQ ID NO: 3237308 - protein, 10 aa, Plasmodium falciparum
NKEKYGNGDI

SEQ ID NO: 3237309 - protein, 4 aa, Plasmodium falciparum
NKEN

SEQ ID NO: 3237310 - protein, 7 aa, Plasmodium falciparum
NKENDKL

SEQ ID NO: 3237311 - protein, 7 aa, Plasmodium falciparum
NKENDNI

SEQ ID NO: 3237312 - protein, 6 aa, Plasmodium falciparum
NKENEK

SEQ ID NO: 3237313 - protein, 9 aa, Plasmodium falciparum
NKENEKKIE

SEQ ID NO: 3237314 - protein, 8 aa, Plasmodium falciparum
NKENKEKK

SEQ ID NO: 3237315 - protein, 30 aa, Plasmodium falciparum
NKENKENNSLCSESTKHDNTINNNYTTSSV

SEQ ID NO: 3237316 - protein, 7 aa, Plasmodium falciparum
NKENKNI

SEQ ID NO: 3237317 - protein, 10 aa, Plasmodium falciparum
NKENKNKNKK

SEQ ID NO: 3237318 - protein, 12 aa, Plasmodium falciparum
NKENNDNMSTPY

SEQ ID NO: 3237319 - protein, 8 aa, Plasmodium falciparum
NKENNDQY

SEQ ID NO: 3237320 - protein, 9 aa, Plasmodium falciparum
NKENNENEL

SEQ ID NO: 3237321 - protein, 8 aa, Plasmodium falciparum
NKENNEYN

SEQ ID NO: 3237322 - protein, 7 aa, Plasmodium falciparum
NKENNQM

SEQ ID NO: 3237323 - protein, 7 aa, Plasmodium falciparum
NKENNQN

SEQ ID NO: 3237324 - protein, 5 aa, Plasmodium falciparum
NKENT

SEQ ID NO: 3237325 - protein, 16 aa, Plasmodium falciparum
NKENTKTVPPEYEYSE

SEQ ID NO: 3237326 - protein, 7 aa, Plasmodium falciparum
NKENTNL

SEQ ID NO: 3237327 - protein, 9 aa, Plasmodium falciparum
NKENTYNTY

SEQ ID NO: 3237328 - protein, 14 aa, Plasmodium falciparum
NKENVEDEKEEECV

SEQ ID NO: 3237329 - protein, 6 aa, Plasmodium falciparum
NKENYK

SEQ ID NO: 3237330 - protein, 7 aa, Plasmodium falciparum
NKENYSM

SEQ ID NO: 3237331 - protein, 7 aa, Plasmodium falciparum
NKEPDYE

SEQ ID NO: 3237332 - protein, 8 aa, Plasmodium falciparum
NKEPNKNM

SEQ ID NO: 3237333 - protein, 19 aa, Plasmodium falciparum
NKEPNKSNHNNENNNNNNL

SEQ ID NO: 3237334 - protein, 7 aa, Plasmodium falciparum
NKEPYND

SEQ ID NO: 3237335 - protein, 9 aa, Plasmodium falciparum
NKEPYTSNE

SEQ ID NO: 3237336 - protein, 4 aa, Plasmodium falciparum
NKEQ

SEQ ID NO: 3237337 - protein, 5 aa, Plasmodium falciparum
NKEQD

SEQ ID NO: 3237338 - protein, 6 aa, Plasmodium falciparum
NKEQHE

SEQ ID NO: 3237339 - protein, 14 aa, Plasmodium falciparum
NKEQIYDKNTKTFQ

SEQ ID NO: 3237340 - protein, 11 aa, Plasmodium falciparum
NKEQKNNQKIN

SEQ ID NO: 3237341 - protein, 7 aa, Plasmodium falciparum
NKEQNNY

SEQ ID NO: 3237342 - protein, 7 aa, Plasmodium falciparum
NKEQQQE

SEQ ID NO: 3237343 - protein, 14 aa, Plasmodium falciparum
NKEQTCSEGNSKNG

SEQ ID NO: 3237344 - protein, 29 aa, Plasmodium falciparum
NKEQTKTSQPVKVSSNNNNNNNNNNSIIP

SEQ ID NO: 3237345 - protein, 8 aa, Plasmodium falciparum
NKEREENK

SEQ ID NO: 3237346 - protein, 13 aa, Plasmodium falciparum
NKERERAENTNPI

SEQ ID NO: 3237347 - protein, 14 aa, Plasmodium falciparum
NKERGSSINRPGMH

SEQ ID NO: 3237348 - protein, 10 aa, Plasmodium falciparum
NKERKDTPDI

SEQ ID NO: 3237349 - protein, 16 aa, Plasmodium falciparum
NKERKNSESGNSNAQD

SEQ ID NO: 3237350 - protein, 4 aa, Plasmodium falciparum
NKES

SEQ ID NO: 3237351 - protein, 6 aa, Plasmodium falciparum
NKESDV

SEQ ID NO: 3237352 - protein, 5 aa, Plasmodium falciparum
NKESG

SEQ ID NO: 3237353 - protein, 8 aa, Plasmodium falciparum
NKESIRDD

SEQ ID NO: 3237354 - protein, 7 aa, Plasmodium falciparum
NKESKTL

SEQ ID NO: 3237355 - protein, 22 aa, Plasmodium falciparum
NKESLEKRKNDIYDEKNENREN

SEQ ID NO: 3237356 - protein, 5 aa, Plasmodium falciparum
NKESN

SEQ ID NO: 3237357 - protein, 11 aa, Plasmodium falciparum
NKESNKEDNII

SEQ ID NO: 3237358 - protein, 10 aa, Plasmodium falciparum
NKESNVESNK

SEQ ID NO: 3237359 - protein, 10 aa, Plasmodium falciparum
NKESSNDRER

SEQ ID NO: 3237360 - protein, 4 aa, Plasmodium falciparum
NKET

SEQ ID NO: 3237361 - protein, 8 aa, Plasmodium falciparum
NKETADKW

SEQ ID NO: 3237362 - protein, 17 aa, Plasmodium falciparum
NKETDGLNADSSNLGPY

SEQ ID NO: 3237363 - protein, 8 aa, Plasmodium falciparum
NKETEINA

SEQ ID NO: 3237364 - protein, 15 aa, Plasmodium falciparum
NKETENEETGKNNQI

SEQ ID NO: 3237365 - protein, 38 aa, Plasmodium falciparum
NKETKKRKGGKDNVEDSNNNNNNNNNNNSGTNKRRMSR

SEQ ID NO: 3237366 - protein, 6 aa, Plasmodium falciparum
NKETNR

SEQ ID NO: 3237367 - protein, 10 aa, Plasmodium falciparum
NKETNRDSKT

SEQ ID NO: 3237368 - protein, 15 aa, Plasmodium falciparum
NKETQSKNLSYPEQK

SEQ ID NO: 3237369 - protein, 9 aa, Plasmodium falciparum
NKETTKDTS

SEQ ID NO: 3237370 - protein, 22 aa, Plasmodium falciparum
NKETVGVTNDDSTTEVKKKTNR

SEQ ID NO: 3237371 - protein, 6 aa, Plasmodium falciparum
NKEWAT

SEQ ID NO: 3237372 - protein, 4 aa, Plasmodium falciparum
NKEY

SEQ ID NO: 3237373 - protein, 14 aa, Plasmodium falciparum
NKEYDKDSNKIDNL

SEQ ID NO: 3237374 - protein, 19 aa, Plasmodium falciparum
NKEYDNKSNATSNYSTKRK

SEQ ID NO: 3237375 - protein, 6 aa, Plasmodium falciparum
NKEYEN

SEQ ID NO: 3237376 - protein, 6 aa, Plasmodium falciparum
NKEYNE

SEQ ID NO: 3237377 - protein, 15 aa, Plasmodium falciparum
NKEYNSKGENNNNIL

SEQ ID NO: 3237378 - protein, 33 aa, Plasmodium falciparum
NKFKDDNNDNNKNYSNDTIYGNEKQKSGTTSKS

SEQ ID NO: 3237379 - protein, 5 aa, Plasmodium falciparum
NKFNT

SEQ ID NO: 3237380 - protein, 24 aa, Plasmodium falciparum
NKGDDHNNNNNNNINNSNGNVSNI

SEQ ID NO: 3237381 - protein, 13 aa, Plasmodium falciparum
NKGDDKNKEKNDL

SEQ ID NO: 3237382 - protein, 6 aa, Plasmodium falciparum
NKGDDL

SEQ ID NO: 3237383 - protein, 40 aa, Plasmodium falciparum
NKGDHQNEDNHDIKSNHNIKSNHNIKSNHNIKNDDNIKND

SEQ ID NO: 3237384 - protein, 7 aa, Plasmodium falciparum
NKGDKDI

SEQ ID NO: 3237385 - protein, 6 aa, Plasmodium falciparum
NKGDKH

SEQ ID NO: 3237386 - protein, 8 aa, Plasmodium falciparum
NKGDKRNF

SEQ ID NO: 3237387 - protein, 10 aa, Plasmodium falciparum
NKGDLASTNK

SEQ ID NO: 3237388 - protein, 8 aa, Plasmodium falciparum
NKGDLDYN

SEQ ID NO: 3237389 - protein, 5 aa, Plasmodium falciparum
NKGDV

SEQ ID NO: 3237390 - protein, 7 aa, Plasmodium falciparum
NKGEDIR

SEQ ID NO: 3237391 - protein, 5 aa, Plasmodium falciparum
NKGER

SEQ ID NO: 3237392 - protein, 12 aa, Plasmodium falciparum
NKGESKKFKRNT

SEQ ID NO: 3237393 - protein, 28 aa, Plasmodium falciparum
NKGEWTKGLSTNPNKINQIENNKSNINN

SEQ ID NO: 3237394 - protein, 17 aa, Plasmodium falciparum
NKGGDNNNINNSNNNIY

SEQ ID NO: 3237395 - protein, 9 aa, Plasmodium falciparum
NKGIKNKHP

SEQ ID NO: 3237396 - protein, 35 aa, Plasmodium falciparum
NKGISSDNNNNNNNNNNNMSSNSSTNNKSPNSDLN

SEQ ID NO: 3237397 - protein, 6 aa, Plasmodium falciparum
NKGITN

SEQ ID NO: 3237398 - protein, 16 aa, Plasmodium falciparum
NKGKKKKKKKKEKKKL

SEQ ID NO: 3237399 - protein, 6 aa, Plasmodium falciparum
NKGKNY

SEQ ID NO: 3237400 - protein, 7 aa, Plasmodium falciparum
NKGKQIR

SEQ ID NO: 3237401 - protein, 15 aa, Plasmodium falciparum
NKGKTTKKNNNNKKK

SEQ ID NO: 3237402 - protein, 21 aa, Plasmodium falciparum
NKGKYESFTTKGRKKKENVQH

SEQ ID NO: 3237403 - protein, 9 aa, Plasmodium falciparum
NKGNFQDSN

SEQ ID NO: 3237404 - protein, 6 aa, Plasmodium falciparum
NKGNIE

SEQ ID NO: 3237405 - protein, 7 aa, Plasmodium falciparum
NKGNIRG

SEQ ID NO: 3237406 - protein, 11 aa, Plasmodium falciparum
NKGNKKKKSCQ

SEQ ID NO: 3237407 - protein, 7 aa, Plasmodium falciparum
NKGNKNI

SEQ ID NO: 3237408 - protein, 8 aa, Plasmodium falciparum
NKGNKNIK

SEQ ID NO: 3237409 - protein, 26 aa, Plasmodium falciparum
NKGNNNNNNNNNNNNDNYNNNNNDNY

SEQ ID NO: 3237410 - protein, 6 aa, Plasmodium falciparum
NKGNTK

SEQ ID NO: 3237411 - protein, 9 aa, Plasmodium falciparum
NKGNTKDDY

SEQ ID NO: 3237412 - protein, 8 aa, Plasmodium falciparum
NKGNVSPE

SEQ ID NO: 3237413 - protein, 5 aa, Plasmodium falciparum
NKGQY

SEQ ID NO: 3237414 - protein, 7 aa, Plasmodium falciparum
NKGRIKS

SEQ ID NO: 3237415 - protein, 9 aa, Plasmodium falciparum
NKGRSHSTM

SEQ ID NO: 3237416 - protein, 10 aa, Plasmodium falciparum
NKGSKKSIDI

SEQ ID NO: 3237417 - protein, 7 aa, Plasmodium falciparum
NKGSNVN

SEQ ID NO: 3237418 - protein, 5 aa, Plasmodium falciparum
NKGSV

SEQ ID NO: 3237419 - protein, 10 aa, Plasmodium falciparum
NKGTNKQKKK

SEQ ID NO: 3237420 - protein, 7 aa, Plasmodium falciparum
NKGVKGH

SEQ ID NO: 3237421 - protein, 6 aa, Plasmodium falciparum
NKHANI

SEQ ID NO: 3237422 - protein, 9 aa, Plasmodium falciparum
NKHDDNLQD

SEQ ID NO: 3237423 - protein, 8 aa, Plasmodium falciparum
NKHDGVST

SEQ ID NO: 3237424 - protein, 27 aa, Plasmodium falciparum
NKHDNLSNRENDNISSQKEEKKKHSIQ

SEQ ID NO: 3237425 - protein, 18 aa, Plasmodium falciparum
NKHDSSHVDETNAPSEED

SEQ ID NO: 3237426 - protein, 9 aa, Plasmodium falciparum
NKHDYQGDH

SEQ ID NO: 3237427 - protein, 7 aa, Plasmodium falciparum
NKHEDDD

SEQ ID NO: 3237428 - protein, 7 aa, Plasmodium falciparum
NKHEEKE

SEQ ID NO: 3237429 - protein, 5 aa, Plasmodium falciparum
NKHEN

SEQ ID NO: 3237430 - protein, 28 aa, Plasmodium falciparum
NKHGNNDINKTNHHNNTTTTSSSSSNNN

SEQ ID NO: 3237431 - protein, 11 aa, Plasmodium falciparum
NKHKAKNKNSK

SEQ ID NO: 3237432 - protein, 9 aa, Plasmodium falciparum
NKHKKNSYK

SEQ ID NO: 3237433 - protein, 7 aa, Plasmodium falciparum
NKHMKNK

SEQ ID NO: 3237434 - protein, 6 aa, Plasmodium falciparum
NKHNKY

SEQ ID NO: 3237435 - protein, 16 aa, Plasmodium falciparum
NKHNKYNKNNKSLSQR

SEQ ID NO: 3237436 - protein, 7 aa, Plasmodium falciparum
NKHNLND

SEQ ID NO: 3237437 - protein, 25 aa, Plasmodium falciparum
NKHNNNNNNNNNNNNNNNNNNNNNN

SEQ ID NO: 3237438 - protein, 6 aa, Plasmodium falciparum
NKHNNS

SEQ ID NO: 3237439 - protein, 7 aa, Plasmodium falciparum
NKHNTNY

SEQ ID NO: 3237440 - protein, 13 aa, Plasmodium falciparum
NKHSINERENKEN

SEQ ID NO: 3237441 - protein, 5 aa, Plasmodium falciparum
NKHSL

SEQ ID NO: 3237442 - protein, 5 aa, Plasmodium falciparum
NKHSY

SEQ ID NO: 3237443 - protein, 4 aa, Plasmodium falciparum
NKHT

SEQ ID NO: 3237444 - protein, 5 aa, Plasmodium falciparum
NKHTE

SEQ ID NO: 3237445 - protein, 8 aa, Plasmodium falciparum
NKHTEAVK

SEQ ID NO: 3237446 - protein, 7 aa, Plasmodium falciparum
NKHTNNN

SEQ ID NO: 3237447 - protein, 27 aa, Plasmodium falciparum
NKHYSSTNDYNNNDNNDDIKNNRDDIN

SEQ ID NO: 3237448 - protein, 4 aa, Plasmodium falciparum
NKID

SEQ ID NO: 3237449 - protein, 15 aa, Plasmodium falciparum
NKIDEDKKNDNKNFQ

SEQ ID NO: 3237450 - protein, 9 aa, Plasmodium falciparum
NKIDKDGNH

SEQ ID NO: 3237451 - protein, 6 aa, Plasmodium falciparum
NKIDNV

SEQ ID NO: 3237452 - protein, 7 aa, Plasmodium falciparum
NKIEDDI

SEQ ID NO: 3237453 - protein, 8 aa, Plasmodium falciparum
NKIEDDIN

SEQ ID NO: 3237454 - protein, 16 aa, Plasmodium falciparum
NKIEEHKKKEDGEEPF

SEQ ID NO: 3237455 - protein, 12 aa, Plasmodium falciparum
NKIEKKENTYNK

SEQ ID NO: 3237456 - protein, 9 aa, Plasmodium falciparum
NKIEKNNKL

SEQ ID NO: 3237457 - protein, 7 aa, Plasmodium falciparum
NKIEKNT

SEQ ID NO: 3237458 - protein, 10 aa, Plasmodium falciparum
NKIENSDSYL

SEQ ID NO: 3237459 - protein, 11 aa, Plasmodium falciparum
NKIGMKKSNKI

SEQ ID NO: 3237460 - protein, 6 aa, Plasmodium falciparum
NKIHKK

SEQ ID NO: 3237461 - protein, 5 aa, Plasmodium falciparum
NKIHN

SEQ ID NO: 3237462 - protein, 8 aa, Plasmodium falciparum
NKIKEDKN

SEQ ID NO: 3237463 - protein, 6 aa, Plasmodium falciparum
NKIKEK

SEQ ID NO: 3237464 - protein, 8 aa, Plasmodium falciparum
NKIKEKRK

SEQ ID NO: 3237465 - protein, 12 aa, Plasmodium falciparum
NKIKHENKHEEN

SEQ ID NO: 3237466 - protein, 9 aa, Plasmodium falciparum
NKIKKSTTI

SEQ ID NO: 3237467 - protein, 4 aa, Plasmodium falciparum
NKIN

SEQ ID NO: 3237468 - protein, 5 aa, Plasmodium falciparum
NKIND

SEQ ID NO: 3237469 - protein, 16 aa, Plasmodium falciparum
NKINDQDKLKKRETSQ

SEQ ID NO: 3237470 - protein, 10 aa, Plasmodium falciparum
NKINDTTKNN

SEQ ID NO: 3237471 - protein, 12 aa, Plasmodium falciparum
NKINEEQTKAIN

SEQ ID NO: 3237472 - protein, 7 aa, Plasmodium falciparum
NKINEKL

SEQ ID NO: 3237473 - protein, 9 aa, Plasmodium falciparum
NKINESKET

SEQ ID NO: 3237474 - protein, 8 aa, Plasmodium falciparum
NKINGDQN

SEQ ID NO: 3237475 - protein, 9 aa, Plasmodium falciparum
NKINKDKKK

SEQ ID NO: 3237476 - protein, 21 aa, Plasmodium falciparum
NKINKKKKKINNNNNKYKTNE

SEQ ID NO: 3237477 - protein, 6 aa, Plasmodium falciparum
NKINKN

SEQ ID NO: 3237478 - protein, 10 aa, Plasmodium falciparum
NKINNKENNN

SEQ ID NO: 3237479 - protein, 11 aa, Plasmodium falciparum
NKINNNNNDNI

SEQ ID NO: 3237480 - protein, 11 aa, Plasmodium falciparum
NKINSSSTYTH

SEQ ID NO: 3237481 - protein, 13 aa, Plasmodium falciparum
NKINTNKDHENDE

SEQ ID NO: 3237482 - protein, 25 aa, Plasmodium falciparum
NKINTTSTHNNNNNNNNNSNSVPSE

SEQ ID NO: 3237483 - protein, 12 aa, Plasmodium falciparum
NKIPQNERQEKD

SEQ ID NO: 3237484 - protein, 8 aa, Plasmodium falciparum
NKIQEQNE

SEQ ID NO: 3237485 - protein, 14 aa, Plasmodium falciparum
NKIQKEEKKKQNNY

SEQ ID NO: 3237486 - protein, 8 aa, Plasmodium falciparum
NKIQNDNE

SEQ ID NO: 3237487 - protein, 4 aa, Plasmodium falciparum
NKIS

SEQ ID NO: 3237488 - protein, 31 aa, Plasmodium falciparum
NKISDDNKNKDNNSSDKYDCNDDDNNNTSNS

SEQ ID NO: 3237489 - protein, 7 aa, Plasmodium falciparum
NKISENY

SEQ ID NO: 3237490 - protein, 6 aa, Plasmodium falciparum
NKISGS

SEQ ID NO: 3237491 - protein, 9 aa, Plasmodium falciparum
NKISTSKEH

SEQ ID NO: 3237492 - protein, 4 aa, Plasmodium falciparum
NKIT

SEQ ID NO: 3237493 - protein, 10 aa, Plasmodium falciparum
NKITNKNNKK

SEQ ID NO: 3237494 - protein, 20 aa, Plasmodium falciparum
NKKATDPIDGCNQKSDANWD

SEQ ID NO: 3237495 - protein, 7 aa, Plasmodium falciparum
NKKCSPC

SEQ ID NO: 3237496 - protein, 8 aa, Plasmodium falciparum
NKKDDKMH

SEQ ID NO: 3237497 - protein, 8 aa, Plasmodium falciparum
NKKDDKTC

SEQ ID NO: 3237498 - protein, 6 aa, Plasmodium falciparum
NKKDDS

SEQ ID NO: 3237499 - protein, 7 aa, Plasmodium falciparum
NKKDDTF

SEQ ID NO: 3237500 - protein, 7 aa, Plasmodium falciparum
NKKDEEN

SEQ ID NO: 3237501 - protein, 44 aa, Plasmodium falciparum
NKKDEENAKRVDKKKKKIKKEKKETSKRNSMNGLEKGDDDNCDG

SEQ ID NO: 3237502 - protein, 10 aa, Plasmodium falciparum
NKKDETSHNY

SEQ ID NO: 3237503 - protein, 7 aa, Plasmodium falciparum
NKKDEYY

SEQ ID NO: 3237504 - protein, 8 aa, Plasmodium falciparum
NKKDGNII

SEQ ID NO: 3237505 - protein, 85 aa, Plasmodium falciparum
NKKDHPTEKSAHEKKNATLLGSKRASKHQLNENASDGITKKDFSQDERDEENKEDDEDKDDDEDDDKDDDEDDDEDDDEDEDDYE

SEQ ID NO: 3237506 - protein, 72 aa, Plasmodium falciparum
NKKDKKFDEGENKTFDAGENKTFDAGENKTFDAGENKTFDAGENKTFDAGENKTFDAGENKTFDAGENKTFD

SEQ ID NO: 3237507 - protein, 13 aa, Plasmodium falciparum
NKKDLKNLSTSTN

SEQ ID NO: 3237508 - protein, 8 aa, Plasmodium falciparum
NKKDNTQT

SEQ ID NO: 3237509 - protein, 6 aa, Plasmodium falciparum
NKKDRT

SEQ ID NO: 3237510 - protein, 7 aa, Plasmodium falciparum
NKKDTEL

SEQ ID NO: 3237511 - protein, 8 aa, Plasmodium falciparum
NKKDVSIN

SEQ ID NO: 3237512 - protein, 5 aa, Plasmodium falciparum
NKKEE

SEQ ID NO: 3237513 - protein, 9 aa, Plasmodium falciparum
NKKEEEKEE

SEQ ID NO: 3237514 - protein, 8 aa, Plasmodium falciparum
NKKEEETC

SEQ ID NO: 3237515 - protein, 10 aa, Plasmodium falciparum
NKKEEGDNDM

SEQ ID NO: 3237516 - protein, 7 aa, Plasmodium falciparum
NKKEENH

SEQ ID NO: 3237517 - protein, 35 aa, Plasmodium falciparum
NKKEEYDSQKGKFDVEKTEKKQGYEDYSEKQASEY

SEQ ID NO: 3237518 - protein, 9 aa, Plasmodium falciparum
NKKEEYPNN

SEQ ID NO: 3237519 - protein, 8 aa, Plasmodium falciparum
NKKEGIDF

SEQ ID NO: 3237520 - protein, 8 aa, Plasmodium falciparum
NKKEIENK

SEQ ID NO: 3237521 - protein, 18 aa, Plasmodium falciparum
NKKEKPERSSQKEPDEIQ

SEQ ID NO: 3237522 - protein, 9 aa, Plasmodium falciparum
NKKEKQNDD

SEQ ID NO: 3237523 - protein, 23 aa, Plasmodium falciparum
NKKENDKKYNKSVNKNSCKSKNS

SEQ ID NO: 3237524 - protein, 17 aa, Plasmodium falciparum
NKKENIDKEEENNIDDK

SEQ ID NO: 3237525 - protein, 34 aa, Plasmodium falciparum
NKKENISNGDINQASNENENKITNGDDNKIQHNN

SEQ ID NO: 3237526 - protein, 11 aa, Plasmodium falciparum
NKKENKCSSSL

SEQ ID NO: 3237527 - protein, 8 aa, Plasmodium falciparum
NKKENKDI

SEQ ID NO: 3237528 - protein, 12 aa, Plasmodium falciparum
NKKENKEKEDNH

SEQ ID NO: 3237529 - protein, 7 aa, Plasmodium falciparum
NKKENNN

SEQ ID NO: 3237530 - protein, 21 aa, Plasmodium falciparum
NKKENNNNNNRTISNTEEKYN

SEQ ID NO: 3237531 - protein, 23 aa, Plasmodium falciparum
NKKEPKENDDKKKINYNSDGDHD

SEQ ID NO: 3237532 - protein, 7 aa, Plasmodium falciparum
NKKEQNI

SEQ ID NO: 3237533 - protein, 11 aa, Plasmodium falciparum
NKKEQPENNQM

SEQ ID NO: 3237534 - protein, 7 aa, Plasmodium falciparum
NKKERAE

SEQ ID NO: 3237535 - protein, 8 aa, Plasmodium falciparum
NKKESGFN

SEQ ID NO: 3237536 - protein, 6 aa, Plasmodium falciparum
NKKESI

SEQ ID NO: 3237537 - protein, 12 aa, Plasmodium falciparum
NKKETNKNNNQV

SEQ ID NO: 3237538 - protein, 9 aa, Plasmodium falciparum
NKKETNKNR

SEQ ID NO: 3237539 - protein, 9 aa, Plasmodium falciparum
NKKEYGNGY

SEQ ID NO: 3237540 - protein, 7 aa, Plasmodium falciparum
NKKGDVN

SEQ ID NO: 3237541 - protein, 22 aa, Plasmodium falciparum
NKKGEENKNTNNQYNDISTSTH

SEQ ID NO: 3237542 - protein, 27 aa, Plasmodium falciparum
NKKGEKGKDNEEKRKGKEEKEDEHSEE

SEQ ID NO: 3237543 - protein, 10 aa, Plasmodium falciparum
NKKGEQNPNN

SEQ ID NO: 3237544 - protein, 8 aa, Plasmodium falciparum
NKKGERYY

SEQ ID NO: 3237545 - protein, 11 aa, Plasmodium falciparum
NKKGNSKERHR

SEQ ID NO: 3237546 - protein, 9 aa, Plasmodium falciparum
NKKGNSSKL

SEQ ID NO: 3237547 - protein, 58 aa, Plasmodium falciparum
NKKGQNINDENINDEKNDTDNNAKKKRDNISNNNNKVDIDKDNAKDISKQNNDTSLNE

SEQ ID NO: 3237548 - protein, 8 aa, Plasmodium falciparum
NKKGSNIS

SEQ ID NO: 3237549 - protein, 9 aa, Plasmodium falciparum
NKKGSNMKK

SEQ ID NO: 3237550 - protein, 19 aa, Plasmodium falciparum
NKKHKTKNYKYNNEHNTEY

SEQ ID NO: 3237551 - protein, 7 aa, Plasmodium falciparum
NKKHNNK

SEQ ID NO: 3237552 - protein, 11 aa, Plasmodium falciparum
NKKHNRHNNKR

SEQ ID NO: 3237553 - protein, 8 aa, Plasmodium falciparum
NKKIGDDE

SEQ ID NO: 3237554 - protein, 5 aa, Plasmodium falciparum
NKKIH

SEQ ID NO: 3237555 - protein, 7 aa, Plasmodium falciparum
NKKIKDV

SEQ ID NO: 3237556 - protein, 9 aa, Plasmodium falciparum
NKKINKSKV

SEQ ID NO: 3237557 - protein, 7 aa, Plasmodium falciparum
NKKINND

SEQ ID NO: 3237558 - protein, 6 aa, Plasmodium falciparum
NKKINT

SEQ ID NO: 3237559 - protein, 9 aa, Plasmodium falciparum
NKKIPNKKN

SEQ ID NO: 3237560 - protein, 30 aa, Plasmodium falciparum
NKKIPSNNNTPGNNNNLGNNNNLGNTNNLG

SEQ ID NO: 3237561 - protein, 8 aa, Plasmodium falciparum
NKKIQEKK

SEQ ID NO: 3237562 - protein, 5 aa, Plasmodium falciparum
NKKIT

SEQ ID NO: 3237563 - protein, 17 aa, Plasmodium falciparum
NKKITNKNLTNRKKRNS

SEQ ID NO: 3237564 - protein, 4 aa, Plasmodium falciparum
NKKK

SEQ ID NO: 3237565 - protein, 9 aa, Plasmodium falciparum
NKKKDEYKC

SEQ ID NO: 3237566 - protein, 18 aa, Plasmodium falciparum
NKKKDNKNTNDENNENDN

SEQ ID NO: 3237567 - protein, 6 aa, Plasmodium falciparum
NKKKEE

SEQ ID NO: 3237568 - protein, 6 aa, Plasmodium falciparum
NKKKEH

SEQ ID NO: 3237569 - protein, 9 aa, Plasmodium falciparum
NKKKEINNN

SEQ ID NO: 3237570 - protein, 11 aa, Plasmodium falciparum
NKKKEKKNIRN

SEQ ID NO: 3237571 - protein, 8 aa, Plasmodium falciparum
NKKKGKIR

SEQ ID NO: 3237572 - protein, 8 aa, Plasmodium falciparum
NKKKGNHK

SEQ ID NO: 3237573 - protein, 24 aa, Plasmodium falciparum
NKKKHMNDKYNKNKHSTSNNINEN

SEQ ID NO: 3237574 - protein, 12 aa, Plasmodium falciparum
NKKKHTSVQKDK

SEQ ID NO: 3237575 - protein, 5 aa, Plasmodium falciparum
NKKKK

SEQ ID NO: 3237576 - protein, 12 aa, Plasmodium falciparum
NKKKKKKDIPLS

SEQ ID NO: 3237577 - protein, 53 aa, Plasmodium falciparum
NKKKKKKKGKRKNQDKGQEKNQDKGQEKCHDKGQEKYHDKGQEKYHDKEQEKT

SEQ ID NO: 3237578 - protein, 16 aa, Plasmodium falciparum
NKKKKKKKLKRKQKGK

SEQ ID NO: 3237579 - protein, 9 aa, Plasmodium falciparum
NKKKKKKKN

SEQ ID NO: 3237580 - protein, 8 aa, Plasmodium falciparum
NKKKKKLY

SEQ ID NO: 3237581 - protein, 10 aa, Plasmodium falciparum
NKKKKKMYDM

SEQ ID NO: 3237582 - protein, 9 aa, Plasmodium falciparum
NKKKKKNDH

SEQ ID NO: 3237583 - protein, 9 aa, Plasmodium falciparum
NKKKKKNKY

SEQ ID NO: 3237584 - protein, 32 aa, Plasmodium falciparum
NKKKKKNNNNNNSNNNNNKNKNKQNTNKKNNK

SEQ ID NO: 3237585 - protein, 8 aa, Plasmodium falciparum
NKKKKNAA

SEQ ID NO: 3237586 - protein, 9 aa, Plasmodium falciparum
NKKKKNGYK

SEQ ID NO: 3237587 - protein, 26 aa, Plasmodium falciparum
NKKKKNTNTQENLQSTQNVSLNQNGT

SEQ ID NO: 3237588 - protein, 9 aa, Plasmodium falciparum
NKKKKQKNV

SEQ ID NO: 3237589 - protein, 19 aa, Plasmodium falciparum
NKKKKSNSPLDVKVVGKKN

SEQ ID NO: 3237590 - protein, 16 aa, Plasmodium falciparum
NKKKKSSDSIKDDNTS

SEQ ID NO: 3237591 - protein, 9 aa, Plasmodium falciparum
NKKKNCNSP

SEQ ID NO: 3237592 - protein, 9 aa, Plasmodium falciparum
NKKKNDGIN

SEQ ID NO: 3237593 - protein, 7 aa, Plasmodium falciparum
NKKKNIK

SEQ ID NO: 3237594 - protein, 40 aa, Plasmodium falciparum
NKKKNIKENKDKEGEDQEDTNKINVEDEEKKKKNMTTNNT

SEQ ID NO: 3237595 - protein, 7 aa, Plasmodium falciparum
NKKKNIS

SEQ ID NO: 3237596 - protein, 7 aa, Plasmodium falciparum
NKKKNKK

SEQ ID NO: 3237597 - protein, 9 aa, Plasmodium falciparum
NKKKNKSKQ

SEQ ID NO: 3237598 - protein, 12 aa, Plasmodium falciparum
NKKKNVKREPNI

SEQ ID NO: 3237599 - protein, 7 aa, Plasmodium falciparum
NKKKPIE

SEQ ID NO: 3237600 - protein, 6 aa, Plasmodium falciparum
NKKKQE

SEQ ID NO: 3237601 - protein, 7 aa, Plasmodium falciparum
NKKKQGG

SEQ ID NO: 3237602 - protein, 13 aa, Plasmodium falciparum
NKKKQKKSKENYS

SEQ ID NO: 3237603 - protein, 5 aa, Plasmodium falciparum
NKKKR

SEQ ID NO: 3237604 - protein, 10 aa, Plasmodium falciparum
NKKKRRNKKL

SEQ ID NO: 3237605 - protein, 5 aa, Plasmodium falciparum
NKKKS

SEQ ID NO: 3237606 - protein, 10 aa, Plasmodium falciparum
NKKKSNRKQM

SEQ ID NO: 3237607 - protein, 7 aa, Plasmodium falciparum
NKKKTCN

SEQ ID NO: 3237608 - protein, 11 aa, Plasmodium falciparum
NKKKTDEESFK

SEQ ID NO: 3237609 - protein, 6 aa, Plasmodium falciparum
NKKKYE

SEQ ID NO: 3237610 - protein, 6 aa, Plasmodium falciparum
NKKKYN

SEQ ID NO: 3237611 - protein, 4 aa, Plasmodium falciparum
NKKL

SEQ ID NO: 3237612 - protein, 25 aa, Plasmodium falciparum
NKKLKDVKTNCRGDSGTDRYCSGNG

SEQ ID NO: 3237613 - protein, 5 aa, Plasmodium falciparum
NKKLN

SEQ ID NO: 3237614 - protein, 7 aa, Plasmodium falciparum
NKKLNDV

SEQ ID NO: 3237615 - protein, 10 aa, Plasmodium falciparum
NKKLNKNKNN

SEQ ID NO: 3237616 - protein, 15 aa, Plasmodium falciparum
NKKMKKKLQYIKLLE

SEQ ID NO: 3237617 - protein, 4 aa, Plasmodium falciparum
NKKN

SEQ ID NO: 3237618 - protein, 33 aa, Plasmodium falciparum
NKKNDDNNKNDDNNKNDDNNKNENNNDSNNIDK

SEQ ID NO: 3237619 - protein, 15 aa, Plasmodium falciparum
NKKNDEDMNKNKKEM

SEQ ID NO: 3237620 - protein, 8 aa, Plasmodium falciparum
NKKNDNCN

SEQ ID NO: 3237621 - protein, 10 aa, Plasmodium falciparum
NKKNDYNNNN

SEQ ID NO: 3237622 - protein, 6 aa, Plasmodium falciparum
NKKNEN

SEQ ID NO: 3237623 - protein, 8 aa, Plasmodium falciparum
NKKNGHDV

SEQ ID NO: 3237624 - protein, 7 aa, Plasmodium falciparum
NKKNHNK

SEQ ID NO: 3237625 - protein, 23 aa, Plasmodium falciparum
NKKNHNPYGKDKYNQLHKSKNTK

SEQ ID NO: 3237626 - protein, 21 aa, Plasmodium falciparum
NKKNIKDSYEEDKNSNNPQDN

SEQ ID NO: 3237627 - protein, 7 aa, Plasmodium falciparum
NKKNISD

SEQ ID NO: 3237628 - protein, 6 aa, Plasmodium falciparum
NKKNKD

SEQ ID NO: 3237629 - protein, 7 aa, Plasmodium falciparum
NKKNKEI

SEQ ID NO: 3237630 - protein, 8 aa, Plasmodium falciparum
NKKNKEKN

SEQ ID NO: 3237631 - protein, 10 aa, Plasmodium falciparum
NKKNKEKQIN

SEQ ID NO: 3237632 - protein, 12 aa, Plasmodium falciparum
NKKNKHKENDVS

SEQ ID NO: 3237633 - protein, 17 aa, Plasmodium falciparum
NKKNKINKNENDRLEEN

SEQ ID NO: 3237634 - protein, 8 aa, Plasmodium falciparum
NKKNKKDI

SEQ ID NO: 3237635 - protein, 13 aa, Plasmodium falciparum
NKKNKKKMENEKG

SEQ ID NO: 3237636 - protein, 8 aa, Plasmodium falciparum
NKKNKKNK

SEQ ID NO: 3237637 - protein, 7 aa, Plasmodium falciparum
NKKNKMK

SEQ ID NO: 3237638 - protein, 7 aa, Plasmodium falciparum
NKKNKNK

SEQ ID NO: 3237639 - protein, 7 aa, Plasmodium falciparum
NKKNKNM

SEQ ID NO: 3237640 - protein, 14 aa, Plasmodium falciparum
NKKNKNNDKDDGID

SEQ ID NO: 3237641 - protein, 24 aa, Plasmodium falciparum
NKKNKRKKKKKEKKKEKERKKKKI

SEQ ID NO: 3237642 - protein, 61 aa, Plasmodium falciparum
NKKNKSKNEGDDSYNESNQGEDNEDNYEKKKNKRYDMDNDEKEKENDDEEDNDNNNNNSYS

SEQ ID NO: 3237643 - protein, 8 aa, Plasmodium falciparum
NKKNKTNM

SEQ ID NO: 3237644 - protein, 7 aa, Plasmodium falciparum
NKKNMKN

SEQ ID NO: 3237645 - protein, 8 aa, Plasmodium falciparum
NKKNMNDK

SEQ ID NO: 3237646 - protein, 9 aa, Plasmodium falciparum
NKKNNDKKK

SEQ ID NO: 3237647 - protein, 6 aa, Plasmodium falciparum
NKKNNH

SEQ ID NO: 3237648 - protein, 12 aa, Plasmodium falciparum
NKKNNINEAPIN

SEQ ID NO: 3237649 - protein, 11 aa, Plasmodium falciparum
NKKNNINEKNN

SEQ ID NO: 3237650 - protein, 27 aa, Plasmodium falciparum
NKKNNINSNSNSNNNNNNNSNNNKYDD

SEQ ID NO: 3237651 - protein, 23 aa, Plasmodium falciparum
NKKNNNNKKDNINNNNNNNNNNH

SEQ ID NO: 3237652 - protein, 18 aa, Plasmodium falciparum
NKKNNTYDGKINKNKEQV

SEQ ID NO: 3237653 - protein, 8 aa, Plasmodium falciparum
NKKNPACP

SEQ ID NO: 3237654 - protein, 15 aa, Plasmodium falciparum
NKKNPLEDDPLNKKG

SEQ ID NO: 3237655 - protein, 22 aa, Plasmodium falciparum
NKKNRKEKENNEIHEENKYDDK

SEQ ID NO: 3237656 - protein, 5 aa, Plasmodium falciparum
NKKNS

SEQ ID NO: 3237657 - protein, 8 aa, Plasmodium falciparum
NKKNSDTF

SEQ ID NO: 3237658 - protein, 11 aa, Plasmodium falciparum
NKKNTSSEDTI

SEQ ID NO: 3237659 - protein, 5 aa, Plasmodium falciparum
NKKNV

SEQ ID NO: 3237660 - protein, 39 aa, Plasmodium falciparum
NKKNVSEDLENDDNKSEEETTIKNEHSKNNNNSKNNINN

SEQ ID NO: 3237661 - protein, 5 aa, Plasmodium falciparum
NKKNY

SEQ ID NO: 3237662 - protein, 9 aa, Plasmodium falciparum
NKKPKGRIQ

SEQ ID NO: 3237663 - protein, 16 aa, Plasmodium falciparum
NKKPPSKSSDYDDNTN

SEQ ID NO: 3237664 - protein, 7 aa, Plasmodium falciparum
NKKPPYY

SEQ ID NO: 3237665 - protein, 9 aa, Plasmodium falciparum
NKKQAKKNY

SEQ ID NO: 3237666 - protein, 6 aa, Plasmodium falciparum
NKKQEY

SEQ ID NO: 3237667 - protein, 10 aa, Plasmodium falciparum
NKKQKDTHND

SEQ ID NO: 3237668 - protein, 9 aa, Plasmodium falciparum
NKKQKKKGV

SEQ ID NO: 3237669 - protein, 11 aa, Plasmodium falciparum
NKKQKKNGTFS

SEQ ID NO: 3237670 - protein, 9 aa, Plasmodium falciparum
NKKQKKNYS

SEQ ID NO: 3237671 - protein, 55 aa, Plasmodium falciparum
NKKQNNNNNMNDDDDDNNNMNDDDDDNNNMNDDDDDNNNMNDDDNNNDNNNDKKK

SEQ ID NO: 3237672 - protein, 8 aa, Plasmodium falciparum
NKKQYEPQ

SEQ ID NO: 3237673 - protein, 4 aa, Plasmodium falciparum
NKKR

SEQ ID NO: 3237674 - protein, 6 aa, Plasmodium falciparum
NKKRDR

SEQ ID NO: 3237675 - protein, 8 aa, Plasmodium falciparum
NKKREKIN

SEQ ID NO: 3237676 - protein, 10 aa, Plasmodium falciparum
NKKRKALNNN

SEQ ID NO: 3237677 - protein, 14 aa, Plasmodium falciparum
NKKRKKETSYSKNE

SEQ ID NO: 3237678 - protein, 7 aa, Plasmodium falciparum
NKKRKNK

SEQ ID NO: 3237679 - protein, 9 aa, Plasmodium falciparum
NKKRKSITS

SEQ ID NO: 3237680 - protein, 10 aa, Plasmodium falciparum
NKKRKSNATM

SEQ ID NO: 3237681 - protein, 6 aa, Plasmodium falciparum
NKKRNI

SEQ ID NO: 3237682 - protein, 4 aa, Plasmodium falciparum
NKKS

SEQ ID NO: 3237683 - protein, 17 aa, Plasmodium falciparum
NKKSEENVNNNNGSDKC

SEQ ID NO: 3237684 - protein, 9 aa, Plasmodium falciparum
NKKSELKED

SEQ ID NO: 3237685 - protein, 10 aa, Plasmodium falciparum
NKKSETSDIN

SEQ ID NO: 3237686 - protein, 9 aa, Plasmodium falciparum
NKKSGSDKY

SEQ ID NO: 3237687 - protein, 8 aa, Plasmodium falciparum
NKKSIDSK

SEQ ID NO: 3237688 - protein, 8 aa, Plasmodium falciparum
NKKSKKKK

SEQ ID NO: 3237689 - protein, 13 aa, Plasmodium falciparum
NKKSKNRSTSYEQ

SEQ ID NO: 3237690 - protein, 14 aa, Plasmodium falciparum
NKKSLRENSGSMRN

SEQ ID NO: 3237691 - protein, 12 aa, Plasmodium falciparum
NKKSNNNYKGQD

SEQ ID NO: 3237692 - protein, 7 aa, Plasmodium falciparum
NKKSSIN

SEQ ID NO: 3237693 - protein, 8 aa, Plasmodium falciparum
NKKSVAHD

SEQ ID NO: 3237694 - protein, 7 aa, Plasmodium falciparum
NKKSYDK

SEQ ID NO: 3237695 - protein, 6 aa, Plasmodium falciparum
NKKSYR

SEQ ID NO: 3237696 - protein, 7 aa, Plasmodium falciparum
NKKTADE

SEQ ID NO: 3237697 - protein, 5 aa, Plasmodium falciparum
NKKTE

SEQ ID NO: 3237698 - protein, 27 aa, Plasmodium falciparum
NKKTEEKKEKKEEEEEIKNKKKTIKNS

SEQ ID NO: 3237699 - protein, 10 aa, Plasmodium falciparum
NKKTKDNVTS

SEQ ID NO: 3237700 - protein, 6 aa, Plasmodium falciparum
NKKTKK

SEQ ID NO: 3237701 - protein, 10 aa, Plasmodium falciparum
NKKTKNKKSE

SEQ ID NO: 3237702 - protein, 9 aa, Plasmodium falciparum
NKKTQTHEI

SEQ ID NO: 3237703 - protein, 10 aa, Plasmodium falciparum
NKKTSDTADE

SEQ ID NO: 3237704 - protein, 7 aa, Plasmodium falciparum
NKKTTQE

SEQ ID NO: 3237705 - protein, 7 aa, Plasmodium falciparum
NKKVENV

SEQ ID NO: 3237706 - protein, 19 aa, Plasmodium falciparum
NKKVSRKKNHKEENRTQQN

SEQ ID NO: 3237707 - protein, 4 aa, Plasmodium falciparum
NKKW

SEQ ID NO: 3237708 - protein, 5 aa, Plasmodium falciparum
NKKYA

SEQ ID NO: 3237709 - protein, 10 aa, Plasmodium falciparum
NKKYDENSLK

SEQ ID NO: 3237710 - protein, 10 aa, Plasmodium falciparum
NKKYETSEEM

SEQ ID NO: 3237711 - protein, 29 aa, Plasmodium falciparum
NKKYKDKKQQEIDQENEEKEEKEEKEEHE

SEQ ID NO: 3237712 - protein, 10 aa, Plasmodium falciparum
NKKYKESETY

SEQ ID NO: 3237713 - protein, 12 aa, Plasmodium falciparum
NKKYKNNDERIN

SEQ ID NO: 3237714 - protein, 9 aa, Plasmodium falciparum
NKKYNNDNI

SEQ ID NO: 3237715 - protein, 7 aa, Plasmodium falciparum
NKKYNYK

SEQ ID NO: 3237716 - protein, 5 aa, Plasmodium falciparum
NKKYP

SEQ ID NO: 3237717 - protein, 8 aa, Plasmodium falciparum
NKKYTVEG

SEQ ID NO: 3237718 - protein, 8 aa, Plasmodium falciparum
NKKYVTNN

SEQ ID NO: 3237719 - protein, 4 aa, Plasmodium falciparum
NKLD

SEQ ID NO: 3237720 - protein, 9 aa, Plasmodium falciparum
NKLDEEKNE

SEQ ID NO: 3237721 - protein, 22 aa, Plasmodium falciparum
NKLDEEYKNSYEKYKSYLLGNK

SEQ ID NO: 3237722 - protein, 5 aa, Plasmodium falciparum
NKLDR

SEQ ID NO: 3237723 - protein, 100 aa, Plasmodium falciparum
NKLDTSKVENKDNDENKDDNDENKDDNDENKDDNDDNKDNDDNMDDDNPNEVKECNKKKKKNKKKKKKKKKIKDNPNGRKEKDKLDDLTEEDKIKSNGCY

SEQ ID NO: 3237724 - protein, 7 aa, Plasmodium falciparum
NKLDTSN

SEQ ID NO: 3237725 - protein, 12 aa, Plasmodium falciparum
NKLDTSNKNDHH

SEQ ID NO: 3237726 - protein, 6 aa, Plasmodium falciparum
NKLEDG

SEQ ID NO: 3237727 - protein, 13 aa, Plasmodium falciparum
NKLENEEDNNNND

SEQ ID NO: 3237728 - protein, 6 aa, Plasmodium falciparum
NKLENM

SEQ ID NO: 3237729 - protein, 9 aa, Plasmodium falciparum
NKLGNNRKN

SEQ ID NO: 3237730 - protein, 14 aa, Plasmodium falciparum
NKLKEKSKGLARKD

SEQ ID NO: 3237731 - protein, 12 aa, Plasmodium falciparum
NKLKKGSLLSPK

SEQ ID NO: 3237732 - protein, 21 aa, Plasmodium falciparum
NKLKNEKSPLSPNKQKKKKKN

SEQ ID NO: 3237733 - protein, 4 aa, Plasmodium falciparum
NKLN

SEQ ID NO: 3237734 - protein, 7 aa, Plasmodium falciparum
NKLNDNE

SEQ ID NO: 3237735 - protein, 5 aa, Plasmodium falciparum
NKLNK

SEQ ID NO: 3237736 - protein, 6 aa, Plasmodium falciparum
NKLPRS

SEQ ID NO: 3237737 - protein, 4 aa, Plasmodium falciparum
NKLQ

SEQ ID NO: 3237738 - protein, 10 aa, Plasmodium falciparum
NKLQKRKTSI

SEQ ID NO: 3237739 - protein, 6 aa, Plasmodium falciparum
NKLSKK

SEQ ID NO: 3237740 - protein, 7 aa, Plasmodium falciparum
NKLSQED

SEQ ID NO: 3237741 - protein, 6 aa, Plasmodium falciparum
NKLSSN

SEQ ID NO: 3237742 - protein, 16 aa, Plasmodium falciparum
NKLTEQKNGNKNTYDT

SEQ ID NO: 3237743 - protein, 6 aa, Plasmodium falciparum
NKMDEE

SEQ ID NO: 3237744 - protein, 11 aa, Plasmodium falciparum
NKMDTNKNINE

SEQ ID NO: 3237745 - protein, 12 aa, Plasmodium falciparum
NKMEGISSSSDS

SEQ ID NO: 3237746 - protein, 39 aa, Plasmodium falciparum
NKMGNYDDYDGGYTTTNNNNKNKNNNNENNNNDNNDNIY

SEQ ID NO: 3237747 - protein, 20 aa, Plasmodium falciparum
NKMGRTRKYSNNKEWIFGNP

SEQ ID NO: 3237748 - protein, 9 aa, Plasmodium falciparum
NKMKENKHY

SEQ ID NO: 3237749 - protein, 12 aa, Plasmodium falciparum
NKMKKKKQNKEK

SEQ ID NO: 3237750 - protein, 5 aa, Plasmodium falciparum
NKMND

SEQ ID NO: 3237751 - protein, 31 aa, Plasmodium falciparum
NKMNKESNEMNKEANEMNKDEENEKYENHNY

SEQ ID NO: 3237752 - protein, 9 aa, Plasmodium falciparum
NKMNNKSNK

SEQ ID NO: 3237753 - protein, 8 aa, Plasmodium falciparum
NKMNNNNH

SEQ ID NO: 3237754 - protein, 5 aa, Plasmodium falciparum
NKMNR

SEQ ID NO: 3237755 - protein, 7 aa, Plasmodium falciparum
NKMNTTE

SEQ ID NO: 3237756 - protein, 9 aa, Plasmodium falciparum
NKMPEGKKP

SEQ ID NO: 3237757 - protein, 24 aa, Plasmodium falciparum
NKMYTTKNNDTSNNNNNNNYYNNN

SEQ ID NO: 3237758 - protein, 10 aa, Plasmodium falciparum
NKNAEEKQRL

SEQ ID NO: 3237759 - protein, 7 aa, Plasmodium falciparum
NKNAGVK

SEQ ID NO: 3237760 - protein, 12 aa, Plasmodium falciparum
NKNAPQKNSLQS

SEQ ID NO: 3237761 - protein, 7 aa, Plasmodium falciparum
NKNCGKK

SEQ ID NO: 3237762 - protein, 6 aa, Plasmodium falciparum
NKNCKN

SEQ ID NO: 3237763 - protein, 13 aa, Plasmodium falciparum
NKNCKSNNTSTIN

SEQ ID NO: 3237764 - protein, 20 aa, Plasmodium falciparum
NKNCKTPSDITNYRKAEKSK

SEQ ID NO: 3237765 - protein, 7 aa, Plasmodium falciparum
NKNCTQE

SEQ ID NO: 3237766 - protein, 9 aa, Plasmodium falciparum
NKNDASQKK

SEQ ID NO: 3237767 - protein, 5 aa, Plasmodium falciparum
NKNDD

SEQ ID NO: 3237768 - protein, 8 aa, Plasmodium falciparum
NKNDEKED

SEQ ID NO: 3237769 - protein, 8 aa, Plasmodium falciparum
NKNDESYN

SEQ ID NO: 3237770 - protein, 8 aa, Plasmodium falciparum
NKNDHNIN

SEQ ID NO: 3237771 - protein, 29 aa, Plasmodium falciparum
NKNDKGEKEETDGAKPKNTEVKEPAPATT

SEQ ID NO: 3237772 - protein, 18 aa, Plasmodium falciparum
NKNDKHVPKNNHTTATHT

SEQ ID NO: 3237773 - protein, 6 aa, Plasmodium falciparum
NKNDKN

SEQ ID NO: 3237774 - protein, 12 aa, Plasmodium falciparum
NKNDKVTTNHPS

SEQ ID NO: 3237775 - protein, 14 aa, Plasmodium falciparum
NKNDKYNEQKYREQ

SEQ ID NO: 3237776 - protein, 5 aa, Plasmodium falciparum
NKNDL

SEQ ID NO: 3237777 - protein, 23 aa, Plasmodium falciparum
NKNDLNKSDTINLNNTNNSISNV

SEQ ID NO: 3237778 - protein, 9 aa, Plasmodium falciparum
NKNDMNGNM

SEQ ID NO: 3237779 - protein, 7 aa, Plasmodium falciparum
NKNDNDA

SEQ ID NO: 3237780 - protein, 7 aa, Plasmodium falciparum
NKNDNEY

SEQ ID NO: 3237781 - protein, 15 aa, Plasmodium falciparum
NKNDNINNTHEENHI

SEQ ID NO: 3237782 - protein, 11 aa, Plasmodium falciparum
NKNDNNEINDG

SEQ ID NO: 3237783 - protein, 13 aa, Plasmodium falciparum
NKNDNQNNTEELK

SEQ ID NO: 3237784 - protein, 7 aa, Plasmodium falciparum
NKNDNTC

SEQ ID NO: 3237785 - protein, 6 aa, Plasmodium falciparum
NKNDPY

SEQ ID NO: 3237786 - protein, 18 aa, Plasmodium falciparum
NKNDSEKHKKTTNNNFGD

SEQ ID NO: 3237787 - protein, 9 aa, Plasmodium falciparum
NKNDSKKLK

SEQ ID NO: 3237788 - protein, 8 aa, Plasmodium falciparum
NKNDTEEE

SEQ ID NO: 3237789 - protein, 7 aa, Plasmodium falciparum
NKNDTRN

SEQ ID NO: 3237790 - protein, 7 aa, Plasmodium falciparum
NKNDTVN

SEQ ID NO: 3237791 - protein, 5 aa, Plasmodium falciparum
NKNDY

SEQ ID NO: 3237792 - protein, 31 aa, Plasmodium falciparum
NKNDYDCNKNDYDYNKNDYDYNYNNSETPVG

SEQ ID NO: 3237793 - protein, 6 aa, Plasmodium falciparum
NKNDYK

SEQ ID NO: 3237794 - protein, 6 aa, Plasmodium falciparum
NKNEAL

SEQ ID NO: 3237795 - protein, 9 aa, Plasmodium falciparum
NKNEDKKNQ

SEQ ID NO: 3237796 - protein, 11 aa, Plasmodium falciparum
NKNEDKKQNNF

SEQ ID NO: 3237797 - protein, 9 aa, Plasmodium falciparum
NKNEECKKS

SEQ ID NO: 3237798 - protein, 7 aa, Plasmodium falciparum
NKNEEKI

SEQ ID NO: 3237799 - protein, 8 aa, Plasmodium falciparum
NKNEEKKF

SEQ ID NO: 3237800 - protein, 43 aa, Plasmodium falciparum
NKNEENETNEKKKKNNNENKQNKDNIDEKNKNNQTEKIKDPKL

SEQ ID NO: 3237801 - protein, 8 aa, Plasmodium falciparum
NKNEGKKE

SEQ ID NO: 3237802 - protein, 6 aa, Plasmodium falciparum
NKNEHH

SEQ ID NO: 3237803 - protein, 8 aa, Plasmodium falciparum
NKNEHNIN

SEQ ID NO: 3237804 - protein, 8 aa, Plasmodium falciparum
NKNEISGE

SEQ ID NO: 3237805 - protein, 7 aa, Plasmodium falciparum
NKNEKDK

SEQ ID NO: 3237806 - protein, 11 aa, Plasmodium falciparum
NKNEKDKYDKL

SEQ ID NO: 3237807 - protein, 16 aa, Plasmodium falciparum
NKNEKDNSTLDREENI

SEQ ID NO: 3237808 - protein, 12 aa, Plasmodium falciparum
NKNEKGEENKSN

SEQ ID NO: 3237809 - protein, 23 aa, Plasmodium falciparum
NKNEKKENITSISSKDIPRNNPY

SEQ ID NO: 3237810 - protein, 10 aa, Plasmodium falciparum
NKNEKKRSLT

SEQ ID NO: 3237811 - protein, 15 aa, Plasmodium falciparum
NKNEKNLKNNKRNKN

SEQ ID NO: 3237812 - protein, 31 aa, Plasmodium falciparum
NKNENHVNSENFNKKKKNIYDKTHKEDNTNI

SEQ ID NO: 3237813 - protein, 9 aa, Plasmodium falciparum
NKNENNYND

SEQ ID NO: 3237814 - protein, 18 aa, Plasmodium falciparum
NKNENVMNEDDNNNNRFN

SEQ ID NO: 3237815 - protein, 10 aa, Plasmodium falciparum
NKNERGKELK

SEQ ID NO: 3237816 - protein, 7 aa, Plasmodium falciparum
NKNERIT

SEQ ID NO: 3237817 - protein, 44 aa, Plasmodium falciparum
NKNFGKNKNYGKNKNYGKNKNYGKNKNYGKNKNYGNNKNYGNNN

SEQ ID NO: 3237818 - protein, 5 aa, Plasmodium falciparum
NKNFQ

SEQ ID NO: 3237819 - protein, 18 aa, Plasmodium falciparum
NKNFSDVKKRKKRNDKNN

SEQ ID NO: 3237820 - protein, 12 aa, Plasmodium falciparum
NKNFYSNPTEVN

SEQ ID NO: 3237821 - protein, 22 aa, Plasmodium falciparum
NKNGDHKKKKINNNNNNKKKYI

SEQ ID NO: 3237822 - protein, 24 aa, Plasmodium falciparum
NKNGENKMKNMSEENIKKEGEKIY

SEQ ID NO: 3237823 - protein, 15 aa, Plasmodium falciparum
NKNGENSISGTQNNQ

SEQ ID NO: 3237824 - protein, 11 aa, Plasmodium falciparum
NKNGGGRGKYS

SEQ ID NO: 3237825 - protein, 6 aa, Plasmodium falciparum
NKNGKS

SEQ ID NO: 3237826 - protein, 8 aa, Plasmodium falciparum
NKNGKTSL

SEQ ID NO: 3237827 - protein, 7 aa, Plasmodium falciparum
NKNGLHS

SEQ ID NO: 3237828 - protein, 7 aa, Plasmodium falciparum
NKNGNKF

SEQ ID NO: 3237829 - protein, 8 aa, Plasmodium falciparum
NKNGNKHE

SEQ ID NO: 3237830 - protein, 23 aa, Plasmodium falciparum
NKNGNNNNNNNNNNKNKNIDNKE

SEQ ID NO: 3237831 - protein, 9 aa, Plasmodium falciparum
NKNGQPSCS

SEQ ID NO: 3237832 - protein, 17 aa, Plasmodium falciparum
NKNGSDVSDTEADPTYA

SEQ ID NO: 3237833 - protein, 18 aa, Plasmodium falciparum
NKNGSSLNISSSHDTSYE

SEQ ID NO: 3237834 - protein, 4 aa, Plasmodium falciparum
NKNH

SEQ ID NO: 3237835 - protein, 17 aa, Plasmodium falciparum
NKNHKNDNNKNISDKKD

SEQ ID NO: 3237836 - protein, 6 aa, Plasmodium falciparum
NKNHTN

SEQ ID NO: 3237837 - protein, 5 aa, Plasmodium falciparum
NKNHY

SEQ ID NO: 3237838 - protein, 7 aa, Plasmodium falciparum
NKNIEKT

SEQ ID NO: 3237839 - protein, 43 aa, Plasmodium falciparum
NKNIESNDKSYKNQNIQSNEQSVTPNRNIEENKDHEKKSNNSF

SEQ ID NO: 3237840 - protein, 5 aa, Plasmodium falciparum
NKNIH

SEQ ID NO: 3237841 - protein, 6 aa, Plasmodium falciparum
NKNIHK

SEQ ID NO: 3237842 - protein, 6 aa, Plasmodium falciparum
NKNIKD

SEQ ID NO: 3237843 - protein, 14 aa, Plasmodium falciparum
NKNIKGNNGYKYNT

SEQ ID NO: 3237844 - protein, 26 aa, Plasmodium falciparum
NKNIKKDTNDNTTNNKSATKTNVTKT

SEQ ID NO: 3237845 - protein, 28 aa, Plasmodium falciparum
NKNINDTKGHNKNNNNNNNIYGDDDDNN

SEQ ID NO: 3237846 - protein, 11 aa, Plasmodium falciparum
NKNINKLKEKN

SEQ ID NO: 3237847 - protein, 6 aa, Plasmodium falciparum
NKNIQY

SEQ ID NO: 3237848 - protein, 7 aa, Plasmodium falciparum
NKNIREE

SEQ ID NO: 3237849 - protein, 31 aa, Plasmodium falciparum
NKNISSCQGNNSNKNVTMKKSGNLENDKKDN

SEQ ID NO: 3237850 - protein, 7 aa, Plasmodium falciparum
NKNISSR

SEQ ID NO: 3237851 - protein, 7 aa, Plasmodium falciparum
NKNISTN

SEQ ID NO: 3237852 - protein, 6 aa, Plasmodium falciparum
NKNITS

SEQ ID NO: 3237853 - protein, 6 aa, Plasmodium falciparum
NKNKDG

SEQ ID NO: 3237854 - protein, 12 aa, Plasmodium falciparum
NKNKDKSKTKNN

SEQ ID NO: 3237855 - protein, 14 aa, Plasmodium falciparum
NKNKEADENNKMDN

SEQ ID NO: 3237856 - protein, 9 aa, Plasmodium falciparum
NKNKEEPIT

SEQ ID NO: 3237857 - protein, 14 aa, Plasmodium falciparum
NKNKENSNEENVQN

SEQ ID NO: 3237858 - protein, 6 aa, Plasmodium falciparum
NKNKEQ

SEQ ID NO: 3237859 - protein, 7 aa, Plasmodium falciparum
NKNKFLS

SEQ ID NO: 3237860 - protein, 8 aa, Plasmodium falciparum
NKNKGNNY

SEQ ID NO: 3237861 - protein, 8 aa, Plasmodium falciparum
NKNKHNKE

SEQ ID NO: 3237862 - protein, 6 aa, Plasmodium falciparum
NKNKIG

SEQ ID NO: 3237863 - protein, 16 aa, Plasmodium falciparum
NKNKKNDNYNDNNNNM

SEQ ID NO: 3237864 - protein, 18 aa, Plasmodium falciparum
NKNKKNKKKSNKHEQNNL

SEQ ID NO: 3237865 - protein, 5 aa, Plasmodium falciparum
NKNKN

SEQ ID NO: 3237866 - protein, 9 aa, Plasmodium falciparum
NKNKNDEGT

SEQ ID NO: 3237867 - protein, 40 aa, Plasmodium falciparum
NKNKNDENDKNNENKKNIKTKENKKDKKSKKKDKITQDEV

SEQ ID NO: 3237868 - protein, 32 aa, Plasmodium falciparum
NKNKNDNYDKNDNYDKKDNYDTNDKNDKNNCD

SEQ ID NO: 3237869 - protein, 9 aa, Plasmodium falciparum
NKNKNDSLG

SEQ ID NO: 3237870 - protein, 8 aa, Plasmodium falciparum
NKNKNERI

SEQ ID NO: 3237871 - protein, 76 aa, Plasmodium falciparum
NKNKNESISQNKKQSINQNKKQSINQNKKQSISQNKKQSISQNKKQSISQNKKQSISQNKNQSISQNKKQSISQNK

SEQ ID NO: 3237872 - protein, 8 aa, Plasmodium falciparum
NKNKNIPQ

SEQ ID NO: 3237873 - protein, 10 aa, Plasmodium falciparum
NKNKNKHDIY

SEQ ID NO: 3237874 - protein, 8 aa, Plasmodium falciparum
NKNKNKSI

SEQ ID NO: 3237875 - protein, 11 aa, Plasmodium falciparum
NKNKNNNENND

SEQ ID NO: 3237876 - protein, 15 aa, Plasmodium falciparum
NKNKNNNNNDDDDNN

SEQ ID NO: 3237877 - protein, 8 aa, Plasmodium falciparum
NKNKNNNY

SEQ ID NO: 3237878 - protein, 8 aa, Plasmodium falciparum
NKNKNNYS

SEQ ID NO: 3237879 - protein, 7 aa, Plasmodium falciparum
NKNKNTY

SEQ ID NO: 3237880 - protein, 7 aa, Plasmodium falciparum
NKNKPQS

SEQ ID NO: 3237881 - protein, 17 aa, Plasmodium falciparum
NKNKPSITPHHTRTTTS

SEQ ID NO: 3237882 - protein, 8 aa, Plasmodium falciparum
NKNKPYIT

SEQ ID NO: 3237883 - protein, 11 aa, Plasmodium falciparum
NKNKQDTCSDN

SEQ ID NO: 3237884 - protein, 5 aa, Plasmodium falciparum
NKNKR

SEQ ID NO: 3237885 - protein, 8 aa, Plasmodium falciparum
NKNKRNNS

SEQ ID NO: 3237886 - protein, 15 aa, Plasmodium falciparum
NKNKTIVNNDNGTKV

SEQ ID NO: 3237887 - protein, 12 aa, Plasmodium falciparum
NKNKTTSSNKTT

SEQ ID NO: 3237888 - protein, 11 aa, Plasmodium falciparum
NKNKVSTNFPN

SEQ ID NO: 3237889 - protein, 7 aa, Plasmodium falciparum
NKNKYKY

SEQ ID NO: 3237890 - protein, 11 aa, Plasmodium falciparum
NKNLDEKTYKI

SEQ ID NO: 3237891 - protein, 6 aa, Plasmodium falciparum
NKNLHS

SEQ ID NO: 3237892 - protein, 12 aa, Plasmodium falciparum
NKNLKDSKTQIN

SEQ ID NO: 3237893 - protein, 6 aa, Plasmodium falciparum
NKNLKE

SEQ ID NO: 3237894 - protein, 5 aa, Plasmodium falciparum
NKNLS

SEQ ID NO: 3237895 - protein, 20 aa, Plasmodium falciparum
NKNMENNNNINKNMENNNNI

SEQ ID NO: 3237896 - protein, 13 aa, Plasmodium falciparum
NKNMNTKKRNINE

SEQ ID NO: 3237897 - protein, 6 aa, Plasmodium falciparum
NKNNDM

SEQ ID NO: 3237898 - protein, 11 aa, Plasmodium falciparum
NKNNDNINNDN

SEQ ID NO: 3237899 - protein, 10 aa, Plasmodium falciparum
NKNNDNVDNG

SEQ ID NO: 3237900 - protein, 10 aa, Plasmodium falciparum
NKNNDTDKKL

SEQ ID NO: 3237901 - protein, 5 aa, Plasmodium falciparum
NKNNE

SEQ ID NO: 3237902 - protein, 9 aa, Plasmodium falciparum
NKNNEDKLN

SEQ ID NO: 3237903 - protein, 7 aa, Plasmodium falciparum
NKNNEEY

SEQ ID NO: 3237904 - protein, 20 aa, Plasmodium falciparum
NKNNEGPNSSFNETKLNNSS

SEQ ID NO: 3237905 - protein, 14 aa, Plasmodium falciparum
NKNNEIQQENPTKR

SEQ ID NO: 3237906 - protein, 7 aa, Plasmodium falciparum
NKNNELK

SEQ ID NO: 3237907 - protein, 8 aa, Plasmodium falciparum
NKNNFNSS

SEQ ID NO: 3237908 - protein, 96 aa, Plasmodium falciparum
NKNNFRNKGLNNNTYGKDNTYGRDNTYGNNNTYGKDNTYGNNNTYGKDNTYGNNNTYGKDNTYGNNNTYGKDNTYGNNNTYGNNNTYGNNNTYGKD

SEQ ID NO: 3237909 - protein, 22 aa, Plasmodium falciparum
NKNNGDEKKDKAGAKTITATPK

SEQ ID NO: 3237910 - protein, 10 aa, Plasmodium falciparum
NKNNHNKKNQ

SEQ ID NO: 3237911 - protein, 8 aa, Plasmodium falciparum
NKNNIEEK

SEQ ID NO: 3237912 - protein, 8 aa, Plasmodium falciparum
NKNNIEKE

SEQ ID NO: 3237913 - protein, 7 aa, Plasmodium falciparum
NKNNINK

SEQ ID NO: 3237914 - protein, 6 aa, Plasmodium falciparum
NKNNIQ

SEQ ID NO: 3237915 - protein, 6 aa, Plasmodium falciparum
NKNNIT

SEQ ID NO: 3237916 - protein, 12 aa, Plasmodium falciparum
NKNNIYDDTSEG

SEQ ID NO: 3237917 - protein, 11 aa, Plasmodium falciparum
NKNNKELSDDD

SEQ ID NO: 3237918 - protein, 29 aa, Plasmodium falciparum
NKNNKKNKNHINHDGDDDDDDNNDDNNNI

SEQ ID NO: 3237919 - protein, 45 aa, Plasmodium falciparum
NKNNKNNKNNKNNKNNKNNKNNKNKNNNDNNNNNNNNNNNSNNNK

SEQ ID NO: 3237920 - protein, 19 aa, Plasmodium falciparum
NKNNKNNKNNNNNNSSSCS

SEQ ID NO: 3237921 - protein, 6 aa, Plasmodium falciparum
NKNNKS

SEQ ID NO: 3237922 - protein, 7 aa, Plasmodium falciparum
NKNNLSS

SEQ ID NO: 3237923 - protein, 7 aa, Plasmodium falciparum
NKNNNAY

SEQ ID NO: 3237924 - protein, 25 aa, Plasmodium falciparum
NKNNNKNNNSNNNNNNNTNCNDNNN

SEQ ID NO: 3237925 - protein, 35 aa, Plasmodium falciparum
NKNNNNNKNNKNNKNNQNNNNNNNDNNNNNQNNIN

SEQ ID NO: 3237926 - protein, 12 aa, Plasmodium falciparum
NKNNNNNKNNRN

SEQ ID NO: 3237927 - protein, 96 aa, Plasmodium falciparum
NKNNNNNNNDKNDKNDKNDKNDKNDKNDGKNNNKGNDKNNNRGNDKNNDKKNNRDNDKNNDKNNDKKNNKDNNNKKKKNGKEQNEDSTESDDESSV

SEQ ID NO: 3237928 - protein, 13 aa, Plasmodium falciparum
NKNNNNNNNNNIY

SEQ ID NO: 3237929 - protein, 8 aa, Plasmodium falciparum
NKNNNYKK

SEQ ID NO: 3237930 - protein, 8 aa, Plasmodium falciparum
NKNNQETK

SEQ ID NO: 3237931 - protein, 19 aa, Plasmodium falciparum
NKNNQKDNHKDNDNERDIR

SEQ ID NO: 3237932 - protein, 9 aa, Plasmodium falciparum
NKNNQTSTY

SEQ ID NO: 3237933 - protein, 23 aa, Plasmodium falciparum
NKNNRINEYQKEHSNDIPNDISK

SEQ ID NO: 3237934 - protein, 5 aa, Plasmodium falciparum
NKNNS

SEQ ID NO: 3237935 - protein, 15 aa, Plasmodium falciparum
NKNNSLNTNKEPSRI

SEQ ID NO: 3237936 - protein, 9 aa, Plasmodium falciparum
NKNNTNDKV

SEQ ID NO: 3237937 - protein, 8 aa, Plasmodium falciparum
NKNNTNNI

SEQ ID NO: 3237938 - protein, 19 aa, Plasmodium falciparum
NKNNTRNENMNEGNDIYEK

SEQ ID NO: 3237939 - protein, 9 aa, Plasmodium falciparum
NKNNTSTPL

SEQ ID NO: 3237940 - protein, 7 aa, Plasmodium falciparum
NKNNVKK

SEQ ID NO: 3237941 - protein, 7 aa, Plasmodium falciparum
NKNNVND

SEQ ID NO: 3237942 - protein, 4 aa, Plasmodium falciparum
NKNP

SEQ ID NO: 3237943 - protein, 11 aa, Plasmodium falciparum
NKNPLEKKKRN

SEQ ID NO: 3237944 - protein, 9 aa, Plasmodium falciparum
NKNPNNAYP

SEQ ID NO: 3237945 - protein, 8 aa, Plasmodium falciparum
NKNPQIRG

SEQ ID NO: 3237946 - protein, 4 aa, Plasmodium falciparum
NKNQ

SEQ ID NO: 3237947 - protein, 5 aa, Plasmodium falciparum
NKNQD

SEQ ID NO: 3237948 - protein, 6 aa, Plasmodium falciparum
NKNQFK

SEQ ID NO: 3237949 - protein, 5 aa, Plasmodium falciparum
NKNQN

SEQ ID NO: 3237950 - protein, 15 aa, Plasmodium falciparum
NKNQNDFFNNIWPPL

SEQ ID NO: 3237951 - protein, 13 aa, Plasmodium falciparum
NKNQNNTNSSYEN

SEQ ID NO: 3237952 - protein, 41 aa, Plasmodium falciparum
NKNQNTIYGNNKEKLKDMPYDNNYNDGGHHDHDNNNDHNND

SEQ ID NO: 3237953 - protein, 10 aa, Plasmodium falciparum
NKNQQKDTKI

SEQ ID NO: 3237954 - protein, 9 aa, Plasmodium falciparum
NKNRAPNIY

SEQ ID NO: 3237955 - protein, 6 aa, Plasmodium falciparum
NKNRKN

SEQ ID NO: 3237956 - protein, 8 aa, Plasmodium falciparum
NKNRSHKS

SEQ ID NO: 3237957 - protein, 15 aa, Plasmodium falciparum
NKNSCNEEDMNNNEN

SEQ ID NO: 3237958 - protein, 6 aa, Plasmodium falciparum
NKNSDE

SEQ ID NO: 3237959 - protein, 9 aa, Plasmodium falciparum
NKNSEDPSK

SEQ ID NO: 3237960 - protein, 9 aa, Plasmodium falciparum
NKNSGNDNE

SEQ ID NO: 3237961 - protein, 7 aa, Plasmodium falciparum
NKNSGVN

SEQ ID NO: 3237962 - protein, 9 aa, Plasmodium falciparum
NKNSHNKYN

SEQ ID NO: 3237963 - protein, 9 aa, Plasmodium falciparum
NKNSINGNP

SEQ ID NO: 3237964 - protein, 8 aa, Plasmodium falciparum
NKNSKDSL

SEQ ID NO: 3237965 - protein, 11 aa, Plasmodium falciparum
NKNSKKKNFKE

SEQ ID NO: 3237966 - protein, 25 aa, Plasmodium falciparum
NKNSKQKDNNNDNAYGGCSRSRSSC

SEQ ID NO: 3237967 - protein, 8 aa, Plasmodium falciparum
NKNSNCSV

SEQ ID NO: 3237968 - protein, 7 aa, Plasmodium falciparum
NKNSNLK

SEQ ID NO: 3237969 - protein, 25 aa, Plasmodium falciparum
NKNSNTLKYNNNNNNNNNNNNNNNS

SEQ ID NO: 3237970 - protein, 8 aa, Plasmodium falciparum
NKNSRTYN

SEQ ID NO: 3237971 - protein, 39 aa, Plasmodium falciparum
NKNSSGTDNNITHKKKEPKNEKENSFEEEDNEKSYCRQG

SEQ ID NO: 3237972 - protein, 8 aa, Plasmodium falciparum
NKNSTASC

SEQ ID NO: 3237973 - protein, 15 aa, Plasmodium falciparum
NKNTDIKNPRSFNQN

SEQ ID NO: 3237974 - protein, 5 aa, Plasmodium falciparum
NKNTE

SEQ ID NO: 3237975 - protein, 8 aa, Plasmodium falciparum
NKNTEDII

SEQ ID NO: 3237976 - protein, 8 aa, Plasmodium falciparum
NKNTEETK

SEQ ID NO: 3237977 - protein, 8 aa, Plasmodium falciparum
NKNTEIEN

SEQ ID NO: 3237978 - protein, 15 aa, Plasmodium falciparum
NKNTEIKDEPNQNND

SEQ ID NO: 3237979 - protein, 7 aa, Plasmodium falciparum
NKNTFDG

SEQ ID NO: 3237980 - protein, 6 aa, Plasmodium falciparum
NKNTHE

SEQ ID NO: 3237981 - protein, 6 aa, Plasmodium falciparum
NKNTKA

SEQ ID NO: 3237982 - protein, 19 aa, Plasmodium falciparum
NKNTKDSKIDFKDTEETFR

SEQ ID NO: 3237983 - protein, 9 aa, Plasmodium falciparum
NKNTKEENE

SEQ ID NO: 3237984 - protein, 8 aa, Plasmodium falciparum
NKNTKNEQ

SEQ ID NO: 3237985 - protein, 14 aa, Plasmodium falciparum
NKNTKRNKEKKEKR

SEQ ID NO: 3237986 - protein, 12 aa, Plasmodium falciparum
NKNTKTDDNINN

SEQ ID NO: 3237987 - protein, 5 aa, Plasmodium falciparum
NKNTL

SEQ ID NO: 3237988 - protein, 9 aa, Plasmodium falciparum
NKNTNINTN

SEQ ID NO: 3237989 - protein, 10 aa, Plasmodium falciparum
NKNTNKKTSF

SEQ ID NO: 3237990 - protein, 8 aa, Plasmodium falciparum
NKNTNKTH

SEQ ID NO: 3237991 - protein, 8 aa, Plasmodium falciparum
NKNTNNKL

SEQ ID NO: 3237992 - protein, 15 aa, Plasmodium falciparum
NKNTNTKKKINDDSC

SEQ ID NO: 3237993 - protein, 17 aa, Plasmodium falciparum
NKNTPNISSTKGTDTDI

SEQ ID NO: 3237994 - protein, 6 aa, Plasmodium falciparum
NKNTSH

SEQ ID NO: 3237995 - protein, 13 aa, Plasmodium falciparum
NKNTTTNTSIDKN

SEQ ID NO: 3237996 - protein, 4 aa, Plasmodium falciparum
NKNV

SEQ ID NO: 3237997 - protein, 8 aa, Plasmodium falciparum
NKNVDDNI

SEQ ID NO: 3237998 - protein, 12 aa, Plasmodium falciparum
NKNVENEEYNNN

SEQ ID NO: 3237999 - protein, 6 aa, Plasmodium falciparum
NKNVFS

SEQ ID NO: 3238000 - protein, 13 aa, Plasmodium falciparum
NKNVKADDNTVEL

SEQ ID NO: 3238001 - protein, 14 aa, Plasmodium falciparum
NKNVKQENVPIPQN

SEQ ID NO: 3238002 - protein, 33 aa, Plasmodium falciparum
NKNVNRDNNIERDNNIERDNNIERDNNIERDNN

SEQ ID NO: 3238003 - protein, 6 aa, Plasmodium falciparum
NKNVQN

SEQ ID NO: 3238004 - protein, 6 aa, Plasmodium falciparum
NKNVQS

SEQ ID NO: 3238005 - protein, 6 aa, Plasmodium falciparum
NKNVSF

SEQ ID NO: 3238006 - protein, 6 aa, Plasmodium falciparum
NKNVSN

SEQ ID NO: 3238007 - protein, 6 aa, Plasmodium falciparum
NKNVST

SEQ ID NO: 3238008 - protein, 4 aa, Plasmodium falciparum
NKNY

SEQ ID NO: 3238009 - protein, 11 aa, Plasmodium falciparum
NKNYDNKENNI

SEQ ID NO: 3238010 - protein, 6 aa, Plasmodium falciparum
NKNYDS

SEQ ID NO: 3238011 - protein, 7 aa, Plasmodium falciparum
NKNYKGT

SEQ ID NO: 3238012 - protein, 9 aa, Plasmodium falciparum
NKNYNSTNY

SEQ ID NO: 3238013 - protein, 6 aa, Plasmodium falciparum
NKNYTQ

SEQ ID NO: 3238014 - protein, 5 aa, Plasmodium falciparum
NKPCN

SEQ ID NO: 3238015 - protein, 8 aa, Plasmodium falciparum
NKPHDTNE

SEQ ID NO: 3238016 - protein, 10 aa, Plasmodium falciparum
NKPHKSPIER

SEQ ID NO: 3238017 - protein, 8 aa, Plasmodium falciparum
NKPINNNY

SEQ ID NO: 3238018 - protein, 6 aa, Plasmodium falciparum
NKPISF

SEQ ID NO: 3238019 - protein, 8 aa, Plasmodium falciparum
NKPKGKNK

SEQ ID NO: 3238020 - protein, 17 aa, Plasmodium falciparum
NKPKLNKKDTSDISHDE

SEQ ID NO: 3238021 - protein, 8 aa, Plasmodium falciparum
NKPKRSHK

SEQ ID NO: 3238022 - protein, 4 aa, Plasmodium falciparum
NKPL

SEQ ID NO: 3238023 - protein, 13 aa, Plasmodium falciparum
NKPLEDNKSFGDN

SEQ ID NO: 3238024 - protein, 7 aa, Plasmodium falciparum
NKPLESE

SEQ ID NO: 3238025 - protein, 9 aa, Plasmodium falciparum
NKPNGLSNS

SEQ ID NO: 3238026 - protein, 15 aa, Plasmodium falciparum
NKPNKKKKKDETLSV

SEQ ID NO: 3238027 - protein, 9 aa, Plasmodium falciparum
NKPNLTNKN

SEQ ID NO: 3238028 - protein, 5 aa, Plasmodium falciparum
NKPNM

SEQ ID NO: 3238029 - protein, 6 aa, Plasmodium falciparum
NKPNQI

SEQ ID NO: 3238030 - protein, 5 aa, Plasmodium falciparum
NKPNY

SEQ ID NO: 3238031 - protein, 9 aa, Plasmodium falciparum
NKPPQGTNN

SEQ ID NO: 3238032 - protein, 8 aa, Plasmodium falciparum
NKPPSNIN

SEQ ID NO: 3238033 - protein, 9 aa, Plasmodium falciparum
NKPQECAGK

SEQ ID NO: 3238034 - protein, 5 aa, Plasmodium falciparum
NKPRN

SEQ ID NO: 3238035 - protein, 14 aa, Plasmodium falciparum
NKPSITPHHTQTNR

SEQ ID NO: 3238036 - protein, 18 aa, Plasmodium falciparum
NKPSTNNFSTNKPSTNNF

SEQ ID NO: 3238037 - protein, 9 aa, Plasmodium falciparum
NKPSTSSFS

SEQ ID NO: 3238038 - protein, 5 aa, Plasmodium falciparum
NKPTN

SEQ ID NO: 3238039 - protein, 4 aa, Plasmodium falciparum
NKPV

SEQ ID NO: 3238040 - protein, 31 aa, Plasmodium falciparum
NKPVNSPVDDNTDVKTMKGEQHIKGQAEDKN

SEQ ID NO: 3238041 - protein, 4 aa, Plasmodium falciparum
NKPY

SEQ ID NO: 3238042 - protein, 11 aa, Plasmodium falciparum
NKPYISPHTPT

SEQ ID NO: 3238043 - protein, 17 aa, Plasmodium falciparum
NKPYITPNTPTTTSRGL

SEQ ID NO: 3238044 - protein, 7 aa, Plasmodium falciparum
NKPYNDM

SEQ ID NO: 3238045 - protein, 7 aa, Plasmodium falciparum
NKQAQRK

SEQ ID NO: 3238046 - protein, 16 aa, Plasmodium falciparum
NKQDEYEKKKRTKKQN

SEQ ID NO: 3238047 - protein, 6 aa, Plasmodium falciparum
NKQDPN

SEQ ID NO: 3238048 - protein, 9 aa, Plasmodium falciparum
NKQEKNGYS

SEQ ID NO: 3238049 - protein, 16 aa, Plasmodium falciparum
NKQEKNKNLGSDNGNH

SEQ ID NO: 3238050 - protein, 9 aa, Plasmodium falciparum
NKQENDYNT

SEQ ID NO: 3238051 - protein, 6 aa, Plasmodium falciparum
NKQHIE

SEQ ID NO: 3238052 - protein, 17 aa, Plasmodium falciparum
NKQIASNNNNNNNNKSI

SEQ ID NO: 3238053 - protein, 55 aa, Plasmodium falciparum
NKQKDINKGDNNNNNNGNNNNGNNNNCNNNNGNNNNCNNNNGNNNNGNNNNGNNN

SEQ ID NO: 3238054 - protein, 18 aa, Plasmodium falciparum
NKQKGDDKIKKKKNEEQK

SEQ ID NO: 3238055 - protein, 12 aa, Plasmodium falciparum
NKQKKNKKKRSS

SEQ ID NO: 3238056 - protein, 68 aa, Plasmodium falciparum
NKQKLYSNDLGKEQDKKKKNTSKNKTETRNTQTNKADKSILSTEKKTSKTKSTLRKNKNNAKKKDNIT

SEQ ID NO: 3238057 - protein, 10 aa, Plasmodium falciparum
NKQLDSQDIS

SEQ ID NO: 3238058 - protein, 5 aa, Plasmodium falciparum
NKQNA

SEQ ID NO: 3238059 - protein, 8 aa, Plasmodium falciparum
NKQNDDKD

SEQ ID NO: 3238060 - protein, 10 aa, Plasmodium falciparum
NKQNDEDINK

SEQ ID NO: 3238061 - protein, 6 aa, Plasmodium falciparum
NKQNDP

SEQ ID NO: 3238062 - protein, 6 aa, Plasmodium falciparum
NKQNEQ

SEQ ID NO: 3238063 - protein, 10 aa, Plasmodium falciparum
NKQNESAINK

SEQ ID NO: 3238064 - protein, 8 aa, Plasmodium falciparum
NKQNGIKN

SEQ ID NO: 3238065 - protein, 5 aa, Plasmodium falciparum
NKQNK

SEQ ID NO: 3238066 - protein, 27 aa, Plasmodium falciparum
NKQNKQDKQDKQNKLNRQNKQNKQNHL

SEQ ID NO: 3238067 - protein, 6 aa, Plasmodium falciparum
NKQNLS

SEQ ID NO: 3238068 - protein, 9 aa, Plasmodium falciparum
NKQNNGNEI

SEQ ID NO: 3238069 - protein, 8 aa, Plasmodium falciparum
NKQNNNKN

SEQ ID NO: 3238070 - protein, 7 aa, Plasmodium falciparum
NKQNNYE

SEQ ID NO: 3238071 - protein, 50 aa, Plasmodium falciparum
NKQNTQNNKKVNTKKADIETNGKSNIETSQDKQLTTKNNDENKNTVKNSK

SEQ ID NO: 3238072 - protein, 17 aa, Plasmodium falciparum
NKQNYGNEKNNSNNNEI

SEQ ID NO: 3238073 - protein, 5 aa, Plasmodium falciparum
NKQPN

SEQ ID NO: 3238074 - protein, 9 aa, Plasmodium falciparum
NKQQMNQQQ

SEQ ID NO: 3238075 - protein, 8 aa, Plasmodium falciparum
NKQQNYNG

SEQ ID NO: 3238076 - protein, 11 aa, Plasmodium falciparum
NKQSYNSNTTE

SEQ ID NO: 3238077 - protein, 7 aa, Plasmodium falciparum
NKQTNDN

SEQ ID NO: 3238078 - protein, 14 aa, Plasmodium falciparum
NKQTNINNHNDNNF

SEQ ID NO: 3238079 - protein, 12 aa, Plasmodium falciparum
NKQTYDKEHDNN

SEQ ID NO: 3238080 - protein, 6 aa, Plasmodium falciparum
NKQYGN

SEQ ID NO: 3238081 - protein, 22 aa, Plasmodium falciparum
NKQYKRNHNKQNEKNKPKEHIQ

SEQ ID NO: 3238082 - protein, 11 aa, Plasmodium falciparum
NKQYNKKDEYM

SEQ ID NO: 3238083 - protein, 8 aa, Plasmodium falciparum
NKQYSNNK

SEQ ID NO: 3238084 - protein, 4 aa, Plasmodium falciparum
NKRA

SEQ ID NO: 3238085 - protein, 5 aa, Plasmodium falciparum
NKRAD

SEQ ID NO: 3238086 - protein, 4 aa, Plasmodium falciparum
NKRC

SEQ ID NO: 3238087 - protein, 9 aa, Plasmodium falciparum
NKRDQGGKQ

SEQ ID NO: 3238088 - protein, 7 aa, Plasmodium falciparum
NKRDYIS

SEQ ID NO: 3238089 - protein, 4 aa, Plasmodium falciparum
NKRE

SEQ ID NO: 3238090 - protein, 8 aa, Plasmodium falciparum
NKREEENF

SEQ ID NO: 3238091 - protein, 17 aa, Plasmodium falciparum
NKREQISNDSLNEKNEI

SEQ ID NO: 3238092 - protein, 7 aa, Plasmodium falciparum
NKREYNN

SEQ ID NO: 3238093 - protein, 46 aa, Plasmodium falciparum
NKRGEKSKKKKEKEIKNKIKNNNKRSECNNNNKYNISKKEKKKKKY

SEQ ID NO: 3238094 - protein, 14 aa, Plasmodium falciparum
NKRGKCKNKKCNND

SEQ ID NO: 3238095 - protein, 6 aa, Plasmodium falciparum
NKRISN

SEQ ID NO: 3238096 - protein, 4 aa, Plasmodium falciparum
NKRK

SEQ ID NO: 3238097 - protein, 6 aa, Plasmodium falciparum
NKRKAA

SEQ ID NO: 3238098 - protein, 8 aa, Plasmodium falciparum
NKRKEENI

SEQ ID NO: 3238099 - protein, 5 aa, Plasmodium falciparum
NKRKK

SEQ ID NO: 3238100 - protein, 11 aa, Plasmodium falciparum
NKRKKDKSNNF

SEQ ID NO: 3238101 - protein, 12 aa, Plasmodium falciparum
NKRKNKNNNSSY

SEQ ID NO: 3238102 - protein, 10 aa, Plasmodium falciparum
NKRKNSETND

SEQ ID NO: 3238103 - protein, 7 aa, Plasmodium falciparum
NKRKQNK

SEQ ID NO: 3238104 - protein, 9 aa, Plasmodium falciparum
NKRKQQELT

SEQ ID NO: 3238105 - protein, 22 aa, Plasmodium falciparum
NKRKSENTYNINEREKDDMNRR

SEQ ID NO: 3238106 - protein, 9 aa, Plasmodium falciparum
NKRKSKESH

SEQ ID NO: 3238107 - protein, 8 aa, Plasmodium falciparum
NKRKSSNI

SEQ ID NO: 3238108 - protein, 9 aa, Plasmodium falciparum
NKRKTDKNE

SEQ ID NO: 3238109 - protein, 12 aa, Plasmodium falciparum
NKRKTLNDTQRN

SEQ ID NO: 3238110 - protein, 9 aa, Plasmodium falciparum
NKRKYNQYG

SEQ ID NO: 3238111 - protein, 19 aa, Plasmodium falciparum
NKRMSNKRRNNKNCNPSND

SEQ ID NO: 3238112 - protein, 9 aa, Plasmodium falciparum
NKRNDNTKI

SEQ ID NO: 3238113 - protein, 5 aa, Plasmodium falciparum
NKRNE

SEQ ID NO: 3238114 - protein, 7 aa, Plasmodium falciparum
NKRNEKP

SEQ ID NO: 3238115 - protein, 20 aa, Plasmodium falciparum
NKRNIRKDKKYQSSCDGSTT

SEQ ID NO: 3238116 - protein, 51 aa, Plasmodium falciparum
NKRNNNNNNNNNNNNNNNNNNNNNNNNNNNNNNNNSNNVDNRKRNKNEECY

SEQ ID NO: 3238117 - protein, 10 aa, Plasmodium falciparum
NKRNNVNNTY

SEQ ID NO: 3238118 - protein, 7 aa, Plasmodium falciparum
NKRNQND

SEQ ID NO: 3238119 - protein, 7 aa, Plasmodium falciparum
NKRNSDL

SEQ ID NO: 3238120 - protein, 7 aa, Plasmodium falciparum
NKRPSYI

SEQ ID NO: 3238121 - protein, 7 aa, Plasmodium falciparum
NKRRKIK

SEQ ID NO: 3238122 - protein, 46 aa, Plasmodium falciparum
NKRRNMKRKNNELEERRNKQADKNSSSGNGKGKINGTRNSPKIKFK

SEQ ID NO: 3238123 - protein, 6 aa, Plasmodium falciparum
NKRRNR

SEQ ID NO: 3238124 - protein, 5 aa, Plasmodium falciparum
NKRSD

SEQ ID NO: 3238125 - protein, 6 aa, Plasmodium falciparum
NKRSDP

SEQ ID NO: 3238126 - protein, 6 aa, Plasmodium falciparum
NKRSFE

SEQ ID NO: 3238127 - protein, 11 aa, Plasmodium falciparum
NKRSGKRFSEV

SEQ ID NO: 3238128 - protein, 7 aa, Plasmodium falciparum
NKRTRKN

SEQ ID NO: 3238129 - protein, 8 aa, Plasmodium falciparum
NKSADKTF

SEQ ID NO: 3238130 - protein, 11 aa, Plasmodium falciparum
NKSADSTEQKK

SEQ ID NO: 3238131 - protein, 9 aa, Plasmodium falciparum
NKSDDNYNS

SEQ ID NO: 3238132 - protein, 5 aa, Plasmodium falciparum
NKSDE

SEQ ID NO: 3238133 - protein, 8 aa, Plasmodium falciparum
NKSDESIN

SEQ ID NO: 3238134 - protein, 10 aa, Plasmodium falciparum
NKSDHKDKRR

SEQ ID NO: 3238135 - protein, 28 aa, Plasmodium falciparum
NKSDHSDKIKKTNNNAHTKNNHEHESHT

SEQ ID NO: 3238136 - protein, 6 aa, Plasmodium falciparum
NKSDQF

SEQ ID NO: 3238137 - protein, 6 aa, Plasmodium falciparum
NKSEDI

SEQ ID NO: 3238138 - protein, 11 aa, Plasmodium falciparum
NKSEEDKKSKC

SEQ ID NO: 3238139 - protein, 7 aa, Plasmodium falciparum
NKSEEHK

SEQ ID NO: 3238140 - protein, 12 aa, Plasmodium falciparum
NKSEKCKSGCNK

SEQ ID NO: 3238141 - protein, 9 aa, Plasmodium falciparum
NKSEKKLPD

SEQ ID NO: 3238142 - protein, 13 aa, Plasmodium falciparum
NKSELGDRSTKMK

SEQ ID NO: 3238143 - protein, 8 aa, Plasmodium falciparum
NKSENEKV

SEQ ID NO: 3238144 - protein, 6 aa, Plasmodium falciparum
NKSEQE

SEQ ID NO: 3238145 - protein, 32 aa, Plasmodium falciparum
NKSEQKQLKDDNNKNDKYEKNISSKNIKQSHK

SEQ ID NO: 3238146 - protein, 6 aa, Plasmodium falciparum
NKSERN

SEQ ID NO: 3238147 - protein, 12 aa, Plasmodium falciparum
NKSEVTNNRQHI

SEQ ID NO: 3238148 - protein, 5 aa, Plasmodium falciparum
NKSFS

SEQ ID NO: 3238149 - protein, 9 aa, Plasmodium falciparum
NKSGGIRNE

SEQ ID NO: 3238150 - protein, 6 aa, Plasmodium falciparum
NKSGKK

SEQ ID NO: 3238151 - protein, 8 aa, Plasmodium falciparum
NKSGNDLK

SEQ ID NO: 3238152 - protein, 11 aa, Plasmodium falciparum
NKSGNEEKNTY

SEQ ID NO: 3238153 - protein, 6 aa, Plasmodium falciparum
NKSGNH

SEQ ID NO: 3238154 - protein, 8 aa, Plasmodium falciparum
NKSGNNLE

SEQ ID NO: 3238155 - protein, 20 aa, Plasmodium falciparum
NKSGSENSSKNMNSETHNIS

SEQ ID NO: 3238156 - protein, 29 aa, Plasmodium falciparum
NKSGTDEKEHNNDSNNNKNNDSNKNNYHN

SEQ ID NO: 3238157 - protein, 5 aa, Plasmodium falciparum
NKSII

SEQ ID NO: 3238158 - protein, 8 aa, Plasmodium falciparum
NKSINNDN

SEQ ID NO: 3238159 - protein, 6 aa, Plasmodium falciparum
NKSISN

SEQ ID NO: 3238160 - protein, 6 aa, Plasmodium falciparum
NKSISP

SEQ ID NO: 3238161 - protein, 4 aa, Plasmodium falciparum
NKSK

SEQ ID NO: 3238162 - protein, 7 aa, Plasmodium falciparum
NKSKIDP

SEQ ID NO: 3238163 - protein, 7 aa, Plasmodium falciparum
NKSKKEW

SEQ ID NO: 3238164 - protein, 5 aa, Plasmodium falciparum
NKSKN

SEQ ID NO: 3238165 - protein, 8 aa, Plasmodium falciparum
NKSKNKNK

SEQ ID NO: 3238166 - protein, 13 aa, Plasmodium falciparum
NKSKNKNKNKKGY

SEQ ID NO: 3238167 - protein, 12 aa, Plasmodium falciparum
NKSKREKCEEEC

SEQ ID NO: 3238168 - protein, 13 aa, Plasmodium falciparum
NKSKREKCKEECK

SEQ ID NO: 3238169 - protein, 21 aa, Plasmodium falciparum
NKSKSNSNNNSSSSSSSSSSN

SEQ ID NO: 3238170 - protein, 7 aa, Plasmodium falciparum
NKSKSNV

SEQ ID NO: 3238171 - protein, 10 aa, Plasmodium falciparum
NKSKSTNINM

SEQ ID NO: 3238172 - protein, 17 aa, Plasmodium falciparum
NKSKYNDKSSNNYDNKY

SEQ ID NO: 3238173 - protein, 12 aa, Plasmodium falciparum
NKSKYTNRSNSY

SEQ ID NO: 3238174 - protein, 10 aa, Plasmodium falciparum
NKSKYTSETP

SEQ ID NO: 3238175 - protein, 4 aa, Plasmodium falciparum
NKSL

SEQ ID NO: 3238176 - protein, 14 aa, Plasmodium falciparum
NKSLHRTPEESEQA

SEQ ID NO: 3238177 - protein, 7 aa, Plasmodium falciparum
NKSLNKS

SEQ ID NO: 3238178 - protein, 7 aa, Plasmodium falciparum
NKSLPEK

SEQ ID NO: 3238179 - protein, 9 aa, Plasmodium falciparum
NKSLTKSHI

SEQ ID NO: 3238180 - protein, 21 aa, Plasmodium falciparum
NKSMNEKDSSIHYDEEGTVKN

SEQ ID NO: 3238181 - protein, 4 aa, Plasmodium falciparum
NKSN

SEQ ID NO: 3238182 - protein, 7 aa, Plasmodium falciparum
NKSNDIQ

SEQ ID NO: 3238183 - protein, 7 aa, Plasmodium falciparum
NKSNEII

SEQ ID NO: 3238184 - protein, 12 aa, Plasmodium falciparum
NKSNERKKKKKV

SEQ ID NO: 3238185 - protein, 8 aa, Plasmodium falciparum
NKSNGSGN

SEQ ID NO: 3238186 - protein, 9 aa, Plasmodium falciparum
NKSNHKPTL

SEQ ID NO: 3238187 - protein, 5 aa, Plasmodium falciparum
NKSNI

SEQ ID NO: 3238188 - protein, 8 aa, Plasmodium falciparum
NKSNINNE

SEQ ID NO: 3238189 - protein, 14 aa, Plasmodium falciparum
NKSNKNKSAIVPPR

SEQ ID NO: 3238190 - protein, 8 aa, Plasmodium falciparum
NKSNKNNI

SEQ ID NO: 3238191 - protein, 10 aa, Plasmodium falciparum
NKSNMEGKYK

SEQ ID NO: 3238192 - protein, 12 aa, Plasmodium falciparum
NKSNNKKSDTVE

SEQ ID NO: 3238193 - protein, 8 aa, Plasmodium falciparum
NKSNNNDN

SEQ ID NO: 3238194 - protein, 8 aa, Plasmodium falciparum
NKSNNNIY

SEQ ID NO: 3238195 - protein, 23 aa, Plasmodium falciparum
NKSNNSNDKCLKESEKNEYDNKY

SEQ ID NO: 3238196 - protein, 9 aa, Plasmodium falciparum
NKSNNVNNI

SEQ ID NO: 3238197 - protein, 6 aa, Plasmodium falciparum
NKSNSF

SEQ ID NO: 3238198 - protein, 9 aa, Plasmodium falciparum
NKSNSLKRR

SEQ ID NO: 3238199 - protein, 28 aa, Plasmodium falciparum
NKSNSNNYKNNDNTCNNNHNNYKNNDNI

SEQ ID NO: 3238200 - protein, 9 aa, Plasmodium falciparum
NKSNSYRKN

SEQ ID NO: 3238201 - protein, 6 aa, Plasmodium falciparum
NKSNVQ

SEQ ID NO: 3238202 - protein, 9 aa, Plasmodium falciparum
NKSPDATTK

SEQ ID NO: 3238203 - protein, 7 aa, Plasmodium falciparum
NKSPHEI

SEQ ID NO: 3238204 - protein, 8 aa, Plasmodium falciparum
NKSPNDNH

SEQ ID NO: 3238205 - protein, 19 aa, Plasmodium falciparum
NKSPNSNNFKPEEEKPRKY

SEQ ID NO: 3238206 - protein, 6 aa, Plasmodium falciparum
NKSPYI

SEQ ID NO: 3238207 - protein, 7 aa, Plasmodium falciparum
NKSQGYE

SEQ ID NO: 3238208 - protein, 7 aa, Plasmodium falciparum
NKSQKAK

SEQ ID NO: 3238209 - protein, 29 aa, Plasmodium falciparum
NKSRDNINQNTNTNNNNNNNNNNDGDRFD

SEQ ID NO: 3238210 - protein, 8 aa, Plasmodium falciparum
NKSRDSYN

SEQ ID NO: 3238211 - protein, 7 aa, Plasmodium falciparum
NKSRNIN

SEQ ID NO: 3238212 - protein, 10 aa, Plasmodium falciparum
NKSRSSYNDD

SEQ ID NO: 3238213 - protein, 7 aa, Plasmodium falciparum
NKSRSTN

SEQ ID NO: 3238214 - protein, 4 aa, Plasmodium falciparum
NKSS

SEQ ID NO: 3238215 - protein, 8 aa, Plasmodium falciparum
NKSSCSAC

SEQ ID NO: 3238216 - protein, 24 aa, Plasmodium falciparum
NKSSDHSNKSSDHSNKLSDHSNKL

SEQ ID NO: 3238217 - protein, 9 aa, Plasmodium falciparum
NKSSDMNTG

SEQ ID NO: 3238218 - protein, 12 aa, Plasmodium falciparum
NKSSDYNKYDTD

SEQ ID NO: 3238219 - protein, 10 aa, Plasmodium falciparum
NKSSETNKQP

SEQ ID NO: 3238220 - protein, 6 aa, Plasmodium falciparum
NKSSFN

SEQ ID NO: 3238221 - protein, 8 aa, Plasmodium falciparum
NKSSFPDK

SEQ ID NO: 3238222 - protein, 8 aa, Plasmodium falciparum
NKSSHINN

SEQ ID NO: 3238223 - protein, 24 aa, Plasmodium falciparum
NKSSITHNSVSSSNITKSNKNTNK

SEQ ID NO: 3238224 - protein, 7 aa, Plasmodium falciparum
NKSSKNI

SEQ ID NO: 3238225 - protein, 8 aa, Plasmodium falciparum
NKSSLEYE

SEQ ID NO: 3238226 - protein, 14 aa, Plasmodium falciparum
NKSSMEEKKKKQYE

SEQ ID NO: 3238227 - protein, 10 aa, Plasmodium falciparum
NKSSNTTNNY

SEQ ID NO: 3238228 - protein, 8 aa, Plasmodium falciparum
NKSSTNNF

SEQ ID NO: 3238229 - protein, 90 aa, Plasmodium falciparum
NKSSVKEEDEIEKSMKAKSSTKSNDETNKANNNKNNNNNNKNNNNNNKNNNNNNKNNNNNNKNSNNNNNNNNDTFEEYEKNNKKKKKNVQ

SEQ ID NO: 3238230 - protein, 8 aa, Plasmodium falciparum
NKSSYKGV

SEQ ID NO: 3238231 - protein, 7 aa, Plasmodium falciparum
NKSSYNK

SEQ ID NO: 3238232 - protein, 5 aa, Plasmodium falciparum
NKSTD

SEQ ID NO: 3238233 - protein, 5 aa, Plasmodium falciparum
NKSTE

SEQ ID NO: 3238234 - protein, 26 aa, Plasmodium falciparum
NKSTEKLKEKNNEDEYNEEQEYEPTA

SEQ ID NO: 3238235 - protein, 9 aa, Plasmodium falciparum
NKSTHTYKK

SEQ ID NO: 3238236 - protein, 32 aa, Plasmodium falciparum
NKSTINSNNFSSNNNNDNNNNNNNNNNNCSNS

SEQ ID NO: 3238237 - protein, 6 aa, Plasmodium falciparum
NKSTIS

SEQ ID NO: 3238238 - protein, 11 aa, Plasmodium falciparum
NKSTKENDNKC

SEQ ID NO: 3238239 - protein, 22 aa, Plasmodium falciparum
NKSTLDSDDDIYDNTNENRNYN

SEQ ID NO: 3238240 - protein, 10 aa, Plasmodium falciparum
NKSTNKISNE

SEQ ID NO: 3238241 - protein, 8 aa, Plasmodium falciparum
NKSTVDSR

SEQ ID NO: 3238242 - protein, 7 aa, Plasmodium falciparum
NKSVEDN

SEQ ID NO: 3238243 - protein, 6 aa, Plasmodium falciparum
NKSVND

SEQ ID NO: 3238244 - protein, 14 aa, Plasmodium falciparum
NKSVNKRNNNPTQE

SEQ ID NO: 3238245 - protein, 23 aa, Plasmodium falciparum
NKSVQSKKKKKEKGKKKLSKNDQ

SEQ ID NO: 3238246 - protein, 10 aa, Plasmodium falciparum
NKSWKDKNHA

SEQ ID NO: 3238247 - protein, 4 aa, Plasmodium falciparum
NKSY

SEQ ID NO: 3238248 - protein, 15 aa, Plasmodium falciparum
NKSYHNNKSVNYNKN

SEQ ID NO: 3238249 - protein, 6 aa, Plasmodium falciparum
NKSYIT

SEQ ID NO: 3238250 - protein, 8 aa, Plasmodium falciparum
NKSYNKGE

SEQ ID NO: 3238251 - protein, 5 aa, Plasmodium falciparum
NKSYV

SEQ ID NO: 3238252 - protein, 8 aa, Plasmodium falciparum
NKTAGTSQ

SEQ ID NO: 3238253 - protein, 4 aa, Plasmodium falciparum
NKTD

SEQ ID NO: 3238254 - protein, 8 aa, Plasmodium falciparum
NKTDDKLK

SEQ ID NO: 3238255 - protein, 5 aa, Plasmodium falciparum
NKTDY

SEQ ID NO: 3238256 - protein, 7 aa, Plasmodium falciparum
NKTEGII

SEQ ID NO: 3238257 - protein, 7 aa, Plasmodium falciparum
NKTEQNH

SEQ ID NO: 3238258 - protein, 10 aa, Plasmodium falciparum
NKTGSGTLEN

SEQ ID NO: 3238259 - protein, 12 aa, Plasmodium falciparum
NKTHCSARPTSK

SEQ ID NO: 3238260 - protein, 5 aa, Plasmodium falciparum
NKTIG

SEQ ID NO: 3238261 - protein, 5 aa, Plasmodium falciparum
NKTIQ

SEQ ID NO: 3238262 - protein, 4 aa, Plasmodium falciparum
NKTK

SEQ ID NO: 3238263 - protein, 9 aa, Plasmodium falciparum
NKTKCNYEG

SEQ ID NO: 3238264 - protein, 45 aa, Plasmodium falciparum
NKTKDISNSSYNNRSNTSTINNHNNNNINNNNNNINNNNNINNNS

SEQ ID NO: 3238265 - protein, 13 aa, Plasmodium falciparum
NKTKENNIDHTNQ

SEQ ID NO: 3238266 - protein, 5 aa, Plasmodium falciparum
NKTKI

SEQ ID NO: 3238267 - protein, 13 aa, Plasmodium falciparum
NKTKKKKTDNNKL

SEQ ID NO: 3238268 - protein, 11 aa, Plasmodium falciparum
NKTKKTETKNS

SEQ ID NO: 3238269 - protein, 6 aa, Plasmodium falciparum
NKTKTC

SEQ ID NO: 3238270 - protein, 5 aa, Plasmodium falciparum
NKTLH

SEQ ID NO: 3238271 - protein, 31 aa, Plasmodium falciparum
NKTLNENNCDSKNYEGKEKNELKKNKFNEKK

SEQ ID NO: 3238272 - protein, 13 aa, Plasmodium falciparum
NKTLSENKEPFKD

SEQ ID NO: 3238273 - protein, 4 aa, Plasmodium falciparum
NKTN

SEQ ID NO: 3238274 - protein, 6 aa, Plasmodium falciparum
NKTNDM

SEQ ID NO: 3238275 - protein, 29 aa, Plasmodium falciparum
NKTNDNLSDKSHDIYSNGQKKKKKDKKKK

SEQ ID NO: 3238276 - protein, 6 aa, Plasmodium falciparum
NKTNFQ

SEQ ID NO: 3238277 - protein, 9 aa, Plasmodium falciparum
NKTNINDKI

SEQ ID NO: 3238278 - protein, 18 aa, Plasmodium falciparum
NKTNISNNSYNNHNNNNN

SEQ ID NO: 3238279 - protein, 8 aa, Plasmodium falciparum
NKTNKDPM

SEQ ID NO: 3238280 - protein, 8 aa, Plasmodium falciparum
NKTNKQID

SEQ ID NO: 3238281 - protein, 8 aa, Plasmodium falciparum
NKTNKTNK

SEQ ID NO: 3238282 - protein, 7 aa, Plasmodium falciparum
NKTNPHN

SEQ ID NO: 3238283 - protein, 30 aa, Plasmodium falciparum
NKTNSYISDNNSNNNNNNNNNDNDTNEKKT

SEQ ID NO: 3238284 - protein, 8 aa, Plasmodium falciparum
NKTNTKNM

SEQ ID NO: 3238285 - protein, 11 aa, Plasmodium falciparum
NKTNVDKNQNK

SEQ ID NO: 3238286 - protein, 5 aa, Plasmodium falciparum
NKTPY

SEQ ID NO: 3238287 - protein, 4 aa, Plasmodium falciparum
NKTQ

SEQ ID NO: 3238288 - protein, 8 aa, Plasmodium falciparum
NKTQPQNV

SEQ ID NO: 3238289 - protein, 7 aa, Plasmodium falciparum
NKTQSTN

SEQ ID NO: 3238290 - protein, 14 aa, Plasmodium falciparum
NKTQTNESNNKREI

SEQ ID NO: 3238291 - protein, 7 aa, Plasmodium falciparum
NKTSEIK

SEQ ID NO: 3238292 - protein, 12 aa, Plasmodium falciparum
NKTSKGSESTNY

SEQ ID NO: 3238293 - protein, 7 aa, Plasmodium falciparum
NKTSKKF

SEQ ID NO: 3238294 - protein, 9 aa, Plasmodium falciparum
NKTSQEQLN

SEQ ID NO: 3238295 - protein, 6 aa, Plasmodium falciparum
NKTSTS

SEQ ID NO: 3238296 - protein, 4 aa, Plasmodium falciparum
NKTT

SEQ ID NO: 3238297 - protein, 5 aa, Plasmodium falciparum
NKTTI

SEQ ID NO: 3238298 - protein, 6 aa, Plasmodium falciparum
NKTTNK

SEQ ID NO: 3238299 - protein, 7 aa, Plasmodium falciparum
NKTTNNI

SEQ ID NO: 3238300 - protein, 10 aa, Plasmodium falciparum
NKTTNYEKSA

SEQ ID NO: 3238301 - protein, 7 aa, Plasmodium falciparum
NKTTYSS

SEQ ID NO: 3238302 - protein, 5 aa, Plasmodium falciparum
NKTVV

SEQ ID NO: 3238303 - protein, 7 aa, Plasmodium falciparum
NKTYDNG

SEQ ID NO: 3238304 - protein, 6 aa, Plasmodium falciparum
NKTYNK

SEQ ID NO: 3238305 - protein, 13 aa, Plasmodium falciparum
NKTYSVEKQHGNH

SEQ ID NO: 3238306 - protein, 5 aa, Plasmodium falciparum
NKVDE

SEQ ID NO: 3238307 - protein, 25 aa, Plasmodium falciparum
NKVDSNKSNNNNNNNNKMKKNSCGS

SEQ ID NO: 3238308 - protein, 6 aa, Plasmodium falciparum
NKVESI

SEQ ID NO: 3238309 - protein, 11 aa, Plasmodium falciparum
NKVGSDNNRNK

SEQ ID NO: 3238310 - protein, 4 aa, Plasmodium falciparum
NKVH

SEQ ID NO: 3238311 - protein, 29 aa, Plasmodium falciparum
NKVNTTNNAPNEIKSNTDNGVNNTTYATT

SEQ ID NO: 3238312 - protein, 21 aa, Plasmodium falciparum
NKVNTTNNAPNEIKSNTYDDM

SEQ ID NO: 3238313 - protein, 12 aa, Plasmodium falciparum
NKVNTTNNAPNV

SEQ ID NO: 3238314 - protein, 13 aa, Plasmodium falciparum
NKVNTTNNTPNEI

SEQ ID NO: 3238315 - protein, 5 aa, Plasmodium falciparum
NKVTG

SEQ ID NO: 3238316 - protein, 45 aa, Plasmodium falciparum
NKVTKEDTKSNNVSPKNEINKSNVKRERESEQYEISSENDTVSSK

SEQ ID NO: 3238317 - protein, 9 aa, Plasmodium falciparum
NKVTNDELK

SEQ ID NO: 3238318 - protein, 11 aa, Plasmodium falciparum
NKVTNKTNTHK

SEQ ID NO: 3238319 - protein, 4 aa, Plasmodium falciparum
NKWE

SEQ ID NO: 3238320 - protein, 5 aa, Plasmodium falciparum
NKWEQ

SEQ ID NO: 3238321 - protein, 4 aa, Plasmodium falciparum
NKWT

SEQ ID NO: 3238322 - protein, 6 aa, Plasmodium falciparum
NKYADE

SEQ ID NO: 3238323 - protein, 12 aa, Plasmodium falciparum
NKYCNDKNKDLD

SEQ ID NO: 3238324 - protein, 70 aa, Plasmodium falciparum
NKYDDNKDDHNKDDHNKDDHNKDDDNKDDDNNYDANKDDDNKDDDNNYDDNNYDDNNYDDNNYDDNNYDD

SEQ ID NO: 3238325 - protein, 9 aa, Plasmodium falciparum
NKYDDSGST

SEQ ID NO: 3238326 - protein, 7 aa, Plasmodium falciparum
NKYDEYK

SEQ ID NO: 3238327 - protein, 21 aa, Plasmodium falciparum
NKYDKEKEKNNDTTKTTRYGP

SEQ ID NO: 3238328 - protein, 20 aa, Plasmodium falciparum
NKYDNGYKNRIPNKQEEDEI

SEQ ID NO: 3238329 - protein, 6 aa, Plasmodium falciparum
NKYDNY

SEQ ID NO: 3238330 - protein, 16 aa, Plasmodium falciparum
NKYDPDVSGASTPTAD

SEQ ID NO: 3238331 - protein, 5 aa, Plasmodium falciparum
NKYDQ

SEQ ID NO: 3238332 - protein, 9 aa, Plasmodium falciparum
NKYDSEIKN

SEQ ID NO: 3238333 - protein, 21 aa, Plasmodium falciparum
NKYDTNVGPYGKSLSGGQKQR

SEQ ID NO: 3238334 - protein, 6 aa, Plasmodium falciparum
NKYDTY

SEQ ID NO: 3238335 - protein, 12 aa, Plasmodium falciparum
NKYEEDEKRKGI

SEQ ID NO: 3238336 - protein, 15 aa, Plasmodium falciparum
NKYEKNDKNDNRGEM

SEQ ID NO: 3238337 - protein, 10 aa, Plasmodium falciparum
NKYENDDDEA

SEQ ID NO: 3238338 - protein, 9 aa, Plasmodium falciparum
NKYENKNKC

SEQ ID NO: 3238339 - protein, 6 aa, Plasmodium falciparum
NKYENT

SEQ ID NO: 3238340 - protein, 30 aa, Plasmodium falciparum
NKYETEISNSGSCGGSGGVKGSSRKTRAAT

SEQ ID NO: 3238341 - protein, 13 aa, Plasmodium falciparum
NKYETEKKDNAYE

SEQ ID NO: 3238342 - protein, 5 aa, Plasmodium falciparum
NKYGD

SEQ ID NO: 3238343 - protein, 14 aa, Plasmodium falciparum
NKYGKYKNNNNNNS

SEQ ID NO: 3238344 - protein, 5 aa, Plasmodium falciparum
NKYIN

SEQ ID NO: 3238345 - protein, 6 aa, Plasmodium falciparum
NKYKQN

SEQ ID NO: 3238346 - protein, 18 aa, Plasmodium falciparum
NKYKSNLSNNKRIKSKNK

SEQ ID NO: 3238347 - protein, 10 aa, Plasmodium falciparum
NKYKSSDHNI

SEQ ID NO: 3238348 - protein, 5 aa, Plasmodium falciparum
NKYND

SEQ ID NO: 3238349 - protein, 13 aa, Plasmodium falciparum
NKYNEDNKNYKEN

SEQ ID NO: 3238350 - protein, 9 aa, Plasmodium falciparum
NKYNNDKNL

SEQ ID NO: 3238351 - protein, 7 aa, Plasmodium falciparum
NKYNNNM

SEQ ID NO: 3238352 - protein, 13 aa, Plasmodium falciparum
NKYNNNNNNNNIP

SEQ ID NO: 3238353 - protein, 16 aa, Plasmodium falciparum
NKYNNNNNNNNKYNNK

SEQ ID NO: 3238354 - protein, 12 aa, Plasmodium falciparum
NKYNNNNNYYKG

SEQ ID NO: 3238355 - protein, 19 aa, Plasmodium falciparum
NKYNNYNKYNNYNKYNNYN

SEQ ID NO: 3238356 - protein, 14 aa, Plasmodium falciparum
NKYNREANTNNDDK

SEQ ID NO: 3238357 - protein, 22 aa, Plasmodium falciparum
NKYQDSDSHSDNINDDDDDEDI

SEQ ID NO: 3238358 - protein, 26 aa, Plasmodium falciparum
NKYQNEISSNSRKKRSTSNNNYKGYD

SEQ ID NO: 3238359 - protein, 24 aa, Plasmodium falciparum
NKYQTEIPVNGRKRRSTTSNYKGY

SEQ ID NO: 3238360 - protein, 26 aa, Plasmodium falciparum
NKYQTEISGGGASGGASGRSRKTRAA

SEQ ID NO: 3238361 - protein, 8 aa, Plasmodium falciparum
NKYSDSHN

SEQ ID NO: 3238362 - protein, 16 aa, Plasmodium falciparum
NKYSDSSEIGSSPSFC

SEQ ID NO: 3238363 - protein, 8 aa, Plasmodium falciparum
NKYSKDSN

SEQ ID NO: 3238364 - protein, 6 aa, Plasmodium falciparum
NKYSNN

SEQ ID NO: 3238365 - protein, 8 aa, Plasmodium falciparum
NKYSPSDV

SEQ ID NO: 3238366 - protein, 4 aa, Plasmodium falciparum
NKYT

SEQ ID NO: 3238367 - protein, 29 aa, Plasmodium falciparum
NKYTEEINGTSTSSRTRRSARGGSDHKGY

SEQ ID NO: 3238368 - protein, 7 aa, Plasmodium falciparum
NKYTKEM

SEQ ID NO: 3238369 - protein, 20 aa, Plasmodium falciparum
NKYTNSQDSVNYSSANTKEM

SEQ ID NO: 3238370 - protein, 5 aa, Plasmodium falciparum
NKYTS

SEQ ID NO: 3238371 - protein, 7 aa, Plasmodium falciparum
NKYTSMD

SEQ ID NO: 3238372 - protein, 4 aa, Plasmodium falciparum
NKYV

SEQ ID NO: 3238373 - protein, 6 aa, Plasmodium falciparum
NKYVPG

SEQ ID NO: 3238374 - protein, 10 aa, Plasmodium falciparum
NLDDKNNHNF

SEQ ID NO: 3238375 - protein, 7 aa, Plasmodium falciparum
NLDDNDK

SEQ ID NO: 3238376 - protein, 10 aa, Plasmodium falciparum
NLDEQNRDET

SEQ ID NO: 3238377 - protein, 5 aa, Plasmodium falciparum
NLDES

SEQ ID NO: 3238378 - protein, 8 aa, Plasmodium falciparum
NLDESVSK

SEQ ID NO: 3238379 - protein, 10 aa, Plasmodium falciparum
NLDKGDTKDK

SEQ ID NO: 3238380 - protein, 8 aa, Plasmodium falciparum
NLDKRDEQ

SEQ ID NO: 3238381 - protein, 16 aa, Plasmodium falciparum
NLDNEDDEKKKKKKKK

SEQ ID NO: 3238382 - protein, 17 aa, Plasmodium falciparum
NLDQENDTNQNKKGYVT

SEQ ID NO: 3238383 - protein, 7 aa, Plasmodium falciparum
NLDRDNN

SEQ ID NO: 3238384 - protein, 92 aa, Plasmodium falciparum
NLDSNDNNINSNDNNINNNDNNLNNNHNKLNNNDNNINNNDNNINNNNNNLNNNDNNLNNNNNNLNNNDNNLNNNDNNLNNNDQNKDTHDYS

SEQ ID NO: 3238385 - protein, 5 aa, Plasmodium falciparum
NLDTK

SEQ ID NO: 3238386 - protein, 4 aa, Plasmodium falciparum
NLED

SEQ ID NO: 3238387 - protein, 132 aa, Plasmodium falciparum
NLEDNNEDISNHDKEKDNNNKKDDDDNKKDDDNKIDDDNKIDDDDNKIDDDNKIDDDDNKIDDDDNKIDDDDNKIDDDDNKKDDDDNKKDDDNKIDDDNKKDDDDNKKDDNNYDNNDECDDDNKKDDNNYDN

SEQ ID NO: 3238388 - protein, 10 aa, Plasmodium falciparum
NLEEKEGNHI

SEQ ID NO: 3238389 - protein, 8 aa, Plasmodium falciparum
NLEEKKKT

SEQ ID NO: 3238390 - protein, 4 aa, Plasmodium falciparum
NLEN

SEQ ID NO: 3238391 - protein, 13 aa, Plasmodium falciparum
NLENKEKCTSCNT

SEQ ID NO: 3238392 - protein, 5 aa, Plasmodium falciparum
NLENS

SEQ ID NO: 3238393 - protein, 5 aa, Plasmodium falciparum
NLERN

SEQ ID NO: 3238394 - protein, 5 aa, Plasmodium falciparum
NLESQ

SEQ ID NO: 3238395 - protein, 6 aa, Plasmodium falciparum
NLESTN

SEQ ID NO: 3238396 - protein, 10 aa, Plasmodium falciparum
NLHNKKKKKE

SEQ ID NO: 3238397 - protein, 8 aa, Plasmodium falciparum
NLHSKSTD

SEQ ID NO: 3238398 - protein, 4 aa, Plasmodium falciparum
NLKD

SEQ ID NO: 3238399 - protein, 5 aa, Plasmodium falciparum
NLKEE

SEQ ID NO: 3238400 - protein, 5 aa, Plasmodium falciparum
NLKEK

SEQ ID NO: 3238401 - protein, 11 aa, Plasmodium falciparum
NLKEKRNSSND

SEQ ID NO: 3238402 - protein, 8 aa, Plasmodium falciparum
NLKENEAA

SEQ ID NO: 3238403 - protein, 8 aa, Plasmodium falciparum
NLKEQKEK

SEQ ID NO: 3238404 - protein, 8 aa, Plasmodium falciparum
NLKGNENR

SEQ ID NO: 3238405 - protein, 4 aa, Plasmodium falciparum
NLKK

SEQ ID NO: 3238406 - protein, 9 aa, Plasmodium falciparum
NLKKDNASN

SEQ ID NO: 3238407 - protein, 8 aa, Plasmodium falciparum
NLKKEAQE

SEQ ID NO: 3238408 - protein, 22 aa, Plasmodium falciparum
NLKKENELKNGIPYNNKYDKTN

SEQ ID NO: 3238409 - protein, 15 aa, Plasmodium falciparum
NLKKGKDKKLKEYSE

SEQ ID NO: 3238410 - protein, 10 aa, Plasmodium falciparum
NLKKKEPNKA

SEQ ID NO: 3238411 - protein, 9 aa, Plasmodium falciparum
NLKKQKENK

SEQ ID NO: 3238412 - protein, 12 aa, Plasmodium falciparum
NLKNAKRTWFPW

SEQ ID NO: 3238413 - protein, 10 aa, Plasmodium falciparum
NLKNEEDNKT

SEQ ID NO: 3238414 - protein, 10 aa, Plasmodium falciparum
NLKNEEKLER

SEQ ID NO: 3238415 - protein, 8 aa, Plasmodium falciparum
NLKNGDEY

SEQ ID NO: 3238416 - protein, 7 aa, Plasmodium falciparum
NLKNNEE

SEQ ID NO: 3238417 - protein, 8 aa, Plasmodium falciparum
NLKNQKKN

SEQ ID NO: 3238418 - protein, 4 aa, Plasmodium falciparum
NLKR

SEQ ID NO: 3238419 - protein, 15 aa, Plasmodium falciparum
NLKRKKKKREKANRN

SEQ ID NO: 3238420 - protein, 22 aa, Plasmodium falciparum
NLKYEEKKKIRTNNKMNNSTNY

SEQ ID NO: 3238421 - protein, 4 aa, Plasmodium falciparum
NLLG

SEQ ID NO: 3238422 - protein, 10 aa, Plasmodium falciparum
NLMNNSDKGN

SEQ ID NO: 3238423 - protein, 19 aa, Plasmodium falciparum
NLNDDTNRAYNNNNNNNES

SEQ ID NO: 3238424 - protein, 15 aa, Plasmodium falciparum
NLNDHEKENKNKQDK

SEQ ID NO: 3238425 - protein, 16 aa, Plasmodium falciparum
NLNEENNMKSKMDETE

SEQ ID NO: 3238426 - protein, 11 aa, Plasmodium falciparum
NLNEKIKNTSN

SEQ ID NO: 3238427 - protein, 5 aa, Plasmodium falciparum
NLNES

SEQ ID NO: 3238428 - protein, 7 aa, Plasmodium falciparum
NLNGNHN

SEQ ID NO: 3238429 - protein, 11 aa, Plasmodium falciparum
NLNKKTENLKK

SEQ ID NO: 3238430 - protein, 52 aa, Plasmodium falciparum
NLNNDELEKEKTNKKNDKNNNKNDKNNKKNDNTNKTKDENNKKSDKTGMEGN

SEQ ID NO: 3238431 - protein, 16 aa, Plasmodium falciparum
NLNNDGKTNSKSKFAK

SEQ ID NO: 3238432 - protein, 14 aa, Plasmodium falciparum
NLNNGKDDKKYSRN

SEQ ID NO: 3238433 - protein, 5 aa, Plasmodium falciparum
NLNNK

SEQ ID NO: 3238434 - protein, 6 aa, Plasmodium falciparum
NLNNKE

SEQ ID NO: 3238435 - protein, 5 aa, Plasmodium falciparum
NLNNN

SEQ ID NO: 3238436 - protein, 8 aa, Plasmodium falciparum
NLNNNDNN

SEQ ID NO: 3238437 - protein, 7 aa, Plasmodium falciparum
NLNNNND

SEQ ID NO: 3238438 - protein, 6 aa, Plasmodium falciparum
NLNNNS

SEQ ID NO: 3238439 - protein, 5 aa, Plasmodium falciparum
NLNNP

SEQ ID NO: 3238440 - protein, 10 aa, Plasmodium falciparum
NLNNQEEKKH

SEQ ID NO: 3238441 - protein, 10 aa, Plasmodium falciparum
NLNNSNDKDN

SEQ ID NO: 3238442 - protein, 4 aa, Plasmodium falciparum
NLNQ

SEQ ID NO: 3238443 - protein, 5 aa, Plasmodium falciparum
NLNQG

SEQ ID NO: 3238444 - protein, 13 aa, Plasmodium falciparum
NLNQNKKESENIT

SEQ ID NO: 3238445 - protein, 23 aa, Plasmodium falciparum
NLNQTDKKNDDKNIDEKVNESLE

SEQ ID NO: 3238446 - protein, 41 aa, Plasmodium falciparum
NLNTKENELNLPNNAENENQSNIPTNTNDARQRNRTESDVK

SEQ ID NO: 3238447 - protein, 14 aa, Plasmodium falciparum
NLNTKNSISNKLSK

SEQ ID NO: 3238448 - protein, 14 aa, Plasmodium falciparum
NLNTNSKGLSDGTL

SEQ ID NO: 3238449 - protein, 5 aa, Plasmodium falciparum
NLNTP

SEQ ID NO: 3238450 - protein, 4 aa, Plasmodium falciparum
NLNY

SEQ ID NO: 3238451 - protein, 5 aa, Plasmodium falciparum
NLPDN

SEQ ID NO: 3238452 - protein, 6 aa, Plasmodium falciparum
NLPEDT

SEQ ID NO: 3238453 - protein, 5 aa, Plasmodium falciparum
NLPEQ

SEQ ID NO: 3238454 - protein, 9 aa, Plasmodium falciparum
NLPKKDKSL

SEQ ID NO: 3238455 - protein, 10 aa, Plasmodium falciparum
NLPLGDAKGV

SEQ ID NO: 3238456 - protein, 29 aa, Plasmodium falciparum
NLPNKNINTRNLADTRSEEDEKQNEAVGG

SEQ ID NO: 3238457 - protein, 27 aa, Plasmodium falciparum
NLPNNNNNNKVKGQQYNHQTENKNKNK

SEQ ID NO: 3238458 - protein, 22 aa, Plasmodium falciparum
NLPNNNNNNNNMKGSYNNEKNN

SEQ ID NO: 3238459 - protein, 17 aa, Plasmodium falciparum
NLPNVDEHKRDEKNNNV

SEQ ID NO: 3238460 - protein, 9 aa, Plasmodium falciparum
NLPSEEEKE

SEQ ID NO: 3238461 - protein, 8 aa, Plasmodium falciparum
NLPTEPFK

SEQ ID NO: 3238462 - protein, 14 aa, Plasmodium falciparum
NLPYNTNTEEDVDS

SEQ ID NO: 3238463 - protein, 5 aa, Plasmodium falciparum
NLPYS

SEQ ID NO: 3238464 - protein, 12 aa, Plasmodium falciparum
NLQDKQKRPYTH

SEQ ID NO: 3238465 - protein, 8 aa, Plasmodium falciparum
NLQKAKGI

SEQ ID NO: 3238466 - protein, 6 aa, Plasmodium falciparum
NLQKNQ

SEQ ID NO: 3238467 - protein, 21 aa, Plasmodium falciparum
NLQNDNNLDNDSTSDTDNTSY

SEQ ID NO: 3238468 - protein, 16 aa, Plasmodium falciparum
NLQNGNIRDNHDTRIN

SEQ ID NO: 3238469 - protein, 9 aa, Plasmodium falciparum
NLQNNKNHF

SEQ ID NO: 3238470 - protein, 12 aa, Plasmodium falciparum
NLQSKNEKLTNT

SEQ ID NO: 3238471 - protein, 4 aa, Plasmodium falciparum
NLQT

SEQ ID NO: 3238472 - protein, 7 aa, Plasmodium falciparum
NLQTNNN

SEQ ID NO: 3238473 - protein, 5 aa, Plasmodium falciparum
NLREK

SEQ ID NO: 3238474 - protein, 9 aa, Plasmodium falciparum
NLRKDDNDI

SEQ ID NO: 3238475 - protein, 5 aa, Plasmodium falciparum
NLRKK

SEQ ID NO: 3238476 - protein, 4 aa, Plasmodium falciparum
NLRN

SEQ ID NO: 3238477 - protein, 10 aa, Plasmodium falciparum
NLRNEDPSDI

SEQ ID NO: 3238478 - protein, 16 aa, Plasmodium falciparum
NLSDKENNKSDPSSNH

SEQ ID NO: 3238479 - protein, 10 aa, Plasmodium falciparum
NLSDKGDDTA

SEQ ID NO: 3238480 - protein, 14 aa, Plasmodium falciparum
NLSESQENHNSSFT

SEQ ID NO: 3238481 - protein, 5 aa, Plasmodium falciparum
NLSKK

SEQ ID NO: 3238482 - protein, 9 aa, Plasmodium falciparum
NLSKNDSID

SEQ ID NO: 3238483 - protein, 88 aa, Plasmodium falciparum
NLSKNKQSGNSMGKYKPDNDDDNKEDNKEDSKDYNKDDNKDDNNDNNNDNNNDNNNDNNNDNNNDNNNDNNNDNNNDHHNDHNNDNNN

SEQ ID NO: 3238484 - protein, 10 aa, Plasmodium falciparum
NLSKSSPRAV

SEQ ID NO: 3238485 - protein, 10 aa, Plasmodium falciparum
NLSNLQNKGL

SEQ ID NO: 3238486 - protein, 33 aa, Plasmodium falciparum
NLSNNNNDNNNDYDNDNNNNNNYSYDNKNDDNI

SEQ ID NO: 3238487 - protein, 5 aa, Plasmodium falciparum
NLSNR

SEQ ID NO: 3238488 - protein, 5 aa, Plasmodium falciparum
NLSRE

SEQ ID NO: 3238489 - protein, 5 aa, Plasmodium falciparum
NLSSC

SEQ ID NO: 3238490 - protein, 17 aa, Plasmodium falciparum
NLSSEVKNAYPDDGSGN

SEQ ID NO: 3238491 - protein, 9 aa, Plasmodium falciparum
NLSSKEPSL

SEQ ID NO: 3238492 - protein, 8 aa, Plasmodium falciparum
NLSSNISN

SEQ ID NO: 3238493 - protein, 6 aa, Plasmodium falciparum
NLSSNK

SEQ ID NO: 3238494 - protein, 12 aa, Plasmodium falciparum
NLSSTSEVSSNN

SEQ ID NO: 3238495 - protein, 22 aa, Plasmodium falciparum
NLSYNEKRHNNNSDNNNDRNMK

SEQ ID NO: 3238496 - protein, 15 aa, Plasmodium falciparum
NLTADEKRKQLLKEI

SEQ ID NO: 3238497 - protein, 6 aa, Plasmodium falciparum
NLTDNN

SEQ ID NO: 3238498 - protein, 5 aa, Plasmodium falciparum
NLTEK

SEQ ID NO: 3238499 - protein, 8 aa, Plasmodium falciparum
NLTKKEEL

SEQ ID NO: 3238500 - protein, 10 aa, Plasmodium falciparum
NLTKQGSVHN

SEQ ID NO: 3238501 - protein, 13 aa, Plasmodium falciparum
NLTKSEVKQKYKN

SEQ ID NO: 3238502 - protein, 5 aa, Plasmodium falciparum
NLTKT

SEQ ID NO: 3238503 - protein, 9 aa, Plasmodium falciparum
NLTPTQDNI

SEQ ID NO: 3238504 - protein, 25 aa, Plasmodium falciparum
NLTQADYNNNNNNNKTQRKGKQIDN

SEQ ID NO: 3238505 - protein, 4 aa, Plasmodium falciparum
NLTS

SEQ ID NO: 3238506 - protein, 6 aa, Plasmodium falciparum
NLTSSE

SEQ ID NO: 3238507 - protein, 27 aa, Plasmodium falciparum
NLTSSSKNASKETKNKDIPNVTNDNTC

SEQ ID NO: 3238508 - protein, 12 aa, Plasmodium falciparum
NLTTPQKKKRKH

SEQ ID NO: 3238509 - protein, 4 aa, Plasmodium falciparum
NLVS

SEQ ID NO: 3238510 - protein, 18 aa, Plasmodium falciparum
NLYDSNKSKTYEKDGTKV

SEQ ID NO: 3238511 - protein, 6 aa, Plasmodium falciparum
NLYEEE

SEQ ID NO: 3238512 - protein, 5 aa, Plasmodium falciparum
NLYGD

SEQ ID NO: 3238513 - protein, 16 aa, Plasmodium falciparum
NLYGSNNDDNNKTNQR

SEQ ID NO: 3238514 - protein, 8 aa, Plasmodium falciparum
NLYKKKKK

SEQ ID NO: 3238515 - protein, 16 aa, Plasmodium falciparum
NLYNSGYNSKPSGNLY

SEQ ID NO: 3238516 - protein, 33 aa, Plasmodium falciparum
NMDEKKNEDYTNDNLNDNKNSNTNNKEKEDTNN

SEQ ID NO: 3238517 - protein, 5 aa, Plasmodium falciparum
NMDEN

SEQ ID NO: 3238518 - protein, 29 aa, Plasmodium falciparum
NMDENNKNVTFSNNDNNNNNGDKKQKSIN

SEQ ID NO: 3238519 - protein, 19 aa, Plasmodium falciparum
NMDGKKNGKVDTKKDEIKN

SEQ ID NO: 3238520 - protein, 6 aa, Plasmodium falciparum
NMDKAT

SEQ ID NO: 3238521 - protein, 9 aa, Plasmodium falciparum
NMDNENNMN

SEQ ID NO: 3238522 - protein, 16 aa, Plasmodium falciparum
NMDNSNKNSNNNNNYY

SEQ ID NO: 3238523 - protein, 13 aa, Plasmodium falciparum
NMDTNNNDGKAKH

SEQ ID NO: 3238524 - protein, 25 aa, Plasmodium falciparum
NMEDRKSKEEGDNNNDHYKEEESCE

SEQ ID NO: 3238525 - protein, 9 aa, Plasmodium falciparum
NMEETKETL

SEQ ID NO: 3238526 - protein, 17 aa, Plasmodium falciparum
NMEKDDKGKFNKTDQTN

SEQ ID NO: 3238527 - protein, 23 aa, Plasmodium falciparum
NMEKDTCPSDENVSVDNESDVNK

SEQ ID NO: 3238528 - protein, 9 aa, Plasmodium falciparum
NMEKELSEK

SEQ ID NO: 3238529 - protein, 5 aa, Plasmodium falciparum
NMEKK

SEQ ID NO: 3238530 - protein, 9 aa, Plasmodium falciparum
NMEKKEKEN

SEQ ID NO: 3238531 - protein, 20 aa, Plasmodium falciparum
NMEKKNKGKNIKKNRNKKIY

SEQ ID NO: 3238532 - protein, 5 aa, Plasmodium falciparum
NMEND

SEQ ID NO: 3238533 - protein, 17 aa, Plasmodium falciparum
NMENNDDKKNKRNNKHN

SEQ ID NO: 3238534 - protein, 7 aa, Plasmodium falciparum
NMENNQD

SEQ ID NO: 3238535 - protein, 34 aa, Plasmodium falciparum
NMENSESQSENEYASGNENENENESESENGHSDV

SEQ ID NO: 3238536 - protein, 9 aa, Plasmodium falciparum
NMEQTSEKH

SEQ ID NO: 3238537 - protein, 19 aa, Plasmodium falciparum
NMGESKKYDIYDDKENVKR

SEQ ID NO: 3238538 - protein, 13 aa, Plasmodium falciparum
NMGNKKSKKGKDI

SEQ ID NO: 3238539 - protein, 11 aa, Plasmodium falciparum
NMGNQDNEGNK

SEQ ID NO: 3238540 - protein, 12 aa, Plasmodium falciparum
NMGSSNRMGTSP

SEQ ID NO: 3238541 - protein, 11 aa, Plasmodium falciparum
NMIKSKEKGQI

SEQ ID NO: 3238542 - protein, 6 aa, Plasmodium falciparum
NMINNP

SEQ ID NO: 3238543 - protein, 14 aa, Plasmodium falciparum
NMISPNDRSSINKG

SEQ ID NO: 3238544 - protein, 13 aa, Plasmodium falciparum
NMKDNLSNNDTNH

SEQ ID NO: 3238545 - protein, 4 aa, Plasmodium falciparum
NMKE

SEQ ID NO: 3238546 - protein, 19 aa, Plasmodium falciparum
NMKEKKNNRELDKRESNSI

SEQ ID NO: 3238547 - protein, 12 aa, Plasmodium falciparum
NMKKKGKTKMNQ

SEQ ID NO: 3238548 - protein, 16 aa, Plasmodium falciparum
NMKKNNNKNEEKYKDK

SEQ ID NO: 3238549 - protein, 8 aa, Plasmodium falciparum
NMKNEGNY

SEQ ID NO: 3238550 - protein, 8 aa, Plasmodium falciparum
NMKNEKIS

SEQ ID NO: 3238551 - protein, 9 aa, Plasmodium falciparum
NMKNKKKKS

SEQ ID NO: 3238552 - protein, 14 aa, Plasmodium falciparum
NMKPEKDKSKYNNI

SEQ ID NO: 3238553 - protein, 8 aa, Plasmodium falciparum
NMKRNRKK

SEQ ID NO: 3238554 - protein, 10 aa, Plasmodium falciparum
NMMENEGNKV

SEQ ID NO: 3238555 - protein, 18 aa, Plasmodium falciparum
NMMNKEEKNTNERKEQLK

SEQ ID NO: 3238556 - protein, 4 aa, Plasmodium falciparum
NMND

SEQ ID NO: 3238557 - protein, 11 aa, Plasmodium falciparum
NMNDDKKYNNL

SEQ ID NO: 3238558 - protein, 20 aa, Plasmodium falciparum
NMNDQDSDETFEDNKDSLTE

SEQ ID NO: 3238559 - protein, 5 aa, Plasmodium falciparum
NMNDT

SEQ ID NO: 3238560 - protein, 4 aa, Plasmodium falciparum
NMNE

SEQ ID NO: 3238561 - protein, 38 aa, Plasmodium falciparum
NMNEEEKYNKDNKDKENQINSNGQDENTEFQENDNNDS

SEQ ID NO: 3238562 - protein, 14 aa, Plasmodium falciparum
NMNEENNNINNNND

SEQ ID NO: 3238563 - protein, 11 aa, Plasmodium falciparum
NMNEKNNSAVN

SEQ ID NO: 3238564 - protein, 23 aa, Plasmodium falciparum
NMNESKSFNKDDLQRNNSTQHNN

SEQ ID NO: 3238565 - protein, 5 aa, Plasmodium falciparum
NMNGD

SEQ ID NO: 3238566 - protein, 19 aa, Plasmodium falciparum
NMNGGNFKNPNSYNNNNNM

SEQ ID NO: 3238567 - protein, 37 aa, Plasmodium falciparum
NMNNKNEEFDQGLSNKKEIKKKNNKIIKKNKKKKKIN

SEQ ID NO: 3238568 - protein, 13 aa, Plasmodium falciparum
NMNNNKNAQSSKM

SEQ ID NO: 3238569 - protein, 12 aa, Plasmodium falciparum
NMNNNNNINGCG

SEQ ID NO: 3238570 - protein, 56 aa, Plasmodium falciparum
NMNNNNNNNNNNNNNNNNNNNNNNNNNNNNNNNNNNNNLNSIGGSKNTMTDGKKKN

SEQ ID NO: 3238571 - protein, 11 aa, Plasmodium falciparum
NMNNNNTGNYN

SEQ ID NO: 3238572 - protein, 5 aa, Plasmodium falciparum
NMNNQ

SEQ ID NO: 3238573 - protein, 19 aa, Plasmodium falciparum
NMNNTKNTNNHNNNNNNNN

SEQ ID NO: 3238574 - protein, 11 aa, Plasmodium falciparum
NMNPDNLKEKQ

SEQ ID NO: 3238575 - protein, 5 aa, Plasmodium falciparum
NMNRE

SEQ ID NO: 3238576 - protein, 20 aa, Plasmodium falciparum
NMNRGKKNDHNDDNDDNNKN

SEQ ID NO: 3238577 - protein, 7 aa, Plasmodium falciparum
NMNRNSL

SEQ ID NO: 3238578 - protein, 8 aa, Plasmodium falciparum
NMNRTSNI

SEQ ID NO: 3238579 - protein, 6 aa, Plasmodium falciparum
NMNSDI

SEQ ID NO: 3238580 - protein, 29 aa, Plasmodium falciparum
NMNSDNNNINSNNINSNINNNNNNNTKLN

SEQ ID NO: 3238581 - protein, 7 aa, Plasmodium falciparum
NMNSGEL

SEQ ID NO: 3238582 - protein, 19 aa, Plasmodium falciparum
NMNSNGKDNINDSINESIE

SEQ ID NO: 3238583 - protein, 10 aa, Plasmodium falciparum
NMNSSGDNSF

SEQ ID NO: 3238584 - protein, 7 aa, Plasmodium falciparum
NMNSSNN

SEQ ID NO: 3238585 - protein, 8 aa, Plasmodium falciparum
NMNSYDDD

SEQ ID NO: 3238586 - protein, 13 aa, Plasmodium falciparum
NMPSKDAHPDLYP

SEQ ID NO: 3238587 - protein, 6 aa, Plasmodium falciparum
NMPSQV

SEQ ID NO: 3238588 - protein, 12 aa, Plasmodium falciparum
NMPTARSPNRYV

SEQ ID NO: 3238589 - protein, 28 aa, Plasmodium falciparum
NMQGQRKKKNNVAYDTYDNNDIHASSQY

SEQ ID NO: 3238590 - protein, 4 aa, Plasmodium falciparum
NMQQ

SEQ ID NO: 3238591 - protein, 28 aa, Plasmodium falciparum
NMQSQSKDNYASEQNVADQSTDNYPTQH

SEQ ID NO: 3238592 - protein, 4 aa, Plasmodium falciparum
NMRE

SEQ ID NO: 3238593 - protein, 8 aa, Plasmodium falciparum
NMRGGAGK

SEQ ID NO: 3238594 - protein, 7 aa, Plasmodium falciparum
NMRKTRA

SEQ ID NO: 3238595 - protein, 13 aa, Plasmodium falciparum
NMRNKGDGSSKEK

SEQ ID NO: 3238596 - protein, 13 aa, Plasmodium falciparum
NMRNNNNNNNNDN

SEQ ID NO: 3238597 - protein, 23 aa, Plasmodium falciparum
NMSDDSSSLKNEDIYENDDNYID

SEQ ID NO: 3238598 - protein, 19 aa, Plasmodium falciparum
NMSDDTNEKLEERKEAGEY

SEQ ID NO: 3238599 - protein, 7 aa, Plasmodium falciparum
NMSNKGS

SEQ ID NO: 3238600 - protein, 6 aa, Plasmodium falciparum
NMSNNM

SEQ ID NO: 3238601 - protein, 7 aa, Plasmodium falciparum
NMSRTNN

SEQ ID NO: 3238602 - protein, 27 aa, Plasmodium falciparum
NMSRTSDMSNSSDSSYVTSPISNEKAN

SEQ ID NO: 3238603 - protein, 9 aa, Plasmodium falciparum
NMSSGQKQR

SEQ ID NO: 3238604 - protein, 17 aa, Plasmodium falciparum
NMSSKKGKKKKKKSVHK

SEQ ID NO: 3238605 - protein, 15 aa, Plasmodium falciparum
NMSTHKNDKKGYNDY

SEQ ID NO: 3238606 - protein, 5 aa, Plasmodium falciparum
NMTSG

SEQ ID NO: 3238607 - protein, 5 aa, Plasmodium falciparum
NMVPE

SEQ ID NO: 3238608 - protein, 9 aa, Plasmodium falciparum
NNADGSDKY

SEQ ID NO: 3238609 - protein, 6 aa, Plasmodium falciparum
NNADNK

SEQ ID NO: 3238610 - protein, 15 aa, Plasmodium falciparum
NNADNNNNNNNIDHK

SEQ ID NO: 3238611 - protein, 25 aa, Plasmodium falciparum
NNAEKKCKENESTNNKMKSSETSCD

SEQ ID NO: 3238612 - protein, 11 aa, Plasmodium falciparum
NNAEKKNNKSL

SEQ ID NO: 3238613 - protein, 7 aa, Plasmodium falciparum
NNAETIN

SEQ ID NO: 3238614 - protein, 7 aa, Plasmodium falciparum
NNAHQKN

SEQ ID NO: 3238615 - protein, 5 aa, Plasmodium falciparum
NNAIN

SEQ ID NO: 3238616 - protein, 6 aa, Plasmodium falciparum
NNAITS

SEQ ID NO: 3238617 - protein, 30 aa, Plasmodium falciparum
NNAKESISTDNTKFEKKQKKKKKKKTNKKK

SEQ ID NO: 3238618 - protein, 11 aa, Plasmodium falciparum
NNAKGTSSKIN

SEQ ID NO: 3238619 - protein, 9 aa, Plasmodium falciparum
NNAKINQDK

SEQ ID NO: 3238620 - protein, 5 aa, Plasmodium falciparum
NNAKK

SEQ ID NO: 3238621 - protein, 7 aa, Plasmodium falciparum
NNAKSSL

SEQ ID NO: 3238622 - protein, 4 aa, Plasmodium falciparum
NNAN

SEQ ID NO: 3238623 - protein, 9 aa, Plasmodium falciparum
NNANEEKPI

SEQ ID NO: 3238624 - protein, 29 aa, Plasmodium falciparum
NNANEHIKNNNDDEKEIYKANKSNNINNN

SEQ ID NO: 3238625 - protein, 15 aa, Plasmodium falciparum
NNANEKTNLASMDNT

SEQ ID NO: 3238626 - protein, 35 aa, Plasmodium falciparum
NNANKNNNVPSGNNPNNQTTNPANNNNNNNNLNKD

SEQ ID NO: 3238627 - protein, 7 aa, Plasmodium falciparum
NNANNMN

SEQ ID NO: 3238628 - protein, 47 aa, Plasmodium falciparum
NNANQTVNNNNNNINKNNIDNNNQNDNNSSKSNNSNNSNNNSNNQHY

SEQ ID NO: 3238629 - protein, 9 aa, Plasmodium falciparum
NNAPINKGA

SEQ ID NO: 3238630 - protein, 17 aa, Plasmodium falciparum
NNAQNNDHNNNNTVGRD

SEQ ID NO: 3238631 - protein, 7 aa, Plasmodium falciparum
NNAQNQN

SEQ ID NO: 3238632 - protein, 30 aa, Plasmodium falciparum
NNATYTTNMSKTTDDKINQKDTYNKTQDEH

SEQ ID NO: 3238633 - protein, 7 aa, Plasmodium falciparum
NNCDNNY

SEQ ID NO: 3238634 - protein, 4 aa, Plasmodium falciparum
NNCE

SEQ ID NO: 3238635 - protein, 6 aa, Plasmodium falciparum
NNCEEI

SEQ ID NO: 3238636 - protein, 9 aa, Plasmodium falciparum
NNCEEKKTK

SEQ ID NO: 3238637 - protein, 5 aa, Plasmodium falciparum
NNCGD

SEQ ID NO: 3238638 - protein, 6 aa, Plasmodium falciparum
NNCHGN

SEQ ID NO: 3238639 - protein, 11 aa, Plasmodium falciparum
NNCKGPKRPFK

SEQ ID NO: 3238640 - protein, 6 aa, Plasmodium falciparum
NNCNNS

SEQ ID NO: 3238641 - protein, 8 aa, Plasmodium falciparum
NNCSSSEE

SEQ ID NO: 3238642 - protein, 12 aa, Plasmodium falciparum
NNCTEIKNSNKK

SEQ ID NO: 3238643 - protein, 8 aa, Plasmodium falciparum
NNCTNKSN

SEQ ID NO: 3238644 - protein, 4 aa, Plasmodium falciparum
NNDA

SEQ ID NO: 3238645 - protein, 15 aa, Plasmodium falciparum
NNDDDDNNNNNNNNN

SEQ ID NO: 3238646 - protein, 9 aa, Plasmodium falciparum
NNDDDEKNK

SEQ ID NO: 3238647 - protein, 95 aa, Plasmodium falciparum
NNDDDINNDDDINNDDDINNDDDINNDDDINNDDDINNDDDINNNDDINNNDDINNDDAKNNDDSKNNDDAKNNDDDINNDDGKNDDDNNITSTK

SEQ ID NO: 3238648 - protein, 6 aa, Plasmodium falciparum
NNDDDL

SEQ ID NO: 3238649 - protein, 10 aa, Plasmodium falciparum
NNDDESQYDN

SEQ ID NO: 3238650 - protein, 13 aa, Plasmodium falciparum
NNDDKIKKNEKDG

SEQ ID NO: 3238651 - protein, 10 aa, Plasmodium falciparum
NNDDKNNVVN

SEQ ID NO: 3238652 - protein, 11 aa, Plasmodium falciparum
NNDDNDNDNMC

SEQ ID NO: 3238653 - protein, 10 aa, Plasmodium falciparum
NNDDNEEESP

SEQ ID NO: 3238654 - protein, 11 aa, Plasmodium falciparum
NNDDNKKKEEI

SEQ ID NO: 3238655 - protein, 46 aa, Plasmodium falciparum
NNDDNKNDDNNNNDNNNNNNNDCNNNNNNDCNNNNNNDCNNNNNND

SEQ ID NO: 3238656 - protein, 28 aa, Plasmodium falciparum
NNDDNNDNNNNNNNNNNNNNNNDNNNEG

SEQ ID NO: 3238657 - protein, 17 aa, Plasmodium falciparum
NNDDNNKNNKDNKKFES

SEQ ID NO: 3238658 - protein, 8 aa, Plasmodium falciparum
NNDDNTTN

SEQ ID NO: 3238659 - protein, 12 aa, Plasmodium falciparum
NNDDYDDDNKSY

SEQ ID NO: 3238660 - protein, 35 aa, Plasmodium falciparum
NNDDYRNQMKNEESDNEQKEKNMDNENNDDEKDNL

SEQ ID NO: 3238661 - protein, 9 aa, Plasmodium falciparum
NNDEETKEI

SEQ ID NO: 3238662 - protein, 8 aa, Plasmodium falciparum
NNDEFEDE

SEQ ID NO: 3238663 - protein, 5 aa, Plasmodium falciparum
NNDEI

SEQ ID NO: 3238664 - protein, 5 aa, Plasmodium falciparum
NNDEK

SEQ ID NO: 3238665 - protein, 6 aa, Plasmodium falciparum
NNDEKD

SEQ ID NO: 3238666 - protein, 7 aa, Plasmodium falciparum
NNDEKKI

SEQ ID NO: 3238667 - protein, 10 aa, Plasmodium falciparum
NNDENNKNEY

SEQ ID NO: 3238668 - protein, 5 aa, Plasmodium falciparum
NNDES

SEQ ID NO: 3238669 - protein, 6 aa, Plasmodium falciparum
NNDETL

SEQ ID NO: 3238670 - protein, 18 aa, Plasmodium falciparum
NNDEVRSDYSIDDKDKKK

SEQ ID NO: 3238671 - protein, 6 aa, Plasmodium falciparum
NNDEYE

SEQ ID NO: 3238672 - protein, 6 aa, Plasmodium falciparum
NNDEYN

SEQ ID NO: 3238673 - protein, 9 aa, Plasmodium falciparum
NNDGMKKSD

SEQ ID NO: 3238674 - protein, 10 aa, Plasmodium falciparum
NNDGTNNSNI

SEQ ID NO: 3238675 - protein, 4 aa, Plasmodium falciparum
NNDH

SEQ ID NO: 3238676 - protein, 11 aa, Plasmodium falciparum
NNDHLSNYADK

SEQ ID NO: 3238677 - protein, 7 aa, Plasmodium falciparum
NNDHNKY

SEQ ID NO: 3238678 - protein, 4 aa, Plasmodium falciparum
NNDI

SEQ ID NO: 3238679 - protein, 8 aa, Plasmodium falciparum
NNDIDKEI

SEQ ID NO: 3238680 - protein, 6 aa, Plasmodium falciparum
NNDIDQ

SEQ ID NO: 3238681 - protein, 19 aa, Plasmodium falciparum
NNDIEKSINNKNQDSTNSM

SEQ ID NO: 3238682 - protein, 7 aa, Plasmodium falciparum
NNDIGNN

SEQ ID NO: 3238683 - protein, 89 aa, Plasmodium falciparum
NNDIKNNDIKNNDIKNNDIKSDDIKSDDIKSDDIKSDDIKSDDIKSDDIKSDDNKSDDIKSDDIKSNDVNNSENSNKFSDDDDYYSSSS

SEQ ID NO: 3238684 - protein, 13 aa, Plasmodium falciparum
NNDINNSEYESMG

SEQ ID NO: 3238685 - protein, 9 aa, Plasmodium falciparum
NNDINSNTL

SEQ ID NO: 3238686 - protein, 9 aa, Plasmodium falciparum
NNDIPNNDI

SEQ ID NO: 3238687 - protein, 11 aa, Plasmodium falciparum
NNDKDNDSNFN

SEQ ID NO: 3238688 - protein, 13 aa, Plasmodium falciparum
NNDKGNETNINQG

SEQ ID NO: 3238689 - protein, 24 aa, Plasmodium falciparum
NNDKHVKNSSNYELKKKKKEKKSC

SEQ ID NO: 3238690 - protein, 5 aa, Plasmodium falciparum
NNDKK

SEQ ID NO: 3238691 - protein, 9 aa, Plasmodium falciparum
NNDKKDNTL

SEQ ID NO: 3238692 - protein, 10 aa, Plasmodium falciparum
NNDKKKINNN

SEQ ID NO: 3238693 - protein, 8 aa, Plasmodium falciparum
NNDKNEQT

SEQ ID NO: 3238694 - protein, 9 aa, Plasmodium falciparum
NNDKNKEDG

SEQ ID NO: 3238695 - protein, 9 aa, Plasmodium falciparum
NNDKNYNKV

SEQ ID NO: 3238696 - protein, 7 aa, Plasmodium falciparum
NNDKQNF

SEQ ID NO: 3238697 - protein, 14 aa, Plasmodium falciparum
NNDKQVKKNEDTKK

SEQ ID NO: 3238698 - protein, 10 aa, Plasmodium falciparum
NNDKSNTSFY

SEQ ID NO: 3238699 - protein, 6 aa, Plasmodium falciparum
NNDKSY

SEQ ID NO: 3238700 - protein, 27 aa, Plasmodium falciparum
NNDKTNVVSKSDDKDKIKNKDKSDEEM

SEQ ID NO: 3238701 - protein, 5 aa, Plasmodium falciparum
NNDKY

SEQ ID NO: 3238702 - protein, 14 aa, Plasmodium falciparum
NNDLPQYEESNKTY

SEQ ID NO: 3238703 - protein, 5 aa, Plasmodium falciparum
NNDLY

SEQ ID NO: 3238704 - protein, 11 aa, Plasmodium falciparum
NNDMKKKDDER

SEQ ID NO: 3238705 - protein, 17 aa, Plasmodium falciparum
NNDMNNNHLDGSNSSNK

SEQ ID NO: 3238706 - protein, 10 aa, Plasmodium falciparum
NNDMNNNNTH

SEQ ID NO: 3238707 - protein, 12 aa, Plasmodium falciparum
NNDMSSKNGVKN

SEQ ID NO: 3238708 - protein, 4 aa, Plasmodium falciparum
NNDN

SEQ ID NO: 3238709 - protein, 41 aa, Plasmodium falciparum
NNDNDGDDNDDDDNDDNDNDDNNNDDNNDDNNDDNNDDNNN

SEQ ID NO: 3238710 - protein, 9 aa, Plasmodium falciparum
NNDNDHSEI

SEQ ID NO: 3238711 - protein, 25 aa, Plasmodium falciparum
NNDNDNNYNNYNNYNNNNNSDFSKS

SEQ ID NO: 3238712 - protein, 22 aa, Plasmodium falciparum
NNDNDRDEDNNKDKDDGNHDNV

SEQ ID NO: 3238713 - protein, 30 aa, Plasmodium falciparum
NNDNIDNNNNNNNNNNIDNNNNNNGDNIYN

SEQ ID NO: 3238714 - protein, 6 aa, Plasmodium falciparum
NNDNIN

SEQ ID NO: 3238715 - protein, 15 aa, Plasmodium falciparum
NNDNINNDNINNEDE

SEQ ID NO: 3238716 - protein, 7 aa, Plasmodium falciparum
NNDNNDE

SEQ ID NO: 3238717 - protein, 11 aa, Plasmodium falciparum
NNDNNKKNDQH

SEQ ID NO: 3238718 - protein, 25 aa, Plasmodium falciparum
NNDNNKNNDNNKNNDNNKNNDNNDD

SEQ ID NO: 3238719 - protein, 11 aa, Plasmodium falciparum
NNDNNKRKNVD

SEQ ID NO: 3238720 - protein, 7 aa, Plasmodium falciparum
NNDNNNN

SEQ ID NO: 3238721 - protein, 39 aa, Plasmodium falciparum
NNDNNNNNNNDDDNNNNDDNDNNNNNNNDDDYSCSSSNS

SEQ ID NO: 3238722 - protein, 11 aa, Plasmodium falciparum
NNDNNNNNNNH

SEQ ID NO: 3238723 - protein, 17 aa, Plasmodium falciparum
NNDNNQENNADKKKDHH

SEQ ID NO: 3238724 - protein, 10 aa, Plasmodium falciparum
NNDNNTKEEL

SEQ ID NO: 3238725 - protein, 9 aa, Plasmodium falciparum
NNDNNVENE

SEQ ID NO: 3238726 - protein, 7 aa, Plasmodium falciparum
NNDNSMR

SEQ ID NO: 3238727 - protein, 20 aa, Plasmodium falciparum
NNDNSSSSNNNNKNNKNNNI

SEQ ID NO: 3238728 - protein, 9 aa, Plasmodium falciparum
NNDNTTNNT

SEQ ID NO: 3238729 - protein, 5 aa, Plasmodium falciparum
NNDNY

SEQ ID NO: 3238730 - protein, 4 aa, Plasmodium falciparum
NNDP

SEQ ID NO: 3238731 - protein, 8 aa, Plasmodium falciparum
NNDPDMNS

SEQ ID NO: 3238732 - protein, 6 aa, Plasmodium falciparum
NNDPTP

SEQ ID NO: 3238733 - protein, 4 aa, Plasmodium falciparum
NNDQ

SEQ ID NO: 3238734 - protein, 12 aa, Plasmodium falciparum
NNDQGENKNKTE

SEQ ID NO: 3238735 - protein, 9 aa, Plasmodium falciparum
NNDQKDKIK

SEQ ID NO: 3238736 - protein, 12 aa, Plasmodium falciparum
NNDQKKYQTTYS

SEQ ID NO: 3238737 - protein, 11 aa, Plasmodium falciparum
NNDQPFSSSTH

SEQ ID NO: 3238738 - protein, 7 aa, Plasmodium falciparum
NNDQQSI

SEQ ID NO: 3238739 - protein, 6 aa, Plasmodium falciparum
NNDREI

SEQ ID NO: 3238740 - protein, 9 aa, Plasmodium falciparum
NNDRKDQEA

SEQ ID NO: 3238741 - protein, 14 aa, Plasmodium falciparum
NNDSDINKKENVHT

SEQ ID NO: 3238742 - protein, 15 aa, Plasmodium falciparum
NNDSEKNESKNNKEM

SEQ ID NO: 3238743 - protein, 6 aa, Plasmodium falciparum
NNDSIK

SEQ ID NO: 3238744 - protein, 10 aa, Plasmodium falciparum
NNDSKRNILD

SEQ ID NO: 3238745 - protein, 5 aa, Plasmodium falciparum
NNDSL

SEQ ID NO: 3238746 - protein, 9 aa, Plasmodium falciparum
NNDSNDKTL

SEQ ID NO: 3238747 - protein, 20 aa, Plasmodium falciparum
NNDSNLENEHSSNNINAHET

SEQ ID NO: 3238748 - protein, 9 aa, Plasmodium falciparum
NNDSNNKNF

SEQ ID NO: 3238749 - protein, 17 aa, Plasmodium falciparum
NNDSNNNNNNNNRDVNN

SEQ ID NO: 3238750 - protein, 8 aa, Plasmodium falciparum
NNDSNSKS

SEQ ID NO: 3238751 - protein, 14 aa, Plasmodium falciparum
NNDSTKEKEDMNEQ

SEQ ID NO: 3238752 - protein, 9 aa, Plasmodium falciparum
NNDSYKKNH

SEQ ID NO: 3238753 - protein, 28 aa, Plasmodium falciparum
NNDSYNDINSYDNNNNNNNNNSNSSSNS

SEQ ID NO: 3238754 - protein, 4 aa, Plasmodium falciparum
NNDT

SEQ ID NO: 3238755 - protein, 7 aa, Plasmodium falciparum
NNDTEHI

SEQ ID NO: 3238756 - protein, 16 aa, Plasmodium falciparum
NNDTEKDGNKKYDTSY

SEQ ID NO: 3238757 - protein, 20 aa, Plasmodium falciparum
NNDTIQLSNKDSKTSRKDLL

SEQ ID NO: 3238758 - protein, 8 aa, Plasmodium falciparum
NNDTKNYK

SEQ ID NO: 3238759 - protein, 14 aa, Plasmodium falciparum
NNDTNNKKDVLPSS

SEQ ID NO: 3238760 - protein, 7 aa, Plasmodium falciparum
NNDTNSL

SEQ ID NO: 3238761 - protein, 7 aa, Plasmodium falciparum
NNDTSSE

SEQ ID NO: 3238762 - protein, 4 aa, Plasmodium falciparum
NNDV

SEQ ID NO: 3238763 - protein, 5 aa, Plasmodium falciparum
NNDYD

SEQ ID NO: 3238764 - protein, 14 aa, Plasmodium falciparum
NNDYNENEEENYKR

SEQ ID NO: 3238765 - protein, 7 aa, Plasmodium falciparum
NNDYSHD

SEQ ID NO: 3238766 - protein, 6 aa, Plasmodium falciparum
NNDYTN

SEQ ID NO: 3238767 - protein, 30 aa, Plasmodium falciparum
NNECTNKQNLSQGNDQGRKEISKDLPNGTY

SEQ ID NO: 3238768 - protein, 4 aa, Plasmodium falciparum
NNED

SEQ ID NO: 3238769 - protein, 6 aa, Plasmodium falciparum
NNEDDD

SEQ ID NO: 3238770 - protein, 30 aa, Plasmodium falciparum
NNEDDKKGIKQKTKNKTKLTKKKNKRKNDC

SEQ ID NO: 3238771 - protein, 9 aa, Plasmodium falciparum
NNEDGKNEI

SEQ ID NO: 3238772 - protein, 6 aa, Plasmodium falciparum
NNEDIN

SEQ ID NO: 3238773 - protein, 6 aa, Plasmodium falciparum
NNEDIY

SEQ ID NO: 3238774 - protein, 12 aa, Plasmodium falciparum
NNEDKKKNVDNN

SEQ ID NO: 3238775 - protein, 7 aa, Plasmodium falciparum
NNEDKKQ

SEQ ID NO: 3238776 - protein, 28 aa, Plasmodium falciparum
NNEDNNDNNSYKHNESNNNSYHNNNSYH

SEQ ID NO: 3238777 - protein, 7 aa, Plasmodium falciparum
NNEDSKY

SEQ ID NO: 3238778 - protein, 17 aa, Plasmodium falciparum
NNEDSSDDNTSSYEEDD

SEQ ID NO: 3238779 - protein, 6 aa, Plasmodium falciparum
NNEDTF

SEQ ID NO: 3238780 - protein, 5 aa, Plasmodium falciparum
NNEDY

SEQ ID NO: 3238781 - protein, 7 aa, Plasmodium falciparum
NNEEENV

SEQ ID NO: 3238782 - protein, 18 aa, Plasmodium falciparum
NNEEEYNEEKSKNDSTNN

SEQ ID NO: 3238783 - protein, 33 aa, Plasmodium falciparum
NNEEGGVNKHTNNINNDNMNDKNYDNDGKGDNT

SEQ ID NO: 3238784 - protein, 16 aa, Plasmodium falciparum
NNEEHHNNNQYNNYEN

SEQ ID NO: 3238785 - protein, 7 aa, Plasmodium falciparum
NNEEIKN

SEQ ID NO: 3238786 - protein, 22 aa, Plasmodium falciparum
NNEEIKNEELSHSSDDKEYDKD

SEQ ID NO: 3238787 - protein, 10 aa, Plasmodium falciparum
NNEEKEKKTE

SEQ ID NO: 3238788 - protein, 13 aa, Plasmodium falciparum
NNEEKNKESKKKK

SEQ ID NO: 3238789 - protein, 10 aa, Plasmodium falciparum
NNEELQDRVE

SEQ ID NO: 3238790 - protein, 11 aa, Plasmodium falciparum
NNEENKIKESN

SEQ ID NO: 3238791 - protein, 6 aa, Plasmodium falciparum
NNEENM

SEQ ID NO: 3238792 - protein, 10 aa, Plasmodium falciparum
NNEENNDTLS

SEQ ID NO: 3238793 - protein, 6 aa, Plasmodium falciparum
NNEEQI

SEQ ID NO: 3238794 - protein, 16 aa, Plasmodium falciparum
NNEETNDIEEINEKED

SEQ ID NO: 3238795 - protein, 20 aa, Plasmodium falciparum
NNEEVEISKSNNSKNNNVGV

SEQ ID NO: 3238796 - protein, 5 aa, Plasmodium falciparum
NNEEY

SEQ ID NO: 3238797 - protein, 26 aa, Plasmodium falciparum
NNEEYIEGSDNNIPSDGKNNNDNDDV

SEQ ID NO: 3238798 - protein, 17 aa, Plasmodium falciparum
NNEEYINGNKKKKSMEC

SEQ ID NO: 3238799 - protein, 9 aa, Plasmodium falciparum
NNEGEDNIQ

SEQ ID NO: 3238800 - protein, 11 aa, Plasmodium falciparum
NNEGNNNKLKE

SEQ ID NO: 3238801 - protein, 15 aa, Plasmodium falciparum
NNEGTYNNIDENNPM

SEQ ID NO: 3238802 - protein, 5 aa, Plasmodium falciparum
NNEGV

SEQ ID NO: 3238803 - protein, 17 aa, Plasmodium falciparum
NNEHKKKNIKKGTNINT

SEQ ID NO: 3238804 - protein, 5 aa, Plasmodium falciparum
NNEHN

SEQ ID NO: 3238805 - protein, 8 aa, Plasmodium falciparum
NNEHNGYV

SEQ ID NO: 3238806 - protein, 13 aa, Plasmodium falciparum
NNEIKDGSRENYN

SEQ ID NO: 3238807 - protein, 5 aa, Plasmodium falciparum
NNEIM

SEQ ID NO: 3238808 - protein, 14 aa, Plasmodium falciparum
NNEINKKSKNHSSM

SEQ ID NO: 3238809 - protein, 4 aa, Plasmodium falciparum
NNEK

SEQ ID NO: 3238810 - protein, 15 aa, Plasmodium falciparum
NNEKDATDDQPTYED

SEQ ID NO: 3238811 - protein, 8 aa, Plasmodium falciparum
NNEKDYTL

SEQ ID NO: 3238812 - protein, 10 aa, Plasmodium falciparum
NNEKEKNVDK

SEQ ID NO: 3238813 - protein, 10 aa, Plasmodium falciparum
NNEKELNNTN

SEQ ID NO: 3238814 - protein, 9 aa, Plasmodium falciparum
NNEKGPDKY

SEQ ID NO: 3238815 - protein, 9 aa, Plasmodium falciparum
NNEKIDGRE

SEQ ID NO: 3238816 - protein, 8 aa, Plasmodium falciparum
NNEKKKEI

SEQ ID NO: 3238817 - protein, 23 aa, Plasmodium falciparum
NNEKKKNSIYSDTQSSKREDEKR

SEQ ID NO: 3238818 - protein, 6 aa, Plasmodium falciparum
NNEKKL

SEQ ID NO: 3238819 - protein, 12 aa, Plasmodium falciparum
NNEKKNDLYDDK

SEQ ID NO: 3238820 - protein, 12 aa, Plasmodium falciparum
NNEKKNKDNKME

SEQ ID NO: 3238821 - protein, 7 aa, Plasmodium falciparum
NNEKKRK

SEQ ID NO: 3238822 - protein, 22 aa, Plasmodium falciparum
NNEKLKKKELNKYDSNISDNNI

SEQ ID NO: 3238823 - protein, 5 aa, Plasmodium falciparum
NNEKN

SEQ ID NO: 3238824 - protein, 18 aa, Plasmodium falciparum
NNEKNEFNNNEKNEMNNN

SEQ ID NO: 3238825 - protein, 16 aa, Plasmodium falciparum
NNEKNVENGKKCSKYV

SEQ ID NO: 3238826 - protein, 8 aa, Plasmodium falciparum
NNEKPTNC

SEQ ID NO: 3238827 - protein, 8 aa, Plasmodium falciparum
NNEKRNNE

SEQ ID NO: 3238828 - protein, 8 aa, Plasmodium falciparum
NNEKTFEN

SEQ ID NO: 3238829 - protein, 9 aa, Plasmodium falciparum
NNEKTKEEV

SEQ ID NO: 3238830 - protein, 4 aa, Plasmodium falciparum
NNEL

SEQ ID NO: 3238831 - protein, 7 aa, Plasmodium falciparum
NNELENN

SEQ ID NO: 3238832 - protein, 10 aa, Plasmodium falciparum
NNELKNDNPF

SEQ ID NO: 3238833 - protein, 4 aa, Plasmodium falciparum
NNEM

SEQ ID NO: 3238834 - protein, 6 aa, Plasmodium falciparum
NNEMND

SEQ ID NO: 3238835 - protein, 19 aa, Plasmodium falciparum
NNEMNNNNNNNNNSSSNYR

SEQ ID NO: 3238836 - protein, 7 aa, Plasmodium falciparum
NNENATT

SEQ ID NO: 3238837 - protein, 7 aa, Plasmodium falciparum
NNENDDW

SEQ ID NO: 3238838 - protein, 10 aa, Plasmodium falciparum
NNENDNDIDT

SEQ ID NO: 3238839 - protein, 13 aa, Plasmodium falciparum
NNENDNNNNNKIS

SEQ ID NO: 3238840 - protein, 6 aa, Plasmodium falciparum
NNENDR

SEQ ID NO: 3238841 - protein, 6 aa, Plasmodium falciparum
NNENEI

SEQ ID NO: 3238842 - protein, 12 aa, Plasmodium falciparum
NNENEKENGMNG

SEQ ID NO: 3238843 - protein, 9 aa, Plasmodium falciparum
NNENFNNEQ

SEQ ID NO: 3238844 - protein, 7 aa, Plasmodium falciparum
NNENGTL

SEQ ID NO: 3238845 - protein, 8 aa, Plasmodium falciparum
NNENGYGV

SEQ ID NO: 3238846 - protein, 5 aa, Plasmodium falciparum
NNENK

SEQ ID NO: 3238847 - protein, 6 aa, Plasmodium falciparum
NNENKI

SEQ ID NO: 3238848 - protein, 12 aa, Plasmodium falciparum
NNENKKNNNEKV

SEQ ID NO: 3238849 - protein, 6 aa, Plasmodium falciparum
NNENKN

SEQ ID NO: 3238850 - protein, 9 aa, Plasmodium falciparum
NNENLNDEN

SEQ ID NO: 3238851 - protein, 5 aa, Plasmodium falciparum
NNENM

SEQ ID NO: 3238852 - protein, 7 aa, Plasmodium falciparum
NNENMEP

SEQ ID NO: 3238853 - protein, 6 aa, Plasmodium falciparum
NNENNI

SEQ ID NO: 3238854 - protein, 8 aa, Plasmodium falciparum
NNENNMKE

SEQ ID NO: 3238855 - protein, 14 aa, Plasmodium falciparum
NNENNQNISNNNNK

SEQ ID NO: 3238856 - protein, 7 aa, Plasmodium falciparum
NNENSED

SEQ ID NO: 3238857 - protein, 5 aa, Plasmodium falciparum
NNENT

SEQ ID NO: 3238858 - protein, 16 aa, Plasmodium falciparum
NNENTNNIENKQNQET

SEQ ID NO: 3238859 - protein, 60 aa, Plasmodium falciparum
NNENVEKKKDKEKKENKQESSRKINNLEKERKETNGLSTNEEDKKENEKNKDQNNNTNKE

SEQ ID NO: 3238860 - protein, 7 aa, Plasmodium falciparum
NNENVGE

SEQ ID NO: 3238861 - protein, 100 aa, Plasmodium falciparum
NNENVNENVNENVNENVNTNTNTNTNTNTNTNTNTNTNTNTNTNTNTNTNTNTNINTNTNTNTNTNTNTNTHTNTNTNTNTNTNTNTNTDDHTNMNNNNI

SEQ ID NO: 3238862 - protein, 7 aa, Plasmodium falciparum
NNENYDK

SEQ ID NO: 3238863 - protein, 11 aa, Plasmodium falciparum
NNEPTTNIDEE

SEQ ID NO: 3238864 - protein, 7 aa, Plasmodium falciparum
NNEQIET

SEQ ID NO: 3238865 - protein, 8 aa, Plasmodium falciparum
NNEQNENA

SEQ ID NO: 3238866 - protein, 8 aa, Plasmodium falciparum
NNEQNNGY

SEQ ID NO: 3238867 - protein, 6 aa, Plasmodium falciparum
NNEQNV

SEQ ID NO: 3238868 - protein, 8 aa, Plasmodium falciparum
NNEQQNGV

SEQ ID NO: 3238869 - protein, 10 aa, Plasmodium falciparum
NNEQRNNISN

SEQ ID NO: 3238870 - protein, 6 aa, Plasmodium falciparum
NNERGN

SEQ ID NO: 3238871 - protein, 8 aa, Plasmodium falciparum
NNERKKNK

SEQ ID NO: 3238872 - protein, 6 aa, Plasmodium falciparum
NNERNN

SEQ ID NO: 3238873 - protein, 9 aa, Plasmodium falciparum
NNERNPCKG

SEQ ID NO: 3238874 - protein, 11 aa, Plasmodium falciparum
NNERRKYAATK

SEQ ID NO: 3238875 - protein, 6 aa, Plasmodium falciparum
NNERST

SEQ ID NO: 3238876 - protein, 9 aa, Plasmodium falciparum
NNESCSDSN

SEQ ID NO: 3238877 - protein, 11 aa, Plasmodium falciparum
NNESLKNNTMS

SEQ ID NO: 3238878 - protein, 21 aa, Plasmodium falciparum
NNESLTNTSGDDTSNKKETFQ

SEQ ID NO: 3238879 - protein, 10 aa, Plasmodium falciparum
NNESNNKKDD

SEQ ID NO: 3238880 - protein, 26 aa, Plasmodium falciparum
NNESNNKNISINNSQNTKGSNIPNTN

SEQ ID NO: 3238881 - protein, 5 aa, Plasmodium falciparum
NNESR

SEQ ID NO: 3238882 - protein, 5 aa, Plasmodium falciparum
NNESS

SEQ ID NO: 3238883 - protein, 5 aa, Plasmodium falciparum
NNESV

SEQ ID NO: 3238884 - protein, 4 aa, Plasmodium falciparum
NNET

SEQ ID NO: 3238885 - protein, 16 aa, Plasmodium falciparum
NNETASNENDKNDFSK

SEQ ID NO: 3238886 - protein, 7 aa, Plasmodium falciparum
NNETDDN

SEQ ID NO: 3238887 - protein, 7 aa, Plasmodium falciparum
NNETKEI

SEQ ID NO: 3238888 - protein, 8 aa, Plasmodium falciparum
NNETKTFN

SEQ ID NO: 3238889 - protein, 15 aa, Plasmodium falciparum
NNETLNQNMKEQKNM

SEQ ID NO: 3238890 - protein, 7 aa, Plasmodium falciparum
NNEVQND

SEQ ID NO: 3238891 - protein, 18 aa, Plasmodium falciparum
NNEVSKSSKNNRRYKSEP

SEQ ID NO: 3238892 - protein, 4 aa, Plasmodium falciparum
NNEY

SEQ ID NO: 3238893 - protein, 22 aa, Plasmodium falciparum
NNEYKNNGKNIPFNTSSSIDNK

SEQ ID NO: 3238894 - protein, 6 aa, Plasmodium falciparum
NNEYKR

SEQ ID NO: 3238895 - protein, 25 aa, Plasmodium falciparum
NNEYNKDDEEIKNNYEDNQDNGDIK

SEQ ID NO: 3238896 - protein, 10 aa, Plasmodium falciparum
NNEYNNETQN

SEQ ID NO: 3238897 - protein, 19 aa, Plasmodium falciparum
NNEYNNNTKENTKGNSNIK

SEQ ID NO: 3238898 - protein, 6 aa, Plasmodium falciparum
NNFDNK

SEQ ID NO: 3238899 - protein, 11 aa, Plasmodium falciparum
NNFEHTNNKYK

SEQ ID NO: 3238900 - protein, 7 aa, Plasmodium falciparum
NNFGTSN

SEQ ID NO: 3238901 - protein, 4 aa, Plasmodium falciparum
NNFK

SEQ ID NO: 3238902 - protein, 9 aa, Plasmodium falciparum
NNFKRDNSK

SEQ ID NO: 3238903 - protein, 4 aa, Plasmodium falciparum
NNFN

SEQ ID NO: 3238904 - protein, 6 aa, Plasmodium falciparum
NNFNDD

SEQ ID NO: 3238905 - protein, 12 aa, Plasmodium falciparum
NNFNKEQTENKN

SEQ ID NO: 3238906 - protein, 5 aa, Plasmodium falciparum
NNFNN

SEQ ID NO: 3238907 - protein, 7 aa, Plasmodium falciparum
NNFNNKK

SEQ ID NO: 3238908 - protein, 11 aa, Plasmodium falciparum
NNFNNNSNNMK

SEQ ID NO: 3238909 - protein, 20 aa, Plasmodium falciparum
NNFNNSSNKNRNKEKMDDKD

SEQ ID NO: 3238910 - protein, 4 aa, Plasmodium falciparum
NNFS

SEQ ID NO: 3238911 - protein, 15 aa, Plasmodium falciparum
NNFSEKNSNKKNRLD

SEQ ID NO: 3238912 - protein, 9 aa, Plasmodium falciparum
NNFSNPQAN

SEQ ID NO: 3238913 - protein, 13 aa, Plasmodium falciparum
NNFSSAEDSISDV

SEQ ID NO: 3238914 - protein, 5 aa, Plasmodium falciparum
NNFTE

SEQ ID NO: 3238915 - protein, 5 aa, Plasmodium falciparum
NNFTT

SEQ ID NO: 3238916 - protein, 14 aa, Plasmodium falciparum
NNFTTRSNTDNANS

SEQ ID NO: 3238917 - protein, 20 aa, Plasmodium falciparum
NNFYGNKKKKIKKRNNNKCE

SEQ ID NO: 3238918 - protein, 99 aa, Plasmodium falciparum
NNGANGGLNSGANGGLNNGANDGLNNGANGGLNNGANGGLNNGANGGLNNGMNNGMNNGMNNGMNNGMNNGMNNGMNNGTNGGLNNGMNNGMNNGMNNG

SEQ ID NO: 3238919 - protein, 9 aa, Plasmodium falciparum
NNGDENNEK

SEQ ID NO: 3238920 - protein, 17 aa, Plasmodium falciparum
NNGDKNCNFEGKKRKKD

SEQ ID NO: 3238921 - protein, 9 aa, Plasmodium falciparum
NNGDKSTCK

SEQ ID NO: 3238922 - protein, 7 aa, Plasmodium falciparum
NNGDRNS

SEQ ID NO: 3238923 - protein, 4 aa, Plasmodium falciparum
NNGE

SEQ ID NO: 3238924 - protein, 6 aa, Plasmodium falciparum
NNGEGN

SEQ ID NO: 3238925 - protein, 6 aa, Plasmodium falciparum
NNGEKK

SEQ ID NO: 3238926 - protein, 6 aa, Plasmodium falciparum
NNGFAN

SEQ ID NO: 3238927 - protein, 8 aa, Plasmodium falciparum
NNGGCGDD

SEQ ID NO: 3238928 - protein, 4 aa, Plasmodium falciparum
NNGH

SEQ ID NO: 3238929 - protein, 4 aa, Plasmodium falciparum
NNGK

SEQ ID NO: 3238930 - protein, 5 aa, Plasmodium falciparum
NNGKV

SEQ ID NO: 3238931 - protein, 4 aa, Plasmodium falciparum
NNGL

SEQ ID NO: 3238932 - protein, 7 aa, Plasmodium falciparum
NNGMSSN

SEQ ID NO: 3238933 - protein, 9 aa, Plasmodium falciparum
NNGNDKDHK

SEQ ID NO: 3238934 - protein, 16 aa, Plasmodium falciparum
NNGNENTGNQNNPIQK

SEQ ID NO: 3238935 - protein, 13 aa, Plasmodium falciparum
NNGNINNNDNNND

SEQ ID NO: 3238936 - protein, 7 aa, Plasmodium falciparum
NNGNKYE

SEQ ID NO: 3238937 - protein, 52 aa, Plasmodium falciparum
NNGNMDNNTKSNSSDGSSSDGSSSDGSSSDGNSSDGSSSSSSNYKNTQSYSK

SEQ ID NO: 3238938 - protein, 35 aa, Plasmodium falciparum
NNGNNNNTNNTNNNNNNNNNNNNNNNNNNNNNNNY

SEQ ID NO: 3238939 - protein, 11 aa, Plasmodium falciparum
NNGNNTKQSKY

SEQ ID NO: 3238940 - protein, 9 aa, Plasmodium falciparum
NNGNQDKYS

SEQ ID NO: 3238941 - protein, 7 aa, Plasmodium falciparum
NNGNSKN

SEQ ID NO: 3238942 - protein, 10 aa, Plasmodium falciparum
NNGQASSSFP

SEQ ID NO: 3238943 - protein, 6 aa, Plasmodium falciparum
NNGRRI

SEQ ID NO: 3238944 - protein, 6 aa, Plasmodium falciparum
NNGRTK

SEQ ID NO: 3238945 - protein, 11 aa, Plasmodium falciparum
NNGSDKKKKSN

SEQ ID NO: 3238946 - protein, 17 aa, Plasmodium falciparum
NNGSNDNNNNDNNIYGD

SEQ ID NO: 3238947 - protein, 6 aa, Plasmodium falciparum
NNGSWK

SEQ ID NO: 3238948 - protein, 8 aa, Plasmodium falciparum
NNGTGKTK

SEQ ID NO: 3238949 - protein, 17 aa, Plasmodium falciparum
NNGTHGNPHNNNSYGHK

SEQ ID NO: 3238950 - protein, 7 aa, Plasmodium falciparum
NNGTNEI

SEQ ID NO: 3238951 - protein, 6 aa, Plasmodium falciparum
NNGTNK

SEQ ID NO: 3238952 - protein, 13 aa, Plasmodium falciparum
NNGTPYNEEPIQD

SEQ ID NO: 3238953 - protein, 4 aa, Plasmodium falciparum
NNGV

SEQ ID NO: 3238954 - protein, 4 aa, Plasmodium falciparum
NNGY

SEQ ID NO: 3238955 - protein, 8 aa, Plasmodium falciparum
NNGYEKKK

SEQ ID NO: 3238956 - protein, 37 aa, Plasmodium falciparum
NNHDDNMNNPDDNMNNHDDNMNNHDDNMNNHDDNMNK

SEQ ID NO: 3238957 - protein, 14 aa, Plasmodium falciparum
NNHDNNSYGKRNKK

SEQ ID NO: 3238958 - protein, 8 aa, Plasmodium falciparum
NNHDNTNN

SEQ ID NO: 3238959 - protein, 15 aa, Plasmodium falciparum
NNHHNNHNNNNNNNN

SEQ ID NO: 3238960 - protein, 8 aa, Plasmodium falciparum
NNHHSQNQ

SEQ ID NO: 3238961 - protein, 9 aa, Plasmodium falciparum
NNHISKTKA

SEQ ID NO: 3238962 - protein, 18 aa, Plasmodium falciparum
NNHKDEKNNYDIKEKNEE

SEQ ID NO: 3238963 - protein, 10 aa, Plasmodium falciparum
NNHKNTYNSS

SEQ ID NO: 3238964 - protein, 6 aa, Plasmodium falciparum
NNHKSD

SEQ ID NO: 3238965 - protein, 13 aa, Plasmodium falciparum
NNHLSNTKNINSS

SEQ ID NO: 3238966 - protein, 8 aa, Plasmodium falciparum
NNHMNDNS

SEQ ID NO: 3238967 - protein, 10 aa, Plasmodium falciparum
NNHNDDDNHC

SEQ ID NO: 3238968 - protein, 7 aa, Plasmodium falciparum
NNHNDGC

SEQ ID NO: 3238969 - protein, 14 aa, Plasmodium falciparum
NNHNDPCNNHNDPC

SEQ ID NO: 3238970 - protein, 17 aa, Plasmodium falciparum
NNHNENYNNDSLNTKEQ

SEQ ID NO: 3238971 - protein, 8 aa, Plasmodium falciparum
NNHNGDDK

SEQ ID NO: 3238972 - protein, 16 aa, Plasmodium falciparum
NNHNKSSNISTTNKKN

SEQ ID NO: 3238973 - protein, 10 aa, Plasmodium falciparum
NNHNNNHDEI

SEQ ID NO: 3238974 - protein, 25 aa, Plasmodium falciparum
NNHNNNHNHNQNNNNNNNNNNGNYY

SEQ ID NO: 3238975 - protein, 21 aa, Plasmodium falciparum
NNHNNNHNNNHNNNQNNNHNI

SEQ ID NO: 3238976 - protein, 9 aa, Plasmodium falciparum
NNHNNNNIY

SEQ ID NO: 3238977 - protein, 26 aa, Plasmodium falciparum
NNHNNNNNSNGNNSNGNNSNGNNSNM

SEQ ID NO: 3238978 - protein, 17 aa, Plasmodium falciparum
NNHNQNINEPQQNKEKE

SEQ ID NO: 3238979 - protein, 15 aa, Plasmodium falciparum
NNHPDKDIKGNKSSI

SEQ ID NO: 3238980 - protein, 6 aa, Plasmodium falciparum
NNHPKV

SEQ ID NO: 3238981 - protein, 8 aa, Plasmodium falciparum
NNHPNNNY

SEQ ID NO: 3238982 - protein, 19 aa, Plasmodium falciparum
NNHSNKKKTKKKQKNFNGE

SEQ ID NO: 3238983 - protein, 20 aa, Plasmodium falciparum
NNHSTNIKKNKQNTNDNLKG

SEQ ID NO: 3238984 - protein, 11 aa, Plasmodium falciparum
NNHSTNQQNDA

SEQ ID NO: 3238985 - protein, 9 aa, Plasmodium falciparum
NNHSTQTEI

SEQ ID NO: 3238986 - protein, 14 aa, Plasmodium falciparum
NNHTASSNNNNNNN

SEQ ID NO: 3238987 - protein, 13 aa, Plasmodium falciparum
NNHTCDTNQSDDV

SEQ ID NO: 3238988 - protein, 8 aa, Plasmodium falciparum
NNHTKKKQ

SEQ ID NO: 3238989 - protein, 13 aa, Plasmodium falciparum
NNHTSDNNTCNNH

SEQ ID NO: 3238990 - protein, 7 aa, Plasmodium falciparum
NNHTSKQ

SEQ ID NO: 3238991 - protein, 4 aa, Plasmodium falciparum
NNHY

SEQ ID NO: 3238992 - protein, 6 aa, Plasmodium falciparum
NNHYNN

SEQ ID NO: 3238993 - protein, 26 aa, Plasmodium falciparum
NNHYNYSTNKNNLKRKKKDSNNLEDI

SEQ ID NO: 3238994 - protein, 27 aa, Plasmodium falciparum
NNICSNNNNNICSNNNNNICSNNNNNI

SEQ ID NO: 3238995 - protein, 4 aa, Plasmodium falciparum
NNID

SEQ ID NO: 3238996 - protein, 5 aa, Plasmodium falciparum
NNIDD

SEQ ID NO: 3238997 - protein, 13 aa, Plasmodium falciparum
NNIDKKKNEDAPN

SEQ ID NO: 3238998 - protein, 10 aa, Plasmodium falciparum
NNIDKSQNYN

SEQ ID NO: 3238999 - protein, 9 aa, Plasmodium falciparum
NNIDNKERI

SEQ ID NO: 3239000 - protein, 4 aa, Plasmodium falciparum
NNIE

SEQ ID NO: 3239001 - protein, 20 aa, Plasmodium falciparum
NNIEENSKESISLTPYGQES

SEQ ID NO: 3239002 - protein, 11 aa, Plasmodium falciparum
NNIEGTKENPK

SEQ ID NO: 3239003 - protein, 5 aa, Plasmodium falciparum
NNIEN

SEQ ID NO: 3239004 - protein, 6 aa, Plasmodium falciparum
NNIENY

SEQ ID NO: 3239005 - protein, 10 aa, Plasmodium falciparum
NNIGCPPKTH

SEQ ID NO: 3239006 - protein, 41 aa, Plasmodium falciparum
NNIGQTNNYDDDEEEEDEEEEDNNNNTSYNNNNNNSSSSSS

SEQ ID NO: 3239007 - protein, 22 aa, Plasmodium falciparum
NNIGTSKLEKDTKKGKTEKFGK

SEQ ID NO: 3239008 - protein, 4 aa, Plasmodium falciparum
NNIH

SEQ ID NO: 3239009 - protein, 7 aa, Plasmodium falciparum
NNIHNQD

SEQ ID NO: 3239010 - protein, 4 aa, Plasmodium falciparum
NNIK

SEQ ID NO: 3239011 - protein, 10 aa, Plasmodium falciparum
NNIKDKKKKS

SEQ ID NO: 3239012 - protein, 6 aa, Plasmodium falciparum
NNIKEK

SEQ ID NO: 3239013 - protein, 6 aa, Plasmodium falciparum
NNIKEN

SEQ ID NO: 3239014 - protein, 37 aa, Plasmodium falciparum
NNIKENKNNIKKNKNNINENKNNINENKNDINENKNN

SEQ ID NO: 3239015 - protein, 17 aa, Plasmodium falciparum
NNIKEYDKKEKEITNKR

SEQ ID NO: 3239016 - protein, 23 aa, Plasmodium falciparum
NNIKGRSKNQKEKKKKKKKSESM

SEQ ID NO: 3239017 - protein, 6 aa, Plasmodium falciparum
NNIKKE

SEQ ID NO: 3239018 - protein, 10 aa, Plasmodium falciparum
NNIKNNDSFA

SEQ ID NO: 3239019 - protein, 10 aa, Plasmodium falciparum
NNIKQDEKKL

SEQ ID NO: 3239020 - protein, 6 aa, Plasmodium falciparum
NNIKTE

SEQ ID NO: 3239021 - protein, 5 aa, Plasmodium falciparum
NNIKY

SEQ ID NO: 3239022 - protein, 4 aa, Plasmodium falciparum
NNIL

SEQ ID NO: 3239023 - protein, 7 aa, Plasmodium falciparum
NNINDAN

SEQ ID NO: 3239024 - protein, 16 aa, Plasmodium falciparum
NNINDLNDNNSPITYE

SEQ ID NO: 3239025 - protein, 6 aa, Plasmodium falciparum
NNINDN

SEQ ID NO: 3239026 - protein, 5 aa, Plasmodium falciparum
NNINE

SEQ ID NO: 3239027 - protein, 17 aa, Plasmodium falciparum
NNINEEYNNDNNNDNIN

SEQ ID NO: 3239028 - protein, 11 aa, Plasmodium falciparum
NNINEQTNKPS

SEQ ID NO: 3239029 - protein, 16 aa, Plasmodium falciparum
NNINGNNINGNNINGN

SEQ ID NO: 3239030 - protein, 5 aa, Plasmodium falciparum
NNINK

SEQ ID NO: 3239031 - protein, 10 aa, Plasmodium falciparum
NNINKKGKHM

SEQ ID NO: 3239032 - protein, 12 aa, Plasmodium falciparum
NNINKMKSPQSC

SEQ ID NO: 3239033 - protein, 12 aa, Plasmodium falciparum
NNINKNNSTTNN

SEQ ID NO: 3239034 - protein, 6 aa, Plasmodium falciparum
NNINND

SEQ ID NO: 3239035 - protein, 9 aa, Plasmodium falciparum
NNINNDNNN

SEQ ID NO: 3239036 - protein, 16 aa, Plasmodium falciparum
NNINNDNNNNNNNNNR

SEQ ID NO: 3239037 - protein, 150 aa, Plasmodium falciparum
NNINNKKTNDSVTNKISGAKANKGNNSNNNNNKSNNNKTSHNNKSNNNNKDDGSKNNNNNNNNNSNNNNNNNNNYGNNNSKKNNNNNNDNNDNNNNNNNNNNNNGDNNKNNNNDEDDDDNDNNGDNKKNKKDKGNHKDTSNKNNNTDKIN

SEQ ID NO: 3239038 - protein, 8 aa, Plasmodium falciparum
NNINNKPN

SEQ ID NO: 3239039 - protein, 11 aa, Plasmodium falciparum
NNINNKRSTLS

SEQ ID NO: 3239040 - protein, 7 aa, Plasmodium falciparum
NNINNNN

SEQ ID NO: 3239041 - protein, 21 aa, Plasmodium falciparum
NNINNNNDRKNEYKDKNNHHS

SEQ ID NO: 3239042 - protein, 18 aa, Plasmodium falciparum
NNINNNNINEYKDNHADG

SEQ ID NO: 3239043 - protein, 14 aa, Plasmodium falciparum
NNINNNNNNNDDIS

SEQ ID NO: 3239044 - protein, 11 aa, Plasmodium falciparum
NNINNNSSHIR

SEQ ID NO: 3239045 - protein, 11 aa, Plasmodium falciparum
NNINNNSSSYY

SEQ ID NO: 3239046 - protein, 13 aa, Plasmodium falciparum
NNINNSDEYNNEN

SEQ ID NO: 3239047 - protein, 8 aa, Plasmodium falciparum
NNINNSSN

SEQ ID NO: 3239048 - protein, 17 aa, Plasmodium falciparum
NNINNYNNNNDENNNYK

SEQ ID NO: 3239049 - protein, 5 aa, Plasmodium falciparum
NNINP

SEQ ID NO: 3239050 - protein, 8 aa, Plasmodium falciparum
NNINPYNR

SEQ ID NO: 3239051 - protein, 14 aa, Plasmodium falciparum
NNINQDDPNLADGL

SEQ ID NO: 3239052 - protein, 6 aa, Plasmodium falciparum
NNINQN

SEQ ID NO: 3239053 - protein, 5 aa, Plasmodium falciparum
NNINR

SEQ ID NO: 3239054 - protein, 8 aa, Plasmodium falciparum
NNINSDDY

SEQ ID NO: 3239055 - protein, 9 aa, Plasmodium falciparum
NNINSNSNK

SEQ ID NO: 3239056 - protein, 6 aa, Plasmodium falciparum
NNINTQ

SEQ ID NO: 3239057 - protein, 5 aa, Plasmodium falciparum
NNINY

SEQ ID NO: 3239058 - protein, 6 aa, Plasmodium falciparum
NNINYS

SEQ ID NO: 3239059 - protein, 4 aa, Plasmodium falciparum
NNIP

SEQ ID NO: 3239060 - protein, 8 aa, Plasmodium falciparum
NNIPENEN

SEQ ID NO: 3239061 - protein, 6 aa, Plasmodium falciparum
NNIPPF

SEQ ID NO: 3239062 - protein, 6 aa, Plasmodium falciparum
NNIPSN

SEQ ID NO: 3239063 - protein, 11 aa, Plasmodium falciparum
NNIPSSNNYNG

SEQ ID NO: 3239064 - protein, 13 aa, Plasmodium falciparum
NNIPTKEINSNSS

SEQ ID NO: 3239065 - protein, 4 aa, Plasmodium falciparum
NNIQ

SEQ ID NO: 3239066 - protein, 17 aa, Plasmodium falciparum
NNIQDPLNGGTSQKNNI

SEQ ID NO: 3239067 - protein, 16 aa, Plasmodium falciparum
NNIQDSPSDDDKREEV

SEQ ID NO: 3239068 - protein, 5 aa, Plasmodium falciparum
NNIQN

SEQ ID NO: 3239069 - protein, 16 aa, Plasmodium falciparum
NNIQNNKTSSYEKQKT

SEQ ID NO: 3239070 - protein, 15 aa, Plasmodium falciparum
NNIQNTNDLETNDTC

SEQ ID NO: 3239071 - protein, 30 aa, Plasmodium falciparum
NNIRKDQDNKTSEHKSSTNIYNKDKNNDYN

SEQ ID NO: 3239072 - protein, 10 aa, Plasmodium falciparum
NNISDDKNNL

SEQ ID NO: 3239073 - protein, 19 aa, Plasmodium falciparum
NNISDEEDIYNNSSEEQEF

SEQ ID NO: 3239074 - protein, 10 aa, Plasmodium falciparum
NNISDSYKEE

SEQ ID NO: 3239075 - protein, 12 aa, Plasmodium falciparum
NNISEEQLNKGE

SEQ ID NO: 3239076 - protein, 7 aa, Plasmodium falciparum
NNISHNN

SEQ ID NO: 3239077 - protein, 7 aa, Plasmodium falciparum
NNISKDN

SEQ ID NO: 3239078 - protein, 8 aa, Plasmodium falciparum
NNISNEND

SEQ ID NO: 3239079 - protein, 14 aa, Plasmodium falciparum
NNISNGSDYTNSSR

SEQ ID NO: 3239080 - protein, 6 aa, Plasmodium falciparum
NNISNK

SEQ ID NO: 3239081 - protein, 19 aa, Plasmodium falciparum
NNISNKNEYVNEEKKKMNK

SEQ ID NO: 3239082 - protein, 22 aa, Plasmodium falciparum
NNISNNKKNTINEEQNNNVNES

SEQ ID NO: 3239083 - protein, 10 aa, Plasmodium falciparum
NNISNNNNNF

SEQ ID NO: 3239084 - protein, 8 aa, Plasmodium falciparum
NNISSDKK

SEQ ID NO: 3239085 - protein, 19 aa, Plasmodium falciparum
NNITDNNLNGSNRTTGNNT

SEQ ID NO: 3239086 - protein, 5 aa, Plasmodium falciparum
NNITR

SEQ ID NO: 3239087 - protein, 9 aa, Plasmodium falciparum
NNITRRSYS

SEQ ID NO: 3239088 - protein, 17 aa, Plasmodium falciparum
NNITSFDNNNNNNNNNV

SEQ ID NO: 3239089 - protein, 7 aa, Plasmodium falciparum
NNITSNS

SEQ ID NO: 3239090 - protein, 5 aa, Plasmodium falciparum
NNITY

SEQ ID NO: 3239091 - protein, 4 aa, Plasmodium falciparum
NNIY

SEQ ID NO: 3239092 - protein, 30 aa, Plasmodium falciparum
NNIYGRKKKNKNIYGNNNNNNNNNNNKHMN

SEQ ID NO: 3239093 - protein, 6 aa, Plasmodium falciparum
NNIYNN

SEQ ID NO: 3239094 - protein, 11 aa, Plasmodium falciparum
NNIYNSNKEEL

SEQ ID NO: 3239095 - protein, 19 aa, Plasmodium falciparum
NNKADDKNIHENNTSEDKN

SEQ ID NO: 3239096 - protein, 8 aa, Plasmodium falciparum
NNKAGEDM

SEQ ID NO: 3239097 - protein, 11 aa, Plasmodium falciparum
NNKAKNQNDYN

SEQ ID NO: 3239098 - protein, 7 aa, Plasmodium falciparum
NNKATNI

SEQ ID NO: 3239099 - protein, 4 aa, Plasmodium falciparum
NNKC

SEQ ID NO: 3239100 - protein, 8 aa, Plasmodium falciparum
NNKCDEKN

SEQ ID NO: 3239101 - protein, 11 aa, Plasmodium falciparum
NNKCSKKANDF

SEQ ID NO: 3239102 - protein, 6 aa, Plasmodium falciparum
NNKDAE

SEQ ID NO: 3239103 - protein, 27 aa, Plasmodium falciparum
NNKDDEEKCNESKKQNHDAFKTGNSLE

SEQ ID NO: 3239104 - protein, 8 aa, Plasmodium falciparum
NNKDDKVT

SEQ ID NO: 3239105 - protein, 8 aa, Plasmodium falciparum
NNKDENIN

SEQ ID NO: 3239106 - protein, 9 aa, Plasmodium falciparum
NNKDENNVP

SEQ ID NO: 3239107 - protein, 6 aa, Plasmodium falciparum
NNKDGY

SEQ ID NO: 3239108 - protein, 13 aa, Plasmodium falciparum
NNKDKEEKKSYAV

SEQ ID NO: 3239109 - protein, 14 aa, Plasmodium falciparum
NNKDLSENIKDEKG

SEQ ID NO: 3239110 - protein, 7 aa, Plasmodium falciparum
NNKDNDM

SEQ ID NO: 3239111 - protein, 37 aa, Plasmodium falciparum
NNKDNNDKNDKNDKNDKNDKNDKNEKNEKNDYDKRSE

SEQ ID NO: 3239112 - protein, 7 aa, Plasmodium falciparum
NNKDNVD

SEQ ID NO: 3239113 - protein, 24 aa, Plasmodium falciparum
NNKDSPKNNINSNNIDSNNINSSH

SEQ ID NO: 3239114 - protein, 13 aa, Plasmodium falciparum
NNKDVNSQGETSN

SEQ ID NO: 3239115 - protein, 4 aa, Plasmodium falciparum
NNKE

SEQ ID NO: 3239116 - protein, 26 aa, Plasmodium falciparum
NNKEDNQSSYISTNGKNKDTKDAVQN

SEQ ID NO: 3239117 - protein, 9 aa, Plasmodium falciparum
NNKEEASKK

SEQ ID NO: 3239118 - protein, 21 aa, Plasmodium falciparum
NNKEENLNHDDDNHMEDQNNS

SEQ ID NO: 3239119 - protein, 25 aa, Plasmodium falciparum
NNKEESNNDASNNNNNDDDDDNNNN

SEQ ID NO: 3239120 - protein, 18 aa, Plasmodium falciparum
NNKEGEKKINNDKDMYNN

SEQ ID NO: 3239121 - protein, 16 aa, Plasmodium falciparum
NNKEIEKGEDKNNYDI

SEQ ID NO: 3239122 - protein, 16 aa, Plasmodium falciparum
NNKEKKMKNNQKTVYS

SEQ ID NO: 3239123 - protein, 29 aa, Plasmodium falciparum
NNKEKNDANKHTKNSMNNNSNNNNNNNYN

SEQ ID NO: 3239124 - protein, 11 aa, Plasmodium falciparum
NNKENNEGKNI

SEQ ID NO: 3239125 - protein, 13 aa, Plasmodium falciparum
NNKENNTNNKDNQ

SEQ ID NO: 3239126 - protein, 9 aa, Plasmodium falciparum
NNKESHHKN

SEQ ID NO: 3239127 - protein, 20 aa, Plasmodium falciparum
NNKETYKKKSHDEDKLNTYN

SEQ ID NO: 3239128 - protein, 4 aa, Plasmodium falciparum
NNKF

SEQ ID NO: 3239129 - protein, 31 aa, Plasmodium falciparum
NNKGDNKKGTPGAKKNDNKAVNPSISSTMYR

SEQ ID NO: 3239130 - protein, 9 aa, Plasmodium falciparum
NNKGGKEFE

SEQ ID NO: 3239131 - protein, 8 aa, Plasmodium falciparum
NNKGNGQN

SEQ ID NO: 3239132 - protein, 7 aa, Plasmodium falciparum
NNKGNHQ

SEQ ID NO: 3239133 - protein, 4 aa, Plasmodium falciparum
NNKH

SEQ ID NO: 3239134 - protein, 7 aa, Plasmodium falciparum
NNKHKEK

SEQ ID NO: 3239135 - protein, 7 aa, Plasmodium falciparum
NNKHNIQ

SEQ ID NO: 3239136 - protein, 7 aa, Plasmodium falciparum
NNKHNNN

SEQ ID NO: 3239137 - protein, 8 aa, Plasmodium falciparum
NNKHPSTL

SEQ ID NO: 3239138 - protein, 7 aa, Plasmodium falciparum
NNKHTFT

SEQ ID NO: 3239139 - protein, 12 aa, Plasmodium falciparum
NNKHTNNNYNEN

SEQ ID NO: 3239140 - protein, 4 aa, Plasmodium falciparum
NNKI

SEQ ID NO: 3239141 - protein, 5 aa, Plasmodium falciparum
NNKIF

SEQ ID NO: 3239142 - protein, 25 aa, Plasmodium falciparum
NNKIGTSINNYSDKKYIEKKKNELN

SEQ ID NO: 3239143 - protein, 12 aa, Plasmodium falciparum
NNKIKDELQQKN

SEQ ID NO: 3239144 - protein, 10 aa, Plasmodium falciparum
NNKIKKKENI

SEQ ID NO: 3239145 - protein, 19 aa, Plasmodium falciparum
NNKINGTSHLDNTNTNNEY

SEQ ID NO: 3239146 - protein, 15 aa, Plasmodium falciparum
NNKINKESKDVKPRN

SEQ ID NO: 3239147 - protein, 13 aa, Plasmodium falciparum
NNKINKKKSIDKH

SEQ ID NO: 3239148 - protein, 48 aa, Plasmodium falciparum
NNKINNNNNNNNNNNNNNSNNCNNNNNNSNSKKKTKKQGKKNLNSEEP

SEQ ID NO: 3239149 - protein, 7 aa, Plasmodium falciparum
NNKIQET

SEQ ID NO: 3239150 - protein, 21 aa, Plasmodium falciparum
NNKIVNSSDCKKNENKNEPYY

SEQ ID NO: 3239151 - protein, 4 aa, Plasmodium falciparum
NNKK

SEQ ID NO: 3239152 - protein, 26 aa, Plasmodium falciparum
NNKKDNNENDINNTNNNNNNSNNNDN

SEQ ID NO: 3239153 - protein, 9 aa, Plasmodium falciparum
NNKKEEINN

SEQ ID NO: 3239154 - protein, 10 aa, Plasmodium falciparum
NNKKEKNTGI

SEQ ID NO: 3239155 - protein, 13 aa, Plasmodium falciparum
NNKKERKPKNSLK

SEQ ID NO: 3239156 - protein, 9 aa, Plasmodium falciparum
NNKKETKCI

SEQ ID NO: 3239157 - protein, 9 aa, Plasmodium falciparum
NNKKGDNNY

SEQ ID NO: 3239158 - protein, 10 aa, Plasmodium falciparum
NNKKGKNSIR

SEQ ID NO: 3239159 - protein, 9 aa, Plasmodium falciparum
NNKKGSNCI

SEQ ID NO: 3239160 - protein, 8 aa, Plasmodium falciparum
NNKKKINN

SEQ ID NO: 3239161 - protein, 9 aa, Plasmodium falciparum
NNKKKKKKK

SEQ ID NO: 3239162 - protein, 14 aa, Plasmodium falciparum
NNKKKKKKKTRNKC

SEQ ID NO: 3239163 - protein, 12 aa, Plasmodium falciparum
NNKKKKKNYKHN

SEQ ID NO: 3239164 - protein, 16 aa, Plasmodium falciparum
NNKKKKKTSQKDYEEI

SEQ ID NO: 3239165 - protein, 11 aa, Plasmodium falciparum
NNKKKKNHCDN

SEQ ID NO: 3239166 - protein, 11 aa, Plasmodium falciparum
NNKKKKNSRWD

SEQ ID NO: 3239167 - protein, 6 aa, Plasmodium falciparum
NNKKKN

SEQ ID NO: 3239168 - protein, 28 aa, Plasmodium falciparum
NNKKKNKKNSQKNNQKNNQKNNQKHNQD

SEQ ID NO: 3239169 - protein, 57 aa, Plasmodium falciparum
NNKKKQNNNNNNNNNSKNNEKLNKRKKKKKKKKHINNKKNNEHTFKNDEKKYTNRRK

SEQ ID NO: 3239170 - protein, 9 aa, Plasmodium falciparum
NNKKKRRYF

SEQ ID NO: 3239171 - protein, 5 aa, Plasmodium falciparum
NNKKN

SEQ ID NO: 3239172 - protein, 7 aa, Plasmodium falciparum
NNKKNDH

SEQ ID NO: 3239173 - protein, 21 aa, Plasmodium falciparum
NNKKNDYYNNNSKYKKEKKRT

SEQ ID NO: 3239174 - protein, 8 aa, Plasmodium falciparum
NNKKNEDY

SEQ ID NO: 3239175 - protein, 23 aa, Plasmodium falciparum
NNKKNIKNNNKKKKNNNNNTNKK

SEQ ID NO: 3239176 - protein, 24 aa, Plasmodium falciparum
NNKKNKKNNYDNNNNNNNNNNNTL

SEQ ID NO: 3239177 - protein, 9 aa, Plasmodium falciparum
NNKKNNSEK

SEQ ID NO: 3239178 - protein, 9 aa, Plasmodium falciparum
NNKKNRNIQ

SEQ ID NO: 3239179 - protein, 9 aa, Plasmodium falciparum
NNKKQNENI

SEQ ID NO: 3239180 - protein, 10 aa, Plasmodium falciparum
NNKKRHKKIN

SEQ ID NO: 3239181 - protein, 9 aa, Plasmodium falciparum
NNKKRRDKV

SEQ ID NO: 3239182 - protein, 11 aa, Plasmodium falciparum
NNKKSKRNVRT

SEQ ID NO: 3239183 - protein, 12 aa, Plasmodium falciparum
NNKKSQNKNELN

SEQ ID NO: 3239184 - protein, 15 aa, Plasmodium falciparum
NNKKSSKNASVEYDD

SEQ ID NO: 3239185 - protein, 9 aa, Plasmodium falciparum
NNKKTLTET

SEQ ID NO: 3239186 - protein, 8 aa, Plasmodium falciparum
NNKKTYED

SEQ ID NO: 3239187 - protein, 5 aa, Plasmodium falciparum
NNKKY

SEQ ID NO: 3239188 - protein, 14 aa, Plasmodium falciparum
NNKLSISKNGNYKN

SEQ ID NO: 3239189 - protein, 6 aa, Plasmodium falciparum
NNKLSK

SEQ ID NO: 3239190 - protein, 4 aa, Plasmodium falciparum
NNKM

SEQ ID NO: 3239191 - protein, 5 aa, Plasmodium falciparum
NNKMD

SEQ ID NO: 3239192 - protein, 8 aa, Plasmodium falciparum
NNKMGKRK

SEQ ID NO: 3239193 - protein, 7 aa, Plasmodium falciparum
NNKMKDN

SEQ ID NO: 3239194 - protein, 9 aa, Plasmodium falciparum
NNKMKNQKK

SEQ ID NO: 3239195 - protein, 28 aa, Plasmodium falciparum
NNKMPAEYEKNTTPVQSSNKKDKSPRGI

SEQ ID NO: 3239196 - protein, 12 aa, Plasmodium falciparum
NNKMQKEEKRKE

SEQ ID NO: 3239197 - protein, 6 aa, Plasmodium falciparum
NNKMST

SEQ ID NO: 3239198 - protein, 18 aa, Plasmodium falciparum
NNKNDDMYSSSVNNGLEE

SEQ ID NO: 3239199 - protein, 32 aa, Plasmodium falciparum
NNKNDEKYQKYEETNISTDKDDNNSSDDNNGI

SEQ ID NO: 3239200 - protein, 7 aa, Plasmodium falciparum
NNKNDNT

SEQ ID NO: 3239201 - protein, 5 aa, Plasmodium falciparum
NNKNE

SEQ ID NO: 3239202 - protein, 6 aa, Plasmodium falciparum
NNKNEN

SEQ ID NO: 3239203 - protein, 37 aa, Plasmodium falciparum
NNKNENKKLNKRNSTLSSINNNNDNNNNNNNNNNNIH

SEQ ID NO: 3239204 - protein, 8 aa, Plasmodium falciparum
NNKNENVN

SEQ ID NO: 3239205 - protein, 8 aa, Plasmodium falciparum
NNKNEQSI

SEQ ID NO: 3239206 - protein, 8 aa, Plasmodium falciparum
NNKNETDP

SEQ ID NO: 3239207 - protein, 6 aa, Plasmodium falciparum
NNKNGF

SEQ ID NO: 3239208 - protein, 6 aa, Plasmodium falciparum
NNKNGI

SEQ ID NO: 3239209 - protein, 8 aa, Plasmodium falciparum
NNKNGLNQ

SEQ ID NO: 3239210 - protein, 8 aa, Plasmodium falciparum
NNKNGNDQ

SEQ ID NO: 3239211 - protein, 10 aa, Plasmodium falciparum
NNKNINDNNM

SEQ ID NO: 3239212 - protein, 12 aa, Plasmodium falciparum
NNKNINNNNNNN

SEQ ID NO: 3239213 - protein, 29 aa, Plasmodium falciparum
NNKNKGTTTTTTTSGSNNNNNYNNNSSSV

SEQ ID NO: 3239214 - protein, 9 aa, Plasmodium falciparum
NNKNKNDES

SEQ ID NO: 3239215 - protein, 10 aa, Plasmodium falciparum
NNKNKNNGYN

SEQ ID NO: 3239216 - protein, 37 aa, Plasmodium falciparum
NNKNKNNNKNNNNNNKNNNNNNKNNNNNNKNNNNDRY

SEQ ID NO: 3239217 - protein, 10 aa, Plasmodium falciparum
NNKNKPYITP

SEQ ID NO: 3239218 - protein, 16 aa, Plasmodium falciparum
NNKNKSNKKKRAKKNI

SEQ ID NO: 3239219 - protein, 5 aa, Plasmodium falciparum
NNKNN

SEQ ID NO: 3239220 - protein, 55 aa, Plasmodium falciparum
NNKNNDDDNNDDNNNNNNDDNNNNNNDDNNNDDNNNDNNNNNDDNNNNNNDDDNN

SEQ ID NO: 3239221 - protein, 9 aa, Plasmodium falciparum
NNKNNELRE

SEQ ID NO: 3239222 - protein, 6 aa, Plasmodium falciparum
NNKNNK

SEQ ID NO: 3239223 - protein, 9 aa, Plasmodium falciparum
NNKNNKIKT

SEQ ID NO: 3239224 - protein, 13 aa, Plasmodium falciparum
NNKNNNKNLAYEN

SEQ ID NO: 3239225 - protein, 7 aa, Plasmodium falciparum
NNKNNNN

SEQ ID NO: 3239226 - protein, 10 aa, Plasmodium falciparum
NNKNNNSDNI

SEQ ID NO: 3239227 - protein, 7 aa, Plasmodium falciparum
NNKNNTY

SEQ ID NO: 3239228 - protein, 8 aa, Plasmodium falciparum
NNKNQIKT

SEQ ID NO: 3239229 - protein, 7 aa, Plasmodium falciparum
NNKNRNQ

SEQ ID NO: 3239230 - protein, 9 aa, Plasmodium falciparum
NNKNSEHVQ

SEQ ID NO: 3239231 - protein, 8 aa, Plasmodium falciparum
NNKNSNDL

SEQ ID NO: 3239232 - protein, 9 aa, Plasmodium falciparum
NNKNSYDDI

SEQ ID NO: 3239233 - protein, 7 aa, Plasmodium falciparum
NNKNTDI

SEQ ID NO: 3239234 - protein, 8 aa, Plasmodium falciparum
NNKNYNNK

SEQ ID NO: 3239235 - protein, 8 aa, Plasmodium falciparum
NNKNYYNK

SEQ ID NO: 3239236 - protein, 6 aa, Plasmodium falciparum
NNKPAY

SEQ ID NO: 3239237 - protein, 8 aa, Plasmodium falciparum
NNKPENDM

SEQ ID NO: 3239238 - protein, 9 aa, Plasmodium falciparum
NNKPKNDCN

SEQ ID NO: 3239239 - protein, 8 aa, Plasmodium falciparum
NNKPSLSL

SEQ ID NO: 3239240 - protein, 12 aa, Plasmodium falciparum
NNKPSSHHEDDL

SEQ ID NO: 3239241 - protein, 11 aa, Plasmodium falciparum
NNKQDNKYEET

SEQ ID NO: 3239242 - protein, 11 aa, Plasmodium falciparum
NNKQKNLGSSY

SEQ ID NO: 3239243 - protein, 16 aa, Plasmodium falciparum
NNKQNDKKYVDDNDNN

SEQ ID NO: 3239244 - protein, 9 aa, Plasmodium falciparum
NNKQTVQEN

SEQ ID NO: 3239245 - protein, 4 aa, Plasmodium falciparum
NNKR

SEQ ID NO: 3239246 - protein, 5 aa, Plasmodium falciparum
NNKRD

SEQ ID NO: 3239247 - protein, 9 aa, Plasmodium falciparum
NNKRKKKRT

SEQ ID NO: 3239248 - protein, 13 aa, Plasmodium falciparum
NNKRKNKKGEHTK

SEQ ID NO: 3239249 - protein, 6 aa, Plasmodium falciparum
NNKRND

SEQ ID NO: 3239250 - protein, 7 aa, Plasmodium falciparum
NNKRNDN

SEQ ID NO: 3239251 - protein, 8 aa, Plasmodium falciparum
NNKRNEKI

SEQ ID NO: 3239252 - protein, 10 aa, Plasmodium falciparum
NNKRSDDEKE

SEQ ID NO: 3239253 - protein, 9 aa, Plasmodium falciparum
NNKSDDKKK

SEQ ID NO: 3239254 - protein, 17 aa, Plasmodium falciparum
NNKSDTQDFCPSDDKNI

SEQ ID NO: 3239255 - protein, 7 aa, Plasmodium falciparum
NNKSIEQ

SEQ ID NO: 3239256 - protein, 17 aa, Plasmodium falciparum
NNKSKHNNINNDTDHKE

SEQ ID NO: 3239257 - protein, 13 aa, Plasmodium falciparum
NNKSKKNKSKNDH

SEQ ID NO: 3239258 - protein, 35 aa, Plasmodium falciparum
NNKSNDNLNNNKTSSSSYAPNFKRETSDDISNNNI

SEQ ID NO: 3239259 - protein, 13 aa, Plasmodium falciparum
NNKSNDNNNEYVE

SEQ ID NO: 3239260 - protein, 9 aa, Plasmodium falciparum
NNKSNKHKK

SEQ ID NO: 3239261 - protein, 9 aa, Plasmodium falciparum
NNKSNNKQN

SEQ ID NO: 3239262 - protein, 66 aa, Plasmodium falciparum
NNKSNNNNNKNENNNNKNENNNKKKDNNKNENNNKKKDNNKNENNNKKKDNNKNNDNNKNNSNNNS

SEQ ID NO: 3239263 - protein, 16 aa, Plasmodium falciparum
NNKSQKISNDNNTSLQ

SEQ ID NO: 3239264 - protein, 16 aa, Plasmodium falciparum
NNKSQKYDNDDINEKS

SEQ ID NO: 3239265 - protein, 8 aa, Plasmodium falciparum
NNKSRFNN

SEQ ID NO: 3239266 - protein, 7 aa, Plasmodium falciparum
NNKSSIT

SEQ ID NO: 3239267 - protein, 5 aa, Plasmodium falciparum
NNKST

SEQ ID NO: 3239268 - protein, 7 aa, Plasmodium falciparum
NNKSTDQ

SEQ ID NO: 3239269 - protein, 10 aa, Plasmodium falciparum
NNKTDENTYN

SEQ ID NO: 3239270 - protein, 8 aa, Plasmodium falciparum
NNKTENKK

SEQ ID NO: 3239271 - protein, 6 aa, Plasmodium falciparum
NNKTFD

SEQ ID NO: 3239272 - protein, 5 aa, Plasmodium falciparum
NNKTI

SEQ ID NO: 3239273 - protein, 7 aa, Plasmodium falciparum
NNKTNDL

SEQ ID NO: 3239274 - protein, 6 aa, Plasmodium falciparum
NNKTNN

SEQ ID NO: 3239275 - protein, 22 aa, Plasmodium falciparum
NNKTPKNQKERNNDENNNDDNY

SEQ ID NO: 3239276 - protein, 14 aa, Plasmodium falciparum
NNKTQINKKNSDDS

SEQ ID NO: 3239277 - protein, 19 aa, Plasmodium falciparum
NNKYEDDGNVHREKEKDLE

SEQ ID NO: 3239278 - protein, 12 aa, Plasmodium falciparum
NNKYESNDEKDD

SEQ ID NO: 3239279 - protein, 6 aa, Plasmodium falciparum
NNKYEY

SEQ ID NO: 3239280 - protein, 5 aa, Plasmodium falciparum
NNKYN

SEQ ID NO: 3239281 - protein, 8 aa, Plasmodium falciparum
NNKYNNDN

SEQ ID NO: 3239282 - protein, 17 aa, Plasmodium falciparum
NNKYNNNHNNKNNNNNI

SEQ ID NO: 3239283 - protein, 5 aa, Plasmodium falciparum
NNKYQ

SEQ ID NO: 3239284 - protein, 21 aa, Plasmodium falciparum
NNKYTDERKYRNKSIKEDVDY

SEQ ID NO: 3239285 - protein, 6 aa, Plasmodium falciparum
NNKYWD

SEQ ID NO: 3239286 - protein, 4 aa, Plasmodium falciparum
NNLD

SEQ ID NO: 3239287 - protein, 5 aa, Plasmodium falciparum
NNLDD

SEQ ID NO: 3239288 - protein, 9 aa, Plasmodium falciparum
NNLDDGKRI

SEQ ID NO: 3239289 - protein, 6 aa, Plasmodium falciparum
NNLDEQ

SEQ ID NO: 3239290 - protein, 8 aa, Plasmodium falciparum
NNLDESNY

SEQ ID NO: 3239291 - protein, 12 aa, Plasmodium falciparum
NNLDPKAKKELG

SEQ ID NO: 3239292 - protein, 8 aa, Plasmodium falciparum
NNLDTNTQ

SEQ ID NO: 3239293 - protein, 4 aa, Plasmodium falciparum
NNLE

SEQ ID NO: 3239294 - protein, 5 aa, Plasmodium falciparum
NNLEK

SEQ ID NO: 3239295 - protein, 6 aa, Plasmodium falciparum
NNLEQK

SEQ ID NO: 3239296 - protein, 13 aa, Plasmodium falciparum
NNLERKNSEQDGL

SEQ ID NO: 3239297 - protein, 4 aa, Plasmodium falciparum
NNLG

SEQ ID NO: 3239298 - protein, 9 aa, Plasmodium falciparum
NNLGPTTQK

SEQ ID NO: 3239299 - protein, 13 aa, Plasmodium falciparum
NNLGTNQKSINHP

SEQ ID NO: 3239300 - protein, 4 aa, Plasmodium falciparum
NNLK

SEQ ID NO: 3239301 - protein, 24 aa, Plasmodium falciparum
NNLKGKHNTLNNNNNNNNINKSSS

SEQ ID NO: 3239302 - protein, 5 aa, Plasmodium falciparum
NNLKH

SEQ ID NO: 3239303 - protein, 9 aa, Plasmodium falciparum
NNLKKNKKK

SEQ ID NO: 3239304 - protein, 5 aa, Plasmodium falciparum
NNLKN

SEQ ID NO: 3239305 - protein, 6 aa, Plasmodium falciparum
NNLKNE

SEQ ID NO: 3239306 - protein, 6 aa, Plasmodium falciparum
NNLKNK

SEQ ID NO: 3239307 - protein, 10 aa, Plasmodium falciparum
NNLKNKNSYL

SEQ ID NO: 3239308 - protein, 12 aa, Plasmodium falciparum
NNLKNNNNHPCN

SEQ ID NO: 3239309 - protein, 6 aa, Plasmodium falciparum
NNLKNT

SEQ ID NO: 3239310 - protein, 24 aa, Plasmodium falciparum
NNLKRKSDANKKNKNNKKNNKVKY

SEQ ID NO: 3239311 - protein, 4 aa, Plasmodium falciparum
NNLL

SEQ ID NO: 3239312 - protein, 5 aa, Plasmodium falciparum
NNLNN

SEQ ID NO: 3239313 - protein, 10 aa, Plasmodium falciparum
NNLNNSNHNH

SEQ ID NO: 3239314 - protein, 20 aa, Plasmodium falciparum
NNLNTDSQSHNNISTENNNL

SEQ ID NO: 3239315 - protein, 14 aa, Plasmodium falciparum
NNLNTQNNNCYSNK

SEQ ID NO: 3239316 - protein, 8 aa, Plasmodium falciparum
NNLNYDKT

SEQ ID NO: 3239317 - protein, 10 aa, Plasmodium falciparum
NNLPENPSTF

SEQ ID NO: 3239318 - protein, 15 aa, Plasmodium falciparum
NNLPNGVNPSEGYNN

SEQ ID NO: 3239319 - protein, 6 aa, Plasmodium falciparum
NNLPPN

SEQ ID NO: 3239320 - protein, 5 aa, Plasmodium falciparum
NNLPS

SEQ ID NO: 3239321 - protein, 4 aa, Plasmodium falciparum
NNLS

SEQ ID NO: 3239322 - protein, 16 aa, Plasmodium falciparum
NNLSNNESKRKSRRKK

SEQ ID NO: 3239323 - protein, 8 aa, Plasmodium falciparum
NNLSNNNN

SEQ ID NO: 3239324 - protein, 7 aa, Plasmodium falciparum
NNLSSDK

SEQ ID NO: 3239325 - protein, 12 aa, Plasmodium falciparum
NNLSSSSVNSIK

SEQ ID NO: 3239326 - protein, 14 aa, Plasmodium falciparum
NNLTDDKNEQKYKS

SEQ ID NO: 3239327 - protein, 36 aa, Plasmodium falciparum
NNLTGAGRKRNSSTTITRTSNTIHNNNNKNNSNNST

SEQ ID NO: 3239328 - protein, 21 aa, Plasmodium falciparum
NNLTSNNSNVNQVENRTNGEH

SEQ ID NO: 3239329 - protein, 11 aa, Plasmodium falciparum
NNMANNTNDTN

SEQ ID NO: 3239330 - protein, 5 aa, Plasmodium falciparum
NNMDI

SEQ ID NO: 3239331 - protein, 7 aa, Plasmodium falciparum
NNMDRSS

SEQ ID NO: 3239332 - protein, 7 aa, Plasmodium falciparum
NNMEEVE

SEQ ID NO: 3239333 - protein, 13 aa, Plasmodium falciparum
NNMEKKKSYGNND

SEQ ID NO: 3239334 - protein, 8 aa, Plasmodium falciparum
NNMGRTSN

SEQ ID NO: 3239335 - protein, 29 aa, Plasmodium falciparum
NNMKCSSTTTVNNSDSNSNNNNNNNNNNI

SEQ ID NO: 3239336 - protein, 9 aa, Plasmodium falciparum
NNMKDKEDR

SEQ ID NO: 3239337 - protein, 7 aa, Plasmodium falciparum
NNMKGDK

SEQ ID NO: 3239338 - protein, 34 aa, Plasmodium falciparum
NNMKHTKNNISDDAEDIISGGKKNINTAHNNNMN

SEQ ID NO: 3239339 - protein, 14 aa, Plasmodium falciparum
NNMNERNDGHTINH

SEQ ID NO: 3239340 - protein, 6 aa, Plasmodium falciparum
NNMNKE

SEQ ID NO: 3239341 - protein, 12 aa, Plasmodium falciparum
NNMNKSGENQYF

SEQ ID NO: 3239342 - protein, 11 aa, Plasmodium falciparum
NNMNNKNNMNN

SEQ ID NO: 3239343 - protein, 11 aa, Plasmodium falciparum
NNMNNNEEQED

SEQ ID NO: 3239344 - protein, 14 aa, Plasmodium falciparum
NNMNNNVNNNMNNN

SEQ ID NO: 3239345 - protein, 7 aa, Plasmodium falciparum
NNMNNTN

SEQ ID NO: 3239346 - protein, 6 aa, Plasmodium falciparum
NNMNQR

SEQ ID NO: 3239347 - protein, 5 aa, Plasmodium falciparum
NNMNY

SEQ ID NO: 3239348 - protein, 7 aa, Plasmodium falciparum
NNMPNNS

SEQ ID NO: 3239349 - protein, 6 aa, Plasmodium falciparum
NNMQKE

SEQ ID NO: 3239350 - protein, 8 aa, Plasmodium falciparum
NNMSENEP

SEQ ID NO: 3239351 - protein, 13 aa, Plasmodium falciparum
NNMSGEKKRKSVE

SEQ ID NO: 3239352 - protein, 6 aa, Plasmodium falciparum
NNMSGV

SEQ ID NO: 3239353 - protein, 7 aa, Plasmodium falciparum
NNMSSHN

SEQ ID NO: 3239354 - protein, 4 aa, Plasmodium falciparum
NNMT

SEQ ID NO: 3239355 - protein, 6 aa, Plasmodium falciparum
NNMYNE

SEQ ID NO: 3239356 - protein, 4 aa, Plasmodium falciparum
NNNA

SEQ ID NO: 3239357 - protein, 6 aa, Plasmodium falciparum
NNNAGY

SEQ ID NO: 3239358 - protein, 9 aa, Plasmodium falciparum
NNNAPNNNV

SEQ ID NO: 3239359 - protein, 9 aa, Plasmodium falciparum
NNNATKTKD

SEQ ID NO: 3239360 - protein, 4 aa, Plasmodium falciparum
NNNC

SEQ ID NO: 3239361 - protein, 5 aa, Plasmodium falciparum
NNNCC

SEQ ID NO: 3239362 - protein, 5 aa, Plasmodium falciparum
NNNCN

SEQ ID NO: 3239363 - protein, 14 aa, Plasmodium falciparum
NNNDDDEEKGERKK

SEQ ID NO: 3239364 - protein, 9 aa, Plasmodium falciparum
NNNDDDNDM

SEQ ID NO: 3239365 - protein, 16 aa, Plasmodium falciparum
NNNDDNNINHNNSEGI

SEQ ID NO: 3239366 - protein, 6 aa, Plasmodium falciparum
NNNDEI

SEQ ID NO: 3239367 - protein, 7 aa, Plasmodium falciparum
NNNDELK

SEQ ID NO: 3239368 - protein, 15 aa, Plasmodium falciparum
NNNDENNEGKNSADN

SEQ ID NO: 3239369 - protein, 18 aa, Plasmodium falciparum
NNNDETDEAKYTPQGSTI

SEQ ID NO: 3239370 - protein, 7 aa, Plasmodium falciparum
NNNDEYS

SEQ ID NO: 3239371 - protein, 6 aa, Plasmodium falciparum
NNNDGE

SEQ ID NO: 3239372 - protein, 5 aa, Plasmodium falciparum
NNNDH

SEQ ID NO: 3239373 - protein, 17 aa, Plasmodium falciparum
NNNDHNNNNNNNNMSRN

SEQ ID NO: 3239374 - protein, 5 aa, Plasmodium falciparum
NNNDI

SEQ ID NO: 3239375 - protein, 10 aa, Plasmodium falciparum
NNNDKEKEDI

SEQ ID NO: 3239376 - protein, 14 aa, Plasmodium falciparum
NNNDMDNETIKNDY

SEQ ID NO: 3239377 - protein, 6 aa, Plasmodium falciparum
NNNDNI

SEQ ID NO: 3239378 - protein, 7 aa, Plasmodium falciparum
NNNDNIN

SEQ ID NO: 3239379 - protein, 37 aa, Plasmodium falciparum
NNNDNKDRINKKNSNSTNNTNSSNDNLSNYNKKEKKL

SEQ ID NO: 3239380 - protein, 8 aa, Plasmodium falciparum
NNNDNKKY

SEQ ID NO: 3239381 - protein, 10 aa, Plasmodium falciparum
NNNDNKTTNV

SEQ ID NO: 3239382 - protein, 24 aa, Plasmodium falciparum
NNNDNNKKGNNDTVHNNDKDDGFN

SEQ ID NO: 3239383 - protein, 7 aa, Plasmodium falciparum
NNNDNNL

SEQ ID NO: 3239384 - protein, 7 aa, Plasmodium falciparum
NNNDNNN

SEQ ID NO: 3239385 - protein, 47 aa, Plasmodium falciparum
NNNDNNNDNINDNNNNNDHGKNNTNHDTYNNNYNNNRIDEDEGDKDL

SEQ ID NO: 3239386 - protein, 8 aa, Plasmodium falciparum
NNNDNNNN

SEQ ID NO: 3239387 - protein, 18 aa, Plasmodium falciparum
NNNDNNNNDNNKNNNNNI

SEQ ID NO: 3239388 - protein, 37 aa, Plasmodium falciparum
NNNDNNNNNDDNNNDDNNNNNNNSNNNSNNNNNNNNI

SEQ ID NO: 3239389 - protein, 16 aa, Plasmodium falciparum
NNNDNNNNNNNNINGV

SEQ ID NO: 3239390 - protein, 41 aa, Plasmodium falciparum
NNNDNNNNNNNNNNNNNNNNNNNNNNNSHNNNYNNQPHSNN

SEQ ID NO: 3239391 - protein, 11 aa, Plasmodium falciparum
NNNDNNNTDIT

SEQ ID NO: 3239392 - protein, 8 aa, Plasmodium falciparum
NNNDNRAV

SEQ ID NO: 3239393 - protein, 11 aa, Plasmodium falciparum
NNNDNTSEYNT

SEQ ID NO: 3239394 - protein, 7 aa, Plasmodium falciparum
NNNDSNN

SEQ ID NO: 3239395 - protein, 8 aa, Plasmodium falciparum
NNNDSSIS

SEQ ID NO: 3239396 - protein, 17 aa, Plasmodium falciparum
NNNDTDNNNNNNNNNNN

SEQ ID NO: 3239397 - protein, 5 aa, Plasmodium falciparum
NNNDV

SEQ ID NO: 3239398 - protein, 12 aa, Plasmodium falciparum
NNNDYGDNEETQ

SEQ ID NO: 3239399 - protein, 6 aa, Plasmodium falciparum
NNNDYS

SEQ ID NO: 3239400 - protein, 18 aa, Plasmodium falciparum
NNNEANYNNSEEDNNNNI

SEQ ID NO: 3239401 - protein, 6 aa, Plasmodium falciparum
NNNEDM

SEQ ID NO: 3239402 - protein, 24 aa, Plasmodium falciparum
NNNEEDDYDDEDDNDDEDDNDDGR

SEQ ID NO: 3239403 - protein, 10 aa, Plasmodium falciparum
NNNEENDQDK

SEQ ID NO: 3239404 - protein, 8 aa, Plasmodium falciparum
NNNEENRN

SEQ ID NO: 3239405 - protein, 8 aa, Plasmodium falciparum
NNNEENTP

SEQ ID NO: 3239406 - protein, 6 aa, Plasmodium falciparum
NNNEGK

SEQ ID NO: 3239407 - protein, 8 aa, Plasmodium falciparum
NNNEGSDE

SEQ ID NO: 3239408 - protein, 40 aa, Plasmodium falciparum
NNNEKKESFSINGDEKKKSFSINGDEKKESFSINGDEKKE

SEQ ID NO: 3239409 - protein, 7 aa, Plasmodium falciparum
NNNEKNN

SEQ ID NO: 3239410 - protein, 11 aa, Plasmodium falciparum
NNNEKSVDETA

SEQ ID NO: 3239411 - protein, 7 aa, Plasmodium falciparum
NNNEKYS

SEQ ID NO: 3239412 - protein, 5 aa, Plasmodium falciparum
NNNEM

SEQ ID NO: 3239413 - protein, 17 aa, Plasmodium falciparum
NNNENEKIKSNKNKHSI

SEQ ID NO: 3239414 - protein, 10 aa, Plasmodium falciparum
NNNENGSVGS

SEQ ID NO: 3239415 - protein, 9 aa, Plasmodium falciparum
NNNENNDNK

SEQ ID NO: 3239416 - protein, 11 aa, Plasmodium falciparum
NNNENNNNENM

SEQ ID NO: 3239417 - protein, 6 aa, Plasmodium falciparum
NNNENP

SEQ ID NO: 3239418 - protein, 7 aa, Plasmodium falciparum
NNNENTY

SEQ ID NO: 3239419 - protein, 15 aa, Plasmodium falciparum
NNNENYSDDNTTNIP

SEQ ID NO: 3239420 - protein, 7 aa, Plasmodium falciparum
NNNEPFS

SEQ ID NO: 3239421 - protein, 8 aa, Plasmodium falciparum
NNNEQNRY

SEQ ID NO: 3239422 - protein, 7 aa, Plasmodium falciparum
NNNESRK

SEQ ID NO: 3239423 - protein, 4 aa, Plasmodium falciparum
NNNF

SEQ ID NO: 3239424 - protein, 17 aa, Plasmodium falciparum
NNNFDKKTRKQKKKKKK

SEQ ID NO: 3239425 - protein, 12 aa, Plasmodium falciparum
NNNFNDDGRGNH

SEQ ID NO: 3239426 - protein, 17 aa, Plasmodium falciparum
NNNGDGYDDDGYGEKNV

SEQ ID NO: 3239427 - protein, 8 aa, Plasmodium falciparum
NNNGPTKL

SEQ ID NO: 3239428 - protein, 9 aa, Plasmodium falciparum
NNNGQESDE

SEQ ID NO: 3239429 - protein, 92 aa, Plasmodium falciparum
NNNGSATAEISDNKDNTINNDSNKNNNGTKKGKSNKTDETDVNSLKSEQEKKDTEDGNNTSEKKKDKKKKKDKKNNHDINNNNNNNKNETCI

SEQ ID NO: 3239430 - protein, 6 aa, Plasmodium falciparum
NNNGTY

SEQ ID NO: 3239431 - protein, 5 aa, Plasmodium falciparum
NNNHD

SEQ ID NO: 3239432 - protein, 6 aa, Plasmodium falciparum
NNNHHH

SEQ ID NO: 3239433 - protein, 6 aa, Plasmodium falciparum
NNNHKE

SEQ ID NO: 3239434 - protein, 6 aa, Plasmodium falciparum
NNNHKR

SEQ ID NO: 3239435 - protein, 13 aa, Plasmodium falciparum
NNNHNHNKIGKKK

SEQ ID NO: 3239436 - protein, 25 aa, Plasmodium falciparum
NNNHNKLKGSYNKTTQQNYSNDDDI

SEQ ID NO: 3239437 - protein, 10 aa, Plasmodium falciparum
NNNHNNNHNN

SEQ ID NO: 3239438 - protein, 15 aa, Plasmodium falciparum
NNNHNNNNKNNNDIC

SEQ ID NO: 3239439 - protein, 15 aa, Plasmodium falciparum
NNNHNNNNNNNNNNR

SEQ ID NO: 3239440 - protein, 12 aa, Plasmodium falciparum
NNNHNNNNNNSC

SEQ ID NO: 3239441 - protein, 7 aa, Plasmodium falciparum
NNNHNSI

SEQ ID NO: 3239442 - protein, 7 aa, Plasmodium falciparum
NNNIDDK

SEQ ID NO: 3239443 - protein, 8 aa, Plasmodium falciparum
NNNIDENN

SEQ ID NO: 3239444 - protein, 11 aa, Plasmodium falciparum
NNNIDNNSIQK

SEQ ID NO: 3239445 - protein, 6 aa, Plasmodium falciparum
NNNIED

SEQ ID NO: 3239446 - protein, 11 aa, Plasmodium falciparum
NNNIHSGSSTH

SEQ ID NO: 3239447 - protein, 20 aa, Plasmodium falciparum
NNNIKKDEHKKEYNERNDKM

SEQ ID NO: 3239448 - protein, 6 aa, Plasmodium falciparum
NNNIKN

SEQ ID NO: 3239449 - protein, 33 aa, Plasmodium falciparum
NNNINDCNDNNINDCNDNNINDCNDNNINDCND

SEQ ID NO: 3239450 - protein, 13 aa, Plasmodium falciparum
NNNINDNNKITNE

SEQ ID NO: 3239451 - protein, 12 aa, Plasmodium falciparum
NNNINDQTHNIG

SEQ ID NO: 3239452 - protein, 6 aa, Plasmodium falciparum
NNNINN

SEQ ID NO: 3239453 - protein, 7 aa, Plasmodium falciparum
NNNINNN

SEQ ID NO: 3239454 - protein, 25 aa, Plasmodium falciparum
NNNINNNNNINSKCNNNNSNSSSSS

SEQ ID NO: 3239455 - protein, 11 aa, Plasmodium falciparum
NNNINNNNNLN

SEQ ID NO: 3239456 - protein, 26 aa, Plasmodium falciparum
NNNINNNNNNNNNNNNINNNSSNINP

SEQ ID NO: 3239457 - protein, 11 aa, Plasmodium falciparum
NNNINNNQHRN

SEQ ID NO: 3239458 - protein, 22 aa, Plasmodium falciparum
NNNINNSNNNNNFNNNNNYNNN

SEQ ID NO: 3239459 - protein, 6 aa, Plasmodium falciparum
NNNINT

SEQ ID NO: 3239460 - protein, 13 aa, Plasmodium falciparum
NNNINTKKYNTQL

SEQ ID NO: 3239461 - protein, 17 aa, Plasmodium falciparum
NNNINTLNNNNSVQNVN

SEQ ID NO: 3239462 - protein, 7 aa, Plasmodium falciparum
NNNINTY

SEQ ID NO: 3239463 - protein, 7 aa, Plasmodium falciparum
NNNIQNE

SEQ ID NO: 3239464 - protein, 9 aa, Plasmodium falciparum
NNNISSNNA

SEQ ID NO: 3239465 - protein, 7 aa, Plasmodium falciparum
NNNISSS

SEQ ID NO: 3239466 - protein, 6 aa, Plasmodium falciparum
NNNITD

SEQ ID NO: 3239467 - protein, 5 aa, Plasmodium falciparum
NNNIY

SEQ ID NO: 3239468 - protein, 13 aa, Plasmodium falciparum
NNNKCDNKNDADI

SEQ ID NO: 3239469 - protein, 18 aa, Plasmodium falciparum
NNNKDEKIINNNNNNNKI

SEQ ID NO: 3239470 - protein, 7 aa, Plasmodium falciparum
NNNKDKI

SEQ ID NO: 3239471 - protein, 6 aa, Plasmodium falciparum
NNNKEE

SEQ ID NO: 3239472 - protein, 7 aa, Plasmodium falciparum
NNNKENH

SEQ ID NO: 3239473 - protein, 9 aa, Plasmodium falciparum
NNNKENYNH

SEQ ID NO: 3239474 - protein, 21 aa, Plasmodium falciparum
NNNKERNNNEHNNNNNPRANE

SEQ ID NO: 3239475 - protein, 12 aa, Plasmodium falciparum
NNNKGDNNNDSE

SEQ ID NO: 3239476 - protein, 5 aa, Plasmodium falciparum
NNNKK

SEQ ID NO: 3239477 - protein, 40 aa, Plasmodium falciparum
NNNKKDNNIYDDKYNKKDNNIKASSHNNKKKECCNSDNND

SEQ ID NO: 3239478 - protein, 9 aa, Plasmodium falciparum
NNNKKEYSG

SEQ ID NO: 3239479 - protein, 8 aa, Plasmodium falciparum
NNNKKGQL

SEQ ID NO: 3239480 - protein, 11 aa, Plasmodium falciparum
NNNKKKKAFTT

SEQ ID NO: 3239481 - protein, 33 aa, Plasmodium falciparum
NNNKKKKKNHNNNNKNHNNNNNDNNNNNNKDPV

SEQ ID NO: 3239482 - protein, 16 aa, Plasmodium falciparum
NNNKKKKNKKNVENQE

SEQ ID NO: 3239483 - protein, 15 aa, Plasmodium falciparum
NNNKKKNTKKEKKII

SEQ ID NO: 3239484 - protein, 8 aa, Plasmodium falciparum
NNNKKNDD

SEQ ID NO: 3239485 - protein, 5 aa, Plasmodium falciparum
NNNKM

SEQ ID NO: 3239486 - protein, 130 aa, Plasmodium falciparum
NNNKMNNNNNNKMNNNNNNKMNNNNNNKMNNNNNNKMNNNNNNKMNNNNNNKMNNNNNNKMNNNNNNKMNNNNNNKMNNNNNNKINNNNNKINNNNNNKINNNNNNKINNNNNNKINNNNNKINNNNNNV

SEQ ID NO: 3239487 - protein, 18 aa, Plasmodium falciparum
NNNKNDTNVEEKGNVNDD

SEQ ID NO: 3239488 - protein, 10 aa, Plasmodium falciparum
NNNKNEEHNR

SEQ ID NO: 3239489 - protein, 30 aa, Plasmodium falciparum
NNNKNIQNKKQNSSSKCKNEKNSYEQSSSS

SEQ ID NO: 3239490 - protein, 18 aa, Plasmodium falciparum
NNNKNKPSITQRHTPRYT

SEQ ID NO: 3239491 - protein, 12 aa, Plasmodium falciparum
NNNKNKSEDNEK

SEQ ID NO: 3239492 - protein, 8 aa, Plasmodium falciparum
NNNKNNIH

SEQ ID NO: 3239493 - protein, 11 aa, Plasmodium falciparum
NNNKNNKKNNS

SEQ ID NO: 3239494 - protein, 85 aa, Plasmodium falciparum
NNNKNNKYSDHNKNNKYSDHNKNNKYSDHNKNNKYSDHNKNNKYRDHNKNKYRDHNKNKYRDHNKNKYRDHNKNKYSDHNNDNNY

SEQ ID NO: 3239495 - protein, 56 aa, Plasmodium falciparum
NNNKNNNNKNNDNKNNDNNDYNNNNSCNNLGERSNHYDNYGGDNNNPCNNNNDKYD

SEQ ID NO: 3239496 - protein, 10 aa, Plasmodium falciparum
NNNKNSDSFK

SEQ ID NO: 3239497 - protein, 8 aa, Plasmodium falciparum
NNNKNSLY

SEQ ID NO: 3239498 - protein, 9 aa, Plasmodium falciparum
NNNKPEHLS

SEQ ID NO: 3239499 - protein, 9 aa, Plasmodium falciparum
NNNKQINNN

SEQ ID NO: 3239500 - protein, 13 aa, Plasmodium falciparum
NNNKQNTQENISR

SEQ ID NO: 3239501 - protein, 9 aa, Plasmodium falciparum
NNNKQNVIN

SEQ ID NO: 3239502 - protein, 10 aa, Plasmodium falciparum
NNNKQTQQNH

SEQ ID NO: 3239503 - protein, 13 aa, Plasmodium falciparum
NNNKSSKKLSCTK

SEQ ID NO: 3239504 - protein, 10 aa, Plasmodium falciparum
NNNKTRKQAT

SEQ ID NO: 3239505 - protein, 27 aa, Plasmodium falciparum
NNNKTSSSNPVDNNTKTVSSENNIKNN

SEQ ID NO: 3239506 - protein, 8 aa, Plasmodium falciparum
NNNKYNNN

SEQ ID NO: 3239507 - protein, 9 aa, Plasmodium falciparum
NNNKYNNNN

SEQ ID NO: 3239508 - protein, 4 aa, Plasmodium falciparum
NNNL

SEQ ID NO: 3239509 - protein, 12 aa, Plasmodium falciparum
NNNLGNNNNNNV

SEQ ID NO: 3239510 - protein, 18 aa, Plasmodium falciparum
NNNLKEKDIQKKEYEKQG

SEQ ID NO: 3239511 - protein, 5 aa, Plasmodium falciparum
NNNLN

SEQ ID NO: 3239512 - protein, 6 aa, Plasmodium falciparum
NNNLND

SEQ ID NO: 3239513 - protein, 8 aa, Plasmodium falciparum
NNNLNPSS

SEQ ID NO: 3239514 - protein, 12 aa, Plasmodium falciparum
NNNLSDGNCKNY

SEQ ID NO: 3239515 - protein, 4 aa, Plasmodium falciparum
NNNM

SEQ ID NO: 3239516 - protein, 7 aa, Plasmodium falciparum
NNNMCDS

SEQ ID NO: 3239517 - protein, 48 aa, Plasmodium falciparum
NNNMDDNNVDDNNVDNNNVDNNNVDNNNVDNNNVDNNNVDDNNVDNNN

SEQ ID NO: 3239518 - protein, 6 aa, Plasmodium falciparum
NNNMEH

SEQ ID NO: 3239519 - protein, 7 aa, Plasmodium falciparum
NNNMHNY

SEQ ID NO: 3239520 - protein, 5 aa, Plasmodium falciparum
NNNMN

SEQ ID NO: 3239521 - protein, 23 aa, Plasmodium falciparum
NNNMNNMNNETSKCQQTSLESQQ

SEQ ID NO: 3239522 - protein, 7 aa, Plasmodium falciparum
NNNMNNN

SEQ ID NO: 3239523 - protein, 11 aa, Plasmodium falciparum
NNNMNNNNNVN

SEQ ID NO: 3239524 - protein, 72 aa, Plasmodium falciparum
NNNMNSSSNNNNKINSNNSHSNNKNNNNKNKNNNNSNNNNNNNNSNNNSNNNNSNNNNNNNNNNNNNNNNVN

SEQ ID NO: 3239525 - protein, 8 aa, Plasmodium falciparum
NNNMNTSP

SEQ ID NO: 3239526 - protein, 7 aa, Plasmodium falciparum
NNNMTND

SEQ ID NO: 3239527 - protein, 14 aa, Plasmodium falciparum
NNNNCDDNNNNCDD

SEQ ID NO: 3239528 - protein, 79 aa, Plasmodium falciparum
NNNNDDDDDDENNTNNNNNNNNNNNNNNNNNNNNNNNNNNNNNNNNNNNNNNNNNNNNNNNNNNNNNNNNNKSNKNNNK

SEQ ID NO: 3239529 - protein, 40 aa, Plasmodium falciparum
NNNNDDDNNDDDNNNDNNNNDNNNNNNNNNNNNNNNNNNN

SEQ ID NO: 3239530 - protein, 45 aa, Plasmodium falciparum
NNNNDDNENDEDNENDEDNEDNEDNEDNEDNENDEDNKNNDDNIH

SEQ ID NO: 3239531 - protein, 232 aa, Plasmodium falciparum
NNNNDDVLSESNNENKEKTSDDATHKETQEKSDQEPSQNIQEDNSDEKHAENEENVEQIETDSNVSEEANDENKDNMQTTTDEGTEELQQNDEDAESLTKENSKSEEQENEDSTDAEAIDKEEVETEEKGKDEQKKDEQKEQDEEEDGEKENKHKSSETTNETVTDIEENKNEVKGEEHLQGSEQSIEASESSQKDETKETEDKEEYVNANDDESSEEDTTPNETNKTDNGS

SEQ ID NO: 3239532 - protein, 6 aa, Plasmodium falciparum
NNNNDN

SEQ ID NO: 3239533 - protein, 8 aa, Plasmodium falciparum
NNNNDNIF

SEQ ID NO: 3239534 - protein, 19 aa, Plasmodium falciparum
NNNNDNIKSDGSHNNNNYK

SEQ ID NO: 3239535 - protein, 9 aa, Plasmodium falciparum
NNNNDNKNN

SEQ ID NO: 3239536 - protein, 15 aa, Plasmodium falciparum
NNNNDSNNNSNNNSN

SEQ ID NO: 3239537 - protein, 16 aa, Plasmodium falciparum
NNNNDYELNGPSLSDV

SEQ ID NO: 3239538 - protein, 5 aa, Plasmodium falciparum
NNNNE

SEQ ID NO: 3239539 - protein, 10 aa, Plasmodium falciparum
NNNNENIGKM

SEQ ID NO: 3239540 - protein, 23 aa, Plasmodium falciparum
NNNNEQCGRKKKRKKENITCENN

SEQ ID NO: 3239541 - protein, 6 aa, Plasmodium falciparum
NNNNER

SEQ ID NO: 3239542 - protein, 21 aa, Plasmodium falciparum
NNNNETKNNKEKHLNNKGADI

SEQ ID NO: 3239543 - protein, 38 aa, Plasmodium falciparum
NNNNGEGNNNNGDGNNNNDDDNHNNNKKNNSLNGDNEK

SEQ ID NO: 3239544 - protein, 13 aa, Plasmodium falciparum
NNNNGNKYYPYDE

SEQ ID NO: 3239545 - protein, 9 aa, Plasmodium falciparum
NNNNHNNNM

SEQ ID NO: 3239546 - protein, 14 aa, Plasmodium falciparum
NNNNHTNKHDNHNS

SEQ ID NO: 3239547 - protein, 5 aa, Plasmodium falciparum
NNNNI

SEQ ID NO: 3239548 - protein, 7 aa, Plasmodium falciparum
NNNNIDK

SEQ ID NO: 3239549 - protein, 8 aa, Plasmodium falciparum
NNNNIDND

SEQ ID NO: 3239550 - protein, 12 aa, Plasmodium falciparum
NNNNIGKPNVDN

SEQ ID NO: 3239551 - protein, 8 aa, Plasmodium falciparum
NNNNINDE

SEQ ID NO: 3239552 - protein, 8 aa, Plasmodium falciparum
NNNNINNE

SEQ ID NO: 3239553 - protein, 10 aa, Plasmodium falciparum
NNNNINNNNI

SEQ ID NO: 3239554 - protein, 46 aa, Plasmodium falciparum
NNNNINNNNINNNINNNNINNNYNNNYNNNYISSSNNYNNKSPNEV

SEQ ID NO: 3239555 - protein, 56 aa, Plasmodium falciparum
NNNNINSNNINSNNINSNNINSNNINSNNINSNNINSNNSNNSNNINSNNSNNINN

SEQ ID NO: 3239556 - protein, 10 aa, Plasmodium falciparum
NNNNINSNSY

SEQ ID NO: 3239557 - protein, 6 aa, Plasmodium falciparum
NNNNIS

SEQ ID NO: 3239558 - protein, 10 aa, Plasmodium falciparum
NNNNISSEKM

SEQ ID NO: 3239559 - protein, 26 aa, Plasmodium falciparum
NNNNISYNNNNNNYHNEYNTNHTEDK

SEQ ID NO: 3239560 - protein, 6 aa, Plasmodium falciparum
NNNNIT

SEQ ID NO: 3239561 - protein, 8 aa, Plasmodium falciparum
NNNNKDKD

SEQ ID NO: 3239562 - protein, 6 aa, Plasmodium falciparum
NNNNKE

SEQ ID NO: 3239563 - protein, 11 aa, Plasmodium falciparum
NNNNKEHENFD

SEQ ID NO: 3239564 - protein, 7 aa, Plasmodium falciparum
NNNNKEN

SEQ ID NO: 3239565 - protein, 9 aa, Plasmodium falciparum
NNNNKEQYY

SEQ ID NO: 3239566 - protein, 12 aa, Plasmodium falciparum
NNNNKESDDQKE

SEQ ID NO: 3239567 - protein, 11 aa, Plasmodium falciparum
NNNNKKDSTNL

SEQ ID NO: 3239568 - protein, 24 aa, Plasmodium falciparum
NNNNKKNISNNNNKKNISNNNNNY

SEQ ID NO: 3239569 - protein, 6 aa, Plasmodium falciparum
NNNNKN

SEQ ID NO: 3239570 - protein, 8 aa, Plasmodium falciparum
NNNNKNNI

SEQ ID NO: 3239571 - protein, 26 aa, Plasmodium falciparum
NNNNKNNNNDNNNSSSCCSSSSSSNI

SEQ ID NO: 3239572 - protein, 25 aa, Plasmodium falciparum
NNNNKNNNNNNKNNNKNNNDDIYNN

SEQ ID NO: 3239573 - protein, 38 aa, Plasmodium falciparum
NNNNKNNNSNNNNNNNNNNNNNNNNNNNNNNNNSNSVN

SEQ ID NO: 3239574 - protein, 10 aa, Plasmodium falciparum
NNNNKNNYDD

SEQ ID NO: 3239575 - protein, 18 aa, Plasmodium falciparum
NNNNKNYKTSEREINKNK

SEQ ID NO: 3239576 - protein, 25 aa, Plasmodium falciparum
NNNNKSDSKSDIKNYNKDDDDFDDM

SEQ ID NO: 3239577 - protein, 7 aa, Plasmodium falciparum
NNNNKSM

SEQ ID NO: 3239578 - protein, 9 aa, Plasmodium falciparum
NNNNKTENE

SEQ ID NO: 3239579 - protein, 13 aa, Plasmodium falciparum
NNNNKYNNENKNM

SEQ ID NO: 3239580 - protein, 7 aa, Plasmodium falciparum
NNNNKYY

SEQ ID NO: 3239581 - protein, 5 aa, Plasmodium falciparum
NNNNL

SEQ ID NO: 3239582 - protein, 8 aa, Plasmodium falciparum
NNNNLKTS

SEQ ID NO: 3239583 - protein, 37 aa, Plasmodium falciparum
NNNNMEQGNQEYENENAQMNYPNKRNMDNNPSNQFDQ

SEQ ID NO: 3239584 - protein, 8 aa, Plasmodium falciparum
NNNNMNNN

SEQ ID NO: 3239585 - protein, 14 aa, Plasmodium falciparum
NNNNMNNNNMNNNN

SEQ ID NO: 3239586 - protein, 17 aa, Plasmodium falciparum
NNNNMNNNNNNNNNINN

SEQ ID NO: 3239587 - protein, 9 aa, Plasmodium falciparum
NNNNNDEEQ

SEQ ID NO: 3239588 - protein, 28 aa, Plasmodium falciparum
NNNNNDEGEQNLKDKYDTYDEKEKVKKK

SEQ ID NO: 3239589 - protein, 13 aa, Plasmodium falciparum
NNNNNDGRIKNRK

SEQ ID NO: 3239590 - protein, 7 aa, Plasmodium falciparum
NNNNNDH

SEQ ID NO: 3239591 - protein, 7 aa, Plasmodium falciparum
NNNNNDI

SEQ ID NO: 3239592 - protein, 16 aa, Plasmodium falciparum
NNNNNDNDNKKIEEKC

SEQ ID NO: 3239593 - protein, 25 aa, Plasmodium falciparum
NNNNNDNDNNITKEGTRHSSNNPLC

SEQ ID NO: 3239594 - protein, 22 aa, Plasmodium falciparum
NNNNNDNNKNNNNNNNNDNNNY

SEQ ID NO: 3239595 - protein, 40 aa, Plasmodium falciparum
NNNNNDNNNNNINNNNINNNNINNNNNNNNNNNNNIHSNN

SEQ ID NO: 3239596 - protein, 22 aa, Plasmodium falciparum
NNNNNDNNNNNNSNNNNNDNNS

SEQ ID NO: 3239597 - protein, 13 aa, Plasmodium falciparum
NNNNNDNSNSYSY

SEQ ID NO: 3239598 - protein, 10 aa, Plasmodium falciparum
NNNNNDPNNM

SEQ ID NO: 3239599 - protein, 6 aa, Plasmodium falciparum
NNNNNE

SEQ ID NO: 3239600 - protein, 24 aa, Plasmodium falciparum
NNNNNEEEAEEKDGNNKTMKSKKG

SEQ ID NO: 3239601 - protein, 13 aa, Plasmodium falciparum
NNNNNEEETEQNM

SEQ ID NO: 3239602 - protein, 7 aa, Plasmodium falciparum
NNNNNEH

SEQ ID NO: 3239603 - protein, 7 aa, Plasmodium falciparum
NNNNNEN

SEQ ID NO: 3239604 - protein, 15 aa, Plasmodium falciparum
NNNNNENNNENNNSK

SEQ ID NO: 3239605 - protein, 22 aa, Plasmodium falciparum
NNNNNENSDSDDINDNVTNNNS

SEQ ID NO: 3239606 - protein, 27 aa, Plasmodium falciparum
NNNNNEYNNNNEYDNNNEYDNNNEYDI

SEQ ID NO: 3239607 - protein, 13 aa, Plasmodium falciparum
NNNNNGNNNNDNI

SEQ ID NO: 3239608 - protein, 8 aa, Plasmodium falciparum
NNNNNHSE

SEQ ID NO: 3239609 - protein, 6 aa, Plasmodium falciparum
NNNNNI

SEQ ID NO: 3239610 - protein, 15 aa, Plasmodium falciparum
NNNNNIGSNNNSRDY

SEQ ID NO: 3239611 - protein, 15 aa, Plasmodium falciparum
NNNNNIKKKNNINKK

SEQ ID NO: 3239612 - protein, 7 aa, Plasmodium falciparum
NNNNNIN

SEQ ID NO: 3239613 - protein, 21 aa, Plasmodium falciparum
NNNNNINDKYPKEKNKLKEDQ

SEQ ID NO: 3239614 - protein, 9 aa, Plasmodium falciparum
NNNNNINNH

SEQ ID NO: 3239615 - protein, 23 aa, Plasmodium falciparum
NNNNNINNINNNSNNNNNNISTS

SEQ ID NO: 3239616 - protein, 9 aa, Plasmodium falciparum
NNNNNINNM

SEQ ID NO: 3239617 - protein, 10 aa, Plasmodium falciparum
NNNNNINNNC

SEQ ID NO: 3239618 - protein, 30 aa, Plasmodium falciparum
NNNNNINNNNNINNINNNNNSNNKQRSSSD

SEQ ID NO: 3239619 - protein, 9 aa, Plasmodium falciparum
NNNNNINRD

SEQ ID NO: 3239620 - protein, 18 aa, Plasmodium falciparum
NNNNNISDSEVDKENNNY

SEQ ID NO: 3239621 - protein, 7 aa, Plasmodium falciparum
NNNNNIY

SEQ ID NO: 3239622 - protein, 6 aa, Plasmodium falciparum
NNNNNK

SEQ ID NO: 3239623 - protein, 14 aa, Plasmodium falciparum
NNNNNKDDHHINDK

SEQ ID NO: 3239624 - protein, 13 aa, Plasmodium falciparum
NNNNNKEEEEGER

SEQ ID NO: 3239625 - protein, 9 aa, Plasmodium falciparum
NNNNNKETL

SEQ ID NO: 3239626 - protein, 8 aa, Plasmodium falciparum
NNNNNKEV

SEQ ID NO: 3239627 - protein, 7 aa, Plasmodium falciparum
NNNNNKG

SEQ ID NO: 3239628 - protein, 27 aa, Plasmodium falciparum
NNNNNKKKNSNNNNNDIKNNNKNNNKR

SEQ ID NO: 3239629 - protein, 11 aa, Plasmodium falciparum
NNNNNKKNNKI

SEQ ID NO: 3239630 - protein, 7 aa, Plasmodium falciparum
NNNNNKT

SEQ ID NO: 3239631 - protein, 9 aa, Plasmodium falciparum
NNNNNLSNH

SEQ ID NO: 3239632 - protein, 6 aa, Plasmodium falciparum
NNNNNM

SEQ ID NO: 3239633 - protein, 7 aa, Plasmodium falciparum
NNNNNMN

SEQ ID NO: 3239634 - protein, 11 aa, Plasmodium falciparum
NNNNNNCGSNN

SEQ ID NO: 3239635 - protein, 26 aa, Plasmodium falciparum
NNNNNNDANNNNNNNNENNNGNNNNS

SEQ ID NO: 3239636 - protein, 73 aa, Plasmodium falciparum
NNNNNNDDNYDDNNGDNNDDNNGDNNGDNNDDNNDDNNDDNYDETKMRKKEETLTCSDKNQKSRIDEKNKKYV

SEQ ID NO: 3239637 - protein, 23 aa, Plasmodium falciparum
NNNNNNDHNDHNDHNNDNNYNNY

SEQ ID NO: 3239638 - protein, 12 aa, Plasmodium falciparum
NNNNNNDKNNNL

SEQ ID NO: 3239639 - protein, 9 aa, Plasmodium falciparum
NNNNNNDNN

SEQ ID NO: 3239640 - protein, 68 aa, Plasmodium falciparum
NNNNNNDNNNGNNNDNNNGNNNGNNNDNNNGNNNGNNNDNNNGNNHNNNHNNNHNNNNSYNSNNLAYD

SEQ ID NO: 3239641 - protein, 17 aa, Plasmodium falciparum
NNNNNNDNNNNNNNSIF

SEQ ID NO: 3239642 - protein, 24 aa, Plasmodium falciparum
NNNNNNEEEFNKSVEKQENDEHKN

SEQ ID NO: 3239643 - protein, 20 aa, Plasmodium falciparum
NNNNNNENNNDSNNDKNNNN

SEQ ID NO: 3239644 - protein, 23 aa, Plasmodium falciparum
NNNNNNENNNENINENINENNNN

SEQ ID NO: 3239645 - protein, 9 aa, Plasmodium falciparum
NNNNNNEYE

SEQ ID NO: 3239646 - protein, 8 aa, Plasmodium falciparum
NNNNNNGN

SEQ ID NO: 3239647 - protein, 18 aa, Plasmodium falciparum
NNNNNNGNCNSNSNNCNS

SEQ ID NO: 3239648 - protein, 12 aa, Plasmodium falciparum
NNNNNNGNSNNS

SEQ ID NO: 3239649 - protein, 20 aa, Plasmodium falciparum
NNNNNNHNNNNNNNNNNNNN

SEQ ID NO: 3239650 - protein, 26 aa, Plasmodium falciparum
NNNNNNHNNNNNNNNNNNNNNNRYNN

SEQ ID NO: 3239651 - protein, 16 aa, Plasmodium falciparum
NNNNNNINNGNNQDNG

SEQ ID NO: 3239652 - protein, 16 aa, Plasmodium falciparum
NNNNNNINNKNNDGDN

SEQ ID NO: 3239653 - protein, 43 aa, Plasmodium falciparum
NNNNNNINNNNNINNNNNNNNNNNNNNNNNNNNNNNNNNNNNN

SEQ ID NO: 3239654 - protein, 33 aa, Plasmodium falciparum
NNNNNNINNNNNNINNNNNNINNNNNNINNNNN

SEQ ID NO: 3239655 - protein, 31 aa, Plasmodium falciparum
NNNNNNINNRNNSSYNNCNEKKKSNESASSV

SEQ ID NO: 3239656 - protein, 33 aa, Plasmodium falciparum
NNNNNNISNNNISNNNISNNNISNNNISNNNIS

SEQ ID NO: 3239657 - protein, 29 aa, Plasmodium falciparum
NNNNNNKALENKGKSGAYKPYGSNKNINK

SEQ ID NO: 3239658 - protein, 8 aa, Plasmodium falciparum
NNNNNNKK

SEQ ID NO: 3239659 - protein, 11 aa, Plasmodium falciparum
NNNNNNKKDDI

SEQ ID NO: 3239660 - protein, 10 aa, Plasmodium falciparum
NNNNNNKKKK

SEQ ID NO: 3239661 - protein, 12 aa, Plasmodium falciparum
NNNNNNKKKKKK

SEQ ID NO: 3239662 - protein, 15 aa, Plasmodium falciparum
NNNNNNKKKKNKKKN

SEQ ID NO: 3239663 - protein, 12 aa, Plasmodium falciparum
NNNNNNKKKSRN

SEQ ID NO: 3239664 - protein, 8 aa, Plasmodium falciparum
NNNNNNKL

SEQ ID NO: 3239665 - protein, 8 aa, Plasmodium falciparum
NNNNNNKM

SEQ ID NO: 3239666 - protein, 22 aa, Plasmodium falciparum
NNNNNNKNISNNNNNNVYPSSM

SEQ ID NO: 3239667 - protein, 10 aa, Plasmodium falciparum
NNNNNNKNKN

SEQ ID NO: 3239668 - protein, 17 aa, Plasmodium falciparum
NNNNNNKNNSKEKKLPL

SEQ ID NO: 3239669 - protein, 8 aa, Plasmodium falciparum
NNNNNNMN

SEQ ID NO: 3239670 - protein, 16 aa, Plasmodium falciparum
NNNNNNMRDDNVRDDN

SEQ ID NO: 3239671 - protein, 9 aa, Plasmodium falciparum
NNNNNNMSP

SEQ ID NO: 3239672 - protein, 23 aa, Plasmodium falciparum
NNNNNNMSSNSHSVSKKKKKDIT

SEQ ID NO: 3239673 - protein, 11 aa, Plasmodium falciparum
NNNNNNNANNI

SEQ ID NO: 3239674 - protein, 31 aa, Plasmodium falciparum
NNNNNNNCSSSNNNCSSSNNNCSSSNNNCSS

SEQ ID NO: 3239675 - protein, 19 aa, Plasmodium falciparum
NNNNNNNDHVNKENNSPYI

SEQ ID NO: 3239676 - protein, 27 aa, Plasmodium falciparum
NNNNNNNDKLNYNNSTSNIGRSTQKNI

SEQ ID NO: 3239677 - protein, 11 aa, Plasmodium falciparum
NNNNNNNDNNF

SEQ ID NO: 3239678 - protein, 10 aa, Plasmodium falciparum
NNNNNNNDNS

SEQ ID NO: 3239679 - protein, 21 aa, Plasmodium falciparum
NNNNNNNDNVDSLSDNYGHNV

SEQ ID NO: 3239680 - protein, 11 aa, Plasmodium falciparum
NNNNNNNDSNY

SEQ ID NO: 3239681 - protein, 8 aa, Plasmodium falciparum
NNNNNNNE

SEQ ID NO: 3239682 - protein, 24 aa, Plasmodium falciparum
NNNNNNNEKKKKKKTNGDGYDDDR

SEQ ID NO: 3239683 - protein, 12 aa, Plasmodium falciparum
NNNNNNNHDNNN

SEQ ID NO: 3239684 - protein, 10 aa, Plasmodium falciparum
NNNNNNNIEN

SEQ ID NO: 3239685 - protein, 18 aa, Plasmodium falciparum
NNNNNNNINNNNNNKNES

SEQ ID NO: 3239686 - protein, 30 aa, Plasmodium falciparum
NNNNNNNINNNNNNNNNNNNNNNSSNTKEY

SEQ ID NO: 3239687 - protein, 19 aa, Plasmodium falciparum
NNNNNNNISNISNNSARES

SEQ ID NO: 3239688 - protein, 8 aa, Plasmodium falciparum
NNNNNNNK

SEQ ID NO: 3239689 - protein, 14 aa, Plasmodium falciparum
NNNNNNNKENITIQ

SEQ ID NO: 3239690 - protein, 12 aa, Plasmodium falciparum
NNNNNNNKKGIS

SEQ ID NO: 3239691 - protein, 11 aa, Plasmodium falciparum
NNNNNNNKLAD

SEQ ID NO: 3239692 - protein, 21 aa, Plasmodium falciparum
NNNNNNNKTNNVNNNYNAQNA

SEQ ID NO: 3239693 - protein, 18 aa, Plasmodium falciparum
NNNNNNNMDNISTNEENK

SEQ ID NO: 3239694 - protein, 15 aa, Plasmodium falciparum
NNNNNNNNDEPNNFK

SEQ ID NO: 3239695 - protein, 10 aa, Plasmodium falciparum
NNNNNNNNDH

SEQ ID NO: 3239696 - protein, 11 aa, Plasmodium falciparum
NNNNNNNNDNI

SEQ ID NO: 3239697 - protein, 49 aa, Plasmodium falciparum
NNNNNNNNDNNNDNNNDNNNDNNNDNNNDNNNNNNNNNNNNNNNSNNSS

SEQ ID NO: 3239698 - protein, 33 aa, Plasmodium falciparum
NNNNNNNNDQKTNNLKYKSSSSWNSKAKKSSYI

SEQ ID NO: 3239699 - protein, 14 aa, Plasmodium falciparum
NNNNNNNNDYNNMN

SEQ ID NO: 3239700 - protein, 9 aa, Plasmodium falciparum
NNNNNNNNE

SEQ ID NO: 3239701 - protein, 13 aa, Plasmodium falciparum
NNNNNNNNEDNYN

SEQ ID NO: 3239702 - protein, 11 aa, Plasmodium falciparum
NNNNNNNNENV

SEQ ID NO: 3239703 - protein, 10 aa, Plasmodium falciparum
NNNNNNNNEY

SEQ ID NO: 3239704 - protein, 36 aa, Plasmodium falciparum
NNNNNNNNHNSNNNNNNNHNSNNNNNNNHNNNNNYY

SEQ ID NO: 3239705 - protein, 10 aa, Plasmodium falciparum
NNNNNNNNIN

SEQ ID NO: 3239706 - protein, 12 aa, Plasmodium falciparum
NNNNNNNNINEQ

SEQ ID NO: 3239707 - protein, 39 aa, Plasmodium falciparum
NNNNNNNNINNNNNSNNNSNSNESPFSSNVSSNKTSGNY

SEQ ID NO: 3239708 - protein, 10 aa, Plasmodium falciparum
NNNNNNNNKI

SEQ ID NO: 3239709 - protein, 12 aa, Plasmodium falciparum
NNNNNNNNKIYN

SEQ ID NO: 3239710 - protein, 10 aa, Plasmodium falciparum
NNNNNNNNKK

SEQ ID NO: 3239711 - protein, 13 aa, Plasmodium falciparum
NNNNNNNNKNKRN

SEQ ID NO: 3239712 - protein, 11 aa, Plasmodium falciparum
NNNNNNNNKNN

SEQ ID NO: 3239713 - protein, 18 aa, Plasmodium falciparum
NNNNNNNNKNNKYNKNNN

SEQ ID NO: 3239714 - protein, 10 aa, Plasmodium falciparum
NNNNNNNNLK

SEQ ID NO: 3239715 - protein, 9 aa, Plasmodium falciparum
NNNNNNNNM

SEQ ID NO: 3239716 - protein, 13 aa, Plasmodium falciparum
NNNNNNNNMHGGG

SEQ ID NO: 3239717 - protein, 12 aa, Plasmodium falciparum
NNNNNNNNNAKN

SEQ ID NO: 3239718 - protein, 11 aa, Plasmodium falciparum
NNNNNNNNNDI

SEQ ID NO: 3239719 - protein, 15 aa, Plasmodium falciparum
NNNNNNNNNDNALEG

SEQ ID NO: 3239720 - protein, 20 aa, Plasmodium falciparum
NNNNNNNNNDNNNNNNNNNV

SEQ ID NO: 3239721 - protein, 18 aa, Plasmodium falciparum
NNNNNNNNNDSNNNNNYN

SEQ ID NO: 3239722 - protein, 14 aa, Plasmodium falciparum
NNNNNNNNNEHYDD

SEQ ID NO: 3239723 - protein, 22 aa, Plasmodium falciparum
NNNNNNNNNIYETKDHNDKHKK

SEQ ID NO: 3239724 - protein, 10 aa, Plasmodium falciparum
NNNNNNNNNK

SEQ ID NO: 3239725 - protein, 11 aa, Plasmodium falciparum
NNNNNNNNNKI

SEQ ID NO: 3239726 - protein, 28 aa, Plasmodium falciparum
NNNNNNNNNKMKGEKNSSSNINNTDNNT

SEQ ID NO: 3239727 - protein, 18 aa, Plasmodium falciparum
NNNNNNNNNKNNKTSYHY

SEQ ID NO: 3239728 - protein, 13 aa, Plasmodium falciparum
NNNNNNNNNKNNN

SEQ ID NO: 3239729 - protein, 10 aa, Plasmodium falciparum
NNNNNNNNNL

SEQ ID NO: 3239730 - protein, 11 aa, Plasmodium falciparum
NNNNNNNNNMS

SEQ ID NO: 3239731 - protein, 17 aa, Plasmodium falciparum
NNNNNNNNNNFDKTSEC

SEQ ID NO: 3239732 - protein, 11 aa, Plasmodium falciparum
NNNNNNNNNNH

SEQ ID NO: 3239733 - protein, 12 aa, Plasmodium falciparum
NNNNNNNNNNIG

SEQ ID NO: 3239734 - protein, 14 aa, Plasmodium falciparum
NNNNNNNNNNINNN

SEQ ID NO: 3239735 - protein, 27 aa, Plasmodium falciparum
NNNNNNNNNNINSSNNNNCNNNSCGGS

SEQ ID NO: 3239736 - protein, 20 aa, Plasmodium falciparum
NNNNNNNNNNITNPINKNNE

SEQ ID NO: 3239737 - protein, 72 aa, Plasmodium falciparum
NNNNNNNNNNKTTSNNHNKNNKINNNNPSENYKKQTDTKHTNNTQNNKYNKTKTTNTFKHPSKDHTDVNTKT

SEQ ID NO: 3239738 - protein, 31 aa, Plasmodium falciparum
NNNNNNNNNNKYVRKEDHKSCSEQSLKDNNE

SEQ ID NO: 3239739 - protein, 12 aa, Plasmodium falciparum
NNNNNNNNNNND

SEQ ID NO: 3239740 - protein, 14 aa, Plasmodium falciparum
NNNNNNNNNNNINN

SEQ ID NO: 3239741 - protein, 12 aa, Plasmodium falciparum
NNNNNNNNNNNN

SEQ ID NO: 3239742 - protein, 16 aa, Plasmodium falciparum
NNNNNNNNNNNNERNN

SEQ ID NO: 3239743 - protein, 15 aa, Plasmodium falciparum
NNNNNNNNNNNNGNN

SEQ ID NO: 3239744 - protein, 18 aa, Plasmodium falciparum
NNNNNNNNNNNNKSNHNN

SEQ ID NO: 3239745 - protein, 41 aa, Plasmodium falciparum
NNNNNNNNNNNNNDNNNNINNNNNNNINNNNNNNNNNGNGF

SEQ ID NO: 3239746 - protein, 19 aa, Plasmodium falciparum
NNNNNNNNNNNNNDRQNID

SEQ ID NO: 3239747 - protein, 24 aa, Plasmodium falciparum
NNNNNNNNNNNNNEHAKNGSPNKD

SEQ ID NO: 3239748 - protein, 15 aa, Plasmodium falciparum
NNNNNNNNNNNNNKQ

SEQ ID NO: 3239749 - protein, 17 aa, Plasmodium falciparum
NNNNNNNNNNNNNNINS

SEQ ID NO: 3239750 - protein, 15 aa, Plasmodium falciparum
NNNNNNNNNNNNNNN

SEQ ID NO: 3239751 - protein, 31 aa, Plasmodium falciparum
NNNNNNNNNNNNNNNKHNNNNIRGKKNYDYQ

SEQ ID NO: 3239752 - protein, 16 aa, Plasmodium falciparum
NNNNNNNNNNNNNNNN

SEQ ID NO: 3239753 - protein, 22 aa, Plasmodium falciparum
NNNNNNNNNNNNNNNNCSNNSY

SEQ ID NO: 3239754 - protein, 29 aa, Plasmodium falciparum
NNNNNNNNNNNNNNNNNCDNNNNNNCDNN

SEQ ID NO: 3239755 - protein, 23 aa, Plasmodium falciparum
NNNNNNNNNNNNNNNNNNISSNN

SEQ ID NO: 3239756 - protein, 23 aa, Plasmodium falciparum
NNNNNNNNNNNNNNNNNNNDYDK

SEQ ID NO: 3239757 - protein, 26 aa, Plasmodium falciparum
NNNNNNNNNNNNNNNNNNNNNNNNDM

SEQ ID NO: 3239758 - protein, 36 aa, Plasmodium falciparum
NNNNNNNNNNNNNNNNNNNNNNNNNNNNMKNTFGNT

SEQ ID NO: 3239759 - protein, 30 aa, Plasmodium falciparum
NNNNNNNNNNNNNNNNNNNNNNNNNNNNNG

SEQ ID NO: 3239760 - protein, 36 aa, Plasmodium falciparum
NNNNNNNNNNNNNNNNNNNNNNNNNNNNNNNNNNNN

SEQ ID NO: 3239761 - protein, 33 aa, Plasmodium falciparum
NNNNNNNNNNNNNNNNNSNSNNIPMNDSKNNKN

SEQ ID NO: 3239762 - protein, 18 aa, Plasmodium falciparum
NNNNNNNNNNNNNNNNNV

SEQ ID NO: 3239763 - protein, 19 aa, Plasmodium falciparum
NNNNNNNNNNNNNNNNNVS

SEQ ID NO: 3239764 - protein, 40 aa, Plasmodium falciparum
NNNNNNNNNNNNNNNNSNNNSNNNNNNNNNNSSNQNNYLD

SEQ ID NO: 3239765 - protein, 51 aa, Plasmodium falciparum
NNNNNNNNNNNNNNNSSSSSSSSSSSSSSSSSNILNDDNKEKKKDEDIDKT

SEQ ID NO: 3239766 - protein, 29 aa, Plasmodium falciparum
NNNNNNNNNNNNNNTSSLLTSSSSSSYYY

SEQ ID NO: 3239767 - protein, 15 aa, Plasmodium falciparum
NNNNNNNNNNNNNNV

SEQ ID NO: 3239768 - protein, 39 aa, Plasmodium falciparum
NNNNNNNNNNNNNNYRSDRGHEDNNITNNNQNNHSNNKY

SEQ ID NO: 3239769 - protein, 15 aa, Plasmodium falciparum
NNNNNNNNNNNNNSN

SEQ ID NO: 3239770 - protein, 27 aa, Plasmodium falciparum
NNNNNNNNNNNNNSNNNNNDEKKKKKI

SEQ ID NO: 3239771 - protein, 20 aa, Plasmodium falciparum
NNNNNNNNNNNNNSSSSNNF

SEQ ID NO: 3239772 - protein, 19 aa, Plasmodium falciparum
NNNNNNNNNNNNSSSSNGT

SEQ ID NO: 3239773 - protein, 17 aa, Plasmodium falciparum
NNNNNNNNNNNNTNLDR

SEQ ID NO: 3239774 - protein, 16 aa, Plasmodium falciparum
NNNNNNNNNNNNVDIN

SEQ ID NO: 3239775 - protein, 13 aa, Plasmodium falciparum
NNNNNNNNNNNNY

SEQ ID NO: 3239776 - protein, 15 aa, Plasmodium falciparum
NNNNNNNNNNNSCDK

SEQ ID NO: 3239777 - protein, 19 aa, Plasmodium falciparum
NNNNNNNNNNNSKNYINNK

SEQ ID NO: 3239778 - protein, 21 aa, Plasmodium falciparum
NNNNNNNNNNNSSSSVSSSRY

SEQ ID NO: 3239779 - protein, 14 aa, Plasmodium falciparum
NNNNNNNNNNRRNG

SEQ ID NO: 3239780 - protein, 14 aa, Plasmodium falciparum
NNNNNNNNNNSNHN

SEQ ID NO: 3239781 - protein, 22 aa, Plasmodium falciparum
NNNNNNNNNNSNNNSNSMNDEE

SEQ ID NO: 3239782 - protein, 11 aa, Plasmodium falciparum
NNNNNNNNNNT

SEQ ID NO: 3239783 - protein, 11 aa, Plasmodium falciparum
NNNNNNNNNNY

SEQ ID NO: 3239784 - protein, 17 aa, Plasmodium falciparum
NNNNNNNNNNYNFNEPS

SEQ ID NO: 3239785 - protein, 10 aa, Plasmodium falciparum
NNNNNNNNNS

SEQ ID NO: 3239786 - protein, 12 aa, Plasmodium falciparum
NNNNNNNNNSNI

SEQ ID NO: 3239787 - protein, 22 aa, Plasmodium falciparum
NNNNNNNNNSNNNNNNNNNSCY

SEQ ID NO: 3239788 - protein, 14 aa, Plasmodium falciparum
NNNNNNNNNSSSTI

SEQ ID NO: 3239789 - protein, 22 aa, Plasmodium falciparum
NNNNNNNNNWDPNNLSGSQNNI

SEQ ID NO: 3239790 - protein, 13 aa, Plasmodium falciparum
NNNNNNNNQNNNN

SEQ ID NO: 3239791 - protein, 23 aa, Plasmodium falciparum
NNNNNNNNRNHNKNNNNSNNNSN

SEQ ID NO: 3239792 - protein, 12 aa, Plasmodium falciparum
NNNNNNNNSDDI

SEQ ID NO: 3239793 - protein, 11 aa, Plasmodium falciparum
NNNNNNNNSEI

SEQ ID NO: 3239794 - protein, 19 aa, Plasmodium falciparum
NNNNNNNNSGSISNMSSNT

SEQ ID NO: 3239795 - protein, 12 aa, Plasmodium falciparum
NNNNNNNNSNIN

SEQ ID NO: 3239796 - protein, 14 aa, Plasmodium falciparum
NNNNNNNNSNNGAV

SEQ ID NO: 3239797 - protein, 34 aa, Plasmodium falciparum
NNNNNNNNSNNNNNNNNNNNNNNNNNSSSGSNCV

SEQ ID NO: 3239798 - protein, 49 aa, Plasmodium falciparum
NNNNNNNNSNNNNNSISSGYREKPKNKYTHKDNETNDLNGDDEDTDIID

SEQ ID NO: 3239799 - protein, 11 aa, Plasmodium falciparum
NNNNNNNNSYK

SEQ ID NO: 3239800 - protein, 23 aa, Plasmodium falciparum
NNNNNNNNTKYDTNEGNNNPTND

SEQ ID NO: 3239801 - protein, 9 aa, Plasmodium falciparum
NNNNNNNNY

SEQ ID NO: 3239802 - protein, 9 aa, Plasmodium falciparum
NNNNNNNQI

SEQ ID NO: 3239803 - protein, 9 aa, Plasmodium falciparum
NNNNNNNSN

SEQ ID NO: 3239804 - protein, 11 aa, Plasmodium falciparum
NNNNNNNSNDS

SEQ ID NO: 3239805 - protein, 15 aa, Plasmodium falciparum
NNNNNNNSNSNKEYI

SEQ ID NO: 3239806 - protein, 37 aa, Plasmodium falciparum
NNNNNNNSSSSITSNGSNALDEKNNYTEENNNNEKKY

SEQ ID NO: 3239807 - protein, 8 aa, Plasmodium falciparum
NNNNNNNV

SEQ ID NO: 3239808 - protein, 26 aa, Plasmodium falciparum
NNNNNNNVRNDNDIGVTKKKDKRQNY

SEQ ID NO: 3239809 - protein, 16 aa, Plasmodium falciparum
NNNNNNNVTNNLGSTN

SEQ ID NO: 3239810 - protein, 8 aa, Plasmodium falciparum
NNNNNNNY

SEQ ID NO: 3239811 - protein, 18 aa, Plasmodium falciparum
NNNNNNNYNHNNHNNNNY

SEQ ID NO: 3239812 - protein, 12 aa, Plasmodium falciparum
NNNNNNSCDDNN

SEQ ID NO: 3239813 - protein, 8 aa, Plasmodium falciparum
NNNNNNSF

SEQ ID NO: 3239814 - protein, 11 aa, Plasmodium falciparum
NNNNNNSNDIK

SEQ ID NO: 3239815 - protein, 20 aa, Plasmodium falciparum
NNNNNNSNSNHSNHNNNSNH

SEQ ID NO: 3239816 - protein, 17 aa, Plasmodium falciparum
NNNNNNSSGSNNSSRTN

SEQ ID NO: 3239817 - protein, 17 aa, Plasmodium falciparum
NNNNNNSSSSNNRISNS

SEQ ID NO: 3239818 - protein, 8 aa, Plasmodium falciparum
NNNNNNTI

SEQ ID NO: 3239819 - protein, 10 aa, Plasmodium falciparum
NNNNNNTSKY

SEQ ID NO: 3239820 - protein, 36 aa, Plasmodium falciparum
NNNNNNVNIGQNNQTKDISYSSKDTNKSIAQKHKYK

SEQ ID NO: 3239821 - protein, 16 aa, Plasmodium falciparum
NNNNNNVSNINNSGCN

SEQ ID NO: 3239822 - protein, 13 aa, Plasmodium falciparum
NNNNNNYNNNYNN

SEQ ID NO: 3239823 - protein, 18 aa, Plasmodium falciparum
NNNNNNYNYNNGDNGKNI

SEQ ID NO: 3239824 - protein, 13 aa, Plasmodium falciparum
NNNNNNYNYNNNN

SEQ ID NO: 3239825 - protein, 16 aa, Plasmodium falciparum
NNNNNNYVNNSTRGKD

SEQ ID NO: 3239826 - protein, 22 aa, Plasmodium falciparum
NNNNNNYVNTSNEKNDIYDNEK

SEQ ID NO: 3239827 - protein, 21 aa, Plasmodium falciparum
NNNNNPNQPNQQNHQNQPNHM

SEQ ID NO: 3239828 - protein, 11 aa, Plasmodium falciparum
NNNNNQENNLS

SEQ ID NO: 3239829 - protein, 11 aa, Plasmodium falciparum
NNNNNQNDSSS

SEQ ID NO: 3239830 - protein, 11 aa, Plasmodium falciparum
NNNNNRKQNNT

SEQ ID NO: 3239831 - protein, 18 aa, Plasmodium falciparum
NNNNNRVEEIKKDSDQED

SEQ ID NO: 3239832 - protein, 6 aa, Plasmodium falciparum
NNNNNS

SEQ ID NO: 3239833 - protein, 54 aa, Plasmodium falciparum
NNNNNSIKNNNNNNNSIKNNNNNNNSIKNNNNNNNSFSATSFSSEKNKNKSYTN

SEQ ID NO: 3239834 - protein, 9 aa, Plasmodium falciparum
NNNNNSNIH

SEQ ID NO: 3239835 - protein, 19 aa, Plasmodium falciparum
NNNNNSNNNNNSNNSNNNI

SEQ ID NO: 3239836 - protein, 8 aa, Plasmodium falciparum
NNNNNSNR

SEQ ID NO: 3239837 - protein, 37 aa, Plasmodium falciparum
NNNNNSNSYKMKKEKKKKKKKKKNQTDEENMKNKKDH

SEQ ID NO: 3239838 - protein, 10 aa, Plasmodium falciparum
NNNNNTECND

SEQ ID NO: 3239839 - protein, 13 aa, Plasmodium falciparum
NNNNNVNNKDKNV

SEQ ID NO: 3239840 - protein, 50 aa, Plasmodium falciparum
NNNNNVNNNDSVNNNDSVNNNDSVNNNDSVNNNDSVNNNDSVNNNDNINN

SEQ ID NO: 3239841 - protein, 8 aa, Plasmodium falciparum
NNNNNYNN

SEQ ID NO: 3239842 - protein, 16 aa, Plasmodium falciparum
NNNNNYNNNNNNNYYN

SEQ ID NO: 3239843 - protein, 9 aa, Plasmodium falciparum
NNNNNYNYN

SEQ ID NO: 3239844 - protein, 8 aa, Plasmodium falciparum
NNNNNYYN

SEQ ID NO: 3239845 - protein, 30 aa, Plasmodium falciparum
NNNNQHDDDDDKEKKKNYNNNDDDDDDHNF

SEQ ID NO: 3239846 - protein, 23 aa, Plasmodium falciparum
NNNNQSEYKEERNNSENNNNNNN

SEQ ID NO: 3239847 - protein, 6 aa, Plasmodium falciparum
NNNNRM

SEQ ID NO: 3239848 - protein, 9 aa, Plasmodium falciparum
NNNNRNDKE

SEQ ID NO: 3239849 - protein, 11 aa, Plasmodium falciparum
NNNNRTNNETN

SEQ ID NO: 3239850 - protein, 5 aa, Plasmodium falciparum
NNNNS

SEQ ID NO: 3239851 - protein, 6 aa, Plasmodium falciparum
NNNNSC

SEQ ID NO: 3239852 - protein, 14 aa, Plasmodium falciparum
NNNNSDIRKDENVP

SEQ ID NO: 3239853 - protein, 7 aa, Plasmodium falciparum
NNNNSKL

SEQ ID NO: 3239854 - protein, 6 aa, Plasmodium falciparum
NNNNSN

SEQ ID NO: 3239855 - protein, 13 aa, Plasmodium falciparum
NNNNSNDNKNISY

SEQ ID NO: 3239856 - protein, 53 aa, Plasmodium falciparum
NNNNSNNNNNINSSSNNINSSSNNINSSSNNINSSSNNINSSSNNINSSSNKY

SEQ ID NO: 3239857 - protein, 11 aa, Plasmodium falciparum
NNNNSNNNNNN

SEQ ID NO: 3239858 - protein, 15 aa, Plasmodium falciparum
NNNNSNNNNNNNNDD

SEQ ID NO: 3239859 - protein, 10 aa, Plasmodium falciparum
NNNNSNNNNY

SEQ ID NO: 3239860 - protein, 7 aa, Plasmodium falciparum
NNNNSNY

SEQ ID NO: 3239861 - protein, 6 aa, Plasmodium falciparum
NNNNSP

SEQ ID NO: 3239862 - protein, 11 aa, Plasmodium falciparum
NNNNSSEKSSL

SEQ ID NO: 3239863 - protein, 11 aa, Plasmodium falciparum
NNNNSSGNMDT

SEQ ID NO: 3239864 - protein, 10 aa, Plasmodium falciparum
NNNNSSNSCG

SEQ ID NO: 3239865 - protein, 6 aa, Plasmodium falciparum
NNNNTH

SEQ ID NO: 3239866 - protein, 14 aa, Plasmodium falciparum
NNNNTHVDDKEASS

SEQ ID NO: 3239867 - protein, 9 aa, Plasmodium falciparum
NNNNTTSTF

SEQ ID NO: 3239868 - protein, 5 aa, Plasmodium falciparum
NNNNV

SEQ ID NO: 3239869 - protein, 15 aa, Plasmodium falciparum
NNNNVDKKGKIDEED

SEQ ID NO: 3239870 - protein, 7 aa, Plasmodium falciparum
NNNNVGN

SEQ ID NO: 3239871 - protein, 40 aa, Plasmodium falciparum
NNNNVNDNNDNNNNNVNDNNVNDNNVNRNNHSNNHCNNND

SEQ ID NO: 3239872 - protein, 21 aa, Plasmodium falciparum
NNNNVNEDINATKKKKKKKKK

SEQ ID NO: 3239873 - protein, 10 aa, Plasmodium falciparum
NNNNVSKKDK

SEQ ID NO: 3239874 - protein, 23 aa, Plasmodium falciparum
NNNNYINNNNNNNNNNKHDEYSH

SEQ ID NO: 3239875 - protein, 39 aa, Plasmodium falciparum
NNNNYNNDDDNDDDNDDNNDDDNNNDGDNNYDTGEESLS

SEQ ID NO: 3239876 - protein, 4 aa, Plasmodium falciparum
NNNP

SEQ ID NO: 3239877 - protein, 7 aa, Plasmodium falciparum
NNNPNKS

SEQ ID NO: 3239878 - protein, 6 aa, Plasmodium falciparum
NNNPNS

SEQ ID NO: 3239879 - protein, 11 aa, Plasmodium falciparum
NNNPQNNHTSG

SEQ ID NO: 3239880 - protein, 10 aa, Plasmodium falciparum
NNNPSNKKDS

SEQ ID NO: 3239881 - protein, 5 aa, Plasmodium falciparum
NNNPV

SEQ ID NO: 3239882 - protein, 25 aa, Plasmodium falciparum
NNNQENVEKNNNVVNEEPNKKVSNN

SEQ ID NO: 3239883 - protein, 23 aa, Plasmodium falciparum
NNNQNVDNSYNQGNENDKTYTSN

SEQ ID NO: 3239884 - protein, 6 aa, Plasmodium falciparum
NNNQSH

SEQ ID NO: 3239885 - protein, 16 aa, Plasmodium falciparum
NNNRALKNKTGEKQMG

SEQ ID NO: 3239886 - protein, 10 aa, Plasmodium falciparum
NNNREHNKNY

SEQ ID NO: 3239887 - protein, 7 aa, Plasmodium falciparum
NNNRKRN

SEQ ID NO: 3239888 - protein, 6 aa, Plasmodium falciparum
NNNRKY

SEQ ID NO: 3239889 - protein, 33 aa, Plasmodium falciparum
NNNRNNNNNNNNKNNNYNNNYNNNNLSSKKENI

SEQ ID NO: 3239890 - protein, 9 aa, Plasmodium falciparum
NNNRTSDSI

SEQ ID NO: 3239891 - protein, 8 aa, Plasmodium falciparum
NNNRVNSD

SEQ ID NO: 3239892 - protein, 4 aa, Plasmodium falciparum
NNNS

SEQ ID NO: 3239893 - protein, 8 aa, Plasmodium falciparum
NNNSDITT

SEQ ID NO: 3239894 - protein, 16 aa, Plasmodium falciparum
NNNSDNNVDVPGTSTH

SEQ ID NO: 3239895 - protein, 7 aa, Plasmodium falciparum
NNNSENI

SEQ ID NO: 3239896 - protein, 62 aa, Plasmodium falciparum
NNNSEVELKEEEEEEEKEGERQAGGQAGGQAGGQAEGQAGGQAEGQTKGQAKGSIKKSRDIQ

SEQ ID NO: 3239897 - protein, 8 aa, Plasmodium falciparum
NNNSGNNF

SEQ ID NO: 3239898 - protein, 9 aa, Plasmodium falciparum
NNNSGNNNY

SEQ ID NO: 3239899 - protein, 7 aa, Plasmodium falciparum
NNNSGNY

SEQ ID NO: 3239900 - protein, 11 aa, Plasmodium falciparum
NNNSHTFNDNN

SEQ ID NO: 3239901 - protein, 20 aa, Plasmodium falciparum
NNNSINSNDDQKKKNNNNNN

SEQ ID NO: 3239902 - protein, 8 aa, Plasmodium falciparum
NNNSKEKN

SEQ ID NO: 3239903 - protein, 9 aa, Plasmodium falciparum
NNNSKNSVA

SEQ ID NO: 3239904 - protein, 7 aa, Plasmodium falciparum
NNNSKNY

SEQ ID NO: 3239905 - protein, 8 aa, Plasmodium falciparum
NNNSMKRK

SEQ ID NO: 3239906 - protein, 7 aa, Plasmodium falciparum
NNNSNIN

SEQ ID NO: 3239907 - protein, 8 aa, Plasmodium falciparum
NNNSNLNS

SEQ ID NO: 3239908 - protein, 7 aa, Plasmodium falciparum
NNNSNNA

SEQ ID NO: 3239909 - protein, 9 aa, Plasmodium falciparum
NNNSNNISA

SEQ ID NO: 3239910 - protein, 7 aa, Plasmodium falciparum
NNNSNNN

SEQ ID NO: 3239911 - protein, 18 aa, Plasmodium falciparum
NNNSNNNIRTYGKNNGIN

SEQ ID NO: 3239912 - protein, 9 aa, Plasmodium falciparum
NNNSNNNNN

SEQ ID NO: 3239913 - protein, 11 aa, Plasmodium falciparum
NNNSNNNNNNN

SEQ ID NO: 3239914 - protein, 16 aa, Plasmodium falciparum
NNNSNNNSNNKKKEHY

SEQ ID NO: 3239915 - protein, 7 aa, Plasmodium falciparum
NNNSPYD

SEQ ID NO: 3239916 - protein, 23 aa, Plasmodium falciparum
NNNSRSKSLSCKGDKLSSNEKHA

SEQ ID NO: 3239917 - protein, 8 aa, Plasmodium falciparum
NNNSSANI

SEQ ID NO: 3239918 - protein, 14 aa, Plasmodium falciparum
NNNSSNNNTSNNIT

SEQ ID NO: 3239919 - protein, 9 aa, Plasmodium falciparum
NNNSSSLYT

SEQ ID NO: 3239920 - protein, 6 aa, Plasmodium falciparum
NNNSSY

SEQ ID NO: 3239921 - protein, 6 aa, Plasmodium falciparum
NNNSTI

SEQ ID NO: 3239922 - protein, 6 aa, Plasmodium falciparum
NNNSVK

SEQ ID NO: 3239923 - protein, 9 aa, Plasmodium falciparum
NNNTDDTDD

SEQ ID NO: 3239924 - protein, 11 aa, Plasmodium falciparum
NNNTDEMKSKT

SEQ ID NO: 3239925 - protein, 110 aa, Plasmodium falciparum
NNNTDTISTDNDNADTKATDNNNNTNTKATDNNNTKIISPDNNNTKTTSTDNNNNTNTKATDNNNTKTISNDNNNTKTISTDNNNTKTISNDNNNTNTISTDNNNNNTNQ

SEQ ID NO: 3239926 - protein, 15 aa, Plasmodium falciparum
NNNTEEENNNLHEQN

SEQ ID NO: 3239927 - protein, 8 aa, Plasmodium falciparum
NNNTEGVE

SEQ ID NO: 3239928 - protein, 11 aa, Plasmodium falciparum
NNNTETCNRKN

SEQ ID NO: 3239929 - protein, 5 aa, Plasmodium falciparum
NNNTH

SEQ ID NO: 3239930 - protein, 13 aa, Plasmodium falciparum
NNNTIKKNKKKKK

SEQ ID NO: 3239931 - protein, 19 aa, Plasmodium falciparum
NNNTKKKSSIWKGSDGSGT

SEQ ID NO: 3239932 - protein, 51 aa, Plasmodium falciparum
NNNTKNNNHYSNNNHHNKNNSNNNNSNNNNNNNNNNNNNNNYNNNNKGNIN

SEQ ID NO: 3239933 - protein, 12 aa, Plasmodium falciparum
NNNTKSSNTTNF

SEQ ID NO: 3239934 - protein, 10 aa, Plasmodium falciparum
NNNTLENNDE

SEQ ID NO: 3239935 - protein, 21 aa, Plasmodium falciparum
NNNTMKDKDKGEKNIGVGSNK

SEQ ID NO: 3239936 - protein, 7 aa, Plasmodium falciparum
NNNTNDK

SEQ ID NO: 3239937 - protein, 69 aa, Plasmodium falciparum
NNNTNDYDNNTNDYYNNNPNYYDNNTNDYYNNNPNDYDNNNPNDYYNNNPNDYDNNNPNDYYNNNPNDY

SEQ ID NO: 3239938 - protein, 8 aa, Plasmodium falciparum
NNNTNNDY

SEQ ID NO: 3239939 - protein, 8 aa, Plasmodium falciparum
NNNTNNMK

SEQ ID NO: 3239940 - protein, 18 aa, Plasmodium falciparum
NNNTNSNTSSNNNNTNKY

SEQ ID NO: 3239941 - protein, 8 aa, Plasmodium falciparum
NNNTNVDT

SEQ ID NO: 3239942 - protein, 7 aa, Plasmodium falciparum
NNNTPHH

SEQ ID NO: 3239943 - protein, 6 aa, Plasmodium falciparum
NNNTPL

SEQ ID NO: 3239944 - protein, 7 aa, Plasmodium falciparum
NNNTRFS

SEQ ID NO: 3239945 - protein, 10 aa, Plasmodium falciparum
NNNTSPVKRK

SEQ ID NO: 3239946 - protein, 6 aa, Plasmodium falciparum
NNNTSS

SEQ ID NO: 3239947 - protein, 12 aa, Plasmodium falciparum
NNNTTDKSENNL

SEQ ID NO: 3239948 - protein, 7 aa, Plasmodium falciparum
NNNTTDN

SEQ ID NO: 3239949 - protein, 23 aa, Plasmodium falciparum
NNNTTGNYKTKSDHNKLSSNDNI

SEQ ID NO: 3239950 - protein, 10 aa, Plasmodium falciparum
NNNTTNENDT

SEQ ID NO: 3239951 - protein, 14 aa, Plasmodium falciparum
NNNTTSDKNKNNNR

SEQ ID NO: 3239952 - protein, 15 aa, Plasmodium falciparum
NNNTVDKKKRKKTHD

SEQ ID NO: 3239953 - protein, 5 aa, Plasmodium falciparum
NNNTY

SEQ ID NO: 3239954 - protein, 6 aa, Plasmodium falciparum
NNNTYG

SEQ ID NO: 3239955 - protein, 20 aa, Plasmodium falciparum
NNNTYNAKSDDKKNQNNNNI

SEQ ID NO: 3239956 - protein, 7 aa, Plasmodium falciparum
NNNVENR

SEQ ID NO: 3239957 - protein, 7 aa, Plasmodium falciparum
NNNVGER

SEQ ID NO: 3239958 - protein, 10 aa, Plasmodium falciparum
NNNVKRESQI

SEQ ID NO: 3239959 - protein, 7 aa, Plasmodium falciparum
NNNVNEE

SEQ ID NO: 3239960 - protein, 6 aa, Plasmodium falciparum
NNNVNN

SEQ ID NO: 3239961 - protein, 10 aa, Plasmodium falciparum
NNNVNNSNNN

SEQ ID NO: 3239962 - protein, 7 aa, Plasmodium falciparum
NNNVRDE

SEQ ID NO: 3239963 - protein, 7 aa, Plasmodium falciparum
NNNVTNK

SEQ ID NO: 3239964 - protein, 5 aa, Plasmodium falciparum
NNNYD

SEQ ID NO: 3239965 - protein, 36 aa, Plasmodium falciparum
NNNYDNNTKREDKNQKYVKNENQREGTSRKNNASSV

SEQ ID NO: 3239966 - protein, 8 aa, Plasmodium falciparum
NNNYDNNY

SEQ ID NO: 3239967 - protein, 8 aa, Plasmodium falciparum
NNNYENNN

SEQ ID NO: 3239968 - protein, 6 aa, Plasmodium falciparum
NNNYIN

SEQ ID NO: 3239969 - protein, 9 aa, Plasmodium falciparum
NNNYKEKEN

SEQ ID NO: 3239970 - protein, 21 aa, Plasmodium falciparum
NNNYKNKNRNNYSNKNNYSNN

SEQ ID NO: 3239971 - protein, 7 aa, Plasmodium falciparum
NNNYNDR

SEQ ID NO: 3239972 - protein, 6 aa, Plasmodium falciparum
NNNYNN

SEQ ID NO: 3239973 - protein, 15 aa, Plasmodium falciparum
NNNYNNKNDNNLQTE

SEQ ID NO: 3239974 - protein, 7 aa, Plasmodium falciparum
NNNYNNN

SEQ ID NO: 3239975 - protein, 26 aa, Plasmodium falciparum
NNNYNSRSSSTSSKNARGYRGGSSNM

SEQ ID NO: 3239976 - protein, 5 aa, Plasmodium falciparum
NNNYS

SEQ ID NO: 3239977 - protein, 26 aa, Plasmodium falciparum
NNNYSHKNKDNVSNTTSIQSRNKYNK

SEQ ID NO: 3239978 - protein, 13 aa, Plasmodium falciparum
NNNYSSNSDNKNK

SEQ ID NO: 3239979 - protein, 6 aa, Plasmodium falciparum
NNNYTY

SEQ ID NO: 3239980 - protein, 6 aa, Plasmodium falciparum
NNNYYN

SEQ ID NO: 3239981 - protein, 19 aa, Plasmodium falciparum
NNPDDNNNDTNNKSVHSSD

SEQ ID NO: 3239982 - protein, 14 aa, Plasmodium falciparum
NNPDLTKAKSKDKY

SEQ ID NO: 3239983 - protein, 8 aa, Plasmodium falciparum
NNPDTSYK

SEQ ID NO: 3239984 - protein, 6 aa, Plasmodium falciparum
NNPKEE

SEQ ID NO: 3239985 - protein, 9 aa, Plasmodium falciparum
NNPKENHEK

SEQ ID NO: 3239986 - protein, 16 aa, Plasmodium falciparum
NNPKLRKNNKERKNNI

SEQ ID NO: 3239987 - protein, 7 aa, Plasmodium falciparum
NNPKNTH

SEQ ID NO: 3239988 - protein, 9 aa, Plasmodium falciparum
NNPKQLNPS

SEQ ID NO: 3239989 - protein, 4 aa, Plasmodium falciparum
NNPL

SEQ ID NO: 3239990 - protein, 5 aa, Plasmodium falciparum
NNPLE

SEQ ID NO: 3239991 - protein, 23 aa, Plasmodium falciparum
NNPNDINNSNYSNDINNSNYPNN

SEQ ID NO: 3239992 - protein, 8 aa, Plasmodium falciparum
NNPNEKTI

SEQ ID NO: 3239993 - protein, 5 aa, Plasmodium falciparum
NNPNF

SEQ ID NO: 3239994 - protein, 17 aa, Plasmodium falciparum
NNPNQTFPSNPNPVENN

SEQ ID NO: 3239995 - protein, 6 aa, Plasmodium falciparum
NNPNVN

SEQ ID NO: 3239996 - protein, 15 aa, Plasmodium falciparum
NNPPNYNNSHNYNNA

SEQ ID NO: 3239997 - protein, 8 aa, Plasmodium falciparum
NNPSGKSN

SEQ ID NO: 3239998 - protein, 5 aa, Plasmodium falciparum
NNPSL

SEQ ID NO: 3239999 - protein, 5 aa, Plasmodium falciparum
NNPTL

SEQ ID NO: 3240000 - protein, 6 aa, Plasmodium falciparum
NNPVDT

SEQ ID NO: 3240001 - protein, 5 aa, Plasmodium falciparum
NNPVS

SEQ ID NO: 3240002 - protein, 13 aa, Plasmodium falciparum
NNPYAEDQTNVKE

SEQ ID NO: 3240003 - protein, 34 aa, Plasmodium falciparum
NNPYKAKNNNNNNNSNNNNNNSNNNNNNNNNNSQ

SEQ ID NO: 3240004 - protein, 4 aa, Plasmodium falciparum
NNQD

SEQ ID NO: 3240005 - protein, 5 aa, Plasmodium falciparum
NNQDD

SEQ ID NO: 3240006 - protein, 10 aa, Plasmodium falciparum
NNQDKNKVEK

SEQ ID NO: 3240007 - protein, 12 aa, Plasmodium falciparum
NNQDKPDQHNNS

SEQ ID NO: 3240008 - protein, 4 aa, Plasmodium falciparum
NNQE

SEQ ID NO: 3240009 - protein, 8 aa, Plasmodium falciparum
NNQEENIN

SEQ ID NO: 3240010 - protein, 8 aa, Plasmodium falciparum
NNQGESVS

SEQ ID NO: 3240011 - protein, 8 aa, Plasmodium falciparum
NNQGNDIT

SEQ ID NO: 3240012 - protein, 6 aa, Plasmodium falciparum
NNQHRN

SEQ ID NO: 3240013 - protein, 18 aa, Plasmodium falciparum
NNQHSGNNPDNDNNNNNN

SEQ ID NO: 3240014 - protein, 5 aa, Plasmodium falciparum
NNQII

SEQ ID NO: 3240015 - protein, 6 aa, Plasmodium falciparum
NNQISD

SEQ ID NO: 3240016 - protein, 9 aa, Plasmodium falciparum
NNQISPYKN

SEQ ID NO: 3240017 - protein, 17 aa, Plasmodium falciparum
NNQKDDIQRNMSNGNNM

SEQ ID NO: 3240018 - protein, 8 aa, Plasmodium falciparum
NNQKDRKE

SEQ ID NO: 3240019 - protein, 10 aa, Plasmodium falciparum
NNQKIKKENE

SEQ ID NO: 3240020 - protein, 8 aa, Plasmodium falciparum
NNQNDNNK

SEQ ID NO: 3240021 - protein, 6 aa, Plasmodium falciparum
NNQNIK

SEQ ID NO: 3240022 - protein, 13 aa, Plasmodium falciparum
NNQNKKSEKNFEN

SEQ ID NO: 3240023 - protein, 45 aa, Plasmodium falciparum
NNQNLKEDVTQCDEEKIEQNNDNGCDDEYDNNNNNNNNIGSSSIS

SEQ ID NO: 3240024 - protein, 16 aa, Plasmodium falciparum
NNQNMNTSLSNNRRKN

SEQ ID NO: 3240025 - protein, 8 aa, Plasmodium falciparum
NNQNNFKH

SEQ ID NO: 3240026 - protein, 25 aa, Plasmodium falciparum
NNQNNLDDKEKKNKLLDSKGRSNNS

SEQ ID NO: 3240027 - protein, 7 aa, Plasmodium falciparum
NNQNPKL

SEQ ID NO: 3240028 - protein, 11 aa, Plasmodium falciparum
NNQNQHPIEKP

SEQ ID NO: 3240029 - protein, 10 aa, Plasmodium falciparum
NNQNRENETS

SEQ ID NO: 3240030 - protein, 8 aa, Plasmodium falciparum
NNQNVNEN

SEQ ID NO: 3240031 - protein, 8 aa, Plasmodium falciparum
NNQQTSEN

SEQ ID NO: 3240032 - protein, 16 aa, Plasmodium falciparum
NNQRNGNRHKNNTNNN

SEQ ID NO: 3240033 - protein, 7 aa, Plasmodium falciparum
NNQRSKI

SEQ ID NO: 3240034 - protein, 13 aa, Plasmodium falciparum
NNQSLGEENTKEK

SEQ ID NO: 3240035 - protein, 8 aa, Plasmodium falciparum
NNQSTINK

SEQ ID NO: 3240036 - protein, 6 aa, Plasmodium falciparum
NNQTDA

SEQ ID NO: 3240037 - protein, 7 aa, Plasmodium falciparum
NNQTGDY

SEQ ID NO: 3240038 - protein, 5 aa, Plasmodium falciparum
NNQTN

SEQ ID NO: 3240039 - protein, 4 aa, Plasmodium falciparum
NNQV

SEQ ID NO: 3240040 - protein, 7 aa, Plasmodium falciparum
NNQYDEQ

SEQ ID NO: 3240041 - protein, 5 aa, Plasmodium falciparum
NNRDI

SEQ ID NO: 3240042 - protein, 11 aa, Plasmodium falciparum
NNRDQEGPIDD

SEQ ID NO: 3240043 - protein, 16 aa, Plasmodium falciparum
NNRDTNYNNTQEEKSK

SEQ ID NO: 3240044 - protein, 5 aa, Plasmodium falciparum
NNREI

SEQ ID NO: 3240045 - protein, 14 aa, Plasmodium falciparum
NNREQKEGDDDMKS

SEQ ID NO: 3240046 - protein, 12 aa, Plasmodium falciparum
NNREQKRIKENI

SEQ ID NO: 3240047 - protein, 6 aa, Plasmodium falciparum
NNRGEI

SEQ ID NO: 3240048 - protein, 6 aa, Plasmodium falciparum
NNRGEY

SEQ ID NO: 3240049 - protein, 10 aa, Plasmodium falciparum
NNRGKTYNPP

SEQ ID NO: 3240050 - protein, 8 aa, Plasmodium falciparum
NNRGSIQS

SEQ ID NO: 3240051 - protein, 13 aa, Plasmodium falciparum
NNRIPSNNTKLNN

SEQ ID NO: 3240052 - protein, 13 aa, Plasmodium falciparum
NNRKCKKKKKNDI

SEQ ID NO: 3240053 - protein, 33 aa, Plasmodium falciparum
NNRKEEHAENNNDLKDKNKTDEVMNNEEKDMGN

SEQ ID NO: 3240054 - protein, 6 aa, Plasmodium falciparum
NNRKIE

SEQ ID NO: 3240055 - protein, 15 aa, Plasmodium falciparum
NNRKNEKFDKNRDLH

SEQ ID NO: 3240056 - protein, 6 aa, Plasmodium falciparum
NNRMEK

SEQ ID NO: 3240057 - protein, 4 aa, Plasmodium falciparum
NNRN

SEQ ID NO: 3240058 - protein, 6 aa, Plasmodium falciparum
NNRNDV

SEQ ID NO: 3240059 - protein, 5 aa, Plasmodium falciparum
NNRNK

SEQ ID NO: 3240060 - protein, 16 aa, Plasmodium falciparum
NNRNKNKNNTNNKNNV

SEQ ID NO: 3240061 - protein, 8 aa, Plasmodium falciparum
NNRNNDNS

SEQ ID NO: 3240062 - protein, 10 aa, Plasmodium falciparum
NNRNNDTRDD

SEQ ID NO: 3240063 - protein, 11 aa, Plasmodium falciparum
NNRNRTSNTIE

SEQ ID NO: 3240064 - protein, 9 aa, Plasmodium falciparum
NNRNSPAEF

SEQ ID NO: 3240065 - protein, 21 aa, Plasmodium falciparum
NNRNYKKNSNEKNARNSSLKL

SEQ ID NO: 3240066 - protein, 16 aa, Plasmodium falciparum
NNRPMDKNDTNNKESD

SEQ ID NO: 3240067 - protein, 18 aa, Plasmodium falciparum
NNRPSSDEEYKEEKDKNK

SEQ ID NO: 3240068 - protein, 7 aa, Plasmodium falciparum
NNRPTQE

SEQ ID NO: 3240069 - protein, 17 aa, Plasmodium falciparum
NNRRGGVNNDKKNIYNT

SEQ ID NO: 3240070 - protein, 7 aa, Plasmodium falciparum
NNRRNKE

SEQ ID NO: 3240071 - protein, 9 aa, Plasmodium falciparum
NNRRTHKSN

SEQ ID NO: 3240072 - protein, 63 aa, Plasmodium falciparum
NNRSKDHDNNAYYEKKKKSMNNNNNTFGNNNVNNSSSGEGPTTTTNEQVERKNNITDGTTEKQ

SEQ ID NO: 3240073 - protein, 8 aa, Plasmodium falciparum
NNRTDEKD

SEQ ID NO: 3240074 - protein, 61 aa, Plasmodium falciparum
NNRTYNNRNNDNMENNSVQNNDSQDNDSQDNDSQSNDSQSNDSQSNDSQNNDSQYNNRKYD

SEQ ID NO: 3240075 - protein, 4 aa, Plasmodium falciparum
NNSD

SEQ ID NO: 3240076 - protein, 16 aa, Plasmodium falciparum
NNSDGGINKDFGTKGS

SEQ ID NO: 3240077 - protein, 8 aa, Plasmodium falciparum
NNSDINKS

SEQ ID NO: 3240078 - protein, 7 aa, Plasmodium falciparum
NNSDITN

SEQ ID NO: 3240079 - protein, 6 aa, Plasmodium falciparum
NNSDNI

SEQ ID NO: 3240080 - protein, 13 aa, Plasmodium falciparum
NNSDNKKIDTSDI

SEQ ID NO: 3240081 - protein, 8 aa, Plasmodium falciparum
NNSDNMNK

SEQ ID NO: 3240082 - protein, 22 aa, Plasmodium falciparum
NNSDRTNIKDTSKKKENKHENI

SEQ ID NO: 3240083 - protein, 4 aa, Plasmodium falciparum
NNSE

SEQ ID NO: 3240084 - protein, 9 aa, Plasmodium falciparum
NNSEDDYTH

SEQ ID NO: 3240085 - protein, 9 aa, Plasmodium falciparum
NNSEDNDHI

SEQ ID NO: 3240086 - protein, 11 aa, Plasmodium falciparum
NNSENGKTTPF

SEQ ID NO: 3240087 - protein, 16 aa, Plasmodium falciparum
NNSEQGKEKKIHKRRK

SEQ ID NO: 3240088 - protein, 19 aa, Plasmodium falciparum
NNSEQHKNKNIYEENNTTH

SEQ ID NO: 3240089 - protein, 5 aa, Plasmodium falciparum
NNSEV

SEQ ID NO: 3240090 - protein, 18 aa, Plasmodium falciparum
NNSEYWDKPNKTYTNSDL

SEQ ID NO: 3240091 - protein, 9 aa, Plasmodium falciparum
NNSFDKDNS

SEQ ID NO: 3240092 - protein, 8 aa, Plasmodium falciparum
NNSFNKEG

SEQ ID NO: 3240093 - protein, 8 aa, Plasmodium falciparum
NNSGDNEF

SEQ ID NO: 3240094 - protein, 12 aa, Plasmodium falciparum
NNSGIHNKRDDN

SEQ ID NO: 3240095 - protein, 7 aa, Plasmodium falciparum
NNSGKNI

SEQ ID NO: 3240096 - protein, 47 aa, Plasmodium falciparum
NNSGKVNEKKKKKAEMKDDNEKKEFDENNIKEEEEEEEYDNDDDFTV

SEQ ID NO: 3240097 - protein, 7 aa, Plasmodium falciparum
NNSGNYY

SEQ ID NO: 3240098 - protein, 11 aa, Plasmodium falciparum
NNSGRNSTADK

SEQ ID NO: 3240099 - protein, 10 aa, Plasmodium falciparum
NNSGTNTSYE

SEQ ID NO: 3240100 - protein, 12 aa, Plasmodium falciparum
NNSHINNDNPNL

SEQ ID NO: 3240101 - protein, 5 aa, Plasmodium falciparum
NNSID

SEQ ID NO: 3240102 - protein, 6 aa, Plasmodium falciparum
NNSIKK

SEQ ID NO: 3240103 - protein, 5 aa, Plasmodium falciparum
NNSIN

SEQ ID NO: 3240104 - protein, 12 aa, Plasmodium falciparum
NNSINNTNLENH

SEQ ID NO: 3240105 - protein, 17 aa, Plasmodium falciparum
NNSINSVTKSSNKETVL

SEQ ID NO: 3240106 - protein, 4 aa, Plasmodium falciparum
NNSK

SEQ ID NO: 3240107 - protein, 13 aa, Plasmodium falciparum
NNSKAQDKIKRKN

SEQ ID NO: 3240108 - protein, 5 aa, Plasmodium falciparum
NNSKG

SEQ ID NO: 3240109 - protein, 7 aa, Plasmodium falciparum
NNSKGIK

SEQ ID NO: 3240110 - protein, 6 aa, Plasmodium falciparum
NNSKKM

SEQ ID NO: 3240111 - protein, 14 aa, Plasmodium falciparum
NNSKKSIKKKNDYT

SEQ ID NO: 3240112 - protein, 7 aa, Plasmodium falciparum
NNSKSFN

SEQ ID NO: 3240113 - protein, 6 aa, Plasmodium falciparum
NNSKSR

SEQ ID NO: 3240114 - protein, 12 aa, Plasmodium falciparum
NNSKVESEDNYY

SEQ ID NO: 3240115 - protein, 4 aa, Plasmodium falciparum
NNSL

SEQ ID NO: 3240116 - protein, 5 aa, Plasmodium falciparum
NNSLD

SEQ ID NO: 3240117 - protein, 14 aa, Plasmodium falciparum
NNSLGKNVSKNDIH

SEQ ID NO: 3240118 - protein, 8 aa, Plasmodium falciparum
NNSLMDSG

SEQ ID NO: 3240119 - protein, 6 aa, Plasmodium falciparum
NNSLQE

SEQ ID NO: 3240120 - protein, 13 aa, Plasmodium falciparum
NNSLSNKKNCDYK

SEQ ID NO: 3240121 - protein, 4 aa, Plasmodium falciparum
NNSM

SEQ ID NO: 3240122 - protein, 13 aa, Plasmodium falciparum
NNSMNDKENDNNF

SEQ ID NO: 3240123 - protein, 4 aa, Plasmodium falciparum
NNSN

SEQ ID NO: 3240124 - protein, 12 aa, Plasmodium falciparum
NNSNAYSEEEKE

SEQ ID NO: 3240125 - protein, 33 aa, Plasmodium falciparum
NNSNDNSDNNNNNNNNNNNNNNNNNNDNNNDRC

SEQ ID NO: 3240126 - protein, 7 aa, Plasmodium falciparum
NNSNDYS

SEQ ID NO: 3240127 - protein, 18 aa, Plasmodium falciparum
NNSNESKACKNNKKCNKE

SEQ ID NO: 3240128 - protein, 17 aa, Plasmodium falciparum
NNSNESKACKNNNKCKD

SEQ ID NO: 3240129 - protein, 5 aa, Plasmodium falciparum
NNSNI

SEQ ID NO: 3240130 - protein, 21 aa, Plasmodium falciparum
NNSNITSNTNNKKKYDESENS

SEQ ID NO: 3240131 - protein, 32 aa, Plasmodium falciparum
NNSNKSVNNMDNNYSNNNYSNNNYSNNNNNDI

SEQ ID NO: 3240132 - protein, 24 aa, Plasmodium falciparum
NNSNMENNDDKKKEENNSTNNKVV

SEQ ID NO: 3240133 - protein, 32 aa, Plasmodium falciparum
NNSNNDNNDNDNDNNNNDNNNDNNNNNDNNNI

SEQ ID NO: 3240134 - protein, 23 aa, Plasmodium falciparum
NNSNNDTSNYNNNNNNNNNNNNC

SEQ ID NO: 3240135 - protein, 11 aa, Plasmodium falciparum
NNSNNFDSSNS

SEQ ID NO: 3240136 - protein, 16 aa, Plasmodium falciparum
NNSNNIKDRIEETKNS

SEQ ID NO: 3240137 - protein, 7 aa, Plasmodium falciparum
NNSNNLG

SEQ ID NO: 3240138 - protein, 6 aa, Plasmodium falciparum
NNSNNN

SEQ ID NO: 3240139 - protein, 12 aa, Plasmodium falciparum
NNSNNNNNNNIL

SEQ ID NO: 3240140 - protein, 12 aa, Plasmodium falciparum
NNSNNNNNNNIN

SEQ ID NO: 3240141 - protein, 19 aa, Plasmodium falciparum
NNSNNNNNNNNNNNNNNKY

SEQ ID NO: 3240142 - protein, 37 aa, Plasmodium falciparum
NNSNNNNNNNNNNNNNNNNNNNNNNNNCNKDGGVVRT

SEQ ID NO: 3240143 - protein, 20 aa, Plasmodium falciparum
NNSNNNTTCNKTSYEAYQEQ

SEQ ID NO: 3240144 - protein, 7 aa, Plasmodium falciparum
NNSNSFN

SEQ ID NO: 3240145 - protein, 28 aa, Plasmodium falciparum
NNSNSLGKENSSNYEKSINQNRDEESCK

SEQ ID NO: 3240146 - protein, 13 aa, Plasmodium falciparum
NNSNTKEKKKNSL

SEQ ID NO: 3240147 - protein, 15 aa, Plasmodium falciparum
NNSNTNTNNNRNIKY

SEQ ID NO: 3240148 - protein, 10 aa, Plasmodium falciparum
NNSNVNNSYQ

SEQ ID NO: 3240149 - protein, 8 aa, Plasmodium falciparum
NNSNYKND

SEQ ID NO: 3240150 - protein, 12 aa, Plasmodium falciparum
NNSPFDSQKPYK

SEQ ID NO: 3240151 - protein, 6 aa, Plasmodium falciparum
NNSPFK

SEQ ID NO: 3240152 - protein, 6 aa, Plasmodium falciparum
NNSPNI

SEQ ID NO: 3240153 - protein, 8 aa, Plasmodium falciparum
NNSQKKRY

SEQ ID NO: 3240154 - protein, 11 aa, Plasmodium falciparum
NNSQQQQQTNV

SEQ ID NO: 3240155 - protein, 14 aa, Plasmodium falciparum
NNSRGTNNNNGTNR

SEQ ID NO: 3240156 - protein, 13 aa, Plasmodium falciparum
NNSRNKNKHSLGS

SEQ ID NO: 3240157 - protein, 4 aa, Plasmodium falciparum
NNSS

SEQ ID NO: 3240158 - protein, 7 aa, Plasmodium falciparum
NNSSCNN

SEQ ID NO: 3240159 - protein, 6 aa, Plasmodium falciparum
NNSSEK

SEQ ID NO: 3240160 - protein, 15 aa, Plasmodium falciparum
NNSSEYAETSNYSSS

SEQ ID NO: 3240161 - protein, 28 aa, Plasmodium falciparum
NNSSNNNNNNNNNINSNNNNNNNNSNIN

SEQ ID NO: 3240162 - protein, 85 aa, Plasmodium falciparum
NNSSNSKAYNNNMRDTSSSNTSMSDTISSNTNSSHTNSSHTTSSNTTSSHTHSRHTHSRRTHSSHTTNSDTNSSNNNKSSSNSAD

SEQ ID NO: 3240163 - protein, 9 aa, Plasmodium falciparum
NNSSPTNNI

SEQ ID NO: 3240164 - protein, 8 aa, Plasmodium falciparum
NNSSSGSS

SEQ ID NO: 3240165 - protein, 7 aa, Plasmodium falciparum
NNSSSIY

SEQ ID NO: 3240166 - protein, 8 aa, Plasmodium falciparum
NNSSSRNN

SEQ ID NO: 3240167 - protein, 11 aa, Plasmodium falciparum
NNSSSSKHNNY

SEQ ID NO: 3240168 - protein, 6 aa, Plasmodium falciparum
NNSSVP

SEQ ID NO: 3240169 - protein, 5 aa, Plasmodium falciparum
NNSTC

SEQ ID NO: 3240170 - protein, 5 aa, Plasmodium falciparum
NNSTI

SEQ ID NO: 3240171 - protein, 6 aa, Plasmodium falciparum
NNSTIK

SEQ ID NO: 3240172 - protein, 6 aa, Plasmodium falciparum
NNSTIY

SEQ ID NO: 3240173 - protein, 7 aa, Plasmodium falciparum
NNSTNGY

SEQ ID NO: 3240174 - protein, 51 aa, Plasmodium falciparum
NNSTNNNNNKSNNNNKSNNNNKSNNNNKSNNKNCSNSSNNFDKKDNMQNQK

SEQ ID NO: 3240175 - protein, 7 aa, Plasmodium falciparum
NNSTPDD

SEQ ID NO: 3240176 - protein, 6 aa, Plasmodium falciparum
NNSVDD

SEQ ID NO: 3240177 - protein, 63 aa, Plasmodium falciparum
NNSVVGNSSSHSPSSSSSSPSSSSSSSSSSPSASSSSSSSSPASSSSSPSSTSDDSKNASLDK

SEQ ID NO: 3240178 - protein, 11 aa, Plasmodium falciparum
NNSYDNNSFNS

SEQ ID NO: 3240179 - protein, 7 aa, Plasmodium falciparum
NNSYKNM

SEQ ID NO: 3240180 - protein, 8 aa, Plasmodium falciparum
NNSYLDDN

SEQ ID NO: 3240181 - protein, 21 aa, Plasmodium falciparum
NNSYNDGNSTCSGNNNTYNDN

SEQ ID NO: 3240182 - protein, 13 aa, Plasmodium falciparum
NNSYNNAEAKPLN

SEQ ID NO: 3240183 - protein, 15 aa, Plasmodium falciparum
NNSYNTNSTTNEEHI

SEQ ID NO: 3240184 - protein, 5 aa, Plasmodium falciparum
NNSYV

SEQ ID NO: 3240185 - protein, 52 aa, Plasmodium falciparum
NNTAHTFSSPTNNNNNNNNNNTDNNDNSNNSNNSNINNKKNYINNNNNHSNY

SEQ ID NO: 3240186 - protein, 5 aa, Plasmodium falciparum
NNTCD

SEQ ID NO: 3240187 - protein, 8 aa, Plasmodium falciparum
NNTCESPG

SEQ ID NO: 3240188 - protein, 6 aa, Plasmodium falciparum
NNTCKK

SEQ ID NO: 3240189 - protein, 9 aa, Plasmodium falciparum
NNTCKNPKG

SEQ ID NO: 3240190 - protein, 7 aa, Plasmodium falciparum
NNTCNEV

SEQ ID NO: 3240191 - protein, 4 aa, Plasmodium falciparum
NNTD

SEQ ID NO: 3240192 - protein, 5 aa, Plasmodium falciparum
NNTDG

SEQ ID NO: 3240193 - protein, 12 aa, Plasmodium falciparum
NNTDGNKKQIDE

SEQ ID NO: 3240194 - protein, 8 aa, Plasmodium falciparum
NNTDNSLR

SEQ ID NO: 3240195 - protein, 9 aa, Plasmodium falciparum
NNTDNSYTI

SEQ ID NO: 3240196 - protein, 5 aa, Plasmodium falciparum
NNTDQ

SEQ ID NO: 3240197 - protein, 18 aa, Plasmodium falciparum
NNTDQNNEQEQPKQDDQL

SEQ ID NO: 3240198 - protein, 7 aa, Plasmodium falciparum
NNTDTNF

SEQ ID NO: 3240199 - protein, 4 aa, Plasmodium falciparum
NNTE

SEQ ID NO: 3240200 - protein, 6 aa, Plasmodium falciparum
NNTEKD

SEQ ID NO: 3240201 - protein, 7 aa, Plasmodium falciparum
NNTEKNL

SEQ ID NO: 3240202 - protein, 10 aa, Plasmodium falciparum
NNTEKSVEKE

SEQ ID NO: 3240203 - protein, 6 aa, Plasmodium falciparum
NNTEKT

SEQ ID NO: 3240204 - protein, 13 aa, Plasmodium falciparum
NNTEMKKNTIKSE

SEQ ID NO: 3240205 - protein, 6 aa, Plasmodium falciparum
NNTEQK

SEQ ID NO: 3240206 - protein, 20 aa, Plasmodium falciparum
NNTEYKSNIEQQKQDNNHSY

SEQ ID NO: 3240207 - protein, 7 aa, Plasmodium falciparum
NNTEYTN

SEQ ID NO: 3240208 - protein, 19 aa, Plasmodium falciparum
NNTFQTKSNTTTNNNNHRN

SEQ ID NO: 3240209 - protein, 7 aa, Plasmodium falciparum
NNTFSEK

SEQ ID NO: 3240210 - protein, 4 aa, Plasmodium falciparum
NNTH

SEQ ID NO: 3240211 - protein, 26 aa, Plasmodium falciparum
NNTHNKNNNNNNNNNNNSSSSSNSCC

SEQ ID NO: 3240212 - protein, 7 aa, Plasmodium falciparum
NNTHPTM

SEQ ID NO: 3240213 - protein, 14 aa, Plasmodium falciparum
NNTHPTMSRDNMEE

SEQ ID NO: 3240214 - protein, 6 aa, Plasmodium falciparum
NNTHSS

SEQ ID NO: 3240215 - protein, 12 aa, Plasmodium falciparum
NNTHSSQRHRAH

SEQ ID NO: 3240216 - protein, 10 aa, Plasmodium falciparum
NNTIADNNNM

SEQ ID NO: 3240217 - protein, 8 aa, Plasmodium falciparum
NNTIDNNK

SEQ ID NO: 3240218 - protein, 17 aa, Plasmodium falciparum
NNTKDKLTKKRYQTTNH

SEQ ID NO: 3240219 - protein, 11 aa, Plasmodium falciparum
NNTKENAPVTS

SEQ ID NO: 3240220 - protein, 18 aa, Plasmodium falciparum
NNTKKKIYNTRTKNKKIV

SEQ ID NO: 3240221 - protein, 7 aa, Plasmodium falciparum
NNTKKRY

SEQ ID NO: 3240222 - protein, 56 aa, Plasmodium falciparum
NNTKNEDINNDDNNNDDNNNEDNNNEDNNNGDNNNGDNNNGDNNNGDNNNGDMKKD

SEQ ID NO: 3240223 - protein, 10 aa, Plasmodium falciparum
NNTKNGEDIN

SEQ ID NO: 3240224 - protein, 7 aa, Plasmodium falciparum
NNTKNNL

SEQ ID NO: 3240225 - protein, 7 aa, Plasmodium falciparum
NNTKNVT

SEQ ID NO: 3240226 - protein, 5 aa, Plasmodium falciparum
NNTKR

SEQ ID NO: 3240227 - protein, 6 aa, Plasmodium falciparum
NNTKSF

SEQ ID NO: 3240228 - protein, 7 aa, Plasmodium falciparum
NNTKTSL

SEQ ID NO: 3240229 - protein, 12 aa, Plasmodium falciparum
NNTKYNSARNEL

SEQ ID NO: 3240230 - protein, 5 aa, Plasmodium falciparum
NNTLN

SEQ ID NO: 3240231 - protein, 6 aa, Plasmodium falciparum
NNTLNK

SEQ ID NO: 3240232 - protein, 7 aa, Plasmodium falciparum
NNTLQDK

SEQ ID NO: 3240233 - protein, 4 aa, Plasmodium falciparum
NNTN

SEQ ID NO: 3240234 - protein, 8 aa, Plasmodium falciparum
NNTNDNNI

SEQ ID NO: 3240235 - protein, 9 aa, Plasmodium falciparum
NNTNEEDSN

SEQ ID NO: 3240236 - protein, 22 aa, Plasmodium falciparum
NNTNEGNMKNTNVNKDTNSKCN

SEQ ID NO: 3240237 - protein, 12 aa, Plasmodium falciparum
NNTNEKNRRTNY

SEQ ID NO: 3240238 - protein, 9 aa, Plasmodium falciparum
NNTNGDKEI

SEQ ID NO: 3240239 - protein, 16 aa, Plasmodium falciparum
NNTNGKQTKCRKGCKG

SEQ ID NO: 3240240 - protein, 31 aa, Plasmodium falciparum
NNTNHKNNNNNNINSNSNSNSSSSSSSNSNY

SEQ ID NO: 3240241 - protein, 8 aa, Plasmodium falciparum
NNTNIDNN

SEQ ID NO: 3240242 - protein, 16 aa, Plasmodium falciparum
NNTNIQNNINDEKEQN

SEQ ID NO: 3240243 - protein, 7 aa, Plasmodium falciparum
NNTNKMD

SEQ ID NO: 3240244 - protein, 9 aa, Plasmodium falciparum
NNTNKNISP

SEQ ID NO: 3240245 - protein, 18 aa, Plasmodium falciparum
NNTNKSKACKNSNKCNND

SEQ ID NO: 3240246 - protein, 5 aa, Plasmodium falciparum
NNTNM

SEQ ID NO: 3240247 - protein, 30 aa, Plasmodium falciparum
NNTNNDNIKNKDYGYDNGDGENKKESSGAF

SEQ ID NO: 3240248 - protein, 24 aa, Plasmodium falciparum
NNTNNFKNTVKEKKQINKTLKKET

SEQ ID NO: 3240249 - protein, 12 aa, Plasmodium falciparum
NNTNNKKQDYNQ

SEQ ID NO: 3240250 - protein, 7 aa, Plasmodium falciparum
NNTNNMN

SEQ ID NO: 3240251 - protein, 8 aa, Plasmodium falciparum
NNTNNNVN

SEQ ID NO: 3240252 - protein, 7 aa, Plasmodium falciparum
NNTNNVN

SEQ ID NO: 3240253 - protein, 20 aa, Plasmodium falciparum
NNTNPNKDKFNDSNNKFKAP

SEQ ID NO: 3240254 - protein, 8 aa, Plasmodium falciparum
NNTNPNYE

SEQ ID NO: 3240255 - protein, 8 aa, Plasmodium falciparum
NNTNRNPF

SEQ ID NO: 3240256 - protein, 11 aa, Plasmodium falciparum
NNTNRNSNSCY

SEQ ID NO: 3240257 - protein, 15 aa, Plasmodium falciparum
NNTNRSNNNNNKTSI

SEQ ID NO: 3240258 - protein, 18 aa, Plasmodium falciparum
NNTNTENYAEKSDDDINE

SEQ ID NO: 3240259 - protein, 9 aa, Plasmodium falciparum
NNTNVEGEK

SEQ ID NO: 3240260 - protein, 43 aa, Plasmodium falciparum
NNTNYRTNNSSTSLKSYGNEKNKKSDNNGKVPMKDQSPNKVSP

SEQ ID NO: 3240261 - protein, 4 aa, Plasmodium falciparum
NNTP

SEQ ID NO: 3240262 - protein, 17 aa, Plasmodium falciparum
NNTPDDKKKKPDFYFEV

SEQ ID NO: 3240263 - protein, 6 aa, Plasmodium falciparum
NNTPFN

SEQ ID NO: 3240264 - protein, 7 aa, Plasmodium falciparum
NNTPRDE

SEQ ID NO: 3240265 - protein, 6 aa, Plasmodium falciparum
NNTPTI

SEQ ID NO: 3240266 - protein, 6 aa, Plasmodium falciparum
NNTQEA

SEQ ID NO: 3240267 - protein, 16 aa, Plasmodium falciparum
NNTQEEDDKIHNPDDN

SEQ ID NO: 3240268 - protein, 8 aa, Plasmodium falciparum
NNTQGTTI

SEQ ID NO: 3240269 - protein, 6 aa, Plasmodium falciparum
NNTQHE

SEQ ID NO: 3240270 - protein, 12 aa, Plasmodium falciparum
NNTQKCKNKNIK

SEQ ID NO: 3240271 - protein, 6 aa, Plasmodium falciparum
NNTQKD

SEQ ID NO: 3240272 - protein, 37 aa, Plasmodium falciparum
NNTQKENPTLDTKEINDSNDQKLEKKENINQINSDNH

SEQ ID NO: 3240273 - protein, 7 aa, Plasmodium falciparum
NNTQNYE

SEQ ID NO: 3240274 - protein, 8 aa, Plasmodium falciparum
NNTQRTTI

SEQ ID NO: 3240275 - protein, 7 aa, Plasmodium falciparum
NNTQSCN

SEQ ID NO: 3240276 - protein, 6 aa, Plasmodium falciparum
NNTQYT

SEQ ID NO: 3240277 - protein, 5 aa, Plasmodium falciparum
NNTRE

SEQ ID NO: 3240278 - protein, 19 aa, Plasmodium falciparum
NNTRTNTLKKNNSNNNNTN

SEQ ID NO: 3240279 - protein, 4 aa, Plasmodium falciparum
NNTS

SEQ ID NO: 3240280 - protein, 10 aa, Plasmodium falciparum
NNTSDEEKDF

SEQ ID NO: 3240281 - protein, 13 aa, Plasmodium falciparum
NNTSHRENKNVSR

SEQ ID NO: 3240282 - protein, 6 aa, Plasmodium falciparum
NNTSKG

SEQ ID NO: 3240283 - protein, 9 aa, Plasmodium falciparum
NNTSKNLNN

SEQ ID NO: 3240284 - protein, 14 aa, Plasmodium falciparum
NNTSKNRKNESNHG

SEQ ID NO: 3240285 - protein, 22 aa, Plasmodium falciparum
NNTSNNNNNNNINNTGSNNNTL

SEQ ID NO: 3240286 - protein, 10 aa, Plasmodium falciparum
NNTSSKDELK

SEQ ID NO: 3240287 - protein, 17 aa, Plasmodium falciparum
NNTSSKDSRRGYSYRNS

SEQ ID NO: 3240288 - protein, 11 aa, Plasmodium falciparum
NNTSTTCSNNE

SEQ ID NO: 3240289 - protein, 5 aa, Plasmodium falciparum
NNTSY

SEQ ID NO: 3240290 - protein, 6 aa, Plasmodium falciparum
NNTSYN

SEQ ID NO: 3240291 - protein, 4 aa, Plasmodium falciparum
NNTT

SEQ ID NO: 3240292 - protein, 9 aa, Plasmodium falciparum
NNTTEKQHI

SEQ ID NO: 3240293 - protein, 40 aa, Plasmodium falciparum
NNTTGNNITNDNNNNDNNNNNNDNNINNNVSSANSTTNNC

SEQ ID NO: 3240294 - protein, 12 aa, Plasmodium falciparum
NNTTKGKNEKKR

SEQ ID NO: 3240295 - protein, 8 aa, Plasmodium falciparum
NNTTKGRY

SEQ ID NO: 3240296 - protein, 7 aa, Plasmodium falciparum
NNTTNIQ

SEQ ID NO: 3240297 - protein, 14 aa, Plasmodium falciparum
NNTTNISNNNNNMN

SEQ ID NO: 3240298 - protein, 23 aa, Plasmodium falciparum
NNTTNNNNNNNISNNNNNNNNNN

SEQ ID NO: 3240299 - protein, 45 aa, Plasmodium falciparum
NNTTTNDNNNNNNDNNNDNNNNNNNNNNNYNGKNEINENNFNEEY

SEQ ID NO: 3240300 - protein, 7 aa, Plasmodium falciparum
NNTTTQH

SEQ ID NO: 3240301 - protein, 6 aa, Plasmodium falciparum
NNTTTR

SEQ ID NO: 3240302 - protein, 20 aa, Plasmodium falciparum
NNTTTTTNNNNNNNNNNNYN

SEQ ID NO: 3240303 - protein, 11 aa, Plasmodium falciparum
NNTVDSTNNTI

SEQ ID NO: 3240304 - protein, 23 aa, Plasmodium falciparum
NNTVEYNSEEDGNSKSKLSKDLP

SEQ ID NO: 3240305 - protein, 5 aa, Plasmodium falciparum
NNTYD

SEQ ID NO: 3240306 - protein, 5 aa, Plasmodium falciparum
NNTYK

SEQ ID NO: 3240307 - protein, 71 aa, Plasmodium falciparum
NNTYNNDTKYLSNPKGVTNKSKQSKKEIEKKKKKKNNNNNNNNNNKIKSEKSANDTKNIPPIPKNTEDRWN

SEQ ID NO: 3240308 - protein, 9 aa, Plasmodium falciparum
NNTYQNTSQ

SEQ ID NO: 3240309 - protein, 8 aa, Plasmodium falciparum
NNTYSKKQ

SEQ ID NO: 3240310 - protein, 10 aa, Plasmodium falciparum
NNTYSSDTSY

SEQ ID NO: 3240311 - protein, 22 aa, Plasmodium falciparum
NNTYSYGDDDQVQNEKKKNLDR

SEQ ID NO: 3240312 - protein, 6 aa, Plasmodium falciparum
NNVATT

SEQ ID NO: 3240313 - protein, 5 aa, Plasmodium falciparum
NNVDG

SEQ ID NO: 3240314 - protein, 30 aa, Plasmodium falciparum
NNVDKTNNQTCNNQKENGKHESIEENEQEI

SEQ ID NO: 3240315 - protein, 8 aa, Plasmodium falciparum
NNVDNKTK

SEQ ID NO: 3240316 - protein, 4 aa, Plasmodium falciparum
NNVE

SEQ ID NO: 3240317 - protein, 13 aa, Plasmodium falciparum
NNVEEEKNNNMNS

SEQ ID NO: 3240318 - protein, 7 aa, Plasmodium falciparum
NNVENDN

SEQ ID NO: 3240319 - protein, 11 aa, Plasmodium falciparum
NNVENNNNNNS

SEQ ID NO: 3240320 - protein, 43 aa, Plasmodium falciparum
NNVERNNENNIKKKNIDNNDNNDNNDDDDDDDDDDDSTNKNGN

SEQ ID NO: 3240321 - protein, 20 aa, Plasmodium falciparum
NNVGGDNSINNDDIRNRGGS

SEQ ID NO: 3240322 - protein, 5 aa, Plasmodium falciparum
NNVGN

SEQ ID NO: 3240323 - protein, 15 aa, Plasmodium falciparum
NNVKNKESNINTTNI

SEQ ID NO: 3240324 - protein, 17 aa, Plasmodium falciparum
NNVMNGQGNNYMNGQTN

SEQ ID NO: 3240325 - protein, 15 aa, Plasmodium falciparum
NNVMNGQGNNYTNSQ

SEQ ID NO: 3240326 - protein, 4 aa, Plasmodium falciparum
NNVN

SEQ ID NO: 3240327 - protein, 6 aa, Plasmodium falciparum
NNVNDN

SEQ ID NO: 3240328 - protein, 7 aa, Plasmodium falciparum
NNVNDYG

SEQ ID NO: 3240329 - protein, 12 aa, Plasmodium falciparum
NNVNEDGFPNPS

SEQ ID NO: 3240330 - protein, 24 aa, Plasmodium falciparum
NNVNEDIEKKKKKKSIEEEGSGDD

SEQ ID NO: 3240331 - protein, 13 aa, Plasmodium falciparum
NNVNNNVNNNNNN

SEQ ID NO: 3240332 - protein, 19 aa, Plasmodium falciparum
NNVNNYDNNNYHNDYNNDD

SEQ ID NO: 3240333 - protein, 8 aa, Plasmodium falciparum
NNVNSYDE

SEQ ID NO: 3240334 - protein, 13 aa, Plasmodium falciparum
NNVNSYKKENEQM

SEQ ID NO: 3240335 - protein, 7 aa, Plasmodium falciparum
NNVPRNI

SEQ ID NO: 3240336 - protein, 36 aa, Plasmodium falciparum
NNVPSINNNNSSSNNNNNPRHSSSNMPSLNNPNQFN

SEQ ID NO: 3240337 - protein, 5 aa, Plasmodium falciparum
NNVPT

SEQ ID NO: 3240338 - protein, 12 aa, Plasmodium falciparum
NNVQEGEGHSQE

SEQ ID NO: 3240339 - protein, 9 aa, Plasmodium falciparum
NNVQKNKSI

SEQ ID NO: 3240340 - protein, 4 aa, Plasmodium falciparum
NNVR

SEQ ID NO: 3240341 - protein, 4 aa, Plasmodium falciparum
NNVS

SEQ ID NO: 3240342 - protein, 5 aa, Plasmodium falciparum
NNVSN

SEQ ID NO: 3240343 - protein, 9 aa, Plasmodium falciparum
NNVSRNSTN

SEQ ID NO: 3240344 - protein, 15 aa, Plasmodium falciparum
NNVSSKNDLTLDDPT

SEQ ID NO: 3240345 - protein, 22 aa, Plasmodium falciparum
NNVSTNEYDNFSSNSISSSEDN

SEQ ID NO: 3240346 - protein, 4 aa, Plasmodium falciparum
NNVT

SEQ ID NO: 3240347 - protein, 25 aa, Plasmodium falciparum
NNVTNKNGSVENNNSLNKYENSTNT

SEQ ID NO: 3240348 - protein, 9 aa, Plasmodium falciparum
NNVTPASSR

SEQ ID NO: 3240349 - protein, 9 aa, Plasmodium falciparum
NNVTSNNNI

SEQ ID NO: 3240350 - protein, 23 aa, Plasmodium falciparum
NNVTYEDDYNETDNNKDEGDDRN

SEQ ID NO: 3240351 - protein, 4 aa, Plasmodium falciparum
NNVY

SEQ ID NO: 3240352 - protein, 6 aa, Plasmodium falciparum
NNYCDD

SEQ ID NO: 3240353 - protein, 4 aa, Plasmodium falciparum
NNYD

SEQ ID NO: 3240354 - protein, 9 aa, Plasmodium falciparum
NNYDDDQNK

SEQ ID NO: 3240355 - protein, 6 aa, Plasmodium falciparum
NNYDDS

SEQ ID NO: 3240356 - protein, 17 aa, Plasmodium falciparum
NNYDESTHRIVLLPLEK

SEQ ID NO: 3240357 - protein, 6 aa, Plasmodium falciparum
NNYDGN

SEQ ID NO: 3240358 - protein, 7 aa, Plasmodium falciparum
NNYDKDQ

SEQ ID NO: 3240359 - protein, 8 aa, Plasmodium falciparum
NNYDNHND

SEQ ID NO: 3240360 - protein, 60 aa, Plasmodium falciparum
NNYDNKKEMNNSDELNGNNNNNNNKNNNNNNNNNNNNNNNNNNNNNINNGGDKNRRNNFN

SEQ ID NO: 3240361 - protein, 27 aa, Plasmodium falciparum
NNYDNNNYDDNNYDDNNYDNNNNNSYY

SEQ ID NO: 3240362 - protein, 24 aa, Plasmodium falciparum
NNYDNNYDNNYDNNYDQDGGNNIY

SEQ ID NO: 3240363 - protein, 26 aa, Plasmodium falciparum
NNYDNQLSSYKNTKQNKTNINEKYNN

SEQ ID NO: 3240364 - protein, 10 aa, Plasmodium falciparum
NNYDSSKAKH

SEQ ID NO: 3240365 - protein, 17 aa, Plasmodium falciparum
NNYDYNENSYDKNSMYD

SEQ ID NO: 3240366 - protein, 13 aa, Plasmodium falciparum
NNYDYRDNGNNYT

SEQ ID NO: 3240367 - protein, 14 aa, Plasmodium falciparum
NNYEEEEKNEKTIS

SEQ ID NO: 3240368 - protein, 5 aa, Plasmodium falciparum
NNYEN

SEQ ID NO: 3240369 - protein, 7 aa, Plasmodium falciparum
NNYENKN

SEQ ID NO: 3240370 - protein, 15 aa, Plasmodium falciparum
NNYEQEDNLKSSSNL

SEQ ID NO: 3240371 - protein, 13 aa, Plasmodium falciparum
NNYEQENNNYGQE

SEQ ID NO: 3240372 - protein, 11 aa, Plasmodium falciparum
NNYETEKEEKN

SEQ ID NO: 3240373 - protein, 15 aa, Plasmodium falciparum
NNYEYDKKNKNKIDV

SEQ ID NO: 3240374 - protein, 7 aa, Plasmodium falciparum
NNYGNDT

SEQ ID NO: 3240375 - protein, 12 aa, Plasmodium falciparum
NNYGNNSYYNDS

SEQ ID NO: 3240376 - protein, 12 aa, Plasmodium falciparum
NNYHDEKNNSNT

SEQ ID NO: 3240377 - protein, 14 aa, Plasmodium falciparum
NNYHNNNNNHHNNN

SEQ ID NO: 3240378 - protein, 10 aa, Plasmodium falciparum
NNYKEINNDE

SEQ ID NO: 3240379 - protein, 6 aa, Plasmodium falciparum
NNYKKG

SEQ ID NO: 3240380 - protein, 11 aa, Plasmodium falciparum
NNYKKKKTTEV

SEQ ID NO: 3240381 - protein, 5 aa, Plasmodium falciparum
NNYKN

SEQ ID NO: 3240382 - protein, 52 aa, Plasmodium falciparum
NNYKNEKKNNNNNNNNNNNNNNNNNNNNNNNNNNNNNNNNNNNNNNNNNSYN

SEQ ID NO: 3240383 - protein, 29 aa, Plasmodium falciparum
NNYKNNDINSTNINNTNNKNLDNNNYNNY

SEQ ID NO: 3240384 - protein, 14 aa, Plasmodium falciparum
NNYKTNHYTNQPKN

SEQ ID NO: 3240385 - protein, 4 aa, Plasmodium falciparum
NNYM

SEQ ID NO: 3240386 - protein, 4 aa, Plasmodium falciparum
NNYN

SEQ ID NO: 3240387 - protein, 18 aa, Plasmodium falciparum
NNYNDDHEENKNSLTEKK

SEQ ID NO: 3240388 - protein, 17 aa, Plasmodium falciparum
NNYNDEKKKKKKKEYDG

SEQ ID NO: 3240389 - protein, 6 aa, Plasmodium falciparum
NNYNDH

SEQ ID NO: 3240390 - protein, 11 aa, Plasmodium falciparum
NNYNDVKNNPF

SEQ ID NO: 3240391 - protein, 11 aa, Plasmodium falciparum
NNYNEEKKTNI

SEQ ID NO: 3240392 - protein, 11 aa, Plasmodium falciparum
NNYNENKIEKQ

SEQ ID NO: 3240393 - protein, 10 aa, Plasmodium falciparum
NNYNKKKKKL

SEQ ID NO: 3240394 - protein, 5 aa, Plasmodium falciparum
NNYNN

SEQ ID NO: 3240395 - protein, 13 aa, Plasmodium falciparum
NNYNNKNKYTSPL

SEQ ID NO: 3240396 - protein, 13 aa, Plasmodium falciparum
NNYNNKNNDNLEN

SEQ ID NO: 3240397 - protein, 6 aa, Plasmodium falciparum
NNYNNN

SEQ ID NO: 3240398 - protein, 21 aa, Plasmodium falciparum
NNYNNNDDDDNDNNSNRLNSS

SEQ ID NO: 3240399 - protein, 11 aa, Plasmodium falciparum
NNYNNNNNNVD

SEQ ID NO: 3240400 - protein, 31 aa, Plasmodium falciparum
NNYNNNSNNNNNNNNNCSNNQDEGNDKVNNS

SEQ ID NO: 3240401 - protein, 32 aa, Plasmodium falciparum
NNYNNSLNSSHASVSKSLNQKPQNDHENINKT

SEQ ID NO: 3240402 - protein, 7 aa, Plasmodium falciparum
NNYNNSN

SEQ ID NO: 3240403 - protein, 6 aa, Plasmodium falciparum
NNYNNY

SEQ ID NO: 3240404 - protein, 10 aa, Plasmodium falciparum
NNYNNYDNNN

SEQ ID NO: 3240405 - protein, 12 aa, Plasmodium falciparum
NNYNQDNKQTSL

SEQ ID NO: 3240406 - protein, 16 aa, Plasmodium falciparum
NNYNQKSNINEKNDKV

SEQ ID NO: 3240407 - protein, 5 aa, Plasmodium falciparum
NNYNR

SEQ ID NO: 3240408 - protein, 20 aa, Plasmodium falciparum
NNYNRYPNNDDKQDNNNNVG

SEQ ID NO: 3240409 - protein, 44 aa, Plasmodium falciparum
NNYNTKPENYEYSEEKKKKKKNEGENFETYETKGNIQEGNETNQ

SEQ ID NO: 3240410 - protein, 10 aa, Plasmodium falciparum
NNYNTSTKEQ

SEQ ID NO: 3240411 - protein, 13 aa, Plasmodium falciparum
NNYNVDNRNRKKY

SEQ ID NO: 3240412 - protein, 10 aa, Plasmodium falciparum
NNYPSNQGVT

SEQ ID NO: 3240413 - protein, 14 aa, Plasmodium falciparum
NNYPYRNKESEEIC

SEQ ID NO: 3240414 - protein, 8 aa, Plasmodium falciparum
NNYQDEKD

SEQ ID NO: 3240415 - protein, 53 aa, Plasmodium falciparum
NNYQNGDNKGDNEDNNMDNENKKLDNEDKKSDNEDKKSDNEDNDKDKDNHYNN

SEQ ID NO: 3240416 - protein, 23 aa, Plasmodium falciparum
NNYQNSSKDNSHTYTSSGDDNLN

SEQ ID NO: 3240417 - protein, 7 aa, Plasmodium falciparum
NNYRNNN

SEQ ID NO: 3240418 - protein, 6 aa, Plasmodium falciparum
NNYSIK

SEQ ID NO: 3240419 - protein, 6 aa, Plasmodium falciparum
NNYSKE

SEQ ID NO: 3240420 - protein, 6 aa, Plasmodium falciparum
NNYSKG

SEQ ID NO: 3240421 - protein, 8 aa, Plasmodium falciparum
NNYSKTKE

SEQ ID NO: 3240422 - protein, 8 aa, Plasmodium falciparum
NNYSPSNS

SEQ ID NO: 3240423 - protein, 11 aa, Plasmodium falciparum
NNYSREEYPIK

SEQ ID NO: 3240424 - protein, 8 aa, Plasmodium falciparum
NNYSSKAK

SEQ ID NO: 3240425 - protein, 10 aa, Plasmodium falciparum
NNYSSYKNSE

SEQ ID NO: 3240426 - protein, 4 aa, Plasmodium falciparum
NNYT

SEQ ID NO: 3240427 - protein, 101 aa, Plasmodium falciparum
NNYTDSDTNSDDSYDYDDTIEDDEDDEEDDEEDESNDNKDDDHEEEEEEGESNSSIDDEFNKENKKTKKENDPDVKEEKSLTTRKKKQKKKKMKKRKKRKN

SEQ ID NO: 3240428 - protein, 12 aa, Plasmodium falciparum
NNYTNKNNSNNY

SEQ ID NO: 3240429 - protein, 5 aa, Plasmodium falciparum
NNYTY

SEQ ID NO: 3240430 - protein, 13 aa, Plasmodium falciparum
NNYVKENKSLTKK

SEQ ID NO: 3240431 - protein, 13 aa, Plasmodium falciparum
NNYYSNSNKENHV

SEQ ID NO: 3240432 - protein, 16 aa, Plasmodium falciparum
NPCDGKNTNFDEDKKQ

SEQ ID NO: 3240433 - protein, 10 aa, Plasmodium falciparum
NPCGDKSATN

SEQ ID NO: 3240434 - protein, 17 aa, Plasmodium falciparum
NPCSGDTSGDSNKQYEA

SEQ ID NO: 3240435 - protein, 24 aa, Plasmodium falciparum
NPCSHDHSKERQLYEKSTKEKINA

SEQ ID NO: 3240436 - protein, 4 aa, Plasmodium falciparum
NPDE

SEQ ID NO: 3240437 - protein, 22 aa, Plasmodium falciparum
NPDEDDKQNKEEKQEEDNSDSL

SEQ ID NO: 3240438 - protein, 9 aa, Plasmodium falciparum
NPDESKKRK

SEQ ID NO: 3240439 - protein, 4 aa, Plasmodium falciparum
NPDG

SEQ ID NO: 3240440 - protein, 5 aa, Plasmodium falciparum
NPDGT

SEQ ID NO: 3240441 - protein, 6 aa, Plasmodium falciparum
NPDISY

SEQ ID NO: 3240442 - protein, 10 aa, Plasmodium falciparum
NPDKEKRDKS

SEQ ID NO: 3240443 - protein, 5 aa, Plasmodium falciparum
NPDKL

SEQ ID NO: 3240444 - protein, 4 aa, Plasmodium falciparum
NPDL

SEQ ID NO: 3240445 - protein, 4 aa, Plasmodium falciparum
NPDN

SEQ ID NO: 3240446 - protein, 6 aa, Plasmodium falciparum
NPDSIG

SEQ ID NO: 3240447 - protein, 6 aa, Plasmodium falciparum
NPDSIN

SEQ ID NO: 3240448 - protein, 6 aa, Plasmodium falciparum
NPDYTN

SEQ ID NO: 3240449 - protein, 5 aa, Plasmodium falciparum
NPECP

SEQ ID NO: 3240450 - protein, 9 aa, Plasmodium falciparum
NPEDRNSNT

SEQ ID NO: 3240451 - protein, 26 aa, Plasmodium falciparum
NPEDTCPTSDTGSRARSDHHDPPPVI

SEQ ID NO: 3240452 - protein, 5 aa, Plasmodium falciparum
NPEEY

SEQ ID NO: 3240453 - protein, 4 aa, Plasmodium falciparum
NPEG

SEQ ID NO: 3240454 - protein, 8 aa, Plasmodium falciparum
NPEGDPTL

SEQ ID NO: 3240455 - protein, 6 aa, Plasmodium falciparum
NPEKKI

SEQ ID NO: 3240456 - protein, 7 aa, Plasmodium falciparum
NPEKPKD

SEQ ID NO: 3240457 - protein, 8 aa, Plasmodium falciparum
NPEKREEP

SEQ ID NO: 3240458 - protein, 6 aa, Plasmodium falciparum
NPENAE

SEQ ID NO: 3240459 - protein, 8 aa, Plasmodium falciparum
NPENGKEM

SEQ ID NO: 3240460 - protein, 4 aa, Plasmodium falciparum
NPES

SEQ ID NO: 3240461 - protein, 10 aa, Plasmodium falciparum
NPESNLGNAE

SEQ ID NO: 3240462 - protein, 5 aa, Plasmodium falciparum
NPGDV

SEQ ID NO: 3240463 - protein, 5 aa, Plasmodium falciparum
NPGLN

SEQ ID NO: 3240464 - protein, 5 aa, Plasmodium falciparum
NPGQS

SEQ ID NO: 3240465 - protein, 37 aa, Plasmodium falciparum
NPGRTCGPDTSHKSDTKPPLPPPLPPAVDPPQAEEPF

SEQ ID NO: 3240466 - protein, 14 aa, Plasmodium falciparum
NPGYLENNKNNVPN

SEQ ID NO: 3240467 - protein, 4 aa, Plasmodium falciparum
NPHE

SEQ ID NO: 3240468 - protein, 4 aa, Plasmodium falciparum
NPHF

SEQ ID NO: 3240469 - protein, 4 aa, Plasmodium falciparum
NPHN

SEQ ID NO: 3240470 - protein, 14 aa, Plasmodium falciparum
NPHNDHNNKSINSY

SEQ ID NO: 3240471 - protein, 28 aa, Plasmodium falciparum
NPHNPSYNDLEKNQSLTSNTNSSQEYYE

SEQ ID NO: 3240472 - protein, 5 aa, Plasmodium falciparum
NPIDT

SEQ ID NO: 3240473 - protein, 13 aa, Plasmodium falciparum
NPIEDDKLKNKNE

SEQ ID NO: 3240474 - protein, 10 aa, Plasmodium falciparum
NPIHDKEETI

SEQ ID NO: 3240475 - protein, 10 aa, Plasmodium falciparum
NPIKKNQTNN

SEQ ID NO: 3240476 - protein, 5 aa, Plasmodium falciparum
NPINS

SEQ ID NO: 3240477 - protein, 8 aa, Plasmodium falciparum
NPKACPKN

SEQ ID NO: 3240478 - protein, 8 aa, Plasmodium falciparum
NPKDENSY

SEQ ID NO: 3240479 - protein, 7 aa, Plasmodium falciparum
NPKDNIN

SEQ ID NO: 3240480 - protein, 5 aa, Plasmodium falciparum
NPKEN

SEQ ID NO: 3240481 - protein, 8 aa, Plasmodium falciparum
NPKESQSI

SEQ ID NO: 3240482 - protein, 4 aa, Plasmodium falciparum
NPKF

SEQ ID NO: 3240483 - protein, 7 aa, Plasmodium falciparum
NPKIGNY

SEQ ID NO: 3240484 - protein, 11 aa, Plasmodium falciparum
NPKKDYPPWKN

SEQ ID NO: 3240485 - protein, 21 aa, Plasmodium falciparum
NPKKKEEEKTKKSEKEPDEFQ

SEQ ID NO: 3240486 - protein, 19 aa, Plasmodium falciparum
NPKKKEESEAKSQNEPEQF

SEQ ID NO: 3240487 - protein, 21 aa, Plasmodium falciparum
NPKKKKKKKKKKLKKKNKKQM

SEQ ID NO: 3240488 - protein, 19 aa, Plasmodium falciparum
NPKKNQDSGNNSSNEPEQF

SEQ ID NO: 3240489 - protein, 6 aa, Plasmodium falciparum
NPKKTI

SEQ ID NO: 3240490 - protein, 5 aa, Plasmodium falciparum
NPKLP

SEQ ID NO: 3240491 - protein, 16 aa, Plasmodium falciparum
NPKNEKTVADLKKNKK

SEQ ID NO: 3240492 - protein, 8 aa, Plasmodium falciparum
NPKNKLKE

SEQ ID NO: 3240493 - protein, 14 aa, Plasmodium falciparum
NPKNSVDKKGGQNQ

SEQ ID NO: 3240494 - protein, 17 aa, Plasmodium falciparum
NPKPKNEFTNMDTNPDN

SEQ ID NO: 3240495 - protein, 9 aa, Plasmodium falciparum
NPKPTNEDN

SEQ ID NO: 3240496 - protein, 5 aa, Plasmodium falciparum
NPKRE

SEQ ID NO: 3240497 - protein, 8 aa, Plasmodium falciparum
NPKTKNEF

SEQ ID NO: 3240498 - protein, 5 aa, Plasmodium falciparum
NPKTL

SEQ ID NO: 3240499 - protein, 5 aa, Plasmodium falciparum
NPKTM

SEQ ID NO: 3240500 - protein, 6 aa, Plasmodium falciparum
NPKTPE

SEQ ID NO: 3240501 - protein, 4 aa, Plasmodium falciparum
NPKY

SEQ ID NO: 3240502 - protein, 5 aa, Plasmodium falciparum
NPKYD

SEQ ID NO: 3240503 - protein, 8 aa, Plasmodium falciparum
NPLDPGTE

SEQ ID NO: 3240504 - protein, 9 aa, Plasmodium falciparum
NPLENKDSI

SEQ ID NO: 3240505 - protein, 13 aa, Plasmodium falciparum
NPLEVKDKESERR

SEQ ID NO: 3240506 - protein, 6 aa, Plasmodium falciparum
NPLSTK

SEQ ID NO: 3240507 - protein, 5 aa, Plasmodium falciparum
NPLTD

SEQ ID NO: 3240508 - protein, 20 aa, Plasmodium falciparum
NPMKGQKEKEEKNNDSNGLP

SEQ ID NO: 3240509 - protein, 5 aa, Plasmodium falciparum
NPNDF

SEQ ID NO: 3240510 - protein, 7 aa, Plasmodium falciparum
NPNDNNI

SEQ ID NO: 3240511 - protein, 9 aa, Plasmodium falciparum
NPNDNNTKK

SEQ ID NO: 3240512 - protein, 42 aa, Plasmodium falciparum
NPNDQNNNMSNQLKKKKKRKKKNNKSKKNININETTNETANY

SEQ ID NO: 3240513 - protein, 8 aa, Plasmodium falciparum
NPNEKETE

SEQ ID NO: 3240514 - protein, 15 aa, Plasmodium falciparum
NPNEQKQQQKKNTHI

SEQ ID NO: 3240515 - protein, 4 aa, Plasmodium falciparum
NPNG

SEQ ID NO: 3240516 - protein, 57 aa, Plasmodium falciparum
NPNGTTTTNNNNNIDNNNIDNYQRNGESDDTTNDITNDTTNETANGTTNNITNNITN

SEQ ID NO: 3240517 - protein, 4 aa, Plasmodium falciparum
NPNH

SEQ ID NO: 3240518 - protein, 6 aa, Plasmodium falciparum
NPNHNL

SEQ ID NO: 3240519 - protein, 4 aa, Plasmodium falciparum
NPNI

SEQ ID NO: 3240520 - protein, 6 aa, Plasmodium falciparum
NPNKIK

SEQ ID NO: 3240521 - protein, 37 aa, Plasmodium falciparum
NPNKKNKKKNKMLKNNNNNNNNNKNKKNKRNNKRSGC

SEQ ID NO: 3240522 - protein, 8 aa, Plasmodium falciparum
NPNKNISQ

SEQ ID NO: 3240523 - protein, 21 aa, Plasmodium falciparum
NPNKVNTKTVNKQNKFSNTGK

SEQ ID NO: 3240524 - protein, 4 aa, Plasmodium falciparum
NPNN

SEQ ID NO: 3240525 - protein, 11 aa, Plasmodium falciparum
NPNNEQNTNKR

SEQ ID NO: 3240526 - protein, 5 aa, Plasmodium falciparum
NPNNK

SEQ ID NO: 3240527 - protein, 6 aa, Plasmodium falciparum
NPNNSI

SEQ ID NO: 3240528 - protein, 23 aa, Plasmodium falciparum
NPNNSNSDCYSSSLNENDDSIES

SEQ ID NO: 3240529 - protein, 7 aa, Plasmodium falciparum
NPNNSTT

SEQ ID NO: 3240530 - protein, 7 aa, Plasmodium falciparum
NPNNVSN

SEQ ID NO: 3240531 - protein, 6 aa, Plasmodium falciparum
NPNQKE

SEQ ID NO: 3240532 - protein, 9 aa, Plasmodium falciparum
NPNQQQQKL

SEQ ID NO: 3240533 - protein, 8 aa, Plasmodium falciparum
NPNQVDDN

SEQ ID NO: 3240534 - protein, 4 aa, Plasmodium falciparum
NPNS

SEQ ID NO: 3240535 - protein, 13 aa, Plasmodium falciparum
NPNTNKDEANKKN

SEQ ID NO: 3240536 - protein, 5 aa, Plasmodium falciparum
NPNYS

SEQ ID NO: 3240537 - protein, 7 aa, Plasmodium falciparum
NPPAPKK

SEQ ID NO: 3240538 - protein, 4 aa, Plasmodium falciparum
NPPE

SEQ ID NO: 3240539 - protein, 5 aa, Plasmodium falciparum
NPPEI

SEQ ID NO: 3240540 - protein, 4 aa, Plasmodium falciparum
NPPI

SEQ ID NO: 3240541 - protein, 8 aa, Plasmodium falciparum
NPPNTYDN

SEQ ID NO: 3240542 - protein, 4 aa, Plasmodium falciparum
NPPY

SEQ ID NO: 3240543 - protein, 5 aa, Plasmodium falciparum
NPPYY

SEQ ID NO: 3240544 - protein, 4 aa, Plasmodium falciparum
NPQE

SEQ ID NO: 3240545 - protein, 4 aa, Plasmodium falciparum
NPRD

SEQ ID NO: 3240546 - protein, 4 aa, Plasmodium falciparum
NPRN

SEQ ID NO: 3240547 - protein, 6 aa, Plasmodium falciparum
NPSDLK

SEQ ID NO: 3240548 - protein, 11 aa, Plasmodium falciparum
NPSGDFGKKEL

SEQ ID NO: 3240549 - protein, 5 aa, Plasmodium falciparum
NPSID

SEQ ID NO: 3240550 - protein, 5 aa, Plasmodium falciparum
NPSIN

SEQ ID NO: 3240551 - protein, 4 aa, Plasmodium falciparum
NPSK

SEQ ID NO: 3240552 - protein, 7 aa, Plasmodium falciparum
NPSNNIG

SEQ ID NO: 3240553 - protein, 8 aa, Plasmodium falciparum
NPSNNRNH

SEQ ID NO: 3240554 - protein, 7 aa, Plasmodium falciparum
NPSRDLG

SEQ ID NO: 3240555 - protein, 10 aa, Plasmodium falciparum
NPSSLDPSSK

SEQ ID NO: 3240556 - protein, 5 aa, Plasmodium falciparum
NPSSY

SEQ ID NO: 3240557 - protein, 4 aa, Plasmodium falciparum
NPST

SEQ ID NO: 3240558 - protein, 5 aa, Plasmodium falciparum
NPSVE

SEQ ID NO: 3240559 - protein, 5 aa, Plasmodium falciparum
NPSYY

SEQ ID NO: 3240560 - protein, 11 aa, Plasmodium falciparum
NPTDASGHGTH

SEQ ID NO: 3240561 - protein, 6 aa, Plasmodium falciparum
NPTETD

SEQ ID NO: 3240562 - protein, 4 aa, Plasmodium falciparum
NPTI

SEQ ID NO: 3240563 - protein, 8 aa, Plasmodium falciparum
NPTNNNSN

SEQ ID NO: 3240564 - protein, 17 aa, Plasmodium falciparum
NPTTTTTNNNNNNNNIN

SEQ ID NO: 3240565 - protein, 9 aa, Plasmodium falciparum
NPTTYKEGD

SEQ ID NO: 3240566 - protein, 4 aa, Plasmodium falciparum
NPTY

SEQ ID NO: 3240567 - protein, 4 aa, Plasmodium falciparum
NPVD

SEQ ID NO: 3240568 - protein, 4 aa, Plasmodium falciparum
NPVE

SEQ ID NO: 3240569 - protein, 16 aa, Plasmodium falciparum
NPVNNNNNNNNNNNND

SEQ ID NO: 3240570 - protein, 7 aa, Plasmodium falciparum
NPYDNNT

SEQ ID NO: 3240571 - protein, 5 aa, Plasmodium falciparum
NPYGD

SEQ ID NO: 3240572 - protein, 4 aa, Plasmodium falciparum
NPYL

SEQ ID NO: 3240573 - protein, 4 aa, Plasmodium falciparum
NPYN

SEQ ID NO: 3240574 - protein, 11 aa, Plasmodium falciparum
NPYNKKGGITL

SEQ ID NO: 3240575 - protein, 9 aa, Plasmodium falciparum
NPYNSDDSV

SEQ ID NO: 3240576 - protein, 5 aa, Plasmodium falciparum
NPYSH

SEQ ID NO: 3240577 - protein, 6 aa, Plasmodium falciparum
NPYSSS

SEQ ID NO: 3240578 - protein, 97 aa, Plasmodium falciparum
NQAKTAQAKDEQHELKPQAEKDASKLTTTYDQTKEVKPQAEKDASKLTTTYDQTKEVKPQAEKDASKLTTTYDQTKEVKPQAEKDALAKTENQNGEL

SEQ ID NO: 3240579 - protein, 21 aa, Plasmodium falciparum
NQCEERKNEDINDKPTNKYNK

SEQ ID NO: 3240580 - protein, 47 aa, Plasmodium falciparum
NQCNTNQRNTNLRNTNQHNDVPKDEITNNVSHKDDTNKIHSNKSKNF

SEQ ID NO: 3240581 - protein, 5 aa, Plasmodium falciparum
NQDDN

SEQ ID NO: 3240582 - protein, 7 aa, Plasmodium falciparum
NQDEKQS

SEQ ID NO: 3240583 - protein, 22 aa, Plasmodium falciparum
NQDEQSQNTYNSDKNNNNYNKN

SEQ ID NO: 3240584 - protein, 10 aa, Plasmodium falciparum
NQDGKKTTTH

SEQ ID NO: 3240585 - protein, 33 aa, Plasmodium falciparum
NQDIEDKKDKYDKHDKQDKKDKYDKHDKQDKQD

SEQ ID NO: 3240586 - protein, 9 aa, Plasmodium falciparum
NQDIEGNKN

SEQ ID NO: 3240587 - protein, 13 aa, Plasmodium falciparum
NQDIQKKKDRQQI

SEQ ID NO: 3240588 - protein, 23 aa, Plasmodium falciparum
NQDISDDENIRDEEEKDEAENID

SEQ ID NO: 3240589 - protein, 15 aa, Plasmodium falciparum
NQDKGYVQDGGYYSP

SEQ ID NO: 3240590 - protein, 7 aa, Plasmodium falciparum
NQDKSNN

SEQ ID NO: 3240591 - protein, 28 aa, Plasmodium falciparum
NQDKTNDYKNGYSNNINNNNSNNYTNEK

SEQ ID NO: 3240592 - protein, 8 aa, Plasmodium falciparum
NQDLTQHE

SEQ ID NO: 3240593 - protein, 8 aa, Plasmodium falciparum
NQDNDNQK

SEQ ID NO: 3240594 - protein, 15 aa, Plasmodium falciparum
NQDSANTKKDTQKIE

SEQ ID NO: 3240595 - protein, 18 aa, Plasmodium falciparum
NQDYNKHPMTKSDMNTER

SEQ ID NO: 3240596 - protein, 38 aa, Plasmodium falciparum
NQEDGEEEDEEEAIEGEDDEEAQDEENDEEEGNNENET

SEQ ID NO: 3240597 - protein, 25 aa, Plasmodium falciparum
NQEDKDAKDCQSKHNDCPQPPAEEV

SEQ ID NO: 3240598 - protein, 98 aa, Plasmodium falciparum
NQEDKDATECKKCEEQAARARSAETNDEPPGSPPRSEEVESEEEEEEEEEDEDHGPDDEEAKTAEGAGEGEGAEAPKEVVPGPKDAEVPAATTTTQND

SEQ ID NO: 3240599 - protein, 6 aa, Plasmodium falciparum
NQEDME

SEQ ID NO: 3240600 - protein, 22 aa, Plasmodium falciparum
NQEEDTVSSEKNKLCDNNNNNN

SEQ ID NO: 3240601 - protein, 12 aa, Plasmodium falciparum
NQEEIIDVSQIT

SEQ ID NO: 3240602 - protein, 7 aa, Plasmodium falciparum
NQEENPD

SEQ ID NO: 3240603 - protein, 5 aa, Plasmodium falciparum
NQEER

SEQ ID NO: 3240604 - protein, 7 aa, Plasmodium falciparum
NQEETKS

SEQ ID NO: 3240605 - protein, 5 aa, Plasmodium falciparum
NQEIK

SEQ ID NO: 3240606 - protein, 10 aa, Plasmodium falciparum
NQEIKNDNEN

SEQ ID NO: 3240607 - protein, 12 aa, Plasmodium falciparum
NQEKAKKKIQNR

SEQ ID NO: 3240608 - protein, 16 aa, Plasmodium falciparum
NQEKDNNNNVKNNNTI

SEQ ID NO: 3240609 - protein, 6 aa, Plasmodium falciparum
NQEKKN

SEQ ID NO: 3240610 - protein, 10 aa, Plasmodium falciparum
NQEKKPDTNI

SEQ ID NO: 3240611 - protein, 11 aa, Plasmodium falciparum
NQEKKSDSLTN

SEQ ID NO: 3240612 - protein, 7 aa, Plasmodium falciparum
NQEKNNV

SEQ ID NO: 3240613 - protein, 30 aa, Plasmodium falciparum
NQENEKTNIVSNNNDNNNDNNNNNNEHNIS

SEQ ID NO: 3240614 - protein, 8 aa, Plasmodium falciparum
NQENETAS

SEQ ID NO: 3240615 - protein, 8 aa, Plasmodium falciparum
NQENISRV

SEQ ID NO: 3240616 - protein, 5 aa, Plasmodium falciparum
NQERK

SEQ ID NO: 3240617 - protein, 10 aa, Plasmodium falciparum
NQESFEKNSY

SEQ ID NO: 3240618 - protein, 7 aa, Plasmodium falciparum
NQETYNN

SEQ ID NO: 3240619 - protein, 6 aa, Plasmodium falciparum
NQEYAQ

SEQ ID NO: 3240620 - protein, 17 aa, Plasmodium falciparum
NQFGNSNYNNMDNTNNK

SEQ ID NO: 3240621 - protein, 13 aa, Plasmodium falciparum
NQFGSGRMDPSVD

SEQ ID NO: 3240622 - protein, 22 aa, Plasmodium falciparum
NQGINENNYVPTKKKKLKYDDQ

SEQ ID NO: 3240623 - protein, 14 aa, Plasmodium falciparum
NQGNKEVEQQNSNN

SEQ ID NO: 3240624 - protein, 6 aa, Plasmodium falciparum
NQGNTD

SEQ ID NO: 3240625 - protein, 33 aa, Plasmodium falciparum
NQGTDIKYDTNKSYDNSTIPRENSCPNSSNENV

SEQ ID NO: 3240626 - protein, 30 aa, Plasmodium falciparum
NQGTQDSDADDISTNGSDKMDQIENKNENI

SEQ ID NO: 3240627 - protein, 22 aa, Plasmodium falciparum
NQGVISKPAESGNISEEYEGQN

SEQ ID NO: 3240628 - protein, 8 aa, Plasmodium falciparum
NQHEQNYS

SEQ ID NO: 3240629 - protein, 4 aa, Plasmodium falciparum
NQHK

SEQ ID NO: 3240630 - protein, 5 aa, Plasmodium falciparum
NQHNE

SEQ ID NO: 3240631 - protein, 5 aa, Plasmodium falciparum
NQIEN

SEQ ID NO: 3240632 - protein, 7 aa, Plasmodium falciparum
NQIKEAS

SEQ ID NO: 3240633 - protein, 6 aa, Plasmodium falciparum
NQIKNA

SEQ ID NO: 3240634 - protein, 6 aa, Plasmodium falciparum
NQINEK

SEQ ID NO: 3240635 - protein, 12 aa, Plasmodium falciparum
NQIQTKESYDEN

SEQ ID NO: 3240636 - protein, 5 aa, Plasmodium falciparum
NQIRT

SEQ ID NO: 3240637 - protein, 12 aa, Plasmodium falciparum
NQISSRRKRSIS

SEQ ID NO: 3240638 - protein, 14 aa, Plasmodium falciparum
NQITNDNKQTDDNN

SEQ ID NO: 3240639 - protein, 7 aa, Plasmodium falciparum
NQKDDQI

SEQ ID NO: 3240640 - protein, 38 aa, Plasmodium falciparum
NQKDKDKDKNKDKNKDTNTKTNANTKTKTNNNNHRQED

SEQ ID NO: 3240641 - protein, 8 aa, Plasmodium falciparum
NQKDMEKN

SEQ ID NO: 3240642 - protein, 21 aa, Plasmodium falciparum
NQKEKGENEKETQNMKQQQYN

SEQ ID NO: 3240643 - protein, 12 aa, Plasmodium falciparum
NQKEQKEERNKK

SEQ ID NO: 3240644 - protein, 8 aa, Plasmodium falciparum
NQKESNNV

SEQ ID NO: 3240645 - protein, 10 aa, Plasmodium falciparum
NQKESNPKYG

SEQ ID NO: 3240646 - protein, 6 aa, Plasmodium falciparum
NQKETY

SEQ ID NO: 3240647 - protein, 12 aa, Plasmodium falciparum
NQKGGTTNNNTC

SEQ ID NO: 3240648 - protein, 25 aa, Plasmodium falciparum
NQKGINTASISGSISRQPNQGTGQI

SEQ ID NO: 3240649 - protein, 8 aa, Plasmodium falciparum
NQKGNHNE

SEQ ID NO: 3240650 - protein, 7 aa, Plasmodium falciparum
NQKHNEK

SEQ ID NO: 3240651 - protein, 6 aa, Plasmodium falciparum
NQKIDT

SEQ ID NO: 3240652 - protein, 8 aa, Plasmodium falciparum
NQKIEGNN

SEQ ID NO: 3240653 - protein, 5 aa, Plasmodium falciparum
NQKKA

SEQ ID NO: 3240654 - protein, 6 aa, Plasmodium falciparum
NQKKDV

SEQ ID NO: 3240655 - protein, 33 aa, Plasmodium falciparum
NQKKSNLGDQKKKNRNQDDRTEHQVDDNNDSDY

SEQ ID NO: 3240656 - protein, 7 aa, Plasmodium falciparum
NQKKTTI

SEQ ID NO: 3240657 - protein, 8 aa, Plasmodium falciparum
NQKNKKEI

SEQ ID NO: 3240658 - protein, 23 aa, Plasmodium falciparum
NQKNKYGEEHEKLKTNSNGDNNC

SEQ ID NO: 3240659 - protein, 12 aa, Plasmodium falciparum
NQKNNDTEQTNN

SEQ ID NO: 3240660 - protein, 46 aa, Plasmodium falciparum
NQKNQTNKSKNNKKDKRNISISNKRNQSISSNNNNNNNKEEEEECT

SEQ ID NO: 3240661 - protein, 9 aa, Plasmodium falciparum
NQKNSEGRS

SEQ ID NO: 3240662 - protein, 36 aa, Plasmodium falciparum
NQKQVKKKKSTSDEEEKKKKELKDKDDTKENVDDGD

SEQ ID NO: 3240663 - protein, 11 aa, Plasmodium falciparum
NQKRKEQIKKT

SEQ ID NO: 3240664 - protein, 12 aa, Plasmodium falciparum
NQKRLTNEVDAK

SEQ ID NO: 3240665 - protein, 7 aa, Plasmodium falciparum
NQKVESH

SEQ ID NO: 3240666 - protein, 18 aa, Plasmodium falciparum
NQKVETEQSTPAKPEPTE

SEQ ID NO: 3240667 - protein, 9 aa, Plasmodium falciparum
NQKYEDKNY

SEQ ID NO: 3240668 - protein, 10 aa, Plasmodium falciparum
NQLPNENTID

SEQ ID NO: 3240669 - protein, 12 aa, Plasmodium falciparum
NQMNGEKNKGGL

SEQ ID NO: 3240670 - protein, 4 aa, Plasmodium falciparum
NQND

SEQ ID NO: 3240671 - protein, 19 aa, Plasmodium falciparum
NQNDEESVKEQKYDNPEEI

SEQ ID NO: 3240672 - protein, 71 aa, Plasmodium falciparum
NQNDHNDHNNNIHNDDNNNIHNDDNNNIHNDDDNNIHNDNDNNNIHNDNDNNNIHNDDNNNIHNNNNKEQG

SEQ ID NO: 3240673 - protein, 16 aa, Plasmodium falciparum
NQNDISHNNNNNDDDD

SEQ ID NO: 3240674 - protein, 4 aa, Plasmodium falciparum
NQNE

SEQ ID NO: 3240675 - protein, 7 aa, Plasmodium falciparum
NQNEDEK

SEQ ID NO: 3240676 - protein, 5 aa, Plasmodium falciparum
NQNEI

SEQ ID NO: 3240677 - protein, 7 aa, Plasmodium falciparum
NQNEKEI

SEQ ID NO: 3240678 - protein, 33 aa, Plasmodium falciparum
NQNEKKKKNTKDNKKDNKNKYNNTHSASETNDE

SEQ ID NO: 3240679 - protein, 60 aa, Plasmodium falciparum
NQNEKNKSCDNQNEKNKSCDNQNEKNKSCDNKNEKNKSCDNKNEKNKSCDNKNEKNKICD

SEQ ID NO: 3240680 - protein, 11 aa, Plasmodium falciparum
NQNGYNNSDYN

SEQ ID NO: 3240681 - protein, 7 aa, Plasmodium falciparum
NQNIKSK

SEQ ID NO: 3240682 - protein, 18 aa, Plasmodium falciparum
NQNKNNSINIEGTQNNSH

SEQ ID NO: 3240683 - protein, 9 aa, Plasmodium falciparum
NQNKNSNIL

SEQ ID NO: 3240684 - protein, 5 aa, Plasmodium falciparum
NQNKS

SEQ ID NO: 3240685 - protein, 9 aa, Plasmodium falciparum
NQNMNERTY

SEQ ID NO: 3240686 - protein, 7 aa, Plasmodium falciparum
NQNMNNT

SEQ ID NO: 3240687 - protein, 5 aa, Plasmodium falciparum
NQNNA

SEQ ID NO: 3240688 - protein, 27 aa, Plasmodium falciparum
NQNNIGDNGSNNNGIYNNTNEQENDNY

SEQ ID NO: 3240689 - protein, 11 aa, Plasmodium falciparum
NQNNKKAMDEK

SEQ ID NO: 3240690 - protein, 10 aa, Plasmodium falciparum
NQNNKKNIPM

SEQ ID NO: 3240691 - protein, 5 aa, Plasmodium falciparum
NQNNL

SEQ ID NO: 3240692 - protein, 25 aa, Plasmodium falciparum
NQNNLRNDTTMNDEEKGKESNNNLE

SEQ ID NO: 3240693 - protein, 5 aa, Plasmodium falciparum
NQNNM

SEQ ID NO: 3240694 - protein, 6 aa, Plasmodium falciparum
NQNNNM

SEQ ID NO: 3240695 - protein, 7 aa, Plasmodium falciparum
NQNNNND

SEQ ID NO: 3240696 - protein, 16 aa, Plasmodium falciparum
NQNNNNNNNNKNENNI

SEQ ID NO: 3240697 - protein, 20 aa, Plasmodium falciparum
NQNNNNNNNNNMNEGGSETL

SEQ ID NO: 3240698 - protein, 45 aa, Plasmodium falciparum
NQNNSNNKNNKKKKTSKDNEELKSDNTKNNKTKDSDGNNNDKTKL

SEQ ID NO: 3240699 - protein, 11 aa, Plasmodium falciparum
NQNNTNNTHNN

SEQ ID NO: 3240700 - protein, 28 aa, Plasmodium falciparum
NQNNTNNYSNNCNNNNNNNNNPLSNNYN

SEQ ID NO: 3240701 - protein, 25 aa, Plasmodium falciparum
NQNNYGNEPGDSNKNYHKQNSQNMN

SEQ ID NO: 3240702 - protein, 18 aa, Plasmodium falciparum
NQNQHQNQHQNQHQNENQ

SEQ ID NO: 3240703 - protein, 10 aa, Plasmodium falciparum
NQNQKNKKKN

SEQ ID NO: 3240704 - protein, 5 aa, Plasmodium falciparum
NQNSF

SEQ ID NO: 3240705 - protein, 10 aa, Plasmodium falciparum
NQNTKQNNTY

SEQ ID NO: 3240706 - protein, 7 aa, Plasmodium falciparum
NQNTQSY

SEQ ID NO: 3240707 - protein, 6 aa, Plasmodium falciparum
NQNTSY

SEQ ID NO: 3240708 - protein, 11 aa, Plasmodium falciparum
NQNVEQKNKIK

SEQ ID NO: 3240709 - protein, 41 aa, Plasmodium falciparum
NQNVNDKNNNCDENNKTEEGESKHKSTTYIPKNSDNNNDKD

SEQ ID NO: 3240710 - protein, 11 aa, Plasmodium falciparum
NQNVNDNDNIE

SEQ ID NO: 3240711 - protein, 6 aa, Plasmodium falciparum
NQNYDR

SEQ ID NO: 3240712 - protein, 4 aa, Plasmodium falciparum
NQPA

SEQ ID NO: 3240713 - protein, 21 aa, Plasmodium falciparum
NQPKDVPNDYKSGDIPFNTQP

SEQ ID NO: 3240714 - protein, 21 aa, Plasmodium falciparum
NQPKDVPNDYSSGDIPFNTQP

SEQ ID NO: 3240715 - protein, 21 aa, Plasmodium falciparum
NQPNDVPNDYKSGDIPFNTQP

SEQ ID NO: 3240716 - protein, 15 aa, Plasmodium falciparum
NQPNEISEPKHNPKN

SEQ ID NO: 3240717 - protein, 19 aa, Plasmodium falciparum
NQPNNGNQANNNNIPNSSS

SEQ ID NO: 3240718 - protein, 8 aa, Plasmodium falciparum
NQPNTEPN

SEQ ID NO: 3240719 - protein, 7 aa, Plasmodium falciparum
NQPNTNN

SEQ ID NO: 3240720 - protein, 9 aa, Plasmodium falciparum
NQPYNDESS

SEQ ID NO: 3240721 - protein, 5 aa, Plasmodium falciparum
NQQCN

SEQ ID NO: 3240722 - protein, 47 aa, Plasmodium falciparum
NQQDQQNDAHIESSKNTQENLNYDDNTNMYEENKNDKKNKKLNNNTK

SEQ ID NO: 3240723 - protein, 7 aa, Plasmodium falciparum
NQQERLQ

SEQ ID NO: 3240724 - protein, 7 aa, Plasmodium falciparum
NQQHMND

SEQ ID NO: 3240725 - protein, 7 aa, Plasmodium falciparum
NQQKQST

SEQ ID NO: 3240726 - protein, 6 aa, Plasmodium falciparum
NQQKYQ

SEQ ID NO: 3240727 - protein, 5 aa, Plasmodium falciparum
NQQND

SEQ ID NO: 3240728 - protein, 13 aa, Plasmodium falciparum
NQQNDQKNNKFDE

SEQ ID NO: 3240729 - protein, 10 aa, Plasmodium falciparum
NQQNDQTYNT

SEQ ID NO: 3240730 - protein, 4 aa, Plasmodium falciparum
NQQP

SEQ ID NO: 3240731 - protein, 4 aa, Plasmodium falciparum
NQQQ

SEQ ID NO: 3240732 - protein, 9 aa, Plasmodium falciparum
NQQQINQQS

SEQ ID NO: 3240733 - protein, 6 aa, Plasmodium falciparum
NQRKSE

SEQ ID NO: 3240734 - protein, 16 aa, Plasmodium falciparum
NQRQSTHVDEQKDTSC

SEQ ID NO: 3240735 - protein, 6 aa, Plasmodium falciparum
NQSAQS

SEQ ID NO: 3240736 - protein, 14 aa, Plasmodium falciparum
NQSATSKKTKKQSV

SEQ ID NO: 3240737 - protein, 5 aa, Plasmodium falciparum
NQSDI

SEQ ID NO: 3240738 - protein, 6 aa, Plasmodium falciparum
NQSDKD

SEQ ID NO: 3240739 - protein, 27 aa, Plasmodium falciparum
NQSEKYNTYNNNNNNNNNNNNNNNNIG

SEQ ID NO: 3240740 - protein, 6 aa, Plasmodium falciparum
NQSEQN

SEQ ID NO: 3240741 - protein, 8 aa, Plasmodium falciparum
NQSFNTNN

SEQ ID NO: 3240742 - protein, 4 aa, Plasmodium falciparum
NQSN

SEQ ID NO: 3240743 - protein, 11 aa, Plasmodium falciparum
NQSNSKCQGVS

SEQ ID NO: 3240744 - protein, 8 aa, Plasmodium falciparum
NQSNTNNF

SEQ ID NO: 3240745 - protein, 8 aa, Plasmodium falciparum
NQSRDIQN

SEQ ID NO: 3240746 - protein, 16 aa, Plasmodium falciparum
NQSRNQINKNMEDSYK

SEQ ID NO: 3240747 - protein, 7 aa, Plasmodium falciparum
NQSRNRR

SEQ ID NO: 3240748 - protein, 13 aa, Plasmodium falciparum
NQSSFEDKSNVEK

SEQ ID NO: 3240749 - protein, 13 aa, Plasmodium falciparum
NQSVHDDNATVDD

SEQ ID NO: 3240750 - protein, 7 aa, Plasmodium falciparum
NQTAEPV

SEQ ID NO: 3240751 - protein, 6 aa, Plasmodium falciparum
NQTDRT

SEQ ID NO: 3240752 - protein, 10 aa, Plasmodium falciparum
NQTEEETVDR

SEQ ID NO: 3240753 - protein, 4 aa, Plasmodium falciparum
NQTI

SEQ ID NO: 3240754 - protein, 14 aa, Plasmodium falciparum
NQTKKKQKKHKRKD

SEQ ID NO: 3240755 - protein, 4 aa, Plasmodium falciparum
NQTN

SEQ ID NO: 3240756 - protein, 8 aa, Plasmodium falciparum
NQTNNINK

SEQ ID NO: 3240757 - protein, 6 aa, Plasmodium falciparum
NQTSAN

SEQ ID NO: 3240758 - protein, 15 aa, Plasmodium falciparum
NQTSYSDDINNTTKL

SEQ ID NO: 3240759 - protein, 11 aa, Plasmodium falciparum
NQTYSSDPTNR

SEQ ID NO: 3240760 - protein, 13 aa, Plasmodium falciparum
NQTYSSYERTSGE

SEQ ID NO: 3240761 - protein, 12 aa, Plasmodium falciparum
NQVDENQNNHQY

SEQ ID NO: 3240762 - protein, 5 aa, Plasmodium falciparum
NQYEP

SEQ ID NO: 3240763 - protein, 7 aa, Plasmodium falciparum
NQYEPSS

SEQ ID NO: 3240764 - protein, 6 aa, Plasmodium falciparum
NQYGNN

SEQ ID NO: 3240765 - protein, 15 aa, Plasmodium falciparum
NQYGSNNKSSNLTNQ

SEQ ID NO: 3240766 - protein, 4 aa, Plasmodium falciparum
NQYK

SEQ ID NO: 3240767 - protein, 4 aa, Plasmodium falciparum
NQYM

SEQ ID NO: 3240768 - protein, 63 aa, Plasmodium falciparum
NQYNDDDYTNKCNQYNDDDYTNKCNQYNDDDYTNKCNQYNDNDYTNKCNQYNDNDYTNKCNQY

SEQ ID NO: 3240769 - protein, 10 aa, Plasmodium falciparum
NQYNRNENSR

SEQ ID NO: 3240770 - protein, 5 aa, Plasmodium falciparum
NQYSP

SEQ ID NO: 3240771 - protein, 6 aa, Plasmodium falciparum
NQYSPS

SEQ ID NO: 3240772 - protein, 5 aa, Plasmodium falciparum
NQYTQ

SEQ ID NO: 3240773 - protein, 8 aa, Plasmodium falciparum
NQYTQEED

SEQ ID NO: 3240774 - protein, 9 aa, Plasmodium falciparum
NRAEGGKYM

SEQ ID NO: 3240775 - protein, 8 aa, Plasmodium falciparum
NRDENKIN

SEQ ID NO: 3240776 - protein, 7 aa, Plasmodium falciparum
NRDKGNI

SEQ ID NO: 3240777 - protein, 9 aa, Plasmodium falciparum
NRDKKKRET

SEQ ID NO: 3240778 - protein, 7 aa, Plasmodium falciparum
NRDKPKY

SEQ ID NO: 3240779 - protein, 8 aa, Plasmodium falciparum
NRDKYGEN

SEQ ID NO: 3240780 - protein, 104 aa, Plasmodium falciparum
NRDNNNDNDNNNNNNNNNNNNNNDDDNNNHNNNNNHNNNNNNNHNNNNNNHNNNNNNNNNNNHNNNNHNNNNNNNNNNNHNNNNNNNNNNNEDGNGENDDNNKT

SEQ ID NO: 3240781 - protein, 19 aa, Plasmodium falciparum
NRDNNSNIKNHTSNNINSD

SEQ ID NO: 3240782 - protein, 10 aa, Plasmodium falciparum
NRDNSLDNDD

SEQ ID NO: 3240783 - protein, 6 aa, Plasmodium falciparum
NRDNYD

SEQ ID NO: 3240784 - protein, 5 aa, Plasmodium falciparum
NRDPS

SEQ ID NO: 3240785 - protein, 6 aa, Plasmodium falciparum
NRDQNK

SEQ ID NO: 3240786 - protein, 6 aa, Plasmodium falciparum
NRDRKK

SEQ ID NO: 3240787 - protein, 4 aa, Plasmodium falciparum
NRDV

SEQ ID NO: 3240788 - protein, 9 aa, Plasmodium falciparum
NREDSKYKD

SEQ ID NO: 3240789 - protein, 5 aa, Plasmodium falciparum
NREEP

SEQ ID NO: 3240790 - protein, 6 aa, Plasmodium falciparum
NREEYM

SEQ ID NO: 3240791 - protein, 20 aa, Plasmodium falciparum
NREGCCNKEESGHENNSKGI

SEQ ID NO: 3240792 - protein, 11 aa, Plasmodium falciparum
NRENRNNGNSY

SEQ ID NO: 3240793 - protein, 9 aa, Plasmodium falciparum
NRENSDDYH

SEQ ID NO: 3240794 - protein, 57 aa, Plasmodium falciparum
NRESDDGELYDENSDLSTVNDESEDAEAKMKGNDTSEMSHNSSQHIESDQQKNDMKT

SEQ ID NO: 3240795 - protein, 7 aa, Plasmodium falciparum
NRESNNI

SEQ ID NO: 3240796 - protein, 12 aa, Plasmodium falciparum
NREYDGEEQTLK

SEQ ID NO: 3240797 - protein, 5 aa, Plasmodium falciparum
NREYG

SEQ ID NO: 3240798 - protein, 6 aa, Plasmodium falciparum
NRFGEN

SEQ ID NO: 3240799 - protein, 11 aa, Plasmodium falciparum
NRFSDKGDAIC

SEQ ID NO: 3240800 - protein, 8 aa, Plasmodium falciparum
NRGPPAAC

SEQ ID NO: 3240801 - protein, 5 aa, Plasmodium falciparum
NRGSR

SEQ ID NO: 3240802 - protein, 6 aa, Plasmodium falciparum
NRGTYS

SEQ ID NO: 3240803 - protein, 5 aa, Plasmodium falciparum
NRHPC

SEQ ID NO: 3240804 - protein, 7 aa, Plasmodium falciparum
NRHSKED

SEQ ID NO: 3240805 - protein, 6 aa, Plasmodium falciparum
NRHSST

SEQ ID NO: 3240806 - protein, 5 aa, Plasmodium falciparum
NRIGG

SEQ ID NO: 3240807 - protein, 5 aa, Plasmodium falciparum
NRIGT

SEQ ID NO: 3240808 - protein, 6 aa, Plasmodium falciparum
NRIKNK

SEQ ID NO: 3240809 - protein, 11 aa, Plasmodium falciparum
NRINDYNGNIN

SEQ ID NO: 3240810 - protein, 95 aa, Plasmodium falciparum
NRINGNRNNCNRCDDNNADNNDDNNNDDNNDDDNNNDNNNNDDNNNDDNNNDDNNNDDNNNDDDNNNNNHNSNNNNNHNSNNNNNHNSNNNNNHI

SEQ ID NO: 3240811 - protein, 6 aa, Plasmodium falciparum
NRINNT

SEQ ID NO: 3240812 - protein, 13 aa, Plasmodium falciparum
NRIQGNNKNSHYK

SEQ ID NO: 3240813 - protein, 36 aa, Plasmodium falciparum
NRKDYSPNGEMEDGHEEHKTEEAKEDMEDSKCREVT

SEQ ID NO: 3240814 - protein, 13 aa, Plasmodium falciparum
NRKEDNNTEEKIK

SEQ ID NO: 3240815 - protein, 46 aa, Plasmodium falciparum
NRKEEHNNKNKDNNCADKREYTKEDNHKDQNQDSTINNNNNNNCSS

SEQ ID NO: 3240816 - protein, 6 aa, Plasmodium falciparum
NRKEEY

SEQ ID NO: 3240817 - protein, 17 aa, Plasmodium falciparum
NRKEMKGKTNDNKKEDI

SEQ ID NO: 3240818 - protein, 7 aa, Plasmodium falciparum
NRKENFD

SEQ ID NO: 3240819 - protein, 10 aa, Plasmodium falciparum
NRKENSDSTF

SEQ ID NO: 3240820 - protein, 6 aa, Plasmodium falciparum
NRKGDG

SEQ ID NO: 3240821 - protein, 5 aa, Plasmodium falciparum
NRKGI

SEQ ID NO: 3240822 - protein, 8 aa, Plasmodium falciparum
NRKKEINE

SEQ ID NO: 3240823 - protein, 8 aa, Plasmodium falciparum
NRKKEKED

SEQ ID NO: 3240824 - protein, 6 aa, Plasmodium falciparum
NRKKET

SEQ ID NO: 3240825 - protein, 5 aa, Plasmodium falciparum
NRKKH

SEQ ID NO: 3240826 - protein, 11 aa, Plasmodium falciparum
NRKKKSNNYDN

SEQ ID NO: 3240827 - protein, 6 aa, Plasmodium falciparum
NRKKNY

SEQ ID NO: 3240828 - protein, 15 aa, Plasmodium falciparum
NRKNDIDYKDDIDEN

SEQ ID NO: 3240829 - protein, 8 aa, Plasmodium falciparum
NRKNDQSI

SEQ ID NO: 3240830 - protein, 6 aa, Plasmodium falciparum
NRKNEL

SEQ ID NO: 3240831 - protein, 8 aa, Plasmodium falciparum
NRKNKKNL

SEQ ID NO: 3240832 - protein, 14 aa, Plasmodium falciparum
NRKNKTNENNYSTY

SEQ ID NO: 3240833 - protein, 5 aa, Plasmodium falciparum
NRKNN

SEQ ID NO: 3240834 - protein, 9 aa, Plasmodium falciparum
NRKNNMSSK

SEQ ID NO: 3240835 - protein, 7 aa, Plasmodium falciparum
NRKNNNH

SEQ ID NO: 3240836 - protein, 14 aa, Plasmodium falciparum
NRKNNYDKKEDITS

SEQ ID NO: 3240837 - protein, 9 aa, Plasmodium falciparum
NRKNSNISP

SEQ ID NO: 3240838 - protein, 10 aa, Plasmodium falciparum
NRKNYEGEKD

SEQ ID NO: 3240839 - protein, 8 aa, Plasmodium falciparum
NRKPNIKE

SEQ ID NO: 3240840 - protein, 5 aa, Plasmodium falciparum
NRKRK

SEQ ID NO: 3240841 - protein, 7 aa, Plasmodium falciparum
NRKRKNP

SEQ ID NO: 3240842 - protein, 7 aa, Plasmodium falciparum
NRKSKDE

SEQ ID NO: 3240843 - protein, 11 aa, Plasmodium falciparum
NRKSKKGNTLE

SEQ ID NO: 3240844 - protein, 5 aa, Plasmodium falciparum
NRKSS

SEQ ID NO: 3240845 - protein, 6 aa, Plasmodium falciparum
NRKTTI

SEQ ID NO: 3240846 - protein, 11 aa, Plasmodium falciparum
NRLEQQNREPG

SEQ ID NO: 3240847 - protein, 6 aa, Plasmodium falciparum
NRLKKE

SEQ ID NO: 3240848 - protein, 5 aa, Plasmodium falciparum
NRMER

SEQ ID NO: 3240849 - protein, 5 aa, Plasmodium falciparum
NRNAY

SEQ ID NO: 3240850 - protein, 4 aa, Plasmodium falciparum
NRND

SEQ ID NO: 3240851 - protein, 5 aa, Plasmodium falciparum
NRNDM

SEQ ID NO: 3240852 - protein, 9 aa, Plasmodium falciparum
NRNDSTTKE

SEQ ID NO: 3240853 - protein, 15 aa, Plasmodium falciparum
NRNDTEQNNATNNGN

SEQ ID NO: 3240854 - protein, 4 aa, Plasmodium falciparum
NRNE

SEQ ID NO: 3240855 - protein, 13 aa, Plasmodium falciparum
NRNEYNKERLSKS

SEQ ID NO: 3240856 - protein, 24 aa, Plasmodium falciparum
NRNHNPSDKECNETLAQTPDETFD

SEQ ID NO: 3240857 - protein, 7 aa, Plasmodium falciparum
NRNHPNG

SEQ ID NO: 3240858 - protein, 13 aa, Plasmodium falciparum
NRNHQKNDDYPLS

SEQ ID NO: 3240859 - protein, 11 aa, Plasmodium falciparum
NRNINEKEEIK

SEQ ID NO: 3240860 - protein, 17 aa, Plasmodium falciparum
NRNKEKYENNDTNENNS

SEQ ID NO: 3240861 - protein, 5 aa, Plasmodium falciparum
NRNKF

SEQ ID NO: 3240862 - protein, 15 aa, Plasmodium falciparum
NRNKIQEKDLEKKQT

SEQ ID NO: 3240863 - protein, 5 aa, Plasmodium falciparum
NRNKK

SEQ ID NO: 3240864 - protein, 9 aa, Plasmodium falciparum
NRNKKNQLK

SEQ ID NO: 3240865 - protein, 18 aa, Plasmodium falciparum
NRNKSKEINETTNDGDKD

SEQ ID NO: 3240866 - protein, 8 aa, Plasmodium falciparum
NRNKSYNS

SEQ ID NO: 3240867 - protein, 4 aa, Plasmodium falciparum
NRNL

SEQ ID NO: 3240868 - protein, 5 aa, Plasmodium falciparum
NRNLM

SEQ ID NO: 3240869 - protein, 7 aa, Plasmodium falciparum
NRNMPNR

SEQ ID NO: 3240870 - protein, 15 aa, Plasmodium falciparum
NRNNCEEKKKTDDFE

SEQ ID NO: 3240871 - protein, 42 aa, Plasmodium falciparum
NRNNEIQNVEGDKENSPYKKVGDDNHDEKNEEGFGNDYNNDE

SEQ ID NO: 3240872 - protein, 8 aa, Plasmodium falciparum
NRNNEKSI

SEQ ID NO: 3240873 - protein, 15 aa, Plasmodium falciparum
NRNNNIRDHTRKGKY

SEQ ID NO: 3240874 - protein, 8 aa, Plasmodium falciparum
NRNNPNSS

SEQ ID NO: 3240875 - protein, 17 aa, Plasmodium falciparum
NRNNQIDNMDKESNSNL

SEQ ID NO: 3240876 - protein, 8 aa, Plasmodium falciparum
NRNNQTIN

SEQ ID NO: 3240877 - protein, 5 aa, Plasmodium falciparum
NRNNS

SEQ ID NO: 3240878 - protein, 7 aa, Plasmodium falciparum
NRNQQDV

SEQ ID NO: 3240879 - protein, 14 aa, Plasmodium falciparum
NRNQRKGDDDMKSS

SEQ ID NO: 3240880 - protein, 5 aa, Plasmodium falciparum
NRNRN

SEQ ID NO: 3240881 - protein, 4 aa, Plasmodium falciparum
NRNS

SEQ ID NO: 3240882 - protein, 12 aa, Plasmodium falciparum
NRNSEYIKKFNE

SEQ ID NO: 3240883 - protein, 79 aa, Plasmodium falciparum
NRNSYNDDISNKSVDSITKKEEEKKYGYYKDEEKKKYGYYKDEENHNSDHDYHDNDENEELNNKNNYLSSSREHKENDK

SEQ ID NO: 3240884 - protein, 8 aa, Plasmodium falciparum
NRNVDGSK

SEQ ID NO: 3240885 - protein, 6 aa, Plasmodium falciparum
NRNVNN

SEQ ID NO: 3240886 - protein, 13 aa, Plasmodium falciparum
NRNVSDKIESENT

SEQ ID NO: 3240887 - protein, 17 aa, Plasmodium falciparum
NRNYENDNSLNNKSGSI

SEQ ID NO: 3240888 - protein, 7 aa, Plasmodium falciparum
NRPAGDG

SEQ ID NO: 3240889 - protein, 5 aa, Plasmodium falciparum
NRPDI

SEQ ID NO: 3240890 - protein, 10 aa, Plasmodium falciparum
NRPKDNSQNM

SEQ ID NO: 3240891 - protein, 4 aa, Plasmodium falciparum
NRPL

SEQ ID NO: 3240892 - protein, 5 aa, Plasmodium falciparum
NRPLK

SEQ ID NO: 3240893 - protein, 13 aa, Plasmodium falciparum
NRPLSKDNNTEKG

SEQ ID NO: 3240894 - protein, 4 aa, Plasmodium falciparum
NRPP

SEQ ID NO: 3240895 - protein, 4 aa, Plasmodium falciparum
NRQK

SEQ ID NO: 3240896 - protein, 12 aa, Plasmodium falciparum
NRQKRKEERDKN

SEQ ID NO: 3240897 - protein, 9 aa, Plasmodium falciparum
NRQKSQPIK

SEQ ID NO: 3240898 - protein, 6 aa, Plasmodium falciparum
NRQPNQ

SEQ ID NO: 3240899 - protein, 5 aa, Plasmodium falciparum
NRQSK

SEQ ID NO: 3240900 - protein, 7 aa, Plasmodium falciparum
NRQSTIT

SEQ ID NO: 3240901 - protein, 7 aa, Plasmodium falciparum
NRRGGGN

SEQ ID NO: 3240902 - protein, 4 aa, Plasmodium falciparum
NRRK

SEQ ID NO: 3240903 - protein, 4 aa, Plasmodium falciparum
NRRM

SEQ ID NO: 3240904 - protein, 5 aa, Plasmodium falciparum
NRRNG

SEQ ID NO: 3240905 - protein, 6 aa, Plasmodium falciparum
NRRNKN

SEQ ID NO: 3240906 - protein, 6 aa, Plasmodium falciparum
NRRNNS

SEQ ID NO: 3240907 - protein, 34 aa, Plasmodium falciparum
NRRNSHNISSNNINNTNTLQENTETNNTSNVNNL

SEQ ID NO: 3240908 - protein, 16 aa, Plasmodium falciparum
NRRNTYKGDLDGRKQY

SEQ ID NO: 3240909 - protein, 7 aa, Plasmodium falciparum
NRRSDEN

SEQ ID NO: 3240910 - protein, 10 aa, Plasmodium falciparum
NRRSNVSNSH

SEQ ID NO: 3240911 - protein, 8 aa, Plasmodium falciparum
NRSENYNN

SEQ ID NO: 3240912 - protein, 8 aa, Plasmodium falciparum
NRSEYPDT

SEQ ID NO: 3240913 - protein, 77 aa, Plasmodium falciparum
NRSGQINNNENEKNKKVLNDTNVEEKNSTNNNNNNNNNNNNNNNNNNNNNNNNNNNNNNNNNNNNNIIGGTNSSDSL

SEQ ID NO: 3240914 - protein, 6 aa, Plasmodium falciparum
NRSHSE

SEQ ID NO: 3240915 - protein, 8 aa, Plasmodium falciparum
NRSKEKYD

SEQ ID NO: 3240916 - protein, 8 aa, Plasmodium falciparum
NRSKGEEN

SEQ ID NO: 3240917 - protein, 15 aa, Plasmodium falciparum
NRSKQSNNTDNISSD

SEQ ID NO: 3240918 - protein, 7 aa, Plasmodium falciparum
NRSNDFH

SEQ ID NO: 3240919 - protein, 9 aa, Plasmodium falciparum
NRSNDNNYM

SEQ ID NO: 3240920 - protein, 9 aa, Plasmodium falciparum
NRSNENKEN

SEQ ID NO: 3240921 - protein, 10 aa, Plasmodium falciparum
NRSNRPNEMD

SEQ ID NO: 3240922 - protein, 5 aa, Plasmodium falciparum
NRSNV

SEQ ID NO: 3240923 - protein, 13 aa, Plasmodium falciparum
NRSNYNNNNNNNY

SEQ ID NO: 3240924 - protein, 5 aa, Plasmodium falciparum
NRSPE

SEQ ID NO: 3240925 - protein, 5 aa, Plasmodium falciparum
NRSSN

SEQ ID NO: 3240926 - protein, 10 aa, Plasmodium falciparum
NRSSTEKKKN

SEQ ID NO: 3240927 - protein, 4 aa, Plasmodium falciparum
NRST

SEQ ID NO: 3240928 - protein, 5 aa, Plasmodium falciparum
NRSTA

SEQ ID NO: 3240929 - protein, 9 aa, Plasmodium falciparum
NRSTTPPLY

SEQ ID NO: 3240930 - protein, 15 aa, Plasmodium falciparum
NRSYNKNYSNDNNYN

SEQ ID NO: 3240931 - protein, 71 aa, Plasmodium falciparum
NRTDNSKMNKVKNNNQTENNDNKKKLGNKEDNQGKNKNNNNKEKQNDINKRGTQNTETKKSNKKLSQDYND

SEQ ID NO: 3240932 - protein, 8 aa, Plasmodium falciparum
NRTDTDKE

SEQ ID NO: 3240933 - protein, 12 aa, Plasmodium falciparum
NRTERTDVQDET

SEQ ID NO: 3240934 - protein, 15 aa, Plasmodium falciparum
NRTESNDNLKNIPQE

SEQ ID NO: 3240935 - protein, 4 aa, Plasmodium falciparum
NRTH

SEQ ID NO: 3240936 - protein, 10 aa, Plasmodium falciparum
NRTKEEKKKK

SEQ ID NO: 3240937 - protein, 9 aa, Plasmodium falciparum
NRTKNNSIQ

SEQ ID NO: 3240938 - protein, 8 aa, Plasmodium falciparum
NRTKQSIK

SEQ ID NO: 3240939 - protein, 26 aa, Plasmodium falciparum
NRTNQNNNITSRNISPSKNYADNIEL

SEQ ID NO: 3240940 - protein, 37 aa, Plasmodium falciparum
NRTSHTHDNNRIETTAENNIGGLSNSNVHDGRDSQRN

SEQ ID NO: 3240941 - protein, 6 aa, Plasmodium falciparum
NRTVTD

SEQ ID NO: 3240942 - protein, 28 aa, Plasmodium falciparum
NRVTSKKANRKKKKKKKKKNGHLSNSNN

SEQ ID NO: 3240943 - protein, 18 aa, Plasmodium falciparum
NRYDDKDNEVDDNNFDPN

SEQ ID NO: 3240944 - protein, 4 aa, Plasmodium falciparum
NRYE

SEQ ID NO: 3240945 - protein, 7 aa, Plasmodium falciparum
NRYEENE

SEQ ID NO: 3240946 - protein, 5 aa, Plasmodium falciparum
NRYGS

SEQ ID NO: 3240947 - protein, 4 aa, Plasmodium falciparum
NRYK

SEQ ID NO: 3240948 - protein, 5 aa, Plasmodium falciparum
NRYKK

SEQ ID NO: 3240949 - protein, 10 aa, Plasmodium falciparum
NRYKNIKPKE

SEQ ID NO: 3240950 - protein, 57 aa, Plasmodium falciparum
NRYKRNKERKRTSENTTNNKNISNRNDRMGNKNISHRNDRMGNENISHRNDRMGNEK

SEQ ID NO: 3240951 - protein, 8 aa, Plasmodium falciparum
NRYNSDDT

SEQ ID NO: 3240952 - protein, 4 aa, Plasmodium falciparum
NRYR

SEQ ID NO: 3240953 - protein, 5 aa, Plasmodium falciparum
NRYVP

SEQ ID NO: 3240954 - protein, 5 aa, Plasmodium falciparum
NSAAE

SEQ ID NO: 3240955 - protein, 18 aa, Plasmodium falciparum
NSADEKNNYMSNETKYNS

SEQ ID NO: 3240956 - protein, 17 aa, Plasmodium falciparum
NSADNKHNNLDKEREKE

SEQ ID NO: 3240957 - protein, 6 aa, Plasmodium falciparum
NSAKQN

SEQ ID NO: 3240958 - protein, 8 aa, Plasmodium falciparum
NSAKSKTE

SEQ ID NO: 3240959 - protein, 7 aa, Plasmodium falciparum
NSAKSRR

SEQ ID NO: 3240960 - protein, 38 aa, Plasmodium falciparum
NSALNANNRNRQNVSNNDGANTTATNNRSVSDRNAQNM

SEQ ID NO: 3240961 - protein, 9 aa, Plasmodium falciparum
NSANRSFED

SEQ ID NO: 3240962 - protein, 9 aa, Plasmodium falciparum
NSANRTNLQ

SEQ ID NO: 3240963 - protein, 7 aa, Plasmodium falciparum
NSANTVN

SEQ ID NO: 3240964 - protein, 4 aa, Plasmodium falciparum
NSAP

SEQ ID NO: 3240965 - protein, 7 aa, Plasmodium falciparum
NSASINS

SEQ ID NO: 3240966 - protein, 8 aa, Plasmodium falciparum
NSASNECK

SEQ ID NO: 3240967 - protein, 8 aa, Plasmodium falciparum
NSASQSGI

SEQ ID NO: 3240968 - protein, 62 aa, Plasmodium falciparum
NSCDNNNKNSCDNNNKNNCDNNNKNNCDNNNKNNCDNNNKNNCDNNNKNNCDNNNTNNCDNN

SEQ ID NO: 3240969 - protein, 5 aa, Plasmodium falciparum
NSCET

SEQ ID NO: 3240970 - protein, 8 aa, Plasmodium falciparum
NSCGNRDA

SEQ ID NO: 3240971 - protein, 4 aa, Plasmodium falciparum
NSCK

SEQ ID NO: 3240972 - protein, 5 aa, Plasmodium falciparum
NSCLE

SEQ ID NO: 3240973 - protein, 5 aa, Plasmodium falciparum
NSCNN

SEQ ID NO: 3240974 - protein, 9 aa, Plasmodium falciparum
NSCRSSNSS

SEQ ID NO: 3240975 - protein, 8 aa, Plasmodium falciparum
NSCTTNAG

SEQ ID NO: 3240976 - protein, 4 aa, Plasmodium falciparum
NSDD

SEQ ID NO: 3240977 - protein, 5 aa, Plasmodium falciparum
NSDDD

SEQ ID NO: 3240978 - protein, 9 aa, Plasmodium falciparum
NSDDKRKED

SEQ ID NO: 3240979 - protein, 42 aa, Plasmodium falciparum
NSDDSINNHSDDSINNHSDDSINNHSDDSINNHSDDSINNLS

SEQ ID NO: 3240980 - protein, 16 aa, Plasmodium falciparum
NSDDSKKKMKSKIRRR

SEQ ID NO: 3240981 - protein, 10 aa, Plasmodium falciparum
NSDEDTSDYE

SEQ ID NO: 3240982 - protein, 17 aa, Plasmodium falciparum
NSDEKKKKYNDVSPTNN

SEQ ID NO: 3240983 - protein, 12 aa, Plasmodium falciparum
NSDGSKCENKCN

SEQ ID NO: 3240984 - protein, 6 aa, Plasmodium falciparum
NSDHIS

SEQ ID NO: 3240985 - protein, 5 aa, Plasmodium falciparum
NSDIK

SEQ ID NO: 3240986 - protein, 4 aa, Plasmodium falciparum
NSDK

SEQ ID NO: 3240987 - protein, 6 aa, Plasmodium falciparum
NSDKLS

SEQ ID NO: 3240988 - protein, 14 aa, Plasmodium falciparum
NSDKNSKTETSATK

SEQ ID NO: 3240989 - protein, 9 aa, Plasmodium falciparum
NSDKPNNIS

SEQ ID NO: 3240990 - protein, 12 aa, Plasmodium falciparum
NSDKQNIEEQKK

SEQ ID NO: 3240991 - protein, 16 aa, Plasmodium falciparum
NSDKSEDSQKQSNENI

SEQ ID NO: 3240992 - protein, 6 aa, Plasmodium falciparum
NSDKTS

SEQ ID NO: 3240993 - protein, 6 aa, Plasmodium falciparum
NSDNHI

SEQ ID NO: 3240994 - protein, 7 aa, Plasmodium falciparum
NSDNNAK

SEQ ID NO: 3240995 - protein, 18 aa, Plasmodium falciparum
NSDNNKVGAQKDVEQNNR

SEQ ID NO: 3240996 - protein, 7 aa, Plasmodium falciparum
NSDNSTM

SEQ ID NO: 3240997 - protein, 9 aa, Plasmodium falciparum
NSDNTTYEK

SEQ ID NO: 3240998 - protein, 7 aa, Plasmodium falciparum
NSDPLNE

SEQ ID NO: 3240999 - protein, 4 aa, Plasmodium falciparum
NSDQ

SEQ ID NO: 3241000 - protein, 6 aa, Plasmodium falciparum
NSDRSY

SEQ ID NO: 3241001 - protein, 74 aa, Plasmodium falciparum
NSDSDDDNNDNNKEEAEKKNNKMNNNNNNNNNNNKNKDYDDDDDDDNSLLSDDEDKPSELSNPDNNYNNDEKKL

SEQ ID NO: 3241002 - protein, 7 aa, Plasmodium falciparum
NSDSFEK

SEQ ID NO: 3241003 - protein, 6 aa, Plasmodium falciparum
NSDSTD

SEQ ID NO: 3241004 - protein, 83 aa, Plasmodium falciparum
NSDTENNNKSDGSNKSDGSNKSDGSNKSDGSNKSDGSNKSDGSNKSDGRNKSDDNNKSDGSNKSNKNYNRSNKCNSSCNKNNR

SEQ ID NO: 3241005 - protein, 7 aa, Plasmodium falciparum
NSDTETL

SEQ ID NO: 3241006 - protein, 8 aa, Plasmodium falciparum
NSDTFKKK

SEQ ID NO: 3241007 - protein, 16 aa, Plasmodium falciparum
NSDTISEVDETNYHEK

SEQ ID NO: 3241008 - protein, 11 aa, Plasmodium falciparum
NSDTKNNSYND

SEQ ID NO: 3241009 - protein, 19 aa, Plasmodium falciparum
NSDVNGAVSKRKSKGKDDI

SEQ ID NO: 3241010 - protein, 8 aa, Plasmodium falciparum
NSDYPDYT

SEQ ID NO: 3241011 - protein, 14 aa, Plasmodium falciparum
NSEDDNKVGPSKEL

SEQ ID NO: 3241012 - protein, 9 aa, Plasmodium falciparum
NSEDETEMD

SEQ ID NO: 3241013 - protein, 9 aa, Plasmodium falciparum
NSEDSITCE

SEQ ID NO: 3241014 - protein, 8 aa, Plasmodium falciparum
NSEDTHLD

SEQ ID NO: 3241015 - protein, 5 aa, Plasmodium falciparum
NSEEF

SEQ ID NO: 3241016 - protein, 6 aa, Plasmodium falciparum
NSEEFK

SEQ ID NO: 3241017 - protein, 11 aa, Plasmodium falciparum
NSEEKNKVNSN

SEQ ID NO: 3241018 - protein, 6 aa, Plasmodium falciparum
NSEEMD

SEQ ID NO: 3241019 - protein, 5 aa, Plasmodium falciparum
NSEEN

SEQ ID NO: 3241020 - protein, 9 aa, Plasmodium falciparum
NSEESIKRS

SEQ ID NO: 3241021 - protein, 9 aa, Plasmodium falciparum
NSEEYSNDS

SEQ ID NO: 3241022 - protein, 4 aa, Plasmodium falciparum
NSEF

SEQ ID NO: 3241023 - protein, 8 aa, Plasmodium falciparum
NSEFNSSP

SEQ ID NO: 3241024 - protein, 7 aa, Plasmodium falciparum
NSEFSNN

SEQ ID NO: 3241025 - protein, 5 aa, Plasmodium falciparum
NSEGY

SEQ ID NO: 3241026 - protein, 6 aa, Plasmodium falciparum
NSEGYE

SEQ ID NO: 3241027 - protein, 7 aa, Plasmodium falciparum
NSEHNTK

SEQ ID NO: 3241028 - protein, 5 aa, Plasmodium falciparum
NSEIN

SEQ ID NO: 3241029 - protein, 5 aa, Plasmodium falciparum
NSEKF

SEQ ID NO: 3241030 - protein, 12 aa, Plasmodium falciparum
NSEKKNTKSSLY

SEQ ID NO: 3241031 - protein, 17 aa, Plasmodium falciparum
NSEKPTSGGHNSEQQRE

SEQ ID NO: 3241032 - protein, 7 aa, Plasmodium falciparum
NSEKSDV

SEQ ID NO: 3241033 - protein, 7 aa, Plasmodium falciparum
NSEKSFK

SEQ ID NO: 3241034 - protein, 4 aa, Plasmodium falciparum
NSEL

SEQ ID NO: 3241035 - protein, 5 aa, Plasmodium falciparum
NSELD

SEQ ID NO: 3241036 - protein, 13 aa, Plasmodium falciparum
NSELEDKLTEEEL

SEQ ID NO: 3241037 - protein, 6 aa, Plasmodium falciparum
NSELNS

SEQ ID NO: 3241038 - protein, 4 aa, Plasmodium falciparum
NSEN

SEQ ID NO: 3241039 - protein, 6 aa, Plasmodium falciparum
NSENEI

SEQ ID NO: 3241040 - protein, 5 aa, Plasmodium falciparum
NSENF

SEQ ID NO: 3241041 - protein, 10 aa, Plasmodium falciparum
NSENKKSSNH

SEQ ID NO: 3241042 - protein, 7 aa, Plasmodium falciparum
NSENLTN

SEQ ID NO: 3241043 - protein, 11 aa, Plasmodium falciparum
NSENNNIPGKQ

SEQ ID NO: 3241044 - protein, 19 aa, Plasmodium falciparum
NSENNTLKNNNNNNDNYNE

SEQ ID NO: 3241045 - protein, 21 aa, Plasmodium falciparum
NSENSTFNNGLNNSGRTGLNN

SEQ ID NO: 3241046 - protein, 15 aa, Plasmodium falciparum
NSENTIDDLSEEENY

SEQ ID NO: 3241047 - protein, 5 aa, Plasmodium falciparum
NSENY

SEQ ID NO: 3241048 - protein, 26 aa, Plasmodium falciparum
NSERATGSSMTDKKNNNNNNNNNNNG

SEQ ID NO: 3241049 - protein, 26 aa, Plasmodium falciparum
NSESDNSNDTSTNNNMSSKKKNTQDV

SEQ ID NO: 3241050 - protein, 14 aa, Plasmodium falciparum
NSESKKKKKYLNNN

SEQ ID NO: 3241051 - protein, 23 aa, Plasmodium falciparum
NSESNKNYTHNNNDEYKQNKNHK

SEQ ID NO: 3241052 - protein, 6 aa, Plasmodium falciparum
NSESSN

SEQ ID NO: 3241053 - protein, 12 aa, Plasmodium falciparum
NSETKIDDKIGK

SEQ ID NO: 3241054 - protein, 8 aa, Plasmodium falciparum
NSEVSSSR

SEQ ID NO: 3241055 - protein, 4 aa, Plasmodium falciparum
NSEY

SEQ ID NO: 3241056 - protein, 6 aa, Plasmodium falciparum
NSEYTN

SEQ ID NO: 3241057 - protein, 12 aa, Plasmodium falciparum
NSFEEEKKNFEK

SEQ ID NO: 3241058 - protein, 6 aa, Plasmodium falciparum
NSFEKE

SEQ ID NO: 3241059 - protein, 4 aa, Plasmodium falciparum
NSFN

SEQ ID NO: 3241060 - protein, 11 aa, Plasmodium falciparum
NSFNKENKSII

SEQ ID NO: 3241061 - protein, 12 aa, Plasmodium falciparum
NSFNKNQGKTFD

SEQ ID NO: 3241062 - protein, 5 aa, Plasmodium falciparum
NSFNN

SEQ ID NO: 3241063 - protein, 7 aa, Plasmodium falciparum
NSFPDPF

SEQ ID NO: 3241064 - protein, 6 aa, Plasmodium falciparum
NSFPNS

SEQ ID NO: 3241065 - protein, 6 aa, Plasmodium falciparum
NSFPSL

SEQ ID NO: 3241066 - protein, 5 aa, Plasmodium falciparum
NSFSS

SEQ ID NO: 3241067 - protein, 16 aa, Plasmodium falciparum
NSFTKNNTSSSSSSSG

SEQ ID NO: 3241068 - protein, 13 aa, Plasmodium falciparum
NSGARSSNDPIQD

SEQ ID NO: 3241069 - protein, 15 aa, Plasmodium falciparum
NSGASGTNVESQGTF

SEQ ID NO: 3241070 - protein, 5 aa, Plasmodium falciparum
NSGCD

SEQ ID NO: 3241071 - protein, 9 aa, Plasmodium falciparum
NSGDEEPRY

SEQ ID NO: 3241072 - protein, 7 aa, Plasmodium falciparum
NSGDHTQ

SEQ ID NO: 3241073 - protein, 11 aa, Plasmodium falciparum
NSGDNNSNEIN

SEQ ID NO: 3241074 - protein, 8 aa, Plasmodium falciparum
NSGEKKRN

SEQ ID NO: 3241075 - protein, 9 aa, Plasmodium falciparum
NSGGAMSQG

SEQ ID NO: 3241076 - protein, 27 aa, Plasmodium falciparum
NSGGTARSGGTSGTSSTSGDSGTNDIN

SEQ ID NO: 3241077 - protein, 6 aa, Plasmodium falciparum
NSGKST

SEQ ID NO: 3241078 - protein, 4 aa, Plasmodium falciparum
NSGL

SEQ ID NO: 3241079 - protein, 24 aa, Plasmodium falciparum
NSGNKENSVPPQTSDKNPGQTPQN

SEQ ID NO: 3241080 - protein, 13 aa, Plasmodium falciparum
NSGNKEPSDEQRK

SEQ ID NO: 3241081 - protein, 6 aa, Plasmodium falciparum
NSGNKN

SEQ ID NO: 3241082 - protein, 8 aa, Plasmodium falciparum
NSGNNITE

SEQ ID NO: 3241083 - protein, 23 aa, Plasmodium falciparum
NSGNQSPPSGTLPPNSVKDPSSW

SEQ ID NO: 3241084 - protein, 20 aa, Plasmodium falciparum
NSGNQSSTVGRNPSQSRVTP

SEQ ID NO: 3241085 - protein, 19 aa, Plasmodium falciparum
NSGNYNFGEEKNKNKNAKS

SEQ ID NO: 3241086 - protein, 20 aa, Plasmodium falciparum
NSGRKSGTNGCNVNGNGETW

SEQ ID NO: 3241087 - protein, 16 aa, Plasmodium falciparum
NSGSNYEEGNKNKENM

SEQ ID NO: 3241088 - protein, 6 aa, Plasmodium falciparum
NSGSQI

SEQ ID NO: 3241089 - protein, 15 aa, Plasmodium falciparum
NSGSSRESSKTDETD

SEQ ID NO: 3241090 - protein, 10 aa, Plasmodium falciparum
NSGTTNETCS

SEQ ID NO: 3241091 - protein, 88 aa, Plasmodium falciparum
NSGTVPKKNGNNNDNKMLGTKGKEKCKNENNKNNESNKNNESNKNNESNKSNKNNKSNKNNKSNKNNKSKNNNDKVENANCSDNEKMK

SEQ ID NO: 3241092 - protein, 20 aa, Plasmodium falciparum
NSGVNSAGGGGGGRSGSQEL

SEQ ID NO: 3241093 - protein, 7 aa, Plasmodium falciparum
NSGVSKS

SEQ ID NO: 3241094 - protein, 11 aa, Plasmodium falciparum
NSGYEQNDKEA

SEQ ID NO: 3241095 - protein, 9 aa, Plasmodium falciparum
NSGYKKSDD

SEQ ID NO: 3241096 - protein, 5 aa, Plasmodium falciparum
NSHDV

SEQ ID NO: 3241097 - protein, 6 aa, Plasmodium falciparum
NSHEEW

SEQ ID NO: 3241098 - protein, 7 aa, Plasmodium falciparum
NSHEKRR

SEQ ID NO: 3241099 - protein, 4 aa, Plasmodium falciparum
NSHK

SEQ ID NO: 3241100 - protein, 6 aa, Plasmodium falciparum
NSHKNA

SEQ ID NO: 3241101 - protein, 5 aa, Plasmodium falciparum
NSHKQ

SEQ ID NO: 3241102 - protein, 6 aa, Plasmodium falciparum
NSHKSP

SEQ ID NO: 3241103 - protein, 15 aa, Plasmodium falciparum
NSHNMNEPSSIGYNS

SEQ ID NO: 3241104 - protein, 9 aa, Plasmodium falciparum
NSHNNKPTY

SEQ ID NO: 3241105 - protein, 36 aa, Plasmodium falciparum
NSHNTQDPSYSKKSKNKNKNKNNYNMTNNNNYENPT

SEQ ID NO: 3241106 - protein, 4 aa, Plasmodium falciparum
NSHT

SEQ ID NO: 3241107 - protein, 11 aa, Plasmodium falciparum
NSIEDGSLRPY

SEQ ID NO: 3241108 - protein, 7 aa, Plasmodium falciparum
NSIGKKK

SEQ ID NO: 3241109 - protein, 14 aa, Plasmodium falciparum
NSIGPSRQNEEDNT

SEQ ID NO: 3241110 - protein, 7 aa, Plasmodium falciparum
NSIHSND

SEQ ID NO: 3241111 - protein, 7 aa, Plasmodium falciparum
NSIKENS

SEQ ID NO: 3241112 - protein, 8 aa, Plasmodium falciparum
NSIKEPKD

SEQ ID NO: 3241113 - protein, 5 aa, Plasmodium falciparum
NSIKR

SEQ ID NO: 3241114 - protein, 15 aa, Plasmodium falciparum
NSILKKEKEKRKNIP

SEQ ID NO: 3241115 - protein, 6 aa, Plasmodium falciparum
NSINEE

SEQ ID NO: 3241116 - protein, 5 aa, Plasmodium falciparum
NSINK

SEQ ID NO: 3241117 - protein, 11 aa, Plasmodium falciparum
NSINNGNLKND

SEQ ID NO: 3241118 - protein, 5 aa, Plasmodium falciparum
NSINP

SEQ ID NO: 3241119 - protein, 4 aa, Plasmodium falciparum
NSIP

SEQ ID NO: 3241120 - protein, 8 aa, Plasmodium falciparum
NSIPGGEN

SEQ ID NO: 3241121 - protein, 10 aa, Plasmodium falciparum
NSIQPEKTQH

SEQ ID NO: 3241122 - protein, 7 aa, Plasmodium falciparum
NSIRNDK

SEQ ID NO: 3241123 - protein, 6 aa, Plasmodium falciparum
NSISDN

SEQ ID NO: 3241124 - protein, 4 aa, Plasmodium falciparum
NSIT

SEQ ID NO: 3241125 - protein, 7 aa, Plasmodium falciparum
NSITDHD

SEQ ID NO: 3241126 - protein, 7 aa, Plasmodium falciparum
NSITNKS

SEQ ID NO: 3241127 - protein, 6 aa, Plasmodium falciparum
NSIYQS

SEQ ID NO: 3241128 - protein, 14 aa, Plasmodium falciparum
NSIYSKKENETRKI

SEQ ID NO: 3241129 - protein, 9 aa, Plasmodium falciparum
NSKAENAIK

SEQ ID NO: 3241130 - protein, 6 aa, Plasmodium falciparum
NSKCTS

SEQ ID NO: 3241131 - protein, 12 aa, Plasmodium falciparum
NSKDNDGTNKKH

SEQ ID NO: 3241132 - protein, 13 aa, Plasmodium falciparum
NSKDSINDSLNTS

SEQ ID NO: 3241133 - protein, 7 aa, Plasmodium falciparum
NSKDTSY

SEQ ID NO: 3241134 - protein, 7 aa, Plasmodium falciparum
NSKDYPN

SEQ ID NO: 3241135 - protein, 8 aa, Plasmodium falciparum
NSKEIDGK

SEQ ID NO: 3241136 - protein, 6 aa, Plasmodium falciparum
NSKEKI

SEQ ID NO: 3241137 - protein, 15 aa, Plasmodium falciparum
NSKEQTKDEQMDKKE

SEQ ID NO: 3241138 - protein, 21 aa, Plasmodium falciparum
NSKESNDHNDYNDNNDNNNNM

SEQ ID NO: 3241139 - protein, 23 aa, Plasmodium falciparum
NSKGEGKNKWKDKNENDQNGDNI

SEQ ID NO: 3241140 - protein, 14 aa, Plasmodium falciparum
NSKGGMKDKPKERI

SEQ ID NO: 3241141 - protein, 5 aa, Plasmodium falciparum
NSKHN

SEQ ID NO: 3241142 - protein, 22 aa, Plasmodium falciparum
NSKIGTTKDLSNGLNNTYQNED

SEQ ID NO: 3241143 - protein, 9 aa, Plasmodium falciparum
NSKKEEKQL

SEQ ID NO: 3241144 - protein, 10 aa, Plasmodium falciparum
NSKKKDSSEF

SEQ ID NO: 3241145 - protein, 6 aa, Plasmodium falciparum
NSKKKK

SEQ ID NO: 3241146 - protein, 23 aa, Plasmodium falciparum
NSKKKNHKDKRNASKNKNKNKDI

SEQ ID NO: 3241147 - protein, 5 aa, Plasmodium falciparum
NSKKS

SEQ ID NO: 3241148 - protein, 8 aa, Plasmodium falciparum
NSKKTKYE

SEQ ID NO: 3241149 - protein, 7 aa, Plasmodium falciparum
NSKLAKD

SEQ ID NO: 3241150 - protein, 23 aa, Plasmodium falciparum
NSKMSSTKKKKDDNGKSNSTFDH

SEQ ID NO: 3241151 - protein, 4 aa, Plasmodium falciparum
NSKN

SEQ ID NO: 3241152 - protein, 6 aa, Plasmodium falciparum
NSKNCS

SEQ ID NO: 3241153 - protein, 9 aa, Plasmodium falciparum
NSKNDNDAQ

SEQ ID NO: 3241154 - protein, 7 aa, Plasmodium falciparum
NSKNINE

SEQ ID NO: 3241155 - protein, 7 aa, Plasmodium falciparum
NSKNNIK

SEQ ID NO: 3241156 - protein, 8 aa, Plasmodium falciparum
NSKNSFNE

SEQ ID NO: 3241157 - protein, 15 aa, Plasmodium falciparum
NSKNYEGNPPKNEYP

SEQ ID NO: 3241158 - protein, 8 aa, Plasmodium falciparum
NSKPRNNA

SEQ ID NO: 3241159 - protein, 6 aa, Plasmodium falciparum
NSKQEE

SEQ ID NO: 3241160 - protein, 9 aa, Plasmodium falciparum
NSKQNEKIS

SEQ ID NO: 3241161 - protein, 13 aa, Plasmodium falciparum
NSKQRHDNNTKQK

SEQ ID NO: 3241162 - protein, 27 aa, Plasmodium falciparum
NSKRENNKKYIQSSNIESTKLTSTSSI

SEQ ID NO: 3241163 - protein, 7 aa, Plasmodium falciparum
NSKRKKC

SEQ ID NO: 3241164 - protein, 7 aa, Plasmodium falciparum
NSKRQPV

SEQ ID NO: 3241165 - protein, 18 aa, Plasmodium falciparum
NSKRRKKKKKGDKENDLL

SEQ ID NO: 3241166 - protein, 8 aa, Plasmodium falciparum
NSKRSNIE

SEQ ID NO: 3241167 - protein, 4 aa, Plasmodium falciparum
NSKS

SEQ ID NO: 3241168 - protein, 8 aa, Plasmodium falciparum
NSKSIKGC

SEQ ID NO: 3241169 - protein, 8 aa, Plasmodium falciparum
NSKSIKNY

SEQ ID NO: 3241170 - protein, 8 aa, Plasmodium falciparum
NSKSKNKL

SEQ ID NO: 3241171 - protein, 8 aa, Plasmodium falciparum
NSKSKNSI

SEQ ID NO: 3241172 - protein, 24 aa, Plasmodium falciparum
NSKSSDQMNTPLTKKKKNKQNEKK

SEQ ID NO: 3241173 - protein, 12 aa, Plasmodium falciparum
NSKSTESAAAGK

SEQ ID NO: 3241174 - protein, 12 aa, Plasmodium falciparum
NSKTEKNIPGQD

SEQ ID NO: 3241175 - protein, 12 aa, Plasmodium falciparum
NSKTKNNNITNK

SEQ ID NO: 3241176 - protein, 7 aa, Plasmodium falciparum
NSKTRKR

SEQ ID NO: 3241177 - protein, 7 aa, Plasmodium falciparum
NSKYDKE

SEQ ID NO: 3241178 - protein, 7 aa, Plasmodium falciparum
NSLCSSK

SEQ ID NO: 3241179 - protein, 10 aa, Plasmodium falciparum
NSLDDDERIQ

SEQ ID NO: 3241180 - protein, 9 aa, Plasmodium falciparum
NSLDDDERM

SEQ ID NO: 3241181 - protein, 8 aa, Plasmodium falciparum
NSLDTDLQ

SEQ ID NO: 3241182 - protein, 23 aa, Plasmodium falciparum
NSLEEGKKHTQKYTQKEKKNYTN

SEQ ID NO: 3241183 - protein, 9 aa, Plasmodium falciparum
NSLESNKNN

SEQ ID NO: 3241184 - protein, 4 aa, Plasmodium falciparum
NSLK

SEQ ID NO: 3241185 - protein, 31 aa, Plasmodium falciparum
NSLKETMGNQSMENNNKINNENNNDVDSVEK

SEQ ID NO: 3241186 - protein, 12 aa, Plasmodium falciparum
NSLKHQCKKHLC

SEQ ID NO: 3241187 - protein, 4 aa, Plasmodium falciparum
NSLL

SEQ ID NO: 3241188 - protein, 4 aa, Plasmodium falciparum
NSLN

SEQ ID NO: 3241189 - protein, 20 aa, Plasmodium falciparum
NSLNNNLKNTNTMNNETRSN

SEQ ID NO: 3241190 - protein, 6 aa, Plasmodium falciparum
NSLNNR

SEQ ID NO: 3241191 - protein, 7 aa, Plasmodium falciparum
NSLNSSD

SEQ ID NO: 3241192 - protein, 4 aa, Plasmodium falciparum
NSLP

SEQ ID NO: 3241193 - protein, 4 aa, Plasmodium falciparum
NSLS

SEQ ID NO: 3241194 - protein, 22 aa, Plasmodium falciparum
NSLSENEDNSGNTNSNNFANTS

SEQ ID NO: 3241195 - protein, 30 aa, Plasmodium falciparum
NSLSNTSNVNINNNNNNNNNNSNGSIRSSG

SEQ ID NO: 3241196 - protein, 83 aa, Plasmodium falciparum
NSLTKKEDHNNRHNINNNNDNNNDNNDDNNNDNNNNDNNNDNNNDNNNDNNNDNNNDNNNDNNNDNNNDNNNDNNNDNNNDNN

SEQ ID NO: 3241197 - protein, 6 aa, Plasmodium falciparum
NSLTND

SEQ ID NO: 3241198 - protein, 4 aa, Plasmodium falciparum
NSLY

SEQ ID NO: 3241199 - protein, 18 aa, Plasmodium falciparum
NSMERNKPSYKENEYDQM

SEQ ID NO: 3241200 - protein, 21 aa, Plasmodium falciparum
NSMESASANSPRNKNNQTAYI

SEQ ID NO: 3241201 - protein, 6 aa, Plasmodium falciparum
NSMGKN

SEQ ID NO: 3241202 - protein, 15 aa, Plasmodium falciparum
NSMKDDKKASDINDK

SEQ ID NO: 3241203 - protein, 7 aa, Plasmodium falciparum
NSMNNRN

SEQ ID NO: 3241204 - protein, 10 aa, Plasmodium falciparum
NSMPNDNDNV

SEQ ID NO: 3241205 - protein, 12 aa, Plasmodium falciparum
NSMQARNNPDYD

SEQ ID NO: 3241206 - protein, 15 aa, Plasmodium falciparum
NSMQQNDRDGVKEQY

SEQ ID NO: 3241207 - protein, 14 aa, Plasmodium falciparum
NSMSESNGYNEKEE

SEQ ID NO: 3241208 - protein, 14 aa, Plasmodium falciparum
NSNADKQKISPYNK

SEQ ID NO: 3241209 - protein, 5 aa, Plasmodium falciparum
NSNAY

SEQ ID NO: 3241210 - protein, 4 aa, Plasmodium falciparum
NSNC

SEQ ID NO: 3241211 - protein, 11 aa, Plasmodium falciparum
NSNCDKNKNID

SEQ ID NO: 3241212 - protein, 4 aa, Plasmodium falciparum
NSND

SEQ ID NO: 3241213 - protein, 6 aa, Plasmodium falciparum
NSNDIN

SEQ ID NO: 3241214 - protein, 12 aa, Plasmodium falciparum
NSNDKKMDPDVQ

SEQ ID NO: 3241215 - protein, 17 aa, Plasmodium falciparum
NSNDKSSSYDSSSIQDS

SEQ ID NO: 3241216 - protein, 5 aa, Plasmodium falciparum
NSNDL

SEQ ID NO: 3241217 - protein, 10 aa, Plasmodium falciparum
NSNDLYEEKQ

SEQ ID NO: 3241218 - protein, 5 aa, Plasmodium falciparum
NSNDN

SEQ ID NO: 3241219 - protein, 17 aa, Plasmodium falciparum
NSNDNNKRYDEYNTMND

SEQ ID NO: 3241220 - protein, 7 aa, Plasmodium falciparum
NSNDNSL

SEQ ID NO: 3241221 - protein, 6 aa, Plasmodium falciparum
NSNDSK

SEQ ID NO: 3241222 - protein, 31 aa, Plasmodium falciparum
NSNDTIRDNSNDTICDNSNNTICDNSNDTIC

SEQ ID NO: 3241223 - protein, 5 aa, Plasmodium falciparum
NSNED

SEQ ID NO: 3241224 - protein, 5 aa, Plasmodium falciparum
NSNEE

SEQ ID NO: 3241225 - protein, 10 aa, Plasmodium falciparum
NSNEKKDQNI

SEQ ID NO: 3241226 - protein, 5 aa, Plasmodium falciparum
NSNEN

SEQ ID NO: 3241227 - protein, 6 aa, Plasmodium falciparum
NSNEQF

SEQ ID NO: 3241228 - protein, 8 aa, Plasmodium falciparum
NSNERDKG

SEQ ID NO: 3241229 - protein, 24 aa, Plasmodium falciparum
NSNESNPNNNNDEKNYKGHNNSTL

SEQ ID NO: 3241230 - protein, 21 aa, Plasmodium falciparum
NSNFTRPNSSINNEYAQQQGG

SEQ ID NO: 3241231 - protein, 6 aa, Plasmodium falciparum
NSNGYD

SEQ ID NO: 3241232 - protein, 6 aa, Plasmodium falciparum
NSNGYY

SEQ ID NO: 3241233 - protein, 4 aa, Plasmodium falciparum
NSNH

SEQ ID NO: 3241234 - protein, 13 aa, Plasmodium falciparum
NSNHKGDDHHSEE

SEQ ID NO: 3241235 - protein, 13 aa, Plasmodium falciparum
NSNIKESKKYNPY

SEQ ID NO: 3241236 - protein, 13 aa, Plasmodium falciparum
NSNINDNNNNINT

SEQ ID NO: 3241237 - protein, 4 aa, Plasmodium falciparum
NSNK

SEQ ID NO: 3241238 - protein, 7 aa, Plasmodium falciparum
NSNKDYQ

SEQ ID NO: 3241239 - protein, 7 aa, Plasmodium falciparum
NSNKEYL

SEQ ID NO: 3241240 - protein, 10 aa, Plasmodium falciparum
NSNKIDTDNI

SEQ ID NO: 3241241 - protein, 10 aa, Plasmodium falciparum
NSNKIKNDEN

SEQ ID NO: 3241242 - protein, 8 aa, Plasmodium falciparum
NSNKINYR

SEQ ID NO: 3241243 - protein, 28 aa, Plasmodium falciparum
NSNKKMNEKGTSKGGLTNRNNNKNKQNI

SEQ ID NO: 3241244 - protein, 10 aa, Plasmodium falciparum
NSNKSDYNID

SEQ ID NO: 3241245 - protein, 12 aa, Plasmodium falciparum
NSNKSTNVSNNF

SEQ ID NO: 3241246 - protein, 17 aa, Plasmodium falciparum
NSNLKSSQNKDKDIISS

SEQ ID NO: 3241247 - protein, 5 aa, Plasmodium falciparum
NSNLS

SEQ ID NO: 3241248 - protein, 7 aa, Plasmodium falciparum
NSNMDNS

SEQ ID NO: 3241249 - protein, 9 aa, Plasmodium falciparum
NSNMDNSNM

SEQ ID NO: 3241250 - protein, 6 aa, Plasmodium falciparum
NSNMGD

SEQ ID NO: 3241251 - protein, 7 aa, Plasmodium falciparum
NSNMNNN

SEQ ID NO: 3241252 - protein, 4 aa, Plasmodium falciparum
NSNN

SEQ ID NO: 3241253 - protein, 20 aa, Plasmodium falciparum
NSNNDDIKCDDKNNHTNNKI

SEQ ID NO: 3241254 - protein, 6 aa, Plasmodium falciparum
NSNNDK

SEQ ID NO: 3241255 - protein, 23 aa, Plasmodium falciparum
NSNNEKKLSSGDSDKKKQNKKKY

SEQ ID NO: 3241256 - protein, 21 aa, Plasmodium falciparum
NSNNENKEQVQKNEQVNKEPI

SEQ ID NO: 3241257 - protein, 6 aa, Plasmodium falciparum
NSNNFN

SEQ ID NO: 3241258 - protein, 9 aa, Plasmodium falciparum
NSNNINSSH

SEQ ID NO: 3241259 - protein, 17 aa, Plasmodium falciparum
NSNNKVNQNNKDKEYYK

SEQ ID NO: 3241260 - protein, 17 aa, Plasmodium falciparum
NSNNLKSNTISDNSKNE

SEQ ID NO: 3241261 - protein, 7 aa, Plasmodium falciparum
NSNNMTS

SEQ ID NO: 3241262 - protein, 11 aa, Plasmodium falciparum
NSNNNKEKREK

SEQ ID NO: 3241263 - protein, 6 aa, Plasmodium falciparum
NSNNNN

SEQ ID NO: 3241264 - protein, 8 aa, Plasmodium falciparum
NSNNNNND

SEQ ID NO: 3241265 - protein, 30 aa, Plasmodium falciparum
NSNNNNNNNNNNHHHHNNNSHHNNNNNHHH

SEQ ID NO: 3241266 - protein, 13 aa, Plasmodium falciparum
NSNNNNNTNQHNS

SEQ ID NO: 3241267 - protein, 11 aa, Plasmodium falciparum
NSNNNSNNNYY

SEQ ID NO: 3241268 - protein, 29 aa, Plasmodium falciparum
NSNNNVVDSNSTNFKENVKNKDNSNNRNM

SEQ ID NO: 3241269 - protein, 7 aa, Plasmodium falciparum
NSNNNYN

SEQ ID NO: 3241270 - protein, 9 aa, Plasmodium falciparum
NSNNPNNIP

SEQ ID NO: 3241271 - protein, 8 aa, Plasmodium falciparum
NSNNQIKN

SEQ ID NO: 3241272 - protein, 12 aa, Plasmodium falciparum
NSNNQSTTINNT

SEQ ID NO: 3241273 - protein, 43 aa, Plasmodium falciparum
NSNNSTSTGSKKNKRKEEKEEKEEKEEEEEKEKEIEVEKKREK

SEQ ID NO: 3241274 - protein, 8 aa, Plasmodium falciparum
NSNPIDNT

SEQ ID NO: 3241275 - protein, 4 aa, Plasmodium falciparum
NSNQ

SEQ ID NO: 3241276 - protein, 6 aa, Plasmodium falciparum
NSNRNT

SEQ ID NO: 3241277 - protein, 6 aa, Plasmodium falciparum
NSNSLA

SEQ ID NO: 3241278 - protein, 10 aa, Plasmodium falciparum
NSNSNNDAKD

SEQ ID NO: 3241279 - protein, 16 aa, Plasmodium falciparum
NSNSSNNNNDDNNVHP

SEQ ID NO: 3241280 - protein, 45 aa, Plasmodium falciparum
NSNTATTTTTTTNNNNNNNNNDNITINNSGASQINNTNNDNNNIT

SEQ ID NO: 3241281 - protein, 17 aa, Plasmodium falciparum
NSNTNGQVKASASNANV

SEQ ID NO: 3241282 - protein, 7 aa, Plasmodium falciparum
NSNTNNK

SEQ ID NO: 3241283 - protein, 71 aa, Plasmodium falciparum
NSNTPNSKKNKYDEEEEKEEKEEEEENNKCNDKDDEDKNKSPQNEDNKNITNDNNDNNNNNVDKENNLKES

SEQ ID NO: 3241284 - protein, 6 aa, Plasmodium falciparum
NSNTPQ

SEQ ID NO: 3241285 - protein, 7 aa, Plasmodium falciparum
NSNTSDL

SEQ ID NO: 3241286 - protein, 7 aa, Plasmodium falciparum
NSNTSQK

SEQ ID NO: 3241287 - protein, 7 aa, Plasmodium falciparum
NSNTTNI

SEQ ID NO: 3241288 - protein, 16 aa, Plasmodium falciparum
NSNTVKKDNTSSNINE

SEQ ID NO: 3241289 - protein, 6 aa, Plasmodium falciparum
NSNTYQ

SEQ ID NO: 3241290 - protein, 4 aa, Plasmodium falciparum
NSNV

SEQ ID NO: 3241291 - protein, 6 aa, Plasmodium falciparum
NSNVNP

SEQ ID NO: 3241292 - protein, 10 aa, Plasmodium falciparum
NSNVSNSNVS

SEQ ID NO: 3241293 - protein, 18 aa, Plasmodium falciparum
NSNYGSKMGSNNINDSTN

SEQ ID NO: 3241294 - protein, 6 aa, Plasmodium falciparum
NSNYPN

SEQ ID NO: 3241295 - protein, 10 aa, Plasmodium falciparum
NSNYSQNKGD

SEQ ID NO: 3241296 - protein, 5 aa, Plasmodium falciparum
NSNYW

SEQ ID NO: 3241297 - protein, 4 aa, Plasmodium falciparum
NSPC

SEQ ID NO: 3241298 - protein, 6 aa, Plasmodium falciparum
NSPCRN

SEQ ID NO: 3241299 - protein, 7 aa, Plasmodium falciparum
NSPDDEM

SEQ ID NO: 3241300 - protein, 18 aa, Plasmodium falciparum
NSPHDNTNIISQRNNITI

SEQ ID NO: 3241301 - protein, 18 aa, Plasmodium falciparum
NSPIPNEEKPNVNKEGNI

SEQ ID NO: 3241302 - protein, 11 aa, Plasmodium falciparum
NSPIRSNEYRE

SEQ ID NO: 3241303 - protein, 13 aa, Plasmodium falciparum
NSPKKEKEKENVE

SEQ ID NO: 3241304 - protein, 4 aa, Plasmodium falciparum
NSPM

SEQ ID NO: 3241305 - protein, 9 aa, Plasmodium falciparum
NSPNDATPY

SEQ ID NO: 3241306 - protein, 6 aa, Plasmodium falciparum
NSPNEY

SEQ ID NO: 3241307 - protein, 6 aa, Plasmodium falciparum
NSPNHE

SEQ ID NO: 3241308 - protein, 5 aa, Plasmodium falciparum
NSPNS

SEQ ID NO: 3241309 - protein, 8 aa, Plasmodium falciparum
NSPNYNNN

SEQ ID NO: 3241310 - protein, 8 aa, Plasmodium falciparum
NSPPSPSY

SEQ ID NO: 3241311 - protein, 4 aa, Plasmodium falciparum
NSPS

SEQ ID NO: 3241312 - protein, 5 aa, Plasmodium falciparum
NSPSY

SEQ ID NO: 3241313 - protein, 4 aa, Plasmodium falciparum
NSPT

SEQ ID NO: 3241314 - protein, 5 aa, Plasmodium falciparum
NSPYI

SEQ ID NO: 3241315 - protein, 15 aa, Plasmodium falciparum
NSPYQNKNVDEIKNK

SEQ ID NO: 3241316 - protein, 6 aa, Plasmodium falciparum
NSPYYK

SEQ ID NO: 3241317 - protein, 4 aa, Plasmodium falciparum
NSQA

SEQ ID NO: 3241318 - protein, 10 aa, Plasmodium falciparum
NSQDDQNGNI

SEQ ID NO: 3241319 - protein, 8 aa, Plasmodium falciparum
NSQDDSNK

SEQ ID NO: 3241320 - protein, 6 aa, Plasmodium falciparum
NSQEYY

SEQ ID NO: 3241321 - protein, 5 aa, Plasmodium falciparum
NSQGK

SEQ ID NO: 3241322 - protein, 6 aa, Plasmodium falciparum
NSQGMN

SEQ ID NO: 3241323 - protein, 11 aa, Plasmodium falciparum
NSQKSEKSNDL

SEQ ID NO: 3241324 - protein, 5 aa, Plasmodium falciparum
NSQKY

SEQ ID NO: 3241325 - protein, 11 aa, Plasmodium falciparum
NSQMNSQNNKI

SEQ ID NO: 3241326 - protein, 4 aa, Plasmodium falciparum
NSQN

SEQ ID NO: 3241327 - protein, 6 aa, Plasmodium falciparum
NSQNED

SEQ ID NO: 3241328 - protein, 5 aa, Plasmodium falciparum
NSQRS

SEQ ID NO: 3241329 - protein, 5 aa, Plasmodium falciparum
NSQTK

SEQ ID NO: 3241330 - protein, 7 aa, Plasmodium falciparum
NSQVERN

SEQ ID NO: 3241331 - protein, 13 aa, Plasmodium falciparum
NSRCGSKSFPYKD

SEQ ID NO: 3241332 - protein, 6 aa, Plasmodium falciparum
NSRDNY

SEQ ID NO: 3241333 - protein, 6 aa, Plasmodium falciparum
NSREDK

SEQ ID NO: 3241334 - protein, 8 aa, Plasmodium falciparum
NSREENGV

SEQ ID NO: 3241335 - protein, 12 aa, Plasmodium falciparum
NSRGGDGSNKTF

SEQ ID NO: 3241336 - protein, 8 aa, Plasmodium falciparum
NSRGLGDS

SEQ ID NO: 3241337 - protein, 7 aa, Plasmodium falciparum
NSRKSDL

SEQ ID NO: 3241338 - protein, 9 aa, Plasmodium falciparum
NSRMEGPND

SEQ ID NO: 3241339 - protein, 5 aa, Plasmodium falciparum
NSRND

SEQ ID NO: 3241340 - protein, 7 aa, Plasmodium falciparum
NSRNEIG

SEQ ID NO: 3241341 - protein, 9 aa, Plasmodium falciparum
NSRNLKSNN

SEQ ID NO: 3241342 - protein, 8 aa, Plasmodium falciparum
NSRNVSSN

SEQ ID NO: 3241343 - protein, 18 aa, Plasmodium falciparum
NSRQNDKNNYNKSNELRE

SEQ ID NO: 3241344 - protein, 11 aa, Plasmodium falciparum
NSRRPRSSRSN

SEQ ID NO: 3241345 - protein, 10 aa, Plasmodium falciparum
NSRSKSNQKG

SEQ ID NO: 3241346 - protein, 248 aa, Plasmodium falciparum
NSRSLGENDDGNNEDNEKLRKPKHKKLKQPADGNPDPNANPNVDPNANPNVDPNANPNVDPNANPNANPNANPNANPNANPNANPNANPNANPNANPNANPNANPNANPNANPNANPNANPNANPNANPNVDPNANPNANPNANPNANPNANPNANPNANPNANPNANPNANPNANPNANPNANPNANPNANPNANPNANPNANPNKNNQGNGQGHNMPNDPNRNVDENANANSAVKNNNNEEPSDKH

SEQ ID NO: 3241347 - protein, 7 aa, Plasmodium falciparum
NSRTNMN

SEQ ID NO: 3241348 - protein, 9 aa, Plasmodium falciparum
NSRTSNNAI

SEQ ID NO: 3241349 - protein, 22 aa, Plasmodium falciparum
NSSAKKNDNANFKKRKTIDSSL

SEQ ID NO: 3241350 - protein, 11 aa, Plasmodium falciparum
NSSDDNNSDQI

SEQ ID NO: 3241351 - protein, 9 aa, Plasmodium falciparum
NSSDENKKE

SEQ ID NO: 3241352 - protein, 6 aa, Plasmodium falciparum
NSSDIN

SEQ ID NO: 3241353 - protein, 10 aa, Plasmodium falciparum
NSSDKKKENI

SEQ ID NO: 3241354 - protein, 7 aa, Plasmodium falciparum
NSSDQSF

SEQ ID NO: 3241355 - protein, 7 aa, Plasmodium falciparum
NSSEKNE

SEQ ID NO: 3241356 - protein, 13 aa, Plasmodium falciparum
NSSEKRGSNDNAL

SEQ ID NO: 3241357 - protein, 9 aa, Plasmodium falciparum
NSSENDNVN

SEQ ID NO: 3241358 - protein, 10 aa, Plasmodium falciparum
NSSENGSYKT

SEQ ID NO: 3241359 - protein, 5 aa, Plasmodium falciparum
NSSES

SEQ ID NO: 3241360 - protein, 7 aa, Plasmodium falciparum
NSSESYD

SEQ ID NO: 3241361 - protein, 4 aa, Plasmodium falciparum
NSSF

SEQ ID NO: 3241362 - protein, 16 aa, Plasmodium falciparum
NSSGKTPTAKKTTPKE

SEQ ID NO: 3241363 - protein, 7 aa, Plasmodium falciparum
NSSHNPY

SEQ ID NO: 3241364 - protein, 18 aa, Plasmodium falciparum
NSSHQNINGNNKQYSSSS

SEQ ID NO: 3241365 - protein, 81 aa, Plasmodium falciparum
NSSINTSTTKNNNNNNNSNKEKHKYSDEDDEDNEDNEDNENDGYNSYGQKNKNNLSEDDYDNENDNDEYGNKNKNSNQSYN

SEQ ID NO: 3241366 - protein, 12 aa, Plasmodium falciparum
NSSISNNDNNYY

SEQ ID NO: 3241367 - protein, 38 aa, Plasmodium falciparum
NSSKDDTKQTSSKLNEEKCKEKLGDSKKKDNKISNVKL

SEQ ID NO: 3241368 - protein, 7 aa, Plasmodium falciparum
NSSKEEM

SEQ ID NO: 3241369 - protein, 8 aa, Plasmodium falciparum
NSSKEKEI

SEQ ID NO: 3241370 - protein, 10 aa, Plasmodium falciparum
NSSKNDERYR

SEQ ID NO: 3241371 - protein, 24 aa, Plasmodium falciparum
NSSKNNSSNNNNNNNCSSSSKNKF

SEQ ID NO: 3241372 - protein, 5 aa, Plasmodium falciparum
NSSKV

SEQ ID NO: 3241373 - protein, 34 aa, Plasmodium falciparum
NSSKYGGSKIYSDSSSRVKGNKDNSNSSNSNNSE

SEQ ID NO: 3241374 - protein, 4 aa, Plasmodium falciparum
NSSL

SEQ ID NO: 3241375 - protein, 7 aa, Plasmodium falciparum
NSSLRNE

SEQ ID NO: 3241376 - protein, 14 aa, Plasmodium falciparum
NSSLSSNNHFNNNN

SEQ ID NO: 3241377 - protein, 4 aa, Plasmodium falciparum
NSSM

SEQ ID NO: 3241378 - protein, 7 aa, Plasmodium falciparum
NSSMSYN

SEQ ID NO: 3241379 - protein, 5 aa, Plasmodium falciparum
NSSNA

SEQ ID NO: 3241380 - protein, 16 aa, Plasmodium falciparum
NSSNDFNSLNNEEQNI

SEQ ID NO: 3241381 - protein, 6 aa, Plasmodium falciparum
NSSNEY

SEQ ID NO: 3241382 - protein, 6 aa, Plasmodium falciparum
NSSNIA

SEQ ID NO: 3241383 - protein, 6 aa, Plasmodium falciparum
NSSNKN

SEQ ID NO: 3241384 - protein, 8 aa, Plasmodium falciparum
NSSNNANS

SEQ ID NO: 3241385 - protein, 12 aa, Plasmodium falciparum
NSSNNNNNNTIN

SEQ ID NO: 3241386 - protein, 6 aa, Plasmodium falciparum
NSSNNR

SEQ ID NO: 3241387 - protein, 6 aa, Plasmodium falciparum
NSSNNS

SEQ ID NO: 3241388 - protein, 9 aa, Plasmodium falciparum
NSSNNSSHH

SEQ ID NO: 3241389 - protein, 8 aa, Plasmodium falciparum
NSSNQDND

SEQ ID NO: 3241390 - protein, 10 aa, Plasmodium falciparum
NSSNRRSSKG

SEQ ID NO: 3241391 - protein, 10 aa, Plasmodium falciparum
NSSNRTFPNE

SEQ ID NO: 3241392 - protein, 16 aa, Plasmodium falciparum
NSSNSNIINGNKSALN

SEQ ID NO: 3241393 - protein, 19 aa, Plasmodium falciparum
NSSNSTMSNEFKEKKKNNE

SEQ ID NO: 3241394 - protein, 8 aa, Plasmodium falciparum
NSSNTSSN

SEQ ID NO: 3241395 - protein, 5 aa, Plasmodium falciparum
NSSPF

SEQ ID NO: 3241396 - protein, 9 aa, Plasmodium falciparum
NSSPHYEDD

SEQ ID NO: 3241397 - protein, 8 aa, Plasmodium falciparum
NSSPNMDN

SEQ ID NO: 3241398 - protein, 6 aa, Plasmodium falciparum
NSSPSN

SEQ ID NO: 3241399 - protein, 13 aa, Plasmodium falciparum
NSSQDDESKKKYG

SEQ ID NO: 3241400 - protein, 6 aa, Plasmodium falciparum
NSSQNI

SEQ ID NO: 3241401 - protein, 4 aa, Plasmodium falciparum
NSSS

SEQ ID NO: 3241402 - protein, 5 aa, Plasmodium falciparum
NSSSA

SEQ ID NO: 3241403 - protein, 7 aa, Plasmodium falciparum
NSSSEFA

SEQ ID NO: 3241404 - protein, 6 aa, Plasmodium falciparum
NSSSEI

SEQ ID NO: 3241405 - protein, 5 aa, Plasmodium falciparum
NSSSF

SEQ ID NO: 3241406 - protein, 8 aa, Plasmodium falciparum
NSSSGKST

SEQ ID NO: 3241407 - protein, 9 aa, Plasmodium falciparum
NSSSKLREC

SEQ ID NO: 3241408 - protein, 38 aa, Plasmodium falciparum
NSSSNDFRKREEKFNKTRDHSNNRYNTQQNSKGSNISE

SEQ ID NO: 3241409 - protein, 10 aa, Plasmodium falciparum
NSSSNECNQS

SEQ ID NO: 3241410 - protein, 33 aa, Plasmodium falciparum
NSSSNNPCEGKDKDGKLTIRKVWEPDNKNVKHN

SEQ ID NO: 3241411 - protein, 10 aa, Plasmodium falciparum
NSSSRESKDM

SEQ ID NO: 3241412 - protein, 9 aa, Plasmodium falciparum
NSSSSNKNN

SEQ ID NO: 3241413 - protein, 13 aa, Plasmodium falciparum
NSSSSQKLSNNSL

SEQ ID NO: 3241414 - protein, 13 aa, Plasmodium falciparum
NSSSSSSSRSRRN

SEQ ID NO: 3241415 - protein, 12 aa, Plasmodium falciparum
NSSSSTNKINKT

SEQ ID NO: 3241416 - protein, 27 aa, Plasmodium falciparum
NSSSTSTSNSSSKSKSSNCRNKKNNQI

SEQ ID NO: 3241417 - protein, 6 aa, Plasmodium falciparum
NSSTAA

SEQ ID NO: 3241418 - protein, 12 aa, Plasmodium falciparum
NSSTLKRKNKNK

SEQ ID NO: 3241419 - protein, 8 aa, Plasmodium falciparum
NSSTQKND

SEQ ID NO: 3241420 - protein, 5 aa, Plasmodium falciparum
NSSTS

SEQ ID NO: 3241421 - protein, 5 aa, Plasmodium falciparum
NSSVR

SEQ ID NO: 3241422 - protein, 4 aa, Plasmodium falciparum
NSSY

SEQ ID NO: 3241423 - protein, 7 aa, Plasmodium falciparum
NSSYKSK

SEQ ID NO: 3241424 - protein, 5 aa, Plasmodium falciparum
NSSYQ

SEQ ID NO: 3241425 - protein, 14 aa, Plasmodium falciparum
NSSYRNKNNSNIHT

SEQ ID NO: 3241426 - protein, 6 aa, Plasmodium falciparum
NSSYTN

SEQ ID NO: 3241427 - protein, 5 aa, Plasmodium falciparum
NSTCR

SEQ ID NO: 3241428 - protein, 5 aa, Plasmodium falciparum
NSTCS

SEQ ID NO: 3241429 - protein, 4 aa, Plasmodium falciparum
NSTE

SEQ ID NO: 3241430 - protein, 5 aa, Plasmodium falciparum
NSTEL

SEQ ID NO: 3241431 - protein, 24 aa, Plasmodium falciparum
NSTENFEKGKKKKETKNKSYNKNI

SEQ ID NO: 3241432 - protein, 8 aa, Plasmodium falciparum
NSTESNVT

SEQ ID NO: 3241433 - protein, 6 aa, Plasmodium falciparum
NSTETN

SEQ ID NO: 3241434 - protein, 5 aa, Plasmodium falciparum
NSTFD

SEQ ID NO: 3241435 - protein, 6 aa, Plasmodium falciparum
NSTGKE

SEQ ID NO: 3241436 - protein, 6 aa, Plasmodium falciparum
NSTHDH

SEQ ID NO: 3241437 - protein, 5 aa, Plasmodium falciparum
NSTHQ

SEQ ID NO: 3241438 - protein, 4 aa, Plasmodium falciparum
NSTI

SEQ ID NO: 3241439 - protein, 6 aa, Plasmodium falciparum
NSTISH

SEQ ID NO: 3241440 - protein, 4 aa, Plasmodium falciparum
NSTK

SEQ ID NO: 3241441 - protein, 5 aa, Plasmodium falciparum
NSTKC

SEQ ID NO: 3241442 - protein, 9 aa, Plasmodium falciparum
NSTKENTKI

SEQ ID NO: 3241443 - protein, 7 aa, Plasmodium falciparum
NSTKKKK

SEQ ID NO: 3241444 - protein, 10 aa, Plasmodium falciparum
NSTLTKSPIH

SEQ ID NO: 3241445 - protein, 8 aa, Plasmodium falciparum
NSTNEDIK

SEQ ID NO: 3241446 - protein, 7 aa, Plasmodium falciparum
NSTNENN

SEQ ID NO: 3241447 - protein, 37 aa, Plasmodium falciparum
NSTNENNERENSQVNCSNKKASYLNGSGNNSSNGKEL

SEQ ID NO: 3241448 - protein, 10 aa, Plasmodium falciparum
NSTNHDDNPY

SEQ ID NO: 3241449 - protein, 12 aa, Plasmodium falciparum
NSTNKLVENNET

SEQ ID NO: 3241450 - protein, 32 aa, Plasmodium falciparum
NSTNNNNNNNNNNNNNDYNNNNKSSNNNNSSN

SEQ ID NO: 3241451 - protein, 5 aa, Plasmodium falciparum
NSTNS

SEQ ID NO: 3241452 - protein, 5 aa, Plasmodium falciparum
NSTNY

SEQ ID NO: 3241453 - protein, 5 aa, Plasmodium falciparum
NSTPP

SEQ ID NO: 3241454 - protein, 9 aa, Plasmodium falciparum
NSTQDPNTK

SEQ ID NO: 3241455 - protein, 13 aa, Plasmodium falciparum
NSTRENNVKNNKL

SEQ ID NO: 3241456 - protein, 13 aa, Plasmodium falciparum
NSTSGGTAGSNKT

SEQ ID NO: 3241457 - protein, 42 aa, Plasmodium falciparum
NSTSGGTAVSASGASSTSGGSGAASGGTSDTSGTNNASQGTF

SEQ ID NO: 3241458 - protein, 10 aa, Plasmodium falciparum
NSTSLNQPNI

SEQ ID NO: 3241459 - protein, 15 aa, Plasmodium falciparum
NSTSNGKNVQDNNNI

SEQ ID NO: 3241460 - protein, 8 aa, Plasmodium falciparum
NSTSPAAA

SEQ ID NO: 3241461 - protein, 9 aa, Plasmodium falciparum
NSTSQKHKI

SEQ ID NO: 3241462 - protein, 14 aa, Plasmodium falciparum
NSTTEIKDEGLKEA

SEQ ID NO: 3241463 - protein, 12 aa, Plasmodium falciparum
NSTTKNEGSTSI

SEQ ID NO: 3241464 - protein, 20 aa, Plasmodium falciparum
NSTTTNRKISASKYKQREKK

SEQ ID NO: 3241465 - protein, 5 aa, Plasmodium falciparum
NSTVS

SEQ ID NO: 3241466 - protein, 4 aa, Plasmodium falciparum
NSTY

SEQ ID NO: 3241467 - protein, 18 aa, Plasmodium falciparum
NSVEKTPQTQLASGDIPT

SEQ ID NO: 3241468 - protein, 32 aa, Plasmodium falciparum
NSVKDDKDINSEHQRYQQKKTNKQTKNIQQNQ

SEQ ID NO: 3241469 - protein, 4 aa, Plasmodium falciparum
NSVN

SEQ ID NO: 3241470 - protein, 6 aa, Plasmodium falciparum
NSVNDE

SEQ ID NO: 3241471 - protein, 13 aa, Plasmodium falciparum
NSVNTGKQNTVPY

SEQ ID NO: 3241472 - protein, 13 aa, Plasmodium falciparum
NSVQRKEKNVKTI

SEQ ID NO: 3241473 - protein, 7 aa, Plasmodium falciparum
NSVSSNF

SEQ ID NO: 3241474 - protein, 6 aa, Plasmodium falciparum
NSVSSV

SEQ ID NO: 3241475 - protein, 20 aa, Plasmodium falciparum
NSVSTPPPTPATKPSDEKRK

SEQ ID NO: 3241476 - protein, 9 aa, Plasmodium falciparum
NSVTKNNKH

SEQ ID NO: 3241477 - protein, 27 aa, Plasmodium falciparum
NSVVSSSSARGNGASRDKNGGSDSQDL

SEQ ID NO: 3241478 - protein, 4 aa, Plasmodium falciparum
NSVY

SEQ ID NO: 3241479 - protein, 13 aa, Plasmodium falciparum
NSWPKKKFSKNKN

SEQ ID NO: 3241480 - protein, 32 aa, Plasmodium falciparum
NSYAPGGFKSAGADENLRKKSSKGRNKNKINN

SEQ ID NO: 3241481 - protein, 13 aa, Plasmodium falciparum
NSYDEEDKEENIK

SEQ ID NO: 3241482 - protein, 16 aa, Plasmodium falciparum
NSYDEEYTYNKSSNKK

SEQ ID NO: 3241483 - protein, 5 aa, Plasmodium falciparum
NSYEN

SEQ ID NO: 3241484 - protein, 9 aa, Plasmodium falciparum
NSYENNTES

SEQ ID NO: 3241485 - protein, 11 aa, Plasmodium falciparum
NSYGYSANDVE

SEQ ID NO: 3241486 - protein, 11 aa, Plasmodium falciparum
NSYHNNKKKQI

SEQ ID NO: 3241487 - protein, 25 aa, Plasmodium falciparum
NSYHSDDNPFNAYQDNNNNNNNTNL

SEQ ID NO: 3241488 - protein, 6 aa, Plasmodium falciparum
NSYHSQ

SEQ ID NO: 3241489 - protein, 9 aa, Plasmodium falciparum
NSYKDQKNY

SEQ ID NO: 3241490 - protein, 14 aa, Plasmodium falciparum
NSYKHNNIKKKNNY

SEQ ID NO: 3241491 - protein, 9 aa, Plasmodium falciparum
NSYKKRDQQ

SEQ ID NO: 3241492 - protein, 6 aa, Plasmodium falciparum
NSYKND

SEQ ID NO: 3241493 - protein, 11 aa, Plasmodium falciparum
NSYKNDKEKAV

SEQ ID NO: 3241494 - protein, 6 aa, Plasmodium falciparum
NSYNDE

SEQ ID NO: 3241495 - protein, 18 aa, Plasmodium falciparum
NSYNDNNHKRSKKHDTVE

SEQ ID NO: 3241496 - protein, 5 aa, Plasmodium falciparum
NSYNK

SEQ ID NO: 3241497 - protein, 10 aa, Plasmodium falciparum
NSYNNNNNNN

SEQ ID NO: 3241498 - protein, 34 aa, Plasmodium falciparum
NSYNNRKEQTNNEQDDDDDDNNKKKKISKYESDD

SEQ ID NO: 3241499 - protein, 10 aa, Plasmodium falciparum
NSYNSYNSYN

SEQ ID NO: 3241500 - protein, 9 aa, Plasmodium falciparum
NSYNTRGSH

SEQ ID NO: 3241501 - protein, 14 aa, Plasmodium falciparum
NSYSEGNTNKSEYE

SEQ ID NO: 3241502 - protein, 11 aa, Plasmodium falciparum
NSYSNNDNDIP

SEQ ID NO: 3241503 - protein, 11 aa, Plasmodium falciparum
NSYSRACSKSL

SEQ ID NO: 3241504 - protein, 8 aa, Plasmodium falciparum
NSYSSNRN

SEQ ID NO: 3241505 - protein, 9 aa, Plasmodium falciparum
NSYSSSLST

SEQ ID NO: 3241506 - protein, 10 aa, Plasmodium falciparum
NSYSTSNNSR

SEQ ID NO: 3241507 - protein, 6 aa, Plasmodium falciparum
NSYSYH

SEQ ID NO: 3241508 - protein, 4 aa, Plasmodium falciparum
NSYT

SEQ ID NO: 3241509 - protein, 5 aa, Plasmodium falciparum
NSYTN

SEQ ID NO: 3241510 - protein, 6 aa, Plasmodium falciparum
NSYTNN

SEQ ID NO: 3241511 - protein, 7 aa, Plasmodium falciparum
NSYYDDE

SEQ ID NO: 3241512 - protein, 6 aa, Plasmodium falciparum
NSYYNN

SEQ ID NO: 3241513 - protein, 20 aa, Plasmodium falciparum
NTAEKNNKYDKHNNNNNNNN

SEQ ID NO: 3241514 - protein, 11 aa, Plasmodium falciparum
NTASRMKSTSL

SEQ ID NO: 3241515 - protein, 13 aa, Plasmodium falciparum
NTASRMKTTGKPD

SEQ ID NO: 3241516 - protein, 5 aa, Plasmodium falciparum
NTCST

SEQ ID NO: 3241517 - protein, 8 aa, Plasmodium falciparum
NTCSTPEQ

SEQ ID NO: 3241518 - protein, 4 aa, Plasmodium falciparum
NTCT

SEQ ID NO: 3241519 - protein, 6 aa, Plasmodium falciparum
NTDDNK

SEQ ID NO: 3241520 - protein, 8 aa, Plasmodium falciparum
NTDDNKIH

SEQ ID NO: 3241521 - protein, 31 aa, Plasmodium falciparum
NTDDNNNDNNDDGNNSDNNNDNNNNNNNNIS

SEQ ID NO: 3241522 - protein, 8 aa, Plasmodium falciparum
NTDEGEAN

SEQ ID NO: 3241523 - protein, 27 aa, Plasmodium falciparum
NTDENITSSSMSSNINEYPTKSNNNTS

SEQ ID NO: 3241524 - protein, 9 aa, Plasmodium falciparum
NTDEQKESK

SEQ ID NO: 3241525 - protein, 10 aa, Plasmodium falciparum
NTDEYDKSNV

SEQ ID NO: 3241526 - protein, 4 aa, Plasmodium falciparum
NTDI

SEQ ID NO: 3241527 - protein, 4 aa, Plasmodium falciparum
NTDK

SEQ ID NO: 3241528 - protein, 5 aa, Plasmodium falciparum
NTDKL

SEQ ID NO: 3241529 - protein, 5 aa, Plasmodium falciparum
NTDKP

SEQ ID NO: 3241530 - protein, 8 aa, Plasmodium falciparum
NTDNNENK

SEQ ID NO: 3241531 - protein, 9 aa, Plasmodium falciparum
NTDNSKTSS

SEQ ID NO: 3241532 - protein, 15 aa, Plasmodium falciparum
NTDNSNNKAESTKKG

SEQ ID NO: 3241533 - protein, 15 aa, Plasmodium falciparum
NTDPNDETSADPEGQ

SEQ ID NO: 3241534 - protein, 17 aa, Plasmodium falciparum
NTDPNDEVERQNADNNE

SEQ ID NO: 3241535 - protein, 27 aa, Plasmodium falciparum
NTDPNDEVERRNADNKEELTSSDPEGQ

SEQ ID NO: 3241536 - protein, 26 aa, Plasmodium falciparum
NTDPNDEVERRNADNKELTSSDPEGQ

SEQ ID NO: 3241537 - protein, 4 aa, Plasmodium falciparum
NTDQ

SEQ ID NO: 3241538 - protein, 5 aa, Plasmodium falciparum
NTDRA

SEQ ID NO: 3241539 - protein, 24 aa, Plasmodium falciparum
NTDTFSTKKKKYRHTEPRIENTYI

SEQ ID NO: 3241540 - protein, 14 aa, Plasmodium falciparum
NTDTPSGDKPTQID

SEQ ID NO: 3241541 - protein, 15 aa, Plasmodium falciparum
NTDTYTYNNNDDDID

SEQ ID NO: 3241542 - protein, 12 aa, Plasmodium falciparum
NTDYNNKKKRKE

SEQ ID NO: 3241543 - protein, 16 aa, Plasmodium falciparum
NTEADKELKEGKIPDE

SEQ ID NO: 3241544 - protein, 4 aa, Plasmodium falciparum
NTED

SEQ ID NO: 3241545 - protein, 10 aa, Plasmodium falciparum
NTEDVNTPTM

SEQ ID NO: 3241546 - protein, 8 aa, Plasmodium falciparum
NTEEEKQN

SEQ ID NO: 3241547 - protein, 10 aa, Plasmodium falciparum
NTEEEYNHNT

SEQ ID NO: 3241548 - protein, 4 aa, Plasmodium falciparum
NTEH

SEQ ID NO: 3241549 - protein, 5 aa, Plasmodium falciparum
NTEIN

SEQ ID NO: 3241550 - protein, 8 aa, Plasmodium falciparum
NTEKENED

SEQ ID NO: 3241551 - protein, 11 aa, Plasmodium falciparum
NTEKNKHTLKN

SEQ ID NO: 3241552 - protein, 9 aa, Plasmodium falciparum
NTEKTFSRS

SEQ ID NO: 3241553 - protein, 48 aa, Plasmodium falciparum
NTEMETQSERQEEDDENEDVEEEENNNVKQNDNKKKKKKKKGKNNNIK

SEQ ID NO: 3241554 - protein, 5 aa, Plasmodium falciparum
NTENI

SEQ ID NO: 3241555 - protein, 7 aa, Plasmodium falciparum
NTENNEF

SEQ ID NO: 3241556 - protein, 6 aa, Plasmodium falciparum
NTENTH

SEQ ID NO: 3241557 - protein, 8 aa, Plasmodium falciparum
NTEPIDDK

SEQ ID NO: 3241558 - protein, 10 aa, Plasmodium falciparum
NTEQNKNSIS

SEQ ID NO: 3241559 - protein, 8 aa, Plasmodium falciparum
NTEQYNDN

SEQ ID NO: 3241560 - protein, 9 aa, Plasmodium falciparum
NTERQKKKK

SEQ ID NO: 3241561 - protein, 15 aa, Plasmodium falciparum
NTESNKKNGLSNNKE

SEQ ID NO: 3241562 - protein, 10 aa, Plasmodium falciparum
NTETKEMDKE

SEQ ID NO: 3241563 - protein, 7 aa, Plasmodium falciparum
NTETPDV

SEQ ID NO: 3241564 - protein, 13 aa, Plasmodium falciparum
NTEVSEKYNNLKD

SEQ ID NO: 3241565 - protein, 15 aa, Plasmodium falciparum
NTEYKEKDEKDEKKS

SEQ ID NO: 3241566 - protein, 4 aa, Plasmodium falciparum
NTFD

SEQ ID NO: 3241567 - protein, 11 aa, Plasmodium falciparum
NTFDGKQNGKE

SEQ ID NO: 3241568 - protein, 41 aa, Plasmodium falciparum
NTFDNNSDLKKDQMDNKKEQEDVEKDVKENEKNDIKEYDEH

SEQ ID NO: 3241569 - protein, 12 aa, Plasmodium falciparum
NTFEKTNKFDNN

SEQ ID NO: 3241570 - protein, 5 aa, Plasmodium falciparum
NTFGE

SEQ ID NO: 3241571 - protein, 14 aa, Plasmodium falciparum
NTFKQKNRNDMTTP

SEQ ID NO: 3241572 - protein, 12 aa, Plasmodium falciparum
NTFNNKNTYDNQ

SEQ ID NO: 3241573 - protein, 8 aa, Plasmodium falciparum
NTFPTQES

SEQ ID NO: 3241574 - protein, 4 aa, Plasmodium falciparum
NTFS

SEQ ID NO: 3241575 - protein, 4 aa, Plasmodium falciparum
NTFY

SEQ ID NO: 3241576 - protein, 6 aa, Plasmodium falciparum
NTGCEI

SEQ ID NO: 3241577 - protein, 5 aa, Plasmodium falciparum
NTGDD

SEQ ID NO: 3241578 - protein, 6 aa, Plasmodium falciparum
NTGDSK

SEQ ID NO: 3241579 - protein, 11 aa, Plasmodium falciparum
NTGDTNQTSTD

SEQ ID NO: 3241580 - protein, 5 aa, Plasmodium falciparum
NTGNA

SEQ ID NO: 3241581 - protein, 20 aa, Plasmodium falciparum
NTGSGASDKEMKAKEEKIKE

SEQ ID NO: 3241582 - protein, 27 aa, Plasmodium falciparum
NTGSTGGSVRDASGGDSGTNNEKEGTF

SEQ ID NO: 3241583 - protein, 6 aa, Plasmodium falciparum
NTGSYN

SEQ ID NO: 3241584 - protein, 23 aa, Plasmodium falciparum
NTGVDAKWSGSKENKDDKSNNEE

SEQ ID NO: 3241585 - protein, 5 aa, Plasmodium falciparum
NTGYS

SEQ ID NO: 3241586 - protein, 6 aa, Plasmodium falciparum
NTHEEG

SEQ ID NO: 3241587 - protein, 6 aa, Plasmodium falciparum
NTHEPN

SEQ ID NO: 3241588 - protein, 4 aa, Plasmodium falciparum
NTHG

SEQ ID NO: 3241589 - protein, 61 aa, Plasmodium falciparum
NTHGSNTHSNNTHGNNTHSNNTHGNNTHSNNTYSNNTHSNNTYSNNTHGNNTHSNNTHGSN

SEQ ID NO: 3241590 - protein, 6 aa, Plasmodium falciparum
NTHINK

SEQ ID NO: 3241591 - protein, 7 aa, Plasmodium falciparum
NTHKDED

SEQ ID NO: 3241592 - protein, 7 aa, Plasmodium falciparum
NTHKKND

SEQ ID NO: 3241593 - protein, 15 aa, Plasmodium falciparum
NTHKNNYSKNQRTKE

SEQ ID NO: 3241594 - protein, 5 aa, Plasmodium falciparum
NTHKY

SEQ ID NO: 3241595 - protein, 23 aa, Plasmodium falciparum
NTHNDNNNNNNNNNNNNNIGGSV

SEQ ID NO: 3241596 - protein, 13 aa, Plasmodium falciparum
NTHNEQQNKDNNC

SEQ ID NO: 3241597 - protein, 14 aa, Plasmodium falciparum
NTHNGDISHNDNNT

SEQ ID NO: 3241598 - protein, 9 aa, Plasmodium falciparum
NTHNKKNQE

SEQ ID NO: 3241599 - protein, 7 aa, Plasmodium falciparum
NTHNNDH

SEQ ID NO: 3241600 - protein, 11 aa, Plasmodium falciparum
NTHPTPSHDTL

SEQ ID NO: 3241601 - protein, 8 aa, Plasmodium falciparum
NTHTIQNR

SEQ ID NO: 3241602 - protein, 11 aa, Plasmodium falciparum
NTIDKDKSKVD

SEQ ID NO: 3241603 - protein, 26 aa, Plasmodium falciparum
NTIDNNNNNNNNNNLYDADNDSSYDD

SEQ ID NO: 3241604 - protein, 4 aa, Plasmodium falciparum
NTIE

SEQ ID NO: 3241605 - protein, 4 aa, Plasmodium falciparum
NTIG

SEQ ID NO: 3241606 - protein, 13 aa, Plasmodium falciparum
NTIKSKKSGNTYK

SEQ ID NO: 3241607 - protein, 23 aa, Plasmodium falciparum
NTIKSSKSIKDKSKSKQDDPHVS

SEQ ID NO: 3241608 - protein, 16 aa, Plasmodium falciparum
NTIKTSYDKTNTCNDK

SEQ ID NO: 3241609 - protein, 5 aa, Plasmodium falciparum
NTINA

SEQ ID NO: 3241610 - protein, 7 aa, Plasmodium falciparum
NTINSDY

SEQ ID NO: 3241611 - protein, 12 aa, Plasmodium falciparum
NTINSNESDVNR

SEQ ID NO: 3241612 - protein, 21 aa, Plasmodium falciparum
NTINTNNVNTTNTNNVNTINT

SEQ ID NO: 3241613 - protein, 25 aa, Plasmodium falciparum
NTIQPPNNNNNNNNNNNNNNNNNNV

SEQ ID NO: 3241614 - protein, 28 aa, Plasmodium falciparum
NTIQSNNIQSNNIQSNNIQSRKSRNLEE

SEQ ID NO: 3241615 - protein, 4 aa, Plasmodium falciparum
NTIS

SEQ ID NO: 3241616 - protein, 6 aa, Plasmodium falciparum
NTISEQ

SEQ ID NO: 3241617 - protein, 4 aa, Plasmodium falciparum
NTIT

SEQ ID NO: 3241618 - protein, 5 aa, Plasmodium falciparum
NTIYS

SEQ ID NO: 3241619 - protein, 6 aa, Plasmodium falciparum
NTKDIN

SEQ ID NO: 3241620 - protein, 5 aa, Plasmodium falciparum
NTKDK

SEQ ID NO: 3241621 - protein, 10 aa, Plasmodium falciparum
NTKDKINKNT

SEQ ID NO: 3241622 - protein, 7 aa, Plasmodium falciparum
NTKDNNM

SEQ ID NO: 3241623 - protein, 10 aa, Plasmodium falciparum
NTKDSNEGGY

SEQ ID NO: 3241624 - protein, 4 aa, Plasmodium falciparum
NTKE

SEQ ID NO: 3241625 - protein, 11 aa, Plasmodium falciparum
NTKEDSTSSFN

SEQ ID NO: 3241626 - protein, 19 aa, Plasmodium falciparum
NTKEIKNKISSNIKDMSDE

SEQ ID NO: 3241627 - protein, 9 aa, Plasmodium falciparum
NTKEKEITA

SEQ ID NO: 3241628 - protein, 8 aa, Plasmodium falciparum
NTKELNEK

SEQ ID NO: 3241629 - protein, 55 aa, Plasmodium falciparum
NTKENNNGHNNDNIKNVNNNNDNNKNVNNNNDNNKNDNIDYNNNDNIDYNNNDNC

SEQ ID NO: 3241630 - protein, 7 aa, Plasmodium falciparum
NTKENTN

SEQ ID NO: 3241631 - protein, 9 aa, Plasmodium falciparum
NTKEPYTDQ

SEQ ID NO: 3241632 - protein, 5 aa, Plasmodium falciparum
NTKEQ

SEQ ID NO: 3241633 - protein, 6 aa, Plasmodium falciparum
NTKEQN

SEQ ID NO: 3241634 - protein, 8 aa, Plasmodium falciparum
NTKERTSI

SEQ ID NO: 3241635 - protein, 9 aa, Plasmodium falciparum
NTKETKPLK

SEQ ID NO: 3241636 - protein, 8 aa, Plasmodium falciparum
NTKEYKDK

SEQ ID NO: 3241637 - protein, 6 aa, Plasmodium falciparum
NTKGEK

SEQ ID NO: 3241638 - protein, 6 aa, Plasmodium falciparum
NTKGKI

SEQ ID NO: 3241639 - protein, 9 aa, Plasmodium falciparum
NTKGNEQHM

SEQ ID NO: 3241640 - protein, 27 aa, Plasmodium falciparum
NTKGNTKGNTKGNTQENIQNNTQENIQ

SEQ ID NO: 3241641 - protein, 7 aa, Plasmodium falciparum
NTKHQKA

SEQ ID NO: 3241642 - protein, 20 aa, Plasmodium falciparum
NTKISDQSTVKKDKSIDSNK

SEQ ID NO: 3241643 - protein, 11 aa, Plasmodium falciparum
NTKKDSKTIKE

SEQ ID NO: 3241644 - protein, 17 aa, Plasmodium falciparum
NTKKDVNNNDKSNVTEE

SEQ ID NO: 3241645 - protein, 7 aa, Plasmodium falciparum
NTKKKKK

SEQ ID NO: 3241646 - protein, 22 aa, Plasmodium falciparum
NTKKKKKKKKIKKDKMSKNKEM

SEQ ID NO: 3241647 - protein, 20 aa, Plasmodium falciparum
NTKKKKNDYLSNEKKQRKEV

SEQ ID NO: 3241648 - protein, 5 aa, Plasmodium falciparum
NTKKL

SEQ ID NO: 3241649 - protein, 10 aa, Plasmodium falciparum
NTKKNIETKD

SEQ ID NO: 3241650 - protein, 22 aa, Plasmodium falciparum
NTKKNKAQNVNNVTNNKDNDVS

SEQ ID NO: 3241651 - protein, 12 aa, Plasmodium falciparum
NTKKRKESKTYH

SEQ ID NO: 3241652 - protein, 8 aa, Plasmodium falciparum
NTKKRKQN

SEQ ID NO: 3241653 - protein, 11 aa, Plasmodium falciparum
NTKKSDHKSEL

SEQ ID NO: 3241654 - protein, 13 aa, Plasmodium falciparum
NTKKTDNLKTDDL

SEQ ID NO: 3241655 - protein, 13 aa, Plasmodium falciparum
NTKLEKTKGKDKY

SEQ ID NO: 3241656 - protein, 19 aa, Plasmodium falciparum
NTKNEKREDLESDKQKQNI

SEQ ID NO: 3241657 - protein, 7 aa, Plasmodium falciparum
NTKNRKH

SEQ ID NO: 3241658 - protein, 8 aa, Plasmodium falciparum
NTKNTEDY

SEQ ID NO: 3241659 - protein, 12 aa, Plasmodium falciparum
NTKNVSCNKEED

SEQ ID NO: 3241660 - protein, 6 aa, Plasmodium falciparum
NTKPNI

SEQ ID NO: 3241661 - protein, 10 aa, Plasmodium falciparum
NTKPSPPPTY

SEQ ID NO: 3241662 - protein, 4 aa, Plasmodium falciparum
NTKQ

SEQ ID NO: 3241663 - protein, 25 aa, Plasmodium falciparum
NTKQEDKKEDNYTKKEDKKDIENSS

SEQ ID NO: 3241664 - protein, 7 aa, Plasmodium falciparum
NTKRATI

SEQ ID NO: 3241665 - protein, 7 aa, Plasmodium falciparum
NTKRGSL

SEQ ID NO: 3241666 - protein, 13 aa, Plasmodium falciparum
NTKRTDDNTFKEK

SEQ ID NO: 3241667 - protein, 7 aa, Plasmodium falciparum
NTKSHVQ

SEQ ID NO: 3241668 - protein, 12 aa, Plasmodium falciparum
NTKSISNTNDMN

SEQ ID NO: 3241669 - protein, 6 aa, Plasmodium falciparum
NTKSKI

SEQ ID NO: 3241670 - protein, 54 aa, Plasmodium falciparum
NTKTRRKYSNTSSSIGSFSKSTTNISKASSLSSLSSLSSLSSLNEKDDDDEDRD

SEQ ID NO: 3241671 - protein, 7 aa, Plasmodium falciparum
NTKTTHD

SEQ ID NO: 3241672 - protein, 7 aa, Plasmodium falciparum
NTKYKKS

SEQ ID NO: 3241673 - protein, 10 aa, Plasmodium falciparum
NTLDGDTQSY

SEQ ID NO: 3241674 - protein, 13 aa, Plasmodium falciparum
NTLDHNENKNNNI

SEQ ID NO: 3241675 - protein, 6 aa, Plasmodium falciparum
NTLDNN

SEQ ID NO: 3241676 - protein, 5 aa, Plasmodium falciparum
NTLHE

SEQ ID NO: 3241677 - protein, 13 aa, Plasmodium falciparum
NTLKNDKKKKTNI

SEQ ID NO: 3241678 - protein, 5 aa, Plasmodium falciparum
NTLKS

SEQ ID NO: 3241679 - protein, 4 aa, Plasmodium falciparum
NTLN

SEQ ID NO: 3241680 - protein, 6 aa, Plasmodium falciparum
NTLNEG

SEQ ID NO: 3241681 - protein, 23 aa, Plasmodium falciparum
NTLNNDKDEIKQTEIDTFQDIEC

SEQ ID NO: 3241682 - protein, 6 aa, Plasmodium falciparum
NTLPKE

SEQ ID NO: 3241683 - protein, 5 aa, Plasmodium falciparum
NTLPN

SEQ ID NO: 3241684 - protein, 4 aa, Plasmodium falciparum
NTLQ

SEQ ID NO: 3241685 - protein, 6 aa, Plasmodium falciparum
NTLQEQ

SEQ ID NO: 3241686 - protein, 34 aa, Plasmodium falciparum
NTLQNESPKKDDELRENDLKTTTENIKSNEVEDK

SEQ ID NO: 3241687 - protein, 4 aa, Plasmodium falciparum
NTLS

SEQ ID NO: 3241688 - protein, 7 aa, Plasmodium falciparum
NTLSKGV

SEQ ID NO: 3241689 - protein, 6 aa, Plasmodium falciparum
NTLTEK

SEQ ID NO: 3241690 - protein, 8 aa, Plasmodium falciparum
NTMAPKNV

SEQ ID NO: 3241691 - protein, 13 aa, Plasmodium falciparum
NTMDDNSLNSSSY

SEQ ID NO: 3241692 - protein, 8 aa, Plasmodium falciparum
NTMDDPKY

SEQ ID NO: 3241693 - protein, 7 aa, Plasmodium falciparum
NTNAQKN

SEQ ID NO: 3241694 - protein, 7 aa, Plasmodium falciparum
NTNAQND

SEQ ID NO: 3241695 - protein, 16 aa, Plasmodium falciparum
NTNAYNNNNNYGNNNN

SEQ ID NO: 3241696 - protein, 10 aa, Plasmodium falciparum
NTNDDENQKK

SEQ ID NO: 3241697 - protein, 5 aa, Plasmodium falciparum
NTNDI

SEQ ID NO: 3241698 - protein, 6 aa, Plasmodium falciparum
NTNDNK

SEQ ID NO: 3241699 - protein, 5 aa, Plasmodium falciparum
NTNDT

SEQ ID NO: 3241700 - protein, 13 aa, Plasmodium falciparum
NTNEEKDKKNEGK

SEQ ID NO: 3241701 - protein, 5 aa, Plasmodium falciparum
NTNEI

SEQ ID NO: 3241702 - protein, 12 aa, Plasmodium falciparum
NTNEKANDTIYN

SEQ ID NO: 3241703 - protein, 8 aa, Plasmodium falciparum
NTNEKKSI

SEQ ID NO: 3241704 - protein, 14 aa, Plasmodium falciparum
NTNEKNNINNPYTK

SEQ ID NO: 3241705 - protein, 74 aa, Plasmodium falciparum
NTNEKSVNNNNNNNNKNKNNVSNNKNKNNVSNNKNKNNVSNNKNKNNVSNNKNKNNVNNNNNKNNVNNNNNNNM

SEQ ID NO: 3241706 - protein, 6 aa, Plasmodium falciparum
NTNENI

SEQ ID NO: 3241707 - protein, 7 aa, Plasmodium falciparum
NTNEQDP

SEQ ID NO: 3241708 - protein, 7 aa, Plasmodium falciparum
NTNEQNV

SEQ ID NO: 3241709 - protein, 15 aa, Plasmodium falciparum
NTNERYKQKNSIQKN

SEQ ID NO: 3241710 - protein, 7 aa, Plasmodium falciparum
NTNEYDE

SEQ ID NO: 3241711 - protein, 5 aa, Plasmodium falciparum
NTNGK

SEQ ID NO: 3241712 - protein, 16 aa, Plasmodium falciparum
NTNGNNKKKNNNHNDN

SEQ ID NO: 3241713 - protein, 11 aa, Plasmodium falciparum
NTNHLENKKNV

SEQ ID NO: 3241714 - protein, 4 aa, Plasmodium falciparum
NTNI

SEQ ID NO: 3241715 - protein, 7 aa, Plasmodium falciparum
NTNIGKK

SEQ ID NO: 3241716 - protein, 17 aa, Plasmodium falciparum
NTNIKSENGGNLSTSNI

SEQ ID NO: 3241717 - protein, 7 aa, Plasmodium falciparum
NTNIRKN

SEQ ID NO: 3241718 - protein, 5 aa, Plasmodium falciparum
NTNIS

SEQ ID NO: 3241719 - protein, 13 aa, Plasmodium falciparum
NTNISSYSTYNNM

SEQ ID NO: 3241720 - protein, 7 aa, Plasmodium falciparum
NTNITRN

SEQ ID NO: 3241721 - protein, 8 aa, Plasmodium falciparum
NTNKDSYK

SEQ ID NO: 3241722 - protein, 6 aa, Plasmodium falciparum
NTNKNT

SEQ ID NO: 3241723 - protein, 10 aa, Plasmodium falciparum
NTNKTQNEWK

SEQ ID NO: 3241724 - protein, 5 aa, Plasmodium falciparum
NTNKV

SEQ ID NO: 3241725 - protein, 5 aa, Plasmodium falciparum
NTNKY

SEQ ID NO: 3241726 - protein, 6 aa, Plasmodium falciparum
NTNKYC

SEQ ID NO: 3241727 - protein, 4 aa, Plasmodium falciparum
NTNM

SEQ ID NO: 3241728 - protein, 7 aa, Plasmodium falciparum
NTNNDEL

SEQ ID NO: 3241729 - protein, 32 aa, Plasmodium falciparum
NTNNDHQSYEKSNESSFSNDTDNEEEKKTDSI

SEQ ID NO: 3241730 - protein, 23 aa, Plasmodium falciparum
NTNNDKNYCKHEEDKKKLNMNKD

SEQ ID NO: 3241731 - protein, 7 aa, Plasmodium falciparum
NTNNDQK

SEQ ID NO: 3241732 - protein, 26 aa, Plasmodium falciparum
NTNNEDKKQQENEENEYNNKNNLHSK

SEQ ID NO: 3241733 - protein, 7 aa, Plasmodium falciparum
NTNNEMS

SEQ ID NO: 3241734 - protein, 5 aa, Plasmodium falciparum
NTNNK

SEQ ID NO: 3241735 - protein, 51 aa, Plasmodium falciparum
NTNNKFDYNNDDNNNNDENNDNNNNNNNNNNNDNNNNNYINEQNKEEITKN

SEQ ID NO: 3241736 - protein, 5 aa, Plasmodium falciparum
NTNNL

SEQ ID NO: 3241737 - protein, 22 aa, Plasmodium falciparum
NTNNNDNNNNNNNINNNNVGNL

SEQ ID NO: 3241738 - protein, 10 aa, Plasmodium falciparum
NTNNNDTPCS

SEQ ID NO: 3241739 - protein, 6 aa, Plasmodium falciparum
NTNNNI

SEQ ID NO: 3241740 - protein, 17 aa, Plasmodium falciparum
NTNNNNNNNNNNDNDNN

SEQ ID NO: 3241741 - protein, 29 aa, Plasmodium falciparum
NTNNNNNNNNNNNNNNNNNNNNNNNNNNN

SEQ ID NO: 3241742 - protein, 61 aa, Plasmodium falciparum
NTNNNNNTSDINNNNTSDINNNNTNNINNNNTNNINNNNTNNINNNTNNTNNNSNNNNNNN

SEQ ID NO: 3241743 - protein, 11 aa, Plasmodium falciparum
NTNNNQKNNHN

SEQ ID NO: 3241744 - protein, 11 aa, Plasmodium falciparum
NTNNQNIYETN

SEQ ID NO: 3241745 - protein, 10 aa, Plasmodium falciparum
NTNNSDESKT

SEQ ID NO: 3241746 - protein, 6 aa, Plasmodium falciparum
NTNNSL

SEQ ID NO: 3241747 - protein, 10 aa, Plasmodium falciparum
NTNNSMGTNM

SEQ ID NO: 3241748 - protein, 7 aa, Plasmodium falciparum
NTNNSNT

SEQ ID NO: 3241749 - protein, 9 aa, Plasmodium falciparum
NTNNTNISL

SEQ ID NO: 3241750 - protein, 11 aa, Plasmodium falciparum
NTNNTSNECNE

SEQ ID NO: 3241751 - protein, 9 aa, Plasmodium falciparum
NTNQETKPL

SEQ ID NO: 3241752 - protein, 9 aa, Plasmodium falciparum
NTNQPSSTI

SEQ ID NO: 3241753 - protein, 8 aa, Plasmodium falciparum
NTNQQNNI

SEQ ID NO: 3241754 - protein, 5 aa, Plasmodium falciparum
NTNRA

SEQ ID NO: 3241755 - protein, 7 aa, Plasmodium falciparum
NTNRDKI

SEQ ID NO: 3241756 - protein, 25 aa, Plasmodium falciparum
NTNRGSINNDSYYRKNNRKYEDSVN

SEQ ID NO: 3241757 - protein, 10 aa, Plasmodium falciparum
NTNSINKKNE

SEQ ID NO: 3241758 - protein, 9 aa, Plasmodium falciparum
NTNSISNNK

SEQ ID NO: 3241759 - protein, 19 aa, Plasmodium falciparum
NTNSKKLLNKDEKCSESTL

SEQ ID NO: 3241760 - protein, 5 aa, Plasmodium falciparum
NTNSL

SEQ ID NO: 3241761 - protein, 18 aa, Plasmodium falciparum
NTNSTENNDYNNDNNDFD

SEQ ID NO: 3241762 - protein, 9 aa, Plasmodium falciparum
NTNTDDTDD

SEQ ID NO: 3241763 - protein, 17 aa, Plasmodium falciparum
NTNTDKKKSQSTQDNLN

SEQ ID NO: 3241764 - protein, 8 aa, Plasmodium falciparum
NTNTMNGS

SEQ ID NO: 3241765 - protein, 5 aa, Plasmodium falciparum
NTNTN

SEQ ID NO: 3241766 - protein, 17 aa, Plasmodium falciparum
NTNTNINTNTNTNINTN

SEQ ID NO: 3241767 - protein, 4 aa, Plasmodium falciparum
NTNV

SEQ ID NO: 3241768 - protein, 6 aa, Plasmodium falciparum
NTNVKG

SEQ ID NO: 3241769 - protein, 9 aa, Plasmodium falciparum
NTNVNNNSD

SEQ ID NO: 3241770 - protein, 9 aa, Plasmodium falciparum
NTNVPQNKM

SEQ ID NO: 3241771 - protein, 5 aa, Plasmodium falciparum
NTNVQ

SEQ ID NO: 3241772 - protein, 5 aa, Plasmodium falciparum
NTNVS

SEQ ID NO: 3241773 - protein, 6 aa, Plasmodium falciparum
NTNVSE

SEQ ID NO: 3241774 - protein, 5 aa, Plasmodium falciparum
NTNYN

SEQ ID NO: 3241775 - protein, 17 aa, Plasmodium falciparum
NTNYNDDDDNNDDNMKN

SEQ ID NO: 3241776 - protein, 11 aa, Plasmodium falciparum
NTNYTNSSTEK

SEQ ID NO: 3241777 - protein, 17 aa, Plasmodium falciparum
NTPDGEKSPIDTEESAV

SEQ ID NO: 3241778 - protein, 11 aa, Plasmodium falciparum
NTPDINEPENI

SEQ ID NO: 3241779 - protein, 5 aa, Plasmodium falciparum
NTPDK

SEQ ID NO: 3241780 - protein, 4 aa, Plasmodium falciparum
NTPF

SEQ ID NO: 3241781 - protein, 30 aa, Plasmodium falciparum
NTPGSQKKKTTSENNKELEKETNKTQYEKY

SEQ ID NO: 3241782 - protein, 4 aa, Plasmodium falciparum
NTPI

SEQ ID NO: 3241783 - protein, 24 aa, Plasmodium falciparum
NTPIESTSQNNSTHETYSSDERKN

SEQ ID NO: 3241784 - protein, 6 aa, Plasmodium falciparum
NTPKDK

SEQ ID NO: 3241785 - protein, 8 aa, Plasmodium falciparum
NTPKETSK

SEQ ID NO: 3241786 - protein, 5 aa, Plasmodium falciparum
NTPKQ

SEQ ID NO: 3241787 - protein, 8 aa, Plasmodium falciparum
NTPNHKKK

SEQ ID NO: 3241788 - protein, 6 aa, Plasmodium falciparum
NTPNLQ

SEQ ID NO: 3241789 - protein, 36 aa, Plasmodium falciparum
NTPRDSDIASSLPSEKEKKFNEEKSVHKENASEGEN

SEQ ID NO: 3241790 - protein, 16 aa, Plasmodium falciparum
NTPSGIDTNDKENMQK

SEQ ID NO: 3241791 - protein, 33 aa, Plasmodium falciparum
NTPSNSFEKKRKRKLDQSVENTKNDMNSNPSDL

SEQ ID NO: 3241792 - protein, 6 aa, Plasmodium falciparum
NTPTCN

SEQ ID NO: 3241793 - protein, 6 aa, Plasmodium falciparum
NTPTDD

SEQ ID NO: 3241794 - protein, 6 aa, Plasmodium falciparum
NTPTST

SEQ ID NO: 3241795 - protein, 4 aa, Plasmodium falciparum
NTPV

SEQ ID NO: 3241796 - protein, 8 aa, Plasmodium falciparum
NTQAENNS

SEQ ID NO: 3241797 - protein, 10 aa, Plasmodium falciparum
NTQDTKNGYE

SEQ ID NO: 3241798 - protein, 10 aa, Plasmodium falciparum
NTQEINKNPI

SEQ ID NO: 3241799 - protein, 7 aa, Plasmodium falciparum
NTQEKND

SEQ ID NO: 3241800 - protein, 4 aa, Plasmodium falciparum
NTQI

SEQ ID NO: 3241801 - protein, 4 aa, Plasmodium falciparum
NTQN

SEQ ID NO: 3241802 - protein, 5 aa, Plasmodium falciparum
NTQQN

SEQ ID NO: 3241803 - protein, 17 aa, Plasmodium falciparum
NTQQPKINYPPHGNNNF

SEQ ID NO: 3241804 - protein, 21 aa, Plasmodium falciparum
NTQQQKQYQEVDENHKGEGLQ

SEQ ID NO: 3241805 - protein, 9 aa, Plasmodium falciparum
NTQSISTKS
